United States Patent 7,250,289 (METHODS OF GENETIC ANALYSIS OF MOUSE) - sequence listing, part 24

SEQ ID NO: 923499 - DNA, 25 bp, Mus musculus
ttaggccatagtcacctgggtctta

SEQ ID NO: 923500 - DNA, 25 bp, Mus musculus
ttaggccatagtgacctgggtctta

SEQ ID NO: 923501 - DNA, 25 bp, Mus musculus
ttaggccatgagcaggcaaactctg

SEQ ID NO: 923502 - DNA, 25 bp, Mus musculus
ttaggccatgaggaggcaaactctg

SEQ ID NO: 923503 - DNA, 25 bp, Mus musculus
ttaggccatggcaagtcgaatctga

SEQ ID NO: 923504 - DNA, 25 bp, Mus musculus
ttaggccatggctagtcgaatctga

SEQ ID NO: 923505 - DNA, 25 bp, Mus musculus
ttaggcccacagctttatagcagga

SEQ ID NO: 923506 - DNA, 25 bp, Mus musculus
ttaggcccacaggtttatagcagga

SEQ ID NO: 923507 - DNA, 25 bp, Mus musculus
ttaggcccagtcagttccctgtaga

SEQ ID NO: 923508 - DNA, 25 bp, Mus musculus
ttaggcccagtctgttccctgtaga

SEQ ID NO: 923509 - DNA, 25 bp, Mus musculus
ttaggcccattacacccaactggtt

SEQ ID NO: 923510 - DNA, 25 bp, Mus musculus
ttaggcccattagacccaactggtt

SEQ ID NO: 923511 - DNA, 25 bp, Mus musculus
ttaggcccctgcacagtcgagggag

SEQ ID NO: 923512 - DNA, 25 bp, Mus musculus
ttaggcccctgctcagtcgagggag

SEQ ID NO: 923513 - DNA, 25 bp, Mus musculus
ttaggcccggatatgaactcttgac

SEQ ID NO: 923514 - DNA, 25 bp, Mus musculus
ttaggcccggatttgaactcttgac

SEQ ID NO: 923515 - DNA, 25 bp, Mus musculus
ttaggcccggctcatattttcactt

SEQ ID NO: 923516 - DNA, 25 bp, Mus musculus
ttaggcccggctgatattttcactt

SEQ ID NO: 923517 - DNA, 25 bp, Mus musculus
ttaggccctgaaatcaaaatgtttg

SEQ ID NO: 923518 - DNA, 25 bp, Mus musculus
ttaggccctgaattcaaaatgtttg

SEQ ID NO: 923519 - DNA, 25 bp, Mus musculus
ttaggcccttcccttgtgtgctctg

SEQ ID NO: 923520 - DNA, 25 bp, Mus musculus
ttaggcccttccgttgtgtgctctg

SEQ ID NO: 923521 - DNA, 25 bp, Mus musculus
ttaggccctttcactttgcatgata

SEQ ID NO: 923522 - DNA, 25 bp, Mus musculus
ttaggccctttctctttgcatgata

SEQ ID NO: 923523 - DNA, 25 bp, Mus musculus
ttaggccgaggcctccagcaaaggt

SEQ ID NO: 923524 - DNA, 25 bp, Mus musculus
ttaggccgaggcgtccagcaaaggt

SEQ ID NO: 923525 - DNA, 25 bp, Mus musculus
ttaggccgcagcactgccagcatag

SEQ ID NO: 923526 - DNA, 25 bp, Mus musculus
ttaggccgcagctctgccagcatag

SEQ ID NO: 923527 - DNA, 25 bp, Mus musculus
ttaggccggagtcacagctgagcta

SEQ ID NO: 923528 - DNA, 25 bp, Mus musculus
ttaggccggagtgacagctgagcta

SEQ ID NO: 923529 - DNA, 25 bp, Mus musculus
ttaggccgggcaagattcagtcctg

SEQ ID NO: 923530 - DNA, 25 bp, Mus musculus
ttaggccgggcatgattcagtcctg

SEQ ID NO: 923531 - DNA, 25 bp, Mus musculus
ttaggccggtgcagtccctcggtaa

SEQ ID NO: 923532 - DNA, 25 bp, Mus musculus
ttaggccggtgctgtccctcggtaa

SEQ ID NO: 923533 - DNA, 25 bp, Mus musculus
ttaggcctacatccaatacactcca

SEQ ID NO: 923534 - DNA, 25 bp, Mus musculus
ttaggcctacatgcaatacactcca

SEQ ID NO: 923535 - DNA, 25 bp, Mus musculus
ttaggcctatacagcaatccacatg

SEQ ID NO: 923536 - DNA, 25 bp, Mus musculus
ttaggcctatactgcaatccacatg

SEQ ID NO: 923537 - DNA, 25 bp, Mus musculus
ttaggcctcacactcattaccgcat

SEQ ID NO: 923538 - DNA, 25 bp, Mus musculus
ttaggcctcacagtcattaccgcat

SEQ ID NO: 923539 - DNA, 25 bp, Mus musculus
ttaggcctccatataagcccatggg

SEQ ID NO: 923540 - DNA, 25 bp, Mus musculus
ttaggcctccatttaagcccatggg

SEQ ID NO: 923541 - DNA, 25 bp, Mus musculus
ttaggcctcctgaaggttcaacatg

SEQ ID NO: 923542 - DNA, 25 bp, Mus musculus
ttaggcctcctgtaggttcaacatg

SEQ ID NO: 923543 - DNA, 25 bp, Mus musculus
ttaggcctcgctcctgaaagcaccg

SEQ ID NO: 923544 - DNA, 25 bp, Mus musculus
ttaggcctcgctgctgaaagcaccg

SEQ ID NO: 923545 - DNA, 25 bp, Mus musculus
ttaggcctctaactactctagtaac

SEQ ID NO: 923546 - DNA, 25 bp, Mus musculus
ttaggcctctaagtactctagtaac

SEQ ID NO: 923547 - DNA, 25 bp, Mus musculus
ttaggcctctgcattcttgtaggat

SEQ ID NO: 923548 - DNA, 25 bp, Mus musculus
ttaggcctctgctttcttgtaggat

SEQ ID NO: 923549 - DNA, 25 bp, Mus musculus
ttaggcctctttacagttgctggac

SEQ ID NO: 923550 - DNA, 25 bp, Mus musculus
ttaggcctcttttcagttgctggac

SEQ ID NO: 923551 - DNA, 25 bp, Mus musculus
ttaggcctggcaatggcggcgcaca

SEQ ID NO: 923552 - DNA, 25 bp, Mus musculus
ttaggcctggcattggcggcgcaca

SEQ ID NO: 923553 - DNA, 25 bp, Mus musculus
ttaggcctgggtcgtccgcttaaag

SEQ ID NO: 923554 - DNA, 25 bp, Mus musculus
ttaggcctgggtggtccgcttaaag

SEQ ID NO: 923555 - DNA, 25 bp, Mus musculus
ttaggcctggttattctggttattt

SEQ ID NO: 923556 - DNA, 25 bp, Mus musculus
ttaggcctggtttttctggttattt

SEQ ID NO: 923557 - DNA, 25 bp, Mus musculus
ttaggcctgttcacccttacctatt

SEQ ID NO: 923558 - DNA, 25 bp, Mus musculus
ttaggcctgttctcccttacctatt

SEQ ID NO: 923559 - DNA, 25 bp, Mus musculus
ttaggccttgcacgccatggcagga

SEQ ID NO: 923560 - DNA, 25 bp, Mus musculus
ttaggccttgcaggccatggcagga

SEQ ID NO: 923561 - DNA, 25 bp, Mus musculus
ttaggccttgtgacagtggaactct

SEQ ID NO: 923562 - DNA, 25 bp, Mus musculus
ttaggccttgtgtcagtggaactct

SEQ ID NO: 923563 - DNA, 25 bp, Mus musculus
ttaggccttgttatactgtagtatg

SEQ ID NO: 923564 - DNA, 25 bp, Mus musculus
ttaggccttgttttactgtagtatg

SEQ ID NO: 923565 - DNA, 25 bp, Mus musculus
ttaggcgaagatcttagcagtttct

SEQ ID NO: 923566 - DNA, 25 bp, Mus musculus
ttaggcgaagatgttagcagtttct

SEQ ID NO: 923567 - DNA, 25 bp, Mus musculus
ttaggcgatcctattgggagatgag

SEQ ID NO: 923568 - DNA, 25 bp, Mus musculus
ttaggcgatccttttgggagatgag

SEQ ID NO: 923569 - DNA, 25 bp, Mus musculus
ttaggcgcgcttccattttccccag

SEQ ID NO: 923570 - DNA, 25 bp, Mus musculus
ttaggcgcgcttgcattttccccag

SEQ ID NO: 923571 - DNA, 25 bp, Mus musculus
ttaggcggagtcacctgctgtgctg

SEQ ID NO: 923572 - DNA, 25 bp, Mus musculus
ttaggcggagtctcctgctgtgctg

SEQ ID NO: 923573 - DNA, 25 bp, Mus musculus
ttaggcggcgagacccttcatttgg

SEQ ID NO: 923574 - DNA, 25 bp, Mus musculus
ttaggcggcgagtcccttcatttgg

SEQ ID NO: 923575 - DNA, 25 bp, Mus musculus
ttaggcgtaactattgcccctcaga

SEQ ID NO: 923576 - DNA, 25 bp, Mus musculus
ttaggcgtaacttttgcccctcaga

SEQ ID NO: 923577 - DNA, 25 bp, Mus musculus
ttaggcgtttacactgtgaacagac

SEQ ID NO: 923578 - DNA, 25 bp, Mus musculus
ttaggcgtttactctgtgaacagac

SEQ ID NO: 923579 - DNA, 25 bp, Mus musculus
ttaggctacaaccggcgggtgcacc

SEQ ID NO: 923580 - DNA, 25 bp, Mus musculus
ttaggctacaacgggcgggtgcacc

SEQ ID NO: 923581 - DNA, 25 bp, Mus musculus
ttaggctacctaaccccttaatatc

SEQ ID NO: 923582 - DNA, 25 bp, Mus musculus
ttaggctacctatccccttaatatc

SEQ ID NO: 923583 - DNA, 25 bp, Mus musculus
ttaggctactagatgctggagaact

SEQ ID NO: 923584 - DNA, 25 bp, Mus musculus
ttaggctactagttgctggagaact

SEQ ID NO: 923585 - DNA, 25 bp, Mus musculus
ttaggctagcctaatctcgtcttta

SEQ ID NO: 923586 - DNA, 25 bp, Mus musculus
ttaggctagccttatctcgtcttta

SEQ ID NO: 923587 - DNA, 25 bp, Mus musculus
ttaggctaggacctgagaatccaca

SEQ ID NO: 923588 - DNA, 25 bp, Mus musculus
ttaggctaggacgtgagaatccaca

SEQ ID NO: 923589 - DNA, 25 bp, Mus musculus
ttaggctcaagcagataacgtttct

SEQ ID NO: 923590 - DNA, 25 bp, Mus musculus
ttaggctcaagctgataacgtttct

SEQ ID NO: 923591 - DNA, 25 bp, Mus musculus
ttaggctccaacctaactgcaattt

SEQ ID NO: 923592 - DNA, 25 bp, Mus musculus
ttaggctccaacgtaactgcaattt

SEQ ID NO: 923593 - DNA, 25 bp, Mus musculus
ttaggctcgtggatcaggagctcct

SEQ ID NO: 923594 - DNA, 25 bp, Mus musculus
ttaggctcgtggttcaggagctcct

SEQ ID NO: 923595 - DNA, 25 bp, Mus musculus
ttaggctctacacacactttattct

SEQ ID NO: 923596 - DNA, 25 bp, Mus musculus
ttaggctctacagacactttattct

SEQ ID NO: 923597 - DNA, 25 bp, Mus musculus
ttaggctctgcaccgagaatggcga

SEQ ID NO: 923598 - DNA, 25 bp, Mus musculus
ttaggctctgcagcgagaatggcga

SEQ ID NO: 923599 - DNA, 25 bp, Mus musculus
ttaggctctggccttggatccaagc

SEQ ID NO: 923600 - DNA, 25 bp, Mus musculus
ttaggctctggcgttggatccaagc

SEQ ID NO: 923601 - DNA, 25 bp, Mus musculus
ttaggctcttccatctggttcattt

SEQ ID NO: 923602 - DNA, 25 bp, Mus musculus
ttaggctcttccttctggttcattt

SEQ ID NO: 923603 - DNA, 25 bp, Mus musculus
ttaggctgagcacacaggttctgcc

SEQ ID NO: 923604 - DNA, 25 bp, Mus musculus
ttaggctgagcagacaggttctgcc

SEQ ID NO: 923605 - DNA, 25 bp, Mus musculus
ttaggctgccagatctagctttgcc

SEQ ID NO: 923606 - DNA, 25 bp, Mus musculus
ttaggctgccagttctagctttgcc

SEQ ID NO: 923607 - DNA, 25 bp, Mus musculus
ttaggctgtatcatcttttgcaact

SEQ ID NO: 923608 - DNA, 25 bp, Mus musculus
ttaggctgtatcttcttttgcaact

SEQ ID NO: 923609 - DNA, 25 bp, Mus musculus
ttaggctgtctaattcttcccaagt

SEQ ID NO: 923610 - DNA, 25 bp, Mus musculus
ttaggctgtctatttcttcccaagt

SEQ ID NO: 923611 - DNA, 25 bp, Mus musculus
ttaggctgtgggagatcccattcct

SEQ ID NO: 923612 - DNA, 25 bp, Mus musculus
ttaggctgtgggtgatcccattcct

SEQ ID NO: 923613 - DNA, 25 bp, Mus musculus
ttaggcttaactaactggcctcaaa

SEQ ID NO: 923614 - DNA, 25 bp, Mus musculus
ttaggcttaacttactggcctcaaa

SEQ ID NO: 923615 - DNA, 25 bp, Mus musculus
ttaggcttagttctcagtctcctcc

SEQ ID NO: 923616 - DNA, 25 bp, Mus musculus
ttaggcttagttgtcagtctcctcc

SEQ ID NO: 923617 - DNA, 25 bp, Mus musculus
ttaggcttcaggagggagggaggtc

SEQ ID NO: 923618 - DNA, 25 bp, Mus musculus
ttaggcttcaggtgggagggaggtc

SEQ ID NO: 923619 - DNA, 25 bp, Mus musculus
ttaggcttcagtatccatggaggat

SEQ ID NO: 923620 - DNA, 25 bp, Mus musculus
ttaggcttcagtttccatggaggat

SEQ ID NO: 923621 - DNA, 25 bp, Mus musculus
ttaggcttggtcagctggattacac

SEQ ID NO: 923622 - DNA, 25 bp, Mus musculus
ttaggcttggtctgctggattacac

SEQ ID NO: 923623 - DNA, 25 bp, Mus musculus
ttaggcttgtatatggtagtccgtc

SEQ ID NO: 923624 - DNA, 25 bp, Mus musculus
ttaggcttgtatttggtagtccgtc

SEQ ID NO: 923625 - DNA, 25 bp, Mus musculus
ttaggcttgtgcattgggtaatcat

SEQ ID NO: 923626 - DNA, 25 bp, Mus musculus
ttaggcttgtgctttgggtaatcat

SEQ ID NO: 923627 - DNA, 25 bp, Mus musculus
ttaggcttgtttaggtttgcgaaat

SEQ ID NO: 923628 - DNA, 25 bp, Mus musculus
ttaggcttgttttggtttgcgaaat

SEQ ID NO: 923629 - DNA, 25 bp, Mus musculus
ttaggctttagccactgcttcctag

SEQ ID NO: 923630 - DNA, 25 bp, Mus musculus
ttaggctttagcgactgcttcctag

SEQ ID NO: 923631 - DNA, 25 bp, Mus musculus
ttaggctttcaacatgctgcaatcc

SEQ ID NO: 923632 - DNA, 25 bp, Mus musculus
ttaggctttcaagatgctgcaatcc

SEQ ID NO: 923633 - DNA, 25 bp, Mus musculus
ttagggaaacacatccttcctctga

SEQ ID NO: 923634 - DNA, 25 bp, Mus musculus
ttagggaaacacttccttcctctga

SEQ ID NO: 923635 - DNA, 25 bp, Mus musculus
ttagggaaatgaccagcctgtttaa

SEQ ID NO: 923636 - DNA, 25 bp, Mus musculus
ttagggaaatgagcagcctgtttaa

SEQ ID NO: 923637 - DNA, 25 bp, Mus musculus
ttagggaaatggctacagtacgtgg

SEQ ID NO: 923638 - DNA, 25 bp, Mus musculus
ttagggaaatgggtacagtacgtgg

SEQ ID NO: 923639 - DNA, 25 bp, Mus musculus
ttagggaacttcctgcatcctgggc

SEQ ID NO: 923640 - DNA, 25 bp, Mus musculus
ttagggaacttcgtgcatcctgggc

SEQ ID NO: 923641 - DNA, 25 bp, Mus musculus
ttagggaatcagaatccctccttgg

SEQ ID NO: 923642 - DNA, 25 bp, Mus musculus
ttagggaatcagtatccctccttgg

SEQ ID NO: 923643 - DNA, 25 bp, Mus musculus
ttagggaatcctcaaccacggccac

SEQ ID NO: 923644 - DNA, 25 bp, Mus musculus
ttagggaatcctgaaccacggccac

SEQ ID NO: 923645 - DNA, 25 bp, Mus musculus
ttagggaatgttcaatgaatcttac

SEQ ID NO: 923646 - DNA, 25 bp, Mus musculus
ttagggaatgttgaatgaatcttac

SEQ ID NO: 923647 - DNA, 25 bp, Mus musculus
ttagggacaacccttggctcacatc

SEQ ID NO: 923648 - DNA, 25 bp, Mus musculus
ttagggacaaccgttggctcacatc

SEQ ID NO: 923649 - DNA, 25 bp, Mus musculus
ttagggacatgcatccagtgccgct

SEQ ID NO: 923650 - DNA, 25 bp, Mus musculus
ttagggacatgcttccagtgccgct

SEQ ID NO: 923651 - DNA, 25 bp, Mus musculus
ttagggacatttatctgggccttag

SEQ ID NO: 923652 - DNA, 25 bp, Mus musculus
ttagggacatttttctgggccttag

SEQ ID NO: 923653 - DNA, 25 bp, Mus musculus
ttagggaccccactaattcctcact

SEQ ID NO: 923654 - DNA, 25 bp, Mus musculus
ttagggaccccagtaattcctcact

SEQ ID NO: 923655 - DNA, 25 bp, Mus musculus
ttagggactgacaagcacactgttt

SEQ ID NO: 923656 - DNA, 25 bp, Mus musculus
ttagggactgactagcacactgttt

SEQ ID NO: 923657 - DNA, 25 bp, Mus musculus
ttagggactgggatatccctctcac

SEQ ID NO: 923658 - DNA, 25 bp, Mus musculus
ttagggactgggttatccctctcac

SEQ ID NO: 923659 - DNA, 25 bp, Mus musculus
ttagggagagagctcagctaccact

SEQ ID NO: 923660 - DNA, 25 bp, Mus musculus
ttagggagagaggtcagctaccact

SEQ ID NO: 923661 - DNA, 25 bp, Mus musculus
ttagggagatgcagcttggacttga

SEQ ID NO: 923662 - DNA, 25 bp, Mus musculus
ttagggagatgctgcttggacttga

SEQ ID NO: 923663 - DNA, 25 bp, Mus musculus
ttagggagcttcaactgtattaggt

SEQ ID NO: 923664 - DNA, 25 bp, Mus musculus
ttagggagcttctactgtattaggt

SEQ ID NO: 923665 - DNA, 25 bp, Mus musculus
ttagggaggaccattgcagtcggcc

SEQ ID NO: 923666 - DNA, 25 bp, Mus musculus
ttagggaggacctttgcagtcggcc

SEQ ID NO: 923667 - DNA, 25 bp, Mus musculus
ttagggaggctccatgcttccccat

SEQ ID NO: 923668 - DNA, 25 bp, Mus musculus
ttagggaggctcgatgcttccccat

SEQ ID NO: 923669 - DNA, 25 bp, Mus musculus
ttagggagtctcaaaaaccgcttca

SEQ ID NO: 923670 - DNA, 25 bp, Mus musculus
ttagggagtctctaaaaccgcttca

SEQ ID NO: 923671 - DNA, 25 bp, Mus musculus
ttagggagttcccagactgctactc

SEQ ID NO: 923672 - DNA, 25 bp, Mus musculus
ttagggagttccgagactgctactc

SEQ ID NO: 923673 - DNA, 25 bp, Mus musculus
ttagggatcactccgaagtttcgtt

SEQ ID NO: 923674 - DNA, 25 bp, Mus musculus
ttagggatcactgcgaagtttcgtt

SEQ ID NO: 923675 - DNA, 25 bp, Mus musculus
ttagggatcatgacttcttgtttca

SEQ ID NO: 923676 - DNA, 25 bp, Mus musculus
ttagggatcatgtcttcttgtttca

SEQ ID NO: 923677 - DNA, 25 bp, Mus musculus
ttagggatcctaagtgtccttgtcc

SEQ ID NO: 923678 - DNA, 25 bp, Mus musculus
ttagggatcctatgtgtccttgtcc

SEQ ID NO: 923679 - DNA, 25 bp, Mus musculus
ttagggatctccattttctctctac

SEQ ID NO: 923680 - DNA, 25 bp, Mus musculus
ttagggatctcctttttctctctac

SEQ ID NO: 923681 - DNA, 25 bp, Mus musculus
ttagggatgcagaacacgtgaaagt

SEQ ID NO: 923682 - DNA, 25 bp, Mus musculus
ttagggatgcagtacacgtgaaagt

SEQ ID NO: 923683 - DNA, 25 bp, Mus musculus
ttagggatggagaactggatacaat

SEQ ID NO: 923684 - DNA, 25 bp, Mus musculus
ttagggatggagtactggatacaat

SEQ ID NO: 923685 - DNA, 25 bp, Mus musculus
ttagggatggatcggcacaaaagca

SEQ ID NO: 923686 - DNA, 25 bp, Mus musculus
ttagggatggatgggcacaaaagca

SEQ ID NO: 923687 - DNA, 25 bp, Mus musculus
ttagggattctcattttggctgcca

SEQ ID NO: 923688 - DNA, 25 bp, Mus musculus
ttagggattctctttttggctgcca

SEQ ID NO: 923689 - DNA, 25 bp, Mus musculus
ttagggattggcatggtttcacgaa

SEQ ID NO: 923690 - DNA, 25 bp, Mus musculus
ttagggattggcttggtttcacgaa

SEQ ID NO: 923691 - DNA, 25 bp, Mus musculus
ttagggcaaacccattgcctgtgtt

SEQ ID NO: 923692 - DNA, 25 bp, Mus musculus
ttagggcaaaccgattgcctgtgtt

SEQ ID NO: 923693 - DNA, 25 bp, Mus musculus
ttagggcaacagcacaagggctatt

SEQ ID NO: 923694 - DNA, 25 bp, Mus musculus
ttagggcaacaggacaagggctatt

SEQ ID NO: 923695 - DNA, 25 bp, Mus musculus
ttagggcaacctactaccaatctgt

SEQ ID NO: 923696 - DNA, 25 bp, Mus musculus
ttagggcaaccttctaccaatctgt

SEQ ID NO: 923697 - DNA, 25 bp, Mus musculus
ttagggcaatcaagtctcacccatt

SEQ ID NO: 923698 - DNA, 25 bp, Mus musculus
ttagggcaatcatgtctcacccatt

SEQ ID NO: 923699 - DNA, 25 bp, Mus musculus
ttagggcacaaacccaaggctgaca

SEQ ID NO: 923700 - DNA, 25 bp, Mus musculus
ttagggcacaaagccaaggctgaca

SEQ ID NO: 923701 - DNA, 25 bp, Mus musculus
ttagggcactgaccactttatctcc

SEQ ID NO: 923702 - DNA, 25 bp, Mus musculus
ttagggcactgagcactttatctcc

SEQ ID NO: 923703 - DNA, 25 bp, Mus musculus
ttagggcagaatatccaatactttc

SEQ ID NO: 923704 - DNA, 25 bp, Mus musculus
ttagggcagaatttccaatactttc

SEQ ID NO: 923705 - DNA, 25 bp, Mus musculus
ttagggcagagcagtgtgcactgtt

SEQ ID NO: 923706 - DNA, 25 bp, Mus musculus
ttagggcagagctgtgtgcactgtt

SEQ ID NO: 923707 - DNA, 25 bp, Mus musculus
ttagggcagcaacttcaacatcaag

SEQ ID NO: 923708 - DNA, 25 bp, Mus musculus
ttagggcagcaagttcaacatcaag

SEQ ID NO: 923709 - DNA, 25 bp, Mus musculus
ttagggcatctcagtgcctacgtaa

SEQ ID NO: 923710 - DNA, 25 bp, Mus musculus
ttagggcatctctgtgcctacgtaa

SEQ ID NO: 923711 - DNA, 25 bp, Mus musculus
ttagggcattcacctctgtatttgt

SEQ ID NO: 923712 - DNA, 25 bp, Mus musculus
ttagggcattcagctctgtatttgt

SEQ ID NO: 923713 - DNA, 25 bp, Mus musculus
ttagggccaccacaaaatcaacaaa

SEQ ID NO: 923714 - DNA, 25 bp, Mus musculus
ttagggccaccagaaaatcaacaaa

SEQ ID NO: 923715 - DNA, 25 bp, Mus musculus
ttagggccatacagttctttgaggg

SEQ ID NO: 923716 - DNA, 25 bp, Mus musculus
ttagggccatactgttctttgaggg

SEQ ID NO: 923717 - DNA, 25 bp, Mus musculus
ttagggccatgaaacctcaggaaca

SEQ ID NO: 923718 - DNA, 25 bp, Mus musculus
ttagggccatgatacctcaggaaca

SEQ ID NO: 923719 - DNA, 25 bp, Mus musculus
ttagggccctatcatgttctgttca

SEQ ID NO: 923720 - DNA, 25 bp, Mus musculus
ttagggccctatgatgttctgttca

SEQ ID NO: 923721 - DNA, 25 bp, Mus musculus
ttagggccctgcactttaatgggag

SEQ ID NO: 923722 - DNA, 25 bp, Mus musculus
ttagggccctgctctttaatgggag

SEQ ID NO: 923723 - DNA, 25 bp, Mus musculus
ttagggccgactatcactgttaaat

SEQ ID NO: 923724 - DNA, 25 bp, Mus musculus
ttagggccgactttcactgttaaat

SEQ ID NO: 923725 - DNA, 25 bp, Mus musculus
ttagggcctaacacagggctgtcag

SEQ ID NO: 923726 - DNA, 25 bp, Mus musculus
ttagggcctaactcagggctgtcag

SEQ ID NO: 923727 - DNA, 25 bp, Mus musculus
ttagggcctggaaatcttgtttcac

SEQ ID NO: 923728 - DNA, 25 bp, Mus musculus
ttagggcctggatatcttgtttcac

SEQ ID NO: 923729 - DNA, 25 bp, Mus musculus
ttagggccttcacatacttgccaga

SEQ ID NO: 923730 - DNA, 25 bp, Mus musculus
ttagggccttcagatacttgccaga

SEQ ID NO: 923731 - DNA, 25 bp, Mus musculus
ttagggctcatcataatgaatggcc

SEQ ID NO: 923732 - DNA, 25 bp, Mus musculus
ttagggctcatcttaatgaatggcc

SEQ ID NO: 923733 - DNA, 25 bp, Mus musculus
ttagggctcctgcatgcacatggca

SEQ ID NO: 923734 - DNA, 25 bp, Mus musculus
ttagggctcctggatgcacatggca

SEQ ID NO: 923735 - DNA, 25 bp, Mus musculus
ttagggctgcctctgtacataaaca

SEQ ID NO: 923736 - DNA, 25 bp, Mus musculus
ttagggctgcctgtgtacataaaca

SEQ ID NO: 923737 - DNA, 25 bp, Mus musculus
ttagggctgcggagctagagttcca

SEQ ID NO: 923738 - DNA, 25 bp, Mus musculus
ttagggctgcggtgctagagttcca

SEQ ID NO: 923739 - DNA, 25 bp, Mus musculus
ttagggctggagcttaccagaccat

SEQ ID NO: 923740 - DNA, 25 bp, Mus musculus
ttagggctggaggttaccagaccat

SEQ ID NO: 923741 - DNA, 25 bp, Mus musculus
ttagggcttattacattaacatttc

SEQ ID NO: 923742 - DNA, 25 bp, Mus musculus
ttagggcttatttcattaacatttc

SEQ ID NO: 923743 - DNA, 25 bp, Mus musculus
ttaggggtggacatttgtcttgcag

SEQ ID NO: 923744 - DNA, 25 bp, Mus musculus
ttaggggtggacttttgtcttgcag

SEQ ID NO: 923745 - DNA, 25 bp, Mus musculus
ttagggtagcctcatctactgagta

SEQ ID NO: 923746 - DNA, 25 bp, Mus musculus
ttagggtagcctgatctactgagta

SEQ ID NO: 923747 - DNA, 25 bp, Mus musculus
ttagggtatgcacctccttttgtag

SEQ ID NO: 923748 - DNA, 25 bp, Mus musculus
ttagggtatgcagctccttttgtag

SEQ ID NO: 923749 - DNA, 25 bp, Mus musculus
ttagggtcacccaaaggcaaagctg

SEQ ID NO: 923750 - DNA, 25 bp, Mus musculus
ttagggtcaccctaaggcaaagctg

SEQ ID NO: 923751 - DNA, 25 bp, Mus musculus
ttagggtcactgacctaatcttgct

SEQ ID NO: 923752 - DNA, 25 bp, Mus musculus
ttagggtcactgtcctaatcttgct

SEQ ID NO: 923753 - DNA, 25 bp, Mus musculus
ttagggtcagacaacctcggtggcc

SEQ ID NO: 923754 - DNA, 25 bp, Mus musculus
ttagggtcagactacctcggtggcc

SEQ ID NO: 923755 - DNA, 25 bp, Mus musculus
ttagggtcagtcacctatactccag

SEQ ID NO: 923756 - DNA, 25 bp, Mus musculus
ttagggtcagtctcctatactccag

SEQ ID NO: 923757 - DNA, 25 bp, Mus musculus
ttagggtcccttctgactcttagct

SEQ ID NO: 923758 - DNA, 25 bp, Mus musculus
ttagggtcccttgtgactcttagct

SEQ ID NO: 923759 - DNA, 25 bp, Mus musculus
ttagggtcctagcacacatgtctgg

SEQ ID NO: 923760 - DNA, 25 bp, Mus musculus
ttagggtcctaggacacatgtctgg

SEQ ID NO: 923761 - DNA, 25 bp, Mus musculus
ttagggtcctccatgattgggcagc

SEQ ID NO: 923762 - DNA, 25 bp, Mus musculus
ttagggtcctccttgattgggcagc

SEQ ID NO: 923763 - DNA, 25 bp, Mus musculus
ttagggtgatggattgaattcatgt

SEQ ID NO: 923764 - DNA, 25 bp, Mus musculus
ttagggtgatggtttgaattcatgt

SEQ ID NO: 923765 - DNA, 25 bp, Mus musculus
ttagggtgcatcagaggaactccag

SEQ ID NO: 923766 - DNA, 25 bp, Mus musculus
ttagggtgcatctgaggaactccag

SEQ ID NO: 923767 - DNA, 25 bp, Mus musculus
ttagggtgccacatcccatttagtg

SEQ ID NO: 923768 - DNA, 25 bp, Mus musculus
ttagggtgccacttcccatttagtg

SEQ ID NO: 923769 - DNA, 25 bp, Mus musculus
ttagggtgctctcacatggccattc

SEQ ID NO: 923770 - DNA, 25 bp, Mus musculus
ttagggtgctctgacatggccattc

SEQ ID NO: 923771 - DNA, 25 bp, Mus musculus
ttagggtgcttcctatgttcatcaa

SEQ ID NO: 923772 - DNA, 25 bp, Mus musculus
ttagggtgcttcgtatgttcatcaa

SEQ ID NO: 923773 - DNA, 25 bp, Mus musculus
ttagggtgggctcatccgattctga

SEQ ID NO: 923774 - DNA, 25 bp, Mus musculus
ttagggtgggctgatccgattctga

SEQ ID NO: 923775 - DNA, 25 bp, Mus musculus
ttagggtgtcacaaaatcacaacat

SEQ ID NO: 923776 - DNA, 25 bp, Mus musculus
ttagggtgtcactaaatcacaacat

SEQ ID NO: 923777 - DNA, 25 bp, Mus musculus
ttagggtgttgaatgacgggtactt

SEQ ID NO: 923778 - DNA, 25 bp, Mus musculus
ttagggtgttgattgacgggtactt

SEQ ID NO: 923779 - DNA, 25 bp, Mus musculus
ttagggttatccataggtacacaag

SEQ ID NO: 923780 - DNA, 25 bp, Mus musculus
ttagggttatccttaggtacacaag

SEQ ID NO: 923781 - DNA, 25 bp, Mus musculus
ttagggttccccaagtagccacagg

SEQ ID NO: 923782 - DNA, 25 bp, Mus musculus
ttagggttcccctagtagccacagg

SEQ ID NO: 923783 - DNA, 25 bp, Mus musculus
ttagggttcgggatggatgcagtaa

SEQ ID NO: 923784 - DNA, 25 bp, Mus musculus
ttagggttcgggttggatgcagtaa

SEQ ID NO: 923785 - DNA, 25 bp, Mus musculus
ttagggttctgacccttcagacagc

SEQ ID NO: 923786 - DNA, 25 bp, Mus musculus
ttagggttctgagccttcagacagc

SEQ ID NO: 923787 - DNA, 25 bp, Mus musculus
ttagggttcttacctcaatttggat

SEQ ID NO: 923788 - DNA, 25 bp, Mus musculus
ttagggttcttagctcaatttggat

SEQ ID NO: 923789 - DNA, 25 bp, Mus musculus
ttagggttgaaccttggcctcctgc

SEQ ID NO: 923790 - DNA, 25 bp, Mus musculus
ttagggttgaacgttggcctcctgc

SEQ ID NO: 923791 - DNA, 25 bp, Mus musculus
ttagggttgagtcctagcccagctt

SEQ ID NO: 923792 - DNA, 25 bp, Mus musculus
ttagggttgagtgctagcccagctt

SEQ ID NO: 923793 - DNA, 25 bp, Mus musculus
ttagggttggccatcccgtgtcagt

SEQ ID NO: 923794 - DNA, 25 bp, Mus musculus
ttagggttggccttcccgtgtcagt

SEQ ID NO: 923795 - DNA, 25 bp, Mus musculus
ttagggtttagaaaccttaggcaga

SEQ ID NO: 923796 - DNA, 25 bp, Mus musculus
ttagggtttagataccttaggcaga

SEQ ID NO: 923797 - DNA, 25 bp, Mus musculus
ttagggtttatcagagcttaaacta

SEQ ID NO: 923798 - DNA, 25 bp, Mus musculus
ttagggtttatctgagcttaaacta

SEQ ID NO: 923799 - DNA, 25 bp, Mus musculus
ttagggtttgcacttcctttgtgag

SEQ ID NO: 923800 - DNA, 25 bp, Mus musculus
ttagggtttgcagttcctttgtgag

SEQ ID NO: 923801 - DNA, 25 bp, Mus musculus
ttaggtaacgtgaatcccacttgtt

SEQ ID NO: 923802 - DNA, 25 bp, Mus musculus
ttaggtaacgtgtatcccacttgtt

SEQ ID NO: 923803 - DNA, 25 bp, Mus musculus
ttaggtaagtccaggtcacatgggc

SEQ ID NO: 923804 - DNA, 25 bp, Mus musculus
ttaggtaagtcctggtcacatgggc

SEQ ID NO: 923805 - DNA, 25 bp, Mus musculus
ttaggtaagttcacttccactgtgt

SEQ ID NO: 923806 - DNA, 25 bp, Mus musculus
ttaggtaagttctcttccactgtgt

SEQ ID NO: 923807 - DNA, 25 bp, Mus musculus
ttaggtacaactcccgaagccacgg

SEQ ID NO: 923808 - DNA, 25 bp, Mus musculus
ttaggtacaactgccgaagccacgg

SEQ ID NO: 923809 - DNA, 25 bp, Mus musculus
ttaggtactaatactcttgagggtt

SEQ ID NO: 923810 - DNA, 25 bp, Mus musculus
ttaggtactaattctcttgagggtt

SEQ ID NO: 923811 - DNA, 25 bp, Mus musculus
ttaggtactcagctcatctctcttt

SEQ ID NO: 923812 - DNA, 25 bp, Mus musculus
ttaggtactcaggtcatctctcttt

SEQ ID NO: 923813 - DNA, 25 bp, Mus musculus
ttaggtacttgtcccgaggcattca

SEQ ID NO: 923814 - DNA, 25 bp, Mus musculus
ttaggtacttgtgccgaggcattca

SEQ ID NO: 923815 - DNA, 25 bp, Mus musculus
ttaggtactttgatcattcacatct

SEQ ID NO: 923816 - DNA, 25 bp, Mus musculus
ttaggtactttgttcattcacatct

SEQ ID NO: 923817 - DNA, 25 bp, Mus musculus
ttaggtacttttaggtctgatctgt

SEQ ID NO: 923818 - DNA, 25 bp, Mus musculus
ttaggtactttttggtctgatctgt

SEQ ID NO: 923819 - DNA, 25 bp, Mus musculus
ttaggtagaagcaccctggtctgag

SEQ ID NO: 923820 - DNA, 25 bp, Mus musculus
ttaggtagaagctccctggtctgag

SEQ ID NO: 923821 - DNA, 25 bp, Mus musculus
ttaggtagatggaaagcattctctt

SEQ ID NO: 923822 - DNA, 25 bp, Mus musculus
ttaggtagatggtaagcattctctt

SEQ ID NO: 923823 - DNA, 25 bp, Mus musculus
ttaggtagctgaacacaagacacat

SEQ ID NO: 923824 - DNA, 25 bp, Mus musculus
ttaggtagctgatcacaagacacat

SEQ ID NO: 923825 - DNA, 25 bp, Mus musculus
ttaggtatacatcaccatgccctgt

SEQ ID NO: 923826 - DNA, 25 bp, Mus musculus
ttaggtatacatcccctatgcctgg

SEQ ID NO: 923827 - DNA, 25 bp, Mus musculus
ttaggtatacatgaccatgccctgt

SEQ ID NO: 923828 - DNA, 25 bp, Mus musculus
ttaggtatacatgccctatgcctgg

SEQ ID NO: 923829 - DNA, 25 bp, Mus musculus
ttaggtcaacccattaagacacggt

SEQ ID NO: 923830 - DNA, 25 bp, Mus musculus
ttaggtcaaccctttaagacacggt

SEQ ID NO: 923831 - DNA, 25 bp, Mus musculus
ttaggtcacatcactattgcccagt

SEQ ID NO: 923832 - DNA, 25 bp, Mus musculus
ttaggtcacatctctattgcccagt

SEQ ID NO: 923833 - DNA, 25 bp, Mus musculus
ttaggtcacattaacaatataatag

SEQ ID NO: 923834 - DNA, 25 bp, Mus musculus
ttaggtcacatttacaatataatag

SEQ ID NO: 923835 - DNA, 25 bp, Mus musculus
ttaggtcaccaacgctcacgtctta

SEQ ID NO: 923836 - DNA, 25 bp, Mus musculus
ttaggtcaccaaggctcacgtctta

SEQ ID NO: 923837 - DNA, 25 bp, Mus musculus
ttaggtcagaggctgccaacttctt

SEQ ID NO: 923838 - DNA, 25 bp, Mus musculus
ttaggtcagagggtgccaacttctt

SEQ ID NO: 923839 - DNA, 25 bp, Mus musculus
ttaggtccacttccaatcactttac

SEQ ID NO: 923840 - DNA, 25 bp, Mus musculus
ttaggtccacttgcaatcactttac

SEQ ID NO: 923841 - DNA, 25 bp, Mus musculus
ttaggtccagatcccatttcttctt

SEQ ID NO: 923842 - DNA, 25 bp, Mus musculus
ttaggtccagatgccatttcttctt

SEQ ID NO: 923843 - DNA, 25 bp, Mus musculus
ttaggtccagtcataggtgctgcgg

SEQ ID NO: 923844 - DNA, 25 bp, Mus musculus
ttaggtccagtcttaggtgctgcgg

SEQ ID NO: 923845 - DNA, 25 bp, Mus musculus
ttaggtccagttattataactcatc

SEQ ID NO: 923846 - DNA, 25 bp, Mus musculus
ttaggtccagtttttataactcatc

SEQ ID NO: 923847 - DNA, 25 bp, Mus musculus
ttaggtccccttatggcaggaaggc

SEQ ID NO: 923848 - DNA, 25 bp, Mus musculus
ttaggtccccttttggcaggaaggc

SEQ ID NO: 923849 - DNA, 25 bp, Mus musculus
ttaggtccttttaggttggcttatg

SEQ ID NO: 923850 - DNA, 25 bp, Mus musculus
ttaggtcctttttggttggcttatg

SEQ ID NO: 923851 - DNA, 25 bp, Mus musculus
ttaggtcgagttacatgcacacgtg

SEQ ID NO: 923852 - DNA, 25 bp, Mus musculus
ttaggtcgagtttcatgcacacgtg

SEQ ID NO: 923853 - DNA, 25 bp, Mus musculus
ttaggtcggtgcagtggattcaaat

SEQ ID NO: 923854 - DNA, 25 bp, Mus musculus
ttaggtcggtgctgtggattcaaat

SEQ ID NO: 923855 - DNA, 25 bp, Mus musculus
ttaggtctatttaattctttgtcaa

SEQ ID NO: 923856 - DNA, 25 bp, Mus musculus
ttaggtctatttactcttggtcata

SEQ ID NO: 923857 - DNA, 25 bp, Mus musculus
ttaggtctattttattctttgtcaa

SEQ ID NO: 923858 - DNA, 25 bp, Mus musculus
ttaggtctattttctcttggtcata

SEQ ID NO: 923859 - DNA, 25 bp, Mus musculus
ttaggtctcctcacgtaagcacagg

SEQ ID NO: 923860 - DNA, 25 bp, Mus musculus
ttaggtctcctctcgtaagcacagg

SEQ ID NO: 923861 - DNA, 25 bp, Mus musculus
ttaggtctctcacagcccactgtag

SEQ ID NO: 923862 - DNA, 25 bp, Mus musculus
ttaggtctctcagagcccactgtag

SEQ ID NO: 923863 - DNA, 25 bp, Mus musculus
ttaggtctgcagagatcctcttcct

SEQ ID NO: 923864 - DNA, 25 bp, Mus musculus
ttaggtctgcagtgatcctcttcct

SEQ ID NO: 923865 - DNA, 25 bp, Mus musculus
ttaggtctgccactgtcaagggttg

SEQ ID NO: 923866 - DNA, 25 bp, Mus musculus
ttaggtctgccagtgtcaagggttg

SEQ ID NO: 923867 - DNA, 25 bp, Mus musculus
ttaggtctgggcaccatcctatgcc

SEQ ID NO: 923868 - DNA, 25 bp, Mus musculus
ttaggtctgggcacggtgtcacagc

SEQ ID NO: 923869 - DNA, 25 bp, Mus musculus
ttaggtctgggctccatcctatgcc

SEQ ID NO: 923870 - DNA, 25 bp, Mus musculus
ttaggtctgggctcggtgtcacagc

SEQ ID NO: 923871 - DNA, 25 bp, Mus musculus
ttaggtcttccacctccatggctgc

SEQ ID NO: 923872 - DNA, 25 bp, Mus musculus
ttaggtcttccactcttgcacaacc

SEQ ID NO: 923873 - DNA, 25 bp, Mus musculus
ttaggtcttccagctccatggctgc

SEQ ID NO: 923874 - DNA, 25 bp, Mus musculus
ttaggtcttccagtcttgcacaacc

SEQ ID NO: 923875 - DNA, 25 bp, Mus musculus
ttaggtcttggccatgagggtaact

SEQ ID NO: 923876 - DNA, 25 bp, Mus musculus
ttaggtcttggcgatgagggtaact

SEQ ID NO: 923877 - DNA, 25 bp, Mus musculus
ttaggtgaaggaacacgctccatgc

SEQ ID NO: 923878 - DNA, 25 bp, Mus musculus
ttaggtgaaggatcacgctccatgc

SEQ ID NO: 923879 - DNA, 25 bp, Mus musculus
ttaggtgacaccatcttaaaaatag

SEQ ID NO: 923880 - DNA, 25 bp, Mus musculus
ttaggtgacaccttcttaaaaatag

SEQ ID NO: 923881 - DNA, 25 bp, Mus musculus
ttaggtgacagaaaacaaagcaggt

SEQ ID NO: 923882 - DNA, 25 bp, Mus musculus
ttaggtgacagataacaaagcaggt

SEQ ID NO: 923883 - DNA, 25 bp, Mus musculus
ttaggtgacccgactggaccaacaa

SEQ ID NO: 923884 - DNA, 25 bp, Mus musculus
ttaggtgacccgtctggaccaacaa

SEQ ID NO: 923885 - DNA, 25 bp, Mus musculus
ttaggtgagaccaaggctccagcca

SEQ ID NO: 923886 - DNA, 25 bp, Mus musculus
ttaggtgagacctaggctccagcca

SEQ ID NO: 923887 - DNA, 25 bp, Mus musculus
ttaggtgagtatactgtttctgtct

SEQ ID NO: 923888 - DNA, 25 bp, Mus musculus
ttaggtgagtattctgtttctgtct

SEQ ID NO: 923889 - DNA, 25 bp, Mus musculus
ttaggtgagtgccacggttcctgaa

SEQ ID NO: 923890 - DNA, 25 bp, Mus musculus
ttaggtgagtgcgacggttcctgaa

SEQ ID NO: 923891 - DNA, 25 bp, Mus musculus
ttaggtgcacaaacaatgtcttgaa

SEQ ID NO: 923892 - DNA, 25 bp, Mus musculus
ttaggtgcacaatcaatgtcttgaa

SEQ ID NO: 923893 - DNA, 25 bp, Mus musculus
ttaggtgcagtgcatctttgtttca

SEQ ID NO: 923894 - DNA, 25 bp, Mus musculus
ttaggtgcagtggatctttgtttca

SEQ ID NO: 923895 - DNA, 25 bp, Mus musculus
ttaggtgcatttcgcgcgggaaaca

SEQ ID NO: 923896 - DNA, 25 bp, Mus musculus
ttaggtgcatttggcgcgggaaaca

SEQ ID NO: 923897 - DNA, 25 bp, Mus musculus
ttaggtgccaagacaataaagcatt

SEQ ID NO: 923898 - DNA, 25 bp, Mus musculus
ttaggtgccaagtcaataaagcatt

SEQ ID NO: 923899 - DNA, 25 bp, Mus musculus
ttaggtgccaatatttgccagtagt

SEQ ID NO: 923900 - DNA, 25 bp, Mus musculus
ttaggtgccaatttttgccagtagt

SEQ ID NO: 923901 - DNA, 25 bp, Mus musculus
ttaggtgccagtagatctttttgta

SEQ ID NO: 923902 - DNA, 25 bp, Mus musculus
ttaggtgccagttgatctttttgta

SEQ ID NO: 923903 - DNA, 25 bp, Mus musculus
ttaggtgcctctaaaccccagatgt

SEQ ID NO: 923904 - DNA, 25 bp, Mus musculus
ttaggtgcctcttaaccccagatgt

SEQ ID NO: 923905 - DNA, 25 bp, Mus musculus
ttaggtgcctgtcctcacatgccca

SEQ ID NO: 923906 - DNA, 25 bp, Mus musculus
ttaggtgcctgtgctcacatgccca

SEQ ID NO: 923907 - DNA, 25 bp, Mus musculus
ttaggtgcctttactccagcaagga

SEQ ID NO: 923908 - DNA, 25 bp, Mus musculus
ttaggtgcctttccggatgacctca

SEQ ID NO: 923909 - DNA, 25 bp, Mus musculus
ttaggtgcctttgcggatgacctca

SEQ ID NO: 923910 - DNA, 25 bp, Mus musculus
ttaggtgccttttctccagcaagga

SEQ ID NO: 923911 - DNA, 25 bp, Mus musculus
ttaggtgcttggaaaccacagtaat

SEQ ID NO: 923912 - DNA, 25 bp, Mus musculus
ttaggtgcttggtaaccacagtaat

SEQ ID NO: 923913 - DNA, 25 bp, Mus musculus
ttaggtggagctaggtttctcttcc

SEQ ID NO: 923914 - DNA, 25 bp, Mus musculus
ttaggtggagcttggtttctcttcc

SEQ ID NO: 923915 - DNA, 25 bp, Mus musculus
ttaggtggctgaatcattcactcat

SEQ ID NO: 923916 - DNA, 25 bp, Mus musculus
ttaggtggctgattcattcactcat

SEQ ID NO: 923917 - DNA, 25 bp, Mus musculus
ttaggtgggactcttccaagacact

SEQ ID NO: 923918 - DNA, 25 bp, Mus musculus
ttaggtgggactgttccaagacact

SEQ ID NO: 923919 - DNA, 25 bp, Mus musculus
ttaggtgggtttccgtggcttttct

SEQ ID NO: 923920 - DNA, 25 bp, Mus musculus
ttaggtgggtttgcgtggcttttct

SEQ ID NO: 923921 - DNA, 25 bp, Mus musculus
ttaggtggtaatcctgggagcacca

SEQ ID NO: 923922 - DNA, 25 bp, Mus musculus
ttaggtggtaatgctgggagcacca

SEQ ID NO: 923923 - DNA, 25 bp, Mus musculus
ttaggtggtggtcactcgctcgccc

SEQ ID NO: 923924 - DNA, 25 bp, Mus musculus
ttaggtggtggtgactcgctcgccc

SEQ ID NO: 923925 - DNA, 25 bp, Mus musculus
ttaggtgtagcacttaccctgcaca

SEQ ID NO: 923926 - DNA, 25 bp, Mus musculus
ttaggtgtagcagttaccctgcaca

SEQ ID NO: 923927 - DNA, 25 bp, Mus musculus
ttaggtgtctccatctcaacaaata

SEQ ID NO: 923928 - DNA, 25 bp, Mus musculus
ttaggtgtctccttctcaacaaata

SEQ ID NO: 923929 - DNA, 25 bp, Mus musculus
ttaggtgtgcggagtcccctagttc

SEQ ID NO: 923930 - DNA, 25 bp, Mus musculus
ttaggtgtgcggtgtcccctagttc

SEQ ID NO: 923931 - DNA, 25 bp, Mus musculus
ttaggtgtgctacagtctgggcctc

SEQ ID NO: 923932 - DNA, 25 bp, Mus musculus
ttaggtgtgctagagtctgggcctc

SEQ ID NO: 923933 - DNA, 25 bp, Mus musculus
ttaggtgtgctcctgactcggctgc

SEQ ID NO: 923934 - DNA, 25 bp, Mus musculus
ttaggtgtgctcgtgactcggctgc

SEQ ID NO: 923935 - DNA, 25 bp, Mus musculus
ttaggtgtgctgaccagctactagt

SEQ ID NO: 923936 - DNA, 25 bp, Mus musculus
ttaggtgtgctgcatcctcacttgt

SEQ ID NO: 923937 - DNA, 25 bp, Mus musculus
ttaggtgtgctggatcctcacttgt

SEQ ID NO: 923938 - DNA, 25 bp, Mus musculus
ttaggtgtgctgtccagctactagt

SEQ ID NO: 923939 - DNA, 25 bp, Mus musculus
ttaggtgttcctattgcatcctctt

SEQ ID NO: 923940 - DNA, 25 bp, Mus musculus
ttaggtgttccttttgcatcctctt

SEQ ID NO: 923941 - DNA, 25 bp, Mus musculus
ttaggtgttgatcctgattccgaca

SEQ ID NO: 923942 - DNA, 25 bp, Mus musculus
ttaggtgttgatgctgattccgaca

SEQ ID NO: 923943 - DNA, 25 bp, Mus musculus
ttaggtgtttgtccaccacatgcct

SEQ ID NO: 923944 - DNA, 25 bp, Mus musculus
ttaggtgtttgtgcaccacatgcct

SEQ ID NO: 923945 - DNA, 25 bp, Mus musculus
ttaggttaattcagtatagccctga

SEQ ID NO: 923946 - DNA, 25 bp, Mus musculus
ttaggttaattctgtatagccctga

SEQ ID NO: 923947 - DNA, 25 bp, Mus musculus
ttaggttagcccaccaaatcgcttg

SEQ ID NO: 923948 - DNA, 25 bp, Mus musculus
ttaggttagccctccaaatcgcttg

SEQ ID NO: 923949 - DNA, 25 bp, Mus musculus
ttaggttatcataatacccaccttt

SEQ ID NO: 923950 - DNA, 25 bp, Mus musculus
ttaggttatcattatacccaccttt

SEQ ID NO: 923951 - DNA, 25 bp, Mus musculus
ttaggttattttcgccaggctcttc

SEQ ID NO: 923952 - DNA, 25 bp, Mus musculus
ttaggttattttggccaggctcttc

SEQ ID NO: 923953 - DNA, 25 bp, Mus musculus
ttaggttcattaccacgttggagga

SEQ ID NO: 923954 - DNA, 25 bp, Mus musculus
ttaggttcattagcacgttggagga

SEQ ID NO: 923955 - DNA, 25 bp, Mus musculus
ttaggttcattcacttgcacccaga

SEQ ID NO: 923956 - DNA, 25 bp, Mus musculus
ttaggttcattctcttgcacccaga

SEQ ID NO: 923957 - DNA, 25 bp, Mus musculus
ttaggttccaacacggagagcgggc

SEQ ID NO: 923958 - DNA, 25 bp, Mus musculus
ttaggttccaactcggagagcgggc

SEQ ID NO: 923959 - DNA, 25 bp, Mus musculus
ttaggttccagccattcataagagc

SEQ ID NO: 923960 - DNA, 25 bp, Mus musculus
ttaggttccagcgattcataagagc

SEQ ID NO: 923961 - DNA, 25 bp, Mus musculus
ttaggttcctggcagtttctgagat

SEQ ID NO: 923962 - DNA, 25 bp, Mus musculus
ttaggttcctgggagtttctgagat

SEQ ID NO: 923963 - DNA, 25 bp, Mus musculus
ttaggttctcacacaggatacactg

SEQ ID NO: 923964 - DNA, 25 bp, Mus musculus
ttaggttctcactcaggatacactg

SEQ ID NO: 923965 - DNA, 25 bp, Mus musculus
ttaggttctgagctgtgggttccct

SEQ ID NO: 923966 - DNA, 25 bp, Mus musculus
ttaggttctgaggtgtgggttccct

SEQ ID NO: 923967 - DNA, 25 bp, Mus musculus
ttaggttctgggaatgcacccggct

SEQ ID NO: 923968 - DNA, 25 bp, Mus musculus
ttaggttctgggtatgcacccggct

SEQ ID NO: 923969 - DNA, 25 bp, Mus musculus
ttaggttctttcaagccagggtctt

SEQ ID NO: 923970 - DNA, 25 bp, Mus musculus
ttaggttctttctagccagggtctt

SEQ ID NO: 923971 - DNA, 25 bp, Mus musculus
ttaggttgaataatgttgtagagta

SEQ ID NO: 923972 - DNA, 25 bp, Mus musculus
ttaggttgaatattgttgtagagta

SEQ ID NO: 923973 - DNA, 25 bp, Mus musculus
ttaggttgacctcaggtgcttgctt

SEQ ID NO: 923974 - DNA, 25 bp, Mus musculus
ttaggttgacctgaggtgcttgctt

SEQ ID NO: 923975 - DNA, 25 bp, Mus musculus
ttaggttgcccaacctgtgtgaagc

SEQ ID NO: 923976 - DNA, 25 bp, Mus musculus
ttaggttgcccatcctgtgtgaagc

SEQ ID NO: 923977 - DNA, 25 bp, Mus musculus
ttaggttgtccaactatgtccatgc

SEQ ID NO: 923978 - DNA, 25 bp, Mus musculus
ttaggttgtccatctatgtccatgc

SEQ ID NO: 923979 - DNA, 25 bp, Mus musculus
ttaggttgtcttctgtagcctccac

SEQ ID NO: 923980 - DNA, 25 bp, Mus musculus
ttaggttgtcttgtgtagcctccac

SEQ ID NO: 923981 - DNA, 25 bp, Mus musculus
ttaggttgtgagaaggcgccaagcc

SEQ ID NO: 923982 - DNA, 25 bp, Mus musculus
ttaggttgtgagtaggcgccaagcc

SEQ ID NO: 923983 - DNA, 25 bp, Mus musculus
ttaggttgtgggagctgtgcctaaa

SEQ ID NO: 923984 - DNA, 25 bp, Mus musculus
ttaggttgtgggtgctgtgcctaaa

SEQ ID NO: 923985 - DNA, 25 bp, Mus musculus
ttaggtttcctcatgagtcctgtgt

SEQ ID NO: 923986 - DNA, 25 bp, Mus musculus
ttaggtttcctcttgagtcctgtgt

SEQ ID NO: 923987 - DNA, 25 bp, Mus musculus
ttaggtttctatactatctctcaaa

SEQ ID NO: 923988 - DNA, 25 bp, Mus musculus
ttaggtttctatcggcagcttcttc

SEQ ID NO: 923989 - DNA, 25 bp, Mus musculus
ttaggtttctatgggcagcttcttc

SEQ ID NO: 923990 - DNA, 25 bp, Mus musculus
ttaggtttctattctatctctcaaa

SEQ ID NO: 923991 - DNA, 25 bp, Mus musculus
ttaggtttgcatatgattttacaca

SEQ ID NO: 923992 - DNA, 25 bp, Mus musculus
ttaggtttgcatttgattttacaca

SEQ ID NO: 923993 - DNA, 25 bp, Mus musculus
ttaggttttaacatcacagggcaat

SEQ ID NO: 923994 - DNA, 25 bp, Mus musculus
ttaggttttaacttcacagggcaat

SEQ ID NO: 923995 - DNA, 25 bp, Mus musculus
ttaggttttggtcaagttatatgtt

SEQ ID NO: 923996 - DNA, 25 bp, Mus musculus
ttaggttttggtgaagttatatgtt

SEQ ID NO: 923997 - DNA, 25 bp, Mus musculus
ttagtaaaagccaagagccctgtgc

SEQ ID NO: 923998 - DNA, 25 bp, Mus musculus
ttagtaaaagcctagagccctgtgc

SEQ ID NO: 923999 - DNA, 25 bp, Mus musculus
ttagtaaacacgaaggcagaacatt

SEQ ID NO: 924000 - DNA, 25 bp, Mus musculus
ttagtaaacacgtaggcagaacatt

SEQ ID NO: 924001 - DNA, 25 bp, Mus musculus
ttagtaacatccagacagactatgt

SEQ ID NO: 924002 - DNA, 25 bp, Mus musculus
ttagtaacatcctgacagactatgt

SEQ ID NO: 924003 - DNA, 25 bp, Mus musculus
ttagtaaccgtcagatcttttccac

SEQ ID NO: 924004 - DNA, 25 bp, Mus musculus
ttagtaaccgtctgatcttttccac

SEQ ID NO: 924005 - DNA, 25 bp, Mus musculus
ttagtaacctctccaaatgattttg

SEQ ID NO: 924006 - DNA, 25 bp, Mus musculus
ttagtaacctctgcaaatgattttg

SEQ ID NO: 924007 - DNA, 25 bp, Mus musculus
ttagtaactctaatccatctctctt

SEQ ID NO: 924008 - DNA, 25 bp, Mus musculus
ttagtaactctattccatctctctt

SEQ ID NO: 924009 - DNA, 25 bp, Mus musculus
ttagtaactgttatatcttgctttg

SEQ ID NO: 924010 - DNA, 25 bp, Mus musculus
ttagtaactgttttatcttgctttg

SEQ ID NO: 924011 - DNA, 25 bp, Mus musculus
ttagtaatgctcaaggatccgacca

SEQ ID NO: 924012 - DNA, 25 bp, Mus musculus
ttagtaatgctctaggatccgacca

SEQ ID NO: 924013 - DNA, 25 bp, Mus musculus
ttagtaattctcagcggtttgtctg

SEQ ID NO: 924014 - DNA, 25 bp, Mus musculus
ttagtaattctctgcggtttgtctg

SEQ ID NO: 924015 - DNA, 25 bp, Mus musculus
ttagtaattgtacattgtcatccag

SEQ ID NO: 924016 - DNA, 25 bp, Mus musculus
ttagtaattgtagattgtcatccag

SEQ ID NO: 924017 - DNA, 25 bp, Mus musculus
ttagtaatttcgactgtgtcttcat

SEQ ID NO: 924018 - DNA, 25 bp, Mus musculus
ttagtaatttcgtctgtgtcttcat

SEQ ID NO: 924019 - DNA, 25 bp, Mus musculus
ttagtacagacgctctttctttcct

SEQ ID NO: 924020 - DNA, 25 bp, Mus musculus
ttagtacagacggtctttctttcct

SEQ ID NO: 924021 - DNA, 25 bp, Mus musculus
ttagtacagatgactgcagaggcca

SEQ ID NO: 924022 - DNA, 25 bp, Mus musculus
ttagtacagatgtctgcagaggcca

SEQ ID NO: 924023 - DNA, 25 bp, Mus musculus
ttagtacagtcccaactaccgtaga

SEQ ID NO: 924024 - DNA, 25 bp, Mus musculus
ttagtacagtccgaactaccgtaga

SEQ ID NO: 924025 - DNA, 25 bp, Mus musculus
ttagtaccaactccttcattctgtc

SEQ ID NO: 924026 - DNA, 25 bp, Mus musculus
ttagtaccaactgcttcattctgtc

SEQ ID NO: 924027 - DNA, 25 bp, Mus musculus
ttagtaccgaagactgaatgcccag

SEQ ID NO: 924028 - DNA, 25 bp, Mus musculus
ttagtaccgaagtctgaatgcccag

SEQ ID NO: 924029 - DNA, 25 bp, Mus musculus
ttagtactaacacctatatcattgt

SEQ ID NO: 924030 - DNA, 25 bp, Mus musculus
ttagtactaacagctatatcattgt

SEQ ID NO: 924031 - DNA, 25 bp, Mus musculus
ttagtactcgtcaggcctctggagg

SEQ ID NO: 924032 - DNA, 25 bp, Mus musculus
ttagtactcgtctggcctctggagg

SEQ ID NO: 924033 - DNA, 25 bp, Mus musculus
ttagtactctggctgaatcgcatcc

SEQ ID NO: 924034 - DNA, 25 bp, Mus musculus
ttagtactctgggtgaatcgcatcc

SEQ ID NO: 924035 - DNA, 25 bp, Mus musculus
ttagtactgtaaactgcttctgagc

SEQ ID NO: 924036 - DNA, 25 bp, Mus musculus
ttagtactgtaatctgcttctgagc

SEQ ID NO: 924037 - DNA, 25 bp, Mus musculus
ttagtacttcctcattacacccttt

SEQ ID NO: 924038 - DNA, 25 bp, Mus musculus
ttagtacttcctgattacacccttt

SEQ ID NO: 924039 - DNA, 25 bp, Mus musculus
ttagtagacataactgttgagtagt

SEQ ID NO: 924040 - DNA, 25 bp, Mus musculus
ttagtagacatatctgttgagtagt

SEQ ID NO: 924041 - DNA, 25 bp, Mus musculus
ttagtagactctcttagattaggga

SEQ ID NO: 924042 - DNA, 25 bp, Mus musculus
ttagtagactctgttagattaggga

SEQ ID NO: 924043 - DNA, 25 bp, Mus musculus
ttagtagcaggcaccaacctcaaga

SEQ ID NO: 924044 - DNA, 25 bp, Mus musculus
ttagtagcaggctccaacctcaaga

SEQ ID NO: 924045 - DNA, 25 bp, Mus musculus
ttagtagcccctcaagcttgggact

SEQ ID NO: 924046 - DNA, 25 bp, Mus musculus
ttagtagcccctgaagcttgggact

SEQ ID NO: 924047 - DNA, 25 bp, Mus musculus
ttagtaggacaacgccacagtggtt

SEQ ID NO: 924048 - DNA, 25 bp, Mus musculus
ttagtaggacaaggccacagtggtt

SEQ ID NO: 924049 - DNA, 25 bp, Mus musculus
ttagtaggacagctagaccgcccgt

SEQ ID NO: 924050 - DNA, 25 bp, Mus musculus
ttagtaggacaggtagaccgcccgt

SEQ ID NO: 924051 - DNA, 25 bp, Mus musculus
ttagtagtcacaccatagtcttaaa

SEQ ID NO: 924052 - DNA, 25 bp, Mus musculus
ttagtagtcacagcatagtcttaaa

SEQ ID NO: 924053 - DNA, 25 bp, Mus musculus
ttagtagtcagcagcctgtgatcct

SEQ ID NO: 924054 - DNA, 25 bp, Mus musculus
ttagtagtcagctgcctgtgatcct

SEQ ID NO: 924055 - DNA, 25 bp, Mus musculus
ttagtagtggtcatccccaaataga

SEQ ID NO: 924056 - DNA, 25 bp, Mus musculus
ttagtagtggtcttccccaaataga

SEQ ID NO: 924057 - DNA, 25 bp, Mus musculus
ttagtagtttttcaccgacatggtt

SEQ ID NO: 924058 - DNA, 25 bp, Mus musculus
ttagtagtttttgaccgacatggtt

SEQ ID NO: 924059 - DNA, 25 bp, Mus musculus
ttagtatatcttctttcaaccatgt

SEQ ID NO: 924060 - DNA, 25 bp, Mus musculus
ttagtatatcttgtttcaaccatgt

SEQ ID NO: 924061 - DNA, 25 bp, Mus musculus
ttagtatcaatgactgtgaccccca

SEQ ID NO: 924062 - DNA, 25 bp, Mus musculus
ttagtatcaatgtctgtgaccccca

SEQ ID NO: 924063 - DNA, 25 bp, Mus musculus
ttagtatcccacagaaatgttccat

SEQ ID NO: 924064 - DNA, 25 bp, Mus musculus
ttagtatcccacatcagtcacttaa

SEQ ID NO: 924065 - DNA, 25 bp, Mus musculus
ttagtatcccactgaaatgttccat

SEQ ID NO: 924066 - DNA, 25 bp, Mus musculus
ttagtatcccacttcagtcacttaa

SEQ ID NO: 924067 - DNA, 25 bp, Mus musculus
ttagtatccgtgacaataggctcct

SEQ ID NO: 924068 - DNA, 25 bp, Mus musculus
ttagtatccgtgtcaataggctcct

SEQ ID NO: 924069 - DNA, 25 bp, Mus musculus
ttagtatctttgagctcaagctcca

SEQ ID NO: 924070 - DNA, 25 bp, Mus musculus
ttagtatctttgtgctcaagctcca

SEQ ID NO: 924071 - DNA, 25 bp, Mus musculus
ttagtatgggcactcttgttttcct

SEQ ID NO: 924072 - DNA, 25 bp, Mus musculus
ttagtatgggcagtcttgttttcct

SEQ ID NO: 924073 - DNA, 25 bp, Mus musculus
ttagtattagttatccttcaccaca

SEQ ID NO: 924074 - DNA, 25 bp, Mus musculus
ttagtattagttttccttcaccaca

SEQ ID NO: 924075 - DNA, 25 bp, Mus musculus
ttagtatttcccaccttctaacttg

SEQ ID NO: 924076 - DNA, 25 bp, Mus musculus
ttagtatttccctccttctaacttg

SEQ ID NO: 924077 - DNA, 25 bp, Mus musculus
ttagtattttcaaccattccacttt

SEQ ID NO: 924078 - DNA, 25 bp, Mus musculus
ttagtattttcatccattccacttt

SEQ ID NO: 924079 - DNA, 25 bp, Mus musculus
ttagtattttgcatattacccaaga

SEQ ID NO: 924080 - DNA, 25 bp, Mus musculus
ttagtattttgcttattacccaaga

SEQ ID NO: 924081 - DNA, 25 bp, Mus musculus
ttagtcaacccactcgtgtgtgtgt

SEQ ID NO: 924082 - DNA, 25 bp, Mus musculus
ttagtcaacccagtcgtgtgtgtgt

SEQ ID NO: 924083 - DNA, 25 bp, Mus musculus
ttagtcaaccttacttattatgcag

SEQ ID NO: 924084 - DNA, 25 bp, Mus musculus
ttagtcaacctttcttattatgcag

SEQ ID NO: 924085 - DNA, 25 bp, Mus musculus
ttagtcacaacaacccaaaacctta

SEQ ID NO: 924086 - DNA, 25 bp, Mus musculus
ttagtcacaacatcccaaaacctta

SEQ ID NO: 924087 - DNA, 25 bp, Mus musculus
ttagtcacacttatgctatggcatg

SEQ ID NO: 924088 - DNA, 25 bp, Mus musculus
ttagtcacacttttgctatggcatg

SEQ ID NO: 924089 - DNA, 25 bp, Mus musculus
ttagtcacagctctctgctctttct

SEQ ID NO: 924090 - DNA, 25 bp, Mus musculus
ttagtcacagctgtctgctctttct

SEQ ID NO: 924091 - DNA, 25 bp, Mus musculus
ttagtcacgtagcacagctgcctgt

SEQ ID NO: 924092 - DNA, 25 bp, Mus musculus
ttagtcacgtaggacagctgcctgt

SEQ ID NO: 924093 - DNA, 25 bp, Mus musculus
ttagtcactaaaccatgggagcagt

SEQ ID NO: 924094 - DNA, 25 bp, Mus musculus
ttagtcactaaagcatgggagcagt

SEQ ID NO: 924095 - DNA, 25 bp, Mus musculus
ttagtcactatacttgattccttgg

SEQ ID NO: 924096 - DNA, 25 bp, Mus musculus
ttagtcactatagttgattccttgg

SEQ ID NO: 924097 - DNA, 25 bp, Mus musculus
ttagtcactgctaggcacttgtgcc

SEQ ID NO: 924098 - DNA, 25 bp, Mus musculus
ttagtcactgcttggcacttgtgcc

SEQ ID NO: 924099 - DNA, 25 bp, Mus musculus
ttagtcaggactctatggacagggc

SEQ ID NO: 924100 - DNA, 25 bp, Mus musculus
ttagtcaggactgtatggacagggc

SEQ ID NO: 924101 - DNA, 25 bp, Mus musculus
ttagtcagtactacatcaaggcagc

SEQ ID NO: 924102 - DNA, 25 bp, Mus musculus
ttagtcagtacttcatcaaggcagc

SEQ ID NO: 924103 - DNA, 25 bp, Mus musculus
ttagtcagtatactgatgcccattc

SEQ ID NO: 924104 - DNA, 25 bp, Mus musculus
ttagtcagtatagtgatgcccattc

SEQ ID NO: 924105 - DNA, 25 bp, Mus musculus
ttagtcagttcaaggccaacgtggg

SEQ ID NO: 924106 - DNA, 25 bp, Mus musculus
ttagtcagttcatggccaacgtggg

SEQ ID NO: 924107 - DNA, 25 bp, Mus musculus
ttagtcatccatactgctttcattg

SEQ ID NO: 924108 - DNA, 25 bp, Mus musculus
ttagtcatccattctgctttcattg

SEQ ID NO: 924109 - DNA, 25 bp, Mus musculus
ttagtcatctctcgaggtgtgcgga

SEQ ID NO: 924110 - DNA, 25 bp, Mus musculus
ttagtcatctctggaggtgtgcgga

SEQ ID NO: 924111 - DNA, 25 bp, Mus musculus
ttagtcatgattctttaacatccca

SEQ ID NO: 924112 - DNA, 25 bp, Mus musculus
ttagtcatgattgtttaacatccca

SEQ ID NO: 924113 - DNA, 25 bp, Mus musculus
ttagtcatgcccacgagtactgctc

SEQ ID NO: 924114 - DNA, 25 bp, Mus musculus
ttagtcatgccctcgagtactgctc

SEQ ID NO: 924115 - DNA, 25 bp, Mus musculus
ttagtcatgcctcgagtaactgctc

SEQ ID NO: 924116 - DNA, 25 bp, Mus musculus
ttagtcatgcctggagtaactgctc

SEQ ID NO: 924117 - DNA, 25 bp, Mus musculus
ttagtcattcccaggttccttggca

SEQ ID NO: 924118 - DNA, 25 bp, Mus musculus
ttagtcattccctggttccttggca

SEQ ID NO: 924119 - DNA, 25 bp, Mus musculus
ttagtcattggtaacgtccgagctt

SEQ ID NO: 924120 - DNA, 25 bp, Mus musculus
ttagtcattggttacgtccgagctt

SEQ ID NO: 924121 - DNA, 25 bp, Mus musculus
ttagtccaaataaacatcccctcag

SEQ ID NO: 924122 - DNA, 25 bp, Mus musculus
ttagtccaaatatacatcccctcag

SEQ ID NO: 924123 - DNA, 25 bp, Mus musculus
ttagtccaacttcaggtctgtctca

SEQ ID NO: 924124 - DNA, 25 bp, Mus musculus
ttagtccaacttgaggtctgtctca

SEQ ID NO: 924125 - DNA, 25 bp, Mus musculus
ttagtccaagtgagctctcctttca

SEQ ID NO: 924126 - DNA, 25 bp, Mus musculus
ttagtccaagtgtgctctcctttca

SEQ ID NO: 924127 - DNA, 25 bp, Mus musculus
ttagtccacatcctttttccagttt

SEQ ID NO: 924128 - DNA, 25 bp, Mus musculus
ttagtccacatcgtttttccagttt

SEQ ID NO: 924129 - DNA, 25 bp, Mus musculus
ttagtccaggttagtcttaaactat

SEQ ID NO: 924130 - DNA, 25 bp, Mus musculus
ttagtccaggtttgtcttaaactat

SEQ ID NO: 924131 - DNA, 25 bp, Mus musculus
ttagtccagtccagtagaatccgct

SEQ ID NO: 924132 - DNA, 25 bp, Mus musculus
ttagtccagtcctgtagaatccgct

SEQ ID NO: 924133 - DNA, 25 bp, Mus musculus
ttagtccatcatctgtgtttcaaat

SEQ ID NO: 924134 - DNA, 25 bp, Mus musculus
ttagtccatcatgtgtgtttcaaat

SEQ ID NO: 924135 - DNA, 25 bp, Mus musculus
ttagtccatgcaactttgcatctct

SEQ ID NO: 924136 - DNA, 25 bp, Mus musculus
ttagtccatgcatctttgcatctct

SEQ ID NO: 924137 - DNA, 25 bp, Mus musculus
ttagtccatttcaaggtggtagtac

SEQ ID NO: 924138 - DNA, 25 bp, Mus musculus
ttagtccatttctaggtggtagtac

SEQ ID NO: 924139 - DNA, 25 bp, Mus musculus
ttagtcccaaatctagtggcctttg

SEQ ID NO: 924140 - DNA, 25 bp, Mus musculus
ttagtcccaaatgtagtggcctttg

SEQ ID NO: 924141 - DNA, 25 bp, Mus musculus
ttagtcccaacacaggttctaccca

SEQ ID NO: 924142 - DNA, 25 bp, Mus musculus
ttagtcccaacagaggttctaccca

SEQ ID NO: 924143 - DNA, 25 bp, Mus musculus
ttagtcccacttacaagccacaaaa

SEQ ID NO: 924144 - DNA, 25 bp, Mus musculus
ttagtcccactttcaagccacaaaa

SEQ ID NO: 924145 - DNA, 25 bp, Mus musculus
ttagtcccagaacctgtgaggccat

SEQ ID NO: 924146 - DNA, 25 bp, Mus musculus
ttagtcccagaagctgtgaggccat

SEQ ID NO: 924147 - DNA, 25 bp, Mus musculus
ttagtcccaggcacaggaccttcgg

SEQ ID NO: 924148 - DNA, 25 bp, Mus musculus
ttagtcccaggctcaggaccttcgg

SEQ ID NO: 924149 - DNA, 25 bp, Mus musculus
ttagtcccattccacttttgtttca

SEQ ID NO: 924150 - DNA, 25 bp, Mus musculus
ttagtcccattcgacttttgtttca

SEQ ID NO: 924151 - DNA, 25 bp, Mus musculus
ttagtcccctgtaatgctggctgct

SEQ ID NO: 924152 - DNA, 25 bp, Mus musculus
ttagtcccctgttatgctggctgct

SEQ ID NO: 924153 - DNA, 25 bp, Mus musculus
ttagtccccttcattggatctcaaa

SEQ ID NO: 924154 - DNA, 25 bp, Mus musculus
ttagtccccttctttggatctcaaa

SEQ ID NO: 924155 - DNA, 25 bp, Mus musculus
ttagtccctagcacctacagaaaag

SEQ ID NO: 924156 - DNA, 25 bp, Mus musculus
ttagtccctagctcctacagaaaag

SEQ ID NO: 924157 - DNA, 25 bp, Mus musculus
ttagtccctcctccttgaaggacag

SEQ ID NO: 924158 - DNA, 25 bp, Mus musculus
ttagtccctcctgcttgaaggacag

SEQ ID NO: 924159 - DNA, 25 bp, Mus musculus
ttagtccctgttagtctgggtccct

SEQ ID NO: 924160 - DNA, 25 bp, Mus musculus
ttagtccctgtttgtctgggtccct

SEQ ID NO: 924161 - DNA, 25 bp, Mus musculus
ttagtcctaacaccggcatacatct

SEQ ID NO: 924162 - DNA, 25 bp, Mus musculus
ttagtcctaacagcggcatacatct

SEQ ID NO: 924163 - DNA, 25 bp, Mus musculus
ttagtcctaagaactgtggcctgca

SEQ ID NO: 924164 - DNA, 25 bp, Mus musculus
ttagtcctaagatctgtggcctgca

SEQ ID NO: 924165 - DNA, 25 bp, Mus musculus
ttagtcctaatcacctgccttctaa

SEQ ID NO: 924166 - DNA, 25 bp, Mus musculus
ttagtcctaatctcctgccttctaa

SEQ ID NO: 924167 - DNA, 25 bp, Mus musculus
ttagtcctatatcctggtcaccata

SEQ ID NO: 924168 - DNA, 25 bp, Mus musculus
ttagtcctatatgctggtcaccata

SEQ ID NO: 924169 - DNA, 25 bp, Mus musculus
ttagtcctcaccagctccagttact

SEQ ID NO: 924170 - DNA, 25 bp, Mus musculus
ttagtcctcacctgctccagttact

SEQ ID NO: 924171 - DNA, 25 bp, Mus musculus
ttagtcctcggccaagacaggtcgc

SEQ ID NO: 924172 - DNA, 25 bp, Mus musculus
ttagtcctcggcgaagacaggtcgc

SEQ ID NO: 924173 - DNA, 25 bp, Mus musculus
ttagtcctctacatggtattgccac

SEQ ID NO: 924174 - DNA, 25 bp, Mus musculus
ttagtcctctacttggtattgccac

SEQ ID NO: 924175 - DNA, 25 bp, Mus musculus
ttagtcctgacactgggctgtcctt

SEQ ID NO: 924176 - DNA, 25 bp, Mus musculus
ttagtcctgacagtgggctgtcctt

SEQ ID NO: 924177 - DNA, 25 bp, Mus musculus
ttagtcctgccccagaccaggtttg

SEQ ID NO: 924178 - DNA, 25 bp, Mus musculus
ttagtcctgcccgagaccaggtttg

SEQ ID NO: 924179 - DNA, 25 bp, Mus musculus
ttagtcctggctcatttcactgtgc

SEQ ID NO: 924180 - DNA, 25 bp, Mus musculus
ttagtcctggctgatttcactgtgc

SEQ ID NO: 924181 - DNA, 25 bp, Mus musculus
ttagtccttcaaatactgctgtatt

SEQ ID NO: 924182 - DNA, 25 bp, Mus musculus
ttagtccttcaattactgctgtatt

SEQ ID NO: 924183 - DNA, 25 bp, Mus musculus
ttagtccttccaacttttatcccaa

SEQ ID NO: 924184 - DNA, 25 bp, Mus musculus
ttagtccttccatcttttatcccaa

SEQ ID NO: 924185 - DNA, 25 bp, Mus musculus
ttagtcgcatgtcttgtgtttgtcc

SEQ ID NO: 924186 - DNA, 25 bp, Mus musculus
ttagtcgcatgtgttgtgtttgtcc

SEQ ID NO: 924187 - DNA, 25 bp, Mus musculus
ttagtcggagtgacatgattgtcgt

SEQ ID NO: 924188 - DNA, 25 bp, Mus musculus
ttagtcggagtgtcatgattgtcgt

SEQ ID NO: 924189 - DNA, 25 bp, Mus musculus
ttagtcggcaccacagggccacatt

SEQ ID NO: 924190 - DNA, 25 bp, Mus musculus
ttagtcggcacctcagggccacatt

SEQ ID NO: 924191 - DNA, 25 bp, Mus musculus
ttagtcggcagcagggaacaagcag

SEQ ID NO: 924192 - DNA, 25 bp, Mus musculus
ttagtcggcagctgggaacaagcag

SEQ ID NO: 924193 - DNA, 25 bp, Mus musculus
ttagtcggtgttaatctgagatgaa

SEQ ID NO: 924194 - DNA, 25 bp, Mus musculus
ttagtcggtgtttatctgagatgaa

SEQ ID NO: 924195 - DNA, 25 bp, Mus musculus
ttagtcgtcaccatctgtcggtctt

SEQ ID NO: 924196 - DNA, 25 bp, Mus musculus
ttagtcgtcaccttctgtcggtctt

SEQ ID NO: 924197 - DNA, 25 bp, Mus musculus
ttagtctaacttactcatgtggtgc

SEQ ID NO: 924198 - DNA, 25 bp, Mus musculus
ttagtctaactttctcatgtggtgc

SEQ ID NO: 924199 - DNA, 25 bp, Mus musculus
ttagtctcaaccatctggtactctg

SEQ ID NO: 924200 - DNA, 25 bp, Mus musculus
ttagtctcaaccttctggtactctg

SEQ ID NO: 924201 - DNA, 25 bp, Mus musculus
ttagtctcagccaggtgtgtctgta

SEQ ID NO: 924202 - DNA, 25 bp, Mus musculus
ttagtctcagcctggtgtgtctgta

SEQ ID NO: 924203 - DNA, 25 bp, Mus musculus
ttagtctcatatacttcaaccaaag

SEQ ID NO: 924204 - DNA, 25 bp, Mus musculus
ttagtctcatattcttcaaccaaag

SEQ ID NO: 924205 - DNA, 25 bp, Mus musculus
ttagtctccttcctgatggtcgccc

SEQ ID NO: 924206 - DNA, 25 bp, Mus musculus
ttagtctccttcgtgatggtcgccc

SEQ ID NO: 924207 - DNA, 25 bp, Mus musculus
ttagtctctcagctggcactacagg

SEQ ID NO: 924208 - DNA, 25 bp, Mus musculus
ttagtctctcaggtggcactacagg

SEQ ID NO: 924209 - DNA, 25 bp, Mus musculus
ttagtctctgagcatgcataaataa

SEQ ID NO: 924210 - DNA, 25 bp, Mus musculus
ttagtctctgaggatgcataaataa

SEQ ID NO: 924211 - DNA, 25 bp, Mus musculus
ttagtctctgataccaggctagcct

SEQ ID NO: 924212 - DNA, 25 bp, Mus musculus
ttagtctctgattccaggctagcct

SEQ ID NO: 924213 - DNA, 25 bp, Mus musculus
ttagtctgaatgcttgtggccctga

SEQ ID NO: 924214 - DNA, 25 bp, Mus musculus
ttagtctgaatggttgtggccctga

SEQ ID NO: 924215 - DNA, 25 bp, Mus musculus
ttagtctgactcaggatttggagcc

SEQ ID NO: 924216 - DNA, 25 bp, Mus musculus
ttagtctgactctggatttggagcc

SEQ ID NO: 924217 - DNA, 25 bp, Mus musculus
ttagtctgcatgaccagcattgcta

SEQ ID NO: 924218 - DNA, 25 bp, Mus musculus
ttagtctgcatgtccagcattgcta

SEQ ID NO: 924219 - DNA, 25 bp, Mus musculus
ttagtctggactctacccgatgcct

SEQ ID NO: 924220 - DNA, 25 bp, Mus musculus
ttagtctggactgtacccgatgcct

SEQ ID NO: 924221 - DNA, 25 bp, Mus musculus
ttagtctgggcacaggtcttgctca

SEQ ID NO: 924222 - DNA, 25 bp, Mus musculus
ttagtctgggcagaggtcttgctca

SEQ ID NO: 924223 - DNA, 25 bp, Mus musculus
ttagtctgggctaatgttatttccc

SEQ ID NO: 924224 - DNA, 25 bp, Mus musculus
ttagtctgggcttatgttatttccc

SEQ ID NO: 924225 - DNA, 25 bp, Mus musculus
ttagtctgtctcaaggtaaatcctc

SEQ ID NO: 924226 - DNA, 25 bp, Mus musculus
ttagtctgtctctaggtaaatcctc

SEQ ID NO: 924227 - DNA, 25 bp, Mus musculus
ttagtcttaagtcaccatcttcctg

SEQ ID NO: 924228 - DNA, 25 bp, Mus musculus
ttagtcttaagtgaccatcttcctg

SEQ ID NO: 924229 - DNA, 25 bp, Mus musculus
ttagtcttagttatttgtttcttgg

SEQ ID NO: 924230 - DNA, 25 bp, Mus musculus
ttagtcttagttttttgtttcttgg

SEQ ID NO: 924231 - DNA, 25 bp, Mus musculus
ttagtctttaacatcgtgtccatat

SEQ ID NO: 924232 - DNA, 25 bp, Mus musculus
ttagtctttaacttcgtgtccatat

SEQ ID NO: 924233 - DNA, 25 bp, Mus musculus
ttagtctttgcaaatggatctgtca

SEQ ID NO: 924234 - DNA, 25 bp, Mus musculus
ttagtctttgcatatggatctgtca

SEQ ID NO: 924235 - DNA, 25 bp, Mus musculus
ttagtgaactttaagctgcggtgca

SEQ ID NO: 924236 - DNA, 25 bp, Mus musculus
ttagtgaacttttagctgcggtgca

SEQ ID NO: 924237 - DNA, 25 bp, Mus musculus
ttagtgaataaacacctgtgagcag

SEQ ID NO: 924238 - DNA, 25 bp, Mus musculus
ttagtgaataaagacctgtgagcag

SEQ ID NO: 924239 - DNA, 25 bp, Mus musculus
ttagtgaatgatctggcccaccagc

SEQ ID NO: 924240 - DNA, 25 bp, Mus musculus
ttagtgaatgatgtggcccaccagc

SEQ ID NO: 924241 - DNA, 25 bp, Mus musculus
ttagtgacccagctgccgtgtcttg

SEQ ID NO: 924242 - DNA, 25 bp, Mus musculus
ttagtgacccaggtgccgtgtcttg

SEQ ID NO: 924243 - DNA, 25 bp, Mus musculus
ttagtgaccctaatccagtttctct

SEQ ID NO: 924244 - DNA, 25 bp, Mus musculus
ttagtgaccctattccagtttctct

SEQ ID NO: 924245 - DNA, 25 bp, Mus musculus
ttagtgaccctcaaaaggagcctat

SEQ ID NO: 924246 - DNA, 25 bp, Mus musculus
ttagtgaccctctaaaggagcctat

SEQ ID NO: 924247 - DNA, 25 bp, Mus musculus
ttagtgactgaactatctccccagc

SEQ ID NO: 924248 - DNA, 25 bp, Mus musculus
ttagtgactgaagtatctccccagc

SEQ ID NO: 924249 - DNA, 25 bp, Mus musculus
ttagtgacttaactctgtcccctgt

SEQ ID NO: 924250 - DNA, 25 bp, Mus musculus
ttagtgacttaagtctgtcccctgt

SEQ ID NO: 924251 - DNA, 25 bp, Mus musculus
ttagtgagagacaaccttctgcctc

SEQ ID NO: 924252 - DNA, 25 bp, Mus musculus
ttagtgagagactaccttctgcctc

SEQ ID NO: 924253 - DNA, 25 bp, Mus musculus
ttagtgagcgccacaaggtacagcc

SEQ ID NO: 924254 - DNA, 25 bp, Mus musculus
ttagtgagcgcctcaaggtacagcc

SEQ ID NO: 924255 - DNA, 25 bp, Mus musculus
ttagtgagctctcgtcgcttcaggg

SEQ ID NO: 924256 - DNA, 25 bp, Mus musculus
ttagtgagctctggtcgcttcaggg

SEQ ID NO: 924257 - DNA, 25 bp, Mus musculus
ttagtgaggcacactcccaggcagt

SEQ ID NO: 924258 - DNA, 25 bp, Mus musculus
ttagtgaggcactctcccaggcagt

SEQ ID NO: 924259 - DNA, 25 bp, Mus musculus
ttagtgagtacacagcttgccaagc

SEQ ID NO: 924260 - DNA, 25 bp, Mus musculus
ttagtgagtacagagcttgccaagc

SEQ ID NO: 924261 - DNA, 25 bp, Mus musculus
ttagtgataacacctcctgcgatgt

SEQ ID NO: 924262 - DNA, 25 bp, Mus musculus
ttagtgataacagctcctgcgatgt

SEQ ID NO: 924263 - DNA, 25 bp, Mus musculus
ttagtgatcccacactgcatcaact

SEQ ID NO: 924264 - DNA, 25 bp, Mus musculus
ttagtgatcccagactgcatcaact

SEQ ID NO: 924265 - DNA, 25 bp, Mus musculus
ttagtgatccccatagtcggaaaat

SEQ ID NO: 924266 - DNA, 25 bp, Mus musculus
ttagtgatccccttagtcggaaaat

SEQ ID NO: 924267 - DNA, 25 bp, Mus musculus
ttagtgatgatgctctcccgggcga

SEQ ID NO: 924268 - DNA, 25 bp, Mus musculus
ttagtgatgatggtctcccgggcga

SEQ ID NO: 924269 - DNA, 25 bp, Mus musculus
ttagtgattcggactctgggagctc

SEQ ID NO: 924270 - DNA, 25 bp, Mus musculus
ttagtgattcggtctctgggagctc

SEQ ID NO: 924271 - DNA, 25 bp, Mus musculus
ttagtgcaggaaatcacccttccca

SEQ ID NO: 924272 - DNA, 25 bp, Mus musculus
ttagtgcaggaattcacccttccca

SEQ ID NO: 924273 - DNA, 25 bp, Mus musculus
ttagtgcatgtgcttcgcttgtttt

SEQ ID NO: 924274 - DNA, 25 bp, Mus musculus
ttagtgcatgtggttcgcttgtttt

SEQ ID NO: 924275 - DNA, 25 bp, Mus musculus
ttagtgccatcaagaatcccatttg

SEQ ID NO: 924276 - DNA, 25 bp, Mus musculus
ttagtgccatcatgaatcccatttg

SEQ ID NO: 924277 - DNA, 25 bp, Mus musculus
ttagtgccctacagtctagacggtt

SEQ ID NO: 924278 - DNA, 25 bp, Mus musculus
ttagtgccctactgtctagacggtt

SEQ ID NO: 924279 - DNA, 25 bp, Mus musculus
ttagtgcccttcagtgttgagtgaa

SEQ ID NO: 924280 - DNA, 25 bp, Mus musculus
ttagtgcccttctgtgttgagtgaa

SEQ ID NO: 924281 - DNA, 25 bp, Mus musculus
ttagtgccctttcgtgcaatcctga

SEQ ID NO: 924282 - DNA, 25 bp, Mus musculus
ttagtgccctttggtgcaatcctga

SEQ ID NO: 924283 - DNA, 25 bp, Mus musculus
ttagtgccgatacactgtggcccac

SEQ ID NO: 924284 - DNA, 25 bp, Mus musculus
ttagtgccgatagactgtggcccac

SEQ ID NO: 924285 - DNA, 25 bp, Mus musculus
ttagtgccgttcacaacgcttgctt

SEQ ID NO: 924286 - DNA, 25 bp, Mus musculus
ttagtgccgttctcaacgcttgctt

SEQ ID NO: 924287 - DNA, 25 bp, Mus musculus
ttagtgcctgtgagtggctgatgta

SEQ ID NO: 924288 - DNA, 25 bp, Mus musculus
ttagtgcctgtgtgtggctgatgta

SEQ ID NO: 924289 - DNA, 25 bp, Mus musculus
ttagtgcctgttcgacttttacctt

SEQ ID NO: 924290 - DNA, 25 bp, Mus musculus
ttagtgcctgttggacttttacctt

SEQ ID NO: 924291 - DNA, 25 bp, Mus musculus
ttagtgcctttgagctgaccctgca

SEQ ID NO: 924292 - DNA, 25 bp, Mus musculus
ttagtgcctttgtgctgaccctgca

SEQ ID NO: 924293 - DNA, 25 bp, Mus musculus
ttagtgcgacttatacagacaccaa

SEQ ID NO: 924294 - DNA, 25 bp, Mus musculus
ttagtgcgacttttacagacaccaa

SEQ ID NO: 924295 - DNA, 25 bp, Mus musculus
ttagtgcggccactgactgcttcaa

SEQ ID NO: 924296 - DNA, 25 bp, Mus musculus
ttagtgcggccagtgactgcttcaa

SEQ ID NO: 924297 - DNA, 25 bp, Mus musculus
ttagtgctaattctactccactcct

SEQ ID NO: 924298 - DNA, 25 bp, Mus musculus
ttagtgctaattgtactccactcct

SEQ ID NO: 924299 - DNA, 25 bp, Mus musculus
ttagtgctagccctcctagagttac

SEQ ID NO: 924300 - DNA, 25 bp, Mus musculus
ttagtgctagccgtcctagagttac

SEQ ID NO: 924301 - DNA, 25 bp, Mus musculus
ttagtgctgaaaactcataaacaga

SEQ ID NO: 924302 - DNA, 25 bp, Mus musculus
ttagtgctgaaatctcataaacaga

SEQ ID NO: 924303 - DNA, 25 bp, Mus musculus
ttagtgctggctctagctaccttct

SEQ ID NO: 924304 - DNA, 25 bp, Mus musculus
ttagtgctggctgtagctaccttct

SEQ ID NO: 924305 - DNA, 25 bp, Mus musculus
ttagtgctggtgaagtttgaaaatc

SEQ ID NO: 924306 - DNA, 25 bp, Mus musculus
ttagtgctggtgtagtttgaaaatc

SEQ ID NO: 924307 - DNA, 25 bp, Mus musculus
ttagtgcttgaacttggctctctat

SEQ ID NO: 924308 - DNA, 25 bp, Mus musculus
ttagtgcttgaagttggctctctat

SEQ ID NO: 924309 - DNA, 25 bp, Mus musculus
ttagtgcttgccaggtggtagagaa

SEQ ID NO: 924310 - DNA, 25 bp, Mus musculus
ttagtgcttgcctggtggtagagaa

SEQ ID NO: 924311 - DNA, 25 bp, Mus musculus
ttagtgcttgttcacatgttctcaa

SEQ ID NO: 924312 - DNA, 25 bp, Mus musculus
ttagtgcttgttgacatgttctcaa

SEQ ID NO: 924313 - DNA, 25 bp, Mus musculus
ttagtggaaactctggtccctagcc

SEQ ID NO: 924314 - DNA, 25 bp, Mus musculus
ttagtggaaactgtggtccctagcc

SEQ ID NO: 924315 - DNA, 25 bp, Mus musculus
ttagtggaacaccagcagaaggtac

SEQ ID NO: 924316 - DNA, 25 bp, Mus musculus
ttagtggaacacgagcagaaggtac

SEQ ID NO: 924317 - DNA, 25 bp, Mus musculus
ttagtggaccgtacctggagtcaac

SEQ ID NO: 924318 - DNA, 25 bp, Mus musculus
ttagtggaccgttcctggagtcaac

SEQ ID NO: 924319 - DNA, 25 bp, Mus musculus
ttagtggatcacacctgcaggctca

SEQ ID NO: 924320 - DNA, 25 bp, Mus musculus
ttagtggatcactcctgcaggctca

SEQ ID NO: 924321 - DNA, 25 bp, Mus musculus
ttagtggatcccatggctgacacgc

SEQ ID NO: 924322 - DNA, 25 bp, Mus musculus
ttagtggatcccttggctgacacgc

SEQ ID NO: 924323 - DNA, 25 bp, Mus musculus
ttagtggcatacaagagaaggccct

SEQ ID NO: 924324 - DNA, 25 bp, Mus musculus
ttagtggcatactagagaaggccct

SEQ ID NO: 924325 - DNA, 25 bp, Mus musculus
ttagtggccaacaatcaaccgatta

SEQ ID NO: 924326 - DNA, 25 bp, Mus musculus
ttagtggccaactatcaaccgatta

SEQ ID NO: 924327 - DNA, 25 bp, Mus musculus
ttagtggctgtcagaaaccccatgt

SEQ ID NO: 924328 - DNA, 25 bp, Mus musculus
ttagtggctgtctgaaaccccatgt

SEQ ID NO: 924329 - DNA, 25 bp, Mus musculus
ttagtggcttttccctagctgaggc

SEQ ID NO: 924330 - DNA, 25 bp, Mus musculus
ttagtggcttttgcctagctgaggc

SEQ ID NO: 924331 - DNA, 25 bp, Mus musculus
ttagtgggacacagggttggcatta

SEQ ID NO: 924332 - DNA, 25 bp, Mus musculus
ttagtgggacactgggttggcatta

SEQ ID NO: 924333 - DNA, 25 bp, Mus musculus
ttagtgggcactataggcccctatg

SEQ ID NO: 924334 - DNA, 25 bp, Mus musculus
ttagtgggcactttaggcccctatg

SEQ ID NO: 924335 - DNA, 25 bp, Mus musculus
ttagtgggcgcgcactccttgtcat

SEQ ID NO: 924336 - DNA, 25 bp, Mus musculus
ttagtgggcgcggactccttgtcat

SEQ ID NO: 924337 - DNA, 25 bp, Mus musculus
ttagtggtacttctcagccaaggct

SEQ ID NO: 924338 - DNA, 25 bp, Mus musculus
ttagtggtacttgtcagccaaggct

SEQ ID NO: 924339 - DNA, 25 bp, Mus musculus
ttagtggtagagatattgcctggca

SEQ ID NO: 924340 - DNA, 25 bp, Mus musculus
ttagtggtagagttattgcctggca

SEQ ID NO: 924341 - DNA, 25 bp, Mus musculus
ttagtggtcagacacaggatagaca

SEQ ID NO: 924342 - DNA, 25 bp, Mus musculus
ttagtggtcagacccttgcccgagc

SEQ ID NO: 924343 - DNA, 25 bp, Mus musculus
ttagtggtcagagacaggatagaca

SEQ ID NO: 924344 - DNA, 25 bp, Mus musculus
ttagtggtcagagccttgcccgagc

SEQ ID NO: 924345 - DNA, 25 bp, Mus musculus
ttagtggtcagtcaggtcctcagca

SEQ ID NO: 924346 - DNA, 25 bp, Mus musculus
ttagtggtcagtgaggtcctcagca

SEQ ID NO: 924347 - DNA, 25 bp, Mus musculus
ttagtggtcccgctgccacagagaa

SEQ ID NO: 924348 - DNA, 25 bp, Mus musculus
ttagtggtcccggtgccacagagaa

SEQ ID NO: 924349 - DNA, 25 bp, Mus musculus
ttagtggtgcacatactcctcatat

SEQ ID NO: 924350 - DNA, 25 bp, Mus musculus
ttagtggtgcacttactcctcatat

SEQ ID NO: 924351 - DNA, 25 bp, Mus musculus
ttagtggtgtaaaccgaggtgcatt

SEQ ID NO: 924352 - DNA, 25 bp, Mus musculus
ttagtggtgtaatccgaggtgcatt

SEQ ID NO: 924353 - DNA, 25 bp, Mus musculus
ttagtggttagtcgttgcttcccga

SEQ ID NO: 924354 - DNA, 25 bp, Mus musculus
ttagtggttagtggttgcttcccga

SEQ ID NO: 924355 - DNA, 25 bp, Mus musculus
ttagtggttcaaaccaaacacacag

SEQ ID NO: 924356 - DNA, 25 bp, Mus musculus
ttagtggttcaatccaaacacacag

SEQ ID NO: 924357 - DNA, 25 bp, Mus musculus
ttagtgtaactaaatgtccctccag

SEQ ID NO: 924358 - DNA, 25 bp, Mus musculus
ttagtgtaactatatgtccctccag

SEQ ID NO: 924359 - DNA, 25 bp, Mus musculus
ttagtgtaccctcctgttacagctt

SEQ ID NO: 924360 - DNA, 25 bp, Mus musculus
ttagtgtaccctgctgttacagctt

SEQ ID NO: 924361 - DNA, 25 bp, Mus musculus
ttagtgtacgatcctgattatcaca

SEQ ID NO: 924362 - DNA, 25 bp, Mus musculus
ttagtgtacgatgctgattatcaca

SEQ ID NO: 924363 - DNA, 25 bp, Mus musculus
ttagtgtcacacagagggcagaagg

SEQ ID NO: 924364 - DNA, 25 bp, Mus musculus
ttagtgtcacactgagggcagaagg

SEQ ID NO: 924365 - DNA, 25 bp, Mus musculus
ttagtgtcactgacagcacctggtg

SEQ ID NO: 924366 - DNA, 25 bp, Mus musculus
ttagtgtcactgtcagcacctggtg

SEQ ID NO: 924367 - DNA, 25 bp, Mus musculus
ttagtgtcatcacatctcactgctg

SEQ ID NO: 924368 - DNA, 25 bp, Mus musculus
ttagtgtcatcagatctcactgctg

SEQ ID NO: 924369 - DNA, 25 bp, Mus musculus
ttagtgtccagaagaatccgagtac

SEQ ID NO: 924370 - DNA, 25 bp, Mus musculus
ttagtgtccagatgaatccgagtac

SEQ ID NO: 924371 - DNA, 25 bp, Mus musculus
ttagtgtcccagatgcatgcatagt

SEQ ID NO: 924372 - DNA, 25 bp, Mus musculus
ttagtgtcccagttgcatgcatagt

SEQ ID NO: 924373 - DNA, 25 bp, Mus musculus
ttagtgtccctcatcaactccagag

SEQ ID NO: 924374 - DNA, 25 bp, Mus musculus
ttagtgtccctcttcaactccagag

SEQ ID NO: 924375 - DNA, 25 bp, Mus musculus
ttagtgtcgtgccagtgaaatgtgt

SEQ ID NO: 924376 - DNA, 25 bp, Mus musculus
ttagtgtcgtgcgagtgaaatgtgt

SEQ ID NO: 924377 - DNA, 25 bp, Mus musculus
ttagtgtctgttcgcagttttgagc

SEQ ID NO: 924378 - DNA, 25 bp, Mus musculus
ttagtgtctgttggcagttttgagc

SEQ ID NO: 924379 - DNA, 25 bp, Mus musculus
ttagtgtcttctcattgggaatgca

SEQ ID NO: 924380 - DNA, 25 bp, Mus musculus
ttagtgtcttctgattgggaatgca

SEQ ID NO: 924381 - DNA, 25 bp, Mus musculus
ttagtgtgatacagtcattgagagt

SEQ ID NO: 924382 - DNA, 25 bp, Mus musculus
ttagtgtgatactgtcattgagagt

SEQ ID NO: 924383 - DNA, 25 bp, Mus musculus
ttagtgtggacccagtctaggcacc

SEQ ID NO: 924384 - DNA, 25 bp, Mus musculus
ttagtgtggacccttccagatgcct

SEQ ID NO: 924385 - DNA, 25 bp, Mus musculus
ttagtgtggaccgagtctaggcacc

SEQ ID NO: 924386 - DNA, 25 bp, Mus musculus
ttagtgtggaccgttccagatgcct

SEQ ID NO: 924387 - DNA, 25 bp, Mus musculus
ttagtgtggatgacccgtgttcctt

SEQ ID NO: 924388 - DNA, 25 bp, Mus musculus
ttagtgtggatgtcccgtgttcctt

SEQ ID NO: 924389 - DNA, 25 bp, Mus musculus
ttagtgtggcacatctttctttgta

SEQ ID NO: 924390 - DNA, 25 bp, Mus musculus
ttagtgtggcacttctttctttgta

SEQ ID NO: 924391 - DNA, 25 bp, Mus musculus
ttagtgtgggctactccatgtgaga

SEQ ID NO: 924392 - DNA, 25 bp, Mus musculus
ttagtgtgggcttctccatgtgaga

SEQ ID NO: 924393 - DNA, 25 bp, Mus musculus
ttagtgtgggtcagctggattttct

SEQ ID NO: 924394 - DNA, 25 bp, Mus musculus
ttagtgtgggtctgctggattttct

SEQ ID NO: 924395 - DNA, 25 bp, Mus musculus
ttagtgtgtgaaaagccagagctgt

SEQ ID NO: 924396 - DNA, 25 bp, Mus musculus
ttagtgtgtgaatagccagagctgt

SEQ ID NO: 924397 - DNA, 25 bp, Mus musculus
ttagtgtgtgtgatgctgtcctgga

SEQ ID NO: 924398 - DNA, 25 bp, Mus musculus
ttagtgtgtgtgttgctgtcctgga

SEQ ID NO: 924399 - DNA, 25 bp, Mus musculus
ttagtgttacacattggactttgaa

SEQ ID NO: 924400 - DNA, 25 bp, Mus musculus
ttagtgttacactttggactttgaa

SEQ ID NO: 924401 - DNA, 25 bp, Mus musculus
ttagtgttagttctgcatccccata

SEQ ID NO: 924402 - DNA, 25 bp, Mus musculus
ttagtgttagttgtgcatccccata

SEQ ID NO: 924403 - DNA, 25 bp, Mus musculus
ttagtgttcaccagctgagatctgt

SEQ ID NO: 924404 - DNA, 25 bp, Mus musculus
ttagtgttcacctgctgagatctgt

SEQ ID NO: 924405 - DNA, 25 bp, Mus musculus
ttagtgttcactcctgggctgcaga

SEQ ID NO: 924406 - DNA, 25 bp, Mus musculus
ttagtgttcactgctgggctgcaga

SEQ ID NO: 924407 - DNA, 25 bp, Mus musculus
ttagtgttcctaacctctaagccct

SEQ ID NO: 924408 - DNA, 25 bp, Mus musculus
ttagtgttcctatcctctaagccct

SEQ ID NO: 924409 - DNA, 25 bp, Mus musculus
ttagtgttgaccacacttcactcaa

SEQ ID NO: 924410 - DNA, 25 bp, Mus musculus
ttagtgttgacctcacttcactcaa

SEQ ID NO: 924411 - DNA, 25 bp, Mus musculus
ttagtgttggatctaaggcttaagc

SEQ ID NO: 924412 - DNA, 25 bp, Mus musculus
ttagtgttggatgtaaggcttaagc

SEQ ID NO: 924413 - DNA, 25 bp, Mus musculus
ttagtgttgttaagtccctcttttt

SEQ ID NO: 924414 - DNA, 25 bp, Mus musculus
ttagtgttgttatgtccctcttttt

SEQ ID NO: 924415 - DNA, 25 bp, Mus musculus
ttagtgtttcccatgggtacaggat

SEQ ID NO: 924416 - DNA, 25 bp, Mus musculus
ttagtgtttcccttgggtacaggat

SEQ ID NO: 924417 - DNA, 25 bp, Mus musculus
ttagttaacaccctcaacaaccctg

SEQ ID NO: 924418 - DNA, 25 bp, Mus musculus
ttagttaacaccgtcaacaaccctg

SEQ ID NO: 924419 - DNA, 25 bp, Mus musculus
ttagttaatataatcctcatggaca

SEQ ID NO: 924420 - DNA, 25 bp, Mus musculus
ttagttaatatattcctcatggaca

SEQ ID NO: 924421 - DNA, 25 bp, Mus musculus
ttagttacagtgctggcactttcta

SEQ ID NO: 924422 - DNA, 25 bp, Mus musculus
ttagttacagtggtggcactttcta

SEQ ID NO: 924423 - DNA, 25 bp, Mus musculus
ttagttacttcaattggctccgttg

SEQ ID NO: 924424 - DNA, 25 bp, Mus musculus
ttagttacttcatttggctccgttg

SEQ ID NO: 924425 - DNA, 25 bp, Mus musculus
ttagttacttgtaattgcctgctgg

SEQ ID NO: 924426 - DNA, 25 bp, Mus musculus
ttagttacttgttattgcctgctgg

SEQ ID NO: 924427 - DNA, 25 bp, Mus musculus
ttagttagctccattttctctgggc

SEQ ID NO: 924428 - DNA, 25 bp, Mus musculus
ttagttagctcctttttctctgggc

SEQ ID NO: 924429 - DNA, 25 bp, Mus musculus
ttagttagtttcatcatggctcccc

SEQ ID NO: 924430 - DNA, 25 bp, Mus musculus
ttagttagtttcttcatggctcccc

SEQ ID NO: 924431 - DNA, 25 bp, Mus musculus
ttagttatcattaagggccaaaagt

SEQ ID NO: 924432 - DNA, 25 bp, Mus musculus
ttagttatcatttagggccaaaagt

SEQ ID NO: 924433 - DNA, 25 bp, Mus musculus
ttagttattaccagccctccagata

SEQ ID NO: 924434 - DNA, 25 bp, Mus musculus
ttagttattacctgccctccagata

SEQ ID NO: 924435 - DNA, 25 bp, Mus musculus
ttagttatttccatatcgtgtgctt

SEQ ID NO: 924436 - DNA, 25 bp, Mus musculus
ttagttatttccttatcgtgtgctt

SEQ ID NO: 924437 - DNA, 25 bp, Mus musculus
ttagttcacaatatccactgtactt

SEQ ID NO: 924438 - DNA, 25 bp, Mus musculus
ttagttcacaatttccactgtactt

SEQ ID NO: 924439 - DNA, 25 bp, Mus musculus
ttagttcactgaaatccatcaagta

SEQ ID NO: 924440 - DNA, 25 bp, Mus musculus
ttagttcactgatatccatcaagta

SEQ ID NO: 924441 - DNA, 25 bp, Mus musculus
ttagttcagatgactcttctagatc

SEQ ID NO: 924442 - DNA, 25 bp, Mus musculus
ttagttcagatgtctcttctagatc

SEQ ID NO: 924443 - DNA, 25 bp, Mus musculus
ttagttccaacacgacactttgctt

SEQ ID NO: 924444 - DNA, 25 bp, Mus musculus
ttagttccaacaggacactttgctt

SEQ ID NO: 924445 - DNA, 25 bp, Mus musculus
ttagttccaaggacctcctgttcag

SEQ ID NO: 924446 - DNA, 25 bp, Mus musculus
ttagttccaaggtcctcctgttcag

SEQ ID NO: 924447 - DNA, 25 bp, Mus musculus
ttagttccactcaactatcagccat

SEQ ID NO: 924448 - DNA, 25 bp, Mus musculus
ttagttccactctactatcagccat

SEQ ID NO: 924449 - DNA, 25 bp, Mus musculus
ttagttccaggtcggtctcctaaag

SEQ ID NO: 924450 - DNA, 25 bp, Mus musculus
ttagttccaggtgggtctcctaaag

SEQ ID NO: 924451 - DNA, 25 bp, Mus musculus
ttagttccattcagttcctgccggc

SEQ ID NO: 924452 - DNA, 25 bp, Mus musculus
ttagttccattctgttcctgccggc

SEQ ID NO: 924453 - DNA, 25 bp, Mus musculus
ttagttcccagcatagacatgttca

SEQ ID NO: 924454 - DNA, 25 bp, Mus musculus
ttagttcccagcttagacatgttca

SEQ ID NO: 924455 - DNA, 25 bp, Mus musculus
ttagttcccttcctggaggatctaa

SEQ ID NO: 924456 - DNA, 25 bp, Mus musculus
ttagttcccttcgtggaggatctaa

SEQ ID NO: 924457 - DNA, 25 bp, Mus musculus
ttagttcccttgctgctacatgtat

SEQ ID NO: 924458 - DNA, 25 bp, Mus musculus
ttagttcccttggtgctacatgtat

SEQ ID NO: 924459 - DNA, 25 bp, Mus musculus
ttagttcctgcacgagatcactccc

SEQ ID NO: 924460 - DNA, 25 bp, Mus musculus
ttagttcctgcaggagatcactccc

SEQ ID NO: 924461 - DNA, 25 bp, Mus musculus
ttagttcctggaccacgggtgtatg

SEQ ID NO: 924462 - DNA, 25 bp, Mus musculus
ttagttcctggagcacgggtgtatg

SEQ ID NO: 924463 - DNA, 25 bp, Mus musculus
ttagttcctggtactcacatggctg

SEQ ID NO: 924464 - DNA, 25 bp, Mus musculus
ttagttcctggttctcacatggctg

SEQ ID NO: 924465 - DNA, 25 bp, Mus musculus
ttagttctacttattggtgcaatcc

SEQ ID NO: 924466 - DNA, 25 bp, Mus musculus
ttagttctactttttggtgcaatcc

SEQ ID NO: 924467 - DNA, 25 bp, Mus musculus
ttagttctcataaaaccgtgttttt

SEQ ID NO: 924468 - DNA, 25 bp, Mus musculus
ttagttctcatataaccgtgttttt

SEQ ID NO: 924469 - DNA, 25 bp, Mus musculus
ttagttctctggagctccgtagtag

SEQ ID NO: 924470 - DNA, 25 bp, Mus musculus
ttagttctctggtgctccgtagtag

SEQ ID NO: 924471 - DNA, 25 bp, Mus musculus
ttagttctgcaacaactcccagcct

SEQ ID NO: 924472 - DNA, 25 bp, Mus musculus
ttagttctgcaagaactcccagcct

SEQ ID NO: 924473 - DNA, 25 bp, Mus musculus
ttagttctggcgataattcccagga

SEQ ID NO: 924474 - DNA, 25 bp, Mus musculus
ttagttctggcgttaattcccagga

SEQ ID NO: 924475 - DNA, 25 bp, Mus musculus
ttagttctggttcttttggccccat

SEQ ID NO: 924476 - DNA, 25 bp, Mus musculus
ttagttctggttgttttggccccat

SEQ ID NO: 924477 - DNA, 25 bp, Mus musculus
ttagttctgttcataccttagctca

SEQ ID NO: 924478 - DNA, 25 bp, Mus musculus
ttagttctgttcttaccttagctca

SEQ ID NO: 924479 - DNA, 25 bp, Mus musculus
ttagttcttagcattgccctttgat

SEQ ID NO: 924480 - DNA, 25 bp, Mus musculus
ttagttcttagctttgccctttgat

SEQ ID NO: 924481 - DNA, 25 bp, Mus musculus
ttagttcttcagcaacaccactttc

SEQ ID NO: 924482 - DNA, 25 bp, Mus musculus
ttagttcttcaggaacaccactttc

SEQ ID NO: 924483 - DNA, 25 bp, Mus musculus
ttagttcttcttaagcctggccctt

SEQ ID NO: 924484 - DNA, 25 bp, Mus musculus
ttagttcttctttagcctggccctt

SEQ ID NO: 924485 - DNA, 25 bp, Mus musculus
ttagttcttttcagcatgttccttc

SEQ ID NO: 924486 - DNA, 25 bp, Mus musculus
ttagttcttttctgcatgttccttc

SEQ ID NO: 924487 - DNA, 25 bp, Mus musculus
ttagttcttttgaacctttgaagat

SEQ ID NO: 924488 - DNA, 25 bp, Mus musculus
ttagttcttttgtacctttgaagat

SEQ ID NO: 924489 - DNA, 25 bp, Mus musculus
ttagttctttttcaggccaccagac

SEQ ID NO: 924490 - DNA, 25 bp, Mus musculus
ttagttctttttgaggccaccagac

SEQ ID NO: 924491 - DNA, 25 bp, Mus musculus
ttagttgaatcacgccccttcaagt

SEQ ID NO: 924492 - DNA, 25 bp, Mus musculus
ttagttgaatcaggccccttcaagt

SEQ ID NO: 924493 - DNA, 25 bp, Mus musculus
ttagttgacctgaacagtgagagca

SEQ ID NO: 924494 - DNA, 25 bp, Mus musculus
ttagttgacctgtacagtgagagca

SEQ ID NO: 924495 - DNA, 25 bp, Mus musculus
ttagttgatagactgcctgcctagc

SEQ ID NO: 924496 - DNA, 25 bp, Mus musculus
ttagttgatagagtgcctgcctagc

SEQ ID NO: 924497 - DNA, 25 bp, Mus musculus
ttagttgatatacgaagacccagcc

SEQ ID NO: 924498 - DNA, 25 bp, Mus musculus
ttagttgatataggaagacccagcc

SEQ ID NO: 924499 - DNA, 25 bp, Mus musculus
ttagttgatcttcaagaccacagag

SEQ ID NO: 924500 - DNA, 25 bp, Mus musculus
ttagttgatcttgaagaccacagag

SEQ ID NO: 924501 - DNA, 25 bp, Mus musculus
ttagttgcaacaaggaacagttaca

SEQ ID NO: 924502 - DNA, 25 bp, Mus musculus
ttagttgcaacatggaacagttaca

SEQ ID NO: 924503 - DNA, 25 bp, Mus musculus
ttagttgcaatgcacctctaggtgg

SEQ ID NO: 924504 - DNA, 25 bp, Mus musculus
ttagttgcaatggacctctaggtgg

SEQ ID NO: 924505 - DNA, 25 bp, Mus musculus
ttagttgcaggcactgatgcttctg

SEQ ID NO: 924506 - DNA, 25 bp, Mus musculus
ttagttgcaggctctgatgcttctg

SEQ ID NO: 924507 - DNA, 25 bp, Mus musculus
ttagttgcatctatcgatcctagct

SEQ ID NO: 924508 - DNA, 25 bp, Mus musculus
ttagttgcatctttcgatcctagct

SEQ ID NO: 924509 - DNA, 25 bp, Mus musculus
ttagttgccatgagttgtagaccca

SEQ ID NO: 924510 - DNA, 25 bp, Mus musculus
ttagttgccatgtgttgtagaccca

SEQ ID NO: 924511 - DNA, 25 bp, Mus musculus
ttagttgccttgaagaacactgcga

SEQ ID NO: 924512 - DNA, 25 bp, Mus musculus
ttagttgccttgtagaacactgcga

SEQ ID NO: 924513 - DNA, 25 bp, Mus musculus
ttagttgctaaccaaccacgccatt

SEQ ID NO: 924514 - DNA, 25 bp, Mus musculus
ttagttgctaacgaaccacgccatt

SEQ ID NO: 924515 - DNA, 25 bp, Mus musculus
ttagttgctctgaagtgtccagctt

SEQ ID NO: 924516 - DNA, 25 bp, Mus musculus
ttagttgctctgtagtgtccagctt

SEQ ID NO: 924517 - DNA, 25 bp, Mus musculus
ttagttgggaggcttcgaactctag

SEQ ID NO: 924518 - DNA, 25 bp, Mus musculus
ttagttgggagggttcgaactctag

SEQ ID NO: 924519 - DNA, 25 bp, Mus musculus
ttagttgggccacgatagctctatc

SEQ ID NO: 924520 - DNA, 25 bp, Mus musculus
ttagttgggccaggatagctctatc

SEQ ID NO: 924521 - DNA, 25 bp, Mus musculus
ttagttggtcatctagtcagtgttg

SEQ ID NO: 924522 - DNA, 25 bp, Mus musculus
ttagttggtcatgtagtcagtgttg

SEQ ID NO: 924523 - DNA, 25 bp, Mus musculus
ttagttggttggctgtccgtttcac

SEQ ID NO: 924524 - DNA, 25 bp, Mus musculus
ttagttggttgggtgtccgtttcac

SEQ ID NO: 924525 - DNA, 25 bp, Mus musculus
ttagttgtctcacagctgagggctc

SEQ ID NO: 924526 - DNA, 25 bp, Mus musculus
ttagttgtctcagagctgagggctc

SEQ ID NO: 924527 - DNA, 25 bp, Mus musculus
ttagttgtgcacatgaggctgacag

SEQ ID NO: 924528 - DNA, 25 bp, Mus musculus
ttagttgtgcacttgaggctgacag

SEQ ID NO: 924529 - DNA, 25 bp, Mus musculus
ttagtttaactcacaggtactgtct

SEQ ID NO: 924530 - DNA, 25 bp, Mus musculus
ttagtttaactctcaggtactgtct

SEQ ID NO: 924531 - DNA, 25 bp, Mus musculus
ttagtttatctgacttcctgaagac

SEQ ID NO: 924532 - DNA, 25 bp, Mus musculus
ttagtttatctgtcttcctgaagac

SEQ ID NO: 924533 - DNA, 25 bp, Mus musculus
ttagtttattttagctgctgggaaa

SEQ ID NO: 924534 - DNA, 25 bp, Mus musculus
ttagtttatttttgctgctgggaaa

SEQ ID NO: 924535 - DNA, 25 bp, Mus musculus
ttagtttcagaacgtatcacgtaca

SEQ ID NO: 924536 - DNA, 25 bp, Mus musculus
ttagtttcagaaggtatcacgtaca

SEQ ID NO: 924537 - DNA, 25 bp, Mus musculus
ttagtttccaatacacccaatgcca

SEQ ID NO: 924538 - DNA, 25 bp, Mus musculus
ttagtttccaattcacccaatgcca

SEQ ID NO: 924539 - DNA, 25 bp, Mus musculus
ttagtttccctaaccacagcgagga

SEQ ID NO: 924540 - DNA, 25 bp, Mus musculus
ttagtttccctatccacagcgagga

SEQ ID NO: 924541 - DNA, 25 bp, Mus musculus
ttagtttccctgaattatcaaagag

SEQ ID NO: 924542 - DNA, 25 bp, Mus musculus
ttagtttccctgtattatcaaagag

SEQ ID NO: 924543 - DNA, 25 bp, Mus musculus
ttagtttccgccagtacgaccagtg

SEQ ID NO: 924544 - DNA, 25 bp, Mus musculus
ttagtttccgcctgtacgaccagtg

SEQ ID NO: 924545 - DNA, 25 bp, Mus musculus
ttagtttcctgaccctggcttggac

SEQ ID NO: 924546 - DNA, 25 bp, Mus musculus
ttagtttcctgagcctggcttggac

SEQ ID NO: 924547 - DNA, 25 bp, Mus musculus
ttagtttctccaagtgagtctcctt

SEQ ID NO: 924548 - DNA, 25 bp, Mus musculus
ttagtttctccatgtgagtctcctt

SEQ ID NO: 924549 - DNA, 25 bp, Mus musculus
ttagtttctgtacaagcatccgtgt

SEQ ID NO: 924550 - DNA, 25 bp, Mus musculus
ttagtttctgtagaagcatccgtgt

SEQ ID NO: 924551 - DNA, 25 bp, Mus musculus
ttagtttgacaactaatagaatcct

SEQ ID NO: 924552 - DNA, 25 bp, Mus musculus
ttagtttgacaagtaatagaatcct

SEQ ID NO: 924553 - DNA, 25 bp, Mus musculus
ttagtttgaccaagagaccctgtct

SEQ ID NO: 924554 - DNA, 25 bp, Mus musculus
ttagtttgaccatgagaccctgtct

SEQ ID NO: 924555 - DNA, 25 bp, Mus musculus
ttagtttgatccatggagcccacat

SEQ ID NO: 924556 - DNA, 25 bp, Mus musculus
ttagtttgatccttggagcccacat

SEQ ID NO: 924557 - DNA, 25 bp, Mus musculus
ttagtttggagccttcccacactct

SEQ ID NO: 924558 - DNA, 25 bp, Mus musculus
ttagtttggagcgttcccacactct

SEQ ID NO: 924559 - DNA, 25 bp, Mus musculus
ttagtttgtgccagtcttgtgctca

SEQ ID NO: 924560 - DNA, 25 bp, Mus musculus
ttagtttgtgcctgtcttgtgctca

SEQ ID NO: 924561 - DNA, 25 bp, Mus musculus
ttagtttgttaaatgattaagctgt

SEQ ID NO: 924562 - DNA, 25 bp, Mus musculus
ttagtttgttaattgattaagctgt

SEQ ID NO: 924563 - DNA, 25 bp, Mus musculus
ttagtttgttccagtcgtcgcctat

SEQ ID NO: 924564 - DNA, 25 bp, Mus musculus
ttagtttgttcctgtcgtcgcctat

SEQ ID NO: 924565 - DNA, 25 bp, Mus musculus
ttagtttgttgtatgctgtcctgaa

SEQ ID NO: 924566 - DNA, 25 bp, Mus musculus
ttagtttgttgtttgctgtcctgaa

SEQ ID NO: 924567 - DNA, 25 bp, Mus musculus
ttagttttatttaacaagtctcatg

SEQ ID NO: 924568 - DNA, 25 bp, Mus musculus
ttagttttattttacaagtctcatg

SEQ ID NO: 924569 - DNA, 25 bp, Mus musculus
ttagttttcagacacccatgtccga

SEQ ID NO: 924570 - DNA, 25 bp, Mus musculus
ttagttttcagagacccatgtccga

SEQ ID NO: 924571 - DNA, 25 bp, Mus musculus
ttagttttcccactgactgcctcag

SEQ ID NO: 924572 - DNA, 25 bp, Mus musculus
ttagttttcccagtgactgcctcag

SEQ ID NO: 924573 - DNA, 25 bp, Mus musculus
ttagttttccctatcttttaagctg

SEQ ID NO: 924574 - DNA, 25 bp, Mus musculus
ttagttttccctttcttttaagctg

SEQ ID NO: 924575 - DNA, 25 bp, Mus musculus
ttagttttctatcaagtatgttttt

SEQ ID NO: 924576 - DNA, 25 bp, Mus musculus
ttagttttctatgaagtatgttttt

SEQ ID NO: 924577 - DNA, 25 bp, Mus musculus
ttagttttgaaacggcctttgctcg

SEQ ID NO: 924578 - DNA, 25 bp, Mus musculus
ttagttttgaaagggcctttgctcg

SEQ ID NO: 924579 - DNA, 25 bp, Mus musculus
ttagttttgaggatccttgctgtcc

SEQ ID NO: 924580 - DNA, 25 bp, Mus musculus
ttagttttgaggttccttgctgtcc

SEQ ID NO: 924581 - DNA, 25 bp, Mus musculus
ttagttttgcccacgtgggaagaga

SEQ ID NO: 924582 - DNA, 25 bp, Mus musculus
ttagttttgccctcgtgggaagaga

SEQ ID NO: 924583 - DNA, 25 bp, Mus musculus
ttagttttgtaccttgtggcctggt

SEQ ID NO: 924584 - DNA, 25 bp, Mus musculus
ttagttttgtacgttgtggcctggt

SEQ ID NO: 924585 - DNA, 25 bp, Mus musculus
ttagttttgtgtatctttctcccgc

SEQ ID NO: 924586 - DNA, 25 bp, Mus musculus
ttagttttgtgtttctttctcccgc

SEQ ID NO: 924587 - DNA, 25 bp, Mus musculus
ttagttttgttgaggcctcatcttt

SEQ ID NO: 924588 - DNA, 25 bp, Mus musculus
ttagttttgttgtggcctcatcttt

SEQ ID NO: 924589 - DNA, 25 bp, Mus musculus
ttagtttttgctctgcaagctccag

SEQ ID NO: 924590 - DNA, 25 bp, Mus musculus
ttagtttttgctgtgcaagctccag

SEQ ID NO: 924591 - DNA, 25 bp, Mus musculus
ttataaaactatcgaacctcctctg

SEQ ID NO: 924592 - DNA, 25 bp, Mus musculus
ttataaaactatggaacctcctctg

SEQ ID NO: 924593 - DNA, 25 bp, Mus musculus
ttataaaagagcaccacctgggccg

SEQ ID NO: 924594 - DNA, 25 bp, Mus musculus
ttataaaagagctccacctgggccg

SEQ ID NO: 924595 - DNA, 25 bp, Mus musculus
ttataaaatcctcgctggctctgtc

SEQ ID NO: 924596 - DNA, 25 bp, Mus musculus
ttataaaatcctggctggctctgtc

SEQ ID NO: 924597 - DNA, 25 bp, Mus musculus
ttataaacctaaattcttgctaact

SEQ ID NO: 924598 - DNA, 25 bp, Mus musculus
ttataaacctaatttcttgctaact

SEQ ID NO: 924599 - DNA, 25 bp, Mus musculus
ttataaacgacacgtgctgccggcc

SEQ ID NO: 924600 - DNA, 25 bp, Mus musculus
ttataaacgacaggtgctgccggcc

SEQ ID NO: 924601 - DNA, 25 bp, Mus musculus
ttataaagctaccactctattcctc

SEQ ID NO: 924602 - DNA, 25 bp, Mus musculus
ttataaagctacgactctattcctc

SEQ ID NO: 924603 - DNA, 25 bp, Mus musculus
ttataaaggcacagttattatttgc

SEQ ID NO: 924604 - DNA, 25 bp, Mus musculus
ttataaaggcactgttattatttgc

SEQ ID NO: 924605 - DNA, 25 bp, Mus musculus
ttataaagttcactccacctccttg

SEQ ID NO: 924606 - DNA, 25 bp, Mus musculus
ttataaagttcagtccacctccttg

SEQ ID NO: 924607 - DNA, 25 bp, Mus musculus
ttataaatctgcagtgtgttcctcc

SEQ ID NO: 924608 - DNA, 25 bp, Mus musculus
ttataaatctgctgtgtgttcctcc

SEQ ID NO: 924609 - DNA, 25 bp, Mus musculus
ttataaatgcttcctactgagaaag

SEQ ID NO: 924610 - DNA, 25 bp, Mus musculus
ttataaatgcttgctactgagaaag

SEQ ID NO: 924611 - DNA, 25 bp, Mus musculus
ttataaatgttgaatgtagatcccc

SEQ ID NO: 924612 - DNA, 25 bp, Mus musculus
ttataaatgttgtatgtagatcccc

SEQ ID NO: 924613 - DNA, 25 bp, Mus musculus
ttataaattaggctgcaccatgtat

SEQ ID NO: 924614 - DNA, 25 bp, Mus musculus
ttataaattagggtgcaccatgtat

SEQ ID NO: 924615 - DNA, 25 bp, Mus musculus
ttataacacaagacctccaggctgt

SEQ ID NO: 924616 - DNA, 25 bp, Mus musculus
ttataacacaagtcctccaggctgt

SEQ ID NO: 924617 - DNA, 25 bp, Mus musculus
ttataacacacaaacctcatccagc

SEQ ID NO: 924618 - DNA, 25 bp, Mus musculus
ttataacacacatacctcatccagc

SEQ ID NO: 924619 - DNA, 25 bp, Mus musculus
ttataacatgatccgctgtgagggc

SEQ ID NO: 924620 - DNA, 25 bp, Mus musculus
ttataacatgatgcgctgtgagggc

SEQ ID NO: 924621 - DNA, 25 bp, Mus musculus
ttataacatggtcatagggccacat

SEQ ID NO: 924622 - DNA, 25 bp, Mus musculus
ttataacatggtgatagggccacat

SEQ ID NO: 924623 - DNA, 25 bp, Mus musculus
ttataacccaggcttgccagctctg

SEQ ID NO: 924624 - DNA, 25 bp, Mus musculus
ttataacccagggttgccagctctg

SEQ ID NO: 924625 - DNA, 25 bp, Mus musculus
ttataacccatgacctttcaacagg

SEQ ID NO: 924626 - DNA, 25 bp, Mus musculus
ttataacccatgtcctttcaacagg

SEQ ID NO: 924627 - DNA, 25 bp, Mus musculus
ttataaccctctcacgggtgaaggg

SEQ ID NO: 924628 - DNA, 25 bp, Mus musculus
ttataaccctctgacgggtgaaggg

SEQ ID NO: 924629 - DNA, 25 bp, Mus musculus
ttataacctatcactaactgcactc

SEQ ID NO: 924630 - DNA, 25 bp, Mus musculus
ttataacctatctctaactgcactc

SEQ ID NO: 924631 - DNA, 25 bp, Mus musculus
ttataacctcggcactgcagaagct

SEQ ID NO: 924632 - DNA, 25 bp, Mus musculus
ttataacctcgggactgcagaagct

SEQ ID NO: 924633 - DNA, 25 bp, Mus musculus
ttataacctggcagactgggtctgc

SEQ ID NO: 924634 - DNA, 25 bp, Mus musculus
ttataacctggctgactgggtctgc

SEQ ID NO: 924635 - DNA, 25 bp, Mus musculus
ttataacctgttacctcatctacca

SEQ ID NO: 924636 - DNA, 25 bp, Mus musculus
ttataacctgtttcctcatctacca

SEQ ID NO: 924637 - DNA, 25 bp, Mus musculus
ttataacggtcactagctactatgt

SEQ ID NO: 924638 - DNA, 25 bp, Mus musculus
ttataacggtcagtagctactatgt

SEQ ID NO: 924639 - DNA, 25 bp, Mus musculus
ttataactaaacagccctggctctc

SEQ ID NO: 924640 - DNA, 25 bp, Mus musculus
ttataactaaactgccctggctctc

SEQ ID NO: 924641 - DNA, 25 bp, Mus musculus
ttataactacaacgatcctgctggc

SEQ ID NO: 924642 - DNA, 25 bp, Mus musculus
ttataactacaaggatcctgctggc

SEQ ID NO: 924643 - DNA, 25 bp, Mus musculus
ttataactcaccacctttatcctta

SEQ ID NO: 924644 - DNA, 25 bp, Mus musculus
ttataactcacctcctttatcctta

SEQ ID NO: 924645 - DNA, 25 bp, Mus musculus
ttataactcactcagatcccttttt

SEQ ID NO: 924646 - DNA, 25 bp, Mus musculus
ttataactcactgagatcccttttt

SEQ ID NO: 924647 - DNA, 25 bp, Mus musculus
ttataactcatcaccatatcttaag

SEQ ID NO: 924648 - DNA, 25 bp, Mus musculus
ttataactcatctccatatcttaag

SEQ ID NO: 924649 - DNA, 25 bp, Mus musculus
ttataactgctcagtaccgcttggg

SEQ ID NO: 924650 - DNA, 25 bp, Mus musculus
ttataactgctctgtaccgcttggg

SEQ ID NO: 924651 - DNA, 25 bp, Mus musculus
ttataactggttaccctcaagatgc

SEQ ID NO: 924652 - DNA, 25 bp, Mus musculus
ttataactggtttccctcaagatgc

SEQ ID NO: 924653 - DNA, 25 bp, Mus musculus
ttataacttgctccttaacttgccc

SEQ ID NO: 924654 - DNA, 25 bp, Mus musculus
ttataacttgctgcttaacttgccc

SEQ ID NO: 924655 - DNA, 25 bp, Mus musculus
ttataacttttaaactgtggcgcct

SEQ ID NO: 924656 - DNA, 25 bp, Mus musculus
ttataacttttatactgtggcgcct

SEQ ID NO: 924657 - DNA, 25 bp, Mus musculus
ttataagacgggagattccaaatta

SEQ ID NO: 924658 - DNA, 25 bp, Mus musculus
ttataagacgggtgattccaaatta

SEQ ID NO: 924659 - DNA, 25 bp, Mus musculus
ttataagactgacgcttgggcgcga

SEQ ID NO: 924660 - DNA, 25 bp, Mus musculus
ttataagactgaggcttgggcgcga

SEQ ID NO: 924661 - DNA, 25 bp, Mus musculus
ttataagaggctccatattgctcat

SEQ ID NO: 924662 - DNA, 25 bp, Mus musculus
ttataagaggctgcatattgctcat

SEQ ID NO: 924663 - DNA, 25 bp, Mus musculus
ttataagagtccaccatcctctcag

SEQ ID NO: 924664 - DNA, 25 bp, Mus musculus
ttataagagtcctccatcctctcag

SEQ ID NO: 924665 - DNA, 25 bp, Mus musculus
ttataagataatccctagtcctttt

SEQ ID NO: 924666 - DNA, 25 bp, Mus musculus
ttataagataatgcctagtcctttt

SEQ ID NO: 924667 - DNA, 25 bp, Mus musculus
ttataagccccgatgccaaagctct

SEQ ID NO: 924668 - DNA, 25 bp, Mus musculus
ttataagccccgttgccaaagctct

SEQ ID NO: 924669 - DNA, 25 bp, Mus musculus
ttataagccgagcagtcagtcccag

SEQ ID NO: 924670 - DNA, 25 bp, Mus musculus
ttataagccgaggagtcagtcccag

SEQ ID NO: 924671 - DNA, 25 bp, Mus musculus
ttataaggcaggacggttgtggaac

SEQ ID NO: 924672 - DNA, 25 bp, Mus musculus
ttataaggcaggtcggttgtggaac

SEQ ID NO: 924673 - DNA, 25 bp, Mus musculus
ttataaggtccaatttctgtgtctg

SEQ ID NO: 924674 - DNA, 25 bp, Mus musculus
ttataaggtccattttctgtgtctg

SEQ ID NO: 924675 - DNA, 25 bp, Mus musculus
ttataaggtgcaacattattttatg

SEQ ID NO: 924676 - DNA, 25 bp, Mus musculus
ttataaggtgcatcattattttatg

SEQ ID NO: 924677 - DNA, 25 bp, Mus musculus
ttataagtctatcctatgtggccta

SEQ ID NO: 924678 - DNA, 25 bp, Mus musculus
ttataagtctatgctatgtggccta

SEQ ID NO: 924679 - DNA, 25 bp, Mus musculus
ttataatacaacactcctggatcgg

SEQ ID NO: 924680 - DNA, 25 bp, Mus musculus
ttataatacaactctcctggatcgg

SEQ ID NO: 924681 - DNA, 25 bp, Mus musculus
ttataatcaaagaccagtggcttct

SEQ ID NO: 924682 - DNA, 25 bp, Mus musculus
ttataatcaaagtccagtggcttct

SEQ ID NO: 924683 - DNA, 25 bp, Mus musculus
ttataatcattcatgcctgcactca

SEQ ID NO: 924684 - DNA, 25 bp, Mus musculus
ttataatcattcttgcctgcactca

SEQ ID NO: 924685 - DNA, 25 bp, Mus musculus
ttataatcatttatcaagtgccatt

SEQ ID NO: 924686 - DNA, 25 bp, Mus musculus
ttataatcatttttcaagtgccatt

SEQ ID NO: 924687 - DNA, 25 bp, Mus musculus
ttataatcctcaactggaccaccac

SEQ ID NO: 924688 - DNA, 25 bp, Mus musculus
ttataatcctcatctggaccaccac

SEQ ID NO: 924689 - DNA, 25 bp, Mus musculus
ttataatctcctaagttacagtaag

SEQ ID NO: 924690 - DNA, 25 bp, Mus musculus
ttataatctcctatgggctgtggcc

SEQ ID NO: 924691 - DNA, 25 bp, Mus musculus
ttataatctccttagttacagtaag

SEQ ID NO: 924692 - DNA, 25 bp, Mus musculus
ttataatctcctttgggctgtggcc

SEQ ID NO: 924693 - DNA, 25 bp, Mus musculus
ttataatctcttcaccaagtcagag

SEQ ID NO: 924694 - DNA, 25 bp, Mus musculus
ttataatctcttgaccaagtcagag

SEQ ID NO: 924695 - DNA, 25 bp, Mus musculus
ttataatgaatacgccaccatccac

SEQ ID NO: 924696 - DNA, 25 bp, Mus musculus
ttataatgaataggccaccatccac

SEQ ID NO: 924697 - DNA, 25 bp, Mus musculus
ttataatgatccctaccctctttcc

SEQ ID NO: 924698 - DNA, 25 bp, Mus musculus
ttataatgatccgtaccctctttcc

SEQ ID NO: 924699 - DNA, 25 bp, Mus musculus
ttataatgccaacctgcaagcgctc

SEQ ID NO: 924700 - DNA, 25 bp, Mus musculus
ttataatgccaagctgcaagcgctc

SEQ ID NO: 924701 - DNA, 25 bp, Mus musculus
ttataatgtattcctctgaggtcag

SEQ ID NO: 924702 - DNA, 25 bp, Mus musculus
ttataatgtattgctctgaggtcag

SEQ ID NO: 924703 - DNA, 25 bp, Mus musculus
ttataattctcaatgaaagcttggg

SEQ ID NO: 924704 - DNA, 25 bp, Mus musculus
ttataattctcattgaaagcttggg

SEQ ID NO: 924705 - DNA, 25 bp, Mus musculus
ttataattctgtcgtgtatgtgatt

SEQ ID NO: 924706 - DNA, 25 bp, Mus musculus
ttataattctgtggtgtatgtgatt

SEQ ID NO: 924707 - DNA, 25 bp, Mus musculus
ttataattgacaccactctcagtga

SEQ ID NO: 924708 - DNA, 25 bp, Mus musculus
ttataattgacagcactctcagtga

SEQ ID NO: 924709 - DNA, 25 bp, Mus musculus
ttataattgccccttgtctaatgcc

SEQ ID NO: 924710 - DNA, 25 bp, Mus musculus
ttataattgcccgttgtctaatgcc

SEQ ID NO: 924711 - DNA, 25 bp, Mus musculus
ttataattttctctactgtcccaca

SEQ ID NO: 924712 - DNA, 25 bp, Mus musculus
ttataattttctgtactgtcccaca

SEQ ID NO: 924713 - DNA, 25 bp, Mus musculus
ttataatttttgcagcgacctaact

SEQ ID NO: 924714 - DNA, 25 bp, Mus musculus
ttataatttttggagcgacctaact

SEQ ID NO: 924715 - DNA, 25 bp, Mus musculus
ttatacaaccaaaatcaatccttat

SEQ ID NO: 924716 - DNA, 25 bp, Mus musculus
ttatacaaccaatatcaatccttat

SEQ ID NO: 924717 - DNA, 25 bp, Mus musculus
ttatacaacgtgaagacggttccct

SEQ ID NO: 924718 - DNA, 25 bp, Mus musculus
ttatacaacgtgtagacggttccct

SEQ ID NO: 924719 - DNA, 25 bp, Mus musculus
ttatacaatccaagacttccagccc

SEQ ID NO: 924720 - DNA, 25 bp, Mus musculus
ttatacaatccatgacttccagccc

SEQ ID NO: 924721 - DNA, 25 bp, Mus musculus
ttatacacatgtccgtacataaggc

SEQ ID NO: 924722 - DNA, 25 bp, Mus musculus
ttatacacatgtgcgtacataaggc

SEQ ID NO: 924723 - DNA, 25 bp, Mus musculus
ttatacactagccttatgcaccagc

SEQ ID NO: 924724 - DNA, 25 bp, Mus musculus
ttatacactagcgttatgcaccagc

SEQ ID NO: 924725 - DNA, 25 bp, Mus musculus
ttatacactgttcaccatgctccaa

SEQ ID NO: 924726 - DNA, 25 bp, Mus musculus
ttatacactgttgaccatgctccaa

SEQ ID NO: 924727 - DNA, 25 bp, Mus musculus
ttatacacttaactccttcaagccc

SEQ ID NO: 924728 - DNA, 25 bp, Mus musculus
ttatacacttaagtccttcaagccc

SEQ ID NO: 924729 - DNA, 25 bp, Mus musculus
ttatacacttagctgtggactggac

SEQ ID NO: 924730 - DNA, 25 bp, Mus musculus
ttatacacttaggtgtggactggac

SEQ ID NO: 924731 - DNA, 25 bp, Mus musculus
ttatacagacagcttaaagggctct

SEQ ID NO: 924732 - DNA, 25 bp, Mus musculus
ttatacagacaggttaaagggctct

SEQ ID NO: 924733 - DNA, 25 bp, Mus musculus
ttatacagatgtaagcaatgccagc

SEQ ID NO: 924734 - DNA, 25 bp, Mus musculus
ttatacagatgttagcaatgccagc

SEQ ID NO: 924735 - DNA, 25 bp, Mus musculus
ttatacaggtgtagctcttaggagt

SEQ ID NO: 924736 - DNA, 25 bp, Mus musculus
ttatacaggtgttgctcttaggagt

SEQ ID NO: 924737 - DNA, 25 bp, Mus musculus
ttatacagttcacaaaccctcccta

SEQ ID NO: 924738 - DNA, 25 bp, Mus musculus
ttatacagttcagaaaccctcccta

SEQ ID NO: 924739 - DNA, 25 bp, Mus musculus
ttatacagttttatccccatggcta

SEQ ID NO: 924740 - DNA, 25 bp, Mus musculus
ttatacagttttcctatcctgtggc

SEQ ID NO: 924741 - DNA, 25 bp, Mus musculus
ttatacagttttgctatcctgtggc

SEQ ID NO: 924742 - DNA, 25 bp, Mus musculus
ttatacagttttttccccatggcta

SEQ ID NO: 924743 - DNA, 25 bp, Mus musculus
ttatacataatcacagccaacctag

SEQ ID NO: 924744 - DNA, 25 bp, Mus musculus
ttatacataatctcagccaacctag

SEQ ID NO: 924745 - DNA, 25 bp, Mus musculus
ttatacatactgctagtttggctac

SEQ ID NO: 924746 - DNA, 25 bp, Mus musculus
ttatacatactggtagtttggctac

SEQ ID NO: 924747 - DNA, 25 bp, Mus musculus
ttatacatatggacctcagaagaca

SEQ ID NO: 924748 - DNA, 25 bp, Mus musculus
ttatacatatggtcctcagaagaca

SEQ ID NO: 924749 - DNA, 25 bp, Mus musculus
ttatacatggtgagggctgttcccc

SEQ ID NO: 924750 - DNA, 25 bp, Mus musculus
ttatacatggtgtgggctgttcccc

SEQ ID NO: 924751 - DNA, 25 bp, Mus musculus
ttatacatttcaaagcctgctcacc

SEQ ID NO: 924752 - DNA, 25 bp, Mus musculus
ttatacatttcatagcctgctcacc

SEQ ID NO: 924753 - DNA, 25 bp, Mus musculus
ttatacatttccagggtgatgggca

SEQ ID NO: 924754 - DNA, 25 bp, Mus musculus
ttatacatttcctgggtgatgggca

SEQ ID NO: 924755 - DNA, 25 bp, Mus musculus
ttatacattttaatcctaagcagtc

SEQ ID NO: 924756 - DNA, 25 bp, Mus musculus
ttatacattttattcctaagcagtc

SEQ ID NO: 924757 - DNA, 25 bp, Mus musculus
ttataccaaagcacaacaccacatc

SEQ ID NO: 924758 - DNA, 25 bp, Mus musculus
ttataccaaagctcaacaccacatc

SEQ ID NO: 924759 - DNA, 25 bp, Mus musculus
ttataccaacccagctgtggtgacc

SEQ ID NO: 924760 - DNA, 25 bp, Mus musculus
ttataccaaccctgctgtggtgacc

SEQ ID NO: 924761 - DNA, 25 bp, Mus musculus
ttataccaagttattctgtcattct

SEQ ID NO: 924762 - DNA, 25 bp, Mus musculus
ttataccaagtttttctgtcattct

SEQ ID NO: 924763 - DNA, 25 bp, Mus musculus
ttataccactttcctctaggagacc

SEQ ID NO: 924764 - DNA, 25 bp, Mus musculus
ttataccactttgctctaggagacc

SEQ ID NO: 924765 - DNA, 25 bp, Mus musculus
ttataccagtcactcaccgtcatag

SEQ ID NO: 924766 - DNA, 25 bp, Mus musculus
ttataccagtcagtcaccgtcatag

SEQ ID NO: 924767 - DNA, 25 bp, Mus musculus
ttataccatatcaagcctggcctct

SEQ ID NO: 924768 - DNA, 25 bp, Mus musculus
ttataccatatctagcctggcctct

SEQ ID NO: 924769 - DNA, 25 bp, Mus musculus
ttatacccaaccctgtgaattccgt

SEQ ID NO: 924770 - DNA, 25 bp, Mus musculus
ttatacccaaccgtgtgaattccgt

SEQ ID NO: 924771 - DNA, 25 bp, Mus musculus
ttatacccaccaacttcatattctt

SEQ ID NO: 924772 - DNA, 25 bp, Mus musculus
ttatacccaccatcttcatattctt

SEQ ID NO: 924773 - DNA, 25 bp, Mus musculus
ttatacccgcatacacagctctcat

SEQ ID NO: 924774 - DNA, 25 bp, Mus musculus
ttatacccgcattcacagctctcat

SEQ ID NO: 924775 - DNA, 25 bp, Mus musculus
ttataccgcaacacacttttgtcca

SEQ ID NO: 924776 - DNA, 25 bp, Mus musculus
ttataccgcaactcacttttgtcca

SEQ ID NO: 924777 - DNA, 25 bp, Mus musculus
ttataccggccccagaacaagacca

SEQ ID NO: 924778 - DNA, 25 bp, Mus musculus
ttataccggcccgagaacaagacca

SEQ ID NO: 924779 - DNA, 25 bp, Mus musculus
ttatacctaatacctaactggacca

SEQ ID NO: 924780 - DNA, 25 bp, Mus musculus
ttatacctaatagctaactggacca

SEQ ID NO: 924781 - DNA, 25 bp, Mus musculus
ttatacctaccacagctcttcaagc

SEQ ID NO: 924782 - DNA, 25 bp, Mus musculus
ttatacctaccagagctcttcaagc

SEQ ID NO: 924783 - DNA, 25 bp, Mus musculus
ttatacctattcactgaccatctga

SEQ ID NO: 924784 - DNA, 25 bp, Mus musculus
ttatacctattctctgaccatctga

SEQ ID NO: 924785 - DNA, 25 bp, Mus musculus
ttatacctcactatgttctttgaat

SEQ ID NO: 924786 - DNA, 25 bp, Mus musculus
ttatacctcactttgttctttgaat

SEQ ID NO: 924787 - DNA, 25 bp, Mus musculus
ttatacctcctgacttcacacagag

SEQ ID NO: 924788 - DNA, 25 bp, Mus musculus
ttatacctcctgtcttcacacagag

SEQ ID NO: 924789 - DNA, 25 bp, Mus musculus
ttatacctctccagctgtaaagtca

SEQ ID NO: 924790 - DNA, 25 bp, Mus musculus
ttatacctctcctgctgtaaagtca

SEQ ID NO: 924791 - DNA, 25 bp, Mus musculus
ttatacctgtctaactttgcttctc

SEQ ID NO: 924792 - DNA, 25 bp, Mus musculus
ttatacctgtctctctggcctgaag

SEQ ID NO: 924793 - DNA, 25 bp, Mus musculus
ttatacctgtctgtctggcctgaag

SEQ ID NO: 924794 - DNA, 25 bp, Mus musculus
ttatacctgtcttactttgcttctc

SEQ ID NO: 924795 - DNA, 25 bp, Mus musculus
ttatacctttttaatattcacgaag

SEQ ID NO: 924796 - DNA, 25 bp, Mus musculus
ttataccttttttatattcacgaag

SEQ ID NO: 924797 - DNA, 25 bp, Mus musculus
ttatacgaggttcttggcccagggc

SEQ ID NO: 924798 - DNA, 25 bp, Mus musculus
ttatacgaggttgttggcccagggc

SEQ ID NO: 924799 - DNA, 25 bp, Mus musculus
ttatacgggagcctgttcagtgtcc

SEQ ID NO: 924800 - DNA, 25 bp, Mus musculus
ttatacgggagcgtgttcagtgtcc

SEQ ID NO: 924801 - DNA, 25 bp, Mus musculus
ttatacggtcctcaacaggaaaaat

SEQ ID NO: 924802 - DNA, 25 bp, Mus musculus
ttatacggtcctgaacaggaaaaat

SEQ ID NO: 924803 - DNA, 25 bp, Mus musculus
ttatacgtctggactcagtttccct

SEQ ID NO: 924804 - DNA, 25 bp, Mus musculus
ttatacgtctggtctcagtttccct

SEQ ID NO: 924805 - DNA, 25 bp, Mus musculus
ttatacgtgtttaaccatatgtctt

SEQ ID NO: 924806 - DNA, 25 bp, Mus musculus
ttatacgtgttttaccatatgtctt

SEQ ID NO: 924807 - DNA, 25 bp, Mus musculus
ttatactacaagcaagagagtctgc

SEQ ID NO: 924808 - DNA, 25 bp, Mus musculus
ttatactacaaggaagagagtctgc

SEQ ID NO: 924809 - DNA, 25 bp, Mus musculus
ttatactacgatccctgggccatgt

SEQ ID NO: 924810 - DNA, 25 bp, Mus musculus
ttatactacgatgcctgggccatgt

SEQ ID NO: 924811 - DNA, 25 bp, Mus musculus
ttatactagatacagctgctgttcc

SEQ ID NO: 924812 - DNA, 25 bp, Mus musculus
ttatactagatagagctgctgttcc

SEQ ID NO: 924813 - DNA, 25 bp, Mus musculus
ttatactaggatcggaatggctgac

SEQ ID NO: 924814 - DNA, 25 bp, Mus musculus
ttatactaggatgggaatggctgac

SEQ ID NO: 924815 - DNA, 25 bp, Mus musculus
ttatactatctcacaaggctcagga

SEQ ID NO: 924816 - DNA, 25 bp, Mus musculus
ttatactatctctcaaggctcagga

SEQ ID NO: 924817 - DNA, 25 bp, Mus musculus
ttatactatgatcagattttccagg

SEQ ID NO: 924818 - DNA, 25 bp, Mus musculus
ttatactatgatgagattttccagg

SEQ ID NO: 924819 - DNA, 25 bp, Mus musculus
ttatactcaattaaacttgttttgc

SEQ ID NO: 924820 - DNA, 25 bp, Mus musculus
ttatactcaatttaacttgttttgc

SEQ ID NO: 924821 - DNA, 25 bp, Mus musculus
ttatactcacccagccagcgtgagt

SEQ ID NO: 924822 - DNA, 25 bp, Mus musculus
ttatactcaccctgccagcgtgagt

SEQ ID NO: 924823 - DNA, 25 bp, Mus musculus
ttatactcactcattctgatattat

SEQ ID NO: 924824 - DNA, 25 bp, Mus musculus
ttatactcactctttctgatattat

SEQ ID NO: 924825 - DNA, 25 bp, Mus musculus
ttatactcagggatgatactgtctg

SEQ ID NO: 924826 - DNA, 25 bp, Mus musculus
ttatactcagggttgatactgtctg

SEQ ID NO: 924827 - DNA, 25 bp, Mus musculus
ttatactccaagagaggataactgt

SEQ ID NO: 924828 - DNA, 25 bp, Mus musculus
ttatactccaagtgaggataactgt

SEQ ID NO: 924829 - DNA, 25 bp, Mus musculus
ttatactccatcatcattccagtga

SEQ ID NO: 924830 - DNA, 25 bp, Mus musculus
ttatactccatcttcattccagtga

SEQ ID NO: 924831 - DNA, 25 bp, Mus musculus
ttatactcccaaaccctgagtgtcc

SEQ ID NO: 924832 - DNA, 25 bp, Mus musculus
ttatactcccaatccctgagtgtcc

SEQ ID NO: 924833 - DNA, 25 bp, Mus musculus
ttatactccctccacttctccctat

SEQ ID NO: 924834 - DNA, 25 bp, Mus musculus
ttatactccctcgacttctccctat

SEQ ID NO: 924835 - DNA, 25 bp, Mus musculus
ttatactcctacatacccattcttt

SEQ ID NO: 924836 - DNA, 25 bp, Mus musculus
ttatactcctacctgtgtcattggc

SEQ ID NO: 924837 - DNA, 25 bp, Mus musculus
ttatactcctacgtgtgtcattggc

SEQ ID NO: 924838 - DNA, 25 bp, Mus musculus
ttatactcctacttacccattcttt

SEQ ID NO: 924839 - DNA, 25 bp, Mus musculus
ttatactcctcccaccctgagagtg

SEQ ID NO: 924840 - DNA, 25 bp, Mus musculus
ttatactcctccgaccctgagagtg

SEQ ID NO: 924841 - DNA, 25 bp, Mus musculus
ttatactcctgtcggtacccacgtt

SEQ ID NO: 924842 - DNA, 25 bp, Mus musculus
ttatactcctgtgggtacccacgtt

SEQ ID NO: 924843 - DNA, 25 bp, Mus musculus
ttatactctgaaccttgccacagcc

SEQ ID NO: 924844 - DNA, 25 bp, Mus musculus
ttatactctgaagcttgccacagcc

SEQ ID NO: 924845 - DNA, 25 bp, Mus musculus
ttatactgagccacactagattatt

SEQ ID NO: 924846 - DNA, 25 bp, Mus musculus
ttatactgagcctcactagattatt

SEQ ID NO: 924847 - DNA, 25 bp, Mus musculus
ttatactgagtcagtggccagtcaa

SEQ ID NO: 924848 - DNA, 25 bp, Mus musculus
ttatactgagtctgtggccagtcaa

SEQ ID NO: 924849 - DNA, 25 bp, Mus musculus
ttatactgggcacccggccccctga

SEQ ID NO: 924850 - DNA, 25 bp, Mus musculus
ttatactgggcagccggccccctga

SEQ ID NO: 924851 - DNA, 25 bp, Mus musculus
ttatactggtaaccacaatgtggta

SEQ ID NO: 924852 - DNA, 25 bp, Mus musculus
ttatactggtaagcacaatgtggta

SEQ ID NO: 924853 - DNA, 25 bp, Mus musculus
ttatactggtcaaactacatgtgca

SEQ ID NO: 924854 - DNA, 25 bp, Mus musculus
ttatactggtcatactacatgtgca

SEQ ID NO: 924855 - DNA, 25 bp, Mus musculus
ttatactgtatgacagctgtcaggg

SEQ ID NO: 924856 - DNA, 25 bp, Mus musculus
ttatactgtatgtcagctgtcaggg

SEQ ID NO: 924857 - DNA, 25 bp, Mus musculus
ttatactgtcttaccttctcttgct

SEQ ID NO: 924858 - DNA, 25 bp, Mus musculus
ttatactgtctttccttctcttgct

SEQ ID NO: 924859 - DNA, 25 bp, Mus musculus
ttatacttacaaccccgcaaacggt

SEQ ID NO: 924860 - DNA, 25 bp, Mus musculus
ttatacttacaagcccgcaaacggt

SEQ ID NO: 924861 - DNA, 25 bp, Mus musculus
ttatacttccttaacagttaacatg

SEQ ID NO: 924862 - DNA, 25 bp, Mus musculus
ttatacttcctttacagttaacatg

SEQ ID NO: 924863 - DNA, 25 bp, Mus musculus
ttatacttctcaacctgttctctta

SEQ ID NO: 924864 - DNA, 25 bp, Mus musculus
ttatacttctcatcctgttctctta

SEQ ID NO: 924865 - DNA, 25 bp, Mus musculus
ttatacttctcgatcattaaattgt

SEQ ID NO: 924866 - DNA, 25 bp, Mus musculus
ttatacttctcgttcattaaattgt

SEQ ID NO: 924867 - DNA, 25 bp, Mus musculus
ttatacttgatccttttttcagacc

SEQ ID NO: 924868 - DNA, 25 bp, Mus musculus
ttatacttgatcgttttttcagacc

SEQ ID NO: 924869 - DNA, 25 bp, Mus musculus
ttatacttgcccatttttctgcttc

SEQ ID NO: 924870 - DNA, 25 bp, Mus musculus
ttatacttgcccttttttctgcttc

SEQ ID NO: 924871 - DNA, 25 bp, Mus musculus
ttatacttggagactatgctggtgt

SEQ ID NO: 924872 - DNA, 25 bp, Mus musculus
ttatacttggagtctatgctggtgt

SEQ ID NO: 924873 - DNA, 25 bp, Mus musculus
ttatactttgtacggccggatttat

SEQ ID NO: 924874 - DNA, 25 bp, Mus musculus
ttatactttgtagggccggatttat

SEQ ID NO: 924875 - DNA, 25 bp, Mus musculus
ttatacttttctcaatgtcccatcc

SEQ ID NO: 924876 - DNA, 25 bp, Mus musculus
ttatacttttctgaatgtcccatcc

SEQ ID NO: 924877 - DNA, 25 bp, Mus musculus
ttatagaacacacgcaccctcatat

SEQ ID NO: 924878 - DNA, 25 bp, Mus musculus
ttatagaacacaggcaccctcatat

SEQ ID NO: 924879 - DNA, 25 bp, Mus musculus
ttatagaaggtgctgatgtgtccat

SEQ ID NO: 924880 - DNA, 25 bp, Mus musculus
ttatagaaggtggtgatgtgtccat

SEQ ID NO: 924881 - DNA, 25 bp, Mus musculus
ttatagaataacacacctcccaacg

SEQ ID NO: 924882 - DNA, 25 bp, Mus musculus
ttatagaataactcacctcccaacg

SEQ ID NO: 924883 - DNA, 25 bp, Mus musculus
ttatagaatacccttgtaattgtct

SEQ ID NO: 924884 - DNA, 25 bp, Mus musculus
ttatagaataccgttgtaattgtct

SEQ ID NO: 924885 - DNA, 25 bp, Mus musculus
ttatagacaagacagcacacacaca

SEQ ID NO: 924886 - DNA, 25 bp, Mus musculus
ttatagacaagagagcacacacaca

SEQ ID NO: 924887 - DNA, 25 bp, Mus musculus
ttatagacacagacaaccactttga

SEQ ID NO: 924888 - DNA, 25 bp, Mus musculus
ttatagacacagtcaaccactttga

SEQ ID NO: 924889 - DNA, 25 bp, Mus musculus
ttatagacatgacacacaatgcctg

SEQ ID NO: 924890 - DNA, 25 bp, Mus musculus
ttatagacatgagacacaatgcctg

SEQ ID NO: 924891 - DNA, 25 bp, Mus musculus
ttatagacatgcaccacacgctggt

SEQ ID NO: 924892 - DNA, 25 bp, Mus musculus
ttatagacatgctccacacgctggt

SEQ ID NO: 924893 - DNA, 25 bp, Mus musculus
ttatagaccaatcacacagcagcct

SEQ ID NO: 924894 - DNA, 25 bp, Mus musculus
ttatagaccaatgacacagcagcct

SEQ ID NO: 924895 - DNA, 25 bp, Mus musculus
ttatagaccgccaaagtagctgctg

SEQ ID NO: 924896 - DNA, 25 bp, Mus musculus
ttatagaccgcctaagtagctgctg

SEQ ID NO: 924897 - DNA, 25 bp, Mus musculus
ttatagacgcagagatttgcttcct

SEQ ID NO: 924898 - DNA, 25 bp, Mus musculus
ttatagacgcagtgatttgcttcct

SEQ ID NO: 924899 - DNA, 25 bp, Mus musculus
ttatagactcctaagtagttcaggg

SEQ ID NO: 924900 - DNA, 25 bp, Mus musculus
ttatagactccttagtagttcaggg

SEQ ID NO: 924901 - DNA, 25 bp, Mus musculus
ttatagactgtcactattcctggct

SEQ ID NO: 924902 - DNA, 25 bp, Mus musculus
ttatagactgtctctattcctggct

SEQ ID NO: 924903 - DNA, 25 bp, Mus musculus
ttatagagagccatttctgtccaag

SEQ ID NO: 924904 - DNA, 25 bp, Mus musculus
ttatagagagccttttctgtccaag

SEQ ID NO: 924905 - DNA, 25 bp, Mus musculus
ttatagagagctatcccttgaggga

SEQ ID NO: 924906 - DNA, 25 bp, Mus musculus
ttatagagagctttcccttgaggga

SEQ ID NO: 924907 - DNA, 25 bp, Mus musculus
ttatagagagttaatatgcacagag

SEQ ID NO: 924908 - DNA, 25 bp, Mus musculus
ttatagagagtttatatgcacagag

SEQ ID NO: 924909 - DNA, 25 bp, Mus musculus
ttatagagcttcacttgcattggta

SEQ ID NO: 924910 - DNA, 25 bp, Mus musculus
ttatagagcttctcttgcattggta

SEQ ID NO: 924911 - DNA, 25 bp, Mus musculus
ttatagaggcctagaaccctaagat

SEQ ID NO: 924912 - DNA, 25 bp, Mus musculus
ttatagaggccttgaaccctaagat

SEQ ID NO: 924913 - DNA, 25 bp, Mus musculus
ttatagagtctcaccattggacctt

SEQ ID NO: 924914 - DNA, 25 bp, Mus musculus
ttatagagtctctccattggacctt

SEQ ID NO: 924915 - DNA, 25 bp, Mus musculus
ttatagagttcaccgttatccacca

SEQ ID NO: 924916 - DNA, 25 bp, Mus musculus
ttatagagttcagcgttatccacca

SEQ ID NO: 924917 - DNA, 25 bp, Mus musculus
ttatagatctagattctgccccaag

SEQ ID NO: 924918 - DNA, 25 bp, Mus musculus
ttatagatctagtttctgccccaag

SEQ ID NO: 924919 - DNA, 25 bp, Mus musculus
ttatagcacttaccaggtagagaca

SEQ ID NO: 924920 - DNA, 25 bp, Mus musculus
ttatagcacttagcaggtagagaca

SEQ ID NO: 924921 - DNA, 25 bp, Mus musculus
ttatagcagggccataactcccaag

SEQ ID NO: 924922 - DNA, 25 bp, Mus musculus
ttatagcagggcgataactcccaag

SEQ ID NO: 924923 - DNA, 25 bp, Mus musculus
ttatagcatcagcaatctgcacata

SEQ ID NO: 924924 - DNA, 25 bp, Mus musculus
ttatagcatcaggaatctgcacata

SEQ ID NO: 924925 - DNA, 25 bp, Mus musculus
ttatagccacctcttccatagaaag

SEQ ID NO: 924926 - DNA, 25 bp, Mus musculus
ttatagccacctgttccatagaaag

SEQ ID NO: 924927 - DNA, 25 bp, Mus musculus
ttatagccgtcaagaatgcattaaa

SEQ ID NO: 924928 - DNA, 25 bp, Mus musculus
ttatagccgtcatgaatgcattaaa

SEQ ID NO: 924929 - DNA, 25 bp, Mus musculus
ttatagcctaagactttgcccatcc

SEQ ID NO: 924930 - DNA, 25 bp, Mus musculus
ttatagcctaagtctttgcccatcc

SEQ ID NO: 924931 - DNA, 25 bp, Mus musculus
ttatagcctagcagtggtagtgcac

SEQ ID NO: 924932 - DNA, 25 bp, Mus musculus
ttatagcctagctgtggtagtgcac

SEQ ID NO: 924933 - DNA, 25 bp, Mus musculus
ttatagcggtacatggtatcacttt

SEQ ID NO: 924934 - DNA, 25 bp, Mus musculus
ttatagcggtacttggtatcacttt

SEQ ID NO: 924935 - DNA, 25 bp, Mus musculus
ttatagctaacaagcagtgcttgca

SEQ ID NO: 924936 - DNA, 25 bp, Mus musculus
ttatagctaacatgcagtgcttgca

SEQ ID NO: 924937 - DNA, 25 bp, Mus musculus
ttatagctatgtcccttgtggtaag

SEQ ID NO: 924938 - DNA, 25 bp, Mus musculus
ttatagctatgtgccttgtggtaag

SEQ ID NO: 924939 - DNA, 25 bp, Mus musculus
ttatagctctgtagactcctagccc

SEQ ID NO: 924940 - DNA, 25 bp, Mus musculus
ttatagctctgtcacttacttcttg

SEQ ID NO: 924941 - DNA, 25 bp, Mus musculus
ttatagctctgtgacttacttcttg

SEQ ID NO: 924942 - DNA, 25 bp, Mus musculus
ttatagctctgttgactcctagccc

SEQ ID NO: 924943 - DNA, 25 bp, Mus musculus
ttatagctctttcactcttcagttt

SEQ ID NO: 924944 - DNA, 25 bp, Mus musculus
ttatagctctttgactcttcagttt

SEQ ID NO: 924945 - DNA, 25 bp, Mus musculus
ttatagctgcatcattttctttctc

SEQ ID NO: 924946 - DNA, 25 bp, Mus musculus
ttatagctgcatgattttctttctc

SEQ ID NO: 924947 - DNA, 25 bp, Mus musculus
ttatagctgctgagccgaggccact

SEQ ID NO: 924948 - DNA, 25 bp, Mus musculus
ttatagctgctgtgccgaggccact

SEQ ID NO: 924949 - DNA, 25 bp, Mus musculus
ttatagctggtgatgccttgtggtc

SEQ ID NO: 924950 - DNA, 25 bp, Mus musculus
ttatagctggtgttgccttgtggtc

SEQ ID NO: 924951 - DNA, 25 bp, Mus musculus
ttatagcttccaaataagaacactg

SEQ ID NO: 924952 - DNA, 25 bp, Mus musculus
ttatagcttccatataagaacactg

SEQ ID NO: 924953 - DNA, 25 bp, Mus musculus
ttatagcttgacaagtgagatggtt

SEQ ID NO: 924954 - DNA, 25 bp, Mus musculus
ttatagcttgactagtgagatggtt

SEQ ID NO: 924955 - DNA, 25 bp, Mus musculus
ttatagcttggtataaacttcccaa

SEQ ID NO: 924956 - DNA, 25 bp, Mus musculus
ttatagcttggtttaaacttcccaa

SEQ ID NO: 924957 - DNA, 25 bp, Mus musculus
ttataggaatgcagatcttttgtac

SEQ ID NO: 924958 - DNA, 25 bp, Mus musculus
ttataggaatgctgatcttttgtac

SEQ ID NO: 924959 - DNA, 25 bp, Mus musculus
ttataggacagcacactttcttttc

SEQ ID NO: 924960 - DNA, 25 bp, Mus musculus
ttataggacagctcactttcttttc

SEQ ID NO: 924961 - DNA, 25 bp, Mus musculus
ttataggactaaactggctggccag

SEQ ID NO: 924962 - DNA, 25 bp, Mus musculus
ttataggactaatctggctggccag

SEQ ID NO: 924963 - DNA, 25 bp, Mus musculus
ttataggaggccataatactgatga

SEQ ID NO: 924964 - DNA, 25 bp, Mus musculus
ttataggaggccttaatactgatga

SEQ ID NO: 924965 - DNA, 25 bp, Mus musculus
ttataggattccactgggactcaga

SEQ ID NO: 924966 - DNA, 25 bp, Mus musculus
ttataggattcctctgggactcaga

SEQ ID NO: 924967 - DNA, 25 bp, Mus musculus
ttataggcgatcaccactggaccaa

SEQ ID NO: 924968 - DNA, 25 bp, Mus musculus
ttataggcgatctccactggaccaa

SEQ ID NO: 924969 - DNA, 25 bp, Mus musculus
ttataggctgtcatgcttcatttgc

SEQ ID NO: 924970 - DNA, 25 bp, Mus musculus
ttataggctgtcttgcttcatttgc

SEQ ID NO: 924971 - DNA, 25 bp, Mus musculus
ttatagggcaaacgcaggcgcatga

SEQ ID NO: 924972 - DNA, 25 bp, Mus musculus
ttatagggcaaaggcaggcgcatga

SEQ ID NO: 924973 - DNA, 25 bp, Mus musculus
ttatagggtcccctctctgatacct

SEQ ID NO: 924974 - DNA, 25 bp, Mus musculus
ttatagggtcccgtctctgatacct

SEQ ID NO: 924975 - DNA, 25 bp, Mus musculus
ttataggtaagccacccaacagtgt

SEQ ID NO: 924976 - DNA, 25 bp, Mus musculus
ttataggtaagcgacccaacagtgt

SEQ ID NO: 924977 - DNA, 25 bp, Mus musculus
ttataggtacctctccttgtgtgct

SEQ ID NO: 924978 - DNA, 25 bp, Mus musculus
ttataggtacctgtccttgtgtgct

SEQ ID NO: 924979 - DNA, 25 bp, Mus musculus
ttataggtggccacactggcacagt

SEQ ID NO: 924980 - DNA, 25 bp, Mus musculus
ttataggtggcctcactggcacagt

SEQ ID NO: 924981 - DNA, 25 bp, Mus musculus
ttataggtgtgtcctcccatgctca

SEQ ID NO: 924982 - DNA, 25 bp, Mus musculus
ttataggtgtgtgctcccatgctca

SEQ ID NO: 924983 - DNA, 25 bp, Mus musculus
ttataggttctcctaagggtcacag

SEQ ID NO: 924984 - DNA, 25 bp, Mus musculus
ttataggttctcgtaagggtcacag

SEQ ID NO: 924985 - DNA, 25 bp, Mus musculus
ttataggttgccattgccagtggga

SEQ ID NO: 924986 - DNA, 25 bp, Mus musculus
ttataggttgcctttgccagtggga

SEQ ID NO: 924987 - DNA, 25 bp, Mus musculus
ttatagtaagggacaccgcctagcc

SEQ ID NO: 924988 - DNA, 25 bp, Mus musculus
ttatagtaagggtcaccgcctagcc

SEQ ID NO: 924989 - DNA, 25 bp, Mus musculus
ttatagtagatcacaaagtcaggga

SEQ ID NO: 924990 - DNA, 25 bp, Mus musculus
ttatagtagatctcaaagtcaggga

SEQ ID NO: 924991 - DNA, 25 bp, Mus musculus
ttatagtatgtaatcctcatgggct

SEQ ID NO: 924992 - DNA, 25 bp, Mus musculus
ttatagtatgtattcctcatgggct

SEQ ID NO: 924993 - DNA, 25 bp, Mus musculus
ttatagtcagtgatactccaattct

SEQ ID NO: 924994 - DNA, 25 bp, Mus musculus
ttatagtcagtgttactccaattct

SEQ ID NO: 924995 - DNA, 25 bp, Mus musculus
ttatagtcccatcctcagtgtcaat

SEQ ID NO: 924996 - DNA, 25 bp, Mus musculus
ttatagtcccatgctcagtgtcaat

SEQ ID NO: 924997 - DNA, 25 bp, Mus musculus
ttatagtctcagcagagccagggac

SEQ ID NO: 924998 - DNA, 25 bp, Mus musculus
ttatagtctcaggagagccagggac

SEQ ID NO: 924999 - DNA, 25 bp, Mus musculus
ttatagtctctgctttgacctcttt

SEQ ID NO: 925000 - DNA, 25 bp, Mus musculus
ttatagtctctggtttgacctcttt

SEQ ID NO: 925001 - DNA, 25 bp, Mus musculus
ttatagtgagcacccttcttgttct

SEQ ID NO: 925002 - DNA, 25 bp, Mus musculus
ttatagtgagcagccttcttgttct

SEQ ID NO: 925003 - DNA, 25 bp, Mus musculus
ttatagtgctacactataccgtccc

SEQ ID NO: 925004 - DNA, 25 bp, Mus musculus
ttatagtgctactctataccgtccc

SEQ ID NO: 925005 - DNA, 25 bp, Mus musculus
ttatagtgtcatcctgatctcagcc

SEQ ID NO: 925006 - DNA, 25 bp, Mus musculus
ttatagtgtcatgctgatctcagcc

SEQ ID NO: 925007 - DNA, 25 bp, Mus musculus
ttatagtgtcctatccgttcccctg

SEQ ID NO: 925008 - DNA, 25 bp, Mus musculus
ttatagtgtcctttccgttcccctg

SEQ ID NO: 925009 - DNA, 25 bp, Mus musculus
ttatagttatccaactgagccatgg

SEQ ID NO: 925010 - DNA, 25 bp, Mus musculus
ttatagttatcctactgagccatgg

SEQ ID NO: 925011 - DNA, 25 bp, Mus musculus
ttatagttcccaccgatatattcct

SEQ ID NO: 925012 - DNA, 25 bp, Mus musculus
ttatagttcccagcgatatattcct

SEQ ID NO: 925013 - DNA, 25 bp, Mus musculus
ttatagttcctacgtaaaaggctat

SEQ ID NO: 925014 - DNA, 25 bp, Mus musculus
ttatagttcctaggtaaaaggctat

SEQ ID NO: 925015 - DNA, 25 bp, Mus musculus
ttatagttggcgatctcactctaac

SEQ ID NO: 925016 - DNA, 25 bp, Mus musculus
ttatagttggcgttctcactctaac

SEQ ID NO: 925017 - DNA, 25 bp, Mus musculus
ttatataaacgaactctctccctct

SEQ ID NO: 925018 - DNA, 25 bp, Mus musculus
ttatataaacgatctctctccctct

SEQ ID NO: 925019 - DNA, 25 bp, Mus musculus
ttatataaactgcattctccttctg

SEQ ID NO: 925020 - DNA, 25 bp, Mus musculus
ttatataaactggattctccttctg

SEQ ID NO: 925021 - DNA, 25 bp, Mus musculus
ttatataactgtcctcagctcttcc

SEQ ID NO: 925022 - DNA, 25 bp, Mus musculus
ttatataactgtgctcagctcttcc

SEQ ID NO: 925023 - DNA, 25 bp, Mus musculus
ttatataatcctagttttctgctca

SEQ ID NO: 925024 - DNA, 25 bp, Mus musculus
ttatataatccttgttttctgctca

SEQ ID NO: 925025 - DNA, 25 bp, Mus musculus
ttatataatgtcatatccttgtcac

SEQ ID NO: 925026 - DNA, 25 bp, Mus musculus
ttatataatgtcttatccttgtcac

SEQ ID NO: 925027 - DNA, 25 bp, Mus musculus
ttatatactgtacctcttcctgatg

SEQ ID NO: 925028 - DNA, 25 bp, Mus musculus
ttatatactgtagctcttcctgatg

SEQ ID NO: 925029 - DNA, 25 bp, Mus musculus
ttatatacttgaatatactgcagct

SEQ ID NO: 925030 - DNA, 25 bp, Mus musculus
ttatatacttgattatactgcagct

SEQ ID NO: 925031 - DNA, 25 bp, Mus musculus
ttatatagggacaggttttggcaca

SEQ ID NO: 925032 - DNA, 25 bp, Mus musculus
ttatatagggactggttttggcaca

SEQ ID NO: 925033 - DNA, 25 bp, Mus musculus
ttatatagttccatcttaacgctag

SEQ ID NO: 925034 - DNA, 25 bp, Mus musculus
ttatatagttccttcttaacgctag

SEQ ID NO: 925035 - DNA, 25 bp, Mus musculus
ttatatagttggcacatcagctgac

SEQ ID NO: 925036 - DNA, 25 bp, Mus musculus
ttatatagttgggacatcagctgac

SEQ ID NO: 925037 - DNA, 25 bp, Mus musculus
ttatatataaccacctgtctcggcg

SEQ ID NO: 925038 - DNA, 25 bp, Mus musculus
ttatatataacctcctgtctcggcg

SEQ ID NO: 925039 - DNA, 25 bp, Mus musculus
ttatatatggagctgttcactggac

SEQ ID NO: 925040 - DNA, 25 bp, Mus musculus
ttatatatggaggtgttcactggac

SEQ ID NO: 925041 - DNA, 25 bp, Mus musculus
ttatatatttttcgctcacaggagg

SEQ ID NO: 925042 - DNA, 25 bp, Mus musculus
ttatatatttttggctcacaggagg

SEQ ID NO: 925043 - DNA, 25 bp, Mus musculus
ttatatcactgactggctggatcca

SEQ ID NO: 925044 - DNA, 25 bp, Mus musculus
ttatatcactgagtggctggatcca

SEQ ID NO: 925045 - DNA, 25 bp, Mus musculus
ttatatcactttccattcctactcg

SEQ ID NO: 925046 - DNA, 25 bp, Mus musculus
ttatatcactttgcattcctactcg

SEQ ID NO: 925047 - DNA, 25 bp, Mus musculus
ttatatcagggcagttcctctcaga

SEQ ID NO: 925048 - DNA, 25 bp, Mus musculus
ttatatcagggctgttcctctcaga

SEQ ID NO: 925049 - DNA, 25 bp, Mus musculus
ttatatcatagccacactcgttacc

SEQ ID NO: 925050 - DNA, 25 bp, Mus musculus
ttatatcatagcgacactcgttacc

SEQ ID NO: 925051 - DNA, 25 bp, Mus musculus
ttatatcatgggacataagacgtgt

SEQ ID NO: 925052 - DNA, 25 bp, Mus musculus
ttatatcatgggtcataagacgtgt

SEQ ID NO: 925053 - DNA, 25 bp, Mus musculus
ttatatcatttcaaggacacctggg

SEQ ID NO: 925054 - DNA, 25 bp, Mus musculus
ttatatcatttctaggacacctggg

SEQ ID NO: 925055 - DNA, 25 bp, Mus musculus
ttatatccaaacatcgggagctggg

SEQ ID NO: 925056 - DNA, 25 bp, Mus musculus
ttatatccaaacttcgggagctggg

SEQ ID NO: 925057 - DNA, 25 bp, Mus musculus
ttatatccaggaccccatacaagta

SEQ ID NO: 925058 - DNA, 25 bp, Mus musculus
ttatatccaggagcccatacaagta

SEQ ID NO: 925059 - DNA, 25 bp, Mus musculus
ttatatccttagagggtgaggccct

SEQ ID NO: 925060 - DNA, 25 bp, Mus musculus
ttatatccttagtgggtgaggccct

SEQ ID NO: 925061 - DNA, 25 bp, Mus musculus
ttatatccttcccatatgagcttcc

SEQ ID NO: 925062 - DNA, 25 bp, Mus musculus
ttatatccttccgatatgagcttcc

SEQ ID NO: 925063 - DNA, 25 bp, Mus musculus
ttatatctacctctgatttgcaagt

SEQ ID NO: 925064 - DNA, 25 bp, Mus musculus
ttatatctacctgtgatttgcaagt

SEQ ID NO: 925065 - DNA, 25 bp, Mus musculus
ttatatctagttccttcctgtcttg

SEQ ID NO: 925066 - DNA, 25 bp, Mus musculus
ttatatctagttgcttcctgtcttg

SEQ ID NO: 925067 - DNA, 25 bp, Mus musculus
ttatatctatgtcaccttcctggga

SEQ ID NO: 925068 - DNA, 25 bp, Mus musculus
ttatatctatgtcttcctcttcctt

SEQ ID NO: 925069 - DNA, 25 bp, Mus musculus
ttatatctatgtgaccttcctggga

SEQ ID NO: 925070 - DNA, 25 bp, Mus musculus
ttatatctatgtgttcctcttcctt

SEQ ID NO: 925071 - DNA, 25 bp, Mus musculus
ttatatctcctaagtccttcagtgt

SEQ ID NO: 925072 - DNA, 25 bp, Mus musculus
ttatatctcctatgtccttcagtgt

SEQ ID NO: 925073 - DNA, 25 bp, Mus musculus
ttatatctgatcacttttgtatttg

SEQ ID NO: 925074 - DNA, 25 bp, Mus musculus
ttatatctgatctcttttgtatttg

SEQ ID NO: 925075 - DNA, 25 bp, Mus musculus
ttatatctgcatcaccttctagaag

SEQ ID NO: 925076 - DNA, 25 bp, Mus musculus
ttatatctgcatgaccttctagaag

SEQ ID NO: 925077 - DNA, 25 bp, Mus musculus
ttatatcttcctcctaaagtaagaa

SEQ ID NO: 925078 - DNA, 25 bp, Mus musculus
ttatatcttcctgctaaagtaagaa

SEQ ID NO: 925079 - DNA, 25 bp, Mus musculus
ttatatcttctcatttactgtcatt

SEQ ID NO: 925080 - DNA, 25 bp, Mus musculus
ttatatcttctcttttactgtcatt

SEQ ID NO: 925081 - DNA, 25 bp, Mus musculus
ttatatgacagcatccagtgtgtgt

SEQ ID NO: 925082 - DNA, 25 bp, Mus musculus
ttatatgacagcttccagtgtgtgt

SEQ ID NO: 925083 - DNA, 25 bp, Mus musculus
ttatatgacttccatccctcaattg

SEQ ID NO: 925084 - DNA, 25 bp, Mus musculus
ttatatgacttcgatccctcaattg

SEQ ID NO: 925085 - DNA, 25 bp, Mus musculus
ttatatgagccacatgatcttccct

SEQ ID NO: 925086 - DNA, 25 bp, Mus musculus
ttatatgagccagatgatcttccct

SEQ ID NO: 925087 - DNA, 25 bp, Mus musculus
ttatatgagtttccatcatctccat

SEQ ID NO: 925088 - DNA, 25 bp, Mus musculus
ttatatgagtttgcatcatctccat

SEQ ID NO: 925089 - DNA, 25 bp, Mus musculus
ttatatgatgctagggatgggtccc

SEQ ID NO: 925090 - DNA, 25 bp, Mus musculus
ttatatgatgcttgggatgggtccc

SEQ ID NO: 925091 - DNA, 25 bp, Mus musculus
ttatatgcccataccagacttacct

SEQ ID NO: 925092 - DNA, 25 bp, Mus musculus
ttatatgcccattccagacttacct

SEQ ID NO: 925093 - DNA, 25 bp, Mus musculus
ttatatgctgatagtcacatgatta

SEQ ID NO: 925094 - DNA, 25 bp, Mus musculus
ttatatgctgattgtcacatgatta

SEQ ID NO: 925095 - DNA, 25 bp, Mus musculus
ttatatgctgcaaaacacctgtcca

SEQ ID NO: 925096 - DNA, 25 bp, Mus musculus
ttatatgctgcataacacctgtcca

SEQ ID NO: 925097 - DNA, 25 bp, Mus musculus
ttatatgctggaaggcttatgccac

SEQ ID NO: 925098 - DNA, 25 bp, Mus musculus
ttatatgctggatggcttatgccac

SEQ ID NO: 925099 - DNA, 25 bp, Mus musculus
ttatatggaagtcgatgattgctac

SEQ ID NO: 925100 - DNA, 25 bp, Mus musculus
ttatatggaagtggatgattgctac

SEQ ID NO: 925101 - DNA, 25 bp, Mus musculus
ttatatggcgaccaggaagtccccg

SEQ ID NO: 925102 - DNA, 25 bp, Mus musculus
ttatatggcgacgaggaagtccccg

SEQ ID NO: 925103 - DNA, 25 bp, Mus musculus
ttatatggcgatctgcttcctgtgt

SEQ ID NO: 925104 - DNA, 25 bp, Mus musculus
ttatatggcgatgtgcttcctgtgt

SEQ ID NO: 925105 - DNA, 25 bp, Mus musculus
ttatatggtcaacactcagctttca

SEQ ID NO: 925106 - DNA, 25 bp, Mus musculus
ttatatggtcaagactcagctttca

SEQ ID NO: 925107 - DNA, 25 bp, Mus musculus
ttatatggtgctatgtatatgccac

SEQ ID NO: 925108 - DNA, 25 bp, Mus musculus
ttatatggtgctttgtatatgccac

SEQ ID NO: 925109 - DNA, 25 bp, Mus musculus
ttatatgtacataacagtggttctc

SEQ ID NO: 925110 - DNA, 25 bp, Mus musculus
ttatatgtacatctgttccccactt

SEQ ID NO: 925111 - DNA, 25 bp, Mus musculus
ttatatgtacatgtgttccccactt

SEQ ID NO: 925112 - DNA, 25 bp, Mus musculus
ttatatgtacattacagtggttctc

SEQ ID NO: 925113 - DNA, 25 bp, Mus musculus
ttatatgtatttcttttctggtgcc

SEQ ID NO: 925114 - DNA, 25 bp, Mus musculus
ttatatgtatttgttttctggtgcc

SEQ ID NO: 925115 - DNA, 25 bp, Mus musculus
ttatatgtgtgtcatgctgctcccc

SEQ ID NO: 925116 - DNA, 25 bp, Mus musculus
ttatatgtgtgtgatgctgctcccc

SEQ ID NO: 925117 - DNA, 25 bp, Mus musculus
ttatatgttctgaggacctggagtc

SEQ ID NO: 925118 - DNA, 25 bp, Mus musculus
ttatatgttctgtggacctggagtc

SEQ ID NO: 925119 - DNA, 25 bp, Mus musculus
ttatattaacgccacggttcaccat

SEQ ID NO: 925120 - DNA, 25 bp, Mus musculus
ttatattaacgcgacggttcaccat

SEQ ID NO: 925121 - DNA, 25 bp, Mus musculus
ttatattagatcactttcaaagggt

SEQ ID NO: 925122 - DNA, 25 bp, Mus musculus
ttatattagatctctttcaaagggt

SEQ ID NO: 925123 - DNA, 25 bp, Mus musculus
ttatattagctaatttaacccttct

SEQ ID NO: 925124 - DNA, 25 bp, Mus musculus
ttatattagctattttaacccttct

SEQ ID NO: 925125 - DNA, 25 bp, Mus musculus
ttatattcatgtctcctcttgcttc

SEQ ID NO: 925126 - DNA, 25 bp, Mus musculus
ttatattcatgtgtcctcttgcttc

SEQ ID NO: 925127 - DNA, 25 bp, Mus musculus
ttatattccataaaccaccatattt

SEQ ID NO: 925128 - DNA, 25 bp, Mus musculus
ttatattccatataccaccatattt

SEQ ID NO: 925129 - DNA, 25 bp, Mus musculus
ttatattctatcatcaaagccaggg

SEQ ID NO: 925130 - DNA, 25 bp, Mus musculus
ttatattctatcttcaaagccaggg

SEQ ID NO: 925131 - DNA, 25 bp, Mus musculus
ttatattctcatctgcatcaacccc

SEQ ID NO: 925132 - DNA, 25 bp, Mus musculus
ttatattctcatgtgcatcaacccc

SEQ ID NO: 925133 - DNA, 25 bp, Mus musculus
ttatattctcttaacaaagggcctc

SEQ ID NO: 925134 - DNA, 25 bp, Mus musculus
ttatattctctttacaaagggcctc

SEQ ID NO: 925135 - DNA, 25 bp, Mus musculus
ttatattctgctattatgtccacct

SEQ ID NO: 925136 - DNA, 25 bp, Mus musculus
ttatattctgcttttatgtccacct

SEQ ID NO: 925137 - DNA, 25 bp, Mus musculus
ttatattcttccacctggaagccca

SEQ ID NO: 925138 - DNA, 25 bp, Mus musculus
ttatattcttcctcctggaagccca

SEQ ID NO: 925139 - DNA, 25 bp, Mus musculus
ttatattgactccaaccatcagcct

SEQ ID NO: 925140 - DNA, 25 bp, Mus musculus
ttatattgactcgaaccatcagcct

SEQ ID NO: 925141 - DNA, 25 bp, Mus musculus
ttatattggcgccacgcctacttgc

SEQ ID NO: 925142 - DNA, 25 bp, Mus musculus
ttatattggcgcgacgcctacttgc

SEQ ID NO: 925143 - DNA, 25 bp, Mus musculus
ttatattgtcccatgaacctttgca

SEQ ID NO: 925144 - DNA, 25 bp, Mus musculus
ttatattgtcccttgaacctttgca

SEQ ID NO: 925145 - DNA, 25 bp, Mus musculus
ttatattgtgaaagcattgcttttg

SEQ ID NO: 925146 - DNA, 25 bp, Mus musculus
ttatattgtgaatgcattgcttttg

SEQ ID NO: 925147 - DNA, 25 bp, Mus musculus
ttatatttaagaatgggagcccagt

SEQ ID NO: 925148 - DNA, 25 bp, Mus musculus
ttatatttaagattgggagcccagt

SEQ ID NO: 925149 - DNA, 25 bp, Mus musculus
ttatatttaatacatctgctgatgc

SEQ ID NO: 925150 - DNA, 25 bp, Mus musculus
ttatatttaatagatctgctgatgc

SEQ ID NO: 925151 - DNA, 25 bp, Mus musculus
ttatatttcctccaattcctgatcc

SEQ ID NO: 925152 - DNA, 25 bp, Mus musculus
ttatatttcctcgaattcctgatcc

SEQ ID NO: 925153 - DNA, 25 bp, Mus musculus
ttatatttctccatctaacctctct

SEQ ID NO: 925154 - DNA, 25 bp, Mus musculus
ttatatttctccttctaacctctct

SEQ ID NO: 925155 - DNA, 25 bp, Mus musculus
ttatatttgcacacgctggaggcat

SEQ ID NO: 925156 - DNA, 25 bp, Mus musculus
ttatatttgcactcgctggaggcat

SEQ ID NO: 925157 - DNA, 25 bp, Mus musculus
ttatatttgcctctgcttgacctaa

SEQ ID NO: 925158 - DNA, 25 bp, Mus musculus
ttatatttgcctgtgcttgacctaa

SEQ ID NO: 925159 - DNA, 25 bp, Mus musculus
ttatatttgctaaggccgttctggg

SEQ ID NO: 925160 - DNA, 25 bp, Mus musculus
ttatatttgctatggccgttctggg

SEQ ID NO: 925161 - DNA, 25 bp, Mus musculus
ttatattttcccacctcagacttca

SEQ ID NO: 925162 - DNA, 25 bp, Mus musculus
ttatattttccctcctcagacttca

SEQ ID NO: 925163 - DNA, 25 bp, Mus musculus
ttatattttctacgcagtctcattc

SEQ ID NO: 925164 - DNA, 25 bp, Mus musculus
ttatattttctaggcagtctcattc

SEQ ID NO: 925165 - DNA, 25 bp, Mus musculus
ttatattttggccatcccacacagc

SEQ ID NO: 925166 - DNA, 25 bp, Mus musculus
ttatattttggcgatcccacacagc

SEQ ID NO: 925167 - DNA, 25 bp, Mus musculus
ttatcaaaacccctgtgcactttaa

SEQ ID NO: 925168 - DNA, 25 bp, Mus musculus
ttatcaaaacccgtgtgcactttaa

SEQ ID NO: 925169 - DNA, 25 bp, Mus musculus
ttatcaaagaatcttggttctctca

SEQ ID NO: 925170 - DNA, 25 bp, Mus musculus
ttatcaaagaatgttggttctctca

SEQ ID NO: 925171 - DNA, 25 bp, Mus musculus
ttatcaaagacacgatttcggtagt

SEQ ID NO: 925172 - DNA, 25 bp, Mus musculus
ttatcaaagacaggatttcggtagt

SEQ ID NO: 925173 - DNA, 25 bp, Mus musculus
ttatcaaatgacctttggacccaac

SEQ ID NO: 925174 - DNA, 25 bp, Mus musculus
ttatcaaatgacgtttggacccaac

SEQ ID NO: 925175 - DNA, 25 bp, Mus musculus
ttatcaaatgtcctggaggtgccca

SEQ ID NO: 925176 - DNA, 25 bp, Mus musculus
ttatcaaatgtcgtggaggtgccca

SEQ ID NO: 925177 - DNA, 25 bp, Mus musculus
ttatcaacaacgagctctctcactt

SEQ ID NO: 925178 - DNA, 25 bp, Mus musculus
ttatcaacaacgtgctctctcactt

SEQ ID NO: 925179 - DNA, 25 bp, Mus musculus
ttatcaacagagatcccagggcact

SEQ ID NO: 925180 - DNA, 25 bp, Mus musculus
ttatcaacagagttcccagggcact

SEQ ID NO: 925181 - DNA, 25 bp, Mus musculus
ttatcaacagcaatccacatatccg

SEQ ID NO: 925182 - DNA, 25 bp, Mus musculus
ttatcaacagcattccacatatccg

SEQ ID NO: 925183 - DNA, 25 bp, Mus musculus
ttatcaagcccgatcacagcagcat

SEQ ID NO: 925184 - DNA, 25 bp, Mus musculus
ttatcaagcccgttcacagcagcat

SEQ ID NO: 925185 - DNA, 25 bp, Mus musculus
ttatcaagctataccatcaccaaga

SEQ ID NO: 925186 - DNA, 25 bp, Mus musculus
ttatcaagctattccatcaccaaga

SEQ ID NO: 925187 - DNA, 25 bp, Mus musculus
ttatcaagctcgattcccgtgcgca

SEQ ID NO: 925188 - DNA, 25 bp, Mus musculus
ttatcaagctcgtttcccgtgcgca

SEQ ID NO: 925189 - DNA, 25 bp, Mus musculus
ttatcaaggatcagatagacgcccc

SEQ ID NO: 925190 - DNA, 25 bp, Mus musculus
ttatcaaggatctgatagacgcccc

SEQ ID NO: 925191 - DNA, 25 bp, Mus musculus
ttatcaaggcgaaccctcagacata

SEQ ID NO: 925192 - DNA, 25 bp, Mus musculus
ttatcaaggcgatccctcagacata

SEQ ID NO: 925193 - DNA, 25 bp, Mus musculus
ttatcaagtaccaacatcatggaat

SEQ ID NO: 925194 - DNA, 25 bp, Mus musculus
ttatcaagtacctacatcatggaat

SEQ ID NO: 925195 - DNA, 25 bp, Mus musculus
ttatcaataaagatcatttgtcatc

SEQ ID NO: 925196 - DNA, 25 bp, Mus musculus
ttatcaataaagttcatttgtcatc

SEQ ID NO: 925197 - DNA, 25 bp, Mus musculus
ttatcaatcattagtcagccaggac

SEQ ID NO: 925198 - DNA, 25 bp, Mus musculus
ttatcaatcatttgtcagccaggac

SEQ ID NO: 925199 - DNA, 25 bp, Mus musculus
ttatcaatgcctacgtgtctatcac

SEQ ID NO: 925200 - DNA, 25 bp, Mus musculus
ttatcaatgccttcgtgtctatcac

SEQ ID NO: 925201 - DNA, 25 bp, Mus musculus
ttatcaattttcaccatactgggta

SEQ ID NO: 925202 - DNA, 25 bp, Mus musculus
ttatcaattttctccatactgggta

SEQ ID NO: 925203 - DNA, 25 bp, Mus musculus
ttatcacaaatcaatgctgcccacc

SEQ ID NO: 925204 - DNA, 25 bp, Mus musculus
ttatcacaaatctatgctgcccacc

SEQ ID NO: 925205 - DNA, 25 bp, Mus musculus
ttatcacaatacaattccctccttt

SEQ ID NO: 925206 - DNA, 25 bp, Mus musculus
ttatcacaatactattccctccttt

SEQ ID NO: 925207 - DNA, 25 bp, Mus musculus
ttatcacacataatttcccctttcc

SEQ ID NO: 925208 - DNA, 25 bp, Mus musculus
ttatcacacatattttcccctttcc

SEQ ID NO: 925209 - DNA, 25 bp, Mus musculus
ttatcacagatcagcccagtatttc

SEQ ID NO: 925210 - DNA, 25 bp, Mus musculus
ttatcacagatctgcccagtatttc

SEQ ID NO: 925211 - DNA, 25 bp, Mus musculus
ttatcacaggttagatcttagagct

SEQ ID NO: 925212 - DNA, 25 bp, Mus musculus
ttatcacaggtttgatcttagagct

SEQ ID NO: 925213 - DNA, 25 bp, Mus musculus
ttatcacatcctcggctgcatctta

SEQ ID NO: 925214 - DNA, 25 bp, Mus musculus
ttatcacatcctgggctgcatctta

SEQ ID NO: 925215 - DNA, 25 bp, Mus musculus
ttatcacatggaaggattcttacct

SEQ ID NO: 925216 - DNA, 25 bp, Mus musculus
ttatcacatggatggattcttacct

SEQ ID NO: 925217 - DNA, 25 bp, Mus musculus
ttatcacatggtccacgacgacact

SEQ ID NO: 925218 - DNA, 25 bp, Mus musculus
ttatcacatggtgcacgacgacact

SEQ ID NO: 925219 - DNA, 25 bp, Mus musculus
ttatcacatttacccaagacagagt

SEQ ID NO: 925220 - DNA, 25 bp, Mus musculus
ttatcacatttagccaagacagagt

SEQ ID NO: 925221 - DNA, 25 bp, Mus musculus
ttatcacatttccagattgaaccaa

SEQ ID NO: 925222 - DNA, 25 bp, Mus musculus
ttatcacatttcgagattgaaccaa

SEQ ID NO: 925223 - DNA, 25 bp, Mus musculus
ttatcaccaacactcggatcacaag

SEQ ID NO: 925224 - DNA, 25 bp, Mus musculus
ttatcaccaacagtcggatcacaag

SEQ ID NO: 925225 - DNA, 25 bp, Mus musculus
ttatcaccactacttgactgtgtcc

SEQ ID NO: 925226 - DNA, 25 bp, Mus musculus
ttatcaccactagttgactgtgtcc

SEQ ID NO: 925227 - DNA, 25 bp, Mus musculus
ttatcaccagggaacatattgtgtt

SEQ ID NO: 925228 - DNA, 25 bp, Mus musculus
ttatcaccagggtacatattgtgtt

SEQ ID NO: 925229 - DNA, 25 bp, Mus musculus
ttatcaccatctcggcatgtctcag

SEQ ID NO: 925230 - DNA, 25 bp, Mus musculus
ttatcaccatctgggcatgtctcag

SEQ ID NO: 925231 - DNA, 25 bp, Mus musculus
ttatcaccatttaacctgagacccg

SEQ ID NO: 925232 - DNA, 25 bp, Mus musculus
ttatcaccattttacctgagacccg

SEQ ID NO: 925233 - DNA, 25 bp, Mus musculus
ttatcacccacaatcttctgaaggc

SEQ ID NO: 925234 - DNA, 25 bp, Mus musculus
ttatcacccacattcttctgaaggc

SEQ ID NO: 925235 - DNA, 25 bp, Mus musculus
ttatcacccagtcgccattataatg

SEQ ID NO: 925236 - DNA, 25 bp, Mus musculus
ttatcacccagtggccattataatg

SEQ ID NO: 925237 - DNA, 25 bp, Mus musculus
ttatcaccctgtataaccgtcttga

SEQ ID NO: 925238 - DNA, 25 bp, Mus musculus
ttatcaccctgtttaaccgtcttga

SEQ ID NO: 925239 - DNA, 25 bp, Mus musculus
ttatcaccgaggcattgtctgcgtc

SEQ ID NO: 925240 - DNA, 25 bp, Mus musculus
ttatcaccgagggattgtctgcgtc

SEQ ID NO: 925241 - DNA, 25 bp, Mus musculus
ttatcacctagactgacccaggact

SEQ ID NO: 925242 - DNA, 25 bp, Mus musculus
ttatcacctagagtgacccaggact

SEQ ID NO: 925243 - DNA, 25 bp, Mus musculus
ttatcacctgtaccactaccgggag

SEQ ID NO: 925244 - DNA, 25 bp, Mus musculus
ttatcacctgtagcactaccgggag

SEQ ID NO: 925245 - DNA, 25 bp, Mus musculus
ttatcaccttagaaagcttgggcca

SEQ ID NO: 925246 - DNA, 25 bp, Mus musculus
ttatcaccttagtaagcttgggcca

SEQ ID NO: 925247 - DNA, 25 bp, Mus musculus
ttatcaccttcacttatagccaggg

SEQ ID NO: 925248 - DNA, 25 bp, Mus musculus
ttatcaccttcagttatagccaggg

SEQ ID NO: 925249 - DNA, 25 bp, Mus musculus
ttatcacgttgtcatggcacttggc

SEQ ID NO: 925250 - DNA, 25 bp, Mus musculus
ttatcacgttgtgatggcacttggc

SEQ ID NO: 925251 - DNA, 25 bp, Mus musculus
ttatcactagccagtccaggatttt

SEQ ID NO: 925252 - DNA, 25 bp, Mus musculus
ttatcactagcctgtccaggatttt

SEQ ID NO: 925253 - DNA, 25 bp, Mus musculus
ttatcactatatcctgcctggtcaa

SEQ ID NO: 925254 - DNA, 25 bp, Mus musculus
ttatcactatatgctgcctggtcaa

SEQ ID NO: 925255 - DNA, 25 bp, Mus musculus
ttatcactctccagtattcaagacc

SEQ ID NO: 925256 - DNA, 25 bp, Mus musculus
ttatcactctcctgtattcaagacc

SEQ ID NO: 925257 - DNA, 25 bp, Mus musculus
ttatcactctttacccttgaatgga

SEQ ID NO: 925258 - DNA, 25 bp, Mus musculus
ttatcactcttttcccttgaatgga

SEQ ID NO: 925259 - DNA, 25 bp, Mus musculus
ttatcactgaataagcattcctgtt

SEQ ID NO: 925260 - DNA, 25 bp, Mus musculus
ttatcactgaattagcattcctgtt

SEQ ID NO: 925261 - DNA, 25 bp, Mus musculus
ttatcactggcactggaatcctggc

SEQ ID NO: 925262 - DNA, 25 bp, Mus musculus
ttatcactggcagtggaatcctggc

SEQ ID NO: 925263 - DNA, 25 bp, Mus musculus
ttatcacttattaatttcttgaaac

SEQ ID NO: 925264 - DNA, 25 bp, Mus musculus
ttatcacttatttatttcttgaaac

SEQ ID NO: 925265 - DNA, 25 bp, Mus musculus
ttatcagaaagcacccactgactgc

SEQ ID NO: 925266 - DNA, 25 bp, Mus musculus
ttatcagaaagctcccactgactgc

SEQ ID NO: 925267 - DNA, 25 bp, Mus musculus
ttatcagactcaacagcctagcata

SEQ ID NO: 925268 - DNA, 25 bp, Mus musculus
ttatcagactcatcagcctagcata

SEQ ID NO: 925269 - DNA, 25 bp, Mus musculus
ttatcagactctccacggaaggccc

SEQ ID NO: 925270 - DNA, 25 bp, Mus musculus
ttatcagactctgcacggaaggccc

SEQ ID NO: 925271 - DNA, 25 bp, Mus musculus
ttatcagactttaggtgggagcaga

SEQ ID NO: 925272 - DNA, 25 bp, Mus musculus
ttatcagacttttggtgggagcaga

SEQ ID NO: 925273 - DNA, 25 bp, Mus musculus
ttatcagagtacaatttgcttatca

SEQ ID NO: 925274 - DNA, 25 bp, Mus musculus
ttatcagagtactatttgcttatca

SEQ ID NO: 925275 - DNA, 25 bp, Mus musculus
ttatcagagtcaaatccctctgcct

SEQ ID NO: 925276 - DNA, 25 bp, Mus musculus
ttatcagagtcatatccctctgcct

SEQ ID NO: 925277 - DNA, 25 bp, Mus musculus
ttatcagagtctcccctatgggcca

SEQ ID NO: 925278 - DNA, 25 bp, Mus musculus
ttatcagagtctgccctatgggcca

SEQ ID NO: 925279 - DNA, 25 bp, Mus musculus
ttatcagatcaaaaccaacccggtg

SEQ ID NO: 925280 - DNA, 25 bp, Mus musculus
ttatcagatcaataccaacccggtg

SEQ ID NO: 925281 - DNA, 25 bp, Mus musculus
ttatcagatgaacgtgtccacccgg

SEQ ID NO: 925282 - DNA, 25 bp, Mus musculus
ttatcagatgaaggtgtccacccgg

SEQ ID NO: 925283 - DNA, 25 bp, Mus musculus
ttatcagcaaatctctggctacatt

SEQ ID NO: 925284 - DNA, 25 bp, Mus musculus
ttatcagcaaatgtctggctacatt

SEQ ID NO: 925285 - DNA, 25 bp, Mus musculus
ttatcagcaccacagacagcagatg

SEQ ID NO: 925286 - DNA, 25 bp, Mus musculus
ttatcagcaccagagacagcagatg

SEQ ID NO: 925287 - DNA, 25 bp, Mus musculus
ttatcagccctcataggtcatataa

SEQ ID NO: 925288 - DNA, 25 bp, Mus musculus
ttatcagccctcttaggtcatataa

SEQ ID NO: 925289 - DNA, 25 bp, Mus musculus
ttatcagcccttctcactgattcaa

SEQ ID NO: 925290 - DNA, 25 bp, Mus musculus
ttatcagcccttgtcactgattcaa

SEQ ID NO: 925291 - DNA, 25 bp, Mus musculus
ttatcagccggcacactggttggga

SEQ ID NO: 925292 - DNA, 25 bp, Mus musculus
ttatcagccggctcactggttggga

SEQ ID NO: 925293 - DNA, 25 bp, Mus musculus
ttatcagccgtgactgcattggagc

SEQ ID NO: 925294 - DNA, 25 bp, Mus musculus
ttatcagccgtgtctgcattggagc

SEQ ID NO: 925295 - DNA, 25 bp, Mus musculus
ttatcagctggtcttttcaggcctc

SEQ ID NO: 925296 - DNA, 25 bp, Mus musculus
ttatcagctggtgttttcaggcctc

SEQ ID NO: 925297 - DNA, 25 bp, Mus musculus
ttatcagctgtcagtcccttccttg

SEQ ID NO: 925298 - DNA, 25 bp, Mus musculus
ttatcagctgtctgtcccttccttg

SEQ ID NO: 925299 - DNA, 25 bp, Mus musculus
ttatcagctgtgatctggtgctgct

SEQ ID NO: 925300 - DNA, 25 bp, Mus musculus
ttatcagctgtgttctggtgctgct

SEQ ID NO: 925301 - DNA, 25 bp, Mus musculus
ttatcagcttgtcctgggtggccat

SEQ ID NO: 925302 - DNA, 25 bp, Mus musculus
ttatcagcttgtgctgggtggccat

SEQ ID NO: 925303 - DNA, 25 bp, Mus musculus
ttatcagctttcaccgccgggagga

SEQ ID NO: 925304 - DNA, 25 bp, Mus musculus
ttatcagctttctccgccgggagga

SEQ ID NO: 925305 - DNA, 25 bp, Mus musculus
ttatcaggaaatccacgcagcggga

SEQ ID NO: 925306 - DNA, 25 bp, Mus musculus
ttatcaggaaatgcacgcagcggga

SEQ ID NO: 925307 - DNA, 25 bp, Mus musculus
ttatcaggaggacccgtagccttcc

SEQ ID NO: 925308 - DNA, 25 bp, Mus musculus
ttatcaggaggagccgtagccttcc

SEQ ID NO: 925309 - DNA, 25 bp, Mus musculus
ttatcaggcgcgatgaactcccttc

SEQ ID NO: 925310 - DNA, 25 bp, Mus musculus
ttatcaggcgcgttgaactcccttc

SEQ ID NO: 925311 - DNA, 25 bp, Mus musculus
ttatcagggaagcttgctctgccag

SEQ ID NO: 925312 - DNA, 25 bp, Mus musculus
ttatcagggaaggttgctctgccag

SEQ ID NO: 925313 - DNA, 25 bp, Mus musculus
ttatcagtaacacaattcctcctga

SEQ ID NO: 925314 - DNA, 25 bp, Mus musculus
ttatcagtaacagaattcctcctga

SEQ ID NO: 925315 - DNA, 25 bp, Mus musculus
ttatcagtacacaaagtgactagca

SEQ ID NO: 925316 - DNA, 25 bp, Mus musculus
ttatcagtacactaagtgactagca

SEQ ID NO: 925317 - DNA, 25 bp, Mus musculus
ttatcagtcagcatcaccagcattc

SEQ ID NO: 925318 - DNA, 25 bp, Mus musculus
ttatcagtcagcttcaccagcattc

SEQ ID NO: 925319 - DNA, 25 bp, Mus musculus
ttatcagtccgtagacagcaggccc

SEQ ID NO: 925320 - DNA, 25 bp, Mus musculus
ttatcagtccgttgacagcaggccc

SEQ ID NO: 925321 - DNA, 25 bp, Mus musculus
ttatcagtcctgagatactctgttt

SEQ ID NO: 925322 - DNA, 25 bp, Mus musculus
ttatcagtcctgtgatactctgttt

SEQ ID NO: 925323 - DNA, 25 bp, Mus musculus
ttatcagtcgccactgaggactcaa

SEQ ID NO: 925324 - DNA, 25 bp, Mus musculus
ttatcagtcgcctctgaggactcaa

SEQ ID NO: 925325 - DNA, 25 bp, Mus musculus
ttatcagtgattagtaagtttcatc

SEQ ID NO: 925326 - DNA, 25 bp, Mus musculus
ttatcagtgatttgtaagtttcatc

SEQ ID NO: 925327 - DNA, 25 bp, Mus musculus
ttatcagtggtcagctgtgtgcgca

SEQ ID NO: 925328 - DNA, 25 bp, Mus musculus
ttatcagtggtctgctgtgtgcgca

SEQ ID NO: 925329 - DNA, 25 bp, Mus musculus
ttatcagttaggatcactggctgct

SEQ ID NO: 925330 - DNA, 25 bp, Mus musculus
ttatcagttaggttcactggctgct

SEQ ID NO: 925331 - DNA, 25 bp, Mus musculus
ttatcagttgataatctcggcgtac

SEQ ID NO: 925332 - DNA, 25 bp, Mus musculus
ttatcagttgattatctcggcgtac

SEQ ID NO: 925333 - DNA, 25 bp, Mus musculus
ttatcatacataagccattcaggaa

SEQ ID NO: 925334 - DNA, 25 bp, Mus musculus
ttatcatacatatgccattcaggaa

SEQ ID NO: 925335 - DNA, 25 bp, Mus musculus
ttatcatatgtgcttgttataccag

SEQ ID NO: 925336 - DNA, 25 bp, Mus musculus
ttatcatatgtggttgttataccag

SEQ ID NO: 925337 - DNA, 25 bp, Mus musculus
ttatcatatttacagctgcagttgg

SEQ ID NO: 925338 - DNA, 25 bp, Mus musculus
ttatcatatttagagctgcagttgg

SEQ ID NO: 925339 - DNA, 25 bp, Mus musculus
ttatcatcaacacgatgggctgggt

SEQ ID NO: 925340 - DNA, 25 bp, Mus musculus
ttatcatcaacaggatgggctgggt

SEQ ID NO: 925341 - DNA, 25 bp, Mus musculus
ttatcatcagccaaattgcagcaat

SEQ ID NO: 925342 - DNA, 25 bp, Mus musculus
ttatcatcagcctaattgcagcaat

SEQ ID NO: 925343 - DNA, 25 bp, Mus musculus
ttatcatcatatactttacttactc

SEQ ID NO: 925344 - DNA, 25 bp, Mus musculus
ttatcatcatattctttacttactc

SEQ ID NO: 925345 - DNA, 25 bp, Mus musculus
ttatcatcattaagtggccccagct

SEQ ID NO: 925346 - DNA, 25 bp, Mus musculus
ttatcatcattatgtggccccagct

SEQ ID NO: 925347 - DNA, 25 bp, Mus musculus
ttatcatcattgatcccaggtggag

SEQ ID NO: 925348 - DNA, 25 bp, Mus musculus
ttatcatcattgttcccaggtggag

SEQ ID NO: 925349 - DNA, 25 bp, Mus musculus
ttatcatccatgacttcatccttga

SEQ ID NO: 925350 - DNA, 25 bp, Mus musculus
ttatcatccatgtcttcatccttga

SEQ ID NO: 925351 - DNA, 25 bp, Mus musculus
ttatcatcctagcagctacctctac

SEQ ID NO: 925352 - DNA, 25 bp, Mus musculus
ttatcatcctaggagctacctctac

SEQ ID NO: 925353 - DNA, 25 bp, Mus musculus
ttatcatcctctaccatgtttggga

SEQ ID NO: 925354 - DNA, 25 bp, Mus musculus
ttatcatcctctctaccactatttc

SEQ ID NO: 925355 - DNA, 25 bp, Mus musculus
ttatcatcctctgtaccactatttc

SEQ ID NO: 925356 - DNA, 25 bp, Mus musculus
ttatcatcctcttccatgtttggga

SEQ ID NO: 925357 - DNA, 25 bp, Mus musculus
ttatcatcctgtacttgaccctgtg

SEQ ID NO: 925358 - DNA, 25 bp, Mus musculus
ttatcatcctgttcttgaccctgtg

SEQ ID NO: 925359 - DNA, 25 bp, Mus musculus
ttatcatctcacagtccacacagtg

SEQ ID NO: 925360 - DNA, 25 bp, Mus musculus
ttatcatctcactgtccacacagtg

SEQ ID NO: 925361 - DNA, 25 bp, Mus musculus
ttatcatctgacaccaagcctatgg

SEQ ID NO: 925362 - DNA, 25 bp, Mus musculus
ttatcatctgactccaagcctatgg

SEQ ID NO: 925363 - DNA, 25 bp, Mus musculus
ttatcatctgccacagaagcttcaa

SEQ ID NO: 925364 - DNA, 25 bp, Mus musculus
ttatcatctgcctcagaagcttcaa

SEQ ID NO: 925365 - DNA, 25 bp, Mus musculus
ttatcatgacggctttgtactgtgg

SEQ ID NO: 925366 - DNA, 25 bp, Mus musculus
ttatcatgacgggtttgtactgtgg

SEQ ID NO: 925367 - DNA, 25 bp, Mus musculus
ttatcatgctagctatgatggcgca

SEQ ID NO: 925368 - DNA, 25 bp, Mus musculus
ttatcatgctaggtatgatggcgca

SEQ ID NO: 925369 - DNA, 25 bp, Mus musculus
ttatcatgctggcttttggtcctcc

SEQ ID NO: 925370 - DNA, 25 bp, Mus musculus
ttatcatgctgggttttggtcctcc

SEQ ID NO: 925371 - DNA, 25 bp, Mus musculus
ttatcatgctgtaagaatggcttgg

SEQ ID NO: 925372 - DNA, 25 bp, Mus musculus
ttatcatgctgttagaatggcttgg

SEQ ID NO: 925373 - DNA, 25 bp, Mus musculus
ttatcatggacacacactaccctta

SEQ ID NO: 925374 - DNA, 25 bp, Mus musculus
ttatcatggacagacactaccctta

SEQ ID NO: 925375 - DNA, 25 bp, Mus musculus
ttatcatgtagtctggcctggtctc

SEQ ID NO: 925376 - DNA, 25 bp, Mus musculus
ttatcatgtagtgtggcctggtctc

SEQ ID NO: 925377 - DNA, 25 bp, Mus musculus
ttatcatgtgggaagccctgggttt

SEQ ID NO: 925378 - DNA, 25 bp, Mus musculus
ttatcatgtgggtagccctgggttt

SEQ ID NO: 925379 - DNA, 25 bp, Mus musculus
ttatcattacgtacagtcacagcta

SEQ ID NO: 925380 - DNA, 25 bp, Mus musculus
ttatcattacgttcagtcacagcta

SEQ ID NO: 925381 - DNA, 25 bp, Mus musculus
ttatcattagtaccccattgcctga

SEQ ID NO: 925382 - DNA, 25 bp, Mus musculus
ttatcattagtagcccattgcctga

SEQ ID NO: 925383 - DNA, 25 bp, Mus musculus
ttatcattcaaacctgaactgtctc

SEQ ID NO: 925384 - DNA, 25 bp, Mus musculus
ttatcattcaaagctgaactgtctc

SEQ ID NO: 925385 - DNA, 25 bp, Mus musculus
ttatcattctcaagacctgctgcac

SEQ ID NO: 925386 - DNA, 25 bp, Mus musculus
ttatcattctcatgacctgctgcac

SEQ ID NO: 925387 - DNA, 25 bp, Mus musculus
ttatcattctttcttccccaacttg

SEQ ID NO: 925388 - DNA, 25 bp, Mus musculus
ttatcattctttgttccccaacttg

SEQ ID NO: 925389 - DNA, 25 bp, Mus musculus
ttatcattgaagataaacggtggca

SEQ ID NO: 925390 - DNA, 25 bp, Mus musculus
ttatcattgaagttaaacggtggca

SEQ ID NO: 925391 - DNA, 25 bp, Mus musculus
ttatcattgctgctaccgtagtgtg

SEQ ID NO: 925392 - DNA, 25 bp, Mus musculus
ttatcattgctggtaccgtagtgtg

SEQ ID NO: 925393 - DNA, 25 bp, Mus musculus
ttatcattgtatctcccaagtctcc

SEQ ID NO: 925394 - DNA, 25 bp, Mus musculus
ttatcattgtatgtcccaagtctcc

SEQ ID NO: 925395 - DNA, 25 bp, Mus musculus
ttatcatttagtacagttctgtcac

SEQ ID NO: 925396 - DNA, 25 bp, Mus musculus
ttatcatttagttcagttctgtcac

SEQ ID NO: 925397 - DNA, 25 bp, Mus musculus
ttatcatttcccctgaggagaatgt

SEQ ID NO: 925398 - DNA, 25 bp, Mus musculus
ttatcatttcccctgctagctaagc

SEQ ID NO: 925399 - DNA, 25 bp, Mus musculus
ttatcatttcccgtgaggagaatgt

SEQ ID NO: 925400 - DNA, 25 bp, Mus musculus
ttatcatttcccgtgctagctaagc

SEQ ID NO: 925401 - DNA, 25 bp, Mus musculus
ttatccaaaaccagggcggccagcg

SEQ ID NO: 925402 - DNA, 25 bp, Mus musculus
ttatccaaaacctgggcggccagcg

SEQ ID NO: 925403 - DNA, 25 bp, Mus musculus
ttatccaaaagcagcggaactgggc

SEQ ID NO: 925404 - DNA, 25 bp, Mus musculus
ttatccaaaagctgcggaactgggc

SEQ ID NO: 925405 - DNA, 25 bp, Mus musculus
ttatccaaacatccccgaagcatac

SEQ ID NO: 925406 - DNA, 25 bp, Mus musculus
ttatccaaacatgcccgaagcatac

SEQ ID NO: 925407 - DNA, 25 bp, Mus musculus
ttatccaaagcgacatagcggctcg

SEQ ID NO: 925408 - DNA, 25 bp, Mus musculus
ttatccaaagcgtcatagcggctcg

SEQ ID NO: 925409 - DNA, 25 bp, Mus musculus
ttatccaaccttacacattcgtatc

SEQ ID NO: 925410 - DNA, 25 bp, Mus musculus
ttatccaacctttcacattcgtatc

SEQ ID NO: 925411 - DNA, 25 bp, Mus musculus
ttatccaagctacgactccattctc

SEQ ID NO: 925412 - DNA, 25 bp, Mus musculus
ttatccaagctaggactccattctc

SEQ ID NO: 925413 - DNA, 25 bp, Mus musculus
ttatccaaggatagaaagcctgcct

SEQ ID NO: 925414 - DNA, 25 bp, Mus musculus
ttatccaaggattgaaagcctgcct

SEQ ID NO: 925415 - DNA, 25 bp, Mus musculus
ttatccaccagaacaggcccaggct

SEQ ID NO: 925416 - DNA, 25 bp, Mus musculus
ttatccaccagatcaggcccaggct

SEQ ID NO: 925417 - DNA, 25 bp, Mus musculus
ttatccaccggcaaaacgtttcctg

SEQ ID NO: 925418 - DNA, 25 bp, Mus musculus
ttatccaccggctaaacgtttcctg

SEQ ID NO: 925419 - DNA, 25 bp, Mus musculus
ttatccacgcctcctggacttctga

SEQ ID NO: 925420 - DNA, 25 bp, Mus musculus
ttatccacgcctgctggacttctga

SEQ ID NO: 925421 - DNA, 25 bp, Mus musculus
ttatccactcacagggtgtcatctc

SEQ ID NO: 925422 - DNA, 25 bp, Mus musculus
ttatccactcactgggtgtcatctc

SEQ ID NO: 925423 - DNA, 25 bp, Mus musculus
ttatccagacacagttaagggccga

SEQ ID NO: 925424 - DNA, 25 bp, Mus musculus
ttatccagacactgttaagggccga

SEQ ID NO: 925425 - DNA, 25 bp, Mus musculus
ttatccagagatattccaggagtgt

SEQ ID NO: 925426 - DNA, 25 bp, Mus musculus
ttatccagagattttccaggagtgt

SEQ ID NO: 925427 - DNA, 25 bp, Mus musculus
ttatccagagtaattaacatgtaaa

SEQ ID NO: 925428 - DNA, 25 bp, Mus musculus
ttatccagagtatttaacatgtaaa

SEQ ID NO: 925429 - DNA, 25 bp, Mus musculus
ttatccagccgtagtagtgcacttt

SEQ ID NO: 925430 - DNA, 25 bp, Mus musculus
ttatccagccgttgtagtgcacttt

SEQ ID NO: 925431 - DNA, 25 bp, Mus musculus
ttatccagcgccatggttagaggga

SEQ ID NO: 925432 - DNA, 25 bp, Mus musculus
ttatccagcgccttggttagaggga

SEQ ID NO: 925433 - DNA, 25 bp, Mus musculus
ttatccaggatgaccacattccatt

SEQ ID NO: 925434 - DNA, 25 bp, Mus musculus
ttatccaggatgtccacattccatt

SEQ ID NO: 925435 - DNA, 25 bp, Mus musculus
ttatccaggccaaccggagagatcc

SEQ ID NO: 925436 - DNA, 25 bp, Mus musculus
ttatccaggccatccggagagatcc

SEQ ID NO: 925437 - DNA, 25 bp, Mus musculus
ttatccaggctgctcagcgcgagac

SEQ ID NO: 925438 - DNA, 25 bp, Mus musculus
ttatccaggctggtcagcgcgagac

SEQ ID NO: 925439 - DNA, 25 bp, Mus musculus
ttatccaggtcaagctaaaaagcga

SEQ ID NO: 925440 - DNA, 25 bp, Mus musculus
ttatccaggtcatgctaaaaagcga

SEQ ID NO: 925441 - DNA, 25 bp, Mus musculus
ttatccagtggaacattcgggcctt

SEQ ID NO: 925442 - DNA, 25 bp, Mus musculus
ttatccagtggatcattcgggcctt

SEQ ID NO: 925443 - DNA, 25 bp, Mus musculus
ttatccataagacatcagcaggtat

SEQ ID NO: 925444 - DNA, 25 bp, Mus musculus
ttatccataagagatcagcaggtat

SEQ ID NO: 925445 - DNA, 25 bp, Mus musculus
ttatccatacccaatctgtacagaa

SEQ ID NO: 925446 - DNA, 25 bp, Mus musculus
ttatccataccctatctgtacagaa

SEQ ID NO: 925447 - DNA, 25 bp, Mus musculus
ttatccatatgcacgtacacacgcg

SEQ ID NO: 925448 - DNA, 25 bp, Mus musculus
ttatccatatgctcgtacacacgcg

SEQ ID NO: 925449 - DNA, 25 bp, Mus musculus
ttatccatcatgctatatctatagg

SEQ ID NO: 925450 - DNA, 25 bp, Mus musculus
ttatccatcatggtatatctatagg

SEQ ID NO: 925451 - DNA, 25 bp, Mus musculus
ttatccatccatagtttcaacattt

SEQ ID NO: 925452 - DNA, 25 bp, Mus musculus
ttatccatccattgtttcaacattt

SEQ ID NO: 925453 - DNA, 25 bp, Mus musculus
ttatccatccctctgaccaagagga

SEQ ID NO: 925454 - DNA, 25 bp, Mus musculus
ttatccatccctgtgaccaagagga

SEQ ID NO: 925455 - DNA, 25 bp, Mus musculus
ttatcccaagggacgttgctgtcct

SEQ ID NO: 925456 - DNA, 25 bp, Mus musculus
ttatcccaagggtcgttgctgtcct

SEQ ID NO: 925457 - DNA, 25 bp, Mus musculus
ttatcccagagcaccaaagtatagc

SEQ ID NO: 925458 - DNA, 25 bp, Mus musculus
ttatcccagagctccaaagtatagc

SEQ ID NO: 925459 - DNA, 25 bp, Mus musculus
ttatcccagcctctacactgtttga

SEQ ID NO: 925460 - DNA, 25 bp, Mus musculus
ttatcccagcctgtacactgtttga

SEQ ID NO: 925461 - DNA, 25 bp, Mus musculus
ttatcccaggatcctctaagcctta

SEQ ID NO: 925462 - DNA, 25 bp, Mus musculus
ttatcccaggatgctctaagcctta

SEQ ID NO: 925463 - DNA, 25 bp, Mus musculus
ttatcccagtgtcattgactccagg

SEQ ID NO: 925464 - DNA, 25 bp, Mus musculus
ttatcccagtgtgattgactccagg

SEQ ID NO: 925465 - DNA, 25 bp, Mus musculus
ttatcccataaaacatttgttttcc

SEQ ID NO: 925466 - DNA, 25 bp, Mus musculus
ttatcccataaatcatttgttttcc

SEQ ID NO: 925467 - DNA, 25 bp, Mus musculus
ttatccccaggaactggattacccc

SEQ ID NO: 925468 - DNA, 25 bp, Mus musculus
ttatccccaggatctggattacccc

SEQ ID NO: 925469 - DNA, 25 bp, Mus musculus
ttatccccagggacaaagggcttgc

SEQ ID NO: 925470 - DNA, 25 bp, Mus musculus
ttatccccagggtcaaagggcttgc

SEQ ID NO: 925471 - DNA, 25 bp, Mus musculus
ttatccccatgcacagaaacgctca

SEQ ID NO: 925472 - DNA, 25 bp, Mus musculus
ttatccccatgctcagaaacgctca

SEQ ID NO: 925473 - DNA, 25 bp, Mus musculus
ttatccccatgtagcttgtggtagc

SEQ ID NO: 925474 - DNA, 25 bp, Mus musculus
ttatccccatgttgcttgtggtagc

SEQ ID NO: 925475 - DNA, 25 bp, Mus musculus
ttatccccttctctgtgactgagtt

SEQ ID NO: 925476 - DNA, 25 bp, Mus musculus
ttatccccttctgtgtgactgagtt

SEQ ID NO: 925477 - DNA, 25 bp, Mus musculus
ttatcccgggtccagttcagttcag

SEQ ID NO: 925478 - DNA, 25 bp, Mus musculus
ttatcccgggtcgagttcagttcag

SEQ ID NO: 925479 - DNA, 25 bp, Mus musculus
ttatcccgtggaatttacctctgga

SEQ ID NO: 925480 - DNA, 25 bp, Mus musculus
ttatcccgtggattttacctctgga

SEQ ID NO: 925481 - DNA, 25 bp, Mus musculus
ttatcccgttgaatgggtatcttgt

SEQ ID NO: 925482 - DNA, 25 bp, Mus musculus
ttatcccgttgattgggtatcttgt

SEQ ID NO: 925483 - DNA, 25 bp, Mus musculus
ttatccctagttcctgtctgagtaa

SEQ ID NO: 925484 - DNA, 25 bp, Mus musculus
ttatccctagttgctgtctgagtaa

SEQ ID NO: 925485 - DNA, 25 bp, Mus musculus
ttatccctctgtcaggagtcaggac

SEQ ID NO: 925486 - DNA, 25 bp, Mus musculus
ttatccctctgtgaggagtcaggac

SEQ ID NO: 925487 - DNA, 25 bp, Mus musculus
ttatccctgccaacgattaactgtg

SEQ ID NO: 925488 - DNA, 25 bp, Mus musculus
ttatccctgccatcgattaactgtg

SEQ ID NO: 925489 - DNA, 25 bp, Mus musculus
ttatccctgcttcactctgtgagaa

SEQ ID NO: 925490 - DNA, 25 bp, Mus musculus
ttatccctgcttgactctgtgagaa

SEQ ID NO: 925491 - DNA, 25 bp, Mus musculus
ttatcccttcagattattatcctaa

SEQ ID NO: 925492 - DNA, 25 bp, Mus musculus
ttatcccttcagtttattatcctaa

SEQ ID NO: 925493 - DNA, 25 bp, Mus musculus
ttatcccttcttataactgggcaga

SEQ ID NO: 925494 - DNA, 25 bp, Mus musculus
ttatcccttcttttaactgggcaga

SEQ ID NO: 925495 - DNA, 25 bp, Mus musculus
ttatcccttgggatctgccaagaat

SEQ ID NO: 925496 - DNA, 25 bp, Mus musculus
ttatcccttgggttctgccaagaat

SEQ ID NO: 925497 - DNA, 25 bp, Mus musculus
ttatcccttgttccaaaagcgtgga

SEQ ID NO: 925498 - DNA, 25 bp, Mus musculus
ttatcccttgttgcaaaagcgtgga

SEQ ID NO: 925499 - DNA, 25 bp, Mus musculus
ttatccctttaactccgctgctttt

SEQ ID NO: 925500 - DNA, 25 bp, Mus musculus
ttatccctttaagtccgctgctttt

SEQ ID NO: 925501 - DNA, 25 bp, Mus musculus
ttatccctttcccaatgtatccatg

SEQ ID NO: 925502 - DNA, 25 bp, Mus musculus
ttatccctttccgaatgtatccatg

SEQ ID NO: 925503 - DNA, 25 bp, Mus musculus
ttatccgacacacggtcacggtcat

SEQ ID NO: 925504 - DNA, 25 bp, Mus musculus
ttatccgacacagggtcacggtcat

SEQ ID NO: 925505 - DNA, 25 bp, Mus musculus
ttatccgaccagagcctgttaagtc

SEQ ID NO: 925506 - DNA, 25 bp, Mus musculus
ttatccgaccagtgcctgttaagtc

SEQ ID NO: 925507 - DNA, 25 bp, Mus musculus
ttatccgaggcaaaagtagttccta

SEQ ID NO: 925508 - DNA, 25 bp, Mus musculus
ttatccgaggcataagtagttccta

SEQ ID NO: 925509 - DNA, 25 bp, Mus musculus
ttatccgattaaaactcaaactctg

SEQ ID NO: 925510 - DNA, 25 bp, Mus musculus
ttatccgattaatactcaaactctg

SEQ ID NO: 925511 - DNA, 25 bp, Mus musculus
ttatccggagacaaaccctggacgc

SEQ ID NO: 925512 - DNA, 25 bp, Mus musculus
ttatccggagactaaccctggacgc

SEQ ID NO: 925513 - DNA, 25 bp, Mus musculus
ttatccggattacgtttcctctgga

SEQ ID NO: 925514 - DNA, 25 bp, Mus musculus
ttatccggattaggtttcctctgga

SEQ ID NO: 925515 - DNA, 25 bp, Mus musculus
ttatccgtaaggagtccacgtcggg

SEQ ID NO: 925516 - DNA, 25 bp, Mus musculus
ttatccgtaaggtgtccacgtcggg

SEQ ID NO: 925517 - DNA, 25 bp, Mus musculus
ttatccgtggctctcagctcattga

SEQ ID NO: 925518 - DNA, 25 bp, Mus musculus
ttatccgtggctgtcagctcattga

SEQ ID NO: 925519 - DNA, 25 bp, Mus musculus
ttatcctacgtgctttctccataaa

SEQ ID NO: 925520 - DNA, 25 bp, Mus musculus
ttatcctacgtggtttctccataaa

SEQ ID NO: 925521 - DNA, 25 bp, Mus musculus
ttatcctagctgaagagacaggcag

SEQ ID NO: 925522 - DNA, 25 bp, Mus musculus
ttatcctagctgtagagacaggcag

SEQ ID NO: 925523 - DNA, 25 bp, Mus musculus
ttatcctagtcaaccaaaaccctta

SEQ ID NO: 925524 - DNA, 25 bp, Mus musculus
ttatcctagtcatccaaaaccctta

SEQ ID NO: 925525 - DNA, 25 bp, Mus musculus
ttatcctatgcaagaagtttcccta

SEQ ID NO: 925526 - DNA, 25 bp, Mus musculus
ttatcctatgcatgaagtttcccta

SEQ ID NO: 925527 - DNA, 25 bp, Mus musculus
ttatcctcaagcagcaacacactta

SEQ ID NO: 925528 - DNA, 25 bp, Mus musculus
ttatcctcaagctgcaacacactta

SEQ ID NO: 925529 - DNA, 25 bp, Mus musculus
ttatcctcacatccctccattatat

SEQ ID NO: 925530 - DNA, 25 bp, Mus musculus
ttatcctcacatgcctccattatat

SEQ ID NO: 925531 - DNA, 25 bp, Mus musculus
ttatcctcatagagaagtttccctg

SEQ ID NO: 925532 - DNA, 25 bp, Mus musculus
ttatcctcatagtgaagtttccctg

SEQ ID NO: 925533 - DNA, 25 bp, Mus musculus
ttatcctcctaaaaatattgccaag

SEQ ID NO: 925534 - DNA, 25 bp, Mus musculus
ttatcctcctaataatattgccaag

SEQ ID NO: 925535 - DNA, 25 bp, Mus musculus
ttatcctcggcgataagacaagagc

SEQ ID NO: 925536 - DNA, 25 bp, Mus musculus
ttatcctcggcgttaagacaagagc

SEQ ID NO: 925537 - DNA, 25 bp, Mus musculus
ttatcctctccacacatagtttgtt

SEQ ID NO: 925538 - DNA, 25 bp, Mus musculus
ttatcctctccagacatagtttgtt

SEQ ID NO: 925539 - DNA, 25 bp, Mus musculus
ttatcctctcttcctgttaatgcat

SEQ ID NO: 925540 - DNA, 25 bp, Mus musculus
ttatcctctcttgctgttaatgcat

SEQ ID NO: 925541 - DNA, 25 bp, Mus musculus
ttatcctctgatagccatgtgtgtg

SEQ ID NO: 925542 - DNA, 25 bp, Mus musculus
ttatcctctgattgccatgtgtgtg

SEQ ID NO: 925543 - DNA, 25 bp, Mus musculus
ttatcctctgttatgtttctcccat

SEQ ID NO: 925544 - DNA, 25 bp, Mus musculus
ttatcctctgttttgtttctcccat

SEQ ID NO: 925545 - DNA, 25 bp, Mus musculus
ttatcctgaaggagtcgcggtgaga

SEQ ID NO: 925546 - DNA, 25 bp, Mus musculus
ttatcctgaaggtgtcgcggtgaga

SEQ ID NO: 925547 - DNA, 25 bp, Mus musculus
ttatcctgaatacaggccacctcca

SEQ ID NO: 925548 - DNA, 25 bp, Mus musculus
ttatcctgaatagaggccacctcca

SEQ ID NO: 925549 - DNA, 25 bp, Mus musculus
ttatcctgaatgacgaaagggccat

SEQ ID NO: 925550 - DNA, 25 bp, Mus musculus
ttatcctgaatgtcgaaagggccat

SEQ ID NO: 925551 - DNA, 25 bp, Mus musculus
ttatcctgagcaacatcgggcacat

SEQ ID NO: 925552 - DNA, 25 bp, Mus musculus
ttatcctgagcatcatcgggcacat

SEQ ID NO: 925553 - DNA, 25 bp, Mus musculus
ttatcctgcactctaagcgtatctc

SEQ ID NO: 925554 - DNA, 25 bp, Mus musculus
ttatcctgcactgtaagcgtatctc

SEQ ID NO: 925555 - DNA, 25 bp, Mus musculus
ttatcctggaaacatcaccaataac

SEQ ID NO: 925556 - DNA, 25 bp, Mus musculus
ttatcctggaaagatcaccaataac

SEQ ID NO: 925557 - DNA, 25 bp, Mus musculus
ttatcctggctgacttgcatactta

SEQ ID NO: 925558 - DNA, 25 bp, Mus musculus
ttatcctggctgtcttgcatactta

SEQ ID NO: 925559 - DNA, 25 bp, Mus musculus
ttatcctgggctctgtaacaagtca

SEQ ID NO: 925560 - DNA, 25 bp, Mus musculus
ttatcctgggctgtgtaacaagtca

SEQ ID NO: 925561 - DNA, 25 bp, Mus musculus
ttatcctggtggcttgtgtcaaaga

SEQ ID NO: 925562 - DNA, 25 bp, Mus musculus
ttatcctggtgggttgtgtcaaaga

SEQ ID NO: 925563 - DNA, 25 bp, Mus musculus
ttatcctgtgaacttaccccaccta

SEQ ID NO: 925564 - DNA, 25 bp, Mus musculus
ttatcctgtgaagttaccccaccta

SEQ ID NO: 925565 - DNA, 25 bp, Mus musculus
ttatcctgtgagcttgggtgcctcc

SEQ ID NO: 925566 - DNA, 25 bp, Mus musculus
ttatcctgtgaggttgggtgcctcc

SEQ ID NO: 925567 - DNA, 25 bp, Mus musculus
ttatcctgtggcactatatgctcct

SEQ ID NO: 925568 - DNA, 25 bp, Mus musculus
ttatcctgtggctctatatgctcct

SEQ ID NO: 925569 - DNA, 25 bp, Mus musculus
ttatcctgtgtgctcactgggtaag

SEQ ID NO: 925570 - DNA, 25 bp, Mus musculus
ttatcctgtgtggtcactgggtaag

SEQ ID NO: 925571 - DNA, 25 bp, Mus musculus
ttatccttaaccactgtaaaccacg

SEQ ID NO: 925572 - DNA, 25 bp, Mus musculus
ttatccttaacctctgtaaaccacg

SEQ ID NO: 925573 - DNA, 25 bp, Mus musculus
ttatccttcacaaggcctgggacac

SEQ ID NO: 925574 - DNA, 25 bp, Mus musculus
ttatccttcacatggcctgggacac

SEQ ID NO: 925575 - DNA, 25 bp, Mus musculus
ttatccttcagactttctcggccca

SEQ ID NO: 925576 - DNA, 25 bp, Mus musculus
ttatccttcagagtttctcggccca

SEQ ID NO: 925577 - DNA, 25 bp, Mus musculus
ttatccttcaggcatccccaaagct

SEQ ID NO: 925578 - DNA, 25 bp, Mus musculus
ttatccttcagggatccccaaagct

SEQ ID NO: 925579 - DNA, 25 bp, Mus musculus
ttatccttcgaaacttcataccaga

SEQ ID NO: 925580 - DNA, 25 bp, Mus musculus
ttatccttcgaatcttcataccaga

SEQ ID NO: 925581 - DNA, 25 bp, Mus musculus
ttatccttcttaaacggaacctttg

SEQ ID NO: 925582 - DNA, 25 bp, Mus musculus
ttatccttcttatacggaacctttg

SEQ ID NO: 925583 - DNA, 25 bp, Mus musculus
ttatccttcttcaatagcctctgaa

SEQ ID NO: 925584 - DNA, 25 bp, Mus musculus
ttatccttcttctatagcctctgaa

SEQ ID NO: 925585 - DNA, 25 bp, Mus musculus
ttatccttgatcatagtttgcttat

SEQ ID NO: 925586 - DNA, 25 bp, Mus musculus
ttatccttgatcttagtttgcttat

SEQ ID NO: 925587 - DNA, 25 bp, Mus musculus
ttatccttggcaacacacctagttt

SEQ ID NO: 925588 - DNA, 25 bp, Mus musculus
ttatccttggcatcacacctagttt

SEQ ID NO: 925589 - DNA, 25 bp, Mus musculus
ttatccttggctacacactgaatgt

SEQ ID NO: 925590 - DNA, 25 bp, Mus musculus
ttatccttggcttcacactgaatgt

SEQ ID NO: 925591 - DNA, 25 bp, Mus musculus
ttatccttgtcacctcacggtcaag

SEQ ID NO: 925592 - DNA, 25 bp, Mus musculus
ttatccttgtcacttggctgcagga

SEQ ID NO: 925593 - DNA, 25 bp, Mus musculus
ttatccttgtcagctcacggtcaag

SEQ ID NO: 925594 - DNA, 25 bp, Mus musculus
ttatccttgtcagttggctgcagga

SEQ ID NO: 925595 - DNA, 25 bp, Mus musculus
ttatcctttaagctccacgagtgga

SEQ ID NO: 925596 - DNA, 25 bp, Mus musculus
ttatcctttaaggtccacgagtgga

SEQ ID NO: 925597 - DNA, 25 bp, Mus musculus
ttatcctttaggatccagagactgg

SEQ ID NO: 925598 - DNA, 25 bp, Mus musculus
ttatcctttaggttccagagactgg

SEQ ID NO: 925599 - DNA, 25 bp, Mus musculus
ttatcctttagtcttgttcccctca

SEQ ID NO: 925600 - DNA, 25 bp, Mus musculus
ttatcctttagtgttgttcccctca

SEQ ID NO: 925601 - DNA, 25 bp, Mus musculus
ttatcctttgagattccttgcagac

SEQ ID NO: 925602 - DNA, 25 bp, Mus musculus
ttatcctttgagtttccttgcagac

SEQ ID NO: 925603 - DNA, 25 bp, Mus musculus
ttatcgacaggaagcctatagggct

SEQ ID NO: 925604 - DNA, 25 bp, Mus musculus
ttatcgacaggatgcctatagggct

SEQ ID NO: 925605 - DNA, 25 bp, Mus musculus
ttatcgattcacatgttggctggta

SEQ ID NO: 925606 - DNA, 25 bp, Mus musculus
ttatcgattcacttgttggctggta

SEQ ID NO: 925607 - DNA, 25 bp, Mus musculus
ttatcgccaaccagctgtatcattt

SEQ ID NO: 925608 - DNA, 25 bp, Mus musculus
ttatcgccaacctgctgtatcattt

SEQ ID NO: 925609 - DNA, 25 bp, Mus musculus
ttatcgccctgcacagttatgagcc

SEQ ID NO: 925610 - DNA, 25 bp, Mus musculus
ttatcgccctgctcagttatgagcc

SEQ ID NO: 925611 - DNA, 25 bp, Mus musculus
ttatcgcgccagagtacgttctgaa

SEQ ID NO: 925612 - DNA, 25 bp, Mus musculus
ttatcgcgccagtgtacgttctgaa

SEQ ID NO: 925613 - DNA, 25 bp, Mus musculus
ttatcggacgagacatgcagcctgc

SEQ ID NO: 925614 - DNA, 25 bp, Mus musculus
ttatcggacgagtcatgcagcctgc

SEQ ID NO: 925615 - DNA, 25 bp, Mus musculus
ttatcggccttgagtcagcaggtcg

SEQ ID NO: 925616 - DNA, 25 bp, Mus musculus
ttatcggccttgtgtcagcaggtcg

SEQ ID NO: 925617 - DNA, 25 bp, Mus musculus
ttatcggctcacaccgagggcttga

SEQ ID NO: 925618 - DNA, 25 bp, Mus musculus
ttatcggctcactccgagggcttga

SEQ ID NO: 925619 - DNA, 25 bp, Mus musculus
ttatcgggttggacacactggtgac

SEQ ID NO: 925620 - DNA, 25 bp, Mus musculus
ttatcgggttggtcacactggtgac

SEQ ID NO: 925621 - DNA, 25 bp, Mus musculus
ttatcgtcgcaacgcactgtgggct

SEQ ID NO: 925622 - DNA, 25 bp, Mus musculus
ttatcgtcgcaaggcactgtgggct

SEQ ID NO: 925623 - DNA, 25 bp, Mus musculus
ttatcgtctttgctgttcacttcta

SEQ ID NO: 925624 - DNA, 25 bp, Mus musculus
ttatcgtctttggtgttcacttcta

SEQ ID NO: 925625 - DNA, 25 bp, Mus musculus
ttatcgtgagctcgatgattgccca

SEQ ID NO: 925626 - DNA, 25 bp, Mus musculus
ttatcgtgagctggatgattgccca

SEQ ID NO: 925627 - DNA, 25 bp, Mus musculus
ttatcgtgagtaatcagtgtctctg

SEQ ID NO: 925628 - DNA, 25 bp, Mus musculus
ttatcgtgagtattcagtgtctctg

SEQ ID NO: 925629 - DNA, 25 bp, Mus musculus
ttatcgtgtgctagttcctaaaaac

SEQ ID NO: 925630 - DNA, 25 bp, Mus musculus
ttatcgtgtgcttgttcctaaaaac

SEQ ID NO: 925631 - DNA, 25 bp, Mus musculus
ttatctaacatcaacattgccctaa

SEQ ID NO: 925632 - DNA, 25 bp, Mus musculus
ttatctaacatctacattgccctaa

SEQ ID NO: 925633 - DNA, 25 bp, Mus musculus
ttatctacacccaggacttcacagt

SEQ ID NO: 925634 - DNA, 25 bp, Mus musculus
ttatctacaccctggacttcacagt

SEQ ID NO: 925635 - DNA, 25 bp, Mus musculus
ttatctacatatacagcttcccatc

SEQ ID NO: 925636 - DNA, 25 bp, Mus musculus
ttatctacatattcagcttcccatc

SEQ ID NO: 925637 - DNA, 25 bp, Mus musculus
ttatctacatgaaggaatgcccttg

SEQ ID NO: 925638 - DNA, 25 bp, Mus musculus
ttatctacatgatggaatgcccttg

SEQ ID NO: 925639 - DNA, 25 bp, Mus musculus
ttatctacctctctgttgttccggg

SEQ ID NO: 925640 - DNA, 25 bp, Mus musculus
ttatctacctctgtgttgttccggg

SEQ ID NO: 925641 - DNA, 25 bp, Mus musculus
ttatctacctttcaatcaacatgag

SEQ ID NO: 925642 - DNA, 25 bp, Mus musculus
ttatctacctttgaatcaacatgag

SEQ ID NO: 925643 - DNA, 25 bp, Mus musculus
ttatctacgtcaccttcctcttgtt

SEQ ID NO: 925644 - DNA, 25 bp, Mus musculus
ttatctacgtcagcttcctcttgtt

SEQ ID NO: 925645 - DNA, 25 bp, Mus musculus
ttatctagatgacagcactccgtcc

SEQ ID NO: 925646 - DNA, 25 bp, Mus musculus
ttatctagatgagagcactccgtcc

SEQ ID NO: 925647 - DNA, 25 bp, Mus musculus
ttatctagctgtacaggctccttca

SEQ ID NO: 925648 - DNA, 25 bp, Mus musculus
ttatctagctgttcaggctccttca

SEQ ID NO: 925649 - DNA, 25 bp, Mus musculus
ttatctaggttgattcttctggaaa

SEQ ID NO: 925650 - DNA, 25 bp, Mus musculus
ttatctaggttgtttcttctggaaa

SEQ ID NO: 925651 - DNA, 25 bp, Mus musculus
ttatctagttagatcctgctcacac

SEQ ID NO: 925652 - DNA, 25 bp, Mus musculus
ttatctagttagttcctgctcacac

SEQ ID NO: 925653 - DNA, 25 bp, Mus musculus
ttatctataagaaggaacacagggc

SEQ ID NO: 925654 - DNA, 25 bp, Mus musculus
ttatctataagatggaacacagggc

SEQ ID NO: 925655 - DNA, 25 bp, Mus musculus
ttatctataggaatgtgacttttat

SEQ ID NO: 925656 - DNA, 25 bp, Mus musculus
ttatctataggattgtgacttttat

SEQ ID NO: 925657 - DNA, 25 bp, Mus musculus
ttatctatcgtgaggcagggctggc

SEQ ID NO: 925658 - DNA, 25 bp, Mus musculus
ttatctatcgtgtggcagggctggc

SEQ ID NO: 925659 - DNA, 25 bp, Mus musculus
ttatctatctctacaaagtggccac

SEQ ID NO: 925660 - DNA, 25 bp, Mus musculus
ttatctatctcttcaaagtggccac

SEQ ID NO: 925661 - DNA, 25 bp, Mus musculus
ttatctatctggaccctgagaagca

SEQ ID NO: 925662 - DNA, 25 bp, Mus musculus
ttatctatctggtccctgagaagca

SEQ ID NO: 925663 - DNA, 25 bp, Mus musculus
ttatctatgtacctccaagctccag

SEQ ID NO: 925664 - DNA, 25 bp, Mus musculus
ttatctatgtacgtccaagctccag

SEQ ID NO: 925665 - DNA, 25 bp, Mus musculus
ttatctatgtatattctcttcctgc

SEQ ID NO: 925666 - DNA, 25 bp, Mus musculus
ttatctatgtattttctcttcctgc

SEQ ID NO: 925667 - DNA, 25 bp, Mus musculus
ttatctcaacgcctgagagcttgaa

SEQ ID NO: 925668 - DNA, 25 bp, Mus musculus
ttatctcaacgcgtgagagcttgaa

SEQ ID NO: 925669 - DNA, 25 bp, Mus musculus
ttatctcaaggccactcaagttgac

SEQ ID NO: 925670 - DNA, 25 bp, Mus musculus
ttatctcaaggcgactcaagttgac

SEQ ID NO: 925671 - DNA, 25 bp, Mus musculus
ttatctcaccacaagacactgtcat

SEQ ID NO: 925672 - DNA, 25 bp, Mus musculus
ttatctcaccactagacactgtcat

SEQ ID NO: 925673 - DNA, 25 bp, Mus musculus
ttatctcaccatctctcactatgta

SEQ ID NO: 925674 - DNA, 25 bp, Mus musculus
ttatctcaccatgtctcactatgta

SEQ ID NO: 925675 - DNA, 25 bp, Mus musculus
ttatctcacgccagtctgtaatgtc

SEQ ID NO: 925676 - DNA, 25 bp, Mus musculus
ttatctcacgcctgtctgtaatgtc

SEQ ID NO: 925677 - DNA, 25 bp, Mus musculus
ttatctcaggaaagggcccttctac

SEQ ID NO: 925678 - DNA, 25 bp, Mus musculus
ttatctcaggaatgggcccttctac

SEQ ID NO: 925679 - DNA, 25 bp, Mus musculus
ttatctcaggctcctttctgattag

SEQ ID NO: 925680 - DNA, 25 bp, Mus musculus
ttatctcaggctgctttctgattag

SEQ ID NO: 925681 - DNA, 25 bp, Mus musculus
ttatctcaggtcactgtcttgttcg

SEQ ID NO: 925682 - DNA, 25 bp, Mus musculus
ttatctcaggtctctgtcttgttcg

SEQ ID NO: 925683 - DNA, 25 bp, Mus musculus
ttatctcagtccctaggcttattgg

SEQ ID NO: 925684 - DNA, 25 bp, Mus musculus
ttatctcagtccgtaggcttattgg

SEQ ID NO: 925685 - DNA, 25 bp, Mus musculus
ttatctcatctcactggtcagggtt

SEQ ID NO: 925686 - DNA, 25 bp, Mus musculus
ttatctcatctctctggtcagggtt

SEQ ID NO: 925687 - DNA, 25 bp, Mus musculus
ttatctcattctacttgcagctcca

SEQ ID NO: 925688 - DNA, 25 bp, Mus musculus
ttatctcattcttcttgcagctcca

SEQ ID NO: 925689 - DNA, 25 bp, Mus musculus
ttatctccactaattcccaatagcc

SEQ ID NO: 925690 - DNA, 25 bp, Mus musculus
ttatctccactatttcccaatagcc

SEQ ID NO: 925691 - DNA, 25 bp, Mus musculus
ttatctcccactcgtactgtgaaca

SEQ ID NO: 925692 - DNA, 25 bp, Mus musculus
ttatctcccactggtactgtgaaca

SEQ ID NO: 925693 - DNA, 25 bp, Mus musculus
ttatctcccatgactcagtaaagtt

SEQ ID NO: 925694 - DNA, 25 bp, Mus musculus
ttatctcccatgtctcagtaaagtt

SEQ ID NO: 925695 - DNA, 25 bp, Mus musculus
ttatctccccagcaccaagaataat

SEQ ID NO: 925696 - DNA, 25 bp, Mus musculus
ttatctccccaggaccaagaataat

SEQ ID NO: 925697 - DNA, 25 bp, Mus musculus
ttatctccctaaatcacatggctgc

SEQ ID NO: 925698 - DNA, 25 bp, Mus musculus
ttatctccctaattcacatggctgc

SEQ ID NO: 925699 - DNA, 25 bp, Mus musculus
ttatctcccttcagtagacccctag

SEQ ID NO: 925700 - DNA, 25 bp, Mus musculus
ttatctcccttctgtagacccctag

SEQ ID NO: 925701 - DNA, 25 bp, Mus musculus
ttatctccgccaagttgatttgacc

SEQ ID NO: 925702 - DNA, 25 bp, Mus musculus
ttatctccgccatgttgatttgacc

SEQ ID NO: 925703 - DNA, 25 bp, Mus musculus
ttatctccgtagacactctaactta

SEQ ID NO: 925704 - DNA, 25 bp, Mus musculus
ttatctccgtagtcactctaactta

SEQ ID NO: 925705 - DNA, 25 bp, Mus musculus
ttatctcctgctctgttgctcacag

SEQ ID NO: 925706 - DNA, 25 bp, Mus musculus
ttatctcctgctgtgttgctcacag

SEQ ID NO: 925707 - DNA, 25 bp, Mus musculus
ttatctcctgtgatgtcttttgacc

SEQ ID NO: 925708 - DNA, 25 bp, Mus musculus
ttatctcctgtgttgtcttttgacc

SEQ ID NO: 925709 - DNA, 25 bp, Mus musculus
ttatctccttacctagcagcacagg

SEQ ID NO: 925710 - DNA, 25 bp, Mus musculus
ttatctccttacgtagcagcacagg

SEQ ID NO: 925711 - DNA, 25 bp, Mus musculus
ttatctccttgcagctactaatagc

SEQ ID NO: 925712 - DNA, 25 bp, Mus musculus
ttatctccttgctgctactaatagc

SEQ ID NO: 925713 - DNA, 25 bp, Mus musculus
ttatctcgtcataattcttttgtat

SEQ ID NO: 925714 - DNA, 25 bp, Mus musculus
ttatctcgtcattattcttttgtat

SEQ ID NO: 925715 - DNA, 25 bp, Mus musculus
ttatctcgttgcactgctaggctga

SEQ ID NO: 925716 - DNA, 25 bp, Mus musculus
ttatctcgttgctctgctaggctga

SEQ ID NO: 925717 - DNA, 25 bp, Mus musculus
ttatctctcagccagatatgcccaa

SEQ ID NO: 925718 - DNA, 25 bp, Mus musculus
ttatctctcagcgagatatgcccaa

SEQ ID NO: 925719 - DNA, 25 bp, Mus musculus
ttatctctcagtcttcttccgaaaa

SEQ ID NO: 925720 - DNA, 25 bp, Mus musculus
ttatctctcagtgttcttccgaaaa

SEQ ID NO: 925721 - DNA, 25 bp, Mus musculus
ttatctctcatacggggctgttgat

SEQ ID NO: 925722 - DNA, 25 bp, Mus musculus
ttatctctcatagggggctgttgat

SEQ ID NO: 925723 - DNA, 25 bp, Mus musculus
ttatctctcccaatctgattttctc

SEQ ID NO: 925724 - DNA, 25 bp, Mus musculus
ttatctctcccattctgattttctc

SEQ ID NO: 925725 - DNA, 25 bp, Mus musculus
ttatctctcgaaagaggtattcccc

SEQ ID NO: 925726 - DNA, 25 bp, Mus musculus
ttatctctcgaatgaggtattcccc

SEQ ID NO: 925727 - DNA, 25 bp, Mus musculus
ttatctctctccaagtcatactcag

SEQ ID NO: 925728 - DNA, 25 bp, Mus musculus
ttatctctctcctagtcatactcag

SEQ ID NO: 925729 - DNA, 25 bp, Mus musculus
ttatctctctgcagtggcactggct

SEQ ID NO: 925730 - DNA, 25 bp, Mus musculus
ttatctctctgctgtggcactggct

SEQ ID NO: 925731 - DNA, 25 bp, Mus musculus
ttatctctcttcaatccagctatag

SEQ ID NO: 925732 - DNA, 25 bp, Mus musculus
ttatctctcttccacctttttattt

SEQ ID NO: 925733 - DNA, 25 bp, Mus musculus
ttatctctcttcgacctttttattt

SEQ ID NO: 925734 - DNA, 25 bp, Mus musculus
ttatctctcttctatccagctatag

SEQ ID NO: 925735 - DNA, 25 bp, Mus musculus
ttatctctgctcctttgcccagaaa

SEQ ID NO: 925736 - DNA, 25 bp, Mus musculus
ttatctctgctcgtttgcccagaaa

SEQ ID NO: 925737 - DNA, 25 bp, Mus musculus
ttatctctgggtaggtgtgaccact

SEQ ID NO: 925738 - DNA, 25 bp, Mus musculus
ttatctctgggttggtgtgaccact

SEQ ID NO: 925739 - DNA, 25 bp, Mus musculus
ttatctctggtgagcacactttctg

SEQ ID NO: 925740 - DNA, 25 bp, Mus musculus
ttatctctggtgtgcacactttctg

SEQ ID NO: 925741 - DNA, 25 bp, Mus musculus
ttatctctgtatcgtacaggagcac

SEQ ID NO: 925742 - DNA, 25 bp, Mus musculus
ttatctctgtatggtacaggagcac

SEQ ID NO: 925743 - DNA, 25 bp, Mus musculus
ttatctctgtctaatgtgtgctatg

SEQ ID NO: 925744 - DNA, 25 bp, Mus musculus
ttatctctgtcttatgtgtgctatg

SEQ ID NO: 925745 - DNA, 25 bp, Mus musculus
ttatctctgtgtcttacaggagctc

SEQ ID NO: 925746 - DNA, 25 bp, Mus musculus
ttatctctgtgtgttacaggagctc

SEQ ID NO: 925747 - DNA, 25 bp, Mus musculus
ttatctcttacaccccaggctagtc

SEQ ID NO: 925748 - DNA, 25 bp, Mus musculus
ttatctcttacagcccaggctagtc

SEQ ID NO: 925749 - DNA, 25 bp, Mus musculus
ttatctcttagaaaattggtagtga

SEQ ID NO: 925750 - DNA, 25 bp, Mus musculus
ttatctcttagataattggtagtga

SEQ ID NO: 925751 - DNA, 25 bp, Mus musculus
ttatctctttaacaaccacagctgg

SEQ ID NO: 925752 - DNA, 25 bp, Mus musculus
ttatctctttaagaaccacagctgg

SEQ ID NO: 925753 - DNA, 25 bp, Mus musculus
ttatctcttttacggctagttggcc

SEQ ID NO: 925754 - DNA, 25 bp, Mus musculus
ttatctcttttagggctagttggcc

SEQ ID NO: 925755 - DNA, 25 bp, Mus musculus
ttatctgaacgtcacgggccctcct

SEQ ID NO: 925756 - DNA, 25 bp, Mus musculus
ttatctgaacgtgacgggccctcct

SEQ ID NO: 925757 - DNA, 25 bp, Mus musculus
ttatctgaagctatctgcaagggta

SEQ ID NO: 925758 - DNA, 25 bp, Mus musculus
ttatctgaagctttctgcaagggta

SEQ ID NO: 925759 - DNA, 25 bp, Mus musculus
ttatctgaatataagatgctctgag

SEQ ID NO: 925760 - DNA, 25 bp, Mus musculus
ttatctgaatattagatgctctgag

SEQ ID NO: 925761 - DNA, 25 bp, Mus musculus
ttatctgacctcatttaatatacat

SEQ ID NO: 925762 - DNA, 25 bp, Mus musculus
ttatctgacctcttttaatatacat

SEQ ID NO: 925763 - DNA, 25 bp, Mus musculus
ttatctgacttcaggagagagctcc

SEQ ID NO: 925764 - DNA, 25 bp, Mus musculus
ttatctgacttctggagagagctcc

SEQ ID NO: 925765 - DNA, 25 bp, Mus musculus
ttatctgactttctgctgcgttccc

SEQ ID NO: 925766 - DNA, 25 bp, Mus musculus
ttatctgactttgtgctgcgttccc

SEQ ID NO: 925767 - DNA, 25 bp, Mus musculus
ttatctgagaccagtttggctttgg

SEQ ID NO: 925768 - DNA, 25 bp, Mus musculus
ttatctgagacctgtttggctttgg

SEQ ID NO: 925769 - DNA, 25 bp, Mus musculus
ttatctgatttacatttctataggc

SEQ ID NO: 925770 - DNA, 25 bp, Mus musculus
ttatctgatttagatttctataggc

SEQ ID NO: 925771 - DNA, 25 bp, Mus musculus
ttatctgcaatgactgtgtcccaca

SEQ ID NO: 925772 - DNA, 25 bp, Mus musculus
ttatctgcaatgtctgtgtcccaca

SEQ ID NO: 925773 - DNA, 25 bp, Mus musculus
ttatctgccactctaggcaacagat

SEQ ID NO: 925774 - DNA, 25 bp, Mus musculus
ttatctgccactgtaggcaacagat

SEQ ID NO: 925775 - DNA, 25 bp, Mus musculus
ttatctgccaggacccgagagtgct

SEQ ID NO: 925776 - DNA, 25 bp, Mus musculus
ttatctgccaggtcccgagagtgct

SEQ ID NO: 925777 - DNA, 25 bp, Mus musculus
ttatctgccccaacaggtcatcaat

SEQ ID NO: 925778 - DNA, 25 bp, Mus musculus
ttatctgccccatcaggtcatcaat

SEQ ID NO: 925779 - DNA, 25 bp, Mus musculus
ttatctgccttaaccaccaacagtg

SEQ ID NO: 925780 - DNA, 25 bp, Mus musculus
ttatctgccttatccaccaacagtg

SEQ ID NO: 925781 - DNA, 25 bp, Mus musculus
ttatctgccttcactgtgcacggag

SEQ ID NO: 925782 - DNA, 25 bp, Mus musculus
ttatctgccttctctgtgcacggag

SEQ ID NO: 925783 - DNA, 25 bp, Mus musculus
ttatctgcgccgagatgtaagccaa

SEQ ID NO: 925784 - DNA, 25 bp, Mus musculus
ttatctgcgccgtgatgtaagccaa

SEQ ID NO: 925785 - DNA, 25 bp, Mus musculus
ttatctgctagacacttaacaagtt

SEQ ID NO: 925786 - DNA, 25 bp, Mus musculus
ttatctgctagagacttaacaagtt

SEQ ID NO: 925787 - DNA, 25 bp, Mus musculus
ttatctgctcatatctcgtatcttc

SEQ ID NO: 925788 - DNA, 25 bp, Mus musculus
ttatctgctcatttctcgtatcttc

SEQ ID NO: 925789 - DNA, 25 bp, Mus musculus
ttatctgctcctcgtgactgaccac

SEQ ID NO: 925790 - DNA, 25 bp, Mus musculus
ttatctgctcctctttcctggaagc

SEQ ID NO: 925791 - DNA, 25 bp, Mus musculus
ttatctgctcctggtgactgaccac

SEQ ID NO: 925792 - DNA, 25 bp, Mus musculus
ttatctgctcctgtttcctggaagc

SEQ ID NO: 925793 - DNA, 25 bp, Mus musculus
ttatctggacagacacccgcaacac

SEQ ID NO: 925794 - DNA, 25 bp, Mus musculus
ttatctggacagtcacccgcaacac

SEQ ID NO: 925795 - DNA, 25 bp, Mus musculus
ttatctggactgaagatacgacaga

SEQ ID NO: 925796 - DNA, 25 bp, Mus musculus
ttatctggactgtagatacgacaga

SEQ ID NO: 925797 - DNA, 25 bp, Mus musculus
ttatctggagacaactaactcgctt

SEQ ID NO: 925798 - DNA, 25 bp, Mus musculus
ttatctggagactactaactcgctt

SEQ ID NO: 925799 - DNA, 25 bp, Mus musculus
ttatctggcaccacaaaaccagtag

SEQ ID NO: 925800 - DNA, 25 bp, Mus musculus
ttatctggcacctcaaaaccagtag

SEQ ID NO: 925801 - DNA, 25 bp, Mus musculus
ttatctggcatcaactcgttaaaga

SEQ ID NO: 925802 - DNA, 25 bp, Mus musculus
ttatctggcatctactcgttaaaga

SEQ ID NO: 925803 - DNA, 25 bp, Mus musculus
ttatctgggcttacttaaggttcca

SEQ ID NO: 925804 - DNA, 25 bp, Mus musculus
ttatctgggctttcttaaggttcca

SEQ ID NO: 925805 - DNA, 25 bp, Mus musculus
ttatctgggtacaggacatctgcct

SEQ ID NO: 925806 - DNA, 25 bp, Mus musculus
ttatctgggtactggacatctgcct

SEQ ID NO: 925807 - DNA, 25 bp, Mus musculus
ttatctggtgaactgctgtcgagca

SEQ ID NO: 925808 - DNA, 25 bp, Mus musculus
ttatctggtgaagtgctgtcgagca

SEQ ID NO: 925809 - DNA, 25 bp, Mus musculus
ttatctggtgatctcgtttacctcc

SEQ ID NO: 925810 - DNA, 25 bp, Mus musculus
ttatctggtgatgtcgtttacctcc

SEQ ID NO: 925811 - DNA, 25 bp, Mus musculus
ttatctggttgtagagggtaggaac

SEQ ID NO: 925812 - DNA, 25 bp, Mus musculus
ttatctggttgttgagggtaggaac

SEQ ID NO: 925813 - DNA, 25 bp, Mus musculus
ttatctgtaagacctcgccatcatt

SEQ ID NO: 925814 - DNA, 25 bp, Mus musculus
ttatctgtaagagctcgccatcatt

SEQ ID NO: 925815 - DNA, 25 bp, Mus musculus
ttatctgtaatcagggtcacctcag

SEQ ID NO: 925816 - DNA, 25 bp, Mus musculus
ttatctgtaatctgggtcacctcag

SEQ ID NO: 925817 - DNA, 25 bp, Mus musculus
ttatctgtcggccaaggcagtaaag

SEQ ID NO: 925818 - DNA, 25 bp, Mus musculus
ttatctgtcggcgaaggcagtaaag

SEQ ID NO: 925819 - DNA, 25 bp, Mus musculus
ttatctgtgactaatccctctttag

SEQ ID NO: 925820 - DNA, 25 bp, Mus musculus
ttatctgtgacttatccctctttag

SEQ ID NO: 925821 - DNA, 25 bp, Mus musculus
ttatctgtgagtaatgggttggcca

SEQ ID NO: 925822 - DNA, 25 bp, Mus musculus
ttatctgtgagttatgggttggcca

SEQ ID NO: 925823 - DNA, 25 bp, Mus musculus
ttatctgtggaaagcattgtgaact

SEQ ID NO: 925824 - DNA, 25 bp, Mus musculus
ttatctgtggaatgcattgtgaact

SEQ ID NO: 925825 - DNA, 25 bp, Mus musculus
ttatctgtggagctgttttctgcct

SEQ ID NO: 925826 - DNA, 25 bp, Mus musculus
ttatctgtggaggtgttttctgcct

SEQ ID NO: 925827 - DNA, 25 bp, Mus musculus
ttatctgtggtcaactgtgattctg

SEQ ID NO: 925828 - DNA, 25 bp, Mus musculus
ttatctgtggtctactgtgattctg

SEQ ID NO: 925829 - DNA, 25 bp, Mus musculus
ttatctgtgttcagaggacctgtcc

SEQ ID NO: 925830 - DNA, 25 bp, Mus musculus
ttatctgtgttctgaggacctgtcc

SEQ ID NO: 925831 - DNA, 25 bp, Mus musculus
ttatctgttaggacggacacgggca

SEQ ID NO: 925832 - DNA, 25 bp, Mus musculus
ttatctgttaggtcggacacgggca

SEQ ID NO: 925833 - DNA, 25 bp, Mus musculus
ttatctgttcatccactaaagttta

SEQ ID NO: 925834 - DNA, 25 bp, Mus musculus
ttatctgttcatgcactaaagttta

SEQ ID NO: 925835 - DNA, 25 bp, Mus musculus
ttatctgttcccctaacattactga

SEQ ID NO: 925836 - DNA, 25 bp, Mus musculus
ttatctgttcccgtaacattactga

SEQ ID NO: 925837 - DNA, 25 bp, Mus musculus
ttatctgttcttaatctgtagtctg

SEQ ID NO: 925838 - DNA, 25 bp, Mus musculus
ttatctgttctttatctgtagtctg

SEQ ID NO: 925839 - DNA, 25 bp, Mus musculus
ttatctgttggactctggcttggtc

SEQ ID NO: 925840 - DNA, 25 bp, Mus musculus
ttatctgttggagtctggcttggtc

SEQ ID NO: 925841 - DNA, 25 bp, Mus musculus
ttatctgttttaatgtttcctcctt

SEQ ID NO: 925842 - DNA, 25 bp, Mus musculus
ttatctgttttattgtttcctcctt

SEQ ID NO: 925843 - DNA, 25 bp, Mus musculus
ttatcttaatgaactcctgccctca

SEQ ID NO: 925844 - DNA, 25 bp, Mus musculus
ttatcttaatgatctcctgccctca

SEQ ID NO: 925845 - DNA, 25 bp, Mus musculus
ttatcttacagtagtggagctccaa

SEQ ID NO: 925846 - DNA, 25 bp, Mus musculus
ttatcttacagttgtggagctccaa

SEQ ID NO: 925847 - DNA, 25 bp, Mus musculus
ttatcttactccattgactactggg

SEQ ID NO: 925848 - DNA, 25 bp, Mus musculus
ttatcttactcctttgactactggg

SEQ ID NO: 925849 - DNA, 25 bp, Mus musculus
ttatcttagctaaccgcgtcgggaa

SEQ ID NO: 925850 - DNA, 25 bp, Mus musculus
ttatcttagctatccgcgtcgggaa

SEQ ID NO: 925851 - DNA, 25 bp, Mus musculus
ttatcttatctgcactggccagaat

SEQ ID NO: 925852 - DNA, 25 bp, Mus musculus
ttatcttatctggactggccagaat

SEQ ID NO: 925853 - DNA, 25 bp, Mus musculus
ttatcttatttacccctagagcatc

SEQ ID NO: 925854 - DNA, 25 bp, Mus musculus
ttatcttatttagccctagagcatc

SEQ ID NO: 925855 - DNA, 25 bp, Mus musculus
ttatcttcaatcaccattctcatgg

SEQ ID NO: 925856 - DNA, 25 bp, Mus musculus
ttatcttcaatctccattctcatgg

SEQ ID NO: 925857 - DNA, 25 bp, Mus musculus
ttatcttcatttacagaggttggag

SEQ ID NO: 925858 - DNA, 25 bp, Mus musculus
ttatcttcatttcttggaccaatca

SEQ ID NO: 925859 - DNA, 25 bp, Mus musculus
ttatcttcatttgttggaccaatca

SEQ ID NO: 925860 - DNA, 25 bp, Mus musculus
ttatcttcattttcagaggttggag

SEQ ID NO: 925861 - DNA, 25 bp, Mus musculus
ttatcttccagcagaaccctgagtg

SEQ ID NO: 925862 - DNA, 25 bp, Mus musculus
ttatcttccagctgaaccctgagtg

SEQ ID NO: 925863 - DNA, 25 bp, Mus musculus
ttatcttcccacaaggacctcagaa

SEQ ID NO: 925864 - DNA, 25 bp, Mus musculus
ttatcttcccactaggacctcagaa

SEQ ID NO: 925865 - DNA, 25 bp, Mus musculus
ttatcttcccttaattacaagaagg

SEQ ID NO: 925866 - DNA, 25 bp, Mus musculus
ttatcttccctttattacaagaagg

SEQ ID NO: 925867 - DNA, 25 bp, Mus musculus
ttatcttcctcaaggttggacaaag

SEQ ID NO: 925868 - DNA, 25 bp, Mus musculus
ttatcttcctcatggttggacaaag

SEQ ID NO: 925869 - DNA, 25 bp, Mus musculus
ttatcttcgataaccctccagagaa

SEQ ID NO: 925870 - DNA, 25 bp, Mus musculus
ttatcttcgatatccctccagagaa

SEQ ID NO: 925871 - DNA, 25 bp, Mus musculus
ttatcttcgccccaggaagggtgca

SEQ ID NO: 925872 - DNA, 25 bp, Mus musculus
ttatcttcgcccgaggaagggtgca

SEQ ID NO: 925873 - DNA, 25 bp, Mus musculus
ttatcttctaaccagacaccaggct

SEQ ID NO: 925874 - DNA, 25 bp, Mus musculus
ttatcttctaacgagacaccaggct

SEQ ID NO: 925875 - DNA, 25 bp, Mus musculus
ttatcttctggcagccctatcaggt

SEQ ID NO: 925876 - DNA, 25 bp, Mus musculus
ttatcttctggctgccctatcaggt

SEQ ID NO: 925877 - DNA, 25 bp, Mus musculus
ttatcttctgtgaatggatcttctg

SEQ ID NO: 925878 - DNA, 25 bp, Mus musculus
ttatcttctgtgtatggatcttctg

SEQ ID NO: 925879 - DNA, 25 bp, Mus musculus
ttatcttgacccacaaaagtgccct

SEQ ID NO: 925880 - DNA, 25 bp, Mus musculus
ttatcttgaccctcaaaagtgccct

SEQ ID NO: 925881 - DNA, 25 bp, Mus musculus
ttatcttgagagataggagcaccat

SEQ ID NO: 925882 - DNA, 25 bp, Mus musculus
ttatcttgagagttaggagcaccat

SEQ ID NO: 925883 - DNA, 25 bp, Mus musculus
ttatcttgagggagcagtcatctga

SEQ ID NO: 925884 - DNA, 25 bp, Mus musculus
ttatcttgagggatgtggatacttt

SEQ ID NO: 925885 - DNA, 25 bp, Mus musculus
ttatcttgagggtgcagtcatctga

SEQ ID NO: 925886 - DNA, 25 bp, Mus musculus
ttatcttgagggttgtggatacttt

SEQ ID NO: 925887 - DNA, 25 bp, Mus musculus
ttatcttgcatgagaattccctccc

SEQ ID NO: 925888 - DNA, 25 bp, Mus musculus
ttatcttgcatgtgaattccctccc

SEQ ID NO: 925889 - DNA, 25 bp, Mus musculus
ttatcttgccaaaacgtctttccct

SEQ ID NO: 925890 - DNA, 25 bp, Mus musculus
ttatcttgccaatacgtctttccct

SEQ ID NO: 925891 - DNA, 25 bp, Mus musculus
ttatcttggcttaagtccctgtata

SEQ ID NO: 925892 - DNA, 25 bp, Mus musculus
ttatcttggctttagtccctgtata

SEQ ID NO: 925893 - DNA, 25 bp, Mus musculus
ttatcttgggacataaggcaggcga

SEQ ID NO: 925894 - DNA, 25 bp, Mus musculus
ttatcttgggacttaaggcaggcga

SEQ ID NO: 925895 - DNA, 25 bp, Mus musculus
ttatcttgtgttcttgtgtttctgt

SEQ ID NO: 925896 - DNA, 25 bp, Mus musculus
ttatcttgtgttgttgtgtttctgt

SEQ ID NO: 925897 - DNA, 25 bp, Mus musculus
ttatcttgtttgcaacaccccacca

SEQ ID NO: 925898 - DNA, 25 bp, Mus musculus
ttatcttgtttggaacaccccacca

SEQ ID NO: 925899 - DNA, 25 bp, Mus musculus
ttatctttctgtagtgtcactgact

SEQ ID NO: 925900 - DNA, 25 bp, Mus musculus
ttatctttctgttgtgtcactgact

SEQ ID NO: 925901 - DNA, 25 bp, Mus musculus
ttatctttgaaaatgccttcactga

SEQ ID NO: 925902 - DNA, 25 bp, Mus musculus
ttatctttgaaattgccttcactga

SEQ ID NO: 925903 - DNA, 25 bp, Mus musculus
ttatctttgcatcttatctggcatc

SEQ ID NO: 925904 - DNA, 25 bp, Mus musculus
ttatctttgcatctttctgcatcaa

SEQ ID NO: 925905 - DNA, 25 bp, Mus musculus
ttatctttgcatgttatctggcatc

SEQ ID NO: 925906 - DNA, 25 bp, Mus musculus
ttatctttgcatgtttctgcatcaa

SEQ ID NO: 925907 - DNA, 25 bp, Mus musculus
ttatctttgtagattcagttttcct

SEQ ID NO: 925908 - DNA, 25 bp, Mus musculus
ttatctttgtagtttcagttttcct

SEQ ID NO: 925909 - DNA, 25 bp, Mus musculus
ttatcttttcctacgaacttctggg

SEQ ID NO: 925910 - DNA, 25 bp, Mus musculus
ttatcttttccttcgaacttctggg

SEQ ID NO: 925911 - DNA, 25 bp, Mus musculus
ttatctttttcaaatctctcccatg

SEQ ID NO: 925912 - DNA, 25 bp, Mus musculus
ttatctttttcatatctctcccatg

SEQ ID NO: 925913 - DNA, 25 bp, Mus musculus
ttatgaaagaccctgaactgaaagt

SEQ ID NO: 925914 - DNA, 25 bp, Mus musculus
ttatgaaagaccgtgaactgaaagt

SEQ ID NO: 925915 - DNA, 25 bp, Mus musculus
ttatgaaatggcctctcacctgcgg

SEQ ID NO: 925916 - DNA, 25 bp, Mus musculus
ttatgaaatggcgtctcacctgcgg

SEQ ID NO: 925917 - DNA, 25 bp, Mus musculus
ttatgaacacaacctggtctcagaa

SEQ ID NO: 925918 - DNA, 25 bp, Mus musculus
ttatgaacacaagctggtctcagaa

SEQ ID NO: 925919 - DNA, 25 bp, Mus musculus
ttatgaacatcaattgtggtgtgct

SEQ ID NO: 925920 - DNA, 25 bp, Mus musculus
ttatgaacatcatttgtggtgtgct

SEQ ID NO: 925921 - DNA, 25 bp, Mus musculus
ttatgaacccacatagtccaaagga

SEQ ID NO: 925922 - DNA, 25 bp, Mus musculus
ttatgaacccacttagtccaaagga

SEQ ID NO: 925923 - DNA, 25 bp, Mus musculus
ttatgaacccccattttcgaacact

SEQ ID NO: 925924 - DNA, 25 bp, Mus musculus
ttatgaaccccctttttcgaacact

SEQ ID NO: 925925 - DNA, 25 bp, Mus musculus
ttatgaaccctgactgcctcagtat

SEQ ID NO: 925926 - DNA, 25 bp, Mus musculus
ttatgaaccctgaggtccccagaag

SEQ ID NO: 925927 - DNA, 25 bp, Mus musculus
ttatgaaccctgtctgcctcagtat

SEQ ID NO: 925928 - DNA, 25 bp, Mus musculus
ttatgaaccctgtggtccccagaag

SEQ ID NO: 925929 - DNA, 25 bp, Mus musculus
ttatgaacctgaatccctgaccaaa

SEQ ID NO: 925930 - DNA, 25 bp, Mus musculus
ttatgaacctgattccctgaccaaa

SEQ ID NO: 925931 - DNA, 25 bp, Mus musculus
ttatgaactgggattcttcagaaat

SEQ ID NO: 925932 - DNA, 25 bp, Mus musculus
ttatgaactgggtttcttcagaaat

SEQ ID NO: 925933 - DNA, 25 bp, Mus musculus
ttatgaacttgtactcaccctgaca

SEQ ID NO: 925934 - DNA, 25 bp, Mus musculus
ttatgaacttgttctcaccctgaca

SEQ ID NO: 925935 - DNA, 25 bp, Mus musculus
ttatgaagcccacgatcccgagatt

SEQ ID NO: 925936 - DNA, 25 bp, Mus musculus
ttatgaagcccaggatcccgagatt

SEQ ID NO: 925937 - DNA, 25 bp, Mus musculus
ttatgaaggccgcttaccatcccat

SEQ ID NO: 925938 - DNA, 25 bp, Mus musculus
ttatgaaggccggttaccatcccat

SEQ ID NO: 925939 - DNA, 25 bp, Mus musculus
ttatgaaggtccagcaggtctgctc

SEQ ID NO: 925940 - DNA, 25 bp, Mus musculus
ttatgaaggtcctgcaggtctgctc

SEQ ID NO: 925941 - DNA, 25 bp, Mus musculus
ttatgaagtccacggcagcctgtct

SEQ ID NO: 925942 - DNA, 25 bp, Mus musculus
ttatgaagtccagggcagcctgtct

SEQ ID NO: 925943 - DNA, 25 bp, Mus musculus
ttatgaatacccaatggtccacctc

SEQ ID NO: 925944 - DNA, 25 bp, Mus musculus
ttatgaataccctatggtccacctc

SEQ ID NO: 925945 - DNA, 25 bp, Mus musculus
ttatgaatagtgaggatctaggaat

SEQ ID NO: 925946 - DNA, 25 bp, Mus musculus
ttatgaatagtgtggatctaggaat

SEQ ID NO: 925947 - DNA, 25 bp, Mus musculus
ttatgaatatatctagagcagccct

SEQ ID NO: 925948 - DNA, 25 bp, Mus musculus
ttatgaatatatgtagagcagccct

SEQ ID NO: 925949 - DNA, 25 bp, Mus musculus
ttatgaatcctgcacccggtgatat

SEQ ID NO: 925950 - DNA, 25 bp, Mus musculus
ttatgaatcctggacccggtgatat

SEQ ID NO: 925951 - DNA, 25 bp, Mus musculus
ttatgaatcttacccaatttcttgg

SEQ ID NO: 925952 - DNA, 25 bp, Mus musculus
ttatgaatcttagccaatttcttgg

SEQ ID NO: 925953 - DNA, 25 bp, Mus musculus
ttatgaatgaccagctgatgtatct

SEQ ID NO: 925954 - DNA, 25 bp, Mus musculus
ttatgaatgacctgctgatgtatct

SEQ ID NO: 925955 - DNA, 25 bp, Mus musculus
ttatgaatgattcatgtcggagggc

SEQ ID NO: 925956 - DNA, 25 bp, Mus musculus
ttatgaatgattgatgtcggagggc

SEQ ID NO: 925957 - DNA, 25 bp, Mus musculus
ttatgaatgcagatgacccagacct

SEQ ID NO: 925958 - DNA, 25 bp, Mus musculus
ttatgaatgcagttgacccagacct

SEQ ID NO: 925959 - DNA, 25 bp, Mus musculus
ttatgaatgcctactgcatgttcgt

SEQ ID NO: 925960 - DNA, 25 bp, Mus musculus
ttatgaatgcctatagcctacccag

SEQ ID NO: 925961 - DNA, 25 bp, Mus musculus
ttatgaatgccttctgcatgttcgt

SEQ ID NO: 925962 - DNA, 25 bp, Mus musculus
ttatgaatgcctttagcctacccag

SEQ ID NO: 925963 - DNA, 25 bp, Mus musculus
ttatgaatgggcagggtgcctgctc

SEQ ID NO: 925964 - DNA, 25 bp, Mus musculus
ttatgaatgggctgggtgcctgctc

SEQ ID NO: 925965 - DNA, 25 bp, Mus musculus
ttatgaattactaccctgaccatcc

SEQ ID NO: 925966 - DNA, 25 bp, Mus musculus
ttatgaattacttccctgaccatcc

SEQ ID NO: 925967 - DNA, 25 bp, Mus musculus
ttatgaattatgcagaagcttctcc

SEQ ID NO: 925968 - DNA, 25 bp, Mus musculus
ttatgaattatggagaagcttctcc

SEQ ID NO: 925969 - DNA, 25 bp, Mus musculus
ttatgaattcccatttcccacggtg

SEQ ID NO: 925970 - DNA, 25 bp, Mus musculus
ttatgaattcccttttcccacggtg

SEQ ID NO: 925971 - DNA, 25 bp, Mus musculus
ttatgaattgtgaactaaggaccta

SEQ ID NO: 925972 - DNA, 25 bp, Mus musculus
ttatgaattgtgtactaaggaccta

SEQ ID NO: 925973 - DNA, 25 bp, Mus musculus
ttatgacaaactctaaacgtgtacc

SEQ ID NO: 925974 - DNA, 25 bp, Mus musculus
ttatgacaaactgtaaacgtgtacc

SEQ ID NO: 925975 - DNA, 25 bp, Mus musculus
ttatgacaaggcctttgtttccctc

SEQ ID NO: 925976 - DNA, 25 bp, Mus musculus
ttatgacaaggcgtttgtttccctc

SEQ ID NO: 925977 - DNA, 25 bp, Mus musculus
ttatgacaagtgatgcgtgatggcg

SEQ ID NO: 925978 - DNA, 25 bp, Mus musculus
ttatgacaagtgttgcgtgatggcg

SEQ ID NO: 925979 - DNA, 25 bp, Mus musculus
ttatgacaatggagactccccggtg

SEQ ID NO: 925980 - DNA, 25 bp, Mus musculus
ttatgacaatggtgactccccggtg

SEQ ID NO: 925981 - DNA, 25 bp, Mus musculus
ttatgacaccccaccaataaaggat

SEQ ID NO: 925982 - DNA, 25 bp, Mus musculus
ttatgacacccctccaataaaggat

SEQ ID NO: 925983 - DNA, 25 bp, Mus musculus
ttatgacagacacctccgaatggct

SEQ ID NO: 925984 - DNA, 25 bp, Mus musculus
ttatgacagacagctccgaatggct

SEQ ID NO: 925985 - DNA, 25 bp, Mus musculus
ttatgacagagtcaaagtacgcaat

SEQ ID NO: 925986 - DNA, 25 bp, Mus musculus
ttatgacagagtgaaagtacgcaat

SEQ ID NO: 925987 - DNA, 25 bp, Mus musculus
ttatgacagattcacagtacgcaac

SEQ ID NO: 925988 - DNA, 25 bp, Mus musculus
ttatgacagattgacagtacgcaac

SEQ ID NO: 925989 - DNA, 25 bp, Mus musculus
ttatgacaggttagtggccatccgc

SEQ ID NO: 925990 - DNA, 25 bp, Mus musculus
ttatgacaggtttgtggccatccgc

SEQ ID NO: 925991 - DNA, 25 bp, Mus musculus
ttatgacagtagctggccccttggc

SEQ ID NO: 925992 - DNA, 25 bp, Mus musculus
ttatgacagtaggtggccccttggc

SEQ ID NO: 925993 - DNA, 25 bp, Mus musculus
ttatgacatggtagacgaggagaca

SEQ ID NO: 925994 - DNA, 25 bp, Mus musculus
ttatgacatggttgacgaggagaca

SEQ ID NO: 925995 - DNA, 25 bp, Mus musculus
ttatgaccagataatcagtgccctg

SEQ ID NO: 925996 - DNA, 25 bp, Mus musculus
ttatgaccagattatcagtgccctg

SEQ ID NO: 925997 - DNA, 25 bp, Mus musculus
ttatgaccagccaaaaacttctggg

SEQ ID NO: 925998 - DNA, 25 bp, Mus musculus
ttatgaccagcctaaaacttctggg

SEQ ID NO: 925999 - DNA, 25 bp, Mus musculus
ttatgacccaatacttgttataaca

SEQ ID NO: 926000 - DNA, 25 bp, Mus musculus
ttatgacccaattcttgttataaca

SEQ ID NO: 926001 - DNA, 25 bp, Mus musculus
ttatgaccctcaataccatcctggg

SEQ ID NO: 926002 - DNA, 25 bp, Mus musculus
ttatgaccctcattaccatcctggg

SEQ ID NO: 926003 - DNA, 25 bp, Mus musculus
ttatgaccctggcaagttatgtaat

SEQ ID NO: 926004 - DNA, 25 bp, Mus musculus
ttatgaccctgggaagttatgtaat

SEQ ID NO: 926005 - DNA, 25 bp, Mus musculus
ttatgacccttcctggtctacacag

SEQ ID NO: 926006 - DNA, 25 bp, Mus musculus
ttatgacccttcgtggtctacacag

SEQ ID NO: 926007 - DNA, 25 bp, Mus musculus
ttatgacctacacacctactaaaag

SEQ ID NO: 926008 - DNA, 25 bp, Mus musculus
ttatgacctacagacctactaaaag

SEQ ID NO: 926009 - DNA, 25 bp, Mus musculus
ttatgacctcatattgctgctgcct

SEQ ID NO: 926010 - DNA, 25 bp, Mus musculus
ttatgacctcattttgctgctgcct

SEQ ID NO: 926011 - DNA, 25 bp, Mus musculus
ttatgacgcacacccaacgcaatgc

SEQ ID NO: 926012 - DNA, 25 bp, Mus musculus
ttatgacgcacagccaacgcaatgc

SEQ ID NO: 926013 - DNA, 25 bp, Mus musculus
ttatgacggactacgtgtgcaagca

SEQ ID NO: 926014 - DNA, 25 bp, Mus musculus
ttatgacggacttcgtgtgcaagca

SEQ ID NO: 926015 - DNA, 25 bp, Mus musculus
ttatgacggagcactactgacactt

SEQ ID NO: 926016 - DNA, 25 bp, Mus musculus
ttatgacggagctctactgacactt

SEQ ID NO: 926017 - DNA, 25 bp, Mus musculus
ttatgacgttccacatatcctccgc

SEQ ID NO: 926018 - DNA, 25 bp, Mus musculus
ttatgacgttcctcatatcctccgc

SEQ ID NO: 926019 - DNA, 25 bp, Mus musculus
ttatgacgttttaaggcaccccatc

SEQ ID NO: 926020 - DNA, 25 bp, Mus musculus
ttatgacgtttttaggcaccccatc

SEQ ID NO: 926021 - DNA, 25 bp, Mus musculus
ttatgactaattcctcttcccagaa

SEQ ID NO: 926022 - DNA, 25 bp, Mus musculus
ttatgactaattgctcttcccagaa

SEQ ID NO: 926023 - DNA, 25 bp, Mus musculus
ttatgactactcaggctatgggatc

SEQ ID NO: 926024 - DNA, 25 bp, Mus musculus
ttatgactactctggctatgggatc

SEQ ID NO: 926025 - DNA, 25 bp, Mus musculus
ttatgactagcccactctaacggag

SEQ ID NO: 926026 - DNA, 25 bp, Mus musculus
ttatgactagccgactctaacggag

SEQ ID NO: 926027 - DNA, 25 bp, Mus musculus
ttatgactcttgacaattttattgt

SEQ ID NO: 926028 - DNA, 25 bp, Mus musculus
ttatgactcttgtcaattttattgt

SEQ ID NO: 926029 - DNA, 25 bp, Mus musculus
ttatgactgctacaaatgtccaagt

SEQ ID NO: 926030 - DNA, 25 bp, Mus musculus
ttatgactgctagaaatgtccaagt

SEQ ID NO: 926031 - DNA, 25 bp, Mus musculus
ttatgactgtgaaaatcgttattta

SEQ ID NO: 926032 - DNA, 25 bp, Mus musculus
ttatgactgtgataatcgttattta

SEQ ID NO: 926033 - DNA, 25 bp, Mus musculus
ttatgacttagcaccacgtgccaaa

SEQ ID NO: 926034 - DNA, 25 bp, Mus musculus
ttatgacttagctccacgtgccaaa

SEQ ID NO: 926035 - DNA, 25 bp, Mus musculus
ttatgacttcacctctgcagacatt

SEQ ID NO: 926036 - DNA, 25 bp, Mus musculus
ttatgacttcacgtctgcagacatt

SEQ ID NO: 926037 - DNA, 25 bp, Mus musculus
ttatgacttgtcaattcagcaccat

SEQ ID NO: 926038 - DNA, 25 bp, Mus musculus
ttatgacttgtctattcagcaccat

SEQ ID NO: 926039 - DNA, 25 bp, Mus musculus
ttatgactttctctgcttggttgga

SEQ ID NO: 926040 - DNA, 25 bp, Mus musculus
ttatgactttctgtgcttggttgga

SEQ ID NO: 926041 - DNA, 25 bp, Mus musculus
ttatgagaaacgcagcccgcgctca

SEQ ID NO: 926042 - DNA, 25 bp, Mus musculus
ttatgagaaacggagcccgcgctca

SEQ ID NO: 926043 - DNA, 25 bp, Mus musculus
ttatgagaacttctaggcctcctgc

SEQ ID NO: 926044 - DNA, 25 bp, Mus musculus
ttatgagaacttgtaggcctcctgc

SEQ ID NO: 926045 - DNA, 25 bp, Mus musculus
ttatgagactggaagaccgacggtg

SEQ ID NO: 926046 - DNA, 25 bp, Mus musculus
ttatgagactggtagaccgacggtg

SEQ ID NO: 926047 - DNA, 25 bp, Mus musculus
ttatgagagtggaggtcccagtgtt

SEQ ID NO: 926048 - DNA, 25 bp, Mus musculus
ttatgagagtggtggtcccagtgtt

SEQ ID NO: 926049 - DNA, 25 bp, Mus musculus
ttatgagatgctatgactgactcta

SEQ ID NO: 926050 - DNA, 25 bp, Mus musculus
ttatgagatgctttgactgactcta

SEQ ID NO: 926051 - DNA, 25 bp, Mus musculus
ttatgagattgtatccctcggctat

SEQ ID NO: 926052 - DNA, 25 bp, Mus musculus
ttatgagattgtttccctcggctat

SEQ ID NO: 926053 - DNA, 25 bp, Mus musculus
ttatgagcaataagtgccgagcaca

SEQ ID NO: 926054 - DNA, 25 bp, Mus musculus
ttatgagcaatatgtgccgagcaca

SEQ ID NO: 926055 - DNA, 25 bp, Mus musculus
ttatgagcactcactttgctctgtt

SEQ ID NO: 926056 - DNA, 25 bp, Mus musculus
ttatgagcactctctttgctctgtt

SEQ ID NO: 926057 - DNA, 25 bp, Mus musculus
ttatgagcatctccactgtgctagg

SEQ ID NO: 926058 - DNA, 25 bp, Mus musculus
ttatgagcatctgcactgtgctagg

SEQ ID NO: 926059 - DNA, 25 bp, Mus musculus
ttatgagccttactaacttctccag

SEQ ID NO: 926060 - DNA, 25 bp, Mus musculus
ttatgagccttagtaacttctccag

SEQ ID NO: 926061 - DNA, 25 bp, Mus musculus
ttatgagctcagagcatggacagaa

SEQ ID NO: 926062 - DNA, 25 bp, Mus musculus
ttatgagctcagtgcatggacagaa

SEQ ID NO: 926063 - DNA, 25 bp, Mus musculus
ttatgagctcttcccggtgccttta

SEQ ID NO: 926064 - DNA, 25 bp, Mus musculus
ttatgagctcttcgcacacaagtga

SEQ ID NO: 926065 - DNA, 25 bp, Mus musculus
ttatgagctcttgccggtgccttta

SEQ ID NO: 926066 - DNA, 25 bp, Mus musculus
ttatgagctcttggcacacaagtga

SEQ ID NO: 926067 - DNA, 25 bp, Mus musculus
ttatgaggaagcagggttgtcccca

SEQ ID NO: 926068 - DNA, 25 bp, Mus musculus
ttatgaggaagctgggttgtcccca

SEQ ID NO: 926069 - DNA, 25 bp, Mus musculus
ttatgaggagaacccaccctatgcc

SEQ ID NO: 926070 - DNA, 25 bp, Mus musculus
ttatgaggagaagccaccctatgcc

SEQ ID NO: 926071 - DNA, 25 bp, Mus musculus
ttatgaggccctcgacactaagcga

SEQ ID NO: 926072 - DNA, 25 bp, Mus musculus
ttatgaggccctggacactaagcga

SEQ ID NO: 926073 - DNA, 25 bp, Mus musculus
ttatgagggtccactaggccctaag

SEQ ID NO: 926074 - DNA, 25 bp, Mus musculus
ttatgagggtcctctaggccctaag

SEQ ID NO: 926075 - DNA, 25 bp, Mus musculus
ttatgaggtgtgattacgttttatt

SEQ ID NO: 926076 - DNA, 25 bp, Mus musculus
ttatgaggtgtgtttacgttttatt

SEQ ID NO: 926077 - DNA, 25 bp, Mus musculus
ttatgaggttcaatgatgaggtaac

SEQ ID NO: 926078 - DNA, 25 bp, Mus musculus
ttatgaggttcactatgtctcctgg

SEQ ID NO: 926079 - DNA, 25 bp, Mus musculus
ttatgaggttcagtatgtctcctgg

SEQ ID NO: 926080 - DNA, 25 bp, Mus musculus
ttatgaggttcattgatgaggtaac

SEQ ID NO: 926081 - DNA, 25 bp, Mus musculus
ttatgagtcattcctgttctggctt

SEQ ID NO: 926082 - DNA, 25 bp, Mus musculus
ttatgagtcattgctgttctggctt

SEQ ID NO: 926083 - DNA, 25 bp, Mus musculus
ttatgagtcccaatgccttgtgcta

SEQ ID NO: 926084 - DNA, 25 bp, Mus musculus
ttatgagtcccattgccttgtgcta

SEQ ID NO: 926085 - DNA, 25 bp, Mus musculus
ttatgagtgaccagtgttggcctgt

SEQ ID NO: 926086 - DNA, 25 bp, Mus musculus
ttatgagtgacctgtgttggcctgt

SEQ ID NO: 926087 - DNA, 25 bp, Mus musculus
ttatgagtgccgcagagcttactga

SEQ ID NO: 926088 - DNA, 25 bp, Mus musculus
ttatgagtgccggagagcttactga

SEQ ID NO: 926089 - DNA, 25 bp, Mus musculus
ttatgagtggccacagcaaccctgg

SEQ ID NO: 926090 - DNA, 25 bp, Mus musculus
ttatgagtggcctcagcaaccctgg

SEQ ID NO: 926091 - DNA, 25 bp, Mus musculus
ttatgagtttccacgcaagtcagca

SEQ ID NO: 926092 - DNA, 25 bp, Mus musculus
ttatgagtttcctcgcaagtcagca

SEQ ID NO: 926093 - DNA, 25 bp, Mus musculus
ttatgatagcctaatccgagccggg

SEQ ID NO: 926094 - DNA, 25 bp, Mus musculus
ttatgatagccttatccgagccggg

SEQ ID NO: 926095 - DNA, 25 bp, Mus musculus
ttatgatatcataacaacctgttgc

SEQ ID NO: 926096 - DNA, 25 bp, Mus musculus
ttatgatatcattacaacctgttgc

SEQ ID NO: 926097 - DNA, 25 bp, Mus musculus
ttatgatccagtatctgctcagtgg

SEQ ID NO: 926098 - DNA, 25 bp, Mus musculus
ttatgatccagtttctgctcagtgg

SEQ ID NO: 926099 - DNA, 25 bp, Mus musculus
ttatgatcccagctgagtttgtgag

SEQ ID NO: 926100 - DNA, 25 bp, Mus musculus
ttatgatcccaggtgagtttgtgag

SEQ ID NO: 926101 - DNA, 25 bp, Mus musculus
ttatgatccttcagtggacctaccg

SEQ ID NO: 926102 - DNA, 25 bp, Mus musculus
ttatgatccttctgtggacctaccg

SEQ ID NO: 926103 - DNA, 25 bp, Mus musculus
ttatgatctgtgatcttggccacct

SEQ ID NO: 926104 - DNA, 25 bp, Mus musculus
ttatgatctgtgttcttggccacct

SEQ ID NO: 926105 - DNA, 25 bp, Mus musculus
ttatgatgcaagacttcctcccagg

SEQ ID NO: 926106 - DNA, 25 bp, Mus musculus
ttatgatgcaagtcttcctcccagg

SEQ ID NO: 926107 - DNA, 25 bp, Mus musculus
ttatgatgccctattgtcactatcc

SEQ ID NO: 926108 - DNA, 25 bp, Mus musculus
ttatgatgcccttttgtcactatcc

SEQ ID NO: 926109 - DNA, 25 bp, Mus musculus
ttatgatgggcacctttcccggctg

SEQ ID NO: 926110 - DNA, 25 bp, Mus musculus
ttatgatgggcagctttcccggctg

SEQ ID NO: 926111 - DNA, 25 bp, Mus musculus
ttatgatgtaatcctaactgcttgt

SEQ ID NO: 926112 - DNA, 25 bp, Mus musculus
ttatgatgtaatgctaactgcttgt

SEQ ID NO: 926113 - DNA, 25 bp, Mus musculus
ttatgatgtgcacacaccttccttt

SEQ ID NO: 926114 - DNA, 25 bp, Mus musculus
ttatgatgtgcagacaccttccttt

SEQ ID NO: 926115 - DNA, 25 bp, Mus musculus
ttatgatgtttactctgatcagacc

SEQ ID NO: 926116 - DNA, 25 bp, Mus musculus
ttatgatgtttagtctgatcagacc

SEQ ID NO: 926117 - DNA, 25 bp, Mus musculus
ttatgattagcaaaggccctgggta

SEQ ID NO: 926118 - DNA, 25 bp, Mus musculus
ttatgattagcataggccctgggta

SEQ ID NO: 926119 - DNA, 25 bp, Mus musculus
ttatgattctttcgatgtgacactt

SEQ ID NO: 926120 - DNA, 25 bp, Mus musculus
ttatgattctttggatgtgacactt

SEQ ID NO: 926121 - DNA, 25 bp, Mus musculus
ttatgattgaacattgtgaccacag

SEQ ID NO: 926122 - DNA, 25 bp, Mus musculus
ttatgattgaactttgtgaccacag

SEQ ID NO: 926123 - DNA, 25 bp, Mus musculus
ttatgatttcatattgtgcttgcaa

SEQ ID NO: 926124 - DNA, 25 bp, Mus musculus
ttatgatttcattttgtgcttgcaa

SEQ ID NO: 926125 - DNA, 25 bp, Mus musculus
ttatgatttgcacccttggaggtga

SEQ ID NO: 926126 - DNA, 25 bp, Mus musculus
ttatgatttgcagccttggaggtga

SEQ ID NO: 926127 - DNA, 25 bp, Mus musculus
ttatgcaaagcacacacaccacacg

SEQ ID NO: 926128 - DNA, 25 bp, Mus musculus
ttatgcaaagcagacacaccacacg

SEQ ID NO: 926129 - DNA, 25 bp, Mus musculus
ttatgcaatgtaactgggttctcag

SEQ ID NO: 926130 - DNA, 25 bp, Mus musculus
ttatgcaatgtatctgggttctcag

SEQ ID NO: 926131 - DNA, 25 bp, Mus musculus
ttatgcacaaacatacctcagcctg

SEQ ID NO: 926132 - DNA, 25 bp, Mus musculus
ttatgcacaaacttacctcagcctg

SEQ ID NO: 926133 - DNA, 25 bp, Mus musculus
ttatgcacagccaagtactgccttc

SEQ ID NO: 926134 - DNA, 25 bp, Mus musculus
ttatgcacagcctagtactgccttc

SEQ ID NO: 926135 - DNA, 25 bp, Mus musculus
ttatgcactcgacttcctcttggag

SEQ ID NO: 926136 - DNA, 25 bp, Mus musculus
ttatgcactcgagttcctcttggag

SEQ ID NO: 926137 - DNA, 25 bp, Mus musculus
ttatgcagaggtcggccgagttctt

SEQ ID NO: 926138 - DNA, 25 bp, Mus musculus
ttatgcagaggtgggccgagttctt

SEQ ID NO: 926139 - DNA, 25 bp, Mus musculus
ttatgcagcaacatggcagggtcca

SEQ ID NO: 926140 - DNA, 25 bp, Mus musculus
ttatgcagcaacttggcagggtcca

SEQ ID NO: 926141 - DNA, 25 bp, Mus musculus
ttatgcagcatcattacccacaggg

SEQ ID NO: 926142 - DNA, 25 bp, Mus musculus
ttatgcagcatctttacccacaggg

SEQ ID NO: 926143 - DNA, 25 bp, Mus musculus
ttatgcagcccaaggtggcctcaaa

SEQ ID NO: 926144 - DNA, 25 bp, Mus musculus
ttatgcagcccatggtggcctcaaa

SEQ ID NO: 926145 - DNA, 25 bp, Mus musculus
ttatgcagcctccaaggatgcccgt

SEQ ID NO: 926146 - DNA, 25 bp, Mus musculus
ttatgcagcctcgaaggatgcccgt

SEQ ID NO: 926147 - DNA, 25 bp, Mus musculus
ttatgcagcgtgctccagccggagc

SEQ ID NO: 926148 - DNA, 25 bp, Mus musculus
ttatgcagcgtggtccagccggagc

SEQ ID NO: 926149 - DNA, 25 bp, Mus musculus
ttatgcagctctcgacgcttgtcag

SEQ ID NO: 926150 - DNA, 25 bp, Mus musculus
ttatgcagctctggacgcttgtcag

SEQ ID NO: 926151 - DNA, 25 bp, Mus musculus
ttatgcaggaaacccctccgaagtt

SEQ ID NO: 926152 - DNA, 25 bp, Mus musculus
ttatgcaggaaagccctccgaagtt

SEQ ID NO: 926153 - DNA, 25 bp, Mus musculus
ttatgcaggctaagtgttccaggta

SEQ ID NO: 926154 - DNA, 25 bp, Mus musculus
ttatgcaggctatgtgttccaggta

SEQ ID NO: 926155 - DNA, 25 bp, Mus musculus
ttatgcagtgctaagaatggaacgc

SEQ ID NO: 926156 - DNA, 25 bp, Mus musculus
ttatgcagtgcttagaatggaacgc

SEQ ID NO: 926157 - DNA, 25 bp, Mus musculus
ttatgcagtggaccccatgggaacc

SEQ ID NO: 926158 - DNA, 25 bp, Mus musculus
ttatgcagtggagcccatgggaacc

SEQ ID NO: 926159 - DNA, 25 bp, Mus musculus
ttatgcagtgtgaccggctgcctaa

SEQ ID NO: 926160 - DNA, 25 bp, Mus musculus
ttatgcagtgtgtccggctgcctaa

SEQ ID NO: 926161 - DNA, 25 bp, Mus musculus
ttatgcagtgttcccatgactgtct

SEQ ID NO: 926162 - DNA, 25 bp, Mus musculus
ttatgcagtgttgccatgactgtct

SEQ ID NO: 926163 - DNA, 25 bp, Mus musculus
ttatgcatccgtagctgtgtgagca

SEQ ID NO: 926164 - DNA, 25 bp, Mus musculus
ttatgcatccgttgctgtgtgagca

SEQ ID NO: 926165 - DNA, 25 bp, Mus musculus
ttatgcatcctgagccgttcttcac

SEQ ID NO: 926166 - DNA, 25 bp, Mus musculus
ttatgcatcctgtgccgttcttcac

SEQ ID NO: 926167 - DNA, 25 bp, Mus musculus
ttatgcatccttcatctcattggct

SEQ ID NO: 926168 - DNA, 25 bp, Mus musculus
ttatgcatccttgatctcattggct

SEQ ID NO: 926169 - DNA, 25 bp, Mus musculus
ttatgcattcagagtcttagacttc

SEQ ID NO: 926170 - DNA, 25 bp, Mus musculus
ttatgcattcagtgtcttagacttc

SEQ ID NO: 926171 - DNA, 25 bp, Mus musculus
ttatgccaagccagcgagcaaacag

SEQ ID NO: 926172 - DNA, 25 bp, Mus musculus
ttatgccaagcctgcgagcaaacag

SEQ ID NO: 926173 - DNA, 25 bp, Mus musculus
ttatgccaattaccagaatcagtgt

SEQ ID NO: 926174 - DNA, 25 bp, Mus musculus
ttatgccaattagcagaatcagtgt

SEQ ID NO: 926175 - DNA, 25 bp, Mus musculus
ttatgccacagtaagcccttttgta

SEQ ID NO: 926176 - DNA, 25 bp, Mus musculus
ttatgccacagttagcccttttgta

SEQ ID NO: 926177 - DNA, 25 bp, Mus musculus
ttatgccacgcaagtccgctgtgca

SEQ ID NO: 926178 - DNA, 25 bp, Mus musculus
ttatgccacgcatgtccgctgtgca

SEQ ID NO: 926179 - DNA, 25 bp, Mus musculus
ttatgccactgaccattactagagt

SEQ ID NO: 926180 - DNA, 25 bp, Mus musculus
ttatgccactgagcattactagagt

SEQ ID NO: 926181 - DNA, 25 bp, Mus musculus
ttatgccactgtatctgctgtcttg

SEQ ID NO: 926182 - DNA, 25 bp, Mus musculus
ttatgccactgtttctgctgtcttg

SEQ ID NO: 926183 - DNA, 25 bp, Mus musculus
ttatgccaggacaagctctcctttt

SEQ ID NO: 926184 - DNA, 25 bp, Mus musculus
ttatgccaggactagctctcctttt

SEQ ID NO: 926185 - DNA, 25 bp, Mus musculus
ttatgccatacccatctatattgta

SEQ ID NO: 926186 - DNA, 25 bp, Mus musculus
ttatgccataccgatctatattgta

SEQ ID NO: 926187 - DNA, 25 bp, Mus musculus
ttatgcccactaactcttttacact

SEQ ID NO: 926188 - DNA, 25 bp, Mus musculus
ttatgcccactatctcttttacact

SEQ ID NO: 926189 - DNA, 25 bp, Mus musculus
ttatgcccatgaatagcccctacac

SEQ ID NO: 926190 - DNA, 25 bp, Mus musculus
ttatgcccatgattagcccctacac

SEQ ID NO: 926191 - DNA, 25 bp, Mus musculus
ttatgcccctagatggtcccaagag

SEQ ID NO: 926192 - DNA, 25 bp, Mus musculus
ttatgcccctagttggtcccaagag

SEQ ID NO: 926193 - DNA, 25 bp, Mus musculus
ttatgcccctccacttgaagagatg

SEQ ID NO: 926194 - DNA, 25 bp, Mus musculus
ttatgcccctcctcttgaagagatg

SEQ ID NO: 926195 - DNA, 25 bp, Mus musculus
ttatgcccctctcaagcaaacatga

SEQ ID NO: 926196 - DNA, 25 bp, Mus musculus
ttatgcccctctgaagcaaacatga

SEQ ID NO: 926197 - DNA, 25 bp, Mus musculus
ttatgccctctacggacagagactg

SEQ ID NO: 926198 - DNA, 25 bp, Mus musculus
ttatgccctctagggacagagactg

SEQ ID NO: 926199 - DNA, 25 bp, Mus musculus
ttatgccgacttcaactgcttctgc

SEQ ID NO: 926200 - DNA, 25 bp, Mus musculus
ttatgccgacttgaactgcttctgc

SEQ ID NO: 926201 - DNA, 25 bp, Mus musculus
ttatgcctatcacatcgacccagct

SEQ ID NO: 926202 - DNA, 25 bp, Mus musculus
ttatgcctatcagatcgacccagct

SEQ ID NO: 926203 - DNA, 25 bp, Mus musculus
ttatgcctccgactaaacttgacag

SEQ ID NO: 926204 - DNA, 25 bp, Mus musculus
ttatgcctccgagtaaacttgacag

SEQ ID NO: 926205 - DNA, 25 bp, Mus musculus
ttatgcctgacaatagccaacctca

SEQ ID NO: 926206 - DNA, 25 bp, Mus musculus
ttatgcctgacattagccaacctca

SEQ ID NO: 926207 - DNA, 25 bp, Mus musculus
ttatgcctgattatgctagcttatt

SEQ ID NO: 926208 - DNA, 25 bp, Mus musculus
ttatgcctgattttgctagcttatt

SEQ ID NO: 926209 - DNA, 25 bp, Mus musculus
ttatgcctgcaacccgggtctataa

SEQ ID NO: 926210 - DNA, 25 bp, Mus musculus
ttatgcctgcaagccgggtctataa

SEQ ID NO: 926211 - DNA, 25 bp, Mus musculus
ttatgcctgttcactgccgagagga

SEQ ID NO: 926212 - DNA, 25 bp, Mus musculus
ttatgcctgttctctgccgagagga

SEQ ID NO: 926213 - DNA, 25 bp, Mus musculus
ttatgcctgtttagatcccatgctt

SEQ ID NO: 926214 - DNA, 25 bp, Mus musculus
ttatgcctgttttgatcccatgctt

SEQ ID NO: 926215 - DNA, 25 bp, Mus musculus
ttatgccttcccatacattgtgttg

SEQ ID NO: 926216 - DNA, 25 bp, Mus musculus
ttatgccttcccttacattgtgttg

SEQ ID NO: 926217 - DNA, 25 bp, Mus musculus
ttatgccttgacatcggtcattccc

SEQ ID NO: 926218 - DNA, 25 bp, Mus musculus
ttatgccttgacttcggtcattccc

SEQ ID NO: 926219 - DNA, 25 bp, Mus musculus
ttatgccttgatccatgcatggcaa

SEQ ID NO: 926220 - DNA, 25 bp, Mus musculus
ttatgccttgatgcatgcatggcaa

SEQ ID NO: 926221 - DNA, 25 bp, Mus musculus
ttatgcctttaccatcgcgtaaatg

SEQ ID NO: 926222 - DNA, 25 bp, Mus musculus
ttatgcctttacgatcgcgtaaatg

SEQ ID NO: 926223 - DNA, 25 bp, Mus musculus
ttatgcctttttcggcctgcgtttc

SEQ ID NO: 926224 - DNA, 25 bp, Mus musculus
ttatgcctttttgggcctgcgtttc

SEQ ID NO: 926225 - DNA, 25 bp, Mus musculus
ttatgcgaactcatattagccagtg

SEQ ID NO: 926226 - DNA, 25 bp, Mus musculus
ttatgcgaactcttattagccagtg

SEQ ID NO: 926227 - DNA, 25 bp, Mus musculus
ttatgcgaggaaacctattcatcag

SEQ ID NO: 926228 - DNA, 25 bp, Mus musculus
ttatgcgaggaatcctattcatcag

SEQ ID NO: 926229 - DNA, 25 bp, Mus musculus
ttatgcgcatggacatggaccggcg

SEQ ID NO: 926230 - DNA, 25 bp, Mus musculus
ttatgcgcatggtcatggaccggcg

SEQ ID NO: 926231 - DNA, 25 bp, Mus musculus
ttatgcggaatgactcgtgttactc

SEQ ID NO: 926232 - DNA, 25 bp, Mus musculus
ttatgcggaatgtctcgtgttactc

SEQ ID NO: 926233 - DNA, 25 bp, Mus musculus
ttatgcggcaggagcaacttgccca

SEQ ID NO: 926234 - DNA, 25 bp, Mus musculus
ttatgcggcaggtgcaacttgccca

SEQ ID NO: 926235 - DNA, 25 bp, Mus musculus
ttatgctagaacacgaacccaggac

SEQ ID NO: 926236 - DNA, 25 bp, Mus musculus
ttatgctagaactcgaacccaggac

SEQ ID NO: 926237 - DNA, 25 bp, Mus musculus
ttatgctagcacacacttagggatt

SEQ ID NO: 926238 - DNA, 25 bp, Mus musculus
ttatgctagcactcacttagggatt

SEQ ID NO: 926239 - DNA, 25 bp, Mus musculus
ttatgctatcacatggaccacggag

SEQ ID NO: 926240 - DNA, 25 bp, Mus musculus
ttatgctatcacttggaccacggag

SEQ ID NO: 926241 - DNA, 25 bp, Mus musculus
ttatgctcaactacaataacgtcag

SEQ ID NO: 926242 - DNA, 25 bp, Mus musculus
ttatgctcaactccttttccctgac

SEQ ID NO: 926243 - DNA, 25 bp, Mus musculus
ttatgctcaactgcttttccctgac

SEQ ID NO: 926244 - DNA, 25 bp, Mus musculus
ttatgctcaacttcaataacgtcag

SEQ ID NO: 926245 - DNA, 25 bp, Mus musculus
ttatgctcaagaaaagctcaccaac

SEQ ID NO: 926246 - DNA, 25 bp, Mus musculus
ttatgctcaagataagctcaccaac

SEQ ID NO: 926247 - DNA, 25 bp, Mus musculus
ttatgctcaatacttctgcctgaat

SEQ ID NO: 926248 - DNA, 25 bp, Mus musculus
ttatgctcaatagttctgcctgaat

SEQ ID NO: 926249 - DNA, 25 bp, Mus musculus
ttatgctcacccagtgatcacagag

SEQ ID NO: 926250 - DNA, 25 bp, Mus musculus
ttatgctcaccctgtgatcacagag

SEQ ID NO: 926251 - DNA, 25 bp, Mus musculus
ttatgctcagcaattgtctaagatg

SEQ ID NO: 926252 - DNA, 25 bp, Mus musculus
ttatgctcagcatttgtctaagatg

SEQ ID NO: 926253 - DNA, 25 bp, Mus musculus
ttatgctcagtccttgtgttcttta

SEQ ID NO: 926254 - DNA, 25 bp, Mus musculus
ttatgctcagtcgttgtgttcttta

SEQ ID NO: 926255 - DNA, 25 bp, Mus musculus
ttatgctcattcactaccatcaggg

SEQ ID NO: 926256 - DNA, 25 bp, Mus musculus
ttatgctcattctctaccatcaggg

SEQ ID NO: 926257 - DNA, 25 bp, Mus musculus
ttatgctccaaaagcacctgttcca

SEQ ID NO: 926258 - DNA, 25 bp, Mus musculus
ttatgctccaaatgcacctgttcca

SEQ ID NO: 926259 - DNA, 25 bp, Mus musculus
ttatgctcccatctcagagttcaac

SEQ ID NO: 926260 - DNA, 25 bp, Mus musculus
ttatgctcccatgtcagagttcaac

SEQ ID NO: 926261 - DNA, 25 bp, Mus musculus
ttatgctcccgtccttcatgtgctc

SEQ ID NO: 926262 - DNA, 25 bp, Mus musculus
ttatgctcccgtgcttcatgtgctc

SEQ ID NO: 926263 - DNA, 25 bp, Mus musculus
ttatgctcctataagatgctggtag

SEQ ID NO: 926264 - DNA, 25 bp, Mus musculus
ttatgctcctattagatgctggtag

SEQ ID NO: 926265 - DNA, 25 bp, Mus musculus
ttatgctcctgtctagttaaaaatt

SEQ ID NO: 926266 - DNA, 25 bp, Mus musculus
ttatgctcctgtgtagttaaaaatt

SEQ ID NO: 926267 - DNA, 25 bp, Mus musculus
ttatgctctaccatgattgatccta

SEQ ID NO: 926268 - DNA, 25 bp, Mus musculus
ttatgctctaccttgattgatccta

SEQ ID NO: 926269 - DNA, 25 bp, Mus musculus
ttatgctctggcctgagccaaagat

SEQ ID NO: 926270 - DNA, 25 bp, Mus musculus
ttatgctctggcgtgagccaaagat

SEQ ID NO: 926271 - DNA, 25 bp, Mus musculus
ttatgctctgtcaacatctccttcc

SEQ ID NO: 926272 - DNA, 25 bp, Mus musculus
ttatgctctgtctacatctccttcc

SEQ ID NO: 926273 - DNA, 25 bp, Mus musculus
ttatgctctttgaccaaaggaatgg

SEQ ID NO: 926274 - DNA, 25 bp, Mus musculus
ttatgctctttgtccaaaggaatgg

SEQ ID NO: 926275 - DNA, 25 bp, Mus musculus
ttatgctgaagtcggcgctatcctc

SEQ ID NO: 926276 - DNA, 25 bp, Mus musculus
ttatgctgaagtgggcgctatcctc

SEQ ID NO: 926277 - DNA, 25 bp, Mus musculus
ttatgctgacggctgatttcttgag

SEQ ID NO: 926278 - DNA, 25 bp, Mus musculus
ttatgctgacgggtgatttcttgag

SEQ ID NO: 926279 - DNA, 25 bp, Mus musculus
ttatgctgagtaagctccaggctcc

SEQ ID NO: 926280 - DNA, 25 bp, Mus musculus
ttatgctgagtatgctccaggctcc

SEQ ID NO: 926281 - DNA, 25 bp, Mus musculus
ttatgctgctgcaaatgaacctaat

SEQ ID NO: 926282 - DNA, 25 bp, Mus musculus
ttatgctgctgctaatgaacctaat

SEQ ID NO: 926283 - DNA, 25 bp, Mus musculus
ttatgctggatgaactctgtacatg

SEQ ID NO: 926284 - DNA, 25 bp, Mus musculus
ttatgctggatgtactctgtacatg

SEQ ID NO: 926285 - DNA, 25 bp, Mus musculus
ttatgctggcatcaatctcccgatt

SEQ ID NO: 926286 - DNA, 25 bp, Mus musculus
ttatgctggcatgaatctcccgatt

SEQ ID NO: 926287 - DNA, 25 bp, Mus musculus
ttatgctgtaagatccatgccaggt

SEQ ID NO: 926288 - DNA, 25 bp, Mus musculus
ttatgctgtaagttccatgccaggt

SEQ ID NO: 926289 - DNA, 25 bp, Mus musculus
ttatgctgtataagcgtgtgggtat

SEQ ID NO: 926290 - DNA, 25 bp, Mus musculus
ttatgctgtatatgcgtgtgggtat

SEQ ID NO: 926291 - DNA, 25 bp, Mus musculus
ttatgctgtcatcaactgtcccaca

SEQ ID NO: 926292 - DNA, 25 bp, Mus musculus
ttatgctgtcatgaactgtcccaca

SEQ ID NO: 926293 - DNA, 25 bp, Mus musculus
ttatgcttcaccctttgcaaaggtc

SEQ ID NO: 926294 - DNA, 25 bp, Mus musculus
ttatgcttcaccgtttgcaaaggtc

SEQ ID NO: 926295 - DNA, 25 bp, Mus musculus
ttatgcttcagcatcttggacaaga

SEQ ID NO: 926296 - DNA, 25 bp, Mus musculus
ttatgcttcagcttcttggacaaga

SEQ ID NO: 926297 - DNA, 25 bp, Mus musculus
ttatgcttcaggataacattccaga

SEQ ID NO: 926298 - DNA, 25 bp, Mus musculus
ttatgcttcaggttaacattccaga

SEQ ID NO: 926299 - DNA, 25 bp, Mus musculus
ttatgcttgcctagttataaggtca

SEQ ID NO: 926300 - DNA, 25 bp, Mus musculus
ttatgcttgccttgttataaggtca

SEQ ID NO: 926301 - DNA, 25 bp, Mus musculus
ttatgcttggccagcgttttgctgg

SEQ ID NO: 926302 - DNA, 25 bp, Mus musculus
ttatgcttggcctgcgttttgctgg

SEQ ID NO: 926303 - DNA, 25 bp, Mus musculus
ttatgcttgtgcaggtaaaatacct

SEQ ID NO: 926304 - DNA, 25 bp, Mus musculus
ttatgcttgtgctggtaaaatacct

SEQ ID NO: 926305 - DNA, 25 bp, Mus musculus
ttatgctttaagaccctcacaaggg

SEQ ID NO: 926306 - DNA, 25 bp, Mus musculus
ttatgctttaagtccctcacaaggg

SEQ ID NO: 926307 - DNA, 25 bp, Mus musculus
ttatgctttctgcttgcctttcctc

SEQ ID NO: 926308 - DNA, 25 bp, Mus musculus
ttatgctttctggttgcctttcctc

SEQ ID NO: 926309 - DNA, 25 bp, Mus musculus
ttatgctttgcaaacctatgtccct

SEQ ID NO: 926310 - DNA, 25 bp, Mus musculus
ttatgctttgcatacctatgtccct

SEQ ID NO: 926311 - DNA, 25 bp, Mus musculus
ttatgctttgtcagagctctggtgt

SEQ ID NO: 926312 - DNA, 25 bp, Mus musculus
ttatgctttgtctgagctctggtgt

SEQ ID NO: 926313 - DNA, 25 bp, Mus musculus
ttatgctttgtgaacctcaaccaag

SEQ ID NO: 926314 - DNA, 25 bp, Mus musculus
ttatgctttgtgtacctcaaccaag

SEQ ID NO: 926315 - DNA, 25 bp, Mus musculus
ttatggaaactacagccctaggctt

SEQ ID NO: 926316 - DNA, 25 bp, Mus musculus
ttatggaaactagagccctaggctt

SEQ ID NO: 926317 - DNA, 25 bp, Mus musculus
ttatggaaatctctgcatctcctcc

SEQ ID NO: 926318 - DNA, 25 bp, Mus musculus
ttatggaaatctgtgcatctcctcc

SEQ ID NO: 926319 - DNA, 25 bp, Mus musculus
ttatggaactcaccgccgattacct

SEQ ID NO: 926320 - DNA, 25 bp, Mus musculus
ttatggaactcagcgccgattacct

SEQ ID NO: 926321 - DNA, 25 bp, Mus musculus
ttatggaaggccctgcattcaactt

SEQ ID NO: 926322 - DNA, 25 bp, Mus musculus
ttatggaaggccgtgcattcaactt

SEQ ID NO: 926323 - DNA, 25 bp, Mus musculus
ttatggaatctcatccttgttcccg

SEQ ID NO: 926324 - DNA, 25 bp, Mus musculus
ttatggaatctcttccttgttcccg

SEQ ID NO: 926325 - DNA, 25 bp, Mus musculus
ttatggacagttcatcagcctgaga

SEQ ID NO: 926326 - DNA, 25 bp, Mus musculus
ttatggacagttgatcagcctgaga

SEQ ID NO: 926327 - DNA, 25 bp, Mus musculus
ttatggactctcattgccgttcaaa

SEQ ID NO: 926328 - DNA, 25 bp, Mus musculus
ttatggactctctttgccgttcaaa

SEQ ID NO: 926329 - DNA, 25 bp, Mus musculus
ttatggagacttaccaggtgtttct

SEQ ID NO: 926330 - DNA, 25 bp, Mus musculus
ttatggagactttccaggtgtttct

SEQ ID NO: 926331 - DNA, 25 bp, Mus musculus
ttatggagagcaatccactcccgga

SEQ ID NO: 926332 - DNA, 25 bp, Mus musculus
ttatggagagcattccactcccgga

SEQ ID NO: 926333 - DNA, 25 bp, Mus musculus
ttatggagccctccttgagtcaggg

SEQ ID NO: 926334 - DNA, 25 bp, Mus musculus
ttatggagccctgcttgagtcaggg

SEQ ID NO: 926335 - DNA, 25 bp, Mus musculus
ttatggaggtcacccgaagctgcgc

SEQ ID NO: 926336 - DNA, 25 bp, Mus musculus
ttatggaggtcagccgaagctgcgc

SEQ ID NO: 926337 - DNA, 25 bp, Mus musculus
ttatggaggtctagtatctatctca

SEQ ID NO: 926338 - DNA, 25 bp, Mus musculus
ttatggaggtcttgtatctatctca

SEQ ID NO: 926339 - DNA, 25 bp, Mus musculus
ttatggaggtgcagggtatcgaact

SEQ ID NO: 926340 - DNA, 25 bp, Mus musculus
ttatggaggtgctgggtatcgaact

SEQ ID NO: 926341 - DNA, 25 bp, Mus musculus
ttatggagtcgtctgctcgggataa

SEQ ID NO: 926342 - DNA, 25 bp, Mus musculus
ttatggagtcgtgtgctcgggataa

SEQ ID NO: 926343 - DNA, 25 bp, Mus musculus
ttatggagtgctcatgtcatcgccc

SEQ ID NO: 926344 - DNA, 25 bp, Mus musculus
ttatggagtgctgatgtcatcgccc

SEQ ID NO: 926345 - DNA, 25 bp, Mus musculus
ttatggagttatcaccggccttgca

SEQ ID NO: 926346 - DNA, 25 bp, Mus musculus
ttatggagttatgaccggccttgca

SEQ ID NO: 926347 - DNA, 25 bp, Mus musculus
ttatggattgacacattatattact

SEQ ID NO: 926348 - DNA, 25 bp, Mus musculus
ttatggattgactcattatattact

SEQ ID NO: 926349 - DNA, 25 bp, Mus musculus
ttatggcaactaacgcagcttcaga

SEQ ID NO: 926350 - DNA, 25 bp, Mus musculus
ttatggcaactatcgcagcttcaga

SEQ ID NO: 926351 - DNA, 25 bp, Mus musculus
ttatggcaccagagtttctcccact

SEQ ID NO: 926352 - DNA, 25 bp, Mus musculus
ttatggcaccagtgtttctcccact

SEQ ID NO: 926353 - DNA, 25 bp, Mus musculus
ttatggcaccatatggactgcccat

SEQ ID NO: 926354 - DNA, 25 bp, Mus musculus
ttatggcaccatttggactgcccat

SEQ ID NO: 926355 - DNA, 25 bp, Mus musculus
ttatggcagatactctcaaacccta

SEQ ID NO: 926356 - DNA, 25 bp, Mus musculus
ttatggcagatagtctcaaacccta

SEQ ID NO: 926357 - DNA, 25 bp, Mus musculus
ttatggcatcctacattgcacagac

SEQ ID NO: 926358 - DNA, 25 bp, Mus musculus
ttatggcatccttcattgcacagac

SEQ ID NO: 926359 - DNA, 25 bp, Mus musculus
ttatggcatggcagcatcttctggt

SEQ ID NO: 926360 - DNA, 25 bp, Mus musculus
ttatggcatggctgcatcttctggt

SEQ ID NO: 926361 - DNA, 25 bp, Mus musculus
ttatggcatgtcaggatcttctgga

SEQ ID NO: 926362 - DNA, 25 bp, Mus musculus
ttatggcatgtctggatcttctgga

SEQ ID NO: 926363 - DNA, 25 bp, Mus musculus
ttatggccagctaatatcccttgaa

SEQ ID NO: 926364 - DNA, 25 bp, Mus musculus
ttatggccagcttatatcccttgaa

SEQ ID NO: 926365 - DNA, 25 bp, Mus musculus
ttatggccatgacagacccagcttt

SEQ ID NO: 926366 - DNA, 25 bp, Mus musculus
ttatggccatgagagacccagcttt

SEQ ID NO: 926367 - DNA, 25 bp, Mus musculus
ttatggccattcactggagcctgta

SEQ ID NO: 926368 - DNA, 25 bp, Mus musculus
ttatggccattctctggagcctgta

SEQ ID NO: 926369 - DNA, 25 bp, Mus musculus
ttatggccctccatgcatcttatat

SEQ ID NO: 926370 - DNA, 25 bp, Mus musculus
ttatggccctccttgcatcttatat

SEQ ID NO: 926371 - DNA, 25 bp, Mus musculus
ttatggccggatatgctttctcctg

SEQ ID NO: 926372 - DNA, 25 bp, Mus musculus
ttatggccggatttgctttctcctg

SEQ ID NO: 926373 - DNA, 25 bp, Mus musculus
ttatggcctaatattgaaggtctcc

SEQ ID NO: 926374 - DNA, 25 bp, Mus musculus
ttatggcctaattttgaaggtctcc

SEQ ID NO: 926375 - DNA, 25 bp, Mus musculus
ttatggcctatgctctttttcctta

SEQ ID NO: 926376 - DNA, 25 bp, Mus musculus
ttatggcctatggtctttttcctta

SEQ ID NO: 926377 - DNA, 25 bp, Mus musculus
ttatggcgactgcttatgttttctg

SEQ ID NO: 926378 - DNA, 25 bp, Mus musculus
ttatggcgactggttatgttttctg

SEQ ID NO: 926379 - DNA, 25 bp, Mus musculus
ttatggcgtgcacggttctagacaa

SEQ ID NO: 926380 - DNA, 25 bp, Mus musculus
ttatggcgtgcagggttctagacaa

SEQ ID NO: 926381 - DNA, 25 bp, Mus musculus
ttatggcgtgtgatttgtggtcctc

SEQ ID NO: 926382 - DNA, 25 bp, Mus musculus
ttatggcgtgtgttttgtggtcctc

SEQ ID NO: 926383 - DNA, 25 bp, Mus musculus
ttatggcgttggagatctcatcccg

SEQ ID NO: 926384 - DNA, 25 bp, Mus musculus
ttatggcgttggtgatctcatcccg

SEQ ID NO: 926385 - DNA, 25 bp, Mus musculus
ttatggctcattccttgcatcagtg

SEQ ID NO: 926386 - DNA, 25 bp, Mus musculus
ttatggctcattgcttgcatcagtg

SEQ ID NO: 926387 - DNA, 25 bp, Mus musculus
ttatggctcctccacctggtatgag

SEQ ID NO: 926388 - DNA, 25 bp, Mus musculus
ttatggctcctcgacctggtatgag

SEQ ID NO: 926389 - DNA, 25 bp, Mus musculus
ttatggctctgtcccaagcgctcct

SEQ ID NO: 926390 - DNA, 25 bp, Mus musculus
ttatggctctgtgccaagcgctcct

SEQ ID NO: 926391 - DNA, 25 bp, Mus musculus
ttatggctctttaccaactttcctt

SEQ ID NO: 926392 - DNA, 25 bp, Mus musculus
ttatggctcttttccaactttcctt

SEQ ID NO: 926393 - DNA, 25 bp, Mus musculus
ttatggctgcacacatcctacagta

SEQ ID NO: 926394 - DNA, 25 bp, Mus musculus
ttatggctgcactcatcctacagta

SEQ ID NO: 926395 - DNA, 25 bp, Mus musculus
ttatggctggatcttccggtagtac

SEQ ID NO: 926396 - DNA, 25 bp, Mus musculus
ttatggctggatgttccggtagtac

SEQ ID NO: 926397 - DNA, 25 bp, Mus musculus
ttatggctggctccagtcactgcgc

SEQ ID NO: 926398 - DNA, 25 bp, Mus musculus
ttatggctggctgcagtcactgcgc

SEQ ID NO: 926399 - DNA, 25 bp, Mus musculus
ttatggctgggcatagttgtgcaca

SEQ ID NO: 926400 - DNA, 25 bp, Mus musculus
ttatggctgggcttagttgtgcaca

SEQ ID NO: 926401 - DNA, 25 bp, Mus musculus
ttatggcttataacctgcagtctgg

SEQ ID NO: 926402 - DNA, 25 bp, Mus musculus
ttatggcttatatcctgcagtctgg

SEQ ID NO: 926403 - DNA, 25 bp, Mus musculus
ttatggctttgcaggactctgcttc

SEQ ID NO: 926404 - DNA, 25 bp, Mus musculus
ttatggctttgctggactctgcttc

SEQ ID NO: 926405 - DNA, 25 bp, Mus musculus
ttatgggaactcaaatatctcaacc

SEQ ID NO: 926406 - DNA, 25 bp, Mus musculus
ttatgggaactctaatatctcaacc

SEQ ID NO: 926407 - DNA, 25 bp, Mus musculus
ttatgggacattatctgagctacaa

SEQ ID NO: 926408 - DNA, 25 bp, Mus musculus
ttatgggacattttctgagctacaa

SEQ ID NO: 926409 - DNA, 25 bp, Mus musculus
ttatgggaccataaaacatgctgat

SEQ ID NO: 926410 - DNA, 25 bp, Mus musculus
ttatgggaccattaaacatgctgat

SEQ ID NO: 926411 - DNA, 25 bp, Mus musculus
ttatgggaccctccttattgcctgg

SEQ ID NO: 926412 - DNA, 25 bp, Mus musculus
ttatgggaccctgcttattgcctgg

SEQ ID NO: 926413 - DNA, 25 bp, Mus musculus
ttatgggacgctacctcaaatgcat

SEQ ID NO: 926414 - DNA, 25 bp, Mus musculus
ttatgggacgcttcctcaaatgcat

SEQ ID NO: 926415 - DNA, 25 bp, Mus musculus
ttatgggaggacagtggtatacaga

SEQ ID NO: 926416 - DNA, 25 bp, Mus musculus
ttatgggaggactgtggtatacaga

SEQ ID NO: 926417 - DNA, 25 bp, Mus musculus
ttatgggaggctagcgctccagcta

SEQ ID NO: 926418 - DNA, 25 bp, Mus musculus
ttatgggaggcttgcgctccagcta

SEQ ID NO: 926419 - DNA, 25 bp, Mus musculus
ttatgggatcagactttttccttct

SEQ ID NO: 926420 - DNA, 25 bp, Mus musculus
ttatgggatcagtctttttccttct

SEQ ID NO: 926421 - DNA, 25 bp, Mus musculus
ttatgggattttctgtgacagtgaa

SEQ ID NO: 926422 - DNA, 25 bp, Mus musculus
ttatgggattttgtgtgacagtgaa

SEQ ID NO: 926423 - DNA, 25 bp, Mus musculus
ttatgggcaaatacccacgggaact

SEQ ID NO: 926424 - DNA, 25 bp, Mus musculus
ttatgggcaaattcccacgggaact

SEQ ID NO: 926425 - DNA, 25 bp, Mus musculus
ttatgggcactacaccattgatggt

SEQ ID NO: 926426 - DNA, 25 bp, Mus musculus
ttatgggcactagaccattgatggt

SEQ ID NO: 926427 - DNA, 25 bp, Mus musculus
ttatgggcaggtctgacccaccgca

SEQ ID NO: 926428 - DNA, 25 bp, Mus musculus
ttatgggcaggtgtgacccaccgca

SEQ ID NO: 926429 - DNA, 25 bp, Mus musculus
ttatgggcatctactctctgtgctg

SEQ ID NO: 926430 - DNA, 25 bp, Mus musculus
ttatgggcatcttctctctgtgctg

SEQ ID NO: 926431 - DNA, 25 bp, Mus musculus
ttatgggcatggactcagcgaggac

SEQ ID NO: 926432 - DNA, 25 bp, Mus musculus
ttatgggcatggtctcagcgaggac

SEQ ID NO: 926433 - DNA, 25 bp, Mus musculus
ttatgggccaacacaaccagcctat

SEQ ID NO: 926434 - DNA, 25 bp, Mus musculus
ttatgggccaactcaaccagcctat

SEQ ID NO: 926435 - DNA, 25 bp, Mus musculus
ttatgggccttactggctggcgctc

SEQ ID NO: 926436 - DNA, 25 bp, Mus musculus
ttatgggccttagtggctggcgctc

SEQ ID NO: 926437 - DNA, 25 bp, Mus musculus
ttatgggctgggacatagctcagtt

SEQ ID NO: 926438 - DNA, 25 bp, Mus musculus
ttatgggctgggtcatagctcagtt

SEQ ID NO: 926439 - DNA, 25 bp, Mus musculus
ttatgggtagtcctgaagtaattcc

SEQ ID NO: 926440 - DNA, 25 bp, Mus musculus
ttatgggtagtcgtgaagtaattcc

SEQ ID NO: 926441 - DNA, 25 bp, Mus musculus
ttatgggtccacaaacaactgaagg

SEQ ID NO: 926442 - DNA, 25 bp, Mus musculus
ttatgggtccactaacaactgaagg

SEQ ID NO: 926443 - DNA, 25 bp, Mus musculus
ttatgggtccctcccatggacaaat

SEQ ID NO: 926444 - DNA, 25 bp, Mus musculus
ttatgggtccctgccatggacaaat

SEQ ID NO: 926445 - DNA, 25 bp, Mus musculus
ttatgggtgccgctcagcagaccat

SEQ ID NO: 926446 - DNA, 25 bp, Mus musculus
ttatgggtgccggtcagcagaccat

SEQ ID NO: 926447 - DNA, 25 bp, Mus musculus
ttatgggtggtgataagtctactat

SEQ ID NO: 926448 - DNA, 25 bp, Mus musculus
ttatgggtggtgttaagtctactat

SEQ ID NO: 926449 - DNA, 25 bp, Mus musculus
ttatgggttcatcccaccaggccca

SEQ ID NO: 926450 - DNA, 25 bp, Mus musculus
ttatgggttcatgccaccaggccca

SEQ ID NO: 926451 - DNA, 25 bp, Mus musculus
ttatggtaacatctgcagcaggaac

SEQ ID NO: 926452 - DNA, 25 bp, Mus musculus
ttatggtaacatgtgcagcaggaac

SEQ ID NO: 926453 - DNA, 25 bp, Mus musculus
ttatggtaatttagaggactggatg

SEQ ID NO: 926454 - DNA, 25 bp, Mus musculus
ttatggtaattttgaggactggatg

SEQ ID NO: 926455 - DNA, 25 bp, Mus musculus
ttatggtatcatagtgctgtgttca

SEQ ID NO: 926456 - DNA, 25 bp, Mus musculus
ttatggtatcattgtgctgtgttca

SEQ ID NO: 926457 - DNA, 25 bp, Mus musculus
ttatggtcagaaactcttaagattt

SEQ ID NO: 926458 - DNA, 25 bp, Mus musculus
ttatggtcagaatctcttaagattt

SEQ ID NO: 926459 - DNA, 25 bp, Mus musculus
ttatggtcagtaccccccagtaggg

SEQ ID NO: 926460 - DNA, 25 bp, Mus musculus
ttatggtcagtagcccccagtaggg

SEQ ID NO: 926461 - DNA, 25 bp, Mus musculus
ttatggtcatttactgctacacagg

SEQ ID NO: 926462 - DNA, 25 bp, Mus musculus
ttatggtcattttctgctacacagg

SEQ ID NO: 926463 - DNA, 25 bp, Mus musculus
ttatggtcctgccttctttgaaatc

SEQ ID NO: 926464 - DNA, 25 bp, Mus musculus
ttatggtcctgcgttctttgaaatc

SEQ ID NO: 926465 - DNA, 25 bp, Mus musculus
ttatggtctcttcgtttctttcttt

SEQ ID NO: 926466 - DNA, 25 bp, Mus musculus
ttatggtctcttggtttctttcttt

SEQ ID NO: 926467 - DNA, 25 bp, Mus musculus
ttatggtctgtgatcgtagctgtga

SEQ ID NO: 926468 - DNA, 25 bp, Mus musculus
ttatggtctgtgttcgtagctgtga

SEQ ID NO: 926469 - DNA, 25 bp, Mus musculus
ttatggtgcaggattcgagagcaat

SEQ ID NO: 926470 - DNA, 25 bp, Mus musculus
ttatggtgcaggtttcgagagcaat

SEQ ID NO: 926471 - DNA, 25 bp, Mus musculus
ttatggtgccaactagcctacatta

SEQ ID NO: 926472 - DNA, 25 bp, Mus musculus
ttatggtgccaagtagcctacatta

SEQ ID NO: 926473 - DNA, 25 bp, Mus musculus
ttatggtgcttgacgtctgtaaaca

SEQ ID NO: 926474 - DNA, 25 bp, Mus musculus
ttatggtgcttgtcgtctgtaaaca

SEQ ID NO: 926475 - DNA, 25 bp, Mus musculus
ttatggtggccaaggaatcccgcaa

SEQ ID NO: 926476 - DNA, 25 bp, Mus musculus
ttatggtggccatggaatcccgcaa

SEQ ID NO: 926477 - DNA, 25 bp, Mus musculus
ttatggtggtgaactttaagtgtaa

SEQ ID NO: 926478 - DNA, 25 bp, Mus musculus
ttatggtggtgatctttaagtgtaa

SEQ ID NO: 926479 - DNA, 25 bp, Mus musculus
ttatggtgttgaccctggctccaaa

SEQ ID NO: 926480 - DNA, 25 bp, Mus musculus
ttatggtgttgagcctggctccaaa

SEQ ID NO: 926481 - DNA, 25 bp, Mus musculus
ttatggttccttaggtcgctcgctc

SEQ ID NO: 926482 - DNA, 25 bp, Mus musculus
ttatggttcctttggtcgctcgctc

SEQ ID NO: 926483 - DNA, 25 bp, Mus musculus
ttatggttctagcttgtcatcttag

SEQ ID NO: 926484 - DNA, 25 bp, Mus musculus
ttatggttctaggttgtcatcttag

SEQ ID NO: 926485 - DNA, 25 bp, Mus musculus
ttatggttctggactgaacccaggt

SEQ ID NO: 926486 - DNA, 25 bp, Mus musculus
ttatggttctggtctgaacccaggt

SEQ ID NO: 926487 - DNA, 25 bp, Mus musculus
ttatggttcttcaactgatgcagtt

SEQ ID NO: 926488 - DNA, 25 bp, Mus musculus
ttatggttcttctactgatgcagtt

SEQ ID NO: 926489 - DNA, 25 bp, Mus musculus
ttatggttggttatccttacagtat

SEQ ID NO: 926490 - DNA, 25 bp, Mus musculus
ttatggttggttttccttacagtat

SEQ ID NO: 926491 - DNA, 25 bp, Mus musculus
ttatggtttctactgctatgactga

SEQ ID NO: 926492 - DNA, 25 bp, Mus musculus
ttatggtttctagtgctatgactga

SEQ ID NO: 926493 - DNA, 25 bp, Mus musculus
ttatggtttgcaccgtctattaaat

SEQ ID NO: 926494 - DNA, 25 bp, Mus musculus
ttatggtttgcagcgtctattaaat

SEQ ID NO: 926495 - DNA, 25 bp, Mus musculus
ttatgtaaaagcaccccaattccag

SEQ ID NO: 926496 - DNA, 25 bp, Mus musculus
ttatgtaaaagctccccaattccag

SEQ ID NO: 926497 - DNA, 25 bp, Mus musculus
ttatgtaaaataccttgtttcaaag

SEQ ID NO: 926498 - DNA, 25 bp, Mus musculus
ttatgtaaaatagcttgtttcaaag

SEQ ID NO: 926499 - DNA, 25 bp, Mus musculus
ttatgtaaattaagactgtgaccta

SEQ ID NO: 926500 - DNA, 25 bp, Mus musculus
ttatgtaaattatgactgtgaccta

SEQ ID NO: 926501 - DNA, 25 bp, Mus musculus
ttatgtaaccctacagaaaaccact

SEQ ID NO: 926502 - DNA, 25 bp, Mus musculus
ttatgtaacccttcagaaaaccact

SEQ ID NO: 926503 - DNA, 25 bp, Mus musculus
ttatgtaagtgtatggccaccatgc

SEQ ID NO: 926504 - DNA, 25 bp, Mus musculus
ttatgtaagtgtttggccaccatgc

SEQ ID NO: 926505 - DNA, 25 bp, Mus musculus
ttatgtaagttgagtgtgcgtgtgc

SEQ ID NO: 926506 - DNA, 25 bp, Mus musculus
ttatgtaagttgtgtgtgcgtgtgc

SEQ ID NO: 926507 - DNA, 25 bp, Mus musculus
ttatgtaatactcccatttccaagc

SEQ ID NO: 926508 - DNA, 25 bp, Mus musculus
ttatgtaatactgccatttccaagc

SEQ ID NO: 926509 - DNA, 25 bp, Mus musculus
ttatgtaattgcattccggccagtt

SEQ ID NO: 926510 - DNA, 25 bp, Mus musculus
ttatgtaattgctttccggccagtt

SEQ ID NO: 926511 - DNA, 25 bp, Mus musculus
ttatgtacatgtatgcttgggcagc

SEQ ID NO: 926512 - DNA, 25 bp, Mus musculus
ttatgtacatgtttgcttgggcagc

SEQ ID NO: 926513 - DNA, 25 bp, Mus musculus
ttatgtactctgatgcatgagtcag

SEQ ID NO: 926514 - DNA, 25 bp, Mus musculus
ttatgtactctgttgcatgagtcag

SEQ ID NO: 926515 - DNA, 25 bp, Mus musculus
ttatgtactgttacctggtccaaag

SEQ ID NO: 926516 - DNA, 25 bp, Mus musculus
ttatgtactgtttcctggtccaaag

SEQ ID NO: 926517 - DNA, 25 bp, Mus musculus
ttatgtacttcgacttcaagctggt

SEQ ID NO: 926518 - DNA, 25 bp, Mus musculus
ttatgtacttcgtcttcaagctggt

SEQ ID NO: 926519 - DNA, 25 bp, Mus musculus
ttatgtagccataagatctcctcgc

SEQ ID NO: 926520 - DNA, 25 bp, Mus musculus
ttatgtagccattagatctcctcgc

SEQ ID NO: 926521 - DNA, 25 bp, Mus musculus
ttatgtagcctacgtttgccatgac

SEQ ID NO: 926522 - DNA, 25 bp, Mus musculus
ttatgtagcctaggtttgccatgac

SEQ ID NO: 926523 - DNA, 25 bp, Mus musculus
ttatgtagctaaatttcccctcact

SEQ ID NO: 926524 - DNA, 25 bp, Mus musculus
ttatgtagctaattttcccctcact

SEQ ID NO: 926525 - DNA, 25 bp, Mus musculus
ttatgtaggcatattccctcctctc

SEQ ID NO: 926526 - DNA, 25 bp, Mus musculus
ttatgtaggcattttccctcctctc

SEQ ID NO: 926527 - DNA, 25 bp, Mus musculus
ttatgtaggctaagtcccaaggtaa

SEQ ID NO: 926528 - DNA, 25 bp, Mus musculus
ttatgtaggctatgtcccaaggtaa

SEQ ID NO: 926529 - DNA, 25 bp, Mus musculus
ttatgtagggaacccatccactcag

SEQ ID NO: 926530 - DNA, 25 bp, Mus musculus
ttatgtagggaagccatccactcag

SEQ ID NO: 926531 - DNA, 25 bp, Mus musculus
ttatgtagtctgagcaaagaaacca

SEQ ID NO: 926532 - DNA, 25 bp, Mus musculus
ttatgtagtctgtgcaaagaaacca

SEQ ID NO: 926533 - DNA, 25 bp, Mus musculus
ttatgtataaccaccactattgtaa

SEQ ID NO: 926534 - DNA, 25 bp, Mus musculus
ttatgtataacctccactattgtaa

SEQ ID NO: 926535 - DNA, 25 bp, Mus musculus
ttatgtatatgtcaacagtggttgg

SEQ ID NO: 926536 - DNA, 25 bp, Mus musculus
ttatgtatatgtgaacagtggttgg

SEQ ID NO: 926537 - DNA, 25 bp, Mus musculus
ttatgtatcaccactcagttcctga

SEQ ID NO: 926538 - DNA, 25 bp, Mus musculus
ttatgtatcacccagtgtagctccc

SEQ ID NO: 926539 - DNA, 25 bp, Mus musculus
ttatgtatcaccgagtgtagctccc

SEQ ID NO: 926540 - DNA, 25 bp, Mus musculus
ttatgtatcacctctcagttcctga

SEQ ID NO: 926541 - DNA, 25 bp, Mus musculus
ttatgtatccagagagtacctcagt

SEQ ID NO: 926542 - DNA, 25 bp, Mus musculus
ttatgtatccagtgagtacctcagt

SEQ ID NO: 926543 - DNA, 25 bp, Mus musculus
ttatgtatcccaccatggccgcttt

SEQ ID NO: 926544 - DNA, 25 bp, Mus musculus
ttatgtatcccagcatggccgcttt

SEQ ID NO: 926545 - DNA, 25 bp, Mus musculus
ttatgtatctatataccatagcaca

SEQ ID NO: 926546 - DNA, 25 bp, Mus musculus
ttatgtatctatttaccatagcaca

SEQ ID NO: 926547 - DNA, 25 bp, Mus musculus
ttatgtattcctacagactgcgttc

SEQ ID NO: 926548 - DNA, 25 bp, Mus musculus
ttatgtattccttcagactgcgttc

SEQ ID NO: 926549 - DNA, 25 bp, Mus musculus
ttatgtcaaactactaagccccgga

SEQ ID NO: 926550 - DNA, 25 bp, Mus musculus
ttatgtcaaacttctaagccccgga

SEQ ID NO: 926551 - DNA, 25 bp, Mus musculus
ttatgtcaatctaagagtccaccac

SEQ ID NO: 926552 - DNA, 25 bp, Mus musculus
ttatgtcaatcttagagtccaccac

SEQ ID NO: 926553 - DNA, 25 bp, Mus musculus
ttatgtcacatactcatcttgggtt

SEQ ID NO: 926554 - DNA, 25 bp, Mus musculus
ttatgtcacatagtcatcttgggtt

SEQ ID NO: 926555 - DNA, 25 bp, Mus musculus
ttatgtcacgatcaccatatccatc

SEQ ID NO: 926556 - DNA, 25 bp, Mus musculus
ttatgtcacgatgaccatatccatc

SEQ ID NO: 926557 - DNA, 25 bp, Mus musculus
ttatgtcactgaacctggccagatt

SEQ ID NO: 926558 - DNA, 25 bp, Mus musculus
ttatgtcactgatcctggccagatt

SEQ ID NO: 926559 - DNA, 25 bp, Mus musculus
ttatgtcagaccaggtaaccatccc

SEQ ID NO: 926560 - DNA, 25 bp, Mus musculus
ttatgtcagacctggtaaccatccc

SEQ ID NO: 926561 - DNA, 25 bp, Mus musculus
ttatgtcagatacggtctcctcctg

SEQ ID NO: 926562 - DNA, 25 bp, Mus musculus
ttatgtcagatagggtctcctcctg

SEQ ID NO: 926563 - DNA, 25 bp, Mus musculus
ttatgtcagcggattcgggataaca

SEQ ID NO: 926564 - DNA, 25 bp, Mus musculus
ttatgtcagcggtttcgggataaca

SEQ ID NO: 926565 - DNA, 25 bp, Mus musculus
ttatgtccataactcccatttcaac

SEQ ID NO: 926566 - DNA, 25 bp, Mus musculus
ttatgtccataagtcccatttcaac

SEQ ID NO: 926567 - DNA, 25 bp, Mus musculus
ttatgtccatgacttgcttttggtt

SEQ ID NO: 926568 - DNA, 25 bp, Mus musculus
ttatgtccatgagttgcttttggtt

SEQ ID NO: 926569 - DNA, 25 bp, Mus musculus
ttatgtcccaccaggcatcgcagtg

SEQ ID NO: 926570 - DNA, 25 bp, Mus musculus
ttatgtcccacctggcatcgcagtg

SEQ ID NO: 926571 - DNA, 25 bp, Mus musculus
ttatgtcccactcgcagggaggtct

SEQ ID NO: 926572 - DNA, 25 bp, Mus musculus
ttatgtcccactctattcctctaaa

SEQ ID NO: 926573 - DNA, 25 bp, Mus musculus
ttatgtcccactggcagggaggtct

SEQ ID NO: 926574 - DNA, 25 bp, Mus musculus
ttatgtcccactgtattcctctaaa

SEQ ID NO: 926575 - DNA, 25 bp, Mus musculus
ttatgtcccttcacaattcaccaca

SEQ ID NO: 926576 - DNA, 25 bp, Mus musculus
ttatgtcccttctcaattcaccaca

SEQ ID NO: 926577 - DNA, 25 bp, Mus musculus
ttatgtcctcagatctgcagagcct

SEQ ID NO: 926578 - DNA, 25 bp, Mus musculus
ttatgtcctcagttctgcagagcct

SEQ ID NO: 926579 - DNA, 25 bp, Mus musculus
ttatgtcctcttccatcttgtcaga

SEQ ID NO: 926580 - DNA, 25 bp, Mus musculus
ttatgtcctcttgcatcttgtcaga

SEQ ID NO: 926581 - DNA, 25 bp, Mus musculus
ttatgtccttgaagtggccatgtct

SEQ ID NO: 926582 - DNA, 25 bp, Mus musculus
ttatgtccttgatgtggccatgtct

SEQ ID NO: 926583 - DNA, 25 bp, Mus musculus
ttatgtcgagctccgcgagaaaccc

SEQ ID NO: 926584 - DNA, 25 bp, Mus musculus
ttatgtcgagctgcgcgagaaaccc

SEQ ID NO: 926585 - DNA, 25 bp, Mus musculus
ttatgtcgcgagaactttgccaggg

SEQ ID NO: 926586 - DNA, 25 bp, Mus musculus
ttatgtcgcgagtactttgccaggg

SEQ ID NO: 926587 - DNA, 25 bp, Mus musculus
ttatgtctactgaaaacattgcgga

SEQ ID NO: 926588 - DNA, 25 bp, Mus musculus
ttatgtctactgtaaacattgcgga

SEQ ID NO: 926589 - DNA, 25 bp, Mus musculus
ttatgtctccttatggcttgcactc

SEQ ID NO: 926590 - DNA, 25 bp, Mus musculus
ttatgtctccttttggcttgcactc

SEQ ID NO: 926591 - DNA, 25 bp, Mus musculus
ttatgtctcttgaaactcccgttta

SEQ ID NO: 926592 - DNA, 25 bp, Mus musculus
ttatgtctcttgtaactcccgttta

SEQ ID NO: 926593 - DNA, 25 bp, Mus musculus
ttatgtctgaggcttcttaagaatt

SEQ ID NO: 926594 - DNA, 25 bp, Mus musculus
ttatgtctgagggttcttaagaatt

SEQ ID NO: 926595 - DNA, 25 bp, Mus musculus
ttatgtctgatgaagagctgctcct

SEQ ID NO: 926596 - DNA, 25 bp, Mus musculus
ttatgtctgatgtagagctgctcct

SEQ ID NO: 926597 - DNA, 25 bp, Mus musculus
ttatgtctggatatgggtgggcctc

SEQ ID NO: 926598 - DNA, 25 bp, Mus musculus
ttatgtctggatttgggtgggcctc

SEQ ID NO: 926599 - DNA, 25 bp, Mus musculus
ttatgtctgtaaagtttcctgggtc

SEQ ID NO: 926600 - DNA, 25 bp, Mus musculus
ttatgtctgtaatgtttcctgggtc

SEQ ID NO: 926601 - DNA, 25 bp, Mus musculus
ttatgtctgtacctcatgtgcatgc

SEQ ID NO: 926602 - DNA, 25 bp, Mus musculus
ttatgtctgtacgtcatgtgcatgc

SEQ ID NO: 926603 - DNA, 25 bp, Mus musculus
ttatgtctgtgcacaagattcccca

SEQ ID NO: 926604 - DNA, 25 bp, Mus musculus
ttatgtctgtgctcaagattcccca

SEQ ID NO: 926605 - DNA, 25 bp, Mus musculus
ttatgtcttcggagcttgcggcttc

SEQ ID NO: 926606 - DNA, 25 bp, Mus musculus
ttatgtcttcggtgcttgcggcttc

SEQ ID NO: 926607 - DNA, 25 bp, Mus musculus
ttatgtcttctaaccaatgtttttg

SEQ ID NO: 926608 - DNA, 25 bp, Mus musculus
ttatgtcttctatccaatgtttttg

SEQ ID NO: 926609 - DNA, 25 bp, Mus musculus
ttatgtcttgctcagggattaaacc

SEQ ID NO: 926610 - DNA, 25 bp, Mus musculus
ttatgtcttgctgagggattaaacc

SEQ ID NO: 926611 - DNA, 25 bp, Mus musculus
ttatgtgaaaggctgactagttgag

SEQ ID NO: 926612 - DNA, 25 bp, Mus musculus
ttatgtgaaagggtgactagttgag

SEQ ID NO: 926613 - DNA, 25 bp, Mus musculus
ttatgtgaaatactgcagatcctcc

SEQ ID NO: 926614 - DNA, 25 bp, Mus musculus
ttatgtgaaatagtgcagatcctcc

SEQ ID NO: 926615 - DNA, 25 bp, Mus musculus
ttatgtgaatcactcctttgcccct

SEQ ID NO: 926616 - DNA, 25 bp, Mus musculus
ttatgtgaatcagtcctttgcccct

SEQ ID NO: 926617 - DNA, 25 bp, Mus musculus
ttatgtgacatgctgctgcagttca

SEQ ID NO: 926618 - DNA, 25 bp, Mus musculus
ttatgtgacatggtgctgcagttca

SEQ ID NO: 926619 - DNA, 25 bp, Mus musculus
ttatgtgaccatcccctccacagat

SEQ ID NO: 926620 - DNA, 25 bp, Mus musculus
ttatgtgaccatgccctccacagat

SEQ ID NO: 926621 - DNA, 25 bp, Mus musculus
ttatgtgacgtaccaatcttggttg

SEQ ID NO: 926622 - DNA, 25 bp, Mus musculus
ttatgtgacgtagcaatcttggttg

SEQ ID NO: 926623 - DNA, 25 bp, Mus musculus
ttatgtgagcacactgacaatgcaa

SEQ ID NO: 926624 - DNA, 25 bp, Mus musculus
ttatgtgagcactctgacaatgcaa

SEQ ID NO: 926625 - DNA, 25 bp, Mus musculus
ttatgtgaggaccaccatcaacaag

SEQ ID NO: 926626 - DNA, 25 bp, Mus musculus
ttatgtgaggacgaccatcaacaag

SEQ ID NO: 926627 - DNA, 25 bp, Mus musculus
ttatgtgagtagaggcccgatcgcc

SEQ ID NO: 926628 - DNA, 25 bp, Mus musculus
ttatgtgagtagtggcccgatcgcc

SEQ ID NO: 926629 - DNA, 25 bp, Mus musculus
ttatgtgcacagagctgggcggact

SEQ ID NO: 926630 - DNA, 25 bp, Mus musculus
ttatgtgcacagatctttccactgc

SEQ ID NO: 926631 - DNA, 25 bp, Mus musculus
ttatgtgcacagtgctgggcggact

SEQ ID NO: 926632 - DNA, 25 bp, Mus musculus
ttatgtgcacagttctttccactgc

SEQ ID NO: 926633 - DNA, 25 bp, Mus musculus
ttatgtgccataatcagttagtcga

SEQ ID NO: 926634 - DNA, 25 bp, Mus musculus
ttatgtgccatattcagttagtcga

SEQ ID NO: 926635 - DNA, 25 bp, Mus musculus
ttatgtgccccgcaaagcaaaacga

SEQ ID NO: 926636 - DNA, 25 bp, Mus musculus
ttatgtgccccggaaagcaaaacga

SEQ ID NO: 926637 - DNA, 25 bp, Mus musculus
ttatgtgcccttagccttgatggta

SEQ ID NO: 926638 - DNA, 25 bp, Mus musculus
ttatgtgccctttgccttgatggta

SEQ ID NO: 926639 - DNA, 25 bp, Mus musculus
ttatgtgcctggacctgcctatggg

SEQ ID NO: 926640 - DNA, 25 bp, Mus musculus
ttatgtgcctggtcctgcctatggg

SEQ ID NO: 926641 - DNA, 25 bp, Mus musculus
ttatgtgctctcagaagtggtggac

SEQ ID NO: 926642 - DNA, 25 bp, Mus musculus
ttatgtgctctctgaagtggtggac

SEQ ID NO: 926643 - DNA, 25 bp, Mus musculus
ttatgtgctcttccaggttgtaagt

SEQ ID NO: 926644 - DNA, 25 bp, Mus musculus
ttatgtgctcttgcaggttgtaagt

SEQ ID NO: 926645 - DNA, 25 bp, Mus musculus
ttatgtgcttcccaggcaaatccac

SEQ ID NO: 926646 - DNA, 25 bp, Mus musculus
ttatgtgcttccgaggcaaatccac

SEQ ID NO: 926647 - DNA, 25 bp, Mus musculus
ttatgtggatgtaagaacgcgctgg

SEQ ID NO: 926648 - DNA, 25 bp, Mus musculus
ttatgtggatgttagaacgcgctgg

SEQ ID NO: 926649 - DNA, 25 bp, Mus musculus
ttatgtggcactcggcattttcttt

SEQ ID NO: 926650 - DNA, 25 bp, Mus musculus
ttatgtggcactgggcattttcttt

SEQ ID NO: 926651 - DNA, 25 bp, Mus musculus
ttatgtggcaggaatagcaccgttc

SEQ ID NO: 926652 - DNA, 25 bp, Mus musculus
ttatgtggcaggtatagcaccgttc

SEQ ID NO: 926653 - DNA, 25 bp, Mus musculus
ttatgtggcccaccttaaccttgaa

SEQ ID NO: 926654 - DNA, 25 bp, Mus musculus
ttatgtggcccagcttaaccttgaa

SEQ ID NO: 926655 - DNA, 25 bp, Mus musculus
ttatgtgggaggaggaatgactaaa

SEQ ID NO: 926656 - DNA, 25 bp, Mus musculus
ttatgtgggaggtggaatgactaaa

SEQ ID NO: 926657 - DNA, 25 bp, Mus musculus
ttatgtggtacgagtgtgtgcatgt

SEQ ID NO: 926658 - DNA, 25 bp, Mus musculus
ttatgtggtacgtgtgtgtgcatgt

SEQ ID NO: 926659 - DNA, 25 bp, Mus musculus
ttatgtggtaggctgaccaagcccc

SEQ ID NO: 926660 - DNA, 25 bp, Mus musculus
ttatgtggtagggtgaccaagcccc

SEQ ID NO: 926661 - DNA, 25 bp, Mus musculus
ttatgtggtgacacactccagttct

SEQ ID NO: 926662 - DNA, 25 bp, Mus musculus
ttatgtggtgactcactccagttct

SEQ ID NO: 926663 - DNA, 25 bp, Mus musculus
ttatgtggtgctagtggcgctttca

SEQ ID NO: 926664 - DNA, 25 bp, Mus musculus
ttatgtggtgcttgtggcgctttca

SEQ ID NO: 926665 - DNA, 25 bp, Mus musculus
ttatgtgtaaagaccagcctgccag

SEQ ID NO: 926666 - DNA, 25 bp, Mus musculus
ttatgtgtaaagtccagcctgccag

SEQ ID NO: 926667 - DNA, 25 bp, Mus musculus
ttatgtgtcatcatgggctgcttct

SEQ ID NO: 926668 - DNA, 25 bp, Mus musculus
ttatgtgtcatcttgggctgcttct

SEQ ID NO: 926669 - DNA, 25 bp, Mus musculus
ttatgtgtccctaacgtttggccct

SEQ ID NO: 926670 - DNA, 25 bp, Mus musculus
ttatgtgtcccttacgtttggccct

SEQ ID NO: 926671 - DNA, 25 bp, Mus musculus
ttatgtgtctgactgctgtacctgc

SEQ ID NO: 926672 - DNA, 25 bp, Mus musculus
ttatgtgtctgagtgctgtacctgc

SEQ ID NO: 926673 - DNA, 25 bp, Mus musculus
ttatgtgttctcatcttttgcagcc

SEQ ID NO: 926674 - DNA, 25 bp, Mus musculus
ttatgtgttctcttcttttgcagcc

SEQ ID NO: 926675 - DNA, 25 bp, Mus musculus
ttatgtgttcttatgattggtattc

SEQ ID NO: 926676 - DNA, 25 bp, Mus musculus
ttatgtgttcttttgattggtattc

SEQ ID NO: 926677 - DNA, 25 bp, Mus musculus
ttatgtgtttccactggctggagat

SEQ ID NO: 926678 - DNA, 25 bp, Mus musculus
ttatgtgtttcctctggctggagat

SEQ ID NO: 926679 - DNA, 25 bp, Mus musculus
ttatgtgtttttctaggaacctaag

SEQ ID NO: 926680 - DNA, 25 bp, Mus musculus
ttatgtgtttttgtaggaacctaag

SEQ ID NO: 926681 - DNA, 25 bp, Mus musculus
ttatgttaaaacagagcccctcttc

SEQ ID NO: 926682 - DNA, 25 bp, Mus musculus
ttatgttaaaactgagcccctcttc

SEQ ID NO: 926683 - DNA, 25 bp, Mus musculus
ttatgttacgaacgctgctgtcagc

SEQ ID NO: 926684 - DNA, 25 bp, Mus musculus
ttatgttacgaaggctgctgtcagc

SEQ ID NO: 926685 - DNA, 25 bp, Mus musculus
ttatgttactaaacatctgtgaaac

SEQ ID NO: 926686 - DNA, 25 bp, Mus musculus
ttatgttactaatcatctgtgaaac

SEQ ID NO: 926687 - DNA, 25 bp, Mus musculus
ttatgttactttatgctgctggctc

SEQ ID NO: 926688 - DNA, 25 bp, Mus musculus
ttatgttactttttgctgctggctc

SEQ ID NO: 926689 - DNA, 25 bp, Mus musculus
ttatgttatgttactttgccagcaa

SEQ ID NO: 926690 - DNA, 25 bp, Mus musculus
ttatgttatgtttctttgccagcaa

SEQ ID NO: 926691 - DNA, 25 bp, Mus musculus
ttatgttcacctcattcacagagtg

SEQ ID NO: 926692 - DNA, 25 bp, Mus musculus
ttatgttcacctgattcacagagtg

SEQ ID NO: 926693 - DNA, 25 bp, Mus musculus
ttatgttcactcctgccaactggct

SEQ ID NO: 926694 - DNA, 25 bp, Mus musculus
ttatgttcactcgtgccaactggct

SEQ ID NO: 926695 - DNA, 25 bp, Mus musculus
ttatgttcatgtaagaaacctcttt

SEQ ID NO: 926696 - DNA, 25 bp, Mus musculus
ttatgttcatgttagaaacctcttt

SEQ ID NO: 926697 - DNA, 25 bp, Mus musculus
ttatgttcccagcacagagcaaaac

SEQ ID NO: 926698 - DNA, 25 bp, Mus musculus
ttatgttcccaggacagagcaaaac

SEQ ID NO: 926699 - DNA, 25 bp, Mus musculus
ttatgttcccctccttaatagtcct

SEQ ID NO: 926700 - DNA, 25 bp, Mus musculus
ttatgttcccctgcttaatagtcct

SEQ ID NO: 926701 - DNA, 25 bp, Mus musculus
ttatgttcccttacttgcaactcaa

SEQ ID NO: 926702 - DNA, 25 bp, Mus musculus
ttatgttccctttcttgcaactcaa

SEQ ID NO: 926703 - DNA, 25 bp, Mus musculus
ttatgttcctgaccctaaagttgca

SEQ ID NO: 926704 - DNA, 25 bp, Mus musculus
ttatgttcctgagcctaaagttgca

SEQ ID NO: 926705 - DNA, 25 bp, Mus musculus
ttatgttcctgcaatgctcttgttc

SEQ ID NO: 926706 - DNA, 25 bp, Mus musculus
ttatgttcctgctatgctcttgttc

SEQ ID NO: 926707 - DNA, 25 bp, Mus musculus
ttatgttctactatatgggcctcga

SEQ ID NO: 926708 - DNA, 25 bp, Mus musculus
ttatgttctactttatgggcctcga

SEQ ID NO: 926709 - DNA, 25 bp, Mus musculus
ttatgttctagtactcccaggcaga

SEQ ID NO: 926710 - DNA, 25 bp, Mus musculus
ttatgttctagttctcccaggcaga

SEQ ID NO: 926711 - DNA, 25 bp, Mus musculus
ttatgttctgcccttgtagaccgca

SEQ ID NO: 926712 - DNA, 25 bp, Mus musculus
ttatgttctgccgttgtagaccgca

SEQ ID NO: 926713 - DNA, 25 bp, Mus musculus
ttatgttctgttattacctctgcaa

SEQ ID NO: 926714 - DNA, 25 bp, Mus musculus
ttatgttctgtttttacctctgcaa

SEQ ID NO: 926715 - DNA, 25 bp, Mus musculus
ttatgttcttggagcttacgcccct

SEQ ID NO: 926716 - DNA, 25 bp, Mus musculus
ttatgttcttggtgcttacgcccct

SEQ ID NO: 926717 - DNA, 25 bp, Mus musculus
ttatgttgagagatggtaccactgg

SEQ ID NO: 926718 - DNA, 25 bp, Mus musculus
ttatgttgagagttggtaccactgg

SEQ ID NO: 926719 - DNA, 25 bp, Mus musculus
ttatgttgctccactaagggctgga

SEQ ID NO: 926720 - DNA, 25 bp, Mus musculus
ttatgttgctcctctaagggctgga

SEQ ID NO: 926721 - DNA, 25 bp, Mus musculus
ttatgttgggcaaggtggacacacc

SEQ ID NO: 926722 - DNA, 25 bp, Mus musculus
ttatgttgggcatggtggacacacc

SEQ ID NO: 926723 - DNA, 25 bp, Mus musculus
ttatgttgtgccatcagtctaccag

SEQ ID NO: 926724 - DNA, 25 bp, Mus musculus
ttatgttgtgccttcagtctaccag

SEQ ID NO: 926725 - DNA, 25 bp, Mus musculus
ttatgtttaactcttcggacttcag

SEQ ID NO: 926726 - DNA, 25 bp, Mus musculus
ttatgtttaactgttcggacttcag

SEQ ID NO: 926727 - DNA, 25 bp, Mus musculus
ttatgtttagaactactggaccctt

SEQ ID NO: 926728 - DNA, 25 bp, Mus musculus
ttatgtttagaagtactggaccctt

SEQ ID NO: 926729 - DNA, 25 bp, Mus musculus
ttatgtttagtcacaggtctggccc

SEQ ID NO: 926730 - DNA, 25 bp, Mus musculus
ttatgtttagtctcaggtctggccc

SEQ ID NO: 926731 - DNA, 25 bp, Mus musculus
ttatgtttatatactgagacccttg

SEQ ID NO: 926732 - DNA, 25 bp, Mus musculus
ttatgtttatattctgagacccttg

SEQ ID NO: 926733 - DNA, 25 bp, Mus musculus
ttatgtttccacagctgacagtcag

SEQ ID NO: 926734 - DNA, 25 bp, Mus musculus
ttatgtttccactgctgacagtcag

SEQ ID NO: 926735 - DNA, 25 bp, Mus musculus
ttatgtttccatcagtttcacggca

SEQ ID NO: 926736 - DNA, 25 bp, Mus musculus
ttatgtttccatgagtttcacggca

SEQ ID NO: 926737 - DNA, 25 bp, Mus musculus
ttatgtttcccaatgttatgctcgc

SEQ ID NO: 926738 - DNA, 25 bp, Mus musculus
ttatgtttcccattgttatgctcgc

SEQ ID NO: 926739 - DNA, 25 bp, Mus musculus
ttatgtttctacacgggaacaaacg

SEQ ID NO: 926740 - DNA, 25 bp, Mus musculus
ttatgtttctactcgggaacaaacg

SEQ ID NO: 926741 - DNA, 25 bp, Mus musculus
ttatgtttctctacattgcgtcaca

SEQ ID NO: 926742 - DNA, 25 bp, Mus musculus
ttatgtttctcttcattgcgtcaca

SEQ ID NO: 926743 - DNA, 25 bp, Mus musculus
ttatgtttgcatagcctccacctga

SEQ ID NO: 926744 - DNA, 25 bp, Mus musculus
ttatgtttgcattgcctccacctga

SEQ ID NO: 926745 - DNA, 25 bp, Mus musculus
ttatgtttggatatccccacaactg

SEQ ID NO: 926746 - DNA, 25 bp, Mus musculus
ttatgtttggatttccccacaactg

SEQ ID NO: 926747 - DNA, 25 bp, Mus musculus
ttatgtttggttcgtgtctgtggca

SEQ ID NO: 926748 - DNA, 25 bp, Mus musculus
ttatgtttggttggtgtctgtggca

SEQ ID NO: 926749 - DNA, 25 bp, Mus musculus
ttatgttttaccagctttctcttct

SEQ ID NO: 926750 - DNA, 25 bp, Mus musculus
ttatgttttacctgctttctcttct

SEQ ID NO: 926751 - DNA, 25 bp, Mus musculus
ttatgtttttctcacttgttcaagt

SEQ ID NO: 926752 - DNA, 25 bp, Mus musculus
ttatgtttttctgacttgttcaagt

SEQ ID NO: 926753 - DNA, 25 bp, Mus musculus
ttatgttttttacgcctgaaggcaa

SEQ ID NO: 926754 - DNA, 25 bp, Mus musculus
ttatgttttttaggcctgaaggcaa

SEQ ID NO: 926755 - DNA, 25 bp, Mus musculus
ttattaaaaacacacttcgaagctg

SEQ ID NO: 926756 - DNA, 25 bp, Mus musculus
ttattaaaaacagacttcgaagctg

SEQ ID NO: 926757 - DNA, 25 bp, Mus musculus
ttattaaagacactgtcccttgctt

SEQ ID NO: 926758 - DNA, 25 bp, Mus musculus
ttattaaagacagtgtcccttgctt

SEQ ID NO: 926759 - DNA, 25 bp, Mus musculus
ttattaaagagcaacctgcagccct

SEQ ID NO: 926760 - DNA, 25 bp, Mus musculus
ttattaaagagctacctgcagccct

SEQ ID NO: 926761 - DNA, 25 bp, Mus musculus
ttattaaagcacaaccactcctgac

SEQ ID NO: 926762 - DNA, 25 bp, Mus musculus
ttattaaagcactaccactcctgac

SEQ ID NO: 926763 - DNA, 25 bp, Mus musculus
ttattaaaggccagactttctcctc

SEQ ID NO: 926764 - DNA, 25 bp, Mus musculus
ttattaaaggcctgactttctcctc

SEQ ID NO: 926765 - DNA, 25 bp, Mus musculus
ttattaaccattcttccagctgctt

SEQ ID NO: 926766 - DNA, 25 bp, Mus musculus
ttattaaccattgttccagctgctt

SEQ ID NO: 926767 - DNA, 25 bp, Mus musculus
ttattaacctctaacactgcctcat

SEQ ID NO: 926768 - DNA, 25 bp, Mus musculus
ttattaacctcttacactgcctcat

SEQ ID NO: 926769 - DNA, 25 bp, Mus musculus
ttattaagagctcgcttggctgcct

SEQ ID NO: 926770 - DNA, 25 bp, Mus musculus
ttattaagagctggcttggctgcct

SEQ ID NO: 926771 - DNA, 25 bp, Mus musculus
ttattaagatgactccagcccctgc

SEQ ID NO: 926772 - DNA, 25 bp, Mus musculus
ttattaagatgagtccagcccctgc

SEQ ID NO: 926773 - DNA, 25 bp, Mus musculus
ttattaagcgcactggtccatgact

SEQ ID NO: 926774 - DNA, 25 bp, Mus musculus
ttattaagcgcagtggtccatgact

SEQ ID NO: 926775 - DNA, 25 bp, Mus musculus
ttattaaggagccttccaagctggg

SEQ ID NO: 926776 - DNA, 25 bp, Mus musculus
ttattaaggagcgttccaagctggg

SEQ ID NO: 926777 - DNA, 25 bp, Mus musculus
ttattaaggctgacactcatcaagt

SEQ ID NO: 926778 - DNA, 25 bp, Mus musculus
ttattaaggctgtcactcatcaagt

SEQ ID NO: 926779 - DNA, 25 bp, Mus musculus
ttattaagtctaacaaagcaggcaa

SEQ ID NO: 926780 - DNA, 25 bp, Mus musculus
ttattaagtctatcaaagcaggcaa

SEQ ID NO: 926781 - DNA, 25 bp, Mus musculus
ttattaatccccacacggagtaatg

SEQ ID NO: 926782 - DNA, 25 bp, Mus musculus
ttattaatcccctcacggagtaatg

SEQ ID NO: 926783 - DNA, 25 bp, Mus musculus
ttattaatctttatcctttcatcag

SEQ ID NO: 926784 - DNA, 25 bp, Mus musculus
ttattaatctttttcctttcatcag

SEQ ID NO: 926785 - DNA, 25 bp, Mus musculus
ttattaatgatgcaggcttactaaa

SEQ ID NO: 926786 - DNA, 25 bp, Mus musculus
ttattaatgatggaggcttactaaa

SEQ ID NO: 926787 - DNA, 25 bp, Mus musculus
ttattaatgctaagggctggcccag

SEQ ID NO: 926788 - DNA, 25 bp, Mus musculus
ttattaatgctatgggctggcccag

SEQ ID NO: 926789 - DNA, 25 bp, Mus musculus
ttattaatgtaactgcaccaatgca

SEQ ID NO: 926790 - DNA, 25 bp, Mus musculus
ttattaatgtaagtgcaccaatgca

SEQ ID NO: 926791 - DNA, 25 bp, Mus musculus
ttattaatgtacattccctcctttg

SEQ ID NO: 926792 - DNA, 25 bp, Mus musculus
ttattaatgtactttccctcctttg

SEQ ID NO: 926793 - DNA, 25 bp, Mus musculus
ttattaattttcatgacttccctac

SEQ ID NO: 926794 - DNA, 25 bp, Mus musculus
ttattaattttcttgacttccctac

SEQ ID NO: 926795 - DNA, 25 bp, Mus musculus
ttattacaaagaaagcacatggtta

SEQ ID NO: 926796 - DNA, 25 bp, Mus musculus
ttattacaaagatagcacatggtta

SEQ ID NO: 926797 - DNA, 25 bp, Mus musculus
ttattacaacctagagctgccctgc

SEQ ID NO: 926798 - DNA, 25 bp, Mus musculus
ttattacaaccttgagctgccctgc

SEQ ID NO: 926799 - DNA, 25 bp, Mus musculus
ttattacaagtcactcattcccctt

SEQ ID NO: 926800 - DNA, 25 bp, Mus musculus
ttattacaagtctctcattcccctt

SEQ ID NO: 926801 - DNA, 25 bp, Mus musculus
ttattacatctaacaaggctgaagg

SEQ ID NO: 926802 - DNA, 25 bp, Mus musculus
ttattacatctatcaaggctgaagg

SEQ ID NO: 926803 - DNA, 25 bp, Mus musculus
ttattaccaccccaagcaagtagtc

SEQ ID NO: 926804 - DNA, 25 bp, Mus musculus
ttattaccacccgaagcaagtagtc

SEQ ID NO: 926805 - DNA, 25 bp, Mus musculus
ttattaccagacagccacgagaaga

SEQ ID NO: 926806 - DNA, 25 bp, Mus musculus
ttattaccagactgccacgagaaga

SEQ ID NO: 926807 - DNA, 25 bp, Mus musculus
ttattaccagatagctagtgcccag

SEQ ID NO: 926808 - DNA, 25 bp, Mus musculus
ttattaccagattgctagtgcccag

SEQ ID NO: 926809 - DNA, 25 bp, Mus musculus
ttattaccatgtaggacccttttat

SEQ ID NO: 926810 - DNA, 25 bp, Mus musculus
ttattaccatgttggacccttttat

SEQ ID NO: 926811 - DNA, 25 bp, Mus musculus
ttattaccgagtaatgcactttggg

SEQ ID NO: 926812 - DNA, 25 bp, Mus musculus
ttattaccgagttatgcactttggg

SEQ ID NO: 926813 - DNA, 25 bp, Mus musculus
ttattacctagcaaacactacagtt

SEQ ID NO: 926814 - DNA, 25 bp, Mus musculus
ttattacctagctaacactacagtt

SEQ ID NO: 926815 - DNA, 25 bp, Mus musculus
ttattacctgcaaatgactttggaa

SEQ ID NO: 926816 - DNA, 25 bp, Mus musculus
ttattacctgcatatgactttggaa

SEQ ID NO: 926817 - DNA, 25 bp, Mus musculus
ttattaccttggaaactgactcagc

SEQ ID NO: 926818 - DNA, 25 bp, Mus musculus
ttattaccttggtaactgactcagc

SEQ ID NO: 926819 - DNA, 25 bp, Mus musculus
ttattacggaatacatatgggattt

SEQ ID NO: 926820 - DNA, 25 bp, Mus musculus
ttattacggaattcatatgggattt

SEQ ID NO: 926821 - DNA, 25 bp, Mus musculus
ttattactaagaagccaggccttgc

SEQ ID NO: 926822 - DNA, 25 bp, Mus musculus
ttattactaagatgccaggccttgc

SEQ ID NO: 926823 - DNA, 25 bp, Mus musculus
ttattactcagccatcagaacttag

SEQ ID NO: 926824 - DNA, 25 bp, Mus musculus
ttattactcagcgatcagaacttag

SEQ ID NO: 926825 - DNA, 25 bp, Mus musculus
ttattactgccccagcagacgaact

SEQ ID NO: 926826 - DNA, 25 bp, Mus musculus
ttattactgcccgagcagacgaact

SEQ ID NO: 926827 - DNA, 25 bp, Mus musculus
ttattactgctcctactgcaatagc

SEQ ID NO: 926828 - DNA, 25 bp, Mus musculus
ttattactgctcgtactgcaatagc

SEQ ID NO: 926829 - DNA, 25 bp, Mus musculus
ttattactggaacatatccctctcc

SEQ ID NO: 926830 - DNA, 25 bp, Mus musculus
ttattactggaagatatccctctcc

SEQ ID NO: 926831 - DNA, 25 bp, Mus musculus
ttattacttgagatcattggtgcta

SEQ ID NO: 926832 - DNA, 25 bp, Mus musculus
ttattacttgagttcattggtgcta

SEQ ID NO: 926833 - DNA, 25 bp, Mus musculus
ttattacttgatctgctcctttcca

SEQ ID NO: 926834 - DNA, 25 bp, Mus musculus
ttattacttgatgtgctcctttcca

SEQ ID NO: 926835 - DNA, 25 bp, Mus musculus
ttattagaccttcttcttgctccag

SEQ ID NO: 926836 - DNA, 25 bp, Mus musculus
ttattagaccttgttcttgctccag

SEQ ID NO: 926837 - DNA, 25 bp, Mus musculus
ttattagcaatgagaactctttggg

SEQ ID NO: 926838 - DNA, 25 bp, Mus musculus
ttattagcaatgtgaactctttggg

SEQ ID NO: 926839 - DNA, 25 bp, Mus musculus
ttattagcagagcttctccgtgtgc

SEQ ID NO: 926840 - DNA, 25 bp, Mus musculus
ttattagcagaggttctccgtgtgc

SEQ ID NO: 926841 - DNA, 25 bp, Mus musculus
ttattagcccttactaccaaatcca

SEQ ID NO: 926842 - DNA, 25 bp, Mus musculus
ttattagccctttctaccaaatcca

SEQ ID NO: 926843 - DNA, 25 bp, Mus musculus
ttattagctcttcagttccccatca

SEQ ID NO: 926844 - DNA, 25 bp, Mus musculus
ttattagctcttgagttccccatca

SEQ ID NO: 926845 - DNA, 25 bp, Mus musculus
ttattagctgcacccgtggtacaga

SEQ ID NO: 926846 - DNA, 25 bp, Mus musculus
ttattagctgcagccgtggtacaga

SEQ ID NO: 926847 - DNA, 25 bp, Mus musculus
ttattagctgctaggtgccttccaa

SEQ ID NO: 926848 - DNA, 25 bp, Mus musculus
ttattagctgcttggtgccttccaa

SEQ ID NO: 926849 - DNA, 25 bp, Mus musculus
ttattagcttgtaaactgtttaagt

SEQ ID NO: 926850 - DNA, 25 bp, Mus musculus
ttattagcttgttaactgtttaagt

SEQ ID NO: 926851 - DNA, 25 bp, Mus musculus
ttattagctttgcttttgacttggt

SEQ ID NO: 926852 - DNA, 25 bp, Mus musculus
ttattagctttggttttgacttggt

SEQ ID NO: 926853 - DNA, 25 bp, Mus musculus
ttattaggatgtcccgtgcctttga

SEQ ID NO: 926854 - DNA, 25 bp, Mus musculus
ttattaggatgtgccgtgcctttga

SEQ ID NO: 926855 - DNA, 25 bp, Mus musculus
ttattagggcttccaagagagcaca

SEQ ID NO: 926856 - DNA, 25 bp, Mus musculus
ttattagggcttgcaagagagcaca

SEQ ID NO: 926857 - DNA, 25 bp, Mus musculus
ttattaggtaccagggatgccccag

SEQ ID NO: 926858 - DNA, 25 bp, Mus musculus
ttattaggtacctgggatgccccag

SEQ ID NO: 926859 - DNA, 25 bp, Mus musculus
ttattagtctctatcacactcagct

SEQ ID NO: 926860 - DNA, 25 bp, Mus musculus
ttattagtctctttcacactcagct

SEQ ID NO: 926861 - DNA, 25 bp, Mus musculus
ttattagtcttactgccactggcaa

SEQ ID NO: 926862 - DNA, 25 bp, Mus musculus
ttattagtcttagtgccactggcaa

SEQ ID NO: 926863 - DNA, 25 bp, Mus musculus
ttattagttttcaggaccttcacca

SEQ ID NO: 926864 - DNA, 25 bp, Mus musculus
ttattagttttctggaccttcacca

SEQ ID NO: 926865 - DNA, 25 bp, Mus musculus
ttattatacaatctccagcccttct

SEQ ID NO: 926866 - DNA, 25 bp, Mus musculus
ttattatacaatgtccagcccttct

SEQ ID NO: 926867 - DNA, 25 bp, Mus musculus
ttattatatcctattgtgatactca

SEQ ID NO: 926868 - DNA, 25 bp, Mus musculus
ttattatatccttttgtgatactca

SEQ ID NO: 926869 - DNA, 25 bp, Mus musculus
ttattatcacagacaacagtcctaa

SEQ ID NO: 926870 - DNA, 25 bp, Mus musculus
ttattatcacagtcaacagtcctaa

SEQ ID NO: 926871 - DNA, 25 bp, Mus musculus
ttattatcccctatgctaaccaccg

SEQ ID NO: 926872 - DNA, 25 bp, Mus musculus
ttattatcccctttgctaaccaccg

SEQ ID NO: 926873 - DNA, 25 bp, Mus musculus
ttattatctattaactggtcagtgt

SEQ ID NO: 926874 - DNA, 25 bp, Mus musculus
ttattatctatttactggtcagtgt

SEQ ID NO: 926875 - DNA, 25 bp, Mus musculus
ttattatcttctaacaacttcctcc

SEQ ID NO: 926876 - DNA, 25 bp, Mus musculus
ttattatcttcttacaacttcctcc

SEQ ID NO: 926877 - DNA, 25 bp, Mus musculus
ttattatgaactacccagaccaagg

SEQ ID NO: 926878 - DNA, 25 bp, Mus musculus
ttattatgaacttcccagaccaagg

SEQ ID NO: 926879 - DNA, 25 bp, Mus musculus
ttattatgagcccatgtcccagaca

SEQ ID NO: 926880 - DNA, 25 bp, Mus musculus
ttattatgagccgatgtcccagaca

SEQ ID NO: 926881 - DNA, 25 bp, Mus musculus
ttattatgatccacacgctgtactc

SEQ ID NO: 926882 - DNA, 25 bp, Mus musculus
ttattatgatcctcacgctgtactc

SEQ ID NO: 926883 - DNA, 25 bp, Mus musculus
ttattatgattaaccaccagctggg

SEQ ID NO: 926884 - DNA, 25 bp, Mus musculus
ttattatgattatccaccagctggg

SEQ ID NO: 926885 - DNA, 25 bp, Mus musculus
ttattatgcataagctctttgatat

SEQ ID NO: 926886 - DNA, 25 bp, Mus musculus
ttattatgcatatgctctttgatat

SEQ ID NO: 926887 - DNA, 25 bp, Mus musculus
ttattatggcttatcgttccgttgc

SEQ ID NO: 926888 - DNA, 25 bp, Mus musculus
ttattatggcttctgaactgctgga

SEQ ID NO: 926889 - DNA, 25 bp, Mus musculus
ttattatggcttgtgaactgctgga

SEQ ID NO: 926890 - DNA, 25 bp, Mus musculus
ttattatggcttttcgttccgttgc

SEQ ID NO: 926891 - DNA, 25 bp, Mus musculus
ttattatgggttatccaatgagtag

SEQ ID NO: 926892 - DNA, 25 bp, Mus musculus
ttattatgggttttccaatgagtag

SEQ ID NO: 926893 - DNA, 25 bp, Mus musculus
ttattatgttgtcaaggccagcctg

SEQ ID NO: 926894 - DNA, 25 bp, Mus musculus
ttattatgttgtgaaggccagcctg

SEQ ID NO: 926895 - DNA, 25 bp, Mus musculus
ttattattcctcattgccttctcaa

SEQ ID NO: 926896 - DNA, 25 bp, Mus musculus
ttattattcctctttgccttctcaa

SEQ ID NO: 926897 - DNA, 25 bp, Mus musculus
ttattattgcaaatcatggtgacag

SEQ ID NO: 926898 - DNA, 25 bp, Mus musculus
ttattattgcaattcatggtgacag

SEQ ID NO: 926899 - DNA, 25 bp, Mus musculus
ttattcaaagttacctccactggtc

SEQ ID NO: 926900 - DNA, 25 bp, Mus musculus
ttattcaaagttcaaagtgtccttt

SEQ ID NO: 926901 - DNA, 25 bp, Mus musculus
ttattcaaagttgaaagtgtccttt

SEQ ID NO: 926902 - DNA, 25 bp, Mus musculus
ttattcaaagtttcctccactggtc

SEQ ID NO: 926903 - DNA, 25 bp, Mus musculus
ttattcaaatgtatccaggaaccaa

SEQ ID NO: 926904 - DNA, 25 bp, Mus musculus
ttattcaaatgtttccaggaaccaa

SEQ ID NO: 926905 - DNA, 25 bp, Mus musculus
ttattcaagaagattccctcctcac

SEQ ID NO: 926906 - DNA, 25 bp, Mus musculus
ttattcaagaagtttccctcctcac

SEQ ID NO: 926907 - DNA, 25 bp, Mus musculus
ttattcaagtatatgctgagcaccc

SEQ ID NO: 926908 - DNA, 25 bp, Mus musculus
ttattcaagtatttgctgagcaccc

SEQ ID NO: 926909 - DNA, 25 bp, Mus musculus
ttattcacactaccctcttgacact

SEQ ID NO: 926910 - DNA, 25 bp, Mus musculus
ttattcacactagcctcttgacact

SEQ ID NO: 926911 - DNA, 25 bp, Mus musculus
ttattcacccatatcaaactaattt

SEQ ID NO: 926912 - DNA, 25 bp, Mus musculus
ttattcacccatttcaaactaattt

SEQ ID NO: 926913 - DNA, 25 bp, Mus musculus
ttattcaccctgataatcccacttc

SEQ ID NO: 926914 - DNA, 25 bp, Mus musculus
ttattcaccctgttaatcccacttc

SEQ ID NO: 926915 - DNA, 25 bp, Mus musculus
ttattcaccgcaatacacccataaa

SEQ ID NO: 926916 - DNA, 25 bp, Mus musculus
ttattcaccgcattacacccataaa

SEQ ID NO: 926917 - DNA, 25 bp, Mus musculus
ttattcactaagaagcacacacaca

SEQ ID NO: 926918 - DNA, 25 bp, Mus musculus
ttattcactaagtagcacacacaca

SEQ ID NO: 926919 - DNA, 25 bp, Mus musculus
ttattcactgctcgtaggcacgtgt

SEQ ID NO: 926920 - DNA, 25 bp, Mus musculus
ttattcactgctggtaggcacgtgt

SEQ ID NO: 926921 - DNA, 25 bp, Mus musculus
ttattcagagccctaatcccaattt

SEQ ID NO: 926922 - DNA, 25 bp, Mus musculus
ttattcagagccgtaatcccaattt

SEQ ID NO: 926923 - DNA, 25 bp, Mus musculus
ttattcagcagaacctcctcctgtg

SEQ ID NO: 926924 - DNA, 25 bp, Mus musculus
ttattcagcagatcctcctcctgtg

SEQ ID NO: 926925 - DNA, 25 bp, Mus musculus
ttattcagcagtaagcctctaagat

SEQ ID NO: 926926 - DNA, 25 bp, Mus musculus
ttattcagcagttagcctctaagat

SEQ ID NO: 926927 - DNA, 25 bp, Mus musculus
ttattcagccttcatttgtaactgt

SEQ ID NO: 926928 - DNA, 25 bp, Mus musculus
ttattcagccttgatttgtaactgt

SEQ ID NO: 926929 - DNA, 25 bp, Mus musculus
ttattcagtcaacgaggctctccct

SEQ ID NO: 926930 - DNA, 25 bp, Mus musculus
ttattcagtcaaggaggctctccct

SEQ ID NO: 926931 - DNA, 25 bp, Mus musculus
ttattcagtgtaatgcacttactag

SEQ ID NO: 926932 - DNA, 25 bp, Mus musculus
ttattcagtgtattgcacttactag

SEQ ID NO: 926933 - DNA, 25 bp, Mus musculus
ttattcagtgtcatagagtgccatt

SEQ ID NO: 926934 - DNA, 25 bp, Mus musculus
ttattcagtgtcttagagtgccatt

SEQ ID NO: 926935 - DNA, 25 bp, Mus musculus
ttattcagttatagctttctttaga

SEQ ID NO: 926936 - DNA, 25 bp, Mus musculus
ttattcagttattgctttctttaga

SEQ ID NO: 926937 - DNA, 25 bp, Mus musculus
ttattcatacatcttcttacactga

SEQ ID NO: 926938 - DNA, 25 bp, Mus musculus
ttattcatacatgttcttacactga

SEQ ID NO: 926939 - DNA, 25 bp, Mus musculus
ttattcatagtcactaccctttcca

SEQ ID NO: 926940 - DNA, 25 bp, Mus musculus
ttattcatagtctctaccctttcca

SEQ ID NO: 926941 - DNA, 25 bp, Mus musculus
ttattcatataaagcacaccgtggg

SEQ ID NO: 926942 - DNA, 25 bp, Mus musculus
ttattcatataatgcacaccgtggg

SEQ ID NO: 926943 - DNA, 25 bp, Mus musculus
ttattcatcaaaacacccctgtttt

SEQ ID NO: 926944 - DNA, 25 bp, Mus musculus
ttattcatcaaatcacccctgtttt

SEQ ID NO: 926945 - DNA, 25 bp, Mus musculus
ttattcatcctccatctcaaagaag

SEQ ID NO: 926946 - DNA, 25 bp, Mus musculus
ttattcatcctcgatctcaaagaag

SEQ ID NO: 926947 - DNA, 25 bp, Mus musculus
ttattcatgggaagacgagccatct

SEQ ID NO: 926948 - DNA, 25 bp, Mus musculus
ttattcatgggatgacgagccatct

SEQ ID NO: 926949 - DNA, 25 bp, Mus musculus
ttattcattagaaaacgatgtcttc

SEQ ID NO: 926950 - DNA, 25 bp, Mus musculus
ttattcattagataacgatgtcttc

SEQ ID NO: 926951 - DNA, 25 bp, Mus musculus
ttattcattatgacaagccaaggtc

SEQ ID NO: 926952 - DNA, 25 bp, Mus musculus
ttattcattatgtcaagccaaggtc

SEQ ID NO: 926953 - DNA, 25 bp, Mus musculus
ttattcattgttagtgggtgtgagg

SEQ ID NO: 926954 - DNA, 25 bp, Mus musculus
ttattcattgtttgtgggtgtgagg

SEQ ID NO: 926955 - DNA, 25 bp, Mus musculus
ttattcatttagaccctggtctggg

SEQ ID NO: 926956 - DNA, 25 bp, Mus musculus
ttattcatttagtccctggtctggg

SEQ ID NO: 926957 - DNA, 25 bp, Mus musculus
ttattcatttgcatgtctgtctgtc

SEQ ID NO: 926958 - DNA, 25 bp, Mus musculus
ttattcatttgcttgtctgtctgtc

SEQ ID NO: 926959 - DNA, 25 bp, Mus musculus
ttattcatttgtatgtcagcttact

SEQ ID NO: 926960 - DNA, 25 bp, Mus musculus
ttattcatttgtttgtcagcttact

SEQ ID NO: 926961 - DNA, 25 bp, Mus musculus
ttattccaacacaagcagggttttt

SEQ ID NO: 926962 - DNA, 25 bp, Mus musculus
ttattccaacactagcagggttttt

SEQ ID NO: 926963 - DNA, 25 bp, Mus musculus
ttattccacagtcagcctttcctgg

SEQ ID NO: 926964 - DNA, 25 bp, Mus musculus
ttattccacagtgagcctttcctgg

SEQ ID NO: 926965 - DNA, 25 bp, Mus musculus
ttattccacgttactcctgtacata

SEQ ID NO: 926966 - DNA, 25 bp, Mus musculus
ttattccacgtttctcctgtacata

SEQ ID NO: 926967 - DNA, 25 bp, Mus musculus
ttattccagcacaagggtgtcagag

SEQ ID NO: 926968 - DNA, 25 bp, Mus musculus
ttattccagcactagggtgtcagag

SEQ ID NO: 926969 - DNA, 25 bp, Mus musculus
ttattccatgacagcttgccctaag

SEQ ID NO: 926970 - DNA, 25 bp, Mus musculus
ttattccatgactgcttgccctaag

SEQ ID NO: 926971 - DNA, 25 bp, Mus musculus
ttattccatttaccagctgacgtct

SEQ ID NO: 926972 - DNA, 25 bp, Mus musculus
ttattccatttagcagctgacgtct

SEQ ID NO: 926973 - DNA, 25 bp, Mus musculus
ttattccatttgcaacttatcccca

SEQ ID NO: 926974 - DNA, 25 bp, Mus musculus
ttattccatttggaacttatcccca

SEQ ID NO: 926975 - DNA, 25 bp, Mus musculus
ttattcccaacacgcgagaggcaga

SEQ ID NO: 926976 - DNA, 25 bp, Mus musculus
ttattcccaacaggcgagaggcaga

SEQ ID NO: 926977 - DNA, 25 bp, Mus musculus
ttattcccagtgacctgtgaggtaa

SEQ ID NO: 926978 - DNA, 25 bp, Mus musculus
ttattcccagtgtcctgtgaggtaa

SEQ ID NO: 926979 - DNA, 25 bp, Mus musculus
ttattccccaagagccacagggttt

SEQ ID NO: 926980 - DNA, 25 bp, Mus musculus
ttattccccaagtgccacagggttt

SEQ ID NO: 926981 - DNA, 25 bp, Mus musculus
ttattccccaatcatgctgcttagt

SEQ ID NO: 926982 - DNA, 25 bp, Mus musculus
ttattccccaatgatgctgcttagt

SEQ ID NO: 926983 - DNA, 25 bp, Mus musculus
ttattcccctcacctgtggtgaggg

SEQ ID NO: 926984 - DNA, 25 bp, Mus musculus
ttattcccctcagctgtggtgaggg

SEQ ID NO: 926985 - DNA, 25 bp, Mus musculus
ttattccccttaaacatatcctgtg

SEQ ID NO: 926986 - DNA, 25 bp, Mus musculus
ttattccccttatacatatcctgtg

SEQ ID NO: 926987 - DNA, 25 bp, Mus musculus
ttattcccctttaggttgcagaggg

SEQ ID NO: 926988 - DNA, 25 bp, Mus musculus
ttattccccttttggttgcagaggg

SEQ ID NO: 926989 - DNA, 25 bp, Mus musculus
ttattcccgcatcacttagtggctt

SEQ ID NO: 926990 - DNA, 25 bp, Mus musculus
ttattcccgcatgacttagtggctt

SEQ ID NO: 926991 - DNA, 25 bp, Mus musculus
ttattccctaccataaaggaggcat

SEQ ID NO: 926992 - DNA, 25 bp, Mus musculus
ttattccctaccttaaaggaggcat

SEQ ID NO: 926993 - DNA, 25 bp, Mus musculus
ttattccctccacctttgaagtgta

SEQ ID NO: 926994 - DNA, 25 bp, Mus musculus
ttattccctccagctttgaagtgta

SEQ ID NO: 926995 - DNA, 25 bp, Mus musculus
ttattccctgctcaggttcaacttt

SEQ ID NO: 926996 - DNA, 25 bp, Mus musculus
ttattccctgctgaggttcaacttt

SEQ ID NO: 926997 - DNA, 25 bp, Mus musculus
ttattccctgggaaactcctgtgtg

SEQ ID NO: 926998 - DNA, 25 bp, Mus musculus
ttattccctgggtaactcctgtgtg

SEQ ID NO: 926999 - DNA, 25 bp, Mus musculus
ttattccgaattctgcatagcatgt

SEQ ID NO: 927000 - DNA, 25 bp, Mus musculus
ttattccgaattgtgcatagcatgt

SEQ ID NO: 927001 - DNA, 25 bp, Mus musculus
ttattccgcagacggacccctttat

SEQ ID NO: 927002 - DNA, 25 bp, Mus musculus
ttattccgcagagggacccctttat

SEQ ID NO: 927003 - DNA, 25 bp, Mus musculus
ttattccgcttcattaacaaacatg

SEQ ID NO: 927004 - DNA, 25 bp, Mus musculus
ttattccgcttctttaacaaacatg

SEQ ID NO: 927005 - DNA, 25 bp, Mus musculus
ttattcctaagacaaattcccttat

SEQ ID NO: 927006 - DNA, 25 bp, Mus musculus
ttattcctaagagaaattcccttat

SEQ ID NO: 927007 - DNA, 25 bp, Mus musculus
ttattcctagcaaagcagttacgag

SEQ ID NO: 927008 - DNA, 25 bp, Mus musculus
ttattcctagcatagcagttacgag

SEQ ID NO: 927009 - DNA, 25 bp, Mus musculus
ttattcctcatgcttattgttgttt

SEQ ID NO: 927010 - DNA, 25 bp, Mus musculus
ttattcctcatggttattgttgttt

SEQ ID NO: 927011 - DNA, 25 bp, Mus musculus
ttattcctcccgcttattaagtgat

SEQ ID NO: 927012 - DNA, 25 bp, Mus musculus
ttattcctcccggttattaagtgat

SEQ ID NO: 927013 - DNA, 25 bp, Mus musculus
ttattcctctggaaccctaagccaa

SEQ ID NO: 927014 - DNA, 25 bp, Mus musculus
ttattcctctggtaccctaagccaa

SEQ ID NO: 927015 - DNA, 25 bp, Mus musculus
ttattcctgccccggattcgttcct

SEQ ID NO: 927016 - DNA, 25 bp, Mus musculus
ttattcctgcccgggattcgttcct

SEQ ID NO: 927017 - DNA, 25 bp, Mus musculus
ttattcctgctaccaagggttcttc

SEQ ID NO: 927018 - DNA, 25 bp, Mus musculus
ttattcctgctagcaagggttcttc

SEQ ID NO: 927019 - DNA, 25 bp, Mus musculus
ttattcctggatagaggcctcactt

SEQ ID NO: 927020 - DNA, 25 bp, Mus musculus
ttattcctggattgaggcctcactt

SEQ ID NO: 927021 - DNA, 25 bp, Mus musculus
ttattcctgtgtccgctgcatctgc

SEQ ID NO: 927022 - DNA, 25 bp, Mus musculus
ttattcctgtgtgcgctgcatctgc

SEQ ID NO: 927023 - DNA, 25 bp, Mus musculus
ttattcctgttgatctaaattacca

SEQ ID NO: 927024 - DNA, 25 bp, Mus musculus
ttattcctgttgttctaaattacca

SEQ ID NO: 927025 - DNA, 25 bp, Mus musculus
ttattccttagtcggaaatgcacat

SEQ ID NO: 927026 - DNA, 25 bp, Mus musculus
ttattccttagtgggaaatgcacat

SEQ ID NO: 927027 - DNA, 25 bp, Mus musculus
ttattccttatgcttctgggctcac

SEQ ID NO: 927028 - DNA, 25 bp, Mus musculus
ttattccttatggttctgggctcac

SEQ ID NO: 927029 - DNA, 25 bp, Mus musculus
ttattccttcagagtctcaagcaag

SEQ ID NO: 927030 - DNA, 25 bp, Mus musculus
ttattccttcagtgtctcaagcaag

SEQ ID NO: 927031 - DNA, 25 bp, Mus musculus
ttattccttgatcttaccattctat

SEQ ID NO: 927032 - DNA, 25 bp, Mus musculus
ttattccttgatgttaccattctat

SEQ ID NO: 927033 - DNA, 25 bp, Mus musculus
ttattcctttccctactgtacacgg

SEQ ID NO: 927034 - DNA, 25 bp, Mus musculus
ttattcctttccgtactgtacacgg

SEQ ID NO: 927035 - DNA, 25 bp, Mus musculus
ttattcgagtggcttctacccaatg

SEQ ID NO: 927036 - DNA, 25 bp, Mus musculus
ttattcgagtgggttctacccaatg

SEQ ID NO: 927037 - DNA, 25 bp, Mus musculus
ttattcgatgccaggatacacgtgc

SEQ ID NO: 927038 - DNA, 25 bp, Mus musculus
ttattcgatgcctggatacacgtgc

SEQ ID NO: 927039 - DNA, 25 bp, Mus musculus
ttattcgcagacacctggatttctg

SEQ ID NO: 927040 - DNA, 25 bp, Mus musculus
ttattcgcagactcctggatttctg

SEQ ID NO: 927041 - DNA, 25 bp, Mus musculus
ttattcggagtcagtcaggctctat

SEQ ID NO: 927042 - DNA, 25 bp, Mus musculus
ttattcggagtctgtcaggctctat

SEQ ID NO: 927043 - DNA, 25 bp, Mus musculus
ttattcggtctgaaagaaccgtgat

SEQ ID NO: 927044 - DNA, 25 bp, Mus musculus
ttattcggtctgcattcccagtggg

SEQ ID NO: 927045 - DNA, 25 bp, Mus musculus
ttattcggtctggattcccagtggg

SEQ ID NO: 927046 - DNA, 25 bp, Mus musculus
ttattcggtctgtaagaaccgtgat

SEQ ID NO: 927047 - DNA, 25 bp, Mus musculus
ttattcggttctagctttggtgact

SEQ ID NO: 927048 - DNA, 25 bp, Mus musculus
ttattcggttcttgctttggtgact

SEQ ID NO: 927049 - DNA, 25 bp, Mus musculus
ttattcgtagaaatcagtagccagg

SEQ ID NO: 927050 - DNA, 25 bp, Mus musculus
ttattcgtagaattcagtagccagg

SEQ ID NO: 927051 - DNA, 25 bp, Mus musculus
ttattcgtttaaaatgttgatagct

SEQ ID NO: 927052 - DNA, 25 bp, Mus musculus
ttattcgtttaatatgttgatagct

SEQ ID NO: 927053 - DNA, 25 bp, Mus musculus
ttattctacaccaaagtcctgctat

SEQ ID NO: 927054 - DNA, 25 bp, Mus musculus
ttattctacacctaagtcctgctat

SEQ ID NO: 927055 - DNA, 25 bp, Mus musculus
ttattctagcagcaggttagcccct

SEQ ID NO: 927056 - DNA, 25 bp, Mus musculus
ttattctagcaggaggttagcccct

SEQ ID NO: 927057 - DNA, 25 bp, Mus musculus
ttattctagtggagttaaaggagct

SEQ ID NO: 927058 - DNA, 25 bp, Mus musculus
ttattctagtggtgttaaaggagct

SEQ ID NO: 927059 - DNA, 25 bp, Mus musculus
ttattctatataaatctttgtgatg

SEQ ID NO: 927060 - DNA, 25 bp, Mus musculus
ttattctatatatatctttgtgatg

SEQ ID NO: 927061 - DNA, 25 bp, Mus musculus
ttattctcacgcactgtatagtcac

SEQ ID NO: 927062 - DNA, 25 bp, Mus musculus
ttattctcacgctctgtatagtcac

SEQ ID NO: 927063 - DNA, 25 bp, Mus musculus
ttattctcaggtcaatcggtcaccc

SEQ ID NO: 927064 - DNA, 25 bp, Mus musculus
ttattctcaggtgaatcggtcaccc

SEQ ID NO: 927065 - DNA, 25 bp, Mus musculus
ttattctcagtcacagataagaggg

SEQ ID NO: 927066 - DNA, 25 bp, Mus musculus
ttattctcagtctcagataagaggg

SEQ ID NO: 927067 - DNA, 25 bp, Mus musculus
ttattctcagttatgccctcagctt

SEQ ID NO: 927068 - DNA, 25 bp, Mus musculus
ttattctcagttctttccccaagga

SEQ ID NO: 927069 - DNA, 25 bp, Mus musculus
ttattctcagttgtttccccaagga

SEQ ID NO: 927070 - DNA, 25 bp, Mus musculus
ttattctcagttttgccctcagctt

SEQ ID NO: 927071 - DNA, 25 bp, Mus musculus
ttattctcatctacacacaaatccc

SEQ ID NO: 927072 - DNA, 25 bp, Mus musculus
ttattctcatcttcacacaaatccc

SEQ ID NO: 927073 - DNA, 25 bp, Mus musculus
ttattctcccacacctgttgcctga

SEQ ID NO: 927074 - DNA, 25 bp, Mus musculus
ttattctcccacagtcaaattcagg

SEQ ID NO: 927075 - DNA, 25 bp, Mus musculus
ttattctcccactcctgttgcctga

SEQ ID NO: 927076 - DNA, 25 bp, Mus musculus
ttattctcccactgtcaaattcagg

SEQ ID NO: 927077 - DNA, 25 bp, Mus musculus
ttattctctacccatgccaaaagac

SEQ ID NO: 927078 - DNA, 25 bp, Mus musculus
ttattctctaccgatgccaaaagac

SEQ ID NO: 927079 - DNA, 25 bp, Mus musculus
ttattctctactcaagggcaccagg

SEQ ID NO: 927080 - DNA, 25 bp, Mus musculus
ttattctctactccttcggcgtggg

SEQ ID NO: 927081 - DNA, 25 bp, Mus musculus
ttattctctactgaagggcaccagg

SEQ ID NO: 927082 - DNA, 25 bp, Mus musculus
ttattctctactgcttcggcgtggg

SEQ ID NO: 927083 - DNA, 25 bp, Mus musculus
ttattctctcttatacttggctctt

SEQ ID NO: 927084 - DNA, 25 bp, Mus musculus
ttattctctcttttacttggctctt

SEQ ID NO: 927085 - DNA, 25 bp, Mus musculus
ttattctcttccagcagcacctggc

SEQ ID NO: 927086 - DNA, 25 bp, Mus musculus
ttattctcttcctgcagcacctggc

SEQ ID NO: 927087 - DNA, 25 bp, Mus musculus
ttattctgaaaccatctccctagag

SEQ ID NO: 927088 - DNA, 25 bp, Mus musculus
ttattctgaaacgatctccctagag

SEQ ID NO: 927089 - DNA, 25 bp, Mus musculus
ttattctgagaaaccctctctggaa

SEQ ID NO: 927090 - DNA, 25 bp, Mus musculus
ttattctgagaatccctctctggaa

SEQ ID NO: 927091 - DNA, 25 bp, Mus musculus
ttattctgccaaaaaagtgttttga

SEQ ID NO: 927092 - DNA, 25 bp, Mus musculus
ttattctgccaataaagtgttttga

SEQ ID NO: 927093 - DNA, 25 bp, Mus musculus
ttattctgcctaattctgtgttgtg

SEQ ID NO: 927094 - DNA, 25 bp, Mus musculus
ttattctgcctatttctgtgttgtg

SEQ ID NO: 927095 - DNA, 25 bp, Mus musculus
ttattctgctgactttgccccactg

SEQ ID NO: 927096 - DNA, 25 bp, Mus musculus
ttattctgctgagtttgccccactg

SEQ ID NO: 927097 - DNA, 25 bp, Mus musculus
ttattctggacgctggtgatcctgt

SEQ ID NO: 927098 - DNA, 25 bp, Mus musculus
ttattctggacggtggtgatcctgt

SEQ ID NO: 927099 - DNA, 25 bp, Mus musculus
ttattctggattccacctggtgtgt

SEQ ID NO: 927100 - DNA, 25 bp, Mus musculus
ttattctggattgcacctggtgtgt

SEQ ID NO: 927101 - DNA, 25 bp, Mus musculus
ttattctgggatctactattggtgc

SEQ ID NO: 927102 - DNA, 25 bp, Mus musculus
ttattctgggatgtactattggtgc

SEQ ID NO: 927103 - DNA, 25 bp, Mus musculus
ttattctgttctacctgtccagggt

SEQ ID NO: 927104 - DNA, 25 bp, Mus musculus
ttattctgttcttcctgtccagggt

SEQ ID NO: 927105 - DNA, 25 bp, Mus musculus
ttattcttaactcatgggccggttc

SEQ ID NO: 927106 - DNA, 25 bp, Mus musculus
ttattcttaactgatgggccggttc

SEQ ID NO: 927107 - DNA, 25 bp, Mus musculus
ttattcttaagtcctgcataatgga

SEQ ID NO: 927108 - DNA, 25 bp, Mus musculus
ttattcttaagtgctgcataatgga

SEQ ID NO: 927109 - DNA, 25 bp, Mus musculus
ttattcttagatattcaccccatta

SEQ ID NO: 927110 - DNA, 25 bp, Mus musculus
ttattcttagattttcaccccatta

SEQ ID NO: 927111 - DNA, 25 bp, Mus musculus
ttattcttcacacaaacctcatatg

SEQ ID NO: 927112 - DNA, 25 bp, Mus musculus
ttattcttcacagaaacctcatatg

SEQ ID NO: 927113 - DNA, 25 bp, Mus musculus
ttattcttccctatccttagaccag

SEQ ID NO: 927114 - DNA, 25 bp, Mus musculus
ttattcttccctttccttagaccag

SEQ ID NO: 927115 - DNA, 25 bp, Mus musculus
ttattcttcctaagccccgggctag

SEQ ID NO: 927116 - DNA, 25 bp, Mus musculus
ttattcttcctatgccccgggctag

SEQ ID NO: 927117 - DNA, 25 bp, Mus musculus
ttattcttgcccctctgctattatt

SEQ ID NO: 927118 - DNA, 25 bp, Mus musculus
ttattcttgcccgtctgctattatt

SEQ ID NO: 927119 - DNA, 25 bp, Mus musculus
ttattcttgcttaggtttctttcct

SEQ ID NO: 927120 - DNA, 25 bp, Mus musculus
ttattcttgctttggtttctttcct

SEQ ID NO: 927121 - DNA, 25 bp, Mus musculus
ttattcttggacagtactcttcgca

SEQ ID NO: 927122 - DNA, 25 bp, Mus musculus
ttattcttggactgtactcttcgca

SEQ ID NO: 927123 - DNA, 25 bp, Mus musculus
ttattcttgtttcggcttgttttgc

SEQ ID NO: 927124 - DNA, 25 bp, Mus musculus
ttattcttgtttgggcttgttttgc

SEQ ID NO: 927125 - DNA, 25 bp, Mus musculus
ttattctttgggaccagctgtccag

SEQ ID NO: 927126 - DNA, 25 bp, Mus musculus
ttattctttgggtccagctgtccag

SEQ ID NO: 927127 - DNA, 25 bp, Mus musculus
ttattgaaaggcatcgtgggcgctc

SEQ ID NO: 927128 - DNA, 25 bp, Mus musculus
ttattgaaaggcttcgtgggcgctc

SEQ ID NO: 927129 - DNA, 25 bp, Mus musculus
ttattgaagctgctgtgcattattc

SEQ ID NO: 927130 - DNA, 25 bp, Mus musculus
ttattgaagctggtgtgcattattc

SEQ ID NO: 927131 - DNA, 25 bp, Mus musculus
ttattgaatattagtctagctgccc

SEQ ID NO: 927132 - DNA, 25 bp, Mus musculus
ttattgaatatttgtctagctgccc

SEQ ID NO: 927133 - DNA, 25 bp, Mus musculus
ttattgacaaccatggtacctcacc

SEQ ID NO: 927134 - DNA, 25 bp, Mus musculus
ttattgacaaccttggtacctcacc

SEQ ID NO: 927135 - DNA, 25 bp, Mus musculus
ttattgacaagcaccgtgggctcaa

SEQ ID NO: 927136 - DNA, 25 bp, Mus musculus
ttattgacaagctccgtgggctcaa

SEQ ID NO: 927137 - DNA, 25 bp, Mus musculus
ttattgacacatctcacacttggta

SEQ ID NO: 927138 - DNA, 25 bp, Mus musculus
ttattgacacatgtcacacttggta

SEQ ID NO: 927139 - DNA, 25 bp, Mus musculus
ttattgacagatactacatccatac

SEQ ID NO: 927140 - DNA, 25 bp, Mus musculus
ttattgacagattctacatccatac

SEQ ID NO: 927141 - DNA, 25 bp, Mus musculus
ttattgacataacaggtgacctcag

SEQ ID NO: 927142 - DNA, 25 bp, Mus musculus
ttattgacataagaggtgacctcag

SEQ ID NO: 927143 - DNA, 25 bp, Mus musculus
ttattgaccaaacagaaacttacgt

SEQ ID NO: 927144 - DNA, 25 bp, Mus musculus
ttattgaccaaagagaaacttacgt

SEQ ID NO: 927145 - DNA, 25 bp, Mus musculus
ttattgacctctaaaaacttgtagt

SEQ ID NO: 927146 - DNA, 25 bp, Mus musculus
ttattgacctcttaaaacttgtagt

SEQ ID NO: 927147 - DNA, 25 bp, Mus musculus
ttattgacgcaaacaggcaggagct

SEQ ID NO: 927148 - DNA, 25 bp, Mus musculus
ttattgacgcaatcaggcaggagct

SEQ ID NO: 927149 - DNA, 25 bp, Mus musculus
ttattgagagccaggcaagtccctc

SEQ ID NO: 927150 - DNA, 25 bp, Mus musculus
ttattgagagcctggcaagtccctc

SEQ ID NO: 927151 - DNA, 25 bp, Mus musculus
ttattgagctgaatgtccctggcac

SEQ ID NO: 927152 - DNA, 25 bp, Mus musculus
ttattgagctgattgtccctggcac

SEQ ID NO: 927153 - DNA, 25 bp, Mus musculus
ttattgagctggatctggtgtccgt

SEQ ID NO: 927154 - DNA, 25 bp, Mus musculus
ttattgagctggttctggtgtccgt

SEQ ID NO: 927155 - DNA, 25 bp, Mus musculus
ttattgagtttgctggtccttgcct

SEQ ID NO: 927156 - DNA, 25 bp, Mus musculus
ttattgagtttggtggtccttgcct

SEQ ID NO: 927157 - DNA, 25 bp, Mus musculus
ttattgatactgatgtttatgttgt

SEQ ID NO: 927158 - DNA, 25 bp, Mus musculus
ttattgatactgttgtttatgttgt

SEQ ID NO: 927159 - DNA, 25 bp, Mus musculus
ttattgatcaatctctgcgggtggg

SEQ ID NO: 927160 - DNA, 25 bp, Mus musculus
ttattgatcaatgtctgcgggtggg

SEQ ID NO: 927161 - DNA, 25 bp, Mus musculus
ttattgatccatcttgcgctgccat

SEQ ID NO: 927162 - DNA, 25 bp, Mus musculus
ttattgatccatgttgcgctgccat

SEQ ID NO: 927163 - DNA, 25 bp, Mus musculus
ttattgatgaacctccgactagccc

SEQ ID NO: 927164 - DNA, 25 bp, Mus musculus
ttattgatgaacgtccgactagccc

SEQ ID NO: 927165 - DNA, 25 bp, Mus musculus
ttattgatgtgacgatgtgggcaga

SEQ ID NO: 927166 - DNA, 25 bp, Mus musculus
ttattgatgtgaggatgtgggcaga

SEQ ID NO: 927167 - DNA, 25 bp, Mus musculus
ttattgattacaacatgcccctcac

SEQ ID NO: 927168 - DNA, 25 bp, Mus musculus
ttattgattacatcatgcccctcac

SEQ ID NO: 927169 - DNA, 25 bp, Mus musculus
ttattgattggaccaagcccgggat

SEQ ID NO: 927170 - DNA, 25 bp, Mus musculus
ttattgattggagcaagcccgggat

SEQ ID NO: 927171 - DNA, 25 bp, Mus musculus
ttattgcaagtaagactgattcccc

SEQ ID NO: 927172 - DNA, 25 bp, Mus musculus
ttattgcaagtatgactgattcccc

SEQ ID NO: 927173 - DNA, 25 bp, Mus musculus
ttattgcagtctctggtcatggctg

SEQ ID NO: 927174 - DNA, 25 bp, Mus musculus
ttattgcagtctgtggtcatggctg

SEQ ID NO: 927175 - DNA, 25 bp, Mus musculus
ttattgcatgcaacacttccacgtg

SEQ ID NO: 927176 - DNA, 25 bp, Mus musculus
ttattgcatgcactgtgaccttggg

SEQ ID NO: 927177 - DNA, 25 bp, Mus musculus
ttattgcatgcagtgtgaccttggg

SEQ ID NO: 927178 - DNA, 25 bp, Mus musculus
ttattgcatgcatcacttccacgtg

SEQ ID NO: 927179 - DNA, 25 bp, Mus musculus
ttattgcatttcagccgttttacaa

SEQ ID NO: 927180 - DNA, 25 bp, Mus musculus
ttattgcatttctgccgttttacaa

SEQ ID NO: 927181 - DNA, 25 bp, Mus musculus
ttattgccaaatctatgcccatctg

SEQ ID NO: 927182 - DNA, 25 bp, Mus musculus
ttattgccaaatgtatgcccatctg

SEQ ID NO: 927183 - DNA, 25 bp, Mus musculus
ttattgccacaactacttgggcggc

SEQ ID NO: 927184 - DNA, 25 bp, Mus musculus
ttattgccacaagtacttgggcggc

SEQ ID NO: 927185 - DNA, 25 bp, Mus musculus
ttattgccactgacgtggcctcaag

SEQ ID NO: 927186 - DNA, 25 bp, Mus musculus
ttattgccactgtcgtggcctcaag

SEQ ID NO: 927187 - DNA, 25 bp, Mus musculus
ttattgccattcaactctctcaaac

SEQ ID NO: 927188 - DNA, 25 bp, Mus musculus
ttattgccattctactctctcaaac

SEQ ID NO: 927189 - DNA, 25 bp, Mus musculus
ttattgcccaatagtctgctgtagg

SEQ ID NO: 927190 - DNA, 25 bp, Mus musculus
ttattgcccaattgtctgctgtagg

SEQ ID NO: 927191 - DNA, 25 bp, Mus musculus
ttattgccccgaccaaatcaggagg

SEQ ID NO: 927192 - DNA, 25 bp, Mus musculus
ttattgccccgagcaaatcaggagg

SEQ ID NO: 927193 - DNA, 25 bp, Mus musculus
ttattgcctgcacatacattacatt

SEQ ID NO: 927194 - DNA, 25 bp, Mus musculus
ttattgcctgcagatacattacatt

SEQ ID NO: 927195 - DNA, 25 bp, Mus musculus
ttattgccttaccagaaatgttagt

SEQ ID NO: 927196 - DNA, 25 bp, Mus musculus
ttattgccttacgagaaatgttagt

SEQ ID NO: 927197 - DNA, 25 bp, Mus musculus
ttattgctcctacatttgttaacag

SEQ ID NO: 927198 - DNA, 25 bp, Mus musculus
ttattgctcctagatttgttaacag

SEQ ID NO: 927199 - DNA, 25 bp, Mus musculus
ttattgctgattcccacccaggact

SEQ ID NO: 927200 - DNA, 25 bp, Mus musculus
ttattgctgattgccacccaggact

SEQ ID NO: 927201 - DNA, 25 bp, Mus musculus
ttattgctgcgtatcatatttgatt

SEQ ID NO: 927202 - DNA, 25 bp, Mus musculus
ttattgctgcgtttcatatttgatt

SEQ ID NO: 927203 - DNA, 25 bp, Mus musculus
ttattgctgctaccgctgtgtaaga

SEQ ID NO: 927204 - DNA, 25 bp, Mus musculus
ttattgctgctagcgctgtgtaaga

SEQ ID NO: 927205 - DNA, 25 bp, Mus musculus
ttattgctggcaaggtacacatttt

SEQ ID NO: 927206 - DNA, 25 bp, Mus musculus
ttattgctggcatggtacacatttt

SEQ ID NO: 927207 - DNA, 25 bp, Mus musculus
ttattgctggtccttctctgggaca

SEQ ID NO: 927208 - DNA, 25 bp, Mus musculus
ttattgctggtcgttctctgggaca

SEQ ID NO: 927209 - DNA, 25 bp, Mus musculus
ttattgctggttaatgaccttaata

SEQ ID NO: 927210 - DNA, 25 bp, Mus musculus
ttattgctggtttatgaccttaata

SEQ ID NO: 927211 - DNA, 25 bp, Mus musculus
ttattgctttatctttcattgtgat

SEQ ID NO: 927212 - DNA, 25 bp, Mus musculus
ttattgctttatgtttcattgtgat

SEQ ID NO: 927213 - DNA, 25 bp, Mus musculus
ttattgcttttaactctcagcaacc

SEQ ID NO: 927214 - DNA, 25 bp, Mus musculus
ttattgcttttatctctcagcaacc

SEQ ID NO: 927215 - DNA, 25 bp, Mus musculus
ttattggaaattcattgtgcagtta

SEQ ID NO: 927216 - DNA, 25 bp, Mus musculus
ttattggaaattgattgtgcagtta

SEQ ID NO: 927217 - DNA, 25 bp, Mus musculus
ttattggaacatacttttgcttctc

SEQ ID NO: 927218 - DNA, 25 bp, Mus musculus
ttattggaacattcttttgcttctc

SEQ ID NO: 927219 - DNA, 25 bp, Mus musculus
ttattggaacccaactacacagctt

SEQ ID NO: 927220 - DNA, 25 bp, Mus musculus
ttattggaaccctactacacagctt

SEQ ID NO: 927221 - DNA, 25 bp, Mus musculus
ttattggactgtaccacttgggtga

SEQ ID NO: 927222 - DNA, 25 bp, Mus musculus
ttattggactgtctggactataccc

SEQ ID NO: 927223 - DNA, 25 bp, Mus musculus
ttattggactgtgtggactataccc

SEQ ID NO: 927224 - DNA, 25 bp, Mus musculus
ttattggactgttccacttgggtga

SEQ ID NO: 927225 - DNA, 25 bp, Mus musculus
ttattggagtcgagggcctcttcac

SEQ ID NO: 927226 - DNA, 25 bp, Mus musculus
ttattggagtcgtgggcctcttcac

SEQ ID NO: 927227 - DNA, 25 bp, Mus musculus
ttattggatcagaccatctgccagc

SEQ ID NO: 927228 - DNA, 25 bp, Mus musculus
ttattggatcagtccatctgccagc

SEQ ID NO: 927229 - DNA, 25 bp, Mus musculus
ttattggcaaccaggacctccagga

SEQ ID NO: 927230 - DNA, 25 bp, Mus musculus
ttattggcaacctggacctccagga

SEQ ID NO: 927231 - DNA, 25 bp, Mus musculus
ttattggccaatacaccctaccttg

SEQ ID NO: 927232 - DNA, 25 bp, Mus musculus
ttattggccaattcaccctaccttg

SEQ ID NO: 927233 - DNA, 25 bp, Mus musculus
ttattggctttaagcccagctacca

SEQ ID NO: 927234 - DNA, 25 bp, Mus musculus
ttattggctttatgcccagctacca

SEQ ID NO: 927235 - DNA, 25 bp, Mus musculus
ttattgggacaaccttagttatcag

SEQ ID NO: 927236 - DNA, 25 bp, Mus musculus
ttattgggacaagcttagttatcag

SEQ ID NO: 927237 - DNA, 25 bp, Mus musculus
ttattgggagatacgtggcagctgt

SEQ ID NO: 927238 - DNA, 25 bp, Mus musculus
ttattgggagattcgtggcagctgt

SEQ ID NO: 927239 - DNA, 25 bp, Mus musculus
ttattgggcattcctttgtcatggc

SEQ ID NO: 927240 - DNA, 25 bp, Mus musculus
ttattgggcattgctttgtcatggc

SEQ ID NO: 927241 - DNA, 25 bp, Mus musculus
ttattgggctatatctgtattttat

SEQ ID NO: 927242 - DNA, 25 bp, Mus musculus
ttattgggctatttctgtattttat

SEQ ID NO: 927243 - DNA, 25 bp, Mus musculus
ttattggtatgtacccctccttaca

SEQ ID NO: 927244 - DNA, 25 bp, Mus musculus
ttattggtatgttcccctccttaca

SEQ ID NO: 927245 - DNA, 25 bp, Mus musculus
ttattggtgatcagtgtaatttccc

SEQ ID NO: 927246 - DNA, 25 bp, Mus musculus
ttattggtgatctgtgtaatttccc

SEQ ID NO: 927247 - DNA, 25 bp, Mus musculus
ttattggtggagaagcttgcctgtg

SEQ ID NO: 927248 - DNA, 25 bp, Mus musculus
ttattggtggagtagcttgcctgtg

SEQ ID NO: 927249 - DNA, 25 bp, Mus musculus
ttattggttcctcttgcggagggct

SEQ ID NO: 927250 - DNA, 25 bp, Mus musculus
ttattggttcctgttgcggagggct

SEQ ID NO: 927251 - DNA, 25 bp, Mus musculus
ttattggtttgtagccacctggtac

SEQ ID NO: 927252 - DNA, 25 bp, Mus musculus
ttattggtttgttgccacctggtac

SEQ ID NO: 927253 - DNA, 25 bp, Mus musculus
ttattgtaaccaaagactcggagac

SEQ ID NO: 927254 - DNA, 25 bp, Mus musculus
ttattgtaaccatagactcggagac

SEQ ID NO: 927255 - DNA, 25 bp, Mus musculus
ttattgtaatccctcatctttccag

SEQ ID NO: 927256 - DNA, 25 bp, Mus musculus
ttattgtaatccgtcatctttccag

SEQ ID NO: 927257 - DNA, 25 bp, Mus musculus
ttattgtacaaaccatgtgagcctg

SEQ ID NO: 927258 - DNA, 25 bp, Mus musculus
ttattgtacaaagcatgtgagcctg

SEQ ID NO: 927259 - DNA, 25 bp, Mus musculus
ttattgtcacagatgggcagtccta

SEQ ID NO: 927260 - DNA, 25 bp, Mus musculus
ttattgtcacagttgggcagtccta

SEQ ID NO: 927261 - DNA, 25 bp, Mus musculus
ttattgtcaggtctgctgcatacat

SEQ ID NO: 927262 - DNA, 25 bp, Mus musculus
ttattgtcaggtgtgctgcatacat

SEQ ID NO: 927263 - DNA, 25 bp, Mus musculus
ttattgtcatttcgtgagaagttac

SEQ ID NO: 927264 - DNA, 25 bp, Mus musculus
ttattgtcatttggtgagaagttac

SEQ ID NO: 927265 - DNA, 25 bp, Mus musculus
ttattgtccaccagtcagcgagaag

SEQ ID NO: 927266 - DNA, 25 bp, Mus musculus
ttattgtccacctgtcagcgagaag

SEQ ID NO: 927267 - DNA, 25 bp, Mus musculus
ttattgtccagcatcaaaggccacc

SEQ ID NO: 927268 - DNA, 25 bp, Mus musculus
ttattgtccagcttcaaaggccacc

SEQ ID NO: 927269 - DNA, 25 bp, Mus musculus
ttattgtcccaccattcataaggaa

SEQ ID NO: 927270 - DNA, 25 bp, Mus musculus
ttattgtcccacgattcataaggaa

SEQ ID NO: 927271 - DNA, 25 bp, Mus musculus
ttattgtccgtcaggtaaaccttat

SEQ ID NO: 927272 - DNA, 25 bp, Mus musculus
ttattgtccgtctggtaaaccttat

SEQ ID NO: 927273 - DNA, 25 bp, Mus musculus
ttattgtcgagaatgggtcgtcttt

SEQ ID NO: 927274 - DNA, 25 bp, Mus musculus
ttattgtcgagattgggtcgtcttt

SEQ ID NO: 927275 - DNA, 25 bp, Mus musculus
ttattgtctgtgcttgcatatggca

SEQ ID NO: 927276 - DNA, 25 bp, Mus musculus
ttattgtctgtggttgcatatggca

SEQ ID NO: 927277 - DNA, 25 bp, Mus musculus
ttattgtgaacaccttactttgtgg

SEQ ID NO: 927278 - DNA, 25 bp, Mus musculus
ttattgtgaacagcttactttgtgg

SEQ ID NO: 927279 - DNA, 25 bp, Mus musculus
ttattgtgccttctcagtttgccaa

SEQ ID NO: 927280 - DNA, 25 bp, Mus musculus
ttattgtgccttgtcagtttgccaa

SEQ ID NO: 927281 - DNA, 25 bp, Mus musculus
ttattgtggcatccctgacaacctg

SEQ ID NO: 927282 - DNA, 25 bp, Mus musculus
ttattgtggcatgcctgacaacctg

SEQ ID NO: 927283 - DNA, 25 bp, Mus musculus
ttattgtggctcagattatgtacac

SEQ ID NO: 927284 - DNA, 25 bp, Mus musculus
ttattgtggctctgattatgtacac

SEQ ID NO: 927285 - DNA, 25 bp, Mus musculus
ttattgtgtctgagccccagtgcct

SEQ ID NO: 927286 - DNA, 25 bp, Mus musculus
ttattgtgtctgtgccccagtgcct

SEQ ID NO: 927287 - DNA, 25 bp, Mus musculus
ttattgtgtgtgacatgagccctgg

SEQ ID NO: 927288 - DNA, 25 bp, Mus musculus
ttattgtgtgtgtcatgagccctgg

SEQ ID NO: 927289 - DNA, 25 bp, Mus musculus
ttattgtgtttgacctgaaatgcca

SEQ ID NO: 927290 - DNA, 25 bp, Mus musculus
ttattgtgtttgtcctgaaatgcca

SEQ ID NO: 927291 - DNA, 25 bp, Mus musculus
ttattgttaacaaagggagctgggt

SEQ ID NO: 927292 - DNA, 25 bp, Mus musculus
ttattgttaacatagggagctgggt

SEQ ID NO: 927293 - DNA, 25 bp, Mus musculus
ttattgttacacatatctttatgac

SEQ ID NO: 927294 - DNA, 25 bp, Mus musculus
ttattgttacacttatctttatgac

SEQ ID NO: 927295 - DNA, 25 bp, Mus musculus
ttattgttatccagtcgttgtccta

SEQ ID NO: 927296 - DNA, 25 bp, Mus musculus
ttattgttatcctgtcgttgtccta

SEQ ID NO: 927297 - DNA, 25 bp, Mus musculus
ttattgttcaggacctaagagtgta

SEQ ID NO: 927298 - DNA, 25 bp, Mus musculus
ttattgttcaggtcctaagagtgta

SEQ ID NO: 927299 - DNA, 25 bp, Mus musculus
ttattgttcataaccttgatctgag

SEQ ID NO: 927300 - DNA, 25 bp, Mus musculus
ttattgttcatatccttgatctgag

SEQ ID NO: 927301 - DNA, 25 bp, Mus musculus
ttattgttccaaagctttagtgatg

SEQ ID NO: 927302 - DNA, 25 bp, Mus musculus
ttattgttccaatgctttagtgatg

SEQ ID NO: 927303 - DNA, 25 bp, Mus musculus
ttattgttccccaggctctaggaca

SEQ ID NO: 927304 - DNA, 25 bp, Mus musculus
ttattgttcccctggctctaggaca

SEQ ID NO: 927305 - DNA, 25 bp, Mus musculus
ttattgttggatatagacttcacca

SEQ ID NO: 927306 - DNA, 25 bp, Mus musculus
ttattgttggatttagacttcacca

SEQ ID NO: 927307 - DNA, 25 bp, Mus musculus
ttattgttggctaccacagccaacc

SEQ ID NO: 927308 - DNA, 25 bp, Mus musculus
ttattgttggcttccacagccaacc

SEQ ID NO: 927309 - DNA, 25 bp, Mus musculus
ttattgttgggtacttgtgctagac

SEQ ID NO: 927310 - DNA, 25 bp, Mus musculus
ttattgttgggttcttgtgctagac

SEQ ID NO: 927311 - DNA, 25 bp, Mus musculus
ttattgtttccccaacactcagctt

SEQ ID NO: 927312 - DNA, 25 bp, Mus musculus
ttattgtttcccgaacactcagctt

SEQ ID NO: 927313 - DNA, 25 bp, Mus musculus
ttattgtttcctcctttctccagaa

SEQ ID NO: 927314 - DNA, 25 bp, Mus musculus
ttattgtttcctgctttctccagaa

SEQ ID NO: 927315 - DNA, 25 bp, Mus musculus
ttattgtttctaagtacccctgctt

SEQ ID NO: 927316 - DNA, 25 bp, Mus musculus
ttattgtttctatgtacccctgctt

SEQ ID NO: 927317 - DNA, 25 bp, Mus musculus
ttattgtttttgcaactgccatgtg

SEQ ID NO: 927318 - DNA, 25 bp, Mus musculus
ttattgtttttggaactgccatgtg

SEQ ID NO: 927319 - DNA, 25 bp, Mus musculus
ttatttaaagttcatgccaggcatc

SEQ ID NO: 927320 - DNA, 25 bp, Mus musculus
ttatttaaagttgatgccaggcatc

SEQ ID NO: 927321 - DNA, 25 bp, Mus musculus
ttatttaacacacagcaatcccctt

SEQ ID NO: 927322 - DNA, 25 bp, Mus musculus
ttatttaacacagagcaatcccctt

SEQ ID NO: 927323 - DNA, 25 bp, Mus musculus
ttatttaacgctacctagtccccat

SEQ ID NO: 927324 - DNA, 25 bp, Mus musculus
ttatttaacgcttcctagtccccat

SEQ ID NO: 927325 - DNA, 25 bp, Mus musculus
ttatttaagtctccgtacctgctgc

SEQ ID NO: 927326 - DNA, 25 bp, Mus musculus
ttatttaagtctgcgtacctgctgc

SEQ ID NO: 927327 - DNA, 25 bp, Mus musculus
ttatttaataatcgcgacaggtctc

SEQ ID NO: 927328 - DNA, 25 bp, Mus musculus
ttatttaataatggcgacaggtctc

SEQ ID NO: 927329 - DNA, 25 bp, Mus musculus
ttatttaattttccacctttgtgtg

SEQ ID NO: 927330 - DNA, 25 bp, Mus musculus
ttatttaattttgcacctttgtgtg

SEQ ID NO: 927331 - DNA, 25 bp, Mus musculus
ttatttacatggaatctgcttccgg

SEQ ID NO: 927332 - DNA, 25 bp, Mus musculus
ttatttacatggtatctgcttccgg

SEQ ID NO: 927333 - DNA, 25 bp, Mus musculus
ttatttactcaaaggcatagatgtg

SEQ ID NO: 927334 - DNA, 25 bp, Mus musculus
ttatttactcaatggcatagatgtg

SEQ ID NO: 927335 - DNA, 25 bp, Mus musculus
ttatttacttcaatttgcctggaaa

SEQ ID NO: 927336 - DNA, 25 bp, Mus musculus
ttatttacttcattttgcctggaaa

SEQ ID NO: 927337 - DNA, 25 bp, Mus musculus
ttatttagacttctatttagaacgt

SEQ ID NO: 927338 - DNA, 25 bp, Mus musculus
ttatttagacttgtatttagaacgt

SEQ ID NO: 927339 - DNA, 25 bp, Mus musculus
ttatttagatagactcccacacacc

SEQ ID NO: 927340 - DNA, 25 bp, Mus musculus
ttatttagatagtctcccacacacc

SEQ ID NO: 927341 - DNA, 25 bp, Mus musculus
ttatttagcattaaggcaccaaagt

SEQ ID NO: 927342 - DNA, 25 bp, Mus musculus
ttatttagcatttaggcaccaaagt

SEQ ID NO: 927343 - DNA, 25 bp, Mus musculus
ttatttagccctcacaccaagcaag

SEQ ID NO: 927344 - DNA, 25 bp, Mus musculus
ttatttagccctgacaccaagcaag

SEQ ID NO: 927345 - DNA, 25 bp, Mus musculus
ttatttagctaccatcgcagacgcc

SEQ ID NO: 927346 - DNA, 25 bp, Mus musculus
ttatttagctacgatcgcagacgcc

SEQ ID NO: 927347 - DNA, 25 bp, Mus musculus
ttatttaggccccagcacactcaga

SEQ ID NO: 927348 - DNA, 25 bp, Mus musculus
ttatttaggcccgagcacactcaga

SEQ ID NO: 927349 - DNA, 25 bp, Mus musculus
ttatttaggtccagcagctacattt

SEQ ID NO: 927350 - DNA, 25 bp, Mus musculus
ttatttaggtcctgcagctacattt

SEQ ID NO: 927351 - DNA, 25 bp, Mus musculus
ttatttaggttcattcaagccaggg

SEQ ID NO: 927352 - DNA, 25 bp, Mus musculus
ttatttaggttctttcaagccaggg

SEQ ID NO: 927353 - DNA, 25 bp, Mus musculus
ttatttagtactctgtcctctctca

SEQ ID NO: 927354 - DNA, 25 bp, Mus musculus
ttatttagtactgtgtcctctctca

SEQ ID NO: 927355 - DNA, 25 bp, Mus musculus
ttatttagtatcatcctcagcttcc

SEQ ID NO: 927356 - DNA, 25 bp, Mus musculus
ttatttagtatcttcctcagcttcc

SEQ ID NO: 927357 - DNA, 25 bp, Mus musculus
ttatttagtcctagaatgtactagg

SEQ ID NO: 927358 - DNA, 25 bp, Mus musculus
ttatttagtccttgaatgtactagg

SEQ ID NO: 927359 - DNA, 25 bp, Mus musculus
ttatttataaataccacccaaagtg

SEQ ID NO: 927360 - DNA, 25 bp, Mus musculus
ttatttataaattccacccaaagtg

SEQ ID NO: 927361 - DNA, 25 bp, Mus musculus
ttatttataactaaccctggtggct

SEQ ID NO: 927362 - DNA, 25 bp, Mus musculus
ttatttataacttaccctggtggct

SEQ ID NO: 927363 - DNA, 25 bp, Mus musculus
ttatttatagtcaggtcccatttag

SEQ ID NO: 927364 - DNA, 25 bp, Mus musculus
ttatttatagtctggtcccatttag

SEQ ID NO: 927365 - DNA, 25 bp, Mus musculus
ttatttatcaccatgtgcccactta

SEQ ID NO: 927366 - DNA, 25 bp, Mus musculus
ttatttatcaccttgtgcccactta

SEQ ID NO: 927367 - DNA, 25 bp, Mus musculus
ttatttatccacagagtcattttcc

SEQ ID NO: 927368 - DNA, 25 bp, Mus musculus
ttatttatccactgagtcattttcc

SEQ ID NO: 927369 - DNA, 25 bp, Mus musculus
ttatttatccccctacattatgtat

SEQ ID NO: 927370 - DNA, 25 bp, Mus musculus
ttatttatccccgtacattatgtat

SEQ ID NO: 927371 - DNA, 25 bp, Mus musculus
ttatttatgcacatgtcttccctcc

SEQ ID NO: 927372 - DNA, 25 bp, Mus musculus
ttatttatgcacttgtcttccctcc

SEQ ID NO: 927373 - DNA, 25 bp, Mus musculus
ttatttatgtgaagagccctctctc

SEQ ID NO: 927374 - DNA, 25 bp, Mus musculus
ttatttatgtgatgagccctctctc

SEQ ID NO: 927375 - DNA, 25 bp, Mus musculus
ttatttattacccaggcttgcctac

SEQ ID NO: 927376 - DNA, 25 bp, Mus musculus
ttatttattaccgaggcttgcctac

SEQ ID NO: 927377 - DNA, 25 bp, Mus musculus
ttatttattcccaggtgatccgctc

SEQ ID NO: 927378 - DNA, 25 bp, Mus musculus
ttatttattccctggtgatccgctc

SEQ ID NO: 927379 - DNA, 25 bp, Mus musculus
ttatttattcgtcacccatgagccc

SEQ ID NO: 927380 - DNA, 25 bp, Mus musculus
ttatttattcgtgacccatgagccc

SEQ ID NO: 927381 - DNA, 25 bp, Mus musculus
ttatttattgcgactcatcgcccag

SEQ ID NO: 927382 - DNA, 25 bp, Mus musculus
ttatttattgcgtctcatcgcccag

SEQ ID NO: 927383 - DNA, 25 bp, Mus musculus
ttatttatttggcttgccttgaact

SEQ ID NO: 927384 - DNA, 25 bp, Mus musculus
ttatttatttgggttgccttgaact

SEQ ID NO: 927385 - DNA, 25 bp, Mus musculus
ttatttatttgtagctcctgcagca

SEQ ID NO: 927386 - DNA, 25 bp, Mus musculus
ttatttatttgttgctcctgcagca

SEQ ID NO: 927387 - DNA, 25 bp, Mus musculus
ttatttcaaatcagtgtgtccacat

SEQ ID NO: 927388 - DNA, 25 bp, Mus musculus
ttatttcaaatctgtgtgtccacat

SEQ ID NO: 927389 - DNA, 25 bp, Mus musculus
ttatttcaacacatcctacccttca

SEQ ID NO: 927390 - DNA, 25 bp, Mus musculus
ttatttcaacacttcctacccttca

SEQ ID NO: 927391 - DNA, 25 bp, Mus musculus
ttatttcacattcggttatgacctg

SEQ ID NO: 927392 - DNA, 25 bp, Mus musculus
ttatttcacattgggttatgacctg

SEQ ID NO: 927393 - DNA, 25 bp, Mus musculus
ttatttcacgcaagagtactctatc

SEQ ID NO: 927394 - DNA, 25 bp, Mus musculus
ttatttcacgcatgagtactctatc

SEQ ID NO: 927395 - DNA, 25 bp, Mus musculus
ttatttcactttatggtctcagcta

SEQ ID NO: 927396 - DNA, 25 bp, Mus musculus
ttatttcactttttggtctcagcta

SEQ ID NO: 927397 - DNA, 25 bp, Mus musculus
ttatttcagcatactagcagtttaa

SEQ ID NO: 927398 - DNA, 25 bp, Mus musculus
ttatttcagcattctagcagtttaa

SEQ ID NO: 927399 - DNA, 25 bp, Mus musculus
ttatttcagcttcacggaccagaga

SEQ ID NO: 927400 - DNA, 25 bp, Mus musculus
ttatttcagcttgacggaccagaga

SEQ ID NO: 927401 - DNA, 25 bp, Mus musculus
ttatttcagtgtaaggaccaatgta

SEQ ID NO: 927402 - DNA, 25 bp, Mus musculus
ttatttcagtgttaggaccaatgta

SEQ ID NO: 927403 - DNA, 25 bp, Mus musculus
ttatttcagttcagccaaggtcagt

SEQ ID NO: 927404 - DNA, 25 bp, Mus musculus
ttatttcagttctgccaaggtcagt

SEQ ID NO: 927405 - DNA, 25 bp, Mus musculus
ttatttcatcataaccttacgtgga

SEQ ID NO: 927406 - DNA, 25 bp, Mus musculus
ttatttcatcattaccttacgtgga

SEQ ID NO: 927407 - DNA, 25 bp, Mus musculus
ttatttcatcttactctttctctcc

SEQ ID NO: 927408 - DNA, 25 bp, Mus musculus
ttatttcatctttctctttctctcc

SEQ ID NO: 927409 - DNA, 25 bp, Mus musculus
ttatttcattgactctggcaggtat

SEQ ID NO: 927410 - DNA, 25 bp, Mus musculus
ttatttcattgagtctggcaggtat

SEQ ID NO: 927411 - DNA, 25 bp, Mus musculus
ttatttcattttatagattggcata

SEQ ID NO: 927412 - DNA, 25 bp, Mus musculus
ttatttcattttttagattggcata

SEQ ID NO: 927413 - DNA, 25 bp, Mus musculus
ttatttccacctacatagcatatgc

SEQ ID NO: 927414 - DNA, 25 bp, Mus musculus
ttatttccaccttcatagcatatgc

SEQ ID NO: 927415 - DNA, 25 bp, Mus musculus
ttatttccacttatggcatgttaaa

SEQ ID NO: 927416 - DNA, 25 bp, Mus musculus
ttatttccacttttggcatgttaaa

SEQ ID NO: 927417 - DNA, 25 bp, Mus musculus
ttatttccagcccaggcttttgctg

SEQ ID NO: 927418 - DNA, 25 bp, Mus musculus
ttatttccagcccttgtgagacagg

SEQ ID NO: 927419 - DNA, 25 bp, Mus musculus
ttatttccagccgaggcttttgctg

SEQ ID NO: 927420 - DNA, 25 bp, Mus musculus
ttatttccagccgttgtgagacagg

SEQ ID NO: 927421 - DNA, 25 bp, Mus musculus
ttatttccaggaaagctttctagct

SEQ ID NO: 927422 - DNA, 25 bp, Mus musculus
ttatttccaggatagctttctagct

SEQ ID NO: 927423 - DNA, 25 bp, Mus musculus
ttatttccaggcacttttgtcaagt

SEQ ID NO: 927424 - DNA, 25 bp, Mus musculus
ttatttccaggctcttttgtcaagt

SEQ ID NO: 927425 - DNA, 25 bp, Mus musculus
ttatttccccgaacctcaacttcat

SEQ ID NO: 927426 - DNA, 25 bp, Mus musculus
ttatttccccgatcctcaacttcat

SEQ ID NO: 927427 - DNA, 25 bp, Mus musculus
ttatttcccctcagtgaacgtaaca

SEQ ID NO: 927428 - DNA, 25 bp, Mus musculus
ttatttcccctctgtgaacgtaaca

SEQ ID NO: 927429 - DNA, 25 bp, Mus musculus
ttatttccccttaactgatttctgt

SEQ ID NO: 927430 - DNA, 25 bp, Mus musculus
ttatttcccctttactgatttctgt

SEQ ID NO: 927431 - DNA, 25 bp, Mus musculus
ttatttcccttcagttggaatttat

SEQ ID NO: 927432 - DNA, 25 bp, Mus musculus
ttatttcccttctgttggaatttat

SEQ ID NO: 927433 - DNA, 25 bp, Mus musculus
ttatttccgtatcagcatagctctt

SEQ ID NO: 927434 - DNA, 25 bp, Mus musculus
ttatttccgtatgagcatagctctt

SEQ ID NO: 927435 - DNA, 25 bp, Mus musculus
ttatttcctacaccatgattcttcg

SEQ ID NO: 927436 - DNA, 25 bp, Mus musculus
ttatttcctacagcatgattcttcg

SEQ ID NO: 927437 - DNA, 25 bp, Mus musculus
ttatttcctaccaggtccctataga

SEQ ID NO: 927438 - DNA, 25 bp, Mus musculus
ttatttcctacctggtccctataga

SEQ ID NO: 927439 - DNA, 25 bp, Mus musculus
ttatttcctccaagtgcctgagctt

SEQ ID NO: 927440 - DNA, 25 bp, Mus musculus
ttatttcctccatgtgcctgagctt

SEQ ID NO: 927441 - DNA, 25 bp, Mus musculus
ttatttcctctactctggtaacggg

SEQ ID NO: 927442 - DNA, 25 bp, Mus musculus
ttatttcctctagtctggtaacggg

SEQ ID NO: 927443 - DNA, 25 bp, Mus musculus
ttatttcctcttagtgggtgttata

SEQ ID NO: 927444 - DNA, 25 bp, Mus musculus
ttatttcctctttgtgggtgttata

SEQ ID NO: 927445 - DNA, 25 bp, Mus musculus
ttatttcctgatctctgccaatcca

SEQ ID NO: 927446 - DNA, 25 bp, Mus musculus
ttatttcctgatgtctgccaatcca

SEQ ID NO: 927447 - DNA, 25 bp, Mus musculus
ttatttcctggcatttgtctctctt

SEQ ID NO: 927448 - DNA, 25 bp, Mus musculus
ttatttcctggcttttgtctctctt

SEQ ID NO: 927449 - DNA, 25 bp, Mus musculus
ttatttcctgtaagtccaactgaca

SEQ ID NO: 927450 - DNA, 25 bp, Mus musculus
ttatttcctgtatgtccaactgaca

SEQ ID NO: 927451 - DNA, 25 bp, Mus musculus
ttatttccttgccttctaatgggtc

SEQ ID NO: 927452 - DNA, 25 bp, Mus musculus
ttatttccttgcgttctaatgggtc

SEQ ID NO: 927453 - DNA, 25 bp, Mus musculus
ttatttcgctttcgtgggacctatg

SEQ ID NO: 927454 - DNA, 25 bp, Mus musculus
ttatttcgctttcgttttcctgtat

SEQ ID NO: 927455 - DNA, 25 bp, Mus musculus
ttatttcgctttggtgggacctatg

SEQ ID NO: 927456 - DNA, 25 bp, Mus musculus
ttatttcgctttggttttcctgtat

SEQ ID NO: 927457 - DNA, 25 bp, Mus musculus
ttatttctaagaatagtacttcctt

SEQ ID NO: 927458 - DNA, 25 bp, Mus musculus
ttatttctaagattagtacttcctt

SEQ ID NO: 927459 - DNA, 25 bp, Mus musculus
ttatttctaaggaatttcccactga

SEQ ID NO: 927460 - DNA, 25 bp, Mus musculus
ttatttctaaggtatttcccactga

SEQ ID NO: 927461 - DNA, 25 bp, Mus musculus
ttatttctacacactaaccgatata

SEQ ID NO: 927462 - DNA, 25 bp, Mus musculus
ttatttctacacagaatttgtatct

SEQ ID NO: 927463 - DNA, 25 bp, Mus musculus
ttatttctacactctaaccgatata

SEQ ID NO: 927464 - DNA, 25 bp, Mus musculus
ttatttctacactgaatttgtatct

SEQ ID NO: 927465 - DNA, 25 bp, Mus musculus
ttatttctagtcagtgtgcaccaag

SEQ ID NO: 927466 - DNA, 25 bp, Mus musculus
ttatttctagtctgtgtgcaccaag

SEQ ID NO: 927467 - DNA, 25 bp, Mus musculus
ttatttctataaccccacttgagga

SEQ ID NO: 927468 - DNA, 25 bp, Mus musculus
ttatttctataagcccacttgagga

SEQ ID NO: 927469 - DNA, 25 bp, Mus musculus
ttatttctatacactcaggccctgt

SEQ ID NO: 927470 - DNA, 25 bp, Mus musculus
ttatttctatactctcaggccctgt

SEQ ID NO: 927471 - DNA, 25 bp, Mus musculus
ttatttctatctaccaatgggtttt

SEQ ID NO: 927472 - DNA, 25 bp, Mus musculus
ttatttctatcttccaatgggtttt

SEQ ID NO: 927473 - DNA, 25 bp, Mus musculus
ttatttctattcctggctggtggtc

SEQ ID NO: 927474 - DNA, 25 bp, Mus musculus
ttatttctattcgtggctggtggtc

SEQ ID NO: 927475 - DNA, 25 bp, Mus musculus
ttatttctatttctgcgatgccttg

SEQ ID NO: 927476 - DNA, 25 bp, Mus musculus
ttatttctatttgtgcgatgccttg

SEQ ID NO: 927477 - DNA, 25 bp, Mus musculus
ttatttctcaggatgtggatccaaa

SEQ ID NO: 927478 - DNA, 25 bp, Mus musculus
ttatttctcaggttgtggatccaaa

SEQ ID NO: 927479 - DNA, 25 bp, Mus musculus
ttatttctcctgctttggccaggtg

SEQ ID NO: 927480 - DNA, 25 bp, Mus musculus
ttatttctcctggtttggccaggtg

SEQ ID NO: 927481 - DNA, 25 bp, Mus musculus
ttatttctctagcataaggcccatc

SEQ ID NO: 927482 - DNA, 25 bp, Mus musculus
ttatttctctaggataaggcccatc

SEQ ID NO: 927483 - DNA, 25 bp, Mus musculus
ttatttctctctattggtgaccaag

SEQ ID NO: 927484 - DNA, 25 bp, Mus musculus
ttatttctctctcccatgcaaatta

SEQ ID NO: 927485 - DNA, 25 bp, Mus musculus
ttatttctctctgccatgcaaatta

SEQ ID NO: 927486 - DNA, 25 bp, Mus musculus
ttatttctctcttttggtgaccaag

SEQ ID NO: 927487 - DNA, 25 bp, Mus musculus
ttatttctgagcactgggctctttt

SEQ ID NO: 927488 - DNA, 25 bp, Mus musculus
ttatttctgagctctgggctctttt

SEQ ID NO: 927489 - DNA, 25 bp, Mus musculus
ttatttctgatacctacagcactgt

SEQ ID NO: 927490 - DNA, 25 bp, Mus musculus
ttatttctgatagctacagcactgt

SEQ ID NO: 927491 - DNA, 25 bp, Mus musculus
ttatttctgatcaccctggactcag

SEQ ID NO: 927492 - DNA, 25 bp, Mus musculus
ttatttctgatcatttaatattggt

SEQ ID NO: 927493 - DNA, 25 bp, Mus musculus
ttatttctgatctccctggactcag

SEQ ID NO: 927494 - DNA, 25 bp, Mus musculus
ttatttctgatcttttaatattggt

SEQ ID NO: 927495 - DNA, 25 bp, Mus musculus
ttatttctgcatatgtccttccata

SEQ ID NO: 927496 - DNA, 25 bp, Mus musculus
ttatttctgcatttgtccttccata

SEQ ID NO: 927497 - DNA, 25 bp, Mus musculus
ttatttctgcttactcgcttgtgga

SEQ ID NO: 927498 - DNA, 25 bp, Mus musculus
ttatttctgctttctcgcttgtgga

SEQ ID NO: 927499 - DNA, 25 bp, Mus musculus
ttatttctgtacattccccctgtga

SEQ ID NO: 927500 - DNA, 25 bp, Mus musculus
ttatttctgtactttccccctgtga

SEQ ID NO: 927501 - DNA, 25 bp, Mus musculus
ttatttctgtatagccttgggttat

SEQ ID NO: 927502 - DNA, 25 bp, Mus musculus
ttatttctgtattgccttgggttat

SEQ ID NO: 927503 - DNA, 25 bp, Mus musculus
ttatttctgtgacgtatggaaccca

SEQ ID NO: 927504 - DNA, 25 bp, Mus musculus
ttatttctgtgaggtatggaaccca

SEQ ID NO: 927505 - DNA, 25 bp, Mus musculus
ttatttcttaatcggattctgtaac

SEQ ID NO: 927506 - DNA, 25 bp, Mus musculus
ttatttcttaatgggattctgtaac

SEQ ID NO: 927507 - DNA, 25 bp, Mus musculus
ttatttcttcacacatgcatgtgca

SEQ ID NO: 927508 - DNA, 25 bp, Mus musculus
ttatttcttcactcatgcatgtgca

SEQ ID NO: 927509 - DNA, 25 bp, Mus musculus
ttatttcttcatcgctatgctcaag

SEQ ID NO: 927510 - DNA, 25 bp, Mus musculus
ttatttcttcatggctatgctcaag

SEQ ID NO: 927511 - DNA, 25 bp, Mus musculus
ttatttcttcggatcatttgcttgg

SEQ ID NO: 927512 - DNA, 25 bp, Mus musculus
ttatttcttcggttcatttgcttgg

SEQ ID NO: 927513 - DNA, 25 bp, Mus musculus
ttatttcttctgcatcctaacccac

SEQ ID NO: 927514 - DNA, 25 bp, Mus musculus
ttatttcttctggatcctaacccac

SEQ ID NO: 927515 - DNA, 25 bp, Mus musculus
ttatttcttgaacttaacccctctg

SEQ ID NO: 927516 - DNA, 25 bp, Mus musculus
ttatttcttgaagttaacccctctg

SEQ ID NO: 927517 - DNA, 25 bp, Mus musculus
ttatttcttgttacagttttccctg

SEQ ID NO: 927518 - DNA, 25 bp, Mus musculus
ttatttcttgtttcagttttccctg

SEQ ID NO: 927519 - DNA, 25 bp, Mus musculus
ttatttctttgcagtaagtgttact

SEQ ID NO: 927520 - DNA, 25 bp, Mus musculus
ttatttctttgctgtaagtgttact

SEQ ID NO: 927521 - DNA, 25 bp, Mus musculus
ttatttgaagcacaaggccctcctt

SEQ ID NO: 927522 - DNA, 25 bp, Mus musculus
ttatttgaagcagaaggccctcctt

SEQ ID NO: 927523 - DNA, 25 bp, Mus musculus
ttatttgaatttactcttccgtgtg

SEQ ID NO: 927524 - DNA, 25 bp, Mus musculus
ttatttgaattttctcttccgtgtg

SEQ ID NO: 927525 - DNA, 25 bp, Mus musculus
ttatttgacaagatagcctctatga

SEQ ID NO: 927526 - DNA, 25 bp, Mus musculus
ttatttgacaagttagcctctatga

SEQ ID NO: 927527 - DNA, 25 bp, Mus musculus
ttatttgactgacagcagaggctca

SEQ ID NO: 927528 - DNA, 25 bp, Mus musculus
ttatttgactgagagcagaggctca

SEQ ID NO: 927529 - DNA, 25 bp, Mus musculus
ttatttgatgccagctattccagcc

SEQ ID NO: 927530 - DNA, 25 bp, Mus musculus
ttatttgatgcctgctattccagcc

SEQ ID NO: 927531 - DNA, 25 bp, Mus musculus
ttatttgattggagctgtttaggaa

SEQ ID NO: 927532 - DNA, 25 bp, Mus musculus
ttatttgattggtgctgtttaggaa

SEQ ID NO: 927533 - DNA, 25 bp, Mus musculus
ttatttgcaataaagatcctatagc

SEQ ID NO: 927534 - DNA, 25 bp, Mus musculus
ttatttgcaatatagatcctatagc

SEQ ID NO: 927535 - DNA, 25 bp, Mus musculus
ttatttgcacataggagtgaactgg

SEQ ID NO: 927536 - DNA, 25 bp, Mus musculus
ttatttgcacattggagtgaactgg

SEQ ID NO: 927537 - DNA, 25 bp, Mus musculus
ttatttgcaccgaatacctacacgc

SEQ ID NO: 927538 - DNA, 25 bp, Mus musculus
ttatttgcaccgtatacctacacgc

SEQ ID NO: 927539 - DNA, 25 bp, Mus musculus
ttatttgcccatccattctttcgtt

SEQ ID NO: 927540 - DNA, 25 bp, Mus musculus
ttatttgcccatgcattctttcgtt

SEQ ID NO: 927541 - DNA, 25 bp, Mus musculus
ttatttgccccaaagataccccatg

SEQ ID NO: 927542 - DNA, 25 bp, Mus musculus
ttatttgccccatagataccccatg

SEQ ID NO: 927543 - DNA, 25 bp, Mus musculus
ttatttgccctgacctgtagtatct

SEQ ID NO: 927544 - DNA, 25 bp, Mus musculus
ttatttgccctgtcctgtagtatct

SEQ ID NO: 927545 - DNA, 25 bp, Mus musculus
ttatttgcgattacaacccttctcc

SEQ ID NO: 927546 - DNA, 25 bp, Mus musculus
ttatttgcgatttcaacccttctcc

SEQ ID NO: 927547 - DNA, 25 bp, Mus musculus
ttatttgcggttactgtgctttgct

SEQ ID NO: 927548 - DNA, 25 bp, Mus musculus
ttatttgcggtttctgtgctttgct

SEQ ID NO: 927549 - DNA, 25 bp, Mus musculus
ttatttgctccactgttaatgtcga

SEQ ID NO: 927550 - DNA, 25 bp, Mus musculus
ttatttgctccagtgttaatgtcga

SEQ ID NO: 927551 - DNA, 25 bp, Mus musculus
ttatttgctctaagactctgtctgc

SEQ ID NO: 927552 - DNA, 25 bp, Mus musculus
ttatttgctctatgactctgtctgc

SEQ ID NO: 927553 - DNA, 25 bp, Mus musculus
ttatttgcttctcagttcttgtttt

SEQ ID NO: 927554 - DNA, 25 bp, Mus musculus
ttatttgcttctgagttcttgtttt

SEQ ID NO: 927555 - DNA, 25 bp, Mus musculus
ttatttggaccaatgactcatcatg

SEQ ID NO: 927556 - DNA, 25 bp, Mus musculus
ttatttggaccattgactcatcatg

SEQ ID NO: 927557 - DNA, 25 bp, Mus musculus
ttatttggagccagggtgtcactca

SEQ ID NO: 927558 - DNA, 25 bp, Mus musculus
ttatttggagcctgggtgtcactca

SEQ ID NO: 927559 - DNA, 25 bp, Mus musculus
ttatttggagtgcttttgttcttgt

SEQ ID NO: 927560 - DNA, 25 bp, Mus musculus
ttatttggagtggttttgttcttgt

SEQ ID NO: 927561 - DNA, 25 bp, Mus musculus
ttatttggcagcaactcctggtggg

SEQ ID NO: 927562 - DNA, 25 bp, Mus musculus
ttatttggcagctactcctggtggg

SEQ ID NO: 927563 - DNA, 25 bp, Mus musculus
ttatttggccagattctcctcctta

SEQ ID NO: 927564 - DNA, 25 bp, Mus musculus
ttatttggccagtttctcctcctta

SEQ ID NO: 927565 - DNA, 25 bp, Mus musculus
ttatttggcgtcaccagagctgtcc

SEQ ID NO: 927566 - DNA, 25 bp, Mus musculus
ttatttggcgtctccagagctgtcc

SEQ ID NO: 927567 - DNA, 25 bp, Mus musculus
ttatttggctccactggtatactct

SEQ ID NO: 927568 - DNA, 25 bp, Mus musculus
ttatttggctcctctggtatactct

SEQ ID NO: 927569 - DNA, 25 bp, Mus musculus
ttatttggcttccaagtcccacaaa

SEQ ID NO: 927570 - DNA, 25 bp, Mus musculus
ttatttggcttcgaagtcccacaaa

SEQ ID NO: 927571 - DNA, 25 bp, Mus musculus
ttatttgggataacactcggtccag

SEQ ID NO: 927572 - DNA, 25 bp, Mus musculus
ttatttgggatatcactcggtccag

SEQ ID NO: 927573 - DNA, 25 bp, Mus musculus
ttatttgggtcccagatggagccca

SEQ ID NO: 927574 - DNA, 25 bp, Mus musculus
ttatttgggtccgagatggagccca

SEQ ID NO: 927575 - DNA, 25 bp, Mus musculus
ttatttgtaaatccagctcttcata

SEQ ID NO: 927576 - DNA, 25 bp, Mus musculus
ttatttgtaaatgcagctcttcata

SEQ ID NO: 927577 - DNA, 25 bp, Mus musculus
ttatttgtaatgcttttctctttcc

SEQ ID NO: 927578 - DNA, 25 bp, Mus musculus
ttatttgtaatggttttctctttcc

SEQ ID NO: 927579 - DNA, 25 bp, Mus musculus
ttatttgtcatacctatttaggtgt

SEQ ID NO: 927580 - DNA, 25 bp, Mus musculus
ttatttgtcatagctatttaggtgt

SEQ ID NO: 927581 - DNA, 25 bp, Mus musculus
ttatttgtcggcattacagctgcag

SEQ ID NO: 927582 - DNA, 25 bp, Mus musculus
ttatttgtcggctttacagctgcag

SEQ ID NO: 927583 - DNA, 25 bp, Mus musculus
ttatttgtgaatattggtagtctga

SEQ ID NO: 927584 - DNA, 25 bp, Mus musculus
ttatttgtgaattttggtagtctga

SEQ ID NO: 927585 - DNA, 25 bp, Mus musculus
ttatttgtgttcaattcatcctgga

SEQ ID NO: 927586 - DNA, 25 bp, Mus musculus
ttatttgtgttctattcatcctgga

SEQ ID NO: 927587 - DNA, 25 bp, Mus musculus
ttatttgtgtttctgtgccctgagt

SEQ ID NO: 927588 - DNA, 25 bp, Mus musculus
ttatttgtgtttgtgtgccctgagt

SEQ ID NO: 927589 - DNA, 25 bp, Mus musculus
ttatttgttaggcatgactcatgga

SEQ ID NO: 927590 - DNA, 25 bp, Mus musculus
ttatttgttagggatgactcatgga

SEQ ID NO: 927591 - DNA, 25 bp, Mus musculus
ttatttgttccaatgactgtaaaat

SEQ ID NO: 927592 - DNA, 25 bp, Mus musculus
ttatttgttccattgactgtaaaat

SEQ ID NO: 927593 - DNA, 25 bp, Mus musculus
ttatttgttctacctatgccacact

SEQ ID NO: 927594 - DNA, 25 bp, Mus musculus
ttatttgttctagctatgccacact

SEQ ID NO: 927595 - DNA, 25 bp, Mus musculus
ttatttgttgtaatgggacagtttc

SEQ ID NO: 927596 - DNA, 25 bp, Mus musculus
ttatttgttgtattgggacagtttc

SEQ ID NO: 927597 - DNA, 25 bp, Mus musculus
ttatttgttttaatccctgtcatgt

SEQ ID NO: 927598 - DNA, 25 bp, Mus musculus
ttatttgttttattccctgtcatgt

SEQ ID NO: 927599 - DNA, 25 bp, Mus musculus
ttattttaatggatacccaccctgc

SEQ ID NO: 927600 - DNA, 25 bp, Mus musculus
ttattttaatggttacccaccctgc

SEQ ID NO: 927601 - DNA, 25 bp, Mus musculus
ttattttacaaccattacctccatc

SEQ ID NO: 927602 - DNA, 25 bp, Mus musculus
ttattttacaacgattacctccatc

SEQ ID NO: 927603 - DNA, 25 bp, Mus musculus
ttattttacatgagctccatcaaag

SEQ ID NO: 927604 - DNA, 25 bp, Mus musculus
ttattttacatgtgctccatcaaag

SEQ ID NO: 927605 - DNA, 25 bp, Mus musculus
ttattttagcccacgggtggtcaca

SEQ ID NO: 927606 - DNA, 25 bp, Mus musculus
ttattttagccctcgggtggtcaca

SEQ ID NO: 927607 - DNA, 25 bp, Mus musculus
ttattttagtacagttgtttccgat

SEQ ID NO: 927608 - DNA, 25 bp, Mus musculus
ttattttagtactgttgtttccgat

SEQ ID NO: 927609 - DNA, 25 bp, Mus musculus
ttattttatgctctttccttctttt

SEQ ID NO: 927610 - DNA, 25 bp, Mus musculus
ttattttatgctgtttccttctttt

SEQ ID NO: 927611 - DNA, 25 bp, Mus musculus
ttattttatggtccctcttccaaaa

SEQ ID NO: 927612 - DNA, 25 bp, Mus musculus
ttattttatggtgcctcttccaaaa

SEQ ID NO: 927613 - DNA, 25 bp, Mus musculus
ttattttcataaccacgtgggtgta

SEQ ID NO: 927614 - DNA, 25 bp, Mus musculus
ttattttcataagcacgtgggtgta

SEQ ID NO: 927615 - DNA, 25 bp, Mus musculus
ttattttccattacccacaggtctg

SEQ ID NO: 927616 - DNA, 25 bp, Mus musculus
ttattttccatttcccacaggtctg

SEQ ID NO: 927617 - DNA, 25 bp, Mus musculus
ttattttcccacaactgtcaatacc

SEQ ID NO: 927618 - DNA, 25 bp, Mus musculus
ttattttcccactactgtcaatacc

SEQ ID NO: 927619 - DNA, 25 bp, Mus musculus
ttattttccgagatggttccatact

SEQ ID NO: 927620 - DNA, 25 bp, Mus musculus
ttattttccgagttggttccatact

SEQ ID NO: 927621 - DNA, 25 bp, Mus musculus
ttattttcctaaagactgtgtgcag

SEQ ID NO: 927622 - DNA, 25 bp, Mus musculus
ttattttcctaatgactgtgtgcag

SEQ ID NO: 927623 - DNA, 25 bp, Mus musculus
ttattttcctctccaggttcccgag

SEQ ID NO: 927624 - DNA, 25 bp, Mus musculus
ttattttcctctgcaggttcccgag

SEQ ID NO: 927625 - DNA, 25 bp, Mus musculus
ttattttcgatcaccaccgtaattc

SEQ ID NO: 927626 - DNA, 25 bp, Mus musculus
ttattttcgatctccaccgtaattc

SEQ ID NO: 927627 - DNA, 25 bp, Mus musculus
ttattttcgcctatttgccttgatc

SEQ ID NO: 927628 - DNA, 25 bp, Mus musculus
ttattttcgcctttttgccttgatc

SEQ ID NO: 927629 - DNA, 25 bp, Mus musculus
ttattttcgtaaccagctgtgtgct

SEQ ID NO: 927630 - DNA, 25 bp, Mus musculus
ttattttcgtaagcagctgtgtgct

SEQ ID NO: 927631 - DNA, 25 bp, Mus musculus
ttattttctaaacctgtagtacaat

SEQ ID NO: 927632 - DNA, 25 bp, Mus musculus
ttattttctaaagctgtagtacaat

SEQ ID NO: 927633 - DNA, 25 bp, Mus musculus
ttattttctactcccgctttttcat

SEQ ID NO: 927634 - DNA, 25 bp, Mus musculus
ttattttctactctacttttagctt

SEQ ID NO: 927635 - DNA, 25 bp, Mus musculus
ttattttctactgccgctttttcat

SEQ ID NO: 927636 - DNA, 25 bp, Mus musculus
ttattttctactgtacttttagctt

SEQ ID NO: 927637 - DNA, 25 bp, Mus musculus
ttattttctaggcacccgttagaga

SEQ ID NO: 927638 - DNA, 25 bp, Mus musculus
ttattttctagggacccgttagaga

SEQ ID NO: 927639 - DNA, 25 bp, Mus musculus
ttattttctagtccatacttctgta

SEQ ID NO: 927640 - DNA, 25 bp, Mus musculus
ttattttctagtgcatacttctgta

SEQ ID NO: 927641 - DNA, 25 bp, Mus musculus
ttattttctgtgacttcaagggatg

SEQ ID NO: 927642 - DNA, 25 bp, Mus musculus
ttattttctgtgtcttcaagggatg

SEQ ID NO: 927643 - DNA, 25 bp, Mus musculus
ttattttctttaatcctagttggtg

SEQ ID NO: 927644 - DNA, 25 bp, Mus musculus
ttattttctttattcctagttggtg

SEQ ID NO: 927645 - DNA, 25 bp, Mus musculus
ttattttgaagcacatccgaacaga

SEQ ID NO: 927646 - DNA, 25 bp, Mus musculus
ttattttgaagctcatccgaacaga

SEQ ID NO: 927647 - DNA, 25 bp, Mus musculus
ttattttgcaatctctgaagtctga

SEQ ID NO: 927648 - DNA, 25 bp, Mus musculus
ttattttgcaatgtctgaagtctga

SEQ ID NO: 927649 - DNA, 25 bp, Mus musculus
ttattttgcagaagaggtcctccca

SEQ ID NO: 927650 - DNA, 25 bp, Mus musculus
ttattttgcagatgaggtcctccca

SEQ ID NO: 927651 - DNA, 25 bp, Mus musculus
ttattttgcttgctgtctcaggaac

SEQ ID NO: 927652 - DNA, 25 bp, Mus musculus
ttattttgcttggtgtctcaggaac

SEQ ID NO: 927653 - DNA, 25 bp, Mus musculus
ttattttggagcagccccgcctggg

SEQ ID NO: 927654 - DNA, 25 bp, Mus musculus
ttattttggagctgccccgcctggg

SEQ ID NO: 927655 - DNA, 25 bp, Mus musculus
ttattttggagtcagggtcagccta

SEQ ID NO: 927656 - DNA, 25 bp, Mus musculus
ttattttggagtgagggtcagccta

SEQ ID NO: 927657 - DNA, 25 bp, Mus musculus
ttattttggataacctctaattaat

SEQ ID NO: 927658 - DNA, 25 bp, Mus musculus
ttattttggatatcctctaattaat

SEQ ID NO: 927659 - DNA, 25 bp, Mus musculus
ttattttgtcatctatcccaattct

SEQ ID NO: 927660 - DNA, 25 bp, Mus musculus
ttattttgtcatcttagccagtaca

SEQ ID NO: 927661 - DNA, 25 bp, Mus musculus
ttattttgtcatgtatcccaattct

SEQ ID NO: 927662 - DNA, 25 bp, Mus musculus
ttattttgtcatgttagccagtaca

SEQ ID NO: 927663 - DNA, 25 bp, Mus musculus
ttattttgtggccacacaggatcag

SEQ ID NO: 927664 - DNA, 25 bp, Mus musculus
ttattttgtggcgacacaggatcag

SEQ ID NO: 927665 - DNA, 25 bp, Mus musculus
ttattttgtgtgctgtgctcagaaa

SEQ ID NO: 927666 - DNA, 25 bp, Mus musculus
ttattttgtgtggtgtgctcagaaa

SEQ ID NO: 927667 - DNA, 25 bp, Mus musculus
ttattttgttaacagccggcattcc

SEQ ID NO: 927668 - DNA, 25 bp, Mus musculus
ttattttgttaagagccggcattcc

SEQ ID NO: 927669 - DNA, 25 bp, Mus musculus
ttatttttaaggcatccaacatgtt

SEQ ID NO: 927670 - DNA, 25 bp, Mus musculus
ttatttttaagggatccaacatgtt

SEQ ID NO: 927671 - DNA, 25 bp, Mus musculus
ttatttttacagatgttgtacacaa

SEQ ID NO: 927672 - DNA, 25 bp, Mus musculus
ttatttttacagttgttgtacacaa

SEQ ID NO: 927673 - DNA, 25 bp, Mus musculus
ttatttttagtcaaggtctcaccaa

SEQ ID NO: 927674 - DNA, 25 bp, Mus musculus
ttatttttagtctaggtctcaccaa

SEQ ID NO: 927675 - DNA, 25 bp, Mus musculus
ttatttttatgactctgcctgtcca

SEQ ID NO: 927676 - DNA, 25 bp, Mus musculus
ttatttttatgagtctgcctgtcca

SEQ ID NO: 927677 - DNA, 25 bp, Mus musculus
ttatttttatgtcccgaagcttgtg

SEQ ID NO: 927678 - DNA, 25 bp, Mus musculus
ttatttttatgtgccgaagcttgtg

SEQ ID NO: 927679 - DNA, 25 bp, Mus musculus
ttatttttattgagtgcccagagtt

SEQ ID NO: 927680 - DNA, 25 bp, Mus musculus
ttatttttattgtgtgcccagagtt

SEQ ID NO: 927681 - DNA, 25 bp, Mus musculus
ttatttttcaaactctgtatcaggt

SEQ ID NO: 927682 - DNA, 25 bp, Mus musculus
ttatttttcaaagtctgtatcaggt

SEQ ID NO: 927683 - DNA, 25 bp, Mus musculus
ttatttttcaacagtcaccgcacag

SEQ ID NO: 927684 - DNA, 25 bp, Mus musculus
ttatttttcaactgtcaccgcacag

SEQ ID NO: 927685 - DNA, 25 bp, Mus musculus
ttatttttcagcagaccatctgcct

SEQ ID NO: 927686 - DNA, 25 bp, Mus musculus
ttatttttcagcctccgaaacacgc

SEQ ID NO: 927687 - DNA, 25 bp, Mus musculus
ttatttttcagcgtccgaaacacgc

SEQ ID NO: 927688 - DNA, 25 bp, Mus musculus
ttatttttcagctgaccatctgcct

SEQ ID NO: 927689 - DNA, 25 bp, Mus musculus
ttatttttcattaacttggaggttg

SEQ ID NO: 927690 - DNA, 25 bp, Mus musculus
ttatttttcatttacttggaggttg

SEQ ID NO: 927691 - DNA, 25 bp, Mus musculus
ttatttttccagcagcaggagctat

SEQ ID NO: 927692 - DNA, 25 bp, Mus musculus
ttatttttccaggagcaggagctat

SEQ ID NO: 927693 - DNA, 25 bp, Mus musculus
ttatttttctcaatgctctaaccaa

SEQ ID NO: 927694 - DNA, 25 bp, Mus musculus
ttatttttctcattgctctaaccaa

SEQ ID NO: 927695 - DNA, 25 bp, Mus musculus
ttatttttctgtcggaacgaggtga

SEQ ID NO: 927696 - DNA, 25 bp, Mus musculus
ttatttttctgtgggaacgaggtga

SEQ ID NO: 927697 - DNA, 25 bp, Mus musculus
ttatttttctttccataacttaatg

SEQ ID NO: 927698 - DNA, 25 bp, Mus musculus
ttatttttctttgcataacttaatg

SEQ ID NO: 927699 - DNA, 25 bp, Mus musculus
ttatttttgcgcactctttgagaca

SEQ ID NO: 927700 - DNA, 25 bp, Mus musculus
ttatttttgcgctctctttgagaca

SEQ ID NO: 927701 - DNA, 25 bp, Mus musculus
ttatttttgctgagtcatttggtaa

SEQ ID NO: 927702 - DNA, 25 bp, Mus musculus
ttatttttgctgtgtcatttggtaa

SEQ ID NO: 927703 - DNA, 25 bp, Mus musculus
ttatttttggctcctgggtaactta

SEQ ID NO: 927704 - DNA, 25 bp, Mus musculus
ttatttttggctgctgggtaactta

SEQ ID NO: 927705 - DNA, 25 bp, Mus musculus
ttatttttggtcaactgcgtgggca

SEQ ID NO: 927706 - DNA, 25 bp, Mus musculus
ttatttttggtctactgcgtgggca

SEQ ID NO: 927707 - DNA, 25 bp, Mus musculus
ttatttttgtaaactactactgcta

SEQ ID NO: 927708 - DNA, 25 bp, Mus musculus
ttatttttgtaatctactactgcta

SEQ ID NO: 927709 - DNA, 25 bp, Mus musculus
ttattttttaagctgcaaacaagag

SEQ ID NO: 927710 - DNA, 25 bp, Mus musculus
ttattttttaaggtgcaaacaagag

SEQ ID NO: 927711 - DNA, 25 bp, Mus musculus
ttattttttacaacagtcacctcat

SEQ ID NO: 927712 - DNA, 25 bp, Mus musculus
ttattttttacatcagtcacctcat

SEQ ID NO: 927713 - DNA, 25 bp, Mus musculus
ttattttttagcagaagtcagtatt

SEQ ID NO: 927714 - DNA, 25 bp, Mus musculus
ttattttttagctgaagtcagtatt

SEQ ID NO: 927715 - DNA, 25 bp, Mus musculus
ttattttttgaacgccactgggaag

SEQ ID NO: 927716 - DNA, 25 bp, Mus musculus
ttattttttgaaggccactgggaag

SEQ ID NO: 927717 - DNA, 25 bp, Mus musculus
ttattttttgcgatgctctaactgt

SEQ ID NO: 927718 - DNA, 25 bp, Mus musculus
ttattttttgcgttgctctaactgt

SEQ ID NO: 927719 - DNA, 25 bp, Mus musculus
ttattttttgctaccacactgttct

SEQ ID NO: 927720 - DNA, 25 bp, Mus musculus
ttattttttgcttccacactgttct

SEQ ID NO: 927721 - DNA, 25 bp, Mus musculus
ttcaaaaacatcatgggccatttca

SEQ ID NO: 927722 - DNA, 25 bp, Mus musculus
ttcaaaaacatcttgggccatttca

SEQ ID NO: 927723 - DNA, 25 bp, Mus musculus
ttcaaaaacttgatccccgtgggct

SEQ ID NO: 927724 - DNA, 25 bp, Mus musculus
ttcaaaaacttgttccccgtgggct

SEQ ID NO: 927725 - DNA, 25 bp, Mus musculus
ttcaaaaagctgatcaagttctaca

SEQ ID NO: 927726 - DNA, 25 bp, Mus musculus
ttcaaaaagctgttcaagttctaca

SEQ ID NO: 927727 - DNA, 25 bp, Mus musculus
ttcaaaaaggatatcccccactctg

SEQ ID NO: 927728 - DNA, 25 bp, Mus musculus
ttcaaaaaggatttcccccactctg

SEQ ID NO: 927729 - DNA, 25 bp, Mus musculus
ttcaaaaagtctcggtccccatgaa

SEQ ID NO: 927730 - DNA, 25 bp, Mus musculus
ttcaaaaagtctgggtccccatgaa

SEQ ID NO: 927731 - DNA, 25 bp, Mus musculus
ttcaaaaatcataccccagaggtgg

SEQ ID NO: 927732 - DNA, 25 bp, Mus musculus
ttcaaaaatcattccccagaggtgg

SEQ ID NO: 927733 - DNA, 25 bp, Mus musculus
ttcaaaaatttccagtcgaaagcct

SEQ ID NO: 927734 - DNA, 25 bp, Mus musculus
ttcaaaaatttcgagtcgaaagcct

SEQ ID NO: 927735 - DNA, 25 bp, Mus musculus
ttcaaaacactgaaccgccgactga

SEQ ID NO: 927736 - DNA, 25 bp, Mus musculus
ttcaaaacactgtaccgccgactga

SEQ ID NO: 927737 - DNA, 25 bp, Mus musculus
ttcaaaacctacctggagacaaaag

SEQ ID NO: 927738 - DNA, 25 bp, Mus musculus
ttcaaaacctacgtggagacaaaag

SEQ ID NO: 927739 - DNA, 25 bp, Mus musculus
ttcaaaactgagatccccatgggcc

SEQ ID NO: 927740 - DNA, 25 bp, Mus musculus
ttcaaaactgagttccccatgggcc

SEQ ID NO: 927741 - DNA, 25 bp, Mus musculus
ttcaaaactgttccctgtaaaatga

SEQ ID NO: 927742 - DNA, 25 bp, Mus musculus
ttcaaaactgttgcctgtaaaatga

SEQ ID NO: 927743 - DNA, 25 bp, Mus musculus
ttcaaaagcaataacccgtctgtgg

SEQ ID NO: 927744 - DNA, 25 bp, Mus musculus
ttcaaaagcaattacccgtctgtgg

SEQ ID NO: 927745 - DNA, 25 bp, Mus musculus
ttcaaaagtattctccacgggaggc

SEQ ID NO: 927746 - DNA, 25 bp, Mus musculus
ttcaaaagtattgtccacgggaggc

SEQ ID NO: 927747 - DNA, 25 bp, Mus musculus
ttcaaaagtgtccacgccatttcac

SEQ ID NO: 927748 - DNA, 25 bp, Mus musculus
ttcaaaagtgtcgacgccatttcac

SEQ ID NO: 927749 - DNA, 25 bp, Mus musculus
ttcaaaatcaaaaggcgctgggcag

SEQ ID NO: 927750 - DNA, 25 bp, Mus musculus
ttcaaaatcaaatggcgctgggcag

SEQ ID NO: 927751 - DNA, 25 bp, Mus musculus
ttcaaaatcataactggtccatagt

SEQ ID NO: 927752 - DNA, 25 bp, Mus musculus
ttcaaaatcatatctggtccatagt

SEQ ID NO: 927753 - DNA, 25 bp, Mus musculus
ttcaaaattaacagtcttaagggct

SEQ ID NO: 927754 - DNA, 25 bp, Mus musculus
ttcaaaattaactgtcttaagggct

SEQ ID NO: 927755 - DNA, 25 bp, Mus musculus
ttcaaaattgtcactctacataagt

SEQ ID NO: 927756 - DNA, 25 bp, Mus musculus
ttcaaaattgtctctctacataagt

SEQ ID NO: 927757 - DNA, 25 bp, Mus musculus
ttcaaacaagcgatagtgtcaggat

SEQ ID NO: 927758 - DNA, 25 bp, Mus musculus
ttcaaacaagcgttagtgtcaggat

SEQ ID NO: 927759 - DNA, 25 bp, Mus musculus
ttcaaacacagtagagacctccaaa

SEQ ID NO: 927760 - DNA, 25 bp, Mus musculus
ttcaaacacagttgagacctccaaa

SEQ ID NO: 927761 - DNA, 25 bp, Mus musculus
ttcaaacacattctccctgacattt

SEQ ID NO: 927762 - DNA, 25 bp, Mus musculus
ttcaaacacattgtccctgacattt

SEQ ID NO: 927763 - DNA, 25 bp, Mus musculus
ttcaaacagacaccctcaggagcct

SEQ ID NO: 927764 - DNA, 25 bp, Mus musculus
ttcaaacagacagcctcaggagcct

SEQ ID NO: 927765 - DNA, 25 bp, Mus musculus
ttcaaacagagaacaaggccggctt

SEQ ID NO: 927766 - DNA, 25 bp, Mus musculus
ttcaaacagagatcaaggccggctt

SEQ ID NO: 927767 - DNA, 25 bp, Mus musculus
ttcaaacagcccctgcagcttgaag

SEQ ID NO: 927768 - DNA, 25 bp, Mus musculus
ttcaaacagcccgtgcagcttgaag

SEQ ID NO: 927769 - DNA, 25 bp, Mus musculus
ttcaaacaggttatgctacttccga

SEQ ID NO: 927770 - DNA, 25 bp, Mus musculus
ttcaaacaggttttgctacttccga

SEQ ID NO: 927771 - DNA, 25 bp, Mus musculus
ttcaaacagttccagtgacctactc

SEQ ID NO: 927772 - DNA, 25 bp, Mus musculus
ttcaaacagttcgagtgacctactc

SEQ ID NO: 927773 - DNA, 25 bp, Mus musculus
ttcaaacatccgatcgccatagaga

SEQ ID NO: 927774 - DNA, 25 bp, Mus musculus
ttcaaacatccgttcgccatagaga

SEQ ID NO: 927775 - DNA, 25 bp, Mus musculus
ttcaaacatctgacaaagcctagtt

SEQ ID NO: 927776 - DNA, 25 bp, Mus musculus
ttcaaacatctgtcaaagcctagtt

SEQ ID NO: 927777 - DNA, 25 bp, Mus musculus
ttcaaacatggcaggttccttttat

SEQ ID NO: 927778 - DNA, 25 bp, Mus musculus
ttcaaacatggccagatctcagagt

SEQ ID NO: 927779 - DNA, 25 bp, Mus musculus
ttcaaacatggcgagatctcagagt

SEQ ID NO: 927780 - DNA, 25 bp, Mus musculus
ttcaaacatggctggttccttttat

SEQ ID NO: 927781 - DNA, 25 bp, Mus musculus
ttcaaacattttcctctgcatacaa

SEQ ID NO: 927782 - DNA, 25 bp, Mus musculus
ttcaaacattttgctctgcatacaa

SEQ ID NO: 927783 - DNA, 25 bp, Mus musculus
ttcaaaccagaaaccgtacttgagt

SEQ ID NO: 927784 - DNA, 25 bp, Mus musculus
ttcaaaccagaatccgtacttgagt

SEQ ID NO: 927785 - DNA, 25 bp, Mus musculus
ttcaaaccagccctacttccatagg

SEQ ID NO: 927786 - DNA, 25 bp, Mus musculus
ttcaaaccagccgtacttccatagg

SEQ ID NO: 927787 - DNA, 25 bp, Mus musculus
ttcaaacccactatggtgtgtcgtt

SEQ ID NO: 927788 - DNA, 25 bp, Mus musculus
ttcaaacccactttggtgtgtcgtt

SEQ ID NO: 927789 - DNA, 25 bp, Mus musculus
ttcaaaccccgaagtatgagcaatg

SEQ ID NO: 927790 - DNA, 25 bp, Mus musculus
ttcaaaccccgatgtatgagcaatg

SEQ ID NO: 927791 - DNA, 25 bp, Mus musculus
ttcaaaccctgaccactatcgctgc

SEQ ID NO: 927792 - DNA, 25 bp, Mus musculus
ttcaaaccctgagcactatcgctgc

SEQ ID NO: 927793 - DNA, 25 bp, Mus musculus
ttcaaaccgttaatgggtacaggat

SEQ ID NO: 927794 - DNA, 25 bp, Mus musculus
ttcaaaccgttattgggtacaggat

SEQ ID NO: 927795 - DNA, 25 bp, Mus musculus
ttcaaacctcaactcttcctggatg

SEQ ID NO: 927796 - DNA, 25 bp, Mus musculus
ttcaaacctcaagtcttcctggatg

SEQ ID NO: 927797 - DNA, 25 bp, Mus musculus
ttcaaacctctgcagatgctgtgcc

SEQ ID NO: 927798 - DNA, 25 bp, Mus musculus
ttcaaacctctggagatgctgtgcc

SEQ ID NO: 927799 - DNA, 25 bp, Mus musculus
ttcaaacctgaaagcactgagagtt

SEQ ID NO: 927800 - DNA, 25 bp, Mus musculus
ttcaaacctgaatgcactgagagtt

SEQ ID NO: 927801 - DNA, 25 bp, Mus musculus
ttcaaacctggaagataatgtatca

SEQ ID NO: 927802 - DNA, 25 bp, Mus musculus
ttcaaacctggatgataatgtatca

SEQ ID NO: 927803 - DNA, 25 bp, Mus musculus
ttcaaacgcgtgaagcaacagggct

SEQ ID NO: 927804 - DNA, 25 bp, Mus musculus
ttcaaacgcgtgtagcaacagggct

SEQ ID NO: 927805 - DNA, 25 bp, Mus musculus
ttcaaacggaagagagtggcagcat

SEQ ID NO: 927806 - DNA, 25 bp, Mus musculus
ttcaaacggaagtgagtggcagcat

SEQ ID NO: 927807 - DNA, 25 bp, Mus musculus
ttcaaacggtctctacactaaaggt

SEQ ID NO: 927808 - DNA, 25 bp, Mus musculus
ttcaaacggtctgtacactaaaggt

SEQ ID NO: 927809 - DNA, 25 bp, Mus musculus
ttcaaactaaggcagcacctcccaa

SEQ ID NO: 927810 - DNA, 25 bp, Mus musculus
ttcaaactaagggagcacctcccaa

SEQ ID NO: 927811 - DNA, 25 bp, Mus musculus
ttcaaactagcacaccatctgcggg

SEQ ID NO: 927812 - DNA, 25 bp, Mus musculus
ttcaaactagcagaccatctgcggg

SEQ ID NO: 927813 - DNA, 25 bp, Mus musculus
ttcaaactcaacacctgagaggcag

SEQ ID NO: 927814 - DNA, 25 bp, Mus musculus
ttcaaactcaactcctgagaggcag

SEQ ID NO: 927815 - DNA, 25 bp, Mus musculus
ttcaaactccagaccattaaatcag

SEQ ID NO: 927816 - DNA, 25 bp, Mus musculus
ttcaaactccagtccattaaatcag

SEQ ID NO: 927817 - DNA, 25 bp, Mus musculus
ttcaaactctcaagtctgactatca

SEQ ID NO: 927818 - DNA, 25 bp, Mus musculus
ttcaaactctcatgtctgactatca

SEQ ID NO: 927819 - DNA, 25 bp, Mus musculus
ttcaaactgagccatgctcgaggga

SEQ ID NO: 927820 - DNA, 25 bp, Mus musculus
ttcaaactgagcgatgctcgaggga

SEQ ID NO: 927821 - DNA, 25 bp, Mus musculus
ttcaaactgttcaacctaaatagga

SEQ ID NO: 927822 - DNA, 25 bp, Mus musculus
ttcaaactgttctacctaaatagga

SEQ ID NO: 927823 - DNA, 25 bp, Mus musculus
ttcaaacttgaaacgcatagcatgt

SEQ ID NO: 927824 - DNA, 25 bp, Mus musculus
ttcaaacttgaatcgcatagcatgt

SEQ ID NO: 927825 - DNA, 25 bp, Mus musculus
ttcaaactttatccacttcacatct

SEQ ID NO: 927826 - DNA, 25 bp, Mus musculus
ttcaaactttatgcacttcacatct

SEQ ID NO: 927827 - DNA, 25 bp, Mus musculus
ttcaaactttcgatgctgaggcctc

SEQ ID NO: 927828 - DNA, 25 bp, Mus musculus
ttcaaactttcgttgctgaggcctc

SEQ ID NO: 927829 - DNA, 25 bp, Mus musculus
ttcaaagaattcaggttacctatag

SEQ ID NO: 927830 - DNA, 25 bp, Mus musculus
ttcaaagaattctggttacctatag

SEQ ID NO: 927831 - DNA, 25 bp, Mus musculus
ttcaaagaattgctcagtaggactg

SEQ ID NO: 927832 - DNA, 25 bp, Mus musculus
ttcaaagaattggtcagtaggactg

SEQ ID NO: 927833 - DNA, 25 bp, Mus musculus
ttcaaagacaaccacgacttcgagg

SEQ ID NO: 927834 - DNA, 25 bp, Mus musculus
ttcaaagacaacgacgacttcgagg

SEQ ID NO: 927835 - DNA, 25 bp, Mus musculus
ttcaaagacatgattcccttctgtg

SEQ ID NO: 927836 - DNA, 25 bp, Mus musculus
ttcaaagacatgtttcccttctgtg

SEQ ID NO: 927837 - DNA, 25 bp, Mus musculus
ttcaaagactggctactctaggcgt

SEQ ID NO: 927838 - DNA, 25 bp, Mus musculus
ttcaaagactgggtactctaggcgt

SEQ ID NO: 927839 - DNA, 25 bp, Mus musculus
ttcaaagacttactgtgggcaacaa

SEQ ID NO: 927840 - DNA, 25 bp, Mus musculus
ttcaaagacttagtgtgggcaacaa

SEQ ID NO: 927841 - DNA, 25 bp, Mus musculus
ttcaaagagctgctatcctgaaagc

SEQ ID NO: 927842 - DNA, 25 bp, Mus musculus
ttcaaagagctggtatcctgaaagc

SEQ ID NO: 927843 - DNA, 25 bp, Mus musculus
ttcaaagagcttatcgccagaagtg

SEQ ID NO: 927844 - DNA, 25 bp, Mus musculus
ttcaaagagcttttcgccagaagtg

SEQ ID NO: 927845 - DNA, 25 bp, Mus musculus
ttcaaagagggacaccgcgacagct

SEQ ID NO: 927846 - DNA, 25 bp, Mus musculus
ttcaaagagggagaccgcgacagct

SEQ ID NO: 927847 - DNA, 25 bp, Mus musculus
ttcaaagagtttcttcttgcagaag

SEQ ID NO: 927848 - DNA, 25 bp, Mus musculus
ttcaaagagtttgttcttgcagaag

SEQ ID NO: 927849 - DNA, 25 bp, Mus musculus
ttcaaagatcttataccttcgactt

SEQ ID NO: 927850 - DNA, 25 bp, Mus musculus
ttcaaagatcttttaccttcgactt

SEQ ID NO: 927851 - DNA, 25 bp, Mus musculus
ttcaaagatgttacccgaccccaga

SEQ ID NO: 927852 - DNA, 25 bp, Mus musculus
ttcaaagatgtttcccgaccccaga

SEQ ID NO: 927853 - DNA, 25 bp, Mus musculus
ttcaaagattctcttcaccatcacg

SEQ ID NO: 927854 - DNA, 25 bp, Mus musculus
ttcaaagattctgttcaccatcacg

SEQ ID NO: 927855 - DNA, 25 bp, Mus musculus
ttcaaagattgtaacctttgggctt

SEQ ID NO: 927856 - DNA, 25 bp, Mus musculus
ttcaaagattgttacctttgggctt

SEQ ID NO: 927857 - DNA, 25 bp, Mus musculus
ttcaaagcaagcctgggcatcatcc

SEQ ID NO: 927858 - DNA, 25 bp, Mus musculus
ttcaaagcaagcgtgggcatcatcc

SEQ ID NO: 927859 - DNA, 25 bp, Mus musculus
ttcaaagcacacatttctggccttg

SEQ ID NO: 927860 - DNA, 25 bp, Mus musculus
ttcaaagcacacttttctggccttg

SEQ ID NO: 927861 - DNA, 25 bp, Mus musculus
ttcaaagcacccactggatgttttc

SEQ ID NO: 927862 - DNA, 25 bp, Mus musculus
ttcaaagcaccctctggatgttttc

SEQ ID NO: 927863 - DNA, 25 bp, Mus musculus
ttcaaagccagccttatctgcacag

SEQ ID NO: 927864 - DNA, 25 bp, Mus musculus
ttcaaagccagcgttatctgcacag

SEQ ID NO: 927865 - DNA, 25 bp, Mus musculus
ttcaaagcccaaccccaaagatata

SEQ ID NO: 927866 - DNA, 25 bp, Mus musculus
ttcaaagcccaagcccaaagatata

SEQ ID NO: 927867 - DNA, 25 bp, Mus musculus
ttcaaagcccgtctccctgaaggac

SEQ ID NO: 927868 - DNA, 25 bp, Mus musculus
ttcaaagcccgtgtccctgaaggac

SEQ ID NO: 927869 - DNA, 25 bp, Mus musculus
ttcaaagccgtactctactctgtag

SEQ ID NO: 927870 - DNA, 25 bp, Mus musculus
ttcaaagccgtagtctactctgtag

SEQ ID NO: 927871 - DNA, 25 bp, Mus musculus
ttcaaagcctgtctgagctacccag

SEQ ID NO: 927872 - DNA, 25 bp, Mus musculus
ttcaaagcctgtgtgagctacccag

SEQ ID NO: 927873 - DNA, 25 bp, Mus musculus
ttcaaagccttgacaaatgctacaa

SEQ ID NO: 927874 - DNA, 25 bp, Mus musculus
ttcaaagccttgtcaaatgctacaa

SEQ ID NO: 927875 - DNA, 25 bp, Mus musculus
ttcaaagctagcaacctacacggtg

SEQ ID NO: 927876 - DNA, 25 bp, Mus musculus
ttcaaagctagctacctacacggtg

SEQ ID NO: 927877 - DNA, 25 bp, Mus musculus
ttcaaagctcttagtcaccaggaca

SEQ ID NO: 927878 - DNA, 25 bp, Mus musculus
ttcaaagctctttgtcaccaggaca

SEQ ID NO: 927879 - DNA, 25 bp, Mus musculus
ttcaaagctgtgacttaccatgcct

SEQ ID NO: 927880 - DNA, 25 bp, Mus musculus
ttcaaagctgtgtcttaccatgcct

SEQ ID NO: 927881 - DNA, 25 bp, Mus musculus
ttcaaaggacagactgttttcccag

SEQ ID NO: 927882 - DNA, 25 bp, Mus musculus
ttcaaaggacagtctgttttcccag

SEQ ID NO: 927883 - DNA, 25 bp, Mus musculus
ttcaaaggaccaccgacctggactt

SEQ ID NO: 927884 - DNA, 25 bp, Mus musculus
ttcaaaggaccagcgacctggactt

SEQ ID NO: 927885 - DNA, 25 bp, Mus musculus
ttcaaaggcactaatggcacttatt

SEQ ID NO: 927886 - DNA, 25 bp, Mus musculus
ttcaaaggcacttatggcacttatt

SEQ ID NO: 927887 - DNA, 25 bp, Mus musculus
ttcaaaggcgtcaaagtcaggcaga

SEQ ID NO: 927888 - DNA, 25 bp, Mus musculus
ttcaaaggcgtctaagtcaggcaga

SEQ ID NO: 927889 - DNA, 25 bp, Mus musculus
ttcaaagggttgagtgtctcgccca

SEQ ID NO: 927890 - DNA, 25 bp, Mus musculus
ttcaaagggttgtgtgtctcgccca

SEQ ID NO: 927891 - DNA, 25 bp, Mus musculus
ttcaaagtccttcgaacctggagcc

SEQ ID NO: 927892 - DNA, 25 bp, Mus musculus
ttcaaagtccttggaacctggagcc

SEQ ID NO: 927893 - DNA, 25 bp, Mus musculus
ttcaaagtctgtatctctgggtgca

SEQ ID NO: 927894 - DNA, 25 bp, Mus musculus
ttcaaagtctgtttctctgggtgca

SEQ ID NO: 927895 - DNA, 25 bp, Mus musculus
ttcaaagtgattcagagttcctcct

SEQ ID NO: 927896 - DNA, 25 bp, Mus musculus
ttcaaagtgattgagagttcctcct

SEQ ID NO: 927897 - DNA, 25 bp, Mus musculus
ttcaaataatttcggctcttcctca

SEQ ID NO: 927898 - DNA, 25 bp, Mus musculus
ttcaaataatttgggctcttcctca

SEQ ID NO: 927899 - DNA, 25 bp, Mus musculus
ttcaaatatcgtactctctgggtct

SEQ ID NO: 927900 - DNA, 25 bp, Mus musculus
ttcaaatatcgttctctctgggtct

SEQ ID NO: 927901 - DNA, 25 bp, Mus musculus
ttcaaatcacttcccttgttacttt

SEQ ID NO: 927902 - DNA, 25 bp, Mus musculus
ttcaaatcacttgccttgttacttt

SEQ ID NO: 927903 - DNA, 25 bp, Mus musculus
ttcaaatcagtgacttgtttcccca

SEQ ID NO: 927904 - DNA, 25 bp, Mus musculus
ttcaaatcagtgtcttgtttcccca

SEQ ID NO: 927905 - DNA, 25 bp, Mus musculus
ttcaaatccaagctcagttgcgtct

SEQ ID NO: 927906 - DNA, 25 bp, Mus musculus
ttcaaatccaaggtcagttgcgtct

SEQ ID NO: 927907 - DNA, 25 bp, Mus musculus
ttcaaatcccaaccgtcagctcgag

SEQ ID NO: 927908 - DNA, 25 bp, Mus musculus
ttcaaatcccaagcgtcagctcgag

SEQ ID NO: 927909 - DNA, 25 bp, Mus musculus
ttcaaatccgtgcttcccctcaatt

SEQ ID NO: 927910 - DNA, 25 bp, Mus musculus
ttcaaatccgtggttcccctcaatt

SEQ ID NO: 927911 - DNA, 25 bp, Mus musculus
ttcaaatcctccatcaactgagtcc

SEQ ID NO: 927912 - DNA, 25 bp, Mus musculus
ttcaaatcctccttcaactgagtcc

SEQ ID NO: 927913 - DNA, 25 bp, Mus musculus
ttcaaatccttcagacctttgctgg

SEQ ID NO: 927914 - DNA, 25 bp, Mus musculus
ttcaaatccttctgacctttgctgg

SEQ ID NO: 927915 - DNA, 25 bp, Mus musculus
ttcaaatcctttcatgttcatccat

SEQ ID NO: 927916 - DNA, 25 bp, Mus musculus
ttcaaatcctttgatgttcatccat

SEQ ID NO: 927917 - DNA, 25 bp, Mus musculus
ttcaaatctctcagtcactttggca

SEQ ID NO: 927918 - DNA, 25 bp, Mus musculus
ttcaaatctctctgtcactttggca

SEQ ID NO: 927919 - DNA, 25 bp, Mus musculus
ttcaaatcttctatttaatcccagc

SEQ ID NO: 927920 - DNA, 25 bp, Mus musculus
ttcaaatcttctttttaatcccagc

SEQ ID NO: 927921 - DNA, 25 bp, Mus musculus
ttcaaatgcttgcttccactgtgca

SEQ ID NO: 927922 - DNA, 25 bp, Mus musculus
ttcaaatgcttggttccactgtgca

SEQ ID NO: 927923 - DNA, 25 bp, Mus musculus
ttcaaatggtaaatgtccctttcag

SEQ ID NO: 927924 - DNA, 25 bp, Mus musculus
ttcaaatggtaattgtccctttcag

SEQ ID NO: 927925 - DNA, 25 bp, Mus musculus
ttcaaatggtgtccaatactttttt

SEQ ID NO: 927926 - DNA, 25 bp, Mus musculus
ttcaaatggtgtgcaatactttttt

SEQ ID NO: 927927 - DNA, 25 bp, Mus musculus
ttcaaatgtcatatctccaccaggg

SEQ ID NO: 927928 - DNA, 25 bp, Mus musculus
ttcaaatgtcatttctccaccaggg

SEQ ID NO: 927929 - DNA, 25 bp, Mus musculus
ttcaaatgtgctacagatgagcttt

SEQ ID NO: 927930 - DNA, 25 bp, Mus musculus
ttcaaatgtgcttcagatgagcttt

SEQ ID NO: 927931 - DNA, 25 bp, Mus musculus
ttcaaattcaatcttagagacccat

SEQ ID NO: 927932 - DNA, 25 bp, Mus musculus
ttcaaattcaatgttagagacccat

SEQ ID NO: 927933 - DNA, 25 bp, Mus musculus
ttcaaattcctgctcggacttggga

SEQ ID NO: 927934 - DNA, 25 bp, Mus musculus
ttcaaattcctggtcggacttggga

SEQ ID NO: 927935 - DNA, 25 bp, Mus musculus
ttcaaattcgatcctgcttttcctc

SEQ ID NO: 927936 - DNA, 25 bp, Mus musculus
ttcaaattcgatgctgcttttcctc

SEQ ID NO: 927937 - DNA, 25 bp, Mus musculus
ttcaaattgctgagactagtggctg

SEQ ID NO: 927938 - DNA, 25 bp, Mus musculus
ttcaaattgctgtgactagtggctg

SEQ ID NO: 927939 - DNA, 25 bp, Mus musculus
ttcaaatttaaccttcctgcttctg

SEQ ID NO: 927940 - DNA, 25 bp, Mus musculus
ttcaaatttaacgttcctgcttctg

SEQ ID NO: 927941 - DNA, 25 bp, Mus musculus
ttcaaattttagagcagcctagggc

SEQ ID NO: 927942 - DNA, 25 bp, Mus musculus
ttcaaattttagtgcagcctagggc

SEQ ID NO: 927943 - DNA, 25 bp, Mus musculus
ttcaacaaaaaaccagctccgactg

SEQ ID NO: 927944 - DNA, 25 bp, Mus musculus
ttcaacaaaaaagcagctccgactg

SEQ ID NO: 927945 - DNA, 25 bp, Mus musculus
ttcaacaaccatctcgtaacaaaaa

SEQ ID NO: 927946 - DNA, 25 bp, Mus musculus
ttcaacaaccatgtcgtaacaaaaa

SEQ ID NO: 927947 - DNA, 25 bp, Mus musculus
ttcaacaaccgaacaagtgtcatgt

SEQ ID NO: 927948 - DNA, 25 bp, Mus musculus
ttcaacaaccgatcaagtgtcatgt

SEQ ID NO: 927949 - DNA, 25 bp, Mus musculus
ttcaacaagcatattttcagcctga

SEQ ID NO: 927950 - DNA, 25 bp, Mus musculus
ttcaacaagcattttttcagcctga

SEQ ID NO: 927951 - DNA, 25 bp, Mus musculus
ttcaacaaggtcaacaagcacccgg

SEQ ID NO: 927952 - DNA, 25 bp, Mus musculus
ttcaacaaggtctacaagcacccgg

SEQ ID NO: 927953 - DNA, 25 bp, Mus musculus
ttcaacacaactcacacaccaggac

SEQ ID NO: 927954 - DNA, 25 bp, Mus musculus
ttcaacacaactgacacaccaggac

SEQ ID NO: 927955 - DNA, 25 bp, Mus musculus
ttcaacacagctactacaacactct

SEQ ID NO: 927956 - DNA, 25 bp, Mus musculus
ttcaacacagcttctacaacactct

SEQ ID NO: 927957 - DNA, 25 bp, Mus musculus
ttcaacaccagacaagccacagtgg

SEQ ID NO: 927958 - DNA, 25 bp, Mus musculus
ttcaacaccagagaagccacagtgg

SEQ ID NO: 927959 - DNA, 25 bp, Mus musculus
ttcaacaccgtgaggaccttgggct

SEQ ID NO: 927960 - DNA, 25 bp, Mus musculus
ttcaacaccgtgtggaccttgggct

SEQ ID NO: 927961 - DNA, 25 bp, Mus musculus
ttcaacaccttcactggtgggaacc

SEQ ID NO: 927962 - DNA, 25 bp, Mus musculus
ttcaacaccttctctggtgggaacc

SEQ ID NO: 927963 - DNA, 25 bp, Mus musculus
ttcaacacttatccatctttcttta

SEQ ID NO: 927964 - DNA, 25 bp, Mus musculus
ttcaacacttatgcatctttcttta

SEQ ID NO: 927965 - DNA, 25 bp, Mus musculus
ttcaacagacacatgccctggctgg

SEQ ID NO: 927966 - DNA, 25 bp, Mus musculus
ttcaacagacacttgccctggctgg

SEQ ID NO: 927967 - DNA, 25 bp, Mus musculus
ttcaacagagttagcaattgcttta

SEQ ID NO: 927968 - DNA, 25 bp, Mus musculus
ttcaacagagtttgcaattgcttta

SEQ ID NO: 927969 - DNA, 25 bp, Mus musculus
ttcaacagcgccctttggaccagat

SEQ ID NO: 927970 - DNA, 25 bp, Mus musculus
ttcaacagcgccgtttggaccagat

SEQ ID NO: 927971 - DNA, 25 bp, Mus musculus
ttcaacagcttgcaaaggccccttg

SEQ ID NO: 927972 - DNA, 25 bp, Mus musculus
ttcaacagcttggaaaggccccttg

SEQ ID NO: 927973 - DNA, 25 bp, Mus musculus
ttcaacaggccacatgtattgccaa

SEQ ID NO: 927974 - DNA, 25 bp, Mus musculus
ttcaacaggccagatgtattgccaa

SEQ ID NO: 927975 - DNA, 25 bp, Mus musculus
ttcaacaggcttctggaccatgggt

SEQ ID NO: 927976 - DNA, 25 bp, Mus musculus
ttcaacaggcttgtggaccatgggt

SEQ ID NO: 927977 - DNA, 25 bp, Mus musculus
ttcaacagttgtccactcgcctgtc

SEQ ID NO: 927978 - DNA, 25 bp, Mus musculus
ttcaacagttgtgcactcgcctgtc

SEQ ID NO: 927979 - DNA, 25 bp, Mus musculus
ttcaacagtttgagtagacacactg

SEQ ID NO: 927980 - DNA, 25 bp, Mus musculus
ttcaacagtttgtgtagacacactg

SEQ ID NO: 927981 - DNA, 25 bp, Mus musculus
ttcaacagttttcagtctgactctg

SEQ ID NO: 927982 - DNA, 25 bp, Mus musculus
ttcaacagttttgagtctgactctg

SEQ ID NO: 927983 - DNA, 25 bp, Mus musculus
ttcaacatacagagaagctacccct

SEQ ID NO: 927984 - DNA, 25 bp, Mus musculus
ttcaacatacagtgaagctacccct

SEQ ID NO: 927985 - DNA, 25 bp, Mus musculus
ttcaacatacatcggctgcaccata

SEQ ID NO: 927986 - DNA, 25 bp, Mus musculus
ttcaacatacatgggctgcaccata

SEQ ID NO: 927987 - DNA, 25 bp, Mus musculus
ttcaacatagctctctcttgcctgc

SEQ ID NO: 927988 - DNA, 25 bp, Mus musculus
ttcaacatagctgtctcttgcctgc

SEQ ID NO: 927989 - DNA, 25 bp, Mus musculus
ttcaacatctccaacttgctggtgc

SEQ ID NO: 927990 - DNA, 25 bp, Mus musculus
ttcaacatctcctacttgctggtgc

SEQ ID NO: 927991 - DNA, 25 bp, Mus musculus
ttcaacatctgtcgtcgaccccatg

SEQ ID NO: 927992 - DNA, 25 bp, Mus musculus
ttcaacatctgtggtcgaccccatg

SEQ ID NO: 927993 - DNA, 25 bp, Mus musculus
ttcaacatgtacagggtgaagcaga

SEQ ID NO: 927994 - DNA, 25 bp, Mus musculus
ttcaacatgtactgggtgaagcaga

SEQ ID NO: 927995 - DNA, 25 bp, Mus musculus
ttcaacattgccagctatgctctgc

SEQ ID NO: 927996 - DNA, 25 bp, Mus musculus
ttcaacattgcctgctatgctctgc

SEQ ID NO: 927997 - DNA, 25 bp, Mus musculus
ttcaacattgtaaaggcctgcctcc

SEQ ID NO: 927998 - DNA, 25 bp, Mus musculus
ttcaacattgtataggcctgcctcc

SEQ ID NO: 927999 - DNA, 25 bp, Mus musculus
ttcaacattgttaagctgctggtct

SEQ ID NO: 928000 - DNA, 25 bp, Mus musculus
ttcaacattgtttagctgctggtct

SEQ ID NO: 928001 - DNA, 25 bp, Mus musculus
ttcaacatttttactctagagcatg

SEQ ID NO: 928002 - DNA, 25 bp, Mus musculus
ttcaacattttttctctagagcatg

SEQ ID NO: 928003 - DNA, 25 bp, Mus musculus
ttcaaccattgccaaaatgggtaga

SEQ ID NO: 928004 - DNA, 25 bp, Mus musculus
ttcaaccattgcgaaaatgggtaga

SEQ ID NO: 928005 - DNA, 25 bp, Mus musculus
ttcaaccattttcccttgctaacgc

SEQ ID NO: 928006 - DNA, 25 bp, Mus musculus
ttcaaccattttgccttgctaacgc

SEQ ID NO: 928007 - DNA, 25 bp, Mus musculus
ttcaacccaaaaatagtcctgtcta

SEQ ID NO: 928008 - DNA, 25 bp, Mus musculus
ttcaacccaaaattagtcctgtcta

SEQ ID NO: 928009 - DNA, 25 bp, Mus musculus
ttcaacccacggagggacacggagt

SEQ ID NO: 928010 - DNA, 25 bp, Mus musculus
ttcaacccacggtgggacacggagt

SEQ ID NO: 928011 - DNA, 25 bp, Mus musculus
ttcaacccactcatctggaatgtgg

SEQ ID NO: 928012 - DNA, 25 bp, Mus musculus
ttcaacccactcttctggaatgtgg

SEQ ID NO: 928013 - DNA, 25 bp, Mus musculus
ttcaacccaggacaaccaataccaa

SEQ ID NO: 928014 - DNA, 25 bp, Mus musculus
ttcaacccaggagaaccaataccaa

SEQ ID NO: 928015 - DNA, 25 bp, Mus musculus
ttcaacccagggacttatactgcta

SEQ ID NO: 928016 - DNA, 25 bp, Mus musculus
ttcaacccagggtcttatactgcta

SEQ ID NO: 928017 - DNA, 25 bp, Mus musculus
ttcaacccccgtcgcagagaagggc

SEQ ID NO: 928018 - DNA, 25 bp, Mus musculus
ttcaacccccgtggcagagaagggc

SEQ ID NO: 928019 - DNA, 25 bp, Mus musculus
ttcaacccggaaagttcagtggcat

SEQ ID NO: 928020 - DNA, 25 bp, Mus musculus
ttcaacccggaatgttcagtggcat

SEQ ID NO: 928021 - DNA, 25 bp, Mus musculus
ttcaacccggcaatggtactgtaca

SEQ ID NO: 928022 - DNA, 25 bp, Mus musculus
ttcaacccggcattggtactgtaca

SEQ ID NO: 928023 - DNA, 25 bp, Mus musculus
ttcaaccctcaccatctaattacta

SEQ ID NO: 928024 - DNA, 25 bp, Mus musculus
ttcaaccctcacgatctaattacta

SEQ ID NO: 928025 - DNA, 25 bp, Mus musculus
ttcaaccctgaaagctgcaccagat

SEQ ID NO: 928026 - DNA, 25 bp, Mus musculus
ttcaaccctgaatgctgcaccagat

SEQ ID NO: 928027 - DNA, 25 bp, Mus musculus
ttcaaccctgagaggagacctatca

SEQ ID NO: 928028 - DNA, 25 bp, Mus musculus
ttcaaccctgagtggagacctatca

SEQ ID NO: 928029 - DNA, 25 bp, Mus musculus
ttcaacccttcacatgtctagtgga

SEQ ID NO: 928030 - DNA, 25 bp, Mus musculus
ttcaacccttcagatgtctagtgga

SEQ ID NO: 928031 - DNA, 25 bp, Mus musculus
ttcaacccttctatcttcaaagatc

SEQ ID NO: 928032 - DNA, 25 bp, Mus musculus
ttcaacccttctttcttcaaagatc

SEQ ID NO: 928033 - DNA, 25 bp, Mus musculus
ttcaaccctttgcaactttgttgct

SEQ ID NO: 928034 - DNA, 25 bp, Mus musculus
ttcaaccctttggaactttgttgct

SEQ ID NO: 928035 - DNA, 25 bp, Mus musculus
ttcaaccgaactctcacactaaaag

SEQ ID NO: 928036 - DNA, 25 bp, Mus musculus
ttcaaccgaactgtcacactaaaag

SEQ ID NO: 928037 - DNA, 25 bp, Mus musculus
ttcaacctaaacataatgcgttcag

SEQ ID NO: 928038 - DNA, 25 bp, Mus musculus
ttcaacctaaacttaatgcgttcag

SEQ ID NO: 928039 - DNA, 25 bp, Mus musculus
ttcaacctactcatcctgcttggtt

SEQ ID NO: 928040 - DNA, 25 bp, Mus musculus
ttcaacctactcttcctgcttggtt

SEQ ID NO: 928041 - DNA, 25 bp, Mus musculus
ttcaacctcacacaggacttggagg

SEQ ID NO: 928042 - DNA, 25 bp, Mus musculus
ttcaacctcacagaggacttggagg

SEQ ID NO: 928043 - DNA, 25 bp, Mus musculus
ttcaacctgtagattgaggcccctt

SEQ ID NO: 928044 - DNA, 25 bp, Mus musculus
ttcaacctgtagtttgaggcccctt

SEQ ID NO: 928045 - DNA, 25 bp, Mus musculus
ttcaacctgtccctgaaggaagtgc

SEQ ID NO: 928046 - DNA, 25 bp, Mus musculus
ttcaacctgtccgtgaaggaagtgc

SEQ ID NO: 928047 - DNA, 25 bp, Mus musculus
ttcaaccttagcagtcctcttgtct

SEQ ID NO: 928048 - DNA, 25 bp, Mus musculus
ttcaaccttagctgtcctcttgtct

SEQ ID NO: 928049 - DNA, 25 bp, Mus musculus
ttcaaccttgttaatctacccactt

SEQ ID NO: 928050 - DNA, 25 bp, Mus musculus
ttcaaccttgtttatctacccactt

SEQ ID NO: 928051 - DNA, 25 bp, Mus musculus
ttcaacgacctaaagcctgtgccaa

SEQ ID NO: 928052 - DNA, 25 bp, Mus musculus
ttcaacgacctatagcctgtgccaa

SEQ ID NO: 928053 - DNA, 25 bp, Mus musculus
ttcaacgctcttaagaatcttttgt

SEQ ID NO: 928054 - DNA, 25 bp, Mus musculus
ttcaacgctctttagaatcttttgt

SEQ ID NO: 928055 - DNA, 25 bp, Mus musculus
ttcaacgcttcgctggtcttcgacg

SEQ ID NO: 928056 - DNA, 25 bp, Mus musculus
ttcaacgcttcggtggtcttcgacg

SEQ ID NO: 928057 - DNA, 25 bp, Mus musculus
ttcaacgtagttacacactcttgcc

SEQ ID NO: 928058 - DNA, 25 bp, Mus musculus
ttcaacgtagtttcacactcttgcc

SEQ ID NO: 928059 - DNA, 25 bp, Mus musculus
ttcaacgtcaagaagtgcggcccgg

SEQ ID NO: 928060 - DNA, 25 bp, Mus musculus
ttcaacgtcaagtagtgcggcccgg

SEQ ID NO: 928061 - DNA, 25 bp, Mus musculus
ttcaacgtcctaacacttcttaagt

SEQ ID NO: 928062 - DNA, 25 bp, Mus musculus
ttcaacgtcctatcacttcttaagt

SEQ ID NO: 928063 - DNA, 25 bp, Mus musculus
ttcaacgtgggaatgtgcccctggc

SEQ ID NO: 928064 - DNA, 25 bp, Mus musculus
ttcaacgtgggattgtgcccctggc

SEQ ID NO: 928065 - DNA, 25 bp, Mus musculus
ttcaactacatacctagccccagag

SEQ ID NO: 928066 - DNA, 25 bp, Mus musculus
ttcaactacatagctagccccagag

SEQ ID NO: 928067 - DNA, 25 bp, Mus musculus
ttcaactacgtgcagttcactcgca

SEQ ID NO: 928068 - DNA, 25 bp, Mus musculus
ttcaactacgtggagttcactcgca

SEQ ID NO: 928069 - DNA, 25 bp, Mus musculus
ttcaactataaactcaaccctgttt

SEQ ID NO: 928070 - DNA, 25 bp, Mus musculus
ttcaactataaagtcaaccctgttt

SEQ ID NO: 928071 - DNA, 25 bp, Mus musculus
ttcaactatctcatctagaaaacag

SEQ ID NO: 928072 - DNA, 25 bp, Mus musculus
ttcaactatctcttctagaaaacag

SEQ ID NO: 928073 - DNA, 25 bp, Mus musculus
ttcaactcaccaacgtcattatcat

SEQ ID NO: 928074 - DNA, 25 bp, Mus musculus
ttcaactcaccatcgtcattatcat

SEQ ID NO: 928075 - DNA, 25 bp, Mus musculus
ttcaactcatgaatctgctgcctaa

SEQ ID NO: 928076 - DNA, 25 bp, Mus musculus
ttcaactcatgattctgctgcctaa

SEQ ID NO: 928077 - DNA, 25 bp, Mus musculus
ttcaactccctgcaagtcattgaga

SEQ ID NO: 928078 - DNA, 25 bp, Mus musculus
ttcaactccctggaagtcattgaga

SEQ ID NO: 928079 - DNA, 25 bp, Mus musculus
ttcaactgcagtcatcctgccagac

SEQ ID NO: 928080 - DNA, 25 bp, Mus musculus
ttcaactgcagtgatcctgccagac

SEQ ID NO: 928081 - DNA, 25 bp, Mus musculus
ttcaactgccagaaagccaaacatg

SEQ ID NO: 928082 - DNA, 25 bp, Mus musculus
ttcaactgccagtaagccaaacatg

SEQ ID NO: 928083 - DNA, 25 bp, Mus musculus
ttcaactgccctatctaacctctta

SEQ ID NO: 928084 - DNA, 25 bp, Mus musculus
ttcaactgccctttctaacctctta

SEQ ID NO: 928085 - DNA, 25 bp, Mus musculus
ttcaactggcacaggaagcatccat

SEQ ID NO: 928086 - DNA, 25 bp, Mus musculus
ttcaactggcactggaagcatccat

SEQ ID NO: 928087 - DNA, 25 bp, Mus musculus
ttcaactggccaaccagcgcatatc

SEQ ID NO: 928088 - DNA, 25 bp, Mus musculus
ttcaactggccatccagcgcatatc

SEQ ID NO: 928089 - DNA, 25 bp, Mus musculus
ttcaactgtagacgagagcgcgcca

SEQ ID NO: 928090 - DNA, 25 bp, Mus musculus
ttcaactgtagaggagagcgcgcca

SEQ ID NO: 928091 - DNA, 25 bp, Mus musculus
ttcaactgtattaattgctgcgttt

SEQ ID NO: 928092 - DNA, 25 bp, Mus musculus
ttcaactgtatttattgctgcgttt

SEQ ID NO: 928093 - DNA, 25 bp, Mus musculus
ttcaactgtttccaaatcaacaaga

SEQ ID NO: 928094 - DNA, 25 bp, Mus musculus
ttcaactgtttcgaaatcaacaaga

SEQ ID NO: 928095 - DNA, 25 bp, Mus musculus
ttcaacttatctaccaatcttcttc

SEQ ID NO: 928096 - DNA, 25 bp, Mus musculus
ttcaacttatcttccaatcttcttc

SEQ ID NO: 928097 - DNA, 25 bp, Mus musculus
ttcaacttcaagctcacggattcta

SEQ ID NO: 928098 - DNA, 25 bp, Mus musculus
ttcaacttcaaggtcacggattcta

SEQ ID NO: 928099 - DNA, 25 bp, Mus musculus
ttcaacttcacaactttacctgatt

SEQ ID NO: 928100 - DNA, 25 bp, Mus musculus
ttcaacttcacatctttacctgatt

SEQ ID NO: 928101 - DNA, 25 bp, Mus musculus
ttcaacttcccaatataaatagctt

SEQ ID NO: 928102 - DNA, 25 bp, Mus musculus
ttcaacttcccattataaatagctt

SEQ ID NO: 928103 - DNA, 25 bp, Mus musculus
ttcaacttccctatgcgggacacga

SEQ ID NO: 928104 - DNA, 25 bp, Mus musculus
ttcaacttccctttgcgggacacga

SEQ ID NO: 928105 - DNA, 25 bp, Mus musculus
ttcaacttctagctgatattagcat

SEQ ID NO: 928106 - DNA, 25 bp, Mus musculus
ttcaacttctaggtgatattagcat

SEQ ID NO: 928107 - DNA, 25 bp, Mus musculus
ttcaacttcttgcacctctgccaat

SEQ ID NO: 928108 - DNA, 25 bp, Mus musculus
ttcaacttcttggacctctgccaat

SEQ ID NO: 928109 - DNA, 25 bp, Mus musculus
ttcaacttctttactcccagtaaga

SEQ ID NO: 928110 - DNA, 25 bp, Mus musculus
ttcaacttcttttctcccagtaaga

SEQ ID NO: 928111 - DNA, 25 bp, Mus musculus
ttcaacttgaacctgagcctgctga

SEQ ID NO: 928112 - DNA, 25 bp, Mus musculus
ttcaacttgaacgtgagcctgctga

SEQ ID NO: 928113 - DNA, 25 bp, Mus musculus
ttcaacttgtaactgtgtctttctt

SEQ ID NO: 928114 - DNA, 25 bp, Mus musculus
ttcaacttgtaagtgtgtctttctt

SEQ ID NO: 928115 - DNA, 25 bp, Mus musculus
ttcaacttgttgactggccagaatg

SEQ ID NO: 928116 - DNA, 25 bp, Mus musculus
ttcaacttgttgtctggccagaatg

SEQ ID NO: 928117 - DNA, 25 bp, Mus musculus
ttcaagaacaaccagcccatgatgt

SEQ ID NO: 928118 - DNA, 25 bp, Mus musculus
ttcaagaacaacgagcccatgatgt

SEQ ID NO: 928119 - DNA, 25 bp, Mus musculus
ttcaagaagaccctgcggcacacag

SEQ ID NO: 928120 - DNA, 25 bp, Mus musculus
ttcaagaagaccgtgcggcacacag

SEQ ID NO: 928121 - DNA, 25 bp, Mus musculus
ttcaagaaggacactttcttccccg

SEQ ID NO: 928122 - DNA, 25 bp, Mus musculus
ttcaagaaggacctgcacaaagcgg

SEQ ID NO: 928123 - DNA, 25 bp, Mus musculus
ttcaagaaggacgtgcacaaagcgg

SEQ ID NO: 928124 - DNA, 25 bp, Mus musculus
ttcaagaaggactctttcttccccg

SEQ ID NO: 928125 - DNA, 25 bp, Mus musculus
ttcaagaagtctcttcctctctgct

SEQ ID NO: 928126 - DNA, 25 bp, Mus musculus
ttcaagaagtctgttcctctctgct

SEQ ID NO: 928127 - DNA, 25 bp, Mus musculus
ttcaagaatcctaatgcagccctac

SEQ ID NO: 928128 - DNA, 25 bp, Mus musculus
ttcaagaatccttatgcagccctac

SEQ ID NO: 928129 - DNA, 25 bp, Mus musculus
ttcaagaatgggactgggagcctca

SEQ ID NO: 928130 - DNA, 25 bp, Mus musculus
ttcaagaatgggtctgggagcctca

SEQ ID NO: 928131 - DNA, 25 bp, Mus musculus
ttcaagacacctcttaacccctggg

SEQ ID NO: 928132 - DNA, 25 bp, Mus musculus
ttcaagacacctgttaacccctggg

SEQ ID NO: 928133 - DNA, 25 bp, Mus musculus
ttcaagacagatcctatccaccttc

SEQ ID NO: 928134 - DNA, 25 bp, Mus musculus
ttcaagacagatgctatccaccttc

SEQ ID NO: 928135 - DNA, 25 bp, Mus musculus
ttcaagaccagccttcacttcatgg

SEQ ID NO: 928136 - DNA, 25 bp, Mus musculus
ttcaagaccagcgttcacttcatgg

SEQ ID NO: 928137 - DNA, 25 bp, Mus musculus
ttcaagacccctcgtcctgggcaaa

SEQ ID NO: 928138 - DNA, 25 bp, Mus musculus
ttcaagacccctggtcctgggcaaa

SEQ ID NO: 928139 - DNA, 25 bp, Mus musculus
ttcaagaccctgacggctactggat

SEQ ID NO: 928140 - DNA, 25 bp, Mus musculus
ttcaagaccctgtcggctactggat

SEQ ID NO: 928141 - DNA, 25 bp, Mus musculus
ttcaagacctgcagcaactgtcagc

SEQ ID NO: 928142 - DNA, 25 bp, Mus musculus
ttcaagacctgctgcaactgtcagc

SEQ ID NO: 928143 - DNA, 25 bp, Mus musculus
ttcaagacctttaagcatcaaactg

SEQ ID NO: 928144 - DNA, 25 bp, Mus musculus
ttcaagaccttttagcatcaaactg

SEQ ID NO: 928145 - DNA, 25 bp, Mus musculus
ttcaagactcagagtttcagaagat

SEQ ID NO: 928146 - DNA, 25 bp, Mus musculus
ttcaagactcagtgtttcagaagat

SEQ ID NO: 928147 - DNA, 25 bp, Mus musculus
ttcaagactgttccggacttgtcca

SEQ ID NO: 928148 - DNA, 25 bp, Mus musculus
ttcaagactgttgcggacttgtcca

SEQ ID NO: 928149 - DNA, 25 bp, Mus musculus
ttcaagacttaacccacagtgggtt

SEQ ID NO: 928150 - DNA, 25 bp, Mus musculus
ttcaagacttaagccacagtgggtt

SEQ ID NO: 928151 - DNA, 25 bp, Mus musculus
ttcaagacttcacaacagcctctat

SEQ ID NO: 928152 - DNA, 25 bp, Mus musculus
ttcaagacttcaccacttgcatggg

SEQ ID NO: 928153 - DNA, 25 bp, Mus musculus
ttcaagacttcagaacagcctctat

SEQ ID NO: 928154 - DNA, 25 bp, Mus musculus
ttcaagacttcagcacttgcatggg

SEQ ID NO: 928155 - DNA, 25 bp, Mus musculus
ttcaagagaaacaagcctgggccaa

SEQ ID NO: 928156 - DNA, 25 bp, Mus musculus
ttcaagagaaactagcctgggccaa

SEQ ID NO: 928157 - DNA, 25 bp, Mus musculus
ttcaagagacttcagctggcacact

SEQ ID NO: 928158 - DNA, 25 bp, Mus musculus
ttcaagagacttgagctggcacact

SEQ ID NO: 928159 - DNA, 25 bp, Mus musculus
ttcaagagagacaaacccctatttt

SEQ ID NO: 928160 - DNA, 25 bp, Mus musculus
ttcaagagagactaacccctatttt

SEQ ID NO: 928161 - DNA, 25 bp, Mus musculus
ttcaagagatctcactagctctgcc

SEQ ID NO: 928162 - DNA, 25 bp, Mus musculus
ttcaagagatctgactagctctgcc

SEQ ID NO: 928163 - DNA, 25 bp, Mus musculus
ttcaagagcactacaaagacgacat

SEQ ID NO: 928164 - DNA, 25 bp, Mus musculus
ttcaagagcacttcaaagacgacat

SEQ ID NO: 928165 - DNA, 25 bp, Mus musculus
ttcaagaggctgcaggtggattccc

SEQ ID NO: 928166 - DNA, 25 bp, Mus musculus
ttcaagaggctggaggtggattccc

SEQ ID NO: 928167 - DNA, 25 bp, Mus musculus
ttcaagagggcaaacgggctgacag

SEQ ID NO: 928168 - DNA, 25 bp, Mus musculus
ttcaagagggcatacgggctgacag

SEQ ID NO: 928169 - DNA, 25 bp, Mus musculus
ttcaagagggtgctgctgtgacaat

SEQ ID NO: 928170 - DNA, 25 bp, Mus musculus
ttcaagagggtggtgctgtgacaat

SEQ ID NO: 928171 - DNA, 25 bp, Mus musculus
ttcaagaggttaaatagggcagata

SEQ ID NO: 928172 - DNA, 25 bp, Mus musculus
ttcaagaggttatatagggcagata

SEQ ID NO: 928173 - DNA, 25 bp, Mus musculus
ttcaagagtagaagttacacagcat

SEQ ID NO: 928174 - DNA, 25 bp, Mus musculus
ttcaagagtagatgttacacagcat

SEQ ID NO: 928175 - DNA, 25 bp, Mus musculus
ttcaagagtgaaaagtgccccatat

SEQ ID NO: 928176 - DNA, 25 bp, Mus musculus
ttcaagagtgaatagtgccccatat

SEQ ID NO: 928177 - DNA, 25 bp, Mus musculus
ttcaagagttttactgtcctgttgg

SEQ ID NO: 928178 - DNA, 25 bp, Mus musculus
ttcaagagtttttctgtcctgttgg

SEQ ID NO: 928179 - DNA, 25 bp, Mus musculus
ttcaagataagaatcgacgcctgga

SEQ ID NO: 928180 - DNA, 25 bp, Mus musculus
ttcaagataagattcgacgcctgga

SEQ ID NO: 928181 - DNA, 25 bp, Mus musculus
ttcaagatccgcatggaacctgacg

SEQ ID NO: 928182 - DNA, 25 bp, Mus musculus
ttcaagatccgcttggaacctgacg

SEQ ID NO: 928183 - DNA, 25 bp, Mus musculus
ttcaagatgcacaacttctctgggc

SEQ ID NO: 928184 - DNA, 25 bp, Mus musculus
ttcaagatgcacacccctagattcc

SEQ ID NO: 928185 - DNA, 25 bp, Mus musculus
ttcaagatgcactacttctctgggc

SEQ ID NO: 928186 - DNA, 25 bp, Mus musculus
ttcaagatgcactcccctagattcc

SEQ ID NO: 928187 - DNA, 25 bp, Mus musculus
ttcaagatggagcaccgaaactatt

SEQ ID NO: 928188 - DNA, 25 bp, Mus musculus
ttcaagatggaggaccgaaactatt

SEQ ID NO: 928189 - DNA, 25 bp, Mus musculus
ttcaagattgctatcactgcacacc

SEQ ID NO: 928190 - DNA, 25 bp, Mus musculus
ttcaagattgctttcactgcacacc

SEQ ID NO: 928191 - DNA, 25 bp, Mus musculus
ttcaagatttctagtggtattctga

SEQ ID NO: 928192 - DNA, 25 bp, Mus musculus
ttcaagatttcttgtggtattctga

SEQ ID NO: 928193 - DNA, 25 bp, Mus musculus
ttcaagcaacttcgtgttagccggc

SEQ ID NO: 928194 - DNA, 25 bp, Mus musculus
ttcaagcaacttggtgttagccggc

SEQ ID NO: 928195 - DNA, 25 bp, Mus musculus
ttcaagcaagtccaaacacagagtt

SEQ ID NO: 928196 - DNA, 25 bp, Mus musculus
ttcaagcaagtcgaaacacagagtt

SEQ ID NO: 928197 - DNA, 25 bp, Mus musculus
ttcaagcaagtgaagttgtcaccac

SEQ ID NO: 928198 - DNA, 25 bp, Mus musculus
ttcaagcaagtgtagttgtcaccac

SEQ ID NO: 928199 - DNA, 25 bp, Mus musculus
ttcaagcacataatcttgcagagga

SEQ ID NO: 928200 - DNA, 25 bp, Mus musculus
ttcaagcacatattcttgcagagga

SEQ ID NO: 928201 - DNA, 25 bp, Mus musculus
ttcaagcaccctcttgaccactggg

SEQ ID NO: 928202 - DNA, 25 bp, Mus musculus
ttcaagcaccctgttgaccactggg

SEQ ID NO: 928203 - DNA, 25 bp, Mus musculus
ttcaagcagacaacaaagcccttct

SEQ ID NO: 928204 - DNA, 25 bp, Mus musculus
ttcaagcagacatcaaagcccttct

SEQ ID NO: 928205 - DNA, 25 bp, Mus musculus
ttcaagcatgcacacacagtgttcc

SEQ ID NO: 928206 - DNA, 25 bp, Mus musculus
ttcaagcatgcagacacagtgttcc

SEQ ID NO: 928207 - DNA, 25 bp, Mus musculus
ttcaagccactactgtatggacttc

SEQ ID NO: 928208 - DNA, 25 bp, Mus musculus
ttcaagccactagtgtatggacttc

SEQ ID NO: 928209 - DNA, 25 bp, Mus musculus
ttcaagccagtcattaactcagtgt

SEQ ID NO: 928210 - DNA, 25 bp, Mus musculus
ttcaagccagtctttaactcagtgt

SEQ ID NO: 928211 - DNA, 25 bp, Mus musculus
ttcaagcccatcactgtgctgtatg

SEQ ID NO: 928212 - DNA, 25 bp, Mus musculus
ttcaagcccatctctgtgctgtatg

SEQ ID NO: 928213 - DNA, 25 bp, Mus musculus
ttcaagcccattccacatgtactga

SEQ ID NO: 928214 - DNA, 25 bp, Mus musculus
ttcaagcccattctctccaaggata

SEQ ID NO: 928215 - DNA, 25 bp, Mus musculus
ttcaagcccattgcacatgtactga

SEQ ID NO: 928216 - DNA, 25 bp, Mus musculus
ttcaagcccattgtctccaaggata

SEQ ID NO: 928217 - DNA, 25 bp, Mus musculus
ttcaagccccgaaacacagtagagc

SEQ ID NO: 928218 - DNA, 25 bp, Mus musculus
ttcaagccccgatacacagtagagc

SEQ ID NO: 928219 - DNA, 25 bp, Mus musculus
ttcaagccctccctggtgggttgca

SEQ ID NO: 928220 - DNA, 25 bp, Mus musculus
ttcaagccctccgtggtgggttgca

SEQ ID NO: 928221 - DNA, 25 bp, Mus musculus
ttcaagccctgaatatgagcagctg

SEQ ID NO: 928222 - DNA, 25 bp, Mus musculus
ttcaagccctgattatgagcagctg

SEQ ID NO: 928223 - DNA, 25 bp, Mus musculus
ttcaagccgaggagcgccaagagga

SEQ ID NO: 928224 - DNA, 25 bp, Mus musculus
ttcaagccgaggtgcgccaagagga

SEQ ID NO: 928225 - DNA, 25 bp, Mus musculus
ttcaagcctctgctttttactacac

SEQ ID NO: 928226 - DNA, 25 bp, Mus musculus
ttcaagcctctggtttttactacac

SEQ ID NO: 928227 - DNA, 25 bp, Mus musculus
ttcaagcctcttaccaccatttaaa

SEQ ID NO: 928228 - DNA, 25 bp, Mus musculus
ttcaagcctctttccaccatttaaa

SEQ ID NO: 928229 - DNA, 25 bp, Mus musculus
ttcaagccttcacaaacaccaagta

SEQ ID NO: 928230 - DNA, 25 bp, Mus musculus
ttcaagccttcagaaacaccaagta

SEQ ID NO: 928231 - DNA, 25 bp, Mus musculus
ttcaagcctttcagtttcaacacac

SEQ ID NO: 928232 - DNA, 25 bp, Mus musculus
ttcaagcctttctgtttcaacacac

SEQ ID NO: 928233 - DNA, 25 bp, Mus musculus
ttcaagcgccttacctgagttctaa

SEQ ID NO: 928234 - DNA, 25 bp, Mus musculus
ttcaagcgcctttcctgagttctaa

SEQ ID NO: 928235 - DNA, 25 bp, Mus musculus
ttcaagctacttacagagggccact

SEQ ID NO: 928236 - DNA, 25 bp, Mus musculus
ttcaagctactttcagagggccact

SEQ ID NO: 928237 - DNA, 25 bp, Mus musculus
ttcaagctagttacgatcctgtgtt

SEQ ID NO: 928238 - DNA, 25 bp, Mus musculus
ttcaagctagtttcgatcctgtgtt

SEQ ID NO: 928239 - DNA, 25 bp, Mus musculus
ttcaagctccatctcttgttttaat

SEQ ID NO: 928240 - DNA, 25 bp, Mus musculus
ttcaagctccatgtcttgttttaat

SEQ ID NO: 928241 - DNA, 25 bp, Mus musculus
ttcaagctctatccctctcttggag

SEQ ID NO: 928242 - DNA, 25 bp, Mus musculus
ttcaagctctatgcctctcttggag

SEQ ID NO: 928243 - DNA, 25 bp, Mus musculus
ttcaagctctctaacgcatcactgt

SEQ ID NO: 928244 - DNA, 25 bp, Mus musculus
ttcaagctctcttacgcatcactgt

SEQ ID NO: 928245 - DNA, 25 bp, Mus musculus
ttcaagcttagcaacaggcactgtt

SEQ ID NO: 928246 - DNA, 25 bp, Mus musculus
ttcaagcttagctacaggcactgtt

SEQ ID NO: 928247 - DNA, 25 bp, Mus musculus
ttcaagcttcaccttatcagaggac

SEQ ID NO: 928248 - DNA, 25 bp, Mus musculus
ttcaagcttcacgttatcagaggac

SEQ ID NO: 928249 - DNA, 25 bp, Mus musculus
ttcaagcttcttaatgtttctctgt

SEQ ID NO: 928250 - DNA, 25 bp, Mus musculus
ttcaagcttctttatgtttctctgt

SEQ ID NO: 928251 - DNA, 25 bp, Mus musculus
ttcaagcttggacccattcattaac

SEQ ID NO: 928252 - DNA, 25 bp, Mus musculus
ttcaagcttggagccattcattaac

SEQ ID NO: 928253 - DNA, 25 bp, Mus musculus
ttcaagcttggtacactgaggtggt

SEQ ID NO: 928254 - DNA, 25 bp, Mus musculus
ttcaagcttggttcactgaggtggt

SEQ ID NO: 928255 - DNA, 25 bp, Mus musculus
ttcaaggaaatcaacagctcacatt

SEQ ID NO: 928256 - DNA, 25 bp, Mus musculus
ttcaaggaaatctacagctcacatt

SEQ ID NO: 928257 - DNA, 25 bp, Mus musculus
ttcaaggaacccatcctgattctac

SEQ ID NO: 928258 - DNA, 25 bp, Mus musculus
ttcaaggaacccttcctgattctac

SEQ ID NO: 928259 - DNA, 25 bp, Mus musculus
ttcaaggaagttcgcttggtaccgg

SEQ ID NO: 928260 - DNA, 25 bp, Mus musculus
ttcaaggaagttggcttggtaccgg

SEQ ID NO: 928261 - DNA, 25 bp, Mus musculus
ttcaaggaatagactccgtccaggg

SEQ ID NO: 928262 - DNA, 25 bp, Mus musculus
ttcaaggaatagtctccgtccaggg

SEQ ID NO: 928263 - DNA, 25 bp, Mus musculus
ttcaaggacactcgacctctgggtt

SEQ ID NO: 928264 - DNA, 25 bp, Mus musculus
ttcaaggacactggacctctgggtt

SEQ ID NO: 928265 - DNA, 25 bp, Mus musculus
ttcaaggactacagcccctagagta

SEQ ID NO: 928266 - DNA, 25 bp, Mus musculus
ttcaaggactactgcccctagagta

SEQ ID NO: 928267 - DNA, 25 bp, Mus musculus
ttcaaggagcggactcggagcctgc

SEQ ID NO: 928268 - DNA, 25 bp, Mus musculus
ttcaaggagcggtctcggagcctgc

SEQ ID NO: 928269 - DNA, 25 bp, Mus musculus
ttcaaggcaaataaaatcccctcgt

SEQ ID NO: 928270 - DNA, 25 bp, Mus musculus
ttcaaggcaaattaaatcccctcgt

SEQ ID NO: 928271 - DNA, 25 bp, Mus musculus
ttcaaggcattcatcggtggtcctg

SEQ ID NO: 928272 - DNA, 25 bp, Mus musculus
ttcaaggcattcttcggtggtcctg

SEQ ID NO: 928273 - DNA, 25 bp, Mus musculus
ttcaaggccagactgctgctcgagt

SEQ ID NO: 928274 - DNA, 25 bp, Mus musculus
ttcaaggccagagtgctgctcgagt

SEQ ID NO: 928275 - DNA, 25 bp, Mus musculus
ttcaaggccttgaacccagaaggat

SEQ ID NO: 928276 - DNA, 25 bp, Mus musculus
ttcaaggccttgtacccagaaggat

SEQ ID NO: 928277 - DNA, 25 bp, Mus musculus
ttcaaggcctttactcatgccctgt

SEQ ID NO: 928278 - DNA, 25 bp, Mus musculus
ttcaaggccttttctcatgccctgt

SEQ ID NO: 928279 - DNA, 25 bp, Mus musculus
ttcaaggctatcagtgttcataact

SEQ ID NO: 928280 - DNA, 25 bp, Mus musculus
ttcaaggctatctgtgttcataact

SEQ ID NO: 928281 - DNA, 25 bp, Mus musculus
ttcaaggctcagagttaggcagact

SEQ ID NO: 928282 - DNA, 25 bp, Mus musculus
ttcaaggctcagtgttaggcagact

SEQ ID NO: 928283 - DNA, 25 bp, Mus musculus
ttcaaggctggcataagtataaatt

SEQ ID NO: 928284 - DNA, 25 bp, Mus musculus
ttcaaggctggcttaagtataaatt

SEQ ID NO: 928285 - DNA, 25 bp, Mus musculus
ttcaaggctgtcagcgagttcccag

SEQ ID NO: 928286 - DNA, 25 bp, Mus musculus
ttcaaggctgtctgcgagttcccag

SEQ ID NO: 928287 - DNA, 25 bp, Mus musculus
ttcaaggctgtgctcacggccgcta

SEQ ID NO: 928288 - DNA, 25 bp, Mus musculus
ttcaaggctgtggtcacggccgcta

SEQ ID NO: 928289 - DNA, 25 bp, Mus musculus
ttcaaggcttggctttctctatcag

SEQ ID NO: 928290 - DNA, 25 bp, Mus musculus
ttcaaggcttgggtttctctatcag

SEQ ID NO: 928291 - DNA, 25 bp, Mus musculus
ttcaagggacaaacactggtgtacc

SEQ ID NO: 928292 - DNA, 25 bp, Mus musculus
ttcaagggacaatcactggtgtacc

SEQ ID NO: 928293 - DNA, 25 bp, Mus musculus
ttcaagggactcacaactccacatg

SEQ ID NO: 928294 - DNA, 25 bp, Mus musculus
ttcaagggactctcaactccacatg

SEQ ID NO: 928295 - DNA, 25 bp, Mus musculus
ttcaagggcttcattgagctgttcc

SEQ ID NO: 928296 - DNA, 25 bp, Mus musculus
ttcaagggcttctttgagctgttcc

SEQ ID NO: 928297 - DNA, 25 bp, Mus musculus
ttcaagggttgccaatcttcaccgt

SEQ ID NO: 928298 - DNA, 25 bp, Mus musculus
ttcaagggttgcgaatcttcaccgt

SEQ ID NO: 928299 - DNA, 25 bp, Mus musculus
ttcaaggtaacaccgaccgtgccca

SEQ ID NO: 928300 - DNA, 25 bp, Mus musculus
ttcaaggtaacagcgaccgtgccca

SEQ ID NO: 928301 - DNA, 25 bp, Mus musculus
ttcaaggtactcctgcctgaagagg

SEQ ID NO: 928302 - DNA, 25 bp, Mus musculus
ttcaaggtactcgtgcctgaagagg

SEQ ID NO: 928303 - DNA, 25 bp, Mus musculus
ttcaaggtagtgatctggctgggct

SEQ ID NO: 928304 - DNA, 25 bp, Mus musculus
ttcaaggtagtgttctggctgggct

SEQ ID NO: 928305 - DNA, 25 bp, Mus musculus
ttcaaggtataaactgtcagctcat

SEQ ID NO: 928306 - DNA, 25 bp, Mus musculus
ttcaaggtataatctgtcagctcat

SEQ ID NO: 928307 - DNA, 25 bp, Mus musculus
ttcaaggtccagatcaagttccaga

SEQ ID NO: 928308 - DNA, 25 bp, Mus musculus
ttcaaggtccagttcaagttccaga

SEQ ID NO: 928309 - DNA, 25 bp, Mus musculus
ttcaaggtcttgacgatgttcgcat

SEQ ID NO: 928310 - DNA, 25 bp, Mus musculus
ttcaaggtcttgtcgatgttcgcat

SEQ ID NO: 928311 - DNA, 25 bp, Mus musculus
ttcaaggtgaaactacatatttggc

SEQ ID NO: 928312 - DNA, 25 bp, Mus musculus
ttcaaggtgaaagtacatatttggc

SEQ ID NO: 928313 - DNA, 25 bp, Mus musculus
ttcaaggtgacgatgcctgacggac

SEQ ID NO: 928314 - DNA, 25 bp, Mus musculus
ttcaaggtgacgttgcctgacggac

SEQ ID NO: 928315 - DNA, 25 bp, Mus musculus
ttcaaggtgatgagggttcagttcc

SEQ ID NO: 928316 - DNA, 25 bp, Mus musculus
ttcaaggtgatgtgggttcagttcc

SEQ ID NO: 928317 - DNA, 25 bp, Mus musculus
ttcaaggtgccaaactcggaattag

SEQ ID NO: 928318 - DNA, 25 bp, Mus musculus
ttcaaggtgccatactcggaattag

SEQ ID NO: 928319 - DNA, 25 bp, Mus musculus
ttcaaggtgtaaccaatccctgccc

SEQ ID NO: 928320 - DNA, 25 bp, Mus musculus
ttcaaggtgtaagcaatccctgccc

SEQ ID NO: 928321 - DNA, 25 bp, Mus musculus
ttcaaggtgtttagtgctgcagaat

SEQ ID NO: 928322 - DNA, 25 bp, Mus musculus
ttcaaggtgttttgtgctgcagaat

SEQ ID NO: 928323 - DNA, 25 bp, Mus musculus
ttcaaggttactacgcggagtgggc

SEQ ID NO: 928324 - DNA, 25 bp, Mus musculus
ttcaaggttacttcgcggagtgggc

SEQ ID NO: 928325 - DNA, 25 bp, Mus musculus
ttcaaggttcatcttcaagggccac

SEQ ID NO: 928326 - DNA, 25 bp, Mus musculus
ttcaaggttcatcttgacccactgc

SEQ ID NO: 928327 - DNA, 25 bp, Mus musculus
ttcaaggttcatgttcaagggccac

SEQ ID NO: 928328 - DNA, 25 bp, Mus musculus
ttcaaggttcatgttgacccactgc

SEQ ID NO: 928329 - DNA, 25 bp, Mus musculus
ttcaagtaacacagcatttgctcca

SEQ ID NO: 928330 - DNA, 25 bp, Mus musculus
ttcaagtaacactgcatttgctcca

SEQ ID NO: 928331 - DNA, 25 bp, Mus musculus
ttcaagtagatgaagccatacccac

SEQ ID NO: 928332 - DNA, 25 bp, Mus musculus
ttcaagtagatgtagccatacccac

SEQ ID NO: 928333 - DNA, 25 bp, Mus musculus
ttcaagtataccctgtgttagtgcc

SEQ ID NO: 928334 - DNA, 25 bp, Mus musculus
ttcaagtataccgtgtgttagtgcc

SEQ ID NO: 928335 - DNA, 25 bp, Mus musculus
ttcaagtatcgcagttcacttagag

SEQ ID NO: 928336 - DNA, 25 bp, Mus musculus
ttcaagtatcgctgttcacttagag

SEQ ID NO: 928337 - DNA, 25 bp, Mus musculus
ttcaagtatgggagactctgggttg

SEQ ID NO: 928338 - DNA, 25 bp, Mus musculus
ttcaagtatgggtgactctgggttg

SEQ ID NO: 928339 - DNA, 25 bp, Mus musculus
ttcaagtcaaccctctttctgtttt

SEQ ID NO: 928340 - DNA, 25 bp, Mus musculus
ttcaagtcaaccgtctttctgtttt

SEQ ID NO: 928341 - DNA, 25 bp, Mus musculus
ttcaagtcagtgctcgatgctctct

SEQ ID NO: 928342 - DNA, 25 bp, Mus musculus
ttcaagtcagtggtcgatgctctct

SEQ ID NO: 928343 - DNA, 25 bp, Mus musculus
ttcaagtcattcctaccgattctgc

SEQ ID NO: 928344 - DNA, 25 bp, Mus musculus
ttcaagtcattcgtaccgattctgc

SEQ ID NO: 928345 - DNA, 25 bp, Mus musculus
ttcaagtcctatcaggacttccctc

SEQ ID NO: 928346 - DNA, 25 bp, Mus musculus
ttcaagtcctatctttacatcctct

SEQ ID NO: 928347 - DNA, 25 bp, Mus musculus
ttcaagtcctatgaggacttccctc

SEQ ID NO: 928348 - DNA, 25 bp, Mus musculus
ttcaagtcctatgtttacatcctct

SEQ ID NO: 928349 - DNA, 25 bp, Mus musculus
ttcaagtctgacatgttttctgcct

SEQ ID NO: 928350 - DNA, 25 bp, Mus musculus
ttcaagtctgacttgttttctgcct

SEQ ID NO: 928351 - DNA, 25 bp, Mus musculus
ttcaagtctgctcccaaattcacag

SEQ ID NO: 928352 - DNA, 25 bp, Mus musculus
ttcaagtctgctgccaaattcacag

SEQ ID NO: 928353 - DNA, 25 bp, Mus musculus
ttcaagtctgtaataaccatagctt

SEQ ID NO: 928354 - DNA, 25 bp, Mus musculus
ttcaagtctgtattaaccatagctt

SEQ ID NO: 928355 - DNA, 25 bp, Mus musculus
ttcaagtcttggagctcggaactct

SEQ ID NO: 928356 - DNA, 25 bp, Mus musculus
ttcaagtcttggtgctcggaactct

SEQ ID NO: 928357 - DNA, 25 bp, Mus musculus
ttcaagtgaatcaaaggctttacct

SEQ ID NO: 928358 - DNA, 25 bp, Mus musculus
ttcaagtgaatctaaggctttacct

SEQ ID NO: 928359 - DNA, 25 bp, Mus musculus
ttcaagtgccatagctatgcctgca

SEQ ID NO: 928360 - DNA, 25 bp, Mus musculus
ttcaagtgccattgctatgcctgca

SEQ ID NO: 928361 - DNA, 25 bp, Mus musculus
ttcaagtgtgctagtacacgcctgg

SEQ ID NO: 928362 - DNA, 25 bp, Mus musculus
ttcaagtgtgcttgtacacgcctgg

SEQ ID NO: 928363 - DNA, 25 bp, Mus musculus
ttcaagttcctcaccgaggagctgt

SEQ ID NO: 928364 - DNA, 25 bp, Mus musculus
ttcaagttcctctccgaggagctgt

SEQ ID NO: 928365 - DNA, 25 bp, Mus musculus
ttcaagttcgcacggacgtcacgtc

SEQ ID NO: 928366 - DNA, 25 bp, Mus musculus
ttcaagttcgcagggacgtcacgtc

SEQ ID NO: 928367 - DNA, 25 bp, Mus musculus
ttcaagttctgacataccagtgttt

SEQ ID NO: 928368 - DNA, 25 bp, Mus musculus
ttcaagttctgagataccagtgttt

SEQ ID NO: 928369 - DNA, 25 bp, Mus musculus
ttcaagttgactctcctgatgccca

SEQ ID NO: 928370 - DNA, 25 bp, Mus musculus
ttcaagttgactgtcctgatgccca

SEQ ID NO: 928371 - DNA, 25 bp, Mus musculus
ttcaagttgccactctatagagaca

SEQ ID NO: 928372 - DNA, 25 bp, Mus musculus
ttcaagttgccagtctatagagaca

SEQ ID NO: 928373 - DNA, 25 bp, Mus musculus
ttcaagttggccagacccagaagaa

SEQ ID NO: 928374 - DNA, 25 bp, Mus musculus
ttcaagttggcctgacccagaagaa

SEQ ID NO: 928375 - DNA, 25 bp, Mus musculus
ttcaagttgggtatcccgagagcca

SEQ ID NO: 928376 - DNA, 25 bp, Mus musculus
ttcaagttgggtttcccgagagcca

SEQ ID NO: 928377 - DNA, 25 bp, Mus musculus
ttcaagtttcctcggttccactatt

SEQ ID NO: 928378 - DNA, 25 bp, Mus musculus
ttcaagtttcctgggttccactatt

SEQ ID NO: 928379 - DNA, 25 bp, Mus musculus
ttcaagtttttacagctacatttct

SEQ ID NO: 928380 - DNA, 25 bp, Mus musculus
ttcaagtttttagagctacatttct

SEQ ID NO: 928381 - DNA, 25 bp, Mus musculus
ttcaataacctcatgtcacagggtt

SEQ ID NO: 928382 - DNA, 25 bp, Mus musculus
ttcaataacctcttgtcacagggtt

SEQ ID NO: 928383 - DNA, 25 bp, Mus musculus
ttcaataacgacatgctccttgcct

SEQ ID NO: 928384 - DNA, 25 bp, Mus musculus
ttcaataacgacttgctccttgcct

SEQ ID NO: 928385 - DNA, 25 bp, Mus musculus
ttcaataaggaaaggccttgcaatt

SEQ ID NO: 928386 - DNA, 25 bp, Mus musculus
ttcaataaggaatggccttgcaatt

SEQ ID NO: 928387 - DNA, 25 bp, Mus musculus
ttcaataccacgacttttgcagccc

SEQ ID NO: 928388 - DNA, 25 bp, Mus musculus
ttcaataccacgtcttttgcagccc

SEQ ID NO: 928389 - DNA, 25 bp, Mus musculus
ttcaatacctgtaaacactgctttt

SEQ ID NO: 928390 - DNA, 25 bp, Mus musculus
ttcaatacctgttaacactgctttt

SEQ ID NO: 928391 - DNA, 25 bp, Mus musculus
ttcaatacgatgcaatcccagctca

SEQ ID NO: 928392 - DNA, 25 bp, Mus musculus
ttcaatacgatggaatcccagctca

SEQ ID NO: 928393 - DNA, 25 bp, Mus musculus
ttcaatagccaactgattccttcca

SEQ ID NO: 928394 - DNA, 25 bp, Mus musculus
ttcaatagccaagtgattccttcca

SEQ ID NO: 928395 - DNA, 25 bp, Mus musculus
ttcaatagccttattgggctcccgg

SEQ ID NO: 928396 - DNA, 25 bp, Mus musculus
ttcaatagcctttttgggctcccgg

SEQ ID NO: 928397 - DNA, 25 bp, Mus musculus
ttcaatatactgatttctcccctgt

SEQ ID NO: 928398 - DNA, 25 bp, Mus musculus
ttcaatatactgttttctcccctgt

SEQ ID NO: 928399 - DNA, 25 bp, Mus musculus
ttcaatatatctatggtgctacctc

SEQ ID NO: 928400 - DNA, 25 bp, Mus musculus
ttcaatatatctttggtgctacctc

SEQ ID NO: 928401 - DNA, 25 bp, Mus musculus
ttcaatatcactcgatccctcagtc

SEQ ID NO: 928402 - DNA, 25 bp, Mus musculus
ttcaatatcactggatccctcagtc

SEQ ID NO: 928403 - DNA, 25 bp, Mus musculus
ttcaatatccctcaaagctgcagtc

SEQ ID NO: 928404 - DNA, 25 bp, Mus musculus
ttcaatatccctgaaagctgcagtc

SEQ ID NO: 928405 - DNA, 25 bp, Mus musculus
ttcaatatttaacaccatgcctggc

SEQ ID NO: 928406 - DNA, 25 bp, Mus musculus
ttcaatatttaagaccatgcctggc

SEQ ID NO: 928407 - DNA, 25 bp, Mus musculus
ttcaatcacctacagctgcacgagc

SEQ ID NO: 928408 - DNA, 25 bp, Mus musculus
ttcaatcacctagagctgcacgagc

SEQ ID NO: 928409 - DNA, 25 bp, Mus musculus
ttcaatcactgcacttatcttaata

SEQ ID NO: 928410 - DNA, 25 bp, Mus musculus
ttcaatcactgcatggaaacatgat

SEQ ID NO: 928411 - DNA, 25 bp, Mus musculus
ttcaatcactgctcttatcttaata

SEQ ID NO: 928412 - DNA, 25 bp, Mus musculus
ttcaatcactgcttggaaacatgat

SEQ ID NO: 928413 - DNA, 25 bp, Mus musculus
ttcaatcagaacacgtggttggcat

SEQ ID NO: 928414 - DNA, 25 bp, Mus musculus
ttcaatcagaactcgtggttggcat

SEQ ID NO: 928415 - DNA, 25 bp, Mus musculus
ttcaatcaggaacggagccacagtt

SEQ ID NO: 928416 - DNA, 25 bp, Mus musculus
ttcaatcaggaagggagccacagtt

SEQ ID NO: 928417 - DNA, 25 bp, Mus musculus
ttcaatcatttcaagtgagttctgc

SEQ ID NO: 928418 - DNA, 25 bp, Mus musculus
ttcaatcatttctagtgagttctgc

SEQ ID NO: 928419 - DNA, 25 bp, Mus musculus
ttcaatcccaacaaccaaatgaagg

SEQ ID NO: 928420 - DNA, 25 bp, Mus musculus
ttcaatcccaactaccaaatgaagg

SEQ ID NO: 928421 - DNA, 25 bp, Mus musculus
ttcaatccccagagcacagataata

SEQ ID NO: 928422 - DNA, 25 bp, Mus musculus
ttcaatccccagtgcacagataata

SEQ ID NO: 928423 - DNA, 25 bp, Mus musculus
ttcaatccccataccttattattac

SEQ ID NO: 928424 - DNA, 25 bp, Mus musculus
ttcaatccccattccttattattac

SEQ ID NO: 928425 - DNA, 25 bp, Mus musculus
ttcaatccctggaggcgtctatgca

SEQ ID NO: 928426 - DNA, 25 bp, Mus musculus
ttcaatccctggcactgcctaaaat

SEQ ID NO: 928427 - DNA, 25 bp, Mus musculus
ttcaatccctgggactgcctaaaat

SEQ ID NO: 928428 - DNA, 25 bp, Mus musculus
ttcaatccctggtggcgtctatgca

SEQ ID NO: 928429 - DNA, 25 bp, Mus musculus
ttcaatccggaaccaaactctaaat

SEQ ID NO: 928430 - DNA, 25 bp, Mus musculus
ttcaatccggaagcaaactctaaat

SEQ ID NO: 928431 - DNA, 25 bp, Mus musculus
ttcaatcgatataagcaagtctcca

SEQ ID NO: 928432 - DNA, 25 bp, Mus musculus
ttcaatcgatattagcaagtctcca

SEQ ID NO: 928433 - DNA, 25 bp, Mus musculus
ttcaatcggatcattggtggttttc

SEQ ID NO: 928434 - DNA, 25 bp, Mus musculus
ttcaatcggatctttggtggttttc

SEQ ID NO: 928435 - DNA, 25 bp, Mus musculus
ttcaatcggccacccaacctgaaga

SEQ ID NO: 928436 - DNA, 25 bp, Mus musculus
ttcaatcggccagccaacctgaaga

SEQ ID NO: 928437 - DNA, 25 bp, Mus musculus
ttcaatctcactcctgtttggctga

SEQ ID NO: 928438 - DNA, 25 bp, Mus musculus
ttcaatctcactgctgtttggctga

SEQ ID NO: 928439 - DNA, 25 bp, Mus musculus
ttcaatctgacaaagagccctaggt

SEQ ID NO: 928440 - DNA, 25 bp, Mus musculus
ttcaatctgacatagagccctaggt

SEQ ID NO: 928441 - DNA, 25 bp, Mus musculus
ttcaatctggcaagtcttcacacca

SEQ ID NO: 928442 - DNA, 25 bp, Mus musculus
ttcaatctggcatgtcttcacacca

SEQ ID NO: 928443 - DNA, 25 bp, Mus musculus
ttcaatcttagcctttggaaatcag

SEQ ID NO: 928444 - DNA, 25 bp, Mus musculus
ttcaatcttagcgtttggaaatcag

SEQ ID NO: 928445 - DNA, 25 bp, Mus musculus
ttcaatctttagaactgcaacaaac

SEQ ID NO: 928446 - DNA, 25 bp, Mus musculus
ttcaatctttagtactgcaacaaac

SEQ ID NO: 928447 - DNA, 25 bp, Mus musculus
ttcaatgaccagaacggcctcttct

SEQ ID NO: 928448 - DNA, 25 bp, Mus musculus
ttcaatgaccagtacggcctcttct

SEQ ID NO: 928449 - DNA, 25 bp, Mus musculus
ttcaatgactccatcgtccatgtta

SEQ ID NO: 928450 - DNA, 25 bp, Mus musculus
ttcaatgactccttcgtccatgtta

SEQ ID NO: 928451 - DNA, 25 bp, Mus musculus
ttcaatgagctgatggcttgaggca

SEQ ID NO: 928452 - DNA, 25 bp, Mus musculus
ttcaatgagctgttggcttgaggca

SEQ ID NO: 928453 - DNA, 25 bp, Mus musculus
ttcaatgaggaaagccatctctcct

SEQ ID NO: 928454 - DNA, 25 bp, Mus musculus
ttcaatgaggaatgccatctctcct

SEQ ID NO: 928455 - DNA, 25 bp, Mus musculus
ttcaatgattccagtgtcacaccca

SEQ ID NO: 928456 - DNA, 25 bp, Mus musculus
ttcaatgattcctgtgtcacaccca

SEQ ID NO: 928457 - DNA, 25 bp, Mus musculus
ttcaatgcaactcgaattctttatc

SEQ ID NO: 928458 - DNA, 25 bp, Mus musculus
ttcaatgcaactggaattctttatc

SEQ ID NO: 928459 - DNA, 25 bp, Mus musculus
ttcaatgcactgaccagaaggcggc

SEQ ID NO: 928460 - DNA, 25 bp, Mus musculus
ttcaatgcactgtccagaaggcggc

SEQ ID NO: 928461 - DNA, 25 bp, Mus musculus
ttcaatgcagaaatcatgctaccca

SEQ ID NO: 928462 - DNA, 25 bp, Mus musculus
ttcaatgcagaattcatgctaccca

SEQ ID NO: 928463 - DNA, 25 bp, Mus musculus
ttcaatgcagccctgttgcagctgg

SEQ ID NO: 928464 - DNA, 25 bp, Mus musculus
ttcaatgcagccgtgttgcagctgg

SEQ ID NO: 928465 - DNA, 25 bp, Mus musculus
ttcaatgcatggctaacagaggatt

SEQ ID NO: 928466 - DNA, 25 bp, Mus musculus
ttcaatgcatgggtaacagaggatt

SEQ ID NO: 928467 - DNA, 25 bp, Mus musculus
ttcaatgccactattaggttcaaga

SEQ ID NO: 928468 - DNA, 25 bp, Mus musculus
ttcaatgccactatttcagagatga

SEQ ID NO: 928469 - DNA, 25 bp, Mus musculus
ttcaatgccacttttaggttcaaga

SEQ ID NO: 928470 - DNA, 25 bp, Mus musculus
ttcaatgccactttttcagagatga

SEQ ID NO: 928471 - DNA, 25 bp, Mus musculus
ttcaatgccctacgttacgtccaag

SEQ ID NO: 928472 - DNA, 25 bp, Mus musculus
ttcaatgccctaggttacgtccaag

SEQ ID NO: 928473 - DNA, 25 bp, Mus musculus
ttcaatgccctcacaattcttttat

SEQ ID NO: 928474 - DNA, 25 bp, Mus musculus
ttcaatgccctctcaattcttttat

SEQ ID NO: 928475 - DNA, 25 bp, Mus musculus
ttcaatgcctaactccttgtacatg

SEQ ID NO: 928476 - DNA, 25 bp, Mus musculus
ttcaatgcctaagtccttgtacatg

SEQ ID NO: 928477 - DNA, 25 bp, Mus musculus
ttcaatgcctgcctgcaaatttcag

SEQ ID NO: 928478 - DNA, 25 bp, Mus musculus
ttcaatgcctgcgtgcaaatttcag

SEQ ID NO: 928479 - DNA, 25 bp, Mus musculus
ttcaatgccttccatgctgatggga

SEQ ID NO: 928480 - DNA, 25 bp, Mus musculus
ttcaatgccttcgatgctgatggga

SEQ ID NO: 928481 - DNA, 25 bp, Mus musculus
ttcaatgctaagacttgccttttat

SEQ ID NO: 928482 - DNA, 25 bp, Mus musculus
ttcaatgctaagtcttgccttttat

SEQ ID NO: 928483 - DNA, 25 bp, Mus musculus
ttcaatgctactaagggcttcccct

SEQ ID NO: 928484 - DNA, 25 bp, Mus musculus
ttcaatgctacttagggcttcccct

SEQ ID NO: 928485 - DNA, 25 bp, Mus musculus
ttcaatgctccacccgtgcctaaag

SEQ ID NO: 928486 - DNA, 25 bp, Mus musculus
ttcaatgctccagccgtgcctaaag

SEQ ID NO: 928487 - DNA, 25 bp, Mus musculus
ttcaatgctggcagggtcatccaaa

SEQ ID NO: 928488 - DNA, 25 bp, Mus musculus
ttcaatgctggctgggtcatccaaa

SEQ ID NO: 928489 - DNA, 25 bp, Mus musculus
ttcaatggacttcatagactatctt

SEQ ID NO: 928490 - DNA, 25 bp, Mus musculus
ttcaatggacttgatagactatctt

SEQ ID NO: 928491 - DNA, 25 bp, Mus musculus
ttcaatggcagcacatacttcacct

SEQ ID NO: 928492 - DNA, 25 bp, Mus musculus
ttcaatggcagctcatacttcacct

SEQ ID NO: 928493 - DNA, 25 bp, Mus musculus
ttcaatggcctgcccgctgtacgag

SEQ ID NO: 928494 - DNA, 25 bp, Mus musculus
ttcaatggcctggccgctgtacgag

SEQ ID NO: 928495 - DNA, 25 bp, Mus musculus
ttcaatggtagtatgcactattctt

SEQ ID NO: 928496 - DNA, 25 bp, Mus musculus
ttcaatggtagtttgcactattctt

SEQ ID NO: 928497 - DNA, 25 bp, Mus musculus
ttcaatggtccacatgccaactcac

SEQ ID NO: 928498 - DNA, 25 bp, Mus musculus
ttcaatggtccagatgccaactcac

SEQ ID NO: 928499 - DNA, 25 bp, Mus musculus
ttcaatggtcccatgagcagtgggt

SEQ ID NO: 928500 - DNA, 25 bp, Mus musculus
ttcaatggtcccttgagcagtgggt

SEQ ID NO: 928501 - DNA, 25 bp, Mus musculus
ttcaatggttggcacaatggcaata

SEQ ID NO: 928502 - DNA, 25 bp, Mus musculus
ttcaatggttgggacaatggcaata

SEQ ID NO: 928503 - DNA, 25 bp, Mus musculus
ttcaatgtcctcacaactggctgat

SEQ ID NO: 928504 - DNA, 25 bp, Mus musculus
ttcaatgtcctctcaactggctgat

SEQ ID NO: 928505 - DNA, 25 bp, Mus musculus
ttcaatgtcctgacctacctgaaga

SEQ ID NO: 928506 - DNA, 25 bp, Mus musculus
ttcaatgtcctgtcctacctgaaga

SEQ ID NO: 928507 - DNA, 25 bp, Mus musculus
ttcaatgtctggaagctcctgtcct

SEQ ID NO: 928508 - DNA, 25 bp, Mus musculus
ttcaatgtctggtagctcctgtcct

SEQ ID NO: 928509 - DNA, 25 bp, Mus musculus
ttcaatgttttcaaagcctcgagga

SEQ ID NO: 928510 - DNA, 25 bp, Mus musculus
ttcaatgttttcctttaatagtgtt

SEQ ID NO: 928511 - DNA, 25 bp, Mus musculus
ttcaatgttttcgtttaatagtgtt

SEQ ID NO: 928512 - DNA, 25 bp, Mus musculus
ttcaatgttttctaagcctcgagga

SEQ ID NO: 928513 - DNA, 25 bp, Mus musculus
ttcaattacaaaccggcagcagcca

SEQ ID NO: 928514 - DNA, 25 bp, Mus musculus
ttcaattacaaagcggcagcagcca

SEQ ID NO: 928515 - DNA, 25 bp, Mus musculus
ttcaattagcttaagttgtacaata

SEQ ID NO: 928516 - DNA, 25 bp, Mus musculus
ttcaattagctttagttgtacaata

SEQ ID NO: 928517 - DNA, 25 bp, Mus musculus
ttcaattaggtcagcaaaccctccc

SEQ ID NO: 928518 - DNA, 25 bp, Mus musculus
ttcaattaggtctgcaaaccctccc

SEQ ID NO: 928519 - DNA, 25 bp, Mus musculus
ttcaattatgtcagtggctgagtac

SEQ ID NO: 928520 - DNA, 25 bp, Mus musculus
ttcaattatgtctgtggctgagtac

SEQ ID NO: 928521 - DNA, 25 bp, Mus musculus
ttcaattattgtaagtcccctcctg

SEQ ID NO: 928522 - DNA, 25 bp, Mus musculus
ttcaattattgttagtcccctcctg

SEQ ID NO: 928523 - DNA, 25 bp, Mus musculus
ttcaattccctgaactgccaaaatg

SEQ ID NO: 928524 - DNA, 25 bp, Mus musculus
ttcaattccctgtactgccaaaatg

SEQ ID NO: 928525 - DNA, 25 bp, Mus musculus
ttcaattcctttaaccctgtacgag

SEQ ID NO: 928526 - DNA, 25 bp, Mus musculus
ttcaattccttttaccctgtacgag

SEQ ID NO: 928527 - DNA, 25 bp, Mus musculus
ttcaattgcttgagggaatgcgaac

SEQ ID NO: 928528 - DNA, 25 bp, Mus musculus
ttcaattgcttgtgggaatgcgaac

SEQ ID NO: 928529 - DNA, 25 bp, Mus musculus
ttcaattggagcatttgctttcttc

SEQ ID NO: 928530 - DNA, 25 bp, Mus musculus
ttcaattggagcttttgctttcttc

SEQ ID NO: 928531 - DNA, 25 bp, Mus musculus
ttcaattgggaccaagcttttttgg

SEQ ID NO: 928532 - DNA, 25 bp, Mus musculus
ttcaattgggacgaagcttttttgg

SEQ ID NO: 928533 - DNA, 25 bp, Mus musculus
ttcaattgtctcacccagtatcttt

SEQ ID NO: 928534 - DNA, 25 bp, Mus musculus
ttcaattgtctctcccagtatcttt

SEQ ID NO: 928535 - DNA, 25 bp, Mus musculus
ttcaattgttcacccttactttgga

SEQ ID NO: 928536 - DNA, 25 bp, Mus musculus
ttcaattgttcagccttactttgga

SEQ ID NO: 928537 - DNA, 25 bp, Mus musculus
ttcaatttatgccagcgcttgtaat

SEQ ID NO: 928538 - DNA, 25 bp, Mus musculus
ttcaatttatgcgagcgcttgtaat

SEQ ID NO: 928539 - DNA, 25 bp, Mus musculus
ttcaatttccgcaacttacaacctg

SEQ ID NO: 928540 - DNA, 25 bp, Mus musculus
ttcaatttccgctacttacaacctg

SEQ ID NO: 928541 - DNA, 25 bp, Mus musculus
ttcaatttccggctgcagttgcagt

SEQ ID NO: 928542 - DNA, 25 bp, Mus musculus
ttcaatttccgggtgcagttgcagt

SEQ ID NO: 928543 - DNA, 25 bp, Mus musculus
ttcaatttctacagtttattcccat

SEQ ID NO: 928544 - DNA, 25 bp, Mus musculus
ttcaatttctactgtttattcccat

SEQ ID NO: 928545 - DNA, 25 bp, Mus musculus
ttcaattttgtgcaagcacttgcta

SEQ ID NO: 928546 - DNA, 25 bp, Mus musculus
ttcaattttgtggaagcacttgcta

SEQ ID NO: 928547 - DNA, 25 bp, Mus musculus
ttcaattttttccatgccactaacc

SEQ ID NO: 928548 - DNA, 25 bp, Mus musculus
ttcaattttttcgatgccactaacc

SEQ ID NO: 928549 - DNA, 25 bp, Mus musculus
ttcacaaacatcagaccagcacact

SEQ ID NO: 928550 - DNA, 25 bp, Mus musculus
ttcacaaacatctgaccagcacact

SEQ ID NO: 928551 - DNA, 25 bp, Mus musculus
ttcacaaaccccatcgagtcagagt

SEQ ID NO: 928552 - DNA, 25 bp, Mus musculus
ttcacaaaccccttcgagtcagagt

SEQ ID NO: 928553 - DNA, 25 bp, Mus musculus
ttcacaaacgacacttaccaacctt

SEQ ID NO: 928554 - DNA, 25 bp, Mus musculus
ttcacaaacgactcttaccaacctt

SEQ ID NO: 928555 - DNA, 25 bp, Mus musculus
ttcacaaaggtgatgccgttcaaag

SEQ ID NO: 928556 - DNA, 25 bp, Mus musculus
ttcacaaaggtgttgccgttcaaag

SEQ ID NO: 928557 - DNA, 25 bp, Mus musculus
ttcacaaagttcactgctgccaggg

SEQ ID NO: 928558 - DNA, 25 bp, Mus musculus
ttcacaaagttctctgctgccaggg

SEQ ID NO: 928559 - DNA, 25 bp, Mus musculus
ttcacaaagttgaccgggttccaga

SEQ ID NO: 928560 - DNA, 25 bp, Mus musculus
ttcacaaagttgtccgggttccaga

SEQ ID NO: 928561 - DNA, 25 bp, Mus musculus
ttcacaacccctcgagccagggagg

SEQ ID NO: 928562 - DNA, 25 bp, Mus musculus
ttcacaacccctggagccagggagg

SEQ ID NO: 928563 - DNA, 25 bp, Mus musculus
ttcacaacctagaatggcacccttt

SEQ ID NO: 928564 - DNA, 25 bp, Mus musculus
ttcacaacctagtatggcacccttt

SEQ ID NO: 928565 - DNA, 25 bp, Mus musculus
ttcacaactcttcaaatcccattgg

SEQ ID NO: 928566 - DNA, 25 bp, Mus musculus
ttcacaactcttgaaatcccattgg

SEQ ID NO: 928567 - DNA, 25 bp, Mus musculus
ttcacaagaaaaaccagtgctactt

SEQ ID NO: 928568 - DNA, 25 bp, Mus musculus
ttcacaagaaaatccagtgctactt

SEQ ID NO: 928569 - DNA, 25 bp, Mus musculus
ttcacaagcagcctgttccagatgg

SEQ ID NO: 928570 - DNA, 25 bp, Mus musculus
ttcacaagcagcgtgttccagatgg

SEQ ID NO: 928571 - DNA, 25 bp, Mus musculus
ttcacaagcagtagacagtcttcat

SEQ ID NO: 928572 - DNA, 25 bp, Mus musculus
ttcacaagcagttgacagtcttcat

SEQ ID NO: 928573 - DNA, 25 bp, Mus musculus
ttcacaagcttacacttactttttt

SEQ ID NO: 928574 - DNA, 25 bp, Mus musculus
ttcacaagcttagacttactttttt

SEQ ID NO: 928575 - DNA, 25 bp, Mus musculus
ttcacaaggctcaaaggagtagcac

SEQ ID NO: 928576 - DNA, 25 bp, Mus musculus
ttcacaaggctctaaggagtagcac

SEQ ID NO: 928577 - DNA, 25 bp, Mus musculus
ttcacaagggcaaaactccaggcag

SEQ ID NO: 928578 - DNA, 25 bp, Mus musculus
ttcacaagggcataactccaggcag

SEQ ID NO: 928579 - DNA, 25 bp, Mus musculus
ttcacaaggtaccactcctgaagtg

SEQ ID NO: 928580 - DNA, 25 bp, Mus musculus
ttcacaaggtacgactcctgaagtg

SEQ ID NO: 928581 - DNA, 25 bp, Mus musculus
ttcacaagtcatccccgcgtttact

SEQ ID NO: 928582 - DNA, 25 bp, Mus musculus
ttcacaagtcatgcccgcgtttact

SEQ ID NO: 928583 - DNA, 25 bp, Mus musculus
ttcacaagtcctcctctagttgcca

SEQ ID NO: 928584 - DNA, 25 bp, Mus musculus
ttcacaagtcctgctctagttgcca

SEQ ID NO: 928585 - DNA, 25 bp, Mus musculus
ttcacaagtgaaccagtagtcccag

SEQ ID NO: 928586 - DNA, 25 bp, Mus musculus
ttcacaagtgaagcagtagtcccag

SEQ ID NO: 928587 - DNA, 25 bp, Mus musculus
ttcacaatattaagcgccaagatct

SEQ ID NO: 928588 - DNA, 25 bp, Mus musculus
ttcacaatattatgcgccaagatct

SEQ ID NO: 928589 - DNA, 25 bp, Mus musculus
ttcacaatattcatgctatagccta

SEQ ID NO: 928590 - DNA, 25 bp, Mus musculus
ttcacaatattcttgctatagccta

SEQ ID NO: 928591 - DNA, 25 bp, Mus musculus
ttcacaatctttcctttccacaaga

SEQ ID NO: 928592 - DNA, 25 bp, Mus musculus
ttcacaatctttgctttccacaaga

SEQ ID NO: 928593 - DNA, 25 bp, Mus musculus
ttcacaatgagcatgtagtatctgt

SEQ ID NO: 928594 - DNA, 25 bp, Mus musculus
ttcacaatgagcttgtagtatctgt

SEQ ID NO: 928595 - DNA, 25 bp, Mus musculus
ttcacaatggagcttgcctggtacc

SEQ ID NO: 928596 - DNA, 25 bp, Mus musculus
ttcacaatggaggttgcctggtacc

SEQ ID NO: 928597 - DNA, 25 bp, Mus musculus
ttcacaatggctcgcagcacacttc

SEQ ID NO: 928598 - DNA, 25 bp, Mus musculus
ttcacaatggctggcagcacacttc

SEQ ID NO: 928599 - DNA, 25 bp, Mus musculus
ttcacaatgtttagccaagctgggc

SEQ ID NO: 928600 - DNA, 25 bp, Mus musculus
ttcacaatgttttgccaagctgggc

SEQ ID NO: 928601 - DNA, 25 bp, Mus musculus
ttcacacaaaatctcctgggcacag

SEQ ID NO: 928602 - DNA, 25 bp, Mus musculus
ttcacacaaaatgtcctgggcacag

SEQ ID NO: 928603 - DNA, 25 bp, Mus musculus
ttcacacaaattcccttgtatttat

SEQ ID NO: 928604 - DNA, 25 bp, Mus musculus
ttcacacaaattgccttgtatttat

SEQ ID NO: 928605 - DNA, 25 bp, Mus musculus
ttcacacaagaaagctccttactca

SEQ ID NO: 928606 - DNA, 25 bp, Mus musculus
ttcacacaagaatgctccttactca

SEQ ID NO: 928607 - DNA, 25 bp, Mus musculus
ttcacacaaggtactgagggcagtt

SEQ ID NO: 928608 - DNA, 25 bp, Mus musculus
ttcacacaaggttctgagggcagtt

SEQ ID NO: 928609 - DNA, 25 bp, Mus musculus
ttcacacacaccaacatagccatag

SEQ ID NO: 928610 - DNA, 25 bp, Mus musculus
ttcacacacacctacatagccatag

SEQ ID NO: 928611 - DNA, 25 bp, Mus musculus
ttcacacacagacacgcatccatgt

SEQ ID NO: 928612 - DNA, 25 bp, Mus musculus
ttcacacacagagacgcatccatgt

SEQ ID NO: 928613 - DNA, 25 bp, Mus musculus
ttcacacacctgcaagcagcaactt

SEQ ID NO: 928614 - DNA, 25 bp, Mus musculus
ttcacacacctggaagcagcaactt

SEQ ID NO: 928615 - DNA, 25 bp, Mus musculus
ttcacacactagacaccagcagagc

SEQ ID NO: 928616 - DNA, 25 bp, Mus musculus
ttcacacactagtcaccagcagagc

SEQ ID NO: 928617 - DNA, 25 bp, Mus musculus
ttcacacactggaatctaaggccat

SEQ ID NO: 928618 - DNA, 25 bp, Mus musculus
ttcacacactggtatctaaggccat

SEQ ID NO: 928619 - DNA, 25 bp, Mus musculus
ttcacacagcatacacaacctgagg

SEQ ID NO: 928620 - DNA, 25 bp, Mus musculus
ttcacacagcattcacaacctgagg

SEQ ID NO: 928621 - DNA, 25 bp, Mus musculus
ttcacacagcgcagaggtgctcagt

SEQ ID NO: 928622 - DNA, 25 bp, Mus musculus
ttcacacagcgctgaggtgctcagt

SEQ ID NO: 928623 - DNA, 25 bp, Mus musculus
ttcacacagggtcagaaggatgtct

SEQ ID NO: 928624 - DNA, 25 bp, Mus musculus
ttcacacagggtgagaaggatgtct

SEQ ID NO: 928625 - DNA, 25 bp, Mus musculus
ttcacacagtgtcctgatggtgcct

SEQ ID NO: 928626 - DNA, 25 bp, Mus musculus
ttcacacagtgtgctgatggtgcct

SEQ ID NO: 928627 - DNA, 25 bp, Mus musculus
ttcacacatggccagcgtgagccga

SEQ ID NO: 928628 - DNA, 25 bp, Mus musculus
ttcacacatggcgagcgtgagccga

SEQ ID NO: 928629 - DNA, 25 bp, Mus musculus
ttcacacatttaaagcatagcagtt

SEQ ID NO: 928630 - DNA, 25 bp, Mus musculus
ttcacacatttatagcatagcagtt

SEQ ID NO: 928631 - DNA, 25 bp, Mus musculus
ttcacaccacacagactctttcttt

SEQ ID NO: 928632 - DNA, 25 bp, Mus musculus
ttcacaccacactgactctttcttt

SEQ ID NO: 928633 - DNA, 25 bp, Mus musculus
ttcacaccactgctgcacaagattg

SEQ ID NO: 928634 - DNA, 25 bp, Mus musculus
ttcacaccactggtgcacaagattg

SEQ ID NO: 928635 - DNA, 25 bp, Mus musculus
ttcacaccagacacagttaacactc

SEQ ID NO: 928636 - DNA, 25 bp, Mus musculus
ttcacaccagactcagttaacactc

SEQ ID NO: 928637 - DNA, 25 bp, Mus musculus
ttcacaccagttctcaccttggaaa

SEQ ID NO: 928638 - DNA, 25 bp, Mus musculus
ttcacaccagttgtcaccttggaaa

SEQ ID NO: 928639 - DNA, 25 bp, Mus musculus
ttcacaccatggcatacatctgtat

SEQ ID NO: 928640 - DNA, 25 bp, Mus musculus
ttcacaccatgggatacatctgtat

SEQ ID NO: 928641 - DNA, 25 bp, Mus musculus
ttcacaccccagctagaataaagac

SEQ ID NO: 928642 - DNA, 25 bp, Mus musculus
ttcacaccccaggtagaataaagac

SEQ ID NO: 928643 - DNA, 25 bp, Mus musculus
ttcacaccctccagttgcttctctc

SEQ ID NO: 928644 - DNA, 25 bp, Mus musculus
ttcacaccctcctgttgcttctctc

SEQ ID NO: 928645 - DNA, 25 bp, Mus musculus
ttcacaccctctatggacagtgatt

SEQ ID NO: 928646 - DNA, 25 bp, Mus musculus
ttcacaccctctttggacagtgatt

SEQ ID NO: 928647 - DNA, 25 bp, Mus musculus
ttcacacccttgaagcagaggccgg

SEQ ID NO: 928648 - DNA, 25 bp, Mus musculus
ttcacacccttgtagcagaggccgg

SEQ ID NO: 928649 - DNA, 25 bp, Mus musculus
ttcacaccggttctcacaggtgtgt

SEQ ID NO: 928650 - DNA, 25 bp, Mus musculus
ttcacaccggttgtcacaggtgtgt

SEQ ID NO: 928651 - DNA, 25 bp, Mus musculus
ttcacacctagcatgaggagcagga

SEQ ID NO: 928652 - DNA, 25 bp, Mus musculus
ttcacacctagcttgaggagcagga

SEQ ID NO: 928653 - DNA, 25 bp, Mus musculus
ttcacacctcccattgtgtatttat

SEQ ID NO: 928654 - DNA, 25 bp, Mus musculus
ttcacacctccctttgtgtatttat

SEQ ID NO: 928655 - DNA, 25 bp, Mus musculus
ttcacacctgtcatgatggctacta

SEQ ID NO: 928656 - DNA, 25 bp, Mus musculus
ttcacacctgtcttgatggctacta

SEQ ID NO: 928657 - DNA, 25 bp, Mus musculus
ttcacacgagccagaagatccaccg

SEQ ID NO: 928658 - DNA, 25 bp, Mus musculus
ttcacacgagcctgaagatccaccg

SEQ ID NO: 928659 - DNA, 25 bp, Mus musculus
ttcacacgcattccatctgtctttg

SEQ ID NO: 928660 - DNA, 25 bp, Mus musculus
ttcacacgcattgcatctgtctttg

SEQ ID NO: 928661 - DNA, 25 bp, Mus musculus
ttcacacgcctcagagtagtcccta

SEQ ID NO: 928662 - DNA, 25 bp, Mus musculus
ttcacacgcctctgagtagtcccta

SEQ ID NO: 928663 - DNA, 25 bp, Mus musculus
ttcacacgcgagctgcagggagtca

SEQ ID NO: 928664 - DNA, 25 bp, Mus musculus
ttcacacgcgaggtgcagggagtca

SEQ ID NO: 928665 - DNA, 25 bp, Mus musculus
ttcacacgcttccatggacaaactt

SEQ ID NO: 928666 - DNA, 25 bp, Mus musculus
ttcacacgcttcgatggacaaactt

SEQ ID NO: 928667 - DNA, 25 bp, Mus musculus
ttcacacgggcccaaggaccttgag

SEQ ID NO: 928668 - DNA, 25 bp, Mus musculus
ttcacacgggccgaaggaccttgag

SEQ ID NO: 928669 - DNA, 25 bp, Mus musculus
ttcacacgggtgatgtcaagttact

SEQ ID NO: 928670 - DNA, 25 bp, Mus musculus
ttcacacgggtgttgtcaagttact

SEQ ID NO: 928671 - DNA, 25 bp, Mus musculus
ttcacacggtgaaagcctaggaggc

SEQ ID NO: 928672 - DNA, 25 bp, Mus musculus
ttcacacggtgatagcctaggaggc

SEQ ID NO: 928673 - DNA, 25 bp, Mus musculus
ttcacacgtgctagtggaggcctga

SEQ ID NO: 928674 - DNA, 25 bp, Mus musculus
ttcacacgtgcttgtggaggcctga

SEQ ID NO: 928675 - DNA, 25 bp, Mus musculus
ttcacacgtggaagcttcacagcca

SEQ ID NO: 928676 - DNA, 25 bp, Mus musculus
ttcacacgtggatgcttcacagcca

SEQ ID NO: 928677 - DNA, 25 bp, Mus musculus
ttcacactcatgaaacaccttacca

SEQ ID NO: 928678 - DNA, 25 bp, Mus musculus
ttcacactcatgtaacaccttacca

SEQ ID NO: 928679 - DNA, 25 bp, Mus musculus
ttcacactcctgagctctaaggatc

SEQ ID NO: 928680 - DNA, 25 bp, Mus musculus
ttcacactcctgatcaagactgatt

SEQ ID NO: 928681 - DNA, 25 bp, Mus musculus
ttcacactcctgtgctctaaggatc

SEQ ID NO: 928682 - DNA, 25 bp, Mus musculus
ttcacactcctgttcaagactgatt

SEQ ID NO: 928683 - DNA, 25 bp, Mus musculus
ttcacactctgtcatcctattggct

SEQ ID NO: 928684 - DNA, 25 bp, Mus musculus
ttcacactctgtgatcctattggct

SEQ ID NO: 928685 - DNA, 25 bp, Mus musculus
ttcacactgagaagagccttggtcc

SEQ ID NO: 928686 - DNA, 25 bp, Mus musculus
ttcacactgagatgagccttggtcc

SEQ ID NO: 928687 - DNA, 25 bp, Mus musculus
ttcacactgcacagatagggtggct

SEQ ID NO: 928688 - DNA, 25 bp, Mus musculus
ttcacactgcactgatagggtggct

SEQ ID NO: 928689 - DNA, 25 bp, Mus musculus
ttcacactggagaagatcccaccta

SEQ ID NO: 928690 - DNA, 25 bp, Mus musculus
ttcacactggagtagatcccaccta

SEQ ID NO: 928691 - DNA, 25 bp, Mus musculus
ttcacactgttcaccatgtctgtat

SEQ ID NO: 928692 - DNA, 25 bp, Mus musculus
ttcacactgttctccatgtctgtat

SEQ ID NO: 928693 - DNA, 25 bp, Mus musculus
ttcacactgttgataccagtaccat

SEQ ID NO: 928694 - DNA, 25 bp, Mus musculus
ttcacactgttgttaccagtaccat

SEQ ID NO: 928695 - DNA, 25 bp, Mus musculus
ttcacacttaggcagctactactag

SEQ ID NO: 928696 - DNA, 25 bp, Mus musculus
ttcacacttagggagctactactag

SEQ ID NO: 928697 - DNA, 25 bp, Mus musculus
ttcacacttcagctcctggctggta

SEQ ID NO: 928698 - DNA, 25 bp, Mus musculus
ttcacacttcaggtcctggctggta

SEQ ID NO: 928699 - DNA, 25 bp, Mus musculus
ttcacacttcatcggaacactcaga

SEQ ID NO: 928700 - DNA, 25 bp, Mus musculus
ttcacacttcatgggaacactcaga

SEQ ID NO: 928701 - DNA, 25 bp, Mus musculus
ttcacactttctatccgggtgcagc

SEQ ID NO: 928702 - DNA, 25 bp, Mus musculus
ttcacactttctttccgggtgcagc

SEQ ID NO: 928703 - DNA, 25 bp, Mus musculus
ttcacagaaaatccttgctgctact

SEQ ID NO: 928704 - DNA, 25 bp, Mus musculus
ttcacagaaaatgcttgctgctact

SEQ ID NO: 928705 - DNA, 25 bp, Mus musculus
ttcacagaacggaaatgtatcccat

SEQ ID NO: 928706 - DNA, 25 bp, Mus musculus
ttcacagaacggtaatgtatcccat

SEQ ID NO: 928707 - DNA, 25 bp, Mus musculus
ttcacagaagctaaagcctcttttt

SEQ ID NO: 928708 - DNA, 25 bp, Mus musculus
ttcacagaagcttaagcctcttttt

SEQ ID NO: 928709 - DNA, 25 bp, Mus musculus
ttcacagaagtgaggttccctccac

SEQ ID NO: 928710 - DNA, 25 bp, Mus musculus
ttcacagaagtgtggttccctccac

SEQ ID NO: 928711 - DNA, 25 bp, Mus musculus
ttcacagacctgctttgagttgctc

SEQ ID NO: 928712 - DNA, 25 bp, Mus musculus
ttcacagacctggtttgagttgctc

SEQ ID NO: 928713 - DNA, 25 bp, Mus musculus
ttcacagacgacagcgacagcgaga

SEQ ID NO: 928714 - DNA, 25 bp, Mus musculus
ttcacagacgactgcgacagcgaga

SEQ ID NO: 928715 - DNA, 25 bp, Mus musculus
ttcacagactgcctacagacccgat

SEQ ID NO: 928716 - DNA, 25 bp, Mus musculus
ttcacagactgcgtacagacccgat

SEQ ID NO: 928717 - DNA, 25 bp, Mus musculus
ttcacagagactattcataccagtt

SEQ ID NO: 928718 - DNA, 25 bp, Mus musculus
ttcacagagacttttcataccagtt

SEQ ID NO: 928719 - DNA, 25 bp, Mus musculus
ttcacagagagcactcgtgggctgc

SEQ ID NO: 928720 - DNA, 25 bp, Mus musculus
ttcacagagagctctcgtgggctgc

SEQ ID NO: 928721 - DNA, 25 bp, Mus musculus
ttcacagagcacaacctcagctaca

SEQ ID NO: 928722 - DNA, 25 bp, Mus musculus
ttcacagagcactacctcagctaca

SEQ ID NO: 928723 - DNA, 25 bp, Mus musculus
ttcacagagcatagccttcccgata

SEQ ID NO: 928724 - DNA, 25 bp, Mus musculus
ttcacagagcattgccttcccgata

SEQ ID NO: 928725 - DNA, 25 bp, Mus musculus
ttcacagagctgatgggttccaggc

SEQ ID NO: 928726 - DNA, 25 bp, Mus musculus
ttcacagagctgttgggttccaggc

SEQ ID NO: 928727 - DNA, 25 bp, Mus musculus
ttcacagaggcaagggttgggttca

SEQ ID NO: 928728 - DNA, 25 bp, Mus musculus
ttcacagaggcatgggttgggttca

SEQ ID NO: 928729 - DNA, 25 bp, Mus musculus
ttcacagaggtcctcaagaccaacg

SEQ ID NO: 928730 - DNA, 25 bp, Mus musculus
ttcacagaggtcgtcaagaccaacg

SEQ ID NO: 928731 - DNA, 25 bp, Mus musculus
ttcacagatcggatggccactagat

SEQ ID NO: 928732 - DNA, 25 bp, Mus musculus
ttcacagatcggttggccactagat

SEQ ID NO: 928733 - DNA, 25 bp, Mus musculus
ttcacagatggcatacatttatgta

SEQ ID NO: 928734 - DNA, 25 bp, Mus musculus
ttcacagatggcttacatttatgta

SEQ ID NO: 928735 - DNA, 25 bp, Mus musculus
ttcacagatgtaccctgagtccttg

SEQ ID NO: 928736 - DNA, 25 bp, Mus musculus
ttcacagatgtagcctgagtccttg

SEQ ID NO: 928737 - DNA, 25 bp, Mus musculus
ttcacagcaattactgtccatctgc

SEQ ID NO: 928738 - DNA, 25 bp, Mus musculus
ttcacagcaatttctgtccatctgc

SEQ ID NO: 928739 - DNA, 25 bp, Mus musculus
ttcacagcacccatttaagttcagc

SEQ ID NO: 928740 - DNA, 25 bp, Mus musculus
ttcacagcacccttttaagttcagc

SEQ ID NO: 928741 - DNA, 25 bp, Mus musculus
ttcacagcactgaggtctcaccaaa

SEQ ID NO: 928742 - DNA, 25 bp, Mus musculus
ttcacagcactgtggtctcaccaaa

SEQ ID NO: 928743 - DNA, 25 bp, Mus musculus
ttcacagcagatatggagagagaga

SEQ ID NO: 928744 - DNA, 25 bp, Mus musculus
ttcacagcagatttggagagagaga

SEQ ID NO: 928745 - DNA, 25 bp, Mus musculus
ttcacagccaccatcagaggacttg

SEQ ID NO: 928746 - DNA, 25 bp, Mus musculus
ttcacagccaccttcagaggacttg

SEQ ID NO: 928747 - DNA, 25 bp, Mus musculus
ttcacagccatcaaggaaccaggta

SEQ ID NO: 928748 - DNA, 25 bp, Mus musculus
ttcacagccatctaggaaccaggta

SEQ ID NO: 928749 - DNA, 25 bp, Mus musculus
ttcacagcctcactcgctaagggat

SEQ ID NO: 928750 - DNA, 25 bp, Mus musculus
ttcacagcctcagtcgctaagggat

SEQ ID NO: 928751 - DNA, 25 bp, Mus musculus
ttcacagctactactggtcatcatg

SEQ ID NO: 928752 - DNA, 25 bp, Mus musculus
ttcacagctacttctggtcatcatg

SEQ ID NO: 928753 - DNA, 25 bp, Mus musculus
ttcacagctgttccacattgatccc

SEQ ID NO: 928754 - DNA, 25 bp, Mus musculus
ttcacagctgttgcacattgatccc

SEQ ID NO: 928755 - DNA, 25 bp, Mus musculus
ttcacagcttccaacaattgtccaa

SEQ ID NO: 928756 - DNA, 25 bp, Mus musculus
ttcacagcttcctacaattgtccaa

SEQ ID NO: 928757 - DNA, 25 bp, Mus musculus
ttcacagctttcataagcctagccc

SEQ ID NO: 928758 - DNA, 25 bp, Mus musculus
ttcacagctttcttaagcctagccc

SEQ ID NO: 928759 - DNA, 25 bp, Mus musculus
ttcacagctttgcattttcaagata

SEQ ID NO: 928760 - DNA, 25 bp, Mus musculus
ttcacagctttggattttcaagata

SEQ ID NO: 928761 - DNA, 25 bp, Mus musculus
ttcacaggacaacgaaagacatcat

SEQ ID NO: 928762 - DNA, 25 bp, Mus musculus
ttcacaggacaaggaaagacatcat

SEQ ID NO: 928763 - DNA, 25 bp, Mus musculus
ttcacaggaccaaggacctcttgga

SEQ ID NO: 928764 - DNA, 25 bp, Mus musculus
ttcacaggaccatggacctcttgga

SEQ ID NO: 928765 - DNA, 25 bp, Mus musculus
ttcacaggagccaatgtccatactg

SEQ ID NO: 928766 - DNA, 25 bp, Mus musculus
ttcacaggagcctatgtccatactg

SEQ ID NO: 928767 - DNA, 25 bp, Mus musculus
ttcacaggccctcacatatggcttg

SEQ ID NO: 928768 - DNA, 25 bp, Mus musculus
ttcacaggccctgacatatggcttg

SEQ ID NO: 928769 - DNA, 25 bp, Mus musculus
ttcacagggccgatctagttcaaag

SEQ ID NO: 928770 - DNA, 25 bp, Mus musculus
ttcacagggccgttctagttcaaag

SEQ ID NO: 928771 - DNA, 25 bp, Mus musculus
ttcacagggctcagaacaacagtct

SEQ ID NO: 928772 - DNA, 25 bp, Mus musculus
ttcacagggctctgaacaacagtct

SEQ ID NO: 928773 - DNA, 25 bp, Mus musculus
ttcacagggttcagtccgttatgat

SEQ ID NO: 928774 - DNA, 25 bp, Mus musculus
ttcacagggttctgtccgttatgat

SEQ ID NO: 928775 - DNA, 25 bp, Mus musculus
ttcacaggtactacatgcacacggt

SEQ ID NO: 928776 - DNA, 25 bp, Mus musculus
ttcacaggtacttcatgcacacggt

SEQ ID NO: 928777 - DNA, 25 bp, Mus musculus
ttcacagtaccccatatctctgatt

SEQ ID NO: 928778 - DNA, 25 bp, Mus musculus
ttcacagtacccgatatctctgatt

SEQ ID NO: 928779 - DNA, 25 bp, Mus musculus
ttcacagtactgattccctctggga

SEQ ID NO: 928780 - DNA, 25 bp, Mus musculus
ttcacagtactgtttccctctggga

SEQ ID NO: 928781 - DNA, 25 bp, Mus musculus
ttcacagtattgactcttacttatg

SEQ ID NO: 928782 - DNA, 25 bp, Mus musculus
ttcacagtattgtctcttacttatg

SEQ ID NO: 928783 - DNA, 25 bp, Mus musculus
ttcacagtctttcagacccacgata

SEQ ID NO: 928784 - DNA, 25 bp, Mus musculus
ttcacagtctttgagacccacgata

SEQ ID NO: 928785 - DNA, 25 bp, Mus musculus
ttcacagtgaatccttgttatcaaa

SEQ ID NO: 928786 - DNA, 25 bp, Mus musculus
ttcacagtgaatgcttgttatcaaa

SEQ ID NO: 928787 - DNA, 25 bp, Mus musculus
ttcacagtgactaatcattatatgt

SEQ ID NO: 928788 - DNA, 25 bp, Mus musculus
ttcacagtgacttatcattatatgt

SEQ ID NO: 928789 - DNA, 25 bp, Mus musculus
ttcacagtgatcaggtagtagccat

SEQ ID NO: 928790 - DNA, 25 bp, Mus musculus
ttcacagtgatctggtagtagccat

SEQ ID NO: 928791 - DNA, 25 bp, Mus musculus
ttcacagtgccccttgtgcgaatgg

SEQ ID NO: 928792 - DNA, 25 bp, Mus musculus
ttcacagtgcccgttgtgcgaatgg

SEQ ID NO: 928793 - DNA, 25 bp, Mus musculus
ttcacagtggctactttccacgtgg

SEQ ID NO: 928794 - DNA, 25 bp, Mus musculus
ttcacagtggcttctttccacgtgg

SEQ ID NO: 928795 - DNA, 25 bp, Mus musculus
ttcacagtggtaccctatggcaggc

SEQ ID NO: 928796 - DNA, 25 bp, Mus musculus
ttcacagtggtagcctatggcaggc

SEQ ID NO: 928797 - DNA, 25 bp, Mus musculus
ttcacagtgtatctcgttcttcatc

SEQ ID NO: 928798 - DNA, 25 bp, Mus musculus
ttcacagtgtatgtcgttcttcatc

SEQ ID NO: 928799 - DNA, 25 bp, Mus musculus
ttcacagtgtccactagagtcacag

SEQ ID NO: 928800 - DNA, 25 bp, Mus musculus
ttcacagtgtcctctagagtcacag

SEQ ID NO: 928801 - DNA, 25 bp, Mus musculus
ttcacagtgtttacccgagcactta

SEQ ID NO: 928802 - DNA, 25 bp, Mus musculus
ttcacagtgttttcccgagcactta

SEQ ID NO: 928803 - DNA, 25 bp, Mus musculus
ttcacagttaaccattccaaatccc

SEQ ID NO: 928804 - DNA, 25 bp, Mus musculus
ttcacagttaacgattccaaatccc

SEQ ID NO: 928805 - DNA, 25 bp, Mus musculus
ttcacagttatcagttggaagtcct

SEQ ID NO: 928806 - DNA, 25 bp, Mus musculus
ttcacagttatctgttggaagtcct

SEQ ID NO: 928807 - DNA, 25 bp, Mus musculus
ttcacagtttaccaagttctcacgc

SEQ ID NO: 928808 - DNA, 25 bp, Mus musculus
ttcacagtttacgaagttctcacgc

SEQ ID NO: 928809 - DNA, 25 bp, Mus musculus
ttcacagttttacctttgtctgtag

SEQ ID NO: 928810 - DNA, 25 bp, Mus musculus
ttcacagttttagctttgtctgtag

SEQ ID NO: 928811 - DNA, 25 bp, Mus musculus
ttcacagttttgagtgtgccacctc

SEQ ID NO: 928812 - DNA, 25 bp, Mus musculus
ttcacagttttgtgtgtgccacctc

SEQ ID NO: 928813 - DNA, 25 bp, Mus musculus
ttcacataaagaacccctacagcat

SEQ ID NO: 928814 - DNA, 25 bp, Mus musculus
ttcacataaagatcccctacagcat

SEQ ID NO: 928815 - DNA, 25 bp, Mus musculus
ttcacatactccaatgaaagcccct

SEQ ID NO: 928816 - DNA, 25 bp, Mus musculus
ttcacatactcctatgaaagcccct

SEQ ID NO: 928817 - DNA, 25 bp, Mus musculus
ttcacatagtgcatctgggctcagt

SEQ ID NO: 928818 - DNA, 25 bp, Mus musculus
ttcacatagtgcttctgggctcagt

SEQ ID NO: 928819 - DNA, 25 bp, Mus musculus
ttcacatccaggcatctcagaacag

SEQ ID NO: 928820 - DNA, 25 bp, Mus musculus
ttcacatccagggatctcagaacag

SEQ ID NO: 928821 - DNA, 25 bp, Mus musculus
ttcacatcctcacacttgtttaaca

SEQ ID NO: 928822 - DNA, 25 bp, Mus musculus
ttcacatcctcagacttgtttaaca

SEQ ID NO: 928823 - DNA, 25 bp, Mus musculus
ttcacatccttaatcgcggccggaa

SEQ ID NO: 928824 - DNA, 25 bp, Mus musculus
ttcacatccttattcgcggccggaa

SEQ ID NO: 928825 - DNA, 25 bp, Mus musculus
ttcacatcgtgccgtttcttgcagt

SEQ ID NO: 928826 - DNA, 25 bp, Mus musculus
ttcacatcgtgcggtttcttgcagt

SEQ ID NO: 928827 - DNA, 25 bp, Mus musculus
ttcacatcgttccaagcactgtgtg

SEQ ID NO: 928828 - DNA, 25 bp, Mus musculus
ttcacatcgttcgaagcactgtgtg

SEQ ID NO: 928829 - DNA, 25 bp, Mus musculus
ttcacatctcaaatggtcccgtttg

SEQ ID NO: 928830 - DNA, 25 bp, Mus musculus
ttcacatctcaattggtcccgtttg

SEQ ID NO: 928831 - DNA, 25 bp, Mus musculus
ttcacatctcccctgtatatttaaa

SEQ ID NO: 928832 - DNA, 25 bp, Mus musculus
ttcacatctcccgtgtatatttaaa

SEQ ID NO: 928833 - DNA, 25 bp, Mus musculus
ttcacatctgtgactttccattcca

SEQ ID NO: 928834 - DNA, 25 bp, Mus musculus
ttcacatctgtgtctttccattcca

SEQ ID NO: 928835 - DNA, 25 bp, Mus musculus
ttcacatcttcacccaggagttaga

SEQ ID NO: 928836 - DNA, 25 bp, Mus musculus
ttcacatcttcagccaggagttaga

SEQ ID NO: 928837 - DNA, 25 bp, Mus musculus
ttcacatgacagatgacgcaagcct

SEQ ID NO: 928838 - DNA, 25 bp, Mus musculus
ttcacatgacagttgacgcaagcct

SEQ ID NO: 928839 - DNA, 25 bp, Mus musculus
ttcacatgatacatcgctctaaatc

SEQ ID NO: 928840 - DNA, 25 bp, Mus musculus
ttcacatgatacttcgctctaaatc

SEQ ID NO: 928841 - DNA, 25 bp, Mus musculus
ttcacatgctagctggattggtcca

SEQ ID NO: 928842 - DNA, 25 bp, Mus musculus
ttcacatgctaggtggattggtcca

SEQ ID NO: 928843 - DNA, 25 bp, Mus musculus
ttcacatggcagatgaatccgtctg

SEQ ID NO: 928844 - DNA, 25 bp, Mus musculus
ttcacatggcagcagttccatagag

SEQ ID NO: 928845 - DNA, 25 bp, Mus musculus
ttcacatggcaggagttccatagag

SEQ ID NO: 928846 - DNA, 25 bp, Mus musculus
ttcacatggcagttgaatccgtctg

SEQ ID NO: 928847 - DNA, 25 bp, Mus musculus
ttcacatggcgaaactggtagcgga

SEQ ID NO: 928848 - DNA, 25 bp, Mus musculus
ttcacatggcgatactggtagcgga

SEQ ID NO: 928849 - DNA, 25 bp, Mus musculus
ttcacatggctccttttgggacagg

SEQ ID NO: 928850 - DNA, 25 bp, Mus musculus
ttcacatggctcgttttgggacagg

SEQ ID NO: 928851 - DNA, 25 bp, Mus musculus
ttcacatgggtcaaataggctgctt

SEQ ID NO: 928852 - DNA, 25 bp, Mus musculus
ttcacatgggtctaataggctgctt

SEQ ID NO: 928853 - DNA, 25 bp, Mus musculus
ttcacatgggtgcaacggtcccaga

SEQ ID NO: 928854 - DNA, 25 bp, Mus musculus
ttcacatgggtgcacatcagcctca

SEQ ID NO: 928855 - DNA, 25 bp, Mus musculus
ttcacatgggtggaacggtcccaga

SEQ ID NO: 928856 - DNA, 25 bp, Mus musculus
ttcacatgggtggacatcagcctca

SEQ ID NO: 928857 - DNA, 25 bp, Mus musculus
ttcacatggtccagggctagggacc

SEQ ID NO: 928858 - DNA, 25 bp, Mus musculus
ttcacatggtccaggtgtatgtgga

SEQ ID NO: 928859 - DNA, 25 bp, Mus musculus
ttcacatggtcctgggctagggacc

SEQ ID NO: 928860 - DNA, 25 bp, Mus musculus
ttcacatggtcctggtgtatgtgga

SEQ ID NO: 928861 - DNA, 25 bp, Mus musculus
ttcacatggtcgatggcaacgtcac

SEQ ID NO: 928862 - DNA, 25 bp, Mus musculus
ttcacatggtcgttggcaacgtcac

SEQ ID NO: 928863 - DNA, 25 bp, Mus musculus
ttcacatgtatacaagtagccctgt

SEQ ID NO: 928864 - DNA, 25 bp, Mus musculus
ttcacatgtatagaagtagccctgt

SEQ ID NO: 928865 - DNA, 25 bp, Mus musculus
ttcacatgtatcagtccattcctct

SEQ ID NO: 928866 - DNA, 25 bp, Mus musculus
ttcacatgtatctgtccattcctct

SEQ ID NO: 928867 - DNA, 25 bp, Mus musculus
ttcacatgttttaagtgttccacat

SEQ ID NO: 928868 - DNA, 25 bp, Mus musculus
ttcacatgtttttagtgttccacat

SEQ ID NO: 928869 - DNA, 25 bp, Mus musculus
ttcacattaagaaccttccctggct

SEQ ID NO: 928870 - DNA, 25 bp, Mus musculus
ttcacattaagatccttccctggct

SEQ ID NO: 928871 - DNA, 25 bp, Mus musculus
ttcacattcccaagactccaaataa

SEQ ID NO: 928872 - DNA, 25 bp, Mus musculus
ttcacattcccacaggctttgggta

SEQ ID NO: 928873 - DNA, 25 bp, Mus musculus
ttcacattcccagaggctttgggta

SEQ ID NO: 928874 - DNA, 25 bp, Mus musculus
ttcacattcccatgactccaaataa

SEQ ID NO: 928875 - DNA, 25 bp, Mus musculus
ttcacattcctccaggctcacaggt

SEQ ID NO: 928876 - DNA, 25 bp, Mus musculus
ttcacattcctcgaggctcacaggt

SEQ ID NO: 928877 - DNA, 25 bp, Mus musculus
ttcacattccttcacttgtggcaag

SEQ ID NO: 928878 - DNA, 25 bp, Mus musculus
ttcacattccttgacttgtggcaag

SEQ ID NO: 928879 - DNA, 25 bp, Mus musculus
ttcacattggagaagtctctggtca

SEQ ID NO: 928880 - DNA, 25 bp, Mus musculus
ttcacattggagtagtctctggtca

SEQ ID NO: 928881 - DNA, 25 bp, Mus musculus
ttcacattgttcattcagccctagg

SEQ ID NO: 928882 - DNA, 25 bp, Mus musculus
ttcacattgttctttcagccctagg

SEQ ID NO: 928883 - DNA, 25 bp, Mus musculus
ttcacatttatcacagccacactgt

SEQ ID NO: 928884 - DNA, 25 bp, Mus musculus
ttcacatttatctcagccacactgt

SEQ ID NO: 928885 - DNA, 25 bp, Mus musculus
ttcacatttgtcaaccctcatgact

SEQ ID NO: 928886 - DNA, 25 bp, Mus musculus
ttcacatttgtctaccctcatgact

SEQ ID NO: 928887 - DNA, 25 bp, Mus musculus
ttcacatttgtgctctcctgtgaga

SEQ ID NO: 928888 - DNA, 25 bp, Mus musculus
ttcacatttgtggtctcctgtgaga

SEQ ID NO: 928889 - DNA, 25 bp, Mus musculus
ttcacatttgttactctttcaatta

SEQ ID NO: 928890 - DNA, 25 bp, Mus musculus
ttcacatttgtttctctttcaatta

SEQ ID NO: 928891 - DNA, 25 bp, Mus musculus
ttcacattttgtcctgcatgactca

SEQ ID NO: 928892 - DNA, 25 bp, Mus musculus
ttcacattttgtgctgcatgactca

SEQ ID NO: 928893 - DNA, 25 bp, Mus musculus
ttcaccaaaccaacggcaaatgctg

SEQ ID NO: 928894 - DNA, 25 bp, Mus musculus
ttcaccaaaccatcggcaaatgctg

SEQ ID NO: 928895 - DNA, 25 bp, Mus musculus
ttcaccaaatctcagagccagcgag

SEQ ID NO: 928896 - DNA, 25 bp, Mus musculus
ttcaccaaatctgagagccagcgag

SEQ ID NO: 928897 - DNA, 25 bp, Mus musculus
ttcaccaacctaacaagttcttagt

SEQ ID NO: 928898 - DNA, 25 bp, Mus musculus
ttcaccaacctatcaagttcttagt

SEQ ID NO: 928899 - DNA, 25 bp, Mus musculus
ttcaccaactctacccttagaaagg

SEQ ID NO: 928900 - DNA, 25 bp, Mus musculus
ttcaccaactcttcccttagaaagg

SEQ ID NO: 928901 - DNA, 25 bp, Mus musculus
ttcaccaagacaagacttcttcctg

SEQ ID NO: 928902 - DNA, 25 bp, Mus musculus
ttcaccaagacatgacttcttcctg

SEQ ID NO: 928903 - DNA, 25 bp, Mus musculus
ttcaccaagagcagaaaagggacat

SEQ ID NO: 928904 - DNA, 25 bp, Mus musculus
ttcaccaagagctgaaaagggacat

SEQ ID NO: 928905 - DNA, 25 bp, Mus musculus
ttcaccaagccccagaagagattct

SEQ ID NO: 928906 - DNA, 25 bp, Mus musculus
ttcaccaagcccgagaagagattct

SEQ ID NO: 928907 - DNA, 25 bp, Mus musculus
ttcaccaagctgacctccaaactga

SEQ ID NO: 928908 - DNA, 25 bp, Mus musculus
ttcaccaagctgtcctccaaactga

SEQ ID NO: 928909 - DNA, 25 bp, Mus musculus
ttcaccaaggccacataagcatcat

SEQ ID NO: 928910 - DNA, 25 bp, Mus musculus
ttcaccaaggcctcataagcatcat

SEQ ID NO: 928911 - DNA, 25 bp, Mus musculus
ttcaccaagtacattctcacgattg

SEQ ID NO: 928912 - DNA, 25 bp, Mus musculus
ttcaccaagtactttctcacgattg

SEQ ID NO: 928913 - DNA, 25 bp, Mus musculus
ttcaccaagtccactagctgtattt

SEQ ID NO: 928914 - DNA, 25 bp, Mus musculus
ttcaccaagtcccacagtactcttg

SEQ ID NO: 928915 - DNA, 25 bp, Mus musculus
ttcaccaagtccgacagtactcttg

SEQ ID NO: 928916 - DNA, 25 bp, Mus musculus
ttcaccaagtcctctagctgtattt

SEQ ID NO: 928917 - DNA, 25 bp, Mus musculus
ttcaccaatctcactgctaatcata

SEQ ID NO: 928918 - DNA, 25 bp, Mus musculus
ttcaccaatctccagtcacagaagg

SEQ ID NO: 928919 - DNA, 25 bp, Mus musculus
ttcaccaatctcgagtcacagaagg

SEQ ID NO: 928920 - DNA, 25 bp, Mus musculus
ttcaccaatctctctgctaatcata

SEQ ID NO: 928921 - DNA, 25 bp, Mus musculus
ttcaccaatgacagtaaaaccacct

SEQ ID NO: 928922 - DNA, 25 bp, Mus musculus
ttcaccaatgactgtaaaaccacct

SEQ ID NO: 928923 - DNA, 25 bp, Mus musculus
ttcaccaattccaaccacaacgttc

SEQ ID NO: 928924 - DNA, 25 bp, Mus musculus
ttcaccaattcctaccacaacgttc

SEQ ID NO: 928925 - DNA, 25 bp, Mus musculus
ttcaccacaattaaaggctgctttt

SEQ ID NO: 928926 - DNA, 25 bp, Mus musculus
ttcaccacaatttaaggctgctttt

SEQ ID NO: 928927 - DNA, 25 bp, Mus musculus
ttcaccacacacacgcactgtaggg

SEQ ID NO: 928928 - DNA, 25 bp, Mus musculus
ttcaccacacactcgcactgtaggg

SEQ ID NO: 928929 - DNA, 25 bp, Mus musculus
ttcaccacacatacatttacactga

SEQ ID NO: 928930 - DNA, 25 bp, Mus musculus
ttcaccacacattcatttacactga

SEQ ID NO: 928931 - DNA, 25 bp, Mus musculus
ttcaccacagccacagagtgagggt

SEQ ID NO: 928932 - DNA, 25 bp, Mus musculus
ttcaccacagcctcagagtgagggt

SEQ ID NO: 928933 - DNA, 25 bp, Mus musculus
ttcaccacatgcctgtgttcatttt

SEQ ID NO: 928934 - DNA, 25 bp, Mus musculus
ttcaccacatgcgtgtgttcatttt

SEQ ID NO: 928935 - DNA, 25 bp, Mus musculus
ttcaccacatttacatgcagctcag

SEQ ID NO: 928936 - DNA, 25 bp, Mus musculus
ttcaccacattttcatgcagctcag

SEQ ID NO: 928937 - DNA, 25 bp, Mus musculus
ttcaccaccaatcacaggcatttgg

SEQ ID NO: 928938 - DNA, 25 bp, Mus musculus
ttcaccaccaatgacaggcatttgg

SEQ ID NO: 928939 - DNA, 25 bp, Mus musculus
ttcaccaccaccaagttatagctgt

SEQ ID NO: 928940 - DNA, 25 bp, Mus musculus
ttcaccaccacctagttatagctgt

SEQ ID NO: 928941 - DNA, 25 bp, Mus musculus
ttcaccaccatcacttttgggagca

SEQ ID NO: 928942 - DNA, 25 bp, Mus musculus
ttcaccaccatctcttttgggagca

SEQ ID NO: 928943 - DNA, 25 bp, Mus musculus
ttcaccaccggcacggacagtgagt

SEQ ID NO: 928944 - DNA, 25 bp, Mus musculus
ttcaccaccggctcggacagtgagt

SEQ ID NO: 928945 - DNA, 25 bp, Mus musculus
ttcaccacctacaggatgcactggg

SEQ ID NO: 928946 - DNA, 25 bp, Mus musculus
ttcaccacctactggatgcactggg

SEQ ID NO: 928947 - DNA, 25 bp, Mus musculus
ttcaccacggctctgtgctgtgcag

SEQ ID NO: 928948 - DNA, 25 bp, Mus musculus
ttcaccacggctgtgtgctgtgcag

SEQ ID NO: 928949 - DNA, 25 bp, Mus musculus
ttcaccacttgaactgatggtctga

SEQ ID NO: 928950 - DNA, 25 bp, Mus musculus
ttcaccacttgatctgatggtctga

SEQ ID NO: 928951 - DNA, 25 bp, Mus musculus
ttcaccagaaagatcagtccccaag

SEQ ID NO: 928952 - DNA, 25 bp, Mus musculus
ttcaccagaaagttcagtccccaag

SEQ ID NO: 928953 - DNA, 25 bp, Mus musculus
ttcaccagaatccagcatgtatttt

SEQ ID NO: 928954 - DNA, 25 bp, Mus musculus
ttcaccagaatcgagcatgtatttt

SEQ ID NO: 928955 - DNA, 25 bp, Mus musculus
ttcaccagactacaggtttctcctg

SEQ ID NO: 928956 - DNA, 25 bp, Mus musculus
ttcaccagactagaggtttctcctg

SEQ ID NO: 928957 - DNA, 25 bp, Mus musculus
ttcaccagatttagttccaaagcat

SEQ ID NO: 928958 - DNA, 25 bp, Mus musculus
ttcaccagattttgttccaaagcat

SEQ ID NO: 928959 - DNA, 25 bp, Mus musculus
ttcaccagcacacaggagaagaaac

SEQ ID NO: 928960 - DNA, 25 bp, Mus musculus
ttcaccagcacagaggagaagaaac

SEQ ID NO: 928961 - DNA, 25 bp, Mus musculus
ttcaccagcaccacagtattcaaat

SEQ ID NO: 928962 - DNA, 25 bp, Mus musculus
ttcaccagcacctcagtattcaaat

SEQ ID NO: 928963 - DNA, 25 bp, Mus musculus
ttcaccagcagcatgatggcttcat

SEQ ID NO: 928964 - DNA, 25 bp, Mus musculus
ttcaccagcagcttgatggcttcat

SEQ ID NO: 928965 - DNA, 25 bp, Mus musculus
ttcaccagccttaccagcaggtttt

SEQ ID NO: 928966 - DNA, 25 bp, Mus musculus
ttcaccagcctttccagcaggtttt

SEQ ID NO: 928967 - DNA, 25 bp, Mus musculus
ttcaccagctgccatgagcgagcgc

SEQ ID NO: 928968 - DNA, 25 bp, Mus musculus
ttcaccagctgcgatgagcgagcgc

SEQ ID NO: 928969 - DNA, 25 bp, Mus musculus
ttcaccagcttgctttgattctttt

SEQ ID NO: 928970 - DNA, 25 bp, Mus musculus
ttcaccagcttggtttgattctttt

SEQ ID NO: 928971 - DNA, 25 bp, Mus musculus
ttcaccaggaccaccaggctgagct

SEQ ID NO: 928972 - DNA, 25 bp, Mus musculus
ttcaccaggacctccaggctgagct

SEQ ID NO: 928973 - DNA, 25 bp, Mus musculus
ttcaccaggcctatgtcccggaaat

SEQ ID NO: 928974 - DNA, 25 bp, Mus musculus
ttcaccaggcctttgtcccggaaat

SEQ ID NO: 928975 - DNA, 25 bp, Mus musculus
ttcaccagtcagcagtaggcacaag

SEQ ID NO: 928976 - DNA, 25 bp, Mus musculus
ttcaccagtcaggagtaggcacaag

SEQ ID NO: 928977 - DNA, 25 bp, Mus musculus
ttcaccagttgcatattattggcct

SEQ ID NO: 928978 - DNA, 25 bp, Mus musculus
ttcaccagttgcttattattggcct

SEQ ID NO: 928979 - DNA, 25 bp, Mus musculus
ttcaccataactaacatcccagagc

SEQ ID NO: 928980 - DNA, 25 bp, Mus musculus
ttcaccataacttacatcccagagc

SEQ ID NO: 928981 - DNA, 25 bp, Mus musculus
ttcaccatacccagtagcttgggat

SEQ ID NO: 928982 - DNA, 25 bp, Mus musculus
ttcaccataccctgtagcttgggat

SEQ ID NO: 928983 - DNA, 25 bp, Mus musculus
ttcaccatcaggatcacagccgagg

SEQ ID NO: 928984 - DNA, 25 bp, Mus musculus
ttcaccatcaggcttagctctcttc

SEQ ID NO: 928985 - DNA, 25 bp, Mus musculus
ttcaccatcagggttagctctcttc

SEQ ID NO: 928986 - DNA, 25 bp, Mus musculus
ttcaccatcaggttcacagccgagg

SEQ ID NO: 928987 - DNA, 25 bp, Mus musculus
ttcaccatcctaaccctaaatcacc

SEQ ID NO: 928988 - DNA, 25 bp, Mus musculus
ttcaccatcctatccctaaatcacc

SEQ ID NO: 928989 - DNA, 25 bp, Mus musculus
ttcaccatctttctttagcaaggta

SEQ ID NO: 928990 - DNA, 25 bp, Mus musculus
ttcaccatctttgtttagcaaggta

SEQ ID NO: 928991 - DNA, 25 bp, Mus musculus
ttcaccatgaatcgccttaggcagt

SEQ ID NO: 928992 - DNA, 25 bp, Mus musculus
ttcaccatgaatggccttaggcagt

SEQ ID NO: 928993 - DNA, 25 bp, Mus musculus
ttcaccatgcaaccacttaggaatt

SEQ ID NO: 928994 - DNA, 25 bp, Mus musculus
ttcaccatgcaagcacttaggaatt

SEQ ID NO: 928995 - DNA, 25 bp, Mus musculus
ttcaccatgtgtcagagactctgct

SEQ ID NO: 928996 - DNA, 25 bp, Mus musculus
ttcaccatgtgtgagagactctgct

SEQ ID NO: 928997 - DNA, 25 bp, Mus musculus
ttcaccattacacgccacgctgaga

SEQ ID NO: 928998 - DNA, 25 bp, Mus musculus
ttcaccattacaggccacgctgaga

SEQ ID NO: 928999 - DNA, 25 bp, Mus musculus
ttcaccattcccacagcagagaaat

SEQ ID NO: 929000 - DNA, 25 bp, Mus musculus
ttcaccattccctcagcagagaaat

SEQ ID NO: 929001 - DNA, 25 bp, Mus musculus
ttcaccatttggcagagctatacat

SEQ ID NO: 929002 - DNA, 25 bp, Mus musculus
ttcaccatttgggagagctatacat

SEQ ID NO: 929003 - DNA, 25 bp, Mus musculus
ttcacccaatctcagaccaacaagt

SEQ ID NO: 929004 - DNA, 25 bp, Mus musculus
ttcacccaatctgagaccaacaagt

SEQ ID NO: 929005 - DNA, 25 bp, Mus musculus
ttcacccacagcaatttcacgggaa

SEQ ID NO: 929006 - DNA, 25 bp, Mus musculus
ttcacccacagctatttcacgggaa

SEQ ID NO: 929007 - DNA, 25 bp, Mus musculus
ttcacccacggtcagtgatggcgga

SEQ ID NO: 929008 - DNA, 25 bp, Mus musculus
ttcacccacggtgagtgatggcgga

SEQ ID NO: 929009 - DNA, 25 bp, Mus musculus
ttcacccagaggaccgcagtggcag

SEQ ID NO: 929010 - DNA, 25 bp, Mus musculus
ttcacccagaggtccgcagtggcag

SEQ ID NO: 929011 - DNA, 25 bp, Mus musculus
ttcacccaggagatgcatctgccaa

SEQ ID NO: 929012 - DNA, 25 bp, Mus musculus
ttcacccaggagttgcatctgccaa

SEQ ID NO: 929013 - DNA, 25 bp, Mus musculus
ttcacccagtatccaggatcctgtg

SEQ ID NO: 929014 - DNA, 25 bp, Mus musculus
ttcacccagtatgcaggatcctgtg

SEQ ID NO: 929015 - DNA, 25 bp, Mus musculus
ttcacccagtgcataacatagctag

SEQ ID NO: 929016 - DNA, 25 bp, Mus musculus
ttcacccagtgcatccagtaggtgg

SEQ ID NO: 929017 - DNA, 25 bp, Mus musculus
ttcacccagtgcttaacatagctag

SEQ ID NO: 929018 - DNA, 25 bp, Mus musculus
ttcacccagtgcttccagtaggtgg

SEQ ID NO: 929019 - DNA, 25 bp, Mus musculus
ttcacccagtggatcaagagacaga

SEQ ID NO: 929020 - DNA, 25 bp, Mus musculus
ttcacccagtggttcaagagacaga

SEQ ID NO: 929021 - DNA, 25 bp, Mus musculus
ttcacccataggatgttagctttga

SEQ ID NO: 929022 - DNA, 25 bp, Mus musculus
ttcacccataggttgttagctttga

SEQ ID NO: 929023 - DNA, 25 bp, Mus musculus
ttcacccatatgcacaataagaagc

SEQ ID NO: 929024 - DNA, 25 bp, Mus musculus
ttcacccatatggacaataagaagc

SEQ ID NO: 929025 - DNA, 25 bp, Mus musculus
ttcacccatcctactcttgaatttt

SEQ ID NO: 929026 - DNA, 25 bp, Mus musculus
ttcacccatccttctcttgaatttt

SEQ ID NO: 929027 - DNA, 25 bp, Mus musculus
ttcacccatgctctgaagtaagctg

SEQ ID NO: 929028 - DNA, 25 bp, Mus musculus
ttcacccatgctgtgaagtaagctg

SEQ ID NO: 929029 - DNA, 25 bp, Mus musculus
ttcacccatggcacactattctgta

SEQ ID NO: 929030 - DNA, 25 bp, Mus musculus
ttcacccatggctcactattctgta

SEQ ID NO: 929031 - DNA, 25 bp, Mus musculus
ttcacccatgtcaggaccgaagtct

SEQ ID NO: 929032 - DNA, 25 bp, Mus musculus
ttcacccatgtctggaccgaagtct

SEQ ID NO: 929033 - DNA, 25 bp, Mus musculus
ttcaccccaaatcttaagcttgcaa

SEQ ID NO: 929034 - DNA, 25 bp, Mus musculus
ttcaccccaaatgttaagcttgcaa

SEQ ID NO: 929035 - DNA, 25 bp, Mus musculus
ttcaccccagatcaaaagcaacaca

SEQ ID NO: 929036 - DNA, 25 bp, Mus musculus
ttcaccccagatgaaaagcaacaca

SEQ ID NO: 929037 - DNA, 25 bp, Mus musculus
ttcaccccattaaatgtccatgttt

SEQ ID NO: 929038 - DNA, 25 bp, Mus musculus
ttcaccccattatatgtccatgttt

SEQ ID NO: 929039 - DNA, 25 bp, Mus musculus
ttcacccctagacaggccatggcca

SEQ ID NO: 929040 - DNA, 25 bp, Mus musculus
ttcacccctagagaggccatggcca

SEQ ID NO: 929041 - DNA, 25 bp, Mus musculus
ttcacccctcatctatggatctgga

SEQ ID NO: 929042 - DNA, 25 bp, Mus musculus
ttcacccctcatgtatggatctgga

SEQ ID NO: 929043 - DNA, 25 bp, Mus musculus
ttcacccctgctcataggcttcaag

SEQ ID NO: 929044 - DNA, 25 bp, Mus musculus
ttcacccctgctcggaaatgagtgc

SEQ ID NO: 929045 - DNA, 25 bp, Mus musculus
ttcacccctgctgataggcttcaag

SEQ ID NO: 929046 - DNA, 25 bp, Mus musculus
ttcacccctgctgggaaatgagtgc

SEQ ID NO: 929047 - DNA, 25 bp, Mus musculus
ttcacccgcagcatgttgacctggg

SEQ ID NO: 929048 - DNA, 25 bp, Mus musculus
ttcacccgcagcttgttgacctggg

SEQ ID NO: 929049 - DNA, 25 bp, Mus musculus
ttcacccgtctgctttctggaaaag

SEQ ID NO: 929050 - DNA, 25 bp, Mus musculus
ttcacccgtctggtttctggaaaag

SEQ ID NO: 929051 - DNA, 25 bp, Mus musculus
ttcaccctacttccagtatagtttc

SEQ ID NO: 929052 - DNA, 25 bp, Mus musculus
ttcaccctacttgcagtatagtttc

SEQ ID NO: 929053 - DNA, 25 bp, Mus musculus
ttcaccctatcacagcttggctttc

SEQ ID NO: 929054 - DNA, 25 bp, Mus musculus
ttcaccctatcagagcttggctttc

SEQ ID NO: 929055 - DNA, 25 bp, Mus musculus
ttcaccctcagtcacggatgtgaga

SEQ ID NO: 929056 - DNA, 25 bp, Mus musculus
ttcaccctcagtgacggatgtgaga

SEQ ID NO: 929057 - DNA, 25 bp, Mus musculus
ttcaccctctctaatgatgtcttta

SEQ ID NO: 929058 - DNA, 25 bp, Mus musculus
ttcaccctctcttatgatgtcttta

SEQ ID NO: 929059 - DNA, 25 bp, Mus musculus
ttcaccctgcacatttctacatgct

SEQ ID NO: 929060 - DNA, 25 bp, Mus musculus
ttcaccctgcacttttctacatgct

SEQ ID NO: 929061 - DNA, 25 bp, Mus musculus
ttcaccctgttaatcccacttcaga

SEQ ID NO: 929062 - DNA, 25 bp, Mus musculus
ttcaccctgttattcccacttcaga

SEQ ID NO: 929063 - DNA, 25 bp, Mus musculus
ttcacccttaatccagaggatatta

SEQ ID NO: 929064 - DNA, 25 bp, Mus musculus
ttcacccttaatgcagaggatatta

SEQ ID NO: 929065 - DNA, 25 bp, Mus musculus
ttcacccttcaaagcagcatctatt

SEQ ID NO: 929066 - DNA, 25 bp, Mus musculus
ttcacccttcaatgcagcatctatt

SEQ ID NO: 929067 - DNA, 25 bp, Mus musculus
ttcacccttccaaataagtctcatg

SEQ ID NO: 929068 - DNA, 25 bp, Mus musculus
ttcacccttccatataagtctcatg

SEQ ID NO: 929069 - DNA, 25 bp, Mus musculus
ttcacccttgaaaatccgcagatgt

SEQ ID NO: 929070 - DNA, 25 bp, Mus musculus
ttcacccttgaatatccgcagatgt

SEQ ID NO: 929071 - DNA, 25 bp, Mus musculus
ttcacccttgctacaacatgagcct

SEQ ID NO: 929072 - DNA, 25 bp, Mus musculus
ttcacccttgcttcaacatgagcct

SEQ ID NO: 929073 - DNA, 25 bp, Mus musculus
ttcaccctttcgatttctgcaagaa

SEQ ID NO: 929074 - DNA, 25 bp, Mus musculus
ttcaccctttcgttttctgcaagaa

SEQ ID NO: 929075 - DNA, 25 bp, Mus musculus
ttcaccctttgcagcgtggaagtca

SEQ ID NO: 929076 - DNA, 25 bp, Mus musculus
ttcaccctttgctgcgtggaagtca

SEQ ID NO: 929077 - DNA, 25 bp, Mus musculus
ttcaccgaaaagcttttgcaacagg

SEQ ID NO: 929078 - DNA, 25 bp, Mus musculus
ttcaccgaaaaggttttgcaacagg

SEQ ID NO: 929079 - DNA, 25 bp, Mus musculus
ttcaccgaagatattcccgttgctt

SEQ ID NO: 929080 - DNA, 25 bp, Mus musculus
ttcaccgaagattttcccgttgctt

SEQ ID NO: 929081 - DNA, 25 bp, Mus musculus
ttcaccgcccataacgagtgctgaa

SEQ ID NO: 929082 - DNA, 25 bp, Mus musculus
ttcaccgcccattacgagtgctgaa

SEQ ID NO: 929083 - DNA, 25 bp, Mus musculus
ttcaccgccgagcttggtccaggaa

SEQ ID NO: 929084 - DNA, 25 bp, Mus musculus
ttcaccgccgaggttggtccaggaa

SEQ ID NO: 929085 - DNA, 25 bp, Mus musculus
ttcaccgcctccagaagaaactgga

SEQ ID NO: 929086 - DNA, 25 bp, Mus musculus
ttcaccgcctcctgaagaaactgga

SEQ ID NO: 929087 - DNA, 25 bp, Mus musculus
ttcaccggaagacgattcctgactc

SEQ ID NO: 929088 - DNA, 25 bp, Mus musculus
ttcaccggaagaggattcctgactc

SEQ ID NO: 929089 - DNA, 25 bp, Mus musculus
ttcaccggaaggatctcaccacatc

SEQ ID NO: 929090 - DNA, 25 bp, Mus musculus
ttcaccggaaggttctcaccacatc

SEQ ID NO: 929091 - DNA, 25 bp, Mus musculus
ttcaccggccgtcgatgcgatatga

SEQ ID NO: 929092 - DNA, 25 bp, Mus musculus
ttcaccggccgtggatgcgatatga

SEQ ID NO: 929093 - DNA, 25 bp, Mus musculus
ttcaccggcgatctggttcgtggac

SEQ ID NO: 929094 - DNA, 25 bp, Mus musculus
ttcaccggcgatgtggttcgtggac

SEQ ID NO: 929095 - DNA, 25 bp, Mus musculus
ttcaccgggaaaagcccacttgact

SEQ ID NO: 929096 - DNA, 25 bp, Mus musculus
ttcaccgggaaatgcccacttgact

SEQ ID NO: 929097 - DNA, 25 bp, Mus musculus
ttcaccggtacacgaagctttctta

SEQ ID NO: 929098 - DNA, 25 bp, Mus musculus
ttcaccggtacaggaagctttctta

SEQ ID NO: 929099 - DNA, 25 bp, Mus musculus
ttcaccgtaagcagcatactcagtg

SEQ ID NO: 929100 - DNA, 25 bp, Mus musculus
ttcaccgtaagctgcatactcagtg

SEQ ID NO: 929101 - DNA, 25 bp, Mus musculus
ttcaccgtaggtcagcagagtgctt

SEQ ID NO: 929102 - DNA, 25 bp, Mus musculus
ttcaccgtaggtgagcagagtgctt

SEQ ID NO: 929103 - DNA, 25 bp, Mus musculus
ttcaccgtcactctagtcaaggatg

SEQ ID NO: 929104 - DNA, 25 bp, Mus musculus
ttcaccgtcactgtagtcaaggatg

SEQ ID NO: 929105 - DNA, 25 bp, Mus musculus
ttcaccgtgaacattagggcccgag

SEQ ID NO: 929106 - DNA, 25 bp, Mus musculus
ttcaccgtgaactttagggcccgag

SEQ ID NO: 929107 - DNA, 25 bp, Mus musculus
ttcaccgtggcccaaaccagattcg

SEQ ID NO: 929108 - DNA, 25 bp, Mus musculus
ttcaccgtggcccaggcgcagagtt

SEQ ID NO: 929109 - DNA, 25 bp, Mus musculus
ttcaccgtggccgaaaccagattcg

SEQ ID NO: 929110 - DNA, 25 bp, Mus musculus
ttcaccgtggccgaggcgcagagtt

SEQ ID NO: 929111 - DNA, 25 bp, Mus musculus
ttcaccgttactctgacaagcacaa

SEQ ID NO: 929112 - DNA, 25 bp, Mus musculus
ttcaccgttactgtgacaagcacaa

SEQ ID NO: 929113 - DNA, 25 bp, Mus musculus
ttcaccgttcccattacataaacgc

SEQ ID NO: 929114 - DNA, 25 bp, Mus musculus
ttcaccgttccctttacataaacgc

SEQ ID NO: 929115 - DNA, 25 bp, Mus musculus
ttcaccgtttgccttttgtactctg

SEQ ID NO: 929116 - DNA, 25 bp, Mus musculus
ttcaccgtttgcgttttgtactctg

SEQ ID NO: 929117 - DNA, 25 bp, Mus musculus
ttcacctaaactcctgtggcatctg

SEQ ID NO: 929118 - DNA, 25 bp, Mus musculus
ttcacctaaactgctgtggcatctg

SEQ ID NO: 929119 - DNA, 25 bp, Mus musculus
ttcacctaacccaaggcagcattaa

SEQ ID NO: 929120 - DNA, 25 bp, Mus musculus
ttcacctaaccctaggcagcattaa

SEQ ID NO: 929121 - DNA, 25 bp, Mus musculus
ttcacctaagtgaccaacagttatt

SEQ ID NO: 929122 - DNA, 25 bp, Mus musculus
ttcacctaagtgtccaacagttatt

SEQ ID NO: 929123 - DNA, 25 bp, Mus musculus
ttcacctacagcacttgcccaagag

SEQ ID NO: 929124 - DNA, 25 bp, Mus musculus
ttcacctacagctcttgcccaagag

SEQ ID NO: 929125 - DNA, 25 bp, Mus musculus
ttcacctaccgtaactaatacagat

SEQ ID NO: 929126 - DNA, 25 bp, Mus musculus
ttcacctaccgttactaatacagat

SEQ ID NO: 929127 - DNA, 25 bp, Mus musculus
ttcacctacctcatatggcatcagg

SEQ ID NO: 929128 - DNA, 25 bp, Mus musculus
ttcacctacctcttatggcatcagg

SEQ ID NO: 929129 - DNA, 25 bp, Mus musculus
ttcacctatcaccaggatcaagctc

SEQ ID NO: 929130 - DNA, 25 bp, Mus musculus
ttcacctatcacgaggatcaagctc

SEQ ID NO: 929131 - DNA, 25 bp, Mus musculus
ttcacctatctacccatggtcatat

SEQ ID NO: 929132 - DNA, 25 bp, Mus musculus
ttcacctatctagccatggtcatat

SEQ ID NO: 929133 - DNA, 25 bp, Mus musculus
ttcacctatctgaccacagtggatt

SEQ ID NO: 929134 - DNA, 25 bp, Mus musculus
ttcacctatctgtccacagtggatt

SEQ ID NO: 929135 - DNA, 25 bp, Mus musculus
ttcacctattgtctgatagccctgg

SEQ ID NO: 929136 - DNA, 25 bp, Mus musculus
ttcacctattgtgtgatagccctgg

SEQ ID NO: 929137 - DNA, 25 bp, Mus musculus
ttcacctcaaataaagtaatgtacc

SEQ ID NO: 929138 - DNA, 25 bp, Mus musculus
ttcacctcaaattaagtaatgtacc

SEQ ID NO: 929139 - DNA, 25 bp, Mus musculus
ttcacctcaccccgttttactgtag

SEQ ID NO: 929140 - DNA, 25 bp, Mus musculus
ttcacctcacccggttttactgtag

SEQ ID NO: 929141 - DNA, 25 bp, Mus musculus
ttcacctcaccgagacgcaggtcaa

SEQ ID NO: 929142 - DNA, 25 bp, Mus musculus
ttcacctcaccgtgacgcaggtcaa

SEQ ID NO: 929143 - DNA, 25 bp, Mus musculus
ttcacctcactccagtttgactagg

SEQ ID NO: 929144 - DNA, 25 bp, Mus musculus
ttcacctcactcgagtttgactagg

SEQ ID NO: 929145 - DNA, 25 bp, Mus musculus
ttcacctcagctatcttgggataac

SEQ ID NO: 929146 - DNA, 25 bp, Mus musculus
ttcacctcagctattggtaccatga

SEQ ID NO: 929147 - DNA, 25 bp, Mus musculus
ttcacctcagctttcttgggataac

SEQ ID NO: 929148 - DNA, 25 bp, Mus musculus
ttcacctcagcttttggtaccatga

SEQ ID NO: 929149 - DNA, 25 bp, Mus musculus
ttcacctcagtgagggcacagtaac

SEQ ID NO: 929150 - DNA, 25 bp, Mus musculus
ttcacctcagtgtgggcacagtaac

SEQ ID NO: 929151 - DNA, 25 bp, Mus musculus
ttcacctcatttactgtcctagttg

SEQ ID NO: 929152 - DNA, 25 bp, Mus musculus
ttcacctcattttctgtcctagttg

SEQ ID NO: 929153 - DNA, 25 bp, Mus musculus
ttcacctccgtgcttcatttcaaat

SEQ ID NO: 929154 - DNA, 25 bp, Mus musculus
ttcacctccgtggttcatttcaaat

SEQ ID NO: 929155 - DNA, 25 bp, Mus musculus
ttcacctcctgcagtcagtgtgcat

SEQ ID NO: 929156 - DNA, 25 bp, Mus musculus
ttcacctcctgctgtcagtgtgcat

SEQ ID NO: 929157 - DNA, 25 bp, Mus musculus
ttcacctcgggtcatcgaaatcgaa

SEQ ID NO: 929158 - DNA, 25 bp, Mus musculus
ttcacctcgggtgatcgaaatcgaa

SEQ ID NO: 929159 - DNA, 25 bp, Mus musculus
ttcacctctgcgacattttaaatta

SEQ ID NO: 929160 - DNA, 25 bp, Mus musculus
ttcacctctgcgtcattttaaatta

SEQ ID NO: 929161 - DNA, 25 bp, Mus musculus
ttcacctctgctcaaaccatggaga

SEQ ID NO: 929162 - DNA, 25 bp, Mus musculus
ttcacctctgctgaaaccatggaga

SEQ ID NO: 929163 - DNA, 25 bp, Mus musculus
ttcacctctgggactaaccgtaagt

SEQ ID NO: 929164 - DNA, 25 bp, Mus musculus
ttcacctctgggtctaaccgtaagt

SEQ ID NO: 929165 - DNA, 25 bp, Mus musculus
ttcacctctggtcctgtgtcactga

SEQ ID NO: 929166 - DNA, 25 bp, Mus musculus
ttcacctctggtgctgtgtcactga

SEQ ID NO: 929167 - DNA, 25 bp, Mus musculus
ttcacctcttttaatagaatcagct

SEQ ID NO: 929168 - DNA, 25 bp, Mus musculus
ttcacctctttttatagaatcagct

SEQ ID NO: 929169 - DNA, 25 bp, Mus musculus
ttcacctgacacatgttttgctggc

SEQ ID NO: 929170 - DNA, 25 bp, Mus musculus
ttcacctgacacttgttttgctggc

SEQ ID NO: 929171 - DNA, 25 bp, Mus musculus
ttcacctgactcccgtataatatgc

SEQ ID NO: 929172 - DNA, 25 bp, Mus musculus
ttcacctgactcgcgtataatatgc

SEQ ID NO: 929173 - DNA, 25 bp, Mus musculus
ttcacctgccctctggttatatgta

SEQ ID NO: 929174 - DNA, 25 bp, Mus musculus
ttcacctgccctgtggttatatgta

SEQ ID NO: 929175 - DNA, 25 bp, Mus musculus
ttcacctgcctgattactgtcggta

SEQ ID NO: 929176 - DNA, 25 bp, Mus musculus
ttcacctgcctgtttactgtcggta

SEQ ID NO: 929177 - DNA, 25 bp, Mus musculus
ttcacctgctttcttgatagtctct

SEQ ID NO: 929178 - DNA, 25 bp, Mus musculus
ttcacctgctttgttgatagtctct

SEQ ID NO: 929179 - DNA, 25 bp, Mus musculus
ttcacctgggcactcacgaaaccaa

SEQ ID NO: 929180 - DNA, 25 bp, Mus musculus
ttcacctgggcagtcacgaaaccaa

SEQ ID NO: 929181 - DNA, 25 bp, Mus musculus
ttcacctggtgtaatacaaagtcag

SEQ ID NO: 929182 - DNA, 25 bp, Mus musculus
ttcacctggtgttatacaaagtcag

SEQ ID NO: 929183 - DNA, 25 bp, Mus musculus
ttcacctggttactacggcagcaga

SEQ ID NO: 929184 - DNA, 25 bp, Mus musculus
ttcacctggttagtacggcagcaga

SEQ ID NO: 929185 - DNA, 25 bp, Mus musculus
ttcacctgtagcatgtgaacatgtg

SEQ ID NO: 929186 - DNA, 25 bp, Mus musculus
ttcacctgtagcttgtgaacatgtg

SEQ ID NO: 929187 - DNA, 25 bp, Mus musculus
ttcacctgtctaaccattcatgtat

SEQ ID NO: 929188 - DNA, 25 bp, Mus musculus
ttcacctgtctatccattcatgtat

SEQ ID NO: 929189 - DNA, 25 bp, Mus musculus
ttcacctgttgcattctgtagttag

SEQ ID NO: 929190 - DNA, 25 bp, Mus musculus
ttcacctgttgctttctgtagttag

SEQ ID NO: 929191 - DNA, 25 bp, Mus musculus
ttcaccttaaaccatacccagctag

SEQ ID NO: 929192 - DNA, 25 bp, Mus musculus
ttcaccttaaacgatacccagctag

SEQ ID NO: 929193 - DNA, 25 bp, Mus musculus
ttcaccttaccaaagactctatcca

SEQ ID NO: 929194 - DNA, 25 bp, Mus musculus
ttcaccttaccatagactctatcca

SEQ ID NO: 929195 - DNA, 25 bp, Mus musculus
ttcaccttagggattgcctcgtgat

SEQ ID NO: 929196 - DNA, 25 bp, Mus musculus
ttcaccttagggtttgcctcgtgat

SEQ ID NO: 929197 - DNA, 25 bp, Mus musculus
ttcaccttcaagctgaggaatccct

SEQ ID NO: 929198 - DNA, 25 bp, Mus musculus
ttcaccttcaaggtgaggaatccct

SEQ ID NO: 929199 - DNA, 25 bp, Mus musculus
ttcaccttcaccatgaacgacagga

SEQ ID NO: 929200 - DNA, 25 bp, Mus musculus
ttcaccttcaccttgaacgacagga

SEQ ID NO: 929201 - DNA, 25 bp, Mus musculus
ttcaccttccgtacacaaggcttaa

SEQ ID NO: 929202 - DNA, 25 bp, Mus musculus
ttcaccttccgttcacaaggcttaa

SEQ ID NO: 929203 - DNA, 25 bp, Mus musculus
ttcaccttcctcacaatggactggg

SEQ ID NO: 929204 - DNA, 25 bp, Mus musculus
ttcaccttcctcacatgcttttggg

SEQ ID NO: 929205 - DNA, 25 bp, Mus musculus
ttcaccttcctctcaatggactggg

SEQ ID NO: 929206 - DNA, 25 bp, Mus musculus
ttcaccttcctctcatgcttttggg

SEQ ID NO: 929207 - DNA, 25 bp, Mus musculus
ttcaccttctttatacagcttatcc

SEQ ID NO: 929208 - DNA, 25 bp, Mus musculus
ttcaccttctttttacagcttatcc

SEQ ID NO: 929209 - DNA, 25 bp, Mus musculus
ttcaccttgaaccacaggaacactt

SEQ ID NO: 929210 - DNA, 25 bp, Mus musculus
ttcaccttgaacgacaggaacactt

SEQ ID NO: 929211 - DNA, 25 bp, Mus musculus
ttcaccttgggactatgtataactt

SEQ ID NO: 929212 - DNA, 25 bp, Mus musculus
ttcaccttgggagtatgtataactt

SEQ ID NO: 929213 - DNA, 25 bp, Mus musculus
ttcaccttgtttaagttgggcacct

SEQ ID NO: 929214 - DNA, 25 bp, Mus musculus
ttcaccttgttttagttgggcacct

SEQ ID NO: 929215 - DNA, 25 bp, Mus musculus
ttcacctttgagaaccgctacctgg

SEQ ID NO: 929216 - DNA, 25 bp, Mus musculus
ttcacctttgagtaccgctacctgg

SEQ ID NO: 929217 - DNA, 25 bp, Mus musculus
ttcaccttttccatcattgtagtag

SEQ ID NO: 929218 - DNA, 25 bp, Mus musculus
ttcaccttttccttcattgtagtag

SEQ ID NO: 929219 - DNA, 25 bp, Mus musculus
ttcacgaaggatctaaactgcttag

SEQ ID NO: 929220 - DNA, 25 bp, Mus musculus
ttcacgaaggatgtaaactgcttag

SEQ ID NO: 929221 - DNA, 25 bp, Mus musculus
ttcacgacacctagccatttgagag

SEQ ID NO: 929222 - DNA, 25 bp, Mus musculus
ttcacgacaccttgccatttgagag

SEQ ID NO: 929223 - DNA, 25 bp, Mus musculus
ttcacgaccactagctgggccgata

SEQ ID NO: 929224 - DNA, 25 bp, Mus musculus
ttcacgaccacttgctgggccgata

SEQ ID NO: 929225 - DNA, 25 bp, Mus musculus
ttcacgagaagaacactacagatgc

SEQ ID NO: 929226 - DNA, 25 bp, Mus musculus
ttcacgagaagatcactacagatgc

SEQ ID NO: 929227 - DNA, 25 bp, Mus musculus
ttcacgagcaccacctgtttatttt

SEQ ID NO: 929228 - DNA, 25 bp, Mus musculus
ttcacgagcacctcctgtttatttt

SEQ ID NO: 929229 - DNA, 25 bp, Mus musculus
ttcacgagcgcaactgggtacggga

SEQ ID NO: 929230 - DNA, 25 bp, Mus musculus
ttcacgagcgcatctgggtacggga

SEQ ID NO: 929231 - DNA, 25 bp, Mus musculus
ttcacgatgtgtcagtgagtgcagc

SEQ ID NO: 929232 - DNA, 25 bp, Mus musculus
ttcacgatgtgtgagtgagtgcagc

SEQ ID NO: 929233 - DNA, 25 bp, Mus musculus
ttcacgcagcagcagtctctgaata

SEQ ID NO: 929234 - DNA, 25 bp, Mus musculus
ttcacgcagcaggagtctctgaata

SEQ ID NO: 929235 - DNA, 25 bp, Mus musculus
ttcacgccagacacttggaagtgac

SEQ ID NO: 929236 - DNA, 25 bp, Mus musculus
ttcacgccagactcttggaagtgac

SEQ ID NO: 929237 - DNA, 25 bp, Mus musculus
ttcacgccctctacctgaagcgggt

SEQ ID NO: 929238 - DNA, 25 bp, Mus musculus
ttcacgccctcttcctgaagcgggt

SEQ ID NO: 929239 - DNA, 25 bp, Mus musculus
ttcacgcctactatccttggatgtc

SEQ ID NO: 929240 - DNA, 25 bp, Mus musculus
ttcacgcctactttccttggatgtc

SEQ ID NO: 929241 - DNA, 25 bp, Mus musculus
ttcacgcgagctatcatgttcagca

SEQ ID NO: 929242 - DNA, 25 bp, Mus musculus
ttcacgcgagctttcatgttcagca

SEQ ID NO: 929243 - DNA, 25 bp, Mus musculus
ttcacgcgtgccatcgaagattggt

SEQ ID NO: 929244 - DNA, 25 bp, Mus musculus
ttcacgcgtgccttcgaagattggt

SEQ ID NO: 929245 - DNA, 25 bp, Mus musculus
ttcacgctgcacatttagccagaga

SEQ ID NO: 929246 - DNA, 25 bp, Mus musculus
ttcacgctgcacttttagccagaga

SEQ ID NO: 929247 - DNA, 25 bp, Mus musculus
ttcacgctgctgacaacgccgggct

SEQ ID NO: 929248 - DNA, 25 bp, Mus musculus
ttcacgctgctgtcaacgccgggct

SEQ ID NO: 929249 - DNA, 25 bp, Mus musculus
ttcacgctggaaaaacggtgcccat

SEQ ID NO: 929250 - DNA, 25 bp, Mus musculus
ttcacgctggaataacggtgcccat

SEQ ID NO: 929251 - DNA, 25 bp, Mus musculus
ttcacgctgggcaacatgcatgtgt

SEQ ID NO: 929252 - DNA, 25 bp, Mus musculus
ttcacgctgggctacatgcatgtgt

SEQ ID NO: 929253 - DNA, 25 bp, Mus musculus
ttcacggaaaacagggctacgcttc

SEQ ID NO: 929254 - DNA, 25 bp, Mus musculus
ttcacggaaaactgggctacgcttc

SEQ ID NO: 929255 - DNA, 25 bp, Mus musculus
ttcacggaagagcactcggagagaa

SEQ ID NO: 929256 - DNA, 25 bp, Mus musculus
ttcacggaagaggactcggagagaa

SEQ ID NO: 929257 - DNA, 25 bp, Mus musculus
ttcacggagcctctgtcttgtgagg

SEQ ID NO: 929258 - DNA, 25 bp, Mus musculus
ttcacggagcctgtgtcttgtgagg

SEQ ID NO: 929259 - DNA, 25 bp, Mus musculus
ttcacggagctacagtgttccttac

SEQ ID NO: 929260 - DNA, 25 bp, Mus musculus
ttcacggagctagagtgttccttac

SEQ ID NO: 929261 - DNA, 25 bp, Mus musculus
ttcacggatacaccagcagtgttgg

SEQ ID NO: 929262 - DNA, 25 bp, Mus musculus
ttcacggatacagcagcagtgttgg

SEQ ID NO: 929263 - DNA, 25 bp, Mus musculus
ttcacgggacttcaacatattactg

SEQ ID NO: 929264 - DNA, 25 bp, Mus musculus
ttcacgggacttgaacatattactg

SEQ ID NO: 929265 - DNA, 25 bp, Mus musculus
ttcacgggctccacgcttttgctgt

SEQ ID NO: 929266 - DNA, 25 bp, Mus musculus
ttcacgggctcctcgcttttgctgt

SEQ ID NO: 929267 - DNA, 25 bp, Mus musculus
ttcacgggtctcaggttggtattca

SEQ ID NO: 929268 - DNA, 25 bp, Mus musculus
ttcacgggtctctggttggtattca

SEQ ID NO: 929269 - DNA, 25 bp, Mus musculus
ttcacgggtgccagacaagaaaagt

SEQ ID NO: 929270 - DNA, 25 bp, Mus musculus
ttcacgggtgcctgacaagaaaagt

SEQ ID NO: 929271 - DNA, 25 bp, Mus musculus
ttcacgggttgcctggacgttatct

SEQ ID NO: 929272 - DNA, 25 bp, Mus musculus
ttcacgggttgcgtggacgttatct

SEQ ID NO: 929273 - DNA, 25 bp, Mus musculus
ttcacggtagataccatcagcgctg

SEQ ID NO: 929274 - DNA, 25 bp, Mus musculus
ttcacggtagattccatcagcgctg

SEQ ID NO: 929275 - DNA, 25 bp, Mus musculus
ttcacggtattcatcaactgtagag

SEQ ID NO: 929276 - DNA, 25 bp, Mus musculus
ttcacggtattcttcaactgtagag

SEQ ID NO: 929277 - DNA, 25 bp, Mus musculus
ttcacggtgggtactcttttcggat

SEQ ID NO: 929278 - DNA, 25 bp, Mus musculus
ttcacggtgggttctcttttcggat

SEQ ID NO: 929279 - DNA, 25 bp, Mus musculus
ttcacggttaccagttattctggtt

SEQ ID NO: 929280 - DNA, 25 bp, Mus musculus
ttcacggttacctgttattctggtt

SEQ ID NO: 929281 - DNA, 25 bp, Mus musculus
ttcacggttccaaccgttacaaggg

SEQ ID NO: 929282 - DNA, 25 bp, Mus musculus
ttcacggttccatccgttacaaggg

SEQ ID NO: 929283 - DNA, 25 bp, Mus musculus
ttcacgtacctcacgggacaacttt

SEQ ID NO: 929284 - DNA, 25 bp, Mus musculus
ttcacgtacctctcgggacaacttt

SEQ ID NO: 929285 - DNA, 25 bp, Mus musculus
ttcacgtagattattgctgctggat

SEQ ID NO: 929286 - DNA, 25 bp, Mus musculus
ttcacgtagatttttgctgctggat

SEQ ID NO: 929287 - DNA, 25 bp, Mus musculus
ttcacgtccaagctcagggtcatgg

SEQ ID NO: 929288 - DNA, 25 bp, Mus musculus
ttcacgtccaaggtcagggtcatgg

SEQ ID NO: 929289 - DNA, 25 bp, Mus musculus
ttcacgtcctagcactgcagtatct

SEQ ID NO: 929290 - DNA, 25 bp, Mus musculus
ttcacgtcctaggactgcagtatct

SEQ ID NO: 929291 - DNA, 25 bp, Mus musculus
ttcacgtctccaacaacttcgtcag

SEQ ID NO: 929292 - DNA, 25 bp, Mus musculus
ttcacgtctccatcaacttcgtcag

SEQ ID NO: 929293 - DNA, 25 bp, Mus musculus
ttcacgtctgccaaccatgtgtgtt

SEQ ID NO: 929294 - DNA, 25 bp, Mus musculus
ttcacgtctgcctaccatgtgtgtt

SEQ ID NO: 929295 - DNA, 25 bp, Mus musculus
ttcacgtcttttcctctctggactt

SEQ ID NO: 929296 - DNA, 25 bp, Mus musculus
ttcacgtcttttgctctctggactt

SEQ ID NO: 929297 - DNA, 25 bp, Mus musculus
ttcacgtgactgagtctgtgctgat

SEQ ID NO: 929298 - DNA, 25 bp, Mus musculus
ttcacgtgactgtgtctgtgctgat

SEQ ID NO: 929299 - DNA, 25 bp, Mus musculus
ttcacgtgcgctcggcctagaaaga

SEQ ID NO: 929300 - DNA, 25 bp, Mus musculus
ttcacgtgcgctgggcctagaaaga

SEQ ID NO: 929301 - DNA, 25 bp, Mus musculus
ttcacgtggtagcagcagattccca

SEQ ID NO: 929302 - DNA, 25 bp, Mus musculus
ttcacgtggtaggagcagattccca

SEQ ID NO: 929303 - DNA, 25 bp, Mus musculus
ttcacgtgtctacagtcactgggta

SEQ ID NO: 929304 - DNA, 25 bp, Mus musculus
ttcacgtgtctagagtcactgggta

SEQ ID NO: 929305 - DNA, 25 bp, Mus musculus
ttcacgttcacccttgattttctta

SEQ ID NO: 929306 - DNA, 25 bp, Mus musculus
ttcacgttcaccgttgattttctta

SEQ ID NO: 929307 - DNA, 25 bp, Mus musculus
ttcacgttcactatgtctgaaggca

SEQ ID NO: 929308 - DNA, 25 bp, Mus musculus
ttcacgttcactttgtctgaaggca

SEQ ID NO: 929309 - DNA, 25 bp, Mus musculus
ttcacgttcatgaatgactgccgct

SEQ ID NO: 929310 - DNA, 25 bp, Mus musculus
ttcacgttcatgtatgactgccgct

SEQ ID NO: 929311 - DNA, 25 bp, Mus musculus
ttcacgttgccccaagtgtcttgta

SEQ ID NO: 929312 - DNA, 25 bp, Mus musculus
ttcacgttgcccgaagtgtcttgta

SEQ ID NO: 929313 - DNA, 25 bp, Mus musculus
ttcacgttggaacccgggtcttgcg

SEQ ID NO: 929314 - DNA, 25 bp, Mus musculus
ttcacgttggaagccgggtcttgcg

SEQ ID NO: 929315 - DNA, 25 bp, Mus musculus
ttcacgtttgtcaaatacgtctcat

SEQ ID NO: 929316 - DNA, 25 bp, Mus musculus
ttcacgtttgtctaatacgtctcat

SEQ ID NO: 929317 - DNA, 25 bp, Mus musculus
ttcacgtttgtgcattctacttgtc

SEQ ID NO: 929318 - DNA, 25 bp, Mus musculus
ttcacgtttgtggattctacttgtc

SEQ ID NO: 929319 - DNA, 25 bp, Mus musculus
ttcacgttttgaattattaggtact

SEQ ID NO: 929320 - DNA, 25 bp, Mus musculus
ttcacgttttgatttattaggtact

SEQ ID NO: 929321 - DNA, 25 bp, Mus musculus
ttcacgtttttcacacaagggctca

SEQ ID NO: 929322 - DNA, 25 bp, Mus musculus
ttcacgtttttctcacaagggctca

SEQ ID NO: 929323 - DNA, 25 bp, Mus musculus
ttcactaaagtgagcgactgggttt

SEQ ID NO: 929324 - DNA, 25 bp, Mus musculus
ttcactaaagtgtgcgactgggttt

SEQ ID NO: 929325 - DNA, 25 bp, Mus musculus
ttcactaaatgtacagtctgccttt

SEQ ID NO: 929326 - DNA, 25 bp, Mus musculus
ttcactaaatgttcagtctgccttt

SEQ ID NO: 929327 - DNA, 25 bp, Mus musculus
ttcactaatataacttttggatcct

SEQ ID NO: 929328 - DNA, 25 bp, Mus musculus
ttcactaatatatcttttggatcct

SEQ ID NO: 929329 - DNA, 25 bp, Mus musculus
ttcactaatgcccagatgtactgga

SEQ ID NO: 929330 - DNA, 25 bp, Mus musculus
ttcactaatgccgagatgtactgga

SEQ ID NO: 929331 - DNA, 25 bp, Mus musculus
ttcactaattttcctctagagatga

SEQ ID NO: 929332 - DNA, 25 bp, Mus musculus
ttcactaattttgctctagagatga

SEQ ID NO: 929333 - DNA, 25 bp, Mus musculus
ttcactacccatcggtgttcattta

SEQ ID NO: 929334 - DNA, 25 bp, Mus musculus
ttcactacccatgggtgttcattta

SEQ ID NO: 929335 - DNA, 25 bp, Mus musculus
ttcactaccccaaaacattatcatc

SEQ ID NO: 929336 - DNA, 25 bp, Mus musculus
ttcactaccccataacattatcatc

SEQ ID NO: 929337 - DNA, 25 bp, Mus musculus
ttcactactgacctgttcgaggcag

SEQ ID NO: 929338 - DNA, 25 bp, Mus musculus
ttcactactgacgtgttcgaggcag

SEQ ID NO: 929339 - DNA, 25 bp, Mus musculus
ttcactactgagctgagaacaactc

SEQ ID NO: 929340 - DNA, 25 bp, Mus musculus
ttcactactgaggtgagaacaactc

SEQ ID NO: 929341 - DNA, 25 bp, Mus musculus
ttcactactgctaattttcctaaaa

SEQ ID NO: 929342 - DNA, 25 bp, Mus musculus
ttcactactgcttattttcctaaaa

SEQ ID NO: 929343 - DNA, 25 bp, Mus musculus
ttcactagagcaatggctgagcccc

SEQ ID NO: 929344 - DNA, 25 bp, Mus musculus
ttcactagagcattggctgagcccc

SEQ ID NO: 929345 - DNA, 25 bp, Mus musculus
ttcactagcgccatatggttttaaa

SEQ ID NO: 929346 - DNA, 25 bp, Mus musculus
ttcactagcgccttatggttttaaa

SEQ ID NO: 929347 - DNA, 25 bp, Mus musculus
ttcactagctatcttatgcactggg

SEQ ID NO: 929348 - DNA, 25 bp, Mus musculus
ttcactagctatgttatgcactggg

SEQ ID NO: 929349 - DNA, 25 bp, Mus musculus
ttcactagtcagctagcaaagccac

SEQ ID NO: 929350 - DNA, 25 bp, Mus musculus
ttcactagtcaggtagcaaagccac

SEQ ID NO: 929351 - DNA, 25 bp, Mus musculus
ttcactatcggcaatcgaggcgggt

SEQ ID NO: 929352 - DNA, 25 bp, Mus musculus
ttcactatcggctatcgaggcgggt

SEQ ID NO: 929353 - DNA, 25 bp, Mus musculus
ttcactatcttcacagttaagccca

SEQ ID NO: 929354 - DNA, 25 bp, Mus musculus
ttcactatcttctcagttaagccca

SEQ ID NO: 929355 - DNA, 25 bp, Mus musculus
ttcactatgaccactttattaactg

SEQ ID NO: 929356 - DNA, 25 bp, Mus musculus
ttcactatgacctctttattaactg

SEQ ID NO: 929357 - DNA, 25 bp, Mus musculus
ttcactatggaaacggatgccggac

SEQ ID NO: 929358 - DNA, 25 bp, Mus musculus
ttcactatggaatcggatgccggac

SEQ ID NO: 929359 - DNA, 25 bp, Mus musculus
ttcactatggctcgtatcacacgta

SEQ ID NO: 929360 - DNA, 25 bp, Mus musculus
ttcactatggctggtatcacacgta

SEQ ID NO: 929361 - DNA, 25 bp, Mus musculus
ttcactatgggcataacagctagaa

SEQ ID NO: 929362 - DNA, 25 bp, Mus musculus
ttcactatgggcttaacagctagaa

SEQ ID NO: 929363 - DNA, 25 bp, Mus musculus
ttcactatgtagatccggaagggat

SEQ ID NO: 929364 - DNA, 25 bp, Mus musculus
ttcactatgtagttccggaagggat

SEQ ID NO: 929365 - DNA, 25 bp, Mus musculus
ttcactattcacaatagtactcgtt

SEQ ID NO: 929366 - DNA, 25 bp, Mus musculus
ttcactattcactatagtactcgtt

SEQ ID NO: 929367 - DNA, 25 bp, Mus musculus
ttcactatttacctggaagcacttg

SEQ ID NO: 929368 - DNA, 25 bp, Mus musculus
ttcactatttacgtggaagcacttg

SEQ ID NO: 929369 - DNA, 25 bp, Mus musculus
ttcactcaaaggctgctttgctctg

SEQ ID NO: 929370 - DNA, 25 bp, Mus musculus
ttcactcaaagggtgctttgctctg

SEQ ID NO: 929371 - DNA, 25 bp, Mus musculus
ttcactcaactccttaacttttaca

SEQ ID NO: 929372 - DNA, 25 bp, Mus musculus
ttcactcaactcgttaacttttaca

SEQ ID NO: 929373 - DNA, 25 bp, Mus musculus
ttcactcaagcaatttcatagacaa

SEQ ID NO: 929374 - DNA, 25 bp, Mus musculus
ttcactcaagcattttcatagacaa

SEQ ID NO: 929375 - DNA, 25 bp, Mus musculus
ttcactcaagccaaagggtaagccc

SEQ ID NO: 929376 - DNA, 25 bp, Mus musculus
ttcactcaagcctaagggtaagccc

SEQ ID NO: 929377 - DNA, 25 bp, Mus musculus
ttcactcaagttcgagacctacctt

SEQ ID NO: 929378 - DNA, 25 bp, Mus musculus
ttcactcaagttggagacctacctt

SEQ ID NO: 929379 - DNA, 25 bp, Mus musculus
ttcactcaattcctctgatcagact

SEQ ID NO: 929380 - DNA, 25 bp, Mus musculus
ttcactcaattcgtctgatcagact

SEQ ID NO: 929381 - DNA, 25 bp, Mus musculus
ttcactcacattaggtgcttcatgt

SEQ ID NO: 929382 - DNA, 25 bp, Mus musculus
ttcactcacatttggtgcttcatgt

SEQ ID NO: 929383 - DNA, 25 bp, Mus musculus
ttcactcacgggaagcctcaagaaa

SEQ ID NO: 929384 - DNA, 25 bp, Mus musculus
ttcactcacgggtagcctcaagaaa

SEQ ID NO: 929385 - DNA, 25 bp, Mus musculus
ttcactcacttgcacacgtacataa

SEQ ID NO: 929386 - DNA, 25 bp, Mus musculus
ttcactcacttggacacgtacataa

SEQ ID NO: 929387 - DNA, 25 bp, Mus musculus
ttcactcagaaacccctgtgcttgg

SEQ ID NO: 929388 - DNA, 25 bp, Mus musculus
ttcactcagaaagccctgtgcttgg

SEQ ID NO: 929389 - DNA, 25 bp, Mus musculus
ttcactcagataagctaaccccatg

SEQ ID NO: 929390 - DNA, 25 bp, Mus musculus
ttcactcagatatgctaaccccatg

SEQ ID NO: 929391 - DNA, 25 bp, Mus musculus
ttcactcagcaccttggcaagatct

SEQ ID NO: 929392 - DNA, 25 bp, Mus musculus
ttcactcagcacgttggcaagatct

SEQ ID NO: 929393 - DNA, 25 bp, Mus musculus
ttcactcagccaaaatgagacactt

SEQ ID NO: 929394 - DNA, 25 bp, Mus musculus
ttcactcagccataatgagacactt

SEQ ID NO: 929395 - DNA, 25 bp, Mus musculus
ttcactcagtgcctcgcaagacagt

SEQ ID NO: 929396 - DNA, 25 bp, Mus musculus
ttcactcagtgcgtcgcaagacagt

SEQ ID NO: 929397 - DNA, 25 bp, Mus musculus
ttcactcatcttcctgattgctgga

SEQ ID NO: 929398 - DNA, 25 bp, Mus musculus
ttcactcatcttgctgattgctgga

SEQ ID NO: 929399 - DNA, 25 bp, Mus musculus
ttcactcatgatatgatccatgtta

SEQ ID NO: 929400 - DNA, 25 bp, Mus musculus
ttcactcatgatttgatccatgtta

SEQ ID NO: 929401 - DNA, 25 bp, Mus musculus
ttcactccacaaccagctgggatta

SEQ ID NO: 929402 - DNA, 25 bp, Mus musculus
ttcactccacaagcagctgggatta

SEQ ID NO: 929403 - DNA, 25 bp, Mus musculus
ttcactccatcgaactgtgggacat

SEQ ID NO: 929404 - DNA, 25 bp, Mus musculus
ttcactccatcgtactgtgggacat

SEQ ID NO: 929405 - DNA, 25 bp, Mus musculus
ttcactccatggaaagtcactccag

SEQ ID NO: 929406 - DNA, 25 bp, Mus musculus
ttcactccatggtaagtcactccag

SEQ ID NO: 929407 - DNA, 25 bp, Mus musculus
ttcactccatttcaacctgtgctca

SEQ ID NO: 929408 - DNA, 25 bp, Mus musculus
ttcactccatttgaacctgtgctca

SEQ ID NO: 929409 - DNA, 25 bp, Mus musculus
ttcactcccaatccctattggatgt

SEQ ID NO: 929410 - DNA, 25 bp, Mus musculus
ttcactcccaatgcctattggatgt

SEQ ID NO: 929411 - DNA, 25 bp, Mus musculus
ttcactccccagagtgactcgagga

SEQ ID NO: 929412 - DNA, 25 bp, Mus musculus
ttcactccccagtgtgactcgagga

SEQ ID NO: 929413 - DNA, 25 bp, Mus musculus
ttcactccccggctccgagaggtgg

SEQ ID NO: 929414 - DNA, 25 bp, Mus musculus
ttcactccccgggtccgagaggtgg

SEQ ID NO: 929415 - DNA, 25 bp, Mus musculus
ttcactccccttatctcaggtgata

SEQ ID NO: 929416 - DNA, 25 bp, Mus musculus
ttcactccccttttctcaggtgata

SEQ ID NO: 929417 - DNA, 25 bp, Mus musculus
ttcactccctggaaaggatattcca

SEQ ID NO: 929418 - DNA, 25 bp, Mus musculus
ttcactccctggacaacagcaatga

SEQ ID NO: 929419 - DNA, 25 bp, Mus musculus
ttcactccctggtaaggatattcca

SEQ ID NO: 929420 - DNA, 25 bp, Mus musculus
ttcactccctggtcaacagcaatga

SEQ ID NO: 929421 - DNA, 25 bp, Mus musculus
ttcactccgaccctagcatcttggg

SEQ ID NO: 929422 - DNA, 25 bp, Mus musculus
ttcactccgaccgtagcatcttggg

SEQ ID NO: 929423 - DNA, 25 bp, Mus musculus
ttcactccggacaggcagagcttgg

SEQ ID NO: 929424 - DNA, 25 bp, Mus musculus
ttcactccggactggcagagcttgg

SEQ ID NO: 929425 - DNA, 25 bp, Mus musculus
ttcactcctgaaactgtatcctcta

SEQ ID NO: 929426 - DNA, 25 bp, Mus musculus
ttcactcctgaatctgtatcctcta

SEQ ID NO: 929427 - DNA, 25 bp, Mus musculus
ttcactcctgtcctcctgcagctgg

SEQ ID NO: 929428 - DNA, 25 bp, Mus musculus
ttcactcctgtcgtcctgcagctgg

SEQ ID NO: 929429 - DNA, 25 bp, Mus musculus
ttcactcggattcacttaggatcac

SEQ ID NO: 929430 - DNA, 25 bp, Mus musculus
ttcactcggattgacttaggatcac

SEQ ID NO: 929431 - DNA, 25 bp, Mus musculus
ttcactcggcccagcataagaatat

SEQ ID NO: 929432 - DNA, 25 bp, Mus musculus
ttcactcggccctgcataagaatat

SEQ ID NO: 929433 - DNA, 25 bp, Mus musculus
ttcactcggctcatacaggtgaaga

SEQ ID NO: 929434 - DNA, 25 bp, Mus musculus
ttcactcggctcttacaggtgaaga

SEQ ID NO: 929435 - DNA, 25 bp, Mus musculus
ttcactcgtactaccggtatcataa

SEQ ID NO: 929436 - DNA, 25 bp, Mus musculus
ttcactcgtacttccggtatcataa

SEQ ID NO: 929437 - DNA, 25 bp, Mus musculus
ttcactcgtagcctcagcagggcca

SEQ ID NO: 929438 - DNA, 25 bp, Mus musculus
ttcactcgtagcgtcagcagggcca

SEQ ID NO: 929439 - DNA, 25 bp, Mus musculus
ttcactcgtagtcagtttccttgaa

SEQ ID NO: 929440 - DNA, 25 bp, Mus musculus
ttcactcgtagtgagtttccttgaa

SEQ ID NO: 929441 - DNA, 25 bp, Mus musculus
ttcactcgtgtgactgcttaattga

SEQ ID NO: 929442 - DNA, 25 bp, Mus musculus
ttcactcgtgtgtctgcttaattga

SEQ ID NO: 929443 - DNA, 25 bp, Mus musculus
ttcactctaagacccttgttatttc

SEQ ID NO: 929444 - DNA, 25 bp, Mus musculus
ttcactctaagagccttgttatttc

SEQ ID NO: 929445 - DNA, 25 bp, Mus musculus
ttcactctacttccagtttgatctc

SEQ ID NO: 929446 - DNA, 25 bp, Mus musculus
ttcactctacttgcagtttgatctc

SEQ ID NO: 929447 - DNA, 25 bp, Mus musculus
ttcactctcacaaaaaattctccct

SEQ ID NO: 929448 - DNA, 25 bp, Mus musculus
ttcactctcacataaaattctccct

SEQ ID NO: 929449 - DNA, 25 bp, Mus musculus
ttcactctcagtctgcaagcctgga

SEQ ID NO: 929450 - DNA, 25 bp, Mus musculus
ttcactctcagtgtgcaagcctgga

SEQ ID NO: 929451 - DNA, 25 bp, Mus musculus
ttcactctccagatgtaatcacagt

SEQ ID NO: 929452 - DNA, 25 bp, Mus musculus
ttcactctccagttgtaatcacagt

SEQ ID NO: 929453 - DNA, 25 bp, Mus musculus
ttcactctctcccttggaagtggaa

SEQ ID NO: 929454 - DNA, 25 bp, Mus musculus
ttcactctctccgttggaagtggaa

SEQ ID NO: 929455 - DNA, 25 bp, Mus musculus
ttcactctctgaaaccagcattttc

SEQ ID NO: 929456 - DNA, 25 bp, Mus musculus
ttcactctctgataccagcattttc

SEQ ID NO: 929457 - DNA, 25 bp, Mus musculus
ttcactctgatcatgatactgtttg

SEQ ID NO: 929458 - DNA, 25 bp, Mus musculus
ttcactctgatcttgatactgtttg

SEQ ID NO: 929459 - DNA, 25 bp, Mus musculus
ttcactctgattaggttcgtggcag

SEQ ID NO: 929460 - DNA, 25 bp, Mus musculus
ttcactctgatttggttcgtggcag

SEQ ID NO: 929461 - DNA, 25 bp, Mus musculus
ttcactctgcttcccaacagtgtaa

SEQ ID NO: 929462 - DNA, 25 bp, Mus musculus
ttcactctgcttgccaacagtgtaa

SEQ ID NO: 929463 - DNA, 25 bp, Mus musculus
ttcactctgggaactttgatagatt

SEQ ID NO: 929464 - DNA, 25 bp, Mus musculus
ttcactctgggatctttgatagatt

SEQ ID NO: 929465 - DNA, 25 bp, Mus musculus
ttcactctgtacagggatttctcct

SEQ ID NO: 929466 - DNA, 25 bp, Mus musculus
ttcactctgtactgggatttctcct

SEQ ID NO: 929467 - DNA, 25 bp, Mus musculus
ttcactctgtctattgccagtggct

SEQ ID NO: 929468 - DNA, 25 bp, Mus musculus
ttcactctgtctccgctgagaaatt

SEQ ID NO: 929469 - DNA, 25 bp, Mus musculus
ttcactctgtctgcgctgagaaatt

SEQ ID NO: 929470 - DNA, 25 bp, Mus musculus
ttcactctgtcttttgccagtggct

SEQ ID NO: 929471 - DNA, 25 bp, Mus musculus
ttcactctgtgcatgagaaactctt

SEQ ID NO: 929472 - DNA, 25 bp, Mus musculus
ttcactctgtgcttgagaaactctt

SEQ ID NO: 929473 - DNA, 25 bp, Mus musculus
ttcactctgtgtctggggccccttt

SEQ ID NO: 929474 - DNA, 25 bp, Mus musculus
ttcactctgtgtgtggggccccttt

SEQ ID NO: 929475 - DNA, 25 bp, Mus musculus
ttcactctgttgatggtggaaccct

SEQ ID NO: 929476 - DNA, 25 bp, Mus musculus
ttcactctgttgttggtggaaccct

SEQ ID NO: 929477 - DNA, 25 bp, Mus musculus
ttcactcttaaaatcctttggttgt

SEQ ID NO: 929478 - DNA, 25 bp, Mus musculus
ttcactcttaaattcctttggttgt

SEQ ID NO: 929479 - DNA, 25 bp, Mus musculus
ttcactcttagcattctgtctcgag

SEQ ID NO: 929480 - DNA, 25 bp, Mus musculus
ttcactcttagctttctgtctcgag

SEQ ID NO: 929481 - DNA, 25 bp, Mus musculus
ttcactctttcaaacgctgcaatgc

SEQ ID NO: 929482 - DNA, 25 bp, Mus musculus
ttcactctttcatacgctgcaatgc

SEQ ID NO: 929483 - DNA, 25 bp, Mus musculus
ttcactgaaaccctcattatgccat

SEQ ID NO: 929484 - DNA, 25 bp, Mus musculus
ttcactgaaaccgtcattatgccat

SEQ ID NO: 929485 - DNA, 25 bp, Mus musculus
ttcactgaacacatctgctcagagt

SEQ ID NO: 929486 - DNA, 25 bp, Mus musculus
ttcactgaacacttctgctcagagt

SEQ ID NO: 929487 - DNA, 25 bp, Mus musculus
ttcactgaactgagtcagtcccacc

SEQ ID NO: 929488 - DNA, 25 bp, Mus musculus
ttcactgaactgtgtcagtcccacc

SEQ ID NO: 929489 - DNA, 25 bp, Mus musculus
ttcactgaccggacttaggctggtg

SEQ ID NO: 929490 - DNA, 25 bp, Mus musculus
ttcactgaccggtcttaggctggtg

SEQ ID NO: 929491 - DNA, 25 bp, Mus musculus
ttcactgactatcgcctggctgcac

SEQ ID NO: 929492 - DNA, 25 bp, Mus musculus
ttcactgactatggcctggctgcac

SEQ ID NO: 929493 - DNA, 25 bp, Mus musculus
ttcactgacttcagcctgagatctg

SEQ ID NO: 929494 - DNA, 25 bp, Mus musculus
ttcactgacttctgcctgagatctg

SEQ ID NO: 929495 - DNA, 25 bp, Mus musculus
ttcactgagagcacaatcactgctt

SEQ ID NO: 929496 - DNA, 25 bp, Mus musculus
ttcactgagagctcaatcactgctt

SEQ ID NO: 929497 - DNA, 25 bp, Mus musculus
ttcactgagcgacggcctaatggtt

SEQ ID NO: 929498 - DNA, 25 bp, Mus musculus
ttcactgagcgagggcctaatggtt

SEQ ID NO: 929499 - DNA, 25 bp, Mus musculus
ttcactgaggatacacaaggccagc

SEQ ID NO: 929500 - DNA, 25 bp, Mus musculus
ttcactgaggattcacaaggccagc

SEQ ID NO: 929501 - DNA, 25 bp, Mus musculus
ttcactgatcacagttccctacgat

SEQ ID NO: 929502 - DNA, 25 bp, Mus musculus
ttcactgatcactgttccctacgat

SEQ ID NO: 929503 - DNA, 25 bp, Mus musculus
ttcactgatgatcgttcacagcatt

SEQ ID NO: 929504 - DNA, 25 bp, Mus musculus
ttcactgatgatggttcacagcatt

SEQ ID NO: 929505 - DNA, 25 bp, Mus musculus
ttcactgatgttcacgatgtgcttt

SEQ ID NO: 929506 - DNA, 25 bp, Mus musculus
ttcactgatgttgacgatgtgcttt

SEQ ID NO: 929507 - DNA, 25 bp, Mus musculus
ttcactgatttgacagatcatccat

SEQ ID NO: 929508 - DNA, 25 bp, Mus musculus
ttcactgatttgagctgtaatccag

SEQ ID NO: 929509 - DNA, 25 bp, Mus musculus
ttcactgatttgtcagatcatccat

SEQ ID NO: 929510 - DNA, 25 bp, Mus musculus
ttcactgatttgtgctgtaatccag

SEQ ID NO: 929511 - DNA, 25 bp, Mus musculus
ttcactgcacagaagggctagctca

SEQ ID NO: 929512 - DNA, 25 bp, Mus musculus
ttcactgcacagtagggctagctca

SEQ ID NO: 929513 - DNA, 25 bp, Mus musculus
ttcactgcatgtccattttcaagtg

SEQ ID NO: 929514 - DNA, 25 bp, Mus musculus
ttcactgcatgtgcattttcaagtg

SEQ ID NO: 929515 - DNA, 25 bp, Mus musculus
ttcactgccaatcaggagcactttc

SEQ ID NO: 929516 - DNA, 25 bp, Mus musculus
ttcactgccaatgaggagcactttc

SEQ ID NO: 929517 - DNA, 25 bp, Mus musculus
ttcactgccatcatcattggagctg

SEQ ID NO: 929518 - DNA, 25 bp, Mus musculus
ttcactgccatcttcattggagctg

SEQ ID NO: 929519 - DNA, 25 bp, Mus musculus
ttcactgccatgagcctgcgatgat

SEQ ID NO: 929520 - DNA, 25 bp, Mus musculus
ttcactgccatgtgcctgcgatgat

SEQ ID NO: 929521 - DNA, 25 bp, Mus musculus
ttcactgccctgctgtttagttaag

SEQ ID NO: 929522 - DNA, 25 bp, Mus musculus
ttcactgccctggtgtttagttaag

SEQ ID NO: 929523 - DNA, 25 bp, Mus musculus
ttcactgcctccattacacagaaga

SEQ ID NO: 929524 - DNA, 25 bp, Mus musculus
ttcactgcctcctttacacagaaga

SEQ ID NO: 929525 - DNA, 25 bp, Mus musculus
ttcactgcctcgcttattctgctga

SEQ ID NO: 929526 - DNA, 25 bp, Mus musculus
ttcactgcctcggttattctgctga

SEQ ID NO: 929527 - DNA, 25 bp, Mus musculus
ttcactgcgactcactaccgactga

SEQ ID NO: 929528 - DNA, 25 bp, Mus musculus
ttcactgcgactgactaccgactga

SEQ ID NO: 929529 - DNA, 25 bp, Mus musculus
ttcactgcgtgtcctgattgatcga

SEQ ID NO: 929530 - DNA, 25 bp, Mus musculus
ttcactgcgtgtgctgattgatcga

SEQ ID NO: 929531 - DNA, 25 bp, Mus musculus
ttcactgcgttcactgcgaaaccag

SEQ ID NO: 929532 - DNA, 25 bp, Mus musculus
ttcactgcgttctctgcgaaaccag

SEQ ID NO: 929533 - DNA, 25 bp, Mus musculus
ttcactgctcacctggtttcagata

SEQ ID NO: 929534 - DNA, 25 bp, Mus musculus
ttcactgctcacgtggtttcagata

SEQ ID NO: 929535 - DNA, 25 bp, Mus musculus
ttcactgctcatagcaggccagatt

SEQ ID NO: 929536 - DNA, 25 bp, Mus musculus
ttcactgctcattgcaggccagatt

SEQ ID NO: 929537 - DNA, 25 bp, Mus musculus
ttcactgctgaaatttcaatttgtc

SEQ ID NO: 929538 - DNA, 25 bp, Mus musculus
ttcactgctgaattttcaatttgtc

SEQ ID NO: 929539 - DNA, 25 bp, Mus musculus
ttcactgctgtcatggtttgcaact

SEQ ID NO: 929540 - DNA, 25 bp, Mus musculus
ttcactgctgtcttggtttgcaact

SEQ ID NO: 929541 - DNA, 25 bp, Mus musculus
ttcactgctgtgatctgttgataac

SEQ ID NO: 929542 - DNA, 25 bp, Mus musculus
ttcactgctgtgttctgttgataac

SEQ ID NO: 929543 - DNA, 25 bp, Mus musculus
ttcactggacggattgcctcttttc

SEQ ID NO: 929544 - DNA, 25 bp, Mus musculus
ttcactggacggtttgcctcttttc

SEQ ID NO: 929545 - DNA, 25 bp, Mus musculus
ttcactggaggacatctgctagttc

SEQ ID NO: 929546 - DNA, 25 bp, Mus musculus
ttcactggaggagatctgctagttc

SEQ ID NO: 929547 - DNA, 25 bp, Mus musculus
ttcactggagttcaagagccaatgt

SEQ ID NO: 929548 - DNA, 25 bp, Mus musculus
ttcactggagttgaagagccaatgt

SEQ ID NO: 929549 - DNA, 25 bp, Mus musculus
ttcactggccacacaagcaacagag

SEQ ID NO: 929550 - DNA, 25 bp, Mus musculus
ttcactggccacaggttatggtgca

SEQ ID NO: 929551 - DNA, 25 bp, Mus musculus
ttcactggccactcaagcaacagag

SEQ ID NO: 929552 - DNA, 25 bp, Mus musculus
ttcactggccactggttatggtgca

SEQ ID NO: 929553 - DNA, 25 bp, Mus musculus
ttcactggctgcaatggcaacctta

SEQ ID NO: 929554 - DNA, 25 bp, Mus musculus
ttcactggctgctatggcaacctta

SEQ ID NO: 929555 - DNA, 25 bp, Mus musculus
ttcactgggaataaaaacactaggg

SEQ ID NO: 929556 - DNA, 25 bp, Mus musculus
ttcactgggaattaaaacactaggg

SEQ ID NO: 929557 - DNA, 25 bp, Mus musculus
ttcactgggcacctgggtagctttc

SEQ ID NO: 929558 - DNA, 25 bp, Mus musculus
ttcactgggcacgtgggtagctttc

SEQ ID NO: 929559 - DNA, 25 bp, Mus musculus
ttcactgggcatctgcggttcaact

SEQ ID NO: 929560 - DNA, 25 bp, Mus musculus
ttcactgggcatgtgcggttcaact

SEQ ID NO: 929561 - DNA, 25 bp, Mus musculus
ttcactggtgctcgtaacgtttgtc

SEQ ID NO: 929562 - DNA, 25 bp, Mus musculus
ttcactggtgctggtaacgtttgtc

SEQ ID NO: 929563 - DNA, 25 bp, Mus musculus
ttcactgtaaagactcctgtttttc

SEQ ID NO: 929564 - DNA, 25 bp, Mus musculus
ttcactgtaaagtctcctgtttttc

SEQ ID NO: 929565 - DNA, 25 bp, Mus musculus
ttcactgtagcactttctgggccat

SEQ ID NO: 929566 - DNA, 25 bp, Mus musculus
ttcactgtagcagtttctgggccat

SEQ ID NO: 929567 - DNA, 25 bp, Mus musculus
ttcactgtatctctaaagccatgtc

SEQ ID NO: 929568 - DNA, 25 bp, Mus musculus
ttcactgtatctgtaaagccatgtc

SEQ ID NO: 929569 - DNA, 25 bp, Mus musculus
ttcactgtatgcagttgagcgtgtt

SEQ ID NO: 929570 - DNA, 25 bp, Mus musculus
ttcactgtatgctgttgagcgtgtt

SEQ ID NO: 929571 - DNA, 25 bp, Mus musculus
ttcactgtccagagagccgagcaca

SEQ ID NO: 929572 - DNA, 25 bp, Mus musculus
ttcactgtccagtgagccgagcaca

SEQ ID NO: 929573 - DNA, 25 bp, Mus musculus
ttcactgtccccagggtaaggacaa

SEQ ID NO: 929574 - DNA, 25 bp, Mus musculus
ttcactgtcccctgggtaaggacaa

SEQ ID NO: 929575 - DNA, 25 bp, Mus musculus
ttcactgtccttaccctgggcattt

SEQ ID NO: 929576 - DNA, 25 bp, Mus musculus
ttcactgtcctttccctgggcattt

SEQ ID NO: 929577 - DNA, 25 bp, Mus musculus
ttcactgtcgatacctgatgggaaa

SEQ ID NO: 929578 - DNA, 25 bp, Mus musculus
ttcactgtcgattcctgatgggaaa

SEQ ID NO: 929579 - DNA, 25 bp, Mus musculus
ttcactgtctaacctgctggccaaa

SEQ ID NO: 929580 - DNA, 25 bp, Mus musculus
ttcactgtctaagctgctggccaaa

SEQ ID NO: 929581 - DNA, 25 bp, Mus musculus
ttcactgtctagctgctgccaaagc

SEQ ID NO: 929582 - DNA, 25 bp, Mus musculus
ttcactgtctaggtgctgccaaagc

SEQ ID NO: 929583 - DNA, 25 bp, Mus musculus
ttcactgtcttgatccatggctatg

SEQ ID NO: 929584 - DNA, 25 bp, Mus musculus
ttcactgtcttgttccatggctatg

SEQ ID NO: 929585 - DNA, 25 bp, Mus musculus
ttcactgtgaatcatttgttgggag

SEQ ID NO: 929586 - DNA, 25 bp, Mus musculus
ttcactgtgaatgatttgttgggag

SEQ ID NO: 929587 - DNA, 25 bp, Mus musculus
ttcactgtgcagcaaggttctcgaa

SEQ ID NO: 929588 - DNA, 25 bp, Mus musculus
ttcactgtgcaggaaggttctcgaa

SEQ ID NO: 929589 - DNA, 25 bp, Mus musculus
ttcactgtgcccagttaccttgtca

SEQ ID NO: 929590 - DNA, 25 bp, Mus musculus
ttcactgtgccctgttaccttgtca

SEQ ID NO: 929591 - DNA, 25 bp, Mus musculus
ttcactgtgggacgtttaacaacaa

SEQ ID NO: 929592 - DNA, 25 bp, Mus musculus
ttcactgtgggaggtttaacaacaa

SEQ ID NO: 929593 - DNA, 25 bp, Mus musculus
ttcactgtggtacctaggcagggct

SEQ ID NO: 929594 - DNA, 25 bp, Mus musculus
ttcactgtggtagctaggcagggct

SEQ ID NO: 929595 - DNA, 25 bp, Mus musculus
ttcactgtgtaaacttgggctgtgt

SEQ ID NO: 929596 - DNA, 25 bp, Mus musculus
ttcactgtgtaatcttgggctgtgt

SEQ ID NO: 929597 - DNA, 25 bp, Mus musculus
ttcactgtgtaccttcaaccgctga

SEQ ID NO: 929598 - DNA, 25 bp, Mus musculus
ttcactgtgtacgttcaaccgctga

SEQ ID NO: 929599 - DNA, 25 bp, Mus musculus
ttcactgtgtctcttggcctgagca

SEQ ID NO: 929600 - DNA, 25 bp, Mus musculus
ttcactgtgtctgttggcctgagca

SEQ ID NO: 929601 - DNA, 25 bp, Mus musculus
ttcactgtgtggaggaggctgggcc

SEQ ID NO: 929602 - DNA, 25 bp, Mus musculus
ttcactgtgtggtggaggctgggcc

SEQ ID NO: 929603 - DNA, 25 bp, Mus musculus
ttcactgttgggaagcctctagata

SEQ ID NO: 929604 - DNA, 25 bp, Mus musculus
ttcactgttgggtagcctctagata

SEQ ID NO: 929605 - DNA, 25 bp, Mus musculus
ttcactgttgtgaccctttgcaaaa

SEQ ID NO: 929606 - DNA, 25 bp, Mus musculus
ttcactgttgtgtccctttgcaaaa

SEQ ID NO: 929607 - DNA, 25 bp, Mus musculus
ttcactgtttttcttcaggacaccc

SEQ ID NO: 929608 - DNA, 25 bp, Mus musculus
ttcactgtttttgttcaggacaccc

SEQ ID NO: 929609 - DNA, 25 bp, Mus musculus
ttcacttaaactccatcgactgatg

SEQ ID NO: 929610 - DNA, 25 bp, Mus musculus
ttcacttaaactgcatcgactgatg

SEQ ID NO: 929611 - DNA, 25 bp, Mus musculus
ttcacttaacataattcccttggga

SEQ ID NO: 929612 - DNA, 25 bp, Mus musculus
ttcacttaacattattcccttggga

SEQ ID NO: 929613 - DNA, 25 bp, Mus musculus
ttcacttacagaaaatgagcaacaa

SEQ ID NO: 929614 - DNA, 25 bp, Mus musculus
ttcacttacagataatgagcaacaa

SEQ ID NO: 929615 - DNA, 25 bp, Mus musculus
ttcacttagagactagcacccagtg

SEQ ID NO: 929616 - DNA, 25 bp, Mus musculus
ttcacttagagagtagcacccagtg

SEQ ID NO: 929617 - DNA, 25 bp, Mus musculus
ttcacttatcccaagccgcagtttc

SEQ ID NO: 929618 - DNA, 25 bp, Mus musculus
ttcacttatccctagccgcagtttc

SEQ ID NO: 929619 - DNA, 25 bp, Mus musculus
ttcacttatgttcgatatgatagca

SEQ ID NO: 929620 - DNA, 25 bp, Mus musculus
ttcacttatgttggatatgatagca

SEQ ID NO: 929621 - DNA, 25 bp, Mus musculus
ttcacttattaaaccttcttcttct

SEQ ID NO: 929622 - DNA, 25 bp, Mus musculus
ttcacttattaatccttcttcttct

SEQ ID NO: 929623 - DNA, 25 bp, Mus musculus
ttcacttatttaatccatcggtaga

SEQ ID NO: 929624 - DNA, 25 bp, Mus musculus
ttcacttatttaattcctgctttat

SEQ ID NO: 929625 - DNA, 25 bp, Mus musculus
ttcacttatttattccatcggtaga

SEQ ID NO: 929626 - DNA, 25 bp, Mus musculus
ttcacttatttatttcctgctttat

SEQ ID NO: 929627 - DNA, 25 bp, Mus musculus
ttcacttcagatctccctaaatatc

SEQ ID NO: 929628 - DNA, 25 bp, Mus musculus
ttcacttcagatgtccctaaatatc

SEQ ID NO: 929629 - DNA, 25 bp, Mus musculus
ttcacttcaggaaaagccgcacttt

SEQ ID NO: 929630 - DNA, 25 bp, Mus musculus
ttcacttcaggataagccgcacttt

SEQ ID NO: 929631 - DNA, 25 bp, Mus musculus
ttcacttcagtgctgattcagccca

SEQ ID NO: 929632 - DNA, 25 bp, Mus musculus
ttcacttcagtggtgattcagccca

SEQ ID NO: 929633 - DNA, 25 bp, Mus musculus
ttcacttcatccacttaactgtcaa

SEQ ID NO: 929634 - DNA, 25 bp, Mus musculus
ttcacttcatcctcttaactgtcaa

SEQ ID NO: 929635 - DNA, 25 bp, Mus musculus
ttcacttccaatatgaaggccttcc

SEQ ID NO: 929636 - DNA, 25 bp, Mus musculus
ttcacttccaatttgaaggccttcc

SEQ ID NO: 929637 - DNA, 25 bp, Mus musculus
ttcacttccaccagatgggtcctgg

SEQ ID NO: 929638 - DNA, 25 bp, Mus musculus
ttcacttccacctgatgggtcctgg

SEQ ID NO: 929639 - DNA, 25 bp, Mus musculus
ttcacttccacgatcgtactggaga

SEQ ID NO: 929640 - DNA, 25 bp, Mus musculus
ttcacttccacgttcgtactggaga

SEQ ID NO: 929641 - DNA, 25 bp, Mus musculus
ttcacttccccaaggacacattgtg

SEQ ID NO: 929642 - DNA, 25 bp, Mus musculus
ttcacttccccatggacacattgtg

SEQ ID NO: 929643 - DNA, 25 bp, Mus musculus
ttcacttccgagattttcattcact

SEQ ID NO: 929644 - DNA, 25 bp, Mus musculus
ttcacttccgagtttttcattcact

SEQ ID NO: 929645 - DNA, 25 bp, Mus musculus
ttcacttccgggacatcatcagaaa

SEQ ID NO: 929646 - DNA, 25 bp, Mus musculus
ttcacttccgggtcatcatcagaaa

SEQ ID NO: 929647 - DNA, 25 bp, Mus musculus
ttcacttcgctgaagttttggcttt

SEQ ID NO: 929648 - DNA, 25 bp, Mus musculus
ttcacttcgctgtagttttggcttt

SEQ ID NO: 929649 - DNA, 25 bp, Mus musculus
ttcacttcgtgcattacctgctggg

SEQ ID NO: 929650 - DNA, 25 bp, Mus musculus
ttcacttcgtgctttacctgctggg

SEQ ID NO: 929651 - DNA, 25 bp, Mus musculus
ttcacttctagcacagacagggttg

SEQ ID NO: 929652 - DNA, 25 bp, Mus musculus
ttcacttctagctcagacagggttg

SEQ ID NO: 929653 - DNA, 25 bp, Mus musculus
ttcacttctattctccttgagtaaa

SEQ ID NO: 929654 - DNA, 25 bp, Mus musculus
ttcacttctattgtccttgagtaaa

SEQ ID NO: 929655 - DNA, 25 bp, Mus musculus
ttcacttctctgataccgactctca

SEQ ID NO: 929656 - DNA, 25 bp, Mus musculus
ttcacttctctgttaccgactctca

SEQ ID NO: 929657 - DNA, 25 bp, Mus musculus
ttcacttctgggatggtctttcaga

SEQ ID NO: 929658 - DNA, 25 bp, Mus musculus
ttcacttctgggttggtctttcaga

SEQ ID NO: 929659 - DNA, 25 bp, Mus musculus
ttcacttctgtcattagggtctgta

SEQ ID NO: 929660 - DNA, 25 bp, Mus musculus
ttcacttctgtctttagggtctgta

SEQ ID NO: 929661 - DNA, 25 bp, Mus musculus
ttcacttctgtgacctaaaggcttt

SEQ ID NO: 929662 - DNA, 25 bp, Mus musculus
ttcacttctgtgtcctaaaggcttt

SEQ ID NO: 929663 - DNA, 25 bp, Mus musculus
ttcacttcttccaggctaggacgta

SEQ ID NO: 929664 - DNA, 25 bp, Mus musculus
ttcacttcttcctggctaggacgta

SEQ ID NO: 929665 - DNA, 25 bp, Mus musculus
ttcacttcttctattggttccatct

SEQ ID NO: 929666 - DNA, 25 bp, Mus musculus
ttcacttcttctccgcatttttcca

SEQ ID NO: 929667 - DNA, 25 bp, Mus musculus
ttcacttcttctgcgcatttttcca

SEQ ID NO: 929668 - DNA, 25 bp, Mus musculus
ttcacttcttcttttggttccatct

SEQ ID NO: 929669 - DNA, 25 bp, Mus musculus
ttcacttgaagcaggaagcatttgt

SEQ ID NO: 929670 - DNA, 25 bp, Mus musculus
ttcacttgaagctggaagcatttgt

SEQ ID NO: 929671 - DNA, 25 bp, Mus musculus
ttcacttgacccaggcgaggaagag

SEQ ID NO: 929672 - DNA, 25 bp, Mus musculus
ttcacttgaccctggcgaggaagag

SEQ ID NO: 929673 - DNA, 25 bp, Mus musculus
ttcacttgcaacagttttctttggt

SEQ ID NO: 929674 - DNA, 25 bp, Mus musculus
ttcacttgcaactgttttctttggt

SEQ ID NO: 929675 - DNA, 25 bp, Mus musculus
ttcacttgcaggaccagggctcaaa

SEQ ID NO: 929676 - DNA, 25 bp, Mus musculus
ttcacttgcaggtccagggctcaaa

SEQ ID NO: 929677 - DNA, 25 bp, Mus musculus
ttcacttgcattagagcttacatac

SEQ ID NO: 929678 - DNA, 25 bp, Mus musculus
ttcacttgcatttgagcttacatac

SEQ ID NO: 929679 - DNA, 25 bp, Mus musculus
ttcacttgctgtccctgattcccaa

SEQ ID NO: 929680 - DNA, 25 bp, Mus musculus
ttcacttgctgtgcctgattcccaa

SEQ ID NO: 929681 - DNA, 25 bp, Mus musculus
ttcacttgctttaattctgacagtt

SEQ ID NO: 929682 - DNA, 25 bp, Mus musculus
ttcacttgcttttattctgacagtt

SEQ ID NO: 929683 - DNA, 25 bp, Mus musculus
ttcacttggctaatttagtgtccca

SEQ ID NO: 929684 - DNA, 25 bp, Mus musculus
ttcacttggctattttagtgtccca

SEQ ID NO: 929685 - DNA, 25 bp, Mus musculus
ttcacttgggacatcacttgcgcag

SEQ ID NO: 929686 - DNA, 25 bp, Mus musculus
ttcacttgggacttcacttgcgcag

SEQ ID NO: 929687 - DNA, 25 bp, Mus musculus
ttcacttgggcacagggagccattt

SEQ ID NO: 929688 - DNA, 25 bp, Mus musculus
ttcacttgggcagagggagccattt

SEQ ID NO: 929689 - DNA, 25 bp, Mus musculus
ttcacttgggctattccacaaatcc

SEQ ID NO: 929690 - DNA, 25 bp, Mus musculus
ttcacttgggcttttccacaaatcc

SEQ ID NO: 929691 - DNA, 25 bp, Mus musculus
ttcacttggtggctctgtctggatg

SEQ ID NO: 929692 - DNA, 25 bp, Mus musculus
ttcacttggtgggtctgtctggatg

SEQ ID NO: 929693 - DNA, 25 bp, Mus musculus
ttcacttgtgccacagattgcttat

SEQ ID NO: 929694 - DNA, 25 bp, Mus musculus
ttcacttgtgcctcagattgcttat

SEQ ID NO: 929695 - DNA, 25 bp, Mus musculus
ttcacttgtgtgaagggctaaacat

SEQ ID NO: 929696 - DNA, 25 bp, Mus musculus
ttcacttgtgtgaggctgtcagtga

SEQ ID NO: 929697 - DNA, 25 bp, Mus musculus
ttcacttgtgtgtagggctaaacat

SEQ ID NO: 929698 - DNA, 25 bp, Mus musculus
ttcacttgtgtgtggctgtcagtga

SEQ ID NO: 929699 - DNA, 25 bp, Mus musculus
ttcacttgttccctctgaggctgaa

SEQ ID NO: 929700 - DNA, 25 bp, Mus musculus
ttcacttgttccgtctgaggctgaa

SEQ ID NO: 929701 - DNA, 25 bp, Mus musculus
ttcactttacctaccgtatgctaag

SEQ ID NO: 929702 - DNA, 25 bp, Mus musculus
ttcactttaccttccgtatgctaag

SEQ ID NO: 929703 - DNA, 25 bp, Mus musculus
ttcactttagaacgtcattcccaac

SEQ ID NO: 929704 - DNA, 25 bp, Mus musculus
ttcactttagaaggtcattcccaac

SEQ ID NO: 929705 - DNA, 25 bp, Mus musculus
ttcactttagtaatcctctttgcag

SEQ ID NO: 929706 - DNA, 25 bp, Mus musculus
ttcactttagtattcctctttgcag

SEQ ID NO: 929707 - DNA, 25 bp, Mus musculus
ttcactttagtcactgtatcccaga

SEQ ID NO: 929708 - DNA, 25 bp, Mus musculus
ttcactttagtcagtcaggccacac

SEQ ID NO: 929709 - DNA, 25 bp, Mus musculus
ttcactttagtctctgtatcccaga

SEQ ID NO: 929710 - DNA, 25 bp, Mus musculus
ttcactttagtctgtcaggccacac

SEQ ID NO: 929711 - DNA, 25 bp, Mus musculus
ttcactttcacaacaatccatcttt

SEQ ID NO: 929712 - DNA, 25 bp, Mus musculus
ttcactttcacatcaatccatcttt

SEQ ID NO: 929713 - DNA, 25 bp, Mus musculus
ttcactttcctgagtctggcaactc

SEQ ID NO: 929714 - DNA, 25 bp, Mus musculus
ttcactttcctgtgtctggcaactc

SEQ ID NO: 929715 - DNA, 25 bp, Mus musculus
ttcactttggcactactcctcagag

SEQ ID NO: 929716 - DNA, 25 bp, Mus musculus
ttcactttggcagtactcctcagag

SEQ ID NO: 929717 - DNA, 25 bp, Mus musculus
ttcactttgggtctctgtccaggac

SEQ ID NO: 929718 - DNA, 25 bp, Mus musculus
ttcactttgggtgtctgtccaggac

SEQ ID NO: 929719 - DNA, 25 bp, Mus musculus
ttcactttggtgaagatcagcccac

SEQ ID NO: 929720 - DNA, 25 bp, Mus musculus
ttcactttggtgtagatcagcccac

SEQ ID NO: 929721 - DNA, 25 bp, Mus musculus
ttcactttgtagctcttggatctag

SEQ ID NO: 929722 - DNA, 25 bp, Mus musculus
ttcactttgtaggtcttggatctag

SEQ ID NO: 929723 - DNA, 25 bp, Mus musculus
ttcactttgtatcctggctgctgta

SEQ ID NO: 929724 - DNA, 25 bp, Mus musculus
ttcactttgtatgctggctgctgta

SEQ ID NO: 929725 - DNA, 25 bp, Mus musculus
ttcacttttagtaaactgtctggca

SEQ ID NO: 929726 - DNA, 25 bp, Mus musculus
ttcacttttagttaactgtctggca

SEQ ID NO: 929727 - DNA, 25 bp, Mus musculus
ttcacttttcagctagcaaggccag

SEQ ID NO: 929728 - DNA, 25 bp, Mus musculus
ttcacttttcaggtagcaaggccag

SEQ ID NO: 929729 - DNA, 25 bp, Mus musculus
ttcacttttccacaacaattagagg

SEQ ID NO: 929730 - DNA, 25 bp, Mus musculus
ttcacttttccagaacaattagagg

SEQ ID NO: 929731 - DNA, 25 bp, Mus musculus
ttcacttttcttcggaacttggagg

SEQ ID NO: 929732 - DNA, 25 bp, Mus musculus
ttcacttttcttgggaacttggagg

SEQ ID NO: 929733 - DNA, 25 bp, Mus musculus
ttcactttttgacgatgcctgccag

SEQ ID NO: 929734 - DNA, 25 bp, Mus musculus
ttcactttttgaggatgcctgccag

SEQ ID NO: 929735 - DNA, 25 bp, Mus musculus
ttcagaaaaatccattgcacactta

SEQ ID NO: 929736 - DNA, 25 bp, Mus musculus
ttcagaaaaatcgattgcacactta

SEQ ID NO: 929737 - DNA, 25 bp, Mus musculus
ttcagaaaacagcactgccccggca

SEQ ID NO: 929738 - DNA, 25 bp, Mus musculus
ttcagaaaacaggactgccccggca

SEQ ID NO: 929739 - DNA, 25 bp, Mus musculus
ttcagaaaactcaagggccttcctt

SEQ ID NO: 929740 - DNA, 25 bp, Mus musculus
ttcagaaaactctagggccttcctt

SEQ ID NO: 929741 - DNA, 25 bp, Mus musculus
ttcagaaacctcagcattcctgctg

SEQ ID NO: 929742 - DNA, 25 bp, Mus musculus
ttcagaaacctctgcattcctgctg

SEQ ID NO: 929743 - DNA, 25 bp, Mus musculus
ttcagaaagttaaacccgtggcgat

SEQ ID NO: 929744 - DNA, 25 bp, Mus musculus
ttcagaaagttatacccgtggcgat

SEQ ID NO: 929745 - DNA, 25 bp, Mus musculus
ttcagaaataaaccacacactctcc

SEQ ID NO: 929746 - DNA, 25 bp, Mus musculus
ttcagaaataaagcacacactctcc

SEQ ID NO: 929747 - DNA, 25 bp, Mus musculus
ttcagaaatagtcggagtttcccta

SEQ ID NO: 929748 - DNA, 25 bp, Mus musculus
ttcagaaatagtgggagtttcccta

SEQ ID NO: 929749 - DNA, 25 bp, Mus musculus
ttcagaacatggagacgattttccc

SEQ ID NO: 929750 - DNA, 25 bp, Mus musculus
ttcagaacatggtgacgattttccc

SEQ ID NO: 929751 - DNA, 25 bp, Mus musculus
ttcagaacattcactttttacccct

SEQ ID NO: 929752 - DNA, 25 bp, Mus musculus
ttcagaacattctctttttacccct

SEQ ID NO: 929753 - DNA, 25 bp, Mus musculus
ttcagaaccaacaaagctcagactt

SEQ ID NO: 929754 - DNA, 25 bp, Mus musculus
ttcagaaccaactaagctcagactt

SEQ ID NO: 929755 - DNA, 25 bp, Mus musculus
ttcagaaccataaaaccactcatac

SEQ ID NO: 929756 - DNA, 25 bp, Mus musculus
ttcagaaccatataaccactcatac

SEQ ID NO: 929757 - DNA, 25 bp, Mus musculus
ttcagaaccgtcaatgagtagtcag

SEQ ID NO: 929758 - DNA, 25 bp, Mus musculus
ttcagaaccgtctatgagtagtcag

SEQ ID NO: 929759 - DNA, 25 bp, Mus musculus
ttcagaaccttgatggaaacattaa

SEQ ID NO: 929760 - DNA, 25 bp, Mus musculus
ttcagaaccttgttggaaacattaa

SEQ ID NO: 929761 - DNA, 25 bp, Mus musculus
ttcagaactgctcagcccctgttgt

SEQ ID NO: 929762 - DNA, 25 bp, Mus musculus
ttcagaactgctgagcccctgttgt

SEQ ID NO: 929763 - DNA, 25 bp, Mus musculus
ttcagaagacacagccctagggcac

SEQ ID NO: 929764 - DNA, 25 bp, Mus musculus
ttcagaagacactgccctagggcac

SEQ ID NO: 929765 - DNA, 25 bp, Mus musculus
ttcagaagcatcaccaaggccatgg

SEQ ID NO: 929766 - DNA, 25 bp, Mus musculus
ttcagaagcatctccaaggccatgg

SEQ ID NO: 929767 - DNA, 25 bp, Mus musculus
ttcagaagcattaaccagctgcctc

SEQ ID NO: 929768 - DNA, 25 bp, Mus musculus
ttcagaagcatttaccagctgcctc

SEQ ID NO: 929769 - DNA, 25 bp, Mus musculus
ttcagaagccaaataccattaccat

SEQ ID NO: 929770 - DNA, 25 bp, Mus musculus
ttcagaagccaattaccattaccat

SEQ ID NO: 929771 - DNA, 25 bp, Mus musculus
ttcagaagcgaacccttgagcaagg

SEQ ID NO: 929772 - DNA, 25 bp, Mus musculus
ttcagaagcgaagccttgagcaagg

SEQ ID NO: 929773 - DNA, 25 bp, Mus musculus
ttcagaagctaaaatttgtgccatt

SEQ ID NO: 929774 - DNA, 25 bp, Mus musculus
ttcagaagctaatatttgtgccatt

SEQ ID NO: 929775 - DNA, 25 bp, Mus musculus
ttcagaagtatcacgcacacacacg

SEQ ID NO: 929776 - DNA, 25 bp, Mus musculus
ttcagaagtatctcgcacacacacg

SEQ ID NO: 929777 - DNA, 25 bp, Mus musculus
ttcagaagtctcacccagcctgttg

SEQ ID NO: 929778 - DNA, 25 bp, Mus musculus
ttcagaagtctctcccagcctgttg

SEQ ID NO: 929779 - DNA, 25 bp, Mus musculus
ttcagaagtctgcttgccctacaag

SEQ ID NO: 929780 - DNA, 25 bp, Mus musculus
ttcagaagtctggttgccctacaag

SEQ ID NO: 929781 - DNA, 25 bp, Mus musculus
ttcagaagtgatcgctgagttcatg

SEQ ID NO: 929782 - DNA, 25 bp, Mus musculus
ttcagaagtgatggctgagttcatg

SEQ ID NO: 929783 - DNA, 25 bp, Mus musculus
ttcagaataaacctatagcatcatg

SEQ ID NO: 929784 - DNA, 25 bp, Mus musculus
ttcagaataaacgtatagcatcatg

SEQ ID NO: 929785 - DNA, 25 bp, Mus musculus
ttcagaatcagacaggatccccacc

SEQ ID NO: 929786 - DNA, 25 bp, Mus musculus
ttcagaatcagagaggatccccacc

SEQ ID NO: 929787 - DNA, 25 bp, Mus musculus
ttcagaatcattccagctctactct

SEQ ID NO: 929788 - DNA, 25 bp, Mus musculus
ttcagaatcattgcagctctactct

SEQ ID NO: 929789 - DNA, 25 bp, Mus musculus
ttcagaatcccaatttaaggcactt

SEQ ID NO: 929790 - DNA, 25 bp, Mus musculus
ttcagaatcccattttaaggcactt

SEQ ID NO: 929791 - DNA, 25 bp, Mus musculus
ttcagaatgaatcgagcgccgttaa

SEQ ID NO: 929792 - DNA, 25 bp, Mus musculus
ttcagaatgaatggagcgccgttaa

SEQ ID NO: 929793 - DNA, 25 bp, Mus musculus
ttcagaatggcaacctacttctttt

SEQ ID NO: 929794 - DNA, 25 bp, Mus musculus
ttcagaatggcatcctacttctttt

SEQ ID NO: 929795 - DNA, 25 bp, Mus musculus
ttcagaatgggcctcatcctttctc

SEQ ID NO: 929796 - DNA, 25 bp, Mus musculus
ttcagaatgggcgtcatcctttctc

SEQ ID NO: 929797 - DNA, 25 bp, Mus musculus
ttcagaatggtgcagatccccagct

SEQ ID NO: 929798 - DNA, 25 bp, Mus musculus
ttcagaatggtggagatccccagct

SEQ ID NO: 929799 - DNA, 25 bp, Mus musculus
ttcagaatgttcaccggaaagtgca

SEQ ID NO: 929800 - DNA, 25 bp, Mus musculus
ttcagaatgttctccggaaagtgca

SEQ ID NO: 929801 - DNA, 25 bp, Mus musculus
ttcagaattcaaaggcaggcagctc

SEQ ID NO: 929802 - DNA, 25 bp, Mus musculus
ttcagaattcaatggcaggcagctc

SEQ ID NO: 929803 - DNA, 25 bp, Mus musculus
ttcagaattcttcctccagactgcc

SEQ ID NO: 929804 - DNA, 25 bp, Mus musculus
ttcagaattcttgctccagactgcc

SEQ ID NO: 929805 - DNA, 25 bp, Mus musculus
ttcagaattgctaggcttctttgcc

SEQ ID NO: 929806 - DNA, 25 bp, Mus musculus
ttcagaattgctcttaccttgatct

SEQ ID NO: 929807 - DNA, 25 bp, Mus musculus
ttcagaattgctgttaccttgatct

SEQ ID NO: 929808 - DNA, 25 bp, Mus musculus
ttcagaattgcttggcttctttgcc

SEQ ID NO: 929809 - DNA, 25 bp, Mus musculus
ttcagaatttagactttcctccaag

SEQ ID NO: 929810 - DNA, 25 bp, Mus musculus
ttcagaatttagtctttcctccaag

SEQ ID NO: 929811 - DNA, 25 bp, Mus musculus
ttcagaatttgcagcctcacctgag

SEQ ID NO: 929812 - DNA, 25 bp, Mus musculus
ttcagaatttgctgcctcacctgag

SEQ ID NO: 929813 - DNA, 25 bp, Mus musculus
ttcagacaaccaagccaggtgcagg

SEQ ID NO: 929814 - DNA, 25 bp, Mus musculus
ttcagacaaccatgccaggtgcagg

SEQ ID NO: 929815 - DNA, 25 bp, Mus musculus
ttcagacaccatagagcaaccaggg

SEQ ID NO: 929816 - DNA, 25 bp, Mus musculus
ttcagacaccattgagcaaccaggg

SEQ ID NO: 929817 - DNA, 25 bp, Mus musculus
ttcagacacctacacttaagtatgt

SEQ ID NO: 929818 - DNA, 25 bp, Mus musculus
ttcagacacctagacttaagtatgt

SEQ ID NO: 929819 - DNA, 25 bp, Mus musculus
ttcagacactcaacttgctccaggg

SEQ ID NO: 929820 - DNA, 25 bp, Mus musculus
ttcagacactcatcttgctccaggg

SEQ ID NO: 929821 - DNA, 25 bp, Mus musculus
ttcagacagccaaacccgttgatta

SEQ ID NO: 929822 - DNA, 25 bp, Mus musculus
ttcagacagccatacccgttgatta

SEQ ID NO: 929823 - DNA, 25 bp, Mus musculus
ttcagacagcctcagctgaattctg

SEQ ID NO: 929824 - DNA, 25 bp, Mus musculus
ttcagacagcctgagctgaattctg

SEQ ID NO: 929825 - DNA, 25 bp, Mus musculus
ttcagacagctcatgcacaggcctt

SEQ ID NO: 929826 - DNA, 25 bp, Mus musculus
ttcagacagctcttgcacaggcctt

SEQ ID NO: 929827 - DNA, 25 bp, Mus musculus
ttcagacagcttatggctatgtagc

SEQ ID NO: 929828 - DNA, 25 bp, Mus musculus
ttcagacagcttttggctatgtagc

SEQ ID NO: 929829 - DNA, 25 bp, Mus musculus
ttcagacaggagctattgcccgagc

SEQ ID NO: 929830 - DNA, 25 bp, Mus musculus
ttcagacaggaggtattgcccgagc

SEQ ID NO: 929831 - DNA, 25 bp, Mus musculus
ttcagacagttccagaatgctccaa

SEQ ID NO: 929832 - DNA, 25 bp, Mus musculus
ttcagacagttcgagaatgctccaa

SEQ ID NO: 929833 - DNA, 25 bp, Mus musculus
ttcagacagttgagaagttccccag

SEQ ID NO: 929834 - DNA, 25 bp, Mus musculus
ttcagacagttgtgaagttccccag

SEQ ID NO: 929835 - DNA, 25 bp, Mus musculus
ttcagacatatgcagtacagggatt

SEQ ID NO: 929836 - DNA, 25 bp, Mus musculus
ttcagacatatggagtacagggatt

SEQ ID NO: 929837 - DNA, 25 bp, Mus musculus
ttcagacatcaaacagaaggccaca

SEQ ID NO: 929838 - DNA, 25 bp, Mus musculus
ttcagacatcaatcagaaggccaca

SEQ ID NO: 929839 - DNA, 25 bp, Mus musculus
ttcagacatgctctagggcacccag

SEQ ID NO: 929840 - DNA, 25 bp, Mus musculus
ttcagacatgctgtagggcacccag

SEQ ID NO: 929841 - DNA, 25 bp, Mus musculus
ttcagacatggaatccgtgagggaa

SEQ ID NO: 929842 - DNA, 25 bp, Mus musculus
ttcagacatggattccgtgagggaa

SEQ ID NO: 929843 - DNA, 25 bp, Mus musculus
ttcagacatgttctacttttggtag

SEQ ID NO: 929844 - DNA, 25 bp, Mus musculus
ttcagacatgttgtacttttggtag

SEQ ID NO: 929845 - DNA, 25 bp, Mus musculus
ttcagaccaagtccaagatcccaaa

SEQ ID NO: 929846 - DNA, 25 bp, Mus musculus
ttcagaccaagtgcaagatcccaaa

SEQ ID NO: 929847 - DNA, 25 bp, Mus musculus
ttcagaccattaacaccaaggtgtg

SEQ ID NO: 929848 - DNA, 25 bp, Mus musculus
ttcagaccattatcaccaaggtgtg

SEQ ID NO: 929849 - DNA, 25 bp, Mus musculus
ttcagaccattgcttgtcacaccca

SEQ ID NO: 929850 - DNA, 25 bp, Mus musculus
ttcagaccattggttgtcacaccca

SEQ ID NO: 929851 - DNA, 25 bp, Mus musculus
ttcagacccagtagcaggtcagctc

SEQ ID NO: 929852 - DNA, 25 bp, Mus musculus
ttcagacccagttgcaggtcagctc

SEQ ID NO: 929853 - DNA, 25 bp, Mus musculus
ttcagaccccagagtgagcagcagc

SEQ ID NO: 929854 - DNA, 25 bp, Mus musculus
ttcagaccccagtgtgagcagcagc

SEQ ID NO: 929855 - DNA, 25 bp, Mus musculus
ttcagacccctcagggagcagcagg

SEQ ID NO: 929856 - DNA, 25 bp, Mus musculus
ttcagacccctctgggagcagcagg

SEQ ID NO: 929857 - DNA, 25 bp, Mus musculus
ttcagacctacaacagttgctgaga

SEQ ID NO: 929858 - DNA, 25 bp, Mus musculus
ttcagacctacatcagttgctgaga

SEQ ID NO: 929859 - DNA, 25 bp, Mus musculus
ttcagacctcaacggaacccggatg

SEQ ID NO: 929860 - DNA, 25 bp, Mus musculus
ttcagacctcaagggaacccggatg

SEQ ID NO: 929861 - DNA, 25 bp, Mus musculus
ttcagacctcacaggttcttcggaa

SEQ ID NO: 929862 - DNA, 25 bp, Mus musculus
ttcagacctcactggttcttcggaa

SEQ ID NO: 929863 - DNA, 25 bp, Mus musculus
ttcagacctgatcattttcggatgt

SEQ ID NO: 929864 - DNA, 25 bp, Mus musculus
ttcagacctgatgattttcggatgt

SEQ ID NO: 929865 - DNA, 25 bp, Mus musculus
ttcagaccttcaagctgcaagatga

SEQ ID NO: 929866 - DNA, 25 bp, Mus musculus
ttcagaccttcatgctgcaagatga

SEQ ID NO: 929867 - DNA, 25 bp, Mus musculus
ttcagacgccagctcctataggagg

SEQ ID NO: 929868 - DNA, 25 bp, Mus musculus
ttcagacgccaggtcctataggagg

SEQ ID NO: 929869 - DNA, 25 bp, Mus musculus
ttcagacggtaactttgggaggcaa

SEQ ID NO: 929870 - DNA, 25 bp, Mus musculus
ttcagacggtaagtttgggaggcaa

SEQ ID NO: 929871 - DNA, 25 bp, Mus musculus
ttcagacgttgcctactgcacttgg

SEQ ID NO: 929872 - DNA, 25 bp, Mus musculus
ttcagacgttgcgtactgcacttgg

SEQ ID NO: 929873 - DNA, 25 bp, Mus musculus
ttcagactaaatcaacccagcgcct

SEQ ID NO: 929874 - DNA, 25 bp, Mus musculus
ttcagactaaatgaacccagcgcct

SEQ ID NO: 929875 - DNA, 25 bp, Mus musculus
ttcagactaagaacaaaagttccaa

SEQ ID NO: 929876 - DNA, 25 bp, Mus musculus
ttcagactaagatcaaaagttccaa

SEQ ID NO: 929877 - DNA, 25 bp, Mus musculus
ttcagactcccactgttctacttgt

SEQ ID NO: 929878 - DNA, 25 bp, Mus musculus
ttcagactcccagtgttctacttgt

SEQ ID NO: 929879 - DNA, 25 bp, Mus musculus
ttcagactcctgaaacgacccagag

SEQ ID NO: 929880 - DNA, 25 bp, Mus musculus
ttcagactcctgtaacgacccagag

SEQ ID NO: 929881 - DNA, 25 bp, Mus musculus
ttcagactcgcccaaagtacagcct

SEQ ID NO: 929882 - DNA, 25 bp, Mus musculus
ttcagactcgccgaaagtacagcct

SEQ ID NO: 929883 - DNA, 25 bp, Mus musculus
ttcagactcgggacaccaactttgg

SEQ ID NO: 929884 - DNA, 25 bp, Mus musculus
ttcagactcgggatctgtcggtgtt

SEQ ID NO: 929885 - DNA, 25 bp, Mus musculus
ttcagactcgggtcaccaactttgg

SEQ ID NO: 929886 - DNA, 25 bp, Mus musculus
ttcagactcgggttctgtcggtgtt

SEQ ID NO: 929887 - DNA, 25 bp, Mus musculus
ttcagactctagatattgttctaat

SEQ ID NO: 929888 - DNA, 25 bp, Mus musculus
ttcagactctagttattgttctaat

SEQ ID NO: 929889 - DNA, 25 bp, Mus musculus
ttcagactctgaatagcaggcccca

SEQ ID NO: 929890 - DNA, 25 bp, Mus musculus
ttcagactctgattagcaggcccca

SEQ ID NO: 929891 - DNA, 25 bp, Mus musculus
ttcagactctgtattggactactca

SEQ ID NO: 929892 - DNA, 25 bp, Mus musculus
ttcagactctgttttggactactca

SEQ ID NO: 929893 - DNA, 25 bp, Mus musculus
ttcagactgataaccccagtatttt

SEQ ID NO: 929894 - DNA, 25 bp, Mus musculus
ttcagactgatatccccagtatttt

SEQ ID NO: 929895 - DNA, 25 bp, Mus musculus
ttcagactgattacctttccacatg

SEQ ID NO: 929896 - DNA, 25 bp, Mus musculus
ttcagactgatttcctttccacatg

SEQ ID NO: 929897 - DNA, 25 bp, Mus musculus
ttcagactgcctcatgaggaggtgt

SEQ ID NO: 929898 - DNA, 25 bp, Mus musculus
ttcagactgcctgatgaggaggtgt

SEQ ID NO: 929899 - DNA, 25 bp, Mus musculus
ttcagactgctgaactcttcatttg

SEQ ID NO: 929900 - DNA, 25 bp, Mus musculus
ttcagactgctgtactcttcatttg

SEQ ID NO: 929901 - DNA, 25 bp, Mus musculus
ttcagactggaaataaagcacacac

SEQ ID NO: 929902 - DNA, 25 bp, Mus musculus
ttcagactggaattaaagcacacac

SEQ ID NO: 929903 - DNA, 25 bp, Mus musculus
ttcagactggacagtgctagagcca

SEQ ID NO: 929904 - DNA, 25 bp, Mus musculus
ttcagactggactgtgctagagcca

SEQ ID NO: 929905 - DNA, 25 bp, Mus musculus
ttcagactggtcaccacttgtagca

SEQ ID NO: 929906 - DNA, 25 bp, Mus musculus
ttcagactggtctccacttgtagca

SEQ ID NO: 929907 - DNA, 25 bp, Mus musculus
ttcagactgtttcagctccagtacc

SEQ ID NO: 929908 - DNA, 25 bp, Mus musculus
ttcagactgtttgagctccagtacc

SEQ ID NO: 929909 - DNA, 25 bp, Mus musculus
ttcagacttcagatttaccttgacc

SEQ ID NO: 929910 - DNA, 25 bp, Mus musculus
ttcagacttcagttttaccttgacc

SEQ ID NO: 929911 - DNA, 25 bp, Mus musculus
ttcagacttctgcaatcaaggttgg

SEQ ID NO: 929912 - DNA, 25 bp, Mus musculus
ttcagacttctggaatcaaggttgg

SEQ ID NO: 929913 - DNA, 25 bp, Mus musculus
ttcagagaccctacggttacagcag

SEQ ID NO: 929914 - DNA, 25 bp, Mus musculus
ttcagagacccttcggttacagcag

SEQ ID NO: 929915 - DNA, 25 bp, Mus musculus
ttcagagaccgcatctgcagggtat

SEQ ID NO: 929916 - DNA, 25 bp, Mus musculus
ttcagagaccgcttctgcagggtat

SEQ ID NO: 929917 - DNA, 25 bp, Mus musculus
ttcagagactgcctgttcaaggtgt

SEQ ID NO: 929918 - DNA, 25 bp, Mus musculus
ttcagagactgcgtgttcaaggtgt

SEQ ID NO: 929919 - DNA, 25 bp, Mus musculus
ttcagagagccaacatggtcatgtc

SEQ ID NO: 929920 - DNA, 25 bp, Mus musculus
ttcagagagccacgcttcagttccc

SEQ ID NO: 929921 - DNA, 25 bp, Mus musculus
ttcagagagccaggcttcagttccc

SEQ ID NO: 929922 - DNA, 25 bp, Mus musculus
ttcagagagccatcatggtcatgtc

SEQ ID NO: 929923 - DNA, 25 bp, Mus musculus
ttcagagagctcctattggccttct

SEQ ID NO: 929924 - DNA, 25 bp, Mus musculus
ttcagagagctcgtattggccttct

SEQ ID NO: 929925 - DNA, 25 bp, Mus musculus
ttcagagagctgaacactgcctact

SEQ ID NO: 929926 - DNA, 25 bp, Mus musculus
ttcagagagctgtacactgcctact

SEQ ID NO: 929927 - DNA, 25 bp, Mus musculus
ttcagagagtctccttgagctcaga

SEQ ID NO: 929928 - DNA, 25 bp, Mus musculus
ttcagagagtctgcttgagctcaga

SEQ ID NO: 929929 - DNA, 25 bp, Mus musculus
ttcagagatgacaatgcctctttgc

SEQ ID NO: 929930 - DNA, 25 bp, Mus musculus
ttcagagatgactatgcctctttgc

SEQ ID NO: 929931 - DNA, 25 bp, Mus musculus
ttcagagatgctaccctatgactac

SEQ ID NO: 929932 - DNA, 25 bp, Mus musculus
ttcagagatgcttccctatgactac

SEQ ID NO: 929933 - DNA, 25 bp, Mus musculus
ttcagagattcccagtttataccac

SEQ ID NO: 929934 - DNA, 25 bp, Mus musculus
ttcagagattccgagtttataccac

SEQ ID NO: 929935 - DNA, 25 bp, Mus musculus
ttcagagcaaggaacaggctgagca

SEQ ID NO: 929936 - DNA, 25 bp, Mus musculus
ttcagagcaaggtacaggctgagca

SEQ ID NO: 929937 - DNA, 25 bp, Mus musculus
ttcagagcacacacttcaccaattc

SEQ ID NO: 929938 - DNA, 25 bp, Mus musculus
ttcagagcacactcttcaccaattc

SEQ ID NO: 929939 - DNA, 25 bp, Mus musculus
ttcagagcacctacctaaagcagga

SEQ ID NO: 929940 - DNA, 25 bp, Mus musculus
ttcagagcacctactgctgtacaaa

SEQ ID NO: 929941 - DNA, 25 bp, Mus musculus
ttcagagcaccttcctaaagcagga

SEQ ID NO: 929942 - DNA, 25 bp, Mus musculus
ttcagagcaccttctgctgtacaaa

SEQ ID NO: 929943 - DNA, 25 bp, Mus musculus
ttcagagcactccttcaaaatccct

SEQ ID NO: 929944 - DNA, 25 bp, Mus musculus
ttcagagcactcgttcaaaatccct

SEQ ID NO: 929945 - DNA, 25 bp, Mus musculus
ttcagagcacttatcaaactccaat

SEQ ID NO: 929946 - DNA, 25 bp, Mus musculus
ttcagagcacttttcaaactccaat

SEQ ID NO: 929947 - DNA, 25 bp, Mus musculus
ttcagagcagacaagaccgcagctg

SEQ ID NO: 929948 - DNA, 25 bp, Mus musculus
ttcagagcagactagaccgcagctg

SEQ ID NO: 929949 - DNA, 25 bp, Mus musculus
ttcagagcagttaggatttgtgact

SEQ ID NO: 929950 - DNA, 25 bp, Mus musculus
ttcagagcagtttggatttgtgact

SEQ ID NO: 929951 - DNA, 25 bp, Mus musculus
ttcagagccccacccggtgatcttt

SEQ ID NO: 929952 - DNA, 25 bp, Mus musculus
ttcagagccccagccggtgatcttt

SEQ ID NO: 929953 - DNA, 25 bp, Mus musculus
ttcagagccctaatacctgttcaga

SEQ ID NO: 929954 - DNA, 25 bp, Mus musculus
ttcagagccctaatcccaatttgga

SEQ ID NO: 929955 - DNA, 25 bp, Mus musculus
ttcagagccctattacctgttcaga

SEQ ID NO: 929956 - DNA, 25 bp, Mus musculus
ttcagagccctattcccaatttgga

SEQ ID NO: 929957 - DNA, 25 bp, Mus musculus
ttcagagccctgcacaagttgctta

SEQ ID NO: 929958 - DNA, 25 bp, Mus musculus
ttcagagccctggacaagttgctta

SEQ ID NO: 929959 - DNA, 25 bp, Mus musculus
ttcagagcccttagcttgtgttatc

SEQ ID NO: 929960 - DNA, 25 bp, Mus musculus
ttcagagccctttgcttgtgttatc

SEQ ID NO: 929961 - DNA, 25 bp, Mus musculus
ttcagagcctgtcgcgggcagtcac

SEQ ID NO: 929962 - DNA, 25 bp, Mus musculus
ttcagagcctgtggcgggcagtcac

SEQ ID NO: 929963 - DNA, 25 bp, Mus musculus
ttcagagcgcccaccaattggtata

SEQ ID NO: 929964 - DNA, 25 bp, Mus musculus
ttcagagcgccctccaattggtata

SEQ ID NO: 929965 - DNA, 25 bp, Mus musculus
ttcagagctcccatcccatttagct

SEQ ID NO: 929966 - DNA, 25 bp, Mus musculus
ttcagagctcccttcccatttagct

SEQ ID NO: 929967 - DNA, 25 bp, Mus musculus
ttcagagctgagcatgatagtgcat

SEQ ID NO: 929968 - DNA, 25 bp, Mus musculus
ttcagagctgaggatgatagtgcat

SEQ ID NO: 929969 - DNA, 25 bp, Mus musculus
ttcagagctgatcggttcactattt

SEQ ID NO: 929970 - DNA, 25 bp, Mus musculus
ttcagagctgatgggttcactattt

SEQ ID NO: 929971 - DNA, 25 bp, Mus musculus
ttcagagctgctattatgccccaca

SEQ ID NO: 929972 - DNA, 25 bp, Mus musculus
ttcagagctgcttttatgccccaca

SEQ ID NO: 929973 - DNA, 25 bp, Mus musculus
ttcagagctggaccgacaggcaatt

SEQ ID NO: 929974 - DNA, 25 bp, Mus musculus
ttcagagctggagcgacaggcaatt

SEQ ID NO: 929975 - DNA, 25 bp, Mus musculus
ttcagagctgggaatacagatggct

SEQ ID NO: 929976 - DNA, 25 bp, Mus musculus
ttcagagctgggtatacagatggct

SEQ ID NO: 929977 - DNA, 25 bp, Mus musculus
ttcagagctggtattgcttcctggc

SEQ ID NO: 929978 - DNA, 25 bp, Mus musculus
ttcagagctggttttgcttcctggc

SEQ ID NO: 929979 - DNA, 25 bp, Mus musculus
ttcagagcttcgagacgagcactaa

SEQ ID NO: 929980 - DNA, 25 bp, Mus musculus
ttcagagcttcgtgacgagcactaa

SEQ ID NO: 929981 - DNA, 25 bp, Mus musculus
ttcagaggaaagatgtcgtagcact

SEQ ID NO: 929982 - DNA, 25 bp, Mus musculus
ttcagaggaaagttgtcgtagcact

SEQ ID NO: 929983 - DNA, 25 bp, Mus musculus
ttcagaggaccgcttagataaaact

SEQ ID NO: 929984 - DNA, 25 bp, Mus musculus
ttcagaggaccggttagataaaact

SEQ ID NO: 929985 - DNA, 25 bp, Mus musculus
ttcagaggacttcaggtgtccctat

SEQ ID NO: 929986 - DNA, 25 bp, Mus musculus
ttcagaggacttgaggtgtccctat

SEQ ID NO: 929987 - DNA, 25 bp, Mus musculus
ttcagaggagcaatctccgtctact

SEQ ID NO: 929988 - DNA, 25 bp, Mus musculus
ttcagaggagcattctccgtctact

SEQ ID NO: 929989 - DNA, 25 bp, Mus musculus
ttcagaggagccaggttcaaatcat

SEQ ID NO: 929990 - DNA, 25 bp, Mus musculus
ttcagaggagcctggttcaaatcat

SEQ ID NO: 929991 - DNA, 25 bp, Mus musculus
ttcagaggataccacattcccaagg

SEQ ID NO: 929992 - DNA, 25 bp, Mus musculus
ttcagaggatacgacattcccaagg

SEQ ID NO: 929993 - DNA, 25 bp, Mus musculus
ttcagaggatagagccttggctcaa

SEQ ID NO: 929994 - DNA, 25 bp, Mus musculus
ttcagaggatagtgccttggctcaa

SEQ ID NO: 929995 - DNA, 25 bp, Mus musculus
ttcagaggctaactctcgctgtcag

SEQ ID NO: 929996 - DNA, 25 bp, Mus musculus
ttcagaggctaagtctcgctgtcag

SEQ ID NO: 929997 - DNA, 25 bp, Mus musculus
ttcagaggctctcgcgataccagca

SEQ ID NO: 929998 - DNA, 25 bp, Mus musculus
ttcagaggctctggcgataccagca

SEQ ID NO: 929999 - DNA, 25 bp, Mus musculus
ttcagagggctcaacgagctgtcaa

SEQ ID NO: 930000 - DNA, 25 bp, Mus musculus
ttcagagggctctacgagctgtcaa

SEQ ID NO: 930001 - DNA, 25 bp, Mus musculus
ttcagaggtcatacggaggtcctag

SEQ ID NO: 930002 - DNA, 25 bp, Mus musculus
ttcagaggtcattcggaggtcctag

SEQ ID NO: 930003 - DNA, 25 bp, Mus musculus
ttcagaggtccccaaggttctattc

SEQ ID NO: 930004 - DNA, 25 bp, Mus musculus
ttcagaggtcccgaaggttctattc

SEQ ID NO: 930005 - DNA, 25 bp, Mus musculus
ttcagaggtcctctctgagtccaac

SEQ ID NO: 930006 - DNA, 25 bp, Mus musculus
ttcagaggtcctgtctgagtccaac

SEQ ID NO: 930007 - DNA, 25 bp, Mus musculus
ttcagaggtcttaagcttgagttaa

SEQ ID NO: 930008 - DNA, 25 bp, Mus musculus
ttcagaggtctttagcttgagttaa

SEQ ID NO: 930009 - DNA, 25 bp, Mus musculus
ttcagaggtggcaagcgtccgactt

SEQ ID NO: 930010 - DNA, 25 bp, Mus musculus
ttcagaggtggctagcgtccgactt

SEQ ID NO: 930011 - DNA, 25 bp, Mus musculus
ttcagaggtgtacagcattgcagac

SEQ ID NO: 930012 - DNA, 25 bp, Mus musculus
ttcagaggtgtagagcattgcagac

SEQ ID NO: 930013 - DNA, 25 bp, Mus musculus
ttcagaggttgtcctgcagctcccc

SEQ ID NO: 930014 - DNA, 25 bp, Mus musculus
ttcagaggttgtgctgcagctcccc

SEQ ID NO: 930015 - DNA, 25 bp, Mus musculus
ttcagagtaccgagccctgtgtgaa

SEQ ID NO: 930016 - DNA, 25 bp, Mus musculus
ttcagagtaccgtgccctgtgtgaa

SEQ ID NO: 930017 - DNA, 25 bp, Mus musculus
ttcagagtatggaccagtgtgtcat

SEQ ID NO: 930018 - DNA, 25 bp, Mus musculus
ttcagagtatggtccagtgtgtcat

SEQ ID NO: 930019 - DNA, 25 bp, Mus musculus
ttcagagtatttacattactcccta

SEQ ID NO: 930020 - DNA, 25 bp, Mus musculus
ttcagagtattttcattactcccta

SEQ ID NO: 930021 - DNA, 25 bp, Mus musculus
ttcagagtcccacgtcatccatgat

SEQ ID NO: 930022 - DNA, 25 bp, Mus musculus
ttcagagtcccaggtcatccatgat

SEQ ID NO: 930023 - DNA, 25 bp, Mus musculus
ttcagagtccggagctgcggtggtg

SEQ ID NO: 930024 - DNA, 25 bp, Mus musculus
ttcagagtccggtgctgcggtggtg

SEQ ID NO: 930025 - DNA, 25 bp, Mus musculus
ttcagagtcctcatcagtcattgat

SEQ ID NO: 930026 - DNA, 25 bp, Mus musculus
ttcagagtcctcttcagtcattgat

SEQ ID NO: 930027 - DNA, 25 bp, Mus musculus
ttcagagtgcccactcttcatttcc

SEQ ID NO: 930028 - DNA, 25 bp, Mus musculus
ttcagagtgccctctcttcatttcc

SEQ ID NO: 930029 - DNA, 25 bp, Mus musculus
ttcagagtgcttcacagctgtgtcc

SEQ ID NO: 930030 - DNA, 25 bp, Mus musculus
ttcagagtgcttgacagctgtgtcc

SEQ ID NO: 930031 - DNA, 25 bp, Mus musculus
ttcagagtggccatgagctgtccct

SEQ ID NO: 930032 - DNA, 25 bp, Mus musculus
ttcagagtggccttgagctgtccct

SEQ ID NO: 930033 - DNA, 25 bp, Mus musculus
ttcagagtgttactcttgctgttcc

SEQ ID NO: 930034 - DNA, 25 bp, Mus musculus
ttcagagtgttagtcttgctgttcc

SEQ ID NO: 930035 - DNA, 25 bp, Mus musculus
ttcagagttcacattccccttagta

SEQ ID NO: 930036 - DNA, 25 bp, Mus musculus
ttcagagttcactttccccttagta

SEQ ID NO: 930037 - DNA, 25 bp, Mus musculus
ttcagagttccacttggttttgcct

SEQ ID NO: 930038 - DNA, 25 bp, Mus musculus
ttcagagttccagttggttttgcct

SEQ ID NO: 930039 - DNA, 25 bp, Mus musculus
ttcagagttgacagctttgtgctac

SEQ ID NO: 930040 - DNA, 25 bp, Mus musculus
ttcagagttgactgctttgtgctac

SEQ ID NO: 930041 - DNA, 25 bp, Mus musculus
ttcagagtttggctacgtgaacaca

SEQ ID NO: 930042 - DNA, 25 bp, Mus musculus
ttcagagtttgggtacgtgaacaca

SEQ ID NO: 930043 - DNA, 25 bp, Mus musculus
ttcagagttttcaggttctgagtaa

SEQ ID NO: 930044 - DNA, 25 bp, Mus musculus
ttcagagttttctggttctgagtaa

SEQ ID NO: 930045 - DNA, 25 bp, Mus musculus
ttcagataaccgatttcccatcagt

SEQ ID NO: 930046 - DNA, 25 bp, Mus musculus
ttcagataaccgttttcccatcagt

SEQ ID NO: 930047 - DNA, 25 bp, Mus musculus
ttcagataatgcctctcttcctttt

SEQ ID NO: 930048 - DNA, 25 bp, Mus musculus
ttcagataatgcgtctcttcctttt

SEQ ID NO: 930049 - DNA, 25 bp, Mus musculus
ttcagataccaccaagtcatcatgt

SEQ ID NO: 930050 - DNA, 25 bp, Mus musculus
ttcagataccacgaagtcatcatgt

SEQ ID NO: 930051 - DNA, 25 bp, Mus musculus
ttcagatagaaaccgagcagccatt

SEQ ID NO: 930052 - DNA, 25 bp, Mus musculus
ttcagatagaaagcgagcagccatt

SEQ ID NO: 930053 - DNA, 25 bp, Mus musculus
ttcagatagagtatctttcagttgc

SEQ ID NO: 930054 - DNA, 25 bp, Mus musculus
ttcagatagagtttctttcagttgc

SEQ ID NO: 930055 - DNA, 25 bp, Mus musculus
ttcagatagcccagttatgtcctca

SEQ ID NO: 930056 - DNA, 25 bp, Mus musculus
ttcagatagcccagttttctaggct

SEQ ID NO: 930057 - DNA, 25 bp, Mus musculus
ttcagatagccctgttatgtcctca

SEQ ID NO: 930058 - DNA, 25 bp, Mus musculus
ttcagatagccctgttttctaggct

SEQ ID NO: 930059 - DNA, 25 bp, Mus musculus
ttcagatagtccctttgcagtgttc

SEQ ID NO: 930060 - DNA, 25 bp, Mus musculus
ttcagatagtccgtttgcagtgttc

SEQ ID NO: 930061 - DNA, 25 bp, Mus musculus
ttcagatatctaccttgacttcccc

SEQ ID NO: 930062 - DNA, 25 bp, Mus musculus
ttcagatatctagcttgacttcccc

SEQ ID NO: 930063 - DNA, 25 bp, Mus musculus
ttcagatatgccaaccggtcaggct

SEQ ID NO: 930064 - DNA, 25 bp, Mus musculus
ttcagatatgcctaccggtcaggct

SEQ ID NO: 930065 - DNA, 25 bp, Mus musculus
ttcagatatggtatgcacaggaggc

SEQ ID NO: 930066 - DNA, 25 bp, Mus musculus
ttcagatatggtttgcacaggaggc

SEQ ID NO: 930067 - DNA, 25 bp, Mus musculus
ttcagatatttcagtgttctaggaa

SEQ ID NO: 930068 - DNA, 25 bp, Mus musculus
ttcagatatttctgtgttctaggaa

SEQ ID NO: 930069 - DNA, 25 bp, Mus musculus
ttcagatcacagaccgaatggaata

SEQ ID NO: 930070 - DNA, 25 bp, Mus musculus
ttcagatcacagtccgaatggaata

SEQ ID NO: 930071 - DNA, 25 bp, Mus musculus
ttcagatcatctctcaagcacgtag

SEQ ID NO: 930072 - DNA, 25 bp, Mus musculus
ttcagatcatctgtcaagcacgtag

SEQ ID NO: 930073 - DNA, 25 bp, Mus musculus
ttcagatcccaaacaggcgcacgag

SEQ ID NO: 930074 - DNA, 25 bp, Mus musculus
ttcagatcccaatcaggcgcacgag

SEQ ID NO: 930075 - DNA, 25 bp, Mus musculus
ttcagatcccagagctcattcaaga

SEQ ID NO: 930076 - DNA, 25 bp, Mus musculus
ttcagatcccagtgctcattcaaga

SEQ ID NO: 930077 - DNA, 25 bp, Mus musculus
ttcagatcgcatacacaccgtggtt

SEQ ID NO: 930078 - DNA, 25 bp, Mus musculus
ttcagatcgcattcacaccgtggtt

SEQ ID NO: 930079 - DNA, 25 bp, Mus musculus
ttcagatctccaacttggacagctc

SEQ ID NO: 930080 - DNA, 25 bp, Mus musculus
ttcagatctccatcttggacagctc

SEQ ID NO: 930081 - DNA, 25 bp, Mus musculus
ttcagatctgcaatgagcttcccca

SEQ ID NO: 930082 - DNA, 25 bp, Mus musculus
ttcagatctgcattgagcttcccca

SEQ ID NO: 930083 - DNA, 25 bp, Mus musculus
ttcagatctgccactgtgcaggtgg

SEQ ID NO: 930084 - DNA, 25 bp, Mus musculus
ttcagatctgcctctgtgcaggtgg

SEQ ID NO: 930085 - DNA, 25 bp, Mus musculus
ttcagatcttcccattcttttcttg

SEQ ID NO: 930086 - DNA, 25 bp, Mus musculus
ttcagatcttccgattcttttcttg

SEQ ID NO: 930087 - DNA, 25 bp, Mus musculus
ttcagatctttacacacggcagcaa

SEQ ID NO: 930088 - DNA, 25 bp, Mus musculus
ttcagatctttagacacggcagcaa

SEQ ID NO: 930089 - DNA, 25 bp, Mus musculus
ttcagatgaagacgtcagatacact

SEQ ID NO: 930090 - DNA, 25 bp, Mus musculus
ttcagatgaagaggtcagatacact

SEQ ID NO: 930091 - DNA, 25 bp, Mus musculus
ttcagatgactcatctagatcacat

SEQ ID NO: 930092 - DNA, 25 bp, Mus musculus
ttcagatgactcttctagatcacat

SEQ ID NO: 930093 - DNA, 25 bp, Mus musculus
ttcagatgatgaagacaccgacaat

SEQ ID NO: 930094 - DNA, 25 bp, Mus musculus
ttcagatgatgatgacaccgacaat

SEQ ID NO: 930095 - DNA, 25 bp, Mus musculus
ttcagatgatggctctggtggtcat

SEQ ID NO: 930096 - DNA, 25 bp, Mus musculus
ttcagatgatgggtctggtggtcat

SEQ ID NO: 930097 - DNA, 25 bp, Mus musculus
ttcagatgcatgcttctcttgcaga

SEQ ID NO: 930098 - DNA, 25 bp, Mus musculus
ttcagatgcatggttctcttgcaga

SEQ ID NO: 930099 - DNA, 25 bp, Mus musculus
ttcagatgccgtcatttctacagag

SEQ ID NO: 930100 - DNA, 25 bp, Mus musculus
ttcagatgccgtgatttctacagag

SEQ ID NO: 930101 - DNA, 25 bp, Mus musculus
ttcagatgctgcaaatgcacctgct

SEQ ID NO: 930102 - DNA, 25 bp, Mus musculus
ttcagatgctgctaatgcacctgct

SEQ ID NO: 930103 - DNA, 25 bp, Mus musculus
ttcagatgctttatgtaggccacat

SEQ ID NO: 930104 - DNA, 25 bp, Mus musculus
ttcagatgctttttgtaggccacat

SEQ ID NO: 930105 - DNA, 25 bp, Mus musculus
ttcagatggcatcactagtgtttgt

SEQ ID NO: 930106 - DNA, 25 bp, Mus musculus
ttcagatggcatgactagtgtttgt

SEQ ID NO: 930107 - DNA, 25 bp, Mus musculus
ttcagatggcctccttgtaagctgc

SEQ ID NO: 930108 - DNA, 25 bp, Mus musculus
ttcagatggcctgcttgtaagctgc

SEQ ID NO: 930109 - DNA, 25 bp, Mus musculus
ttcagatggcttattgagccccact

SEQ ID NO: 930110 - DNA, 25 bp, Mus musculus
ttcagatggctttttgagccccact

SEQ ID NO: 930111 - DNA, 25 bp, Mus musculus
ttcagatgtctgctttagatatatt

SEQ ID NO: 930112 - DNA, 25 bp, Mus musculus
ttcagatgtctggtttagatatatt

SEQ ID NO: 930113 - DNA, 25 bp, Mus musculus
ttcagatgtgcgcagcgttcaccca

SEQ ID NO: 930114 - DNA, 25 bp, Mus musculus
ttcagatgtgcggagcgttcaccca

SEQ ID NO: 930115 - DNA, 25 bp, Mus musculus
ttcagatgtggactgcgtacgcttt

SEQ ID NO: 930116 - DNA, 25 bp, Mus musculus
ttcagatgtggagtgcgtacgcttt

SEQ ID NO: 930117 - DNA, 25 bp, Mus musculus
ttcagattaaccaccttagggacgc

SEQ ID NO: 930118 - DNA, 25 bp, Mus musculus
ttcagattaacctccttagggacgc

SEQ ID NO: 930119 - DNA, 25 bp, Mus musculus
ttcagattacgaaggcgtgcccaag

SEQ ID NO: 930120 - DNA, 25 bp, Mus musculus
ttcagattacgatggcgtgcccaag

SEQ ID NO: 930121 - DNA, 25 bp, Mus musculus
ttcagattaggcatcaccatttccc

SEQ ID NO: 930122 - DNA, 25 bp, Mus musculus
ttcagattaggcttcaccatttccc

SEQ ID NO: 930123 - DNA, 25 bp, Mus musculus
ttcagattcattccacaaagtccag

SEQ ID NO: 930124 - DNA, 25 bp, Mus musculus
ttcagattcattgcacaaagtccag

SEQ ID NO: 930125 - DNA, 25 bp, Mus musculus
ttcagattccagacctgctgagagg

SEQ ID NO: 930126 - DNA, 25 bp, Mus musculus
ttcagattccagtcctgctgagagg

SEQ ID NO: 930127 - DNA, 25 bp, Mus musculus
ttcagattccctcaagccaaagctt

SEQ ID NO: 930128 - DNA, 25 bp, Mus musculus
ttcagattccctgaagccaaagctt

SEQ ID NO: 930129 - DNA, 25 bp, Mus musculus
ttcagattcctgacgtttgttttag

SEQ ID NO: 930130 - DNA, 25 bp, Mus musculus
ttcagattcctgtcgtttgttttag

SEQ ID NO: 930131 - DNA, 25 bp, Mus musculus
ttcagattctgtctcatttttcaat

SEQ ID NO: 930132 - DNA, 25 bp, Mus musculus
ttcagattctgtgtcatttttcaat

SEQ ID NO: 930133 - DNA, 25 bp, Mus musculus
ttcagattcttcctcctcctttttt

SEQ ID NO: 930134 - DNA, 25 bp, Mus musculus
ttcagattcttcgtcctcctttttt

SEQ ID NO: 930135 - DNA, 25 bp, Mus musculus
ttcagattcttgatactccagggag

SEQ ID NO: 930136 - DNA, 25 bp, Mus musculus
ttcagattcttgttactccagggag

SEQ ID NO: 930137 - DNA, 25 bp, Mus musculus
ttcagattggtccttgttctctcac

SEQ ID NO: 930138 - DNA, 25 bp, Mus musculus
ttcagattggtcgttgttctctcac

SEQ ID NO: 930139 - DNA, 25 bp, Mus musculus
ttcagattgtaaatagcgcgtcagc

SEQ ID NO: 930140 - DNA, 25 bp, Mus musculus
ttcagattgtaattagcgcgtcagc

SEQ ID NO: 930141 - DNA, 25 bp, Mus musculus
ttcagattgtacatgctagggccag

SEQ ID NO: 930142 - DNA, 25 bp, Mus musculus
ttcagattgtacttgctagggccag

SEQ ID NO: 930143 - DNA, 25 bp, Mus musculus
ttcagatttaccctgtggacttagg

SEQ ID NO: 930144 - DNA, 25 bp, Mus musculus
ttcagatttaccgtgtggacttagg

SEQ ID NO: 930145 - DNA, 25 bp, Mus musculus
ttcagattttatattgcaccaaaaa

SEQ ID NO: 930146 - DNA, 25 bp, Mus musculus
ttcagattttattttgcaccaaaaa

SEQ ID NO: 930147 - DNA, 25 bp, Mus musculus
ttcagcaaacaaatgctcacggtgt

SEQ ID NO: 930148 - DNA, 25 bp, Mus musculus
ttcagcaaacaattgctcacggtgt

SEQ ID NO: 930149 - DNA, 25 bp, Mus musculus
ttcagcaaagccaagttcagacatt

SEQ ID NO: 930150 - DNA, 25 bp, Mus musculus
ttcagcaaagcctagttcagacatt

SEQ ID NO: 930151 - DNA, 25 bp, Mus musculus
ttcagcaaagctatccaactcagtg

SEQ ID NO: 930152 - DNA, 25 bp, Mus musculus
ttcagcaaagctttccaactcagtg

SEQ ID NO: 930153 - DNA, 25 bp, Mus musculus
ttcagcaaaggcaggcaccatcgtt

SEQ ID NO: 930154 - DNA, 25 bp, Mus musculus
ttcagcaaaggctggcaccatcgtt

SEQ ID NO: 930155 - DNA, 25 bp, Mus musculus
ttcagcaaatccacagtcacgtcgg

SEQ ID NO: 930156 - DNA, 25 bp, Mus musculus
ttcagcaaatcctcagtcacgtcgg

SEQ ID NO: 930157 - DNA, 25 bp, Mus musculus
ttcagcaaatgaatagtccctattt

SEQ ID NO: 930158 - DNA, 25 bp, Mus musculus
ttcagcaaatgattagtccctattt

SEQ ID NO: 930159 - DNA, 25 bp, Mus musculus
ttcagcaactttctgtcctgttcag

SEQ ID NO: 930160 - DNA, 25 bp, Mus musculus
ttcagcaactttgtgtcctgttcag

SEQ ID NO: 930161 - DNA, 25 bp, Mus musculus
ttcagcaagtacaccatgtctggtc

SEQ ID NO: 930162 - DNA, 25 bp, Mus musculus
ttcagcaagtactccatgtctggtc

SEQ ID NO: 930163 - DNA, 25 bp, Mus musculus
ttcagcaagtccatagtctacagtg

SEQ ID NO: 930164 - DNA, 25 bp, Mus musculus
ttcagcaagtccttagtctacagtg

SEQ ID NO: 930165 - DNA, 25 bp, Mus musculus
ttcagcaagttcattcccgagggat

SEQ ID NO: 930166 - DNA, 25 bp, Mus musculus
ttcagcaagttctttcccgagggat

SEQ ID NO: 930167 - DNA, 25 bp, Mus musculus
ttcagcaataaaaagtcccagattt

SEQ ID NO: 930168 - DNA, 25 bp, Mus musculus
ttcagcaataaatagtcccagattt

SEQ ID NO: 930169 - DNA, 25 bp, Mus musculus
ttcagcaatcaacccggaacacgca

SEQ ID NO: 930170 - DNA, 25 bp, Mus musculus
ttcagcaatcaagccggaacacgca

SEQ ID NO: 930171 - DNA, 25 bp, Mus musculus
ttcagcacaatcatgccctagttac

SEQ ID NO: 930172 - DNA, 25 bp, Mus musculus
ttcagcacaatcttgccctagttac

SEQ ID NO: 930173 - DNA, 25 bp, Mus musculus
ttcagcacaggaaaaggtgtgcctt

SEQ ID NO: 930174 - DNA, 25 bp, Mus musculus
ttcagcacaggataaggtgtgcctt

SEQ ID NO: 930175 - DNA, 25 bp, Mus musculus
ttcagcacagttaagtgtcagccct

SEQ ID NO: 930176 - DNA, 25 bp, Mus musculus
ttcagcacagtttagtgtcagccct

SEQ ID NO: 930177 - DNA, 25 bp, Mus musculus
ttcagcacattccttacaaacctac

SEQ ID NO: 930178 - DNA, 25 bp, Mus musculus
ttcagcacattcgttacaaacctac

SEQ ID NO: 930179 - DNA, 25 bp, Mus musculus
ttcagcaccagccaaggccggagga

SEQ ID NO: 930180 - DNA, 25 bp, Mus musculus
ttcagcaccagcgaaggccggagga

SEQ ID NO: 930181 - DNA, 25 bp, Mus musculus
ttcagcaccgtgctagctgatcttt

SEQ ID NO: 930182 - DNA, 25 bp, Mus musculus
ttcagcaccgtggtagctgatcttt

SEQ ID NO: 930183 - DNA, 25 bp, Mus musculus
ttcagcacctgtctcaagcagctaa

SEQ ID NO: 930184 - DNA, 25 bp, Mus musculus
ttcagcacctgtgtcaagcagctaa

SEQ ID NO: 930185 - DNA, 25 bp, Mus musculus
ttcagcaccttcaacaacaccaaag

SEQ ID NO: 930186 - DNA, 25 bp, Mus musculus
ttcagcaccttctacaacaccaaag

SEQ ID NO: 930187 - DNA, 25 bp, Mus musculus
ttcagcacgggtaccgcggacagcg

SEQ ID NO: 930188 - DNA, 25 bp, Mus musculus
ttcagcacgggttccgcggacagcg

SEQ ID NO: 930189 - DNA, 25 bp, Mus musculus
ttcagcactcttcaccagttgcaga

SEQ ID NO: 930190 - DNA, 25 bp, Mus musculus
ttcagcactcttgaccagttgcaga

SEQ ID NO: 930191 - DNA, 25 bp, Mus musculus
ttcagcactgctcggcctcgatgta

SEQ ID NO: 930192 - DNA, 25 bp, Mus musculus
ttcagcactgctgggcctcgatgta

SEQ ID NO: 930193 - DNA, 25 bp, Mus musculus
ttcagcacttcgcacagcgccccag

SEQ ID NO: 930194 - DNA, 25 bp, Mus musculus
ttcagcacttcggacagcgccccag

SEQ ID NO: 930195 - DNA, 25 bp, Mus musculus
ttcagcactttgaatatctttcctt

SEQ ID NO: 930196 - DNA, 25 bp, Mus musculus
ttcagcactttgtatatctttcctt

SEQ ID NO: 930197 - DNA, 25 bp, Mus musculus
ttcagcagaaagaatacagtggcct

SEQ ID NO: 930198 - DNA, 25 bp, Mus musculus
ttcagcagaaagtatacagtggcct

SEQ ID NO: 930199 - DNA, 25 bp, Mus musculus
ttcagcagacttcaattttggccaa

SEQ ID NO: 930200 - DNA, 25 bp, Mus musculus
ttcagcagacttgaattttggccaa

SEQ ID NO: 930201 - DNA, 25 bp, Mus musculus
ttcagcagctagcatctttaccact

SEQ ID NO: 930202 - DNA, 25 bp, Mus musculus
ttcagcagctaggatctttaccact

SEQ ID NO: 930203 - DNA, 25 bp, Mus musculus
ttcagcagctgcacggaattccctg

SEQ ID NO: 930204 - DNA, 25 bp, Mus musculus
ttcagcagctgctcggaattccctg

SEQ ID NO: 930205 - DNA, 25 bp, Mus musculus
ttcagcagctgtcttcatccagtct

SEQ ID NO: 930206 - DNA, 25 bp, Mus musculus
ttcagcagctgtgttcatccagtct

SEQ ID NO: 930207 - DNA, 25 bp, Mus musculus
ttcagcaggaagaccgcctcagcgt

SEQ ID NO: 930208 - DNA, 25 bp, Mus musculus
ttcagcaggaagtccgcctcagcgt

SEQ ID NO: 930209 - DNA, 25 bp, Mus musculus
ttcagcaggcttcccacatgtaagt

SEQ ID NO: 930210 - DNA, 25 bp, Mus musculus
ttcagcaggcttgccacatgtaagt

SEQ ID NO: 930211 - DNA, 25 bp, Mus musculus
ttcagcagtcatatggccttaaaaa

SEQ ID NO: 930212 - DNA, 25 bp, Mus musculus
ttcagcagtcatttggccttaaaaa

SEQ ID NO: 930213 - DNA, 25 bp, Mus musculus
ttcagcagtgtaactggtaaaatac

SEQ ID NO: 930214 - DNA, 25 bp, Mus musculus
ttcagcagtgtatctggtaaaatac

SEQ ID NO: 930215 - DNA, 25 bp, Mus musculus
ttcagcagttcaaagggcttcccag

SEQ ID NO: 930216 - DNA, 25 bp, Mus musculus
ttcagcagttcatagggcttcccag

SEQ ID NO: 930217 - DNA, 25 bp, Mus musculus
ttcagcatagtcacaaggttacaat

SEQ ID NO: 930218 - DNA, 25 bp, Mus musculus
ttcagcatagtctcaaggttacaat

SEQ ID NO: 930219 - DNA, 25 bp, Mus musculus
ttcagcatatgactagcacagtatt

SEQ ID NO: 930220 - DNA, 25 bp, Mus musculus
ttcagcatatgagtagcacagtatt

SEQ ID NO: 930221 - DNA, 25 bp, Mus musculus
ttcagcatcctgactgggaacttga

SEQ ID NO: 930222 - DNA, 25 bp, Mus musculus
ttcagcatcctgtctgggaacttga

SEQ ID NO: 930223 - DNA, 25 bp, Mus musculus
ttcagcatcgcccaggatttcaaag

SEQ ID NO: 930224 - DNA, 25 bp, Mus musculus
ttcagcatcgccgaggatttcaaag

SEQ ID NO: 930225 - DNA, 25 bp, Mus musculus
ttcagcatgcgacgaggcttgcagc

SEQ ID NO: 930226 - DNA, 25 bp, Mus musculus
ttcagcatgcgaggaggcttgcagc

SEQ ID NO: 930227 - DNA, 25 bp, Mus musculus
ttcagcatgtgtcggtacaggttac

SEQ ID NO: 930228 - DNA, 25 bp, Mus musculus
ttcagcatgtgtgggtacaggttac

SEQ ID NO: 930229 - DNA, 25 bp, Mus musculus
ttcagcattgtaaaaccaggccttg

SEQ ID NO: 930230 - DNA, 25 bp, Mus musculus
ttcagcattgtataaccaggccttg

SEQ ID NO: 930231 - DNA, 25 bp, Mus musculus
ttcagcatttaaacagaatttccat

SEQ ID NO: 930232 - DNA, 25 bp, Mus musculus
ttcagcatttaatcagaatttccat

SEQ ID NO: 930233 - DNA, 25 bp, Mus musculus
ttcagcatttcaagagccacgctac

SEQ ID NO: 930234 - DNA, 25 bp, Mus musculus
ttcagcatttcatgagccacgctac

SEQ ID NO: 930235 - DNA, 25 bp, Mus musculus
ttcagccaaactatagagtgttatt

SEQ ID NO: 930236 - DNA, 25 bp, Mus musculus
ttcagccaaactattgccctattct

SEQ ID NO: 930237 - DNA, 25 bp, Mus musculus
ttcagccaaactttagagtgttatt

SEQ ID NO: 930238 - DNA, 25 bp, Mus musculus
ttcagccaaacttttgccctattct

SEQ ID NO: 930239 - DNA, 25 bp, Mus musculus
ttcagccaaagcaggtggcttcatc

SEQ ID NO: 930240 - DNA, 25 bp, Mus musculus
ttcagccaaagctggtggcttcatc

SEQ ID NO: 930241 - DNA, 25 bp, Mus musculus
ttcagccaaggaatttggtctgctt

SEQ ID NO: 930242 - DNA, 25 bp, Mus musculus
ttcagccaaggattttggtctgctt

SEQ ID NO: 930243 - DNA, 25 bp, Mus musculus
ttcagccacagtcaacagcacaact

SEQ ID NO: 930244 - DNA, 25 bp, Mus musculus
ttcagccacagtgaacagcacaact

SEQ ID NO: 930245 - DNA, 25 bp, Mus musculus
ttcagccaccagagtcaagaactta

SEQ ID NO: 930246 - DNA, 25 bp, Mus musculus
ttcagccaccagtgtcaagaactta

SEQ ID NO: 930247 - DNA, 25 bp, Mus musculus
ttcagccacctaacctgggaacagg

SEQ ID NO: 930248 - DNA, 25 bp, Mus musculus
ttcagccacctatcctgggaacagg

SEQ ID NO: 930249 - DNA, 25 bp, Mus musculus
ttcagccacgttcttcagtttatgt

SEQ ID NO: 930250 - DNA, 25 bp, Mus musculus
ttcagccacgttgttcagtttatgt

SEQ ID NO: 930251 - DNA, 25 bp, Mus musculus
ttcagccactccagtactactgtga

SEQ ID NO: 930252 - DNA, 25 bp, Mus musculus
ttcagccactcctgtactactgtga

SEQ ID NO: 930253 - DNA, 25 bp, Mus musculus
ttcagccactgaaggcggtcatggt

SEQ ID NO: 930254 - DNA, 25 bp, Mus musculus
ttcagccactgatggcggtcatggt

SEQ ID NO: 930255 - DNA, 25 bp, Mus musculus
ttcagccacttgagtcttaccagga

SEQ ID NO: 930256 - DNA, 25 bp, Mus musculus
ttcagccacttgtgtcttaccagga

SEQ ID NO: 930257 - DNA, 25 bp, Mus musculus
ttcagccagactacactctttgata

SEQ ID NO: 930258 - DNA, 25 bp, Mus musculus
ttcagccagacttcactctttgata

SEQ ID NO: 930259 - DNA, 25 bp, Mus musculus
ttcagccagccccatattgagaagt

SEQ ID NO: 930260 - DNA, 25 bp, Mus musculus
ttcagccagcccgatattgagaagt

SEQ ID NO: 930261 - DNA, 25 bp, Mus musculus
ttcagccagcctcttgcaccaggtt

SEQ ID NO: 930262 - DNA, 25 bp, Mus musculus
ttcagccagcctgttgcaccaggtt

SEQ ID NO: 930263 - DNA, 25 bp, Mus musculus
ttcagccaggagcaagttcactgtc

SEQ ID NO: 930264 - DNA, 25 bp, Mus musculus
ttcagccaggaggaagttcactgtc

SEQ ID NO: 930265 - DNA, 25 bp, Mus musculus
ttcagccatatcagggcccactggt

SEQ ID NO: 930266 - DNA, 25 bp, Mus musculus
ttcagccatatctgggcccactggt

SEQ ID NO: 930267 - DNA, 25 bp, Mus musculus
ttcagccatattcaaacattaggtc

SEQ ID NO: 930268 - DNA, 25 bp, Mus musculus
ttcagccatattgaaacattaggtc

SEQ ID NO: 930269 - DNA, 25 bp, Mus musculus
ttcagcccacttaactatgaagtat

SEQ ID NO: 930270 - DNA, 25 bp, Mus musculus
ttcagcccactttactatgaagtat

SEQ ID NO: 930271 - DNA, 25 bp, Mus musculus
ttcagcccagaacaggtggacctcc

SEQ ID NO: 930272 - DNA, 25 bp, Mus musculus
ttcagcccagaagaggtggacctcc

SEQ ID NO: 930273 - DNA, 25 bp, Mus musculus
ttcagcccaggaatactcaagattc

SEQ ID NO: 930274 - DNA, 25 bp, Mus musculus
ttcagcccaggattactcaagattc

SEQ ID NO: 930275 - DNA, 25 bp, Mus musculus
ttcagcccatcacgctgtggtttga

SEQ ID NO: 930276 - DNA, 25 bp, Mus musculus
ttcagcccatcaggctgtggtttga

SEQ ID NO: 930277 - DNA, 25 bp, Mus musculus
ttcagccccagacccatgtggcagg

SEQ ID NO: 930278 - DNA, 25 bp, Mus musculus
ttcagccccagagccatgtggcagg

SEQ ID NO: 930279 - DNA, 25 bp, Mus musculus
ttcagccccgtaaaacagttccttg

SEQ ID NO: 930280 - DNA, 25 bp, Mus musculus
ttcagccccgtataacagttccttg

SEQ ID NO: 930281 - DNA, 25 bp, Mus musculus
ttcagcccctaaaagtctaactttg

SEQ ID NO: 930282 - DNA, 25 bp, Mus musculus
ttcagcccctaatagtctaactttg

SEQ ID NO: 930283 - DNA, 25 bp, Mus musculus
ttcagccccttcaagacttttttga

SEQ ID NO: 930284 - DNA, 25 bp, Mus musculus
ttcagccccttctagacttttttga

SEQ ID NO: 930285 - DNA, 25 bp, Mus musculus
ttcagcccgcagaacttagcacagg

SEQ ID NO: 930286 - DNA, 25 bp, Mus musculus
ttcagcccgcagtacttagcacagg

SEQ ID NO: 930287 - DNA, 25 bp, Mus musculus
ttcagcccgtatatgcggatcagac

SEQ ID NO: 930288 - DNA, 25 bp, Mus musculus
ttcagcccgtatttgcggatcagac

SEQ ID NO: 930289 - DNA, 25 bp, Mus musculus
ttcagccctaatcagacatactctt

SEQ ID NO: 930290 - DNA, 25 bp, Mus musculus
ttcagccctaatgagacatactctt

SEQ ID NO: 930291 - DNA, 25 bp, Mus musculus
ttcagccctaccaaagacactagtg

SEQ ID NO: 930292 - DNA, 25 bp, Mus musculus
ttcagccctacctaagacactagtg

SEQ ID NO: 930293 - DNA, 25 bp, Mus musculus
ttcagccctcatctggtttctcatt

SEQ ID NO: 930294 - DNA, 25 bp, Mus musculus
ttcagccctcatgtggtttctcatt

SEQ ID NO: 930295 - DNA, 25 bp, Mus musculus
ttcagccctggaagcaaggcctcat

SEQ ID NO: 930296 - DNA, 25 bp, Mus musculus
ttcagccctggatgcaaggcctcat

SEQ ID NO: 930297 - DNA, 25 bp, Mus musculus
ttcagccctgtaaacgtcaatgtcc

SEQ ID NO: 930298 - DNA, 25 bp, Mus musculus
ttcagccctgtatacgtcaatgtcc

SEQ ID NO: 930299 - DNA, 25 bp, Mus musculus
ttcagccctttcaaacagcagcgtg

SEQ ID NO: 930300 - DNA, 25 bp, Mus musculus
ttcagccctttcacttgtattggag

SEQ ID NO: 930301 - DNA, 25 bp, Mus musculus
ttcagccctttctaacagcagcgtg

SEQ ID NO: 930302 - DNA, 25 bp, Mus musculus
ttcagccctttctcttgtattggag

SEQ ID NO: 930303 - DNA, 25 bp, Mus musculus
ttcagccgctccaggaggactgaga

SEQ ID NO: 930304 - DNA, 25 bp, Mus musculus
ttcagccgctcctggaggactgaga

SEQ ID NO: 930305 - DNA, 25 bp, Mus musculus
ttcagccgctgaagaatcgcacagt

SEQ ID NO: 930306 - DNA, 25 bp, Mus musculus
ttcagccgctgatgaatcgcacagt

SEQ ID NO: 930307 - DNA, 25 bp, Mus musculus
ttcagccggcggatctattacagcg

SEQ ID NO: 930308 - DNA, 25 bp, Mus musculus
ttcagccggcggttctattacagcg

SEQ ID NO: 930309 - DNA, 25 bp, Mus musculus
ttcagccgtacccatacagagaagg

SEQ ID NO: 930310 - DNA, 25 bp, Mus musculus
ttcagccgtaccgatacagagaagg

SEQ ID NO: 930311 - DNA, 25 bp, Mus musculus
ttcagcctaatgactacagtacaga

SEQ ID NO: 930312 - DNA, 25 bp, Mus musculus
ttcagcctaatgtctacagtacaga

SEQ ID NO: 930313 - DNA, 25 bp, Mus musculus
ttcagcctagcaagttgacctcaga

SEQ ID NO: 930314 - DNA, 25 bp, Mus musculus
ttcagcctagcatgttgacctcaga

SEQ ID NO: 930315 - DNA, 25 bp, Mus musculus
ttcagcctcaggaaactttctcgaa

SEQ ID NO: 930316 - DNA, 25 bp, Mus musculus
ttcagcctcaggtaactttctcgaa

SEQ ID NO: 930317 - DNA, 25 bp, Mus musculus
ttcagcctcatgaactgcaaccgct

SEQ ID NO: 930318 - DNA, 25 bp, Mus musculus
ttcagcctcatgtactgcaaccgct

SEQ ID NO: 930319 - DNA, 25 bp, Mus musculus
ttcagcctccagaatcttagagtca

SEQ ID NO: 930320 - DNA, 25 bp, Mus musculus
ttcagcctccagattgatagccaat

SEQ ID NO: 930321 - DNA, 25 bp, Mus musculus
ttcagcctccagtatcttagagtca

SEQ ID NO: 930322 - DNA, 25 bp, Mus musculus
ttcagcctccagtttgatagccaat

SEQ ID NO: 930323 - DNA, 25 bp, Mus musculus
ttcagcctccatcggtatcatgcac

SEQ ID NO: 930324 - DNA, 25 bp, Mus musculus
ttcagcctccatgggtatcatgcac

SEQ ID NO: 930325 - DNA, 25 bp, Mus musculus
ttcagcctctagaagtccaatgcgc

SEQ ID NO: 930326 - DNA, 25 bp, Mus musculus
ttcagcctctagtagtccaatgcgc

SEQ ID NO: 930327 - DNA, 25 bp, Mus musculus
ttcagcctgactcactctagttagt

SEQ ID NO: 930328 - DNA, 25 bp, Mus musculus
ttcagcctgactctccatgaagggc

SEQ ID NO: 930329 - DNA, 25 bp, Mus musculus
ttcagcctgactgactctagttagt

SEQ ID NO: 930330 - DNA, 25 bp, Mus musculus
ttcagcctgactgtccatgaagggc

SEQ ID NO: 930331 - DNA, 25 bp, Mus musculus
ttcagcctgctgcttctctggacct

SEQ ID NO: 930332 - DNA, 25 bp, Mus musculus
ttcagcctgctggttctctggacct

SEQ ID NO: 930333 - DNA, 25 bp, Mus musculus
ttcagcctggacagactttgcccag

SEQ ID NO: 930334 - DNA, 25 bp, Mus musculus
ttcagcctggactgactttgcccag

SEQ ID NO: 930335 - DNA, 25 bp, Mus musculus
ttcagcctggccatctgtgacttct

SEQ ID NO: 930336 - DNA, 25 bp, Mus musculus
ttcagcctggccttctgtgacttct

SEQ ID NO: 930337 - DNA, 25 bp, Mus musculus
ttcagcctggttaagaagtctctta

SEQ ID NO: 930338 - DNA, 25 bp, Mus musculus
ttcagcctggtttagaagtctctta

SEQ ID NO: 930339 - DNA, 25 bp, Mus musculus
ttcagccttgaaagtcagagccata

SEQ ID NO: 930340 - DNA, 25 bp, Mus musculus
ttcagccttgaatgtcagagccata

SEQ ID NO: 930341 - DNA, 25 bp, Mus musculus
ttcagccttgatctcacttcagggc

SEQ ID NO: 930342 - DNA, 25 bp, Mus musculus
ttcagccttgatgtcacttcagggc

SEQ ID NO: 930343 - DNA, 25 bp, Mus musculus
ttcagccttgcccaaatggacttct

SEQ ID NO: 930344 - DNA, 25 bp, Mus musculus
ttcagccttgccgaaatggacttct

SEQ ID NO: 930345 - DNA, 25 bp, Mus musculus
ttcagccttgctctcttgatgggac

SEQ ID NO: 930346 - DNA, 25 bp, Mus musculus
ttcagccttgctgtcttgatgggac

SEQ ID NO: 930347 - DNA, 25 bp, Mus musculus
ttcagcctttcaatccatacagtgg

SEQ ID NO: 930348 - DNA, 25 bp, Mus musculus
ttcagcctttcactaagtcctccat

SEQ ID NO: 930349 - DNA, 25 bp, Mus musculus
ttcagcctttcagtaagtcctccat

SEQ ID NO: 930350 - DNA, 25 bp, Mus musculus
ttcagcctttcattccatacagtgg

SEQ ID NO: 930351 - DNA, 25 bp, Mus musculus
ttcagcctttttcagtggacactac

SEQ ID NO: 930352 - DNA, 25 bp, Mus musculus
ttcagcctttttgagtggacactac

SEQ ID NO: 930353 - DNA, 25 bp, Mus musculus
ttcagcgaaacaagccgtcacgagt

SEQ ID NO: 930354 - DNA, 25 bp, Mus musculus
ttcagcgaaacatgccgtcacgagt

SEQ ID NO: 930355 - DNA, 25 bp, Mus musculus
ttcagcgaccttcatccagcagcga

SEQ ID NO: 930356 - DNA, 25 bp, Mus musculus
ttcagcgaccttgatccagcagcga

SEQ ID NO: 930357 - DNA, 25 bp, Mus musculus
ttcagcgactccattcgttcctgct

SEQ ID NO: 930358 - DNA, 25 bp, Mus musculus
ttcagcgactcctttcgttcctgct

SEQ ID NO: 930359 - DNA, 25 bp, Mus musculus
ttcagcgaggagatccatccattat

SEQ ID NO: 930360 - DNA, 25 bp, Mus musculus
ttcagcgaggagttccatccattat

SEQ ID NO: 930361 - DNA, 25 bp, Mus musculus
ttcagcgatcaaaatcccaggcaag

SEQ ID NO: 930362 - DNA, 25 bp, Mus musculus
ttcagcgatcaatatcccaggcaag

SEQ ID NO: 930363 - DNA, 25 bp, Mus musculus
ttcagcgcagaactaggccaccaaa

SEQ ID NO: 930364 - DNA, 25 bp, Mus musculus
ttcagcgcagaagtaggccaccaaa

SEQ ID NO: 930365 - DNA, 25 bp, Mus musculus
ttcagcggactcagtaccgtgatgt

SEQ ID NO: 930366 - DNA, 25 bp, Mus musculus
ttcagcggactctgtaccgtgatgt

SEQ ID NO: 930367 - DNA, 25 bp, Mus musculus
ttcagcggcttcagtatctcccagt

SEQ ID NO: 930368 - DNA, 25 bp, Mus musculus
ttcagcggcttctgtatctcccagt

SEQ ID NO: 930369 - DNA, 25 bp, Mus musculus
ttcagcgggctaatagggagacact

SEQ ID NO: 930370 - DNA, 25 bp, Mus musculus
ttcagcgggctattagggagacact

SEQ ID NO: 930371 - DNA, 25 bp, Mus musculus
ttcagcggtgcgaaggccctcgaca

SEQ ID NO: 930372 - DNA, 25 bp, Mus musculus
ttcagcggtgcgtaggccctcgaca

SEQ ID NO: 930373 - DNA, 25 bp, Mus musculus
ttcagcgtcaccaaaagagccaatt

SEQ ID NO: 930374 - DNA, 25 bp, Mus musculus
ttcagcgtcacctaaagagccaatt

SEQ ID NO: 930375 - DNA, 25 bp, Mus musculus
ttcagcgtcttcatcgacgtggaga

SEQ ID NO: 930376 - DNA, 25 bp, Mus musculus
ttcagcgtcttcttcgacgtggaga

SEQ ID NO: 930377 - DNA, 25 bp, Mus musculus
ttcagcgtgacccagatgagttcga

SEQ ID NO: 930378 - DNA, 25 bp, Mus musculus
ttcagcgtgaccgagatgagttcga

SEQ ID NO: 930379 - DNA, 25 bp, Mus musculus
ttcagcgttaccaaattccttcagt

SEQ ID NO: 930380 - DNA, 25 bp, Mus musculus
ttcagcgttacctaattccttcagt

SEQ ID NO: 930381 - DNA, 25 bp, Mus musculus
ttcagcgttcacagtcatgggccag

SEQ ID NO: 930382 - DNA, 25 bp, Mus musculus
ttcagcgttcactgtcatgggccag

SEQ ID NO: 930383 - DNA, 25 bp, Mus musculus
ttcagcgttccaccaatcctaaaag

SEQ ID NO: 930384 - DNA, 25 bp, Mus musculus
ttcagcgttccagcaatcctaaaag

SEQ ID NO: 930385 - DNA, 25 bp, Mus musculus
ttcagctaaaccatggtagttgcga

SEQ ID NO: 930386 - DNA, 25 bp, Mus musculus
ttcagctaaaccttggtagttgcga

SEQ ID NO: 930387 - DNA, 25 bp, Mus musculus
ttcagctacagaagaggcacacatt

SEQ ID NO: 930388 - DNA, 25 bp, Mus musculus
ttcagctacagatgaggcacacatt

SEQ ID NO: 930389 - DNA, 25 bp, Mus musculus
ttcagctacagcctgtatggcatct

SEQ ID NO: 930390 - DNA, 25 bp, Mus musculus
ttcagctacagcgtgtatggcatct

SEQ ID NO: 930391 - DNA, 25 bp, Mus musculus
ttcagctaccgtccgcgcatgagga

SEQ ID NO: 930392 - DNA, 25 bp, Mus musculus
ttcagctaccgtgcgcgcatgagga

SEQ ID NO: 930393 - DNA, 25 bp, Mus musculus
ttcagctactgacggaagctcttcc

SEQ ID NO: 930394 - DNA, 25 bp, Mus musculus
ttcagctactgagggaagctcttcc

SEQ ID NO: 930395 - DNA, 25 bp, Mus musculus
ttcagctactggagcaagcaactgc

SEQ ID NO: 930396 - DNA, 25 bp, Mus musculus
ttcagctactggtgcaagcaactgc

SEQ ID NO: 930397 - DNA, 25 bp, Mus musculus
ttcagctagaagaatatggacctat

SEQ ID NO: 930398 - DNA, 25 bp, Mus musculus
ttcagctagaagtatatggacctat

SEQ ID NO: 930399 - DNA, 25 bp, Mus musculus
ttcagctagagacaggccatgccat

SEQ ID NO: 930400 - DNA, 25 bp, Mus musculus
ttcagctagagagaggccatgccat

SEQ ID NO: 930401 - DNA, 25 bp, Mus musculus
ttcagctagattcccagctccctgg

SEQ ID NO: 930402 - DNA, 25 bp, Mus musculus
ttcagctagattgccagctccctgg

SEQ ID NO: 930403 - DNA, 25 bp, Mus musculus
ttcagctaggctcgtaccctgcaaa

SEQ ID NO: 930404 - DNA, 25 bp, Mus musculus
ttcagctaggctggtaccctgcaaa

SEQ ID NO: 930405 - DNA, 25 bp, Mus musculus
ttcagctaggttcaactccaggtca

SEQ ID NO: 930406 - DNA, 25 bp, Mus musculus
ttcagctaggttgaactccaggtca

SEQ ID NO: 930407 - DNA, 25 bp, Mus musculus
ttcagctagtcaagtgtccaaagct

SEQ ID NO: 930408 - DNA, 25 bp, Mus musculus
ttcagctagtcatgtgtccaaagct

SEQ ID NO: 930409 - DNA, 25 bp, Mus musculus
ttcagctataagacggtgcagttgt

SEQ ID NO: 930410 - DNA, 25 bp, Mus musculus
ttcagctataagtcggtgcagttgt

SEQ ID NO: 930411 - DNA, 25 bp, Mus musculus
ttcagctatatacctctaccccaaa

SEQ ID NO: 930412 - DNA, 25 bp, Mus musculus
ttcagctatatagctctaccccaaa

SEQ ID NO: 930413 - DNA, 25 bp, Mus musculus
ttcagctatttaatccagaaacttt

SEQ ID NO: 930414 - DNA, 25 bp, Mus musculus
ttcagctatttattccagaaacttt

SEQ ID NO: 930415 - DNA, 25 bp, Mus musculus
ttcagctcacatctatcatggttcc

SEQ ID NO: 930416 - DNA, 25 bp, Mus musculus
ttcagctcacatgtatcatggttcc

SEQ ID NO: 930417 - DNA, 25 bp, Mus musculus
ttcagctcactgcttaactgaacat

SEQ ID NO: 930418 - DNA, 25 bp, Mus musculus
ttcagctcactggttaactgaacat

SEQ ID NO: 930419 - DNA, 25 bp, Mus musculus
ttcagctcagaaaggactagtgtgc

SEQ ID NO: 930420 - DNA, 25 bp, Mus musculus
ttcagctcagaatggactagtgtgc

SEQ ID NO: 930421 - DNA, 25 bp, Mus musculus
ttcagctcagctctggatacctgtg

SEQ ID NO: 930422 - DNA, 25 bp, Mus musculus
ttcagctcagctgtggatacctgtg

SEQ ID NO: 930423 - DNA, 25 bp, Mus musculus
ttcagctcatctccaataactcctg

SEQ ID NO: 930424 - DNA, 25 bp, Mus musculus
ttcagctcatctgcaataactcctg

SEQ ID NO: 930425 - DNA, 25 bp, Mus musculus
ttcagctcatggcttaggtgggcac

SEQ ID NO: 930426 - DNA, 25 bp, Mus musculus
ttcagctcatgggttaggtgggcac

SEQ ID NO: 930427 - DNA, 25 bp, Mus musculus
ttcagctcatgtccaaatttggcat

SEQ ID NO: 930428 - DNA, 25 bp, Mus musculus
ttcagctcatgtgcaaatttggcat

SEQ ID NO: 930429 - DNA, 25 bp, Mus musculus
ttcagctccaaaagtttgttcctcc

SEQ ID NO: 930430 - DNA, 25 bp, Mus musculus
ttcagctccaaatgtttgttcctcc

SEQ ID NO: 930431 - DNA, 25 bp, Mus musculus
ttcagctccaatcttccttcaaaat

SEQ ID NO: 930432 - DNA, 25 bp, Mus musculus
ttcagctccaatgttccttcaaaat

SEQ ID NO: 930433 - DNA, 25 bp, Mus musculus
ttcagctccccacaaggcaaaaggc

SEQ ID NO: 930434 - DNA, 25 bp, Mus musculus
ttcagctccccagaaggcaaaaggc

SEQ ID NO: 930435 - DNA, 25 bp, Mus musculus
ttcagctcctgaacagttgcagtca

SEQ ID NO: 930436 - DNA, 25 bp, Mus musculus
ttcagctcctgatcagttgcagtca

SEQ ID NO: 930437 - DNA, 25 bp, Mus musculus
ttcagctccttacgaggcctttagg

SEQ ID NO: 930438 - DNA, 25 bp, Mus musculus
ttcagctccttaggaggcctttagg

SEQ ID NO: 930439 - DNA, 25 bp, Mus musculus
ttcagctcgctacctggcccggaaa

SEQ ID NO: 930440 - DNA, 25 bp, Mus musculus
ttcagctcgctagctggcccggaaa

SEQ ID NO: 930441 - DNA, 25 bp, Mus musculus
ttcagctcgtacctgcagacaagtt

SEQ ID NO: 930442 - DNA, 25 bp, Mus musculus
ttcagctcgtacgtgcagacaagtt

SEQ ID NO: 930443 - DNA, 25 bp, Mus musculus
ttcagctcgtgtcgctggccagtga

SEQ ID NO: 930444 - DNA, 25 bp, Mus musculus
ttcagctcgtgtggctggccagtga

SEQ ID NO: 930445 - DNA, 25 bp, Mus musculus
ttcagctctcagcataggttcatta

SEQ ID NO: 930446 - DNA, 25 bp, Mus musculus
ttcagctctcaggataggttcatta

SEQ ID NO: 930447 - DNA, 25 bp, Mus musculus
ttcagctctctgaagctctttgtgg

SEQ ID NO: 930448 - DNA, 25 bp, Mus musculus
ttcagctctctgtagctctttgtgg

SEQ ID NO: 930449 - DNA, 25 bp, Mus musculus
ttcagctctgacaggcatgggcctc

SEQ ID NO: 930450 - DNA, 25 bp, Mus musculus
ttcagctctgactggcatgggcctc

SEQ ID NO: 930451 - DNA, 25 bp, Mus musculus
ttcagctctgggaggaaatacttca

SEQ ID NO: 930452 - DNA, 25 bp, Mus musculus
ttcagctctgggtggaaatacttca

SEQ ID NO: 930453 - DNA, 25 bp, Mus musculus
ttcagctcttccaaatttactttta

SEQ ID NO: 930454 - DNA, 25 bp, Mus musculus
ttcagctcttccactaactggctac

SEQ ID NO: 930455 - DNA, 25 bp, Mus musculus
ttcagctcttcctaatttactttta

SEQ ID NO: 930456 - DNA, 25 bp, Mus musculus
ttcagctcttcctctaactggctac

SEQ ID NO: 930457 - DNA, 25 bp, Mus musculus
ttcagctgaagaccctgcgcacgca

SEQ ID NO: 930458 - DNA, 25 bp, Mus musculus
ttcagctgaagagcctgcgcacgca

SEQ ID NO: 930459 - DNA, 25 bp, Mus musculus
ttcagctgactgatgagctcctgga

SEQ ID NO: 930460 - DNA, 25 bp, Mus musculus
ttcagctgactgcttctactctcat

SEQ ID NO: 930461 - DNA, 25 bp, Mus musculus
ttcagctgactggttctactctcat

SEQ ID NO: 930462 - DNA, 25 bp, Mus musculus
ttcagctgactgttgagctcctgga

SEQ ID NO: 930463 - DNA, 25 bp, Mus musculus
ttcagctgagatcgcaactcgggct

SEQ ID NO: 930464 - DNA, 25 bp, Mus musculus
ttcagctgagatggcaactcgggct

SEQ ID NO: 930465 - DNA, 25 bp, Mus musculus
ttcagctgcactctgaggtgttcat

SEQ ID NO: 930466 - DNA, 25 bp, Mus musculus
ttcagctgcactgtgaggtgttcat

SEQ ID NO: 930467 - DNA, 25 bp, Mus musculus
ttcagctgcatcattagcccaggaa

SEQ ID NO: 930468 - DNA, 25 bp, Mus musculus
ttcagctgcatctttagcccaggaa

SEQ ID NO: 930469 - DNA, 25 bp, Mus musculus
ttcagctgcccaagagaagtgcccc

SEQ ID NO: 930470 - DNA, 25 bp, Mus musculus
ttcagctgcccacagcatttagtat

SEQ ID NO: 930471 - DNA, 25 bp, Mus musculus
ttcagctgcccagagcatttagtat

SEQ ID NO: 930472 - DNA, 25 bp, Mus musculus
ttcagctgcccatgagaagtgcccc

SEQ ID NO: 930473 - DNA, 25 bp, Mus musculus
ttcagctgccgtagtcttctcgtga

SEQ ID NO: 930474 - DNA, 25 bp, Mus musculus
ttcagctgccgttgtcttctcgtga

SEQ ID NO: 930475 - DNA, 25 bp, Mus musculus
ttcagctgcgtcaggtctggtcagg

SEQ ID NO: 930476 - DNA, 25 bp, Mus musculus
ttcagctgcgtctggtctggtcagg

SEQ ID NO: 930477 - DNA, 25 bp, Mus musculus
ttcagctggaatcccaatgaacctt

SEQ ID NO: 930478 - DNA, 25 bp, Mus musculus
ttcagctggaatgccaatgaacctt

SEQ ID NO: 930479 - DNA, 25 bp, Mus musculus
ttcagctggaggaggcagtgcacac

SEQ ID NO: 930480 - DNA, 25 bp, Mus musculus
ttcagctggaggataccttggccca

SEQ ID NO: 930481 - DNA, 25 bp, Mus musculus
ttcagctggaggtggcagtgcacac

SEQ ID NO: 930482 - DNA, 25 bp, Mus musculus
ttcagctggaggttaccttggccca

SEQ ID NO: 930483 - DNA, 25 bp, Mus musculus
ttcagctggcagaagttttcttcat

SEQ ID NO: 930484 - DNA, 25 bp, Mus musculus
ttcagctggcagtagttttcttcat

SEQ ID NO: 930485 - DNA, 25 bp, Mus musculus
ttcagctgttctcagttgtggacaa

SEQ ID NO: 930486 - DNA, 25 bp, Mus musculus
ttcagctgttctgagttgtggacaa

SEQ ID NO: 930487 - DNA, 25 bp, Mus musculus
ttcagcttacccaatacttttacct

SEQ ID NO: 930488 - DNA, 25 bp, Mus musculus
ttcagcttaccctatacttttacct

SEQ ID NO: 930489 - DNA, 25 bp, Mus musculus
ttcagcttacctccatttctggaat

SEQ ID NO: 930490 - DNA, 25 bp, Mus musculus
ttcagcttacctgcatttctggaat

SEQ ID NO: 930491 - DNA, 25 bp, Mus musculus
ttcagcttagacacccctggaaggc

SEQ ID NO: 930492 - DNA, 25 bp, Mus musculus
ttcagcttagactcccctggaaggc

SEQ ID NO: 930493 - DNA, 25 bp, Mus musculus
ttcagcttaggccttccaaggaaca

SEQ ID NO: 930494 - DNA, 25 bp, Mus musculus
ttcagcttaggcgttccaaggaaca

SEQ ID NO: 930495 - DNA, 25 bp, Mus musculus
ttcagcttatgccagcactggtcag

SEQ ID NO: 930496 - DNA, 25 bp, Mus musculus
ttcagcttatgccaggtgacttaaa

SEQ ID NO: 930497 - DNA, 25 bp, Mus musculus
ttcagcttatgcgagcactggtcag

SEQ ID NO: 930498 - DNA, 25 bp, Mus musculus
ttcagcttatgcgaggtgacttaaa

SEQ ID NO: 930499 - DNA, 25 bp, Mus musculus
ttcagcttcacactgcaggtgcagt

SEQ ID NO: 930500 - DNA, 25 bp, Mus musculus
ttcagcttcacagtgcaggtgcagt

SEQ ID NO: 930501 - DNA, 25 bp, Mus musculus
ttcagcttcacccagcaggacatgc

SEQ ID NO: 930502 - DNA, 25 bp, Mus musculus
ttcagcttcaccgagcaggacatgc

SEQ ID NO: 930503 - DNA, 25 bp, Mus musculus
ttcagcttcacgctgatgaaaaacc

SEQ ID NO: 930504 - DNA, 25 bp, Mus musculus
ttcagcttcacggtgatgaaaaacc

SEQ ID NO: 930505 - DNA, 25 bp, Mus musculus
ttcagcttcagcactggtggtgtgg

SEQ ID NO: 930506 - DNA, 25 bp, Mus musculus
ttcagcttcagctctggtggtgtgg

SEQ ID NO: 930507 - DNA, 25 bp, Mus musculus
ttcagcttcaggacaactggagatt

SEQ ID NO: 930508 - DNA, 25 bp, Mus musculus
ttcagcttcaggtcaactggagatt

SEQ ID NO: 930509 - DNA, 25 bp, Mus musculus
ttcagcttcattccatgtaatgtag

SEQ ID NO: 930510 - DNA, 25 bp, Mus musculus
ttcagcttcattgcatgtaatgtag

SEQ ID NO: 930511 - DNA, 25 bp, Mus musculus
ttcagcttccatcttggtggtcgat

SEQ ID NO: 930512 - DNA, 25 bp, Mus musculus
ttcagcttccatgttggtggtcgat

SEQ ID NO: 930513 - DNA, 25 bp, Mus musculus
ttcagcttccctaacacgtaacaaa

SEQ ID NO: 930514 - DNA, 25 bp, Mus musculus
ttcagcttcccttacacgtaacaaa

SEQ ID NO: 930515 - DNA, 25 bp, Mus musculus
ttcagcttcctccaacaacactagg

SEQ ID NO: 930516 - DNA, 25 bp, Mus musculus
ttcagcttcctcgaacaacactagg

SEQ ID NO: 930517 - DNA, 25 bp, Mus musculus
ttcagcttcgacctgcacgacgatg

SEQ ID NO: 930518 - DNA, 25 bp, Mus musculus
ttcagcttcgacgtgcacgacgatg

SEQ ID NO: 930519 - DNA, 25 bp, Mus musculus
ttcagcttcgtcctgggtgtctttg

SEQ ID NO: 930520 - DNA, 25 bp, Mus musculus
ttcagcttcgtcgtgggtgtctttg

SEQ ID NO: 930521 - DNA, 25 bp, Mus musculus
ttcagcttctgcctttgttctttaa

SEQ ID NO: 930522 - DNA, 25 bp, Mus musculus
ttcagcttctgcgtttgttctttaa

SEQ ID NO: 930523 - DNA, 25 bp, Mus musculus
ttcagcttgacaccaatgatccttt

SEQ ID NO: 930524 - DNA, 25 bp, Mus musculus
ttcagcttgacagcaatgatccttt

SEQ ID NO: 930525 - DNA, 25 bp, Mus musculus
ttcagcttgcagataaggtcttggc

SEQ ID NO: 930526 - DNA, 25 bp, Mus musculus
ttcagcttgcagttaaggtcttggc

SEQ ID NO: 930527 - DNA, 25 bp, Mus musculus
ttcagcttgcatacctcacctgtga

SEQ ID NO: 930528 - DNA, 25 bp, Mus musculus
ttcagcttgcattcctcacctgtga

SEQ ID NO: 930529 - DNA, 25 bp, Mus musculus
ttcagcttgcttactagtctggaag

SEQ ID NO: 930530 - DNA, 25 bp, Mus musculus
ttcagcttgctttctagtctggaag

SEQ ID NO: 930531 - DNA, 25 bp, Mus musculus
ttcagcttgtacagccgagtccagg

SEQ ID NO: 930532 - DNA, 25 bp, Mus musculus
ttcagcttgtactgccgagtccagg

SEQ ID NO: 930533 - DNA, 25 bp, Mus musculus
ttcagctttaggacggttttctctc

SEQ ID NO: 930534 - DNA, 25 bp, Mus musculus
ttcagctttaggtcggttttctctc

SEQ ID NO: 930535 - DNA, 25 bp, Mus musculus
ttcagctttcttacctacactaaga

SEQ ID NO: 930536 - DNA, 25 bp, Mus musculus
ttcagctttctttcctacactaaga

SEQ ID NO: 930537 - DNA, 25 bp, Mus musculus
ttcagctttgatacggttcaccaga

SEQ ID NO: 930538 - DNA, 25 bp, Mus musculus
ttcagctttgattcggttcaccaga

SEQ ID NO: 930539 - DNA, 25 bp, Mus musculus
ttcagctttggtcaagatggatcca

SEQ ID NO: 930540 - DNA, 25 bp, Mus musculus
ttcagctttggtgaagatggatcca

SEQ ID NO: 930541 - DNA, 25 bp, Mus musculus
ttcagcttttatatctgtgaaatca

SEQ ID NO: 930542 - DNA, 25 bp, Mus musculus
ttcagcttttatttctgtgaaatca

SEQ ID NO: 930543 - DNA, 25 bp, Mus musculus
ttcaggaaaagccatccgttgtgtt

SEQ ID NO: 930544 - DNA, 25 bp, Mus musculus
ttcaggaaaagcgatccgttgtgtt

SEQ ID NO: 930545 - DNA, 25 bp, Mus musculus
ttcaggaacacacccaagacctttg

SEQ ID NO: 930546 - DNA, 25 bp, Mus musculus
ttcaggaacacagccaagacctttg

SEQ ID NO: 930547 - DNA, 25 bp, Mus musculus
ttcaggaacaggacacaggtggcta

SEQ ID NO: 930548 - DNA, 25 bp, Mus musculus
ttcaggaacaggtcacaggtggcta

SEQ ID NO: 930549 - DNA, 25 bp, Mus musculus
ttcaggaacctcacacaactacaat

SEQ ID NO: 930550 - DNA, 25 bp, Mus musculus
ttcaggaacctcaggcctggaccag

SEQ ID NO: 930551 - DNA, 25 bp, Mus musculus
ttcaggaacctctcacaactacaat

SEQ ID NO: 930552 - DNA, 25 bp, Mus musculus
ttcaggaacctctggcctggaccag

SEQ ID NO: 930553 - DNA, 25 bp, Mus musculus
ttcaggaacgtcaaacacaggatgc

SEQ ID NO: 930554 - DNA, 25 bp, Mus musculus
ttcaggaacgtctaacacaggatgc

SEQ ID NO: 930555 - DNA, 25 bp, Mus musculus
ttcaggaactggatatcagctttgc

SEQ ID NO: 930556 - DNA, 25 bp, Mus musculus
ttcaggaactggttatcagctttgc

SEQ ID NO: 930557 - DNA, 25 bp, Mus musculus
ttcaggaagagcaacccagtgccta

SEQ ID NO: 930558 - DNA, 25 bp, Mus musculus
ttcaggaagagctacccagtgccta

SEQ ID NO: 930559 - DNA, 25 bp, Mus musculus
ttcaggaagatcacaggccgaccag

SEQ ID NO: 930560 - DNA, 25 bp, Mus musculus
ttcaggaagatctcaggccgaccag

SEQ ID NO: 930561 - DNA, 25 bp, Mus musculus
ttcaggaagtctcgagagtctcccc

SEQ ID NO: 930562 - DNA, 25 bp, Mus musculus
ttcaggaagtctggagagtctcccc

SEQ ID NO: 930563 - DNA, 25 bp, Mus musculus
ttcaggaagtggatgccttcctcct

SEQ ID NO: 930564 - DNA, 25 bp, Mus musculus
ttcaggaagtggttgccttcctcct

SEQ ID NO: 930565 - DNA, 25 bp, Mus musculus
ttcaggaatggtaggtgccttgtgt

SEQ ID NO: 930566 - DNA, 25 bp, Mus musculus
ttcaggaatggttggtgccttgtgt

SEQ ID NO: 930567 - DNA, 25 bp, Mus musculus
ttcaggaattctacggcagaggaca

SEQ ID NO: 930568 - DNA, 25 bp, Mus musculus
ttcaggaattcttcggcagaggaca

SEQ ID NO: 930569 - DNA, 25 bp, Mus musculus
ttcaggacaagtacatatggccatt

SEQ ID NO: 930570 - DNA, 25 bp, Mus musculus
ttcaggacaagttcatatggccatt

SEQ ID NO: 930571 - DNA, 25 bp, Mus musculus
ttcaggacactcatcgttaagtagg

SEQ ID NO: 930572 - DNA, 25 bp, Mus musculus
ttcaggacactcttcgttaagtagg

SEQ ID NO: 930573 - DNA, 25 bp, Mus musculus
ttcaggacaggcatccctgtgggct

SEQ ID NO: 930574 - DNA, 25 bp, Mus musculus
ttcaggacaggcttccctgtgggct

SEQ ID NO: 930575 - DNA, 25 bp, Mus musculus
ttcaggacagtccataggcctcagc

SEQ ID NO: 930576 - DNA, 25 bp, Mus musculus
ttcaggacagtcgataggcctcagc

SEQ ID NO: 930577 - DNA, 25 bp, Mus musculus
ttcaggaccagcaagagaattccag

SEQ ID NO: 930578 - DNA, 25 bp, Mus musculus
ttcaggaccagctagagaattccag

SEQ ID NO: 930579 - DNA, 25 bp, Mus musculus
ttcaggaccctgagttagtgcaaag

SEQ ID NO: 930580 - DNA, 25 bp, Mus musculus
ttcaggaccctgtgttagtgcaaag

SEQ ID NO: 930581 - DNA, 25 bp, Mus musculus
ttcaggacgaggaagatagctccaa

SEQ ID NO: 930582 - DNA, 25 bp, Mus musculus
ttcaggacgaggtagatagctccaa

SEQ ID NO: 930583 - DNA, 25 bp, Mus musculus
ttcaggactaaaatcatccaaggga

SEQ ID NO: 930584 - DNA, 25 bp, Mus musculus
ttcaggactaaattcatccaaggga

SEQ ID NO: 930585 - DNA, 25 bp, Mus musculus
ttcaggactctgacttccagcagct

SEQ ID NO: 930586 - DNA, 25 bp, Mus musculus
ttcaggactctgattagaacacaag

SEQ ID NO: 930587 - DNA, 25 bp, Mus musculus
ttcaggactctgcatctaggcattt

SEQ ID NO: 930588 - DNA, 25 bp, Mus musculus
ttcaggactctggatctaggcattt

SEQ ID NO: 930589 - DNA, 25 bp, Mus musculus
ttcaggactctgtcttccagcagct

SEQ ID NO: 930590 - DNA, 25 bp, Mus musculus
ttcaggactctgtttagaacacaag

SEQ ID NO: 930591 - DNA, 25 bp, Mus musculus
ttcaggactgtgcattttcaggttt

SEQ ID NO: 930592 - DNA, 25 bp, Mus musculus
ttcaggactgtggattttcaggttt

SEQ ID NO: 930593 - DNA, 25 bp, Mus musculus
ttcaggacttccatctaagcagctg

SEQ ID NO: 930594 - DNA, 25 bp, Mus musculus
ttcaggacttccttctaagcagctg

SEQ ID NO: 930595 - DNA, 25 bp, Mus musculus
ttcaggagaagccagggctatgcaa

SEQ ID NO: 930596 - DNA, 25 bp, Mus musculus
ttcaggagaagcgagggctatgcaa

SEQ ID NO: 930597 - DNA, 25 bp, Mus musculus
ttcaggagagggatgtcacctgagt

SEQ ID NO: 930598 - DNA, 25 bp, Mus musculus
ttcaggagagggttgtcacctgagt

SEQ ID NO: 930599 - DNA, 25 bp, Mus musculus
ttcaggagcctgctctaaaatcagg

SEQ ID NO: 930600 - DNA, 25 bp, Mus musculus
ttcaggagcctggtctaaaatcagg

SEQ ID NO: 930601 - DNA, 25 bp, Mus musculus
ttcaggagcttgaaccagacagtgt

SEQ ID NO: 930602 - DNA, 25 bp, Mus musculus
ttcaggagcttgtaccagacagtgt

SEQ ID NO: 930603 - DNA, 25 bp, Mus musculus
ttcaggagggcgctggacccacacc

SEQ ID NO: 930604 - DNA, 25 bp, Mus musculus
ttcaggagggcggtggacccacacc

SEQ ID NO: 930605 - DNA, 25 bp, Mus musculus
ttcaggagtcacatccctcatttta

SEQ ID NO: 930606 - DNA, 25 bp, Mus musculus
ttcaggagtcacttccctcatttta

SEQ ID NO: 930607 - DNA, 25 bp, Mus musculus
ttcaggagtgatcttcatgagaaca

SEQ ID NO: 930608 - DNA, 25 bp, Mus musculus
ttcaggagtgatgttcatgagaaca

SEQ ID NO: 930609 - DNA, 25 bp, Mus musculus
ttcaggagtgttattggacccaata

SEQ ID NO: 930610 - DNA, 25 bp, Mus musculus
ttcaggagtgtttttggacccaata

SEQ ID NO: 930611 - DNA, 25 bp, Mus musculus
ttcaggagttgaagggcagcgttta

SEQ ID NO: 930612 - DNA, 25 bp, Mus musculus
ttcaggagttgatgggcagcgttta

SEQ ID NO: 930613 - DNA, 25 bp, Mus musculus
ttcaggataagcaccccgcaagcgt

SEQ ID NO: 930614 - DNA, 25 bp, Mus musculus
ttcaggataagctccccgcaagcgt

SEQ ID NO: 930615 - DNA, 25 bp, Mus musculus
ttcaggatactacaggtgagtcatc

SEQ ID NO: 930616 - DNA, 25 bp, Mus musculus
ttcaggatactagaggtgagtcatc

SEQ ID NO: 930617 - DNA, 25 bp, Mus musculus
ttcaggatactgacattccctttga

SEQ ID NO: 930618 - DNA, 25 bp, Mus musculus
ttcaggatactgactcccttcacag

SEQ ID NO: 930619 - DNA, 25 bp, Mus musculus
ttcaggatactgtcattccctttga

SEQ ID NO: 930620 - DNA, 25 bp, Mus musculus
ttcaggatactgtctcccttcacag

SEQ ID NO: 930621 - DNA, 25 bp, Mus musculus
ttcaggatattcaacgttttctcat

SEQ ID NO: 930622 - DNA, 25 bp, Mus musculus
ttcaggatattctacgttttctcat

SEQ ID NO: 930623 - DNA, 25 bp, Mus musculus
ttcaggatcaacatggtctcctcac

SEQ ID NO: 930624 - DNA, 25 bp, Mus musculus
ttcaggatcaacttggtctcctcac

SEQ ID NO: 930625 - DNA, 25 bp, Mus musculus
ttcaggatcaagagtgtagtcattc

SEQ ID NO: 930626 - DNA, 25 bp, Mus musculus
ttcaggatcaagtgtgtagtcattc

SEQ ID NO: 930627 - DNA, 25 bp, Mus musculus
ttcaggatccataactcggtgccca

SEQ ID NO: 930628 - DNA, 25 bp, Mus musculus
ttcaggatccattactcggtgccca

SEQ ID NO: 930629 - DNA, 25 bp, Mus musculus
ttcaggatccctagactcttgatgc

SEQ ID NO: 930630 - DNA, 25 bp, Mus musculus
ttcaggatcccttgactcttgatgc

SEQ ID NO: 930631 - DNA, 25 bp, Mus musculus
ttcaggatcgaaccataaaggtttt

SEQ ID NO: 930632 - DNA, 25 bp, Mus musculus
ttcaggatcgaagcataaaggtttt

SEQ ID NO: 930633 - DNA, 25 bp, Mus musculus
ttcaggatgcctccgcctggtgacg

SEQ ID NO: 930634 - DNA, 25 bp, Mus musculus
ttcaggatgcctgcgcctggtgacg

SEQ ID NO: 930635 - DNA, 25 bp, Mus musculus
ttcaggatggacctagtgagatgca

SEQ ID NO: 930636 - DNA, 25 bp, Mus musculus
ttcaggatggacgtagtgagatgca

SEQ ID NO: 930637 - DNA, 25 bp, Mus musculus
ttcaggatggcccaacccaggtggt

SEQ ID NO: 930638 - DNA, 25 bp, Mus musculus
ttcaggatggccgaacccaggtggt

SEQ ID NO: 930639 - DNA, 25 bp, Mus musculus
ttcaggattccgatttagtgaaagt

SEQ ID NO: 930640 - DNA, 25 bp, Mus musculus
ttcaggattccgttttagtgaaagt

SEQ ID NO: 930641 - DNA, 25 bp, Mus musculus
ttcaggattgctccctacacaaatg

SEQ ID NO: 930642 - DNA, 25 bp, Mus musculus
ttcaggattgctgcctacacaaatg

SEQ ID NO: 930643 - DNA, 25 bp, Mus musculus
ttcaggattggacaccatgtcaggg

SEQ ID NO: 930644 - DNA, 25 bp, Mus musculus
ttcaggattggagaccatgtcaggg

SEQ ID NO: 930645 - DNA, 25 bp, Mus musculus
ttcaggatttgaagtccgccatcaa

SEQ ID NO: 930646 - DNA, 25 bp, Mus musculus
ttcaggatttgatgtccgccatcaa

SEQ ID NO: 930647 - DNA, 25 bp, Mus musculus
ttcaggcaatttctaaacagggatg

SEQ ID NO: 930648 - DNA, 25 bp, Mus musculus
ttcaggcaatttgtaaacagggatg

SEQ ID NO: 930649 - DNA, 25 bp, Mus musculus
ttcaggcaccaacgaagaccctaat

SEQ ID NO: 930650 - DNA, 25 bp, Mus musculus
ttcaggcaccaaggaagaccctaat

SEQ ID NO: 930651 - DNA, 25 bp, Mus musculus
ttcaggcaccggatgatgcacagct

SEQ ID NO: 930652 - DNA, 25 bp, Mus musculus
ttcaggcaccggttgatgcacagct

SEQ ID NO: 930653 - DNA, 25 bp, Mus musculus
ttcaggcacctgaggacattgcgca

SEQ ID NO: 930654 - DNA, 25 bp, Mus musculus
ttcaggcacctgtggacattgcgca

SEQ ID NO: 930655 - DNA, 25 bp, Mus musculus
ttcaggcactgtctgatccctagga

SEQ ID NO: 930656 - DNA, 25 bp, Mus musculus
ttcaggcactgtgtgatccctagga

SEQ ID NO: 930657 - DNA, 25 bp, Mus musculus
ttcaggcagatcacgtcttgaacga

SEQ ID NO: 930658 - DNA, 25 bp, Mus musculus
ttcaggcagatctcgtcttgaacga

SEQ ID NO: 930659 - DNA, 25 bp, Mus musculus
ttcaggcagcctcttttatcagaaa

SEQ ID NO: 930660 - DNA, 25 bp, Mus musculus
ttcaggcagcctgttttatcagaaa

SEQ ID NO: 930661 - DNA, 25 bp, Mus musculus
ttcaggcataccactttccctgcta

SEQ ID NO: 930662 - DNA, 25 bp, Mus musculus
ttcaggcatacctctttccctgcta

SEQ ID NO: 930663 - DNA, 25 bp, Mus musculus
ttcaggcatccactctgggtctcaa

SEQ ID NO: 930664 - DNA, 25 bp, Mus musculus
ttcaggcatccagtctgggtctcaa

SEQ ID NO: 930665 - DNA, 25 bp, Mus musculus
ttcaggcatggaattttcaaaacat

SEQ ID NO: 930666 - DNA, 25 bp, Mus musculus
ttcaggcatggatttttcaaaacat

SEQ ID NO: 930667 - DNA, 25 bp, Mus musculus
ttcaggcatggcacaaggacataca

SEQ ID NO: 930668 - DNA, 25 bp, Mus musculus
ttcaggcatggctcaaggacataca

SEQ ID NO: 930669 - DNA, 25 bp, Mus musculus
ttcaggcatttcaccaagattgatg

SEQ ID NO: 930670 - DNA, 25 bp, Mus musculus
ttcaggcatttctccaagattgatg

SEQ ID NO: 930671 - DNA, 25 bp, Mus musculus
ttcaggccaagtagaaccccagagc

SEQ ID NO: 930672 - DNA, 25 bp, Mus musculus
ttcaggccaagttgaaccccagagc

SEQ ID NO: 930673 - DNA, 25 bp, Mus musculus
ttcaggccaattcatggattggcat

SEQ ID NO: 930674 - DNA, 25 bp, Mus musculus
ttcaggccaattgatggattggcat

SEQ ID NO: 930675 - DNA, 25 bp, Mus musculus
ttcaggccacgtacccctcaataat

SEQ ID NO: 930676 - DNA, 25 bp, Mus musculus
ttcaggccacgttcccctcaataat

SEQ ID NO: 930677 - DNA, 25 bp, Mus musculus
ttcaggccactgctgactctgagtg

SEQ ID NO: 930678 - DNA, 25 bp, Mus musculus
ttcaggccactggtgactctgagtg

SEQ ID NO: 930679 - DNA, 25 bp, Mus musculus
ttcaggccacttcatgctattccaa

SEQ ID NO: 930680 - DNA, 25 bp, Mus musculus
ttcaggccacttgatgctattccaa

SEQ ID NO: 930681 - DNA, 25 bp, Mus musculus
ttcaggccagaacgtttggaccagt

SEQ ID NO: 930682 - DNA, 25 bp, Mus musculus
ttcaggccagaaggtttggaccagt

SEQ ID NO: 930683 - DNA, 25 bp, Mus musculus
ttcaggccagccaatagtaatacat

SEQ ID NO: 930684 - DNA, 25 bp, Mus musculus
ttcaggccagcctatagtaatacat

SEQ ID NO: 930685 - DNA, 25 bp, Mus musculus
ttcaggccaggaatagtacagagct

SEQ ID NO: 930686 - DNA, 25 bp, Mus musculus
ttcaggccaggacgaccgagggctt

SEQ ID NO: 930687 - DNA, 25 bp, Mus musculus
ttcaggccaggaggaccgagggctt

SEQ ID NO: 930688 - DNA, 25 bp, Mus musculus
ttcaggccaggattagtacagagct

SEQ ID NO: 930689 - DNA, 25 bp, Mus musculus
ttcaggcccagtccacgcagaggaa

SEQ ID NO: 930690 - DNA, 25 bp, Mus musculus
ttcaggcccagtgcacgcagaggaa

SEQ ID NO: 930691 - DNA, 25 bp, Mus musculus
ttcaggccctaaaacctatgccagg

SEQ ID NO: 930692 - DNA, 25 bp, Mus musculus
ttcaggccctaatacctatgccagg

SEQ ID NO: 930693 - DNA, 25 bp, Mus musculus
ttcaggccctggcaacaggccttta

SEQ ID NO: 930694 - DNA, 25 bp, Mus musculus
ttcaggccctgggaacaggccttta

SEQ ID NO: 930695 - DNA, 25 bp, Mus musculus
ttcaggcctgaacccagcatctgag

SEQ ID NO: 930696 - DNA, 25 bp, Mus musculus
ttcaggcctgaagccagcatctgag

SEQ ID NO: 930697 - DNA, 25 bp, Mus musculus
ttcaggcctgctatccaagctctct

SEQ ID NO: 930698 - DNA, 25 bp, Mus musculus
ttcaggcctgctttccaagctctct

SEQ ID NO: 930699 - DNA, 25 bp, Mus musculus
ttcaggcctggacagcagcaaggtt

SEQ ID NO: 930700 - DNA, 25 bp, Mus musculus
ttcaggcctggagagcagcaaggtt

SEQ ID NO: 930701 - DNA, 25 bp, Mus musculus
ttcaggcctggtccgagtttacgaa

SEQ ID NO: 930702 - DNA, 25 bp, Mus musculus
ttcaggcctggtgcgagtttacgaa

SEQ ID NO: 930703 - DNA, 25 bp, Mus musculus
ttcaggcctgtacttaggctaggtt

SEQ ID NO: 930704 - DNA, 25 bp, Mus musculus
ttcaggcctgtagttaggctaggtt

SEQ ID NO: 930705 - DNA, 25 bp, Mus musculus
ttcaggcgaaacagcgatctgcggc

SEQ ID NO: 930706 - DNA, 25 bp, Mus musculus
ttcaggcgaaactgcgatctgcggc

SEQ ID NO: 930707 - DNA, 25 bp, Mus musculus
ttcaggcgagaacagctactgctct

SEQ ID NO: 930708 - DNA, 25 bp, Mus musculus
ttcaggcgagaagagctactgctct

SEQ ID NO: 930709 - DNA, 25 bp, Mus musculus
ttcaggcgagctcattctttgtgat

SEQ ID NO: 930710 - DNA, 25 bp, Mus musculus
ttcaggcgagctgattctttgtgat

SEQ ID NO: 930711 - DNA, 25 bp, Mus musculus
ttcaggcgggcaacccgaaggagtt

SEQ ID NO: 930712 - DNA, 25 bp, Mus musculus
ttcaggcgggcatcccgaaggagtt

SEQ ID NO: 930713 - DNA, 25 bp, Mus musculus
ttcaggctactcagaacctttaccg

SEQ ID NO: 930714 - DNA, 25 bp, Mus musculus
ttcaggctactctgaacctttaccg

SEQ ID NO: 930715 - DNA, 25 bp, Mus musculus
ttcaggctagttagaactacgcagt

SEQ ID NO: 930716 - DNA, 25 bp, Mus musculus
ttcaggctagttagtgcaggaccat

SEQ ID NO: 930717 - DNA, 25 bp, Mus musculus
ttcaggctagtttgaactacgcagt

SEQ ID NO: 930718 - DNA, 25 bp, Mus musculus
ttcaggctagtttgtgcaggaccat

SEQ ID NO: 930719 - DNA, 25 bp, Mus musculus
ttcaggctatacacgcatcaagctg

SEQ ID NO: 930720 - DNA, 25 bp, Mus musculus
ttcaggctatactcgcatcaagctg

SEQ ID NO: 930721 - DNA, 25 bp, Mus musculus
ttcaggctccagcttgttgctgtgt

SEQ ID NO: 930722 - DNA, 25 bp, Mus musculus
ttcaggctccaggttgttgctgtgt

SEQ ID NO: 930723 - DNA, 25 bp, Mus musculus
ttcaggctctagaaggttccaatta

SEQ ID NO: 930724 - DNA, 25 bp, Mus musculus
ttcaggctctagtaggttccaatta

SEQ ID NO: 930725 - DNA, 25 bp, Mus musculus
ttcaggctctgcactagagaattgt

SEQ ID NO: 930726 - DNA, 25 bp, Mus musculus
ttcaggctctgctctagagaattgt

SEQ ID NO: 930727 - DNA, 25 bp, Mus musculus
ttcaggctgaagctccgccagtatg

SEQ ID NO: 930728 - DNA, 25 bp, Mus musculus
ttcaggctgaaggtccgccagtatg

SEQ ID NO: 930729 - DNA, 25 bp, Mus musculus
ttcaggctgccaaactctaccatga

SEQ ID NO: 930730 - DNA, 25 bp, Mus musculus
ttcaggctgccatactctaccatga

SEQ ID NO: 930731 - DNA, 25 bp, Mus musculus
ttcaggctgcctatgagcaggagtt

SEQ ID NO: 930732 - DNA, 25 bp, Mus musculus
ttcaggctgcctttgagcaggagtt

SEQ ID NO: 930733 - DNA, 25 bp, Mus musculus
ttcaggctggcacatggctgcagat

SEQ ID NO: 930734 - DNA, 25 bp, Mus musculus
ttcaggctggcagatggctgcagat

SEQ ID NO: 930735 - DNA, 25 bp, Mus musculus
ttcaggctggccacttaattcaaac

SEQ ID NO: 930736 - DNA, 25 bp, Mus musculus
ttcaggctggcctcttaattcaaac

SEQ ID NO: 930737 - DNA, 25 bp, Mus musculus
ttcaggctgggtctgaggcatcaac

SEQ ID NO: 930738 - DNA, 25 bp, Mus musculus
ttcaggctgggtgtgaggcatcaac

SEQ ID NO: 930739 - DNA, 25 bp, Mus musculus
ttcaggctgtcacagtccccaggga

SEQ ID NO: 930740 - DNA, 25 bp, Mus musculus
ttcaggctgtcagagtccccaggga

SEQ ID NO: 930741 - DNA, 25 bp, Mus musculus
ttcaggctgtggattgctcttaaca

SEQ ID NO: 930742 - DNA, 25 bp, Mus musculus
ttcaggctgtggtttgctcttaaca

SEQ ID NO: 930743 - DNA, 25 bp, Mus musculus
ttcagggaacttcaagcactgtttg

SEQ ID NO: 930744 - DNA, 25 bp, Mus musculus
ttcagggaacttgaagcactgtttg

SEQ ID NO: 930745 - DNA, 25 bp, Mus musculus
ttcagggaccgtacaccttgaccgt

SEQ ID NO: 930746 - DNA, 25 bp, Mus musculus
ttcagggaccgttcaccttgaccgt

SEQ ID NO: 930747 - DNA, 25 bp, Mus musculus
ttcagggacctgattctatcctgcc

SEQ ID NO: 930748 - DNA, 25 bp, Mus musculus
ttcagggacctgtttctatcctgcc

SEQ ID NO: 930749 - DNA, 25 bp, Mus musculus
ttcagggagtctcggcactgcacta

SEQ ID NO: 930750 - DNA, 25 bp, Mus musculus
ttcagggagtctgggcactgcacta

SEQ ID NO: 930751 - DNA, 25 bp, Mus musculus
ttcagggcataaagttttccaagga

SEQ ID NO: 930752 - DNA, 25 bp, Mus musculus
ttcagggcataatgttttccaagga

SEQ ID NO: 930753 - DNA, 25 bp, Mus musculus
ttcagggcatagatgttcaccacgc

SEQ ID NO: 930754 - DNA, 25 bp, Mus musculus
ttcagggcatagttgttcaccacgc

SEQ ID NO: 930755 - DNA, 25 bp, Mus musculus
ttcagggcccataccaaaaataaag

SEQ ID NO: 930756 - DNA, 25 bp, Mus musculus
ttcagggcccattccaaaaataaag

SEQ ID NO: 930757 - DNA, 25 bp, Mus musculus
ttcagggcccgtagctgctgggcaa

SEQ ID NO: 930758 - DNA, 25 bp, Mus musculus
ttcagggcccgttgctgctgggcaa

SEQ ID NO: 930759 - DNA, 25 bp, Mus musculus
ttcagggccctcctttgccagcaaa

SEQ ID NO: 930760 - DNA, 25 bp, Mus musculus
ttcagggccctcgtttgccagcaaa

SEQ ID NO: 930761 - DNA, 25 bp, Mus musculus
ttcagggcctgtccacattagtgga

SEQ ID NO: 930762 - DNA, 25 bp, Mus musculus
ttcagggcctgtgcacattagtgga

SEQ ID NO: 930763 - DNA, 25 bp, Mus musculus
ttcagggcggccacacagtgcgagt

SEQ ID NO: 930764 - DNA, 25 bp, Mus musculus
ttcagggcggcctcacagtgcgagt

SEQ ID NO: 930765 - DNA, 25 bp, Mus musculus
ttcagggctaatacaaaccccattt

SEQ ID NO: 930766 - DNA, 25 bp, Mus musculus
ttcagggctaattcaaaccccattt

SEQ ID NO: 930767 - DNA, 25 bp, Mus musculus
ttcagggcttgaccgtgatgacccc

SEQ ID NO: 930768 - DNA, 25 bp, Mus musculus
ttcagggcttgagcgtgatgacccc

SEQ ID NO: 930769 - DNA, 25 bp, Mus musculus
ttcagggtacaactcagttccagga

SEQ ID NO: 930770 - DNA, 25 bp, Mus musculus
ttcagggtacaagtcagttccagga

SEQ ID NO: 930771 - DNA, 25 bp, Mus musculus
ttcagggtagctaatgcctcagggt

SEQ ID NO: 930772 - DNA, 25 bp, Mus musculus
ttcagggtagcttatgcctcagggt

SEQ ID NO: 930773 - DNA, 25 bp, Mus musculus
ttcagggtaggaagccaggtcctct

SEQ ID NO: 930774 - DNA, 25 bp, Mus musculus
ttcagggtaggatgccaggtcctct

SEQ ID NO: 930775 - DNA, 25 bp, Mus musculus
ttcagggtcaatatagtgccacttt

SEQ ID NO: 930776 - DNA, 25 bp, Mus musculus
ttcagggtcaatttagtgccacttt

SEQ ID NO: 930777 - DNA, 25 bp, Mus musculus
ttcagggtcatcagagaaggctccc

SEQ ID NO: 930778 - DNA, 25 bp, Mus musculus
ttcagggtcatctgagaaggctccc

SEQ ID NO: 930779 - DNA, 25 bp, Mus musculus
ttcagggtccccaaggagatagagc

SEQ ID NO: 930780 - DNA, 25 bp, Mus musculus
ttcagggtcccctaggagatagagc

SEQ ID NO: 930781 - DNA, 25 bp, Mus musculus
ttcagggtcctacttgggagagcat

SEQ ID NO: 930782 - DNA, 25 bp, Mus musculus
ttcagggtcctagttgggagagcat

SEQ ID NO: 930783 - DNA, 25 bp, Mus musculus
ttcagggtcgccactgtgagcaaag

SEQ ID NO: 930784 - DNA, 25 bp, Mus musculus
ttcagggtcgcctctgtgagcaaag

SEQ ID NO: 930785 - DNA, 25 bp, Mus musculus
ttcagggtctccaggcttgtttttg

SEQ ID NO: 930786 - DNA, 25 bp, Mus musculus
ttcagggtctcctggcttgtttttg

SEQ ID NO: 930787 - DNA, 25 bp, Mus musculus
ttcagggtctggacatggagctttt

SEQ ID NO: 930788 - DNA, 25 bp, Mus musculus
ttcagggtctggtcatggagctttt

SEQ ID NO: 930789 - DNA, 25 bp, Mus musculus
ttcagggtcttcaatggtcaggttc

SEQ ID NO: 930790 - DNA, 25 bp, Mus musculus
ttcagggtcttctatggtcaggttc

SEQ ID NO: 930791 - DNA, 25 bp, Mus musculus
ttcagggtggctaagacactgtctt

SEQ ID NO: 930792 - DNA, 25 bp, Mus musculus
ttcagggtggcttagacactgtctt

SEQ ID NO: 930793 - DNA, 25 bp, Mus musculus
ttcagggtgggaagataggactcac

SEQ ID NO: 930794 - DNA, 25 bp, Mus musculus
ttcagggtgggatgataggactcac

SEQ ID NO: 930795 - DNA, 25 bp, Mus musculus
ttcagggtggttcgattctggccat

SEQ ID NO: 930796 - DNA, 25 bp, Mus musculus
ttcagggtggttggattctggccat

SEQ ID NO: 930797 - DNA, 25 bp, Mus musculus
ttcagggttcgtacgggtgctagca

SEQ ID NO: 930798 - DNA, 25 bp, Mus musculus
ttcagggttcgttcgggtgctagca

SEQ ID NO: 930799 - DNA, 25 bp, Mus musculus
ttcagggttgccagggatctaactt

SEQ ID NO: 930800 - DNA, 25 bp, Mus musculus
ttcagggttgcccagaatgtaaact

SEQ ID NO: 930801 - DNA, 25 bp, Mus musculus
ttcagggttgccgagaatgtaaact

SEQ ID NO: 930802 - DNA, 25 bp, Mus musculus
ttcagggttgcctgggatctaactt

SEQ ID NO: 930803 - DNA, 25 bp, Mus musculus
ttcagggttgctcccattgaattga

SEQ ID NO: 930804 - DNA, 25 bp, Mus musculus
ttcagggttgctgccattgaattga

SEQ ID NO: 930805 - DNA, 25 bp, Mus musculus
ttcagggttgttcaaagcacattca

SEQ ID NO: 930806 - DNA, 25 bp, Mus musculus
ttcagggttgttgaaagcacattca

SEQ ID NO: 930807 - DNA, 25 bp, Mus musculus
ttcagggtttctcgtttgcaccttt

SEQ ID NO: 930808 - DNA, 25 bp, Mus musculus
ttcagggtttctggtttgcaccttt

SEQ ID NO: 930809 - DNA, 25 bp, Mus musculus
ttcaggtacaagctgttattgtcaa

SEQ ID NO: 930810 - DNA, 25 bp, Mus musculus
ttcaggtacaaggtgttattgtcaa

SEQ ID NO: 930811 - DNA, 25 bp, Mus musculus
ttcaggtagaacagggcagggccca

SEQ ID NO: 930812 - DNA, 25 bp, Mus musculus
ttcaggtagaactgggcagggccca

SEQ ID NO: 930813 - DNA, 25 bp, Mus musculus
ttcaggtagcaacgccagagacccc

SEQ ID NO: 930814 - DNA, 25 bp, Mus musculus
ttcaggtagcaaggccagagacccc

SEQ ID NO: 930815 - DNA, 25 bp, Mus musculus
ttcaggtagccacccgggagcagct

SEQ ID NO: 930816 - DNA, 25 bp, Mus musculus
ttcaggtagccagccgggagcagct

SEQ ID NO: 930817 - DNA, 25 bp, Mus musculus
ttcaggtagtctagcagctggcggt

SEQ ID NO: 930818 - DNA, 25 bp, Mus musculus
ttcaggtagtcttgcagctggcggt

SEQ ID NO: 930819 - DNA, 25 bp, Mus musculus
ttcaggtcactcagcctacagttgg

SEQ ID NO: 930820 - DNA, 25 bp, Mus musculus
ttcaggtcactctgcctacagttgg

SEQ ID NO: 930821 - DNA, 25 bp, Mus musculus
ttcaggtcagccatggatactggtc

SEQ ID NO: 930822 - DNA, 25 bp, Mus musculus
ttcaggtcagccttggatactggtc

SEQ ID NO: 930823 - DNA, 25 bp, Mus musculus
ttcaggtcatggcacttggctacag

SEQ ID NO: 930824 - DNA, 25 bp, Mus musculus
ttcaggtcatggctaaccaccagga

SEQ ID NO: 930825 - DNA, 25 bp, Mus musculus
ttcaggtcatgggacttggctacag

SEQ ID NO: 930826 - DNA, 25 bp, Mus musculus
ttcaggtcatgggtaaccaccagga

SEQ ID NO: 930827 - DNA, 25 bp, Mus musculus
ttcaggtccctcattgactggctgt

SEQ ID NO: 930828 - DNA, 25 bp, Mus musculus
ttcaggtccctctttgactggctgt

SEQ ID NO: 930829 - DNA, 25 bp, Mus musculus
ttcaggtcctctcctgtgggatggt

SEQ ID NO: 930830 - DNA, 25 bp, Mus musculus
ttcaggtcctctgctgtgggatggt

SEQ ID NO: 930831 - DNA, 25 bp, Mus musculus
ttcaggtcctggcaaccgcagacat

SEQ ID NO: 930832 - DNA, 25 bp, Mus musculus
ttcaggtcctgggaaccgcagacat

SEQ ID NO: 930833 - DNA, 25 bp, Mus musculus
ttcaggtctgaaagctagcgtgtca

SEQ ID NO: 930834 - DNA, 25 bp, Mus musculus
ttcaggtctgaacagctgctctagt

SEQ ID NO: 930835 - DNA, 25 bp, Mus musculus
ttcaggtctgaagagctgctctagt

SEQ ID NO: 930836 - DNA, 25 bp, Mus musculus
ttcaggtctgaatgctagcgtgtca

SEQ ID NO: 930837 - DNA, 25 bp, Mus musculus
ttcaggtgaaacctctcttcttctc

SEQ ID NO: 930838 - DNA, 25 bp, Mus musculus
ttcaggtgaaacgtctcttcttctc

SEQ ID NO: 930839 - DNA, 25 bp, Mus musculus
ttcaggtgctatcgctcgaacccag

SEQ ID NO: 930840 - DNA, 25 bp, Mus musculus
ttcaggtgctatggctcgaacccag

SEQ ID NO: 930841 - DNA, 25 bp, Mus musculus
ttcaggtggcctcatgggacatgtt

SEQ ID NO: 930842 - DNA, 25 bp, Mus musculus
ttcaggtggcctgatgggacatgtt

SEQ ID NO: 930843 - DNA, 25 bp, Mus musculus
ttcaggtgtggcctccaggagccaa

SEQ ID NO: 930844 - DNA, 25 bp, Mus musculus
ttcaggtgtggcgtccaggagccaa

SEQ ID NO: 930845 - DNA, 25 bp, Mus musculus
ttcaggttaatccttccagtctaag

SEQ ID NO: 930846 - DNA, 25 bp, Mus musculus
ttcaggttaatcgttccagtctaag

SEQ ID NO: 930847 - DNA, 25 bp, Mus musculus
ttcaggttagcaaacactttagtgt

SEQ ID NO: 930848 - DNA, 25 bp, Mus musculus
ttcaggttagcatacactttagtgt

SEQ ID NO: 930849 - DNA, 25 bp, Mus musculus
ttcaggttaggaaatgttgtgctct

SEQ ID NO: 930850 - DNA, 25 bp, Mus musculus
ttcaggttaggatatgttgtgctct

SEQ ID NO: 930851 - DNA, 25 bp, Mus musculus
ttcaggttcatgatagcactgttga

SEQ ID NO: 930852 - DNA, 25 bp, Mus musculus
ttcaggttcatgttagcactgttga

SEQ ID NO: 930853 - DNA, 25 bp, Mus musculus
ttcaggttcctgattcaagtgtcac

SEQ ID NO: 930854 - DNA, 25 bp, Mus musculus
ttcaggttcctgattcataagcccc

SEQ ID NO: 930855 - DNA, 25 bp, Mus musculus
ttcaggttcctgtttcaagtgtcac

SEQ ID NO: 930856 - DNA, 25 bp, Mus musculus
ttcaggttcctgtttcataagcccc

SEQ ID NO: 930857 - DNA, 25 bp, Mus musculus
ttcaggttccttacactatgtgttt

SEQ ID NO: 930858 - DNA, 25 bp, Mus musculus
ttcaggttcctttcactatgtgttt

SEQ ID NO: 930859 - DNA, 25 bp, Mus musculus
ttcaggttcggaacactacttcaga

SEQ ID NO: 930860 - DNA, 25 bp, Mus musculus
ttcaggttcggatcactacttcaga

SEQ ID NO: 930861 - DNA, 25 bp, Mus musculus
ttcaggttcggcacaggactccttt

SEQ ID NO: 930862 - DNA, 25 bp, Mus musculus
ttcaggttcggctcaggactccttt

SEQ ID NO: 930863 - DNA, 25 bp, Mus musculus
ttcaggttctgtattgcatgttttc

SEQ ID NO: 930864 - DNA, 25 bp, Mus musculus
ttcaggttctgttttgcatgttttc

SEQ ID NO: 930865 - DNA, 25 bp, Mus musculus
ttcaggttgactcttcatccttaac

SEQ ID NO: 930866 - DNA, 25 bp, Mus musculus
ttcaggttgactgttcatccttaac

SEQ ID NO: 930867 - DNA, 25 bp, Mus musculus
ttcaggttgccaagtctcactcttt

SEQ ID NO: 930868 - DNA, 25 bp, Mus musculus
ttcaggttgccatgtctcactcttt

SEQ ID NO: 930869 - DNA, 25 bp, Mus musculus
ttcaggtttccaagggctgagccta

SEQ ID NO: 930870 - DNA, 25 bp, Mus musculus
ttcaggtttccatgggctgagccta

SEQ ID NO: 930871 - DNA, 25 bp, Mus musculus
ttcaggttttcaacagagtttgcaa

SEQ ID NO: 930872 - DNA, 25 bp, Mus musculus
ttcaggttttcatcagagtttgcaa

SEQ ID NO: 930873 - DNA, 25 bp, Mus musculus
ttcagtaactcgctaacattattga

SEQ ID NO: 930874 - DNA, 25 bp, Mus musculus
ttcagtaactcggtaacattattga

SEQ ID NO: 930875 - DNA, 25 bp, Mus musculus
ttcagtaagcttcactgtttgactt

SEQ ID NO: 930876 - DNA, 25 bp, Mus musculus
ttcagtaagcttgactgtttgactt

SEQ ID NO: 930877 - DNA, 25 bp, Mus musculus
ttcagtaaggccctacccattcatt

SEQ ID NO: 930878 - DNA, 25 bp, Mus musculus
ttcagtaaggccgtacccattcatt

SEQ ID NO: 930879 - DNA, 25 bp, Mus musculus
ttcagtaagtgacgcccaccagcat

SEQ ID NO: 930880 - DNA, 25 bp, Mus musculus
ttcagtaagtgaggcccaccagcat

SEQ ID NO: 930881 - DNA, 25 bp, Mus musculus
ttcagtaagtttacaggacatggac

SEQ ID NO: 930882 - DNA, 25 bp, Mus musculus
ttcagtaagttttcaggacatggac

SEQ ID NO: 930883 - DNA, 25 bp, Mus musculus
ttcagtaataacatgggctcccgga

SEQ ID NO: 930884 - DNA, 25 bp, Mus musculus
ttcagtaataacttgggctcccgga

SEQ ID NO: 930885 - DNA, 25 bp, Mus musculus
ttcagtacacgtatggactcctggc

SEQ ID NO: 930886 - DNA, 25 bp, Mus musculus
ttcagtacacgtttggactcctggc

SEQ ID NO: 930887 - DNA, 25 bp, Mus musculus
ttcagtacatacacattgtgtgtgt

SEQ ID NO: 930888 - DNA, 25 bp, Mus musculus
ttcagtacatactcattgtgtgtgt

SEQ ID NO: 930889 - DNA, 25 bp, Mus musculus
ttcagtacatcgagggccgcagccg

SEQ ID NO: 930890 - DNA, 25 bp, Mus musculus
ttcagtacatcgtgggccgcagccg

SEQ ID NO: 930891 - DNA, 25 bp, Mus musculus
ttcagtacatctctgcttgcagggg

SEQ ID NO: 930892 - DNA, 25 bp, Mus musculus
ttcagtacatctgtgcttgcagggg

SEQ ID NO: 930893 - DNA, 25 bp, Mus musculus
ttcagtaccacaactctgctgaggg

SEQ ID NO: 930894 - DNA, 25 bp, Mus musculus
ttcagtaccacatctctgctgaggg

SEQ ID NO: 930895 - DNA, 25 bp, Mus musculus
ttcagtaccagtctctaccagccaa

SEQ ID NO: 930896 - DNA, 25 bp, Mus musculus
ttcagtaccagtgtctaccagccaa

SEQ ID NO: 930897 - DNA, 25 bp, Mus musculus
ttcagtaccattacccacacaggaa

SEQ ID NO: 930898 - DNA, 25 bp, Mus musculus
ttcagtaccatttcccacacaggaa

SEQ ID NO: 930899 - DNA, 25 bp, Mus musculus
ttcagtacccatctgctcgagccaa

SEQ ID NO: 930900 - DNA, 25 bp, Mus musculus
ttcagtacccatgtgctcgagccaa

SEQ ID NO: 930901 - DNA, 25 bp, Mus musculus
ttcagtactaggctatattatgtgt

SEQ ID NO: 930902 - DNA, 25 bp, Mus musculus
ttcagtactagggtatattatgtgt

SEQ ID NO: 930903 - DNA, 25 bp, Mus musculus
ttcagtactcttcggtagatgctta

SEQ ID NO: 930904 - DNA, 25 bp, Mus musculus
ttcagtactcttgggtagatgctta

SEQ ID NO: 930905 - DNA, 25 bp, Mus musculus
ttcagtacttggcacgagtaaggtg

SEQ ID NO: 930906 - DNA, 25 bp, Mus musculus
ttcagtacttgggacgagtaaggtg

SEQ ID NO: 930907 - DNA, 25 bp, Mus musculus
ttcagtagacctccctgggaagcct

SEQ ID NO: 930908 - DNA, 25 bp, Mus musculus
ttcagtagacctgcctgggaagcct

SEQ ID NO: 930909 - DNA, 25 bp, Mus musculus
ttcagtagatcaatctgatgttttc

SEQ ID NO: 930910 - DNA, 25 bp, Mus musculus
ttcagtagatcattctgatgttttc

SEQ ID NO: 930911 - DNA, 25 bp, Mus musculus
ttcagtagcccacgtactcactaaa

SEQ ID NO: 930912 - DNA, 25 bp, Mus musculus
ttcagtagcccaggtactcactaaa

SEQ ID NO: 930913 - DNA, 25 bp, Mus musculus
ttcagtagccctactctacctatac

SEQ ID NO: 930914 - DNA, 25 bp, Mus musculus
ttcagtagcccttctctacctatac

SEQ ID NO: 930915 - DNA, 25 bp, Mus musculus
ttcagtagctaaagctcggtgccct

SEQ ID NO: 930916 - DNA, 25 bp, Mus musculus
ttcagtagctaatgctcggtgccct

SEQ ID NO: 930917 - DNA, 25 bp, Mus musculus
ttcagtagctgcatgtggctggtct

SEQ ID NO: 930918 - DNA, 25 bp, Mus musculus
ttcagtagctgcttgtggctggtct

SEQ ID NO: 930919 - DNA, 25 bp, Mus musculus
ttcagtagctttatgtccactttcc

SEQ ID NO: 930920 - DNA, 25 bp, Mus musculus
ttcagtagctttttgtccactttcc

SEQ ID NO: 930921 - DNA, 25 bp, Mus musculus
ttcagtagggcacgtgtaacctgca

SEQ ID NO: 930922 - DNA, 25 bp, Mus musculus
ttcagtagggcaggtgtaacctgca

SEQ ID NO: 930923 - DNA, 25 bp, Mus musculus
ttcagtatagcccaaggaagccaca

SEQ ID NO: 930924 - DNA, 25 bp, Mus musculus
ttcagtatagccgaaggaagccaca

SEQ ID NO: 930925 - DNA, 25 bp, Mus musculus
ttcagtatcacgattattagacctt

SEQ ID NO: 930926 - DNA, 25 bp, Mus musculus
ttcagtatcacgtttattagacctt

SEQ ID NO: 930927 - DNA, 25 bp, Mus musculus
ttcagtatcccaccattagtgttga

SEQ ID NO: 930928 - DNA, 25 bp, Mus musculus
ttcagtatcccagcattagtgttga

SEQ ID NO: 930929 - DNA, 25 bp, Mus musculus
ttcagtatctgaattcccggatgtc

SEQ ID NO: 930930 - DNA, 25 bp, Mus musculus
ttcagtatctgatttcccggatgtc

SEQ ID NO: 930931 - DNA, 25 bp, Mus musculus
ttcagtatgccactccaatcagata

SEQ ID NO: 930932 - DNA, 25 bp, Mus musculus
ttcagtatgccagtccaatcagata

SEQ ID NO: 930933 - DNA, 25 bp, Mus musculus
ttcagtatgggcaccgcttggtgca

SEQ ID NO: 930934 - DNA, 25 bp, Mus musculus
ttcagtatgggctccgcttggtgca

SEQ ID NO: 930935 - DNA, 25 bp, Mus musculus
ttcagtattacgacatttcagccaa

SEQ ID NO: 930936 - DNA, 25 bp, Mus musculus
ttcagtattacgtcatttcagccaa

SEQ ID NO: 930937 - DNA, 25 bp, Mus musculus
ttcagtattcttacctcttaccaag

SEQ ID NO: 930938 - DNA, 25 bp, Mus musculus
ttcagtattctttcctcttaccaag

SEQ ID NO: 930939 - DNA, 25 bp, Mus musculus
ttcagtattttaacactaatgtatg

SEQ ID NO: 930940 - DNA, 25 bp, Mus musculus
ttcagtattttatcactaatgtatg

SEQ ID NO: 930941 - DNA, 25 bp, Mus musculus
ttcagtcacagaactgctttcctag

SEQ ID NO: 930942 - DNA, 25 bp, Mus musculus
ttcagtcacagatctgctttcctag

SEQ ID NO: 930943 - DNA, 25 bp, Mus musculus
ttcagtcacatgctgtccgtgggaa

SEQ ID NO: 930944 - DNA, 25 bp, Mus musculus
ttcagtcacatggtgtccgtgggaa

SEQ ID NO: 930945 - DNA, 25 bp, Mus musculus
ttcagtcaccctctgaacagaccat

SEQ ID NO: 930946 - DNA, 25 bp, Mus musculus
ttcagtcaccctgtgaacagaccat

SEQ ID NO: 930947 - DNA, 25 bp, Mus musculus
ttcagtcacggacggagtgccccaa

SEQ ID NO: 930948 - DNA, 25 bp, Mus musculus
ttcagtcacggagggagtgccccaa

SEQ ID NO: 930949 - DNA, 25 bp, Mus musculus
ttcagtcagaatagaatttccaggg

SEQ ID NO: 930950 - DNA, 25 bp, Mus musculus
ttcagtcagaattgaatttccaggg

SEQ ID NO: 930951 - DNA, 25 bp, Mus musculus
ttcagtcagatcaattgctccgagg

SEQ ID NO: 930952 - DNA, 25 bp, Mus musculus
ttcagtcagatctattgctccgagg

SEQ ID NO: 930953 - DNA, 25 bp, Mus musculus
ttcagtcagcaaagacgtctagtgg

SEQ ID NO: 930954 - DNA, 25 bp, Mus musculus
ttcagtcagcaatgacgtctagtgg

SEQ ID NO: 930955 - DNA, 25 bp, Mus musculus
ttcagtcagcctacattagcaccaa

SEQ ID NO: 930956 - DNA, 25 bp, Mus musculus
ttcagtcagccttcattagcaccaa

SEQ ID NO: 930957 - DNA, 25 bp, Mus musculus
ttcagtcaggccacagaagtctggt

SEQ ID NO: 930958 - DNA, 25 bp, Mus musculus
ttcagtcaggccacatatttccata

SEQ ID NO: 930959 - DNA, 25 bp, Mus musculus
ttcagtcaggcctcagaagtctggt

SEQ ID NO: 930960 - DNA, 25 bp, Mus musculus
ttcagtcaggcctcatatttccata

SEQ ID NO: 930961 - DNA, 25 bp, Mus musculus
ttcagtcaggtgctcatttgcagct

SEQ ID NO: 930962 - DNA, 25 bp, Mus musculus
ttcagtcaggtggtcatttgcagct

SEQ ID NO: 930963 - DNA, 25 bp, Mus musculus
ttcagtcatcaaactacatagttca

SEQ ID NO: 930964 - DNA, 25 bp, Mus musculus
ttcagtcatcaatctacatagttca

SEQ ID NO: 930965 - DNA, 25 bp, Mus musculus
ttcagtcatgacacagggcaccctc

SEQ ID NO: 930966 - DNA, 25 bp, Mus musculus
ttcagtcatgactcagggcaccctc

SEQ ID NO: 930967 - DNA, 25 bp, Mus musculus
ttcagtcattagcagagacgcacgg

SEQ ID NO: 930968 - DNA, 25 bp, Mus musculus
ttcagtcattaggagagacgcacgg

SEQ ID NO: 930969 - DNA, 25 bp, Mus musculus
ttcagtccacgtaggctgacttcaa

SEQ ID NO: 930970 - DNA, 25 bp, Mus musculus
ttcagtccacgttggctgacttcaa

SEQ ID NO: 930971 - DNA, 25 bp, Mus musculus
ttcagtccactgaattgtcaaaggt

SEQ ID NO: 930972 - DNA, 25 bp, Mus musculus
ttcagtccactgtattgtcaaaggt

SEQ ID NO: 930973 - DNA, 25 bp, Mus musculus
ttcagtccaggacttgcaggccagc

SEQ ID NO: 930974 - DNA, 25 bp, Mus musculus
ttcagtccaggagttgcaggccagc

SEQ ID NO: 930975 - DNA, 25 bp, Mus musculus
ttcagtccatcaatttactctcttg

SEQ ID NO: 930976 - DNA, 25 bp, Mus musculus
ttcagtccatcattttactctcttg

SEQ ID NO: 930977 - DNA, 25 bp, Mus musculus
ttcagtccatccagtgtcatttgga

SEQ ID NO: 930978 - DNA, 25 bp, Mus musculus
ttcagtccatcctgtgtcatttgga

SEQ ID NO: 930979 - DNA, 25 bp, Mus musculus
ttcagtccatgtacccaaaagccag

SEQ ID NO: 930980 - DNA, 25 bp, Mus musculus
ttcagtccatgttcccaaaagccag

SEQ ID NO: 930981 - DNA, 25 bp, Mus musculus
ttcagtcccaaccttattcttacaa

SEQ ID NO: 930982 - DNA, 25 bp, Mus musculus
ttcagtcccaacgttattcttacaa

SEQ ID NO: 930983 - DNA, 25 bp, Mus musculus
ttcagtccccagaggattaggcaga

SEQ ID NO: 930984 - DNA, 25 bp, Mus musculus
ttcagtccccagtggattaggcaga

SEQ ID NO: 930985 - DNA, 25 bp, Mus musculus
ttcagtcctagcaccgtaactaagt

SEQ ID NO: 930986 - DNA, 25 bp, Mus musculus
ttcagtcctagctccgtaactaagt

SEQ ID NO: 930987 - DNA, 25 bp, Mus musculus
ttcagtcctcagagaacagtcctcg

SEQ ID NO: 930988 - DNA, 25 bp, Mus musculus
ttcagtcctcagtgaacagtcctcg

SEQ ID NO: 930989 - DNA, 25 bp, Mus musculus
ttcagtcctgagagtcatacaagtg

SEQ ID NO: 930990 - DNA, 25 bp, Mus musculus
ttcagtcctgagtgtcatacaagtg

SEQ ID NO: 930991 - DNA, 25 bp, Mus musculus
ttcagtcctttaactcctgtataat

SEQ ID NO: 930992 - DNA, 25 bp, Mus musculus
ttcagtcctttatctcctgtataat

SEQ ID NO: 930993 - DNA, 25 bp, Mus musculus
ttcagtcgatgcatagacttgtttt

SEQ ID NO: 930994 - DNA, 25 bp, Mus musculus
ttcagtcgatgcttagacttgtttt

SEQ ID NO: 930995 - DNA, 25 bp, Mus musculus
ttcagtctaactacactggctagaa

SEQ ID NO: 930996 - DNA, 25 bp, Mus musculus
ttcagtctaacttcactggctagaa

SEQ ID NO: 930997 - DNA, 25 bp, Mus musculus
ttcagtctactcctctgcttcctgg

SEQ ID NO: 930998 - DNA, 25 bp, Mus musculus
ttcagtctactcgtctgcttcctgg

SEQ ID NO: 930999 - DNA, 25 bp, Mus musculus
ttcagtctagacagactcacagtcg

SEQ ID NO: 931000 - DNA, 25 bp, Mus musculus
ttcagtctagactgactcacagtcg

SEQ ID NO: 931001 - DNA, 25 bp, Mus musculus
ttcagtctagccattgggcacccag

SEQ ID NO: 931002 - DNA, 25 bp, Mus musculus
ttcagtctagcctttgggcacccag

SEQ ID NO: 931003 - DNA, 25 bp, Mus musculus
ttcagtctatagacagcaggcccct

SEQ ID NO: 931004 - DNA, 25 bp, Mus musculus
ttcagtctatagtcagcaggcccct

SEQ ID NO: 931005 - DNA, 25 bp, Mus musculus
ttcagtctcagcattgaaggaccat

SEQ ID NO: 931006 - DNA, 25 bp, Mus musculus
ttcagtctcagctttgaaggaccat

SEQ ID NO: 931007 - DNA, 25 bp, Mus musculus
ttcagtctccttagacaccagaaag

SEQ ID NO: 931008 - DNA, 25 bp, Mus musculus
ttcagtctcctttgacaccagaaag

SEQ ID NO: 931009 - DNA, 25 bp, Mus musculus
ttcagtctctctaccacattccatg

SEQ ID NO: 931010 - DNA, 25 bp, Mus musculus
ttcagtctctcttccacattccatg

SEQ ID NO: 931011 - DNA, 25 bp, Mus musculus
ttcagtctctgaagtgttaggagtc

SEQ ID NO: 931012 - DNA, 25 bp, Mus musculus
ttcagtctctgatgtgttaggagtc

SEQ ID NO: 931013 - DNA, 25 bp, Mus musculus
ttcagtctctgcaatccacgtggta

SEQ ID NO: 931014 - DNA, 25 bp, Mus musculus
ttcagtctctgcacacaagtcagga

SEQ ID NO: 931015 - DNA, 25 bp, Mus musculus
ttcagtctctgctatccacgtggta

SEQ ID NO: 931016 - DNA, 25 bp, Mus musculus
ttcagtctctgctcacaagtcagga

SEQ ID NO: 931017 - DNA, 25 bp, Mus musculus
ttcagtctcttaagcccgtcagtgg

SEQ ID NO: 931018 - DNA, 25 bp, Mus musculus
ttcagtctcttatgcccgtcagtgg

SEQ ID NO: 931019 - DNA, 25 bp, Mus musculus
ttcagtctctttactcaggtgtttt

SEQ ID NO: 931020 - DNA, 25 bp, Mus musculus
ttcagtctcttttctcaggtgtttt

SEQ ID NO: 931021 - DNA, 25 bp, Mus musculus
ttcagtctgaacaagggccctgctg

SEQ ID NO: 931022 - DNA, 25 bp, Mus musculus
ttcagtctgaactagggccctgctg

SEQ ID NO: 931023 - DNA, 25 bp, Mus musculus
ttcagtctgaatcacagcaggccta

SEQ ID NO: 931024 - DNA, 25 bp, Mus musculus
ttcagtctgaatgacagcaggccta

SEQ ID NO: 931025 - DNA, 25 bp, Mus musculus
ttcagtctgggtagctactgagttc

SEQ ID NO: 931026 - DNA, 25 bp, Mus musculus
ttcagtctgggttgctactgagttc

SEQ ID NO: 931027 - DNA, 25 bp, Mus musculus
ttcagtctggtgacttgtggccatg

SEQ ID NO: 931028 - DNA, 25 bp, Mus musculus
ttcagtctggtgtcttgtggccatg

SEQ ID NO: 931029 - DNA, 25 bp, Mus musculus
ttcagtctgtctaggttcttggaag

SEQ ID NO: 931030 - DNA, 25 bp, Mus musculus
ttcagtctgtcttggttcttggaag

SEQ ID NO: 931031 - DNA, 25 bp, Mus musculus
ttcagtctgtggaatcgcgagtcta

SEQ ID NO: 931032 - DNA, 25 bp, Mus musculus
ttcagtctgtggtatcgcgagtcta

SEQ ID NO: 931033 - DNA, 25 bp, Mus musculus
ttcagtctgttgagagcatggccac

SEQ ID NO: 931034 - DNA, 25 bp, Mus musculus
ttcagtctgttgtgagcatggccac

SEQ ID NO: 931035 - DNA, 25 bp, Mus musculus
ttcagtcttcagatcaaggcaacag

SEQ ID NO: 931036 - DNA, 25 bp, Mus musculus
ttcagtcttcagttcaaggcaacag

SEQ ID NO: 931037 - DNA, 25 bp, Mus musculus
ttcagtcttcatactcttgttggtg

SEQ ID NO: 931038 - DNA, 25 bp, Mus musculus
ttcagtcttcattctcttgttggtg

SEQ ID NO: 931039 - DNA, 25 bp, Mus musculus
ttcagtcttccactacttacaactt

SEQ ID NO: 931040 - DNA, 25 bp, Mus musculus
ttcagtcttccagtacttacaactt

SEQ ID NO: 931041 - DNA, 25 bp, Mus musculus
ttcagtcttgcccacactttaccaa

SEQ ID NO: 931042 - DNA, 25 bp, Mus musculus
ttcagtcttgccgacactttaccaa

SEQ ID NO: 931043 - DNA, 25 bp, Mus musculus
ttcagtcttggcatctcacttagga

SEQ ID NO: 931044 - DNA, 25 bp, Mus musculus
ttcagtcttggcttctcacttagga

SEQ ID NO: 931045 - DNA, 25 bp, Mus musculus
ttcagtcttgtgctcttgtgtttaa

SEQ ID NO: 931046 - DNA, 25 bp, Mus musculus
ttcagtcttgtggtcttgtgtttaa

SEQ ID NO: 931047 - DNA, 25 bp, Mus musculus
ttcagtcttttcaagccacattctt

SEQ ID NO: 931048 - DNA, 25 bp, Mus musculus
ttcagtcttttcactactaggcttt

SEQ ID NO: 931049 - DNA, 25 bp, Mus musculus
ttcagtcttttctagccacattctt

SEQ ID NO: 931050 - DNA, 25 bp, Mus musculus
ttcagtcttttctctactaggcttt

SEQ ID NO: 931051 - DNA, 25 bp, Mus musculus
ttcagtgaaaataatcttcccgagt

SEQ ID NO: 931052 - DNA, 25 bp, Mus musculus
ttcagtgaaaattatcttcccgagt

SEQ ID NO: 931053 - DNA, 25 bp, Mus musculus
ttcagtgaacccaccgaaactctgg

SEQ ID NO: 931054 - DNA, 25 bp, Mus musculus
ttcagtgaaccctccgaaactctgg

SEQ ID NO: 931055 - DNA, 25 bp, Mus musculus
ttcagtgaacttccagactagcgca

SEQ ID NO: 931056 - DNA, 25 bp, Mus musculus
ttcagtgaacttgcagactagcgca

SEQ ID NO: 931057 - DNA, 25 bp, Mus musculus
ttcagtgaatcaaagcccctggacc

SEQ ID NO: 931058 - DNA, 25 bp, Mus musculus
ttcagtgaatcatagcccctggacc

SEQ ID NO: 931059 - DNA, 25 bp, Mus musculus
ttcagtgacagtaggtgttcctctt

SEQ ID NO: 931060 - DNA, 25 bp, Mus musculus
ttcagtgacagttggtgttcctctt

SEQ ID NO: 931061 - DNA, 25 bp, Mus musculus
ttcagtgaccacctggccgaggaag

SEQ ID NO: 931062 - DNA, 25 bp, Mus musculus
ttcagtgaccacgtggccgaggaag

SEQ ID NO: 931063 - DNA, 25 bp, Mus musculus
ttcagtgacttcacttgttcataga

SEQ ID NO: 931064 - DNA, 25 bp, Mus musculus
ttcagtgacttctcttgttcataga

SEQ ID NO: 931065 - DNA, 25 bp, Mus musculus
ttcagtgacttgaacattcagcaat

SEQ ID NO: 931066 - DNA, 25 bp, Mus musculus
ttcagtgacttgtacattcagcaat

SEQ ID NO: 931067 - DNA, 25 bp, Mus musculus
ttcagtgactttccttggttctcag

SEQ ID NO: 931068 - DNA, 25 bp, Mus musculus
ttcagtgactttgcttggttctcag

SEQ ID NO: 931069 - DNA, 25 bp, Mus musculus
ttcagtgagaccacggccttcatgc

SEQ ID NO: 931070 - DNA, 25 bp, Mus musculus
ttcagtgagacctcggccttcatgc

SEQ ID NO: 931071 - DNA, 25 bp, Mus musculus
ttcagtgagattcatagagtttatc

SEQ ID NO: 931072 - DNA, 25 bp, Mus musculus
ttcagtgagattgatagagtttatc

SEQ ID NO: 931073 - DNA, 25 bp, Mus musculus
ttcagtgagcggacaaatgcaacaa

SEQ ID NO: 931074 - DNA, 25 bp, Mus musculus
ttcagtgagcggtcaaatgcaacaa

SEQ ID NO: 931075 - DNA, 25 bp, Mus musculus
ttcagtgaggttctctgcaaggttc

SEQ ID NO: 931076 - DNA, 25 bp, Mus musculus
ttcagtgaggttgtctgcaaggttc

SEQ ID NO: 931077 - DNA, 25 bp, Mus musculus
ttcagtgatactccgtgggcttggc

SEQ ID NO: 931078 - DNA, 25 bp, Mus musculus
ttcagtgatactgcgtgggcttggc

SEQ ID NO: 931079 - DNA, 25 bp, Mus musculus
ttcagtgatgtgatgttctacaatc

SEQ ID NO: 931080 - DNA, 25 bp, Mus musculus
ttcagtgatgtgttgttctacaatc

SEQ ID NO: 931081 - DNA, 25 bp, Mus musculus
ttcagtgcacctattattgaggaac

SEQ ID NO: 931082 - DNA, 25 bp, Mus musculus
ttcagtgcaccttttattgaggaac

SEQ ID NO: 931083 - DNA, 25 bp, Mus musculus
ttcagtgcacgtctgaacagcctgt

SEQ ID NO: 931084 - DNA, 25 bp, Mus musculus
ttcagtgcacgtgtgaacagcctgt

SEQ ID NO: 931085 - DNA, 25 bp, Mus musculus
ttcagtgcaggaatacgttagcgtc

SEQ ID NO: 931086 - DNA, 25 bp, Mus musculus
ttcagtgcaggattacgttagcgtc

SEQ ID NO: 931087 - DNA, 25 bp, Mus musculus
ttcagtgcattacaggtcctgctca

SEQ ID NO: 931088 - DNA, 25 bp, Mus musculus
ttcagtgcattagaggtcctgctca

SEQ ID NO: 931089 - DNA, 25 bp, Mus musculus
ttcagtgccaacatcaagccaactt

SEQ ID NO: 931090 - DNA, 25 bp, Mus musculus
ttcagtgccaacttcaagccaactt

SEQ ID NO: 931091 - DNA, 25 bp, Mus musculus
ttcagtgccatcacccacataggaa

SEQ ID NO: 931092 - DNA, 25 bp, Mus musculus
ttcagtgccatctcccacataggaa

SEQ ID NO: 931093 - DNA, 25 bp, Mus musculus
ttcagtgcctagcaggtatctccac

SEQ ID NO: 931094 - DNA, 25 bp, Mus musculus
ttcagtgcctaggaggtatctccac

SEQ ID NO: 931095 - DNA, 25 bp, Mus musculus
ttcagtgcctctacctagcttgtgt

SEQ ID NO: 931096 - DNA, 25 bp, Mus musculus
ttcagtgcctcttcctagcttgtgt

SEQ ID NO: 931097 - DNA, 25 bp, Mus musculus
ttcagtgcctggctagtaatctcca

SEQ ID NO: 931098 - DNA, 25 bp, Mus musculus
ttcagtgcctgggtagtaatctcca

SEQ ID NO: 931099 - DNA, 25 bp, Mus musculus
ttcagtgcctgtccagagggctcag

SEQ ID NO: 931100 - DNA, 25 bp, Mus musculus
ttcagtgcctgtgcagagggctcag

SEQ ID NO: 931101 - DNA, 25 bp, Mus musculus
ttcagtgcggtgataaattataacg

SEQ ID NO: 931102 - DNA, 25 bp, Mus musculus
ttcagtgcggtgttaaattataacg

SEQ ID NO: 931103 - DNA, 25 bp, Mus musculus
ttcagtgctatgactcttccgggtg

SEQ ID NO: 931104 - DNA, 25 bp, Mus musculus
ttcagtgctatgtctcttccgggtg

SEQ ID NO: 931105 - DNA, 25 bp, Mus musculus
ttcagtgctcagctatgtagtaagt

SEQ ID NO: 931106 - DNA, 25 bp, Mus musculus
ttcagtgctcaggtatgtagtaagt

SEQ ID NO: 931107 - DNA, 25 bp, Mus musculus
ttcagtgctggacattgaacacaca

SEQ ID NO: 931108 - DNA, 25 bp, Mus musculus
ttcagtgctggagattgaacacaca

SEQ ID NO: 931109 - DNA, 25 bp, Mus musculus
ttcagtgctgtgaactaggtgctac

SEQ ID NO: 931110 - DNA, 25 bp, Mus musculus
ttcagtgctgtgtactaggtgctac

SEQ ID NO: 931111 - DNA, 25 bp, Mus musculus
ttcagtgctgttaaatcttcatata

SEQ ID NO: 931112 - DNA, 25 bp, Mus musculus
ttcagtgctgtttaatcttcatata

SEQ ID NO: 931113 - DNA, 25 bp, Mus musculus
ttcagtgcttggcatcgccgggaac

SEQ ID NO: 931114 - DNA, 25 bp, Mus musculus
ttcagtgcttgggatcgccgggaac

SEQ ID NO: 931115 - DNA, 25 bp, Mus musculus
ttcagtggaataaagttggaaaact

SEQ ID NO: 931116 - DNA, 25 bp, Mus musculus
ttcagtggaatatagttggaaaact

SEQ ID NO: 931117 - DNA, 25 bp, Mus musculus
ttcagtggaccaaattttcaggatg

SEQ ID NO: 931118 - DNA, 25 bp, Mus musculus
ttcagtggaccatattttcaggatg

SEQ ID NO: 931119 - DNA, 25 bp, Mus musculus
ttcagtggacctaccttggcctgtt

SEQ ID NO: 931120 - DNA, 25 bp, Mus musculus
ttcagtggaccttccttggcctgtt

SEQ ID NO: 931121 - DNA, 25 bp, Mus musculus
ttcagtggagtcaccagggccgatc

SEQ ID NO: 931122 - DNA, 25 bp, Mus musculus
ttcagtggagtctccagggccgatc

SEQ ID NO: 931123 - DNA, 25 bp, Mus musculus
ttcagtggcaacctgctggttagcc

SEQ ID NO: 931124 - DNA, 25 bp, Mus musculus
ttcagtggcaacgtgctggttagcc

SEQ ID NO: 931125 - DNA, 25 bp, Mus musculus
ttcagtggcctgaccgtggaagagt

SEQ ID NO: 931126 - DNA, 25 bp, Mus musculus
ttcagtggcctgtccgtggaagagt

SEQ ID NO: 931127 - DNA, 25 bp, Mus musculus
ttcagtggccttactagcatcatgt

SEQ ID NO: 931128 - DNA, 25 bp, Mus musculus
ttcagtggcctttctagcatcatgt

SEQ ID NO: 931129 - DNA, 25 bp, Mus musculus
ttcagtggctctcagatggagtcag

SEQ ID NO: 931130 - DNA, 25 bp, Mus musculus
ttcagtggctctgagatggagtcag

SEQ ID NO: 931131 - DNA, 25 bp, Mus musculus
ttcagtggctgtattctaccgagac

SEQ ID NO: 931132 - DNA, 25 bp, Mus musculus
ttcagtggctgttttctaccgagac

SEQ ID NO: 931133 - DNA, 25 bp, Mus musculus
ttcagtgggaccctggtctagcttt

SEQ ID NO: 931134 - DNA, 25 bp, Mus musculus
ttcagtgggaccgtggtctagcttt

SEQ ID NO: 931135 - DNA, 25 bp, Mus musculus
ttcagtgggagaatcctgtgctagc

SEQ ID NO: 931136 - DNA, 25 bp, Mus musculus
ttcagtgggagattcctgtgctagc

SEQ ID NO: 931137 - DNA, 25 bp, Mus musculus
ttcagtgggatacaccccggcaggc

SEQ ID NO: 931138 - DNA, 25 bp, Mus musculus
ttcagtgggatagaccccggcaggc

SEQ ID NO: 931139 - DNA, 25 bp, Mus musculus
ttcagtgggcccatttgatggacat

SEQ ID NO: 931140 - DNA, 25 bp, Mus musculus
ttcagtgggcccttttgatggacat

SEQ ID NO: 931141 - DNA, 25 bp, Mus musculus
ttcagtgggtctcggctatctggta

SEQ ID NO: 931142 - DNA, 25 bp, Mus musculus
ttcagtgggtctgggctatctggta

SEQ ID NO: 931143 - DNA, 25 bp, Mus musculus
ttcagtggtacacaattgtcctaga

SEQ ID NO: 931144 - DNA, 25 bp, Mus musculus
ttcagtggtacagaattgtcctaga

SEQ ID NO: 931145 - DNA, 25 bp, Mus musculus
ttcagtggtcatagttcagcagcag

SEQ ID NO: 931146 - DNA, 25 bp, Mus musculus
ttcagtggtcattgttcagcagcag

SEQ ID NO: 931147 - DNA, 25 bp, Mus musculus
ttcagtggtctaagtatagaaccca

SEQ ID NO: 931148 - DNA, 25 bp, Mus musculus
ttcagtggtctatgtatagaaccca

SEQ ID NO: 931149 - DNA, 25 bp, Mus musculus
ttcagtggtgagaaccaggtctcct

SEQ ID NO: 931150 - DNA, 25 bp, Mus musculus
ttcagtggtgagtaccaggtctcct

SEQ ID NO: 931151 - DNA, 25 bp, Mus musculus
ttcagtggtggtaagctggcttcca

SEQ ID NO: 931152 - DNA, 25 bp, Mus musculus
ttcagtggtggttagctggcttcca

SEQ ID NO: 931153 - DNA, 25 bp, Mus musculus
ttcagtggttatccgtggtaccctt

SEQ ID NO: 931154 - DNA, 25 bp, Mus musculus
ttcagtggttatgcgtggtaccctt

SEQ ID NO: 931155 - DNA, 25 bp, Mus musculus
ttcagtgtacaaaccatgtgcccca

SEQ ID NO: 931156 - DNA, 25 bp, Mus musculus
ttcagtgtacaatccatgtgcccca

SEQ ID NO: 931157 - DNA, 25 bp, Mus musculus
ttcagtgtagacatccgatcggatg

SEQ ID NO: 931158 - DNA, 25 bp, Mus musculus
ttcagtgtagacttccgatcggatg

SEQ ID NO: 931159 - DNA, 25 bp, Mus musculus
ttcagtgtaggcatattttttgtaa

SEQ ID NO: 931160 - DNA, 25 bp, Mus musculus
ttcagtgtaggcttattttttgtaa

SEQ ID NO: 931161 - DNA, 25 bp, Mus musculus
ttcagtgtatgtcactctccagcag

SEQ ID NO: 931162 - DNA, 25 bp, Mus musculus
ttcagtgtatgtgactctccagcag

SEQ ID NO: 931163 - DNA, 25 bp, Mus musculus
ttcagtgtcaaacaagccccgctta

SEQ ID NO: 931164 - DNA, 25 bp, Mus musculus
ttcagtgtcaaagaagccccgctta

SEQ ID NO: 931165 - DNA, 25 bp, Mus musculus
ttcagtgtccagagcctctgagcga

SEQ ID NO: 931166 - DNA, 25 bp, Mus musculus
ttcagtgtccagtgcctctgagcga

SEQ ID NO: 931167 - DNA, 25 bp, Mus musculus
ttcagtgtcctcaacactgtgccgg

SEQ ID NO: 931168 - DNA, 25 bp, Mus musculus
ttcagtgtcctctacactgtgccgg

SEQ ID NO: 931169 - DNA, 25 bp, Mus musculus
ttcagtgtccttaagtacattcagt

SEQ ID NO: 931170 - DNA, 25 bp, Mus musculus
ttcagtgtcctttagtacattcagt

SEQ ID NO: 931171 - DNA, 25 bp, Mus musculus
ttcagtgtctgcatggttgtttatc

SEQ ID NO: 931172 - DNA, 25 bp, Mus musculus
ttcagtgtctgcttggttgtttatc

SEQ ID NO: 931173 - DNA, 25 bp, Mus musculus
ttcagtgtctgtagcctctgctgtt

SEQ ID NO: 931174 - DNA, 25 bp, Mus musculus
ttcagtgtctgttgcctctgctgtt

SEQ ID NO: 931175 - DNA, 25 bp, Mus musculus
ttcagtgtgaacaactgtggagccc

SEQ ID NO: 931176 - DNA, 25 bp, Mus musculus
ttcagtgtgaactactgtggagccc

SEQ ID NO: 931177 - DNA, 25 bp, Mus musculus
ttcagtgtgaatcatggtggcatct

SEQ ID NO: 931178 - DNA, 25 bp, Mus musculus
ttcagtgtgaatgatggtggcatct

SEQ ID NO: 931179 - DNA, 25 bp, Mus musculus
ttcagtgtgccacttgggcagtcta

SEQ ID NO: 931180 - DNA, 25 bp, Mus musculus
ttcagtgtgccagttgggcagtcta

SEQ ID NO: 931181 - DNA, 25 bp, Mus musculus
ttcagtgtgcccaagccatgtttgg

SEQ ID NO: 931182 - DNA, 25 bp, Mus musculus
ttcagtgtgccctagccatgtttgg

SEQ ID NO: 931183 - DNA, 25 bp, Mus musculus
ttcagtgtgctaaattcctccaggt

SEQ ID NO: 931184 - DNA, 25 bp, Mus musculus
ttcagtgtgctatattcctccaggt

SEQ ID NO: 931185 - DNA, 25 bp, Mus musculus
ttcagtgtgctcagcaaaagagaac

SEQ ID NO: 931186 - DNA, 25 bp, Mus musculus
ttcagtgtgctcagcgagatcaagg

SEQ ID NO: 931187 - DNA, 25 bp, Mus musculus
ttcagtgtgctctgcaaaagagaac

SEQ ID NO: 931188 - DNA, 25 bp, Mus musculus
ttcagtgtgctctgcgagatcaagg

SEQ ID NO: 931189 - DNA, 25 bp, Mus musculus
ttcagtgtgctgatacaagctccct

SEQ ID NO: 931190 - DNA, 25 bp, Mus musculus
ttcagtgtgctgttacaagctccct

SEQ ID NO: 931191 - DNA, 25 bp, Mus musculus
ttcagtgtgggaacctataatttta

SEQ ID NO: 931192 - DNA, 25 bp, Mus musculus
ttcagtgtgggatcctataatttta

SEQ ID NO: 931193 - DNA, 25 bp, Mus musculus
ttcagtgtgtttcatgccagccacc

SEQ ID NO: 931194 - DNA, 25 bp, Mus musculus
ttcagtgtgtttgatgccagccacc

SEQ ID NO: 931195 - DNA, 25 bp, Mus musculus
ttcagtgttaccacacctggcagcg

SEQ ID NO: 931196 - DNA, 25 bp, Mus musculus
ttcagtgttacctcacctggcagcg

SEQ ID NO: 931197 - DNA, 25 bp, Mus musculus
ttcagtgttaggatcacccaggttt

SEQ ID NO: 931198 - DNA, 25 bp, Mus musculus
ttcagtgttaggttcacccaggttt

SEQ ID NO: 931199 - DNA, 25 bp, Mus musculus
ttcagtgttattagttggtctcctt

SEQ ID NO: 931200 - DNA, 25 bp, Mus musculus
ttcagtgttatttgttggtctcctt

SEQ ID NO: 931201 - DNA, 25 bp, Mus musculus
ttcagtgttcctactgtgtaccaac

SEQ ID NO: 931202 - DNA, 25 bp, Mus musculus
ttcagtgttcctcataggcacaggg

SEQ ID NO: 931203 - DNA, 25 bp, Mus musculus
ttcagtgttcctgataggcacaggg

SEQ ID NO: 931204 - DNA, 25 bp, Mus musculus
ttcagtgttccttctgtgtaccaac

SEQ ID NO: 931205 - DNA, 25 bp, Mus musculus
ttcagtgttctgatccattttcata

SEQ ID NO: 931206 - DNA, 25 bp, Mus musculus
ttcagtgttctgttccattttcata

SEQ ID NO: 931207 - DNA, 25 bp, Mus musculus
ttcagtgttcttagtatgtctgtgt

SEQ ID NO: 931208 - DNA, 25 bp, Mus musculus
ttcagtgttctttgtatgtctgtgt

SEQ ID NO: 931209 - DNA, 25 bp, Mus musculus
ttcagtgtttggaaggtgaggccta

SEQ ID NO: 931210 - DNA, 25 bp, Mus musculus
ttcagtgtttggtaggtgaggccta

SEQ ID NO: 931211 - DNA, 25 bp, Mus musculus
ttcagttaactacaggacgcttcat

SEQ ID NO: 931212 - DNA, 25 bp, Mus musculus
ttcagttaactagaggacgcttcat

SEQ ID NO: 931213 - DNA, 25 bp, Mus musculus
ttcagttaagtaagtcaagcccagg

SEQ ID NO: 931214 - DNA, 25 bp, Mus musculus
ttcagttaagtatgtcaagcccagg

SEQ ID NO: 931215 - DNA, 25 bp, Mus musculus
ttcagttaagtgcatctgacgccct

SEQ ID NO: 931216 - DNA, 25 bp, Mus musculus
ttcagttaagtggatctgacgccct

SEQ ID NO: 931217 - DNA, 25 bp, Mus musculus
ttcagttacactcgttggcccatga

SEQ ID NO: 931218 - DNA, 25 bp, Mus musculus
ttcagttacactggttggcccatga

SEQ ID NO: 931219 - DNA, 25 bp, Mus musculus
ttcagttaccatcgtgcagatgcca

SEQ ID NO: 931220 - DNA, 25 bp, Mus musculus
ttcagttaccatggtgcagatgcca

SEQ ID NO: 931221 - DNA, 25 bp, Mus musculus
ttcagttaccttctaggtgaaccct

SEQ ID NO: 931222 - DNA, 25 bp, Mus musculus
ttcagttaccttgtaggtgaaccct

SEQ ID NO: 931223 - DNA, 25 bp, Mus musculus
ttcagttactgtcgcacctacctgg

SEQ ID NO: 931224 - DNA, 25 bp, Mus musculus
ttcagttactgtggcacctacctgg

SEQ ID NO: 931225 - DNA, 25 bp, Mus musculus
ttcagttagagcaatccagcttccc

SEQ ID NO: 931226 - DNA, 25 bp, Mus musculus
ttcagttagagctatccagcttccc

SEQ ID NO: 931227 - DNA, 25 bp, Mus musculus
ttcagttagtaacgcaacattgccc

SEQ ID NO: 931228 - DNA, 25 bp, Mus musculus
ttcagttagtaaggcaacattgccc

SEQ ID NO: 931229 - DNA, 25 bp, Mus musculus
ttcagttatcacagacctcagggac

SEQ ID NO: 931230 - DNA, 25 bp, Mus musculus
ttcagttatcactgacctcagggac

SEQ ID NO: 931231 - DNA, 25 bp, Mus musculus
ttcagttatctaaggaacaataaag

SEQ ID NO: 931232 - DNA, 25 bp, Mus musculus
ttcagttatctatggaacaataaag

SEQ ID NO: 931233 - DNA, 25 bp, Mus musculus
ttcagttatttgctggttccctcta

SEQ ID NO: 931234 - DNA, 25 bp, Mus musculus
ttcagttatttggtggttccctcta

SEQ ID NO: 931235 - DNA, 25 bp, Mus musculus
ttcagttcacctaatgccttcttat

SEQ ID NO: 931236 - DNA, 25 bp, Mus musculus
ttcagttcacctccagggctggcac

SEQ ID NO: 931237 - DNA, 25 bp, Mus musculus
ttcagttcacctgcagggctggcac

SEQ ID NO: 931238 - DNA, 25 bp, Mus musculus
ttcagttcaccttatgccttcttat

SEQ ID NO: 931239 - DNA, 25 bp, Mus musculus
ttcagttcaggactaggctgtctca

SEQ ID NO: 931240 - DNA, 25 bp, Mus musculus
ttcagttcaggagtaggctgtctca

SEQ ID NO: 931241 - DNA, 25 bp, Mus musculus
ttcagttcatcaccacttgcacaag

SEQ ID NO: 931242 - DNA, 25 bp, Mus musculus
ttcagttcatcagcacttgcacaag

SEQ ID NO: 931243 - DNA, 25 bp, Mus musculus
ttcagttcattcattggccacctag

SEQ ID NO: 931244 - DNA, 25 bp, Mus musculus
ttcagttcattctttggccacctag

SEQ ID NO: 931245 - DNA, 25 bp, Mus musculus
ttcagttccacaccgaagcctctgt

SEQ ID NO: 931246 - DNA, 25 bp, Mus musculus
ttcagttccacagcgaagcctctgt

SEQ ID NO: 931247 - DNA, 25 bp, Mus musculus
ttcagttccccgctcagttgcagtg

SEQ ID NO: 931248 - DNA, 25 bp, Mus musculus
ttcagttccccggtcagttgcagtg

SEQ ID NO: 931249 - DNA, 25 bp, Mus musculus
ttcagttcccgtagctctgaagtgg

SEQ ID NO: 931250 - DNA, 25 bp, Mus musculus
ttcagttcccgttgctctgaagtgg

SEQ ID NO: 931251 - DNA, 25 bp, Mus musculus
ttcagttccctgattctttgtaatt

SEQ ID NO: 931252 - DNA, 25 bp, Mus musculus
ttcagttccctgtttctttgtaatt

SEQ ID NO: 931253 - DNA, 25 bp, Mus musculus
ttcagttcctagaccttggttagaa

SEQ ID NO: 931254 - DNA, 25 bp, Mus musculus
ttcagttcctagcatctatgtggca

SEQ ID NO: 931255 - DNA, 25 bp, Mus musculus
ttcagttcctaggatctatgtggca

SEQ ID NO: 931256 - DNA, 25 bp, Mus musculus
ttcagttcctagtccttggttagaa

SEQ ID NO: 931257 - DNA, 25 bp, Mus musculus
ttcagttcctccctggagatcattt

SEQ ID NO: 931258 - DNA, 25 bp, Mus musculus
ttcagttcctccgtggagatcattt

SEQ ID NO: 931259 - DNA, 25 bp, Mus musculus
ttcagttcctgtctttggttgtttc

SEQ ID NO: 931260 - DNA, 25 bp, Mus musculus
ttcagttcctgtgtttggttgtttc

SEQ ID NO: 931261 - DNA, 25 bp, Mus musculus
ttcagttcctttaagcagctgggga

SEQ ID NO: 931262 - DNA, 25 bp, Mus musculus
ttcagttccttttagcagctgggga

SEQ ID NO: 931263 - DNA, 25 bp, Mus musculus
ttcagttcgcctcccacagtctgga

SEQ ID NO: 931264 - DNA, 25 bp, Mus musculus
ttcagttcgcctgccacagtctgga

SEQ ID NO: 931265 - DNA, 25 bp, Mus musculus
ttcagttctacaattacaaaccagg

SEQ ID NO: 931266 - DNA, 25 bp, Mus musculus
ttcagttctacatttacaaaccagg

SEQ ID NO: 931267 - DNA, 25 bp, Mus musculus
ttcagttctactagaccaaacctca

SEQ ID NO: 931268 - DNA, 25 bp, Mus musculus
ttcagttctacttgaccaaacctca

SEQ ID NO: 931269 - DNA, 25 bp, Mus musculus
ttcagttctatcaacagcaagggct

SEQ ID NO: 931270 - DNA, 25 bp, Mus musculus
ttcagttctatctacagcaagggct

SEQ ID NO: 931271 - DNA, 25 bp, Mus musculus
ttcagttctcacattagttggtaag

SEQ ID NO: 931272 - DNA, 25 bp, Mus musculus
ttcagttctcactttagttggtaag

SEQ ID NO: 931273 - DNA, 25 bp, Mus musculus
ttcagttctgaacactcgcatgcca

SEQ ID NO: 931274 - DNA, 25 bp, Mus musculus
ttcagttctgaagactcgcatgcca

SEQ ID NO: 931275 - DNA, 25 bp, Mus musculus
ttcagttctgctcttacaatggaga

SEQ ID NO: 931276 - DNA, 25 bp, Mus musculus
ttcagttctgctgttacaatggaga

SEQ ID NO: 931277 - DNA, 25 bp, Mus musculus
ttcagttctttcatagccctaatgg

SEQ ID NO: 931278 - DNA, 25 bp, Mus musculus
ttcagttctttcttagccctaatgg

SEQ ID NO: 931279 - DNA, 25 bp, Mus musculus
ttcagttgaatgcagctgcttttac

SEQ ID NO: 931280 - DNA, 25 bp, Mus musculus
ttcagttgaatggagctgcttttac

SEQ ID NO: 931281 - DNA, 25 bp, Mus musculus
ttcagttgccccactggatagcaag

SEQ ID NO: 931282 - DNA, 25 bp, Mus musculus
ttcagttgcccctctggatagcaag

SEQ ID NO: 931283 - DNA, 25 bp, Mus musculus
ttcagttgctcaagggttgacagct

SEQ ID NO: 931284 - DNA, 25 bp, Mus musculus
ttcagttgctcatgggttgacagct

SEQ ID NO: 931285 - DNA, 25 bp, Mus musculus
ttcagttgcttgctgttatccagat

SEQ ID NO: 931286 - DNA, 25 bp, Mus musculus
ttcagttgcttggtgttatccagat

SEQ ID NO: 931287 - DNA, 25 bp, Mus musculus
ttcagttggagcacagcccaggcca

SEQ ID NO: 931288 - DNA, 25 bp, Mus musculus
ttcagttggagctcagcccaggcca

SEQ ID NO: 931289 - DNA, 25 bp, Mus musculus
ttcagttggctcaagggtgggttta

SEQ ID NO: 931290 - DNA, 25 bp, Mus musculus
ttcagttggctcactgatttggctg

SEQ ID NO: 931291 - DNA, 25 bp, Mus musculus
ttcagttggctctagggtgggttta

SEQ ID NO: 931292 - DNA, 25 bp, Mus musculus
ttcagttggctctctgatttggctg

SEQ ID NO: 931293 - DNA, 25 bp, Mus musculus
ttcagttgggaaacctgagccttat

SEQ ID NO: 931294 - DNA, 25 bp, Mus musculus
ttcagttgggaatcctgagccttat

SEQ ID NO: 931295 - DNA, 25 bp, Mus musculus
ttcagttgggttccatgcttctatt

SEQ ID NO: 931296 - DNA, 25 bp, Mus musculus
ttcagttgggttgcatgcttctatt

SEQ ID NO: 931297 - DNA, 25 bp, Mus musculus
ttcagttgtcaaccccattgtctat

SEQ ID NO: 931298 - DNA, 25 bp, Mus musculus
ttcagttgtcaagcccattgtctat

SEQ ID NO: 931299 - DNA, 25 bp, Mus musculus
ttcagttgtgaaagccgcgtcctgt

SEQ ID NO: 931300 - DNA, 25 bp, Mus musculus
ttcagttgtgaatgccgcgtcctgt

SEQ ID NO: 931301 - DNA, 25 bp, Mus musculus
ttcagttgtttaaatcattgtcatt

SEQ ID NO: 931302 - DNA, 25 bp, Mus musculus
ttcagttgtttatatcattgtcatt

SEQ ID NO: 931303 - DNA, 25 bp, Mus musculus
ttcagttgtttcagctctagcgagc

SEQ ID NO: 931304 - DNA, 25 bp, Mus musculus
ttcagttgtttctgctctagcgagc

SEQ ID NO: 931305 - DNA, 25 bp, Mus musculus
ttcagtttaccacatggcgacagcc

SEQ ID NO: 931306 - DNA, 25 bp, Mus musculus
ttcagtttaccagatggcgacagcc

SEQ ID NO: 931307 - DNA, 25 bp, Mus musculus
ttcagtttatccacctcatcattaa

SEQ ID NO: 931308 - DNA, 25 bp, Mus musculus
ttcagtttatcctcctcatcattaa

SEQ ID NO: 931309 - DNA, 25 bp, Mus musculus
ttcagtttccaccaagtgtcacgag

SEQ ID NO: 931310 - DNA, 25 bp, Mus musculus
ttcagtttccacgaagtgtcacgag

SEQ ID NO: 931311 - DNA, 25 bp, Mus musculus
ttcagtttctccacaggccatatgt

SEQ ID NO: 931312 - DNA, 25 bp, Mus musculus
ttcagtttctcctcaggccatatgt

SEQ ID NO: 931313 - DNA, 25 bp, Mus musculus
ttcagtttctctacagtttaaaaat

SEQ ID NO: 931314 - DNA, 25 bp, Mus musculus
ttcagtttctcttcagtttaaaaat

SEQ ID NO: 931315 - DNA, 25 bp, Mus musculus
ttcagtttcttccattgctaacaat

SEQ ID NO: 931316 - DNA, 25 bp, Mus musculus
ttcagtttcttcgattgctaacaat

SEQ ID NO: 931317 - DNA, 25 bp, Mus musculus
ttcagtttctttcagtagcttcctc

SEQ ID NO: 931318 - DNA, 25 bp, Mus musculus
ttcagtttctttgagtagcttcctc

SEQ ID NO: 931319 - DNA, 25 bp, Mus musculus
ttcagtttgagcagcaatgccctta

SEQ ID NO: 931320 - DNA, 25 bp, Mus musculus
ttcagtttgagctgcaatgccctta

SEQ ID NO: 931321 - DNA, 25 bp, Mus musculus
ttcagtttgatcaatcttcttcccc

SEQ ID NO: 931322 - DNA, 25 bp, Mus musculus
ttcagtttgatctatcttcttcccc

SEQ ID NO: 931323 - DNA, 25 bp, Mus musculus
ttcagtttgcctcgacagggatgat

SEQ ID NO: 931324 - DNA, 25 bp, Mus musculus
ttcagtttgcctggacagggatgat

SEQ ID NO: 931325 - DNA, 25 bp, Mus musculus
ttcagtttggacactctctttgcca

SEQ ID NO: 931326 - DNA, 25 bp, Mus musculus
ttcagtttggactctctctttgcca

SEQ ID NO: 931327 - DNA, 25 bp, Mus musculus
ttcagtttgtcccattccgagatta

SEQ ID NO: 931328 - DNA, 25 bp, Mus musculus
ttcagtttgtccgattccgagatta

SEQ ID NO: 931329 - DNA, 25 bp, Mus musculus
ttcagttttactatgccatatccag

SEQ ID NO: 931330 - DNA, 25 bp, Mus musculus
ttcagttttactccattttcacaac

SEQ ID NO: 931331 - DNA, 25 bp, Mus musculus
ttcagttttactgcattttcacaac

SEQ ID NO: 931332 - DNA, 25 bp, Mus musculus
ttcagttttactttgccatatccag

SEQ ID NO: 931333 - DNA, 25 bp, Mus musculus
ttcagttttccaagctaggccacaa

SEQ ID NO: 931334 - DNA, 25 bp, Mus musculus
ttcagttttccatgctaggccacaa

SEQ ID NO: 931335 - DNA, 25 bp, Mus musculus
ttcagttttcgcaatacctaattca

SEQ ID NO: 931336 - DNA, 25 bp, Mus musculus
ttcagttttcgctatacctaattca

SEQ ID NO: 931337 - DNA, 25 bp, Mus musculus
ttcagttttgagaccacaacagcag

SEQ ID NO: 931338 - DNA, 25 bp, Mus musculus
ttcagttttgagtccacaacagcag

SEQ ID NO: 931339 - DNA, 25 bp, Mus musculus
ttcagttttgtgatgtgctggtaat

SEQ ID NO: 931340 - DNA, 25 bp, Mus musculus
ttcagttttgtgttgtgctggtaat

SEQ ID NO: 931341 - DNA, 25 bp, Mus musculus
ttcagttttgttatgcttccagcta

SEQ ID NO: 931342 - DNA, 25 bp, Mus musculus
ttcagttttgttttgcttccagcta

SEQ ID NO: 931343 - DNA, 25 bp, Mus musculus
ttcagtttttatcttcccactcctc

SEQ ID NO: 931344 - DNA, 25 bp, Mus musculus
ttcagtttttatgttcccactcctc

SEQ ID NO: 931345 - DNA, 25 bp, Mus musculus
ttcataaactttagtctccacgttg

SEQ ID NO: 931346 - DNA, 25 bp, Mus musculus
ttcataaacttttgtctccacgttg

SEQ ID NO: 931347 - DNA, 25 bp, Mus musculus
ttcataaagttaacctgggctcccc

SEQ ID NO: 931348 - DNA, 25 bp, Mus musculus
ttcataaagttatcctgggctcccc

SEQ ID NO: 931349 - DNA, 25 bp, Mus musculus
ttcataaccctgaggacagtcctac

SEQ ID NO: 931350 - DNA, 25 bp, Mus musculus
ttcataaccctgtggacagtcctac

SEQ ID NO: 931351 - DNA, 25 bp, Mus musculus
ttcataaccttaagccaaccgactc

SEQ ID NO: 931352 - DNA, 25 bp, Mus musculus
ttcataaccttatgccaaccgactc

SEQ ID NO: 931353 - DNA, 25 bp, Mus musculus
ttcataacgagtcgctgtcttcttc

SEQ ID NO: 931354 - DNA, 25 bp, Mus musculus
ttcataacgagtggctgtcttcttc

SEQ ID NO: 931355 - DNA, 25 bp, Mus musculus
ttcataactgctatctgctcccaaa

SEQ ID NO: 931356 - DNA, 25 bp, Mus musculus
ttcataactgctttctgctcccaaa

SEQ ID NO: 931357 - DNA, 25 bp, Mus musculus
ttcataacttgcagtcactcctgat

SEQ ID NO: 931358 - DNA, 25 bp, Mus musculus
ttcataacttgctgtcactcctgat

SEQ ID NO: 931359 - DNA, 25 bp, Mus musculus
ttcataagagaacacatactagaga

SEQ ID NO: 931360 - DNA, 25 bp, Mus musculus
ttcataagagaagacatactagaga

SEQ ID NO: 931361 - DNA, 25 bp, Mus musculus
ttcataagccatcggtgtcgctgtc

SEQ ID NO: 931362 - DNA, 25 bp, Mus musculus
ttcataagccatgggtgtcgctgtc

SEQ ID NO: 931363 - DNA, 25 bp, Mus musculus
ttcataagtcatccttaggtaccac

SEQ ID NO: 931364 - DNA, 25 bp, Mus musculus
ttcataagtcatgcttaggtaccac

SEQ ID NO: 931365 - DNA, 25 bp, Mus musculus
ttcataagtttcagagcaaggctcg

SEQ ID NO: 931366 - DNA, 25 bp, Mus musculus
ttcataagtttctgagcaaggctcg

SEQ ID NO: 931367 - DNA, 25 bp, Mus musculus
ttcataatcccacattttgataatg

SEQ ID NO: 931368 - DNA, 25 bp, Mus musculus
ttcataatcccagattttgataatg

SEQ ID NO: 931369 - DNA, 25 bp, Mus musculus
ttcataatgagccttgtcagccttt

SEQ ID NO: 931370 - DNA, 25 bp, Mus musculus
ttcataatgagcgttgtcagccttt

SEQ ID NO: 931371 - DNA, 25 bp, Mus musculus
ttcataattatccagacccttcaca

SEQ ID NO: 931372 - DNA, 25 bp, Mus musculus
ttcataattatcgagacccttcaca

SEQ ID NO: 931373 - DNA, 25 bp, Mus musculus
ttcataattgtgagtgactcttgct

SEQ ID NO: 931374 - DNA, 25 bp, Mus musculus
ttcataattgtgtgtgactcttgct

SEQ ID NO: 931375 - DNA, 25 bp, Mus musculus
ttcatacacatccttcttatctgca

SEQ ID NO: 931376 - DNA, 25 bp, Mus musculus
ttcatacacatcgttcttatctgca

SEQ ID NO: 931377 - DNA, 25 bp, Mus musculus
ttcatacactaaaagcttcctgctt

SEQ ID NO: 931378 - DNA, 25 bp, Mus musculus
ttcatacactaatagcttcctgctt

SEQ ID NO: 931379 - DNA, 25 bp, Mus musculus
ttcatacactgactgttattttaac

SEQ ID NO: 931380 - DNA, 25 bp, Mus musculus
ttcatacactgagtgttattttaac

SEQ ID NO: 931381 - DNA, 25 bp, Mus musculus
ttcatacatccccaaaagtctttac

SEQ ID NO: 931382 - DNA, 25 bp, Mus musculus
ttcatacatcccgaaaagtctttac

SEQ ID NO: 931383 - DNA, 25 bp, Mus musculus
ttcataccagttagagcaccgtgct

SEQ ID NO: 931384 - DNA, 25 bp, Mus musculus
ttcataccagtttgagcaccgtgct

SEQ ID NO: 931385 - DNA, 25 bp, Mus musculus
ttcataccatgaccacaatgtgtaa

SEQ ID NO: 931386 - DNA, 25 bp, Mus musculus
ttcataccatgagcacaatgtgtaa

SEQ ID NO: 931387 - DNA, 25 bp, Mus musculus
ttcataccatgtaaccctgacttgc

SEQ ID NO: 931388 - DNA, 25 bp, Mus musculus
ttcataccatgttaccctgacttgc

SEQ ID NO: 931389 - DNA, 25 bp, Mus musculus
ttcataccattcattttccactaat

SEQ ID NO: 931390 - DNA, 25 bp, Mus musculus
ttcataccattctttttccactaat

SEQ ID NO: 931391 - DNA, 25 bp, Mus musculus
ttcataccctgtattggctctctca

SEQ ID NO: 931392 - DNA, 25 bp, Mus musculus
ttcataccctgttttggctctctca

SEQ ID NO: 931393 - DNA, 25 bp, Mus musculus
ttcatacctccgagtagttcagtga

SEQ ID NO: 931394 - DNA, 25 bp, Mus musculus
ttcatacctccgtgtagttcagtga

SEQ ID NO: 931395 - DNA, 25 bp, Mus musculus
ttcataccttgtccccagaggtcag

SEQ ID NO: 931396 - DNA, 25 bp, Mus musculus
ttcataccttgtgcccagaggtcag

SEQ ID NO: 931397 - DNA, 25 bp, Mus musculus
ttcatacgtatgctttgctttttga

SEQ ID NO: 931398 - DNA, 25 bp, Mus musculus
ttcatacgtatggtttgctttttga

SEQ ID NO: 931399 - DNA, 25 bp, Mus musculus
ttcatactcaaaatttaccacttgg

SEQ ID NO: 931400 - DNA, 25 bp, Mus musculus
ttcatactcaaattttaccacttgg

SEQ ID NO: 931401 - DNA, 25 bp, Mus musculus
ttcatactcacacaacagtcacgat

SEQ ID NO: 931402 - DNA, 25 bp, Mus musculus
ttcatactcacagaacagtcacgat

SEQ ID NO: 931403 - DNA, 25 bp, Mus musculus
ttcatactcctcaagcagacatcac

SEQ ID NO: 931404 - DNA, 25 bp, Mus musculus
ttcatactcctctagcagacatcac

SEQ ID NO: 931405 - DNA, 25 bp, Mus musculus
ttcatactgataatgttaacactta

SEQ ID NO: 931406 - DNA, 25 bp, Mus musculus
ttcatactgatattgttaacactta

SEQ ID NO: 931407 - DNA, 25 bp, Mus musculus
ttcatactgggcacagtctcttagc

SEQ ID NO: 931408 - DNA, 25 bp, Mus musculus
ttcatactgggctcagtctcttagc

SEQ ID NO: 931409 - DNA, 25 bp, Mus musculus
ttcatactgtttagaccacaccttg

SEQ ID NO: 931410 - DNA, 25 bp, Mus musculus
ttcatactgttttgaccacaccttg

SEQ ID NO: 931411 - DNA, 25 bp, Mus musculus
ttcatacttccaacttcaagcgcat

SEQ ID NO: 931412 - DNA, 25 bp, Mus musculus
ttcatacttccatcttcaagcgcat

SEQ ID NO: 931413 - DNA, 25 bp, Mus musculus
ttcatagaaattcacttgcctctac

SEQ ID NO: 931414 - DNA, 25 bp, Mus musculus
ttcatagaaattgacttgcctctac

SEQ ID NO: 931415 - DNA, 25 bp, Mus musculus
ttcatagactctcaagtcgcctgct

SEQ ID NO: 931416 - DNA, 25 bp, Mus musculus
ttcatagactctgaagtcgcctgct

SEQ ID NO: 931417 - DNA, 25 bp, Mus musculus
ttcatagagcacacacccaaacagg

SEQ ID NO: 931418 - DNA, 25 bp, Mus musculus
ttcatagagcactcacccaaacagg

SEQ ID NO: 931419 - DNA, 25 bp, Mus musculus
ttcatagagttccttgtacagaata

SEQ ID NO: 931420 - DNA, 25 bp, Mus musculus
ttcatagagttcgttgtacagaata

SEQ ID NO: 931421 - DNA, 25 bp, Mus musculus
ttcatagatctcatacaagtggcct

SEQ ID NO: 931422 - DNA, 25 bp, Mus musculus
ttcatagatctcttacaagtggcct

SEQ ID NO: 931423 - DNA, 25 bp, Mus musculus
ttcatagattccaagtcactcctcg

SEQ ID NO: 931424 - DNA, 25 bp, Mus musculus
ttcatagattcctagtcactcctcg

SEQ ID NO: 931425 - DNA, 25 bp, Mus musculus
ttcatagcaaaacagggtaccttta

SEQ ID NO: 931426 - DNA, 25 bp, Mus musculus
ttcatagcaaaagagggtaccttta

SEQ ID NO: 931427 - DNA, 25 bp, Mus musculus
ttcatagcaccaccttcacaataat

SEQ ID NO: 931428 - DNA, 25 bp, Mus musculus
ttcatagcaccagcttcacaataat

SEQ ID NO: 931429 - DNA, 25 bp, Mus musculus
ttcatagccattaccatcatcagtt

SEQ ID NO: 931430 - DNA, 25 bp, Mus musculus
ttcatagccattacctcggtggttt

SEQ ID NO: 931431 - DNA, 25 bp, Mus musculus
ttcatagccatttccatcatcagtt

SEQ ID NO: 931432 - DNA, 25 bp, Mus musculus
ttcatagccatttcctcggtggttt

SEQ ID NO: 931433 - DNA, 25 bp, Mus musculus
ttcatagcccacaggtttgcagcag

SEQ ID NO: 931434 - DNA, 25 bp, Mus musculus
ttcatagcccactggtttgcagcag

SEQ ID NO: 931435 - DNA, 25 bp, Mus musculus
ttcatagcctacaaccacagacgtg

SEQ ID NO: 931436 - DNA, 25 bp, Mus musculus
ttcatagcctactaccacagacgtg

SEQ ID NO: 931437 - DNA, 25 bp, Mus musculus
ttcatagcgagtcccttgcactgag

SEQ ID NO: 931438 - DNA, 25 bp, Mus musculus
ttcatagcgagtgccttgcactgag

SEQ ID NO: 931439 - DNA, 25 bp, Mus musculus
ttcatagctctacgccatctcctgg

SEQ ID NO: 931440 - DNA, 25 bp, Mus musculus
ttcatagctctaggccatctcctgg

SEQ ID NO: 931441 - DNA, 25 bp, Mus musculus
ttcatagctgtccttgatttcatat

SEQ ID NO: 931442 - DNA, 25 bp, Mus musculus
ttcatagctgtcgttgatttcatat

SEQ ID NO: 931443 - DNA, 25 bp, Mus musculus
ttcatagcttcaatagttcaggtct

SEQ ID NO: 931444 - DNA, 25 bp, Mus musculus
ttcatagcttcattagttcaggtct

SEQ ID NO: 931445 - DNA, 25 bp, Mus musculus
ttcataggaactattctcagtcacc

SEQ ID NO: 931446 - DNA, 25 bp, Mus musculus
ttcataggaacttttctcagtcacc

SEQ ID NO: 931447 - DNA, 25 bp, Mus musculus
ttcataggacttcagacccacaagg

SEQ ID NO: 931448 - DNA, 25 bp, Mus musculus
ttcataggacttgagacccacaagg

SEQ ID NO: 931449 - DNA, 25 bp, Mus musculus
ttcataggcgggaaggcattttctt

SEQ ID NO: 931450 - DNA, 25 bp, Mus musculus
ttcataggcgggtaggcattttctt

SEQ ID NO: 931451 - DNA, 25 bp, Mus musculus
ttcatagggcttacgaacacaactg

SEQ ID NO: 931452 - DNA, 25 bp, Mus musculus
ttcatagggctttcgaacacaactg

SEQ ID NO: 931453 - DNA, 25 bp, Mus musculus
ttcatagtgtgtacttgggcatcca

SEQ ID NO: 931454 - DNA, 25 bp, Mus musculus
ttcatagtgtgttcttgggcatcca

SEQ ID NO: 931455 - DNA, 25 bp, Mus musculus
ttcatagttagtaccttcacgtctt

SEQ ID NO: 931456 - DNA, 25 bp, Mus musculus
ttcatagttagtctgccgtgtggcg

SEQ ID NO: 931457 - DNA, 25 bp, Mus musculus
ttcatagttagtgtgccgtgtggcg

SEQ ID NO: 931458 - DNA, 25 bp, Mus musculus
ttcatagttagttccttcacgtctt

SEQ ID NO: 931459 - DNA, 25 bp, Mus musculus
ttcatataaatcagtttccccaccc

SEQ ID NO: 931460 - DNA, 25 bp, Mus musculus
ttcatataaatctgtttccccaccc

SEQ ID NO: 931461 - DNA, 25 bp, Mus musculus
ttcatataatcccttatatccccca

SEQ ID NO: 931462 - DNA, 25 bp, Mus musculus
ttcatataatccgttatatccccca

SEQ ID NO: 931463 - DNA, 25 bp, Mus musculus
ttcatatactggaaaacaaccttgt

SEQ ID NO: 931464 - DNA, 25 bp, Mus musculus
ttcatatactggtaaacaaccttgt

SEQ ID NO: 931465 - DNA, 25 bp, Mus musculus
ttcatataggtacccttatctttgg

SEQ ID NO: 931466 - DNA, 25 bp, Mus musculus
ttcatataggtagccttatctttgg

SEQ ID NO: 931467 - DNA, 25 bp, Mus musculus
ttcatatataaaaccaaactgccat

SEQ ID NO: 931468 - DNA, 25 bp, Mus musculus
ttcatatataaatccaaactgccat

SEQ ID NO: 931469 - DNA, 25 bp, Mus musculus
ttcatatatagtacactgtcctctc

SEQ ID NO: 931470 - DNA, 25 bp, Mus musculus
ttcatatatagttcactgtcctctc

SEQ ID NO: 931471 - DNA, 25 bp, Mus musculus
ttcatatatgttagggccacagtgg

SEQ ID NO: 931472 - DNA, 25 bp, Mus musculus
ttcatatatgtttgggccacagtgg

SEQ ID NO: 931473 - DNA, 25 bp, Mus musculus
ttcatatcagcgcatgaggtatgct

SEQ ID NO: 931474 - DNA, 25 bp, Mus musculus
ttcatatcagcggatgaggtatgct

SEQ ID NO: 931475 - DNA, 25 bp, Mus musculus
ttcatatcagttactgcccacagag

SEQ ID NO: 931476 - DNA, 25 bp, Mus musculus
ttcatatcagtttctgcccacagag

SEQ ID NO: 931477 - DNA, 25 bp, Mus musculus
ttcatatcatacatcccaatcacac

SEQ ID NO: 931478 - DNA, 25 bp, Mus musculus
ttcatatcatacttcccaatcacac

SEQ ID NO: 931479 - DNA, 25 bp, Mus musculus
ttcatatcccagactgcattatcac

SEQ ID NO: 931480 - DNA, 25 bp, Mus musculus
ttcatatcccagtctgcattatcac

SEQ ID NO: 931481 - DNA, 25 bp, Mus musculus
ttcatatccgccatcatgtgtcatt

SEQ ID NO: 931482 - DNA, 25 bp, Mus musculus
ttcatatccgccttcatgtgtcatt

SEQ ID NO: 931483 - DNA, 25 bp, Mus musculus
ttcatatcctggaagctgccttgga

SEQ ID NO: 931484 - DNA, 25 bp, Mus musculus
ttcatatcctggtagctgccttgga

SEQ ID NO: 931485 - DNA, 25 bp, Mus musculus
ttcatatctatgaattctatattaa

SEQ ID NO: 931486 - DNA, 25 bp, Mus musculus
ttcatatctatgtattctatattaa

SEQ ID NO: 931487 - DNA, 25 bp, Mus musculus
ttcatatgaatgatgcctgcacccc

SEQ ID NO: 931488 - DNA, 25 bp, Mus musculus
ttcatatgaatgttgcctgcacccc

SEQ ID NO: 931489 - DNA, 25 bp, Mus musculus
ttcatatgcctaattagaaaactgc

SEQ ID NO: 931490 - DNA, 25 bp, Mus musculus
ttcatatgcctatttagaaaactgc

SEQ ID NO: 931491 - DNA, 25 bp, Mus musculus
ttcatatgctttcattccttccatt

SEQ ID NO: 931492 - DNA, 25 bp, Mus musculus
ttcatatgctttgattccttccatt

SEQ ID NO: 931493 - DNA, 25 bp, Mus musculus
ttcatatggctacacctgtgttatc

SEQ ID NO: 931494 - DNA, 25 bp, Mus musculus
ttcatatggctagacctgtgttatc

SEQ ID NO: 931495 - DNA, 25 bp, Mus musculus
ttcatatggtttaactcagcagtgt

SEQ ID NO: 931496 - DNA, 25 bp, Mus musculus
ttcatatggttttactcagcagtgt

SEQ ID NO: 931497 - DNA, 25 bp, Mus musculus
ttcatatgtcacaggctggcccgtc

SEQ ID NO: 931498 - DNA, 25 bp, Mus musculus
ttcatatgtcactggctggcccgtc

SEQ ID NO: 931499 - DNA, 25 bp, Mus musculus
ttcatatgttgtagtttaattccca

SEQ ID NO: 931500 - DNA, 25 bp, Mus musculus
ttcatatgttgttgtttaattccca

SEQ ID NO: 931501 - DNA, 25 bp, Mus musculus
ttcatattagtaatttagagcaagc

SEQ ID NO: 931502 - DNA, 25 bp, Mus musculus
ttcatattagtattttagagcaagc

SEQ ID NO: 931503 - DNA, 25 bp, Mus musculus
ttcatattcactcactgcttctggc

SEQ ID NO: 931504 - DNA, 25 bp, Mus musculus
ttcatattcactgactgcttctggc

SEQ ID NO: 931505 - DNA, 25 bp, Mus musculus
ttcatattccagaacagccctgtgg

SEQ ID NO: 931506 - DNA, 25 bp, Mus musculus
ttcatattccagactcctagttcta

SEQ ID NO: 931507 - DNA, 25 bp, Mus musculus
ttcatattccagtacagccctgtgg

SEQ ID NO: 931508 - DNA, 25 bp, Mus musculus
ttcatattccagtctcctagttcta

SEQ ID NO: 931509 - DNA, 25 bp, Mus musculus
ttcatattgtagatgctttgcaggc

SEQ ID NO: 931510 - DNA, 25 bp, Mus musculus
ttcatattgtagttgctttgcaggc

SEQ ID NO: 931511 - DNA, 25 bp, Mus musculus
ttcatatttcttcacctacagggtt

SEQ ID NO: 931512 - DNA, 25 bp, Mus musculus
ttcatatttcttctcctctcctgct

SEQ ID NO: 931513 - DNA, 25 bp, Mus musculus
ttcatatttcttgacctacagggtt

SEQ ID NO: 931514 - DNA, 25 bp, Mus musculus
ttcatatttcttgtcctctcctgct

SEQ ID NO: 931515 - DNA, 25 bp, Mus musculus
ttcatatttgagatgctagcagtaa

SEQ ID NO: 931516 - DNA, 25 bp, Mus musculus
ttcatatttgagttgctagcagtaa

SEQ ID NO: 931517 - DNA, 25 bp, Mus musculus
ttcatcaaaccacgctaggatttca

SEQ ID NO: 931518 - DNA, 25 bp, Mus musculus
ttcatcaaaccaggctaggatttca

SEQ ID NO: 931519 - DNA, 25 bp, Mus musculus
ttcatcaaagtgataagcttcacag

SEQ ID NO: 931520 - DNA, 25 bp, Mus musculus
ttcatcaaagtgttaagcttcacag

SEQ ID NO: 931521 - DNA, 25 bp, Mus musculus
ttcatcaaatttccctcctagttcc

SEQ ID NO: 931522 - DNA, 25 bp, Mus musculus
ttcatcaaatttgcctcctagttcc

SEQ ID NO: 931523 - DNA, 25 bp, Mus musculus
ttcatcaaccggcagaagcgtaagg

SEQ ID NO: 931524 - DNA, 25 bp, Mus musculus
ttcatcaaccgggagaagcgtaagg

SEQ ID NO: 931525 - DNA, 25 bp, Mus musculus
ttcatcaaccttaatgcacaaaaaa

SEQ ID NO: 931526 - DNA, 25 bp, Mus musculus
ttcatcaacctttatgcacaaaaaa

SEQ ID NO: 931527 - DNA, 25 bp, Mus musculus
ttcatcaactggatttgtgtaataa

SEQ ID NO: 931528 - DNA, 25 bp, Mus musculus
ttcatcaactggctgattcaaacca

SEQ ID NO: 931529 - DNA, 25 bp, Mus musculus
ttcatcaactgggtgattcaaacca

SEQ ID NO: 931530 - DNA, 25 bp, Mus musculus
ttcatcaactggttttgtgtaataa

SEQ ID NO: 931531 - DNA, 25 bp, Mus musculus
ttcatcaagcatctcaggccatcac

SEQ ID NO: 931532 - DNA, 25 bp, Mus musculus
ttcatcaagcatgtcaggccatcac

SEQ ID NO: 931533 - DNA, 25 bp, Mus musculus
ttcatcaaggtcagcactatcctgc

SEQ ID NO: 931534 - DNA, 25 bp, Mus musculus
ttcatcaaggtctgcactatcctgc

SEQ ID NO: 931535 - DNA, 25 bp, Mus musculus
ttcatcaagtaccactgctccaagg

SEQ ID NO: 931536 - DNA, 25 bp, Mus musculus
ttcatcaagtacgactgctccaagg

SEQ ID NO: 931537 - DNA, 25 bp, Mus musculus
ttcatcaatttcagtttcccaattt

SEQ ID NO: 931538 - DNA, 25 bp, Mus musculus
ttcatcaatttctgtttcccaattt

SEQ ID NO: 931539 - DNA, 25 bp, Mus musculus
ttcatcacaaatcatctgcccagat

SEQ ID NO: 931540 - DNA, 25 bp, Mus musculus
ttcatcacaaatgatctgcccagat

SEQ ID NO: 931541 - DNA, 25 bp, Mus musculus
ttcatcacaatccatcagtctggcc

SEQ ID NO: 931542 - DNA, 25 bp, Mus musculus
ttcatcacaatcgatcagtctggcc

SEQ ID NO: 931543 - DNA, 25 bp, Mus musculus
ttcatcaccaggcacctggatcaga

SEQ ID NO: 931544 - DNA, 25 bp, Mus musculus
ttcatcaccagggacctggatcaga

SEQ ID NO: 931545 - DNA, 25 bp, Mus musculus
ttcatcaccgctcccagtggaggac

SEQ ID NO: 931546 - DNA, 25 bp, Mus musculus
ttcatcaccgctgccagtggaggac

SEQ ID NO: 931547 - DNA, 25 bp, Mus musculus
ttcatcactactcacccttaaattt

SEQ ID NO: 931548 - DNA, 25 bp, Mus musculus
ttcatcactactgacccttaaattt

SEQ ID NO: 931549 - DNA, 25 bp, Mus musculus
ttcatcactgaaccataccccaatt

SEQ ID NO: 931550 - DNA, 25 bp, Mus musculus
ttcatcactgaagcataccccaatt

SEQ ID NO: 931551 - DNA, 25 bp, Mus musculus
ttcatcactgtgcacccagaacgag

SEQ ID NO: 931552 - DNA, 25 bp, Mus musculus
ttcatcactgtggacccagaacgag

SEQ ID NO: 931553 - DNA, 25 bp, Mus musculus
ttcatcacttatcactttctgcatc

SEQ ID NO: 931554 - DNA, 25 bp, Mus musculus
ttcatcacttatgactttctgcatc

SEQ ID NO: 931555 - DNA, 25 bp, Mus musculus
ttcatcacttggacgaatgcccaca

SEQ ID NO: 931556 - DNA, 25 bp, Mus musculus
ttcatcacttggtcgaatgcccaca

SEQ ID NO: 931557 - DNA, 25 bp, Mus musculus
ttcatcactttcagcttcaacgtaa

SEQ ID NO: 931558 - DNA, 25 bp, Mus musculus
ttcatcactttctgcttcaacgtaa

SEQ ID NO: 931559 - DNA, 25 bp, Mus musculus
ttcatcacttttccatgtcttcatg

SEQ ID NO: 931560 - DNA, 25 bp, Mus musculus
ttcatcacttttgcatgtcttcatg

SEQ ID NO: 931561 - DNA, 25 bp, Mus musculus
ttcatcagaagacatcaaagcaggg

SEQ ID NO: 931562 - DNA, 25 bp, Mus musculus
ttcatcagaagagatcaaagcaggg

SEQ ID NO: 931563 - DNA, 25 bp, Mus musculus
ttcatcagcatcatggaacaagagt

SEQ ID NO: 931564 - DNA, 25 bp, Mus musculus
ttcatcagcatcttggaacaagagt

SEQ ID NO: 931565 - DNA, 25 bp, Mus musculus
ttcatcagcatgcacgacgactcgg

SEQ ID NO: 931566 - DNA, 25 bp, Mus musculus
ttcatcagcatggacgacgactcgg

SEQ ID NO: 931567 - DNA, 25 bp, Mus musculus
ttcatcagccacactcctagggcat

SEQ ID NO: 931568 - DNA, 25 bp, Mus musculus
ttcatcagccacatggactcatgtg

SEQ ID NO: 931569 - DNA, 25 bp, Mus musculus
ttcatcagccactctcctagggcat

SEQ ID NO: 931570 - DNA, 25 bp, Mus musculus
ttcatcagccacttggactcatgtg

SEQ ID NO: 931571 - DNA, 25 bp, Mus musculus
ttcatcagccggattttgttattga

SEQ ID NO: 931572 - DNA, 25 bp, Mus musculus
ttcatcagccggtttttgttattga

SEQ ID NO: 931573 - DNA, 25 bp, Mus musculus
ttcatcagctgcaccaagtggttgg

SEQ ID NO: 931574 - DNA, 25 bp, Mus musculus
ttcatcagctgctccaagtggttgg

SEQ ID NO: 931575 - DNA, 25 bp, Mus musculus
ttcatcaggaagactttgtagttct

SEQ ID NO: 931576 - DNA, 25 bp, Mus musculus
ttcatcaggaagtctttgtagttct

SEQ ID NO: 931577 - DNA, 25 bp, Mus musculus
ttcatcaggagtactggcagagcct

SEQ ID NO: 931578 - DNA, 25 bp, Mus musculus
ttcatcaggagttctggcagagcct

SEQ ID NO: 931579 - DNA, 25 bp, Mus musculus
ttcatcagggttatcatgtgtccaa

SEQ ID NO: 931580 - DNA, 25 bp, Mus musculus
ttcatcagggttcagaaaggacact

SEQ ID NO: 931581 - DNA, 25 bp, Mus musculus
ttcatcagggttgagaaaggacact

SEQ ID NO: 931582 - DNA, 25 bp, Mus musculus
ttcatcagggttttcatgtgtccaa

SEQ ID NO: 931583 - DNA, 25 bp, Mus musculus
ttcatcagtctgcatcaaagatact

SEQ ID NO: 931584 - DNA, 25 bp, Mus musculus
ttcatcagtctggatcaaagatact

SEQ ID NO: 931585 - DNA, 25 bp, Mus musculus
ttcatcagtcttccttagcatttca

SEQ ID NO: 931586 - DNA, 25 bp, Mus musculus
ttcatcagtcttgcttagcatttca

SEQ ID NO: 931587 - DNA, 25 bp, Mus musculus
ttcatcagtgggacaattccttgat

SEQ ID NO: 931588 - DNA, 25 bp, Mus musculus
ttcatcagtgggtcaattccttgat

SEQ ID NO: 931589 - DNA, 25 bp, Mus musculus
ttcatcagttctaagggactcggcc

SEQ ID NO: 931590 - DNA, 25 bp, Mus musculus
ttcatcagttcttagggactcggcc

SEQ ID NO: 931591 - DNA, 25 bp, Mus musculus
ttcatcatactaagctgatcctagt

SEQ ID NO: 931592 - DNA, 25 bp, Mus musculus
ttcatcatactatgctgatcctagt

SEQ ID NO: 931593 - DNA, 25 bp, Mus musculus
ttcatcatcaaactgcaaggtctta

SEQ ID NO: 931594 - DNA, 25 bp, Mus musculus
ttcatcatcaaagtgcaaggtctta

SEQ ID NO: 931595 - DNA, 25 bp, Mus musculus
ttcatcatcattcgcctcttgaccg

SEQ ID NO: 931596 - DNA, 25 bp, Mus musculus
ttcatcatcattggcctcttgaccg

SEQ ID NO: 931597 - DNA, 25 bp, Mus musculus
ttcatcatctacacatcctcgggcg

SEQ ID NO: 931598 - DNA, 25 bp, Mus musculus
ttcatcatctactcatcctcgggcg

SEQ ID NO: 931599 - DNA, 25 bp, Mus musculus
ttcatcatcttcatgttattctttt

SEQ ID NO: 931600 - DNA, 25 bp, Mus musculus
ttcatcatcttcatttgcttcacgg

SEQ ID NO: 931601 - DNA, 25 bp, Mus musculus
ttcatcatcttcttgttattctttt

SEQ ID NO: 931602 - DNA, 25 bp, Mus musculus
ttcatcatcttcttttgcttcacgg

SEQ ID NO: 931603 - DNA, 25 bp, Mus musculus
ttcatcatctttctatgtcattagc

SEQ ID NO: 931604 - DNA, 25 bp, Mus musculus
ttcatcatctttgtatgtcattagc

SEQ ID NO: 931605 - DNA, 25 bp, Mus musculus
ttcatcatgttgcatccagttgcct

SEQ ID NO: 931606 - DNA, 25 bp, Mus musculus
ttcatcatgttggatccagttgcct

SEQ ID NO: 931607 - DNA, 25 bp, Mus musculus
ttcatcattagacaactggagtttt

SEQ ID NO: 931608 - DNA, 25 bp, Mus musculus
ttcatcattagagaactggagtttt

SEQ ID NO: 931609 - DNA, 25 bp, Mus musculus
ttcatcattcaacgcctgcgatcag

SEQ ID NO: 931610 - DNA, 25 bp, Mus musculus
ttcatcattcaaggcctgcgatcag

SEQ ID NO: 931611 - DNA, 25 bp, Mus musculus
ttcatcattccactggccctggcag

SEQ ID NO: 931612 - DNA, 25 bp, Mus musculus
ttcatcattccagtggccctggcag

SEQ ID NO: 931613 - DNA, 25 bp, Mus musculus
ttcatcattgatagtcttggctaaa

SEQ ID NO: 931614 - DNA, 25 bp, Mus musculus
ttcatcattgattgtcttggctaaa

SEQ ID NO: 931615 - DNA, 25 bp, Mus musculus
ttcatccaaaggcaagtgtacttgt

SEQ ID NO: 931616 - DNA, 25 bp, Mus musculus
ttcatccaaagggaagtgtacttgt

SEQ ID NO: 931617 - DNA, 25 bp, Mus musculus
ttcatccactctattttaggtccat

SEQ ID NO: 931618 - DNA, 25 bp, Mus musculus
ttcatccactcttttttaggtccat

SEQ ID NO: 931619 - DNA, 25 bp, Mus musculus
ttcatccacttcactgagcagcaga

SEQ ID NO: 931620 - DNA, 25 bp, Mus musculus
ttcatccacttctctgagcagcaga

SEQ ID NO: 931621 - DNA, 25 bp, Mus musculus
ttcatccagactattgccttcaaat

SEQ ID NO: 931622 - DNA, 25 bp, Mus musculus
ttcatccagacttttgccttcaaat

SEQ ID NO: 931623 - DNA, 25 bp, Mus musculus
ttcatccagcggagccgattccaac

SEQ ID NO: 931624 - DNA, 25 bp, Mus musculus
ttcatccagcggtgccgattccaac

SEQ ID NO: 931625 - DNA, 25 bp, Mus musculus
ttcatccataagagggtcccttgag

SEQ ID NO: 931626 - DNA, 25 bp, Mus musculus
ttcatccataagtgggtcccttgag

SEQ ID NO: 931627 - DNA, 25 bp, Mus musculus
ttcatccatactcttgtgcgtaacc

SEQ ID NO: 931628 - DNA, 25 bp, Mus musculus
ttcatccatactgttgtgcgtaacc

SEQ ID NO: 931629 - DNA, 25 bp, Mus musculus
ttcatccatatgagccaggtgttca

SEQ ID NO: 931630 - DNA, 25 bp, Mus musculus
ttcatccatatgtgccaggtgttca

SEQ ID NO: 931631 - DNA, 25 bp, Mus musculus
ttcatccatgtaagttgcatctttg

SEQ ID NO: 931632 - DNA, 25 bp, Mus musculus
ttcatccatgtatgttgcatctttg

SEQ ID NO: 931633 - DNA, 25 bp, Mus musculus
ttcatccatgtcactactttctatg

SEQ ID NO: 931634 - DNA, 25 bp, Mus musculus
ttcatccatgtctctactttctatg

SEQ ID NO: 931635 - DNA, 25 bp, Mus musculus
ttcatccattgccagtggagggttt

SEQ ID NO: 931636 - DNA, 25 bp, Mus musculus
ttcatccattgcgagtggagggttt

SEQ ID NO: 931637 - DNA, 25 bp, Mus musculus
ttcatcccagtacactagcagactt

SEQ ID NO: 931638 - DNA, 25 bp, Mus musculus
ttcatcccagtagactagcagactt

SEQ ID NO: 931639 - DNA, 25 bp, Mus musculus
ttcatcccagttcccatgtaaaaca

SEQ ID NO: 931640 - DNA, 25 bp, Mus musculus
ttcatcccagttgccatgtaaaaca

SEQ ID NO: 931641 - DNA, 25 bp, Mus musculus
ttcatcccgattcatcacatggagg

SEQ ID NO: 931642 - DNA, 25 bp, Mus musculus
ttcatcccgattgatcacatggagg

SEQ ID NO: 931643 - DNA, 25 bp, Mus musculus
ttcatcccggcaccagctggatgga

SEQ ID NO: 931644 - DNA, 25 bp, Mus musculus
ttcatcccggcagcagctggatgga

SEQ ID NO: 931645 - DNA, 25 bp, Mus musculus
ttcatccctaaaaccaggacgtggc

SEQ ID NO: 931646 - DNA, 25 bp, Mus musculus
ttcatccctaaatccaggacgtggc

SEQ ID NO: 931647 - DNA, 25 bp, Mus musculus
ttcatccctctaacttatttgcctg

SEQ ID NO: 931648 - DNA, 25 bp, Mus musculus
ttcatccctctatcttatttgcctg

SEQ ID NO: 931649 - DNA, 25 bp, Mus musculus
ttcatccctgggatggagttgctac

SEQ ID NO: 931650 - DNA, 25 bp, Mus musculus
ttcatccctgggttggagttgctac

SEQ ID NO: 931651 - DNA, 25 bp, Mus musculus
ttcatccctgtcataagcacaacca

SEQ ID NO: 931652 - DNA, 25 bp, Mus musculus
ttcatccctgtcttaagcacaacca

SEQ ID NO: 931653 - DNA, 25 bp, Mus musculus
ttcatccctttcagttcagataaat

SEQ ID NO: 931654 - DNA, 25 bp, Mus musculus
ttcatccctttctgttcagataaat

SEQ ID NO: 931655 - DNA, 25 bp, Mus musculus
ttcatccgaggaaacaatgtgctgt

SEQ ID NO: 931656 - DNA, 25 bp, Mus musculus
ttcatccgaggatacaatgtgctgt

SEQ ID NO: 931657 - DNA, 25 bp, Mus musculus
ttcatccgctggctcaacaaggaga

SEQ ID NO: 931658 - DNA, 25 bp, Mus musculus
ttcatccgctgggtcaacaaggaga

SEQ ID NO: 931659 - DNA, 25 bp, Mus musculus
ttcatcctaaggacgtgggcctgcc

SEQ ID NO: 931660 - DNA, 25 bp, Mus musculus
ttcatcctaaggtcgtgggcctgcc

SEQ ID NO: 931661 - DNA, 25 bp, Mus musculus
ttcatcctagcgctttgcctgagaa

SEQ ID NO: 931662 - DNA, 25 bp, Mus musculus
ttcatcctagcggtttgcctgagaa

SEQ ID NO: 931663 - DNA, 25 bp, Mus musculus
ttcatcctatccatgtgttatctac

SEQ ID NO: 931664 - DNA, 25 bp, Mus musculus
ttcatcctatccttgtgttatctac

SEQ ID NO: 931665 - DNA, 25 bp, Mus musculus
ttcatcctatctacactgtccgtta

SEQ ID NO: 931666 - DNA, 25 bp, Mus musculus
ttcatcctatcttcactgtccgtta

SEQ ID NO: 931667 - DNA, 25 bp, Mus musculus
ttcatcctattcctggcttacaata

SEQ ID NO: 931668 - DNA, 25 bp, Mus musculus
ttcatcctattcgtggcttacaata

SEQ ID NO: 931669 - DNA, 25 bp, Mus musculus
ttcatcctcactcggaacaaggcac

SEQ ID NO: 931670 - DNA, 25 bp, Mus musculus
ttcatcctcactgggaacaaggcac

SEQ ID NO: 931671 - DNA, 25 bp, Mus musculus
ttcatcctcaggctccaggggtaca

SEQ ID NO: 931672 - DNA, 25 bp, Mus musculus
ttcatcctcagggtccaggggtaca

SEQ ID NO: 931673 - DNA, 25 bp, Mus musculus
ttcatcctcgcaattggcacctgag

SEQ ID NO: 931674 - DNA, 25 bp, Mus musculus
ttcatcctcgcatttggcacctgag

SEQ ID NO: 931675 - DNA, 25 bp, Mus musculus
ttcatcctgatgatatcaccaaatt

SEQ ID NO: 931676 - DNA, 25 bp, Mus musculus
ttcatcctgatgttatcaccaaatt

SEQ ID NO: 931677 - DNA, 25 bp, Mus musculus
ttcatcctgcatctctgtagcgtta

SEQ ID NO: 931678 - DNA, 25 bp, Mus musculus
ttcatcctgcatgtctgtagcgtta

SEQ ID NO: 931679 - DNA, 25 bp, Mus musculus
ttcatcctgctgatcaagtcaaccc

SEQ ID NO: 931680 - DNA, 25 bp, Mus musculus
ttcatcctgctgttcaagtcaaccc

SEQ ID NO: 931681 - DNA, 25 bp, Mus musculus
ttcatcctggatcgtcgccttaata

SEQ ID NO: 931682 - DNA, 25 bp, Mus musculus
ttcatcctggatggtcgccttaata

SEQ ID NO: 931683 - DNA, 25 bp, Mus musculus
ttcatcctggtcagctacatacgca

SEQ ID NO: 931684 - DNA, 25 bp, Mus musculus
ttcatcctggtctgctacatacgca

SEQ ID NO: 931685 - DNA, 25 bp, Mus musculus
ttcatcctggttatcacggcaataa

SEQ ID NO: 931686 - DNA, 25 bp, Mus musculus
ttcatcctggttttcacggcaataa

SEQ ID NO: 931687 - DNA, 25 bp, Mus musculus
ttcatcctgtagatagtcatcacct

SEQ ID NO: 931688 - DNA, 25 bp, Mus musculus
ttcatcctgtagttagtcatcacct

SEQ ID NO: 931689 - DNA, 25 bp, Mus musculus
ttcatccttaagatctcaaagggtt

SEQ ID NO: 931690 - DNA, 25 bp, Mus musculus
ttcatccttaagttctcaaagggtt

SEQ ID NO: 931691 - DNA, 25 bp, Mus musculus
ttcatccttagtatcattccttcaa

SEQ ID NO: 931692 - DNA, 25 bp, Mus musculus
ttcatccttagtttcattccttcaa

SEQ ID NO: 931693 - DNA, 25 bp, Mus musculus
ttcatccttcacaggaataaatatt

SEQ ID NO: 931694 - DNA, 25 bp, Mus musculus
ttcatccttcaccaacaaagcatca

SEQ ID NO: 931695 - DNA, 25 bp, Mus musculus
ttcatccttcacgaacaaagcatca

SEQ ID NO: 931696 - DNA, 25 bp, Mus musculus
ttcatccttcactggaataaatatt

SEQ ID NO: 931697 - DNA, 25 bp, Mus musculus
ttcatcctttggataaagacagcac

SEQ ID NO: 931698 - DNA, 25 bp, Mus musculus
ttcatcctttggttaaagacagcac

SEQ ID NO: 931699 - DNA, 25 bp, Mus musculus
ttcatcgacatcattacatcaaaca

SEQ ID NO: 931700 - DNA, 25 bp, Mus musculus
ttcatcgacatctttacatcaaaca

SEQ ID NO: 931701 - DNA, 25 bp, Mus musculus
ttcatcgagacgctgccccaaaaat

SEQ ID NO: 931702 - DNA, 25 bp, Mus musculus
ttcatcgagacggtgccccaaaaat

SEQ ID NO: 931703 - DNA, 25 bp, Mus musculus
ttcatcgatcgaaggcatccgcatt

SEQ ID NO: 931704 - DNA, 25 bp, Mus musculus
ttcatcgatcgatggcatccgcatt

SEQ ID NO: 931705 - DNA, 25 bp, Mus musculus
ttcatcgccaaactgtgtctccagc

SEQ ID NO: 931706 - DNA, 25 bp, Mus musculus
ttcatcgccaaagtgtgtctccagc

SEQ ID NO: 931707 - DNA, 25 bp, Mus musculus
ttcatcgctcacagtacgtcaaagg

SEQ ID NO: 931708 - DNA, 25 bp, Mus musculus
ttcatcgctcactgtacgtcaaagg

SEQ ID NO: 931709 - DNA, 25 bp, Mus musculus
ttcatcgctgaccttgtggtgggac

SEQ ID NO: 931710 - DNA, 25 bp, Mus musculus
ttcatcgctgacgttgtggtgggac

SEQ ID NO: 931711 - DNA, 25 bp, Mus musculus
ttcatcgctgtcagctctaaaggga

SEQ ID NO: 931712 - DNA, 25 bp, Mus musculus
ttcatcgctgtctgctctaaaggga

SEQ ID NO: 931713 - DNA, 25 bp, Mus musculus
ttcatcggctgaacctaggatctgg

SEQ ID NO: 931714 - DNA, 25 bp, Mus musculus
ttcatcggctgatcctaggatctgg

SEQ ID NO: 931715 - DNA, 25 bp, Mus musculus
ttcatcggcttgacctgggaacaca

SEQ ID NO: 931716 - DNA, 25 bp, Mus musculus
ttcatcggcttgtcctgggaacaca

SEQ ID NO: 931717 - DNA, 25 bp, Mus musculus
ttcatcggtacaaccttcctgctgg

SEQ ID NO: 931718 - DNA, 25 bp, Mus musculus
ttcatcggtacatccttcctgctgg

SEQ ID NO: 931719 - DNA, 25 bp, Mus musculus
ttcatcggtcccacagttttactat

SEQ ID NO: 931720 - DNA, 25 bp, Mus musculus
ttcatcggtccctcagttttactat

SEQ ID NO: 931721 - DNA, 25 bp, Mus musculus
ttcatcgtaatgcagggtaactatt

SEQ ID NO: 931722 - DNA, 25 bp, Mus musculus
ttcatcgtaatggagggtaactatt

SEQ ID NO: 931723 - DNA, 25 bp, Mus musculus
ttcatcgtcccaccctttagaggag

SEQ ID NO: 931724 - DNA, 25 bp, Mus musculus
ttcatcgtcccagcctttagaggag

SEQ ID NO: 931725 - DNA, 25 bp, Mus musculus
ttcatctaatctctgtcttttctgc

SEQ ID NO: 931726 - DNA, 25 bp, Mus musculus
ttcatctaatctgtgtcttttctgc

SEQ ID NO: 931727 - DNA, 25 bp, Mus musculus
ttcatctacactactccatcatagt

SEQ ID NO: 931728 - DNA, 25 bp, Mus musculus
ttcatctacacttctccatcatagt

SEQ ID NO: 931729 - DNA, 25 bp, Mus musculus
ttcatctaccccagtttattgactg

SEQ ID NO: 931730 - DNA, 25 bp, Mus musculus
ttcatctacccctgtttattgactg

SEQ ID NO: 931731 - DNA, 25 bp, Mus musculus
ttcatctacttcaacctgggtcagg

SEQ ID NO: 931732 - DNA, 25 bp, Mus musculus
ttcatctacttctacctgggtcagg

SEQ ID NO: 931733 - DNA, 25 bp, Mus musculus
ttcatctaggttcagcatcttaagc

SEQ ID NO: 931734 - DNA, 25 bp, Mus musculus
ttcatctaggttgagcatcttaagc

SEQ ID NO: 931735 - DNA, 25 bp, Mus musculus
ttcatctatagtccccggcttgcac

SEQ ID NO: 931736 - DNA, 25 bp, Mus musculus
ttcatctatagtgcccggcttgcac

SEQ ID NO: 931737 - DNA, 25 bp, Mus musculus
ttcatctatattccccagccaagaa

SEQ ID NO: 931738 - DNA, 25 bp, Mus musculus
ttcatctatattgcccagccaagaa

SEQ ID NO: 931739 - DNA, 25 bp, Mus musculus
ttcatctatcacagtgacttacaag

SEQ ID NO: 931740 - DNA, 25 bp, Mus musculus
ttcatctatcactgtgacttacaag

SEQ ID NO: 931741 - DNA, 25 bp, Mus musculus
ttcatctcaacacaacacagctaga

SEQ ID NO: 931742 - DNA, 25 bp, Mus musculus
ttcatctcaacagaacacagctaga

SEQ ID NO: 931743 - DNA, 25 bp, Mus musculus
ttcatctcacacagctctatgttta

SEQ ID NO: 931744 - DNA, 25 bp, Mus musculus
ttcatctcacactgctctatgttta

SEQ ID NO: 931745 - DNA, 25 bp, Mus musculus
ttcatctcatctcgaagcagcgctc

SEQ ID NO: 931746 - DNA, 25 bp, Mus musculus
ttcatctcatctggaagcagcgctc

SEQ ID NO: 931747 - DNA, 25 bp, Mus musculus
ttcatctcatgccagaaagccttga

SEQ ID NO: 931748 - DNA, 25 bp, Mus musculus
ttcatctcatgcgagaaagccttga

SEQ ID NO: 931749 - DNA, 25 bp, Mus musculus
ttcatctcccatacttgagaagcag

SEQ ID NO: 931750 - DNA, 25 bp, Mus musculus
ttcatctcccattcttgagaagcag

SEQ ID NO: 931751 - DNA, 25 bp, Mus musculus
ttcatctccctcaacatttgatcct

SEQ ID NO: 931752 - DNA, 25 bp, Mus musculus
ttcatctccctctacatttgatcct

SEQ ID NO: 931753 - DNA, 25 bp, Mus musculus
ttcatctccctgaggcacggaagta

SEQ ID NO: 931754 - DNA, 25 bp, Mus musculus
ttcatctccctgtggcacggaagta

SEQ ID NO: 931755 - DNA, 25 bp, Mus musculus
ttcatctccgctagtgtaatatttg

SEQ ID NO: 931756 - DNA, 25 bp, Mus musculus
ttcatctccgcttgtgtaatatttg

SEQ ID NO: 931757 - DNA, 25 bp, Mus musculus
ttcatctcctccccgggtgctagag

SEQ ID NO: 931758 - DNA, 25 bp, Mus musculus
ttcatctcctccgcgggtgctagag

SEQ ID NO: 931759 - DNA, 25 bp, Mus musculus
ttcatctcctttcactatttttacc

SEQ ID NO: 931760 - DNA, 25 bp, Mus musculus
ttcatctcctttgactatttttacc

SEQ ID NO: 931761 - DNA, 25 bp, Mus musculus
ttcatctctgacagacccttaggat

SEQ ID NO: 931762 - DNA, 25 bp, Mus musculus
ttcatctctgactgacccttaggat

SEQ ID NO: 931763 - DNA, 25 bp, Mus musculus
ttcatctctgatcgagtttcccctc

SEQ ID NO: 931764 - DNA, 25 bp, Mus musculus
ttcatctctgatggagtttcccctc

SEQ ID NO: 931765 - DNA, 25 bp, Mus musculus
ttcatctcttggattgtcttcagcc

SEQ ID NO: 931766 - DNA, 25 bp, Mus musculus
ttcatctcttggtttgtcttcagcc

SEQ ID NO: 931767 - DNA, 25 bp, Mus musculus
ttcatctgagtaaggagtcgctgcc

SEQ ID NO: 931768 - DNA, 25 bp, Mus musculus
ttcatctgagtatggagtcgctgcc

SEQ ID NO: 931769 - DNA, 25 bp, Mus musculus
ttcatctgatgaatttcaataaaac

SEQ ID NO: 931770 - DNA, 25 bp, Mus musculus
ttcatctgatgattttcaataaaac

SEQ ID NO: 931771 - DNA, 25 bp, Mus musculus
ttcatctgatggaggtgttctgtgc

SEQ ID NO: 931772 - DNA, 25 bp, Mus musculus
ttcatctgatggtggtgttctgtgc

SEQ ID NO: 931773 - DNA, 25 bp, Mus musculus
ttcatctgccagaagccctgaaacc

SEQ ID NO: 931774 - DNA, 25 bp, Mus musculus
ttcatctgccagtagccctgaaacc

SEQ ID NO: 931775 - DNA, 25 bp, Mus musculus
ttcatctgcctaagcctctaacagt

SEQ ID NO: 931776 - DNA, 25 bp, Mus musculus
ttcatctgcctatgcctctaacagt

SEQ ID NO: 931777 - DNA, 25 bp, Mus musculus
ttcatctgctataagaccagctgct

SEQ ID NO: 931778 - DNA, 25 bp, Mus musculus
ttcatctgctattagaccagctgct

SEQ ID NO: 931779 - DNA, 25 bp, Mus musculus
ttcatctggaacactcttgacttag

SEQ ID NO: 931780 - DNA, 25 bp, Mus musculus
ttcatctggaactctcttgacttag

SEQ ID NO: 931781 - DNA, 25 bp, Mus musculus
ttcatctgggtcctacgggagtaca

SEQ ID NO: 931782 - DNA, 25 bp, Mus musculus
ttcatctgggtcgtacgggagtaca

SEQ ID NO: 931783 - DNA, 25 bp, Mus musculus
ttcatctggttgacagttcgcgtcc

SEQ ID NO: 931784 - DNA, 25 bp, Mus musculus
ttcatctggttgtcagttcgcgtcc

SEQ ID NO: 931785 - DNA, 25 bp, Mus musculus
ttcatctgtaacactcccaacgtaa

SEQ ID NO: 931786 - DNA, 25 bp, Mus musculus
ttcatctgtaactctcccaacgtaa

SEQ ID NO: 931787 - DNA, 25 bp, Mus musculus
ttcatctgtaggactgaacatcctg

SEQ ID NO: 931788 - DNA, 25 bp, Mus musculus
ttcatctgtaggtctgaacatcctg

SEQ ID NO: 931789 - DNA, 25 bp, Mus musculus
ttcatctgtgttacacctttaccat

SEQ ID NO: 931790 - DNA, 25 bp, Mus musculus
ttcatctgtgtttcacctttaccat

SEQ ID NO: 931791 - DNA, 25 bp, Mus musculus
ttcatcttacaaactgcagttaaac

SEQ ID NO: 931792 - DNA, 25 bp, Mus musculus
ttcatcttacaatctgcagttaaac

SEQ ID NO: 931793 - DNA, 25 bp, Mus musculus
ttcatcttcacgcttaccattgggt

SEQ ID NO: 931794 - DNA, 25 bp, Mus musculus
ttcatcttcacggttaccattgggt

SEQ ID NO: 931795 - DNA, 25 bp, Mus musculus
ttcatcttcatgagtcgtctgcttc

SEQ ID NO: 931796 - DNA, 25 bp, Mus musculus
ttcatcttcatgtgtcgtctgcttc

SEQ ID NO: 931797 - DNA, 25 bp, Mus musculus
ttcatcttccagatccaggagccag

SEQ ID NO: 931798 - DNA, 25 bp, Mus musculus
ttcatcttccagttccaggagccag

SEQ ID NO: 931799 - DNA, 25 bp, Mus musculus
ttcatcttccggacagcagctggtt

SEQ ID NO: 931800 - DNA, 25 bp, Mus musculus
ttcatcttccggtcagcagctggtt

SEQ ID NO: 931801 - DNA, 25 bp, Mus musculus
ttcatcttccttaccaatgcctagg

SEQ ID NO: 931802 - DNA, 25 bp, Mus musculus
ttcatcttcctttccaatgcctagg

SEQ ID NO: 931803 - DNA, 25 bp, Mus musculus
ttcatcttctttaccgaacacaggc

SEQ ID NO: 931804 - DNA, 25 bp, Mus musculus
ttcatcttcttttccgaacacaggc

SEQ ID NO: 931805 - DNA, 25 bp, Mus musculus
ttcatcttgaggatgcctgtccaca

SEQ ID NO: 931806 - DNA, 25 bp, Mus musculus
ttcatcttgaggttgcctgtccaca

SEQ ID NO: 931807 - DNA, 25 bp, Mus musculus
ttcatcttgctgctggtctggatcc

SEQ ID NO: 931808 - DNA, 25 bp, Mus musculus
ttcatcttgctggtggtctggatcc

SEQ ID NO: 931809 - DNA, 25 bp, Mus musculus
ttcatcttggccatcccggaagcaa

SEQ ID NO: 931810 - DNA, 25 bp, Mus musculus
ttcatcttggccttcccggaagcaa

SEQ ID NO: 931811 - DNA, 25 bp, Mus musculus
ttcatcttgggcatccttatcatcc

SEQ ID NO: 931812 - DNA, 25 bp, Mus musculus
ttcatcttgggcttccttatcatcc

SEQ ID NO: 931813 - DNA, 25 bp, Mus musculus
ttcatcttggtcactcgcagaagta

SEQ ID NO: 931814 - DNA, 25 bp, Mus musculus
ttcatcttggtctctcgcagaagta

SEQ ID NO: 931815 - DNA, 25 bp, Mus musculus
ttcatcttgtacatggagcctcatt

SEQ ID NO: 931816 - DNA, 25 bp, Mus musculus
ttcatcttgtacttggagcctcatt

SEQ ID NO: 931817 - DNA, 25 bp, Mus musculus
ttcatctttaacatactggtgcagt

SEQ ID NO: 931818 - DNA, 25 bp, Mus musculus
ttcatctttaacttactggtgcagt

SEQ ID NO: 931819 - DNA, 25 bp, Mus musculus
ttcatctttcaacttgtagcaagct

SEQ ID NO: 931820 - DNA, 25 bp, Mus musculus
ttcatctttcaagttgtagcaagct

SEQ ID NO: 931821 - DNA, 25 bp, Mus musculus
ttcatctttgcaattaaaagctttc

SEQ ID NO: 931822 - DNA, 25 bp, Mus musculus
ttcatctttgcatttaaaagctttc

SEQ ID NO: 931823 - DNA, 25 bp, Mus musculus
ttcatctttgcgctgggccaatttg

SEQ ID NO: 931824 - DNA, 25 bp, Mus musculus
ttcatctttgcggtgggccaatttg

SEQ ID NO: 931825 - DNA, 25 bp, Mus musculus
ttcatctttgggaataaacattcat

SEQ ID NO: 931826 - DNA, 25 bp, Mus musculus
ttcatctttgggtataaacattcat

SEQ ID NO: 931827 - DNA, 25 bp, Mus musculus
ttcatctttttcatccggcttcacg

SEQ ID NO: 931828 - DNA, 25 bp, Mus musculus
ttcatctttttccatccggtaacca

SEQ ID NO: 931829 - DNA, 25 bp, Mus musculus
ttcatctttttcgatccggtaacca

SEQ ID NO: 931830 - DNA, 25 bp, Mus musculus
ttcatctttttcttccggcttcacg

SEQ ID NO: 931831 - DNA, 25 bp, Mus musculus
ttcatgaaaatccaaacacgttaag

SEQ ID NO: 931832 - DNA, 25 bp, Mus musculus
ttcatgaaaatcgaaacacgttaag

SEQ ID NO: 931833 - DNA, 25 bp, Mus musculus
ttcatgaaccatcgtcagccccaaa

SEQ ID NO: 931834 - DNA, 25 bp, Mus musculus
ttcatgaaccatggtcagccccaaa

SEQ ID NO: 931835 - DNA, 25 bp, Mus musculus
ttcatgaagattatggtccacacct

SEQ ID NO: 931836 - DNA, 25 bp, Mus musculus
ttcatgaagattttggtccacacct

SEQ ID NO: 931837 - DNA, 25 bp, Mus musculus
ttcatgaagcgcctgggtcttccag

SEQ ID NO: 931838 - DNA, 25 bp, Mus musculus
ttcatgaagcgcgtgggtcttccag

SEQ ID NO: 931839 - DNA, 25 bp, Mus musculus
ttcatgaagcgtaaccccaagggac

SEQ ID NO: 931840 - DNA, 25 bp, Mus musculus
ttcatgaagcgttaccccaagggac

SEQ ID NO: 931841 - DNA, 25 bp, Mus musculus
ttcatgaagctaatgcgagtctgca

SEQ ID NO: 931842 - DNA, 25 bp, Mus musculus
ttcatgaagctattgcgagtctgca

SEQ ID NO: 931843 - DNA, 25 bp, Mus musculus
ttcatgaagtcaaatctagccaatg

SEQ ID NO: 931844 - DNA, 25 bp, Mus musculus
ttcatgaagtcatatctagccaatg

SEQ ID NO: 931845 - DNA, 25 bp, Mus musculus
ttcatgaagtttacatacctttggg

SEQ ID NO: 931846 - DNA, 25 bp, Mus musculus
ttcatgaagttttcatacctttggg

SEQ ID NO: 931847 - DNA, 25 bp, Mus musculus
ttcatgaatcgtatcccaggagctt

SEQ ID NO: 931848 - DNA, 25 bp, Mus musculus
ttcatgaatcgtttcccaggagctt

SEQ ID NO: 931849 - DNA, 25 bp, Mus musculus
ttcatgaatggtcgcagctgactat

SEQ ID NO: 931850 - DNA, 25 bp, Mus musculus
ttcatgaatggtggcagctgactat

SEQ ID NO: 931851 - DNA, 25 bp, Mus musculus
ttcatgacaggccagtttccagagg

SEQ ID NO: 931852 - DNA, 25 bp, Mus musculus
ttcatgacaggcgagtttccagagg

SEQ ID NO: 931853 - DNA, 25 bp, Mus musculus
ttcatgaccctcattctctagcgtg

SEQ ID NO: 931854 - DNA, 25 bp, Mus musculus
ttcatgaccctctttctctagcgtg

SEQ ID NO: 931855 - DNA, 25 bp, Mus musculus
ttcatgacggacctgccagcaggtt

SEQ ID NO: 931856 - DNA, 25 bp, Mus musculus
ttcatgacggacgtgccagcaggtt

SEQ ID NO: 931857 - DNA, 25 bp, Mus musculus
ttcatgactgatctgcccaacagtc

SEQ ID NO: 931858 - DNA, 25 bp, Mus musculus
ttcatgactgatgtgcccaacagtc

SEQ ID NO: 931859 - DNA, 25 bp, Mus musculus
ttcatgagaagccaccaacctcagt

SEQ ID NO: 931860 - DNA, 25 bp, Mus musculus
ttcatgagaagcgaccaacctcagt

SEQ ID NO: 931861 - DNA, 25 bp, Mus musculus
ttcatgaggcgacaggtcttcaaat

SEQ ID NO: 931862 - DNA, 25 bp, Mus musculus
ttcatgaggcgagaggtcttcaaat

SEQ ID NO: 931863 - DNA, 25 bp, Mus musculus
ttcatgaggtcaccaatggcagcgt

SEQ ID NO: 931864 - DNA, 25 bp, Mus musculus
ttcatgaggtcagcaatggcagcgt

SEQ ID NO: 931865 - DNA, 25 bp, Mus musculus
ttcatgagtggcaacctgggctatt

SEQ ID NO: 931866 - DNA, 25 bp, Mus musculus
ttcatgagtggctacctgggctatt

SEQ ID NO: 931867 - DNA, 25 bp, Mus musculus
ttcatgatccagaccattgcgcagt

SEQ ID NO: 931868 - DNA, 25 bp, Mus musculus
ttcatgatccagtccattgcgcagt

SEQ ID NO: 931869 - DNA, 25 bp, Mus musculus
ttcatgatccttcaccttggacaaa

SEQ ID NO: 931870 - DNA, 25 bp, Mus musculus
ttcatgatccttgaccttggacaaa

SEQ ID NO: 931871 - DNA, 25 bp, Mus musculus
ttcatgatgaacactagcgcgggtc

SEQ ID NO: 931872 - DNA, 25 bp, Mus musculus
ttcatgatgaactctagcgcgggtc

SEQ ID NO: 931873 - DNA, 25 bp, Mus musculus
ttcatgatgatgatagaggatatca

SEQ ID NO: 931874 - DNA, 25 bp, Mus musculus
ttcatgatgatgttagaggatatca

SEQ ID NO: 931875 - DNA, 25 bp, Mus musculus
ttcatgatgcccagccttaccacag

SEQ ID NO: 931876 - DNA, 25 bp, Mus musculus
ttcatgatgccctgccttaccacag

SEQ ID NO: 931877 - DNA, 25 bp, Mus musculus
ttcatgattactacttttctgttgt

SEQ ID NO: 931878 - DNA, 25 bp, Mus musculus
ttcatgattacttcttttctgttgt

SEQ ID NO: 931879 - DNA, 25 bp, Mus musculus
ttcatgattcatatagggacctaga

SEQ ID NO: 931880 - DNA, 25 bp, Mus musculus
ttcatgattcatttagggacctaga

SEQ ID NO: 931881 - DNA, 25 bp, Mus musculus
ttcatgattcttctgattttcctgg

SEQ ID NO: 931882 - DNA, 25 bp, Mus musculus
ttcatgattcttgtgattttcctgg

SEQ ID NO: 931883 - DNA, 25 bp, Mus musculus
ttcatgattgccctgcgcctagtta

SEQ ID NO: 931884 - DNA, 25 bp, Mus musculus
ttcatgattgccgtgcgcctagtta

SEQ ID NO: 931885 - DNA, 25 bp, Mus musculus
ttcatgatttctcttggtcttcctt

SEQ ID NO: 931886 - DNA, 25 bp, Mus musculus
ttcatgatttctgttggtcttcctt

SEQ ID NO: 931887 - DNA, 25 bp, Mus musculus
ttcatgattttaaaaccacaacctt

SEQ ID NO: 931888 - DNA, 25 bp, Mus musculus
ttcatgattttataaccacaacctt

SEQ ID NO: 931889 - DNA, 25 bp, Mus musculus
ttcatgcaacttcccgagtttccaa

SEQ ID NO: 931890 - DNA, 25 bp, Mus musculus
ttcatgcaacttgccgagtttccaa

SEQ ID NO: 931891 - DNA, 25 bp, Mus musculus
ttcatgcacatcagagctgaccacc

SEQ ID NO: 931892 - DNA, 25 bp, Mus musculus
ttcatgcacatctgagctgaccacc

SEQ ID NO: 931893 - DNA, 25 bp, Mus musculus
ttcatgcacccacagcacagacaaa

SEQ ID NO: 931894 - DNA, 25 bp, Mus musculus
ttcatgcacccagagcacagacaaa

SEQ ID NO: 931895 - DNA, 25 bp, Mus musculus
ttcatgcaccctcaggcagggagtt

SEQ ID NO: 931896 - DNA, 25 bp, Mus musculus
ttcatgcaccctgaggcagggagtt

SEQ ID NO: 931897 - DNA, 25 bp, Mus musculus
ttcatgcacctacactccatatgtc

SEQ ID NO: 931898 - DNA, 25 bp, Mus musculus
ttcatgcacctagactccatatgtc

SEQ ID NO: 931899 - DNA, 25 bp, Mus musculus
ttcatgcactttactgtttctagta

SEQ ID NO: 931900 - DNA, 25 bp, Mus musculus
ttcatgcacttttctgtttctagta

SEQ ID NO: 931901 - DNA, 25 bp, Mus musculus
ttcatgcagaaccagggtgcacttt

SEQ ID NO: 931902 - DNA, 25 bp, Mus musculus
ttcatgcagaacgagggtgcacttt

SEQ ID NO: 931903 - DNA, 25 bp, Mus musculus
ttcatgcaggtaatagtgtgggttt

SEQ ID NO: 931904 - DNA, 25 bp, Mus musculus
ttcatgcaggtattagtgtgggttt

SEQ ID NO: 931905 - DNA, 25 bp, Mus musculus
ttcatgcatgcaatgggacctttct

SEQ ID NO: 931906 - DNA, 25 bp, Mus musculus
ttcatgcatgcattgggacctttct

SEQ ID NO: 931907 - DNA, 25 bp, Mus musculus
ttcatgcatgccaggaaagctctct

SEQ ID NO: 931908 - DNA, 25 bp, Mus musculus
ttcatgcatgcctggaaagctctct

SEQ ID NO: 931909 - DNA, 25 bp, Mus musculus
ttcatgcattctcgccccatagagt

SEQ ID NO: 931910 - DNA, 25 bp, Mus musculus
ttcatgcattctggccccatagagt

SEQ ID NO: 931911 - DNA, 25 bp, Mus musculus
ttcatgccaaagatcctgggcgtat

SEQ ID NO: 931912 - DNA, 25 bp, Mus musculus
ttcatgccaaagttcctgggcgtat

SEQ ID NO: 931913 - DNA, 25 bp, Mus musculus
ttcatgccagaacctgagctcaatt

SEQ ID NO: 931914 - DNA, 25 bp, Mus musculus
ttcatgccagaagctgagctcaatt

SEQ ID NO: 931915 - DNA, 25 bp, Mus musculus
ttcatgccaggaagcgcaagttgga

SEQ ID NO: 931916 - DNA, 25 bp, Mus musculus
ttcatgccaggatgcgcaagttgga

SEQ ID NO: 931917 - DNA, 25 bp, Mus musculus
ttcatgccattccagggcttgggtg

SEQ ID NO: 931918 - DNA, 25 bp, Mus musculus
ttcatgccattcgagggcttgggtg

SEQ ID NO: 931919 - DNA, 25 bp, Mus musculus
ttcatgccatttacggctggacgtc

SEQ ID NO: 931920 - DNA, 25 bp, Mus musculus
ttcatgccattttcggctggacgtc

SEQ ID NO: 931921 - DNA, 25 bp, Mus musculus
ttcatgcccaacactgccttttttc

SEQ ID NO: 931922 - DNA, 25 bp, Mus musculus
ttcatgcccaactctgccttttttc

SEQ ID NO: 931923 - DNA, 25 bp, Mus musculus
ttcatgcccgtcatgttctccctga

SEQ ID NO: 931924 - DNA, 25 bp, Mus musculus
ttcatgcccgtcttgttctccctga

SEQ ID NO: 931925 - DNA, 25 bp, Mus musculus
ttcatgccctataatctttgccctt

SEQ ID NO: 931926 - DNA, 25 bp, Mus musculus
ttcatgccctattatctttgccctt

SEQ ID NO: 931927 - DNA, 25 bp, Mus musculus
ttcatgccgcctctggtaatgcgta

SEQ ID NO: 931928 - DNA, 25 bp, Mus musculus
ttcatgccgcctgtggtaatgcgta

SEQ ID NO: 931929 - DNA, 25 bp, Mus musculus
ttcatgccgtacctgtgttacgttc

SEQ ID NO: 931930 - DNA, 25 bp, Mus musculus
ttcatgccgtacgtgtgttacgttc

SEQ ID NO: 931931 - DNA, 25 bp, Mus musculus
ttcatgcctgtaatttggaacttgg

SEQ ID NO: 931932 - DNA, 25 bp, Mus musculus
ttcatgcctgtattttggaacttgg

SEQ ID NO: 931933 - DNA, 25 bp, Mus musculus
ttcatgccttatatcactagtgttg

SEQ ID NO: 931934 - DNA, 25 bp, Mus musculus
ttcatgccttatttcactagtgttg

SEQ ID NO: 931935 - DNA, 25 bp, Mus musculus
ttcatgccttcccaccttgtgagtt

SEQ ID NO: 931936 - DNA, 25 bp, Mus musculus
ttcatgccttccgaccttgtgagtt

SEQ ID NO: 931937 - DNA, 25 bp, Mus musculus
ttcatgccttgtcttggcaacatga

SEQ ID NO: 931938 - DNA, 25 bp, Mus musculus
ttcatgccttgtgttggcaacatga

SEQ ID NO: 931939 - DNA, 25 bp, Mus musculus
ttcatgctaaaaacacacggcctat

SEQ ID NO: 931940 - DNA, 25 bp, Mus musculus
ttcatgctaaaatcacacggcctat

SEQ ID NO: 931941 - DNA, 25 bp, Mus musculus
ttcatgctaaacacccaataaggga

SEQ ID NO: 931942 - DNA, 25 bp, Mus musculus
ttcatgctaaactcccaataaggga

SEQ ID NO: 931943 - DNA, 25 bp, Mus musculus
ttcatgctaatgaagcaggcccttt

SEQ ID NO: 931944 - DNA, 25 bp, Mus musculus
ttcatgctaatgtagcaggcccttt

SEQ ID NO: 931945 - DNA, 25 bp, Mus musculus
ttcatgctagttacccagtgacttg

SEQ ID NO: 931946 - DNA, 25 bp, Mus musculus
ttcatgctagtttcccagtgacttg

SEQ ID NO: 931947 - DNA, 25 bp, Mus musculus
ttcatgctctagatgcctcgtctga

SEQ ID NO: 931948 - DNA, 25 bp, Mus musculus
ttcatgctctagttgcctcgtctga

SEQ ID NO: 931949 - DNA, 25 bp, Mus musculus
ttcatgctctgcactgtgacgatca

SEQ ID NO: 931950 - DNA, 25 bp, Mus musculus
ttcatgctctgctctgtgacgatca

SEQ ID NO: 931951 - DNA, 25 bp, Mus musculus
ttcatgctctggatagggtgaggtt

SEQ ID NO: 931952 - DNA, 25 bp, Mus musculus
ttcatgctctggttagggtgaggtt

SEQ ID NO: 931953 - DNA, 25 bp, Mus musculus
ttcatgctggaactctttatctggg

SEQ ID NO: 931954 - DNA, 25 bp, Mus musculus
ttcatgctggaagtctttatctggg

SEQ ID NO: 931955 - DNA, 25 bp, Mus musculus
ttcatgctggtactttttgtgtgga

SEQ ID NO: 931956 - DNA, 25 bp, Mus musculus
ttcatgctggtagtttttgtgtgga

SEQ ID NO: 931957 - DNA, 25 bp, Mus musculus
ttcatgcttagtacaggactgttac

SEQ ID NO: 931958 - DNA, 25 bp, Mus musculus
ttcatgcttagttcaggactgttac

SEQ ID NO: 931959 - DNA, 25 bp, Mus musculus
ttcatgcttcctcctccaaatagct

SEQ ID NO: 931960 - DNA, 25 bp, Mus musculus
ttcatgcttcctgctccaaatagct

SEQ ID NO: 931961 - DNA, 25 bp, Mus musculus
ttcatgcttgcaaactagaagacag

SEQ ID NO: 931962 - DNA, 25 bp, Mus musculus
ttcatgcttgcaaatttaataactt

SEQ ID NO: 931963 - DNA, 25 bp, Mus musculus
ttcatgcttgcatactagaagacag

SEQ ID NO: 931964 - DNA, 25 bp, Mus musculus
ttcatgcttgcatatttaataactt

SEQ ID NO: 931965 - DNA, 25 bp, Mus musculus
ttcatgctttccacatgcaacacta

SEQ ID NO: 931966 - DNA, 25 bp, Mus musculus
ttcatgctttcctcatgcaacacta

SEQ ID NO: 931967 - DNA, 25 bp, Mus musculus
ttcatggaaccaaatccagcctccg

SEQ ID NO: 931968 - DNA, 25 bp, Mus musculus
ttcatggaaccacagcgtcagaaga

SEQ ID NO: 931969 - DNA, 25 bp, Mus musculus
ttcatggaaccagagcgtcagaaga

SEQ ID NO: 931970 - DNA, 25 bp, Mus musculus
ttcatggaaccatatccagcctccg

SEQ ID NO: 931971 - DNA, 25 bp, Mus musculus
ttcatggaatcaaacacgccacggg

SEQ ID NO: 931972 - DNA, 25 bp, Mus musculus
ttcatggaatcatacacgccacggg

SEQ ID NO: 931973 - DNA, 25 bp, Mus musculus
ttcatggaatgtcaaatcgcctatg

SEQ ID NO: 931974 - DNA, 25 bp, Mus musculus
ttcatggaatgtgaaatcgcctatg

SEQ ID NO: 931975 - DNA, 25 bp, Mus musculus
ttcatggagacccagacgttccgtg

SEQ ID NO: 931976 - DNA, 25 bp, Mus musculus
ttcatggagaccgagacgttccgtg

SEQ ID NO: 931977 - DNA, 25 bp, Mus musculus
ttcatggagactaataaccaaaagt

SEQ ID NO: 931978 - DNA, 25 bp, Mus musculus
ttcatggagacttataaccaaaagt

SEQ ID NO: 931979 - DNA, 25 bp, Mus musculus
ttcatggagcagagcgaggaactgt

SEQ ID NO: 931980 - DNA, 25 bp, Mus musculus
ttcatggagcagtgcgaggaactgt

SEQ ID NO: 931981 - DNA, 25 bp, Mus musculus
ttcatggagcatcggagcacaacct

SEQ ID NO: 931982 - DNA, 25 bp, Mus musculus
ttcatggagcatgggagcacaacct

SEQ ID NO: 931983 - DNA, 25 bp, Mus musculus
ttcatggaggagagtgtgggctgcc

SEQ ID NO: 931984 - DNA, 25 bp, Mus musculus
ttcatggaggagtgtgtgggctgcc

SEQ ID NO: 931985 - DNA, 25 bp, Mus musculus
ttcatggaggtgatggctctgcttc

SEQ ID NO: 931986 - DNA, 25 bp, Mus musculus
ttcatggaggtgttggctctgcttc

SEQ ID NO: 931987 - DNA, 25 bp, Mus musculus
ttcatggagtacctggcagccctca

SEQ ID NO: 931988 - DNA, 25 bp, Mus musculus
ttcatggagtacgtggcagccctca

SEQ ID NO: 931989 - DNA, 25 bp, Mus musculus
ttcatggagtgaaaccctgctttgc

SEQ ID NO: 931990 - DNA, 25 bp, Mus musculus
ttcatggagtgaatatgttgataat

SEQ ID NO: 931991 - DNA, 25 bp, Mus musculus
ttcatggagtgataccctgctttgc

SEQ ID NO: 931992 - DNA, 25 bp, Mus musculus
ttcatggagtgattatgttgataat

SEQ ID NO: 931993 - DNA, 25 bp, Mus musculus
ttcatggatgctaggattgtttctc

SEQ ID NO: 931994 - DNA, 25 bp, Mus musculus
ttcatggatgcttggattgtttctc

SEQ ID NO: 931995 - DNA, 25 bp, Mus musculus
ttcatggccattcgaatgggcatac

SEQ ID NO: 931996 - DNA, 25 bp, Mus musculus
ttcatggccattggaatgggcatac

SEQ ID NO: 931997 - DNA, 25 bp, Mus musculus
ttcatggccccgaaagcgtggaaag

SEQ ID NO: 931998 - DNA, 25 bp, Mus musculus
ttcatggccccgtaagcgtggaaag

SEQ ID NO: 931999 - DNA, 25 bp, Mus musculus
ttcatggcctctattcattggttga

SEQ ID NO: 932000 - DNA, 25 bp, Mus musculus
ttcatggcctcttttcattggttga

SEQ ID NO: 932001 - DNA, 25 bp, Mus musculus
ttcatggcgtatctgtacccctgaa

SEQ ID NO: 932002 - DNA, 25 bp, Mus musculus
ttcatggcgtatgtgtacccctgaa

SEQ ID NO: 932003 - DNA, 25 bp, Mus musculus
ttcatggctctaccagcatatggag

SEQ ID NO: 932004 - DNA, 25 bp, Mus musculus
ttcatggctctagcagcatatggag

SEQ ID NO: 932005 - DNA, 25 bp, Mus musculus
ttcatggcttctcgatactgcaggg

SEQ ID NO: 932006 - DNA, 25 bp, Mus musculus
ttcatggcttctggatactgcaggg

SEQ ID NO: 932007 - DNA, 25 bp, Mus musculus
ttcatgggaagccactttgacaggc

SEQ ID NO: 932008 - DNA, 25 bp, Mus musculus
ttcatgggaagcgactttgacaggc

SEQ ID NO: 932009 - DNA, 25 bp, Mus musculus
ttcatgggacacaatcaaagctgtt

SEQ ID NO: 932010 - DNA, 25 bp, Mus musculus
ttcatgggacactatcaaagctgtt

SEQ ID NO: 932011 - DNA, 25 bp, Mus musculus
ttcatgggactgaacctggagtggc

SEQ ID NO: 932012 - DNA, 25 bp, Mus musculus
ttcatgggactgtacctggagtggc

SEQ ID NO: 932013 - DNA, 25 bp, Mus musculus
ttcatgggtctcacagttctatgtt

SEQ ID NO: 932014 - DNA, 25 bp, Mus musculus
ttcatgggtctctcagttctatgtt

SEQ ID NO: 932015 - DNA, 25 bp, Mus musculus
ttcatgggtgatatcaacgccggct

SEQ ID NO: 932016 - DNA, 25 bp, Mus musculus
ttcatgggtgatttcaacgccggct

SEQ ID NO: 932017 - DNA, 25 bp, Mus musculus
ttcatggtaattcaccctgtgggtc

SEQ ID NO: 932018 - DNA, 25 bp, Mus musculus
ttcatggtaattgaccctgtgggtc

SEQ ID NO: 932019 - DNA, 25 bp, Mus musculus
ttcatggtactgattaggcccctag

SEQ ID NO: 932020 - DNA, 25 bp, Mus musculus
ttcatggtactgtttaggcccctag

SEQ ID NO: 932021 - DNA, 25 bp, Mus musculus
ttcatggtatttatctcaacagtag

SEQ ID NO: 932022 - DNA, 25 bp, Mus musculus
ttcatggtatttttctcaacagtag

SEQ ID NO: 932023 - DNA, 25 bp, Mus musculus
ttcatggtcactaatagtttgctgt

SEQ ID NO: 932024 - DNA, 25 bp, Mus musculus
ttcatggtcacttatagtttgctgt

SEQ ID NO: 932025 - DNA, 25 bp, Mus musculus
ttcatggtcagtctcttttgatttt

SEQ ID NO: 932026 - DNA, 25 bp, Mus musculus
ttcatggtcagtgtcttttgatttt

SEQ ID NO: 932027 - DNA, 25 bp, Mus musculus
ttcatggtcatgatcgtcatccggt

SEQ ID NO: 932028 - DNA, 25 bp, Mus musculus
ttcatggtcatgttcgtcatccggt

SEQ ID NO: 932029 - DNA, 25 bp, Mus musculus
ttcatggtgactaatgagcttccta

SEQ ID NO: 932030 - DNA, 25 bp, Mus musculus
ttcatggtgacttatgagcttccta

SEQ ID NO: 932031 - DNA, 25 bp, Mus musculus
ttcatggtgccaagcggtagaagac

SEQ ID NO: 932032 - DNA, 25 bp, Mus musculus
ttcatggtgccatgcggtagaagac

SEQ ID NO: 932033 - DNA, 25 bp, Mus musculus
ttcatggtgcggctctatacagggt

SEQ ID NO: 932034 - DNA, 25 bp, Mus musculus
ttcatggtgcgggtctatacagggt

SEQ ID NO: 932035 - DNA, 25 bp, Mus musculus
ttcatggtgttcatagttcccagcc

SEQ ID NO: 932036 - DNA, 25 bp, Mus musculus
ttcatggtgttcttagttcccagcc

SEQ ID NO: 932037 - DNA, 25 bp, Mus musculus
ttcatggtgttgctatctaaaattg

SEQ ID NO: 932038 - DNA, 25 bp, Mus musculus
ttcatggtgttggtatctaaaattg

SEQ ID NO: 932039 - DNA, 25 bp, Mus musculus
ttcatggttgtcctctctctttact

SEQ ID NO: 932040 - DNA, 25 bp, Mus musculus
ttcatggttgtcgtctctctttact

SEQ ID NO: 932041 - DNA, 25 bp, Mus musculus
ttcatggttttgactccctattcat

SEQ ID NO: 932042 - DNA, 25 bp, Mus musculus
ttcatggttttgtctccctattcat

SEQ ID NO: 932043 - DNA, 25 bp, Mus musculus
ttcatgtaagctctaggctacaagt

SEQ ID NO: 932044 - DNA, 25 bp, Mus musculus
ttcatgtaagctgtaggctacaagt

SEQ ID NO: 932045 - DNA, 25 bp, Mus musculus
ttcatgtacaggcaataagcatccc

SEQ ID NO: 932046 - DNA, 25 bp, Mus musculus
ttcatgtacagggaataagcatccc

SEQ ID NO: 932047 - DNA, 25 bp, Mus musculus
ttcatgtacctgcacatgtgacctt

SEQ ID NO: 932048 - DNA, 25 bp, Mus musculus
ttcatgtacctggacatgtgacctt

SEQ ID NO: 932049 - DNA, 25 bp, Mus musculus
ttcatgtactggaaagctgtcattc

SEQ ID NO: 932050 - DNA, 25 bp, Mus musculus
ttcatgtactggtaagctgtcattc

SEQ ID NO: 932051 - DNA, 25 bp, Mus musculus
ttcatgtagctgcaacctaccttct

SEQ ID NO: 932052 - DNA, 25 bp, Mus musculus
ttcatgtagctggaacctaccttct

SEQ ID NO: 932053 - DNA, 25 bp, Mus musculus
ttcatgtatccacttggcgcctaga

SEQ ID NO: 932054 - DNA, 25 bp, Mus musculus
ttcatgtatccagttggcgcctaga

SEQ ID NO: 932055 - DNA, 25 bp, Mus musculus
ttcatgtcaactactactatgtcag

SEQ ID NO: 932056 - DNA, 25 bp, Mus musculus
ttcatgtcaacttctactatgtcag

SEQ ID NO: 932057 - DNA, 25 bp, Mus musculus
ttcatgtcagacctcaatgacccct

SEQ ID NO: 932058 - DNA, 25 bp, Mus musculus
ttcatgtcagacgtcaatgacccct

SEQ ID NO: 932059 - DNA, 25 bp, Mus musculus
ttcatgtccatcactgtagcaatac

SEQ ID NO: 932060 - DNA, 25 bp, Mus musculus
ttcatgtccatctctgtagcaatac

SEQ ID NO: 932061 - DNA, 25 bp, Mus musculus
ttcatgtcccctaaatattctttgt

SEQ ID NO: 932062 - DNA, 25 bp, Mus musculus
ttcatgtccccttaatattctttgt

SEQ ID NO: 932063 - DNA, 25 bp, Mus musculus
ttcatgtctctacttggagcctgag

SEQ ID NO: 932064 - DNA, 25 bp, Mus musculus
ttcatgtctctagttggagcctgag

SEQ ID NO: 932065 - DNA, 25 bp, Mus musculus
ttcatgtcttgaatccttggccctg

SEQ ID NO: 932066 - DNA, 25 bp, Mus musculus
ttcatgtcttgattccttggccctg

SEQ ID NO: 932067 - DNA, 25 bp, Mus musculus
ttcatgtcttgcattttgtctctag

SEQ ID NO: 932068 - DNA, 25 bp, Mus musculus
ttcatgtcttgctttttgtctctag

SEQ ID NO: 932069 - DNA, 25 bp, Mus musculus
ttcatgtgactgagacaccttgact

SEQ ID NO: 932070 - DNA, 25 bp, Mus musculus
ttcatgtgactgtgacaccttgact

SEQ ID NO: 932071 - DNA, 25 bp, Mus musculus
ttcatgtgcggcaattgtcgtcaac

SEQ ID NO: 932072 - DNA, 25 bp, Mus musculus
ttcatgtgcggctattgtcgtcaac

SEQ ID NO: 932073 - DNA, 25 bp, Mus musculus
ttcatgtggattaaggctgttttca

SEQ ID NO: 932074 - DNA, 25 bp, Mus musculus
ttcatgtggatttaggctgttttca

SEQ ID NO: 932075 - DNA, 25 bp, Mus musculus
ttcatgtgggaaacaggctgcctct

SEQ ID NO: 932076 - DNA, 25 bp, Mus musculus
ttcatgtgggaatcaggctgcctct

SEQ ID NO: 932077 - DNA, 25 bp, Mus musculus
ttcatgtgtggtatccacggaggcc

SEQ ID NO: 932078 - DNA, 25 bp, Mus musculus
ttcatgtgtggtttccacggaggcc

SEQ ID NO: 932079 - DNA, 25 bp, Mus musculus
ttcatgtgtttgatgcctgtggcac

SEQ ID NO: 932080 - DNA, 25 bp, Mus musculus
ttcatgtgtttgttgcctgtggcac

SEQ ID NO: 932081 - DNA, 25 bp, Mus musculus
ttcatgttcagaaagggcccggcgt

SEQ ID NO: 932082 - DNA, 25 bp, Mus musculus
ttcatgttcagatagggcccggcgt

SEQ ID NO: 932083 - DNA, 25 bp, Mus musculus
ttcatgttctacataatcctctcaa

SEQ ID NO: 932084 - DNA, 25 bp, Mus musculus
ttcatgttctacttaatcctctcaa

SEQ ID NO: 932085 - DNA, 25 bp, Mus musculus
ttcatgttcttcaggtacgagctct

SEQ ID NO: 932086 - DNA, 25 bp, Mus musculus
ttcatgttcttctggtacgagctct

SEQ ID NO: 932087 - DNA, 25 bp, Mus musculus
ttcatgttctttccttgttcccagg

SEQ ID NO: 932088 - DNA, 25 bp, Mus musculus
ttcatgttctttgcttgttcccagg

SEQ ID NO: 932089 - DNA, 25 bp, Mus musculus
ttcatgttgctcctctgcagaacgg

SEQ ID NO: 932090 - DNA, 25 bp, Mus musculus
ttcatgttgctcgtctgcagaacgg

SEQ ID NO: 932091 - DNA, 25 bp, Mus musculus
ttcatgttgtgaaactctgcaaacg

SEQ ID NO: 932092 - DNA, 25 bp, Mus musculus
ttcatgttgtgatactctgcaaacg

SEQ ID NO: 932093 - DNA, 25 bp, Mus musculus
ttcatgtttaataacccttgggaag

SEQ ID NO: 932094 - DNA, 25 bp, Mus musculus
ttcatgtttaattacccttgggaag

SEQ ID NO: 932095 - DNA, 25 bp, Mus musculus
ttcatgtttctaattcattcttcct

SEQ ID NO: 932096 - DNA, 25 bp, Mus musculus
ttcatgtttctatttcattcttcct

SEQ ID NO: 932097 - DNA, 25 bp, Mus musculus
ttcatgtttctcatcagtcagaggc

SEQ ID NO: 932098 - DNA, 25 bp, Mus musculus
ttcatgtttctcttcagtcagaggc

SEQ ID NO: 932099 - DNA, 25 bp, Mus musculus
ttcatgtttcttacatgagctcccc

SEQ ID NO: 932100 - DNA, 25 bp, Mus musculus
ttcatgtttctttcatgagctcccc

SEQ ID NO: 932101 - DNA, 25 bp, Mus musculus
ttcatgtttgccaactgggccacag

SEQ ID NO: 932102 - DNA, 25 bp, Mus musculus
ttcatgtttgcctactgggccacag

SEQ ID NO: 932103 - DNA, 25 bp, Mus musculus
ttcatgtttttgcagtggcaccctt

SEQ ID NO: 932104 - DNA, 25 bp, Mus musculus
ttcatgtttttggagtggcaccctt

SEQ ID NO: 932105 - DNA, 25 bp, Mus musculus
ttcattaaccccacatccgatagag

SEQ ID NO: 932106 - DNA, 25 bp, Mus musculus
ttcattaacccctcatccgatagag

SEQ ID NO: 932107 - DNA, 25 bp, Mus musculus
ttcattaatctcaatccttcaacct

SEQ ID NO: 932108 - DNA, 25 bp, Mus musculus
ttcattaatctctatccttcaacct

SEQ ID NO: 932109 - DNA, 25 bp, Mus musculus
ttcattaccacgatggaggaggata

SEQ ID NO: 932110 - DNA, 25 bp, Mus musculus
ttcattaccacgttggaggaggata

SEQ ID NO: 932111 - DNA, 25 bp, Mus musculus
ttcattaccatcaagaatcgcgagt

SEQ ID NO: 932112 - DNA, 25 bp, Mus musculus
ttcattaccatctagaatcgcgagt

SEQ ID NO: 932113 - DNA, 25 bp, Mus musculus
ttcattactaatcccttgagccatc

SEQ ID NO: 932114 - DNA, 25 bp, Mus musculus
ttcattactaatgccttgagccatc

SEQ ID NO: 932115 - DNA, 25 bp, Mus musculus
ttcattactttgatcccagcctcat

SEQ ID NO: 932116 - DNA, 25 bp, Mus musculus
ttcattactttgttcccagcctcat

SEQ ID NO: 932117 - DNA, 25 bp, Mus musculus
ttcattagccaaaaaattgcttcaa

SEQ ID NO: 932118 - DNA, 25 bp, Mus musculus
ttcattagccaataaattgcttcaa

SEQ ID NO: 932119 - DNA, 25 bp, Mus musculus
ttcattataggcaagcatgcttgtt

SEQ ID NO: 932120 - DNA, 25 bp, Mus musculus
ttcattataggctagcatgcttgtt

SEQ ID NO: 932121 - DNA, 25 bp, Mus musculus
ttcattattggaaagagacagccca

SEQ ID NO: 932122 - DNA, 25 bp, Mus musculus
ttcattattggatagagacagccca

SEQ ID NO: 932123 - DNA, 25 bp, Mus musculus
ttcattattgtactggccctttcta

SEQ ID NO: 932124 - DNA, 25 bp, Mus musculus
ttcattattgtagtggccctttcta

SEQ ID NO: 932125 - DNA, 25 bp, Mus musculus
ttcattattttcagctcagccacca

SEQ ID NO: 932126 - DNA, 25 bp, Mus musculus
ttcattattttccttccctccactt

SEQ ID NO: 932127 - DNA, 25 bp, Mus musculus
ttcattattttcgttccctccactt

SEQ ID NO: 932128 - DNA, 25 bp, Mus musculus
ttcattattttctgctcagccacca

SEQ ID NO: 932129 - DNA, 25 bp, Mus musculus
ttcattcaaaatcctgcctttagtg

SEQ ID NO: 932130 - DNA, 25 bp, Mus musculus
ttcattcaaaatgctgcctttagtg

SEQ ID NO: 932131 - DNA, 25 bp, Mus musculus
ttcattcaacaaacccagtgacctg

SEQ ID NO: 932132 - DNA, 25 bp, Mus musculus
ttcattcaacaatcccagtgacctg

SEQ ID NO: 932133 - DNA, 25 bp, Mus musculus
ttcattcacacaaaatagagccgga

SEQ ID NO: 932134 - DNA, 25 bp, Mus musculus
ttcattcacacactcattgccaggg

SEQ ID NO: 932135 - DNA, 25 bp, Mus musculus
ttcattcacacagtcattgccaggg

SEQ ID NO: 932136 - DNA, 25 bp, Mus musculus
ttcattcacacataatagagccgga

SEQ ID NO: 932137 - DNA, 25 bp, Mus musculus
ttcattcaccggcaaaacgaaagat

SEQ ID NO: 932138 - DNA, 25 bp, Mus musculus
ttcattcaccgggaaaacgaaagat

SEQ ID NO: 932139 - DNA, 25 bp, Mus musculus
ttcattcactcaatactacctctga

SEQ ID NO: 932140 - DNA, 25 bp, Mus musculus
ttcattcactcattactacctctga

SEQ ID NO: 932141 - DNA, 25 bp, Mus musculus
ttcattcactccatttcgcttttta

SEQ ID NO: 932142 - DNA, 25 bp, Mus musculus
ttcattcactccttttcgcttttta

SEQ ID NO: 932143 - DNA, 25 bp, Mus musculus
ttcattcactgtcctcacatttgag

SEQ ID NO: 932144 - DNA, 25 bp, Mus musculus
ttcattcactgtgctcacatttgag

SEQ ID NO: 932145 - DNA, 25 bp, Mus musculus
ttcattcacttgcaactgttttctt

SEQ ID NO: 932146 - DNA, 25 bp, Mus musculus
ttcattcacttggaactgttttctt

SEQ ID NO: 932147 - DNA, 25 bp, Mus musculus
ttcattcagaatatcctcattcccc

SEQ ID NO: 932148 - DNA, 25 bp, Mus musculus
ttcattcagaatttcctcattcccc

SEQ ID NO: 932149 - DNA, 25 bp, Mus musculus
ttcattcagcctagggaagtcaatt

SEQ ID NO: 932150 - DNA, 25 bp, Mus musculus
ttcattcagccttgggaagtcaatt

SEQ ID NO: 932151 - DNA, 25 bp, Mus musculus
ttcattcagtgtcttgcctgtgctt

SEQ ID NO: 932152 - DNA, 25 bp, Mus musculus
ttcattcagtgtgttgcctgtgctt

SEQ ID NO: 932153 - DNA, 25 bp, Mus musculus
ttcattcataaaaccgagcccgcat

SEQ ID NO: 932154 - DNA, 25 bp, Mus musculus
ttcattcataaatccgagcccgcat

SEQ ID NO: 932155 - DNA, 25 bp, Mus musculus
ttcattcatacaattgcctcattga

SEQ ID NO: 932156 - DNA, 25 bp, Mus musculus
ttcattcatacatttgcctcattga

SEQ ID NO: 932157 - DNA, 25 bp, Mus musculus
ttcattcatagtagctcttccaggg

SEQ ID NO: 932158 - DNA, 25 bp, Mus musculus
ttcattcatagttgctcttccaggg

SEQ ID NO: 932159 - DNA, 25 bp, Mus musculus
ttcattcatcctagcctggattgag

SEQ ID NO: 932160 - DNA, 25 bp, Mus musculus
ttcattcatccttgcctggattgag

SEQ ID NO: 932161 - DNA, 25 bp, Mus musculus
ttcattcattctcgagtcagcctgg

SEQ ID NO: 932162 - DNA, 25 bp, Mus musculus
ttcattcattctggagtcagcctgg

SEQ ID NO: 932163 - DNA, 25 bp, Mus musculus
ttcattcattgacacttcagattgg

SEQ ID NO: 932164 - DNA, 25 bp, Mus musculus
ttcattcattgagacttcagattgg

SEQ ID NO: 932165 - DNA, 25 bp, Mus musculus
ttcattcattggacgatagagtctc

SEQ ID NO: 932166 - DNA, 25 bp, Mus musculus
ttcattcattggtcgatagagtctc

SEQ ID NO: 932167 - DNA, 25 bp, Mus musculus
ttcattccaaaaccacaccatagtg

SEQ ID NO: 932168 - DNA, 25 bp, Mus musculus
ttcattccaaaagcacaccatagtg

SEQ ID NO: 932169 - DNA, 25 bp, Mus musculus
ttcattccaggtactagagctttct

SEQ ID NO: 932170 - DNA, 25 bp, Mus musculus
ttcattccaggttctagagctttct

SEQ ID NO: 932171 - DNA, 25 bp, Mus musculus
ttcattccccaaacgatggagcagt

SEQ ID NO: 932172 - DNA, 25 bp, Mus musculus
ttcattccccaactgctggctgctg

SEQ ID NO: 932173 - DNA, 25 bp, Mus musculus
ttcattccccaagtgctggctgctg

SEQ ID NO: 932174 - DNA, 25 bp, Mus musculus
ttcattccccaatcgatggagcagt

SEQ ID NO: 932175 - DNA, 25 bp, Mus musculus
ttcattccccagatcaaactcaagt

SEQ ID NO: 932176 - DNA, 25 bp, Mus musculus
ttcattccccagttcaaactcaagt

SEQ ID NO: 932177 - DNA, 25 bp, Mus musculus
ttcattccccttcctttgacttaag

SEQ ID NO: 932178 - DNA, 25 bp, Mus musculus
ttcattccccttgctttgacttaag

SEQ ID NO: 932179 - DNA, 25 bp, Mus musculus
ttcattcccgtacacttacttctgt

SEQ ID NO: 932180 - DNA, 25 bp, Mus musculus
ttcattcccgtagacttacttctgt

SEQ ID NO: 932181 - DNA, 25 bp, Mus musculus
ttcattcccttcaggaaccggtact

SEQ ID NO: 932182 - DNA, 25 bp, Mus musculus
ttcattcccttctggaaccggtact

SEQ ID NO: 932183 - DNA, 25 bp, Mus musculus
ttcattccgagcaatcaacatatgg

SEQ ID NO: 932184 - DNA, 25 bp, Mus musculus
ttcattccgagctatcaacatatgg

SEQ ID NO: 932185 - DNA, 25 bp, Mus musculus
ttcattccgcatctgtcttccaagt

SEQ ID NO: 932186 - DNA, 25 bp, Mus musculus
ttcattccgcatgtgtcttccaagt

SEQ ID NO: 932187 - DNA, 25 bp, Mus musculus
ttcattccgcgccagtgcaaagcgc

SEQ ID NO: 932188 - DNA, 25 bp, Mus musculus
ttcattccgcgcgagtgcaaagcgc

SEQ ID NO: 932189 - DNA, 25 bp, Mus musculus
ttcattcctaacaataccttaccag

SEQ ID NO: 932190 - DNA, 25 bp, Mus musculus
ttcattcctaactataccttaccag

SEQ ID NO: 932191 - DNA, 25 bp, Mus musculus
ttcattcctaatacctccaaggtac

SEQ ID NO: 932192 - DNA, 25 bp, Mus musculus
ttcattcctaattcctccaaggtac

SEQ ID NO: 932193 - DNA, 25 bp, Mus musculus
ttcattcctcagaagtgttagtatc

SEQ ID NO: 932194 - DNA, 25 bp, Mus musculus
ttcattcctcagtagtgttagtatc

SEQ ID NO: 932195 - DNA, 25 bp, Mus musculus
ttcattcctgatacgcctctaattt

SEQ ID NO: 932196 - DNA, 25 bp, Mus musculus
ttcattcctgattcgcctctaattt

SEQ ID NO: 932197 - DNA, 25 bp, Mus musculus
ttcattcctgctatatggttccata

SEQ ID NO: 932198 - DNA, 25 bp, Mus musculus
ttcattcctgctttatggttccata

SEQ ID NO: 932199 - DNA, 25 bp, Mus musculus
ttcattcctgtacccgtcatggtca

SEQ ID NO: 932200 - DNA, 25 bp, Mus musculus
ttcattcctgtagccgtcatggtca

SEQ ID NO: 932201 - DNA, 25 bp, Mus musculus
ttcattcctgtccaaggcttagtgg

SEQ ID NO: 932202 - DNA, 25 bp, Mus musculus
ttcattcctgtcgaaggcttagtgg

SEQ ID NO: 932203 - DNA, 25 bp, Mus musculus
ttcattcggcaccacagggaccagt

SEQ ID NO: 932204 - DNA, 25 bp, Mus musculus
ttcattcggcacgacagggaccagt

SEQ ID NO: 932205 - DNA, 25 bp, Mus musculus
ttcattctagatcagctaacttatt

SEQ ID NO: 932206 - DNA, 25 bp, Mus musculus
ttcattctagatgagctaacttatt

SEQ ID NO: 932207 - DNA, 25 bp, Mus musculus
ttcattctatcacaagcctccgtga

SEQ ID NO: 932208 - DNA, 25 bp, Mus musculus
ttcattctatcagaagcctccgtga

SEQ ID NO: 932209 - DNA, 25 bp, Mus musculus
ttcattctatgtccccaattgtcaa

SEQ ID NO: 932210 - DNA, 25 bp, Mus musculus
ttcattctatgtgcccaattgtcaa

SEQ ID NO: 932211 - DNA, 25 bp, Mus musculus
ttcattctcctgaggctgtgttgta

SEQ ID NO: 932212 - DNA, 25 bp, Mus musculus
ttcattctcctgtggctgtgttgta

SEQ ID NO: 932213 - DNA, 25 bp, Mus musculus
ttcattctcttacagccagcaagca

SEQ ID NO: 932214 - DNA, 25 bp, Mus musculus
ttcattctcttagagccagcaagca

SEQ ID NO: 932215 - DNA, 25 bp, Mus musculus
ttcattctcttcagtcatttctcag

SEQ ID NO: 932216 - DNA, 25 bp, Mus musculus
ttcattctcttctgtcatttctcag

SEQ ID NO: 932217 - DNA, 25 bp, Mus musculus
ttcattctgaatctgtccataccat

SEQ ID NO: 932218 - DNA, 25 bp, Mus musculus
ttcattctgaatgtgtccataccat

SEQ ID NO: 932219 - DNA, 25 bp, Mus musculus
ttcattctgcagcttccttgtggat

SEQ ID NO: 932220 - DNA, 25 bp, Mus musculus
ttcattctgcaggttccttgtggat

SEQ ID NO: 932221 - DNA, 25 bp, Mus musculus
ttcattctgcttaagaacgcaagct

SEQ ID NO: 932222 - DNA, 25 bp, Mus musculus
ttcattctgctttagaacgcaagct

SEQ ID NO: 932223 - DNA, 25 bp, Mus musculus
ttcattctggatacgacatggctac

SEQ ID NO: 932224 - DNA, 25 bp, Mus musculus
ttcattctggattcgacatggctac

SEQ ID NO: 932225 - DNA, 25 bp, Mus musculus
ttcattctgtcaatgtggcctgtca

SEQ ID NO: 932226 - DNA, 25 bp, Mus musculus
ttcattctgtcattgtggcctgtca

SEQ ID NO: 932227 - DNA, 25 bp, Mus musculus
ttcattctgttcacccagttttaca

SEQ ID NO: 932228 - DNA, 25 bp, Mus musculus
ttcattctgttctcccagttttaca

SEQ ID NO: 932229 - DNA, 25 bp, Mus musculus
ttcattcttagcacctgtagactgg

SEQ ID NO: 932230 - DNA, 25 bp, Mus musculus
ttcattcttagctcctgtagactgg

SEQ ID NO: 932231 - DNA, 25 bp, Mus musculus
ttcattcttccacatgcagctagaa

SEQ ID NO: 932232 - DNA, 25 bp, Mus musculus
ttcattcttccagatgcagctagaa

SEQ ID NO: 932233 - DNA, 25 bp, Mus musculus
ttcattcttcctcctacagtgaaag

SEQ ID NO: 932234 - DNA, 25 bp, Mus musculus
ttcattcttcctgctacagtgaaag

SEQ ID NO: 932235 - DNA, 25 bp, Mus musculus
ttcattcttgaacagcatgggacag

SEQ ID NO: 932236 - DNA, 25 bp, Mus musculus
ttcattcttgaagagcatgggacag

SEQ ID NO: 932237 - DNA, 25 bp, Mus musculus
ttcattcttgcgataatgccttgta

SEQ ID NO: 932238 - DNA, 25 bp, Mus musculus
ttcattcttgcgttaatgccttgta

SEQ ID NO: 932239 - DNA, 25 bp, Mus musculus
ttcattcttgctatgggcactggct

SEQ ID NO: 932240 - DNA, 25 bp, Mus musculus
ttcattcttgctttgggcactggct

SEQ ID NO: 932241 - DNA, 25 bp, Mus musculus
ttcattcttgttacttgtgatgcaa

SEQ ID NO: 932242 - DNA, 25 bp, Mus musculus
ttcattcttgtttcttgtgatgcaa

SEQ ID NO: 932243 - DNA, 25 bp, Mus musculus
ttcattctttaaaagcgcccctttg

SEQ ID NO: 932244 - DNA, 25 bp, Mus musculus
ttcattctttaatagcgcccctttg

SEQ ID NO: 932245 - DNA, 25 bp, Mus musculus
ttcattctttataagtccctctacc

SEQ ID NO: 932246 - DNA, 25 bp, Mus musculus
ttcattctttattagtccctctacc

SEQ ID NO: 932247 - DNA, 25 bp, Mus musculus
ttcattctttccctcattgctttca

SEQ ID NO: 932248 - DNA, 25 bp, Mus musculus
ttcattctttccgtcattgctttca

SEQ ID NO: 932249 - DNA, 25 bp, Mus musculus
ttcattctttctctcctgtgtgcac

SEQ ID NO: 932250 - DNA, 25 bp, Mus musculus
ttcattctttctgtcctgtgtgcac

SEQ ID NO: 932251 - DNA, 25 bp, Mus musculus
ttcattctttgtctcatccatctca

SEQ ID NO: 932252 - DNA, 25 bp, Mus musculus
ttcattctttgtgtcatccatctca

SEQ ID NO: 932253 - DNA, 25 bp, Mus musculus
ttcattcttttcactgtgcttcaca

SEQ ID NO: 932254 - DNA, 25 bp, Mus musculus
ttcattcttttctctgtgcttcaca

SEQ ID NO: 932255 - DNA, 25 bp, Mus musculus
ttcattgacccgcaggctttcacag

SEQ ID NO: 932256 - DNA, 25 bp, Mus musculus
ttcattgacccggaggctttcacag

SEQ ID NO: 932257 - DNA, 25 bp, Mus musculus
ttcattgactgacccattcctgcct

SEQ ID NO: 932258 - DNA, 25 bp, Mus musculus
ttcattgactgagccattcctgcct

SEQ ID NO: 932259 - DNA, 25 bp, Mus musculus
ttcattgagaatccccgtctcttca

SEQ ID NO: 932260 - DNA, 25 bp, Mus musculus
ttcattgagaatgcccgtctcttca

SEQ ID NO: 932261 - DNA, 25 bp, Mus musculus
ttcattgagagacgcccaagcagat

SEQ ID NO: 932262 - DNA, 25 bp, Mus musculus
ttcattgagagaggcccaagcagat

SEQ ID NO: 932263 - DNA, 25 bp, Mus musculus
ttcattgaggttaactctgagttca

SEQ ID NO: 932264 - DNA, 25 bp, Mus musculus
ttcattgaggtttactctgagttca

SEQ ID NO: 932265 - DNA, 25 bp, Mus musculus
ttcattgatccgcagcgctatgagg

SEQ ID NO: 932266 - DNA, 25 bp, Mus musculus
ttcattgatccggagcgctatgagg

SEQ ID NO: 932267 - DNA, 25 bp, Mus musculus
ttcattgcagcacggatcctagcca

SEQ ID NO: 932268 - DNA, 25 bp, Mus musculus
ttcattgcagcagggatcctagcca

SEQ ID NO: 932269 - DNA, 25 bp, Mus musculus
ttcattgcatagaagcccagcggat

SEQ ID NO: 932270 - DNA, 25 bp, Mus musculus
ttcattgcatagtagcccagcggat

SEQ ID NO: 932271 - DNA, 25 bp, Mus musculus
ttcattgccaccacccagaagttta

SEQ ID NO: 932272 - DNA, 25 bp, Mus musculus
ttcattgccacctcccagaagttta

SEQ ID NO: 932273 - DNA, 25 bp, Mus musculus
ttcattgcctgcctatgtaggtttg

SEQ ID NO: 932274 - DNA, 25 bp, Mus musculus
ttcattgcctgcgtatgtaggtttg

SEQ ID NO: 932275 - DNA, 25 bp, Mus musculus
ttcattgccttactcttgctactac

SEQ ID NO: 932276 - DNA, 25 bp, Mus musculus
ttcattgccttagtcttgctactac

SEQ ID NO: 932277 - DNA, 25 bp, Mus musculus
ttcattgcgtcgaaaagctggcttt

SEQ ID NO: 932278 - DNA, 25 bp, Mus musculus
ttcattgcgtcgtaaagctggcttt

SEQ ID NO: 932279 - DNA, 25 bp, Mus musculus
ttcattgctcctaggtagaccaggc

SEQ ID NO: 932280 - DNA, 25 bp, Mus musculus
ttcattgctcctcagagagttgaaa

SEQ ID NO: 932281 - DNA, 25 bp, Mus musculus
ttcattgctcctgagagagttgaaa

SEQ ID NO: 932282 - DNA, 25 bp, Mus musculus
ttcattgctccttggtagaccaggc

SEQ ID NO: 932283 - DNA, 25 bp, Mus musculus
ttcattgctcggaactatctggagg

SEQ ID NO: 932284 - DNA, 25 bp, Mus musculus
ttcattgctcggtactatctggagg

SEQ ID NO: 932285 - DNA, 25 bp, Mus musculus
ttcattgctgacacccaggctatgg

SEQ ID NO: 932286 - DNA, 25 bp, Mus musculus
ttcattgctgactcccaggctatgg

SEQ ID NO: 932287 - DNA, 25 bp, Mus musculus
ttcattgctgtgaacagaccccata

SEQ ID NO: 932288 - DNA, 25 bp, Mus musculus
ttcattgctgtgtacagaccccata

SEQ ID NO: 932289 - DNA, 25 bp, Mus musculus
ttcattggaaatatcgtctgctctg

SEQ ID NO: 932290 - DNA, 25 bp, Mus musculus
ttcattggaaatttcgtctgctctg

SEQ ID NO: 932291 - DNA, 25 bp, Mus musculus
ttcattggaaggatctgctccccag

SEQ ID NO: 932292 - DNA, 25 bp, Mus musculus
ttcattggaaggcttggcgtagtat

SEQ ID NO: 932293 - DNA, 25 bp, Mus musculus
ttcattggaagggttggcgtagtat

SEQ ID NO: 932294 - DNA, 25 bp, Mus musculus
ttcattggaaggttctgctccccag

SEQ ID NO: 932295 - DNA, 25 bp, Mus musculus
ttcattggaagtagtcgctgccgta

SEQ ID NO: 932296 - DNA, 25 bp, Mus musculus
ttcattggaagttgtcgctgccgta

SEQ ID NO: 932297 - DNA, 25 bp, Mus musculus
ttcattggacctactgtggatattt

SEQ ID NO: 932298 - DNA, 25 bp, Mus musculus
ttcattggaccttctgtggatattt

SEQ ID NO: 932299 - DNA, 25 bp, Mus musculus
ttcattggagccctaaagttcaaac

SEQ ID NO: 932300 - DNA, 25 bp, Mus musculus
ttcattggagccgtaaagttcaaac

SEQ ID NO: 932301 - DNA, 25 bp, Mus musculus
ttcattggccgaccagctgcaaaga

SEQ ID NO: 932302 - DNA, 25 bp, Mus musculus
ttcattggccgagcagctgcaaaga

SEQ ID NO: 932303 - DNA, 25 bp, Mus musculus
ttcattggcttgactgctgaacaaa

SEQ ID NO: 932304 - DNA, 25 bp, Mus musculus
ttcattggcttgtctgctgaacaaa

SEQ ID NO: 932305 - DNA, 25 bp, Mus musculus
ttcattgggaagagtctaagcatct

SEQ ID NO: 932306 - DNA, 25 bp, Mus musculus
ttcattgggaagtgtctaagcatct

SEQ ID NO: 932307 - DNA, 25 bp, Mus musculus
ttcattggtgacctgcctacctgtt

SEQ ID NO: 932308 - DNA, 25 bp, Mus musculus
ttcattggtgacgtgcctacctgtt

SEQ ID NO: 932309 - DNA, 25 bp, Mus musculus
ttcattggttaaccttcatccccac

SEQ ID NO: 932310 - DNA, 25 bp, Mus musculus
ttcattggttaagcttcatccccac

SEQ ID NO: 932311 - DNA, 25 bp, Mus musculus
ttcattggttagacagccttggcag

SEQ ID NO: 932312 - DNA, 25 bp, Mus musculus
ttcattggttagtcagccttggcag

SEQ ID NO: 932313 - DNA, 25 bp, Mus musculus
ttcattgtacaaaccagtgcagctg

SEQ ID NO: 932314 - DNA, 25 bp, Mus musculus
ttcattgtacaatccagtgcagctg

SEQ ID NO: 932315 - DNA, 25 bp, Mus musculus
ttcattgtagatcctttatactaaa

SEQ ID NO: 932316 - DNA, 25 bp, Mus musculus
ttcattgtagatgctttatactaaa

SEQ ID NO: 932317 - DNA, 25 bp, Mus musculus
ttcattgtcaaacgtaaacgagggt

SEQ ID NO: 932318 - DNA, 25 bp, Mus musculus
ttcattgtcaaaggtaaacgagggt

SEQ ID NO: 932319 - DNA, 25 bp, Mus musculus
ttcattgtcagcatcggtgttgtca

SEQ ID NO: 932320 - DNA, 25 bp, Mus musculus
ttcattgtcagcttcggtgttgtca

SEQ ID NO: 932321 - DNA, 25 bp, Mus musculus
ttcattgtcaggaggcagactcctt

SEQ ID NO: 932322 - DNA, 25 bp, Mus musculus
ttcattgtcaggtggcagactcctt

SEQ ID NO: 932323 - DNA, 25 bp, Mus musculus
ttcattgtcatcactcatcctgatg

SEQ ID NO: 932324 - DNA, 25 bp, Mus musculus
ttcattgtcatctctcatcctgatg

SEQ ID NO: 932325 - DNA, 25 bp, Mus musculus
ttcattgtccccagtttctttcaca

SEQ ID NO: 932326 - DNA, 25 bp, Mus musculus
ttcattgtcccctgtttctttcaca

SEQ ID NO: 932327 - DNA, 25 bp, Mus musculus
ttcattgtccctcccaagataggaa

SEQ ID NO: 932328 - DNA, 25 bp, Mus musculus
ttcattgtccctgccaagataggaa

SEQ ID NO: 932329 - DNA, 25 bp, Mus musculus
ttcattgtgcatccaaggctgacct

SEQ ID NO: 932330 - DNA, 25 bp, Mus musculus
ttcattgtgcatgcaaggctgacct

SEQ ID NO: 932331 - DNA, 25 bp, Mus musculus
ttcattgtgctgacattgttcctgt

SEQ ID NO: 932332 - DNA, 25 bp, Mus musculus
ttcattgtgctgtcattgttcctgt

SEQ ID NO: 932333 - DNA, 25 bp, Mus musculus
ttcattgtgggtcgctggtccttaa

SEQ ID NO: 932334 - DNA, 25 bp, Mus musculus
ttcattgtgggtggctggtccttaa

SEQ ID NO: 932335 - DNA, 25 bp, Mus musculus
ttcattgtgtcacaagcctttgata

SEQ ID NO: 932336 - DNA, 25 bp, Mus musculus
ttcattgtgtcagaagcctttgata

SEQ ID NO: 932337 - DNA, 25 bp, Mus musculus
ttcattgtgtttagggatgtatagc

SEQ ID NO: 932338 - DNA, 25 bp, Mus musculus
ttcattgtgttttgggatgtatagc

SEQ ID NO: 932339 - DNA, 25 bp, Mus musculus
ttcattgttaacagaactagcttca

SEQ ID NO: 932340 - DNA, 25 bp, Mus musculus
ttcattgttaactgaactagcttca

SEQ ID NO: 932341 - DNA, 25 bp, Mus musculus
ttcattgttgcccatggaaggtcag

SEQ ID NO: 932342 - DNA, 25 bp, Mus musculus
ttcattgttgccgatggaaggtcag

SEQ ID NO: 932343 - DNA, 25 bp, Mus musculus
ttcattgttgtaactgcctctgagt

SEQ ID NO: 932344 - DNA, 25 bp, Mus musculus
ttcattgttgtatctgcctctgagt

SEQ ID NO: 932345 - DNA, 25 bp, Mus musculus
ttcattgtttttagtcccaggcctt

SEQ ID NO: 932346 - DNA, 25 bp, Mus musculus
ttcattgttttttgtcccaggcctt

SEQ ID NO: 932347 - DNA, 25 bp, Mus musculus
ttcatttacccacaactaggaagtg

SEQ ID NO: 932348 - DNA, 25 bp, Mus musculus
ttcatttacccagaactaggaagtg

SEQ ID NO: 932349 - DNA, 25 bp, Mus musculus
ttcatttagagcaaactgaactttg

SEQ ID NO: 932350 - DNA, 25 bp, Mus musculus
ttcatttagagctaactgaactttg

SEQ ID NO: 932351 - DNA, 25 bp, Mus musculus
ttcatttagctgattggcagaattc

SEQ ID NO: 932352 - DNA, 25 bp, Mus musculus
ttcatttagctgtttggcagaattc

SEQ ID NO: 932353 - DNA, 25 bp, Mus musculus
ttcatttagggcatggagctggcat

SEQ ID NO: 932354 - DNA, 25 bp, Mus musculus
ttcatttagggcttggagctggcat

SEQ ID NO: 932355 - DNA, 25 bp, Mus musculus
ttcatttagtacaggttcttaataa

SEQ ID NO: 932356 - DNA, 25 bp, Mus musculus
ttcatttagtactggttcttaataa

SEQ ID NO: 932357 - DNA, 25 bp, Mus musculus
ttcatttatgctatttcgggatttg

SEQ ID NO: 932358 - DNA, 25 bp, Mus musculus
ttcatttatgctttttcgggatttg

SEQ ID NO: 932359 - DNA, 25 bp, Mus musculus
ttcatttcaaaaaccacctctgttt

SEQ ID NO: 932360 - DNA, 25 bp, Mus musculus
ttcatttcaaaacccagtcaaactg

SEQ ID NO: 932361 - DNA, 25 bp, Mus musculus
ttcatttcaaaagccagtcaaactg

SEQ ID NO: 932362 - DNA, 25 bp, Mus musculus
ttcatttcaaaatccacctctgttt

SEQ ID NO: 932363 - DNA, 25 bp, Mus musculus
ttcatttcagaacattgtgtcctct

SEQ ID NO: 932364 - DNA, 25 bp, Mus musculus
ttcatttcagaagattgtgtcctct

SEQ ID NO: 932365 - DNA, 25 bp, Mus musculus
ttcatttcagatattctggttgtcc

SEQ ID NO: 932366 - DNA, 25 bp, Mus musculus
ttcatttcagattttctggttgtcc

SEQ ID NO: 932367 - DNA, 25 bp, Mus musculus
ttcatttcatgcagagattgttcag

SEQ ID NO: 932368 - DNA, 25 bp, Mus musculus
ttcatttcatgctgagattgttcag

SEQ ID NO: 932369 - DNA, 25 bp, Mus musculus
ttcatttcattccagtgattcaagt

SEQ ID NO: 932370 - DNA, 25 bp, Mus musculus
ttcatttcattcgagtgattcaagt

SEQ ID NO: 932371 - DNA, 25 bp, Mus musculus
ttcatttccaacacccaagtgcaca

SEQ ID NO: 932372 - DNA, 25 bp, Mus musculus
ttcatttccaactcccaagtgcaca

SEQ ID NO: 932373 - DNA, 25 bp, Mus musculus
ttcatttccaagaatcccacagaat

SEQ ID NO: 932374 - DNA, 25 bp, Mus musculus
ttcatttccaagtatcccacagaat

SEQ ID NO: 932375 - DNA, 25 bp, Mus musculus
ttcatttcccacctgtgtgacatga

SEQ ID NO: 932376 - DNA, 25 bp, Mus musculus
ttcatttcccacgtgtgtgacatga

SEQ ID NO: 932377 - DNA, 25 bp, Mus musculus
ttcatttccccaacaatctttctgt

SEQ ID NO: 932378 - DNA, 25 bp, Mus musculus
ttcatttccccatcaatctttctgt

SEQ ID NO: 932379 - DNA, 25 bp, Mus musculus
ttcatttccccgattacctcaattg

SEQ ID NO: 932380 - DNA, 25 bp, Mus musculus
ttcatttccccgtttacctcaattg

SEQ ID NO: 932381 - DNA, 25 bp, Mus musculus
ttcatttcccgtctttgactctgta

SEQ ID NO: 932382 - DNA, 25 bp, Mus musculus
ttcatttcccgtgtttgactctgta

SEQ ID NO: 932383 - DNA, 25 bp, Mus musculus
ttcatttcctccacagctggtaact

SEQ ID NO: 932384 - DNA, 25 bp, Mus musculus
ttcatttcctcctcagctggtaact

SEQ ID NO: 932385 - DNA, 25 bp, Mus musculus
ttcatttcctgcagaggtccttgga

SEQ ID NO: 932386 - DNA, 25 bp, Mus musculus
ttcatttcctgcccatcctaagcta

SEQ ID NO: 932387 - DNA, 25 bp, Mus musculus
ttcatttcctgcgcatcctaagcta

SEQ ID NO: 932388 - DNA, 25 bp, Mus musculus
ttcatttcctgctgaggtccttgga

SEQ ID NO: 932389 - DNA, 25 bp, Mus musculus
ttcatttcctggcattcacttctcc

SEQ ID NO: 932390 - DNA, 25 bp, Mus musculus
ttcatttcctgggattcacttctcc

SEQ ID NO: 932391 - DNA, 25 bp, Mus musculus
ttcatttcctgtctctacacctttt

SEQ ID NO: 932392 - DNA, 25 bp, Mus musculus
ttcatttcctgtgtctacacctttt

SEQ ID NO: 932393 - DNA, 25 bp, Mus musculus
ttcatttccttgctgcgtttgtaaa

SEQ ID NO: 932394 - DNA, 25 bp, Mus musculus
ttcatttccttggtgcgtttgtaaa

SEQ ID NO: 932395 - DNA, 25 bp, Mus musculus
ttcatttcgggtcttgcccaacaga

SEQ ID NO: 932396 - DNA, 25 bp, Mus musculus
ttcatttcgggtgttgcccaacaga

SEQ ID NO: 932397 - DNA, 25 bp, Mus musculus
ttcatttctcctctttatatatata

SEQ ID NO: 932398 - DNA, 25 bp, Mus musculus
ttcatttctcctgtttatatatata

SEQ ID NO: 932399 - DNA, 25 bp, Mus musculus
ttcatttctgatcgtgcgctggcga

SEQ ID NO: 932400 - DNA, 25 bp, Mus musculus
ttcatttctgatggtgcgctggcga

SEQ ID NO: 932401 - DNA, 25 bp, Mus musculus
ttcatttctgcacccgagagggatg

SEQ ID NO: 932402 - DNA, 25 bp, Mus musculus
ttcatttctgcagccgagagggatg

SEQ ID NO: 932403 - DNA, 25 bp, Mus musculus
ttcatttctgccctgtgtagtcaag

SEQ ID NO: 932404 - DNA, 25 bp, Mus musculus
ttcatttctgccgtgtgtagtcaag

SEQ ID NO: 932405 - DNA, 25 bp, Mus musculus
ttcatttctgtcacccgagagatca

SEQ ID NO: 932406 - DNA, 25 bp, Mus musculus
ttcatttctgtctcccgagagatca

SEQ ID NO: 932407 - DNA, 25 bp, Mus musculus
ttcatttcttccaacacatcttgac

SEQ ID NO: 932408 - DNA, 25 bp, Mus musculus
ttcatttcttcctacacatcttgac

SEQ ID NO: 932409 - DNA, 25 bp, Mus musculus
ttcatttcttctctatggcggccca

SEQ ID NO: 932410 - DNA, 25 bp, Mus musculus
ttcatttcttctcttactgtttgtt

SEQ ID NO: 932411 - DNA, 25 bp, Mus musculus
ttcatttcttctgtatggcggccca

SEQ ID NO: 932412 - DNA, 25 bp, Mus musculus
ttcatttcttctgttactgtttgtt

SEQ ID NO: 932413 - DNA, 25 bp, Mus musculus
ttcatttcttggatgctaagggctt

SEQ ID NO: 932414 - DNA, 25 bp, Mus musculus
ttcatttcttggttgctaagggctt

SEQ ID NO: 932415 - DNA, 25 bp, Mus musculus
ttcatttctttcagttggtcccttc

SEQ ID NO: 932416 - DNA, 25 bp, Mus musculus
ttcatttctttctgttggtcccttc

SEQ ID NO: 932417 - DNA, 25 bp, Mus musculus
ttcatttgagaaaccatagcattgg

SEQ ID NO: 932418 - DNA, 25 bp, Mus musculus
ttcatttgagaatccatagcattgg

SEQ ID NO: 932419 - DNA, 25 bp, Mus musculus
ttcatttgcgtaacctactgtctga

SEQ ID NO: 932420 - DNA, 25 bp, Mus musculus
ttcatttgcgtatcctactgtctga

SEQ ID NO: 932421 - DNA, 25 bp, Mus musculus
ttcatttgcttcacggcctccatct

SEQ ID NO: 932422 - DNA, 25 bp, Mus musculus
ttcatttgcttctcggcctccatct

SEQ ID NO: 932423 - DNA, 25 bp, Mus musculus
ttcatttggctcattttcttgtctg

SEQ ID NO: 932424 - DNA, 25 bp, Mus musculus
ttcatttggctctttttcttgtctg

SEQ ID NO: 932425 - DNA, 25 bp, Mus musculus
ttcatttggtttccgctttctcctc

SEQ ID NO: 932426 - DNA, 25 bp, Mus musculus
ttcatttggtttgcgctttctcctc

SEQ ID NO: 932427 - DNA, 25 bp, Mus musculus
ttcatttgtatccaaggtgctgaat

SEQ ID NO: 932428 - DNA, 25 bp, Mus musculus
ttcatttgtatcgaaggtgctgaat

SEQ ID NO: 932429 - DNA, 25 bp, Mus musculus
ttcatttgtggcatgcaattttctt

SEQ ID NO: 932430 - DNA, 25 bp, Mus musculus
ttcatttgtggcttgcaattttctt

SEQ ID NO: 932431 - DNA, 25 bp, Mus musculus
ttcatttgttcacgaggctttccaa

SEQ ID NO: 932432 - DNA, 25 bp, Mus musculus
ttcatttgttcaggaggctttccaa

SEQ ID NO: 932433 - DNA, 25 bp, Mus musculus
ttcatttgttggctttccttggttg

SEQ ID NO: 932434 - DNA, 25 bp, Mus musculus
ttcatttgttgggtttccttggttg

SEQ ID NO: 932435 - DNA, 25 bp, Mus musculus
ttcattttacagcttcaaacccata

SEQ ID NO: 932436 - DNA, 25 bp, Mus musculus
ttcattttacaggttcaaacccata

SEQ ID NO: 932437 - DNA, 25 bp, Mus musculus
ttcattttagcccaaggtcacctga

SEQ ID NO: 932438 - DNA, 25 bp, Mus musculus
ttcattttagccgaaggtcacctga

SEQ ID NO: 932439 - DNA, 25 bp, Mus musculus
ttcattttcaccatttcctctgtta

SEQ ID NO: 932440 - DNA, 25 bp, Mus musculus
ttcattttcaccttttcctctgtta

SEQ ID NO: 932441 - DNA, 25 bp, Mus musculus
ttcattttcagaacaagccctccag

SEQ ID NO: 932442 - DNA, 25 bp, Mus musculus
ttcattttcagatcaagccctccag

SEQ ID NO: 932443 - DNA, 25 bp, Mus musculus
ttcattttcataaccgattttgaag

SEQ ID NO: 932444 - DNA, 25 bp, Mus musculus
ttcattttcatatccgattttgaag

SEQ ID NO: 932445 - DNA, 25 bp, Mus musculus
ttcattttcatgctctccccaaaaa

SEQ ID NO: 932446 - DNA, 25 bp, Mus musculus
ttcattttcatggtctccccaaaaa

SEQ ID NO: 932447 - DNA, 25 bp, Mus musculus
ttcattttccttaccacttaacaca

SEQ ID NO: 932448 - DNA, 25 bp, Mus musculus
ttcattttccttactgcctactact

SEQ ID NO: 932449 - DNA, 25 bp, Mus musculus
ttcattttcctttccacttaacaca

SEQ ID NO: 932450 - DNA, 25 bp, Mus musculus
ttcattttcctttctgcctactact

SEQ ID NO: 932451 - DNA, 25 bp, Mus musculus
ttcattttctagctactgttctcaa

SEQ ID NO: 932452 - DNA, 25 bp, Mus musculus
ttcattttctaggtactgttctcaa

SEQ ID NO: 932453 - DNA, 25 bp, Mus musculus
ttcattttctccaaccaaagctgct

SEQ ID NO: 932454 - DNA, 25 bp, Mus musculus
ttcattttctcctaccaaagctgct

SEQ ID NO: 932455 - DNA, 25 bp, Mus musculus
ttcattttcttaatgcacctctggc

SEQ ID NO: 932456 - DNA, 25 bp, Mus musculus
ttcattttcttactcaacagttgtg

SEQ ID NO: 932457 - DNA, 25 bp, Mus musculus
ttcattttcttagtcaacagttgtg

SEQ ID NO: 932458 - DNA, 25 bp, Mus musculus
ttcattttcttattgcacctctggc

SEQ ID NO: 932459 - DNA, 25 bp, Mus musculus
ttcattttcttcactagccttatgc

SEQ ID NO: 932460 - DNA, 25 bp, Mus musculus
ttcattttcttcactgctcttatgc

SEQ ID NO: 932461 - DNA, 25 bp, Mus musculus
ttcattttcttctctagccttatgc

SEQ ID NO: 932462 - DNA, 25 bp, Mus musculus
ttcattttcttctctgctcttatgc

SEQ ID NO: 932463 - DNA, 25 bp, Mus musculus
ttcattttctttcactgtccgcttg

SEQ ID NO: 932464 - DNA, 25 bp, Mus musculus
ttcattttctttgactgtccgcttg

SEQ ID NO: 932465 - DNA, 25 bp, Mus musculus
ttcattttgcatatccttttggtac

SEQ ID NO: 932466 - DNA, 25 bp, Mus musculus
ttcattttgcatttccttttggtac

SEQ ID NO: 932467 - DNA, 25 bp, Mus musculus
ttcattttgcctctcgcatgtcgga

SEQ ID NO: 932468 - DNA, 25 bp, Mus musculus
ttcattttgcctgtcgcatgtcgga

SEQ ID NO: 932469 - DNA, 25 bp, Mus musculus
ttcattttggagcatcatgaagctc

SEQ ID NO: 932470 - DNA, 25 bp, Mus musculus
ttcattttggaggatcatgaagctc

SEQ ID NO: 932471 - DNA, 25 bp, Mus musculus
ttcattttggttacagtagaccttt

SEQ ID NO: 932472 - DNA, 25 bp, Mus musculus
ttcattttggtttcagtagaccttt

SEQ ID NO: 932473 - DNA, 25 bp, Mus musculus
ttcatttttcaaagaacccgagacc

SEQ ID NO: 932474 - DNA, 25 bp, Mus musculus
ttcatttttcaatgaacccgagacc

SEQ ID NO: 932475 - DNA, 25 bp, Mus musculus
ttcatttttctaaagccctacatag

SEQ ID NO: 932476 - DNA, 25 bp, Mus musculus
ttcatttttctatagccctacatag

SEQ ID NO: 932477 - DNA, 25 bp, Mus musculus
ttcatttttgaaccgctggagcggt

SEQ ID NO: 932478 - DNA, 25 bp, Mus musculus
ttcatttttgaagcgctggagcggt

SEQ ID NO: 932479 - DNA, 25 bp, Mus musculus
ttcatttttgggacatttaaggcag

SEQ ID NO: 932480 - DNA, 25 bp, Mus musculus
ttcatttttgggtcatttaaggcag

SEQ ID NO: 932481 - DNA, 25 bp, Mus musculus
ttcatttttggtatcattgtatcac

SEQ ID NO: 932482 - DNA, 25 bp, Mus musculus
ttcatttttggtttcattgtatcac

SEQ ID NO: 932483 - DNA, 25 bp, Mus musculus
ttcattttttggaagcatcccctct

SEQ ID NO: 932484 - DNA, 25 bp, Mus musculus
ttcattttttggtagcatcccctct

SEQ ID NO: 932485 - DNA, 25 bp, Mus musculus
ttccaaaacgagagcgaaagtggtt

SEQ ID NO: 932486 - DNA, 25 bp, Mus musculus
ttccaaaacgagtgcgaaagtggtt

SEQ ID NO: 932487 - DNA, 25 bp, Mus musculus
ttccaaaaggtcaaccggagccctg

SEQ ID NO: 932488 - DNA, 25 bp, Mus musculus
ttccaaaaggtcactctgttcccaa

SEQ ID NO: 932489 - DNA, 25 bp, Mus musculus
ttccaaaaggtctaccggagccctg

SEQ ID NO: 932490 - DNA, 25 bp, Mus musculus
ttccaaaaggtctctctgttcccaa

SEQ ID NO: 932491 - DNA, 25 bp, Mus musculus
ttccaaaagtttctggactccctgt

SEQ ID NO: 932492 - DNA, 25 bp, Mus musculus
ttccaaaagtttgtggactccctgt

SEQ ID NO: 932493 - DNA, 25 bp, Mus musculus
ttccaaacaccaatgcctgtacagt

SEQ ID NO: 932494 - DNA, 25 bp, Mus musculus
ttccaaacaccattgcctgtacagt

SEQ ID NO: 932495 - DNA, 25 bp, Mus musculus
ttccaaacacttaacacattcagtt

SEQ ID NO: 932496 - DNA, 25 bp, Mus musculus
ttccaaacactttacacattcagtt

SEQ ID NO: 932497 - DNA, 25 bp, Mus musculus
ttccaaacatcacaccattgaaaaa

SEQ ID NO: 932498 - DNA, 25 bp, Mus musculus
ttccaaacatcagaccattgaaaaa

SEQ ID NO: 932499 - DNA, 25 bp, Mus musculus
ttccaaacatttaaagatcctactt

SEQ ID NO: 932500 - DNA, 25 bp, Mus musculus
ttccaaacattttaagatcctactt

SEQ ID NO: 932501 - DNA, 25 bp, Mus musculus
ttccaaaccacacgcaggcatttgg

SEQ ID NO: 932502 - DNA, 25 bp, Mus musculus
ttccaaaccacaggcaggcatttgg

SEQ ID NO: 932503 - DNA, 25 bp, Mus musculus
ttccaaaccagtcctattcattctt

SEQ ID NO: 932504 - DNA, 25 bp, Mus musculus
ttccaaaccagtgctattcattctt

SEQ ID NO: 932505 - DNA, 25 bp, Mus musculus
ttccaaacccatatgtacctttgag

SEQ ID NO: 932506 - DNA, 25 bp, Mus musculus
ttccaaacccatttgtacctttgag

SEQ ID NO: 932507 - DNA, 25 bp, Mus musculus
ttccaaacctaaatctcatcccagg

SEQ ID NO: 932508 - DNA, 25 bp, Mus musculus
ttccaaacctaattctcatcccagg

SEQ ID NO: 932509 - DNA, 25 bp, Mus musculus
ttccaaacctgaccccgaggctgga

SEQ ID NO: 932510 - DNA, 25 bp, Mus musculus
ttccaaacctgagcccgaggctgga

SEQ ID NO: 932511 - DNA, 25 bp, Mus musculus
ttccaaactatactaacaggctaag

SEQ ID NO: 932512 - DNA, 25 bp, Mus musculus
ttccaaactatagtaacaggctaag

SEQ ID NO: 932513 - DNA, 25 bp, Mus musculus
ttccaaactgtcaagagcctgcggc

SEQ ID NO: 932514 - DNA, 25 bp, Mus musculus
ttccaaactgtctagagcctgcggc

SEQ ID NO: 932515 - DNA, 25 bp, Mus musculus
ttccaaacttttctggtcacctgac

SEQ ID NO: 932516 - DNA, 25 bp, Mus musculus
ttccaaacttttgtggtcacctgac

SEQ ID NO: 932517 - DNA, 25 bp, Mus musculus
ttccaaagactcccacacattgatt

SEQ ID NO: 932518 - DNA, 25 bp, Mus musculus
ttccaaagactcgcacacattgatt

SEQ ID NO: 932519 - DNA, 25 bp, Mus musculus
ttccaaagagccaccttgaagcctg

SEQ ID NO: 932520 - DNA, 25 bp, Mus musculus
ttccaaagagcctccttgaagcctg

SEQ ID NO: 932521 - DNA, 25 bp, Mus musculus
ttccaaagccctcacactgagtagg

SEQ ID NO: 932522 - DNA, 25 bp, Mus musculus
ttccaaagccctgacactgagtagg

SEQ ID NO: 932523 - DNA, 25 bp, Mus musculus
ttccaaagctggatcttctcaccaa

SEQ ID NO: 932524 - DNA, 25 bp, Mus musculus
ttccaaagctggttcttctcaccaa

SEQ ID NO: 932525 - DNA, 25 bp, Mus musculus
ttccaaaggatcagggccaagacct

SEQ ID NO: 932526 - DNA, 25 bp, Mus musculus
ttccaaaggatctgggccaagacct

SEQ ID NO: 932527 - DNA, 25 bp, Mus musculus
ttccaaaggcacagacgagtctcag

SEQ ID NO: 932528 - DNA, 25 bp, Mus musculus
ttccaaaggcactgacgagtctcag

SEQ ID NO: 932529 - DNA, 25 bp, Mus musculus
ttccaaaggccccagattcagttcc

SEQ ID NO: 932530 - DNA, 25 bp, Mus musculus
ttccaaaggcccgagattcagttcc

SEQ ID NO: 932531 - DNA, 25 bp, Mus musculus
ttccaaaggcgtccatttgcttaaa

SEQ ID NO: 932532 - DNA, 25 bp, Mus musculus
ttccaaaggcgtgcatttgcttaaa

SEQ ID NO: 932533 - DNA, 25 bp, Mus musculus
ttccaaagtactatgtcatcaacat

SEQ ID NO: 932534 - DNA, 25 bp, Mus musculus
ttccaaagtactttgtcatcaacat

SEQ ID NO: 932535 - DNA, 25 bp, Mus musculus
ttccaaagtcctcgctgacagatgc

SEQ ID NO: 932536 - DNA, 25 bp, Mus musculus
ttccaaagtcctggctgacagatgc

SEQ ID NO: 932537 - DNA, 25 bp, Mus musculus
ttccaaagtgaaatgctaggtgagg

SEQ ID NO: 932538 - DNA, 25 bp, Mus musculus
ttccaaagtgaattgctaggtgagg

SEQ ID NO: 932539 - DNA, 25 bp, Mus musculus
ttccaaagttgactgcgccagacct

SEQ ID NO: 932540 - DNA, 25 bp, Mus musculus
ttccaaagttgagtgcgccagacct

SEQ ID NO: 932541 - DNA, 25 bp, Mus musculus
ttccaaatacctccgggattactcg

SEQ ID NO: 932542 - DNA, 25 bp, Mus musculus
ttccaaatacctgcgggattactcg

SEQ ID NO: 932543 - DNA, 25 bp, Mus musculus
ttccaaatattgcttataaagtaga

SEQ ID NO: 932544 - DNA, 25 bp, Mus musculus
ttccaaatattggttataaagtaga

SEQ ID NO: 932545 - DNA, 25 bp, Mus musculus
ttccaaatctatagttgctgaacat

SEQ ID NO: 932546 - DNA, 25 bp, Mus musculus
ttccaaatctattgttgctgaacat

SEQ ID NO: 932547 - DNA, 25 bp, Mus musculus
ttccaaatctgcactggaaaaccac

SEQ ID NO: 932548 - DNA, 25 bp, Mus musculus
ttccaaatctgctctggaaaaccac

SEQ ID NO: 932549 - DNA, 25 bp, Mus musculus
ttccaaatgattcacatctgccacc

SEQ ID NO: 932550 - DNA, 25 bp, Mus musculus
ttccaaatgattgacatctgccacc

SEQ ID NO: 932551 - DNA, 25 bp, Mus musculus
ttccaaatgcccaaagccttgtttc

SEQ ID NO: 932552 - DNA, 25 bp, Mus musculus
ttccaaatgccctaagccttgtttc

SEQ ID NO: 932553 - DNA, 25 bp, Mus musculus
ttccaaatgcgtcggctgctacgaa

SEQ ID NO: 932554 - DNA, 25 bp, Mus musculus
ttccaaatgcgtgggctgctacgaa

SEQ ID NO: 932555 - DNA, 25 bp, Mus musculus
ttccaaatgttaacactttccctgg

SEQ ID NO: 932556 - DNA, 25 bp, Mus musculus
ttccaaatgttatcactttccctgg

SEQ ID NO: 932557 - DNA, 25 bp, Mus musculus
ttccaaattgcaactcactttttcc

SEQ ID NO: 932558 - DNA, 25 bp, Mus musculus
ttccaaattgcatctcactttttcc

SEQ ID NO: 932559 - DNA, 25 bp, Mus musculus
ttccaaatttacattacacgtgatt

SEQ ID NO: 932560 - DNA, 25 bp, Mus musculus
ttccaaatttactttacacgtgatt

SEQ ID NO: 932561 - DNA, 25 bp, Mus musculus
ttccaacacagaaggcctagggcct

SEQ ID NO: 932562 - DNA, 25 bp, Mus musculus
ttccaacacagatggcctagggcct

SEQ ID NO: 932563 - DNA, 25 bp, Mus musculus
ttccaacagtggatttgcctcatgt

SEQ ID NO: 932564 - DNA, 25 bp, Mus musculus
ttccaacagtggttttgcctcatgt

SEQ ID NO: 932565 - DNA, 25 bp, Mus musculus
ttccaacattatacacaactctgtg

SEQ ID NO: 932566 - DNA, 25 bp, Mus musculus
ttccaacattattcacaactctgtg

SEQ ID NO: 932567 - DNA, 25 bp, Mus musculus
ttccaaccaaagagaagcaagcttt

SEQ ID NO: 932568 - DNA, 25 bp, Mus musculus
ttccaaccaaagtgaagcaagcttt

SEQ ID NO: 932569 - DNA, 25 bp, Mus musculus
ttccaaccaaccaagaagcaccttt

SEQ ID NO: 932570 - DNA, 25 bp, Mus musculus
ttccaaccaacctagaagcaccttt

SEQ ID NO: 932571 - DNA, 25 bp, Mus musculus
ttccaaccacagcatttgaggctca

SEQ ID NO: 932572 - DNA, 25 bp, Mus musculus
ttccaaccacaggatttgaggctca

SEQ ID NO: 932573 - DNA, 25 bp, Mus musculus
ttccaaccatagcaggtcatctaag

SEQ ID NO: 932574 - DNA, 25 bp, Mus musculus
ttccaaccataggaggtcatctaag

SEQ ID NO: 932575 - DNA, 25 bp, Mus musculus
ttccaacccagcagcattcagagat

SEQ ID NO: 932576 - DNA, 25 bp, Mus musculus
ttccaacccagctgcattcagagat

SEQ ID NO: 932577 - DNA, 25 bp, Mus musculus
ttccaacccatcagggtggaactca

SEQ ID NO: 932578 - DNA, 25 bp, Mus musculus
ttccaacccatctgggtggaactca

SEQ ID NO: 932579 - DNA, 25 bp, Mus musculus
ttccaaccgttgcaaatttcctggt

SEQ ID NO: 932580 - DNA, 25 bp, Mus musculus
ttccaaccgttggaaatttcctggt

SEQ ID NO: 932581 - DNA, 25 bp, Mus musculus
ttccaacctaagaaactgcctctca

SEQ ID NO: 932582 - DNA, 25 bp, Mus musculus
ttccaacctaagtaactgcctctca

SEQ ID NO: 932583 - DNA, 25 bp, Mus musculus
ttccaacctccaactaactgtgttg

SEQ ID NO: 932584 - DNA, 25 bp, Mus musculus
ttccaacctccatctaactgtgttg

SEQ ID NO: 932585 - DNA, 25 bp, Mus musculus
ttccaacctctaacccaatttaata

SEQ ID NO: 932586 - DNA, 25 bp, Mus musculus
ttccaacctctatcccaatttaata

SEQ ID NO: 932587 - DNA, 25 bp, Mus musculus
ttccaacctcttcacatcgagatca

SEQ ID NO: 932588 - DNA, 25 bp, Mus musculus
ttccaacctcttgacatcgagatca

SEQ ID NO: 932589 - DNA, 25 bp, Mus musculus
ttccaacctggaagggctgcttcaa

SEQ ID NO: 932590 - DNA, 25 bp, Mus musculus
ttccaacctggatgggctgcttcaa

SEQ ID NO: 932591 - DNA, 25 bp, Mus musculus
ttccaacctggccacctgaattcaa

SEQ ID NO: 932592 - DNA, 25 bp, Mus musculus
ttccaacctggcgacctgaattcaa

SEQ ID NO: 932593 - DNA, 25 bp, Mus musculus
ttccaaccttaaacacaatgttatg

SEQ ID NO: 932594 - DNA, 25 bp, Mus musculus
ttccaaccttaatcacaatgttatg

SEQ ID NO: 932595 - DNA, 25 bp, Mus musculus
ttccaaccttgaatcgttacagcga

SEQ ID NO: 932596 - DNA, 25 bp, Mus musculus
ttccaaccttgattcgttacagcga

SEQ ID NO: 932597 - DNA, 25 bp, Mus musculus
ttccaacctttacagttcacgagag

SEQ ID NO: 932598 - DNA, 25 bp, Mus musculus
ttccaacctttagagttcacgagag

SEQ ID NO: 932599 - DNA, 25 bp, Mus musculus
ttccaacgagctaccggacttggtt

SEQ ID NO: 932600 - DNA, 25 bp, Mus musculus
ttccaacgagcttccggacttggtt

SEQ ID NO: 932601 - DNA, 25 bp, Mus musculus
ttccaacgctgcctttgctttaaaa

SEQ ID NO: 932602 - DNA, 25 bp, Mus musculus
ttccaacgctgcgtttgctttaaaa

SEQ ID NO: 932603 - DNA, 25 bp, Mus musculus
ttccaacgggtcataaagactctgt

SEQ ID NO: 932604 - DNA, 25 bp, Mus musculus
ttccaacgggtcttaaagactctgt

SEQ ID NO: 932605 - DNA, 25 bp, Mus musculus
ttccaactatgtcacctctaacctg

SEQ ID NO: 932606 - DNA, 25 bp, Mus musculus
ttccaactatgtgacctctaacctg

SEQ ID NO: 932607 - DNA, 25 bp, Mus musculus
ttccaactcccaagaagttatccct

SEQ ID NO: 932608 - DNA, 25 bp, Mus musculus
ttccaactcccatgaagttatccct

SEQ ID NO: 932609 - DNA, 25 bp, Mus musculus
ttccaactcggaattgccaagtgat

SEQ ID NO: 932610 - DNA, 25 bp, Mus musculus
ttccaactcggatttgccaagtgat

SEQ ID NO: 932611 - DNA, 25 bp, Mus musculus
ttccaactctggagccatatctagc

SEQ ID NO: 932612 - DNA, 25 bp, Mus musculus
ttccaactctggtgccatatctagc

SEQ ID NO: 932613 - DNA, 25 bp, Mus musculus
ttccaactgatcagtttccacatgg

SEQ ID NO: 932614 - DNA, 25 bp, Mus musculus
ttccaactgatctgtttccacatgg

SEQ ID NO: 932615 - DNA, 25 bp, Mus musculus
ttccaactggacagctcttgagaaa

SEQ ID NO: 932616 - DNA, 25 bp, Mus musculus
ttccaactggactgctcttgagaaa

SEQ ID NO: 932617 - DNA, 25 bp, Mus musculus
ttccaactggtacaaagttcctatg

SEQ ID NO: 932618 - DNA, 25 bp, Mus musculus
ttccaactggtagaaagttcctatg

SEQ ID NO: 932619 - DNA, 25 bp, Mus musculus
ttccaactgtagcagcaggttcaga

SEQ ID NO: 932620 - DNA, 25 bp, Mus musculus
ttccaactgtaggagcaggttcaga

SEQ ID NO: 932621 - DNA, 25 bp, Mus musculus
ttccaacttaacctcagtaatgtag

SEQ ID NO: 932622 - DNA, 25 bp, Mus musculus
ttccaacttaacgtcagtaatgtag

SEQ ID NO: 932623 - DNA, 25 bp, Mus musculus
ttccaacttagacatgtgcctgccc

SEQ ID NO: 932624 - DNA, 25 bp, Mus musculus
ttccaacttagagatgtgcctgccc

SEQ ID NO: 932625 - DNA, 25 bp, Mus musculus
ttccaacttgagcttcccgcgaact

SEQ ID NO: 932626 - DNA, 25 bp, Mus musculus
ttccaacttgaggttcccgcgaact

SEQ ID NO: 932627 - DNA, 25 bp, Mus musculus
ttccaacttgccatgttaaccagga

SEQ ID NO: 932628 - DNA, 25 bp, Mus musculus
ttccaacttgccttgttaaccagga

SEQ ID NO: 932629 - DNA, 25 bp, Mus musculus
ttccaacttggcctcttaaatgtcg

SEQ ID NO: 932630 - DNA, 25 bp, Mus musculus
ttccaacttggcgtcttaaatgtcg

SEQ ID NO: 932631 - DNA, 25 bp, Mus musculus
ttccaactttccatgcttctttgaa

SEQ ID NO: 932632 - DNA, 25 bp, Mus musculus
ttccaactttccttgcttctttgaa

SEQ ID NO: 932633 - DNA, 25 bp, Mus musculus
ttccaactttggactgtggagccgt

SEQ ID NO: 932634 - DNA, 25 bp, Mus musculus
ttccaactttggtctgtggagccgt

SEQ ID NO: 932635 - DNA, 25 bp, Mus musculus
ttccaagaacctccttctactaggg

SEQ ID NO: 932636 - DNA, 25 bp, Mus musculus
ttccaagaacctgcttctactaggg

SEQ ID NO: 932637 - DNA, 25 bp, Mus musculus
ttccaagaagaaatgcccacgggat

SEQ ID NO: 932638 - DNA, 25 bp, Mus musculus
ttccaagaagaattgcccacgggat

SEQ ID NO: 932639 - DNA, 25 bp, Mus musculus
ttccaagaagcacgtccttgcagct

SEQ ID NO: 932640 - DNA, 25 bp, Mus musculus
ttccaagaagcaggtccttgcagct

SEQ ID NO: 932641 - DNA, 25 bp, Mus musculus
ttccaagaatgcctctgtatcaact

SEQ ID NO: 932642 - DNA, 25 bp, Mus musculus
ttccaagaatgcgtctgtatcaact

SEQ ID NO: 932643 - DNA, 25 bp, Mus musculus
ttccaagaattaccaggagctgcat

SEQ ID NO: 932644 - DNA, 25 bp, Mus musculus
ttccaagaattagcaggagctgcat

SEQ ID NO: 932645 - DNA, 25 bp, Mus musculus
ttccaagaattgaatctgcaagttc

SEQ ID NO: 932646 - DNA, 25 bp, Mus musculus
ttccaagaattgtatctgcaagttc

SEQ ID NO: 932647 - DNA, 25 bp, Mus musculus
ttccaagacagacgagtctcactgt

SEQ ID NO: 932648 - DNA, 25 bp, Mus musculus
ttccaagacagaggagtctcactgt

SEQ ID NO: 932649 - DNA, 25 bp, Mus musculus
ttccaagaccgcagtaaagtgtgct

SEQ ID NO: 932650 - DNA, 25 bp, Mus musculus
ttccaagaccgctgtaaagtgtgct

SEQ ID NO: 932651 - DNA, 25 bp, Mus musculus
ttccaagactccatcttaaattaat

SEQ ID NO: 932652 - DNA, 25 bp, Mus musculus
ttccaagactccttcttaaattaat

SEQ ID NO: 932653 - DNA, 25 bp, Mus musculus
ttccaagacttcaacctgccaggta

SEQ ID NO: 932654 - DNA, 25 bp, Mus musculus
ttccaagacttctacctgccaggta

SEQ ID NO: 932655 - DNA, 25 bp, Mus musculus
ttccaagagatacccatgtgtcatg

SEQ ID NO: 932656 - DNA, 25 bp, Mus musculus
ttccaagagatagccatgtgtcatg

SEQ ID NO: 932657 - DNA, 25 bp, Mus musculus
ttccaagagatcagacgctgtcctc

SEQ ID NO: 932658 - DNA, 25 bp, Mus musculus
ttccaagagatctgacgctgtcctc

SEQ ID NO: 932659 - DNA, 25 bp, Mus musculus
ttccaagatggcaaagaacaaggac

SEQ ID NO: 932660 - DNA, 25 bp, Mus musculus
ttccaagatggctaagaacaaggac

SEQ ID NO: 932661 - DNA, 25 bp, Mus musculus
ttccaagatgttaatttgcaccaaa

SEQ ID NO: 932662 - DNA, 25 bp, Mus musculus
ttccaagatgtttatttgcaccaaa

SEQ ID NO: 932663 - DNA, 25 bp, Mus musculus
ttccaagcacatctgcagccataac

SEQ ID NO: 932664 - DNA, 25 bp, Mus musculus
ttccaagcacatgtgcagccataac

SEQ ID NO: 932665 - DNA, 25 bp, Mus musculus
ttccaagcattactttaacctccct

SEQ ID NO: 932666 - DNA, 25 bp, Mus musculus
ttccaagcattagtttaacctccct

SEQ ID NO: 932667 - DNA, 25 bp, Mus musculus
ttccaagccacacctatccagagag

SEQ ID NO: 932668 - DNA, 25 bp, Mus musculus
ttccaagccacagctatccagagag

SEQ ID NO: 932669 - DNA, 25 bp, Mus musculus
ttccaagccagtctgacctaatgag

SEQ ID NO: 932670 - DNA, 25 bp, Mus musculus
ttccaagccagtgtgacctaatgag

SEQ ID NO: 932671 - DNA, 25 bp, Mus musculus
ttccaagcccggcactgaggcttga

SEQ ID NO: 932672 - DNA, 25 bp, Mus musculus
ttccaagcccgggactgaggcttga

SEQ ID NO: 932673 - DNA, 25 bp, Mus musculus
ttccaagctcccattgagacacagg

SEQ ID NO: 932674 - DNA, 25 bp, Mus musculus
ttccaagctccctttgagacacagg

SEQ ID NO: 932675 - DNA, 25 bp, Mus musculus
ttccaagctgacagcaacctggtgt

SEQ ID NO: 932676 - DNA, 25 bp, Mus musculus
ttccaagctgactgcaacctggtgt

SEQ ID NO: 932677 - DNA, 25 bp, Mus musculus
ttccaagcttacactctttgtctag

SEQ ID NO: 932678 - DNA, 25 bp, Mus musculus
ttccaagcttactctctttgtctag

SEQ ID NO: 932679 - DNA, 25 bp, Mus musculus
ttccaagctttaaagtcctggctcc

SEQ ID NO: 932680 - DNA, 25 bp, Mus musculus
ttccaagctttatagtcctggctcc

SEQ ID NO: 932681 - DNA, 25 bp, Mus musculus
ttccaaggaaacatttaagggctat

SEQ ID NO: 932682 - DNA, 25 bp, Mus musculus
ttccaaggaaacttttaagggctat

SEQ ID NO: 932683 - DNA, 25 bp, Mus musculus
ttccaaggatggattgggagcatca

SEQ ID NO: 932684 - DNA, 25 bp, Mus musculus
ttccaaggatggtttgggagcatca

SEQ ID NO: 932685 - DNA, 25 bp, Mus musculus
ttccaaggattgacattagagcacc

SEQ ID NO: 932686 - DNA, 25 bp, Mus musculus
ttccaaggattgtcattagagcacc

SEQ ID NO: 932687 - DNA, 25 bp, Mus musculus
ttccaaggcaagagggttcagatga

SEQ ID NO: 932688 - DNA, 25 bp, Mus musculus
ttccaaggcaagtgggttcagatga

SEQ ID NO: 932689 - DNA, 25 bp, Mus musculus
ttccaaggccagaatcctgggtcag

SEQ ID NO: 932690 - DNA, 25 bp, Mus musculus
ttccaaggccagtatcctgggtcag

SEQ ID NO: 932691 - DNA, 25 bp, Mus musculus
ttccaaggctatacgagcaccttag

SEQ ID NO: 932692 - DNA, 25 bp, Mus musculus
ttccaaggctattcgagcaccttag

SEQ ID NO: 932693 - DNA, 25 bp, Mus musculus
ttccaaggctggcaggagcttctga

SEQ ID NO: 932694 - DNA, 25 bp, Mus musculus
ttccaaggctgggaggagcttctga

SEQ ID NO: 932695 - DNA, 25 bp, Mus musculus
ttccaaggcttccttgtggggcctg

SEQ ID NO: 932696 - DNA, 25 bp, Mus musculus
ttccaaggcttcctttcacagttgt

SEQ ID NO: 932697 - DNA, 25 bp, Mus musculus
ttccaaggcttcgttgtggggcctg

SEQ ID NO: 932698 - DNA, 25 bp, Mus musculus
ttccaaggcttcgtttcacagttgt

SEQ ID NO: 932699 - DNA, 25 bp, Mus musculus
ttccaagggaatctaatgcctttga

SEQ ID NO: 932700 - DNA, 25 bp, Mus musculus
ttccaagggaatgtaatgcctttga

SEQ ID NO: 932701 - DNA, 25 bp, Mus musculus
ttccaagggccgcaagtttgagcgc

SEQ ID NO: 932702 - DNA, 25 bp, Mus musculus
ttccaagggccggaagtttgagcgc

SEQ ID NO: 932703 - DNA, 25 bp, Mus musculus
ttccaaggtagccatgccctaacca

SEQ ID NO: 932704 - DNA, 25 bp, Mus musculus
ttccaaggtagcgatgccctaacca

SEQ ID NO: 932705 - DNA, 25 bp, Mus musculus
ttccaaggttcacagagtggaggat

SEQ ID NO: 932706 - DNA, 25 bp, Mus musculus
ttccaaggttcagagagtggaggat

SEQ ID NO: 932707 - DNA, 25 bp, Mus musculus
ttccaagtatcaacaacttagtcta

SEQ ID NO: 932708 - DNA, 25 bp, Mus musculus
ttccaagtatcatcaacttagtcta

SEQ ID NO: 932709 - DNA, 25 bp, Mus musculus
ttccaagtccaaatcctggaggcag

SEQ ID NO: 932710 - DNA, 25 bp, Mus musculus
ttccaagtccaattcctggaggcag

SEQ ID NO: 932711 - DNA, 25 bp, Mus musculus
ttccaagtctagaggtggcagggaa

SEQ ID NO: 932712 - DNA, 25 bp, Mus musculus
ttccaagtctagtggtggcagggaa

SEQ ID NO: 932713 - DNA, 25 bp, Mus musculus
ttccaagtcttgataggtgtctgct

SEQ ID NO: 932714 - DNA, 25 bp, Mus musculus
ttccaagtcttgttaggtgtctgct

SEQ ID NO: 932715 - DNA, 25 bp, Mus musculus
ttccaagtctttctgtatttcaccc

SEQ ID NO: 932716 - DNA, 25 bp, Mus musculus
ttccaagtctttgtgtatttcaccc

SEQ ID NO: 932717 - DNA, 25 bp, Mus musculus
ttccaagtggccacattagactgcc

SEQ ID NO: 932718 - DNA, 25 bp, Mus musculus
ttccaagtggcctcattagactgcc

SEQ ID NO: 932719 - DNA, 25 bp, Mus musculus
ttccaagtggctcattaggttgtac

SEQ ID NO: 932720 - DNA, 25 bp, Mus musculus
ttccaagtggctgattaggttgtac

SEQ ID NO: 932721 - DNA, 25 bp, Mus musculus
ttccaagtgtgcagaccacccagag

SEQ ID NO: 932722 - DNA, 25 bp, Mus musculus
ttccaagtgtgctgaccacccagag

SEQ ID NO: 932723 - DNA, 25 bp, Mus musculus
ttccaagttcttacacatgctcaac

SEQ ID NO: 932724 - DNA, 25 bp, Mus musculus
ttccaagttctttcacatgctcaac

SEQ ID NO: 932725 - DNA, 25 bp, Mus musculus
ttccaagttgcaaattcgtgtgcta

SEQ ID NO: 932726 - DNA, 25 bp, Mus musculus
ttccaagttgcatattcgtgtgcta

SEQ ID NO: 932727 - DNA, 25 bp, Mus musculus
ttccaatagactatgggcctgcggt

SEQ ID NO: 932728 - DNA, 25 bp, Mus musculus
ttccaatagactttgggcctgcggt

SEQ ID NO: 932729 - DNA, 25 bp, Mus musculus
ttccaatatgaacgccttccctgca

SEQ ID NO: 932730 - DNA, 25 bp, Mus musculus
ttccaatatgaaggccttccctgca

SEQ ID NO: 932731 - DNA, 25 bp, Mus musculus
ttccaatcagaccagagttcgtgct

SEQ ID NO: 932732 - DNA, 25 bp, Mus musculus
ttccaatcagacgagagttcgtgct

SEQ ID NO: 932733 - DNA, 25 bp, Mus musculus
ttccaatcagttctcaagtctccaa

SEQ ID NO: 932734 - DNA, 25 bp, Mus musculus
ttccaatcagttgtcaagtctccaa

SEQ ID NO: 932735 - DNA, 25 bp, Mus musculus
ttccaatcctggatgagtgtagcaa

SEQ ID NO: 932736 - DNA, 25 bp, Mus musculus
ttccaatcctggttgagtgtagcaa

SEQ ID NO: 932737 - DNA, 25 bp, Mus musculus
ttccaatctatgatggtttacctgt

SEQ ID NO: 932738 - DNA, 25 bp, Mus musculus
ttccaatctatgttggtttacctgt

SEQ ID NO: 932739 - DNA, 25 bp, Mus musculus
ttccaatgccttacacgtgtacaga

SEQ ID NO: 932740 - DNA, 25 bp, Mus musculus
ttccaatgcctttcacgtgtacaga

SEQ ID NO: 932741 - DNA, 25 bp, Mus musculus
ttccaatgctacataaaggcccttt

SEQ ID NO: 932742 - DNA, 25 bp, Mus musculus
ttccaatgctacttaaaggcccttt

SEQ ID NO: 932743 - DNA, 25 bp, Mus musculus
ttccaatggcctcggaaaccccatt

SEQ ID NO: 932744 - DNA, 25 bp, Mus musculus
ttccaatggcctgggaaaccccatt

SEQ ID NO: 932745 - DNA, 25 bp, Mus musculus
ttccaatgtaatagccgtcttctgt

SEQ ID NO: 932746 - DNA, 25 bp, Mus musculus
ttccaatgtaattgccgtcttctgt

SEQ ID NO: 932747 - DNA, 25 bp, Mus musculus
ttccaatgttgtcaaggcagagatt

SEQ ID NO: 932748 - DNA, 25 bp, Mus musculus
ttccaatgttgtgaaggcagagatt

SEQ ID NO: 932749 - DNA, 25 bp, Mus musculus
ttccaattatatagaggccttaaaa

SEQ ID NO: 932750 - DNA, 25 bp, Mus musculus
ttccaattatattgaggccttaaaa

SEQ ID NO: 932751 - DNA, 25 bp, Mus musculus
ttccaattcattcccattatcccat

SEQ ID NO: 932752 - DNA, 25 bp, Mus musculus
ttccaattcattgccattatcccat

SEQ ID NO: 932753 - DNA, 25 bp, Mus musculus
ttccaattcctcatcggagttccct

SEQ ID NO: 932754 - DNA, 25 bp, Mus musculus
ttccaattcctcttcggagttccct

SEQ ID NO: 932755 - DNA, 25 bp, Mus musculus
ttccaattctataccattctcacaa

SEQ ID NO: 932756 - DNA, 25 bp, Mus musculus
ttccaattctattccattctcacaa

SEQ ID NO: 932757 - DNA, 25 bp, Mus musculus
ttccaattgaatccatcttcccttc

SEQ ID NO: 932758 - DNA, 25 bp, Mus musculus
ttccaattgaatgcatcttcccttc

SEQ ID NO: 932759 - DNA, 25 bp, Mus musculus
ttccaatttcttcttcatgtaagat

SEQ ID NO: 932760 - DNA, 25 bp, Mus musculus
ttccaatttcttgttcatgtaagat

SEQ ID NO: 932761 - DNA, 25 bp, Mus musculus
ttccaatttggaatcgacatagtca

SEQ ID NO: 932762 - DNA, 25 bp, Mus musculus
ttccaatttggattcgacatagtca

SEQ ID NO: 932763 - DNA, 25 bp, Mus musculus
ttccacaacaacctcgtgggtgtga

SEQ ID NO: 932764 - DNA, 25 bp, Mus musculus
ttccacaacaacgtcgtgggtgtga

SEQ ID NO: 932765 - DNA, 25 bp, Mus musculus
ttccacaagccaagtactactcgag

SEQ ID NO: 932766 - DNA, 25 bp, Mus musculus
ttccacaagccatgtactactcgag

SEQ ID NO: 932767 - DNA, 25 bp, Mus musculus
ttccacaagggaaccggtctccatg

SEQ ID NO: 932768 - DNA, 25 bp, Mus musculus
ttccacaagggatccggtctccatg

SEQ ID NO: 932769 - DNA, 25 bp, Mus musculus
ttccacaagtgcatagtaacttatg

SEQ ID NO: 932770 - DNA, 25 bp, Mus musculus
ttccacaagtgccttttttaaacag

SEQ ID NO: 932771 - DNA, 25 bp, Mus musculus
ttccacaagtgcgttttttaaacag

SEQ ID NO: 932772 - DNA, 25 bp, Mus musculus
ttccacaagtgcttagtaacttatg

SEQ ID NO: 932773 - DNA, 25 bp, Mus musculus
ttccacaatgaccatactaggtcgc

SEQ ID NO: 932774 - DNA, 25 bp, Mus musculus
ttccacaatgacgatactaggtcgc

SEQ ID NO: 932775 - DNA, 25 bp, Mus musculus
ttccacaatgagctgcgatttcctt

SEQ ID NO: 932776 - DNA, 25 bp, Mus musculus
ttccacaatgaggtgcgatttcctt

SEQ ID NO: 932777 - DNA, 25 bp, Mus musculus
ttccacacagccattgcctagagtg

SEQ ID NO: 932778 - DNA, 25 bp, Mus musculus
ttccacacagcctttgcctagagtg

SEQ ID NO: 932779 - DNA, 25 bp, Mus musculus
ttccacacaggaccatgagggtctt

SEQ ID NO: 932780 - DNA, 25 bp, Mus musculus
ttccacacaggagcatgagggtctt

SEQ ID NO: 932781 - DNA, 25 bp, Mus musculus
ttccacaccagaatgccctttggtt

SEQ ID NO: 932782 - DNA, 25 bp, Mus musculus
ttccacaccagattgccctttggtt

SEQ ID NO: 932783 - DNA, 25 bp, Mus musculus
ttccacaccctacatttttcataag

SEQ ID NO: 932784 - DNA, 25 bp, Mus musculus
ttccacaccctagatttttcataag

SEQ ID NO: 932785 - DNA, 25 bp, Mus musculus
ttccacacgaaaactatgtacgcat

SEQ ID NO: 932786 - DNA, 25 bp, Mus musculus
ttccacacgaaatctatgtacgcat

SEQ ID NO: 932787 - DNA, 25 bp, Mus musculus
ttccacacggttatcaagccagaag

SEQ ID NO: 932788 - DNA, 25 bp, Mus musculus
ttccacacggttttcaagccagaag

SEQ ID NO: 932789 - DNA, 25 bp, Mus musculus
ttccacactgctatgcaatgaagat

SEQ ID NO: 932790 - DNA, 25 bp, Mus musculus
ttccacactgctttgcaatgaagat

SEQ ID NO: 932791 - DNA, 25 bp, Mus musculus
ttccacactggaaacactgactttt

SEQ ID NO: 932792 - DNA, 25 bp, Mus musculus
ttccacactggatacactgactttt

SEQ ID NO: 932793 - DNA, 25 bp, Mus musculus
ttccacacttctcatacacaaactg

SEQ ID NO: 932794 - DNA, 25 bp, Mus musculus
ttccacacttctgatacacaaactg

SEQ ID NO: 932795 - DNA, 25 bp, Mus musculus
ttccacactttgaaaaagcaacaca

SEQ ID NO: 932796 - DNA, 25 bp, Mus musculus
ttccacactttgtaaaagcaacaca

SEQ ID NO: 932797 - DNA, 25 bp, Mus musculus
ttccacagaaccattgttacgcttt

SEQ ID NO: 932798 - DNA, 25 bp, Mus musculus
ttccacagaacctttgttacgcttt

SEQ ID NO: 932799 - DNA, 25 bp, Mus musculus
ttccacagaagccaggttaccttag

SEQ ID NO: 932800 - DNA, 25 bp, Mus musculus
ttccacagaagcgaggttaccttag

SEQ ID NO: 932801 - DNA, 25 bp, Mus musculus
ttccacagaattatgtcaagctcct

SEQ ID NO: 932802 - DNA, 25 bp, Mus musculus
ttccacagaattttgtcaagctcct

SEQ ID NO: 932803 - DNA, 25 bp, Mus musculus
ttccacagacatccgcaattgattt

SEQ ID NO: 932804 - DNA, 25 bp, Mus musculus
ttccacagacatgcgcaattgattt

SEQ ID NO: 932805 - DNA, 25 bp, Mus musculus
ttccacagattgatcgcctcaaggg

SEQ ID NO: 932806 - DNA, 25 bp, Mus musculus
ttccacagattgttcgcctcaaggg

SEQ ID NO: 932807 - DNA, 25 bp, Mus musculus
ttccacagcatccaggaggccaatg

SEQ ID NO: 932808 - DNA, 25 bp, Mus musculus
ttccacagcatcgaggaggccaatg

SEQ ID NO: 932809 - DNA, 25 bp, Mus musculus
ttccacaggccaaagagattttctt

SEQ ID NO: 932810 - DNA, 25 bp, Mus musculus
ttccacaggccatagagattttctt

SEQ ID NO: 932811 - DNA, 25 bp, Mus musculus
ttccacagggcgctgttcattcaag

SEQ ID NO: 932812 - DNA, 25 bp, Mus musculus
ttccacagggcggtgttcattcaag

SEQ ID NO: 932813 - DNA, 25 bp, Mus musculus
ttccacagggctattcatcaccaaa

SEQ ID NO: 932814 - DNA, 25 bp, Mus musculus
ttccacagggcttttcatcaccaaa

SEQ ID NO: 932815 - DNA, 25 bp, Mus musculus
ttccacagttagcatgaagacttcg

SEQ ID NO: 932816 - DNA, 25 bp, Mus musculus
ttccacagttaggatgaagacttcg

SEQ ID NO: 932817 - DNA, 25 bp, Mus musculus
ttccacagttatatgcatgcccttt

SEQ ID NO: 932818 - DNA, 25 bp, Mus musculus
ttccacagttatttgcatgcccttt

SEQ ID NO: 932819 - DNA, 25 bp, Mus musculus
ttccacagttgacagcccttctagt

SEQ ID NO: 932820 - DNA, 25 bp, Mus musculus
ttccacagttgagagcccttctagt

SEQ ID NO: 932821 - DNA, 25 bp, Mus musculus
ttccacataatgcattatctacagg

SEQ ID NO: 932822 - DNA, 25 bp, Mus musculus
ttccacataatggattatctacagg

SEQ ID NO: 932823 - DNA, 25 bp, Mus musculus
ttccacatagccaggtacctactga

SEQ ID NO: 932824 - DNA, 25 bp, Mus musculus
ttccacatagcctggtacctactga

SEQ ID NO: 932825 - DNA, 25 bp, Mus musculus
ttccacatagtcaccgtaggctgag

SEQ ID NO: 932826 - DNA, 25 bp, Mus musculus
ttccacatagtctccgtaggctgag

SEQ ID NO: 932827 - DNA, 25 bp, Mus musculus
ttccacatagtgagacctttttctg

SEQ ID NO: 932828 - DNA, 25 bp, Mus musculus
ttccacatagtgtgacctttttctg

SEQ ID NO: 932829 - DNA, 25 bp, Mus musculus
ttccacatatgtccgggtgcaggtg

SEQ ID NO: 932830 - DNA, 25 bp, Mus musculus
ttccacatatgtgcgggtgcaggtg

SEQ ID NO: 932831 - DNA, 25 bp, Mus musculus
ttccacatcataacaaagttcaata

SEQ ID NO: 932832 - DNA, 25 bp, Mus musculus
ttccacatcatatcaaagttcaata

SEQ ID NO: 932833 - DNA, 25 bp, Mus musculus
ttccacatcccaagagcagctatag

SEQ ID NO: 932834 - DNA, 25 bp, Mus musculus
ttccacatcccatgagcagctatag

SEQ ID NO: 932835 - DNA, 25 bp, Mus musculus
ttccacatccctcagggcatagagt

SEQ ID NO: 932836 - DNA, 25 bp, Mus musculus
ttccacatccctgagggcatagagt

SEQ ID NO: 932837 - DNA, 25 bp, Mus musculus
ttccacatcgtgagagggatgaggc

SEQ ID NO: 932838 - DNA, 25 bp, Mus musculus
ttccacatcgtgtgagggatgaggc

SEQ ID NO: 932839 - DNA, 25 bp, Mus musculus
ttccacatctcaaactctttagttc

SEQ ID NO: 932840 - DNA, 25 bp, Mus musculus
ttccacatctcatactctttagttc

SEQ ID NO: 932841 - DNA, 25 bp, Mus musculus
ttccacatcttgacttgaccagcag

SEQ ID NO: 932842 - DNA, 25 bp, Mus musculus
ttccacatcttgtcttgaccagcag

SEQ ID NO: 932843 - DNA, 25 bp, Mus musculus
ttccacatgcacattgggagcctgc

SEQ ID NO: 932844 - DNA, 25 bp, Mus musculus
ttccacatgcactttgggagcctgc

SEQ ID NO: 932845 - DNA, 25 bp, Mus musculus
ttccacatgcccacaaggaggtttt

SEQ ID NO: 932846 - DNA, 25 bp, Mus musculus
ttccacatgccctcaaggaggtttt

SEQ ID NO: 932847 - DNA, 25 bp, Mus musculus
ttccacatgcttcctattttctcct

SEQ ID NO: 932848 - DNA, 25 bp, Mus musculus
ttccacatgcttgctattttctcct

SEQ ID NO: 932849 - DNA, 25 bp, Mus musculus
ttccacatgggtagatttgagtaat

SEQ ID NO: 932850 - DNA, 25 bp, Mus musculus
ttccacatgggttgatttgagtaat

SEQ ID NO: 932851 - DNA, 25 bp, Mus musculus
ttccacatgtcccatagccatcatg

SEQ ID NO: 932852 - DNA, 25 bp, Mus musculus
ttccacatgtccgatagccatcatg

SEQ ID NO: 932853 - DNA, 25 bp, Mus musculus
ttccacatgtggacactttcagggt

SEQ ID NO: 932854 - DNA, 25 bp, Mus musculus
ttccacatgtggcttttcagagcaa

SEQ ID NO: 932855 - DNA, 25 bp, Mus musculus
ttccacatgtgggttttcagagcaa

SEQ ID NO: 932856 - DNA, 25 bp, Mus musculus
ttccacatgtggtcactttcagggt

SEQ ID NO: 932857 - DNA, 25 bp, Mus musculus
ttccacatgtttagccttggagaaa

SEQ ID NO: 932858 - DNA, 25 bp, Mus musculus
ttccacatgttttgccttggagaaa

SEQ ID NO: 932859 - DNA, 25 bp, Mus musculus
ttccacattcagatggacactgccc

SEQ ID NO: 932860 - DNA, 25 bp, Mus musculus
ttccacattcagttggacactgccc

SEQ ID NO: 932861 - DNA, 25 bp, Mus musculus
ttccacattcctattgatttttcat

SEQ ID NO: 932862 - DNA, 25 bp, Mus musculus
ttccacattccttttgatttttcat

SEQ ID NO: 932863 - DNA, 25 bp, Mus musculus
ttccacattcttcccgaggaaatcg

SEQ ID NO: 932864 - DNA, 25 bp, Mus musculus
ttccacattcttgccgaggaaatcg

SEQ ID NO: 932865 - DNA, 25 bp, Mus musculus
ttccacatttaacgcctttctcttc

SEQ ID NO: 932866 - DNA, 25 bp, Mus musculus
ttccacatttaaggcctttctcttc

SEQ ID NO: 932867 - DNA, 25 bp, Mus musculus
ttccacatttgacgacgataatcag

SEQ ID NO: 932868 - DNA, 25 bp, Mus musculus
ttccacatttgaggacgataatcag

SEQ ID NO: 932869 - DNA, 25 bp, Mus musculus
ttccaccaaaataagcttcacagca

SEQ ID NO: 932870 - DNA, 25 bp, Mus musculus
ttccaccaaaattagcttcacagca

SEQ ID NO: 932871 - DNA, 25 bp, Mus musculus
ttccaccaagccatgtgtgcatctt

SEQ ID NO: 932872 - DNA, 25 bp, Mus musculus
ttccaccaagccttgtgtgcatctt

SEQ ID NO: 932873 - DNA, 25 bp, Mus musculus
ttccaccaagtgagctccaaggttg

SEQ ID NO: 932874 - DNA, 25 bp, Mus musculus
ttccaccaagtgtgctccaaggttg

SEQ ID NO: 932875 - DNA, 25 bp, Mus musculus
ttccaccaccatcagcatgtcagtt

SEQ ID NO: 932876 - DNA, 25 bp, Mus musculus
ttccaccaccatgagcatgtcagtt

SEQ ID NO: 932877 - DNA, 25 bp, Mus musculus
ttccaccacctaatgatagggaata

SEQ ID NO: 932878 - DNA, 25 bp, Mus musculus
ttccaccacctattgatagggaata

SEQ ID NO: 932879 - DNA, 25 bp, Mus musculus
ttccaccacctcaaaccataggttt

SEQ ID NO: 932880 - DNA, 25 bp, Mus musculus
ttccaccacctctaaccataggttt

SEQ ID NO: 932881 - DNA, 25 bp, Mus musculus
ttccaccactaaccttaggcaagac

SEQ ID NO: 932882 - DNA, 25 bp, Mus musculus
ttccaccactaagcttaggcaagac

SEQ ID NO: 932883 - DNA, 25 bp, Mus musculus
ttccaccactagaaagaagattcat

SEQ ID NO: 932884 - DNA, 25 bp, Mus musculus
ttccaccactagtaagaagattcat

SEQ ID NO: 932885 - DNA, 25 bp, Mus musculus
ttccaccagagtagcatttctttct

SEQ ID NO: 932886 - DNA, 25 bp, Mus musculus
ttccaccagagttgcatttctttct

SEQ ID NO: 932887 - DNA, 25 bp, Mus musculus
ttccaccagctcagggattggctga

SEQ ID NO: 932888 - DNA, 25 bp, Mus musculus
ttccaccagctctgggattggctga

SEQ ID NO: 932889 - DNA, 25 bp, Mus musculus
ttccaccagtacaccgggcgagagg

SEQ ID NO: 932890 - DNA, 25 bp, Mus musculus
ttccaccagtactccgggcgagagg

SEQ ID NO: 932891 - DNA, 25 bp, Mus musculus
ttccaccagtcgcagtgacatgagt

SEQ ID NO: 932892 - DNA, 25 bp, Mus musculus
ttccaccagtcggagtgacatgagt

SEQ ID NO: 932893 - DNA, 25 bp, Mus musculus
ttccaccagttactggcggctcagc

SEQ ID NO: 932894 - DNA, 25 bp, Mus musculus
ttccaccagttagtggcggctcagc

SEQ ID NO: 932895 - DNA, 25 bp, Mus musculus
ttccaccagttccatgttgctaagg

SEQ ID NO: 932896 - DNA, 25 bp, Mus musculus
ttccaccagttcgatgttgctaagg

SEQ ID NO: 932897 - DNA, 25 bp, Mus musculus
ttccaccatactcctgtcagaattg

SEQ ID NO: 932898 - DNA, 25 bp, Mus musculus
ttccaccatactgctgtcagaattg

SEQ ID NO: 932899 - DNA, 25 bp, Mus musculus
ttccaccatccgacacgtattaaaa

SEQ ID NO: 932900 - DNA, 25 bp, Mus musculus
ttccaccatccgtcacgtattaaaa

SEQ ID NO: 932901 - DNA, 25 bp, Mus musculus
ttccaccatctaagatgagcctctg

SEQ ID NO: 932902 - DNA, 25 bp, Mus musculus
ttccaccatctatgatgagcctctg

SEQ ID NO: 932903 - DNA, 25 bp, Mus musculus
ttccaccatgaaatgaacccaactg

SEQ ID NO: 932904 - DNA, 25 bp, Mus musculus
ttccaccatgaattgaacccaactg

SEQ ID NO: 932905 - DNA, 25 bp, Mus musculus
ttccaccatgttcgctgttgactct

SEQ ID NO: 932906 - DNA, 25 bp, Mus musculus
ttccaccatgttggctgttgactct

SEQ ID NO: 932907 - DNA, 25 bp, Mus musculus
ttccaccattataaccctaggcata

SEQ ID NO: 932908 - DNA, 25 bp, Mus musculus
ttccaccattattaccctaggcata

SEQ ID NO: 932909 - DNA, 25 bp, Mus musculus
ttccacccaacacaccagagaattt

SEQ ID NO: 932910 - DNA, 25 bp, Mus musculus
ttccacccaacagaccagagaattt

SEQ ID NO: 932911 - DNA, 25 bp, Mus musculus
ttccacccagcgcaaactagggaat

SEQ ID NO: 932912 - DNA, 25 bp, Mus musculus
ttccacccagcggaaactagggaat

SEQ ID NO: 932913 - DNA, 25 bp, Mus musculus
ttccacccatttaacgtttgctact

SEQ ID NO: 932914 - DNA, 25 bp, Mus musculus
ttccacccattttacgtttgctact

SEQ ID NO: 932915 - DNA, 25 bp, Mus musculus
ttccaccccaggctaaaggaagaca

SEQ ID NO: 932916 - DNA, 25 bp, Mus musculus
ttccaccccagggtaaaggaagaca

SEQ ID NO: 932917 - DNA, 25 bp, Mus musculus
ttccaccccatgagaattatgacat

SEQ ID NO: 932918 - DNA, 25 bp, Mus musculus
ttccaccccatgtgaattatgacat

SEQ ID NO: 932919 - DNA, 25 bp, Mus musculus
ttccacccctggaatacatggaggg

SEQ ID NO: 932920 - DNA, 25 bp, Mus musculus
ttccacccctggtatacatggaggg

SEQ ID NO: 932921 - DNA, 25 bp, Mus musculus
ttccacccctgtagttttttcagag

SEQ ID NO: 932922 - DNA, 25 bp, Mus musculus
ttccacccctgttgttttttcagag

SEQ ID NO: 932923 - DNA, 25 bp, Mus musculus
ttccacccggatatactgtaacatt

SEQ ID NO: 932924 - DNA, 25 bp, Mus musculus
ttccacccggatttactgtaacatt

SEQ ID NO: 932925 - DNA, 25 bp, Mus musculus
ttccacccgtgtctgtgtgagttgt

SEQ ID NO: 932926 - DNA, 25 bp, Mus musculus
ttccacccgtgtgtgtgtgagttgt

SEQ ID NO: 932927 - DNA, 25 bp, Mus musculus
ttccaccctgggatcagcaggctac

SEQ ID NO: 932928 - DNA, 25 bp, Mus musculus
ttccaccctgggttcagcaggctac

SEQ ID NO: 932929 - DNA, 25 bp, Mus musculus
ttccaccctggtacgtcgtatataa

SEQ ID NO: 932930 - DNA, 25 bp, Mus musculus
ttccaccctggttcgtcgtatataa

SEQ ID NO: 932931 - DNA, 25 bp, Mus musculus
ttccaccgccctattatggttggga

SEQ ID NO: 932932 - DNA, 25 bp, Mus musculus
ttccaccgcccttttatggttggga

SEQ ID NO: 932933 - DNA, 25 bp, Mus musculus
ttccaccgtgaaccgaaagagccag

SEQ ID NO: 932934 - DNA, 25 bp, Mus musculus
ttccaccgtgaagcgaaagagccag

SEQ ID NO: 932935 - DNA, 25 bp, Mus musculus
ttccaccgtgacaacaaagcgatta

SEQ ID NO: 932936 - DNA, 25 bp, Mus musculus
ttccaccgtgactacaaagcgatta

SEQ ID NO: 932937 - DNA, 25 bp, Mus musculus
ttccaccgtgtgaacttgagattct

SEQ ID NO: 932938 - DNA, 25 bp, Mus musculus
ttccaccgtgtgtacttgagattct

SEQ ID NO: 932939 - DNA, 25 bp, Mus musculus
ttccaccgttttctgcatatgttgc

SEQ ID NO: 932940 - DNA, 25 bp, Mus musculus
ttccaccgttttgtgcatatgttgc

SEQ ID NO: 932941 - DNA, 25 bp, Mus musculus
ttccacctagggatttcctaatcat

SEQ ID NO: 932942 - DNA, 25 bp, Mus musculus
ttccacctagggttttcctaatcat

SEQ ID NO: 932943 - DNA, 25 bp, Mus musculus
ttccacctaggtaaataccagcagg

SEQ ID NO: 932944 - DNA, 25 bp, Mus musculus
ttccacctaggtaagccataactat

SEQ ID NO: 932945 - DNA, 25 bp, Mus musculus
ttccacctaggttaataccagcagg

SEQ ID NO: 932946 - DNA, 25 bp, Mus musculus
ttccacctaggttagccataactat

SEQ ID NO: 932947 - DNA, 25 bp, Mus musculus
ttccacctatttaccaagcatttta

SEQ ID NO: 932948 - DNA, 25 bp, Mus musculus
ttccacctattttccaagcatttta

SEQ ID NO: 932949 - DNA, 25 bp, Mus musculus
ttccacctcagcaaatatatggcat

SEQ ID NO: 932950 - DNA, 25 bp, Mus musculus
ttccacctcagcactgaattcttta

SEQ ID NO: 932951 - DNA, 25 bp, Mus musculus
ttccacctcagctaatatatggcat

SEQ ID NO: 932952 - DNA, 25 bp, Mus musculus
ttccacctcagctctgaattcttta

SEQ ID NO: 932953 - DNA, 25 bp, Mus musculus
ttccacctctaactcacagatctga

SEQ ID NO: 932954 - DNA, 25 bp, Mus musculus
ttccacctctaagtcacagatctga

SEQ ID NO: 932955 - DNA, 25 bp, Mus musculus
ttccacctgacccaagttttaagtg

SEQ ID NO: 932956 - DNA, 25 bp, Mus musculus
ttccacctgaccgaagttttaagtg

SEQ ID NO: 932957 - DNA, 25 bp, Mus musculus
ttccacctgcaaacttcagcagcag

SEQ ID NO: 932958 - DNA, 25 bp, Mus musculus
ttccacctgcaatcttcagcagcag

SEQ ID NO: 932959 - DNA, 25 bp, Mus musculus
ttccacctgcacctcagttgaaaaa

SEQ ID NO: 932960 - DNA, 25 bp, Mus musculus
ttccacctgcacgtcagttgaaaaa

SEQ ID NO: 932961 - DNA, 25 bp, Mus musculus
ttccacctgcagcacttctgtattt

SEQ ID NO: 932962 - DNA, 25 bp, Mus musculus
ttccacctgcaggacttctgtattt

SEQ ID NO: 932963 - DNA, 25 bp, Mus musculus
ttccacctgcttccaatgcggatgg

SEQ ID NO: 932964 - DNA, 25 bp, Mus musculus
ttccacctgcttgcaatgcggatgg

SEQ ID NO: 932965 - DNA, 25 bp, Mus musculus
ttccacctgggacatgctgcgatgc

SEQ ID NO: 932966 - DNA, 25 bp, Mus musculus
ttccacctgggagatgctgcgatgc

SEQ ID NO: 932967 - DNA, 25 bp, Mus musculus
ttccacctggtcattactcttaggg

SEQ ID NO: 932968 - DNA, 25 bp, Mus musculus
ttccacctggtctttactcttaggg

SEQ ID NO: 932969 - DNA, 25 bp, Mus musculus
ttccacctggttagctcttgtagca

SEQ ID NO: 932970 - DNA, 25 bp, Mus musculus
ttccacctggtttgctcttgtagca

SEQ ID NO: 932971 - DNA, 25 bp, Mus musculus
ttccacctgtaaaaaatgccagttt

SEQ ID NO: 932972 - DNA, 25 bp, Mus musculus
ttccacctgtaataaatgccagttt

SEQ ID NO: 932973 - DNA, 25 bp, Mus musculus
ttccacctgtgtccatgtaagcaca

SEQ ID NO: 932974 - DNA, 25 bp, Mus musculus
ttccacctgtgtgcatgtaagcaca

SEQ ID NO: 932975 - DNA, 25 bp, Mus musculus
ttccaccttagaacaggactgttgg

SEQ ID NO: 932976 - DNA, 25 bp, Mus musculus
ttccaccttagaccatggccaagtt

SEQ ID NO: 932977 - DNA, 25 bp, Mus musculus
ttccaccttagagcatggccaagtt

SEQ ID NO: 932978 - DNA, 25 bp, Mus musculus
ttccaccttagatcaggactgttgg

SEQ ID NO: 932979 - DNA, 25 bp, Mus musculus
ttccaccttaggcaccaatgtcagg

SEQ ID NO: 932980 - DNA, 25 bp, Mus musculus
ttccaccttagggaccaatgtcagg

SEQ ID NO: 932981 - DNA, 25 bp, Mus musculus
ttccaccttcataaacagactactc

SEQ ID NO: 932982 - DNA, 25 bp, Mus musculus
ttccaccttcattaacagactactc

SEQ ID NO: 932983 - DNA, 25 bp, Mus musculus
ttccaccttcctagatacatagctt

SEQ ID NO: 932984 - DNA, 25 bp, Mus musculus
ttccaccttccttgatacatagctt

SEQ ID NO: 932985 - DNA, 25 bp, Mus musculus
ttccacctttgacctttaataatga

SEQ ID NO: 932986 - DNA, 25 bp, Mus musculus
ttccacctttgagctttaataatga

SEQ ID NO: 932987 - DNA, 25 bp, Mus musculus
ttccacctttgtagcactcttcctc

SEQ ID NO: 932988 - DNA, 25 bp, Mus musculus
ttccacctttgttgcactcttcctc

SEQ ID NO: 932989 - DNA, 25 bp, Mus musculus
ttccacgaacgcattccttttgaga

SEQ ID NO: 932990 - DNA, 25 bp, Mus musculus
ttccacgaacgctttccttttgaga

SEQ ID NO: 932991 - DNA, 25 bp, Mus musculus
ttccacgaactaccattgctgattc

SEQ ID NO: 932992 - DNA, 25 bp, Mus musculus
ttccacgaactagcattgctgattc

SEQ ID NO: 932993 - DNA, 25 bp, Mus musculus
ttccacgaatgtagaccctacctag

SEQ ID NO: 932994 - DNA, 25 bp, Mus musculus
ttccacgaatgttgaccctacctag

SEQ ID NO: 932995 - DNA, 25 bp, Mus musculus
ttccacgacggccagaactatacat

SEQ ID NO: 932996 - DNA, 25 bp, Mus musculus
ttccacgacggcgagaactatacat

SEQ ID NO: 932997 - DNA, 25 bp, Mus musculus
ttccacgaggaaagcagtagcagca

SEQ ID NO: 932998 - DNA, 25 bp, Mus musculus
ttccacgaggaatgcagtagcagca

SEQ ID NO: 932999 - DNA, 25 bp, Mus musculus
ttccacgatcctcacacaatataaa

SEQ ID NO: 933000 - DNA, 25 bp, Mus musculus
ttccacgatcctgacacaatataaa

SEQ ID NO: 933001 - DNA, 25 bp, Mus musculus
ttccacgatggtcctactctgggtc

SEQ ID NO: 933002 - DNA, 25 bp, Mus musculus
ttccacgatggtgctactctgggtc

SEQ ID NO: 933003 - DNA, 25 bp, Mus musculus
ttccacgccagccatgtttaatcac

SEQ ID NO: 933004 - DNA, 25 bp, Mus musculus
ttccacgccagcgatgtttaatcac

SEQ ID NO: 933005 - DNA, 25 bp, Mus musculus
ttccacgccgaactctgaagctgtg

SEQ ID NO: 933006 - DNA, 25 bp, Mus musculus
ttccacgccgaagtctgaagctgtg

SEQ ID NO: 933007 - DNA, 25 bp, Mus musculus
ttccacgcgggcaggtccggaaact

SEQ ID NO: 933008 - DNA, 25 bp, Mus musculus
ttccacgcgggctggtccggaaact

SEQ ID NO: 933009 - DNA, 25 bp, Mus musculus
ttccacggacatataatagcttcat

SEQ ID NO: 933010 - DNA, 25 bp, Mus musculus
ttccacggacatttaatagcttcat

SEQ ID NO: 933011 - DNA, 25 bp, Mus musculus
ttccacgggacactaacccagctgg

SEQ ID NO: 933012 - DNA, 25 bp, Mus musculus
ttccacgggacagtaacccagctgg

SEQ ID NO: 933013 - DNA, 25 bp, Mus musculus
ttccacgggaggcactacttgtatc

SEQ ID NO: 933014 - DNA, 25 bp, Mus musculus
ttccacgggagggactacttgtatc

SEQ ID NO: 933015 - DNA, 25 bp, Mus musculus
ttccacggtgtgatatgggttttca

SEQ ID NO: 933016 - DNA, 25 bp, Mus musculus
ttccacggtgtgttatgggttttca

SEQ ID NO: 933017 - DNA, 25 bp, Mus musculus
ttccacgtatggatgggactgtgct

SEQ ID NO: 933018 - DNA, 25 bp, Mus musculus
ttccacgtatggttgggactgtgct

SEQ ID NO: 933019 - DNA, 25 bp, Mus musculus
ttccacgtcaagaagatccgcgagg

SEQ ID NO: 933020 - DNA, 25 bp, Mus musculus
ttccacgtcaagtagatccgcgagg

SEQ ID NO: 933021 - DNA, 25 bp, Mus musculus
ttccacgtgcggaactcctgtttct

SEQ ID NO: 933022 - DNA, 25 bp, Mus musculus
ttccacgtgcggtactcctgtttct

SEQ ID NO: 933023 - DNA, 25 bp, Mus musculus
ttccacgtgctccagtactatgaca

SEQ ID NO: 933024 - DNA, 25 bp, Mus musculus
ttccacgtgctcgagtactatgaca

SEQ ID NO: 933025 - DNA, 25 bp, Mus musculus
ttccacgttcctattacagcaaaag

SEQ ID NO: 933026 - DNA, 25 bp, Mus musculus
ttccacgttccttttacagcaaaag

SEQ ID NO: 933027 - DNA, 25 bp, Mus musculus
ttccactaacccacctggtggctta

SEQ ID NO: 933028 - DNA, 25 bp, Mus musculus
ttccactaaccctcctggtggctta

SEQ ID NO: 933029 - DNA, 25 bp, Mus musculus
ttccactaacctcaggctgaggtag

SEQ ID NO: 933030 - DNA, 25 bp, Mus musculus
ttccactaacctgaggctgaggtag

SEQ ID NO: 933031 - DNA, 25 bp, Mus musculus
ttccactaagatctgtataaggcct

SEQ ID NO: 933032 - DNA, 25 bp, Mus musculus
ttccactaagatgtgtataaggcct

SEQ ID NO: 933033 - DNA, 25 bp, Mus musculus
ttccactacaaaaaagccagcttca

SEQ ID NO: 933034 - DNA, 25 bp, Mus musculus
ttccactacaaataagccagcttca

SEQ ID NO: 933035 - DNA, 25 bp, Mus musculus
ttccactacagcacttatcaggctt

SEQ ID NO: 933036 - DNA, 25 bp, Mus musculus
ttccactacagctcttatcaggctt

SEQ ID NO: 933037 - DNA, 25 bp, Mus musculus
ttccactaccacagagcctgggaaa

SEQ ID NO: 933038 - DNA, 25 bp, Mus musculus
ttccactaccactgagcctgggaaa

SEQ ID NO: 933039 - DNA, 25 bp, Mus musculus
ttccactagtgcatgaagccctgga

SEQ ID NO: 933040 - DNA, 25 bp, Mus musculus
ttccactagtgcttgaagccctgga

SEQ ID NO: 933041 - DNA, 25 bp, Mus musculus
ttccactagttgcagaccaagtatt

SEQ ID NO: 933042 - DNA, 25 bp, Mus musculus
ttccactagttggagaccaagtatt

SEQ ID NO: 933043 - DNA, 25 bp, Mus musculus
ttccactcacatcaaggttacatag

SEQ ID NO: 933044 - DNA, 25 bp, Mus musculus
ttccactcacatgaaggttacatag

SEQ ID NO: 933045 - DNA, 25 bp, Mus musculus
ttccactcagttcccgatgctttgt

SEQ ID NO: 933046 - DNA, 25 bp, Mus musculus
ttccactcagttgccgatgctttgt

SEQ ID NO: 933047 - DNA, 25 bp, Mus musculus
ttccactcatctcttatcagctggg

SEQ ID NO: 933048 - DNA, 25 bp, Mus musculus
ttccactcatctgttatcagctggg

SEQ ID NO: 933049 - DNA, 25 bp, Mus musculus
ttccactcctccatttcaggatatt

SEQ ID NO: 933050 - DNA, 25 bp, Mus musculus
ttccactcctccttttcaggatatt

SEQ ID NO: 933051 - DNA, 25 bp, Mus musculus
ttccactcgggccggaccgcaagga

SEQ ID NO: 933052 - DNA, 25 bp, Mus musculus
ttccactcgggcgggaccgcaagga

SEQ ID NO: 933053 - DNA, 25 bp, Mus musculus
ttccactctcggacatttgtatttt

SEQ ID NO: 933054 - DNA, 25 bp, Mus musculus
ttccactctcggtcatttgtatttt

SEQ ID NO: 933055 - DNA, 25 bp, Mus musculus
ttccactctcgtagtgggagtactt

SEQ ID NO: 933056 - DNA, 25 bp, Mus musculus
ttccactctcgttgtgggagtactt

SEQ ID NO: 933057 - DNA, 25 bp, Mus musculus
ttccactctcttaattcctgttgga

SEQ ID NO: 933058 - DNA, 25 bp, Mus musculus
ttccactctctttattcctgttgga

SEQ ID NO: 933059 - DNA, 25 bp, Mus musculus
ttccactgaaccactggtactttct

SEQ ID NO: 933060 - DNA, 25 bp, Mus musculus
ttccactgaacctctggtactttct

SEQ ID NO: 933061 - DNA, 25 bp, Mus musculus
ttccactgacataggtttatactga

SEQ ID NO: 933062 - DNA, 25 bp, Mus musculus
ttccactgacattggtttatactga

SEQ ID NO: 933063 - DNA, 25 bp, Mus musculus
ttccactgacggatggcacagacag

SEQ ID NO: 933064 - DNA, 25 bp, Mus musculus
ttccactgacggttggcacagacag

SEQ ID NO: 933065 - DNA, 25 bp, Mus musculus
ttccactgagccaacactagccagt

SEQ ID NO: 933066 - DNA, 25 bp, Mus musculus
ttccactgagcctacactagccagt

SEQ ID NO: 933067 - DNA, 25 bp, Mus musculus
ttccactgcagtcccttgatctgta

SEQ ID NO: 933068 - DNA, 25 bp, Mus musculus
ttccactgcagtgccttgatctgta

SEQ ID NO: 933069 - DNA, 25 bp, Mus musculus
ttccactgctgaatctttataatca

SEQ ID NO: 933070 - DNA, 25 bp, Mus musculus
ttccactgctgattctttataatca

SEQ ID NO: 933071 - DNA, 25 bp, Mus musculus
ttccactggacaagtgattcctggc

SEQ ID NO: 933072 - DNA, 25 bp, Mus musculus
ttccactggacatgtgattcctggc

SEQ ID NO: 933073 - DNA, 25 bp, Mus musculus
ttccactgggcacagcttgctaaat

SEQ ID NO: 933074 - DNA, 25 bp, Mus musculus
ttccactgggcagagcttgctaaat

SEQ ID NO: 933075 - DNA, 25 bp, Mus musculus
ttccactgggtgcagactgtaccgt

SEQ ID NO: 933076 - DNA, 25 bp, Mus musculus
ttccactgggtggagactgtaccgt

SEQ ID NO: 933077 - DNA, 25 bp, Mus musculus
ttccactgggttacagcttcagtca

SEQ ID NO: 933078 - DNA, 25 bp, Mus musculus
ttccactgggttacgcctgtaagaa

SEQ ID NO: 933079 - DNA, 25 bp, Mus musculus
ttccactgggtttcagcttcagtca

SEQ ID NO: 933080 - DNA, 25 bp, Mus musculus
ttccactgggtttcgcctgtaagaa

SEQ ID NO: 933081 - DNA, 25 bp, Mus musculus
ttccactggtgacattgtgctgaca

SEQ ID NO: 933082 - DNA, 25 bp, Mus musculus
ttccactggtgagattgtgctgaca

SEQ ID NO: 933083 - DNA, 25 bp, Mus musculus
ttccactgtagtacctgtcacaacc

SEQ ID NO: 933084 - DNA, 25 bp, Mus musculus
ttccactgtagttcctgtcacaacc

SEQ ID NO: 933085 - DNA, 25 bp, Mus musculus
ttccactgtctgataagggcttctg

SEQ ID NO: 933086 - DNA, 25 bp, Mus musculus
ttccactgtctgttaagggcttctg

SEQ ID NO: 933087 - DNA, 25 bp, Mus musculus
ttccactgtcttcattgagagaagc

SEQ ID NO: 933088 - DNA, 25 bp, Mus musculus
ttccactgtcttgattgagagaagc

SEQ ID NO: 933089 - DNA, 25 bp, Mus musculus
ttccactgtggaatgcaaccttgct

SEQ ID NO: 933090 - DNA, 25 bp, Mus musculus
ttccactgtggacaggtcattcccc

SEQ ID NO: 933091 - DNA, 25 bp, Mus musculus
ttccactgtggagaggtcattcccc

SEQ ID NO: 933092 - DNA, 25 bp, Mus musculus
ttccactgtggattgcaaccttgct

SEQ ID NO: 933093 - DNA, 25 bp, Mus musculus
ttccactgttaaaagagtacccctg

SEQ ID NO: 933094 - DNA, 25 bp, Mus musculus
ttccactgttaactgtgatctgagt

SEQ ID NO: 933095 - DNA, 25 bp, Mus musculus
ttccactgttaagtgtgatctgagt

SEQ ID NO: 933096 - DNA, 25 bp, Mus musculus
ttccactgttaatagagtacccctg

SEQ ID NO: 933097 - DNA, 25 bp, Mus musculus
ttccactgtttgcaacatctttcct

SEQ ID NO: 933098 - DNA, 25 bp, Mus musculus
ttccactgtttggaacatctttcct

SEQ ID NO: 933099 - DNA, 25 bp, Mus musculus
ttccacttaaagctcgcaaggcttc

SEQ ID NO: 933100 - DNA, 25 bp, Mus musculus
ttccacttaaaggtcgcaaggcttc

SEQ ID NO: 933101 - DNA, 25 bp, Mus musculus
ttccacttaattagttgttctaggt

SEQ ID NO: 933102 - DNA, 25 bp, Mus musculus
ttccacttaattattactcagggtg

SEQ ID NO: 933103 - DNA, 25 bp, Mus musculus
ttccacttaatttgttgttctaggt

SEQ ID NO: 933104 - DNA, 25 bp, Mus musculus
ttccacttaatttttactcagggtg

SEQ ID NO: 933105 - DNA, 25 bp, Mus musculus
ttccacttacatcaactttaataca

SEQ ID NO: 933106 - DNA, 25 bp, Mus musculus
ttccacttacatgaactttaataca

SEQ ID NO: 933107 - DNA, 25 bp, Mus musculus
ttccacttacctaagggtgtggtca

SEQ ID NO: 933108 - DNA, 25 bp, Mus musculus
ttccacttaccttagggtgtggtca

SEQ ID NO: 933109 - DNA, 25 bp, Mus musculus
ttccacttagaactgtttggtcaag

SEQ ID NO: 933110 - DNA, 25 bp, Mus musculus
ttccacttagaagtgtttggtcaag

SEQ ID NO: 933111 - DNA, 25 bp, Mus musculus
ttccacttagtaccaaagccattaa

SEQ ID NO: 933112 - DNA, 25 bp, Mus musculus
ttccacttagtagcaaagccattaa

SEQ ID NO: 933113 - DNA, 25 bp, Mus musculus
ttccacttatccagcggtacagaaa

SEQ ID NO: 933114 - DNA, 25 bp, Mus musculus
ttccacttatcctgcggtacagaaa

SEQ ID NO: 933115 - DNA, 25 bp, Mus musculus
ttccacttcactctcacttctgtat

SEQ ID NO: 933116 - DNA, 25 bp, Mus musculus
ttccacttcactgtcacttctgtat

SEQ ID NO: 933117 - DNA, 25 bp, Mus musculus
ttccacttccatacccataatgtta

SEQ ID NO: 933118 - DNA, 25 bp, Mus musculus
ttccacttccattcccataatgtta

SEQ ID NO: 933119 - DNA, 25 bp, Mus musculus
ttccacttctcaataaatgtttgtt

SEQ ID NO: 933120 - DNA, 25 bp, Mus musculus
ttccacttctcattaaatgtttgtt

SEQ ID NO: 933121 - DNA, 25 bp, Mus musculus
ttccacttcttaattctgccttaaa

SEQ ID NO: 933122 - DNA, 25 bp, Mus musculus
ttccacttcttatttctgccttaaa

SEQ ID NO: 933123 - DNA, 25 bp, Mus musculus
ttccacttgaagagtctcctgggat

SEQ ID NO: 933124 - DNA, 25 bp, Mus musculus
ttccacttgaagtgtctcctgggat

SEQ ID NO: 933125 - DNA, 25 bp, Mus musculus
ttccacttgagcaggtttctacact

SEQ ID NO: 933126 - DNA, 25 bp, Mus musculus
ttccacttgagctggtttctacact

SEQ ID NO: 933127 - DNA, 25 bp, Mus musculus
ttccacttgcatatggttaggtcca

SEQ ID NO: 933128 - DNA, 25 bp, Mus musculus
ttccacttgcatttggttaggtcca

SEQ ID NO: 933129 - DNA, 25 bp, Mus musculus
ttccacttgtcaagaccttgctgag

SEQ ID NO: 933130 - DNA, 25 bp, Mus musculus
ttccacttgtcatgaccttgctgag

SEQ ID NO: 933131 - DNA, 25 bp, Mus musculus
ttccactttccacgctgggagcttg

SEQ ID NO: 933132 - DNA, 25 bp, Mus musculus
ttccactttccaggctgggagcttg

SEQ ID NO: 933133 - DNA, 25 bp, Mus musculus
ttccactttcccatgttagggtttg

SEQ ID NO: 933134 - DNA, 25 bp, Mus musculus
ttccactttcccttgttagggtttg

SEQ ID NO: 933135 - DNA, 25 bp, Mus musculus
ttccactttcggattcccagcggat

SEQ ID NO: 933136 - DNA, 25 bp, Mus musculus
ttccactttcggtttcccagcggat

SEQ ID NO: 933137 - DNA, 25 bp, Mus musculus
ttccactttctcacatcactgaggt

SEQ ID NO: 933138 - DNA, 25 bp, Mus musculus
ttccactttctcactatgattcacg

SEQ ID NO: 933139 - DNA, 25 bp, Mus musculus
ttccactttctctcatcactgaggt

SEQ ID NO: 933140 - DNA, 25 bp, Mus musculus
ttccactttctctctatgattcacg

SEQ ID NO: 933141 - DNA, 25 bp, Mus musculus
ttccagaaacatctacccctagaag

SEQ ID NO: 933142 - DNA, 25 bp, Mus musculus
ttccagaaacatgtacccctagaag

SEQ ID NO: 933143 - DNA, 25 bp, Mus musculus
ttccagaacaacagctgtctgtgga

SEQ ID NO: 933144 - DNA, 25 bp, Mus musculus
ttccagaacaactgctgtctgtgga

SEQ ID NO: 933145 - DNA, 25 bp, Mus musculus
ttccagaacaagacgccaccagatg

SEQ ID NO: 933146 - DNA, 25 bp, Mus musculus
ttccagaacaagacttgtgctagct

SEQ ID NO: 933147 - DNA, 25 bp, Mus musculus
ttccagaacaagtcgccaccagatg

SEQ ID NO: 933148 - DNA, 25 bp, Mus musculus
ttccagaacaagtcttgtgctagct

SEQ ID NO: 933149 - DNA, 25 bp, Mus musculus
ttccagaaccagaagcacgccattt

SEQ ID NO: 933150 - DNA, 25 bp, Mus musculus
ttccagaaccagtagcacgccattt

SEQ ID NO: 933151 - DNA, 25 bp, Mus musculus
ttccagaaccgcagggctaagcaac

SEQ ID NO: 933152 - DNA, 25 bp, Mus musculus
ttccagaaccgctgggctaagcaac

SEQ ID NO: 933153 - DNA, 25 bp, Mus musculus
ttccagaagaccaagcagttctcag

SEQ ID NO: 933154 - DNA, 25 bp, Mus musculus
ttccagaagacctagcagttctcag

SEQ ID NO: 933155 - DNA, 25 bp, Mus musculus
ttccagaagcttcctagccgactga

SEQ ID NO: 933156 - DNA, 25 bp, Mus musculus
ttccagaagcttgctagccgactga

SEQ ID NO: 933157 - DNA, 25 bp, Mus musculus
ttccagaatcgcaggtacaagtgca

SEQ ID NO: 933158 - DNA, 25 bp, Mus musculus
ttccagaatcgctggtacaagtgca

SEQ ID NO: 933159 - DNA, 25 bp, Mus musculus
ttccagaatgctctctaggctattt

SEQ ID NO: 933160 - DNA, 25 bp, Mus musculus
ttccagaatgctgtctaggctattt

SEQ ID NO: 933161 - DNA, 25 bp, Mus musculus
ttccagaatgtcatgaagccgtgta

SEQ ID NO: 933162 - DNA, 25 bp, Mus musculus
ttccagaatgtcttgaagccgtgta

SEQ ID NO: 933163 - DNA, 25 bp, Mus musculus
ttccagaattagagtcccgagccat

SEQ ID NO: 933164 - DNA, 25 bp, Mus musculus
ttccagaattagtgtcccgagccat

SEQ ID NO: 933165 - DNA, 25 bp, Mus musculus
ttccagacactgaggaggtgctccg

SEQ ID NO: 933166 - DNA, 25 bp, Mus musculus
ttccagacactgtggaggtgctccg

SEQ ID NO: 933167 - DNA, 25 bp, Mus musculus
ttccagacagaacatgcaacagatt

SEQ ID NO: 933168 - DNA, 25 bp, Mus musculus
ttccagacagaagatgcaacagatt

SEQ ID NO: 933169 - DNA, 25 bp, Mus musculus
ttccagacaggcatggctatacaga

SEQ ID NO: 933170 - DNA, 25 bp, Mus musculus
ttccagacaggcttggctatacaga

SEQ ID NO: 933171 - DNA, 25 bp, Mus musculus
ttccagaccagtctctctctgatga

SEQ ID NO: 933172 - DNA, 25 bp, Mus musculus
ttccagaccagtgtctctctgatga

SEQ ID NO: 933173 - DNA, 25 bp, Mus musculus
ttccagacccagcaaaagggcaaga

SEQ ID NO: 933174 - DNA, 25 bp, Mus musculus
ttccagacccaggaaaagggcaaga

SEQ ID NO: 933175 - DNA, 25 bp, Mus musculus
ttccagaccccaagtcgaaaaactt

SEQ ID NO: 933176 - DNA, 25 bp, Mus musculus
ttccagaccccatgtcgaaaaactt

SEQ ID NO: 933177 - DNA, 25 bp, Mus musculus
ttccagaccggtctccctttcgtag

SEQ ID NO: 933178 - DNA, 25 bp, Mus musculus
ttccagaccggtgtccctttcgtag

SEQ ID NO: 933179 - DNA, 25 bp, Mus musculus
ttccagactattatcggtcagcctg

SEQ ID NO: 933180 - DNA, 25 bp, Mus musculus
ttccagactattttcggtcagcctg

SEQ ID NO: 933181 - DNA, 25 bp, Mus musculus
ttccagactcatcacacgaacagtt

SEQ ID NO: 933182 - DNA, 25 bp, Mus musculus
ttccagactcatgacacgaacagtt

SEQ ID NO: 933183 - DNA, 25 bp, Mus musculus
ttccagactgccatttctggccttt

SEQ ID NO: 933184 - DNA, 25 bp, Mus musculus
ttccagactgccttttctggccttt

SEQ ID NO: 933185 - DNA, 25 bp, Mus musculus
ttccagagaagtctccggtccggta

SEQ ID NO: 933186 - DNA, 25 bp, Mus musculus
ttccagagaagtgtccggtccggta

SEQ ID NO: 933187 - DNA, 25 bp, Mus musculus
ttccagagacacagcatgtggtgct

SEQ ID NO: 933188 - DNA, 25 bp, Mus musculus
ttccagagacactgcatgtggtgct

SEQ ID NO: 933189 - DNA, 25 bp, Mus musculus
ttccagagacccctctggctgaggc

SEQ ID NO: 933190 - DNA, 25 bp, Mus musculus
ttccagagacccgtctggctgaggc

SEQ ID NO: 933191 - DNA, 25 bp, Mus musculus
ttccagagacggatcaggtcgctca

SEQ ID NO: 933192 - DNA, 25 bp, Mus musculus
ttccagagacggttcaggtcgctca

SEQ ID NO: 933193 - DNA, 25 bp, Mus musculus
ttccagagactgatcccaagcaggg

SEQ ID NO: 933194 - DNA, 25 bp, Mus musculus
ttccagagactgttcccaagcaggg

SEQ ID NO: 933195 - DNA, 25 bp, Mus musculus
ttccagagagcaagatcagggtacc

SEQ ID NO: 933196 - DNA, 25 bp, Mus musculus
ttccagagagcatgatcagggtacc

SEQ ID NO: 933197 - DNA, 25 bp, Mus musculus
ttccagagcaatcacatggacatgg

SEQ ID NO: 933198 - DNA, 25 bp, Mus musculus
ttccagagcaatgacatggacatgg

SEQ ID NO: 933199 - DNA, 25 bp, Mus musculus
ttccagagcacaaagaacggtccat

SEQ ID NO: 933200 - DNA, 25 bp, Mus musculus
ttccagagcacaccatatgtaccct

SEQ ID NO: 933201 - DNA, 25 bp, Mus musculus
ttccagagcacagcatatgtaccct

SEQ ID NO: 933202 - DNA, 25 bp, Mus musculus
ttccagagcacatagaacggtccat

SEQ ID NO: 933203 - DNA, 25 bp, Mus musculus
ttccagagcctaacagtgcaggtgt

SEQ ID NO: 933204 - DNA, 25 bp, Mus musculus
ttccagagcctatcagtgcaggtgt

SEQ ID NO: 933205 - DNA, 25 bp, Mus musculus
ttccagagctctatcttatttcaac

SEQ ID NO: 933206 - DNA, 25 bp, Mus musculus
ttccagagctctttcttatttcaac

SEQ ID NO: 933207 - DNA, 25 bp, Mus musculus
ttccagaggagccagtcagcccctg

SEQ ID NO: 933208 - DNA, 25 bp, Mus musculus
ttccagaggagcgagtcagcccctg

SEQ ID NO: 933209 - DNA, 25 bp, Mus musculus
ttccagaggtctcttttctagcaca

SEQ ID NO: 933210 - DNA, 25 bp, Mus musculus
ttccagaggtctgttttctagcaca

SEQ ID NO: 933211 - DNA, 25 bp, Mus musculus
ttccagagtggacggccagggttta

SEQ ID NO: 933212 - DNA, 25 bp, Mus musculus
ttccagagtggagggccagggttta

SEQ ID NO: 933213 - DNA, 25 bp, Mus musculus
ttccagagtgtcaaactttcattct

SEQ ID NO: 933214 - DNA, 25 bp, Mus musculus
ttccagagtgtctaactttcattct

SEQ ID NO: 933215 - DNA, 25 bp, Mus musculus
ttccagagttggactctggtgtttt

SEQ ID NO: 933216 - DNA, 25 bp, Mus musculus
ttccagagttggtctctggtgtttt

SEQ ID NO: 933217 - DNA, 25 bp, Mus musculus
ttccagataagcctttcctacaggg

SEQ ID NO: 933218 - DNA, 25 bp, Mus musculus
ttccagataagcgtttcctacaggg

SEQ ID NO: 933219 - DNA, 25 bp, Mus musculus
ttccagatagtgcacccggatgaac

SEQ ID NO: 933220 - DNA, 25 bp, Mus musculus
ttccagatagtggacccggatgaac

SEQ ID NO: 933221 - DNA, 25 bp, Mus musculus
ttccagatatctatgtacaccacag

SEQ ID NO: 933222 - DNA, 25 bp, Mus musculus
ttccagatatctttgtacaccacag

SEQ ID NO: 933223 - DNA, 25 bp, Mus musculus
ttccagatcaccacttgtacgcact

SEQ ID NO: 933224 - DNA, 25 bp, Mus musculus
ttccagatcacctcttgtacgcact

SEQ ID NO: 933225 - DNA, 25 bp, Mus musculus
ttccagatcctcaagcccgctgata

SEQ ID NO: 933226 - DNA, 25 bp, Mus musculus
ttccagatcctctagcccgctgata

SEQ ID NO: 933227 - DNA, 25 bp, Mus musculus
ttccagatcctgctcccactctcct

SEQ ID NO: 933228 - DNA, 25 bp, Mus musculus
ttccagatcctggtcccactctcct

SEQ ID NO: 933229 - DNA, 25 bp, Mus musculus
ttccagatcgtaacatttctcttct

SEQ ID NO: 933230 - DNA, 25 bp, Mus musculus
ttccagatcgtatcatttctcttct

SEQ ID NO: 933231 - DNA, 25 bp, Mus musculus
ttccagatctgcatgtttgacccaa

SEQ ID NO: 933232 - DNA, 25 bp, Mus musculus
ttccagatctgcttgtttgacccaa

SEQ ID NO: 933233 - DNA, 25 bp, Mus musculus
ttccagatgcaacgcctacacagtt

SEQ ID NO: 933234 - DNA, 25 bp, Mus musculus
ttccagatgcaaggcctacacagtt

SEQ ID NO: 933235 - DNA, 25 bp, Mus musculus
ttccagatgccaagagtgggcccca

SEQ ID NO: 933236 - DNA, 25 bp, Mus musculus
ttccagatgccatgagtgggcccca

SEQ ID NO: 933237 - DNA, 25 bp, Mus musculus
ttccagatgcctccgaaaaataggg

SEQ ID NO: 933238 - DNA, 25 bp, Mus musculus
ttccagatgcctgcgaaaaataggg

SEQ ID NO: 933239 - DNA, 25 bp, Mus musculus
ttccagatgcgaacaggcctacttc

SEQ ID NO: 933240 - DNA, 25 bp, Mus musculus
ttccagatgcgatcaggcctacttc

SEQ ID NO: 933241 - DNA, 25 bp, Mus musculus
ttccagatgcgcacaaggaccatgc

SEQ ID NO: 933242 - DNA, 25 bp, Mus musculus
ttccagatgcgctcaaggaccatgc

SEQ ID NO: 933243 - DNA, 25 bp, Mus musculus
ttccagatggagagtcgaggccgca

SEQ ID NO: 933244 - DNA, 25 bp, Mus musculus
ttccagatggagtgtcgaggccgca

SEQ ID NO: 933245 - DNA, 25 bp, Mus musculus
ttccagatggcacaattgtccgagt

SEQ ID NO: 933246 - DNA, 25 bp, Mus musculus
ttccagatggcagaattgtccgagt

SEQ ID NO: 933247 - DNA, 25 bp, Mus musculus
ttccagatgtgaagaagccacagga

SEQ ID NO: 933248 - DNA, 25 bp, Mus musculus
ttccagatgtgatgaagccacagga

SEQ ID NO: 933249 - DNA, 25 bp, Mus musculus
ttccagatgttaatctactgacagg

SEQ ID NO: 933250 - DNA, 25 bp, Mus musculus
ttccagatgttattctactgacagg

SEQ ID NO: 933251 - DNA, 25 bp, Mus musculus
ttccagatgttccagtgctctcttc

SEQ ID NO: 933252 - DNA, 25 bp, Mus musculus
ttccagatgttcgagtgctctcttc

SEQ ID NO: 933253 - DNA, 25 bp, Mus musculus
ttccagatgttgatctactgttcta

SEQ ID NO: 933254 - DNA, 25 bp, Mus musculus
ttccagatgttgttctactgttcta

SEQ ID NO: 933255 - DNA, 25 bp, Mus musculus
ttccagattatgattattagccttc

SEQ ID NO: 933256 - DNA, 25 bp, Mus musculus
ttccagattatgtttattagccttc

SEQ ID NO: 933257 - DNA, 25 bp, Mus musculus
ttccagattattaatgtgcagtgta

SEQ ID NO: 933258 - DNA, 25 bp, Mus musculus
ttccagattatttatgtgcagtgta

SEQ ID NO: 933259 - DNA, 25 bp, Mus musculus
ttccagattcagagttatccccaga

SEQ ID NO: 933260 - DNA, 25 bp, Mus musculus
ttccagattcagataacttgcatat

SEQ ID NO: 933261 - DNA, 25 bp, Mus musculus
ttccagattcagtgttatccccaga

SEQ ID NO: 933262 - DNA, 25 bp, Mus musculus
ttccagattcagttaacttgcatat

SEQ ID NO: 933263 - DNA, 25 bp, Mus musculus
ttccagattcctcccacaataacag

SEQ ID NO: 933264 - DNA, 25 bp, Mus musculus
ttccagattcctgccacaataacag

SEQ ID NO: 933265 - DNA, 25 bp, Mus musculus
ttccagattcgtcgcccaggtgata

SEQ ID NO: 933266 - DNA, 25 bp, Mus musculus
ttccagattcgtggcccaggtgata

SEQ ID NO: 933267 - DNA, 25 bp, Mus musculus
ttccagattcttaacccttccatat

SEQ ID NO: 933268 - DNA, 25 bp, Mus musculus
ttccagattcttagcactttcccat

SEQ ID NO: 933269 - DNA, 25 bp, Mus musculus
ttccagattctttacccttccatat

SEQ ID NO: 933270 - DNA, 25 bp, Mus musculus
ttccagattctttgcactttcccat

SEQ ID NO: 933271 - DNA, 25 bp, Mus musculus
ttccagcaaacacggcccggatgta

SEQ ID NO: 933272 - DNA, 25 bp, Mus musculus
ttccagcaaacagggcccggatgta

SEQ ID NO: 933273 - DNA, 25 bp, Mus musculus
ttccagcaaagaccgtaacctcaag

SEQ ID NO: 933274 - DNA, 25 bp, Mus musculus
ttccagcaaagagcgtaacctcaag

SEQ ID NO: 933275 - DNA, 25 bp, Mus musculus
ttccagcaacctagtcccatgtgca

SEQ ID NO: 933276 - DNA, 25 bp, Mus musculus
ttccagcaaccttgtcccatgtgca

SEQ ID NO: 933277 - DNA, 25 bp, Mus musculus
ttccagcaagacaatcctgatcgtg

SEQ ID NO: 933278 - DNA, 25 bp, Mus musculus
ttccagcaagactatcctgatcgtg

SEQ ID NO: 933279 - DNA, 25 bp, Mus musculus
ttccagcaaggacccattcttggag

SEQ ID NO: 933280 - DNA, 25 bp, Mus musculus
ttccagcaaggagccattcttggag

SEQ ID NO: 933281 - DNA, 25 bp, Mus musculus
ttccagcaagttcagcccttctttg

SEQ ID NO: 933282 - DNA, 25 bp, Mus musculus
ttccagcaagttgagcccttctttg

SEQ ID NO: 933283 - DNA, 25 bp, Mus musculus
ttccagcacacacgatgcagagcag

SEQ ID NO: 933284 - DNA, 25 bp, Mus musculus
ttccagcacacaggatgcagagcag

SEQ ID NO: 933285 - DNA, 25 bp, Mus musculus
ttccagcacatacagactctattaa

SEQ ID NO: 933286 - DNA, 25 bp, Mus musculus
ttccagcacatacagtcggctcagt

SEQ ID NO: 933287 - DNA, 25 bp, Mus musculus
ttccagcacatagagactctattaa

SEQ ID NO: 933288 - DNA, 25 bp, Mus musculus
ttccagcacatagagtcggctcagt

SEQ ID NO: 933289 - DNA, 25 bp, Mus musculus
ttccagcacattatcccatccctgc

SEQ ID NO: 933290 - DNA, 25 bp, Mus musculus
ttccagcacattttcccatccctgc

SEQ ID NO: 933291 - DNA, 25 bp, Mus musculus
ttccagcagaaactccacggccatt

SEQ ID NO: 933292 - DNA, 25 bp, Mus musculus
ttccagcagaaagtccacggccatt

SEQ ID NO: 933293 - DNA, 25 bp, Mus musculus
ttccagcagcagctgtttcggactt

SEQ ID NO: 933294 - DNA, 25 bp, Mus musculus
ttccagcagcaggtgtttcggactt

SEQ ID NO: 933295 - DNA, 25 bp, Mus musculus
ttccagcagctgcaccgaattgatt

SEQ ID NO: 933296 - DNA, 25 bp, Mus musculus
ttccagcagctggaccgaattgatt

SEQ ID NO: 933297 - DNA, 25 bp, Mus musculus
ttccagcaggatagtactgcaatca

SEQ ID NO: 933298 - DNA, 25 bp, Mus musculus
ttccagcaggattgtactgcaatca

SEQ ID NO: 933299 - DNA, 25 bp, Mus musculus
ttccagcaggttatagtgccttgac

SEQ ID NO: 933300 - DNA, 25 bp, Mus musculus
ttccagcaggttttagtgccttgac

SEQ ID NO: 933301 - DNA, 25 bp, Mus musculus
ttccagcagtggctcctgcccgtga

SEQ ID NO: 933302 - DNA, 25 bp, Mus musculus
ttccagcagtgggtcctgcccgtga

SEQ ID NO: 933303 - DNA, 25 bp, Mus musculus
ttccagcagtttcttggcattgaaa

SEQ ID NO: 933304 - DNA, 25 bp, Mus musculus
ttccagcagtttgttggcattgaaa

SEQ ID NO: 933305 - DNA, 25 bp, Mus musculus
ttccagcatcagagactgtggcatt

SEQ ID NO: 933306 - DNA, 25 bp, Mus musculus
ttccagcatcagtgactgtggcatt

SEQ ID NO: 933307 - DNA, 25 bp, Mus musculus
ttccagcatccacatttgcctgtaa

SEQ ID NO: 933308 - DNA, 25 bp, Mus musculus
ttccagcatccagatttgcctgtaa

SEQ ID NO: 933309 - DNA, 25 bp, Mus musculus
ttccagcatgttagtaatcctctct

SEQ ID NO: 933310 - DNA, 25 bp, Mus musculus
ttccagcatgtttgtaatcctctct

SEQ ID NO: 933311 - DNA, 25 bp, Mus musculus
ttccagccacctcattatagactat

SEQ ID NO: 933312 - DNA, 25 bp, Mus musculus
ttccagccacctgattatagactat

SEQ ID NO: 933313 - DNA, 25 bp, Mus musculus
ttccagccaggcctagtgatagaga

SEQ ID NO: 933314 - DNA, 25 bp, Mus musculus
ttccagccaggcgtagtgatagaga

SEQ ID NO: 933315 - DNA, 25 bp, Mus musculus
ttccagcccctaagaaagtttcttt

SEQ ID NO: 933316 - DNA, 25 bp, Mus musculus
ttccagcccctatgaaagtttcttt

SEQ ID NO: 933317 - DNA, 25 bp, Mus musculus
ttccagcccctgcttaggaatctgg

SEQ ID NO: 933318 - DNA, 25 bp, Mus musculus
ttccagcccctggttaggaatctgg

SEQ ID NO: 933319 - DNA, 25 bp, Mus musculus
ttccagccccttcggtcagaaagtg

SEQ ID NO: 933320 - DNA, 25 bp, Mus musculus
ttccagccccttgggtcagaaagtg

SEQ ID NO: 933321 - DNA, 25 bp, Mus musculus
ttccagccctccaaagaagtcacgg

SEQ ID NO: 933322 - DNA, 25 bp, Mus musculus
ttccagccctcctaagaagtcacgg

SEQ ID NO: 933323 - DNA, 25 bp, Mus musculus
ttccagccctgcagggattggatga

SEQ ID NO: 933324 - DNA, 25 bp, Mus musculus
ttccagccctgctgggattggatga

SEQ ID NO: 933325 - DNA, 25 bp, Mus musculus
ttccagcccttgattactacctaaa

SEQ ID NO: 933326 - DNA, 25 bp, Mus musculus
ttccagcccttgtttactacctaaa

SEQ ID NO: 933327 - DNA, 25 bp, Mus musculus
ttccagcctctcaggtaccaaatag

SEQ ID NO: 933328 - DNA, 25 bp, Mus musculus
ttccagcctctctggtaccaaatag

SEQ ID NO: 933329 - DNA, 25 bp, Mus musculus
ttccagcctgcacagttgttctggt

SEQ ID NO: 933330 - DNA, 25 bp, Mus musculus
ttccagcctgcagagttgttctggt

SEQ ID NO: 933331 - DNA, 25 bp, Mus musculus
ttccagcctggtaggagcatgctac

SEQ ID NO: 933332 - DNA, 25 bp, Mus musculus
ttccagcctggttggagcatgctac

SEQ ID NO: 933333 - DNA, 25 bp, Mus musculus
ttccagccttccattatcggtatgg

SEQ ID NO: 933334 - DNA, 25 bp, Mus musculus
ttccagccttcctttatcggtatgg

SEQ ID NO: 933335 - DNA, 25 bp, Mus musculus
ttccagccttgaaacacgcttcaaa

SEQ ID NO: 933336 - DNA, 25 bp, Mus musculus
ttccagccttgatacacgcttcaaa

SEQ ID NO: 933337 - DNA, 25 bp, Mus musculus
ttccagccttttagtctgaggtaat

SEQ ID NO: 933338 - DNA, 25 bp, Mus musculus
ttccagcctttttgtctgaggtaat

SEQ ID NO: 933339 - DNA, 25 bp, Mus musculus
ttccagcgaggaaccggcgtcagtt

SEQ ID NO: 933340 - DNA, 25 bp, Mus musculus
ttccagcgaggatccggcgtcagtt

SEQ ID NO: 933341 - DNA, 25 bp, Mus musculus
ttccagcgctcaatagccacgtgtg

SEQ ID NO: 933342 - DNA, 25 bp, Mus musculus
ttccagcgctcattagccacgtgtg

SEQ ID NO: 933343 - DNA, 25 bp, Mus musculus
ttccagcggaggacaaggtactgca

SEQ ID NO: 933344 - DNA, 25 bp, Mus musculus
ttccagcggaggtcaaggtactgca

SEQ ID NO: 933345 - DNA, 25 bp, Mus musculus
ttccagcggcacattgcggagtggc

SEQ ID NO: 933346 - DNA, 25 bp, Mus musculus
ttccagcggcactttgcggagtggc

SEQ ID NO: 933347 - DNA, 25 bp, Mus musculus
ttccagcgggctatgcatcacatca

SEQ ID NO: 933348 - DNA, 25 bp, Mus musculus
ttccagcgggctttgcatcacatca

SEQ ID NO: 933349 - DNA, 25 bp, Mus musculus
ttccagctacatacctttacaggca

SEQ ID NO: 933350 - DNA, 25 bp, Mus musculus
ttccagctacattcctttacaggca

SEQ ID NO: 933351 - DNA, 25 bp, Mus musculus
ttccagctacctatgcgagatagag

SEQ ID NO: 933352 - DNA, 25 bp, Mus musculus
ttccagctacctttgcgagatagag

SEQ ID NO: 933353 - DNA, 25 bp, Mus musculus
ttccagctcagtacctctatatatt

SEQ ID NO: 933354 - DNA, 25 bp, Mus musculus
ttccagctcagttcctctatatatt

SEQ ID NO: 933355 - DNA, 25 bp, Mus musculus
ttccagctcattagccaactacttt

SEQ ID NO: 933356 - DNA, 25 bp, Mus musculus
ttccagctcatttgccaactacttt

SEQ ID NO: 933357 - DNA, 25 bp, Mus musculus
ttccagctccgtcgatggcaataac

SEQ ID NO: 933358 - DNA, 25 bp, Mus musculus
ttccagctccgtggatggcaataac

SEQ ID NO: 933359 - DNA, 25 bp, Mus musculus
ttccagctcctgattccaaagagac

SEQ ID NO: 933360 - DNA, 25 bp, Mus musculus
ttccagctcctgtttccaaagagac

SEQ ID NO: 933361 - DNA, 25 bp, Mus musculus
ttccagctctctacatgtactggga

SEQ ID NO: 933362 - DNA, 25 bp, Mus musculus
ttccagctctcttcatgtactggga

SEQ ID NO: 933363 - DNA, 25 bp, Mus musculus
ttccagctgaagctaaccctttagc

SEQ ID NO: 933364 - DNA, 25 bp, Mus musculus
ttccagctgaaggtaaccctttagc

SEQ ID NO: 933365 - DNA, 25 bp, Mus musculus
ttccagctgatgacagggcacttga

SEQ ID NO: 933366 - DNA, 25 bp, Mus musculus
ttccagctgatgtcagggcacttga

SEQ ID NO: 933367 - DNA, 25 bp, Mus musculus
ttccagctgctgagaatcctcagag

SEQ ID NO: 933368 - DNA, 25 bp, Mus musculus
ttccagctgctgtgaatcctcagag

SEQ ID NO: 933369 - DNA, 25 bp, Mus musculus
ttccagctgcttctccaatgacatt

SEQ ID NO: 933370 - DNA, 25 bp, Mus musculus
ttccagctgcttgtccaatgacatt

SEQ ID NO: 933371 - DNA, 25 bp, Mus musculus
ttccagctggcacaaccatcttggt

SEQ ID NO: 933372 - DNA, 25 bp, Mus musculus
ttccagctggcagaaccatcttggt

SEQ ID NO: 933373 - DNA, 25 bp, Mus musculus
ttccagctgggtaaattgccgttta

SEQ ID NO: 933374 - DNA, 25 bp, Mus musculus
ttccagctgggttaattgccgttta

SEQ ID NO: 933375 - DNA, 25 bp, Mus musculus
ttccagctggtaactcctcacaaag

SEQ ID NO: 933376 - DNA, 25 bp, Mus musculus
ttccagctggtatctcctcacaaag

SEQ ID NO: 933377 - DNA, 25 bp, Mus musculus
ttccagctgtaaaaccaccatagaa

SEQ ID NO: 933378 - DNA, 25 bp, Mus musculus
ttccagctgtaataccaccatagaa

SEQ ID NO: 933379 - DNA, 25 bp, Mus musculus
ttccagctgtaccacctaggaagcc

SEQ ID NO: 933380 - DNA, 25 bp, Mus musculus
ttccagctgtacgacctaggaagcc

SEQ ID NO: 933381 - DNA, 25 bp, Mus musculus
ttccagctgtccctcacttatgtga

SEQ ID NO: 933382 - DNA, 25 bp, Mus musculus
ttccagctgtccgtcacttatgtga

SEQ ID NO: 933383 - DNA, 25 bp, Mus musculus
ttccagctgttgagccgtttcagaa

SEQ ID NO: 933384 - DNA, 25 bp, Mus musculus
ttccagctgttgtgccgtttcagaa

SEQ ID NO: 933385 - DNA, 25 bp, Mus musculus
ttccagcttaacactatgttgaagc

SEQ ID NO: 933386 - DNA, 25 bp, Mus musculus
ttccagcttaactctatgttgaagc

SEQ ID NO: 933387 - DNA, 25 bp, Mus musculus
ttccagcttaccagggtaccttagt

SEQ ID NO: 933388 - DNA, 25 bp, Mus musculus
ttccagcttacctgggtaccttagt

SEQ ID NO: 933389 - DNA, 25 bp, Mus musculus
ttccagcttctaaatgccacgcaaa

SEQ ID NO: 933390 - DNA, 25 bp, Mus musculus
ttccagcttctatatgccacgcaaa

SEQ ID NO: 933391 - DNA, 25 bp, Mus musculus
ttccagcttgtgcatattaacacgt

SEQ ID NO: 933392 - DNA, 25 bp, Mus musculus
ttccagcttgtggatattaacacgt

SEQ ID NO: 933393 - DNA, 25 bp, Mus musculus
ttccagctttcgacccgaggactat

SEQ ID NO: 933394 - DNA, 25 bp, Mus musculus
ttccagctttcgtcccgaggactat

SEQ ID NO: 933395 - DNA, 25 bp, Mus musculus
ttccaggaaagtcgcctccacctga

SEQ ID NO: 933396 - DNA, 25 bp, Mus musculus
ttccaggaaagtggcctccacctga

SEQ ID NO: 933397 - DNA, 25 bp, Mus musculus
ttccaggaataacctctgttcccat

SEQ ID NO: 933398 - DNA, 25 bp, Mus musculus
ttccaggaataagctctgttcccat

SEQ ID NO: 933399 - DNA, 25 bp, Mus musculus
ttccaggaatcccaaatacttggtg

SEQ ID NO: 933400 - DNA, 25 bp, Mus musculus
ttccaggaatccgaaatacttggtg

SEQ ID NO: 933401 - DNA, 25 bp, Mus musculus
ttccaggacaatcatctgctcaacc

SEQ ID NO: 933402 - DNA, 25 bp, Mus musculus
ttccaggacaatgatctgctcaacc

SEQ ID NO: 933403 - DNA, 25 bp, Mus musculus
ttccaggacacgcagtcatcacgat

SEQ ID NO: 933404 - DNA, 25 bp, Mus musculus
ttccaggacacggagtcatcacgat

SEQ ID NO: 933405 - DNA, 25 bp, Mus musculus
ttccaggacagtctaccatagctct

SEQ ID NO: 933406 - DNA, 25 bp, Mus musculus
ttccaggacagtgtaccatagctct

SEQ ID NO: 933407 - DNA, 25 bp, Mus musculus
ttccaggaccacagggtagtcattt

SEQ ID NO: 933408 - DNA, 25 bp, Mus musculus
ttccaggaccactgggtagtcattt

SEQ ID NO: 933409 - DNA, 25 bp, Mus musculus
ttccaggacccacgcttggcaaaaa

SEQ ID NO: 933410 - DNA, 25 bp, Mus musculus
ttccaggacccaggcttggcaaaaa

SEQ ID NO: 933411 - DNA, 25 bp, Mus musculus
ttccaggactccagggacacagagt

SEQ ID NO: 933412 - DNA, 25 bp, Mus musculus
ttccaggactcctgggacacagagt

SEQ ID NO: 933413 - DNA, 25 bp, Mus musculus
ttccaggactgcattgtgacgtctg

SEQ ID NO: 933414 - DNA, 25 bp, Mus musculus
ttccaggactgctttgtgacgtctg

SEQ ID NO: 933415 - DNA, 25 bp, Mus musculus
ttccaggacttcagtgtgggcaagt

SEQ ID NO: 933416 - DNA, 25 bp, Mus musculus
ttccaggacttctgtgtgggcaagt

SEQ ID NO: 933417 - DNA, 25 bp, Mus musculus
ttccaggagaagctcagctcccatc

SEQ ID NO: 933418 - DNA, 25 bp, Mus musculus
ttccaggagaaggtcagctcccatc

SEQ ID NO: 933419 - DNA, 25 bp, Mus musculus
ttccaggagaccacgctttaaagac

SEQ ID NO: 933420 - DNA, 25 bp, Mus musculus
ttccaggagacctcgctttaaagac

SEQ ID NO: 933421 - DNA, 25 bp, Mus musculus
ttccaggagagacactttaagactt

SEQ ID NO: 933422 - DNA, 25 bp, Mus musculus
ttccaggagagagactttaagactt

SEQ ID NO: 933423 - DNA, 25 bp, Mus musculus
ttccaggagatccaatcccgtcttg

SEQ ID NO: 933424 - DNA, 25 bp, Mus musculus
ttccaggagatcgaatcccgtcttg

SEQ ID NO: 933425 - DNA, 25 bp, Mus musculus
ttccaggagcgcctctctaaggaga

SEQ ID NO: 933426 - DNA, 25 bp, Mus musculus
ttccaggagcgcgtctctaaggaga

SEQ ID NO: 933427 - DNA, 25 bp, Mus musculus
ttccaggaggtcaccttccgaaagc

SEQ ID NO: 933428 - DNA, 25 bp, Mus musculus
ttccaggaggtctccttccgaaagc

SEQ ID NO: 933429 - DNA, 25 bp, Mus musculus
ttccaggaggttaccctatgtttgg

SEQ ID NO: 933430 - DNA, 25 bp, Mus musculus
ttccaggaggtttccctatgtttgg

SEQ ID NO: 933431 - DNA, 25 bp, Mus musculus
ttccaggataacctgctctactttc

SEQ ID NO: 933432 - DNA, 25 bp, Mus musculus
ttccaggataacgtgctctactttc

SEQ ID NO: 933433 - DNA, 25 bp, Mus musculus
ttccaggatagtattaccaaagtga

SEQ ID NO: 933434 - DNA, 25 bp, Mus musculus
ttccaggatagttttaccaaagtga

SEQ ID NO: 933435 - DNA, 25 bp, Mus musculus
ttccaggatgatctgttcccggaca

SEQ ID NO: 933436 - DNA, 25 bp, Mus musculus
ttccaggatgatgtgttcccggaca

SEQ ID NO: 933437 - DNA, 25 bp, Mus musculus
ttccaggattcaaggtgcctctatt

SEQ ID NO: 933438 - DNA, 25 bp, Mus musculus
ttccaggattcatggtgcctctatt

SEQ ID NO: 933439 - DNA, 25 bp, Mus musculus
ttccaggattctaggactccagaat

SEQ ID NO: 933440 - DNA, 25 bp, Mus musculus
ttccaggattcttggactccagaat

SEQ ID NO: 933441 - DNA, 25 bp, Mus musculus
ttccaggcagctaactttagggttg

SEQ ID NO: 933442 - DNA, 25 bp, Mus musculus
ttccaggcagctcgtagaggctcca

SEQ ID NO: 933443 - DNA, 25 bp, Mus musculus
ttccaggcagctggtagaggctcca

SEQ ID NO: 933444 - DNA, 25 bp, Mus musculus
ttccaggcagcttactttagggttg

SEQ ID NO: 933445 - DNA, 25 bp, Mus musculus
ttccaggcagtaactcgggcaaccg

SEQ ID NO: 933446 - DNA, 25 bp, Mus musculus
ttccaggcagtatctcgggcaaccg

SEQ ID NO: 933447 - DNA, 25 bp, Mus musculus
ttccaggcatgtatgagtttcagtt

SEQ ID NO: 933448 - DNA, 25 bp, Mus musculus
ttccaggcatgtttgagtttcagtt

SEQ ID NO: 933449 - DNA, 25 bp, Mus musculus
ttccaggcattcacttaactttcag

SEQ ID NO: 933450 - DNA, 25 bp, Mus musculus
ttccaggcattctcttaactttcag

SEQ ID NO: 933451 - DNA, 25 bp, Mus musculus
ttccaggccagcactgtagagcaag

SEQ ID NO: 933452 - DNA, 25 bp, Mus musculus
ttccaggccagctctgtagagcaag

SEQ ID NO: 933453 - DNA, 25 bp, Mus musculus
ttccaggccagtctgttaatcagag

SEQ ID NO: 933454 - DNA, 25 bp, Mus musculus
ttccaggccagtgtgttaatcagag

SEQ ID NO: 933455 - DNA, 25 bp, Mus musculus
ttccaggcccccaatatttcagaag

SEQ ID NO: 933456 - DNA, 25 bp, Mus musculus
ttccaggccccctatatttcagaag

SEQ ID NO: 933457 - DNA, 25 bp, Mus musculus
ttccaggcggcgagcacgcagagaa

SEQ ID NO: 933458 - DNA, 25 bp, Mus musculus
ttccaggcggcgtgcacgcagagaa

SEQ ID NO: 933459 - DNA, 25 bp, Mus musculus
ttccaggcgtcacgcaagcgctgtt

SEQ ID NO: 933460 - DNA, 25 bp, Mus musculus
ttccaggcgtcaggcaagcgctgtt

SEQ ID NO: 933461 - DNA, 25 bp, Mus musculus
ttccaggcgtttatcatcttgtgta

SEQ ID NO: 933462 - DNA, 25 bp, Mus musculus
ttccaggcgtttttcatcttgtgta

SEQ ID NO: 933463 - DNA, 25 bp, Mus musculus
ttccaggctaatcagagttacccag

SEQ ID NO: 933464 - DNA, 25 bp, Mus musculus
ttccaggctaatgagagttacccag

SEQ ID NO: 933465 - DNA, 25 bp, Mus musculus
ttccaggctcgtatacccatgcatg

SEQ ID NO: 933466 - DNA, 25 bp, Mus musculus
ttccaggctcgtttacccatgcatg

SEQ ID NO: 933467 - DNA, 25 bp, Mus musculus
ttccaggctgcacagataaccggct

SEQ ID NO: 933468 - DNA, 25 bp, Mus musculus
ttccaggctgcagagataaccggct

SEQ ID NO: 933469 - DNA, 25 bp, Mus musculus
ttccagggaatcagggtctgctcac

SEQ ID NO: 933470 - DNA, 25 bp, Mus musculus
ttccagggaatctgggtctgctcac

SEQ ID NO: 933471 - DNA, 25 bp, Mus musculus
ttccagggaattatccaaagtagca

SEQ ID NO: 933472 - DNA, 25 bp, Mus musculus
ttccagggaattttccaaagtagca

SEQ ID NO: 933473 - DNA, 25 bp, Mus musculus
ttccagggacttcacgtgtctacag

SEQ ID NO: 933474 - DNA, 25 bp, Mus musculus
ttccagggacttgacgtgtctacag

SEQ ID NO: 933475 - DNA, 25 bp, Mus musculus
ttccagggagatattcttatgttct

SEQ ID NO: 933476 - DNA, 25 bp, Mus musculus
ttccagggagattttcttatgttct

SEQ ID NO: 933477 - DNA, 25 bp, Mus musculus
ttccagggcaccaaacatcttcttg

SEQ ID NO: 933478 - DNA, 25 bp, Mus musculus
ttccagggcacctaacatcttcttg

SEQ ID NO: 933479 - DNA, 25 bp, Mus musculus
ttccagggcatgcaattcacatgca

SEQ ID NO: 933480 - DNA, 25 bp, Mus musculus
ttccagggcatggaattcacatgca

SEQ ID NO: 933481 - DNA, 25 bp, Mus musculus
ttccagggccctactatatgttctt

SEQ ID NO: 933482 - DNA, 25 bp, Mus musculus
ttccagggcccttctatatgttctt

SEQ ID NO: 933483 - DNA, 25 bp, Mus musculus
ttccagggccttagtgtggtggcta

SEQ ID NO: 933484 - DNA, 25 bp, Mus musculus
ttccagggcctttgtgtggtggcta

SEQ ID NO: 933485 - DNA, 25 bp, Mus musculus
ttccaggggattaaacaagcacaca

SEQ ID NO: 933486 - DNA, 25 bp, Mus musculus
ttccaggggatttaacaagcacaca

SEQ ID NO: 933487 - DNA, 25 bp, Mus musculus
ttccagggtggcacatccagagact

SEQ ID NO: 933488 - DNA, 25 bp, Mus musculus
ttccagggtggctcatccagagact

SEQ ID NO: 933489 - DNA, 25 bp, Mus musculus
ttccagggttatagctataggactt

SEQ ID NO: 933490 - DNA, 25 bp, Mus musculus
ttccagggttattgctataggactt

SEQ ID NO: 933491 - DNA, 25 bp, Mus musculus
ttccaggtaggaatgttgccgcatc

SEQ ID NO: 933492 - DNA, 25 bp, Mus musculus
ttccaggtaggattgttgccgcatc

SEQ ID NO: 933493 - DNA, 25 bp, Mus musculus
ttccaggtcagcacagtaggttctc

SEQ ID NO: 933494 - DNA, 25 bp, Mus musculus
ttccaggtcagctcagtaggttctc

SEQ ID NO: 933495 - DNA, 25 bp, Mus musculus
ttccaggtcaggagatggctaatcc

SEQ ID NO: 933496 - DNA, 25 bp, Mus musculus
ttccaggtcaggtgatggctaatcc

SEQ ID NO: 933497 - DNA, 25 bp, Mus musculus
ttccaggtcctgactgcagtgccat

SEQ ID NO: 933498 - DNA, 25 bp, Mus musculus
ttccaggtcctgtctgcagtgccat

SEQ ID NO: 933499 - DNA, 25 bp, Mus musculus
ttccaggtcgctataaagtaagaca

SEQ ID NO: 933500 - DNA, 25 bp, Mus musculus
ttccaggtcgctttaaagtaagaca

SEQ ID NO: 933501 - DNA, 25 bp, Mus musculus
ttccaggtgcatagcctaagtagac

SEQ ID NO: 933502 - DNA, 25 bp, Mus musculus
ttccaggtgcattgcctaagtagac

SEQ ID NO: 933503 - DNA, 25 bp, Mus musculus
ttccaggtgctgctgacatttcagg

SEQ ID NO: 933504 - DNA, 25 bp, Mus musculus
ttccaggtgctggtgacatttcagg

SEQ ID NO: 933505 - DNA, 25 bp, Mus musculus
ttccaggtgcttctgccttagagtc

SEQ ID NO: 933506 - DNA, 25 bp, Mus musculus
ttccaggtgcttgtgccttagagtc

SEQ ID NO: 933507 - DNA, 25 bp, Mus musculus
ttccaggtggtcaagcatgtgcgta

SEQ ID NO: 933508 - DNA, 25 bp, Mus musculus
ttccaggtggtctagcatgtgcgta

SEQ ID NO: 933509 - DNA, 25 bp, Mus musculus
ttccaggtggtgatccagaagtcct

SEQ ID NO: 933510 - DNA, 25 bp, Mus musculus
ttccaggtggtgttccagaagtcct

SEQ ID NO: 933511 - DNA, 25 bp, Mus musculus
ttccaggtgtctaaatctccagtct

SEQ ID NO: 933512 - DNA, 25 bp, Mus musculus
ttccaggtgtcttaatctccagtct

SEQ ID NO: 933513 - DNA, 25 bp, Mus musculus
ttccaggtgtgaagagaccagctca

SEQ ID NO: 933514 - DNA, 25 bp, Mus musculus
ttccaggtgtgatgagaccagctca

SEQ ID NO: 933515 - DNA, 25 bp, Mus musculus
ttccaggtgtttcctagaggtcatt

SEQ ID NO: 933516 - DNA, 25 bp, Mus musculus
ttccaggtgtttgctagaggtcatt

SEQ ID NO: 933517 - DNA, 25 bp, Mus musculus
ttccaggttacacgccagacgactc

SEQ ID NO: 933518 - DNA, 25 bp, Mus musculus
ttccaggttacaggccagacgactc

SEQ ID NO: 933519 - DNA, 25 bp, Mus musculus
ttccaggttcacagctgtcttcagt

SEQ ID NO: 933520 - DNA, 25 bp, Mus musculus
ttccaggttcactgctgtcttcagt

SEQ ID NO: 933521 - DNA, 25 bp, Mus musculus
ttccaggttccactggtgacattgt

SEQ ID NO: 933522 - DNA, 25 bp, Mus musculus
ttccaggttccagtggtgacattgt

SEQ ID NO: 933523 - DNA, 25 bp, Mus musculus
ttccaggttggcactttactttgtt

SEQ ID NO: 933524 - DNA, 25 bp, Mus musculus
ttccaggttggctctttactttgtt

SEQ ID NO: 933525 - DNA, 25 bp, Mus musculus
ttccaggtttttacagacttgtaag

SEQ ID NO: 933526 - DNA, 25 bp, Mus musculus
ttccaggttttttcagacttgtaag

SEQ ID NO: 933527 - DNA, 25 bp, Mus musculus
ttccagtaaataccaggctgagagt

SEQ ID NO: 933528 - DNA, 25 bp, Mus musculus
ttccagtaaatagcaggctgagagt

SEQ ID NO: 933529 - DNA, 25 bp, Mus musculus
ttccagtaagacctcttctctcatt

SEQ ID NO: 933530 - DNA, 25 bp, Mus musculus
ttccagtaagacgtcttctctcatt

SEQ ID NO: 933531 - DNA, 25 bp, Mus musculus
ttccagtacacccttggcagaacag

SEQ ID NO: 933532 - DNA, 25 bp, Mus musculus
ttccagtacaccgttggcagaacag

SEQ ID NO: 933533 - DNA, 25 bp, Mus musculus
ttccagtacactcgcaatcccatgt

SEQ ID NO: 933534 - DNA, 25 bp, Mus musculus
ttccagtacactggcaatcccatgt

SEQ ID NO: 933535 - DNA, 25 bp, Mus musculus
ttccagtagctaatgctaggctagt

SEQ ID NO: 933536 - DNA, 25 bp, Mus musculus
ttccagtagctattgctaggctagt

SEQ ID NO: 933537 - DNA, 25 bp, Mus musculus
ttccagtatgcacacgggctggagc

SEQ ID NO: 933538 - DNA, 25 bp, Mus musculus
ttccagtatgcagacgggctggagc

SEQ ID NO: 933539 - DNA, 25 bp, Mus musculus
ttccagtatgccagagcgtcagact

SEQ ID NO: 933540 - DNA, 25 bp, Mus musculus
ttccagtatgcctgagcgtcagact

SEQ ID NO: 933541 - DNA, 25 bp, Mus musculus
ttccagtattaccatgaacagttgt

SEQ ID NO: 933542 - DNA, 25 bp, Mus musculus
ttccagtattacgatgaacagttgt

SEQ ID NO: 933543 - DNA, 25 bp, Mus musculus
ttccagtcaaataaccttctttgtg

SEQ ID NO: 933544 - DNA, 25 bp, Mus musculus
ttccagtcaaattaccttctttgtg

SEQ ID NO: 933545 - DNA, 25 bp, Mus musculus
ttccagtcaaggaggcatctgcact

SEQ ID NO: 933546 - DNA, 25 bp, Mus musculus
ttccagtcaaggtggcatctgcact

SEQ ID NO: 933547 - DNA, 25 bp, Mus musculus
ttccagtccaatccagcaccagggt

SEQ ID NO: 933548 - DNA, 25 bp, Mus musculus
ttccagtccaatgcagcaccagggt

SEQ ID NO: 933549 - DNA, 25 bp, Mus musculus
ttccagtccaccacgggctatgtag

SEQ ID NO: 933550 - DNA, 25 bp, Mus musculus
ttccagtccacctcgggctatgtag

SEQ ID NO: 933551 - DNA, 25 bp, Mus musculus
ttccagtccggcagtcagtaagatc

SEQ ID NO: 933552 - DNA, 25 bp, Mus musculus
ttccagtccggctgtcagtaagatc

SEQ ID NO: 933553 - DNA, 25 bp, Mus musculus
ttccagtcctctcgtacttcctgaa

SEQ ID NO: 933554 - DNA, 25 bp, Mus musculus
ttccagtcctctggtacttcctgaa

SEQ ID NO: 933555 - DNA, 25 bp, Mus musculus
ttccagtctagtcggtttgcttttt

SEQ ID NO: 933556 - DNA, 25 bp, Mus musculus
ttccagtctagtgggtttgcttttt

SEQ ID NO: 933557 - DNA, 25 bp, Mus musculus
ttccagtctatccacatgttaccta

SEQ ID NO: 933558 - DNA, 25 bp, Mus musculus
ttccagtctatcgacatgttaccta

SEQ ID NO: 933559 - DNA, 25 bp, Mus musculus
ttccagtctcctcaatctgaacagg

SEQ ID NO: 933560 - DNA, 25 bp, Mus musculus
ttccagtctcctgaatctgaacagg

SEQ ID NO: 933561 - DNA, 25 bp, Mus musculus
ttccagtctgatcggagaccctatc

SEQ ID NO: 933562 - DNA, 25 bp, Mus musculus
ttccagtctgatgggagaccctatc

SEQ ID NO: 933563 - DNA, 25 bp, Mus musculus
ttccagtctggccagtagtagggtg

SEQ ID NO: 933564 - DNA, 25 bp, Mus musculus
ttccagtctggcgagtagtagggtg

SEQ ID NO: 933565 - DNA, 25 bp, Mus musculus
ttccagtcttgcaggtgatcctgta

SEQ ID NO: 933566 - DNA, 25 bp, Mus musculus
ttccagtcttgctggtgatcctgta

SEQ ID NO: 933567 - DNA, 25 bp, Mus musculus
ttccagtcttggaccctgtgttgac

SEQ ID NO: 933568 - DNA, 25 bp, Mus musculus
ttccagtcttggtccctgtgttgac

SEQ ID NO: 933569 - DNA, 25 bp, Mus musculus
ttccagtgaggaacaccatccaggt

SEQ ID NO: 933570 - DNA, 25 bp, Mus musculus
ttccagtgaggatcaccatccaggt

SEQ ID NO: 933571 - DNA, 25 bp, Mus musculus
ttccagtgcactacctgatcaggaa

SEQ ID NO: 933572 - DNA, 25 bp, Mus musculus
ttccagtgcacttcctgatcaggaa

SEQ ID NO: 933573 - DNA, 25 bp, Mus musculus
ttccagtgctctattgttacgtttt

SEQ ID NO: 933574 - DNA, 25 bp, Mus musculus
ttccagtgctcttttgttacgtttt

SEQ ID NO: 933575 - DNA, 25 bp, Mus musculus
ttccagtgctggactcaccttcatc

SEQ ID NO: 933576 - DNA, 25 bp, Mus musculus
ttccagtgctggtctcaccttcatc

SEQ ID NO: 933577 - DNA, 25 bp, Mus musculus
ttccagtgtcacacctgcggcaaga

SEQ ID NO: 933578 - DNA, 25 bp, Mus musculus
ttccagtgtcactcctgcggcaaga

SEQ ID NO: 933579 - DNA, 25 bp, Mus musculus
ttccagtgtggcctctatggtaaaa

SEQ ID NO: 933580 - DNA, 25 bp, Mus musculus
ttccagtgtggcgtctatggtaaaa

SEQ ID NO: 933581 - DNA, 25 bp, Mus musculus
ttccagtgtgttactgcatttacat

SEQ ID NO: 933582 - DNA, 25 bp, Mus musculus
ttccagtgtgtttctgcatttacat

SEQ ID NO: 933583 - DNA, 25 bp, Mus musculus
ttccagttaaacctgctgatcttaa

SEQ ID NO: 933584 - DNA, 25 bp, Mus musculus
ttccagttaaacgtgctgatcttaa

SEQ ID NO: 933585 - DNA, 25 bp, Mus musculus
ttccagttacttcatatgactcagt

SEQ ID NO: 933586 - DNA, 25 bp, Mus musculus
ttccagttacttgatatgactcagt

SEQ ID NO: 933587 - DNA, 25 bp, Mus musculus
ttccagttatcactgccattttagc

SEQ ID NO: 933588 - DNA, 25 bp, Mus musculus
ttccagttatcagtgccattttagc

SEQ ID NO: 933589 - DNA, 25 bp, Mus musculus
ttccagttgtaaaccagtttgtcag

SEQ ID NO: 933590 - DNA, 25 bp, Mus musculus
ttccagttgtaatccagtttgtcag

SEQ ID NO: 933591 - DNA, 25 bp, Mus musculus
ttccagttgtggcacttgagcttct

SEQ ID NO: 933592 - DNA, 25 bp, Mus musculus
ttccagttgtgggacttgagcttct

SEQ ID NO: 933593 - DNA, 25 bp, Mus musculus
ttccagtttccgactacatccagag

SEQ ID NO: 933594 - DNA, 25 bp, Mus musculus
ttccagtttccgtctacatccagag

SEQ ID NO: 933595 - DNA, 25 bp, Mus musculus
ttccagtttcgaatgccaaatcagg

SEQ ID NO: 933596 - DNA, 25 bp, Mus musculus
ttccagtttcgattgccaaatcagg

SEQ ID NO: 933597 - DNA, 25 bp, Mus musculus
ttccagtttgctaatatttccagtg

SEQ ID NO: 933598 - DNA, 25 bp, Mus musculus
ttccagtttgcttatatttccagtg

SEQ ID NO: 933599 - DNA, 25 bp, Mus musculus
ttccagtttgtgataattagtatgc

SEQ ID NO: 933600 - DNA, 25 bp, Mus musculus
ttccagtttgtgttaattagtatgc

SEQ ID NO: 933601 - DNA, 25 bp, Mus musculus
ttccagttttaaagccgtttctcag

SEQ ID NO: 933602 - DNA, 25 bp, Mus musculus
ttccagttttaatgccgtttctcag

SEQ ID NO: 933603 - DNA, 25 bp, Mus musculus
ttccagttttgtacacctgaagcga

SEQ ID NO: 933604 - DNA, 25 bp, Mus musculus
ttccagttttgtactttctttatat

SEQ ID NO: 933605 - DNA, 25 bp, Mus musculus
ttccagttttgttcacctgaagcga

SEQ ID NO: 933606 - DNA, 25 bp, Mus musculus
ttccagttttgttctttctttatat

SEQ ID NO: 933607 - DNA, 25 bp, Mus musculus
ttccataaccgcctgtgacaagtaa

SEQ ID NO: 933608 - DNA, 25 bp, Mus musculus
ttccataaccgcgtgtgacaagtaa

SEQ ID NO: 933609 - DNA, 25 bp, Mus musculus
ttccatacaacacctcgtcatgaaa

SEQ ID NO: 933610 - DNA, 25 bp, Mus musculus
ttccatacaacagctcgtcatgaaa

SEQ ID NO: 933611 - DNA, 25 bp, Mus musculus
ttccatacattgaagatttggtttc

SEQ ID NO: 933612 - DNA, 25 bp, Mus musculus
ttccatacattgtagatttggtttc

SEQ ID NO: 933613 - DNA, 25 bp, Mus musculus
ttccatacccagcatacgtggtgct

SEQ ID NO: 933614 - DNA, 25 bp, Mus musculus
ttccatacccaggatacgtggtgct

SEQ ID NO: 933615 - DNA, 25 bp, Mus musculus
ttccatacgtcaaagctaggcccta

SEQ ID NO: 933616 - DNA, 25 bp, Mus musculus
ttccatacgtcatagctaggcccta

SEQ ID NO: 933617 - DNA, 25 bp, Mus musculus
ttccatactacaaatctttctgctt

SEQ ID NO: 933618 - DNA, 25 bp, Mus musculus
ttccatactacatatctttctgctt

SEQ ID NO: 933619 - DNA, 25 bp, Mus musculus
ttccatactggacatgcaggacctg

SEQ ID NO: 933620 - DNA, 25 bp, Mus musculus
ttccatactggagatgcaggacctg

SEQ ID NO: 933621 - DNA, 25 bp, Mus musculus
ttccatactttcagtagagacaaga

SEQ ID NO: 933622 - DNA, 25 bp, Mus musculus
ttccatactttctgtagagacaaga

SEQ ID NO: 933623 - DNA, 25 bp, Mus musculus
ttccatagcccacggtgtatagggt

SEQ ID NO: 933624 - DNA, 25 bp, Mus musculus
ttccatagcccagggtgtatagggt

SEQ ID NO: 933625 - DNA, 25 bp, Mus musculus
ttccatagccttaccttgacattga

SEQ ID NO: 933626 - DNA, 25 bp, Mus musculus
ttccatagcctttccttgacattga

SEQ ID NO: 933627 - DNA, 25 bp, Mus musculus
ttccatagctgtcaccatggtctat

SEQ ID NO: 933628 - DNA, 25 bp, Mus musculus
ttccatagctgtgaccatggtctat

SEQ ID NO: 933629 - DNA, 25 bp, Mus musculus
ttccataggaatagaggtctggcct

SEQ ID NO: 933630 - DNA, 25 bp, Mus musculus
ttccataggaattgaggtctggcct

SEQ ID NO: 933631 - DNA, 25 bp, Mus musculus
ttccataggcttatcagggttctga

SEQ ID NO: 933632 - DNA, 25 bp, Mus musculus
ttccataggcttttcagggttctga

SEQ ID NO: 933633 - DNA, 25 bp, Mus musculus
ttccatagtagtcagcagctgcagc

SEQ ID NO: 933634 - DNA, 25 bp, Mus musculus
ttccatagtagtgagcagctgcagc

SEQ ID NO: 933635 - DNA, 25 bp, Mus musculus
ttccatagtgaaacagcatcggctg

SEQ ID NO: 933636 - DNA, 25 bp, Mus musculus
ttccatagtgaatcagcatcggctg

SEQ ID NO: 933637 - DNA, 25 bp, Mus musculus
ttccatatatgcatctctaggagag

SEQ ID NO: 933638 - DNA, 25 bp, Mus musculus
ttccatatatgcttctctaggagag

SEQ ID NO: 933639 - DNA, 25 bp, Mus musculus
ttccatattcagattggcattcata

SEQ ID NO: 933640 - DNA, 25 bp, Mus musculus
ttccatattcagtttggcattcata

SEQ ID NO: 933641 - DNA, 25 bp, Mus musculus
ttccatattcatctgctaactcctt

SEQ ID NO: 933642 - DNA, 25 bp, Mus musculus
ttccatattcatgtgctaactcctt

SEQ ID NO: 933643 - DNA, 25 bp, Mus musculus
ttccatatttcaatcctgtacggcc

SEQ ID NO: 933644 - DNA, 25 bp, Mus musculus
ttccatatttcattcctgtacggcc

SEQ ID NO: 933645 - DNA, 25 bp, Mus musculus
ttccatatttccctttgtcttgaag

SEQ ID NO: 933646 - DNA, 25 bp, Mus musculus
ttccatatttccgtttgtcttgaag

SEQ ID NO: 933647 - DNA, 25 bp, Mus musculus
ttccatcaaaatcaagtcttggctg

SEQ ID NO: 933648 - DNA, 25 bp, Mus musculus
ttccatcaaaatgaagtcttggctg

SEQ ID NO: 933649 - DNA, 25 bp, Mus musculus
ttccatcaaagccaggcccacagta

SEQ ID NO: 933650 - DNA, 25 bp, Mus musculus
ttccatcaaagcgaggcccacagta

SEQ ID NO: 933651 - DNA, 25 bp, Mus musculus
ttccatcaatggctctgcattcagt

SEQ ID NO: 933652 - DNA, 25 bp, Mus musculus
ttccatcaatgggtctgcattcagt

SEQ ID NO: 933653 - DNA, 25 bp, Mus musculus
ttccatcaggaacctacgggcaagt

SEQ ID NO: 933654 - DNA, 25 bp, Mus musculus
ttccatcaggaagctacgggcaagt

SEQ ID NO: 933655 - DNA, 25 bp, Mus musculus
ttccatcatactctctgctccagtt

SEQ ID NO: 933656 - DNA, 25 bp, Mus musculus
ttccatcatactgtctgctccagtt

SEQ ID NO: 933657 - DNA, 25 bp, Mus musculus
ttccatcatgaactgtgacgttgac

SEQ ID NO: 933658 - DNA, 25 bp, Mus musculus
ttccatcatgaagtgtgacgttgac

SEQ ID NO: 933659 - DNA, 25 bp, Mus musculus
ttccatcatgctcggtaaagctgct

SEQ ID NO: 933660 - DNA, 25 bp, Mus musculus
ttccatcatgctgggtaaagctgct

SEQ ID NO: 933661 - DNA, 25 bp, Mus musculus
ttccatcatgtgcattttagggctt

SEQ ID NO: 933662 - DNA, 25 bp, Mus musculus
ttccatcatgtggattttagggctt

SEQ ID NO: 933663 - DNA, 25 bp, Mus musculus
ttccatcattgacacactcgtcgtt

SEQ ID NO: 933664 - DNA, 25 bp, Mus musculus
ttccatcattgagacactcgtcgtt

SEQ ID NO: 933665 - DNA, 25 bp, Mus musculus
ttccatccacagattagtctcatcc

SEQ ID NO: 933666 - DNA, 25 bp, Mus musculus
ttccatccacagtttagtctcatcc

SEQ ID NO: 933667 - DNA, 25 bp, Mus musculus
ttccatccactcaaagcctttagga

SEQ ID NO: 933668 - DNA, 25 bp, Mus musculus
ttccatccactctaagcctttagga

SEQ ID NO: 933669 - DNA, 25 bp, Mus musculus
ttccatccagacaagcaaggccagc

SEQ ID NO: 933670 - DNA, 25 bp, Mus musculus
ttccatccagactagcaaggccagc

SEQ ID NO: 933671 - DNA, 25 bp, Mus musculus
ttccatccagatccaagtcgtggga

SEQ ID NO: 933672 - DNA, 25 bp, Mus musculus
ttccatccagatgcaagtcgtggga

SEQ ID NO: 933673 - DNA, 25 bp, Mus musculus
ttccatccagtcataattttgtttc

SEQ ID NO: 933674 - DNA, 25 bp, Mus musculus
ttccatccagtcttaattttgtttc

SEQ ID NO: 933675 - DNA, 25 bp, Mus musculus
ttccatccatgaccgattctgaatg

SEQ ID NO: 933676 - DNA, 25 bp, Mus musculus
ttccatccatgagcgattctgaatg

SEQ ID NO: 933677 - DNA, 25 bp, Mus musculus
ttccatccattcactatacttttct

SEQ ID NO: 933678 - DNA, 25 bp, Mus musculus
ttccatccattctctatacttttct

SEQ ID NO: 933679 - DNA, 25 bp, Mus musculus
ttccatcccaacactaccagagaaa

SEQ ID NO: 933680 - DNA, 25 bp, Mus musculus
ttccatcccaactctaccagagaaa

SEQ ID NO: 933681 - DNA, 25 bp, Mus musculus
ttccatcccacaatgtatttttcag

SEQ ID NO: 933682 - DNA, 25 bp, Mus musculus
ttccatcccacattgtatttttcag

SEQ ID NO: 933683 - DNA, 25 bp, Mus musculus
ttccatcccagccatggtaaccagg

SEQ ID NO: 933684 - DNA, 25 bp, Mus musculus
ttccatcccagcgatggtaaccagg

SEQ ID NO: 933685 - DNA, 25 bp, Mus musculus
ttccatcccaggaaatgtgcctttc

SEQ ID NO: 933686 - DNA, 25 bp, Mus musculus
ttccatcccaggtaatgtgcctttc

SEQ ID NO: 933687 - DNA, 25 bp, Mus musculus
ttccatcccagtcttcacaatctga

SEQ ID NO: 933688 - DNA, 25 bp, Mus musculus
ttccatcccagtgttcacaatctga

SEQ ID NO: 933689 - DNA, 25 bp, Mus musculus
ttccatccccagagcagcagagaac

SEQ ID NO: 933690 - DNA, 25 bp, Mus musculus
ttccatccccagagctaaaaagtaa

SEQ ID NO: 933691 - DNA, 25 bp, Mus musculus
ttccatccccagtgcagcagagaac

SEQ ID NO: 933692 - DNA, 25 bp, Mus musculus
ttccatccccagtgctaaaaagtaa

SEQ ID NO: 933693 - DNA, 25 bp, Mus musculus
ttccatcccctacgagagtcacgaa

SEQ ID NO: 933694 - DNA, 25 bp, Mus musculus
ttccatcccctaggagagtcacgaa

SEQ ID NO: 933695 - DNA, 25 bp, Mus musculus
ttccatcccctcattatcaggagca

SEQ ID NO: 933696 - DNA, 25 bp, Mus musculus
ttccatcccctcattgaggtaggaa

SEQ ID NO: 933697 - DNA, 25 bp, Mus musculus
ttccatcccctctttatcaggagca

SEQ ID NO: 933698 - DNA, 25 bp, Mus musculus
ttccatcccctctttgaggtaggaa

SEQ ID NO: 933699 - DNA, 25 bp, Mus musculus
ttccatcccggaataaactgtttga

SEQ ID NO: 933700 - DNA, 25 bp, Mus musculus
ttccatcccggattaaactgtttga

SEQ ID NO: 933701 - DNA, 25 bp, Mus musculus
ttccatccctgaaagtccgtctgag

SEQ ID NO: 933702 - DNA, 25 bp, Mus musculus
ttccatccctgatagtccgtctgag

SEQ ID NO: 933703 - DNA, 25 bp, Mus musculus
ttccatccctgtacctgtagacgta

SEQ ID NO: 933704 - DNA, 25 bp, Mus musculus
ttccatccctgttcctgtagacgta

SEQ ID NO: 933705 - DNA, 25 bp, Mus musculus
ttccatcctaggagcctccattaag

SEQ ID NO: 933706 - DNA, 25 bp, Mus musculus
ttccatcctaggtgcctccattaag

SEQ ID NO: 933707 - DNA, 25 bp, Mus musculus
ttccatcctatccagtcatatctaa

SEQ ID NO: 933708 - DNA, 25 bp, Mus musculus
ttccatcctatcgagtcatatctaa

SEQ ID NO: 933709 - DNA, 25 bp, Mus musculus
ttccatcctggaagctgatcgccaa

SEQ ID NO: 933710 - DNA, 25 bp, Mus musculus
ttccatcctggatgctgatcgccaa

SEQ ID NO: 933711 - DNA, 25 bp, Mus musculus
ttccatccttaaccatagacaataa

SEQ ID NO: 933712 - DNA, 25 bp, Mus musculus
ttccatccttaagcatagacaataa

SEQ ID NO: 933713 - DNA, 25 bp, Mus musculus
ttccatccttgaccgagatgccaat

SEQ ID NO: 933714 - DNA, 25 bp, Mus musculus
ttccatccttgagcgagatgccaat

SEQ ID NO: 933715 - DNA, 25 bp, Mus musculus
ttccatcgggccctaaaagtaatga

SEQ ID NO: 933716 - DNA, 25 bp, Mus musculus
ttccatcgggccgtaaaagtaatga

SEQ ID NO: 933717 - DNA, 25 bp, Mus musculus
ttccatcgtgaaagccagtgttctg

SEQ ID NO: 933718 - DNA, 25 bp, Mus musculus
ttccatcgtgaatgccagtgttctg

SEQ ID NO: 933719 - DNA, 25 bp, Mus musculus
ttccatctatgccattgggatccaa

SEQ ID NO: 933720 - DNA, 25 bp, Mus musculus
ttccatctatgcgattgggatccaa

SEQ ID NO: 933721 - DNA, 25 bp, Mus musculus
ttccatctcaagcatatcattagac

SEQ ID NO: 933722 - DNA, 25 bp, Mus musculus
ttccatctcaaggatatcattagac

SEQ ID NO: 933723 - DNA, 25 bp, Mus musculus
ttccatctccaacaggccactctgt

SEQ ID NO: 933724 - DNA, 25 bp, Mus musculus
ttccatctccaagaggccactctgt

SEQ ID NO: 933725 - DNA, 25 bp, Mus musculus
ttccatctctaaaccttccagagtt

SEQ ID NO: 933726 - DNA, 25 bp, Mus musculus
ttccatctctaatccttccagagtt

SEQ ID NO: 933727 - DNA, 25 bp, Mus musculus
ttccatctgacccactttgtaagtt

SEQ ID NO: 933728 - DNA, 25 bp, Mus musculus
ttccatctgaccgactttgtaagtt

SEQ ID NO: 933729 - DNA, 25 bp, Mus musculus
ttccatctgagacacaaaatgccca

SEQ ID NO: 933730 - DNA, 25 bp, Mus musculus
ttccatctgagagacaaaatgccca

SEQ ID NO: 933731 - DNA, 25 bp, Mus musculus
ttccatctgcttccacttattattt

SEQ ID NO: 933732 - DNA, 25 bp, Mus musculus
ttccatctgcttgcacttattattt

SEQ ID NO: 933733 - DNA, 25 bp, Mus musculus
ttccatctgtcgatccggtagaagg

SEQ ID NO: 933734 - DNA, 25 bp, Mus musculus
ttccatctgtcgttccggtagaagg

SEQ ID NO: 933735 - DNA, 25 bp, Mus musculus
ttccatcttagtcttccttcttaag

SEQ ID NO: 933736 - DNA, 25 bp, Mus musculus
ttccatcttagtgttccttcttaag

SEQ ID NO: 933737 - DNA, 25 bp, Mus musculus
ttccatcttcctccagttaatttct

SEQ ID NO: 933738 - DNA, 25 bp, Mus musculus
ttccatcttcctgcagttaatttct

SEQ ID NO: 933739 - DNA, 25 bp, Mus musculus
ttccatcttgagaaagggaccctga

SEQ ID NO: 933740 - DNA, 25 bp, Mus musculus
ttccatcttgagtaagggaccctga

SEQ ID NO: 933741 - DNA, 25 bp, Mus musculus
ttccatcttgctccaactatgggca

SEQ ID NO: 933742 - DNA, 25 bp, Mus musculus
ttccatcttgctgcaactatgggca

SEQ ID NO: 933743 - DNA, 25 bp, Mus musculus
ttccatcttgtgatagctgaaagat

SEQ ID NO: 933744 - DNA, 25 bp, Mus musculus
ttccatcttgtgttagctgaaagat

SEQ ID NO: 933745 - DNA, 25 bp, Mus musculus
ttccatctttatatggcttccaggg

SEQ ID NO: 933746 - DNA, 25 bp, Mus musculus
ttccatctttatttggcttccaggg

SEQ ID NO: 933747 - DNA, 25 bp, Mus musculus
ttccatctttccaaaccttctaaag

SEQ ID NO: 933748 - DNA, 25 bp, Mus musculus
ttccatctttccacataacactatt

SEQ ID NO: 933749 - DNA, 25 bp, Mus musculus
ttccatctttccagatcacaacaag

SEQ ID NO: 933750 - DNA, 25 bp, Mus musculus
ttccatctttcctaaccttctaaag

SEQ ID NO: 933751 - DNA, 25 bp, Mus musculus
ttccatctttcctcataacactatt

SEQ ID NO: 933752 - DNA, 25 bp, Mus musculus
ttccatctttcctgatcacaacaag

SEQ ID NO: 933753 - DNA, 25 bp, Mus musculus
ttccatgaactcattttacgtgttg

SEQ ID NO: 933754 - DNA, 25 bp, Mus musculus
ttccatgaactctttttacgtgttg

SEQ ID NO: 933755 - DNA, 25 bp, Mus musculus
ttccatgacagtcttgggacaggca

SEQ ID NO: 933756 - DNA, 25 bp, Mus musculus
ttccatgacagtgttgggacaggca

SEQ ID NO: 933757 - DNA, 25 bp, Mus musculus
ttccatgacccaacaggagctcaag

SEQ ID NO: 933758 - DNA, 25 bp, Mus musculus
ttccatgacccatcaggagctcaag

SEQ ID NO: 933759 - DNA, 25 bp, Mus musculus
ttccatgactataaggcttcctgca

SEQ ID NO: 933760 - DNA, 25 bp, Mus musculus
ttccatgactattaggcttcctgca

SEQ ID NO: 933761 - DNA, 25 bp, Mus musculus
ttccatgactcactttctcaccagg

SEQ ID NO: 933762 - DNA, 25 bp, Mus musculus
ttccatgactcagtttctcaccagg

SEQ ID NO: 933763 - DNA, 25 bp, Mus musculus
ttccatgagcttcgaattttgcccc

SEQ ID NO: 933764 - DNA, 25 bp, Mus musculus
ttccatgagcttggaattttgcccc

SEQ ID NO: 933765 - DNA, 25 bp, Mus musculus
ttccatgaggtgagaagagcagtgc

SEQ ID NO: 933766 - DNA, 25 bp, Mus musculus
ttccatgaggtgtgaagagcagtgc

SEQ ID NO: 933767 - DNA, 25 bp, Mus musculus
ttccatgatcttcgtgccaggcgag

SEQ ID NO: 933768 - DNA, 25 bp, Mus musculus
ttccatgatcttggtgccaggcgag

SEQ ID NO: 933769 - DNA, 25 bp, Mus musculus
ttccatgatgtgacttctgcctttc

SEQ ID NO: 933770 - DNA, 25 bp, Mus musculus
ttccatgatgtgtcttctgcctttc

SEQ ID NO: 933771 - DNA, 25 bp, Mus musculus
ttccatgcaaatagactccctgctg

SEQ ID NO: 933772 - DNA, 25 bp, Mus musculus
ttccatgcaaattgactccctgctg

SEQ ID NO: 933773 - DNA, 25 bp, Mus musculus
ttccatgcacttctacacatttaag

SEQ ID NO: 933774 - DNA, 25 bp, Mus musculus
ttccatgcacttgtacacatttaag

SEQ ID NO: 933775 - DNA, 25 bp, Mus musculus
ttccatgcatccctattgagagtta

SEQ ID NO: 933776 - DNA, 25 bp, Mus musculus
ttccatgcatccgtattgagagtta

SEQ ID NO: 933777 - DNA, 25 bp, Mus musculus
ttccatgccaagaataagaatctga

SEQ ID NO: 933778 - DNA, 25 bp, Mus musculus
ttccatgccaagtataagaatctga

SEQ ID NO: 933779 - DNA, 25 bp, Mus musculus
ttccatgccacccaagctgtcaaaa

SEQ ID NO: 933780 - DNA, 25 bp, Mus musculus
ttccatgccaccgaagctgtcaaaa

SEQ ID NO: 933781 - DNA, 25 bp, Mus musculus
ttccatgccactaacaattttttct

SEQ ID NO: 933782 - DNA, 25 bp, Mus musculus
ttccatgccacttacaattttttct

SEQ ID NO: 933783 - DNA, 25 bp, Mus musculus
ttccatgccagcaatcactgggatg

SEQ ID NO: 933784 - DNA, 25 bp, Mus musculus
ttccatgccagctatcactgggatg

SEQ ID NO: 933785 - DNA, 25 bp, Mus musculus
ttccatgcctcaccggctgaggcag

SEQ ID NO: 933786 - DNA, 25 bp, Mus musculus
ttccatgcctcagcggctgaggcag

SEQ ID NO: 933787 - DNA, 25 bp, Mus musculus
ttccatgcctccactgtgagttggg

SEQ ID NO: 933788 - DNA, 25 bp, Mus musculus
ttccatgcctcctctgtgagttggg

SEQ ID NO: 933789 - DNA, 25 bp, Mus musculus
ttccatgcggaaatttcaagaacag

SEQ ID NO: 933790 - DNA, 25 bp, Mus musculus
ttccatgcggaattttcaagaacag

SEQ ID NO: 933791 - DNA, 25 bp, Mus musculus
ttccatgcggagaatgcaaccgttt

SEQ ID NO: 933792 - DNA, 25 bp, Mus musculus
ttccatgcggagtatgcaaccgttt

SEQ ID NO: 933793 - DNA, 25 bp, Mus musculus
ttccatgctcttactacaaattcct

SEQ ID NO: 933794 - DNA, 25 bp, Mus musculus
ttccatgctctttctacaaattcct

SEQ ID NO: 933795 - DNA, 25 bp, Mus musculus
ttccatgcttatcaagaaacacgtt

SEQ ID NO: 933796 - DNA, 25 bp, Mus musculus
ttccatgcttatgaagaaacacgtt

SEQ ID NO: 933797 - DNA, 25 bp, Mus musculus
ttccatgcttctagcttatactcag

SEQ ID NO: 933798 - DNA, 25 bp, Mus musculus
ttccatgcttcttgcttatactcag

SEQ ID NO: 933799 - DNA, 25 bp, Mus musculus
ttccatggaaggagcttggccccac

SEQ ID NO: 933800 - DNA, 25 bp, Mus musculus
ttccatggaaggtgcttggccccac

SEQ ID NO: 933801 - DNA, 25 bp, Mus musculus
ttccatggaccaaagaatgatagtt

SEQ ID NO: 933802 - DNA, 25 bp, Mus musculus
ttccatggaccatagaatgatagtt

SEQ ID NO: 933803 - DNA, 25 bp, Mus musculus
ttccatggaggaattatttcagatc

SEQ ID NO: 933804 - DNA, 25 bp, Mus musculus
ttccatggaggatttatttcagatc

SEQ ID NO: 933805 - DNA, 25 bp, Mus musculus
ttccatggattcactcggctttagt

SEQ ID NO: 933806 - DNA, 25 bp, Mus musculus
ttccatggattctctcggctttagt

SEQ ID NO: 933807 - DNA, 25 bp, Mus musculus
ttccatggcaaacagtggtcccagt

SEQ ID NO: 933808 - DNA, 25 bp, Mus musculus
ttccatggcaaagagtggtcccagt

SEQ ID NO: 933809 - DNA, 25 bp, Mus musculus
ttccatggccggaggcttttccttc

SEQ ID NO: 933810 - DNA, 25 bp, Mus musculus
ttccatggccggtggcttttccttc

SEQ ID NO: 933811 - DNA, 25 bp, Mus musculus
ttccatggcttgcttacttcggtgt

SEQ ID NO: 933812 - DNA, 25 bp, Mus musculus
ttccatggcttggttacttcggtgt

SEQ ID NO: 933813 - DNA, 25 bp, Mus musculus
ttccatgggaagagcttggaactca

SEQ ID NO: 933814 - DNA, 25 bp, Mus musculus
ttccatgggaagtgcttggaactca

SEQ ID NO: 933815 - DNA, 25 bp, Mus musculus
ttccatgggatgagattgcttcttc

SEQ ID NO: 933816 - DNA, 25 bp, Mus musculus
ttccatgggatgtgattgcttcttc

SEQ ID NO: 933817 - DNA, 25 bp, Mus musculus
ttccatgggcttactaaggcactct

SEQ ID NO: 933818 - DNA, 25 bp, Mus musculus
ttccatgggcttccccgccaggaaa

SEQ ID NO: 933819 - DNA, 25 bp, Mus musculus
ttccatgggcttccttctctcagaa

SEQ ID NO: 933820 - DNA, 25 bp, Mus musculus
ttccatgggcttgcccgccaggaaa

SEQ ID NO: 933821 - DNA, 25 bp, Mus musculus
ttccatgggcttgcttctctcagaa

SEQ ID NO: 933822 - DNA, 25 bp, Mus musculus
ttccatgggctttctaaggcactct

SEQ ID NO: 933823 - DNA, 25 bp, Mus musculus
ttccatgggtgtacctctgagataa

SEQ ID NO: 933824 - DNA, 25 bp, Mus musculus
ttccatgggtgttcctctgagataa

SEQ ID NO: 933825 - DNA, 25 bp, Mus musculus
ttccatggtggcagtttgtctggct

SEQ ID NO: 933826 - DNA, 25 bp, Mus musculus
ttccatggtggctgtttgtctggct

SEQ ID NO: 933827 - DNA, 25 bp, Mus musculus
ttccatggttttagcgttgcctttt

SEQ ID NO: 933828 - DNA, 25 bp, Mus musculus
ttccatggtttttgcgttgcctttt

SEQ ID NO: 933829 - DNA, 25 bp, Mus musculus
ttccatgtagccctagacatagtcc

SEQ ID NO: 933830 - DNA, 25 bp, Mus musculus
ttccatgtagccgtagacatagtcc

SEQ ID NO: 933831 - DNA, 25 bp, Mus musculus
ttccatgtatatcatgataccctat

SEQ ID NO: 933832 - DNA, 25 bp, Mus musculus
ttccatgtatatgatgataccctat

SEQ ID NO: 933833 - DNA, 25 bp, Mus musculus
ttccatgtcaataggttccggagag

SEQ ID NO: 933834 - DNA, 25 bp, Mus musculus
ttccatgtcaattggttccggagag

SEQ ID NO: 933835 - DNA, 25 bp, Mus musculus
ttccatgtcacactccatcattgag

SEQ ID NO: 933836 - DNA, 25 bp, Mus musculus
ttccatgtcacagtccatcattgag

SEQ ID NO: 933837 - DNA, 25 bp, Mus musculus
ttccatgtccctataaaagctttca

SEQ ID NO: 933838 - DNA, 25 bp, Mus musculus
ttccatgtccctttaaaagctttca

SEQ ID NO: 933839 - DNA, 25 bp, Mus musculus
ttccatgtcctccaagtgttcacaa

SEQ ID NO: 933840 - DNA, 25 bp, Mus musculus
ttccatgtcctcgaagtgttcacaa

SEQ ID NO: 933841 - DNA, 25 bp, Mus musculus
ttccatgtcgatacaaactgacccc

SEQ ID NO: 933842 - DNA, 25 bp, Mus musculus
ttccatgtcgattcaaactgacccc

SEQ ID NO: 933843 - DNA, 25 bp, Mus musculus
ttccatgtctccatgtcttagacta

SEQ ID NO: 933844 - DNA, 25 bp, Mus musculus
ttccatgtctccctgtcatgagaaa

SEQ ID NO: 933845 - DNA, 25 bp, Mus musculus
ttccatgtctccgtgtcatgagaaa

SEQ ID NO: 933846 - DNA, 25 bp, Mus musculus
ttccatgtctccttgtcttagacta

SEQ ID NO: 933847 - DNA, 25 bp, Mus musculus
ttccatgtctggaaaatgatcacag

SEQ ID NO: 933848 - DNA, 25 bp, Mus musculus
ttccatgtctggtaaatgatcacag

SEQ ID NO: 933849 - DNA, 25 bp, Mus musculus
ttccatgtgcctcatggccctatgg

SEQ ID NO: 933850 - DNA, 25 bp, Mus musculus
ttccatgtgcctgatggccctatgg

SEQ ID NO: 933851 - DNA, 25 bp, Mus musculus
ttccatgtgctgatgcagggtcctg

SEQ ID NO: 933852 - DNA, 25 bp, Mus musculus
ttccatgtgctgttgcagggtcctg

SEQ ID NO: 933853 - DNA, 25 bp, Mus musculus
ttccatgtgcttcgtttttcctctg

SEQ ID NO: 933854 - DNA, 25 bp, Mus musculus
ttccatgtgcttggtttttcctctg

SEQ ID NO: 933855 - DNA, 25 bp, Mus musculus
ttccatgtgtttcctaccctaaaga

SEQ ID NO: 933856 - DNA, 25 bp, Mus musculus
ttccatgtgtttgctaccctaaaga

SEQ ID NO: 933857 - DNA, 25 bp, Mus musculus
ttccatgttaggcttctttgtcttt

SEQ ID NO: 933858 - DNA, 25 bp, Mus musculus
ttccatgttagggttctttgtcttt

SEQ ID NO: 933859 - DNA, 25 bp, Mus musculus
ttccatgttctcaatgccaatcact

SEQ ID NO: 933860 - DNA, 25 bp, Mus musculus
ttccatgttctctatgccaatcact

SEQ ID NO: 933861 - DNA, 25 bp, Mus musculus
ttccatgttgttcaactctgactgt

SEQ ID NO: 933862 - DNA, 25 bp, Mus musculus
ttccatgttgttgaactctgactgt

SEQ ID NO: 933863 - DNA, 25 bp, Mus musculus
ttccatgtttttaagcctcaacctc

SEQ ID NO: 933864 - DNA, 25 bp, Mus musculus
ttccatgttttttagcctcaacctc

SEQ ID NO: 933865 - DNA, 25 bp, Mus musculus
ttccattaagttatcaacccagagt

SEQ ID NO: 933866 - DNA, 25 bp, Mus musculus
ttccattaagttttcaacccagagt

SEQ ID NO: 933867 - DNA, 25 bp, Mus musculus
ttccattaatttcggttggcaggac

SEQ ID NO: 933868 - DNA, 25 bp, Mus musculus
ttccattaatttctctccgcattca

SEQ ID NO: 933869 - DNA, 25 bp, Mus musculus
ttccattaatttgggttggcaggac

SEQ ID NO: 933870 - DNA, 25 bp, Mus musculus
ttccattaatttgtctccgcattca

SEQ ID NO: 933871 - DNA, 25 bp, Mus musculus
ttccattcagaaagcccaggctgct

SEQ ID NO: 933872 - DNA, 25 bp, Mus musculus
ttccattcagaatgcccaggctgct

SEQ ID NO: 933873 - DNA, 25 bp, Mus musculus
ttccattcccaaattcaactgcagc

SEQ ID NO: 933874 - DNA, 25 bp, Mus musculus
ttccattcccaatttcaactgcagc

SEQ ID NO: 933875 - DNA, 25 bp, Mus musculus
ttccattccctcaggctcaagaaag

SEQ ID NO: 933876 - DNA, 25 bp, Mus musculus
ttccattccctcagtgacaagtatt

SEQ ID NO: 933877 - DNA, 25 bp, Mus musculus
ttccattccctctggctcaagaaag

SEQ ID NO: 933878 - DNA, 25 bp, Mus musculus
ttccattccctctgtgacaagtatt

SEQ ID NO: 933879 - DNA, 25 bp, Mus musculus
ttccattcctctacagtttctgttt

SEQ ID NO: 933880 - DNA, 25 bp, Mus musculus
ttccattcctcttcagtttctgttt

SEQ ID NO: 933881 - DNA, 25 bp, Mus musculus
ttccattcctgcactgttgctaatg

SEQ ID NO: 933882 - DNA, 25 bp, Mus musculus
ttccattcctgctctgttgctaatg

SEQ ID NO: 933883 - DNA, 25 bp, Mus musculus
ttccattccttcagtattcttgcta

SEQ ID NO: 933884 - DNA, 25 bp, Mus musculus
ttccattccttctgtattcttgcta

SEQ ID NO: 933885 - DNA, 25 bp, Mus musculus
ttccattcttccactatgtgctgac

SEQ ID NO: 933886 - DNA, 25 bp, Mus musculus
ttccattcttcctctatgtgctgac

SEQ ID NO: 933887 - DNA, 25 bp, Mus musculus
ttccattctttcagtagacactact

SEQ ID NO: 933888 - DNA, 25 bp, Mus musculus
ttccattctttctgtagacactact

SEQ ID NO: 933889 - DNA, 25 bp, Mus musculus
ttccattgacaaacacagccagctt

SEQ ID NO: 933890 - DNA, 25 bp, Mus musculus
ttccattgacaatcacagccagctt

SEQ ID NO: 933891 - DNA, 25 bp, Mus musculus
ttccattgctttcggcccatggtaa

SEQ ID NO: 933892 - DNA, 25 bp, Mus musculus
ttccattgctttgggcccatggtaa

SEQ ID NO: 933893 - DNA, 25 bp, Mus musculus
ttccattggcaacgtcacaggcagt

SEQ ID NO: 933894 - DNA, 25 bp, Mus musculus
ttccattggcaaggtcacaggcagt

SEQ ID NO: 933895 - DNA, 25 bp, Mus musculus
ttccattgtggcactttggagttgc

SEQ ID NO: 933896 - DNA, 25 bp, Mus musculus
ttccattgtggctctttggagttgc

SEQ ID NO: 933897 - DNA, 25 bp, Mus musculus
ttccattgtgtgacccctcagtttt

SEQ ID NO: 933898 - DNA, 25 bp, Mus musculus
ttccattgtgtgtcccctcagtttt

SEQ ID NO: 933899 - DNA, 25 bp, Mus musculus
ttccattgttgtcgtgaactgtcaa

SEQ ID NO: 933900 - DNA, 25 bp, Mus musculus
ttccattgttgtggtgaactgtcaa

SEQ ID NO: 933901 - DNA, 25 bp, Mus musculus
ttccatttacctatttaaaatactg

SEQ ID NO: 933902 - DNA, 25 bp, Mus musculus
ttccatttacctttttaaaatactg

SEQ ID NO: 933903 - DNA, 25 bp, Mus musculus
ttccatttactcattaacccatcac

SEQ ID NO: 933904 - DNA, 25 bp, Mus musculus
ttccatttactctttaacccatcac

SEQ ID NO: 933905 - DNA, 25 bp, Mus musculus
ttccatttcaaaacagcgggtcact

SEQ ID NO: 933906 - DNA, 25 bp, Mus musculus
ttccatttcaaatcagcgggtcact

SEQ ID NO: 933907 - DNA, 25 bp, Mus musculus
ttccatttcaacagtttgtcagctt

SEQ ID NO: 933908 - DNA, 25 bp, Mus musculus
ttccatttcaactgtttgtcagctt

SEQ ID NO: 933909 - DNA, 25 bp, Mus musculus
ttccatttccacaatctcagctaaa

SEQ ID NO: 933910 - DNA, 25 bp, Mus musculus
ttccatttccactatctcagctaaa

SEQ ID NO: 933911 - DNA, 25 bp, Mus musculus
ttccatttccctagtctgtagtctg

SEQ ID NO: 933912 - DNA, 25 bp, Mus musculus
ttccatttcccttgtctgtagtctg

SEQ ID NO: 933913 - DNA, 25 bp, Mus musculus
ttccatttcctaattcccaggtatc

SEQ ID NO: 933914 - DNA, 25 bp, Mus musculus
ttccatttcctatttcccaggtatc

SEQ ID NO: 933915 - DNA, 25 bp, Mus musculus
ttccatttcctgagagactgaggca

SEQ ID NO: 933916 - DNA, 25 bp, Mus musculus
ttccatttcctgtgagactgaggca

SEQ ID NO: 933917 - DNA, 25 bp, Mus musculus
ttccatttctaaccatcatgcctca

SEQ ID NO: 933918 - DNA, 25 bp, Mus musculus
ttccatttctaagcatcatgcctca

SEQ ID NO: 933919 - DNA, 25 bp, Mus musculus
ttccatttctacatcctagcaatga

SEQ ID NO: 933920 - DNA, 25 bp, Mus musculus
ttccatttctacttcctagcaatga

SEQ ID NO: 933921 - DNA, 25 bp, Mus musculus
ttccatttctgaagtcatgttgaca

SEQ ID NO: 933922 - DNA, 25 bp, Mus musculus
ttccatttctgatgtcatgttgaca

SEQ ID NO: 933923 - DNA, 25 bp, Mus musculus
ttccatttggatctgagcaggcgca

SEQ ID NO: 933924 - DNA, 25 bp, Mus musculus
ttccatttggatgtgagcaggcgca

SEQ ID NO: 933925 - DNA, 25 bp, Mus musculus
ttccatttgggcaagagccggcata

SEQ ID NO: 933926 - DNA, 25 bp, Mus musculus
ttccatttgggctagagccggcata

SEQ ID NO: 933927 - DNA, 25 bp, Mus musculus
ttccatttgtacatccaagcgtatt

SEQ ID NO: 933928 - DNA, 25 bp, Mus musculus
ttccatttgtacttccaagcgtatt

SEQ ID NO: 933929 - DNA, 25 bp, Mus musculus
ttccattttaacctccatacagtct

SEQ ID NO: 933930 - DNA, 25 bp, Mus musculus
ttccattttaacgtccatacagtct

SEQ ID NO: 933931 - DNA, 25 bp, Mus musculus
ttccattttcataccttttctagag

SEQ ID NO: 933932 - DNA, 25 bp, Mus musculus
ttccattttcattccttttctagag

SEQ ID NO: 933933 - DNA, 25 bp, Mus musculus
ttccattttgtgatcccaacactaa

SEQ ID NO: 933934 - DNA, 25 bp, Mus musculus
ttccattttgtgttcccaacactaa

SEQ ID NO: 933935 - DNA, 25 bp, Mus musculus
ttcccaaaatgcatgctcagaagtc

SEQ ID NO: 933936 - DNA, 25 bp, Mus musculus
ttcccaaaatgcttgctcagaagtc

SEQ ID NO: 933937 - DNA, 25 bp, Mus musculus
ttcccaaactttcttcagactgtat

SEQ ID NO: 933938 - DNA, 25 bp, Mus musculus
ttcccaaactttgttcagactgtat

SEQ ID NO: 933939 - DNA, 25 bp, Mus musculus
ttcccaaagactactgttcccatct

SEQ ID NO: 933940 - DNA, 25 bp, Mus musculus
ttcccaaagacttctgttcccatct

SEQ ID NO: 933941 - DNA, 25 bp, Mus musculus
ttcccaaagcgcctaagattgcttt

SEQ ID NO: 933942 - DNA, 25 bp, Mus musculus
ttcccaaagcgcgtaagattgcttt

SEQ ID NO: 933943 - DNA, 25 bp, Mus musculus
ttcccaaagcttacaggatcctgct

SEQ ID NO: 933944 - DNA, 25 bp, Mus musculus
ttcccaaagctttcaggatcctgct

SEQ ID NO: 933945 - DNA, 25 bp, Mus musculus
ttcccaaagggcaattgcggcagcc

SEQ ID NO: 933946 - DNA, 25 bp, Mus musculus
ttcccaaagggctattgcggcagcc

SEQ ID NO: 933947 - DNA, 25 bp, Mus musculus
ttcccaaaggttaaaaggagatgct

SEQ ID NO: 933948 - DNA, 25 bp, Mus musculus
ttcccaaaggtttaaaggagatgct

SEQ ID NO: 933949 - DNA, 25 bp, Mus musculus
ttcccaaagtatcacctactaggat

SEQ ID NO: 933950 - DNA, 25 bp, Mus musculus
ttcccaaagtatgacctactaggat

SEQ ID NO: 933951 - DNA, 25 bp, Mus musculus
ttcccaaatagcatatacctaagag

SEQ ID NO: 933952 - DNA, 25 bp, Mus musculus
ttcccaaatagcttatacctaagag

SEQ ID NO: 933953 - DNA, 25 bp, Mus musculus
ttcccaaatatcaggtaacttctag

SEQ ID NO: 933954 - DNA, 25 bp, Mus musculus
ttcccaaatatctggtaacttctag

SEQ ID NO: 933955 - DNA, 25 bp, Mus musculus
ttcccaaatcagaactatgctgcta

SEQ ID NO: 933956 - DNA, 25 bp, Mus musculus
ttcccaaatcagtactatgctgcta

SEQ ID NO: 933957 - DNA, 25 bp, Mus musculus
ttcccaaatcatcctagcctatgct

SEQ ID NO: 933958 - DNA, 25 bp, Mus musculus
ttcccaaatcatgctagcctatgct

SEQ ID NO: 933959 - DNA, 25 bp, Mus musculus
ttcccaaatcgtagtatcatgcttt

SEQ ID NO: 933960 - DNA, 25 bp, Mus musculus
ttcccaaatcgttgtatcatgcttt

SEQ ID NO: 933961 - DNA, 25 bp, Mus musculus
ttcccaaatgctatgtgatcctact

SEQ ID NO: 933962 - DNA, 25 bp, Mus musculus
ttcccaaatgctttgtgatcctact

SEQ ID NO: 933963 - DNA, 25 bp, Mus musculus
ttcccaaatggacataattgacaaa

SEQ ID NO: 933964 - DNA, 25 bp, Mus musculus
ttcccaaatggagataattgacaaa

SEQ ID NO: 933965 - DNA, 25 bp, Mus musculus
ttcccaacaatacctgtgtggcctg

SEQ ID NO: 933966 - DNA, 25 bp, Mus musculus
ttcccaacaatagctgtgtggcctg

SEQ ID NO: 933967 - DNA, 25 bp, Mus musculus
ttcccaacacatagtaggccttcaa

SEQ ID NO: 933968 - DNA, 25 bp, Mus musculus
ttcccaacacattgtaggccttcaa

SEQ ID NO: 933969 - DNA, 25 bp, Mus musculus
ttcccaacaggtcggaggatcgccc

SEQ ID NO: 933970 - DNA, 25 bp, Mus musculus
ttcccaacaggtgggaggatcgccc

SEQ ID NO: 933971 - DNA, 25 bp, Mus musculus
ttcccaacatcccacagcaggtaaa

SEQ ID NO: 933972 - DNA, 25 bp, Mus musculus
ttcccaacatccgacagcaggtaaa

SEQ ID NO: 933973 - DNA, 25 bp, Mus musculus
ttcccaaccactaagaaatgcaaaa

SEQ ID NO: 933974 - DNA, 25 bp, Mus musculus
ttcccaaccacttagaaatgcaaaa

SEQ ID NO: 933975 - DNA, 25 bp, Mus musculus
ttcccaacctctagtaattaccagc

SEQ ID NO: 933976 - DNA, 25 bp, Mus musculus
ttcccaacctcttgtaattaccagc

SEQ ID NO: 933977 - DNA, 25 bp, Mus musculus
ttcccaactaaaatctgagatgcag

SEQ ID NO: 933978 - DNA, 25 bp, Mus musculus
ttcccaactaaattctgagatgcag

SEQ ID NO: 933979 - DNA, 25 bp, Mus musculus
ttcccaactgccagtggtcaccaga

SEQ ID NO: 933980 - DNA, 25 bp, Mus musculus
ttcccaactgcctgtggtcaccaga

SEQ ID NO: 933981 - DNA, 25 bp, Mus musculus
ttcccaactgtaaagcaagcgtggt

SEQ ID NO: 933982 - DNA, 25 bp, Mus musculus
ttcccaactgtatagcaagcgtggt

SEQ ID NO: 933983 - DNA, 25 bp, Mus musculus
ttcccaagacagagcccagtacagt

SEQ ID NO: 933984 - DNA, 25 bp, Mus musculus
ttcccaagacagatagcatacacat

SEQ ID NO: 933985 - DNA, 25 bp, Mus musculus
ttcccaagacagctactgatcccag

SEQ ID NO: 933986 - DNA, 25 bp, Mus musculus
ttcccaagacaggtactgatcccag

SEQ ID NO: 933987 - DNA, 25 bp, Mus musculus
ttcccaagacagtgcccagtacagt

SEQ ID NO: 933988 - DNA, 25 bp, Mus musculus
ttcccaagacagttagcatacacat

SEQ ID NO: 933989 - DNA, 25 bp, Mus musculus
ttcccaagacgaattgttaatatct

SEQ ID NO: 933990 - DNA, 25 bp, Mus musculus
ttcccaagacgatttgttaatatct

SEQ ID NO: 933991 - DNA, 25 bp, Mus musculus
ttcccaagagccatagtgattaagg

SEQ ID NO: 933992 - DNA, 25 bp, Mus musculus
ttcccaagagccttagtgattaagg

SEQ ID NO: 933993 - DNA, 25 bp, Mus musculus
ttcccaagaggcactcaggctattg

SEQ ID NO: 933994 - DNA, 25 bp, Mus musculus
ttcccaagaggccaaacttcatagg

SEQ ID NO: 933995 - DNA, 25 bp, Mus musculus
ttcccaagaggcgaaacttcatagg

SEQ ID NO: 933996 - DNA, 25 bp, Mus musculus
ttcccaagaggctctcaggctattg

SEQ ID NO: 933997 - DNA, 25 bp, Mus musculus
ttcccaagatggcaggtacctctgt

SEQ ID NO: 933998 - DNA, 25 bp, Mus musculus
ttcccaagatgggaggtacctctgt

SEQ ID NO: 933999 - DNA, 25 bp, Mus musculus
ttcccaagatgtcaaagtctctaca

SEQ ID NO: 934000 - DNA, 25 bp, Mus musculus
ttcccaagatgtgaaagtctctaca

SEQ ID NO: 934001 - DNA, 25 bp, Mus musculus
ttcccaagattcctttgtcaagctg

SEQ ID NO: 934002 - DNA, 25 bp, Mus musculus
ttcccaagattcgtttgtcaagctg

SEQ ID NO: 934003 - DNA, 25 bp, Mus musculus
ttcccaagccatccagactttgagc

SEQ ID NO: 934004 - DNA, 25 bp, Mus musculus
ttcccaagccatgcagactttgagc

SEQ ID NO: 934005 - DNA, 25 bp, Mus musculus
ttcccaagctatatcagcaaaggca

SEQ ID NO: 934006 - DNA, 25 bp, Mus musculus
ttcccaagctatttcagcaaaggca

SEQ ID NO: 934007 - DNA, 25 bp, Mus musculus
ttcccaagctctcgaggacatgtga

SEQ ID NO: 934008 - DNA, 25 bp, Mus musculus
ttcccaagctctggaggacatgtga

SEQ ID NO: 934009 - DNA, 25 bp, Mus musculus
ttcccaagggataactactgcccgt

SEQ ID NO: 934010 - DNA, 25 bp, Mus musculus
ttcccaagggattactactgcccgt

SEQ ID NO: 934011 - DNA, 25 bp, Mus musculus
ttcccaaggtaacagaaccctctca

SEQ ID NO: 934012 - DNA, 25 bp, Mus musculus
ttcccaaggtaagagaaccctctca

SEQ ID NO: 934013 - DNA, 25 bp, Mus musculus
ttcccaagtgttacacaggccacca

SEQ ID NO: 934014 - DNA, 25 bp, Mus musculus
ttcccaagtgtttcacaggccacca

SEQ ID NO: 934015 - DNA, 25 bp, Mus musculus
ttcccaatggcacctattgctttga

SEQ ID NO: 934016 - DNA, 25 bp, Mus musculus
ttcccaatggcagctattgctttga

SEQ ID NO: 934017 - DNA, 25 bp, Mus musculus
ttcccaatgtatccatgctgtctgt

SEQ ID NO: 934018 - DNA, 25 bp, Mus musculus
ttcccaatgtatgcatgctgtctgt

SEQ ID NO: 934019 - DNA, 25 bp, Mus musculus
ttcccaattaatcaacagtccagta

SEQ ID NO: 934020 - DNA, 25 bp, Mus musculus
ttcccaattaatgaacagtccagta

SEQ ID NO: 934021 - DNA, 25 bp, Mus musculus
ttcccaattatcattcttcatccat

SEQ ID NO: 934022 - DNA, 25 bp, Mus musculus
ttcccaattatctttcttcatccat

SEQ ID NO: 934023 - DNA, 25 bp, Mus musculus
ttcccaattcaacctacaatttcgt

SEQ ID NO: 934024 - DNA, 25 bp, Mus musculus
ttcccaattcaagctacaatttcgt

SEQ ID NO: 934025 - DNA, 25 bp, Mus musculus
ttcccaattgctagggttgaaggtg

SEQ ID NO: 934026 - DNA, 25 bp, Mus musculus
ttcccaattgcttgggttgaaggtg

SEQ ID NO: 934027 - DNA, 25 bp, Mus musculus
ttcccacaaaaaagaccaggccatg

SEQ ID NO: 934028 - DNA, 25 bp, Mus musculus
ttcccacaaaaatgaccaggccatg

SEQ ID NO: 934029 - DNA, 25 bp, Mus musculus
ttcccacaacgacgcctggattaat

SEQ ID NO: 934030 - DNA, 25 bp, Mus musculus
ttcccacaacgaggcctggattaat

SEQ ID NO: 934031 - DNA, 25 bp, Mus musculus
ttcccacaagagatgagtgaggcct

SEQ ID NO: 934032 - DNA, 25 bp, Mus musculus
ttcccacaagagttgagtgaggcct

SEQ ID NO: 934033 - DNA, 25 bp, Mus musculus
ttcccacaagataggtaggttggag

SEQ ID NO: 934034 - DNA, 25 bp, Mus musculus
ttcccacaagattggtaggttggag

SEQ ID NO: 934035 - DNA, 25 bp, Mus musculus
ttcccacaagttcctggagggcccg

SEQ ID NO: 934036 - DNA, 25 bp, Mus musculus
ttcccacaagttgctggagggcccg

SEQ ID NO: 934037 - DNA, 25 bp, Mus musculus
ttcccacaatccatgtgtccagaat

SEQ ID NO: 934038 - DNA, 25 bp, Mus musculus
ttcccacaatccttgtgtccagaat

SEQ ID NO: 934039 - DNA, 25 bp, Mus musculus
ttcccacacactaaattttcttctg

SEQ ID NO: 934040 - DNA, 25 bp, Mus musculus
ttcccacacacttaattttcttctg

SEQ ID NO: 934041 - DNA, 25 bp, Mus musculus
ttcccacacataacttccctaaata

SEQ ID NO: 934042 - DNA, 25 bp, Mus musculus
ttcccacacatatcttccctaaata

SEQ ID NO: 934043 - DNA, 25 bp, Mus musculus
ttcccacacggaacgattcagcatt

SEQ ID NO: 934044 - DNA, 25 bp, Mus musculus
ttcccacacggatcgattcagcatt

SEQ ID NO: 934045 - DNA, 25 bp, Mus musculus
ttcccacacgttagaccacatcaat

SEQ ID NO: 934046 - DNA, 25 bp, Mus musculus
ttcccacacgtttgaccacatcaat

SEQ ID NO: 934047 - DNA, 25 bp, Mus musculus
ttcccacactgccatcagattgttt

SEQ ID NO: 934048 - DNA, 25 bp, Mus musculus
ttcccacactgcgatcagattgttt

SEQ ID NO: 934049 - DNA, 25 bp, Mus musculus
ttcccacacttcactggacatgtag

SEQ ID NO: 934050 - DNA, 25 bp, Mus musculus
ttcccacacttctctggacatgtag

SEQ ID NO: 934051 - DNA, 25 bp, Mus musculus
ttcccacagaaaacaggctagctta

SEQ ID NO: 934052 - DNA, 25 bp, Mus musculus
ttcccacagaaatcaggctagctta

SEQ ID NO: 934053 - DNA, 25 bp, Mus musculus
ttcccacaggctcacagtgtcagga

SEQ ID NO: 934054 - DNA, 25 bp, Mus musculus
ttcccacaggctcccaaatggaaag

SEQ ID NO: 934055 - DNA, 25 bp, Mus musculus
ttcccacaggctgacagtgtcagga

SEQ ID NO: 934056 - DNA, 25 bp, Mus musculus
ttcccacaggctgccaaatggaaag

SEQ ID NO: 934057 - DNA, 25 bp, Mus musculus
ttcccacagttgagtgtttaaccag

SEQ ID NO: 934058 - DNA, 25 bp, Mus musculus
ttcccacagttgtgtgtttaaccag

SEQ ID NO: 934059 - DNA, 25 bp, Mus musculus
ttcccacatgtaaatctagcatatt

SEQ ID NO: 934060 - DNA, 25 bp, Mus musculus
ttcccacatgtaccctagacaggtt

SEQ ID NO: 934061 - DNA, 25 bp, Mus musculus
ttcccacatgtagcctagacaggtt

SEQ ID NO: 934062 - DNA, 25 bp, Mus musculus
ttcccacatgtatatctagcatatt

SEQ ID NO: 934063 - DNA, 25 bp, Mus musculus
ttcccacattcaatgcagccatagg

SEQ ID NO: 934064 - DNA, 25 bp, Mus musculus
ttcccacattcattgcagccatagg

SEQ ID NO: 934065 - DNA, 25 bp, Mus musculus
ttcccaccacagactgagttcctgt

SEQ ID NO: 934066 - DNA, 25 bp, Mus musculus
ttcccaccacagtctgagttcctgt

SEQ ID NO: 934067 - DNA, 25 bp, Mus musculus
ttcccaccagacattgatccgcaag

SEQ ID NO: 934068 - DNA, 25 bp, Mus musculus
ttcccaccagactttgatccgcaag

SEQ ID NO: 934069 - DNA, 25 bp, Mus musculus
ttcccaccagagattgtaggcctag

SEQ ID NO: 934070 - DNA, 25 bp, Mus musculus
ttcccaccagagtttgtaggcctag

SEQ ID NO: 934071 - DNA, 25 bp, Mus musculus
ttcccaccaggaagaccgtactatg

SEQ ID NO: 934072 - DNA, 25 bp, Mus musculus
ttcccaccaggatgaccgtactatg

SEQ ID NO: 934073 - DNA, 25 bp, Mus musculus
ttcccaccagggaccataagatgac

SEQ ID NO: 934074 - DNA, 25 bp, Mus musculus
ttcccaccagggtccataagatgac

SEQ ID NO: 934075 - DNA, 25 bp, Mus musculus
ttcccacccaccaggattggatttt

SEQ ID NO: 934076 - DNA, 25 bp, Mus musculus
ttcccacccacctggattggatttt

SEQ ID NO: 934077 - DNA, 25 bp, Mus musculus
ttcccacccactcataagcttagag

SEQ ID NO: 934078 - DNA, 25 bp, Mus musculus
ttcccacccactgataagcttagag

SEQ ID NO: 934079 - DNA, 25 bp, Mus musculus
ttcccacccaggcactgaatttaaa

SEQ ID NO: 934080 - DNA, 25 bp, Mus musculus
ttcccacccagggactgaatttaaa

SEQ ID NO: 934081 - DNA, 25 bp, Mus musculus
ttcccacccagtcatgactacgatg

SEQ ID NO: 934082 - DNA, 25 bp, Mus musculus
ttcccacccagtgatgactacgatg

SEQ ID NO: 934083 - DNA, 25 bp, Mus musculus
ttcccacccggacacatagatggct

SEQ ID NO: 934084 - DNA, 25 bp, Mus musculus
ttcccacccggagacatagatggct

SEQ ID NO: 934085 - DNA, 25 bp, Mus musculus
ttcccaccgactacctggaggagat

SEQ ID NO: 934086 - DNA, 25 bp, Mus musculus
ttcccaccgacttcctggaggagat

SEQ ID NO: 934087 - DNA, 25 bp, Mus musculus
ttcccaccgagacgttagctagtga

SEQ ID NO: 934088 - DNA, 25 bp, Mus musculus
ttcccaccgagaggttagctagtga

SEQ ID NO: 934089 - DNA, 25 bp, Mus musculus
ttcccaccgcttcatttagcaaagc

SEQ ID NO: 934090 - DNA, 25 bp, Mus musculus
ttcccaccgcttgatttagcaaagc

SEQ ID NO: 934091 - DNA, 25 bp, Mus musculus
ttcccaccggaacgtcgtcaatgta

SEQ ID NO: 934092 - DNA, 25 bp, Mus musculus
ttcccaccggaaggtcgtcaatgta

SEQ ID NO: 934093 - DNA, 25 bp, Mus musculus
ttcccaccgtggcagttgttaatga

SEQ ID NO: 934094 - DNA, 25 bp, Mus musculus
ttcccaccgtgggagttgttaatga

SEQ ID NO: 934095 - DNA, 25 bp, Mus musculus
ttcccacctcagatagccaaattaa

SEQ ID NO: 934096 - DNA, 25 bp, Mus musculus
ttcccacctcagttagccaaattaa

SEQ ID NO: 934097 - DNA, 25 bp, Mus musculus
ttcccacctcggagtccagagtgct

SEQ ID NO: 934098 - DNA, 25 bp, Mus musculus
ttcccacctcggtgtccagagtgct

SEQ ID NO: 934099 - DNA, 25 bp, Mus musculus
ttcccacctggaataagttttgagc

SEQ ID NO: 934100 - DNA, 25 bp, Mus musculus
ttcccacctggattaagttttgagc

SEQ ID NO: 934101 - DNA, 25 bp, Mus musculus
ttcccaccttatctgaggatccatc

SEQ ID NO: 934102 - DNA, 25 bp, Mus musculus
ttcccaccttatgtgaggatccatc

SEQ ID NO: 934103 - DNA, 25 bp, Mus musculus
ttcccaccttcaaggatcgtgatag

SEQ ID NO: 934104 - DNA, 25 bp, Mus musculus
ttcccaccttcatggatcgtgatag

SEQ ID NO: 934105 - DNA, 25 bp, Mus musculus
ttcccacgccttcgctctgagagaa

SEQ ID NO: 934106 - DNA, 25 bp, Mus musculus
ttcccacgccttggctctgagagaa

SEQ ID NO: 934107 - DNA, 25 bp, Mus musculus
ttcccacggtttccggaggcgactg

SEQ ID NO: 934108 - DNA, 25 bp, Mus musculus
ttcccacggtttgcggaggcgactg

SEQ ID NO: 934109 - DNA, 25 bp, Mus musculus
ttcccacgtgcccatgatagcatgg

SEQ ID NO: 934110 - DNA, 25 bp, Mus musculus
ttcccacgtgccgatgatagcatgg

SEQ ID NO: 934111 - DNA, 25 bp, Mus musculus
ttcccacgtgggagagagtccttga

SEQ ID NO: 934112 - DNA, 25 bp, Mus musculus
ttcccacgtgggtgagagtccttga

SEQ ID NO: 934113 - DNA, 25 bp, Mus musculus
ttcccactactgacaataccagtca

SEQ ID NO: 934114 - DNA, 25 bp, Mus musculus
ttcccactactgactgtgaatgata

SEQ ID NO: 934115 - DNA, 25 bp, Mus musculus
ttcccactactgtcaataccagtca

SEQ ID NO: 934116 - DNA, 25 bp, Mus musculus
ttcccactactgtctgtgaatgata

SEQ ID NO: 934117 - DNA, 25 bp, Mus musculus
ttcccactcaccactttggaatttg

SEQ ID NO: 934118 - DNA, 25 bp, Mus musculus
ttcccactcacctctttggaatttg

SEQ ID NO: 934119 - DNA, 25 bp, Mus musculus
ttcccactcactcggttcaattaga

SEQ ID NO: 934120 - DNA, 25 bp, Mus musculus
ttcccactcactgggttcaattaga

SEQ ID NO: 934121 - DNA, 25 bp, Mus musculus
ttcccactccagacatttttctgaa

SEQ ID NO: 934122 - DNA, 25 bp, Mus musculus
ttcccactccagtcatttttctgaa

SEQ ID NO: 934123 - DNA, 25 bp, Mus musculus
ttcccactcctaagttctttactgt

SEQ ID NO: 934124 - DNA, 25 bp, Mus musculus
ttcccactcctatgttctttactgt

SEQ ID NO: 934125 - DNA, 25 bp, Mus musculus
ttcccactctgaatctgggtagggt

SEQ ID NO: 934126 - DNA, 25 bp, Mus musculus
ttcccactctgattctgggtagggt

SEQ ID NO: 934127 - DNA, 25 bp, Mus musculus
ttcccactgagcaaggcctgtatga

SEQ ID NO: 934128 - DNA, 25 bp, Mus musculus
ttcccactgagctaggcctgtatga

SEQ ID NO: 934129 - DNA, 25 bp, Mus musculus
ttcccactggtgaccattttaaggt

SEQ ID NO: 934130 - DNA, 25 bp, Mus musculus
ttcccactggtgtccattttaaggt

SEQ ID NO: 934131 - DNA, 25 bp, Mus musculus
ttcccactggttctccgaataaagc

SEQ ID NO: 934132 - DNA, 25 bp, Mus musculus
ttcccactggttgtccgaataaagc

SEQ ID NO: 934133 - DNA, 25 bp, Mus musculus
ttcccactgtacctcatttatattc

SEQ ID NO: 934134 - DNA, 25 bp, Mus musculus
ttcccactgtacgtcatttatattc

SEQ ID NO: 934135 - DNA, 25 bp, Mus musculus
ttcccactgtccactgattacagaa

SEQ ID NO: 934136 - DNA, 25 bp, Mus musculus
ttcccactgtcctctgattacagaa

SEQ ID NO: 934137 - DNA, 25 bp, Mus musculus
ttcccactgtgcatttcgctttcct

SEQ ID NO: 934138 - DNA, 25 bp, Mus musculus
ttcccactgtgcttttcgctttcct

SEQ ID NO: 934139 - DNA, 25 bp, Mus musculus
ttcccacttaatctgtagttcatgt

SEQ ID NO: 934140 - DNA, 25 bp, Mus musculus
ttcccacttaatgtgtagttcatgt

SEQ ID NO: 934141 - DNA, 25 bp, Mus musculus
ttcccacttattcttgttccctttg

SEQ ID NO: 934142 - DNA, 25 bp, Mus musculus
ttcccacttattgttgttccctttg

SEQ ID NO: 934143 - DNA, 25 bp, Mus musculus
ttcccacttcagatagcctaatctg

SEQ ID NO: 934144 - DNA, 25 bp, Mus musculus
ttcccacttcagttagcctaatctg

SEQ ID NO: 934145 - DNA, 25 bp, Mus musculus
ttcccacttgcaagtaaaactgacc

SEQ ID NO: 934146 - DNA, 25 bp, Mus musculus
ttcccacttgcatgtaaaactgacc

SEQ ID NO: 934147 - DNA, 25 bp, Mus musculus
ttcccactttaaacctcttgagaaa

SEQ ID NO: 934148 - DNA, 25 bp, Mus musculus
ttcccactttaatcctcttgagaaa

SEQ ID NO: 934149 - DNA, 25 bp, Mus musculus
ttcccactttacagtccacgagaga

SEQ ID NO: 934150 - DNA, 25 bp, Mus musculus
ttcccactttactgtccacgagaga

SEQ ID NO: 934151 - DNA, 25 bp, Mus musculus
ttcccactttggaggacctgtagag

SEQ ID NO: 934152 - DNA, 25 bp, Mus musculus
ttcccactttggtggacctgtagag

SEQ ID NO: 934153 - DNA, 25 bp, Mus musculus
ttcccactttttcaatgggtgcggg

SEQ ID NO: 934154 - DNA, 25 bp, Mus musculus
ttcccactttttgaatgggtgcggg

SEQ ID NO: 934155 - DNA, 25 bp, Mus musculus
ttcccagaaacaccctctaaagcaa

SEQ ID NO: 934156 - DNA, 25 bp, Mus musculus
ttcccagaaacagcctctaaagcaa

SEQ ID NO: 934157 - DNA, 25 bp, Mus musculus
ttcccagaacaacctgcggcactag

SEQ ID NO: 934158 - DNA, 25 bp, Mus musculus
ttcccagaacaagctgcggcactag

SEQ ID NO: 934159 - DNA, 25 bp, Mus musculus
ttcccagaacccatctcagtaaaga

SEQ ID NO: 934160 - DNA, 25 bp, Mus musculus
ttcccagaacccttctcagtaaaga

SEQ ID NO: 934161 - DNA, 25 bp, Mus musculus
ttcccagaacctacatgatactcac

SEQ ID NO: 934162 - DNA, 25 bp, Mus musculus
ttcccagaacctatcgtgagaagct

SEQ ID NO: 934163 - DNA, 25 bp, Mus musculus
ttcccagaaccttcatgatactcac

SEQ ID NO: 934164 - DNA, 25 bp, Mus musculus
ttcccagaacctttcgtgagaagct

SEQ ID NO: 934165 - DNA, 25 bp, Mus musculus
ttcccagaagctaagggcctgtgtg

SEQ ID NO: 934166 - DNA, 25 bp, Mus musculus
ttcccagaagcttagggcctgtgtg

SEQ ID NO: 934167 - DNA, 25 bp, Mus musculus
ttcccagaagggacctctgctcatt

SEQ ID NO: 934168 - DNA, 25 bp, Mus musculus
ttcccagaagggtcctctgctcatt

SEQ ID NO: 934169 - DNA, 25 bp, Mus musculus
ttcccagaaggtaaccccgtgcagt

SEQ ID NO: 934170 - DNA, 25 bp, Mus musculus
ttcccagaaggttaccccgtgcagt

SEQ ID NO: 934171 - DNA, 25 bp, Mus musculus
ttcccagaagtcacacagttatcat

SEQ ID NO: 934172 - DNA, 25 bp, Mus musculus
ttcccagaagtctcacagttatcat

SEQ ID NO: 934173 - DNA, 25 bp, Mus musculus
ttcccagaatggaccatgtttgttg

SEQ ID NO: 934174 - DNA, 25 bp, Mus musculus
ttcccagaatggtccatgtttgttg

SEQ ID NO: 934175 - DNA, 25 bp, Mus musculus
ttcccagacaacctttgatccactt

SEQ ID NO: 934176 - DNA, 25 bp, Mus musculus
ttcccagacaacgtttgatccactt

SEQ ID NO: 934177 - DNA, 25 bp, Mus musculus
ttcccagacatcatcactacattgg

SEQ ID NO: 934178 - DNA, 25 bp, Mus musculus
ttcccagacatcttcactacattgg

SEQ ID NO: 934179 - DNA, 25 bp, Mus musculus
ttcccagacatgatctcatctattc

SEQ ID NO: 934180 - DNA, 25 bp, Mus musculus
ttcccagacatgttctcatctattc

SEQ ID NO: 934181 - DNA, 25 bp, Mus musculus
ttcccagacggcacaaaggttaagg

SEQ ID NO: 934182 - DNA, 25 bp, Mus musculus
ttcccagacggctcaaaggttaagg

SEQ ID NO: 934183 - DNA, 25 bp, Mus musculus
ttcccagacggtccagttttgagga

SEQ ID NO: 934184 - DNA, 25 bp, Mus musculus
ttcccagacggtgcagttttgagga

SEQ ID NO: 934185 - DNA, 25 bp, Mus musculus
ttcccagagaagagtacattgacca

SEQ ID NO: 934186 - DNA, 25 bp, Mus musculus
ttcccagagaagagttgcccagcta

SEQ ID NO: 934187 - DNA, 25 bp, Mus musculus
ttcccagagaagtgtacattgacca

SEQ ID NO: 934188 - DNA, 25 bp, Mus musculus
ttcccagagaagtgttgcccagcta

SEQ ID NO: 934189 - DNA, 25 bp, Mus musculus
ttcccagagacaaatttttaaattt

SEQ ID NO: 934190 - DNA, 25 bp, Mus musculus
ttcccagagacatatttttaaattt

SEQ ID NO: 934191 - DNA, 25 bp, Mus musculus
ttcccagagagtatgtggcgttgga

SEQ ID NO: 934192 - DNA, 25 bp, Mus musculus
ttcccagagagtttgtggcgttgga

SEQ ID NO: 934193 - DNA, 25 bp, Mus musculus
ttcccagagcacagtccaagttcag

SEQ ID NO: 934194 - DNA, 25 bp, Mus musculus
ttcccagagcactgtccaagttcag

SEQ ID NO: 934195 - DNA, 25 bp, Mus musculus
ttcccagagcagatgtcggcaagtt

SEQ ID NO: 934196 - DNA, 25 bp, Mus musculus
ttcccagagcagttgtcggcaagtt

SEQ ID NO: 934197 - DNA, 25 bp, Mus musculus
ttcccagagcccctgtagttccagt

SEQ ID NO: 934198 - DNA, 25 bp, Mus musculus
ttcccagagcccgtgtagttccagt

SEQ ID NO: 934199 - DNA, 25 bp, Mus musculus
ttcccagagctgaatgacactaatt

SEQ ID NO: 934200 - DNA, 25 bp, Mus musculus
ttcccagagctgagggctgccttga

SEQ ID NO: 934201 - DNA, 25 bp, Mus musculus
ttcccagagctgtatgacactaatt

SEQ ID NO: 934202 - DNA, 25 bp, Mus musculus
ttcccagagctgtgggctgccttga

SEQ ID NO: 934203 - DNA, 25 bp, Mus musculus
ttcccagagcttactgtacctgagg

SEQ ID NO: 934204 - DNA, 25 bp, Mus musculus
ttcccagagctttctgtacctgagg

SEQ ID NO: 934205 - DNA, 25 bp, Mus musculus
ttcccagagggaattttaacaatgt

SEQ ID NO: 934206 - DNA, 25 bp, Mus musculus
ttcccagagggacgtaccagcgacc

SEQ ID NO: 934207 - DNA, 25 bp, Mus musculus
ttcccagagggaggtaccagcgacc

SEQ ID NO: 934208 - DNA, 25 bp, Mus musculus
ttcccagagggatttttaacaatgt

SEQ ID NO: 934209 - DNA, 25 bp, Mus musculus
ttcccagatgccattctatggttct

SEQ ID NO: 934210 - DNA, 25 bp, Mus musculus
ttcccagatgcctttctatggttct

SEQ ID NO: 934211 - DNA, 25 bp, Mus musculus
ttcccagatggtcctaagaggctca

SEQ ID NO: 934212 - DNA, 25 bp, Mus musculus
ttcccagatggtgctaagaggctca

SEQ ID NO: 934213 - DNA, 25 bp, Mus musculus
ttcccagattcacagagacttttca

SEQ ID NO: 934214 - DNA, 25 bp, Mus musculus
ttcccagattcagagagacttttca

SEQ ID NO: 934215 - DNA, 25 bp, Mus musculus
ttcccagattcgacacaatgcctat

SEQ ID NO: 934216 - DNA, 25 bp, Mus musculus
ttcccagattcgtcacaatgcctat

SEQ ID NO: 934217 - DNA, 25 bp, Mus musculus
ttcccagatttcagcagggtctgag

SEQ ID NO: 934218 - DNA, 25 bp, Mus musculus
ttcccagatttctgcagggtctgag

SEQ ID NO: 934219 - DNA, 25 bp, Mus musculus
ttcccagcaaccactaaacctagag

SEQ ID NO: 934220 - DNA, 25 bp, Mus musculus
ttcccagcaacctctaaacctagag

SEQ ID NO: 934221 - DNA, 25 bp, Mus musculus
ttcccagcaagcatcgcaaaaacta

SEQ ID NO: 934222 - DNA, 25 bp, Mus musculus
ttcccagcaagcttcgcaaaaacta

SEQ ID NO: 934223 - DNA, 25 bp, Mus musculus
ttcccagcacatccatggacatttt

SEQ ID NO: 934224 - DNA, 25 bp, Mus musculus
ttcccagcacatgcatggacatttt

SEQ ID NO: 934225 - DNA, 25 bp, Mus musculus
ttcccagcaccacccatattagatg

SEQ ID NO: 934226 - DNA, 25 bp, Mus musculus
ttcccagcaccagccatattagatg

SEQ ID NO: 934227 - DNA, 25 bp, Mus musculus
ttcccagcacctatgttgggcaact

SEQ ID NO: 934228 - DNA, 25 bp, Mus musculus
ttcccagcacctttgttgggcaact

SEQ ID NO: 934229 - DNA, 25 bp, Mus musculus
ttcccagcacgtccttttgtgaata

SEQ ID NO: 934230 - DNA, 25 bp, Mus musculus
ttcccagcacgtgcttttgtgaata

SEQ ID NO: 934231 - DNA, 25 bp, Mus musculus
ttcccagcagagatcgacttgaacc

SEQ ID NO: 934232 - DNA, 25 bp, Mus musculus
ttcccagcagagttcgacttgaacc

SEQ ID NO: 934233 - DNA, 25 bp, Mus musculus
ttcccagcagcacaacagacagtct

SEQ ID NO: 934234 - DNA, 25 bp, Mus musculus
ttcccagcagcagaacagacagtct

SEQ ID NO: 934235 - DNA, 25 bp, Mus musculus
ttcccagcaggcctgtggtaattgt

SEQ ID NO: 934236 - DNA, 25 bp, Mus musculus
ttcccagcaggcgtgtggtaattgt

SEQ ID NO: 934237 - DNA, 25 bp, Mus musculus
ttcccagcaggtctgtgatccttga

SEQ ID NO: 934238 - DNA, 25 bp, Mus musculus
ttcccagcaggtgtgtgatccttga

SEQ ID NO: 934239 - DNA, 25 bp, Mus musculus
ttcccagcagtgagaactcacccgt

SEQ ID NO: 934240 - DNA, 25 bp, Mus musculus
ttcccagcagtgtgaactcacccgt

SEQ ID NO: 934241 - DNA, 25 bp, Mus musculus
ttcccagcatccagtggcaggcaca

SEQ ID NO: 934242 - DNA, 25 bp, Mus musculus
ttcccagcatcctgtggcaggcaca

SEQ ID NO: 934243 - DNA, 25 bp, Mus musculus
ttcccagcatgtacggaggcaccaa

SEQ ID NO: 934244 - DNA, 25 bp, Mus musculus
ttcccagcatgttcggaggcaccaa

SEQ ID NO: 934245 - DNA, 25 bp, Mus musculus
ttcccagcattaaaatctacaaatt

SEQ ID NO: 934246 - DNA, 25 bp, Mus musculus
ttcccagcattataatctacaaatt

SEQ ID NO: 934247 - DNA, 25 bp, Mus musculus
ttcccagccacgatcataactttaa

SEQ ID NO: 934248 - DNA, 25 bp, Mus musculus
ttcccagccacgttcataactttaa

SEQ ID NO: 934249 - DNA, 25 bp, Mus musculus
ttcccagccattcacttgctatttt

SEQ ID NO: 934250 - DNA, 25 bp, Mus musculus
ttcccagccattgacttgctatttt

SEQ ID NO: 934251 - DNA, 25 bp, Mus musculus
ttcccagccgatcagctgtaagact

SEQ ID NO: 934252 - DNA, 25 bp, Mus musculus
ttcccagccgatgagctgtaagact

SEQ ID NO: 934253 - DNA, 25 bp, Mus musculus
ttcccagcctaacgtgttacccagt

SEQ ID NO: 934254 - DNA, 25 bp, Mus musculus
ttcccagcctaactttcaggctcta

SEQ ID NO: 934255 - DNA, 25 bp, Mus musculus
ttcccagcctaaggtgttacccagt

SEQ ID NO: 934256 - DNA, 25 bp, Mus musculus
ttcccagcctaagtttcaggctcta

SEQ ID NO: 934257 - DNA, 25 bp, Mus musculus
ttcccagcctatacctaaagggtgg

SEQ ID NO: 934258 - DNA, 25 bp, Mus musculus
ttcccagcctattcctaaagggtgg

SEQ ID NO: 934259 - DNA, 25 bp, Mus musculus
ttcccagcctggatcaggtgtagat

SEQ ID NO: 934260 - DNA, 25 bp, Mus musculus
ttcccagcctggttcaggtgtagat

SEQ ID NO: 934261 - DNA, 25 bp, Mus musculus
ttcccagcgataaattcctgaggct

SEQ ID NO: 934262 - DNA, 25 bp, Mus musculus
ttcccagcgatatattcctgaggct

SEQ ID NO: 934263 - DNA, 25 bp, Mus musculus
ttcccagctgagaccagtagcaaaa

SEQ ID NO: 934264 - DNA, 25 bp, Mus musculus
ttcccagctgagtccagtagcaaaa

SEQ ID NO: 934265 - DNA, 25 bp, Mus musculus
ttcccagctgtcacgacgcagagag

SEQ ID NO: 934266 - DNA, 25 bp, Mus musculus
ttcccagctgtctcgacgcagagag

SEQ ID NO: 934267 - DNA, 25 bp, Mus musculus
ttcccagcttggcttcattggaaaa

SEQ ID NO: 934268 - DNA, 25 bp, Mus musculus
ttcccagcttgggttcattggaaaa

SEQ ID NO: 934269 - DNA, 25 bp, Mus musculus
ttcccaggaattatgtcacagcagt

SEQ ID NO: 934270 - DNA, 25 bp, Mus musculus
ttcccaggaattttgtcacagcagt

SEQ ID NO: 934271 - DNA, 25 bp, Mus musculus
ttcccaggacgacagatgagcagga

SEQ ID NO: 934272 - DNA, 25 bp, Mus musculus
ttcccaggacgagagatgagcagga

SEQ ID NO: 934273 - DNA, 25 bp, Mus musculus
ttcccaggatccctcactgtggaat

SEQ ID NO: 934274 - DNA, 25 bp, Mus musculus
ttcccaggatccgtcactgtggaat

SEQ ID NO: 934275 - DNA, 25 bp, Mus musculus
ttcccaggattgacccaccagacag

SEQ ID NO: 934276 - DNA, 25 bp, Mus musculus
ttcccaggattgtcccaccagacag

SEQ ID NO: 934277 - DNA, 25 bp, Mus musculus
ttcccaggcaggatcatgctgtgta

SEQ ID NO: 934278 - DNA, 25 bp, Mus musculus
ttcccaggcaggttcatgctgtgta

SEQ ID NO: 934279 - DNA, 25 bp, Mus musculus
ttcccaggcatgaccaagactggca

SEQ ID NO: 934280 - DNA, 25 bp, Mus musculus
ttcccaggcatgtccaagactggca

SEQ ID NO: 934281 - DNA, 25 bp, Mus musculus
ttcccaggcctgcataacttacagt

SEQ ID NO: 934282 - DNA, 25 bp, Mus musculus
ttcccaggcctggataacttacagt

SEQ ID NO: 934283 - DNA, 25 bp, Mus musculus
ttcccaggcgaactccatcacgagg

SEQ ID NO: 934284 - DNA, 25 bp, Mus musculus
ttcccaggcgaagtccatcacgagg

SEQ ID NO: 934285 - DNA, 25 bp, Mus musculus
ttcccaggcgtgagagctccaagga

SEQ ID NO: 934286 - DNA, 25 bp, Mus musculus
ttcccaggcgtgtgagctccaagga

SEQ ID NO: 934287 - DNA, 25 bp, Mus musculus
ttcccaggctcaacacagtggctta

SEQ ID NO: 934288 - DNA, 25 bp, Mus musculus
ttcccaggctcaccatcaattgtgc

SEQ ID NO: 934289 - DNA, 25 bp, Mus musculus
ttcccaggctcactctaatgtttcg

SEQ ID NO: 934290 - DNA, 25 bp, Mus musculus
ttcccaggctcagcatcaattgtgc

SEQ ID NO: 934291 - DNA, 25 bp, Mus musculus
ttcccaggctcagtctaatgtttcg

SEQ ID NO: 934292 - DNA, 25 bp, Mus musculus
ttcccaggctcatcacagtggctta

SEQ ID NO: 934293 - DNA, 25 bp, Mus musculus
ttcccaggctttctttgcttagggc

SEQ ID NO: 934294 - DNA, 25 bp, Mus musculus
ttcccaggctttgtttgcttagggc

SEQ ID NO: 934295 - DNA, 25 bp, Mus musculus
ttcccagggagacaagtattcaaca

SEQ ID NO: 934296 - DNA, 25 bp, Mus musculus
ttcccagggagagaagtattcaaca

SEQ ID NO: 934297 - DNA, 25 bp, Mus musculus
ttcccagggaggacttcggaagctg

SEQ ID NO: 934298 - DNA, 25 bp, Mus musculus
ttcccagggaggtcttcggaagctg

SEQ ID NO: 934299 - DNA, 25 bp, Mus musculus
ttcccagggcataagagagagactt

SEQ ID NO: 934300 - DNA, 25 bp, Mus musculus
ttcccagggcattagagagagactt

SEQ ID NO: 934301 - DNA, 25 bp, Mus musculus
ttcccagggcccctatggtaggaga

SEQ ID NO: 934302 - DNA, 25 bp, Mus musculus
ttcccagggcccgtatggtaggaga

SEQ ID NO: 934303 - DNA, 25 bp, Mus musculus
ttcccagggctaaattgtgcccagt

SEQ ID NO: 934304 - DNA, 25 bp, Mus musculus
ttcccagggctatattgtgcccagt

SEQ ID NO: 934305 - DNA, 25 bp, Mus musculus
ttcccagggctgcaactgaagcagg

SEQ ID NO: 934306 - DNA, 25 bp, Mus musculus
ttcccagggctggaactgaagcagg

SEQ ID NO: 934307 - DNA, 25 bp, Mus musculus
ttcccagggtcaataggctacggta

SEQ ID NO: 934308 - DNA, 25 bp, Mus musculus
ttcccagggtcattaggctacggta

SEQ ID NO: 934309 - DNA, 25 bp, Mus musculus
ttcccagggtgcaccagacgacgga

SEQ ID NO: 934310 - DNA, 25 bp, Mus musculus
ttcccagggtgctccagacgacgga

SEQ ID NO: 934311 - DNA, 25 bp, Mus musculus
ttcccaggtaatcagcatcgggtgg

SEQ ID NO: 934312 - DNA, 25 bp, Mus musculus
ttcccaggtaatgagcatcgggtgg

SEQ ID NO: 934313 - DNA, 25 bp, Mus musculus
ttcccaggtggcctcaatcagtttg

SEQ ID NO: 934314 - DNA, 25 bp, Mus musculus
ttcccaggtggcgtcaatcagtttg

SEQ ID NO: 934315 - DNA, 25 bp, Mus musculus
ttcccaggtgttcgtaccagtgcac

SEQ ID NO: 934316 - DNA, 25 bp, Mus musculus
ttcccaggtgttggtaccagtgcac

SEQ ID NO: 934317 - DNA, 25 bp, Mus musculus
ttcccagtagctaatattatctgta

SEQ ID NO: 934318 - DNA, 25 bp, Mus musculus
ttcccagtagcttatattatctgta

SEQ ID NO: 934319 - DNA, 25 bp, Mus musculus
ttcccagtatccattgcataacatg

SEQ ID NO: 934320 - DNA, 25 bp, Mus musculus
ttcccagtatcctttgcataacatg

SEQ ID NO: 934321 - DNA, 25 bp, Mus musculus
ttcccagtattcaccagaagccctg

SEQ ID NO: 934322 - DNA, 25 bp, Mus musculus
ttcccagtattctccagaagccctg

SEQ ID NO: 934323 - DNA, 25 bp, Mus musculus
ttcccagtatttacttgcattgcta

SEQ ID NO: 934324 - DNA, 25 bp, Mus musculus
ttcccagtattttcttgcattgcta

SEQ ID NO: 934325 - DNA, 25 bp, Mus musculus
ttcccagtcaagaccacacagcctt

SEQ ID NO: 934326 - DNA, 25 bp, Mus musculus
ttcccagtcaagtccacacagcctt

SEQ ID NO: 934327 - DNA, 25 bp, Mus musculus
ttcccagtcactcgtactgatttgt

SEQ ID NO: 934328 - DNA, 25 bp, Mus musculus
ttcccagtcactggtactgatttgt

SEQ ID NO: 934329 - DNA, 25 bp, Mus musculus
ttcccagtcagacaactatgtccct

SEQ ID NO: 934330 - DNA, 25 bp, Mus musculus
ttcccagtcagagaactatgtccct

SEQ ID NO: 934331 - DNA, 25 bp, Mus musculus
ttcccagtcccacacgggaaaggct

SEQ ID NO: 934332 - DNA, 25 bp, Mus musculus
ttcccagtcccagacgggaaaggct

SEQ ID NO: 934333 - DNA, 25 bp, Mus musculus
ttcccagtcctgcacaactgattta

SEQ ID NO: 934334 - DNA, 25 bp, Mus musculus
ttcccagtcctggacaactgattta

SEQ ID NO: 934335 - DNA, 25 bp, Mus musculus
ttcccagtctgtacacatcagaggt

SEQ ID NO: 934336 - DNA, 25 bp, Mus musculus
ttcccagtctgttcacatcagaggt

SEQ ID NO: 934337 - DNA, 25 bp, Mus musculus
ttcccagtcttgatcctactacaaa

SEQ ID NO: 934338 - DNA, 25 bp, Mus musculus
ttcccagtcttgttcctactacaaa

SEQ ID NO: 934339 - DNA, 25 bp, Mus musculus
ttcccagtgagcattttaattagca

SEQ ID NO: 934340 - DNA, 25 bp, Mus musculus
ttcccagtgagctttttaattagca

SEQ ID NO: 934341 - DNA, 25 bp, Mus musculus
ttcccagtgaggaacaagggtagct

SEQ ID NO: 934342 - DNA, 25 bp, Mus musculus
ttcccagtgaggtacaagggtagct

SEQ ID NO: 934343 - DNA, 25 bp, Mus musculus
ttcccagtgcccacaggatgattgg

SEQ ID NO: 934344 - DNA, 25 bp, Mus musculus
ttcccagtgccctcaggatgattgg

SEQ ID NO: 934345 - DNA, 25 bp, Mus musculus
ttcccagtgctaacttggtggtgtt

SEQ ID NO: 934346 - DNA, 25 bp, Mus musculus
ttcccagtgctatcttggtggtgtt

SEQ ID NO: 934347 - DNA, 25 bp, Mus musculus
ttcccagtgctgaggtatgaggtgt

SEQ ID NO: 934348 - DNA, 25 bp, Mus musculus
ttcccagtgctgcatgactaagacg

SEQ ID NO: 934349 - DNA, 25 bp, Mus musculus
ttcccagtgctggatgactaagacg

SEQ ID NO: 934350 - DNA, 25 bp, Mus musculus
ttcccagtgctgtggtatgaggtgt

SEQ ID NO: 934351 - DNA, 25 bp, Mus musculus
ttcccagtggcacaggctgatggca

SEQ ID NO: 934352 - DNA, 25 bp, Mus musculus
ttcccagtggcagaggctgatggca

SEQ ID NO: 934353 - DNA, 25 bp, Mus musculus
ttcccagtggcccaagccgaggctg

SEQ ID NO: 934354 - DNA, 25 bp, Mus musculus
ttcccagtggccgaagccgaggctg

SEQ ID NO: 934355 - DNA, 25 bp, Mus musculus
ttcccagtgggacgtgcagcagttc

SEQ ID NO: 934356 - DNA, 25 bp, Mus musculus
ttcccagtgggaggtgcagcagttc

SEQ ID NO: 934357 - DNA, 25 bp, Mus musculus
ttcccagtggtcattctcccttcta

SEQ ID NO: 934358 - DNA, 25 bp, Mus musculus
ttcccagtggtctttctcccttcta

SEQ ID NO: 934359 - DNA, 25 bp, Mus musculus
ttcccagtggtgagaaagcgcttgt

SEQ ID NO: 934360 - DNA, 25 bp, Mus musculus
ttcccagtggtgtgaaagcgcttgt

SEQ ID NO: 934361 - DNA, 25 bp, Mus musculus
ttcccagtgttgactgctattagca

SEQ ID NO: 934362 - DNA, 25 bp, Mus musculus
ttcccagtgttgtctgctattagca

SEQ ID NO: 934363 - DNA, 25 bp, Mus musculus
ttcccagtgtttattattcctgtgg

SEQ ID NO: 934364 - DNA, 25 bp, Mus musculus
ttcccagtgttttttattcctgtgg

SEQ ID NO: 934365 - DNA, 25 bp, Mus musculus
ttcccagttcatacagggattttct

SEQ ID NO: 934366 - DNA, 25 bp, Mus musculus
ttcccagttcattcagggattttct

SEQ ID NO: 934367 - DNA, 25 bp, Mus musculus
ttcccagttcctctttgtcactttt

SEQ ID NO: 934368 - DNA, 25 bp, Mus musculus
ttcccagttcctgtttgtcactttt

SEQ ID NO: 934369 - DNA, 25 bp, Mus musculus
ttcccagttctaaccaatcatcctt

SEQ ID NO: 934370 - DNA, 25 bp, Mus musculus
ttcccagttctatccaatcatcctt

SEQ ID NO: 934371 - DNA, 25 bp, Mus musculus
ttcccagttctgcaggctgatggtc

SEQ ID NO: 934372 - DNA, 25 bp, Mus musculus
ttcccagttctggaggctgatggtc

SEQ ID NO: 934373 - DNA, 25 bp, Mus musculus
ttcccagttgctagtgctttgaccc

SEQ ID NO: 934374 - DNA, 25 bp, Mus musculus
ttcccagttgcttgtgctttgaccc

SEQ ID NO: 934375 - DNA, 25 bp, Mus musculus
ttcccagtttagatgtcttagcagt

SEQ ID NO: 934376 - DNA, 25 bp, Mus musculus
ttcccagtttagttgtcttagcagt

SEQ ID NO: 934377 - DNA, 25 bp, Mus musculus
ttcccataagagcaggttgcacgct

SEQ ID NO: 934378 - DNA, 25 bp, Mus musculus
ttcccataagaggaggttgcacgct

SEQ ID NO: 934379 - DNA, 25 bp, Mus musculus
ttcccataataaacgttcctgatgc

SEQ ID NO: 934380 - DNA, 25 bp, Mus musculus
ttcccataataatcgttcctgatgc

SEQ ID NO: 934381 - DNA, 25 bp, Mus musculus
ttcccatactgaattgtttcccttc

SEQ ID NO: 934382 - DNA, 25 bp, Mus musculus
ttcccatactgatttgtttcccttc

SEQ ID NO: 934383 - DNA, 25 bp, Mus musculus
ttcccatagggcagggagtgtccac

SEQ ID NO: 934384 - DNA, 25 bp, Mus musculus
ttcccatagggctgggagtgtccac

SEQ ID NO: 934385 - DNA, 25 bp, Mus musculus
ttcccatagtggctgtgacacagat

SEQ ID NO: 934386 - DNA, 25 bp, Mus musculus
ttcccatagtgggtgtgacacagat

SEQ ID NO: 934387 - DNA, 25 bp, Mus musculus
ttcccatcaactagtagctgttcta

SEQ ID NO: 934388 - DNA, 25 bp, Mus musculus
ttcccatcaacttgtagctgttcta

SEQ ID NO: 934389 - DNA, 25 bp, Mus musculus
ttcccatcacagaaaggcctgccag

SEQ ID NO: 934390 - DNA, 25 bp, Mus musculus
ttcccatcacagtaaggcctgccag

SEQ ID NO: 934391 - DNA, 25 bp, Mus musculus
ttcccatcaccgcagcaatattaaa

SEQ ID NO: 934392 - DNA, 25 bp, Mus musculus
ttcccatcaccggagcaatattaaa

SEQ ID NO: 934393 - DNA, 25 bp, Mus musculus
ttcccatcagtgattgaaaatctgt

SEQ ID NO: 934394 - DNA, 25 bp, Mus musculus
ttcccatcagtgtttgaaaatctgt

SEQ ID NO: 934395 - DNA, 25 bp, Mus musculus
ttcccatcataaaatatttttgtat

SEQ ID NO: 934396 - DNA, 25 bp, Mus musculus
ttcccatcataatatatttttgtat

SEQ ID NO: 934397 - DNA, 25 bp, Mus musculus
ttcccatcatacaccttttcccttg

SEQ ID NO: 934398 - DNA, 25 bp, Mus musculus
ttcccatcatactccttttcccttg

SEQ ID NO: 934399 - DNA, 25 bp, Mus musculus
ttcccatccaaacccatcggtggaa

SEQ ID NO: 934400 - DNA, 25 bp, Mus musculus
ttcccatccaaagccatcggtggaa

SEQ ID NO: 934401 - DNA, 25 bp, Mus musculus
ttcccatccattcgcagcggcagga

SEQ ID NO: 934402 - DNA, 25 bp, Mus musculus
ttcccatccattggcagcggcagga

SEQ ID NO: 934403 - DNA, 25 bp, Mus musculus
ttcccatcccatcttagtagaactg

SEQ ID NO: 934404 - DNA, 25 bp, Mus musculus
ttcccatcccatgttagtagaactg

SEQ ID NO: 934405 - DNA, 25 bp, Mus musculus
ttcccatccctacatttcaattcta

SEQ ID NO: 934406 - DNA, 25 bp, Mus musculus
ttcccatccctagatttcaattcta

SEQ ID NO: 934407 - DNA, 25 bp, Mus musculus
ttcccatccggcagaagttcaacaa

SEQ ID NO: 934408 - DNA, 25 bp, Mus musculus
ttcccatccggctgaagttcaacaa

SEQ ID NO: 934409 - DNA, 25 bp, Mus musculus
ttcccatcctatccattgcttttat

SEQ ID NO: 934410 - DNA, 25 bp, Mus musculus
ttcccatcctatgcattgcttttat

SEQ ID NO: 934411 - DNA, 25 bp, Mus musculus
ttcccatcctgcaaacgactatgat

SEQ ID NO: 934412 - DNA, 25 bp, Mus musculus
ttcccatcctgctaacgactatgat

SEQ ID NO: 934413 - DNA, 25 bp, Mus musculus
ttcccatccttccttaaggctaagg

SEQ ID NO: 934414 - DNA, 25 bp, Mus musculus
ttcccatccttcgttaaggctaagg

SEQ ID NO: 934415 - DNA, 25 bp, Mus musculus
ttcccatcgctaccaaaaaagtgca

SEQ ID NO: 934416 - DNA, 25 bp, Mus musculus
ttcccatcgctagcaaaaaagtgca

SEQ ID NO: 934417 - DNA, 25 bp, Mus musculus
ttcccatctgaacgtatctgcaccg

SEQ ID NO: 934418 - DNA, 25 bp, Mus musculus
ttcccatctgaaggtatctgcaccg

SEQ ID NO: 934419 - DNA, 25 bp, Mus musculus
ttcccatctgatactttctgggcat

SEQ ID NO: 934420 - DNA, 25 bp, Mus musculus
ttcccatctgattctttctgggcat

SEQ ID NO: 934421 - DNA, 25 bp, Mus musculus
ttcccatctgcaactctgcactgta

SEQ ID NO: 934422 - DNA, 25 bp, Mus musculus
ttcccatctgcatctctgcactgta

SEQ ID NO: 934423 - DNA, 25 bp, Mus musculus
ttcccatctggaaactagctacttt

SEQ ID NO: 934424 - DNA, 25 bp, Mus musculus
ttcccatctggatactagctacttt

SEQ ID NO: 934425 - DNA, 25 bp, Mus musculus
ttcccatctgtacatttttggcgat

SEQ ID NO: 934426 - DNA, 25 bp, Mus musculus
ttcccatctgtagatttttggcgat

SEQ ID NO: 934427 - DNA, 25 bp, Mus musculus
ttcccatcttgtctgcaatgtggca

SEQ ID NO: 934428 - DNA, 25 bp, Mus musculus
ttcccatcttgtgtgcaatgtggca

SEQ ID NO: 934429 - DNA, 25 bp, Mus musculus
ttcccatctttcaggaggtgccctt

SEQ ID NO: 934430 - DNA, 25 bp, Mus musculus
ttcccatctttctggaggtgccctt

SEQ ID NO: 934431 - DNA, 25 bp, Mus musculus
ttcccatcttttatggtacagccca

SEQ ID NO: 934432 - DNA, 25 bp, Mus musculus
ttcccatcttttttggtacagccca

SEQ ID NO: 934433 - DNA, 25 bp, Mus musculus
ttcccatgaatccttgcctgtgaga

SEQ ID NO: 934434 - DNA, 25 bp, Mus musculus
ttcccatgaatcgttgcctgtgaga

SEQ ID NO: 934435 - DNA, 25 bp, Mus musculus
ttcccatgaccacagtgtccatctt

SEQ ID NO: 934436 - DNA, 25 bp, Mus musculus
ttcccatgaccagagtgtccatctt

SEQ ID NO: 934437 - DNA, 25 bp, Mus musculus
ttcccatgagtcaccttcttgagaa

SEQ ID NO: 934438 - DNA, 25 bp, Mus musculus
ttcccatgagtctccttcttgagaa

SEQ ID NO: 934439 - DNA, 25 bp, Mus musculus
ttcccatgatggatggtgagaccca

SEQ ID NO: 934440 - DNA, 25 bp, Mus musculus
ttcccatgatggttggtgagaccca

SEQ ID NO: 934441 - DNA, 25 bp, Mus musculus
ttcccatgcctgatccaaaaacttc

SEQ ID NO: 934442 - DNA, 25 bp, Mus musculus
ttcccatgcctgttccaaaaacttc

SEQ ID NO: 934443 - DNA, 25 bp, Mus musculus
ttcccatgcttgagtagccgacttg

SEQ ID NO: 934444 - DNA, 25 bp, Mus musculus
ttcccatgcttgtgtagccgacttg

SEQ ID NO: 934445 - DNA, 25 bp, Mus musculus
ttcccatggaaccttgtgatttggg

SEQ ID NO: 934446 - DNA, 25 bp, Mus musculus
ttcccatggaacgttgtgatttggg

SEQ ID NO: 934447 - DNA, 25 bp, Mus musculus
ttcccatggaagagtcgcatgctct

SEQ ID NO: 934448 - DNA, 25 bp, Mus musculus
ttcccatggaagtgtcgcatgctct

SEQ ID NO: 934449 - DNA, 25 bp, Mus musculus
ttcccatggacacttggccatgtct

SEQ ID NO: 934450 - DNA, 25 bp, Mus musculus
ttcccatggacagttggccatgtct

SEQ ID NO: 934451 - DNA, 25 bp, Mus musculus
ttcccatggaggaaacatgtgcttt

SEQ ID NO: 934452 - DNA, 25 bp, Mus musculus
ttcccatggaggtaacatgtgcttt

SEQ ID NO: 934453 - DNA, 25 bp, Mus musculus
ttcccatggcctcaacatctttctt

SEQ ID NO: 934454 - DNA, 25 bp, Mus musculus
ttcccatggcctgaacatctttctt

SEQ ID NO: 934455 - DNA, 25 bp, Mus musculus
ttcccatgggaacgtctgtgcagtg

SEQ ID NO: 934456 - DNA, 25 bp, Mus musculus
ttcccatgggaaggtctgtgcagtg

SEQ ID NO: 934457 - DNA, 25 bp, Mus musculus
ttcccatgggtgattgcatctccat

SEQ ID NO: 934458 - DNA, 25 bp, Mus musculus
ttcccatgggtgtttgcatctccat

SEQ ID NO: 934459 - DNA, 25 bp, Mus musculus
ttcccatgtaaactctactctgcag

SEQ ID NO: 934460 - DNA, 25 bp, Mus musculus
ttcccatgtaaagtctactctgcag

SEQ ID NO: 934461 - DNA, 25 bp, Mus musculus
ttcccatgtcatacaagaaccccag

SEQ ID NO: 934462 - DNA, 25 bp, Mus musculus
ttcccatgtcattcaagaaccccag

SEQ ID NO: 934463 - DNA, 25 bp, Mus musculus
ttcccatgtgagaggagactcccaa

SEQ ID NO: 934464 - DNA, 25 bp, Mus musculus
ttcccatgtgagcacaacgccaatg

SEQ ID NO: 934465 - DNA, 25 bp, Mus musculus
ttcccatgtgaggacaacgccaatg

SEQ ID NO: 934466 - DNA, 25 bp, Mus musculus
ttcccatgtgagtggagactcccaa

SEQ ID NO: 934467 - DNA, 25 bp, Mus musculus
ttcccatgttttagtcagtacccct

SEQ ID NO: 934468 - DNA, 25 bp, Mus musculus
ttcccatgtttttgtcagtacccct

SEQ ID NO: 934469 - DNA, 25 bp, Mus musculus
ttcccattaaacctcaccattggtg

SEQ ID NO: 934470 - DNA, 25 bp, Mus musculus
ttcccattaaacgtcaccattggtg

SEQ ID NO: 934471 - DNA, 25 bp, Mus musculus
ttcccattaggacaatcagtcccct

SEQ ID NO: 934472 - DNA, 25 bp, Mus musculus
ttcccattaggagaatcagtcccct

SEQ ID NO: 934473 - DNA, 25 bp, Mus musculus
ttcccattattgacatcgcacccat

SEQ ID NO: 934474 - DNA, 25 bp, Mus musculus
ttcccattattgtcatcgcacccat

SEQ ID NO: 934475 - DNA, 25 bp, Mus musculus
ttcccattccaaatcttcaacttaa

SEQ ID NO: 934476 - DNA, 25 bp, Mus musculus
ttcccattccaattcttcaacttaa

SEQ ID NO: 934477 - DNA, 25 bp, Mus musculus
ttcccattccacatgtactttttag

SEQ ID NO: 934478 - DNA, 25 bp, Mus musculus
ttcccattccacttgtactttttag

SEQ ID NO: 934479 - DNA, 25 bp, Mus musculus
ttcccattcctaaagagcaccatcg

SEQ ID NO: 934480 - DNA, 25 bp, Mus musculus
ttcccattcctatagagcaccatcg

SEQ ID NO: 934481 - DNA, 25 bp, Mus musculus
ttcccattccttcatgtagacaaag

SEQ ID NO: 934482 - DNA, 25 bp, Mus musculus
ttcccattccttcgcctatgaaatt

SEQ ID NO: 934483 - DNA, 25 bp, Mus musculus
ttcccattccttgatgtagacaaag

SEQ ID NO: 934484 - DNA, 25 bp, Mus musculus
ttcccattccttggcctatgaaatt

SEQ ID NO: 934485 - DNA, 25 bp, Mus musculus
ttcccattctctatcatcagactca

SEQ ID NO: 934486 - DNA, 25 bp, Mus musculus
ttcccattctctatcttagacaagg

SEQ ID NO: 934487 - DNA, 25 bp, Mus musculus
ttcccattctctttcatcagactca

SEQ ID NO: 934488 - DNA, 25 bp, Mus musculus
ttcccattctctttcttagacaagg

SEQ ID NO: 934489 - DNA, 25 bp, Mus musculus
ttcccattgctgagcatactctatg

SEQ ID NO: 934490 - DNA, 25 bp, Mus musculus
ttcccattgctgtgcatactctatg

SEQ ID NO: 934491 - DNA, 25 bp, Mus musculus
ttcccattgcttccaagctgctgag

SEQ ID NO: 934492 - DNA, 25 bp, Mus musculus
ttcccattgcttgcaagctgctgag

SEQ ID NO: 934493 - DNA, 25 bp, Mus musculus
ttcccattgggacatttcagactaa

SEQ ID NO: 934494 - DNA, 25 bp, Mus musculus
ttcccattgggagatttcagactaa

SEQ ID NO: 934495 - DNA, 25 bp, Mus musculus
ttcccatttcctagagactgttaat

SEQ ID NO: 934496 - DNA, 25 bp, Mus musculus
ttcccatttccttgagactgttaat

SEQ ID NO: 934497 - DNA, 25 bp, Mus musculus
ttcccatttgcaatcttgtttctag

SEQ ID NO: 934498 - DNA, 25 bp, Mus musculus
ttcccatttgcattcttgtttctag

SEQ ID NO: 934499 - DNA, 25 bp, Mus musculus
ttcccatttggaacgtcaacttaga

SEQ ID NO: 934500 - DNA, 25 bp, Mus musculus
ttcccatttggatcgtcaacttaga

SEQ ID NO: 934501 - DNA, 25 bp, Mus musculus
ttcccatttgttccagaatcttcca

SEQ ID NO: 934502 - DNA, 25 bp, Mus musculus
ttcccatttgttgcagaatcttcca

SEQ ID NO: 934503 - DNA, 25 bp, Mus musculus
ttccccaaagaaattcctgcagctc

SEQ ID NO: 934504 - DNA, 25 bp, Mus musculus
ttccccaaagaatttcctgcagctc

SEQ ID NO: 934505 - DNA, 25 bp, Mus musculus
ttccccaaagccaaaaatcatccag

SEQ ID NO: 934506 - DNA, 25 bp, Mus musculus
ttccccaaagcctaaaatcatccag

SEQ ID NO: 934507 - DNA, 25 bp, Mus musculus
ttccccaaagggaactgacgtctgt

SEQ ID NO: 934508 - DNA, 25 bp, Mus musculus
ttccccaaagggagatttgcattcg

SEQ ID NO: 934509 - DNA, 25 bp, Mus musculus
ttccccaaagggtactgacgtctgt

SEQ ID NO: 934510 - DNA, 25 bp, Mus musculus
ttccccaaagggtgatttgcattcg

SEQ ID NO: 934511 - DNA, 25 bp, Mus musculus
ttccccaaatggaaggactcaagct

SEQ ID NO: 934512 - DNA, 25 bp, Mus musculus
ttccccaaatggtaggactcaagct

SEQ ID NO: 934513 - DNA, 25 bp, Mus musculus
ttccccaaattccacattacatcta

SEQ ID NO: 934514 - DNA, 25 bp, Mus musculus
ttccccaaattcgacattacatcta

SEQ ID NO: 934515 - DNA, 25 bp, Mus musculus
ttccccaacacaaaggacagcacag

SEQ ID NO: 934516 - DNA, 25 bp, Mus musculus
ttccccaacacataggacagcacag

SEQ ID NO: 934517 - DNA, 25 bp, Mus musculus
ttccccaaccagaaccagactaaga

SEQ ID NO: 934518 - DNA, 25 bp, Mus musculus
ttccccaaccagtaccagactaaga

SEQ ID NO: 934519 - DNA, 25 bp, Mus musculus
ttccccaactgtcgggcaggccaga

SEQ ID NO: 934520 - DNA, 25 bp, Mus musculus
ttccccaactgtggggcaggccaga

SEQ ID NO: 934521 - DNA, 25 bp, Mus musculus
ttccccaagatgagattccagccag

SEQ ID NO: 934522 - DNA, 25 bp, Mus musculus
ttccccaagatgtgattccagccag

SEQ ID NO: 934523 - DNA, 25 bp, Mus musculus
ttccccaagcccaggagtctgaaag

SEQ ID NO: 934524 - DNA, 25 bp, Mus musculus
ttccccaagccctggagtctgaaag

SEQ ID NO: 934525 - DNA, 25 bp, Mus musculus
ttccccaagtgaagggccttttctt

SEQ ID NO: 934526 - DNA, 25 bp, Mus musculus
ttccccaagtgactgtttggacact

SEQ ID NO: 934527 - DNA, 25 bp, Mus musculus
ttccccaagtgagtgtttggacact

SEQ ID NO: 934528 - DNA, 25 bp, Mus musculus
ttccccaagtgatgggccttttctt

SEQ ID NO: 934529 - DNA, 25 bp, Mus musculus
ttccccaagttgattttgtcacagt

SEQ ID NO: 934530 - DNA, 25 bp, Mus musculus
ttccccaagttgtttttgtcacagt

SEQ ID NO: 934531 - DNA, 25 bp, Mus musculus
ttccccaataaaatgcctgggtctc

SEQ ID NO: 934532 - DNA, 25 bp, Mus musculus
ttccccaataaacttcatcagtgtc

SEQ ID NO: 934533 - DNA, 25 bp, Mus musculus
ttccccaataaagttcatcagtgtc

SEQ ID NO: 934534 - DNA, 25 bp, Mus musculus
ttccccaataaattgcctgggtctc

SEQ ID NO: 934535 - DNA, 25 bp, Mus musculus
ttccccaatcatccatagtaattgt

SEQ ID NO: 934536 - DNA, 25 bp, Mus musculus
ttccccaatcatgcatagtaattgt

SEQ ID NO: 934537 - DNA, 25 bp, Mus musculus
ttccccacaactcgaaggaacacat

SEQ ID NO: 934538 - DNA, 25 bp, Mus musculus
ttccccacaactggaaggaacacat

SEQ ID NO: 934539 - DNA, 25 bp, Mus musculus
ttccccacacacagcggttcattag

SEQ ID NO: 934540 - DNA, 25 bp, Mus musculus
ttccccacacactgcggttcattag

SEQ ID NO: 934541 - DNA, 25 bp, Mus musculus
ttccccacaccaatgaatgctacaa

SEQ ID NO: 934542 - DNA, 25 bp, Mus musculus
ttccccacaccattgaatgctacaa

SEQ ID NO: 934543 - DNA, 25 bp, Mus musculus
ttccccacagaactctgaattcctg

SEQ ID NO: 934544 - DNA, 25 bp, Mus musculus
ttccccacagaagtctgaattcctg

SEQ ID NO: 934545 - DNA, 25 bp, Mus musculus
ttccccacagcaatctgcattgagc

SEQ ID NO: 934546 - DNA, 25 bp, Mus musculus
ttccccacagcattctgcattgagc

SEQ ID NO: 934547 - DNA, 25 bp, Mus musculus
ttccccacagggacggtctggattg

SEQ ID NO: 934548 - DNA, 25 bp, Mus musculus
ttccccacagggtcggtctggattg

SEQ ID NO: 934549 - DNA, 25 bp, Mus musculus
ttccccacatgtactgttattcttt

SEQ ID NO: 934550 - DNA, 25 bp, Mus musculus
ttccccacatgttctgttattcttt

SEQ ID NO: 934551 - DNA, 25 bp, Mus musculus
ttccccaccaatatcatttcctgga

SEQ ID NO: 934552 - DNA, 25 bp, Mus musculus
ttccccaccaatttcatttcctgga

SEQ ID NO: 934553 - DNA, 25 bp, Mus musculus
ttccccaccccaagtgtgagtgtgt

SEQ ID NO: 934554 - DNA, 25 bp, Mus musculus
ttccccaccccatgtgtgagtgtgt

SEQ ID NO: 934555 - DNA, 25 bp, Mus musculus
ttccccacctacattcctgatggag

SEQ ID NO: 934556 - DNA, 25 bp, Mus musculus
ttccccacctactttcctgatggag

SEQ ID NO: 934557 - DNA, 25 bp, Mus musculus
ttccccacctctcgtgtagggagaa

SEQ ID NO: 934558 - DNA, 25 bp, Mus musculus
ttccccacctctggtgtagggagaa

SEQ ID NO: 934559 - DNA, 25 bp, Mus musculus
ttccccacggataggccaagcataa

SEQ ID NO: 934560 - DNA, 25 bp, Mus musculus
ttccccacggattggccaagcataa

SEQ ID NO: 934561 - DNA, 25 bp, Mus musculus
ttccccacgggcagtgtgatattta

SEQ ID NO: 934562 - DNA, 25 bp, Mus musculus
ttccccacgggctgtgtgatattta

SEQ ID NO: 934563 - DNA, 25 bp, Mus musculus
ttccccacggtgattctaactaagt

SEQ ID NO: 934564 - DNA, 25 bp, Mus musculus
ttccccacggtgtttctaactaagt

SEQ ID NO: 934565 - DNA, 25 bp, Mus musculus
ttccccactaagcatcttttgcttt

SEQ ID NO: 934566 - DNA, 25 bp, Mus musculus
ttccccactaaggatcttttgcttt

SEQ ID NO: 934567 - DNA, 25 bp, Mus musculus
ttccccactgggaatatctttcatt

SEQ ID NO: 934568 - DNA, 25 bp, Mus musculus
ttccccactgggtatatctttcatt

SEQ ID NO: 934569 - DNA, 25 bp, Mus musculus
ttccccactgtcaggaaccatagca

SEQ ID NO: 934570 - DNA, 25 bp, Mus musculus
ttccccactgtctggaaccatagca

SEQ ID NO: 934571 - DNA, 25 bp, Mus musculus
ttccccactgtgaataactgacctt

SEQ ID NO: 934572 - DNA, 25 bp, Mus musculus
ttccccactgtgacatttaaagtca

SEQ ID NO: 934573 - DNA, 25 bp, Mus musculus
ttccccactgtgtataactgacctt

SEQ ID NO: 934574 - DNA, 25 bp, Mus musculus
ttccccactgtgtcatttaaagtca

SEQ ID NO: 934575 - DNA, 25 bp, Mus musculus
ttccccacttatcgccatgtggatt

SEQ ID NO: 934576 - DNA, 25 bp, Mus musculus
ttccccacttatggccatgtggatt

SEQ ID NO: 934577 - DNA, 25 bp, Mus musculus
ttccccacttgccaattacttattg

SEQ ID NO: 934578 - DNA, 25 bp, Mus musculus
ttccccacttgcgaattacttattg

SEQ ID NO: 934579 - DNA, 25 bp, Mus musculus
ttccccacttttagaatcagactcc

SEQ ID NO: 934580 - DNA, 25 bp, Mus musculus
ttccccactttttgaatcagactcc

SEQ ID NO: 934581 - DNA, 25 bp, Mus musculus
ttccccagaaacacgcaggcagtta

SEQ ID NO: 934582 - DNA, 25 bp, Mus musculus
ttccccagaaactcgcaggcagtta

SEQ ID NO: 934583 - DNA, 25 bp, Mus musculus
ttccccagaatactattaactcctg

SEQ ID NO: 934584 - DNA, 25 bp, Mus musculus
ttccccagaatagtattaactcctg

SEQ ID NO: 934585 - DNA, 25 bp, Mus musculus
ttccccagacaacctgtgcattgag

SEQ ID NO: 934586 - DNA, 25 bp, Mus musculus
ttccccagacaagctgtgcattgag

SEQ ID NO: 934587 - DNA, 25 bp, Mus musculus
ttccccagagaacttttgccagtcc

SEQ ID NO: 934588 - DNA, 25 bp, Mus musculus
ttccccagagaagttttgccagtcc

SEQ ID NO: 934589 - DNA, 25 bp, Mus musculus
ttccccagagttatcagagttttct

SEQ ID NO: 934590 - DNA, 25 bp, Mus musculus
ttccccagagttttcagagttttct

SEQ ID NO: 934591 - DNA, 25 bp, Mus musculus
ttccccagatgcaggctatgccttg

SEQ ID NO: 934592 - DNA, 25 bp, Mus musculus
ttccccagatgctggctatgccttg

SEQ ID NO: 934593 - DNA, 25 bp, Mus musculus
ttccccagatgtaaaaccgttctca

SEQ ID NO: 934594 - DNA, 25 bp, Mus musculus
ttccccagatgttaaaccgttctca

SEQ ID NO: 934595 - DNA, 25 bp, Mus musculus
ttccccagcaagacagctatgctga

SEQ ID NO: 934596 - DNA, 25 bp, Mus musculus
ttccccagcaagtcagctatgctga

SEQ ID NO: 934597 - DNA, 25 bp, Mus musculus
ttccccagcacccaatgtaagtgtg

SEQ ID NO: 934598 - DNA, 25 bp, Mus musculus
ttccccagcaccgaatgtaagtgtg

SEQ ID NO: 934599 - DNA, 25 bp, Mus musculus
ttccccagcattccccagttgttag

SEQ ID NO: 934600 - DNA, 25 bp, Mus musculus
ttccccagcattgcccagttgttag

SEQ ID NO: 934601 - DNA, 25 bp, Mus musculus
ttccccagccgaaaaggcttcacat

SEQ ID NO: 934602 - DNA, 25 bp, Mus musculus
ttccccagccgataaggcttcacat

SEQ ID NO: 934603 - DNA, 25 bp, Mus musculus
ttccccagccgcacagagctgtagc

SEQ ID NO: 934604 - DNA, 25 bp, Mus musculus
ttccccagccgctcagagctgtagc

SEQ ID NO: 934605 - DNA, 25 bp, Mus musculus
ttccccagcctcctgaataattgaa

SEQ ID NO: 934606 - DNA, 25 bp, Mus musculus
ttccccagcctcgtgaataattgaa

SEQ ID NO: 934607 - DNA, 25 bp, Mus musculus
ttccccagcggacgatatcgtgtgg

SEQ ID NO: 934608 - DNA, 25 bp, Mus musculus
ttccccagcggaggatatcgtgtgg

SEQ ID NO: 934609 - DNA, 25 bp, Mus musculus
ttccccagctccaagaagaagaggt

SEQ ID NO: 934610 - DNA, 25 bp, Mus musculus
ttccccagctcctagaagaagaggt

SEQ ID NO: 934611 - DNA, 25 bp, Mus musculus
ttccccagcttgatgatgcttcata

SEQ ID NO: 934612 - DNA, 25 bp, Mus musculus
ttccccagcttgttgatgcttcata

SEQ ID NO: 934613 - DNA, 25 bp, Mus musculus
ttccccaggaagctctagcgactta

SEQ ID NO: 934614 - DNA, 25 bp, Mus musculus
ttccccaggaaggtctagcgactta

SEQ ID NO: 934615 - DNA, 25 bp, Mus musculus
ttccccaggagacgacccttttgtg

SEQ ID NO: 934616 - DNA, 25 bp, Mus musculus
ttccccaggagaggacccttttgtg

SEQ ID NO: 934617 - DNA, 25 bp, Mus musculus
ttccccaggagtacattatttgttt

SEQ ID NO: 934618 - DNA, 25 bp, Mus musculus
ttccccaggagttcattatttgttt

SEQ ID NO: 934619 - DNA, 25 bp, Mus musculus
ttccccaggcaaaggtggatgccca

SEQ ID NO: 934620 - DNA, 25 bp, Mus musculus
ttccccaggcaatggtggatgccca

SEQ ID NO: 934621 - DNA, 25 bp, Mus musculus
ttccccaggcacaaaaggccatcag

SEQ ID NO: 934622 - DNA, 25 bp, Mus musculus
ttccccaggcactaaaggccatcag

SEQ ID NO: 934623 - DNA, 25 bp, Mus musculus
ttccccaggcctatagtagataagg

SEQ ID NO: 934624 - DNA, 25 bp, Mus musculus
ttccccaggcctttagtagataagg

SEQ ID NO: 934625 - DNA, 25 bp, Mus musculus
ttccccaggctaatgctaatgctta

SEQ ID NO: 934626 - DNA, 25 bp, Mus musculus
ttccccaggctattgctaatgctta

SEQ ID NO: 934627 - DNA, 25 bp, Mus musculus
ttccccagtatcctcaagtgatcaa

SEQ ID NO: 934628 - DNA, 25 bp, Mus musculus
ttccccagtatcgtcaagtgatcaa

SEQ ID NO: 934629 - DNA, 25 bp, Mus musculus
ttccccagtcttccgtaaaggtgct

SEQ ID NO: 934630 - DNA, 25 bp, Mus musculus
ttccccagtcttgcgtaaaggtgct

SEQ ID NO: 934631 - DNA, 25 bp, Mus musculus
ttccccagtgaacggctgccaagaa

SEQ ID NO: 934632 - DNA, 25 bp, Mus musculus
ttccccagtgaagggctgccaagaa

SEQ ID NO: 934633 - DNA, 25 bp, Mus musculus
ttccccagtgccctaagacgacaaa

SEQ ID NO: 934634 - DNA, 25 bp, Mus musculus
ttccccagtgccgtaagacgacaaa

SEQ ID NO: 934635 - DNA, 25 bp, Mus musculus
ttccccagtgctaagtcaggactga

SEQ ID NO: 934636 - DNA, 25 bp, Mus musculus
ttccccagtgcttagtcaggactga

SEQ ID NO: 934637 - DNA, 25 bp, Mus musculus
ttccccagttgccagtcatttattt

SEQ ID NO: 934638 - DNA, 25 bp, Mus musculus
ttccccagttgcgagtcatttattt

SEQ ID NO: 934639 - DNA, 25 bp, Mus musculus
ttccccagtttcaagttctcagata

SEQ ID NO: 934640 - DNA, 25 bp, Mus musculus
ttccccagtttctagttctcagata

SEQ ID NO: 934641 - DNA, 25 bp, Mus musculus
ttccccataaccatggcaactgctg

SEQ ID NO: 934642 - DNA, 25 bp, Mus musculus
ttccccataaccttggcaactgctg

SEQ ID NO: 934643 - DNA, 25 bp, Mus musculus
ttccccataccacagtctttgctag

SEQ ID NO: 934644 - DNA, 25 bp, Mus musculus
ttccccataccagagtctttgctag

SEQ ID NO: 934645 - DNA, 25 bp, Mus musculus
ttccccatacttaccatcattaaat

SEQ ID NO: 934646 - DNA, 25 bp, Mus musculus
ttccccatactttccatcattaaat

SEQ ID NO: 934647 - DNA, 25 bp, Mus musculus
ttccccatatcaaacactgcacaat

SEQ ID NO: 934648 - DNA, 25 bp, Mus musculus
ttccccatatcatacactgcacaat

SEQ ID NO: 934649 - DNA, 25 bp, Mus musculus
ttccccatatccaacttctatgggt

SEQ ID NO: 934650 - DNA, 25 bp, Mus musculus
ttccccatatcctacttctatgggt

SEQ ID NO: 934651 - DNA, 25 bp, Mus musculus
ttccccatatgccactagtgtgtag

SEQ ID NO: 934652 - DNA, 25 bp, Mus musculus
ttccccatatgcgactagtgtgtag

SEQ ID NO: 934653 - DNA, 25 bp, Mus musculus
ttccccatcctaatggactggctga

SEQ ID NO: 934654 - DNA, 25 bp, Mus musculus
ttccccatcctattggactggctga

SEQ ID NO: 934655 - DNA, 25 bp, Mus musculus
ttccccatcgatcaccgagtgcaga

SEQ ID NO: 934656 - DNA, 25 bp, Mus musculus
ttccccatcgatgaccgagtgcaga

SEQ ID NO: 934657 - DNA, 25 bp, Mus musculus
ttccccatctgaacttatgacatgc

SEQ ID NO: 934658 - DNA, 25 bp, Mus musculus
ttccccatctgatcttatgacatgc

SEQ ID NO: 934659 - DNA, 25 bp, Mus musculus
ttccccatcttcaacttttttgaga

SEQ ID NO: 934660 - DNA, 25 bp, Mus musculus
ttccccatcttctacttttttgaga

SEQ ID NO: 934661 - DNA, 25 bp, Mus musculus
ttccccatgaacctctttgtagacc

SEQ ID NO: 934662 - DNA, 25 bp, Mus musculus
ttccccatgaacgtctttgtagacc

SEQ ID NO: 934663 - DNA, 25 bp, Mus musculus
ttccccatgattccgaagattggat

SEQ ID NO: 934664 - DNA, 25 bp, Mus musculus
ttccccatgattgcgaagattggat

SEQ ID NO: 934665 - DNA, 25 bp, Mus musculus
ttccccatgcagcatgcatttgcac

SEQ ID NO: 934666 - DNA, 25 bp, Mus musculus
ttccccatgcaggatgcatttgcac

SEQ ID NO: 934667 - DNA, 25 bp, Mus musculus
ttccccatgggcagcgatagaggcc

SEQ ID NO: 934668 - DNA, 25 bp, Mus musculus
ttccccatgggctgcgatagaggcc

SEQ ID NO: 934669 - DNA, 25 bp, Mus musculus
ttccccatgtgcacagtggccagga

SEQ ID NO: 934670 - DNA, 25 bp, Mus musculus
ttccccatgtgctcagtggccagga

SEQ ID NO: 934671 - DNA, 25 bp, Mus musculus
ttccccattagactgcaatattctg

SEQ ID NO: 934672 - DNA, 25 bp, Mus musculus
ttccccattagagtgcaatattctg

SEQ ID NO: 934673 - DNA, 25 bp, Mus musculus
ttccccattgacctgaagaccatga

SEQ ID NO: 934674 - DNA, 25 bp, Mus musculus
ttccccattgacgtgaagaccatga

SEQ ID NO: 934675 - DNA, 25 bp, Mus musculus
ttcccccagactccagaagacataa

SEQ ID NO: 934676 - DNA, 25 bp, Mus musculus
ttcccccagactgcagaagacataa

SEQ ID NO: 934677 - DNA, 25 bp, Mus musculus
ttccccccatgaaaagtgatgacgt

SEQ ID NO: 934678 - DNA, 25 bp, Mus musculus
ttccccccatgataagtgatgacgt

SEQ ID NO: 934679 - DNA, 25 bp, Mus musculus
ttccccgaagccaggagtatacagt

SEQ ID NO: 934680 - DNA, 25 bp, Mus musculus
ttccccgaagcctggagtatacagt

SEQ ID NO: 934681 - DNA, 25 bp, Mus musculus
ttccccgagaagattgacatgacca

SEQ ID NO: 934682 - DNA, 25 bp, Mus musculus
ttccccgagaagtttgacatgacca

SEQ ID NO: 934683 - DNA, 25 bp, Mus musculus
ttccccgagaatctctaacttttga

SEQ ID NO: 934684 - DNA, 25 bp, Mus musculus
ttccccgagaatgtctaacttttga

SEQ ID NO: 934685 - DNA, 25 bp, Mus musculus
ttccccgaggcaaatttgcacttct

SEQ ID NO: 934686 - DNA, 25 bp, Mus musculus
ttccccgaggcatatttgcacttct

SEQ ID NO: 934687 - DNA, 25 bp, Mus musculus
ttccccgaggtgcagtcaaagccat

SEQ ID NO: 934688 - DNA, 25 bp, Mus musculus
ttccccgaggtggagtcaaagccat

SEQ ID NO: 934689 - DNA, 25 bp, Mus musculus
ttccccgaggttcaggcgctgtctc

SEQ ID NO: 934690 - DNA, 25 bp, Mus musculus
ttccccgaggttgaggcgctgtctc

SEQ ID NO: 934691 - DNA, 25 bp, Mus musculus
ttccccgagtctaccaagggcataa

SEQ ID NO: 934692 - DNA, 25 bp, Mus musculus
ttccccgagtcttccaagggcataa

SEQ ID NO: 934693 - DNA, 25 bp, Mus musculus
ttccccgcagcaagattcccataga

SEQ ID NO: 934694 - DNA, 25 bp, Mus musculus
ttccccgcagcatgattcccataga

SEQ ID NO: 934695 - DNA, 25 bp, Mus musculus
ttccccgcccaacaggtgtatttcg

SEQ ID NO: 934696 - DNA, 25 bp, Mus musculus
ttccccgcccaagaggtgtatttcg

SEQ ID NO: 934697 - DNA, 25 bp, Mus musculus
ttccccgccttgctgagggacagag

SEQ ID NO: 934698 - DNA, 25 bp, Mus musculus
ttccccgccttggtgagggacagag

SEQ ID NO: 934699 - DNA, 25 bp, Mus musculus
ttccccgcgtaaagaacctcttgat

SEQ ID NO: 934700 - DNA, 25 bp, Mus musculus
ttccccgcgtaatgaacctcttgat

SEQ ID NO: 934701 - DNA, 25 bp, Mus musculus
ttccccgctctgaaatggtggatgt

SEQ ID NO: 934702 - DNA, 25 bp, Mus musculus
ttccccgctctgtaatggtggatgt

SEQ ID NO: 934703 - DNA, 25 bp, Mus musculus
ttccccggacacctgtatgacgagg

SEQ ID NO: 934704 - DNA, 25 bp, Mus musculus
ttccccggacacgtgtatgacgagg

SEQ ID NO: 934705 - DNA, 25 bp, Mus musculus
ttccccggccatacaagaactgaaa

SEQ ID NO: 934706 - DNA, 25 bp, Mus musculus
ttccccggccattcaagaactgaaa

SEQ ID NO: 934707 - DNA, 25 bp, Mus musculus
ttccccgggaagacctggagagaat

SEQ ID NO: 934708 - DNA, 25 bp, Mus musculus
ttccccgggaagtcctggagagaat

SEQ ID NO: 934709 - DNA, 25 bp, Mus musculus
ttccccgggagaactgccagtcaaa

SEQ ID NO: 934710 - DNA, 25 bp, Mus musculus
ttccccgggagatctgccagtcaaa

SEQ ID NO: 934711 - DNA, 25 bp, Mus musculus
ttccccgggcttctaggaagaagca

SEQ ID NO: 934712 - DNA, 25 bp, Mus musculus
ttccccgggcttgtaggaagaagca

SEQ ID NO: 934713 - DNA, 25 bp, Mus musculus
ttccccggtacacagacccttgaag

SEQ ID NO: 934714 - DNA, 25 bp, Mus musculus
ttccccggtacagagacccttgaag

SEQ ID NO: 934715 - DNA, 25 bp, Mus musculus
ttccccgtgacaagtgcaccctgag

SEQ ID NO: 934716 - DNA, 25 bp, Mus musculus
ttccccgtgacatgtgcaccctgag

SEQ ID NO: 934717 - DNA, 25 bp, Mus musculus
ttccccgtggtacagagtatgcttt

SEQ ID NO: 934718 - DNA, 25 bp, Mus musculus
ttccccgtggtagagagtatgcttt

SEQ ID NO: 934719 - DNA, 25 bp, Mus musculus
ttccccgtggttacatctaggattg

SEQ ID NO: 934720 - DNA, 25 bp, Mus musculus
ttccccgtggtttcatctaggattg

SEQ ID NO: 934721 - DNA, 25 bp, Mus musculus
ttccccgtgtctaatctgtagactt

SEQ ID NO: 934722 - DNA, 25 bp, Mus musculus
ttccccgtgtcttatctgtagactt

SEQ ID NO: 934723 - DNA, 25 bp, Mus musculus
ttccccgttccaagaattcgcggat

SEQ ID NO: 934724 - DNA, 25 bp, Mus musculus
ttccccgttccatgaattcgcggat

SEQ ID NO: 934725 - DNA, 25 bp, Mus musculus
ttccccgttgagcattgtattgctg

SEQ ID NO: 934726 - DNA, 25 bp, Mus musculus
ttccccgttgaggattgtattgctg

SEQ ID NO: 934727 - DNA, 25 bp, Mus musculus
ttccccgttggcctgcttggtgaca

SEQ ID NO: 934728 - DNA, 25 bp, Mus musculus
ttccccgttggcgtgcttggtgaca

SEQ ID NO: 934729 - DNA, 25 bp, Mus musculus
ttccccgtttagctttgaggcatga

SEQ ID NO: 934730 - DNA, 25 bp, Mus musculus
ttccccgtttaggtttgaggcatga

SEQ ID NO: 934731 - DNA, 25 bp, Mus musculus
ttcccctaaaaaattcaatgagaat

SEQ ID NO: 934732 - DNA, 25 bp, Mus musculus
ttcccctaaaaatttcaatgagaat

SEQ ID NO: 934733 - DNA, 25 bp, Mus musculus
ttcccctaaataattgattcccctg

SEQ ID NO: 934734 - DNA, 25 bp, Mus musculus
ttcccctaaatatttgattcccctg

SEQ ID NO: 934735 - DNA, 25 bp, Mus musculus
ttcccctaactcctaataaaggcag

SEQ ID NO: 934736 - DNA, 25 bp, Mus musculus
ttcccctaactcgtaataaaggcag

SEQ ID NO: 934737 - DNA, 25 bp, Mus musculus
ttcccctaagcgcttcctgggagaa

SEQ ID NO: 934738 - DNA, 25 bp, Mus musculus
ttcccctaagcggttcctgggagaa

SEQ ID NO: 934739 - DNA, 25 bp, Mus musculus
ttcccctacctgattgcttgtcaaa

SEQ ID NO: 934740 - DNA, 25 bp, Mus musculus
ttcccctacctgcatatgtatgcag

SEQ ID NO: 934741 - DNA, 25 bp, Mus musculus
ttcccctacctggatatgtatgcag

SEQ ID NO: 934742 - DNA, 25 bp, Mus musculus
ttcccctacctgtttgcttgtcaaa

SEQ ID NO: 934743 - DNA, 25 bp, Mus musculus
ttcccctagatgctggagaaagcct

SEQ ID NO: 934744 - DNA, 25 bp, Mus musculus
ttcccctagatggtggagaaagcct

SEQ ID NO: 934745 - DNA, 25 bp, Mus musculus
ttcccctagcctcgtttgttccgtg

SEQ ID NO: 934746 - DNA, 25 bp, Mus musculus
ttcccctagcctggtttgttccgtg

SEQ ID NO: 934747 - DNA, 25 bp, Mus musculus
ttcccctagcttagtgctcttgatt

SEQ ID NO: 934748 - DNA, 25 bp, Mus musculus
ttcccctagctttgtgctcttgatt

SEQ ID NO: 934749 - DNA, 25 bp, Mus musculus
ttcccctagtgcagttctgaacaaa

SEQ ID NO: 934750 - DNA, 25 bp, Mus musculus
ttcccctagtgctgttctgaacaaa

SEQ ID NO: 934751 - DNA, 25 bp, Mus musculus
ttcccctataagaactgcaagacgg

SEQ ID NO: 934752 - DNA, 25 bp, Mus musculus
ttcccctataagtactgcaagacgg

SEQ ID NO: 934753 - DNA, 25 bp, Mus musculus
ttcccctatcctattaatattcttg

SEQ ID NO: 934754 - DNA, 25 bp, Mus musculus
ttcccctatccttttaatattcttg

SEQ ID NO: 934755 - DNA, 25 bp, Mus musculus
ttcccctatgtaaagctgagaaata

SEQ ID NO: 934756 - DNA, 25 bp, Mus musculus
ttcccctatgtaagatccttttcca

SEQ ID NO: 934757 - DNA, 25 bp, Mus musculus
ttcccctatgtatagctgagaaata

SEQ ID NO: 934758 - DNA, 25 bp, Mus musculus
ttcccctatgtatgatccttttcca

SEQ ID NO: 934759 - DNA, 25 bp, Mus musculus
ttcccctcaaagattcaaatgttca

SEQ ID NO: 934760 - DNA, 25 bp, Mus musculus
ttcccctcaaagcaaatctctcaag

SEQ ID NO: 934761 - DNA, 25 bp, Mus musculus
ttcccctcaaaggaaatctctcaag

SEQ ID NO: 934762 - DNA, 25 bp, Mus musculus
ttcccctcaaagtttcaaatgttca

SEQ ID NO: 934763 - DNA, 25 bp, Mus musculus
ttcccctcaagaacaagagcaggac

SEQ ID NO: 934764 - DNA, 25 bp, Mus musculus
ttcccctcaagatcaagagcaggac

SEQ ID NO: 934765 - DNA, 25 bp, Mus musculus
ttcccctcacgtcgtagggatgcag

SEQ ID NO: 934766 - DNA, 25 bp, Mus musculus
ttcccctcacgtggtagggatgcag

SEQ ID NO: 934767 - DNA, 25 bp, Mus musculus
ttcccctcagacctaagttcataat

SEQ ID NO: 934768 - DNA, 25 bp, Mus musculus
ttcccctcagacgtaagttcataat

SEQ ID NO: 934769 - DNA, 25 bp, Mus musculus
ttcccctcagctccatagttgtata

SEQ ID NO: 934770 - DNA, 25 bp, Mus musculus
ttcccctcagctgcatagttgtata

SEQ ID NO: 934771 - DNA, 25 bp, Mus musculus
ttcccctcatgccatacacaataaa

SEQ ID NO: 934772 - DNA, 25 bp, Mus musculus
ttcccctcatgcgatacacaataaa

SEQ ID NO: 934773 - DNA, 25 bp, Mus musculus
ttcccctccaagcaacagaaatctt

SEQ ID NO: 934774 - DNA, 25 bp, Mus musculus
ttcccctccaaggaacagaaatctt

SEQ ID NO: 934775 - DNA, 25 bp, Mus musculus
ttcccctccatactacagatttcta

SEQ ID NO: 934776 - DNA, 25 bp, Mus musculus
ttcccctccatagtacagatttcta

SEQ ID NO: 934777 - DNA, 25 bp, Mus musculus
ttcccctcctccaaaagtcaaggtg

SEQ ID NO: 934778 - DNA, 25 bp, Mus musculus
ttcccctcctcctaaagtcaaggtg

SEQ ID NO: 934779 - DNA, 25 bp, Mus musculus
ttcccctcctctatgtggagtcatt

SEQ ID NO: 934780 - DNA, 25 bp, Mus musculus
ttcccctcctctttgtggagtcatt

SEQ ID NO: 934781 - DNA, 25 bp, Mus musculus
ttcccctcggagaccacaatggaga

SEQ ID NO: 934782 - DNA, 25 bp, Mus musculus
ttcccctcggagtccacaatggaga

SEQ ID NO: 934783 - DNA, 25 bp, Mus musculus
ttcccctcggtaactgtatgatttt

SEQ ID NO: 934784 - DNA, 25 bp, Mus musculus
ttcccctcggtatctgtatgatttt

SEQ ID NO: 934785 - DNA, 25 bp, Mus musculus
ttcccctcgtgcatgtagatctgaa

SEQ ID NO: 934786 - DNA, 25 bp, Mus musculus
ttcccctcgtgcttgtagatctgaa

SEQ ID NO: 934787 - DNA, 25 bp, Mus musculus
ttcccctcgttcagaaatcacttgg

SEQ ID NO: 934788 - DNA, 25 bp, Mus musculus
ttcccctcgttctgaaatcacttgg

SEQ ID NO: 934789 - DNA, 25 bp, Mus musculus
ttcccctctaatatcaaaacgctga

SEQ ID NO: 934790 - DNA, 25 bp, Mus musculus
ttcccctctaatttcaaaacgctga

SEQ ID NO: 934791 - DNA, 25 bp, Mus musculus
ttcccctcttcaagatatctttaaa

SEQ ID NO: 934792 - DNA, 25 bp, Mus musculus
ttcccctcttcaatcaggttgtttg

SEQ ID NO: 934793 - DNA, 25 bp, Mus musculus
ttcccctcttcatgatatctttaaa

SEQ ID NO: 934794 - DNA, 25 bp, Mus musculus
ttcccctcttcattcaggttgtttg

SEQ ID NO: 934795 - DNA, 25 bp, Mus musculus
ttcccctcttccatctggtagtgga

SEQ ID NO: 934796 - DNA, 25 bp, Mus musculus
ttcccctcttccttctggtagtgga

SEQ ID NO: 934797 - DNA, 25 bp, Mus musculus
ttcccctcttgcatgtattgcccta

SEQ ID NO: 934798 - DNA, 25 bp, Mus musculus
ttcccctcttgcttgtattgcccta

SEQ ID NO: 934799 - DNA, 25 bp, Mus musculus
ttcccctgaaggaactcgtagctaa

SEQ ID NO: 934800 - DNA, 25 bp, Mus musculus
ttcccctgaaggtactcgtagctaa

SEQ ID NO: 934801 - DNA, 25 bp, Mus musculus
ttcccctgacctccagatgtgggag

SEQ ID NO: 934802 - DNA, 25 bp, Mus musculus
ttcccctgacctgcagatgtgggag

SEQ ID NO: 934803 - DNA, 25 bp, Mus musculus
ttcccctgacgaacttggcttccaa

SEQ ID NO: 934804 - DNA, 25 bp, Mus musculus
ttcccctgacgatcttggcttccaa

SEQ ID NO: 934805 - DNA, 25 bp, Mus musculus
ttcccctgagctagacaagcacaag

SEQ ID NO: 934806 - DNA, 25 bp, Mus musculus
ttcccctgagcttgacaagcacaag

SEQ ID NO: 934807 - DNA, 25 bp, Mus musculus
ttcccctgaggactatgccgtggcc

SEQ ID NO: 934808 - DNA, 25 bp, Mus musculus
ttcccctgaggagtatgccgtggcc

SEQ ID NO: 934809 - DNA, 25 bp, Mus musculus
ttcccctgatgcagcactgtgatgt

SEQ ID NO: 934810 - DNA, 25 bp, Mus musculus
ttcccctgatgctgcactgtgatgt

SEQ ID NO: 934811 - DNA, 25 bp, Mus musculus
ttcccctgatggctccatccgaaaa

SEQ ID NO: 934812 - DNA, 25 bp, Mus musculus
ttcccctgatgggtccatccgaaaa

SEQ ID NO: 934813 - DNA, 25 bp, Mus musculus
ttcccctgcaaaagtggtcctagga

SEQ ID NO: 934814 - DNA, 25 bp, Mus musculus
ttcccctgcaaatgtggtcctagga

SEQ ID NO: 934815 - DNA, 25 bp, Mus musculus
ttcccctgctccatgaaagttacaa

SEQ ID NO: 934816 - DNA, 25 bp, Mus musculus
ttcccctgctccttgaaagttacaa

SEQ ID NO: 934817 - DNA, 25 bp, Mus musculus
ttcccctgctctattaaacttgaag

SEQ ID NO: 934818 - DNA, 25 bp, Mus musculus
ttcccctgctcttttaaacttgaag

SEQ ID NO: 934819 - DNA, 25 bp, Mus musculus
ttcccctgcttcaggtagtcttgca

SEQ ID NO: 934820 - DNA, 25 bp, Mus musculus
ttcccctgcttctggtagtcttgca

SEQ ID NO: 934821 - DNA, 25 bp, Mus musculus
ttcccctggagactggccctactgg

SEQ ID NO: 934822 - DNA, 25 bp, Mus musculus
ttcccctggagagtggccctactgg

SEQ ID NO: 934823 - DNA, 25 bp, Mus musculus
ttcccctggagcacagtttttattt

SEQ ID NO: 934824 - DNA, 25 bp, Mus musculus
ttcccctggagctcagtttttattt

SEQ ID NO: 934825 - DNA, 25 bp, Mus musculus
ttcccctggattcaagataccatga

SEQ ID NO: 934826 - DNA, 25 bp, Mus musculus
ttcccctggattgaagataccatga

SEQ ID NO: 934827 - DNA, 25 bp, Mus musculus
ttcccctggcccatttgactatgtg

SEQ ID NO: 934828 - DNA, 25 bp, Mus musculus
ttcccctggcccttttgactatgtg

SEQ ID NO: 934829 - DNA, 25 bp, Mus musculus
ttcccctggcttccagaggccaaag

SEQ ID NO: 934830 - DNA, 25 bp, Mus musculus
ttcccctggcttgcagaggccaaag

SEQ ID NO: 934831 - DNA, 25 bp, Mus musculus
ttcccctgggaaatgagtcattgtt

SEQ ID NO: 934832 - DNA, 25 bp, Mus musculus
ttcccctgggaattgagtcattgtt

SEQ ID NO: 934833 - DNA, 25 bp, Mus musculus
ttcccctgggtgaagcgagttcagc

SEQ ID NO: 934834 - DNA, 25 bp, Mus musculus
ttcccctgggtgtagcgagttcagc

SEQ ID NO: 934835 - DNA, 25 bp, Mus musculus
ttcccctgtacacgtaaactcttgg

SEQ ID NO: 934836 - DNA, 25 bp, Mus musculus
ttcccctgtacaggtaaactcttgg

SEQ ID NO: 934837 - DNA, 25 bp, Mus musculus
ttcccctgtcaaaggcaatgggcta

SEQ ID NO: 934838 - DNA, 25 bp, Mus musculus
ttcccctgtcaatggcaatgggcta

SEQ ID NO: 934839 - DNA, 25 bp, Mus musculus
ttcccctgtcagacgatgattgcag

SEQ ID NO: 934840 - DNA, 25 bp, Mus musculus
ttcccctgtcagtcgatgattgcag

SEQ ID NO: 934841 - DNA, 25 bp, Mus musculus
ttcccctgtcccaggtgggcagagt

SEQ ID NO: 934842 - DNA, 25 bp, Mus musculus
ttcccctgtccctggtgggcagagt

SEQ ID NO: 934843 - DNA, 25 bp, Mus musculus
ttcccctgtccgctatgtacattca

SEQ ID NO: 934844 - DNA, 25 bp, Mus musculus
ttcccctgtccggtatgtacattca

SEQ ID NO: 934845 - DNA, 25 bp, Mus musculus
ttcccctgtcctatggcgaggaact

SEQ ID NO: 934846 - DNA, 25 bp, Mus musculus
ttcccctgtcctttggcgaggaact

SEQ ID NO: 934847 - DNA, 25 bp, Mus musculus
ttcccctgtgaccagtgtttatgtt

SEQ ID NO: 934848 - DNA, 25 bp, Mus musculus
ttcccctgtgacgagtgtttatgtt

SEQ ID NO: 934849 - DNA, 25 bp, Mus musculus
ttcccctgtgcacagcctttaaaaa

SEQ ID NO: 934850 - DNA, 25 bp, Mus musculus
ttcccctgtgcagagcctttaaaaa

SEQ ID NO: 934851 - DNA, 25 bp, Mus musculus
ttcccctgtgtgcataatgtcgcag

SEQ ID NO: 934852 - DNA, 25 bp, Mus musculus
ttcccctgtgtggataatgtcgcag

SEQ ID NO: 934853 - DNA, 25 bp, Mus musculus
ttcccctgttgaattcttagtctct

SEQ ID NO: 934854 - DNA, 25 bp, Mus musculus
ttcccctgttgatttcttagtctct

SEQ ID NO: 934855 - DNA, 25 bp, Mus musculus
ttccccttaaagatatgtccacatg

SEQ ID NO: 934856 - DNA, 25 bp, Mus musculus
ttccccttaaagttatgtccacatg

SEQ ID NO: 934857 - DNA, 25 bp, Mus musculus
ttccccttaactaggtttactgatg

SEQ ID NO: 934858 - DNA, 25 bp, Mus musculus
ttccccttaacttggtttactgatg

SEQ ID NO: 934859 - DNA, 25 bp, Mus musculus
ttccccttaagtccatgccgaagag

SEQ ID NO: 934860 - DNA, 25 bp, Mus musculus
ttccccttaagtgcatgccgaagag

SEQ ID NO: 934861 - DNA, 25 bp, Mus musculus
ttccccttagcgatgacatcctgat

SEQ ID NO: 934862 - DNA, 25 bp, Mus musculus
ttccccttagcgttgacatcctgat

SEQ ID NO: 934863 - DNA, 25 bp, Mus musculus
ttccccttagtgatcaagtgttgag

SEQ ID NO: 934864 - DNA, 25 bp, Mus musculus
ttccccttagtgttcaagtgttgag

SEQ ID NO: 934865 - DNA, 25 bp, Mus musculus
ttccccttatgaagacgacgctctg

SEQ ID NO: 934866 - DNA, 25 bp, Mus musculus
ttccccttatgatgacgacgctctg

SEQ ID NO: 934867 - DNA, 25 bp, Mus musculus
ttccccttcaaaatatttagaccag

SEQ ID NO: 934868 - DNA, 25 bp, Mus musculus
ttccccttcaaattatttagaccag

SEQ ID NO: 934869 - DNA, 25 bp, Mus musculus
ttccccttcaagcatgtgttagacc

SEQ ID NO: 934870 - DNA, 25 bp, Mus musculus
ttccccttcaaggatgtgttagacc

SEQ ID NO: 934871 - DNA, 25 bp, Mus musculus
ttccccttcaccaagtttctggctt

SEQ ID NO: 934872 - DNA, 25 bp, Mus musculus
ttccccttcacctagtttctggctt

SEQ ID NO: 934873 - DNA, 25 bp, Mus musculus
ttccccttcatgaacccaagagttg

SEQ ID NO: 934874 - DNA, 25 bp, Mus musculus
ttccccttcatgatgccctgcctta

SEQ ID NO: 934875 - DNA, 25 bp, Mus musculus
ttccccttcatgtacccaagagttg

SEQ ID NO: 934876 - DNA, 25 bp, Mus musculus
ttccccttcatgttgccctgcctta

SEQ ID NO: 934877 - DNA, 25 bp, Mus musculus
ttccccttcattccatctggcattt

SEQ ID NO: 934878 - DNA, 25 bp, Mus musculus
ttccccttcattgcatctggcattt

SEQ ID NO: 934879 - DNA, 25 bp, Mus musculus
ttccccttcctgattgcttactgac

SEQ ID NO: 934880 - DNA, 25 bp, Mus musculus
ttccccttcctgtttgcttactgac

SEQ ID NO: 934881 - DNA, 25 bp, Mus musculus
ttccccttcgttaattggctaccag

SEQ ID NO: 934882 - DNA, 25 bp, Mus musculus
ttccccttcgtttattggctaccag

SEQ ID NO: 934883 - DNA, 25 bp, Mus musculus
ttccccttgcttacctagaggatga

SEQ ID NO: 934884 - DNA, 25 bp, Mus musculus
ttccccttgcttagtttggactaag

SEQ ID NO: 934885 - DNA, 25 bp, Mus musculus
ttccccttgctttcctagaggatga

SEQ ID NO: 934886 - DNA, 25 bp, Mus musculus
ttccccttgctttgtttggactaag

SEQ ID NO: 934887 - DNA, 25 bp, Mus musculus
ttccccttgttcaggatggttttag

SEQ ID NO: 934888 - DNA, 25 bp, Mus musculus
ttccccttgttctggatggttttag

SEQ ID NO: 934889 - DNA, 25 bp, Mus musculus
ttcccctttaccattctgagctttt

SEQ ID NO: 934890 - DNA, 25 bp, Mus musculus
ttcccctttacctttctgagctttt

SEQ ID NO: 934891 - DNA, 25 bp, Mus musculus
ttcccctttactacatatcagctat

SEQ ID NO: 934892 - DNA, 25 bp, Mus musculus
ttcccctttacttcatatcagctat

SEQ ID NO: 934893 - DNA, 25 bp, Mus musculus
ttcccctttgatcatgtctacactg

SEQ ID NO: 934894 - DNA, 25 bp, Mus musculus
ttcccctttgatgatgtctacactg

SEQ ID NO: 934895 - DNA, 25 bp, Mus musculus
ttcccctttgcccagagacccaaag

SEQ ID NO: 934896 - DNA, 25 bp, Mus musculus
ttcccctttgccgagagacccaaag

SEQ ID NO: 934897 - DNA, 25 bp, Mus musculus
ttcccctttgctatcatcttgaaat

SEQ ID NO: 934898 - DNA, 25 bp, Mus musculus
ttcccctttgctttcatcttgaaat

SEQ ID NO: 934899 - DNA, 25 bp, Mus musculus
ttccccttttccatgcagcatattt

SEQ ID NO: 934900 - DNA, 25 bp, Mus musculus
ttccccttttccttgcagcatattt

SEQ ID NO: 934901 - DNA, 25 bp, Mus musculus
ttcccgaactctcagccaaaagcga

SEQ ID NO: 934902 - DNA, 25 bp, Mus musculus
ttcccgaactctgagccaaaagcga

SEQ ID NO: 934903 - DNA, 25 bp, Mus musculus
ttcccgaaggctattgttgaaggat

SEQ ID NO: 934904 - DNA, 25 bp, Mus musculus
ttcccgaaggcttttgttgaaggat

SEQ ID NO: 934905 - DNA, 25 bp, Mus musculus
ttcccgagagccagacaaattgcta

SEQ ID NO: 934906 - DNA, 25 bp, Mus musculus
ttcccgagagcctgacaaattgcta

SEQ ID NO: 934907 - DNA, 25 bp, Mus musculus
ttcccgagatacagtaaagaatata

SEQ ID NO: 934908 - DNA, 25 bp, Mus musculus
ttcccgagatactgtaaagaatata

SEQ ID NO: 934909 - DNA, 25 bp, Mus musculus
ttcccgagcatacggcttttctcca

SEQ ID NO: 934910 - DNA, 25 bp, Mus musculus
ttcccgagcatagggcttttctcca

SEQ ID NO: 934911 - DNA, 25 bp, Mus musculus
ttcccgagctgcagttgatgctggc

SEQ ID NO: 934912 - DNA, 25 bp, Mus musculus
ttcccgagctgctgttgatgctggc

SEQ ID NO: 934913 - DNA, 25 bp, Mus musculus
ttcccgagctggcactgctaggtgt

SEQ ID NO: 934914 - DNA, 25 bp, Mus musculus
ttcccgagctgggactgctaggtgt

SEQ ID NO: 934915 - DNA, 25 bp, Mus musculus
ttcccgaggaacatttatttggagt

SEQ ID NO: 934916 - DNA, 25 bp, Mus musculus
ttcccgaggaacttttatttggagt

SEQ ID NO: 934917 - DNA, 25 bp, Mus musculus
ttcccgaggaggagtggagcatcca

SEQ ID NO: 934918 - DNA, 25 bp, Mus musculus
ttcccgaggaggtgtggagcatcca

SEQ ID NO: 934919 - DNA, 25 bp, Mus musculus
ttcccgaggcctaggtcttaaggag

SEQ ID NO: 934920 - DNA, 25 bp, Mus musculus
ttcccgaggccttggtcttaaggag

SEQ ID NO: 934921 - DNA, 25 bp, Mus musculus
ttcccgaggctcaacaatttacact

SEQ ID NO: 934922 - DNA, 25 bp, Mus musculus
ttcccgaggctctacaatttacact

SEQ ID NO: 934923 - DNA, 25 bp, Mus musculus
ttcccgaggctgaacagcatttatt

SEQ ID NO: 934924 - DNA, 25 bp, Mus musculus
ttcccgaggctgtacagcatttatt

SEQ ID NO: 934925 - DNA, 25 bp, Mus musculus
ttcccgagtacaccacctttgacgt

SEQ ID NO: 934926 - DNA, 25 bp, Mus musculus
ttcccgagtacagcacctttgacgt

SEQ ID NO: 934927 - DNA, 25 bp, Mus musculus
ttcccgagtctaaaagcttgcttca

SEQ ID NO: 934928 - DNA, 25 bp, Mus musculus
ttcccgagtctataagcttgcttca

SEQ ID NO: 934929 - DNA, 25 bp, Mus musculus
ttcccgagtctcagaagcttattga

SEQ ID NO: 934930 - DNA, 25 bp, Mus musculus
ttcccgagtctctgaagcttattga

SEQ ID NO: 934931 - DNA, 25 bp, Mus musculus
ttcccgagtgcacggctgtctgcgt

SEQ ID NO: 934932 - DNA, 25 bp, Mus musculus
ttcccgagtgcagggctgtctgcgt

SEQ ID NO: 934933 - DNA, 25 bp, Mus musculus
ttcccgagtttcagctatcatcaga

SEQ ID NO: 934934 - DNA, 25 bp, Mus musculus
ttcccgagtttctgctatcatcaga

SEQ ID NO: 934935 - DNA, 25 bp, Mus musculus
ttcccgatatgtcttagacacccca

SEQ ID NO: 934936 - DNA, 25 bp, Mus musculus
ttcccgatatgtgttagacacccca

SEQ ID NO: 934937 - DNA, 25 bp, Mus musculus
ttcccgatccagatccagacacagg

SEQ ID NO: 934938 - DNA, 25 bp, Mus musculus
ttcccgatccagttccagacacagg

SEQ ID NO: 934939 - DNA, 25 bp, Mus musculus
ttcccgattgagcatgccccagggt

SEQ ID NO: 934940 - DNA, 25 bp, Mus musculus
ttcccgattgaggatgccccagggt

SEQ ID NO: 934941 - DNA, 25 bp, Mus musculus
ttcccgattgcccatgtacatagat

SEQ ID NO: 934942 - DNA, 25 bp, Mus musculus
ttcccgattgccgatgtacatagat

SEQ ID NO: 934943 - DNA, 25 bp, Mus musculus
ttcccgattgttcaatattaatgga

SEQ ID NO: 934944 - DNA, 25 bp, Mus musculus
ttcccgattgttgaatattaatgga

SEQ ID NO: 934945 - DNA, 25 bp, Mus musculus
ttcccgcagatcagcagtgtcaagg

SEQ ID NO: 934946 - DNA, 25 bp, Mus musculus
ttcccgcagatctgcagtgtcaagg

SEQ ID NO: 934947 - DNA, 25 bp, Mus musculus
ttcccgcagccaaattgtattttgt

SEQ ID NO: 934948 - DNA, 25 bp, Mus musculus
ttcccgcagccatattgtattttgt

SEQ ID NO: 934949 - DNA, 25 bp, Mus musculus
ttcccgcatacaagtcagcacagct

SEQ ID NO: 934950 - DNA, 25 bp, Mus musculus
ttcccgcatacatgtcagcacagct

SEQ ID NO: 934951 - DNA, 25 bp, Mus musculus
ttcccgccctcgactatggtggcgg

SEQ ID NO: 934952 - DNA, 25 bp, Mus musculus
ttcccgccctcgtctatggtggcgg

SEQ ID NO: 934953 - DNA, 25 bp, Mus musculus
ttcccgcctagaaaggcatccaaga

SEQ ID NO: 934954 - DNA, 25 bp, Mus musculus
ttcccgcctagataggcatccaaga

SEQ ID NO: 934955 - DNA, 25 bp, Mus musculus
ttcccgcctctgatcttagaagtat

SEQ ID NO: 934956 - DNA, 25 bp, Mus musculus
ttcccgcctctgttcttagaagtat

SEQ ID NO: 934957 - DNA, 25 bp, Mus musculus
ttcccgcgaactccggagattagaa

SEQ ID NO: 934958 - DNA, 25 bp, Mus musculus
ttcccgcgaactgcggagattagaa

SEQ ID NO: 934959 - DNA, 25 bp, Mus musculus
ttcccgcggcggatggtaacagact

SEQ ID NO: 934960 - DNA, 25 bp, Mus musculus
ttcccgcggcggttggtaacagact

SEQ ID NO: 934961 - DNA, 25 bp, Mus musculus
ttcccgctggaaaagcgcgtaccct

SEQ ID NO: 934962 - DNA, 25 bp, Mus musculus
ttcccgctggaatagcgcgtaccct

SEQ ID NO: 934963 - DNA, 25 bp, Mus musculus
ttcccgctttacaagtgttaaccat

SEQ ID NO: 934964 - DNA, 25 bp, Mus musculus
ttcccgctttactagtgttaaccat

SEQ ID NO: 934965 - DNA, 25 bp, Mus musculus
ttcccgctttcgcttaagatttaca

SEQ ID NO: 934966 - DNA, 25 bp, Mus musculus
ttcccgctttcggttaagatttaca

SEQ ID NO: 934967 - DNA, 25 bp, Mus musculus
ttcccggagaaacgtaagctaagct

SEQ ID NO: 934968 - DNA, 25 bp, Mus musculus
ttcccggagaaaggtaagctaagct

SEQ ID NO: 934969 - DNA, 25 bp, Mus musculus
ttcccggagatacaggttgctttga

SEQ ID NO: 934970 - DNA, 25 bp, Mus musculus
ttcccggagatagaggttgctttga

SEQ ID NO: 934971 - DNA, 25 bp, Mus musculus
ttcccggatctcattttacttcaca

SEQ ID NO: 934972 - DNA, 25 bp, Mus musculus
ttcccggatctctttttacttcaca

SEQ ID NO: 934973 - DNA, 25 bp, Mus musculus
ttcccggatgctaattgtaccctac

SEQ ID NO: 934974 - DNA, 25 bp, Mus musculus
ttcccggatgcttattgtaccctac

SEQ ID NO: 934975 - DNA, 25 bp, Mus musculus
ttcccggcaggcaaatcagatacct

SEQ ID NO: 934976 - DNA, 25 bp, Mus musculus
ttcccggcaggctaatcagatacct

SEQ ID NO: 934977 - DNA, 25 bp, Mus musculus
ttcccggcagtgagtacatgaggat

SEQ ID NO: 934978 - DNA, 25 bp, Mus musculus
ttcccggcagtgtgtacatgaggat

SEQ ID NO: 934979 - DNA, 25 bp, Mus musculus
ttcccggccatcatgaaaagcactt

SEQ ID NO: 934980 - DNA, 25 bp, Mus musculus
ttcccggccatcttgaaaagcactt

SEQ ID NO: 934981 - DNA, 25 bp, Mus musculus
ttcccggcgctacacagtgaggaag

SEQ ID NO: 934982 - DNA, 25 bp, Mus musculus
ttcccggcgctagacagtgaggaag

SEQ ID NO: 934983 - DNA, 25 bp, Mus musculus
ttcccggctccaaaggtgatcacta

SEQ ID NO: 934984 - DNA, 25 bp, Mus musculus
ttcccggctccataggtgatcacta

SEQ ID NO: 934985 - DNA, 25 bp, Mus musculus
ttcccggctcggagctgagtgaagc

SEQ ID NO: 934986 - DNA, 25 bp, Mus musculus
ttcccggctcggtgctgagtgaagc

SEQ ID NO: 934987 - DNA, 25 bp, Mus musculus
ttcccgggaggaaagcgcatgtgca

SEQ ID NO: 934988 - DNA, 25 bp, Mus musculus
ttcccgggaggatagcgcatgtgca

SEQ ID NO: 934989 - DNA, 25 bp, Mus musculus
ttcccgggagggacacactgaagtg

SEQ ID NO: 934990 - DNA, 25 bp, Mus musculus
ttcccgggagggtcacactgaagtg

SEQ ID NO: 934991 - DNA, 25 bp, Mus musculus
ttcccgggatagaggtgacagtcaa

SEQ ID NO: 934992 - DNA, 25 bp, Mus musculus
ttcccgggatagtggtgacagtcaa

SEQ ID NO: 934993 - DNA, 25 bp, Mus musculus
ttcccgggtattatcatacgttgca

SEQ ID NO: 934994 - DNA, 25 bp, Mus musculus
ttcccgggtattttcatacgttgca

SEQ ID NO: 934995 - DNA, 25 bp, Mus musculus
ttcccgggtccactaaagcaaacag

SEQ ID NO: 934996 - DNA, 25 bp, Mus musculus
ttcccgggtccagtaaagcaaacag

SEQ ID NO: 934997 - DNA, 25 bp, Mus musculus
ttcccggtacatacaccattctcaa

SEQ ID NO: 934998 - DNA, 25 bp, Mus musculus
ttcccggtacattcaccattctcaa

SEQ ID NO: 934999 - DNA, 25 bp, Mus musculus
ttcccggtatgtaagcattttcctt

SEQ ID NO: 935000 - DNA, 25 bp, Mus musculus
ttcccggtatgttagcattttcctt

SEQ ID NO: 935001 - DNA, 25 bp, Mus musculus
ttcccggtgattagttggcaggttc

SEQ ID NO: 935002 - DNA, 25 bp, Mus musculus
ttcccggtgatttgttggcaggttc

SEQ ID NO: 935003 - DNA, 25 bp, Mus musculus
ttcccggtgctgattacctatgaca

SEQ ID NO: 935004 - DNA, 25 bp, Mus musculus
ttcccggtgctgtttacctatgaca

SEQ ID NO: 935005 - DNA, 25 bp, Mus musculus
ttcccggtgtgtcttgagcatcaca

SEQ ID NO: 935006 - DNA, 25 bp, Mus musculus
ttcccggtgtgtgttgagcatcaca

SEQ ID NO: 935007 - DNA, 25 bp, Mus musculus
ttcccggttatcaccatcttaagaa

SEQ ID NO: 935008 - DNA, 25 bp, Mus musculus
ttcccggttatctccatcttaagaa

SEQ ID NO: 935009 - DNA, 25 bp, Mus musculus
ttcccgtacagaaacaagcagcagg

SEQ ID NO: 935010 - DNA, 25 bp, Mus musculus
ttcccgtacagatacaagcagcagg

SEQ ID NO: 935011 - DNA, 25 bp, Mus musculus
ttcccgtcacaccttttatgggtag

SEQ ID NO: 935012 - DNA, 25 bp, Mus musculus
ttcccgtcacacgttttatgggtag

SEQ ID NO: 935013 - DNA, 25 bp, Mus musculus
ttcccgtccaggatacaaggcagct

SEQ ID NO: 935014 - DNA, 25 bp, Mus musculus
ttcccgtccaggttacaaggcagct

SEQ ID NO: 935015 - DNA, 25 bp, Mus musculus
ttcccgtcgccaagaagtggatgtt

SEQ ID NO: 935016 - DNA, 25 bp, Mus musculus
ttcccgtcgccatgaagtggatgtt

SEQ ID NO: 935017 - DNA, 25 bp, Mus musculus
ttcccgtgaacgacagctcggccat

SEQ ID NO: 935018 - DNA, 25 bp, Mus musculus
ttcccgtgaacgtcagctcggccat

SEQ ID NO: 935019 - DNA, 25 bp, Mus musculus
ttcccgtgagtcaaataggcttttt

SEQ ID NO: 935020 - DNA, 25 bp, Mus musculus
ttcccgtgagtcatagaggtctggg

SEQ ID NO: 935021 - DNA, 25 bp, Mus musculus
ttcccgtgagtctaataggcttttt

SEQ ID NO: 935022 - DNA, 25 bp, Mus musculus
ttcccgtgagtcttagaggtctggg

SEQ ID NO: 935023 - DNA, 25 bp, Mus musculus
ttcccgtggccacgacactgctgta

SEQ ID NO: 935024 - DNA, 25 bp, Mus musculus
ttcccgtggccacgttggcacatta

SEQ ID NO: 935025 - DNA, 25 bp, Mus musculus
ttcccgtggccaggacactgctgta

SEQ ID NO: 935026 - DNA, 25 bp, Mus musculus
ttcccgtggccaggttggcacatta

SEQ ID NO: 935027 - DNA, 25 bp, Mus musculus
ttcccgtgggacaagaggccctcat

SEQ ID NO: 935028 - DNA, 25 bp, Mus musculus
ttcccgtgggactagaggccctcat

SEQ ID NO: 935029 - DNA, 25 bp, Mus musculus
ttcccgtgtgcaagtgagcgtgtga

SEQ ID NO: 935030 - DNA, 25 bp, Mus musculus
ttcccgtgtgcatgtgagcgtgtga

SEQ ID NO: 935031 - DNA, 25 bp, Mus musculus
ttcccgttactcctgagaacatggg

SEQ ID NO: 935032 - DNA, 25 bp, Mus musculus
ttcccgttactcgtgagaacatggg

SEQ ID NO: 935033 - DNA, 25 bp, Mus musculus
ttcccgttatttactgtctttattg

SEQ ID NO: 935034 - DNA, 25 bp, Mus musculus
ttcccgttattttctgtctttattg

SEQ ID NO: 935035 - DNA, 25 bp, Mus musculus
ttcccgttcagaagtttccttagct

SEQ ID NO: 935036 - DNA, 25 bp, Mus musculus
ttcccgttcagatgtttccttagct

SEQ ID NO: 935037 - DNA, 25 bp, Mus musculus
ttcccgttccataattgtctgttca

SEQ ID NO: 935038 - DNA, 25 bp, Mus musculus
ttcccgttccattattgtctgttca

SEQ ID NO: 935039 - DNA, 25 bp, Mus musculus
ttcccgttgagcactagaagtgtta

SEQ ID NO: 935040 - DNA, 25 bp, Mus musculus
ttcccgttgagctctagaagtgtta

SEQ ID NO: 935041 - DNA, 25 bp, Mus musculus
ttcccgttggctctatcgttcatac

SEQ ID NO: 935042 - DNA, 25 bp, Mus musculus
ttcccgttggctgtatcgttcatac

SEQ ID NO: 935043 - DNA, 25 bp, Mus musculus
ttccctaaaaggcatactgtggcat

SEQ ID NO: 935044 - DNA, 25 bp, Mus musculus
ttccctaaaagggatactgtggcat

SEQ ID NO: 935045 - DNA, 25 bp, Mus musculus
ttccctaactcaagcatttctgaat

SEQ ID NO: 935046 - DNA, 25 bp, Mus musculus
ttccctaactcatgcatttctgaat

SEQ ID NO: 935047 - DNA, 25 bp, Mus musculus
ttccctaagcttagcctcggaatgt

SEQ ID NO: 935048 - DNA, 25 bp, Mus musculus
ttccctaagctttgcctcggaatgt

SEQ ID NO: 935049 - DNA, 25 bp, Mus musculus
ttccctaaggttaccatacccagtg

SEQ ID NO: 935050 - DNA, 25 bp, Mus musculus
ttccctaaggtttccatacccagtg

SEQ ID NO: 935051 - DNA, 25 bp, Mus musculus
ttccctaatagtccatttcttatat

SEQ ID NO: 935052 - DNA, 25 bp, Mus musculus
ttccctaatagtgcatttcttatat

SEQ ID NO: 935053 - DNA, 25 bp, Mus musculus
ttccctaatctcagtctgtcttaga

SEQ ID NO: 935054 - DNA, 25 bp, Mus musculus
ttccctaatctctgtctgtcttaga

SEQ ID NO: 935055 - DNA, 25 bp, Mus musculus
ttccctaatggccaactggagactg

SEQ ID NO: 935056 - DNA, 25 bp, Mus musculus
ttccctaatggcgaactggagactg

SEQ ID NO: 935057 - DNA, 25 bp, Mus musculus
ttccctaattaccttgactttcaca

SEQ ID NO: 935058 - DNA, 25 bp, Mus musculus
ttccctaattacgttgactttcaca

SEQ ID NO: 935059 - DNA, 25 bp, Mus musculus
ttccctacatggcatagaacatagc

SEQ ID NO: 935060 - DNA, 25 bp, Mus musculus
ttccctacatgggatagaacatagc

SEQ ID NO: 935061 - DNA, 25 bp, Mus musculus
ttccctaccaagactgagcaggcgt

SEQ ID NO: 935062 - DNA, 25 bp, Mus musculus
ttccctaccaagtctgagcaggcgt

SEQ ID NO: 935063 - DNA, 25 bp, Mus musculus
ttccctaccactatgaactgttcac

SEQ ID NO: 935064 - DNA, 25 bp, Mus musculus
ttccctaccactttgaactgttcac

SEQ ID NO: 935065 - DNA, 25 bp, Mus musculus
ttccctaccagtcaaattgctagca

SEQ ID NO: 935066 - DNA, 25 bp, Mus musculus
ttccctaccagtgaaattgctagca

SEQ ID NO: 935067 - DNA, 25 bp, Mus musculus
ttccctacccaaagatcagctattt

SEQ ID NO: 935068 - DNA, 25 bp, Mus musculus
ttccctacccaatgatcagctattt

SEQ ID NO: 935069 - DNA, 25 bp, Mus musculus
ttccctaccgagatctagtagatta

SEQ ID NO: 935070 - DNA, 25 bp, Mus musculus
ttccctaccgagttctagtagatta

SEQ ID NO: 935071 - DNA, 25 bp, Mus musculus
ttccctactccaagctttgtttctt

SEQ ID NO: 935072 - DNA, 25 bp, Mus musculus
ttccctactccatgctttgtttctt

SEQ ID NO: 935073 - DNA, 25 bp, Mus musculus
ttccctactctcaaattatccttgt

SEQ ID NO: 935074 - DNA, 25 bp, Mus musculus
ttccctactctctaattatccttgt

SEQ ID NO: 935075 - DNA, 25 bp, Mus musculus
ttccctactgtacacggagaaataa

SEQ ID NO: 935076 - DNA, 25 bp, Mus musculus
ttccctactgtagacggagaaataa

SEQ ID NO: 935077 - DNA, 25 bp, Mus musculus
ttccctactgttcattgtaaagggt

SEQ ID NO: 935078 - DNA, 25 bp, Mus musculus
ttccctactgttgattgtaaagggt

SEQ ID NO: 935079 - DNA, 25 bp, Mus musculus
ttccctacttcacctagcacttcca

SEQ ID NO: 935080 - DNA, 25 bp, Mus musculus
ttccctacttcagctagcacttcca

SEQ ID NO: 935081 - DNA, 25 bp, Mus musculus
ttccctagagcaaccaactcagtgg

SEQ ID NO: 935082 - DNA, 25 bp, Mus musculus
ttccctagagcaagggcagagactg

SEQ ID NO: 935083 - DNA, 25 bp, Mus musculus
ttccctagagcatccaactcagtgg

SEQ ID NO: 935084 - DNA, 25 bp, Mus musculus
ttccctagagcatgggcagagactg

SEQ ID NO: 935085 - DNA, 25 bp, Mus musculus
ttccctagcaacaggcatggccttg

SEQ ID NO: 935086 - DNA, 25 bp, Mus musculus
ttccctagcaactggcatggccttg

SEQ ID NO: 935087 - DNA, 25 bp, Mus musculus
ttccctagcaagacggtggctattc

SEQ ID NO: 935088 - DNA, 25 bp, Mus musculus
ttccctagcaagtcggtggctattc

SEQ ID NO: 935089 - DNA, 25 bp, Mus musculus
ttccctagcagtactagtccactag

SEQ ID NO: 935090 - DNA, 25 bp, Mus musculus
ttccctagcagttctagtccactag

SEQ ID NO: 935091 - DNA, 25 bp, Mus musculus
ttccctagccaaaccttcagatata

SEQ ID NO: 935092 - DNA, 25 bp, Mus musculus
ttccctagccaatccttcagatata

SEQ ID NO: 935093 - DNA, 25 bp, Mus musculus
ttccctagctggcaatcgtcaactg

SEQ ID NO: 935094 - DNA, 25 bp, Mus musculus
ttccctagctgggaatcgtcaactg

SEQ ID NO: 935095 - DNA, 25 bp, Mus musculus
ttccctagcttcagccatgattgta

SEQ ID NO: 935096 - DNA, 25 bp, Mus musculus
ttccctagcttctgccatgattgta

SEQ ID NO: 935097 - DNA, 25 bp, Mus musculus
ttccctaggaaaagcgcgccatcag

SEQ ID NO: 935098 - DNA, 25 bp, Mus musculus
ttccctaggaaatgcgcgccatcag

SEQ ID NO: 935099 - DNA, 25 bp, Mus musculus
ttccctaggaggatatttgcttgca

SEQ ID NO: 935100 - DNA, 25 bp, Mus musculus
ttccctaggaggttatttgcttgca

SEQ ID NO: 935101 - DNA, 25 bp, Mus musculus
ttccctagggcaccttccagacaga

SEQ ID NO: 935102 - DNA, 25 bp, Mus musculus
ttccctagggcagcttccagacaga

SEQ ID NO: 935103 - DNA, 25 bp, Mus musculus
ttccctagtttcagttgtgcccttc

SEQ ID NO: 935104 - DNA, 25 bp, Mus musculus
ttccctagtttctgttgtgcccttc

SEQ ID NO: 935105 - DNA, 25 bp, Mus musculus
ttccctagtttgagttggtcagtct

SEQ ID NO: 935106 - DNA, 25 bp, Mus musculus
ttccctagtttgtgttggtcagtct

SEQ ID NO: 935107 - DNA, 25 bp, Mus musculus
ttccctatagcaaccagacggctga

SEQ ID NO: 935108 - DNA, 25 bp, Mus musculus
ttccctatagcatccagacggctga

SEQ ID NO: 935109 - DNA, 25 bp, Mus musculus
ttccctatccaacgagtccagcaat

SEQ ID NO: 935110 - DNA, 25 bp, Mus musculus
ttccctatccaaggagtccagcaat

SEQ ID NO: 935111 - DNA, 25 bp, Mus musculus
ttccctatccttccctatatgatag

SEQ ID NO: 935112 - DNA, 25 bp, Mus musculus
ttccctatccttgcctatatgatag

SEQ ID NO: 935113 - DNA, 25 bp, Mus musculus
ttccctatcgtgacttacaggtcta

SEQ ID NO: 935114 - DNA, 25 bp, Mus musculus
ttccctatcgtgtcttacaggtcta

SEQ ID NO: 935115 - DNA, 25 bp, Mus musculus
ttccctatctgtagtaaccgtaata

SEQ ID NO: 935116 - DNA, 25 bp, Mus musculus
ttccctatctgttgtaaccgtaata

SEQ ID NO: 935117 - DNA, 25 bp, Mus musculus
ttccctatctttaaagctgttaaca

SEQ ID NO: 935118 - DNA, 25 bp, Mus musculus
ttccctatcttttaagctgttaaca

SEQ ID NO: 935119 - DNA, 25 bp, Mus musculus
ttccctatgataagaaccacccttt

SEQ ID NO: 935120 - DNA, 25 bp, Mus musculus
ttccctatgatatgaaccacccttt

SEQ ID NO: 935121 - DNA, 25 bp, Mus musculus
ttccctatgtagacctagattgcct

SEQ ID NO: 935122 - DNA, 25 bp, Mus musculus
ttccctatgtagtcctagattgcct

SEQ ID NO: 935123 - DNA, 25 bp, Mus musculus
ttccctatgtgcatctgctctcaaa

SEQ ID NO: 935124 - DNA, 25 bp, Mus musculus
ttccctatgtgcttctgctctcaaa

SEQ ID NO: 935125 - DNA, 25 bp, Mus musculus
ttccctattctgattatggttgaaa

SEQ ID NO: 935126 - DNA, 25 bp, Mus musculus
ttccctattctgctatgcaggtgta

SEQ ID NO: 935127 - DNA, 25 bp, Mus musculus
ttccctattctggtatgcaggtgta

SEQ ID NO: 935128 - DNA, 25 bp, Mus musculus
ttccctattctgtttatggttgaaa

SEQ ID NO: 935129 - DNA, 25 bp, Mus musculus
ttccctatttgaataagattgccat

SEQ ID NO: 935130 - DNA, 25 bp, Mus musculus
ttccctatttgattaagattgccat

SEQ ID NO: 935131 - DNA, 25 bp, Mus musculus
ttccctatttggatgtccttataca

SEQ ID NO: 935132 - DNA, 25 bp, Mus musculus
ttccctatttggttgtccttataca

SEQ ID NO: 935133 - DNA, 25 bp, Mus musculus
ttccctcaaagcctgggttggctcc

SEQ ID NO: 935134 - DNA, 25 bp, Mus musculus
ttccctcaaagcgtgggttggctcc

SEQ ID NO: 935135 - DNA, 25 bp, Mus musculus
ttccctcaaaggcatcctgctggaa

SEQ ID NO: 935136 - DNA, 25 bp, Mus musculus
ttccctcaaagggatcctgctggaa

SEQ ID NO: 935137 - DNA, 25 bp, Mus musculus
ttccctcaaatacaattatgcgttc

SEQ ID NO: 935138 - DNA, 25 bp, Mus musculus
ttccctcaaatagaattatgcgttc

SEQ ID NO: 935139 - DNA, 25 bp, Mus musculus
ttccctcaagagctgtgtttctgtc

SEQ ID NO: 935140 - DNA, 25 bp, Mus musculus
ttccctcaagaggtgtgtttctgtc

SEQ ID NO: 935141 - DNA, 25 bp, Mus musculus
ttccctcaagatccactgattctgt

SEQ ID NO: 935142 - DNA, 25 bp, Mus musculus
ttccctcaagatgcactgattctgt

SEQ ID NO: 935143 - DNA, 25 bp, Mus musculus
ttccctcaagcccaaacgtctggga

SEQ ID NO: 935144 - DNA, 25 bp, Mus musculus
ttccctcaagccgaaacgtctggga

SEQ ID NO: 935145 - DNA, 25 bp, Mus musculus
ttccctcaaggtatcgatttggaga

SEQ ID NO: 935146 - DNA, 25 bp, Mus musculus
ttccctcaaggtttcgatttggaga

SEQ ID NO: 935147 - DNA, 25 bp, Mus musculus
ttccctcaagttagcacaagataca

SEQ ID NO: 935148 - DNA, 25 bp, Mus musculus
ttccctcaagtttgcacaagataca

SEQ ID NO: 935149 - DNA, 25 bp, Mus musculus
ttccctcacataaccaacaattctc

SEQ ID NO: 935150 - DNA, 25 bp, Mus musculus
ttccctcacatatccaacaattctc

SEQ ID NO: 935151 - DNA, 25 bp, Mus musculus
ttccctcactgactcagactgttca

SEQ ID NO: 935152 - DNA, 25 bp, Mus musculus
ttccctcactgagtcagactgttca

SEQ ID NO: 935153 - DNA, 25 bp, Mus musculus
ttccctcactgcataccttaataat

SEQ ID NO: 935154 - DNA, 25 bp, Mus musculus
ttccctcactgcttaccttaataat

SEQ ID NO: 935155 - DNA, 25 bp, Mus musculus
ttccctcactttcatgtaagccacg

SEQ ID NO: 935156 - DNA, 25 bp, Mus musculus
ttccctcactttgatgtaagccacg

SEQ ID NO: 935157 - DNA, 25 bp, Mus musculus
ttccctcagagaaactgggccccgg

SEQ ID NO: 935158 - DNA, 25 bp, Mus musculus
ttccctcagagatactgggccccgg

SEQ ID NO: 935159 - DNA, 25 bp, Mus musculus
ttccctcagagcagcagaggctgta

SEQ ID NO: 935160 - DNA, 25 bp, Mus musculus
ttccctcagagctgcagaggctgta

SEQ ID NO: 935161 - DNA, 25 bp, Mus musculus
ttccctcagccactgattctgtggg

SEQ ID NO: 935162 - DNA, 25 bp, Mus musculus
ttccctcagccagtgattctgtggg

SEQ ID NO: 935163 - DNA, 25 bp, Mus musculus
ttccctcagctgatcggtgtgacat

SEQ ID NO: 935164 - DNA, 25 bp, Mus musculus
ttccctcagctgcttgtcaaaatca

SEQ ID NO: 935165 - DNA, 25 bp, Mus musculus
ttccctcagctggttgtcaaaatca

SEQ ID NO: 935166 - DNA, 25 bp, Mus musculus
ttccctcagctgttcggtgtgacat

SEQ ID NO: 935167 - DNA, 25 bp, Mus musculus
ttccctcagggcaagcttatgcata

SEQ ID NO: 935168 - DNA, 25 bp, Mus musculus
ttccctcagggctagcttatgcata

SEQ ID NO: 935169 - DNA, 25 bp, Mus musculus
ttccctcaggtgagtgcatgcgcaa

SEQ ID NO: 935170 - DNA, 25 bp, Mus musculus
ttccctcaggtgtgtgcatgcgcaa

SEQ ID NO: 935171 - DNA, 25 bp, Mus musculus
ttccctcaggttacttgaagatttt

SEQ ID NO: 935172 - DNA, 25 bp, Mus musculus
ttccctcaggtttcttgaagatttt

SEQ ID NO: 935173 - DNA, 25 bp, Mus musculus
ttccctcatagtatattgatctgct

SEQ ID NO: 935174 - DNA, 25 bp, Mus musculus
ttccctcatagtttattgatctgct

SEQ ID NO: 935175 - DNA, 25 bp, Mus musculus
ttccctcatgaaattcctaacttgg

SEQ ID NO: 935176 - DNA, 25 bp, Mus musculus
ttccctcatgaatttcctaacttgg

SEQ ID NO: 935177 - DNA, 25 bp, Mus musculus
ttccctcatgctcgtattttttcaa

SEQ ID NO: 935178 - DNA, 25 bp, Mus musculus
ttccctcatgctggtattttttcaa

SEQ ID NO: 935179 - DNA, 25 bp, Mus musculus
ttccctcattgactcgctagtgaat

SEQ ID NO: 935180 - DNA, 25 bp, Mus musculus
ttccctcattgagtcgctagtgaat

SEQ ID NO: 935181 - DNA, 25 bp, Mus musculus
ttccctcatttaaaagctcaattaa

SEQ ID NO: 935182 - DNA, 25 bp, Mus musculus
ttccctcatttataagctcaattaa

SEQ ID NO: 935183 - DNA, 25 bp, Mus musculus
ttccctcatttgcagccaagatcgg

SEQ ID NO: 935184 - DNA, 25 bp, Mus musculus
ttccctcatttggagccaagatcgg

SEQ ID NO: 935185 - DNA, 25 bp, Mus musculus
ttccctcattttcttagtgcctatc

SEQ ID NO: 935186 - DNA, 25 bp, Mus musculus
ttccctcattttgttagtgcctatc

SEQ ID NO: 935187 - DNA, 25 bp, Mus musculus
ttccctccaacaattaactcaatca

SEQ ID NO: 935188 - DNA, 25 bp, Mus musculus
ttccctccaacatttaactcaatca

SEQ ID NO: 935189 - DNA, 25 bp, Mus musculus
ttccctccaatgacatcagcttagg

SEQ ID NO: 935190 - DNA, 25 bp, Mus musculus
ttccctccaatgtcatcagcttagg

SEQ ID NO: 935191 - DNA, 25 bp, Mus musculus
ttccctccagaaatgcagttagact

SEQ ID NO: 935192 - DNA, 25 bp, Mus musculus
ttccctccagaattgcagttagact

SEQ ID NO: 935193 - DNA, 25 bp, Mus musculus
ttccctccagagaagagctgacatg

SEQ ID NO: 935194 - DNA, 25 bp, Mus musculus
ttccctccagagtagagctgacatg

SEQ ID NO: 935195 - DNA, 25 bp, Mus musculus
ttccctccagctacaatctttagtg

SEQ ID NO: 935196 - DNA, 25 bp, Mus musculus
ttccctccagctccaaatgtaacat

SEQ ID NO: 935197 - DNA, 25 bp, Mus musculus
ttccctccagctgcaaatgtaacat

SEQ ID NO: 935198 - DNA, 25 bp, Mus musculus
ttccctccagcttcaatctttagtg

SEQ ID NO: 935199 - DNA, 25 bp, Mus musculus
ttccctccatagcaatatattataa

SEQ ID NO: 935200 - DNA, 25 bp, Mus musculus
ttccctccataggaatatattataa

SEQ ID NO: 935201 - DNA, 25 bp, Mus musculus
ttccctccatctaaggcagtgtgtg

SEQ ID NO: 935202 - DNA, 25 bp, Mus musculus
ttccctccatcttaggcagtgtgtg

SEQ ID NO: 935203 - DNA, 25 bp, Mus musculus
ttccctccatgcagaagcttgcaga

SEQ ID NO: 935204 - DNA, 25 bp, Mus musculus
ttccctccatgcctggcagtttaaa

SEQ ID NO: 935205 - DNA, 25 bp, Mus musculus
ttccctccatgcgtggcagtttaaa

SEQ ID NO: 935206 - DNA, 25 bp, Mus musculus
ttccctccatgctgaagcttgcaga

SEQ ID NO: 935207 - DNA, 25 bp, Mus musculus
ttccctccatggcatcttggtgtga

SEQ ID NO: 935208 - DNA, 25 bp, Mus musculus
ttccctccatgggatcttggtgtga

SEQ ID NO: 935209 - DNA, 25 bp, Mus musculus
ttccctcccaatcgctctgagaata

SEQ ID NO: 935210 - DNA, 25 bp, Mus musculus
ttccctcccaatggctctgagaata

SEQ ID NO: 935211 - DNA, 25 bp, Mus musculus
ttccctcccagaaaacaatgccttg

SEQ ID NO: 935212 - DNA, 25 bp, Mus musculus
ttccctcccagataacaatgccttg

SEQ ID NO: 935213 - DNA, 25 bp, Mus musculus
ttccctcccagtctgcacagaagtg

SEQ ID NO: 935214 - DNA, 25 bp, Mus musculus
ttccctcccagtgtgcacagaagtg

SEQ ID NO: 935215 - DNA, 25 bp, Mus musculus
ttccctcccataaatgaagtgaagg

SEQ ID NO: 935216 - DNA, 25 bp, Mus musculus
ttccctcccatatatgaagtgaagg

SEQ ID NO: 935217 - DNA, 25 bp, Mus musculus
ttccctcccatcactggagatgatg

SEQ ID NO: 935218 - DNA, 25 bp, Mus musculus
ttccctcccatctctggagatgatg

SEQ ID NO: 935219 - DNA, 25 bp, Mus musculus
ttccctccctcgagggaaatactgg

SEQ ID NO: 935220 - DNA, 25 bp, Mus musculus
ttccctccctcgtgggaaatactgg

SEQ ID NO: 935221 - DNA, 25 bp, Mus musculus
ttccctccctgaattatactgggat

SEQ ID NO: 935222 - DNA, 25 bp, Mus musculus
ttccctccctgatttatactgggat

SEQ ID NO: 935223 - DNA, 25 bp, Mus musculus
ttccctccctgtaagtgatccaaat

SEQ ID NO: 935224 - DNA, 25 bp, Mus musculus
ttccctccctgttagtgatccaaat

SEQ ID NO: 935225 - DNA, 25 bp, Mus musculus
ttccctcctatgatctgcttttctc

SEQ ID NO: 935226 - DNA, 25 bp, Mus musculus
ttccctcctatgttctgcttttctc

SEQ ID NO: 935227 - DNA, 25 bp, Mus musculus
ttccctcctctgacttaggatatag

SEQ ID NO: 935228 - DNA, 25 bp, Mus musculus
ttccctcctctgtcttaggatatag

SEQ ID NO: 935229 - DNA, 25 bp, Mus musculus
ttccctcctgggatggatacatctg

SEQ ID NO: 935230 - DNA, 25 bp, Mus musculus
ttccctcctgggttggatacatctg

SEQ ID NO: 935231 - DNA, 25 bp, Mus musculus
ttccctcctgtcacattgaatacat

SEQ ID NO: 935232 - DNA, 25 bp, Mus musculus
ttccctcctgtctcattgaatacat

SEQ ID NO: 935233 - DNA, 25 bp, Mus musculus
ttccctcctgtgaggcttagaatgg

SEQ ID NO: 935234 - DNA, 25 bp, Mus musculus
ttccctcctgtgtggcttagaatgg

SEQ ID NO: 935235 - DNA, 25 bp, Mus musculus
ttccctcctttgctgatatacatta

SEQ ID NO: 935236 - DNA, 25 bp, Mus musculus
ttccctcctttggtgatatacatta

SEQ ID NO: 935237 - DNA, 25 bp, Mus musculus
ttccctcgaacccaactcgtaagat

SEQ ID NO: 935238 - DNA, 25 bp, Mus musculus
ttccctcgaaccgaactcgtaagat

SEQ ID NO: 935239 - DNA, 25 bp, Mus musculus
ttccctcgggacatgatcgacttag

SEQ ID NO: 935240 - DNA, 25 bp, Mus musculus
ttccctcgggacttgatcgacttag

SEQ ID NO: 935241 - DNA, 25 bp, Mus musculus
ttccctcgtcttaggctgaagaaga

SEQ ID NO: 935242 - DNA, 25 bp, Mus musculus
ttccctcgtctttggctgaagaaga

SEQ ID NO: 935243 - DNA, 25 bp, Mus musculus
ttccctcgttttacaatgctagtgt

SEQ ID NO: 935244 - DNA, 25 bp, Mus musculus
ttccctcgtttttcaatgctagtgt

SEQ ID NO: 935245 - DNA, 25 bp, Mus musculus
ttccctctaactcctttacaagtag

SEQ ID NO: 935246 - DNA, 25 bp, Mus musculus
ttccctctaactgctttacaagtag

SEQ ID NO: 935247 - DNA, 25 bp, Mus musculus
ttccctctacttaagccagtttcat

SEQ ID NO: 935248 - DNA, 25 bp, Mus musculus
ttccctctactttagccagtttcat

SEQ ID NO: 935249 - DNA, 25 bp, Mus musculus
ttccctctagatccttactgtgaac

SEQ ID NO: 935250 - DNA, 25 bp, Mus musculus
ttccctctagatgcttactgtgaac

SEQ ID NO: 935251 - DNA, 25 bp, Mus musculus
ttccctctagcaatgtgtaacccaa

SEQ ID NO: 935252 - DNA, 25 bp, Mus musculus
ttccctctagcattgtgtaacccaa

SEQ ID NO: 935253 - DNA, 25 bp, Mus musculus
ttccctctaggccagaaacttgtat

SEQ ID NO: 935254 - DNA, 25 bp, Mus musculus
ttccctctaggcgagaaacttgtat

SEQ ID NO: 935255 - DNA, 25 bp, Mus musculus
ttccctctatttacaaccaaatcct

SEQ ID NO: 935256 - DNA, 25 bp, Mus musculus
ttccctctattttcaaccaaatcct

SEQ ID NO: 935257 - DNA, 25 bp, Mus musculus
ttccctctcatcacttttgtgaatg

SEQ ID NO: 935258 - DNA, 25 bp, Mus musculus
ttccctctcatctcttttgtgaatg

SEQ ID NO: 935259 - DNA, 25 bp, Mus musculus
ttccctctccatcgtatgggttcag

SEQ ID NO: 935260 - DNA, 25 bp, Mus musculus
ttccctctccatggtatgggttcag

SEQ ID NO: 935261 - DNA, 25 bp, Mus musculus
ttccctctcccacttaaaacggatg

SEQ ID NO: 935262 - DNA, 25 bp, Mus musculus
ttccctctcccagttaaaacggatg

SEQ ID NO: 935263 - DNA, 25 bp, Mus musculus
ttccctctccctcaaacgagggatg

SEQ ID NO: 935264 - DNA, 25 bp, Mus musculus
ttccctctccctgaaacgagggatg

SEQ ID NO: 935265 - DNA, 25 bp, Mus musculus
ttccctctctgcattttcaaataca

SEQ ID NO: 935266 - DNA, 25 bp, Mus musculus
ttccctctctgctttttcaaataca

SEQ ID NO: 935267 - DNA, 25 bp, Mus musculus
ttccctctctgtacttagacattta

SEQ ID NO: 935268 - DNA, 25 bp, Mus musculus
ttccctctctgttcttagacattta

SEQ ID NO: 935269 - DNA, 25 bp, Mus musculus
ttccctctgaagcacttaggagcta

SEQ ID NO: 935270 - DNA, 25 bp, Mus musculus
ttccctctgaaggacttaggagcta

SEQ ID NO: 935271 - DNA, 25 bp, Mus musculus
ttccctctgactaatcttgagctca

SEQ ID NO: 935272 - DNA, 25 bp, Mus musculus
ttccctctgacttatcttgagctca

SEQ ID NO: 935273 - DNA, 25 bp, Mus musculus
ttccctctgagcctgagcatcaata

SEQ ID NO: 935274 - DNA, 25 bp, Mus musculus
ttccctctgagcgtgagcatcaata

SEQ ID NO: 935275 - DNA, 25 bp, Mus musculus
ttccctctgattccaaatgatgtta

SEQ ID NO: 935276 - DNA, 25 bp, Mus musculus
ttccctctgattgcaaatgatgtta

SEQ ID NO: 935277 - DNA, 25 bp, Mus musculus
ttccctctgcggctgaactgtggag

SEQ ID NO: 935278 - DNA, 25 bp, Mus musculus
ttccctctgcgggtgaactgtggag

SEQ ID NO: 935279 - DNA, 25 bp, Mus musculus
ttccctctgctgcaggcatttaaga

SEQ ID NO: 935280 - DNA, 25 bp, Mus musculus
ttccctctgctggaggcatttaaga

SEQ ID NO: 935281 - DNA, 25 bp, Mus musculus
ttccctctgtctatgaagccatatt

SEQ ID NO: 935282 - DNA, 25 bp, Mus musculus
ttccctctgtctctattacgcaatg

SEQ ID NO: 935283 - DNA, 25 bp, Mus musculus
ttccctctgtctgtattacgcaatg

SEQ ID NO: 935284 - DNA, 25 bp, Mus musculus
ttccctctgtctttgaagccatatt

SEQ ID NO: 935285 - DNA, 25 bp, Mus musculus
ttccctctgtgcacgcctgggcgga

SEQ ID NO: 935286 - DNA, 25 bp, Mus musculus
ttccctctgtgctcgcctgggcgga

SEQ ID NO: 935287 - DNA, 25 bp, Mus musculus
ttccctctgtggagtgaagctagaa

SEQ ID NO: 935288 - DNA, 25 bp, Mus musculus
ttccctctgtggtgtgaagctagaa

SEQ ID NO: 935289 - DNA, 25 bp, Mus musculus
ttccctctgtgtaataacttccttc

SEQ ID NO: 935290 - DNA, 25 bp, Mus musculus
ttccctctgtgttataacttccttc

SEQ ID NO: 935291 - DNA, 25 bp, Mus musculus
ttccctctgttgagtgtaggactgc

SEQ ID NO: 935292 - DNA, 25 bp, Mus musculus
ttccctctgttgtgtgtaggactgc

SEQ ID NO: 935293 - DNA, 25 bp, Mus musculus
ttccctcttatgatgcttcttctgg

SEQ ID NO: 935294 - DNA, 25 bp, Mus musculus
ttccctcttatgttgcttcttctgg

SEQ ID NO: 935295 - DNA, 25 bp, Mus musculus
ttccctcttgctcctgaattcagaa

SEQ ID NO: 935296 - DNA, 25 bp, Mus musculus
ttccctcttgctgctgaattcagaa

SEQ ID NO: 935297 - DNA, 25 bp, Mus musculus
ttccctctttccatgaagtctcagt

SEQ ID NO: 935298 - DNA, 25 bp, Mus musculus
ttccctctttccttgaagtctcagt

SEQ ID NO: 935299 - DNA, 25 bp, Mus musculus
ttccctctttctctccaattaaaag

SEQ ID NO: 935300 - DNA, 25 bp, Mus musculus
ttccctctttctgtccaattaaaag

SEQ ID NO: 935301 - DNA, 25 bp, Mus musculus
ttccctctttggcttcatagaatgt

SEQ ID NO: 935302 - DNA, 25 bp, Mus musculus
ttccctctttgggttcatagaatgt

SEQ ID NO: 935303 - DNA, 25 bp, Mus musculus
ttccctgaaacccaaatatgccaag

SEQ ID NO: 935304 - DNA, 25 bp, Mus musculus
ttccctgaaaccgaaatatgccaag

SEQ ID NO: 935305 - DNA, 25 bp, Mus musculus
ttccctgaaatgcactttaccttgt

SEQ ID NO: 935306 - DNA, 25 bp, Mus musculus
ttccctgaaatggactttaccttgt

SEQ ID NO: 935307 - DNA, 25 bp, Mus musculus
ttccctgaaggcatgcgtttactcg

SEQ ID NO: 935308 - DNA, 25 bp, Mus musculus
ttccctgaaggcttgcgtttactcg

SEQ ID NO: 935309 - DNA, 25 bp, Mus musculus
ttccctgaagggaggcctggccagt

SEQ ID NO: 935310 - DNA, 25 bp, Mus musculus
ttccctgaagggtggcctggccagt

SEQ ID NO: 935311 - DNA, 25 bp, Mus musculus
ttccctgacacgatttggttgcatg

SEQ ID NO: 935312 - DNA, 25 bp, Mus musculus
ttccctgacacgttttggttgcatg

SEQ ID NO: 935313 - DNA, 25 bp, Mus musculus
ttccctgacagaagatgccagtgat

SEQ ID NO: 935314 - DNA, 25 bp, Mus musculus
ttccctgacagacctatgaaaatgt

SEQ ID NO: 935315 - DNA, 25 bp, Mus musculus
ttccctgacagagctatgaaaatgt

SEQ ID NO: 935316 - DNA, 25 bp, Mus musculus
ttccctgacagatgatgccagtgat

SEQ ID NO: 935317 - DNA, 25 bp, Mus musculus
ttccctgaccccaaaatgggagatg

SEQ ID NO: 935318 - DNA, 25 bp, Mus musculus
ttccctgaccccaggttatgaaaga

SEQ ID NO: 935319 - DNA, 25 bp, Mus musculus
ttccctgacccctaaatgggagatg

SEQ ID NO: 935320 - DNA, 25 bp, Mus musculus
ttccctgacccctggttatgaaaga

SEQ ID NO: 935321 - DNA, 25 bp, Mus musculus
ttccctgaccttagaaatagcatga

SEQ ID NO: 935322 - DNA, 25 bp, Mus musculus
ttccctgaccttcactacaaacaag

SEQ ID NO: 935323 - DNA, 25 bp, Mus musculus
ttccctgaccttgactacaaacaag

SEQ ID NO: 935324 - DNA, 25 bp, Mus musculus
ttccctgacctttgaaatagcatga

SEQ ID NO: 935325 - DNA, 25 bp, Mus musculus
ttccctgacttgctgctcacaggca

SEQ ID NO: 935326 - DNA, 25 bp, Mus musculus
ttccctgacttggtgctcacaggca

SEQ ID NO: 935327 - DNA, 25 bp, Mus musculus
ttccctgagcatacaatccctggat

SEQ ID NO: 935328 - DNA, 25 bp, Mus musculus
ttccctgagcattcaatccctggat

SEQ ID NO: 935329 - DNA, 25 bp, Mus musculus
ttccctgagcgaaaacatccttggc

SEQ ID NO: 935330 - DNA, 25 bp, Mus musculus
ttccctgagcgataacatccttggc

SEQ ID NO: 935331 - DNA, 25 bp, Mus musculus
ttccctgagcttccctgataacaag

SEQ ID NO: 935332 - DNA, 25 bp, Mus musculus
ttccctgagcttctcacagaacaca

SEQ ID NO: 935333 - DNA, 25 bp, Mus musculus
ttccctgagcttgcctgataacaag

SEQ ID NO: 935334 - DNA, 25 bp, Mus musculus
ttccctgagcttgtcacagaacaca

SEQ ID NO: 935335 - DNA, 25 bp, Mus musculus
ttccctgaggcactttcagtctagt

SEQ ID NO: 935336 - DNA, 25 bp, Mus musculus
ttccctgaggcagtttcagtctagt

SEQ ID NO: 935337 - DNA, 25 bp, Mus musculus
ttccctgaggtactttactgtgatc

SEQ ID NO: 935338 - DNA, 25 bp, Mus musculus
ttccctgaggtagtttactgtgatc

SEQ ID NO: 935339 - DNA, 25 bp, Mus musculus
ttccctgagtagagatctgcccagg

SEQ ID NO: 935340 - DNA, 25 bp, Mus musculus
ttccctgagtagtgatctgcccagg

SEQ ID NO: 935341 - DNA, 25 bp, Mus musculus
ttccctgatcctcacttagtgttga

SEQ ID NO: 935342 - DNA, 25 bp, Mus musculus
ttccctgatcctgacttagtgttga

SEQ ID NO: 935343 - DNA, 25 bp, Mus musculus
ttccctgatgatccatcctccttag

SEQ ID NO: 935344 - DNA, 25 bp, Mus musculus
ttccctgatgatgcatcctccttag

SEQ ID NO: 935345 - DNA, 25 bp, Mus musculus
ttccctgatgcactggtctgcagta

SEQ ID NO: 935346 - DNA, 25 bp, Mus musculus
ttccctgatgcagtggtctgcagta

SEQ ID NO: 935347 - DNA, 25 bp, Mus musculus
ttccctgatgccaaaggattcttag

SEQ ID NO: 935348 - DNA, 25 bp, Mus musculus
ttccctgatgcctaaggattcttag

SEQ ID NO: 935349 - DNA, 25 bp, Mus musculus
ttccctgcaaaccttttacattacg

SEQ ID NO: 935350 - DNA, 25 bp, Mus musculus
ttccctgcaaacgttttacattacg

SEQ ID NO: 935351 - DNA, 25 bp, Mus musculus
ttccctgcaaatcagtgttgactgt

SEQ ID NO: 935352 - DNA, 25 bp, Mus musculus
ttccctgcaaatgagtgttgactgt

SEQ ID NO: 935353 - DNA, 25 bp, Mus musculus
ttccctgcacgtcctggagaagagc

SEQ ID NO: 935354 - DNA, 25 bp, Mus musculus
ttccctgcacgtgctggagaagagc

SEQ ID NO: 935355 - DNA, 25 bp, Mus musculus
ttccctgcagctctactagctgaga

SEQ ID NO: 935356 - DNA, 25 bp, Mus musculus
ttccctgcagctgtactagctgaga

SEQ ID NO: 935357 - DNA, 25 bp, Mus musculus
ttccctgcatccatgacagtgcttg

SEQ ID NO: 935358 - DNA, 25 bp, Mus musculus
ttccctgcatccttgacagtgcttg

SEQ ID NO: 935359 - DNA, 25 bp, Mus musculus
ttccctgcattgcagacctttggac

SEQ ID NO: 935360 - DNA, 25 bp, Mus musculus
ttccctgcattggagacctttggac

SEQ ID NO: 935361 - DNA, 25 bp, Mus musculus
ttccctgccaataggttcctgtgtt

SEQ ID NO: 935362 - DNA, 25 bp, Mus musculus
ttccctgccaattggttcctgtgtt

SEQ ID NO: 935363 - DNA, 25 bp, Mus musculus
ttccctgccaggacagacccatgta

SEQ ID NO: 935364 - DNA, 25 bp, Mus musculus
ttccctgccaggtcagacccatgta

SEQ ID NO: 935365 - DNA, 25 bp, Mus musculus
ttccctgccagtattcatagaccag

SEQ ID NO: 935366 - DNA, 25 bp, Mus musculus
ttccctgccagttttcatagaccag

SEQ ID NO: 935367 - DNA, 25 bp, Mus musculus
ttccctgccgaaccttgccaatgtg

SEQ ID NO: 935368 - DNA, 25 bp, Mus musculus
ttccctgccgaagcttgccaatgtg

SEQ ID NO: 935369 - DNA, 25 bp, Mus musculus
ttccctgcctaacttgaacagtgct

SEQ ID NO: 935370 - DNA, 25 bp, Mus musculus
ttccctgcctaagttgaacagtgct

SEQ ID NO: 935371 - DNA, 25 bp, Mus musculus
ttccctgctcacaaaatgactattg

SEQ ID NO: 935372 - DNA, 25 bp, Mus musculus
ttccctgctcactaaatgactattg

SEQ ID NO: 935373 - DNA, 25 bp, Mus musculus
ttccctgctggaataagcctgcttt

SEQ ID NO: 935374 - DNA, 25 bp, Mus musculus
ttccctgctggattaagcctgcttt

SEQ ID NO: 935375 - DNA, 25 bp, Mus musculus
ttccctgctgttaatttgctaagca

SEQ ID NO: 935376 - DNA, 25 bp, Mus musculus
ttccctgctgtttatttgctaagca

SEQ ID NO: 935377 - DNA, 25 bp, Mus musculus
ttccctgctttcatcctaaaggttc

SEQ ID NO: 935378 - DNA, 25 bp, Mus musculus
ttccctgctttcttcctaaaggttc

SEQ ID NO: 935379 - DNA, 25 bp, Mus musculus
ttccctggaagaaggaactgacaag

SEQ ID NO: 935380 - DNA, 25 bp, Mus musculus
ttccctggaagatggaactgacaag

SEQ ID NO: 935381 - DNA, 25 bp, Mus musculus
ttccctggaattcattgctccacgc

SEQ ID NO: 935382 - DNA, 25 bp, Mus musculus
ttccctggaattgattgctccacgc

SEQ ID NO: 935383 - DNA, 25 bp, Mus musculus
ttccctggacagattaatgtgcata

SEQ ID NO: 935384 - DNA, 25 bp, Mus musculus
ttccctggacagtttaatgtgcata

SEQ ID NO: 935385 - DNA, 25 bp, Mus musculus
ttccctggaccacagttttggccag

SEQ ID NO: 935386 - DNA, 25 bp, Mus musculus
ttccctggaccagagttttggccag

SEQ ID NO: 935387 - DNA, 25 bp, Mus musculus
ttccctggagacaaagttgctctgt

SEQ ID NO: 935388 - DNA, 25 bp, Mus musculus
ttccctggagacaacagtggtccca

SEQ ID NO: 935389 - DNA, 25 bp, Mus musculus
ttccctggagactaagttgctctgt

SEQ ID NO: 935390 - DNA, 25 bp, Mus musculus
ttccctggagactacagtggtccca

SEQ ID NO: 935391 - DNA, 25 bp, Mus musculus
ttccctggagctctgtgtaatggcc

SEQ ID NO: 935392 - DNA, 25 bp, Mus musculus
ttccctggagctgtgtgtaatggcc

SEQ ID NO: 935393 - DNA, 25 bp, Mus musculus
ttccctggaggaaacttggctgtca

SEQ ID NO: 935394 - DNA, 25 bp, Mus musculus
ttccctggaggatacttggctgtca

SEQ ID NO: 935395 - DNA, 25 bp, Mus musculus
ttccctggatagctcgcttggatga

SEQ ID NO: 935396 - DNA, 25 bp, Mus musculus
ttccctggataggtcgcttggatga

SEQ ID NO: 935397 - DNA, 25 bp, Mus musculus
ttccctggatcccattactaatcat

SEQ ID NO: 935398 - DNA, 25 bp, Mus musculus
ttccctggatccgattactaatcat

SEQ ID NO: 935399 - DNA, 25 bp, Mus musculus
ttccctggattcactgaaggagcat

SEQ ID NO: 935400 - DNA, 25 bp, Mus musculus
ttccctggattctctgaaggagcat

SEQ ID NO: 935401 - DNA, 25 bp, Mus musculus
ttccctggattgctgtaaacaaccg

SEQ ID NO: 935402 - DNA, 25 bp, Mus musculus
ttccctggattggtgtaaacaaccg

SEQ ID NO: 935403 - DNA, 25 bp, Mus musculus
ttccctggcaggagtggcagcccac

SEQ ID NO: 935404 - DNA, 25 bp, Mus musculus
ttccctggcaggtgtggcagcccac

SEQ ID NO: 935405 - DNA, 25 bp, Mus musculus
ttccctggcatactgctctaagcaa

SEQ ID NO: 935406 - DNA, 25 bp, Mus musculus
ttccctggcatagtgctctaagcaa

SEQ ID NO: 935407 - DNA, 25 bp, Mus musculus
ttccctggccatctgaagactagag

SEQ ID NO: 935408 - DNA, 25 bp, Mus musculus
ttccctggccatgtgaagactagag

SEQ ID NO: 935409 - DNA, 25 bp, Mus musculus
ttccctggccttaagcagatgtcta

SEQ ID NO: 935410 - DNA, 25 bp, Mus musculus
ttccctggcctttagcagatgtcta

SEQ ID NO: 935411 - DNA, 25 bp, Mus musculus
ttccctggctagatatgtagtttct

SEQ ID NO: 935412 - DNA, 25 bp, Mus musculus
ttccctggctagctgctggaagtga

SEQ ID NO: 935413 - DNA, 25 bp, Mus musculus
ttccctggctaggtgctggaagtga

SEQ ID NO: 935414 - DNA, 25 bp, Mus musculus
ttccctggctagttatgtagtttct

SEQ ID NO: 935415 - DNA, 25 bp, Mus musculus
ttccctggctccaccttatacccac

SEQ ID NO: 935416 - DNA, 25 bp, Mus musculus
ttccctggctcctccttatacccac

SEQ ID NO: 935417 - DNA, 25 bp, Mus musculus
ttccctggcttaaagaggaactcga

SEQ ID NO: 935418 - DNA, 25 bp, Mus musculus
ttccctggcttatagaggaactcga

SEQ ID NO: 935419 - DNA, 25 bp, Mus musculus
ttccctggcttcaggtgttatgttc

SEQ ID NO: 935420 - DNA, 25 bp, Mus musculus
ttccctggcttctggtgttatgttc

SEQ ID NO: 935421 - DNA, 25 bp, Mus musculus
ttccctgggaaaaacgtgggccctg

SEQ ID NO: 935422 - DNA, 25 bp, Mus musculus
ttccctgggaaatacgtgggccctg

SEQ ID NO: 935423 - DNA, 25 bp, Mus musculus
ttccctgggaatatggcccatcggg

SEQ ID NO: 935424 - DNA, 25 bp, Mus musculus
ttccctgggaatccggtggttaaat

SEQ ID NO: 935425 - DNA, 25 bp, Mus musculus
ttccctgggaatgcggtggttaaat

SEQ ID NO: 935426 - DNA, 25 bp, Mus musculus
ttccctgggaatttggcccatcggg

SEQ ID NO: 935427 - DNA, 25 bp, Mus musculus
ttccctgggactaagtctccgaagt

SEQ ID NO: 935428 - DNA, 25 bp, Mus musculus
ttccctgggacttagtctccgaagt

SEQ ID NO: 935429 - DNA, 25 bp, Mus musculus
ttccctgggagtaagatcctgagct

SEQ ID NO: 935430 - DNA, 25 bp, Mus musculus
ttccctgggagttagatcctgagct

SEQ ID NO: 935431 - DNA, 25 bp, Mus musculus
ttccctgggatgaaggttgaccctg

SEQ ID NO: 935432 - DNA, 25 bp, Mus musculus
ttccctgggatgtaggttgaccctg

SEQ ID NO: 935433 - DNA, 25 bp, Mus musculus
ttccctgggctcacaggcttgtaag

SEQ ID NO: 935434 - DNA, 25 bp, Mus musculus
ttccctgggctctcaggcttgtaag

SEQ ID NO: 935435 - DNA, 25 bp, Mus musculus
ttccctgggcttaatggaggtagac

SEQ ID NO: 935436 - DNA, 25 bp, Mus musculus
ttccctgggctttatggaggtagac

SEQ ID NO: 935437 - DNA, 25 bp, Mus musculus
ttccctgggtgactgtgactcccac

SEQ ID NO: 935438 - DNA, 25 bp, Mus musculus
ttccctgggtgagtgtgactcccac

SEQ ID NO: 935439 - DNA, 25 bp, Mus musculus
ttccctgggttgaatggactgctgc

SEQ ID NO: 935440 - DNA, 25 bp, Mus musculus
ttccctgggttgtatggactgctgc

SEQ ID NO: 935441 - DNA, 25 bp, Mus musculus
ttccctgggtttactatataaacag

SEQ ID NO: 935442 - DNA, 25 bp, Mus musculus
ttccctgggttttctatataaacag

SEQ ID NO: 935443 - DNA, 25 bp, Mus musculus
ttccctggtattatattaagcttga

SEQ ID NO: 935444 - DNA, 25 bp, Mus musculus
ttccctggtattttattaagcttga

SEQ ID NO: 935445 - DNA, 25 bp, Mus musculus
ttccctggtgctctggacatttaag

SEQ ID NO: 935446 - DNA, 25 bp, Mus musculus
ttccctggtgctgtggacatttaag

SEQ ID NO: 935447 - DNA, 25 bp, Mus musculus
ttccctggtgtaccacagatcagtg

SEQ ID NO: 935448 - DNA, 25 bp, Mus musculus
ttccctggtgtagcacagatcagtg

SEQ ID NO: 935449 - DNA, 25 bp, Mus musculus
ttccctggtgtgagagattctttag

SEQ ID NO: 935450 - DNA, 25 bp, Mus musculus
ttccctggtgtgtgagattctttag

SEQ ID NO: 935451 - DNA, 25 bp, Mus musculus
ttccctggttccactatgtgaacta

SEQ ID NO: 935452 - DNA, 25 bp, Mus musculus
ttccctggttcctctatgtgaacta

SEQ ID NO: 935453 - DNA, 25 bp, Mus musculus
ttccctggttggagatcccatcttt

SEQ ID NO: 935454 - DNA, 25 bp, Mus musculus
ttccctggttggtgatcccatcttt

SEQ ID NO: 935455 - DNA, 25 bp, Mus musculus
ttccctgtaaaacctgttgtaagca

SEQ ID NO: 935456 - DNA, 25 bp, Mus musculus
ttccctgtaaaagctgttgtaagca

SEQ ID NO: 935457 - DNA, 25 bp, Mus musculus
ttccctgtaataacctggttggcta

SEQ ID NO: 935458 - DNA, 25 bp, Mus musculus
ttccctgtaatatcctggttggcta

SEQ ID NO: 935459 - DNA, 25 bp, Mus musculus
ttccctgtaccaagagtgcttcact

SEQ ID NO: 935460 - DNA, 25 bp, Mus musculus
ttccctgtaccatgagtgcttcact

SEQ ID NO: 935461 - DNA, 25 bp, Mus musculus
ttccctgtagggattatgcatttac

SEQ ID NO: 935462 - DNA, 25 bp, Mus musculus
ttccctgtagggtttatgcatttac

SEQ ID NO: 935463 - DNA, 25 bp, Mus musculus
ttccctgtaggtccaacaacattat

SEQ ID NO: 935464 - DNA, 25 bp, Mus musculus
ttccctgtaggtccatagtaaccct

SEQ ID NO: 935465 - DNA, 25 bp, Mus musculus
ttccctgtaggtgcaacaacattat

SEQ ID NO: 935466 - DNA, 25 bp, Mus musculus
ttccctgtaggtgcatagtaaccct

SEQ ID NO: 935467 - DNA, 25 bp, Mus musculus
ttccctgtatttcttttgccattta

SEQ ID NO: 935468 - DNA, 25 bp, Mus musculus
ttccctgtatttgttttgccattta

SEQ ID NO: 935469 - DNA, 25 bp, Mus musculus
ttccctgtcacacaggttgtacaac

SEQ ID NO: 935470 - DNA, 25 bp, Mus musculus
ttccctgtcacagaggttgtacaac

SEQ ID NO: 935471 - DNA, 25 bp, Mus musculus
ttccctgtcactacacaagatcttt

SEQ ID NO: 935472 - DNA, 25 bp, Mus musculus
ttccctgtcacttcacaagatcttt

SEQ ID NO: 935473 - DNA, 25 bp, Mus musculus
ttccctgtcagaagtagtgctgcag

SEQ ID NO: 935474 - DNA, 25 bp, Mus musculus
ttccctgtcagaattactggctgcc

SEQ ID NO: 935475 - DNA, 25 bp, Mus musculus
ttccctgtcagatgtagtgctgcag

SEQ ID NO: 935476 - DNA, 25 bp, Mus musculus
ttccctgtcagatttactggctgcc

SEQ ID NO: 935477 - DNA, 25 bp, Mus musculus
ttccctgtcagcacacttaaatgta

SEQ ID NO: 935478 - DNA, 25 bp, Mus musculus
ttccctgtcagctcacttaaatgta

SEQ ID NO: 935479 - DNA, 25 bp, Mus musculus
ttccctgtcataacatctttgccat

SEQ ID NO: 935480 - DNA, 25 bp, Mus musculus
ttccctgtcatatcatctttgccat

SEQ ID NO: 935481 - DNA, 25 bp, Mus musculus
ttccctgtcatgctcacctttagga

SEQ ID NO: 935482 - DNA, 25 bp, Mus musculus
ttccctgtcatggtcacctttagga

SEQ ID NO: 935483 - DNA, 25 bp, Mus musculus
ttccctgtcctacgctactcagagg

SEQ ID NO: 935484 - DNA, 25 bp, Mus musculus
ttccctgtcctaggctactcagagg

SEQ ID NO: 935485 - DNA, 25 bp, Mus musculus
ttccctgtctatcggccacatctgt

SEQ ID NO: 935486 - DNA, 25 bp, Mus musculus
ttccctgtctatgggccacatctgt

SEQ ID NO: 935487 - DNA, 25 bp, Mus musculus
ttccctgtctcccagaatggtgaga

SEQ ID NO: 935488 - DNA, 25 bp, Mus musculus
ttccctgtctccgagaatggtgaga

SEQ ID NO: 935489 - DNA, 25 bp, Mus musculus
ttccctgtgaccaagggctgacttc

SEQ ID NO: 935490 - DNA, 25 bp, Mus musculus
ttccctgtgacctagggctgacttc

SEQ ID NO: 935491 - DNA, 25 bp, Mus musculus
ttccctgtgagtctgcgggctcaaa

SEQ ID NO: 935492 - DNA, 25 bp, Mus musculus
ttccctgtgagtgtgcgggctcaaa

SEQ ID NO: 935493 - DNA, 25 bp, Mus musculus
ttccctgtgatcctgacaggtgcat

SEQ ID NO: 935494 - DNA, 25 bp, Mus musculus
ttccctgtgatcgtgacaggtgcat

SEQ ID NO: 935495 - DNA, 25 bp, Mus musculus
ttccctgtgatgctatacggctttt

SEQ ID NO: 935496 - DNA, 25 bp, Mus musculus
ttccctgtgatggtatacggctttt

SEQ ID NO: 935497 - DNA, 25 bp, Mus musculus
ttccctgtgcacacagcatgtggat

SEQ ID NO: 935498 - DNA, 25 bp, Mus musculus
ttccctgtgcactcagcatgtggat

SEQ ID NO: 935499 - DNA, 25 bp, Mus musculus
ttccctgtgcggctgtgggcacatc

SEQ ID NO: 935500 - DNA, 25 bp, Mus musculus
ttccctgtgcgggtgtgggcacatc

SEQ ID NO: 935501 - DNA, 25 bp, Mus musculus
ttccctgtgctaattctagtgaaat

SEQ ID NO: 935502 - DNA, 25 bp, Mus musculus
ttccctgtgctatttctagtgaaat

SEQ ID NO: 935503 - DNA, 25 bp, Mus musculus
ttccctgtggaaattatgtgatgtg

SEQ ID NO: 935504 - DNA, 25 bp, Mus musculus
ttccctgtggaacccgattttcctg

SEQ ID NO: 935505 - DNA, 25 bp, Mus musculus
ttccctgtggaagccgattttcctg

SEQ ID NO: 935506 - DNA, 25 bp, Mus musculus
ttccctgtggaatttatgtgatgtg

SEQ ID NO: 935507 - DNA, 25 bp, Mus musculus
ttccctgtgggaacacctagcatta

SEQ ID NO: 935508 - DNA, 25 bp, Mus musculus
ttccctgtgggatcacctagcatta

SEQ ID NO: 935509 - DNA, 25 bp, Mus musculus
ttccctgtgggcctctgcaaaatca

SEQ ID NO: 935510 - DNA, 25 bp, Mus musculus
ttccctgtgggcgtctgcaaaatca

SEQ ID NO: 935511 - DNA, 25 bp, Mus musculus
ttccctgtgggtcgtgtcagaattt

SEQ ID NO: 935512 - DNA, 25 bp, Mus musculus
ttccctgtgggtggtgtcagaattt

SEQ ID NO: 935513 - DNA, 25 bp, Mus musculus
ttccctgtggttcactgaactgctg

SEQ ID NO: 935514 - DNA, 25 bp, Mus musculus
ttccctgtggttgactgaactgctg

SEQ ID NO: 935515 - DNA, 25 bp, Mus musculus
ttccctgtgtggaaccatctctaca

SEQ ID NO: 935516 - DNA, 25 bp, Mus musculus
ttccctgtgtggtaccatctctaca

SEQ ID NO: 935517 - DNA, 25 bp, Mus musculus
ttccctgtgtgtcccaaccaatata

SEQ ID NO: 935518 - DNA, 25 bp, Mus musculus
ttccctgtgtgtgccaaccaatata

SEQ ID NO: 935519 - DNA, 25 bp, Mus musculus
ttccctgtgttacctttcttgctat

SEQ ID NO: 935520 - DNA, 25 bp, Mus musculus
ttccctgtgttagctttcttgctat

SEQ ID NO: 935521 - DNA, 25 bp, Mus musculus
ttccctgtgttgagttccattggca

SEQ ID NO: 935522 - DNA, 25 bp, Mus musculus
ttccctgtgttgtgttccattggca

SEQ ID NO: 935523 - DNA, 25 bp, Mus musculus
ttccctgttaaaccatcccatcagt

SEQ ID NO: 935524 - DNA, 25 bp, Mus musculus
ttccctgttaaagcatcccatcagt

SEQ ID NO: 935525 - DNA, 25 bp, Mus musculus
ttccctgttaacagctgtacactat

SEQ ID NO: 935526 - DNA, 25 bp, Mus musculus
ttccctgttaactgctgtacactat

SEQ ID NO: 935527 - DNA, 25 bp, Mus musculus
ttccctgttaataaacactgcaagt

SEQ ID NO: 935528 - DNA, 25 bp, Mus musculus
ttccctgttaattaacactgcaagt

SEQ ID NO: 935529 - DNA, 25 bp, Mus musculus
ttccctgttcaaattaccacccaat

SEQ ID NO: 935530 - DNA, 25 bp, Mus musculus
ttccctgttcaatttaccacccaat

SEQ ID NO: 935531 - DNA, 25 bp, Mus musculus
ttccctgttcccagcggacaaaagc

SEQ ID NO: 935532 - DNA, 25 bp, Mus musculus
ttccctgttccctgcggacaaaagc

SEQ ID NO: 935533 - DNA, 25 bp, Mus musculus
ttccctgttcgcattcctctgtttt

SEQ ID NO: 935534 - DNA, 25 bp, Mus musculus
ttccctgttcgctttcctctgtttt

SEQ ID NO: 935535 - DNA, 25 bp, Mus musculus
ttccctgttggcattgctgttcccc

SEQ ID NO: 935536 - DNA, 25 bp, Mus musculus
ttccctgttggctttgctgttcccc

SEQ ID NO: 935537 - DNA, 25 bp, Mus musculus
ttccctgttgtcaccaagtgttatg

SEQ ID NO: 935538 - DNA, 25 bp, Mus musculus
ttccctgttgtctccaagtgttatg

SEQ ID NO: 935539 - DNA, 25 bp, Mus musculus
ttccctgttttcctcttaaatgtgt

SEQ ID NO: 935540 - DNA, 25 bp, Mus musculus
ttccctgttttcgtcttaaatgtgt

SEQ ID NO: 935541 - DNA, 25 bp, Mus musculus
ttcccttaacatcgcctcagaagat

SEQ ID NO: 935542 - DNA, 25 bp, Mus musculus
ttcccttaacatggcctcagaagat

SEQ ID NO: 935543 - DNA, 25 bp, Mus musculus
ttcccttaaggaccaagaagcgcct

SEQ ID NO: 935544 - DNA, 25 bp, Mus musculus
ttcccttaaggagcaagaagcgcct

SEQ ID NO: 935545 - DNA, 25 bp, Mus musculus
ttcccttacaccactcaagacaaat

SEQ ID NO: 935546 - DNA, 25 bp, Mus musculus
ttcccttacacctctcaagacaaat

SEQ ID NO: 935547 - DNA, 25 bp, Mus musculus
ttcccttacagtatctttgagcggt

SEQ ID NO: 935548 - DNA, 25 bp, Mus musculus
ttcccttacagtttctttgagcggt

SEQ ID NO: 935549 - DNA, 25 bp, Mus musculus
ttcccttacattctcaagtcatgta

SEQ ID NO: 935550 - DNA, 25 bp, Mus musculus
ttcccttacattgtcaagtcatgta

SEQ ID NO: 935551 - DNA, 25 bp, Mus musculus
ttcccttaccaactgtatccaagcg

SEQ ID NO: 935552 - DNA, 25 bp, Mus musculus
ttcccttaccaagtgtatccaagcg

SEQ ID NO: 935553 - DNA, 25 bp, Mus musculus
ttcccttaccccagacatgtatata

SEQ ID NO: 935554 - DNA, 25 bp, Mus musculus
ttcccttacccctgacatgtatata

SEQ ID NO: 935555 - DNA, 25 bp, Mus musculus
ttcccttactcaccatcgcagaatt

SEQ ID NO: 935556 - DNA, 25 bp, Mus musculus
ttcccttactcagcatcgcagaatt

SEQ ID NO: 935557 - DNA, 25 bp, Mus musculus
ttcccttactccacacgatgaggtt

SEQ ID NO: 935558 - DNA, 25 bp, Mus musculus
ttcccttactcctcacgatgaggtt

SEQ ID NO: 935559 - DNA, 25 bp, Mus musculus
ttcccttagctcaggtatacaccaa

SEQ ID NO: 935560 - DNA, 25 bp, Mus musculus
ttcccttagctcctgtgcctttaga

SEQ ID NO: 935561 - DNA, 25 bp, Mus musculus
ttcccttagctcgtgtgcctttaga

SEQ ID NO: 935562 - DNA, 25 bp, Mus musculus
ttcccttagctctggtatacaccaa

SEQ ID NO: 935563 - DNA, 25 bp, Mus musculus
ttcccttagctgcattatggcttgt

SEQ ID NO: 935564 - DNA, 25 bp, Mus musculus
ttcccttagctggattatggcttgt

SEQ ID NO: 935565 - DNA, 25 bp, Mus musculus
ttcccttaggacagaaccacactag

SEQ ID NO: 935566 - DNA, 25 bp, Mus musculus
ttcccttaggactgaaccacactag

SEQ ID NO: 935567 - DNA, 25 bp, Mus musculus
ttcccttagggacagctgcagagct

SEQ ID NO: 935568 - DNA, 25 bp, Mus musculus
ttcccttagggagagctgcagagct

SEQ ID NO: 935569 - DNA, 25 bp, Mus musculus
ttcccttagggccagtgtctgataa

SEQ ID NO: 935570 - DNA, 25 bp, Mus musculus
ttcccttagggcgagtgtctgataa

SEQ ID NO: 935571 - DNA, 25 bp, Mus musculus
ttcccttatgggagctgaatctagc

SEQ ID NO: 935572 - DNA, 25 bp, Mus musculus
ttcccttatgggtgctgaatctagc

SEQ ID NO: 935573 - DNA, 25 bp, Mus musculus
ttcccttcaaaaatctttgttagct

SEQ ID NO: 935574 - DNA, 25 bp, Mus musculus
ttcccttcaaaattctttgttagct

SEQ ID NO: 935575 - DNA, 25 bp, Mus musculus
ttcccttcagagatcagcttgagtt

SEQ ID NO: 935576 - DNA, 25 bp, Mus musculus
ttcccttcagagttcagcttgagtt

SEQ ID NO: 935577 - DNA, 25 bp, Mus musculus
ttcccttcagctacacgaaaggcag

SEQ ID NO: 935578 - DNA, 25 bp, Mus musculus
ttcccttcagctccttttaaaggtt

SEQ ID NO: 935579 - DNA, 25 bp, Mus musculus
ttcccttcagctgcttttaaaggtt

SEQ ID NO: 935580 - DNA, 25 bp, Mus musculus
ttcccttcagcttcacgaaaggcag

SEQ ID NO: 935581 - DNA, 25 bp, Mus musculus
ttcccttcagtaaattcaatctctt

SEQ ID NO: 935582 - DNA, 25 bp, Mus musculus
ttcccttcagtatattcaatctctt

SEQ ID NO: 935583 - DNA, 25 bp, Mus musculus
ttcccttccagcaatccaagaggaa

SEQ ID NO: 935584 - DNA, 25 bp, Mus musculus
ttcccttccagctatccaagaggaa

SEQ ID NO: 935585 - DNA, 25 bp, Mus musculus
ttcccttccatacagcatggggtga

SEQ ID NO: 935586 - DNA, 25 bp, Mus musculus
ttcccttccatagagcatggggtga

SEQ ID NO: 935587 - DNA, 25 bp, Mus musculus
ttcccttcccaaactacatagttat

SEQ ID NO: 935588 - DNA, 25 bp, Mus musculus
ttcccttcccaacagagattcgatt

SEQ ID NO: 935589 - DNA, 25 bp, Mus musculus
ttcccttcccaacgcacagagcaat

SEQ ID NO: 935590 - DNA, 25 bp, Mus musculus
ttcccttcccaagagagattcgatt

SEQ ID NO: 935591 - DNA, 25 bp, Mus musculus
ttcccttcccaaggcacagagcaat

SEQ ID NO: 935592 - DNA, 25 bp, Mus musculus
ttcccttcccaatctacatagttat

SEQ ID NO: 935593 - DNA, 25 bp, Mus musculus
ttcccttcccatagtactagatgca

SEQ ID NO: 935594 - DNA, 25 bp, Mus musculus
ttcccttcccattgtactagatgca

SEQ ID NO: 935595 - DNA, 25 bp, Mus musculus
ttcccttcccttccagattgtgaga

SEQ ID NO: 935596 - DNA, 25 bp, Mus musculus
ttcccttcccttgcagattgtgaga

SEQ ID NO: 935597 - DNA, 25 bp, Mus musculus
ttcccttcctctcggcttgaagatg

SEQ ID NO: 935598 - DNA, 25 bp, Mus musculus
ttcccttcctctgggcttgaagatg

SEQ ID NO: 935599 - DNA, 25 bp, Mus musculus
ttcccttcctgtatctgcatgataa

SEQ ID NO: 935600 - DNA, 25 bp, Mus musculus
ttcccttcctgtttctgcatgataa

SEQ ID NO: 935601 - DNA, 25 bp, Mus musculus
ttcccttccttaattgaggcatgac

SEQ ID NO: 935602 - DNA, 25 bp, Mus musculus
ttcccttccttatttgaggcatgac

SEQ ID NO: 935603 - DNA, 25 bp, Mus musculus
ttcccttcctttcgacagtgttaca

SEQ ID NO: 935604 - DNA, 25 bp, Mus musculus
ttcccttcctttggacagtgttaca

SEQ ID NO: 935605 - DNA, 25 bp, Mus musculus
ttcccttcgctcaggatacggtgac

SEQ ID NO: 935606 - DNA, 25 bp, Mus musculus
ttcccttcgctctggatacggtgac

SEQ ID NO: 935607 - DNA, 25 bp, Mus musculus
ttcccttcggagaaagcaggacgcg

SEQ ID NO: 935608 - DNA, 25 bp, Mus musculus
ttcccttcggagtaagcaggacgcg

SEQ ID NO: 935609 - DNA, 25 bp, Mus musculus
ttcccttctgctcttacttaggttc

SEQ ID NO: 935610 - DNA, 25 bp, Mus musculus
ttcccttctgctgttacttaggttc

SEQ ID NO: 935611 - DNA, 25 bp, Mus musculus
ttcccttctgtgctgctgggcattg

SEQ ID NO: 935612 - DNA, 25 bp, Mus musculus
ttcccttctgtggtgctgggcattg

SEQ ID NO: 935613 - DNA, 25 bp, Mus musculus
ttcccttcttaaacagctttcattc

SEQ ID NO: 935614 - DNA, 25 bp, Mus musculus
ttcccttcttaatcagctttcattc

SEQ ID NO: 935615 - DNA, 25 bp, Mus musculus
ttcccttcttacaggttcagggtag

SEQ ID NO: 935616 - DNA, 25 bp, Mus musculus
ttcccttcttactggttcagggtag

SEQ ID NO: 935617 - DNA, 25 bp, Mus musculus
ttcccttcttcacacgacatggcag

SEQ ID NO: 935618 - DNA, 25 bp, Mus musculus
ttcccttcttcagacgacatggcag

SEQ ID NO: 935619 - DNA, 25 bp, Mus musculus
ttcccttcttctaaatctgcacaaa

SEQ ID NO: 935620 - DNA, 25 bp, Mus musculus
ttcccttcttctactgttcaaactt

SEQ ID NO: 935621 - DNA, 25 bp, Mus musculus
ttcccttcttcttaatctgcacaaa

SEQ ID NO: 935622 - DNA, 25 bp, Mus musculus
ttcccttcttcttctgttcaaactt

SEQ ID NO: 935623 - DNA, 25 bp, Mus musculus
ttcccttcttgcaggagagcggact

SEQ ID NO: 935624 - DNA, 25 bp, Mus musculus
ttcccttcttgctggagagcggact

SEQ ID NO: 935625 - DNA, 25 bp, Mus musculus
ttcccttcttttctatggactacaa

SEQ ID NO: 935626 - DNA, 25 bp, Mus musculus
ttcccttcttttgtatggactacaa

SEQ ID NO: 935627 - DNA, 25 bp, Mus musculus
ttcccttgaatgcaaaatcctgggt

SEQ ID NO: 935628 - DNA, 25 bp, Mus musculus
ttcccttgaatggaaaatcctgggt

SEQ ID NO: 935629 - DNA, 25 bp, Mus musculus
ttcccttgagttccacatcgacata

SEQ ID NO: 935630 - DNA, 25 bp, Mus musculus
ttcccttgagttcttgtgctgtaat

SEQ ID NO: 935631 - DNA, 25 bp, Mus musculus
ttcccttgagttgcacatcgacata

SEQ ID NO: 935632 - DNA, 25 bp, Mus musculus
ttcccttgagttgttgtgctgtaat

SEQ ID NO: 935633 - DNA, 25 bp, Mus musculus
ttcccttgcaagcttgctttgattg

SEQ ID NO: 935634 - DNA, 25 bp, Mus musculus
ttcccttgcaaggttgctttgattg

SEQ ID NO: 935635 - DNA, 25 bp, Mus musculus
ttcccttgcacacggttgacataga

SEQ ID NO: 935636 - DNA, 25 bp, Mus musculus
ttcccttgcacagggttgacataga

SEQ ID NO: 935637 - DNA, 25 bp, Mus musculus
ttcccttgcagcagcagtacagtag

SEQ ID NO: 935638 - DNA, 25 bp, Mus musculus
ttcccttgcagctgcagtacagtag

SEQ ID NO: 935639 - DNA, 25 bp, Mus musculus
ttcccttgcccaattataggcacag

SEQ ID NO: 935640 - DNA, 25 bp, Mus musculus
ttcccttgcccatttataggcacag

SEQ ID NO: 935641 - DNA, 25 bp, Mus musculus
ttcccttgcctcatcagcgtgtgtg

SEQ ID NO: 935642 - DNA, 25 bp, Mus musculus
ttcccttgcctcttcagcgtgtgtg

SEQ ID NO: 935643 - DNA, 25 bp, Mus musculus
ttcccttgccttatgaagaaatgta

SEQ ID NO: 935644 - DNA, 25 bp, Mus musculus
ttcccttgccttttgaagaaatgta

SEQ ID NO: 935645 - DNA, 25 bp, Mus musculus
ttcccttgcgtacttcagattgtag

SEQ ID NO: 935646 - DNA, 25 bp, Mus musculus
ttcccttgcgtagttcagattgtag

SEQ ID NO: 935647 - DNA, 25 bp, Mus musculus
ttcccttgctggactttccaagata

SEQ ID NO: 935648 - DNA, 25 bp, Mus musculus
ttcccttgctggtctttccaagata

SEQ ID NO: 935649 - DNA, 25 bp, Mus musculus
ttcccttgcttacaagcaggacttg

SEQ ID NO: 935650 - DNA, 25 bp, Mus musculus
ttcccttgcttagaagcaggacttg

SEQ ID NO: 935651 - DNA, 25 bp, Mus musculus
ttcccttgcttgaacccttgaagga

SEQ ID NO: 935652 - DNA, 25 bp, Mus musculus
ttcccttgcttgtacccttgaagga

SEQ ID NO: 935653 - DNA, 25 bp, Mus musculus
ttcccttgctttaggtatataggct

SEQ ID NO: 935654 - DNA, 25 bp, Mus musculus
ttcccttgcttttggtatataggct

SEQ ID NO: 935655 - DNA, 25 bp, Mus musculus
ttcccttggacaatttgtgtctagt

SEQ ID NO: 935656 - DNA, 25 bp, Mus musculus
ttcccttggacattttgtgtctagt

SEQ ID NO: 935657 - DNA, 25 bp, Mus musculus
ttcccttggcatagcacacacagga

SEQ ID NO: 935658 - DNA, 25 bp, Mus musculus
ttcccttggcattgcacacacagga

SEQ ID NO: 935659 - DNA, 25 bp, Mus musculus
ttcccttggcctcgaaagcttggtg

SEQ ID NO: 935660 - DNA, 25 bp, Mus musculus
ttcccttggcctggaaagcttggtg

SEQ ID NO: 935661 - DNA, 25 bp, Mus musculus
ttcccttggctcctttgtaataatt

SEQ ID NO: 935662 - DNA, 25 bp, Mus musculus
ttcccttggctcgtttgtaataatt

SEQ ID NO: 935663 - DNA, 25 bp, Mus musculus
ttcccttggcttctccttgattggt

SEQ ID NO: 935664 - DNA, 25 bp, Mus musculus
ttcccttggcttgtccttgattggt

SEQ ID NO: 935665 - DNA, 25 bp, Mus musculus
ttcccttgggccaggtgatatgaga

SEQ ID NO: 935666 - DNA, 25 bp, Mus musculus
ttcccttgggcctggtgatatgaga

SEQ ID NO: 935667 - DNA, 25 bp, Mus musculus
ttcccttgggcgcacccctctggac

SEQ ID NO: 935668 - DNA, 25 bp, Mus musculus
ttcccttgggcggacccctctggac

SEQ ID NO: 935669 - DNA, 25 bp, Mus musculus
ttcccttgggtacaggatagaattg

SEQ ID NO: 935670 - DNA, 25 bp, Mus musculus
ttcccttgggtagaggatagaattg

SEQ ID NO: 935671 - DNA, 25 bp, Mus musculus
ttcccttgggttctagcttcagtac

SEQ ID NO: 935672 - DNA, 25 bp, Mus musculus
ttcccttgggttgtagcttcagtac

SEQ ID NO: 935673 - DNA, 25 bp, Mus musculus
ttcccttggtggcttgctgagtcca

SEQ ID NO: 935674 - DNA, 25 bp, Mus musculus
ttcccttggtgggttgctgagtcca

SEQ ID NO: 935675 - DNA, 25 bp, Mus musculus
ttcccttgtgatctttacagcctgc

SEQ ID NO: 935676 - DNA, 25 bp, Mus musculus
ttcccttgtgatgtttacagcctgc

SEQ ID NO: 935677 - DNA, 25 bp, Mus musculus
ttcccttgtggtactaggagcacag

SEQ ID NO: 935678 - DNA, 25 bp, Mus musculus
ttcccttgtggttctaggagcacag

SEQ ID NO: 935679 - DNA, 25 bp, Mus musculus
ttccctttaatcacatacagttagc

SEQ ID NO: 935680 - DNA, 25 bp, Mus musculus
ttccctttaatctcatacagttagc

SEQ ID NO: 935681 - DNA, 25 bp, Mus musculus
ttccctttaccaatgaggcaccgga

SEQ ID NO: 935682 - DNA, 25 bp, Mus musculus
ttccctttaccattgaggcaccgga

SEQ ID NO: 935683 - DNA, 25 bp, Mus musculus
ttccctttaccgagcgcttctggga

SEQ ID NO: 935684 - DNA, 25 bp, Mus musculus
ttccctttaccgtgcgcttctggga

SEQ ID NO: 935685 - DNA, 25 bp, Mus musculus
ttccctttcaacataattaggctca

SEQ ID NO: 935686 - DNA, 25 bp, Mus musculus
ttccctttcaacttaattaggctca

SEQ ID NO: 935687 - DNA, 25 bp, Mus musculus
ttccctttcaagcacaagccaggtg

SEQ ID NO: 935688 - DNA, 25 bp, Mus musculus
ttccctttcaaggacaagccaggtg

SEQ ID NO: 935689 - DNA, 25 bp, Mus musculus
ttccctttcattaatcctttagcta

SEQ ID NO: 935690 - DNA, 25 bp, Mus musculus
ttccctttcatttatcctttagcta

SEQ ID NO: 935691 - DNA, 25 bp, Mus musculus
ttccctttccagcagaccgggtgca

SEQ ID NO: 935692 - DNA, 25 bp, Mus musculus
ttccctttccaggagaccgggtgca

SEQ ID NO: 935693 - DNA, 25 bp, Mus musculus
ttccctttccccaatgtaaagctga

SEQ ID NO: 935694 - DNA, 25 bp, Mus musculus
ttccctttcccctatgtaaagctga

SEQ ID NO: 935695 - DNA, 25 bp, Mus musculus
ttccctttctaaactgttgtttcag

SEQ ID NO: 935696 - DNA, 25 bp, Mus musculus
ttccctttctaatctgttgtttcag

SEQ ID NO: 935697 - DNA, 25 bp, Mus musculus
ttccctttctagagcagatctccag

SEQ ID NO: 935698 - DNA, 25 bp, Mus musculus
ttccctttctagtgcagatctccag

SEQ ID NO: 935699 - DNA, 25 bp, Mus musculus
ttccctttctctaaagatggctttt

SEQ ID NO: 935700 - DNA, 25 bp, Mus musculus
ttccctttctcttaagatggctttt

SEQ ID NO: 935701 - DNA, 25 bp, Mus musculus
ttccctttcttaataccacagcaat

SEQ ID NO: 935702 - DNA, 25 bp, Mus musculus
ttccctttcttattaccacagcaat

SEQ ID NO: 935703 - DNA, 25 bp, Mus musculus
ttccctttgagactggtatacatcc

SEQ ID NO: 935704 - DNA, 25 bp, Mus musculus
ttccctttgagagtggtatacatcc

SEQ ID NO: 935705 - DNA, 25 bp, Mus musculus
ttccctttgcaaactgagctactag

SEQ ID NO: 935706 - DNA, 25 bp, Mus musculus
ttccctttgcaatctgagctactag

SEQ ID NO: 935707 - DNA, 25 bp, Mus musculus
ttccctttgcagacacagcatagct

SEQ ID NO: 935708 - DNA, 25 bp, Mus musculus
ttccctttgcagtcacagcatagct

SEQ ID NO: 935709 - DNA, 25 bp, Mus musculus
ttccctttgtggacagctctgatga

SEQ ID NO: 935710 - DNA, 25 bp, Mus musculus
ttccctttgtggtcagctctgatga

SEQ ID NO: 935711 - DNA, 25 bp, Mus musculus
ttcccttttagtcctggctgcattt

SEQ ID NO: 935712 - DNA, 25 bp, Mus musculus
ttcccttttagtgctggctgcattt

SEQ ID NO: 935713 - DNA, 25 bp, Mus musculus
ttcccttttcagaaacattgttcgg

SEQ ID NO: 935714 - DNA, 25 bp, Mus musculus
ttcccttttcagtaacattgttcgg

SEQ ID NO: 935715 - DNA, 25 bp, Mus musculus
ttcccttttcatcgtcctgtttgaa

SEQ ID NO: 935716 - DNA, 25 bp, Mus musculus
ttcccttttcatggtcctgtttgaa

SEQ ID NO: 935717 - DNA, 25 bp, Mus musculus
ttcccttttccaaaatctttgaaag

SEQ ID NO: 935718 - DNA, 25 bp, Mus musculus
ttcccttttccataatctttgaaag

SEQ ID NO: 935719 - DNA, 25 bp, Mus musculus
ttcccttttctcagatgttgtagat

SEQ ID NO: 935720 - DNA, 25 bp, Mus musculus
ttcccttttctctgatgttgtagat

SEQ ID NO: 935721 - DNA, 25 bp, Mus musculus
ttcccttttctgatagtgttagcgg

SEQ ID NO: 935722 - DNA, 25 bp, Mus musculus
ttcccttttctgttagtgttagcgg

SEQ ID NO: 935723 - DNA, 25 bp, Mus musculus
ttcccttttgccaaggctaatccaa

SEQ ID NO: 935724 - DNA, 25 bp, Mus musculus
ttcccttttgcctaggctaatccaa

SEQ ID NO: 935725 - DNA, 25 bp, Mus musculus
ttccctttttcacactattggtcac

SEQ ID NO: 935726 - DNA, 25 bp, Mus musculus
ttccctttttcagactattggtcac

SEQ ID NO: 935727 - DNA, 25 bp, Mus musculus
ttccgaacaattcccacttgccggc

SEQ ID NO: 935728 - DNA, 25 bp, Mus musculus
ttccgaacaattgccacttgccggc

SEQ ID NO: 935729 - DNA, 25 bp, Mus musculus
ttccgaacaccaactcctgtagagt

SEQ ID NO: 935730 - DNA, 25 bp, Mus musculus
ttccgaacaccatctcctgtagagt

SEQ ID NO: 935731 - DNA, 25 bp, Mus musculus
ttccgaaccttcagacgtcatgtag

SEQ ID NO: 935732 - DNA, 25 bp, Mus musculus
ttccgaaccttctgacgtcatgtag

SEQ ID NO: 935733 - DNA, 25 bp, Mus musculus
ttccgaacttgacgagcccgacagt

SEQ ID NO: 935734 - DNA, 25 bp, Mus musculus
ttccgaacttgaggagcccgacagt

SEQ ID NO: 935735 - DNA, 25 bp, Mus musculus
ttccgaacttgtctgaacatggacc

SEQ ID NO: 935736 - DNA, 25 bp, Mus musculus
ttccgaacttgtgtgaacatggacc

SEQ ID NO: 935737 - DNA, 25 bp, Mus musculus
ttccgaagagcactcatgccgggtg

SEQ ID NO: 935738 - DNA, 25 bp, Mus musculus
ttccgaagagcagtcatgccgggtg

SEQ ID NO: 935739 - DNA, 25 bp, Mus musculus
ttccgaagatacactaaccttacca

SEQ ID NO: 935740 - DNA, 25 bp, Mus musculus
ttccgaagatactctaaccttacca

SEQ ID NO: 935741 - DNA, 25 bp, Mus musculus
ttccgaagcacacgcccaatgaatt

SEQ ID NO: 935742 - DNA, 25 bp, Mus musculus
ttccgaagcacaggcccaatgaatt

SEQ ID NO: 935743 - DNA, 25 bp, Mus musculus
ttccgaagcctgatcataccccagc

SEQ ID NO: 935744 - DNA, 25 bp, Mus musculus
ttccgaagcctgttcataccccagc

SEQ ID NO: 935745 - DNA, 25 bp, Mus musculus
ttccgaagctataagctgctgttga

SEQ ID NO: 935746 - DNA, 25 bp, Mus musculus
ttccgaagctattagctgctgttga

SEQ ID NO: 935747 - DNA, 25 bp, Mus musculus
ttccgaagctgtaccaaggctgtct

SEQ ID NO: 935748 - DNA, 25 bp, Mus musculus
ttccgaagctgttccaaggctgtct

SEQ ID NO: 935749 - DNA, 25 bp, Mus musculus
ttccgaagttatatgacacacgttt

SEQ ID NO: 935750 - DNA, 25 bp, Mus musculus
ttccgaagttatttgacacacgttt

SEQ ID NO: 935751 - DNA, 25 bp, Mus musculus
ttccgaagttttaggcaacagcgac

SEQ ID NO: 935752 - DNA, 25 bp, Mus musculus
ttccgaagtttttggcaacagcgac

SEQ ID NO: 935753 - DNA, 25 bp, Mus musculus
ttccgaatcacaacataacgggact

SEQ ID NO: 935754 - DNA, 25 bp, Mus musculus
ttccgaatcacatcataacgggact

SEQ ID NO: 935755 - DNA, 25 bp, Mus musculus
ttccgaattagcaatagcagccctt

SEQ ID NO: 935756 - DNA, 25 bp, Mus musculus
ttccgaattagctatagcagccctt

SEQ ID NO: 935757 - DNA, 25 bp, Mus musculus
ttccgaatttgccaccagcctgtca

SEQ ID NO: 935758 - DNA, 25 bp, Mus musculus
ttccgaatttgcgaccagcctgtca

SEQ ID NO: 935759 - DNA, 25 bp, Mus musculus
ttccgacagagaacccagagggcgt

SEQ ID NO: 935760 - DNA, 25 bp, Mus musculus
ttccgacagagatcccagagggcgt

SEQ ID NO: 935761 - DNA, 25 bp, Mus musculus
ttccgacagagcagttagcttactt

SEQ ID NO: 935762 - DNA, 25 bp, Mus musculus
ttccgacagagctgttagcttactt

SEQ ID NO: 935763 - DNA, 25 bp, Mus musculus
ttccgacaggcccaggacgtgttag

SEQ ID NO: 935764 - DNA, 25 bp, Mus musculus
ttccgacaggccgaggacgtgttag

SEQ ID NO: 935765 - DNA, 25 bp, Mus musculus
ttccgacaggctcccagtctctgtg

SEQ ID NO: 935766 - DNA, 25 bp, Mus musculus
ttccgacaggctgccagtctctgtg

SEQ ID NO: 935767 - DNA, 25 bp, Mus musculus
ttccgacctcatactttacatacag

SEQ ID NO: 935768 - DNA, 25 bp, Mus musculus
ttccgacctcattctttacatacag

SEQ ID NO: 935769 - DNA, 25 bp, Mus musculus
ttccgacgcactctggagcccatgg

SEQ ID NO: 935770 - DNA, 25 bp, Mus musculus
ttccgacgcactgtggagcccatgg

SEQ ID NO: 935771 - DNA, 25 bp, Mus musculus
ttccgactcctaccggatgacaagg

SEQ ID NO: 935772 - DNA, 25 bp, Mus musculus
ttccgactcctagcggatgacaagg

SEQ ID NO: 935773 - DNA, 25 bp, Mus musculus
ttccgactgaacatgtatgagctga

SEQ ID NO: 935774 - DNA, 25 bp, Mus musculus
ttccgactgaacttgtatgagctga

SEQ ID NO: 935775 - DNA, 25 bp, Mus musculus
ttccgactgaatctgtttacgaccg

SEQ ID NO: 935776 - DNA, 25 bp, Mus musculus
ttccgactgaatgtgtttacgaccg

SEQ ID NO: 935777 - DNA, 25 bp, Mus musculus
ttccgacttagccatgccccgagta

SEQ ID NO: 935778 - DNA, 25 bp, Mus musculus
ttccgacttagcgatgccccgagta

SEQ ID NO: 935779 - DNA, 25 bp, Mus musculus
ttccgacttgttccctccaggataa

SEQ ID NO: 935780 - DNA, 25 bp, Mus musculus
ttccgacttgttgcctccaggataa

SEQ ID NO: 935781 - DNA, 25 bp, Mus musculus
ttccgagaccaaaaggatggctacc

SEQ ID NO: 935782 - DNA, 25 bp, Mus musculus
ttccgagaccaataggatggctacc

SEQ ID NO: 935783 - DNA, 25 bp, Mus musculus
ttccgagagcttctgcgttgtgctt

SEQ ID NO: 935784 - DNA, 25 bp, Mus musculus
ttccgagagcttgtgcgttgtgctt

SEQ ID NO: 935785 - DNA, 25 bp, Mus musculus
ttccgagagttaaggcctgggcatc

SEQ ID NO: 935786 - DNA, 25 bp, Mus musculus
ttccgagagttatggcctgggcatc

SEQ ID NO: 935787 - DNA, 25 bp, Mus musculus
ttccgagcagccatcgacaaatcgt

SEQ ID NO: 935788 - DNA, 25 bp, Mus musculus
ttccgagcagccttcgacaaatcgt

SEQ ID NO: 935789 - DNA, 25 bp, Mus musculus
ttccgaggccgtcaagaagcttctg

SEQ ID NO: 935790 - DNA, 25 bp, Mus musculus
ttccgaggccgtgaagaagcttctg

SEQ ID NO: 935791 - DNA, 25 bp, Mus musculus
ttccgaggtgacacactgttgcagg

SEQ ID NO: 935792 - DNA, 25 bp, Mus musculus
ttccgaggtgactcactgttgcagg

SEQ ID NO: 935793 - DNA, 25 bp, Mus musculus
ttccgagtcactccaaaattttagg

SEQ ID NO: 935794 - DNA, 25 bp, Mus musculus
ttccgagtcactgcaaaattttagg

SEQ ID NO: 935795 - DNA, 25 bp, Mus musculus
ttccgagtgggcatggacaagtgat

SEQ ID NO: 935796 - DNA, 25 bp, Mus musculus
ttccgagtgggcttggacaagtgat

SEQ ID NO: 935797 - DNA, 25 bp, Mus musculus
ttccgagtgtaactgttcctgctag

SEQ ID NO: 935798 - DNA, 25 bp, Mus musculus
ttccgagtgtaagtgttcctgctag

SEQ ID NO: 935799 - DNA, 25 bp, Mus musculus
ttccgagttctgctatcaaaggcgt

SEQ ID NO: 935800 - DNA, 25 bp, Mus musculus
ttccgagttctggtatcaaaggcgt

SEQ ID NO: 935801 - DNA, 25 bp, Mus musculus
ttccgatacaacacagtcccagatt

SEQ ID NO: 935802 - DNA, 25 bp, Mus musculus
ttccgatacaactcagtcccagatt

SEQ ID NO: 935803 - DNA, 25 bp, Mus musculus
ttccgatatgccacttgcggtagtg

SEQ ID NO: 935804 - DNA, 25 bp, Mus musculus
ttccgatatgcctcttgcggtagtg

SEQ ID NO: 935805 - DNA, 25 bp, Mus musculus
ttccgatcaagaaatgaaacccgag

SEQ ID NO: 935806 - DNA, 25 bp, Mus musculus
ttccgatcaagatatgaaacccgag

SEQ ID NO: 935807 - DNA, 25 bp, Mus musculus
ttccgatcaaggcagttcttcagtt

SEQ ID NO: 935808 - DNA, 25 bp, Mus musculus
ttccgatcaagggagttcttcagtt

SEQ ID NO: 935809 - DNA, 25 bp, Mus musculus
ttccgatccatcattgaccacatta

SEQ ID NO: 935810 - DNA, 25 bp, Mus musculus
ttccgatccatctttgaccacatta

SEQ ID NO: 935811 - DNA, 25 bp, Mus musculus
ttccgatcccatagtatcctcaaga

SEQ ID NO: 935812 - DNA, 25 bp, Mus musculus
ttccgatcccattgtatcctcaaga

SEQ ID NO: 935813 - DNA, 25 bp, Mus musculus
ttccgatcccggcaaggagagaact

SEQ ID NO: 935814 - DNA, 25 bp, Mus musculus
ttccgatcccgggaaggagagaact

SEQ ID NO: 935815 - DNA, 25 bp, Mus musculus
ttccgatcccttcaagcgcagagga

SEQ ID NO: 935816 - DNA, 25 bp, Mus musculus
ttccgatcccttgaagcgcagagga

SEQ ID NO: 935817 - DNA, 25 bp, Mus musculus
ttccgatcgcccagtacatacatat

SEQ ID NO: 935818 - DNA, 25 bp, Mus musculus
ttccgatcgccctgtacatacatat

SEQ ID NO: 935819 - DNA, 25 bp, Mus musculus
ttccgatcttagctccagggacaga

SEQ ID NO: 935820 - DNA, 25 bp, Mus musculus
ttccgatcttaggtccagggacaga

SEQ ID NO: 935821 - DNA, 25 bp, Mus musculus
ttccgatgatgaccttccctagaca

SEQ ID NO: 935822 - DNA, 25 bp, Mus musculus
ttccgatgatgagcttccctagaca

SEQ ID NO: 935823 - DNA, 25 bp, Mus musculus
ttccgatgccctcaggctcttttcc

SEQ ID NO: 935824 - DNA, 25 bp, Mus musculus
ttccgatgccctgaggctcttttcc

SEQ ID NO: 935825 - DNA, 25 bp, Mus musculus
ttccgatgcgtccagatgctagagt

SEQ ID NO: 935826 - DNA, 25 bp, Mus musculus
ttccgatgcgtcgagatgctagagt

SEQ ID NO: 935827 - DNA, 25 bp, Mus musculus
ttccgatgcttaccgcttataagca

SEQ ID NO: 935828 - DNA, 25 bp, Mus musculus
ttccgatgcttagcgcttataagca

SEQ ID NO: 935829 - DNA, 25 bp, Mus musculus
ttccgatggtgacaccgaccttgat

SEQ ID NO: 935830 - DNA, 25 bp, Mus musculus
ttccgatggtgagaccgaccttgat

SEQ ID NO: 935831 - DNA, 25 bp, Mus musculus
ttccgatgttttagcaactgtgggc

SEQ ID NO: 935832 - DNA, 25 bp, Mus musculus
ttccgatgtttttgcaactgtgggc

SEQ ID NO: 935833 - DNA, 25 bp, Mus musculus
ttccgattcgtccaacccggagagc

SEQ ID NO: 935834 - DNA, 25 bp, Mus musculus
ttccgattcgtcgaacccggagagc

SEQ ID NO: 935835 - DNA, 25 bp, Mus musculus
ttccgattggaaaatccctcaggat

SEQ ID NO: 935836 - DNA, 25 bp, Mus musculus
ttccgattggaatatccctcaggat

SEQ ID NO: 935837 - DNA, 25 bp, Mus musculus
ttccgattggcacatcctggagtca

SEQ ID NO: 935838 - DNA, 25 bp, Mus musculus
ttccgattggcagatcctggagtca

SEQ ID NO: 935839 - DNA, 25 bp, Mus musculus
ttccgcaatgagcagttcactttat

SEQ ID NO: 935840 - DNA, 25 bp, Mus musculus
ttccgcaatgaggagttcactttat

SEQ ID NO: 935841 - DNA, 25 bp, Mus musculus
ttccgcacagctaatgcagcttcta

SEQ ID NO: 935842 - DNA, 25 bp, Mus musculus
ttccgcacagcttatgcagcttcta

SEQ ID NO: 935843 - DNA, 25 bp, Mus musculus
ttccgcaccacacccagtatggtat

SEQ ID NO: 935844 - DNA, 25 bp, Mus musculus
ttccgcaccacagccagtatggtat

SEQ ID NO: 935845 - DNA, 25 bp, Mus musculus
ttccgcaggaatagtgtaacccagg

SEQ ID NO: 935846 - DNA, 25 bp, Mus musculus
ttccgcaggaattgtgtaacccagg

SEQ ID NO: 935847 - DNA, 25 bp, Mus musculus
ttccgcagtaccagggctatcacat

SEQ ID NO: 935848 - DNA, 25 bp, Mus musculus
ttccgcagtacctgggctatcacat

SEQ ID NO: 935849 - DNA, 25 bp, Mus musculus
ttccgcagtggactcaagggcagct

SEQ ID NO: 935850 - DNA, 25 bp, Mus musculus
ttccgcagtggagtcaagggcagct

SEQ ID NO: 935851 - DNA, 25 bp, Mus musculus
ttccgcatacgtctgggaacagtat

SEQ ID NO: 935852 - DNA, 25 bp, Mus musculus
ttccgcatacgtgtgggaacagtat

SEQ ID NO: 935853 - DNA, 25 bp, Mus musculus
ttccgcatccataaccaacagggtt

SEQ ID NO: 935854 - DNA, 25 bp, Mus musculus
ttccgcatccattaccaacagggtt

SEQ ID NO: 935855 - DNA, 25 bp, Mus musculus
ttccgcatgaacaacagccgcaaga

SEQ ID NO: 935856 - DNA, 25 bp, Mus musculus
ttccgcatgaactacagccgcaaga

SEQ ID NO: 935857 - DNA, 25 bp, Mus musculus
ttccgcattgttcttgctagcctag

SEQ ID NO: 935858 - DNA, 25 bp, Mus musculus
ttccgcattgttgttgctagcctag

SEQ ID NO: 935859 - DNA, 25 bp, Mus musculus
ttccgccactggcatattcagtctt

SEQ ID NO: 935860 - DNA, 25 bp, Mus musculus
ttccgccactgggatattcagtctt

SEQ ID NO: 935861 - DNA, 25 bp, Mus musculus
ttccgccagcaaagtcactctgaac

SEQ ID NO: 935862 - DNA, 25 bp, Mus musculus
ttccgccagcaatgtcactctgaac

SEQ ID NO: 935863 - DNA, 25 bp, Mus musculus
ttccgccagcacacatcggtgtttg

SEQ ID NO: 935864 - DNA, 25 bp, Mus musculus
ttccgccagcactcatcggtgtttg

SEQ ID NO: 935865 - DNA, 25 bp, Mus musculus
ttccgccagcgcatgatgcaaatgt

SEQ ID NO: 935866 - DNA, 25 bp, Mus musculus
ttccgccagcgcttgatgcaaatgt

SEQ ID NO: 935867 - DNA, 25 bp, Mus musculus
ttccgccatcagctcaggcaagaag

SEQ ID NO: 935868 - DNA, 25 bp, Mus musculus
ttccgccatcaggtcaggcaagaag

SEQ ID NO: 935869 - DNA, 25 bp, Mus musculus
ttccgccatgacaatgtgctcaata

SEQ ID NO: 935870 - DNA, 25 bp, Mus musculus
ttccgccatgactatgtgctcaata

SEQ ID NO: 935871 - DNA, 25 bp, Mus musculus
ttccgcccgagtagcagtttttaat

SEQ ID NO: 935872 - DNA, 25 bp, Mus musculus
ttccgcccgagttgcagtttttaat

SEQ ID NO: 935873 - DNA, 25 bp, Mus musculus
ttccgccgaaaaagagaagacgctt

SEQ ID NO: 935874 - DNA, 25 bp, Mus musculus
ttccgccgaaaatgagaagacgctt

SEQ ID NO: 935875 - DNA, 25 bp, Mus musculus
ttccgccgcgggaaaagccatctga

SEQ ID NO: 935876 - DNA, 25 bp, Mus musculus
ttccgccgcgggtaaagccatctga

SEQ ID NO: 935877 - DNA, 25 bp, Mus musculus
ttccgccggatgagagagcatctat

SEQ ID NO: 935878 - DNA, 25 bp, Mus musculus
ttccgccggatgtgagagcatctat

SEQ ID NO: 935879 - DNA, 25 bp, Mus musculus
ttccgcctacttctggttgggttgc

SEQ ID NO: 935880 - DNA, 25 bp, Mus musculus
ttccgcctacttgtggttgggttgc

SEQ ID NO: 935881 - DNA, 25 bp, Mus musculus
ttccgcctcaatcatggcttcaagg

SEQ ID NO: 935882 - DNA, 25 bp, Mus musculus
ttccgcctcaatgatggcttcaagg

SEQ ID NO: 935883 - DNA, 25 bp, Mus musculus
ttccgcctcctgaattttacaacaa

SEQ ID NO: 935884 - DNA, 25 bp, Mus musculus
ttccgcctcctgtattttacaacaa

SEQ ID NO: 935885 - DNA, 25 bp, Mus musculus
ttccgccttgacagtccatgaaaga

SEQ ID NO: 935886 - DNA, 25 bp, Mus musculus
ttccgccttgactgtccatgaaaga

SEQ ID NO: 935887 - DNA, 25 bp, Mus musculus
ttccgcgaaaacactgtctgggcta

SEQ ID NO: 935888 - DNA, 25 bp, Mus musculus
ttccgcgaaaactctgtctgggcta

SEQ ID NO: 935889 - DNA, 25 bp, Mus musculus
ttccgcgacatgagcctcataagga

SEQ ID NO: 935890 - DNA, 25 bp, Mus musculus
ttccgcgacatgtgcctcataagga

SEQ ID NO: 935891 - DNA, 25 bp, Mus musculus
ttccgcgagcacagggagcgctcct

SEQ ID NO: 935892 - DNA, 25 bp, Mus musculus
ttccgcgagcactgggagcgctcct

SEQ ID NO: 935893 - DNA, 25 bp, Mus musculus
ttccgcgcatgaccagtgaggcttg

SEQ ID NO: 935894 - DNA, 25 bp, Mus musculus
ttccgcgcatgagcagtgaggcttg

SEQ ID NO: 935895 - DNA, 25 bp, Mus musculus
ttccgcgccgtcatgtctgtcctga

SEQ ID NO: 935896 - DNA, 25 bp, Mus musculus
ttccgcgccgtcttgtctgtcctga

SEQ ID NO: 935897 - DNA, 25 bp, Mus musculus
ttccgcgtaactctctgtggagtga

SEQ ID NO: 935898 - DNA, 25 bp, Mus musculus
ttccgcgtaactgtctgtggagtga

SEQ ID NO: 935899 - DNA, 25 bp, Mus musculus
ttccgcgttccccactggagatgac

SEQ ID NO: 935900 - DNA, 25 bp, Mus musculus
ttccgcgttcccgactggagatgac

SEQ ID NO: 935901 - DNA, 25 bp, Mus musculus
ttccgcgttcgacgactgttttcag

SEQ ID NO: 935902 - DNA, 25 bp, Mus musculus
ttccgcgttcgaggactgttttcag

SEQ ID NO: 935903 - DNA, 25 bp, Mus musculus
ttccgctacaaacagtcgctcaagt

SEQ ID NO: 935904 - DNA, 25 bp, Mus musculus
ttccgctacaaagagtcgctcaagt

SEQ ID NO: 935905 - DNA, 25 bp, Mus musculus
ttccgctacactaatgctgccataa

SEQ ID NO: 935906 - DNA, 25 bp, Mus musculus
ttccgctacacttatgctgccataa

SEQ ID NO: 935907 - DNA, 25 bp, Mus musculus
ttccgctacggcaatttcattcctg

SEQ ID NO: 935908 - DNA, 25 bp, Mus musculus
ttccgctacggctatttcattcctg

SEQ ID NO: 935909 - DNA, 25 bp, Mus musculus
ttccgctcagcaccgtgccggtagg

SEQ ID NO: 935910 - DNA, 25 bp, Mus musculus
ttccgctcagcagcgtgccggtagg

SEQ ID NO: 935911 - DNA, 25 bp, Mus musculus
ttccgctcctacattgcagcaggtt

SEQ ID NO: 935912 - DNA, 25 bp, Mus musculus
ttccgctcctactttgcagcaggtt

SEQ ID NO: 935913 - DNA, 25 bp, Mus musculus
ttccgctctttgacagagtattggt

SEQ ID NO: 935914 - DNA, 25 bp, Mus musculus
ttccgctctttgtcagagtattggt

SEQ ID NO: 935915 - DNA, 25 bp, Mus musculus
ttccgctggagacactactgacgtt

SEQ ID NO: 935916 - DNA, 25 bp, Mus musculus
ttccgctggagagactactgacgtt

SEQ ID NO: 935917 - DNA, 25 bp, Mus musculus
ttccgctggcttcgacctaaaggtt

SEQ ID NO: 935918 - DNA, 25 bp, Mus musculus
ttccgctggcttggacctaaaggtt

SEQ ID NO: 935919 - DNA, 25 bp, Mus musculus
ttccgctgggttagcaggcttgtga

SEQ ID NO: 935920 - DNA, 25 bp, Mus musculus
ttccgctgggtttgcaggcttgtga

SEQ ID NO: 935921 - DNA, 25 bp, Mus musculus
ttccgctgtccgcaaatcccggagt

SEQ ID NO: 935922 - DNA, 25 bp, Mus musculus
ttccgctgtccggaaatcccggagt

SEQ ID NO: 935923 - DNA, 25 bp, Mus musculus
ttccgctgtgaaattgcagtgatgc

SEQ ID NO: 935924 - DNA, 25 bp, Mus musculus
ttccgctgtgaatttgcagtgatgc

SEQ ID NO: 935925 - DNA, 25 bp, Mus musculus
ttccgctgtttcagagtgggacccc

SEQ ID NO: 935926 - DNA, 25 bp, Mus musculus
ttccgctgtttctgagtgggacccc

SEQ ID NO: 935927 - DNA, 25 bp, Mus musculus
ttccgctttcccatttgtgttagaa

SEQ ID NO: 935928 - DNA, 25 bp, Mus musculus
ttccgctttcccttttgtgttagaa

SEQ ID NO: 935929 - DNA, 25 bp, Mus musculus
ttccgctttctcctcctgggatctt

SEQ ID NO: 935930 - DNA, 25 bp, Mus musculus
ttccgctttctcgtcctgggatctt

SEQ ID NO: 935931 - DNA, 25 bp, Mus musculus
ttccgctttgatcccgacaacgtca

SEQ ID NO: 935932 - DNA, 25 bp, Mus musculus
ttccgctttgatgccgacaacgtca

SEQ ID NO: 935933 - DNA, 25 bp, Mus musculus
ttccgctttgtcctacagcttgtgg

SEQ ID NO: 935934 - DNA, 25 bp, Mus musculus
ttccgctttgtcgtacagcttgtgg

SEQ ID NO: 935935 - DNA, 25 bp, Mus musculus
ttccggaaatgccttctgctttggg

SEQ ID NO: 935936 - DNA, 25 bp, Mus musculus
ttccggaaatgcgttctgctttggg

SEQ ID NO: 935937 - DNA, 25 bp, Mus musculus
ttccggaactggaatagcgccgctt

SEQ ID NO: 935938 - DNA, 25 bp, Mus musculus
ttccggaactggtatagcgccgctt

SEQ ID NO: 935939 - DNA, 25 bp, Mus musculus
ttccggaactttccctctaatgttt

SEQ ID NO: 935940 - DNA, 25 bp, Mus musculus
ttccggaactttgcctctaatgttt

SEQ ID NO: 935941 - DNA, 25 bp, Mus musculus
ttccggaagccacccacagggcaaa

SEQ ID NO: 935942 - DNA, 25 bp, Mus musculus
ttccggaagccagccacagggcaaa

SEQ ID NO: 935943 - DNA, 25 bp, Mus musculus
ttccggacgtgaagaccacatgcat

SEQ ID NO: 935944 - DNA, 25 bp, Mus musculus
ttccggacgtgatgaccacatgcat

SEQ ID NO: 935945 - DNA, 25 bp, Mus musculus
ttccggactatgaacaatatttctt

SEQ ID NO: 935946 - DNA, 25 bp, Mus musculus
ttccggactatgtacaatatttctt

SEQ ID NO: 935947 - DNA, 25 bp, Mus musculus
ttccggactgcgcatgtgcagagca

SEQ ID NO: 935948 - DNA, 25 bp, Mus musculus
ttccggactgcggatgtgcagagca

SEQ ID NO: 935949 - DNA, 25 bp, Mus musculus
ttccggagcacgaggaggactacct

SEQ ID NO: 935950 - DNA, 25 bp, Mus musculus
ttccggagcacgtggaggactacct

SEQ ID NO: 935951 - DNA, 25 bp, Mus musculus
ttccggagcttcatatggccaagac

SEQ ID NO: 935952 - DNA, 25 bp, Mus musculus
ttccggagcttcttatggccaagac

SEQ ID NO: 935953 - DNA, 25 bp, Mus musculus
ttccggatcctaactttggttttct

SEQ ID NO: 935954 - DNA, 25 bp, Mus musculus
ttccggatcctatctttggttttct

SEQ ID NO: 935955 - DNA, 25 bp, Mus musculus
ttccggatgactacaattgccaggt

SEQ ID NO: 935956 - DNA, 25 bp, Mus musculus
ttccggatgacttcaattgccaggt

SEQ ID NO: 935957 - DNA, 25 bp, Mus musculus
ttccggattgacattctatatttta

SEQ ID NO: 935958 - DNA, 25 bp, Mus musculus
ttccggattgactttctatatttta

SEQ ID NO: 935959 - DNA, 25 bp, Mus musculus
ttccggattgccattctacaacaga

SEQ ID NO: 935960 - DNA, 25 bp, Mus musculus
ttccggattgcctttctacaacaga

SEQ ID NO: 935961 - DNA, 25 bp, Mus musculus
ttccggcaccttcagactctgaaga

SEQ ID NO: 935962 - DNA, 25 bp, Mus musculus
ttccggcaccttgagactctgaaga

SEQ ID NO: 935963 - DNA, 25 bp, Mus musculus
ttccggcagtacccgaaggacatag

SEQ ID NO: 935964 - DNA, 25 bp, Mus musculus
ttccggcagtacgcgaaggacatag

SEQ ID NO: 935965 - DNA, 25 bp, Mus musculus
ttccggcagtttcgctaccaggacg

SEQ ID NO: 935966 - DNA, 25 bp, Mus musculus
ttccggcagtttggctaccaggacg

SEQ ID NO: 935967 - DNA, 25 bp, Mus musculus
ttccggcccaatcctaactggaata

SEQ ID NO: 935968 - DNA, 25 bp, Mus musculus
ttccggcccaatgctaactggaata

SEQ ID NO: 935969 - DNA, 25 bp, Mus musculus
ttccggcctttgcagtgtgtacaga

SEQ ID NO: 935970 - DNA, 25 bp, Mus musculus
ttccggcctttggagtgtgtacaga

SEQ ID NO: 935971 - DNA, 25 bp, Mus musculus
ttccggcgcataaagtcagcaaggt

SEQ ID NO: 935972 - DNA, 25 bp, Mus musculus
ttccggcgcatatagtcagcaaggt

SEQ ID NO: 935973 - DNA, 25 bp, Mus musculus
ttccggcgcgcgatggtgagataac

SEQ ID NO: 935974 - DNA, 25 bp, Mus musculus
ttccggcgcgcgttggtgagataac

SEQ ID NO: 935975 - DNA, 25 bp, Mus musculus
ttccggcgtccgaagtagttcttat

SEQ ID NO: 935976 - DNA, 25 bp, Mus musculus
ttccggcgtccgtagtagttcttat

SEQ ID NO: 935977 - DNA, 25 bp, Mus musculus
ttccggctcccaatcgattagagga

SEQ ID NO: 935978 - DNA, 25 bp, Mus musculus
ttccggctcccattcgattagagga

SEQ ID NO: 935979 - DNA, 25 bp, Mus musculus
ttccggctcgaacgttctggattac

SEQ ID NO: 935980 - DNA, 25 bp, Mus musculus
ttccggctcgaaggttctggattac

SEQ ID NO: 935981 - DNA, 25 bp, Mus musculus
ttccggctctatcggcactgggtaa

SEQ ID NO: 935982 - DNA, 25 bp, Mus musculus
ttccggctctatgggcactgggtaa

SEQ ID NO: 935983 - DNA, 25 bp, Mus musculus
ttccggctgccacggttcaggagaa

SEQ ID NO: 935984 - DNA, 25 bp, Mus musculus
ttccggctgccagggttcaggagaa

SEQ ID NO: 935985 - DNA, 25 bp, Mus musculus
ttccggctgccgactatggtgtaga

SEQ ID NO: 935986 - DNA, 25 bp, Mus musculus
ttccggctgccgtctatggtgtaga

SEQ ID NO: 935987 - DNA, 25 bp, Mus musculus
ttccgggagaacctgcaacaacaaa

SEQ ID NO: 935988 - DNA, 25 bp, Mus musculus
ttccgggagaacgtgcaacaacaaa

SEQ ID NO: 935989 - DNA, 25 bp, Mus musculus
ttccgggagcacatggttcgagaga

SEQ ID NO: 935990 - DNA, 25 bp, Mus musculus
ttccgggagcacttggttcgagaga

SEQ ID NO: 935991 - DNA, 25 bp, Mus musculus
ttccgggatccaatgccaagcttag

SEQ ID NO: 935992 - DNA, 25 bp, Mus musculus
ttccgggatccattgccaagcttag

SEQ ID NO: 935993 - DNA, 25 bp, Mus musculus
ttccgggatctgaacaaggacgggc

SEQ ID NO: 935994 - DNA, 25 bp, Mus musculus
ttccgggatctgtacaaggacgggc

SEQ ID NO: 935995 - DNA, 25 bp, Mus musculus
ttccgggatgcacgccctggtgcta

SEQ ID NO: 935996 - DNA, 25 bp, Mus musculus
ttccgggatgcaggccctggtgcta

SEQ ID NO: 935997 - DNA, 25 bp, Mus musculus
ttccgggatggaacttcacctcatt

SEQ ID NO: 935998 - DNA, 25 bp, Mus musculus
ttccgggatggatcttcacctcatt

SEQ ID NO: 935999 - DNA, 25 bp, Mus musculus
ttccgggattctcatagtcagccaa

SEQ ID NO: 936000 - DNA, 25 bp, Mus musculus
ttccgggattctgatagtcagccaa

SEQ ID NO: 936001 - DNA, 25 bp, Mus musculus
ttccgggcactgataactgtggtgt

SEQ ID NO: 936002 - DNA, 25 bp, Mus musculus
ttccgggcactgttaactgtggtgt

SEQ ID NO: 936003 - DNA, 25 bp, Mus musculus
ttccgggcatcgcagaagaaattgg

SEQ ID NO: 936004 - DNA, 25 bp, Mus musculus
ttccgggcatcggagaagaaattgg

SEQ ID NO: 936005 - DNA, 25 bp, Mus musculus
ttccgggcctatctcagaaggctgg

SEQ ID NO: 936006 - DNA, 25 bp, Mus musculus
ttccgggcctatgtcagaaggctgg

SEQ ID NO: 936007 - DNA, 25 bp, Mus musculus
ttccgggcctgaagcctacgaagaa

SEQ ID NO: 936008 - DNA, 25 bp, Mus musculus
ttccgggcctgatgcctacgaagaa

SEQ ID NO: 936009 - DNA, 25 bp, Mus musculus
ttccgggccttcaggatgagggaca

SEQ ID NO: 936010 - DNA, 25 bp, Mus musculus
ttccgggccttctggatgagggaca

SEQ ID NO: 936011 - DNA, 25 bp, Mus musculus
ttccgggctgagagcaagtacacat

SEQ ID NO: 936012 - DNA, 25 bp, Mus musculus
ttccgggctgagtgcaagtacacat

SEQ ID NO: 936013 - DNA, 25 bp, Mus musculus
ttccgggctgtcacctgacgctaca

SEQ ID NO: 936014 - DNA, 25 bp, Mus musculus
ttccgggctgtctcctgacgctaca

SEQ ID NO: 936015 - DNA, 25 bp, Mus musculus
ttccgggtcgcaagatctaacagtc

SEQ ID NO: 936016 - DNA, 25 bp, Mus musculus
ttccgggtcgcatgatctaacagtc

SEQ ID NO: 936017 - DNA, 25 bp, Mus musculus
ttccgggtggcacaacgcaaggtca

SEQ ID NO: 936018 - DNA, 25 bp, Mus musculus
ttccgggtggcagaacgcaaggtca

SEQ ID NO: 936019 - DNA, 25 bp, Mus musculus
ttccgggttgttacagccgcgaacg

SEQ ID NO: 936020 - DNA, 25 bp, Mus musculus
ttccgggttgtttcagccgcgaacg

SEQ ID NO: 936021 - DNA, 25 bp, Mus musculus
ttccggtaatctatgttctcctagt

SEQ ID NO: 936022 - DNA, 25 bp, Mus musculus
ttccggtaatctttgttctcctagt

SEQ ID NO: 936023 - DNA, 25 bp, Mus musculus
ttccggtaccttatcttcatggtca

SEQ ID NO: 936024 - DNA, 25 bp, Mus musculus
ttccggtaccttttcttcatggtca

SEQ ID NO: 936025 - DNA, 25 bp, Mus musculus
ttccggtacgacctcatcctgaaga

SEQ ID NO: 936026 - DNA, 25 bp, Mus musculus
ttccggtacgacgtcatcctgaaga

SEQ ID NO: 936027 - DNA, 25 bp, Mus musculus
ttccggtatgaaaaccactcttagt

SEQ ID NO: 936028 - DNA, 25 bp, Mus musculus
ttccggtatgaataccactcttagt

SEQ ID NO: 936029 - DNA, 25 bp, Mus musculus
ttccggtcagacacacctcgaaaag

SEQ ID NO: 936030 - DNA, 25 bp, Mus musculus
ttccggtcagactcacctcgaaaag

SEQ ID NO: 936031 - DNA, 25 bp, Mus musculus
ttccggtccactatcaggagttcaa

SEQ ID NO: 936032 - DNA, 25 bp, Mus musculus
ttccggtccactttcaggagttcaa

SEQ ID NO: 936033 - DNA, 25 bp, Mus musculus
ttccggtccccaagaagccttgaag

SEQ ID NO: 936034 - DNA, 25 bp, Mus musculus
ttccggtccccatgaagccttgaag

SEQ ID NO: 936035 - DNA, 25 bp, Mus musculus
ttccggtccggtcttcgtattagtg

SEQ ID NO: 936036 - DNA, 25 bp, Mus musculus
ttccggtccggtgttcgtattagtg

SEQ ID NO: 936037 - DNA, 25 bp, Mus musculus
ttccggtcctgacacacgttcagaa

SEQ ID NO: 936038 - DNA, 25 bp, Mus musculus
ttccggtcctgagacacgttcagaa

SEQ ID NO: 936039 - DNA, 25 bp, Mus musculus
ttccggtcggagctgtgatcaactg

SEQ ID NO: 936040 - DNA, 25 bp, Mus musculus
ttccggtcggaggtgtgatcaactg

SEQ ID NO: 936041 - DNA, 25 bp, Mus musculus
ttccggtctgtgctcctacgtgaaa

SEQ ID NO: 936042 - DNA, 25 bp, Mus musculus
ttccggtctgtggtcctacgtgaaa

SEQ ID NO: 936043 - DNA, 25 bp, Mus musculus
ttccggtcttcacggtacagggtat

SEQ ID NO: 936044 - DNA, 25 bp, Mus musculus
ttccggtcttcagggtacagggtat

SEQ ID NO: 936045 - DNA, 25 bp, Mus musculus
ttccggtgaactctcagttgccaaa

SEQ ID NO: 936046 - DNA, 25 bp, Mus musculus
ttccggtgaactgtcagttgccaaa

SEQ ID NO: 936047 - DNA, 25 bp, Mus musculus
ttccggtgccttcccaatgatgaag

SEQ ID NO: 936048 - DNA, 25 bp, Mus musculus
ttccggtgccttgccaatgatgaag

SEQ ID NO: 936049 - DNA, 25 bp, Mus musculus
ttccggtggaacagtacccggagct

SEQ ID NO: 936050 - DNA, 25 bp, Mus musculus
ttccggtggaactgtacccggagct

SEQ ID NO: 936051 - DNA, 25 bp, Mus musculus
ttccggtggccacaggacgaaaaca

SEQ ID NO: 936052 - DNA, 25 bp, Mus musculus
ttccggtggccagaggacgaaaaca

SEQ ID NO: 936053 - DNA, 25 bp, Mus musculus
ttccggtgtgttccctgtgccatgg

SEQ ID NO: 936054 - DNA, 25 bp, Mus musculus
ttccggtgtgttgcctgtgccatgg

SEQ ID NO: 936055 - DNA, 25 bp, Mus musculus
ttccggttaaccatggcaaagtcag

SEQ ID NO: 936056 - DNA, 25 bp, Mus musculus
ttccggttaaccttggcaaagtcag

SEQ ID NO: 936057 - DNA, 25 bp, Mus musculus
ttccggttccttctgggactgagtt

SEQ ID NO: 936058 - DNA, 25 bp, Mus musculus
ttccggttccttgtgggactgagtt

SEQ ID NO: 936059 - DNA, 25 bp, Mus musculus
ttccggttctaacaggctctgcagc

SEQ ID NO: 936060 - DNA, 25 bp, Mus musculus
ttccggttctaagaggctctgcagc

SEQ ID NO: 936061 - DNA, 25 bp, Mus musculus
ttccgtaaagctagaagcctgacat

SEQ ID NO: 936062 - DNA, 25 bp, Mus musculus
ttccgtaaagcttgaagcctgacat

SEQ ID NO: 936063 - DNA, 25 bp, Mus musculus
ttccgtaaggaaaccatctgagtat

SEQ ID NO: 936064 - DNA, 25 bp, Mus musculus
ttccgtaaggaatccatctgagtat

SEQ ID NO: 936065 - DNA, 25 bp, Mus musculus
ttccgtaataggctattcaggtgct

SEQ ID NO: 936066 - DNA, 25 bp, Mus musculus
ttccgtaatagggtattcaggtgct

SEQ ID NO: 936067 - DNA, 25 bp, Mus musculus
ttccgtacacagatggagccgggta

SEQ ID NO: 936068 - DNA, 25 bp, Mus musculus
ttccgtacacagttggagccgggta

SEQ ID NO: 936069 - DNA, 25 bp, Mus musculus
ttccgtactgcaactgatcacaatg

SEQ ID NO: 936070 - DNA, 25 bp, Mus musculus
ttccgtactgcatctgatcacaatg

SEQ ID NO: 936071 - DNA, 25 bp, Mus musculus
ttccgtacttagatttccattagat

SEQ ID NO: 936072 - DNA, 25 bp, Mus musculus
ttccgtacttagttttccattagat

SEQ ID NO: 936073 - DNA, 25 bp, Mus musculus
ttccgtagcaatattcccaatctgg

SEQ ID NO: 936074 - DNA, 25 bp, Mus musculus
ttccgtagcaattttcccaatctgg

SEQ ID NO: 936075 - DNA, 25 bp, Mus musculus
ttccgtagctctctctatgaagggt

SEQ ID NO: 936076 - DNA, 25 bp, Mus musculus
ttccgtagctctgtctatgaagggt

SEQ ID NO: 936077 - DNA, 25 bp, Mus musculus
ttccgtagggttccgcctggcccag

SEQ ID NO: 936078 - DNA, 25 bp, Mus musculus
ttccgtagggttgcgcctggcccag

SEQ ID NO: 936079 - DNA, 25 bp, Mus musculus
ttccgtataaaacccagcaagctag

SEQ ID NO: 936080 - DNA, 25 bp, Mus musculus
ttccgtataaaagccagcaagctag

SEQ ID NO: 936081 - DNA, 25 bp, Mus musculus
ttccgtataaatctcattcttctac

SEQ ID NO: 936082 - DNA, 25 bp, Mus musculus
ttccgtataaatgtcattcttctac

SEQ ID NO: 936083 - DNA, 25 bp, Mus musculus
ttccgtatccggctcaacagatact

SEQ ID NO: 936084 - DNA, 25 bp, Mus musculus
ttccgtatccgggtcaacagatact

SEQ ID NO: 936085 - DNA, 25 bp, Mus musculus
ttccgtattcttcctgtgttatgcc

SEQ ID NO: 936086 - DNA, 25 bp, Mus musculus
ttccgtattcttgctgtgttatgcc

SEQ ID NO: 936087 - DNA, 25 bp, Mus musculus
ttccgtcaattgctctgtctttctt

SEQ ID NO: 936088 - DNA, 25 bp, Mus musculus
ttccgtcaattggtctgtctttctt

SEQ ID NO: 936089 - DNA, 25 bp, Mus musculus
ttccgtcactgtcaagctgcactag

SEQ ID NO: 936090 - DNA, 25 bp, Mus musculus
ttccgtcactgtgaagctgcactag

SEQ ID NO: 936091 - DNA, 25 bp, Mus musculus
ttccgtcattgtatataggcctctg

SEQ ID NO: 936092 - DNA, 25 bp, Mus musculus
ttccgtcattgtttataggcctctg

SEQ ID NO: 936093 - DNA, 25 bp, Mus musculus
ttccgtccgacgaatttaccataag

SEQ ID NO: 936094 - DNA, 25 bp, Mus musculus
ttccgtccgacgtatttaccataag

SEQ ID NO: 936095 - DNA, 25 bp, Mus musculus
ttccgtcctgatcataagtattctt

SEQ ID NO: 936096 - DNA, 25 bp, Mus musculus
ttccgtcctgatgataagtattctt

SEQ ID NO: 936097 - DNA, 25 bp, Mus musculus
ttccgtcctgtgaacactgcgaaat

SEQ ID NO: 936098 - DNA, 25 bp, Mus musculus
ttccgtcctgtgtacactgcgaaat

SEQ ID NO: 936099 - DNA, 25 bp, Mus musculus
ttccgtcgaggaagtcgtcagcaga

SEQ ID NO: 936100 - DNA, 25 bp, Mus musculus
ttccgtcgaggatgtcgtcagcaga

SEQ ID NO: 936101 - DNA, 25 bp, Mus musculus
ttccgtcgcggacagtgccagcaga

SEQ ID NO: 936102 - DNA, 25 bp, Mus musculus
ttccgtcgcggagagtgccagcaga

SEQ ID NO: 936103 - DNA, 25 bp, Mus musculus
ttccgtctagaactcttccgacaga

SEQ ID NO: 936104 - DNA, 25 bp, Mus musculus
ttccgtctagaagtcttccgacaga

SEQ ID NO: 936105 - DNA, 25 bp, Mus musculus
ttccgtctagcaatggccacaggtt

SEQ ID NO: 936106 - DNA, 25 bp, Mus musculus
ttccgtctagcattggccacaggtt

SEQ ID NO: 936107 - DNA, 25 bp, Mus musculus
ttccgtctcattatcagtttaagta

SEQ ID NO: 936108 - DNA, 25 bp, Mus musculus
ttccgtctcattttcagtttaagta

SEQ ID NO: 936109 - DNA, 25 bp, Mus musculus
ttccgtctctgaccaaatgcatctc

SEQ ID NO: 936110 - DNA, 25 bp, Mus musculus
ttccgtctctgagcaaatgcatctc

SEQ ID NO: 936111 - DNA, 25 bp, Mus musculus
ttccgtctggagaacgagcatctaa

SEQ ID NO: 936112 - DNA, 25 bp, Mus musculus
ttccgtctggagtacgagcatctaa

SEQ ID NO: 936113 - DNA, 25 bp, Mus musculus
ttccgtgaaggtccgtcttcctcaa

SEQ ID NO: 936114 - DNA, 25 bp, Mus musculus
ttccgtgaaggtgcgtcttcctcaa

SEQ ID NO: 936115 - DNA, 25 bp, Mus musculus
ttccgtgaatgtcgagaaccagtct

SEQ ID NO: 936116 - DNA, 25 bp, Mus musculus
ttccgtgaatgtggagaaccagtct

SEQ ID NO: 936117 - DNA, 25 bp, Mus musculus
ttccgtgactacatgttctcagcaa

SEQ ID NO: 936118 - DNA, 25 bp, Mus musculus
ttccgtgactacttgttctcagcaa

SEQ ID NO: 936119 - DNA, 25 bp, Mus musculus
ttccgtgatgggagtttttcccagc

SEQ ID NO: 936120 - DNA, 25 bp, Mus musculus
ttccgtgatgggtgtttttcccagc

SEQ ID NO: 936121 - DNA, 25 bp, Mus musculus
ttccgtgcaataacatgtggcctgg

SEQ ID NO: 936122 - DNA, 25 bp, Mus musculus
ttccgtgcaatatcatgtggcctgg

SEQ ID NO: 936123 - DNA, 25 bp, Mus musculus
ttccgtgccatacaggatgactgcc

SEQ ID NO: 936124 - DNA, 25 bp, Mus musculus
ttccgtgccatagaggatgactgcc

SEQ ID NO: 936125 - DNA, 25 bp, Mus musculus
ttccgtgccctgagtgtatattcag

SEQ ID NO: 936126 - DNA, 25 bp, Mus musculus
ttccgtgccctgtgtgtatattcag

SEQ ID NO: 936127 - DNA, 25 bp, Mus musculus
ttccgtgcctacatgaacctggaca

SEQ ID NO: 936128 - DNA, 25 bp, Mus musculus
ttccgtgcctacttgaacctggaca

SEQ ID NO: 936129 - DNA, 25 bp, Mus musculus
ttccgtgcgcttacacatccttatt

SEQ ID NO: 936130 - DNA, 25 bp, Mus musculus
ttccgtgcgctttcacatccttatt

SEQ ID NO: 936131 - DNA, 25 bp, Mus musculus
ttccgtgctactactagactaacaa

SEQ ID NO: 936132 - DNA, 25 bp, Mus musculus
ttccgtgctacttctagactaacaa

SEQ ID NO: 936133 - DNA, 25 bp, Mus musculus
ttccgtgctcagaccttatgtggaa

SEQ ID NO: 936134 - DNA, 25 bp, Mus musculus
ttccgtgctcagtccttatgtggaa

SEQ ID NO: 936135 - DNA, 25 bp, Mus musculus
ttccgtgctttgacgaactcttcta

SEQ ID NO: 936136 - DNA, 25 bp, Mus musculus
ttccgtgctttgtcgaactcttcta

SEQ ID NO: 936137 - DNA, 25 bp, Mus musculus
ttccgtggacacattctatgttagt

SEQ ID NO: 936138 - DNA, 25 bp, Mus musculus
ttccgtggacactttctatgttagt

SEQ ID NO: 936139 - DNA, 25 bp, Mus musculus
ttccgtggctgaatccttgcatgtg

SEQ ID NO: 936140 - DNA, 25 bp, Mus musculus
ttccgtggctgattccttgcatgtg

SEQ ID NO: 936141 - DNA, 25 bp, Mus musculus
ttccgtgtaataatttttgtgcgct

SEQ ID NO: 936142 - DNA, 25 bp, Mus musculus
ttccgtgtaatattttttgtgcgct

SEQ ID NO: 936143 - DNA, 25 bp, Mus musculus
ttccgtgtatgcctggaggacaaag

SEQ ID NO: 936144 - DNA, 25 bp, Mus musculus
ttccgtgtatgcgtggaggacaaag

SEQ ID NO: 936145 - DNA, 25 bp, Mus musculus
ttccgtgtgaaaagtgaagctgtgt

SEQ ID NO: 936146 - DNA, 25 bp, Mus musculus
ttccgtgtgaaatgtgaagctgtgt

SEQ ID NO: 936147 - DNA, 25 bp, Mus musculus
ttccgtgtgatcaccaagcgccgtg

SEQ ID NO: 936148 - DNA, 25 bp, Mus musculus
ttccgtgtgatcatcatagctctag

SEQ ID NO: 936149 - DNA, 25 bp, Mus musculus
ttccgtgtgatctccaagcgccgtg

SEQ ID NO: 936150 - DNA, 25 bp, Mus musculus
ttccgtgtgatcttcatagctctag

SEQ ID NO: 936151 - DNA, 25 bp, Mus musculus
ttccgtgtgcttaaaaaaggtgttg

SEQ ID NO: 936152 - DNA, 25 bp, Mus musculus
ttccgtgtgcttagatgtgatctgt

SEQ ID NO: 936153 - DNA, 25 bp, Mus musculus
ttccgtgtgctttaaaaaggtgttg

SEQ ID NO: 936154 - DNA, 25 bp, Mus musculus
ttccgtgtgctttgatgtgatctgt

SEQ ID NO: 936155 - DNA, 25 bp, Mus musculus
ttccgtgttagtctggtggacccaa

SEQ ID NO: 936156 - DNA, 25 bp, Mus musculus
ttccgtgttagtgtggtggacccaa

SEQ ID NO: 936157 - DNA, 25 bp, Mus musculus
ttccgtgttcacagggcacaacagg

SEQ ID NO: 936158 - DNA, 25 bp, Mus musculus
ttccgtgttcactgggcacaacagg

SEQ ID NO: 936159 - DNA, 25 bp, Mus musculus
ttccgtgttcctagtattttctgta

SEQ ID NO: 936160 - DNA, 25 bp, Mus musculus
ttccgtgttccttgtattttctgta

SEQ ID NO: 936161 - DNA, 25 bp, Mus musculus
ttccgttacaatcgctcactaacca

SEQ ID NO: 936162 - DNA, 25 bp, Mus musculus
ttccgttacaatggctcactaacca

SEQ ID NO: 936163 - DNA, 25 bp, Mus musculus
ttccgttcccaacccctgttgggag

SEQ ID NO: 936164 - DNA, 25 bp, Mus musculus
ttccgttcccaagccctgttgggag

SEQ ID NO: 936165 - DNA, 25 bp, Mus musculus
ttccgttctccactgtctaaaattt

SEQ ID NO: 936166 - DNA, 25 bp, Mus musculus
ttccgttctccagtgtctaaaattt

SEQ ID NO: 936167 - DNA, 25 bp, Mus musculus
ttccgttcttctctggctcttttaa

SEQ ID NO: 936168 - DNA, 25 bp, Mus musculus
ttccgttcttctgtggctcttttaa

SEQ ID NO: 936169 - DNA, 25 bp, Mus musculus
ttccgttcttgtatctcctttctgt

SEQ ID NO: 936170 - DNA, 25 bp, Mus musculus
ttccgttcttgtttctcctttctgt

SEQ ID NO: 936171 - DNA, 25 bp, Mus musculus
ttccgttgctgtcgtaaagcaccat

SEQ ID NO: 936172 - DNA, 25 bp, Mus musculus
ttccgttgctgtggtaaagcaccat

SEQ ID NO: 936173 - DNA, 25 bp, Mus musculus
ttccgttggcatcgccatgtatact

SEQ ID NO: 936174 - DNA, 25 bp, Mus musculus
ttccgttggcatggccatgtatact

SEQ ID NO: 936175 - DNA, 25 bp, Mus musculus
ttccgttgtagcaacctccaaagag

SEQ ID NO: 936176 - DNA, 25 bp, Mus musculus
ttccgttgtagctacctccaaagag

SEQ ID NO: 936177 - DNA, 25 bp, Mus musculus
ttccgttgtgtccttttttgctgtc

SEQ ID NO: 936178 - DNA, 25 bp, Mus musculus
ttccgttgtgtcgttttttgctgtc

SEQ ID NO: 936179 - DNA, 25 bp, Mus musculus
ttccgtttacacatggagagctcct

SEQ ID NO: 936180 - DNA, 25 bp, Mus musculus
ttccgtttacacttggagagctcct

SEQ ID NO: 936181 - DNA, 25 bp, Mus musculus
ttccgtttacctacttggtgctgat

SEQ ID NO: 936182 - DNA, 25 bp, Mus musculus
ttccgtttaccttcttggtgctgat

SEQ ID NO: 936183 - DNA, 25 bp, Mus musculus
ttccgtttagctaccagacaacttt

SEQ ID NO: 936184 - DNA, 25 bp, Mus musculus
ttccgtttagcttccagacaacttt

SEQ ID NO: 936185 - DNA, 25 bp, Mus musculus
ttccgtttccgaatggtgaacaggc

SEQ ID NO: 936186 - DNA, 25 bp, Mus musculus
ttccgtttccgattggtgaacaggc

SEQ ID NO: 936187 - DNA, 25 bp, Mus musculus
ttccgtttctttcagctggctggaa

SEQ ID NO: 936188 - DNA, 25 bp, Mus musculus
ttccgtttctttgagctggctggaa

SEQ ID NO: 936189 - DNA, 25 bp, Mus musculus
ttccgtttgaaacgtgctcgttacg

SEQ ID NO: 936190 - DNA, 25 bp, Mus musculus
ttccgtttgaaaggtgctcgttacg

SEQ ID NO: 936191 - DNA, 25 bp, Mus musculus
ttccgtttgcctagaactctatgag

SEQ ID NO: 936192 - DNA, 25 bp, Mus musculus
ttccgtttgccttgaactctatgag

SEQ ID NO: 936193 - DNA, 25 bp, Mus musculus
ttccgtttgttcataagacatgcaa

SEQ ID NO: 936194 - DNA, 25 bp, Mus musculus
ttccgtttgttcttaagacatgcaa

SEQ ID NO: 936195 - DNA, 25 bp, Mus musculus
ttccgttttagtcaaagttagagct

SEQ ID NO: 936196 - DNA, 25 bp, Mus musculus
ttccgttttagtgaaagttagagct

SEQ ID NO: 936197 - DNA, 25 bp, Mus musculus
ttccgttttccgcaggcaatgggaa

SEQ ID NO: 936198 - DNA, 25 bp, Mus musculus
ttccgttttccggaggcaatgggaa

SEQ ID NO: 936199 - DNA, 25 bp, Mus musculus
ttccgtttttttcttctgatgccaa

SEQ ID NO: 936200 - DNA, 25 bp, Mus musculus
ttccgtttttttgttctgatgccaa

SEQ ID NO: 936201 - DNA, 25 bp, Mus musculus
ttcctaaaagagctgccttggccat

SEQ ID NO: 936202 - DNA, 25 bp, Mus musculus
ttcctaaaagaggtgccttggccat

SEQ ID NO: 936203 - DNA, 25 bp, Mus musculus
ttcctaaacctgctgtatgtgctca

SEQ ID NO: 936204 - DNA, 25 bp, Mus musculus
ttcctaaacctggtgtatgtgctca

SEQ ID NO: 936205 - DNA, 25 bp, Mus musculus
ttcctaaactcgagactggccatgg

SEQ ID NO: 936206 - DNA, 25 bp, Mus musculus
ttcctaaactcgtgactggccatgg

SEQ ID NO: 936207 - DNA, 25 bp, Mus musculus
ttcctaagaacaccttgattgtaca

SEQ ID NO: 936208 - DNA, 25 bp, Mus musculus
ttcctaagaacagcttgattgtaca

SEQ ID NO: 936209 - DNA, 25 bp, Mus musculus
ttcctaagaacgaatcccatgcatc

SEQ ID NO: 936210 - DNA, 25 bp, Mus musculus
ttcctaagaacgtatcccatgcatc

SEQ ID NO: 936211 - DNA, 25 bp, Mus musculus
ttcctaagcacactgagaaatcgca

SEQ ID NO: 936212 - DNA, 25 bp, Mus musculus
ttcctaagcacagtgagaaatcgca

SEQ ID NO: 936213 - DNA, 25 bp, Mus musculus
ttcctaagcagacccttctatagca

SEQ ID NO: 936214 - DNA, 25 bp, Mus musculus
ttcctaagcagagccttctatagca

SEQ ID NO: 936215 - DNA, 25 bp, Mus musculus
ttcctaagcgcacaacagccctata

SEQ ID NO: 936216 - DNA, 25 bp, Mus musculus
ttcctaagcgcagaacagccctata

SEQ ID NO: 936217 - DNA, 25 bp, Mus musculus
ttcctaagcttacacaagggcctcc

SEQ ID NO: 936218 - DNA, 25 bp, Mus musculus
ttcctaagcttagacaagggcctcc

SEQ ID NO: 936219 - DNA, 25 bp, Mus musculus
ttcctaaggacgataccactgagct

SEQ ID NO: 936220 - DNA, 25 bp, Mus musculus
ttcctaaggacgttaccactgagct

SEQ ID NO: 936221 - DNA, 25 bp, Mus musculus
ttcctaaggcttatggtatgtcaac

SEQ ID NO: 936222 - DNA, 25 bp, Mus musculus
ttcctaaggcttttggtatgtcaac

SEQ ID NO: 936223 - DNA, 25 bp, Mus musculus
ttcctaaggtctacagtttagaaag

SEQ ID NO: 936224 - DNA, 25 bp, Mus musculus
ttcctaaggtcttcagtttagaaag

SEQ ID NO: 936225 - DNA, 25 bp, Mus musculus
ttcctaagtctgaagtccctagtca

SEQ ID NO: 936226 - DNA, 25 bp, Mus musculus
ttcctaagtctgtagtccctagtca

SEQ ID NO: 936227 - DNA, 25 bp, Mus musculus
ttcctaagtgggatggttcgtcata

SEQ ID NO: 936228 - DNA, 25 bp, Mus musculus
ttcctaagtgggttggttcgtcata

SEQ ID NO: 936229 - DNA, 25 bp, Mus musculus
ttcctaatcattccttgtgatgtac

SEQ ID NO: 936230 - DNA, 25 bp, Mus musculus
ttcctaatcattgcttgtgatgtac

SEQ ID NO: 936231 - DNA, 25 bp, Mus musculus
ttcctaatgacacactcctcaaaac

SEQ ID NO: 936232 - DNA, 25 bp, Mus musculus
ttcctaatgacagactcctcaaaac

SEQ ID NO: 936233 - DNA, 25 bp, Mus musculus
ttcctaatgcttagaccctttacag

SEQ ID NO: 936234 - DNA, 25 bp, Mus musculus
ttcctaatgctttgaccctttacag

SEQ ID NO: 936235 - DNA, 25 bp, Mus musculus
ttcctaatggaacacgacgatgata

SEQ ID NO: 936236 - DNA, 25 bp, Mus musculus
ttcctaatggaagacgacgatgata

SEQ ID NO: 936237 - DNA, 25 bp, Mus musculus
ttcctaatgtgtagactctgtgcta

SEQ ID NO: 936238 - DNA, 25 bp, Mus musculus
ttcctaatgtgtctgcgtttgctat

SEQ ID NO: 936239 - DNA, 25 bp, Mus musculus
ttcctaatgtgtgtgcgtttgctat

SEQ ID NO: 936240 - DNA, 25 bp, Mus musculus
ttcctaatgtgttgactctgtgcta

SEQ ID NO: 936241 - DNA, 25 bp, Mus musculus
ttcctaattctgctctaaagtattg

SEQ ID NO: 936242 - DNA, 25 bp, Mus musculus
ttcctaattctggtctaaagtattg

SEQ ID NO: 936243 - DNA, 25 bp, Mus musculus
ttcctaattgttacacaactccatt

SEQ ID NO: 936244 - DNA, 25 bp, Mus musculus
ttcctaattgtttcacaactccatt

SEQ ID NO: 936245 - DNA, 25 bp, Mus musculus
ttcctaatttgcagggcttgggatt

SEQ ID NO: 936246 - DNA, 25 bp, Mus musculus
ttcctaatttgctgggcttgggatt

SEQ ID NO: 936247 - DNA, 25 bp, Mus musculus
ttcctacaagacacagctaacctgg

SEQ ID NO: 936248 - DNA, 25 bp, Mus musculus
ttcctacaagactcagctaacctgg

SEQ ID NO: 936249 - DNA, 25 bp, Mus musculus
ttcctacaatgccaacctctcaggt

SEQ ID NO: 936250 - DNA, 25 bp, Mus musculus
ttcctacaatgcgaacctctcaggt

SEQ ID NO: 936251 - DNA, 25 bp, Mus musculus
ttcctacacagcagcttccattcag

SEQ ID NO: 936252 - DNA, 25 bp, Mus musculus
ttcctacacagctgcttccattcag

SEQ ID NO: 936253 - DNA, 25 bp, Mus musculus
ttcctacacatcagggctactgtga

SEQ ID NO: 936254 - DNA, 25 bp, Mus musculus
ttcctacacatctgggctactgtga

SEQ ID NO: 936255 - DNA, 25 bp, Mus musculus
ttcctacactccaacactatgactg

SEQ ID NO: 936256 - DNA, 25 bp, Mus musculus
ttcctacactcctacactatgactg

SEQ ID NO: 936257 - DNA, 25 bp, Mus musculus
ttcctacagagcatcgggaagtaag

SEQ ID NO: 936258 - DNA, 25 bp, Mus musculus
ttcctacagagcttcgggaagtaag

SEQ ID NO: 936259 - DNA, 25 bp, Mus musculus
ttcctacagaggataatcttgttct

SEQ ID NO: 936260 - DNA, 25 bp, Mus musculus
ttcctacagaggttaatcttgttct

SEQ ID NO: 936261 - DNA, 25 bp, Mus musculus
ttcctacatatactagcaaatccac

SEQ ID NO: 936262 - DNA, 25 bp, Mus musculus
ttcctacatatagtagcaaatccac

SEQ ID NO: 936263 - DNA, 25 bp, Mus musculus
ttcctacatttaagctctgattcta

SEQ ID NO: 936264 - DNA, 25 bp, Mus musculus
ttcctacatttatgctctgattcta

SEQ ID NO: 936265 - DNA, 25 bp, Mus musculus
ttcctaccaggaagtgcttgctgct

SEQ ID NO: 936266 - DNA, 25 bp, Mus musculus
ttcctaccaggatgtgcttgctgct

SEQ ID NO: 936267 - DNA, 25 bp, Mus musculus
ttcctaccaggtatgaacttcagca

SEQ ID NO: 936268 - DNA, 25 bp, Mus musculus
ttcctaccaggtttgaacttcagca

SEQ ID NO: 936269 - DNA, 25 bp, Mus musculus
ttcctaccagtaccgcctggttgga

SEQ ID NO: 936270 - DNA, 25 bp, Mus musculus
ttcctaccagtagcgcctggttgga

SEQ ID NO: 936271 - DNA, 25 bp, Mus musculus
ttcctaccagtcactcactatgaag

SEQ ID NO: 936272 - DNA, 25 bp, Mus musculus
ttcctaccagtctctcactatgaag

SEQ ID NO: 936273 - DNA, 25 bp, Mus musculus
ttcctaccccagagaggtcatggca

SEQ ID NO: 936274 - DNA, 25 bp, Mus musculus
ttcctaccccagtgaggtcatggca

SEQ ID NO: 936275 - DNA, 25 bp, Mus musculus
ttcctaccctccagcaggagagcat

SEQ ID NO: 936276 - DNA, 25 bp, Mus musculus
ttcctaccctcctgcaggagagcat

SEQ ID NO: 936277 - DNA, 25 bp, Mus musculus
ttcctaccctcgaagcaaacaggag

SEQ ID NO: 936278 - DNA, 25 bp, Mus musculus
ttcctaccctcgtagcaaacaggag

SEQ ID NO: 936279 - DNA, 25 bp, Mus musculus
ttcctaccctgcaggtgataggcag

SEQ ID NO: 936280 - DNA, 25 bp, Mus musculus
ttcctaccctgcctagtgcatgaaa

SEQ ID NO: 936281 - DNA, 25 bp, Mus musculus
ttcctaccctgcgtagtgcatgaaa

SEQ ID NO: 936282 - DNA, 25 bp, Mus musculus
ttcctaccctgctggtgataggcag

SEQ ID NO: 936283 - DNA, 25 bp, Mus musculus
ttcctacctccaagcaaaactgtgt

SEQ ID NO: 936284 - DNA, 25 bp, Mus musculus
ttcctacctccatgcaaaactgtgt

SEQ ID NO: 936285 - DNA, 25 bp, Mus musculus
ttcctacctctgagccttttgaaga

SEQ ID NO: 936286 - DNA, 25 bp, Mus musculus
ttcctacctctgtgccttttgaaga

SEQ ID NO: 936287 - DNA, 25 bp, Mus musculus
ttcctaccttctacctccaagagta

SEQ ID NO: 936288 - DNA, 25 bp, Mus musculus
ttcctaccttcttcctccaagagta

SEQ ID NO: 936289 - DNA, 25 bp, Mus musculus
ttcctacgaatgagcatgttgccat

SEQ ID NO: 936290 - DNA, 25 bp, Mus musculus
ttcctacgaatgtgcatgttgccat

SEQ ID NO: 936291 - DNA, 25 bp, Mus musculus
ttcctacgggtaacgtaattccatt

SEQ ID NO: 936292 - DNA, 25 bp, Mus musculus
ttcctacgggtatcgtaattccatt

SEQ ID NO: 936293 - DNA, 25 bp, Mus musculus
ttcctactagtcctgctcaccttgg

SEQ ID NO: 936294 - DNA, 25 bp, Mus musculus
ttcctactagtcgtgctcaccttgg

SEQ ID NO: 936295 - DNA, 25 bp, Mus musculus
ttcctactcaggctcaagcagggta

SEQ ID NO: 936296 - DNA, 25 bp, Mus musculus
ttcctactcagggtcaagcagggta

SEQ ID NO: 936297 - DNA, 25 bp, Mus musculus
ttcctactccacctggcatgtaaag

SEQ ID NO: 936298 - DNA, 25 bp, Mus musculus
ttcctactccacgtggcatgtaaag

SEQ ID NO: 936299 - DNA, 25 bp, Mus musculus
ttcctactccatatatttttaccac

SEQ ID NO: 936300 - DNA, 25 bp, Mus musculus
ttcctactccatttatttttaccac

SEQ ID NO: 936301 - DNA, 25 bp, Mus musculus
ttcctactcctccttatggaagtgt

SEQ ID NO: 936302 - DNA, 25 bp, Mus musculus
ttcctactcctcgttatggaagtgt

SEQ ID NO: 936303 - DNA, 25 bp, Mus musculus
ttcctactgaatctaccaagttcca

SEQ ID NO: 936304 - DNA, 25 bp, Mus musculus
ttcctactgaatgtaccaagttcca

SEQ ID NO: 936305 - DNA, 25 bp, Mus musculus
ttcctactgctgagacctttaaaac

SEQ ID NO: 936306 - DNA, 25 bp, Mus musculus
ttcctactgctgtgacctttaaaac

SEQ ID NO: 936307 - DNA, 25 bp, Mus musculus
ttcctactgtgccttcgacgctggg

SEQ ID NO: 936308 - DNA, 25 bp, Mus musculus
ttcctactgtgcgttcgacgctggg

SEQ ID NO: 936309 - DNA, 25 bp, Mus musculus
ttcctactgtttcccgactagaacg

SEQ ID NO: 936310 - DNA, 25 bp, Mus musculus
ttcctactgtttgccgactagaacg

SEQ ID NO: 936311 - DNA, 25 bp, Mus musculus
ttcctacttaccatttagggcacag

SEQ ID NO: 936312 - DNA, 25 bp, Mus musculus
ttcctacttaccttttagggcacag

SEQ ID NO: 936313 - DNA, 25 bp, Mus musculus
ttcctacttagaatacgctttccgg

SEQ ID NO: 936314 - DNA, 25 bp, Mus musculus
ttcctacttagattacgctttccgg

SEQ ID NO: 936315 - DNA, 25 bp, Mus musculus
ttcctacttctcacagcagcgcaag

SEQ ID NO: 936316 - DNA, 25 bp, Mus musculus
ttcctacttctctcagcagcgcaag

SEQ ID NO: 936317 - DNA, 25 bp, Mus musculus
ttcctacttggaccttgccaccagt

SEQ ID NO: 936318 - DNA, 25 bp, Mus musculus
ttcctacttggagcttgccaccagt

SEQ ID NO: 936319 - DNA, 25 bp, Mus musculus
ttcctagaaggtagtgtagcatgat

SEQ ID NO: 936320 - DNA, 25 bp, Mus musculus
ttcctagaaggttgtgtagcatgat

SEQ ID NO: 936321 - DNA, 25 bp, Mus musculus
ttcctagaatgcactgccatccgag

SEQ ID NO: 936322 - DNA, 25 bp, Mus musculus
ttcctagaatgctctgccatccgag

SEQ ID NO: 936323 - DNA, 25 bp, Mus musculus
ttcctagaatttcgaggcctcttca

SEQ ID NO: 936324 - DNA, 25 bp, Mus musculus
ttcctagaatttggaggcctcttca

SEQ ID NO: 936325 - DNA, 25 bp, Mus musculus
ttcctagacatgataacctccttgg

SEQ ID NO: 936326 - DNA, 25 bp, Mus musculus
ttcctagacatgttaacctccttgg

SEQ ID NO: 936327 - DNA, 25 bp, Mus musculus
ttcctagactctataagacagccta

SEQ ID NO: 936328 - DNA, 25 bp, Mus musculus
ttcctagactctttaagacagccta

SEQ ID NO: 936329 - DNA, 25 bp, Mus musculus
ttcctagagcaaacattggcaagtt

SEQ ID NO: 936330 - DNA, 25 bp, Mus musculus
ttcctagagcaatcattggcaagtt

SEQ ID NO: 936331 - DNA, 25 bp, Mus musculus
ttcctagaggaactcctggcttctg

SEQ ID NO: 936332 - DNA, 25 bp, Mus musculus
ttcctagaggaagtcctggcttctg

SEQ ID NO: 936333 - DNA, 25 bp, Mus musculus
ttcctagagttcatgctttctttcc

SEQ ID NO: 936334 - DNA, 25 bp, Mus musculus
ttcctagagttcttgctttctttcc

SEQ ID NO: 936335 - DNA, 25 bp, Mus musculus
ttcctagatcctatccatctaccaa

SEQ ID NO: 936336 - DNA, 25 bp, Mus musculus
ttcctagatcctttccatctaccaa

SEQ ID NO: 936337 - DNA, 25 bp, Mus musculus
ttcctagattgacttacacacatag

SEQ ID NO: 936338 - DNA, 25 bp, Mus musculus
ttcctagattgagttacacacatag

SEQ ID NO: 936339 - DNA, 25 bp, Mus musculus
ttcctagattgcagatgctcacttg

SEQ ID NO: 936340 - DNA, 25 bp, Mus musculus
ttcctagattgctgatgctcacttg

SEQ ID NO: 936341 - DNA, 25 bp, Mus musculus
ttcctagcactgacatggcaggtgt

SEQ ID NO: 936342 - DNA, 25 bp, Mus musculus
ttcctagcactgtcatggcaggtgt

SEQ ID NO: 936343 - DNA, 25 bp, Mus musculus
ttcctagcagctcaatcctattgac

SEQ ID NO: 936344 - DNA, 25 bp, Mus musculus
ttcctagcagctgaatcctattgac

SEQ ID NO: 936345 - DNA, 25 bp, Mus musculus
ttcctagcatatctgagcgctccat

SEQ ID NO: 936346 - DNA, 25 bp, Mus musculus
ttcctagcatatgtgagcgctccat

SEQ ID NO: 936347 - DNA, 25 bp, Mus musculus
ttcctagcatgaatggccagcgtga

SEQ ID NO: 936348 - DNA, 25 bp, Mus musculus
ttcctagcatgattggccagcgtga

SEQ ID NO: 936349 - DNA, 25 bp, Mus musculus
ttcctagccaacatctgccagggca

SEQ ID NO: 936350 - DNA, 25 bp, Mus musculus
ttcctagccaacttctgccagggca

SEQ ID NO: 936351 - DNA, 25 bp, Mus musculus
ttcctagccctacaattgcattctt

SEQ ID NO: 936352 - DNA, 25 bp, Mus musculus
ttcctagccctagaattgcattctt

SEQ ID NO: 936353 - DNA, 25 bp, Mus musculus
ttcctagcctccaacctaaaaatgg

SEQ ID NO: 936354 - DNA, 25 bp, Mus musculus
ttcctagcctccctttgacaatggc

SEQ ID NO: 936355 - DNA, 25 bp, Mus musculus
ttcctagcctccgtttgacaatggc

SEQ ID NO: 936356 - DNA, 25 bp, Mus musculus
ttcctagcctcctacctaaaaatgg

SEQ ID NO: 936357 - DNA, 25 bp, Mus musculus
ttcctagcctttcactttcttggac

SEQ ID NO: 936358 - DNA, 25 bp, Mus musculus
ttcctagcctttgactttcttggac

SEQ ID NO: 936359 - DNA, 25 bp, Mus musculus
ttcctagctattctagcctaagcct

SEQ ID NO: 936360 - DNA, 25 bp, Mus musculus
ttcctagctattgtagcctaagcct

SEQ ID NO: 936361 - DNA, 25 bp, Mus musculus
ttcctaggacagacccagcatggat

SEQ ID NO: 936362 - DNA, 25 bp, Mus musculus
ttcctaggacagtcccagcatggat

SEQ ID NO: 936363 - DNA, 25 bp, Mus musculus
ttcctaggaccaccctgcttcaaaa

SEQ ID NO: 936364 - DNA, 25 bp, Mus musculus
ttcctaggaccagcctgcttcaaaa

SEQ ID NO: 936365 - DNA, 25 bp, Mus musculus
ttcctaggctagcagctgctgagcc

SEQ ID NO: 936366 - DNA, 25 bp, Mus musculus
ttcctaggctaggagctgctgagcc

SEQ ID NO: 936367 - DNA, 25 bp, Mus musculus
ttcctagggattattagcttctgaa

SEQ ID NO: 936368 - DNA, 25 bp, Mus musculus
ttcctagggatttttagcttctgaa

SEQ ID NO: 936369 - DNA, 25 bp, Mus musculus
ttcctagtataaactgaactcatct

SEQ ID NO: 936370 - DNA, 25 bp, Mus musculus
ttcctagtataatctgaactcatct

SEQ ID NO: 936371 - DNA, 25 bp, Mus musculus
ttcctagtcccactgcacacgtgag

SEQ ID NO: 936372 - DNA, 25 bp, Mus musculus
ttcctagtcccagtgcacacgtgag

SEQ ID NO: 936373 - DNA, 25 bp, Mus musculus
ttcctagtcttaaacacgtgtggac

SEQ ID NO: 936374 - DNA, 25 bp, Mus musculus
ttcctagtcttatacacgtgtggac

SEQ ID NO: 936375 - DNA, 25 bp, Mus musculus
ttcctagtgtgtcgcagttggtctg

SEQ ID NO: 936376 - DNA, 25 bp, Mus musculus
ttcctagtgtgtggcagttggtctg

SEQ ID NO: 936377 - DNA, 25 bp, Mus musculus
ttcctagttctacagggcctatcct

SEQ ID NO: 936378 - DNA, 25 bp, Mus musculus
ttcctagttctagagggcctatcct

SEQ ID NO: 936379 - DNA, 25 bp, Mus musculus
ttcctagttcttagtgaacctacct

SEQ ID NO: 936380 - DNA, 25 bp, Mus musculus
ttcctagttctttgtgaacctacct

SEQ ID NO: 936381 - DNA, 25 bp, Mus musculus
ttcctagtttacagcatgatgcaaa

SEQ ID NO: 936382 - DNA, 25 bp, Mus musculus
ttcctagtttactgcatgatgcaaa

SEQ ID NO: 936383 - DNA, 25 bp, Mus musculus
ttcctagttttcaggattggtacct

SEQ ID NO: 936384 - DNA, 25 bp, Mus musculus
ttcctagttttctggattggtacct

SEQ ID NO: 936385 - DNA, 25 bp, Mus musculus
ttcctataagcccaaacacattttc

SEQ ID NO: 936386 - DNA, 25 bp, Mus musculus
ttcctataagccgaaacacattttc

SEQ ID NO: 936387 - DNA, 25 bp, Mus musculus
ttcctataccagctgatgcagcagc

SEQ ID NO: 936388 - DNA, 25 bp, Mus musculus
ttcctataccaggtgatgcagcagc

SEQ ID NO: 936389 - DNA, 25 bp, Mus musculus
ttcctataccttctagagtctgtcc

SEQ ID NO: 936390 - DNA, 25 bp, Mus musculus
ttcctataccttgtagagtctgtcc

SEQ ID NO: 936391 - DNA, 25 bp, Mus musculus
ttcctatactcaaaggatgaacaga

SEQ ID NO: 936392 - DNA, 25 bp, Mus musculus
ttcctatactcataggatgaacaga

SEQ ID NO: 936393 - DNA, 25 bp, Mus musculus
ttcctatactccaaggttcatgtat

SEQ ID NO: 936394 - DNA, 25 bp, Mus musculus
ttcctatactcctaggttcatgtat

SEQ ID NO: 936395 - DNA, 25 bp, Mus musculus
ttcctatacttccactcaactttaa

SEQ ID NO: 936396 - DNA, 25 bp, Mus musculus
ttcctatacttcgactcaactttaa

SEQ ID NO: 936397 - DNA, 25 bp, Mus musculus
ttcctatagctaagtcttcacctca

SEQ ID NO: 936398 - DNA, 25 bp, Mus musculus
ttcctatagctatgtcttcacctca

SEQ ID NO: 936399 - DNA, 25 bp, Mus musculus
ttcctatagttgctagcattcatta

SEQ ID NO: 936400 - DNA, 25 bp, Mus musculus
ttcctatagttggtagcattcatta

SEQ ID NO: 936401 - DNA, 25 bp, Mus musculus
ttcctatattttccttctccaaggt

SEQ ID NO: 936402 - DNA, 25 bp, Mus musculus
ttcctatattttgcttctccaaggt

SEQ ID NO: 936403 - DNA, 25 bp, Mus musculus
ttcctatcaggccttcaagactctg

SEQ ID NO: 936404 - DNA, 25 bp, Mus musculus
ttcctatcaggcgttcaagactctg

SEQ ID NO: 936405 - DNA, 25 bp, Mus musculus
ttcctatccaccaactcattctggg

SEQ ID NO: 936406 - DNA, 25 bp, Mus musculus
ttcctatccacctactcattctggg

SEQ ID NO: 936407 - DNA, 25 bp, Mus musculus
ttcctatccaggaccctagatgaga

SEQ ID NO: 936408 - DNA, 25 bp, Mus musculus
ttcctatccaggtccctagatgaga

SEQ ID NO: 936409 - DNA, 25 bp, Mus musculus
ttcctatccataacgggacatcacc

SEQ ID NO: 936410 - DNA, 25 bp, Mus musculus
ttcctatccatatcgggacatcacc

SEQ ID NO: 936411 - DNA, 25 bp, Mus musculus
ttcctatccctcatcttcatgagga

SEQ ID NO: 936412 - DNA, 25 bp, Mus musculus
ttcctatccctcttcttcatgagga

SEQ ID NO: 936413 - DNA, 25 bp, Mus musculus
ttcctatcctcacggacctgtgctg

SEQ ID NO: 936414 - DNA, 25 bp, Mus musculus
ttcctatcctcagggacctgtgctg

SEQ ID NO: 936415 - DNA, 25 bp, Mus musculus
ttcctatcgaggatgccagcaacaa

SEQ ID NO: 936416 - DNA, 25 bp, Mus musculus
ttcctatcgaggttgccagcaacaa

SEQ ID NO: 936417 - DNA, 25 bp, Mus musculus
ttcctatctgctcctgctaatgctg

SEQ ID NO: 936418 - DNA, 25 bp, Mus musculus
ttcctatctgctgctgctaatgctg

SEQ ID NO: 936419 - DNA, 25 bp, Mus musculus
ttcctatctggcatcatccatttca

SEQ ID NO: 936420 - DNA, 25 bp, Mus musculus
ttcctatctggcttcatccatttca

SEQ ID NO: 936421 - DNA, 25 bp, Mus musculus
ttcctatgatcactcccctaatgta

SEQ ID NO: 936422 - DNA, 25 bp, Mus musculus
ttcctatgatcagtcccctaatgta

SEQ ID NO: 936423 - DNA, 25 bp, Mus musculus
ttcctatgcagtacttgcggagtga

SEQ ID NO: 936424 - DNA, 25 bp, Mus musculus
ttcctatgcagttcttgcggagtga

SEQ ID NO: 936425 - DNA, 25 bp, Mus musculus
ttcctatgccctctgatatgtaaga

SEQ ID NO: 936426 - DNA, 25 bp, Mus musculus
ttcctatgccctgtgatatgtaaga

SEQ ID NO: 936427 - DNA, 25 bp, Mus musculus
ttcctatgcctaaaaccatggctca

SEQ ID NO: 936428 - DNA, 25 bp, Mus musculus
ttcctatgcctataaccatggctca

SEQ ID NO: 936429 - DNA, 25 bp, Mus musculus
ttcctatgcctgattccaaaaccac

SEQ ID NO: 936430 - DNA, 25 bp, Mus musculus
ttcctatgcctgtttccaaaaccac

SEQ ID NO: 936431 - DNA, 25 bp, Mus musculus
ttcctatggaggagtcgcggtcgtc

SEQ ID NO: 936432 - DNA, 25 bp, Mus musculus
ttcctatggaggtgtcgcggtcgtc

SEQ ID NO: 936433 - DNA, 25 bp, Mus musculus
ttcctatggccacctgaaagtcatt

SEQ ID NO: 936434 - DNA, 25 bp, Mus musculus
ttcctatggccagctgaaagtcatt

SEQ ID NO: 936435 - DNA, 25 bp, Mus musculus
ttcctatgggccaagcactcagact

SEQ ID NO: 936436 - DNA, 25 bp, Mus musculus
ttcctatgggcctagcactcagact

SEQ ID NO: 936437 - DNA, 25 bp, Mus musculus
ttcctatgtaccagggagtgcacaa

SEQ ID NO: 936438 - DNA, 25 bp, Mus musculus
ttcctatgtacctgggagtgcacaa

SEQ ID NO: 936439 - DNA, 25 bp, Mus musculus
ttcctatgtcgtaatctctgcccag

SEQ ID NO: 936440 - DNA, 25 bp, Mus musculus
ttcctatgtcgttatctctgcccag

SEQ ID NO: 936441 - DNA, 25 bp, Mus musculus
ttcctatgtgcaccagaaattacat

SEQ ID NO: 936442 - DNA, 25 bp, Mus musculus
ttcctatgtgcagcagaaattacat

SEQ ID NO: 936443 - DNA, 25 bp, Mus musculus
ttcctattagaactttccccgtgct

SEQ ID NO: 936444 - DNA, 25 bp, Mus musculus
ttcctattagaagtttccccgtgct

SEQ ID NO: 936445 - DNA, 25 bp, Mus musculus
ttcctattcccacgtttcctacaga

SEQ ID NO: 936446 - DNA, 25 bp, Mus musculus
ttcctattcccaggtttcctacaga

SEQ ID NO: 936447 - DNA, 25 bp, Mus musculus
ttcctattcctactttctccagaac

SEQ ID NO: 936448 - DNA, 25 bp, Mus musculus
ttcctattcctagtttctccagaac

SEQ ID NO: 936449 - DNA, 25 bp, Mus musculus
ttcctattctagattttgcaagtga

SEQ ID NO: 936450 - DNA, 25 bp, Mus musculus
ttcctattctagtttttgcaagtga

SEQ ID NO: 936451 - DNA, 25 bp, Mus musculus
ttcctattgactaagcttgccagag

SEQ ID NO: 936452 - DNA, 25 bp, Mus musculus
ttcctattgacttagcttgccagag

SEQ ID NO: 936453 - DNA, 25 bp, Mus musculus
ttcctattgctcatccttgtggaaa

SEQ ID NO: 936454 - DNA, 25 bp, Mus musculus
ttcctattgctcttccttgtggaaa

SEQ ID NO: 936455 - DNA, 25 bp, Mus musculus
ttcctattggctcgttccatttggt

SEQ ID NO: 936456 - DNA, 25 bp, Mus musculus
ttcctattggctggttccatttggt

SEQ ID NO: 936457 - DNA, 25 bp, Mus musculus
ttcctattggtgcttagaacatgag

SEQ ID NO: 936458 - DNA, 25 bp, Mus musculus
ttcctattggtggttagaacatgag

SEQ ID NO: 936459 - DNA, 25 bp, Mus musculus
ttcctatttcctactctctgaagat

SEQ ID NO: 936460 - DNA, 25 bp, Mus musculus
ttcctatttccttctctctgaagat

SEQ ID NO: 936461 - DNA, 25 bp, Mus musculus
ttcctattttccagttgtcctttat

SEQ ID NO: 936462 - DNA, 25 bp, Mus musculus
ttcctattttcctgttgtcctttat

SEQ ID NO: 936463 - DNA, 25 bp, Mus musculus
ttcctcaaaaccagttagtagaaag

SEQ ID NO: 936464 - DNA, 25 bp, Mus musculus
ttcctcaaaacctgttagtagaaag

SEQ ID NO: 936465 - DNA, 25 bp, Mus musculus
ttcctcaaacccacggtggagaagg

SEQ ID NO: 936466 - DNA, 25 bp, Mus musculus
ttcctcaaaccctcggtggagaagg

SEQ ID NO: 936467 - DNA, 25 bp, Mus musculus
ttcctcaaccagaggcagaaccagg

SEQ ID NO: 936468 - DNA, 25 bp, Mus musculus
ttcctcaaccagtggcagaaccagg

SEQ ID NO: 936469 - DNA, 25 bp, Mus musculus
ttcctcaactccaagcgtgagatcg

SEQ ID NO: 936470 - DNA, 25 bp, Mus musculus
ttcctcaactcctagcgtgagatcg

SEQ ID NO: 936471 - DNA, 25 bp, Mus musculus
ttcctcaactctccctagaggagaa

SEQ ID NO: 936472 - DNA, 25 bp, Mus musculus
ttcctcaactctgcctagaggagaa

SEQ ID NO: 936473 - DNA, 25 bp, Mus musculus
ttcctcaactttatcaggttcctgg

SEQ ID NO: 936474 - DNA, 25 bp, Mus musculus
ttcctcaactttttcaggttcctgg

SEQ ID NO: 936475 - DNA, 25 bp, Mus musculus
ttcctcaagaggcttttgtccccaa

SEQ ID NO: 936476 - DNA, 25 bp, Mus musculus
ttcctcaagagggttttgtccccaa

SEQ ID NO: 936477 - DNA, 25 bp, Mus musculus
ttcctcaagccaagctctagtacag

SEQ ID NO: 936478 - DNA, 25 bp, Mus musculus
ttcctcaagccatgctctagtacag

SEQ ID NO: 936479 - DNA, 25 bp, Mus musculus
ttcctcaagcgcaccttaaagcaga

SEQ ID NO: 936480 - DNA, 25 bp, Mus musculus
ttcctcaagcgctccttaaagcaga

SEQ ID NO: 936481 - DNA, 25 bp, Mus musculus
ttcctcaaggagacacttatgttca

SEQ ID NO: 936482 - DNA, 25 bp, Mus musculus
ttcctcaaggagtcacttatgttca

SEQ ID NO: 936483 - DNA, 25 bp, Mus musculus
ttcctcaagtgactttaatgctcat

SEQ ID NO: 936484 - DNA, 25 bp, Mus musculus
ttcctcaagtgagtttaatgctcat

SEQ ID NO: 936485 - DNA, 25 bp, Mus musculus
ttcctcaatcggatcttggatctga

SEQ ID NO: 936486 - DNA, 25 bp, Mus musculus
ttcctcaatcggttcttggatctga

SEQ ID NO: 936487 - DNA, 25 bp, Mus musculus
ttcctcacaattatgatggctatta

SEQ ID NO: 936488 - DNA, 25 bp, Mus musculus
ttcctcacaattcctggaagtaaaa

SEQ ID NO: 936489 - DNA, 25 bp, Mus musculus
ttcctcacaattgctggaagtaaaa

SEQ ID NO: 936490 - DNA, 25 bp, Mus musculus
ttcctcacaattttgatggctatta

SEQ ID NO: 936491 - DNA, 25 bp, Mus musculus
ttcctcacatacacaatctcaaaga

SEQ ID NO: 936492 - DNA, 25 bp, Mus musculus
ttcctcacatactcaatctcaaaga

SEQ ID NO: 936493 - DNA, 25 bp, Mus musculus
ttcctcaccacacccagtatagtgt

SEQ ID NO: 936494 - DNA, 25 bp, Mus musculus
ttcctcaccacactatctaaaaaga

SEQ ID NO: 936495 - DNA, 25 bp, Mus musculus
ttcctcaccacagccagtatagtgt

SEQ ID NO: 936496 - DNA, 25 bp, Mus musculus
ttcctcaccacagtatctaaaaaga

SEQ ID NO: 936497 - DNA, 25 bp, Mus musculus
ttcctcaccgacctgacaatgatga

SEQ ID NO: 936498 - DNA, 25 bp, Mus musculus
ttcctcaccgacgtgacaatgatga

SEQ ID NO: 936499 - DNA, 25 bp, Mus musculus
ttcctcaccggaaggagggagtttg

SEQ ID NO: 936500 - DNA, 25 bp, Mus musculus
ttcctcaccggatggagggagtttg

SEQ ID NO: 936501 - DNA, 25 bp, Mus musculus
ttcctcaccttgaacactcacttaa

SEQ ID NO: 936502 - DNA, 25 bp, Mus musculus
ttcctcaccttgaagttgcataagg

SEQ ID NO: 936503 - DNA, 25 bp, Mus musculus
ttcctcaccttgtacactcacttaa

SEQ ID NO: 936504 - DNA, 25 bp, Mus musculus
ttcctcaccttgtagttgcataagg

SEQ ID NO: 936505 - DNA, 25 bp, Mus musculus
ttcctcactaccaccttagttagaa

SEQ ID NO: 936506 - DNA, 25 bp, Mus musculus
ttcctcactacctccttagttagaa

SEQ ID NO: 936507 - DNA, 25 bp, Mus musculus
ttcctcactatcattcttctggttg

SEQ ID NO: 936508 - DNA, 25 bp, Mus musculus
ttcctcactatctttcttctggttg

SEQ ID NO: 936509 - DNA, 25 bp, Mus musculus
ttcctcactctcactcaaaatgata

SEQ ID NO: 936510 - DNA, 25 bp, Mus musculus
ttcctcactctctctcaaaatgata

SEQ ID NO: 936511 - DNA, 25 bp, Mus musculus
ttcctcactgagctgagtactgagc

SEQ ID NO: 936512 - DNA, 25 bp, Mus musculus
ttcctcactgaggtgagtactgagc

SEQ ID NO: 936513 - DNA, 25 bp, Mus musculus
ttcctcactggaatgtagcttttca

SEQ ID NO: 936514 - DNA, 25 bp, Mus musculus
ttcctcactggattgtagcttttca

SEQ ID NO: 936515 - DNA, 25 bp, Mus musculus
ttcctcagaaacactcctatctgta

SEQ ID NO: 936516 - DNA, 25 bp, Mus musculus
ttcctcagaaactctcctatctgta

SEQ ID NO: 936517 - DNA, 25 bp, Mus musculus
ttcctcagaaggagtccaagcccag

SEQ ID NO: 936518 - DNA, 25 bp, Mus musculus
ttcctcagaaggtgtccaagcccag

SEQ ID NO: 936519 - DNA, 25 bp, Mus musculus
ttcctcagaattctttggctggttc

SEQ ID NO: 936520 - DNA, 25 bp, Mus musculus
ttcctcagaattgtttggctggttc

SEQ ID NO: 936521 - DNA, 25 bp, Mus musculus
ttcctcagacacagagcgaatttgg

SEQ ID NO: 936522 - DNA, 25 bp, Mus musculus
ttcctcagacactgagcgaatttgg

SEQ ID NO: 936523 - DNA, 25 bp, Mus musculus
ttcctcagagagaagatttatttat

SEQ ID NO: 936524 - DNA, 25 bp, Mus musculus
ttcctcagagagtagatttatttat

SEQ ID NO: 936525 - DNA, 25 bp, Mus musculus
ttcctcagaggcaggacatcttggg

SEQ ID NO: 936526 - DNA, 25 bp, Mus musculus
ttcctcagaggctggacatcttggg

SEQ ID NO: 936527 - DNA, 25 bp, Mus musculus
ttcctcagagggagagcttctttct

SEQ ID NO: 936528 - DNA, 25 bp, Mus musculus
ttcctcagagggtgagcttctttct

SEQ ID NO: 936529 - DNA, 25 bp, Mus musculus
ttcctcagcaatagtcagccagtga

SEQ ID NO: 936530 - DNA, 25 bp, Mus musculus
ttcctcagcaattgtcagccagtga

SEQ ID NO: 936531 - DNA, 25 bp, Mus musculus
ttcctcagcagccaggagttcaggg

SEQ ID NO: 936532 - DNA, 25 bp, Mus musculus
ttcctcagcagcgaggagttcaggg

SEQ ID NO: 936533 - DNA, 25 bp, Mus musculus
ttcctcagcaggcagtcaggccagg

SEQ ID NO: 936534 - DNA, 25 bp, Mus musculus
ttcctcagcagggagtcaggccagg

SEQ ID NO: 936535 - DNA, 25 bp, Mus musculus
ttcctcagccatcaacagagaggct

SEQ ID NO: 936536 - DNA, 25 bp, Mus musculus
ttcctcagccatgaacagagaggct

SEQ ID NO: 936537 - DNA, 25 bp, Mus musculus
ttcctcagctcaatatcccaataaa

SEQ ID NO: 936538 - DNA, 25 bp, Mus musculus
ttcctcagctcattatcccaataaa

SEQ ID NO: 936539 - DNA, 25 bp, Mus musculus
ttcctcagcttcatgactggcgtca

SEQ ID NO: 936540 - DNA, 25 bp, Mus musculus
ttcctcagcttcttgactggcgtca

SEQ ID NO: 936541 - DNA, 25 bp, Mus musculus
ttcctcaggagccattcattgtggg

SEQ ID NO: 936542 - DNA, 25 bp, Mus musculus
ttcctcaggagcgattcattgtggg

SEQ ID NO: 936543 - DNA, 25 bp, Mus musculus
ttcctcaggctcagtcagccaggga

SEQ ID NO: 936544 - DNA, 25 bp, Mus musculus
ttcctcaggctctgtcagccaggga

SEQ ID NO: 936545 - DNA, 25 bp, Mus musculus
ttcctcagggctaccatagtgacaa

SEQ ID NO: 936546 - DNA, 25 bp, Mus musculus
ttcctcagggcttccatagtgacaa

SEQ ID NO: 936547 - DNA, 25 bp, Mus musculus
ttcctcagtactataatgcagatgt

SEQ ID NO: 936548 - DNA, 25 bp, Mus musculus
ttcctcagtactttaatgcagatgt

SEQ ID NO: 936549 - DNA, 25 bp, Mus musculus
ttcctcagtagcatcccatgtttat

SEQ ID NO: 936550 - DNA, 25 bp, Mus musculus
ttcctcagtagcttcccatgtttat

SEQ ID NO: 936551 - DNA, 25 bp, Mus musculus
ttcctcagtcacacattcaaaagat

SEQ ID NO: 936552 - DNA, 25 bp, Mus musculus
ttcctcagtcactcattcaaaagat

SEQ ID NO: 936553 - DNA, 25 bp, Mus musculus
ttcctcagtccaaagttctgtactt

SEQ ID NO: 936554 - DNA, 25 bp, Mus musculus
ttcctcagtccatagttctgtactt

SEQ ID NO: 936555 - DNA, 25 bp, Mus musculus
ttcctcagtccccagtctgatagaa

SEQ ID NO: 936556 - DNA, 25 bp, Mus musculus
ttcctcagtcccgagtctgatagaa

SEQ ID NO: 936557 - DNA, 25 bp, Mus musculus
ttcctcagtgctcggcttaccactg

SEQ ID NO: 936558 - DNA, 25 bp, Mus musculus
ttcctcagtgctgggcttaccactg

SEQ ID NO: 936559 - DNA, 25 bp, Mus musculus
ttcctcagtgtaaagacagcagtgt

SEQ ID NO: 936560 - DNA, 25 bp, Mus musculus
ttcctcagtgtatagacagcagtgt

SEQ ID NO: 936561 - DNA, 25 bp, Mus musculus
ttcctcagtgtcagtggcaatgtct

SEQ ID NO: 936562 - DNA, 25 bp, Mus musculus
ttcctcagtgtctgtggcaatgtct

SEQ ID NO: 936563 - DNA, 25 bp, Mus musculus
ttcctcagttgacatttccttcata

SEQ ID NO: 936564 - DNA, 25 bp, Mus musculus
ttcctcagttgagatttccttcata

SEQ ID NO: 936565 - DNA, 25 bp, Mus musculus
ttcctcataatgacagtgcttagca

SEQ ID NO: 936566 - DNA, 25 bp, Mus musculus
ttcctcataatgtcagtgcttagca

SEQ ID NO: 936567 - DNA, 25 bp, Mus musculus
ttcctcatacacctttttaacatcc

SEQ ID NO: 936568 - DNA, 25 bp, Mus musculus
ttcctcatacacgtttttaacatcc

SEQ ID NO: 936569 - DNA, 25 bp, Mus musculus
ttcctcatattaaatcccggctgtt

SEQ ID NO: 936570 - DNA, 25 bp, Mus musculus
ttcctcatattatatcccggctgtt

SEQ ID NO: 936571 - DNA, 25 bp, Mus musculus
ttcctcatatttcctgtccccagga

SEQ ID NO: 936572 - DNA, 25 bp, Mus musculus
ttcctcatatttgctgtccccagga

SEQ ID NO: 936573 - DNA, 25 bp, Mus musculus
ttcctcatcagtctttccttggcaa

SEQ ID NO: 936574 - DNA, 25 bp, Mus musculus
ttcctcatcagtgtttccttggcaa

SEQ ID NO: 936575 - DNA, 25 bp, Mus musculus
ttcctcatcatactgggcatctgcc

SEQ ID NO: 936576 - DNA, 25 bp, Mus musculus
ttcctcatcatagtgggcatctgcc

SEQ ID NO: 936577 - DNA, 25 bp, Mus musculus
ttcctcatcattctagcaacgacta

SEQ ID NO: 936578 - DNA, 25 bp, Mus musculus
ttcctcatcattgtagcaacgacta

SEQ ID NO: 936579 - DNA, 25 bp, Mus musculus
ttcctcatccaacaatgctaaagtg

SEQ ID NO: 936580 - DNA, 25 bp, Mus musculus
ttcctcatccaagaatgctaaagtg

SEQ ID NO: 936581 - DNA, 25 bp, Mus musculus
ttcctcatcctgaatcggacatctg

SEQ ID NO: 936582 - DNA, 25 bp, Mus musculus
ttcctcatcctgtatcggacatctg

SEQ ID NO: 936583 - DNA, 25 bp, Mus musculus
ttcctcatcgctccagtttattggt

SEQ ID NO: 936584 - DNA, 25 bp, Mus musculus
ttcctcatcgctgcagtttattggt

SEQ ID NO: 936585 - DNA, 25 bp, Mus musculus
ttcctcatctcaacggctgaagcct

SEQ ID NO: 936586 - DNA, 25 bp, Mus musculus
ttcctcatctcatcggctgaagcct

SEQ ID NO: 936587 - DNA, 25 bp, Mus musculus
ttcctcatcttcctgatcgtgggat

SEQ ID NO: 936588 - DNA, 25 bp, Mus musculus
ttcctcatcttcgtgatcgtgggat

SEQ ID NO: 936589 - DNA, 25 bp, Mus musculus
ttcctcatgagacggtgggacccaa

SEQ ID NO: 936590 - DNA, 25 bp, Mus musculus
ttcctcatgagagggtgggacccaa

SEQ ID NO: 936591 - DNA, 25 bp, Mus musculus
ttcctcatgggcacagctgcttctg

SEQ ID NO: 936592 - DNA, 25 bp, Mus musculus
ttcctcatgggctcagctgcttctg

SEQ ID NO: 936593 - DNA, 25 bp, Mus musculus
ttcctcatggtgagctgtagctctt

SEQ ID NO: 936594 - DNA, 25 bp, Mus musculus
ttcctcatggtgtgctgtagctctt

SEQ ID NO: 936595 - DNA, 25 bp, Mus musculus
ttcctcatgtgaagctctgagccca

SEQ ID NO: 936596 - DNA, 25 bp, Mus musculus
ttcctcatgtgatgctctgagccca

SEQ ID NO: 936597 - DNA, 25 bp, Mus musculus
ttcctcattgctaagacagttggta

SEQ ID NO: 936598 - DNA, 25 bp, Mus musculus
ttcctcattgcttagacagttggta

SEQ ID NO: 936599 - DNA, 25 bp, Mus musculus
ttcctcatttcaaagttgctaccag

SEQ ID NO: 936600 - DNA, 25 bp, Mus musculus
ttcctcatttcatagttgctaccag

SEQ ID NO: 936601 - DNA, 25 bp, Mus musculus
ttcctcatttcccaagccttggttt

SEQ ID NO: 936602 - DNA, 25 bp, Mus musculus
ttcctcatttccgaagccttggttt

SEQ ID NO: 936603 - DNA, 25 bp, Mus musculus
ttcctccaaaacagcttatacccat

SEQ ID NO: 936604 - DNA, 25 bp, Mus musculus
ttcctccaaaactgcttatacccat

SEQ ID NO: 936605 - DNA, 25 bp, Mus musculus
ttcctccaaaccagttgaaccacta

SEQ ID NO: 936606 - DNA, 25 bp, Mus musculus
ttcctccaaacctgttgaaccacta

SEQ ID NO: 936607 - DNA, 25 bp, Mus musculus
ttcctccaaaggatcaatggtgact

SEQ ID NO: 936608 - DNA, 25 bp, Mus musculus
ttcctccaaaggttcaatggtgact

SEQ ID NO: 936609 - DNA, 25 bp, Mus musculus
ttcctccaactcaaattcagagcat

SEQ ID NO: 936610 - DNA, 25 bp, Mus musculus
ttcctccaactctaattcagagcat

SEQ ID NO: 936611 - DNA, 25 bp, Mus musculus
ttcctccaagctattcttgcattga

SEQ ID NO: 936612 - DNA, 25 bp, Mus musculus
ttcctccaagcttttcttgcattga

SEQ ID NO: 936613 - DNA, 25 bp, Mus musculus
ttcctccaccatatgttccaggcat

SEQ ID NO: 936614 - DNA, 25 bp, Mus musculus
ttcctccaccatttgttccaggcat

SEQ ID NO: 936615 - DNA, 25 bp, Mus musculus
ttcctccactataagattgctcata

SEQ ID NO: 936616 - DNA, 25 bp, Mus musculus
ttcctccactattagattgctcata

SEQ ID NO: 936617 - DNA, 25 bp, Mus musculus
ttcctccactggactaggacggaag

SEQ ID NO: 936618 - DNA, 25 bp, Mus musculus
ttcctccactggtctaggacggaag

SEQ ID NO: 936619 - DNA, 25 bp, Mus musculus
ttcctccagacgctgagcagcgaga

SEQ ID NO: 936620 - DNA, 25 bp, Mus musculus
ttcctccagacggtgagcagcgaga

SEQ ID NO: 936621 - DNA, 25 bp, Mus musculus
ttcctccagagaccttcgtggttct

SEQ ID NO: 936622 - DNA, 25 bp, Mus musculus
ttcctccagagagcttcgtggttct

SEQ ID NO: 936623 - DNA, 25 bp, Mus musculus
ttcctccagtggctttgtagtttgt

SEQ ID NO: 936624 - DNA, 25 bp, Mus musculus
ttcctccagtgggtttgtagtttgt

SEQ ID NO: 936625 - DNA, 25 bp, Mus musculus
ttcctccatggaaggagccagggtt

SEQ ID NO: 936626 - DNA, 25 bp, Mus musculus
ttcctccatggatggagccagggtt

SEQ ID NO: 936627 - DNA, 25 bp, Mus musculus
ttcctccatgttatccctgggacag

SEQ ID NO: 936628 - DNA, 25 bp, Mus musculus
ttcctccatgttttccctgggacag

SEQ ID NO: 936629 - DNA, 25 bp, Mus musculus
ttcctccattgaagggtcatgagaa

SEQ ID NO: 936630 - DNA, 25 bp, Mus musculus
ttcctccattgatgggtcatgagaa

SEQ ID NO: 936631 - DNA, 25 bp, Mus musculus
ttcctccattgcctagaatctggga

SEQ ID NO: 936632 - DNA, 25 bp, Mus musculus
ttcctccattgcgtagaatctggga

SEQ ID NO: 936633 - DNA, 25 bp, Mus musculus
ttcctccattgtctgtgcatctgta

SEQ ID NO: 936634 - DNA, 25 bp, Mus musculus
ttcctccattgtgtgtgcatctgta

SEQ ID NO: 936635 - DNA, 25 bp, Mus musculus
ttcctccatttgaggccctgagaca

SEQ ID NO: 936636 - DNA, 25 bp, Mus musculus
ttcctccatttgtggccctgagaca

SEQ ID NO: 936637 - DNA, 25 bp, Mus musculus
ttcctcccaactcaacaatcaaaaa

SEQ ID NO: 936638 - DNA, 25 bp, Mus musculus
ttcctcccaactgaacaatcaaaaa

SEQ ID NO: 936639 - DNA, 25 bp, Mus musculus
ttcctcccactaaaggtttgttctg

SEQ ID NO: 936640 - DNA, 25 bp, Mus musculus
ttcctcccactataggtttgttctg

SEQ ID NO: 936641 - DNA, 25 bp, Mus musculus
ttcctcccagaacagttagaccttg

SEQ ID NO: 936642 - DNA, 25 bp, Mus musculus
ttcctcccagaagagttagaccttg

SEQ ID NO: 936643 - DNA, 25 bp, Mus musculus
ttcctcccagcaatgtgttgatggt

SEQ ID NO: 936644 - DNA, 25 bp, Mus musculus
ttcctcccagcattgtgttgatggt

SEQ ID NO: 936645 - DNA, 25 bp, Mus musculus
ttcctcccaggaaatggtgctctcc

SEQ ID NO: 936646 - DNA, 25 bp, Mus musculus
ttcctcccaggatatggtgctctcc

SEQ ID NO: 936647 - DNA, 25 bp, Mus musculus
ttcctcccaggcctcagatataggt

SEQ ID NO: 936648 - DNA, 25 bp, Mus musculus
ttcctcccaggcgtcagatataggt

SEQ ID NO: 936649 - DNA, 25 bp, Mus musculus
ttcctcccatacaacagacatatct

SEQ ID NO: 936650 - DNA, 25 bp, Mus musculus
ttcctcccatactacagacatatct

SEQ ID NO: 936651 - DNA, 25 bp, Mus musculus
ttcctcccatccatggatagatgca

SEQ ID NO: 936652 - DNA, 25 bp, Mus musculus
ttcctcccatccttggatagatgca

SEQ ID NO: 936653 - DNA, 25 bp, Mus musculus
ttcctcccatgactatctgatgttt

SEQ ID NO: 936654 - DNA, 25 bp, Mus musculus
ttcctcccatgagtatctgatgttt

SEQ ID NO: 936655 - DNA, 25 bp, Mus musculus
ttcctccccaatattgcttgaagag

SEQ ID NO: 936656 - DNA, 25 bp, Mus musculus
ttcctccccaattttgcttgaagag

SEQ ID NO: 936657 - DNA, 25 bp, Mus musculus
ttcctcccctctcttgatggagata

SEQ ID NO: 936658 - DNA, 25 bp, Mus musculus
ttcctcccctctgttgatggagata

SEQ ID NO: 936659 - DNA, 25 bp, Mus musculus
ttcctcccctgtagctatctgatgt

SEQ ID NO: 936660 - DNA, 25 bp, Mus musculus
ttcctcccctgttgctatctgatgt

SEQ ID NO: 936661 - DNA, 25 bp, Mus musculus
ttcctcccgctgagaacacgtatgt

SEQ ID NO: 936662 - DNA, 25 bp, Mus musculus
ttcctcccgctgtgaacacgtatgt

SEQ ID NO: 936663 - DNA, 25 bp, Mus musculus
ttcctccctagtacattctttttat

SEQ ID NO: 936664 - DNA, 25 bp, Mus musculus
ttcctccctagttcattctttttat

SEQ ID NO: 936665 - DNA, 25 bp, Mus musculus
ttcctccctgatctgggttgttagc

SEQ ID NO: 936666 - DNA, 25 bp, Mus musculus
ttcctccctgatgtgggttgttagc

SEQ ID NO: 936667 - DNA, 25 bp, Mus musculus
ttcctccctgcaagactagggtaaa

SEQ ID NO: 936668 - DNA, 25 bp, Mus musculus
ttcctccctgcatgactagggtaaa

SEQ ID NO: 936669 - DNA, 25 bp, Mus musculus
ttcctccctgccagcttattgaaag

SEQ ID NO: 936670 - DNA, 25 bp, Mus musculus
ttcctccctgcctgcttattgaaag

SEQ ID NO: 936671 - DNA, 25 bp, Mus musculus
ttcctccctgtgatgacttattaag

SEQ ID NO: 936672 - DNA, 25 bp, Mus musculus
ttcctccctgtgttgacttattaag

SEQ ID NO: 936673 - DNA, 25 bp, Mus musculus
ttcctcccttggagacctggtgacc

SEQ ID NO: 936674 - DNA, 25 bp, Mus musculus
ttcctcccttggtgacctggtgacc

SEQ ID NO: 936675 - DNA, 25 bp, Mus musculus
ttcctccctttgaagatctgtccat

SEQ ID NO: 936676 - DNA, 25 bp, Mus musculus
ttcctccctttgtagatctgtccat

SEQ ID NO: 936677 - DNA, 25 bp, Mus musculus
ttcctccgaaagcaccatgaactta

SEQ ID NO: 936678 - DNA, 25 bp, Mus musculus
ttcctccgaaaggaccatgaactta

SEQ ID NO: 936679 - DNA, 25 bp, Mus musculus
ttcctccgatgacccttgtatgatt

SEQ ID NO: 936680 - DNA, 25 bp, Mus musculus
ttcctccgatgagccttgtatgatt

SEQ ID NO: 936681 - DNA, 25 bp, Mus musculus
ttcctccgatgcatgtgatcctgtg

SEQ ID NO: 936682 - DNA, 25 bp, Mus musculus
ttcctccgatgcttgtgatcctgtg

SEQ ID NO: 936683 - DNA, 25 bp, Mus musculus
ttcctccggttcactttgtatgctg

SEQ ID NO: 936684 - DNA, 25 bp, Mus musculus
ttcctccggttctctttgtatgctg

SEQ ID NO: 936685 - DNA, 25 bp, Mus musculus
ttcctccgttcccagggagaactgt

SEQ ID NO: 936686 - DNA, 25 bp, Mus musculus
ttcctccgttccgagggagaactgt

SEQ ID NO: 936687 - DNA, 25 bp, Mus musculus
ttcctcctaggcaccaagagtgatg

SEQ ID NO: 936688 - DNA, 25 bp, Mus musculus
ttcctcctaggccattgcaaatatt

SEQ ID NO: 936689 - DNA, 25 bp, Mus musculus
ttcctcctaggcgattgcaaatatt

SEQ ID NO: 936690 - DNA, 25 bp, Mus musculus
ttcctcctaggctccaagagtgatg

SEQ ID NO: 936691 - DNA, 25 bp, Mus musculus
ttcctcctcattaagttgatatcac

SEQ ID NO: 936692 - DNA, 25 bp, Mus musculus
ttcctcctcatttagttgatatcac

SEQ ID NO: 936693 - DNA, 25 bp, Mus musculus
ttcctcctccagctctatagatttc

SEQ ID NO: 936694 - DNA, 25 bp, Mus musculus
ttcctcctccaggtctatagatttc

SEQ ID NO: 936695 - DNA, 25 bp, Mus musculus
ttcctcctccctacacaaatagaaa

SEQ ID NO: 936696 - DNA, 25 bp, Mus musculus
ttcctcctcccttcacaaatagaaa

SEQ ID NO: 936697 - DNA, 25 bp, Mus musculus
ttcctcctccggaaagatactgttt

SEQ ID NO: 936698 - DNA, 25 bp, Mus musculus
ttcctcctccggtaagatactgttt

SEQ ID NO: 936699 - DNA, 25 bp, Mus musculus
ttcctcctcctcatagcactaaatt

SEQ ID NO: 936700 - DNA, 25 bp, Mus musculus
ttcctcctcctcttagcactaaatt

SEQ ID NO: 936701 - DNA, 25 bp, Mus musculus
ttcctcctcgctagtctgatagtac

SEQ ID NO: 936702 - DNA, 25 bp, Mus musculus
ttcctcctcgcttgtctgatagtac

SEQ ID NO: 936703 - DNA, 25 bp, Mus musculus
ttcctcctctgtatatcggcttgag

SEQ ID NO: 936704 - DNA, 25 bp, Mus musculus
ttcctcctctgtttatcggcttgag

SEQ ID NO: 936705 - DNA, 25 bp, Mus musculus
ttcctcctcttcagagcctattata

SEQ ID NO: 936706 - DNA, 25 bp, Mus musculus
ttcctcctcttctgagcctattata

SEQ ID NO: 936707 - DNA, 25 bp, Mus musculus
ttcctcctcttgagcaggatgtgga

SEQ ID NO: 936708 - DNA, 25 bp, Mus musculus
ttcctcctcttgtgcaggatgtgga

SEQ ID NO: 936709 - DNA, 25 bp, Mus musculus
ttcctcctctttcattcttctgaat

SEQ ID NO: 936710 - DNA, 25 bp, Mus musculus
ttcctcctctttgattcttctgaat

SEQ ID NO: 936711 - DNA, 25 bp, Mus musculus
ttcctcctgacaacaatagatttga

SEQ ID NO: 936712 - DNA, 25 bp, Mus musculus
ttcctcctgacatcaatagatttga

SEQ ID NO: 936713 - DNA, 25 bp, Mus musculus
ttcctcctgataatcagtccaaatt

SEQ ID NO: 936714 - DNA, 25 bp, Mus musculus
ttcctcctgatattcagtccaaatt

SEQ ID NO: 936715 - DNA, 25 bp, Mus musculus
ttcctcctgatcaaatggcacctaa

SEQ ID NO: 936716 - DNA, 25 bp, Mus musculus
ttcctcctgatctaatggcacctaa

SEQ ID NO: 936717 - DNA, 25 bp, Mus musculus
ttcctcctgatgattttctctagta

SEQ ID NO: 936718 - DNA, 25 bp, Mus musculus
ttcctcctgatgtttttctctagta

SEQ ID NO: 936719 - DNA, 25 bp, Mus musculus
ttcctcctgattccagagactgtgc

SEQ ID NO: 936720 - DNA, 25 bp, Mus musculus
ttcctcctgattgcagagactgtgc

SEQ ID NO: 936721 - DNA, 25 bp, Mus musculus
ttcctcctgcataccaggcagataa

SEQ ID NO: 936722 - DNA, 25 bp, Mus musculus
ttcctcctgcatcttcaacatttag

SEQ ID NO: 936723 - DNA, 25 bp, Mus musculus
ttcctcctgcatgttcaacatttag

SEQ ID NO: 936724 - DNA, 25 bp, Mus musculus
ttcctcctgcattccaggcagataa

SEQ ID NO: 936725 - DNA, 25 bp, Mus musculus
ttcctcctggccattgtgttgacag

SEQ ID NO: 936726 - DNA, 25 bp, Mus musculus
ttcctcctggcctttgtgttgacag

SEQ ID NO: 936727 - DNA, 25 bp, Mus musculus
ttcctcctgggaccaatgatgggac

SEQ ID NO: 936728 - DNA, 25 bp, Mus musculus
ttcctcctgggagcaatgatgggac

SEQ ID NO: 936729 - DNA, 25 bp, Mus musculus
ttcctcctggttagggttctggaga

SEQ ID NO: 936730 - DNA, 25 bp, Mus musculus
ttcctcctggttctcgcttcctaaa

SEQ ID NO: 936731 - DNA, 25 bp, Mus musculus
ttcctcctggttgtcgcttcctaaa

SEQ ID NO: 936732 - DNA, 25 bp, Mus musculus
ttcctcctggtttgggttctggaga

SEQ ID NO: 936733 - DNA, 25 bp, Mus musculus
ttcctcctgtagattggccatactg

SEQ ID NO: 936734 - DNA, 25 bp, Mus musculus
ttcctcctgtagtttggccatactg

SEQ ID NO: 936735 - DNA, 25 bp, Mus musculus
ttcctcctgtcaagtcttgtacttg

SEQ ID NO: 936736 - DNA, 25 bp, Mus musculus
ttcctcctgtcatgtcttgtacttg

SEQ ID NO: 936737 - DNA, 25 bp, Mus musculus
ttcctcctgtggatgactaggcaga

SEQ ID NO: 936738 - DNA, 25 bp, Mus musculus
ttcctcctgtggttgactaggcaga

SEQ ID NO: 936739 - DNA, 25 bp, Mus musculus
ttcctcctgtgtcaacatgtcagaa

SEQ ID NO: 936740 - DNA, 25 bp, Mus musculus
ttcctcctgtgtgaacatgtcagaa

SEQ ID NO: 936741 - DNA, 25 bp, Mus musculus
ttcctcctgttcacaatctgcaaga

SEQ ID NO: 936742 - DNA, 25 bp, Mus musculus
ttcctcctgttctcaatctgcaaga

SEQ ID NO: 936743 - DNA, 25 bp, Mus musculus
ttcctccttagaaaatgcaccctca

SEQ ID NO: 936744 - DNA, 25 bp, Mus musculus
ttcctccttagataatgcaccctca

SEQ ID NO: 936745 - DNA, 25 bp, Mus musculus
ttcctccttatcctttctgaagtca

SEQ ID NO: 936746 - DNA, 25 bp, Mus musculus
ttcctccttatcgtttctgaagtca

SEQ ID NO: 936747 - DNA, 25 bp, Mus musculus
ttcctccttattatgatgcatggcc

SEQ ID NO: 936748 - DNA, 25 bp, Mus musculus
ttcctccttattcttgatggcaacg

SEQ ID NO: 936749 - DNA, 25 bp, Mus musculus
ttcctccttattgttgatggcaacg

SEQ ID NO: 936750 - DNA, 25 bp, Mus musculus
ttcctccttattttgatgcatggcc

SEQ ID NO: 936751 - DNA, 25 bp, Mus musculus
ttcctccttcacaggtggcttaatg

SEQ ID NO: 936752 - DNA, 25 bp, Mus musculus
ttcctccttcactggtggcttaatg

SEQ ID NO: 936753 - DNA, 25 bp, Mus musculus
ttcctccttcagagtaagtgcattc

SEQ ID NO: 936754 - DNA, 25 bp, Mus musculus
ttcctccttcagtgtaagtgcattc

SEQ ID NO: 936755 - DNA, 25 bp, Mus musculus
ttcctccttccaagctggatttaca

SEQ ID NO: 936756 - DNA, 25 bp, Mus musculus
ttcctccttccatgctggatttaca

SEQ ID NO: 936757 - DNA, 25 bp, Mus musculus
ttcctccttcccatagatacagatg

SEQ ID NO: 936758 - DNA, 25 bp, Mus musculus
ttcctccttcccttagatacagatg

SEQ ID NO: 936759 - DNA, 25 bp, Mus musculus
ttcctccttggaaacaattctcttg

SEQ ID NO: 936760 - DNA, 25 bp, Mus musculus
ttcctccttggatacaattctcttg

SEQ ID NO: 936761 - DNA, 25 bp, Mus musculus
ttcctccttgtaagagcttcaaccc

SEQ ID NO: 936762 - DNA, 25 bp, Mus musculus
ttcctccttgtatgagcttcaaccc

SEQ ID NO: 936763 - DNA, 25 bp, Mus musculus
ttcctccttgtgatggttatgcgta

SEQ ID NO: 936764 - DNA, 25 bp, Mus musculus
ttcctccttgtgttggttatgcgta

SEQ ID NO: 936765 - DNA, 25 bp, Mus musculus
ttcctcctttaaatgtttgttgcag

SEQ ID NO: 936766 - DNA, 25 bp, Mus musculus
ttcctcctttaattgtttgttgcag

SEQ ID NO: 936767 - DNA, 25 bp, Mus musculus
ttcctcctttagaatgtgtgtgcta

SEQ ID NO: 936768 - DNA, 25 bp, Mus musculus
ttcctcctttagtatgtgtgtgcta

SEQ ID NO: 936769 - DNA, 25 bp, Mus musculus
ttcctcctttgtcctagaccagtaa

SEQ ID NO: 936770 - DNA, 25 bp, Mus musculus
ttcctcctttgtgctagaccagtaa

SEQ ID NO: 936771 - DNA, 25 bp, Mus musculus
ttcctcctttttaagagtctctcat

SEQ ID NO: 936772 - DNA, 25 bp, Mus musculus
ttcctccttttttagagtctctcat

SEQ ID NO: 936773 - DNA, 25 bp, Mus musculus
ttcctcgactggaatgacagctagc

SEQ ID NO: 936774 - DNA, 25 bp, Mus musculus
ttcctcgactggtatgacagctagc

SEQ ID NO: 936775 - DNA, 25 bp, Mus musculus
ttcctcgagaagaacatggttcctt

SEQ ID NO: 936776 - DNA, 25 bp, Mus musculus
ttcctcgagaagtacatggttcctt

SEQ ID NO: 936777 - DNA, 25 bp, Mus musculus
ttcctcgagcgaacataagtttcaa

SEQ ID NO: 936778 - DNA, 25 bp, Mus musculus
ttcctcgagcgatcataagtttcaa

SEQ ID NO: 936779 - DNA, 25 bp, Mus musculus
ttcctcgagctgatactgcctgtac

SEQ ID NO: 936780 - DNA, 25 bp, Mus musculus
ttcctcgagctgttactgcctgtac

SEQ ID NO: 936781 - DNA, 25 bp, Mus musculus
ttcctcgcccttagaagcagggatt

SEQ ID NO: 936782 - DNA, 25 bp, Mus musculus
ttcctcgccctttgaagcagggatt

SEQ ID NO: 936783 - DNA, 25 bp, Mus musculus
ttcctcgccggtctcgtagtaatca

SEQ ID NO: 936784 - DNA, 25 bp, Mus musculus
ttcctcgccggtgtcgtagtaatca

SEQ ID NO: 936785 - DNA, 25 bp, Mus musculus
ttcctcgctacactcctttatattg

SEQ ID NO: 936786 - DNA, 25 bp, Mus musculus
ttcctcgctacagtcctttatattg

SEQ ID NO: 936787 - DNA, 25 bp, Mus musculus
ttcctcggagtcaaattctgtgtca

SEQ ID NO: 936788 - DNA, 25 bp, Mus musculus
ttcctcggagtctaattctgtgtca

SEQ ID NO: 936789 - DNA, 25 bp, Mus musculus
ttcctcggagtgatcaggtcagaga

SEQ ID NO: 936790 - DNA, 25 bp, Mus musculus
ttcctcggagtgttcaggtcagaga

SEQ ID NO: 936791 - DNA, 25 bp, Mus musculus
ttcctcggctatacatatacctcat

SEQ ID NO: 936792 - DNA, 25 bp, Mus musculus
ttcctcggctattcatatacctcat

SEQ ID NO: 936793 - DNA, 25 bp, Mus musculus
ttcctcggctgtctcaatgtcaaag

SEQ ID NO: 936794 - DNA, 25 bp, Mus musculus
ttcctcggctgtgtcaatgtcaaag

SEQ ID NO: 936795 - DNA, 25 bp, Mus musculus
ttcctcgggtggctcgttttcaaga

SEQ ID NO: 936796 - DNA, 25 bp, Mus musculus
ttcctcgggtgggtcgttttcaaga

SEQ ID NO: 936797 - DNA, 25 bp, Mus musculus
ttcctcggtcccatgtagagtggag

SEQ ID NO: 936798 - DNA, 25 bp, Mus musculus
ttcctcggtcccttgtagagtggag

SEQ ID NO: 936799 - DNA, 25 bp, Mus musculus
ttcctcggtgaccaagttgcacgtg

SEQ ID NO: 936800 - DNA, 25 bp, Mus musculus
ttcctcggtgacgaagttgcacgtg

SEQ ID NO: 936801 - DNA, 25 bp, Mus musculus
ttcctcggttatataatgtgtttgg

SEQ ID NO: 936802 - DNA, 25 bp, Mus musculus
ttcctcggttatttaatgtgtttgg

SEQ ID NO: 936803 - DNA, 25 bp, Mus musculus
ttcctcgtctgtctaaagctctcat

SEQ ID NO: 936804 - DNA, 25 bp, Mus musculus
ttcctcgtctgtgtaaagctctcat

SEQ ID NO: 936805 - DNA, 25 bp, Mus musculus
ttcctcgtgatcctgccaagtaaag

SEQ ID NO: 936806 - DNA, 25 bp, Mus musculus
ttcctcgtgatcgtgccaagtaaag

SEQ ID NO: 936807 - DNA, 25 bp, Mus musculus
ttcctcgtgatgagttccttttcct

SEQ ID NO: 936808 - DNA, 25 bp, Mus musculus
ttcctcgtgatgtgttccttttcct

SEQ ID NO: 936809 - DNA, 25 bp, Mus musculus
ttcctcgtgcagcaagtgggcatgt

SEQ ID NO: 936810 - DNA, 25 bp, Mus musculus
ttcctcgtgcaggaagtgggcatgt

SEQ ID NO: 936811 - DNA, 25 bp, Mus musculus
ttcctcgttcacaggttactaagca

SEQ ID NO: 936812 - DNA, 25 bp, Mus musculus
ttcctcgttcactggttactaagca

SEQ ID NO: 936813 - DNA, 25 bp, Mus musculus
ttcctcgttctgatgctttcagttt

SEQ ID NO: 936814 - DNA, 25 bp, Mus musculus
ttcctcgttctgttgctttcagttt

SEQ ID NO: 936815 - DNA, 25 bp, Mus musculus
ttcctcgttgttaattctgcaccat

SEQ ID NO: 936816 - DNA, 25 bp, Mus musculus
ttcctcgttgtttattctgcaccat

SEQ ID NO: 936817 - DNA, 25 bp, Mus musculus
ttcctcgttttcatcatcctggtgg

SEQ ID NO: 936818 - DNA, 25 bp, Mus musculus
ttcctcgttttcttcatcctggtgg

SEQ ID NO: 936819 - DNA, 25 bp, Mus musculus
ttcctctaacacagcctacatgcaa

SEQ ID NO: 936820 - DNA, 25 bp, Mus musculus
ttcctctaacactgcctacatgcaa

SEQ ID NO: 936821 - DNA, 25 bp, Mus musculus
ttcctctaattcctgttctgggtct

SEQ ID NO: 936822 - DNA, 25 bp, Mus musculus
ttcctctaattcgtgttctgggtct

SEQ ID NO: 936823 - DNA, 25 bp, Mus musculus
ttcctctacatgctctgcagggatg

SEQ ID NO: 936824 - DNA, 25 bp, Mus musculus
ttcctctacatggtctgcagggatg

SEQ ID NO: 936825 - DNA, 25 bp, Mus musculus
ttcctctacattactctggcagata

SEQ ID NO: 936826 - DNA, 25 bp, Mus musculus
ttcctctacatttctctggcagata

SEQ ID NO: 936827 - DNA, 25 bp, Mus musculus
ttcctctagactctgctcattagtt

SEQ ID NO: 936828 - DNA, 25 bp, Mus musculus
ttcctctagactgtgctcattagtt

SEQ ID NO: 936829 - DNA, 25 bp, Mus musculus
ttcctctagaggagttgagctgtct

SEQ ID NO: 936830 - DNA, 25 bp, Mus musculus
ttcctctagaggtgttgagctgtct

SEQ ID NO: 936831 - DNA, 25 bp, Mus musculus
ttcctctagcctatggtccggagac

SEQ ID NO: 936832 - DNA, 25 bp, Mus musculus
ttcctctagcctttggtccggagac

SEQ ID NO: 936833 - DNA, 25 bp, Mus musculus
ttcctctaggttacctgttcataga

SEQ ID NO: 936834 - DNA, 25 bp, Mus musculus
ttcctctaggtttcctgttcataga

SEQ ID NO: 936835 - DNA, 25 bp, Mus musculus
ttcctctatagcaccatgtgcttgc

SEQ ID NO: 936836 - DNA, 25 bp, Mus musculus
ttcctctatagctccatgtgcttgc

SEQ ID NO: 936837 - DNA, 25 bp, Mus musculus
ttcctctatataatgccacccatgg

SEQ ID NO: 936838 - DNA, 25 bp, Mus musculus
ttcctctatatattgccacccatgg

SEQ ID NO: 936839 - DNA, 25 bp, Mus musculus
ttcctctcaagtaagcatctactgc

SEQ ID NO: 936840 - DNA, 25 bp, Mus musculus
ttcctctcaagtctggtaccctaga

SEQ ID NO: 936841 - DNA, 25 bp, Mus musculus
ttcctctcaagtgtggtaccctaga

SEQ ID NO: 936842 - DNA, 25 bp, Mus musculus
ttcctctcaagttagcatctactgc

SEQ ID NO: 936843 - DNA, 25 bp, Mus musculus
ttcctctcaattatcttcagtaatg

SEQ ID NO: 936844 - DNA, 25 bp, Mus musculus
ttcctctcaattttcttcagtaatg

SEQ ID NO: 936845 - DNA, 25 bp, Mus musculus
ttcctctcactcctcaggagaaagg

SEQ ID NO: 936846 - DNA, 25 bp, Mus musculus
ttcctctcactcgtcaggagaaagg

SEQ ID NO: 936847 - DNA, 25 bp, Mus musculus
ttcctctcagttactcagttttgtt

SEQ ID NO: 936848 - DNA, 25 bp, Mus musculus
ttcctctcagtttctcagttttgtt

SEQ ID NO: 936849 - DNA, 25 bp, Mus musculus
ttcctctcataaataatcaacccat

SEQ ID NO: 936850 - DNA, 25 bp, Mus musculus
ttcctctcataattaatcaacccat

SEQ ID NO: 936851 - DNA, 25 bp, Mus musculus
ttcctctcattgaaatagcccctat

SEQ ID NO: 936852 - DNA, 25 bp, Mus musculus
ttcctctcattgtaatagcccctat

SEQ ID NO: 936853 - DNA, 25 bp, Mus musculus
ttcctctccaaaactatgcattacc

SEQ ID NO: 936854 - DNA, 25 bp, Mus musculus
ttcctctccaaatctatgcattacc

SEQ ID NO: 936855 - DNA, 25 bp, Mus musculus
ttcctctccaatcggctccagtgaa

SEQ ID NO: 936856 - DNA, 25 bp, Mus musculus
ttcctctccaatgggctccagtgaa

SEQ ID NO: 936857 - DNA, 25 bp, Mus musculus
ttcctctccatacccattgctatgg

SEQ ID NO: 936858 - DNA, 25 bp, Mus musculus
ttcctctccatagccattgctatgg

SEQ ID NO: 936859 - DNA, 25 bp, Mus musculus
ttcctctccatgcatttggactctg

SEQ ID NO: 936860 - DNA, 25 bp, Mus musculus
ttcctctccatggatttggactctg

SEQ ID NO: 936861 - DNA, 25 bp, Mus musculus
ttcctctcccacatgtcaagatttc

SEQ ID NO: 936862 - DNA, 25 bp, Mus musculus
ttcctctcccacttgtcaagatttc

SEQ ID NO: 936863 - DNA, 25 bp, Mus musculus
ttcctctcccttagacaaccaaaga

SEQ ID NO: 936864 - DNA, 25 bp, Mus musculus
ttcctctccctttgacaaccaaaga

SEQ ID NO: 936865 - DNA, 25 bp, Mus musculus
ttcctctcctgtcaaccttttagaa

SEQ ID NO: 936866 - DNA, 25 bp, Mus musculus
ttcctctcctgtgaaccttttagaa

SEQ ID NO: 936867 - DNA, 25 bp, Mus musculus
ttcctctccttacagtacatgatta

SEQ ID NO: 936868 - DNA, 25 bp, Mus musculus
ttcctctccttagagtacatgatta

SEQ ID NO: 936869 - DNA, 25 bp, Mus musculus
ttcctctcgagccagtaattaagta

SEQ ID NO: 936870 - DNA, 25 bp, Mus musculus
ttcctctcgagcgagtaattaagta

SEQ ID NO: 936871 - DNA, 25 bp, Mus musculus
ttcctctcgggtagccacacagaga

SEQ ID NO: 936872 - DNA, 25 bp, Mus musculus
ttcctctcgggttgccacacagaga

SEQ ID NO: 936873 - DNA, 25 bp, Mus musculus
ttcctctcgtggctgaagtttatgg

SEQ ID NO: 936874 - DNA, 25 bp, Mus musculus
ttcctctcgtgggtgaagtttatgg

SEQ ID NO: 936875 - DNA, 25 bp, Mus musculus
ttcctctctaccatctcatattttt

SEQ ID NO: 936876 - DNA, 25 bp, Mus musculus
ttcctctctaccttctcatattttt

SEQ ID NO: 936877 - DNA, 25 bp, Mus musculus
ttcctctctaggatctgctgtagaa

SEQ ID NO: 936878 - DNA, 25 bp, Mus musculus
ttcctctctaggttctgctgtagaa

SEQ ID NO: 936879 - DNA, 25 bp, Mus musculus
ttcctctctatcagagtatgtactg

SEQ ID NO: 936880 - DNA, 25 bp, Mus musculus
ttcctctctatctgagtatgtactg

SEQ ID NO: 936881 - DNA, 25 bp, Mus musculus
ttcctctctcaaagtgctttctcaa

SEQ ID NO: 936882 - DNA, 25 bp, Mus musculus
ttcctctctcaatgtgctttctcaa

SEQ ID NO: 936883 - DNA, 25 bp, Mus musculus
ttcctctctcagcagcaaaataaaa

SEQ ID NO: 936884 - DNA, 25 bp, Mus musculus
ttcctctctcaggagcaaaataaaa

SEQ ID NO: 936885 - DNA, 25 bp, Mus musculus
ttcctctctcttataccctgtataa

SEQ ID NO: 936886 - DNA, 25 bp, Mus musculus
ttcctctctcttttaccctgtataa

SEQ ID NO: 936887 - DNA, 25 bp, Mus musculus
ttcctctctgagactgtgctgaagg

SEQ ID NO: 936888 - DNA, 25 bp, Mus musculus
ttcctctctgagctgtttgctctcc

SEQ ID NO: 936889 - DNA, 25 bp, Mus musculus
ttcctctctgaggtgtttgctctcc

SEQ ID NO: 936890 - DNA, 25 bp, Mus musculus
ttcctctctgagtctgtgctgaagg

SEQ ID NO: 936891 - DNA, 25 bp, Mus musculus
ttcctctctgtgcataagcatttgg

SEQ ID NO: 936892 - DNA, 25 bp, Mus musculus
ttcctctctgtggataagcatttgg

SEQ ID NO: 936893 - DNA, 25 bp, Mus musculus
ttcctctgaagacctcgagactaac

SEQ ID NO: 936894 - DNA, 25 bp, Mus musculus
ttcctctgaagagctcgagactaac

SEQ ID NO: 936895 - DNA, 25 bp, Mus musculus
ttcctctgaccgacatggcagcggg

SEQ ID NO: 936896 - DNA, 25 bp, Mus musculus
ttcctctgaccgtcatggcagcggg

SEQ ID NO: 936897 - DNA, 25 bp, Mus musculus
ttcctctgacttacactttattggt

SEQ ID NO: 936898 - DNA, 25 bp, Mus musculus
ttcctctgactttcactttattggt

SEQ ID NO: 936899 - DNA, 25 bp, Mus musculus
ttcctctgagtgacgctatgcaaaa

SEQ ID NO: 936900 - DNA, 25 bp, Mus musculus
ttcctctgagtgtcgctatgcaaaa

SEQ ID NO: 936901 - DNA, 25 bp, Mus musculus
ttcctctgatttccttaggagacga

SEQ ID NO: 936902 - DNA, 25 bp, Mus musculus
ttcctctgatttgcttaggagacga

SEQ ID NO: 936903 - DNA, 25 bp, Mus musculus
ttcctctgcaccaatcctgggagaa

SEQ ID NO: 936904 - DNA, 25 bp, Mus musculus
ttcctctgcacctatcctgggagaa

SEQ ID NO: 936905 - DNA, 25 bp, Mus musculus
ttcctctgcagaaatagctgctttc

SEQ ID NO: 936906 - DNA, 25 bp, Mus musculus
ttcctctgcagaatcgtctgtggca

SEQ ID NO: 936907 - DNA, 25 bp, Mus musculus
ttcctctgcagatatagctgctttc

SEQ ID NO: 936908 - DNA, 25 bp, Mus musculus
ttcctctgcagattcgtctgtggca

SEQ ID NO: 936909 - DNA, 25 bp, Mus musculus
ttcctctgccaaagtgctgggaaga

SEQ ID NO: 936910 - DNA, 25 bp, Mus musculus
ttcctctgccaacagagccgttgtt

SEQ ID NO: 936911 - DNA, 25 bp, Mus musculus
ttcctctgccaagagagccgttgtt

SEQ ID NO: 936912 - DNA, 25 bp, Mus musculus
ttcctctgccaatgtgctgggaaga

SEQ ID NO: 936913 - DNA, 25 bp, Mus musculus
ttcctctgcctaaagtgtgtgctgg

SEQ ID NO: 936914 - DNA, 25 bp, Mus musculus
ttcctctgcctatagtgtgtgctgg

SEQ ID NO: 936915 - DNA, 25 bp, Mus musculus
ttcctctggaagctgtccgtcatca

SEQ ID NO: 936916 - DNA, 25 bp, Mus musculus
ttcctctggaaggtgtccgtcatca

SEQ ID NO: 936917 - DNA, 25 bp, Mus musculus
ttcctctggtgaactttgtagaaag

SEQ ID NO: 936918 - DNA, 25 bp, Mus musculus
ttcctctggtgatctttgtagaaag

SEQ ID NO: 936919 - DNA, 25 bp, Mus musculus
ttcctctggtgcctcatagaagaag

SEQ ID NO: 936920 - DNA, 25 bp, Mus musculus
ttcctctggtgcgtcatagaagaag

SEQ ID NO: 936921 - DNA, 25 bp, Mus musculus
ttcctctgtactctaatctcatcac

SEQ ID NO: 936922 - DNA, 25 bp, Mus musculus
ttcctctgtactgtaatctcatcac

SEQ ID NO: 936923 - DNA, 25 bp, Mus musculus
ttcctctgtagcaatgtctaatgta

SEQ ID NO: 936924 - DNA, 25 bp, Mus musculus
ttcctctgtagctatgtctaatgta

SEQ ID NO: 936925 - DNA, 25 bp, Mus musculus
ttcctctgtcttctttacccaaaat

SEQ ID NO: 936926 - DNA, 25 bp, Mus musculus
ttcctctgtcttgtttacccaaaat

SEQ ID NO: 936927 - DNA, 25 bp, Mus musculus
ttcctctgtgccacatcagggcaga

SEQ ID NO: 936928 - DNA, 25 bp, Mus musculus
ttcctctgtgcctcatcagggcaga

SEQ ID NO: 936929 - DNA, 25 bp, Mus musculus
ttcctctgtgtaatctaagtgcatt

SEQ ID NO: 936930 - DNA, 25 bp, Mus musculus
ttcctctgtgtattctaagtgcatt

SEQ ID NO: 936931 - DNA, 25 bp, Mus musculus
ttcctctgtgttatctcagagcaag

SEQ ID NO: 936932 - DNA, 25 bp, Mus musculus
ttcctctgtgttttctcagagcaag

SEQ ID NO: 936933 - DNA, 25 bp, Mus musculus
ttcctctgttctctagtctcagctg

SEQ ID NO: 936934 - DNA, 25 bp, Mus musculus
ttcctctgttctgtagtctcagctg

SEQ ID NO: 936935 - DNA, 25 bp, Mus musculus
ttcctctgtttgagccaacccttta

SEQ ID NO: 936936 - DNA, 25 bp, Mus musculus
ttcctctgtttgtgccaacccttta

SEQ ID NO: 936937 - DNA, 25 bp, Mus musculus
ttcctcttaaccctggattagtaat

SEQ ID NO: 936938 - DNA, 25 bp, Mus musculus
ttcctcttaaccgtggattagtaat

SEQ ID NO: 936939 - DNA, 25 bp, Mus musculus
ttcctcttaattcgctgggcacact

SEQ ID NO: 936940 - DNA, 25 bp, Mus musculus
ttcctcttaattggctgggcacact

SEQ ID NO: 936941 - DNA, 25 bp, Mus musculus
ttcctcttacaacccgcatcaattt

SEQ ID NO: 936942 - DNA, 25 bp, Mus musculus
ttcctcttacaagccgcatcaattt

SEQ ID NO: 936943 - DNA, 25 bp, Mus musculus
ttcctcttacgaataacacctgcaa

SEQ ID NO: 936944 - DNA, 25 bp, Mus musculus
ttcctcttacgattaacacctgcaa

SEQ ID NO: 936945 - DNA, 25 bp, Mus musculus
ttcctcttagctatggtttatgttt

SEQ ID NO: 936946 - DNA, 25 bp, Mus musculus
ttcctcttagctttggtttatgttt

SEQ ID NO: 936947 - DNA, 25 bp, Mus musculus
ttcctcttatggcaccgataatctg

SEQ ID NO: 936948 - DNA, 25 bp, Mus musculus
ttcctcttatgggaccgataatctg

SEQ ID NO: 936949 - DNA, 25 bp, Mus musculus
ttcctcttcactcagagttcactag

SEQ ID NO: 936950 - DNA, 25 bp, Mus musculus
ttcctcttcactcagtggctcgtaa

SEQ ID NO: 936951 - DNA, 25 bp, Mus musculus
ttcctcttcactgagagttcactag

SEQ ID NO: 936952 - DNA, 25 bp, Mus musculus
ttcctcttcactgagtggctcgtaa

SEQ ID NO: 936953 - DNA, 25 bp, Mus musculus
ttcctcttcatcaggaggctgggat

SEQ ID NO: 936954 - DNA, 25 bp, Mus musculus
ttcctcttcatctggaggctgggat

SEQ ID NO: 936955 - DNA, 25 bp, Mus musculus
ttcctcttccggcataacattctca

SEQ ID NO: 936956 - DNA, 25 bp, Mus musculus
ttcctcttccgggataacattctca

SEQ ID NO: 936957 - DNA, 25 bp, Mus musculus
ttcctcttctccatggtaagtgaca

SEQ ID NO: 936958 - DNA, 25 bp, Mus musculus
ttcctcttctccttggtaagtgaca

SEQ ID NO: 936959 - DNA, 25 bp, Mus musculus
ttcctcttctgaccacaccgtgaaa

SEQ ID NO: 936960 - DNA, 25 bp, Mus musculus
ttcctcttctgagcacaccgtgaaa

SEQ ID NO: 936961 - DNA, 25 bp, Mus musculus
ttcctcttgagacctttgcttagca

SEQ ID NO: 936962 - DNA, 25 bp, Mus musculus
ttcctcttgagagctttgcttagca

SEQ ID NO: 936963 - DNA, 25 bp, Mus musculus
ttcctcttgcccagcagtggatgga

SEQ ID NO: 936964 - DNA, 25 bp, Mus musculus
ttcctcttgccctgcagtggatgga

SEQ ID NO: 936965 - DNA, 25 bp, Mus musculus
ttcctcttgctcatggatgacttat

SEQ ID NO: 936966 - DNA, 25 bp, Mus musculus
ttcctcttgctcttggatgacttat

SEQ ID NO: 936967 - DNA, 25 bp, Mus musculus
ttcctcttggctacttgtgaaaata

SEQ ID NO: 936968 - DNA, 25 bp, Mus musculus
ttcctcttggcttcttgtgaaaata

SEQ ID NO: 936969 - DNA, 25 bp, Mus musculus
ttcctcttgggtagcttatgtcaga

SEQ ID NO: 936970 - DNA, 25 bp, Mus musculus
ttcctcttgggttgcttatgtcaga

SEQ ID NO: 936971 - DNA, 25 bp, Mus musculus
ttcctctttattccacagggcgaaa

SEQ ID NO: 936972 - DNA, 25 bp, Mus musculus
ttcctctttattgcacagggcgaaa

SEQ ID NO: 936973 - DNA, 25 bp, Mus musculus
ttcctctttccaccttgagatgtga

SEQ ID NO: 936974 - DNA, 25 bp, Mus musculus
ttcctctttccagcttgagatgtga

SEQ ID NO: 936975 - DNA, 25 bp, Mus musculus
ttcctctttctgaagtactttctta

SEQ ID NO: 936976 - DNA, 25 bp, Mus musculus
ttcctctttctgagacaatccacta

SEQ ID NO: 936977 - DNA, 25 bp, Mus musculus
ttcctctttctgtagtactttctta

SEQ ID NO: 936978 - DNA, 25 bp, Mus musculus
ttcctctttctgtgacaatccacta

SEQ ID NO: 936979 - DNA, 25 bp, Mus musculus
ttcctctttcttcaagtgcctgggt

SEQ ID NO: 936980 - DNA, 25 bp, Mus musculus
ttcctctttcttgaagtgcctgggt

SEQ ID NO: 936981 - DNA, 25 bp, Mus musculus
ttcctctttgtaaggaacttaaagg

SEQ ID NO: 936982 - DNA, 25 bp, Mus musculus
ttcctctttgtatggaacttaaagg

SEQ ID NO: 936983 - DNA, 25 bp, Mus musculus
ttcctctttgttcagactaacactt

SEQ ID NO: 936984 - DNA, 25 bp, Mus musculus
ttcctctttgttgagactaacactt

SEQ ID NO: 936985 - DNA, 25 bp, Mus musculus
ttcctcttttatactgtgggacctg

SEQ ID NO: 936986 - DNA, 25 bp, Mus musculus
ttcctcttttattctgtgggacctg

SEQ ID NO: 936987 - DNA, 25 bp, Mus musculus
ttcctcttttctagcatgtaatata

SEQ ID NO: 936988 - DNA, 25 bp, Mus musculus
ttcctcttttctcgagtatgtcaga

SEQ ID NO: 936989 - DNA, 25 bp, Mus musculus
ttcctcttttctggagtatgtcaga

SEQ ID NO: 936990 - DNA, 25 bp, Mus musculus
ttcctcttttcttgcatgtaatata

SEQ ID NO: 936991 - DNA, 25 bp, Mus musculus
ttcctcttttggcacattgaatttt

SEQ ID NO: 936992 - DNA, 25 bp, Mus musculus
ttcctcttttgggacattgaatttt

SEQ ID NO: 936993 - DNA, 25 bp, Mus musculus
ttcctctttttacaagctcttccct

SEQ ID NO: 936994 - DNA, 25 bp, Mus musculus
ttcctctttttagaagctcttccct

SEQ ID NO: 936995 - DNA, 25 bp, Mus musculus
ttcctcttttttccagtgagccata

SEQ ID NO: 936996 - DNA, 25 bp, Mus musculus
ttcctcttttttgcagtgagccata

SEQ ID NO: 936997 - DNA, 25 bp, Mus musculus
ttcctgaaaggtcaacttaacagac

SEQ ID NO: 936998 - DNA, 25 bp, Mus musculus
ttcctgaaaggtgaacttaacagac

SEQ ID NO: 936999 - DNA, 25 bp, Mus musculus
ttcctgaaattcagaccatccaact

SEQ ID NO: 937000 - DNA, 25 bp, Mus musculus
ttcctgaaattctgaccatccaact

SEQ ID NO: 937001 - DNA, 25 bp, Mus musculus
ttcctgaacaggcttcccaagtgta

SEQ ID NO: 937002 - DNA, 25 bp, Mus musculus
ttcctgaacagggttcccaagtgta

SEQ ID NO: 937003 - DNA, 25 bp, Mus musculus
ttcctgaacccacacctgatgaaga

SEQ ID NO: 937004 - DNA, 25 bp, Mus musculus
ttcctgaacccagacctgatgaaga

SEQ ID NO: 937005 - DNA, 25 bp, Mus musculus
ttcctgaactccctgctatctttgc

SEQ ID NO: 937006 - DNA, 25 bp, Mus musculus
ttcctgaactccgtgctatctttgc

SEQ ID NO: 937007 - DNA, 25 bp, Mus musculus
ttcctgaactctatgctgactcggt

SEQ ID NO: 937008 - DNA, 25 bp, Mus musculus
ttcctgaactctttgctgactcggt

SEQ ID NO: 937009 - DNA, 25 bp, Mus musculus
ttcctgaactgacaaattcgttgtt

SEQ ID NO: 937010 - DNA, 25 bp, Mus musculus
ttcctgaactgagaaattcgttgtt

SEQ ID NO: 937011 - DNA, 25 bp, Mus musculus
ttcctgaagaaaacgttggagatac

SEQ ID NO: 937012 - DNA, 25 bp, Mus musculus
ttcctgaagaaatcgttggagatac

SEQ ID NO: 937013 - DNA, 25 bp, Mus musculus
ttcctgaagccaatttccccagctt

SEQ ID NO: 937014 - DNA, 25 bp, Mus musculus
ttcctgaagccattttccccagctt

SEQ ID NO: 937015 - DNA, 25 bp, Mus musculus
ttcctgaagctacgtatgtctcaca

SEQ ID NO: 937016 - DNA, 25 bp, Mus musculus
ttcctgaagctaggtatgtctcaca

SEQ ID NO: 937017 - DNA, 25 bp, Mus musculus
ttcctgaagggcatcacagctgctg

SEQ ID NO: 937018 - DNA, 25 bp, Mus musculus
ttcctgaagggcttcacagctgctg

SEQ ID NO: 937019 - DNA, 25 bp, Mus musculus
ttcctgaatgcaccataattgctgt

SEQ ID NO: 937020 - DNA, 25 bp, Mus musculus
ttcctgaatgcagcataattgctgt

SEQ ID NO: 937021 - DNA, 25 bp, Mus musculus
ttcctgaattggacaaggcacagag

SEQ ID NO: 937022 - DNA, 25 bp, Mus musculus
ttcctgaattggtcaaggcacagag

SEQ ID NO: 937023 - DNA, 25 bp, Mus musculus
ttcctgacactacttccatatttgc

SEQ ID NO: 937024 - DNA, 25 bp, Mus musculus
ttcctgacactagttccatatttgc

SEQ ID NO: 937025 - DNA, 25 bp, Mus musculus
ttcctgacagagatgagacctgccc

SEQ ID NO: 937026 - DNA, 25 bp, Mus musculus
ttcctgacagagttgagacctgccc

SEQ ID NO: 937027 - DNA, 25 bp, Mus musculus
ttcctgacaggcatctgactccaga

SEQ ID NO: 937028 - DNA, 25 bp, Mus musculus
ttcctgacaggcttctgactccaga

SEQ ID NO: 937029 - DNA, 25 bp, Mus musculus
ttcctgacattcactcgaatcctca

SEQ ID NO: 937030 - DNA, 25 bp, Mus musculus
ttcctgacattctctcgaatcctca

SEQ ID NO: 937031 - DNA, 25 bp, Mus musculus
ttcctgaccaaaaacacacagatgt

SEQ ID NO: 937032 - DNA, 25 bp, Mus musculus
ttcctgaccaaatacacacagatgt

SEQ ID NO: 937033 - DNA, 25 bp, Mus musculus
ttcctgaccaacaagctcctttgtg

SEQ ID NO: 937034 - DNA, 25 bp, Mus musculus
ttcctgaccaactagctcctttgtg

SEQ ID NO: 937035 - DNA, 25 bp, Mus musculus
ttcctgaccaatcttccaaatgctg

SEQ ID NO: 937036 - DNA, 25 bp, Mus musculus
ttcctgaccaatgttccaaatgctg

SEQ ID NO: 937037 - DNA, 25 bp, Mus musculus
ttcctgaccactccagctatgtgaa

SEQ ID NO: 937038 - DNA, 25 bp, Mus musculus
ttcctgaccactgcagctatgtgaa

SEQ ID NO: 937039 - DNA, 25 bp, Mus musculus
ttcctgacctatagttacaaactca

SEQ ID NO: 937040 - DNA, 25 bp, Mus musculus
ttcctgacctattgttacaaactca

SEQ ID NO: 937041 - DNA, 25 bp, Mus musculus
ttcctgactcaacccgtggtctctg

SEQ ID NO: 937042 - DNA, 25 bp, Mus musculus
ttcctgactcaagccgtggtctctg

SEQ ID NO: 937043 - DNA, 25 bp, Mus musculus
ttcctgactcaccacttactaaaat

SEQ ID NO: 937044 - DNA, 25 bp, Mus musculus
ttcctgactcacgacttactaaaat

SEQ ID NO: 937045 - DNA, 25 bp, Mus musculus
ttcctgactcagcatttccttctca

SEQ ID NO: 937046 - DNA, 25 bp, Mus musculus
ttcctgactcaggatttccttctca

SEQ ID NO: 937047 - DNA, 25 bp, Mus musculus
ttcctgactcggagtatggatctgt

SEQ ID NO: 937048 - DNA, 25 bp, Mus musculus
ttcctgactcggtgtatggatctgt

SEQ ID NO: 937049 - DNA, 25 bp, Mus musculus
ttcctgactctgcagttgctagtgc

SEQ ID NO: 937050 - DNA, 25 bp, Mus musculus
ttcctgactctggagttgctagtgc

SEQ ID NO: 937051 - DNA, 25 bp, Mus musculus
ttcctgactcttacctgcataaata

SEQ ID NO: 937052 - DNA, 25 bp, Mus musculus
ttcctgactctttcctgcataaata

SEQ ID NO: 937053 - DNA, 25 bp, Mus musculus
ttcctgactgacagaatgcagctgc

SEQ ID NO: 937054 - DNA, 25 bp, Mus musculus
ttcctgactgactgaatgcagctgc

SEQ ID NO: 937055 - DNA, 25 bp, Mus musculus
ttcctgactgccagagcgaggttgg

SEQ ID NO: 937056 - DNA, 25 bp, Mus musculus
ttcctgactgcctgagcgaggttgg

SEQ ID NO: 937057 - DNA, 25 bp, Mus musculus
ttcctgactgtcaagacctattctc

SEQ ID NO: 937058 - DNA, 25 bp, Mus musculus
ttcctgactgtctagacctattctc

SEQ ID NO: 937059 - DNA, 25 bp, Mus musculus
ttcctgactgttctcctgttggtac

SEQ ID NO: 937060 - DNA, 25 bp, Mus musculus
ttcctgactgttgtcctgttggtac

SEQ ID NO: 937061 - DNA, 25 bp, Mus musculus
ttcctgacttccctatgcatgcctt

SEQ ID NO: 937062 - DNA, 25 bp, Mus musculus
ttcctgacttccgtatgcatgcctt

SEQ ID NO: 937063 - DNA, 25 bp, Mus musculus
ttcctgagacgtcgagagtaccctg

SEQ ID NO: 937064 - DNA, 25 bp, Mus musculus
ttcctgagacgtggagagtaccctg

SEQ ID NO: 937065 - DNA, 25 bp, Mus musculus
ttcctgagactcagctgagctgcac

SEQ ID NO: 937066 - DNA, 25 bp, Mus musculus
ttcctgagactctgctgagctgcac

SEQ ID NO: 937067 - DNA, 25 bp, Mus musculus
ttcctgagaggaacttgggctttcc

SEQ ID NO: 937068 - DNA, 25 bp, Mus musculus
ttcctgagaggatcttgggctttcc

SEQ ID NO: 937069 - DNA, 25 bp, Mus musculus
ttcctgagaggccatcagatgatcg

SEQ ID NO: 937070 - DNA, 25 bp, Mus musculus
ttcctgagaggcgatcagatgatcg

SEQ ID NO: 937071 - DNA, 25 bp, Mus musculus
ttcctgagatatacctgggatagct

SEQ ID NO: 937072 - DNA, 25 bp, Mus musculus
ttcctgagatattcctgggatagct

SEQ ID NO: 937073 - DNA, 25 bp, Mus musculus
ttcctgagattgctactgctcttgt

SEQ ID NO: 937074 - DNA, 25 bp, Mus musculus
ttcctgagattggtactgctcttgt

SEQ ID NO: 937075 - DNA, 25 bp, Mus musculus
ttcctgagcaggatgtctggatctc

SEQ ID NO: 937076 - DNA, 25 bp, Mus musculus
ttcctgagcaggttgtctggatctc

SEQ ID NO: 937077 - DNA, 25 bp, Mus musculus
ttcctgagccgtcttgtacataatc

SEQ ID NO: 937078 - DNA, 25 bp, Mus musculus
ttcctgagccgtgttgtacataatc

SEQ ID NO: 937079 - DNA, 25 bp, Mus musculus
ttcctgagcctgaacccgcaggagc

SEQ ID NO: 937080 - DNA, 25 bp, Mus musculus
ttcctgagcctgtacccgcaggagc

SEQ ID NO: 937081 - DNA, 25 bp, Mus musculus
ttcctgagctgcctctggaagcttg

SEQ ID NO: 937082 - DNA, 25 bp, Mus musculus
ttcctgagctgcgtctggaagcttg

SEQ ID NO: 937083 - DNA, 25 bp, Mus musculus
ttcctgagcttgagagatatttaaa

SEQ ID NO: 937084 - DNA, 25 bp, Mus musculus
ttcctgagcttgtgagatatttaaa

SEQ ID NO: 937085 - DNA, 25 bp, Mus musculus
ttcctgaggaccattataatgacag

SEQ ID NO: 937086 - DNA, 25 bp, Mus musculus
ttcctgaggacctttataatgacag

SEQ ID NO: 937087 - DNA, 25 bp, Mus musculus
ttcctgaggcccagggttcagtgct

SEQ ID NO: 937088 - DNA, 25 bp, Mus musculus
ttcctgaggccctgggttcagtgct

SEQ ID NO: 937089 - DNA, 25 bp, Mus musculus
ttcctgaggctcatgctagactatg

SEQ ID NO: 937090 - DNA, 25 bp, Mus musculus
ttcctgaggctcttgctagactatg

SEQ ID NO: 937091 - DNA, 25 bp, Mus musculus
ttcctgagggcaagagaaatccaca

SEQ ID NO: 937092 - DNA, 25 bp, Mus musculus
ttcctgagggcatgagaaatccaca

SEQ ID NO: 937093 - DNA, 25 bp, Mus musculus
ttcctgagggctagaacttttccaa

SEQ ID NO: 937094 - DNA, 25 bp, Mus musculus
ttcctgagggcttgaacttttccaa

SEQ ID NO: 937095 - DNA, 25 bp, Mus musculus
ttcctgaggtctcacacatcaccag

SEQ ID NO: 937096 - DNA, 25 bp, Mus musculus
ttcctgaggtctgacacatcaccag

SEQ ID NO: 937097 - DNA, 25 bp, Mus musculus
ttcctgaggtgcaattgacaaaaaa

SEQ ID NO: 937098 - DNA, 25 bp, Mus musculus
ttcctgaggtgctattgacaaaaaa

SEQ ID NO: 937099 - DNA, 25 bp, Mus musculus
ttcctgagtgtcacatgtagccact

SEQ ID NO: 937100 - DNA, 25 bp, Mus musculus
ttcctgagtgtctcatgtagccact

SEQ ID NO: 937101 - DNA, 25 bp, Mus musculus
ttcctgagttccctctgtatttata

SEQ ID NO: 937102 - DNA, 25 bp, Mus musculus
ttcctgagttccgtctgtatttata

SEQ ID NO: 937103 - DNA, 25 bp, Mus musculus
ttcctgagttttcccaaggatgttc

SEQ ID NO: 937104 - DNA, 25 bp, Mus musculus
ttcctgagttttgccaaggatgttc

SEQ ID NO: 937105 - DNA, 25 bp, Mus musculus
ttcctgatattaaaccaactcctcg

SEQ ID NO: 937106 - DNA, 25 bp, Mus musculus
ttcctgatattataccaactcctcg

SEQ ID NO: 937107 - DNA, 25 bp, Mus musculus
ttcctgatcaacatcattgaagagt

SEQ ID NO: 937108 - DNA, 25 bp, Mus musculus
ttcctgatcaacttcattgaagagt

SEQ ID NO: 937109 - DNA, 25 bp, Mus musculus
ttcctgatcatgaggcggaggccag

SEQ ID NO: 937110 - DNA, 25 bp, Mus musculus
ttcctgatcatgtggcggaggccag

SEQ ID NO: 937111 - DNA, 25 bp, Mus musculus
ttcctgatccgtacttggcttctta

SEQ ID NO: 937112 - DNA, 25 bp, Mus musculus
ttcctgatccgttcttggcttctta

SEQ ID NO: 937113 - DNA, 25 bp, Mus musculus
ttcctgatcgttatcgccaacagaa

SEQ ID NO: 937114 - DNA, 25 bp, Mus musculus
ttcctgatcgttttcgccaacagaa

SEQ ID NO: 937115 - DNA, 25 bp, Mus musculus
ttcctgatctctacttttagtccat

SEQ ID NO: 937116 - DNA, 25 bp, Mus musculus
ttcctgatctcttcttttagtccat

SEQ ID NO: 937117 - DNA, 25 bp, Mus musculus
ttcctgatgatacacttgggttcca

SEQ ID NO: 937118 - DNA, 25 bp, Mus musculus
ttcctgatgatagacttgggttcca

SEQ ID NO: 937119 - DNA, 25 bp, Mus musculus
ttcctgatgctcatttctctcctgt

SEQ ID NO: 937120 - DNA, 25 bp, Mus musculus
ttcctgatgctcttttctctcctgt

SEQ ID NO: 937121 - DNA, 25 bp, Mus musculus
ttcctgatggctcatccacctggag

SEQ ID NO: 937122 - DNA, 25 bp, Mus musculus
ttcctgatggctgatccacctggag

SEQ ID NO: 937123 - DNA, 25 bp, Mus musculus
ttcctgatgtgactggacgtggagt

SEQ ID NO: 937124 - DNA, 25 bp, Mus musculus
ttcctgatgtgagtggacgtggagt

SEQ ID NO: 937125 - DNA, 25 bp, Mus musculus
ttcctgattataatgcacttgtaca

SEQ ID NO: 937126 - DNA, 25 bp, Mus musculus
ttcctgattatattgcacttgtaca

SEQ ID NO: 937127 - DNA, 25 bp, Mus musculus
ttcctgattcagagcccctttatta

SEQ ID NO: 937128 - DNA, 25 bp, Mus musculus
ttcctgattcagtgcccctttatta

SEQ ID NO: 937129 - DNA, 25 bp, Mus musculus
ttcctgattccgaagcgccagcgag

SEQ ID NO: 937130 - DNA, 25 bp, Mus musculus
ttcctgattccgtagcgccagcgag

SEQ ID NO: 937131 - DNA, 25 bp, Mus musculus
ttcctgattctcatgactgtagcag

SEQ ID NO: 937132 - DNA, 25 bp, Mus musculus
ttcctgattctcattcgggactcaa

SEQ ID NO: 937133 - DNA, 25 bp, Mus musculus
ttcctgattctcttgactgtagcag

SEQ ID NO: 937134 - DNA, 25 bp, Mus musculus
ttcctgattctctttcgggactcaa

SEQ ID NO: 937135 - DNA, 25 bp, Mus musculus
ttcctgatttctactgttcctgttt

SEQ ID NO: 937136 - DNA, 25 bp, Mus musculus
ttcctgatttcttctgttcctgttt

SEQ ID NO: 937137 - DNA, 25 bp, Mus musculus
ttcctgatttttcctctggagtcct

SEQ ID NO: 937138 - DNA, 25 bp, Mus musculus
ttcctgatttttgctctggagtcct

SEQ ID NO: 937139 - DNA, 25 bp, Mus musculus
ttcctgcaagaaaggcgatggtatg

SEQ ID NO: 937140 - DNA, 25 bp, Mus musculus
ttcctgcaagaatggcgatggtatg

SEQ ID NO: 937141 - DNA, 25 bp, Mus musculus
ttcctgcacaggaaatcctcatggg

SEQ ID NO: 937142 - DNA, 25 bp, Mus musculus
ttcctgcacaggatcctaattccta

SEQ ID NO: 937143 - DNA, 25 bp, Mus musculus
ttcctgcacaggtaatcctcatggg

SEQ ID NO: 937144 - DNA, 25 bp, Mus musculus
ttcctgcacaggttcctaattccta

SEQ ID NO: 937145 - DNA, 25 bp, Mus musculus
ttcctgcacgttactggagaggcaa

SEQ ID NO: 937146 - DNA, 25 bp, Mus musculus
ttcctgcacgtttctggagaggcaa

SEQ ID NO: 937147 - DNA, 25 bp, Mus musculus
ttcctgcactgcctggtctttctgg

SEQ ID NO: 937148 - DNA, 25 bp, Mus musculus
ttcctgcactgcgtggtctttctgg

SEQ ID NO: 937149 - DNA, 25 bp, Mus musculus
ttcctgcactgtaatcttcttgtgg

SEQ ID NO: 937150 - DNA, 25 bp, Mus musculus
ttcctgcactgttatcttcttgtgg

SEQ ID NO: 937151 - DNA, 25 bp, Mus musculus
ttcctgcactttcaggctagttagt

SEQ ID NO: 937152 - DNA, 25 bp, Mus musculus
ttcctgcactttgaggctagttagt

SEQ ID NO: 937153 - DNA, 25 bp, Mus musculus
ttcctgcatcccagtgcggcgcttg

SEQ ID NO: 937154 - DNA, 25 bp, Mus musculus
ttcctgcatccctgtgcggcgcttg

SEQ ID NO: 937155 - DNA, 25 bp, Mus musculus
ttcctgcatctcatctttgggacac

SEQ ID NO: 937156 - DNA, 25 bp, Mus musculus
ttcctgcatctcttctttgggacac

SEQ ID NO: 937157 - DNA, 25 bp, Mus musculus
ttcctgcatgaaatgttacccttct

SEQ ID NO: 937158 - DNA, 25 bp, Mus musculus
ttcctgcatgaattgttacccttct

SEQ ID NO: 937159 - DNA, 25 bp, Mus musculus
ttcctgcatggcataaggtaaatgg

SEQ ID NO: 937160 - DNA, 25 bp, Mus musculus
ttcctgcatggcttaaggtaaatgg

SEQ ID NO: 937161 - DNA, 25 bp, Mus musculus
ttcctgcattctatttctcatatcc

SEQ ID NO: 937162 - DNA, 25 bp, Mus musculus
ttcctgcattctttttctcatatcc

SEQ ID NO: 937163 - DNA, 25 bp, Mus musculus
ttcctgcattgtcaggtttacctgt

SEQ ID NO: 937164 - DNA, 25 bp, Mus musculus
ttcctgcattgtgaggtttacctgt

SEQ ID NO: 937165 - DNA, 25 bp, Mus musculus
ttcctgcatttactgtgtggattcc

SEQ ID NO: 937166 - DNA, 25 bp, Mus musculus
ttcctgcatttagtgtgtggattcc

SEQ ID NO: 937167 - DNA, 25 bp, Mus musculus
ttcctgcatttgaagtgtgggcttg

SEQ ID NO: 937168 - DNA, 25 bp, Mus musculus
ttcctgcatttgtagtgtgggcttg

SEQ ID NO: 937169 - DNA, 25 bp, Mus musculus
ttcctgccacacagatctctctgga

SEQ ID NO: 937170 - DNA, 25 bp, Mus musculus
ttcctgccacactgatctctctgga

SEQ ID NO: 937171 - DNA, 25 bp, Mus musculus
ttcctgccactaataatttgatcat

SEQ ID NO: 937172 - DNA, 25 bp, Mus musculus
ttcctgccactattaatttgatcat

SEQ ID NO: 937173 - DNA, 25 bp, Mus musculus
ttcctgccactgaagttcctgtaga

SEQ ID NO: 937174 - DNA, 25 bp, Mus musculus
ttcctgccactgtagttcctgtaga

SEQ ID NO: 937175 - DNA, 25 bp, Mus musculus
ttcctgccagaacctttgatcgatg

SEQ ID NO: 937176 - DNA, 25 bp, Mus musculus
ttcctgccagaagctttgatcgatg

SEQ ID NO: 937177 - DNA, 25 bp, Mus musculus
ttcctgccaggaccgggactaatgc

SEQ ID NO: 937178 - DNA, 25 bp, Mus musculus
ttcctgccaggagcgggactaatgc

SEQ ID NO: 937179 - DNA, 25 bp, Mus musculus
ttcctgccagtaattttcccagaaa

SEQ ID NO: 937180 - DNA, 25 bp, Mus musculus
ttcctgccagtatttttcccagaaa

SEQ ID NO: 937181 - DNA, 25 bp, Mus musculus
ttcctgccatgactttctttcatga

SEQ ID NO: 937182 - DNA, 25 bp, Mus musculus
ttcctgccatgagtttctttcatga

SEQ ID NO: 937183 - DNA, 25 bp, Mus musculus
ttcctgccatggcttagactagcct

SEQ ID NO: 937184 - DNA, 25 bp, Mus musculus
ttcctgccatgggttagactagcct

SEQ ID NO: 937185 - DNA, 25 bp, Mus musculus
ttcctgcccaaacgactcgggttgt

SEQ ID NO: 937186 - DNA, 25 bp, Mus musculus
ttcctgcccaaaggactcgggttgt

SEQ ID NO: 937187 - DNA, 25 bp, Mus musculus
ttcctgcccagacgtccctggatga

SEQ ID NO: 937188 - DNA, 25 bp, Mus musculus
ttcctgcccagaggtccctggatga

SEQ ID NO: 937189 - DNA, 25 bp, Mus musculus
ttcctgcccattataaagacctcct

SEQ ID NO: 937190 - DNA, 25 bp, Mus musculus
ttcctgcccattttaaagacctcct

SEQ ID NO: 937191 - DNA, 25 bp, Mus musculus
ttcctgccccaaccggataagtgca

SEQ ID NO: 937192 - DNA, 25 bp, Mus musculus
ttcctgccccaagcggataagtgca

SEQ ID NO: 937193 - DNA, 25 bp, Mus musculus
ttcctgcccctaagaaacttcgttg

SEQ ID NO: 937194 - DNA, 25 bp, Mus musculus
ttcctgcccctaatgaatgtgtggt

SEQ ID NO: 937195 - DNA, 25 bp, Mus musculus
ttcctgcccctatgaaacttcgttg

SEQ ID NO: 937196 - DNA, 25 bp, Mus musculus
ttcctgcccctattgaatgtgtggt

SEQ ID NO: 937197 - DNA, 25 bp, Mus musculus
ttcctgcccggactgtgaactcatc

SEQ ID NO: 937198 - DNA, 25 bp, Mus musculus
ttcctgcccggagtgtgaactcatc

SEQ ID NO: 937199 - DNA, 25 bp, Mus musculus
ttcctgccctcaaggtatgtggaga

SEQ ID NO: 937200 - DNA, 25 bp, Mus musculus
ttcctgccctcatggtatgtggaga

SEQ ID NO: 937201 - DNA, 25 bp, Mus musculus
ttcctgccctccacagatgatttct

SEQ ID NO: 937202 - DNA, 25 bp, Mus musculus
ttcctgccctcctcagatgatttct

SEQ ID NO: 937203 - DNA, 25 bp, Mus musculus
ttcctgccctcgaataaaagtctgt

SEQ ID NO: 937204 - DNA, 25 bp, Mus musculus
ttcctgccctcgtataaaagtctgt

SEQ ID NO: 937205 - DNA, 25 bp, Mus musculus
ttcctgcccttcagcatagggtagc

SEQ ID NO: 937206 - DNA, 25 bp, Mus musculus
ttcctgcccttctgcatagggtagc

SEQ ID NO: 937207 - DNA, 25 bp, Mus musculus
ttcctgccctttagcattagggtta

SEQ ID NO: 937208 - DNA, 25 bp, Mus musculus
ttcctgcccttttgcattagggtta

SEQ ID NO: 937209 - DNA, 25 bp, Mus musculus
ttcctgccgctgaatactgtatttt

SEQ ID NO: 937210 - DNA, 25 bp, Mus musculus
ttcctgccgctgtatactgtatttt

SEQ ID NO: 937211 - DNA, 25 bp, Mus musculus
ttcctgccggcaaggatggctctga

SEQ ID NO: 937212 - DNA, 25 bp, Mus musculus
ttcctgccggcatggatggctctga

SEQ ID NO: 937213 - DNA, 25 bp, Mus musculus
ttcctgcctacgagaggctcaactg

SEQ ID NO: 937214 - DNA, 25 bp, Mus musculus
ttcctgcctacgtgaggctcaactg

SEQ ID NO: 937215 - DNA, 25 bp, Mus musculus
ttcctgcctatcatgtgaccaagca

SEQ ID NO: 937216 - DNA, 25 bp, Mus musculus
ttcctgcctatcttgtgaccaagca

SEQ ID NO: 937217 - DNA, 25 bp, Mus musculus
ttcctgcctgagagggctgccagct

SEQ ID NO: 937218 - DNA, 25 bp, Mus musculus
ttcctgcctgagtgggctgccagct

SEQ ID NO: 937219 - DNA, 25 bp, Mus musculus
ttcctgcctgctactaattcagggt

SEQ ID NO: 937220 - DNA, 25 bp, Mus musculus
ttcctgcctgctcaacagtgaacaa

SEQ ID NO: 937221 - DNA, 25 bp, Mus musculus
ttcctgcctgctgaacagtgaacaa

SEQ ID NO: 937222 - DNA, 25 bp, Mus musculus
ttcctgcctgcttctaattcagggt

SEQ ID NO: 937223 - DNA, 25 bp, Mus musculus
ttcctgcctgtcactgaccttttat

SEQ ID NO: 937224 - DNA, 25 bp, Mus musculus
ttcctgcctgtctctgaccttttat

SEQ ID NO: 937225 - DNA, 25 bp, Mus musculus
ttcctgccttccctcaatctggaag

SEQ ID NO: 937226 - DNA, 25 bp, Mus musculus
ttcctgccttccgtcaatctggaag

SEQ ID NO: 937227 - DNA, 25 bp, Mus musculus
ttcctgccttctaactgcagatagg

SEQ ID NO: 937228 - DNA, 25 bp, Mus musculus
ttcctgccttctctggaacacaagg

SEQ ID NO: 937229 - DNA, 25 bp, Mus musculus
ttcctgccttctgtggaacacaagg

SEQ ID NO: 937230 - DNA, 25 bp, Mus musculus
ttcctgccttcttactgcagatagg

SEQ ID NO: 937231 - DNA, 25 bp, Mus musculus
ttcctgcgacggcagcagatgcatg

SEQ ID NO: 937232 - DNA, 25 bp, Mus musculus
ttcctgcgacgggagcagatgcatg

SEQ ID NO: 937233 - DNA, 25 bp, Mus musculus
ttcctgcgccgcactcagcaggtag

SEQ ID NO: 937234 - DNA, 25 bp, Mus musculus
ttcctgcgccgctctcagcaggtag

SEQ ID NO: 937235 - DNA, 25 bp, Mus musculus
ttcctgcggccaccgaaagtcaaga

SEQ ID NO: 937236 - DNA, 25 bp, Mus musculus
ttcctgcggccagcgaaagtcaaga

SEQ ID NO: 937237 - DNA, 25 bp, Mus musculus
ttcctgcgggagaagagttgaagcc

SEQ ID NO: 937238 - DNA, 25 bp, Mus musculus
ttcctgcgggagtagagttgaagcc

SEQ ID NO: 937239 - DNA, 25 bp, Mus musculus
ttcctgcggtgtaatttagccattc

SEQ ID NO: 937240 - DNA, 25 bp, Mus musculus
ttcctgcggtgttatttagccattc

SEQ ID NO: 937241 - DNA, 25 bp, Mus musculus
ttcctgcggttcaatctagattctg

SEQ ID NO: 937242 - DNA, 25 bp, Mus musculus
ttcctgcggttctatctagattctg

SEQ ID NO: 937243 - DNA, 25 bp, Mus musculus
ttcctgcggttgctggtaactgtga

SEQ ID NO: 937244 - DNA, 25 bp, Mus musculus
ttcctgcggttggtggtaactgtga

SEQ ID NO: 937245 - DNA, 25 bp, Mus musculus
ttcctgcgtgaaattgcttctgtca

SEQ ID NO: 937246 - DNA, 25 bp, Mus musculus
ttcctgcgtgaatttgcttctgtca

SEQ ID NO: 937247 - DNA, 25 bp, Mus musculus
ttcctgcgtgatcctgcacgaccag

SEQ ID NO: 937248 - DNA, 25 bp, Mus musculus
ttcctgcgtgatgctgcacgaccag

SEQ ID NO: 937249 - DNA, 25 bp, Mus musculus
ttcctgcgtggtcttcttttcttca

SEQ ID NO: 937250 - DNA, 25 bp, Mus musculus
ttcctgcgtggtgttcttttcttca

SEQ ID NO: 937251 - DNA, 25 bp, Mus musculus
ttcctgctaaaaacttatggcccta

SEQ ID NO: 937252 - DNA, 25 bp, Mus musculus
ttcctgctaaaatcttatggcccta

SEQ ID NO: 937253 - DNA, 25 bp, Mus musculus
ttcctgctaacacccgttgttttgt

SEQ ID NO: 937254 - DNA, 25 bp, Mus musculus
ttcctgctaacagccgttgttttgt

SEQ ID NO: 937255 - DNA, 25 bp, Mus musculus
ttcctgctaataataactctttgtg

SEQ ID NO: 937256 - DNA, 25 bp, Mus musculus
ttcctgctaatattaactctttgtg

SEQ ID NO: 937257 - DNA, 25 bp, Mus musculus
ttcctgctagcgacatcacaaaggg

SEQ ID NO: 937258 - DNA, 25 bp, Mus musculus
ttcctgctagcgtcatcacaaaggg

SEQ ID NO: 937259 - DNA, 25 bp, Mus musculus
ttcctgctatgtagtgcattccaca

SEQ ID NO: 937260 - DNA, 25 bp, Mus musculus
ttcctgctatgttgtgcattccaca

SEQ ID NO: 937261 - DNA, 25 bp, Mus musculus
ttcctgctcacgagaccaaagtggg

SEQ ID NO: 937262 - DNA, 25 bp, Mus musculus
ttcctgctcacgtgaccaaagtggg

SEQ ID NO: 937263 - DNA, 25 bp, Mus musculus
ttcctgctcctaactaacttcaatt

SEQ ID NO: 937264 - DNA, 25 bp, Mus musculus
ttcctgctcctatctaacttcaatt

SEQ ID NO: 937265 - DNA, 25 bp, Mus musculus
ttcctgctctccactaggaattcac

SEQ ID NO: 937266 - DNA, 25 bp, Mus musculus
ttcctgctctccattggtgtccatt

SEQ ID NO: 937267 - DNA, 25 bp, Mus musculus
ttcctgctctcctctaggaattcac

SEQ ID NO: 937268 - DNA, 25 bp, Mus musculus
ttcctgctctcctttggtgtccatt

SEQ ID NO: 937269 - DNA, 25 bp, Mus musculus
ttcctgctcttaagcaaaggatgca

SEQ ID NO: 937270 - DNA, 25 bp, Mus musculus
ttcctgctcttaagcccatgacaag

SEQ ID NO: 937271 - DNA, 25 bp, Mus musculus
ttcctgctcttatgcaaaggatgca

SEQ ID NO: 937272 - DNA, 25 bp, Mus musculus
ttcctgctcttatgcccatgacaag

SEQ ID NO: 937273 - DNA, 25 bp, Mus musculus
ttcctgctctttcttgtccagttcg

SEQ ID NO: 937274 - DNA, 25 bp, Mus musculus
ttcctgctctttgttgtccagttcg

SEQ ID NO: 937275 - DNA, 25 bp, Mus musculus
ttcctgctgacacacgatggagctg

SEQ ID NO: 937276 - DNA, 25 bp, Mus musculus
ttcctgctgacagacgatggagctg

SEQ ID NO: 937277 - DNA, 25 bp, Mus musculus
ttcctgctgactcctttctgagaac

SEQ ID NO: 937278 - DNA, 25 bp, Mus musculus
ttcctgctgactcgatcctattgta

SEQ ID NO: 937279 - DNA, 25 bp, Mus musculus
ttcctgctgactgctttctgagaac

SEQ ID NO: 937280 - DNA, 25 bp, Mus musculus
ttcctgctgactggatcctattgta

SEQ ID NO: 937281 - DNA, 25 bp, Mus musculus
ttcctgctgaggatagcgggagaat

SEQ ID NO: 937282 - DNA, 25 bp, Mus musculus
ttcctgctgaggttagcgggagaat

SEQ ID NO: 937283 - DNA, 25 bp, Mus musculus
ttcctgctgcatctgggcaatcagc

SEQ ID NO: 937284 - DNA, 25 bp, Mus musculus
ttcctgctgcatgtgggcaatcagc

SEQ ID NO: 937285 - DNA, 25 bp, Mus musculus
ttcctgctgcctctgtagattgtct

SEQ ID NO: 937286 - DNA, 25 bp, Mus musculus
ttcctgctgcctgtgtagattgtct

SEQ ID NO: 937287 - DNA, 25 bp, Mus musculus
ttcctgctgcttaggcaacaataaa

SEQ ID NO: 937288 - DNA, 25 bp, Mus musculus
ttcctgctgctttggcaacaataaa

SEQ ID NO: 937289 - DNA, 25 bp, Mus musculus
ttcctgctggacctatctagggttt

SEQ ID NO: 937290 - DNA, 25 bp, Mus musculus
ttcctgctggacgtatctagggttt

SEQ ID NO: 937291 - DNA, 25 bp, Mus musculus
ttcctgctggatcctgatgctgtgg

SEQ ID NO: 937292 - DNA, 25 bp, Mus musculus
ttcctgctggatgctgatgctgtgg

SEQ ID NO: 937293 - DNA, 25 bp, Mus musculus
ttcctgctgggtaaagtcttgctta

SEQ ID NO: 937294 - DNA, 25 bp, Mus musculus
ttcctgctgggttaagtcttgctta

SEQ ID NO: 937295 - DNA, 25 bp, Mus musculus
ttcctgctgtcacgacagctgctga

SEQ ID NO: 937296 - DNA, 25 bp, Mus musculus
ttcctgctgtcaggacagctgctga

SEQ ID NO: 937297 - DNA, 25 bp, Mus musculus
ttcctgctgtgcaacaaactctggg

SEQ ID NO: 937298 - DNA, 25 bp, Mus musculus
ttcctgctgtgcaacaagctctggg

SEQ ID NO: 937299 - DNA, 25 bp, Mus musculus
ttcctgctgtgcctggtagtagatt

SEQ ID NO: 937300 - DNA, 25 bp, Mus musculus
ttcctgctgtgcgtggtagtagatt

SEQ ID NO: 937301 - DNA, 25 bp, Mus musculus
ttcctgctgtgctacaaactctggg

SEQ ID NO: 937302 - DNA, 25 bp, Mus musculus
ttcctgctgtgctacaagctctggg

SEQ ID NO: 937303 - DNA, 25 bp, Mus musculus
ttcctgctgtggctcagttatccgg

SEQ ID NO: 937304 - DNA, 25 bp, Mus musculus
ttcctgctgtgggtcagttatccgg

SEQ ID NO: 937305 - DNA, 25 bp, Mus musculus
ttcctgcttcttctcaaaggagcgt

SEQ ID NO: 937306 - DNA, 25 bp, Mus musculus
ttcctgcttcttgtcaaaggagcgt

SEQ ID NO: 937307 - DNA, 25 bp, Mus musculus
ttcctgcttgcaccatgtgtgctaa

SEQ ID NO: 937308 - DNA, 25 bp, Mus musculus
ttcctgcttgcagcatgtgtgctaa

SEQ ID NO: 937309 - DNA, 25 bp, Mus musculus
ttcctgcttgtgactcttgtaaata

SEQ ID NO: 937310 - DNA, 25 bp, Mus musculus
ttcctgcttgtgctttgagatctca

SEQ ID NO: 937311 - DNA, 25 bp, Mus musculus
ttcctgcttgtggtttgagatctca

SEQ ID NO: 937312 - DNA, 25 bp, Mus musculus
ttcctgcttgtgtctcttgtaaata

SEQ ID NO: 937313 - DNA, 25 bp, Mus musculus
ttcctgcttttgattctattgttgt

SEQ ID NO: 937314 - DNA, 25 bp, Mus musculus
ttcctgcttttgtttctattgttgt

SEQ ID NO: 937315 - DNA, 25 bp, Mus musculus
ttcctggaaagcatccctttatgtt

SEQ ID NO: 937316 - DNA, 25 bp, Mus musculus
ttcctggaaagccactatctggata

SEQ ID NO: 937317 - DNA, 25 bp, Mus musculus
ttcctggaaagcgactatctggata

SEQ ID NO: 937318 - DNA, 25 bp, Mus musculus
ttcctggaaagcttccctttatgtt

SEQ ID NO: 937319 - DNA, 25 bp, Mus musculus
ttcctggaaagtcgagctgggcatc

SEQ ID NO: 937320 - DNA, 25 bp, Mus musculus
ttcctggaaagtggagctgggcatc

SEQ ID NO: 937321 - DNA, 25 bp, Mus musculus
ttcctggaaccaacatagatttcta

SEQ ID NO: 937322 - DNA, 25 bp, Mus musculus
ttcctggaaccatcatagatttcta

SEQ ID NO: 937323 - DNA, 25 bp, Mus musculus
ttcctggaagccaggtataatcaag

SEQ ID NO: 937324 - DNA, 25 bp, Mus musculus
ttcctggaagcctggtataatcaag

SEQ ID NO: 937325 - DNA, 25 bp, Mus musculus
ttcctggaagctacacaccctaaga

SEQ ID NO: 937326 - DNA, 25 bp, Mus musculus
ttcctggaagcttcacaccctaaga

SEQ ID NO: 937327 - DNA, 25 bp, Mus musculus
ttcctggacaccatacctttctaag

SEQ ID NO: 937328 - DNA, 25 bp, Mus musculus
ttcctggacaccttacctttctaag

SEQ ID NO: 937329 - DNA, 25 bp, Mus musculus
ttcctggacactagcactgggcagt

SEQ ID NO: 937330 - DNA, 25 bp, Mus musculus
ttcctggacacttgcactgggcagt

SEQ ID NO: 937331 - DNA, 25 bp, Mus musculus
ttcctggacatgacctcagacagag

SEQ ID NO: 937332 - DNA, 25 bp, Mus musculus
ttcctggacatgtcctcagacagag

SEQ ID NO: 937333 - DNA, 25 bp, Mus musculus
ttcctggaccatatgctcacgctag

SEQ ID NO: 937334 - DNA, 25 bp, Mus musculus
ttcctggaccatttgctcacgctag

SEQ ID NO: 937335 - DNA, 25 bp, Mus musculus
ttcctggaccctacactcgtgaatc

SEQ ID NO: 937336 - DNA, 25 bp, Mus musculus
ttcctggacccttcactcgtgaatc

SEQ ID NO: 937337 - DNA, 25 bp, Mus musculus
ttcctggactgcagacctgaaggcc

SEQ ID NO: 937338 - DNA, 25 bp, Mus musculus
ttcctggactgctgacctgaaggcc

SEQ ID NO: 937339 - DNA, 25 bp, Mus musculus
ttcctggactttcacgaccttaaat

SEQ ID NO: 937340 - DNA, 25 bp, Mus musculus
ttcctggactttgacgaccttaaat

SEQ ID NO: 937341 - DNA, 25 bp, Mus musculus
ttcctggaggacaagctactctggc

SEQ ID NO: 937342 - DNA, 25 bp, Mus musculus
ttcctggaggactagctactctggc

SEQ ID NO: 937343 - DNA, 25 bp, Mus musculus
ttcctggagggtatcgatccattca

SEQ ID NO: 937344 - DNA, 25 bp, Mus musculus
ttcctggagggtttcgatccattca

SEQ ID NO: 937345 - DNA, 25 bp, Mus musculus
ttcctggagtttcaattccgacctg

SEQ ID NO: 937346 - DNA, 25 bp, Mus musculus
ttcctggagtttgaattccgacctg

SEQ ID NO: 937347 - DNA, 25 bp, Mus musculus
ttcctggatcaaccacggcacggag

SEQ ID NO: 937348 - DNA, 25 bp, Mus musculus
ttcctggatcaagcacggcacggag

SEQ ID NO: 937349 - DNA, 25 bp, Mus musculus
ttcctggattctctttgacaagaaa

SEQ ID NO: 937350 - DNA, 25 bp, Mus musculus
ttcctggattctgtttgacaagaaa

SEQ ID NO: 937351 - DNA, 25 bp, Mus musculus
ttcctggcacttcgtgtttctatgt

SEQ ID NO: 937352 - DNA, 25 bp, Mus musculus
ttcctggcacttggtgtttctatgt

SEQ ID NO: 937353 - DNA, 25 bp, Mus musculus
ttcctggcagatactcttcagagta

SEQ ID NO: 937354 - DNA, 25 bp, Mus musculus
ttcctggcagatcactcactgttgg

SEQ ID NO: 937355 - DNA, 25 bp, Mus musculus
ttcctggcagatgactcactgttgg

SEQ ID NO: 937356 - DNA, 25 bp, Mus musculus
ttcctggcagattctcttcagagta

SEQ ID NO: 937357 - DNA, 25 bp, Mus musculus
ttcctggcagctatttagctttccc

SEQ ID NO: 937358 - DNA, 25 bp, Mus musculus
ttcctggcagctttttagctttccc

SEQ ID NO: 937359 - DNA, 25 bp, Mus musculus
ttcctggcaggcacagtggacaccc

SEQ ID NO: 937360 - DNA, 25 bp, Mus musculus
ttcctggcaggctcagtggacaccc

SEQ ID NO: 937361 - DNA, 25 bp, Mus musculus
ttcctggcaggtccaaggttctatt

SEQ ID NO: 937362 - DNA, 25 bp, Mus musculus
ttcctggcaggtgcaaggttctatt

SEQ ID NO: 937363 - DNA, 25 bp, Mus musculus
ttcctggcagtgcaaatgccttcta

SEQ ID NO: 937364 - DNA, 25 bp, Mus musculus
ttcctggcagtggaaatgccttcta

SEQ ID NO: 937365 - DNA, 25 bp, Mus musculus
ttcctggcattcctgaggccctgga

SEQ ID NO: 937366 - DNA, 25 bp, Mus musculus
ttcctggcattcgtgaggccctgga

SEQ ID NO: 937367 - DNA, 25 bp, Mus musculus
ttcctggccaaccagtggcaagtct

SEQ ID NO: 937368 - DNA, 25 bp, Mus musculus
ttcctggccaacgagtggcaagtct

SEQ ID NO: 937369 - DNA, 25 bp, Mus musculus
ttcctggccaatccaagcacaaaag

SEQ ID NO: 937370 - DNA, 25 bp, Mus musculus
ttcctggccaatgcaagcacaaaag

SEQ ID NO: 937371 - DNA, 25 bp, Mus musculus
ttcctggccagtaggagtgctgctg

SEQ ID NO: 937372 - DNA, 25 bp, Mus musculus
ttcctggccagttggagtgctgctg

SEQ ID NO: 937373 - DNA, 25 bp, Mus musculus
ttcctggcccagaggtcattggtag

SEQ ID NO: 937374 - DNA, 25 bp, Mus musculus
ttcctggcccagtggtcattggtag

SEQ ID NO: 937375 - DNA, 25 bp, Mus musculus
ttcctggccccgagggtgctcaggc

SEQ ID NO: 937376 - DNA, 25 bp, Mus musculus
ttcctggccccgtgggtgctcaggc

SEQ ID NO: 937377 - DNA, 25 bp, Mus musculus
ttcctggccgagctggttactcaaa

SEQ ID NO: 937378 - DNA, 25 bp, Mus musculus
ttcctggccgaggtggttactcaaa

SEQ ID NO: 937379 - DNA, 25 bp, Mus musculus
ttcctggccggaatctgaagagctg

SEQ ID NO: 937380 - DNA, 25 bp, Mus musculus
ttcctggccggattctgaagagctg

SEQ ID NO: 937381 - DNA, 25 bp, Mus musculus
ttcctggcctctctacaatggcaag

SEQ ID NO: 937382 - DNA, 25 bp, Mus musculus
ttcctggcctctgtacaatggcaag

SEQ ID NO: 937383 - DNA, 25 bp, Mus musculus
ttcctggcctgaccaagcagtcctg

SEQ ID NO: 937384 - DNA, 25 bp, Mus musculus
ttcctggcctgagcaagcagtcctg

SEQ ID NO: 937385 - DNA, 25 bp, Mus musculus
ttcctggcctggcacatgtggttat

SEQ ID NO: 937386 - DNA, 25 bp, Mus musculus
ttcctggcctgggacatgtggttat

SEQ ID NO: 937387 - DNA, 25 bp, Mus musculus
ttcctggccttcaaaagaccattgc

SEQ ID NO: 937388 - DNA, 25 bp, Mus musculus
ttcctggccttctaaagaccattgc

SEQ ID NO: 937389 - DNA, 25 bp, Mus musculus
ttcctggcggagcacaacagtctca

SEQ ID NO: 937390 - DNA, 25 bp, Mus musculus
ttcctggcggaggacaacagtctca

SEQ ID NO: 937391 - DNA, 25 bp, Mus musculus
ttcctggctagtattgcacacttga

SEQ ID NO: 937392 - DNA, 25 bp, Mus musculus
ttcctggctagttttgcacacttga

SEQ ID NO: 937393 - DNA, 25 bp, Mus musculus
ttcctggctggaagaagtagaccat

SEQ ID NO: 937394 - DNA, 25 bp, Mus musculus
ttcctggctggatgaagtagaccat

SEQ ID NO: 937395 - DNA, 25 bp, Mus musculus
ttcctggctggtagtggtgattgca

SEQ ID NO: 937396 - DNA, 25 bp, Mus musculus
ttcctggctggttgtggtgattgca

SEQ ID NO: 937397 - DNA, 25 bp, Mus musculus
ttcctggctgtcattacagacactt

SEQ ID NO: 937398 - DNA, 25 bp, Mus musculus
ttcctggctgtctttacagacactt

SEQ ID NO: 937399 - DNA, 25 bp, Mus musculus
ttcctggcttttcctccttcagttc

SEQ ID NO: 937400 - DNA, 25 bp, Mus musculus
ttcctggcttttgctccttcagttc

SEQ ID NO: 937401 - DNA, 25 bp, Mus musculus
ttcctgggaaccaccaagctctggg

SEQ ID NO: 937402 - DNA, 25 bp, Mus musculus
ttcctgggaacctccaagctctggg

SEQ ID NO: 937403 - DNA, 25 bp, Mus musculus
ttcctgggaagaactgacctggctc

SEQ ID NO: 937404 - DNA, 25 bp, Mus musculus
ttcctgggaagatctgacctggctc

SEQ ID NO: 937405 - DNA, 25 bp, Mus musculus
ttcctgggaagcacgaagaggctgt

SEQ ID NO: 937406 - DNA, 25 bp, Mus musculus
ttcctgggaagctcgaagaggctgt

SEQ ID NO: 937407 - DNA, 25 bp, Mus musculus
ttcctgggacctcaacagaaactcc

SEQ ID NO: 937408 - DNA, 25 bp, Mus musculus
ttcctgggacctgaacagaaactcc

SEQ ID NO: 937409 - DNA, 25 bp, Mus musculus
ttcctgggaggacgctcctcggaca

SEQ ID NO: 937410 - DNA, 25 bp, Mus musculus
ttcctgggaggaggctcctcggaca

SEQ ID NO: 937411 - DNA, 25 bp, Mus musculus
ttcctgggatacagtgcactgccat

SEQ ID NO: 937412 - DNA, 25 bp, Mus musculus
ttcctgggatactgtgcactgccat

SEQ ID NO: 937413 - DNA, 25 bp, Mus musculus
ttcctgggatggctggagctgtgtc

SEQ ID NO: 937414 - DNA, 25 bp, Mus musculus
ttcctgggatgggtggagctgtgtc

SEQ ID NO: 937415 - DNA, 25 bp, Mus musculus
ttcctgggcccacaatcatagaggg

SEQ ID NO: 937416 - DNA, 25 bp, Mus musculus
ttcctgggcccagaatcatagaggg

SEQ ID NO: 937417 - DNA, 25 bp, Mus musculus
ttcctgggccctcaagagaatgttc

SEQ ID NO: 937418 - DNA, 25 bp, Mus musculus
ttcctgggccctgaagagaatgttc

SEQ ID NO: 937419 - DNA, 25 bp, Mus musculus
ttcctgggcctgagtcaatggcaca

SEQ ID NO: 937420 - DNA, 25 bp, Mus musculus
ttcctgggcctgtgtcaatggcaca

SEQ ID NO: 937421 - DNA, 25 bp, Mus musculus
ttcctgggcgctaggcggatgccca

SEQ ID NO: 937422 - DNA, 25 bp, Mus musculus
ttcctgggcgcttggcggatgccca

SEQ ID NO: 937423 - DNA, 25 bp, Mus musculus
ttcctgggctctcttcagtcagagg

SEQ ID NO: 937424 - DNA, 25 bp, Mus musculus
ttcctgggctctgttcagtcagagg

SEQ ID NO: 937425 - DNA, 25 bp, Mus musculus
ttcctgggtaatcacattctgggta

SEQ ID NO: 937426 - DNA, 25 bp, Mus musculus
ttcctgggtaatgacattctgggta

SEQ ID NO: 937427 - DNA, 25 bp, Mus musculus
ttcctgggtcagaagctggcatgtg

SEQ ID NO: 937428 - DNA, 25 bp, Mus musculus
ttcctgggtcagtagctggcatgtg

SEQ ID NO: 937429 - DNA, 25 bp, Mus musculus
ttcctgggtgtccatcactacccac

SEQ ID NO: 937430 - DNA, 25 bp, Mus musculus
ttcctgggtgtcgatcactacccac

SEQ ID NO: 937431 - DNA, 25 bp, Mus musculus
ttcctgggttccaggtgaatcagta

SEQ ID NO: 937432 - DNA, 25 bp, Mus musculus
ttcctgggttcccatgaactcaggg

SEQ ID NO: 937433 - DNA, 25 bp, Mus musculus
ttcctgggttccgatgaactcaggg

SEQ ID NO: 937434 - DNA, 25 bp, Mus musculus
ttcctgggttcctggtgaatcagta

SEQ ID NO: 937435 - DNA, 25 bp, Mus musculus
ttcctggtaataattgttcctgtaa

SEQ ID NO: 937436 - DNA, 25 bp, Mus musculus
ttcctggtaatatttgttcctgtaa

SEQ ID NO: 937437 - DNA, 25 bp, Mus musculus
ttcctggtaattcccgatgctgttc

SEQ ID NO: 937438 - DNA, 25 bp, Mus musculus
ttcctggtaattgccgatgctgttc

SEQ ID NO: 937439 - DNA, 25 bp, Mus musculus
ttcctggtacaaaggtgtgcttagt

SEQ ID NO: 937440 - DNA, 25 bp, Mus musculus
ttcctggtacaatggtgtgcttagt

SEQ ID NO: 937441 - DNA, 25 bp, Mus musculus
ttcctggtacacctgacctagagga

SEQ ID NO: 937442 - DNA, 25 bp, Mus musculus
ttcctggtacacgtgacctagagga

SEQ ID NO: 937443 - DNA, 25 bp, Mus musculus
ttcctggtacagatcggtgtgaatg

SEQ ID NO: 937444 - DNA, 25 bp, Mus musculus
ttcctggtacagttcggtgtgaatg

SEQ ID NO: 937445 - DNA, 25 bp, Mus musculus
ttcctggtaggtagaagctagacat

SEQ ID NO: 937446 - DNA, 25 bp, Mus musculus
ttcctggtaggttgaagctagacat

SEQ ID NO: 937447 - DNA, 25 bp, Mus musculus
ttcctggtatatcgacttctgtatt

SEQ ID NO: 937448 - DNA, 25 bp, Mus musculus
ttcctggtatatggacttctgtatt

SEQ ID NO: 937449 - DNA, 25 bp, Mus musculus
ttcctggtatgtctcactcactata

SEQ ID NO: 937450 - DNA, 25 bp, Mus musculus
ttcctggtatgtgtcactcactata

SEQ ID NO: 937451 - DNA, 25 bp, Mus musculus
ttcctggtcaacaaaactactgtga

SEQ ID NO: 937452 - DNA, 25 bp, Mus musculus
ttcctggtcaactaaactactgtga

SEQ ID NO: 937453 - DNA, 25 bp, Mus musculus
ttcctggtccaaagcatgctctggc

SEQ ID NO: 937454 - DNA, 25 bp, Mus musculus
ttcctggtccaatgcatgctctggc

SEQ ID NO: 937455 - DNA, 25 bp, Mus musculus
ttcctggtcgttctacccagggcat

SEQ ID NO: 937456 - DNA, 25 bp, Mus musculus
ttcctggtcgttgtacccagggcat

SEQ ID NO: 937457 - DNA, 25 bp, Mus musculus
ttcctggtgatgattatgtttctct

SEQ ID NO: 937458 - DNA, 25 bp, Mus musculus
ttcctggtgatgtttatgtttctct

SEQ ID NO: 937459 - DNA, 25 bp, Mus musculus
ttcctggtgccactacaatccaatt

SEQ ID NO: 937460 - DNA, 25 bp, Mus musculus
ttcctggtgccagtacaatccaatt

SEQ ID NO: 937461 - DNA, 25 bp, Mus musculus
ttcctggtgcccctgatgatgaagc

SEQ ID NO: 937462 - DNA, 25 bp, Mus musculus
ttcctggtgcccgtgatgatgaagc

SEQ ID NO: 937463 - DNA, 25 bp, Mus musculus
ttcctggtgcgtctcccatgtcttt

SEQ ID NO: 937464 - DNA, 25 bp, Mus musculus
ttcctggtgcgtgtcccatgtcttt

SEQ ID NO: 937465 - DNA, 25 bp, Mus musculus
ttcctggtgctcaagggacccgtgt

SEQ ID NO: 937466 - DNA, 25 bp, Mus musculus
ttcctggtgctctagggacccgtgt

SEQ ID NO: 937467 - DNA, 25 bp, Mus musculus
ttcctggtgctgaacaagatgctat

SEQ ID NO: 937468 - DNA, 25 bp, Mus musculus
ttcctggtgctgtacaagatgctat

SEQ ID NO: 937469 - DNA, 25 bp, Mus musculus
ttcctggtgcttatccttaacatgg

SEQ ID NO: 937470 - DNA, 25 bp, Mus musculus
ttcctggtgcttttccttaacatgg

SEQ ID NO: 937471 - DNA, 25 bp, Mus musculus
ttcctggtggagacactcgggtgca

SEQ ID NO: 937472 - DNA, 25 bp, Mus musculus
ttcctggtggagtcactcgggtgca

SEQ ID NO: 937473 - DNA, 25 bp, Mus musculus
ttcctggtggcacaacctgtctgtg

SEQ ID NO: 937474 - DNA, 25 bp, Mus musculus
ttcctggtggcagaacctgtctgtg

SEQ ID NO: 937475 - DNA, 25 bp, Mus musculus
ttcctggtggctatcgcacacaaca

SEQ ID NO: 937476 - DNA, 25 bp, Mus musculus
ttcctggtggctttcgcacacaaca

SEQ ID NO: 937477 - DNA, 25 bp, Mus musculus
ttcctggtgggtatagtttctgcaa

SEQ ID NO: 937478 - DNA, 25 bp, Mus musculus
ttcctggtgggtttagtttctgcaa

SEQ ID NO: 937479 - DNA, 25 bp, Mus musculus
ttcctggttaacacctgttttgttg

SEQ ID NO: 937480 - DNA, 25 bp, Mus musculus
ttcctggttaactcctgttttgttg

SEQ ID NO: 937481 - DNA, 25 bp, Mus musculus
ttcctggttatcacaacaacgaagg

SEQ ID NO: 937482 - DNA, 25 bp, Mus musculus
ttcctggttatctcaacaacgaagg

SEQ ID NO: 937483 - DNA, 25 bp, Mus musculus
ttcctggttattcctgacttctaga

SEQ ID NO: 937484 - DNA, 25 bp, Mus musculus
ttcctggttattgctgacttctaga

SEQ ID NO: 937485 - DNA, 25 bp, Mus musculus
ttcctggttctgaatgtggcgtttt

SEQ ID NO: 937486 - DNA, 25 bp, Mus musculus
ttcctggttctgtatgtggcgtttt

SEQ ID NO: 937487 - DNA, 25 bp, Mus musculus
ttcctggttgtaccgtaacagcaca

SEQ ID NO: 937488 - DNA, 25 bp, Mus musculus
ttcctggttgtagcgtaacagcaca

SEQ ID NO: 937489 - DNA, 25 bp, Mus musculus
ttcctggtttcccaagaacttatga

SEQ ID NO: 937490 - DNA, 25 bp, Mus musculus
ttcctggtttccgaagaacttatga

SEQ ID NO: 937491 - DNA, 25 bp, Mus musculus
ttcctggttttccttgctattaagg

SEQ ID NO: 937492 - DNA, 25 bp, Mus musculus
ttcctggttttcgttgctattaagg

SEQ ID NO: 937493 - DNA, 25 bp, Mus musculus
ttcctgtaaacaagcacttaggagg

SEQ ID NO: 937494 - DNA, 25 bp, Mus musculus
ttcctgtaaacatgcacttaggagg

SEQ ID NO: 937495 - DNA, 25 bp, Mus musculus
ttcctgtaaatgagtcagtcttagt

SEQ ID NO: 937496 - DNA, 25 bp, Mus musculus
ttcctgtaaatgtgtcagtcttagt

SEQ ID NO: 937497 - DNA, 25 bp, Mus musculus
ttcctgtaacagatttgctcttccc

SEQ ID NO: 937498 - DNA, 25 bp, Mus musculus
ttcctgtaacagttttgctcttccc

SEQ ID NO: 937499 - DNA, 25 bp, Mus musculus
ttcctgtaactccccaagaattctg

SEQ ID NO: 937500 - DNA, 25 bp, Mus musculus
ttcctgtaactcgccaagaattctg

SEQ ID NO: 937501 - DNA, 25 bp, Mus musculus
ttcctgtacactagtaaccctccta

SEQ ID NO: 937502 - DNA, 25 bp, Mus musculus
ttcctgtacacttgtaaccctccta

SEQ ID NO: 937503 - DNA, 25 bp, Mus musculus
ttcctgtacccaatgctgacttttg

SEQ ID NO: 937504 - DNA, 25 bp, Mus musculus
ttcctgtacccattgctgacttttg

SEQ ID NO: 937505 - DNA, 25 bp, Mus musculus
ttcctgtacctcatgcgcagaaatg

SEQ ID NO: 937506 - DNA, 25 bp, Mus musculus
ttcctgtacctcttgcgcagaaatg

SEQ ID NO: 937507 - DNA, 25 bp, Mus musculus
ttcctgtaccttacagagcatccca

SEQ ID NO: 937508 - DNA, 25 bp, Mus musculus
ttcctgtacctttcagagcatccca

SEQ ID NO: 937509 - DNA, 25 bp, Mus musculus
ttcctgtactgcatagggcatgaac

SEQ ID NO: 937510 - DNA, 25 bp, Mus musculus
ttcctgtactgcttagggcatgaac

SEQ ID NO: 937511 - DNA, 25 bp, Mus musculus
ttcctgtaggaacatgattttataa

SEQ ID NO: 937512 - DNA, 25 bp, Mus musculus
ttcctgtaggaagatgattttataa

SEQ ID NO: 937513 - DNA, 25 bp, Mus musculus
ttcctgtagtacatatcaaagctat

SEQ ID NO: 937514 - DNA, 25 bp, Mus musculus
ttcctgtagtacttatcaaagctat

SEQ ID NO: 937515 - DNA, 25 bp, Mus musculus
ttcctgtatctactgtcatctctga

SEQ ID NO: 937516 - DNA, 25 bp, Mus musculus
ttcctgtatctagtgtcatctctga

SEQ ID NO: 937517 - DNA, 25 bp, Mus musculus
ttcctgtatctgaccccactgagca

SEQ ID NO: 937518 - DNA, 25 bp, Mus musculus
ttcctgtatctgtccccactgagca

SEQ ID NO: 937519 - DNA, 25 bp, Mus musculus
ttcctgtatgctatcccctaattgg

SEQ ID NO: 937520 - DNA, 25 bp, Mus musculus
ttcctgtatgctttcccctaattgg

SEQ ID NO: 937521 - DNA, 25 bp, Mus musculus
ttcctgtatttcatgtgcattaatc

SEQ ID NO: 937522 - DNA, 25 bp, Mus musculus
ttcctgtatttcttgtgcattaatc

SEQ ID NO: 937523 - DNA, 25 bp, Mus musculus
ttcctgtcacttatgaactgtttag

SEQ ID NO: 937524 - DNA, 25 bp, Mus musculus
ttcctgtcacttttgaactgtttag

SEQ ID NO: 937525 - DNA, 25 bp, Mus musculus
ttcctgtcagccaggcatttgataa

SEQ ID NO: 937526 - DNA, 25 bp, Mus musculus
ttcctgtcagcctggcatttgataa

SEQ ID NO: 937527 - DNA, 25 bp, Mus musculus
ttcctgtcagggatatcttgtgttc

SEQ ID NO: 937528 - DNA, 25 bp, Mus musculus
ttcctgtcagggttatcttgtgttc

SEQ ID NO: 937529 - DNA, 25 bp, Mus musculus
ttcctgtcaggtatgtgttcgtgta

SEQ ID NO: 937530 - DNA, 25 bp, Mus musculus
ttcctgtcaggtttgtgttcgtgta

SEQ ID NO: 937531 - DNA, 25 bp, Mus musculus
ttcctgtccaccaacatgtgaggca

SEQ ID NO: 937532 - DNA, 25 bp, Mus musculus
ttcctgtccacctacatgtgaggca

SEQ ID NO: 937533 - DNA, 25 bp, Mus musculus
ttcctgtcccagagcagtggcctaa

SEQ ID NO: 937534 - DNA, 25 bp, Mus musculus
ttcctgtcccagtgcagtggcctaa

SEQ ID NO: 937535 - DNA, 25 bp, Mus musculus
ttcctgtcccatctaactgcttttc

SEQ ID NO: 937536 - DNA, 25 bp, Mus musculus
ttcctgtcccatgtaactgcttttc

SEQ ID NO: 937537 - DNA, 25 bp, Mus musculus
ttcctgtccccaattagcaaattga

SEQ ID NO: 937538 - DNA, 25 bp, Mus musculus
ttcctgtccccatttagcaaattga

SEQ ID NO: 937539 - DNA, 25 bp, Mus musculus
ttcctgtcccggcatgtgaagaacg

SEQ ID NO: 937540 - DNA, 25 bp, Mus musculus
ttcctgtcccgggatgtgaagaacg

SEQ ID NO: 937541 - DNA, 25 bp, Mus musculus
ttcctgtccctaaggtggttctgaa

SEQ ID NO: 937542 - DNA, 25 bp, Mus musculus
ttcctgtccctatggtggttctgaa

SEQ ID NO: 937543 - DNA, 25 bp, Mus musculus
ttcctgtcctccatgatcaaaagca

SEQ ID NO: 937544 - DNA, 25 bp, Mus musculus
ttcctgtcctccttgatcaaaagca

SEQ ID NO: 937545 - DNA, 25 bp, Mus musculus
ttcctgtcggctaaggcggccgcca

SEQ ID NO: 937546 - DNA, 25 bp, Mus musculus
ttcctgtcggcttaggcggccgcca

SEQ ID NO: 937547 - DNA, 25 bp, Mus musculus
ttcctgtctaccagtgtgttctctg

SEQ ID NO: 937548 - DNA, 25 bp, Mus musculus
ttcctgtctacctgtgtgttctctg

SEQ ID NO: 937549 - DNA, 25 bp, Mus musculus
ttcctgtctcacaatgtgggagcat

SEQ ID NO: 937550 - DNA, 25 bp, Mus musculus
ttcctgtctcactatgtgggagcat

SEQ ID NO: 937551 - DNA, 25 bp, Mus musculus
ttcctgtctcagctgaaattgtggg

SEQ ID NO: 937552 - DNA, 25 bp, Mus musculus
ttcctgtctcaggtgaaattgtggg

SEQ ID NO: 937553 - DNA, 25 bp, Mus musculus
ttcctgtctcatctctacaatgtca

SEQ ID NO: 937554 - DNA, 25 bp, Mus musculus
ttcctgtctcatgtctacaatgtca

SEQ ID NO: 937555 - DNA, 25 bp, Mus musculus
ttcctgtctccaatttcctaagagt

SEQ ID NO: 937556 - DNA, 25 bp, Mus musculus
ttcctgtctccattttcctaagagt

SEQ ID NO: 937557 - DNA, 25 bp, Mus musculus
ttcctgtctgacctacgtgagattg

SEQ ID NO: 937558 - DNA, 25 bp, Mus musculus
ttcctgtctgacgtacgtgagattg

SEQ ID NO: 937559 - DNA, 25 bp, Mus musculus
ttcctgtctgccagggacatgttta

SEQ ID NO: 937560 - DNA, 25 bp, Mus musculus
ttcctgtctgcctgggacatgttta

SEQ ID NO: 937561 - DNA, 25 bp, Mus musculus
ttcctgtctgtgcagaagcaagcag

SEQ ID NO: 937562 - DNA, 25 bp, Mus musculus
ttcctgtctgtggagaagcaagcag

SEQ ID NO: 937563 - DNA, 25 bp, Mus musculus
ttcctgtcttaccagcttttgagaa

SEQ ID NO: 937564 - DNA, 25 bp, Mus musculus
ttcctgtcttacctgtcaaggacac

SEQ ID NO: 937565 - DNA, 25 bp, Mus musculus
ttcctgtcttacgagcttttgagaa

SEQ ID NO: 937566 - DNA, 25 bp, Mus musculus
ttcctgtcttacgtgtcaaggacac

SEQ ID NO: 937567 - DNA, 25 bp, Mus musculus
ttcctgtcttcaaggcatctgcacc

SEQ ID NO: 937568 - DNA, 25 bp, Mus musculus
ttcctgtcttcatggcatctgcacc

SEQ ID NO: 937569 - DNA, 25 bp, Mus musculus
ttcctgtctttcctgtcattctgct

SEQ ID NO: 937570 - DNA, 25 bp, Mus musculus
ttcctgtctttcgtgtcattctgct

SEQ ID NO: 937571 - DNA, 25 bp, Mus musculus
ttcctgtgaacaactatttgatgtg

SEQ ID NO: 937572 - DNA, 25 bp, Mus musculus
ttcctgtgaacatctatttgatgtg

SEQ ID NO: 937573 - DNA, 25 bp, Mus musculus
ttcctgtgaaccaggtagtgtttca

SEQ ID NO: 937574 - DNA, 25 bp, Mus musculus
ttcctgtgaacctggtagtgtttca

SEQ ID NO: 937575 - DNA, 25 bp, Mus musculus
ttcctgtgaaggagccggaccggta

SEQ ID NO: 937576 - DNA, 25 bp, Mus musculus
ttcctgtgaaggtgccggaccggta

SEQ ID NO: 937577 - DNA, 25 bp, Mus musculus
ttcctgtgaataaagctcttcccca

SEQ ID NO: 937578 - DNA, 25 bp, Mus musculus
ttcctgtgaatatagctcttcccca

SEQ ID NO: 937579 - DNA, 25 bp, Mus musculus
ttcctgtgacagagggagaggttcc

SEQ ID NO: 937580 - DNA, 25 bp, Mus musculus
ttcctgtgacagtgggagaggttcc

SEQ ID NO: 937581 - DNA, 25 bp, Mus musculus
ttcctgtgacctagtagtaaattag

SEQ ID NO: 937582 - DNA, 25 bp, Mus musculus
ttcctgtgaccttgtagtaaattag

SEQ ID NO: 937583 - DNA, 25 bp, Mus musculus
ttcctgtgacttaccattttcttca

SEQ ID NO: 937584 - DNA, 25 bp, Mus musculus
ttcctgtgactttccattttcttca

SEQ ID NO: 937585 - DNA, 25 bp, Mus musculus
ttcctgtgagagatctatgtagcct

SEQ ID NO: 937586 - DNA, 25 bp, Mus musculus
ttcctgtgagagttctatgtagcct

SEQ ID NO: 937587 - DNA, 25 bp, Mus musculus
ttcctgtgcactcagctgattggtt

SEQ ID NO: 937588 - DNA, 25 bp, Mus musculus
ttcctgtgcactgagctgattggtt

SEQ ID NO: 937589 - DNA, 25 bp, Mus musculus
ttcctgtgccaccaaggtcgagtga

SEQ ID NO: 937590 - DNA, 25 bp, Mus musculus
ttcctgtgccacgaaggtcgagtga

SEQ ID NO: 937591 - DNA, 25 bp, Mus musculus
ttcctgtgcgtcacttgcagtctga

SEQ ID NO: 937592 - DNA, 25 bp, Mus musculus
ttcctgtgcgtctcttgcagtctga

SEQ ID NO: 937593 - DNA, 25 bp, Mus musculus
ttcctgtgctcaattccagagatga

SEQ ID NO: 937594 - DNA, 25 bp, Mus musculus
ttcctgtgctcatttccagagatga

SEQ ID NO: 937595 - DNA, 25 bp, Mus musculus
ttcctgtggtatctggcaacgctca

SEQ ID NO: 937596 - DNA, 25 bp, Mus musculus
ttcctgtggtatgtggcaacgctca

SEQ ID NO: 937597 - DNA, 25 bp, Mus musculus
ttcctgtggtttcgccagcccctga

SEQ ID NO: 937598 - DNA, 25 bp, Mus musculus
ttcctgtggtttggccagcccctga

SEQ ID NO: 937599 - DNA, 25 bp, Mus musculus
ttcctgtgtaaccttccgctaatct

SEQ ID NO: 937600 - DNA, 25 bp, Mus musculus
ttcctgtgtaacgttccgctaatct

SEQ ID NO: 937601 - DNA, 25 bp, Mus musculus
ttcctgtgtattagtcgtcctgccc

SEQ ID NO: 937602 - DNA, 25 bp, Mus musculus
ttcctgtgtatttgtcgtcctgccc

SEQ ID NO: 937603 - DNA, 25 bp, Mus musculus
ttcctgtgtcctcctattgttttaa

SEQ ID NO: 937604 - DNA, 25 bp, Mus musculus
ttcctgtgtcctgctattgttttaa

SEQ ID NO: 937605 - DNA, 25 bp, Mus musculus
ttcctgtgtcggcttgcagcgcatc

SEQ ID NO: 937606 - DNA, 25 bp, Mus musculus
ttcctgtgtcgggttgcagcgcatc

SEQ ID NO: 937607 - DNA, 25 bp, Mus musculus
ttcctgtgtgcgatggcatatacct

SEQ ID NO: 937608 - DNA, 25 bp, Mus musculus
ttcctgtgtgcgttggcatatacct

SEQ ID NO: 937609 - DNA, 25 bp, Mus musculus
ttcctgtgtggtcccatgtatcttg

SEQ ID NO: 937610 - DNA, 25 bp, Mus musculus
ttcctgtgtggtgccatgtatcttg

SEQ ID NO: 937611 - DNA, 25 bp, Mus musculus
ttcctgtgttctaccatttactgaa

SEQ ID NO: 937612 - DNA, 25 bp, Mus musculus
ttcctgtgttcttccatttactgaa

SEQ ID NO: 937613 - DNA, 25 bp, Mus musculus
ttcctgtgtttcctaggccatgata

SEQ ID NO: 937614 - DNA, 25 bp, Mus musculus
ttcctgtgtttcgtaggccatgata

SEQ ID NO: 937615 - DNA, 25 bp, Mus musculus
ttcctgttaactcaataatctggtg

SEQ ID NO: 937616 - DNA, 25 bp, Mus musculus
ttcctgttaactgaataatctggtg

SEQ ID NO: 937617 - DNA, 25 bp, Mus musculus
ttcctgttactcacaagactgttgg

SEQ ID NO: 937618 - DNA, 25 bp, Mus musculus
ttcctgttactctcaagactgttgg

SEQ ID NO: 937619 - DNA, 25 bp, Mus musculus
ttcctgttatgcagcacctggctaa

SEQ ID NO: 937620 - DNA, 25 bp, Mus musculus
ttcctgttatgctgcacctggctaa

SEQ ID NO: 937621 - DNA, 25 bp, Mus musculus
ttcctgttcaaacgctctgtgctac

SEQ ID NO: 937622 - DNA, 25 bp, Mus musculus
ttcctgttcaaaggctctgtgctac

SEQ ID NO: 937623 - DNA, 25 bp, Mus musculus
ttcctgttcattcatagcaaaatgg

SEQ ID NO: 937624 - DNA, 25 bp, Mus musculus
ttcctgttcattgatagcaaaatgg

SEQ ID NO: 937625 - DNA, 25 bp, Mus musculus
ttcctgttccagagaagcatgagat

SEQ ID NO: 937626 - DNA, 25 bp, Mus musculus
ttcctgttccagtgaagcatgagat

SEQ ID NO: 937627 - DNA, 25 bp, Mus musculus
ttcctgttcccacgatgtcactgaa

SEQ ID NO: 937628 - DNA, 25 bp, Mus musculus
ttcctgttcccaggatgtcactgaa

SEQ ID NO: 937629 - DNA, 25 bp, Mus musculus
ttcctgttctggatcctttgtgaca

SEQ ID NO: 937630 - DNA, 25 bp, Mus musculus
ttcctgttctggttcctttgtgaca

SEQ ID NO: 937631 - DNA, 25 bp, Mus musculus
ttcctgttgcaaatgcctggagagg

SEQ ID NO: 937632 - DNA, 25 bp, Mus musculus
ttcctgttgcaattgcctggagagg

SEQ ID NO: 937633 - DNA, 25 bp, Mus musculus
ttcctgttgcgtccctggactcagg

SEQ ID NO: 937634 - DNA, 25 bp, Mus musculus
ttcctgttgcgtgcctggactcagg

SEQ ID NO: 937635 - DNA, 25 bp, Mus musculus
ttcctgttgttaacttctggtgtac

SEQ ID NO: 937636 - DNA, 25 bp, Mus musculus
ttcctgttgttatcttctggtgtac

SEQ ID NO: 937637 - DNA, 25 bp, Mus musculus
ttcctgtttaatattgttctctatc

SEQ ID NO: 937638 - DNA, 25 bp, Mus musculus
ttcctgtttaattttgttctctatc

SEQ ID NO: 937639 - DNA, 25 bp, Mus musculus
ttcctgtttacaagagtaccacctg

SEQ ID NO: 937640 - DNA, 25 bp, Mus musculus
ttcctgtttacatgagtaccacctg

SEQ ID NO: 937641 - DNA, 25 bp, Mus musculus
ttcctgtttaccctatagatcccag

SEQ ID NO: 937642 - DNA, 25 bp, Mus musculus
ttcctgtttaccgtatagatcccag

SEQ ID NO: 937643 - DNA, 25 bp, Mus musculus
ttcctgtttagtcatatggagtaaa

SEQ ID NO: 937644 - DNA, 25 bp, Mus musculus
ttcctgtttagtgatatggagtaaa

SEQ ID NO: 937645 - DNA, 25 bp, Mus musculus
ttcctgtttatgaacctcctgccta

SEQ ID NO: 937646 - DNA, 25 bp, Mus musculus
ttcctgtttatgtacctcctgccta

SEQ ID NO: 937647 - DNA, 25 bp, Mus musculus
ttcctgtttctcaacacatgttgtg

SEQ ID NO: 937648 - DNA, 25 bp, Mus musculus
ttcctgtttctctacacatgttgtg

SEQ ID NO: 937649 - DNA, 25 bp, Mus musculus
ttcctgtttcttaccagagctgctg

SEQ ID NO: 937650 - DNA, 25 bp, Mus musculus
ttcctgtttcttcgctgaagatgac

SEQ ID NO: 937651 - DNA, 25 bp, Mus musculus
ttcctgtttcttggctgaagatgac

SEQ ID NO: 937652 - DNA, 25 bp, Mus musculus
ttcctgtttctttccagagctgctg

SEQ ID NO: 937653 - DNA, 25 bp, Mus musculus
ttcctgtttgctattcgatgaagat

SEQ ID NO: 937654 - DNA, 25 bp, Mus musculus
ttcctgtttgcttttcgatgaagat

SEQ ID NO: 937655 - DNA, 25 bp, Mus musculus
ttcctgttttaacccaatagcctgt

SEQ ID NO: 937656 - DNA, 25 bp, Mus musculus
ttcctgttttaagccaatagcctgt

SEQ ID NO: 937657 - DNA, 25 bp, Mus musculus
ttcctgttttgtacatagatttatt

SEQ ID NO: 937658 - DNA, 25 bp, Mus musculus
ttcctgttttgtccaaagtccctgg

SEQ ID NO: 937659 - DNA, 25 bp, Mus musculus
ttcctgttttgtgcaaagtccctgg

SEQ ID NO: 937660 - DNA, 25 bp, Mus musculus
ttcctgttttgttcatagatttatt

SEQ ID NO: 937661 - DNA, 25 bp, Mus musculus
ttcctgtttttacagagcacgtacg

SEQ ID NO: 937662 - DNA, 25 bp, Mus musculus
ttcctgtttttagagagcacgtacg

SEQ ID NO: 937663 - DNA, 25 bp, Mus musculus
ttcctgtttttcctacctgagacat

SEQ ID NO: 937664 - DNA, 25 bp, Mus musculus
ttcctgtttttcgtacctgagacat

SEQ ID NO: 937665 - DNA, 25 bp, Mus musculus
ttccttaaaggaactacgaatattg

SEQ ID NO: 937666 - DNA, 25 bp, Mus musculus
ttccttaaaggatctacgaatattg

SEQ ID NO: 937667 - DNA, 25 bp, Mus musculus
ttccttaaccagagttgcatgccag

SEQ ID NO: 937668 - DNA, 25 bp, Mus musculus
ttccttaaccagtgttgcatgccag

SEQ ID NO: 937669 - DNA, 25 bp, Mus musculus
ttccttaagcaacactgccctatga

SEQ ID NO: 937670 - DNA, 25 bp, Mus musculus
ttccttaagcaagactgccctatga

SEQ ID NO: 937671 - DNA, 25 bp, Mus musculus
ttccttaatataatgaggctatggg

SEQ ID NO: 937672 - DNA, 25 bp, Mus musculus
ttccttaatatattgaggctatggg

SEQ ID NO: 937673 - DNA, 25 bp, Mus musculus
ttccttaatgagacgcgaacgctgt

SEQ ID NO: 937674 - DNA, 25 bp, Mus musculus
ttccttaatgagtcgcgaacgctgt

SEQ ID NO: 937675 - DNA, 25 bp, Mus musculus
ttccttacacagaccctgtttttgt

SEQ ID NO: 937676 - DNA, 25 bp, Mus musculus
ttccttacacagtccctgtttttgt

SEQ ID NO: 937677 - DNA, 25 bp, Mus musculus
ttccttacccaaattcttgccattt

SEQ ID NO: 937678 - DNA, 25 bp, Mus musculus
ttccttacccaacactcagcaatat

SEQ ID NO: 937679 - DNA, 25 bp, Mus musculus
ttccttacccaagactcagcaatat

SEQ ID NO: 937680 - DNA, 25 bp, Mus musculus
ttccttacccaatttcttgccattt

SEQ ID NO: 937681 - DNA, 25 bp, Mus musculus
ttccttacccagctgtcttgtaaca

SEQ ID NO: 937682 - DNA, 25 bp, Mus musculus
ttccttacccaggtgtcttgtaaca

SEQ ID NO: 937683 - DNA, 25 bp, Mus musculus
ttccttacctcccatgaatgagaag

SEQ ID NO: 937684 - DNA, 25 bp, Mus musculus
ttccttacctccgatgaatgagaag

SEQ ID NO: 937685 - DNA, 25 bp, Mus musculus
ttccttacctctatgtgccatacga

SEQ ID NO: 937686 - DNA, 25 bp, Mus musculus
ttccttacctctttgtgccatacga

SEQ ID NO: 937687 - DNA, 25 bp, Mus musculus
ttccttactacccatcaataccaga

SEQ ID NO: 937688 - DNA, 25 bp, Mus musculus
ttccttactaccgatcaataccaga

SEQ ID NO: 937689 - DNA, 25 bp, Mus musculus
ttccttactggaaggatgtggagga

SEQ ID NO: 937690 - DNA, 25 bp, Mus musculus
ttccttactggatggatgtggagga

SEQ ID NO: 937691 - DNA, 25 bp, Mus musculus
ttccttactgtaaaacttccctaga

SEQ ID NO: 937692 - DNA, 25 bp, Mus musculus
ttccttactgtataacttccctaga

SEQ ID NO: 937693 - DNA, 25 bp, Mus musculus
ttccttacttgtcttctttctaaag

SEQ ID NO: 937694 - DNA, 25 bp, Mus musculus
ttccttacttgtgttctttctaaag

SEQ ID NO: 937695 - DNA, 25 bp, Mus musculus
ttccttagaccaatctgacctagtt

SEQ ID NO: 937696 - DNA, 25 bp, Mus musculus
ttccttagaccattctgacctagtt

SEQ ID NO: 937697 - DNA, 25 bp, Mus musculus
ttccttagacccactgagaatgctc

SEQ ID NO: 937698 - DNA, 25 bp, Mus musculus
ttccttagaccctctgagaatgctc

SEQ ID NO: 937699 - DNA, 25 bp, Mus musculus
ttccttagacttccagtactgtgat

SEQ ID NO: 937700 - DNA, 25 bp, Mus musculus
ttccttagacttgcagtactgtgat

SEQ ID NO: 937701 - DNA, 25 bp, Mus musculus
ttccttagagccaggtagatgtctt

SEQ ID NO: 937702 - DNA, 25 bp, Mus musculus
ttccttagagcctggtagatgtctt

SEQ ID NO: 937703 - DNA, 25 bp, Mus musculus
ttccttagatggcaggagcagagct

SEQ ID NO: 937704 - DNA, 25 bp, Mus musculus
ttccttagatgggaggagcagagct

SEQ ID NO: 937705 - DNA, 25 bp, Mus musculus
ttccttagccctagggacgtgttga

SEQ ID NO: 937706 - DNA, 25 bp, Mus musculus
ttccttagcccttgggacgtgttga

SEQ ID NO: 937707 - DNA, 25 bp, Mus musculus
ttccttagctctcgaacacttttct

SEQ ID NO: 937708 - DNA, 25 bp, Mus musculus
ttccttagctctggaacacttttct

SEQ ID NO: 937709 - DNA, 25 bp, Mus musculus
ttccttaggacacgtgtgaccttct

SEQ ID NO: 937710 - DNA, 25 bp, Mus musculus
ttccttaggacaggtgtgaccttct

SEQ ID NO: 937711 - DNA, 25 bp, Mus musculus
ttccttagtaatcggctggattcct

SEQ ID NO: 937712 - DNA, 25 bp, Mus musculus
ttccttagtaatgggctggattcct

SEQ ID NO: 937713 - DNA, 25 bp, Mus musculus
ttccttagtattatctcttgctgct

SEQ ID NO: 937714 - DNA, 25 bp, Mus musculus
ttccttagtattttctcttgctgct

SEQ ID NO: 937715 - DNA, 25 bp, Mus musculus
ttccttagtcctatttctagagctc

SEQ ID NO: 937716 - DNA, 25 bp, Mus musculus
ttccttagtcctttttctagagctc

SEQ ID NO: 937717 - DNA, 25 bp, Mus musculus
ttccttataagcatctcttccattc

SEQ ID NO: 937718 - DNA, 25 bp, Mus musculus
ttccttataagcttctcttccattc

SEQ ID NO: 937719 - DNA, 25 bp, Mus musculus
ttccttatacgccatattcctcaaa

SEQ ID NO: 937720 - DNA, 25 bp, Mus musculus
ttccttatacgcgatattcctcaaa

SEQ ID NO: 937721 - DNA, 25 bp, Mus musculus
ttccttatactgcacctgggatgcc

SEQ ID NO: 937722 - DNA, 25 bp, Mus musculus
ttccttatactgctggtgaccaatg

SEQ ID NO: 937723 - DNA, 25 bp, Mus musculus
ttccttatactggacctgggatgcc

SEQ ID NO: 937724 - DNA, 25 bp, Mus musculus
ttccttatactggtggtgaccaatg

SEQ ID NO: 937725 - DNA, 25 bp, Mus musculus
ttccttataggacttcagatgtatc

SEQ ID NO: 937726 - DNA, 25 bp, Mus musculus
ttccttataggagttcagatgtatc

SEQ ID NO: 937727 - DNA, 25 bp, Mus musculus
ttccttatctcaatcatagttggtt

SEQ ID NO: 937728 - DNA, 25 bp, Mus musculus
ttccttatctcattcatagttggtt

SEQ ID NO: 937729 - DNA, 25 bp, Mus musculus
ttccttatctcgacgatgtgacaca

SEQ ID NO: 937730 - DNA, 25 bp, Mus musculus
ttccttatctcgtcgatgtgacaca

SEQ ID NO: 937731 - DNA, 25 bp, Mus musculus
ttccttatctgtcgtctactgtgat

SEQ ID NO: 937732 - DNA, 25 bp, Mus musculus
ttccttatctgtggtctactgtgat

SEQ ID NO: 937733 - DNA, 25 bp, Mus musculus
ttccttatcttcaatgtctctgtca

SEQ ID NO: 937734 - DNA, 25 bp, Mus musculus
ttccttatcttctatgtctctgtca

SEQ ID NO: 937735 - DNA, 25 bp, Mus musculus
ttccttatgatccacctacagagag

SEQ ID NO: 937736 - DNA, 25 bp, Mus musculus
ttccttatgatcgacctacagagag

SEQ ID NO: 937737 - DNA, 25 bp, Mus musculus
ttccttatgcttataaatggcagac

SEQ ID NO: 937738 - DNA, 25 bp, Mus musculus
ttccttatgcttttaaatggcagac

SEQ ID NO: 937739 - DNA, 25 bp, Mus musculus
ttccttatggttccagacagcaggg

SEQ ID NO: 937740 - DNA, 25 bp, Mus musculus
ttccttatggttgcagacagcaggg

SEQ ID NO: 937741 - DNA, 25 bp, Mus musculus
ttccttatgtctcgtgaaatatctg

SEQ ID NO: 937742 - DNA, 25 bp, Mus musculus
ttccttatgtctggtgaaatatctg

SEQ ID NO: 937743 - DNA, 25 bp, Mus musculus
ttccttatgtgaattttatatgtac

SEQ ID NO: 937744 - DNA, 25 bp, Mus musculus
ttccttatgtgatttttatatgtac

SEQ ID NO: 937745 - DNA, 25 bp, Mus musculus
ttccttattatactgcttgcccaaa

SEQ ID NO: 937746 - DNA, 25 bp, Mus musculus
ttccttattatagtgcttgcccaaa

SEQ ID NO: 937747 - DNA, 25 bp, Mus musculus
ttccttattccacacattgccagag

SEQ ID NO: 937748 - DNA, 25 bp, Mus musculus
ttccttattccagacattgccagag

SEQ ID NO: 937749 - DNA, 25 bp, Mus musculus
ttccttattgatcatgcgactcttg

SEQ ID NO: 937750 - DNA, 25 bp, Mus musculus
ttccttattgatgatgcgactcttg

SEQ ID NO: 937751 - DNA, 25 bp, Mus musculus
ttccttatttaccagggtcctgtgt

SEQ ID NO: 937752 - DNA, 25 bp, Mus musculus
ttccttatttacgagggtcctgtgt

SEQ ID NO: 937753 - DNA, 25 bp, Mus musculus
ttccttatttgcaggtccatatgcc

SEQ ID NO: 937754 - DNA, 25 bp, Mus musculus
ttccttatttgctggtccatatgcc

SEQ ID NO: 937755 - DNA, 25 bp, Mus musculus
ttccttattttgagtgatgccttaa

SEQ ID NO: 937756 - DNA, 25 bp, Mus musculus
ttccttattttgtgtgatgccttaa

SEQ ID NO: 937757 - DNA, 25 bp, Mus musculus
ttccttcaaagccaaaggcccctgg

SEQ ID NO: 937758 - DNA, 25 bp, Mus musculus
ttccttcaaagcgaaaggcccctgg

SEQ ID NO: 937759 - DNA, 25 bp, Mus musculus
ttccttcaaatcagaggcttgcctg

SEQ ID NO: 937760 - DNA, 25 bp, Mus musculus
ttccttcaaatctgaggcttgcctg

SEQ ID NO: 937761 - DNA, 25 bp, Mus musculus
ttccttcaaggtcatgtcacacgtg

SEQ ID NO: 937762 - DNA, 25 bp, Mus musculus
ttccttcaaggtgatgtcacacgtg

SEQ ID NO: 937763 - DNA, 25 bp, Mus musculus
ttccttcaccctccagcttcatttt

SEQ ID NO: 937764 - DNA, 25 bp, Mus musculus
ttccttcaccctgcagcttcatttt

SEQ ID NO: 937765 - DNA, 25 bp, Mus musculus
ttccttcactagctttgtggaccag

SEQ ID NO: 937766 - DNA, 25 bp, Mus musculus
ttccttcactaggtttgtggaccag

SEQ ID NO: 937767 - DNA, 25 bp, Mus musculus
ttccttcactatcaacttctgccag

SEQ ID NO: 937768 - DNA, 25 bp, Mus musculus
ttccttcactatgaacttctgccag

SEQ ID NO: 937769 - DNA, 25 bp, Mus musculus
ttccttcactcaccaagcagtgcag

SEQ ID NO: 937770 - DNA, 25 bp, Mus musculus
ttccttcactcagcaagcagtgcag

SEQ ID NO: 937771 - DNA, 25 bp, Mus musculus
ttccttcactgtacctacttagata

SEQ ID NO: 937772 - DNA, 25 bp, Mus musculus
ttccttcactgttcctacttagata

SEQ ID NO: 937773 - DNA, 25 bp, Mus musculus
ttccttcagaatcggatgaaagcaa

SEQ ID NO: 937774 - DNA, 25 bp, Mus musculus
ttccttcagaatgggatgaaagcaa

SEQ ID NO: 937775 - DNA, 25 bp, Mus musculus
ttccttcagagtcctgacactctat

SEQ ID NO: 937776 - DNA, 25 bp, Mus musculus
ttccttcagagtgctgacactctat

SEQ ID NO: 937777 - DNA, 25 bp, Mus musculus
ttccttcagcctagaaacctctatt

SEQ ID NO: 937778 - DNA, 25 bp, Mus musculus
ttccttcagccttgaaacctctatt

SEQ ID NO: 937779 - DNA, 25 bp, Mus musculus
ttccttcaggagagcttgtcacttc

SEQ ID NO: 937780 - DNA, 25 bp, Mus musculus
ttccttcaggagtgcttgtcacttc

SEQ ID NO: 937781 - DNA, 25 bp, Mus musculus
ttccttcagtccatttgggacagat

SEQ ID NO: 937782 - DNA, 25 bp, Mus musculus
ttccttcagtccttttgggacagat

SEQ ID NO: 937783 - DNA, 25 bp, Mus musculus
ttccttcatgagctttgcttcagtt

SEQ ID NO: 937784 - DNA, 25 bp, Mus musculus
ttccttcatgaggtttgcttcagtt

SEQ ID NO: 937785 - DNA, 25 bp, Mus musculus
ttccttcattggcatggagtcagct

SEQ ID NO: 937786 - DNA, 25 bp, Mus musculus
ttccttcattgggatggagtcagct

SEQ ID NO: 937787 - DNA, 25 bp, Mus musculus
ttccttccaatcattcagtggctga

SEQ ID NO: 937788 - DNA, 25 bp, Mus musculus
ttccttccaatctttcagtggctga

SEQ ID NO: 937789 - DNA, 25 bp, Mus musculus
ttccttccagtgacttccatgggat

SEQ ID NO: 937790 - DNA, 25 bp, Mus musculus
ttccttccagtgtcttccatgggat

SEQ ID NO: 937791 - DNA, 25 bp, Mus musculus
ttccttccagttaaccagtgtctga

SEQ ID NO: 937792 - DNA, 25 bp, Mus musculus
ttccttccagttccgatgcagaaaa

SEQ ID NO: 937793 - DNA, 25 bp, Mus musculus
ttccttccagttgcgatgcagaaaa

SEQ ID NO: 937794 - DNA, 25 bp, Mus musculus
ttccttccagtttaccagtgtctga

SEQ ID NO: 937795 - DNA, 25 bp, Mus musculus
ttccttccatggatgttaccaaaag

SEQ ID NO: 937796 - DNA, 25 bp, Mus musculus
ttccttccatggttgttaccaaaag

SEQ ID NO: 937797 - DNA, 25 bp, Mus musculus
ttccttcccaaaaattgttttgtag

SEQ ID NO: 937798 - DNA, 25 bp, Mus musculus
ttccttcccaaatattgttttgtag

SEQ ID NO: 937799 - DNA, 25 bp, Mus musculus
ttccttcccagcagtgccagtaaaa

SEQ ID NO: 937800 - DNA, 25 bp, Mus musculus
ttccttcccagcatcactgagaacg

SEQ ID NO: 937801 - DNA, 25 bp, Mus musculus
ttccttcccagctgtgccagtaaaa

SEQ ID NO: 937802 - DNA, 25 bp, Mus musculus
ttccttcccagcttcactgagaacg

SEQ ID NO: 937803 - DNA, 25 bp, Mus musculus
ttccttcccagtctaaatgtttagt

SEQ ID NO: 937804 - DNA, 25 bp, Mus musculus
ttccttcccagtgtaaatgtttagt

SEQ ID NO: 937805 - DNA, 25 bp, Mus musculus
ttccttcccatgacattcaagaacc

SEQ ID NO: 937806 - DNA, 25 bp, Mus musculus
ttccttcccatgtcattcaagaacc

SEQ ID NO: 937807 - DNA, 25 bp, Mus musculus
ttccttccccagaaatgagccatta

SEQ ID NO: 937808 - DNA, 25 bp, Mus musculus
ttccttccccagtaatgagccatta

SEQ ID NO: 937809 - DNA, 25 bp, Mus musculus
ttccttccccggaactctggaggct

SEQ ID NO: 937810 - DNA, 25 bp, Mus musculus
ttccttccccggtactctggaggct

SEQ ID NO: 937811 - DNA, 25 bp, Mus musculus
ttccttcccctgctgatgcgtaaat

SEQ ID NO: 937812 - DNA, 25 bp, Mus musculus
ttccttcccctggtgatgcgtaaat

SEQ ID NO: 937813 - DNA, 25 bp, Mus musculus
ttccttccctaaagattgcatcaga

SEQ ID NO: 937814 - DNA, 25 bp, Mus musculus
ttccttccctaatgattgcatcaga

SEQ ID NO: 937815 - DNA, 25 bp, Mus musculus
ttccttccgagacgaaaatccccat

SEQ ID NO: 937816 - DNA, 25 bp, Mus musculus
ttccttccgagaggaaaatccccat

SEQ ID NO: 937817 - DNA, 25 bp, Mus musculus
ttccttccgtatccttgtgtcaaga

SEQ ID NO: 937818 - DNA, 25 bp, Mus musculus
ttccttccgtatcgtttgttaagct

SEQ ID NO: 937819 - DNA, 25 bp, Mus musculus
ttccttccgtatgcttgtgtcaaga

SEQ ID NO: 937820 - DNA, 25 bp, Mus musculus
ttccttccgtatggtttgttaagct

SEQ ID NO: 937821 - DNA, 25 bp, Mus musculus
ttccttccgtgaaggttctcaagta

SEQ ID NO: 937822 - DNA, 25 bp, Mus musculus
ttccttccgtgatggttctcaagta

SEQ ID NO: 937823 - DNA, 25 bp, Mus musculus
ttccttccgtgcatactttaattga

SEQ ID NO: 937824 - DNA, 25 bp, Mus musculus
ttccttccgtgcttactttaattga

SEQ ID NO: 937825 - DNA, 25 bp, Mus musculus
ttccttccgttcagctggcccttag

SEQ ID NO: 937826 - DNA, 25 bp, Mus musculus
ttccttccgttctgctggcccttag

SEQ ID NO: 937827 - DNA, 25 bp, Mus musculus
ttccttcctagaaggacttagtcca

SEQ ID NO: 937828 - DNA, 25 bp, Mus musculus
ttccttcctagatggacttagtcca

SEQ ID NO: 937829 - DNA, 25 bp, Mus musculus
ttccttcctccaagcatgcagaaat

SEQ ID NO: 937830 - DNA, 25 bp, Mus musculus
ttccttcctccatgcatgcagaaat

SEQ ID NO: 937831 - DNA, 25 bp, Mus musculus
ttccttcctcgcattcctgaatacc

SEQ ID NO: 937832 - DNA, 25 bp, Mus musculus
ttccttcctcgctttcctgaatacc

SEQ ID NO: 937833 - DNA, 25 bp, Mus musculus
ttccttcctcttatagagccaaggg

SEQ ID NO: 937834 - DNA, 25 bp, Mus musculus
ttccttcctcttttagagccaaggg

SEQ ID NO: 937835 - DNA, 25 bp, Mus musculus
ttccttcctgtgctcatagtggtca

SEQ ID NO: 937836 - DNA, 25 bp, Mus musculus
ttccttcctgtggtcatagtggtca

SEQ ID NO: 937837 - DNA, 25 bp, Mus musculus
ttccttccttataagtgcgtagctt

SEQ ID NO: 937838 - DNA, 25 bp, Mus musculus
ttccttccttattagtgcgtagctt

SEQ ID NO: 937839 - DNA, 25 bp, Mus musculus
ttccttccttctacaatttactaca

SEQ ID NO: 937840 - DNA, 25 bp, Mus musculus
ttccttccttcttcaatttactaca

SEQ ID NO: 937841 - DNA, 25 bp, Mus musculus
ttccttccttgcagtgcgaccctgg

SEQ ID NO: 937842 - DNA, 25 bp, Mus musculus
ttccttccttgctgtgcgaccctgg

SEQ ID NO: 937843 - DNA, 25 bp, Mus musculus
ttccttccttgtaccagggaggtgg

SEQ ID NO: 937844 - DNA, 25 bp, Mus musculus
ttccttccttgttccagggaggtgg

SEQ ID NO: 937845 - DNA, 25 bp, Mus musculus
ttccttcctttgaggcagagcacat

SEQ ID NO: 937846 - DNA, 25 bp, Mus musculus
ttccttcctttgtggcagagcacat

SEQ ID NO: 937847 - DNA, 25 bp, Mus musculus
ttccttccttttagtgacagtaggc

SEQ ID NO: 937848 - DNA, 25 bp, Mus musculus
ttccttcctttttgtgacagtaggc

SEQ ID NO: 937849 - DNA, 25 bp, Mus musculus
ttccttcgcacccagttcagtgagg

SEQ ID NO: 937850 - DNA, 25 bp, Mus musculus
ttccttcgcaccgagttcagtgagg

SEQ ID NO: 937851 - DNA, 25 bp, Mus musculus
ttccttcgccagcagttgaatctat

SEQ ID NO: 937852 - DNA, 25 bp, Mus musculus
ttccttcgccaggagttgaatctat

SEQ ID NO: 937853 - DNA, 25 bp, Mus musculus
ttccttcgttacatgaaacagtcca

SEQ ID NO: 937854 - DNA, 25 bp, Mus musculus
ttccttcgttacttgaaacagtcca

SEQ ID NO: 937855 - DNA, 25 bp, Mus musculus
ttccttctaaccaacaaccacaaat

SEQ ID NO: 937856 - DNA, 25 bp, Mus musculus
ttccttctaacctacaaccacaaat

SEQ ID NO: 937857 - DNA, 25 bp, Mus musculus
ttccttctaagaaagcactttactg

SEQ ID NO: 937858 - DNA, 25 bp, Mus musculus
ttccttctaagatagcactttactg

SEQ ID NO: 937859 - DNA, 25 bp, Mus musculus
ttccttctactgatgttctccaaag

SEQ ID NO: 937860 - DNA, 25 bp, Mus musculus
ttccttctactgttgttctccaaag

SEQ ID NO: 937861 - DNA, 25 bp, Mus musculus
ttccttctacttcggtcatcagaat

SEQ ID NO: 937862 - DNA, 25 bp, Mus musculus
ttccttctacttgggtcatcagaat

SEQ ID NO: 937863 - DNA, 25 bp, Mus musculus
ttccttctagaactaggctacctaa

SEQ ID NO: 937864 - DNA, 25 bp, Mus musculus
ttccttctagaagtaggctacctaa

SEQ ID NO: 937865 - DNA, 25 bp, Mus musculus
ttccttctagctccagccacttgtg

SEQ ID NO: 937866 - DNA, 25 bp, Mus musculus
ttccttctagctgcagccacttgtg

SEQ ID NO: 937867 - DNA, 25 bp, Mus musculus
ttccttctatgcaaagctcatcttc

SEQ ID NO: 937868 - DNA, 25 bp, Mus musculus
ttccttctatgctaagctcatcttc

SEQ ID NO: 937869 - DNA, 25 bp, Mus musculus
ttccttctatttaccctttacacag

SEQ ID NO: 937870 - DNA, 25 bp, Mus musculus
ttccttctattttccctttacacag

SEQ ID NO: 937871 - DNA, 25 bp, Mus musculus
ttccttctcagtatctcccatatac

SEQ ID NO: 937872 - DNA, 25 bp, Mus musculus
ttccttctcagtctcatgtcatttt

SEQ ID NO: 937873 - DNA, 25 bp, Mus musculus
ttccttctcagtgtcatgtcatttt

SEQ ID NO: 937874 - DNA, 25 bp, Mus musculus
ttccttctcagtttctcccatatac

SEQ ID NO: 937875 - DNA, 25 bp, Mus musculus
ttccttctcatcaacacatacttaa

SEQ ID NO: 937876 - DNA, 25 bp, Mus musculus
ttccttctcatcacaaccttgtctt

SEQ ID NO: 937877 - DNA, 25 bp, Mus musculus
ttccttctcatcctagggaggtcat

SEQ ID NO: 937878 - DNA, 25 bp, Mus musculus
ttccttctcatcgtagggaggtcat

SEQ ID NO: 937879 - DNA, 25 bp, Mus musculus
ttccttctcatctacacatacttaa

SEQ ID NO: 937880 - DNA, 25 bp, Mus musculus
ttccttctcatctcaaccttgtctt

SEQ ID NO: 937881 - DNA, 25 bp, Mus musculus
ttccttctcattcaaatactttgtc

SEQ ID NO: 937882 - DNA, 25 bp, Mus musculus
ttccttctcattcaatattttctag

SEQ ID NO: 937883 - DNA, 25 bp, Mus musculus
ttccttctcattgaaatactttgtc

SEQ ID NO: 937884 - DNA, 25 bp, Mus musculus
ttccttctcattgaatattttctag

SEQ ID NO: 937885 - DNA, 25 bp, Mus musculus
ttccttctccatattgcaccaactc

SEQ ID NO: 937886 - DNA, 25 bp, Mus musculus
ttccttctccattttgcaccaactc

SEQ ID NO: 937887 - DNA, 25 bp, Mus musculus
ttccttctccctattgtggatattg

SEQ ID NO: 937888 - DNA, 25 bp, Mus musculus
ttccttctcccttttgtggatattg

SEQ ID NO: 937889 - DNA, 25 bp, Mus musculus
ttccttctcctcacctacatgtatt

SEQ ID NO: 937890 - DNA, 25 bp, Mus musculus
ttccttctcctctcctacatgtatt

SEQ ID NO: 937891 - DNA, 25 bp, Mus musculus
ttccttctcctgagtactcaactac

SEQ ID NO: 937892 - DNA, 25 bp, Mus musculus
ttccttctcctgtgtactcaactac

SEQ ID NO: 937893 - DNA, 25 bp, Mus musculus
ttccttctcgatagaaacattctga

SEQ ID NO: 937894 - DNA, 25 bp, Mus musculus
ttccttctcgattgaaacattctga

SEQ ID NO: 937895 - DNA, 25 bp, Mus musculus
ttccttctcgttatctggttagaac

SEQ ID NO: 937896 - DNA, 25 bp, Mus musculus
ttccttctcgttttctggttagaac

SEQ ID NO: 937897 - DNA, 25 bp, Mus musculus
ttccttctctatcggtcggcacaga

SEQ ID NO: 937898 - DNA, 25 bp, Mus musculus
ttccttctctatgggtcggcacaga

SEQ ID NO: 937899 - DNA, 25 bp, Mus musculus
ttccttctctcaattctttgtactt

SEQ ID NO: 937900 - DNA, 25 bp, Mus musculus
ttccttctctcatttctttgtactt

SEQ ID NO: 937901 - DNA, 25 bp, Mus musculus
ttccttctctcccaggaaagcggga

SEQ ID NO: 937902 - DNA, 25 bp, Mus musculus
ttccttctctccgaggaaagcggga

SEQ ID NO: 937903 - DNA, 25 bp, Mus musculus
ttccttctctctccacaaacaagtt

SEQ ID NO: 937904 - DNA, 25 bp, Mus musculus
ttccttctctctgcacaaacaagtt

SEQ ID NO: 937905 - DNA, 25 bp, Mus musculus
ttccttctctgtcactttcactttt

SEQ ID NO: 937906 - DNA, 25 bp, Mus musculus
ttccttctctgtgactttcactttt

SEQ ID NO: 937907 - DNA, 25 bp, Mus musculus
ttccttctcttcctactttgtacca

SEQ ID NO: 937908 - DNA, 25 bp, Mus musculus
ttccttctcttcgtactttgtacca

SEQ ID NO: 937909 - DNA, 25 bp, Mus musculus
ttccttctgactcgccttgtatcta

SEQ ID NO: 937910 - DNA, 25 bp, Mus musculus
ttccttctgactggccttgtatcta

SEQ ID NO: 937911 - DNA, 25 bp, Mus musculus
ttccttctgattagcctgcccatcc

SEQ ID NO: 937912 - DNA, 25 bp, Mus musculus
ttccttctgatttgcctgcccatcc

SEQ ID NO: 937913 - DNA, 25 bp, Mus musculus
ttccttctgggaaggccagcatcat

SEQ ID NO: 937914 - DNA, 25 bp, Mus musculus
ttccttctgggatggccagcatcat

SEQ ID NO: 937915 - DNA, 25 bp, Mus musculus
ttccttctggtcactcatgactgta

SEQ ID NO: 937916 - DNA, 25 bp, Mus musculus
ttccttctggtctctcatgactgta

SEQ ID NO: 937917 - DNA, 25 bp, Mus musculus
ttccttctggttcattttattcatt

SEQ ID NO: 937918 - DNA, 25 bp, Mus musculus
ttccttctggttgattttattcatt

SEQ ID NO: 937919 - DNA, 25 bp, Mus musculus
ttccttctgtggatccttatgccaa

SEQ ID NO: 937920 - DNA, 25 bp, Mus musculus
ttccttctgtggttccttatgccaa

SEQ ID NO: 937921 - DNA, 25 bp, Mus musculus
ttccttctgtttcctaattttccat

SEQ ID NO: 937922 - DNA, 25 bp, Mus musculus
ttccttctgtttctgggcatggtcc

SEQ ID NO: 937923 - DNA, 25 bp, Mus musculus
ttccttctgtttgctaattttccat

SEQ ID NO: 937924 - DNA, 25 bp, Mus musculus
ttccttctgtttgtgggcatggtcc

SEQ ID NO: 937925 - DNA, 25 bp, Mus musculus
ttccttcttaagagttctgcctctt

SEQ ID NO: 937926 - DNA, 25 bp, Mus musculus
ttccttcttaagtgttctgcctctt

SEQ ID NO: 937927 - DNA, 25 bp, Mus musculus
ttccttcttatcctgagattgtgag

SEQ ID NO: 937928 - DNA, 25 bp, Mus musculus
ttccttcttatcgtgagattgtgag

SEQ ID NO: 937929 - DNA, 25 bp, Mus musculus
ttccttcttcaacatcgtctattgg

SEQ ID NO: 937930 - DNA, 25 bp, Mus musculus
ttccttcttcaagatcgtctattgg

SEQ ID NO: 937931 - DNA, 25 bp, Mus musculus
ttccttcttcatcatgtggagtccc

SEQ ID NO: 937932 - DNA, 25 bp, Mus musculus
ttccttcttcatgatgtggagtccc

SEQ ID NO: 937933 - DNA, 25 bp, Mus musculus
ttccttcttccaagtgggttgtgga

SEQ ID NO: 937934 - DNA, 25 bp, Mus musculus
ttccttcttccatgtgggttgtgga

SEQ ID NO: 937935 - DNA, 25 bp, Mus musculus
ttccttcttcctatagctgcagaac

SEQ ID NO: 937936 - DNA, 25 bp, Mus musculus
ttccttcttcctttagctgcagaac

SEQ ID NO: 937937 - DNA, 25 bp, Mus musculus
ttccttcttctgcagactgcgatag

SEQ ID NO: 937938 - DNA, 25 bp, Mus musculus
ttccttcttctggagactgcgatag

SEQ ID NO: 937939 - DNA, 25 bp, Mus musculus
ttccttcttgaactcgagatggcag

SEQ ID NO: 937940 - DNA, 25 bp, Mus musculus
ttccttcttgaagtcgagatggcag

SEQ ID NO: 937941 - DNA, 25 bp, Mus musculus
ttccttcttggacggaccactcagt

SEQ ID NO: 937942 - DNA, 25 bp, Mus musculus
ttccttcttggagggaccactcagt

SEQ ID NO: 937943 - DNA, 25 bp, Mus musculus
ttccttctttacaggacattctgat

SEQ ID NO: 937944 - DNA, 25 bp, Mus musculus
ttccttctttactggacattctgat

SEQ ID NO: 937945 - DNA, 25 bp, Mus musculus
ttccttctttcaatcatactcagtt

SEQ ID NO: 937946 - DNA, 25 bp, Mus musculus
ttccttctttcattcatactcagtt

SEQ ID NO: 937947 - DNA, 25 bp, Mus musculus
ttccttctttccatcatgctgggta

SEQ ID NO: 937948 - DNA, 25 bp, Mus musculus
ttccttctttccttcatgctgggta

SEQ ID NO: 937949 - DNA, 25 bp, Mus musculus
ttccttcttttcctgtgataccgag

SEQ ID NO: 937950 - DNA, 25 bp, Mus musculus
ttccttcttttcgtgtgataccgag

SEQ ID NO: 937951 - DNA, 25 bp, Mus musculus
ttccttcttttgcttctcagcacgg

SEQ ID NO: 937952 - DNA, 25 bp, Mus musculus
ttccttcttttggttctcagcacgg

SEQ ID NO: 937953 - DNA, 25 bp, Mus musculus
ttccttctttttcatcggtggttga

SEQ ID NO: 937954 - DNA, 25 bp, Mus musculus
ttccttctttttgatcggtggttga

SEQ ID NO: 937955 - DNA, 25 bp, Mus musculus
ttccttgaaggtcggcttgacttaa

SEQ ID NO: 937956 - DNA, 25 bp, Mus musculus
ttccttgaaggtgggcttgacttaa

SEQ ID NO: 937957 - DNA, 25 bp, Mus musculus
ttccttgaataaacactacgcatca

SEQ ID NO: 937958 - DNA, 25 bp, Mus musculus
ttccttgaataatcactacgcatca

SEQ ID NO: 937959 - DNA, 25 bp, Mus musculus
ttccttgaatgtagagcctgcccag

SEQ ID NO: 937960 - DNA, 25 bp, Mus musculus
ttccttgaatgttgagcctgcccag

SEQ ID NO: 937961 - DNA, 25 bp, Mus musculus
ttccttgacattcacattcctgtgc

SEQ ID NO: 937962 - DNA, 25 bp, Mus musculus
ttccttgacattgacattcctgtgc

SEQ ID NO: 937963 - DNA, 25 bp, Mus musculus
ttccttgaccatatgccttgagtgg

SEQ ID NO: 937964 - DNA, 25 bp, Mus musculus
ttccttgaccatttgccttgagtgg

SEQ ID NO: 937965 - DNA, 25 bp, Mus musculus
ttccttgacgtcacctcaatgaggg

SEQ ID NO: 937966 - DNA, 25 bp, Mus musculus
ttccttgacgtctcctcaatgaggg

SEQ ID NO: 937967 - DNA, 25 bp, Mus musculus
ttccttgagatgctcagtttagctt

SEQ ID NO: 937968 - DNA, 25 bp, Mus musculus
ttccttgagatggtcagtttagctt

SEQ ID NO: 937969 - DNA, 25 bp, Mus musculus
ttccttgagctgatgctgtacccct

SEQ ID NO: 937970 - DNA, 25 bp, Mus musculus
ttccttgagctgttgctgtacccct

SEQ ID NO: 937971 - DNA, 25 bp, Mus musculus
ttccttgaggatagaaagcttttgt

SEQ ID NO: 937972 - DNA, 25 bp, Mus musculus
ttccttgaggattgaaagcttttgt

SEQ ID NO: 937973 - DNA, 25 bp, Mus musculus
ttccttgagggcaacgctggcatag

SEQ ID NO: 937974 - DNA, 25 bp, Mus musculus
ttccttgagggctacgctggcatag

SEQ ID NO: 937975 - DNA, 25 bp, Mus musculus
ttccttgagtatcactacagcaatg

SEQ ID NO: 937976 - DNA, 25 bp, Mus musculus
ttccttgagtatgactacagcaatg

SEQ ID NO: 937977 - DNA, 25 bp, Mus musculus
ttccttgataacaatctgttcctga

SEQ ID NO: 937978 - DNA, 25 bp, Mus musculus
ttccttgataactatctgttcctga

SEQ ID NO: 937979 - DNA, 25 bp, Mus musculus
ttccttgatgaactcactagtctct

SEQ ID NO: 937980 - DNA, 25 bp, Mus musculus
ttccttgatgaagtcactagtctct

SEQ ID NO: 937981 - DNA, 25 bp, Mus musculus
ttccttgatggtagagcttgaggga

SEQ ID NO: 937982 - DNA, 25 bp, Mus musculus
ttccttgatggttgagcttgaggga

SEQ ID NO: 937983 - DNA, 25 bp, Mus musculus
ttccttgcaactcgagctcagagct

SEQ ID NO: 937984 - DNA, 25 bp, Mus musculus
ttccttgcaactggagctcagagct

SEQ ID NO: 937985 - DNA, 25 bp, Mus musculus
ttccttgcagcaagtgaatcccata

SEQ ID NO: 937986 - DNA, 25 bp, Mus musculus
ttccttgcagcatgtgaatcccata

SEQ ID NO: 937987 - DNA, 25 bp, Mus musculus
ttccttgcaggcagggccaggccag

SEQ ID NO: 937988 - DNA, 25 bp, Mus musculus
ttccttgcaggctgggccaggccag

SEQ ID NO: 937989 - DNA, 25 bp, Mus musculus
ttccttgcatagagacggtctccag

SEQ ID NO: 937990 - DNA, 25 bp, Mus musculus
ttccttgcatagtgacggtctccag

SEQ ID NO: 937991 - DNA, 25 bp, Mus musculus
ttccttgcatgaactgtccgtgaca

SEQ ID NO: 937992 - DNA, 25 bp, Mus musculus
ttccttgcatgatctgtccgtgaca

SEQ ID NO: 937993 - DNA, 25 bp, Mus musculus
ttccttgcccacatactaggatgat

SEQ ID NO: 937994 - DNA, 25 bp, Mus musculus
ttccttgcccacttactaggatgat

SEQ ID NO: 937995 - DNA, 25 bp, Mus musculus
ttccttgcccagatagggtcccctt

SEQ ID NO: 937996 - DNA, 25 bp, Mus musculus
ttccttgcccagttagggtcccctt

SEQ ID NO: 937997 - DNA, 25 bp, Mus musculus
ttccttgccttcacacactataacc

SEQ ID NO: 937998 - DNA, 25 bp, Mus musculus
ttccttgccttctcacactataacc

SEQ ID NO: 937999 - DNA, 25 bp, Mus musculus
ttccttgccttgattgcccatatct

SEQ ID NO: 938000 - DNA, 25 bp, Mus musculus
ttccttgccttgtttgcccatatct

SEQ ID NO: 938001 - DNA, 25 bp, Mus musculus
ttccttgcgtgccaggcaagtttta

SEQ ID NO: 938002 - DNA, 25 bp, Mus musculus
ttccttgcgtgcgaggcaagtttta

SEQ ID NO: 938003 - DNA, 25 bp, Mus musculus
ttccttgctccccagagtttatcaa

SEQ ID NO: 938004 - DNA, 25 bp, Mus musculus
ttccttgctcccgagagtttatcaa

SEQ ID NO: 938005 - DNA, 25 bp, Mus musculus
ttccttgctcttcctcgactggtat

SEQ ID NO: 938006 - DNA, 25 bp, Mus musculus
ttccttgctcttgctcgactggtat

SEQ ID NO: 938007 - DNA, 25 bp, Mus musculus
ttccttgcttaccacattgttaact

SEQ ID NO: 938008 - DNA, 25 bp, Mus musculus
ttccttgcttacgacattgttaact

SEQ ID NO: 938009 - DNA, 25 bp, Mus musculus
ttccttggaaaccaggagatgccat

SEQ ID NO: 938010 - DNA, 25 bp, Mus musculus
ttccttggaaacgaggagatgccat

SEQ ID NO: 938011 - DNA, 25 bp, Mus musculus
ttccttggaactcctaagaatggcc

SEQ ID NO: 938012 - DNA, 25 bp, Mus musculus
ttccttggaactgctaagaatggcc

SEQ ID NO: 938013 - DNA, 25 bp, Mus musculus
ttccttggaggaagtagactctaga

SEQ ID NO: 938014 - DNA, 25 bp, Mus musculus
ttccttggaggatgtagactctaga

SEQ ID NO: 938015 - DNA, 25 bp, Mus musculus
ttccttggatcgaaacagaaccgtt

SEQ ID NO: 938016 - DNA, 25 bp, Mus musculus
ttccttggatcgtaacagaaccgtt

SEQ ID NO: 938017 - DNA, 25 bp, Mus musculus
ttccttggcaggcagcgagacacag

SEQ ID NO: 938018 - DNA, 25 bp, Mus musculus
ttccttggcagggagcgagacacag

SEQ ID NO: 938019 - DNA, 25 bp, Mus musculus
ttccttggcagtattgaagtagaac

SEQ ID NO: 938020 - DNA, 25 bp, Mus musculus
ttccttggcagttttgaagtagaac

SEQ ID NO: 938021 - DNA, 25 bp, Mus musculus
ttccttggccatcacttaaaagcag

SEQ ID NO: 938022 - DNA, 25 bp, Mus musculus
ttccttggccatgacttaaaagcag

SEQ ID NO: 938023 - DNA, 25 bp, Mus musculus
ttccttggctagctccgattctgct

SEQ ID NO: 938024 - DNA, 25 bp, Mus musculus
ttccttggctaggtccgattctgct

SEQ ID NO: 938025 - DNA, 25 bp, Mus musculus
ttccttggcttgaggttccctcaaa

SEQ ID NO: 938026 - DNA, 25 bp, Mus musculus
ttccttggcttgtggttccctcaaa

SEQ ID NO: 938027 - DNA, 25 bp, Mus musculus
ttccttggctttaatcatgctaata

SEQ ID NO: 938028 - DNA, 25 bp, Mus musculus
ttccttggcttttatcatgctaata

SEQ ID NO: 938029 - DNA, 25 bp, Mus musculus
ttccttgggaacatggtgtctctgt

SEQ ID NO: 938030 - DNA, 25 bp, Mus musculus
ttccttgggaacttggtgtctctgt

SEQ ID NO: 938031 - DNA, 25 bp, Mus musculus
ttccttgggagtctgtcctcaggga

SEQ ID NO: 938032 - DNA, 25 bp, Mus musculus
ttccttgggagtgtgtcctcaggga

SEQ ID NO: 938033 - DNA, 25 bp, Mus musculus
ttccttgggcccaacctaaaagatg

SEQ ID NO: 938034 - DNA, 25 bp, Mus musculus
ttccttgggccctacctaaaagatg

SEQ ID NO: 938035 - DNA, 25 bp, Mus musculus
ttccttggtctcaattcttcgctga

SEQ ID NO: 938036 - DNA, 25 bp, Mus musculus
ttccttggtctctattcttcgctga

SEQ ID NO: 938037 - DNA, 25 bp, Mus musculus
ttccttggtgcgaatgccgtacgcg

SEQ ID NO: 938038 - DNA, 25 bp, Mus musculus
ttccttggtgcgtatgccgtacgcg

SEQ ID NO: 938039 - DNA, 25 bp, Mus musculus
ttccttggtttcagtggtagctaaa

SEQ ID NO: 938040 - DNA, 25 bp, Mus musculus
ttccttggtttcattgctgactcaa

SEQ ID NO: 938041 - DNA, 25 bp, Mus musculus
ttccttggtttctgtggtagctaaa

SEQ ID NO: 938042 - DNA, 25 bp, Mus musculus
ttccttggtttctttgctgactcaa

SEQ ID NO: 938043 - DNA, 25 bp, Mus musculus
ttccttggtttgaatgaccacccct

SEQ ID NO: 938044 - DNA, 25 bp, Mus musculus
ttccttggtttgtatgaccacccct

SEQ ID NO: 938045 - DNA, 25 bp, Mus musculus
ttccttgtaaagaaaatcctatggg

SEQ ID NO: 938046 - DNA, 25 bp, Mus musculus
ttccttgtaaagtaaatcctatggg

SEQ ID NO: 938047 - DNA, 25 bp, Mus musculus
ttccttgtaccgagttttctctttg

SEQ ID NO: 938048 - DNA, 25 bp, Mus musculus
ttccttgtaccgtgttttctctttg

SEQ ID NO: 938049 - DNA, 25 bp, Mus musculus
ttccttgtcccacactttttagata

SEQ ID NO: 938050 - DNA, 25 bp, Mus musculus
ttccttgtcccagactttttagata

SEQ ID NO: 938051 - DNA, 25 bp, Mus musculus
ttccttgtccctcaatctgaaagaa

SEQ ID NO: 938052 - DNA, 25 bp, Mus musculus
ttccttgtccctgaatctgaaagaa

SEQ ID NO: 938053 - DNA, 25 bp, Mus musculus
ttccttgtcctcagtgggcttctag

SEQ ID NO: 938054 - DNA, 25 bp, Mus musculus
ttccttgtcctctgtgggcttctag

SEQ ID NO: 938055 - DNA, 25 bp, Mus musculus
ttccttgtgaaaacaccttgaactt

SEQ ID NO: 938056 - DNA, 25 bp, Mus musculus
ttccttgtgaaatcaccttgaactt

SEQ ID NO: 938057 - DNA, 25 bp, Mus musculus
ttccttgtgaagatgatatactatt

SEQ ID NO: 938058 - DNA, 25 bp, Mus musculus
ttccttgtgaagttgatatactatt

SEQ ID NO: 938059 - DNA, 25 bp, Mus musculus
ttccttgtgaatcttatttggtatt

SEQ ID NO: 938060 - DNA, 25 bp, Mus musculus
ttccttgtgaatgttatttggtatt

SEQ ID NO: 938061 - DNA, 25 bp, Mus musculus
ttccttgtgactatcattccttggg

SEQ ID NO: 938062 - DNA, 25 bp, Mus musculus
ttccttgtgactttcattccttggg

SEQ ID NO: 938063 - DNA, 25 bp, Mus musculus
ttccttgtgcagagctagggcccta

SEQ ID NO: 938064 - DNA, 25 bp, Mus musculus
ttccttgtgcagtgctagggcccta

SEQ ID NO: 938065 - DNA, 25 bp, Mus musculus
ttccttgtggaacctctgtgcttct

SEQ ID NO: 938066 - DNA, 25 bp, Mus musculus
ttccttgtggaagctctgtgcttct

SEQ ID NO: 938067 - DNA, 25 bp, Mus musculus
ttccttgtggctctccattagatgc

SEQ ID NO: 938068 - DNA, 25 bp, Mus musculus
ttccttgtggctgtccattagatgc

SEQ ID NO: 938069 - DNA, 25 bp, Mus musculus
ttccttgtgttgactgctttgatgt

SEQ ID NO: 938070 - DNA, 25 bp, Mus musculus
ttccttgtgttgaggatggaagcta

SEQ ID NO: 938071 - DNA, 25 bp, Mus musculus
ttccttgtgttgtctgctttgatgt

SEQ ID NO: 938072 - DNA, 25 bp, Mus musculus
ttccttgtgttgtggatggaagcta

SEQ ID NO: 938073 - DNA, 25 bp, Mus musculus
ttccttgttactcttgtggtgtgga

SEQ ID NO: 938074 - DNA, 25 bp, Mus musculus
ttccttgttactgttgtggtgtgga

SEQ ID NO: 938075 - DNA, 25 bp, Mus musculus
ttccttgttagcagtgcttgtattg

SEQ ID NO: 938076 - DNA, 25 bp, Mus musculus
ttccttgttagctgtgcttgtattg

SEQ ID NO: 938077 - DNA, 25 bp, Mus musculus
ttccttgttcacagacactgtggca

SEQ ID NO: 938078 - DNA, 25 bp, Mus musculus
ttccttgttcactgacactgtggca

SEQ ID NO: 938079 - DNA, 25 bp, Mus musculus
ttccttgttcgaaagctgcaggttt

SEQ ID NO: 938080 - DNA, 25 bp, Mus musculus
ttccttgttcgaagatgcaccccat

SEQ ID NO: 938081 - DNA, 25 bp, Mus musculus
ttccttgttcgatagctgcaggttt

SEQ ID NO: 938082 - DNA, 25 bp, Mus musculus
ttccttgttcgatgatgcaccccat

SEQ ID NO: 938083 - DNA, 25 bp, Mus musculus
ttccttgtttagagactggactcga

SEQ ID NO: 938084 - DNA, 25 bp, Mus musculus
ttccttgtttagtgactggactcga

SEQ ID NO: 938085 - DNA, 25 bp, Mus musculus
ttccttgtttctattgacacatatt

SEQ ID NO: 938086 - DNA, 25 bp, Mus musculus
ttccttgtttcttttgacacatatt

SEQ ID NO: 938087 - DNA, 25 bp, Mus musculus
ttcctttaaaaacttgcatactgca

SEQ ID NO: 938088 - DNA, 25 bp, Mus musculus
ttcctttaaaaagttgcatactgca

SEQ ID NO: 938089 - DNA, 25 bp, Mus musculus
ttcctttaactaagattggtgtgct

SEQ ID NO: 938090 - DNA, 25 bp, Mus musculus
ttcctttaactatgattggtgtgct

SEQ ID NO: 938091 - DNA, 25 bp, Mus musculus
ttcctttacaagcacaactcagttc

SEQ ID NO: 938092 - DNA, 25 bp, Mus musculus
ttcctttacaaggacaactcagttc

SEQ ID NO: 938093 - DNA, 25 bp, Mus musculus
ttcctttacccaacagaaacctgtg

SEQ ID NO: 938094 - DNA, 25 bp, Mus musculus
ttcctttacccaatgtagctgatat

SEQ ID NO: 938095 - DNA, 25 bp, Mus musculus
ttcctttacccacatgtgtttctct

SEQ ID NO: 938096 - DNA, 25 bp, Mus musculus
ttcctttacccagatgtgtttctct

SEQ ID NO: 938097 - DNA, 25 bp, Mus musculus
ttcctttacccatcagaaacctgtg

SEQ ID NO: 938098 - DNA, 25 bp, Mus musculus
ttcctttacccattgtagctgatat

SEQ ID NO: 938099 - DNA, 25 bp, Mus musculus
ttcctttacctcagtacactggtga

SEQ ID NO: 938100 - DNA, 25 bp, Mus musculus
ttcctttacctctgtacactggtga

SEQ ID NO: 938101 - DNA, 25 bp, Mus musculus
ttcctttactataaatcgctcccct

SEQ ID NO: 938102 - DNA, 25 bp, Mus musculus
ttcctttactattaatcgctcccct

SEQ ID NO: 938103 - DNA, 25 bp, Mus musculus
ttcctttactccaaataacctgtat

SEQ ID NO: 938104 - DNA, 25 bp, Mus musculus
ttcctttactcctaataacctgtat

SEQ ID NO: 938105 - DNA, 25 bp, Mus musculus
ttcctttactggacttgggcagtgc

SEQ ID NO: 938106 - DNA, 25 bp, Mus musculus
ttcctttactggtcttgggcagtgc

SEQ ID NO: 938107 - DNA, 25 bp, Mus musculus
ttcctttagacaatccaagagaaat

SEQ ID NO: 938108 - DNA, 25 bp, Mus musculus
ttcctttagacattccaagagaaat

SEQ ID NO: 938109 - DNA, 25 bp, Mus musculus
ttcctttagggtcatattcctcaga

SEQ ID NO: 938110 - DNA, 25 bp, Mus musculus
ttcctttagggtgatattcctcaga

SEQ ID NO: 938111 - DNA, 25 bp, Mus musculus
ttcctttagtgacgcttaacgccct

SEQ ID NO: 938112 - DNA, 25 bp, Mus musculus
ttcctttagtgaggcttaacgccct

SEQ ID NO: 938113 - DNA, 25 bp, Mus musculus
ttcctttataaccacaggcacagag

SEQ ID NO: 938114 - DNA, 25 bp, Mus musculus
ttcctttataacgacaggcacagag

SEQ ID NO: 938115 - DNA, 25 bp, Mus musculus
ttcctttataccaaacctctcagat

SEQ ID NO: 938116 - DNA, 25 bp, Mus musculus
ttcctttatacctaacctctcagat

SEQ ID NO: 938117 - DNA, 25 bp, Mus musculus
ttcctttatctcagtttccttcaaa

SEQ ID NO: 938118 - DNA, 25 bp, Mus musculus
ttcctttatctctgtttccttcaaa

SEQ ID NO: 938119 - DNA, 25 bp, Mus musculus
ttcctttatctgacatcatctacta

SEQ ID NO: 938120 - DNA, 25 bp, Mus musculus
ttcctttatctgtcatcatctacta

SEQ ID NO: 938121 - DNA, 25 bp, Mus musculus
ttcctttcaagaacgtggtccagag

SEQ ID NO: 938122 - DNA, 25 bp, Mus musculus
ttcctttcaagatcgtggtccagag

SEQ ID NO: 938123 - DNA, 25 bp, Mus musculus
ttcctttcaatcaggagagtgagac

SEQ ID NO: 938124 - DNA, 25 bp, Mus musculus
ttcctttcaatctggagagtgagac

SEQ ID NO: 938125 - DNA, 25 bp, Mus musculus
ttcctttcaattagtcaaatgttga

SEQ ID NO: 938126 - DNA, 25 bp, Mus musculus
ttcctttcaatttgtcaaatgttga

SEQ ID NO: 938127 - DNA, 25 bp, Mus musculus
ttcctttcactaatatccgggtagg

SEQ ID NO: 938128 - DNA, 25 bp, Mus musculus
ttcctttcactattatccgggtagg

SEQ ID NO: 938129 - DNA, 25 bp, Mus musculus
ttcctttcccaaatggataccaatc

SEQ ID NO: 938130 - DNA, 25 bp, Mus musculus
ttcctttcccaattggataccaatc

SEQ ID NO: 938131 - DNA, 25 bp, Mus musculus
ttcctttccctactgtacacggaga

SEQ ID NO: 938132 - DNA, 25 bp, Mus musculus
ttcctttccctagtgtacacggaga

SEQ ID NO: 938133 - DNA, 25 bp, Mus musculus
ttcctttccctgaaggcaataaatg

SEQ ID NO: 938134 - DNA, 25 bp, Mus musculus
ttcctttccctgtaggcaataaatg

SEQ ID NO: 938135 - DNA, 25 bp, Mus musculus
ttcctttcctcacacttatttgatt

SEQ ID NO: 938136 - DNA, 25 bp, Mus musculus
ttcctttcctcaccaccagggtggg

SEQ ID NO: 938137 - DNA, 25 bp, Mus musculus
ttcctttcctcactgggctttagaa

SEQ ID NO: 938138 - DNA, 25 bp, Mus musculus
ttcctttcctcagacttatttgatt

SEQ ID NO: 938139 - DNA, 25 bp, Mus musculus
ttcctttcctcagcaccagggtggg

SEQ ID NO: 938140 - DNA, 25 bp, Mus musculus
ttcctttcctcagtgggctttagaa

SEQ ID NO: 938141 - DNA, 25 bp, Mus musculus
ttcctttcctgtatgcaaccttgct

SEQ ID NO: 938142 - DNA, 25 bp, Mus musculus
ttcctttcctgtttgcaaccttgct

SEQ ID NO: 938143 - DNA, 25 bp, Mus musculus
ttcctttccttgatggagccctgga

SEQ ID NO: 938144 - DNA, 25 bp, Mus musculus
ttcctttccttgttggagccctgga

SEQ ID NO: 938145 - DNA, 25 bp, Mus musculus
ttcctttcctttcatatgggtatca

SEQ ID NO: 938146 - DNA, 25 bp, Mus musculus
ttcctttcctttgatatgggtatca

SEQ ID NO: 938147 - DNA, 25 bp, Mus musculus
ttcctttcgaatcgcactaccttag

SEQ ID NO: 938148 - DNA, 25 bp, Mus musculus
ttcctttcgaatggcactaccttag

SEQ ID NO: 938149 - DNA, 25 bp, Mus musculus
ttcctttcgaggagtaccacgtaca

SEQ ID NO: 938150 - DNA, 25 bp, Mus musculus
ttcctttcgaggtgtaccacgtaca

SEQ ID NO: 938151 - DNA, 25 bp, Mus musculus
ttcctttcgcatagggctccaatat

SEQ ID NO: 938152 - DNA, 25 bp, Mus musculus
ttcctttcgcattgggctccaatat

SEQ ID NO: 938153 - DNA, 25 bp, Mus musculus
ttcctttctagaactccagtgtgag

SEQ ID NO: 938154 - DNA, 25 bp, Mus musculus
ttcctttctagatctccagtgtgag

SEQ ID NO: 938155 - DNA, 25 bp, Mus musculus
ttcctttctcatatgcatgggtgtg

SEQ ID NO: 938156 - DNA, 25 bp, Mus musculus
ttcctttctcatatgtgtgataggt

SEQ ID NO: 938157 - DNA, 25 bp, Mus musculus
ttcctttctcatttgcatgggtgtg

SEQ ID NO: 938158 - DNA, 25 bp, Mus musculus
ttcctttctcatttgtgtgataggt

SEQ ID NO: 938159 - DNA, 25 bp, Mus musculus
ttcctttctctcaaatttgtcacaa

SEQ ID NO: 938160 - DNA, 25 bp, Mus musculus
ttcctttctctctaatttgtcacaa

SEQ ID NO: 938161 - DNA, 25 bp, Mus musculus
ttcctttctctgatgcactatgaat

SEQ ID NO: 938162 - DNA, 25 bp, Mus musculus
ttcctttctctgttgcactatgaat

SEQ ID NO: 938163 - DNA, 25 bp, Mus musculus
ttcctttctggccagttcaccaaaa

SEQ ID NO: 938164 - DNA, 25 bp, Mus musculus
ttcctttctggcgagttcaccaaaa

SEQ ID NO: 938165 - DNA, 25 bp, Mus musculus
ttcctttctggtatggaatgccatc

SEQ ID NO: 938166 - DNA, 25 bp, Mus musculus
ttcctttctggtttggaatgccatc

SEQ ID NO: 938167 - DNA, 25 bp, Mus musculus
ttcctttctgtcctggccttaaagt

SEQ ID NO: 938168 - DNA, 25 bp, Mus musculus
ttcctttctgtcgtggccttaaagt

SEQ ID NO: 938169 - DNA, 25 bp, Mus musculus
ttcctttcttcaagcagaacctctg

SEQ ID NO: 938170 - DNA, 25 bp, Mus musculus
ttcctttcttcatgcagaacctctg

SEQ ID NO: 938171 - DNA, 25 bp, Mus musculus
ttcctttcttcccaggtagacagta

SEQ ID NO: 938172 - DNA, 25 bp, Mus musculus
ttcctttcttccgaggtagacagta

SEQ ID NO: 938173 - DNA, 25 bp, Mus musculus
ttcctttcttctctgattttgtcta

SEQ ID NO: 938174 - DNA, 25 bp, Mus musculus
ttcctttcttctgtgattttgtcta

SEQ ID NO: 938175 - DNA, 25 bp, Mus musculus
ttcctttgacacaacgcacttttat

SEQ ID NO: 938176 - DNA, 25 bp, Mus musculus
ttcctttgacactacgcacttttat

SEQ ID NO: 938177 - DNA, 25 bp, Mus musculus
ttcctttgactacccaacatccaga

SEQ ID NO: 938178 - DNA, 25 bp, Mus musculus
ttcctttgactagccaacatccaga

SEQ ID NO: 938179 - DNA, 25 bp, Mus musculus
ttcctttgactgacacaggccatgt

SEQ ID NO: 938180 - DNA, 25 bp, Mus musculus
ttcctttgactgtcacaggccatgt

SEQ ID NO: 938181 - DNA, 25 bp, Mus musculus
ttcctttgagcacgcatcttcggga

SEQ ID NO: 938182 - DNA, 25 bp, Mus musculus
ttcctttgagcaggcatcttcggga

SEQ ID NO: 938183 - DNA, 25 bp, Mus musculus
ttcctttgatggctccccgcttctt

SEQ ID NO: 938184 - DNA, 25 bp, Mus musculus
ttcctttgatgggtccccgcttctt

SEQ ID NO: 938185 - DNA, 25 bp, Mus musculus
ttcctttgattactggattgctcca

SEQ ID NO: 938186 - DNA, 25 bp, Mus musculus
ttcctttgattagtggattgctcca

SEQ ID NO: 938187 - DNA, 25 bp, Mus musculus
ttcctttgcaaaataaatggtggct

SEQ ID NO: 938188 - DNA, 25 bp, Mus musculus
ttcctttgcaaattaaatggtggct

SEQ ID NO: 938189 - DNA, 25 bp, Mus musculus
ttcctttgcatcactttgactttgg

SEQ ID NO: 938190 - DNA, 25 bp, Mus musculus
ttcctttgcatctctttgactttgg

SEQ ID NO: 938191 - DNA, 25 bp, Mus musculus
ttcctttgccaacccctgagataaa

SEQ ID NO: 938192 - DNA, 25 bp, Mus musculus
ttcctttgccaagccctgagataaa

SEQ ID NO: 938193 - DNA, 25 bp, Mus musculus
ttcctttgccagaggtgttgaagcc

SEQ ID NO: 938194 - DNA, 25 bp, Mus musculus
ttcctttgccagtggtgttgaagcc

SEQ ID NO: 938195 - DNA, 25 bp, Mus musculus
ttcctttgcccaagatcatgcatac

SEQ ID NO: 938196 - DNA, 25 bp, Mus musculus
ttcctttgcccaatgacctttgtaa

SEQ ID NO: 938197 - DNA, 25 bp, Mus musculus
ttcctttgcccaatttggttggttg

SEQ ID NO: 938198 - DNA, 25 bp, Mus musculus
ttcctttgcccatgatcatgcatac

SEQ ID NO: 938199 - DNA, 25 bp, Mus musculus
ttcctttgcccattgacctttgtaa

SEQ ID NO: 938200 - DNA, 25 bp, Mus musculus
ttcctttgcccattttggttggttg

SEQ ID NO: 938201 - DNA, 25 bp, Mus musculus
ttcctttgctgcaacttcatttgtt

SEQ ID NO: 938202 - DNA, 25 bp, Mus musculus
ttcctttgctgctacttcatttgtt

SEQ ID NO: 938203 - DNA, 25 bp, Mus musculus
ttcctttgctgtcgagagctggagc

SEQ ID NO: 938204 - DNA, 25 bp, Mus musculus
ttcctttgctgtggagagctggagc

SEQ ID NO: 938205 - DNA, 25 bp, Mus musculus
ttcctttgcttccacagttttcatt

SEQ ID NO: 938206 - DNA, 25 bp, Mus musculus
ttcctttgcttcgacagttttcatt

SEQ ID NO: 938207 - DNA, 25 bp, Mus musculus
ttcctttggaacctctgctctttag

SEQ ID NO: 938208 - DNA, 25 bp, Mus musculus
ttcctttggaacgtctgctctttag

SEQ ID NO: 938209 - DNA, 25 bp, Mus musculus
ttcctttgggaactgcgactgtact

SEQ ID NO: 938210 - DNA, 25 bp, Mus musculus
ttcctttgggaagtgcgactgtact

SEQ ID NO: 938211 - DNA, 25 bp, Mus musculus
ttcctttgggccacaaactacagat

SEQ ID NO: 938212 - DNA, 25 bp, Mus musculus
ttcctttgggcctcaaactacagat

SEQ ID NO: 938213 - DNA, 25 bp, Mus musculus
ttcctttgggtaatggtagtctgct

SEQ ID NO: 938214 - DNA, 25 bp, Mus musculus
ttcctttgggtattggtagtctgct

SEQ ID NO: 938215 - DNA, 25 bp, Mus musculus
ttcctttggtgtacatgttcatgca

SEQ ID NO: 938216 - DNA, 25 bp, Mus musculus
ttcctttggtgttcatgttcatgca

SEQ ID NO: 938217 - DNA, 25 bp, Mus musculus
ttcctttgtactctttggactaaag

SEQ ID NO: 938218 - DNA, 25 bp, Mus musculus
ttcctttgtactgtttggactaaag

SEQ ID NO: 938219 - DNA, 25 bp, Mus musculus
ttcctttgtcccacaagttctgtgg

SEQ ID NO: 938220 - DNA, 25 bp, Mus musculus
ttcctttgtccctcaagttctgtgg

SEQ ID NO: 938221 - DNA, 25 bp, Mus musculus
ttcctttgtctcctatttcatttgt

SEQ ID NO: 938222 - DNA, 25 bp, Mus musculus
ttcctttgtctcgtatttcatttgt

SEQ ID NO: 938223 - DNA, 25 bp, Mus musculus
ttcctttgtgacatccttcttgatt

SEQ ID NO: 938224 - DNA, 25 bp, Mus musculus
ttcctttgtgacttccttcttgatt

SEQ ID NO: 938225 - DNA, 25 bp, Mus musculus
ttcctttgtgatatgctcaaccagg

SEQ ID NO: 938226 - DNA, 25 bp, Mus musculus
ttcctttgtgatttgctcaaccagg

SEQ ID NO: 938227 - DNA, 25 bp, Mus musculus
ttcctttgttcaagtaaatccaaca

SEQ ID NO: 938228 - DNA, 25 bp, Mus musculus
ttcctttgttcatgtaaatccaaca

SEQ ID NO: 938229 - DNA, 25 bp, Mus musculus
ttcctttgttcccagtactcagtga

SEQ ID NO: 938230 - DNA, 25 bp, Mus musculus
ttcctttgttccgagtactcagtga

SEQ ID NO: 938231 - DNA, 25 bp, Mus musculus
ttcctttgttgtattctgtaatata

SEQ ID NO: 938232 - DNA, 25 bp, Mus musculus
ttcctttgttgttttctgtaatata

SEQ ID NO: 938233 - DNA, 25 bp, Mus musculus
ttccttttcaagaacaatgacagag

SEQ ID NO: 938234 - DNA, 25 bp, Mus musculus
ttccttttcaagtacaatgacagag

SEQ ID NO: 938235 - DNA, 25 bp, Mus musculus
ttccttttcaccaaacgacacgatg

SEQ ID NO: 938236 - DNA, 25 bp, Mus musculus
ttccttttcacctaacgacacgatg

SEQ ID NO: 938237 - DNA, 25 bp, Mus musculus
ttccttttcccaagattcttgacag

SEQ ID NO: 938238 - DNA, 25 bp, Mus musculus
ttccttttcccatgattcttgacag

SEQ ID NO: 938239 - DNA, 25 bp, Mus musculus
ttccttttcctgcaggcaagcaatg

SEQ ID NO: 938240 - DNA, 25 bp, Mus musculus
ttccttttcctggaggcaagcaatg

SEQ ID NO: 938241 - DNA, 25 bp, Mus musculus
ttccttttctaaagaaccctcagct

SEQ ID NO: 938242 - DNA, 25 bp, Mus musculus
ttccttttctaatgaaccctcagct

SEQ ID NO: 938243 - DNA, 25 bp, Mus musculus
ttccttttctcaacatcagtgctgt

SEQ ID NO: 938244 - DNA, 25 bp, Mus musculus
ttccttttctcatcatcagtgctgt

SEQ ID NO: 938245 - DNA, 25 bp, Mus musculus
ttccttttctgactgctctgcatga

SEQ ID NO: 938246 - DNA, 25 bp, Mus musculus
ttccttttctgagtgctctgcatga

SEQ ID NO: 938247 - DNA, 25 bp, Mus musculus
ttccttttctgcaaacagccacaag

SEQ ID NO: 938248 - DNA, 25 bp, Mus musculus
ttccttttctgctaacagccacaag

SEQ ID NO: 938249 - DNA, 25 bp, Mus musculus
ttccttttctggagactccttgaga

SEQ ID NO: 938250 - DNA, 25 bp, Mus musculus
ttccttttctggtgactccttgaga

SEQ ID NO: 938251 - DNA, 25 bp, Mus musculus
ttccttttcttccaactaccatgat

SEQ ID NO: 938252 - DNA, 25 bp, Mus musculus
ttccttttcttcgaactaccatgat

SEQ ID NO: 938253 - DNA, 25 bp, Mus musculus
ttccttttgaccaagttgcctgaga

SEQ ID NO: 938254 - DNA, 25 bp, Mus musculus
ttccttttgacctagttgcctgaga

SEQ ID NO: 938255 - DNA, 25 bp, Mus musculus
ttccttttgatgctgatagtctcta

SEQ ID NO: 938256 - DNA, 25 bp, Mus musculus
ttccttttgatggtgatagtctcta

SEQ ID NO: 938257 - DNA, 25 bp, Mus musculus
ttccttttgattcttcagaagcacc

SEQ ID NO: 938258 - DNA, 25 bp, Mus musculus
ttccttttgattgttcagaagcacc

SEQ ID NO: 938259 - DNA, 25 bp, Mus musculus
ttccttttgcacagtttgcccagat

SEQ ID NO: 938260 - DNA, 25 bp, Mus musculus
ttccttttgcactgtttgcccagat

SEQ ID NO: 938261 - DNA, 25 bp, Mus musculus
ttccttttgcccctcatattgaaga

SEQ ID NO: 938262 - DNA, 25 bp, Mus musculus
ttccttttgcccgtcatattgaaga

SEQ ID NO: 938263 - DNA, 25 bp, Mus musculus
ttccttttgcttacacacggaattt

SEQ ID NO: 938264 - DNA, 25 bp, Mus musculus
ttccttttgctttcacacggaattt

SEQ ID NO: 938265 - DNA, 25 bp, Mus musculus
ttccttttggatatacggagtgcca

SEQ ID NO: 938266 - DNA, 25 bp, Mus musculus
ttccttttggatttacggagtgcca

SEQ ID NO: 938267 - DNA, 25 bp, Mus musculus
ttccttttgggtctattttgctaag

SEQ ID NO: 938268 - DNA, 25 bp, Mus musculus
ttccttttgggtgtattttgctaag

SEQ ID NO: 938269 - DNA, 25 bp, Mus musculus
ttcctttttaagacactgtgatata

SEQ ID NO: 938270 - DNA, 25 bp, Mus musculus
ttcctttttaagtcactgtgatata

SEQ ID NO: 938271 - DNA, 25 bp, Mus musculus
ttcctttttataatctccactctgc

SEQ ID NO: 938272 - DNA, 25 bp, Mus musculus
ttcctttttatattctccactctgc

SEQ ID NO: 938273 - DNA, 25 bp, Mus musculus
ttcctttttatcactatgcctgcaa

SEQ ID NO: 938274 - DNA, 25 bp, Mus musculus
ttcctttttatctctatgcctgcaa

SEQ ID NO: 938275 - DNA, 25 bp, Mus musculus
ttcctttttattaagatcccgctca

SEQ ID NO: 938276 - DNA, 25 bp, Mus musculus
ttcctttttatttagatcccgctca

SEQ ID NO: 938277 - DNA, 25 bp, Mus musculus
ttcctttttctgcttatgtggtgcc

SEQ ID NO: 938278 - DNA, 25 bp, Mus musculus
ttcctttttctggttatgtggtgcc

SEQ ID NO: 938279 - DNA, 25 bp, Mus musculus
ttcctttttgaaatatgcccagtcg

SEQ ID NO: 938280 - DNA, 25 bp, Mus musculus
ttcctttttgaattatgcccagtcg

SEQ ID NO: 938281 - DNA, 25 bp, Mus musculus
ttccttttttctattgtcctgagag

SEQ ID NO: 938282 - DNA, 25 bp, Mus musculus
ttccttttttcttttgtcctgagag

SEQ ID NO: 938283 - DNA, 25 bp, Mus musculus
ttcgaaaacggcagcagttctgaca

SEQ ID NO: 938284 - DNA, 25 bp, Mus musculus
ttcgaaaacggctgcagttctgaca

SEQ ID NO: 938285 - DNA, 25 bp, Mus musculus
ttcgaaaatgacatcccgtgctgct

SEQ ID NO: 938286 - DNA, 25 bp, Mus musculus
ttcgaaaatgacttcccgtgctgct

SEQ ID NO: 938287 - DNA, 25 bp, Mus musculus
ttcgaaacttccatagtaccaatga

SEQ ID NO: 938288 - DNA, 25 bp, Mus musculus
ttcgaaacttccttagtaccaatga

SEQ ID NO: 938289 - DNA, 25 bp, Mus musculus
ttcgaaacttcgctacctggaggtc

SEQ ID NO: 938290 - DNA, 25 bp, Mus musculus
ttcgaaacttcggtacctggaggtc

SEQ ID NO: 938291 - DNA, 25 bp, Mus musculus
ttcgaaaggcatccaggtgctccct

SEQ ID NO: 938292 - DNA, 25 bp, Mus musculus
ttcgaaaggcatgcaggtgctccct

SEQ ID NO: 938293 - DNA, 25 bp, Mus musculus
ttcgaaatcgccactgtcccatgtg

SEQ ID NO: 938294 - DNA, 25 bp, Mus musculus
ttcgaaatcgcctctgtcccatgtg

SEQ ID NO: 938295 - DNA, 25 bp, Mus musculus
ttcgaaattcctctgtcgcaatggg

SEQ ID NO: 938296 - DNA, 25 bp, Mus musculus
ttcgaaattcctgtgtcgcaatggg

SEQ ID NO: 938297 - DNA, 25 bp, Mus musculus
ttcgaaatttcactgacgtgtgaat

SEQ ID NO: 938298 - DNA, 25 bp, Mus musculus
ttcgaaatttcagtgacgtgtgaat

SEQ ID NO: 938299 - DNA, 25 bp, Mus musculus
ttcgaacgtcttcccggcaggtgga

SEQ ID NO: 938300 - DNA, 25 bp, Mus musculus
ttcgaacgtcttgccggcaggtgga

SEQ ID NO: 938301 - DNA, 25 bp, Mus musculus
ttcgaactcctcatctggggcagat

SEQ ID NO: 938302 - DNA, 25 bp, Mus musculus
ttcgaactcctcttctggggcagat

SEQ ID NO: 938303 - DNA, 25 bp, Mus musculus
ttcgaactgttcagggtctgcgacc

SEQ ID NO: 938304 - DNA, 25 bp, Mus musculus
ttcgaactgttctgggtctgcgacc

SEQ ID NO: 938305 - DNA, 25 bp, Mus musculus
ttcgaacttcaactttttactccag

SEQ ID NO: 938306 - DNA, 25 bp, Mus musculus
ttcgaacttcaagtttttactccag

SEQ ID NO: 938307 - DNA, 25 bp, Mus musculus
ttcgaagaccctccagttaccgtgg

SEQ ID NO: 938308 - DNA, 25 bp, Mus musculus
ttcgaagaccctgcagttaccgtgg

SEQ ID NO: 938309 - DNA, 25 bp, Mus musculus
ttcgaagagacacaactctgctgct

SEQ ID NO: 938310 - DNA, 25 bp, Mus musculus
ttcgaagagacagaactctgctgct

SEQ ID NO: 938311 - DNA, 25 bp, Mus musculus
ttcgaagcactcctattccaagatg

SEQ ID NO: 938312 - DNA, 25 bp, Mus musculus
ttcgaagcactcgtattccaagatg

SEQ ID NO: 938313 - DNA, 25 bp, Mus musculus
ttcgaagcagatactcaccatgtga

SEQ ID NO: 938314 - DNA, 25 bp, Mus musculus
ttcgaagcagattctcaccatgtga

SEQ ID NO: 938315 - DNA, 25 bp, Mus musculus
ttcgaagcatgaatgatctgtttat

SEQ ID NO: 938316 - DNA, 25 bp, Mus musculus
ttcgaagcatgattgatctgtttat

SEQ ID NO: 938317 - DNA, 25 bp, Mus musculus
ttcgaagccagacagttcgcttagt

SEQ ID NO: 938318 - DNA, 25 bp, Mus musculus
ttcgaagccagagagttcgcttagt

SEQ ID NO: 938319 - DNA, 25 bp, Mus musculus
ttcgaagctacaaggccaagggtca

SEQ ID NO: 938320 - DNA, 25 bp, Mus musculus
ttcgaagctacatggccaagggtca

SEQ ID NO: 938321 - DNA, 25 bp, Mus musculus
ttcgaaggaccgatcagccaaataa

SEQ ID NO: 938322 - DNA, 25 bp, Mus musculus
ttcgaaggaccgttcagccaaataa

SEQ ID NO: 938323 - DNA, 25 bp, Mus musculus
ttcgaagtctttcacctcaacatga

SEQ ID NO: 938324 - DNA, 25 bp, Mus musculus
ttcgaagtctttgacctcaacatga

SEQ ID NO: 938325 - DNA, 25 bp, Mus musculus
ttcgaatcgcgcctaaatatgtctc

SEQ ID NO: 938326 - DNA, 25 bp, Mus musculus
ttcgaatcgcgcgtaaatatgtctc

SEQ ID NO: 938327 - DNA, 25 bp, Mus musculus
ttcgaatgcagccttaaagggccaa

SEQ ID NO: 938328 - DNA, 25 bp, Mus musculus
ttcgaatgcagcgttaaagggccaa

SEQ ID NO: 938329 - DNA, 25 bp, Mus musculus
ttcgaattcccgcactattgcacgc

SEQ ID NO: 938330 - DNA, 25 bp, Mus musculus
ttcgaattcccggactattgcacgc

SEQ ID NO: 938331 - DNA, 25 bp, Mus musculus
ttcgacaaagtcagctggatctggc

SEQ ID NO: 938332 - DNA, 25 bp, Mus musculus
ttcgacaaagtctgctggatctggc

SEQ ID NO: 938333 - DNA, 25 bp, Mus musculus
ttcgacaaccggaacctgggcaaag

SEQ ID NO: 938334 - DNA, 25 bp, Mus musculus
ttcgacaaccggtacctgggcaaag

SEQ ID NO: 938335 - DNA, 25 bp, Mus musculus
ttcgacaagggcaggaccacgtgtg

SEQ ID NO: 938336 - DNA, 25 bp, Mus musculus
ttcgacaagggctggaccacgtgtg

SEQ ID NO: 938337 - DNA, 25 bp, Mus musculus
ttcgacacggaccacaatggagctg

SEQ ID NO: 938338 - DNA, 25 bp, Mus musculus
ttcgacacggacgacaatggagctg

SEQ ID NO: 938339 - DNA, 25 bp, Mus musculus
ttcgacaggaagatcagcttcaaga

SEQ ID NO: 938340 - DNA, 25 bp, Mus musculus
ttcgacaggaagttcagcttcaaga

SEQ ID NO: 938341 - DNA, 25 bp, Mus musculus
ttcgacataccccttaacaaatcac

SEQ ID NO: 938342 - DNA, 25 bp, Mus musculus
ttcgacatacccgttaacaaatcac

SEQ ID NO: 938343 - DNA, 25 bp, Mus musculus
ttcgacatccttcagtactcagagc

SEQ ID NO: 938344 - DNA, 25 bp, Mus musculus
ttcgacatccttgagtactcagagc

SEQ ID NO: 938345 - DNA, 25 bp, Mus musculus
ttcgacattgcaagctgggatccag

SEQ ID NO: 938346 - DNA, 25 bp, Mus musculus
ttcgacattgcatgctgggatccag

SEQ ID NO: 938347 - DNA, 25 bp, Mus musculus
ttcgaccaaattaaccaagcctttg

SEQ ID NO: 938348 - DNA, 25 bp, Mus musculus
ttcgaccaaatttaccaagcctttg

SEQ ID NO: 938349 - DNA, 25 bp, Mus musculus
ttcgaccaagcccaaagaaaatgtc

SEQ ID NO: 938350 - DNA, 25 bp, Mus musculus
ttcgaccaagccgaaagaaaatgtc

SEQ ID NO: 938351 - DNA, 25 bp, Mus musculus
ttcgaccacacacgaatctgcatgg

SEQ ID NO: 938352 - DNA, 25 bp, Mus musculus
ttcgaccacacaggaatctgcatgg

SEQ ID NO: 938353 - DNA, 25 bp, Mus musculus
ttcgaccactaacgcttcatttaag

SEQ ID NO: 938354 - DNA, 25 bp, Mus musculus
ttcgaccactaaggcttcatttaag

SEQ ID NO: 938355 - DNA, 25 bp, Mus musculus
ttcgacccatggactctatatgctt

SEQ ID NO: 938356 - DNA, 25 bp, Mus musculus
ttcgacccatggtctctatatgctt

SEQ ID NO: 938357 - DNA, 25 bp, Mus musculus
ttcgaccccaaccaggtcaaagtcg

SEQ ID NO: 938358 - DNA, 25 bp, Mus musculus
ttcgaccccaacgaggtcaaagtcg

SEQ ID NO: 938359 - DNA, 25 bp, Mus musculus
ttcgaccctgcactaactatggcac

SEQ ID NO: 938360 - DNA, 25 bp, Mus musculus
ttcgaccctgcagtaactatggcac

SEQ ID NO: 938361 - DNA, 25 bp, Mus musculus
ttcgacggacgcagctagagctgag

SEQ ID NO: 938362 - DNA, 25 bp, Mus musculus
ttcgacggacgctgctagagctgag

SEQ ID NO: 938363 - DNA, 25 bp, Mus musculus
ttcgacggctgtcccaggagaacca

SEQ ID NO: 938364 - DNA, 25 bp, Mus musculus
ttcgacggctgtgccaggagaacca

SEQ ID NO: 938365 - DNA, 25 bp, Mus musculus
ttcgacgtactacctctgtggcaaa

SEQ ID NO: 938366 - DNA, 25 bp, Mus musculus
ttcgacgtactagctctgtggcaaa

SEQ ID NO: 938367 - DNA, 25 bp, Mus musculus
ttcgacgtcggcagcaacaagtacg

SEQ ID NO: 938368 - DNA, 25 bp, Mus musculus
ttcgacgtcggctgcaacaagtacg

SEQ ID NO: 938369 - DNA, 25 bp, Mus musculus
ttcgacgttcgaactccagaggagg

SEQ ID NO: 938370 - DNA, 25 bp, Mus musculus
ttcgacgttcgatctccagaggagg

SEQ ID NO: 938371 - DNA, 25 bp, Mus musculus
ttcgactaaaggacaccgagacttt

SEQ ID NO: 938372 - DNA, 25 bp, Mus musculus
ttcgactaaaggtcaccgagacttt

SEQ ID NO: 938373 - DNA, 25 bp, Mus musculus
ttcgactccttgctgaatctgaaca

SEQ ID NO: 938374 - DNA, 25 bp, Mus musculus
ttcgactccttggtgaatctgaaca

SEQ ID NO: 938375 - DNA, 25 bp, Mus musculus
ttcgactctgcgctgatgcacaggt

SEQ ID NO: 938376 - DNA, 25 bp, Mus musculus
ttcgactctgcggtgatgcacaggt

SEQ ID NO: 938377 - DNA, 25 bp, Mus musculus
ttcgactgaagtcatctagggccta

SEQ ID NO: 938378 - DNA, 25 bp, Mus musculus
ttcgactgaagtgatctagggccta

SEQ ID NO: 938379 - DNA, 25 bp, Mus musculus
ttcgacttcccacgtggcttgtgtt

SEQ ID NO: 938380 - DNA, 25 bp, Mus musculus
ttcgacttcccaggtggcttgtgtt

SEQ ID NO: 938381 - DNA, 25 bp, Mus musculus
ttcgacttcggaaagagaaccagat

SEQ ID NO: 938382 - DNA, 25 bp, Mus musculus
ttcgacttcggatagagaaccagat

SEQ ID NO: 938383 - DNA, 25 bp, Mus musculus
ttcgagaaatgaatcctgcctttgg

SEQ ID NO: 938384 - DNA, 25 bp, Mus musculus
ttcgagaaatgattcctgcctttgg

SEQ ID NO: 938385 - DNA, 25 bp, Mus musculus
ttcgagacgcctaccgggagttcga

SEQ ID NO: 938386 - DNA, 25 bp, Mus musculus
ttcgagacgccttccgggagttcga

SEQ ID NO: 938387 - DNA, 25 bp, Mus musculus
ttcgagacgtgccagtggaactgtt

SEQ ID NO: 938388 - DNA, 25 bp, Mus musculus
ttcgagacgtgcgagtggaactgtt

SEQ ID NO: 938389 - DNA, 25 bp, Mus musculus
ttcgagagaccgaggtttccgctgg

SEQ ID NO: 938390 - DNA, 25 bp, Mus musculus
ttcgagagaccgtggtttccgctgg

SEQ ID NO: 938391 - DNA, 25 bp, Mus musculus
ttcgagatccggaggagggttccta

SEQ ID NO: 938392 - DNA, 25 bp, Mus musculus
ttcgagatccggtggagggttccta

SEQ ID NO: 938393 - DNA, 25 bp, Mus musculus
ttcgagatgaacaacgccacaggcc

SEQ ID NO: 938394 - DNA, 25 bp, Mus musculus
ttcgagatgaactacgccacaggcc

SEQ ID NO: 938395 - DNA, 25 bp, Mus musculus
ttcgagatggacctcactgtgtatc

SEQ ID NO: 938396 - DNA, 25 bp, Mus musculus
ttcgagatggacgtcactgtgtatc

SEQ ID NO: 938397 - DNA, 25 bp, Mus musculus
ttcgagatgggacttgcttgtgtac

SEQ ID NO: 938398 - DNA, 25 bp, Mus musculus
ttcgagatgggagttgcttgtgtac

SEQ ID NO: 938399 - DNA, 25 bp, Mus musculus
ttcgagcaggtcctgactgacatca

SEQ ID NO: 938400 - DNA, 25 bp, Mus musculus
ttcgagcaggtcgtgactgacatca

SEQ ID NO: 938401 - DNA, 25 bp, Mus musculus
ttcgagccagccaatcagatggtca

SEQ ID NO: 938402 - DNA, 25 bp, Mus musculus
ttcgagccagcctatcagatggtca

SEQ ID NO: 938403 - DNA, 25 bp, Mus musculus
ttcgagccctagaagctgggtgtct

SEQ ID NO: 938404 - DNA, 25 bp, Mus musculus
ttcgagccctagtagctgggtgtct

SEQ ID NO: 938405 - DNA, 25 bp, Mus musculus
ttcgagctcagcagggtagccactg

SEQ ID NO: 938406 - DNA, 25 bp, Mus musculus
ttcgagctcagctgggtagccactg

SEQ ID NO: 938407 - DNA, 25 bp, Mus musculus
ttcgagctctaaccccatcacagaa

SEQ ID NO: 938408 - DNA, 25 bp, Mus musculus
ttcgagctctaagcccatcacagaa

SEQ ID NO: 938409 - DNA, 25 bp, Mus musculus
ttcgagctgctcaatcccatgatgg

SEQ ID NO: 938410 - DNA, 25 bp, Mus musculus
ttcgagctgctctatcccatgatgg

SEQ ID NO: 938411 - DNA, 25 bp, Mus musculus
ttcgaggaacacaaaatgatcccta

SEQ ID NO: 938412 - DNA, 25 bp, Mus musculus
ttcgaggaacactaaatgatcccta

SEQ ID NO: 938413 - DNA, 25 bp, Mus musculus
ttcgaggaatgtcactcgctggccc

SEQ ID NO: 938414 - DNA, 25 bp, Mus musculus
ttcgaggaatgtgactcgctggccc

SEQ ID NO: 938415 - DNA, 25 bp, Mus musculus
ttcgaggaccttctggcagctttga

SEQ ID NO: 938416 - DNA, 25 bp, Mus musculus
ttcgaggaccttgtggcagctttga

SEQ ID NO: 938417 - DNA, 25 bp, Mus musculus
ttcgaggactaaagctgtgccccaa

SEQ ID NO: 938418 - DNA, 25 bp, Mus musculus
ttcgaggactaatgctgtgccccaa

SEQ ID NO: 938419 - DNA, 25 bp, Mus musculus
ttcgaggacttcagcccggactcgt

SEQ ID NO: 938420 - DNA, 25 bp, Mus musculus
ttcgaggacttctgcccggactcgt

SEQ ID NO: 938421 - DNA, 25 bp, Mus musculus
ttcgagggaagcctgaagccatgct

SEQ ID NO: 938422 - DNA, 25 bp, Mus musculus
ttcgagggaagcgtgaagccatgct

SEQ ID NO: 938423 - DNA, 25 bp, Mus musculus
ttcgaggtggctcatgaagacaagc

SEQ ID NO: 938424 - DNA, 25 bp, Mus musculus
ttcgaggtggctgatgaagacaagc

SEQ ID NO: 938425 - DNA, 25 bp, Mus musculus
ttcgaggttaaaagagttggcccag

SEQ ID NO: 938426 - DNA, 25 bp, Mus musculus
ttcgaggttaaatgagttggcccag

SEQ ID NO: 938427 - DNA, 25 bp, Mus musculus
ttcgaggttctaattatctgcagta

SEQ ID NO: 938428 - DNA, 25 bp, Mus musculus
ttcgaggttctatttatctgcagta

SEQ ID NO: 938429 - DNA, 25 bp, Mus musculus
ttcgagtagagaagcaggccccgcc

SEQ ID NO: 938430 - DNA, 25 bp, Mus musculus
ttcgagtagagatgcaggccccgcc

SEQ ID NO: 938431 - DNA, 25 bp, Mus musculus
ttcgagtcccaccttgtgccttggt

SEQ ID NO: 938432 - DNA, 25 bp, Mus musculus
ttcgagtcccacgttgtgccttggt

SEQ ID NO: 938433 - DNA, 25 bp, Mus musculus
ttcgagtccgaacgttcgtggtgtt

SEQ ID NO: 938434 - DNA, 25 bp, Mus musculus
ttcgagtccgaaggttcgtggtgtt

SEQ ID NO: 938435 - DNA, 25 bp, Mus musculus
ttcgagtcttatatccaggaaccag

SEQ ID NO: 938436 - DNA, 25 bp, Mus musculus
ttcgagtcttatttccaggaaccag

SEQ ID NO: 938437 - DNA, 25 bp, Mus musculus
ttcgagtgaatgaggcagttaaaca

SEQ ID NO: 938438 - DNA, 25 bp, Mus musculus
ttcgagtgaatgtggcagttaaaca

SEQ ID NO: 938439 - DNA, 25 bp, Mus musculus
ttcgagttatttagacccatctttc

SEQ ID NO: 938440 - DNA, 25 bp, Mus musculus
ttcgagttattttgacccatctttc

SEQ ID NO: 938441 - DNA, 25 bp, Mus musculus
ttcgagttcctcatgcgtgtcgtct

SEQ ID NO: 938442 - DNA, 25 bp, Mus musculus
ttcgagttcctcttgcgtgtcgtct

SEQ ID NO: 938443 - DNA, 25 bp, Mus musculus
ttcgagtttcgtcggacttgggact

SEQ ID NO: 938444 - DNA, 25 bp, Mus musculus
ttcgagtttcgtgggacttgggact

SEQ ID NO: 938445 - DNA, 25 bp, Mus musculus
ttcgataaaaacaatgtcctatttt

SEQ ID NO: 938446 - DNA, 25 bp, Mus musculus
ttcgataaaaactatgtcctatttt

SEQ ID NO: 938447 - DNA, 25 bp, Mus musculus
ttcgatacctccacagcaggtagag

SEQ ID NO: 938448 - DNA, 25 bp, Mus musculus
ttcgatacctcctcagcaggtagag

SEQ ID NO: 938449 - DNA, 25 bp, Mus musculus
ttcgatatgaccaccagtcacggct

SEQ ID NO: 938450 - DNA, 25 bp, Mus musculus
ttcgatatgacctccagtcacggct

SEQ ID NO: 938451 - DNA, 25 bp, Mus musculus
ttcgatattactccaaattcttaga

SEQ ID NO: 938452 - DNA, 25 bp, Mus musculus
ttcgatattactgcaaattcttaga

SEQ ID NO: 938453 - DNA, 25 bp, Mus musculus
ttcgatccgtgacagcagccagcaa

SEQ ID NO: 938454 - DNA, 25 bp, Mus musculus
ttcgatccgtgagagcagccagcaa

SEQ ID NO: 938455 - DNA, 25 bp, Mus musculus
ttcgatcctcgtcaggtgcaggtca

SEQ ID NO: 938456 - DNA, 25 bp, Mus musculus
ttcgatcctcgtgaggtgcaggtca

SEQ ID NO: 938457 - DNA, 25 bp, Mus musculus
ttcgatctcaagagaaaccctgtta

SEQ ID NO: 938458 - DNA, 25 bp, Mus musculus
ttcgatctcaagtgaaaccctgtta

SEQ ID NO: 938459 - DNA, 25 bp, Mus musculus
ttcgatgaagcccagaatgctgctt

SEQ ID NO: 938460 - DNA, 25 bp, Mus musculus
ttcgatgaagccgagaatgctgctt

SEQ ID NO: 938461 - DNA, 25 bp, Mus musculus
ttcgatgacgttacacatgcttgca

SEQ ID NO: 938462 - DNA, 25 bp, Mus musculus
ttcgatgacgtttcacatgcttgca

SEQ ID NO: 938463 - DNA, 25 bp, Mus musculus
ttcgatgactctagctgaagtagta

SEQ ID NO: 938464 - DNA, 25 bp, Mus musculus
ttcgatgactcttgctgaagtagta

SEQ ID NO: 938465 - DNA, 25 bp, Mus musculus
ttcgatgatctgatcaaccacacgc

SEQ ID NO: 938466 - DNA, 25 bp, Mus musculus
ttcgatgatctgttcaaccacacgc

SEQ ID NO: 938467 - DNA, 25 bp, Mus musculus
ttcgatgcaaggatctggactgttt

SEQ ID NO: 938468 - DNA, 25 bp, Mus musculus
ttcgatgcaaggttctggactgttt

SEQ ID NO: 938469 - DNA, 25 bp, Mus musculus
ttcgatgcccagacaggagctgaca

SEQ ID NO: 938470 - DNA, 25 bp, Mus musculus
ttcgatgcccagtcaggagctgaca

SEQ ID NO: 938471 - DNA, 25 bp, Mus musculus
ttcgatgggatcactgtacagccag

SEQ ID NO: 938472 - DNA, 25 bp, Mus musculus
ttcgatgggatctctgtacagccag

SEQ ID NO: 938473 - DNA, 25 bp, Mus musculus
ttcgatgggtttaggttgacttttg

SEQ ID NO: 938474 - DNA, 25 bp, Mus musculus
ttcgatgggttttggttgacttttg

SEQ ID NO: 938475 - DNA, 25 bp, Mus musculus
ttcgatggtgtactgcatgcaaaag

SEQ ID NO: 938476 - DNA, 25 bp, Mus musculus
ttcgatggtgtagtgcatgcaaaag

SEQ ID NO: 938477 - DNA, 25 bp, Mus musculus
ttcgatgtaaggctggagatgtatt

SEQ ID NO: 938478 - DNA, 25 bp, Mus musculus
ttcgatgtaagggtggagatgtatt

SEQ ID NO: 938479 - DNA, 25 bp, Mus musculus
ttcgatttccccatttgtttgcaga

SEQ ID NO: 938480 - DNA, 25 bp, Mus musculus
ttcgatttccccttttgtttgcaga

SEQ ID NO: 938481 - DNA, 25 bp, Mus musculus
ttcgatttccttattcctgtagaga

SEQ ID NO: 938482 - DNA, 25 bp, Mus musculus
ttcgatttcctttttcctgtagaga

SEQ ID NO: 938483 - DNA, 25 bp, Mus musculus
ttcgattttactagactttactctc

SEQ ID NO: 938484 - DNA, 25 bp, Mus musculus
ttcgattttacttgactttactctc

SEQ ID NO: 938485 - DNA, 25 bp, Mus musculus
ttcgcaagaagaagaacctcctgtt

SEQ ID NO: 938486 - DNA, 25 bp, Mus musculus
ttcgcaagaagatgaacctcctgtt

SEQ ID NO: 938487 - DNA, 25 bp, Mus musculus
ttcgcaagatccagtgccgggacca

SEQ ID NO: 938488 - DNA, 25 bp, Mus musculus
ttcgcaagatcctgtgccgggacca

SEQ ID NO: 938489 - DNA, 25 bp, Mus musculus
ttcgcaagtattatgggaacccctg

SEQ ID NO: 938490 - DNA, 25 bp, Mus musculus
ttcgcaagtattttgggaacccctg

SEQ ID NO: 938491 - DNA, 25 bp, Mus musculus
ttcgcaatacctacatcttctcctt

SEQ ID NO: 938492 - DNA, 25 bp, Mus musculus
ttcgcaataccttcatcttctcctt

SEQ ID NO: 938493 - DNA, 25 bp, Mus musculus
ttcgcacacaacattcagaacactg

SEQ ID NO: 938494 - DNA, 25 bp, Mus musculus
ttcgcacacaactttcagaacactg

SEQ ID NO: 938495 - DNA, 25 bp, Mus musculus
ttcgcacaccctccaatgggaaaca

SEQ ID NO: 938496 - DNA, 25 bp, Mus musculus
ttcgcacaccctgcaatgggaaaca

SEQ ID NO: 938497 - DNA, 25 bp, Mus musculus
ttcgcacagatgaggcacgaagtga

SEQ ID NO: 938498 - DNA, 25 bp, Mus musculus
ttcgcacagatgtggcacgaagtga

SEQ ID NO: 938499 - DNA, 25 bp, Mus musculus
ttcgcacagctcagtacagtcaatt

SEQ ID NO: 938500 - DNA, 25 bp, Mus musculus
ttcgcacagctctgtacagtcaatt

SEQ ID NO: 938501 - DNA, 25 bp, Mus musculus
ttcgcacagcttctacctacagtga

SEQ ID NO: 938502 - DNA, 25 bp, Mus musculus
ttcgcacagcttgtacctacagtga

SEQ ID NO: 938503 - DNA, 25 bp, Mus musculus
ttcgcaccagccagtcggagattca

SEQ ID NO: 938504 - DNA, 25 bp, Mus musculus
ttcgcaccagcctgtcggagattca

SEQ ID NO: 938505 - DNA, 25 bp, Mus musculus
ttcgcaccatgcaagttcggaagat

SEQ ID NO: 938506 - DNA, 25 bp, Mus musculus
ttcgcaccatgctagttcggaagat

SEQ ID NO: 938507 - DNA, 25 bp, Mus musculus
ttcgcaccttgtagtgcgctgctcc

SEQ ID NO: 938508 - DNA, 25 bp, Mus musculus
ttcgcaccttgttgtgcgctgctcc

SEQ ID NO: 938509 - DNA, 25 bp, Mus musculus
ttcgcactcgcaccaacattgttca

SEQ ID NO: 938510 - DNA, 25 bp, Mus musculus
ttcgcactcgcagcaacattgttca

SEQ ID NO: 938511 - DNA, 25 bp, Mus musculus
ttcgcactcttcagcaaacatttgg

SEQ ID NO: 938512 - DNA, 25 bp, Mus musculus
ttcgcactcttctgcaaacatttgg

SEQ ID NO: 938513 - DNA, 25 bp, Mus musculus
ttcgcagaccgcactgtggtcacca

SEQ ID NO: 938514 - DNA, 25 bp, Mus musculus
ttcgcagaccgctctgtggtcacca

SEQ ID NO: 938515 - DNA, 25 bp, Mus musculus
ttcgcagactccaggatttctgacc

SEQ ID NO: 938516 - DNA, 25 bp, Mus musculus
ttcgcagactcctggatttctgacc

SEQ ID NO: 938517 - DNA, 25 bp, Mus musculus
ttcgcagagaggcttcactaggcaa

SEQ ID NO: 938518 - DNA, 25 bp, Mus musculus
ttcgcagagagggttcactaggcaa

SEQ ID NO: 938519 - DNA, 25 bp, Mus musculus
ttcgcagagctcctatacacaggtt

SEQ ID NO: 938520 - DNA, 25 bp, Mus musculus
ttcgcagagctcgtatacacaggtt

SEQ ID NO: 938521 - DNA, 25 bp, Mus musculus
ttcgcagaggttatcatatggtgac

SEQ ID NO: 938522 - DNA, 25 bp, Mus musculus
ttcgcagaggttttcatatggtgac

SEQ ID NO: 938523 - DNA, 25 bp, Mus musculus
ttcgcagataagatttaaggccttc

SEQ ID NO: 938524 - DNA, 25 bp, Mus musculus
ttcgcagataagttttaaggccttc

SEQ ID NO: 938525 - DNA, 25 bp, Mus musculus
ttcgcagccatgaaaggccactgaa

SEQ ID NO: 938526 - DNA, 25 bp, Mus musculus
ttcgcagccatgtaaggccactgaa

SEQ ID NO: 938527 - DNA, 25 bp, Mus musculus
ttcgcagctactcgactctcaagag

SEQ ID NO: 938528 - DNA, 25 bp, Mus musculus
ttcgcagctactggactctcaagag

SEQ ID NO: 938529 - DNA, 25 bp, Mus musculus
ttcgcagcttcactgacctagagga

SEQ ID NO: 938530 - DNA, 25 bp, Mus musculus
ttcgcagcttcagtgacctagagga

SEQ ID NO: 938531 - DNA, 25 bp, Mus musculus
ttcgcaggactgctttacagaaggg

SEQ ID NO: 938532 - DNA, 25 bp, Mus musculus
ttcgcaggactggtttacagaaggg

SEQ ID NO: 938533 - DNA, 25 bp, Mus musculus
ttcgcaggttccattggcggagctg

SEQ ID NO: 938534 - DNA, 25 bp, Mus musculus
ttcgcaggttcctttggcggagctg

SEQ ID NO: 938535 - DNA, 25 bp, Mus musculus
ttcgcagtacatagctttaatgccc

SEQ ID NO: 938536 - DNA, 25 bp, Mus musculus
ttcgcagtacattgctttaatgccc

SEQ ID NO: 938537 - DNA, 25 bp, Mus musculus
ttcgcagtgacaagacttccctact

SEQ ID NO: 938538 - DNA, 25 bp, Mus musculus
ttcgcagtgacatgacttccctact

SEQ ID NO: 938539 - DNA, 25 bp, Mus musculus
ttcgcagtgcatcagtttcgacccc

SEQ ID NO: 938540 - DNA, 25 bp, Mus musculus
ttcgcagtgcatgagtttcgacccc

SEQ ID NO: 938541 - DNA, 25 bp, Mus musculus
ttcgcagttaccattttcacccgtg

SEQ ID NO: 938542 - DNA, 25 bp, Mus musculus
ttcgcagttacctttttcacccgtg

SEQ ID NO: 938543 - DNA, 25 bp, Mus musculus
ttcgcagttccccagaaaagctagt

SEQ ID NO: 938544 - DNA, 25 bp, Mus musculus
ttcgcagttcccgagaaaagctagt

SEQ ID NO: 938545 - DNA, 25 bp, Mus musculus
ttcgcagttgggattcgctagggct

SEQ ID NO: 938546 - DNA, 25 bp, Mus musculus
ttcgcagttgggtttcgctagggct

SEQ ID NO: 938547 - DNA, 25 bp, Mus musculus
ttcgcatcactactggtccgggtca

SEQ ID NO: 938548 - DNA, 25 bp, Mus musculus
ttcgcatcactagtggtccgggtca

SEQ ID NO: 938549 - DNA, 25 bp, Mus musculus
ttcgcatcagagcatccatattggg

SEQ ID NO: 938550 - DNA, 25 bp, Mus musculus
ttcgcatcagaggatccatattggg

SEQ ID NO: 938551 - DNA, 25 bp, Mus musculus
ttcgcatcagctccaatgagggcag

SEQ ID NO: 938552 - DNA, 25 bp, Mus musculus
ttcgcatcagctgcaatgagggcag

SEQ ID NO: 938553 - DNA, 25 bp, Mus musculus
ttcgcatccattattaaattggctt

SEQ ID NO: 938554 - DNA, 25 bp, Mus musculus
ttcgcatccatttttaaattggctt

SEQ ID NO: 938555 - DNA, 25 bp, Mus musculus
ttcgcatccccaagtaaggctgagc

SEQ ID NO: 938556 - DNA, 25 bp, Mus musculus
ttcgcatccccatgtaaggctgagc

SEQ ID NO: 938557 - DNA, 25 bp, Mus musculus
ttcgcatccctgataagagactatg

SEQ ID NO: 938558 - DNA, 25 bp, Mus musculus
ttcgcatccctgttaagagactatg

SEQ ID NO: 938559 - DNA, 25 bp, Mus musculus
ttcgcatcctgtcgaagggcttttc

SEQ ID NO: 938560 - DNA, 25 bp, Mus musculus
ttcgcatcctgtggaagggcttttc

SEQ ID NO: 938561 - DNA, 25 bp, Mus musculus
ttcgcatgatacatcctttgctctt

SEQ ID NO: 938562 - DNA, 25 bp, Mus musculus
ttcgcatgatacttcctttgctctt

SEQ ID NO: 938563 - DNA, 25 bp, Mus musculus
ttcgcatggactcggaagttctttt

SEQ ID NO: 938564 - DNA, 25 bp, Mus musculus
ttcgcatggactgggaagttctttt

SEQ ID NO: 938565 - DNA, 25 bp, Mus musculus
ttcgcatgtgccatgtcctgtggat

SEQ ID NO: 938566 - DNA, 25 bp, Mus musculus
ttcgcatgtgccttgtcctgtggat

SEQ ID NO: 938567 - DNA, 25 bp, Mus musculus
ttcgcattctcgaggtctaggctgg

SEQ ID NO: 938568 - DNA, 25 bp, Mus musculus
ttcgcattctcgtggtctaggctgg

SEQ ID NO: 938569 - DNA, 25 bp, Mus musculus
ttcgcatttcacatcccacatgggt

SEQ ID NO: 938570 - DNA, 25 bp, Mus musculus
ttcgcatttcacttcccacatgggt

SEQ ID NO: 938571 - DNA, 25 bp, Mus musculus
ttcgccaaagtacagcctacagctt

SEQ ID NO: 938572 - DNA, 25 bp, Mus musculus
ttcgccaaagtagagcctacagctt

SEQ ID NO: 938573 - DNA, 25 bp, Mus musculus
ttcgccaacaagaacccacggaaga

SEQ ID NO: 938574 - DNA, 25 bp, Mus musculus
ttcgccaacaagtacccacggaaga

SEQ ID NO: 938575 - DNA, 25 bp, Mus musculus
ttcgccaacgatcgtgaacctcctg

SEQ ID NO: 938576 - DNA, 25 bp, Mus musculus
ttcgccaacgatggtgaacctcctg

SEQ ID NO: 938577 - DNA, 25 bp, Mus musculus
ttcgccaactttattatggagccat

SEQ ID NO: 938578 - DNA, 25 bp, Mus musculus
ttcgccaacttttttatggagccat

SEQ ID NO: 938579 - DNA, 25 bp, Mus musculus
ttcgccacacagaagcctgcttagt

SEQ ID NO: 938580 - DNA, 25 bp, Mus musculus
ttcgccacacagtagcctgcttagt

SEQ ID NO: 938581 - DNA, 25 bp, Mus musculus
ttcgccacagacacggaacttgagt

SEQ ID NO: 938582 - DNA, 25 bp, Mus musculus
ttcgccacagactcggaacttgagt

SEQ ID NO: 938583 - DNA, 25 bp, Mus musculus
ttcgccaccctgcaggtaactgaaa

SEQ ID NO: 938584 - DNA, 25 bp, Mus musculus
ttcgccaccctggaggtaactgaaa

SEQ ID NO: 938585 - DNA, 25 bp, Mus musculus
ttcgccaccgctcggtcggatggaa

SEQ ID NO: 938586 - DNA, 25 bp, Mus musculus
ttcgccaccgctgggtcggatggaa

SEQ ID NO: 938587 - DNA, 25 bp, Mus musculus
ttcgccacgactcaagctgccatag

SEQ ID NO: 938588 - DNA, 25 bp, Mus musculus
ttcgccacgactgaagctgccatag

SEQ ID NO: 938589 - DNA, 25 bp, Mus musculus
ttcgccactgtaaagtcacctcttt

SEQ ID NO: 938590 - DNA, 25 bp, Mus musculus
ttcgccactgtatagtcacctcttt

SEQ ID NO: 938591 - DNA, 25 bp, Mus musculus
ttcgccacttccactataaatcaaa

SEQ ID NO: 938592 - DNA, 25 bp, Mus musculus
ttcgccacttcctctataaatcaaa

SEQ ID NO: 938593 - DNA, 25 bp, Mus musculus
ttcgccagaagacagtcctagaaat

SEQ ID NO: 938594 - DNA, 25 bp, Mus musculus
ttcgccagaagagagtcctagaaat

SEQ ID NO: 938595 - DNA, 25 bp, Mus musculus
ttcgccagatcacagtcaatgacct

SEQ ID NO: 938596 - DNA, 25 bp, Mus musculus
ttcgccagatcagagtcaatgacct

SEQ ID NO: 938597 - DNA, 25 bp, Mus musculus
ttcgccagccgacttgtgtggatta

SEQ ID NO: 938598 - DNA, 25 bp, Mus musculus
ttcgccagccgagttgtgtggatta

SEQ ID NO: 938599 - DNA, 25 bp, Mus musculus
ttcgccaggcccaaaatgatgattt

SEQ ID NO: 938600 - DNA, 25 bp, Mus musculus
ttcgccaggccctaaatgatgattt

SEQ ID NO: 938601 - DNA, 25 bp, Mus musculus
ttcgccagtcttaaggactgcttta

SEQ ID NO: 938602 - DNA, 25 bp, Mus musculus
ttcgccagtctttaggactgcttta

SEQ ID NO: 938603 - DNA, 25 bp, Mus musculus
ttcgccattaaaccaacctgttact

SEQ ID NO: 938604 - DNA, 25 bp, Mus musculus
ttcgccattaaagcaacctgttact

SEQ ID NO: 938605 - DNA, 25 bp, Mus musculus
ttcgccattctgatttctgcagtgt

SEQ ID NO: 938606 - DNA, 25 bp, Mus musculus
ttcgccattctgttttctgcagtgt

SEQ ID NO: 938607 - DNA, 25 bp, Mus musculus
ttcgccattgcccagaacgagagca

SEQ ID NO: 938608 - DNA, 25 bp, Mus musculus
ttcgccattgccgagaacgagagca

SEQ ID NO: 938609 - DNA, 25 bp, Mus musculus
ttcgccattgcgatgtcaacaagga

SEQ ID NO: 938610 - DNA, 25 bp, Mus musculus
ttcgccattgcgttgtcaacaagga

SEQ ID NO: 938611 - DNA, 25 bp, Mus musculus
ttcgcccgggtgaccatgtatgtgg

SEQ ID NO: 938612 - DNA, 25 bp, Mus musculus
ttcgcccgggtgtccatgtatgtgg

SEQ ID NO: 938613 - DNA, 25 bp, Mus musculus
ttcgccctaactccagatggtggcc

SEQ ID NO: 938614 - DNA, 25 bp, Mus musculus
ttcgccctaactgcagatggtggcc

SEQ ID NO: 938615 - DNA, 25 bp, Mus musculus
ttcgccctcgaccttattaactctg

SEQ ID NO: 938616 - DNA, 25 bp, Mus musculus
ttcgccctcgacgttattaactctg

SEQ ID NO: 938617 - DNA, 25 bp, Mus musculus
ttcgccctgaagagcattcgcattg

SEQ ID NO: 938618 - DNA, 25 bp, Mus musculus
ttcgccctgaagtgcattcgcattg

SEQ ID NO: 938619 - DNA, 25 bp, Mus musculus
ttcgccctgggtattctgtgagaaa

SEQ ID NO: 938620 - DNA, 25 bp, Mus musculus
ttcgccctgggttttctgtgagaaa

SEQ ID NO: 938621 - DNA, 25 bp, Mus musculus
ttcgccctgttacgttgtagttgga

SEQ ID NO: 938622 - DNA, 25 bp, Mus musculus
ttcgccctgttaggttgtagttgga

SEQ ID NO: 938623 - DNA, 25 bp, Mus musculus
ttcgccctttgcagtttatagtgtg

SEQ ID NO: 938624 - DNA, 25 bp, Mus musculus
ttcgccctttgctgtttatagtgtg

SEQ ID NO: 938625 - DNA, 25 bp, Mus musculus
ttcgcccttttcatctctgtgtaaa

SEQ ID NO: 938626 - DNA, 25 bp, Mus musculus
ttcgcccttttcttctctgtgtaaa

SEQ ID NO: 938627 - DNA, 25 bp, Mus musculus
ttcgccgaagtcaagtgtgtgtttt

SEQ ID NO: 938628 - DNA, 25 bp, Mus musculus
ttcgccgaagtctagtgtgtgtttt

SEQ ID NO: 938629 - DNA, 25 bp, Mus musculus
ttcgccgcgaaaagtcagggagact

SEQ ID NO: 938630 - DNA, 25 bp, Mus musculus
ttcgccgcgaaatgtcagggagact

SEQ ID NO: 938631 - DNA, 25 bp, Mus musculus
ttcgccgcgctgaaaccggagctgg

SEQ ID NO: 938632 - DNA, 25 bp, Mus musculus
ttcgccgcgctgtaaccggagctgg

SEQ ID NO: 938633 - DNA, 25 bp, Mus musculus
ttcgccgctggcctatagcgagaag

SEQ ID NO: 938634 - DNA, 25 bp, Mus musculus
ttcgccgctggcgtatagcgagaag

SEQ ID NO: 938635 - DNA, 25 bp, Mus musculus
ttcgccgggatccagatcagtcgaa

SEQ ID NO: 938636 - DNA, 25 bp, Mus musculus
ttcgccgggatcgagatcagtcgaa

SEQ ID NO: 938637 - DNA, 25 bp, Mus musculus
ttcgccgtggtccttgagtaatctt

SEQ ID NO: 938638 - DNA, 25 bp, Mus musculus
ttcgccgtggtcgttgagtaatctt

SEQ ID NO: 938639 - DNA, 25 bp, Mus musculus
ttcgcctccaacatcagttagcagt

SEQ ID NO: 938640 - DNA, 25 bp, Mus musculus
ttcgcctccaacttcagttagcagt

SEQ ID NO: 938641 - DNA, 25 bp, Mus musculus
ttcgcctccagcagctttgtaagca

SEQ ID NO: 938642 - DNA, 25 bp, Mus musculus
ttcgcctccagctgctttgtaagca

SEQ ID NO: 938643 - DNA, 25 bp, Mus musculus
ttcgcctctgttcgagaaccactgt

SEQ ID NO: 938644 - DNA, 25 bp, Mus musculus
ttcgcctctgttggagaaccactgt

SEQ ID NO: 938645 - DNA, 25 bp, Mus musculus
ttcgcctgagctcaaagcctgagga

SEQ ID NO: 938646 - DNA, 25 bp, Mus musculus
ttcgcctgagctgaaagcctgagga

SEQ ID NO: 938647 - DNA, 25 bp, Mus musculus
ttcgcctgatcgctgagtttgtata

SEQ ID NO: 938648 - DNA, 25 bp, Mus musculus
ttcgcctgatcggtgagtttgtata

SEQ ID NO: 938649 - DNA, 25 bp, Mus musculus
ttcgcctggttcctctctattttaa

SEQ ID NO: 938650 - DNA, 25 bp, Mus musculus
ttcgcctggttcgtctctattttaa

SEQ ID NO: 938651 - DNA, 25 bp, Mus musculus
ttcgccttaaacaatggacactcta

SEQ ID NO: 938652 - DNA, 25 bp, Mus musculus
ttcgccttaaactatggacactcta

SEQ ID NO: 938653 - DNA, 25 bp, Mus musculus
ttcgccttacctccttcttagtgag

SEQ ID NO: 938654 - DNA, 25 bp, Mus musculus
ttcgccttacctgcttcttagtgag

SEQ ID NO: 938655 - DNA, 25 bp, Mus musculus
ttcgcctttgcacggaacctctgac

SEQ ID NO: 938656 - DNA, 25 bp, Mus musculus
ttcgcctttgcagggaacctctgac

SEQ ID NO: 938657 - DNA, 25 bp, Mus musculus
ttcgcgaaacgcctcatgcagttca

SEQ ID NO: 938658 - DNA, 25 bp, Mus musculus
ttcgcgaaacgcgtcatgcagttca

SEQ ID NO: 938659 - DNA, 25 bp, Mus musculus
ttcgcgcccaggaaggaaaactttg

SEQ ID NO: 938660 - DNA, 25 bp, Mus musculus
ttcgcgcccaggtaggaaaactttg

SEQ ID NO: 938661 - DNA, 25 bp, Mus musculus
ttcgcgcccgcactgagctggaatc

SEQ ID NO: 938662 - DNA, 25 bp, Mus musculus
ttcgcgcccgcagtgagctggaatc

SEQ ID NO: 938663 - DNA, 25 bp, Mus musculus
ttcgcgccgcaactcactggcggga

SEQ ID NO: 938664 - DNA, 25 bp, Mus musculus
ttcgcgccgcaagtcactggcggga

SEQ ID NO: 938665 - DNA, 25 bp, Mus musculus
ttcgcgcgcgcgagacgggacaggg

SEQ ID NO: 938666 - DNA, 25 bp, Mus musculus
ttcgcgcgcgcgtgacgggacaggg

SEQ ID NO: 938667 - DNA, 25 bp, Mus musculus
ttcgcgctcagcctgaagatggctt

SEQ ID NO: 938668 - DNA, 25 bp, Mus musculus
ttcgcgctcagcgtgaagatggctt

SEQ ID NO: 938669 - DNA, 25 bp, Mus musculus
ttcgcgcttaatccccacgtggtgg

SEQ ID NO: 938670 - DNA, 25 bp, Mus musculus
ttcgcgcttaatgcccacgtggtgg

SEQ ID NO: 938671 - DNA, 25 bp, Mus musculus
ttcgcggccaatcccaagagcagag

SEQ ID NO: 938672 - DNA, 25 bp, Mus musculus
ttcgcggccaatgccaagagcagag

SEQ ID NO: 938673 - DNA, 25 bp, Mus musculus
ttcgcggcgaccaggttgagcattt

SEQ ID NO: 938674 - DNA, 25 bp, Mus musculus
ttcgcggcgacctggttgagcattt

SEQ ID NO: 938675 - DNA, 25 bp, Mus musculus
ttcgcgggtgtgaagttgcagcaat

SEQ ID NO: 938676 - DNA, 25 bp, Mus musculus
ttcgcgggtgtgtagttgcagcaat

SEQ ID NO: 938677 - DNA, 25 bp, Mus musculus
ttcgcgtattttaaagacctgcttc

SEQ ID NO: 938678 - DNA, 25 bp, Mus musculus
ttcgcgtatttttaagacctgcttc

SEQ ID NO: 938679 - DNA, 25 bp, Mus musculus
ttcgcgtccacacacatacagcttc

SEQ ID NO: 938680 - DNA, 25 bp, Mus musculus
ttcgcgtccacagacatacagcttc

SEQ ID NO: 938681 - DNA, 25 bp, Mus musculus
ttcgctaagagtattcccaacagtt

SEQ ID NO: 938682 - DNA, 25 bp, Mus musculus
ttcgctaagagttttcccaacagtt

SEQ ID NO: 938683 - DNA, 25 bp, Mus musculus
ttcgctacaggcacaggttcagtga

SEQ ID NO: 938684 - DNA, 25 bp, Mus musculus
ttcgctacaggctcaggttcagtga

SEQ ID NO: 938685 - DNA, 25 bp, Mus musculus
ttcgctaccagcaggaccgtgggat

SEQ ID NO: 938686 - DNA, 25 bp, Mus musculus
ttcgctaccagctggaccgtgggat

SEQ ID NO: 938687 - DNA, 25 bp, Mus musculus
ttcgctactacgacgggcataaggg

SEQ ID NO: 938688 - DNA, 25 bp, Mus musculus
ttcgctactacgtcgggcataaggg

SEQ ID NO: 938689 - DNA, 25 bp, Mus musculus
ttcgctactccgatggtctaatggg

SEQ ID NO: 938690 - DNA, 25 bp, Mus musculus
ttcgctactccgttggtctaatggg

SEQ ID NO: 938691 - DNA, 25 bp, Mus musculus
ttcgctacttctctgtgagtaaggg

SEQ ID NO: 938692 - DNA, 25 bp, Mus musculus
ttcgctacttctgtgtgagtaaggg

SEQ ID NO: 938693 - DNA, 25 bp, Mus musculus
ttcgctagccagactgtgctcaaaa

SEQ ID NO: 938694 - DNA, 25 bp, Mus musculus
ttcgctagccagtctgtgctcaaaa

SEQ ID NO: 938695 - DNA, 25 bp, Mus musculus
ttcgctatcatcaccaacgtggaat

SEQ ID NO: 938696 - DNA, 25 bp, Mus musculus
ttcgctatcatctccaacgtggaat

SEQ ID NO: 938697 - DNA, 25 bp, Mus musculus
ttcgctatgaccatgtactgccagg

SEQ ID NO: 938698 - DNA, 25 bp, Mus musculus
ttcgctatgaccttgtactgccagg

SEQ ID NO: 938699 - DNA, 25 bp, Mus musculus
ttcgctcaccaaatttattccatgt

SEQ ID NO: 938700 - DNA, 25 bp, Mus musculus
ttcgctcaccaattttattccatgt

SEQ ID NO: 938701 - DNA, 25 bp, Mus musculus
ttcgctcactaacctgtaatacgct

SEQ ID NO: 938702 - DNA, 25 bp, Mus musculus
ttcgctcactaagctgtaatacgct

SEQ ID NO: 938703 - DNA, 25 bp, Mus musculus
ttcgctcagggacatggcacatttc

SEQ ID NO: 938704 - DNA, 25 bp, Mus musculus
ttcgctcagggagatggcacatttc

SEQ ID NO: 938705 - DNA, 25 bp, Mus musculus
ttcgctcccacacgaaaagctgctt

SEQ ID NO: 938706 - DNA, 25 bp, Mus musculus
ttcgctcccacaggaaaagctgctt

SEQ ID NO: 938707 - DNA, 25 bp, Mus musculus
ttcgctccccaacaacagttaaagg

SEQ ID NO: 938708 - DNA, 25 bp, Mus musculus
ttcgctccccaagaacagttaaagg

SEQ ID NO: 938709 - DNA, 25 bp, Mus musculus
ttcgctccgctgaaggaatattttg

SEQ ID NO: 938710 - DNA, 25 bp, Mus musculus
ttcgctccgctgtaggaatattttg

SEQ ID NO: 938711 - DNA, 25 bp, Mus musculus
ttcgctcctaccaggcagagcatgg

SEQ ID NO: 938712 - DNA, 25 bp, Mus musculus
ttcgctcctacctggcagagcatgg

SEQ ID NO: 938713 - DNA, 25 bp, Mus musculus
ttcgctcctgtcctcaataaagcaa

SEQ ID NO: 938714 - DNA, 25 bp, Mus musculus
ttcgctcctgtcgtcaataaagcaa

SEQ ID NO: 938715 - DNA, 25 bp, Mus musculus
ttcgctcggtctcatgaactgacga

SEQ ID NO: 938716 - DNA, 25 bp, Mus musculus
ttcgctcggtctgatgaactgacga

SEQ ID NO: 938717 - DNA, 25 bp, Mus musculus
ttcgctctccgactggccgtgggaa

SEQ ID NO: 938718 - DNA, 25 bp, Mus musculus
ttcgctctccgagtggccgtgggaa

SEQ ID NO: 938719 - DNA, 25 bp, Mus musculus
ttcgctctcgctagctgagactata

SEQ ID NO: 938720 - DNA, 25 bp, Mus musculus
ttcgctctcgcttgctgagactata

SEQ ID NO: 938721 - DNA, 25 bp, Mus musculus
ttcgctctgagacttgacctgaggc

SEQ ID NO: 938722 - DNA, 25 bp, Mus musculus
ttcgctctgagagttgacctgaggc

SEQ ID NO: 938723 - DNA, 25 bp, Mus musculus
ttcgctctggatacggtgacagcac

SEQ ID NO: 938724 - DNA, 25 bp, Mus musculus
ttcgctctggattcggtgacagcac

SEQ ID NO: 938725 - DNA, 25 bp, Mus musculus
ttcgctcttattccagagaaatatg

SEQ ID NO: 938726 - DNA, 25 bp, Mus musculus
ttcgctcttattgcagagaaatatg

SEQ ID NO: 938727 - DNA, 25 bp, Mus musculus
ttcgctcttgggatgttgtgcatac

SEQ ID NO: 938728 - DNA, 25 bp, Mus musculus
ttcgctcttgggttgttgtgcatac

SEQ ID NO: 938729 - DNA, 25 bp, Mus musculus
ttcgctgaaggaccgctacaagtag

SEQ ID NO: 938730 - DNA, 25 bp, Mus musculus
ttcgctgaaggagcgctacaagtag

SEQ ID NO: 938731 - DNA, 25 bp, Mus musculus
ttcgctgacttaactgtaaaaccca

SEQ ID NO: 938732 - DNA, 25 bp, Mus musculus
ttcgctgacttatctgtaaaaccca

SEQ ID NO: 938733 - DNA, 25 bp, Mus musculus
ttcgctgagcttcgtgctaggctag

SEQ ID NO: 938734 - DNA, 25 bp, Mus musculus
ttcgctgagcttggtgctaggctag

SEQ ID NO: 938735 - DNA, 25 bp, Mus musculus
ttcgctgagtaccaagtccagtcaa

SEQ ID NO: 938736 - DNA, 25 bp, Mus musculus
ttcgctgagtacgaagtccagtcaa

SEQ ID NO: 938737 - DNA, 25 bp, Mus musculus
ttcgctgatcttcacgtggttgaga

SEQ ID NO: 938738 - DNA, 25 bp, Mus musculus
ttcgctgatcttgacgtggttgaga

SEQ ID NO: 938739 - DNA, 25 bp, Mus musculus
ttcgctgatgttcgttattaaagta

SEQ ID NO: 938740 - DNA, 25 bp, Mus musculus
ttcgctgatgttggttattaaagta

SEQ ID NO: 938741 - DNA, 25 bp, Mus musculus
ttcgctgcagcccattatcgagggt

SEQ ID NO: 938742 - DNA, 25 bp, Mus musculus
ttcgctgcagccgattatcgagggt

SEQ ID NO: 938743 - DNA, 25 bp, Mus musculus
ttcgctgccttcctggtcacgttgc

SEQ ID NO: 938744 - DNA, 25 bp, Mus musculus
ttcgctgccttcgtggtcacgttgc

SEQ ID NO: 938745 - DNA, 25 bp, Mus musculus
ttcgctgctatgcttttagcctgta

SEQ ID NO: 938746 - DNA, 25 bp, Mus musculus
ttcgctgctatggttttagcctgta

SEQ ID NO: 938747 - DNA, 25 bp, Mus musculus
ttcgctgcttagcttctgtgattgt

SEQ ID NO: 938748 - DNA, 25 bp, Mus musculus
ttcgctgcttaggttctgtgattgt

SEQ ID NO: 938749 - DNA, 25 bp, Mus musculus
ttcgctgctttacctatcggattac

SEQ ID NO: 938750 - DNA, 25 bp, Mus musculus
ttcgctgctttagctatcggattac

SEQ ID NO: 938751 - DNA, 25 bp, Mus musculus
ttcgctgtcccgactgagtttatct

SEQ ID NO: 938752 - DNA, 25 bp, Mus musculus
ttcgctgtcccgtctgagtttatct

SEQ ID NO: 938753 - DNA, 25 bp, Mus musculus
ttcgctgttcacctgaaggacgttt

SEQ ID NO: 938754 - DNA, 25 bp, Mus musculus
ttcgctgttcacgtgaaggacgttt

SEQ ID NO: 938755 - DNA, 25 bp, Mus musculus
ttcgctgtttctcatgtgcttatac

SEQ ID NO: 938756 - DNA, 25 bp, Mus musculus
ttcgctgtttctgatgtgcttatac

SEQ ID NO: 938757 - DNA, 25 bp, Mus musculus
ttcgcttaatgaaagaaggacgcat

SEQ ID NO: 938758 - DNA, 25 bp, Mus musculus
ttcgcttaatgatagaaggacgcat

SEQ ID NO: 938759 - DNA, 25 bp, Mus musculus
ttcgcttatctcagagcccaaggct

SEQ ID NO: 938760 - DNA, 25 bp, Mus musculus
ttcgcttatctctgagcccaaggct

SEQ ID NO: 938761 - DNA, 25 bp, Mus musculus
ttcgcttccattacgagtttcagaa

SEQ ID NO: 938762 - DNA, 25 bp, Mus musculus
ttcgcttccatttcgagtttcagaa

SEQ ID NO: 938763 - DNA, 25 bp, Mus musculus
ttcgcttccctgagtttctaatttt

SEQ ID NO: 938764 - DNA, 25 bp, Mus musculus
ttcgcttccctgtgtttctaatttt

SEQ ID NO: 938765 - DNA, 25 bp, Mus musculus
ttcgcttcctgcctttgtacctgag

SEQ ID NO: 938766 - DNA, 25 bp, Mus musculus
ttcgcttcctgcgtttgtacctgag

SEQ ID NO: 938767 - DNA, 25 bp, Mus musculus
ttcgcttcgttaagaggagacacct

SEQ ID NO: 938768 - DNA, 25 bp, Mus musculus
ttcgcttcgttatgaggagacacct

SEQ ID NO: 938769 - DNA, 25 bp, Mus musculus
ttcgcttgactgagtgtagcttcat

SEQ ID NO: 938770 - DNA, 25 bp, Mus musculus
ttcgcttgactgtgtgtagcttcat

SEQ ID NO: 938771 - DNA, 25 bp, Mus musculus
ttcgcttgtaatctggctggcccat

SEQ ID NO: 938772 - DNA, 25 bp, Mus musculus
ttcgcttgtaatgtggctggcccat

SEQ ID NO: 938773 - DNA, 25 bp, Mus musculus
ttcgctttggttacacccgcttgat

SEQ ID NO: 938774 - DNA, 25 bp, Mus musculus
ttcgctttggtttcacccgcttgat

SEQ ID NO: 938775 - DNA, 25 bp, Mus musculus
ttcgctttgttcatctatcagccaa

SEQ ID NO: 938776 - DNA, 25 bp, Mus musculus
ttcgctttgttcttctatcagccaa

SEQ ID NO: 938777 - DNA, 25 bp, Mus musculus
ttcgcttttacgcttgccaggaaaa

SEQ ID NO: 938778 - DNA, 25 bp, Mus musculus
ttcgcttttacggttgccaggaaaa

SEQ ID NO: 938779 - DNA, 25 bp, Mus musculus
ttcgcttttactccggtatgaggtt

SEQ ID NO: 938780 - DNA, 25 bp, Mus musculus
ttcgcttttactgcggtatgaggtt

SEQ ID NO: 938781 - DNA, 25 bp, Mus musculus
ttcgctttttggcaccagctccaca

SEQ ID NO: 938782 - DNA, 25 bp, Mus musculus
ttcgctttttgggaccagctccaca

SEQ ID NO: 938783 - DNA, 25 bp, Mus musculus
ttcggaaaactgcaacacaccattt

SEQ ID NO: 938784 - DNA, 25 bp, Mus musculus
ttcggaaaactggaacacaccattt

SEQ ID NO: 938785 - DNA, 25 bp, Mus musculus
ttcggaaacccaagagtggaatata

SEQ ID NO: 938786 - DNA, 25 bp, Mus musculus
ttcggaaacccatgagtggaatata

SEQ ID NO: 938787 - DNA, 25 bp, Mus musculus
ttcggaaactccacccacagaagct

SEQ ID NO: 938788 - DNA, 25 bp, Mus musculus
ttcggaaactcctcccacagaagct

SEQ ID NO: 938789 - DNA, 25 bp, Mus musculus
ttcggaaagatgagaacaagttcta

SEQ ID NO: 938790 - DNA, 25 bp, Mus musculus
ttcggaaagatgtgaacaagttcta

SEQ ID NO: 938791 - DNA, 25 bp, Mus musculus
ttcggaacagatccaccctgaaagt

SEQ ID NO: 938792 - DNA, 25 bp, Mus musculus
ttcggaacagatgcaccctgaaagt

SEQ ID NO: 938793 - DNA, 25 bp, Mus musculus
ttcggaaccgtcctcttatgatgtt

SEQ ID NO: 938794 - DNA, 25 bp, Mus musculus
ttcggaaccgtcgtcttatgatgtt

SEQ ID NO: 938795 - DNA, 25 bp, Mus musculus
ttcggaacctgcaccagtctggatt

SEQ ID NO: 938796 - DNA, 25 bp, Mus musculus
ttcggaacctgctccagtctggatt

SEQ ID NO: 938797 - DNA, 25 bp, Mus musculus
ttcggaactggaaatgaccatcctc

SEQ ID NO: 938798 - DNA, 25 bp, Mus musculus
ttcggaactggatatgaccatcctc

SEQ ID NO: 938799 - DNA, 25 bp, Mus musculus
ttcggaactgtgcaagctgccccaa

SEQ ID NO: 938800 - DNA, 25 bp, Mus musculus
ttcggaactgtggaagctgccccaa

SEQ ID NO: 938801 - DNA, 25 bp, Mus musculus
ttcggaagattaaatgctacatgtg

SEQ ID NO: 938802 - DNA, 25 bp, Mus musculus
ttcggaagattatatgctacatgtg

SEQ ID NO: 938803 - DNA, 25 bp, Mus musculus
ttcggaagccccatggtgctatggg

SEQ ID NO: 938804 - DNA, 25 bp, Mus musculus
ttcggaagccccttggtgctatggg

SEQ ID NO: 938805 - DNA, 25 bp, Mus musculus
ttcggaatcccaaactccaaattgt

SEQ ID NO: 938806 - DNA, 25 bp, Mus musculus
ttcggaatcccatactccaaattgt

SEQ ID NO: 938807 - DNA, 25 bp, Mus musculus
ttcggaatcctaagacacctacatc

SEQ ID NO: 938808 - DNA, 25 bp, Mus musculus
ttcggaatcctatgacacctacatc

SEQ ID NO: 938809 - DNA, 25 bp, Mus musculus
ttcggaatgtatatgttggctgttt

SEQ ID NO: 938810 - DNA, 25 bp, Mus musculus
ttcggaatgtatttgttggctgttt

SEQ ID NO: 938811 - DNA, 25 bp, Mus musculus
ttcggacaatccacatcaagcaaga

SEQ ID NO: 938812 - DNA, 25 bp, Mus musculus
ttcggacaatcctcatcaagcaaga

SEQ ID NO: 938813 - DNA, 25 bp, Mus musculus
ttcggacacatgcagttaaactcac

SEQ ID NO: 938814 - DNA, 25 bp, Mus musculus
ttcggacacatggagttaaactcac

SEQ ID NO: 938815 - DNA, 25 bp, Mus musculus
ttcggacagtgacggccgcatcacc

SEQ ID NO: 938816 - DNA, 25 bp, Mus musculus
ttcggacagtgagggccgcatcacc

SEQ ID NO: 938817 - DNA, 25 bp, Mus musculus
ttcggacagttcctgcctgaggcaa

SEQ ID NO: 938818 - DNA, 25 bp, Mus musculus
ttcggacagttcgtgcctgaggcaa

SEQ ID NO: 938819 - DNA, 25 bp, Mus musculus
ttcggaccagatatcatcacagtca

SEQ ID NO: 938820 - DNA, 25 bp, Mus musculus
ttcggaccagatttcatcacagtca

SEQ ID NO: 938821 - DNA, 25 bp, Mus musculus
ttcggacccatcactttaaccaaag

SEQ ID NO: 938822 - DNA, 25 bp, Mus musculus
ttcggacccatctctttaaccaaag

SEQ ID NO: 938823 - DNA, 25 bp, Mus musculus
ttcggaccctgtaattcctaccagt

SEQ ID NO: 938824 - DNA, 25 bp, Mus musculus
ttcggaccctgttattcctaccagt

SEQ ID NO: 938825 - DNA, 25 bp, Mus musculus
ttcggactcctgcagtcactctgtg

SEQ ID NO: 938826 - DNA, 25 bp, Mus musculus
ttcggactcctggagtcactctgtg

SEQ ID NO: 938827 - DNA, 25 bp, Mus musculus
ttcggactgatgcactaatgccatc

SEQ ID NO: 938828 - DNA, 25 bp, Mus musculus
ttcggactgatggactaatgccatc

SEQ ID NO: 938829 - DNA, 25 bp, Mus musculus
ttcggactggaactgctctacatag

SEQ ID NO: 938830 - DNA, 25 bp, Mus musculus
ttcggactggaagtgctctacatag

SEQ ID NO: 938831 - DNA, 25 bp, Mus musculus
ttcggagagctcatctacccctgga

SEQ ID NO: 938832 - DNA, 25 bp, Mus musculus
ttcggagagctcttctacccctgga

SEQ ID NO: 938833 - DNA, 25 bp, Mus musculus
ttcggagcaaccacctgggcatcaa

SEQ ID NO: 938834 - DNA, 25 bp, Mus musculus
ttcggagcaacctcctgggcatcaa

SEQ ID NO: 938835 - DNA, 25 bp, Mus musculus
ttcggagcctgacatgaaaccatct

SEQ ID NO: 938836 - DNA, 25 bp, Mus musculus
ttcggagcctgagatgaaaccatct

SEQ ID NO: 938837 - DNA, 25 bp, Mus musculus
ttcggagcgctcagactctgataga

SEQ ID NO: 938838 - DNA, 25 bp, Mus musculus
ttcggagcgctctgactctgataga

SEQ ID NO: 938839 - DNA, 25 bp, Mus musculus
ttcggagctgttctctctgccaaag

SEQ ID NO: 938840 - DNA, 25 bp, Mus musculus
ttcggagctgttgtctctgccaaag

SEQ ID NO: 938841 - DNA, 25 bp, Mus musculus
ttcggaggaccaagcactgcagctg

SEQ ID NO: 938842 - DNA, 25 bp, Mus musculus
ttcggaggaccatgcactgcagctg

SEQ ID NO: 938843 - DNA, 25 bp, Mus musculus
ttcggagggttcagtcactataata

SEQ ID NO: 938844 - DNA, 25 bp, Mus musculus
ttcggagggttcatctgtagtgcag

SEQ ID NO: 938845 - DNA, 25 bp, Mus musculus
ttcggagggttctgtcactataata

SEQ ID NO: 938846 - DNA, 25 bp, Mus musculus
ttcggagggttcttctgtagtgcag

SEQ ID NO: 938847 - DNA, 25 bp, Mus musculus
ttcggagtacccacggtgactgcga

SEQ ID NO: 938848 - DNA, 25 bp, Mus musculus
ttcggagtaccctcggtgactgcga

SEQ ID NO: 938849 - DNA, 25 bp, Mus musculus
ttcggagtatgcactgcgcatgtct

SEQ ID NO: 938850 - DNA, 25 bp, Mus musculus
ttcggagtatgctctgcgcatgtct

SEQ ID NO: 938851 - DNA, 25 bp, Mus musculus
ttcggagtcgtgaatgtctgccgac

SEQ ID NO: 938852 - DNA, 25 bp, Mus musculus
ttcggagtcgtgtatgtctgccgac

SEQ ID NO: 938853 - DNA, 25 bp, Mus musculus
ttcggagtctttagttctcagccct

SEQ ID NO: 938854 - DNA, 25 bp, Mus musculus
ttcggagtcttttgttctcagccct

SEQ ID NO: 938855 - DNA, 25 bp, Mus musculus
ttcggagttcccaataagcctcttt

SEQ ID NO: 938856 - DNA, 25 bp, Mus musculus
ttcggagttccctataagcctcttt

SEQ ID NO: 938857 - DNA, 25 bp, Mus musculus
ttcggagtttcacgctagttagaac

SEQ ID NO: 938858 - DNA, 25 bp, Mus musculus
ttcggagtttcaggctagttagaac

SEQ ID NO: 938859 - DNA, 25 bp, Mus musculus
ttcggagtttctcttccattctttg

SEQ ID NO: 938860 - DNA, 25 bp, Mus musculus
ttcggagtttctgttccattctttg

SEQ ID NO: 938861 - DNA, 25 bp, Mus musculus
ttcggatatcgacctcacacagact

SEQ ID NO: 938862 - DNA, 25 bp, Mus musculus
ttcggatatcgagctcacacagact

SEQ ID NO: 938863 - DNA, 25 bp, Mus musculus
ttcggatcacgcccggagtagaagc

SEQ ID NO: 938864 - DNA, 25 bp, Mus musculus
ttcggatcacgcgcggagtagaagc

SEQ ID NO: 938865 - DNA, 25 bp, Mus musculus
ttcggatcgcccatcagaagtacct

SEQ ID NO: 938866 - DNA, 25 bp, Mus musculus
ttcggatcgcccttcagaagtacct

SEQ ID NO: 938867 - DNA, 25 bp, Mus musculus
ttcggatctattctcccactggact

SEQ ID NO: 938868 - DNA, 25 bp, Mus musculus
ttcggatctattgtcccactggact

SEQ ID NO: 938869 - DNA, 25 bp, Mus musculus
ttcggatgcacacgcctctgatggt

SEQ ID NO: 938870 - DNA, 25 bp, Mus musculus
ttcggatgcacaggcctctgatggt

SEQ ID NO: 938871 - DNA, 25 bp, Mus musculus
ttcggatgtgctccagtgactcact

SEQ ID NO: 938872 - DNA, 25 bp, Mus musculus
ttcggatgtgctgcagtgactcact

SEQ ID NO: 938873 - DNA, 25 bp, Mus musculus
ttcggattccttctttcctccattt

SEQ ID NO: 938874 - DNA, 25 bp, Mus musculus
ttcggattccttgtttcctccattt

SEQ ID NO: 938875 - DNA, 25 bp, Mus musculus
ttcggcaacccgagacagggtcatt

SEQ ID NO: 938876 - DNA, 25 bp, Mus musculus
ttcggcaacccgtgacagggtcatt

SEQ ID NO: 938877 - DNA, 25 bp, Mus musculus
ttcggcaatgaaaagcctacgtttt

SEQ ID NO: 938878 - DNA, 25 bp, Mus musculus
ttcggcaatgaatagcctacgtttt

SEQ ID NO: 938879 - DNA, 25 bp, Mus musculus
ttcggcacaggactccttttaaaga

SEQ ID NO: 938880 - DNA, 25 bp, Mus musculus
ttcggcacaggagtccttttaaaga

SEQ ID NO: 938881 - DNA, 25 bp, Mus musculus
ttcggcacctctatctaaccttttc

SEQ ID NO: 938882 - DNA, 25 bp, Mus musculus
ttcggcacctctttctaaccttttc

SEQ ID NO: 938883 - DNA, 25 bp, Mus musculus
ttcggcagcacacgtacaatgtctt

SEQ ID NO: 938884 - DNA, 25 bp, Mus musculus
ttcggcagcacaggtacaatgtctt

SEQ ID NO: 938885 - DNA, 25 bp, Mus musculus
ttcggcagccgacgacactgaagcc

SEQ ID NO: 938886 - DNA, 25 bp, Mus musculus
ttcggcagccgaggacactgaagcc

SEQ ID NO: 938887 - DNA, 25 bp, Mus musculus
ttcggcagcgaaactgggttgtcct

SEQ ID NO: 938888 - DNA, 25 bp, Mus musculus
ttcggcagcgaatctgggttgtcct

SEQ ID NO: 938889 - DNA, 25 bp, Mus musculus
ttcggcagcgacaggcgttggctcc

SEQ ID NO: 938890 - DNA, 25 bp, Mus musculus
ttcggcagcgactggcgttggctcc

SEQ ID NO: 938891 - DNA, 25 bp, Mus musculus
ttcggcagcgcacacaatgaggaca

SEQ ID NO: 938892 - DNA, 25 bp, Mus musculus
ttcggcagcgcagacaatgaggaca

SEQ ID NO: 938893 - DNA, 25 bp, Mus musculus
ttcggccacctgcatatgcacagtg

SEQ ID NO: 938894 - DNA, 25 bp, Mus musculus
ttcggccacctggatatgcacagtg

SEQ ID NO: 938895 - DNA, 25 bp, Mus musculus
ttcggccactgacttagactctgaa

SEQ ID NO: 938896 - DNA, 25 bp, Mus musculus
ttcggccactgagttagactctgaa

SEQ ID NO: 938897 - DNA, 25 bp, Mus musculus
ttcggccagcgccactgaggacagc

SEQ ID NO: 938898 - DNA, 25 bp, Mus musculus
ttcggccagcgcgactgaggacagc

SEQ ID NO: 938899 - DNA, 25 bp, Mus musculus
ttcggccatcctaagaccaaaggtc

SEQ ID NO: 938900 - DNA, 25 bp, Mus musculus
ttcggccatccttagaccaaaggtc

SEQ ID NO: 938901 - DNA, 25 bp, Mus musculus
ttcggcccggtcaatcatgaagaac

SEQ ID NO: 938902 - DNA, 25 bp, Mus musculus
ttcggcccggtctatcatgaagaac

SEQ ID NO: 938903 - DNA, 25 bp, Mus musculus
ttcggccgcgcccaggctggctaga

SEQ ID NO: 938904 - DNA, 25 bp, Mus musculus
ttcggccgcgccgaggctggctaga

SEQ ID NO: 938905 - DNA, 25 bp, Mus musculus
ttcggccgcgtcagcgcagagctca

SEQ ID NO: 938906 - DNA, 25 bp, Mus musculus
ttcggccgcgtctgcgcagagctca

SEQ ID NO: 938907 - DNA, 25 bp, Mus musculus
ttcggccggcttcaacaggcagcgc

SEQ ID NO: 938908 - DNA, 25 bp, Mus musculus
ttcggccggcttgaacaggcagcgc

SEQ ID NO: 938909 - DNA, 25 bp, Mus musculus
ttcggcgaatgacccactgtcgttc

SEQ ID NO: 938910 - DNA, 25 bp, Mus musculus
ttcggcgaatgagccactgtcgttc

SEQ ID NO: 938911 - DNA, 25 bp, Mus musculus
ttcggcgagataaacctataacagg

SEQ ID NO: 938912 - DNA, 25 bp, Mus musculus
ttcggcgagatatacctataacagg

SEQ ID NO: 938913 - DNA, 25 bp, Mus musculus
ttcggcgcacttagtaaaatcttgt

SEQ ID NO: 938914 - DNA, 25 bp, Mus musculus
ttcggcgcactttgtaaaatcttgt

SEQ ID NO: 938915 - DNA, 25 bp, Mus musculus
ttcggcggagacagtatatccatga

SEQ ID NO: 938916 - DNA, 25 bp, Mus musculus
ttcggcggagactgtatatccatga

SEQ ID NO: 938917 - DNA, 25 bp, Mus musculus
ttcggcggccccaagacctgcggct

SEQ ID NO: 938918 - DNA, 25 bp, Mus musculus
ttcggcggcccctagacctgcggct

SEQ ID NO: 938919 - DNA, 25 bp, Mus musculus
ttcggcggcgtacgagagcacctat

SEQ ID NO: 938920 - DNA, 25 bp, Mus musculus
ttcggcggcgtaggagagcacctat

SEQ ID NO: 938921 - DNA, 25 bp, Mus musculus
ttcggcgggcacaggcattcagaaa

SEQ ID NO: 938922 - DNA, 25 bp, Mus musculus
ttcggcgggcactggcattcagaaa

SEQ ID NO: 938923 - DNA, 25 bp, Mus musculus
ttcggcgtgtgacctctgcggcttc

SEQ ID NO: 938924 - DNA, 25 bp, Mus musculus
ttcggcgtgtgagctctgcggcttc

SEQ ID NO: 938925 - DNA, 25 bp, Mus musculus
ttcggctaaggcagaaaaggtacat

SEQ ID NO: 938926 - DNA, 25 bp, Mus musculus
ttcggctaaggctgaaaaggtacat

SEQ ID NO: 938927 - DNA, 25 bp, Mus musculus
ttcggctacagcacctactgatgat

SEQ ID NO: 938928 - DNA, 25 bp, Mus musculus
ttcggctacagctcctactgatgat

SEQ ID NO: 938929 - DNA, 25 bp, Mus musculus
ttcggctacataaataagacccctt

SEQ ID NO: 938930 - DNA, 25 bp, Mus musculus
ttcggctacatatataagacccctt

SEQ ID NO: 938931 - DNA, 25 bp, Mus musculus
ttcggctactgtattttctaatatg

SEQ ID NO: 938932 - DNA, 25 bp, Mus musculus
ttcggctactgttttttctaatatg

SEQ ID NO: 938933 - DNA, 25 bp, Mus musculus
ttcggctagttgcttaaggatggta

SEQ ID NO: 938934 - DNA, 25 bp, Mus musculus
ttcggctagttggttaaggatggta

SEQ ID NO: 938935 - DNA, 25 bp, Mus musculus
ttcggctcatagaaagctgtccgct

SEQ ID NO: 938936 - DNA, 25 bp, Mus musculus
ttcggctcatagtaagctgtccgct

SEQ ID NO: 938937 - DNA, 25 bp, Mus musculus
ttcggctcccctacgggaagattca

SEQ ID NO: 938938 - DNA, 25 bp, Mus musculus
ttcggctccccttcgggaagattca

SEQ ID NO: 938939 - DNA, 25 bp, Mus musculus
ttcggctccgacatggaagatggac

SEQ ID NO: 938940 - DNA, 25 bp, Mus musculus
ttcggctccgacttggaagatggac

SEQ ID NO: 938941 - DNA, 25 bp, Mus musculus
ttcggctctactagtcttgaacatg

SEQ ID NO: 938942 - DNA, 25 bp, Mus musculus
ttcggctctacttgtcttgaacatg

SEQ ID NO: 938943 - DNA, 25 bp, Mus musculus
ttcggctcttggaacttcgatgtca

SEQ ID NO: 938944 - DNA, 25 bp, Mus musculus
ttcggctcttggtacttcgatgtca

SEQ ID NO: 938945 - DNA, 25 bp, Mus musculus
ttcggctgctgacgctggacactga

SEQ ID NO: 938946 - DNA, 25 bp, Mus musculus
ttcggctgctgaggctggacactga

SEQ ID NO: 938947 - DNA, 25 bp, Mus musculus
ttcggctgcttcactatcaaatctg

SEQ ID NO: 938948 - DNA, 25 bp, Mus musculus
ttcggctgcttctctatcaaatctg

SEQ ID NO: 938949 - DNA, 25 bp, Mus musculus
ttcggctgggccatcttggccttgt

SEQ ID NO: 938950 - DNA, 25 bp, Mus musculus
ttcggctgggccttcttggccttgt

SEQ ID NO: 938951 - DNA, 25 bp, Mus musculus
ttcggctgttcccttgctacaagaa

SEQ ID NO: 938952 - DNA, 25 bp, Mus musculus
ttcggctgttccgttgctacaagaa

SEQ ID NO: 938953 - DNA, 25 bp, Mus musculus
ttcggcttcatcacctatcagggat

SEQ ID NO: 938954 - DNA, 25 bp, Mus musculus
ttcggcttcatctcctatcagggat

SEQ ID NO: 938955 - DNA, 25 bp, Mus musculus
ttcggcttccaacccagaaagagca

SEQ ID NO: 938956 - DNA, 25 bp, Mus musculus
ttcggcttccaagccagaaagagca

SEQ ID NO: 938957 - DNA, 25 bp, Mus musculus
ttcgggaacagcacgagcacatcaa

SEQ ID NO: 938958 - DNA, 25 bp, Mus musculus
ttcgggaacagctcgagcacatcaa

SEQ ID NO: 938959 - DNA, 25 bp, Mus musculus
ttcgggaacccacgcatctctatac

SEQ ID NO: 938960 - DNA, 25 bp, Mus musculus
ttcgggaacccaggcatctctatac

SEQ ID NO: 938961 - DNA, 25 bp, Mus musculus
ttcgggaagatcacctctctcagct

SEQ ID NO: 938962 - DNA, 25 bp, Mus musculus
ttcgggaagatctcctctctcagct

SEQ ID NO: 938963 - DNA, 25 bp, Mus musculus
ttcgggacacctacgaggcgtgcga

SEQ ID NO: 938964 - DNA, 25 bp, Mus musculus
ttcgggacaccttcgaggcgtgcga

SEQ ID NO: 938965 - DNA, 25 bp, Mus musculus
ttcgggacagaaatcctcatgggca

SEQ ID NO: 938966 - DNA, 25 bp, Mus musculus
ttcgggacagaattcctcatgggca

SEQ ID NO: 938967 - DNA, 25 bp, Mus musculus
ttcgggacaggaaacgttgactgca

SEQ ID NO: 938968 - DNA, 25 bp, Mus musculus
ttcgggacaggatacgttgactgca

SEQ ID NO: 938969 - DNA, 25 bp, Mus musculus
ttcgggaccccacaagagtatgtta

SEQ ID NO: 938970 - DNA, 25 bp, Mus musculus
ttcgggaccccagaagagtatgtta

SEQ ID NO: 938971 - DNA, 25 bp, Mus musculus
ttcgggaccgtgctcctagttcttg

SEQ ID NO: 938972 - DNA, 25 bp, Mus musculus
ttcgggaccgtggtcctagttcttg

SEQ ID NO: 938973 - DNA, 25 bp, Mus musculus
ttcgggacctcgagcggcagtcaga

SEQ ID NO: 938974 - DNA, 25 bp, Mus musculus
ttcgggacctcgtgcggcagtcaga

SEQ ID NO: 938975 - DNA, 25 bp, Mus musculus
ttcgggacgaacatcggctcagcag

SEQ ID NO: 938976 - DNA, 25 bp, Mus musculus
ttcgggacgaacttcggctcagcag

SEQ ID NO: 938977 - DNA, 25 bp, Mus musculus
ttcgggactcagctaaaccacgtgg

SEQ ID NO: 938978 - DNA, 25 bp, Mus musculus
ttcgggactcaggtaaaccacgtgg

SEQ ID NO: 938979 - DNA, 25 bp, Mus musculus
ttcgggactggaaaagagggactat

SEQ ID NO: 938980 - DNA, 25 bp, Mus musculus
ttcgggactggataagagggactat

SEQ ID NO: 938981 - DNA, 25 bp, Mus musculus
ttcgggatcaggcaggatgcaccac

SEQ ID NO: 938982 - DNA, 25 bp, Mus musculus
ttcgggatcagggaggatgcaccac

SEQ ID NO: 938983 - DNA, 25 bp, Mus musculus
ttcgggatgcctctatctggttatt

SEQ ID NO: 938984 - DNA, 25 bp, Mus musculus
ttcgggatgcctgtatctggttatt

SEQ ID NO: 938985 - DNA, 25 bp, Mus musculus
ttcgggcaagaaactctgcccctga

SEQ ID NO: 938986 - DNA, 25 bp, Mus musculus
ttcgggcaagaatctctgcccctga

SEQ ID NO: 938987 - DNA, 25 bp, Mus musculus
ttcgggcagcatagggagtatttac

SEQ ID NO: 938988 - DNA, 25 bp, Mus musculus
ttcgggcagcattgggagtatttac

SEQ ID NO: 938989 - DNA, 25 bp, Mus musculus
ttcgggcagcttagaccttatttag

SEQ ID NO: 938990 - DNA, 25 bp, Mus musculus
ttcgggcagctttgaccttatttag

SEQ ID NO: 938991 - DNA, 25 bp, Mus musculus
ttcgggccaaagatcagaatgggca

SEQ ID NO: 938992 - DNA, 25 bp, Mus musculus
ttcgggccaaagttcagaatgggca

SEQ ID NO: 938993 - DNA, 25 bp, Mus musculus
ttcgggccaagcacacacaggagag

SEQ ID NO: 938994 - DNA, 25 bp, Mus musculus
ttcgggccaagctcacacaggagag

SEQ ID NO: 938995 - DNA, 25 bp, Mus musculus
ttcgggccacagaagaaccgtctac

SEQ ID NO: 938996 - DNA, 25 bp, Mus musculus
ttcgggccacagtagaaccgtctac

SEQ ID NO: 938997 - DNA, 25 bp, Mus musculus
ttcgggccattgacaaccagtacac

SEQ ID NO: 938998 - DNA, 25 bp, Mus musculus
ttcgggccattgtcaaccagtacac

SEQ ID NO: 938999 - DNA, 25 bp, Mus musculus
ttcgggcgctagataaagaacaaag

SEQ ID NO: 939000 - DNA, 25 bp, Mus musculus
ttcgggcgctagttaaagaacaaag

SEQ ID NO: 939001 - DNA, 25 bp, Mus musculus
ttcgggcggcaacagagaggcgtgt

SEQ ID NO: 939002 - DNA, 25 bp, Mus musculus
ttcgggcggcaagagagaggcgtgt

SEQ ID NO: 939003 - DNA, 25 bp, Mus musculus
ttcgggcgggcgacttcactctgga

SEQ ID NO: 939004 - DNA, 25 bp, Mus musculus
ttcgggcgggcgtcttcactctgga

SEQ ID NO: 939005 - DNA, 25 bp, Mus musculus
ttcgggcggtgacatggcttcgccg

SEQ ID NO: 939006 - DNA, 25 bp, Mus musculus
ttcgggcggtgagatggcttcgccg

SEQ ID NO: 939007 - DNA, 25 bp, Mus musculus
ttcgggcgttggcagctagctaatt

SEQ ID NO: 939008 - DNA, 25 bp, Mus musculus
ttcgggcgttgggagctagctaatt

SEQ ID NO: 939009 - DNA, 25 bp, Mus musculus
ttcgggctccacagtcagtgcaggt

SEQ ID NO: 939010 - DNA, 25 bp, Mus musculus
ttcgggctccactgtcagtgcaggt

SEQ ID NO: 939011 - DNA, 25 bp, Mus musculus
ttcgggctgatcatccagcaggtgt

SEQ ID NO: 939012 - DNA, 25 bp, Mus musculus
ttcgggctgatcttccagcaggtgt

SEQ ID NO: 939013 - DNA, 25 bp, Mus musculus
ttcgggctgcctctatgacacattc

SEQ ID NO: 939014 - DNA, 25 bp, Mus musculus
ttcgggctgcctgtatgacacattc

SEQ ID NO: 939015 - DNA, 25 bp, Mus musculus
ttcgggctggcacagccagctcagt

SEQ ID NO: 939016 - DNA, 25 bp, Mus musculus
ttcgggctggcagagccagctcagt

SEQ ID NO: 939017 - DNA, 25 bp, Mus musculus
ttcgggctgtgtagccagactgcta

SEQ ID NO: 939018 - DNA, 25 bp, Mus musculus
ttcgggctgtgttgccagactgcta

SEQ ID NO: 939019 - DNA, 25 bp, Mus musculus
ttcgggctttggatcacgctatatc

SEQ ID NO: 939020 - DNA, 25 bp, Mus musculus
ttcgggctttggttcacgctatatc

SEQ ID NO: 939021 - DNA, 25 bp, Mus musculus
ttcgggctttttcaattctgaattt

SEQ ID NO: 939022 - DNA, 25 bp, Mus musculus
ttcgggctttttgaattctgaattt

SEQ ID NO: 939023 - DNA, 25 bp, Mus musculus
ttcgggtcagacattatgtaagctt

SEQ ID NO: 939024 - DNA, 25 bp, Mus musculus
ttcgggtcagactttatgtaagctt

SEQ ID NO: 939025 - DNA, 25 bp, Mus musculus
ttcgggtccactcgtgctggagtca

SEQ ID NO: 939026 - DNA, 25 bp, Mus musculus
ttcgggtccactggtgctggagtca

SEQ ID NO: 939027 - DNA, 25 bp, Mus musculus
ttcgggtctcatcaaggttgcttta

SEQ ID NO: 939028 - DNA, 25 bp, Mus musculus
ttcgggtctcatgaaggttgcttta

SEQ ID NO: 939029 - DNA, 25 bp, Mus musculus
ttcgggtgacatccttctaatcacc

SEQ ID NO: 939030 - DNA, 25 bp, Mus musculus
ttcgggtgacatgcttctaatcacc

SEQ ID NO: 939031 - DNA, 25 bp, Mus musculus
ttcgggttacagagtcacctgttgc

SEQ ID NO: 939032 - DNA, 25 bp, Mus musculus
ttcgggttacagtgtcacctgttgc

SEQ ID NO: 939033 - DNA, 25 bp, Mus musculus
ttcggtaacttaattctctctggga

SEQ ID NO: 939034 - DNA, 25 bp, Mus musculus
ttcggtaacttatttctctctggga

SEQ ID NO: 939035 - DNA, 25 bp, Mus musculus
ttcggtaagagacccctgctttcct

SEQ ID NO: 939036 - DNA, 25 bp, Mus musculus
ttcggtaagagagccctgctttcct

SEQ ID NO: 939037 - DNA, 25 bp, Mus musculus
ttcggtaccctgacgtggcaggagc

SEQ ID NO: 939038 - DNA, 25 bp, Mus musculus
ttcggtaccctgtcgtggcaggagc

SEQ ID NO: 939039 - DNA, 25 bp, Mus musculus
ttcggtaccgaaacgcagtcattgc

SEQ ID NO: 939040 - DNA, 25 bp, Mus musculus
ttcggtaccgaatcgcagtcattgc

SEQ ID NO: 939041 - DNA, 25 bp, Mus musculus
ttcggtagctgaaggccaactccca

SEQ ID NO: 939042 - DNA, 25 bp, Mus musculus
ttcggtagctgatggccaactccca

SEQ ID NO: 939043 - DNA, 25 bp, Mus musculus
ttcggtatattactcacaaggatga

SEQ ID NO: 939044 - DNA, 25 bp, Mus musculus
ttcggtatattagtcacaaggatga

SEQ ID NO: 939045 - DNA, 25 bp, Mus musculus
ttcggtatctttcctcttctgggac

SEQ ID NO: 939046 - DNA, 25 bp, Mus musculus
ttcggtatctttgctcttctgggac

SEQ ID NO: 939047 - DNA, 25 bp, Mus musculus
ttcggtatgtgaaggaacttccttt

SEQ ID NO: 939048 - DNA, 25 bp, Mus musculus
ttcggtatgtgatggaacttccttt

SEQ ID NO: 939049 - DNA, 25 bp, Mus musculus
ttcggtattcttacaaggagatgac

SEQ ID NO: 939050 - DNA, 25 bp, Mus musculus
ttcggtattctttcaaggagatgac

SEQ ID NO: 939051 - DNA, 25 bp, Mus musculus
ttcggtcatccgacaatgccttgca

SEQ ID NO: 939052 - DNA, 25 bp, Mus musculus
ttcggtcatccgtcaatgccttgca

SEQ ID NO: 939053 - DNA, 25 bp, Mus musculus
ttcggtccagtgaagctgtacatat

SEQ ID NO: 939054 - DNA, 25 bp, Mus musculus
ttcggtccagtgtagctgtacatat

SEQ ID NO: 939055 - DNA, 25 bp, Mus musculus
ttcggtcccggtataacctaggcat

SEQ ID NO: 939056 - DNA, 25 bp, Mus musculus
ttcggtcccggtttaacctaggcat

SEQ ID NO: 939057 - DNA, 25 bp, Mus musculus
ttcggtctactcagcggtaagcagc

SEQ ID NO: 939058 - DNA, 25 bp, Mus musculus
ttcggtctactctgcggtaagcagc

SEQ ID NO: 939059 - DNA, 25 bp, Mus musculus
ttcggtctcaatcctatcatgcaag

SEQ ID NO: 939060 - DNA, 25 bp, Mus musculus
ttcggtctcaatgctatcatgcaag

SEQ ID NO: 939061 - DNA, 25 bp, Mus musculus
ttcggtctgcagaactacacagtag

SEQ ID NO: 939062 - DNA, 25 bp, Mus musculus
ttcggtctgcagtactacacagtag

SEQ ID NO: 939063 - DNA, 25 bp, Mus musculus
ttcggtgagcatctgggtactttga

SEQ ID NO: 939064 - DNA, 25 bp, Mus musculus
ttcggtgagcatgtgggtactttga

SEQ ID NO: 939065 - DNA, 25 bp, Mus musculus
ttcggtgcttggctggcacattttc

SEQ ID NO: 939066 - DNA, 25 bp, Mus musculus
ttcggtgcttgggtggcacattttc

SEQ ID NO: 939067 - DNA, 25 bp, Mus musculus
ttcggtggatatcctttgttgcatg

SEQ ID NO: 939068 - DNA, 25 bp, Mus musculus
ttcggtggatatgctttgttgcatg

SEQ ID NO: 939069 - DNA, 25 bp, Mus musculus
ttcggtggattcatctaaggtcctc

SEQ ID NO: 939070 - DNA, 25 bp, Mus musculus
ttcggtggattcttctaaggtcctc

SEQ ID NO: 939071 - DNA, 25 bp, Mus musculus
ttcggtgggcgacatcggcctttcc

SEQ ID NO: 939072 - DNA, 25 bp, Mus musculus
ttcggtgggcgagatcggcctttcc

SEQ ID NO: 939073 - DNA, 25 bp, Mus musculus
ttcggtggttttcgccgtactgagc

SEQ ID NO: 939074 - DNA, 25 bp, Mus musculus
ttcggtggttttggccgtactgagc

SEQ ID NO: 939075 - DNA, 25 bp, Mus musculus
ttcggtgtgacaataccctcaggct

SEQ ID NO: 939076 - DNA, 25 bp, Mus musculus
ttcggtgtgacattaccctcaggct

SEQ ID NO: 939077 - DNA, 25 bp, Mus musculus
ttcggttccatgctacattgatcca

SEQ ID NO: 939078 - DNA, 25 bp, Mus musculus
ttcggttccatggtacattgatcca

SEQ ID NO: 939079 - DNA, 25 bp, Mus musculus
ttcggttctgctcggagagctctaa

SEQ ID NO: 939080 - DNA, 25 bp, Mus musculus
ttcggttctgctgggagagctctaa

SEQ ID NO: 939081 - DNA, 25 bp, Mus musculus
ttcggttcttccaggcaaggtcaga

SEQ ID NO: 939082 - DNA, 25 bp, Mus musculus
ttcggttcttcctggcaaggtcaga

SEQ ID NO: 939083 - DNA, 25 bp, Mus musculus
ttcggttgaccacagggtatgcatc

SEQ ID NO: 939084 - DNA, 25 bp, Mus musculus
ttcggttgaccagagggtatgcatc

SEQ ID NO: 939085 - DNA, 25 bp, Mus musculus
ttcggttgctttactgaacactgtc

SEQ ID NO: 939086 - DNA, 25 bp, Mus musculus
ttcggttgcttttctgaacactgtc

SEQ ID NO: 939087 - DNA, 25 bp, Mus musculus
ttcggttgtcaaatattatgccaaa

SEQ ID NO: 939088 - DNA, 25 bp, Mus musculus
ttcggttgtcaattattatgccaaa

SEQ ID NO: 939089 - DNA, 25 bp, Mus musculus
ttcggtttccacatttctgtgttag

SEQ ID NO: 939090 - DNA, 25 bp, Mus musculus
ttcggtttccacttttctgtgttag

SEQ ID NO: 939091 - DNA, 25 bp, Mus musculus
ttcggtttctagctaccagttttca

SEQ ID NO: 939092 - DNA, 25 bp, Mus musculus
ttcggtttctaggtaccagttttca

SEQ ID NO: 939093 - DNA, 25 bp, Mus musculus
ttcggtttgaatactctgctgttga

SEQ ID NO: 939094 - DNA, 25 bp, Mus musculus
ttcggtttgaattctctgctgttga

SEQ ID NO: 939095 - DNA, 25 bp, Mus musculus
ttcggtttgattacgccttcgatga

SEQ ID NO: 939096 - DNA, 25 bp, Mus musculus
ttcggtttgatttcgccttcgatga

SEQ ID NO: 939097 - DNA, 25 bp, Mus musculus
ttcggttttcccctgcatgtgtcat

SEQ ID NO: 939098 - DNA, 25 bp, Mus musculus
ttcggttttcccgtgcatgtgtcat

SEQ ID NO: 939099 - DNA, 25 bp, Mus musculus
ttcggttttttacgagtggtctcat

SEQ ID NO: 939100 - DNA, 25 bp, Mus musculus
ttcggttttttaggagtggtctcat

SEQ ID NO: 939101 - DNA, 25 bp, Mus musculus
ttcgtaaaacacacagctcactgag

SEQ ID NO: 939102 - DNA, 25 bp, Mus musculus
ttcgtaaaacactcagctcactgag

SEQ ID NO: 939103 - DNA, 25 bp, Mus musculus
ttcgtaaactgaagagtgcaccgca

SEQ ID NO: 939104 - DNA, 25 bp, Mus musculus
ttcgtaaactgatgagtgcaccgca

SEQ ID NO: 939105 - DNA, 25 bp, Mus musculus
ttcgtaaagcagaaccttgccaaag

SEQ ID NO: 939106 - DNA, 25 bp, Mus musculus
ttcgtaaagcagtaccttgccaaag

SEQ ID NO: 939107 - DNA, 25 bp, Mus musculus
ttcgtaacacagcttgggataacac

SEQ ID NO: 939108 - DNA, 25 bp, Mus musculus
ttcgtaacacaggttgggataacac

SEQ ID NO: 939109 - DNA, 25 bp, Mus musculus
ttcgtacaaagtccagctgtgccct

SEQ ID NO: 939110 - DNA, 25 bp, Mus musculus
ttcgtacaaagtgcagctgtgccct

SEQ ID NO: 939111 - DNA, 25 bp, Mus musculus
ttcgtacgctaacccaaactgtaat

SEQ ID NO: 939112 - DNA, 25 bp, Mus musculus
ttcgtacgctaagccaaactgtaat

SEQ ID NO: 939113 - DNA, 25 bp, Mus musculus
ttcgtacggtggatttgtgcagcgc

SEQ ID NO: 939114 - DNA, 25 bp, Mus musculus
ttcgtacggtggttttgtgcagcgc

SEQ ID NO: 939115 - DNA, 25 bp, Mus musculus
ttcgtagacattataagtacacttc

SEQ ID NO: 939116 - DNA, 25 bp, Mus musculus
ttcgtagacattttaagtacacttc

SEQ ID NO: 939117 - DNA, 25 bp, Mus musculus
ttcgtagattttcttttgttgggct

SEQ ID NO: 939118 - DNA, 25 bp, Mus musculus
ttcgtagattttgttttgttgggct

SEQ ID NO: 939119 - DNA, 25 bp, Mus musculus
ttcgtagctcaaataaagtccagtt

SEQ ID NO: 939120 - DNA, 25 bp, Mus musculus
ttcgtagctcaattaaagtccagtt

SEQ ID NO: 939121 - DNA, 25 bp, Mus musculus
ttcgtagctctgctattcactttac

SEQ ID NO: 939122 - DNA, 25 bp, Mus musculus
ttcgtagctctggtattcactttac

SEQ ID NO: 939123 - DNA, 25 bp, Mus musculus
ttcgtatagcacaacctcctagagt

SEQ ID NO: 939124 - DNA, 25 bp, Mus musculus
ttcgtatagcactacctcctagagt

SEQ ID NO: 939125 - DNA, 25 bp, Mus musculus
ttcgtatcccacatcagtattttag

SEQ ID NO: 939126 - DNA, 25 bp, Mus musculus
ttcgtatcccacttcagtattttag

SEQ ID NO: 939127 - DNA, 25 bp, Mus musculus
ttcgtatcctggatcgctttcttca

SEQ ID NO: 939128 - DNA, 25 bp, Mus musculus
ttcgtatcctggttcgctttcttca

SEQ ID NO: 939129 - DNA, 25 bp, Mus musculus
ttcgtatcgatgaagtctgctggta

SEQ ID NO: 939130 - DNA, 25 bp, Mus musculus
ttcgtatcgatgtagtctgctggta

SEQ ID NO: 939131 - DNA, 25 bp, Mus musculus
ttcgtatctcttatgtctgactctc

SEQ ID NO: 939132 - DNA, 25 bp, Mus musculus
ttcgtatctcttttgtctgactctc

SEQ ID NO: 939133 - DNA, 25 bp, Mus musculus
ttcgtattgggcaccggaacaacaa

SEQ ID NO: 939134 - DNA, 25 bp, Mus musculus
ttcgtattgggctccggaacaacaa

SEQ ID NO: 939135 - DNA, 25 bp, Mus musculus
ttcgtcaacagcaagacacttcctg

SEQ ID NO: 939136 - DNA, 25 bp, Mus musculus
ttcgtcaacagctagacacttcctg

SEQ ID NO: 939137 - DNA, 25 bp, Mus musculus
ttcgtcaggattccagactacaggg

SEQ ID NO: 939138 - DNA, 25 bp, Mus musculus
ttcgtcaggattgcagactacaggg

SEQ ID NO: 939139 - DNA, 25 bp, Mus musculus
ttcgtcagggagcatgagaccctac

SEQ ID NO: 939140 - DNA, 25 bp, Mus musculus
ttcgtcagggaggatgagaccctac

SEQ ID NO: 939141 - DNA, 25 bp, Mus musculus
ttcgtcatcaatctagaaggtggtg

SEQ ID NO: 939142 - DNA, 25 bp, Mus musculus
ttcgtcatcaatgtagaaggtggtg

SEQ ID NO: 939143 - DNA, 25 bp, Mus musculus
ttcgtccaaatcacggcactgctgg

SEQ ID NO: 939144 - DNA, 25 bp, Mus musculus
ttcgtccaaatctcggcactgctgg

SEQ ID NO: 939145 - DNA, 25 bp, Mus musculus
ttcgtccagcttaagttaactgatt

SEQ ID NO: 939146 - DNA, 25 bp, Mus musculus
ttcgtccagctttagttaactgatt

SEQ ID NO: 939147 - DNA, 25 bp, Mus musculus
ttcgtccattctctaaataacttgt

SEQ ID NO: 939148 - DNA, 25 bp, Mus musculus
ttcgtccattctgtaaataacttgt

SEQ ID NO: 939149 - DNA, 25 bp, Mus musculus
ttcgtcccaacactggaatgtaagg

SEQ ID NO: 939150 - DNA, 25 bp, Mus musculus
ttcgtcccaacagtggaatgtaagg

SEQ ID NO: 939151 - DNA, 25 bp, Mus musculus
ttcgtcccagacacacaagactagg

SEQ ID NO: 939152 - DNA, 25 bp, Mus musculus
ttcgtcccagactcacaagactagg

SEQ ID NO: 939153 - DNA, 25 bp, Mus musculus
ttcgtcccagagacatgtacaccag

SEQ ID NO: 939154 - DNA, 25 bp, Mus musculus
ttcgtcccagagtcatgtacaccag

SEQ ID NO: 939155 - DNA, 25 bp, Mus musculus
ttcgtcctctccagccaaacaagaa

SEQ ID NO: 939156 - DNA, 25 bp, Mus musculus
ttcgtcctctcctgccaaacaagaa

SEQ ID NO: 939157 - DNA, 25 bp, Mus musculus
ttcgtcgaccccagaaagggatcat

SEQ ID NO: 939158 - DNA, 25 bp, Mus musculus
ttcgtcgacccctgaaagggatcat

SEQ ID NO: 939159 - DNA, 25 bp, Mus musculus
ttcgtcggccagacacccctggtgg

SEQ ID NO: 939160 - DNA, 25 bp, Mus musculus
ttcgtcggccagtcacccctggtgg

SEQ ID NO: 939161 - DNA, 25 bp, Mus musculus
ttcgtcgtaggaagatgatgcagtc

SEQ ID NO: 939162 - DNA, 25 bp, Mus musculus
ttcgtcgtaggatgatgatgcagtc

SEQ ID NO: 939163 - DNA, 25 bp, Mus musculus
ttcgtctaccctatggcacataaag

SEQ ID NO: 939164 - DNA, 25 bp, Mus musculus
ttcgtctaccctttggcacataaag

SEQ ID NO: 939165 - DNA, 25 bp, Mus musculus
ttcgtctcagaacttccagtcacat

SEQ ID NO: 939166 - DNA, 25 bp, Mus musculus
ttcgtctcagaagttccagtcacat

SEQ ID NO: 939167 - DNA, 25 bp, Mus musculus
ttcgtctcggcgacctggagcggcc

SEQ ID NO: 939168 - DNA, 25 bp, Mus musculus
ttcgtctcggcgtcctggagcggcc

SEQ ID NO: 939169 - DNA, 25 bp, Mus musculus
ttcgtctgcagaagcgcggcacagg

SEQ ID NO: 939170 - DNA, 25 bp, Mus musculus
ttcgtctgcagatgcgcggcacagg

SEQ ID NO: 939171 - DNA, 25 bp, Mus musculus
ttcgtctgtctacaaaacccaggcc

SEQ ID NO: 939172 - DNA, 25 bp, Mus musculus
ttcgtctgtctagaaaacccaggcc

SEQ ID NO: 939173 - DNA, 25 bp, Mus musculus
ttcgtctgtctcatcccttaatttt

SEQ ID NO: 939174 - DNA, 25 bp, Mus musculus
ttcgtctgtctcttcccttaatttt

SEQ ID NO: 939175 - DNA, 25 bp, Mus musculus
ttcgtctgtgtgatgtcaagagcca

SEQ ID NO: 939176 - DNA, 25 bp, Mus musculus
ttcgtctgtgtgttgtcaagagcca

SEQ ID NO: 939177 - DNA, 25 bp, Mus musculus
ttcgtcttcatacggcgctgaggca

SEQ ID NO: 939178 - DNA, 25 bp, Mus musculus
ttcgtcttcatagggcgctgaggca

SEQ ID NO: 939179 - DNA, 25 bp, Mus musculus
ttcgtcttcttcctccaaggaatat

SEQ ID NO: 939180 - DNA, 25 bp, Mus musculus
ttcgtcttcttcgtccaaggaatat

SEQ ID NO: 939181 - DNA, 25 bp, Mus musculus
ttcgtctttgcacccgtcaaggaca

SEQ ID NO: 939182 - DNA, 25 bp, Mus musculus
ttcgtctttgcagccgtcaaggaca

SEQ ID NO: 939183 - DNA, 25 bp, Mus musculus
ttcgtgaacgttctcaattgtttac

SEQ ID NO: 939184 - DNA, 25 bp, Mus musculus
ttcgtgaacgttgtcaattgtttac

SEQ ID NO: 939185 - DNA, 25 bp, Mus musculus
ttcgtgaaggctaccgctgtcgagt

SEQ ID NO: 939186 - DNA, 25 bp, Mus musculus
ttcgtgaaggcttccgctgtcgagt

SEQ ID NO: 939187 - DNA, 25 bp, Mus musculus
ttcgtgaagtgtagagtaccatgac

SEQ ID NO: 939188 - DNA, 25 bp, Mus musculus
ttcgtgaagtgttgagtaccatgac

SEQ ID NO: 939189 - DNA, 25 bp, Mus musculus
ttcgtgacagtgaatcttcgccaaa

SEQ ID NO: 939190 - DNA, 25 bp, Mus musculus
ttcgtgacagtgtatcttcgccaaa

SEQ ID NO: 939191 - DNA, 25 bp, Mus musculus
ttcgtgactgggatgctgcagctgt

SEQ ID NO: 939192 - DNA, 25 bp, Mus musculus
ttcgtgactgggttgctgcagctgt

SEQ ID NO: 939193 - DNA, 25 bp, Mus musculus
ttcgtgacttctcaccgaagcaaga

SEQ ID NO: 939194 - DNA, 25 bp, Mus musculus
ttcgtgacttctgaccgaagcaaga

SEQ ID NO: 939195 - DNA, 25 bp, Mus musculus
ttcgtgagagccagctacccagaat

SEQ ID NO: 939196 - DNA, 25 bp, Mus musculus
ttcgtgagagcctgctacccagaat

SEQ ID NO: 939197 - DNA, 25 bp, Mus musculus
ttcgtgagcactaaacccagagcct

SEQ ID NO: 939198 - DNA, 25 bp, Mus musculus
ttcgtgagcacttaacccagagcct

SEQ ID NO: 939199 - DNA, 25 bp, Mus musculus
ttcgtgagcagaactcaagagcctt

SEQ ID NO: 939200 - DNA, 25 bp, Mus musculus
ttcgtgagcagatctcaagagcctt

SEQ ID NO: 939201 - DNA, 25 bp, Mus musculus
ttcgtgagcctgcagaagttgagtt

SEQ ID NO: 939202 - DNA, 25 bp, Mus musculus
ttcgtgagcctggagaagttgagtt

SEQ ID NO: 939203 - DNA, 25 bp, Mus musculus
ttcgtgaggataaccggcgtgtcgc

SEQ ID NO: 939204 - DNA, 25 bp, Mus musculus
ttcgtgaggatatccggcgtgtcgc

SEQ ID NO: 939205 - DNA, 25 bp, Mus musculus
ttcgtgatccacaacagattgtaac

SEQ ID NO: 939206 - DNA, 25 bp, Mus musculus
ttcgtgatccactacagattgtaac

SEQ ID NO: 939207 - DNA, 25 bp, Mus musculus
ttcgtgcaccgaatctctcacggaa

SEQ ID NO: 939208 - DNA, 25 bp, Mus musculus
ttcgtgcaccgattctctcacggaa

SEQ ID NO: 939209 - DNA, 25 bp, Mus musculus
ttcgtgcagagaaggaacatggtga

SEQ ID NO: 939210 - DNA, 25 bp, Mus musculus
ttcgtgcagagatggaacatggtga

SEQ ID NO: 939211 - DNA, 25 bp, Mus musculus
ttcgtgcagagcagtgcaaggtttt

SEQ ID NO: 939212 - DNA, 25 bp, Mus musculus
ttcgtgcagagctgtgcaaggtttt

SEQ ID NO: 939213 - DNA, 25 bp, Mus musculus
ttcgtgcattcactccagtgcaaat

SEQ ID NO: 939214 - DNA, 25 bp, Mus musculus
ttcgtgcattcagtccagtgcaaat

SEQ ID NO: 939215 - DNA, 25 bp, Mus musculus
ttcgtgccaaagagttagatcccat

SEQ ID NO: 939216 - DNA, 25 bp, Mus musculus
ttcgtgccaaagtgttagatcccat

SEQ ID NO: 939217 - DNA, 25 bp, Mus musculus
ttcgtgccagtgaatgaggaattct

SEQ ID NO: 939218 - DNA, 25 bp, Mus musculus
ttcgtgccagtgtatgaggaattct

SEQ ID NO: 939219 - DNA, 25 bp, Mus musculus
ttcgtgccatcaactcagtgtagca

SEQ ID NO: 939220 - DNA, 25 bp, Mus musculus
ttcgtgccatcatctcagtgtagca

SEQ ID NO: 939221 - DNA, 25 bp, Mus musculus
ttcgtgcccaatccgatggtccacc

SEQ ID NO: 939222 - DNA, 25 bp, Mus musculus
ttcgtgcccaatgcgatggtccacc

SEQ ID NO: 939223 - DNA, 25 bp, Mus musculus
ttcgtgccctcactgaagaagcttc

SEQ ID NO: 939224 - DNA, 25 bp, Mus musculus
ttcgtgccctcagtgaagaagcttc

SEQ ID NO: 939225 - DNA, 25 bp, Mus musculus
ttcgtgcctggcacatggtagagca

SEQ ID NO: 939226 - DNA, 25 bp, Mus musculus
ttcgtgcctggctcatggtagagca

SEQ ID NO: 939227 - DNA, 25 bp, Mus musculus
ttcgtgcctgtcagattctcaccac

SEQ ID NO: 939228 - DNA, 25 bp, Mus musculus
ttcgtgcctgtctgattctcaccac

SEQ ID NO: 939229 - DNA, 25 bp, Mus musculus
ttcgtgcgccttaagaactcttcag

SEQ ID NO: 939230 - DNA, 25 bp, Mus musculus
ttcgtgcgcctttagaactcttcag

SEQ ID NO: 939231 - DNA, 25 bp, Mus musculus
ttcgtgcgctgcagcggctgctcgc

SEQ ID NO: 939232 - DNA, 25 bp, Mus musculus
ttcgtgcgctgctgcggctgctcgc

SEQ ID NO: 939233 - DNA, 25 bp, Mus musculus
ttcgtgcgtgtgagcgttcatgcgt

SEQ ID NO: 939234 - DNA, 25 bp, Mus musculus
ttcgtgcgtgtgtgcgttcatgcgt

SEQ ID NO: 939235 - DNA, 25 bp, Mus musculus
ttcgtgcttgctagagggctcacct

SEQ ID NO: 939236 - DNA, 25 bp, Mus musculus
ttcgtgcttgcttgagggctcacct

SEQ ID NO: 939237 - DNA, 25 bp, Mus musculus
ttcgtggaacacaatcgggacatat

SEQ ID NO: 939238 - DNA, 25 bp, Mus musculus
ttcgtggaacactatcgggacatat

SEQ ID NO: 939239 - DNA, 25 bp, Mus musculus
ttcgtggaagccactatgtcggtga

SEQ ID NO: 939240 - DNA, 25 bp, Mus musculus
ttcgtggaagcctctatgtcggtga

SEQ ID NO: 939241 - DNA, 25 bp, Mus musculus
ttcgtggaccagcaacgtttctcgc

SEQ ID NO: 939242 - DNA, 25 bp, Mus musculus
ttcgtggaccaggaacgtttctcgc

SEQ ID NO: 939243 - DNA, 25 bp, Mus musculus
ttcgtggaccctccagaagttggat

SEQ ID NO: 939244 - DNA, 25 bp, Mus musculus
ttcgtggaccctgcagaagttggat

SEQ ID NO: 939245 - DNA, 25 bp, Mus musculus
ttcgtggacgttaacagcccaggct

SEQ ID NO: 939246 - DNA, 25 bp, Mus musculus
ttcgtggacgtttacagcccaggct

SEQ ID NO: 939247 - DNA, 25 bp, Mus musculus
ttcgtggaggtaatgaccgaatata

SEQ ID NO: 939248 - DNA, 25 bp, Mus musculus
ttcgtggaggtattgaccgaatata

SEQ ID NO: 939249 - DNA, 25 bp, Mus musculus
ttcgtggatccaatcaccaagaaga

SEQ ID NO: 939250 - DNA, 25 bp, Mus musculus
ttcgtggatccattcaccaagaaga

SEQ ID NO: 939251 - DNA, 25 bp, Mus musculus
ttcgtggcagagagtagtcctttgt

SEQ ID NO: 939252 - DNA, 25 bp, Mus musculus
ttcgtggcagagtgtagtcctttgt

SEQ ID NO: 939253 - DNA, 25 bp, Mus musculus
ttcgtggcatgcaagaatctcttct

SEQ ID NO: 939254 - DNA, 25 bp, Mus musculus
ttcgtggcatgctagaatctcttct

SEQ ID NO: 939255 - DNA, 25 bp, Mus musculus
ttcgtggccctgactttgcctcgat

SEQ ID NO: 939256 - DNA, 25 bp, Mus musculus
ttcgtggccctgtctttgcctcgat

SEQ ID NO: 939257 - DNA, 25 bp, Mus musculus
ttcgtgggccaacgtctgagtgccc

SEQ ID NO: 939258 - DNA, 25 bp, Mus musculus
ttcgtgggccaaggtctgagtgccc

SEQ ID NO: 939259 - DNA, 25 bp, Mus musculus
ttcgtgggtctgactgtgctgtgaa

SEQ ID NO: 939260 - DNA, 25 bp, Mus musculus
ttcgtgggtctgtctgtgctgtgaa

SEQ ID NO: 939261 - DNA, 25 bp, Mus musculus
ttcgtggtctgtcgaagttgttgca

SEQ ID NO: 939262 - DNA, 25 bp, Mus musculus
ttcgtggtctgtggaagttgttgca

SEQ ID NO: 939263 - DNA, 25 bp, Mus musculus
ttcgtggtcttgattaaggcaaacg

SEQ ID NO: 939264 - DNA, 25 bp, Mus musculus
ttcgtggtcttgtttaaggcaaacg

SEQ ID NO: 939265 - DNA, 25 bp, Mus musculus
ttcgtggtgctgagattggaaccca

SEQ ID NO: 939266 - DNA, 25 bp, Mus musculus
ttcgtggtgctgcagttgccctaca

SEQ ID NO: 939267 - DNA, 25 bp, Mus musculus
ttcgtggtgctggagttgccctaca

SEQ ID NO: 939268 - DNA, 25 bp, Mus musculus
ttcgtggtgctgtgattggaaccca

SEQ ID NO: 939269 - DNA, 25 bp, Mus musculus
ttcgtggtgggcattaagttataca

SEQ ID NO: 939270 - DNA, 25 bp, Mus musculus
ttcgtggtgggctttaagttataca

SEQ ID NO: 939271 - DNA, 25 bp, Mus musculus
ttcgtggtgttcagggaaaggcttt

SEQ ID NO: 939272 - DNA, 25 bp, Mus musculus
ttcgtggtgttctgggaaaggcttt

SEQ ID NO: 939273 - DNA, 25 bp, Mus musculus
ttcgtggttgacagtaatgaccgag

SEQ ID NO: 939274 - DNA, 25 bp, Mus musculus
ttcgtggttgactgtaatgaccgag

SEQ ID NO: 939275 - DNA, 25 bp, Mus musculus
ttcgtgtcagtgcatggacttaatt

SEQ ID NO: 939276 - DNA, 25 bp, Mus musculus
ttcgtgtcagtggatggacttaatt

SEQ ID NO: 939277 - DNA, 25 bp, Mus musculus
ttcgtgtccagccagcagcccttga

SEQ ID NO: 939278 - DNA, 25 bp, Mus musculus
ttcgtgtccagcgagcagcccttga

SEQ ID NO: 939279 - DNA, 25 bp, Mus musculus
ttcgtgtcgcctagatgagggactc

SEQ ID NO: 939280 - DNA, 25 bp, Mus musculus
ttcgtgtcgccttgatgagggactc

SEQ ID NO: 939281 - DNA, 25 bp, Mus musculus
ttcgtgtcgtggcatgactgtgcct

SEQ ID NO: 939282 - DNA, 25 bp, Mus musculus
ttcgtgtcgtgggatgactgtgcct

SEQ ID NO: 939283 - DNA, 25 bp, Mus musculus
ttcgtgtcgttgcagagggcttact

SEQ ID NO: 939284 - DNA, 25 bp, Mus musculus
ttcgtgtcgttggagagggcttact

SEQ ID NO: 939285 - DNA, 25 bp, Mus musculus
ttcgtgtctgacaagagaccccaga

SEQ ID NO: 939286 - DNA, 25 bp, Mus musculus
ttcgtgtctgactagagaccccaga

SEQ ID NO: 939287 - DNA, 25 bp, Mus musculus
ttcgtgtgcccgaattgtcacaaaa

SEQ ID NO: 939288 - DNA, 25 bp, Mus musculus
ttcgtgtgcccgtattgtcacaaaa

SEQ ID NO: 939289 - DNA, 25 bp, Mus musculus
ttcgtgtgctgcaagaccttcgaga

SEQ ID NO: 939290 - DNA, 25 bp, Mus musculus
ttcgtgtgctgctagaccttcgaga

SEQ ID NO: 939291 - DNA, 25 bp, Mus musculus
ttcgtgtgtcaactatgtggctttc

SEQ ID NO: 939292 - DNA, 25 bp, Mus musculus
ttcgtgtgtcaagtatgtggctttc

SEQ ID NO: 939293 - DNA, 25 bp, Mus musculus
ttcgtgtgtgatatgtctaactctt

SEQ ID NO: 939294 - DNA, 25 bp, Mus musculus
ttcgtgtgtgatttgtctaactctt

SEQ ID NO: 939295 - DNA, 25 bp, Mus musculus
ttcgtgtgttggctgccagtgtaca

SEQ ID NO: 939296 - DNA, 25 bp, Mus musculus
ttcgtgtgttgggtgccagtgtaca

SEQ ID NO: 939297 - DNA, 25 bp, Mus musculus
ttcgtgtgttgtcttctgcctgcgg

SEQ ID NO: 939298 - DNA, 25 bp, Mus musculus
ttcgtgtgttgtgttctgcctgcgg

SEQ ID NO: 939299 - DNA, 25 bp, Mus musculus
ttcgtgtgtttgacaaggaaggaaa

SEQ ID NO: 939300 - DNA, 25 bp, Mus musculus
ttcgtgtgtttgtcaaggaaggaaa

SEQ ID NO: 939301 - DNA, 25 bp, Mus musculus
ttcgtgttccgaaagcccaaggtgc

SEQ ID NO: 939302 - DNA, 25 bp, Mus musculus
ttcgtgttccgatagcccaaggtgc

SEQ ID NO: 939303 - DNA, 25 bp, Mus musculus
ttcgtgttcctcaccgagaaaagtg

SEQ ID NO: 939304 - DNA, 25 bp, Mus musculus
ttcgtgttcctctccgagaaaagtg

SEQ ID NO: 939305 - DNA, 25 bp, Mus musculus
ttcgtgttctgcaccaggccatgga

SEQ ID NO: 939306 - DNA, 25 bp, Mus musculus
ttcgtgttctgctccaggccatgga

SEQ ID NO: 939307 - DNA, 25 bp, Mus musculus
ttcgtgttgaggacaagcactgcta

SEQ ID NO: 939308 - DNA, 25 bp, Mus musculus
ttcgtgttgaggtcaagcactgcta

SEQ ID NO: 939309 - DNA, 25 bp, Mus musculus
ttcgtgtttttccacctcttcaatg

SEQ ID NO: 939310 - DNA, 25 bp, Mus musculus
ttcgtgtttttcgacctcttcaatg

SEQ ID NO: 939311 - DNA, 25 bp, Mus musculus
ttcgttccaccactcataaaccaga

SEQ ID NO: 939312 - DNA, 25 bp, Mus musculus
ttcgttccaccagtcataaaccaga

SEQ ID NO: 939313 - DNA, 25 bp, Mus musculus
ttcgttccatatcctatctcctggg

SEQ ID NO: 939314 - DNA, 25 bp, Mus musculus
ttcgttccatatgctatctcctggg

SEQ ID NO: 939315 - DNA, 25 bp, Mus musculus
ttcgttcccacactaggcccagagg

SEQ ID NO: 939316 - DNA, 25 bp, Mus musculus
ttcgttcccacagtaggcccagagg

SEQ ID NO: 939317 - DNA, 25 bp, Mus musculus
ttcgttccgggaagcacattggtgt

SEQ ID NO: 939318 - DNA, 25 bp, Mus musculus
ttcgttccgggatgcacattggtgt

SEQ ID NO: 939319 - DNA, 25 bp, Mus musculus
ttcgttccttacctgattgctggca

SEQ ID NO: 939320 - DNA, 25 bp, Mus musculus
ttcgttccttacgtgattgctggca

SEQ ID NO: 939321 - DNA, 25 bp, Mus musculus
ttcgttctaagtctcagcagcggcc

SEQ ID NO: 939322 - DNA, 25 bp, Mus musculus
ttcgttctaagtgtcagcagcggcc

SEQ ID NO: 939323 - DNA, 25 bp, Mus musculus
ttcgttctctggacctatgtgagat

SEQ ID NO: 939324 - DNA, 25 bp, Mus musculus
ttcgttctctggtcctatgtgagat

SEQ ID NO: 939325 - DNA, 25 bp, Mus musculus
ttcgttgaccttagagccagggatt

SEQ ID NO: 939326 - DNA, 25 bp, Mus musculus
ttcgttgacctttgagccagggatt

SEQ ID NO: 939327 - DNA, 25 bp, Mus musculus
ttcgttgactgtagtgtcaggtggt

SEQ ID NO: 939328 - DNA, 25 bp, Mus musculus
ttcgttgactgttgtgtcaggtggt

SEQ ID NO: 939329 - DNA, 25 bp, Mus musculus
ttcgttgcttctcactatgctgcag

SEQ ID NO: 939330 - DNA, 25 bp, Mus musculus
ttcgttgcttctgactatgctgcag

SEQ ID NO: 939331 - DNA, 25 bp, Mus musculus
ttcgttgctttgcaaggctatccaa

SEQ ID NO: 939332 - DNA, 25 bp, Mus musculus
ttcgttgctttggaaggctatccaa

SEQ ID NO: 939333 - DNA, 25 bp, Mus musculus
ttcgttggaccacggaccaccatat

SEQ ID NO: 939334 - DNA, 25 bp, Mus musculus
ttcgttggaccagggaccaccatat

SEQ ID NO: 939335 - DNA, 25 bp, Mus musculus
ttcgttggccttccacgctgaggta

SEQ ID NO: 939336 - DNA, 25 bp, Mus musculus
ttcgttggccttgcacgctgaggta

SEQ ID NO: 939337 - DNA, 25 bp, Mus musculus
ttcgttggctacaatgtgcagatat

SEQ ID NO: 939338 - DNA, 25 bp, Mus musculus
ttcgttggctactatgtgcagatat

SEQ ID NO: 939339 - DNA, 25 bp, Mus musculus
ttcgttgggatgaagctgtgcaaga

SEQ ID NO: 939340 - DNA, 25 bp, Mus musculus
ttcgttgggatgtagctgtgcaaga

SEQ ID NO: 939341 - DNA, 25 bp, Mus musculus
ttcgttgggtccatgtcatgattgc

SEQ ID NO: 939342 - DNA, 25 bp, Mus musculus
ttcgttgggtccttgtcatgattgc

SEQ ID NO: 939343 - DNA, 25 bp, Mus musculus
ttcgttgtcaaaaggaagcccttgc

SEQ ID NO: 939344 - DNA, 25 bp, Mus musculus
ttcgttgtcaaatggaagcccttgc

SEQ ID NO: 939345 - DNA, 25 bp, Mus musculus
ttcgttgtctttaatgaggcctcag

SEQ ID NO: 939346 - DNA, 25 bp, Mus musculus
ttcgttgtcttttatgaggcctcag

SEQ ID NO: 939347 - DNA, 25 bp, Mus musculus
ttcgttgttaatcttagccatccct

SEQ ID NO: 939348 - DNA, 25 bp, Mus musculus
ttcgttgttaatgttagccatccct

SEQ ID NO: 939349 - DNA, 25 bp, Mus musculus
ttcgttgttgttaacctgttgcttg

SEQ ID NO: 939350 - DNA, 25 bp, Mus musculus
ttcgttgttgttctctactgcattt

SEQ ID NO: 939351 - DNA, 25 bp, Mus musculus
ttcgttgttgttgtctactgcattt

SEQ ID NO: 939352 - DNA, 25 bp, Mus musculus
ttcgttgttgtttacctgttgcttg

SEQ ID NO: 939353 - DNA, 25 bp, Mus musculus
ttcgtttcatagaacacaacacttg

SEQ ID NO: 939354 - DNA, 25 bp, Mus musculus
ttcgtttcatagtacacaacacttg

SEQ ID NO: 939355 - DNA, 25 bp, Mus musculus
ttcgtttcatgtctcagcctttcct

SEQ ID NO: 939356 - DNA, 25 bp, Mus musculus
ttcgtttcatgtgtcagcctttcct

SEQ ID NO: 939357 - DNA, 25 bp, Mus musculus
ttcgtttctcttcggtagacgccta

SEQ ID NO: 939358 - DNA, 25 bp, Mus musculus
ttcgtttctcttgggtagacgccta

SEQ ID NO: 939359 - DNA, 25 bp, Mus musculus
ttcgtttgtcccaggctgatttaag

SEQ ID NO: 939360 - DNA, 25 bp, Mus musculus
ttcgtttgtccctggctgatttaag

SEQ ID NO: 939361 - DNA, 25 bp, Mus musculus
ttcgttttatttatcaccatgtgcc

SEQ ID NO: 939362 - DNA, 25 bp, Mus musculus
ttcgttttatttttcaccatgtgcc

SEQ ID NO: 939363 - DNA, 25 bp, Mus musculus
ttcgttttcacccagaagcttgtgc

SEQ ID NO: 939364 - DNA, 25 bp, Mus musculus
ttcgttttcaccgagaagcttgtgc

SEQ ID NO: 939365 - DNA, 25 bp, Mus musculus
ttcgtttttactcccactgtattat

SEQ ID NO: 939366 - DNA, 25 bp, Mus musculus
ttcgtttttactgccactgtattat

SEQ ID NO: 939367 - DNA, 25 bp, Mus musculus
ttcgtttttcgcctgtatgatgact

SEQ ID NO: 939368 - DNA, 25 bp, Mus musculus
ttcgtttttcgcgtgtatgatgact

SEQ ID NO: 939369 - DNA, 25 bp, Mus musculus
ttcgtttttgagactgtattcccca

SEQ ID NO: 939370 - DNA, 25 bp, Mus musculus
ttcgtttttgagtctgtattcccca

SEQ ID NO: 939371 - DNA, 25 bp, Mus musculus
ttctaaaaatgtacccatgttactt

SEQ ID NO: 939372 - DNA, 25 bp, Mus musculus
ttctaaaaatgttcccatgttactt

SEQ ID NO: 939373 - DNA, 25 bp, Mus musculus
ttctaaaacaaacgcacagttgctg

SEQ ID NO: 939374 - DNA, 25 bp, Mus musculus
ttctaaaacaaaggcacagttgctg

SEQ ID NO: 939375 - DNA, 25 bp, Mus musculus
ttctaaaacatgacacatcttgcct

SEQ ID NO: 939376 - DNA, 25 bp, Mus musculus
ttctaaaacatgtcacatcttgcct

SEQ ID NO: 939377 - DNA, 25 bp, Mus musculus
ttctaaaagttgctgtggccacggt

SEQ ID NO: 939378 - DNA, 25 bp, Mus musculus
ttctaaaagttggtgtggccacggt

SEQ ID NO: 939379 - DNA, 25 bp, Mus musculus
ttctaaaatcagcaggaagccattc

SEQ ID NO: 939380 - DNA, 25 bp, Mus musculus
ttctaaaatcaggaggaagccattc

SEQ ID NO: 939381 - DNA, 25 bp, Mus musculus
ttctaaaatgctaggctggtttgcc

SEQ ID NO: 939382 - DNA, 25 bp, Mus musculus
ttctaaaatgcttggctggtttgcc

SEQ ID NO: 939383 - DNA, 25 bp, Mus musculus
ttctaaacacggaatcctttccact

SEQ ID NO: 939384 - DNA, 25 bp, Mus musculus
ttctaaacacggtatcctttccact

SEQ ID NO: 939385 - DNA, 25 bp, Mus musculus
ttctaaacagctcctggatccacca

SEQ ID NO: 939386 - DNA, 25 bp, Mus musculus
ttctaaacagctgctggatccacca

SEQ ID NO: 939387 - DNA, 25 bp, Mus musculus
ttctaaacccatacatattgaggca

SEQ ID NO: 939388 - DNA, 25 bp, Mus musculus
ttctaaacccattcatattgaggca

SEQ ID NO: 939389 - DNA, 25 bp, Mus musculus
ttctaaacctgtagtacaatgtatc

SEQ ID NO: 939390 - DNA, 25 bp, Mus musculus
ttctaaacctgttgtacaatgtatc

SEQ ID NO: 939391 - DNA, 25 bp, Mus musculus
ttctaaacctttcgagtaacaacat

SEQ ID NO: 939392 - DNA, 25 bp, Mus musculus
ttctaaacctttggagtaacaacat

SEQ ID NO: 939393 - DNA, 25 bp, Mus musculus
ttctaaacgcagctggttaatgtcc

SEQ ID NO: 939394 - DNA, 25 bp, Mus musculus
ttctaaacgcaggtggttaatgtcc

SEQ ID NO: 939395 - DNA, 25 bp, Mus musculus
ttctaaactgaaacctcctggttag

SEQ ID NO: 939396 - DNA, 25 bp, Mus musculus
ttctaaactgaatcctcctggttag

SEQ ID NO: 939397 - DNA, 25 bp, Mus musculus
ttctaaactttccatgtttccactt

SEQ ID NO: 939398 - DNA, 25 bp, Mus musculus
ttctaaactttcgatgtttccactt

SEQ ID NO: 939399 - DNA, 25 bp, Mus musculus
ttctaaagatccacagtcttgatat

SEQ ID NO: 939400 - DNA, 25 bp, Mus musculus
ttctaaagatcctcagtcttgatat

SEQ ID NO: 939401 - DNA, 25 bp, Mus musculus
ttctaaagcacacgctctggcaggc

SEQ ID NO: 939402 - DNA, 25 bp, Mus musculus
ttctaaagcacaggctctggcaggc

SEQ ID NO: 939403 - DNA, 25 bp, Mus musculus
ttctaaagccacatcatataggact

SEQ ID NO: 939404 - DNA, 25 bp, Mus musculus
ttctaaagccacttcatataggact

SEQ ID NO: 939405 - DNA, 25 bp, Mus musculus
ttctaaagccagatttatgagctgt

SEQ ID NO: 939406 - DNA, 25 bp, Mus musculus
ttctaaagccagttttatgagctgt

SEQ ID NO: 939407 - DNA, 25 bp, Mus musculus
ttctaaagtcctaaaactgtgttca

SEQ ID NO: 939408 - DNA, 25 bp, Mus musculus
ttctaaagtccttaaactgtgttca

SEQ ID NO: 939409 - DNA, 25 bp, Mus musculus
ttctaaagtggtccctgtacctcca

SEQ ID NO: 939410 - DNA, 25 bp, Mus musculus
ttctaaagtggtgcctgtacctcca

SEQ ID NO: 939411 - DNA, 25 bp, Mus musculus
ttctaaagtgtgattgtgcagctca

SEQ ID NO: 939412 - DNA, 25 bp, Mus musculus
ttctaaagtgtgtttgtgcagctca

SEQ ID NO: 939413 - DNA, 25 bp, Mus musculus
ttctaaagttctactgaccacactc

SEQ ID NO: 939414 - DNA, 25 bp, Mus musculus
ttctaaagttcttctgaccacactc

SEQ ID NO: 939415 - DNA, 25 bp, Mus musculus
ttctaaagtttgcttgcggctccca

SEQ ID NO: 939416 - DNA, 25 bp, Mus musculus
ttctaaagtttggttgcggctccca

SEQ ID NO: 939417 - DNA, 25 bp, Mus musculus
ttctaaataagtcttgtcctctcct

SEQ ID NO: 939418 - DNA, 25 bp, Mus musculus
ttctaaataagtgttgtcctctcct

SEQ ID NO: 939419 - DNA, 25 bp, Mus musculus
ttctaaatacagagaccatctgggt

SEQ ID NO: 939420 - DNA, 25 bp, Mus musculus
ttctaaatacagtgaccatctgggt

SEQ ID NO: 939421 - DNA, 25 bp, Mus musculus
ttctaaatcacaactctccctaaat

SEQ ID NO: 939422 - DNA, 25 bp, Mus musculus
ttctaaatcacatctctccctaaat

SEQ ID NO: 939423 - DNA, 25 bp, Mus musculus
ttctaaatctgcatgacccatctat

SEQ ID NO: 939424 - DNA, 25 bp, Mus musculus
ttctaaatctgcttgacccatctat

SEQ ID NO: 939425 - DNA, 25 bp, Mus musculus
ttctaaatgggcacggtttctcctg

SEQ ID NO: 939426 - DNA, 25 bp, Mus musculus
ttctaaatgggctcggtttctcctg

SEQ ID NO: 939427 - DNA, 25 bp, Mus musculus
ttctaaatgtgacagttccagtttc

SEQ ID NO: 939428 - DNA, 25 bp, Mus musculus
ttctaaatgtgagagttccagtttc

SEQ ID NO: 939429 - DNA, 25 bp, Mus musculus
ttctaaatgttgatctcgtgtatat

SEQ ID NO: 939430 - DNA, 25 bp, Mus musculus
ttctaaatgttgttctcgtgtatat

SEQ ID NO: 939431 - DNA, 25 bp, Mus musculus
ttctaacaagcaagtctggatggat

SEQ ID NO: 939432 - DNA, 25 bp, Mus musculus
ttctaacaagcatgtctggatggat

SEQ ID NO: 939433 - DNA, 25 bp, Mus musculus
ttctaacaagccaaattcacccttc

SEQ ID NO: 939434 - DNA, 25 bp, Mus musculus
ttctaacaagcctaattcacccttc

SEQ ID NO: 939435 - DNA, 25 bp, Mus musculus
ttctaacaagttctgtgggtgatct

SEQ ID NO: 939436 - DNA, 25 bp, Mus musculus
ttctaacaagttgtgtgggtgatct

SEQ ID NO: 939437 - DNA, 25 bp, Mus musculus
ttctaacacaccagactgctgctgg

SEQ ID NO: 939438 - DNA, 25 bp, Mus musculus
ttctaacacacctgactgctgctgg

SEQ ID NO: 939439 - DNA, 25 bp, Mus musculus
ttctaacacatgcagcacagggatc

SEQ ID NO: 939440 - DNA, 25 bp, Mus musculus
ttctaacacatggagcacagggatc

SEQ ID NO: 939441 - DNA, 25 bp, Mus musculus
ttctaacacattacagaggtcagtc

SEQ ID NO: 939442 - DNA, 25 bp, Mus musculus
ttctaacacatttcagaggtcagtc

SEQ ID NO: 939443 - DNA, 25 bp, Mus musculus
ttctaacaccccagagagccggaaa

SEQ ID NO: 939444 - DNA, 25 bp, Mus musculus
ttctaacacccctgagagccggaaa

SEQ ID NO: 939445 - DNA, 25 bp, Mus musculus
ttctaacaccctatgagattcctgg

SEQ ID NO: 939446 - DNA, 25 bp, Mus musculus
ttctaacaccctctccagaaggcaa

SEQ ID NO: 939447 - DNA, 25 bp, Mus musculus
ttctaacaccctgtccagaaggcaa

SEQ ID NO: 939448 - DNA, 25 bp, Mus musculus
ttctaacaccctttgagattcctgg

SEQ ID NO: 939449 - DNA, 25 bp, Mus musculus
ttctaacacgtgacattgctcatcc

SEQ ID NO: 939450 - DNA, 25 bp, Mus musculus
ttctaacacgtgtcattgctcatcc

SEQ ID NO: 939451 - DNA, 25 bp, Mus musculus
ttctaacagcagattattcagcaaa

SEQ ID NO: 939452 - DNA, 25 bp, Mus musculus
ttctaacagcagtttattcagcaaa

SEQ ID NO: 939453 - DNA, 25 bp, Mus musculus
ttctaaccagccacttcataaaatt

SEQ ID NO: 939454 - DNA, 25 bp, Mus musculus
ttctaaccagcctcttcataaaatt

SEQ ID NO: 939455 - DNA, 25 bp, Mus musculus
ttctaacccaacaagtaggtagctg

SEQ ID NO: 939456 - DNA, 25 bp, Mus musculus
ttctaacccaactagtaggtagctg

SEQ ID NO: 939457 - DNA, 25 bp, Mus musculus
ttctaaccccagctcgggaatgcag

SEQ ID NO: 939458 - DNA, 25 bp, Mus musculus
ttctaaccccaggtcgggaatgcag

SEQ ID NO: 939459 - DNA, 25 bp, Mus musculus
ttctaaccgagcattcatattccac

SEQ ID NO: 939460 - DNA, 25 bp, Mus musculus
ttctaaccgagctttcatattccac

SEQ ID NO: 939461 - DNA, 25 bp, Mus musculus
ttctaacctggtactttgttgtctc

SEQ ID NO: 939462 - DNA, 25 bp, Mus musculus
ttctaacctggttctttgttgtctc

SEQ ID NO: 939463 - DNA, 25 bp, Mus musculus
ttctaacgaggtatccaaggcactt

SEQ ID NO: 939464 - DNA, 25 bp, Mus musculus
ttctaacgaggtttccaaggcactt

SEQ ID NO: 939465 - DNA, 25 bp, Mus musculus
ttctaacgtagcactaaggtcctca

SEQ ID NO: 939466 - DNA, 25 bp, Mus musculus
ttctaacgtagctctaaggtcctca

SEQ ID NO: 939467 - DNA, 25 bp, Mus musculus
ttctaactaacacagcctttgcagc

SEQ ID NO: 939468 - DNA, 25 bp, Mus musculus
ttctaactaacagagcctttgcagc

SEQ ID NO: 939469 - DNA, 25 bp, Mus musculus
ttctaactcctgacactcaaactta

SEQ ID NO: 939470 - DNA, 25 bp, Mus musculus
ttctaactcctgtcactcaaactta

SEQ ID NO: 939471 - DNA, 25 bp, Mus musculus
ttctaactcttgaagttcctaacgt

SEQ ID NO: 939472 - DNA, 25 bp, Mus musculus
ttctaactcttgtagttcctaacgt

SEQ ID NO: 939473 - DNA, 25 bp, Mus musculus
ttctaactgtatatccactgtgatt

SEQ ID NO: 939474 - DNA, 25 bp, Mus musculus
ttctaactgtatttccactgtgatt

SEQ ID NO: 939475 - DNA, 25 bp, Mus musculus
ttctaactgtggatgtgtgctctca

SEQ ID NO: 939476 - DNA, 25 bp, Mus musculus
ttctaactgtggttgtgtgctctca

SEQ ID NO: 939477 - DNA, 25 bp, Mus musculus
ttctaacttcatcgatcagtgcccc

SEQ ID NO: 939478 - DNA, 25 bp, Mus musculus
ttctaacttcatggatcagtgcccc

SEQ ID NO: 939479 - DNA, 25 bp, Mus musculus
ttctaagaatagaacttcctttatt

SEQ ID NO: 939480 - DNA, 25 bp, Mus musculus
ttctaagaatagtacttcctttatt

SEQ ID NO: 939481 - DNA, 25 bp, Mus musculus
ttctaagagcccaccatttatgaag

SEQ ID NO: 939482 - DNA, 25 bp, Mus musculus
ttctaagagccctccatttatgaag

SEQ ID NO: 939483 - DNA, 25 bp, Mus musculus
ttctaagagtcacagttagcatctc

SEQ ID NO: 939484 - DNA, 25 bp, Mus musculus
ttctaagagtcagagttagcatctc

SEQ ID NO: 939485 - DNA, 25 bp, Mus musculus
ttctaagatgggatctccctggctg

SEQ ID NO: 939486 - DNA, 25 bp, Mus musculus
ttctaagatgggttctccctggctg

SEQ ID NO: 939487 - DNA, 25 bp, Mus musculus
ttctaagcactaattccacactttg

SEQ ID NO: 939488 - DNA, 25 bp, Mus musculus
ttctaagcactatttccacactttg

SEQ ID NO: 939489 - DNA, 25 bp, Mus musculus
ttctaagcaggtcaggacctcctcc

SEQ ID NO: 939490 - DNA, 25 bp, Mus musculus
ttctaagcaggtgaggacctcctcc

SEQ ID NO: 939491 - DNA, 25 bp, Mus musculus
ttctaagccagaacattacgccatg

SEQ ID NO: 939492 - DNA, 25 bp, Mus musculus
ttctaagccagatcattacgccatg

SEQ ID NO: 939493 - DNA, 25 bp, Mus musculus
ttctaagcctacctgtgtcttcaaa

SEQ ID NO: 939494 - DNA, 25 bp, Mus musculus
ttctaagcctacgtgtgtcttcaaa

SEQ ID NO: 939495 - DNA, 25 bp, Mus musculus
ttctaagcctctatggtattggaaa

SEQ ID NO: 939496 - DNA, 25 bp, Mus musculus
ttctaagcctctttggtattggaaa

SEQ ID NO: 939497 - DNA, 25 bp, Mus musculus
ttctaagcgaagatctgaccctcat

SEQ ID NO: 939498 - DNA, 25 bp, Mus musculus
ttctaagcgaagttctgaccctcat

SEQ ID NO: 939499 - DNA, 25 bp, Mus musculus
ttctaagctgaaagatgcaaaggca

SEQ ID NO: 939500 - DNA, 25 bp, Mus musculus
ttctaagctgaatgatgcaaaggca

SEQ ID NO: 939501 - DNA, 25 bp, Mus musculus
ttctaagctgttaccatcccttttt

SEQ ID NO: 939502 - DNA, 25 bp, Mus musculus
ttctaagctgtttccatcccttttt

SEQ ID NO: 939503 - DNA, 25 bp, Mus musculus
ttctaaggacctctttgttcccaca

SEQ ID NO: 939504 - DNA, 25 bp, Mus musculus
ttctaaggacctgtttgttcccaca

SEQ ID NO: 939505 - DNA, 25 bp, Mus musculus
ttctaaggactgaagcacccacact

SEQ ID NO: 939506 - DNA, 25 bp, Mus musculus
ttctaaggactgtagcacccacact

SEQ ID NO: 939507 - DNA, 25 bp, Mus musculus
ttctaaggctgaaagctgctggctt

SEQ ID NO: 939508 - DNA, 25 bp, Mus musculus
ttctaaggctgatagctgctggctt

SEQ ID NO: 939509 - DNA, 25 bp, Mus musculus
ttctaagggctcaggacggttccct

SEQ ID NO: 939510 - DNA, 25 bp, Mus musculus
ttctaagggctctggacggttccct

SEQ ID NO: 939511 - DNA, 25 bp, Mus musculus
ttctaagggtacacgtttcgtctct

SEQ ID NO: 939512 - DNA, 25 bp, Mus musculus
ttctaagggtactcgtttcgtctct

SEQ ID NO: 939513 - DNA, 25 bp, Mus musculus
ttctaagggttgaggaagactccac

SEQ ID NO: 939514 - DNA, 25 bp, Mus musculus
ttctaagggttgtggaagactccac

SEQ ID NO: 939515 - DNA, 25 bp, Mus musculus
ttctaagggtttacgtgtaatacat

SEQ ID NO: 939516 - DNA, 25 bp, Mus musculus
ttctaagggttttcgtgtaatacat

SEQ ID NO: 939517 - DNA, 25 bp, Mus musculus
ttctaaggtcttccactggtcagat

SEQ ID NO: 939518 - DNA, 25 bp, Mus musculus
ttctaaggtcttgcactggtcagat

SEQ ID NO: 939519 - DNA, 25 bp, Mus musculus
ttctaagtatgcctaatcattcatt

SEQ ID NO: 939520 - DNA, 25 bp, Mus musculus
ttctaagtatgcgtaatcattcatt

SEQ ID NO: 939521 - DNA, 25 bp, Mus musculus
ttctaagtcccgaagctacagcttt

SEQ ID NO: 939522 - DNA, 25 bp, Mus musculus
ttctaagtcccgatgtttctccttg

SEQ ID NO: 939523 - DNA, 25 bp, Mus musculus
ttctaagtcccgtagctacagcttt

SEQ ID NO: 939524 - DNA, 25 bp, Mus musculus
ttctaagtcccgttgtttctccttg

SEQ ID NO: 939525 - DNA, 25 bp, Mus musculus
ttctaagtcctgcaaggtcccaggg

SEQ ID NO: 939526 - DNA, 25 bp, Mus musculus
ttctaagtcctggaaggtcccaggg

SEQ ID NO: 939527 - DNA, 25 bp, Mus musculus
ttctaagtctttacacacatcaatg

SEQ ID NO: 939528 - DNA, 25 bp, Mus musculus
ttctaagtcttttcacacatcaatg

SEQ ID NO: 939529 - DNA, 25 bp, Mus musculus
ttctaagtgcagaagagggcccttt

SEQ ID NO: 939530 - DNA, 25 bp, Mus musculus
ttctaagtgcagtagagggcccttt

SEQ ID NO: 939531 - DNA, 25 bp, Mus musculus
ttctaagtgcataaacccctgtttt

SEQ ID NO: 939532 - DNA, 25 bp, Mus musculus
ttctaagtgcattaacccctgtttt

SEQ ID NO: 939533 - DNA, 25 bp, Mus musculus
ttctaagtggagcttccggacagca

SEQ ID NO: 939534 - DNA, 25 bp, Mus musculus
ttctaagtggaggttccggacagca

SEQ ID NO: 939535 - DNA, 25 bp, Mus musculus
ttctaagttagcatcgtcgtttcta

SEQ ID NO: 939536 - DNA, 25 bp, Mus musculus
ttctaagttagcttcgtcgtttcta

SEQ ID NO: 939537 - DNA, 25 bp, Mus musculus
ttctaagttcctactccacatcaac

SEQ ID NO: 939538 - DNA, 25 bp, Mus musculus
ttctaagttccttctccacatcaac

SEQ ID NO: 939539 - DNA, 25 bp, Mus musculus
ttctaagttgcccaggtcccggaga

SEQ ID NO: 939540 - DNA, 25 bp, Mus musculus
ttctaagttgccgaggtcccggaga

SEQ ID NO: 939541 - DNA, 25 bp, Mus musculus
ttctaatcagtgaagcatggttgta

SEQ ID NO: 939542 - DNA, 25 bp, Mus musculus
ttctaatcagtgatctaatatgctt

SEQ ID NO: 939543 - DNA, 25 bp, Mus musculus
ttctaatcagtgtagcatggttgta

SEQ ID NO: 939544 - DNA, 25 bp, Mus musculus
ttctaatcagtgttctaatatgctt

SEQ ID NO: 939545 - DNA, 25 bp, Mus musculus
ttctaatgacagaatcctgaagtct

SEQ ID NO: 939546 - DNA, 25 bp, Mus musculus
ttctaatgacagtatcctgaagtct

SEQ ID NO: 939547 - DNA, 25 bp, Mus musculus
ttctaatgatgtacccttcccctct

SEQ ID NO: 939548 - DNA, 25 bp, Mus musculus
ttctaatgatgttcccttcccctct

SEQ ID NO: 939549 - DNA, 25 bp, Mus musculus
ttctaatgcctaagttgggtacaca

SEQ ID NO: 939550 - DNA, 25 bp, Mus musculus
ttctaatgcctatgttgggtacaca

SEQ ID NO: 939551 - DNA, 25 bp, Mus musculus
ttctaatggtatcactccctgggct

SEQ ID NO: 939552 - DNA, 25 bp, Mus musculus
ttctaatggtatgactccctgggct

SEQ ID NO: 939553 - DNA, 25 bp, Mus musculus
ttctaatgtcttccattcctatctc

SEQ ID NO: 939554 - DNA, 25 bp, Mus musculus
ttctaatgtcttgcattcctatctc

SEQ ID NO: 939555 - DNA, 25 bp, Mus musculus
ttctaattaaacatctcaccctcaa

SEQ ID NO: 939556 - DNA, 25 bp, Mus musculus
ttctaattaaacttctcaccctcaa

SEQ ID NO: 939557 - DNA, 25 bp, Mus musculus
ttctaattacttcccactaccacag

SEQ ID NO: 939558 - DNA, 25 bp, Mus musculus
ttctaattacttgccactaccacag

SEQ ID NO: 939559 - DNA, 25 bp, Mus musculus
ttctaattcctacacagactcctgg

SEQ ID NO: 939560 - DNA, 25 bp, Mus musculus
ttctaattcctagacagactcctgg

SEQ ID NO: 939561 - DNA, 25 bp, Mus musculus
ttctaattccttatgctttgccctg

SEQ ID NO: 939562 - DNA, 25 bp, Mus musculus
ttctaattccttttgctttgccctg

SEQ ID NO: 939563 - DNA, 25 bp, Mus musculus
ttctaattctgtcactcaccagcta

SEQ ID NO: 939564 - DNA, 25 bp, Mus musculus
ttctaattctgtgactcaccagcta

SEQ ID NO: 939565 - DNA, 25 bp, Mus musculus
ttctaattgagtagcactcccacgc

SEQ ID NO: 939566 - DNA, 25 bp, Mus musculus
ttctaattgagttgcactcccacgc

SEQ ID NO: 939567 - DNA, 25 bp, Mus musculus
ttctaattgctgctctgatcctatt

SEQ ID NO: 939568 - DNA, 25 bp, Mus musculus
ttctaattgctggtctgatcctatt

SEQ ID NO: 939569 - DNA, 25 bp, Mus musculus
ttctaattgtttaaggctggaaagc

SEQ ID NO: 939570 - DNA, 25 bp, Mus musculus
ttctaattgttttaggctggaaagc

SEQ ID NO: 939571 - DNA, 25 bp, Mus musculus
ttctaatttcaacttcattgtactt

SEQ ID NO: 939572 - DNA, 25 bp, Mus musculus
ttctaatttcaagttcattgtactt

SEQ ID NO: 939573 - DNA, 25 bp, Mus musculus
ttctaatttcacattcccagtacct

SEQ ID NO: 939574 - DNA, 25 bp, Mus musculus
ttctaatttcactttcccagtacct

SEQ ID NO: 939575 - DNA, 25 bp, Mus musculus
ttctacaaatgtagaagctgctttt

SEQ ID NO: 939576 - DNA, 25 bp, Mus musculus
ttctacaaatgtcgctgaggacttt

SEQ ID NO: 939577 - DNA, 25 bp, Mus musculus
ttctacaaatgtggctgaggacttt

SEQ ID NO: 939578 - DNA, 25 bp, Mus musculus
ttctacaaatgttgaagctgctttt

SEQ ID NO: 939579 - DNA, 25 bp, Mus musculus
ttctacaacactcacctccatgagg

SEQ ID NO: 939580 - DNA, 25 bp, Mus musculus
ttctacaacactgacctccatgagg

SEQ ID NO: 939581 - DNA, 25 bp, Mus musculus
ttctacaattatcaaaactccattt

SEQ ID NO: 939582 - DNA, 25 bp, Mus musculus
ttctacaattatgaaaactccattt

SEQ ID NO: 939583 - DNA, 25 bp, Mus musculus
ttctacacagcgagggtttccttca

SEQ ID NO: 939584 - DNA, 25 bp, Mus musculus
ttctacacagcgtgggtttccttca

SEQ ID NO: 939585 - DNA, 25 bp, Mus musculus
ttctacacatagcaccagacatcta

SEQ ID NO: 939586 - DNA, 25 bp, Mus musculus
ttctacacataggaccagacatcta

SEQ ID NO: 939587 - DNA, 25 bp, Mus musculus
ttctacaccaagaacgatgctgctc

SEQ ID NO: 939588 - DNA, 25 bp, Mus musculus
ttctacaccaagtacgatgctgctc

SEQ ID NO: 939589 - DNA, 25 bp, Mus musculus
ttctacaccagtcgctttgttctgt

SEQ ID NO: 939590 - DNA, 25 bp, Mus musculus
ttctacaccagtggctttgttctgt

SEQ ID NO: 939591 - DNA, 25 bp, Mus musculus
ttctacaccccaaaacatatcactt

SEQ ID NO: 939592 - DNA, 25 bp, Mus musculus
ttctacaccccataacatatcactt

SEQ ID NO: 939593 - DNA, 25 bp, Mus musculus
ttctacacccgaccagtggagaatc

SEQ ID NO: 939594 - DNA, 25 bp, Mus musculus
ttctacacccgagcagtggagaatc

SEQ ID NO: 939595 - DNA, 25 bp, Mus musculus
ttctacactcttagtctcctttcaa

SEQ ID NO: 939596 - DNA, 25 bp, Mus musculus
ttctacactctttgtctcctttcaa

SEQ ID NO: 939597 - DNA, 25 bp, Mus musculus
ttctacagcaacatctgtcatggtc

SEQ ID NO: 939598 - DNA, 25 bp, Mus musculus
ttctacagcaacttctgtcatggtc

SEQ ID NO: 939599 - DNA, 25 bp, Mus musculus
ttctacagcaccacctgccatgatt

SEQ ID NO: 939600 - DNA, 25 bp, Mus musculus
ttctacagcacctcctgccatgatt

SEQ ID NO: 939601 - DNA, 25 bp, Mus musculus
ttctacagccacagctctggaagtg

SEQ ID NO: 939602 - DNA, 25 bp, Mus musculus
ttctacagccactgctctggaagtg

SEQ ID NO: 939603 - DNA, 25 bp, Mus musculus
ttctacagcttgctcttgccggtca

SEQ ID NO: 939604 - DNA, 25 bp, Mus musculus
ttctacagcttggtcttgccggtca

SEQ ID NO: 939605 - DNA, 25 bp, Mus musculus
ttctacagtaaaagaccccgcagat

SEQ ID NO: 939606 - DNA, 25 bp, Mus musculus
ttctacagtaaatgaccccgcagat

SEQ ID NO: 939607 - DNA, 25 bp, Mus musculus
ttctacagtagcagccgagaggcct

SEQ ID NO: 939608 - DNA, 25 bp, Mus musculus
ttctacagtagctgccgagaggcct

SEQ ID NO: 939609 - DNA, 25 bp, Mus musculus
ttctacagtgagacgggcatgccta

SEQ ID NO: 939610 - DNA, 25 bp, Mus musculus
ttctacagtgagtcgggcatgccta

SEQ ID NO: 939611 - DNA, 25 bp, Mus musculus
ttctacagtttcattccattcaagt

SEQ ID NO: 939612 - DNA, 25 bp, Mus musculus
ttctacagtttctttccattcaagt

SEQ ID NO: 939613 - DNA, 25 bp, Mus musculus
ttctacatatgtacaacccagccac

SEQ ID NO: 939614 - DNA, 25 bp, Mus musculus
ttctacatatgttcaacccagccac

SEQ ID NO: 939615 - DNA, 25 bp, Mus musculus
ttctacatcacaatatctcacaata

SEQ ID NO: 939616 - DNA, 25 bp, Mus musculus
ttctacatcacattatctcacaata

SEQ ID NO: 939617 - DNA, 25 bp, Mus musculus
ttctacatccgaatactggctgacc

SEQ ID NO: 939618 - DNA, 25 bp, Mus musculus
ttctacatccgattactggctgacc

SEQ ID NO: 939619 - DNA, 25 bp, Mus musculus
ttctacatctcaccgttggtaattt

SEQ ID NO: 939620 - DNA, 25 bp, Mus musculus
ttctacatctcagcgttggtaattt

SEQ ID NO: 939621 - DNA, 25 bp, Mus musculus
ttctacatctgtctcttcattggca

SEQ ID NO: 939622 - DNA, 25 bp, Mus musculus
ttctacatctgtgtcttcattggca

SEQ ID NO: 939623 - DNA, 25 bp, Mus musculus
ttctacatcttcaacttcctcaagt

SEQ ID NO: 939624 - DNA, 25 bp, Mus musculus
ttctacatcttctacttcctcaagt

SEQ ID NO: 939625 - DNA, 25 bp, Mus musculus
ttctacattgatcctgaatttgcag

SEQ ID NO: 939626 - DNA, 25 bp, Mus musculus
ttctacattgatgctgaatttgcag

SEQ ID NO: 939627 - DNA, 25 bp, Mus musculus
ttctacattgccctctgtaggccag

SEQ ID NO: 939628 - DNA, 25 bp, Mus musculus
ttctacattgccgtctgtaggccag

SEQ ID NO: 939629 - DNA, 25 bp, Mus musculus
ttctacatttctattcctagggaat

SEQ ID NO: 939630 - DNA, 25 bp, Mus musculus
ttctacatttcttttcctagggaat

SEQ ID NO: 939631 - DNA, 25 bp, Mus musculus
ttctacatttttcctttgaccagtg

SEQ ID NO: 939632 - DNA, 25 bp, Mus musculus
ttctacatttttgctttgaccagtg

SEQ ID NO: 939633 - DNA, 25 bp, Mus musculus
ttctaccaactcactttgggtcaaa

SEQ ID NO: 939634 - DNA, 25 bp, Mus musculus
ttctaccaactctctttgggtcaaa

SEQ ID NO: 939635 - DNA, 25 bp, Mus musculus
ttctaccaaggcaatactctcaaag

SEQ ID NO: 939636 - DNA, 25 bp, Mus musculus
ttctaccaaggctatactctcaaag

SEQ ID NO: 939637 - DNA, 25 bp, Mus musculus
ttctaccaatatctgatctaaccta

SEQ ID NO: 939638 - DNA, 25 bp, Mus musculus
ttctaccaatatgtgatctaaccta

SEQ ID NO: 939639 - DNA, 25 bp, Mus musculus
ttctaccacacgcatagtcaaactc

SEQ ID NO: 939640 - DNA, 25 bp, Mus musculus
ttctaccacacggatagtcaaactc

SEQ ID NO: 939641 - DNA, 25 bp, Mus musculus
ttctaccactgcatacgtttcaaaa

SEQ ID NO: 939642 - DNA, 25 bp, Mus musculus
ttctaccactgcttacgtttcaaaa

SEQ ID NO: 939643 - DNA, 25 bp, Mus musculus
ttctaccagaagattgccacaggca

SEQ ID NO: 939644 - DNA, 25 bp, Mus musculus
ttctaccagaagtttgccacaggca

SEQ ID NO: 939645 - DNA, 25 bp, Mus musculus
ttctaccagcttagccaaggcgtcg

SEQ ID NO: 939646 - DNA, 25 bp, Mus musculus
ttctaccagctttgccaaggcgtcg

SEQ ID NO: 939647 - DNA, 25 bp, Mus musculus
ttctaccatataatgtactgtgagc

SEQ ID NO: 939648 - DNA, 25 bp, Mus musculus
ttctaccatatattgtactgtgagc

SEQ ID NO: 939649 - DNA, 25 bp, Mus musculus
ttctaccatggtcctaatatcagag

SEQ ID NO: 939650 - DNA, 25 bp, Mus musculus
ttctaccatggtgctaatatcagag

SEQ ID NO: 939651 - DNA, 25 bp, Mus musculus
ttctaccatgtcaggacgcggcaag

SEQ ID NO: 939652 - DNA, 25 bp, Mus musculus
ttctaccatgtctggacgcggcaag

SEQ ID NO: 939653 - DNA, 25 bp, Mus musculus
ttctacccacatcagagatctgggc

SEQ ID NO: 939654 - DNA, 25 bp, Mus musculus
ttctacccacatgagagatctgggc

SEQ ID NO: 939655 - DNA, 25 bp, Mus musculus
ttctacccacccctataagcccagt

SEQ ID NO: 939656 - DNA, 25 bp, Mus musculus
ttctacccacccgtataagcccagt

SEQ ID NO: 939657 - DNA, 25 bp, Mus musculus
ttctacccacctcgcttttgggttg

SEQ ID NO: 939658 - DNA, 25 bp, Mus musculus
ttctacccacctggcttttgggttg

SEQ ID NO: 939659 - DNA, 25 bp, Mus musculus
ttctacccacttcacaggtctggag

SEQ ID NO: 939660 - DNA, 25 bp, Mus musculus
ttctacccacttgacaggtctggag

SEQ ID NO: 939661 - DNA, 25 bp, Mus musculus
ttctacccatttacacgaagcacat

SEQ ID NO: 939662 - DNA, 25 bp, Mus musculus
ttctacccattttcacgaagcacat

SEQ ID NO: 939663 - DNA, 25 bp, Mus musculus
ttctaccccgtacgtactagaggag

SEQ ID NO: 939664 - DNA, 25 bp, Mus musculus
ttctaccccgtaggtactagaggag

SEQ ID NO: 939665 - DNA, 25 bp, Mus musculus
ttctacccctgccatttatggtaag

SEQ ID NO: 939666 - DNA, 25 bp, Mus musculus
ttctacccctgcgatttatggtaag

SEQ ID NO: 939667 - DNA, 25 bp, Mus musculus
ttctacccctgtacagtcacaagta

SEQ ID NO: 939668 - DNA, 25 bp, Mus musculus
ttctacccctgttcagtcacaagta

SEQ ID NO: 939669 - DNA, 25 bp, Mus musculus
ttctaccccttcacgacagctgaaa

SEQ ID NO: 939670 - DNA, 25 bp, Mus musculus
ttctaccccttctcgacagctgaaa

SEQ ID NO: 939671 - DNA, 25 bp, Mus musculus
ttctacccggacaccatagaggagt

SEQ ID NO: 939672 - DNA, 25 bp, Mus musculus
ttctacccggactccatagaggagt

SEQ ID NO: 939673 - DNA, 25 bp, Mus musculus
ttctaccctctgagatatgagttgg

SEQ ID NO: 939674 - DNA, 25 bp, Mus musculus
ttctaccctctgtgatatgagttgg

SEQ ID NO: 939675 - DNA, 25 bp, Mus musculus
ttctaccctgataattggctggatt

SEQ ID NO: 939676 - DNA, 25 bp, Mus musculus
ttctaccctgattattggctggatt

SEQ ID NO: 939677 - DNA, 25 bp, Mus musculus
ttctaccctgtgattgaacatctga

SEQ ID NO: 939678 - DNA, 25 bp, Mus musculus
ttctaccctgtgatttccaggatat

SEQ ID NO: 939679 - DNA, 25 bp, Mus musculus
ttctaccctgtgtttgaacatctga

SEQ ID NO: 939680 - DNA, 25 bp, Mus musculus
ttctaccctgtgttttccaggatat

SEQ ID NO: 939681 - DNA, 25 bp, Mus musculus
ttctaccctttgaagctcagagagc

SEQ ID NO: 939682 - DNA, 25 bp, Mus musculus
ttctaccctttgtagctcagagagc

SEQ ID NO: 939683 - DNA, 25 bp, Mus musculus
ttctaccgaattctgactgactcag

SEQ ID NO: 939684 - DNA, 25 bp, Mus musculus
ttctaccgaattgtgactgactcag

SEQ ID NO: 939685 - DNA, 25 bp, Mus musculus
ttctaccgagttatagtcatcattt

SEQ ID NO: 939686 - DNA, 25 bp, Mus musculus
ttctaccgagttttagtcatcattt

SEQ ID NO: 939687 - DNA, 25 bp, Mus musculus
ttctaccggagtatgccacacttat

SEQ ID NO: 939688 - DNA, 25 bp, Mus musculus
ttctaccggagtttgccacacttat

SEQ ID NO: 939689 - DNA, 25 bp, Mus musculus
ttctaccgtatacttggacccttgg

SEQ ID NO: 939690 - DNA, 25 bp, Mus musculus
ttctaccgtatagttggacccttgg

SEQ ID NO: 939691 - DNA, 25 bp, Mus musculus
ttctaccgtcctacaacagattgac

SEQ ID NO: 939692 - DNA, 25 bp, Mus musculus
ttctaccgtccttcaacagattgac

SEQ ID NO: 939693 - DNA, 25 bp, Mus musculus
ttctacctaaccaccgttttgaatg

SEQ ID NO: 939694 - DNA, 25 bp, Mus musculus
ttctacctaacctccgttttgaatg

SEQ ID NO: 939695 - DNA, 25 bp, Mus musculus
ttctacctacggcactggactgctg

SEQ ID NO: 939696 - DNA, 25 bp, Mus musculus
ttctacctacgggactggactgctg

SEQ ID NO: 939697 - DNA, 25 bp, Mus musculus
ttctacctaggtcacagtcatttaa

SEQ ID NO: 939698 - DNA, 25 bp, Mus musculus
ttctacctaggtgacagtcatttaa

SEQ ID NO: 939699 - DNA, 25 bp, Mus musculus
ttctacctatgaatcaactgtttcc

SEQ ID NO: 939700 - DNA, 25 bp, Mus musculus
ttctacctatgattcaactgtttcc

SEQ ID NO: 939701 - DNA, 25 bp, Mus musculus
ttctacctatgccacactttaaata

SEQ ID NO: 939702 - DNA, 25 bp, Mus musculus
ttctacctatgcgacactttaaata

SEQ ID NO: 939703 - DNA, 25 bp, Mus musculus
ttctacctcaacactggaagtcaaa

SEQ ID NO: 939704 - DNA, 25 bp, Mus musculus
ttctacctcaactctggaagtcaaa

SEQ ID NO: 939705 - DNA, 25 bp, Mus musculus
ttctacctcactcatcattgctcaa

SEQ ID NO: 939706 - DNA, 25 bp, Mus musculus
ttctacctcactgatcattgctcaa

SEQ ID NO: 939707 - DNA, 25 bp, Mus musculus
ttctacctccagcactaactcgata

SEQ ID NO: 939708 - DNA, 25 bp, Mus musculus
ttctacctccaggactaactcgata

SEQ ID NO: 939709 - DNA, 25 bp, Mus musculus
ttctacctgacaactacacttttga

SEQ ID NO: 939710 - DNA, 25 bp, Mus musculus
ttctacctgacatctacacttttga

SEQ ID NO: 939711 - DNA, 25 bp, Mus musculus
ttctacctggtcaacaaaggccctg

SEQ ID NO: 939712 - DNA, 25 bp, Mus musculus
ttctacctggtctacaaaggccctg

SEQ ID NO: 939713 - DNA, 25 bp, Mus musculus
ttctacctgtggcttttaaaggcca

SEQ ID NO: 939714 - DNA, 25 bp, Mus musculus
ttctacctgtgggttttaaaggcca

SEQ ID NO: 939715 - DNA, 25 bp, Mus musculus
ttctaccttaaactacttcaccatt

SEQ ID NO: 939716 - DNA, 25 bp, Mus musculus
ttctaccttaaagtacttcaccatt

SEQ ID NO: 939717 - DNA, 25 bp, Mus musculus
ttctaccttccacggactgcaatta

SEQ ID NO: 939718 - DNA, 25 bp, Mus musculus
ttctaccttccagggactgcaatta

SEQ ID NO: 939719 - DNA, 25 bp, Mus musculus
ttctaccttctgagagaccccgaaa

SEQ ID NO: 939720 - DNA, 25 bp, Mus musculus
ttctaccttctgtgagaccccgaaa

SEQ ID NO: 939721 - DNA, 25 bp, Mus musculus
ttctacgagggcaacatcttttctg

SEQ ID NO: 939722 - DNA, 25 bp, Mus musculus
ttctacgagggctacatcttttctg

SEQ ID NO: 939723 - DNA, 25 bp, Mus musculus
ttctacggagtgctgcttgggcatc

SEQ ID NO: 939724 - DNA, 25 bp, Mus musculus
ttctacggagtggtgcttgggcatc

SEQ ID NO: 939725 - DNA, 25 bp, Mus musculus
ttctacggcagacgaagctgcagat

SEQ ID NO: 939726 - DNA, 25 bp, Mus musculus
ttctacggcagaggaagctgcagat

SEQ ID NO: 939727 - DNA, 25 bp, Mus musculus
ttctacggttctcttctgggtaaga

SEQ ID NO: 939728 - DNA, 25 bp, Mus musculus
ttctacggttctgttctgggtaaga

SEQ ID NO: 939729 - DNA, 25 bp, Mus musculus
ttctacgtactgagtccggacaacg

SEQ ID NO: 939730 - DNA, 25 bp, Mus musculus
ttctacgtactgtgtccggacaacg

SEQ ID NO: 939731 - DNA, 25 bp, Mus musculus
ttctacgtcttgatccaaaggcgga

SEQ ID NO: 939732 - DNA, 25 bp, Mus musculus
ttctacgtcttgttccaaaggcgga

SEQ ID NO: 939733 - DNA, 25 bp, Mus musculus
ttctactagctcagaggccacttat

SEQ ID NO: 939734 - DNA, 25 bp, Mus musculus
ttctactagctctgaggccacttat

SEQ ID NO: 939735 - DNA, 25 bp, Mus musculus
ttctactaggttctgatacactctc

SEQ ID NO: 939736 - DNA, 25 bp, Mus musculus
ttctactaggttgtgatacactctc

SEQ ID NO: 939737 - DNA, 25 bp, Mus musculus
ttctactagttcctgtttcttctga

SEQ ID NO: 939738 - DNA, 25 bp, Mus musculus
ttctactagttcgtgtttcttctga

SEQ ID NO: 939739 - DNA, 25 bp, Mus musculus
ttctactcaagaacagttgcctctg

SEQ ID NO: 939740 - DNA, 25 bp, Mus musculus
ttctactcaagatcagttgcctctg

SEQ ID NO: 939741 - DNA, 25 bp, Mus musculus
ttctactccagtaacatcttctttt

SEQ ID NO: 939742 - DNA, 25 bp, Mus musculus
ttctactccagttacatcttctttt

SEQ ID NO: 939743 - DNA, 25 bp, Mus musculus
ttctactccgtcaaactgtgtcagc

SEQ ID NO: 939744 - DNA, 25 bp, Mus musculus
ttctactccgtctaactgtgtcagc

SEQ ID NO: 939745 - DNA, 25 bp, Mus musculus
ttctactccttaacacgtacaagtg

SEQ ID NO: 939746 - DNA, 25 bp, Mus musculus
ttctactccttatcacgtacaagtg

SEQ ID NO: 939747 - DNA, 25 bp, Mus musculus
ttctactctaccagaatggcttttg

SEQ ID NO: 939748 - DNA, 25 bp, Mus musculus
ttctactctacctgaatggcttttg

SEQ ID NO: 939749 - DNA, 25 bp, Mus musculus
ttctactctgcccattcgatgtggg

SEQ ID NO: 939750 - DNA, 25 bp, Mus musculus
ttctactctgccgattcgatgtggg

SEQ ID NO: 939751 - DNA, 25 bp, Mus musculus
ttctactctgtcaccctttaagtga

SEQ ID NO: 939752 - DNA, 25 bp, Mus musculus
ttctactctgtctccctttaagtga

SEQ ID NO: 939753 - DNA, 25 bp, Mus musculus
ttctactcttgacactctgaagttc

SEQ ID NO: 939754 - DNA, 25 bp, Mus musculus
ttctactcttgagactctgaagttc

SEQ ID NO: 939755 - DNA, 25 bp, Mus musculus
ttctactcttgccttgctgcagcaa

SEQ ID NO: 939756 - DNA, 25 bp, Mus musculus
ttctactcttgcgttgctgcagcaa

SEQ ID NO: 939757 - DNA, 25 bp, Mus musculus
ttctactgaaaccttaacactccac

SEQ ID NO: 939758 - DNA, 25 bp, Mus musculus
ttctactgaaacgttaacactccac

SEQ ID NO: 939759 - DNA, 25 bp, Mus musculus
ttctactgacatatctaatgctagt

SEQ ID NO: 939760 - DNA, 25 bp, Mus musculus
ttctactgacatttctaatgctagt

SEQ ID NO: 939761 - DNA, 25 bp, Mus musculus
ttctactgagtgaactgctgatctt

SEQ ID NO: 939762 - DNA, 25 bp, Mus musculus
ttctactgagtgtactgctgatctt

SEQ ID NO: 939763 - DNA, 25 bp, Mus musculus
ttctactgcaagcacatgtgactag

SEQ ID NO: 939764 - DNA, 25 bp, Mus musculus
ttctactgcaaggacatgtgactag

SEQ ID NO: 939765 - DNA, 25 bp, Mus musculus
ttctactgcagaacaaggccccatc

SEQ ID NO: 939766 - DNA, 25 bp, Mus musculus
ttctactgcagatcaaggccccatc

SEQ ID NO: 939767 - DNA, 25 bp, Mus musculus
ttctactgcaggcaaggacagcttc

SEQ ID NO: 939768 - DNA, 25 bp, Mus musculus
ttctactgcagggaaggacagcttc

SEQ ID NO: 939769 - DNA, 25 bp, Mus musculus
ttctactgcctgaactcgggaggta

SEQ ID NO: 939770 - DNA, 25 bp, Mus musculus
ttctactgcctgtactcgggaggta

SEQ ID NO: 939771 - DNA, 25 bp, Mus musculus
ttctactgtagtctctgctgcaaag

SEQ ID NO: 939772 - DNA, 25 bp, Mus musculus
ttctactgtagtgtctgctgcaaag

SEQ ID NO: 939773 - DNA, 25 bp, Mus musculus
ttctactgtgcccagcactggttga

SEQ ID NO: 939774 - DNA, 25 bp, Mus musculus
ttctactgtgccgagcactggttga

SEQ ID NO: 939775 - DNA, 25 bp, Mus musculus
ttctactgtgttcctgtggtgtgat

SEQ ID NO: 939776 - DNA, 25 bp, Mus musculus
ttctactgtgttgctgtggtgtgat

SEQ ID NO: 939777 - DNA, 25 bp, Mus musculus
ttctactgtttaatcccatcttgta

SEQ ID NO: 939778 - DNA, 25 bp, Mus musculus
ttctactgtttattcccatcttgta

SEQ ID NO: 939779 - DNA, 25 bp, Mus musculus
ttctacttagaacctgccgtgttat

SEQ ID NO: 939780 - DNA, 25 bp, Mus musculus
ttctacttagaagctgccgtgttat

SEQ ID NO: 939781 - DNA, 25 bp, Mus musculus
ttctacttagagattctacctttct

SEQ ID NO: 939782 - DNA, 25 bp, Mus musculus
ttctacttagagtttctacctttct

SEQ ID NO: 939783 - DNA, 25 bp, Mus musculus
ttctacttcaaccagaccaagggct

SEQ ID NO: 939784 - DNA, 25 bp, Mus musculus
ttctacttcaacgagaccaagggct

SEQ ID NO: 939785 - DNA, 25 bp, Mus musculus
ttctacttcatcagtcatccccaaa

SEQ ID NO: 939786 - DNA, 25 bp, Mus musculus
ttctacttcatctgtcatccccaaa

SEQ ID NO: 939787 - DNA, 25 bp, Mus musculus
ttctacttcccgaactttgtcagtt

SEQ ID NO: 939788 - DNA, 25 bp, Mus musculus
ttctacttcccgtactttgtcagtt

SEQ ID NO: 939789 - DNA, 25 bp, Mus musculus
ttctacttccggagaccaagggcgt

SEQ ID NO: 939790 - DNA, 25 bp, Mus musculus
ttctacttccggtgaccaagggcgt

SEQ ID NO: 939791 - DNA, 25 bp, Mus musculus
ttctacttccgtcttggtgtgtatt

SEQ ID NO: 939792 - DNA, 25 bp, Mus musculus
ttctacttccgtgttggtgtgtatt

SEQ ID NO: 939793 - DNA, 25 bp, Mus musculus
ttctacttcctaagtctgaagtccc

SEQ ID NO: 939794 - DNA, 25 bp, Mus musculus
ttctacttcctatgtctgaagtccc

SEQ ID NO: 939795 - DNA, 25 bp, Mus musculus
ttctacttctgtcctgaagacacag

SEQ ID NO: 939796 - DNA, 25 bp, Mus musculus
ttctacttctgtgctgaagacacag

SEQ ID NO: 939797 - DNA, 25 bp, Mus musculus
ttctacttgaacacctgtgtttcca

SEQ ID NO: 939798 - DNA, 25 bp, Mus musculus
ttctacttgaactcctgtgtttcca

SEQ ID NO: 939799 - DNA, 25 bp, Mus musculus
ttctacttgcgtatttcgcaggagc

SEQ ID NO: 939800 - DNA, 25 bp, Mus musculus
ttctacttgcgtttttcgcaggagc

SEQ ID NO: 939801 - DNA, 25 bp, Mus musculus
ttctacttggaactgtacacatttg

SEQ ID NO: 939802 - DNA, 25 bp, Mus musculus
ttctacttggaagtgtacacatttg

SEQ ID NO: 939803 - DNA, 25 bp, Mus musculus
ttctacttgtagagtctgcacatca

SEQ ID NO: 939804 - DNA, 25 bp, Mus musculus
ttctacttgtagtgtctgcacatca

SEQ ID NO: 939805 - DNA, 25 bp, Mus musculus
ttctacttgtgtaggactccctgca

SEQ ID NO: 939806 - DNA, 25 bp, Mus musculus
ttctacttgtgttggactccctgca

SEQ ID NO: 939807 - DNA, 25 bp, Mus musculus
ttctacttttgtacttgggcaccac

SEQ ID NO: 939808 - DNA, 25 bp, Mus musculus
ttctacttttgttcttgggcaccac

SEQ ID NO: 939809 - DNA, 25 bp, Mus musculus
ttctactttttgacttcttacctgc

SEQ ID NO: 939810 - DNA, 25 bp, Mus musculus
ttctactttttgtcttcttacctgc

SEQ ID NO: 939811 - DNA, 25 bp, Mus musculus
ttctagaaagcaccagtacgtttaa

SEQ ID NO: 939812 - DNA, 25 bp, Mus musculus
ttctagaaagcagcagtacgtttaa

SEQ ID NO: 939813 - DNA, 25 bp, Mus musculus
ttctagaaataacgccatggctact

SEQ ID NO: 939814 - DNA, 25 bp, Mus musculus
ttctagaaataaggccatggctact

SEQ ID NO: 939815 - DNA, 25 bp, Mus musculus
ttctagaaattccacttgctgagtt

SEQ ID NO: 939816 - DNA, 25 bp, Mus musculus
ttctagaaattcgacttgctgagtt

SEQ ID NO: 939817 - DNA, 25 bp, Mus musculus
ttctagaacgggatgacagtgtatt

SEQ ID NO: 939818 - DNA, 25 bp, Mus musculus
ttctagaacgggttgacagtgtatt

SEQ ID NO: 939819 - DNA, 25 bp, Mus musculus
ttctagaagaccagctcagccctgt

SEQ ID NO: 939820 - DNA, 25 bp, Mus musculus
ttctagaagacctgctcagccctgt

SEQ ID NO: 939821 - DNA, 25 bp, Mus musculus
ttctagaagggcccctttctttggg

SEQ ID NO: 939822 - DNA, 25 bp, Mus musculus
ttctagaagggcgcctttctttggg

SEQ ID NO: 939823 - DNA, 25 bp, Mus musculus
ttctagaatgtcagggttcaattcc

SEQ ID NO: 939824 - DNA, 25 bp, Mus musculus
ttctagaatgtctgggttcaattcc

SEQ ID NO: 939825 - DNA, 25 bp, Mus musculus
ttctagacaattacctgacatcccc

SEQ ID NO: 939826 - DNA, 25 bp, Mus musculus
ttctagacaatttcctgacatcccc

SEQ ID NO: 939827 - DNA, 25 bp, Mus musculus
ttctagacatgcatcccctaaggac

SEQ ID NO: 939828 - DNA, 25 bp, Mus musculus
ttctagacatgcatgctccagatga

SEQ ID NO: 939829 - DNA, 25 bp, Mus musculus
ttctagacatgcttcccctaaggac

SEQ ID NO: 939830 - DNA, 25 bp, Mus musculus
ttctagacatgcttgctccagatga

SEQ ID NO: 939831 - DNA, 25 bp, Mus musculus
ttctagaccacacagttggttggta

SEQ ID NO: 939832 - DNA, 25 bp, Mus musculus
ttctagaccacagagttggttggta

SEQ ID NO: 939833 - DNA, 25 bp, Mus musculus
ttctagaccaccctgggctcatagt

SEQ ID NO: 939834 - DNA, 25 bp, Mus musculus
ttctagaccaccgtgggctcatagt

SEQ ID NO: 939835 - DNA, 25 bp, Mus musculus
ttctagacggttctcctatggttga

SEQ ID NO: 939836 - DNA, 25 bp, Mus musculus
ttctagacggttgtcctatggttga

SEQ ID NO: 939837 - DNA, 25 bp, Mus musculus
ttctagacgtggaacccagcatggg

SEQ ID NO: 939838 - DNA, 25 bp, Mus musculus
ttctagacgtggtacccagcatggg

SEQ ID NO: 939839 - DNA, 25 bp, Mus musculus
ttctagagcactcgcatcctccaag

SEQ ID NO: 939840 - DNA, 25 bp, Mus musculus
ttctagagcactggcatcctccaag

SEQ ID NO: 939841 - DNA, 25 bp, Mus musculus
ttctagagctccatgatgttccata

SEQ ID NO: 939842 - DNA, 25 bp, Mus musculus
ttctagagctccttgatgttccata

SEQ ID NO: 939843 - DNA, 25 bp, Mus musculus
ttctagaggagcagagatctgggat

SEQ ID NO: 939844 - DNA, 25 bp, Mus musculus
ttctagaggagctgagatctgggat

SEQ ID NO: 939845 - DNA, 25 bp, Mus musculus
ttctagagtctaactgcagcaggat

SEQ ID NO: 939846 - DNA, 25 bp, Mus musculus
ttctagagtctatctgcagcaggat

SEQ ID NO: 939847 - DNA, 25 bp, Mus musculus
ttctagataaaccaataatgtgttg

SEQ ID NO: 939848 - DNA, 25 bp, Mus musculus
ttctagataaacgaataatgtgttg

SEQ ID NO: 939849 - DNA, 25 bp, Mus musculus
ttctagatcatcattcttcagttga

SEQ ID NO: 939850 - DNA, 25 bp, Mus musculus
ttctagatcatctttcttcagttga

SEQ ID NO: 939851 - DNA, 25 bp, Mus musculus
ttctagatccttcaagactggcgtt

SEQ ID NO: 939852 - DNA, 25 bp, Mus musculus
ttctagatccttgaagactggcgtt

SEQ ID NO: 939853 - DNA, 25 bp, Mus musculus
ttctagatctctacaaagacccaga

SEQ ID NO: 939854 - DNA, 25 bp, Mus musculus
ttctagatctcttcaaagacccaga

SEQ ID NO: 939855 - DNA, 25 bp, Mus musculus
ttctagatgagtagagtgtgtgcct

SEQ ID NO: 939856 - DNA, 25 bp, Mus musculus
ttctagatgagttgagtgtgtgcct

SEQ ID NO: 939857 - DNA, 25 bp, Mus musculus
ttctagattgtcatttatagtgtgt

SEQ ID NO: 939858 - DNA, 25 bp, Mus musculus
ttctagattgtcttttatagtgtgt

SEQ ID NO: 939859 - DNA, 25 bp, Mus musculus
ttctagcaaatacatctgtcacatg

SEQ ID NO: 939860 - DNA, 25 bp, Mus musculus
ttctagcaaatagatctgtcacatg

SEQ ID NO: 939861 - DNA, 25 bp, Mus musculus
ttctagcccacccatggatgcatag

SEQ ID NO: 939862 - DNA, 25 bp, Mus musculus
ttctagcccaccgatggatgcatag

SEQ ID NO: 939863 - DNA, 25 bp, Mus musculus
ttctagccccagagtgctcttgttt

SEQ ID NO: 939864 - DNA, 25 bp, Mus musculus
ttctagccccagcttttcaaacaaa

SEQ ID NO: 939865 - DNA, 25 bp, Mus musculus
ttctagccccaggttttcaaacaaa

SEQ ID NO: 939866 - DNA, 25 bp, Mus musculus
ttctagccccagtgtgctcttgttt

SEQ ID NO: 939867 - DNA, 25 bp, Mus musculus
ttctagccccataactgacttggtg

SEQ ID NO: 939868 - DNA, 25 bp, Mus musculus
ttctagccccattactgacttggtg

SEQ ID NO: 939869 - DNA, 25 bp, Mus musculus
ttctagccgattctcttcagatcag

SEQ ID NO: 939870 - DNA, 25 bp, Mus musculus
ttctagccgattgtcttcagatcag

SEQ ID NO: 939871 - DNA, 25 bp, Mus musculus
ttctagcctcccaaaccgagaggaa

SEQ ID NO: 939872 - DNA, 25 bp, Mus musculus
ttctagcctccctaaccgagaggaa

SEQ ID NO: 939873 - DNA, 25 bp, Mus musculus
ttctagcctctgatgtatatcttaa

SEQ ID NO: 939874 - DNA, 25 bp, Mus musculus
ttctagcctctgttgtatatcttaa

SEQ ID NO: 939875 - DNA, 25 bp, Mus musculus
ttctagcctggacctagtgtcatgg

SEQ ID NO: 939876 - DNA, 25 bp, Mus musculus
ttctagcctggacctagtgtcatgt

SEQ ID NO: 939877 - DNA, 25 bp, Mus musculus
ttctagcctggagctagtgtcatgg

SEQ ID NO: 939878 - DNA, 25 bp, Mus musculus
ttctagcctggagctagtgtcatgt

SEQ ID NO: 939879 - DNA, 25 bp, Mus musculus
ttctagcgagcaagcagtggccctg

SEQ ID NO: 939880 - DNA, 25 bp, Mus musculus
ttctagcgagcatgcagtggccctg

SEQ ID NO: 939881 - DNA, 25 bp, Mus musculus
ttctagctagaaattcttgttcttt

SEQ ID NO: 939882 - DNA, 25 bp, Mus musculus
ttctagctagaatttcttgttcttt

SEQ ID NO: 939883 - DNA, 25 bp, Mus musculus
ttctagctagataatcttgcctatg

SEQ ID NO: 939884 - DNA, 25 bp, Mus musculus
ttctagctagattatcttgcctatg

SEQ ID NO: 939885 - DNA, 25 bp, Mus musculus
ttctagctagggaagtatttcttgc

SEQ ID NO: 939886 - DNA, 25 bp, Mus musculus
ttctagctagggtagtatttcttgc

SEQ ID NO: 939887 - DNA, 25 bp, Mus musculus
ttctagctcccacagctttggaata

SEQ ID NO: 939888 - DNA, 25 bp, Mus musculus
ttctagctcccagagctttggaata

SEQ ID NO: 939889 - DNA, 25 bp, Mus musculus
ttctagctctttctgggcttttcaa

SEQ ID NO: 939890 - DNA, 25 bp, Mus musculus
ttctagctctttgtgggcttttcaa

SEQ ID NO: 939891 - DNA, 25 bp, Mus musculus
ttctagctgctaataatgtgttgta

SEQ ID NO: 939892 - DNA, 25 bp, Mus musculus
ttctagctgctattaatgtgttgta

SEQ ID NO: 939893 - DNA, 25 bp, Mus musculus
ttctagctggaacgaggagctcatt

SEQ ID NO: 939894 - DNA, 25 bp, Mus musculus
ttctagctggaaggaggagctcatt

SEQ ID NO: 939895 - DNA, 25 bp, Mus musculus
ttctagctggtgagcgcatcataaa

SEQ ID NO: 939896 - DNA, 25 bp, Mus musculus
ttctagctggtgtgcgcatcataaa

SEQ ID NO: 939897 - DNA, 25 bp, Mus musculus
ttctagctgtgaagttatgtgggct

SEQ ID NO: 939898 - DNA, 25 bp, Mus musculus
ttctagctgtgatgttatgtgggct

SEQ ID NO: 939899 - DNA, 25 bp, Mus musculus
ttctagcttagcattcttcaccgtt

SEQ ID NO: 939900 - DNA, 25 bp, Mus musculus
ttctagcttagctttcttcaccgtt

SEQ ID NO: 939901 - DNA, 25 bp, Mus musculus
ttctagcttgccaggtttcctctgt

SEQ ID NO: 939902 - DNA, 25 bp, Mus musculus
ttctagcttgcctggtttcctctgt

SEQ ID NO: 939903 - DNA, 25 bp, Mus musculus
ttctagcttgtcatgctgtgtgatc

SEQ ID NO: 939904 - DNA, 25 bp, Mus musculus
ttctagcttgtcttgctgtgtgatc

SEQ ID NO: 939905 - DNA, 25 bp, Mus musculus
ttctagctttctcaacagcaaatag

SEQ ID NO: 939906 - DNA, 25 bp, Mus musculus
ttctagctttctgaacagcaaatag

SEQ ID NO: 939907 - DNA, 25 bp, Mus musculus
ttctaggaactgcacactggacaat

SEQ ID NO: 939908 - DNA, 25 bp, Mus musculus
ttctaggaactggacactggacaat

SEQ ID NO: 939909 - DNA, 25 bp, Mus musculus
ttctaggaagaaccagcatcaatga

SEQ ID NO: 939910 - DNA, 25 bp, Mus musculus
ttctaggaagaagcagcatcaatga

SEQ ID NO: 939911 - DNA, 25 bp, Mus musculus
ttctaggaagccaaagccccagatg

SEQ ID NO: 939912 - DNA, 25 bp, Mus musculus
ttctaggaagcctaagccccagatg

SEQ ID NO: 939913 - DNA, 25 bp, Mus musculus
ttctaggacctgcatgatccctggg

SEQ ID NO: 939914 - DNA, 25 bp, Mus musculus
ttctaggacctggatgatccctggg

SEQ ID NO: 939915 - DNA, 25 bp, Mus musculus
ttctaggactctctgcacctgttgt

SEQ ID NO: 939916 - DNA, 25 bp, Mus musculus
ttctaggactctgtgcacctgttgt

SEQ ID NO: 939917 - DNA, 25 bp, Mus musculus
ttctaggagccactcttacagcaga

SEQ ID NO: 939918 - DNA, 25 bp, Mus musculus
ttctaggagccagtcttacagcaga

SEQ ID NO: 939919 - DNA, 25 bp, Mus musculus
ttctaggagggcagggttggacact

SEQ ID NO: 939920 - DNA, 25 bp, Mus musculus
ttctaggagggctgggttggacact

SEQ ID NO: 939921 - DNA, 25 bp, Mus musculus
ttctaggcagtcacattctatagat

SEQ ID NO: 939922 - DNA, 25 bp, Mus musculus
ttctaggcagtctcattctatagat

SEQ ID NO: 939923 - DNA, 25 bp, Mus musculus
ttctaggccctaactccatgataga

SEQ ID NO: 939924 - DNA, 25 bp, Mus musculus
ttctaggccctatctccatgataga

SEQ ID NO: 939925 - DNA, 25 bp, Mus musculus
ttctaggcctctataatctcagttt

SEQ ID NO: 939926 - DNA, 25 bp, Mus musculus
ttctaggcctctttaatctcagttt

SEQ ID NO: 939927 - DNA, 25 bp, Mus musculus
ttctaggctcacagctattcattag

SEQ ID NO: 939928 - DNA, 25 bp, Mus musculus
ttctaggctcactgctattcattag

SEQ ID NO: 939929 - DNA, 25 bp, Mus musculus
ttctaggctcccactagagtggctg

SEQ ID NO: 939930 - DNA, 25 bp, Mus musculus
ttctaggctccctctagagtggctg

SEQ ID NO: 939931 - DNA, 25 bp, Mus musculus
ttctaggctgagcacccagccatgt

SEQ ID NO: 939932 - DNA, 25 bp, Mus musculus
ttctaggctgaggacccagccatgt

SEQ ID NO: 939933 - DNA, 25 bp, Mus musculus
ttctaggctgccagcccattttctt

SEQ ID NO: 939934 - DNA, 25 bp, Mus musculus
ttctaggctgcctgcccattttctt

SEQ ID NO: 939935 - DNA, 25 bp, Mus musculus
ttctaggctggtcgccatgacgtct

SEQ ID NO: 939936 - DNA, 25 bp, Mus musculus
ttctaggctggtggccatgacgtct

SEQ ID NO: 939937 - DNA, 25 bp, Mus musculus
ttctagggaagaaccaaggcagcca

SEQ ID NO: 939938 - DNA, 25 bp, Mus musculus
ttctagggaagatccaaggcagcca

SEQ ID NO: 939939 - DNA, 25 bp, Mus musculus
ttctagggagttaagccccagcttc

SEQ ID NO: 939940 - DNA, 25 bp, Mus musculus
ttctagggagtttagccccagcttc

SEQ ID NO: 939941 - DNA, 25 bp, Mus musculus
ttctagggcactactattcttcgtt

SEQ ID NO: 939942 - DNA, 25 bp, Mus musculus
ttctagggcacttctattcttcgtt

SEQ ID NO: 939943 - DNA, 25 bp, Mus musculus
ttctagggcagcaattctcaactcc

SEQ ID NO: 939944 - DNA, 25 bp, Mus musculus
ttctagggcagctattctcaactcc

SEQ ID NO: 939945 - DNA, 25 bp, Mus musculus
ttctagggtttcacaggttatttct

SEQ ID NO: 939946 - DNA, 25 bp, Mus musculus
ttctagggtttctcaggttatttct

SEQ ID NO: 939947 - DNA, 25 bp, Mus musculus
ttctaggtaatcactgggatgtgac

SEQ ID NO: 939948 - DNA, 25 bp, Mus musculus
ttctaggtaatctctgggatgtgac

SEQ ID NO: 939949 - DNA, 25 bp, Mus musculus
ttctaggtaatgagccaagccatcc

SEQ ID NO: 939950 - DNA, 25 bp, Mus musculus
ttctaggtaatgtgccaagccatcc

SEQ ID NO: 939951 - DNA, 25 bp, Mus musculus
ttctaggtcaatatgtgagctcaga

SEQ ID NO: 939952 - DNA, 25 bp, Mus musculus
ttctaggtcaatttgtgagctcaga

SEQ ID NO: 939953 - DNA, 25 bp, Mus musculus
ttctaggtcaccctctgacatatag

SEQ ID NO: 939954 - DNA, 25 bp, Mus musculus
ttctaggtcaccgtctgacatatag

SEQ ID NO: 939955 - DNA, 25 bp, Mus musculus
ttctaggtctataagatccggctgg

SEQ ID NO: 939956 - DNA, 25 bp, Mus musculus
ttctaggtctattagatccggctgg

SEQ ID NO: 939957 - DNA, 25 bp, Mus musculus
ttctaggtgctactatggcaaactc

SEQ ID NO: 939958 - DNA, 25 bp, Mus musculus
ttctaggtgctagtatggcaaactc

SEQ ID NO: 939959 - DNA, 25 bp, Mus musculus
ttctaggtggagacaaagccccaaa

SEQ ID NO: 939960 - DNA, 25 bp, Mus musculus
ttctaggtggagtcaaagccccaaa

SEQ ID NO: 939961 - DNA, 25 bp, Mus musculus
ttctaggtgtgcatgctcattcaga

SEQ ID NO: 939962 - DNA, 25 bp, Mus musculus
ttctaggtgtgcttgctcattcaga

SEQ ID NO: 939963 - DNA, 25 bp, Mus musculus
ttctaggttctgaccattctgggtt

SEQ ID NO: 939964 - DNA, 25 bp, Mus musculus
ttctaggttctgatcattcttcgga

SEQ ID NO: 939965 - DNA, 25 bp, Mus musculus
ttctaggttctgtccattctgggtt

SEQ ID NO: 939966 - DNA, 25 bp, Mus musculus
ttctaggttctgttcattcttcgga

SEQ ID NO: 939967 - DNA, 25 bp, Mus musculus
ttctaggttggcactccttacggag

SEQ ID NO: 939968 - DNA, 25 bp, Mus musculus
ttctaggttggctctccttacggag

SEQ ID NO: 939969 - DNA, 25 bp, Mus musculus
ttctagtaatctctgtctcgttggc

SEQ ID NO: 939970 - DNA, 25 bp, Mus musculus
ttctagtaatctgtgtctcgttggc

SEQ ID NO: 939971 - DNA, 25 bp, Mus musculus
ttctagtaccttcgcttggcattca

SEQ ID NO: 939972 - DNA, 25 bp, Mus musculus
ttctagtaccttggcttggcattca

SEQ ID NO: 939973 - DNA, 25 bp, Mus musculus
ttctagtagcccaggccatcatagc

SEQ ID NO: 939974 - DNA, 25 bp, Mus musculus
ttctagtagccctggccatcatagc

SEQ ID NO: 939975 - DNA, 25 bp, Mus musculus
ttctagtagctaatttaaccattgg

SEQ ID NO: 939976 - DNA, 25 bp, Mus musculus
ttctagtagctattttaaccattgg

SEQ ID NO: 939977 - DNA, 25 bp, Mus musculus
ttctagtagggtatcccctgtcaga

SEQ ID NO: 939978 - DNA, 25 bp, Mus musculus
ttctagtagggtttcccctgtcaga

SEQ ID NO: 939979 - DNA, 25 bp, Mus musculus
ttctagtatagaatcccagtgggac

SEQ ID NO: 939980 - DNA, 25 bp, Mus musculus
ttctagtatagattcccagtgggac

SEQ ID NO: 939981 - DNA, 25 bp, Mus musculus
ttctagtcaaaaaagtcagcacttt

SEQ ID NO: 939982 - DNA, 25 bp, Mus musculus
ttctagtcaaaatagtcagcacttt

SEQ ID NO: 939983 - DNA, 25 bp, Mus musculus
ttctagtccagcactgtggtctttc

SEQ ID NO: 939984 - DNA, 25 bp, Mus musculus
ttctagtccagctctgtggtctttc

SEQ ID NO: 939985 - DNA, 25 bp, Mus musculus
ttctagtcccggaatctgctataga

SEQ ID NO: 939986 - DNA, 25 bp, Mus musculus
ttctagtcccggtatctgctataga

SEQ ID NO: 939987 - DNA, 25 bp, Mus musculus
ttctagtcctcaaaccatgtgtgcc

SEQ ID NO: 939988 - DNA, 25 bp, Mus musculus
ttctagtcctcataccatgtgtgcc

SEQ ID NO: 939989 - DNA, 25 bp, Mus musculus
ttctagtctgctcttcatctaccat

SEQ ID NO: 939990 - DNA, 25 bp, Mus musculus
ttctagtctgctgttcatctaccat

SEQ ID NO: 939991 - DNA, 25 bp, Mus musculus
ttctagtcttgtcgaggaatcggca

SEQ ID NO: 939992 - DNA, 25 bp, Mus musculus
ttctagtcttgtggaggaatcggca

SEQ ID NO: 939993 - DNA, 25 bp, Mus musculus
ttctagtctttgagggctggcaaat

SEQ ID NO: 939994 - DNA, 25 bp, Mus musculus
ttctagtctttgtgggctggcaaat

SEQ ID NO: 939995 - DNA, 25 bp, Mus musculus
ttctagtgagctagtgatctgtgga

SEQ ID NO: 939996 - DNA, 25 bp, Mus musculus
ttctagtgagcttgtgatctgtgga

SEQ ID NO: 939997 - DNA, 25 bp, Mus musculus
ttctagtgccttacttgtcttgatt

SEQ ID NO: 939998 - DNA, 25 bp, Mus musculus
ttctagtgcctttcttgtcttgatt

SEQ ID NO: 939999 - DNA, 25 bp, Mus musculus
ttctagtgggtgatttcttcctgat

SEQ ID NO: 940000 - DNA, 25 bp, Mus musculus
ttctagtgggtgttttcttcctgat

SEQ ID NO: 940001 - DNA, 25 bp, Mus musculus
ttctagtgtatccaggccgttagct

SEQ ID NO: 940002 - DNA, 25 bp, Mus musculus
ttctagtgtatcgaggccgttagct

SEQ ID NO: 940003 - DNA, 25 bp, Mus musculus
ttctagtgtgagaaactgcgggctg

SEQ ID NO: 940004 - DNA, 25 bp, Mus musculus
ttctagtgtgagtaactgcgggctg

SEQ ID NO: 940005 - DNA, 25 bp, Mus musculus
ttctagttaattcagctgtcgttta

SEQ ID NO: 940006 - DNA, 25 bp, Mus musculus
ttctagttaattgagctgtcgttta

SEQ ID NO: 940007 - DNA, 25 bp, Mus musculus
ttctagttctcaacaggcaaccctg

SEQ ID NO: 940008 - DNA, 25 bp, Mus musculus
ttctagttctcatcaggcaaccctg

SEQ ID NO: 940009 - DNA, 25 bp, Mus musculus
ttctagttgacaccggatagggact

SEQ ID NO: 940010 - DNA, 25 bp, Mus musculus
ttctagttgacagcggatagggact

SEQ ID NO: 940011 - DNA, 25 bp, Mus musculus
ttctagttgagtacaggatcctggt

SEQ ID NO: 940012 - DNA, 25 bp, Mus musculus
ttctagttgagttcaggatcctggt

SEQ ID NO: 940013 - DNA, 25 bp, Mus musculus
ttctagttgctgatagcatcccctt

SEQ ID NO: 940014 - DNA, 25 bp, Mus musculus
ttctagttgctgttagcatcccctt

SEQ ID NO: 940015 - DNA, 25 bp, Mus musculus
ttctagttgtgcaccgaggcatcaa

SEQ ID NO: 940016 - DNA, 25 bp, Mus musculus
ttctagttgtgctccgaggcatcaa

SEQ ID NO: 940017 - DNA, 25 bp, Mus musculus
ttctagtttagactgagttgcccta

SEQ ID NO: 940018 - DNA, 25 bp, Mus musculus
ttctagtttagagtgagttgcccta

SEQ ID NO: 940019 - DNA, 25 bp, Mus musculus
ttctagtttgaacgtcggccttgta

SEQ ID NO: 940020 - DNA, 25 bp, Mus musculus
ttctagtttgaaggtcggccttgta

SEQ ID NO: 940021 - DNA, 25 bp, Mus musculus
ttctagtttgtcatcgactcctgtc

SEQ ID NO: 940022 - DNA, 25 bp, Mus musculus
ttctagtttgtcttcgactcctgtc

SEQ ID NO: 940023 - DNA, 25 bp, Mus musculus
ttctataaacacagacacttcaggt

SEQ ID NO: 940024 - DNA, 25 bp, Mus musculus
ttctataaacactgacacttcaggt

SEQ ID NO: 940025 - DNA, 25 bp, Mus musculus
ttctataaatatccttgcagatgtg

SEQ ID NO: 940026 - DNA, 25 bp, Mus musculus
ttctataaatatgcttgcagatgtg

SEQ ID NO: 940027 - DNA, 25 bp, Mus musculus
ttctataacccgatggtgcccgagg

SEQ ID NO: 940028 - DNA, 25 bp, Mus musculus
ttctataacccgttggtgcccgagg

SEQ ID NO: 940029 - DNA, 25 bp, Mus musculus
ttctataagtgcagcaatgctcagt

SEQ ID NO: 940030 - DNA, 25 bp, Mus musculus
ttctataagtgctgcaatgctcagt

SEQ ID NO: 940031 - DNA, 25 bp, Mus musculus
ttctataatatcctttccttttctt

SEQ ID NO: 940032 - DNA, 25 bp, Mus musculus
ttctataatatcgtttccttttctt

SEQ ID NO: 940033 - DNA, 25 bp, Mus musculus
ttctataatgcaaaggttctcaacc

SEQ ID NO: 940034 - DNA, 25 bp, Mus musculus
ttctataatgcataggttctcaacc

SEQ ID NO: 940035 - DNA, 25 bp, Mus musculus
ttctatacgagtagtgaatgttctt

SEQ ID NO: 940036 - DNA, 25 bp, Mus musculus
ttctatacgagttgtgaatgttctt

SEQ ID NO: 940037 - DNA, 25 bp, Mus musculus
ttctatacttgaactctgtctatga

SEQ ID NO: 940038 - DNA, 25 bp, Mus musculus
ttctatacttgatctctgtctatga

SEQ ID NO: 940039 - DNA, 25 bp, Mus musculus
ttctataggattcactctgtctgat

SEQ ID NO: 940040 - DNA, 25 bp, Mus musculus
ttctataggattgactctgtctgat

SEQ ID NO: 940041 - DNA, 25 bp, Mus musculus
ttctatatatccctctggctttttg

SEQ ID NO: 940042 - DNA, 25 bp, Mus musculus
ttctatatatccgtctggctttttg

SEQ ID NO: 940043 - DNA, 25 bp, Mus musculus
ttctatatcaggctcggtgaaaaaa

SEQ ID NO: 940044 - DNA, 25 bp, Mus musculus
ttctatatcagggtcggtgaaaaaa

SEQ ID NO: 940045 - DNA, 25 bp, Mus musculus
ttctatatcattcttcctcctctta

SEQ ID NO: 940046 - DNA, 25 bp, Mus musculus
ttctatatcattgttcctcctctta

SEQ ID NO: 940047 - DNA, 25 bp, Mus musculus
ttctatatgatcaccctttgttcct

SEQ ID NO: 940048 - DNA, 25 bp, Mus musculus
ttctatatgatctccctttgttcct

SEQ ID NO: 940049 - DNA, 25 bp, Mus musculus
ttctatatgcctagtattgtgtgat

SEQ ID NO: 940050 - DNA, 25 bp, Mus musculus
ttctatatgccttgtattgtgtgat

SEQ ID NO: 940051 - DNA, 25 bp, Mus musculus
ttctatcaaaacatgggacttccta

SEQ ID NO: 940052 - DNA, 25 bp, Mus musculus
ttctatcaaaacttgggacttccta

SEQ ID NO: 940053 - DNA, 25 bp, Mus musculus
ttctatcaaagaaccagcgacctga

SEQ ID NO: 940054 - DNA, 25 bp, Mus musculus
ttctatcaaagatccagcgacctga

SEQ ID NO: 940055 - DNA, 25 bp, Mus musculus
ttctatcaagtaagtttttaccaag

SEQ ID NO: 940056 - DNA, 25 bp, Mus musculus
ttctatcaagtatgtttttaccaag

SEQ ID NO: 940057 - DNA, 25 bp, Mus musculus
ttctatcacagtctgcatctgcagg

SEQ ID NO: 940058 - DNA, 25 bp, Mus musculus
ttctatcacagtgtgcatctgcagg

SEQ ID NO: 940059 - DNA, 25 bp, Mus musculus
ttctatcagatcagccactgtgcag

SEQ ID NO: 940060 - DNA, 25 bp, Mus musculus
ttctatcagatctgccactgtgcag

SEQ ID NO: 940061 - DNA, 25 bp, Mus musculus
ttctatcagcgccaagatgtgggtc

SEQ ID NO: 940062 - DNA, 25 bp, Mus musculus
ttctatcagcgcgaagatgtgggtc

SEQ ID NO: 940063 - DNA, 25 bp, Mus musculus
ttctatcatccaatccgatgtcatg

SEQ ID NO: 940064 - DNA, 25 bp, Mus musculus
ttctatcatccattccgatgtcatg

SEQ ID NO: 940065 - DNA, 25 bp, Mus musculus
ttctatccactgacaattttaatta

SEQ ID NO: 940066 - DNA, 25 bp, Mus musculus
ttctatccactgtcaattttaatta

SEQ ID NO: 940067 - DNA, 25 bp, Mus musculus
ttctatccatcgcactttccttttc

SEQ ID NO: 940068 - DNA, 25 bp, Mus musculus
ttctatccatcggactttccttttc

SEQ ID NO: 940069 - DNA, 25 bp, Mus musculus
ttctatcccagaatcctttgtgcct

SEQ ID NO: 940070 - DNA, 25 bp, Mus musculus
ttctatcccagattcctttgtgcct

SEQ ID NO: 940071 - DNA, 25 bp, Mus musculus
ttctatcccatgctgcacttccagg

SEQ ID NO: 940072 - DNA, 25 bp, Mus musculus
ttctatcccatggtgcacttccagg

SEQ ID NO: 940073 - DNA, 25 bp, Mus musculus
ttctatccccttatagagtcctcat

SEQ ID NO: 940074 - DNA, 25 bp, Mus musculus
ttctatccccttttagagtcctcat

SEQ ID NO: 940075 - DNA, 25 bp, Mus musculus
ttctatcctgccacttaacaagttc

SEQ ID NO: 940076 - DNA, 25 bp, Mus musculus
ttctatcctgcctcttaacaagttc

SEQ ID NO: 940077 - DNA, 25 bp, Mus musculus
ttctatcctggtcggaggtactgat

SEQ ID NO: 940078 - DNA, 25 bp, Mus musculus
ttctatcctggtgggaggtactgat

SEQ ID NO: 940079 - DNA, 25 bp, Mus musculus
ttctatctcagtcatctgcttgttg

SEQ ID NO: 940080 - DNA, 25 bp, Mus musculus
ttctatctcagtgatctgcttgttg

SEQ ID NO: 940081 - DNA, 25 bp, Mus musculus
ttctatctcctactacatctgtggg

SEQ ID NO: 940082 - DNA, 25 bp, Mus musculus
ttctatctcctagtacatctgtggg

SEQ ID NO: 940083 - DNA, 25 bp, Mus musculus
ttctatctctccacagactttgtaa

SEQ ID NO: 940084 - DNA, 25 bp, Mus musculus
ttctatctctcctcagactttgtaa

SEQ ID NO: 940085 - DNA, 25 bp, Mus musculus
ttctatctgctcaacatcgtcaatg

SEQ ID NO: 940086 - DNA, 25 bp, Mus musculus
ttctatctgctcatttcaaactttg

SEQ ID NO: 940087 - DNA, 25 bp, Mus musculus
ttctatctgctctacatcgtcaatg

SEQ ID NO: 940088 - DNA, 25 bp, Mus musculus
ttctatctgctcttttcaaactttg

SEQ ID NO: 940089 - DNA, 25 bp, Mus musculus
ttctatctggtgcacagactgcaag

SEQ ID NO: 940090 - DNA, 25 bp, Mus musculus
ttctatctggtggacagactgcaag

SEQ ID NO: 940091 - DNA, 25 bp, Mus musculus
ttctatctgttccttgcacacaaag

SEQ ID NO: 940092 - DNA, 25 bp, Mus musculus
ttctatctgttcgttgcacacaaag

SEQ ID NO: 940093 - DNA, 25 bp, Mus musculus
ttctatctgtttctgtctggactcc

SEQ ID NO: 940094 - DNA, 25 bp, Mus musculus
ttctatctgtttgtgtctggactcc

SEQ ID NO: 940095 - DNA, 25 bp, Mus musculus
ttctatcttgctagttacaggtcgg

SEQ ID NO: 940096 - DNA, 25 bp, Mus musculus
ttctatcttgcttgttacaggtcgg

SEQ ID NO: 940097 - DNA, 25 bp, Mus musculus
ttctatgaccttactcttccaggag

SEQ ID NO: 940098 - DNA, 25 bp, Mus musculus
ttctatgacctttctcttccaggag

SEQ ID NO: 940099 - DNA, 25 bp, Mus musculus
ttctatgactgcactcttggatcca

SEQ ID NO: 940100 - DNA, 25 bp, Mus musculus
ttctatgactgctctcttggatcca

SEQ ID NO: 940101 - DNA, 25 bp, Mus musculus
ttctatgagcgtcgagttgccgttc

SEQ ID NO: 940102 - DNA, 25 bp, Mus musculus
ttctatgagcgtggagttgccgttc

SEQ ID NO: 940103 - DNA, 25 bp, Mus musculus
ttctatgatggtcaacacctgtccc

SEQ ID NO: 940104 - DNA, 25 bp, Mus musculus
ttctatgatggtgaacacctgtccc

SEQ ID NO: 940105 - DNA, 25 bp, Mus musculus
ttctatgcaactcctttcctaatga

SEQ ID NO: 940106 - DNA, 25 bp, Mus musculus
ttctatgcaactgctttcctaatga

SEQ ID NO: 940107 - DNA, 25 bp, Mus musculus
ttctatgcacacatgaagcgcaact

SEQ ID NO: 940108 - DNA, 25 bp, Mus musculus
ttctatgcacacttgaagcgcaact

SEQ ID NO: 940109 - DNA, 25 bp, Mus musculus
ttctatgcagagattcacctcctga

SEQ ID NO: 940110 - DNA, 25 bp, Mus musculus
ttctatgcagagtttcacctcctga

SEQ ID NO: 940111 - DNA, 25 bp, Mus musculus
ttctatgccctaaaccactatcaag

SEQ ID NO: 940112 - DNA, 25 bp, Mus musculus
ttctatgccctataccactatcaag

SEQ ID NO: 940113 - DNA, 25 bp, Mus musculus
ttctatgcctcaataaatggatttc

SEQ ID NO: 940114 - DNA, 25 bp, Mus musculus
ttctatgcctcattaaatggatttc

SEQ ID NO: 940115 - DNA, 25 bp, Mus musculus
ttctatgctagactgaccctatcac

SEQ ID NO: 940116 - DNA, 25 bp, Mus musculus
ttctatgctagagtgaccctatcac

SEQ ID NO: 940117 - DNA, 25 bp, Mus musculus
ttctatgctcaaccatgcttgtgta

SEQ ID NO: 940118 - DNA, 25 bp, Mus musculus
ttctatgctcaagcatgcttgtgta

SEQ ID NO: 940119 - DNA, 25 bp, Mus musculus
ttctatgctgccattggaaaccgtc

SEQ ID NO: 940120 - DNA, 25 bp, Mus musculus
ttctatgctgcctttggaaaccgtc

SEQ ID NO: 940121 - DNA, 25 bp, Mus musculus
ttctatgcttatctcccactgtgcc

SEQ ID NO: 940122 - DNA, 25 bp, Mus musculus
ttctatgcttatgtcccactgtgcc

SEQ ID NO: 940123 - DNA, 25 bp, Mus musculus
ttctatgcttgccaggttgcccaga

SEQ ID NO: 940124 - DNA, 25 bp, Mus musculus
ttctatgcttgcgaggttgcccaga

SEQ ID NO: 940125 - DNA, 25 bp, Mus musculus
ttctatggaacactgattcttttca

SEQ ID NO: 940126 - DNA, 25 bp, Mus musculus
ttctatggaacagtgattcttttca

SEQ ID NO: 940127 - DNA, 25 bp, Mus musculus
ttctatggccaacctcagggaatgc

SEQ ID NO: 940128 - DNA, 25 bp, Mus musculus
ttctatggccaagctcagggaatgc

SEQ ID NO: 940129 - DNA, 25 bp, Mus musculus
ttctatggccagcactctctgatga

SEQ ID NO: 940130 - DNA, 25 bp, Mus musculus
ttctatggccaggactctctgatga

SEQ ID NO: 940131 - DNA, 25 bp, Mus musculus
ttctatggctctccgatctatgggt

SEQ ID NO: 940132 - DNA, 25 bp, Mus musculus
ttctatggctctgcgatctatgggt

SEQ ID NO: 940133 - DNA, 25 bp, Mus musculus
ttctatggtcctctaggcaggttgt

SEQ ID NO: 940134 - DNA, 25 bp, Mus musculus
ttctatggtcctgtaggcaggttgt

SEQ ID NO: 940135 - DNA, 25 bp, Mus musculus
ttctatggttttagcattgccctgt

SEQ ID NO: 940136 - DNA, 25 bp, Mus musculus
ttctatggtttttgcattgccctgt

SEQ ID NO: 940137 - DNA, 25 bp, Mus musculus
ttctatgtaagcattgcagttgtac

SEQ ID NO: 940138 - DNA, 25 bp, Mus musculus
ttctatgtaagctttgcagttgtac

SEQ ID NO: 940139 - DNA, 25 bp, Mus musculus
ttctatgtaatccaagtgcctcctc

SEQ ID NO: 940140 - DNA, 25 bp, Mus musculus
ttctatgtaatcgaagtgcctcctc

SEQ ID NO: 940141 - DNA, 25 bp, Mus musculus
ttctatgtacgtccccgggaagcta

SEQ ID NO: 940142 - DNA, 25 bp, Mus musculus
ttctatgtacgtgcccgggaagcta

SEQ ID NO: 940143 - DNA, 25 bp, Mus musculus
ttctatgtaggcaaggaacgttcta

SEQ ID NO: 940144 - DNA, 25 bp, Mus musculus
ttctatgtaggctaggaacgttcta

SEQ ID NO: 940145 - DNA, 25 bp, Mus musculus
ttctatgtcatccacataacaccct

SEQ ID NO: 940146 - DNA, 25 bp, Mus musculus
ttctatgtcatcgacataacaccct

SEQ ID NO: 940147 - DNA, 25 bp, Mus musculus
ttctatgtcattctttgatccttat

SEQ ID NO: 940148 - DNA, 25 bp, Mus musculus
ttctatgtcattgtttgatccttat

SEQ ID NO: 940149 - DNA, 25 bp, Mus musculus
ttctatgtcctgacttcagttgtag

SEQ ID NO: 940150 - DNA, 25 bp, Mus musculus
ttctatgtcctgtcttcagttgtag

SEQ ID NO: 940151 - DNA, 25 bp, Mus musculus
ttctatgtgcaacgcgcctttgccc

SEQ ID NO: 940152 - DNA, 25 bp, Mus musculus
ttctatgtgcaaggcgcctttgccc

SEQ ID NO: 940153 - DNA, 25 bp, Mus musculus
ttctatgtgctgaagtgttttgcct

SEQ ID NO: 940154 - DNA, 25 bp, Mus musculus
ttctatgtgctgaatcccagagcct

SEQ ID NO: 940155 - DNA, 25 bp, Mus musculus
ttctatgtgctgacattctgcagaa

SEQ ID NO: 940156 - DNA, 25 bp, Mus musculus
ttctatgtgctgtagtgttttgcct

SEQ ID NO: 940157 - DNA, 25 bp, Mus musculus
ttctatgtgctgtatcccagagcct

SEQ ID NO: 940158 - DNA, 25 bp, Mus musculus
ttctatgtgctgtcattctgcagaa

SEQ ID NO: 940159 - DNA, 25 bp, Mus musculus
ttctatgtggccatgaatcgcaggg

SEQ ID NO: 940160 - DNA, 25 bp, Mus musculus
ttctatgtggccttgaatcgcaggg

SEQ ID NO: 940161 - DNA, 25 bp, Mus musculus
ttctatgtgttgattgtcatgttct

SEQ ID NO: 940162 - DNA, 25 bp, Mus musculus
ttctatgtgttgtttgtcatgttct

SEQ ID NO: 940163 - DNA, 25 bp, Mus musculus
ttctatgttccgagtttaaagaaga

SEQ ID NO: 940164 - DNA, 25 bp, Mus musculus
ttctatgttccgtgtttaaagaaga

SEQ ID NO: 940165 - DNA, 25 bp, Mus musculus
ttctatgttgtaatgaacggcctgg

SEQ ID NO: 940166 - DNA, 25 bp, Mus musculus
ttctatgttgtattgaacggcctgg

SEQ ID NO: 940167 - DNA, 25 bp, Mus musculus
ttctatgtttctccactgccaatgt

SEQ ID NO: 940168 - DNA, 25 bp, Mus musculus
ttctatgtttctgcactgccaatgt

SEQ ID NO: 940169 - DNA, 25 bp, Mus musculus
ttctattaacccacgccataacaat

SEQ ID NO: 940170 - DNA, 25 bp, Mus musculus
ttctattaaccctcgccataacaat

SEQ ID NO: 940171 - DNA, 25 bp, Mus musculus
ttctattaccttcgtcctcaccttt

SEQ ID NO: 940172 - DNA, 25 bp, Mus musculus
ttctattaccttggtcctcaccttt

SEQ ID NO: 940173 - DNA, 25 bp, Mus musculus
ttctattactataatcacatgacca

SEQ ID NO: 940174 - DNA, 25 bp, Mus musculus
ttctattactattatcacatgacca

SEQ ID NO: 940175 - DNA, 25 bp, Mus musculus
ttctattactttcctagcttttcct

SEQ ID NO: 940176 - DNA, 25 bp, Mus musculus
ttctattactttgctagcttttcct

SEQ ID NO: 940177 - DNA, 25 bp, Mus musculus
ttctattagcagacaccagtgggtc

SEQ ID NO: 940178 - DNA, 25 bp, Mus musculus
ttctattagcagtcaccagtgggtc

SEQ ID NO: 940179 - DNA, 25 bp, Mus musculus
ttctattagttcctagggctgggct

SEQ ID NO: 940180 - DNA, 25 bp, Mus musculus
ttctattagttcgtagggctgggct

SEQ ID NO: 940181 - DNA, 25 bp, Mus musculus
ttctattatccgactgtttgaccct

SEQ ID NO: 940182 - DNA, 25 bp, Mus musculus
ttctattatccgtctgtttgaccct

SEQ ID NO: 940183 - DNA, 25 bp, Mus musculus
ttctattctacacactggaactttg

SEQ ID NO: 940184 - DNA, 25 bp, Mus musculus
ttctattctacagactggaactttg

SEQ ID NO: 940185 - DNA, 25 bp, Mus musculus
ttctattctcttatgtgctgtggtg

SEQ ID NO: 940186 - DNA, 25 bp, Mus musculus
ttctattctcttttgtgctgtggtg

SEQ ID NO: 940187 - DNA, 25 bp, Mus musculus
ttctattctgtacagctttgccttt

SEQ ID NO: 940188 - DNA, 25 bp, Mus musculus
ttctattctgtagagctttgccttt

SEQ ID NO: 940189 - DNA, 25 bp, Mus musculus
ttctattcttaaactacaggctgta

SEQ ID NO: 940190 - DNA, 25 bp, Mus musculus
ttctattcttaatctacaggctgta

SEQ ID NO: 940191 - DNA, 25 bp, Mus musculus
ttctattcttttacagatccagttg

SEQ ID NO: 940192 - DNA, 25 bp, Mus musculus
ttctattctttttcagatccagttg

SEQ ID NO: 940193 - DNA, 25 bp, Mus musculus
ttctattgacccagagaaggcaccc

SEQ ID NO: 940194 - DNA, 25 bp, Mus musculus
ttctattgaccctgagaaggcaccc

SEQ ID NO: 940195 - DNA, 25 bp, Mus musculus
ttctattgcattccagcaggagcta

SEQ ID NO: 940196 - DNA, 25 bp, Mus musculus
ttctattgcattgcagcaggagcta

SEQ ID NO: 940197 - DNA, 25 bp, Mus musculus
ttctattgcgatcaaccctctttta

SEQ ID NO: 940198 - DNA, 25 bp, Mus musculus
ttctattgcgatgaaccctctttta

SEQ ID NO: 940199 - DNA, 25 bp, Mus musculus
ttctattgcttaagcagtgccccag

SEQ ID NO: 940200 - DNA, 25 bp, Mus musculus
ttctattgcttatgcagtgccccag

SEQ ID NO: 940201 - DNA, 25 bp, Mus musculus
ttctattggtctagtctatccctcc

SEQ ID NO: 940202 - DNA, 25 bp, Mus musculus
ttctattggtcttgtctatccctcc

SEQ ID NO: 940203 - DNA, 25 bp, Mus musculus
ttctatttaccaaggattcctgtat

SEQ ID NO: 940204 - DNA, 25 bp, Mus musculus
ttctatttaccatggattcctgtat

SEQ ID NO: 940205 - DNA, 25 bp, Mus musculus
ttctatttactcaaggcatatggca

SEQ ID NO: 940206 - DNA, 25 bp, Mus musculus
ttctatttactctaggcatatggca

SEQ ID NO: 940207 - DNA, 25 bp, Mus musculus
ttctatttcattcctttctgctaat

SEQ ID NO: 940208 - DNA, 25 bp, Mus musculus
ttctatttcattgctttctgctaat

SEQ ID NO: 940209 - DNA, 25 bp, Mus musculus
ttctatttccagagggacagtgaag

SEQ ID NO: 940210 - DNA, 25 bp, Mus musculus
ttctatttccagtgggacagtgaag

SEQ ID NO: 940211 - DNA, 25 bp, Mus musculus
ttctatttctaccaccggtctcctg

SEQ ID NO: 940212 - DNA, 25 bp, Mus musculus
ttctatttctacgaccggtctcctg

SEQ ID NO: 940213 - DNA, 25 bp, Mus musculus
ttctatttctatccttcaccctttg

SEQ ID NO: 940214 - DNA, 25 bp, Mus musculus
ttctatttctatgcttcaccctttg

SEQ ID NO: 940215 - DNA, 25 bp, Mus musculus
ttctatttctcgctagaccccagac

SEQ ID NO: 940216 - DNA, 25 bp, Mus musculus
ttctatttctcggtagaccccagac

SEQ ID NO: 940217 - DNA, 25 bp, Mus musculus
ttctatttcttgaaagtagccatat

SEQ ID NO: 940218 - DNA, 25 bp, Mus musculus
ttctatttcttgtaagtagccatat

SEQ ID NO: 940219 - DNA, 25 bp, Mus musculus
ttctatttctttcatagtctcccca

SEQ ID NO: 940220 - DNA, 25 bp, Mus musculus
ttctatttctttgatagtctcccca

SEQ ID NO: 940221 - DNA, 25 bp, Mus musculus
ttctatttgcaacaacacgaccctg

SEQ ID NO: 940222 - DNA, 25 bp, Mus musculus
ttctatttgcaagaacacgaccctg

SEQ ID NO: 940223 - DNA, 25 bp, Mus musculus
ttctatttgcatacctgttaggtac

SEQ ID NO: 940224 - DNA, 25 bp, Mus musculus
ttctatttgcattcctgttaggtac

SEQ ID NO: 940225 - DNA, 25 bp, Mus musculus
ttctatttgcccacagcagttttta

SEQ ID NO: 940226 - DNA, 25 bp, Mus musculus
ttctatttgccctcagcagttttta

SEQ ID NO: 940227 - DNA, 25 bp, Mus musculus
ttctatttgtccagccttgagccta

SEQ ID NO: 940228 - DNA, 25 bp, Mus musculus
ttctatttgtcctgccttgagccta

SEQ ID NO: 940229 - DNA, 25 bp, Mus musculus
ttctatttgtgaagcgtccccttaa

SEQ ID NO: 940230 - DNA, 25 bp, Mus musculus
ttctatttgtgatgcgtccccttaa

SEQ ID NO: 940231 - DNA, 25 bp, Mus musculus
ttctattttcaaatgtctctcccag

SEQ ID NO: 940232 - DNA, 25 bp, Mus musculus
ttctattttcaattgtctctcccag

SEQ ID NO: 940233 - DNA, 25 bp, Mus musculus
ttctcaaaatatcttctgttctggg

SEQ ID NO: 940234 - DNA, 25 bp, Mus musculus
ttctcaaaatatgttctgttctggg

SEQ ID NO: 940235 - DNA, 25 bp, Mus musculus
ttctcaaaatgcattgtaggttttt

SEQ ID NO: 940236 - DNA, 25 bp, Mus musculus
ttctcaaaatgctttgtaggttttt

SEQ ID NO: 940237 - DNA, 25 bp, Mus musculus
ttctcaaacactccattgtctccta

SEQ ID NO: 940238 - DNA, 25 bp, Mus musculus
ttctcaaacactgcattgtctccta

SEQ ID NO: 940239 - DNA, 25 bp, Mus musculus
ttctcaaagaagacctctatgccat

SEQ ID NO: 940240 - DNA, 25 bp, Mus musculus
ttctcaaagaagtcctctatgccat

SEQ ID NO: 940241 - DNA, 25 bp, Mus musculus
ttctcaaagcttccctgaattctac

SEQ ID NO: 940242 - DNA, 25 bp, Mus musculus
ttctcaaagcttgcctgaattctac

SEQ ID NO: 940243 - DNA, 25 bp, Mus musculus
ttctcaaatcttaaacctctctcac

SEQ ID NO: 940244 - DNA, 25 bp, Mus musculus
ttctcaaatctttaacctctctcac

SEQ ID NO: 940245 - DNA, 25 bp, Mus musculus
ttctcaaatgccactaccttgtgtc

SEQ ID NO: 940246 - DNA, 25 bp, Mus musculus
ttctcaaatgcctctaccttgtgtc

SEQ ID NO: 940247 - DNA, 25 bp, Mus musculus
ttctcaaatgctagttaggataaca

SEQ ID NO: 940248 - DNA, 25 bp, Mus musculus
ttctcaaatgcttgttaggataaca

SEQ ID NO: 940249 - DNA, 25 bp, Mus musculus
ttctcaaattgaactagggccaact

SEQ ID NO: 940250 - DNA, 25 bp, Mus musculus
ttctcaaattgatctagggccaact

SEQ ID NO: 940251 - DNA, 25 bp, Mus musculus
ttctcaacccaaaattttggcggat

SEQ ID NO: 940252 - DNA, 25 bp, Mus musculus
ttctcaacccaatattttggcggat

SEQ ID NO: 940253 - DNA, 25 bp, Mus musculus
ttctcaaccctacggcgtcagacat

SEQ ID NO: 940254 - DNA, 25 bp, Mus musculus
ttctcaaccctagggcgtcagacat

SEQ ID NO: 940255 - DNA, 25 bp, Mus musculus
ttctcaacctgcctaatgtttggtg

SEQ ID NO: 940256 - DNA, 25 bp, Mus musculus
ttctcaacctgcgtaatgtttggtg

SEQ ID NO: 940257 - DNA, 25 bp, Mus musculus
ttctcaactcctctgtagacagtat

SEQ ID NO: 940258 - DNA, 25 bp, Mus musculus
ttctcaactcctgtgtagacagtat

SEQ ID NO: 940259 - DNA, 25 bp, Mus musculus
ttctcaactttgctcacgatcattt

SEQ ID NO: 940260 - DNA, 25 bp, Mus musculus
ttctcaactttggtcacgatcattt

SEQ ID NO: 940261 - DNA, 25 bp, Mus musculus
ttctcaagaaggaacccgggctgta

SEQ ID NO: 940262 - DNA, 25 bp, Mus musculus
ttctcaagaaggtacccgggctgta

SEQ ID NO: 940263 - DNA, 25 bp, Mus musculus
ttctcaagaatgctccaggccctga

SEQ ID NO: 940264 - DNA, 25 bp, Mus musculus
ttctcaagaatggtccaggccctga

SEQ ID NO: 940265 - DNA, 25 bp, Mus musculus
ttctcaagagtaatgcatcctcccc

SEQ ID NO: 940266 - DNA, 25 bp, Mus musculus
ttctcaagagtattgcatcctcccc

SEQ ID NO: 940267 - DNA, 25 bp, Mus musculus
ttctcaagcatccaatgtcctcaga

SEQ ID NO: 940268 - DNA, 25 bp, Mus musculus
ttctcaagcatcgaatgtcctcaga

SEQ ID NO: 940269 - DNA, 25 bp, Mus musculus
ttctcaagcatgcacaggatccagg

SEQ ID NO: 940270 - DNA, 25 bp, Mus musculus
ttctcaagcatggacaggatccagg

SEQ ID NO: 940271 - DNA, 25 bp, Mus musculus
ttctcaagccccactgttttatgca

SEQ ID NO: 940272 - DNA, 25 bp, Mus musculus
ttctcaagcccctctgttttatgca

SEQ ID NO: 940273 - DNA, 25 bp, Mus musculus
ttctcaagctccacaataaagtttt

SEQ ID NO: 940274 - DNA, 25 bp, Mus musculus
ttctcaagctccataggcaaaacaa

SEQ ID NO: 940275 - DNA, 25 bp, Mus musculus
ttctcaagctcctcaataaagtttt

SEQ ID NO: 940276 - DNA, 25 bp, Mus musculus
ttctcaagctccttaggcaaaacaa

SEQ ID NO: 940277 - DNA, 25 bp, Mus musculus
ttctcaagggaaccacatcggagca

SEQ ID NO: 940278 - DNA, 25 bp, Mus musculus
ttctcaagggaagcacatcggagca

SEQ ID NO: 940279 - DNA, 25 bp, Mus musculus
ttctcaagtgacacaggtagtacct

SEQ ID NO: 940280 - DNA, 25 bp, Mus musculus
ttctcaagtgactcaggtagtacct

SEQ ID NO: 940281 - DNA, 25 bp, Mus musculus
ttctcaagtgcaccctctgaggaag

SEQ ID NO: 940282 - DNA, 25 bp, Mus musculus
ttctcaagtgcagcctctgaggaag

SEQ ID NO: 940283 - DNA, 25 bp, Mus musculus
ttctcaatacccatgcaatggcagt

SEQ ID NO: 940284 - DNA, 25 bp, Mus musculus
ttctcaatacccttgcaatggcagt

SEQ ID NO: 940285 - DNA, 25 bp, Mus musculus
ttctcaatcacaatagcttctttaa

SEQ ID NO: 940286 - DNA, 25 bp, Mus musculus
ttctcaatcacattagcttctttaa

SEQ ID NO: 940287 - DNA, 25 bp, Mus musculus
ttctcaatcccaactgctttagtag

SEQ ID NO: 940288 - DNA, 25 bp, Mus musculus
ttctcaatcccatctgctttagtag

SEQ ID NO: 940289 - DNA, 25 bp, Mus musculus
ttctcaatctcactgagcggcaggt

SEQ ID NO: 940290 - DNA, 25 bp, Mus musculus
ttctcaatctcagtgagcggcaggt

SEQ ID NO: 940291 - DNA, 25 bp, Mus musculus
ttctcaatgaaaccctacacaattt

SEQ ID NO: 940292 - DNA, 25 bp, Mus musculus
ttctcaatgaaagcctacacaattt

SEQ ID NO: 940293 - DNA, 25 bp, Mus musculus
ttctcaatggtcaacatccaggccg

SEQ ID NO: 940294 - DNA, 25 bp, Mus musculus
ttctcaatggtctacatccaggccg

SEQ ID NO: 940295 - DNA, 25 bp, Mus musculus
ttctcaatgtagaggccttggatat

SEQ ID NO: 940296 - DNA, 25 bp, Mus musculus
ttctcaatgtagtggccttggatat

SEQ ID NO: 940297 - DNA, 25 bp, Mus musculus
ttctcaatgtccacgagctcagtct

SEQ ID NO: 940298 - DNA, 25 bp, Mus musculus
ttctcaatgtcctcgagctcagtct

SEQ ID NO: 940299 - DNA, 25 bp, Mus musculus
ttctcaatgtctattgctttcagaa

SEQ ID NO: 940300 - DNA, 25 bp, Mus musculus
ttctcaatgtcttttgctttcagaa

SEQ ID NO: 940301 - DNA, 25 bp, Mus musculus
ttctcaatgtgccttctatctcaac

SEQ ID NO: 940302 - DNA, 25 bp, Mus musculus
ttctcaatgtgcgttctatctcaac

SEQ ID NO: 940303 - DNA, 25 bp, Mus musculus
ttctcacaagttcctcacactgaca

SEQ ID NO: 940304 - DNA, 25 bp, Mus musculus
ttctcacaagttgctcacactgaca

SEQ ID NO: 940305 - DNA, 25 bp, Mus musculus
ttctcacacctaattttgccctata

SEQ ID NO: 940306 - DNA, 25 bp, Mus musculus
ttctcacacctatttttgccctata

SEQ ID NO: 940307 - DNA, 25 bp, Mus musculus
ttctcacacctgcaaggaatcctta

SEQ ID NO: 940308 - DNA, 25 bp, Mus musculus
ttctcacacctggaaggaatcctta

SEQ ID NO: 940309 - DNA, 25 bp, Mus musculus
ttctcacacgtgctatttctttttc

SEQ ID NO: 940310 - DNA, 25 bp, Mus musculus
ttctcacacgtggtatttctttttc

SEQ ID NO: 940311 - DNA, 25 bp, Mus musculus
ttctcacactagctcagtacccatg

SEQ ID NO: 940312 - DNA, 25 bp, Mus musculus
ttctcacactaggtcagtacccatg

SEQ ID NO: 940313 - DNA, 25 bp, Mus musculus
ttctcacagaacagagactttgagt

SEQ ID NO: 940314 - DNA, 25 bp, Mus musculus
ttctcacagaactgagactttgagt

SEQ ID NO: 940315 - DNA, 25 bp, Mus musculus
ttctcacagaagcctgagtccacct

SEQ ID NO: 940316 - DNA, 25 bp, Mus musculus
ttctcacagaaggctgagtccacct

SEQ ID NO: 940317 - DNA, 25 bp, Mus musculus
ttctcacagagaaatcaccactatt

SEQ ID NO: 940318 - DNA, 25 bp, Mus musculus
ttctcacagagatatcaccactatt

SEQ ID NO: 940319 - DNA, 25 bp, Mus musculus
ttctcacaggctacaatctttccaa

SEQ ID NO: 940320 - DNA, 25 bp, Mus musculus
ttctcacaggcttcaatctttccaa

SEQ ID NO: 940321 - DNA, 25 bp, Mus musculus
ttctcacagtggaatatactctttt

SEQ ID NO: 940322 - DNA, 25 bp, Mus musculus
ttctcacagtggtatatactctttt

SEQ ID NO: 940323 - DNA, 25 bp, Mus musculus
ttctcacagttaccatggccgacag

SEQ ID NO: 940324 - DNA, 25 bp, Mus musculus
ttctcacagttagcatggccgacag

SEQ ID NO: 940325 - DNA, 25 bp, Mus musculus
ttctcacattgtacttccttgcata

SEQ ID NO: 940326 - DNA, 25 bp, Mus musculus
ttctcacattgttcttccttgcata

SEQ ID NO: 940327 - DNA, 25 bp, Mus musculus
ttctcaccaaagacccagagcgagc

SEQ ID NO: 940328 - DNA, 25 bp, Mus musculus
ttctcaccaaagtcccagagcgagc

SEQ ID NO: 940329 - DNA, 25 bp, Mus musculus
ttctcaccacgcagcgggaaccaaa

SEQ ID NO: 940330 - DNA, 25 bp, Mus musculus
ttctcaccacgctgcgggaaccaaa

SEQ ID NO: 940331 - DNA, 25 bp, Mus musculus
ttctcaccactaagaccctgaaggg

SEQ ID NO: 940332 - DNA, 25 bp, Mus musculus
ttctcaccactatgaccctgaaggg

SEQ ID NO: 940333 - DNA, 25 bp, Mus musculus
ttctcaccagttacagcactgtcaa

SEQ ID NO: 940334 - DNA, 25 bp, Mus musculus
ttctcaccagtttcagcactgtcaa

SEQ ID NO: 940335 - DNA, 25 bp, Mus musculus
ttctcacccaacaatgctgactctt

SEQ ID NO: 940336 - DNA, 25 bp, Mus musculus
ttctcacccaactatgctgactctt

SEQ ID NO: 940337 - DNA, 25 bp, Mus musculus
ttctcacccactcgcatctaaaatg

SEQ ID NO: 940338 - DNA, 25 bp, Mus musculus
ttctcacccactggcatctaaaatg

SEQ ID NO: 940339 - DNA, 25 bp, Mus musculus
ttctcaccccatctagagactagaa

SEQ ID NO: 940340 - DNA, 25 bp, Mus musculus
ttctcaccccatgtagagactagaa

SEQ ID NO: 940341 - DNA, 25 bp, Mus musculus
ttctcaccccgacttgtgtctgtct

SEQ ID NO: 940342 - DNA, 25 bp, Mus musculus
ttctcaccccgagttgtgtctgtct

SEQ ID NO: 940343 - DNA, 25 bp, Mus musculus
ttctcaccgaggacccatggaacag

SEQ ID NO: 940344 - DNA, 25 bp, Mus musculus
ttctcaccgaggtcccatggaacag

SEQ ID NO: 940345 - DNA, 25 bp, Mus musculus
ttctcacctactcctgcggataaat

SEQ ID NO: 940346 - DNA, 25 bp, Mus musculus
ttctcacctactgctgcggataaat

SEQ ID NO: 940347 - DNA, 25 bp, Mus musculus
ttctcacctataaggctgtaaggct

SEQ ID NO: 940348 - DNA, 25 bp, Mus musculus
ttctcacctatatggctgtaaggct

SEQ ID NO: 940349 - DNA, 25 bp, Mus musculus
ttctcacctgagacaaagcgtgtgt

SEQ ID NO: 940350 - DNA, 25 bp, Mus musculus
ttctcacctgagtcaaagcgtgtgt

SEQ ID NO: 940351 - DNA, 25 bp, Mus musculus
ttctcacctgtaatttcatttgctt

SEQ ID NO: 940352 - DNA, 25 bp, Mus musculus
ttctcacctgtaccagtggatttaa

SEQ ID NO: 940353 - DNA, 25 bp, Mus musculus
ttctcacctgtagcagtggatttaa

SEQ ID NO: 940354 - DNA, 25 bp, Mus musculus
ttctcacctgtattttcatttgctt

SEQ ID NO: 940355 - DNA, 25 bp, Mus musculus
ttctcaccttccctacttcagctag

SEQ ID NO: 940356 - DNA, 25 bp, Mus musculus
ttctcaccttccgtacttcagctag

SEQ ID NO: 940357 - DNA, 25 bp, Mus musculus
ttctcacgctaaccctgaagtatga

SEQ ID NO: 940358 - DNA, 25 bp, Mus musculus
ttctcacgctaagcctgaagtatga

SEQ ID NO: 940359 - DNA, 25 bp, Mus musculus
ttctcacgggcgagggtgccaccca

SEQ ID NO: 940360 - DNA, 25 bp, Mus musculus
ttctcacgggcgtgggtgccaccca

SEQ ID NO: 940361 - DNA, 25 bp, Mus musculus
ttctcactaacaaacagggcctctt

SEQ ID NO: 940362 - DNA, 25 bp, Mus musculus
ttctcactaacatacagggcctctt

SEQ ID NO: 940363 - DNA, 25 bp, Mus musculus
ttctcactatctcactcttgctgaa

SEQ ID NO: 940364 - DNA, 25 bp, Mus musculus
ttctcactatctgactcttgctgaa

SEQ ID NO: 940365 - DNA, 25 bp, Mus musculus
ttctcactatgtcttctcccaggag

SEQ ID NO: 940366 - DNA, 25 bp, Mus musculus
ttctcactatgtgttctcccaggag

SEQ ID NO: 940367 - DNA, 25 bp, Mus musculus
ttctcactgaaaccgatgggctcca

SEQ ID NO: 940368 - DNA, 25 bp, Mus musculus
ttctcactgaaagcgatgggctcca

SEQ ID NO: 940369 - DNA, 25 bp, Mus musculus
ttctcactgattcattggcaagcat

SEQ ID NO: 940370 - DNA, 25 bp, Mus musculus
ttctcactgattgattggcaagcat

SEQ ID NO: 940371 - DNA, 25 bp, Mus musculus
ttctcactgcctcttgtgtgttcct

SEQ ID NO: 940372 - DNA, 25 bp, Mus musculus
ttctcactgcctgttgtgtgttcct

SEQ ID NO: 940373 - DNA, 25 bp, Mus musculus
ttctcactggccaagttaagtgttt

SEQ ID NO: 940374 - DNA, 25 bp, Mus musculus
ttctcactggcctagttaagtgttt

SEQ ID NO: 940375 - DNA, 25 bp, Mus musculus
ttctcactgtgacgctgttacctaa

SEQ ID NO: 940376 - DNA, 25 bp, Mus musculus
ttctcactgtgaggctgttacctaa

SEQ ID NO: 940377 - DNA, 25 bp, Mus musculus
ttctcactgtttataccaaggtgga

SEQ ID NO: 940378 - DNA, 25 bp, Mus musculus
ttctcactgtttttaccaaggtgga

SEQ ID NO: 940379 - DNA, 25 bp, Mus musculus
ttctcacttctacttccactgttta

SEQ ID NO: 940380 - DNA, 25 bp, Mus musculus
ttctcacttctagttccactgttta

SEQ ID NO: 940381 - DNA, 25 bp, Mus musculus
ttctcactttaacaattcttttcta

SEQ ID NO: 940382 - DNA, 25 bp, Mus musculus
ttctcactttaagaattcttttcta

SEQ ID NO: 940383 - DNA, 25 bp, Mus musculus
ttctcactttagcactccagctagc

SEQ ID NO: 940384 - DNA, 25 bp, Mus musculus
ttctcactttaggactccagctagc

SEQ ID NO: 940385 - DNA, 25 bp, Mus musculus
ttctcactttcgatttccacatcaa

SEQ ID NO: 940386 - DNA, 25 bp, Mus musculus
ttctcactttcgttttccacatcaa

SEQ ID NO: 940387 - DNA, 25 bp, Mus musculus
ttctcactttgacaagcccctgaat

SEQ ID NO: 940388 - DNA, 25 bp, Mus musculus
ttctcactttgagaagcccctgaat

SEQ ID NO: 940389 - DNA, 25 bp, Mus musculus
ttctcagaaaccattcgacctgcag

SEQ ID NO: 940390 - DNA, 25 bp, Mus musculus
ttctcagaaacctttcgacctgcag

SEQ ID NO: 940391 - DNA, 25 bp, Mus musculus
ttctcagaaatcagctgtttgtgag

SEQ ID NO: 940392 - DNA, 25 bp, Mus musculus
ttctcagaaatctgctgtttgtgag

SEQ ID NO: 940393 - DNA, 25 bp, Mus musculus
ttctcagaacatcggcagtcatcct

SEQ ID NO: 940394 - DNA, 25 bp, Mus musculus
ttctcagaacatgggcagtcatcct

SEQ ID NO: 940395 - DNA, 25 bp, Mus musculus
ttctcagaactgacggcccttagag

SEQ ID NO: 940396 - DNA, 25 bp, Mus musculus
ttctcagaactgtcggcccttagag

SEQ ID NO: 940397 - DNA, 25 bp, Mus musculus
ttctcagaagccagttggacctggc

SEQ ID NO: 940398 - DNA, 25 bp, Mus musculus
ttctcagaagcctgttggacctggc

SEQ ID NO: 940399 - DNA, 25 bp, Mus musculus
ttctcagaccttcagctaggattat

SEQ ID NO: 940400 - DNA, 25 bp, Mus musculus
ttctcagaccttgagctaggattat

SEQ ID NO: 940401 - DNA, 25 bp, Mus musculus
ttctcagactctacaggtgcagttg

SEQ ID NO: 940402 - DNA, 25 bp, Mus musculus
ttctcagactcttcaggtgcagttg

SEQ ID NO: 940403 - DNA, 25 bp, Mus musculus
ttctcagactgaacctggaccatgt

SEQ ID NO: 940404 - DNA, 25 bp, Mus musculus
ttctcagactgacttacggacatta

SEQ ID NO: 940405 - DNA, 25 bp, Mus musculus
ttctcagactgagttacggacatta

SEQ ID NO: 940406 - DNA, 25 bp, Mus musculus
ttctcagactgatcctggaccatgt

SEQ ID NO: 940407 - DNA, 25 bp, Mus musculus
ttctcagactgtagctcaccaccag

SEQ ID NO: 940408 - DNA, 25 bp, Mus musculus
ttctcagactgttgctcaccaccag

SEQ ID NO: 940409 - DNA, 25 bp, Mus musculus
ttctcagagaccataaaaacaagtt

SEQ ID NO: 940410 - DNA, 25 bp, Mus musculus
ttctcagagaccttaaaaacaagtt

SEQ ID NO: 940411 - DNA, 25 bp, Mus musculus
ttctcagagcacaccagcatcaggg

SEQ ID NO: 940412 - DNA, 25 bp, Mus musculus
ttctcagagcactccagcatcaggg

SEQ ID NO: 940413 - DNA, 25 bp, Mus musculus
ttctcagaggacaccacgtacaagt

SEQ ID NO: 940414 - DNA, 25 bp, Mus musculus
ttctcagaggaccaatggaactcca

SEQ ID NO: 940415 - DNA, 25 bp, Mus musculus
ttctcagaggacgaatggaactcca

SEQ ID NO: 940416 - DNA, 25 bp, Mus musculus
ttctcagaggactccacgtacaagt

SEQ ID NO: 940417 - DNA, 25 bp, Mus musculus
ttctcagaggcaagggtggcgcctt

SEQ ID NO: 940418 - DNA, 25 bp, Mus musculus
ttctcagaggcatgggtggcgcctt

SEQ ID NO: 940419 - DNA, 25 bp, Mus musculus
ttctcagaggccactaacccgggag

SEQ ID NO: 940420 - DNA, 25 bp, Mus musculus
ttctcagaggcctctaacccgggag

SEQ ID NO: 940421 - DNA, 25 bp, Mus musculus
ttctcagagggcctgtgacgcctag

SEQ ID NO: 940422 - DNA, 25 bp, Mus musculus
ttctcagagggcgtgtgacgcctag

SEQ ID NO: 940423 - DNA, 25 bp, Mus musculus
ttctcagagggtaatattcagagct

SEQ ID NO: 940424 - DNA, 25 bp, Mus musculus
ttctcagagggttatattcagagct

SEQ ID NO: 940425 - DNA, 25 bp, Mus musculus
ttctcagagttcatatatgatactt

SEQ ID NO: 940426 - DNA, 25 bp, Mus musculus
ttctcagagttcttatatgatactt

SEQ ID NO: 940427 - DNA, 25 bp, Mus musculus
ttctcagagttgagtggtcctcacc

SEQ ID NO: 940428 - DNA, 25 bp, Mus musculus
ttctcagagttgtgtggtcctcacc

SEQ ID NO: 940429 - DNA, 25 bp, Mus musculus
ttctcagatctcacgtgttctttac

SEQ ID NO: 940430 - DNA, 25 bp, Mus musculus
ttctcagatctcctgggccctctag

SEQ ID NO: 940431 - DNA, 25 bp, Mus musculus
ttctcagatctcgtgggccctctag

SEQ ID NO: 940432 - DNA, 25 bp, Mus musculus
ttctcagatctctcgtgttctttac

SEQ ID NO: 940433 - DNA, 25 bp, Mus musculus
ttctcagatgcgctcacatgtttct

SEQ ID NO: 940434 - DNA, 25 bp, Mus musculus
ttctcagatgcggtcacatgtttct

SEQ ID NO: 940435 - DNA, 25 bp, Mus musculus
ttctcagatgctactggaatcaact

SEQ ID NO: 940436 - DNA, 25 bp, Mus musculus
ttctcagatgcttctggaatcaact

SEQ ID NO: 940437 - DNA, 25 bp, Mus musculus
ttctcagattttagcaggctcggat

SEQ ID NO: 940438 - DNA, 25 bp, Mus musculus
ttctcagatttttgcaggctcggat

SEQ ID NO: 940439 - DNA, 25 bp, Mus musculus
ttctcagcaaaacgttccgctgtgg

SEQ ID NO: 940440 - DNA, 25 bp, Mus musculus
ttctcagcaaaaggttccgctgtgg

SEQ ID NO: 940441 - DNA, 25 bp, Mus musculus
ttctcagcaccacaatccgaatatg

SEQ ID NO: 940442 - DNA, 25 bp, Mus musculus
ttctcagcaccagaatccgaatatg

SEQ ID NO: 940443 - DNA, 25 bp, Mus musculus
ttctcagcagaccatctttcatcct

SEQ ID NO: 940444 - DNA, 25 bp, Mus musculus
ttctcagcagacgatctttcatcct

SEQ ID NO: 940445 - DNA, 25 bp, Mus musculus
ttctcagcagctctctgtcaggcag

SEQ ID NO: 940446 - DNA, 25 bp, Mus musculus
ttctcagcagctgtctgtcaggcag

SEQ ID NO: 940447 - DNA, 25 bp, Mus musculus
ttctcagcataaacttatcccattg

SEQ ID NO: 940448 - DNA, 25 bp, Mus musculus
ttctcagcataatcttatcccattg

SEQ ID NO: 940449 - DNA, 25 bp, Mus musculus
ttctcagcatagactcagaggcctg

SEQ ID NO: 940450 - DNA, 25 bp, Mus musculus
ttctcagcatagtctcagaggcctg

SEQ ID NO: 940451 - DNA, 25 bp, Mus musculus
ttctcagcatctcacagtaccttct

SEQ ID NO: 940452 - DNA, 25 bp, Mus musculus
ttctcagcatctgacagtaccttct

SEQ ID NO: 940453 - DNA, 25 bp, Mus musculus
ttctcagcatgaaagtgaagggtct

SEQ ID NO: 940454 - DNA, 25 bp, Mus musculus
ttctcagcatgatagtgaagggtct

SEQ ID NO: 940455 - DNA, 25 bp, Mus musculus
ttctcagcattgaacttagcatata

SEQ ID NO: 940456 - DNA, 25 bp, Mus musculus
ttctcagcattgtacttagcatata

SEQ ID NO: 940457 - DNA, 25 bp, Mus musculus
ttctcagccctgaacttttatgttt

SEQ ID NO: 940458 - DNA, 25 bp, Mus musculus
ttctcagccctgtacttttatgttt

SEQ ID NO: 940459 - DNA, 25 bp, Mus musculus
ttctcagccgttaccctggaatcac

SEQ ID NO: 940460 - DNA, 25 bp, Mus musculus
ttctcagccgtttccctggaatcac

SEQ ID NO: 940461 - DNA, 25 bp, Mus musculus
ttctcagccttgactgtactgttga

SEQ ID NO: 940462 - DNA, 25 bp, Mus musculus
ttctcagccttgtctgtactgttga

SEQ ID NO: 940463 - DNA, 25 bp, Mus musculus
ttctcagctaccatttgcataccag

SEQ ID NO: 940464 - DNA, 25 bp, Mus musculus
ttctcagctaccttttgcataccag

SEQ ID NO: 940465 - DNA, 25 bp, Mus musculus
ttctcagctccactctgaagtttcc

SEQ ID NO: 940466 - DNA, 25 bp, Mus musculus
ttctcagctccagtctgaagtttcc

SEQ ID NO: 940467 - DNA, 25 bp, Mus musculus
ttctcagctccccaatgaacaatga

SEQ ID NO: 940468 - DNA, 25 bp, Mus musculus
ttctcagctcccgaatgaacaatga

SEQ ID NO: 940469 - DNA, 25 bp, Mus musculus
ttctcagctggaaagggcttcacag

SEQ ID NO: 940470 - DNA, 25 bp, Mus musculus
ttctcagctggatagggcttcacag

SEQ ID NO: 940471 - DNA, 25 bp, Mus musculus
ttctcagcttgaattttaaacatca

SEQ ID NO: 940472 - DNA, 25 bp, Mus musculus
ttctcagcttgatttttaaacatca

SEQ ID NO: 940473 - DNA, 25 bp, Mus musculus
ttctcaggcaacaagtgcgggtcct

SEQ ID NO: 940474 - DNA, 25 bp, Mus musculus
ttctcaggcaactagtgcgggtcct

SEQ ID NO: 940475 - DNA, 25 bp, Mus musculus
ttctcaggcccactaggtgagtgct

SEQ ID NO: 940476 - DNA, 25 bp, Mus musculus
ttctcaggcccagtaggtgagtgct

SEQ ID NO: 940477 - DNA, 25 bp, Mus musculus
ttctcaggcctaaggaagccctcct

SEQ ID NO: 940478 - DNA, 25 bp, Mus musculus
ttctcaggcctatggaagccctcct

SEQ ID NO: 940479 - DNA, 25 bp, Mus musculus
ttctcaggccttcgaacttgaaccg

SEQ ID NO: 940480 - DNA, 25 bp, Mus musculus
ttctcaggccttggaacttgaaccg

SEQ ID NO: 940481 - DNA, 25 bp, Mus musculus
ttctcaggcgaacagctgccgtttg

SEQ ID NO: 940482 - DNA, 25 bp, Mus musculus
ttctcaggcgaagagctgccgtttg

SEQ ID NO: 940483 - DNA, 25 bp, Mus musculus
ttctcaggctcacagaactggagtc

SEQ ID NO: 940484 - DNA, 25 bp, Mus musculus
ttctcaggctcagagaactggagtc

SEQ ID NO: 940485 - DNA, 25 bp, Mus musculus
ttctcaggctccagaatttatactg

SEQ ID NO: 940486 - DNA, 25 bp, Mus musculus
ttctcaggctcctgaatttatactg

SEQ ID NO: 940487 - DNA, 25 bp, Mus musculus
ttctcaggctgtcttgcccaagatg

SEQ ID NO: 940488 - DNA, 25 bp, Mus musculus
ttctcaggctgtgttgcccaagatg

SEQ ID NO: 940489 - DNA, 25 bp, Mus musculus
ttctcaggcttcaggatttggtgga

SEQ ID NO: 940490 - DNA, 25 bp, Mus musculus
ttctcaggcttctggatttggtgga

SEQ ID NO: 940491 - DNA, 25 bp, Mus musculus
ttctcagggcctcctcagtgggttt

SEQ ID NO: 940492 - DNA, 25 bp, Mus musculus
ttctcagggcctgctcagtgggttt

SEQ ID NO: 940493 - DNA, 25 bp, Mus musculus
ttctcagggctccacctctttcgag

SEQ ID NO: 940494 - DNA, 25 bp, Mus musculus
ttctcagggctcgacctctttcgag

SEQ ID NO: 940495 - DNA, 25 bp, Mus musculus
ttctcaggtttcagctgatcttgca

SEQ ID NO: 940496 - DNA, 25 bp, Mus musculus
ttctcaggtttctgctgatcttgca

SEQ ID NO: 940497 - DNA, 25 bp, Mus musculus
ttctcaggtttgacgtgggctagcc

SEQ ID NO: 940498 - DNA, 25 bp, Mus musculus
ttctcaggtttgtcgtgggctagcc

SEQ ID NO: 940499 - DNA, 25 bp, Mus musculus
ttctcagtacagaaacgatgtgccc

SEQ ID NO: 940500 - DNA, 25 bp, Mus musculus
ttctcagtacagtaacgatgtgccc

SEQ ID NO: 940501 - DNA, 25 bp, Mus musculus
ttctcagtactccttccacaggtta

SEQ ID NO: 940502 - DNA, 25 bp, Mus musculus
ttctcagtactcgttccacaggtta

SEQ ID NO: 940503 - DNA, 25 bp, Mus musculus
ttctcagtagccaggaagtgacaga

SEQ ID NO: 940504 - DNA, 25 bp, Mus musculus
ttctcagtagcctggaagtgacaga

SEQ ID NO: 940505 - DNA, 25 bp, Mus musculus
ttctcagtattgatctttttgctta

SEQ ID NO: 940506 - DNA, 25 bp, Mus musculus
ttctcagtattgttctttttgctta

SEQ ID NO: 940507 - DNA, 25 bp, Mus musculus
ttctcagtccagaacattttgtttc

SEQ ID NO: 940508 - DNA, 25 bp, Mus musculus
ttctcagtccagtacattttgtttc

SEQ ID NO: 940509 - DNA, 25 bp, Mus musculus
ttctcagtcctgagattgtccgggt

SEQ ID NO: 940510 - DNA, 25 bp, Mus musculus
ttctcagtcctgtgattgtccgggt

SEQ ID NO: 940511 - DNA, 25 bp, Mus musculus
ttctcagtcgcaaggtgaatcacaa

SEQ ID NO: 940512 - DNA, 25 bp, Mus musculus
ttctcagtcgcatggtgaatcacaa

SEQ ID NO: 940513 - DNA, 25 bp, Mus musculus
ttctcagtctttcggattggtggaa

SEQ ID NO: 940514 - DNA, 25 bp, Mus musculus
ttctcagtctttgggattggtggaa

SEQ ID NO: 940515 - DNA, 25 bp, Mus musculus
ttctcagtgaaaatgttggctaggc

SEQ ID NO: 940516 - DNA, 25 bp, Mus musculus
ttctcagtgaaattgttggctaggc

SEQ ID NO: 940517 - DNA, 25 bp, Mus musculus
ttctcagtgactcagggccactgtc

SEQ ID NO: 940518 - DNA, 25 bp, Mus musculus
ttctcagtgactcttagccacatgg

SEQ ID NO: 940519 - DNA, 25 bp, Mus musculus
ttctcagtgactgagggccactgtc

SEQ ID NO: 940520 - DNA, 25 bp, Mus musculus
ttctcagtgactgttagccacatgg

SEQ ID NO: 940521 - DNA, 25 bp, Mus musculus
ttctcagtgatcagtgttgaatgga

SEQ ID NO: 940522 - DNA, 25 bp, Mus musculus
ttctcagtgatctgtgttgaatgga

SEQ ID NO: 940523 - DNA, 25 bp, Mus musculus
ttctcagtgcagcagggcttagtgt

SEQ ID NO: 940524 - DNA, 25 bp, Mus musculus
ttctcagtgcaggagggcttagtgt

SEQ ID NO: 940525 - DNA, 25 bp, Mus musculus
ttctcagtgctcctagagcctcaag

SEQ ID NO: 940526 - DNA, 25 bp, Mus musculus
ttctcagtgctcgtagagcctcaag

SEQ ID NO: 940527 - DNA, 25 bp, Mus musculus
ttctcagtggacaataaacgacttc

SEQ ID NO: 940528 - DNA, 25 bp, Mus musculus
ttctcagtggactataaacgacttc

SEQ ID NO: 940529 - DNA, 25 bp, Mus musculus
ttctcagtggcacttttcctcttaa

SEQ ID NO: 940530 - DNA, 25 bp, Mus musculus
ttctcagtggcagttttcctcttaa

SEQ ID NO: 940531 - DNA, 25 bp, Mus musculus
ttctcagtgggtcctttgttttaag

SEQ ID NO: 940532 - DNA, 25 bp, Mus musculus
ttctcagtgggtctgcctgtgacca

SEQ ID NO: 940533 - DNA, 25 bp, Mus musculus
ttctcagtgggtgctttgttttaag

SEQ ID NO: 940534 - DNA, 25 bp, Mus musculus
ttctcagtgggtgtgcctgtgacca

SEQ ID NO: 940535 - DNA, 25 bp, Mus musculus
ttctcagtgtatacaccagctccct

SEQ ID NO: 940536 - DNA, 25 bp, Mus musculus
ttctcagtgtatagtatacgccctt

SEQ ID NO: 940537 - DNA, 25 bp, Mus musculus
ttctcagtgtattcaccagctccct

SEQ ID NO: 940538 - DNA, 25 bp, Mus musculus
ttctcagtgtattgtatacgccctt

SEQ ID NO: 940539 - DNA, 25 bp, Mus musculus
ttctcagtgtccacattggttgagt

SEQ ID NO: 940540 - DNA, 25 bp, Mus musculus
ttctcagtgtcctcattggttgagt

SEQ ID NO: 940541 - DNA, 25 bp, Mus musculus
ttctcagtgtggatgtcatgccgtt

SEQ ID NO: 940542 - DNA, 25 bp, Mus musculus
ttctcagtgtggttgtcatgccgtt

SEQ ID NO: 940543 - DNA, 25 bp, Mus musculus
ttctcagtgtgtatctgtccagcca

SEQ ID NO: 940544 - DNA, 25 bp, Mus musculus
ttctcagtgtgtttctgtccagcca

SEQ ID NO: 940545 - DNA, 25 bp, Mus musculus
ttctcagttaaaccacagattgcca

SEQ ID NO: 940546 - DNA, 25 bp, Mus musculus
ttctcagttaaagcacagattgcca

SEQ ID NO: 940547 - DNA, 25 bp, Mus musculus
ttctcagttaccacaaagccagctt

SEQ ID NO: 940548 - DNA, 25 bp, Mus musculus
ttctcagttacctcaaagccagctt

SEQ ID NO: 940549 - DNA, 25 bp, Mus musculus
ttctcagttagaatgctccttgcca

SEQ ID NO: 940550 - DNA, 25 bp, Mus musculus
ttctcagttagattgctccttgcca

SEQ ID NO: 940551 - DNA, 25 bp, Mus musculus
ttctcagttatcaggccagagcact

SEQ ID NO: 940552 - DNA, 25 bp, Mus musculus
ttctcagttatctggccagagcact

SEQ ID NO: 940553 - DNA, 25 bp, Mus musculus
ttctcagttctcaacagtaaactat

SEQ ID NO: 940554 - DNA, 25 bp, Mus musculus
ttctcagttctctacagtaaactat

SEQ ID NO: 940555 - DNA, 25 bp, Mus musculus
ttctcagttctgctgaaaatgtttc

SEQ ID NO: 940556 - DNA, 25 bp, Mus musculus
ttctcagttctggtgaaaatgtttc

SEQ ID NO: 940557 - DNA, 25 bp, Mus musculus
ttctcagttgccaaaacgccccagt

SEQ ID NO: 940558 - DNA, 25 bp, Mus musculus
ttctcagttgccctaatcatatttc

SEQ ID NO: 940559 - DNA, 25 bp, Mus musculus
ttctcagttgccgtaatcatatttc

SEQ ID NO: 940560 - DNA, 25 bp, Mus musculus
ttctcagttgcctaaacgccccagt

SEQ ID NO: 940561 - DNA, 25 bp, Mus musculus
ttctcagtttccattccatgaaaaa

SEQ ID NO: 940562 - DNA, 25 bp, Mus musculus
ttctcagtttccctccttctacagg

SEQ ID NO: 940563 - DNA, 25 bp, Mus musculus
ttctcagtttccgtccttctacagg

SEQ ID NO: 940564 - DNA, 25 bp, Mus musculus
ttctcagtttcctttccatgaaaaa

SEQ ID NO: 940565 - DNA, 25 bp, Mus musculus
ttctcagtttgtatcttgatcacag

SEQ ID NO: 940566 - DNA, 25 bp, Mus musculus
ttctcagtttgtttcttgatcacag

SEQ ID NO: 940567 - DNA, 25 bp, Mus musculus
ttctcagtttttagggtcagcaagc

SEQ ID NO: 940568 - DNA, 25 bp, Mus musculus
ttctcagttttttgggtcagcaagc

SEQ ID NO: 940569 - DNA, 25 bp, Mus musculus
ttctcataaagaatttacctggctt

SEQ ID NO: 940570 - DNA, 25 bp, Mus musculus
ttctcataaagattttacctggctt

SEQ ID NO: 940571 - DNA, 25 bp, Mus musculus
ttctcataatttctgctcaggcagc

SEQ ID NO: 940572 - DNA, 25 bp, Mus musculus
ttctcataatttgtgctcaggcagc

SEQ ID NO: 940573 - DNA, 25 bp, Mus musculus
ttctcatagcaaaccatgaattgga

SEQ ID NO: 940574 - DNA, 25 bp, Mus musculus
ttctcatagcaatccatgaattgga

SEQ ID NO: 940575 - DNA, 25 bp, Mus musculus
ttctcatatgtgaggtgtcatagta

SEQ ID NO: 940576 - DNA, 25 bp, Mus musculus
ttctcatatgtgtggtgtcatagta

SEQ ID NO: 940577 - DNA, 25 bp, Mus musculus
ttctcatattgcaacgcctccgagg

SEQ ID NO: 940578 - DNA, 25 bp, Mus musculus
ttctcatattgctacgcctccgagg

SEQ ID NO: 940579 - DNA, 25 bp, Mus musculus
ttctcatcacttctctatgtctcta

SEQ ID NO: 940580 - DNA, 25 bp, Mus musculus
ttctcatcacttgtctatgtctcta

SEQ ID NO: 940581 - DNA, 25 bp, Mus musculus
ttctcatcagctcagtactggcgga

SEQ ID NO: 940582 - DNA, 25 bp, Mus musculus
ttctcatcagctcttgtagaagttc

SEQ ID NO: 940583 - DNA, 25 bp, Mus musculus
ttctcatcagctgagtactggcgga

SEQ ID NO: 940584 - DNA, 25 bp, Mus musculus
ttctcatcagctgttgtagaagttc

SEQ ID NO: 940585 - DNA, 25 bp, Mus musculus
ttctcatcatcaccgccagattttg

SEQ ID NO: 940586 - DNA, 25 bp, Mus musculus
ttctcatcatcagcgccagattttg

SEQ ID NO: 940587 - DNA, 25 bp, Mus musculus
ttctcatcatccagcaaaccgaggg

SEQ ID NO: 940588 - DNA, 25 bp, Mus musculus
ttctcatcatcctgcaaaccgaggg

SEQ ID NO: 940589 - DNA, 25 bp, Mus musculus
ttctcatcatgacccttcaatcctg

SEQ ID NO: 940590 - DNA, 25 bp, Mus musculus
ttctcatcatgagccttcaatcctg

SEQ ID NO: 940591 - DNA, 25 bp, Mus musculus
ttctcatcattaacactcttcatca

SEQ ID NO: 940592 - DNA, 25 bp, Mus musculus
ttctcatcattatcactcttcatca

SEQ ID NO: 940593 - DNA, 25 bp, Mus musculus
ttctcatccaaaccagcatagtggt

SEQ ID NO: 940594 - DNA, 25 bp, Mus musculus
ttctcatccaaagcagcatagtggt

SEQ ID NO: 940595 - DNA, 25 bp, Mus musculus
ttctcatccaccatggcacactgta

SEQ ID NO: 940596 - DNA, 25 bp, Mus musculus
ttctcatccaccttggcacactgta

SEQ ID NO: 940597 - DNA, 25 bp, Mus musculus
ttctcatccatgaatggctccattt

SEQ ID NO: 940598 - DNA, 25 bp, Mus musculus
ttctcatccatgtatggctccattt

SEQ ID NO: 940599 - DNA, 25 bp, Mus musculus
ttctcatccccaagtttagctgaca

SEQ ID NO: 940600 - DNA, 25 bp, Mus musculus
ttctcatccccatgtttagctgaca

SEQ ID NO: 940601 - DNA, 25 bp, Mus musculus
ttctcatcccgtctctagtgtgagc

SEQ ID NO: 940602 - DNA, 25 bp, Mus musculus
ttctcatcccgtgtctagtgtgagc

SEQ ID NO: 940603 - DNA, 25 bp, Mus musculus
ttctcatccctgaaactggaagctt

SEQ ID NO: 940604 - DNA, 25 bp, Mus musculus
ttctcatccctgtaactggaagctt

SEQ ID NO: 940605 - DNA, 25 bp, Mus musculus
ttctcatcctacagctggtttggta

SEQ ID NO: 940606 - DNA, 25 bp, Mus musculus
ttctcatcctactgctggtttggta

SEQ ID NO: 940607 - DNA, 25 bp, Mus musculus
ttctcatcctcacaaagtcaccggg

SEQ ID NO: 940608 - DNA, 25 bp, Mus musculus
ttctcatcctcagaaagtcaccggg

SEQ ID NO: 940609 - DNA, 25 bp, Mus musculus
ttctcatcctcgaggaagactgggc

SEQ ID NO: 940610 - DNA, 25 bp, Mus musculus
ttctcatcctcgcagttgtgtatag

SEQ ID NO: 940611 - DNA, 25 bp, Mus musculus
ttctcatcctcggagttgtgtatag

SEQ ID NO: 940612 - DNA, 25 bp, Mus musculus
ttctcatcctcgtggaagactgggc

SEQ ID NO: 940613 - DNA, 25 bp, Mus musculus
ttctcatcctctcctatagttttga

SEQ ID NO: 940614 - DNA, 25 bp, Mus musculus
ttctcatcctctgctatagttttga

SEQ ID NO: 940615 - DNA, 25 bp, Mus musculus
ttctcatcctgacgcaaactcacat

SEQ ID NO: 940616 - DNA, 25 bp, Mus musculus
ttctcatcctgaggcaaactcacat

SEQ ID NO: 940617 - DNA, 25 bp, Mus musculus
ttctcatcctggagctgagcacagt

SEQ ID NO: 940618 - DNA, 25 bp, Mus musculus
ttctcatcctggtgctgagcacagt

SEQ ID NO: 940619 - DNA, 25 bp, Mus musculus
ttctcatcgtttatgcagtggtggc

SEQ ID NO: 940620 - DNA, 25 bp, Mus musculus
ttctcatcgtttttgcagtggtggc

SEQ ID NO: 940621 - DNA, 25 bp, Mus musculus
ttctcatctaggaagtcgcagcgac

SEQ ID NO: 940622 - DNA, 25 bp, Mus musculus
ttctcatctaggtagtcgcagcgac

SEQ ID NO: 940623 - DNA, 25 bp, Mus musculus
ttctcatctctactttgcacagggc

SEQ ID NO: 940624 - DNA, 25 bp, Mus musculus
ttctcatctctagtttgcacagggc

SEQ ID NO: 940625 - DNA, 25 bp, Mus musculus
ttctcatctctcacgtacatgtaaa

SEQ ID NO: 940626 - DNA, 25 bp, Mus musculus
ttctcatctctcagttatctgttct

SEQ ID NO: 940627 - DNA, 25 bp, Mus musculus
ttctcatctctctcgtacatgtaaa

SEQ ID NO: 940628 - DNA, 25 bp, Mus musculus
ttctcatctctctgttatctgttct

SEQ ID NO: 940629 - DNA, 25 bp, Mus musculus
ttctcatctgaaccccgagtgtgac

SEQ ID NO: 940630 - DNA, 25 bp, Mus musculus
ttctcatctgaagcccgagtgtgac

SEQ ID NO: 940631 - DNA, 25 bp, Mus musculus
ttctcatctgctctgaggcacgaga

SEQ ID NO: 940632 - DNA, 25 bp, Mus musculus
ttctcatctgctgtgaggcacgaga

SEQ ID NO: 940633 - DNA, 25 bp, Mus musculus
ttctcatctttcctttgatctggat

SEQ ID NO: 940634 - DNA, 25 bp, Mus musculus
ttctcatctttcgtttgatctggat

SEQ ID NO: 940635 - DNA, 25 bp, Mus musculus
ttctcatgacagagatacccaggat

SEQ ID NO: 940636 - DNA, 25 bp, Mus musculus
ttctcatgacagtgatacccaggat

SEQ ID NO: 940637 - DNA, 25 bp, Mus musculus
ttctcatgatgcaaaggacttcctt

SEQ ID NO: 940638 - DNA, 25 bp, Mus musculus
ttctcatgatgctaaggacttcctt

SEQ ID NO: 940639 - DNA, 25 bp, Mus musculus
ttctcatgcacaccagggccttggg

SEQ ID NO: 940640 - DNA, 25 bp, Mus musculus
ttctcatgcacagcagggccttggg

SEQ ID NO: 940641 - DNA, 25 bp, Mus musculus
ttctcatgcccaccggaccaaggat

SEQ ID NO: 940642 - DNA, 25 bp, Mus musculus
ttctcatgcccagcggaccaaggat

SEQ ID NO: 940643 - DNA, 25 bp, Mus musculus
ttctcatgcgggaggttttgtggat

SEQ ID NO: 940644 - DNA, 25 bp, Mus musculus
ttctcatgcgggtggttttgtggat

SEQ ID NO: 940645 - DNA, 25 bp, Mus musculus
ttctcatgctaacaattgctttaaa

SEQ ID NO: 940646 - DNA, 25 bp, Mus musculus
ttctcatgctaagaattgctttaaa

SEQ ID NO: 940647 - DNA, 25 bp, Mus musculus
ttctcatgctatactttgaaatcat

SEQ ID NO: 940648 - DNA, 25 bp, Mus musculus
ttctcatgctattctttgaaatcat

SEQ ID NO: 940649 - DNA, 25 bp, Mus musculus
ttctcatgctcaatgggttaccgac

SEQ ID NO: 940650 - DNA, 25 bp, Mus musculus
ttctcatgctcattgggttaccgac

SEQ ID NO: 940651 - DNA, 25 bp, Mus musculus
ttctcatgctctaatgtaaatgacc

SEQ ID NO: 940652 - DNA, 25 bp, Mus musculus
ttctcatgctcttatgtaaatgacc

SEQ ID NO: 940653 - DNA, 25 bp, Mus musculus
ttctcatgctgacactccggagagg

SEQ ID NO: 940654 - DNA, 25 bp, Mus musculus
ttctcatgctgagactccggagagg

SEQ ID NO: 940655 - DNA, 25 bp, Mus musculus
ttctcatggaaacgtgcccctatta

SEQ ID NO: 940656 - DNA, 25 bp, Mus musculus
ttctcatggaaaggtgcccctatta

SEQ ID NO: 940657 - DNA, 25 bp, Mus musculus
ttctcatggaccaatggagtgagac

SEQ ID NO: 940658 - DNA, 25 bp, Mus musculus
ttctcatggacctatggagtgagac

SEQ ID NO: 940659 - DNA, 25 bp, Mus musculus
ttctcatggagcactgatcgacctc

SEQ ID NO: 940660 - DNA, 25 bp, Mus musculus
ttctcatggagctctgatcgacctc

SEQ ID NO: 940661 - DNA, 25 bp, Mus musculus
ttctcatggcctattgaaacctcaa

SEQ ID NO: 940662 - DNA, 25 bp, Mus musculus
ttctcatggccttttgaaacctcaa

SEQ ID NO: 940663 - DNA, 25 bp, Mus musculus
ttctcatggctgaaggtagttgcta

SEQ ID NO: 940664 - DNA, 25 bp, Mus musculus
ttctcatggctgtaggtagttgcta

SEQ ID NO: 940665 - DNA, 25 bp, Mus musculus
ttctcatgggcactttttcttgctt

SEQ ID NO: 940666 - DNA, 25 bp, Mus musculus
ttctcatgggcagtttttcttgctt

SEQ ID NO: 940667 - DNA, 25 bp, Mus musculus
ttctcatgggctaatttgttcctcc

SEQ ID NO: 940668 - DNA, 25 bp, Mus musculus
ttctcatgggcttatttgttcctcc

SEQ ID NO: 940669 - DNA, 25 bp, Mus musculus
ttctcatgtacacggttcgctgatc

SEQ ID NO: 940670 - DNA, 25 bp, Mus musculus
ttctcatgtacagggttcgctgatc

SEQ ID NO: 940671 - DNA, 25 bp, Mus musculus
ttctcatgttcgcacaccagggtcc

SEQ ID NO: 940672 - DNA, 25 bp, Mus musculus
ttctcatgttcggacaccagggtcc

SEQ ID NO: 940673 - DNA, 25 bp, Mus musculus
ttctcatgttctccgcgtacctcag

SEQ ID NO: 940674 - DNA, 25 bp, Mus musculus
ttctcatgttctgcgcgtacctcag

SEQ ID NO: 940675 - DNA, 25 bp, Mus musculus
ttctcattagatattcccttggtat

SEQ ID NO: 940676 - DNA, 25 bp, Mus musculus
ttctcattagattttcccttggtat

SEQ ID NO: 940677 - DNA, 25 bp, Mus musculus
ttctcattagctcccaagatggcag

SEQ ID NO: 940678 - DNA, 25 bp, Mus musculus
ttctcattagctgccaagatggcag

SEQ ID NO: 940679 - DNA, 25 bp, Mus musculus
ttctcattccggctcttcggatggg

SEQ ID NO: 940680 - DNA, 25 bp, Mus musculus
ttctcattccgggtcttcggatggg

SEQ ID NO: 940681 - DNA, 25 bp, Mus musculus
ttctcattccttatcatgttcaaat

SEQ ID NO: 940682 - DNA, 25 bp, Mus musculus
ttctcattccttttcatgttcaaat

SEQ ID NO: 940683 - DNA, 25 bp, Mus musculus
ttctcattcgatatctcaggattcc

SEQ ID NO: 940684 - DNA, 25 bp, Mus musculus
ttctcattcgatttctcaggattcc

SEQ ID NO: 940685 - DNA, 25 bp, Mus musculus
ttctcattctgcagacctgaaccta

SEQ ID NO: 940686 - DNA, 25 bp, Mus musculus
ttctcattctgctgacctgaaccta

SEQ ID NO: 940687 - DNA, 25 bp, Mus musculus
ttctcattgagacctctggttggta

SEQ ID NO: 940688 - DNA, 25 bp, Mus musculus
ttctcattgagagctctggttggta

SEQ ID NO: 940689 - DNA, 25 bp, Mus musculus
ttctcattgctgaggctgactcaga

SEQ ID NO: 940690 - DNA, 25 bp, Mus musculus
ttctcattgctgtggctgactcaga

SEQ ID NO: 940691 - DNA, 25 bp, Mus musculus
ttctcattggctaggtgaaatacct

SEQ ID NO: 940692 - DNA, 25 bp, Mus musculus
ttctcattggcttggtgaaatacct

SEQ ID NO: 940693 - DNA, 25 bp, Mus musculus
ttctcattgttaccctcagtttccc

SEQ ID NO: 940694 - DNA, 25 bp, Mus musculus
ttctcattgttagcctcagtttccc

SEQ ID NO: 940695 - DNA, 25 bp, Mus musculus
ttctcattgttcagcttggcctcaa

SEQ ID NO: 940696 - DNA, 25 bp, Mus musculus
ttctcattgttctgcttggcctcaa

SEQ ID NO: 940697 - DNA, 25 bp, Mus musculus
ttctcatttaacctctgtgtgtgtg

SEQ ID NO: 940698 - DNA, 25 bp, Mus musculus
ttctcatttaacgtctgtgtgtgtg

SEQ ID NO: 940699 - DNA, 25 bp, Mus musculus
ttctcatttcaaccattcgtttgag

SEQ ID NO: 940700 - DNA, 25 bp, Mus musculus
ttctcatttcaagcattcgtttgag

SEQ ID NO: 940701 - DNA, 25 bp, Mus musculus
ttctcatttctcacttagtagcttt

SEQ ID NO: 940702 - DNA, 25 bp, Mus musculus
ttctcatttctctcttagtagcttt

SEQ ID NO: 940703 - DNA, 25 bp, Mus musculus
ttctcatttgttcccagctccttag

SEQ ID NO: 940704 - DNA, 25 bp, Mus musculus
ttctcatttgttgccagctccttag

SEQ ID NO: 940705 - DNA, 25 bp, Mus musculus
ttctcatttttaacctcagcctgat

SEQ ID NO: 940706 - DNA, 25 bp, Mus musculus
ttctcatttttatcctcagcctgat

SEQ ID NO: 940707 - DNA, 25 bp, Mus musculus
ttctccaaagccacatcctagtaac

SEQ ID NO: 940708 - DNA, 25 bp, Mus musculus
ttctccaaagcctcatcctagtaac

SEQ ID NO: 940709 - DNA, 25 bp, Mus musculus
ttctccaaaggtctgaaacttattt

SEQ ID NO: 940710 - DNA, 25 bp, Mus musculus
ttctccaaaggtgtgaaacttattt

SEQ ID NO: 940711 - DNA, 25 bp, Mus musculus
ttctccaaataactactaatgctgt

SEQ ID NO: 940712 - DNA, 25 bp, Mus musculus
ttctccaaataagtactaatgctgt

SEQ ID NO: 940713 - DNA, 25 bp, Mus musculus
ttctccaactccattatctgggacc

SEQ ID NO: 940714 - DNA, 25 bp, Mus musculus
ttctccaactcctttatctgggacc

SEQ ID NO: 940715 - DNA, 25 bp, Mus musculus
ttctccaactctcaatactctgtag

SEQ ID NO: 940716 - DNA, 25 bp, Mus musculus
ttctccaactctgaatactctgtag

SEQ ID NO: 940717 - DNA, 25 bp, Mus musculus
ttctccaactgtactcatctctatg

SEQ ID NO: 940718 - DNA, 25 bp, Mus musculus
ttctccaactgtccacttttgggtg

SEQ ID NO: 940719 - DNA, 25 bp, Mus musculus
ttctccaactgtgcacttttgggtg

SEQ ID NO: 940720 - DNA, 25 bp, Mus musculus
ttctccaactgttctcatctctatg

SEQ ID NO: 940721 - DNA, 25 bp, Mus musculus
ttctccaacttgcacgtgctgagag

SEQ ID NO: 940722 - DNA, 25 bp, Mus musculus
ttctccaacttggacgtgctgagag

SEQ ID NO: 940723 - DNA, 25 bp, Mus musculus
ttctccaagatgctggtactccgga

SEQ ID NO: 940724 - DNA, 25 bp, Mus musculus
ttctccaagatggtggtactccgga

SEQ ID NO: 940725 - DNA, 25 bp, Mus musculus
ttctccaagcggaggcaacagttca

SEQ ID NO: 940726 - DNA, 25 bp, Mus musculus
ttctccaagcggtggcaacagttca

SEQ ID NO: 940727 - DNA, 25 bp, Mus musculus
ttctccaaggacactgactgcagat

SEQ ID NO: 940728 - DNA, 25 bp, Mus musculus
ttctccaaggactctgactgcagat

SEQ ID NO: 940729 - DNA, 25 bp, Mus musculus
ttctccaaggatcgatcctggcgca

SEQ ID NO: 940730 - DNA, 25 bp, Mus musculus
ttctccaaggatggatcctggcgca

SEQ ID NO: 940731 - DNA, 25 bp, Mus musculus
ttctccaagtgtcagctttctgagc

SEQ ID NO: 940732 - DNA, 25 bp, Mus musculus
ttctccaagtgtgagctttctgagc

SEQ ID NO: 940733 - DNA, 25 bp, Mus musculus
ttctccaatcctcgcaacttcgaga

SEQ ID NO: 940734 - DNA, 25 bp, Mus musculus
ttctccaatcctggcaacttcgaga

SEQ ID NO: 940735 - DNA, 25 bp, Mus musculus
ttctccaatgagatagttcagccag

SEQ ID NO: 940736 - DNA, 25 bp, Mus musculus
ttctccaatgagttagttcagccag

SEQ ID NO: 940737 - DNA, 25 bp, Mus musculus
ttctccaattctacttgaggtgttg

SEQ ID NO: 940738 - DNA, 25 bp, Mus musculus
ttctccaattcttcttgaggtgttg

SEQ ID NO: 940739 - DNA, 25 bp, Mus musculus
ttctccacaagtctccattttaata

SEQ ID NO: 940740 - DNA, 25 bp, Mus musculus
ttctccacaagtgtccattttaata

SEQ ID NO: 940741 - DNA, 25 bp, Mus musculus
ttctccacacttatttatggacagt

SEQ ID NO: 940742 - DNA, 25 bp, Mus musculus
ttctccacacttttttatggacagt

SEQ ID NO: 940743 - DNA, 25 bp, Mus musculus
ttctccacatccagacagccataaa

SEQ ID NO: 940744 - DNA, 25 bp, Mus musculus
ttctccacatcctgacagccataaa

SEQ ID NO: 940745 - DNA, 25 bp, Mus musculus
ttctccacatttcttctcggtgaaa

SEQ ID NO: 940746 - DNA, 25 bp, Mus musculus
ttctccacatttgttctcggtgaaa

SEQ ID NO: 940747 - DNA, 25 bp, Mus musculus
ttctccaccaatcctgtgtgttaga

SEQ ID NO: 940748 - DNA, 25 bp, Mus musculus
ttctccaccaatgctgtgtgttaga

SEQ ID NO: 940749 - DNA, 25 bp, Mus musculus
ttctccaccacccatgtaaggcaag

SEQ ID NO: 940750 - DNA, 25 bp, Mus musculus
ttctccaccaccgatgtaaggcaag

SEQ ID NO: 940751 - DNA, 25 bp, Mus musculus
ttctccaccatgatccattcttagg

SEQ ID NO: 940752 - DNA, 25 bp, Mus musculus
ttctccaccatgttccattcttagg

SEQ ID NO: 940753 - DNA, 25 bp, Mus musculus
ttctccaccctaccttaattctgag

SEQ ID NO: 940754 - DNA, 25 bp, Mus musculus
ttctccaccctagcttaattctgag

SEQ ID NO: 940755 - DNA, 25 bp, Mus musculus
ttctccaccttcaactgaaaggctg

SEQ ID NO: 940756 - DNA, 25 bp, Mus musculus
ttctccaccttctactgaaaggctg

SEQ ID NO: 940757 - DNA, 25 bp, Mus musculus
ttctccacctttccatgagacagta

SEQ ID NO: 940758 - DNA, 25 bp, Mus musculus
ttctccacctttgcatgagacagta

SEQ ID NO: 940759 - DNA, 25 bp, Mus musculus
ttctccacgctgattttcatcagat

SEQ ID NO: 940760 - DNA, 25 bp, Mus musculus
ttctccacgctgtttttcatcagat

SEQ ID NO: 940761 - DNA, 25 bp, Mus musculus
ttctccacgggtatctcttgggctc

SEQ ID NO: 940762 - DNA, 25 bp, Mus musculus
ttctccacgggtttctcttgggctc

SEQ ID NO: 940763 - DNA, 25 bp, Mus musculus
ttctccacgtgccttccagctttga

SEQ ID NO: 940764 - DNA, 25 bp, Mus musculus
ttctccacgtgcgttccagctttga

SEQ ID NO: 940765 - DNA, 25 bp, Mus musculus
ttctccactataatacatcctctat

SEQ ID NO: 940766 - DNA, 25 bp, Mus musculus
ttctccactatattacatcctctat

SEQ ID NO: 940767 - DNA, 25 bp, Mus musculus
ttctccactatgcagggtctctcat

SEQ ID NO: 940768 - DNA, 25 bp, Mus musculus
ttctccactatggagggtctctcat

SEQ ID NO: 940769 - DNA, 25 bp, Mus musculus
ttctccactcttcacagagttccgt

SEQ ID NO: 940770 - DNA, 25 bp, Mus musculus
ttctccactcttgacagagttccgt

SEQ ID NO: 940771 - DNA, 25 bp, Mus musculus
ttctccactgctcgtaggattgcaa

SEQ ID NO: 940772 - DNA, 25 bp, Mus musculus
ttctccactgctggtaggattgcaa

SEQ ID NO: 940773 - DNA, 25 bp, Mus musculus
ttctccagaaccaccaaacaaaaag

SEQ ID NO: 940774 - DNA, 25 bp, Mus musculus
ttctccagaacctccaaacaaaaag

SEQ ID NO: 940775 - DNA, 25 bp, Mus musculus
ttctccagaaggaagcaatcatttt

SEQ ID NO: 940776 - DNA, 25 bp, Mus musculus
ttctccagaaggtagcaatcatttt

SEQ ID NO: 940777 - DNA, 25 bp, Mus musculus
ttctccagacccactaaacagtaat

SEQ ID NO: 940778 - DNA, 25 bp, Mus musculus
ttctccagaccctctaaacagtaat

SEQ ID NO: 940779 - DNA, 25 bp, Mus musculus
ttctccagacctatgtttgacaatc

SEQ ID NO: 940780 - DNA, 25 bp, Mus musculus
ttctccagacctttgtttgacaatc

SEQ ID NO: 940781 - DNA, 25 bp, Mus musculus
ttctccagagccagaggtttatgag

SEQ ID NO: 940782 - DNA, 25 bp, Mus musculus
ttctccagagcctgaggtttatgag

SEQ ID NO: 940783 - DNA, 25 bp, Mus musculus
ttctccagaggaagtgcagtcagtg

SEQ ID NO: 940784 - DNA, 25 bp, Mus musculus
ttctccagaggatgtgcagtcagtg

SEQ ID NO: 940785 - DNA, 25 bp, Mus musculus
ttctccagagttactttagtcttta

SEQ ID NO: 940786 - DNA, 25 bp, Mus musculus
ttctccagagtttctttagtcttta

SEQ ID NO: 940787 - DNA, 25 bp, Mus musculus
ttctccagatccaatgagggtttca

SEQ ID NO: 940788 - DNA, 25 bp, Mus musculus
ttctccagatcctatgagggtttca

SEQ ID NO: 940789 - DNA, 25 bp, Mus musculus
ttctccagcagccatgtcaggcaag

SEQ ID NO: 940790 - DNA, 25 bp, Mus musculus
ttctccagcagcgatgtcaggcaag

SEQ ID NO: 940791 - DNA, 25 bp, Mus musculus
ttctccagcccaataaatccagtta

SEQ ID NO: 940792 - DNA, 25 bp, Mus musculus
ttctccagcccattaaatccagtta

SEQ ID NO: 940793 - DNA, 25 bp, Mus musculus
ttctccagcctgcatgtgattttta

SEQ ID NO: 940794 - DNA, 25 bp, Mus musculus
ttctccagcctggatgtgattttta

SEQ ID NO: 940795 - DNA, 25 bp, Mus musculus
ttctccagctagatattctttacgt

SEQ ID NO: 940796 - DNA, 25 bp, Mus musculus
ttctccagctagttattctttacgt

SEQ ID NO: 940797 - DNA, 25 bp, Mus musculus
ttctccagctgcagtttgtccaggc

SEQ ID NO: 940798 - DNA, 25 bp, Mus musculus
ttctccagctgctgtttgtccaggc

SEQ ID NO: 940799 - DNA, 25 bp, Mus musculus
ttctccaggcaacgattagtgggca

SEQ ID NO: 940800 - DNA, 25 bp, Mus musculus
ttctccaggcaaggattagtgggca

SEQ ID NO: 940801 - DNA, 25 bp, Mus musculus
ttctccagggctctcatcttagcgg

SEQ ID NO: 940802 - DNA, 25 bp, Mus musculus
ttctccagggctcttgagcccagag

SEQ ID NO: 940803 - DNA, 25 bp, Mus musculus
ttctccagggctgtcatcttagcgg

SEQ ID NO: 940804 - DNA, 25 bp, Mus musculus
ttctccagggctgttgagcccagag

SEQ ID NO: 940805 - DNA, 25 bp, Mus musculus
ttctccagtaccagttacattgggt

SEQ ID NO: 940806 - DNA, 25 bp, Mus musculus
ttctccagtacctgttacattgggt

SEQ ID NO: 940807 - DNA, 25 bp, Mus musculus
ttctccagtagcattcagcttttaa

SEQ ID NO: 940808 - DNA, 25 bp, Mus musculus
ttctccagtagctttcagcttttaa

SEQ ID NO: 940809 - DNA, 25 bp, Mus musculus
ttctccagtcgaatgctcggcttta

SEQ ID NO: 940810 - DNA, 25 bp, Mus musculus
ttctccagtcgattgctcggcttta

SEQ ID NO: 940811 - DNA, 25 bp, Mus musculus
ttctccagtggtagtcaggaacctt

SEQ ID NO: 940812 - DNA, 25 bp, Mus musculus
ttctccagtggttgtcaggaacctt

SEQ ID NO: 940813 - DNA, 25 bp, Mus musculus
ttctccagtgttagtcattcttcat

SEQ ID NO: 940814 - DNA, 25 bp, Mus musculus
ttctccagtgtttgtcattcttcat

SEQ ID NO: 940815 - DNA, 25 bp, Mus musculus
ttctccagttgtctggacagccatg

SEQ ID NO: 940816 - DNA, 25 bp, Mus musculus
ttctccagttgtgtggacagccatg

SEQ ID NO: 940817 - DNA, 25 bp, Mus musculus
ttctccatatataaaccacagtcta

SEQ ID NO: 940818 - DNA, 25 bp, Mus musculus
ttctccatatattaaccacagtcta

SEQ ID NO: 940819 - DNA, 25 bp, Mus musculus
ttctccatatccacctgacattgga

SEQ ID NO: 940820 - DNA, 25 bp, Mus musculus
ttctccatatcctcctgacattgga

SEQ ID NO: 940821 - DNA, 25 bp, Mus musculus
ttctccatatctcctccagaaaagg

SEQ ID NO: 940822 - DNA, 25 bp, Mus musculus
ttctccatatctgctccagaaaagg

SEQ ID NO: 940823 - DNA, 25 bp, Mus musculus
ttctccatcagtactcagaatcagc

SEQ ID NO: 940824 - DNA, 25 bp, Mus musculus
ttctccatcagttctcagaatcagc

SEQ ID NO: 940825 - DNA, 25 bp, Mus musculus
ttctccatcatgctaatgccaggct

SEQ ID NO: 940826 - DNA, 25 bp, Mus musculus
ttctccatcatggtaatgccaggct

SEQ ID NO: 940827 - DNA, 25 bp, Mus musculus
ttctccatccacacttacaggtgga

SEQ ID NO: 940828 - DNA, 25 bp, Mus musculus
ttctccatccacatggctcttcggg

SEQ ID NO: 940829 - DNA, 25 bp, Mus musculus
ttctccatccaccagaggaacagtg

SEQ ID NO: 940830 - DNA, 25 bp, Mus musculus
ttctccatccacgagaggaacagtg

SEQ ID NO: 940831 - DNA, 25 bp, Mus musculus
ttctccatccactcttacaggtgga

SEQ ID NO: 940832 - DNA, 25 bp, Mus musculus
ttctccatccacttggctcttcggg

SEQ ID NO: 940833 - DNA, 25 bp, Mus musculus
ttctccatccataaaagatcctcat

SEQ ID NO: 940834 - DNA, 25 bp, Mus musculus
ttctccatccattaaagatcctcat

SEQ ID NO: 940835 - DNA, 25 bp, Mus musculus
ttctccatcctaaggaccacaactg

SEQ ID NO: 940836 - DNA, 25 bp, Mus musculus
ttctccatcctatggaccacaactg

SEQ ID NO: 940837 - DNA, 25 bp, Mus musculus
ttctccatcctgaagtcattccaaa

SEQ ID NO: 940838 - DNA, 25 bp, Mus musculus
ttctccatcctgtagtcattccaaa

SEQ ID NO: 940839 - DNA, 25 bp, Mus musculus
ttctccatccttcagaactcaagta

SEQ ID NO: 940840 - DNA, 25 bp, Mus musculus
ttctccatccttgagaactcaagta

SEQ ID NO: 940841 - DNA, 25 bp, Mus musculus
ttctccatctcaaaccaacgtggtt

SEQ ID NO: 940842 - DNA, 25 bp, Mus musculus
ttctccatctcataccaacgtggtt

SEQ ID NO: 940843 - DNA, 25 bp, Mus musculus
ttctccatctctagctgtctcatgt

SEQ ID NO: 940844 - DNA, 25 bp, Mus musculus
ttctccatctcttgctgtctcatgt

SEQ ID NO: 940845 - DNA, 25 bp, Mus musculus
ttctccatcttcaacgcgtttactg

SEQ ID NO: 940846 - DNA, 25 bp, Mus musculus
ttctccatcttctacgcgtttactg

SEQ ID NO: 940847 - DNA, 25 bp, Mus musculus
ttctccatctttagaaaccttcctg

SEQ ID NO: 940848 - DNA, 25 bp, Mus musculus
ttctccatctttctgtatccgggaa

SEQ ID NO: 940849 - DNA, 25 bp, Mus musculus
ttctccatctttgtgtatccgggaa

SEQ ID NO: 940850 - DNA, 25 bp, Mus musculus
ttctccatcttttgaaaccttcctg

SEQ ID NO: 940851 - DNA, 25 bp, Mus musculus
ttctccatgcgccattttcaaagaa

SEQ ID NO: 940852 - DNA, 25 bp, Mus musculus
ttctccatgcgcgattttcaaagaa

SEQ ID NO: 940853 - DNA, 25 bp, Mus musculus
ttctccatgctgctccatgttaaga

SEQ ID NO: 940854 - DNA, 25 bp, Mus musculus
ttctccatgctggtccatgttaaga

SEQ ID NO: 940855 - DNA, 25 bp, Mus musculus
ttctccatggagcatcaacctgaat

SEQ ID NO: 940856 - DNA, 25 bp, Mus musculus
ttctccatggaggatcaacctgaat

SEQ ID NO: 940857 - DNA, 25 bp, Mus musculus
ttctccatggatcagaaccagaccc

SEQ ID NO: 940858 - DNA, 25 bp, Mus musculus
ttctccatggatgagaaccagaccc

SEQ ID NO: 940859 - DNA, 25 bp, Mus musculus
ttctccatgtttaggtccccagcac

SEQ ID NO: 940860 - DNA, 25 bp, Mus musculus
ttctccatgttttggtccccagcac

SEQ ID NO: 940861 - DNA, 25 bp, Mus musculus
ttctccattctcagctataaaggac

SEQ ID NO: 940862 - DNA, 25 bp, Mus musculus
ttctccattctctgctataaaggac

SEQ ID NO: 940863 - DNA, 25 bp, Mus musculus
ttctccatttctcatgtcagcaagg

SEQ ID NO: 940864 - DNA, 25 bp, Mus musculus
ttctccatttctgatgtcagcaagg

SEQ ID NO: 940865 - DNA, 25 bp, Mus musculus
ttctcccaaaccagtacttgaagtt

SEQ ID NO: 940866 - DNA, 25 bp, Mus musculus
ttctcccaaacctgtacttgaagtt

SEQ ID NO: 940867 - DNA, 25 bp, Mus musculus
ttctcccaaccaagccggagtgctg

SEQ ID NO: 940868 - DNA, 25 bp, Mus musculus
ttctcccaaccatgccggagtgctg

SEQ ID NO: 940869 - DNA, 25 bp, Mus musculus
ttctcccaacttcaccataaaaatc

SEQ ID NO: 940870 - DNA, 25 bp, Mus musculus
ttctcccaacttgaccataaaaatc

SEQ ID NO: 940871 - DNA, 25 bp, Mus musculus
ttctcccaaggaagacgcatctcta

SEQ ID NO: 940872 - DNA, 25 bp, Mus musculus
ttctcccaaggaagcacgcttgtgc

SEQ ID NO: 940873 - DNA, 25 bp, Mus musculus
ttctcccaaggaatttgcggcgtat

SEQ ID NO: 940874 - DNA, 25 bp, Mus musculus
ttctcccaaggatgacgcatctcta

SEQ ID NO: 940875 - DNA, 25 bp, Mus musculus
ttctcccaaggatgcacgcttgtgc

SEQ ID NO: 940876 - DNA, 25 bp, Mus musculus
ttctcccaaggattttgcggcgtat

SEQ ID NO: 940877 - DNA, 25 bp, Mus musculus
ttctcccaagtaatctcctaccagc

SEQ ID NO: 940878 - DNA, 25 bp, Mus musculus
ttctcccaagtattctcctaccagc

SEQ ID NO: 940879 - DNA, 25 bp, Mus musculus
ttctcccaatctactaccatttaat

SEQ ID NO: 940880 - DNA, 25 bp, Mus musculus
ttctcccaatcttctaccatttaat

SEQ ID NO: 940881 - DNA, 25 bp, Mus musculus
ttctcccacaaactctttattttat

SEQ ID NO: 940882 - DNA, 25 bp, Mus musculus
ttctcccacaaagtctttattttat

SEQ ID NO: 940883 - DNA, 25 bp, Mus musculus
ttctcccacactaatcagcttatat

SEQ ID NO: 940884 - DNA, 25 bp, Mus musculus
ttctcccacacttatcagcttatat

SEQ ID NO: 940885 - DNA, 25 bp, Mus musculus
ttctcccacaggcactcaaggttga

SEQ ID NO: 940886 - DNA, 25 bp, Mus musculus
ttctcccacagggactcaaggttga

SEQ ID NO: 940887 - DNA, 25 bp, Mus musculus
ttctcccaccacagccaaaagaaga

SEQ ID NO: 940888 - DNA, 25 bp, Mus musculus
ttctcccaccactgccaaaagaaga

SEQ ID NO: 940889 - DNA, 25 bp, Mus musculus
ttctcccaccccatgaaaacagagg

SEQ ID NO: 940890 - DNA, 25 bp, Mus musculus
ttctcccaccccttgaaaacagagg

SEQ ID NO: 940891 - DNA, 25 bp, Mus musculus
ttctcccaccgcactgttggaaatg

SEQ ID NO: 940892 - DNA, 25 bp, Mus musculus
ttctcccaccgctctgttggaaatg

SEQ ID NO: 940893 - DNA, 25 bp, Mus musculus
ttctcccaccttaggaaccagaaag

SEQ ID NO: 940894 - DNA, 25 bp, Mus musculus
ttctcccacctttggaaccagaaag

SEQ ID NO: 940895 - DNA, 25 bp, Mus musculus
ttctcccagaacagtggcctttgtg

SEQ ID NO: 940896 - DNA, 25 bp, Mus musculus
ttctcccagaactgtggcctttgtg

SEQ ID NO: 940897 - DNA, 25 bp, Mus musculus
ttctcccagactctgaggacaccag

SEQ ID NO: 940898 - DNA, 25 bp, Mus musculus
ttctcccagactgtgaggacaccag

SEQ ID NO: 940899 - DNA, 25 bp, Mus musculus
ttctcccagatcctcaaggtgctga

SEQ ID NO: 940900 - DNA, 25 bp, Mus musculus
ttctcccagatcgtcaaggtgctga

SEQ ID NO: 940901 - DNA, 25 bp, Mus musculus
ttctcccagcgtcaattgcagacaa

SEQ ID NO: 940902 - DNA, 25 bp, Mus musculus
ttctcccagcgtgaattgcagacaa

SEQ ID NO: 940903 - DNA, 25 bp, Mus musculus
ttctcccagtgtatagatgatctca

SEQ ID NO: 940904 - DNA, 25 bp, Mus musculus
ttctcccagtgtttagatgatctca

SEQ ID NO: 940905 - DNA, 25 bp, Mus musculus
ttctcccagtttcctctggttgaag

SEQ ID NO: 940906 - DNA, 25 bp, Mus musculus
ttctcccagtttgctctggttgaag

SEQ ID NO: 940907 - DNA, 25 bp, Mus musculus
ttctcccataacctcctttttgaag

SEQ ID NO: 940908 - DNA, 25 bp, Mus musculus
ttctcccataacgtcctttttgaag

SEQ ID NO: 940909 - DNA, 25 bp, Mus musculus
ttctcccataataaacataggtgtt

SEQ ID NO: 940910 - DNA, 25 bp, Mus musculus
ttctcccataattaacataggtgtt

SEQ ID NO: 940911 - DNA, 25 bp, Mus musculus
ttctcccatcagctcatctgattct

SEQ ID NO: 940912 - DNA, 25 bp, Mus musculus
ttctcccatcaggtcatctgattct

SEQ ID NO: 940913 - DNA, 25 bp, Mus musculus
ttctcccatcctcaaatggtgtttg

SEQ ID NO: 940914 - DNA, 25 bp, Mus musculus
ttctcccatcctgaaatggtgtttg

SEQ ID NO: 940915 - DNA, 25 bp, Mus musculus
ttctcccatggccacaaaggattat

SEQ ID NO: 940916 - DNA, 25 bp, Mus musculus
ttctcccatggcgacaaaggattat

SEQ ID NO: 940917 - DNA, 25 bp, Mus musculus
ttctccccaacaattttattgtgaa

SEQ ID NO: 940918 - DNA, 25 bp, Mus musculus
ttctccccaacatttttattgtgaa

SEQ ID NO: 940919 - DNA, 25 bp, Mus musculus
ttctccccacaactcatttatgatt

SEQ ID NO: 940920 - DNA, 25 bp, Mus musculus
ttctccccacaagtcatttatgatt

SEQ ID NO: 940921 - DNA, 25 bp, Mus musculus
ttctccccagctctaactactaaaa

SEQ ID NO: 940922 - DNA, 25 bp, Mus musculus
ttctccccagctgtaactactaaaa

SEQ ID NO: 940923 - DNA, 25 bp, Mus musculus
ttctccccatcaagtatgtctaggt

SEQ ID NO: 940924 - DNA, 25 bp, Mus musculus
ttctccccatcatgtatgtctaggt

SEQ ID NO: 940925 - DNA, 25 bp, Mus musculus
ttctccccatctcttcatagtttat

SEQ ID NO: 940926 - DNA, 25 bp, Mus musculus
ttctccccatctgttcatagtttat

SEQ ID NO: 940927 - DNA, 25 bp, Mus musculus
ttctccccatgccaacgagtatagg

SEQ ID NO: 940928 - DNA, 25 bp, Mus musculus
ttctccccatgcgaacgagtatagg

SEQ ID NO: 940929 - DNA, 25 bp, Mus musculus
ttctcccctatgatgctaatgttca

SEQ ID NO: 940930 - DNA, 25 bp, Mus musculus
ttctcccctatgttgctaatgttca

SEQ ID NO: 940931 - DNA, 25 bp, Mus musculus
ttctcccctcttaatctattggtag

SEQ ID NO: 940932 - DNA, 25 bp, Mus musculus
ttctcccctctttatctattggtag

SEQ ID NO: 940933 - DNA, 25 bp, Mus musculus
ttctcccctgaacacatcattgtca

SEQ ID NO: 940934 - DNA, 25 bp, Mus musculus
ttctcccctgaagacatcattgtca

SEQ ID NO: 940935 - DNA, 25 bp, Mus musculus
ttctcccctggcctgattgaggtgg

SEQ ID NO: 940936 - DNA, 25 bp, Mus musculus
ttctcccctggcgtgattgaggtgg

SEQ ID NO: 940937 - DNA, 25 bp, Mus musculus
ttctcccgactcagcctacataatg

SEQ ID NO: 940938 - DNA, 25 bp, Mus musculus
ttctcccgactctgcctacataatg

SEQ ID NO: 940939 - DNA, 25 bp, Mus musculus
ttctcccgcattcaaacagtctgtt

SEQ ID NO: 940940 - DNA, 25 bp, Mus musculus
ttctcccgcattgaaacagtctgtt

SEQ ID NO: 940941 - DNA, 25 bp, Mus musculus
ttctcccgccaaactgacgtgtgga

SEQ ID NO: 940942 - DNA, 25 bp, Mus musculus
ttctcccgccaatctgacgtgtgga

SEQ ID NO: 940943 - DNA, 25 bp, Mus musculus
ttctcccgcgggaacgtgccttcga

SEQ ID NO: 940944 - DNA, 25 bp, Mus musculus
ttctcccgcgggtacgtgccttcga

SEQ ID NO: 940945 - DNA, 25 bp, Mus musculus
ttctcccgctgccaggaagctgttg

SEQ ID NO: 940946 - DNA, 25 bp, Mus musculus
ttctcccgctgcgaggaagctgttg

SEQ ID NO: 940947 - DNA, 25 bp, Mus musculus
ttctcccgggaaagattactgcaag

SEQ ID NO: 940948 - DNA, 25 bp, Mus musculus
ttctcccgggaatgattactgcaag

SEQ ID NO: 940949 - DNA, 25 bp, Mus musculus
ttctcccgtgctcaactgttagata

SEQ ID NO: 940950 - DNA, 25 bp, Mus musculus
ttctcccgtgctgaactgttagata

SEQ ID NO: 940951 - DNA, 25 bp, Mus musculus
ttctcccgtggtacctgcaatggaa

SEQ ID NO: 940952 - DNA, 25 bp, Mus musculus
ttctcccgtggttcctgcaatggaa

SEQ ID NO: 940953 - DNA, 25 bp, Mus musculus
ttctccctaactaatctcttatcag

SEQ ID NO: 940954 - DNA, 25 bp, Mus musculus
ttctccctaactccttgttcattca

SEQ ID NO: 940955 - DNA, 25 bp, Mus musculus
ttctccctaactgcttgttcattca

SEQ ID NO: 940956 - DNA, 25 bp, Mus musculus
ttctccctaacttatctcttatcag

SEQ ID NO: 940957 - DNA, 25 bp, Mus musculus
ttctccctaagaaacagagtggacc

SEQ ID NO: 940958 - DNA, 25 bp, Mus musculus
ttctccctaagatacagagtggacc

SEQ ID NO: 940959 - DNA, 25 bp, Mus musculus
ttctccctaccgaaggccagggatg

SEQ ID NO: 940960 - DNA, 25 bp, Mus musculus
ttctccctaccgtaggccagggatg

SEQ ID NO: 940961 - DNA, 25 bp, Mus musculus
ttctccctacgaactttgtcaaatc

SEQ ID NO: 940962 - DNA, 25 bp, Mus musculus
ttctccctacgatctttgtcaaatc

SEQ ID NO: 940963 - DNA, 25 bp, Mus musculus
ttctccctagaacagtatgcgtcag

SEQ ID NO: 940964 - DNA, 25 bp, Mus musculus
ttctccctagaagagtatgcgtcag

SEQ ID NO: 940965 - DNA, 25 bp, Mus musculus
ttctccctcaccaggatttcatttt

SEQ ID NO: 940966 - DNA, 25 bp, Mus musculus
ttctccctcacctggatttcatttt

SEQ ID NO: 940967 - DNA, 25 bp, Mus musculus
ttctccctcagaactacaaggtcag

SEQ ID NO: 940968 - DNA, 25 bp, Mus musculus
ttctccctcagatctacaaggtcag

SEQ ID NO: 940969 - DNA, 25 bp, Mus musculus
ttctccctccctaaagtgattggat

SEQ ID NO: 940970 - DNA, 25 bp, Mus musculus
ttctccctcccttaagtgattggat

SEQ ID NO: 940971 - DNA, 25 bp, Mus musculus
ttctccctctatatctacaattttc

SEQ ID NO: 940972 - DNA, 25 bp, Mus musculus
ttctccctctatttctacaattttc

SEQ ID NO: 940973 - DNA, 25 bp, Mus musculus
ttctccctcttacttagtagcacag

SEQ ID NO: 940974 - DNA, 25 bp, Mus musculus
ttctccctcttagttagtagcacag

SEQ ID NO: 940975 - DNA, 25 bp, Mus musculus
ttctccctgagaactgtaaaccttc

SEQ ID NO: 940976 - DNA, 25 bp, Mus musculus
ttctccctgagatctgtaaaccttc

SEQ ID NO: 940977 - DNA, 25 bp, Mus musculus
ttctccctgaggaaagggtgttcct

SEQ ID NO: 940978 - DNA, 25 bp, Mus musculus
ttctccctgaggtaagggtgttcct

SEQ ID NO: 940979 - DNA, 25 bp, Mus musculus
ttctccctgagtattacagtaatgg

SEQ ID NO: 940980 - DNA, 25 bp, Mus musculus
ttctccctgagttttacagtaatgg

SEQ ID NO: 940981 - DNA, 25 bp, Mus musculus
ttctccctgcggcaagcggcgctat

SEQ ID NO: 940982 - DNA, 25 bp, Mus musculus
ttctccctgcgggaagcggcgctat

SEQ ID NO: 940983 - DNA, 25 bp, Mus musculus
ttctccctgcttaaatccacagtgt

SEQ ID NO: 940984 - DNA, 25 bp, Mus musculus
ttctccctgctttaatccacagtgt

SEQ ID NO: 940985 - DNA, 25 bp, Mus musculus
ttctccctggagaatcatcaacatt

SEQ ID NO: 940986 - DNA, 25 bp, Mus musculus
ttctccctggagtatcatcaacatt

SEQ ID NO: 940987 - DNA, 25 bp, Mus musculus
ttctccctgtgaatggcagcccaga

SEQ ID NO: 940988 - DNA, 25 bp, Mus musculus
ttctccctgtgattggcagcccaga

SEQ ID NO: 940989 - DNA, 25 bp, Mus musculus
ttctcccttattagctctttcaatt

SEQ ID NO: 940990 - DNA, 25 bp, Mus musculus
ttctcccttatttgctctttcaatt

SEQ ID NO: 940991 - DNA, 25 bp, Mus musculus
ttctcccttcaaaggtccagactag

SEQ ID NO: 940992 - DNA, 25 bp, Mus musculus
ttctcccttcaatggtccagactag

SEQ ID NO: 940993 - DNA, 25 bp, Mus musculus
ttctcccttcccagatagtgaaggc

SEQ ID NO: 940994 - DNA, 25 bp, Mus musculus
ttctcccttccctgatagtgaaggc

SEQ ID NO: 940995 - DNA, 25 bp, Mus musculus
ttctcccttctaaggtccatgcttt

SEQ ID NO: 940996 - DNA, 25 bp, Mus musculus
ttctcccttctatggtccatgcttt

SEQ ID NO: 940997 - DNA, 25 bp, Mus musculus
ttctcccttgatactttttgcagtt

SEQ ID NO: 940998 - DNA, 25 bp, Mus musculus
ttctcccttgattctttttgcagtt

SEQ ID NO: 940999 - DNA, 25 bp, Mus musculus
ttctccctttagactgagtcaggtt

SEQ ID NO: 941000 - DNA, 25 bp, Mus musculus
ttctccctttagtctgagtcaggtt

SEQ ID NO: 941001 - DNA, 25 bp, Mus musculus
ttctccctttctcttgatgtagcaa

SEQ ID NO: 941002 - DNA, 25 bp, Mus musculus
ttctccctttctgttgatgtagcaa

SEQ ID NO: 941003 - DNA, 25 bp, Mus musculus
ttctccctttggattgagttcccaa

SEQ ID NO: 941004 - DNA, 25 bp, Mus musculus
ttctccctttggtttgagttcccaa

SEQ ID NO: 941005 - DNA, 25 bp, Mus musculus
ttctccgaaatgctctatcgattcc

SEQ ID NO: 941006 - DNA, 25 bp, Mus musculus
ttctccgaaatggtctatcgattcc

SEQ ID NO: 941007 - DNA, 25 bp, Mus musculus
ttctccgaatttccatgatctttaa

SEQ ID NO: 941008 - DNA, 25 bp, Mus musculus
ttctccgaatttgcatgatctttaa

SEQ ID NO: 941009 - DNA, 25 bp, Mus musculus
ttctccgacccaaatcaaggcaggg

SEQ ID NO: 941010 - DNA, 25 bp, Mus musculus
ttctccgacccatatcaaggcaggg

SEQ ID NO: 941011 - DNA, 25 bp, Mus musculus
ttctccgaccttatcttcagttcca

SEQ ID NO: 941012 - DNA, 25 bp, Mus musculus
ttctccgaccttttcttcagttcca

SEQ ID NO: 941013 - DNA, 25 bp, Mus musculus
ttctccgactctcttcttatctgtg

SEQ ID NO: 941014 - DNA, 25 bp, Mus musculus
ttctccgactctgttcttatctgtg

SEQ ID NO: 941015 - DNA, 25 bp, Mus musculus
ttctccgagaccagggagcgccagc

SEQ ID NO: 941016 - DNA, 25 bp, Mus musculus
ttctccgagacctgggagcgccagc

SEQ ID NO: 941017 - DNA, 25 bp, Mus musculus
ttctccgagctgacctgtgccgaga

SEQ ID NO: 941018 - DNA, 25 bp, Mus musculus
ttctccgagctgagggcctgcaagg

SEQ ID NO: 941019 - DNA, 25 bp, Mus musculus
ttctccgagctgtcctgtgccgaga

SEQ ID NO: 941020 - DNA, 25 bp, Mus musculus
ttctccgagctgtgggcctgcaagg

SEQ ID NO: 941021 - DNA, 25 bp, Mus musculus
ttctccgagtgtactccattgtgat

SEQ ID NO: 941022 - DNA, 25 bp, Mus musculus
ttctccgagtgttctccattgtgat

SEQ ID NO: 941023 - DNA, 25 bp, Mus musculus
ttctccgccatgactgagcacagga

SEQ ID NO: 941024 - DNA, 25 bp, Mus musculus
ttctccgccatgtctgagcacagga

SEQ ID NO: 941025 - DNA, 25 bp, Mus musculus
ttctccgcccaacgtggatgttcgc

SEQ ID NO: 941026 - DNA, 25 bp, Mus musculus
ttctccgcccaaggtggatgttcgc

SEQ ID NO: 941027 - DNA, 25 bp, Mus musculus
ttctccgcgaagcaggtttaactca

SEQ ID NO: 941028 - DNA, 25 bp, Mus musculus
ttctccgcgaaggaggtttaactca

SEQ ID NO: 941029 - DNA, 25 bp, Mus musculus
ttctccgcgtgcctggtcttcctgg

SEQ ID NO: 941030 - DNA, 25 bp, Mus musculus
ttctccgcgtgcgtggtcttcctgg

SEQ ID NO: 941031 - DNA, 25 bp, Mus musculus
ttctccgctcatcgcagagcaggaa

SEQ ID NO: 941032 - DNA, 25 bp, Mus musculus
ttctccgctcatggcagagcaggaa

SEQ ID NO: 941033 - DNA, 25 bp, Mus musculus
ttctccgctgttactgctcagagtt

SEQ ID NO: 941034 - DNA, 25 bp, Mus musculus
ttctccgctgtttctgctcagagtt

SEQ ID NO: 941035 - DNA, 25 bp, Mus musculus
ttctccggcaaaacctactcatatt

SEQ ID NO: 941036 - DNA, 25 bp, Mus musculus
ttctccggcaaatcctactcatatt

SEQ ID NO: 941037 - DNA, 25 bp, Mus musculus
ttctccgggaaccacgttgtgagtg

SEQ ID NO: 941038 - DNA, 25 bp, Mus musculus
ttctccgggaacgacgttgtgagtg

SEQ ID NO: 941039 - DNA, 25 bp, Mus musculus
ttctccggtatcagatccagcaaac

SEQ ID NO: 941040 - DNA, 25 bp, Mus musculus
ttctccggtatctgatccagcaaac

SEQ ID NO: 941041 - DNA, 25 bp, Mus musculus
ttctccggtgacatctatactatac

SEQ ID NO: 941042 - DNA, 25 bp, Mus musculus
ttctccggtgacttctatactatac

SEQ ID NO: 941043 - DNA, 25 bp, Mus musculus
ttctccggtggaccgaaacctggga

SEQ ID NO: 941044 - DNA, 25 bp, Mus musculus
ttctccggtggagcgaaacctggga

SEQ ID NO: 941045 - DNA, 25 bp, Mus musculus
ttctccgtagatcaatggtccttaa

SEQ ID NO: 941046 - DNA, 25 bp, Mus musculus
ttctccgtagatgaatggtccttaa

SEQ ID NO: 941047 - DNA, 25 bp, Mus musculus
ttctccgtctaaacggcaatatggg

SEQ ID NO: 941048 - DNA, 25 bp, Mus musculus
ttctccgtctaatcggcaatatggg

SEQ ID NO: 941049 - DNA, 25 bp, Mus musculus
ttctccgtgagcaggccatcagtgt

SEQ ID NO: 941050 - DNA, 25 bp, Mus musculus
ttctccgtgagctggccatcagtgt

SEQ ID NO: 941051 - DNA, 25 bp, Mus musculus
ttctccgtggcgacaagatgtcctg

SEQ ID NO: 941052 - DNA, 25 bp, Mus musculus
ttctccgtggcgtcaagatgtcctg

SEQ ID NO: 941053 - DNA, 25 bp, Mus musculus
ttctcctaacgtctgtgtggtcggg

SEQ ID NO: 941054 - DNA, 25 bp, Mus musculus
ttctcctaacgtgtgtgtggtcggg

SEQ ID NO: 941055 - DNA, 25 bp, Mus musculus
ttctcctaactcacaaagctcctgt

SEQ ID NO: 941056 - DNA, 25 bp, Mus musculus
ttctcctaactctcaaagctcctgt

SEQ ID NO: 941057 - DNA, 25 bp, Mus musculus
ttctcctaagatattgtggccatgc

SEQ ID NO: 941058 - DNA, 25 bp, Mus musculus
ttctcctaagattttgtggccatgc

SEQ ID NO: 941059 - DNA, 25 bp, Mus musculus
ttctcctaccacattaatgcgggac

SEQ ID NO: 941060 - DNA, 25 bp, Mus musculus
ttctcctaccactttaatgcgggac

SEQ ID NO: 941061 - DNA, 25 bp, Mus musculus
ttctcctaccagacttcgatttttc

SEQ ID NO: 941062 - DNA, 25 bp, Mus musculus
ttctcctaccagtcttcgatttttc

SEQ ID NO: 941063 - DNA, 25 bp, Mus musculus
ttctcctacgcgattctgggctttg

SEQ ID NO: 941064 - DNA, 25 bp, Mus musculus
ttctcctacgcgtttctgggctttg

SEQ ID NO: 941065 - DNA, 25 bp, Mus musculus
ttctcctacgtaatcttttcctgat

SEQ ID NO: 941066 - DNA, 25 bp, Mus musculus
ttctcctacgtattcttttcctgat

SEQ ID NO: 941067 - DNA, 25 bp, Mus musculus
ttctcctaggtaagggctggctcca

SEQ ID NO: 941068 - DNA, 25 bp, Mus musculus
ttctcctaggtatgggctggctcca

SEQ ID NO: 941069 - DNA, 25 bp, Mus musculus
ttctcctatgatcatggtggctaac

SEQ ID NO: 941070 - DNA, 25 bp, Mus musculus
ttctcctatgatgatggtggctaac

SEQ ID NO: 941071 - DNA, 25 bp, Mus musculus
ttctcctatggtagaactcccacag

SEQ ID NO: 941072 - DNA, 25 bp, Mus musculus
ttctcctatggttgaactcccacag

SEQ ID NO: 941073 - DNA, 25 bp, Mus musculus
ttctcctatgtgactaacgccttct

SEQ ID NO: 941074 - DNA, 25 bp, Mus musculus
ttctcctatgtgctcgatggtcatc

SEQ ID NO: 941075 - DNA, 25 bp, Mus musculus
ttctcctatgtggtcgatggtcatc

SEQ ID NO: 941076 - DNA, 25 bp, Mus musculus
ttctcctatgtgtctaacgccttct

SEQ ID NO: 941077 - DNA, 25 bp, Mus musculus
ttctcctcaaggaggtgatgctgtt

SEQ ID NO: 941078 - DNA, 25 bp, Mus musculus
ttctcctcaaggtggtgatgctgtt

SEQ ID NO: 941079 - DNA, 25 bp, Mus musculus
ttctcctcacagctgttagggagct

SEQ ID NO: 941080 - DNA, 25 bp, Mus musculus
ttctcctcacaggtgttagggagct

SEQ ID NO: 941081 - DNA, 25 bp, Mus musculus
ttctcctcacatcattcttttcggg

SEQ ID NO: 941082 - DNA, 25 bp, Mus musculus
ttctcctcacatgattcttttcggg

SEQ ID NO: 941083 - DNA, 25 bp, Mus musculus
ttctcctcacggaatccaattggtt

SEQ ID NO: 941084 - DNA, 25 bp, Mus musculus
ttctcctcacggtatccaattggtt

SEQ ID NO: 941085 - DNA, 25 bp, Mus musculus
ttctcctcactgaagtaaagcacaa

SEQ ID NO: 941086 - DNA, 25 bp, Mus musculus
ttctcctcactgtagtaaagcacaa

SEQ ID NO: 941087 - DNA, 25 bp, Mus musculus
ttctcctcacttctgacaatgcaaa

SEQ ID NO: 941088 - DNA, 25 bp, Mus musculus
ttctcctcacttgtgacaatgcaaa

SEQ ID NO: 941089 - DNA, 25 bp, Mus musculus
ttctcctcagagcaaatccaggctt

SEQ ID NO: 941090 - DNA, 25 bp, Mus musculus
ttctcctcagaggaaatccaggctt

SEQ ID NO: 941091 - DNA, 25 bp, Mus musculus
ttctcctcatgcattatatttctcg

SEQ ID NO: 941092 - DNA, 25 bp, Mus musculus
ttctcctcatgctttatatttctcg

SEQ ID NO: 941093 - DNA, 25 bp, Mus musculus
ttctcctcattgctgggtcagacgc

SEQ ID NO: 941094 - DNA, 25 bp, Mus musculus
ttctcctcattggtgggtcagacgc

SEQ ID NO: 941095 - DNA, 25 bp, Mus musculus
ttctcctccaatcgctgcaagacag

SEQ ID NO: 941096 - DNA, 25 bp, Mus musculus
ttctcctccaatggctgcaagacag

SEQ ID NO: 941097 - DNA, 25 bp, Mus musculus
ttctcctccagtacatattaactcc

SEQ ID NO: 941098 - DNA, 25 bp, Mus musculus
ttctcctccagtctttcggaaagct

SEQ ID NO: 941099 - DNA, 25 bp, Mus musculus
ttctcctccagtgtttcggaaagct

SEQ ID NO: 941100 - DNA, 25 bp, Mus musculus
ttctcctccagttcatattaactcc

SEQ ID NO: 941101 - DNA, 25 bp, Mus musculus
ttctcctcccttcacatcatatggg

SEQ ID NO: 941102 - DNA, 25 bp, Mus musculus
ttctcctcccttgacatcatatggg

SEQ ID NO: 941103 - DNA, 25 bp, Mus musculus
ttctcctcctaaagatgttcctcta

SEQ ID NO: 941104 - DNA, 25 bp, Mus musculus
ttctcctcctaatgatgttcctcta

SEQ ID NO: 941105 - DNA, 25 bp, Mus musculus
ttctcctcctcacaatatgctgtga

SEQ ID NO: 941106 - DNA, 25 bp, Mus musculus
ttctcctcctcagaatatgctgtga

SEQ ID NO: 941107 - DNA, 25 bp, Mus musculus
ttctcctcctctagatcttttagac

SEQ ID NO: 941108 - DNA, 25 bp, Mus musculus
ttctcctcctcttgatcttttagac

SEQ ID NO: 941109 - DNA, 25 bp, Mus musculus
ttctcctcgtcaaatattactgcca

SEQ ID NO: 941110 - DNA, 25 bp, Mus musculus
ttctcctcgtcatatattactgcca

SEQ ID NO: 941111 - DNA, 25 bp, Mus musculus
ttctcctctaacacctgctgtggca

SEQ ID NO: 941112 - DNA, 25 bp, Mus musculus
ttctcctctaactcctgctgtggca

SEQ ID NO: 941113 - DNA, 25 bp, Mus musculus
ttctcctctatcacacttcaaaaaa

SEQ ID NO: 941114 - DNA, 25 bp, Mus musculus
ttctcctctatctcacttcaaaaaa

SEQ ID NO: 941115 - DNA, 25 bp, Mus musculus
ttctcctctcacacttctaagatat

SEQ ID NO: 941116 - DNA, 25 bp, Mus musculus
ttctcctctcactcttctaagatat

SEQ ID NO: 941117 - DNA, 25 bp, Mus musculus
ttctcctctgtactgattgtcacac

SEQ ID NO: 941118 - DNA, 25 bp, Mus musculus
ttctcctctgtagtgattgtcacac

SEQ ID NO: 941119 - DNA, 25 bp, Mus musculus
ttctcctctgttagcattatttgca

SEQ ID NO: 941120 - DNA, 25 bp, Mus musculus
ttctcctctgtttgcattatttgca

SEQ ID NO: 941121 - DNA, 25 bp, Mus musculus
ttctcctcttttacataccatcatt

SEQ ID NO: 941122 - DNA, 25 bp, Mus musculus
ttctcctctttttcataccatcatt

SEQ ID NO: 941123 - DNA, 25 bp, Mus musculus
ttctcctgaagccatctcaaacatt

SEQ ID NO: 941124 - DNA, 25 bp, Mus musculus
ttctcctgaagcgatctcaaacatt

SEQ ID NO: 941125 - DNA, 25 bp, Mus musculus
ttctcctgacctacaccaacgaatg

SEQ ID NO: 941126 - DNA, 25 bp, Mus musculus
ttctcctgaccttcaccaacgaatg

SEQ ID NO: 941127 - DNA, 25 bp, Mus musculus
ttctcctgagtgctaagatcaagag

SEQ ID NO: 941128 - DNA, 25 bp, Mus musculus
ttctcctgagtggtaagatcaagag

SEQ ID NO: 941129 - DNA, 25 bp, Mus musculus
ttctcctgcaaactgagtaccctga

SEQ ID NO: 941130 - DNA, 25 bp, Mus musculus
ttctcctgcaaactgtggactaatc

SEQ ID NO: 941131 - DNA, 25 bp, Mus musculus
ttctcctgcaaagtgagtaccctga

SEQ ID NO: 941132 - DNA, 25 bp, Mus musculus
ttctcctgcaaagtgtggactaatc

SEQ ID NO: 941133 - DNA, 25 bp, Mus musculus
ttctcctggagaagctaatcagcgc

SEQ ID NO: 941134 - DNA, 25 bp, Mus musculus
ttctcctggagatgctaatcagcgc

SEQ ID NO: 941135 - DNA, 25 bp, Mus musculus
ttctcctgggaactgtgttagtgcc

SEQ ID NO: 941136 - DNA, 25 bp, Mus musculus
ttctcctgggaagtgtgttagtgcc

SEQ ID NO: 941137 - DNA, 25 bp, Mus musculus
ttctcctgggctatgaattcctgta

SEQ ID NO: 941138 - DNA, 25 bp, Mus musculus
ttctcctgggctttgaattcctgta

SEQ ID NO: 941139 - DNA, 25 bp, Mus musculus
ttctcctggtcacaaagcggctgct

SEQ ID NO: 941140 - DNA, 25 bp, Mus musculus
ttctcctggtcagaaagcggctgct

SEQ ID NO: 941141 - DNA, 25 bp, Mus musculus
ttctcctggtgcagctgtgaggtca

SEQ ID NO: 941142 - DNA, 25 bp, Mus musculus
ttctcctggtgctgctgtgaggtca

SEQ ID NO: 941143 - DNA, 25 bp, Mus musculus
ttctcctgtacaaacctctttttct

SEQ ID NO: 941144 - DNA, 25 bp, Mus musculus
ttctcctgtacatacctctttttct

SEQ ID NO: 941145 - DNA, 25 bp, Mus musculus
ttctcctgtatcatagcatagtggg

SEQ ID NO: 941146 - DNA, 25 bp, Mus musculus
ttctcctgtatcttagcatagtggg

SEQ ID NO: 941147 - DNA, 25 bp, Mus musculus
ttctcctgtcatcatttttatttga

SEQ ID NO: 941148 - DNA, 25 bp, Mus musculus
ttctcctgtcatgatttttatttga

SEQ ID NO: 941149 - DNA, 25 bp, Mus musculus
ttctcctgtggacccagatgctggc

SEQ ID NO: 941150 - DNA, 25 bp, Mus musculus
ttctcctgtggagccagatgctggc

SEQ ID NO: 941151 - DNA, 25 bp, Mus musculus
ttctcctgttaaacaatgccattgg

SEQ ID NO: 941152 - DNA, 25 bp, Mus musculus
ttctcctgttaatcaatgccattgg

SEQ ID NO: 941153 - DNA, 25 bp, Mus musculus
ttctcctgtttgcttcggatcaaaa

SEQ ID NO: 941154 - DNA, 25 bp, Mus musculus
ttctcctgtttggttcggatcaaaa

SEQ ID NO: 941155 - DNA, 25 bp, Mus musculus
ttctcctgttttcagctgtagagta

SEQ ID NO: 941156 - DNA, 25 bp, Mus musculus
ttctcctgttttgagctgtagagta

SEQ ID NO: 941157 - DNA, 25 bp, Mus musculus
ttctccttacagaatctttacccct

SEQ ID NO: 941158 - DNA, 25 bp, Mus musculus
ttctccttacagtatctttacccct

SEQ ID NO: 941159 - DNA, 25 bp, Mus musculus
ttctccttagcacgcaccataatca

SEQ ID NO: 941160 - DNA, 25 bp, Mus musculus
ttctccttagcaggcaccataatca

SEQ ID NO: 941161 - DNA, 25 bp, Mus musculus
ttctccttaggcctttcacaggtag

SEQ ID NO: 941162 - DNA, 25 bp, Mus musculus
ttctccttaggcgtttcacaggtag

SEQ ID NO: 941163 - DNA, 25 bp, Mus musculus
ttctccttcagaattggtgtccctg

SEQ ID NO: 941164 - DNA, 25 bp, Mus musculus
ttctccttcagatttggtgtccctg

SEQ ID NO: 941165 - DNA, 25 bp, Mus musculus
ttctccttcagcatgtactgcaaag

SEQ ID NO: 941166 - DNA, 25 bp, Mus musculus
ttctccttcagcttgtactgcaaag

SEQ ID NO: 941167 - DNA, 25 bp, Mus musculus
ttctccttcaggacaaatgcattga

SEQ ID NO: 941168 - DNA, 25 bp, Mus musculus
ttctccttcaggtcaaatgcattga

SEQ ID NO: 941169 - DNA, 25 bp, Mus musculus
ttctccttcatgattgattccacca

SEQ ID NO: 941170 - DNA, 25 bp, Mus musculus
ttctccttcatgtttgattccacca

SEQ ID NO: 941171 - DNA, 25 bp, Mus musculus
ttctccttccaccaagcaagagttg

SEQ ID NO: 941172 - DNA, 25 bp, Mus musculus
ttctccttccacgaagcaagagttg

SEQ ID NO: 941173 - DNA, 25 bp, Mus musculus
ttctccttcgcgctggaacaagaca

SEQ ID NO: 941174 - DNA, 25 bp, Mus musculus
ttctccttcgcggtggaacaagaca

SEQ ID NO: 941175 - DNA, 25 bp, Mus musculus
ttctccttctacctgggcagcaaga

SEQ ID NO: 941176 - DNA, 25 bp, Mus musculus
ttctccttctacgtgggcagcaaga

SEQ ID NO: 941177 - DNA, 25 bp, Mus musculus
ttctccttgcagaaatatttccaac

SEQ ID NO: 941178 - DNA, 25 bp, Mus musculus
ttctccttgcagtaatatttccaac

SEQ ID NO: 941179 - DNA, 25 bp, Mus musculus
ttctccttgctacttgatttcctat

SEQ ID NO: 941180 - DNA, 25 bp, Mus musculus
ttctccttgctagttgatttcctat

SEQ ID NO: 941181 - DNA, 25 bp, Mus musculus
ttctccttgctgaccaaaagtctgg

SEQ ID NO: 941182 - DNA, 25 bp, Mus musculus
ttctccttgctgtccaaaagtctgg

SEQ ID NO: 941183 - DNA, 25 bp, Mus musculus
ttctccttggacacactttgtgggt

SEQ ID NO: 941184 - DNA, 25 bp, Mus musculus
ttctccttggactcactttgtgggt

SEQ ID NO: 941185 - DNA, 25 bp, Mus musculus
ttctccttgggaagagtttggctca

SEQ ID NO: 941186 - DNA, 25 bp, Mus musculus
ttctccttgggatgagtttggctca

SEQ ID NO: 941187 - DNA, 25 bp, Mus musculus
ttctccttgttgaggaatattacat

SEQ ID NO: 941188 - DNA, 25 bp, Mus musculus
ttctccttgttgtggaatattacat

SEQ ID NO: 941189 - DNA, 25 bp, Mus musculus
ttctcctttaagcacgtcctggaag

SEQ ID NO: 941190 - DNA, 25 bp, Mus musculus
ttctcctttaaggacgtcctggaag

SEQ ID NO: 941191 - DNA, 25 bp, Mus musculus
ttctcctttctcacgggagttgaga

SEQ ID NO: 941192 - DNA, 25 bp, Mus musculus
ttctcctttctcaggtcagaatagc

SEQ ID NO: 941193 - DNA, 25 bp, Mus musculus
ttctcctttctctcgggagttgaga

SEQ ID NO: 941194 - DNA, 25 bp, Mus musculus
ttctcctttctctggtcagaatagc

SEQ ID NO: 941195 - DNA, 25 bp, Mus musculus
ttctcctttcttaattagcttgtca

SEQ ID NO: 941196 - DNA, 25 bp, Mus musculus
ttctcctttctttattagcttgtca

SEQ ID NO: 941197 - DNA, 25 bp, Mus musculus
ttctcctttgagcacattcgggaag

SEQ ID NO: 941198 - DNA, 25 bp, Mus musculus
ttctcctttgaggacattcgggaag

SEQ ID NO: 941199 - DNA, 25 bp, Mus musculus
ttctcctttgcacgttgtttttcca

SEQ ID NO: 941200 - DNA, 25 bp, Mus musculus
ttctcctttgcaggttgtttttcca

SEQ ID NO: 941201 - DNA, 25 bp, Mus musculus
ttctcctttggtctcttgtctattc

SEQ ID NO: 941202 - DNA, 25 bp, Mus musculus
ttctcctttggtgtcttgtctattc

SEQ ID NO: 941203 - DNA, 25 bp, Mus musculus
ttctccttttaccacatcacatgtg

SEQ ID NO: 941204 - DNA, 25 bp, Mus musculus
ttctccttttacgacatcacatgtg

SEQ ID NO: 941205 - DNA, 25 bp, Mus musculus
ttctccttttatagattgcctccag

SEQ ID NO: 941206 - DNA, 25 bp, Mus musculus
ttctccttttattgattgcctccag

SEQ ID NO: 941207 - DNA, 25 bp, Mus musculus
ttctccttttggcaagtgcttactc

SEQ ID NO: 941208 - DNA, 25 bp, Mus musculus
ttctccttttgggaagtgcttactc

SEQ ID NO: 941209 - DNA, 25 bp, Mus musculus
ttctcctttttaaacagacattcct

SEQ ID NO: 941210 - DNA, 25 bp, Mus musculus
ttctcctttttatacagacattcct

SEQ ID NO: 941211 - DNA, 25 bp, Mus musculus
ttctcgaacacacaggcatatgcaa

SEQ ID NO: 941212 - DNA, 25 bp, Mus musculus
ttctcgaacacagaggcatatgcaa

SEQ ID NO: 941213 - DNA, 25 bp, Mus musculus
ttctcgaacatcatagcgtgaccca

SEQ ID NO: 941214 - DNA, 25 bp, Mus musculus
ttctcgaacatcttagcgtgaccca

SEQ ID NO: 941215 - DNA, 25 bp, Mus musculus
ttctcgaacattagtttcatacaag

SEQ ID NO: 941216 - DNA, 25 bp, Mus musculus
ttctcgaacatttgtttcatacaag

SEQ ID NO: 941217 - DNA, 25 bp, Mus musculus
ttctcgaacccaatccgggtgaagg

SEQ ID NO: 941218 - DNA, 25 bp, Mus musculus
ttctcgaacccattccgggtgaagg

SEQ ID NO: 941219 - DNA, 25 bp, Mus musculus
ttctcgaagctcataatcactttga

SEQ ID NO: 941220 - DNA, 25 bp, Mus musculus
ttctcgaagctcttaatcactttga

SEQ ID NO: 941221 - DNA, 25 bp, Mus musculus
ttctcgaatcaaatctggcacgttt

SEQ ID NO: 941222 - DNA, 25 bp, Mus musculus
ttctcgaatcaattctggcacgttt

SEQ ID NO: 941223 - DNA, 25 bp, Mus musculus
ttctcgaatcagattcattcaccga

SEQ ID NO: 941224 - DNA, 25 bp, Mus musculus
ttctcgaatcagtttcattcaccga

SEQ ID NO: 941225 - DNA, 25 bp, Mus musculus
ttctcgacacctcggaggaatgctt

SEQ ID NO: 941226 - DNA, 25 bp, Mus musculus
ttctcgacacctgggaggaatgctt

SEQ ID NO: 941227 - DNA, 25 bp, Mus musculus
ttctcgaccgaaacgtggctgtcta

SEQ ID NO: 941228 - DNA, 25 bp, Mus musculus
ttctcgaccgaatcgtggctgtcta

SEQ ID NO: 941229 - DNA, 25 bp, Mus musculus
ttctcgactctgaagcccagcagca

SEQ ID NO: 941230 - DNA, 25 bp, Mus musculus
ttctcgactctgtagcccagcagca

SEQ ID NO: 941231 - DNA, 25 bp, Mus musculus
ttctcgagtcctcacttggatggct

SEQ ID NO: 941232 - DNA, 25 bp, Mus musculus
ttctcgagtcctgacttggatggct

SEQ ID NO: 941233 - DNA, 25 bp, Mus musculus
ttctcgagttctaccacagtgaatc

SEQ ID NO: 941234 - DNA, 25 bp, Mus musculus
ttctcgagttcttccacagtgaatc

SEQ ID NO: 941235 - DNA, 25 bp, Mus musculus
ttctcgatcatgaaactttctactt

SEQ ID NO: 941236 - DNA, 25 bp, Mus musculus
ttctcgatcatgtaactttctactt

SEQ ID NO: 941237 - DNA, 25 bp, Mus musculus
ttctcgcacaagagcttgcaggctg

SEQ ID NO: 941238 - DNA, 25 bp, Mus musculus
ttctcgcacaagtgcttgcaggctg

SEQ ID NO: 941239 - DNA, 25 bp, Mus musculus
ttctcgcagggcagtttcttccttt

SEQ ID NO: 941240 - DNA, 25 bp, Mus musculus
ttctcgcagggctgtttcttccttt

SEQ ID NO: 941241 - DNA, 25 bp, Mus musculus
ttctcgcgcacaactgtgacatgag

SEQ ID NO: 941242 - DNA, 25 bp, Mus musculus
ttctcgcgcacatctgtgacatgag

SEQ ID NO: 941243 - DNA, 25 bp, Mus musculus
ttctcgcggtccctgagggtcgcat

SEQ ID NO: 941244 - DNA, 25 bp, Mus musculus
ttctcgcggtccgtgagggtcgcat

SEQ ID NO: 941245 - DNA, 25 bp, Mus musculus
ttctcgctagacactgccgaatggt

SEQ ID NO: 941246 - DNA, 25 bp, Mus musculus
ttctcgctagactctgccgaatggt

SEQ ID NO: 941247 - DNA, 25 bp, Mus musculus
ttctcgctgactcatgctgttttag

SEQ ID NO: 941248 - DNA, 25 bp, Mus musculus
ttctcgctgactgatgctgttttag

SEQ ID NO: 941249 - DNA, 25 bp, Mus musculus
ttctcgcttcctcgcctgatggatt

SEQ ID NO: 941250 - DNA, 25 bp, Mus musculus
ttctcgcttcctggcctgatggatt

SEQ ID NO: 941251 - DNA, 25 bp, Mus musculus
ttctcgctttctcccaatatatcaa

SEQ ID NO: 941252 - DNA, 25 bp, Mus musculus
ttctcgctttctgccaatatatcaa

SEQ ID NO: 941253 - DNA, 25 bp, Mus musculus
ttctcggaacccatatgcaggattt

SEQ ID NO: 941254 - DNA, 25 bp, Mus musculus
ttctcggaacccttatgcaggattt

SEQ ID NO: 941255 - DNA, 25 bp, Mus musculus
ttctcggagaagatcatgccctgga

SEQ ID NO: 941256 - DNA, 25 bp, Mus musculus
ttctcggagaagttcatgccctgga

SEQ ID NO: 941257 - DNA, 25 bp, Mus musculus
ttctcggagcgcagagcccactttc

SEQ ID NO: 941258 - DNA, 25 bp, Mus musculus
ttctcggagcgctgagcccactttc

SEQ ID NO: 941259 - DNA, 25 bp, Mus musculus
ttctcggagctgacttcttgcaggg

SEQ ID NO: 941260 - DNA, 25 bp, Mus musculus
ttctcggagctgtcttcttgcaggg

SEQ ID NO: 941261 - DNA, 25 bp, Mus musculus
ttctcggagtttcacctgtatcacc

SEQ ID NO: 941262 - DNA, 25 bp, Mus musculus
ttctcggagtttgacctgtatcacc

SEQ ID NO: 941263 - DNA, 25 bp, Mus musculus
ttctcggcgctgactgctaaatctg

SEQ ID NO: 941264 - DNA, 25 bp, Mus musculus
ttctcggcgctgtctgctaaatctg

SEQ ID NO: 941265 - DNA, 25 bp, Mus musculus
ttctcggctcacacagcatcattta

SEQ ID NO: 941266 - DNA, 25 bp, Mus musculus
ttctcggctcactcagcatcattta

SEQ ID NO: 941267 - DNA, 25 bp, Mus musculus
ttctcggctgaccatgtgcacggga

SEQ ID NO: 941268 - DNA, 25 bp, Mus musculus
ttctcggctgacgatgtgcacggga

SEQ ID NO: 941269 - DNA, 25 bp, Mus musculus
ttctcgggaaacaattcatactgga

SEQ ID NO: 941270 - DNA, 25 bp, Mus musculus
ttctcgggaaactattcatactgga

SEQ ID NO: 941271 - DNA, 25 bp, Mus musculus
ttctcgggccctagaaggtcagtat

SEQ ID NO: 941272 - DNA, 25 bp, Mus musculus
ttctcgggcccttgaaggtcagtat

SEQ ID NO: 941273 - DNA, 25 bp, Mus musculus
ttctcgggtgagatctatctgtgtt

SEQ ID NO: 941274 - DNA, 25 bp, Mus musculus
ttctcgggtgagttctatctgtgtt

SEQ ID NO: 941275 - DNA, 25 bp, Mus musculus
ttctcgggtgataatggacctgcct

SEQ ID NO: 941276 - DNA, 25 bp, Mus musculus
ttctcgggtgattatggacctgcct

SEQ ID NO: 941277 - DNA, 25 bp, Mus musculus
ttctcggtcaatctgggcttttcac

SEQ ID NO: 941278 - DNA, 25 bp, Mus musculus
ttctcggtcaatgtgggcttttcac

SEQ ID NO: 941279 - DNA, 25 bp, Mus musculus
ttctcggtttttctcttgtcattta

SEQ ID NO: 941280 - DNA, 25 bp, Mus musculus
ttctcggtttttgtcttgtcattta

SEQ ID NO: 941281 - DNA, 25 bp, Mus musculus
ttctcgtaagtcatgaccattactg

SEQ ID NO: 941282 - DNA, 25 bp, Mus musculus
ttctcgtaagtcttgaccattactg

SEQ ID NO: 941283 - DNA, 25 bp, Mus musculus
ttctcgtacccactagaccctgtgg

SEQ ID NO: 941284 - DNA, 25 bp, Mus musculus
ttctcgtacccagtagaccctgtgg

SEQ ID NO: 941285 - DNA, 25 bp, Mus musculus
ttctcgtcaagcatgtctactacca

SEQ ID NO: 941286 - DNA, 25 bp, Mus musculus
ttctcgtcaagcttgtctactacca

SEQ ID NO: 941287 - DNA, 25 bp, Mus musculus
ttctcgtcacgcaagttacagcatc

SEQ ID NO: 941288 - DNA, 25 bp, Mus musculus
ttctcgtcacgctagttacagcatc

SEQ ID NO: 941289 - DNA, 25 bp, Mus musculus
ttctcgtcattgctaaatttgctat

SEQ ID NO: 941290 - DNA, 25 bp, Mus musculus
ttctcgtcattggtaaatttgctat

SEQ ID NO: 941291 - DNA, 25 bp, Mus musculus
ttctcgtcgtgcaaggaaacctgga

SEQ ID NO: 941292 - DNA, 25 bp, Mus musculus
ttctcgtcgtgctaggaaacctgga

SEQ ID NO: 941293 - DNA, 25 bp, Mus musculus
ttctcgtctaagaccagcatctgtg

SEQ ID NO: 941294 - DNA, 25 bp, Mus musculus
ttctcgtctaagtccagcatctgtg

SEQ ID NO: 941295 - DNA, 25 bp, Mus musculus
ttctcgtctctgcacattgaacgat

SEQ ID NO: 941296 - DNA, 25 bp, Mus musculus
ttctcgtctctggacattgaacgat

SEQ ID NO: 941297 - DNA, 25 bp, Mus musculus
ttctcgtctgagctgtggttagtac

SEQ ID NO: 941298 - DNA, 25 bp, Mus musculus
ttctcgtctgaggtgtggttagtac

SEQ ID NO: 941299 - DNA, 25 bp, Mus musculus
ttctcgtgaaatccaatgcagccga

SEQ ID NO: 941300 - DNA, 25 bp, Mus musculus
ttctcgtgaaatgcaatgcagccga

SEQ ID NO: 941301 - DNA, 25 bp, Mus musculus
ttctcgtggccaacttccacaagta

SEQ ID NO: 941302 - DNA, 25 bp, Mus musculus
ttctcgtggccatcttccacaagta

SEQ ID NO: 941303 - DNA, 25 bp, Mus musculus
ttctcgtggtatattgaaccttggc

SEQ ID NO: 941304 - DNA, 25 bp, Mus musculus
ttctcgtggtattttgaaccttggc

SEQ ID NO: 941305 - DNA, 25 bp, Mus musculus
ttctcgtttagaaccacagtggatt

SEQ ID NO: 941306 - DNA, 25 bp, Mus musculus
ttctcgtttagatccacagtggatt

SEQ ID NO: 941307 - DNA, 25 bp, Mus musculus
ttctctaaatacctccctttgctaa

SEQ ID NO: 941308 - DNA, 25 bp, Mus musculus
ttctctaaatacgtccctttgctaa

SEQ ID NO: 941309 - DNA, 25 bp, Mus musculus
ttctctaacaccctagcatgtcttg

SEQ ID NO: 941310 - DNA, 25 bp, Mus musculus
ttctctaacaccgtagcatgtcttg

SEQ ID NO: 941311 - DNA, 25 bp, Mus musculus
ttctctaaccttagctaacttctgt

SEQ ID NO: 941312 - DNA, 25 bp, Mus musculus
ttctctaaccttctcctggacatta

SEQ ID NO: 941313 - DNA, 25 bp, Mus musculus
ttctctaaccttgtcctggacatta

SEQ ID NO: 941314 - DNA, 25 bp, Mus musculus
ttctctaacctttgctaacttctgt

SEQ ID NO: 941315 - DNA, 25 bp, Mus musculus
ttctctaactttagaactccattct

SEQ ID NO: 941316 - DNA, 25 bp, Mus musculus
ttctctaacttttgaactccattct

SEQ ID NO: 941317 - DNA, 25 bp, Mus musculus
ttctctacaagaaccataaacgctg

SEQ ID NO: 941318 - DNA, 25 bp, Mus musculus
ttctctacaagatccataaacgctg

SEQ ID NO: 941319 - DNA, 25 bp, Mus musculus
ttctctacacttaataaaacccaag

SEQ ID NO: 941320 - DNA, 25 bp, Mus musculus
ttctctacactttataaaacccaag

SEQ ID NO: 941321 - DNA, 25 bp, Mus musculus
ttctctacagaaactacccgtgtgt

SEQ ID NO: 941322 - DNA, 25 bp, Mus musculus
ttctctacagaatctacccgtgtgt

SEQ ID NO: 941323 - DNA, 25 bp, Mus musculus
ttctctacagtccaggtgttcctaa

SEQ ID NO: 941324 - DNA, 25 bp, Mus musculus
ttctctacagtcgaggtgttcctaa

SEQ ID NO: 941325 - DNA, 25 bp, Mus musculus
ttctctacatccaagggaatgctgg

SEQ ID NO: 941326 - DNA, 25 bp, Mus musculus
ttctctacatcctagggaatgctgg

SEQ ID NO: 941327 - DNA, 25 bp, Mus musculus
ttctctacatgccactcaaaatgat

SEQ ID NO: 941328 - DNA, 25 bp, Mus musculus
ttctctacatgcgactcaaaatgat

SEQ ID NO: 941329 - DNA, 25 bp, Mus musculus
ttctctaccagacgagtgatgccag

SEQ ID NO: 941330 - DNA, 25 bp, Mus musculus
ttctctaccagaggagtgatgccag

SEQ ID NO: 941331 - DNA, 25 bp, Mus musculus
ttctctacccaaagttctaggccta

SEQ ID NO: 941332 - DNA, 25 bp, Mus musculus
ttctctacccaatgttctaggccta

SEQ ID NO: 941333 - DNA, 25 bp, Mus musculus
ttctctacctataccacgtgaccat

SEQ ID NO: 941334 - DNA, 25 bp, Mus musculus
ttctctacctattccacgtgaccat

SEQ ID NO: 941335 - DNA, 25 bp, Mus musculus
ttctctacctgtcggtctagataat

SEQ ID NO: 941336 - DNA, 25 bp, Mus musculus
ttctctacctgtgggtctagataat

SEQ ID NO: 941337 - DNA, 25 bp, Mus musculus
ttctctactctgatctgtccgtgag

SEQ ID NO: 941338 - DNA, 25 bp, Mus musculus
ttctctactctgttctgtccgtgag

SEQ ID NO: 941339 - DNA, 25 bp, Mus musculus
ttctctagagacagtttccactttt

SEQ ID NO: 941340 - DNA, 25 bp, Mus musculus
ttctctagagactgtttccactttt

SEQ ID NO: 941341 - DNA, 25 bp, Mus musculus
ttctctagatgaaagcttgcggctc

SEQ ID NO: 941342 - DNA, 25 bp, Mus musculus
ttctctagatgatagcttgcggctc

SEQ ID NO: 941343 - DNA, 25 bp, Mus musculus
ttctctagcatgcttgacctctcat

SEQ ID NO: 941344 - DNA, 25 bp, Mus musculus
ttctctagcatggttgacctctcat

SEQ ID NO: 941345 - DNA, 25 bp, Mus musculus
ttctctagcgtaagtggcttcatga

SEQ ID NO: 941346 - DNA, 25 bp, Mus musculus
ttctctagcgtatgtggcttcatga

SEQ ID NO: 941347 - DNA, 25 bp, Mus musculus
ttctctagctgtcacgaccagtcgt

SEQ ID NO: 941348 - DNA, 25 bp, Mus musculus
ttctctagctgtgacgaccagtcgt

SEQ ID NO: 941349 - DNA, 25 bp, Mus musculus
ttctctaggcccacatagtcatgtg

SEQ ID NO: 941350 - DNA, 25 bp, Mus musculus
ttctctaggccctcatagtcatgtg

SEQ ID NO: 941351 - DNA, 25 bp, Mus musculus
ttctctagggagctctttggcctga

SEQ ID NO: 941352 - DNA, 25 bp, Mus musculus
ttctctagggaggtctttggcctga

SEQ ID NO: 941353 - DNA, 25 bp, Mus musculus
ttctctagggccacccgcaggatga

SEQ ID NO: 941354 - DNA, 25 bp, Mus musculus
ttctctagggcctcccgcaggatga

SEQ ID NO: 941355 - DNA, 25 bp, Mus musculus
ttctctaggtggcatgtcagatcca

SEQ ID NO: 941356 - DNA, 25 bp, Mus musculus
ttctctaggtgggatgtcagatcca

SEQ ID NO: 941357 - DNA, 25 bp, Mus musculus
ttctctagtcatagaacacatccag

SEQ ID NO: 941358 - DNA, 25 bp, Mus musculus
ttctctagtcattgaacacatccag

SEQ ID NO: 941359 - DNA, 25 bp, Mus musculus
ttctctagtcttcttcccaatgtag

SEQ ID NO: 941360 - DNA, 25 bp, Mus musculus
ttctctagtcttgttcccaatgtag

SEQ ID NO: 941361 - DNA, 25 bp, Mus musculus
ttctctagtgtcagtctggcctgga

SEQ ID NO: 941362 - DNA, 25 bp, Mus musculus
ttctctagtgtctgtctggcctgga

SEQ ID NO: 941363 - DNA, 25 bp, Mus musculus
ttctctagtgttctgccgcctttta

SEQ ID NO: 941364 - DNA, 25 bp, Mus musculus
ttctctagtgttgtgccgcctttta

SEQ ID NO: 941365 - DNA, 25 bp, Mus musculus
ttctctagttccagatcctgatgct

SEQ ID NO: 941366 - DNA, 25 bp, Mus musculus
ttctctagttcctgatcctgatgct

SEQ ID NO: 941367 - DNA, 25 bp, Mus musculus
ttctctatacttctgttcacttgtt

SEQ ID NO: 941368 - DNA, 25 bp, Mus musculus
ttctctatacttgtgttcacttgtt

SEQ ID NO: 941369 - DNA, 25 bp, Mus musculus
ttctctatcacgacacagttttctc

SEQ ID NO: 941370 - DNA, 25 bp, Mus musculus
ttctctatcacgtcacagttttctc

SEQ ID NO: 941371 - DNA, 25 bp, Mus musculus
ttctctatcccaattctcaaatctt

SEQ ID NO: 941372 - DNA, 25 bp, Mus musculus
ttctctatcccatttctcaaatctt

SEQ ID NO: 941373 - DNA, 25 bp, Mus musculus
ttctctatcgttctatgttccttta

SEQ ID NO: 941374 - DNA, 25 bp, Mus musculus
ttctctatcgttgtatgttccttta

SEQ ID NO: 941375 - DNA, 25 bp, Mus musculus
ttctctatctcgcttggattctcta

SEQ ID NO: 941376 - DNA, 25 bp, Mus musculus
ttctctatctcggttggattctcta

SEQ ID NO: 941377 - DNA, 25 bp, Mus musculus
ttctctatgaccacagcccgtgtgt

SEQ ID NO: 941378 - DNA, 25 bp, Mus musculus
ttctctatgacctcagcccgtgtgt

SEQ ID NO: 941379 - DNA, 25 bp, Mus musculus
ttctctatgcctagctggaatgagt

SEQ ID NO: 941380 - DNA, 25 bp, Mus musculus
ttctctatgccttgctggaatgagt

SEQ ID NO: 941381 - DNA, 25 bp, Mus musculus
ttctctattcttacttggaagtaca

SEQ ID NO: 941382 - DNA, 25 bp, Mus musculus
ttctctattctttcttggaagtaca

SEQ ID NO: 941383 - DNA, 25 bp, Mus musculus
ttctctatttttatgtcagtgcatc

SEQ ID NO: 941384 - DNA, 25 bp, Mus musculus
ttctctatttttttgtcagtgcatc

SEQ ID NO: 941385 - DNA, 25 bp, Mus musculus
ttctctcaagtcaccaaatgcattt

SEQ ID NO: 941386 - DNA, 25 bp, Mus musculus
ttctctcaagtctccaaatgcattt

SEQ ID NO: 941387 - DNA, 25 bp, Mus musculus
ttctctcacactcctaatctttgga

SEQ ID NO: 941388 - DNA, 25 bp, Mus musculus
ttctctcacactgctaatctttgga

SEQ ID NO: 941389 - DNA, 25 bp, Mus musculus
ttctctcacgtaagagtacctcacg

SEQ ID NO: 941390 - DNA, 25 bp, Mus musculus
ttctctcacgtatgagtacctcacg

SEQ ID NO: 941391 - DNA, 25 bp, Mus musculus
ttctctcactgaagtccgactaggc

SEQ ID NO: 941392 - DNA, 25 bp, Mus musculus
ttctctcactgatgtccgactaggc

SEQ ID NO: 941393 - DNA, 25 bp, Mus musculus
ttctctcactttaaagtctgctcat

SEQ ID NO: 941394 - DNA, 25 bp, Mus musculus
ttctctcacttttaagtctgctcat

SEQ ID NO: 941395 - DNA, 25 bp, Mus musculus
ttctctcagagcagcatgcatctag

SEQ ID NO: 941396 - DNA, 25 bp, Mus musculus
ttctctcagagctgcatgcatctag

SEQ ID NO: 941397 - DNA, 25 bp, Mus musculus
ttctctcagaggacagcaagtgaca

SEQ ID NO: 941398 - DNA, 25 bp, Mus musculus
ttctctcagaggatccctcttagaa

SEQ ID NO: 941399 - DNA, 25 bp, Mus musculus
ttctctcagaggtcagcaagtgaca

SEQ ID NO: 941400 - DNA, 25 bp, Mus musculus
ttctctcagaggttccctcttagaa

SEQ ID NO: 941401 - DNA, 25 bp, Mus musculus
ttctctcagagtctgcccgtggttc

SEQ ID NO: 941402 - DNA, 25 bp, Mus musculus
ttctctcagagtgtgcccgtggttc

SEQ ID NO: 941403 - DNA, 25 bp, Mus musculus
ttctctcagcgtctggctgaactgg

SEQ ID NO: 941404 - DNA, 25 bp, Mus musculus
ttctctcagcgtgtggctgaactgg

SEQ ID NO: 941405 - DNA, 25 bp, Mus musculus
ttctctcagcttaagggatcctcag

SEQ ID NO: 941406 - DNA, 25 bp, Mus musculus
ttctctcagctttagggatcctcag

SEQ ID NO: 941407 - DNA, 25 bp, Mus musculus
ttctctcaggaaagaacccccatat

SEQ ID NO: 941408 - DNA, 25 bp, Mus musculus
ttctctcaggaactagggtgtggtt

SEQ ID NO: 941409 - DNA, 25 bp, Mus musculus
ttctctcaggaagtagggtgtggtt

SEQ ID NO: 941410 - DNA, 25 bp, Mus musculus
ttctctcaggaatgaacccccatat

SEQ ID NO: 941411 - DNA, 25 bp, Mus musculus
ttctctcaggccatatgacaattgg

SEQ ID NO: 941412 - DNA, 25 bp, Mus musculus
ttctctcaggccttatgacaattgg

SEQ ID NO: 941413 - DNA, 25 bp, Mus musculus
ttctctcagggtaagttactcgttt

SEQ ID NO: 941414 - DNA, 25 bp, Mus musculus
ttctctcagggttagttactcgttt

SEQ ID NO: 941415 - DNA, 25 bp, Mus musculus
ttctctcaggtccatgaggcgtcaa

SEQ ID NO: 941416 - DNA, 25 bp, Mus musculus
ttctctcaggtcgatgaggcgtcaa

SEQ ID NO: 941417 - DNA, 25 bp, Mus musculus
ttctctcagtcgccggaagaccctt

SEQ ID NO: 941418 - DNA, 25 bp, Mus musculus
ttctctcagtcggcggaagaccctt

SEQ ID NO: 941419 - DNA, 25 bp, Mus musculus
ttctctcagtctcctgcttggagtt

SEQ ID NO: 941420 - DNA, 25 bp, Mus musculus
ttctctcagtctgctgcttggagtt

SEQ ID NO: 941421 - DNA, 25 bp, Mus musculus
ttctctcatatcactgtctactttc

SEQ ID NO: 941422 - DNA, 25 bp, Mus musculus
ttctctcatatctctgtctactttc

SEQ ID NO: 941423 - DNA, 25 bp, Mus musculus
ttctctcatcatacagcattcatct

SEQ ID NO: 941424 - DNA, 25 bp, Mus musculus
ttctctcatcatatgtcccgggatt

SEQ ID NO: 941425 - DNA, 25 bp, Mus musculus
ttctctcatcattcagcattcatct

SEQ ID NO: 941426 - DNA, 25 bp, Mus musculus
ttctctcatcatttgtcccgggatt

SEQ ID NO: 941427 - DNA, 25 bp, Mus musculus
ttctctcatccactttctatgtgta

SEQ ID NO: 941428 - DNA, 25 bp, Mus musculus
ttctctcatccagtttctatgtgta

SEQ ID NO: 941429 - DNA, 25 bp, Mus musculus
ttctctcattccactgattctggta

SEQ ID NO: 941430 - DNA, 25 bp, Mus musculus
ttctctcattcctctgattctggta

SEQ ID NO: 941431 - DNA, 25 bp, Mus musculus
ttctctcattgcctcaaatgacttg

SEQ ID NO: 941432 - DNA, 25 bp, Mus musculus
ttctctcattgcgtcaaatgacttg

SEQ ID NO: 941433 - DNA, 25 bp, Mus musculus
ttctctccaatgatgccgaatacgg

SEQ ID NO: 941434 - DNA, 25 bp, Mus musculus
ttctctccaatgcaactcggtgtga

SEQ ID NO: 941435 - DNA, 25 bp, Mus musculus
ttctctccaatggaactcggtgtga

SEQ ID NO: 941436 - DNA, 25 bp, Mus musculus
ttctctccaatgttgccgaatacgg

SEQ ID NO: 941437 - DNA, 25 bp, Mus musculus
ttctctccacacatctgagataaac

SEQ ID NO: 941438 - DNA, 25 bp, Mus musculus
ttctctccacacttctgagataaac

SEQ ID NO: 941439 - DNA, 25 bp, Mus musculus
ttctctccactacctgagggctata

SEQ ID NO: 941440 - DNA, 25 bp, Mus musculus
ttctctccactagctgagggctata

SEQ ID NO: 941441 - DNA, 25 bp, Mus musculus
ttctctccagaccaaaaaacaccat

SEQ ID NO: 941442 - DNA, 25 bp, Mus musculus
ttctctccagacgaaaaaacaccat

SEQ ID NO: 941443 - DNA, 25 bp, Mus musculus
ttctctccagagatcatcgtcagtg

SEQ ID NO: 941444 - DNA, 25 bp, Mus musculus
ttctctccagagttcatcgtcagtg

SEQ ID NO: 941445 - DNA, 25 bp, Mus musculus
ttctctccaggacccaagttttagg

SEQ ID NO: 941446 - DNA, 25 bp, Mus musculus
ttctctccaggactcaggcttgcca

SEQ ID NO: 941447 - DNA, 25 bp, Mus musculus
ttctctccaggagccaagttttagg

SEQ ID NO: 941448 - DNA, 25 bp, Mus musculus
ttctctccaggagtcaggcttgcca

SEQ ID NO: 941449 - DNA, 25 bp, Mus musculus
ttctctccaggcaatgtgtttaaga

SEQ ID NO: 941450 - DNA, 25 bp, Mus musculus
ttctctccaggctatgtgtttaaga

SEQ ID NO: 941451 - DNA, 25 bp, Mus musculus
ttctctccattgacctttgtgttct

SEQ ID NO: 941452 - DNA, 25 bp, Mus musculus
ttctctccattgtcctttgtgttct

SEQ ID NO: 941453 - DNA, 25 bp, Mus musculus
ttctctcccctgaatatgtaggtgt

SEQ ID NO: 941454 - DNA, 25 bp, Mus musculus
ttctctcccctgtatatgtaggtgt

SEQ ID NO: 941455 - DNA, 25 bp, Mus musculus
ttctctcccggaacttaaggtccag

SEQ ID NO: 941456 - DNA, 25 bp, Mus musculus
ttctctcccggatcttaaggtccag

SEQ ID NO: 941457 - DNA, 25 bp, Mus musculus
ttctctccctgcatagcttttaaaa

SEQ ID NO: 941458 - DNA, 25 bp, Mus musculus
ttctctccctgcttagcttttaaaa

SEQ ID NO: 941459 - DNA, 25 bp, Mus musculus
ttctctccctgtcactaatgtcaga

SEQ ID NO: 941460 - DNA, 25 bp, Mus musculus
ttctctccctgtgactaatgtcaga

SEQ ID NO: 941461 - DNA, 25 bp, Mus musculus
ttctctccggttagttatctgcagt

SEQ ID NO: 941462 - DNA, 25 bp, Mus musculus
ttctctccggtttgttatctgcagt

SEQ ID NO: 941463 - DNA, 25 bp, Mus musculus
ttctctcctagaaccacttggaatg

SEQ ID NO: 941464 - DNA, 25 bp, Mus musculus
ttctctcctagatccacttggaatg

SEQ ID NO: 941465 - DNA, 25 bp, Mus musculus
ttctctcctcagatcctaaggaagg

SEQ ID NO: 941466 - DNA, 25 bp, Mus musculus
ttctctcctcagttcctaaggaagg

SEQ ID NO: 941467 - DNA, 25 bp, Mus musculus
ttctctcctcggaaactgaaaacat

SEQ ID NO: 941468 - DNA, 25 bp, Mus musculus
ttctctcctcggtaactgaaaacat

SEQ ID NO: 941469 - DNA, 25 bp, Mus musculus
ttctctcctctgagagtgaaggtgt

SEQ ID NO: 941470 - DNA, 25 bp, Mus musculus
ttctctcctctgtgagtgaaggtgt

SEQ ID NO: 941471 - DNA, 25 bp, Mus musculus
ttctctcctgcacacatcagtgtgc

SEQ ID NO: 941472 - DNA, 25 bp, Mus musculus
ttctctcctgcagacatcagtgtgc

SEQ ID NO: 941473 - DNA, 25 bp, Mus musculus
ttctctcctggacaaagtttctcaa

SEQ ID NO: 941474 - DNA, 25 bp, Mus musculus
ttctctcctggagaaagtttctcaa

SEQ ID NO: 941475 - DNA, 25 bp, Mus musculus
ttctctccttgaagaaataatccta

SEQ ID NO: 941476 - DNA, 25 bp, Mus musculus
ttctctccttgatgaaataatccta

SEQ ID NO: 941477 - DNA, 25 bp, Mus musculus
ttctctccttttccctttcagggtt

SEQ ID NO: 941478 - DNA, 25 bp, Mus musculus
ttctctccttttgcctttcagggtt

SEQ ID NO: 941479 - DNA, 25 bp, Mus musculus
ttctctcgcactccctggaaagtga

SEQ ID NO: 941480 - DNA, 25 bp, Mus musculus
ttctctcgcactgcctggaaagtga

SEQ ID NO: 941481 - DNA, 25 bp, Mus musculus
ttctctcggctaacctttctgctaa

SEQ ID NO: 941482 - DNA, 25 bp, Mus musculus
ttctctcggctatcctttctgctaa

SEQ ID NO: 941483 - DNA, 25 bp, Mus musculus
ttctctcggctgatcgtggagctgc

SEQ ID NO: 941484 - DNA, 25 bp, Mus musculus
ttctctcggctgttcgtggagctgc

SEQ ID NO: 941485 - DNA, 25 bp, Mus musculus
ttctctcggttcatacaaaggacct

SEQ ID NO: 941486 - DNA, 25 bp, Mus musculus
ttctctcggttcttacaaaggacct

SEQ ID NO: 941487 - DNA, 25 bp, Mus musculus
ttctctcgtggacagcatctctggg

SEQ ID NO: 941488 - DNA, 25 bp, Mus musculus
ttctctcgtggagagcatctctggg

SEQ ID NO: 941489 - DNA, 25 bp, Mus musculus
ttctctctaagccttcccagttaaa

SEQ ID NO: 941490 - DNA, 25 bp, Mus musculus
ttctctctaagcgttcccagttaaa

SEQ ID NO: 941491 - DNA, 25 bp, Mus musculus
ttctctctagacactccagcaaaat

SEQ ID NO: 941492 - DNA, 25 bp, Mus musculus
ttctctctagactctccagcaaaat

SEQ ID NO: 941493 - DNA, 25 bp, Mus musculus
ttctctctatcaagtgctctctgga

SEQ ID NO: 941494 - DNA, 25 bp, Mus musculus
ttctctctatcatgtgctctctgga

SEQ ID NO: 941495 - DNA, 25 bp, Mus musculus
ttctctctatctagggactatcata

SEQ ID NO: 941496 - DNA, 25 bp, Mus musculus
ttctctctatcttgggactatcata

SEQ ID NO: 941497 - DNA, 25 bp, Mus musculus
ttctctctcagacctgtttggcaac

SEQ ID NO: 941498 - DNA, 25 bp, Mus musculus
ttctctctcagagctgtttggcaac

SEQ ID NO: 941499 - DNA, 25 bp, Mus musculus
ttctctctccaaagacatgaaaatt

SEQ ID NO: 941500 - DNA, 25 bp, Mus musculus
ttctctctccaatgacatgaaaatt

SEQ ID NO: 941501 - DNA, 25 bp, Mus musculus
ttctctctccacaccaggagacgga

SEQ ID NO: 941502 - DNA, 25 bp, Mus musculus
ttctctctccactccaggagacgga

SEQ ID NO: 941503 - DNA, 25 bp, Mus musculus
ttctctctccatctggttgatagag

SEQ ID NO: 941504 - DNA, 25 bp, Mus musculus
ttctctctccatgtggttgatagag

SEQ ID NO: 941505 - DNA, 25 bp, Mus musculus
ttctctctccctagaccattctggg

SEQ ID NO: 941506 - DNA, 25 bp, Mus musculus
ttctctctccctcgaatacattcag

SEQ ID NO: 941507 - DNA, 25 bp, Mus musculus
ttctctctccctggaatacattcag

SEQ ID NO: 941508 - DNA, 25 bp, Mus musculus
ttctctctcccttgaccattctggg

SEQ ID NO: 941509 - DNA, 25 bp, Mus musculus
ttctctctcctaaaaatttactctt

SEQ ID NO: 941510 - DNA, 25 bp, Mus musculus
ttctctctcctataaatttactctt

SEQ ID NO: 941511 - DNA, 25 bp, Mus musculus
ttctctctcctccagtatgactgag

SEQ ID NO: 941512 - DNA, 25 bp, Mus musculus
ttctctctcctcgagtatgactgag

SEQ ID NO: 941513 - DNA, 25 bp, Mus musculus
ttctctctcctgagttgctcatttg

SEQ ID NO: 941514 - DNA, 25 bp, Mus musculus
ttctctctcctgataaactctcttt

SEQ ID NO: 941515 - DNA, 25 bp, Mus musculus
ttctctctcctgtgttgctcatttg

SEQ ID NO: 941516 - DNA, 25 bp, Mus musculus
ttctctctcctgttaaactctcttt

SEQ ID NO: 941517 - DNA, 25 bp, Mus musculus
ttctctctctaaaacacttctctat

SEQ ID NO: 941518 - DNA, 25 bp, Mus musculus
ttctctctctaaagtgcaacaagga

SEQ ID NO: 941519 - DNA, 25 bp, Mus musculus
ttctctctctaatacacttctctat

SEQ ID NO: 941520 - DNA, 25 bp, Mus musculus
ttctctctctaatgtgcaacaagga

SEQ ID NO: 941521 - DNA, 25 bp, Mus musculus
ttctctctctcaactcctggtaaac

SEQ ID NO: 941522 - DNA, 25 bp, Mus musculus
ttctctctctcacaccagatttaca

SEQ ID NO: 941523 - DNA, 25 bp, Mus musculus
ttctctctctcagaccagatttaca

SEQ ID NO: 941524 - DNA, 25 bp, Mus musculus
ttctctctctcatctcctggtaaac

SEQ ID NO: 941525 - DNA, 25 bp, Mus musculus
ttctctctctctatggaatattcgg

SEQ ID NO: 941526 - DNA, 25 bp, Mus musculus
ttctctctctctttggaatattcgg

SEQ ID NO: 941527 - DNA, 25 bp, Mus musculus
ttctctctcttccattccgtttaag

SEQ ID NO: 941528 - DNA, 25 bp, Mus musculus
ttctctctcttcgattccgtttaag

SEQ ID NO: 941529 - DNA, 25 bp, Mus musculus
ttctctctcttgctctaacgtggga

SEQ ID NO: 941530 - DNA, 25 bp, Mus musculus
ttctctctcttggtctaacgtggga

SEQ ID NO: 941531 - DNA, 25 bp, Mus musculus
ttctctctgaccatgtgccaagaag

SEQ ID NO: 941532 - DNA, 25 bp, Mus musculus
ttctctctgaccttgtgccaagaag

SEQ ID NO: 941533 - DNA, 25 bp, Mus musculus
ttctctctgatgacctaactcgtaa

SEQ ID NO: 941534 - DNA, 25 bp, Mus musculus
ttctctctgatgtcctaactcgtaa

SEQ ID NO: 941535 - DNA, 25 bp, Mus musculus
ttctctctgcatcttggaagggagg

SEQ ID NO: 941536 - DNA, 25 bp, Mus musculus
ttctctctgcatgttggaagggagg

SEQ ID NO: 941537 - DNA, 25 bp, Mus musculus
ttctctctgcgtcgaaactcaattc

SEQ ID NO: 941538 - DNA, 25 bp, Mus musculus
ttctctctgcgtggaaactcaattc

SEQ ID NO: 941539 - DNA, 25 bp, Mus musculus
ttctctctgctactgtttttgaaga

SEQ ID NO: 941540 - DNA, 25 bp, Mus musculus
ttctctctgctagtgtttttgaaga

SEQ ID NO: 941541 - DNA, 25 bp, Mus musculus
ttctctctgctccaataagtgctgg

SEQ ID NO: 941542 - DNA, 25 bp, Mus musculus
ttctctctgctcgaataagtgctgg

SEQ ID NO: 941543 - DNA, 25 bp, Mus musculus
ttctctctgctgaaaatatgtcttc

SEQ ID NO: 941544 - DNA, 25 bp, Mus musculus
ttctctctgctgtaaatatgtcttc

SEQ ID NO: 941545 - DNA, 25 bp, Mus musculus
ttctctctggcactacagggcaata

SEQ ID NO: 941546 - DNA, 25 bp, Mus musculus
ttctctctggcagtacagggcaata

SEQ ID NO: 941547 - DNA, 25 bp, Mus musculus
ttctctctgggcacttgaagggtct

SEQ ID NO: 941548 - DNA, 25 bp, Mus musculus
ttctctctgggctcttgaagggtct

SEQ ID NO: 941549 - DNA, 25 bp, Mus musculus
ttctctctgtctcttatgttcatca

SEQ ID NO: 941550 - DNA, 25 bp, Mus musculus
ttctctctgtctgttatgttcatca

SEQ ID NO: 941551 - DNA, 25 bp, Mus musculus
ttctctctgtggaaccgacatgcga

SEQ ID NO: 941552 - DNA, 25 bp, Mus musculus
ttctctctgtggtaccgacatgcga

SEQ ID NO: 941553 - DNA, 25 bp, Mus musculus
ttctctctgtgtaactttgatgtta

SEQ ID NO: 941554 - DNA, 25 bp, Mus musculus
ttctctctgtgttactttgatgtta

SEQ ID NO: 941555 - DNA, 25 bp, Mus musculus
ttctctcttaatagccagggaactc

SEQ ID NO: 941556 - DNA, 25 bp, Mus musculus
ttctctcttaatcctagggcgtaaa

SEQ ID NO: 941557 - DNA, 25 bp, Mus musculus
ttctctcttaatgctagggcgtaaa

SEQ ID NO: 941558 - DNA, 25 bp, Mus musculus
ttctctcttaattgccagggaactc

SEQ ID NO: 941559 - DNA, 25 bp, Mus musculus
ttctctcttacacacgagcagtttg

SEQ ID NO: 941560 - DNA, 25 bp, Mus musculus
ttctctcttacagacgagcagtttg

SEQ ID NO: 941561 - DNA, 25 bp, Mus musculus
ttctctcttagtctctggcattcag

SEQ ID NO: 941562 - DNA, 25 bp, Mus musculus
ttctctcttagtgtctggcattcag

SEQ ID NO: 941563 - DNA, 25 bp, Mus musculus
ttctctcttccacctgtgagttata

SEQ ID NO: 941564 - DNA, 25 bp, Mus musculus
ttctctcttccagctgtgagttata

SEQ ID NO: 941565 - DNA, 25 bp, Mus musculus
ttctctcttctgcagccattaaacc

SEQ ID NO: 941566 - DNA, 25 bp, Mus musculus
ttctctcttctggagccattaaacc

SEQ ID NO: 941567 - DNA, 25 bp, Mus musculus
ttctctcttgacaccacttacaggt

SEQ ID NO: 941568 - DNA, 25 bp, Mus musculus
ttctctcttgactccacttacaggt

SEQ ID NO: 941569 - DNA, 25 bp, Mus musculus
ttctctcttggcagtgatggcacca

SEQ ID NO: 941570 - DNA, 25 bp, Mus musculus
ttctctcttggctgtgatggcacca

SEQ ID NO: 941571 - DNA, 25 bp, Mus musculus
ttctctcttggtattggccatttgc

SEQ ID NO: 941572 - DNA, 25 bp, Mus musculus
ttctctcttggtcagttcctagcag

SEQ ID NO: 941573 - DNA, 25 bp, Mus musculus
ttctctcttggtctctgtttaatgt

SEQ ID NO: 941574 - DNA, 25 bp, Mus musculus
ttctctcttggtgagttcctagcag

SEQ ID NO: 941575 - DNA, 25 bp, Mus musculus
ttctctcttggtgtctgtttaatgt

SEQ ID NO: 941576 - DNA, 25 bp, Mus musculus
ttctctcttggttttggccatttgc

SEQ ID NO: 941577 - DNA, 25 bp, Mus musculus
ttctctcttgtaccttgcttgcaga

SEQ ID NO: 941578 - DNA, 25 bp, Mus musculus
ttctctcttgtagcttgcttgcaga

SEQ ID NO: 941579 - DNA, 25 bp, Mus musculus
ttctctcttgttaaagtcactgcta

SEQ ID NO: 941580 - DNA, 25 bp, Mus musculus
ttctctcttgtttaagtcactgcta

SEQ ID NO: 941581 - DNA, 25 bp, Mus musculus
ttctctctttccacatctcttatat

SEQ ID NO: 941582 - DNA, 25 bp, Mus musculus
ttctctctttcctcatctcttatat

SEQ ID NO: 941583 - DNA, 25 bp, Mus musculus
ttctctctttgaagagctgctgttg

SEQ ID NO: 941584 - DNA, 25 bp, Mus musculus
ttctctctttgatgagctgctgttg

SEQ ID NO: 941585 - DNA, 25 bp, Mus musculus
ttctctcttttaacttcgggcaaat

SEQ ID NO: 941586 - DNA, 25 bp, Mus musculus
ttctctcttttatcttcgggcaaat

SEQ ID NO: 941587 - DNA, 25 bp, Mus musculus
ttctctcttttcatcactcactaaa

SEQ ID NO: 941588 - DNA, 25 bp, Mus musculus
ttctctcttttcttcactcactaaa

SEQ ID NO: 941589 - DNA, 25 bp, Mus musculus
ttctctcttttgaaattttataaca

SEQ ID NO: 941590 - DNA, 25 bp, Mus musculus
ttctctcttttgtaattttataaca

SEQ ID NO: 941591 - DNA, 25 bp, Mus musculus
ttctctgaacacaggcagctttcta

SEQ ID NO: 941592 - DNA, 25 bp, Mus musculus
ttctctgaacactggcagctttcta

SEQ ID NO: 941593 - DNA, 25 bp, Mus musculus
ttctctgaacctctaatataacttg

SEQ ID NO: 941594 - DNA, 25 bp, Mus musculus
ttctctgaacctgtaatataacttg

SEQ ID NO: 941595 - DNA, 25 bp, Mus musculus
ttctctgaagccaagatcctcttcc

SEQ ID NO: 941596 - DNA, 25 bp, Mus musculus
ttctctgaagcctagatcctcttcc

SEQ ID NO: 941597 - DNA, 25 bp, Mus musculus
ttctctgaagtcaactgatctccca

SEQ ID NO: 941598 - DNA, 25 bp, Mus musculus
ttctctgaagtcctgggtagtgccc

SEQ ID NO: 941599 - DNA, 25 bp, Mus musculus
ttctctgaagtcgtgggtagtgccc

SEQ ID NO: 941600 - DNA, 25 bp, Mus musculus
ttctctgaagtctactgatctccca

SEQ ID NO: 941601 - DNA, 25 bp, Mus musculus
ttctctgaatctaaggttcctcaca

SEQ ID NO: 941602 - DNA, 25 bp, Mus musculus
ttctctgaatcttaggttcctcaca

SEQ ID NO: 941603 - DNA, 25 bp, Mus musculus
ttctctgacactagcacactggtgg

SEQ ID NO: 941604 - DNA, 25 bp, Mus musculus
ttctctgacacttgcacactggtgg

SEQ ID NO: 941605 - DNA, 25 bp, Mus musculus
ttctctgaccatactagtgtactgc

SEQ ID NO: 941606 - DNA, 25 bp, Mus musculus
ttctctgaccattctagtgtactgc

SEQ ID NO: 941607 - DNA, 25 bp, Mus musculus
ttctctgaccctagccaaggagtgt

SEQ ID NO: 941608 - DNA, 25 bp, Mus musculus
ttctctgacccttgccaaggagtgt

SEQ ID NO: 941609 - DNA, 25 bp, Mus musculus
ttctctgacctgaccatagcgtgtg

SEQ ID NO: 941610 - DNA, 25 bp, Mus musculus
ttctctgacctgtccatagcgtgtg

SEQ ID NO: 941611 - DNA, 25 bp, Mus musculus
ttctctgactctaccgaccgaagaa

SEQ ID NO: 941612 - DNA, 25 bp, Mus musculus
ttctctgactcttccgaccgaagaa

SEQ ID NO: 941613 - DNA, 25 bp, Mus musculus
ttctctgagatgaccttgctctgat

SEQ ID NO: 941614 - DNA, 25 bp, Mus musculus
ttctctgagatgtccttgctctgat

SEQ ID NO: 941615 - DNA, 25 bp, Mus musculus
ttctctgagcagagccaggttctca

SEQ ID NO: 941616 - DNA, 25 bp, Mus musculus
ttctctgagcagtgccaggttctca

SEQ ID NO: 941617 - DNA, 25 bp, Mus musculus
ttctctgagccaagctgccaagaca

SEQ ID NO: 941618 - DNA, 25 bp, Mus musculus
ttctctgagccatgctgccaagaca

SEQ ID NO: 941619 - DNA, 25 bp, Mus musculus
ttctctgagcctatacccgttaagg

SEQ ID NO: 941620 - DNA, 25 bp, Mus musculus
ttctctgagcctttacccgttaagg

SEQ ID NO: 941621 - DNA, 25 bp, Mus musculus
ttctctgaggccaatgagcggtacc

SEQ ID NO: 941622 - DNA, 25 bp, Mus musculus
ttctctgaggcctatgagcggtacc

SEQ ID NO: 941623 - DNA, 25 bp, Mus musculus
ttctctgagggtagggcgcttttta

SEQ ID NO: 941624 - DNA, 25 bp, Mus musculus
ttctctgagggttgggcgcttttta

SEQ ID NO: 941625 - DNA, 25 bp, Mus musculus
ttctctgaggtcacgccatcgatgc

SEQ ID NO: 941626 - DNA, 25 bp, Mus musculus
ttctctgaggtctcgccatcgatgc

SEQ ID NO: 941627 - DNA, 25 bp, Mus musculus
ttctctgataagctggatttcctgg

SEQ ID NO: 941628 - DNA, 25 bp, Mus musculus
ttctctgataaggtggatttcctgg

SEQ ID NO: 941629 - DNA, 25 bp, Mus musculus
ttctctgatagaaacaattccctgt

SEQ ID NO: 941630 - DNA, 25 bp, Mus musculus
ttctctgatagatacaattccctgt

SEQ ID NO: 941631 - DNA, 25 bp, Mus musculus
ttctctgatccaagaactcaaagtt

SEQ ID NO: 941632 - DNA, 25 bp, Mus musculus
ttctctgatccatgaactcaaagtt

SEQ ID NO: 941633 - DNA, 25 bp, Mus musculus
ttctctgatcctcgaaaagtttctt

SEQ ID NO: 941634 - DNA, 25 bp, Mus musculus
ttctctgatcctggaaaagtttctt

SEQ ID NO: 941635 - DNA, 25 bp, Mus musculus
ttctctgcaatacttgataaagcat

SEQ ID NO: 941636 - DNA, 25 bp, Mus musculus
ttctctgcaatagttgataaagcat

SEQ ID NO: 941637 - DNA, 25 bp, Mus musculus
ttctctgcactgattggccagcata

SEQ ID NO: 941638 - DNA, 25 bp, Mus musculus
ttctctgcactgtttggccagcata

SEQ ID NO: 941639 - DNA, 25 bp, Mus musculus
ttctctgcagatcatggggcccttg

SEQ ID NO: 941640 - DNA, 25 bp, Mus musculus
ttctctgcagatgatggggcccttg

SEQ ID NO: 941641 - DNA, 25 bp, Mus musculus
ttctctgcagctatgttgcttcagg

SEQ ID NO: 941642 - DNA, 25 bp, Mus musculus
ttctctgcagctttgttgcttcagg

SEQ ID NO: 941643 - DNA, 25 bp, Mus musculus
ttctctgcagttaatgcattcgctg

SEQ ID NO: 941644 - DNA, 25 bp, Mus musculus
ttctctgcagtttatgcattcgctg

SEQ ID NO: 941645 - DNA, 25 bp, Mus musculus
ttctctgcatctccagtttctttaa

SEQ ID NO: 941646 - DNA, 25 bp, Mus musculus
ttctctgcatctgcagtttctttaa

SEQ ID NO: 941647 - DNA, 25 bp, Mus musculus
ttctctgccactaaaaactaatcca

SEQ ID NO: 941648 - DNA, 25 bp, Mus musculus
ttctctgccacttaaaactaatcca

SEQ ID NO: 941649 - DNA, 25 bp, Mus musculus
ttctctgccattcttgcccaaaaac

SEQ ID NO: 941650 - DNA, 25 bp, Mus musculus
ttctctgccattgttgcccaaaaac

SEQ ID NO: 941651 - DNA, 25 bp, Mus musculus
ttctctgccctgagcagcaagaact

SEQ ID NO: 941652 - DNA, 25 bp, Mus musculus
ttctctgccctgtgcagcaagaact

SEQ ID NO: 941653 - DNA, 25 bp, Mus musculus
ttctctgccgagaggagcacagtgc

SEQ ID NO: 941654 - DNA, 25 bp, Mus musculus
ttctctgccgagagtatcagcaaca

SEQ ID NO: 941655 - DNA, 25 bp, Mus musculus
ttctctgccgagtggagcacagtgc

SEQ ID NO: 941656 - DNA, 25 bp, Mus musculus
ttctctgccgagtgtatcagcaaca

SEQ ID NO: 941657 - DNA, 25 bp, Mus musculus
ttctctgccggcatcatgttttttg

SEQ ID NO: 941658 - DNA, 25 bp, Mus musculus
ttctctgccggcttcatgttttttg

SEQ ID NO: 941659 - DNA, 25 bp, Mus musculus
ttctctgccgtcattacacactgta

SEQ ID NO: 941660 - DNA, 25 bp, Mus musculus
ttctctgccgtctttacacactgta

SEQ ID NO: 941661 - DNA, 25 bp, Mus musculus
ttctctgcctcaagctggtagatca

SEQ ID NO: 941662 - DNA, 25 bp, Mus musculus
ttctctgcctcatgctggtagatca

SEQ ID NO: 941663 - DNA, 25 bp, Mus musculus
ttctctgcctctagaagcaacttca

SEQ ID NO: 941664 - DNA, 25 bp, Mus musculus
ttctctgcctcttgaagcaacttca

SEQ ID NO: 941665 - DNA, 25 bp, Mus musculus
ttctctgcctttactaatgcaaaat

SEQ ID NO: 941666 - DNA, 25 bp, Mus musculus
ttctctgcctttcgcattgtcagtt

SEQ ID NO: 941667 - DNA, 25 bp, Mus musculus
ttctctgcctttctcattagtttcc

SEQ ID NO: 941668 - DNA, 25 bp, Mus musculus
ttctctgcctttggcattgtcagtt

SEQ ID NO: 941669 - DNA, 25 bp, Mus musculus
ttctctgcctttgtcattagtttcc

SEQ ID NO: 941670 - DNA, 25 bp, Mus musculus
ttctctgccttttctaatgcaaaat

SEQ ID NO: 941671 - DNA, 25 bp, Mus musculus
ttctctgcgaagaccctcaggacta

SEQ ID NO: 941672 - DNA, 25 bp, Mus musculus
ttctctgcgaagtccctcaggacta

SEQ ID NO: 941673 - DNA, 25 bp, Mus musculus
ttctctgctagcctgcagctaggca

SEQ ID NO: 941674 - DNA, 25 bp, Mus musculus
ttctctgctagcgtgcagctaggca

SEQ ID NO: 941675 - DNA, 25 bp, Mus musculus
ttctctgctcacatggacttgccag

SEQ ID NO: 941676 - DNA, 25 bp, Mus musculus
ttctctgctcacttggacttgccag

SEQ ID NO: 941677 - DNA, 25 bp, Mus musculus
ttctctgctctgaggccacaaattg

SEQ ID NO: 941678 - DNA, 25 bp, Mus musculus
ttctctgctctgtggccacaaattg

SEQ ID NO: 941679 - DNA, 25 bp, Mus musculus
ttctctgctcttccattctggatgt

SEQ ID NO: 941680 - DNA, 25 bp, Mus musculus
ttctctgctcttcggttcaatgcca

SEQ ID NO: 941681 - DNA, 25 bp, Mus musculus
ttctctgctcttgcattctggatgt

SEQ ID NO: 941682 - DNA, 25 bp, Mus musculus
ttctctgctcttgggttcaatgcca

SEQ ID NO: 941683 - DNA, 25 bp, Mus musculus
ttctctgctgacattatatttatat

SEQ ID NO: 941684 - DNA, 25 bp, Mus musculus
ttctctgctgactttatatttatat

SEQ ID NO: 941685 - DNA, 25 bp, Mus musculus
ttctctgctgctagatgacttattt

SEQ ID NO: 941686 - DNA, 25 bp, Mus musculus
ttctctgctgctatatttttggtgt

SEQ ID NO: 941687 - DNA, 25 bp, Mus musculus
ttctctgctgcttgatgacttattt

SEQ ID NO: 941688 - DNA, 25 bp, Mus musculus
ttctctgctgctttatttttggtgt

SEQ ID NO: 941689 - DNA, 25 bp, Mus musculus
ttctctgctggcagcgacgacagtg

SEQ ID NO: 941690 - DNA, 25 bp, Mus musculus
ttctctgctggctgcgacgacagtg

SEQ ID NO: 941691 - DNA, 25 bp, Mus musculus
ttctctgctggtaccatcttctaag

SEQ ID NO: 941692 - DNA, 25 bp, Mus musculus
ttctctgctggttccatcttctaag

SEQ ID NO: 941693 - DNA, 25 bp, Mus musculus
ttctctgcttaacgccctaacttta

SEQ ID NO: 941694 - DNA, 25 bp, Mus musculus
ttctctgcttaaggccctaacttta

SEQ ID NO: 941695 - DNA, 25 bp, Mus musculus
ttctctgcttggaatttctggttta

SEQ ID NO: 941696 - DNA, 25 bp, Mus musculus
ttctctgcttggtatttctggttta

SEQ ID NO: 941697 - DNA, 25 bp, Mus musculus
ttctctggaaatacacctatggctt

SEQ ID NO: 941698 - DNA, 25 bp, Mus musculus
ttctctggaaattcacctatggctt

SEQ ID NO: 941699 - DNA, 25 bp, Mus musculus
ttctctggaactcctctttggaaag

SEQ ID NO: 941700 - DNA, 25 bp, Mus musculus
ttctctggaactgctctttggaaag

SEQ ID NO: 941701 - DNA, 25 bp, Mus musculus
ttctctggaagcactgacaatggcc

SEQ ID NO: 941702 - DNA, 25 bp, Mus musculus
ttctctggaagctctgacaatggcc

SEQ ID NO: 941703 - DNA, 25 bp, Mus musculus
ttctctggacaaacgaatctgtagc

SEQ ID NO: 941704 - DNA, 25 bp, Mus musculus
ttctctggacaatcgaatctgtagc

SEQ ID NO: 941705 - DNA, 25 bp, Mus musculus
ttctctggagccaagcaggtgtcat

SEQ ID NO: 941706 - DNA, 25 bp, Mus musculus
ttctctggagcctagcaggtgtcat

SEQ ID NO: 941707 - DNA, 25 bp, Mus musculus
ttctctggatataaaagcaacacat

SEQ ID NO: 941708 - DNA, 25 bp, Mus musculus
ttctctggatattaaagcaacacat

SEQ ID NO: 941709 - DNA, 25 bp, Mus musculus
ttctctggattgctggtcgctatga

SEQ ID NO: 941710 - DNA, 25 bp, Mus musculus
ttctctggattggtggtcgctatga

SEQ ID NO: 941711 - DNA, 25 bp, Mus musculus
ttctctggcaatactttcctggatc

SEQ ID NO: 941712 - DNA, 25 bp, Mus musculus
ttctctggcaattctttcctggatc

SEQ ID NO: 941713 - DNA, 25 bp, Mus musculus
ttctctggcccacatgttgagtctg

SEQ ID NO: 941714 - DNA, 25 bp, Mus musculus
ttctctggcccagatgttgagtctg

SEQ ID NO: 941715 - DNA, 25 bp, Mus musculus
ttctctggcctgattgaggatagca

SEQ ID NO: 941716 - DNA, 25 bp, Mus musculus
ttctctggcctgtttgaggatagca

SEQ ID NO: 941717 - DNA, 25 bp, Mus musculus
ttctctggcggcagaccaagaagca

SEQ ID NO: 941718 - DNA, 25 bp, Mus musculus
ttctctggcggctgaccaagaagca

SEQ ID NO: 941719 - DNA, 25 bp, Mus musculus
ttctctggctcaccttcagtggaat

SEQ ID NO: 941720 - DNA, 25 bp, Mus musculus
ttctctggctcagcttcagtggaat

SEQ ID NO: 941721 - DNA, 25 bp, Mus musculus
ttctctgggacaagggaagggccca

SEQ ID NO: 941722 - DNA, 25 bp, Mus musculus
ttctctgggacatgggaagggccca

SEQ ID NO: 941723 - DNA, 25 bp, Mus musculus
ttctctgggatgcattctgtaatca

SEQ ID NO: 941724 - DNA, 25 bp, Mus musculus
ttctctgggatggattctgtaatca

SEQ ID NO: 941725 - DNA, 25 bp, Mus musculus
ttctctgggcttaatgttctgtaca

SEQ ID NO: 941726 - DNA, 25 bp, Mus musculus
ttctctgggctttatgttctgtaca

SEQ ID NO: 941727 - DNA, 25 bp, Mus musculus
ttctctgggtggaaacctactccat

SEQ ID NO: 941728 - DNA, 25 bp, Mus musculus
ttctctgggtggtaacctactccat

SEQ ID NO: 941729 - DNA, 25 bp, Mus musculus
ttctctgggttcacagtacgtcccc

SEQ ID NO: 941730 - DNA, 25 bp, Mus musculus
ttctctgggttctcagtacgtcccc

SEQ ID NO: 941731 - DNA, 25 bp, Mus musculus
ttctctggtgtcaacaaggccaggt

SEQ ID NO: 941732 - DNA, 25 bp, Mus musculus
ttctctggtgtctacaaggccaggt

SEQ ID NO: 941733 - DNA, 25 bp, Mus musculus
ttctctggtgttctgacagggtctc

SEQ ID NO: 941734 - DNA, 25 bp, Mus musculus
ttctctggtgttgtgacagggtctc

SEQ ID NO: 941735 - DNA, 25 bp, Mus musculus
ttctctggttcaaagctttatttcc

SEQ ID NO: 941736 - DNA, 25 bp, Mus musculus
ttctctggttcaagcttatagcagc

SEQ ID NO: 941737 - DNA, 25 bp, Mus musculus
ttctctggttcatagctttatttcc

SEQ ID NO: 941738 - DNA, 25 bp, Mus musculus
ttctctggttcatgcttatagcagc

SEQ ID NO: 941739 - DNA, 25 bp, Mus musculus
ttctctgtaaagagatggctcctta

SEQ ID NO: 941740 - DNA, 25 bp, Mus musculus
ttctctgtaaagtgatggctcctta

SEQ ID NO: 941741 - DNA, 25 bp, Mus musculus
ttctctgtaacaaggactaagtgct

SEQ ID NO: 941742 - DNA, 25 bp, Mus musculus
ttctctgtaacatggactaagtgct

SEQ ID NO: 941743 - DNA, 25 bp, Mus musculus
ttctctgtaaccatctctgatgggt

SEQ ID NO: 941744 - DNA, 25 bp, Mus musculus
ttctctgtaaccttctctgatgggt

SEQ ID NO: 941745 - DNA, 25 bp, Mus musculus
ttctctgtacagatctagtgcttct

SEQ ID NO: 941746 - DNA, 25 bp, Mus musculus
ttctctgtacagcaagtggacttct

SEQ ID NO: 941747 - DNA, 25 bp, Mus musculus
ttctctgtacaggaagtggacttct

SEQ ID NO: 941748 - DNA, 25 bp, Mus musculus
ttctctgtacagttctagtgcttct

SEQ ID NO: 941749 - DNA, 25 bp, Mus musculus
ttctctgtaggccttgcagcaaggt

SEQ ID NO: 941750 - DNA, 25 bp, Mus musculus
ttctctgtaggcgttgcagcaaggt

SEQ ID NO: 941751 - DNA, 25 bp, Mus musculus
ttctctgtagttaaagtcccttgct

SEQ ID NO: 941752 - DNA, 25 bp, Mus musculus
ttctctgtagtttaagtcccttgct

SEQ ID NO: 941753 - DNA, 25 bp, Mus musculus
ttctctgtatagacaagcctagctt

SEQ ID NO: 941754 - DNA, 25 bp, Mus musculus
ttctctgtatagtcaagcctagctt

SEQ ID NO: 941755 - DNA, 25 bp, Mus musculus
ttctctgtatggatatgcagtactg

SEQ ID NO: 941756 - DNA, 25 bp, Mus musculus
ttctctgtatggctatcgtaagttc

SEQ ID NO: 941757 - DNA, 25 bp, Mus musculus
ttctctgtatgggtatcgtaagttc

SEQ ID NO: 941758 - DNA, 25 bp, Mus musculus
ttctctgtatggttatgcagtactg

SEQ ID NO: 941759 - DNA, 25 bp, Mus musculus
ttctctgtcaccatctcaagtatta

SEQ ID NO: 941760 - DNA, 25 bp, Mus musculus
ttctctgtcaccttctcaagtatta

SEQ ID NO: 941761 - DNA, 25 bp, Mus musculus
ttctctgtccaccatcaaatgattg

SEQ ID NO: 941762 - DNA, 25 bp, Mus musculus
ttctctgtccacgatcaaatgattg

SEQ ID NO: 941763 - DNA, 25 bp, Mus musculus
ttctctgtgaaccaatccaggaaca

SEQ ID NO: 941764 - DNA, 25 bp, Mus musculus
ttctctgtgaacgaatccaggaaca

SEQ ID NO: 941765 - DNA, 25 bp, Mus musculus
ttctctgtgaagctgtccaggaccg

SEQ ID NO: 941766 - DNA, 25 bp, Mus musculus
ttctctgtgaaggtgtccaggaccg

SEQ ID NO: 941767 - DNA, 25 bp, Mus musculus
ttctctgtgcagattccataagggc

SEQ ID NO: 941768 - DNA, 25 bp, Mus musculus
ttctctgtgcagtttccataagggc

SEQ ID NO: 941769 - DNA, 25 bp, Mus musculus
ttctctgtgcatagaaggccttgga

SEQ ID NO: 941770 - DNA, 25 bp, Mus musculus
ttctctgtgcattgaaggccttgga

SEQ ID NO: 941771 - DNA, 25 bp, Mus musculus
ttctctgtgcttaccatgtactata

SEQ ID NO: 941772 - DNA, 25 bp, Mus musculus
ttctctgtgctttccatgtactata

SEQ ID NO: 941773 - DNA, 25 bp, Mus musculus
ttctctgtggagacgtgtgaagatt

SEQ ID NO: 941774 - DNA, 25 bp, Mus musculus
ttctctgtggagtcgtgtgaagatt

SEQ ID NO: 941775 - DNA, 25 bp, Mus musculus
ttctctgtggccaacttcacactgg

SEQ ID NO: 941776 - DNA, 25 bp, Mus musculus
ttctctgtggcctacttcacactgg

SEQ ID NO: 941777 - DNA, 25 bp, Mus musculus
ttctctgtggctagagtgtctcaca

SEQ ID NO: 941778 - DNA, 25 bp, Mus musculus
ttctctgtggcttgagtgtctcaca

SEQ ID NO: 941779 - DNA, 25 bp, Mus musculus
ttctctgtggttactcaaacctctt

SEQ ID NO: 941780 - DNA, 25 bp, Mus musculus
ttctctgtggttactgtaaaaaact

SEQ ID NO: 941781 - DNA, 25 bp, Mus musculus
ttctctgtggtttctcaaacctctt

SEQ ID NO: 941782 - DNA, 25 bp, Mus musculus
ttctctgtggtttctgtaaaaaact

SEQ ID NO: 941783 - DNA, 25 bp, Mus musculus
ttctctgtgttaactatcatgtttg

SEQ ID NO: 941784 - DNA, 25 bp, Mus musculus
ttctctgtgttatctatcatgtttg

SEQ ID NO: 941785 - DNA, 25 bp, Mus musculus
ttctctgtgttcacgtatgttgtgt

SEQ ID NO: 941786 - DNA, 25 bp, Mus musculus
ttctctgtgttctcgtatgttgtgt

SEQ ID NO: 941787 - DNA, 25 bp, Mus musculus
ttctctgtgttgacactctcaggaa

SEQ ID NO: 941788 - DNA, 25 bp, Mus musculus
ttctctgtgttgtcactctcaggaa

SEQ ID NO: 941789 - DNA, 25 bp, Mus musculus
ttctctgttactcaaagccttccta

SEQ ID NO: 941790 - DNA, 25 bp, Mus musculus
ttctctgttactgaaagccttccta

SEQ ID NO: 941791 - DNA, 25 bp, Mus musculus
ttctctgttcgtaaccgggccatcc

SEQ ID NO: 941792 - DNA, 25 bp, Mus musculus
ttctctgttcgttaccgggccatcc

SEQ ID NO: 941793 - DNA, 25 bp, Mus musculus
ttctctgttctcattaccgccagtt

SEQ ID NO: 941794 - DNA, 25 bp, Mus musculus
ttctctgttctctttaccgccagtt

SEQ ID NO: 941795 - DNA, 25 bp, Mus musculus
ttctctgttgctcttgacgaccctt

SEQ ID NO: 941796 - DNA, 25 bp, Mus musculus
ttctctgttgctgttgacgaccctt

SEQ ID NO: 941797 - DNA, 25 bp, Mus musculus
ttctctgtttctaacttatgacccc

SEQ ID NO: 941798 - DNA, 25 bp, Mus musculus
ttctctgtttctactgcatcaagga

SEQ ID NO: 941799 - DNA, 25 bp, Mus musculus
ttctctgtttcttacttatgacccc

SEQ ID NO: 941800 - DNA, 25 bp, Mus musculus
ttctctgtttcttctgcatcaagga

SEQ ID NO: 941801 - DNA, 25 bp, Mus musculus
ttctctgtttggaatgtggcattca

SEQ ID NO: 941802 - DNA, 25 bp, Mus musculus
ttctctgtttggtatgtggcattca

SEQ ID NO: 941803 - DNA, 25 bp, Mus musculus
ttctctgttttcagctgaaacaccc

SEQ ID NO: 941804 - DNA, 25 bp, Mus musculus
ttctctgttttctgctgaaacaccc

SEQ ID NO: 941805 - DNA, 25 bp, Mus musculus
ttctctgttttgaaaaatccctttg

SEQ ID NO: 941806 - DNA, 25 bp, Mus musculus
ttctctgttttgtaaaatccctttg

SEQ ID NO: 941807 - DNA, 25 bp, Mus musculus
ttctcttaaaggagcagtgttgccc

SEQ ID NO: 941808 - DNA, 25 bp, Mus musculus
ttctcttaaaggtgcagtgttgccc

SEQ ID NO: 941809 - DNA, 25 bp, Mus musculus
ttctcttaacaaatggttccatggt

SEQ ID NO: 941810 - DNA, 25 bp, Mus musculus
ttctcttaacaattggttccatggt

SEQ ID NO: 941811 - DNA, 25 bp, Mus musculus
ttctcttaacctctcactgtgtaga

SEQ ID NO: 941812 - DNA, 25 bp, Mus musculus
ttctcttaacctgtcactgtgtaga

SEQ ID NO: 941813 - DNA, 25 bp, Mus musculus
ttctcttaagagcttgatgtacaga

SEQ ID NO: 941814 - DNA, 25 bp, Mus musculus
ttctcttaagaggttgatgtacaga

SEQ ID NO: 941815 - DNA, 25 bp, Mus musculus
ttctcttaagtgctaatcagggtga

SEQ ID NO: 941816 - DNA, 25 bp, Mus musculus
ttctcttaagtggtaatcagggtga

SEQ ID NO: 941817 - DNA, 25 bp, Mus musculus
ttctcttaatttcccgcgaacggcg

SEQ ID NO: 941818 - DNA, 25 bp, Mus musculus
ttctcttaatttgccgcgaacggcg

SEQ ID NO: 941819 - DNA, 25 bp, Mus musculus
ttctcttacacccttcgaaatgggt

SEQ ID NO: 941820 - DNA, 25 bp, Mus musculus
ttctcttacaccgttcgaaatgggt

SEQ ID NO: 941821 - DNA, 25 bp, Mus musculus
ttctcttacattatgggcatttacc

SEQ ID NO: 941822 - DNA, 25 bp, Mus musculus
ttctcttacattttgggcatttacc

SEQ ID NO: 941823 - DNA, 25 bp, Mus musculus
ttctcttaccacatcacggtgtaca

SEQ ID NO: 941824 - DNA, 25 bp, Mus musculus
ttctcttaccacttcacggtgtaca

SEQ ID NO: 941825 - DNA, 25 bp, Mus musculus
ttctcttactagcaacaggttttct

SEQ ID NO: 941826 - DNA, 25 bp, Mus musculus
ttctcttactaggaacaggttttct

SEQ ID NO: 941827 - DNA, 25 bp, Mus musculus
ttctcttactgtaaccgattcatgg

SEQ ID NO: 941828 - DNA, 25 bp, Mus musculus
ttctcttactgttaccgattcatgg

SEQ ID NO: 941829 - DNA, 25 bp, Mus musculus
ttctcttagtagaatcctgatcttc

SEQ ID NO: 941830 - DNA, 25 bp, Mus musculus
ttctcttagtagtatcctgatcttc

SEQ ID NO: 941831 - DNA, 25 bp, Mus musculus
ttctcttagtcaaagcacttggcat

SEQ ID NO: 941832 - DNA, 25 bp, Mus musculus
ttctcttagtcatagcacttggcat

SEQ ID NO: 941833 - DNA, 25 bp, Mus musculus
ttctcttagtccctgaagttctagg

SEQ ID NO: 941834 - DNA, 25 bp, Mus musculus
ttctcttagtccgtgaagttctagg

SEQ ID NO: 941835 - DNA, 25 bp, Mus musculus
ttctcttagtgtcaaagcctccttc

SEQ ID NO: 941836 - DNA, 25 bp, Mus musculus
ttctcttagtgtgaaagcctccttc

SEQ ID NO: 941837 - DNA, 25 bp, Mus musculus
ttctcttataccctggatactttcc

SEQ ID NO: 941838 - DNA, 25 bp, Mus musculus
ttctcttataccgtggatactttcc

SEQ ID NO: 941839 - DNA, 25 bp, Mus musculus
ttctcttatagactccttatgggac

SEQ ID NO: 941840 - DNA, 25 bp, Mus musculus
ttctcttatagagtccttatgggac

SEQ ID NO: 941841 - DNA, 25 bp, Mus musculus
ttctcttatccgcagaacggagaac

SEQ ID NO: 941842 - DNA, 25 bp, Mus musculus
ttctcttatccggagaacggagaac

SEQ ID NO: 941843 - DNA, 25 bp, Mus musculus
ttctcttattctacaaaacactggt

SEQ ID NO: 941844 - DNA, 25 bp, Mus musculus
ttctcttattcttcaaaacactggt

SEQ ID NO: 941845 - DNA, 25 bp, Mus musculus
ttctcttatttcagccaccatggaa

SEQ ID NO: 941846 - DNA, 25 bp, Mus musculus
ttctcttatttctgccaccatggaa

SEQ ID NO: 941847 - DNA, 25 bp, Mus musculus
ttctcttcaaaaacctacacctggg

SEQ ID NO: 941848 - DNA, 25 bp, Mus musculus
ttctcttcaaaatcctacacctggg

SEQ ID NO: 941849 - DNA, 25 bp, Mus musculus
ttctcttcaaatatatgtaggatac

SEQ ID NO: 941850 - DNA, 25 bp, Mus musculus
ttctcttcaaatttatgtaggatac

SEQ ID NO: 941851 - DNA, 25 bp, Mus musculus
ttctcttcaacacactgggactcat

SEQ ID NO: 941852 - DNA, 25 bp, Mus musculus
ttctcttcaacagactgggactcat

SEQ ID NO: 941853 - DNA, 25 bp, Mus musculus
ttctcttcaactctggtggagtacg

SEQ ID NO: 941854 - DNA, 25 bp, Mus musculus
ttctcttcaactgtggtggagtacg

SEQ ID NO: 941855 - DNA, 25 bp, Mus musculus
ttctcttcaagcctaacgcagctgt

SEQ ID NO: 941856 - DNA, 25 bp, Mus musculus
ttctcttcaagcgtaacgcagctgt

SEQ ID NO: 941857 - DNA, 25 bp, Mus musculus
ttctcttcacagaaacttcccttag

SEQ ID NO: 941858 - DNA, 25 bp, Mus musculus
ttctcttcacagtaacttcccttag

SEQ ID NO: 941859 - DNA, 25 bp, Mus musculus
ttctcttcactgcatgtttatttat

SEQ ID NO: 941860 - DNA, 25 bp, Mus musculus
ttctcttcactggatgtttatttat

SEQ ID NO: 941861 - DNA, 25 bp, Mus musculus
ttctcttcagacaacgactcttggt

SEQ ID NO: 941862 - DNA, 25 bp, Mus musculus
ttctcttcagactacgactcttggt

SEQ ID NO: 941863 - DNA, 25 bp, Mus musculus
ttctcttcaggtcacctgtcgggag

SEQ ID NO: 941864 - DNA, 25 bp, Mus musculus
ttctcttcaggtgacctgtcgggag

SEQ ID NO: 941865 - DNA, 25 bp, Mus musculus
ttctcttcagtcaagtacccagtga

SEQ ID NO: 941866 - DNA, 25 bp, Mus musculus
ttctcttcagtctagtacccagtga

SEQ ID NO: 941867 - DNA, 25 bp, Mus musculus
ttctcttcatataccttccagttag

SEQ ID NO: 941868 - DNA, 25 bp, Mus musculus
ttctcttcatattccttccagttag

SEQ ID NO: 941869 - DNA, 25 bp, Mus musculus
ttctcttcatgtatcaaggtcccag

SEQ ID NO: 941870 - DNA, 25 bp, Mus musculus
ttctcttcatgtttcaaggtcccag

SEQ ID NO: 941871 - DNA, 25 bp, Mus musculus
ttctcttccaagatgacccacgaat

SEQ ID NO: 941872 - DNA, 25 bp, Mus musculus
ttctcttccaagttgacccacgaat

SEQ ID NO: 941873 - DNA, 25 bp, Mus musculus
ttctcttcccaccttaggacaggaa

SEQ ID NO: 941874 - DNA, 25 bp, Mus musculus
ttctcttcccacgttaggacaggaa

SEQ ID NO: 941875 - DNA, 25 bp, Mus musculus
ttctcttcccctagctgggctgtca

SEQ ID NO: 941876 - DNA, 25 bp, Mus musculus
ttctcttccccttgctgggctgtca

SEQ ID NO: 941877 - DNA, 25 bp, Mus musculus
ttctcttcccgtagtggagccagga

SEQ ID NO: 941878 - DNA, 25 bp, Mus musculus
ttctcttcccgttgtggagccagga

SEQ ID NO: 941879 - DNA, 25 bp, Mus musculus
ttctcttccgtaacttagcagtttg

SEQ ID NO: 941880 - DNA, 25 bp, Mus musculus
ttctcttccgtatcttagcagtttg

SEQ ID NO: 941881 - DNA, 25 bp, Mus musculus
ttctcttcctaccaaacaactctgt

SEQ ID NO: 941882 - DNA, 25 bp, Mus musculus
ttctcttcctacgaaacaactctgt

SEQ ID NO: 941883 - DNA, 25 bp, Mus musculus
ttctcttcctagcagttacaacaga

SEQ ID NO: 941884 - DNA, 25 bp, Mus musculus
ttctcttcctaggagttacaacaga

SEQ ID NO: 941885 - DNA, 25 bp, Mus musculus
ttctcttcctgcatcaagttctcat

SEQ ID NO: 941886 - DNA, 25 bp, Mus musculus
ttctcttcctgcttcaagttctcat

SEQ ID NO: 941887 - DNA, 25 bp, Mus musculus
ttctcttcctggagtaccaactacc

SEQ ID NO: 941888 - DNA, 25 bp, Mus musculus
ttctcttcctggtgtaccaactacc

SEQ ID NO: 941889 - DNA, 25 bp, Mus musculus
ttctcttcctgtagttcccagtcat

SEQ ID NO: 941890 - DNA, 25 bp, Mus musculus
ttctcttcctgttgttcccagtcat

SEQ ID NO: 941891 - DNA, 25 bp, Mus musculus
ttctcttcgacactccaggacagaa

SEQ ID NO: 941892 - DNA, 25 bp, Mus musculus
ttctcttcgacagtccaggacagaa

SEQ ID NO: 941893 - DNA, 25 bp, Mus musculus
ttctcttcggctcgagctcggcaag

SEQ ID NO: 941894 - DNA, 25 bp, Mus musculus
ttctcttcggctggagctcggcaag

SEQ ID NO: 941895 - DNA, 25 bp, Mus musculus
ttctcttctaatatatgggagcaga

SEQ ID NO: 941896 - DNA, 25 bp, Mus musculus
ttctcttctaatcggttttctttct

SEQ ID NO: 941897 - DNA, 25 bp, Mus musculus
ttctcttctaatgggttttctttct

SEQ ID NO: 941898 - DNA, 25 bp, Mus musculus
ttctcttctaatttatgggagcaga

SEQ ID NO: 941899 - DNA, 25 bp, Mus musculus
ttctcttctatgctatccttacaca

SEQ ID NO: 941900 - DNA, 25 bp, Mus musculus
ttctcttctatggtatccttacaca

SEQ ID NO: 941901 - DNA, 25 bp, Mus musculus
ttctcttctctcatagagctcccag

SEQ ID NO: 941902 - DNA, 25 bp, Mus musculus
ttctcttctctcttagagctcccag

SEQ ID NO: 941903 - DNA, 25 bp, Mus musculus
ttctcttctgataagcctagcctga

SEQ ID NO: 941904 - DNA, 25 bp, Mus musculus
ttctcttctgattagcctagcctga

SEQ ID NO: 941905 - DNA, 25 bp, Mus musculus
ttctcttctggaatgctcttgtgac

SEQ ID NO: 941906 - DNA, 25 bp, Mus musculus
ttctcttctggattgctcttgtgac

SEQ ID NO: 941907 - DNA, 25 bp, Mus musculus
ttctcttctgtccattgactcagct

SEQ ID NO: 941908 - DNA, 25 bp, Mus musculus
ttctcttctgtcgattgactcagct

SEQ ID NO: 941909 - DNA, 25 bp, Mus musculus
ttctcttcttccaagggtgacacga

SEQ ID NO: 941910 - DNA, 25 bp, Mus musculus
ttctcttcttcctagggtgacacga

SEQ ID NO: 941911 - DNA, 25 bp, Mus musculus
ttctcttctttaacttcctgcatta

SEQ ID NO: 941912 - DNA, 25 bp, Mus musculus
ttctcttctttatcttcctgcatta

SEQ ID NO: 941913 - DNA, 25 bp, Mus musculus
ttctcttgaagcatgggccaccaga

SEQ ID NO: 941914 - DNA, 25 bp, Mus musculus
ttctcttgaagcttgggccaccaga

SEQ ID NO: 941915 - DNA, 25 bp, Mus musculus
ttctcttgacaaaacctgttcagct

SEQ ID NO: 941916 - DNA, 25 bp, Mus musculus
ttctcttgacaatacctgttcagct

SEQ ID NO: 941917 - DNA, 25 bp, Mus musculus
ttctcttgacagacgtgagcatatg

SEQ ID NO: 941918 - DNA, 25 bp, Mus musculus
ttctcttgacagtcgtgagcatatg

SEQ ID NO: 941919 - DNA, 25 bp, Mus musculus
ttctcttgccatccctgctaaaaag

SEQ ID NO: 941920 - DNA, 25 bp, Mus musculus
ttctcttgccatgcctgctaaaaag

SEQ ID NO: 941921 - DNA, 25 bp, Mus musculus
ttctcttgctccattgttcacccag

SEQ ID NO: 941922 - DNA, 25 bp, Mus musculus
ttctcttgctcctttgttcacccag

SEQ ID NO: 941923 - DNA, 25 bp, Mus musculus
ttctcttgctgcataacctgtctta

SEQ ID NO: 941924 - DNA, 25 bp, Mus musculus
ttctcttgctgcttaacctgtctta

SEQ ID NO: 941925 - DNA, 25 bp, Mus musculus
ttctcttgctgtcaaaagacgccaa

SEQ ID NO: 941926 - DNA, 25 bp, Mus musculus
ttctcttgctgtgaaaagacgccaa

SEQ ID NO: 941927 - DNA, 25 bp, Mus musculus
ttctcttgcttcaacttcacaaatc

SEQ ID NO: 941928 - DNA, 25 bp, Mus musculus
ttctcttgcttctacttcacaaatc

SEQ ID NO: 941929 - DNA, 25 bp, Mus musculus
ttctcttggagaaatgaatgcaacc

SEQ ID NO: 941930 - DNA, 25 bp, Mus musculus
ttctcttggagaactagtggtgact

SEQ ID NO: 941931 - DNA, 25 bp, Mus musculus
ttctcttggagatatgaatgcaacc

SEQ ID NO: 941932 - DNA, 25 bp, Mus musculus
ttctcttggagatctagtggtgact

SEQ ID NO: 941933 - DNA, 25 bp, Mus musculus
ttctcttggaggaaggaccgaccaa

SEQ ID NO: 941934 - DNA, 25 bp, Mus musculus
ttctcttggaggtaggaccgaccaa

SEQ ID NO: 941935 - DNA, 25 bp, Mus musculus
ttctcttggatcctggcttggcttt

SEQ ID NO: 941936 - DNA, 25 bp, Mus musculus
ttctcttggatcgtggcttggcttt

SEQ ID NO: 941937 - DNA, 25 bp, Mus musculus
ttctcttggcaccattccaacagga

SEQ ID NO: 941938 - DNA, 25 bp, Mus musculus
ttctcttggcacgattccaacagga

SEQ ID NO: 941939 - DNA, 25 bp, Mus musculus
ttctcttgggtccacataatagcat

SEQ ID NO: 941940 - DNA, 25 bp, Mus musculus
ttctcttgggtcgacataatagcat

SEQ ID NO: 941941 - DNA, 25 bp, Mus musculus
ttctcttggtttatgatagttccat

SEQ ID NO: 941942 - DNA, 25 bp, Mus musculus
ttctcttggtttttgatagttccat

SEQ ID NO: 941943 - DNA, 25 bp, Mus musculus
ttctcttgtaagcacctaatcctga

SEQ ID NO: 941944 - DNA, 25 bp, Mus musculus
ttctcttgtaaggacctaatcctga

SEQ ID NO: 941945 - DNA, 25 bp, Mus musculus
ttctcttgtcgtatacgctttgatg

SEQ ID NO: 941946 - DNA, 25 bp, Mus musculus
ttctcttgtcgtttacgctttgatg

SEQ ID NO: 941947 - DNA, 25 bp, Mus musculus
ttctcttgtgccaccggtttccatt

SEQ ID NO: 941948 - DNA, 25 bp, Mus musculus
ttctcttgtgcctccggtttccatt

SEQ ID NO: 941949 - DNA, 25 bp, Mus musculus
ttctcttgtgttccctgaggtccca

SEQ ID NO: 941950 - DNA, 25 bp, Mus musculus
ttctcttgtgttgcctgaggtccca

SEQ ID NO: 941951 - DNA, 25 bp, Mus musculus
ttctcttgttcactggacatcctag

SEQ ID NO: 941952 - DNA, 25 bp, Mus musculus
ttctcttgttcagtggacatcctag

SEQ ID NO: 941953 - DNA, 25 bp, Mus musculus
ttctcttgtttcctgttatttctat

SEQ ID NO: 941954 - DNA, 25 bp, Mus musculus
ttctcttgtttcgtgttatttctat

SEQ ID NO: 941955 - DNA, 25 bp, Mus musculus
ttctcttgttttatactgggcatga

SEQ ID NO: 941956 - DNA, 25 bp, Mus musculus
ttctcttgttttttactgggcatga

SEQ ID NO: 941957 - DNA, 25 bp, Mus musculus
ttctctttaaagatcctgactcagt

SEQ ID NO: 941958 - DNA, 25 bp, Mus musculus
ttctctttaaagttcctgactcagt

SEQ ID NO: 941959 - DNA, 25 bp, Mus musculus
ttctctttacaaagggcctctcttc

SEQ ID NO: 941960 - DNA, 25 bp, Mus musculus
ttctctttacaatgggcctctcttc

SEQ ID NO: 941961 - DNA, 25 bp, Mus musculus
ttctctttactcattcttcctcctt

SEQ ID NO: 941962 - DNA, 25 bp, Mus musculus
ttctctttactctttcttcctcctt

SEQ ID NO: 941963 - DNA, 25 bp, Mus musculus
ttctctttagcaatcctagtgggat

SEQ ID NO: 941964 - DNA, 25 bp, Mus musculus
ttctctttagcattcctagtgggat

SEQ ID NO: 941965 - DNA, 25 bp, Mus musculus
ttctctttagtcatagtccattccc

SEQ ID NO: 941966 - DNA, 25 bp, Mus musculus
ttctctttagtcttagtccattccc

SEQ ID NO: 941967 - DNA, 25 bp, Mus musculus
ttctctttcatcaaagttccaagat

SEQ ID NO: 941968 - DNA, 25 bp, Mus musculus
ttctctttcatctaagttccaagat

SEQ ID NO: 941969 - DNA, 25 bp, Mus musculus
ttctctttcattccgttatcccaga

SEQ ID NO: 941970 - DNA, 25 bp, Mus musculus
ttctctttcattgcgttatcccaga

SEQ ID NO: 941971 - DNA, 25 bp, Mus musculus
ttctctttccctcctttataaatat

SEQ ID NO: 941972 - DNA, 25 bp, Mus musculus
ttctctttccctgctttataaatat

SEQ ID NO: 941973 - DNA, 25 bp, Mus musculus
ttctctttcctcctattctgatata

SEQ ID NO: 941974 - DNA, 25 bp, Mus musculus
ttctctttcctcgtattctgatata

SEQ ID NO: 941975 - DNA, 25 bp, Mus musculus
ttctctttccttagcctcaatactg

SEQ ID NO: 941976 - DNA, 25 bp, Mus musculus
ttctctttcctttgcctcaatactg

SEQ ID NO: 941977 - DNA, 25 bp, Mus musculus
ttctctttctccattgtgcgtaata

SEQ ID NO: 941978 - DNA, 25 bp, Mus musculus
ttctctttctcccagatggatcctt

SEQ ID NO: 941979 - DNA, 25 bp, Mus musculus
ttctctttctccgagatggatcctt

SEQ ID NO: 941980 - DNA, 25 bp, Mus musculus
ttctctttctcctttgtgcgtaata

SEQ ID NO: 941981 - DNA, 25 bp, Mus musculus
ttctctttctgacgtcggcgttatt

SEQ ID NO: 941982 - DNA, 25 bp, Mus musculus
ttctctttctgaggtcggcgttatt

SEQ ID NO: 941983 - DNA, 25 bp, Mus musculus
ttctctttcttgacctccagattaa

SEQ ID NO: 941984 - DNA, 25 bp, Mus musculus
ttctctttcttgtcctccagattaa

SEQ ID NO: 941985 - DNA, 25 bp, Mus musculus
ttctctttctttacagatctgcagt

SEQ ID NO: 941986 - DNA, 25 bp, Mus musculus
ttctctttcttttcagatctgcagt

SEQ ID NO: 941987 - DNA, 25 bp, Mus musculus
ttctctttgaaaaaccacggtcagg

SEQ ID NO: 941988 - DNA, 25 bp, Mus musculus
ttctctttgaaataccacggtcagg

SEQ ID NO: 941989 - DNA, 25 bp, Mus musculus
ttctctttgcctacagaccacattg

SEQ ID NO: 941990 - DNA, 25 bp, Mus musculus
ttctctttgcctagggtaaaaatca

SEQ ID NO: 941991 - DNA, 25 bp, Mus musculus
ttctctttgcctcctgttagcctaa

SEQ ID NO: 941992 - DNA, 25 bp, Mus musculus
ttctctttgcctgctgttagcctaa

SEQ ID NO: 941993 - DNA, 25 bp, Mus musculus
ttctctttgccttcagaccacattg

SEQ ID NO: 941994 - DNA, 25 bp, Mus musculus
ttctctttgccttgggtaaaaatca

SEQ ID NO: 941995 - DNA, 25 bp, Mus musculus
ttctctttgctcatcttatatccct

SEQ ID NO: 941996 - DNA, 25 bp, Mus musculus
ttctctttgctcttcttatatccct

SEQ ID NO: 941997 - DNA, 25 bp, Mus musculus
ttctctttgcttacctaaacccgtg

SEQ ID NO: 941998 - DNA, 25 bp, Mus musculus
ttctctttgctttcctaaacccgtg

SEQ ID NO: 941999 - DNA, 25 bp, Mus musculus
ttctctttggagcttatgtcgctaa

SEQ ID NO: 942000 - DNA, 25 bp, Mus musculus
ttctctttggaggttatgtcgctaa

SEQ ID NO: 942001 - DNA, 25 bp, Mus musculus
ttctctttgtctagtcctgtaaagg

SEQ ID NO: 942002 - DNA, 25 bp, Mus musculus
ttctctttgtcttgtcctgtaaagg

SEQ ID NO: 942003 - DNA, 25 bp, Mus musculus
ttctctttgtgtccctggagtccag

SEQ ID NO: 942004 - DNA, 25 bp, Mus musculus
ttctctttgtgtgcctggagtccag

SEQ ID NO: 942005 - DNA, 25 bp, Mus musculus
ttctcttttcctaacaaccgtgaag

SEQ ID NO: 942006 - DNA, 25 bp, Mus musculus
ttctcttttccttacaaccgtgaag

SEQ ID NO: 942007 - DNA, 25 bp, Mus musculus
ttctcttttgagcacaccctttaaa

SEQ ID NO: 942008 - DNA, 25 bp, Mus musculus
ttctcttttgaggacaccctttaaa

SEQ ID NO: 942009 - DNA, 25 bp, Mus musculus
ttctcttttgccctttggatacttt

SEQ ID NO: 942010 - DNA, 25 bp, Mus musculus
ttctcttttgccgtttggatacttt

SEQ ID NO: 942011 - DNA, 25 bp, Mus musculus
ttctcttttggcatctgtatgtgca

SEQ ID NO: 942012 - DNA, 25 bp, Mus musculus
ttctcttttggcttctgtatgtgca

SEQ ID NO: 942013 - DNA, 25 bp, Mus musculus
ttctcttttgtcaatagcagcttga

SEQ ID NO: 942014 - DNA, 25 bp, Mus musculus
ttctcttttgtctatagcagcttga

SEQ ID NO: 942015 - DNA, 25 bp, Mus musculus
ttctctttttgtaataccgataaca

SEQ ID NO: 942016 - DNA, 25 bp, Mus musculus
ttctctttttgttataccgataaca

SEQ ID NO: 942017 - DNA, 25 bp, Mus musculus
ttctcttttttcaccacagcactta

SEQ ID NO: 942018 - DNA, 25 bp, Mus musculus
ttctcttttttctccacagcactta

SEQ ID NO: 942019 - DNA, 25 bp, Mus musculus
ttctgaaacactcggaacctgagat

SEQ ID NO: 942020 - DNA, 25 bp, Mus musculus
ttctgaaacactgggaacctgagat

SEQ ID NO: 942021 - DNA, 25 bp, Mus musculus
ttctgaaactttccgcaaaactata

SEQ ID NO: 942022 - DNA, 25 bp, Mus musculus
ttctgaaactttgcgcaaaactata

SEQ ID NO: 942023 - DNA, 25 bp, Mus musculus
ttctgaaagtgaaggcgtggcccgt

SEQ ID NO: 942024 - DNA, 25 bp, Mus musculus
ttctgaaagtgatggcgtggcccgt

SEQ ID NO: 942025 - DNA, 25 bp, Mus musculus
ttctgaaatctaaaacccttcgttt

SEQ ID NO: 942026 - DNA, 25 bp, Mus musculus
ttctgaaatctataacccttcgttt

SEQ ID NO: 942027 - DNA, 25 bp, Mus musculus
ttctgaaatgtgacttgccttgggt

SEQ ID NO: 942028 - DNA, 25 bp, Mus musculus
ttctgaaatgtgtcttgccttgggt

SEQ ID NO: 942029 - DNA, 25 bp, Mus musculus
ttctgaaccctgcataagactgagg

SEQ ID NO: 942030 - DNA, 25 bp, Mus musculus
ttctgaaccctgcatgacttctata

SEQ ID NO: 942031 - DNA, 25 bp, Mus musculus
ttctgaaccctggataagactgagg

SEQ ID NO: 942032 - DNA, 25 bp, Mus musculus
ttctgaaccctggatgacttctata

SEQ ID NO: 942033 - DNA, 25 bp, Mus musculus
ttctgaacgcttcacccctgtgatg

SEQ ID NO: 942034 - DNA, 25 bp, Mus musculus
ttctgaacgcttgacccctgtgatg

SEQ ID NO: 942035 - DNA, 25 bp, Mus musculus
ttctgaactaagattgtgttgcgtt

SEQ ID NO: 942036 - DNA, 25 bp, Mus musculus
ttctgaactaagtttgtgttgcgtt

SEQ ID NO: 942037 - DNA, 25 bp, Mus musculus
ttctgaactacaatagaccgtgtct

SEQ ID NO: 942038 - DNA, 25 bp, Mus musculus
ttctgaactacattagaccgtgtct

SEQ ID NO: 942039 - DNA, 25 bp, Mus musculus
ttctgaactacccaaaacgtgcctg

SEQ ID NO: 942040 - DNA, 25 bp, Mus musculus
ttctgaactaccgaaaacgtgcctg

SEQ ID NO: 942041 - DNA, 25 bp, Mus musculus
ttctgaactcctccgtgattctgtt

SEQ ID NO: 942042 - DNA, 25 bp, Mus musculus
ttctgaactcctgcgtgattctgtt

SEQ ID NO: 942043 - DNA, 25 bp, Mus musculus
ttctgaactctcacacagggtagat

SEQ ID NO: 942044 - DNA, 25 bp, Mus musculus
ttctgaactctctcacagggtagat

SEQ ID NO: 942045 - DNA, 25 bp, Mus musculus
ttctgaactgcaaactaagctttag

SEQ ID NO: 942046 - DNA, 25 bp, Mus musculus
ttctgaactgcatactaagctttag

SEQ ID NO: 942047 - DNA, 25 bp, Mus musculus
ttctgaacttaccttttctgtccat

SEQ ID NO: 942048 - DNA, 25 bp, Mus musculus
ttctgaacttacgttttctgtccat

SEQ ID NO: 942049 - DNA, 25 bp, Mus musculus
ttctgaagaaacccgctcaactgtg

SEQ ID NO: 942050 - DNA, 25 bp, Mus musculus
ttctgaagaaacgcgctcaactgtg

SEQ ID NO: 942051 - DNA, 25 bp, Mus musculus
ttctgaagacccacagggaaggccc

SEQ ID NO: 942052 - DNA, 25 bp, Mus musculus
ttctgaagaccctcagggaaggccc

SEQ ID NO: 942053 - DNA, 25 bp, Mus musculus
ttctgaagagcacgttgcccgcctc

SEQ ID NO: 942054 - DNA, 25 bp, Mus musculus
ttctgaagagcaggttgcccgcctc

SEQ ID NO: 942055 - DNA, 25 bp, Mus musculus
ttctgaagatctattcctcattgaa

SEQ ID NO: 942056 - DNA, 25 bp, Mus musculus
ttctgaagatcttttcctcattgaa

SEQ ID NO: 942057 - DNA, 25 bp, Mus musculus
ttctgaagccccatcttttggaggt

SEQ ID NO: 942058 - DNA, 25 bp, Mus musculus
ttctgaagccccttcttttggaggt

SEQ ID NO: 942059 - DNA, 25 bp, Mus musculus
ttctgaagccttatatgtaccacta

SEQ ID NO: 942060 - DNA, 25 bp, Mus musculus
ttctgaagccttttatgtaccacta

SEQ ID NO: 942061 - DNA, 25 bp, Mus musculus
ttctgaaggcttctaataaaatatc

SEQ ID NO: 942062 - DNA, 25 bp, Mus musculus
ttctgaaggcttgtaataaaatatc

SEQ ID NO: 942063 - DNA, 25 bp, Mus musculus
ttctgaagggaaccacactctggca

SEQ ID NO: 942064 - DNA, 25 bp, Mus musculus
ttctgaagggaagcacactctggca

SEQ ID NO: 942065 - DNA, 25 bp, Mus musculus
ttctgaagggccagctgtacaccgt

SEQ ID NO: 942066 - DNA, 25 bp, Mus musculus
ttctgaagggcctgctgtacaccgt

SEQ ID NO: 942067 - DNA, 25 bp, Mus musculus
ttctgaagtacactttggctgccca

SEQ ID NO: 942068 - DNA, 25 bp, Mus musculus
ttctgaagtacagtttggctgccca

SEQ ID NO: 942069 - DNA, 25 bp, Mus musculus
ttctgaagttgtatgtggacacacc

SEQ ID NO: 942070 - DNA, 25 bp, Mus musculus
ttctgaagttgtttgtggacacacc

SEQ ID NO: 942071 - DNA, 25 bp, Mus musculus
ttctgaatagcaattggtcccacca

SEQ ID NO: 942072 - DNA, 25 bp, Mus musculus
ttctgaatagcatttggtcccacca

SEQ ID NO: 942073 - DNA, 25 bp, Mus musculus
ttctgaatcacactgcccagtatcc

SEQ ID NO: 942074 - DNA, 25 bp, Mus musculus
ttctgaatcacagtgcccagtatcc

SEQ ID NO: 942075 - DNA, 25 bp, Mus musculus
ttctgaatccagagcccatcatctg

SEQ ID NO: 942076 - DNA, 25 bp, Mus musculus
ttctgaatccagtgcccatcatctg

SEQ ID NO: 942077 - DNA, 25 bp, Mus musculus
ttctgaatcctgaaatcaccatggt

SEQ ID NO: 942078 - DNA, 25 bp, Mus musculus
ttctgaatcctgtaatcaccatggt

SEQ ID NO: 942079 - DNA, 25 bp, Mus musculus
ttctgaatcggacgttcactactgt

SEQ ID NO: 942080 - DNA, 25 bp, Mus musculus
ttctgaatcggaggttcactactgt

SEQ ID NO: 942081 - DNA, 25 bp, Mus musculus
ttctgaatgactagactggactctc

SEQ ID NO: 942082 - DNA, 25 bp, Mus musculus
ttctgaatgacttgactggactctc

SEQ ID NO: 942083 - DNA, 25 bp, Mus musculus
ttctgaatgtcactgaatgggcaac

SEQ ID NO: 942084 - DNA, 25 bp, Mus musculus
ttctgaatgtcagtgaatgggcaac

SEQ ID NO: 942085 - DNA, 25 bp, Mus musculus
ttctgaattcagactcacgatggca

SEQ ID NO: 942086 - DNA, 25 bp, Mus musculus
ttctgaattcagtctcacgatggca

SEQ ID NO: 942087 - DNA, 25 bp, Mus musculus
ttctgaattgccagcgcccgggttt

SEQ ID NO: 942088 - DNA, 25 bp, Mus musculus
ttctgaattgcctgcgcccgggttt

SEQ ID NO: 942089 - DNA, 25 bp, Mus musculus
ttctgaatttgaatgcttgacccca

SEQ ID NO: 942090 - DNA, 25 bp, Mus musculus
ttctgaatttgattgcttgacccca

SEQ ID NO: 942091 - DNA, 25 bp, Mus musculus
ttctgaatttgcatgtttgcctgac

SEQ ID NO: 942092 - DNA, 25 bp, Mus musculus
ttctgaatttgcttgtttgcctgac

SEQ ID NO: 942093 - DNA, 25 bp, Mus musculus
ttctgacacaccaagagagggcact

SEQ ID NO: 942094 - DNA, 25 bp, Mus musculus
ttctgacacacctagagagggcact

SEQ ID NO: 942095 - DNA, 25 bp, Mus musculus
ttctgacaccttcatagtcaccatg

SEQ ID NO: 942096 - DNA, 25 bp, Mus musculus
ttctgacaccttgatagtcaccatg

SEQ ID NO: 942097 - DNA, 25 bp, Mus musculus
ttctgacactttcacttttgcagat

SEQ ID NO: 942098 - DNA, 25 bp, Mus musculus
ttctgacactttgacttttgcagat

SEQ ID NO: 942099 - DNA, 25 bp, Mus musculus
ttctgacagctgatgggatttcccc

SEQ ID NO: 942100 - DNA, 25 bp, Mus musculus
ttctgacagctgttgggatttcccc

SEQ ID NO: 942101 - DNA, 25 bp, Mus musculus
ttctgacaggtacaagtttaaggtc

SEQ ID NO: 942102 - DNA, 25 bp, Mus musculus
ttctgacaggtagaagtttaaggtc

SEQ ID NO: 942103 - DNA, 25 bp, Mus musculus
ttctgacaggtgagtgcgccttcat

SEQ ID NO: 942104 - DNA, 25 bp, Mus musculus
ttctgacaggtgtgtgcgccttcat

SEQ ID NO: 942105 - DNA, 25 bp, Mus musculus
ttctgacagttcactactcttattt

SEQ ID NO: 942106 - DNA, 25 bp, Mus musculus
ttctgacagttcagaccttggtcac

SEQ ID NO: 942107 - DNA, 25 bp, Mus musculus
ttctgacagttctctactcttattt

SEQ ID NO: 942108 - DNA, 25 bp, Mus musculus
ttctgacagttctgaccttggtcac

SEQ ID NO: 942109 - DNA, 25 bp, Mus musculus
ttctgacatctgcatctgaaggctc

SEQ ID NO: 942110 - DNA, 25 bp, Mus musculus
ttctgacatctggatctgaaggctc

SEQ ID NO: 942111 - DNA, 25 bp, Mus musculus
ttctgacatgtcctgcatttctcta

SEQ ID NO: 942112 - DNA, 25 bp, Mus musculus
ttctgacatgtcgtgcatttctcta

SEQ ID NO: 942113 - DNA, 25 bp, Mus musculus
ttctgacatttaatggcaccaagca

SEQ ID NO: 942114 - DNA, 25 bp, Mus musculus
ttctgacatttattggcaccaagca

SEQ ID NO: 942115 - DNA, 25 bp, Mus musculus
ttctgacatttcacgggccattgtt

SEQ ID NO: 942116 - DNA, 25 bp, Mus musculus
ttctgacatttctcgggccattgtt

SEQ ID NO: 942117 - DNA, 25 bp, Mus musculus
ttctgaccaagcattctcttgagga

SEQ ID NO: 942118 - DNA, 25 bp, Mus musculus
ttctgaccaagctttctcttgagga

SEQ ID NO: 942119 - DNA, 25 bp, Mus musculus
ttctgaccaataatgtccacctctg

SEQ ID NO: 942120 - DNA, 25 bp, Mus musculus
ttctgaccaatattgtccacctctg

SEQ ID NO: 942121 - DNA, 25 bp, Mus musculus
ttctgaccacttagcttcttcctga

SEQ ID NO: 942122 - DNA, 25 bp, Mus musculus
ttctgaccactttgcttcttcctga

SEQ ID NO: 942123 - DNA, 25 bp, Mus musculus
ttctgaccatgacaccacatcctgg

SEQ ID NO: 942124 - DNA, 25 bp, Mus musculus
ttctgaccatgagaccacatcctgg

SEQ ID NO: 942125 - DNA, 25 bp, Mus musculus
ttctgaccattcattgtacccttta

SEQ ID NO: 942126 - DNA, 25 bp, Mus musculus
ttctgaccattctttgtacccttta

SEQ ID NO: 942127 - DNA, 25 bp, Mus musculus
ttctgacccaagatggcctcgtgac

SEQ ID NO: 942128 - DNA, 25 bp, Mus musculus
ttctgacccaagttggcctcgtgac

SEQ ID NO: 942129 - DNA, 25 bp, Mus musculus
ttctgacccatactagggctgtgta

SEQ ID NO: 942130 - DNA, 25 bp, Mus musculus
ttctgacccatagtagggctgtgta

SEQ ID NO: 942131 - DNA, 25 bp, Mus musculus
ttctgacccatcactatttattttc

SEQ ID NO: 942132 - DNA, 25 bp, Mus musculus
ttctgacccatctctatttattttc

SEQ ID NO: 942133 - DNA, 25 bp, Mus musculus
ttctgacccctgcaactgtcaggat

SEQ ID NO: 942134 - DNA, 25 bp, Mus musculus
ttctgacccctggaactgtcaggat

SEQ ID NO: 942135 - DNA, 25 bp, Mus musculus
ttctgacccgagaggtacatttgtt

SEQ ID NO: 942136 - DNA, 25 bp, Mus musculus
ttctgacccgagtggtacatttgtt

SEQ ID NO: 942137 - DNA, 25 bp, Mus musculus
ttctgacccggacggcgggcctgat

SEQ ID NO: 942138 - DNA, 25 bp, Mus musculus
ttctgacccggagggcgggcctgat

SEQ ID NO: 942139 - DNA, 25 bp, Mus musculus
ttctgacccgggaagagctgcgagc

SEQ ID NO: 942140 - DNA, 25 bp, Mus musculus
ttctgacccgggtagagctgcgagc

SEQ ID NO: 942141 - DNA, 25 bp, Mus musculus
ttctgaccctctagggacctttgaa

SEQ ID NO: 942142 - DNA, 25 bp, Mus musculus
ttctgaccctcttgggacctttgaa

SEQ ID NO: 942143 - DNA, 25 bp, Mus musculus
ttctgaccctgcagcaaatgaagat

SEQ ID NO: 942144 - DNA, 25 bp, Mus musculus
ttctgaccctgctgcaaatgaagat

SEQ ID NO: 942145 - DNA, 25 bp, Mus musculus
ttctgacctactcctgagcaggagg

SEQ ID NO: 942146 - DNA, 25 bp, Mus musculus
ttctgacctactgctgagcaggagg

SEQ ID NO: 942147 - DNA, 25 bp, Mus musculus
ttctgacctccaaagacactgcatt

SEQ ID NO: 942148 - DNA, 25 bp, Mus musculus
ttctgacctccaaggatatcaggct

SEQ ID NO: 942149 - DNA, 25 bp, Mus musculus
ttctgacctccatagacactgcatt

SEQ ID NO: 942150 - DNA, 25 bp, Mus musculus
ttctgacctccatggatatcaggct

SEQ ID NO: 942151 - DNA, 25 bp, Mus musculus
ttctgacctcccagagtaagggtta

SEQ ID NO: 942152 - DNA, 25 bp, Mus musculus
ttctgacctccctgagtaagggtta

SEQ ID NO: 942153 - DNA, 25 bp, Mus musculus
ttctgacctccgaggtggtactata

SEQ ID NO: 942154 - DNA, 25 bp, Mus musculus
ttctgacctccgtggtggtactata

SEQ ID NO: 942155 - DNA, 25 bp, Mus musculus
ttctgacctctaaatgtggtctcta

SEQ ID NO: 942156 - DNA, 25 bp, Mus musculus
ttctgacctctaatggcagtaggca

SEQ ID NO: 942157 - DNA, 25 bp, Mus musculus
ttctgacctctatatgtggtctcta

SEQ ID NO: 942158 - DNA, 25 bp, Mus musculus
ttctgacctctattggcagtaggca

SEQ ID NO: 942159 - DNA, 25 bp, Mus musculus
ttctgacctctcatggcatttgttt

SEQ ID NO: 942160 - DNA, 25 bp, Mus musculus
ttctgacctctcttggcatttgttt

SEQ ID NO: 942161 - DNA, 25 bp, Mus musculus
ttctgacctcttagtcaacaccaat

SEQ ID NO: 942162 - DNA, 25 bp, Mus musculus
ttctgacctctttgtcaacaccaat

SEQ ID NO: 942163 - DNA, 25 bp, Mus musculus
ttctgaccttgaaagctttccgggc

SEQ ID NO: 942164 - DNA, 25 bp, Mus musculus
ttctgaccttgatagctttccgggc

SEQ ID NO: 942165 - DNA, 25 bp, Mus musculus
ttctgaccttggcatgaatcgcttc

SEQ ID NO: 942166 - DNA, 25 bp, Mus musculus
ttctgaccttgggatgaatcgcttc

SEQ ID NO: 942167 - DNA, 25 bp, Mus musculus
ttctgaccttttcaaacggtttgag

SEQ ID NO: 942168 - DNA, 25 bp, Mus musculus
ttctgaccttttgaaacggtttgag

SEQ ID NO: 942169 - DNA, 25 bp, Mus musculus
ttctgacgggggctagcctgacttc

SEQ ID NO: 942170 - DNA, 25 bp, Mus musculus
ttctgacggggggtagcctgacttc

SEQ ID NO: 942171 - DNA, 25 bp, Mus musculus
ttctgacggtatccaaggacagctt

SEQ ID NO: 942172 - DNA, 25 bp, Mus musculus
ttctgacggtatgcaaggacagctt

SEQ ID NO: 942173 - DNA, 25 bp, Mus musculus
ttctgacgtcagaaaagtcccactg

SEQ ID NO: 942174 - DNA, 25 bp, Mus musculus
ttctgacgtcagtaaagtcccactg

SEQ ID NO: 942175 - DNA, 25 bp, Mus musculus
ttctgactaaggcagtctgaccctg

SEQ ID NO: 942176 - DNA, 25 bp, Mus musculus
ttctgactaagggagtctgaccctg

SEQ ID NO: 942177 - DNA, 25 bp, Mus musculus
ttctgactatcgaggtctctactgc

SEQ ID NO: 942178 - DNA, 25 bp, Mus musculus
ttctgactatcgtggtctctactgc

SEQ ID NO: 942179 - DNA, 25 bp, Mus musculus
ttctgactcaggaactccctaacta

SEQ ID NO: 942180 - DNA, 25 bp, Mus musculus
ttctgactcaggtactccctaacta

SEQ ID NO: 942181 - DNA, 25 bp, Mus musculus
ttctgactcagtaggtccgggacgg

SEQ ID NO: 942182 - DNA, 25 bp, Mus musculus
ttctgactcagttggtccgggacgg

SEQ ID NO: 942183 - DNA, 25 bp, Mus musculus
ttctgactccaacactgaaggcgaa

SEQ ID NO: 942184 - DNA, 25 bp, Mus musculus
ttctgactccaagactgaaggcgaa

SEQ ID NO: 942185 - DNA, 25 bp, Mus musculus
ttctgactccctaacctgagtttaa

SEQ ID NO: 942186 - DNA, 25 bp, Mus musculus
ttctgactcccttacctgagtttaa

SEQ ID NO: 942187 - DNA, 25 bp, Mus musculus
ttctgactctatatactcctgtgtg

SEQ ID NO: 942188 - DNA, 25 bp, Mus musculus
ttctgactctatttactcctgtgtg

SEQ ID NO: 942189 - DNA, 25 bp, Mus musculus
ttctgactctcaacacggtgcaagg

SEQ ID NO: 942190 - DNA, 25 bp, Mus musculus
ttctgactctcatcacggtgcaagg

SEQ ID NO: 942191 - DNA, 25 bp, Mus musculus
ttctgactctgtacgtgtgcacaca

SEQ ID NO: 942192 - DNA, 25 bp, Mus musculus
ttctgactctgttcgtgtgcacaca

SEQ ID NO: 942193 - DNA, 25 bp, Mus musculus
ttctgactcttacctcacttggtct

SEQ ID NO: 942194 - DNA, 25 bp, Mus musculus
ttctgactcttagctcacttggtct

SEQ ID NO: 942195 - DNA, 25 bp, Mus musculus
ttctgactgacaactgcctttacta

SEQ ID NO: 942196 - DNA, 25 bp, Mus musculus
ttctgactgacatctgcctttacta

SEQ ID NO: 942197 - DNA, 25 bp, Mus musculus
ttctgactgagaatttaaattgcag

SEQ ID NO: 942198 - DNA, 25 bp, Mus musculus
ttctgactgagattttaaattgcag

SEQ ID NO: 942199 - DNA, 25 bp, Mus musculus
ttctgactgcctactccactggaat

SEQ ID NO: 942200 - DNA, 25 bp, Mus musculus
ttctgactgcctcctgggaccaggg

SEQ ID NO: 942201 - DNA, 25 bp, Mus musculus
ttctgactgcctgctgggaccaggg

SEQ ID NO: 942202 - DNA, 25 bp, Mus musculus
ttctgactgccttctccactggaat

SEQ ID NO: 942203 - DNA, 25 bp, Mus musculus
ttctgactgctcctgtcatgtatga

SEQ ID NO: 942204 - DNA, 25 bp, Mus musculus
ttctgactgctcgtgtcatgtatga

SEQ ID NO: 942205 - DNA, 25 bp, Mus musculus
ttctgactgctgagtctatgctgcc

SEQ ID NO: 942206 - DNA, 25 bp, Mus musculus
ttctgactgctgtgtctatgctgcc

SEQ ID NO: 942207 - DNA, 25 bp, Mus musculus
ttctgactggtcctattttctgaaa

SEQ ID NO: 942208 - DNA, 25 bp, Mus musculus
ttctgactggtcgtattttctgaaa

SEQ ID NO: 942209 - DNA, 25 bp, Mus musculus
ttctgactgtgactgaaatcaatgc

SEQ ID NO: 942210 - DNA, 25 bp, Mus musculus
ttctgactgtgagtgaaatcaatgc

SEQ ID NO: 942211 - DNA, 25 bp, Mus musculus
ttctgacttacaaggtgtttcacat

SEQ ID NO: 942212 - DNA, 25 bp, Mus musculus
ttctgacttacacaacctggaggca

SEQ ID NO: 942213 - DNA, 25 bp, Mus musculus
ttctgacttacagaacctggaggca

SEQ ID NO: 942214 - DNA, 25 bp, Mus musculus
ttctgacttacatggtgtttcacat

SEQ ID NO: 942215 - DNA, 25 bp, Mus musculus
ttctgacttcatatgtttttctaca

SEQ ID NO: 942216 - DNA, 25 bp, Mus musculus
ttctgacttcatttgtttttctaca

SEQ ID NO: 942217 - DNA, 25 bp, Mus musculus
ttctgacttccaatcgcattccatg

SEQ ID NO: 942218 - DNA, 25 bp, Mus musculus
ttctgacttccattcgcattccatg

SEQ ID NO: 942219 - DNA, 25 bp, Mus musculus
ttctgacttcctagtgggttggtac

SEQ ID NO: 942220 - DNA, 25 bp, Mus musculus
ttctgacttccttgtgggttggtac

SEQ ID NO: 942221 - DNA, 25 bp, Mus musculus
ttctgacttgcccataactgtgtat

SEQ ID NO: 942222 - DNA, 25 bp, Mus musculus
ttctgacttgccgataactgtgtat

SEQ ID NO: 942223 - DNA, 25 bp, Mus musculus
ttctgacttggcatcctctgattgt

SEQ ID NO: 942224 - DNA, 25 bp, Mus musculus
ttctgacttggcattgccatttttt

SEQ ID NO: 942225 - DNA, 25 bp, Mus musculus
ttctgacttggcttcctctgattgt

SEQ ID NO: 942226 - DNA, 25 bp, Mus musculus
ttctgacttggctttgccatttttt

SEQ ID NO: 942227 - DNA, 25 bp, Mus musculus
ttctgactttagagtttcctagaca

SEQ ID NO: 942228 - DNA, 25 bp, Mus musculus
ttctgactttagtgtttcctagaca

SEQ ID NO: 942229 - DNA, 25 bp, Mus musculus
ttctgactttataaatggatggcct

SEQ ID NO: 942230 - DNA, 25 bp, Mus musculus
ttctgactttattaatggatggcct

SEQ ID NO: 942231 - DNA, 25 bp, Mus musculus
ttctgactttccatgcctggtggca

SEQ ID NO: 942232 - DNA, 25 bp, Mus musculus
ttctgactttccttgcctggtggca

SEQ ID NO: 942233 - DNA, 25 bp, Mus musculus
ttctgactttgacctggagttcccg

SEQ ID NO: 942234 - DNA, 25 bp, Mus musculus
ttctgactttgagctggagttcccg

SEQ ID NO: 942235 - DNA, 25 bp, Mus musculus
ttctgacttttgacccgttcaggaa

SEQ ID NO: 942236 - DNA, 25 bp, Mus musculus
ttctgacttttgtcccgttcaggaa

SEQ ID NO: 942237 - DNA, 25 bp, Mus musculus
ttctgagaaactcccaaattgattt

SEQ ID NO: 942238 - DNA, 25 bp, Mus musculus
ttctgagaaactgccaaattgattt

SEQ ID NO: 942239 - DNA, 25 bp, Mus musculus
ttctgagaacttagtccgtccgtac

SEQ ID NO: 942240 - DNA, 25 bp, Mus musculus
ttctgagaactttgtccgtccgtac

SEQ ID NO: 942241 - DNA, 25 bp, Mus musculus
ttctgagaagttctaaagaggctgc

SEQ ID NO: 942242 - DNA, 25 bp, Mus musculus
ttctgagaagttgtaaagaggctgc

SEQ ID NO: 942243 - DNA, 25 bp, Mus musculus
ttctgagaattgaacctcggtcctc

SEQ ID NO: 942244 - DNA, 25 bp, Mus musculus
ttctgagaattgtacctcggtcctc

SEQ ID NO: 942245 - DNA, 25 bp, Mus musculus
ttctgagacaagaggctgctgatca

SEQ ID NO: 942246 - DNA, 25 bp, Mus musculus
ttctgagacaagtggctgctgatca

SEQ ID NO: 942247 - DNA, 25 bp, Mus musculus
ttctgagacagccaaagtgttcctt

SEQ ID NO: 942248 - DNA, 25 bp, Mus musculus
ttctgagacagcgaaagtgttcctt

SEQ ID NO: 942249 - DNA, 25 bp, Mus musculus
ttctgagaccatcaagaaatcatta

SEQ ID NO: 942250 - DNA, 25 bp, Mus musculus
ttctgagaccatgaagaaatcatta

SEQ ID NO: 942251 - DNA, 25 bp, Mus musculus
ttctgagactagatgcccattggat

SEQ ID NO: 942252 - DNA, 25 bp, Mus musculus
ttctgagactagttgcccattggat

SEQ ID NO: 942253 - DNA, 25 bp, Mus musculus
ttctgagactataaatgtgcttgct

SEQ ID NO: 942254 - DNA, 25 bp, Mus musculus
ttctgagactattaatgtgcttgct

SEQ ID NO: 942255 - DNA, 25 bp, Mus musculus
ttctgagactcaatctaccatgaag

SEQ ID NO: 942256 - DNA, 25 bp, Mus musculus
ttctgagactcattctaccatgaag

SEQ ID NO: 942257 - DNA, 25 bp, Mus musculus
ttctgagagactagcgctcccgcag

SEQ ID NO: 942258 - DNA, 25 bp, Mus musculus
ttctgagagactctctatcctgaag

SEQ ID NO: 942259 - DNA, 25 bp, Mus musculus
ttctgagagactgtctatcctgaag

SEQ ID NO: 942260 - DNA, 25 bp, Mus musculus
ttctgagagacttgcgctcccgcag

SEQ ID NO: 942261 - DNA, 25 bp, Mus musculus
ttctgagagtcgcatggagcaccat

SEQ ID NO: 942262 - DNA, 25 bp, Mus musculus
ttctgagagtcggatggagcaccat

SEQ ID NO: 942263 - DNA, 25 bp, Mus musculus
ttctgagatcttactgctgacgatt

SEQ ID NO: 942264 - DNA, 25 bp, Mus musculus
ttctgagatctttctgctgacgatt

SEQ ID NO: 942265 - DNA, 25 bp, Mus musculus
ttctgagattcaaatccggtccaag

SEQ ID NO: 942266 - DNA, 25 bp, Mus musculus
ttctgagattcatatccggtccaag

SEQ ID NO: 942267 - DNA, 25 bp, Mus musculus
ttctgagcacataggaagcctccca

SEQ ID NO: 942268 - DNA, 25 bp, Mus musculus
ttctgagcacattggaagcctccca

SEQ ID NO: 942269 - DNA, 25 bp, Mus musculus
ttctgagcacctagtgggagtcaca

SEQ ID NO: 942270 - DNA, 25 bp, Mus musculus
ttctgagcaccttgtgggagtcaca

SEQ ID NO: 942271 - DNA, 25 bp, Mus musculus
ttctgagcagctcaagacaccgtat

SEQ ID NO: 942272 - DNA, 25 bp, Mus musculus
ttctgagcagctgaagacaccgtat

SEQ ID NO: 942273 - DNA, 25 bp, Mus musculus
ttctgagcatatacccacctgtgtg

SEQ ID NO: 942274 - DNA, 25 bp, Mus musculus
ttctgagcatattcccacctgtgtg

SEQ ID NO: 942275 - DNA, 25 bp, Mus musculus
ttctgagccagcaaacctgttggat

SEQ ID NO: 942276 - DNA, 25 bp, Mus musculus
ttctgagccagctaacctgttggat

SEQ ID NO: 942277 - DNA, 25 bp, Mus musculus
ttctgagcccctaacacttaatatg

SEQ ID NO: 942278 - DNA, 25 bp, Mus musculus
ttctgagccccttacacttaatatg

SEQ ID NO: 942279 - DNA, 25 bp, Mus musculus
ttctgagccctaataattccacatc

SEQ ID NO: 942280 - DNA, 25 bp, Mus musculus
ttctgagccctattaattccacatc

SEQ ID NO: 942281 - DNA, 25 bp, Mus musculus
ttctgagcctagagtggaagccaac

SEQ ID NO: 942282 - DNA, 25 bp, Mus musculus
ttctgagcctagatggaaaccccaa

SEQ ID NO: 942283 - DNA, 25 bp, Mus musculus
ttctgagcctagtgtggaagccaac

SEQ ID NO: 942284 - DNA, 25 bp, Mus musculus
ttctgagcctagttggaaaccccaa

SEQ ID NO: 942285 - DNA, 25 bp, Mus musculus
ttctgagcctgtatctgctcaatgc

SEQ ID NO: 942286 - DNA, 25 bp, Mus musculus
ttctgagcctgtttctgctcaatgc

SEQ ID NO: 942287 - DNA, 25 bp, Mus musculus
ttctgagccttaaccctagtgaagt

SEQ ID NO: 942288 - DNA, 25 bp, Mus musculus
ttctgagccttatccctagtgaagt

SEQ ID NO: 942289 - DNA, 25 bp, Mus musculus
ttctgagcgtgccttgagactagtg

SEQ ID NO: 942290 - DNA, 25 bp, Mus musculus
ttctgagcgtgcgttgagactagtg

SEQ ID NO: 942291 - DNA, 25 bp, Mus musculus
ttctgagctagacaccacggtactt

SEQ ID NO: 942292 - DNA, 25 bp, Mus musculus
ttctgagctagagaccacggtactt

SEQ ID NO: 942293 - DNA, 25 bp, Mus musculus
ttctgagctcatagtaattggtaat

SEQ ID NO: 942294 - DNA, 25 bp, Mus musculus
ttctgagctcattgtaattggtaat

SEQ ID NO: 942295 - DNA, 25 bp, Mus musculus
ttctgagctggaactttctgccaaa

SEQ ID NO: 942296 - DNA, 25 bp, Mus musculus
ttctgagctggatctttctgccaaa

SEQ ID NO: 942297 - DNA, 25 bp, Mus musculus
ttctgaggacaacaaccttggacac

SEQ ID NO: 942298 - DNA, 25 bp, Mus musculus
ttctgaggacaagaaccttggacac

SEQ ID NO: 942299 - DNA, 25 bp, Mus musculus
ttctgaggacccaaaacccagccta

SEQ ID NO: 942300 - DNA, 25 bp, Mus musculus
ttctgaggaccctaaacccagccta

SEQ ID NO: 942301 - DNA, 25 bp, Mus musculus
ttctgaggacctccgtggagtcaca

SEQ ID NO: 942302 - DNA, 25 bp, Mus musculus
ttctgaggacctgcgtggagtcaca

SEQ ID NO: 942303 - DNA, 25 bp, Mus musculus
ttctgaggagacacctggtggcact

SEQ ID NO: 942304 - DNA, 25 bp, Mus musculus
ttctgaggagactcctggtggcact

SEQ ID NO: 942305 - DNA, 25 bp, Mus musculus
ttctgaggagagagtccaaggaaca

SEQ ID NO: 942306 - DNA, 25 bp, Mus musculus
ttctgaggagagtgtccaaggaaca

SEQ ID NO: 942307 - DNA, 25 bp, Mus musculus
ttctgaggagggaccagatgcaact

SEQ ID NO: 942308 - DNA, 25 bp, Mus musculus
ttctgaggagggtccagatgcaact

SEQ ID NO: 942309 - DNA, 25 bp, Mus musculus
ttctgaggatgcatcggcaagcggc

SEQ ID NO: 942310 - DNA, 25 bp, Mus musculus
ttctgaggatgcttcggcaagcggc

SEQ ID NO: 942311 - DNA, 25 bp, Mus musculus
ttctgaggcaacctggagctgtccc

SEQ ID NO: 942312 - DNA, 25 bp, Mus musculus
ttctgaggcaacgtggagctgtccc

SEQ ID NO: 942313 - DNA, 25 bp, Mus musculus
ttctgaggctaacgtatggcttggt

SEQ ID NO: 942314 - DNA, 25 bp, Mus musculus
ttctgaggctaaggtatggcttggt

SEQ ID NO: 942315 - DNA, 25 bp, Mus musculus
ttctgaggcttgagctcacagcagg

SEQ ID NO: 942316 - DNA, 25 bp, Mus musculus
ttctgaggcttgtgctcacagcagg

SEQ ID NO: 942317 - DNA, 25 bp, Mus musculus
ttctgagggaaaatggcggtttcaa

SEQ ID NO: 942318 - DNA, 25 bp, Mus musculus
ttctgagggaaattggcggtttcaa

SEQ ID NO: 942319 - DNA, 25 bp, Mus musculus
ttctgagggaacagaggacagccta

SEQ ID NO: 942320 - DNA, 25 bp, Mus musculus
ttctgagggaactgaggacagccta

SEQ ID NO: 942321 - DNA, 25 bp, Mus musculus
ttctgagggagcagcgctacctgaa

SEQ ID NO: 942322 - DNA, 25 bp, Mus musculus
ttctgagggagctgcgctacctgaa

SEQ ID NO: 942323 - DNA, 25 bp, Mus musculus
ttctgagggcagcagcccaattcaa

SEQ ID NO: 942324 - DNA, 25 bp, Mus musculus
ttctgagggcaggagcccaattcaa

SEQ ID NO: 942325 - DNA, 25 bp, Mus musculus
ttctgagggcgacgacagcaccgac

SEQ ID NO: 942326 - DNA, 25 bp, Mus musculus
ttctgagggcgaggacagcaccgac

SEQ ID NO: 942327 - DNA, 25 bp, Mus musculus
ttctgaggtataatctgggtggtta

SEQ ID NO: 942328 - DNA, 25 bp, Mus musculus
ttctgaggtatattctgggtggtta

SEQ ID NO: 942329 - DNA, 25 bp, Mus musculus
ttctgaggtcgcagagtgtacccag

SEQ ID NO: 942330 - DNA, 25 bp, Mus musculus
ttctgaggtcgctgagtgtacccag

SEQ ID NO: 942331 - DNA, 25 bp, Mus musculus
ttctgaggtctcacaaagcctggtt

SEQ ID NO: 942332 - DNA, 25 bp, Mus musculus
ttctgaggtctctcaaagcctggtt

SEQ ID NO: 942333 - DNA, 25 bp, Mus musculus
ttctgaggtgcaagtgcagcctccc

SEQ ID NO: 942334 - DNA, 25 bp, Mus musculus
ttctgaggtgcatgtgcagcctccc

SEQ ID NO: 942335 - DNA, 25 bp, Mus musculus
ttctgagtccaccttacacacaatg

SEQ ID NO: 942336 - DNA, 25 bp, Mus musculus
ttctgagtccacgttacacacaatg

SEQ ID NO: 942337 - DNA, 25 bp, Mus musculus
ttctgagtccccaggttttctgcat

SEQ ID NO: 942338 - DNA, 25 bp, Mus musculus
ttctgagtcccctggttttctgcat

SEQ ID NO: 942339 - DNA, 25 bp, Mus musculus
ttctgagtccttaacatcatttgtt

SEQ ID NO: 942340 - DNA, 25 bp, Mus musculus
ttctgagtcctttacatcatttgtt

SEQ ID NO: 942341 - DNA, 25 bp, Mus musculus
ttctgagtctccagtctgcgggtac

SEQ ID NO: 942342 - DNA, 25 bp, Mus musculus
ttctgagtctcctgtctgcgggtac

SEQ ID NO: 942343 - DNA, 25 bp, Mus musculus
ttctgagtctctatgcctacaagca

SEQ ID NO: 942344 - DNA, 25 bp, Mus musculus
ttctgagtctctttgcctacaagca

SEQ ID NO: 942345 - DNA, 25 bp, Mus musculus
ttctgagtctgtctacacttaccac

SEQ ID NO: 942346 - DNA, 25 bp, Mus musculus
ttctgagtctgtgtacacttaccac

SEQ ID NO: 942347 - DNA, 25 bp, Mus musculus
ttctgagtgcacacctttttcatgt

SEQ ID NO: 942348 - DNA, 25 bp, Mus musculus
ttctgagtgcactcctttttcatgt

SEQ ID NO: 942349 - DNA, 25 bp, Mus musculus
ttctgagtgccacgctcatgcttga

SEQ ID NO: 942350 - DNA, 25 bp, Mus musculus
ttctgagtgccaggctcatgcttga

SEQ ID NO: 942351 - DNA, 25 bp, Mus musculus
ttctgagtgcttaccttgtgtgagc

SEQ ID NO: 942352 - DNA, 25 bp, Mus musculus
ttctgagtgcttatagcccctgaaa

SEQ ID NO: 942353 - DNA, 25 bp, Mus musculus
ttctgagtgctttccttgtgtgagc

SEQ ID NO: 942354 - DNA, 25 bp, Mus musculus
ttctgagtgcttttagcccctgaaa

SEQ ID NO: 942355 - DNA, 25 bp, Mus musculus
ttctgagtggcaaaggtcttgagac

SEQ ID NO: 942356 - DNA, 25 bp, Mus musculus
ttctgagtggcataggtcttgagac

SEQ ID NO: 942357 - DNA, 25 bp, Mus musculus
ttctgagtgggaccccagattcctc

SEQ ID NO: 942358 - DNA, 25 bp, Mus musculus
ttctgagtgggagcccagattcctc

SEQ ID NO: 942359 - DNA, 25 bp, Mus musculus
ttctgagtgtacacgttgcgctgtt

SEQ ID NO: 942360 - DNA, 25 bp, Mus musculus
ttctgagtgtactcgttgcgctgtt

SEQ ID NO: 942361 - DNA, 25 bp, Mus musculus
ttctgagttacaatgagggcctgat

SEQ ID NO: 942362 - DNA, 25 bp, Mus musculus
ttctgagttacattgagggcctgat

SEQ ID NO: 942363 - DNA, 25 bp, Mus musculus
ttctgagttctgcagcaaactgctc

SEQ ID NO: 942364 - DNA, 25 bp, Mus musculus
ttctgagttctggagcaaactgctc

SEQ ID NO: 942365 - DNA, 25 bp, Mus musculus
ttctgagttgaaagtcgatggtgca

SEQ ID NO: 942366 - DNA, 25 bp, Mus musculus
ttctgagttgaatgtcgatggtgca

SEQ ID NO: 942367 - DNA, 25 bp, Mus musculus
ttctgagttgccaaagctcttaact

SEQ ID NO: 942368 - DNA, 25 bp, Mus musculus
ttctgagttgcctaagctcttaact

SEQ ID NO: 942369 - DNA, 25 bp, Mus musculus
ttctgagttgctccttggcttagca

SEQ ID NO: 942370 - DNA, 25 bp, Mus musculus
ttctgagttgctgcttggcttagca

SEQ ID NO: 942371 - DNA, 25 bp, Mus musculus
ttctgagtttcaaactctcgaggcc

SEQ ID NO: 942372 - DNA, 25 bp, Mus musculus
ttctgagtttcatactctcgaggcc

SEQ ID NO: 942373 - DNA, 25 bp, Mus musculus
ttctgatacagtccacgttctctgc

SEQ ID NO: 942374 - DNA, 25 bp, Mus musculus
ttctgatacagtgcacgttctctgc

SEQ ID NO: 942375 - DNA, 25 bp, Mus musculus
ttctgatagatacctcccaccttga

SEQ ID NO: 942376 - DNA, 25 bp, Mus musculus
ttctgatagatagctcccaccttga

SEQ ID NO: 942377 - DNA, 25 bp, Mus musculus
ttctgatatcagctcccgattacaa

SEQ ID NO: 942378 - DNA, 25 bp, Mus musculus
ttctgatatcaggtcccgattacaa

SEQ ID NO: 942379 - DNA, 25 bp, Mus musculus
ttctgatcaggtccgtctcttggtc

SEQ ID NO: 942380 - DNA, 25 bp, Mus musculus
ttctgatcaggtgcgtctcttggtc

SEQ ID NO: 942381 - DNA, 25 bp, Mus musculus
ttctgatccccaaagaaggaaatgt

SEQ ID NO: 942382 - DNA, 25 bp, Mus musculus
ttctgatccccaagggcacgatcct

SEQ ID NO: 942383 - DNA, 25 bp, Mus musculus
ttctgatccccatagaaggaaatgt

SEQ ID NO: 942384 - DNA, 25 bp, Mus musculus
ttctgatccccatgggcacgatcct

SEQ ID NO: 942385 - DNA, 25 bp, Mus musculus
ttctgatcccgaaaacccagagaca

SEQ ID NO: 942386 - DNA, 25 bp, Mus musculus
ttctgatcccgataacccagagaca

SEQ ID NO: 942387 - DNA, 25 bp, Mus musculus
ttctgatcgaccctttcaaagtgaa

SEQ ID NO: 942388 - DNA, 25 bp, Mus musculus
ttctgatcgaccgtttcaaagtgaa

SEQ ID NO: 942389 - DNA, 25 bp, Mus musculus
ttctgatctcagaaatgccaccctc

SEQ ID NO: 942390 - DNA, 25 bp, Mus musculus
ttctgatctcagtaatgccaccctc

SEQ ID NO: 942391 - DNA, 25 bp, Mus musculus
ttctgatctgttcggtgtggcttcc

SEQ ID NO: 942392 - DNA, 25 bp, Mus musculus
ttctgatctgttgggtgtggcttcc

SEQ ID NO: 942393 - DNA, 25 bp, Mus musculus
ttctgatcttttactggaaggcact

SEQ ID NO: 942394 - DNA, 25 bp, Mus musculus
ttctgatctttttctggaaggcact

SEQ ID NO: 942395 - DNA, 25 bp, Mus musculus
ttctgatgaaatcttcccatactca

SEQ ID NO: 942396 - DNA, 25 bp, Mus musculus
ttctgatgaaatgttcccatactca

SEQ ID NO: 942397 - DNA, 25 bp, Mus musculus
ttctgatgacagctccctgggcaag

SEQ ID NO: 942398 - DNA, 25 bp, Mus musculus
ttctgatgacaggtccctgggcaag

SEQ ID NO: 942399 - DNA, 25 bp, Mus musculus
ttctgatgagagaagggccctgact

SEQ ID NO: 942400 - DNA, 25 bp, Mus musculus
ttctgatgagagtagggccctgact

SEQ ID NO: 942401 - DNA, 25 bp, Mus musculus
ttctgatgagatatatgttgtccca

SEQ ID NO: 942402 - DNA, 25 bp, Mus musculus
ttctgatgagatttatgttgtccca

SEQ ID NO: 942403 - DNA, 25 bp, Mus musculus
ttctgatgagcaattgctcttgtat

SEQ ID NO: 942404 - DNA, 25 bp, Mus musculus
ttctgatgagcatttgctcttgtat

SEQ ID NO: 942405 - DNA, 25 bp, Mus musculus
ttctgatgcaggagcgcaggccctc

SEQ ID NO: 942406 - DNA, 25 bp, Mus musculus
ttctgatgcaggtgcgcaggccctc

SEQ ID NO: 942407 - DNA, 25 bp, Mus musculus
ttctgatgcagtaacagtgagttgc

SEQ ID NO: 942408 - DNA, 25 bp, Mus musculus
ttctgatgcagttacagtgagttgc

SEQ ID NO: 942409 - DNA, 25 bp, Mus musculus
ttctgatgcattctgatgggtcagt

SEQ ID NO: 942410 - DNA, 25 bp, Mus musculus
ttctgatgcattgtgatgggtcagt

SEQ ID NO: 942411 - DNA, 25 bp, Mus musculus
ttctgatgcctcataaacttatgtc

SEQ ID NO: 942412 - DNA, 25 bp, Mus musculus
ttctgatgcctcttaaacttatgtc

SEQ ID NO: 942413 - DNA, 25 bp, Mus musculus
ttctgatgcctgaagaagtctctgg

SEQ ID NO: 942414 - DNA, 25 bp, Mus musculus
ttctgatgcctgtagaagtctctgg

SEQ ID NO: 942415 - DNA, 25 bp, Mus musculus
ttctgatgctccatggtccttggca

SEQ ID NO: 942416 - DNA, 25 bp, Mus musculus
ttctgatgctccttggtccttggca

SEQ ID NO: 942417 - DNA, 25 bp, Mus musculus
ttctgatggagcagttgcctgcagg

SEQ ID NO: 942418 - DNA, 25 bp, Mus musculus
ttctgatggagctgttgcctgcagg

SEQ ID NO: 942419 - DNA, 25 bp, Mus musculus
ttctgatgtaagatctgagtgtgac

SEQ ID NO: 942420 - DNA, 25 bp, Mus musculus
ttctgatgtaagttctgagtgtgac

SEQ ID NO: 942421 - DNA, 25 bp, Mus musculus
ttctgatgtagaagtgccgcctatt

SEQ ID NO: 942422 - DNA, 25 bp, Mus musculus
ttctgatgtagatgtgccgcctatt

SEQ ID NO: 942423 - DNA, 25 bp, Mus musculus
ttctgattagttctggaccgcctga

SEQ ID NO: 942424 - DNA, 25 bp, Mus musculus
ttctgattagttgtggaccgcctga

SEQ ID NO: 942425 - DNA, 25 bp, Mus musculus
ttctgattcaagagctactggcctg

SEQ ID NO: 942426 - DNA, 25 bp, Mus musculus
ttctgattcaagtgctactggcctg

SEQ ID NO: 942427 - DNA, 25 bp, Mus musculus
ttctgattcatcaaccgagtcttct

SEQ ID NO: 942428 - DNA, 25 bp, Mus musculus
ttctgattcatctaccgagtcttct

SEQ ID NO: 942429 - DNA, 25 bp, Mus musculus
ttctgattcattatagttttcttat

SEQ ID NO: 942430 - DNA, 25 bp, Mus musculus
ttctgattcattttagttttcttat

SEQ ID NO: 942431 - DNA, 25 bp, Mus musculus
ttctgattctctcatccaattaatg

SEQ ID NO: 942432 - DNA, 25 bp, Mus musculus
ttctgattctctgatccaattaatg

SEQ ID NO: 942433 - DNA, 25 bp, Mus musculus
ttctgattcttcatttttcactggc

SEQ ID NO: 942434 - DNA, 25 bp, Mus musculus
ttctgattcttcttttttcactggc

SEQ ID NO: 942435 - DNA, 25 bp, Mus musculus
ttctgattgcagagaggtgagtcct

SEQ ID NO: 942436 - DNA, 25 bp, Mus musculus
ttctgattgcagtgaggtgagtcct

SEQ ID NO: 942437 - DNA, 25 bp, Mus musculus
ttctgattggctctgaacttctgga

SEQ ID NO: 942438 - DNA, 25 bp, Mus musculus
ttctgattggctgtgaacttctgga

SEQ ID NO: 942439 - DNA, 25 bp, Mus musculus
ttctgattggttagatgtctcctcc

SEQ ID NO: 942440 - DNA, 25 bp, Mus musculus
ttctgattggtttgatgtctcctcc

SEQ ID NO: 942441 - DNA, 25 bp, Mus musculus
ttctgatttcagaccttcacaaagt

SEQ ID NO: 942442 - DNA, 25 bp, Mus musculus
ttctgatttcagtccttcacaaagt

SEQ ID NO: 942443 - DNA, 25 bp, Mus musculus
ttctgatttcttagatggctccctt

SEQ ID NO: 942444 - DNA, 25 bp, Mus musculus
ttctgatttctttgatggctccctt

SEQ ID NO: 942445 - DNA, 25 bp, Mus musculus
ttctgatttggacgctgccactcaa

SEQ ID NO: 942446 - DNA, 25 bp, Mus musculus
ttctgatttggaggctgccactcaa

SEQ ID NO: 942447 - DNA, 25 bp, Mus musculus
ttctgattttctatgctggactcct

SEQ ID NO: 942448 - DNA, 25 bp, Mus musculus
ttctgattttctttgctggactcct

SEQ ID NO: 942449 - DNA, 25 bp, Mus musculus
ttctgattttgtaaacatgggtact

SEQ ID NO: 942450 - DNA, 25 bp, Mus musculus
ttctgattttgttaacatgggtact

SEQ ID NO: 942451 - DNA, 25 bp, Mus musculus
ttctgatttttaatcctagcacaag

SEQ ID NO: 942452 - DNA, 25 bp, Mus musculus
ttctgatttttattcctagcacaag

SEQ ID NO: 942453 - DNA, 25 bp, Mus musculus
ttctgatttttcagttgcctttctg

SEQ ID NO: 942454 - DNA, 25 bp, Mus musculus
ttctgatttttctgttgcctttctg

SEQ ID NO: 942455 - DNA, 25 bp, Mus musculus
ttctgcaaaacgatgccacaccttg

SEQ ID NO: 942456 - DNA, 25 bp, Mus musculus
ttctgcaaaacgttgccacaccttg

SEQ ID NO: 942457 - DNA, 25 bp, Mus musculus
ttctgcaaccgaagtaccgaatgtg

SEQ ID NO: 942458 - DNA, 25 bp, Mus musculus
ttctgcaaccgatgtaccgaatgtg

SEQ ID NO: 942459 - DNA, 25 bp, Mus musculus
ttctgcaactttcttcagggctggt

SEQ ID NO: 942460 - DNA, 25 bp, Mus musculus
ttctgcaactttgttcagggctggt

SEQ ID NO: 942461 - DNA, 25 bp, Mus musculus
ttctgcaagcagctgaagccgagag

SEQ ID NO: 942462 - DNA, 25 bp, Mus musculus
ttctgcaagcaggtgaagccgagag

SEQ ID NO: 942463 - DNA, 25 bp, Mus musculus
ttctgcaagctcacatttggtctct

SEQ ID NO: 942464 - DNA, 25 bp, Mus musculus
ttctgcaagctctcatttggtctct

SEQ ID NO: 942465 - DNA, 25 bp, Mus musculus
ttctgcaaggctaatgacactcgtt

SEQ ID NO: 942466 - DNA, 25 bp, Mus musculus
ttctgcaaggcttatgacactcgtt

SEQ ID NO: 942467 - DNA, 25 bp, Mus musculus
ttctgcaagtaaacctgtgttaaca

SEQ ID NO: 942468 - DNA, 25 bp, Mus musculus
ttctgcaagtaatcctgtgttaaca

SEQ ID NO: 942469 - DNA, 25 bp, Mus musculus
ttctgcaatcctctccaggtcttta

SEQ ID NO: 942470 - DNA, 25 bp, Mus musculus
ttctgcaatcctgtccaggtcttta

SEQ ID NO: 942471 - DNA, 25 bp, Mus musculus
ttctgcaatcttctcactgtcaaaa

SEQ ID NO: 942472 - DNA, 25 bp, Mus musculus
ttctgcaatcttgtcactgtcaaaa

SEQ ID NO: 942473 - DNA, 25 bp, Mus musculus
ttctgcacaatccatcagtgttaca

SEQ ID NO: 942474 - DNA, 25 bp, Mus musculus
ttctgcacaatcgatcagtgttaca

SEQ ID NO: 942475 - DNA, 25 bp, Mus musculus
ttctgcacacagcttggactctcaa

SEQ ID NO: 942476 - DNA, 25 bp, Mus musculus
ttctgcacacaggttggactctcaa

SEQ ID NO: 942477 - DNA, 25 bp, Mus musculus
ttctgcacagatcttattgattcct

SEQ ID NO: 942478 - DNA, 25 bp, Mus musculus
ttctgcacagatgttattgattcct

SEQ ID NO: 942479 - DNA, 25 bp, Mus musculus
ttctgcacatatataactctcccta

SEQ ID NO: 942480 - DNA, 25 bp, Mus musculus
ttctgcacatatttaactctcccta

SEQ ID NO: 942481 - DNA, 25 bp, Mus musculus
ttctgcacattgacttgggtctcca

SEQ ID NO: 942482 - DNA, 25 bp, Mus musculus
ttctgcacattgtcttgggtctcca

SEQ ID NO: 942483 - DNA, 25 bp, Mus musculus
ttctgcaccactcctatttgtagct

SEQ ID NO: 942484 - DNA, 25 bp, Mus musculus
ttctgcaccactgctatttgtagct

SEQ ID NO: 942485 - DNA, 25 bp, Mus musculus
ttctgcacggtaagagctgacactc

SEQ ID NO: 942486 - DNA, 25 bp, Mus musculus
ttctgcacggtatgagctgacactc

SEQ ID NO: 942487 - DNA, 25 bp, Mus musculus
ttctgcactagaaggactgcgctgt

SEQ ID NO: 942488 - DNA, 25 bp, Mus musculus
ttctgcactagatggactgcgctgt

SEQ ID NO: 942489 - DNA, 25 bp, Mus musculus
ttctgcactgatacccctttatgaa

SEQ ID NO: 942490 - DNA, 25 bp, Mus musculus
ttctgcactgattcccctttatgaa

SEQ ID NO: 942491 - DNA, 25 bp, Mus musculus
ttctgcactgcaatcaaacgttctt

SEQ ID NO: 942492 - DNA, 25 bp, Mus musculus
ttctgcactgcattcaaacgttctt

SEQ ID NO: 942493 - DNA, 25 bp, Mus musculus
ttctgcactgccaatgtctgtttta

SEQ ID NO: 942494 - DNA, 25 bp, Mus musculus
ttctgcactgccagggtggtggatc

SEQ ID NO: 942495 - DNA, 25 bp, Mus musculus
ttctgcactgcctatgtctgtttta

SEQ ID NO: 942496 - DNA, 25 bp, Mus musculus
ttctgcactgcctgggtggtggatc

SEQ ID NO: 942497 - DNA, 25 bp, Mus musculus
ttctgcagaaatagatgatctatta

SEQ ID NO: 942498 - DNA, 25 bp, Mus musculus
ttctgcagaaattgatgatctatta

SEQ ID NO: 942499 - DNA, 25 bp, Mus musculus
ttctgcagaagaaggtccttgccct

SEQ ID NO: 942500 - DNA, 25 bp, Mus musculus
ttctgcagaagacctcctggcacag

SEQ ID NO: 942501 - DNA, 25 bp, Mus musculus
ttctgcagaagagctcctggcacag

SEQ ID NO: 942502 - DNA, 25 bp, Mus musculus
ttctgcagaagatggtccttgccct

SEQ ID NO: 942503 - DNA, 25 bp, Mus musculus
ttctgcagactcaattcacaaccga

SEQ ID NO: 942504 - DNA, 25 bp, Mus musculus
ttctgcagactctattcacaaccga

SEQ ID NO: 942505 - DNA, 25 bp, Mus musculus
ttctgcagagacatggttggccaca

SEQ ID NO: 942506 - DNA, 25 bp, Mus musculus
ttctgcagagacttggttggccaca

SEQ ID NO: 942507 - DNA, 25 bp, Mus musculus
ttctgcagcaacaacgggattcaat

SEQ ID NO: 942508 - DNA, 25 bp, Mus musculus
ttctgcagcaactacgggattcaat

SEQ ID NO: 942509 - DNA, 25 bp, Mus musculus
ttctgcagccagatctatctttgaa

SEQ ID NO: 942510 - DNA, 25 bp, Mus musculus
ttctgcagccagttctatctttgaa

SEQ ID NO: 942511 - DNA, 25 bp, Mus musculus
ttctgcagcgccatcccagctgtca

SEQ ID NO: 942512 - DNA, 25 bp, Mus musculus
ttctgcagcgccttcccagctgtca

SEQ ID NO: 942513 - DNA, 25 bp, Mus musculus
ttctgcagctccctcatattgaaga

SEQ ID NO: 942514 - DNA, 25 bp, Mus musculus
ttctgcagctccgtcatattgaaga

SEQ ID NO: 942515 - DNA, 25 bp, Mus musculus
ttctgcaggaaaccgcgtgtgtgtt

SEQ ID NO: 942516 - DNA, 25 bp, Mus musculus
ttctgcaggaaagcgcgtgtgtgtt

SEQ ID NO: 942517 - DNA, 25 bp, Mus musculus
ttctgcaggaacatccagcatgtgg

SEQ ID NO: 942518 - DNA, 25 bp, Mus musculus
ttctgcaggaacttccagcatgtgg

SEQ ID NO: 942519 - DNA, 25 bp, Mus musculus
ttctgcaggaagaagcctcaacccg

SEQ ID NO: 942520 - DNA, 25 bp, Mus musculus
ttctgcaggaagtagcctcaacccg

SEQ ID NO: 942521 - DNA, 25 bp, Mus musculus
ttctgcaggacaagatgttcatcac

SEQ ID NO: 942522 - DNA, 25 bp, Mus musculus
ttctgcaggacatgatgttcatcac

SEQ ID NO: 942523 - DNA, 25 bp, Mus musculus
ttctgcaggcagacaaagtggatct

SEQ ID NO: 942524 - DNA, 25 bp, Mus musculus
ttctgcaggcagcttcacgattaaa

SEQ ID NO: 942525 - DNA, 25 bp, Mus musculus
ttctgcaggcaggttcacgattaaa

SEQ ID NO: 942526 - DNA, 25 bp, Mus musculus
ttctgcaggcagtcaaagtggatct

SEQ ID NO: 942527 - DNA, 25 bp, Mus musculus
ttctgcagggaactgcgcccaacga

SEQ ID NO: 942528 - DNA, 25 bp, Mus musculus
ttctgcagggaagtgcgcccaacga

SEQ ID NO: 942529 - DNA, 25 bp, Mus musculus
ttctgcagggcccaggaattgcatt

SEQ ID NO: 942530 - DNA, 25 bp, Mus musculus
ttctgcagggccgaggaattgcatt

SEQ ID NO: 942531 - DNA, 25 bp, Mus musculus
ttctgcagtcggagctgaggtacga

SEQ ID NO: 942532 - DNA, 25 bp, Mus musculus
ttctgcagtcggtgctgaggtacga

SEQ ID NO: 942533 - DNA, 25 bp, Mus musculus
ttctgcagtctgcttgctcaccctt

SEQ ID NO: 942534 - DNA, 25 bp, Mus musculus
ttctgcagtctggttgctcaccctt

SEQ ID NO: 942535 - DNA, 25 bp, Mus musculus
ttctgcagtgacatcaagaccattt

SEQ ID NO: 942536 - DNA, 25 bp, Mus musculus
ttctgcagtgacttcaagaccattt

SEQ ID NO: 942537 - DNA, 25 bp, Mus musculus
ttctgcagtgagagttcctattcct

SEQ ID NO: 942538 - DNA, 25 bp, Mus musculus
ttctgcagtgagtgttcctattcct

SEQ ID NO: 942539 - DNA, 25 bp, Mus musculus
ttctgcagtgcaaggtgaaaagacc

SEQ ID NO: 942540 - DNA, 25 bp, Mus musculus
ttctgcagtgcatggtgaaaagacc

SEQ ID NO: 942541 - DNA, 25 bp, Mus musculus
ttctgcagttcaagcccttcactac

SEQ ID NO: 942542 - DNA, 25 bp, Mus musculus
ttctgcagttcatgcccttcactac

SEQ ID NO: 942543 - DNA, 25 bp, Mus musculus
ttctgcagttggctccgaatggcca

SEQ ID NO: 942544 - DNA, 25 bp, Mus musculus
ttctgcagttgggtccgaatggcca

SEQ ID NO: 942545 - DNA, 25 bp, Mus musculus
ttctgcataaagaaacccctcagcc

SEQ ID NO: 942546 - DNA, 25 bp, Mus musculus
ttctgcataaagtaacccctcagcc

SEQ ID NO: 942547 - DNA, 25 bp, Mus musculus
ttctgcatacacatccttggtcctt

SEQ ID NO: 942548 - DNA, 25 bp, Mus musculus
ttctgcatacacttccttggtcctt

SEQ ID NO: 942549 - DNA, 25 bp, Mus musculus
ttctgcatacagagccttacgaggc

SEQ ID NO: 942550 - DNA, 25 bp, Mus musculus
ttctgcatacagtgccttacgaggc

SEQ ID NO: 942551 - DNA, 25 bp, Mus musculus
ttctgcatcagtatggagaggtagc

SEQ ID NO: 942552 - DNA, 25 bp, Mus musculus
ttctgcatcagtttggagaggtagc

SEQ ID NO: 942553 - DNA, 25 bp, Mus musculus
ttctgcatcatcctgttgggacagt

SEQ ID NO: 942554 - DNA, 25 bp, Mus musculus
ttctgcatcatcgtgttgggacagt

SEQ ID NO: 942555 - DNA, 25 bp, Mus musculus
ttctgcatccttctttacattaata

SEQ ID NO: 942556 - DNA, 25 bp, Mus musculus
ttctgcatccttgtttacattaata

SEQ ID NO: 942557 - DNA, 25 bp, Mus musculus
ttctgcatctctatgtttctagtac

SEQ ID NO: 942558 - DNA, 25 bp, Mus musculus
ttctgcatctctttgtttctagtac

SEQ ID NO: 942559 - DNA, 25 bp, Mus musculus
ttctgcatctgcattgcgtagctat

SEQ ID NO: 942560 - DNA, 25 bp, Mus musculus
ttctgcatctgcatttgtcatgtta

SEQ ID NO: 942561 - DNA, 25 bp, Mus musculus
ttctgcatctgctttgcgtagctat

SEQ ID NO: 942562 - DNA, 25 bp, Mus musculus
ttctgcatctgcttttgtcatgtta

SEQ ID NO: 942563 - DNA, 25 bp, Mus musculus
ttctgcatctgtacagagagcagat

SEQ ID NO: 942564 - DNA, 25 bp, Mus musculus
ttctgcatctgttcagagagcagat

SEQ ID NO: 942565 - DNA, 25 bp, Mus musculus
ttctgcatgaatcacctccggagat

SEQ ID NO: 942566 - DNA, 25 bp, Mus musculus
ttctgcatgaatgacctccggagat

SEQ ID NO: 942567 - DNA, 25 bp, Mus musculus
ttctgcatgcaacgcctggaattac

SEQ ID NO: 942568 - DNA, 25 bp, Mus musculus
ttctgcatgcaaggcctggaattac

SEQ ID NO: 942569 - DNA, 25 bp, Mus musculus
ttctgcatgcgtctggcacgtgaag

SEQ ID NO: 942570 - DNA, 25 bp, Mus musculus
ttctgcatgcgtgtggcacgtgaag

SEQ ID NO: 942571 - DNA, 25 bp, Mus musculus
ttctgcatgctcatcggtcgaatga

SEQ ID NO: 942572 - DNA, 25 bp, Mus musculus
ttctgcatgctcttcggtcgaatga

SEQ ID NO: 942573 - DNA, 25 bp, Mus musculus
ttctgcatggtcaaagtctttgtgt

SEQ ID NO: 942574 - DNA, 25 bp, Mus musculus
ttctgcatggtctaagtctttgtgt

SEQ ID NO: 942575 - DNA, 25 bp, Mus musculus
ttctgcatggtgaacttgattcttt

SEQ ID NO: 942576 - DNA, 25 bp, Mus musculus
ttctgcatggtgtacttgattcttt

SEQ ID NO: 942577 - DNA, 25 bp, Mus musculus
ttctgcattctgatcaggtgataac

SEQ ID NO: 942578 - DNA, 25 bp, Mus musculus
ttctgcattctgttcaggtgataac

SEQ ID NO: 942579 - DNA, 25 bp, Mus musculus
ttctgccaaggacggactgactcct

SEQ ID NO: 942580 - DNA, 25 bp, Mus musculus
ttctgccaaggagggactgactcct

SEQ ID NO: 942581 - DNA, 25 bp, Mus musculus
ttctgccaagtacaaatccacacac

SEQ ID NO: 942582 - DNA, 25 bp, Mus musculus
ttctgccaagtagaaatccacacac

SEQ ID NO: 942583 - DNA, 25 bp, Mus musculus
ttctgccaccagaggtttacggatg

SEQ ID NO: 942584 - DNA, 25 bp, Mus musculus
ttctgccaccagtggtttacggatg

SEQ ID NO: 942585 - DNA, 25 bp, Mus musculus
ttctgccaccgccatctggataatg

SEQ ID NO: 942586 - DNA, 25 bp, Mus musculus
ttctgccaccgcgatctggataatg

SEQ ID NO: 942587 - DNA, 25 bp, Mus musculus
ttctgccaccgtccggagctcacac

SEQ ID NO: 942588 - DNA, 25 bp, Mus musculus
ttctgccaccgtgcggagctcacac

SEQ ID NO: 942589 - DNA, 25 bp, Mus musculus
ttctgccactgccttttacaaagca

SEQ ID NO: 942590 - DNA, 25 bp, Mus musculus
ttctgccactgcgttttacaaagca

SEQ ID NO: 942591 - DNA, 25 bp, Mus musculus
ttctgccagatgagtggcgtcctgg

SEQ ID NO: 942592 - DNA, 25 bp, Mus musculus
ttctgccagatgtgtggcgtcctgg

SEQ ID NO: 942593 - DNA, 25 bp, Mus musculus
ttctgccagcaaagccattcggatt

SEQ ID NO: 942594 - DNA, 25 bp, Mus musculus
ttctgccagcaatgccattcggatt

SEQ ID NO: 942595 - DNA, 25 bp, Mus musculus
ttctgccagcacaatttgaattttt

SEQ ID NO: 942596 - DNA, 25 bp, Mus musculus
ttctgccagcacctactgagggaga

SEQ ID NO: 942597 - DNA, 25 bp, Mus musculus
ttctgccagcacgtactgagggaga

SEQ ID NO: 942598 - DNA, 25 bp, Mus musculus
ttctgccagcactatttgaattttt

SEQ ID NO: 942599 - DNA, 25 bp, Mus musculus
ttctgccagctcagttctttgcctt

SEQ ID NO: 942600 - DNA, 25 bp, Mus musculus
ttctgccagctctgttctttgcctt

SEQ ID NO: 942601 - DNA, 25 bp, Mus musculus
ttctgccaggacatctggcgcgtac

SEQ ID NO: 942602 - DNA, 25 bp, Mus musculus
ttctgccaggacttctggcgcgtac

SEQ ID NO: 942603 - DNA, 25 bp, Mus musculus
ttctgccaggatactcgagctaagg

SEQ ID NO: 942604 - DNA, 25 bp, Mus musculus
ttctgccaggattctcgagctaagg

SEQ ID NO: 942605 - DNA, 25 bp, Mus musculus
ttctgccagggaagctgggccccaa

SEQ ID NO: 942606 - DNA, 25 bp, Mus musculus
ttctgccagggatgctgggccccaa

SEQ ID NO: 942607 - DNA, 25 bp, Mus musculus
ttctgccagggcacgtgcgcactac

SEQ ID NO: 942608 - DNA, 25 bp, Mus musculus
ttctgccagggctcgtgcgcactac

SEQ ID NO: 942609 - DNA, 25 bp, Mus musculus
ttctgccagtccatttgtatgcatt

SEQ ID NO: 942610 - DNA, 25 bp, Mus musculus
ttctgccagtccttttgtatgcatt

SEQ ID NO: 942611 - DNA, 25 bp, Mus musculus
ttctgccatagaatcatttgactta

SEQ ID NO: 942612 - DNA, 25 bp, Mus musculus
ttctgccatagattcatttgactta

SEQ ID NO: 942613 - DNA, 25 bp, Mus musculus
ttctgccatagtacctcactagtaa

SEQ ID NO: 942614 - DNA, 25 bp, Mus musculus
ttctgccatagttcctcactagtaa

SEQ ID NO: 942615 - DNA, 25 bp, Mus musculus
ttctgccatcgacctgctctcaata

SEQ ID NO: 942616 - DNA, 25 bp, Mus musculus
ttctgccatcgagctgctctcaata

SEQ ID NO: 942617 - DNA, 25 bp, Mus musculus
ttctgccatctgagactactgatat

SEQ ID NO: 942618 - DNA, 25 bp, Mus musculus
ttctgccatctgtgactactgatat

SEQ ID NO: 942619 - DNA, 25 bp, Mus musculus
ttctgccatgatagcgcccgctgtg

SEQ ID NO: 942620 - DNA, 25 bp, Mus musculus
ttctgccatgattgcgcccgctgtg

SEQ ID NO: 942621 - DNA, 25 bp, Mus musculus
ttctgccatgccagctacttagtac

SEQ ID NO: 942622 - DNA, 25 bp, Mus musculus
ttctgccatgcctgctacttagtac

SEQ ID NO: 942623 - DNA, 25 bp, Mus musculus
ttctgccattgcattgtactcattg

SEQ ID NO: 942624 - DNA, 25 bp, Mus musculus
ttctgccattgctttgtactcattg

SEQ ID NO: 942625 - DNA, 25 bp, Mus musculus
ttctgccatttgctagatatgcaat

SEQ ID NO: 942626 - DNA, 25 bp, Mus musculus
ttctgccatttggtagatatgcaat

SEQ ID NO: 942627 - DNA, 25 bp, Mus musculus
ttctgcccaagccaacccggaaaag

SEQ ID NO: 942628 - DNA, 25 bp, Mus musculus
ttctgcccaagcgaacccggaaaag

SEQ ID NO: 942629 - DNA, 25 bp, Mus musculus
ttctgcccacataccatatttgctt

SEQ ID NO: 942630 - DNA, 25 bp, Mus musculus
ttctgcccacattccatatttgctt

SEQ ID NO: 942631 - DNA, 25 bp, Mus musculus
ttctgcccactgacgggcatgtgca

SEQ ID NO: 942632 - DNA, 25 bp, Mus musculus
ttctgcccactgtcgggcatgtgca

SEQ ID NO: 942633 - DNA, 25 bp, Mus musculus
ttctgcccacttccaagaacttagg

SEQ ID NO: 942634 - DNA, 25 bp, Mus musculus
ttctgcccacttgcaagaacttagg

SEQ ID NO: 942635 - DNA, 25 bp, Mus musculus
ttctgcccagctagacttcttaatc

SEQ ID NO: 942636 - DNA, 25 bp, Mus musculus
ttctgcccagcttgacttcttaatc

SEQ ID NO: 942637 - DNA, 25 bp, Mus musculus
ttctgcccaggcacctgatgaggta

SEQ ID NO: 942638 - DNA, 25 bp, Mus musculus
ttctgcccaggctcctgatgaggta

SEQ ID NO: 942639 - DNA, 25 bp, Mus musculus
ttctgcccagggatatttgctgctt

SEQ ID NO: 942640 - DNA, 25 bp, Mus musculus
ttctgcccagggttatttgctgctt

SEQ ID NO: 942641 - DNA, 25 bp, Mus musculus
ttctgcccatgacctaggaacagct

SEQ ID NO: 942642 - DNA, 25 bp, Mus musculus
ttctgcccatgagctaggaacagct

SEQ ID NO: 942643 - DNA, 25 bp, Mus musculus
ttctgcccattacacaggcacttag

SEQ ID NO: 942644 - DNA, 25 bp, Mus musculus
ttctgcccattagacaggcacttag

SEQ ID NO: 942645 - DNA, 25 bp, Mus musculus
ttctgccccggaagccagaagagat

SEQ ID NO: 942646 - DNA, 25 bp, Mus musculus
ttctgccccggatgccagaagagat

SEQ ID NO: 942647 - DNA, 25 bp, Mus musculus
ttctgccccttgattcttactagtt

SEQ ID NO: 942648 - DNA, 25 bp, Mus musculus
ttctgccccttgctaagttttcaaa

SEQ ID NO: 942649 - DNA, 25 bp, Mus musculus
ttctgccccttggtaagttttcaaa

SEQ ID NO: 942650 - DNA, 25 bp, Mus musculus
ttctgccccttgtttcttactagtt

SEQ ID NO: 942651 - DNA, 25 bp, Mus musculus
ttctgcccgccactctggcttttaa

SEQ ID NO: 942652 - DNA, 25 bp, Mus musculus
ttctgcccgccagtctggcttttaa

SEQ ID NO: 942653 - DNA, 25 bp, Mus musculus
ttctgccctctaaaagcaccatttt

SEQ ID NO: 942654 - DNA, 25 bp, Mus musculus
ttctgccctctataagcaccatttt

SEQ ID NO: 942655 - DNA, 25 bp, Mus musculus
ttctgccctctgaatgccaatattt

SEQ ID NO: 942656 - DNA, 25 bp, Mus musculus
ttctgccctctgtatgccaatattt

SEQ ID NO: 942657 - DNA, 25 bp, Mus musculus
ttctgccctcttccagagtctagaa

SEQ ID NO: 942658 - DNA, 25 bp, Mus musculus
ttctgccctcttgcagagtctagaa

SEQ ID NO: 942659 - DNA, 25 bp, Mus musculus
ttctgccctgttatgattttgaaca

SEQ ID NO: 942660 - DNA, 25 bp, Mus musculus
ttctgccctgttttgattttgaaca

SEQ ID NO: 942661 - DNA, 25 bp, Mus musculus
ttctgcccttatactacaggcccag

SEQ ID NO: 942662 - DNA, 25 bp, Mus musculus
ttctgcccttattctacaggcccag

SEQ ID NO: 942663 - DNA, 25 bp, Mus musculus
ttctgcccttcactgttaaggtaca

SEQ ID NO: 942664 - DNA, 25 bp, Mus musculus
ttctgcccttcagtgttaaggtaca

SEQ ID NO: 942665 - DNA, 25 bp, Mus musculus
ttctgccctttgagacatcacacct

SEQ ID NO: 942666 - DNA, 25 bp, Mus musculus
ttctgccctttgtgacatcacacct

SEQ ID NO: 942667 - DNA, 25 bp, Mus musculus
ttctgccgagctaccaagctgtaga

SEQ ID NO: 942668 - DNA, 25 bp, Mus musculus
ttctgccgagcttccaagctgtaga

SEQ ID NO: 942669 - DNA, 25 bp, Mus musculus
ttctgccgatggagtccgacagcac

SEQ ID NO: 942670 - DNA, 25 bp, Mus musculus
ttctgccgatggtgtccgacagcac

SEQ ID NO: 942671 - DNA, 25 bp, Mus musculus
ttctgccgcagcaacttggatgcat

SEQ ID NO: 942672 - DNA, 25 bp, Mus musculus
ttctgccgcagctacttggatgcat

SEQ ID NO: 942673 - DNA, 25 bp, Mus musculus
ttctgccggtaccagtgtatggtta

SEQ ID NO: 942674 - DNA, 25 bp, Mus musculus
ttctgccggtacgagtgtatggtta

SEQ ID NO: 942675 - DNA, 25 bp, Mus musculus
ttctgccgtctcctttaggtacaaa

SEQ ID NO: 942676 - DNA, 25 bp, Mus musculus
ttctgccgtctcgtttaggtacaaa

SEQ ID NO: 942677 - DNA, 25 bp, Mus musculus
ttctgccgtggtctgctcgctgagc

SEQ ID NO: 942678 - DNA, 25 bp, Mus musculus
ttctgccgtggtgtgctcgctgagc

SEQ ID NO: 942679 - DNA, 25 bp, Mus musculus
ttctgccgtgtaatagtgttccatc

SEQ ID NO: 942680 - DNA, 25 bp, Mus musculus
ttctgccgtgtattagtgttccatc

SEQ ID NO: 942681 - DNA, 25 bp, Mus musculus
ttctgcctactacaaaggagcccat

SEQ ID NO: 942682 - DNA, 25 bp, Mus musculus
ttctgcctactagaaaggagcccat

SEQ ID NO: 942683 - DNA, 25 bp, Mus musculus
ttctgcctactccttttaacctctg

SEQ ID NO: 942684 - DNA, 25 bp, Mus musculus
ttctgcctactcgttttaacctctg

SEQ ID NO: 942685 - DNA, 25 bp, Mus musculus
ttctgcctaggcctgatcttttatc

SEQ ID NO: 942686 - DNA, 25 bp, Mus musculus
ttctgcctaggcgtgatcttttatc

SEQ ID NO: 942687 - DNA, 25 bp, Mus musculus
ttctgcctagtccattgtagtctta

SEQ ID NO: 942688 - DNA, 25 bp, Mus musculus
ttctgcctagtcgattgtagtctta

SEQ ID NO: 942689 - DNA, 25 bp, Mus musculus
ttctgcctattgacgcttagaaatg

SEQ ID NO: 942690 - DNA, 25 bp, Mus musculus
ttctgcctattgatttctatgctac

SEQ ID NO: 942691 - DNA, 25 bp, Mus musculus
ttctgcctattgtcgcttagaaatg

SEQ ID NO: 942692 - DNA, 25 bp, Mus musculus
ttctgcctattgttttctatgctac

SEQ ID NO: 942693 - DNA, 25 bp, Mus musculus
ttctgcctcaacaaggtgacccagg

SEQ ID NO: 942694 - DNA, 25 bp, Mus musculus
ttctgcctcaacatccctgaatgaa

SEQ ID NO: 942695 - DNA, 25 bp, Mus musculus
ttctgcctcaacctgtgctgccagc

SEQ ID NO: 942696 - DNA, 25 bp, Mus musculus
ttctgcctcaacgtgtgctgccagc

SEQ ID NO: 942697 - DNA, 25 bp, Mus musculus
ttctgcctcaactaggtgacccagg

SEQ ID NO: 942698 - DNA, 25 bp, Mus musculus
ttctgcctcaacttccctgaatgaa

SEQ ID NO: 942699 - DNA, 25 bp, Mus musculus
ttctgcctcaagagcatcgaagcgg

SEQ ID NO: 942700 - DNA, 25 bp, Mus musculus
ttctgcctcaagtgcatcgaagcgg

SEQ ID NO: 942701 - DNA, 25 bp, Mus musculus
ttctgcctcagaaccccatgaagca

SEQ ID NO: 942702 - DNA, 25 bp, Mus musculus
ttctgcctcagatccccatgaagca

SEQ ID NO: 942703 - DNA, 25 bp, Mus musculus
ttctgcctcagcaaaagtctaagtc

SEQ ID NO: 942704 - DNA, 25 bp, Mus musculus
ttctgcctcagctaaagtctaagtc

SEQ ID NO: 942705 - DNA, 25 bp, Mus musculus
ttctgcctcaggctcaggagctgat

SEQ ID NO: 942706 - DNA, 25 bp, Mus musculus
ttctgcctcagggtcaggagctgat

SEQ ID NO: 942707 - DNA, 25 bp, Mus musculus
ttctgcctcatcatgatatgtctgc

SEQ ID NO: 942708 - DNA, 25 bp, Mus musculus
ttctgcctcatcttgatatgtctgc

SEQ ID NO: 942709 - DNA, 25 bp, Mus musculus
ttctgcctcccaagctctgtcagat

SEQ ID NO: 942710 - DNA, 25 bp, Mus musculus
ttctgcctcccatgctctgtcagat

SEQ ID NO: 942711 - DNA, 25 bp, Mus musculus
ttctgcctcctacgcaagagaccag

SEQ ID NO: 942712 - DNA, 25 bp, Mus musculus
ttctgcctcctaggcaagagaccag

SEQ ID NO: 942713 - DNA, 25 bp, Mus musculus
ttctgcctccttaattgacacaatc

SEQ ID NO: 942714 - DNA, 25 bp, Mus musculus
ttctgcctcctttattgacacaatc

SEQ ID NO: 942715 - DNA, 25 bp, Mus musculus
ttctgcctcggtcggagcaccctgg

SEQ ID NO: 942716 - DNA, 25 bp, Mus musculus
ttctgcctcggtgggagcaccctgg

SEQ ID NO: 942717 - DNA, 25 bp, Mus musculus
ttctgcctctgaatgccggacagga

SEQ ID NO: 942718 - DNA, 25 bp, Mus musculus
ttctgcctctgattgccggacagga

SEQ ID NO: 942719 - DNA, 25 bp, Mus musculus
ttctgcctctgtctggagttgtcag

SEQ ID NO: 942720 - DNA, 25 bp, Mus musculus
ttctgcctctgtgtggagttgtcag

SEQ ID NO: 942721 - DNA, 25 bp, Mus musculus
ttctgcctcttcaccagctctgaga

SEQ ID NO: 942722 - DNA, 25 bp, Mus musculus
ttctgcctcttctccagctctgaga

SEQ ID NO: 942723 - DNA, 25 bp, Mus musculus
ttctgcctctttcaactcaacaaga

SEQ ID NO: 942724 - DNA, 25 bp, Mus musculus
ttctgcctctttgaactcaacaaga

SEQ ID NO: 942725 - DNA, 25 bp, Mus musculus
ttctgcctgaatcatactgaactga

SEQ ID NO: 942726 - DNA, 25 bp, Mus musculus
ttctgcctgaatgatactgaactga

SEQ ID NO: 942727 - DNA, 25 bp, Mus musculus
ttctgcctgacaactactttatcta

SEQ ID NO: 942728 - DNA, 25 bp, Mus musculus
ttctgcctgacatctactttatcta

SEQ ID NO: 942729 - DNA, 25 bp, Mus musculus
ttctgcctgatacggattattactc

SEQ ID NO: 942730 - DNA, 25 bp, Mus musculus
ttctgcctgatagggattattactc

SEQ ID NO: 942731 - DNA, 25 bp, Mus musculus
ttctgcctgcaaccactatggagct

SEQ ID NO: 942732 - DNA, 25 bp, Mus musculus
ttctgcctgcaagcactatggagct

SEQ ID NO: 942733 - DNA, 25 bp, Mus musculus
ttctgcctgcccctggaaggagctt

SEQ ID NO: 942734 - DNA, 25 bp, Mus musculus
ttctgcctgcccgtggaaggagctt

SEQ ID NO: 942735 - DNA, 25 bp, Mus musculus
ttctgcctgcgtcttaaaaaataag

SEQ ID NO: 942736 - DNA, 25 bp, Mus musculus
ttctgcctgcgtgttaaaaaataag

SEQ ID NO: 942737 - DNA, 25 bp, Mus musculus
ttctgcctggctagtgtctacaaaa

SEQ ID NO: 942738 - DNA, 25 bp, Mus musculus
ttctgcctggcttgtgtctacaaaa

SEQ ID NO: 942739 - DNA, 25 bp, Mus musculus
ttctgcctgggcagagccagtgttc

SEQ ID NO: 942740 - DNA, 25 bp, Mus musculus
ttctgcctgggctgagccagtgttc

SEQ ID NO: 942741 - DNA, 25 bp, Mus musculus
ttctgccttaagattctgttccatg

SEQ ID NO: 942742 - DNA, 25 bp, Mus musculus
ttctgccttaagtttctgttccatg

SEQ ID NO: 942743 - DNA, 25 bp, Mus musculus
ttctgccttatcctctttggagagt

SEQ ID NO: 942744 - DNA, 25 bp, Mus musculus
ttctgccttatcgtctttggagagt

SEQ ID NO: 942745 - DNA, 25 bp, Mus musculus
ttctgccttcagagtgacaatcatg

SEQ ID NO: 942746 - DNA, 25 bp, Mus musculus
ttctgccttcagtgtgacaatcatg

SEQ ID NO: 942747 - DNA, 25 bp, Mus musculus
ttctgccttgaaaatgtgtcttgtg

SEQ ID NO: 942748 - DNA, 25 bp, Mus musculus
ttctgccttgaaaggctaatgctgc

SEQ ID NO: 942749 - DNA, 25 bp, Mus musculus
ttctgccttgaatatgtgtcttgtg

SEQ ID NO: 942750 - DNA, 25 bp, Mus musculus
ttctgccttgaatggctaatgctgc

SEQ ID NO: 942751 - DNA, 25 bp, Mus musculus
ttctgccttgatcctcacatagaag

SEQ ID NO: 942752 - DNA, 25 bp, Mus musculus
ttctgccttgatgctcacatagaag

SEQ ID NO: 942753 - DNA, 25 bp, Mus musculus
ttctgccttggcactatttgtaaca

SEQ ID NO: 942754 - DNA, 25 bp, Mus musculus
ttctgccttggcatagagggtcatt

SEQ ID NO: 942755 - DNA, 25 bp, Mus musculus
ttctgccttggctctatttgtaaca

SEQ ID NO: 942756 - DNA, 25 bp, Mus musculus
ttctgccttggcttagagggtcatt

SEQ ID NO: 942757 - DNA, 25 bp, Mus musculus
ttctgccttgggatcgtgtaagcaa

SEQ ID NO: 942758 - DNA, 25 bp, Mus musculus
ttctgccttgggttcgtgtaagcaa

SEQ ID NO: 942759 - DNA, 25 bp, Mus musculus
ttctgccttgttctacaccatgtgt

SEQ ID NO: 942760 - DNA, 25 bp, Mus musculus
ttctgccttgttgtacaccatgtgt

SEQ ID NO: 942761 - DNA, 25 bp, Mus musculus
ttctgcctttaccttctgtgtgctg

SEQ ID NO: 942762 - DNA, 25 bp, Mus musculus
ttctgcctttacgttctgtgtgctg

SEQ ID NO: 942763 - DNA, 25 bp, Mus musculus
ttctgcctttatcaatatcaactgt

SEQ ID NO: 942764 - DNA, 25 bp, Mus musculus
ttctgcctttatgaatatcaactgt

SEQ ID NO: 942765 - DNA, 25 bp, Mus musculus
ttctgcctttcgattcatttcattt

SEQ ID NO: 942766 - DNA, 25 bp, Mus musculus
ttctgcctttcgtttcatttcattt

SEQ ID NO: 942767 - DNA, 25 bp, Mus musculus
ttctgccttttaagaaacttccggt

SEQ ID NO: 942768 - DNA, 25 bp, Mus musculus
ttctgccttttatgaaacttccggt

SEQ ID NO: 942769 - DNA, 25 bp, Mus musculus
ttctgcgaactaactcagcggacag

SEQ ID NO: 942770 - DNA, 25 bp, Mus musculus
ttctgcgaactatctcagcggacag

SEQ ID NO: 942771 - DNA, 25 bp, Mus musculus
ttctgcgaagttagatgctagctct

SEQ ID NO: 942772 - DNA, 25 bp, Mus musculus
ttctgcgaagtttgatgctagctct

SEQ ID NO: 942773 - DNA, 25 bp, Mus musculus
ttctgcgagcacatgtccatgaagg

SEQ ID NO: 942774 - DNA, 25 bp, Mus musculus
ttctgcgagcacttgtccatgaagg

SEQ ID NO: 942775 - DNA, 25 bp, Mus musculus
ttctgcgagtcacacccggagagca

SEQ ID NO: 942776 - DNA, 25 bp, Mus musculus
ttctgcgagtcagacccggagagca

SEQ ID NO: 942777 - DNA, 25 bp, Mus musculus
ttctgcgattcccttatgagtcttg

SEQ ID NO: 942778 - DNA, 25 bp, Mus musculus
ttctgcgattccgttatgagtcttg

SEQ ID NO: 942779 - DNA, 25 bp, Mus musculus
ttctgcgcaggtcctgactgactct

SEQ ID NO: 942780 - DNA, 25 bp, Mus musculus
ttctgcgcaggtgctgactgactct

SEQ ID NO: 942781 - DNA, 25 bp, Mus musculus
ttctgcgccttaaactgttccatta

SEQ ID NO: 942782 - DNA, 25 bp, Mus musculus
ttctgcgccttatactgttccatta

SEQ ID NO: 942783 - DNA, 25 bp, Mus musculus
ttctgcgctgttcttgtttctggga

SEQ ID NO: 942784 - DNA, 25 bp, Mus musculus
ttctgcgctgttgttgtttctggga

SEQ ID NO: 942785 - DNA, 25 bp, Mus musculus
ttctgcggaatgactcgggtgctga

SEQ ID NO: 942786 - DNA, 25 bp, Mus musculus
ttctgcggaatgtctcgggtgctga

SEQ ID NO: 942787 - DNA, 25 bp, Mus musculus
ttctgcggacctcctgatcctgaaa

SEQ ID NO: 942788 - DNA, 25 bp, Mus musculus
ttctgcggacctgctgatcctgaaa

SEQ ID NO: 942789 - DNA, 25 bp, Mus musculus
ttctgcggctacagggcagccccag

SEQ ID NO: 942790 - DNA, 25 bp, Mus musculus
ttctgcggctactgggcagccccag

SEQ ID NO: 942791 - DNA, 25 bp, Mus musculus
ttctgcgtcaccactgtccacgtag

SEQ ID NO: 942792 - DNA, 25 bp, Mus musculus
ttctgcgtcacctctgtccacgtag

SEQ ID NO: 942793 - DNA, 25 bp, Mus musculus
ttctgcgtcttgatagatggaccgt

SEQ ID NO: 942794 - DNA, 25 bp, Mus musculus
ttctgcgtcttgttagatggaccgt

SEQ ID NO: 942795 - DNA, 25 bp, Mus musculus
ttctgcgtgcctcggactgctaagt

SEQ ID NO: 942796 - DNA, 25 bp, Mus musculus
ttctgcgtgcctgggactgctaagt

SEQ ID NO: 942797 - DNA, 25 bp, Mus musculus
ttctgctaatggatcaggaggcgga

SEQ ID NO: 942798 - DNA, 25 bp, Mus musculus
ttctgctaatggttcaggaggcgga

SEQ ID NO: 942799 - DNA, 25 bp, Mus musculus
ttctgctaatgtccattccattgcc

SEQ ID NO: 942800 - DNA, 25 bp, Mus musculus
ttctgctaatgtgcattccattgcc

SEQ ID NO: 942801 - DNA, 25 bp, Mus musculus
ttctgctacaataaggtcacttttt

SEQ ID NO: 942802 - DNA, 25 bp, Mus musculus
ttctgctacaattaggtcacttttt

SEQ ID NO: 942803 - DNA, 25 bp, Mus musculus
ttctgctaccaacaaggctctgtct

SEQ ID NO: 942804 - DNA, 25 bp, Mus musculus
ttctgctaccaagaaggctctgtct

SEQ ID NO: 942805 - DNA, 25 bp, Mus musculus
ttctgctacgaaagttatctgacat

SEQ ID NO: 942806 - DNA, 25 bp, Mus musculus
ttctgctacgaatgttatctgacat

SEQ ID NO: 942807 - DNA, 25 bp, Mus musculus
ttctgctacgcaaaaaggccttgga

SEQ ID NO: 942808 - DNA, 25 bp, Mus musculus
ttctgctacgcataaaggccttgga

SEQ ID NO: 942809 - DNA, 25 bp, Mus musculus
ttctgctactgaccatctgcataag

SEQ ID NO: 942810 - DNA, 25 bp, Mus musculus
ttctgctactgagcatctgcataag

SEQ ID NO: 942811 - DNA, 25 bp, Mus musculus
ttctgctagattctgtgagcggact

SEQ ID NO: 942812 - DNA, 25 bp, Mus musculus
ttctgctagattgtgtgagcggact

SEQ ID NO: 942813 - DNA, 25 bp, Mus musculus
ttctgctagtctcttcttgatggtc

SEQ ID NO: 942814 - DNA, 25 bp, Mus musculus
ttctgctagtctgttcttgatggtc

SEQ ID NO: 942815 - DNA, 25 bp, Mus musculus
ttctgctagttgaggctgagaacct

SEQ ID NO: 942816 - DNA, 25 bp, Mus musculus
ttctgctagttgtggctgagaacct

SEQ ID NO: 942817 - DNA, 25 bp, Mus musculus
ttctgctatcaactcatcctctatg

SEQ ID NO: 942818 - DNA, 25 bp, Mus musculus
ttctgctatcaagtcatcctctatg

SEQ ID NO: 942819 - DNA, 25 bp, Mus musculus
ttctgctatggcagagttgaggtta

SEQ ID NO: 942820 - DNA, 25 bp, Mus musculus
ttctgctatggctgagttgaggtta

SEQ ID NO: 942821 - DNA, 25 bp, Mus musculus
ttctgctattgcagggaagccccat

SEQ ID NO: 942822 - DNA, 25 bp, Mus musculus
ttctgctattgctgggaagccccat

SEQ ID NO: 942823 - DNA, 25 bp, Mus musculus
ttctgctcaacgcaactgtgacaca

SEQ ID NO: 942824 - DNA, 25 bp, Mus musculus
ttctgctcaacggaactgtgacaca

SEQ ID NO: 942825 - DNA, 25 bp, Mus musculus
ttctgctcacgtctttcaaacgaaa

SEQ ID NO: 942826 - DNA, 25 bp, Mus musculus
ttctgctcacgtgtttcaaacgaaa

SEQ ID NO: 942827 - DNA, 25 bp, Mus musculus
ttctgctcagcaaatgaggccacca

SEQ ID NO: 942828 - DNA, 25 bp, Mus musculus
ttctgctcagcaactttcaggatac

SEQ ID NO: 942829 - DNA, 25 bp, Mus musculus
ttctgctcagcatatgaggccacca

SEQ ID NO: 942830 - DNA, 25 bp, Mus musculus
ttctgctcagcatctttcaggatac

SEQ ID NO: 942831 - DNA, 25 bp, Mus musculus
ttctgctcagctattggctactgga

SEQ ID NO: 942832 - DNA, 25 bp, Mus musculus
ttctgctcagcttttggctactgga

SEQ ID NO: 942833 - DNA, 25 bp, Mus musculus
ttctgctcatgtatgcagcaataca

SEQ ID NO: 942834 - DNA, 25 bp, Mus musculus
ttctgctcatgtttgcagcaataca

SEQ ID NO: 942835 - DNA, 25 bp, Mus musculus
ttctgctcattcatcgcggtttatc

SEQ ID NO: 942836 - DNA, 25 bp, Mus musculus
ttctgctcattcttcgcggtttatc

SEQ ID NO: 942837 - DNA, 25 bp, Mus musculus
ttctgctccacaagaacacagctac

SEQ ID NO: 942838 - DNA, 25 bp, Mus musculus
ttctgctccacatgaacacagctac

SEQ ID NO: 942839 - DNA, 25 bp, Mus musculus
ttctgctcccagaggctgcaagtca

SEQ ID NO: 942840 - DNA, 25 bp, Mus musculus
ttctgctcccagtggctgcaagtca

SEQ ID NO: 942841 - DNA, 25 bp, Mus musculus
ttctgctccccgagctcaataaaag

SEQ ID NO: 942842 - DNA, 25 bp, Mus musculus
ttctgctccccgtgctcaataaaag

SEQ ID NO: 942843 - DNA, 25 bp, Mus musculus
ttctgctccgttcttctgaaccttc

SEQ ID NO: 942844 - DNA, 25 bp, Mus musculus
ttctgctccgttgttctgaaccttc

SEQ ID NO: 942845 - DNA, 25 bp, Mus musculus
ttctgctcctatagctaccgagagg

SEQ ID NO: 942846 - DNA, 25 bp, Mus musculus
ttctgctcctatcctttcaggattc

SEQ ID NO: 942847 - DNA, 25 bp, Mus musculus
ttctgctcctatgctttcaggattc

SEQ ID NO: 942848 - DNA, 25 bp, Mus musculus
ttctgctcctattgctaccgagagg

SEQ ID NO: 942849 - DNA, 25 bp, Mus musculus
ttctgctcctctacaagctgtagat

SEQ ID NO: 942850 - DNA, 25 bp, Mus musculus
ttctgctcctcttcaagctgtagat

SEQ ID NO: 942851 - DNA, 25 bp, Mus musculus
ttctgctcctgtacttgcaaactga

SEQ ID NO: 942852 - DNA, 25 bp, Mus musculus
ttctgctcctgttcttgcaaactga

SEQ ID NO: 942853 - DNA, 25 bp, Mus musculus
ttctgctcgcagatcagcacatgac

SEQ ID NO: 942854 - DNA, 25 bp, Mus musculus
ttctgctcgcagttcagcacatgac

SEQ ID NO: 942855 - DNA, 25 bp, Mus musculus
ttctgctcgtctcagggatggttga

SEQ ID NO: 942856 - DNA, 25 bp, Mus musculus
ttctgctcgtctgagggatggttga

SEQ ID NO: 942857 - DNA, 25 bp, Mus musculus
ttctgctctcaaagtccacacagga

SEQ ID NO: 942858 - DNA, 25 bp, Mus musculus
ttctgctctcaatgtccacacagga

SEQ ID NO: 942859 - DNA, 25 bp, Mus musculus
ttctgctctgatccaaggaacgatg

SEQ ID NO: 942860 - DNA, 25 bp, Mus musculus
ttctgctctgatgcaaggaacgatg

SEQ ID NO: 942861 - DNA, 25 bp, Mus musculus
ttctgctctgtcacatctgaagcct

SEQ ID NO: 942862 - DNA, 25 bp, Mus musculus
ttctgctctgtctcatctgaagcct

SEQ ID NO: 942863 - DNA, 25 bp, Mus musculus
ttctgctcttctcaggcatgtggta

SEQ ID NO: 942864 - DNA, 25 bp, Mus musculus
ttctgctcttctgaggcatgtggta

SEQ ID NO: 942865 - DNA, 25 bp, Mus musculus
ttctgctctttgattactattccat

SEQ ID NO: 942866 - DNA, 25 bp, Mus musculus
ttctgctctttgtttactattccat

SEQ ID NO: 942867 - DNA, 25 bp, Mus musculus
ttctgctcttttacgaaatccattc

SEQ ID NO: 942868 - DNA, 25 bp, Mus musculus
ttctgctctttttcgaaatccattc

SEQ ID NO: 942869 - DNA, 25 bp, Mus musculus
ttctgctgacttatgtgggaaccca

SEQ ID NO: 942870 - DNA, 25 bp, Mus musculus
ttctgctgacttttgtgggaaccca

SEQ ID NO: 942871 - DNA, 25 bp, Mus musculus
ttctgctgcataagttactgtgcta

SEQ ID NO: 942872 - DNA, 25 bp, Mus musculus
ttctgctgcatatgttactgtgcta

SEQ ID NO: 942873 - DNA, 25 bp, Mus musculus
ttctgctgcatcctgtgtggaggaa

SEQ ID NO: 942874 - DNA, 25 bp, Mus musculus
ttctgctgcatcgtgtgtggaggaa

SEQ ID NO: 942875 - DNA, 25 bp, Mus musculus
ttctgctgccctactcaagcagggt

SEQ ID NO: 942876 - DNA, 25 bp, Mus musculus
ttctgctgcccttctcaagcagggt

SEQ ID NO: 942877 - DNA, 25 bp, Mus musculus
ttctgctgccgtaatggtgtgtgcc

SEQ ID NO: 942878 - DNA, 25 bp, Mus musculus
ttctgctgccgttatggtgtgtgcc

SEQ ID NO: 942879 - DNA, 25 bp, Mus musculus
ttctgctgcgatacgaagttcctga

SEQ ID NO: 942880 - DNA, 25 bp, Mus musculus
ttctgctgcgattcgaagttcctga

SEQ ID NO: 942881 - DNA, 25 bp, Mus musculus
ttctgctgcgggacttgtggcttcc

SEQ ID NO: 942882 - DNA, 25 bp, Mus musculus
ttctgctgcgggtcttgtggcttcc

SEQ ID NO: 942883 - DNA, 25 bp, Mus musculus
ttctgctgctctatcagtactgcat

SEQ ID NO: 942884 - DNA, 25 bp, Mus musculus
ttctgctgctctttcagtactgcat

SEQ ID NO: 942885 - DNA, 25 bp, Mus musculus
ttctgctggcaacggaactcaaggt

SEQ ID NO: 942886 - DNA, 25 bp, Mus musculus
ttctgctggcaagggaactcaaggt

SEQ ID NO: 942887 - DNA, 25 bp, Mus musculus
ttctgctggcagatgctgagagcct

SEQ ID NO: 942888 - DNA, 25 bp, Mus musculus
ttctgctggcagttgctgagagcct

SEQ ID NO: 942889 - DNA, 25 bp, Mus musculus
ttctgctggcgtccacaagcagctc

SEQ ID NO: 942890 - DNA, 25 bp, Mus musculus
ttctgctggcgtgcacaagcagctc

SEQ ID NO: 942891 - DNA, 25 bp, Mus musculus
ttctgctgggctatacatgctgtag

SEQ ID NO: 942892 - DNA, 25 bp, Mus musculus
ttctgctgggctttacatgctgtag

SEQ ID NO: 942893 - DNA, 25 bp, Mus musculus
ttctgctggtatacgtaggcttcat

SEQ ID NO: 942894 - DNA, 25 bp, Mus musculus
ttctgctggtattcgtaggcttcat

SEQ ID NO: 942895 - DNA, 25 bp, Mus musculus
ttctgctgtaacaacctcacgtaga

SEQ ID NO: 942896 - DNA, 25 bp, Mus musculus
ttctgctgtaactacctcacgtaga

SEQ ID NO: 942897 - DNA, 25 bp, Mus musculus
ttctgctgtacaagctggtctcaaa

SEQ ID NO: 942898 - DNA, 25 bp, Mus musculus
ttctgctgtacatgctggtctcaaa

SEQ ID NO: 942899 - DNA, 25 bp, Mus musculus
ttctgctgtgaacggcccttgtgat

SEQ ID NO: 942900 - DNA, 25 bp, Mus musculus
ttctgctgtgaagggcccttgtgat

SEQ ID NO: 942901 - DNA, 25 bp, Mus musculus
ttctgctgtgatcccatgtcgttga

SEQ ID NO: 942902 - DNA, 25 bp, Mus musculus
ttctgctgtgatgccatgtcgttga

SEQ ID NO: 942903 - DNA, 25 bp, Mus musculus
ttctgctgtgtgaccttctctgagg

SEQ ID NO: 942904 - DNA, 25 bp, Mus musculus
ttctgctgtgtgtccttctctgagg

SEQ ID NO: 942905 - DNA, 25 bp, Mus musculus
ttctgctgttccagaataccttcca

SEQ ID NO: 942906 - DNA, 25 bp, Mus musculus
ttctgctgttcctgaataccttcca

SEQ ID NO: 942907 - DNA, 25 bp, Mus musculus
ttctgcttaaaactgtggctgtcac

SEQ ID NO: 942908 - DNA, 25 bp, Mus musculus
ttctgcttaaaagtgtggctgtcac

SEQ ID NO: 942909 - DNA, 25 bp, Mus musculus
ttctgcttaaggactttgttttaga

SEQ ID NO: 942910 - DNA, 25 bp, Mus musculus
ttctgcttaaggtctttgttttaga

SEQ ID NO: 942911 - DNA, 25 bp, Mus musculus
ttctgcttacctacatttggattca

SEQ ID NO: 942912 - DNA, 25 bp, Mus musculus
ttctgcttaccttcatttggattca

SEQ ID NO: 942913 - DNA, 25 bp, Mus musculus
ttctgcttagcaagggtcaacgtgt

SEQ ID NO: 942914 - DNA, 25 bp, Mus musculus
ttctgcttagcatgggtcaacgtgt

SEQ ID NO: 942915 - DNA, 25 bp, Mus musculus
ttctgcttagttcgctttgcacttg

SEQ ID NO: 942916 - DNA, 25 bp, Mus musculus
ttctgcttagttggctttgcacttg

SEQ ID NO: 942917 - DNA, 25 bp, Mus musculus
ttctgcttcaacctggccagcatca

SEQ ID NO: 942918 - DNA, 25 bp, Mus musculus
ttctgcttcaacgtggccagcatca

SEQ ID NO: 942919 - DNA, 25 bp, Mus musculus
ttctgcttcacgcacatgttaggaa

SEQ ID NO: 942920 - DNA, 25 bp, Mus musculus
ttctgcttcacggacatgttaggaa

SEQ ID NO: 942921 - DNA, 25 bp, Mus musculus
ttctgcttccacaaactactcagag

SEQ ID NO: 942922 - DNA, 25 bp, Mus musculus
ttctgcttccactaactactcagag

SEQ ID NO: 942923 - DNA, 25 bp, Mus musculus
ttctgcttcccacaggactcgggaa

SEQ ID NO: 942924 - DNA, 25 bp, Mus musculus
ttctgcttcccacctggtaaaacag

SEQ ID NO: 942925 - DNA, 25 bp, Mus musculus
ttctgcttcccagaggactcgggaa

SEQ ID NO: 942926 - DNA, 25 bp, Mus musculus
ttctgcttcccagctggtaaaacag

SEQ ID NO: 942927 - DNA, 25 bp, Mus musculus
ttctgcttcctgaagtctttgtgac

SEQ ID NO: 942928 - DNA, 25 bp, Mus musculus
ttctgcttcctgtagtctttgtgac

SEQ ID NO: 942929 - DNA, 25 bp, Mus musculus
ttctgcttctgcatttgtatgatag

SEQ ID NO: 942930 - DNA, 25 bp, Mus musculus
ttctgcttctgcttttgtatgatag

SEQ ID NO: 942931 - DNA, 25 bp, Mus musculus
ttctgcttctttcacattactaggt

SEQ ID NO: 942932 - DNA, 25 bp, Mus musculus
ttctgcttctttgacattactaggt

SEQ ID NO: 942933 - DNA, 25 bp, Mus musculus
ttctgcttgagaagggtgggacctt

SEQ ID NO: 942934 - DNA, 25 bp, Mus musculus
ttctgcttgagatgggtgggacctt

SEQ ID NO: 942935 - DNA, 25 bp, Mus musculus
ttctgcttgcatctgtgacattcca

SEQ ID NO: 942936 - DNA, 25 bp, Mus musculus
ttctgcttgcatgtgtgacattcca

SEQ ID NO: 942937 - DNA, 25 bp, Mus musculus
ttctgcttgcttctgggacacaatc

SEQ ID NO: 942938 - DNA, 25 bp, Mus musculus
ttctgcttgcttgtgggacacaatc

SEQ ID NO: 942939 - DNA, 25 bp, Mus musculus
ttctgcttggcaaggcatcctaaga

SEQ ID NO: 942940 - DNA, 25 bp, Mus musculus
ttctgcttggcatggcatcctaaga

SEQ ID NO: 942941 - DNA, 25 bp, Mus musculus
ttctgcttgtatagacaggtctact

SEQ ID NO: 942942 - DNA, 25 bp, Mus musculus
ttctgcttgtatatgacttcaaaca

SEQ ID NO: 942943 - DNA, 25 bp, Mus musculus
ttctgcttgtattgacaggtctact

SEQ ID NO: 942944 - DNA, 25 bp, Mus musculus
ttctgcttgtatttgacttcaaaca

SEQ ID NO: 942945 - DNA, 25 bp, Mus musculus
ttctgcttgtcactcggcagcttag

SEQ ID NO: 942946 - DNA, 25 bp, Mus musculus
ttctgcttgtcagtcggcagcttag

SEQ ID NO: 942947 - DNA, 25 bp, Mus musculus
ttctgcttgtcccagttgtaccagg

SEQ ID NO: 942948 - DNA, 25 bp, Mus musculus
ttctgcttgtcccatggaaggctga

SEQ ID NO: 942949 - DNA, 25 bp, Mus musculus
ttctgcttgtccgagttgtaccagg

SEQ ID NO: 942950 - DNA, 25 bp, Mus musculus
ttctgcttgtccgatggaaggctga

SEQ ID NO: 942951 - DNA, 25 bp, Mus musculus
ttctgcttgtcgctttctcttctgc

SEQ ID NO: 942952 - DNA, 25 bp, Mus musculus
ttctgcttgtcggtttctcttctgc

SEQ ID NO: 942953 - DNA, 25 bp, Mus musculus
ttctgcttgtgcactgggtcttaat

SEQ ID NO: 942954 - DNA, 25 bp, Mus musculus
ttctgcttgtgctctgggtcttaat

SEQ ID NO: 942955 - DNA, 25 bp, Mus musculus
ttctgcttgttaagtgggctctaca

SEQ ID NO: 942956 - DNA, 25 bp, Mus musculus
ttctgcttgttatgtgggctctaca

SEQ ID NO: 942957 - DNA, 25 bp, Mus musculus
ttctgctttataccggaactgtact

SEQ ID NO: 942958 - DNA, 25 bp, Mus musculus
ttctgctttatagcggaactgtact

SEQ ID NO: 942959 - DNA, 25 bp, Mus musculus
ttctgctttatgctcttgtgggagg

SEQ ID NO: 942960 - DNA, 25 bp, Mus musculus
ttctgctttatggtcttgtgggagg

SEQ ID NO: 942961 - DNA, 25 bp, Mus musculus
ttctgctttcacagaagcagctcac

SEQ ID NO: 942962 - DNA, 25 bp, Mus musculus
ttctgctttcactgaagcagctcac

SEQ ID NO: 942963 - DNA, 25 bp, Mus musculus
ttctgctttcggaacagcgtgtgtt

SEQ ID NO: 942964 - DNA, 25 bp, Mus musculus
ttctgctttcggtacagcgtgtgtt

SEQ ID NO: 942965 - DNA, 25 bp, Mus musculus
ttctgctttctaaaagcaccaggca

SEQ ID NO: 942966 - DNA, 25 bp, Mus musculus
ttctgctttctataagcaccaggca

SEQ ID NO: 942967 - DNA, 25 bp, Mus musculus
ttctgctttgaaagttgcctgctca

SEQ ID NO: 942968 - DNA, 25 bp, Mus musculus
ttctgctttgaatgttgcctgctca

SEQ ID NO: 942969 - DNA, 25 bp, Mus musculus
ttctgctttgcaatgggaacaattc

SEQ ID NO: 942970 - DNA, 25 bp, Mus musculus
ttctgctttgcattgggaacaattc

SEQ ID NO: 942971 - DNA, 25 bp, Mus musculus
ttctgctttgtcactcctatgtggg

SEQ ID NO: 942972 - DNA, 25 bp, Mus musculus
ttctgctttgtctctcctatgtggg

SEQ ID NO: 942973 - DNA, 25 bp, Mus musculus
ttctgcttttctcagaccgtgagag

SEQ ID NO: 942974 - DNA, 25 bp, Mus musculus
ttctgcttttctctccacacatctg

SEQ ID NO: 942975 - DNA, 25 bp, Mus musculus
ttctgcttttctgagaccgtgagag

SEQ ID NO: 942976 - DNA, 25 bp, Mus musculus
ttctgcttttctgtccacacatctg

SEQ ID NO: 942977 - DNA, 25 bp, Mus musculus
ttctgcttttgtcccaccactgtaa

SEQ ID NO: 942978 - DNA, 25 bp, Mus musculus
ttctgcttttgtctgctattctgca

SEQ ID NO: 942979 - DNA, 25 bp, Mus musculus
ttctgcttttgtgccaccactgtaa

SEQ ID NO: 942980 - DNA, 25 bp, Mus musculus
ttctgcttttgtgtgctattctgca

SEQ ID NO: 942981 - DNA, 25 bp, Mus musculus
ttctggaaaacaactacacggccct

SEQ ID NO: 942982 - DNA, 25 bp, Mus musculus
ttctggaaaacatctacacggccct

SEQ ID NO: 942983 - DNA, 25 bp, Mus musculus
ttctggaaatctctgacttctgtca

SEQ ID NO: 942984 - DNA, 25 bp, Mus musculus
ttctggaaatctgtgacttctgtca

SEQ ID NO: 942985 - DNA, 25 bp, Mus musculus
ttctggaacagcatcacgctcacag

SEQ ID NO: 942986 - DNA, 25 bp, Mus musculus
ttctggaacagcttcacgctcacag

SEQ ID NO: 942987 - DNA, 25 bp, Mus musculus
ttctggaagaatcgtggtcactgct

SEQ ID NO: 942988 - DNA, 25 bp, Mus musculus
ttctggaagaatggtggtcactgct

SEQ ID NO: 942989 - DNA, 25 bp, Mus musculus
ttctggaagaggatgcatgcgagca

SEQ ID NO: 942990 - DNA, 25 bp, Mus musculus
ttctggaagaggttgcatgcgagca

SEQ ID NO: 942991 - DNA, 25 bp, Mus musculus
ttctggaagcggaaacccttgaatt

SEQ ID NO: 942992 - DNA, 25 bp, Mus musculus
ttctggaagcggtaacccttgaatt

SEQ ID NO: 942993 - DNA, 25 bp, Mus musculus
ttctggaagctcatctaggactatg

SEQ ID NO: 942994 - DNA, 25 bp, Mus musculus
ttctggaagctcttctaggactatg

SEQ ID NO: 942995 - DNA, 25 bp, Mus musculus
ttctggaaggaaaacgaggactatt

SEQ ID NO: 942996 - DNA, 25 bp, Mus musculus
ttctggaaggaaaatgctaacaatc

SEQ ID NO: 942997 - DNA, 25 bp, Mus musculus
ttctggaaggaatacgaggactatt

SEQ ID NO: 942998 - DNA, 25 bp, Mus musculus
ttctggaaggaatatgctaacaatc

SEQ ID NO: 942999 - DNA, 25 bp, Mus musculus
ttctggaatcaccttgtattacagt

SEQ ID NO: 943000 - DNA, 25 bp, Mus musculus
ttctggaatcacgttgtattacagt

SEQ ID NO: 943001 - DNA, 25 bp, Mus musculus
ttctggaatcagatcaaggcacagg

SEQ ID NO: 943002 - DNA, 25 bp, Mus musculus
ttctggaatcagcttctcacgtttt

SEQ ID NO: 943003 - DNA, 25 bp, Mus musculus
ttctggaatcaggttctcacgtttt

SEQ ID NO: 943004 - DNA, 25 bp, Mus musculus
ttctggaatcagttcaaggcacagg

SEQ ID NO: 943005 - DNA, 25 bp, Mus musculus
ttctggaatccaagagcacctgtac

SEQ ID NO: 943006 - DNA, 25 bp, Mus musculus
ttctggaatccatgagcacctgtac

SEQ ID NO: 943007 - DNA, 25 bp, Mus musculus
ttctggaatctgcttacaggacttt

SEQ ID NO: 943008 - DNA, 25 bp, Mus musculus
ttctggaatctggttacaggacttt

SEQ ID NO: 943009 - DNA, 25 bp, Mus musculus
ttctggaatgagaccttgtcatctt

SEQ ID NO: 943010 - DNA, 25 bp, Mus musculus
ttctggaatgagtccttgtcatctt

SEQ ID NO: 943011 - DNA, 25 bp, Mus musculus
ttctggaatgtgagtaccctgctgg

SEQ ID NO: 943012 - DNA, 25 bp, Mus musculus
ttctggaatgtgtgtaccctgctgg

SEQ ID NO: 943013 - DNA, 25 bp, Mus musculus
ttctggaattacagcctggagactt

SEQ ID NO: 943014 - DNA, 25 bp, Mus musculus
ttctggaattactgcctggagactt

SEQ ID NO: 943015 - DNA, 25 bp, Mus musculus
ttctggacaggcacttcatggctca

SEQ ID NO: 943016 - DNA, 25 bp, Mus musculus
ttctggacaggctcttcatggctca

SEQ ID NO: 943017 - DNA, 25 bp, Mus musculus
ttctggacatgaaaccctttactgg

SEQ ID NO: 943018 - DNA, 25 bp, Mus musculus
ttctggacatgataccctttactgg

SEQ ID NO: 943019 - DNA, 25 bp, Mus musculus
ttctggaccacgacatgttcaccat

SEQ ID NO: 943020 - DNA, 25 bp, Mus musculus
ttctggaccacgtcatgttcaccat

SEQ ID NO: 943021 - DNA, 25 bp, Mus musculus
ttctggaccctacggttctgtagcc

SEQ ID NO: 943022 - DNA, 25 bp, Mus musculus
ttctggaccctagggttctgtagcc

SEQ ID NO: 943023 - DNA, 25 bp, Mus musculus
ttctggacgagaaatggcactcctc

SEQ ID NO: 943024 - DNA, 25 bp, Mus musculus
ttctggacgagatatggcactcctc

SEQ ID NO: 943025 - DNA, 25 bp, Mus musculus
ttctggactccaaacaatattgttc

SEQ ID NO: 943026 - DNA, 25 bp, Mus musculus
ttctggactccatacaatattgttc

SEQ ID NO: 943027 - DNA, 25 bp, Mus musculus
ttctggactcgtaagggaacctcat

SEQ ID NO: 943028 - DNA, 25 bp, Mus musculus
ttctggactcgttagggaacctcat

SEQ ID NO: 943029 - DNA, 25 bp, Mus musculus
ttctggactctgcagcttactttct

SEQ ID NO: 943030 - DNA, 25 bp, Mus musculus
ttctggactctggagcttactttct

SEQ ID NO: 943031 - DNA, 25 bp, Mus musculus
ttctggactgcgctctgggttcagt

SEQ ID NO: 943032 - DNA, 25 bp, Mus musculus
ttctggactgcggtctgggttcagt

SEQ ID NO: 943033 - DNA, 25 bp, Mus musculus
ttctggactttgcaacgccttcttg

SEQ ID NO: 943034 - DNA, 25 bp, Mus musculus
ttctggactttggaacgccttcttg

SEQ ID NO: 943035 - DNA, 25 bp, Mus musculus
ttctggagaacacgacgactcttcc

SEQ ID NO: 943036 - DNA, 25 bp, Mus musculus
ttctggagaacaggacgactcttcc

SEQ ID NO: 943037 - DNA, 25 bp, Mus musculus
ttctggagaatacccttggacttca

SEQ ID NO: 943038 - DNA, 25 bp, Mus musculus
ttctggagaatagccttggacttca

SEQ ID NO: 943039 - DNA, 25 bp, Mus musculus
ttctggagacagcacctggcagatc

SEQ ID NO: 943040 - DNA, 25 bp, Mus musculus
ttctggagacaggacctggcagatc

SEQ ID NO: 943041 - DNA, 25 bp, Mus musculus
ttctggagaggtcgcccctttagca

SEQ ID NO: 943042 - DNA, 25 bp, Mus musculus
ttctggagaggtggcccctttagca

SEQ ID NO: 943043 - DNA, 25 bp, Mus musculus
ttctggagatcaagggttccgaacc

SEQ ID NO: 943044 - DNA, 25 bp, Mus musculus
ttctggagatcatgggttccgaacc

SEQ ID NO: 943045 - DNA, 25 bp, Mus musculus
ttctggagcaagctctcatttccca

SEQ ID NO: 943046 - DNA, 25 bp, Mus musculus
ttctggagcaaggtctcatttccca

SEQ ID NO: 943047 - DNA, 25 bp, Mus musculus
ttctggagcagtctgcatgcactct

SEQ ID NO: 943048 - DNA, 25 bp, Mus musculus
ttctggagcagtgtgcatgcactct

SEQ ID NO: 943049 - DNA, 25 bp, Mus musculus
ttctggagcccacgcttcttattac

SEQ ID NO: 943050 - DNA, 25 bp, Mus musculus
ttctggagcccaggcttcttattac

SEQ ID NO: 943051 - DNA, 25 bp, Mus musculus
ttctggagctggcatgtcttctaga

SEQ ID NO: 943052 - DNA, 25 bp, Mus musculus
ttctggagctgggatgtcttctaga

SEQ ID NO: 943053 - DNA, 25 bp, Mus musculus
ttctggagcttgaacattcaagaat

SEQ ID NO: 943054 - DNA, 25 bp, Mus musculus
ttctggagcttgtacattcaagaat

SEQ ID NO: 943055 - DNA, 25 bp, Mus musculus
ttctggaggattatatgtgctaata

SEQ ID NO: 943056 - DNA, 25 bp, Mus musculus
ttctggaggattttatgtgctaata

SEQ ID NO: 943057 - DNA, 25 bp, Mus musculus
ttctggaggcttctgcaaatcccac

SEQ ID NO: 943058 - DNA, 25 bp, Mus musculus
ttctggaggcttgtgcaaatcccac

SEQ ID NO: 943059 - DNA, 25 bp, Mus musculus
ttctggagggttatccaggctcttt

SEQ ID NO: 943060 - DNA, 25 bp, Mus musculus
ttctggagggttttccaggctcttt

SEQ ID NO: 943061 - DNA, 25 bp, Mus musculus
ttctggagtgaaagcctgggataca

SEQ ID NO: 943062 - DNA, 25 bp, Mus musculus
ttctggagtgaatgcctgggataca

SEQ ID NO: 943063 - DNA, 25 bp, Mus musculus
ttctggagtggcaggcgaacccctc

SEQ ID NO: 943064 - DNA, 25 bp, Mus musculus
ttctggagtggctggcgaacccctc

SEQ ID NO: 943065 - DNA, 25 bp, Mus musculus
ttctggagtgtcactgcggtacaaa

SEQ ID NO: 943066 - DNA, 25 bp, Mus musculus
ttctggagtgtctctgcggtacaaa

SEQ ID NO: 943067 - DNA, 25 bp, Mus musculus
ttctggagttatagctgccccgagt

SEQ ID NO: 943068 - DNA, 25 bp, Mus musculus
ttctggagttattgctgccccgagt

SEQ ID NO: 943069 - DNA, 25 bp, Mus musculus
ttctggatatcaagcaggctcctat

SEQ ID NO: 943070 - DNA, 25 bp, Mus musculus
ttctggatatcatgcaggctcctat

SEQ ID NO: 943071 - DNA, 25 bp, Mus musculus
ttctggatcagcatcgtactgtgga

SEQ ID NO: 943072 - DNA, 25 bp, Mus musculus
ttctggatcagcttcgtactgtgga

SEQ ID NO: 943073 - DNA, 25 bp, Mus musculus
ttctggatcaggcacttgctgtcgc

SEQ ID NO: 943074 - DNA, 25 bp, Mus musculus
ttctggatcagggacttgctgtcgc

SEQ ID NO: 943075 - DNA, 25 bp, Mus musculus
ttctggatccttagagattttagca

SEQ ID NO: 943076 - DNA, 25 bp, Mus musculus
ttctggatcctttgagattttagca

SEQ ID NO: 943077 - DNA, 25 bp, Mus musculus
ttctggatctccaatcaggctgagt

SEQ ID NO: 943078 - DNA, 25 bp, Mus musculus
ttctggatctcctatcaggctgagt

SEQ ID NO: 943079 - DNA, 25 bp, Mus musculus
ttctggatgactctgctcacagatg

SEQ ID NO: 943080 - DNA, 25 bp, Mus musculus
ttctggatgactgtgctcacagatg

SEQ ID NO: 943081 - DNA, 25 bp, Mus musculus
ttctggatgataccattggctgtgc

SEQ ID NO: 943082 - DNA, 25 bp, Mus musculus
ttctggatgatagcattggctgtgc

SEQ ID NO: 943083 - DNA, 25 bp, Mus musculus
ttctggatgcctcgtatgatttatc

SEQ ID NO: 943084 - DNA, 25 bp, Mus musculus
ttctggatgcctggtatgatttatc

SEQ ID NO: 943085 - DNA, 25 bp, Mus musculus
ttctggatgcggctgccagcaagcc

SEQ ID NO: 943086 - DNA, 25 bp, Mus musculus
ttctggatgcgggtgccagcaagcc

SEQ ID NO: 943087 - DNA, 25 bp, Mus musculus
ttctggatgggaactcttttcgccg

SEQ ID NO: 943088 - DNA, 25 bp, Mus musculus
ttctggatgggatctcttttcgccg

SEQ ID NO: 943089 - DNA, 25 bp, Mus musculus
ttctggatgtccacgtggtcaggaa

SEQ ID NO: 943090 - DNA, 25 bp, Mus musculus
ttctggatgtcctcgtggtcaggaa

SEQ ID NO: 943091 - DNA, 25 bp, Mus musculus
ttctggatgtttaggctcacaccaa

SEQ ID NO: 943092 - DNA, 25 bp, Mus musculus
ttctggatgttttggctcacaccaa

SEQ ID NO: 943093 - DNA, 25 bp, Mus musculus
ttctggattaccaacaatgttttaa

SEQ ID NO: 943094 - DNA, 25 bp, Mus musculus
ttctggattacctacaatgttttaa

SEQ ID NO: 943095 - DNA, 25 bp, Mus musculus
ttctggattcacattaacgctttaa

SEQ ID NO: 943096 - DNA, 25 bp, Mus musculus
ttctggattcactttaacgctttaa

SEQ ID NO: 943097 - DNA, 25 bp, Mus musculus
ttctggattctaaagagcttatgct

SEQ ID NO: 943098 - DNA, 25 bp, Mus musculus
ttctggattctatagagcttatgct

SEQ ID NO: 943099 - DNA, 25 bp, Mus musculus
ttctggattgggaaagccatccctc

SEQ ID NO: 943100 - DNA, 25 bp, Mus musculus
ttctggattgggagagcatgctaac

SEQ ID NO: 943101 - DNA, 25 bp, Mus musculus
ttctggattgggtaagccatccctc

SEQ ID NO: 943102 - DNA, 25 bp, Mus musculus
ttctggattgggtgagcatgctaac

SEQ ID NO: 943103 - DNA, 25 bp, Mus musculus
ttctggcaacggatcatagcacgga

SEQ ID NO: 943104 - DNA, 25 bp, Mus musculus
ttctggcaacggttcatagcacgga

SEQ ID NO: 943105 - DNA, 25 bp, Mus musculus
ttctggcaagagcttttgtttctta

SEQ ID NO: 943106 - DNA, 25 bp, Mus musculus
ttctggcaagaggttttgtttctta

SEQ ID NO: 943107 - DNA, 25 bp, Mus musculus
ttctggcaatagagcagcagcctgt

SEQ ID NO: 943108 - DNA, 25 bp, Mus musculus
ttctggcaatagtgcagcagcctgt

SEQ ID NO: 943109 - DNA, 25 bp, Mus musculus
ttctggcacctaactcttagcaaag

SEQ ID NO: 943110 - DNA, 25 bp, Mus musculus
ttctggcacctatctcttagcaaag

SEQ ID NO: 943111 - DNA, 25 bp, Mus musculus
ttctggcacggcatgccgtccttca

SEQ ID NO: 943112 - DNA, 25 bp, Mus musculus
ttctggcacggcttgccgtccttca

SEQ ID NO: 943113 - DNA, 25 bp, Mus musculus
ttctggcactgcagaaggatccttc

SEQ ID NO: 943114 - DNA, 25 bp, Mus musculus
ttctggcactgctgaaggatccttc

SEQ ID NO: 943115 - DNA, 25 bp, Mus musculus
ttctggcagactagagactcaagct

SEQ ID NO: 943116 - DNA, 25 bp, Mus musculus
ttctggcagacttgagactcaagct

SEQ ID NO: 943117 - DNA, 25 bp, Mus musculus
ttctggcagataaaatttgtacttc

SEQ ID NO: 943118 - DNA, 25 bp, Mus musculus
ttctggcagatataatttgtacttc

SEQ ID NO: 943119 - DNA, 25 bp, Mus musculus
ttctggcagtgaactctccacaggg

SEQ ID NO: 943120 - DNA, 25 bp, Mus musculus
ttctggcagtgatctctccacaggg

SEQ ID NO: 943121 - DNA, 25 bp, Mus musculus
ttctggcatatgaatatttggtccc

SEQ ID NO: 943122 - DNA, 25 bp, Mus musculus
ttctggcatatgtatatttggtccc

SEQ ID NO: 943123 - DNA, 25 bp, Mus musculus
ttctggcatcaactgtttctctgtc

SEQ ID NO: 943124 - DNA, 25 bp, Mus musculus
ttctggcatcaagtgtttctctgtc

SEQ ID NO: 943125 - DNA, 25 bp, Mus musculus
ttctggcatctacacatacctgaac

SEQ ID NO: 943126 - DNA, 25 bp, Mus musculus
ttctggcatctagacatacctgaac

SEQ ID NO: 943127 - DNA, 25 bp, Mus musculus
ttctggcatgacaagcccatgtttc

SEQ ID NO: 943128 - DNA, 25 bp, Mus musculus
ttctggcatgactagcccatgtttc

SEQ ID NO: 943129 - DNA, 25 bp, Mus musculus
ttctggcattcgcaagcttgtggca

SEQ ID NO: 943130 - DNA, 25 bp, Mus musculus
ttctggcattcggaagcttgtggca

SEQ ID NO: 943131 - DNA, 25 bp, Mus musculus
ttctggcatttgcttaagctggctt

SEQ ID NO: 943132 - DNA, 25 bp, Mus musculus
ttctggcatttggttaagctggctt

SEQ ID NO: 943133 - DNA, 25 bp, Mus musculus
ttctggccaatgaaggtcaaacctc

SEQ ID NO: 943134 - DNA, 25 bp, Mus musculus
ttctggccaatgtaggtcaaacctc

SEQ ID NO: 943135 - DNA, 25 bp, Mus musculus
ttctggccagaaccgaagatacttt

SEQ ID NO: 943136 - DNA, 25 bp, Mus musculus
ttctggccagaagcgaagatacttt

SEQ ID NO: 943137 - DNA, 25 bp, Mus musculus
ttctggccagcaaagcacattattt

SEQ ID NO: 943138 - DNA, 25 bp, Mus musculus
ttctggccagcatagcacattattt

SEQ ID NO: 943139 - DNA, 25 bp, Mus musculus
ttctggccagccaggatggctagat

SEQ ID NO: 943140 - DNA, 25 bp, Mus musculus
ttctggccagccatgaagacactta

SEQ ID NO: 943141 - DNA, 25 bp, Mus musculus
ttctggccagcctggatggctagat

SEQ ID NO: 943142 - DNA, 25 bp, Mus musculus
ttctggccagccttgaagacactta

SEQ ID NO: 943143 - DNA, 25 bp, Mus musculus
ttctggccagcgcgtgttccctgag

SEQ ID NO: 943144 - DNA, 25 bp, Mus musculus
ttctggccagcgggtgttccctgag

SEQ ID NO: 943145 - DNA, 25 bp, Mus musculus
ttctggccagtgagtgtacctaacc

SEQ ID NO: 943146 - DNA, 25 bp, Mus musculus
ttctggccagtgtgtgtacctaacc

SEQ ID NO: 943147 - DNA, 25 bp, Mus musculus
ttctggccatgtccttgtagctaca

SEQ ID NO: 943148 - DNA, 25 bp, Mus musculus
ttctggccatgtgcttgtagctaca

SEQ ID NO: 943149 - DNA, 25 bp, Mus musculus
ttctggccatttagacctcatagct

SEQ ID NO: 943150 - DNA, 25 bp, Mus musculus
ttctggccattttgacctcatagct

SEQ ID NO: 943151 - DNA, 25 bp, Mus musculus
ttctggcccaatccggaagtggaca

SEQ ID NO: 943152 - DNA, 25 bp, Mus musculus
ttctggcccaatgcggaagtggaca

SEQ ID NO: 943153 - DNA, 25 bp, Mus musculus
ttctggcccactcgccacggtgctg

SEQ ID NO: 943154 - DNA, 25 bp, Mus musculus
ttctggcccactggccacggtgctg

SEQ ID NO: 943155 - DNA, 25 bp, Mus musculus
ttctggccccgacgatgacaacatc

SEQ ID NO: 943156 - DNA, 25 bp, Mus musculus
ttctggccccgaggatgacaacatc

SEQ ID NO: 943157 - DNA, 25 bp, Mus musculus
ttctggccctaaaactgcattctgt

SEQ ID NO: 943158 - DNA, 25 bp, Mus musculus
ttctggccctaatactgcattctgt

SEQ ID NO: 943159 - DNA, 25 bp, Mus musculus
ttctggcctacaatcacagcctagg

SEQ ID NO: 943160 - DNA, 25 bp, Mus musculus
ttctggcctacattcacagcctagg

SEQ ID NO: 943161 - DNA, 25 bp, Mus musculus
ttctggcctattatgctgagcgacc

SEQ ID NO: 943162 - DNA, 25 bp, Mus musculus
ttctggcctattttgctgagcgacc

SEQ ID NO: 943163 - DNA, 25 bp, Mus musculus
ttctggcctccgatggtgacattat

SEQ ID NO: 943164 - DNA, 25 bp, Mus musculus
ttctggcctccgttggtgacattat

SEQ ID NO: 943165 - DNA, 25 bp, Mus musculus
ttctggcctcctaaggcaatctcat

SEQ ID NO: 943166 - DNA, 25 bp, Mus musculus
ttctggcctccttaggcaatctcat

SEQ ID NO: 943167 - DNA, 25 bp, Mus musculus
ttctggcctcgacctcgacgagttg

SEQ ID NO: 943168 - DNA, 25 bp, Mus musculus
ttctggcctcgagctcgacgagttg

SEQ ID NO: 943169 - DNA, 25 bp, Mus musculus
ttctggcctctaccaagttcaacaa

SEQ ID NO: 943170 - DNA, 25 bp, Mus musculus
ttctggcctctagcaagttcaacaa

SEQ ID NO: 943171 - DNA, 25 bp, Mus musculus
ttctggcctctgaataccaagcatg

SEQ ID NO: 943172 - DNA, 25 bp, Mus musculus
ttctggcctctgtataccaagcatg

SEQ ID NO: 943173 - DNA, 25 bp, Mus musculus
ttctggcctgagactagtttatttc

SEQ ID NO: 943174 - DNA, 25 bp, Mus musculus
ttctggcctgagtctagtttatttc

SEQ ID NO: 943175 - DNA, 25 bp, Mus musculus
ttctggcctgctcgaaataatctct

SEQ ID NO: 943176 - DNA, 25 bp, Mus musculus
ttctggcctgctggaaataatctct

SEQ ID NO: 943177 - DNA, 25 bp, Mus musculus
ttctggccttgcacgctttggttaa

SEQ ID NO: 943178 - DNA, 25 bp, Mus musculus
ttctggccttgctcgctttggttaa

SEQ ID NO: 943179 - DNA, 25 bp, Mus musculus
ttctggccttttcataggtacgtga

SEQ ID NO: 943180 - DNA, 25 bp, Mus musculus
ttctggccttttgataggtacgtga

SEQ ID NO: 943181 - DNA, 25 bp, Mus musculus
ttctggcgagaacctagcagcctgg

SEQ ID NO: 943182 - DNA, 25 bp, Mus musculus
ttctggcgagaagctagcagcctgg

SEQ ID NO: 943183 - DNA, 25 bp, Mus musculus
ttctggcgcagaagggaccattcaa

SEQ ID NO: 943184 - DNA, 25 bp, Mus musculus
ttctggcgcagatgggaccattcaa

SEQ ID NO: 943185 - DNA, 25 bp, Mus musculus
ttctggctaaaaatcctaagggcaa

SEQ ID NO: 943186 - DNA, 25 bp, Mus musculus
ttctggctaaaattcctaagggcaa

SEQ ID NO: 943187 - DNA, 25 bp, Mus musculus
ttctggctacctagtctgagacttc

SEQ ID NO: 943188 - DNA, 25 bp, Mus musculus
ttctggctacctctgtatcaaccaa

SEQ ID NO: 943189 - DNA, 25 bp, Mus musculus
ttctggctacctgtgtatcaaccaa

SEQ ID NO: 943190 - DNA, 25 bp, Mus musculus
ttctggctaccttgtctgagacttc

SEQ ID NO: 943191 - DNA, 25 bp, Mus musculus
ttctggctactaatggagctctcct

SEQ ID NO: 943192 - DNA, 25 bp, Mus musculus
ttctggctactattggagctctcct

SEQ ID NO: 943193 - DNA, 25 bp, Mus musculus
ttctggctactcaaattctcttaaa

SEQ ID NO: 943194 - DNA, 25 bp, Mus musculus
ttctggctactctaattctcttaaa

SEQ ID NO: 943195 - DNA, 25 bp, Mus musculus
ttctggctagcaaccatagtgagac

SEQ ID NO: 943196 - DNA, 25 bp, Mus musculus
ttctggctagcatccatagtgagac

SEQ ID NO: 943197 - DNA, 25 bp, Mus musculus
ttctggctcaccatagttactgtat

SEQ ID NO: 943198 - DNA, 25 bp, Mus musculus
ttctggctcaccttagttactgtat

SEQ ID NO: 943199 - DNA, 25 bp, Mus musculus
ttctggctcactcaacatgaaaggg

SEQ ID NO: 943200 - DNA, 25 bp, Mus musculus
ttctggctcactgaacatgaaaggg

SEQ ID NO: 943201 - DNA, 25 bp, Mus musculus
ttctggctcatgagaggtgctagtg

SEQ ID NO: 943202 - DNA, 25 bp, Mus musculus
ttctggctcatgtgaggtgctagtg

SEQ ID NO: 943203 - DNA, 25 bp, Mus musculus
ttctggctccatcactaagagaatt

SEQ ID NO: 943204 - DNA, 25 bp, Mus musculus
ttctggctccatcgctgttagcata

SEQ ID NO: 943205 - DNA, 25 bp, Mus musculus
ttctggctccatcggcacccaggta

SEQ ID NO: 943206 - DNA, 25 bp, Mus musculus
ttctggctccatgactaagagaatt

SEQ ID NO: 943207 - DNA, 25 bp, Mus musculus
ttctggctccatggctgttagcata

SEQ ID NO: 943208 - DNA, 25 bp, Mus musculus
ttctggctccatgggcacccaggta

SEQ ID NO: 943209 - DNA, 25 bp, Mus musculus
ttctggctcccactttgaggctgta

SEQ ID NO: 943210 - DNA, 25 bp, Mus musculus
ttctggctcccagtttgaggctgta

SEQ ID NO: 943211 - DNA, 25 bp, Mus musculus
ttctggctcgagctggaaacctcaa

SEQ ID NO: 943212 - DNA, 25 bp, Mus musculus
ttctggctcgaggtggaaacctcaa

SEQ ID NO: 943213 - DNA, 25 bp, Mus musculus
ttctggctctcacggcttcattcct

SEQ ID NO: 943214 - DNA, 25 bp, Mus musculus
ttctggctctcagggcttcattcct

SEQ ID NO: 943215 - DNA, 25 bp, Mus musculus
ttctggctcttccatgtggattttg

SEQ ID NO: 943216 - DNA, 25 bp, Mus musculus
ttctggctcttcgatgtggattttg

SEQ ID NO: 943217 - DNA, 25 bp, Mus musculus
ttctggctgaccattctactttaaa

SEQ ID NO: 943218 - DNA, 25 bp, Mus musculus
ttctggctgacctttctactttaaa

SEQ ID NO: 943219 - DNA, 25 bp, Mus musculus
ttctggctgaggattacacgctagt

SEQ ID NO: 943220 - DNA, 25 bp, Mus musculus
ttctggctgaggtttacacgctagt

SEQ ID NO: 943221 - DNA, 25 bp, Mus musculus
ttctggctgccacaggcaccaggta

SEQ ID NO: 943222 - DNA, 25 bp, Mus musculus
ttctggctgccagaggcaccaggta

SEQ ID NO: 943223 - DNA, 25 bp, Mus musculus
ttctggctgcctctctttgctgcca

SEQ ID NO: 943224 - DNA, 25 bp, Mus musculus
ttctggctgcctgtctttgctgcca

SEQ ID NO: 943225 - DNA, 25 bp, Mus musculus
ttctggctggcacaataaggtcaaa

SEQ ID NO: 943226 - DNA, 25 bp, Mus musculus
ttctggctggcagaataaggtcaaa

SEQ ID NO: 943227 - DNA, 25 bp, Mus musculus
ttctggctgggaatcgggtactgaa

SEQ ID NO: 943228 - DNA, 25 bp, Mus musculus
ttctggctgggattcgggtactgaa

SEQ ID NO: 943229 - DNA, 25 bp, Mus musculus
ttctggctgtcgactccgtgactga

SEQ ID NO: 943230 - DNA, 25 bp, Mus musculus
ttctggctgtcgtctccgtgactga

SEQ ID NO: 943231 - DNA, 25 bp, Mus musculus
ttctggcttcacaaggcctggagaa

SEQ ID NO: 943232 - DNA, 25 bp, Mus musculus
ttctggcttcactaggcctggagaa

SEQ ID NO: 943233 - DNA, 25 bp, Mus musculus
ttctggcttgagacggctttggtta

SEQ ID NO: 943234 - DNA, 25 bp, Mus musculus
ttctggcttgagtcggctttggtta

SEQ ID NO: 943235 - DNA, 25 bp, Mus musculus
ttctggcttgctacatgatgatctg

SEQ ID NO: 943236 - DNA, 25 bp, Mus musculus
ttctggcttgcttcatgatgatctg

SEQ ID NO: 943237 - DNA, 25 bp, Mus musculus
ttctggcttgttactttgagtcttg

SEQ ID NO: 943238 - DNA, 25 bp, Mus musculus
ttctggcttgtttctttgagtcttg

SEQ ID NO: 943239 - DNA, 25 bp, Mus musculus
ttctggctttggagactgcaacatc

SEQ ID NO: 943240 - DNA, 25 bp, Mus musculus
ttctggctttggaggagagcttgct

SEQ ID NO: 943241 - DNA, 25 bp, Mus musculus
ttctggctttggtgactgcaacatc

SEQ ID NO: 943242 - DNA, 25 bp, Mus musculus
ttctggctttggtggagagcttgct

SEQ ID NO: 943243 - DNA, 25 bp, Mus musculus
ttctggcttttgatatctttttctt

SEQ ID NO: 943244 - DNA, 25 bp, Mus musculus
ttctggcttttgttatctttttctt

SEQ ID NO: 943245 - DNA, 25 bp, Mus musculus
ttctgggaaacacttgggtggctcc

SEQ ID NO: 943246 - DNA, 25 bp, Mus musculus
ttctgggaaacagttgggtggctcc

SEQ ID NO: 943247 - DNA, 25 bp, Mus musculus
ttctgggaacatctttcctcacttg

SEQ ID NO: 943248 - DNA, 25 bp, Mus musculus
ttctgggaacatgtttcctcacttg

SEQ ID NO: 943249 - DNA, 25 bp, Mus musculus
ttctgggaaccacaggtccctccat

SEQ ID NO: 943250 - DNA, 25 bp, Mus musculus
ttctgggaaccagaggtccctccat

SEQ ID NO: 943251 - DNA, 25 bp, Mus musculus
ttctgggaagaacgcgtcaactgga

SEQ ID NO: 943252 - DNA, 25 bp, Mus musculus
ttctgggaagaaggcgtcaactgga

SEQ ID NO: 943253 - DNA, 25 bp, Mus musculus
ttctgggacatgaatcttctctctc

SEQ ID NO: 943254 - DNA, 25 bp, Mus musculus
ttctgggacatgtatcttctctctc

SEQ ID NO: 943255 - DNA, 25 bp, Mus musculus
ttctgggacggccatcgagaaccaa

SEQ ID NO: 943256 - DNA, 25 bp, Mus musculus
ttctgggacggcgatcgagaaccaa

SEQ ID NO: 943257 - DNA, 25 bp, Mus musculus
ttctgggactacacttaggcctaaa

SEQ ID NO: 943258 - DNA, 25 bp, Mus musculus
ttctgggactactcttaggcctaaa

SEQ ID NO: 943259 - DNA, 25 bp, Mus musculus
ttctgggagagtcagtgacaccaca

SEQ ID NO: 943260 - DNA, 25 bp, Mus musculus
ttctgggagagtgagtgacaccaca

SEQ ID NO: 943261 - DNA, 25 bp, Mus musculus
ttctgggagcggcaactgagcctat

SEQ ID NO: 943262 - DNA, 25 bp, Mus musculus
ttctgggagcgggaactgagcctat

SEQ ID NO: 943263 - DNA, 25 bp, Mus musculus
ttctgggaggatatactgtttggca

SEQ ID NO: 943264 - DNA, 25 bp, Mus musculus
ttctgggaggatttactgtttggca

SEQ ID NO: 943265 - DNA, 25 bp, Mus musculus
ttctgggaggtgacctactttcctg

SEQ ID NO: 943266 - DNA, 25 bp, Mus musculus
ttctgggaggtgtcctactttcctg

SEQ ID NO: 943267 - DNA, 25 bp, Mus musculus
ttctgggataacattttgcgggacg

SEQ ID NO: 943268 - DNA, 25 bp, Mus musculus
ttctgggataactttttgcgggacg

SEQ ID NO: 943269 - DNA, 25 bp, Mus musculus
ttctgggatcctcggtcgcagcgcc

SEQ ID NO: 943270 - DNA, 25 bp, Mus musculus
ttctgggatcctgggtcgcagcgcc

SEQ ID NO: 943271 - DNA, 25 bp, Mus musculus
ttctgggatgcacctgaggtctcat

SEQ ID NO: 943272 - DNA, 25 bp, Mus musculus
ttctgggatgcagctgaggtctcat

SEQ ID NO: 943273 - DNA, 25 bp, Mus musculus
ttctgggatgccattccttgcaaaa

SEQ ID NO: 943274 - DNA, 25 bp, Mus musculus
ttctgggatgcctttccttgcaaaa

SEQ ID NO: 943275 - DNA, 25 bp, Mus musculus
ttctgggatgcgaaccactggacta

SEQ ID NO: 943276 - DNA, 25 bp, Mus musculus
ttctgggatgcgtaccactggacta

SEQ ID NO: 943277 - DNA, 25 bp, Mus musculus
ttctgggattgacctcagactgtta

SEQ ID NO: 943278 - DNA, 25 bp, Mus musculus
ttctgggattgagctcagactgtta

SEQ ID NO: 943279 - DNA, 25 bp, Mus musculus
ttctgggatttcacgcatgttgcaa

SEQ ID NO: 943280 - DNA, 25 bp, Mus musculus
ttctgggatttctcgcatgttgcaa

SEQ ID NO: 943281 - DNA, 25 bp, Mus musculus
ttctgggcaaggacctcttgatgtg

SEQ ID NO: 943282 - DNA, 25 bp, Mus musculus
ttctgggcaaggtcctcttgatgtg

SEQ ID NO: 943283 - DNA, 25 bp, Mus musculus
ttctgggcaatgaactaggatcctc

SEQ ID NO: 943284 - DNA, 25 bp, Mus musculus
ttctgggcaatgtactaggatcctc

SEQ ID NO: 943285 - DNA, 25 bp, Mus musculus
ttctgggcacagaacacgctttggt

SEQ ID NO: 943286 - DNA, 25 bp, Mus musculus
ttctgggcacagtacacgctttggt

SEQ ID NO: 943287 - DNA, 25 bp, Mus musculus
ttctgggcactgaggattgagctag

SEQ ID NO: 943288 - DNA, 25 bp, Mus musculus
ttctgggcactgagggactcttcct

SEQ ID NO: 943289 - DNA, 25 bp, Mus musculus
ttctgggcactgtggattgagctag

SEQ ID NO: 943290 - DNA, 25 bp, Mus musculus
ttctgggcactgtgggactcttcct

SEQ ID NO: 943291 - DNA, 25 bp, Mus musculus
ttctgggcattgacttcctggttat

SEQ ID NO: 943292 - DNA, 25 bp, Mus musculus
ttctgggcattgtcttcctggttat

SEQ ID NO: 943293 - DNA, 25 bp, Mus musculus
ttctgggccaccacagggaagggat

SEQ ID NO: 943294 - DNA, 25 bp, Mus musculus
ttctgggccacctcagggaagggat

SEQ ID NO: 943295 - DNA, 25 bp, Mus musculus
ttctgggccatactctgtgagttct

SEQ ID NO: 943296 - DNA, 25 bp, Mus musculus
ttctgggccatagtctgtgagttct

SEQ ID NO: 943297 - DNA, 25 bp, Mus musculus
ttctgggcccagagtcagggtctct

SEQ ID NO: 943298 - DNA, 25 bp, Mus musculus
ttctgggcccagcactaactgtgag

SEQ ID NO: 943299 - DNA, 25 bp, Mus musculus
ttctgggcccaggactaactgtgag

SEQ ID NO: 943300 - DNA, 25 bp, Mus musculus
ttctgggcccagtgtcagggtctct

SEQ ID NO: 943301 - DNA, 25 bp, Mus musculus
ttctgggcctacagctgctaaagtg

SEQ ID NO: 943302 - DNA, 25 bp, Mus musculus
ttctgggcctactgctgctaaagtg

SEQ ID NO: 943303 - DNA, 25 bp, Mus musculus
ttctgggcctagaggcagacgctgc

SEQ ID NO: 943304 - DNA, 25 bp, Mus musculus
ttctgggcctagtggcagacgctgc

SEQ ID NO: 943305 - DNA, 25 bp, Mus musculus
ttctgggccttcagtacaatcagca

SEQ ID NO: 943306 - DNA, 25 bp, Mus musculus
ttctgggccttccaagtcattctga

SEQ ID NO: 943307 - DNA, 25 bp, Mus musculus
ttctgggccttcgaagtcattctga

SEQ ID NO: 943308 - DNA, 25 bp, Mus musculus
ttctgggccttctgtacaatcagca

SEQ ID NO: 943309 - DNA, 25 bp, Mus musculus
ttctgggccttgaaggatctctagc

SEQ ID NO: 943310 - DNA, 25 bp, Mus musculus
ttctgggccttgtaggatctctagc

SEQ ID NO: 943311 - DNA, 25 bp, Mus musculus
ttctgggcctttatcacttttgata

SEQ ID NO: 943312 - DNA, 25 bp, Mus musculus
ttctgggcctttttcacttttgata

SEQ ID NO: 943313 - DNA, 25 bp, Mus musculus
ttctgggctactcggaagcctgtct

SEQ ID NO: 943314 - DNA, 25 bp, Mus musculus
ttctgggctactgggaagcctgtct

SEQ ID NO: 943315 - DNA, 25 bp, Mus musculus
ttctgggctcacagcggtgatccag

SEQ ID NO: 943316 - DNA, 25 bp, Mus musculus
ttctgggctcactgcggtgatccag

SEQ ID NO: 943317 - DNA, 25 bp, Mus musculus
ttctgggctcataaaccatcagcgt

SEQ ID NO: 943318 - DNA, 25 bp, Mus musculus
ttctgggctcattaaccatcagcgt

SEQ ID NO: 943319 - DNA, 25 bp, Mus musculus
ttctgggctctcctaatatgtcagg

SEQ ID NO: 943320 - DNA, 25 bp, Mus musculus
ttctgggctctcgtaatatgtcagg

SEQ ID NO: 943321 - DNA, 25 bp, Mus musculus
ttctgggctgatcctcaaaggctgt

SEQ ID NO: 943322 - DNA, 25 bp, Mus musculus
ttctgggctgatgctcaaaggctgt

SEQ ID NO: 943323 - DNA, 25 bp, Mus musculus
ttctgggctgcaaaactggagtctg

SEQ ID NO: 943324 - DNA, 25 bp, Mus musculus
ttctgggctgcataactggagtctg

SEQ ID NO: 943325 - DNA, 25 bp, Mus musculus
ttctgggctgctactaggtactcag

SEQ ID NO: 943326 - DNA, 25 bp, Mus musculus
ttctgggctgcttctaggtactcag

SEQ ID NO: 943327 - DNA, 25 bp, Mus musculus
ttctgggctgtcagttcttaagatc

SEQ ID NO: 943328 - DNA, 25 bp, Mus musculus
ttctgggctgtctgttcttaagatc

SEQ ID NO: 943329 - DNA, 25 bp, Mus musculus
ttctgggctgttagttctccaagga

SEQ ID NO: 943330 - DNA, 25 bp, Mus musculus
ttctgggctgtttgttctccaagga

SEQ ID NO: 943331 - DNA, 25 bp, Mus musculus
ttctgggcttgcattcctgtacact

SEQ ID NO: 943332 - DNA, 25 bp, Mus musculus
ttctgggcttgctttcctgtacact

SEQ ID NO: 943333 - DNA, 25 bp, Mus musculus
ttctgggctttcacatctgctttga

SEQ ID NO: 943334 - DNA, 25 bp, Mus musculus
ttctgggctttctcatctgctttga

SEQ ID NO: 943335 - DNA, 25 bp, Mus musculus
ttctgggtaaagcacctcccgtgaa

SEQ ID NO: 943336 - DNA, 25 bp, Mus musculus
ttctgggtaaaggacctcccgtgaa

SEQ ID NO: 943337 - DNA, 25 bp, Mus musculus
ttctgggtaagaatgagtcctccat

SEQ ID NO: 943338 - DNA, 25 bp, Mus musculus
ttctgggtaagattgagtcctccat

SEQ ID NO: 943339 - DNA, 25 bp, Mus musculus
ttctgggtatcaaccttagtaaagc

SEQ ID NO: 943340 - DNA, 25 bp, Mus musculus
ttctgggtatcatccttagtaaagc

SEQ ID NO: 943341 - DNA, 25 bp, Mus musculus
ttctgggtcattctgcatcctaggg

SEQ ID NO: 943342 - DNA, 25 bp, Mus musculus
ttctgggtcattgtgcatcctaggg

SEQ ID NO: 943343 - DNA, 25 bp, Mus musculus
ttctgggtccatctaagtccttcaa

SEQ ID NO: 943344 - DNA, 25 bp, Mus musculus
ttctgggtccatgtaagtccttcaa

SEQ ID NO: 943345 - DNA, 25 bp, Mus musculus
ttctgggtcccactggctgaatcag

SEQ ID NO: 943346 - DNA, 25 bp, Mus musculus
ttctgggtcccagtggctgaatcag

SEQ ID NO: 943347 - DNA, 25 bp, Mus musculus
ttctgggtccccagacataaacctt

SEQ ID NO: 943348 - DNA, 25 bp, Mus musculus
ttctgggtcccctgacataaacctt

SEQ ID NO: 943349 - DNA, 25 bp, Mus musculus
ttctgggtcctgctcattcattgtc

SEQ ID NO: 943350 - DNA, 25 bp, Mus musculus
ttctgggtcctggtcattcattgtc

SEQ ID NO: 943351 - DNA, 25 bp, Mus musculus
ttctgggtccttatcaagggatcgc

SEQ ID NO: 943352 - DNA, 25 bp, Mus musculus
ttctgggtccttttcaagggatcgc

SEQ ID NO: 943353 - DNA, 25 bp, Mus musculus
ttctgggtctcaaacgggttgtcac

SEQ ID NO: 943354 - DNA, 25 bp, Mus musculus
ttctgggtctcacgctttgtttgaa

SEQ ID NO: 943355 - DNA, 25 bp, Mus musculus
ttctgggtctcaggctttgtttgaa

SEQ ID NO: 943356 - DNA, 25 bp, Mus musculus
ttctgggtctcatacgggttgtcac

SEQ ID NO: 943357 - DNA, 25 bp, Mus musculus
ttctgggtcttaacttatggaggca

SEQ ID NO: 943358 - DNA, 25 bp, Mus musculus
ttctgggtcttacccgtgagtgtaa

SEQ ID NO: 943359 - DNA, 25 bp, Mus musculus
ttctgggtcttactagtgttcatac

SEQ ID NO: 943360 - DNA, 25 bp, Mus musculus
ttctgggtcttagccgtgagtgtaa

SEQ ID NO: 943361 - DNA, 25 bp, Mus musculus
ttctgggtcttagtagtgttcatac

SEQ ID NO: 943362 - DNA, 25 bp, Mus musculus
ttctgggtcttatcttatggaggca

SEQ ID NO: 943363 - DNA, 25 bp, Mus musculus
ttctgggtcttgacctaccagagga

SEQ ID NO: 943364 - DNA, 25 bp, Mus musculus
ttctgggtcttgtcctaccagagga

SEQ ID NO: 943365 - DNA, 25 bp, Mus musculus
ttctgggtgataatgcctcttactg

SEQ ID NO: 943366 - DNA, 25 bp, Mus musculus
ttctgggtgatattgcctcttactg

SEQ ID NO: 943367 - DNA, 25 bp, Mus musculus
ttctgggtgcctccttatatgaaaa

SEQ ID NO: 943368 - DNA, 25 bp, Mus musculus
ttctgggtgcctgcttatatgaaaa

SEQ ID NO: 943369 - DNA, 25 bp, Mus musculus
ttctgggtggctcttcagtggtttc

SEQ ID NO: 943370 - DNA, 25 bp, Mus musculus
ttctgggtggctgttcagtggtttc

SEQ ID NO: 943371 - DNA, 25 bp, Mus musculus
ttctgggtgtgtctaactactctgt

SEQ ID NO: 943372 - DNA, 25 bp, Mus musculus
ttctgggtgtgtgtaactactctgt

SEQ ID NO: 943373 - DNA, 25 bp, Mus musculus
ttctgggtgtttctgggtcattata

SEQ ID NO: 943374 - DNA, 25 bp, Mus musculus
ttctgggtgtttgtgggtcattata

SEQ ID NO: 943375 - DNA, 25 bp, Mus musculus
ttctgggttcctactagggtattgg

SEQ ID NO: 943376 - DNA, 25 bp, Mus musculus
ttctgggttccttctagggtattgg

SEQ ID NO: 943377 - DNA, 25 bp, Mus musculus
ttctgggttgaaatgcctcacttct

SEQ ID NO: 943378 - DNA, 25 bp, Mus musculus
ttctgggttgaattgcctcacttct

SEQ ID NO: 943379 - DNA, 25 bp, Mus musculus
ttctgggttgctagactcatgtctg

SEQ ID NO: 943380 - DNA, 25 bp, Mus musculus
ttctgggttgcttgactcatgtctg

SEQ ID NO: 943381 - DNA, 25 bp, Mus musculus
ttctggtaaatgctcttgtgccctt

SEQ ID NO: 943382 - DNA, 25 bp, Mus musculus
ttctggtaaatggtcttgtgccctt

SEQ ID NO: 943383 - DNA, 25 bp, Mus musculus
ttctggtacagactaagctccctta

SEQ ID NO: 943384 - DNA, 25 bp, Mus musculus
ttctggtacagagtaagctccctta

SEQ ID NO: 943385 - DNA, 25 bp, Mus musculus
ttctggtaccaaccacacatgtaat

SEQ ID NO: 943386 - DNA, 25 bp, Mus musculus
ttctggtaccaagcacacatgtaat

SEQ ID NO: 943387 - DNA, 25 bp, Mus musculus
ttctggtacgctccggaatgtttaa

SEQ ID NO: 943388 - DNA, 25 bp, Mus musculus
ttctggtacgctgcggaatgtttaa

SEQ ID NO: 943389 - DNA, 25 bp, Mus musculus
ttctggtactccctctcatccatgt

SEQ ID NO: 943390 - DNA, 25 bp, Mus musculus
ttctggtactccgtctcatccatgt

SEQ ID NO: 943391 - DNA, 25 bp, Mus musculus
ttctggtactgcatttgccttccta

SEQ ID NO: 943392 - DNA, 25 bp, Mus musculus
ttctggtactgcttttgccttccta

SEQ ID NO: 943393 - DNA, 25 bp, Mus musculus
ttctggtagagcacctaacacttta

SEQ ID NO: 943394 - DNA, 25 bp, Mus musculus
ttctggtagagctcctaacacttta

SEQ ID NO: 943395 - DNA, 25 bp, Mus musculus
ttctggtagctcagatctttggttt

SEQ ID NO: 943396 - DNA, 25 bp, Mus musculus
ttctggtagctctgatctttggttt

SEQ ID NO: 943397 - DNA, 25 bp, Mus musculus
ttctggtagtggatgcatgctgtct

SEQ ID NO: 943398 - DNA, 25 bp, Mus musculus
ttctggtagtggttgcatgctgtct

SEQ ID NO: 943399 - DNA, 25 bp, Mus musculus
ttctggtatagaacttcttccttca

SEQ ID NO: 943400 - DNA, 25 bp, Mus musculus
ttctggtatagatcttcttccttca

SEQ ID NO: 943401 - DNA, 25 bp, Mus musculus
ttctggtatcacacttacaccaagg

SEQ ID NO: 943402 - DNA, 25 bp, Mus musculus
ttctggtatcactcttacaccaagg

SEQ ID NO: 943403 - DNA, 25 bp, Mus musculus
ttctggtatcccagcacccgagatg

SEQ ID NO: 943404 - DNA, 25 bp, Mus musculus
ttctggtatccctgcacccgagatg

SEQ ID NO: 943405 - DNA, 25 bp, Mus musculus
ttctggtatctcctctttgtgaaca

SEQ ID NO: 943406 - DNA, 25 bp, Mus musculus
ttctggtatctcgtctttgtgaaca

SEQ ID NO: 943407 - DNA, 25 bp, Mus musculus
ttctggtatgaaattgcccttgcct

SEQ ID NO: 943408 - DNA, 25 bp, Mus musculus
ttctggtatgaatttgcccttgcct

SEQ ID NO: 943409 - DNA, 25 bp, Mus musculus
ttctggtattatcttttcaaaacag

SEQ ID NO: 943410 - DNA, 25 bp, Mus musculus
ttctggtattatgttttcaaaacag

SEQ ID NO: 943411 - DNA, 25 bp, Mus musculus
ttctggtcagcaatcctatggccat

SEQ ID NO: 943412 - DNA, 25 bp, Mus musculus
ttctggtcagcattcctatggccat

SEQ ID NO: 943413 - DNA, 25 bp, Mus musculus
ttctggtcatctcttgagtttctct

SEQ ID NO: 943414 - DNA, 25 bp, Mus musculus
ttctggtcatctgttgagtttctct

SEQ ID NO: 943415 - DNA, 25 bp, Mus musculus
ttctggtccactagcatggagaaca

SEQ ID NO: 943416 - DNA, 25 bp, Mus musculus
ttctggtccacttgcatggagaaca

SEQ ID NO: 943417 - DNA, 25 bp, Mus musculus
ttctggtccagcctctcaaaataaa

SEQ ID NO: 943418 - DNA, 25 bp, Mus musculus
ttctggtccagcgtctcaaaataaa

SEQ ID NO: 943419 - DNA, 25 bp, Mus musculus
ttctggtcccctagcaaggaaaaca

SEQ ID NO: 943420 - DNA, 25 bp, Mus musculus
ttctggtcccctctagcgaaaggca

SEQ ID NO: 943421 - DNA, 25 bp, Mus musculus
ttctggtcccctgtagcgaaaggca

SEQ ID NO: 943422 - DNA, 25 bp, Mus musculus
ttctggtccccttgcaaggaaaaca

SEQ ID NO: 943423 - DNA, 25 bp, Mus musculus
ttctggtcctatcaaaaccacccag

SEQ ID NO: 943424 - DNA, 25 bp, Mus musculus
ttctggtcctatcaggagacctcag

SEQ ID NO: 943425 - DNA, 25 bp, Mus musculus
ttctggtcctatgaaaaccacccag

SEQ ID NO: 943426 - DNA, 25 bp, Mus musculus
ttctggtcctatgaggagacctcag

SEQ ID NO: 943427 - DNA, 25 bp, Mus musculus
ttctggtcctgcactctatagccct

SEQ ID NO: 943428 - DNA, 25 bp, Mus musculus
ttctggtcctgctctctatagccct

SEQ ID NO: 943429 - DNA, 25 bp, Mus musculus
ttctggtcctttatcttgcagaaaa

SEQ ID NO: 943430 - DNA, 25 bp, Mus musculus
ttctggtcctttttcttgcagaaaa

SEQ ID NO: 943431 - DNA, 25 bp, Mus musculus
ttctggtcgtggcttggttcttctg

SEQ ID NO: 943432 - DNA, 25 bp, Mus musculus
ttctggtcgtgggttggttcttctg

SEQ ID NO: 943433 - DNA, 25 bp, Mus musculus
ttctggtctccaagtctgtgtattt

SEQ ID NO: 943434 - DNA, 25 bp, Mus musculus
ttctggtctccatgtctgtgtattt

SEQ ID NO: 943435 - DNA, 25 bp, Mus musculus
ttctggtctctaaggactcctggac

SEQ ID NO: 943436 - DNA, 25 bp, Mus musculus
ttctggtctctaagggtactgcatg

SEQ ID NO: 943437 - DNA, 25 bp, Mus musculus
ttctggtctctacagactctgcaca

SEQ ID NO: 943438 - DNA, 25 bp, Mus musculus
ttctggtctctagagactctgcaca

SEQ ID NO: 943439 - DNA, 25 bp, Mus musculus
ttctggtctctatggactcctggac

SEQ ID NO: 943440 - DNA, 25 bp, Mus musculus
ttctggtctctatgggtactgcatg

SEQ ID NO: 943441 - DNA, 25 bp, Mus musculus
ttctggtctctgagtgcacacaacg

SEQ ID NO: 943442 - DNA, 25 bp, Mus musculus
ttctggtctctgcaaccatcagatg

SEQ ID NO: 943443 - DNA, 25 bp, Mus musculus
ttctggtctctggaaccatcagatg

SEQ ID NO: 943444 - DNA, 25 bp, Mus musculus
ttctggtctctgtgtgcacacaacg

SEQ ID NO: 943445 - DNA, 25 bp, Mus musculus
ttctggtgacatctttttgcttatc

SEQ ID NO: 943446 - DNA, 25 bp, Mus musculus
ttctggtgacatgtttttgcttatc

SEQ ID NO: 943447 - DNA, 25 bp, Mus musculus
ttctggtgaccacacaacacagcac

SEQ ID NO: 943448 - DNA, 25 bp, Mus musculus
ttctggtgaccagacaacacagcac

SEQ ID NO: 943449 - DNA, 25 bp, Mus musculus
ttctggtgccacctagtggtcagaa

SEQ ID NO: 943450 - DNA, 25 bp, Mus musculus
ttctggtgccacgtagtggtcagaa

SEQ ID NO: 943451 - DNA, 25 bp, Mus musculus
ttctggtgcctgattttaaccaatg

SEQ ID NO: 943452 - DNA, 25 bp, Mus musculus
ttctggtgcctgtttttaaccaatg

SEQ ID NO: 943453 - DNA, 25 bp, Mus musculus
ttctggtggcacaggcagggcgatc

SEQ ID NO: 943454 - DNA, 25 bp, Mus musculus
ttctggtggcactggcagggcgatc

SEQ ID NO: 943455 - DNA, 25 bp, Mus musculus
ttctggtggtaaacatgcctttttt

SEQ ID NO: 943456 - DNA, 25 bp, Mus musculus
ttctggtggtaatcatgcctttttt

SEQ ID NO: 943457 - DNA, 25 bp, Mus musculus
ttctggtggtttacaggtccaaaca

SEQ ID NO: 943458 - DNA, 25 bp, Mus musculus
ttctggtggttttcaggtccaaaca

SEQ ID NO: 943459 - DNA, 25 bp, Mus musculus
ttctggtgttgaagctaggtcttga

SEQ ID NO: 943460 - DNA, 25 bp, Mus musculus
ttctggtgttgatgctaggtcttga

SEQ ID NO: 943461 - DNA, 25 bp, Mus musculus
ttctggtgtttgagctgagctgtga

SEQ ID NO: 943462 - DNA, 25 bp, Mus musculus
ttctggtgtttgtgctgagctgtga

SEQ ID NO: 943463 - DNA, 25 bp, Mus musculus
ttctggttacagactatttccatgc

SEQ ID NO: 943464 - DNA, 25 bp, Mus musculus
ttctggttacagtctatttccatgc

SEQ ID NO: 943465 - DNA, 25 bp, Mus musculus
ttctggttagacctgtgtgggctct

SEQ ID NO: 943466 - DNA, 25 bp, Mus musculus
ttctggttagacgtgtgtgggctct

SEQ ID NO: 943467 - DNA, 25 bp, Mus musculus
ttctggttccacagcctgagtagaa

SEQ ID NO: 943468 - DNA, 25 bp, Mus musculus
ttctggttccacaggtgcctacatg

SEQ ID NO: 943469 - DNA, 25 bp, Mus musculus
ttctggttccactgcctgagtagaa

SEQ ID NO: 943470 - DNA, 25 bp, Mus musculus
ttctggttccactggtgcctacatg

SEQ ID NO: 943471 - DNA, 25 bp, Mus musculus
ttctggttcttcagtccatccttac

SEQ ID NO: 943472 - DNA, 25 bp, Mus musculus
ttctggttcttctgtccatccttac

SEQ ID NO: 943473 - DNA, 25 bp, Mus musculus
ttctggttgccacaccggcacggat

SEQ ID NO: 943474 - DNA, 25 bp, Mus musculus
ttctggttgccagaccggcacggat

SEQ ID NO: 943475 - DNA, 25 bp, Mus musculus
ttctggttgcccactacaccatgaa

SEQ ID NO: 943476 - DNA, 25 bp, Mus musculus
ttctggttgccctctacaccatgaa

SEQ ID NO: 943477 - DNA, 25 bp, Mus musculus
ttctggttggccattcttcctggac

SEQ ID NO: 943478 - DNA, 25 bp, Mus musculus
ttctggttggcctttcttcctggac

SEQ ID NO: 943479 - DNA, 25 bp, Mus musculus
ttctggttgttcatgtatcagtgtt

SEQ ID NO: 943480 - DNA, 25 bp, Mus musculus
ttctggttgttcttgtatcagtgtt

SEQ ID NO: 943481 - DNA, 25 bp, Mus musculus
ttctggttgttgatggccttcatca

SEQ ID NO: 943482 - DNA, 25 bp, Mus musculus
ttctggttgttgttggccttcatca

SEQ ID NO: 943483 - DNA, 25 bp, Mus musculus
ttctggtttagaagctagtgtttct

SEQ ID NO: 943484 - DNA, 25 bp, Mus musculus
ttctggtttagatgctagtgtttct

SEQ ID NO: 943485 - DNA, 25 bp, Mus musculus
ttctggtttcatcacccatcttcag

SEQ ID NO: 943486 - DNA, 25 bp, Mus musculus
ttctggtttcatgacccatcttcag

SEQ ID NO: 943487 - DNA, 25 bp, Mus musculus
ttctggtttccaatcctttcctaat

SEQ ID NO: 943488 - DNA, 25 bp, Mus musculus
ttctggtttccattcctttcctaat

SEQ ID NO: 943489 - DNA, 25 bp, Mus musculus
ttctggtttctgctagcaggcctcc

SEQ ID NO: 943490 - DNA, 25 bp, Mus musculus
ttctggtttctggtagcaggcctcc

SEQ ID NO: 943491 - DNA, 25 bp, Mus musculus
ttctggtttgtaagggttccacacg

SEQ ID NO: 943492 - DNA, 25 bp, Mus musculus
ttctggtttgtatgggttccacacg

SEQ ID NO: 943493 - DNA, 25 bp, Mus musculus
ttctggtttgtcctggaacctccat

SEQ ID NO: 943494 - DNA, 25 bp, Mus musculus
ttctggtttgtcgtggaacctccat

SEQ ID NO: 943495 - DNA, 25 bp, Mus musculus
ttctggttttctcgccgtctatatc

SEQ ID NO: 943496 - DNA, 25 bp, Mus musculus
ttctggttttctggccgtctatatc

SEQ ID NO: 943497 - DNA, 25 bp, Mus musculus
ttctgtaaaaccagtttccccacag

SEQ ID NO: 943498 - DNA, 25 bp, Mus musculus
ttctgtaaaacctgtttccccacag

SEQ ID NO: 943499 - DNA, 25 bp, Mus musculus
ttctgtaaaaggaggcagccccaca

SEQ ID NO: 943500 - DNA, 25 bp, Mus musculus
ttctgtaaaaggtggcagccccaca

SEQ ID NO: 943501 - DNA, 25 bp, Mus musculus
ttctgtaaagatcccctttggtccg

SEQ ID NO: 943502 - DNA, 25 bp, Mus musculus
ttctgtaaagatgccctttggtccg

SEQ ID NO: 943503 - DNA, 25 bp, Mus musculus
ttctgtaaattacttctgtttcttt

SEQ ID NO: 943504 - DNA, 25 bp, Mus musculus
ttctgtaaattagttctgtttcttt

SEQ ID NO: 943505 - DNA, 25 bp, Mus musculus
ttctgtaacagaatcatggagactc

SEQ ID NO: 943506 - DNA, 25 bp, Mus musculus
ttctgtaacagaccacgcccagaac

SEQ ID NO: 943507 - DNA, 25 bp, Mus musculus
ttctgtaacagagcacgcccagaac

SEQ ID NO: 943508 - DNA, 25 bp, Mus musculus
ttctgtaacagattcatggagactc

SEQ ID NO: 943509 - DNA, 25 bp, Mus musculus
ttctgtaactataggatgacgcttt

SEQ ID NO: 943510 - DNA, 25 bp, Mus musculus
ttctgtaactattggatgacgcttt

SEQ ID NO: 943511 - DNA, 25 bp, Mus musculus
ttctgtaactgcagggcgctgggat

SEQ ID NO: 943512 - DNA, 25 bp, Mus musculus
ttctgtaactgctgggcgctgggat

SEQ ID NO: 943513 - DNA, 25 bp, Mus musculus
ttctgtaacttgaactttattggag

SEQ ID NO: 943514 - DNA, 25 bp, Mus musculus
ttctgtaacttgtactttattggag

SEQ ID NO: 943515 - DNA, 25 bp, Mus musculus
ttctgtaagcagatgcagccgcctg

SEQ ID NO: 943516 - DNA, 25 bp, Mus musculus
ttctgtaagcagttgcagccgcctg

SEQ ID NO: 943517 - DNA, 25 bp, Mus musculus
ttctgtaagggtccccagtgtgact

SEQ ID NO: 943518 - DNA, 25 bp, Mus musculus
ttctgtaagggtgcccagtgtgact

SEQ ID NO: 943519 - DNA, 25 bp, Mus musculus
ttctgtaatcagctactgtctgttt

SEQ ID NO: 943520 - DNA, 25 bp, Mus musculus
ttctgtaatcaggtactgtctgttt

SEQ ID NO: 943521 - DNA, 25 bp, Mus musculus
ttctgtaatgctataggcccagtac

SEQ ID NO: 943522 - DNA, 25 bp, Mus musculus
ttctgtaatgctttaggcccagtac

SEQ ID NO: 943523 - DNA, 25 bp, Mus musculus
ttctgtaatgttactaccacactgt

SEQ ID NO: 943524 - DNA, 25 bp, Mus musculus
ttctgtaatgtttctaccacactgt

SEQ ID NO: 943525 - DNA, 25 bp, Mus musculus
ttctgtacaagaaccaagtgagtct

SEQ ID NO: 943526 - DNA, 25 bp, Mus musculus
ttctgtacaagatccaagtgagtct

SEQ ID NO: 943527 - DNA, 25 bp, Mus musculus
ttctgtacagacaagtagcattcta

SEQ ID NO: 943528 - DNA, 25 bp, Mus musculus
ttctgtacagactagtagcattcta

SEQ ID NO: 943529 - DNA, 25 bp, Mus musculus
ttctgtacagcaagttccattccat

SEQ ID NO: 943530 - DNA, 25 bp, Mus musculus
ttctgtacagcatgttccattccat

SEQ ID NO: 943531 - DNA, 25 bp, Mus musculus
ttctgtacagtgcctataagagctg

SEQ ID NO: 943532 - DNA, 25 bp, Mus musculus
ttctgtacagtggctataagagctg

SEQ ID NO: 943533 - DNA, 25 bp, Mus musculus
ttctgtaccaaactgcctggaggtt

SEQ ID NO: 943534 - DNA, 25 bp, Mus musculus
ttctgtaccaaagtgcctggaggtt

SEQ ID NO: 943535 - DNA, 25 bp, Mus musculus
ttctgtaccagaaatggccagttga

SEQ ID NO: 943536 - DNA, 25 bp, Mus musculus
ttctgtaccagatatggccagttga

SEQ ID NO: 943537 - DNA, 25 bp, Mus musculus
ttctgtaccattcacttacttggga

SEQ ID NO: 943538 - DNA, 25 bp, Mus musculus
ttctgtaccattgacttacttggga

SEQ ID NO: 943539 - DNA, 25 bp, Mus musculus
ttctgtaccccactaatcaactagt

SEQ ID NO: 943540 - DNA, 25 bp, Mus musculus
ttctgtaccccagtaatcaactagt

SEQ ID NO: 943541 - DNA, 25 bp, Mus musculus
ttctgtacctataagctgccttttt

SEQ ID NO: 943542 - DNA, 25 bp, Mus musculus
ttctgtacctattagctgccttttt

SEQ ID NO: 943543 - DNA, 25 bp, Mus musculus
ttctgtacgaacagatgaccggcca

SEQ ID NO: 943544 - DNA, 25 bp, Mus musculus
ttctgtacgaactgatgaccggcca

SEQ ID NO: 943545 - DNA, 25 bp, Mus musculus
ttctgtacgaggaggttctcatcta

SEQ ID NO: 943546 - DNA, 25 bp, Mus musculus
ttctgtacgaggtggttctcatcta

SEQ ID NO: 943547 - DNA, 25 bp, Mus musculus
ttctgtacttacctaactttggaag

SEQ ID NO: 943548 - DNA, 25 bp, Mus musculus
ttctgtacttacgtaactttggaag

SEQ ID NO: 943549 - DNA, 25 bp, Mus musculus
ttctgtagaactacagttgactgca

SEQ ID NO: 943550 - DNA, 25 bp, Mus musculus
ttctgtagaacttcagttgactgca

SEQ ID NO: 943551 - DNA, 25 bp, Mus musculus
ttctgtagaccgcaccaggcgaata

SEQ ID NO: 943552 - DNA, 25 bp, Mus musculus
ttctgtagaccggaccaggcgaata

SEQ ID NO: 943553 - DNA, 25 bp, Mus musculus
ttctgtagcaagaccaatctgtcca

SEQ ID NO: 943554 - DNA, 25 bp, Mus musculus
ttctgtagcaagtccaatctgtcca

SEQ ID NO: 943555 - DNA, 25 bp, Mus musculus
ttctgtaggaaaaggagcactctct

SEQ ID NO: 943556 - DNA, 25 bp, Mus musculus
ttctgtaggaaatggagcactctct

SEQ ID NO: 943557 - DNA, 25 bp, Mus musculus
ttctgtagggccctggtatttgcag

SEQ ID NO: 943558 - DNA, 25 bp, Mus musculus
ttctgtagggccgtggtatttgcag

SEQ ID NO: 943559 - DNA, 25 bp, Mus musculus
ttctgtagtaacagccttggcgact

SEQ ID NO: 943560 - DNA, 25 bp, Mus musculus
ttctgtagtaactgccttggcgact

SEQ ID NO: 943561 - DNA, 25 bp, Mus musculus
ttctgtagtaccaaagcaggctccc

SEQ ID NO: 943562 - DNA, 25 bp, Mus musculus
ttctgtagtacctaagcaggctccc

SEQ ID NO: 943563 - DNA, 25 bp, Mus musculus
ttctgtagttccaaggtgtgtgttt

SEQ ID NO: 943564 - DNA, 25 bp, Mus musculus
ttctgtagttcctaggtgtgtgttt

SEQ ID NO: 943565 - DNA, 25 bp, Mus musculus
ttctgtagttgcacaagaactgagc

SEQ ID NO: 943566 - DNA, 25 bp, Mus musculus
ttctgtagttgctcaagaactgagc

SEQ ID NO: 943567 - DNA, 25 bp, Mus musculus
ttctgtagtttgacctttgtcctga

SEQ ID NO: 943568 - DNA, 25 bp, Mus musculus
ttctgtagtttgtcctttgtcctga

SEQ ID NO: 943569 - DNA, 25 bp, Mus musculus
ttctgtatatacagtgccaccctgt

SEQ ID NO: 943570 - DNA, 25 bp, Mus musculus
ttctgtatatactgtgccaccctgt

SEQ ID NO: 943571 - DNA, 25 bp, Mus musculus
ttctgtatatttattacgagtctag

SEQ ID NO: 943572 - DNA, 25 bp, Mus musculus
ttctgtatattttttacgagtctag

SEQ ID NO: 943573 - DNA, 25 bp, Mus musculus
ttctgtatcccaaaaacaggctccc

SEQ ID NO: 943574 - DNA, 25 bp, Mus musculus
ttctgtatcccaaagatatggagca

SEQ ID NO: 943575 - DNA, 25 bp, Mus musculus
ttctgtatcccataaacaggctccc

SEQ ID NO: 943576 - DNA, 25 bp, Mus musculus
ttctgtatcccatagatatggagca

SEQ ID NO: 943577 - DNA, 25 bp, Mus musculus
ttctgtatccctcgtttcctataac

SEQ ID NO: 943578 - DNA, 25 bp, Mus musculus
ttctgtatccctggtttcctataac

SEQ ID NO: 943579 - DNA, 25 bp, Mus musculus
ttctgtatcttgatctttgtatggg

SEQ ID NO: 943580 - DNA, 25 bp, Mus musculus
ttctgtatcttgttctttgtatggg

SEQ ID NO: 943581 - DNA, 25 bp, Mus musculus
ttctgtatctttctggcgtggtcct

SEQ ID NO: 943582 - DNA, 25 bp, Mus musculus
ttctgtatctttgtggcgtggtcct

SEQ ID NO: 943583 - DNA, 25 bp, Mus musculus
ttctgtatgcacctcagagagcctt

SEQ ID NO: 943584 - DNA, 25 bp, Mus musculus
ttctgtatgcacgtcagagagcctt

SEQ ID NO: 943585 - DNA, 25 bp, Mus musculus
ttctgtatgcatcttggtggactta

SEQ ID NO: 943586 - DNA, 25 bp, Mus musculus
ttctgtatgcatgttggtggactta

SEQ ID NO: 943587 - DNA, 25 bp, Mus musculus
ttctgtatgctcatttctattttcc

SEQ ID NO: 943588 - DNA, 25 bp, Mus musculus
ttctgtatgctcttttctattttcc

SEQ ID NO: 943589 - DNA, 25 bp, Mus musculus
ttctgtattaatattaggactgcaa

SEQ ID NO: 943590 - DNA, 25 bp, Mus musculus
ttctgtattaattttaggactgcaa

SEQ ID NO: 943591 - DNA, 25 bp, Mus musculus
ttctgtattctcatagcgcatgacc

SEQ ID NO: 943592 - DNA, 25 bp, Mus musculus
ttctgtattctcttagcgcatgacc

SEQ ID NO: 943593 - DNA, 25 bp, Mus musculus
ttctgtattctgatgctgtatgccc

SEQ ID NO: 943594 - DNA, 25 bp, Mus musculus
ttctgtattctgttgctgtatgccc

SEQ ID NO: 943595 - DNA, 25 bp, Mus musculus
ttctgtatttagcacaaagtcctaa

SEQ ID NO: 943596 - DNA, 25 bp, Mus musculus
ttctgtatttaggacaaagtcctaa

SEQ ID NO: 943597 - DNA, 25 bp, Mus musculus
ttctgtcaaagacctggccggctgg

SEQ ID NO: 943598 - DNA, 25 bp, Mus musculus
ttctgtcaaagagctggccggctgg

SEQ ID NO: 943599 - DNA, 25 bp, Mus musculus
ttctgtcaagggaactttaggttga

SEQ ID NO: 943600 - DNA, 25 bp, Mus musculus
ttctgtcaagggtactttaggttga

SEQ ID NO: 943601 - DNA, 25 bp, Mus musculus
ttctgtcaatatctcatctttccct

SEQ ID NO: 943602 - DNA, 25 bp, Mus musculus
ttctgtcaatatgtcatctttccct

SEQ ID NO: 943603 - DNA, 25 bp, Mus musculus
ttctgtcacagcagcctacagatga

SEQ ID NO: 943604 - DNA, 25 bp, Mus musculus
ttctgtcacagctgcctacagatga

SEQ ID NO: 943605 - DNA, 25 bp, Mus musculus
ttctgtcacattacctagagggctg

SEQ ID NO: 943606 - DNA, 25 bp, Mus musculus
ttctgtcacatttcctagagggctg

SEQ ID NO: 943607 - DNA, 25 bp, Mus musculus
ttctgtcaccaacagcttgtctctg

SEQ ID NO: 943608 - DNA, 25 bp, Mus musculus
ttctgtcaccaactttgtacctgag

SEQ ID NO: 943609 - DNA, 25 bp, Mus musculus
ttctgtcaccaagagcttgtctctg

SEQ ID NO: 943610 - DNA, 25 bp, Mus musculus
ttctgtcaccaagtttgtacctgag

SEQ ID NO: 943611 - DNA, 25 bp, Mus musculus
ttctgtcactcaccagctaggcctg

SEQ ID NO: 943612 - DNA, 25 bp, Mus musculus
ttctgtcactcagcagctaggcctg

SEQ ID NO: 943613 - DNA, 25 bp, Mus musculus
ttctgtcacttaccatgtgcataat

SEQ ID NO: 943614 - DNA, 25 bp, Mus musculus
ttctgtcacttagcatgtgcataat

SEQ ID NO: 943615 - DNA, 25 bp, Mus musculus
ttctgtcagagaaccctgtgcctca

SEQ ID NO: 943616 - DNA, 25 bp, Mus musculus
ttctgtcagagatccctgtgcctca

SEQ ID NO: 943617 - DNA, 25 bp, Mus musculus
ttctgtcagcacatcgtatgtacca

SEQ ID NO: 943618 - DNA, 25 bp, Mus musculus
ttctgtcagcacttcgtatgtacca

SEQ ID NO: 943619 - DNA, 25 bp, Mus musculus
ttctgtcaggtgaattcaactctct

SEQ ID NO: 943620 - DNA, 25 bp, Mus musculus
ttctgtcaggtgtattcaactctct

SEQ ID NO: 943621 - DNA, 25 bp, Mus musculus
ttctgtcataacagtgctgtcccca

SEQ ID NO: 943622 - DNA, 25 bp, Mus musculus
ttctgtcataactgtgctgtcccca

SEQ ID NO: 943623 - DNA, 25 bp, Mus musculus
ttctgtcatgtccttagtgatttag

SEQ ID NO: 943624 - DNA, 25 bp, Mus musculus
ttctgtcatgtcgttagtgatttag

SEQ ID NO: 943625 - DNA, 25 bp, Mus musculus
ttctgtcattctacacctttctgag

SEQ ID NO: 943626 - DNA, 25 bp, Mus musculus
ttctgtcattcttcacctttctgag

SEQ ID NO: 943627 - DNA, 25 bp, Mus musculus
ttctgtccaaagaaggctcaagccc

SEQ ID NO: 943628 - DNA, 25 bp, Mus musculus
ttctgtccaaagtaggctcaagccc

SEQ ID NO: 943629 - DNA, 25 bp, Mus musculus
ttctgtccaagtatacgatcctgtg

SEQ ID NO: 943630 - DNA, 25 bp, Mus musculus
ttctgtccaagtttacgatcctgtg

SEQ ID NO: 943631 - DNA, 25 bp, Mus musculus
ttctgtccaccacaggcactatgga

SEQ ID NO: 943632 - DNA, 25 bp, Mus musculus
ttctgtccaccagaggcactatgga

SEQ ID NO: 943633 - DNA, 25 bp, Mus musculus
ttctgtccacctatgggttccagga

SEQ ID NO: 943634 - DNA, 25 bp, Mus musculus
ttctgtccacctttgggttccagga

SEQ ID NO: 943635 - DNA, 25 bp, Mus musculus
ttctgtccagatagtagttttcggt

SEQ ID NO: 943636 - DNA, 25 bp, Mus musculus
ttctgtccagattgtagttttcggt

SEQ ID NO: 943637 - DNA, 25 bp, Mus musculus
ttctgtccagcaaacagcacagcca

SEQ ID NO: 943638 - DNA, 25 bp, Mus musculus
ttctgtccagcatacagcacagcca

SEQ ID NO: 943639 - DNA, 25 bp, Mus musculus
ttctgtccatgaatcgccaggagca

SEQ ID NO: 943640 - DNA, 25 bp, Mus musculus
ttctgtccatgattcgccaggagca

SEQ ID NO: 943641 - DNA, 25 bp, Mus musculus
ttctgtccccatattctgcatacaa

SEQ ID NO: 943642 - DNA, 25 bp, Mus musculus
ttctgtccccattttctgcatacaa

SEQ ID NO: 943643 - DNA, 25 bp, Mus musculus
ttctgtcccccaaataagacactca

SEQ ID NO: 943644 - DNA, 25 bp, Mus musculus
ttctgtcccccatataagacactca

SEQ ID NO: 943645 - DNA, 25 bp, Mus musculus
ttctgtccctctactttatcttaaa

SEQ ID NO: 943646 - DNA, 25 bp, Mus musculus
ttctgtccctctccaaggaaggcag

SEQ ID NO: 943647 - DNA, 25 bp, Mus musculus
ttctgtccctctgcaaggaaggcag

SEQ ID NO: 943648 - DNA, 25 bp, Mus musculus
ttctgtccctcttctttatcttaaa

SEQ ID NO: 943649 - DNA, 25 bp, Mus musculus
ttctgtcccttcaaaaatatctttg

SEQ ID NO: 943650 - DNA, 25 bp, Mus musculus
ttctgtcccttctaaaatatctttg

SEQ ID NO: 943651 - DNA, 25 bp, Mus musculus
ttctgtccgactaggcacatctaaa

SEQ ID NO: 943652 - DNA, 25 bp, Mus musculus
ttctgtccgacttggcacatctaaa

SEQ ID NO: 943653 - DNA, 25 bp, Mus musculus
ttctgtcctctacacctggtgcaca

SEQ ID NO: 943654 - DNA, 25 bp, Mus musculus
ttctgtcctctagacctggtgcaca

SEQ ID NO: 943655 - DNA, 25 bp, Mus musculus
ttctgtcctgatattagtatttctt

SEQ ID NO: 943656 - DNA, 25 bp, Mus musculus
ttctgtcctgattttagtatttctt

SEQ ID NO: 943657 - DNA, 25 bp, Mus musculus
ttctgtcctgcactcatacatgcta

SEQ ID NO: 943658 - DNA, 25 bp, Mus musculus
ttctgtcctgcagtcatacatgcta

SEQ ID NO: 943659 - DNA, 25 bp, Mus musculus
ttctgtcctgctatgtgggtttcag

SEQ ID NO: 943660 - DNA, 25 bp, Mus musculus
ttctgtcctgctttgtgggtttcag

SEQ ID NO: 943661 - DNA, 25 bp, Mus musculus
ttctgtccttccagcacagaaggta

SEQ ID NO: 943662 - DNA, 25 bp, Mus musculus
ttctgtccttcctgcacagaaggta

SEQ ID NO: 943663 - DNA, 25 bp, Mus musculus
ttctgtcgggctcttaaaaggctca

SEQ ID NO: 943664 - DNA, 25 bp, Mus musculus
ttctgtcgggctgttaaaaggctca

SEQ ID NO: 943665 - DNA, 25 bp, Mus musculus
ttctgtcggtttataatctgccaaa

SEQ ID NO: 943666 - DNA, 25 bp, Mus musculus
ttctgtcggtttttaatctgccaaa

SEQ ID NO: 943667 - DNA, 25 bp, Mus musculus
ttctgtcgtagcattcttctagggc

SEQ ID NO: 943668 - DNA, 25 bp, Mus musculus
ttctgtcgtagctttcttctagggc

SEQ ID NO: 943669 - DNA, 25 bp, Mus musculus
ttctgtcgtccaaaccactatttta

SEQ ID NO: 943670 - DNA, 25 bp, Mus musculus
ttctgtcgtccataccactatttta

SEQ ID NO: 943671 - DNA, 25 bp, Mus musculus
ttctgtcgtgataactggccggtca

SEQ ID NO: 943672 - DNA, 25 bp, Mus musculus
ttctgtcgtgattactggccggtca

SEQ ID NO: 943673 - DNA, 25 bp, Mus musculus
ttctgtctaaggatgtgcataaggc

SEQ ID NO: 943674 - DNA, 25 bp, Mus musculus
ttctgtctaaggttgtgcataaggc

SEQ ID NO: 943675 - DNA, 25 bp, Mus musculus
ttctgtctacttcatacctgtctga

SEQ ID NO: 943676 - DNA, 25 bp, Mus musculus
ttctgtctacttgatacctgtctga

SEQ ID NO: 943677 - DNA, 25 bp, Mus musculus
ttctgtctagacctggtttcttgga

SEQ ID NO: 943678 - DNA, 25 bp, Mus musculus
ttctgtctagacgtggtttcttgga

SEQ ID NO: 943679 - DNA, 25 bp, Mus musculus
ttctgtctagccaccagtggaaagt

SEQ ID NO: 943680 - DNA, 25 bp, Mus musculus
ttctgtctagcctccagtggaaagt

SEQ ID NO: 943681 - DNA, 25 bp, Mus musculus
ttctgtctagggattatcgtggctc

SEQ ID NO: 943682 - DNA, 25 bp, Mus musculus
ttctgtctagggtttatcgtggctc

SEQ ID NO: 943683 - DNA, 25 bp, Mus musculus
ttctgtctcaacatctagagcggtt

SEQ ID NO: 943684 - DNA, 25 bp, Mus musculus
ttctgtctcaacttctagagcggtt

SEQ ID NO: 943685 - DNA, 25 bp, Mus musculus
ttctgtctcatcagctgtactcgga

SEQ ID NO: 943686 - DNA, 25 bp, Mus musculus
ttctgtctcatctgctgtactcgga

SEQ ID NO: 943687 - DNA, 25 bp, Mus musculus
ttctgtctccatagtaaacaatcag

SEQ ID NO: 943688 - DNA, 25 bp, Mus musculus
ttctgtctccattgtaaacaatcag

SEQ ID NO: 943689 - DNA, 25 bp, Mus musculus
ttctgtctcccaaggctctaattga

SEQ ID NO: 943690 - DNA, 25 bp, Mus musculus
ttctgtctcccatggctctaattga

SEQ ID NO: 943691 - DNA, 25 bp, Mus musculus
ttctgtctccgaattccttcataga

SEQ ID NO: 943692 - DNA, 25 bp, Mus musculus
ttctgtctccgatttccttcataga

SEQ ID NO: 943693 - DNA, 25 bp, Mus musculus
ttctgtctcgtgacctgatcatgaa

SEQ ID NO: 943694 - DNA, 25 bp, Mus musculus
ttctgtctcgtgtcctgatcatgaa

SEQ ID NO: 943695 - DNA, 25 bp, Mus musculus
ttctgtctctaccttgtccaaaata

SEQ ID NO: 943696 - DNA, 25 bp, Mus musculus
ttctgtctctacgttgtccaaaata

SEQ ID NO: 943697 - DNA, 25 bp, Mus musculus
ttctgtctctcaaaaaggtaatggt

SEQ ID NO: 943698 - DNA, 25 bp, Mus musculus
ttctgtctctcataaaggtaatggt

SEQ ID NO: 943699 - DNA, 25 bp, Mus musculus
ttctgtctctgactgtctgacatgt

SEQ ID NO: 943700 - DNA, 25 bp, Mus musculus
ttctgtctctgagtgtctgacatgt

SEQ ID NO: 943701 - DNA, 25 bp, Mus musculus
ttctgtctctttcatcagtgactat

SEQ ID NO: 943702 - DNA, 25 bp, Mus musculus
ttctgtctctttcctaaacttccca

SEQ ID NO: 943703 - DNA, 25 bp, Mus musculus
ttctgtctctttgatcagtgactat

SEQ ID NO: 943704 - DNA, 25 bp, Mus musculus
ttctgtctctttgctaaacttccca

SEQ ID NO: 943705 - DNA, 25 bp, Mus musculus
ttctgtctgaagagtgttggttctg

SEQ ID NO: 943706 - DNA, 25 bp, Mus musculus
ttctgtctgaagtgtgttggttctg

SEQ ID NO: 943707 - DNA, 25 bp, Mus musculus
ttctgtctgagtctccacgagggtg

SEQ ID NO: 943708 - DNA, 25 bp, Mus musculus
ttctgtctgagtgtccacgagggtg

SEQ ID NO: 943709 - DNA, 25 bp, Mus musculus
ttctgtctgcaaccatcctctatga

SEQ ID NO: 943710 - DNA, 25 bp, Mus musculus
ttctgtctgcaagcatcctctatga

SEQ ID NO: 943711 - DNA, 25 bp, Mus musculus
ttctgtctgcagagttcctcacact

SEQ ID NO: 943712 - DNA, 25 bp, Mus musculus
ttctgtctgcagtgttcctcacact

SEQ ID NO: 943713 - DNA, 25 bp, Mus musculus
ttctgtctgctgaattcatttctct

SEQ ID NO: 943714 - DNA, 25 bp, Mus musculus
ttctgtctgctgtattcatttctct

SEQ ID NO: 943715 - DNA, 25 bp, Mus musculus
ttctgtctggagaggtctttccgaa

SEQ ID NO: 943716 - DNA, 25 bp, Mus musculus
ttctgtctggagtggtctttccgaa

SEQ ID NO: 943717 - DNA, 25 bp, Mus musculus
ttctgtctgtagcatgcgaacacaa

SEQ ID NO: 943718 - DNA, 25 bp, Mus musculus
ttctgtctgtaggatgcgaacacaa

SEQ ID NO: 943719 - DNA, 25 bp, Mus musculus
ttctgtctgtcacctgtgtactggc

SEQ ID NO: 943720 - DNA, 25 bp, Mus musculus
ttctgtctgtcagctgtgtactggc

SEQ ID NO: 943721 - DNA, 25 bp, Mus musculus
ttctgtctgtggctaaagccgaagg

SEQ ID NO: 943722 - DNA, 25 bp, Mus musculus
ttctgtctgtgggtaaagccgaagg

SEQ ID NO: 943723 - DNA, 25 bp, Mus musculus
ttctgtcttaatcgtatcctactga

SEQ ID NO: 943724 - DNA, 25 bp, Mus musculus
ttctgtcttaatggtatcctactga

SEQ ID NO: 943725 - DNA, 25 bp, Mus musculus
ttctgtcttagccttgcacagggaa

SEQ ID NO: 943726 - DNA, 25 bp, Mus musculus
ttctgtcttagcgttgcacagggaa

SEQ ID NO: 943727 - DNA, 25 bp, Mus musculus
ttctgtcttccgaggagtgctaaga

SEQ ID NO: 943728 - DNA, 25 bp, Mus musculus
ttctgtcttccgtggagtgctaaga

SEQ ID NO: 943729 - DNA, 25 bp, Mus musculus
ttctgtcttctaatcttgtaatcaa

SEQ ID NO: 943730 - DNA, 25 bp, Mus musculus
ttctgtcttctattcttgtaatcaa

SEQ ID NO: 943731 - DNA, 25 bp, Mus musculus
ttctgtcttctgctctggaattgca

SEQ ID NO: 943732 - DNA, 25 bp, Mus musculus
ttctgtcttctggtctggaattgca

SEQ ID NO: 943733 - DNA, 25 bp, Mus musculus
ttctgtcttgacagtttcctgcgac

SEQ ID NO: 943734 - DNA, 25 bp, Mus musculus
ttctgtcttgactgtttcctgcgac

SEQ ID NO: 943735 - DNA, 25 bp, Mus musculus
ttctgtcttgcactgtgggtggcac

SEQ ID NO: 943736 - DNA, 25 bp, Mus musculus
ttctgtcttgcagtgtgggtggcac

SEQ ID NO: 943737 - DNA, 25 bp, Mus musculus
ttctgtcttgctcagaggcagttct

SEQ ID NO: 943738 - DNA, 25 bp, Mus musculus
ttctgtcttgctgagaggcagttct

SEQ ID NO: 943739 - DNA, 25 bp, Mus musculus
ttctgtcttgtcagattgttgctcc

SEQ ID NO: 943740 - DNA, 25 bp, Mus musculus
ttctgtcttgtctgattgttgctcc

SEQ ID NO: 943741 - DNA, 25 bp, Mus musculus
ttctgtctttctaccaacctgagaa

SEQ ID NO: 943742 - DNA, 25 bp, Mus musculus
ttctgtctttctcctgtgcatatta

SEQ ID NO: 943743 - DNA, 25 bp, Mus musculus
ttctgtctttctctgtgcaatgcag

SEQ ID NO: 943744 - DNA, 25 bp, Mus musculus
ttctgtctttctgctgtgcatatta

SEQ ID NO: 943745 - DNA, 25 bp, Mus musculus
ttctgtctttctgtgtgcaatgcag

SEQ ID NO: 943746 - DNA, 25 bp, Mus musculus
ttctgtctttcttccaacctgagaa

SEQ ID NO: 943747 - DNA, 25 bp, Mus musculus
ttctgtctttggagccccgatttta

SEQ ID NO: 943748 - DNA, 25 bp, Mus musculus
ttctgtctttggcttgtttctctat

SEQ ID NO: 943749 - DNA, 25 bp, Mus musculus
ttctgtctttgggttgtttctctat

SEQ ID NO: 943750 - DNA, 25 bp, Mus musculus
ttctgtctttggtgccccgatttta

SEQ ID NO: 943751 - DNA, 25 bp, Mus musculus
ttctgtgaaaatacttgagacccaa

SEQ ID NO: 943752 - DNA, 25 bp, Mus musculus
ttctgtgaaaattcttgagacccaa

SEQ ID NO: 943753 - DNA, 25 bp, Mus musculus
ttctgtgaaatacgagacttataac

SEQ ID NO: 943754 - DNA, 25 bp, Mus musculus
ttctgtgaaataggagacttataac

SEQ ID NO: 943755 - DNA, 25 bp, Mus musculus
ttctgtgaacacctgctttacgatt

SEQ ID NO: 943756 - DNA, 25 bp, Mus musculus
ttctgtgaacacgtgctttacgatt

SEQ ID NO: 943757 - DNA, 25 bp, Mus musculus
ttctgtgaaccaaggtctaccttgc

SEQ ID NO: 943758 - DNA, 25 bp, Mus musculus
ttctgtgaaccatggtctaccttgc

SEQ ID NO: 943759 - DNA, 25 bp, Mus musculus
ttctgtgaagaacccctgttctcgt

SEQ ID NO: 943760 - DNA, 25 bp, Mus musculus
ttctgtgaagaagccctgttctcgt

SEQ ID NO: 943761 - DNA, 25 bp, Mus musculus
ttctgtgaagctcacaacgttaggt

SEQ ID NO: 943762 - DNA, 25 bp, Mus musculus
ttctgtgaagctgacaacgttaggt

SEQ ID NO: 943763 - DNA, 25 bp, Mus musculus
ttctgtgaaggccaaagtaagacaa

SEQ ID NO: 943764 - DNA, 25 bp, Mus musculus
ttctgtgaaggcgaaagtaagacaa

SEQ ID NO: 943765 - DNA, 25 bp, Mus musculus
ttctgtgaattcatcccggaagcat

SEQ ID NO: 943766 - DNA, 25 bp, Mus musculus
ttctgtgaattcttcccggaagcat

SEQ ID NO: 943767 - DNA, 25 bp, Mus musculus
ttctgtgacaacagggagtttcctt

SEQ ID NO: 943768 - DNA, 25 bp, Mus musculus
ttctgtgacaactgggagtttcctt

SEQ ID NO: 943769 - DNA, 25 bp, Mus musculus
ttctgtgacagcagttcatccaaga

SEQ ID NO: 943770 - DNA, 25 bp, Mus musculus
ttctgtgacagcctgtcccttaaag

SEQ ID NO: 943771 - DNA, 25 bp, Mus musculus
ttctgtgacagcgtgtcccttaaag

SEQ ID NO: 943772 - DNA, 25 bp, Mus musculus
ttctgtgacagctgttcatccaaga

SEQ ID NO: 943773 - DNA, 25 bp, Mus musculus
ttctgtgacattaccgcgttatttc

SEQ ID NO: 943774 - DNA, 25 bp, Mus musculus
ttctgtgacatttccgcgttatttc

SEQ ID NO: 943775 - DNA, 25 bp, Mus musculus
ttctgtgaccctcgtgtgactaagc

SEQ ID NO: 943776 - DNA, 25 bp, Mus musculus
ttctgtgaccctggtgtgactaagc

SEQ ID NO: 943777 - DNA, 25 bp, Mus musculus
ttctgtgaccgtcccacttttcatt

SEQ ID NO: 943778 - DNA, 25 bp, Mus musculus
ttctgtgaccgtctgggcagcataa

SEQ ID NO: 943779 - DNA, 25 bp, Mus musculus
ttctgtgaccgtgccacttttcatt

SEQ ID NO: 943780 - DNA, 25 bp, Mus musculus
ttctgtgaccgtgtgggcagcataa

SEQ ID NO: 943781 - DNA, 25 bp, Mus musculus
ttctgtgacctcaggatgcctggtg

SEQ ID NO: 943782 - DNA, 25 bp, Mus musculus
ttctgtgacctctggatgcctggtg

SEQ ID NO: 943783 - DNA, 25 bp, Mus musculus
ttctgtgactgcctagtagacccaa

SEQ ID NO: 943784 - DNA, 25 bp, Mus musculus
ttctgtgactgcgtagtagacccaa

SEQ ID NO: 943785 - DNA, 25 bp, Mus musculus
ttctgtgacttcattgagagaaaat

SEQ ID NO: 943786 - DNA, 25 bp, Mus musculus
ttctgtgacttctttgagagaaaat

SEQ ID NO: 943787 - DNA, 25 bp, Mus musculus
ttctgtgagacaatagtttgaggca

SEQ ID NO: 943788 - DNA, 25 bp, Mus musculus
ttctgtgagacattagtttgaggca

SEQ ID NO: 943789 - DNA, 25 bp, Mus musculus
ttctgtgagcctcaggatccgtcat

SEQ ID NO: 943790 - DNA, 25 bp, Mus musculus
ttctgtgagcctgaggatccgtcat

SEQ ID NO: 943791 - DNA, 25 bp, Mus musculus
ttctgtgagcgtccgtttgtgtctg

SEQ ID NO: 943792 - DNA, 25 bp, Mus musculus
ttctgtgagcgtgcgtttgtgtctg

SEQ ID NO: 943793 - DNA, 25 bp, Mus musculus
ttctgtgagcttccacttagttcca

SEQ ID NO: 943794 - DNA, 25 bp, Mus musculus
ttctgtgagcttgcacttagttcca

SEQ ID NO: 943795 - DNA, 25 bp, Mus musculus
ttctgtgatcacacgcagagacgcg

SEQ ID NO: 943796 - DNA, 25 bp, Mus musculus
ttctgtgatcactcgcagagacgcg

SEQ ID NO: 943797 - DNA, 25 bp, Mus musculus
ttctgtgatccacgcgattccaaca

SEQ ID NO: 943798 - DNA, 25 bp, Mus musculus
ttctgtgatccaggcgattccaaca

SEQ ID NO: 943799 - DNA, 25 bp, Mus musculus
ttctgtgatctgcttccatcatgtc

SEQ ID NO: 943800 - DNA, 25 bp, Mus musculus
ttctgtgatctggttccatcatgtc

SEQ ID NO: 943801 - DNA, 25 bp, Mus musculus
ttctgtgattgcagtagtttctttc

SEQ ID NO: 943802 - DNA, 25 bp, Mus musculus
ttctgtgattgctgtagtttctttc

SEQ ID NO: 943803 - DNA, 25 bp, Mus musculus
ttctgtgattttcagctttataaac

SEQ ID NO: 943804 - DNA, 25 bp, Mus musculus
ttctgtgattttgagctttataaac

SEQ ID NO: 943805 - DNA, 25 bp, Mus musculus
ttctgtgcaagaatgtctacgccca

SEQ ID NO: 943806 - DNA, 25 bp, Mus musculus
ttctgtgcaagattgtctacgccca

SEQ ID NO: 943807 - DNA, 25 bp, Mus musculus
ttctgtgccacacgttgaaaaccat

SEQ ID NO: 943808 - DNA, 25 bp, Mus musculus
ttctgtgccacaggttgaaaaccat

SEQ ID NO: 943809 - DNA, 25 bp, Mus musculus
ttctgtgcccggcacaggtcggaac

SEQ ID NO: 943810 - DNA, 25 bp, Mus musculus
ttctgtgcccgggacaggtcggaac

SEQ ID NO: 943811 - DNA, 25 bp, Mus musculus
ttctgtgccctccttgttgtggcga

SEQ ID NO: 943812 - DNA, 25 bp, Mus musculus
ttctgtgccctcgttgttgtggcga

SEQ ID NO: 943813 - DNA, 25 bp, Mus musculus
ttctgtgcctctaagctggtcaggt

SEQ ID NO: 943814 - DNA, 25 bp, Mus musculus
ttctgtgcctcttagctggtcaggt

SEQ ID NO: 943815 - DNA, 25 bp, Mus musculus
ttctgtgccttcatgtgaatttcta

SEQ ID NO: 943816 - DNA, 25 bp, Mus musculus
ttctgtgccttcttgtgaatttcta

SEQ ID NO: 943817 - DNA, 25 bp, Mus musculus
ttctgtgcgaggaccagaacttgcc

SEQ ID NO: 943818 - DNA, 25 bp, Mus musculus
ttctgtgcgaggtccagaacttgcc

SEQ ID NO: 943819 - DNA, 25 bp, Mus musculus
ttctgtgcgcttagctgggtcatag

SEQ ID NO: 943820 - DNA, 25 bp, Mus musculus
ttctgtgcgctttgctgggtcatag

SEQ ID NO: 943821 - DNA, 25 bp, Mus musculus
ttctgtgcggacaacaatgtggaca

SEQ ID NO: 943822 - DNA, 25 bp, Mus musculus
ttctgtgcggactacaatgtggaca

SEQ ID NO: 943823 - DNA, 25 bp, Mus musculus
ttctgtgcgtctctaattcctgtca

SEQ ID NO: 943824 - DNA, 25 bp, Mus musculus
ttctgtgcgtctgtaattcctgtca

SEQ ID NO: 943825 - DNA, 25 bp, Mus musculus
ttctgtgctaatcctggtacattgt

SEQ ID NO: 943826 - DNA, 25 bp, Mus musculus
ttctgtgctaatgctggtacattgt

SEQ ID NO: 943827 - DNA, 25 bp, Mus musculus
ttctgtgctagaagtttttcggtca

SEQ ID NO: 943828 - DNA, 25 bp, Mus musculus
ttctgtgctagatgtttttcggtca

SEQ ID NO: 943829 - DNA, 25 bp, Mus musculus
ttctgtgctatcattggttgttcat

SEQ ID NO: 943830 - DNA, 25 bp, Mus musculus
ttctgtgctatctttggttgttcat

SEQ ID NO: 943831 - DNA, 25 bp, Mus musculus
ttctgtgctctgatagactgtgctt

SEQ ID NO: 943832 - DNA, 25 bp, Mus musculus
ttctgtgctctgttagactgtgctt

SEQ ID NO: 943833 - DNA, 25 bp, Mus musculus
ttctgtgctggaacccttagagaca

SEQ ID NO: 943834 - DNA, 25 bp, Mus musculus
ttctgtgctggatcccttagagaca

SEQ ID NO: 943835 - DNA, 25 bp, Mus musculus
ttctgtgcttccaagggagttctga

SEQ ID NO: 943836 - DNA, 25 bp, Mus musculus
ttctgtgcttccaagtcgctgttgg

SEQ ID NO: 943837 - DNA, 25 bp, Mus musculus
ttctgtgcttcctagggagttctga

SEQ ID NO: 943838 - DNA, 25 bp, Mus musculus
ttctgtgcttcctagtcgctgttgg

SEQ ID NO: 943839 - DNA, 25 bp, Mus musculus
ttctgtgcttttcgtccttttgaaa

SEQ ID NO: 943840 - DNA, 25 bp, Mus musculus
ttctgtgcttttggtccttttgaaa

SEQ ID NO: 943841 - DNA, 25 bp, Mus musculus
ttctgtggacatcccctacgaacac

SEQ ID NO: 943842 - DNA, 25 bp, Mus musculus
ttctgtggacatgccctacgaacac

SEQ ID NO: 943843 - DNA, 25 bp, Mus musculus
ttctgtggactacccaaagagtggt

SEQ ID NO: 943844 - DNA, 25 bp, Mus musculus
ttctgtggactagccaaagagtggt

SEQ ID NO: 943845 - DNA, 25 bp, Mus musculus
ttctgtggagatcgtgccttccctc

SEQ ID NO: 943846 - DNA, 25 bp, Mus musculus
ttctgtggagatggtgccttccctc

SEQ ID NO: 943847 - DNA, 25 bp, Mus musculus
ttctgtggattcatgtgggagcgat

SEQ ID NO: 943848 - DNA, 25 bp, Mus musculus
ttctgtggattcttgtgggagcgat

SEQ ID NO: 943849 - DNA, 25 bp, Mus musculus
ttctgtggattgaactctggttacc

SEQ ID NO: 943850 - DNA, 25 bp, Mus musculus
ttctgtggattgtactctggttacc

SEQ ID NO: 943851 - DNA, 25 bp, Mus musculus
ttctgtggcactaaggactgctcta

SEQ ID NO: 943852 - DNA, 25 bp, Mus musculus
ttctgtggcactatgacagtaaccg

SEQ ID NO: 943853 - DNA, 25 bp, Mus musculus
ttctgtggcacttaggactgctcta

SEQ ID NO: 943854 - DNA, 25 bp, Mus musculus
ttctgtggcactttgacagtaaccg

SEQ ID NO: 943855 - DNA, 25 bp, Mus musculus
ttctgtggcagaaaagctctcattt

SEQ ID NO: 943856 - DNA, 25 bp, Mus musculus
ttctgtggcagataagctctcattt

SEQ ID NO: 943857 - DNA, 25 bp, Mus musculus
ttctgtggcagcctcccgcagcagg

SEQ ID NO: 943858 - DNA, 25 bp, Mus musculus
ttctgtggcagcctgaagcaagcct

SEQ ID NO: 943859 - DNA, 25 bp, Mus musculus
ttctgtggcagcgtcccgcagcagg

SEQ ID NO: 943860 - DNA, 25 bp, Mus musculus
ttctgtggcagcgtgaagcaagcct

SEQ ID NO: 943861 - DNA, 25 bp, Mus musculus
ttctgtggccacaaaaacatctgct

SEQ ID NO: 943862 - DNA, 25 bp, Mus musculus
ttctgtggccactaaaacatctgct

SEQ ID NO: 943863 - DNA, 25 bp, Mus musculus
ttctgtggccctccaggtctcagag

SEQ ID NO: 943864 - DNA, 25 bp, Mus musculus
ttctgtggccctgcaggtctcagag

SEQ ID NO: 943865 - DNA, 25 bp, Mus musculus
ttctgtggccgcaggaggtagcttc

SEQ ID NO: 943866 - DNA, 25 bp, Mus musculus
ttctgtggccgctggaggtagcttc

SEQ ID NO: 943867 - DNA, 25 bp, Mus musculus
ttctgtggcgaacacgctggctccg

SEQ ID NO: 943868 - DNA, 25 bp, Mus musculus
ttctgtggcgaagacgctggctccg

SEQ ID NO: 943869 - DNA, 25 bp, Mus musculus
ttctgtggctagcactttacccaca

SEQ ID NO: 943870 - DNA, 25 bp, Mus musculus
ttctgtggctaggactttacccaca

SEQ ID NO: 943871 - DNA, 25 bp, Mus musculus
ttctgtggctttccttcagtaagta

SEQ ID NO: 943872 - DNA, 25 bp, Mus musculus
ttctgtggctttgcttcagtaagta

SEQ ID NO: 943873 - DNA, 25 bp, Mus musculus
ttctgtgggaacagtggcagacaga

SEQ ID NO: 943874 - DNA, 25 bp, Mus musculus
ttctgtgggaactgtggcagacaga

SEQ ID NO: 943875 - DNA, 25 bp, Mus musculus
ttctgtgggcgcaagtttgcgcgca

SEQ ID NO: 943876 - DNA, 25 bp, Mus musculus
ttctgtgggcgctagtttgcgcgca

SEQ ID NO: 943877 - DNA, 25 bp, Mus musculus
ttctgtgggcttacggctatttctg

SEQ ID NO: 943878 - DNA, 25 bp, Mus musculus
ttctgtgggctttcggctatttctg

SEQ ID NO: 943879 - DNA, 25 bp, Mus musculus
ttctgtggtcaaaaagcttctactg

SEQ ID NO: 943880 - DNA, 25 bp, Mus musculus
ttctgtggtcaataagcttctactg

SEQ ID NO: 943881 - DNA, 25 bp, Mus musculus
ttctgtggtcatcagcatacgctga

SEQ ID NO: 943882 - DNA, 25 bp, Mus musculus
ttctgtggtcatgagcatacgctga

SEQ ID NO: 943883 - DNA, 25 bp, Mus musculus
ttctgtggtcccatttctaaaagca

SEQ ID NO: 943884 - DNA, 25 bp, Mus musculus
ttctgtggtcccttttctaaaagca

SEQ ID NO: 943885 - DNA, 25 bp, Mus musculus
ttctgtggtgctaaagagtaaacgc

SEQ ID NO: 943886 - DNA, 25 bp, Mus musculus
ttctgtggtgcttaagagtaaacgc

SEQ ID NO: 943887 - DNA, 25 bp, Mus musculus
ttctgtgtaacaattgtctagttaa

SEQ ID NO: 943888 - DNA, 25 bp, Mus musculus
ttctgtgtaacatttgtctagttaa

SEQ ID NO: 943889 - DNA, 25 bp, Mus musculus
ttctgtgtaaccatattatgtgcaa

SEQ ID NO: 943890 - DNA, 25 bp, Mus musculus
ttctgtgtaaccttattatgtgcaa

SEQ ID NO: 943891 - DNA, 25 bp, Mus musculus
ttctgtgtaattatgcaaggctgta

SEQ ID NO: 943892 - DNA, 25 bp, Mus musculus
ttctgtgtaattttgcaaggctgta

SEQ ID NO: 943893 - DNA, 25 bp, Mus musculus
ttctgtgtacccaggagatagtctt

SEQ ID NO: 943894 - DNA, 25 bp, Mus musculus
ttctgtgtaccctggagatagtctt

SEQ ID NO: 943895 - DNA, 25 bp, Mus musculus
ttctgtgtacgccaccaagaggaga

SEQ ID NO: 943896 - DNA, 25 bp, Mus musculus
ttctgtgtacgcgaccaagaggaga

SEQ ID NO: 943897 - DNA, 25 bp, Mus musculus
ttctgtgtagatcctgtcagggcag

SEQ ID NO: 943898 - DNA, 25 bp, Mus musculus
ttctgtgtagatgctgtcagggcag

SEQ ID NO: 943899 - DNA, 25 bp, Mus musculus
ttctgtgtaggaaccttggagccag

SEQ ID NO: 943900 - DNA, 25 bp, Mus musculus
ttctgtgtaggatccttggagccag

SEQ ID NO: 943901 - DNA, 25 bp, Mus musculus
ttctgtgtagggattctcaaatcca

SEQ ID NO: 943902 - DNA, 25 bp, Mus musculus
ttctgtgtagggtttctcaaatcca

SEQ ID NO: 943903 - DNA, 25 bp, Mus musculus
ttctgtgtatatatcctgacttggg

SEQ ID NO: 943904 - DNA, 25 bp, Mus musculus
ttctgtgtatatttcctgacttggg

SEQ ID NO: 943905 - DNA, 25 bp, Mus musculus
ttctgtgtatctagagactcctgac

SEQ ID NO: 943906 - DNA, 25 bp, Mus musculus
ttctgtgtatctatgaggctgagat

SEQ ID NO: 943907 - DNA, 25 bp, Mus musculus
ttctgtgtatcttgagactcctgac

SEQ ID NO: 943908 - DNA, 25 bp, Mus musculus
ttctgtgtatctttgaggctgagat

SEQ ID NO: 943909 - DNA, 25 bp, Mus musculus
ttctgtgtatggcttctgctgctgc

SEQ ID NO: 943910 - DNA, 25 bp, Mus musculus
ttctgtgtatgggttctgctgctgc

SEQ ID NO: 943911 - DNA, 25 bp, Mus musculus
ttctgtgtatgtcaggatgttatgc

SEQ ID NO: 943912 - DNA, 25 bp, Mus musculus
ttctgtgtatgtgaggatgttatgc

SEQ ID NO: 943913 - DNA, 25 bp, Mus musculus
ttctgtgtcagcaactggaggtgaa

SEQ ID NO: 943914 - DNA, 25 bp, Mus musculus
ttctgtgtcagctactggaggtgaa

SEQ ID NO: 943915 - DNA, 25 bp, Mus musculus
ttctgtgtcattcgtctttctagca

SEQ ID NO: 943916 - DNA, 25 bp, Mus musculus
ttctgtgtcattggtctttctagca

SEQ ID NO: 943917 - DNA, 25 bp, Mus musculus
ttctgtgtccacaagagatgctgta

SEQ ID NO: 943918 - DNA, 25 bp, Mus musculus
ttctgtgtccactagagatgctgta

SEQ ID NO: 943919 - DNA, 25 bp, Mus musculus
ttctgtgtccccagaatctggaaaa

SEQ ID NO: 943920 - DNA, 25 bp, Mus musculus
ttctgtgtcccctgaatctggaaaa

SEQ ID NO: 943921 - DNA, 25 bp, Mus musculus
ttctgtgtccctatatgagcttcca

SEQ ID NO: 943922 - DNA, 25 bp, Mus musculus
ttctgtgtccctttatgagcttcca

SEQ ID NO: 943923 - DNA, 25 bp, Mus musculus
ttctgtgtcctaagggctacacctg

SEQ ID NO: 943924 - DNA, 25 bp, Mus musculus
ttctgtgtcctatgggctacacctg

SEQ ID NO: 943925 - DNA, 25 bp, Mus musculus
ttctgtgtctacaggctgaaatgtt

SEQ ID NO: 943926 - DNA, 25 bp, Mus musculus
ttctgtgtctactggctgaaatgtt

SEQ ID NO: 943927 - DNA, 25 bp, Mus musculus
ttctgtgtctctccatagctcagag

SEQ ID NO: 943928 - DNA, 25 bp, Mus musculus
ttctgtgtctctgcatagctcagag

SEQ ID NO: 943929 - DNA, 25 bp, Mus musculus
ttctgtgtctgcaaatctcttggga

SEQ ID NO: 943930 - DNA, 25 bp, Mus musculus
ttctgtgtctgccaggccaatgcaa

SEQ ID NO: 943931 - DNA, 25 bp, Mus musculus
ttctgtgtctgcgaggccaatgcaa

SEQ ID NO: 943932 - DNA, 25 bp, Mus musculus
ttctgtgtctgctaatctcttggga

SEQ ID NO: 943933 - DNA, 25 bp, Mus musculus
ttctgtgtcttgactttgtaatccc

SEQ ID NO: 943934 - DNA, 25 bp, Mus musculus
ttctgtgtcttgtctttgtaatccc

SEQ ID NO: 943935 - DNA, 25 bp, Mus musculus
ttctgtgtgaatcatggacccttac

SEQ ID NO: 943936 - DNA, 25 bp, Mus musculus
ttctgtgtgaatgatggacccttac

SEQ ID NO: 943937 - DNA, 25 bp, Mus musculus
ttctgtgtgagtaacccctagaggt

SEQ ID NO: 943938 - DNA, 25 bp, Mus musculus
ttctgtgtgagttacccctagaggt

SEQ ID NO: 943939 - DNA, 25 bp, Mus musculus
ttctgtgtgattaggccaacgtttg

SEQ ID NO: 943940 - DNA, 25 bp, Mus musculus
ttctgtgtgatttggccaacgtttg

SEQ ID NO: 943941 - DNA, 25 bp, Mus musculus
ttctgtgtgccaatctgggagttgc

SEQ ID NO: 943942 - DNA, 25 bp, Mus musculus
ttctgtgtgccattctgggagttgc

SEQ ID NO: 943943 - DNA, 25 bp, Mus musculus
ttctgtgtgcgtctttcctttgcat

SEQ ID NO: 943944 - DNA, 25 bp, Mus musculus
ttctgtgtgcgtgtttcctttgcat

SEQ ID NO: 943945 - DNA, 25 bp, Mus musculus
ttctgtgtgggtagcgtctggatct

SEQ ID NO: 943946 - DNA, 25 bp, Mus musculus
ttctgtgtgggttgcgtctggatct

SEQ ID NO: 943947 - DNA, 25 bp, Mus musculus
ttctgtgtgtccatctatatcttta

SEQ ID NO: 943948 - DNA, 25 bp, Mus musculus
ttctgtgtgtccttctatatcttta

SEQ ID NO: 943949 - DNA, 25 bp, Mus musculus
ttctgtgtgtgaagtcatgcagcca

SEQ ID NO: 943950 - DNA, 25 bp, Mus musculus
ttctgtgtgtgatgtcatgcagcca

SEQ ID NO: 943951 - DNA, 25 bp, Mus musculus
ttctgtgtgtttactgttttatgca

SEQ ID NO: 943952 - DNA, 25 bp, Mus musculus
ttctgtgtgttttctgttttatgca

SEQ ID NO: 943953 - DNA, 25 bp, Mus musculus
ttctgtgttaagacaagcatggcct

SEQ ID NO: 943954 - DNA, 25 bp, Mus musculus
ttctgtgttaagtcaagcatggcct

SEQ ID NO: 943955 - DNA, 25 bp, Mus musculus
ttctgtgttcagatccctttgacgt

SEQ ID NO: 943956 - DNA, 25 bp, Mus musculus
ttctgtgttcagttccctttgacgt

SEQ ID NO: 943957 - DNA, 25 bp, Mus musculus
ttctgtgttccaaatttgctgcgca

SEQ ID NO: 943958 - DNA, 25 bp, Mus musculus
ttctgtgttccatatttgctgcgca

SEQ ID NO: 943959 - DNA, 25 bp, Mus musculus
ttctgtgttcccaggagatgacagc

SEQ ID NO: 943960 - DNA, 25 bp, Mus musculus
ttctgtgttcccaggatgcaacact

SEQ ID NO: 943961 - DNA, 25 bp, Mus musculus
ttctgtgttcccatttgaatgactg

SEQ ID NO: 943962 - DNA, 25 bp, Mus musculus
ttctgtgttccctggagatgacagc

SEQ ID NO: 943963 - DNA, 25 bp, Mus musculus
ttctgtgttccctggatgcaacact

SEQ ID NO: 943964 - DNA, 25 bp, Mus musculus
ttctgtgttcccttttgaatgactg

SEQ ID NO: 943965 - DNA, 25 bp, Mus musculus
ttctgtgttctcaccatttgagtat

SEQ ID NO: 943966 - DNA, 25 bp, Mus musculus
ttctgtgttctctccatttgagtat

SEQ ID NO: 943967 - DNA, 25 bp, Mus musculus
ttctgtgttgaccatttgctcctac

SEQ ID NO: 943968 - DNA, 25 bp, Mus musculus
ttctgtgttgacgatttgctcctac

SEQ ID NO: 943969 - DNA, 25 bp, Mus musculus
ttctgtgttgttctaattttgctaa

SEQ ID NO: 943970 - DNA, 25 bp, Mus musculus
ttctgtgttgttgtaattttgctaa

SEQ ID NO: 943971 - DNA, 25 bp, Mus musculus
ttctgtgtttacagggcccggactg

SEQ ID NO: 943972 - DNA, 25 bp, Mus musculus
ttctgtgtttactgggcccggactg

SEQ ID NO: 943973 - DNA, 25 bp, Mus musculus
ttctgtgtttgcattgtgctgcccc

SEQ ID NO: 943974 - DNA, 25 bp, Mus musculus
ttctgtgtttgctttgtgctgcccc

SEQ ID NO: 943975 - DNA, 25 bp, Mus musculus
ttctgtgtttggatatgctgatgac

SEQ ID NO: 943976 - DNA, 25 bp, Mus musculus
ttctgtgtttggttatgctgatgac

SEQ ID NO: 943977 - DNA, 25 bp, Mus musculus
ttctgtgtttgtcctagccatactt

SEQ ID NO: 943978 - DNA, 25 bp, Mus musculus
ttctgtgtttgtgctagccatactt

SEQ ID NO: 943979 - DNA, 25 bp, Mus musculus
ttctgtgttttcatctcaggagtta

SEQ ID NO: 943980 - DNA, 25 bp, Mus musculus
ttctgtgttttccagatcattctca

SEQ ID NO: 943981 - DNA, 25 bp, Mus musculus
ttctgtgttttcgagatcattctca

SEQ ID NO: 943982 - DNA, 25 bp, Mus musculus
ttctgtgttttcttctcaggagtta

SEQ ID NO: 943983 - DNA, 25 bp, Mus musculus
ttctgttaaaagctgttcccgtttg

SEQ ID NO: 943984 - DNA, 25 bp, Mus musculus
ttctgttaaaaggtgttcccgtttg

SEQ ID NO: 943985 - DNA, 25 bp, Mus musculus
ttctgttaagagactgctgatttct

SEQ ID NO: 943986 - DNA, 25 bp, Mus musculus
ttctgttaagagagctttccccact

SEQ ID NO: 943987 - DNA, 25 bp, Mus musculus
ttctgttaagagatggcccagccat

SEQ ID NO: 943988 - DNA, 25 bp, Mus musculus
ttctgttaagagtctgctgatttct

SEQ ID NO: 943989 - DNA, 25 bp, Mus musculus
ttctgttaagagtgctttccccact

SEQ ID NO: 943990 - DNA, 25 bp, Mus musculus
ttctgttaagagttggcccagccat

SEQ ID NO: 943991 - DNA, 25 bp, Mus musculus
ttctgttaagtcaatgccagcccgg

SEQ ID NO: 943992 - DNA, 25 bp, Mus musculus
ttctgttaagtctatgccagcccgg

SEQ ID NO: 943993 - DNA, 25 bp, Mus musculus
ttctgttacaatccttggtcactgc

SEQ ID NO: 943994 - DNA, 25 bp, Mus musculus
ttctgttacaatgcttggtcactgc

SEQ ID NO: 943995 - DNA, 25 bp, Mus musculus
ttctgttacccacgagttgacacca

SEQ ID NO: 943996 - DNA, 25 bp, Mus musculus
ttctgttacccaggagttgacacca

SEQ ID NO: 943997 - DNA, 25 bp, Mus musculus
ttctgttacctcagctgtcatcagc

SEQ ID NO: 943998 - DNA, 25 bp, Mus musculus
ttctgttacctctgctgtcatcagc

SEQ ID NO: 943999 - DNA, 25 bp, Mus musculus
ttctgttactgaaaatcgtaaatcc

SEQ ID NO: 944000 - DNA, 25 bp, Mus musculus
ttctgttactgataatcgtaaatcc

SEQ ID NO: 944001 - DNA, 25 bp, Mus musculus
ttctgttactgccacactgggacca

SEQ ID NO: 944002 - DNA, 25 bp, Mus musculus
ttctgttactgcgacactgggacca

SEQ ID NO: 944003 - DNA, 25 bp, Mus musculus
ttctgttacttcagtaccccaggaa

SEQ ID NO: 944004 - DNA, 25 bp, Mus musculus
ttctgttacttctgtaccccaggaa

SEQ ID NO: 944005 - DNA, 25 bp, Mus musculus
ttctgttagcagcaagggaattaag

SEQ ID NO: 944006 - DNA, 25 bp, Mus musculus
ttctgttagcaggaagggaattaag

SEQ ID NO: 944007 - DNA, 25 bp, Mus musculus
ttctgttaggaaagtcactgaaaca

SEQ ID NO: 944008 - DNA, 25 bp, Mus musculus
ttctgttaggaatgtcactgaaaca

SEQ ID NO: 944009 - DNA, 25 bp, Mus musculus
ttctgttatcctcctaattccatga

SEQ ID NO: 944010 - DNA, 25 bp, Mus musculus
ttctgttatcctgctaattccatga

SEQ ID NO: 944011 - DNA, 25 bp, Mus musculus
ttctgttatggaattgttcctgcat

SEQ ID NO: 944012 - DNA, 25 bp, Mus musculus
ttctgttatggatttgttcctgcat

SEQ ID NO: 944013 - DNA, 25 bp, Mus musculus
ttctgttcaaatcatggtgctctga

SEQ ID NO: 944014 - DNA, 25 bp, Mus musculus
ttctgttcaaatgatggtgctctga

SEQ ID NO: 944015 - DNA, 25 bp, Mus musculus
ttctgttcagaacgcgcatagtatc

SEQ ID NO: 944016 - DNA, 25 bp, Mus musculus
ttctgttcagaaggcgcatagtatc

SEQ ID NO: 944017 - DNA, 25 bp, Mus musculus
ttctgttcatctctgtatcactaat

SEQ ID NO: 944018 - DNA, 25 bp, Mus musculus
ttctgttcatctgtgtatcactaat

SEQ ID NO: 944019 - DNA, 25 bp, Mus musculus
ttctgttcattgaggatgctctgct

SEQ ID NO: 944020 - DNA, 25 bp, Mus musculus
ttctgttcattgtggatgctctgct

SEQ ID NO: 944021 - DNA, 25 bp, Mus musculus
ttctgttccacccaaacaacttcat

SEQ ID NO: 944022 - DNA, 25 bp, Mus musculus
ttctgttccaccgaaacaacttcat

SEQ ID NO: 944023 - DNA, 25 bp, Mus musculus
ttctgttccagaatctctccataat

SEQ ID NO: 944024 - DNA, 25 bp, Mus musculus
ttctgttccagattctctccataat

SEQ ID NO: 944025 - DNA, 25 bp, Mus musculus
ttctgttcccataatgttcatctca

SEQ ID NO: 944026 - DNA, 25 bp, Mus musculus
ttctgttcccattatgttcatctca

SEQ ID NO: 944027 - DNA, 25 bp, Mus musculus
ttctgttcccggaactgtgatgtac

SEQ ID NO: 944028 - DNA, 25 bp, Mus musculus
ttctgttcccggtactgtgatgtac

SEQ ID NO: 944029 - DNA, 25 bp, Mus musculus
ttctgttccctcatctgtacactga

SEQ ID NO: 944030 - DNA, 25 bp, Mus musculus
ttctgttccctcttctgtacactga

SEQ ID NO: 944031 - DNA, 25 bp, Mus musculus
ttctgttccgtgagcggagcactgg

SEQ ID NO: 944032 - DNA, 25 bp, Mus musculus
ttctgttccgtgaggtgacctgtca

SEQ ID NO: 944033 - DNA, 25 bp, Mus musculus
ttctgttccgtgtgcggagcactgg

SEQ ID NO: 944034 - DNA, 25 bp, Mus musculus
ttctgttccgtgtggtgacctgtca

SEQ ID NO: 944035 - DNA, 25 bp, Mus musculus
ttctgttccgttacattttgtacta

SEQ ID NO: 944036 - DNA, 25 bp, Mus musculus
ttctgttccgtttcattttgtacta

SEQ ID NO: 944037 - DNA, 25 bp, Mus musculus
ttctgttcctagctcagacagctgg

SEQ ID NO: 944038 - DNA, 25 bp, Mus musculus
ttctgttcctaggtcagacagctgg

SEQ ID NO: 944039 - DNA, 25 bp, Mus musculus
ttctgttcctccacatatttctgag

SEQ ID NO: 944040 - DNA, 25 bp, Mus musculus
ttctgttcctcctcatatttctgag

SEQ ID NO: 944041 - DNA, 25 bp, Mus musculus
ttctgttccttccattcatgggtgt

SEQ ID NO: 944042 - DNA, 25 bp, Mus musculus
ttctgttccttcgattcatgggtgt

SEQ ID NO: 944043 - DNA, 25 bp, Mus musculus
ttctgttcgtaaaaaccttagcagt

SEQ ID NO: 944044 - DNA, 25 bp, Mus musculus
ttctgttcgtaataaccttagcagt

SEQ ID NO: 944045 - DNA, 25 bp, Mus musculus
ttctgttcgttcaggttctgttctg

SEQ ID NO: 944046 - DNA, 25 bp, Mus musculus
ttctgttcgttctggttctgttctg

SEQ ID NO: 944047 - DNA, 25 bp, Mus musculus
ttctgttctagcaggagggtcccca

SEQ ID NO: 944048 - DNA, 25 bp, Mus musculus
ttctgttctagctggagggtcccca

SEQ ID NO: 944049 - DNA, 25 bp, Mus musculus
ttctgttctatacctgccagccttt

SEQ ID NO: 944050 - DNA, 25 bp, Mus musculus
ttctgttctatagctgccagccttt

SEQ ID NO: 944051 - DNA, 25 bp, Mus musculus
ttctgttctcagaatctctacccat

SEQ ID NO: 944052 - DNA, 25 bp, Mus musculus
ttctgttctcagacgacacaataac

SEQ ID NO: 944053 - DNA, 25 bp, Mus musculus
ttctgttctcagtatctctacccat

SEQ ID NO: 944054 - DNA, 25 bp, Mus musculus
ttctgttctcagtcgacacaataac

SEQ ID NO: 944055 - DNA, 25 bp, Mus musculus
ttctgttctcctcaattgcttggta

SEQ ID NO: 944056 - DNA, 25 bp, Mus musculus
ttctgttctcctctctagcataaga

SEQ ID NO: 944057 - DNA, 25 bp, Mus musculus
ttctgttctcctgaattgcttggta

SEQ ID NO: 944058 - DNA, 25 bp, Mus musculus
ttctgttctcctgtctagcataaga

SEQ ID NO: 944059 - DNA, 25 bp, Mus musculus
ttctgttctctactgtgatcctctg

SEQ ID NO: 944060 - DNA, 25 bp, Mus musculus
ttctgttctctagtgtgatcctctg

SEQ ID NO: 944061 - DNA, 25 bp, Mus musculus
ttctgttctctcagggtgcctgtcc

SEQ ID NO: 944062 - DNA, 25 bp, Mus musculus
ttctgttctctctgggtgcctgtcc

SEQ ID NO: 944063 - DNA, 25 bp, Mus musculus
ttctgttctgaacatacaatgtcct

SEQ ID NO: 944064 - DNA, 25 bp, Mus musculus
ttctgttctgaagatacaatgtcct

SEQ ID NO: 944065 - DNA, 25 bp, Mus musculus
ttctgttctgatctcgacactgggt

SEQ ID NO: 944066 - DNA, 25 bp, Mus musculus
ttctgttctgatctctctttcctca

SEQ ID NO: 944067 - DNA, 25 bp, Mus musculus
ttctgttctgatgtcgacactgggt

SEQ ID NO: 944068 - DNA, 25 bp, Mus musculus
ttctgttctgatgtctctttcctca

SEQ ID NO: 944069 - DNA, 25 bp, Mus musculus
ttctgttctgcaactagtctttctg

SEQ ID NO: 944070 - DNA, 25 bp, Mus musculus
ttctgttctgcatctagtctttctg

SEQ ID NO: 944071 - DNA, 25 bp, Mus musculus
ttctgttctggaaggaactcctccc

SEQ ID NO: 944072 - DNA, 25 bp, Mus musculus
ttctgttctggaatgccgtgtgttg

SEQ ID NO: 944073 - DNA, 25 bp, Mus musculus
ttctgttctggatggaactcctccc

SEQ ID NO: 944074 - DNA, 25 bp, Mus musculus
ttctgttctggattgccgtgtgttg

SEQ ID NO: 944075 - DNA, 25 bp, Mus musculus
ttctgttctgttaaccttgtgtcta

SEQ ID NO: 944076 - DNA, 25 bp, Mus musculus
ttctgttctgttaagggcttggcta

SEQ ID NO: 944077 - DNA, 25 bp, Mus musculus
ttctgttctgttctgtgctgtgcaa

SEQ ID NO: 944078 - DNA, 25 bp, Mus musculus
ttctgttctgttgtgtgctgtgcaa

SEQ ID NO: 944079 - DNA, 25 bp, Mus musculus
ttctgttctgtttaccttgtgtcta

SEQ ID NO: 944080 - DNA, 25 bp, Mus musculus
ttctgttctgtttagggcttggcta

SEQ ID NO: 944081 - DNA, 25 bp, Mus musculus
ttctgttcttggatgcttctttcaa

SEQ ID NO: 944082 - DNA, 25 bp, Mus musculus
ttctgttcttggttgcttctttcaa

SEQ ID NO: 944083 - DNA, 25 bp, Mus musculus
ttctgttcttttagtgtacgatcct

SEQ ID NO: 944084 - DNA, 25 bp, Mus musculus
ttctgttctttttgtgtacgatcct

SEQ ID NO: 944085 - DNA, 25 bp, Mus musculus
ttctgttgacccaacagacctacac

SEQ ID NO: 944086 - DNA, 25 bp, Mus musculus
ttctgttgaccctacagacctacac

SEQ ID NO: 944087 - DNA, 25 bp, Mus musculus
ttctgttgactgaggttgctggcgc

SEQ ID NO: 944088 - DNA, 25 bp, Mus musculus
ttctgttgactgtggttgctggcgc

SEQ ID NO: 944089 - DNA, 25 bp, Mus musculus
ttctgttgagttaagcctaccacca

SEQ ID NO: 944090 - DNA, 25 bp, Mus musculus
ttctgttgagtttagcctaccacca

SEQ ID NO: 944091 - DNA, 25 bp, Mus musculus
ttctgttgcaatctccttctttatt

SEQ ID NO: 944092 - DNA, 25 bp, Mus musculus
ttctgttgcaatgtccttctttatt

SEQ ID NO: 944093 - DNA, 25 bp, Mus musculus
ttctgttgccaaaactgcttttcca

SEQ ID NO: 944094 - DNA, 25 bp, Mus musculus
ttctgttgccaactgtgttctgcag

SEQ ID NO: 944095 - DNA, 25 bp, Mus musculus
ttctgttgccaagtgtgttctgcag

SEQ ID NO: 944096 - DNA, 25 bp, Mus musculus
ttctgttgccaatactgcttttcca

SEQ ID NO: 944097 - DNA, 25 bp, Mus musculus
ttctgttgccatctcagtggtgagt

SEQ ID NO: 944098 - DNA, 25 bp, Mus musculus
ttctgttgccatgtcagtggtgagt

SEQ ID NO: 944099 - DNA, 25 bp, Mus musculus
ttctgttgccttaagggttatactt

SEQ ID NO: 944100 - DNA, 25 bp, Mus musculus
ttctgttgcctttagggttatactt

SEQ ID NO: 944101 - DNA, 25 bp, Mus musculus
ttctgttgctatcatgacacaccct

SEQ ID NO: 944102 - DNA, 25 bp, Mus musculus
ttctgttgctatgatgacacaccct

SEQ ID NO: 944103 - DNA, 25 bp, Mus musculus
ttctgttgctgaaatccttgtgtgc

SEQ ID NO: 944104 - DNA, 25 bp, Mus musculus
ttctgttgctgacgctttcatacac

SEQ ID NO: 944105 - DNA, 25 bp, Mus musculus
ttctgttgctgaggctttcatacac

SEQ ID NO: 944106 - DNA, 25 bp, Mus musculus
ttctgttgctgatatccttgtgtgc

SEQ ID NO: 944107 - DNA, 25 bp, Mus musculus
ttctgttgctgcaaagggacactat

SEQ ID NO: 944108 - DNA, 25 bp, Mus musculus
ttctgttgctgctaagggacactat

SEQ ID NO: 944109 - DNA, 25 bp, Mus musculus
ttctgttggcctccttgaattacaa

SEQ ID NO: 944110 - DNA, 25 bp, Mus musculus
ttctgttggcctgcttgaattacaa

SEQ ID NO: 944111 - DNA, 25 bp, Mus musculus
ttctgttgtcaaaggtgcttgctgc

SEQ ID NO: 944112 - DNA, 25 bp, Mus musculus
ttctgttgtcaatggtgcttgctgc

SEQ ID NO: 944113 - DNA, 25 bp, Mus musculus
ttctgttgtgatcaaccctctttta

SEQ ID NO: 944114 - DNA, 25 bp, Mus musculus
ttctgttgtgatccactgaacacat

SEQ ID NO: 944115 - DNA, 25 bp, Mus musculus
ttctgttgtgatgaaccctctttta

SEQ ID NO: 944116 - DNA, 25 bp, Mus musculus
ttctgttgtgatgcactgaacacat

SEQ ID NO: 944117 - DNA, 25 bp, Mus musculus
ttctgtttagaacacccactagcct

SEQ ID NO: 944118 - DNA, 25 bp, Mus musculus
ttctgtttagaagacccactagcct

SEQ ID NO: 944119 - DNA, 25 bp, Mus musculus
ttctgtttagcccagtgttaacgat

SEQ ID NO: 944120 - DNA, 25 bp, Mus musculus
ttctgtttagccctttggtaccaca

SEQ ID NO: 944121 - DNA, 25 bp, Mus musculus
ttctgtttagccgagtgttaacgat

SEQ ID NO: 944122 - DNA, 25 bp, Mus musculus
ttctgtttagccgtttggtaccaca

SEQ ID NO: 944123 - DNA, 25 bp, Mus musculus
ttctgtttatccactcatgggtgat

SEQ ID NO: 944124 - DNA, 25 bp, Mus musculus
ttctgtttatcctctcatgggtgat

SEQ ID NO: 944125 - DNA, 25 bp, Mus musculus
ttctgtttatgcagcagccggacta

SEQ ID NO: 944126 - DNA, 25 bp, Mus musculus
ttctgtttatgctgcagccggacta

SEQ ID NO: 944127 - DNA, 25 bp, Mus musculus
ttctgtttcactatttcctcttctt

SEQ ID NO: 944128 - DNA, 25 bp, Mus musculus
ttctgtttcactttttcctcttctt

SEQ ID NO: 944129 - DNA, 25 bp, Mus musculus
ttctgtttcaggctcgcatcatcga

SEQ ID NO: 944130 - DNA, 25 bp, Mus musculus
ttctgtttcagggtcgcatcatcga

SEQ ID NO: 944131 - DNA, 25 bp, Mus musculus
ttctgtttcctccaaagtcctcaaa

SEQ ID NO: 944132 - DNA, 25 bp, Mus musculus
ttctgtttcctcgaaagtcctcaaa

SEQ ID NO: 944133 - DNA, 25 bp, Mus musculus
ttctgtttcgaacctcgctgtccag

SEQ ID NO: 944134 - DNA, 25 bp, Mus musculus
ttctgtttcgaagctcgctgtccag

SEQ ID NO: 944135 - DNA, 25 bp, Mus musculus
ttctgtttctaaccttttccactgt

SEQ ID NO: 944136 - DNA, 25 bp, Mus musculus
ttctgtttctaagcttttccactgt

SEQ ID NO: 944137 - DNA, 25 bp, Mus musculus
ttctgtttctatcttgtgtccggag

SEQ ID NO: 944138 - DNA, 25 bp, Mus musculus
ttctgtttctatgttgtgtccggag

SEQ ID NO: 944139 - DNA, 25 bp, Mus musculus
ttctgtttctccaacaacacctaca

SEQ ID NO: 944140 - DNA, 25 bp, Mus musculus
ttctgtttctcctacaacacctaca

SEQ ID NO: 944141 - DNA, 25 bp, Mus musculus
ttctgtttctctatactgtacctag

SEQ ID NO: 944142 - DNA, 25 bp, Mus musculus
ttctgtttctctttactgtacctag

SEQ ID NO: 944143 - DNA, 25 bp, Mus musculus
ttctgtttctgtcgtgccttgagat

SEQ ID NO: 944144 - DNA, 25 bp, Mus musculus
ttctgtttctgtggtgccttgagat

SEQ ID NO: 944145 - DNA, 25 bp, Mus musculus
ttctgtttcttgcattgccgttcaa

SEQ ID NO: 944146 - DNA, 25 bp, Mus musculus
ttctgtttcttggattgccgttcaa

SEQ ID NO: 944147 - DNA, 25 bp, Mus musculus
ttctgtttctttagagatccctgat

SEQ ID NO: 944148 - DNA, 25 bp, Mus musculus
ttctgtttcttttgagatccctgat

SEQ ID NO: 944149 - DNA, 25 bp, Mus musculus
ttctgtttgaataccactagccaaa

SEQ ID NO: 944150 - DNA, 25 bp, Mus musculus
ttctgtttgaattccactagccaaa

SEQ ID NO: 944151 - DNA, 25 bp, Mus musculus
ttctgtttgagaccatcactgacat

SEQ ID NO: 944152 - DNA, 25 bp, Mus musculus
ttctgtttgagagcatcactgacat

SEQ ID NO: 944153 - DNA, 25 bp, Mus musculus
ttctgtttgcccagctgtctgtgat

SEQ ID NO: 944154 - DNA, 25 bp, Mus musculus
ttctgtttgccctgctgtctgtgat

SEQ ID NO: 944155 - DNA, 25 bp, Mus musculus
ttctgtttgcctaggaatatgctat

SEQ ID NO: 944156 - DNA, 25 bp, Mus musculus
ttctgtttgccttggaatatgctat

SEQ ID NO: 944157 - DNA, 25 bp, Mus musculus
ttctgtttgtacatgatccaccctt

SEQ ID NO: 944158 - DNA, 25 bp, Mus musculus
ttctgtttgtacttgatccaccctt

SEQ ID NO: 944159 - DNA, 25 bp, Mus musculus
ttctgtttgtccagtgttttgttaa

SEQ ID NO: 944160 - DNA, 25 bp, Mus musculus
ttctgtttgtccatgtttactttgc

SEQ ID NO: 944161 - DNA, 25 bp, Mus musculus
ttctgtttgtcctgtgttttgttaa

SEQ ID NO: 944162 - DNA, 25 bp, Mus musculus
ttctgtttgtccttgtttactttgc

SEQ ID NO: 944163 - DNA, 25 bp, Mus musculus
ttctgtttgtctattgacctgaaaa

SEQ ID NO: 944164 - DNA, 25 bp, Mus musculus
ttctgtttgtcttttgacctgaaaa

SEQ ID NO: 944165 - DNA, 25 bp, Mus musculus
ttctgtttgttcactcctattctga

SEQ ID NO: 944166 - DNA, 25 bp, Mus musculus
ttctgtttgttctctcctattctga

SEQ ID NO: 944167 - DNA, 25 bp, Mus musculus
ttctgtttgtttaacctgcccttca

SEQ ID NO: 944168 - DNA, 25 bp, Mus musculus
ttctgtttgttttacctgcccttca

SEQ ID NO: 944169 - DNA, 25 bp, Mus musculus
ttctgttttcaactactccaataaa

SEQ ID NO: 944170 - DNA, 25 bp, Mus musculus
ttctgttttcaagtactccaataaa

SEQ ID NO: 944171 - DNA, 25 bp, Mus musculus
ttctgttttcatatgcctccctaag

SEQ ID NO: 944172 - DNA, 25 bp, Mus musculus
ttctgttttcatcacttagtatctt

SEQ ID NO: 944173 - DNA, 25 bp, Mus musculus
ttctgttttcatgacttagtatctt

SEQ ID NO: 944174 - DNA, 25 bp, Mus musculus
ttctgttttcatttgcctccctaag

SEQ ID NO: 944175 - DNA, 25 bp, Mus musculus
ttctgttttccgaagccctctgaat

SEQ ID NO: 944176 - DNA, 25 bp, Mus musculus
ttctgttttccgtagccctctgaat

SEQ ID NO: 944177 - DNA, 25 bp, Mus musculus
ttctgttttctaccctaccacattc

SEQ ID NO: 944178 - DNA, 25 bp, Mus musculus
ttctgttttctagcctaccacattc

SEQ ID NO: 944179 - DNA, 25 bp, Mus musculus
ttctgttttctgacatgtttaagca

SEQ ID NO: 944180 - DNA, 25 bp, Mus musculus
ttctgttttctgtcatgtttaagca

SEQ ID NO: 944181 - DNA, 25 bp, Mus musculus
ttctgttttcttagatgaagctttc

SEQ ID NO: 944182 - DNA, 25 bp, Mus musculus
ttctgttttctttgatgaagctttc

SEQ ID NO: 944183 - DNA, 25 bp, Mus musculus
ttctgttttgagcagaagtcacctc

SEQ ID NO: 944184 - DNA, 25 bp, Mus musculus
ttctgttttgaggagaagtcacctc

SEQ ID NO: 944185 - DNA, 25 bp, Mus musculus
ttctgttttgctatgatccaatatt

SEQ ID NO: 944186 - DNA, 25 bp, Mus musculus
ttctgttttgctttgatccaatatt

SEQ ID NO: 944187 - DNA, 25 bp, Mus musculus
ttctgttttgtactgtgtgttctca

SEQ ID NO: 944188 - DNA, 25 bp, Mus musculus
ttctgttttgtagtgtgtgttctca

SEQ ID NO: 944189 - DNA, 25 bp, Mus musculus
ttctgtttttacctctgcaaagctt

SEQ ID NO: 944190 - DNA, 25 bp, Mus musculus
ttctgtttttacgtctgcaaagctt

SEQ ID NO: 944191 - DNA, 25 bp, Mus musculus
ttcttaaaacacatcccttcactca

SEQ ID NO: 944192 - DNA, 25 bp, Mus musculus
ttcttaaaacacttcccttcactca

SEQ ID NO: 944193 - DNA, 25 bp, Mus musculus
ttcttaaaatggctcaacggtgaga

SEQ ID NO: 944194 - DNA, 25 bp, Mus musculus
ttcttaaaatgggtcaacggtgaga

SEQ ID NO: 944195 - DNA, 25 bp, Mus musculus
ttcttaaagaataccctcattcgtt

SEQ ID NO: 944196 - DNA, 25 bp, Mus musculus
ttcttaaagaattccctcattcgtt

SEQ ID NO: 944197 - DNA, 25 bp, Mus musculus
ttcttaaagatcctgcatgctgtcc

SEQ ID NO: 944198 - DNA, 25 bp, Mus musculus
ttcttaaagatcgtgcatgctgtcc

SEQ ID NO: 944199 - DNA, 25 bp, Mus musculus
ttcttaaaggttcttcattgtataa

SEQ ID NO: 944200 - DNA, 25 bp, Mus musculus
ttcttaaaggttgttcattgtataa

SEQ ID NO: 944201 - DNA, 25 bp, Mus musculus
ttcttaaatctgaatgctgcccgtt

SEQ ID NO: 944202 - DNA, 25 bp, Mus musculus
ttcttaaatctgtatgctgcccgtt

SEQ ID NO: 944203 - DNA, 25 bp, Mus musculus
ttcttaacacccatggtcctgcaat

SEQ ID NO: 944204 - DNA, 25 bp, Mus musculus
ttcttaacacccttggtcctgcaat

SEQ ID NO: 944205 - DNA, 25 bp, Mus musculus
ttcttaacattcataccctctttga

SEQ ID NO: 944206 - DNA, 25 bp, Mus musculus
ttcttaacattcttaccctctttga

SEQ ID NO: 944207 - DNA, 25 bp, Mus musculus
ttcttaaccgccctgtggaaagagg

SEQ ID NO: 944208 - DNA, 25 bp, Mus musculus
ttcttaaccgccgtgtggaaagagg

SEQ ID NO: 944209 - DNA, 25 bp, Mus musculus
ttcttaacctctagcgactgctgtt

SEQ ID NO: 944210 - DNA, 25 bp, Mus musculus
ttcttaacctcttgcgactgctgtt

SEQ ID NO: 944211 - DNA, 25 bp, Mus musculus
ttcttaactataactgtctacaggc

SEQ ID NO: 944212 - DNA, 25 bp, Mus musculus
ttcttaactatatctgtctacaggc

SEQ ID NO: 944213 - DNA, 25 bp, Mus musculus
ttcttaactcatcggccggttcatg

SEQ ID NO: 944214 - DNA, 25 bp, Mus musculus
ttcttaactcatgggccggttcatg

SEQ ID NO: 944215 - DNA, 25 bp, Mus musculus
ttcttaagagacctatgcctttggc

SEQ ID NO: 944216 - DNA, 25 bp, Mus musculus
ttcttaagagacgtatgcctttggc

SEQ ID NO: 944217 - DNA, 25 bp, Mus musculus
ttcttaagcggccagggcggcggcg

SEQ ID NO: 944218 - DNA, 25 bp, Mus musculus
ttcttaagcggcgagggcggcggcg

SEQ ID NO: 944219 - DNA, 25 bp, Mus musculus
ttcttaagcttaactctgcaaccat

SEQ ID NO: 944220 - DNA, 25 bp, Mus musculus
ttcttaagcttatctctgcaaccat

SEQ ID NO: 944221 - DNA, 25 bp, Mus musculus
ttcttaagctttccaattgcttgag

SEQ ID NO: 944222 - DNA, 25 bp, Mus musculus
ttcttaagctttgcaattgcttgag

SEQ ID NO: 944223 - DNA, 25 bp, Mus musculus
ttcttaagtgctctcaggtttacca

SEQ ID NO: 944224 - DNA, 25 bp, Mus musculus
ttcttaagtgctgtcaggtttacca

SEQ ID NO: 944225 - DNA, 25 bp, Mus musculus
ttcttaagtttgcacgtgggaacaa

SEQ ID NO: 944226 - DNA, 25 bp, Mus musculus
ttcttaagtttggacgtgggaacaa

SEQ ID NO: 944227 - DNA, 25 bp, Mus musculus
ttcttaataaatcctcacttcccca

SEQ ID NO: 944228 - DNA, 25 bp, Mus musculus
ttcttaataaatgctcacttcccca

SEQ ID NO: 944229 - DNA, 25 bp, Mus musculus
ttcttaataggtacctgggtgcagt

SEQ ID NO: 944230 - DNA, 25 bp, Mus musculus
ttcttaataggttcctgggtgcagt

SEQ ID NO: 944231 - DNA, 25 bp, Mus musculus
ttcttaatcatccaattggttatgt

SEQ ID NO: 944232 - DNA, 25 bp, Mus musculus
ttcttaatcatcgaattggttatgt

SEQ ID NO: 944233 - DNA, 25 bp, Mus musculus
ttcttaatccatacttgctgcacag

SEQ ID NO: 944234 - DNA, 25 bp, Mus musculus
ttcttaatccattcttgctgcacag

SEQ ID NO: 944235 - DNA, 25 bp, Mus musculus
ttcttaatgatactccacccttcct

SEQ ID NO: 944236 - DNA, 25 bp, Mus musculus
ttcttaatgatagtccacccttcct

SEQ ID NO: 944237 - DNA, 25 bp, Mus musculus
ttcttaatgccactgtgttgatttg

SEQ ID NO: 944238 - DNA, 25 bp, Mus musculus
ttcttaatgccagtgtgttgatttg

SEQ ID NO: 944239 - DNA, 25 bp, Mus musculus
ttcttaatgttccaaggtctgtact

SEQ ID NO: 944240 - DNA, 25 bp, Mus musculus
ttcttaatgttcgaaggtctgtact

SEQ ID NO: 944241 - DNA, 25 bp, Mus musculus
ttcttacaacttatgtggctcgcca

SEQ ID NO: 944242 - DNA, 25 bp, Mus musculus
ttcttacaacttttgtggctcgcca

SEQ ID NO: 944243 - DNA, 25 bp, Mus musculus
ttcttacacagcaagtattcctccc

SEQ ID NO: 944244 - DNA, 25 bp, Mus musculus
ttcttacacagctagtattcctccc

SEQ ID NO: 944245 - DNA, 25 bp, Mus musculus
ttcttacacttcagactgacgcgag

SEQ ID NO: 944246 - DNA, 25 bp, Mus musculus
ttcttacacttctgactgacgcgag

SEQ ID NO: 944247 - DNA, 25 bp, Mus musculus
ttcttacagattactcaacacccgg

SEQ ID NO: 944248 - DNA, 25 bp, Mus musculus
ttcttacagatttctcaacacccgg

SEQ ID NO: 944249 - DNA, 25 bp, Mus musculus
ttcttacatgcaaccaagggcgctt

SEQ ID NO: 944250 - DNA, 25 bp, Mus musculus
ttcttacatgcatccaagggcgctt

SEQ ID NO: 944251 - DNA, 25 bp, Mus musculus
ttcttacatggcattcctttgttgt

SEQ ID NO: 944252 - DNA, 25 bp, Mus musculus
ttcttacatggctttcctttgttgt

SEQ ID NO: 944253 - DNA, 25 bp, Mus musculus
ttcttacatgtgaagattgctgcca

SEQ ID NO: 944254 - DNA, 25 bp, Mus musculus
ttcttacatgtgtagattgctgcca

SEQ ID NO: 944255 - DNA, 25 bp, Mus musculus
ttcttaccaagaagcactggctgtg

SEQ ID NO: 944256 - DNA, 25 bp, Mus musculus
ttcttaccaagatgcactggctgtg

SEQ ID NO: 944257 - DNA, 25 bp, Mus musculus
ttcttaccacctatacattcaccag

SEQ ID NO: 944258 - DNA, 25 bp, Mus musculus
ttcttaccacctttacattcaccag

SEQ ID NO: 944259 - DNA, 25 bp, Mus musculus
ttcttaccactaagttttggcatcc

SEQ ID NO: 944260 - DNA, 25 bp, Mus musculus
ttcttaccactatgttttggcatcc

SEQ ID NO: 944261 - DNA, 25 bp, Mus musculus
ttcttaccagtaagtgcccatttgc

SEQ ID NO: 944262 - DNA, 25 bp, Mus musculus
ttcttaccagtatgtgcccatttgc

SEQ ID NO: 944263 - DNA, 25 bp, Mus musculus
ttcttaccatccaaataaaccttat

SEQ ID NO: 944264 - DNA, 25 bp, Mus musculus
ttcttaccatcctaataaaccttat

SEQ ID NO: 944265 - DNA, 25 bp, Mus musculus
ttcttaccattcagtatgcttccac

SEQ ID NO: 944266 - DNA, 25 bp, Mus musculus
ttcttaccattctgtatgcttccac

SEQ ID NO: 944267 - DNA, 25 bp, Mus musculus
ttcttacccaccagttaaatgaaag

SEQ ID NO: 944268 - DNA, 25 bp, Mus musculus
ttcttacccacctgttaaatgaaag

SEQ ID NO: 944269 - DNA, 25 bp, Mus musculus
ttcttacccggtcggactctgaaat

SEQ ID NO: 944270 - DNA, 25 bp, Mus musculus
ttcttacccggtgggactctgaaat

SEQ ID NO: 944271 - DNA, 25 bp, Mus musculus
ttcttacccgttccaggctgagaag

SEQ ID NO: 944272 - DNA, 25 bp, Mus musculus
ttcttacccgttgcaggctgagaag

SEQ ID NO: 944273 - DNA, 25 bp, Mus musculus
ttcttacctggcatctggtgcagaa

SEQ ID NO: 944274 - DNA, 25 bp, Mus musculus
ttcttacctggcttctggtgcagaa

SEQ ID NO: 944275 - DNA, 25 bp, Mus musculus
ttcttacctgggactaggtttgctc

SEQ ID NO: 944276 - DNA, 25 bp, Mus musculus
ttcttacctgggtctaggtttgctc

SEQ ID NO: 944277 - DNA, 25 bp, Mus musculus
ttcttaccttaacacaaccacacta

SEQ ID NO: 944278 - DNA, 25 bp, Mus musculus
ttcttaccttaagacaaccacacta

SEQ ID NO: 944279 - DNA, 25 bp, Mus musculus
ttcttacgactgagactacttgcat

SEQ ID NO: 944280 - DNA, 25 bp, Mus musculus
ttcttacgactgtgactacttgcat

SEQ ID NO: 944281 - DNA, 25 bp, Mus musculus
ttcttacgtgtgatagtggaaccct

SEQ ID NO: 944282 - DNA, 25 bp, Mus musculus
ttcttacgtgtgttagtggaaccct

SEQ ID NO: 944283 - DNA, 25 bp, Mus musculus
ttcttactaaacacctctgactcag

SEQ ID NO: 944284 - DNA, 25 bp, Mus musculus
ttcttactaaactcctctgactcag

SEQ ID NO: 944285 - DNA, 25 bp, Mus musculus
ttcttactaacccacaagtgccagt

SEQ ID NO: 944286 - DNA, 25 bp, Mus musculus
ttcttactaaccgacaagtgccagt

SEQ ID NO: 944287 - DNA, 25 bp, Mus musculus
ttcttactacaaactgcttcgggag

SEQ ID NO: 944288 - DNA, 25 bp, Mus musculus
ttcttactacaatctgcttcgggag

SEQ ID NO: 944289 - DNA, 25 bp, Mus musculus
ttcttactccaaattgtggcgtcca

SEQ ID NO: 944290 - DNA, 25 bp, Mus musculus
ttcttactccaatttgtggcgtcca

SEQ ID NO: 944291 - DNA, 25 bp, Mus musculus
ttcttactctgccctttcatcattt

SEQ ID NO: 944292 - DNA, 25 bp, Mus musculus
ttcttactctgcgctttcatcattt

SEQ ID NO: 944293 - DNA, 25 bp, Mus musculus
ttcttactgagaagcataaacccct

SEQ ID NO: 944294 - DNA, 25 bp, Mus musculus
ttcttactgagatgcataaacccct

SEQ ID NO: 944295 - DNA, 25 bp, Mus musculus
ttcttactgtgccaacatgaggact

SEQ ID NO: 944296 - DNA, 25 bp, Mus musculus
ttcttactgtgcgaacatgaggact

SEQ ID NO: 944297 - DNA, 25 bp, Mus musculus
ttcttactttgaaatggcatacttc

SEQ ID NO: 944298 - DNA, 25 bp, Mus musculus
ttcttactttgatatggcatacttc

SEQ ID NO: 944299 - DNA, 25 bp, Mus musculus
ttcttacttttcagtgttgacttca

SEQ ID NO: 944300 - DNA, 25 bp, Mus musculus
ttcttacttttctgtgttgacttca

SEQ ID NO: 944301 - DNA, 25 bp, Mus musculus
ttcttagaagacacctgattttctc

SEQ ID NO: 944302 - DNA, 25 bp, Mus musculus
ttcttagaagactcctgattttctc

SEQ ID NO: 944303 - DNA, 25 bp, Mus musculus
ttcttagaataacggctgcctccca

SEQ ID NO: 944304 - DNA, 25 bp, Mus musculus
ttcttagaataagggctgcctccca

SEQ ID NO: 944305 - DNA, 25 bp, Mus musculus
ttcttagacactattttctcagtag

SEQ ID NO: 944306 - DNA, 25 bp, Mus musculus
ttcttagacacttttttctcagtag

SEQ ID NO: 944307 - DNA, 25 bp, Mus musculus
ttcttagacagtagtcctcacctgc

SEQ ID NO: 944308 - DNA, 25 bp, Mus musculus
ttcttagacagttgtcctcacctgc

SEQ ID NO: 944309 - DNA, 25 bp, Mus musculus
ttcttagaccctaggctaacccagg

SEQ ID NO: 944310 - DNA, 25 bp, Mus musculus
ttcttagacccttggctaacccagg

SEQ ID NO: 944311 - DNA, 25 bp, Mus musculus
ttcttagagtgtcttccccatgcac

SEQ ID NO: 944312 - DNA, 25 bp, Mus musculus
ttcttagagtgtgttccccatgcac

SEQ ID NO: 944313 - DNA, 25 bp, Mus musculus
ttcttagcaactcctgtagcaatga

SEQ ID NO: 944314 - DNA, 25 bp, Mus musculus
ttcttagcaactgctgtagcaatga

SEQ ID NO: 944315 - DNA, 25 bp, Mus musculus
ttcttagcacctctgtcaggcagtt

SEQ ID NO: 944316 - DNA, 25 bp, Mus musculus
ttcttagcacctgtgtcaggcagtt

SEQ ID NO: 944317 - DNA, 25 bp, Mus musculus
ttcttagcatgtaaggctcttcctt

SEQ ID NO: 944318 - DNA, 25 bp, Mus musculus
ttcttagcatgttaggctcttcctt

SEQ ID NO: 944319 - DNA, 25 bp, Mus musculus
ttcttagccaaactcagtgctcttt

SEQ ID NO: 944320 - DNA, 25 bp, Mus musculus
ttcttagccaaagtcagtgctcttt

SEQ ID NO: 944321 - DNA, 25 bp, Mus musculus
ttcttagccatgattgtcgccacga

SEQ ID NO: 944322 - DNA, 25 bp, Mus musculus
ttcttagccatgtttgtcgccacga

SEQ ID NO: 944323 - DNA, 25 bp, Mus musculus
ttcttagccttgatggtgtgggaat

SEQ ID NO: 944324 - DNA, 25 bp, Mus musculus
ttcttagccttgttggtgtgggaat

SEQ ID NO: 944325 - DNA, 25 bp, Mus musculus
ttcttagcggctagttggcccaggg

SEQ ID NO: 944326 - DNA, 25 bp, Mus musculus
ttcttagcggcttgttggcccaggg

SEQ ID NO: 944327 - DNA, 25 bp, Mus musculus
ttcttagctgagaatttcgccccac

SEQ ID NO: 944328 - DNA, 25 bp, Mus musculus
ttcttagctgagtatttcgccccac

SEQ ID NO: 944329 - DNA, 25 bp, Mus musculus
ttcttagctggtctagacctgtcct

SEQ ID NO: 944330 - DNA, 25 bp, Mus musculus
ttcttagctggtgtagacctgtcct

SEQ ID NO: 944331 - DNA, 25 bp, Mus musculus
ttcttagcttaccatggtactcttt

SEQ ID NO: 944332 - DNA, 25 bp, Mus musculus
ttcttagcttacgatggtactcttt

SEQ ID NO: 944333 - DNA, 25 bp, Mus musculus
ttcttaggccgtctcctactttgat

SEQ ID NO: 944334 - DNA, 25 bp, Mus musculus
ttcttaggccgtgtcctactttgat

SEQ ID NO: 944335 - DNA, 25 bp, Mus musculus
ttcttagtcacaccttcctgagaaa

SEQ ID NO: 944336 - DNA, 25 bp, Mus musculus
ttcttagtcacagcttcctgagaaa

SEQ ID NO: 944337 - DNA, 25 bp, Mus musculus
ttcttagtctagcagggatcccctt

SEQ ID NO: 944338 - DNA, 25 bp, Mus musculus
ttcttagtctaggagggatcccctt

SEQ ID NO: 944339 - DNA, 25 bp, Mus musculus
ttcttagtcttcacaatgggcggta

SEQ ID NO: 944340 - DNA, 25 bp, Mus musculus
ttcttagtcttctcaatgggcggta

SEQ ID NO: 944341 - DNA, 25 bp, Mus musculus
ttcttagtgggtatagctcctcaca

SEQ ID NO: 944342 - DNA, 25 bp, Mus musculus
ttcttagtgggtttagctcctcaca

SEQ ID NO: 944343 - DNA, 25 bp, Mus musculus
ttcttagtgtatattgatgggacta

SEQ ID NO: 944344 - DNA, 25 bp, Mus musculus
ttcttagtgtattttgatgggacta

SEQ ID NO: 944345 - DNA, 25 bp, Mus musculus
ttcttagtgtgacccgcttcccgtg

SEQ ID NO: 944346 - DNA, 25 bp, Mus musculus
ttcttagtgtgagccgcttcccgtg

SEQ ID NO: 944347 - DNA, 25 bp, Mus musculus
ttcttagtgttcacatgatgcctca

SEQ ID NO: 944348 - DNA, 25 bp, Mus musculus
ttcttagtgttctcatgatgcctca

SEQ ID NO: 944349 - DNA, 25 bp, Mus musculus
ttcttagttgtgcacttgaggctga

SEQ ID NO: 944350 - DNA, 25 bp, Mus musculus
ttcttagttgtggacttgaggctga

SEQ ID NO: 944351 - DNA, 25 bp, Mus musculus
ttcttataaataaagccaggtggtc

SEQ ID NO: 944352 - DNA, 25 bp, Mus musculus
ttcttataaatatagccaggtggtc

SEQ ID NO: 944353 - DNA, 25 bp, Mus musculus
ttcttataactgctcaactttcttg

SEQ ID NO: 944354 - DNA, 25 bp, Mus musculus
ttcttataactggtcaactttcttg

SEQ ID NO: 944355 - DNA, 25 bp, Mus musculus
ttcttataagtgcagtttcttaaaa

SEQ ID NO: 944356 - DNA, 25 bp, Mus musculus
ttcttataagtggagtttcttaaaa

SEQ ID NO: 944357 - DNA, 25 bp, Mus musculus
ttcttataatctcttctgggtctca

SEQ ID NO: 944358 - DNA, 25 bp, Mus musculus
ttcttataatctgttctgggtctca

SEQ ID NO: 944359 - DNA, 25 bp, Mus musculus
ttcttataatgtcccctgtctttaa

SEQ ID NO: 944360 - DNA, 25 bp, Mus musculus
ttcttataatgtgccctgtctttaa

SEQ ID NO: 944361 - DNA, 25 bp, Mus musculus
ttcttataccccacaaggttgcagc

SEQ ID NO: 944362 - DNA, 25 bp, Mus musculus
ttcttatacccctcaaggttgcagc

SEQ ID NO: 944363 - DNA, 25 bp, Mus musculus
ttcttatagcaccagggatcaccag

SEQ ID NO: 944364 - DNA, 25 bp, Mus musculus
ttcttatagcacgagggatcaccag

SEQ ID NO: 944365 - DNA, 25 bp, Mus musculus
ttcttatatcacatgtcctgagtgg

SEQ ID NO: 944366 - DNA, 25 bp, Mus musculus
ttcttatatcacttgtcctgagtgg

SEQ ID NO: 944367 - DNA, 25 bp, Mus musculus
ttcttatcacccatagtccttagga

SEQ ID NO: 944368 - DNA, 25 bp, Mus musculus
ttcttatcacccttagtccttagga

SEQ ID NO: 944369 - DNA, 25 bp, Mus musculus
ttcttatcatcaaagctgaaagcaa

SEQ ID NO: 944370 - DNA, 25 bp, Mus musculus
ttcttatcatcaattcatcctccat

SEQ ID NO: 944371 - DNA, 25 bp, Mus musculus
ttcttatcatcatagctgaaagcaa

SEQ ID NO: 944372 - DNA, 25 bp, Mus musculus
ttcttatcatcatttcatcctccat

SEQ ID NO: 944373 - DNA, 25 bp, Mus musculus
ttcttatccagaattcctcacagtc

SEQ ID NO: 944374 - DNA, 25 bp, Mus musculus
ttcttatccagatttcctcacagtc

SEQ ID NO: 944375 - DNA, 25 bp, Mus musculus
ttcttatccccaagctcagcaaaag

SEQ ID NO: 944376 - DNA, 25 bp, Mus musculus
ttcttatccccatgctcagcaaaag

SEQ ID NO: 944377 - DNA, 25 bp, Mus musculus
ttcttatccgcgcttgacatgtggg

SEQ ID NO: 944378 - DNA, 25 bp, Mus musculus
ttcttatccgcggttgacatgtggg

SEQ ID NO: 944379 - DNA, 25 bp, Mus musculus
ttcttatctgctcagtttgtcactg

SEQ ID NO: 944380 - DNA, 25 bp, Mus musculus
ttcttatctgctgagtttgtcactg

SEQ ID NO: 944381 - DNA, 25 bp, Mus musculus
ttcttatgactaacacagtgatctc

SEQ ID NO: 944382 - DNA, 25 bp, Mus musculus
ttcttatgactaacctggctatgat

SEQ ID NO: 944383 - DNA, 25 bp, Mus musculus
ttcttatgactatcacagtgatctc

SEQ ID NO: 944384 - DNA, 25 bp, Mus musculus
ttcttatgactatcctggctatgat

SEQ ID NO: 944385 - DNA, 25 bp, Mus musculus
ttcttatgtgggattattactttag

SEQ ID NO: 944386 - DNA, 25 bp, Mus musculus
ttcttatgtgggtttattactttag

SEQ ID NO: 944387 - DNA, 25 bp, Mus musculus
ttcttatgtgtacgactgtgggtct

SEQ ID NO: 944388 - DNA, 25 bp, Mus musculus
ttcttatgtgtaggactgtgggtct

SEQ ID NO: 944389 - DNA, 25 bp, Mus musculus
ttcttattaaaaacacacttcgaag

SEQ ID NO: 944390 - DNA, 25 bp, Mus musculus
ttcttattaaaatcacacttcgaag

SEQ ID NO: 944391 - DNA, 25 bp, Mus musculus
ttcttattaaaccacctgctatttc

SEQ ID NO: 944392 - DNA, 25 bp, Mus musculus
ttcttattaaacgacctgctatttc

SEQ ID NO: 944393 - DNA, 25 bp, Mus musculus
ttcttattcacactaccctcttgac

SEQ ID NO: 944394 - DNA, 25 bp, Mus musculus
ttcttattcacagtaccctcttgac

SEQ ID NO: 944395 - DNA, 25 bp, Mus musculus
ttcttattctcacttttgccctcag

SEQ ID NO: 944396 - DNA, 25 bp, Mus musculus
ttcttattctcagttttgccctcag

SEQ ID NO: 944397 - DNA, 25 bp, Mus musculus
ttcttattgggcctgtacactccag

SEQ ID NO: 944398 - DNA, 25 bp, Mus musculus
ttcttattgggcgtgtacactccag

SEQ ID NO: 944399 - DNA, 25 bp, Mus musculus
ttcttatttcctaaattcttctgaa

SEQ ID NO: 944400 - DNA, 25 bp, Mus musculus
ttcttatttccttaattcttctgaa

SEQ ID NO: 944401 - DNA, 25 bp, Mus musculus
ttcttatttgcacccatctagtcaa

SEQ ID NO: 944402 - DNA, 25 bp, Mus musculus
ttcttatttgcagccatctagtcaa

SEQ ID NO: 944403 - DNA, 25 bp, Mus musculus
ttcttatttgctcggtgctgatctc

SEQ ID NO: 944404 - DNA, 25 bp, Mus musculus
ttcttatttgctgggtgctgatctc

SEQ ID NO: 944405 - DNA, 25 bp, Mus musculus
ttcttcaaaagacacttctaacctt

SEQ ID NO: 944406 - DNA, 25 bp, Mus musculus
ttcttcaaaagagacttctaacctt

SEQ ID NO: 944407 - DNA, 25 bp, Mus musculus
ttcttcaaactcagttggtcccctt

SEQ ID NO: 944408 - DNA, 25 bp, Mus musculus
ttcttcaaactctgttggtcccctt

SEQ ID NO: 944409 - DNA, 25 bp, Mus musculus
ttcttcaaatccaccatcaactgag

SEQ ID NO: 944410 - DNA, 25 bp, Mus musculus
ttcttcaaatcctccatcaactgag

SEQ ID NO: 944411 - DNA, 25 bp, Mus musculus
ttcttcaacagcacttcaatcaggg

SEQ ID NO: 944412 - DNA, 25 bp, Mus musculus
ttcttcaacagctcttcaatcaggg

SEQ ID NO: 944413 - DNA, 25 bp, Mus musculus
ttcttcaacctgatgagctttccca

SEQ ID NO: 944414 - DNA, 25 bp, Mus musculus
ttcttcaacctgttgagctttccca

SEQ ID NO: 944415 - DNA, 25 bp, Mus musculus
ttcttcaacgcacaagtgtctctac

SEQ ID NO: 944416 - DNA, 25 bp, Mus musculus
ttcttcaacgcagaagtgtctctac

SEQ ID NO: 944417 - DNA, 25 bp, Mus musculus
ttcttcaactatccgggactgcatc

SEQ ID NO: 944418 - DNA, 25 bp, Mus musculus
ttcttcaactatgcgggactgcatc

SEQ ID NO: 944419 - DNA, 25 bp, Mus musculus
ttcttcaactccaacagcgattgct

SEQ ID NO: 944420 - DNA, 25 bp, Mus musculus
ttcttcaactcctacagcgattgct

SEQ ID NO: 944421 - DNA, 25 bp, Mus musculus
ttcttcaagattatatgttttccct

SEQ ID NO: 944422 - DNA, 25 bp, Mus musculus
ttcttcaagattttatgttttccct

SEQ ID NO: 944423 - DNA, 25 bp, Mus musculus
ttcttcaaggaaagcaaagacctga

SEQ ID NO: 944424 - DNA, 25 bp, Mus musculus
ttcttcaaggaatgcaaagacctga

SEQ ID NO: 944425 - DNA, 25 bp, Mus musculus
ttcttcaaggacacacattcttaca

SEQ ID NO: 944426 - DNA, 25 bp, Mus musculus
ttcttcaaggactcacattcttaca

SEQ ID NO: 944427 - DNA, 25 bp, Mus musculus
ttcttcaaggcccaaacagtctcaa

SEQ ID NO: 944428 - DNA, 25 bp, Mus musculus
ttcttcaaggccgaaacagtctcaa

SEQ ID NO: 944429 - DNA, 25 bp, Mus musculus
ttcttcaatgtcctcggccaagtct

SEQ ID NO: 944430 - DNA, 25 bp, Mus musculus
ttcttcaatgtcgtcggccaagtct

SEQ ID NO: 944431 - DNA, 25 bp, Mus musculus
ttcttcaattaactttgggctccat

SEQ ID NO: 944432 - DNA, 25 bp, Mus musculus
ttcttcaattaagtttgggctccat

SEQ ID NO: 944433 - DNA, 25 bp, Mus musculus
ttcttcacagccagttcagcctggg

SEQ ID NO: 944434 - DNA, 25 bp, Mus musculus
ttcttcacagcctgttcagcctggg

SEQ ID NO: 944435 - DNA, 25 bp, Mus musculus
ttcttcacatgaacgattacaatga

SEQ ID NO: 944436 - DNA, 25 bp, Mus musculus
ttcttcacatgatcgattacaatga

SEQ ID NO: 944437 - DNA, 25 bp, Mus musculus
ttcttcacattcatgcccagtgtct

SEQ ID NO: 944438 - DNA, 25 bp, Mus musculus
ttcttcacattcttgcccagtgtct

SEQ ID NO: 944439 - DNA, 25 bp, Mus musculus
ttcttcaccaacatactactgacca

SEQ ID NO: 944440 - DNA, 25 bp, Mus musculus
ttcttcaccaacttactactgacca

SEQ ID NO: 944441 - DNA, 25 bp, Mus musculus
ttcttcaccaatcacttctttgaca

SEQ ID NO: 944442 - DNA, 25 bp, Mus musculus
ttcttcaccaatgacttctttgaca

SEQ ID NO: 944443 - DNA, 25 bp, Mus musculus
ttcttcaccgccagtccaaagacat

SEQ ID NO: 944444 - DNA, 25 bp, Mus musculus
ttcttcaccgcctgtccaaagacat

SEQ ID NO: 944445 - DNA, 25 bp, Mus musculus
ttcttcacgggcaggacccactgct

SEQ ID NO: 944446 - DNA, 25 bp, Mus musculus
ttcttcacgggctggacccactgct

SEQ ID NO: 944447 - DNA, 25 bp, Mus musculus
ttcttcacggtgaggagacctggtc

SEQ ID NO: 944448 - DNA, 25 bp, Mus musculus
ttcttcacggtgtggagacctggtc

SEQ ID NO: 944449 - DNA, 25 bp, Mus musculus
ttcttcactacaatgtttgagctga

SEQ ID NO: 944450 - DNA, 25 bp, Mus musculus
ttcttcactacattgtttgagctga

SEQ ID NO: 944451 - DNA, 25 bp, Mus musculus
ttcttcactgaaattacccactcga

SEQ ID NO: 944452 - DNA, 25 bp, Mus musculus
ttcttcactgaatttacccactcga

SEQ ID NO: 944453 - DNA, 25 bp, Mus musculus
ttcttcactgttctacctgtggaaa

SEQ ID NO: 944454 - DNA, 25 bp, Mus musculus
ttcttcactgttgtacctgtggaaa

SEQ ID NO: 944455 - DNA, 25 bp, Mus musculus
ttcttcacttaacattgtgcccggt

SEQ ID NO: 944456 - DNA, 25 bp, Mus musculus
ttcttcacttaagattgtgcccggt

SEQ ID NO: 944457 - DNA, 25 bp, Mus musculus
ttcttcacttctaagagcccttctt

SEQ ID NO: 944458 - DNA, 25 bp, Mus musculus
ttcttcacttcttagagcccttctt

SEQ ID NO: 944459 - DNA, 25 bp, Mus musculus
ttcttcagagaaaggactgcccctt

SEQ ID NO: 944460 - DNA, 25 bp, Mus musculus
ttcttcagagaatggactgcccctt

SEQ ID NO: 944461 - DNA, 25 bp, Mus musculus
ttcttcagagcaaccttctctctgg

SEQ ID NO: 944462 - DNA, 25 bp, Mus musculus
ttcttcagagcatccttctctctgg

SEQ ID NO: 944463 - DNA, 25 bp, Mus musculus
ttcttcagagctagtcgtctttttc

SEQ ID NO: 944464 - DNA, 25 bp, Mus musculus
ttcttcagagcttgtcgtctttttc

SEQ ID NO: 944465 - DNA, 25 bp, Mus musculus
ttcttcagaggaacgcaaactcccc

SEQ ID NO: 944466 - DNA, 25 bp, Mus musculus
ttcttcagaggatcgcaaactcccc

SEQ ID NO: 944467 - DNA, 25 bp, Mus musculus
ttcttcagatatatcagtgttctag

SEQ ID NO: 944468 - DNA, 25 bp, Mus musculus
ttcttcagatatttcagtgttctag

SEQ ID NO: 944469 - DNA, 25 bp, Mus musculus
ttcttcagatcacggcagaaccatg

SEQ ID NO: 944470 - DNA, 25 bp, Mus musculus
ttcttcagatcagggcagaaccatg

SEQ ID NO: 944471 - DNA, 25 bp, Mus musculus
ttcttcagatgtaaactcagtgact

SEQ ID NO: 944472 - DNA, 25 bp, Mus musculus
ttcttcagatgttaactcagtgact

SEQ ID NO: 944473 - DNA, 25 bp, Mus musculus
ttcttcagatttcacctgtgacccc

SEQ ID NO: 944474 - DNA, 25 bp, Mus musculus
ttcttcagatttgacctgtgacccc

SEQ ID NO: 944475 - DNA, 25 bp, Mus musculus
ttcttcagccagactctaaactctc

SEQ ID NO: 944476 - DNA, 25 bp, Mus musculus
ttcttcagccagaggttggtagaat

SEQ ID NO: 944477 - DNA, 25 bp, Mus musculus
ttcttcagccagtctctaaactctc

SEQ ID NO: 944478 - DNA, 25 bp, Mus musculus
ttcttcagccagtggttggtagaat

SEQ ID NO: 944479 - DNA, 25 bp, Mus musculus
ttcttcagccccaatccagaaatga

SEQ ID NO: 944480 - DNA, 25 bp, Mus musculus
ttcttcagcccctatccagaaatga

SEQ ID NO: 944481 - DNA, 25 bp, Mus musculus
ttcttcagctacacacattctctgg

SEQ ID NO: 944482 - DNA, 25 bp, Mus musculus
ttcttcagctactcacattctctgg

SEQ ID NO: 944483 - DNA, 25 bp, Mus musculus
ttcttcagctccagggacatccgga

SEQ ID NO: 944484 - DNA, 25 bp, Mus musculus
ttcttcagctcctgggacatccgga

SEQ ID NO: 944485 - DNA, 25 bp, Mus musculus
ttcttcaggacaccactgccagaga

SEQ ID NO: 944486 - DNA, 25 bp, Mus musculus
ttcttcaggacagcactgccagaga

SEQ ID NO: 944487 - DNA, 25 bp, Mus musculus
ttcttcaggaggacaaggccctatg

SEQ ID NO: 944488 - DNA, 25 bp, Mus musculus
ttcttcaggaggtcaaggccctatg

SEQ ID NO: 944489 - DNA, 25 bp, Mus musculus
ttcttcagtaccaattattttcatg

SEQ ID NO: 944490 - DNA, 25 bp, Mus musculus
ttcttcagtacctattattttcatg

SEQ ID NO: 944491 - DNA, 25 bp, Mus musculus
ttcttcagtcttcttttagcagcca

SEQ ID NO: 944492 - DNA, 25 bp, Mus musculus
ttcttcagtcttgttttagcagcca

SEQ ID NO: 944493 - DNA, 25 bp, Mus musculus
ttcttcagttctcccaggtatgtgc

SEQ ID NO: 944494 - DNA, 25 bp, Mus musculus
ttcttcagttctgccaggtatgtgc

SEQ ID NO: 944495 - DNA, 25 bp, Mus musculus
ttcttcatacacaaaaagcttcctg

SEQ ID NO: 944496 - DNA, 25 bp, Mus musculus
ttcttcatacactaaaagcttcctg

SEQ ID NO: 944497 - DNA, 25 bp, Mus musculus
ttcttcatagagattatacaggtgc

SEQ ID NO: 944498 - DNA, 25 bp, Mus musculus
ttcttcatagagtttatacaggtgc

SEQ ID NO: 944499 - DNA, 25 bp, Mus musculus
ttcttcataggcaacagactatatt

SEQ ID NO: 944500 - DNA, 25 bp, Mus musculus
ttcttcataggctacagactatatt

SEQ ID NO: 944501 - DNA, 25 bp, Mus musculus
ttcttcataggtcttctccagcagg

SEQ ID NO: 944502 - DNA, 25 bp, Mus musculus
ttcttcataggtgttctccagcagg

SEQ ID NO: 944503 - DNA, 25 bp, Mus musculus
ttcttcatctagctgcagggctttt

SEQ ID NO: 944504 - DNA, 25 bp, Mus musculus
ttcttcatctaggtgcagggctttt

SEQ ID NO: 944505 - DNA, 25 bp, Mus musculus
ttcttcatctctctcaccaaatact

SEQ ID NO: 944506 - DNA, 25 bp, Mus musculus
ttcttcatctctgtcaccaaatact

SEQ ID NO: 944507 - DNA, 25 bp, Mus musculus
ttcttcatcttcactagcttgtcaa

SEQ ID NO: 944508 - DNA, 25 bp, Mus musculus
ttcttcatcttctctagcttgtcaa

SEQ ID NO: 944509 - DNA, 25 bp, Mus musculus
ttcttcatgcgtatctaaggctaga

SEQ ID NO: 944510 - DNA, 25 bp, Mus musculus
ttcttcatgcgtttctaaggctaga

SEQ ID NO: 944511 - DNA, 25 bp, Mus musculus
ttcttcatgctgaaagcaatcccga

SEQ ID NO: 944512 - DNA, 25 bp, Mus musculus
ttcttcatgctgtaagcaatcccga

SEQ ID NO: 944513 - DNA, 25 bp, Mus musculus
ttcttcatggaaaccagtagcccgg

SEQ ID NO: 944514 - DNA, 25 bp, Mus musculus
ttcttcatggaatccagtagcccgg

SEQ ID NO: 944515 - DNA, 25 bp, Mus musculus
ttcttcatgtccaacagttctgcta

SEQ ID NO: 944516 - DNA, 25 bp, Mus musculus
ttcttcatgtcctacagttctgcta

SEQ ID NO: 944517 - DNA, 25 bp, Mus musculus
ttcttcatgtgcctctttctttaga

SEQ ID NO: 944518 - DNA, 25 bp, Mus musculus
ttcttcatgtgcgtctttctttaga

SEQ ID NO: 944519 - DNA, 25 bp, Mus musculus
ttcttcattcgactcgtactttctt

SEQ ID NO: 944520 - DNA, 25 bp, Mus musculus
ttcttcattcgagtcgtactttctt

SEQ ID NO: 944521 - DNA, 25 bp, Mus musculus
ttcttcattcttagctcctgtagac

SEQ ID NO: 944522 - DNA, 25 bp, Mus musculus
ttcttcattctttgctcctgtagac

SEQ ID NO: 944523 - DNA, 25 bp, Mus musculus
ttcttcattggcagcacttgtgtca

SEQ ID NO: 944524 - DNA, 25 bp, Mus musculus
ttcttcattggctgcacttgtgtca

SEQ ID NO: 944525 - DNA, 25 bp, Mus musculus
ttcttcatttatctgaccccaaagc

SEQ ID NO: 944526 - DNA, 25 bp, Mus musculus
ttcttcatttatgtgaccccaaagc

SEQ ID NO: 944527 - DNA, 25 bp, Mus musculus
ttcttcatttggcagaccacagggc

SEQ ID NO: 944528 - DNA, 25 bp, Mus musculus
ttcttcatttgggagaccacagggc

SEQ ID NO: 944529 - DNA, 25 bp, Mus musculus
ttcttcatttgtatgcggtgtgtcc

SEQ ID NO: 944530 - DNA, 25 bp, Mus musculus
ttcttcatttgtttgcggtgtgtcc

SEQ ID NO: 944531 - DNA, 25 bp, Mus musculus
ttcttcattttccacatttttgaga

SEQ ID NO: 944532 - DNA, 25 bp, Mus musculus
ttcttcattttcgacatttttgaga

SEQ ID NO: 944533 - DNA, 25 bp, Mus musculus
ttcttcattttgagaagcctagttt

SEQ ID NO: 944534 - DNA, 25 bp, Mus musculus
ttcttcattttgtgaagcctagttt

SEQ ID NO: 944535 - DNA, 25 bp, Mus musculus
ttcttccaacggcacaagctcaagg

SEQ ID NO: 944536 - DNA, 25 bp, Mus musculus
ttcttccaacgggacaagctcaagg

SEQ ID NO: 944537 - DNA, 25 bp, Mus musculus
ttcttccaactcacatttcacaaac

SEQ ID NO: 944538 - DNA, 25 bp, Mus musculus
ttcttccaactctcatttcacaaac

SEQ ID NO: 944539 - DNA, 25 bp, Mus musculus
ttcttccaagtgagattcaactaga

SEQ ID NO: 944540 - DNA, 25 bp, Mus musculus
ttcttccaagtgtgattcaactaga

SEQ ID NO: 944541 - DNA, 25 bp, Mus musculus
ttcttccaatttcttgttcctgctg

SEQ ID NO: 944542 - DNA, 25 bp, Mus musculus
ttcttccaatttgttgttcctgctg

SEQ ID NO: 944543 - DNA, 25 bp, Mus musculus
ttcttccacagtccatagaataagg

SEQ ID NO: 944544 - DNA, 25 bp, Mus musculus
ttcttccacagtgcatagaataagg

SEQ ID NO: 944545 - DNA, 25 bp, Mus musculus
ttcttccaccctagaggcagggtag

SEQ ID NO: 944546 - DNA, 25 bp, Mus musculus
ttcttccacccttgaggcagggtag

SEQ ID NO: 944547 - DNA, 25 bp, Mus musculus
ttcttccacctccaagtatgtgtgt

SEQ ID NO: 944548 - DNA, 25 bp, Mus musculus
ttcttccacctcgaagtatgtgtgt

SEQ ID NO: 944549 - DNA, 25 bp, Mus musculus
ttcttccactgaatgggcattgtgc

SEQ ID NO: 944550 - DNA, 25 bp, Mus musculus
ttcttccactgattgggcattgtgc

SEQ ID NO: 944551 - DNA, 25 bp, Mus musculus
ttcttccactgtctatcactgacat

SEQ ID NO: 944552 - DNA, 25 bp, Mus musculus
ttcttccactgtgtatcactgacat

SEQ ID NO: 944553 - DNA, 25 bp, Mus musculus
ttcttccagaatatgctacccttga

SEQ ID NO: 944554 - DNA, 25 bp, Mus musculus
ttcttccagaatttgctacccttga

SEQ ID NO: 944555 - DNA, 25 bp, Mus musculus
ttcttccagacaatccttgtgacta

SEQ ID NO: 944556 - DNA, 25 bp, Mus musculus
ttcttccagacattccttgtgacta

SEQ ID NO: 944557 - DNA, 25 bp, Mus musculus
ttcttccagaggctcccagtgacca

SEQ ID NO: 944558 - DNA, 25 bp, Mus musculus
ttcttccagagggtcccagtgacca

SEQ ID NO: 944559 - DNA, 25 bp, Mus musculus
ttcttccagctcaactcgtaaaagg

SEQ ID NO: 944560 - DNA, 25 bp, Mus musculus
ttcttccagctctactcgtaaaagg

SEQ ID NO: 944561 - DNA, 25 bp, Mus musculus
ttcttccaggctaggacgtatccct

SEQ ID NO: 944562 - DNA, 25 bp, Mus musculus
ttcttccaggcttggacgtatccct

SEQ ID NO: 944563 - DNA, 25 bp, Mus musculus
ttcttccagggcacaggaagccagg

SEQ ID NO: 944564 - DNA, 25 bp, Mus musculus
ttcttccagggctcaggaagccagg

SEQ ID NO: 944565 - DNA, 25 bp, Mus musculus
ttcttccagggtacgaaactttatg

SEQ ID NO: 944566 - DNA, 25 bp, Mus musculus
ttcttccagggttcgaaactttatg

SEQ ID NO: 944567 - DNA, 25 bp, Mus musculus
ttcttccagtccatcactttcagat

SEQ ID NO: 944568 - DNA, 25 bp, Mus musculus
ttcttccagtccctgttgggtccag

SEQ ID NO: 944569 - DNA, 25 bp, Mus musculus
ttcttccagtccgtgttgggtccag

SEQ ID NO: 944570 - DNA, 25 bp, Mus musculus
ttcttccagtccttcactttcagat

SEQ ID NO: 944571 - DNA, 25 bp, Mus musculus
ttcttccataaaatgcctcagtcat

SEQ ID NO: 944572 - DNA, 25 bp, Mus musculus
ttcttccataaattgcctcagtcat

SEQ ID NO: 944573 - DNA, 25 bp, Mus musculus
ttcttccatcatcatgagctgttga

SEQ ID NO: 944574 - DNA, 25 bp, Mus musculus
ttcttccatcatgatgagctgttga

SEQ ID NO: 944575 - DNA, 25 bp, Mus musculus
ttcttccatcttacttgagcagcat

SEQ ID NO: 944576 - DNA, 25 bp, Mus musculus
ttcttccatctttcttgagcagcat

SEQ ID NO: 944577 - DNA, 25 bp, Mus musculus
ttcttccatggcattacacgtgtca

SEQ ID NO: 944578 - DNA, 25 bp, Mus musculus
ttcttccatggctttacacgtgtca

SEQ ID NO: 944579 - DNA, 25 bp, Mus musculus
ttcttcccaattacatggtctcatc

SEQ ID NO: 944580 - DNA, 25 bp, Mus musculus
ttcttcccaatttcatggtctcatc

SEQ ID NO: 944581 - DNA, 25 bp, Mus musculus
ttcttcccagatagtgcgttgccgc

SEQ ID NO: 944582 - DNA, 25 bp, Mus musculus
ttcttcccagattgtgcgttgccgc

SEQ ID NO: 944583 - DNA, 25 bp, Mus musculus
ttcttcccagctcctagtagataga

SEQ ID NO: 944584 - DNA, 25 bp, Mus musculus
ttcttcccagctgctagtagataga

SEQ ID NO: 944585 - DNA, 25 bp, Mus musculus
ttcttcccagtgactgcaacattgt

SEQ ID NO: 944586 - DNA, 25 bp, Mus musculus
ttcttcccagtgtctgcaacattgt

SEQ ID NO: 944587 - DNA, 25 bp, Mus musculus
ttcttccccagaagcagttggttga

SEQ ID NO: 944588 - DNA, 25 bp, Mus musculus
ttcttccccagacgttctaatgtct

SEQ ID NO: 944589 - DNA, 25 bp, Mus musculus
ttcttccccagaggttctaatgtct

SEQ ID NO: 944590 - DNA, 25 bp, Mus musculus
ttcttccccagatgcagttggttga

SEQ ID NO: 944591 - DNA, 25 bp, Mus musculus
ttcttccccaggaatatcaaggctg

SEQ ID NO: 944592 - DNA, 25 bp, Mus musculus
ttcttccccaggtatatcaaggctg

SEQ ID NO: 944593 - DNA, 25 bp, Mus musculus
ttcttccccgacatcgtcttcgtct

SEQ ID NO: 944594 - DNA, 25 bp, Mus musculus
ttcttccccgacttcgtcttcgtct

SEQ ID NO: 944595 - DNA, 25 bp, Mus musculus
ttcttccccttgatggatttcatac

SEQ ID NO: 944596 - DNA, 25 bp, Mus musculus
ttcttccccttgcaggcttggcaga

SEQ ID NO: 944597 - DNA, 25 bp, Mus musculus
ttcttccccttggaggcttggcaga

SEQ ID NO: 944598 - DNA, 25 bp, Mus musculus
ttcttccccttgttggatttcatac

SEQ ID NO: 944599 - DNA, 25 bp, Mus musculus
ttcttcccggcacgcatatgtgcag

SEQ ID NO: 944600 - DNA, 25 bp, Mus musculus
ttcttcccggcaggcatatgtgcag

SEQ ID NO: 944601 - DNA, 25 bp, Mus musculus
ttcttccctaatcacttgagtgtat

SEQ ID NO: 944602 - DNA, 25 bp, Mus musculus
ttcttccctaatgacttgagtgtat

SEQ ID NO: 944603 - DNA, 25 bp, Mus musculus
ttcttccctaggcagaaaccgttgg

SEQ ID NO: 944604 - DNA, 25 bp, Mus musculus
ttcttccctagggagaaaccgttgg

SEQ ID NO: 944605 - DNA, 25 bp, Mus musculus
ttcttccctcacatgactttatcat

SEQ ID NO: 944606 - DNA, 25 bp, Mus musculus
ttcttccctcacttgactttatcat

SEQ ID NO: 944607 - DNA, 25 bp, Mus musculus
ttcttccctcagctctgacaactaa

SEQ ID NO: 944608 - DNA, 25 bp, Mus musculus
ttcttccctcaggtctgacaactaa

SEQ ID NO: 944609 - DNA, 25 bp, Mus musculus
ttcttccctcccaaatgatgtgtgc

SEQ ID NO: 944610 - DNA, 25 bp, Mus musculus
ttcttccctccctaatgatgtgtgc

SEQ ID NO: 944611 - DNA, 25 bp, Mus musculus
ttcttccctctgaaagcacatacat

SEQ ID NO: 944612 - DNA, 25 bp, Mus musculus
ttcttccctctgtaagcacatacat

SEQ ID NO: 944613 - DNA, 25 bp, Mus musculus
ttcttccctgaccacgtggagctga

SEQ ID NO: 944614 - DNA, 25 bp, Mus musculus
ttcttccctgacgacgtggagctga

SEQ ID NO: 944615 - DNA, 25 bp, Mus musculus
ttcttccctggcaagatatgtagtt

SEQ ID NO: 944616 - DNA, 25 bp, Mus musculus
ttcttccctggctagatatgtagtt

SEQ ID NO: 944617 - DNA, 25 bp, Mus musculus
ttcttccgaagcaatgcccaggtaa

SEQ ID NO: 944618 - DNA, 25 bp, Mus musculus
ttcttccgaagctatgcccaggtaa

SEQ ID NO: 944619 - DNA, 25 bp, Mus musculus
ttcttccgctatctgaaggcaaagg

SEQ ID NO: 944620 - DNA, 25 bp, Mus musculus
ttcttccgctatgtgaaggcaaagg

SEQ ID NO: 944621 - DNA, 25 bp, Mus musculus
ttcttccggctaagtgctaggctta

SEQ ID NO: 944622 - DNA, 25 bp, Mus musculus
ttcttccggctatgtgctaggctta

SEQ ID NO: 944623 - DNA, 25 bp, Mus musculus
ttcttccgggacatcggtttcgaag

SEQ ID NO: 944624 - DNA, 25 bp, Mus musculus
ttcttccgggacttcggtttcgaag

SEQ ID NO: 944625 - DNA, 25 bp, Mus musculus
ttcttcctagatcatgggtgtgtta

SEQ ID NO: 944626 - DNA, 25 bp, Mus musculus
ttcttcctagatgatgggtgtgtta

SEQ ID NO: 944627 - DNA, 25 bp, Mus musculus
ttcttcctagcaagtcggtcacaat

SEQ ID NO: 944628 - DNA, 25 bp, Mus musculus
ttcttcctagcatgtcggtcacaat

SEQ ID NO: 944629 - DNA, 25 bp, Mus musculus
ttcttcctaggacctcagagtttgc

SEQ ID NO: 944630 - DNA, 25 bp, Mus musculus
ttcttcctaggagctcagagtttgc

SEQ ID NO: 944631 - DNA, 25 bp, Mus musculus
ttcttcctatccagttaaccagcag

SEQ ID NO: 944632 - DNA, 25 bp, Mus musculus
ttcttcctatcctgttaaccagcag

SEQ ID NO: 944633 - DNA, 25 bp, Mus musculus
ttcttcctcagcacgatcttccaaa

SEQ ID NO: 944634 - DNA, 25 bp, Mus musculus
ttcttcctcagctcgatcttccaaa

SEQ ID NO: 944635 - DNA, 25 bp, Mus musculus
ttcttcctcattatgttccttcata

SEQ ID NO: 944636 - DNA, 25 bp, Mus musculus
ttcttcctcattctcttgaaagatt

SEQ ID NO: 944637 - DNA, 25 bp, Mus musculus
ttcttcctcattgtcttgaaagatt

SEQ ID NO: 944638 - DNA, 25 bp, Mus musculus
ttcttcctcattttgttccttcata

SEQ ID NO: 944639 - DNA, 25 bp, Mus musculus
ttcttcctccacagatgccctgagg

SEQ ID NO: 944640 - DNA, 25 bp, Mus musculus
ttcttcctccactgatgccctgagg

SEQ ID NO: 944641 - DNA, 25 bp, Mus musculus
ttcttcctcctaagacacggttcat

SEQ ID NO: 944642 - DNA, 25 bp, Mus musculus
ttcttcctcctatgacacggttcat

SEQ ID NO: 944643 - DNA, 25 bp, Mus musculus
ttcttcctcgtgatgtgttcctttt

SEQ ID NO: 944644 - DNA, 25 bp, Mus musculus
ttcttcctcgtgttgtgttcctttt

SEQ ID NO: 944645 - DNA, 25 bp, Mus musculus
ttcttcctctcacaccattgtggag

SEQ ID NO: 944646 - DNA, 25 bp, Mus musculus
ttcttcctctcagaccattgtggag

SEQ ID NO: 944647 - DNA, 25 bp, Mus musculus
ttcttcctctctagtggccaataat

SEQ ID NO: 944648 - DNA, 25 bp, Mus musculus
ttcttcctctcttgtggccaataat

SEQ ID NO: 944649 - DNA, 25 bp, Mus musculus
ttcttcctcttaaggcaccgataat

SEQ ID NO: 944650 - DNA, 25 bp, Mus musculus
ttcttcctcttatggcaccgataat

SEQ ID NO: 944651 - DNA, 25 bp, Mus musculus
ttcttcctcttcagaagcctatact

SEQ ID NO: 944652 - DNA, 25 bp, Mus musculus
ttcttcctcttcctgatatgcaagt

SEQ ID NO: 944653 - DNA, 25 bp, Mus musculus
ttcttcctcttcgtgatatgcaagt

SEQ ID NO: 944654 - DNA, 25 bp, Mus musculus
ttcttcctcttctgaagcctatact

SEQ ID NO: 944655 - DNA, 25 bp, Mus musculus
ttcttcctctttcccataacagaag

SEQ ID NO: 944656 - DNA, 25 bp, Mus musculus
ttcttcctctttgccataacagaag

SEQ ID NO: 944657 - DNA, 25 bp, Mus musculus
ttcttcctgagactctgaacctaga

SEQ ID NO: 944658 - DNA, 25 bp, Mus musculus
ttcttcctgagagtctgaacctaga

SEQ ID NO: 944659 - DNA, 25 bp, Mus musculus
ttcttcctgattaagctgctgtgca

SEQ ID NO: 944660 - DNA, 25 bp, Mus musculus
ttcttcctgatttagctgctgtgca

SEQ ID NO: 944661 - DNA, 25 bp, Mus musculus
ttcttcctgcgtcagtctcagaagt

SEQ ID NO: 944662 - DNA, 25 bp, Mus musculus
ttcttcctgcgtgagtctcagaagt

SEQ ID NO: 944663 - DNA, 25 bp, Mus musculus
ttcttcctgctaattcatctcttga

SEQ ID NO: 944664 - DNA, 25 bp, Mus musculus
ttcttcctgctatttcatctcttga

SEQ ID NO: 944665 - DNA, 25 bp, Mus musculus
ttcttcctgctcctgggtttcgctg

SEQ ID NO: 944666 - DNA, 25 bp, Mus musculus
ttcttcctgctcgtgggtttcgctg

SEQ ID NO: 944667 - DNA, 25 bp, Mus musculus
ttcttcctggacaaagactctcggg

SEQ ID NO: 944668 - DNA, 25 bp, Mus musculus
ttcttcctggactaagactctcggg

SEQ ID NO: 944669 - DNA, 25 bp, Mus musculus
ttcttcctggctattcttggagctg

SEQ ID NO: 944670 - DNA, 25 bp, Mus musculus
ttcttcctggcttttcttggagctg

SEQ ID NO: 944671 - DNA, 25 bp, Mus musculus
ttcttcctgtggagaatcaaccaaa

SEQ ID NO: 944672 - DNA, 25 bp, Mus musculus
ttcttcctgtggtgaatcaaccaaa

SEQ ID NO: 944673 - DNA, 25 bp, Mus musculus
ttcttcctgttcatacagtgccata

SEQ ID NO: 944674 - DNA, 25 bp, Mus musculus
ttcttcctgttcttacagtgccata

SEQ ID NO: 944675 - DNA, 25 bp, Mus musculus
ttcttccttcatcaggacagagcta

SEQ ID NO: 944676 - DNA, 25 bp, Mus musculus
ttcttccttcatgaggacagagcta

SEQ ID NO: 944677 - DNA, 25 bp, Mus musculus
ttcttccttccaatggttcaacaca

SEQ ID NO: 944678 - DNA, 25 bp, Mus musculus
ttcttccttccattggttcaacaca

SEQ ID NO: 944679 - DNA, 25 bp, Mus musculus
ttcttccttctgaaaactgtgacca

SEQ ID NO: 944680 - DNA, 25 bp, Mus musculus
ttcttccttctgtaaactgtgacca

SEQ ID NO: 944681 - DNA, 25 bp, Mus musculus
ttcttccttggaagctggcctggac

SEQ ID NO: 944682 - DNA, 25 bp, Mus musculus
ttcttccttggatgctggcctggac

SEQ ID NO: 944683 - DNA, 25 bp, Mus musculus
ttcttcctttatatgttgtattggg

SEQ ID NO: 944684 - DNA, 25 bp, Mus musculus
ttcttcctttatttgttgtattggg

SEQ ID NO: 944685 - DNA, 25 bp, Mus musculus
ttcttcctttctattcccaagtagt

SEQ ID NO: 944686 - DNA, 25 bp, Mus musculus
ttcttcctttcttttcccaagtagt

SEQ ID NO: 944687 - DNA, 25 bp, Mus musculus
ttcttcgacaagatgaaccaaagga

SEQ ID NO: 944688 - DNA, 25 bp, Mus musculus
ttcttcgacaagttgaaccaaagga

SEQ ID NO: 944689 - DNA, 25 bp, Mus musculus
ttcttcgacgtgctcatctgtttct

SEQ ID NO: 944690 - DNA, 25 bp, Mus musculus
ttcttcgacgtggtcatctgtttct

SEQ ID NO: 944691 - DNA, 25 bp, Mus musculus
ttcttcgaggaaccagctgccttct

SEQ ID NO: 944692 - DNA, 25 bp, Mus musculus
ttcttcgaggaagcagctgccttct

SEQ ID NO: 944693 - DNA, 25 bp, Mus musculus
ttcttcgcacatctgcacagtgctg

SEQ ID NO: 944694 - DNA, 25 bp, Mus musculus
ttcttcgcacatgtgcacagtgctg

SEQ ID NO: 944695 - DNA, 25 bp, Mus musculus
ttcttcggaacacaacaggttgcct

SEQ ID NO: 944696 - DNA, 25 bp, Mus musculus
ttcttcggaacagaacaggttgcct

SEQ ID NO: 944697 - DNA, 25 bp, Mus musculus
ttcttcggaccacatttcatcacag

SEQ ID NO: 944698 - DNA, 25 bp, Mus musculus
ttcttcggaccacggacacgactca

SEQ ID NO: 944699 - DNA, 25 bp, Mus musculus
ttcttcggaccagatttcatcacag

SEQ ID NO: 944700 - DNA, 25 bp, Mus musculus
ttcttcggaccagggacacgactca

SEQ ID NO: 944701 - DNA, 25 bp, Mus musculus
ttcttcggatcaattgcttggaaag

SEQ ID NO: 944702 - DNA, 25 bp, Mus musculus
ttcttcggatcatttgcttggaaag

SEQ ID NO: 944703 - DNA, 25 bp, Mus musculus
ttcttcggatgaacgggctctcact

SEQ ID NO: 944704 - DNA, 25 bp, Mus musculus
ttcttcggatgatcgggctctcact

SEQ ID NO: 944705 - DNA, 25 bp, Mus musculus
ttcttcgggatcctccagatgatga

SEQ ID NO: 944706 - DNA, 25 bp, Mus musculus
ttcttcgggatcgtccagatgatga

SEQ ID NO: 944707 - DNA, 25 bp, Mus musculus
ttcttcgggtcccagaacaacttct

SEQ ID NO: 944708 - DNA, 25 bp, Mus musculus
ttcttcgggtccgagaacaacttct

SEQ ID NO: 944709 - DNA, 25 bp, Mus musculus
ttcttcgggtctctgggacttctag

SEQ ID NO: 944710 - DNA, 25 bp, Mus musculus
ttcttcgggtctgtgggacttctag

SEQ ID NO: 944711 - DNA, 25 bp, Mus musculus
ttcttcgtaatgagagatgttcctc

SEQ ID NO: 944712 - DNA, 25 bp, Mus musculus
ttcttcgtaatgtgagatgttcctc

SEQ ID NO: 944713 - DNA, 25 bp, Mus musculus
ttcttcgtatcacggtctgcactaa

SEQ ID NO: 944714 - DNA, 25 bp, Mus musculus
ttcttcgtatcagggtctgcactaa

SEQ ID NO: 944715 - DNA, 25 bp, Mus musculus
ttcttcgtatgaccagttcttaact

SEQ ID NO: 944716 - DNA, 25 bp, Mus musculus
ttcttcgtatgagcagttcttaact

SEQ ID NO: 944717 - DNA, 25 bp, Mus musculus
ttcttcgtattccacagctacagtt

SEQ ID NO: 944718 - DNA, 25 bp, Mus musculus
ttcttcgtattcgacagctacagtt

SEQ ID NO: 944719 - DNA, 25 bp, Mus musculus
ttcttcgtcatgaacttgctggagg

SEQ ID NO: 944720 - DNA, 25 bp, Mus musculus
ttcttcgtcatgtacttgctggagg

SEQ ID NO: 944721 - DNA, 25 bp, Mus musculus
ttcttcgtcctcaccaagcaggaag

SEQ ID NO: 944722 - DNA, 25 bp, Mus musculus
ttcttcgtcctctccaagcaggaag

SEQ ID NO: 944723 - DNA, 25 bp, Mus musculus
ttcttcgtgcaaagttgtatttttc

SEQ ID NO: 944724 - DNA, 25 bp, Mus musculus
ttcttcgtgcaatgttgtatttttc

SEQ ID NO: 944725 - DNA, 25 bp, Mus musculus
ttcttcgttcccaatgctcacagtt

SEQ ID NO: 944726 - DNA, 25 bp, Mus musculus
ttcttcgttccctatgctcacagtt

SEQ ID NO: 944727 - DNA, 25 bp, Mus musculus
ttcttctaaaaactcggcgcatcct

SEQ ID NO: 944728 - DNA, 25 bp, Mus musculus
ttcttctaaaaagtcggcgcatcct

SEQ ID NO: 944729 - DNA, 25 bp, Mus musculus
ttcttctaaaagcagtacccgtggg

SEQ ID NO: 944730 - DNA, 25 bp, Mus musculus
ttcttctaaaaggagtacccgtggg

SEQ ID NO: 944731 - DNA, 25 bp, Mus musculus
ttcttctaactgcacctgccaagtt

SEQ ID NO: 944732 - DNA, 25 bp, Mus musculus
ttcttctaactggacctgccaagtt

SEQ ID NO: 944733 - DNA, 25 bp, Mus musculus
ttcttctaagtgcaagccttctgtc

SEQ ID NO: 944734 - DNA, 25 bp, Mus musculus
ttcttctaagtggaagccttctgtc

SEQ ID NO: 944735 - DNA, 25 bp, Mus musculus
ttcttctacattcgaggcaccaacg

SEQ ID NO: 944736 - DNA, 25 bp, Mus musculus
ttcttctacattggaggcaccaacg

SEQ ID NO: 944737 - DNA, 25 bp, Mus musculus
ttcttctaccctacccttgccctca

SEQ ID NO: 944738 - DNA, 25 bp, Mus musculus
ttcttctacccttcccttgccctca

SEQ ID NO: 944739 - DNA, 25 bp, Mus musculus
ttcttctactagatcattcttcctg

SEQ ID NO: 944740 - DNA, 25 bp, Mus musculus
ttcttctactagttcattcttcctg

SEQ ID NO: 944741 - DNA, 25 bp, Mus musculus
ttcttctactctccaggaggcttca

SEQ ID NO: 944742 - DNA, 25 bp, Mus musculus
ttcttctactctgcaggaggcttca

SEQ ID NO: 944743 - DNA, 25 bp, Mus musculus
ttcttctatgcgcagttggccacga

SEQ ID NO: 944744 - DNA, 25 bp, Mus musculus
ttcttctatgcggagttggccacga

SEQ ID NO: 944745 - DNA, 25 bp, Mus musculus
ttcttctatggtcaactgaacccca

SEQ ID NO: 944746 - DNA, 25 bp, Mus musculus
ttcttctatggtgaactgaacccca

SEQ ID NO: 944747 - DNA, 25 bp, Mus musculus
ttcttctattggacttgtctatccc

SEQ ID NO: 944748 - DNA, 25 bp, Mus musculus
ttcttctattggtcttgtctatccc

SEQ ID NO: 944749 - DNA, 25 bp, Mus musculus
ttcttctcaaatacttgtttcacat

SEQ ID NO: 944750 - DNA, 25 bp, Mus musculus
ttcttctcaaattcttgtttcacat

SEQ ID NO: 944751 - DNA, 25 bp, Mus musculus
ttcttctcagacataccgtaggagc

SEQ ID NO: 944752 - DNA, 25 bp, Mus musculus
ttcttctcagacttaccgtaggagc

SEQ ID NO: 944753 - DNA, 25 bp, Mus musculus
ttcttctcagtgaccaagccagcaa

SEQ ID NO: 944754 - DNA, 25 bp, Mus musculus
ttcttctcagtgtccaagccagcaa

SEQ ID NO: 944755 - DNA, 25 bp, Mus musculus
ttcttctccagcagttgcatgcgcg

SEQ ID NO: 944756 - DNA, 25 bp, Mus musculus
ttcttctccagctgttgcatgcgcg

SEQ ID NO: 944757 - DNA, 25 bp, Mus musculus
ttcttctccgagatccagatgaatt

SEQ ID NO: 944758 - DNA, 25 bp, Mus musculus
ttcttctccgagttccagatgaatt

SEQ ID NO: 944759 - DNA, 25 bp, Mus musculus
ttcttctcctgcagcatgtcagcat

SEQ ID NO: 944760 - DNA, 25 bp, Mus musculus
ttcttctcctgctgcatgtcagcat

SEQ ID NO: 944761 - DNA, 25 bp, Mus musculus
ttcttctccttcatgcaggacacaa

SEQ ID NO: 944762 - DNA, 25 bp, Mus musculus
ttcttctccttcttgcaggacacaa

SEQ ID NO: 944763 - DNA, 25 bp, Mus musculus
ttcttctcctttcctgacagagcag

SEQ ID NO: 944764 - DNA, 25 bp, Mus musculus
ttcttctcctttgctgacagagcag

SEQ ID NO: 944765 - DNA, 25 bp, Mus musculus
ttcttctcggccatctaactggttc

SEQ ID NO: 944766 - DNA, 25 bp, Mus musculus
ttcttctcggccttctaactggttc

SEQ ID NO: 944767 - DNA, 25 bp, Mus musculus
ttcttctctaaccttcaaaactgcc

SEQ ID NO: 944768 - DNA, 25 bp, Mus musculus
ttcttctctaacgttcaaaactgcc

SEQ ID NO: 944769 - DNA, 25 bp, Mus musculus
ttcttctctagtatgattccttcag

SEQ ID NO: 944770 - DNA, 25 bp, Mus musculus
ttcttctctagtttgattccttcag

SEQ ID NO: 944771 - DNA, 25 bp, Mus musculus
ttcttctctatgatcccaccagaat

SEQ ID NO: 944772 - DNA, 25 bp, Mus musculus
ttcttctctatgttcccaccagaat

SEQ ID NO: 944773 - DNA, 25 bp, Mus musculus
ttcttctctcatacattacatacat

SEQ ID NO: 944774 - DNA, 25 bp, Mus musculus
ttcttctctcattcattacatacat

SEQ ID NO: 944775 - DNA, 25 bp, Mus musculus
ttcttctctcctataggcaagcact

SEQ ID NO: 944776 - DNA, 25 bp, Mus musculus
ttcttctctcctttaggcaagcact

SEQ ID NO: 944777 - DNA, 25 bp, Mus musculus
ttcttctctcgaagctgtgtgtgta

SEQ ID NO: 944778 - DNA, 25 bp, Mus musculus
ttcttctctcgatgctgtgtgtgta

SEQ ID NO: 944779 - DNA, 25 bp, Mus musculus
ttcttctctcttcgatctttagcca

SEQ ID NO: 944780 - DNA, 25 bp, Mus musculus
ttcttctctcttggatctttagcca

SEQ ID NO: 944781 - DNA, 25 bp, Mus musculus
ttcttctctggaacattggctgcaa

SEQ ID NO: 944782 - DNA, 25 bp, Mus musculus
ttcttctctggatcattggctgcaa

SEQ ID NO: 944783 - DNA, 25 bp, Mus musculus
ttcttctctggcatagtatgggctt

SEQ ID NO: 944784 - DNA, 25 bp, Mus musculus
ttcttctctggcttagtatgggctt

SEQ ID NO: 944785 - DNA, 25 bp, Mus musculus
ttcttctctgtaaaccttgtgactt

SEQ ID NO: 944786 - DNA, 25 bp, Mus musculus
ttcttctctgtataccttgtgactt

SEQ ID NO: 944787 - DNA, 25 bp, Mus musculus
ttcttctctgtcaggctcttattca

SEQ ID NO: 944788 - DNA, 25 bp, Mus musculus
ttcttctctgtctggctcttattca

SEQ ID NO: 944789 - DNA, 25 bp, Mus musculus
ttcttctctgttatgtccacataca

SEQ ID NO: 944790 - DNA, 25 bp, Mus musculus
ttcttctctgttttgtccacataca

SEQ ID NO: 944791 - DNA, 25 bp, Mus musculus
ttcttctcttatctccaaagccaga

SEQ ID NO: 944792 - DNA, 25 bp, Mus musculus
ttcttctcttatgtccaaagccaga

SEQ ID NO: 944793 - DNA, 25 bp, Mus musculus
ttcttctcttcacgatgtagtcaga

SEQ ID NO: 944794 - DNA, 25 bp, Mus musculus
ttcttctcttcaggatgtagtcaga

SEQ ID NO: 944795 - DNA, 25 bp, Mus musculus
ttcttctcttctatcatccaaatca

SEQ ID NO: 944796 - DNA, 25 bp, Mus musculus
ttcttctcttctttcatccaaatca

SEQ ID NO: 944797 - DNA, 25 bp, Mus musculus
ttcttctgagatccctacttgcttt

SEQ ID NO: 944798 - DNA, 25 bp, Mus musculus
ttcttctgagatgcctacttgcttt

SEQ ID NO: 944799 - DNA, 25 bp, Mus musculus
ttcttctgataaatccactccacta

SEQ ID NO: 944800 - DNA, 25 bp, Mus musculus
ttcttctgataattccactccacta

SEQ ID NO: 944801 - DNA, 25 bp, Mus musculus
ttcttctgatcgatgtgggtttttt

SEQ ID NO: 944802 - DNA, 25 bp, Mus musculus
ttcttctgatcgttgtgggtttttt

SEQ ID NO: 944803 - DNA, 25 bp, Mus musculus
ttcttctgatgtccagctgaccact

SEQ ID NO: 944804 - DNA, 25 bp, Mus musculus
ttcttctgatgtgcagctgaccact

SEQ ID NO: 944805 - DNA, 25 bp, Mus musculus
ttcttctgattcacttacccatctg

SEQ ID NO: 944806 - DNA, 25 bp, Mus musculus
ttcttctgattctcttacccatctg

SEQ ID NO: 944807 - DNA, 25 bp, Mus musculus
ttcttctgcaaacccaccattgtat

SEQ ID NO: 944808 - DNA, 25 bp, Mus musculus
ttcttctgcaaagccaccattgtat

SEQ ID NO: 944809 - DNA, 25 bp, Mus musculus
ttcttctgcctcatacaggagaact

SEQ ID NO: 944810 - DNA, 25 bp, Mus musculus
ttcttctgcctcttacaggagaact

SEQ ID NO: 944811 - DNA, 25 bp, Mus musculus
ttcttctgcctgagttggtcatgta

SEQ ID NO: 944812 - DNA, 25 bp, Mus musculus
ttcttctgcctgtgttggtcatgta

SEQ ID NO: 944813 - DNA, 25 bp, Mus musculus
ttcttctgccttccaaaatcttagt

SEQ ID NO: 944814 - DNA, 25 bp, Mus musculus
ttcttctgccttgcaaaatcttagt

SEQ ID NO: 944815 - DNA, 25 bp, Mus musculus
ttcttctgctgaaggcagggcagct

SEQ ID NO: 944816 - DNA, 25 bp, Mus musculus
ttcttctgctgatggcagggcagct

SEQ ID NO: 944817 - DNA, 25 bp, Mus musculus
ttcttctggcagagactgggtattc

SEQ ID NO: 944818 - DNA, 25 bp, Mus musculus
ttcttctggcagcaagttctggatt

SEQ ID NO: 944819 - DNA, 25 bp, Mus musculus
ttcttctggcaggaagttctggatt

SEQ ID NO: 944820 - DNA, 25 bp, Mus musculus
ttcttctggcagtgactgggtattc

SEQ ID NO: 944821 - DNA, 25 bp, Mus musculus
ttcttctggcataaaaggctcgttt

SEQ ID NO: 944822 - DNA, 25 bp, Mus musculus
ttcttctggcattaaaggctcgttt

SEQ ID NO: 944823 - DNA, 25 bp, Mus musculus
ttcttctgggacatggaaagcctgt

SEQ ID NO: 944824 - DNA, 25 bp, Mus musculus
ttcttctgggacttggaaagcctgt

SEQ ID NO: 944825 - DNA, 25 bp, Mus musculus
ttcttctgggatcggcagatttgca

SEQ ID NO: 944826 - DNA, 25 bp, Mus musculus
ttcttctgggatgggcagatttgca

SEQ ID NO: 944827 - DNA, 25 bp, Mus musculus
ttcttctgggccagctttcacagac

SEQ ID NO: 944828 - DNA, 25 bp, Mus musculus
ttcttctgggcctgctttcacagac

SEQ ID NO: 944829 - DNA, 25 bp, Mus musculus
ttcttctggtacacggtctagcaaa

SEQ ID NO: 944830 - DNA, 25 bp, Mus musculus
ttcttctggtactcggtctagcaaa

SEQ ID NO: 944831 - DNA, 25 bp, Mus musculus
ttcttctggttgcttgcccccaacg

SEQ ID NO: 944832 - DNA, 25 bp, Mus musculus
ttcttctggttggttgcccccaacg

SEQ ID NO: 944833 - DNA, 25 bp, Mus musculus
ttcttctgtcatccattttcctaaa

SEQ ID NO: 944834 - DNA, 25 bp, Mus musculus
ttcttctgtcatgcattttcctaaa

SEQ ID NO: 944835 - DNA, 25 bp, Mus musculus
ttcttctgtgtcagatatgtccaat

SEQ ID NO: 944836 - DNA, 25 bp, Mus musculus
ttcttctgtgtctgatatgtccaat

SEQ ID NO: 944837 - DNA, 25 bp, Mus musculus
ttcttctgttgacggacactaggct

SEQ ID NO: 944838 - DNA, 25 bp, Mus musculus
ttcttctgttgagggacactaggct

SEQ ID NO: 944839 - DNA, 25 bp, Mus musculus
ttcttcttaagcatcatgggtgtgt

SEQ ID NO: 944840 - DNA, 25 bp, Mus musculus
ttcttcttaagcttcatgggtgtgt

SEQ ID NO: 944841 - DNA, 25 bp, Mus musculus
ttcttcttaattcatcatgttggca

SEQ ID NO: 944842 - DNA, 25 bp, Mus musculus
ttcttcttaattgatcatgttggca

SEQ ID NO: 944843 - DNA, 25 bp, Mus musculus
ttcttcttactacggcttgccagga

SEQ ID NO: 944844 - DNA, 25 bp, Mus musculus
ttcttcttactagggcttgccagga

SEQ ID NO: 944845 - DNA, 25 bp, Mus musculus
ttcttcttactgcagagtataaccc

SEQ ID NO: 944846 - DNA, 25 bp, Mus musculus
ttcttcttactggagagtataaccc

SEQ ID NO: 944847 - DNA, 25 bp, Mus musculus
ttcttcttacttctcatcccagaga

SEQ ID NO: 944848 - DNA, 25 bp, Mus musculus
ttcttcttacttgtcatcccagaga

SEQ ID NO: 944849 - DNA, 25 bp, Mus musculus
ttcttcttagatcctaaccctgggc

SEQ ID NO: 944850 - DNA, 25 bp, Mus musculus
ttcttcttagatgctaaccctgggc

SEQ ID NO: 944851 - DNA, 25 bp, Mus musculus
ttcttcttagctacacttctagcga

SEQ ID NO: 944852 - DNA, 25 bp, Mus musculus
ttcttcttagcttcacttctagcga

SEQ ID NO: 944853 - DNA, 25 bp, Mus musculus
ttcttcttagtacttcccctatctg

SEQ ID NO: 944854 - DNA, 25 bp, Mus musculus
ttcttcttagtagttcccctatctg

SEQ ID NO: 944855 - DNA, 25 bp, Mus musculus
ttcttcttcatcactttcgactatt

SEQ ID NO: 944856 - DNA, 25 bp, Mus musculus
ttcttcttcatctctttcgactatt

SEQ ID NO: 944857 - DNA, 25 bp, Mus musculus
ttcttcttccagcaagttcagccct

SEQ ID NO: 944858 - DNA, 25 bp, Mus musculus
ttcttcttccaggaagttcagccct

SEQ ID NO: 944859 - DNA, 25 bp, Mus musculus
ttcttcttccatatgactttagctg

SEQ ID NO: 944860 - DNA, 25 bp, Mus musculus
ttcttcttccatttgactttagctg

SEQ ID NO: 944861 - DNA, 25 bp, Mus musculus
ttcttcttccttctatttcctcatt

SEQ ID NO: 944862 - DNA, 25 bp, Mus musculus
ttcttcttccttgtatttcctcatt

SEQ ID NO: 944863 - DNA, 25 bp, Mus musculus
ttcttcttctctctggaatggctca

SEQ ID NO: 944864 - DNA, 25 bp, Mus musculus
ttcttcttctctgtggaatggctca

SEQ ID NO: 944865 - DNA, 25 bp, Mus musculus
ttcttcttgaagactttcccagtga

SEQ ID NO: 944866 - DNA, 25 bp, Mus musculus
ttcttcttgaagtctttcccagtga

SEQ ID NO: 944867 - DNA, 25 bp, Mus musculus
ttcttcttgcaacaacactggtccc

SEQ ID NO: 944868 - DNA, 25 bp, Mus musculus
ttcttcttgcaagaacactggtccc

SEQ ID NO: 944869 - DNA, 25 bp, Mus musculus
ttcttcttgcagagcctcaggcaat

SEQ ID NO: 944870 - DNA, 25 bp, Mus musculus
ttcttcttgcagtgcctcaggcaat

SEQ ID NO: 944871 - DNA, 25 bp, Mus musculus
ttcttcttgcctaggatttcagcca

SEQ ID NO: 944872 - DNA, 25 bp, Mus musculus
ttcttcttgccttggatttcagcca

SEQ ID NO: 944873 - DNA, 25 bp, Mus musculus
ttcttcttggacataagggcccaga

SEQ ID NO: 944874 - DNA, 25 bp, Mus musculus
ttcttcttggacttaagggcccaga

SEQ ID NO: 944875 - DNA, 25 bp, Mus musculus
ttcttcttggctaaacattcacctc

SEQ ID NO: 944876 - DNA, 25 bp, Mus musculus
ttcttcttggcttaacattcacctc

SEQ ID NO: 944877 - DNA, 25 bp, Mus musculus
ttcttcttgtttcctatgacctttt

SEQ ID NO: 944878 - DNA, 25 bp, Mus musculus
ttcttcttgtttgctatgacctttt

SEQ ID NO: 944879 - DNA, 25 bp, Mus musculus
ttcttctttagcaagcataccagag

SEQ ID NO: 944880 - DNA, 25 bp, Mus musculus
ttcttctttagctagcataccagag

SEQ ID NO: 944881 - DNA, 25 bp, Mus musculus
ttcttctttatcaactatccttccc

SEQ ID NO: 944882 - DNA, 25 bp, Mus musculus
ttcttctttatctactatccttccc

SEQ ID NO: 944883 - DNA, 25 bp, Mus musculus
ttcttctttgaaacctggagtcctg

SEQ ID NO: 944884 - DNA, 25 bp, Mus musculus
ttcttctttgaatcctggagtcctg

SEQ ID NO: 944885 - DNA, 25 bp, Mus musculus
ttcttctttgcccatgagtgatcag

SEQ ID NO: 944886 - DNA, 25 bp, Mus musculus
ttcttctttgccgatgagtgatcag

SEQ ID NO: 944887 - DNA, 25 bp, Mus musculus
ttcttctttgtaaatttggtgactg

SEQ ID NO: 944888 - DNA, 25 bp, Mus musculus
ttcttctttgtatatttggtgactg

SEQ ID NO: 944889 - DNA, 25 bp, Mus musculus
ttcttctttttcaccggtcgtatca

SEQ ID NO: 944890 - DNA, 25 bp, Mus musculus
ttcttctttttctccggtcgtatca

SEQ ID NO: 944891 - DNA, 25 bp, Mus musculus
ttcttgaaagccaagcagggccagg

SEQ ID NO: 944892 - DNA, 25 bp, Mus musculus
ttcttgaaagcctagcagggccagg

SEQ ID NO: 944893 - DNA, 25 bp, Mus musculus
ttcttgaaagctcctgggtgtgtgc

SEQ ID NO: 944894 - DNA, 25 bp, Mus musculus
ttcttgaaagctgctgggtgtgtgc

SEQ ID NO: 944895 - DNA, 25 bp, Mus musculus
ttcttgaaccagattgatgctacct

SEQ ID NO: 944896 - DNA, 25 bp, Mus musculus
ttcttgaaccagtttgatgctacct

SEQ ID NO: 944897 - DNA, 25 bp, Mus musculus
ttcttgaattccatggcaaacccat

SEQ ID NO: 944898 - DNA, 25 bp, Mus musculus
ttcttgaattccttggcaaacccat

SEQ ID NO: 944899 - DNA, 25 bp, Mus musculus
ttcttgaattctactcctggaggtg

SEQ ID NO: 944900 - DNA, 25 bp, Mus musculus
ttcttgaattcttctcctggaggtg

SEQ ID NO: 944901 - DNA, 25 bp, Mus musculus
ttcttgacaataagcacaataaaaa

SEQ ID NO: 944902 - DNA, 25 bp, Mus musculus
ttcttgacaatatgcacaataaaaa

SEQ ID NO: 944903 - DNA, 25 bp, Mus musculus
ttcttgacaccccacgggtatggga

SEQ ID NO: 944904 - DNA, 25 bp, Mus musculus
ttcttgacacccgacgggtatggga

SEQ ID NO: 944905 - DNA, 25 bp, Mus musculus
ttcttgacatgtacctccctataaa

SEQ ID NO: 944906 - DNA, 25 bp, Mus musculus
ttcttgacatgttcctccctataaa

SEQ ID NO: 944907 - DNA, 25 bp, Mus musculus
ttcttgaccacaatgccacggctag

SEQ ID NO: 944908 - DNA, 25 bp, Mus musculus
ttcttgaccacaccattagagcact

SEQ ID NO: 944909 - DNA, 25 bp, Mus musculus
ttcttgaccacagcattagagcact

SEQ ID NO: 944910 - DNA, 25 bp, Mus musculus
ttcttgaccacattgccacggctag

SEQ ID NO: 944911 - DNA, 25 bp, Mus musculus
ttcttgaccctgcaggccgactggg

SEQ ID NO: 944912 - DNA, 25 bp, Mus musculus
ttcttgaccctggaggccgactggg

SEQ ID NO: 944913 - DNA, 25 bp, Mus musculus
ttcttgacctccacagtaactagac

SEQ ID NO: 944914 - DNA, 25 bp, Mus musculus
ttcttgacctcctcagtaactagac

SEQ ID NO: 944915 - DNA, 25 bp, Mus musculus
ttcttgaccttcagcatttcatcat

SEQ ID NO: 944916 - DNA, 25 bp, Mus musculus
ttcttgaccttctgcatttcatcat

SEQ ID NO: 944917 - DNA, 25 bp, Mus musculus
ttcttgactaatattttaacgcatt

SEQ ID NO: 944918 - DNA, 25 bp, Mus musculus
ttcttgactaattttttaacgcatt

SEQ ID NO: 944919 - DNA, 25 bp, Mus musculus
ttcttgactgacaggtttctttctt

SEQ ID NO: 944920 - DNA, 25 bp, Mus musculus
ttcttgactgactggtttctttctt

SEQ ID NO: 944921 - DNA, 25 bp, Mus musculus
ttcttgactggcctcacccactggg

SEQ ID NO: 944922 - DNA, 25 bp, Mus musculus
ttcttgactggcgtcacccactggg

SEQ ID NO: 944923 - DNA, 25 bp, Mus musculus
ttcttgagacacaataactcatatt

SEQ ID NO: 944924 - DNA, 25 bp, Mus musculus
ttcttgagacactataactcatatt

SEQ ID NO: 944925 - DNA, 25 bp, Mus musculus
ttcttgagcgcaattctctggctac

SEQ ID NO: 944926 - DNA, 25 bp, Mus musculus
ttcttgagcgcatttctctggctac

SEQ ID NO: 944927 - DNA, 25 bp, Mus musculus
ttcttgagctaaccttgaccctggg

SEQ ID NO: 944928 - DNA, 25 bp, Mus musculus
ttcttgagctaagcttgaccctggg

SEQ ID NO: 944929 - DNA, 25 bp, Mus musculus
ttcttgagctggcagcttgttgcac

SEQ ID NO: 944930 - DNA, 25 bp, Mus musculus
ttcttgagctgggagcttgttgcac

SEQ ID NO: 944931 - DNA, 25 bp, Mus musculus
ttcttgaggcggacaacccatgggt

SEQ ID NO: 944932 - DNA, 25 bp, Mus musculus
ttcttgaggcggtcaacccatgggt

SEQ ID NO: 944933 - DNA, 25 bp, Mus musculus
ttcttgaggtagcaggacccaccca

SEQ ID NO: 944934 - DNA, 25 bp, Mus musculus
ttcttgaggtaggaggacccaccca

SEQ ID NO: 944935 - DNA, 25 bp, Mus musculus
ttcttgagtggccataaccctgtcc

SEQ ID NO: 944936 - DNA, 25 bp, Mus musculus
ttcttgagtggcgataaccctgtcc

SEQ ID NO: 944937 - DNA, 25 bp, Mus musculus
ttcttgataataattgagagctttc

SEQ ID NO: 944938 - DNA, 25 bp, Mus musculus
ttcttgataatatttgagagctttc

SEQ ID NO: 944939 - DNA, 25 bp, Mus musculus
ttcttgatcactatcaggacagctt

SEQ ID NO: 944940 - DNA, 25 bp, Mus musculus
ttcttgatcactttcaggacagctt

SEQ ID NO: 944941 - DNA, 25 bp, Mus musculus
ttcttgatcattcaacatactgctg

SEQ ID NO: 944942 - DNA, 25 bp, Mus musculus
ttcttgatcattgaacatactgctg

SEQ ID NO: 944943 - DNA, 25 bp, Mus musculus
ttcttgatgaagacgttgcccaccc

SEQ ID NO: 944944 - DNA, 25 bp, Mus musculus
ttcttgatgaagtcgttgcccaccc

SEQ ID NO: 944945 - DNA, 25 bp, Mus musculus
ttcttgatgatcacggcctacggtg

SEQ ID NO: 944946 - DNA, 25 bp, Mus musculus
ttcttgatgatctcggcctacggtg

SEQ ID NO: 944947 - DNA, 25 bp, Mus musculus
ttcttgatgctgattccgggtggag

SEQ ID NO: 944948 - DNA, 25 bp, Mus musculus
ttcttgatgctgtttccgggtggag

SEQ ID NO: 944949 - DNA, 25 bp, Mus musculus
ttcttgatgttgctggaggcgccac

SEQ ID NO: 944950 - DNA, 25 bp, Mus musculus
ttcttgatgttggtggaggcgccac

SEQ ID NO: 944951 - DNA, 25 bp, Mus musculus
ttcttgattgtgaacatgctgtaac

SEQ ID NO: 944952 - DNA, 25 bp, Mus musculus
ttcttgattgtgtacatgctgtaac

SEQ ID NO: 944953 - DNA, 25 bp, Mus musculus
ttcttgcaacgtcagccaaaccaga

SEQ ID NO: 944954 - DNA, 25 bp, Mus musculus
ttcttgcaacgtgagccaaaccaga

SEQ ID NO: 944955 - DNA, 25 bp, Mus musculus
ttcttgcacctcacacacctgtatg

SEQ ID NO: 944956 - DNA, 25 bp, Mus musculus
ttcttgcacctcagcgggacagagt

SEQ ID NO: 944957 - DNA, 25 bp, Mus musculus
ttcttgcacctctcacacctgtatg

SEQ ID NO: 944958 - DNA, 25 bp, Mus musculus
ttcttgcacctctgcgggacagagt

SEQ ID NO: 944959 - DNA, 25 bp, Mus musculus
ttcttgcacgctaggtgagcactct

SEQ ID NO: 944960 - DNA, 25 bp, Mus musculus
ttcttgcacgcttggtgagcactct

SEQ ID NO: 944961 - DNA, 25 bp, Mus musculus
ttcttgcagccaagcaggatccaga

SEQ ID NO: 944962 - DNA, 25 bp, Mus musculus
ttcttgcagccatgcaggatccaga

SEQ ID NO: 944963 - DNA, 25 bp, Mus musculus
ttcttgcagggtctccatggtttat

SEQ ID NO: 944964 - DNA, 25 bp, Mus musculus
ttcttgcagggtgtccatggtttat

SEQ ID NO: 944965 - DNA, 25 bp, Mus musculus
ttcttgcattgtcctgcagtgacgt

SEQ ID NO: 944966 - DNA, 25 bp, Mus musculus
ttcttgcattgtgctgcagtgacgt

SEQ ID NO: 944967 - DNA, 25 bp, Mus musculus
ttcttgcattttactcatcgccatg

SEQ ID NO: 944968 - DNA, 25 bp, Mus musculus
ttcttgcatttttctcatcgccatg

SEQ ID NO: 944969 - DNA, 25 bp, Mus musculus
ttcttgccaaggagactacgttcgt

SEQ ID NO: 944970 - DNA, 25 bp, Mus musculus
ttcttgccaaggtgactacgttcgt

SEQ ID NO: 944971 - DNA, 25 bp, Mus musculus
ttcttgccaatgctgctatgtctgt

SEQ ID NO: 944972 - DNA, 25 bp, Mus musculus
ttcttgccaatggtgctatgtctgt

SEQ ID NO: 944973 - DNA, 25 bp, Mus musculus
ttcttgccaccgcttagccgttagc

SEQ ID NO: 944974 - DNA, 25 bp, Mus musculus
ttcttgccaccggttagccgttagc

SEQ ID NO: 944975 - DNA, 25 bp, Mus musculus
ttcttgccagtgctctaggatctga

SEQ ID NO: 944976 - DNA, 25 bp, Mus musculus
ttcttgccagtggtctaggatctga

SEQ ID NO: 944977 - DNA, 25 bp, Mus musculus
ttcttgccatgcctacaaatgaaaa

SEQ ID NO: 944978 - DNA, 25 bp, Mus musculus
ttcttgccatgcgtacaaatgaaaa

SEQ ID NO: 944979 - DNA, 25 bp, Mus musculus
ttcttgcccactcgctgccaagagg

SEQ ID NO: 944980 - DNA, 25 bp, Mus musculus
ttcttgcccactggctgccaagagg

SEQ ID NO: 944981 - DNA, 25 bp, Mus musculus
ttcttgcccagacaactgattgtgc

SEQ ID NO: 944982 - DNA, 25 bp, Mus musculus
ttcttgcccagagaactgattgtgc

SEQ ID NO: 944983 - DNA, 25 bp, Mus musculus
ttcttgcccatcatggtcttagaca

SEQ ID NO: 944984 - DNA, 25 bp, Mus musculus
ttcttgcccatcttggtcttagaca

SEQ ID NO: 944985 - DNA, 25 bp, Mus musculus
ttcttgcccgggataggcctgggac

SEQ ID NO: 944986 - DNA, 25 bp, Mus musculus
ttcttgcccgggttaggcctgggac

SEQ ID NO: 944987 - DNA, 25 bp, Mus musculus
ttcttgccctacattcagctccttt

SEQ ID NO: 944988 - DNA, 25 bp, Mus musculus
ttcttgccctactttcagctccttt

SEQ ID NO: 944989 - DNA, 25 bp, Mus musculus
ttcttgccctcaatatgcctgtgtt

SEQ ID NO: 944990 - DNA, 25 bp, Mus musculus
ttcttgccctcattatgcctgtgtt

SEQ ID NO: 944991 - DNA, 25 bp, Mus musculus
ttcttgcccttaaaacttgacaccg

SEQ ID NO: 944992 - DNA, 25 bp, Mus musculus
ttcttgcccttataacttgacaccg

SEQ ID NO: 944993 - DNA, 25 bp, Mus musculus
ttcttgccgaccagtagagagtctt

SEQ ID NO: 944994 - DNA, 25 bp, Mus musculus
ttcttgccgacctgtagagagtctt

SEQ ID NO: 944995 - DNA, 25 bp, Mus musculus
ttcttgcctagcatgtcacatgcca

SEQ ID NO: 944996 - DNA, 25 bp, Mus musculus
ttcttgcctagcttgtcacatgcca

SEQ ID NO: 944997 - DNA, 25 bp, Mus musculus
ttcttgcctatgctgtccgccacag

SEQ ID NO: 944998 - DNA, 25 bp, Mus musculus
ttcttgcctatggtgtccgccacag

SEQ ID NO: 944999 - DNA, 25 bp, Mus musculus
ttcttgcctcccaatttagggatcg

SEQ ID NO: 945000 - DNA, 25 bp, Mus musculus
ttcttgcctccctatttagggatcg

SEQ ID NO: 945001 - DNA, 25 bp, Mus musculus
ttcttgcctcctctaaagcacagta

SEQ ID NO: 945002 - DNA, 25 bp, Mus musculus
ttcttgcctcctgtaaagcacagta

SEQ ID NO: 945003 - DNA, 25 bp, Mus musculus
ttcttgcctctgagcaggcagagaa

SEQ ID NO: 945004 - DNA, 25 bp, Mus musculus
ttcttgcctctgagtccttgaatgc

SEQ ID NO: 945005 - DNA, 25 bp, Mus musculus
ttcttgcctctgtgcaggcagagaa

SEQ ID NO: 945006 - DNA, 25 bp, Mus musculus
ttcttgcctctgtgtccttgaatgc

SEQ ID NO: 945007 - DNA, 25 bp, Mus musculus
ttcttgccttggaaatatcatgagc

SEQ ID NO: 945008 - DNA, 25 bp, Mus musculus
ttcttgccttggtaatatcatgagc

SEQ ID NO: 945009 - DNA, 25 bp, Mus musculus
ttcttgcctttcattgtgcttcagt

SEQ ID NO: 945010 - DNA, 25 bp, Mus musculus
ttcttgcctttctttgtgcttcagt

SEQ ID NO: 945011 - DNA, 25 bp, Mus musculus
ttcttgcggcggatcttgttcttgc

SEQ ID NO: 945012 - DNA, 25 bp, Mus musculus
ttcttgcggcggttcttgttcttgc

SEQ ID NO: 945013 - DNA, 25 bp, Mus musculus
ttcttgcgtgatcaggttgcggata

SEQ ID NO: 945014 - DNA, 25 bp, Mus musculus
ttcttgcgtgatgaggttgcggata

SEQ ID NO: 945015 - DNA, 25 bp, Mus musculus
ttcttgctacatccccttaaaagtt

SEQ ID NO: 945016 - DNA, 25 bp, Mus musculus
ttcttgctacatgcccttaaaagtt

SEQ ID NO: 945017 - DNA, 25 bp, Mus musculus
ttcttgctacccctgaccttgtgtg

SEQ ID NO: 945018 - DNA, 25 bp, Mus musculus
ttcttgctacccgtgaccttgtgtg

SEQ ID NO: 945019 - DNA, 25 bp, Mus musculus
ttcttgctaggcattcttaggaaca

SEQ ID NO: 945020 - DNA, 25 bp, Mus musculus
ttcttgctaggctttcttaggaaca

SEQ ID NO: 945021 - DNA, 25 bp, Mus musculus
ttcttgctagtgctcccttgggaag

SEQ ID NO: 945022 - DNA, 25 bp, Mus musculus
ttcttgctagtggtcccttgggaag

SEQ ID NO: 945023 - DNA, 25 bp, Mus musculus
ttcttgctcattaataatccgtaga

SEQ ID NO: 945024 - DNA, 25 bp, Mus musculus
ttcttgctcatttataatccgtaga

SEQ ID NO: 945025 - DNA, 25 bp, Mus musculus
ttcttgctctcactcctgtaattgt

SEQ ID NO: 945026 - DNA, 25 bp, Mus musculus
ttcttgctctcagtcctgtaattgt

SEQ ID NO: 945027 - DNA, 25 bp, Mus musculus
ttcttgctctctatcttttacacag

SEQ ID NO: 945028 - DNA, 25 bp, Mus musculus
ttcttgctctctttcttttacacag

SEQ ID NO: 945029 - DNA, 25 bp, Mus musculus
ttcttgctcttcaagggcagtcagt

SEQ ID NO: 945030 - DNA, 25 bp, Mus musculus
ttcttgctcttctagggcagtcagt

SEQ ID NO: 945031 - DNA, 25 bp, Mus musculus
ttcttgctgaccaacaccaggtata

SEQ ID NO: 945032 - DNA, 25 bp, Mus musculus
ttcttgctgacctacaccaggtata

SEQ ID NO: 945033 - DNA, 25 bp, Mus musculus
ttcttgctgagcaggtactggcgaa

SEQ ID NO: 945034 - DNA, 25 bp, Mus musculus
ttcttgctgagctggtactggcgaa

SEQ ID NO: 945035 - DNA, 25 bp, Mus musculus
ttcttgctgcctagggtctgtgtca

SEQ ID NO: 945036 - DNA, 25 bp, Mus musculus
ttcttgctgccttgggtctgtgtca

SEQ ID NO: 945037 - DNA, 25 bp, Mus musculus
ttcttgctggctctgttctcttaag

SEQ ID NO: 945038 - DNA, 25 bp, Mus musculus
ttcttgctggctgtgttctcttaag

SEQ ID NO: 945039 - DNA, 25 bp, Mus musculus
ttcttgctgggcagcatatcagagt

SEQ ID NO: 945040 - DNA, 25 bp, Mus musculus
ttcttgctgggctgcatatcagagt

SEQ ID NO: 945041 - DNA, 25 bp, Mus musculus
ttcttgctgtacatggatgaggcca

SEQ ID NO: 945042 - DNA, 25 bp, Mus musculus
ttcttgctgtacttggatgaggcca

SEQ ID NO: 945043 - DNA, 25 bp, Mus musculus
ttcttgctgtgtcaggcctgtggaa

SEQ ID NO: 945044 - DNA, 25 bp, Mus musculus
ttcttgctgtgtgaggcctgtggaa

SEQ ID NO: 945045 - DNA, 25 bp, Mus musculus
ttcttgcttagaaagttgctcttgt

SEQ ID NO: 945046 - DNA, 25 bp, Mus musculus
ttcttgcttagatagttgctcttgt

SEQ ID NO: 945047 - DNA, 25 bp, Mus musculus
ttcttgcttccgctagttctaacat

SEQ ID NO: 945048 - DNA, 25 bp, Mus musculus
ttcttgcttccggtagttctaacat

SEQ ID NO: 945049 - DNA, 25 bp, Mus musculus
ttcttgcttctgactagtacttggc

SEQ ID NO: 945050 - DNA, 25 bp, Mus musculus
ttcttgcttctgtctagtacttggc

SEQ ID NO: 945051 - DNA, 25 bp, Mus musculus
ttcttgcttgatccctacgtgtcta

SEQ ID NO: 945052 - DNA, 25 bp, Mus musculus
ttcttgcttgatgcctacgtgtcta

SEQ ID NO: 945053 - DNA, 25 bp, Mus musculus
ttcttgcttgttcccggatttatta

SEQ ID NO: 945054 - DNA, 25 bp, Mus musculus
ttcttgcttgttgccggatttatta

SEQ ID NO: 945055 - DNA, 25 bp, Mus musculus
ttcttgctttctacctataacttga

SEQ ID NO: 945056 - DNA, 25 bp, Mus musculus
ttcttgctttcttcctataacttga

SEQ ID NO: 945057 - DNA, 25 bp, Mus musculus
ttcttgctttgcacagagtgaccta

SEQ ID NO: 945058 - DNA, 25 bp, Mus musculus
ttcttgctttgctcagagtgaccta

SEQ ID NO: 945059 - DNA, 25 bp, Mus musculus
ttcttgcttttaaaccacagtaaga

SEQ ID NO: 945060 - DNA, 25 bp, Mus musculus
ttcttgcttttataccacagtaaga

SEQ ID NO: 945061 - DNA, 25 bp, Mus musculus
ttcttggaagaaaagctaatagctc

SEQ ID NO: 945062 - DNA, 25 bp, Mus musculus
ttcttggaagaatagctaatagctc

SEQ ID NO: 945063 - DNA, 25 bp, Mus musculus
ttcttggaaggcctggattgctcac

SEQ ID NO: 945064 - DNA, 25 bp, Mus musculus
ttcttggaaggcgtggattgctcac

SEQ ID NO: 945065 - DNA, 25 bp, Mus musculus
ttcttggaatacaacctcatgcaga

SEQ ID NO: 945066 - DNA, 25 bp, Mus musculus
ttcttggaatactacctcatgcaga

SEQ ID NO: 945067 - DNA, 25 bp, Mus musculus
ttcttggacatcaggcatttcatat

SEQ ID NO: 945068 - DNA, 25 bp, Mus musculus
ttcttggacatctggcatttcatat

SEQ ID NO: 945069 - DNA, 25 bp, Mus musculus
ttcttggagaaaaaaggcacccagc

SEQ ID NO: 945070 - DNA, 25 bp, Mus musculus
ttcttggagaaaccacgccactggg

SEQ ID NO: 945071 - DNA, 25 bp, Mus musculus
ttcttggagaaagcacgccactggg

SEQ ID NO: 945072 - DNA, 25 bp, Mus musculus
ttcttggagaaataaggcacccagc

SEQ ID NO: 945073 - DNA, 25 bp, Mus musculus
ttcttggagttgaacctagcagcgg

SEQ ID NO: 945074 - DNA, 25 bp, Mus musculus
ttcttggagttgtacctagcagcgg

SEQ ID NO: 945075 - DNA, 25 bp, Mus musculus
ttcttggattgaccctagcttcaac

SEQ ID NO: 945076 - DNA, 25 bp, Mus musculus
ttcttggattgagcctagcttcaac

SEQ ID NO: 945077 - DNA, 25 bp, Mus musculus
ttcttggattgcaggtatactgttt

SEQ ID NO: 945078 - DNA, 25 bp, Mus musculus
ttcttggattgctggtatactgttt

SEQ ID NO: 945079 - DNA, 25 bp, Mus musculus
ttcttggcacacactatcattggtc

SEQ ID NO: 945080 - DNA, 25 bp, Mus musculus
ttcttggcacactctatcattggtc

SEQ ID NO: 945081 - DNA, 25 bp, Mus musculus
ttcttggcatagctgtcgttaatcc

SEQ ID NO: 945082 - DNA, 25 bp, Mus musculus
ttcttggcataggtgtcgttaatcc

SEQ ID NO: 945083 - DNA, 25 bp, Mus musculus
ttcttggcatcaaaagcacgctggt

SEQ ID NO: 945084 - DNA, 25 bp, Mus musculus
ttcttggcatcataagcacgctggt

SEQ ID NO: 945085 - DNA, 25 bp, Mus musculus
ttcttggccaagcacactgaggagc

SEQ ID NO: 945086 - DNA, 25 bp, Mus musculus
ttcttggccaaggacactgaggagc

SEQ ID NO: 945087 - DNA, 25 bp, Mus musculus
ttcttggccaatagtcacatgatat

SEQ ID NO: 945088 - DNA, 25 bp, Mus musculus
ttcttggccaattgtcacatgatat

SEQ ID NO: 945089 - DNA, 25 bp, Mus musculus
ttcttggccgccacgtggagtctgt

SEQ ID NO: 945090 - DNA, 25 bp, Mus musculus
ttcttggccgcctcgtggagtctgt

SEQ ID NO: 945091 - DNA, 25 bp, Mus musculus
ttcttggccttgattcggctaatga

SEQ ID NO: 945092 - DNA, 25 bp, Mus musculus
ttcttggccttgtttcggctaatga

SEQ ID NO: 945093 - DNA, 25 bp, Mus musculus
ttcttggctaagcataagcctggtt

SEQ ID NO: 945094 - DNA, 25 bp, Mus musculus
ttcttggctaaggataagcctggtt

SEQ ID NO: 945095 - DNA, 25 bp, Mus musculus
ttcttggctatgactgtcctcacac

SEQ ID NO: 945096 - DNA, 25 bp, Mus musculus
ttcttggctatgtctgtcctcacac

SEQ ID NO: 945097 - DNA, 25 bp, Mus musculus
ttcttggctcatccagtgttaatgc

SEQ ID NO: 945098 - DNA, 25 bp, Mus musculus
ttcttggctcatgcagtgttaatgc

SEQ ID NO: 945099 - DNA, 25 bp, Mus musculus
ttcttggctggtacttagtacccat

SEQ ID NO: 945100 - DNA, 25 bp, Mus musculus
ttcttggctggttcttagtacccat

SEQ ID NO: 945101 - DNA, 25 bp, Mus musculus
ttcttggctgtgatgactcagaaga

SEQ ID NO: 945102 - DNA, 25 bp, Mus musculus
ttcttggctgtgttgactcagaaga

SEQ ID NO: 945103 - DNA, 25 bp, Mus musculus
ttcttggcttacagcagaaggttgc

SEQ ID NO: 945104 - DNA, 25 bp, Mus musculus
ttcttggcttactgcagaaggttgc

SEQ ID NO: 945105 - DNA, 25 bp, Mus musculus
ttcttggcttctaattggaacccta

SEQ ID NO: 945106 - DNA, 25 bp, Mus musculus
ttcttggcttcttattggaacccta

SEQ ID NO: 945107 - DNA, 25 bp, Mus musculus
ttcttgggaggcactggtataccct

SEQ ID NO: 945108 - DNA, 25 bp, Mus musculus
ttcttgggaggctctggtataccct

SEQ ID NO: 945109 - DNA, 25 bp, Mus musculus
ttcttgggatggctgtacattcttt

SEQ ID NO: 945110 - DNA, 25 bp, Mus musculus
ttcttgggatgggtgtacattcttt

SEQ ID NO: 945111 - DNA, 25 bp, Mus musculus
ttcttgggcagcagagctcaggccc

SEQ ID NO: 945112 - DNA, 25 bp, Mus musculus
ttcttgggcagctgagctcaggccc

SEQ ID NO: 945113 - DNA, 25 bp, Mus musculus
ttcttgggctttagaaacactggcc

SEQ ID NO: 945114 - DNA, 25 bp, Mus musculus
ttcttgggcttttgaaacactggcc

SEQ ID NO: 945115 - DNA, 25 bp, Mus musculus
ttcttgggttgccttgaccaacaag

SEQ ID NO: 945116 - DNA, 25 bp, Mus musculus
ttcttgggttgcgttgaccaacaag

SEQ ID NO: 945117 - DNA, 25 bp, Mus musculus
ttcttgggtttccttctcaatgcca

SEQ ID NO: 945118 - DNA, 25 bp, Mus musculus
ttcttgggtttcgttctcaatgcca

SEQ ID NO: 945119 - DNA, 25 bp, Mus musculus
ttcttggtaagcatctatgtagcct

SEQ ID NO: 945120 - DNA, 25 bp, Mus musculus
ttcttggtaagcttctatgtagcct

SEQ ID NO: 945121 - DNA, 25 bp, Mus musculus
ttcttggtaccaccagtagcgacca

SEQ ID NO: 945122 - DNA, 25 bp, Mus musculus
ttcttggtaccagcagtagcgacca

SEQ ID NO: 945123 - DNA, 25 bp, Mus musculus
ttcttggtagttactggactgatgc

SEQ ID NO: 945124 - DNA, 25 bp, Mus musculus
ttcttggtagtttctggactgatgc

SEQ ID NO: 945125 - DNA, 25 bp, Mus musculus
ttcttggtcaagcttaacagtttct

SEQ ID NO: 945126 - DNA, 25 bp, Mus musculus
ttcttggtcaaggttaacagtttct

SEQ ID NO: 945127 - DNA, 25 bp, Mus musculus
ttcttggtcaggactgggtaccaca

SEQ ID NO: 945128 - DNA, 25 bp, Mus musculus
ttcttggtcaggtctgggtaccaca

SEQ ID NO: 945129 - DNA, 25 bp, Mus musculus
ttcttggtcccgctgtgggtctgaa

SEQ ID NO: 945130 - DNA, 25 bp, Mus musculus
ttcttggtcccggtgtgggtctgaa

SEQ ID NO: 945131 - DNA, 25 bp, Mus musculus
ttcttggtcctcagtttctgctcaa

SEQ ID NO: 945132 - DNA, 25 bp, Mus musculus
ttcttggtcctctgtttctgctcaa

SEQ ID NO: 945133 - DNA, 25 bp, Mus musculus
ttcttggtcctgactgtgcctcagt

SEQ ID NO: 945134 - DNA, 25 bp, Mus musculus
ttcttggtcctgtctgtgcctcagt

SEQ ID NO: 945135 - DNA, 25 bp, Mus musculus
ttcttggtctccatatgttctatga

SEQ ID NO: 945136 - DNA, 25 bp, Mus musculus
ttcttggtctccttatgttctatga

SEQ ID NO: 945137 - DNA, 25 bp, Mus musculus
ttcttggtgatactctcttgtcttt

SEQ ID NO: 945138 - DNA, 25 bp, Mus musculus
ttcttggtgatagtctcttgtcttt

SEQ ID NO: 945139 - DNA, 25 bp, Mus musculus
ttcttggtgcctacattatcagagg

SEQ ID NO: 945140 - DNA, 25 bp, Mus musculus
ttcttggtgccttcattatcagagg

SEQ ID NO: 945141 - DNA, 25 bp, Mus musculus
ttcttggtgctgacttcagttctga

SEQ ID NO: 945142 - DNA, 25 bp, Mus musculus
ttcttggtgctgtcttcagttctga

SEQ ID NO: 945143 - DNA, 25 bp, Mus musculus
ttcttggtgttcctttcttccagca

SEQ ID NO: 945144 - DNA, 25 bp, Mus musculus
ttcttggtgttcgtttcttccagca

SEQ ID NO: 945145 - DNA, 25 bp, Mus musculus
ttcttggttcatcatactccagacc

SEQ ID NO: 945146 - DNA, 25 bp, Mus musculus
ttcttggttcatgatactccagacc

SEQ ID NO: 945147 - DNA, 25 bp, Mus musculus
ttcttggttttaccactttattgtg

SEQ ID NO: 945148 - DNA, 25 bp, Mus musculus
ttcttggttttagcactttattgtg

SEQ ID NO: 945149 - DNA, 25 bp, Mus musculus
ttcttggttttgagtgatcccttcc

SEQ ID NO: 945150 - DNA, 25 bp, Mus musculus
ttcttggttttgtgtgatcccttcc

SEQ ID NO: 945151 - DNA, 25 bp, Mus musculus
ttcttgtaaagcatacccacattat

SEQ ID NO: 945152 - DNA, 25 bp, Mus musculus
ttcttgtaaagcctgtgggtaccga

SEQ ID NO: 945153 - DNA, 25 bp, Mus musculus
ttcttgtaaagcgtgtgggtaccga

SEQ ID NO: 945154 - DNA, 25 bp, Mus musculus
ttcttgtaaagcttacccacattat

SEQ ID NO: 945155 - DNA, 25 bp, Mus musculus
ttcttgtaagtaacactctggagac

SEQ ID NO: 945156 - DNA, 25 bp, Mus musculus
ttcttgtaagtatcactctggagac

SEQ ID NO: 945157 - DNA, 25 bp, Mus musculus
ttcttgtaccagcttgaggacacat

SEQ ID NO: 945158 - DNA, 25 bp, Mus musculus
ttcttgtaccaggttgaggacacat

SEQ ID NO: 945159 - DNA, 25 bp, Mus musculus
ttcttgtacttgattggttccttct

SEQ ID NO: 945160 - DNA, 25 bp, Mus musculus
ttcttgtacttgtttggttccttct

SEQ ID NO: 945161 - DNA, 25 bp, Mus musculus
ttcttgtagtttaaccagggcaaca

SEQ ID NO: 945162 - DNA, 25 bp, Mus musculus
ttcttgtagttttaccagggcaaca

SEQ ID NO: 945163 - DNA, 25 bp, Mus musculus
ttcttgtataatacccagtggtttg

SEQ ID NO: 945164 - DNA, 25 bp, Mus musculus
ttcttgtataattcccagtggtttg

SEQ ID NO: 945165 - DNA, 25 bp, Mus musculus
ttcttgtattctcctatcccatcag

SEQ ID NO: 945166 - DNA, 25 bp, Mus musculus
ttcttgtattctgctatcccatcag

SEQ ID NO: 945167 - DNA, 25 bp, Mus musculus
ttcttgtattttatgattatgcccc

SEQ ID NO: 945168 - DNA, 25 bp, Mus musculus
ttcttgtattttttgattatgcccc

SEQ ID NO: 945169 - DNA, 25 bp, Mus musculus
ttcttgtcaatgcacttctcactgg

SEQ ID NO: 945170 - DNA, 25 bp, Mus musculus
ttcttgtcaatggacttctcactgg

SEQ ID NO: 945171 - DNA, 25 bp, Mus musculus
ttcttgtcacctcagttcccttggt

SEQ ID NO: 945172 - DNA, 25 bp, Mus musculus
ttcttgtcacctgagttcccttggt

SEQ ID NO: 945173 - DNA, 25 bp, Mus musculus
ttcttgtcagacctggtggtgccca

SEQ ID NO: 945174 - DNA, 25 bp, Mus musculus
ttcttgtcagacgtggtggtgccca

SEQ ID NO: 945175 - DNA, 25 bp, Mus musculus
ttcttgtcatgaaggttcggtgcat

SEQ ID NO: 945176 - DNA, 25 bp, Mus musculus
ttcttgtcatgatggttcggtgcat

SEQ ID NO: 945177 - DNA, 25 bp, Mus musculus
ttcttgtcattgcagcatcatctag

SEQ ID NO: 945178 - DNA, 25 bp, Mus musculus
ttcttgtcattggagcatcatctag

SEQ ID NO: 945179 - DNA, 25 bp, Mus musculus
ttcttgtccatcaatttccagtttc

SEQ ID NO: 945180 - DNA, 25 bp, Mus musculus
ttcttgtccatctatttccagtttc

SEQ ID NO: 945181 - DNA, 25 bp, Mus musculus
ttcttgtccctacattctgaatcaa

SEQ ID NO: 945182 - DNA, 25 bp, Mus musculus
ttcttgtccctagattctgaatcaa

SEQ ID NO: 945183 - DNA, 25 bp, Mus musculus
ttcttgtcctccaaaagctcttaag

SEQ ID NO: 945184 - DNA, 25 bp, Mus musculus
ttcttgtcctcctaaagctcttaag

SEQ ID NO: 945185 - DNA, 25 bp, Mus musculus
ttcttgtcctctagaagtccccaag

SEQ ID NO: 945186 - DNA, 25 bp, Mus musculus
ttcttgtcctcttgaagtccccaag

SEQ ID NO: 945187 - DNA, 25 bp, Mus musculus
ttcttgtcgctgcacgagactgatt

SEQ ID NO: 945188 - DNA, 25 bp, Mus musculus
ttcttgtcgctggacgagactgatt

SEQ ID NO: 945189 - DNA, 25 bp, Mus musculus
ttcttgtctgctccttctgagatct

SEQ ID NO: 945190 - DNA, 25 bp, Mus musculus
ttcttgtctgctgcttctgagatct

SEQ ID NO: 945191 - DNA, 25 bp, Mus musculus
ttcttgtgaaccagtgtatacataa

SEQ ID NO: 945192 - DNA, 25 bp, Mus musculus
ttcttgtgaacctgtgtatacataa

SEQ ID NO: 945193 - DNA, 25 bp, Mus musculus
ttcttgtgaatgagactgctcttgc

SEQ ID NO: 945194 - DNA, 25 bp, Mus musculus
ttcttgtgaatgtgactgctcttgc

SEQ ID NO: 945195 - DNA, 25 bp, Mus musculus
ttcttgtgccaacatcagtgttttc

SEQ ID NO: 945196 - DNA, 25 bp, Mus musculus
ttcttgtgccaagatcagtgttttc

SEQ ID NO: 945197 - DNA, 25 bp, Mus musculus
ttcttgtgctgacttcctggtacca

SEQ ID NO: 945198 - DNA, 25 bp, Mus musculus
ttcttgtgctgagttcctggtacca

SEQ ID NO: 945199 - DNA, 25 bp, Mus musculus
ttcttgtggtatactgaaccttggc

SEQ ID NO: 945200 - DNA, 25 bp, Mus musculus
ttcttgtggtattctgaaccttggc

SEQ ID NO: 945201 - DNA, 25 bp, Mus musculus
ttcttgtggtttcattctttgattt

SEQ ID NO: 945202 - DNA, 25 bp, Mus musculus
ttcttgtggtttgattctttgattt

SEQ ID NO: 945203 - DNA, 25 bp, Mus musculus
ttcttgtgtattacttatctgctgg

SEQ ID NO: 945204 - DNA, 25 bp, Mus musculus
ttcttgtgtatttcttatctgctgg

SEQ ID NO: 945205 - DNA, 25 bp, Mus musculus
ttcttgtgtcctcaaagggccacgg

SEQ ID NO: 945206 - DNA, 25 bp, Mus musculus
ttcttgtgtcctgaaagggccacgg

SEQ ID NO: 945207 - DNA, 25 bp, Mus musculus
ttcttgtgtggtattctgggtttcg

SEQ ID NO: 945208 - DNA, 25 bp, Mus musculus
ttcttgtgtggttttctgggtttcg

SEQ ID NO: 945209 - DNA, 25 bp, Mus musculus
ttcttgtgttcaacgccatcctgaa

SEQ ID NO: 945210 - DNA, 25 bp, Mus musculus
ttcttgtgttcatcgccatcctgaa

SEQ ID NO: 945211 - DNA, 25 bp, Mus musculus
ttcttgttactcagggttttatcat

SEQ ID NO: 945212 - DNA, 25 bp, Mus musculus
ttcttgttactctgggttttatcat

SEQ ID NO: 945213 - DNA, 25 bp, Mus musculus
ttcttgttatctaaccaaatcctgc

SEQ ID NO: 945214 - DNA, 25 bp, Mus musculus
ttcttgttatcttaccaaatcctgc

SEQ ID NO: 945215 - DNA, 25 bp, Mus musculus
ttcttgttccatcctttgcctaaga

SEQ ID NO: 945216 - DNA, 25 bp, Mus musculus
ttcttgttccatgctttgcctaaga

SEQ ID NO: 945217 - DNA, 25 bp, Mus musculus
ttcttgttctatcaccatttctggt

SEQ ID NO: 945218 - DNA, 25 bp, Mus musculus
ttcttgttctatgaccatttctggt

SEQ ID NO: 945219 - DNA, 25 bp, Mus musculus
ttcttgttctccatttcttaggaat

SEQ ID NO: 945220 - DNA, 25 bp, Mus musculus
ttcttgttctccttttcttaggaat

SEQ ID NO: 945221 - DNA, 25 bp, Mus musculus
ttcttgttctcgaatggcagcttgc

SEQ ID NO: 945222 - DNA, 25 bp, Mus musculus
ttcttgttctcgtatggcagcttgc

SEQ ID NO: 945223 - DNA, 25 bp, Mus musculus
ttcttgttctgactgaattgccctg

SEQ ID NO: 945224 - DNA, 25 bp, Mus musculus
ttcttgttctgagtgaattgccctg

SEQ ID NO: 945225 - DNA, 25 bp, Mus musculus
ttcttgttctgcagcgccaagcagg

SEQ ID NO: 945226 - DNA, 25 bp, Mus musculus
ttcttgttctgctgcgccaagcagg

SEQ ID NO: 945227 - DNA, 25 bp, Mus musculus
ttcttgttctggcagctcaaagcca

SEQ ID NO: 945228 - DNA, 25 bp, Mus musculus
ttcttgttctgggagctcaaagcca

SEQ ID NO: 945229 - DNA, 25 bp, Mus musculus
ttcttgttctgtaccaccaggagct

SEQ ID NO: 945230 - DNA, 25 bp, Mus musculus
ttcttgttctgttccaccaggagct

SEQ ID NO: 945231 - DNA, 25 bp, Mus musculus
ttcttgttgctacacacagcgatgc

SEQ ID NO: 945232 - DNA, 25 bp, Mus musculus
ttcttgttgctacagccttctttat

SEQ ID NO: 945233 - DNA, 25 bp, Mus musculus
ttcttgttgctagacacagcgatgc

SEQ ID NO: 945234 - DNA, 25 bp, Mus musculus
ttcttgttgctagagccttctttat

SEQ ID NO: 945235 - DNA, 25 bp, Mus musculus
ttcttgttgctcattttggtgtctt

SEQ ID NO: 945236 - DNA, 25 bp, Mus musculus
ttcttgttgctctttttggtgtctt

SEQ ID NO: 945237 - DNA, 25 bp, Mus musculus
ttcttgtttcctcagacagggtgga

SEQ ID NO: 945238 - DNA, 25 bp, Mus musculus
ttcttgtttcctgagacagggtgga

SEQ ID NO: 945239 - DNA, 25 bp, Mus musculus
ttcttgttttccaaatgtctgcttg

SEQ ID NO: 945240 - DNA, 25 bp, Mus musculus
ttcttgttttcctaatgtctgcttg

SEQ ID NO: 945241 - DNA, 25 bp, Mus musculus
ttctttaaagagctgctacaccttt

SEQ ID NO: 945242 - DNA, 25 bp, Mus musculus
ttctttaaagaggtgctacaccttt

SEQ ID NO: 945243 - DNA, 25 bp, Mus musculus
ttctttaaagggatcatcttcaaat

SEQ ID NO: 945244 - DNA, 25 bp, Mus musculus
ttctttaaagggttcatcttcaaat

SEQ ID NO: 945245 - DNA, 25 bp, Mus musculus
ttctttaaccacccttgagctgtac

SEQ ID NO: 945246 - DNA, 25 bp, Mus musculus
ttctttaaccacgcttgagctgtac

SEQ ID NO: 945247 - DNA, 25 bp, Mus musculus
ttctttaacctgactttctcacatt

SEQ ID NO: 945248 - DNA, 25 bp, Mus musculus
ttctttaacctgtctttctcacatt

SEQ ID NO: 945249 - DNA, 25 bp, Mus musculus
ttctttaactgcacctgcatgcgct

SEQ ID NO: 945250 - DNA, 25 bp, Mus musculus
ttctttaactgctcctgcatgcgct

SEQ ID NO: 945251 - DNA, 25 bp, Mus musculus
ttctttaacttcctccgtgtagaca

SEQ ID NO: 945252 - DNA, 25 bp, Mus musculus
ttctttaacttcgtccgtgtagaca

SEQ ID NO: 945253 - DNA, 25 bp, Mus musculus
ttctttaagaatactctggacaagg

SEQ ID NO: 945254 - DNA, 25 bp, Mus musculus
ttctttaagaattctctggacaagg

SEQ ID NO: 945255 - DNA, 25 bp, Mus musculus
ttctttaagcttaggtcacagacat

SEQ ID NO: 945256 - DNA, 25 bp, Mus musculus
ttctttaagctttggtcacagacat

SEQ ID NO: 945257 - DNA, 25 bp, Mus musculus
ttctttaatcacaccatttacccat

SEQ ID NO: 945258 - DNA, 25 bp, Mus musculus
ttctttaatcactccatttacccat

SEQ ID NO: 945259 - DNA, 25 bp, Mus musculus
ttctttaatgtcacagtttgcactc

SEQ ID NO: 945260 - DNA, 25 bp, Mus musculus
ttctttaatgtctcagtttgcactc

SEQ ID NO: 945261 - DNA, 25 bp, Mus musculus
ttctttaattttcttggctatgtaa

SEQ ID NO: 945262 - DNA, 25 bp, Mus musculus
ttctttaattttgttggctatgtaa

SEQ ID NO: 945263 - DNA, 25 bp, Mus musculus
ttctttacatacaaacttacgactg

SEQ ID NO: 945264 - DNA, 25 bp, Mus musculus
ttctttacatactaacttacgactg

SEQ ID NO: 945265 - DNA, 25 bp, Mus musculus
ttctttaccaaaatgtggtggctct

SEQ ID NO: 945266 - DNA, 25 bp, Mus musculus
ttctttaccaaattgtggtggctct

SEQ ID NO: 945267 - DNA, 25 bp, Mus musculus
ttctttaccataacctccggattat

SEQ ID NO: 945268 - DNA, 25 bp, Mus musculus
ttctttaccatatcctccggattat

SEQ ID NO: 945269 - DNA, 25 bp, Mus musculus
ttctttacccagacagttctttact

SEQ ID NO: 945270 - DNA, 25 bp, Mus musculus
ttctttacccagcttgaggtcttca

SEQ ID NO: 945271 - DNA, 25 bp, Mus musculus
ttctttacccaggttgaggtcttca

SEQ ID NO: 945272 - DNA, 25 bp, Mus musculus
ttctttacccagtcagttctttact

SEQ ID NO: 945273 - DNA, 25 bp, Mus musculus
ttctttacctatcctgttcacattt

SEQ ID NO: 945274 - DNA, 25 bp, Mus musculus
ttctttacctatgctgttcacattt

SEQ ID NO: 945275 - DNA, 25 bp, Mus musculus
ttctttactatccaccctgcaacgt

SEQ ID NO: 945276 - DNA, 25 bp, Mus musculus
ttctttactatcgaccctgcaacgt

SEQ ID NO: 945277 - DNA, 25 bp, Mus musculus
ttctttactgtgcagacaatgttct

SEQ ID NO: 945278 - DNA, 25 bp, Mus musculus
ttctttactgtggagacaatgttct

SEQ ID NO: 945279 - DNA, 25 bp, Mus musculus
ttctttacttcacatctggtttcaa

SEQ ID NO: 945280 - DNA, 25 bp, Mus musculus
ttctttacttcagatctggtttcaa

SEQ ID NO: 945281 - DNA, 25 bp, Mus musculus
ttctttagaaacatacacgccttta

SEQ ID NO: 945282 - DNA, 25 bp, Mus musculus
ttctttagaaacttacacgccttta

SEQ ID NO: 945283 - DNA, 25 bp, Mus musculus
ttctttagcactatgatgtttctta

SEQ ID NO: 945284 - DNA, 25 bp, Mus musculus
ttctttagcactttgatgtttctta

SEQ ID NO: 945285 - DNA, 25 bp, Mus musculus
ttctttagctgtatcaatgagatcg

SEQ ID NO: 945286 - DNA, 25 bp, Mus musculus
ttctttagctgtttcaatgagatcg

SEQ ID NO: 945287 - DNA, 25 bp, Mus musculus
ttctttagggacatgacctttgggt

SEQ ID NO: 945288 - DNA, 25 bp, Mus musculus
ttctttagggacttgacctttgggt

SEQ ID NO: 945289 - DNA, 25 bp, Mus musculus
ttctttagtaatcattctttcacta

SEQ ID NO: 945290 - DNA, 25 bp, Mus musculus
ttctttagtaatgattctttcacta

SEQ ID NO: 945291 - DNA, 25 bp, Mus musculus
ttctttagtctgatggttgatctca

SEQ ID NO: 945292 - DNA, 25 bp, Mus musculus
ttctttagtctgttggttgatctca

SEQ ID NO: 945293 - DNA, 25 bp, Mus musculus
ttctttagtggacttgcccgctggc

SEQ ID NO: 945294 - DNA, 25 bp, Mus musculus
ttctttagtggagttgcccgctggc

SEQ ID NO: 945295 - DNA, 25 bp, Mus musculus
ttctttatagctacaacttcttgta

SEQ ID NO: 945296 - DNA, 25 bp, Mus musculus
ttctttatagcttcaacttcttgta

SEQ ID NO: 945297 - DNA, 25 bp, Mus musculus
ttctttatatctagtcctttggtta

SEQ ID NO: 945298 - DNA, 25 bp, Mus musculus
ttctttatatcttgtcctttggtta

SEQ ID NO: 945299 - DNA, 25 bp, Mus musculus
ttctttatcaacaatccttcccctc

SEQ ID NO: 945300 - DNA, 25 bp, Mus musculus
ttctttatcaactatccttcccctc

SEQ ID NO: 945301 - DNA, 25 bp, Mus musculus
ttctttatccatcagcaccaggctt

SEQ ID NO: 945302 - DNA, 25 bp, Mus musculus
ttctttatccatgagcaccaggctt

SEQ ID NO: 945303 - DNA, 25 bp, Mus musculus
ttctttatccctcttgtcctgttcc

SEQ ID NO: 945304 - DNA, 25 bp, Mus musculus
ttctttatccctgttgtcctgttcc

SEQ ID NO: 945305 - DNA, 25 bp, Mus musculus
ttctttatgaatactctttgacaca

SEQ ID NO: 945306 - DNA, 25 bp, Mus musculus
ttctttatgaattctctttgacaca

SEQ ID NO: 945307 - DNA, 25 bp, Mus musculus
ttctttatgtatcatagctgtccca

SEQ ID NO: 945308 - DNA, 25 bp, Mus musculus
ttctttatgtatgatagctgtccca

SEQ ID NO: 945309 - DNA, 25 bp, Mus musculus
ttctttattaccacattctccagtg

SEQ ID NO: 945310 - DNA, 25 bp, Mus musculus
ttctttattacctcattctccagtg

SEQ ID NO: 945311 - DNA, 25 bp, Mus musculus
ttctttattcgcagactcctggatt

SEQ ID NO: 945312 - DNA, 25 bp, Mus musculus
ttctttattcgctgactcctggatt

SEQ ID NO: 945313 - DNA, 25 bp, Mus musculus
ttctttattctaagggacaggcctt

SEQ ID NO: 945314 - DNA, 25 bp, Mus musculus
ttctttattctatgggacaggcctt

SEQ ID NO: 945315 - DNA, 25 bp, Mus musculus
ttctttattgtcatgcctcacctga

SEQ ID NO: 945316 - DNA, 25 bp, Mus musculus
ttctttattgtcttgcctcacctga

SEQ ID NO: 945317 - DNA, 25 bp, Mus musculus
ttctttatttctccctgtactaact

SEQ ID NO: 945318 - DNA, 25 bp, Mus musculus
ttctttatttctgcctgtactaact

SEQ ID NO: 945319 - DNA, 25 bp, Mus musculus
ttctttatttgcaccagggctggtc

SEQ ID NO: 945320 - DNA, 25 bp, Mus musculus
ttctttatttgctccagggctggtc

SEQ ID NO: 945321 - DNA, 25 bp, Mus musculus
ttctttcaaactacggaccattctc

SEQ ID NO: 945322 - DNA, 25 bp, Mus musculus
ttctttcaaacttcggaccattctc

SEQ ID NO: 945323 - DNA, 25 bp, Mus musculus
ttctttcaactcacagttgcctgtg

SEQ ID NO: 945324 - DNA, 25 bp, Mus musculus
ttctttcaactctcagttgcctgtg

SEQ ID NO: 945325 - DNA, 25 bp, Mus musculus
ttctttcacagcactgaggtctcac

SEQ ID NO: 945326 - DNA, 25 bp, Mus musculus
ttctttcacagctctgaggtctcac

SEQ ID NO: 945327 - DNA, 25 bp, Mus musculus
ttctttcagatcagccactgtgcag

SEQ ID NO: 945328 - DNA, 25 bp, Mus musculus
ttctttcagatctgccactgtgcag

SEQ ID NO: 945329 - DNA, 25 bp, Mus musculus
ttctttcagcacagtttgtattgaa

SEQ ID NO: 945330 - DNA, 25 bp, Mus musculus
ttctttcagcactgtttgtattgaa

SEQ ID NO: 945331 - DNA, 25 bp, Mus musculus
ttctttcaggccaacaggagccaga

SEQ ID NO: 945332 - DNA, 25 bp, Mus musculus
ttctttcaggcctacaggagccaga

SEQ ID NO: 945333 - DNA, 25 bp, Mus musculus
ttctttcagggcatgaccgtgatga

SEQ ID NO: 945334 - DNA, 25 bp, Mus musculus
ttctttcagggcttgaccgtgatga

SEQ ID NO: 945335 - DNA, 25 bp, Mus musculus
ttctttcatattattggccgagtag

SEQ ID NO: 945336 - DNA, 25 bp, Mus musculus
ttctttcatatttttggccgagtag

SEQ ID NO: 945337 - DNA, 25 bp, Mus musculus
ttctttcatcctacaccaacaaagc

SEQ ID NO: 945338 - DNA, 25 bp, Mus musculus
ttctttcatccttcaccaacaaagc

SEQ ID NO: 945339 - DNA, 25 bp, Mus musculus
ttctttcatgggacacttgaagcca

SEQ ID NO: 945340 - DNA, 25 bp, Mus musculus
ttctttcatgggtcacttgaagcca

SEQ ID NO: 945341 - DNA, 25 bp, Mus musculus
ttctttcattagaatccgaggtatt

SEQ ID NO: 945342 - DNA, 25 bp, Mus musculus
ttctttcattagtatccgaggtatt

SEQ ID NO: 945343 - DNA, 25 bp, Mus musculus
ttctttcattttcttcgttcagtat

SEQ ID NO: 945344 - DNA, 25 bp, Mus musculus
ttctttcattttgttcgttcagtat

SEQ ID NO: 945345 - DNA, 25 bp, Mus musculus
ttctttccaaagacaggttgtggta

SEQ ID NO: 945346 - DNA, 25 bp, Mus musculus
ttctttccaaagtcaggttgtggta

SEQ ID NO: 945347 - DNA, 25 bp, Mus musculus
ttctttccacgtaagtgcgcgaaga

SEQ ID NO: 945348 - DNA, 25 bp, Mus musculus
ttctttccacgttagtgcgcgaaga

SEQ ID NO: 945349 - DNA, 25 bp, Mus musculus
ttctttccactaatgtacatcccat

SEQ ID NO: 945350 - DNA, 25 bp, Mus musculus
ttctttccactattgtacatcccat

SEQ ID NO: 945351 - DNA, 25 bp, Mus musculus
ttctttccagacagaaccataggga

SEQ ID NO: 945352 - DNA, 25 bp, Mus musculus
ttctttccagactgaaccataggga

SEQ ID NO: 945353 - DNA, 25 bp, Mus musculus
ttctttccagctctaaaaccaccat

SEQ ID NO: 945354 - DNA, 25 bp, Mus musculus
ttctttccagctgtaaaaccaccat

SEQ ID NO: 945355 - DNA, 25 bp, Mus musculus
ttctttccaggtagtcaaatttcca

SEQ ID NO: 945356 - DNA, 25 bp, Mus musculus
ttctttccaggttgtcaaatttcca

SEQ ID NO: 945357 - DNA, 25 bp, Mus musculus
ttctttccatggcagtaacttaaaa

SEQ ID NO: 945358 - DNA, 25 bp, Mus musculus
ttctttccatgggagtaacttaaaa

SEQ ID NO: 945359 - DNA, 25 bp, Mus musculus
ttctttcccagcaaaaactgcttta

SEQ ID NO: 945360 - DNA, 25 bp, Mus musculus
ttctttcccagcaaattgtaggaac

SEQ ID NO: 945361 - DNA, 25 bp, Mus musculus
ttctttcccagcattgtgcatatgt

SEQ ID NO: 945362 - DNA, 25 bp, Mus musculus
ttctttcccagctaaaactgcttta

SEQ ID NO: 945363 - DNA, 25 bp, Mus musculus
ttctttcccagctaattgtaggaac

SEQ ID NO: 945364 - DNA, 25 bp, Mus musculus
ttctttcccagctttgtgcatatgt

SEQ ID NO: 945365 - DNA, 25 bp, Mus musculus
ttctttcccatgactatcttttatc

SEQ ID NO: 945366 - DNA, 25 bp, Mus musculus
ttctttcccatgtctatcttttatc

SEQ ID NO: 945367 - DNA, 25 bp, Mus musculus
ttctttccccaaatacactggaaca

SEQ ID NO: 945368 - DNA, 25 bp, Mus musculus
ttctttccccaattacactggaaca

SEQ ID NO: 945369 - DNA, 25 bp, Mus musculus
ttctttcccgctatcgcttaagatt

SEQ ID NO: 945370 - DNA, 25 bp, Mus musculus
ttctttcccgctttcgcttaagatt

SEQ ID NO: 945371 - DNA, 25 bp, Mus musculus
ttctttccctacagtcattcatggg

SEQ ID NO: 945372 - DNA, 25 bp, Mus musculus
ttctttccctactgtcattcatggg

SEQ ID NO: 945373 - DNA, 25 bp, Mus musculus
ttctttccctagaccataggaaaca

SEQ ID NO: 945374 - DNA, 25 bp, Mus musculus
ttctttccctagtccataggaaaca

SEQ ID NO: 945375 - DNA, 25 bp, Mus musculus
ttctttccctgcctcataaattttt

SEQ ID NO: 945376 - DNA, 25 bp, Mus musculus
ttctttccctgcgtcataaattttt

SEQ ID NO: 945377 - DNA, 25 bp, Mus musculus
ttctttccctgtcccatgggcacag

SEQ ID NO: 945378 - DNA, 25 bp, Mus musculus
ttctttccctgtgccatgggcacag

SEQ ID NO: 945379 - DNA, 25 bp, Mus musculus
ttctttccgcttattggtggtggat

SEQ ID NO: 945380 - DNA, 25 bp, Mus musculus
ttctttccgctttttggtggtggat

SEQ ID NO: 945381 - DNA, 25 bp, Mus musculus
ttctttccggtacctgaggtcttga

SEQ ID NO: 945382 - DNA, 25 bp, Mus musculus
ttctttccggtagctgaggtcttga

SEQ ID NO: 945383 - DNA, 25 bp, Mus musculus
ttctttccggtccactttcaggagt

SEQ ID NO: 945384 - DNA, 25 bp, Mus musculus
ttctttccggtcgactttcaggagt

SEQ ID NO: 945385 - DNA, 25 bp, Mus musculus
ttctttcctactcctcagcttaaag

SEQ ID NO: 945386 - DNA, 25 bp, Mus musculus
ttctttcctactgctcagcttaaag

SEQ ID NO: 945387 - DNA, 25 bp, Mus musculus
ttctttcctcatattgtaaactttt

SEQ ID NO: 945388 - DNA, 25 bp, Mus musculus
ttctttcctcattttgtaaactttt

SEQ ID NO: 945389 - DNA, 25 bp, Mus musculus
ttctttcctccaatcccataataaa

SEQ ID NO: 945390 - DNA, 25 bp, Mus musculus
ttctttcctccattcccataataaa

SEQ ID NO: 945391 - DNA, 25 bp, Mus musculus
ttctttcctccgacctcaagagaaa

SEQ ID NO: 945392 - DNA, 25 bp, Mus musculus
ttctttcctccgtcctcaagagaaa

SEQ ID NO: 945393 - DNA, 25 bp, Mus musculus
ttctttcctctacgactggtatgga

SEQ ID NO: 945394 - DNA, 25 bp, Mus musculus
ttctttcctctaggactggtatgga

SEQ ID NO: 945395 - DNA, 25 bp, Mus musculus
ttctttcctctcaatgggtgtgtac

SEQ ID NO: 945396 - DNA, 25 bp, Mus musculus
ttctttcctctctatgggtgtgtac

SEQ ID NO: 945397 - DNA, 25 bp, Mus musculus
ttctttcctctgctggctttgcaaa

SEQ ID NO: 945398 - DNA, 25 bp, Mus musculus
ttctttcctctggtggctttgcaaa

SEQ ID NO: 945399 - DNA, 25 bp, Mus musculus
ttctttcctcttagtctgtgttaaa

SEQ ID NO: 945400 - DNA, 25 bp, Mus musculus
ttctttcctctttgtctgtgttaaa

SEQ ID NO: 945401 - DNA, 25 bp, Mus musculus
ttctttcctgaaaggcatcacggcc

SEQ ID NO: 945402 - DNA, 25 bp, Mus musculus
ttctttcctgaatggcatcacggcc

SEQ ID NO: 945403 - DNA, 25 bp, Mus musculus
ttctttcctgctattcttgtttgac

SEQ ID NO: 945404 - DNA, 25 bp, Mus musculus
ttctttcctgctcgccggtttcgtg

SEQ ID NO: 945405 - DNA, 25 bp, Mus musculus
ttctttcctgctggccggtttcgtg

SEQ ID NO: 945406 - DNA, 25 bp, Mus musculus
ttctttcctgcttttcttgtttgac

SEQ ID NO: 945407 - DNA, 25 bp, Mus musculus
ttctttccttgcaaatgggttccct

SEQ ID NO: 945408 - DNA, 25 bp, Mus musculus
ttctttccttgctaatgggttccct

SEQ ID NO: 945409 - DNA, 25 bp, Mus musculus
ttctttcctttcactggaggcatca

SEQ ID NO: 945410 - DNA, 25 bp, Mus musculus
ttctttcctttcctatcttaataat

SEQ ID NO: 945411 - DNA, 25 bp, Mus musculus
ttctttcctttcgtatcttaataat

SEQ ID NO: 945412 - DNA, 25 bp, Mus musculus
ttctttcctttctctggaggcatca

SEQ ID NO: 945413 - DNA, 25 bp, Mus musculus
ttctttcctttgaactatggtcttt

SEQ ID NO: 945414 - DNA, 25 bp, Mus musculus
ttctttcctttgtactatggtcttt

SEQ ID NO: 945415 - DNA, 25 bp, Mus musculus
ttctttccttttctgcacaactcta

SEQ ID NO: 945416 - DNA, 25 bp, Mus musculus
ttctttccttttgtgcacaactcta

SEQ ID NO: 945417 - DNA, 25 bp, Mus musculus
ttctttcgaattcttagcccaactc

SEQ ID NO: 945418 - DNA, 25 bp, Mus musculus
ttctttcgaattgttagcccaactc

SEQ ID NO: 945419 - DNA, 25 bp, Mus musculus
ttctttcgagtgaatcccagtatcc

SEQ ID NO: 945420 - DNA, 25 bp, Mus musculus
ttctttcgagtgtatcccagtatcc

SEQ ID NO: 945421 - DNA, 25 bp, Mus musculus
ttctttcgcagtctgagtgcttaga

SEQ ID NO: 945422 - DNA, 25 bp, Mus musculus
ttctttcgcagtgtgagtgcttaga

SEQ ID NO: 945423 - DNA, 25 bp, Mus musculus
ttctttcgccatagcaccagagtat

SEQ ID NO: 945424 - DNA, 25 bp, Mus musculus
ttctttcgccattgcaccagagtat

SEQ ID NO: 945425 - DNA, 25 bp, Mus musculus
ttctttcggcctctacgacatgaaa

SEQ ID NO: 945426 - DNA, 25 bp, Mus musculus
ttctttcggcctgtacgacatgaaa

SEQ ID NO: 945427 - DNA, 25 bp, Mus musculus
ttctttcgtctcctcgtgaagtaag

SEQ ID NO: 945428 - DNA, 25 bp, Mus musculus
ttctttcgtctcgtcgtgaagtaag

SEQ ID NO: 945429 - DNA, 25 bp, Mus musculus
ttctttcgttttccgctcacaagaa

SEQ ID NO: 945430 - DNA, 25 bp, Mus musculus
ttctttcgttttgcgctcacaagaa

SEQ ID NO: 945431 - DNA, 25 bp, Mus musculus
ttctttctaaatatcctccctgata

SEQ ID NO: 945432 - DNA, 25 bp, Mus musculus
ttctttctaaatttcctccctgata

SEQ ID NO: 945433 - DNA, 25 bp, Mus musculus
ttctttctacccatgcttgtatgtt

SEQ ID NO: 945434 - DNA, 25 bp, Mus musculus
ttctttctacccttgcttgtatgtt

SEQ ID NO: 945435 - DNA, 25 bp, Mus musculus
ttctttctacgaccacgccattgac

SEQ ID NO: 945436 - DNA, 25 bp, Mus musculus
ttctttctacgagcacgccattgac

SEQ ID NO: 945437 - DNA, 25 bp, Mus musculus
ttctttctactcatgttgtggccca

SEQ ID NO: 945438 - DNA, 25 bp, Mus musculus
ttctttctactcttgttgtggccca

SEQ ID NO: 945439 - DNA, 25 bp, Mus musculus
ttctttctacttcccctgctgtttg

SEQ ID NO: 945440 - DNA, 25 bp, Mus musculus
ttctttctacttgccctgctgtttg

SEQ ID NO: 945441 - DNA, 25 bp, Mus musculus
ttctttctattgcaatacagtctct

SEQ ID NO: 945442 - DNA, 25 bp, Mus musculus
ttctttctattggaatacagtctct

SEQ ID NO: 945443 - DNA, 25 bp, Mus musculus
ttctttctcactactgttttggcgg

SEQ ID NO: 945444 - DNA, 25 bp, Mus musculus
ttctttctcacttctgttttggcgg

SEQ ID NO: 945445 - DNA, 25 bp, Mus musculus
ttctttctcatgagctgacctcact

SEQ ID NO: 945446 - DNA, 25 bp, Mus musculus
ttctttctcatgtgctgacctcact

SEQ ID NO: 945447 - DNA, 25 bp, Mus musculus
ttctttctcccaatacagggtttct

SEQ ID NO: 945448 - DNA, 25 bp, Mus musculus
ttctttctcccattacagggtttct

SEQ ID NO: 945449 - DNA, 25 bp, Mus musculus
ttctttctccctaacatatccccaa

SEQ ID NO: 945450 - DNA, 25 bp, Mus musculus
ttctttctcccttacatatccccaa

SEQ ID NO: 945451 - DNA, 25 bp, Mus musculus
ttctttctcctaaaagggtatggct

SEQ ID NO: 945452 - DNA, 25 bp, Mus musculus
ttctttctcctataagggtatggct

SEQ ID NO: 945453 - DNA, 25 bp, Mus musculus
ttctttctccttacaatgctccttg

SEQ ID NO: 945454 - DNA, 25 bp, Mus musculus
ttctttctcctttcaatgctccttg

SEQ ID NO: 945455 - DNA, 25 bp, Mus musculus
ttctttctctagatgaaagcttgcg

SEQ ID NO: 945456 - DNA, 25 bp, Mus musculus
ttctttctctagttgaaagcttgcg

SEQ ID NO: 945457 - DNA, 25 bp, Mus musculus
ttctttctctccagtgttaatattt

SEQ ID NO: 945458 - DNA, 25 bp, Mus musculus
ttctttctctccattgacctttgtg

SEQ ID NO: 945459 - DNA, 25 bp, Mus musculus
ttctttctctcccagtcacataaaa

SEQ ID NO: 945460 - DNA, 25 bp, Mus musculus
ttctttctctccgagtcacataaaa

SEQ ID NO: 945461 - DNA, 25 bp, Mus musculus
ttctttctctcctgtgttaatattt

SEQ ID NO: 945462 - DNA, 25 bp, Mus musculus
ttctttctctcctttgacctttgtg

SEQ ID NO: 945463 - DNA, 25 bp, Mus musculus
ttctttctgactcgtaggctgacag

SEQ ID NO: 945464 - DNA, 25 bp, Mus musculus
ttctttctgactggtaggctgacag

SEQ ID NO: 945465 - DNA, 25 bp, Mus musculus
ttctttctgcccagctggtgtgcca

SEQ ID NO: 945466 - DNA, 25 bp, Mus musculus
ttctttctgccctgctggtgtgcca

SEQ ID NO: 945467 - DNA, 25 bp, Mus musculus
ttctttctggaaatcttgacatttg

SEQ ID NO: 945468 - DNA, 25 bp, Mus musculus
ttctttctggaattcttgacatttg

SEQ ID NO: 945469 - DNA, 25 bp, Mus musculus
ttctttctggtgaattgatatccta

SEQ ID NO: 945470 - DNA, 25 bp, Mus musculus
ttctttctggtgtattgatatccta

SEQ ID NO: 945471 - DNA, 25 bp, Mus musculus
ttctttctgtacagaccaggtggat

SEQ ID NO: 945472 - DNA, 25 bp, Mus musculus
ttctttctgtactgaccaggtggat

SEQ ID NO: 945473 - DNA, 25 bp, Mus musculus
ttctttctgtatattcactaaggct

SEQ ID NO: 945474 - DNA, 25 bp, Mus musculus
ttctttctgtattttcactaaggct

SEQ ID NO: 945475 - DNA, 25 bp, Mus musculus
ttctttctgtttagcctagcctact

SEQ ID NO: 945476 - DNA, 25 bp, Mus musculus
ttctttctgttttgcctagcctact

SEQ ID NO: 945477 - DNA, 25 bp, Mus musculus
ttctttcttatgatcttgacccacc

SEQ ID NO: 945478 - DNA, 25 bp, Mus musculus
ttctttcttatgttcttgacccacc

SEQ ID NO: 945479 - DNA, 25 bp, Mus musculus
ttctttcttcaaactcaaggtctta

SEQ ID NO: 945480 - DNA, 25 bp, Mus musculus
ttctttcttcaatctcaaggtctta

SEQ ID NO: 945481 - DNA, 25 bp, Mus musculus
ttctttcttcacaggtatgcttcac

SEQ ID NO: 945482 - DNA, 25 bp, Mus musculus
ttctttcttcactggtatgcttcac

SEQ ID NO: 945483 - DNA, 25 bp, Mus musculus
ttctttcttcagaagtgtttgctaa

SEQ ID NO: 945484 - DNA, 25 bp, Mus musculus
ttctttcttcagtagtgtttgctaa

SEQ ID NO: 945485 - DNA, 25 bp, Mus musculus
ttctttcttcccaatttcgtatcaa

SEQ ID NO: 945486 - DNA, 25 bp, Mus musculus
ttctttcttccctatttcgtatcaa

SEQ ID NO: 945487 - DNA, 25 bp, Mus musculus
ttctttcttctaagcccactgaatt

SEQ ID NO: 945488 - DNA, 25 bp, Mus musculus
ttctttcttctatgcccactgaatt

SEQ ID NO: 945489 - DNA, 25 bp, Mus musculus
ttctttcttctcaaccctaactaag

SEQ ID NO: 945490 - DNA, 25 bp, Mus musculus
ttctttcttctcagacatggagggt

SEQ ID NO: 945491 - DNA, 25 bp, Mus musculus
ttctttcttctctaccctaactaag

SEQ ID NO: 945492 - DNA, 25 bp, Mus musculus
ttctttcttctctgacatggagggt

SEQ ID NO: 945493 - DNA, 25 bp, Mus musculus
ttctttcttctgagtcagtgttggc

SEQ ID NO: 945494 - DNA, 25 bp, Mus musculus
ttctttcttctgtgtcagtgttggc

SEQ ID NO: 945495 - DNA, 25 bp, Mus musculus
ttctttcttgacaggctgttctctt

SEQ ID NO: 945496 - DNA, 25 bp, Mus musculus
ttctttcttgactggctgttctctt

SEQ ID NO: 945497 - DNA, 25 bp, Mus musculus
ttctttcttgagagattctctcccc

SEQ ID NO: 945498 - DNA, 25 bp, Mus musculus
ttctttcttgagtgattctctcccc

SEQ ID NO: 945499 - DNA, 25 bp, Mus musculus
ttctttcttggacagctcacgattg

SEQ ID NO: 945500 - DNA, 25 bp, Mus musculus
ttctttcttggagagctcacgattg

SEQ ID NO: 945501 - DNA, 25 bp, Mus musculus
ttctttcttgtgctttgattctttg

SEQ ID NO: 945502 - DNA, 25 bp, Mus musculus
ttctttcttgtggtttgattctttg

SEQ ID NO: 945503 - DNA, 25 bp, Mus musculus
ttctttcttgttcttggctatttcc

SEQ ID NO: 945504 - DNA, 25 bp, Mus musculus
ttctttcttgttgttggctatttcc

SEQ ID NO: 945505 - DNA, 25 bp, Mus musculus
ttctttctttcaaactttacccaat

SEQ ID NO: 945506 - DNA, 25 bp, Mus musculus
ttctttctttcatactttacccaat

SEQ ID NO: 945507 - DNA, 25 bp, Mus musculus
ttctttctttccaaccctgggcact

SEQ ID NO: 945508 - DNA, 25 bp, Mus musculus
ttctttctttccaggctgaattttt

SEQ ID NO: 945509 - DNA, 25 bp, Mus musculus
ttctttctttcctaccctgggcact

SEQ ID NO: 945510 - DNA, 25 bp, Mus musculus
ttctttctttcctggctgaattttt

SEQ ID NO: 945511 - DNA, 25 bp, Mus musculus
ttctttcttttcagggagtttgtgg

SEQ ID NO: 945512 - DNA, 25 bp, Mus musculus
ttctttcttttctgggagtttgtgg

SEQ ID NO: 945513 - DNA, 25 bp, Mus musculus
ttctttgaaggcagggtttctcttt

SEQ ID NO: 945514 - DNA, 25 bp, Mus musculus
ttctttgaaggctgggtttctcttt

SEQ ID NO: 945515 - DNA, 25 bp, Mus musculus
ttctttgaagtgacagtagccggga

SEQ ID NO: 945516 - DNA, 25 bp, Mus musculus
ttctttgaagtgtcagtagccggga

SEQ ID NO: 945517 - DNA, 25 bp, Mus musculus
ttctttgacgtgcagcgggcagcca

SEQ ID NO: 945518 - DNA, 25 bp, Mus musculus
ttctttgacgtggagcgggcagcca

SEQ ID NO: 945519 - DNA, 25 bp, Mus musculus
ttctttgagagaagacagtcctgag

SEQ ID NO: 945520 - DNA, 25 bp, Mus musculus
ttctttgagagatgacagtcctgag

SEQ ID NO: 945521 - DNA, 25 bp, Mus musculus
ttctttgagataattttcctgatga

SEQ ID NO: 945522 - DNA, 25 bp, Mus musculus
ttctttgagatatttttcctgatga

SEQ ID NO: 945523 - DNA, 25 bp, Mus musculus
ttctttgagccacacgccaacttga

SEQ ID NO: 945524 - DNA, 25 bp, Mus musculus
ttctttgagccagacgccaacttga

SEQ ID NO: 945525 - DNA, 25 bp, Mus musculus
ttctttgagtaccaacgcctttaat

SEQ ID NO: 945526 - DNA, 25 bp, Mus musculus
ttctttgagtacgaacgcctttaat

SEQ ID NO: 945527 - DNA, 25 bp, Mus musculus
ttctttgatagaaccgtaccccagg

SEQ ID NO: 945528 - DNA, 25 bp, Mus musculus
ttctttgatagatccgtaccccagg

SEQ ID NO: 945529 - DNA, 25 bp, Mus musculus
ttctttgatatacaagcacatcaca

SEQ ID NO: 945530 - DNA, 25 bp, Mus musculus
ttctttgatatagaagcacatcaca

SEQ ID NO: 945531 - DNA, 25 bp, Mus musculus
ttctttgcacggatgcagtttgaca

SEQ ID NO: 945532 - DNA, 25 bp, Mus musculus
ttctttgcacggttgcagtttgaca

SEQ ID NO: 945533 - DNA, 25 bp, Mus musculus
ttctttgcagccatacctgactgta

SEQ ID NO: 945534 - DNA, 25 bp, Mus musculus
ttctttgcagccttacctgactgta

SEQ ID NO: 945535 - DNA, 25 bp, Mus musculus
ttctttgcaggtatctgtagccgga

SEQ ID NO: 945536 - DNA, 25 bp, Mus musculus
ttctttgcaggtttctgtagccgga

SEQ ID NO: 945537 - DNA, 25 bp, Mus musculus
ttctttgccacactggagcacaatg

SEQ ID NO: 945538 - DNA, 25 bp, Mus musculus
ttctttgccacagtggagcacaatg

SEQ ID NO: 945539 - DNA, 25 bp, Mus musculus
ttctttgccaggactcacttacagc

SEQ ID NO: 945540 - DNA, 25 bp, Mus musculus
ttctttgccaggtctcacttacagc

SEQ ID NO: 945541 - DNA, 25 bp, Mus musculus
ttctttgccagtatgttgacatatc

SEQ ID NO: 945542 - DNA, 25 bp, Mus musculus
ttctttgccagtttgttgacatatc

SEQ ID NO: 945543 - DNA, 25 bp, Mus musculus
ttctttgccattccagtaactttcc

SEQ ID NO: 945544 - DNA, 25 bp, Mus musculus
ttctttgccattgcagtaactttcc

SEQ ID NO: 945545 - DNA, 25 bp, Mus musculus
ttctttgcccaacgaattctacttc

SEQ ID NO: 945546 - DNA, 25 bp, Mus musculus
ttctttgcccaaggaattctacttc

SEQ ID NO: 945547 - DNA, 25 bp, Mus musculus
ttctttgccccgattccatttcaat

SEQ ID NO: 945548 - DNA, 25 bp, Mus musculus
ttctttgccccgtttccatttcaat

SEQ ID NO: 945549 - DNA, 25 bp, Mus musculus
ttctttgcccgaagatttgccccat

SEQ ID NO: 945550 - DNA, 25 bp, Mus musculus
ttctttgcccgatgatttgccccat

SEQ ID NO: 945551 - DNA, 25 bp, Mus musculus
ttctttgccctgaagcactcataaa

SEQ ID NO: 945552 - DNA, 25 bp, Mus musculus
ttctttgccctgtagcactcataaa

SEQ ID NO: 945553 - DNA, 25 bp, Mus musculus
ttctttgcccttctaaatgtttatt

SEQ ID NO: 945554 - DNA, 25 bp, Mus musculus
ttctttgcccttgtaaatgtttatt

SEQ ID NO: 945555 - DNA, 25 bp, Mus musculus
ttctttgcctatcgatttcctactg

SEQ ID NO: 945556 - DNA, 25 bp, Mus musculus
ttctttgcctatggatttcctactg

SEQ ID NO: 945557 - DNA, 25 bp, Mus musculus
ttctttgccttacctttgcagtgag

SEQ ID NO: 945558 - DNA, 25 bp, Mus musculus
ttctttgccttagctttgcagtgag

SEQ ID NO: 945559 - DNA, 25 bp, Mus musculus
ttctttgcggcaccagaagcaagca

SEQ ID NO: 945560 - DNA, 25 bp, Mus musculus
ttctttgcggcagcagaagcaagca

SEQ ID NO: 945561 - DNA, 25 bp, Mus musculus
ttctttgctcccagccttgaaatag

SEQ ID NO: 945562 - DNA, 25 bp, Mus musculus
ttctttgctccctgccttgaaatag

SEQ ID NO: 945563 - DNA, 25 bp, Mus musculus
ttctttgctgagatcaggtaaccga

SEQ ID NO: 945564 - DNA, 25 bp, Mus musculus
ttctttgctgagttcaggtaaccga

SEQ ID NO: 945565 - DNA, 25 bp, Mus musculus
ttctttgctgctcatctgttggata

SEQ ID NO: 945566 - DNA, 25 bp, Mus musculus
ttctttgctgctgatctgttggata

SEQ ID NO: 945567 - DNA, 25 bp, Mus musculus
ttctttgctgtcattctttgtcata

SEQ ID NO: 945568 - DNA, 25 bp, Mus musculus
ttctttgctgtcctcaagtgtgatg

SEQ ID NO: 945569 - DNA, 25 bp, Mus musculus
ttctttgctgtcgtcaagtgtgatg

SEQ ID NO: 945570 - DNA, 25 bp, Mus musculus
ttctttgctgtctttctttgtcata

SEQ ID NO: 945571 - DNA, 25 bp, Mus musculus
ttctttgcttttatccctttgtctc

SEQ ID NO: 945572 - DNA, 25 bp, Mus musculus
ttctttgcttttttccctttgtctc

SEQ ID NO: 945573 - DNA, 25 bp, Mus musculus
ttctttggaaccacctggaggccat

SEQ ID NO: 945574 - DNA, 25 bp, Mus musculus
ttctttggaacctcctggaggccat

SEQ ID NO: 945575 - DNA, 25 bp, Mus musculus
ttctttggaagcctgtattagtcag

SEQ ID NO: 945576 - DNA, 25 bp, Mus musculus
ttctttggaagcgtgtattagtcag

SEQ ID NO: 945577 - DNA, 25 bp, Mus musculus
ttctttggacccagggctcgagtga

SEQ ID NO: 945578 - DNA, 25 bp, Mus musculus
ttctttggaccctgggctcgagtga

SEQ ID NO: 945579 - DNA, 25 bp, Mus musculus
ttctttggactcatggcagctgctg

SEQ ID NO: 945580 - DNA, 25 bp, Mus musculus
ttctttggactcttggcagctgctg

SEQ ID NO: 945581 - DNA, 25 bp, Mus musculus
ttctttggacttatagcctgggctg

SEQ ID NO: 945582 - DNA, 25 bp, Mus musculus
ttctttggacttttagcctgggctg

SEQ ID NO: 945583 - DNA, 25 bp, Mus musculus
ttctttggagcgcaaaccaggaaag

SEQ ID NO: 945584 - DNA, 25 bp, Mus musculus
ttctttggagcggaaaccaggaaag

SEQ ID NO: 945585 - DNA, 25 bp, Mus musculus
ttctttggaggcacctagcagggtg

SEQ ID NO: 945586 - DNA, 25 bp, Mus musculus
ttctttggaggctcctagcagggtg

SEQ ID NO: 945587 - DNA, 25 bp, Mus musculus
ttctttggagtcagcaccgagggtg

SEQ ID NO: 945588 - DNA, 25 bp, Mus musculus
ttctttggagtctgcaccgagggtg

SEQ ID NO: 945589 - DNA, 25 bp, Mus musculus
ttctttggccagacgggagcacgga

SEQ ID NO: 945590 - DNA, 25 bp, Mus musculus
ttctttggccagtcgggagcacgga

SEQ ID NO: 945591 - DNA, 25 bp, Mus musculus
ttctttggcccaacctgtttcttgt

SEQ ID NO: 945592 - DNA, 25 bp, Mus musculus
ttctttggcccatcctgtttcttgt

SEQ ID NO: 945593 - DNA, 25 bp, Mus musculus
ttctttggctggatcttaagtatga

SEQ ID NO: 945594 - DNA, 25 bp, Mus musculus
ttctttggctggttcttaagtatga

SEQ ID NO: 945595 - DNA, 25 bp, Mus musculus
ttctttgggaaaaactgcctttggc

SEQ ID NO: 945596 - DNA, 25 bp, Mus musculus
ttctttgggaaatactgcctttggc

SEQ ID NO: 945597 - DNA, 25 bp, Mus musculus
ttctttgggaccactgaccctacaa

SEQ ID NO: 945598 - DNA, 25 bp, Mus musculus
ttctttgggacctctgaccctacaa

SEQ ID NO: 945599 - DNA, 25 bp, Mus musculus
ttctttgggctgagcatctgagatg

SEQ ID NO: 945600 - DNA, 25 bp, Mus musculus
ttctttgggctgtgcatctgagatg

SEQ ID NO: 945601 - DNA, 25 bp, Mus musculus
ttctttggggtgatttcaggtgtgc

SEQ ID NO: 945602 - DNA, 25 bp, Mus musculus
ttctttggggtgttttcaggtgtgc

SEQ ID NO: 945603 - DNA, 25 bp, Mus musculus
ttctttgggttcacaggcatggttc

SEQ ID NO: 945604 - DNA, 25 bp, Mus musculus
ttctttgggttctcaggcatggttc

SEQ ID NO: 945605 - DNA, 25 bp, Mus musculus
ttctttgggtttactagagctcctt

SEQ ID NO: 945606 - DNA, 25 bp, Mus musculus
ttctttgggttttctagagctcctt

SEQ ID NO: 945607 - DNA, 25 bp, Mus musculus
ttctttggtctcctgggctatagcc

SEQ ID NO: 945608 - DNA, 25 bp, Mus musculus
ttctttggtctcgtgggctatagcc

SEQ ID NO: 945609 - DNA, 25 bp, Mus musculus
ttctttggtgacagtccctattgta

SEQ ID NO: 945610 - DNA, 25 bp, Mus musculus
ttctttggtgactgtccctattgta

SEQ ID NO: 945611 - DNA, 25 bp, Mus musculus
ttctttggtgccctaaaactgctgt

SEQ ID NO: 945612 - DNA, 25 bp, Mus musculus
ttctttggtgccgtaaaactgctgt

SEQ ID NO: 945613 - DNA, 25 bp, Mus musculus
ttctttggtttcctgactggttttg

SEQ ID NO: 945614 - DNA, 25 bp, Mus musculus
ttctttggtttcgtgactggttttg

SEQ ID NO: 945615 - DNA, 25 bp, Mus musculus
ttctttgtaagtcgtcagtcattca

SEQ ID NO: 945616 - DNA, 25 bp, Mus musculus
ttctttgtaagtggtcagtcattca

SEQ ID NO: 945617 - DNA, 25 bp, Mus musculus
ttctttgtacagattatcccagtgt

SEQ ID NO: 945618 - DNA, 25 bp, Mus musculus
ttctttgtacagtttatcccagtgt

SEQ ID NO: 945619 - DNA, 25 bp, Mus musculus
ttctttgtagaaactcgctgggtta

SEQ ID NO: 945620 - DNA, 25 bp, Mus musculus
ttctttgtagaatctcgctgggtta

SEQ ID NO: 945621 - DNA, 25 bp, Mus musculus
ttctttgtataactcagccttggga

SEQ ID NO: 945622 - DNA, 25 bp, Mus musculus
ttctttgtataagtcagccttggga

SEQ ID NO: 945623 - DNA, 25 bp, Mus musculus
ttctttgtattcattcagtcttgat

SEQ ID NO: 945624 - DNA, 25 bp, Mus musculus
ttctttgtattctttcagtcttgat

SEQ ID NO: 945625 - DNA, 25 bp, Mus musculus
ttctttgtcacaagctgggctactg

SEQ ID NO: 945626 - DNA, 25 bp, Mus musculus
ttctttgtcacacagccaaactgag

SEQ ID NO: 945627 - DNA, 25 bp, Mus musculus
ttctttgtcacagagccaaactgag

SEQ ID NO: 945628 - DNA, 25 bp, Mus musculus
ttctttgtcacatgctgggctactg

SEQ ID NO: 945629 - DNA, 25 bp, Mus musculus
ttctttgtcaggcatcttcttgatg

SEQ ID NO: 945630 - DNA, 25 bp, Mus musculus
ttctttgtcagggatcttcttgatg

SEQ ID NO: 945631 - DNA, 25 bp, Mus musculus
ttctttgtcccgatctacttataat

SEQ ID NO: 945632 - DNA, 25 bp, Mus musculus
ttctttgtcccgttctacttataat

SEQ ID NO: 945633 - DNA, 25 bp, Mus musculus
ttctttgtccctccaaatgggtctc

SEQ ID NO: 945634 - DNA, 25 bp, Mus musculus
ttctttgtccctgcaaatgggtctc

SEQ ID NO: 945635 - DNA, 25 bp, Mus musculus
ttctttgtccgcacacagcacacat

SEQ ID NO: 945636 - DNA, 25 bp, Mus musculus
ttctttgtccgctcacagcacacat

SEQ ID NO: 945637 - DNA, 25 bp, Mus musculus
ttctttgtcttgactagagctgctc

SEQ ID NO: 945638 - DNA, 25 bp, Mus musculus
ttctttgtcttgtctagagctgctc

SEQ ID NO: 945639 - DNA, 25 bp, Mus musculus
ttctttgtgatgctcacagctgctt

SEQ ID NO: 945640 - DNA, 25 bp, Mus musculus
ttctttgtgatggtcacagctgctt

SEQ ID NO: 945641 - DNA, 25 bp, Mus musculus
ttctttgtgcctatacttactgtct

SEQ ID NO: 945642 - DNA, 25 bp, Mus musculus
ttctttgtgcctttacttactgtct

SEQ ID NO: 945643 - DNA, 25 bp, Mus musculus
ttctttgtgcggattctgaatgcca

SEQ ID NO: 945644 - DNA, 25 bp, Mus musculus
ttctttgtgcggtttctgaatgcca

SEQ ID NO: 945645 - DNA, 25 bp, Mus musculus
ttctttgtggacattctctggcacc

SEQ ID NO: 945646 - DNA, 25 bp, Mus musculus
ttctttgtggactttctctggcacc

SEQ ID NO: 945647 - DNA, 25 bp, Mus musculus
ttctttgtgtaacggccctggccgt

SEQ ID NO: 945648 - DNA, 25 bp, Mus musculus
ttctttgtgtaagggccctggccgt

SEQ ID NO: 945649 - DNA, 25 bp, Mus musculus
ttctttgttatcattctgtctccct

SEQ ID NO: 945650 - DNA, 25 bp, Mus musculus
ttctttgttatctttctgtctccct

SEQ ID NO: 945651 - DNA, 25 bp, Mus musculus
ttctttgttcgcaccttttccctct

SEQ ID NO: 945652 - DNA, 25 bp, Mus musculus
ttctttgttcgctccttttccctct

SEQ ID NO: 945653 - DNA, 25 bp, Mus musculus
ttctttgttgataactgtagcttgt

SEQ ID NO: 945654 - DNA, 25 bp, Mus musculus
ttctttgttgattactgtagcttgt

SEQ ID NO: 945655 - DNA, 25 bp, Mus musculus
ttctttgttgtgacatacaggccct

SEQ ID NO: 945656 - DNA, 25 bp, Mus musculus
ttctttgttgtgtcatacaggccct

SEQ ID NO: 945657 - DNA, 25 bp, Mus musculus
ttctttgtttctcgttgttgaggca

SEQ ID NO: 945658 - DNA, 25 bp, Mus musculus
ttctttgtttctggttgttgaggca

SEQ ID NO: 945659 - DNA, 25 bp, Mus musculus
ttcttttaaaccagggtgccacagg

SEQ ID NO: 945660 - DNA, 25 bp, Mus musculus
ttcttttaaacctgggtgccacagg

SEQ ID NO: 945661 - DNA, 25 bp, Mus musculus
ttcttttaatatcttccccatcaac

SEQ ID NO: 945662 - DNA, 25 bp, Mus musculus
ttcttttaatatgttccccatcaac

SEQ ID NO: 945663 - DNA, 25 bp, Mus musculus
ttcttttaatgtcatgctgtttaga

SEQ ID NO: 945664 - DNA, 25 bp, Mus musculus
ttcttttaatgtgatgctgtttaga

SEQ ID NO: 945665 - DNA, 25 bp, Mus musculus
ttcttttacaccatgttcctgcact

SEQ ID NO: 945666 - DNA, 25 bp, Mus musculus
ttcttttacaccttgttcctgcact

SEQ ID NO: 945667 - DNA, 25 bp, Mus musculus
ttcttttacatcagcacctctggga

SEQ ID NO: 945668 - DNA, 25 bp, Mus musculus
ttcttttacatctgcacctctggga

SEQ ID NO: 945669 - DNA, 25 bp, Mus musculus
ttcttttacccacatcttttcaata

SEQ ID NO: 945670 - DNA, 25 bp, Mus musculus
ttcttttacccagatcttttcaata

SEQ ID NO: 945671 - DNA, 25 bp, Mus musculus
ttcttttagagcagaccgtgttcca

SEQ ID NO: 945672 - DNA, 25 bp, Mus musculus
ttcttttagagctgaccgtgttcca

SEQ ID NO: 945673 - DNA, 25 bp, Mus musculus
ttcttttagcctagtcactgcctga

SEQ ID NO: 945674 - DNA, 25 bp, Mus musculus
ttcttttagccttgtcactgcctga

SEQ ID NO: 945675 - DNA, 25 bp, Mus musculus
ttcttttaggccactcctttatagt

SEQ ID NO: 945676 - DNA, 25 bp, Mus musculus
ttcttttaggcctctcctttatagt

SEQ ID NO: 945677 - DNA, 25 bp, Mus musculus
ttcttttagtcactttatcccatcc

SEQ ID NO: 945678 - DNA, 25 bp, Mus musculus
ttcttttagtcagtttatcccatcc

SEQ ID NO: 945679 - DNA, 25 bp, Mus musculus
ttcttttagtccattttatattgag

SEQ ID NO: 945680 - DNA, 25 bp, Mus musculus
ttcttttagtcctttttatattgag

SEQ ID NO: 945681 - DNA, 25 bp, Mus musculus
ttcttttagtggacatatattggct

SEQ ID NO: 945682 - DNA, 25 bp, Mus musculus
ttcttttagtggtcatatattggct

SEQ ID NO: 945683 - DNA, 25 bp, Mus musculus
ttcttttagttgatggtgcccctct

SEQ ID NO: 945684 - DNA, 25 bp, Mus musculus
ttcttttagttgttggtgcccctct

SEQ ID NO: 945685 - DNA, 25 bp, Mus musculus
ttcttttataagacacttctgtgtt

SEQ ID NO: 945686 - DNA, 25 bp, Mus musculus
ttcttttataagtcacttctgtgtt

SEQ ID NO: 945687 - DNA, 25 bp, Mus musculus
ttcttttataggaaagcaggctcac

SEQ ID NO: 945688 - DNA, 25 bp, Mus musculus
ttcttttataggtaagcaggctcac

SEQ ID NO: 945689 - DNA, 25 bp, Mus musculus
ttcttttatcttagtccctccactt

SEQ ID NO: 945690 - DNA, 25 bp, Mus musculus
ttcttttatctttgtccctccactt

SEQ ID NO: 945691 - DNA, 25 bp, Mus musculus
ttcttttattaacatgctgctccca

SEQ ID NO: 945692 - DNA, 25 bp, Mus musculus
ttcttttattaagatgctgctccca

SEQ ID NO: 945693 - DNA, 25 bp, Mus musculus
ttcttttcaaaaaagcattccccaa

SEQ ID NO: 945694 - DNA, 25 bp, Mus musculus
ttcttttcaaaatagcattccccaa

SEQ ID NO: 945695 - DNA, 25 bp, Mus musculus
ttcttttcaactcactgtgtcccct

SEQ ID NO: 945696 - DNA, 25 bp, Mus musculus
ttcttttcaactgactgtgtcccct

SEQ ID NO: 945697 - DNA, 25 bp, Mus musculus
ttcttttcactgatgttcacgatgt

SEQ ID NO: 945698 - DNA, 25 bp, Mus musculus
ttcttttcactgctttatctacaga

SEQ ID NO: 945699 - DNA, 25 bp, Mus musculus
ttcttttcactggtttatctacaga

SEQ ID NO: 945700 - DNA, 25 bp, Mus musculus
ttcttttcactgttgttcacgatgt

SEQ ID NO: 945701 - DNA, 25 bp, Mus musculus
ttcttttcacttactaatcttgaca

SEQ ID NO: 945702 - DNA, 25 bp, Mus musculus
ttcttttcactttctaatcttgaca

SEQ ID NO: 945703 - DNA, 25 bp, Mus musculus
ttcttttccccaaaaaaggctcttg

SEQ ID NO: 945704 - DNA, 25 bp, Mus musculus
ttcttttccccataaaaggctcttg

SEQ ID NO: 945705 - DNA, 25 bp, Mus musculus
ttcttttcccttctatagtgagttg

SEQ ID NO: 945706 - DNA, 25 bp, Mus musculus
ttcttttcccttgtatagtgagttg

SEQ ID NO: 945707 - DNA, 25 bp, Mus musculus
ttcttttcctagctattctagccta

SEQ ID NO: 945708 - DNA, 25 bp, Mus musculus
ttcttttcctaggtattctagccta

SEQ ID NO: 945709 - DNA, 25 bp, Mus musculus
ttcttttccttcagagaccgtgaca

SEQ ID NO: 945710 - DNA, 25 bp, Mus musculus
ttcttttccttctgagaccgtgaca

SEQ ID NO: 945711 - DNA, 25 bp, Mus musculus
ttcttttctcaaaattcccctttct

SEQ ID NO: 945712 - DNA, 25 bp, Mus musculus
ttcttttctcaatattcccctttct

SEQ ID NO: 945713 - DNA, 25 bp, Mus musculus
ttcttttctcagcacctgtggagga

SEQ ID NO: 945714 - DNA, 25 bp, Mus musculus
ttcttttctcaggacctgtggagga

SEQ ID NO: 945715 - DNA, 25 bp, Mus musculus
ttcttttctcctaaccagtgcttaa

SEQ ID NO: 945716 - DNA, 25 bp, Mus musculus
ttcttttctccttaccagtgcttaa

SEQ ID NO: 945717 - DNA, 25 bp, Mus musculus
ttcttttctgagagattgggagcca

SEQ ID NO: 945718 - DNA, 25 bp, Mus musculus
ttcttttctgagtgattgggagcca

SEQ ID NO: 945719 - DNA, 25 bp, Mus musculus
ttcttttctgtaagatgtgcatgca

SEQ ID NO: 945720 - DNA, 25 bp, Mus musculus
ttcttttctgtatgatgtgcatgca

SEQ ID NO: 945721 - DNA, 25 bp, Mus musculus
ttcttttctgtcacctcagtatttg

SEQ ID NO: 945722 - DNA, 25 bp, Mus musculus
ttcttttctgtctcctcagtatttg

SEQ ID NO: 945723 - DNA, 25 bp, Mus musculus
ttcttttctgttaatgagtgtgaca

SEQ ID NO: 945724 - DNA, 25 bp, Mus musculus
ttcttttctgtttatgagtgtgaca

SEQ ID NO: 945725 - DNA, 25 bp, Mus musculus
ttcttttcttaaccttaactctgca

SEQ ID NO: 945726 - DNA, 25 bp, Mus musculus
ttcttttcttaagcttaactctgca

SEQ ID NO: 945727 - DNA, 25 bp, Mus musculus
ttcttttcttacctggagcctctga

SEQ ID NO: 945728 - DNA, 25 bp, Mus musculus
ttcttttcttacgtggagcctctga

SEQ ID NO: 945729 - DNA, 25 bp, Mus musculus
ttcttttcttcgattggcccaaatg

SEQ ID NO: 945730 - DNA, 25 bp, Mus musculus
ttcttttcttcgtttggcccaaatg

SEQ ID NO: 945731 - DNA, 25 bp, Mus musculus
ttcttttgacctacattttcctata

SEQ ID NO: 945732 - DNA, 25 bp, Mus musculus
ttcttttgaccttcattttcctata

SEQ ID NO: 945733 - DNA, 25 bp, Mus musculus
ttcttttgagccaccttccattttc

SEQ ID NO: 945734 - DNA, 25 bp, Mus musculus
ttcttttgagcctccttccattttc

SEQ ID NO: 945735 - DNA, 25 bp, Mus musculus
ttcttttgaggaaggtgtgtctaat

SEQ ID NO: 945736 - DNA, 25 bp, Mus musculus
ttcttttgaggatggtgtgtctaat

SEQ ID NO: 945737 - DNA, 25 bp, Mus musculus
ttcttttgaggcaaaagtcccctat

SEQ ID NO: 945738 - DNA, 25 bp, Mus musculus
ttcttttgaggctaaagtcccctat

SEQ ID NO: 945739 - DNA, 25 bp, Mus musculus
ttcttttgagttccatggtccccaa

SEQ ID NO: 945740 - DNA, 25 bp, Mus musculus
ttcttttgagttgcatggtccccaa

SEQ ID NO: 945741 - DNA, 25 bp, Mus musculus
ttcttttgatacatgcccttcactg

SEQ ID NO: 945742 - DNA, 25 bp, Mus musculus
ttcttttgatacttgcccttcactg

SEQ ID NO: 945743 - DNA, 25 bp, Mus musculus
ttcttttgccacctacttctaactt

SEQ ID NO: 945744 - DNA, 25 bp, Mus musculus
ttcttttgccacgtacttctaactt

SEQ ID NO: 945745 - DNA, 25 bp, Mus musculus
ttcttttgccagatttccagcagag

SEQ ID NO: 945746 - DNA, 25 bp, Mus musculus
ttcttttgccagttttccagcagag

SEQ ID NO: 945747 - DNA, 25 bp, Mus musculus
ttcttttgcctcatttgatgctgca

SEQ ID NO: 945748 - DNA, 25 bp, Mus musculus
ttcttttgcctcttttgatgctgca

SEQ ID NO: 945749 - DNA, 25 bp, Mus musculus
ttcttttgctctacctagtggcacc

SEQ ID NO: 945750 - DNA, 25 bp, Mus musculus
ttcttttgctcttcctagtggcacc

SEQ ID NO: 945751 - DNA, 25 bp, Mus musculus
ttcttttggaatcgccctgtggtca

SEQ ID NO: 945752 - DNA, 25 bp, Mus musculus
ttcttttggaatggccctgtggtca

SEQ ID NO: 945753 - DNA, 25 bp, Mus musculus
ttcttttggatgcacgcccaacgat

SEQ ID NO: 945754 - DNA, 25 bp, Mus musculus
ttcttttggatggacgcccaacgat

SEQ ID NO: 945755 - DNA, 25 bp, Mus musculus
ttcttttggccaagttcagctctgc

SEQ ID NO: 945756 - DNA, 25 bp, Mus musculus
ttcttttggccatgttcagctctgc

SEQ ID NO: 945757 - DNA, 25 bp, Mus musculus
ttcttttggcttaatccgatttggt

SEQ ID NO: 945758 - DNA, 25 bp, Mus musculus
ttcttttggctttatccgatttggt

SEQ ID NO: 945759 - DNA, 25 bp, Mus musculus
ttcttttggtctctgcaagcttcag

SEQ ID NO: 945760 - DNA, 25 bp, Mus musculus
ttcttttggtctgtgcaagcttcag

SEQ ID NO: 945761 - DNA, 25 bp, Mus musculus
ttcttttggtgacccaggagtgccc

SEQ ID NO: 945762 - DNA, 25 bp, Mus musculus
ttcttttggtgagccaggagtgccc

SEQ ID NO: 945763 - DNA, 25 bp, Mus musculus
ttcttttggtgtatgctgaacgaag

SEQ ID NO: 945764 - DNA, 25 bp, Mus musculus
ttcttttggtgtttgctgaacgaag

SEQ ID NO: 945765 - DNA, 25 bp, Mus musculus
ttcttttggttcagtgttgttttgt

SEQ ID NO: 945766 - DNA, 25 bp, Mus musculus
ttcttttggttctgtgttgttttgt

SEQ ID NO: 945767 - DNA, 25 bp, Mus musculus
ttcttttgtatcatcagttcctgct

SEQ ID NO: 945768 - DNA, 25 bp, Mus musculus
ttcttttgtatcttcagttcctgct

SEQ ID NO: 945769 - DNA, 25 bp, Mus musculus
ttcttttgtctacttccccagtgaa

SEQ ID NO: 945770 - DNA, 25 bp, Mus musculus
ttcttttgtctagttccccagtgaa

SEQ ID NO: 945771 - DNA, 25 bp, Mus musculus
ttcttttgtcttaggtactttgaga

SEQ ID NO: 945772 - DNA, 25 bp, Mus musculus
ttcttttgtcttcataacggtcttt

SEQ ID NO: 945773 - DNA, 25 bp, Mus musculus
ttcttttgtcttgataacggtcttt

SEQ ID NO: 945774 - DNA, 25 bp, Mus musculus
ttcttttgtctttggtactttgaga

SEQ ID NO: 945775 - DNA, 25 bp, Mus musculus
ttcttttgttctatgttgttgtatg

SEQ ID NO: 945776 - DNA, 25 bp, Mus musculus
ttcttttgttctttgttgttgtatg

SEQ ID NO: 945777 - DNA, 25 bp, Mus musculus
ttcttttgtttgctcctgcatttga

SEQ ID NO: 945778 - DNA, 25 bp, Mus musculus
ttcttttgtttggtcctgcatttga

SEQ ID NO: 945779 - DNA, 25 bp, Mus musculus
ttctttttacagcttatccccagca

SEQ ID NO: 945780 - DNA, 25 bp, Mus musculus
ttctttttacaggttatccccagca

SEQ ID NO: 945781 - DNA, 25 bp, Mus musculus
ttctttttagtacccactgaccaat

SEQ ID NO: 945782 - DNA, 25 bp, Mus musculus
ttctttttagtagccactgaccaat

SEQ ID NO: 945783 - DNA, 25 bp, Mus musculus
ttctttttatcccaggaaagctcgg

SEQ ID NO: 945784 - DNA, 25 bp, Mus musculus
ttctttttatccgaggaaagctcgg

SEQ ID NO: 945785 - DNA, 25 bp, Mus musculus
ttctttttcaccaacacgctcatag

SEQ ID NO: 945786 - DNA, 25 bp, Mus musculus
ttctttttcacctacacgctcatag

SEQ ID NO: 945787 - DNA, 25 bp, Mus musculus
ttctttttcaggcttatgtcctctt

SEQ ID NO: 945788 - DNA, 25 bp, Mus musculus
ttctttttcagggttatgtcctctt

SEQ ID NO: 945789 - DNA, 25 bp, Mus musculus
ttctttttcatcagactcttctcac

SEQ ID NO: 945790 - DNA, 25 bp, Mus musculus
ttctttttcatctgactcttctcac

SEQ ID NO: 945791 - DNA, 25 bp, Mus musculus
ttctttttccccatgttagttgtat

SEQ ID NO: 945792 - DNA, 25 bp, Mus musculus
ttctttttccccttgttagttgtat

SEQ ID NO: 945793 - DNA, 25 bp, Mus musculus
ttctttttcggccatcctaagacca

SEQ ID NO: 945794 - DNA, 25 bp, Mus musculus
ttctttttcggcgatcctaagacca

SEQ ID NO: 945795 - DNA, 25 bp, Mus musculus
ttctttttctggctgctcagtattt

SEQ ID NO: 945796 - DNA, 25 bp, Mus musculus
ttctttttctgggtgctcagtattt

SEQ ID NO: 945797 - DNA, 25 bp, Mus musculus
ttctttttctgtctgtcccgagcca

SEQ ID NO: 945798 - DNA, 25 bp, Mus musculus
ttctttttctgtgtgtcccgagcca

SEQ ID NO: 945799 - DNA, 25 bp, Mus musculus
ttctttttcttaaccttcagtgtta

SEQ ID NO: 945800 - DNA, 25 bp, Mus musculus
ttctttttcttatccttcagtgtta

SEQ ID NO: 945801 - DNA, 25 bp, Mus musculus
ttctttttggcaagaggctttccca

SEQ ID NO: 945802 - DNA, 25 bp, Mus musculus
ttctttttggcacgaaaactcgaca

SEQ ID NO: 945803 - DNA, 25 bp, Mus musculus
ttctttttggcaggaaaactcgaca

SEQ ID NO: 945804 - DNA, 25 bp, Mus musculus
ttctttttggcatgaggctttccca

SEQ ID NO: 945805 - DNA, 25 bp, Mus musculus
ttctttttgtgcacaagacccactg

SEQ ID NO: 945806 - DNA, 25 bp, Mus musculus
ttctttttgtgctcaagacccactg

SEQ ID NO: 945807 - DNA, 25 bp, Mus musculus
ttctttttgttactctcactggacg

SEQ ID NO: 945808 - DNA, 25 bp, Mus musculus
ttctttttgttagtctcactggacg

SEQ ID NO: 945809 - DNA, 25 bp, Mus musculus
ttcttttttcgtcttactgggagag

SEQ ID NO: 945810 - DNA, 25 bp, Mus musculus
ttcttttttcgtgttactgggagag

SEQ ID NO: 945811 - DNA, 25 bp, Mus musculus
ttctttttttagctcccgatcacat

SEQ ID NO: 945812 - DNA, 25 bp, Mus musculus
ttctttttttaggtcccgatcacat

SEQ ID NO: 945813 - DNA, 25 bp, Mus musculus
ttgaaaaacacaacccgtggccagc

SEQ ID NO: 945814 - DNA, 25 bp, Mus musculus
ttgaaaaacacatcccgtggccagc

SEQ ID NO: 945815 - DNA, 25 bp, Mus musculus
ttgaaaaaccttacccaccagcttg

SEQ ID NO: 945816 - DNA, 25 bp, Mus musculus
ttgaaaaaccttcctacagtctctt

SEQ ID NO: 945817 - DNA, 25 bp, Mus musculus
ttgaaaaaccttgctacagtctctt

SEQ ID NO: 945818 - DNA, 25 bp, Mus musculus
ttgaaaaacctttcccaccagcttg

SEQ ID NO: 945819 - DNA, 25 bp, Mus musculus
ttgaaaaacgagctggcccagctga

SEQ ID NO: 945820 - DNA, 25 bp, Mus musculus
ttgaaaaacgaggtggcccagctga

SEQ ID NO: 945821 - DNA, 25 bp, Mus musculus
ttgaaaaactaactcgccacaccct

SEQ ID NO: 945822 - DNA, 25 bp, Mus musculus
ttgaaaaactaagtcgccacaccct

SEQ ID NO: 945823 - DNA, 25 bp, Mus musculus
ttgaaaaactcaaccaaatcccagt

SEQ ID NO: 945824 - DNA, 25 bp, Mus musculus
ttgaaaaactcatccaaatcccagt

SEQ ID NO: 945825 - DNA, 25 bp, Mus musculus
ttgaaaaagagcactccctttctcc

SEQ ID NO: 945826 - DNA, 25 bp, Mus musculus
ttgaaaaagagctctccctttctcc

SEQ ID NO: 945827 - DNA, 25 bp, Mus musculus
ttgaaaaaggttcaaggactggctg

SEQ ID NO: 945828 - DNA, 25 bp, Mus musculus
ttgaaaaaggttgaaggactggctg

SEQ ID NO: 945829 - DNA, 25 bp, Mus musculus
ttgaaaaagtccagaaacagcacct

SEQ ID NO: 945830 - DNA, 25 bp, Mus musculus
ttgaaaaagtcctgaaacagcacct

SEQ ID NO: 945831 - DNA, 25 bp, Mus musculus
ttgaaaaattctattagccgggcag

SEQ ID NO: 945832 - DNA, 25 bp, Mus musculus
ttgaaaaattcttttagccgggcag

SEQ ID NO: 945833 - DNA, 25 bp, Mus musculus
ttgaaaaccccaacagatcctgcgg

SEQ ID NO: 945834 - DNA, 25 bp, Mus musculus
ttgaaaaccccatcagatcctgcgg

SEQ ID NO: 945835 - DNA, 25 bp, Mus musculus
ttgaaaacgcaaaccgtgcatttct

SEQ ID NO: 945836 - DNA, 25 bp, Mus musculus
ttgaaaacgcaatccgtgcatttct

SEQ ID NO: 945837 - DNA, 25 bp, Mus musculus
ttgaaaactgcccagcactgacctt

SEQ ID NO: 945838 - DNA, 25 bp, Mus musculus
ttgaaaactgccgagcactgacctt

SEQ ID NO: 945839 - DNA, 25 bp, Mus musculus
ttgaaaagatgtaccctctactttt

SEQ ID NO: 945840 - DNA, 25 bp, Mus musculus
ttgaaaagatgttccctctactttt

SEQ ID NO: 945841 - DNA, 25 bp, Mus musculus
ttgaaaagccagacaccttcctatt

SEQ ID NO: 945842 - DNA, 25 bp, Mus musculus
ttgaaaagccagtcaccttcctatt

SEQ ID NO: 945843 - DNA, 25 bp, Mus musculus
ttgaaaaggtctcccatctcactaa

SEQ ID NO: 945844 - DNA, 25 bp, Mus musculus
ttgaaaaggtctgccatctcactaa

SEQ ID NO: 945845 - DNA, 25 bp, Mus musculus
ttgaaaagttcacggaccttcttgg

SEQ ID NO: 945846 - DNA, 25 bp, Mus musculus
ttgaaaagttcagggaccttcttgg

SEQ ID NO: 945847 - DNA, 25 bp, Mus musculus
ttgaaaagttttcttgggactgaca

SEQ ID NO: 945848 - DNA, 25 bp, Mus musculus
ttgaaaagttttgttgggactgaca

SEQ ID NO: 945849 - DNA, 25 bp, Mus musculus
ttgaaaatacatcccctctcatgat

SEQ ID NO: 945850 - DNA, 25 bp, Mus musculus
ttgaaaatacatgccctctcatgat

SEQ ID NO: 945851 - DNA, 25 bp, Mus musculus
ttgaaaatgcagcagtggtgagaaa

SEQ ID NO: 945852 - DNA, 25 bp, Mus musculus
ttgaaaatgcaggagtggtgagaaa

SEQ ID NO: 945853 - DNA, 25 bp, Mus musculus
ttgaaaatgcccaaactatgatgca

SEQ ID NO: 945854 - DNA, 25 bp, Mus musculus
ttgaaaatgccctaactatgatgca

SEQ ID NO: 945855 - DNA, 25 bp, Mus musculus
ttgaaaatggctccctcagtgacat

SEQ ID NO: 945856 - DNA, 25 bp, Mus musculus
ttgaaaatggctgcctcagtgacat

SEQ ID NO: 945857 - DNA, 25 bp, Mus musculus
ttgaaacacaacctagctaatgctg

SEQ ID NO: 945858 - DNA, 25 bp, Mus musculus
ttgaaacacaacgtagctaatgctg

SEQ ID NO: 945859 - DNA, 25 bp, Mus musculus
ttgaaacacatcacttcagggcaga

SEQ ID NO: 945860 - DNA, 25 bp, Mus musculus
ttgaaacacatctcttcagggcaga

SEQ ID NO: 945861 - DNA, 25 bp, Mus musculus
ttgaaacactccctatcttcggtgc

SEQ ID NO: 945862 - DNA, 25 bp, Mus musculus
ttgaaacactccgtatcttcggtgc

SEQ ID NO: 945863 - DNA, 25 bp, Mus musculus
ttgaaacagggtctgcccagctgac

SEQ ID NO: 945864 - DNA, 25 bp, Mus musculus
ttgaaacagggtgtgcccagctgac

SEQ ID NO: 945865 - DNA, 25 bp, Mus musculus
ttgaaacagtgaccaagctcttccc

SEQ ID NO: 945866 - DNA, 25 bp, Mus musculus
ttgaaacagtgagcaagctcttccc

SEQ ID NO: 945867 - DNA, 25 bp, Mus musculus
ttgaaacagttgacaaattcagtgc

SEQ ID NO: 945868 - DNA, 25 bp, Mus musculus
ttgaaacagttgtcaaattcagtgc

SEQ ID NO: 945869 - DNA, 25 bp, Mus musculus
ttgaaaccaaagagctgggcatcca

SEQ ID NO: 945870 - DNA, 25 bp, Mus musculus
ttgaaaccaaagtgctgggcatcca

SEQ ID NO: 945871 - DNA, 25 bp, Mus musculus
ttgaaaccaacccttcgttcatcag

SEQ ID NO: 945872 - DNA, 25 bp, Mus musculus
ttgaaaccaaccgttcgttcatcag

SEQ ID NO: 945873 - DNA, 25 bp, Mus musculus
ttgaaaccagcaactgagccagcca

SEQ ID NO: 945874 - DNA, 25 bp, Mus musculus
ttgaaaccagcatctgagccagcca

SEQ ID NO: 945875 - DNA, 25 bp, Mus musculus
ttgaaaccagctaggggtactcagt

SEQ ID NO: 945876 - DNA, 25 bp, Mus musculus
ttgaaaccagcttggggtactcagt

SEQ ID NO: 945877 - DNA, 25 bp, Mus musculus
ttgaaaccaggcacagaagtgacat

SEQ ID NO: 945878 - DNA, 25 bp, Mus musculus
ttgaaaccaggctcagaagtgacat

SEQ ID NO: 945879 - DNA, 25 bp, Mus musculus
ttgaaaccagggaagcatggctcct

SEQ ID NO: 945880 - DNA, 25 bp, Mus musculus
ttgaaaccagggtagcatggctcct

SEQ ID NO: 945881 - DNA, 25 bp, Mus musculus
ttgaaaccagtgacggctaaggcct

SEQ ID NO: 945882 - DNA, 25 bp, Mus musculus
ttgaaaccagtgtcggctaaggcct

SEQ ID NO: 945883 - DNA, 25 bp, Mus musculus
ttgaaacccttcatgtatcctctga

SEQ ID NO: 945884 - DNA, 25 bp, Mus musculus
ttgaaacccttcttgtatcctctga

SEQ ID NO: 945885 - DNA, 25 bp, Mus musculus
ttgaaaccgaacacctaacctagat

SEQ ID NO: 945886 - DNA, 25 bp, Mus musculus
ttgaaaccgaactcctaacctagat

SEQ ID NO: 945887 - DNA, 25 bp, Mus musculus
ttgaaaccggctctctctattgtgt

SEQ ID NO: 945888 - DNA, 25 bp, Mus musculus
ttgaaaccggctgtctctattgtgt

SEQ ID NO: 945889 - DNA, 25 bp, Mus musculus
ttgaaaccgtttccaccgacttgct

SEQ ID NO: 945890 - DNA, 25 bp, Mus musculus
ttgaaaccgtttgcaccgacttgct

SEQ ID NO: 945891 - DNA, 25 bp, Mus musculus
ttgaaacctagcacccaacatgctt

SEQ ID NO: 945892 - DNA, 25 bp, Mus musculus
ttgaaacctagctcccaacatgctt

SEQ ID NO: 945893 - DNA, 25 bp, Mus musculus
ttgaaacctctaatctgcctgactt

SEQ ID NO: 945894 - DNA, 25 bp, Mus musculus
ttgaaacctctattctgcctgactt

SEQ ID NO: 945895 - DNA, 25 bp, Mus musculus
ttgaaacctgtgatgtcttttccca

SEQ ID NO: 945896 - DNA, 25 bp, Mus musculus
ttgaaacctgtgttgtcttttccca

SEQ ID NO: 945897 - DNA, 25 bp, Mus musculus
ttgaaaccttgccattgtacctctt

SEQ ID NO: 945898 - DNA, 25 bp, Mus musculus
ttgaaaccttgcgattgtacctctt

SEQ ID NO: 945899 - DNA, 25 bp, Mus musculus
ttgaaacgaattagcctcttcctgc

SEQ ID NO: 945900 - DNA, 25 bp, Mus musculus
ttgaaacgaatttgcctcttcctgc

SEQ ID NO: 945901 - DNA, 25 bp, Mus musculus
ttgaaacggattcagagagaactgg

SEQ ID NO: 945902 - DNA, 25 bp, Mus musculus
ttgaaacggattgagagagaactgg

SEQ ID NO: 945903 - DNA, 25 bp, Mus musculus
ttgaaacgggtgaccggaagactgc

SEQ ID NO: 945904 - DNA, 25 bp, Mus musculus
ttgaaacgggtgtccggaagactgc

SEQ ID NO: 945905 - DNA, 25 bp, Mus musculus
ttgaaacgtaaaaactccacagtct

SEQ ID NO: 945906 - DNA, 25 bp, Mus musculus
ttgaaacgtaaatactccacagtct

SEQ ID NO: 945907 - DNA, 25 bp, Mus musculus
ttgaaactatttctcagggaaccta

SEQ ID NO: 945908 - DNA, 25 bp, Mus musculus
ttgaaactatttgtcagggaaccta

SEQ ID NO: 945909 - DNA, 25 bp, Mus musculus
ttgaaactcaaaattacatgcatgt

SEQ ID NO: 945910 - DNA, 25 bp, Mus musculus
ttgaaactcaaatttacatgcatgt

SEQ ID NO: 945911 - DNA, 25 bp, Mus musculus
ttgaaactctgtctgcagttgcagt

SEQ ID NO: 945912 - DNA, 25 bp, Mus musculus
ttgaaactctgtgtgcagttgcagt

SEQ ID NO: 945913 - DNA, 25 bp, Mus musculus
ttgaaactgtacattctgttgctga

SEQ ID NO: 945914 - DNA, 25 bp, Mus musculus
ttgaaactgtactttctgttgctga

SEQ ID NO: 945915 - DNA, 25 bp, Mus musculus
ttgaaactgtggattcttgcccgcc

SEQ ID NO: 945916 - DNA, 25 bp, Mus musculus
ttgaaactgtggtttcttgcccgcc

SEQ ID NO: 945917 - DNA, 25 bp, Mus musculus
ttgaaacttcaactcactttattac

SEQ ID NO: 945918 - DNA, 25 bp, Mus musculus
ttgaaacttcaagtcactttattac

SEQ ID NO: 945919 - DNA, 25 bp, Mus musculus
ttgaaacttccaagaacccactcaa

SEQ ID NO: 945920 - DNA, 25 bp, Mus musculus
ttgaaacttccatgaacccactcaa

SEQ ID NO: 945921 - DNA, 25 bp, Mus musculus
ttgaaactttacctcagatcacctt

SEQ ID NO: 945922 - DNA, 25 bp, Mus musculus
ttgaaactttacgtcagatcacctt

SEQ ID NO: 945923 - DNA, 25 bp, Mus musculus
ttgaaagaatccactgctgctggct

SEQ ID NO: 945924 - DNA, 25 bp, Mus musculus
ttgaaagaatcctctgctgctggct

SEQ ID NO: 945925 - DNA, 25 bp, Mus musculus
ttgaaagacagcctgcatccttcat

SEQ ID NO: 945926 - DNA, 25 bp, Mus musculus
ttgaaagacagcgtgcatccttcat

SEQ ID NO: 945927 - DNA, 25 bp, Mus musculus
ttgaaagacttccacacagacctct

SEQ ID NO: 945928 - DNA, 25 bp, Mus musculus
ttgaaagacttcgacacagacctct

SEQ ID NO: 945929 - DNA, 25 bp, Mus musculus
ttgaaagatcaacccctttactgcc

SEQ ID NO: 945930 - DNA, 25 bp, Mus musculus
ttgaaagatcaagccctttactgcc

SEQ ID NO: 945931 - DNA, 25 bp, Mus musculus
ttgaaagccagaagaagcagctctt

SEQ ID NO: 945932 - DNA, 25 bp, Mus musculus
ttgaaagccagatgaagcagctctt

SEQ ID NO: 945933 - DNA, 25 bp, Mus musculus
ttgaaagccccaattagcaattatt

SEQ ID NO: 945934 - DNA, 25 bp, Mus musculus
ttgaaagccccatttagcaattatt

SEQ ID NO: 945935 - DNA, 25 bp, Mus musculus
ttgaaagcctccatgcatccacaag

SEQ ID NO: 945936 - DNA, 25 bp, Mus musculus
ttgaaagcctccttgcatccacaag

SEQ ID NO: 945937 - DNA, 25 bp, Mus musculus
ttgaaagctaaccttgttttacaag

SEQ ID NO: 945938 - DNA, 25 bp, Mus musculus
ttgaaagctaacgttgttttacaag

SEQ ID NO: 945939 - DNA, 25 bp, Mus musculus
ttgaaagctattatcctctcaattt

SEQ ID NO: 945940 - DNA, 25 bp, Mus musculus
ttgaaagctattttcctctcaattt

SEQ ID NO: 945941 - DNA, 25 bp, Mus musculus
ttgaaagctctacgccccgcaggct

SEQ ID NO: 945942 - DNA, 25 bp, Mus musculus
ttgaaagctctaggccccgcaggct

SEQ ID NO: 945943 - DNA, 25 bp, Mus musculus
ttgaaagcttccacttccagtttgt

SEQ ID NO: 945944 - DNA, 25 bp, Mus musculus
ttgaaagcttcctcttccagtttgt

SEQ ID NO: 945945 - DNA, 25 bp, Mus musculus
ttgaaagcttggagtccaggctaca

SEQ ID NO: 945946 - DNA, 25 bp, Mus musculus
ttgaaagcttggtgtccaggctaca

SEQ ID NO: 945947 - DNA, 25 bp, Mus musculus
ttgaaagcttgtccccagttggtaa

SEQ ID NO: 945948 - DNA, 25 bp, Mus musculus
ttgaaagcttgtgcccagttggtaa

SEQ ID NO: 945949 - DNA, 25 bp, Mus musculus
ttgaaaggacatagggaggaagctt

SEQ ID NO: 945950 - DNA, 25 bp, Mus musculus
ttgaaaggacattgggaggaagctt

SEQ ID NO: 945951 - DNA, 25 bp, Mus musculus
ttgaaaggattcactagtttttact

SEQ ID NO: 945952 - DNA, 25 bp, Mus musculus
ttgaaaggattctctagtttttact

SEQ ID NO: 945953 - DNA, 25 bp, Mus musculus
ttgaaaggcaggagtctggcccagc

SEQ ID NO: 945954 - DNA, 25 bp, Mus musculus
ttgaaaggcaggtgtctggcccagc

SEQ ID NO: 945955 - DNA, 25 bp, Mus musculus
ttgaaaggctaaagctgccttctta

SEQ ID NO: 945956 - DNA, 25 bp, Mus musculus
ttgaaaggctaatgctgccttctta

SEQ ID NO: 945957 - DNA, 25 bp, Mus musculus
ttgaaagggaccatggccaccctgg

SEQ ID NO: 945958 - DNA, 25 bp, Mus musculus
ttgaaagggaccttggccaccctgg

SEQ ID NO: 945959 - DNA, 25 bp, Mus musculus
ttgaaaggtcttaccattgcacttt

SEQ ID NO: 945960 - DNA, 25 bp, Mus musculus
ttgaaaggtctttccattgcacttt

SEQ ID NO: 945961 - DNA, 25 bp, Mus musculus
ttgaaaggtggtatctccagcacat

SEQ ID NO: 945962 - DNA, 25 bp, Mus musculus
ttgaaaggtggtttctccagcacat

SEQ ID NO: 945963 - DNA, 25 bp, Mus musculus
ttgaaaggtttgctcagtcactctg

SEQ ID NO: 945964 - DNA, 25 bp, Mus musculus
ttgaaaggtttggtcagtcactctg

SEQ ID NO: 945965 - DNA, 25 bp, Mus musculus
ttgaaagtcagcaagccgagcgcgc

SEQ ID NO: 945966 - DNA, 25 bp, Mus musculus
ttgaaagtcagctagccgagcgcgc

SEQ ID NO: 945967 - DNA, 25 bp, Mus musculus
ttgaaagtgaccaggagcttccggt

SEQ ID NO: 945968 - DNA, 25 bp, Mus musculus
ttgaaagtgacctggagcttccggt

SEQ ID NO: 945969 - DNA, 25 bp, Mus musculus
ttgaaagtgccgaccacagtgcatg

SEQ ID NO: 945970 - DNA, 25 bp, Mus musculus
ttgaaagtgccgtccacagtgcatg

SEQ ID NO: 945971 - DNA, 25 bp, Mus musculus
ttgaaagtggcaattcctctggagc

SEQ ID NO: 945972 - DNA, 25 bp, Mus musculus
ttgaaagtggcatttcctctggagc

SEQ ID NO: 945973 - DNA, 25 bp, Mus musculus
ttgaaagttcccagattcttctgtt

SEQ ID NO: 945974 - DNA, 25 bp, Mus musculus
ttgaaagttccctgattcttctgtt

SEQ ID NO: 945975 - DNA, 25 bp, Mus musculus
ttgaaagttcctatggatgttaaag

SEQ ID NO: 945976 - DNA, 25 bp, Mus musculus
ttgaaagttcctttggatgttaaag

SEQ ID NO: 945977 - DNA, 25 bp, Mus musculus
ttgaaagttttccatgtccttcctc

SEQ ID NO: 945978 - DNA, 25 bp, Mus musculus
ttgaaagttttcgatgtccttcctc

SEQ ID NO: 945979 - DNA, 25 bp, Mus musculus
ttgaaatacacgcaaccttacgatg

SEQ ID NO: 945980 - DNA, 25 bp, Mus musculus
ttgaaatacacggaaccttacgatg

SEQ ID NO: 945981 - DNA, 25 bp, Mus musculus
ttgaaatactgaagtctcccactcc

SEQ ID NO: 945982 - DNA, 25 bp, Mus musculus
ttgaaatactgatgtctcccactcc

SEQ ID NO: 945983 - DNA, 25 bp, Mus musculus
ttgaaatagtttctggtgggttcag

SEQ ID NO: 945984 - DNA, 25 bp, Mus musculus
ttgaaatagtttgtggtgggttcag

SEQ ID NO: 945985 - DNA, 25 bp, Mus musculus
ttgaaatcagccagcacgccaagta

SEQ ID NO: 945986 - DNA, 25 bp, Mus musculus
ttgaaatcagcctgcacgccaagta

SEQ ID NO: 945987 - DNA, 25 bp, Mus musculus
ttgaaatcccacacctatcagacaa

SEQ ID NO: 945988 - DNA, 25 bp, Mus musculus
ttgaaatcccactcctatcagacaa

SEQ ID NO: 945989 - DNA, 25 bp, Mus musculus
ttgaaatcccatacttgccaaataa

SEQ ID NO: 945990 - DNA, 25 bp, Mus musculus
ttgaaatcccattcttgccaaataa

SEQ ID NO: 945991 - DNA, 25 bp, Mus musculus
ttgaaatcgaacctttgtgccctat

SEQ ID NO: 945992 - DNA, 25 bp, Mus musculus
ttgaaatcgaacgtttgtgccctat

SEQ ID NO: 945993 - DNA, 25 bp, Mus musculus
ttgaaatctactaagccccacaacc

SEQ ID NO: 945994 - DNA, 25 bp, Mus musculus
ttgaaatctacttagccccacaacc

SEQ ID NO: 945995 - DNA, 25 bp, Mus musculus
ttgaaatctatacgtgtgtatctca

SEQ ID NO: 945996 - DNA, 25 bp, Mus musculus
ttgaaatctataggtgtgtatctca

SEQ ID NO: 945997 - DNA, 25 bp, Mus musculus
ttgaaatctcccaggtcaaggctga

SEQ ID NO: 945998 - DNA, 25 bp, Mus musculus
ttgaaatctccctggtcaaggctga

SEQ ID NO: 945999 - DNA, 25 bp, Mus musculus
ttgaaatctcttaccgagtgtggat

SEQ ID NO: 946000 - DNA, 25 bp, Mus musculus
ttgaaatctctttccgagtgtggat

SEQ ID NO: 946001 - DNA, 25 bp, Mus musculus
ttgaaatctgcaagagtcttctcac

SEQ ID NO: 946002 - DNA, 25 bp, Mus musculus
ttgaaatctgcatgagtcttctcac

SEQ ID NO: 946003 - DNA, 25 bp, Mus musculus
ttgaaatggtaacgcttctccaagc

SEQ ID NO: 946004 - DNA, 25 bp, Mus musculus
ttgaaatggtaaggcttctccaagc

SEQ ID NO: 946005 - DNA, 25 bp, Mus musculus
ttgaaatggtcacatgtccccgtgg

SEQ ID NO: 946006 - DNA, 25 bp, Mus musculus
ttgaaatggtcagatgtccccgtgg

SEQ ID NO: 946007 - DNA, 25 bp, Mus musculus
ttgaaatggtccaggagtccactgc

SEQ ID NO: 946008 - DNA, 25 bp, Mus musculus
ttgaaatggtcctggagtccactgc

SEQ ID NO: 946009 - DNA, 25 bp, Mus musculus
ttgaaatgtcatactgtgccataat

SEQ ID NO: 946010 - DNA, 25 bp, Mus musculus
ttgaaatgtcattctgtgccataat

SEQ ID NO: 946011 - DNA, 25 bp, Mus musculus
ttgaaattcctgactgatttgcccc

SEQ ID NO: 946012 - DNA, 25 bp, Mus musculus
ttgaaattcctgtctgatttgcccc

SEQ ID NO: 946013 - DNA, 25 bp, Mus musculus
ttgaaattccttactgtgtgcacct

SEQ ID NO: 946014 - DNA, 25 bp, Mus musculus
ttgaaattcctttctgtgtgcacct

SEQ ID NO: 946015 - DNA, 25 bp, Mus musculus
ttgaaattgatcaggcatggaaaat

SEQ ID NO: 946016 - DNA, 25 bp, Mus musculus
ttgaaattgatctggcatggaaaat

SEQ ID NO: 946017 - DNA, 25 bp, Mus musculus
ttgaaattggcaacataaacaagct

SEQ ID NO: 946018 - DNA, 25 bp, Mus musculus
ttgaaattggcatcataaacaagct

SEQ ID NO: 946019 - DNA, 25 bp, Mus musculus
ttgaacaaaatcataccccacggtg

SEQ ID NO: 946020 - DNA, 25 bp, Mus musculus
ttgaacaaaatcttaccccacggtg

SEQ ID NO: 946021 - DNA, 25 bp, Mus musculus
ttgaacaaactaagctcttattagc

SEQ ID NO: 946022 - DNA, 25 bp, Mus musculus
ttgaacaaactatgctcttattagc

SEQ ID NO: 946023 - DNA, 25 bp, Mus musculus
ttgaacaaactgacatacgtatggg

SEQ ID NO: 946024 - DNA, 25 bp, Mus musculus
ttgaacaaactgtcatacgtatggg

SEQ ID NO: 946025 - DNA, 25 bp, Mus musculus
ttgaacaaacttcccaacctttgat

SEQ ID NO: 946026 - DNA, 25 bp, Mus musculus
ttgaacaaacttgccaacctttgat

SEQ ID NO: 946027 - DNA, 25 bp, Mus musculus
ttgaacaacctgagtgcgcaaagaa

SEQ ID NO: 946028 - DNA, 25 bp, Mus musculus
ttgaacaacctgtgtgcgcaaagaa

SEQ ID NO: 946029 - DNA, 25 bp, Mus musculus
ttgaacaatatacttcttccaggtg

SEQ ID NO: 946030 - DNA, 25 bp, Mus musculus
ttgaacaatatagttcttccaggtg

SEQ ID NO: 946031 - DNA, 25 bp, Mus musculus
ttgaacaatcacatccttaacaggg

SEQ ID NO: 946032 - DNA, 25 bp, Mus musculus
ttgaacaatcacttccttaacaggg

SEQ ID NO: 946033 - DNA, 25 bp, Mus musculus
ttgaacaattacctatgaagatttg

SEQ ID NO: 946034 - DNA, 25 bp, Mus musculus
ttgaacaattacgtatgaagatttg

SEQ ID NO: 946035 - DNA, 25 bp, Mus musculus
ttgaacacactaaggcgcaagggcc

SEQ ID NO: 946036 - DNA, 25 bp, Mus musculus
ttgaacacactatggcgcaagggcc

SEQ ID NO: 946037 - DNA, 25 bp, Mus musculus
ttgaacaccctcatgtctcctagat

SEQ ID NO: 946038 - DNA, 25 bp, Mus musculus
ttgaacaccctcttgtctcctagat

SEQ ID NO: 946039 - DNA, 25 bp, Mus musculus
ttgaacaccgtgcagagtcccggga

SEQ ID NO: 946040 - DNA, 25 bp, Mus musculus
ttgaacaccgtggagagtcccggga

SEQ ID NO: 946041 - DNA, 25 bp, Mus musculus
ttgaacaccttcaatgatattgact

SEQ ID NO: 946042 - DNA, 25 bp, Mus musculus
ttgaacaccttctatgatattgact

SEQ ID NO: 946043 - DNA, 25 bp, Mus musculus
ttgaacacggcgccctacgctgacg

SEQ ID NO: 946044 - DNA, 25 bp, Mus musculus
ttgaacacggcggcctacgctgacg

SEQ ID NO: 946045 - DNA, 25 bp, Mus musculus
ttgaacactaaccttgtatgcatca

SEQ ID NO: 946046 - DNA, 25 bp, Mus musculus
ttgaacactaacgttgtatgcatca

SEQ ID NO: 946047 - DNA, 25 bp, Mus musculus
ttgaacactaagcactactcttccc

SEQ ID NO: 946048 - DNA, 25 bp, Mus musculus
ttgaacactaaggactactcttccc

SEQ ID NO: 946049 - DNA, 25 bp, Mus musculus
ttgaacacttccaccgactcgagaa

SEQ ID NO: 946050 - DNA, 25 bp, Mus musculus
ttgaacacttcctccgactcgagaa

SEQ ID NO: 946051 - DNA, 25 bp, Mus musculus
ttgaacacttgcatcagaaataatg

SEQ ID NO: 946052 - DNA, 25 bp, Mus musculus
ttgaacacttgcttcagaaataatg

SEQ ID NO: 946053 - DNA, 25 bp, Mus musculus
ttgaacagaaacatgtcttggcctc

SEQ ID NO: 946054 - DNA, 25 bp, Mus musculus
ttgaacagaaacttgtcttggcctc

SEQ ID NO: 946055 - DNA, 25 bp, Mus musculus
ttgaacagagctagtaaacctcact

SEQ ID NO: 946056 - DNA, 25 bp, Mus musculus
ttgaacagagcttgtaaacctcact

SEQ ID NO: 946057 - DNA, 25 bp, Mus musculus
ttgaacagctgtcaaccatgcctcc

SEQ ID NO: 946058 - DNA, 25 bp, Mus musculus
ttgaacagctgtgaaccatgcctcc

SEQ ID NO: 946059 - DNA, 25 bp, Mus musculus
ttgaacaggcggactctatgccaac

SEQ ID NO: 946060 - DNA, 25 bp, Mus musculus
ttgaacaggcggtctctatgccaac

SEQ ID NO: 946061 - DNA, 25 bp, Mus musculus
ttgaacatacggactgacagcctac

SEQ ID NO: 946062 - DNA, 25 bp, Mus musculus
ttgaacatacggtctgacagcctac

SEQ ID NO: 946063 - DNA, 25 bp, Mus musculus
ttgaacatccgtctgcatcctacat

SEQ ID NO: 946064 - DNA, 25 bp, Mus musculus
ttgaacatccgtgtgcatcctacat

SEQ ID NO: 946065 - DNA, 25 bp, Mus musculus
ttgaacatcgttcgcaggactggtt

SEQ ID NO: 946066 - DNA, 25 bp, Mus musculus
ttgaacatcgttggcaggactggtt

SEQ ID NO: 946067 - DNA, 25 bp, Mus musculus
ttgaacatgaagaaccccaccagag

SEQ ID NO: 946068 - DNA, 25 bp, Mus musculus
ttgaacatgaagtaccccaccagag

SEQ ID NO: 946069 - DNA, 25 bp, Mus musculus
ttgaacatggcaatgttaccaactg

SEQ ID NO: 946070 - DNA, 25 bp, Mus musculus
ttgaacatggcattgttaccaactg

SEQ ID NO: 946071 - DNA, 25 bp, Mus musculus
ttgaacatggttcctgctgccaagc

SEQ ID NO: 946072 - DNA, 25 bp, Mus musculus
ttgaacatggttgctgctgccaagc

SEQ ID NO: 946073 - DNA, 25 bp, Mus musculus
ttgaacattcaacctctaacacttg

SEQ ID NO: 946074 - DNA, 25 bp, Mus musculus
ttgaacattcaagctctaacacttg

SEQ ID NO: 946075 - DNA, 25 bp, Mus musculus
ttgaacatttgtatcgactgcattg

SEQ ID NO: 946076 - DNA, 25 bp, Mus musculus
ttgaacatttgtttcgactgcattg

SEQ ID NO: 946077 - DNA, 25 bp, Mus musculus
ttgaacattttcagtcaacccgtgc

SEQ ID NO: 946078 - DNA, 25 bp, Mus musculus
ttgaacattttctgtcaacccgtgc

SEQ ID NO: 946079 - DNA, 25 bp, Mus musculus
ttgaaccaaaaaaccgatctcctag

SEQ ID NO: 946080 - DNA, 25 bp, Mus musculus
ttgaaccaaaaatccgatctcctag

SEQ ID NO: 946081 - DNA, 25 bp, Mus musculus
ttgaaccaaaggcttcttgcacgct

SEQ ID NO: 946082 - DNA, 25 bp, Mus musculus
ttgaaccaaagggttcttgcacgct

SEQ ID NO: 946083 - DNA, 25 bp, Mus musculus
ttgaaccaacagaccttgaagcgct

SEQ ID NO: 946084 - DNA, 25 bp, Mus musculus
ttgaaccaacagtccttgaagcgct

SEQ ID NO: 946085 - DNA, 25 bp, Mus musculus
ttgaaccaaggtcaactggaatgat

SEQ ID NO: 946086 - DNA, 25 bp, Mus musculus
ttgaaccaaggtgaactggaatgat

SEQ ID NO: 946087 - DNA, 25 bp, Mus musculus
ttgaaccaattaacttaccctctac

SEQ ID NO: 946088 - DNA, 25 bp, Mus musculus
ttgaaccaattatcttaccctctac

SEQ ID NO: 946089 - DNA, 25 bp, Mus musculus
ttgaaccactggagacttgtagcat

SEQ ID NO: 946090 - DNA, 25 bp, Mus musculus
ttgaaccactggtgacttgtagcat

SEQ ID NO: 946091 - DNA, 25 bp, Mus musculus
ttgaaccagctgagtgcggccatcc

SEQ ID NO: 946092 - DNA, 25 bp, Mus musculus
ttgaaccagctgtgtgcggccatcc

SEQ ID NO: 946093 - DNA, 25 bp, Mus musculus
ttgaaccaggaacagccaatctttg

SEQ ID NO: 946094 - DNA, 25 bp, Mus musculus
ttgaaccaggaagagccaatctttg

SEQ ID NO: 946095 - DNA, 25 bp, Mus musculus
ttgaaccatcgccagttagagccgc

SEQ ID NO: 946096 - DNA, 25 bp, Mus musculus
ttgaaccatcgcgagttagagccgc

SEQ ID NO: 946097 - DNA, 25 bp, Mus musculus
ttgaaccatggtcaacccaactctc

SEQ ID NO: 946098 - DNA, 25 bp, Mus musculus
ttgaaccatggtgaacccaactctc

SEQ ID NO: 946099 - DNA, 25 bp, Mus musculus
ttgaaccattttctggaaccacttt

SEQ ID NO: 946100 - DNA, 25 bp, Mus musculus
ttgaaccattttgtggaaccacttt

SEQ ID NO: 946101 - DNA, 25 bp, Mus musculus
ttgaacccacaacacactttcagtt

SEQ ID NO: 946102 - DNA, 25 bp, Mus musculus
ttgaacccacaagacactttcagtt

SEQ ID NO: 946103 - DNA, 25 bp, Mus musculus
ttgaacccacgcctcaatgtgaaag

SEQ ID NO: 946104 - DNA, 25 bp, Mus musculus
ttgaacccacgcgtcaatgtgaaag

SEQ ID NO: 946105 - DNA, 25 bp, Mus musculus
ttgaacccactgactgatctctgtt

SEQ ID NO: 946106 - DNA, 25 bp, Mus musculus
ttgaacccactgagcctccaggcta

SEQ ID NO: 946107 - DNA, 25 bp, Mus musculus
ttgaacccactgtctgatctctgtt

SEQ ID NO: 946108 - DNA, 25 bp, Mus musculus
ttgaacccactgtgcctccaggcta

SEQ ID NO: 946109 - DNA, 25 bp, Mus musculus
ttgaacccaggacttctgacatgcc

SEQ ID NO: 946110 - DNA, 25 bp, Mus musculus
ttgaacccaggagttctgacatgcc

SEQ ID NO: 946111 - DNA, 25 bp, Mus musculus
ttgaacccatgtacggtcgccagac

SEQ ID NO: 946112 - DNA, 25 bp, Mus musculus
ttgaacccatgttcggtcgccagac

SEQ ID NO: 946113 - DNA, 25 bp, Mus musculus
ttgaaccccaaaactttccattctt

SEQ ID NO: 946114 - DNA, 25 bp, Mus musculus
ttgaaccccaaatctttccattctt

SEQ ID NO: 946115 - DNA, 25 bp, Mus musculus
ttgaaccccaacattctggtggact

SEQ ID NO: 946116 - DNA, 25 bp, Mus musculus
ttgaaccccaactttctggtggact

SEQ ID NO: 946117 - DNA, 25 bp, Mus musculus
ttgaaccccatcctagctcaggatg

SEQ ID NO: 946118 - DNA, 25 bp, Mus musculus
ttgaaccccatcgtagctcaggatg

SEQ ID NO: 946119 - DNA, 25 bp, Mus musculus
ttgaacccgcccatctgagaggtgt

SEQ ID NO: 946120 - DNA, 25 bp, Mus musculus
ttgaacccgcccttctgagaggtgt

SEQ ID NO: 946121 - DNA, 25 bp, Mus musculus
ttgaaccctcagcacatgaccttat

SEQ ID NO: 946122 - DNA, 25 bp, Mus musculus
ttgaaccctcaggacatgaccttat

SEQ ID NO: 946123 - DNA, 25 bp, Mus musculus
ttgaaccctggtctttgggagacca

SEQ ID NO: 946124 - DNA, 25 bp, Mus musculus
ttgaaccctggtgtttgggagacca

SEQ ID NO: 946125 - DNA, 25 bp, Mus musculus
ttgaaccgcatgctcctgtgaggtc

SEQ ID NO: 946126 - DNA, 25 bp, Mus musculus
ttgaaccgcatggtcctgtgaggtc

SEQ ID NO: 946127 - DNA, 25 bp, Mus musculus
ttgaaccgtgaaagcaatgtagtct

SEQ ID NO: 946128 - DNA, 25 bp, Mus musculus
ttgaaccgtgaatgcaatgtagtct

SEQ ID NO: 946129 - DNA, 25 bp, Mus musculus
ttgaacctacacagtacccttgtcc

SEQ ID NO: 946130 - DNA, 25 bp, Mus musculus
ttgaacctacactgtacccttgtcc

SEQ ID NO: 946131 - DNA, 25 bp, Mus musculus
ttgaacctaggaatcatgtctccag

SEQ ID NO: 946132 - DNA, 25 bp, Mus musculus
ttgaacctaggattcatgtctccag

SEQ ID NO: 946133 - DNA, 25 bp, Mus musculus
ttgaacctaggtcgtctacaagagc

SEQ ID NO: 946134 - DNA, 25 bp, Mus musculus
ttgaacctaggtggtctacaagagc

SEQ ID NO: 946135 - DNA, 25 bp, Mus musculus
ttgaacctatgcagactatccagtg

SEQ ID NO: 946136 - DNA, 25 bp, Mus musculus
ttgaacctatgctgactatccagtg

SEQ ID NO: 946137 - DNA, 25 bp, Mus musculus
ttgaacctcagtagtgtggtaaagc

SEQ ID NO: 946138 - DNA, 25 bp, Mus musculus
ttgaacctcagttgtgtggtaaagc

SEQ ID NO: 946139 - DNA, 25 bp, Mus musculus
ttgaacctgagcaaacactggctag

SEQ ID NO: 946140 - DNA, 25 bp, Mus musculus
ttgaacctgagctaacactggctag

SEQ ID NO: 946141 - DNA, 25 bp, Mus musculus
ttgaacctgagtatttggcacatga

SEQ ID NO: 946142 - DNA, 25 bp, Mus musculus
ttgaacctgagtttttggcacatga

SEQ ID NO: 946143 - DNA, 25 bp, Mus musculus
ttgaacctggttactcatgcctaca

SEQ ID NO: 946144 - DNA, 25 bp, Mus musculus
ttgaacctggtttctcatgcctaca

SEQ ID NO: 946145 - DNA, 25 bp, Mus musculus
ttgaacctgtcaagtggtttgtgta

SEQ ID NO: 946146 - DNA, 25 bp, Mus musculus
ttgaacctgtcatgtggtttgtgta

SEQ ID NO: 946147 - DNA, 25 bp, Mus musculus
ttgaacctgtgaatgtgacccatga

SEQ ID NO: 946148 - DNA, 25 bp, Mus musculus
ttgaacctgtgattgtgacccatga

SEQ ID NO: 946149 - DNA, 25 bp, Mus musculus
ttgaacctgtgtcaactgcccgctt

SEQ ID NO: 946150 - DNA, 25 bp, Mus musculus
ttgaacctgtgtgaactgcccgctt

SEQ ID NO: 946151 - DNA, 25 bp, Mus musculus
ttgaaccttcctctgttactggcag

SEQ ID NO: 946152 - DNA, 25 bp, Mus musculus
ttgaaccttcctgtgttactggcag

SEQ ID NO: 946153 - DNA, 25 bp, Mus musculus
ttgaaccttggcagcatcttgaggg

SEQ ID NO: 946154 - DNA, 25 bp, Mus musculus
ttgaaccttggctgcatcttgaggg

SEQ ID NO: 946155 - DNA, 25 bp, Mus musculus
ttgaacctttcaaagcccaggctgg

SEQ ID NO: 946156 - DNA, 25 bp, Mus musculus
ttgaacctttcatagcccaggctgg

SEQ ID NO: 946157 - DNA, 25 bp, Mus musculus
ttgaacctttctattactaattatg

SEQ ID NO: 946158 - DNA, 25 bp, Mus musculus
ttgaacctttcttttactaattatg

SEQ ID NO: 946159 - DNA, 25 bp, Mus musculus
ttgaacgaatgacctcatcccagtt

SEQ ID NO: 946160 - DNA, 25 bp, Mus musculus
ttgaacgaatgagctcatcccagtt

SEQ ID NO: 946161 - DNA, 25 bp, Mus musculus
ttgaacgaccccagggcaagaggct

SEQ ID NO: 946162 - DNA, 25 bp, Mus musculus
ttgaacgacccctgggcaagaggct

SEQ ID NO: 946163 - DNA, 25 bp, Mus musculus
ttgaacgcagttcatcgcatgattt

SEQ ID NO: 946164 - DNA, 25 bp, Mus musculus
ttgaacgcagttgatcgcatgattt

SEQ ID NO: 946165 - DNA, 25 bp, Mus musculus
ttgaacgcccagagcgtcctcgcgg

SEQ ID NO: 946166 - DNA, 25 bp, Mus musculus
ttgaacgcccagtgcgtcctcgcgg

SEQ ID NO: 946167 - DNA, 25 bp, Mus musculus
ttgaacggaagaccgcgtgtgcttc

SEQ ID NO: 946168 - DNA, 25 bp, Mus musculus
ttgaacggaagagcgcgtgtgcttc

SEQ ID NO: 946169 - DNA, 25 bp, Mus musculus
ttgaacgtttaacccagtcagggta

SEQ ID NO: 946170 - DNA, 25 bp, Mus musculus
ttgaacgtttaagccagtcagggta

SEQ ID NO: 946171 - DNA, 25 bp, Mus musculus
ttgaacgtttctactatgtgtcgaa

SEQ ID NO: 946172 - DNA, 25 bp, Mus musculus
ttgaacgtttcttctatgtgtcgaa

SEQ ID NO: 946173 - DNA, 25 bp, Mus musculus
ttgaactaaagaaatcgtggctgat

SEQ ID NO: 946174 - DNA, 25 bp, Mus musculus
ttgaactaaagatatcgtggctgat

SEQ ID NO: 946175 - DNA, 25 bp, Mus musculus
ttgaactaactgcactagaatgggt

SEQ ID NO: 946176 - DNA, 25 bp, Mus musculus
ttgaactaactggactagaatgggt

SEQ ID NO: 946177 - DNA, 25 bp, Mus musculus
ttgaactacaagctagatttaaggc

SEQ ID NO: 946178 - DNA, 25 bp, Mus musculus
ttgaactacaaggtagatttaaggc

SEQ ID NO: 946179 - DNA, 25 bp, Mus musculus
ttgaactacttcataacttgtcgag

SEQ ID NO: 946180 - DNA, 25 bp, Mus musculus
ttgaactacttcttaacttgtcgag

SEQ ID NO: 946181 - DNA, 25 bp, Mus musculus
ttgaactaggccctcatgtgctcgg

SEQ ID NO: 946182 - DNA, 25 bp, Mus musculus
ttgaactaggccgtcatgtgctcgg

SEQ ID NO: 946183 - DNA, 25 bp, Mus musculus
ttgaactatgtacaggctaggacct

SEQ ID NO: 946184 - DNA, 25 bp, Mus musculus
ttgaactatgtagaggctaggacct

SEQ ID NO: 946185 - DNA, 25 bp, Mus musculus
ttgaactcactaatgctctgcttcc

SEQ ID NO: 946186 - DNA, 25 bp, Mus musculus
ttgaactcactattgctctgcttcc

SEQ ID NO: 946187 - DNA, 25 bp, Mus musculus
ttgaactcagacactgcatgtggat

SEQ ID NO: 946188 - DNA, 25 bp, Mus musculus
ttgaactcagactctgcatgtggat

SEQ ID NO: 946189 - DNA, 25 bp, Mus musculus
ttgaactcagtgaacctaagtcctt

SEQ ID NO: 946190 - DNA, 25 bp, Mus musculus
ttgaactcagtgtacctaagtcctt

SEQ ID NO: 946191 - DNA, 25 bp, Mus musculus
ttgaactccctaagaggcccaaaat

SEQ ID NO: 946192 - DNA, 25 bp, Mus musculus
ttgaactccctaatttctgcttatc

SEQ ID NO: 946193 - DNA, 25 bp, Mus musculus
ttgaactccctatgaggcccaaaat

SEQ ID NO: 946194 - DNA, 25 bp, Mus musculus
ttgaactccctattttctgcttatc

SEQ ID NO: 946195 - DNA, 25 bp, Mus musculus
ttgaactccgatctcttggacccac

SEQ ID NO: 946196 - DNA, 25 bp, Mus musculus
ttgaactccgatgtcttggacccac

SEQ ID NO: 946197 - DNA, 25 bp, Mus musculus
ttgaactccgccactaaagcagacg

SEQ ID NO: 946198 - DNA, 25 bp, Mus musculus
ttgaactccgcctctaaagcagacg

SEQ ID NO: 946199 - DNA, 25 bp, Mus musculus
ttgaactccggtagtcaaacttgac

SEQ ID NO: 946200 - DNA, 25 bp, Mus musculus
ttgaactccggttgtcaaacttgac

SEQ ID NO: 946201 - DNA, 25 bp, Mus musculus
ttgaactcgaagatgctggcccagc

SEQ ID NO: 946202 - DNA, 25 bp, Mus musculus
ttgaactcgaagttgctggcccagc

SEQ ID NO: 946203 - DNA, 25 bp, Mus musculus
ttgaactcgagaccctcatttccca

SEQ ID NO: 946204 - DNA, 25 bp, Mus musculus
ttgaactcgagagcctcatttccca

SEQ ID NO: 946205 - DNA, 25 bp, Mus musculus
ttgaactctcagaaacccatcatcc

SEQ ID NO: 946206 - DNA, 25 bp, Mus musculus
ttgaactctcagtaacccatcatcc

SEQ ID NO: 946207 - DNA, 25 bp, Mus musculus
ttgaactctcatcctatgcactggg

SEQ ID NO: 946208 - DNA, 25 bp, Mus musculus
ttgaactctcatgctatgcactggg

SEQ ID NO: 946209 - DNA, 25 bp, Mus musculus
ttgaactctgtgatggccaggctga

SEQ ID NO: 946210 - DNA, 25 bp, Mus musculus
ttgaactctgtgttggccaggctga

SEQ ID NO: 946211 - DNA, 25 bp, Mus musculus
ttgaactcttacctacattccaaag

SEQ ID NO: 946212 - DNA, 25 bp, Mus musculus
ttgaactcttacgtacattccaaag

SEQ ID NO: 946213 - DNA, 25 bp, Mus musculus
ttgaactcttagatcttccggcttc

SEQ ID NO: 946214 - DNA, 25 bp, Mus musculus
ttgaactcttagttcttccggcttc

SEQ ID NO: 946215 - DNA, 25 bp, Mus musculus
ttgaactctttaacatctcactctg

SEQ ID NO: 946216 - DNA, 25 bp, Mus musculus
ttgaactctttatcatctcactctg

SEQ ID NO: 946217 - DNA, 25 bp, Mus musculus
ttgaactgactgaaactggaaatgt

SEQ ID NO: 946218 - DNA, 25 bp, Mus musculus
ttgaactgactgtaactggaaatgt

SEQ ID NO: 946219 - DNA, 25 bp, Mus musculus
ttgaactgagcacctccagcggcag

SEQ ID NO: 946220 - DNA, 25 bp, Mus musculus
ttgaactgagcagctccagcggcag

SEQ ID NO: 946221 - DNA, 25 bp, Mus musculus
ttgaactgcactctccagctctgtg

SEQ ID NO: 946222 - DNA, 25 bp, Mus musculus
ttgaactgcactgtccagctctgtg

SEQ ID NO: 946223 - DNA, 25 bp, Mus musculus
ttgaactgccaacgtccagacaact

SEQ ID NO: 946224 - DNA, 25 bp, Mus musculus
ttgaactgccaaggtccagacaact

SEQ ID NO: 946225 - DNA, 25 bp, Mus musculus
ttgaactgctgaagcactgggcttc

SEQ ID NO: 946226 - DNA, 25 bp, Mus musculus
ttgaactgctgatgcactgggcttc

SEQ ID NO: 946227 - DNA, 25 bp, Mus musculus
ttgaactgctggacctctcactgaa

SEQ ID NO: 946228 - DNA, 25 bp, Mus musculus
ttgaactgctggtcctctcactgaa

SEQ ID NO: 946229 - DNA, 25 bp, Mus musculus
ttgaactgcttgctgatcctcctgt

SEQ ID NO: 946230 - DNA, 25 bp, Mus musculus
ttgaactgcttggtgatcctcctgt

SEQ ID NO: 946231 - DNA, 25 bp, Mus musculus
ttgaactggatacagtggctcacgc

SEQ ID NO: 946232 - DNA, 25 bp, Mus musculus
ttgaactggatagagtggctcacgc

SEQ ID NO: 946233 - DNA, 25 bp, Mus musculus
ttgaactggcatagtttggtacaac

SEQ ID NO: 946234 - DNA, 25 bp, Mus musculus
ttgaactggcattgtttggtacaac

SEQ ID NO: 946235 - DNA, 25 bp, Mus musculus
ttgaactgggcaacactcctactgt

SEQ ID NO: 946236 - DNA, 25 bp, Mus musculus
ttgaactgggcatcactcctactgt

SEQ ID NO: 946237 - DNA, 25 bp, Mus musculus
ttgaactggtgcagatcccacagac

SEQ ID NO: 946238 - DNA, 25 bp, Mus musculus
ttgaactggtgctgatcccacagac

SEQ ID NO: 946239 - DNA, 25 bp, Mus musculus
ttgaactgtataaagaagctggtgg

SEQ ID NO: 946240 - DNA, 25 bp, Mus musculus
ttgaactgtataatcctcgaatcca

SEQ ID NO: 946241 - DNA, 25 bp, Mus musculus
ttgaactgtatatagaagctggtgg

SEQ ID NO: 946242 - DNA, 25 bp, Mus musculus
ttgaactgtatattcctcgaatcca

SEQ ID NO: 946243 - DNA, 25 bp, Mus musculus
ttgaactgtgttaaacttcctccct

SEQ ID NO: 946244 - DNA, 25 bp, Mus musculus
ttgaactgtgtttaacttcctccct

SEQ ID NO: 946245 - DNA, 25 bp, Mus musculus
ttgaacttaagaaccacctacctaa

SEQ ID NO: 946246 - DNA, 25 bp, Mus musculus
ttgaacttaagatccacctacctaa

SEQ ID NO: 946247 - DNA, 25 bp, Mus musculus
ttgaacttcactactacctcagcag

SEQ ID NO: 946248 - DNA, 25 bp, Mus musculus
ttgaacttcacttctacctcagcag

SEQ ID NO: 946249 - DNA, 25 bp, Mus musculus
ttgaacttctaacccttttgcctct

SEQ ID NO: 946250 - DNA, 25 bp, Mus musculus
ttgaacttctaagccttttgcctct

SEQ ID NO: 946251 - DNA, 25 bp, Mus musculus
ttgaacttctgtaatgcacacacat

SEQ ID NO: 946252 - DNA, 25 bp, Mus musculus
ttgaacttctgttatgcacacacat

SEQ ID NO: 946253 - DNA, 25 bp, Mus musculus
ttgaacttcttaataccgtatgctg

SEQ ID NO: 946254 - DNA, 25 bp, Mus musculus
ttgaacttcttattaccgtatgctg

SEQ ID NO: 946255 - DNA, 25 bp, Mus musculus
ttgaacttgagaactggcctcctcc

SEQ ID NO: 946256 - DNA, 25 bp, Mus musculus
ttgaacttgagatctggcctcctcc

SEQ ID NO: 946257 - DNA, 25 bp, Mus musculus
ttgaacttgattctgttgaaaacct

SEQ ID NO: 946258 - DNA, 25 bp, Mus musculus
ttgaacttgattgtgttgaaaacct

SEQ ID NO: 946259 - DNA, 25 bp, Mus musculus
ttgaacttgcagctaactctctctt

SEQ ID NO: 946260 - DNA, 25 bp, Mus musculus
ttgaacttgcaggtaactctctctt

SEQ ID NO: 946261 - DNA, 25 bp, Mus musculus
ttgaacttgcgccatatcatgcccc

SEQ ID NO: 946262 - DNA, 25 bp, Mus musculus
ttgaacttgcgcgatatcatgcccc

SEQ ID NO: 946263 - DNA, 25 bp, Mus musculus
ttgaacttgggcatccttctggagc

SEQ ID NO: 946264 - DNA, 25 bp, Mus musculus
ttgaacttgggcttccttctggagc

SEQ ID NO: 946265 - DNA, 25 bp, Mus musculus
ttgaacttgtgaacgtcctgactca

SEQ ID NO: 946266 - DNA, 25 bp, Mus musculus
ttgaacttgtgatcgtcctgactca

SEQ ID NO: 946267 - DNA, 25 bp, Mus musculus
ttgaactttacaacttgggagagct

SEQ ID NO: 946268 - DNA, 25 bp, Mus musculus
ttgaactttacatcttgggagagct

SEQ ID NO: 946269 - DNA, 25 bp, Mus musculus
ttgaactttccaaaacctagcgagg

SEQ ID NO: 946270 - DNA, 25 bp, Mus musculus
ttgaactttccataacctagcgagg

SEQ ID NO: 946271 - DNA, 25 bp, Mus musculus
ttgaagaaatctcggtgcagaacac

SEQ ID NO: 946272 - DNA, 25 bp, Mus musculus
ttgaagaaatctgggtgcagaacac

SEQ ID NO: 946273 - DNA, 25 bp, Mus musculus
ttgaagaactgtccaccatggatac

SEQ ID NO: 946274 - DNA, 25 bp, Mus musculus
ttgaagaactgtgcaccatggatac

SEQ ID NO: 946275 - DNA, 25 bp, Mus musculus
ttgaagaatattaccaatgagaaca

SEQ ID NO: 946276 - DNA, 25 bp, Mus musculus
ttgaagaatatttccaatgagaaca

SEQ ID NO: 946277 - DNA, 25 bp, Mus musculus
ttgaagaattcaatactcccattgt

SEQ ID NO: 946278 - DNA, 25 bp, Mus musculus
ttgaagaattcattactcccattgt

SEQ ID NO: 946279 - DNA, 25 bp, Mus musculus
ttgaagaatttaccagactcctggg

SEQ ID NO: 946280 - DNA, 25 bp, Mus musculus
ttgaagaatttagcagactcctggg

SEQ ID NO: 946281 - DNA, 25 bp, Mus musculus
ttgaagacatcaagggtaccctatt

SEQ ID NO: 946282 - DNA, 25 bp, Mus musculus
ttgaagacatcatgggtaccctatt

SEQ ID NO: 946283 - DNA, 25 bp, Mus musculus
ttgaagacatccaatggaccccaca

SEQ ID NO: 946284 - DNA, 25 bp, Mus musculus
ttgaagacatcctatggaccccaca

SEQ ID NO: 946285 - DNA, 25 bp, Mus musculus
ttgaagaccagcactcaggatccag

SEQ ID NO: 946286 - DNA, 25 bp, Mus musculus
ttgaagaccagctctcaggatccag

SEQ ID NO: 946287 - DNA, 25 bp, Mus musculus
ttgaagacccagaaacctacctaag

SEQ ID NO: 946288 - DNA, 25 bp, Mus musculus
ttgaagacccagtaacctacctaag

SEQ ID NO: 946289 - DNA, 25 bp, Mus musculus
ttgaagacccctatcatgttgcact

SEQ ID NO: 946290 - DNA, 25 bp, Mus musculus
ttgaagacccctttcatgttgcact

SEQ ID NO: 946291 - DNA, 25 bp, Mus musculus
ttgaagaccgttagtgtataacaga

SEQ ID NO: 946292 - DNA, 25 bp, Mus musculus
ttgaagaccgtttgtgtataacaga

SEQ ID NO: 946293 - DNA, 25 bp, Mus musculus
ttgaagacctccagcccagaaacca

SEQ ID NO: 946294 - DNA, 25 bp, Mus musculus
ttgaagacctcctgcccagaaacca

SEQ ID NO: 946295 - DNA, 25 bp, Mus musculus
ttgaagacctggcttcatcccggct

SEQ ID NO: 946296 - DNA, 25 bp, Mus musculus
ttgaagacctgggttcatcccggct

SEQ ID NO: 946297 - DNA, 25 bp, Mus musculus
ttgaagactggactgctggcatgcc

SEQ ID NO: 946298 - DNA, 25 bp, Mus musculus
ttgaagactggagtgctggcatgcc

SEQ ID NO: 946299 - DNA, 25 bp, Mus musculus
ttgaagagaactagtcagactcgac

SEQ ID NO: 946300 - DNA, 25 bp, Mus musculus
ttgaagagaacttgtcagactcgac

SEQ ID NO: 946301 - DNA, 25 bp, Mus musculus
ttgaagagactaagcctgcccacag

SEQ ID NO: 946302 - DNA, 25 bp, Mus musculus
ttgaagagactatgcctgcccacag

SEQ ID NO: 946303 - DNA, 25 bp, Mus musculus
ttgaagagatttcgctcccatagac

SEQ ID NO: 946304 - DNA, 25 bp, Mus musculus
ttgaagagatttggctcccatagac

SEQ ID NO: 946305 - DNA, 25 bp, Mus musculus
ttgaagagcacaatgttcccacctg

SEQ ID NO: 946306 - DNA, 25 bp, Mus musculus
ttgaagagcacattgttcccacctg

SEQ ID NO: 946307 - DNA, 25 bp, Mus musculus
ttgaagagcagtatgatcagaccgt

SEQ ID NO: 946308 - DNA, 25 bp, Mus musculus
ttgaagagcagtttgatcagaccgt

SEQ ID NO: 946309 - DNA, 25 bp, Mus musculus
ttgaagagccctcagcatgaagcaa

SEQ ID NO: 946310 - DNA, 25 bp, Mus musculus
ttgaagagccctgagcatgaagcaa

SEQ ID NO: 946311 - DNA, 25 bp, Mus musculus
ttgaagagtactccagccagcccag

SEQ ID NO: 946312 - DNA, 25 bp, Mus musculus
ttgaagagtactgcagccagcccag

SEQ ID NO: 946313 - DNA, 25 bp, Mus musculus
ttgaagatatacacactgtacttat

SEQ ID NO: 946314 - DNA, 25 bp, Mus musculus
ttgaagatatactcactgtacttat

SEQ ID NO: 946315 - DNA, 25 bp, Mus musculus
ttgaagatatgccttgccgcatcag

SEQ ID NO: 946316 - DNA, 25 bp, Mus musculus
ttgaagatatgcgttgccgcatcag

SEQ ID NO: 946317 - DNA, 25 bp, Mus musculus
ttgaagatcctgatcctgaagttat

SEQ ID NO: 946318 - DNA, 25 bp, Mus musculus
ttgaagatcctgttcctgaagttat

SEQ ID NO: 946319 - DNA, 25 bp, Mus musculus
ttgaagatctgtccatattcaggaa

SEQ ID NO: 946320 - DNA, 25 bp, Mus musculus
ttgaagatctgtgcatattcaggaa

SEQ ID NO: 946321 - DNA, 25 bp, Mus musculus
ttgaagatgacgacaggctggagca

SEQ ID NO: 946322 - DNA, 25 bp, Mus musculus
ttgaagatgacgtcaggctggagca

SEQ ID NO: 946323 - DNA, 25 bp, Mus musculus
ttgaagatgcttagactgcaccgcc

SEQ ID NO: 946324 - DNA, 25 bp, Mus musculus
ttgaagatgctttgactgcaccgcc

SEQ ID NO: 946325 - DNA, 25 bp, Mus musculus
ttgaagatggaaacaggcagacagt

SEQ ID NO: 946326 - DNA, 25 bp, Mus musculus
ttgaagatggaatcaggcagacagt

SEQ ID NO: 946327 - DNA, 25 bp, Mus musculus
ttgaagattctaaaccagctatggg

SEQ ID NO: 946328 - DNA, 25 bp, Mus musculus
ttgaagattctataccagctatggg

SEQ ID NO: 946329 - DNA, 25 bp, Mus musculus
ttgaagatttgcagggcgcggaggt

SEQ ID NO: 946330 - DNA, 25 bp, Mus musculus
ttgaagatttgctgggcgcggaggt

SEQ ID NO: 946331 - DNA, 25 bp, Mus musculus
ttgaagcaaagccccagctgtgctg

SEQ ID NO: 946332 - DNA, 25 bp, Mus musculus
ttgaagcaaagcgccagctgtgctg

SEQ ID NO: 946333 - DNA, 25 bp, Mus musculus
ttgaagcaatctcccctgggccatg

SEQ ID NO: 946334 - DNA, 25 bp, Mus musculus
ttgaagcaatctgccctgggccatg

SEQ ID NO: 946335 - DNA, 25 bp, Mus musculus
ttgaagcacaccagactgtatttgc

SEQ ID NO: 946336 - DNA, 25 bp, Mus musculus
ttgaagcacacctgactgtatttgc

SEQ ID NO: 946337 - DNA, 25 bp, Mus musculus
ttgaagcacatcctctgttcctagc

SEQ ID NO: 946338 - DNA, 25 bp, Mus musculus
ttgaagcacatcgtctgttcctagc

SEQ ID NO: 946339 - DNA, 25 bp, Mus musculus
ttgaagcaccatattcccttcgaac

SEQ ID NO: 946340 - DNA, 25 bp, Mus musculus
ttgaagcaccattttcccttcgaac

SEQ ID NO: 946341 - DNA, 25 bp, Mus musculus
ttgaagcacccaagattttgtctgg

SEQ ID NO: 946342 - DNA, 25 bp, Mus musculus
ttgaagcacccatgattttgtctgg

SEQ ID NO: 946343 - DNA, 25 bp, Mus musculus
ttgaagcacccgcatggtaggcttg

SEQ ID NO: 946344 - DNA, 25 bp, Mus musculus
ttgaagcacccggatggtaggcttg

SEQ ID NO: 946345 - DNA, 25 bp, Mus musculus
ttgaagcacctgctcacatcaacag

SEQ ID NO: 946346 - DNA, 25 bp, Mus musculus
ttgaagcacctggtcacatcaacag

SEQ ID NO: 946347 - DNA, 25 bp, Mus musculus
ttgaagcaccttagcaccaaatgga

SEQ ID NO: 946348 - DNA, 25 bp, Mus musculus
ttgaagcacctttgcaccaaatgga

SEQ ID NO: 946349 - DNA, 25 bp, Mus musculus
ttgaagcagatgcttttccggtatc

SEQ ID NO: 946350 - DNA, 25 bp, Mus musculus
ttgaagcagatggttttccggtatc

SEQ ID NO: 946351 - DNA, 25 bp, Mus musculus
ttgaagcagattctatgtagcccag

SEQ ID NO: 946352 - DNA, 25 bp, Mus musculus
ttgaagcagattgtatgtagcccag

SEQ ID NO: 946353 - DNA, 25 bp, Mus musculus
ttgaagcagggtaggcagcaaacaa

SEQ ID NO: 946354 - DNA, 25 bp, Mus musculus
ttgaagcagggttggcagcaaacaa

SEQ ID NO: 946355 - DNA, 25 bp, Mus musculus
ttgaagccaggcagagtccaccgct

SEQ ID NO: 946356 - DNA, 25 bp, Mus musculus
ttgaagccaggctgagtccaccgct

SEQ ID NO: 946357 - DNA, 25 bp, Mus musculus
ttgaagcccactccacaggagggaa

SEQ ID NO: 946358 - DNA, 25 bp, Mus musculus
ttgaagcccactgcacaggagggaa

SEQ ID NO: 946359 - DNA, 25 bp, Mus musculus
ttgaagcccgtgattccttcagtgc

SEQ ID NO: 946360 - DNA, 25 bp, Mus musculus
ttgaagcccgtgtttccttcagtgc

SEQ ID NO: 946361 - DNA, 25 bp, Mus musculus
ttgaagccctcaactatgaggccgt

SEQ ID NO: 946362 - DNA, 25 bp, Mus musculus
ttgaagccctcatctatgaggccgt

SEQ ID NO: 946363 - DNA, 25 bp, Mus musculus
ttgaagccctggacaagtgacacag

SEQ ID NO: 946364 - DNA, 25 bp, Mus musculus
ttgaagccctggtcaagtgacacag

SEQ ID NO: 946365 - DNA, 25 bp, Mus musculus
ttgaagcctggcagaagctgtagca

SEQ ID NO: 946366 - DNA, 25 bp, Mus musculus
ttgaagcctggctgaagctgtagca

SEQ ID NO: 946367 - DNA, 25 bp, Mus musculus
ttgaagcctgttagggtcactgaaa

SEQ ID NO: 946368 - DNA, 25 bp, Mus musculus
ttgaagcctgtttgggtcactgaaa

SEQ ID NO: 946369 - DNA, 25 bp, Mus musculus
ttgaagccttcccatgctgtttgga

SEQ ID NO: 946370 - DNA, 25 bp, Mus musculus
ttgaagccttccgatgctgtttgga

SEQ ID NO: 946371 - DNA, 25 bp, Mus musculus
ttgaagcgctctagagtgggaccga

SEQ ID NO: 946372 - DNA, 25 bp, Mus musculus
ttgaagcgctcttgagtgggaccga

SEQ ID NO: 946373 - DNA, 25 bp, Mus musculus
ttgaagcggaaacgccaaacgattc

SEQ ID NO: 946374 - DNA, 25 bp, Mus musculus
ttgaagcggaaaggccaaacgattc

SEQ ID NO: 946375 - DNA, 25 bp, Mus musculus
ttgaagctaactaggtctacaaaaa

SEQ ID NO: 946376 - DNA, 25 bp, Mus musculus
ttgaagctaacttggtctacaaaaa

SEQ ID NO: 946377 - DNA, 25 bp, Mus musculus
ttgaagctacacaggatgactacgt

SEQ ID NO: 946378 - DNA, 25 bp, Mus musculus
ttgaagctacactggatgactacgt

SEQ ID NO: 946379 - DNA, 25 bp, Mus musculus
ttgaagctacccagccagtagtgac

SEQ ID NO: 946380 - DNA, 25 bp, Mus musculus
ttgaagctaccctgccagtagtgac

SEQ ID NO: 946381 - DNA, 25 bp, Mus musculus
ttgaagctagcaagcgaccgctgtt

SEQ ID NO: 946382 - DNA, 25 bp, Mus musculus
ttgaagctagcatgcgaccgctgtt

SEQ ID NO: 946383 - DNA, 25 bp, Mus musculus
ttgaagctcagcatgcagaaagctg

SEQ ID NO: 946384 - DNA, 25 bp, Mus musculus
ttgaagctcagcttgcagaaagctg

SEQ ID NO: 946385 - DNA, 25 bp, Mus musculus
ttgaagctccaaacccatgggaagt

SEQ ID NO: 946386 - DNA, 25 bp, Mus musculus
ttgaagctccaatcccatgggaagt

SEQ ID NO: 946387 - DNA, 25 bp, Mus musculus
ttgaagctgacaacgaggacgactt

SEQ ID NO: 946388 - DNA, 25 bp, Mus musculus
ttgaagctgacatcgaggacgactt

SEQ ID NO: 946389 - DNA, 25 bp, Mus musculus
ttgaagctggaccaactggctatct

SEQ ID NO: 946390 - DNA, 25 bp, Mus musculus
ttgaagctggacgaactggctatct

SEQ ID NO: 946391 - DNA, 25 bp, Mus musculus
ttgaagcttcatcacaaccctctga

SEQ ID NO: 946392 - DNA, 25 bp, Mus musculus
ttgaagcttcatgacaaccctctga

SEQ ID NO: 946393 - DNA, 25 bp, Mus musculus
ttgaagcttccacggccagttacta

SEQ ID NO: 946394 - DNA, 25 bp, Mus musculus
ttgaagcttccagggccagttacta

SEQ ID NO: 946395 - DNA, 25 bp, Mus musculus
ttgaaggaaatgactcctcggctcc

SEQ ID NO: 946396 - DNA, 25 bp, Mus musculus
ttgaaggaaatgtctcctcggctcc

SEQ ID NO: 946397 - DNA, 25 bp, Mus musculus
ttgaaggacagaagcagttcctctg

SEQ ID NO: 946398 - DNA, 25 bp, Mus musculus
ttgaaggacagatgcagttcctctg

SEQ ID NO: 946399 - DNA, 25 bp, Mus musculus
ttgaaggaccatacttccacacttg

SEQ ID NO: 946400 - DNA, 25 bp, Mus musculus
ttgaaggaccattcttccacacttg

SEQ ID NO: 946401 - DNA, 25 bp, Mus musculus
ttgaaggacccaagtcctcagccta

SEQ ID NO: 946402 - DNA, 25 bp, Mus musculus
ttgaaggacccatgtcctcagccta

SEQ ID NO: 946403 - DNA, 25 bp, Mus musculus
ttgaaggatacccagaccctgaggt

SEQ ID NO: 946404 - DNA, 25 bp, Mus musculus
ttgaaggataccgagaccctgaggt

SEQ ID NO: 946405 - DNA, 25 bp, Mus musculus
ttgaaggatagcacggcctttgcgt

SEQ ID NO: 946406 - DNA, 25 bp, Mus musculus
ttgaaggatagctcggcctttgcgt

SEQ ID NO: 946407 - DNA, 25 bp, Mus musculus
ttgaaggcacttaagtcctgctggc

SEQ ID NO: 946408 - DNA, 25 bp, Mus musculus
ttgaaggcactttagtcctgctggc

SEQ ID NO: 946409 - DNA, 25 bp, Mus musculus
ttgaaggcagatcctactctggcct

SEQ ID NO: 946410 - DNA, 25 bp, Mus musculus
ttgaaggcagatgctactctggcct

SEQ ID NO: 946411 - DNA, 25 bp, Mus musculus
ttgaaggcagcgataccggtcccat

SEQ ID NO: 946412 - DNA, 25 bp, Mus musculus
ttgaaggcagcgttaccggtcccat

SEQ ID NO: 946413 - DNA, 25 bp, Mus musculus
ttgaaggcattcactcataccgctc

SEQ ID NO: 946414 - DNA, 25 bp, Mus musculus
ttgaaggcattctctcataccgctc

SEQ ID NO: 946415 - DNA, 25 bp, Mus musculus
ttgaaggctaaacggcatgtctacc

SEQ ID NO: 946416 - DNA, 25 bp, Mus musculus
ttgaaggctaaagggcatgtctacc

SEQ ID NO: 946417 - DNA, 25 bp, Mus musculus
ttgaaggctgaactgggtacatccc

SEQ ID NO: 946418 - DNA, 25 bp, Mus musculus
ttgaaggctgaagtgggtacatccc

SEQ ID NO: 946419 - DNA, 25 bp, Mus musculus
ttgaaggctgctcttgacatcccag

SEQ ID NO: 946420 - DNA, 25 bp, Mus musculus
ttgaaggctgctgttgacatcccag

SEQ ID NO: 946421 - DNA, 25 bp, Mus musculus
ttgaaggctgttacctagtcttgct

SEQ ID NO: 946422 - DNA, 25 bp, Mus musculus
ttgaaggctgtttcctagtcttgct

SEQ ID NO: 946423 - DNA, 25 bp, Mus musculus
ttgaaggctttaactttgcacactt

SEQ ID NO: 946424 - DNA, 25 bp, Mus musculus
ttgaaggctttatctttgcacactt

SEQ ID NO: 946425 - DNA, 25 bp, Mus musculus
ttgaaggctttgacaccggtgagtt

SEQ ID NO: 946426 - DNA, 25 bp, Mus musculus
ttgaaggctttgtcaccggtgagtt

SEQ ID NO: 946427 - DNA, 25 bp, Mus musculus
ttgaagggcccacaaggcaccactt

SEQ ID NO: 946428 - DNA, 25 bp, Mus musculus
ttgaagggcccagaaggcaccactt

SEQ ID NO: 946429 - DNA, 25 bp, Mus musculus
ttgaagggctacatcttaccctgta

SEQ ID NO: 946430 - DNA, 25 bp, Mus musculus
ttgaagggctacttcttaccctgta

SEQ ID NO: 946431 - DNA, 25 bp, Mus musculus
ttgaagggtgtgaaacttcagctct

SEQ ID NO: 946432 - DNA, 25 bp, Mus musculus
ttgaagggtgtgtaacttcagctct

SEQ ID NO: 946433 - DNA, 25 bp, Mus musculus
ttgaagggttgcatccatcaggttg

SEQ ID NO: 946434 - DNA, 25 bp, Mus musculus
ttgaagggttgcttccatcaggttg

SEQ ID NO: 946435 - DNA, 25 bp, Mus musculus
ttgaagggtttacctgttgagctgg

SEQ ID NO: 946436 - DNA, 25 bp, Mus musculus
ttgaagggtttagctgttgagctgg

SEQ ID NO: 946437 - DNA, 25 bp, Mus musculus
ttgaaggtacacagtgaaggtatcc

SEQ ID NO: 946438 - DNA, 25 bp, Mus musculus
ttgaaggtacactgtgaaggtatcc

SEQ ID NO: 946439 - DNA, 25 bp, Mus musculus
ttgaaggtagccaagcgacccactt

SEQ ID NO: 946440 - DNA, 25 bp, Mus musculus
ttgaaggtagccaccggccatttct

SEQ ID NO: 946441 - DNA, 25 bp, Mus musculus
ttgaaggtagcctagcgacccactt

SEQ ID NO: 946442 - DNA, 25 bp, Mus musculus
ttgaaggtagcctccggccatttct

SEQ ID NO: 946443 - DNA, 25 bp, Mus musculus
ttgaaggtccctccatagattccac

SEQ ID NO: 946444 - DNA, 25 bp, Mus musculus
ttgaaggtccctgcatagattccac

SEQ ID NO: 946445 - DNA, 25 bp, Mus musculus
ttgaaggtctaaaccctctactggg

SEQ ID NO: 946446 - DNA, 25 bp, Mus musculus
ttgaaggtctaatccctctactggg

SEQ ID NO: 946447 - DNA, 25 bp, Mus musculus
ttgaaggtcttgcatgtctgccttt

SEQ ID NO: 946448 - DNA, 25 bp, Mus musculus
ttgaaggtcttggatgtctgccttt

SEQ ID NO: 946449 - DNA, 25 bp, Mus musculus
ttgaaggtgactcatctttctgcca

SEQ ID NO: 946450 - DNA, 25 bp, Mus musculus
ttgaaggtgactgatctttctgcca

SEQ ID NO: 946451 - DNA, 25 bp, Mus musculus
ttgaaggtgcccagatcaccaggtc

SEQ ID NO: 946452 - DNA, 25 bp, Mus musculus
ttgaaggtgccctgatcaccaggtc

SEQ ID NO: 946453 - DNA, 25 bp, Mus musculus
ttgaaggtgcctatctcatccagaa

SEQ ID NO: 946454 - DNA, 25 bp, Mus musculus
ttgaaggtgcctttctcatccagaa

SEQ ID NO: 946455 - DNA, 25 bp, Mus musculus
ttgaaggtgctgctaatccttttct

SEQ ID NO: 946456 - DNA, 25 bp, Mus musculus
ttgaaggtgctggtaatccttttct

SEQ ID NO: 946457 - DNA, 25 bp, Mus musculus
ttgaaggtggtaaggaagcctgcat

SEQ ID NO: 946458 - DNA, 25 bp, Mus musculus
ttgaaggtggtatggaagcctgcat

SEQ ID NO: 946459 - DNA, 25 bp, Mus musculus
ttgaaggttccaactattcctgctt

SEQ ID NO: 946460 - DNA, 25 bp, Mus musculus
ttgaaggttccatctattcctgctt

SEQ ID NO: 946461 - DNA, 25 bp, Mus musculus
ttgaagtaacccatgttctttgctc

SEQ ID NO: 946462 - DNA, 25 bp, Mus musculus
ttgaagtaacccttgttctttgctc

SEQ ID NO: 946463 - DNA, 25 bp, Mus musculus
ttgaagtaatggctggtcctgcatc

SEQ ID NO: 946464 - DNA, 25 bp, Mus musculus
ttgaagtaatgggtggtcctgcatc

SEQ ID NO: 946465 - DNA, 25 bp, Mus musculus
ttgaagtactacacgaacccttcct

SEQ ID NO: 946466 - DNA, 25 bp, Mus musculus
ttgaagtactactcgaacccttcct

SEQ ID NO: 946467 - DNA, 25 bp, Mus musculus
ttgaagtagcaacaaccatctttgc

SEQ ID NO: 946468 - DNA, 25 bp, Mus musculus
ttgaagtagcaagaaccatctttgc

SEQ ID NO: 946469 - DNA, 25 bp, Mus musculus
ttgaagtagtgaacctccccaatga

SEQ ID NO: 946470 - DNA, 25 bp, Mus musculus
ttgaagtagtgatcctccccaatga

SEQ ID NO: 946471 - DNA, 25 bp, Mus musculus
ttgaagtatttgacctccacccagg

SEQ ID NO: 946472 - DNA, 25 bp, Mus musculus
ttgaagtatttgtcctccacccagg

SEQ ID NO: 946473 - DNA, 25 bp, Mus musculus
ttgaagtcagagacctcgctccgga

SEQ ID NO: 946474 - DNA, 25 bp, Mus musculus
ttgaagtcagagtcctcgctccgga

SEQ ID NO: 946475 - DNA, 25 bp, Mus musculus
ttgaagtcatcgacaaaccccagtc

SEQ ID NO: 946476 - DNA, 25 bp, Mus musculus
ttgaagtcatcgtcaaaccccagtc

SEQ ID NO: 946477 - DNA, 25 bp, Mus musculus
ttgaagtccaagaaaacagtaaatg

SEQ ID NO: 946478 - DNA, 25 bp, Mus musculus
ttgaagtccaagtaaacagtaaatg

SEQ ID NO: 946479 - DNA, 25 bp, Mus musculus
ttgaagtccataccaccaagaggaa

SEQ ID NO: 946480 - DNA, 25 bp, Mus musculus
ttgaagtccatagcaccaagaggaa

SEQ ID NO: 946481 - DNA, 25 bp, Mus musculus
ttgaagtcctaaccgagggccttga

SEQ ID NO: 946482 - DNA, 25 bp, Mus musculus
ttgaagtcctaagcgagggccttga

SEQ ID NO: 946483 - DNA, 25 bp, Mus musculus
ttgaagtcctgtctgcacactctag

SEQ ID NO: 946484 - DNA, 25 bp, Mus musculus
ttgaagtcctgtgtgcacactctag

SEQ ID NO: 946485 - DNA, 25 bp, Mus musculus
ttgaagtccttcagcttgtacagcc

SEQ ID NO: 946486 - DNA, 25 bp, Mus musculus
ttgaagtccttctgcttgtacagcc

SEQ ID NO: 946487 - DNA, 25 bp, Mus musculus
ttgaagtctacaaaaactgctttat

SEQ ID NO: 946488 - DNA, 25 bp, Mus musculus
ttgaagtctacataaactgctttat

SEQ ID NO: 946489 - DNA, 25 bp, Mus musculus
ttgaagtcttctctgttgtttggct

SEQ ID NO: 946490 - DNA, 25 bp, Mus musculus
ttgaagtcttctgtgttgtttggct

SEQ ID NO: 946491 - DNA, 25 bp, Mus musculus
ttgaagtgaagcactgttctgcctc

SEQ ID NO: 946492 - DNA, 25 bp, Mus musculus
ttgaagtgaagctctgttctgcctc

SEQ ID NO: 946493 - DNA, 25 bp, Mus musculus
ttgaagtgacaaacctcttgccatt

SEQ ID NO: 946494 - DNA, 25 bp, Mus musculus
ttgaagtgacaatcctcttgccatt

SEQ ID NO: 946495 - DNA, 25 bp, Mus musculus
ttgaagtggcccattgagtgcaggc

SEQ ID NO: 946496 - DNA, 25 bp, Mus musculus
ttgaagtggccctttgagtgcaggc

SEQ ID NO: 946497 - DNA, 25 bp, Mus musculus
ttgaagtggctcatcctacttcaaa

SEQ ID NO: 946498 - DNA, 25 bp, Mus musculus
ttgaagtggctcttcctacttcaaa

SEQ ID NO: 946499 - DNA, 25 bp, Mus musculus
ttgaagttcaagacaatcctggtct

SEQ ID NO: 946500 - DNA, 25 bp, Mus musculus
ttgaagttcaagtcaatcctggtct

SEQ ID NO: 946501 - DNA, 25 bp, Mus musculus
ttgaagttcagcaactcggtgcagg

SEQ ID NO: 946502 - DNA, 25 bp, Mus musculus
ttgaagttcagctactcggtgcagg

SEQ ID NO: 946503 - DNA, 25 bp, Mus musculus
ttgaagttgatccttgcttgggctt

SEQ ID NO: 946504 - DNA, 25 bp, Mus musculus
ttgaagttgatcgttgcttgggctt

SEQ ID NO: 946505 - DNA, 25 bp, Mus musculus
ttgaagttgcataaggacccgtgtt

SEQ ID NO: 946506 - DNA, 25 bp, Mus musculus
ttgaagttgcattaggacccgtgtt

SEQ ID NO: 946507 - DNA, 25 bp, Mus musculus
ttgaagttggaaaccctgtactgtg

SEQ ID NO: 946508 - DNA, 25 bp, Mus musculus
ttgaagttggaatccctgtactgtg

SEQ ID NO: 946509 - DNA, 25 bp, Mus musculus
ttgaagtttctcacccgctctggcg

SEQ ID NO: 946510 - DNA, 25 bp, Mus musculus
ttgaagtttctctcccgctctggcg

SEQ ID NO: 946511 - DNA, 25 bp, Mus musculus
ttgaataaacgtaagcaggtcgagg

SEQ ID NO: 946512 - DNA, 25 bp, Mus musculus
ttgaataaacgttagcaggtcgagg

SEQ ID NO: 946513 - DNA, 25 bp, Mus musculus
ttgaataactctatcatggaggtca

SEQ ID NO: 946514 - DNA, 25 bp, Mus musculus
ttgaataactctttcatggaggtca

SEQ ID NO: 946515 - DNA, 25 bp, Mus musculus
ttgaataagagaacgcccctcgtga

SEQ ID NO: 946516 - DNA, 25 bp, Mus musculus
ttgaataagagatcgcccctcgtga

SEQ ID NO: 946517 - DNA, 25 bp, Mus musculus
ttgaataattctactctcgtcttcc

SEQ ID NO: 946518 - DNA, 25 bp, Mus musculus
ttgaataattcttctctcgtcttcc

SEQ ID NO: 946519 - DNA, 25 bp, Mus musculus
ttgaataattgcattgactcctggg

SEQ ID NO: 946520 - DNA, 25 bp, Mus musculus
ttgaataattgctttgactcctggg

SEQ ID NO: 946521 - DNA, 25 bp, Mus musculus
ttgaataattgtaaggccccgttgc

SEQ ID NO: 946522 - DNA, 25 bp, Mus musculus
ttgaataattgttaggccccgttgc

SEQ ID NO: 946523 - DNA, 25 bp, Mus musculus
ttgaatacactacgcatgttctacc

SEQ ID NO: 946524 - DNA, 25 bp, Mus musculus
ttgaatacactaggcatgttctacc

SEQ ID NO: 946525 - DNA, 25 bp, Mus musculus
ttgaataccacaattctgccttctt

SEQ ID NO: 946526 - DNA, 25 bp, Mus musculus
ttgaataccacatttctgccttctt

SEQ ID NO: 946527 - DNA, 25 bp, Mus musculus
ttgaataccactactgtggccttag

SEQ ID NO: 946528 - DNA, 25 bp, Mus musculus
ttgaataccacttctgtggccttag

SEQ ID NO: 946529 - DNA, 25 bp, Mus musculus
ttgaatacctgaaggccttacggct

SEQ ID NO: 946530 - DNA, 25 bp, Mus musculus
ttgaatacctgatggccttacggct

SEQ ID NO: 946531 - DNA, 25 bp, Mus musculus
ttgaatactgttatctctggcacct

SEQ ID NO: 946532 - DNA, 25 bp, Mus musculus
ttgaatactgttttctctggcacct

SEQ ID NO: 946533 - DNA, 25 bp, Mus musculus
ttgaatacttcaaccctagttggta

SEQ ID NO: 946534 - DNA, 25 bp, Mus musculus
ttgaatacttcatccctagttggta

SEQ ID NO: 946535 - DNA, 25 bp, Mus musculus
ttgaatagcctcaccctttgaaatt

SEQ ID NO: 946536 - DNA, 25 bp, Mus musculus
ttgaatagcctctccctttgaaatt

SEQ ID NO: 946537 - DNA, 25 bp, Mus musculus
ttgaatagcgcacatcacacagcct

SEQ ID NO: 946538 - DNA, 25 bp, Mus musculus
ttgaatagcgcagatcacacagcct

SEQ ID NO: 946539 - DNA, 25 bp, Mus musculus
ttgaatatcacacttagcagtagct

SEQ ID NO: 946540 - DNA, 25 bp, Mus musculus
ttgaatatcacagttagcagtagct

SEQ ID NO: 946541 - DNA, 25 bp, Mus musculus
ttgaatatcctgctctccatgatgc

SEQ ID NO: 946542 - DNA, 25 bp, Mus musculus
ttgaatatcctggtctccatgatgc

SEQ ID NO: 946543 - DNA, 25 bp, Mus musculus
ttgaatatctctctacatggcaggg

SEQ ID NO: 946544 - DNA, 25 bp, Mus musculus
ttgaatatctctgtacatggcaggg

SEQ ID NO: 946545 - DNA, 25 bp, Mus musculus
ttgaatatgtctaacctgggtctca

SEQ ID NO: 946546 - DNA, 25 bp, Mus musculus
ttgaatatgtcttacctgggtctca

SEQ ID NO: 946547 - DNA, 25 bp, Mus musculus
ttgaatattaggatccgggccagct

SEQ ID NO: 946548 - DNA, 25 bp, Mus musculus
ttgaatattaggttccgggccagct

SEQ ID NO: 946549 - DNA, 25 bp, Mus musculus
ttgaatattgggagagcaggtgcct

SEQ ID NO: 946550 - DNA, 25 bp, Mus musculus
ttgaatattgggtgagcaggtgcct

SEQ ID NO: 946551 - DNA, 25 bp, Mus musculus
ttgaatatttacattccaccaaaat

SEQ ID NO: 946552 - DNA, 25 bp, Mus musculus
ttgaatatttactttccaccaaaat

SEQ ID NO: 946553 - DNA, 25 bp, Mus musculus
ttgaatattttgacctcaggcttat

SEQ ID NO: 946554 - DNA, 25 bp, Mus musculus
ttgaatattttgtcctcaggcttat

SEQ ID NO: 946555 - DNA, 25 bp, Mus musculus
ttgaatcagagtaacccacgtctcg

SEQ ID NO: 946556 - DNA, 25 bp, Mus musculus
ttgaatcagagttacccacgtctcg

SEQ ID NO: 946557 - DNA, 25 bp, Mus musculus
ttgaatcagctaagtcttcattatg

SEQ ID NO: 946558 - DNA, 25 bp, Mus musculus
ttgaatcagctatgtcttcattatg

SEQ ID NO: 946559 - DNA, 25 bp, Mus musculus
ttgaatcatcacaatacatggctat

SEQ ID NO: 946560 - DNA, 25 bp, Mus musculus
ttgaatcatcactatacatggctat

SEQ ID NO: 946561 - DNA, 25 bp, Mus musculus
ttgaatcatttcacacatatactta

SEQ ID NO: 946562 - DNA, 25 bp, Mus musculus
ttgaatcatttctcacatatactta

SEQ ID NO: 946563 - DNA, 25 bp, Mus musculus
ttgaatcatttgacaaggccgtgga

SEQ ID NO: 946564 - DNA, 25 bp, Mus musculus
ttgaatcatttgtcaaggccgtgga

SEQ ID NO: 946565 - DNA, 25 bp, Mus musculus
ttgaatccacaaaatctccgaagtt

SEQ ID NO: 946566 - DNA, 25 bp, Mus musculus
ttgaatccacaatatctccgaagtt

SEQ ID NO: 946567 - DNA, 25 bp, Mus musculus
ttgaatccacagagctctgcttctc

SEQ ID NO: 946568 - DNA, 25 bp, Mus musculus
ttgaatccacagtgctctgcttctc

SEQ ID NO: 946569 - DNA, 25 bp, Mus musculus
ttgaatccagatccctgtggtttca

SEQ ID NO: 946570 - DNA, 25 bp, Mus musculus
ttgaatccagatgcctgtggtttca

SEQ ID NO: 946571 - DNA, 25 bp, Mus musculus
ttgaatccaggtcccctctcaaaga

SEQ ID NO: 946572 - DNA, 25 bp, Mus musculus
ttgaatccaggtgccctctcaaaga

SEQ ID NO: 946573 - DNA, 25 bp, Mus musculus
ttgaatcccaagagcctgagcccat

SEQ ID NO: 946574 - DNA, 25 bp, Mus musculus
ttgaatcccaagtgcctgagcccat

SEQ ID NO: 946575 - DNA, 25 bp, Mus musculus
ttgaatcctaatctctagctgccgt

SEQ ID NO: 946576 - DNA, 25 bp, Mus musculus
ttgaatcctaatgtctagctgccgt

SEQ ID NO: 946577 - DNA, 25 bp, Mus musculus
ttgaatcctagaaactctccagggc

SEQ ID NO: 946578 - DNA, 25 bp, Mus musculus
ttgaatcctagatactctccagggc

SEQ ID NO: 946579 - DNA, 25 bp, Mus musculus
ttgaatcctgatatcttttgagaca

SEQ ID NO: 946580 - DNA, 25 bp, Mus musculus
ttgaatcctgatttcttttgagaca

SEQ ID NO: 946581 - DNA, 25 bp, Mus musculus
ttgaatcctgctcagccctatggtg

SEQ ID NO: 946582 - DNA, 25 bp, Mus musculus
ttgaatcctgctgagccctatggtg

SEQ ID NO: 946583 - DNA, 25 bp, Mus musculus
ttgaatccttcaaacgcgctgacat

SEQ ID NO: 946584 - DNA, 25 bp, Mus musculus
ttgaatccttcatacgcgctgacat

SEQ ID NO: 946585 - DNA, 25 bp, Mus musculus
ttgaatcgaaacactctctttagag

SEQ ID NO: 946586 - DNA, 25 bp, Mus musculus
ttgaatcgaaactctctctttagag

SEQ ID NO: 946587 - DNA, 25 bp, Mus musculus
ttgaatcgcagactgacacctgtcc

SEQ ID NO: 946588 - DNA, 25 bp, Mus musculus
ttgaatcgcagagtgacacctgtcc

SEQ ID NO: 946589 - DNA, 25 bp, Mus musculus
ttgaatctaccaagccactttgtga

SEQ ID NO: 946590 - DNA, 25 bp, Mus musculus
ttgaatctaccatgccactttgtga

SEQ ID NO: 946591 - DNA, 25 bp, Mus musculus
ttgaatctcacacttggacgtctgg

SEQ ID NO: 946592 - DNA, 25 bp, Mus musculus
ttgaatctcacagttggacgtctgg

SEQ ID NO: 946593 - DNA, 25 bp, Mus musculus
ttgaatctcactagacccctagatc

SEQ ID NO: 946594 - DNA, 25 bp, Mus musculus
ttgaatctcacttgacccctagatc

SEQ ID NO: 946595 - DNA, 25 bp, Mus musculus
ttgaatctcaggcatccggcaggga

SEQ ID NO: 946596 - DNA, 25 bp, Mus musculus
ttgaatctcagggatccggcaggga

SEQ ID NO: 946597 - DNA, 25 bp, Mus musculus
ttgaatctccacagtttggtcccct

SEQ ID NO: 946598 - DNA, 25 bp, Mus musculus
ttgaatctccactgtttggtcccct

SEQ ID NO: 946599 - DNA, 25 bp, Mus musculus
ttgaatctctgacgtgacccaccag

SEQ ID NO: 946600 - DNA, 25 bp, Mus musculus
ttgaatctctgaggtgacccaccag

SEQ ID NO: 946601 - DNA, 25 bp, Mus musculus
ttgaatctctggagccaactagcca

SEQ ID NO: 946602 - DNA, 25 bp, Mus musculus
ttgaatctctggtgccaactagcca

SEQ ID NO: 946603 - DNA, 25 bp, Mus musculus
ttgaatctgaccagcaagtgctgac

SEQ ID NO: 946604 - DNA, 25 bp, Mus musculus
ttgaatctgacctgcaagtgctgac

SEQ ID NO: 946605 - DNA, 25 bp, Mus musculus
ttgaatctgccactgccaacctcat

SEQ ID NO: 946606 - DNA, 25 bp, Mus musculus
ttgaatctgccagtgccaacctcat

SEQ ID NO: 946607 - DNA, 25 bp, Mus musculus
ttgaatctggggaaactcctctcct

SEQ ID NO: 946608 - DNA, 25 bp, Mus musculus
ttgaatctggggtaactcctctcct

SEQ ID NO: 946609 - DNA, 25 bp, Mus musculus
ttgaatctgtgtagtctctgaccct

SEQ ID NO: 946610 - DNA, 25 bp, Mus musculus
ttgaatctgtgttgtctctgaccct

SEQ ID NO: 946611 - DNA, 25 bp, Mus musculus
ttgaatcttacactgaaacttctgg

SEQ ID NO: 946612 - DNA, 25 bp, Mus musculus
ttgaatcttacagtgaaacttctgg

SEQ ID NO: 946613 - DNA, 25 bp, Mus musculus
ttgaatcttaccatgaggtccccga

SEQ ID NO: 946614 - DNA, 25 bp, Mus musculus
ttgaatcttaccttgaggtccccga

SEQ ID NO: 946615 - DNA, 25 bp, Mus musculus
ttgaatcttccacggaagcctccga

SEQ ID NO: 946616 - DNA, 25 bp, Mus musculus
ttgaatcttccagggaagcctccga

SEQ ID NO: 946617 - DNA, 25 bp, Mus musculus
ttgaatctttagcagtccaatacgc

SEQ ID NO: 946618 - DNA, 25 bp, Mus musculus
ttgaatctttaggagtccaatacgc

SEQ ID NO: 946619 - DNA, 25 bp, Mus musculus
ttgaatgaacagatgtccagcgcat

SEQ ID NO: 946620 - DNA, 25 bp, Mus musculus
ttgaatgaacagttgtccagcgcat

SEQ ID NO: 946621 - DNA, 25 bp, Mus musculus
ttgaatgaaccgcagccacatacat

SEQ ID NO: 946622 - DNA, 25 bp, Mus musculus
ttgaatgaaccggagccacatacat

SEQ ID NO: 946623 - DNA, 25 bp, Mus musculus
ttgaatgaactcatccagcgggaaa

SEQ ID NO: 946624 - DNA, 25 bp, Mus musculus
ttgaatgaactcttccagcgggaaa

SEQ ID NO: 946625 - DNA, 25 bp, Mus musculus
ttgaatgaagccagtcgagacctct

SEQ ID NO: 946626 - DNA, 25 bp, Mus musculus
ttgaatgaagcctgtcgagacctct

SEQ ID NO: 946627 - DNA, 25 bp, Mus musculus
ttgaatgaatgacaggacctccaca

SEQ ID NO: 946628 - DNA, 25 bp, Mus musculus
ttgaatgaatgagaggacctccaca

SEQ ID NO: 946629 - DNA, 25 bp, Mus musculus
ttgaatgactcgctccagattccaa

SEQ ID NO: 946630 - DNA, 25 bp, Mus musculus
ttgaatgactcggtccagattccaa

SEQ ID NO: 946631 - DNA, 25 bp, Mus musculus
ttgaatgaggctagctccggtgacc

SEQ ID NO: 946632 - DNA, 25 bp, Mus musculus
ttgaatgaggcttgctccggtgacc

SEQ ID NO: 946633 - DNA, 25 bp, Mus musculus
ttgaatgcccaacttccgttacctt

SEQ ID NO: 946634 - DNA, 25 bp, Mus musculus
ttgaatgcccaagttccgttacctt

SEQ ID NO: 946635 - DNA, 25 bp, Mus musculus
ttgaatgccccgagaactatcgccg

SEQ ID NO: 946636 - DNA, 25 bp, Mus musculus
ttgaatgccccgtgaactatcgccg

SEQ ID NO: 946637 - DNA, 25 bp, Mus musculus
ttgaatgcctcccagcagtagtcat

SEQ ID NO: 946638 - DNA, 25 bp, Mus musculus
ttgaatgcctccgagcagtagtcat

SEQ ID NO: 946639 - DNA, 25 bp, Mus musculus
ttgaatgctaccatccatttcacta

SEQ ID NO: 946640 - DNA, 25 bp, Mus musculus
ttgaatgctaccttccatttcacta

SEQ ID NO: 946641 - DNA, 25 bp, Mus musculus
ttgaatgcttagaagacgccctccc

SEQ ID NO: 946642 - DNA, 25 bp, Mus musculus
ttgaatgcttagtagacgccctccc

SEQ ID NO: 946643 - DNA, 25 bp, Mus musculus
ttgaatgcttgaccccaggaaggag

SEQ ID NO: 946644 - DNA, 25 bp, Mus musculus
ttgaatgcttgagcccaggaaggag

SEQ ID NO: 946645 - DNA, 25 bp, Mus musculus
ttgaatgggcttaattcctgtggcc

SEQ ID NO: 946646 - DNA, 25 bp, Mus musculus
ttgaatgggctttattcctgtggcc

SEQ ID NO: 946647 - DNA, 25 bp, Mus musculus
ttgaatggtattcggcgtatcctgg

SEQ ID NO: 946648 - DNA, 25 bp, Mus musculus
ttgaatggtattgggcgtatcctgg

SEQ ID NO: 946649 - DNA, 25 bp, Mus musculus
ttgaatggtgttcgagtgttactcc

SEQ ID NO: 946650 - DNA, 25 bp, Mus musculus
ttgaatggtgttggagtgttactcc

SEQ ID NO: 946651 - DNA, 25 bp, Mus musculus
ttgaatgtaaccaataccactaata

SEQ ID NO: 946652 - DNA, 25 bp, Mus musculus
ttgaatgtaacctataccactaata

SEQ ID NO: 946653 - DNA, 25 bp, Mus musculus
ttgaatgtagaaacggtgagcacac

SEQ ID NO: 946654 - DNA, 25 bp, Mus musculus
ttgaatgtagaatcggtgagcacac

SEQ ID NO: 946655 - DNA, 25 bp, Mus musculus
ttgaatgtaggcactagggcagaga

SEQ ID NO: 946656 - DNA, 25 bp, Mus musculus
ttgaatgtaggctctagggcagaga

SEQ ID NO: 946657 - DNA, 25 bp, Mus musculus
ttgaatgtccttaaccacttctact

SEQ ID NO: 946658 - DNA, 25 bp, Mus musculus
ttgaatgtcctttaccacttctact

SEQ ID NO: 946659 - DNA, 25 bp, Mus musculus
ttgaatgtgctgatctactcgaaaa

SEQ ID NO: 946660 - DNA, 25 bp, Mus musculus
ttgaatgtgctgttctactcgaaaa

SEQ ID NO: 946661 - DNA, 25 bp, Mus musculus
ttgaatgtggttactcgtcgacttg

SEQ ID NO: 946662 - DNA, 25 bp, Mus musculus
ttgaatgtggtttctcgtcgacttg

SEQ ID NO: 946663 - DNA, 25 bp, Mus musculus
ttgaatgtgttcactctaccagctc

SEQ ID NO: 946664 - DNA, 25 bp, Mus musculus
ttgaatgtgttctctctaccagctc

SEQ ID NO: 946665 - DNA, 25 bp, Mus musculus
ttgaatgttaaaatatgctcttggg

SEQ ID NO: 946666 - DNA, 25 bp, Mus musculus
ttgaatgttaaattatgctcttggg

SEQ ID NO: 946667 - DNA, 25 bp, Mus musculus
ttgaattacagccagcagccccaag

SEQ ID NO: 946668 - DNA, 25 bp, Mus musculus
ttgaattacagcgagcagccccaag

SEQ ID NO: 946669 - DNA, 25 bp, Mus musculus
ttgaattactagacacttccttcgg

SEQ ID NO: 946670 - DNA, 25 bp, Mus musculus
ttgaattactagtcacttccttcgg

SEQ ID NO: 946671 - DNA, 25 bp, Mus musculus
ttgaattacttcctcaatttctctg

SEQ ID NO: 946672 - DNA, 25 bp, Mus musculus
ttgaattacttcgtcaatttctctg

SEQ ID NO: 946673 - DNA, 25 bp, Mus musculus
ttgaattaggtcattgggctgttac

SEQ ID NO: 946674 - DNA, 25 bp, Mus musculus
ttgaattaggtctttgggctgttac

SEQ ID NO: 946675 - DNA, 25 bp, Mus musculus
ttgaattatgtcctgcttccaacca

SEQ ID NO: 946676 - DNA, 25 bp, Mus musculus
ttgaattatgtcgtgcttccaacca

SEQ ID NO: 946677 - DNA, 25 bp, Mus musculus
ttgaattcacccaagaaagcacaca

SEQ ID NO: 946678 - DNA, 25 bp, Mus musculus
ttgaattcaccctagaaagcacaca

SEQ ID NO: 946679 - DNA, 25 bp, Mus musculus
ttgaattcatccacacctgcatagc

SEQ ID NO: 946680 - DNA, 25 bp, Mus musculus
ttgaattcatcctcacctgcatagc

SEQ ID NO: 946681 - DNA, 25 bp, Mus musculus
ttgaattccactcgcctttcggaca

SEQ ID NO: 946682 - DNA, 25 bp, Mus musculus
ttgaattccactggcctttcggaca

SEQ ID NO: 946683 - DNA, 25 bp, Mus musculus
ttgaattcccatcaagggcactttc

SEQ ID NO: 946684 - DNA, 25 bp, Mus musculus
ttgaattcccatgaagggcactttc

SEQ ID NO: 946685 - DNA, 25 bp, Mus musculus
ttgaattcccctccaggtttaattc

SEQ ID NO: 946686 - DNA, 25 bp, Mus musculus
ttgaattcccctgcaggtttaattc

SEQ ID NO: 946687 - DNA, 25 bp, Mus musculus
ttgaattcccgcactgtagatctgt

SEQ ID NO: 946688 - DNA, 25 bp, Mus musculus
ttgaattcccgctctgtagatctgt

SEQ ID NO: 946689 - DNA, 25 bp, Mus musculus
ttgaattcctttactccgcaatgat

SEQ ID NO: 946690 - DNA, 25 bp, Mus musculus
ttgaattcctttatagcatattact

SEQ ID NO: 946691 - DNA, 25 bp, Mus musculus
ttgaattccttttctccgcaatgat

SEQ ID NO: 946692 - DNA, 25 bp, Mus musculus
ttgaattcctttttagcatattact

SEQ ID NO: 946693 - DNA, 25 bp, Mus musculus
ttgaattcgttcacattctccgttg

SEQ ID NO: 946694 - DNA, 25 bp, Mus musculus
ttgaattcgttctcattctccgttg

SEQ ID NO: 946695 - DNA, 25 bp, Mus musculus
ttgaattctattcccctctcctttt

SEQ ID NO: 946696 - DNA, 25 bp, Mus musculus
ttgaattctattgccctctcctttt

SEQ ID NO: 946697 - DNA, 25 bp, Mus musculus
ttgaattctctaacatagcgtccta

SEQ ID NO: 946698 - DNA, 25 bp, Mus musculus
ttgaattctctatcatagcgtccta

SEQ ID NO: 946699 - DNA, 25 bp, Mus musculus
ttgaattctgagatctgctaccttc

SEQ ID NO: 946700 - DNA, 25 bp, Mus musculus
ttgaattctgagttctgctaccttc

SEQ ID NO: 946701 - DNA, 25 bp, Mus musculus
ttgaattctgatcgtctgagctctc

SEQ ID NO: 946702 - DNA, 25 bp, Mus musculus
ttgaattctgatggtctgagctctc

SEQ ID NO: 946703 - DNA, 25 bp, Mus musculus
ttgaattctggtctttttcccctct

SEQ ID NO: 946704 - DNA, 25 bp, Mus musculus
ttgaattctggtgtttttcccctct

SEQ ID NO: 946705 - DNA, 25 bp, Mus musculus
ttgaattctgtcactctactcttgg

SEQ ID NO: 946706 - DNA, 25 bp, Mus musculus
ttgaattctgtctctctactcttgg

SEQ ID NO: 946707 - DNA, 25 bp, Mus musculus
ttgaattcttagactcttgtgctgt

SEQ ID NO: 946708 - DNA, 25 bp, Mus musculus
ttgaattcttagtctcttgtgctgt

SEQ ID NO: 946709 - DNA, 25 bp, Mus musculus
ttgaattcttggacgaacgctctga

SEQ ID NO: 946710 - DNA, 25 bp, Mus musculus
ttgaattcttggtcgaacgctctga

SEQ ID NO: 946711 - DNA, 25 bp, Mus musculus
ttgaattgactcagccaggacagat

SEQ ID NO: 946712 - DNA, 25 bp, Mus musculus
ttgaattgactctgccaggacagat

SEQ ID NO: 946713 - DNA, 25 bp, Mus musculus
ttgaattgactgatgcctgggttgt

SEQ ID NO: 946714 - DNA, 25 bp, Mus musculus
ttgaattgactgttgcctgggttgt

SEQ ID NO: 946715 - DNA, 25 bp, Mus musculus
ttgaattgccaacatttaagaataa

SEQ ID NO: 946716 - DNA, 25 bp, Mus musculus
ttgaattgccaagatttaagaataa

SEQ ID NO: 946717 - DNA, 25 bp, Mus musculus
ttgaattgccgcctgtttgttacga

SEQ ID NO: 946718 - DNA, 25 bp, Mus musculus
ttgaattgccgcgtgtttgttacga

SEQ ID NO: 946719 - DNA, 25 bp, Mus musculus
ttgaattgcctactttttattcagc

SEQ ID NO: 946720 - DNA, 25 bp, Mus musculus
ttgaattgcctagtttttattcagc

SEQ ID NO: 946721 - DNA, 25 bp, Mus musculus
ttgaattgctctacttggctatggc

SEQ ID NO: 946722 - DNA, 25 bp, Mus musculus
ttgaattgctcttcttggctatggc

SEQ ID NO: 946723 - DNA, 25 bp, Mus musculus
ttgaattggcttacttttggaacag

SEQ ID NO: 946724 - DNA, 25 bp, Mus musculus
ttgaattggctttcttttggaacag

SEQ ID NO: 946725 - DNA, 25 bp, Mus musculus
ttgaattgggtcaacagacactaac

SEQ ID NO: 946726 - DNA, 25 bp, Mus musculus
ttgaattgggtctacagacactaac

SEQ ID NO: 946727 - DNA, 25 bp, Mus musculus
ttgaattggtccctcttattatagt

SEQ ID NO: 946728 - DNA, 25 bp, Mus musculus
ttgaattggtccgtcttattatagt

SEQ ID NO: 946729 - DNA, 25 bp, Mus musculus
ttgaattgtaggagtgatgttatgc

SEQ ID NO: 946730 - DNA, 25 bp, Mus musculus
ttgaattgtaggtgtgatgttatgc

SEQ ID NO: 946731 - DNA, 25 bp, Mus musculus
ttgaattgtctgaccacggacatca

SEQ ID NO: 946732 - DNA, 25 bp, Mus musculus
ttgaattgtctgtccacggacatca

SEQ ID NO: 946733 - DNA, 25 bp, Mus musculus
ttgaattgttaaagtacctctgtac

SEQ ID NO: 946734 - DNA, 25 bp, Mus musculus
ttgaattgttaatgtacctctgtac

SEQ ID NO: 946735 - DNA, 25 bp, Mus musculus
ttgaatttcctgaatgaacccctgc

SEQ ID NO: 946736 - DNA, 25 bp, Mus musculus
ttgaatttcctgcaacactggtatt

SEQ ID NO: 946737 - DNA, 25 bp, Mus musculus
ttgaatttcctggaacactggtatt

SEQ ID NO: 946738 - DNA, 25 bp, Mus musculus
ttgaatttcctgtatgaacccctgc

SEQ ID NO: 946739 - DNA, 25 bp, Mus musculus
ttgaatttctcaccccactacctag

SEQ ID NO: 946740 - DNA, 25 bp, Mus musculus
ttgaatttctcagcccactacctag

SEQ ID NO: 946741 - DNA, 25 bp, Mus musculus
ttgaatttctctcccacgttttctt

SEQ ID NO: 946742 - DNA, 25 bp, Mus musculus
ttgaatttctctgccacgttttctt

SEQ ID NO: 946743 - DNA, 25 bp, Mus musculus
ttgaatttctttcggaacaggaaag

SEQ ID NO: 946744 - DNA, 25 bp, Mus musculus
ttgaatttctttgggaacaggaaag

SEQ ID NO: 946745 - DNA, 25 bp, Mus musculus
ttgaatttgagcagccttcagagga

SEQ ID NO: 946746 - DNA, 25 bp, Mus musculus
ttgaatttgagctgccttcagagga

SEQ ID NO: 946747 - DNA, 25 bp, Mus musculus
ttgaatttgcccaggctcagcaaag

SEQ ID NO: 946748 - DNA, 25 bp, Mus musculus
ttgaatttgccctggctcagcaaag

SEQ ID NO: 946749 - DNA, 25 bp, Mus musculus
ttgaatttggcaaccttaccttgaa

SEQ ID NO: 946750 - DNA, 25 bp, Mus musculus
ttgaatttggcatccttaccttgaa

SEQ ID NO: 946751 - DNA, 25 bp, Mus musculus
ttgaattttattcgctgagcacata

SEQ ID NO: 946752 - DNA, 25 bp, Mus musculus
ttgaattttattggctgagcacata

SEQ ID NO: 946753 - DNA, 25 bp, Mus musculus
ttgaattttcaaaccactctcggcc

SEQ ID NO: 946754 - DNA, 25 bp, Mus musculus
ttgaattttcaatccactctcggcc

SEQ ID NO: 946755 - DNA, 25 bp, Mus musculus
ttgaatttttcccacagttcctctc

SEQ ID NO: 946756 - DNA, 25 bp, Mus musculus
ttgaatttttccgacagttcctctc

SEQ ID NO: 946757 - DNA, 25 bp, Mus musculus
ttgacaaagaacaacgggcaattta

SEQ ID NO: 946758 - DNA, 25 bp, Mus musculus
ttgacaaagaactacgggcaattta

SEQ ID NO: 946759 - DNA, 25 bp, Mus musculus
ttgacaaagctcatgctccattgca

SEQ ID NO: 946760 - DNA, 25 bp, Mus musculus
ttgacaaagctcttgctccattgca

SEQ ID NO: 946761 - DNA, 25 bp, Mus musculus
ttgacaaatgacatcagctttggca

SEQ ID NO: 946762 - DNA, 25 bp, Mus musculus
ttgacaaatgacttcagctttggca

SEQ ID NO: 946763 - DNA, 25 bp, Mus musculus
ttgacaaatggccaccaattagagg

SEQ ID NO: 946764 - DNA, 25 bp, Mus musculus
ttgacaaatggcgaccaattagagg

SEQ ID NO: 946765 - DNA, 25 bp, Mus musculus
ttgacaacaccacaatccaagtttt

SEQ ID NO: 946766 - DNA, 25 bp, Mus musculus
ttgacaacaccagaatccaagtttt

SEQ ID NO: 946767 - DNA, 25 bp, Mus musculus
ttgacaaccacgctcatgggccatg

SEQ ID NO: 946768 - DNA, 25 bp, Mus musculus
ttgacaaccacggtcatgggccatg

SEQ ID NO: 946769 - DNA, 25 bp, Mus musculus
ttgacaacccatcccaatgagacaa

SEQ ID NO: 946770 - DNA, 25 bp, Mus musculus
ttgacaacccatgccaatgagacaa

SEQ ID NO: 946771 - DNA, 25 bp, Mus musculus
ttgacaacgcctaggtgacatcctc

SEQ ID NO: 946772 - DNA, 25 bp, Mus musculus
ttgacaacgccttggtgacatcctc

SEQ ID NO: 946773 - DNA, 25 bp, Mus musculus
ttgacaactctgcttactgctcagg

SEQ ID NO: 946774 - DNA, 25 bp, Mus musculus
ttgacaactctggttactgctcagg

SEQ ID NO: 946775 - DNA, 25 bp, Mus musculus
ttgacaactgttaccagcaccattg

SEQ ID NO: 946776 - DNA, 25 bp, Mus musculus
ttgacaactgtttccagcaccattg

SEQ ID NO: 946777 - DNA, 25 bp, Mus musculus
ttgacaacttggattcctggagtcc

SEQ ID NO: 946778 - DNA, 25 bp, Mus musculus
ttgacaacttggtttcctggagtcc

SEQ ID NO: 946779 - DNA, 25 bp, Mus musculus
ttgacaagacctcaagttccatcct

SEQ ID NO: 946780 - DNA, 25 bp, Mus musculus
ttgacaagacctgaagttccatcct

SEQ ID NO: 946781 - DNA, 25 bp, Mus musculus
ttgacaagagaacgcccgtccaact

SEQ ID NO: 946782 - DNA, 25 bp, Mus musculus
ttgacaagagaaggcccgtccaact

SEQ ID NO: 946783 - DNA, 25 bp, Mus musculus
ttgacaagatcgctgctcaaggccg

SEQ ID NO: 946784 - DNA, 25 bp, Mus musculus
ttgacaagatcggtgctcaaggccg

SEQ ID NO: 946785 - DNA, 25 bp, Mus musculus
ttgacaagatctctgacactcctgt

SEQ ID NO: 946786 - DNA, 25 bp, Mus musculus
ttgacaagatctgtgacactcctgt

SEQ ID NO: 946787 - DNA, 25 bp, Mus musculus
ttgacaagcatcagagatcacactt

SEQ ID NO: 946788 - DNA, 25 bp, Mus musculus
ttgacaagcatctgagatcacactt

SEQ ID NO: 946789 - DNA, 25 bp, Mus musculus
ttgacaagccaaatctccactcctg

SEQ ID NO: 946790 - DNA, 25 bp, Mus musculus
ttgacaagccaattctccactcctg

SEQ ID NO: 946791 - DNA, 25 bp, Mus musculus
ttgacaagtgctaattttgtgccca

SEQ ID NO: 946792 - DNA, 25 bp, Mus musculus
ttgacaagtgcttattttgtgccca

SEQ ID NO: 946793 - DNA, 25 bp, Mus musculus
ttgacaagttctactgacagcagga

SEQ ID NO: 946794 - DNA, 25 bp, Mus musculus
ttgacaagttcttctgacagcagga

SEQ ID NO: 946795 - DNA, 25 bp, Mus musculus
ttgacaagttggaacattcaggaac

SEQ ID NO: 946796 - DNA, 25 bp, Mus musculus
ttgacaagttggtacattcaggaac

SEQ ID NO: 946797 - DNA, 25 bp, Mus musculus
ttgacaatatcaacatgacacacta

SEQ ID NO: 946798 - DNA, 25 bp, Mus musculus
ttgacaatatcatcatgacacacta

SEQ ID NO: 946799 - DNA, 25 bp, Mus musculus
ttgacaatattgacgctgaggactt

SEQ ID NO: 946800 - DNA, 25 bp, Mus musculus
ttgacaatattgtcgctgaggactt

SEQ ID NO: 946801 - DNA, 25 bp, Mus musculus
ttgacaatcacccatctaagcttgc

SEQ ID NO: 946802 - DNA, 25 bp, Mus musculus
ttgacaatcaccgatctaagcttgc

SEQ ID NO: 946803 - DNA, 25 bp, Mus musculus
ttgacaatcagaaacccctcccagg

SEQ ID NO: 946804 - DNA, 25 bp, Mus musculus
ttgacaatcagatacccctcccagg

SEQ ID NO: 946805 - DNA, 25 bp, Mus musculus
ttgacaatcctgcagatcccctgca

SEQ ID NO: 946806 - DNA, 25 bp, Mus musculus
ttgacaatcctggagatcccctgca

SEQ ID NO: 946807 - DNA, 25 bp, Mus musculus
ttgacaatcgtaatggcccaggaga

SEQ ID NO: 946808 - DNA, 25 bp, Mus musculus
ttgacaatcgtattggcccaggaga

SEQ ID NO: 946809 - DNA, 25 bp, Mus musculus
ttgacaatggccaaggtttgcaaat

SEQ ID NO: 946810 - DNA, 25 bp, Mus musculus
ttgacaatggcctaggtttgcaaat

SEQ ID NO: 946811 - DNA, 25 bp, Mus musculus
ttgacaatgtgtagtgttccccgat

SEQ ID NO: 946812 - DNA, 25 bp, Mus musculus
ttgacaatgtgttgtgttccccgat

SEQ ID NO: 946813 - DNA, 25 bp, Mus musculus
ttgacaattctgactcacatgccac

SEQ ID NO: 946814 - DNA, 25 bp, Mus musculus
ttgacaattctgatgtgtgcccggg

SEQ ID NO: 946815 - DNA, 25 bp, Mus musculus
ttgacaattctgtctcacatgccac

SEQ ID NO: 946816 - DNA, 25 bp, Mus musculus
ttgacaattctgttgtgtgcccggg

SEQ ID NO: 946817 - DNA, 25 bp, Mus musculus
ttgacacaatcacttgctactgcca

SEQ ID NO: 946818 - DNA, 25 bp, Mus musculus
ttgacacaatcagttgctactgcca

SEQ ID NO: 946819 - DNA, 25 bp, Mus musculus
ttgacacacatgaattccacatccc

SEQ ID NO: 946820 - DNA, 25 bp, Mus musculus
ttgacacacatgtattccacatccc

SEQ ID NO: 946821 - DNA, 25 bp, Mus musculus
ttgacacacctcactaggctataac

SEQ ID NO: 946822 - DNA, 25 bp, Mus musculus
ttgacacacctctctaggctataac

SEQ ID NO: 946823 - DNA, 25 bp, Mus musculus
ttgacacactggacaaccctgaatg

SEQ ID NO: 946824 - DNA, 25 bp, Mus musculus
ttgacacactggtcaaccctgaatg

SEQ ID NO: 946825 - DNA, 25 bp, Mus musculus
ttgacacagcccacttatctgcact

SEQ ID NO: 946826 - DNA, 25 bp, Mus musculus
ttgacacagccctcttatctgcact

SEQ ID NO: 946827 - DNA, 25 bp, Mus musculus
ttgacacagggtcttttgctggcct

SEQ ID NO: 946828 - DNA, 25 bp, Mus musculus
ttgacacagggtgttttgctggcct

SEQ ID NO: 946829 - DNA, 25 bp, Mus musculus
ttgacacaggtcactctagcttgaa

SEQ ID NO: 946830 - DNA, 25 bp, Mus musculus
ttgacacaggtctctctagcttgaa

SEQ ID NO: 946831 - DNA, 25 bp, Mus musculus
ttgacacaggttcttaaccacccca

SEQ ID NO: 946832 - DNA, 25 bp, Mus musculus
ttgacacaggttgttaaccacccca

SEQ ID NO: 946833 - DNA, 25 bp, Mus musculus
ttgacacatactactgctctgagca

SEQ ID NO: 946834 - DNA, 25 bp, Mus musculus
ttgacacatacttctgctctgagca

SEQ ID NO: 946835 - DNA, 25 bp, Mus musculus
ttgacacatccccaaggcttctttt

SEQ ID NO: 946836 - DNA, 25 bp, Mus musculus
ttgacacatcccgaaggcttctttt

SEQ ID NO: 946837 - DNA, 25 bp, Mus musculus
ttgacaccaacacctcagagggctg

SEQ ID NO: 946838 - DNA, 25 bp, Mus musculus
ttgacaccaacagctcagagggctg

SEQ ID NO: 946839 - DNA, 25 bp, Mus musculus
ttgacaccagacctgtgggctcctg

SEQ ID NO: 946840 - DNA, 25 bp, Mus musculus
ttgacaccagacgtgtgggctcctg

SEQ ID NO: 946841 - DNA, 25 bp, Mus musculus
ttgacaccaggtaaggcctgcaact

SEQ ID NO: 946842 - DNA, 25 bp, Mus musculus
ttgacaccaggttaggcctgcaact

SEQ ID NO: 946843 - DNA, 25 bp, Mus musculus
ttgacacccaacatctccagagatg

SEQ ID NO: 946844 - DNA, 25 bp, Mus musculus
ttgacacccaacttctccagagatg

SEQ ID NO: 946845 - DNA, 25 bp, Mus musculus
ttgacacccaatactatctattcct

SEQ ID NO: 946846 - DNA, 25 bp, Mus musculus
ttgacacccaattctatctattcct

SEQ ID NO: 946847 - DNA, 25 bp, Mus musculus
ttgacacccatgcctgaaatgctat

SEQ ID NO: 946848 - DNA, 25 bp, Mus musculus
ttgacacccatggctgaaatgctat

SEQ ID NO: 946849 - DNA, 25 bp, Mus musculus
ttgacaccctatcccaaagatcaga

SEQ ID NO: 946850 - DNA, 25 bp, Mus musculus
ttgacaccctatgccaaagatcaga

SEQ ID NO: 946851 - DNA, 25 bp, Mus musculus
ttgacaccgtggatttggtccattt

SEQ ID NO: 946852 - DNA, 25 bp, Mus musculus
ttgacaccgtggttttggtccattt

SEQ ID NO: 946853 - DNA, 25 bp, Mus musculus
ttgacacctaacataaatcttctta

SEQ ID NO: 946854 - DNA, 25 bp, Mus musculus
ttgacacctaacttaaatcttctta

SEQ ID NO: 946855 - DNA, 25 bp, Mus musculus
ttgacacctatactccaaacttgct

SEQ ID NO: 946856 - DNA, 25 bp, Mus musculus
ttgacacctatagtccaaacttgct

SEQ ID NO: 946857 - DNA, 25 bp, Mus musculus
ttgacacctcatcatagacaccctg

SEQ ID NO: 946858 - DNA, 25 bp, Mus musculus
ttgacacctcatgatagacaccctg

SEQ ID NO: 946859 - DNA, 25 bp, Mus musculus
ttgacacctgtgaatttcttttttc

SEQ ID NO: 946860 - DNA, 25 bp, Mus musculus
ttgacacctgtgatcactccttggt

SEQ ID NO: 946861 - DNA, 25 bp, Mus musculus
ttgacacctgtgtatttcttttttc

SEQ ID NO: 946862 - DNA, 25 bp, Mus musculus
ttgacacctgtgttcactccttggt

SEQ ID NO: 946863 - DNA, 25 bp, Mus musculus
ttgacaccttaacgaatcgcccgtc

SEQ ID NO: 946864 - DNA, 25 bp, Mus musculus
ttgacaccttaaggaatcgcccgtc

SEQ ID NO: 946865 - DNA, 25 bp, Mus musculus
ttgacaccttccaaacctgctttgt

SEQ ID NO: 946866 - DNA, 25 bp, Mus musculus
ttgacaccttcctaacctgctttgt

SEQ ID NO: 946867 - DNA, 25 bp, Mus musculus
ttgacaccttggctcggaacctgca

SEQ ID NO: 946868 - DNA, 25 bp, Mus musculus
ttgacaccttgggtcggaacctgca

SEQ ID NO: 946869 - DNA, 25 bp, Mus musculus
ttgacacgagccaactgaatgctgt

SEQ ID NO: 946870 - DNA, 25 bp, Mus musculus
ttgacacgagcctactgaatgctgt

SEQ ID NO: 946871 - DNA, 25 bp, Mus musculus
ttgacacgctgtctggagcccaagt

SEQ ID NO: 946872 - DNA, 25 bp, Mus musculus
ttgacacgctgtgtggagcccaagt

SEQ ID NO: 946873 - DNA, 25 bp, Mus musculus
ttgacacggattaattgtaattgct

SEQ ID NO: 946874 - DNA, 25 bp, Mus musculus
ttgacacggatttattgtaattgct

SEQ ID NO: 946875 - DNA, 25 bp, Mus musculus
ttgacacgtaccagctcatcagtga

SEQ ID NO: 946876 - DNA, 25 bp, Mus musculus
ttgacacgtacctgctcatcagtga

SEQ ID NO: 946877 - DNA, 25 bp, Mus musculus
ttgacacgtgacaactgcttctctt

SEQ ID NO: 946878 - DNA, 25 bp, Mus musculus
ttgacacgtgactactgcttctctt

SEQ ID NO: 946879 - DNA, 25 bp, Mus musculus
ttgacactagtgaacccaggactgg

SEQ ID NO: 946880 - DNA, 25 bp, Mus musculus
ttgacactagtgtacccaggactgg

SEQ ID NO: 946881 - DNA, 25 bp, Mus musculus
ttgacactcacactttgtccctgac

SEQ ID NO: 946882 - DNA, 25 bp, Mus musculus
ttgacactcacagtttgtccctgac

SEQ ID NO: 946883 - DNA, 25 bp, Mus musculus
ttgacactcgttctttgacagccta

SEQ ID NO: 946884 - DNA, 25 bp, Mus musculus
ttgacactcgttgtttgacagccta

SEQ ID NO: 946885 - DNA, 25 bp, Mus musculus
ttgacactgaccaggacggctacat

SEQ ID NO: 946886 - DNA, 25 bp, Mus musculus
ttgacactgacctggacggctacat

SEQ ID NO: 946887 - DNA, 25 bp, Mus musculus
ttgacactgctgcacgtccgtgtaa

SEQ ID NO: 946888 - DNA, 25 bp, Mus musculus
ttgacactgctggacgtccgtgtaa

SEQ ID NO: 946889 - DNA, 25 bp, Mus musculus
ttgacactgggaatcagtttaggca

SEQ ID NO: 946890 - DNA, 25 bp, Mus musculus
ttgacactgggattcagtttaggca

SEQ ID NO: 946891 - DNA, 25 bp, Mus musculus
ttgacacttgttagtctctgtgagc

SEQ ID NO: 946892 - DNA, 25 bp, Mus musculus
ttgacacttgtttgtctctgtgagc

SEQ ID NO: 946893 - DNA, 25 bp, Mus musculus
ttgacagaaaatcagcccgcacact

SEQ ID NO: 946894 - DNA, 25 bp, Mus musculus
ttgacagaaaatgagcccgcacact

SEQ ID NO: 946895 - DNA, 25 bp, Mus musculus
ttgacagaaattagccaacgggctt

SEQ ID NO: 946896 - DNA, 25 bp, Mus musculus
ttgacagaaatttgccaacgggctt

SEQ ID NO: 946897 - DNA, 25 bp, Mus musculus
ttgacagaatggcaaaggaagcatt

SEQ ID NO: 946898 - DNA, 25 bp, Mus musculus
ttgacagaatgggaaaggaagcatt

SEQ ID NO: 946899 - DNA, 25 bp, Mus musculus
ttgacagaccctaataagccctttc

SEQ ID NO: 946900 - DNA, 25 bp, Mus musculus
ttgacagacccttataagccctttc

SEQ ID NO: 946901 - DNA, 25 bp, Mus musculus
ttgacagactgcaggcccagtgtag

SEQ ID NO: 946902 - DNA, 25 bp, Mus musculus
ttgacagactgctggcccagtgtag

SEQ ID NO: 946903 - DNA, 25 bp, Mus musculus
ttgacagagaacagaggcgactgca

SEQ ID NO: 946904 - DNA, 25 bp, Mus musculus
ttgacagagaactgaggcgactgca

SEQ ID NO: 946905 - DNA, 25 bp, Mus musculus
ttgacagagaggcacaacgctggtt

SEQ ID NO: 946906 - DNA, 25 bp, Mus musculus
ttgacagagagggacaacgctggtt

SEQ ID NO: 946907 - DNA, 25 bp, Mus musculus
ttgacagagccgcaattatttagaa

SEQ ID NO: 946908 - DNA, 25 bp, Mus musculus
ttgacagagccggaattatttagaa

SEQ ID NO: 946909 - DNA, 25 bp, Mus musculus
ttgacagagtcaagtggcccagtat

SEQ ID NO: 946910 - DNA, 25 bp, Mus musculus
ttgacagagtcatgtggcccagtat

SEQ ID NO: 946911 - DNA, 25 bp, Mus musculus
ttgacagatagtcgtggcacacatc

SEQ ID NO: 946912 - DNA, 25 bp, Mus musculus
ttgacagatagtggtggcacacatc

SEQ ID NO: 946913 - DNA, 25 bp, Mus musculus
ttgacagcaagaacctttccctggg

SEQ ID NO: 946914 - DNA, 25 bp, Mus musculus
ttgacagcaagatcctttccctggg

SEQ ID NO: 946915 - DNA, 25 bp, Mus musculus
ttgacagccaagaccattcagcctt

SEQ ID NO: 946916 - DNA, 25 bp, Mus musculus
ttgacagccaagtccattcagcctt

SEQ ID NO: 946917 - DNA, 25 bp, Mus musculus
ttgacagccagcatctcgctggcag

SEQ ID NO: 946918 - DNA, 25 bp, Mus musculus
ttgacagccagcttctcgctggcag

SEQ ID NO: 946919 - DNA, 25 bp, Mus musculus
ttgacagccatgcaaacacgccctt

SEQ ID NO: 946920 - DNA, 25 bp, Mus musculus
ttgacagccatggaaacacgccctt

SEQ ID NO: 946921 - DNA, 25 bp, Mus musculus
ttgacagcccagaacgcctaaagac

SEQ ID NO: 946922 - DNA, 25 bp, Mus musculus
ttgacagcccagtacgcctaaagac

SEQ ID NO: 946923 - DNA, 25 bp, Mus musculus
ttgacagcctacagaaggacctgga

SEQ ID NO: 946924 - DNA, 25 bp, Mus musculus
ttgacagcctactgaaggacctgga

SEQ ID NO: 946925 - DNA, 25 bp, Mus musculus
ttgacagcctcacatgagtcaccgt

SEQ ID NO: 946926 - DNA, 25 bp, Mus musculus
ttgacagcctcagatgagtcaccgt

SEQ ID NO: 946927 - DNA, 25 bp, Mus musculus
ttgacagccttcctttagcttgact

SEQ ID NO: 946928 - DNA, 25 bp, Mus musculus
ttgacagccttcgtttagcttgact

SEQ ID NO: 946929 - DNA, 25 bp, Mus musculus
ttgacagctgtcacagaggcgacat

SEQ ID NO: 946930 - DNA, 25 bp, Mus musculus
ttgacagctgtctcagaggcgacat

SEQ ID NO: 946931 - DNA, 25 bp, Mus musculus
ttgacagcttcaagacttaagagta

SEQ ID NO: 946932 - DNA, 25 bp, Mus musculus
ttgacagcttcatgacttaagagta

SEQ ID NO: 946933 - DNA, 25 bp, Mus musculus
ttgacagcttgcattctctgcctag

SEQ ID NO: 946934 - DNA, 25 bp, Mus musculus
ttgacagcttgctttctctgcctag

SEQ ID NO: 946935 - DNA, 25 bp, Mus musculus
ttgacagctttaattagggaggcat

SEQ ID NO: 946936 - DNA, 25 bp, Mus musculus
ttgacagctttatttagggaggcat

SEQ ID NO: 946937 - DNA, 25 bp, Mus musculus
ttgacaggaccacgagcggctcttt

SEQ ID NO: 946938 - DNA, 25 bp, Mus musculus
ttgacaggaccaggagcggctcttt

SEQ ID NO: 946939 - DNA, 25 bp, Mus musculus
ttgacaggatcgctggaggccatca

SEQ ID NO: 946940 - DNA, 25 bp, Mus musculus
ttgacaggatcggtggaggccatca

SEQ ID NO: 946941 - DNA, 25 bp, Mus musculus
ttgacaggcatcctcacagcaggat

SEQ ID NO: 946942 - DNA, 25 bp, Mus musculus
ttgacaggcatcgtcacagcaggat

SEQ ID NO: 946943 - DNA, 25 bp, Mus musculus
ttgacaggcttgcatggttcacccc

SEQ ID NO: 946944 - DNA, 25 bp, Mus musculus
ttgacaggcttggatggttcacccc

SEQ ID NO: 946945 - DNA, 25 bp, Mus musculus
ttgacagggataacccttgcacatt

SEQ ID NO: 946946 - DNA, 25 bp, Mus musculus
ttgacagggatatcccttgcacatt

SEQ ID NO: 946947 - DNA, 25 bp, Mus musculus
ttgacagggtttcacacagtccatc

SEQ ID NO: 946948 - DNA, 25 bp, Mus musculus
ttgacagggtttgacacagtccatc

SEQ ID NO: 946949 - DNA, 25 bp, Mus musculus
ttgacaggtagtcatcggattccca

SEQ ID NO: 946950 - DNA, 25 bp, Mus musculus
ttgacaggtagtgatcggattccca

SEQ ID NO: 946951 - DNA, 25 bp, Mus musculus
ttgacaggtcctcagattcctcggc

SEQ ID NO: 946952 - DNA, 25 bp, Mus musculus
ttgacaggtcctgagattcctcggc

SEQ ID NO: 946953 - DNA, 25 bp, Mus musculus
ttgacagtaaccctcttcacttctg

SEQ ID NO: 946954 - DNA, 25 bp, Mus musculus
ttgacagtaaccgtcttcacttctg

SEQ ID NO: 946955 - DNA, 25 bp, Mus musculus
ttgacagtaatgaccgagagcgggt

SEQ ID NO: 946956 - DNA, 25 bp, Mus musculus
ttgacagtaatgtccgagagcgggt

SEQ ID NO: 946957 - DNA, 25 bp, Mus musculus
ttgacagtaccaccaacagacattg

SEQ ID NO: 946958 - DNA, 25 bp, Mus musculus
ttgacagtaccagcaacagacattg

SEQ ID NO: 946959 - DNA, 25 bp, Mus musculus
ttgacagtagagctctggcctaccc

SEQ ID NO: 946960 - DNA, 25 bp, Mus musculus
ttgacagtagaggtctggcctaccc

SEQ ID NO: 946961 - DNA, 25 bp, Mus musculus
ttgacagtagcacagaccagacata

SEQ ID NO: 946962 - DNA, 25 bp, Mus musculus
ttgacagtagcagagaccagacata

SEQ ID NO: 946963 - DNA, 25 bp, Mus musculus
ttgacagtcagtccatgggcgccat

SEQ ID NO: 946964 - DNA, 25 bp, Mus musculus
ttgacagtcagtgcatgggcgccat

SEQ ID NO: 946965 - DNA, 25 bp, Mus musculus
ttgacagtccctaaatgtaattcag

SEQ ID NO: 946966 - DNA, 25 bp, Mus musculus
ttgacagtcccttaatgtaattcag

SEQ ID NO: 946967 - DNA, 25 bp, Mus musculus
ttgacagtcgtgagcatatgaccac

SEQ ID NO: 946968 - DNA, 25 bp, Mus musculus
ttgacagtcgtgtgcatatgaccac

SEQ ID NO: 946969 - DNA, 25 bp, Mus musculus
ttgacagtctgtactatccatcaca

SEQ ID NO: 946970 - DNA, 25 bp, Mus musculus
ttgacagtctgtcaacctggcactt

SEQ ID NO: 946971 - DNA, 25 bp, Mus musculus
ttgacagtctgtgaacctggcactt

SEQ ID NO: 946972 - DNA, 25 bp, Mus musculus
ttgacagtctgttctatccatcaca

SEQ ID NO: 946973 - DNA, 25 bp, Mus musculus
ttgacagtgggtatctctttgccct

SEQ ID NO: 946974 - DNA, 25 bp, Mus musculus
ttgacagtgggtttctctttgccct

SEQ ID NO: 946975 - DNA, 25 bp, Mus musculus
ttgacagtggtcaaatcccttttga

SEQ ID NO: 946976 - DNA, 25 bp, Mus musculus
ttgacagtggtctaatcccttttga

SEQ ID NO: 946977 - DNA, 25 bp, Mus musculus
ttgacagttcaacgctttgcagaca

SEQ ID NO: 946978 - DNA, 25 bp, Mus musculus
ttgacagttcaaggctttgcagaca

SEQ ID NO: 946979 - DNA, 25 bp, Mus musculus
ttgacagttgcaagctctgaactct

SEQ ID NO: 946980 - DNA, 25 bp, Mus musculus
ttgacagttgcatgctctgaactct

SEQ ID NO: 946981 - DNA, 25 bp, Mus musculus
ttgacagttgttctcagacttcctg

SEQ ID NO: 946982 - DNA, 25 bp, Mus musculus
ttgacagttgttgtcagacttcctg

SEQ ID NO: 946983 - DNA, 25 bp, Mus musculus
ttgacagtttgtagggctggtagcc

SEQ ID NO: 946984 - DNA, 25 bp, Mus musculus
ttgacagtttgttgggctggtagcc

SEQ ID NO: 946985 - DNA, 25 bp, Mus musculus
ttgacataatcaaccagcctcatgc

SEQ ID NO: 946986 - DNA, 25 bp, Mus musculus
ttgacataatcatccagcctcatgc

SEQ ID NO: 946987 - DNA, 25 bp, Mus musculus
ttgacatagaacataagaacccatt

SEQ ID NO: 946988 - DNA, 25 bp, Mus musculus
ttgacatagaacttaagaacccatt

SEQ ID NO: 946989 - DNA, 25 bp, Mus musculus
ttgacatagagcagcttctgtgtaa

SEQ ID NO: 946990 - DNA, 25 bp, Mus musculus
ttgacatagagctgcttctgtgtaa

SEQ ID NO: 946991 - DNA, 25 bp, Mus musculus
ttgacatagaggccccatctgtctg

SEQ ID NO: 946992 - DNA, 25 bp, Mus musculus
ttgacatagagggcccatctgtctg

SEQ ID NO: 946993 - DNA, 25 bp, Mus musculus
ttgacatatactatacgtgcccgaa

SEQ ID NO: 946994 - DNA, 25 bp, Mus musculus
ttgacatatactatgcccaaacagt

SEQ ID NO: 946995 - DNA, 25 bp, Mus musculus
ttgacatatactttacgtgcccgaa

SEQ ID NO: 946996 - DNA, 25 bp, Mus musculus
ttgacatatactttgcccaaacagt

SEQ ID NO: 946997 - DNA, 25 bp, Mus musculus
ttgacatatggtatcgactgactga

SEQ ID NO: 946998 - DNA, 25 bp, Mus musculus
ttgacatatggtttcgactgactga

SEQ ID NO: 946999 - DNA, 25 bp, Mus musculus
ttgacatcatccctactatgactac

SEQ ID NO: 947000 - DNA, 25 bp, Mus musculus
ttgacatcatccgtactatgactac

SEQ ID NO: 947001 - DNA, 25 bp, Mus musculus
ttgacatcatctaatccctgctcag

SEQ ID NO: 947002 - DNA, 25 bp, Mus musculus
ttgacatcatcttatccctgctcag

SEQ ID NO: 947003 - DNA, 25 bp, Mus musculus
ttgacatccattccgttctctttga

SEQ ID NO: 947004 - DNA, 25 bp, Mus musculus
ttgacatccattgcgttctctttga

SEQ ID NO: 947005 - DNA, 25 bp, Mus musculus
ttgacatcccttcctggaaacagca

SEQ ID NO: 947006 - DNA, 25 bp, Mus musculus
ttgacatcccttgctggaaacagca

SEQ ID NO: 947007 - DNA, 25 bp, Mus musculus
ttgacatcctagagcatctgacaag

SEQ ID NO: 947008 - DNA, 25 bp, Mus musculus
ttgacatcctagtgcatctgacaag

SEQ ID NO: 947009 - DNA, 25 bp, Mus musculus
ttgacatcctgcaggataccatcag

SEQ ID NO: 947010 - DNA, 25 bp, Mus musculus
ttgacatcctgctggataccatcag

SEQ ID NO: 947011 - DNA, 25 bp, Mus musculus
ttgacatccttaccacagagctttg

SEQ ID NO: 947012 - DNA, 25 bp, Mus musculus
ttgacatccttagcacagagctttg

SEQ ID NO: 947013 - DNA, 25 bp, Mus musculus
ttgacatcgaccctttactgtacag

SEQ ID NO: 947014 - DNA, 25 bp, Mus musculus
ttgacatcgaccgtttactgtacag

SEQ ID NO: 947015 - DNA, 25 bp, Mus musculus
ttgacatcgccacctcagagaaaac

SEQ ID NO: 947016 - DNA, 25 bp, Mus musculus
ttgacatcgccagctcagagaaaac

SEQ ID NO: 947017 - DNA, 25 bp, Mus musculus
ttgacatctaggcacacacccagtc

SEQ ID NO: 947018 - DNA, 25 bp, Mus musculus
ttgacatctagggacacacccagtc

SEQ ID NO: 947019 - DNA, 25 bp, Mus musculus
ttgacatgctggcacagcagctctc

SEQ ID NO: 947020 - DNA, 25 bp, Mus musculus
ttgacatgctgggacagcagctctc

SEQ ID NO: 947021 - DNA, 25 bp, Mus musculus
ttgacatgggacacagttaaacctg

SEQ ID NO: 947022 - DNA, 25 bp, Mus musculus
ttgacatgggactcagttaaacctg

SEQ ID NO: 947023 - DNA, 25 bp, Mus musculus
ttgacatgggtccttgagcacagga

SEQ ID NO: 947024 - DNA, 25 bp, Mus musculus
ttgacatgggtcgttgagcacagga

SEQ ID NO: 947025 - DNA, 25 bp, Mus musculus
ttgacattaatcagccatctcttct

SEQ ID NO: 947026 - DNA, 25 bp, Mus musculus
ttgacattaatctgccatctcttct

SEQ ID NO: 947027 - DNA, 25 bp, Mus musculus
ttgacattacctaggaaagttccat

SEQ ID NO: 947028 - DNA, 25 bp, Mus musculus
ttgacattaccttggaaagttccat

SEQ ID NO: 947029 - DNA, 25 bp, Mus musculus
ttgacattagggaggtgcccgatga

SEQ ID NO: 947030 - DNA, 25 bp, Mus musculus
ttgacattagggtggtgcccgatga

SEQ ID NO: 947031 - DNA, 25 bp, Mus musculus
ttgacattccatctagccgtagaca

SEQ ID NO: 947032 - DNA, 25 bp, Mus musculus
ttgacattccatgtagccgtagaca

SEQ ID NO: 947033 - DNA, 25 bp, Mus musculus
ttgacattccctactctatcagatg

SEQ ID NO: 947034 - DNA, 25 bp, Mus musculus
ttgacattcccttctctatcagatg

SEQ ID NO: 947035 - DNA, 25 bp, Mus musculus
ttgacattgatgcatttgaccctaa

SEQ ID NO: 947036 - DNA, 25 bp, Mus musculus
ttgacattgatggatttgaccctaa

SEQ ID NO: 947037 - DNA, 25 bp, Mus musculus
ttgacattgcacctctggacattgg

SEQ ID NO: 947038 - DNA, 25 bp, Mus musculus
ttgacattgcacgtctggacattgg

SEQ ID NO: 947039 - DNA, 25 bp, Mus musculus
ttgacattgctaacatgctcggctt

SEQ ID NO: 947040 - DNA, 25 bp, Mus musculus
ttgacattgctatcatgctcggctt

SEQ ID NO: 947041 - DNA, 25 bp, Mus musculus
ttgacattggtacttcctgagtgct

SEQ ID NO: 947042 - DNA, 25 bp, Mus musculus
ttgacattggtagttcctgagtgct

SEQ ID NO: 947043 - DNA, 25 bp, Mus musculus
ttgacattggtcagtctgtgcctgc

SEQ ID NO: 947044 - DNA, 25 bp, Mus musculus
ttgacattggtctgtctgtgcctgc

SEQ ID NO: 947045 - DNA, 25 bp, Mus musculus
ttgacattgtgtatccaggtctttg

SEQ ID NO: 947046 - DNA, 25 bp, Mus musculus
ttgacattgtgtttccaggtctttg

SEQ ID NO: 947047 - DNA, 25 bp, Mus musculus
ttgacatttcacaaacaccctattt

SEQ ID NO: 947048 - DNA, 25 bp, Mus musculus
ttgacatttcactaacaccctattt

SEQ ID NO: 947049 - DNA, 25 bp, Mus musculus
ttgaccaaactcagctgaacaagga

SEQ ID NO: 947050 - DNA, 25 bp, Mus musculus
ttgaccaaactccacacacgggcgg

SEQ ID NO: 947051 - DNA, 25 bp, Mus musculus
ttgaccaaactcgacacacgggcgg

SEQ ID NO: 947052 - DNA, 25 bp, Mus musculus
ttgaccaaactctgctgaacaagga

SEQ ID NO: 947053 - DNA, 25 bp, Mus musculus
ttgaccaaaggacaaccctgcctct

SEQ ID NO: 947054 - DNA, 25 bp, Mus musculus
ttgaccaaaggagaaccctgcctct

SEQ ID NO: 947055 - DNA, 25 bp, Mus musculus
ttgaccaagagccaaccctgaaggg

SEQ ID NO: 947056 - DNA, 25 bp, Mus musculus
ttgaccaagagcgaaccctgaaggg

SEQ ID NO: 947057 - DNA, 25 bp, Mus musculus
ttgaccaagccgcactagacacaat

SEQ ID NO: 947058 - DNA, 25 bp, Mus musculus
ttgaccaagccggactagacacaat

SEQ ID NO: 947059 - DNA, 25 bp, Mus musculus
ttgaccaagcttagctgacctctag

SEQ ID NO: 947060 - DNA, 25 bp, Mus musculus
ttgaccaagctttgctgacctctag

SEQ ID NO: 947061 - DNA, 25 bp, Mus musculus
ttgaccaatcatctaacagccacat

SEQ ID NO: 947062 - DNA, 25 bp, Mus musculus
ttgaccaatcatgtaacagccacat

SEQ ID NO: 947063 - DNA, 25 bp, Mus musculus
ttgaccaccatccagctgggctcag

SEQ ID NO: 947064 - DNA, 25 bp, Mus musculus
ttgaccaccatcgagctgggctcag

SEQ ID NO: 947065 - DNA, 25 bp, Mus musculus
ttgaccacctgtatgtcatctatct

SEQ ID NO: 947066 - DNA, 25 bp, Mus musculus
ttgaccacctgtttgtcatctatct

SEQ ID NO: 947067 - DNA, 25 bp, Mus musculus
ttgaccactcatcgaagcaggacca

SEQ ID NO: 947068 - DNA, 25 bp, Mus musculus
ttgaccactcatggaagcaggacca

SEQ ID NO: 947069 - DNA, 25 bp, Mus musculus
ttgaccactgtcacatcttaactaa

SEQ ID NO: 947070 - DNA, 25 bp, Mus musculus
ttgaccactgtctcatcttaactaa

SEQ ID NO: 947071 - DNA, 25 bp, Mus musculus
ttgaccactgttacaagtctccatt

SEQ ID NO: 947072 - DNA, 25 bp, Mus musculus
ttgaccactgtttcaagtctccatt

SEQ ID NO: 947073 - DNA, 25 bp, Mus musculus
ttgaccagaatgattcccacaaaaa

SEQ ID NO: 947074 - DNA, 25 bp, Mus musculus
ttgaccagaatgtttcccacaaaaa

SEQ ID NO: 947075 - DNA, 25 bp, Mus musculus
ttgaccagacaccgtagaggactcg

SEQ ID NO: 947076 - DNA, 25 bp, Mus musculus
ttgaccagacacggtagaggactcg

SEQ ID NO: 947077 - DNA, 25 bp, Mus musculus
ttgaccagacataccgatctgtgct

SEQ ID NO: 947078 - DNA, 25 bp, Mus musculus
ttgaccagacattccgatctgtgct

SEQ ID NO: 947079 - DNA, 25 bp, Mus musculus
ttgaccagactgcaaggactgctct

SEQ ID NO: 947080 - DNA, 25 bp, Mus musculus
ttgaccagactggaaggactgctct

SEQ ID NO: 947081 - DNA, 25 bp, Mus musculus
ttgaccagcgatcaactttctgaga

SEQ ID NO: 947082 - DNA, 25 bp, Mus musculus
ttgaccagcgatgaactttctgaga

SEQ ID NO: 947083 - DNA, 25 bp, Mus musculus
ttgaccagcgtaaacacttgttcct

SEQ ID NO: 947084 - DNA, 25 bp, Mus musculus
ttgaccagcgtatacacttgttcct

SEQ ID NO: 947085 - DNA, 25 bp, Mus musculus
ttgaccagctccaccaggataagat

SEQ ID NO: 947086 - DNA, 25 bp, Mus musculus
ttgaccagctcctccaggataagat

SEQ ID NO: 947087 - DNA, 25 bp, Mus musculus
ttgaccagctttccctagtggtgaa

SEQ ID NO: 947088 - DNA, 25 bp, Mus musculus
ttgaccagctttgcctagtggtgaa

SEQ ID NO: 947089 - DNA, 25 bp, Mus musculus
ttgaccaggagccacgtgcagaccc

SEQ ID NO: 947090 - DNA, 25 bp, Mus musculus
ttgaccaggagcgacgtgcagaccc

SEQ ID NO: 947091 - DNA, 25 bp, Mus musculus
ttgaccagggcaacagcttaaaaat

SEQ ID NO: 947092 - DNA, 25 bp, Mus musculus
ttgaccagggcatcagcttaaaaat

SEQ ID NO: 947093 - DNA, 25 bp, Mus musculus
ttgaccagtctgacagcccaaagga

SEQ ID NO: 947094 - DNA, 25 bp, Mus musculus
ttgaccagtctgtcagcccaaagga

SEQ ID NO: 947095 - DNA, 25 bp, Mus musculus
ttgaccagttcacgcagctcatcag

SEQ ID NO: 947096 - DNA, 25 bp, Mus musculus
ttgaccagttcaggcagctcatcag

SEQ ID NO: 947097 - DNA, 25 bp, Mus musculus
ttgaccagttctctcgaagactttc

SEQ ID NO: 947098 - DNA, 25 bp, Mus musculus
ttgaccagttctgtcgaagactttc

SEQ ID NO: 947099 - DNA, 25 bp, Mus musculus
ttgaccataacgaatctgctctcca

SEQ ID NO: 947100 - DNA, 25 bp, Mus musculus
ttgaccataacgtatctgctctcca

SEQ ID NO: 947101 - DNA, 25 bp, Mus musculus
ttgaccatcttcagcccagataaac

SEQ ID NO: 947102 - DNA, 25 bp, Mus musculus
ttgaccatcttctgcccagataaac

SEQ ID NO: 947103 - DNA, 25 bp, Mus musculus
ttgaccatgcttatgctagctgctc

SEQ ID NO: 947104 - DNA, 25 bp, Mus musculus
ttgaccatgcttttgctagctgctc

SEQ ID NO: 947105 - DNA, 25 bp, Mus musculus
ttgaccatggacattgtgtgtgccc

SEQ ID NO: 947106 - DNA, 25 bp, Mus musculus
ttgaccatggactttgtgtgtgccc

SEQ ID NO: 947107 - DNA, 25 bp, Mus musculus
ttgaccatgggcagctccgagagcg

SEQ ID NO: 947108 - DNA, 25 bp, Mus musculus
ttgaccatgggctgctccgagagcg

SEQ ID NO: 947109 - DNA, 25 bp, Mus musculus
ttgaccatggtgatgattgtgacgt

SEQ ID NO: 947110 - DNA, 25 bp, Mus musculus
ttgaccatggtgttgattgtgacgt

SEQ ID NO: 947111 - DNA, 25 bp, Mus musculus
ttgaccatgtttactatgctccctt

SEQ ID NO: 947112 - DNA, 25 bp, Mus musculus
ttgaccatgttttctatgctccctt

SEQ ID NO: 947113 - DNA, 25 bp, Mus musculus
ttgaccattttcatgtgccctccct

SEQ ID NO: 947114 - DNA, 25 bp, Mus musculus
ttgaccattttcttgtgccctccct

SEQ ID NO: 947115 - DNA, 25 bp, Mus musculus
ttgacccaattcctggtgacttgag

SEQ ID NO: 947116 - DNA, 25 bp, Mus musculus
ttgacccaattcgtggtgacttgag

SEQ ID NO: 947117 - DNA, 25 bp, Mus musculus
ttgacccacacacaggatcctgtga

SEQ ID NO: 947118 - DNA, 25 bp, Mus musculus
ttgacccacacagaggatcctgtga

SEQ ID NO: 947119 - DNA, 25 bp, Mus musculus
ttgacccacagtaccactagttgac

SEQ ID NO: 947120 - DNA, 25 bp, Mus musculus
ttgacccacagttccactagttgac

SEQ ID NO: 947121 - DNA, 25 bp, Mus musculus
ttgacccacccaatgtggctagata

SEQ ID NO: 947122 - DNA, 25 bp, Mus musculus
ttgacccacccattgtggctagata

SEQ ID NO: 947123 - DNA, 25 bp, Mus musculus
ttgacccaccctcgtagattagcca

SEQ ID NO: 947124 - DNA, 25 bp, Mus musculus
ttgacccaccctggtagattagcca

SEQ ID NO: 947125 - DNA, 25 bp, Mus musculus
ttgacccaccggccatatgcatatc

SEQ ID NO: 947126 - DNA, 25 bp, Mus musculus
ttgacccaccgggcatatgcatatc

SEQ ID NO: 947127 - DNA, 25 bp, Mus musculus
ttgacccagacccagaacagctgag

SEQ ID NO: 947128 - DNA, 25 bp, Mus musculus
ttgacccagaccgagaacagctgag

SEQ ID NO: 947129 - DNA, 25 bp, Mus musculus
ttgacccagtgacctgcgacctgct

SEQ ID NO: 947130 - DNA, 25 bp, Mus musculus
ttgacccagtgagctgcgacctgct

SEQ ID NO: 947131 - DNA, 25 bp, Mus musculus
ttgacccatcacaactgctgaacga

SEQ ID NO: 947132 - DNA, 25 bp, Mus musculus
ttgacccatcactactgctgaacga

SEQ ID NO: 947133 - DNA, 25 bp, Mus musculus
ttgacccatgtgcaagtctctctgg

SEQ ID NO: 947134 - DNA, 25 bp, Mus musculus
ttgacccatgtggaagtctctctgg

SEQ ID NO: 947135 - DNA, 25 bp, Mus musculus
ttgaccccaaatccaagtcactgac

SEQ ID NO: 947136 - DNA, 25 bp, Mus musculus
ttgaccccaaatgcaagtcactgac

SEQ ID NO: 947137 - DNA, 25 bp, Mus musculus
ttgaccccagaactccagatgcccc

SEQ ID NO: 947138 - DNA, 25 bp, Mus musculus
ttgaccccagaagtccagatgcccc

SEQ ID NO: 947139 - DNA, 25 bp, Mus musculus
ttgaccccagggaaccttggcctga

SEQ ID NO: 947140 - DNA, 25 bp, Mus musculus
ttgaccccagggtaccttggcctga

SEQ ID NO: 947141 - DNA, 25 bp, Mus musculus
ttgaccccaggtcttaagtctgttg

SEQ ID NO: 947142 - DNA, 25 bp, Mus musculus
ttgaccccaggtgttaagtctgttg

SEQ ID NO: 947143 - DNA, 25 bp, Mus musculus
ttgacccctacccagaagtgatgac

SEQ ID NO: 947144 - DNA, 25 bp, Mus musculus
ttgacccctaccgagaagtgatgac

SEQ ID NO: 947145 - DNA, 25 bp, Mus musculus
ttgacccctccaactgcttatttat

SEQ ID NO: 947146 - DNA, 25 bp, Mus musculus
ttgacccctccacggcaaaggatac

SEQ ID NO: 947147 - DNA, 25 bp, Mus musculus
ttgacccctccagggcaaaggatac

SEQ ID NO: 947148 - DNA, 25 bp, Mus musculus
ttgacccctccatctgcttatttat

SEQ ID NO: 947149 - DNA, 25 bp, Mus musculus
ttgacccctctcacatcttgctgtt

SEQ ID NO: 947150 - DNA, 25 bp, Mus musculus
ttgacccctctctcatcttgctgtt

SEQ ID NO: 947151 - DNA, 25 bp, Mus musculus
ttgacccctgctccggatatggcaa

SEQ ID NO: 947152 - DNA, 25 bp, Mus musculus
ttgacccctgctgcggatatggcaa

SEQ ID NO: 947153 - DNA, 25 bp, Mus musculus
ttgaccccttgccaccaaaggaaat

SEQ ID NO: 947154 - DNA, 25 bp, Mus musculus
ttgaccccttgcgaccaaaggaaat

SEQ ID NO: 947155 - DNA, 25 bp, Mus musculus
ttgacccgagcccagttgataacag

SEQ ID NO: 947156 - DNA, 25 bp, Mus musculus
ttgacccgagccgagttgataacag

SEQ ID NO: 947157 - DNA, 25 bp, Mus musculus
ttgacccgcagtcgtttactcacct

SEQ ID NO: 947158 - DNA, 25 bp, Mus musculus
ttgacccgcagtggtttactcacct

SEQ ID NO: 947159 - DNA, 25 bp, Mus musculus
ttgacccggaagaggtatcacaccc

SEQ ID NO: 947160 - DNA, 25 bp, Mus musculus
ttgacccggaagtggtatcacaccc

SEQ ID NO: 947161 - DNA, 25 bp, Mus musculus
ttgacccgtttgaccatatcccgtg

SEQ ID NO: 947162 - DNA, 25 bp, Mus musculus
ttgacccgtttgtccatatcccgtg

SEQ ID NO: 947163 - DNA, 25 bp, Mus musculus
ttgaccctacaacagaactacatga

SEQ ID NO: 947164 - DNA, 25 bp, Mus musculus
ttgaccctacaagagaactacatga

SEQ ID NO: 947165 - DNA, 25 bp, Mus musculus
ttgaccctacggagcctatggaggt

SEQ ID NO: 947166 - DNA, 25 bp, Mus musculus
ttgaccctacggtgcctatggaggt

SEQ ID NO: 947167 - DNA, 25 bp, Mus musculus
ttgaccctagcacccatcgagtgca

SEQ ID NO: 947168 - DNA, 25 bp, Mus musculus
ttgaccctagcagccatcgagtgca

SEQ ID NO: 947169 - DNA, 25 bp, Mus musculus
ttgaccctagggagaccttacgcct

SEQ ID NO: 947170 - DNA, 25 bp, Mus musculus
ttgaccctagggtgaccttacgcct

SEQ ID NO: 947171 - DNA, 25 bp, Mus musculus
ttgaccctatcaaatgtctctcctt

SEQ ID NO: 947172 - DNA, 25 bp, Mus musculus
ttgaccctatcatatgtctctcctt

SEQ ID NO: 947173 - DNA, 25 bp, Mus musculus
ttgaccctatttcgctttacatttt

SEQ ID NO: 947174 - DNA, 25 bp, Mus musculus
ttgaccctatttggctttacatttt

SEQ ID NO: 947175 - DNA, 25 bp, Mus musculus
ttgaccctcggtagtaattttctgt

SEQ ID NO: 947176 - DNA, 25 bp, Mus musculus
ttgaccctcggttgtaattttctgt

SEQ ID NO: 947177 - DNA, 25 bp, Mus musculus
ttgaccctcgtaacagccatgaaat

SEQ ID NO: 947178 - DNA, 25 bp, Mus musculus
ttgaccctcgtatcagccatgaaat

SEQ ID NO: 947179 - DNA, 25 bp, Mus musculus
ttgaccctctacagtggatccagaa

SEQ ID NO: 947180 - DNA, 25 bp, Mus musculus
ttgaccctctactgtggatccagaa

SEQ ID NO: 947181 - DNA, 25 bp, Mus musculus
ttgaccctgcagagctcctgaaatg

SEQ ID NO: 947182 - DNA, 25 bp, Mus musculus
ttgaccctgcagtgctcctgaaatg

SEQ ID NO: 947183 - DNA, 25 bp, Mus musculus
ttgaccctgtccaaacaacattctt

SEQ ID NO: 947184 - DNA, 25 bp, Mus musculus
ttgaccctgtcctaacaacattctt

SEQ ID NO: 947185 - DNA, 25 bp, Mus musculus
ttgacccttccaaggctttttgtca

SEQ ID NO: 947186 - DNA, 25 bp, Mus musculus
ttgacccttccatggctttttgtca

SEQ ID NO: 947187 - DNA, 25 bp, Mus musculus
ttgacccttgaaaacagtttctcac

SEQ ID NO: 947188 - DNA, 25 bp, Mus musculus
ttgacccttgaatacagtttctcac

SEQ ID NO: 947189 - DNA, 25 bp, Mus musculus
ttgacccttgcactccttgggacag

SEQ ID NO: 947190 - DNA, 25 bp, Mus musculus
ttgacccttgcagtccttgggacag

SEQ ID NO: 947191 - DNA, 25 bp, Mus musculus
ttgacccttgtcatggttcctccaa

SEQ ID NO: 947192 - DNA, 25 bp, Mus musculus
ttgacccttgtcttggttcctccaa

SEQ ID NO: 947193 - DNA, 25 bp, Mus musculus
ttgaccctttccaggcacattgtgt

SEQ ID NO: 947194 - DNA, 25 bp, Mus musculus
ttgaccctttcctggcacattgtgt

SEQ ID NO: 947195 - DNA, 25 bp, Mus musculus
ttgaccctttgtcggtaggtctgat

SEQ ID NO: 947196 - DNA, 25 bp, Mus musculus
ttgaccctttgtgggtaggtctgat

SEQ ID NO: 947197 - DNA, 25 bp, Mus musculus
ttgaccctttttactggcaacccag

SEQ ID NO: 947198 - DNA, 25 bp, Mus musculus
ttgacccttttttctggcaacccag

SEQ ID NO: 947199 - DNA, 25 bp, Mus musculus
ttgaccgaaagccaacagccatctt

SEQ ID NO: 947200 - DNA, 25 bp, Mus musculus
ttgaccgaaagcgaacagccatctt

SEQ ID NO: 947201 - DNA, 25 bp, Mus musculus
ttgaccgacaggagagtagccgcca

SEQ ID NO: 947202 - DNA, 25 bp, Mus musculus
ttgaccgacaggtgagtagccgcca

SEQ ID NO: 947203 - DNA, 25 bp, Mus musculus
ttgaccgacgacaagaggatatcct

SEQ ID NO: 947204 - DNA, 25 bp, Mus musculus
ttgaccgacgactagaggatatcct

SEQ ID NO: 947205 - DNA, 25 bp, Mus musculus
ttgaccgagcaaccatgcacgttat

SEQ ID NO: 947206 - DNA, 25 bp, Mus musculus
ttgaccgagcaagcatgcacgttat

SEQ ID NO: 947207 - DNA, 25 bp, Mus musculus
ttgaccgctccaaggacaagtgaag

SEQ ID NO: 947208 - DNA, 25 bp, Mus musculus
ttgaccgctccatggacaagtgaag

SEQ ID NO: 947209 - DNA, 25 bp, Mus musculus
ttgaccggagtgaggacttggccca

SEQ ID NO: 947210 - DNA, 25 bp, Mus musculus
ttgaccggagtgtggacttggccca

SEQ ID NO: 947211 - DNA, 25 bp, Mus musculus
ttgaccggccccatgaatgagaacc

SEQ ID NO: 947212 - DNA, 25 bp, Mus musculus
ttgaccggccccttgaatgagaacc

SEQ ID NO: 947213 - DNA, 25 bp, Mus musculus
ttgaccgggaaaaccatttcgggcg

SEQ ID NO: 947214 - DNA, 25 bp, Mus musculus
ttgaccgggaaatccatttcgggcg

SEQ ID NO: 947215 - DNA, 25 bp, Mus musculus
ttgaccgggagcagcagctagccaa

SEQ ID NO: 947216 - DNA, 25 bp, Mus musculus
ttgaccgggagctgcagctagccaa

SEQ ID NO: 947217 - DNA, 25 bp, Mus musculus
ttgaccgtactcatcatactttgct

SEQ ID NO: 947218 - DNA, 25 bp, Mus musculus
ttgaccgtactcttcatactttgct

SEQ ID NO: 947219 - DNA, 25 bp, Mus musculus
ttgaccgtatttataatctgcctgt

SEQ ID NO: 947220 - DNA, 25 bp, Mus musculus
ttgaccgtatttttaatctgcctgt

SEQ ID NO: 947221 - DNA, 25 bp, Mus musculus
ttgaccgtgatgaccccacaggtgg

SEQ ID NO: 947222 - DNA, 25 bp, Mus musculus
ttgaccgtgatgtccccacaggtgg

SEQ ID NO: 947223 - DNA, 25 bp, Mus musculus
ttgacctaacatagcagtgtgccaa

SEQ ID NO: 947224 - DNA, 25 bp, Mus musculus
ttgacctaacattgcagtgtgccaa

SEQ ID NO: 947225 - DNA, 25 bp, Mus musculus
ttgacctacatcatttctgcttctg

SEQ ID NO: 947226 - DNA, 25 bp, Mus musculus
ttgacctacatcttttctgcttctg

SEQ ID NO: 947227 - DNA, 25 bp, Mus musculus
ttgacctagcgtctaccagggctgg

SEQ ID NO: 947228 - DNA, 25 bp, Mus musculus
ttgacctagcgtgtaccagggctgg

SEQ ID NO: 947229 - DNA, 25 bp, Mus musculus
ttgacctagggaatgcagccacact

SEQ ID NO: 947230 - DNA, 25 bp, Mus musculus
ttgacctagggattgcagccacact

SEQ ID NO: 947231 - DNA, 25 bp, Mus musculus
ttgacctattcacagcaccttcatt

SEQ ID NO: 947232 - DNA, 25 bp, Mus musculus
ttgacctattcagagcaccttcatt

SEQ ID NO: 947233 - DNA, 25 bp, Mus musculus
ttgacctatttaccctttaccctga

SEQ ID NO: 947234 - DNA, 25 bp, Mus musculus
ttgacctatttagcctttaccctga

SEQ ID NO: 947235 - DNA, 25 bp, Mus musculus
ttgacctattttaagctcgtagcta

SEQ ID NO: 947236 - DNA, 25 bp, Mus musculus
ttgacctatttttagctcgtagcta

SEQ ID NO: 947237 - DNA, 25 bp, Mus musculus
ttgacctcacaacatctgctttcca

SEQ ID NO: 947238 - DNA, 25 bp, Mus musculus
ttgacctcacaagatctgctttcca

SEQ ID NO: 947239 - DNA, 25 bp, Mus musculus
ttgacctcagccatggcagtactca

SEQ ID NO: 947240 - DNA, 25 bp, Mus musculus
ttgacctcagccttggcagtactca

SEQ ID NO: 947241 - DNA, 25 bp, Mus musculus
ttgacctcaggtatagagttcgcac

SEQ ID NO: 947242 - DNA, 25 bp, Mus musculus
ttgacctcaggtttagagttcgcac

SEQ ID NO: 947243 - DNA, 25 bp, Mus musculus
ttgacctcagtgacgtggagctgga

SEQ ID NO: 947244 - DNA, 25 bp, Mus musculus
ttgacctcagtgtcgtggagctgga

SEQ ID NO: 947245 - DNA, 25 bp, Mus musculus
ttgacctcataccttgcacagaact

SEQ ID NO: 947246 - DNA, 25 bp, Mus musculus
ttgacctcatacgttgcacagaact

SEQ ID NO: 947247 - DNA, 25 bp, Mus musculus
ttgacctcccgtaacaacaaggctg

SEQ ID NO: 947248 - DNA, 25 bp, Mus musculus
ttgacctcccgttacaacaaggctg

SEQ ID NO: 947249 - DNA, 25 bp, Mus musculus
ttgacctccctgaaaaccaatcaga

SEQ ID NO: 947250 - DNA, 25 bp, Mus musculus
ttgacctccctgtaaaccaatcaga

SEQ ID NO: 947251 - DNA, 25 bp, Mus musculus
ttgacctccgacagtgctacaagaa

SEQ ID NO: 947252 - DNA, 25 bp, Mus musculus
ttgacctccgactgtgctacaagaa

SEQ ID NO: 947253 - DNA, 25 bp, Mus musculus
ttgacctccgccagacctttggacc

SEQ ID NO: 947254 - DNA, 25 bp, Mus musculus
ttgacctccgcctgacctttggacc

SEQ ID NO: 947255 - DNA, 25 bp, Mus musculus
ttgacctccggacaataatcacgat

SEQ ID NO: 947256 - DNA, 25 bp, Mus musculus
ttgacctccggagaataatcacgat

SEQ ID NO: 947257 - DNA, 25 bp, Mus musculus
ttgacctcctaacgctcaagcgatc

SEQ ID NO: 947258 - DNA, 25 bp, Mus musculus
ttgacctcctaaggctcaagcgatc

SEQ ID NO: 947259 - DNA, 25 bp, Mus musculus
ttgacctcctcaagaagattctggg

SEQ ID NO: 947260 - DNA, 25 bp, Mus musculus
ttgacctcctcatgaagattctggg

SEQ ID NO: 947261 - DNA, 25 bp, Mus musculus
ttgacctcctccagtcagaggataa

SEQ ID NO: 947262 - DNA, 25 bp, Mus musculus
ttgacctcctcctgtcagaggataa

SEQ ID NO: 947263 - DNA, 25 bp, Mus musculus
ttgacctctactcatcctgtcttca

SEQ ID NO: 947264 - DNA, 25 bp, Mus musculus
ttgacctctactgatcctgtcttca

SEQ ID NO: 947265 - DNA, 25 bp, Mus musculus
ttgacctctcacataaaaacacatt

SEQ ID NO: 947266 - DNA, 25 bp, Mus musculus
ttgacctctcacttaaaaacacatt

SEQ ID NO: 947267 - DNA, 25 bp, Mus musculus
ttgacctctgtcaatcccaggcaaa

SEQ ID NO: 947268 - DNA, 25 bp, Mus musculus
ttgacctctgtctatcccaggcaaa

SEQ ID NO: 947269 - DNA, 25 bp, Mus musculus
ttgacctcttttctatcactcctga

SEQ ID NO: 947270 - DNA, 25 bp, Mus musculus
ttgacctcttttgtatcactcctga

SEQ ID NO: 947271 - DNA, 25 bp, Mus musculus
ttgacctgccggctttaaagggaga

SEQ ID NO: 947272 - DNA, 25 bp, Mus musculus
ttgacctgccgggtttaaagggaga

SEQ ID NO: 947273 - DNA, 25 bp, Mus musculus
ttgacctgcgtcaactcaaggtaga

SEQ ID NO: 947274 - DNA, 25 bp, Mus musculus
ttgacctgcgtctactcaaggtaga

SEQ ID NO: 947275 - DNA, 25 bp, Mus musculus
ttgacctgcgttcccaggacaacga

SEQ ID NO: 947276 - DNA, 25 bp, Mus musculus
ttgacctgcgttgccaggacaacga

SEQ ID NO: 947277 - DNA, 25 bp, Mus musculus
ttgacctgctgacaatccttccttt

SEQ ID NO: 947278 - DNA, 25 bp, Mus musculus
ttgacctgctgagaatccttccttt

SEQ ID NO: 947279 - DNA, 25 bp, Mus musculus
ttgacctgctgcaccagaggctgtt

SEQ ID NO: 947280 - DNA, 25 bp, Mus musculus
ttgacctgctgctccagaggctgtt

SEQ ID NO: 947281 - DNA, 25 bp, Mus musculus
ttgacctggaaacccacagttcctt

SEQ ID NO: 947282 - DNA, 25 bp, Mus musculus
ttgacctggaaagccacagttcctt

SEQ ID NO: 947283 - DNA, 25 bp, Mus musculus
ttgacctggcttccttacctagggt

SEQ ID NO: 947284 - DNA, 25 bp, Mus musculus
ttgacctggcttgcttacctagggt

SEQ ID NO: 947285 - DNA, 25 bp, Mus musculus
ttgacctgggtcaagccatcctgtg

SEQ ID NO: 947286 - DNA, 25 bp, Mus musculus
ttgacctgggtctagccatcctgtg

SEQ ID NO: 947287 - DNA, 25 bp, Mus musculus
ttgacctgggtgctgttggtcccac

SEQ ID NO: 947288 - DNA, 25 bp, Mus musculus
ttgacctgggtggtgttggtcccac

SEQ ID NO: 947289 - DNA, 25 bp, Mus musculus
ttgacctggtgtaaggctgcttctg

SEQ ID NO: 947290 - DNA, 25 bp, Mus musculus
ttgacctggtgttaggctgcttctg

SEQ ID NO: 947291 - DNA, 25 bp, Mus musculus
ttgacctgtcaaccaagactttctt

SEQ ID NO: 947292 - DNA, 25 bp, Mus musculus
ttgacctgtcaagcaagactttctt

SEQ ID NO: 947293 - DNA, 25 bp, Mus musculus
ttgacctgtcttactatcgattgtt

SEQ ID NO: 947294 - DNA, 25 bp, Mus musculus
ttgacctgtctttctatcgattgtt

SEQ ID NO: 947295 - DNA, 25 bp, Mus musculus
ttgacctgtgtcagatagccttgaa

SEQ ID NO: 947296 - DNA, 25 bp, Mus musculus
ttgacctgtgtctgatagccttgaa

SEQ ID NO: 947297 - DNA, 25 bp, Mus musculus
ttgaccttagctattgcccagttct

SEQ ID NO: 947298 - DNA, 25 bp, Mus musculus
ttgaccttagcttttgcccagttct

SEQ ID NO: 947299 - DNA, 25 bp, Mus musculus
ttgaccttagtacggttttgaaatg

SEQ ID NO: 947300 - DNA, 25 bp, Mus musculus
ttgaccttagtagggttttgaaatg

SEQ ID NO: 947301 - DNA, 25 bp, Mus musculus
ttgaccttcactccctttctcaaat

SEQ ID NO: 947302 - DNA, 25 bp, Mus musculus
ttgaccttcactgcctttctcaaat

SEQ ID NO: 947303 - DNA, 25 bp, Mus musculus
ttgaccttcccaagggagctgtgca

SEQ ID NO: 947304 - DNA, 25 bp, Mus musculus
ttgaccttcccatgggagctgtgca

SEQ ID NO: 947305 - DNA, 25 bp, Mus musculus
ttgaccttccctagctttccttata

SEQ ID NO: 947306 - DNA, 25 bp, Mus musculus
ttgaccttcccttgctttccttata

SEQ ID NO: 947307 - DNA, 25 bp, Mus musculus
ttgaccttcgggaacctgaatagaa

SEQ ID NO: 947308 - DNA, 25 bp, Mus musculus
ttgaccttcgggtacctgaatagaa

SEQ ID NO: 947309 - DNA, 25 bp, Mus musculus
ttgaccttcgtgagcatggagtgac

SEQ ID NO: 947310 - DNA, 25 bp, Mus musculus
ttgaccttcgtgtgcatggagtgac

SEQ ID NO: 947311 - DNA, 25 bp, Mus musculus
ttgaccttctccagggatgcttcag

SEQ ID NO: 947312 - DNA, 25 bp, Mus musculus
ttgaccttctcctgggatgcttcag

SEQ ID NO: 947313 - DNA, 25 bp, Mus musculus
ttgaccttctgtctcatgcagggag

SEQ ID NO: 947314 - DNA, 25 bp, Mus musculus
ttgaccttctgtgtcatgcagggag

SEQ ID NO: 947315 - DNA, 25 bp, Mus musculus
ttgaccttgaagatactgacactgt

SEQ ID NO: 947316 - DNA, 25 bp, Mus musculus
ttgaccttgaagttactgacactgt

SEQ ID NO: 947317 - DNA, 25 bp, Mus musculus
ttgaccttgaatatgttggacttaa

SEQ ID NO: 947318 - DNA, 25 bp, Mus musculus
ttgaccttgaatttgttggacttaa

SEQ ID NO: 947319 - DNA, 25 bp, Mus musculus
ttgaccttgatcaccatgggtagtt

SEQ ID NO: 947320 - DNA, 25 bp, Mus musculus
ttgaccttgatctccatgggtagtt

SEQ ID NO: 947321 - DNA, 25 bp, Mus musculus
ttgaccttgctgacgtcagactacc

SEQ ID NO: 947322 - DNA, 25 bp, Mus musculus
ttgaccttgctgtcgtcagactacc

SEQ ID NO: 947323 - DNA, 25 bp, Mus musculus
ttgaccttggacagggagtctcagc

SEQ ID NO: 947324 - DNA, 25 bp, Mus musculus
ttgaccttggactgggagtctcagc

SEQ ID NO: 947325 - DNA, 25 bp, Mus musculus
ttgaccttggcaatctactaaaata

SEQ ID NO: 947326 - DNA, 25 bp, Mus musculus
ttgaccttggcattctactaaaata

SEQ ID NO: 947327 - DNA, 25 bp, Mus musculus
ttgaccttggctcgcactgtatgca

SEQ ID NO: 947328 - DNA, 25 bp, Mus musculus
ttgaccttggctggcactgtatgca

SEQ ID NO: 947329 - DNA, 25 bp, Mus musculus
ttgaccttgggtagggaagccttct

SEQ ID NO: 947330 - DNA, 25 bp, Mus musculus
ttgaccttgggttgggaagccttct

SEQ ID NO: 947331 - DNA, 25 bp, Mus musculus
ttgaccttgttcaccactactgaaa

SEQ ID NO: 947332 - DNA, 25 bp, Mus musculus
ttgaccttgttctccactactgaaa

SEQ ID NO: 947333 - DNA, 25 bp, Mus musculus
ttgacctttccccattgacaaagag

SEQ ID NO: 947334 - DNA, 25 bp, Mus musculus
ttgacctttcccgattgacaaagag

SEQ ID NO: 947335 - DNA, 25 bp, Mus musculus
ttgacctttcctatccagcggtgtg

SEQ ID NO: 947336 - DNA, 25 bp, Mus musculus
ttgacctttcctcagaacagcgttt

SEQ ID NO: 947337 - DNA, 25 bp, Mus musculus
ttgacctttcctgagaacagcgttt

SEQ ID NO: 947338 - DNA, 25 bp, Mus musculus
ttgacctttcctttccagcggtgtg

SEQ ID NO: 947339 - DNA, 25 bp, Mus musculus
ttgacctttctaattgatcccgtga

SEQ ID NO: 947340 - DNA, 25 bp, Mus musculus
ttgacctttctatttgatcccgtga

SEQ ID NO: 947341 - DNA, 25 bp, Mus musculus
ttgacctttgctctggttaaaacag

SEQ ID NO: 947342 - DNA, 25 bp, Mus musculus
ttgacctttgctctgttctagaaca

SEQ ID NO: 947343 - DNA, 25 bp, Mus musculus
ttgacctttgctgtggttaaaacag

SEQ ID NO: 947344 - DNA, 25 bp, Mus musculus
ttgacctttgctgtgttctagaaca

SEQ ID NO: 947345 - DNA, 25 bp, Mus musculus
ttgacgaatgctagtcagcctgccg

SEQ ID NO: 947346 - DNA, 25 bp, Mus musculus
ttgacgaatgcttgtcagcctgccg

SEQ ID NO: 947347 - DNA, 25 bp, Mus musculus
ttgacgacaggcacattcttaggaa

SEQ ID NO: 947348 - DNA, 25 bp, Mus musculus
ttgacgacaggctcattcttaggaa

SEQ ID NO: 947349 - DNA, 25 bp, Mus musculus
ttgacgacatgcattgtgctggcac

SEQ ID NO: 947350 - DNA, 25 bp, Mus musculus
ttgacgacatgctttgtgctggcac

SEQ ID NO: 947351 - DNA, 25 bp, Mus musculus
ttgacgaccaggatgaaaagggaca

SEQ ID NO: 947352 - DNA, 25 bp, Mus musculus
ttgacgaccaggttgaaaagggaca

SEQ ID NO: 947353 - DNA, 25 bp, Mus musculus
ttgacgacccttctctggcctgata

SEQ ID NO: 947354 - DNA, 25 bp, Mus musculus
ttgacgacccttgtctggcctgata

SEQ ID NO: 947355 - DNA, 25 bp, Mus musculus
ttgacgagaacaacgacgcggccat

SEQ ID NO: 947356 - DNA, 25 bp, Mus musculus
ttgacgagaacatcgacgcggccat

SEQ ID NO: 947357 - DNA, 25 bp, Mus musculus
ttgacgagctgtagcgacacacctg

SEQ ID NO: 947358 - DNA, 25 bp, Mus musculus
ttgacgagctgttgcgacacacctg

SEQ ID NO: 947359 - DNA, 25 bp, Mus musculus
ttgacgagtacaaccgcagcgaagc

SEQ ID NO: 947360 - DNA, 25 bp, Mus musculus
ttgacgagtacatccgcagcgaagc

SEQ ID NO: 947361 - DNA, 25 bp, Mus musculus
ttgacgagtccaaccttacagccat

SEQ ID NO: 947362 - DNA, 25 bp, Mus musculus
ttgacgagtccatccttacagccat

SEQ ID NO: 947363 - DNA, 25 bp, Mus musculus
ttgacgatatctcttgccttttcta

SEQ ID NO: 947364 - DNA, 25 bp, Mus musculus
ttgacgatatctgttgccttttcta

SEQ ID NO: 947365 - DNA, 25 bp, Mus musculus
ttgacgatccatccctttgggagcc

SEQ ID NO: 947366 - DNA, 25 bp, Mus musculus
ttgacgatccatgcctttgggagcc

SEQ ID NO: 947367 - DNA, 25 bp, Mus musculus
ttgacgcaggcacctttggttgatt

SEQ ID NO: 947368 - DNA, 25 bp, Mus musculus
ttgacgcaggcagctttggttgatt

SEQ ID NO: 947369 - DNA, 25 bp, Mus musculus
ttgacgccgtgtacgatggatccaa

SEQ ID NO: 947370 - DNA, 25 bp, Mus musculus
ttgacgccgtgttcgatggatccaa

SEQ ID NO: 947371 - DNA, 25 bp, Mus musculus
ttgacgcctcatcatttcaacgggc

SEQ ID NO: 947372 - DNA, 25 bp, Mus musculus
ttgacgcctcatgatttcaacgggc

SEQ ID NO: 947373 - DNA, 25 bp, Mus musculus
ttgacgcctcttcatcctattctca

SEQ ID NO: 947374 - DNA, 25 bp, Mus musculus
ttgacgcctcttgatcctattctca

SEQ ID NO: 947375 - DNA, 25 bp, Mus musculus
ttgacgcggccaacggcattgacga

SEQ ID NO: 947376 - DNA, 25 bp, Mus musculus
ttgacgcggccatcggcattgacga

SEQ ID NO: 947377 - DNA, 25 bp, Mus musculus
ttgacgctcagcaccagagcaaaga

SEQ ID NO: 947378 - DNA, 25 bp, Mus musculus
ttgacgctcagctccagagcaaaga

SEQ ID NO: 947379 - DNA, 25 bp, Mus musculus
ttgacgctcgagcaggctacgtatt

SEQ ID NO: 947380 - DNA, 25 bp, Mus musculus
ttgacgctcgaggaggctacgtatt

SEQ ID NO: 947381 - DNA, 25 bp, Mus musculus
ttgacgctgaggactttatcagatc

SEQ ID NO: 947382 - DNA, 25 bp, Mus musculus
ttgacgctgaggtctttatcagatc

SEQ ID NO: 947383 - DNA, 25 bp, Mus musculus
ttgacggacttcaagtgatgaggaa

SEQ ID NO: 947384 - DNA, 25 bp, Mus musculus
ttgacggacttctagtgatgaggaa

SEQ ID NO: 947385 - DNA, 25 bp, Mus musculus
ttgacggcctacctcatgaaattgt

SEQ ID NO: 947386 - DNA, 25 bp, Mus musculus
ttgacggcctacgtcatgaaattgt

SEQ ID NO: 947387 - DNA, 25 bp, Mus musculus
ttgacggctacaactcggcgctcct

SEQ ID NO: 947388 - DNA, 25 bp, Mus musculus
ttgacggctacatctcggcgctcct

SEQ ID NO: 947389 - DNA, 25 bp, Mus musculus
ttgacggctgttacaggtctcccag

SEQ ID NO: 947390 - DNA, 25 bp, Mus musculus
ttgacggctgtttcaggtctcccag

SEQ ID NO: 947391 - DNA, 25 bp, Mus musculus
ttgacgggaaacacatcctgactct

SEQ ID NO: 947392 - DNA, 25 bp, Mus musculus
ttgacgggaaactcatcctgactct

SEQ ID NO: 947393 - DNA, 25 bp, Mus musculus
ttgacggtccctcgtggcttctgga

SEQ ID NO: 947394 - DNA, 25 bp, Mus musculus
ttgacggtccctggtggcttctgga

SEQ ID NO: 947395 - DNA, 25 bp, Mus musculus
ttgacggttgtgctgtggttttact

SEQ ID NO: 947396 - DNA, 25 bp, Mus musculus
ttgacggttgtggtgtggttttact

SEQ ID NO: 947397 - DNA, 25 bp, Mus musculus
ttgacgtaaatgatgaccctggcac

SEQ ID NO: 947398 - DNA, 25 bp, Mus musculus
ttgacgtaaatgttgaccctggcac

SEQ ID NO: 947399 - DNA, 25 bp, Mus musculus
ttgacgtcatgcagacacagcctgt

SEQ ID NO: 947400 - DNA, 25 bp, Mus musculus
ttgacgtcatgctgacacagcctgt

SEQ ID NO: 947401 - DNA, 25 bp, Mus musculus
ttgacgtcgagcagcacactttggc

SEQ ID NO: 947402 - DNA, 25 bp, Mus musculus
ttgacgtcgagctgcacactttggc

SEQ ID NO: 947403 - DNA, 25 bp, Mus musculus
ttgacgtctcaaaagctcatgcctc

SEQ ID NO: 947404 - DNA, 25 bp, Mus musculus
ttgacgtctcaatagctcatgcctc

SEQ ID NO: 947405 - DNA, 25 bp, Mus musculus
ttgacgtctgaccacgtgaaggaac

SEQ ID NO: 947406 - DNA, 25 bp, Mus musculus
ttgacgtctgacgacgtgaaggaac

SEQ ID NO: 947407 - DNA, 25 bp, Mus musculus
ttgacgtgtcatcttgttctgacct

SEQ ID NO: 947408 - DNA, 25 bp, Mus musculus
ttgacgtgtcatgttgttctgacct

SEQ ID NO: 947409 - DNA, 25 bp, Mus musculus
ttgacgttcgaaccagccacacttt

SEQ ID NO: 947410 - DNA, 25 bp, Mus musculus
ttgacgttcgaagcagccacacttt

SEQ ID NO: 947411 - DNA, 25 bp, Mus musculus
ttgacgtttgtgaggaacggcgctt

SEQ ID NO: 947412 - DNA, 25 bp, Mus musculus
ttgacgtttgtgtggaacggcgctt

SEQ ID NO: 947413 - DNA, 25 bp, Mus musculus
ttgactaaatgaaggtgccgtcttc

SEQ ID NO: 947414 - DNA, 25 bp, Mus musculus
ttgactaaatgatggtgccgtcttc

SEQ ID NO: 947415 - DNA, 25 bp, Mus musculus
ttgactaacagacttcggcccacca

SEQ ID NO: 947416 - DNA, 25 bp, Mus musculus
ttgactaacagagttcggcccacca

SEQ ID NO: 947417 - DNA, 25 bp, Mus musculus
ttgactaatctgaatcttggtatgt

SEQ ID NO: 947418 - DNA, 25 bp, Mus musculus
ttgactaatctgtatcttggtatgt

SEQ ID NO: 947419 - DNA, 25 bp, Mus musculus
ttgactacatcacaacacacagttg

SEQ ID NO: 947420 - DNA, 25 bp, Mus musculus
ttgactacatcagaacacacagttg

SEQ ID NO: 947421 - DNA, 25 bp, Mus musculus
ttgactacccacactgatgccgaca

SEQ ID NO: 947422 - DNA, 25 bp, Mus musculus
ttgactacccactctgatgccgaca

SEQ ID NO: 947423 - DNA, 25 bp, Mus musculus
ttgactacgttgctgattggtgtta

SEQ ID NO: 947424 - DNA, 25 bp, Mus musculus
ttgactacgttggtgattggtgtta

SEQ ID NO: 947425 - DNA, 25 bp, Mus musculus
ttgactactgcaaaaacggtccgga

SEQ ID NO: 947426 - DNA, 25 bp, Mus musculus
ttgactactgcataaacggtccgga

SEQ ID NO: 947427 - DNA, 25 bp, Mus musculus
ttgactagagtgaagccctgctcgt

SEQ ID NO: 947428 - DNA, 25 bp, Mus musculus
ttgactagagtgtagccctgctcgt

SEQ ID NO: 947429 - DNA, 25 bp, Mus musculus
ttgactagccaacatccagagtcct

SEQ ID NO: 947430 - DNA, 25 bp, Mus musculus
ttgactagccaagatccagagtcct

SEQ ID NO: 947431 - DNA, 25 bp, Mus musculus
ttgactagctggctctgtgggcaca

SEQ ID NO: 947432 - DNA, 25 bp, Mus musculus
ttgactagctgggtctgtgggcaca

SEQ ID NO: 947433 - DNA, 25 bp, Mus musculus
ttgactaggcagctctgcctgcaga

SEQ ID NO: 947434 - DNA, 25 bp, Mus musculus
ttgactaggcaggtctgcctgcaga

SEQ ID NO: 947435 - DNA, 25 bp, Mus musculus
ttgactatatatcgcgaaactttta

SEQ ID NO: 947436 - DNA, 25 bp, Mus musculus
ttgactatatatggcgaaactttta

SEQ ID NO: 947437 - DNA, 25 bp, Mus musculus
ttgactatatctagactgagggctt

SEQ ID NO: 947438 - DNA, 25 bp, Mus musculus
ttgactatatcttgactgagggctt

SEQ ID NO: 947439 - DNA, 25 bp, Mus musculus
ttgactatgtggctgctccaccaac

SEQ ID NO: 947440 - DNA, 25 bp, Mus musculus
ttgactatgtgggtgctccaccaac

SEQ ID NO: 947441 - DNA, 25 bp, Mus musculus
ttgactattacacaagtgcacccct

SEQ ID NO: 947442 - DNA, 25 bp, Mus musculus
ttgactattacagaagtgcacccct

SEQ ID NO: 947443 - DNA, 25 bp, Mus musculus
ttgactattgtcatgaaatctggta

SEQ ID NO: 947444 - DNA, 25 bp, Mus musculus
ttgactattgtcctgctttcctttt

SEQ ID NO: 947445 - DNA, 25 bp, Mus musculus
ttgactattgtcgtgctttcctttt

SEQ ID NO: 947446 - DNA, 25 bp, Mus musculus
ttgactattgtcttgaaatctggta

SEQ ID NO: 947447 - DNA, 25 bp, Mus musculus
ttgactatttttagagctatggagc

SEQ ID NO: 947448 - DNA, 25 bp, Mus musculus
ttgactattttttgagctatggagc

SEQ ID NO: 947449 - DNA, 25 bp, Mus musculus
ttgactcaacctaaactgataccat

SEQ ID NO: 947450 - DNA, 25 bp, Mus musculus
ttgactcaaccttaactgataccat

SEQ ID NO: 947451 - DNA, 25 bp, Mus musculus
ttgactcaagaaatggaggcccggc

SEQ ID NO: 947452 - DNA, 25 bp, Mus musculus
ttgactcaagaattggaggcccggc

SEQ ID NO: 947453 - DNA, 25 bp, Mus musculus
ttgactcaagctattcaccactgac

SEQ ID NO: 947454 - DNA, 25 bp, Mus musculus
ttgactcaagcttttcaccactgac

SEQ ID NO: 947455 - DNA, 25 bp, Mus musculus
ttgactcacacactagtggccttgt

SEQ ID NO: 947456 - DNA, 25 bp, Mus musculus
ttgactcacacagtagtggccttgt

SEQ ID NO: 947457 - DNA, 25 bp, Mus musculus
ttgactcacaggcattttctaacat

SEQ ID NO: 947458 - DNA, 25 bp, Mus musculus
ttgactcacagggattttctaacat

SEQ ID NO: 947459 - DNA, 25 bp, Mus musculus
ttgactcacataaatggcattgcta

SEQ ID NO: 947460 - DNA, 25 bp, Mus musculus
ttgactcacatatatggcattgcta

SEQ ID NO: 947461 - DNA, 25 bp, Mus musculus
ttgactcaccagaaccacacggtag

SEQ ID NO: 947462 - DNA, 25 bp, Mus musculus
ttgactcaccagtaccacacggtag

SEQ ID NO: 947463 - DNA, 25 bp, Mus musculus
ttgactcacgaccaaagctatcctg

SEQ ID NO: 947464 - DNA, 25 bp, Mus musculus
ttgactcacgacgaaagctatcctg

SEQ ID NO: 947465 - DNA, 25 bp, Mus musculus
ttgactcagaaacatgcaggcaccc

SEQ ID NO: 947466 - DNA, 25 bp, Mus musculus
ttgactcagaaagatgcaggcaccc

SEQ ID NO: 947467 - DNA, 25 bp, Mus musculus
ttgactcatggtccctttcctaaag

SEQ ID NO: 947468 - DNA, 25 bp, Mus musculus
ttgactcatggtgcctttcctaaag

SEQ ID NO: 947469 - DNA, 25 bp, Mus musculus
ttgactccaaccctctttgcctgtt

SEQ ID NO: 947470 - DNA, 25 bp, Mus musculus
ttgactccaaccgtctttgcctgtt

SEQ ID NO: 947471 - DNA, 25 bp, Mus musculus
ttgactccacctagttttgattttc

SEQ ID NO: 947472 - DNA, 25 bp, Mus musculus
ttgactccaccttgttttgattttc

SEQ ID NO: 947473 - DNA, 25 bp, Mus musculus
ttgactccacgcacttggttataaa

SEQ ID NO: 947474 - DNA, 25 bp, Mus musculus
ttgactccacgctcttggttataaa

SEQ ID NO: 947475 - DNA, 25 bp, Mus musculus
ttgactccactacactctctaatgt

SEQ ID NO: 947476 - DNA, 25 bp, Mus musculus
ttgactccactagactctctaatgt

SEQ ID NO: 947477 - DNA, 25 bp, Mus musculus
ttgactccagccactcttttgtgag

SEQ ID NO: 947478 - DNA, 25 bp, Mus musculus
ttgactccagcccagctgaggaaga

SEQ ID NO: 947479 - DNA, 25 bp, Mus musculus
ttgactccagccgagctgaggaaga

SEQ ID NO: 947480 - DNA, 25 bp, Mus musculus
ttgactccagcctctcttttgtgag

SEQ ID NO: 947481 - DNA, 25 bp, Mus musculus
ttgactccagtccttaccctaagaa

SEQ ID NO: 947482 - DNA, 25 bp, Mus musculus
ttgactccagtcgttaccctaagaa

SEQ ID NO: 947483 - DNA, 25 bp, Mus musculus
ttgactccatggattctgcgcttga

SEQ ID NO: 947484 - DNA, 25 bp, Mus musculus
ttgactccatggtttctgcgcttga

SEQ ID NO: 947485 - DNA, 25 bp, Mus musculus
ttgactccattcatacgatcacaga

SEQ ID NO: 947486 - DNA, 25 bp, Mus musculus
ttgactccattcttacgatcacaga

SEQ ID NO: 947487 - DNA, 25 bp, Mus musculus
ttgactcccaacaccgaatgcagga

SEQ ID NO: 947488 - DNA, 25 bp, Mus musculus
ttgactcccaactccgaatgcagga

SEQ ID NO: 947489 - DNA, 25 bp, Mus musculus
ttgactcccaagaggataggctagt

SEQ ID NO: 947490 - DNA, 25 bp, Mus musculus
ttgactcccaagagtattaccccaa

SEQ ID NO: 947491 - DNA, 25 bp, Mus musculus
ttgactcccaagtggataggctagt

SEQ ID NO: 947492 - DNA, 25 bp, Mus musculus
ttgactcccaagtgtattaccccaa

SEQ ID NO: 947493 - DNA, 25 bp, Mus musculus
ttgactccccacaaaaatctctaca

SEQ ID NO: 947494 - DNA, 25 bp, Mus musculus
ttgactccccactaaaatctctaca

SEQ ID NO: 947495 - DNA, 25 bp, Mus musculus
ttgactcccctccatgatggctgtg

SEQ ID NO: 947496 - DNA, 25 bp, Mus musculus
ttgactcccctcgatgatggctgtg

SEQ ID NO: 947497 - DNA, 25 bp, Mus musculus
ttgactccctccatgatggctgtgc

SEQ ID NO: 947498 - DNA, 25 bp, Mus musculus
ttgactccctccttgatggctgtgc

SEQ ID NO: 947499 - DNA, 25 bp, Mus musculus
ttgactccgaaaacctgctaacctg

SEQ ID NO: 947500 - DNA, 25 bp, Mus musculus
ttgactccgaaatcctgctaacctg

SEQ ID NO: 947501 - DNA, 25 bp, Mus musculus
ttgactccgtgtctttatttaagac

SEQ ID NO: 947502 - DNA, 25 bp, Mus musculus
ttgactccgtgtgtttatttaagac

SEQ ID NO: 947503 - DNA, 25 bp, Mus musculus
ttgactcctggcagctccgagaatg

SEQ ID NO: 947504 - DNA, 25 bp, Mus musculus
ttgactcctggctgctccgagaatg

SEQ ID NO: 947505 - DNA, 25 bp, Mus musculus
ttgactcctgtacacttccatgtgt

SEQ ID NO: 947506 - DNA, 25 bp, Mus musculus
ttgactcctgtagacttccatgtgt

SEQ ID NO: 947507 - DNA, 25 bp, Mus musculus
ttgactccttcaagacctcctgaag

SEQ ID NO: 947508 - DNA, 25 bp, Mus musculus
ttgactccttcatgacctcctgaag

SEQ ID NO: 947509 - DNA, 25 bp, Mus musculus
ttgactcgctgcagcagtggccgtt

SEQ ID NO: 947510 - DNA, 25 bp, Mus musculus
ttgactcgctgctgcagtggccgtt

SEQ ID NO: 947511 - DNA, 25 bp, Mus musculus
ttgactctactgagtacccttgctg

SEQ ID NO: 947512 - DNA, 25 bp, Mus musculus
ttgactctactgtgtacccttgctg

SEQ ID NO: 947513 - DNA, 25 bp, Mus musculus
ttgactctagacctgcaacattcca

SEQ ID NO: 947514 - DNA, 25 bp, Mus musculus
ttgactctagacgtgcaacattcca

SEQ ID NO: 947515 - DNA, 25 bp, Mus musculus
ttgactctcaagatggcagcccagc

SEQ ID NO: 947516 - DNA, 25 bp, Mus musculus
ttgactctcaagttggcagcccagc

SEQ ID NO: 947517 - DNA, 25 bp, Mus musculus
ttgactctcacaactgtggctagtc

SEQ ID NO: 947518 - DNA, 25 bp, Mus musculus
ttgactctcacatctgtggctagtc

SEQ ID NO: 947519 - DNA, 25 bp, Mus musculus
ttgactctccacaaaaagcctcggg

SEQ ID NO: 947520 - DNA, 25 bp, Mus musculus
ttgactctccacacttcataaaggc

SEQ ID NO: 947521 - DNA, 25 bp, Mus musculus
ttgactctccactaaaagcctcggg

SEQ ID NO: 947522 - DNA, 25 bp, Mus musculus
ttgactctccactcttcataaaggc

SEQ ID NO: 947523 - DNA, 25 bp, Mus musculus
ttgactctccccagggctgcacggg

SEQ ID NO: 947524 - DNA, 25 bp, Mus musculus
ttgactctcccctgggctgcacggg

SEQ ID NO: 947525 - DNA, 25 bp, Mus musculus
ttgactctctgacaagtgttaaagg

SEQ ID NO: 947526 - DNA, 25 bp, Mus musculus
ttgactctctgagaagtgttaaagg

SEQ ID NO: 947527 - DNA, 25 bp, Mus musculus
ttgactctgatcctgcagcctctat

SEQ ID NO: 947528 - DNA, 25 bp, Mus musculus
ttgactctgatcgtgcagcctctat

SEQ ID NO: 947529 - DNA, 25 bp, Mus musculus
ttgactctgcagcaggctgtcgaca

SEQ ID NO: 947530 - DNA, 25 bp, Mus musculus
ttgactctgcagctatcatagaaga

SEQ ID NO: 947531 - DNA, 25 bp, Mus musculus
ttgactctgcaggaggctgtcgaca

SEQ ID NO: 947532 - DNA, 25 bp, Mus musculus
ttgactctgcaggtatcatagaaga

SEQ ID NO: 947533 - DNA, 25 bp, Mus musculus
ttgactctgcatatgggacctatta

SEQ ID NO: 947534 - DNA, 25 bp, Mus musculus
ttgactctgcatttgggacctatta

SEQ ID NO: 947535 - DNA, 25 bp, Mus musculus
ttgactctgcttccagctgaaaggt

SEQ ID NO: 947536 - DNA, 25 bp, Mus musculus
ttgactctgcttgcagctgaaaggt

SEQ ID NO: 947537 - DNA, 25 bp, Mus musculus
ttgactctggcacgtatgtacatgg

SEQ ID NO: 947538 - DNA, 25 bp, Mus musculus
ttgactctggcaggtatgtacatgg

SEQ ID NO: 947539 - DNA, 25 bp, Mus musculus
ttgactcttaataaccccttggact

SEQ ID NO: 947540 - DNA, 25 bp, Mus musculus
ttgactcttaattaccccttggact

SEQ ID NO: 947541 - DNA, 25 bp, Mus musculus
ttgactcttcggatcagcactggat

SEQ ID NO: 947542 - DNA, 25 bp, Mus musculus
ttgactcttcggttcagcactggat

SEQ ID NO: 947543 - DNA, 25 bp, Mus musculus
ttgactctttccacacttggctggg

SEQ ID NO: 947544 - DNA, 25 bp, Mus musculus
ttgactctttcctcacttggctggg

SEQ ID NO: 947545 - DNA, 25 bp, Mus musculus
ttgactgaaccaccccaagtttggg

SEQ ID NO: 947546 - DNA, 25 bp, Mus musculus
ttgactgaaccagcccaagtttggg

SEQ ID NO: 947547 - DNA, 25 bp, Mus musculus
ttgactgaagtccattgcagctaca

SEQ ID NO: 947548 - DNA, 25 bp, Mus musculus
ttgactgaagtcgattgcagctaca

SEQ ID NO: 947549 - DNA, 25 bp, Mus musculus
ttgactgaatctcgaatcacctggt

SEQ ID NO: 947550 - DNA, 25 bp, Mus musculus
ttgactgaatctggaatcacctggt

SEQ ID NO: 947551 - DNA, 25 bp, Mus musculus
ttgactgaccttacacggcagaggt

SEQ ID NO: 947552 - DNA, 25 bp, Mus musculus
ttgactgacctttcacggcagaggt

SEQ ID NO: 947553 - DNA, 25 bp, Mus musculus
ttgactgactctaagacttgccatt

SEQ ID NO: 947554 - DNA, 25 bp, Mus musculus
ttgactgactcttagacttgccatt

SEQ ID NO: 947555 - DNA, 25 bp, Mus musculus
ttgactgagaaaacctactttaagg

SEQ ID NO: 947556 - DNA, 25 bp, Mus musculus
ttgactgagaaatcctactttaagg

SEQ ID NO: 947557 - DNA, 25 bp, Mus musculus
ttgactgagcatcaaaagagcccga

SEQ ID NO: 947558 - DNA, 25 bp, Mus musculus
ttgactgagcatccccgctgagtgg

SEQ ID NO: 947559 - DNA, 25 bp, Mus musculus
ttgactgagcatgaaaagagcccga

SEQ ID NO: 947560 - DNA, 25 bp, Mus musculus
ttgactgagcatgcccgctgagtgg

SEQ ID NO: 947561 - DNA, 25 bp, Mus musculus
ttgactgagcccctgaattcaagag

SEQ ID NO: 947562 - DNA, 25 bp, Mus musculus
ttgactgagcccgtgaattcaagag

SEQ ID NO: 947563 - DNA, 25 bp, Mus musculus
ttgactgagtttagcctagaaagga

SEQ ID NO: 947564 - DNA, 25 bp, Mus musculus
ttgactgagtttatcatccttacaa

SEQ ID NO: 947565 - DNA, 25 bp, Mus musculus
ttgactgagtttccatgccaggcag

SEQ ID NO: 947566 - DNA, 25 bp, Mus musculus
ttgactgagtttgcatgccaggcag

SEQ ID NO: 947567 - DNA, 25 bp, Mus musculus
ttgactgagttttgcctagaaagga

SEQ ID NO: 947568 - DNA, 25 bp, Mus musculus
ttgactgagtttttcatccttacaa

SEQ ID NO: 947569 - DNA, 25 bp, Mus musculus
ttgactgatccacctgggccagagc

SEQ ID NO: 947570 - DNA, 25 bp, Mus musculus
ttgactgatccagctgggccagagc

SEQ ID NO: 947571 - DNA, 25 bp, Mus musculus
ttgactgatgaacgactctgatgga

SEQ ID NO: 947572 - DNA, 25 bp, Mus musculus
ttgactgatgaaggactctgatgga

SEQ ID NO: 947573 - DNA, 25 bp, Mus musculus
ttgactgatttcactccttgataga

SEQ ID NO: 947574 - DNA, 25 bp, Mus musculus
ttgactgatttctctccttgataga

SEQ ID NO: 947575 - DNA, 25 bp, Mus musculus
ttgactgattttaaggccacctggt

SEQ ID NO: 947576 - DNA, 25 bp, Mus musculus
ttgactgatttttaggccacctggt

SEQ ID NO: 947577 - DNA, 25 bp, Mus musculus
ttgactgcaagtactcagagccggt

SEQ ID NO: 947578 - DNA, 25 bp, Mus musculus
ttgactgcaagttctcagagccggt

SEQ ID NO: 947579 - DNA, 25 bp, Mus musculus
ttgactgcactaaaggccaggactt

SEQ ID NO: 947580 - DNA, 25 bp, Mus musculus
ttgactgcactataggccaggactt

SEQ ID NO: 947581 - DNA, 25 bp, Mus musculus
ttgactgcatttagcatcacccacg

SEQ ID NO: 947582 - DNA, 25 bp, Mus musculus
ttgactgcattttgcatcacccacg

SEQ ID NO: 947583 - DNA, 25 bp, Mus musculus
ttgactgccaagatgctaactgcta

SEQ ID NO: 947584 - DNA, 25 bp, Mus musculus
ttgactgccaagttgctaactgcta

SEQ ID NO: 947585 - DNA, 25 bp, Mus musculus
ttgactgcccacatttagttactat

SEQ ID NO: 947586 - DNA, 25 bp, Mus musculus
ttgactgcccacttttagttactat

SEQ ID NO: 947587 - DNA, 25 bp, Mus musculus
ttgactgcctgaaacccagaccaga

SEQ ID NO: 947588 - DNA, 25 bp, Mus musculus
ttgactgcctgatacccagaccaga

SEQ ID NO: 947589 - DNA, 25 bp, Mus musculus
ttgactgctaagagattacggacct

SEQ ID NO: 947590 - DNA, 25 bp, Mus musculus
ttgactgctaagtgattacggacct

SEQ ID NO: 947591 - DNA, 25 bp, Mus musculus
ttgactgctgaccttctccgtgatt

SEQ ID NO: 947592 - DNA, 25 bp, Mus musculus
ttgactgctgacgttctccgtgatt

SEQ ID NO: 947593 - DNA, 25 bp, Mus musculus
ttgactgctgttacagaagacccga

SEQ ID NO: 947594 - DNA, 25 bp, Mus musculus
ttgactgctgtttcagaagacccga

SEQ ID NO: 947595 - DNA, 25 bp, Mus musculus
ttgactggaggtccagacccgccag

SEQ ID NO: 947596 - DNA, 25 bp, Mus musculus
ttgactggaggtgcagacccgccag

SEQ ID NO: 947597 - DNA, 25 bp, Mus musculus
ttgactggatccagcccaacagagt

SEQ ID NO: 947598 - DNA, 25 bp, Mus musculus
ttgactggatcctgcccaacagagt

SEQ ID NO: 947599 - DNA, 25 bp, Mus musculus
ttgactggattgctgtgattttaca

SEQ ID NO: 947600 - DNA, 25 bp, Mus musculus
ttgactggattggtgtgattttaca

SEQ ID NO: 947601 - DNA, 25 bp, Mus musculus
ttgactggcaacattaaataaactt

SEQ ID NO: 947602 - DNA, 25 bp, Mus musculus
ttgactggcaactttaaataaactt

SEQ ID NO: 947603 - DNA, 25 bp, Mus musculus
ttgactggcaccagtgacctttttt

SEQ ID NO: 947604 - DNA, 25 bp, Mus musculus
ttgactggcacctgtgacctttttt

SEQ ID NO: 947605 - DNA, 25 bp, Mus musculus
ttgactggcagcacataactcttca

SEQ ID NO: 947606 - DNA, 25 bp, Mus musculus
ttgactggcagctcataactcttca

SEQ ID NO: 947607 - DNA, 25 bp, Mus musculus
ttgactggctcccttgtcagcaaga

SEQ ID NO: 947608 - DNA, 25 bp, Mus musculus
ttgactggctccgttgtcagcaaga

SEQ ID NO: 947609 - DNA, 25 bp, Mus musculus
ttgactgggaaaaagatcaccgaga

SEQ ID NO: 947610 - DNA, 25 bp, Mus musculus
ttgactgggaaatagatcaccgaga

SEQ ID NO: 947611 - DNA, 25 bp, Mus musculus
ttgactgggcagaacagagcactta

SEQ ID NO: 947612 - DNA, 25 bp, Mus musculus
ttgactgggcagtacagagcactta

SEQ ID NO: 947613 - DNA, 25 bp, Mus musculus
ttgactggtcgtagctatggcctgt

SEQ ID NO: 947614 - DNA, 25 bp, Mus musculus
ttgactggtcgttgctatggcctgt

SEQ ID NO: 947615 - DNA, 25 bp, Mus musculus
ttgactggttcacaaatatatccac

SEQ ID NO: 947616 - DNA, 25 bp, Mus musculus
ttgactggttcagaaatatatccac

SEQ ID NO: 947617 - DNA, 25 bp, Mus musculus
ttgactgtaaggcttcattgcacta

SEQ ID NO: 947618 - DNA, 25 bp, Mus musculus
ttgactgtaagggttcattgcacta

SEQ ID NO: 947619 - DNA, 25 bp, Mus musculus
ttgactgtagacactggcaatgcca

SEQ ID NO: 947620 - DNA, 25 bp, Mus musculus
ttgactgtagactctggcaatgcca

SEQ ID NO: 947621 - DNA, 25 bp, Mus musculus
ttgactgtagtccagcatcacggag

SEQ ID NO: 947622 - DNA, 25 bp, Mus musculus
ttgactgtagtcgagcatcacggag

SEQ ID NO: 947623 - DNA, 25 bp, Mus musculus
ttgactgtatatcgccagcacaaat

SEQ ID NO: 947624 - DNA, 25 bp, Mus musculus
ttgactgtatatggccagcacaaat

SEQ ID NO: 947625 - DNA, 25 bp, Mus musculus
ttgactgtatcgatggcctatgccc

SEQ ID NO: 947626 - DNA, 25 bp, Mus musculus
ttgactgtatcgttggcctatgccc

SEQ ID NO: 947627 - DNA, 25 bp, Mus musculus
ttgactgtatttctctccattggct

SEQ ID NO: 947628 - DNA, 25 bp, Mus musculus
ttgactgtatttgtctccattggct

SEQ ID NO: 947629 - DNA, 25 bp, Mus musculus
ttgactgtcattatgttaactattt

SEQ ID NO: 947630 - DNA, 25 bp, Mus musculus
ttgactgtcattttgttaactattt

SEQ ID NO: 947631 - DNA, 25 bp, Mus musculus
ttgactgtcctgctggccttgtacc

SEQ ID NO: 947632 - DNA, 25 bp, Mus musculus
ttgactgtcctggtggccttgtacc

SEQ ID NO: 947633 - DNA, 25 bp, Mus musculus
ttgactgtcgtgcaacttgatctgt

SEQ ID NO: 947634 - DNA, 25 bp, Mus musculus
ttgactgtcgtggaacttgatctgt

SEQ ID NO: 947635 - DNA, 25 bp, Mus musculus
ttgactgtctaccagctgggctggc

SEQ ID NO: 947636 - DNA, 25 bp, Mus musculus
ttgactgtctacgagctgggctggc

SEQ ID NO: 947637 - DNA, 25 bp, Mus musculus
ttgactgtcttaaggccaagcccca

SEQ ID NO: 947638 - DNA, 25 bp, Mus musculus
ttgactgtcttatggccaagcccca

SEQ ID NO: 947639 - DNA, 25 bp, Mus musculus
ttgactgtgacaaggttgcacctga

SEQ ID NO: 947640 - DNA, 25 bp, Mus musculus
ttgactgtgacatggttgcacctga

SEQ ID NO: 947641 - DNA, 25 bp, Mus musculus
ttgactgtgccacacaggccatgga

SEQ ID NO: 947642 - DNA, 25 bp, Mus musculus
ttgactgtgccagacaggccatgga

SEQ ID NO: 947643 - DNA, 25 bp, Mus musculus
ttgactgtgctaatttaccaaattg

SEQ ID NO: 947644 - DNA, 25 bp, Mus musculus
ttgactgtgctattttaccaaattg

SEQ ID NO: 947645 - DNA, 25 bp, Mus musculus
ttgactgtggccatcctgttagtga

SEQ ID NO: 947646 - DNA, 25 bp, Mus musculus
ttgactgtggccttcctgttagtga

SEQ ID NO: 947647 - DNA, 25 bp, Mus musculus
ttgactgtgggtaaggtatacttac

SEQ ID NO: 947648 - DNA, 25 bp, Mus musculus
ttgactgtgggttaggtatacttac

SEQ ID NO: 947649 - DNA, 25 bp, Mus musculus
ttgactgttcatacccagtttggtt

SEQ ID NO: 947650 - DNA, 25 bp, Mus musculus
ttgactgttcattcccagtttggtt

SEQ ID NO: 947651 - DNA, 25 bp, Mus musculus
ttgactgttctgaccgcgaccgcag

SEQ ID NO: 947652 - DNA, 25 bp, Mus musculus
ttgactgttctgtccgcgaccgcag

SEQ ID NO: 947653 - DNA, 25 bp, Mus musculus
ttgactgttcttcgccttagaatct

SEQ ID NO: 947654 - DNA, 25 bp, Mus musculus
ttgactgttcttggccttagaatct

SEQ ID NO: 947655 - DNA, 25 bp, Mus musculus
ttgactgttgacaagtcctccagca

SEQ ID NO: 947656 - DNA, 25 bp, Mus musculus
ttgactgttgactagtcctccagca

SEQ ID NO: 947657 - DNA, 25 bp, Mus musculus
ttgacttaaattcgctgatacgagg

SEQ ID NO: 947658 - DNA, 25 bp, Mus musculus
ttgacttaaattggctgatacgagg

SEQ ID NO: 947659 - DNA, 25 bp, Mus musculus
ttgacttaacccattgctgtctaca

SEQ ID NO: 947660 - DNA, 25 bp, Mus musculus
ttgacttaaccctttgctgtctaca

SEQ ID NO: 947661 - DNA, 25 bp, Mus musculus
ttgacttaatttcaccctcacagca

SEQ ID NO: 947662 - DNA, 25 bp, Mus musculus
ttgacttaatttgaccctcacagca

SEQ ID NO: 947663 - DNA, 25 bp, Mus musculus
ttgacttaccacataggcatgaagg

SEQ ID NO: 947664 - DNA, 25 bp, Mus musculus
ttgacttaccacttaggcatgaagg

SEQ ID NO: 947665 - DNA, 25 bp, Mus musculus
ttgacttactccacagtacttagag

SEQ ID NO: 947666 - DNA, 25 bp, Mus musculus
ttgacttactcctcagtacttagag

SEQ ID NO: 947667 - DNA, 25 bp, Mus musculus
ttgacttacttaacactttgtgcat

SEQ ID NO: 947668 - DNA, 25 bp, Mus musculus
ttgacttacttatcactttgtgcat

SEQ ID NO: 947669 - DNA, 25 bp, Mus musculus
ttgacttatagtccatcatagcagg

SEQ ID NO: 947670 - DNA, 25 bp, Mus musculus
ttgacttatagtgcatcatagcagg

SEQ ID NO: 947671 - DNA, 25 bp, Mus musculus
ttgacttatgtgactgactccagat

SEQ ID NO: 947672 - DNA, 25 bp, Mus musculus
ttgacttatgtgtctgactccagat

SEQ ID NO: 947673 - DNA, 25 bp, Mus musculus
ttgacttattaaacttgcagccctt

SEQ ID NO: 947674 - DNA, 25 bp, Mus musculus
ttgacttattaatcttgcagccctt

SEQ ID NO: 947675 - DNA, 25 bp, Mus musculus
ttgacttcaagacctctctaattaa

SEQ ID NO: 947676 - DNA, 25 bp, Mus musculus
ttgacttcaagaccttcgcttttgg

SEQ ID NO: 947677 - DNA, 25 bp, Mus musculus
ttgacttcaagagctctctaattaa

SEQ ID NO: 947678 - DNA, 25 bp, Mus musculus
ttgacttcaagagcttcgcttttgg

SEQ ID NO: 947679 - DNA, 25 bp, Mus musculus
ttgacttcacaacgtaagaattcat

SEQ ID NO: 947680 - DNA, 25 bp, Mus musculus
ttgacttcacaaggtaagaattcat

SEQ ID NO: 947681 - DNA, 25 bp, Mus musculus
ttgacttcacgtctctggacctctc

SEQ ID NO: 947682 - DNA, 25 bp, Mus musculus
ttgacttcacgtgtctggacctctc

SEQ ID NO: 947683 - DNA, 25 bp, Mus musculus
ttgacttcacttctattcctacatt

SEQ ID NO: 947684 - DNA, 25 bp, Mus musculus
ttgacttcacttgtattcctacatt

SEQ ID NO: 947685 - DNA, 25 bp, Mus musculus
ttgacttcagagacgtgggctgcct

SEQ ID NO: 947686 - DNA, 25 bp, Mus musculus
ttgacttcagagtcgtgggctgcct

SEQ ID NO: 947687 - DNA, 25 bp, Mus musculus
ttgacttcagatattcaggacccct

SEQ ID NO: 947688 - DNA, 25 bp, Mus musculus
ttgacttcagattttcaggacccct

SEQ ID NO: 947689 - DNA, 25 bp, Mus musculus
ttgacttcatgcagtgatgcacctg

SEQ ID NO: 947690 - DNA, 25 bp, Mus musculus
ttgacttcatgctgtgatgcacctg

SEQ ID NO: 947691 - DNA, 25 bp, Mus musculus
ttgacttcattaatcccatggtatt

SEQ ID NO: 947692 - DNA, 25 bp, Mus musculus
ttgacttcattattcccatggtatt

SEQ ID NO: 947693 - DNA, 25 bp, Mus musculus
ttgacttccaagaggctcagacact

SEQ ID NO: 947694 - DNA, 25 bp, Mus musculus
ttgacttccaagtggctcagacact

SEQ ID NO: 947695 - DNA, 25 bp, Mus musculus
ttgacttccactagtaccggccaca

SEQ ID NO: 947696 - DNA, 25 bp, Mus musculus
ttgacttccacttgtaccggccaca

SEQ ID NO: 947697 - DNA, 25 bp, Mus musculus
ttgacttccagcatttgtgcagttt

SEQ ID NO: 947698 - DNA, 25 bp, Mus musculus
ttgacttccagcttttgtgcagttt

SEQ ID NO: 947699 - DNA, 25 bp, Mus musculus
ttgacttccctgcaataacacactg

SEQ ID NO: 947700 - DNA, 25 bp, Mus musculus
ttgacttccctggaataacacactg

SEQ ID NO: 947701 - DNA, 25 bp, Mus musculus
ttgacttccttccttatatccacta

SEQ ID NO: 947702 - DNA, 25 bp, Mus musculus
ttgacttccttcgttatatccacta

SEQ ID NO: 947703 - DNA, 25 bp, Mus musculus
ttgacttctatgattgccccgggca

SEQ ID NO: 947704 - DNA, 25 bp, Mus musculus
ttgacttctatgtttgccccgggca

SEQ ID NO: 947705 - DNA, 25 bp, Mus musculus
ttgacttctcaaagctcttctgact

SEQ ID NO: 947706 - DNA, 25 bp, Mus musculus
ttgacttctcaatgctcttctgact

SEQ ID NO: 947707 - DNA, 25 bp, Mus musculus
ttgacttctgaaagcatcttcaggg

SEQ ID NO: 947708 - DNA, 25 bp, Mus musculus
ttgacttctgaatgcatcttcaggg

SEQ ID NO: 947709 - DNA, 25 bp, Mus musculus
ttgacttctgacacagcgtgcagag

SEQ ID NO: 947710 - DNA, 25 bp, Mus musculus
ttgacttctgactcagcgtgcagag

SEQ ID NO: 947711 - DNA, 25 bp, Mus musculus
ttgacttctgccctcaatgcgttgc

SEQ ID NO: 947712 - DNA, 25 bp, Mus musculus
ttgacttctgccgtcaatgcgttgc

SEQ ID NO: 947713 - DNA, 25 bp, Mus musculus
ttgacttctgttccggtcctgtaaa

SEQ ID NO: 947714 - DNA, 25 bp, Mus musculus
ttgacttctgttgcggtcctgtaaa

SEQ ID NO: 947715 - DNA, 25 bp, Mus musculus
ttgacttcttaaaccattcttgctg

SEQ ID NO: 947716 - DNA, 25 bp, Mus musculus
ttgacttcttaatccattcttgctg

SEQ ID NO: 947717 - DNA, 25 bp, Mus musculus
ttgacttcttcacccatatgcacaa

SEQ ID NO: 947718 - DNA, 25 bp, Mus musculus
ttgacttcttcacgtggctaggtta

SEQ ID NO: 947719 - DNA, 25 bp, Mus musculus
ttgacttcttcagccatatgcacaa

SEQ ID NO: 947720 - DNA, 25 bp, Mus musculus
ttgacttcttcaggtggctaggtta

SEQ ID NO: 947721 - DNA, 25 bp, Mus musculus
ttgacttgacccctctggacattga

SEQ ID NO: 947722 - DNA, 25 bp, Mus musculus
ttgacttgacccgtctggacattga

SEQ ID NO: 947723 - DNA, 25 bp, Mus musculus
ttgacttgaggcagttttcagtgtg

SEQ ID NO: 947724 - DNA, 25 bp, Mus musculus
ttgacttgaggctgttttcagtgtg

SEQ ID NO: 947725 - DNA, 25 bp, Mus musculus
ttgacttgcgttcatctttttacat

SEQ ID NO: 947726 - DNA, 25 bp, Mus musculus
ttgacttgcgttgatctttttacat

SEQ ID NO: 947727 - DNA, 25 bp, Mus musculus
ttgacttgctctcagaccctgcgaa

SEQ ID NO: 947728 - DNA, 25 bp, Mus musculus
ttgacttgctctgagaccctgcgaa

SEQ ID NO: 947729 - DNA, 25 bp, Mus musculus
ttgacttgcttacgctcgtacctgc

SEQ ID NO: 947730 - DNA, 25 bp, Mus musculus
ttgacttgcttaggctcgtacctgc

SEQ ID NO: 947731 - DNA, 25 bp, Mus musculus
ttgacttggaacagtgcttgcagct

SEQ ID NO: 947732 - DNA, 25 bp, Mus musculus
ttgacttggaactgtgcttgcagct

SEQ ID NO: 947733 - DNA, 25 bp, Mus musculus
ttgacttggagcatatgcgaacagt

SEQ ID NO: 947734 - DNA, 25 bp, Mus musculus
ttgacttggagcttatgcgaacagt

SEQ ID NO: 947735 - DNA, 25 bp, Mus musculus
ttgacttggaggaagctgggtaatc

SEQ ID NO: 947736 - DNA, 25 bp, Mus musculus
ttgacttggaggtagctgggtaatc

SEQ ID NO: 947737 - DNA, 25 bp, Mus musculus
ttgacttggcttaaaaccgaagaca

SEQ ID NO: 947738 - DNA, 25 bp, Mus musculus
ttgacttggctttaaaccgaagaca

SEQ ID NO: 947739 - DNA, 25 bp, Mus musculus
ttgacttgtagaatggcccctactt

SEQ ID NO: 947740 - DNA, 25 bp, Mus musculus
ttgacttgtagattggcccctactt

SEQ ID NO: 947741 - DNA, 25 bp, Mus musculus
ttgacttgttaaatgcttgctggga

SEQ ID NO: 947742 - DNA, 25 bp, Mus musculus
ttgacttgttaattgcttgctggga

SEQ ID NO: 947743 - DNA, 25 bp, Mus musculus
ttgactttaaagagtcccatctgca

SEQ ID NO: 947744 - DNA, 25 bp, Mus musculus
ttgactttaaagtgtcccatctgca

SEQ ID NO: 947745 - DNA, 25 bp, Mus musculus
ttgactttatttcatcttacaaact

SEQ ID NO: 947746 - DNA, 25 bp, Mus musculus
ttgactttatttgatcttacaaact

SEQ ID NO: 947747 - DNA, 25 bp, Mus musculus
ttgactttcagtactttctcccagg

SEQ ID NO: 947748 - DNA, 25 bp, Mus musculus
ttgactttcagttctttctcccagg

SEQ ID NO: 947749 - DNA, 25 bp, Mus musculus
ttgactttctagctcttcgtatgaa

SEQ ID NO: 947750 - DNA, 25 bp, Mus musculus
ttgactttctaggtcttcgtatgaa

SEQ ID NO: 947751 - DNA, 25 bp, Mus musculus
ttgactttctgtatatggatggcac

SEQ ID NO: 947752 - DNA, 25 bp, Mus musculus
ttgactttctgtttatggatggcac

SEQ ID NO: 947753 - DNA, 25 bp, Mus musculus
ttgactttctttctcaccttctttt

SEQ ID NO: 947754 - DNA, 25 bp, Mus musculus
ttgactttctttgtcaccttctttt

SEQ ID NO: 947755 - DNA, 25 bp, Mus musculus
ttgactttgatgacgatggaaccct

SEQ ID NO: 947756 - DNA, 25 bp, Mus musculus
ttgactttgatgatgagccaatgac

SEQ ID NO: 947757 - DNA, 25 bp, Mus musculus
ttgactttgatgtcgatggaaccct

SEQ ID NO: 947758 - DNA, 25 bp, Mus musculus
ttgactttgatgttgagccaatgac

SEQ ID NO: 947759 - DNA, 25 bp, Mus musculus
ttgactttgcccacaacccaggtgt

SEQ ID NO: 947760 - DNA, 25 bp, Mus musculus
ttgactttgccctcaacccaggtgt

SEQ ID NO: 947761 - DNA, 25 bp, Mus musculus
ttgactttgcttaggttatgtttgt

SEQ ID NO: 947762 - DNA, 25 bp, Mus musculus
ttgactttgctttggttatgtttgt

SEQ ID NO: 947763 - DNA, 25 bp, Mus musculus
ttgactttggcgacaccatggtcca

SEQ ID NO: 947764 - DNA, 25 bp, Mus musculus
ttgactttggcgtcaccatggtcca

SEQ ID NO: 947765 - DNA, 25 bp, Mus musculus
ttgactttgtaaactctgcctgtga

SEQ ID NO: 947766 - DNA, 25 bp, Mus musculus
ttgactttgtaatctctgcctgtga

SEQ ID NO: 947767 - DNA, 25 bp, Mus musculus
ttgacttttaatctgcaattcctag

SEQ ID NO: 947768 - DNA, 25 bp, Mus musculus
ttgacttttaatgtgcaattcctag

SEQ ID NO: 947769 - DNA, 25 bp, Mus musculus
ttgacttttaccagcctttaaggat

SEQ ID NO: 947770 - DNA, 25 bp, Mus musculus
ttgacttttacctgcctttaaggat

SEQ ID NO: 947771 - DNA, 25 bp, Mus musculus
ttgacttttcacaaatgagtaaata

SEQ ID NO: 947772 - DNA, 25 bp, Mus musculus
ttgacttttcactaatgagtaaata

SEQ ID NO: 947773 - DNA, 25 bp, Mus musculus
ttgacttttcctcataatgtttatc

SEQ ID NO: 947774 - DNA, 25 bp, Mus musculus
ttgacttttcctgataatgtttatc

SEQ ID NO: 947775 - DNA, 25 bp, Mus musculus
ttgacttttgaaaccatgtgagctc

SEQ ID NO: 947776 - DNA, 25 bp, Mus musculus
ttgacttttgaatccatgtgagctc

SEQ ID NO: 947777 - DNA, 25 bp, Mus musculus
ttgacttttgacatcactggccgct

SEQ ID NO: 947778 - DNA, 25 bp, Mus musculus
ttgacttttgacttcactggccgct

SEQ ID NO: 947779 - DNA, 25 bp, Mus musculus
ttgacttttgtcaaccattgaggtt

SEQ ID NO: 947780 - DNA, 25 bp, Mus musculus
ttgacttttgtctaccattgaggtt

SEQ ID NO: 947781 - DNA, 25 bp, Mus musculus
ttgagaaaaacccatgctgcagggt

SEQ ID NO: 947782 - DNA, 25 bp, Mus musculus
ttgagaaaaaccgatgctgcagggt

SEQ ID NO: 947783 - DNA, 25 bp, Mus musculus
ttgagaaaactgaccgttccacctc

SEQ ID NO: 947784 - DNA, 25 bp, Mus musculus
ttgagaaaactgtccgttccacctc

SEQ ID NO: 947785 - DNA, 25 bp, Mus musculus
ttgagaaaagccaagacacctgccc

SEQ ID NO: 947786 - DNA, 25 bp, Mus musculus
ttgagaaaagcctagacacctgccc

SEQ ID NO: 947787 - DNA, 25 bp, Mus musculus
ttgagaaacttgctgggccagtgaa

SEQ ID NO: 947788 - DNA, 25 bp, Mus musculus
ttgagaaacttggtgggccagtgaa

SEQ ID NO: 947789 - DNA, 25 bp, Mus musculus
ttgagaaagaagctccgacgtgtct

SEQ ID NO: 947790 - DNA, 25 bp, Mus musculus
ttgagaaagaaggtccgacgtgtct

SEQ ID NO: 947791 - DNA, 25 bp, Mus musculus
ttgagaaaggatcgcctccaccctt

SEQ ID NO: 947792 - DNA, 25 bp, Mus musculus
ttgagaaaggatggcctccaccctt

SEQ ID NO: 947793 - DNA, 25 bp, Mus musculus
ttgagaaatgtgagcttagctcttt

SEQ ID NO: 947794 - DNA, 25 bp, Mus musculus
ttgagaaatgtgtgcttagctcttt

SEQ ID NO: 947795 - DNA, 25 bp, Mus musculus
ttgagaacacctctgaaccttacgg

SEQ ID NO: 947796 - DNA, 25 bp, Mus musculus
ttgagaacacctgtgaaccttacgg

SEQ ID NO: 947797 - DNA, 25 bp, Mus musculus
ttgagaacacggatgcagcctgcaa

SEQ ID NO: 947798 - DNA, 25 bp, Mus musculus
ttgagaacacggttgcagcctgcaa

SEQ ID NO: 947799 - DNA, 25 bp, Mus musculus
ttgagaacatctaacccagcagcct

SEQ ID NO: 947800 - DNA, 25 bp, Mus musculus
ttgagaacatcttacccagcagcct

SEQ ID NO: 947801 - DNA, 25 bp, Mus musculus
ttgagaacattcattccctcggaag

SEQ ID NO: 947802 - DNA, 25 bp, Mus musculus
ttgagaacattctttccctcggaag

SEQ ID NO: 947803 - DNA, 25 bp, Mus musculus
ttgagaaccaccagcagagagaact

SEQ ID NO: 947804 - DNA, 25 bp, Mus musculus
ttgagaaccacctgcagagagaact

SEQ ID NO: 947805 - DNA, 25 bp, Mus musculus
ttgagaaccactaccctagagccat

SEQ ID NO: 947806 - DNA, 25 bp, Mus musculus
ttgagaaccacttccctagagccat

SEQ ID NO: 947807 - DNA, 25 bp, Mus musculus
ttgagaaccgctcgcctagagctgt

SEQ ID NO: 947808 - DNA, 25 bp, Mus musculus
ttgagaaccgctggcctagagctgt

SEQ ID NO: 947809 - DNA, 25 bp, Mus musculus
ttgagaacctcacagaagatgcatt

SEQ ID NO: 947810 - DNA, 25 bp, Mus musculus
ttgagaacctcagagaagatgcatt

SEQ ID NO: 947811 - DNA, 25 bp, Mus musculus
ttgagaacctcgatgcggctgctgg

SEQ ID NO: 947812 - DNA, 25 bp, Mus musculus
ttgagaacctcgttgcggctgctgg

SEQ ID NO: 947813 - DNA, 25 bp, Mus musculus
ttgagaaccttgaagctgcatacag

SEQ ID NO: 947814 - DNA, 25 bp, Mus musculus
ttgagaaccttgtagctgcatacag

SEQ ID NO: 947815 - DNA, 25 bp, Mus musculus
ttgagaacgtgtcccgatgtcttcc

SEQ ID NO: 947816 - DNA, 25 bp, Mus musculus
ttgagaacgtgtgccgatgtcttcc

SEQ ID NO: 947817 - DNA, 25 bp, Mus musculus
ttgagaactaggcagacccctctat

SEQ ID NO: 947818 - DNA, 25 bp, Mus musculus
ttgagaactagggagacccctctat

SEQ ID NO: 947819 - DNA, 25 bp, Mus musculus
ttgagaactcaaacgcccgacaaga

SEQ ID NO: 947820 - DNA, 25 bp, Mus musculus
ttgagaactcaatcgcccgacaaga

SEQ ID NO: 947821 - DNA, 25 bp, Mus musculus
ttgagaactgttctgctaaagcggg

SEQ ID NO: 947822 - DNA, 25 bp, Mus musculus
ttgagaactgttgtgctaaagcggg

SEQ ID NO: 947823 - DNA, 25 bp, Mus musculus
ttgagaacttgcattacctgctaag

SEQ ID NO: 947824 - DNA, 25 bp, Mus musculus
ttgagaacttgctttacctgctaag

SEQ ID NO: 947825 - DNA, 25 bp, Mus musculus
ttgagaagacttcaggaaccagctg

SEQ ID NO: 947826 - DNA, 25 bp, Mus musculus
ttgagaagacttgaggaaccagctg

SEQ ID NO: 947827 - DNA, 25 bp, Mus musculus
ttgagaagatctctgtggtctctcc

SEQ ID NO: 947828 - DNA, 25 bp, Mus musculus
ttgagaagatctgtgtggtctctcc

SEQ ID NO: 947829 - DNA, 25 bp, Mus musculus
ttgagaagctgcaccagaacagaat

SEQ ID NO: 947830 - DNA, 25 bp, Mus musculus
ttgagaagctgctccagaacagaat

SEQ ID NO: 947831 - DNA, 25 bp, Mus musculus
ttgagaaggcacagaccaccatggt

SEQ ID NO: 947832 - DNA, 25 bp, Mus musculus
ttgagaaggcactgaccaccatggt

SEQ ID NO: 947833 - DNA, 25 bp, Mus musculus
ttgagaaggcctcactgtggctgac

SEQ ID NO: 947834 - DNA, 25 bp, Mus musculus
ttgagaaggcctgactgtggctgac

SEQ ID NO: 947835 - DNA, 25 bp, Mus musculus
ttgagaaggtggaccccaggttcaa

SEQ ID NO: 947836 - DNA, 25 bp, Mus musculus
ttgagaaggtggtccccaggttcaa

SEQ ID NO: 947837 - DNA, 25 bp, Mus musculus
ttgagaatccctcatggtggcatcc

SEQ ID NO: 947838 - DNA, 25 bp, Mus musculus
ttgagaatccctgatggtggcatcc

SEQ ID NO: 947839 - DNA, 25 bp, Mus musculus
ttgagaatcttcctatgcaacttgc

SEQ ID NO: 947840 - DNA, 25 bp, Mus musculus
ttgagaatcttcgtatgcaacttgc

SEQ ID NO: 947841 - DNA, 25 bp, Mus musculus
ttgagaatgacacggcatgctagca

SEQ ID NO: 947842 - DNA, 25 bp, Mus musculus
ttgagaatgacagggcatgctagca

SEQ ID NO: 947843 - DNA, 25 bp, Mus musculus
ttgagaatgtagaactgggcgtcat

SEQ ID NO: 947844 - DNA, 25 bp, Mus musculus
ttgagaatgtagtactgggcgtcat

SEQ ID NO: 947845 - DNA, 25 bp, Mus musculus
ttgagaattcaaccccaccagtgct

SEQ ID NO: 947846 - DNA, 25 bp, Mus musculus
ttgagaattcaagcccaccagtgct

SEQ ID NO: 947847 - DNA, 25 bp, Mus musculus
ttgagaattctacacccagtcagct

SEQ ID NO: 947848 - DNA, 25 bp, Mus musculus
ttgagaattctagacccagtcagct

SEQ ID NO: 947849 - DNA, 25 bp, Mus musculus
ttgagaattgtacttccatggcagt

SEQ ID NO: 947850 - DNA, 25 bp, Mus musculus
ttgagaattgtagttccatggcagt

SEQ ID NO: 947851 - DNA, 25 bp, Mus musculus
ttgagacaaacactccacacacagg

SEQ ID NO: 947852 - DNA, 25 bp, Mus musculus
ttgagacaaacagtccacacacagg

SEQ ID NO: 947853 - DNA, 25 bp, Mus musculus
ttgagacaagctcttctcatggagc

SEQ ID NO: 947854 - DNA, 25 bp, Mus musculus
ttgagacaagctgttctcatggagc

SEQ ID NO: 947855 - DNA, 25 bp, Mus musculus
ttgagacacacactcatacagattt

SEQ ID NO: 947856 - DNA, 25 bp, Mus musculus
ttgagacacacagtcatacagattt

SEQ ID NO: 947857 - DNA, 25 bp, Mus musculus
ttgagacacactcttctctctgctg

SEQ ID NO: 947858 - DNA, 25 bp, Mus musculus
ttgagacacactgttctctctgctg

SEQ ID NO: 947859 - DNA, 25 bp, Mus musculus
ttgagacacctacgatacggtttgt

SEQ ID NO: 947860 - DNA, 25 bp, Mus musculus
ttgagacacctaggatacggtttgt

SEQ ID NO: 947861 - DNA, 25 bp, Mus musculus
ttgagacaccttccatgagttccta

SEQ ID NO: 947862 - DNA, 25 bp, Mus musculus
ttgagacaccttgcatgagttccta

SEQ ID NO: 947863 - DNA, 25 bp, Mus musculus
ttgagacactcgctaccacatgaga

SEQ ID NO: 947864 - DNA, 25 bp, Mus musculus
ttgagacactcggtaccacatgaga

SEQ ID NO: 947865 - DNA, 25 bp, Mus musculus
ttgagacactgcatttacttctggc

SEQ ID NO: 947866 - DNA, 25 bp, Mus musculus
ttgagacactgcttttacttctggc

SEQ ID NO: 947867 - DNA, 25 bp, Mus musculus
ttgagacagaccacactacatggac

SEQ ID NO: 947868 - DNA, 25 bp, Mus musculus
ttgagacagacctcactacatggac

SEQ ID NO: 947869 - DNA, 25 bp, Mus musculus
ttgagacagagccacttctccttca

SEQ ID NO: 947870 - DNA, 25 bp, Mus musculus
ttgagacagagcgacttctccttca

SEQ ID NO: 947871 - DNA, 25 bp, Mus musculus
ttgagacagaggacggctctaaaga

SEQ ID NO: 947872 - DNA, 25 bp, Mus musculus
ttgagacagaggtcggctctaaaga

SEQ ID NO: 947873 - DNA, 25 bp, Mus musculus
ttgagacagatgcatcacttgagcc

SEQ ID NO: 947874 - DNA, 25 bp, Mus musculus
ttgagacagatggatcacttgagcc

SEQ ID NO: 947875 - DNA, 25 bp, Mus musculus
ttgagacagggcatcccagctggcg

SEQ ID NO: 947876 - DNA, 25 bp, Mus musculus
ttgagacagggcttcccagctggcg

SEQ ID NO: 947877 - DNA, 25 bp, Mus musculus
ttgagacatgtcatttccggagcat

SEQ ID NO: 947878 - DNA, 25 bp, Mus musculus
ttgagacatgtcttttccggagcat

SEQ ID NO: 947879 - DNA, 25 bp, Mus musculus
ttgagaccaaggcacttttcctcca

SEQ ID NO: 947880 - DNA, 25 bp, Mus musculus
ttgagaccaaggctttggccccttt

SEQ ID NO: 947881 - DNA, 25 bp, Mus musculus
ttgagaccaagggacttttcctcca

SEQ ID NO: 947882 - DNA, 25 bp, Mus musculus
ttgagaccaagggtttggccccttt

SEQ ID NO: 947883 - DNA, 25 bp, Mus musculus
ttgagaccaggaaaaatcagtgaac

SEQ ID NO: 947884 - DNA, 25 bp, Mus musculus
ttgagaccaggataaatcagtgaac

SEQ ID NO: 947885 - DNA, 25 bp, Mus musculus
ttgagaccagtcatgtaagactccc

SEQ ID NO: 947886 - DNA, 25 bp, Mus musculus
ttgagaccagtcttgtaagactccc

SEQ ID NO: 947887 - DNA, 25 bp, Mus musculus
ttgagacccactagagcatcactca

SEQ ID NO: 947888 - DNA, 25 bp, Mus musculus
ttgagacccacttgagcatcactca

SEQ ID NO: 947889 - DNA, 25 bp, Mus musculus
ttgagacccgttcttacgcagatct

SEQ ID NO: 947890 - DNA, 25 bp, Mus musculus
ttgagacccgttgttacgcagatct

SEQ ID NO: 947891 - DNA, 25 bp, Mus musculus
ttgagaccgtctcactgtgtaagcc

SEQ ID NO: 947892 - DNA, 25 bp, Mus musculus
ttgagaccgtctgactgtgtaagcc

SEQ ID NO: 947893 - DNA, 25 bp, Mus musculus
ttgagaccgttgactccttggagac

SEQ ID NO: 947894 - DNA, 25 bp, Mus musculus
ttgagaccgttgtctccttggagac

SEQ ID NO: 947895 - DNA, 25 bp, Mus musculus
ttgagacctaaaaaacctatgcctt

SEQ ID NO: 947896 - DNA, 25 bp, Mus musculus
ttgagacctaaataacctatgcctt

SEQ ID NO: 947897 - DNA, 25 bp, Mus musculus
ttgagacctataactggccagaccg

SEQ ID NO: 947898 - DNA, 25 bp, Mus musculus
ttgagacctatatctggccagaccg

SEQ ID NO: 947899 - DNA, 25 bp, Mus musculus
ttgagacctcagctgcctaccgtta

SEQ ID NO: 947900 - DNA, 25 bp, Mus musculus
ttgagacctcaggtgcctaccgtta

SEQ ID NO: 947901 - DNA, 25 bp, Mus musculus
ttgagacctctgagccatgcttctg

SEQ ID NO: 947902 - DNA, 25 bp, Mus musculus
ttgagacctctgtgccatgcttctg

SEQ ID NO: 947903 - DNA, 25 bp, Mus musculus
ttgagacgatacatagccaggctct

SEQ ID NO: 947904 - DNA, 25 bp, Mus musculus
ttgagacgatacttagccaggctct

SEQ ID NO: 947905 - DNA, 25 bp, Mus musculus
ttgagacgcacacaccacagtgaat

SEQ ID NO: 947906 - DNA, 25 bp, Mus musculus
ttgagacgcacagaccacagtgaat

SEQ ID NO: 947907 - DNA, 25 bp, Mus musculus
ttgagacgccgcagaggacatgccg

SEQ ID NO: 947908 - DNA, 25 bp, Mus musculus
ttgagacgccgctgaggacatgccg

SEQ ID NO: 947909 - DNA, 25 bp, Mus musculus
ttgagacgtcccatatgctctgggc

SEQ ID NO: 947910 - DNA, 25 bp, Mus musculus
ttgagacgtcccttatgctctgggc

SEQ ID NO: 947911 - DNA, 25 bp, Mus musculus
ttgagactagatatcccagtgacct

SEQ ID NO: 947912 - DNA, 25 bp, Mus musculus
ttgagactagatttcccagtgacct

SEQ ID NO: 947913 - DNA, 25 bp, Mus musculus
ttgagactcaccaaaggcttgcttt

SEQ ID NO: 947914 - DNA, 25 bp, Mus musculus
ttgagactcacctaaggcttgcttt

SEQ ID NO: 947915 - DNA, 25 bp, Mus musculus
ttgagactcgataacatctttgttg

SEQ ID NO: 947916 - DNA, 25 bp, Mus musculus
ttgagactcgattacatctttgttg

SEQ ID NO: 947917 - DNA, 25 bp, Mus musculus
ttgagactctgaacgacctatacct

SEQ ID NO: 947918 - DNA, 25 bp, Mus musculus
ttgagactctgatcgacctatacct

SEQ ID NO: 947919 - DNA, 25 bp, Mus musculus
ttgagactctggatggaccccattt

SEQ ID NO: 947920 - DNA, 25 bp, Mus musculus
ttgagactctggttggaccccattt

SEQ ID NO: 947921 - DNA, 25 bp, Mus musculus
ttgagactggtgacttaggacagat

SEQ ID NO: 947922 - DNA, 25 bp, Mus musculus
ttgagactggtgtcttaggacagat

SEQ ID NO: 947923 - DNA, 25 bp, Mus musculus
ttgagactgtctctttctgctcctc

SEQ ID NO: 947924 - DNA, 25 bp, Mus musculus
ttgagactgtctgtttctgctcctc

SEQ ID NO: 947925 - DNA, 25 bp, Mus musculus
ttgagacttacccttcattgaagag

SEQ ID NO: 947926 - DNA, 25 bp, Mus musculus
ttgagacttaccgttcattgaagag

SEQ ID NO: 947927 - DNA, 25 bp, Mus musculus
ttgagacttaggctcgtaagcaaaa

SEQ ID NO: 947928 - DNA, 25 bp, Mus musculus
ttgagacttagggtcgtaagcaaaa

SEQ ID NO: 947929 - DNA, 25 bp, Mus musculus
ttgagacttccactttggaagatat

SEQ ID NO: 947930 - DNA, 25 bp, Mus musculus
ttgagacttccagtttggaagatat

SEQ ID NO: 947931 - DNA, 25 bp, Mus musculus
ttgagacttttgagtttggtggaaa

SEQ ID NO: 947932 - DNA, 25 bp, Mus musculus
ttgagacttttgtgtttggtggaaa

SEQ ID NO: 947933 - DNA, 25 bp, Mus musculus
ttgagagaaaccaggcagcgtcccc

SEQ ID NO: 947934 - DNA, 25 bp, Mus musculus
ttgagagaaacctggcagcgtcccc

SEQ ID NO: 947935 - DNA, 25 bp, Mus musculus
ttgagagaccaaaccttaaggcttt

SEQ ID NO: 947936 - DNA, 25 bp, Mus musculus
ttgagagaccaatccttaaggcttt

SEQ ID NO: 947937 - DNA, 25 bp, Mus musculus
ttgagagacgctactggcacctgag

SEQ ID NO: 947938 - DNA, 25 bp, Mus musculus
ttgagagacgcttctggcacctgag

SEQ ID NO: 947939 - DNA, 25 bp, Mus musculus
ttgagagagcccaagctgctagcca

SEQ ID NO: 947940 - DNA, 25 bp, Mus musculus
ttgagagagccctagctgctagcca

SEQ ID NO: 947941 - DNA, 25 bp, Mus musculus
ttgagagaggagaacctaggctccc

SEQ ID NO: 947942 - DNA, 25 bp, Mus musculus
ttgagagaggagtacctaggctccc

SEQ ID NO: 947943 - DNA, 25 bp, Mus musculus
ttgagagagggcacacgcaagcata

SEQ ID NO: 947944 - DNA, 25 bp, Mus musculus
ttgagagagggctcacgcaagcata

SEQ ID NO: 947945 - DNA, 25 bp, Mus musculus
ttgagagatgcacctccttttgcca

SEQ ID NO: 947946 - DNA, 25 bp, Mus musculus
ttgagagatgcagctccttttgcca

SEQ ID NO: 947947 - DNA, 25 bp, Mus musculus
ttgagagattcccagtgtcagcctc

SEQ ID NO: 947948 - DNA, 25 bp, Mus musculus
ttgagagattccgagtgtcagcctc

SEQ ID NO: 947949 - DNA, 25 bp, Mus musculus
ttgagagcaacaccctatcacagta

SEQ ID NO: 947950 - DNA, 25 bp, Mus musculus
ttgagagcaacagcctatcacagta

SEQ ID NO: 947951 - DNA, 25 bp, Mus musculus
ttgagagcaagtacaacccctcagc

SEQ ID NO: 947952 - DNA, 25 bp, Mus musculus
ttgagagcaagttcaacccctcagc

SEQ ID NO: 947953 - DNA, 25 bp, Mus musculus
ttgagagcagcaacgaatccttggg

SEQ ID NO: 947954 - DNA, 25 bp, Mus musculus
ttgagagcagcatcgaatccttggg

SEQ ID NO: 947955 - DNA, 25 bp, Mus musculus
ttgagagcagtgctgccaagctaaa

SEQ ID NO: 947956 - DNA, 25 bp, Mus musculus
ttgagagcagtggtgccaagctaaa

SEQ ID NO: 947957 - DNA, 25 bp, Mus musculus
ttgagagcatagaccatcatggtgg

SEQ ID NO: 947958 - DNA, 25 bp, Mus musculus
ttgagagcatagtccatcatggtgg

SEQ ID NO: 947959 - DNA, 25 bp, Mus musculus
ttgagagccagtaccaagctgtgag

SEQ ID NO: 947960 - DNA, 25 bp, Mus musculus
ttgagagccagttccaagctgtgag

SEQ ID NO: 947961 - DNA, 25 bp, Mus musculus
ttgagagcccctcaggttccagtgg

SEQ ID NO: 947962 - DNA, 25 bp, Mus musculus
ttgagagcccctcctacatgcgatg

SEQ ID NO: 947963 - DNA, 25 bp, Mus musculus
ttgagagcccctgaggttccagtgg

SEQ ID NO: 947964 - DNA, 25 bp, Mus musculus
ttgagagcccctgctacatgcgatg

SEQ ID NO: 947965 - DNA, 25 bp, Mus musculus
ttgagagcccttagggcattcacct

SEQ ID NO: 947966 - DNA, 25 bp, Mus musculus
ttgagagccctttgggcattcacct

SEQ ID NO: 947967 - DNA, 25 bp, Mus musculus
ttgagagccttcagtggtcccctaa

SEQ ID NO: 947968 - DNA, 25 bp, Mus musculus
ttgagagccttctgtggtcccctaa

SEQ ID NO: 947969 - DNA, 25 bp, Mus musculus
ttgagagcgcccacctttacacact

SEQ ID NO: 947970 - DNA, 25 bp, Mus musculus
ttgagagcgcccagcagaactagct

SEQ ID NO: 947971 - DNA, 25 bp, Mus musculus
ttgagagcgccctcctttacacact

SEQ ID NO: 947972 - DNA, 25 bp, Mus musculus
ttgagagcgccctgcagaactagct

SEQ ID NO: 947973 - DNA, 25 bp, Mus musculus
ttgagagcgcgcacagagccattgt

SEQ ID NO: 947974 - DNA, 25 bp, Mus musculus
ttgagagcgcgctcagagccattgt

SEQ ID NO: 947975 - DNA, 25 bp, Mus musculus
ttgagagctgctaccctgaaaagat

SEQ ID NO: 947976 - DNA, 25 bp, Mus musculus
ttgagagctgcttccctgaaaagat

SEQ ID NO: 947977 - DNA, 25 bp, Mus musculus
ttgagagctgtccttttttggttaa

SEQ ID NO: 947978 - DNA, 25 bp, Mus musculus
ttgagagctgtcgttttttggttaa

SEQ ID NO: 947979 - DNA, 25 bp, Mus musculus
ttgagaggacctcctgccactactt

SEQ ID NO: 947980 - DNA, 25 bp, Mus musculus
ttgagaggacctgctgccactactt

SEQ ID NO: 947981 - DNA, 25 bp, Mus musculus
ttgagaggatctacgagctggcccg

SEQ ID NO: 947982 - DNA, 25 bp, Mus musculus
ttgagaggatcttcgagctggcccg

SEQ ID NO: 947983 - DNA, 25 bp, Mus musculus
ttgagaggcgctatgattaccccga

SEQ ID NO: 947984 - DNA, 25 bp, Mus musculus
ttgagaggcgctttgattaccccga

SEQ ID NO: 947985 - DNA, 25 bp, Mus musculus
ttgagagggacaagccatcttgact

SEQ ID NO: 947986 - DNA, 25 bp, Mus musculus
ttgagagggacatgccatcttgact

SEQ ID NO: 947987 - DNA, 25 bp, Mus musculus
ttgagagtcaccagtagccaaagtc

SEQ ID NO: 947988 - DNA, 25 bp, Mus musculus
ttgagagtcacctgtagccaaagtc

SEQ ID NO: 947989 - DNA, 25 bp, Mus musculus
ttgagagtcactcttgtccactgga

SEQ ID NO: 947990 - DNA, 25 bp, Mus musculus
ttgagagtcactgttgtccactgga

SEQ ID NO: 947991 - DNA, 25 bp, Mus musculus
ttgagagtcttcattggtcagctga

SEQ ID NO: 947992 - DNA, 25 bp, Mus musculus
ttgagagtcttctttggtcagctga

SEQ ID NO: 947993 - DNA, 25 bp, Mus musculus
ttgagagtgctcatctgccgcaaaa

SEQ ID NO: 947994 - DNA, 25 bp, Mus musculus
ttgagagtgctcttctgccgcaaaa

SEQ ID NO: 947995 - DNA, 25 bp, Mus musculus
ttgagagtggtgcattttctgccct

SEQ ID NO: 947996 - DNA, 25 bp, Mus musculus
ttgagagtggtggattttctgccct

SEQ ID NO: 947997 - DNA, 25 bp, Mus musculus
ttgagagtgtgtccaccatagctcc

SEQ ID NO: 947998 - DNA, 25 bp, Mus musculus
ttgagagtgtgtgcaccatagctcc

SEQ ID NO: 947999 - DNA, 25 bp, Mus musculus
ttgagagttcaaaccggcttgatga

SEQ ID NO: 948000 - DNA, 25 bp, Mus musculus
ttgagagttcaatccggcttgatga

SEQ ID NO: 948001 - DNA, 25 bp, Mus musculus
ttgagagttggtaagatggcacagt

SEQ ID NO: 948002 - DNA, 25 bp, Mus musculus
ttgagagttggttagatggcacagt

SEQ ID NO: 948003 - DNA, 25 bp, Mus musculus
ttgagagttgtcatcttttgcctgg

SEQ ID NO: 948004 - DNA, 25 bp, Mus musculus
ttgagagttgtcttcttttgcctgg

SEQ ID NO: 948005 - DNA, 25 bp, Mus musculus
ttgagataaagtctctctatgtaac

SEQ ID NO: 948006 - DNA, 25 bp, Mus musculus
ttgagataaagtgtctctatgtaac

SEQ ID NO: 948007 - DNA, 25 bp, Mus musculus
ttgagataaattccccttccctagc

SEQ ID NO: 948008 - DNA, 25 bp, Mus musculus
ttgagataaattgcccttccctagc

SEQ ID NO: 948009 - DNA, 25 bp, Mus musculus
ttgagataacttagtctccctcggc

SEQ ID NO: 948010 - DNA, 25 bp, Mus musculus
ttgagataactttgtctccctcggc

SEQ ID NO: 948011 - DNA, 25 bp, Mus musculus
ttgagataattactccctaccggag

SEQ ID NO: 948012 - DNA, 25 bp, Mus musculus
ttgagataattagtccctaccggag

SEQ ID NO: 948013 - DNA, 25 bp, Mus musculus
ttgagataccacaccggattgaatt

SEQ ID NO: 948014 - DNA, 25 bp, Mus musculus
ttgagataccactccggattgaatt

SEQ ID NO: 948015 - DNA, 25 bp, Mus musculus
ttgagatactcccaagctgcagagg

SEQ ID NO: 948016 - DNA, 25 bp, Mus musculus
ttgagatactccctgaagcttctgg

SEQ ID NO: 948017 - DNA, 25 bp, Mus musculus
ttgagatactccgaagctgcagagg

SEQ ID NO: 948018 - DNA, 25 bp, Mus musculus
ttgagatactccgtgaagcttctgg

SEQ ID NO: 948019 - DNA, 25 bp, Mus musculus
ttgagatagccaacaaaaccagcag

SEQ ID NO: 948020 - DNA, 25 bp, Mus musculus
ttgagatagccatcaaaaccagcag

SEQ ID NO: 948021 - DNA, 25 bp, Mus musculus
ttgagatatccaccacatcacactt

SEQ ID NO: 948022 - DNA, 25 bp, Mus musculus
ttgagatatccagcacatcacactt

SEQ ID NO: 948023 - DNA, 25 bp, Mus musculus
ttgagatatctgcttggccaataac

SEQ ID NO: 948024 - DNA, 25 bp, Mus musculus
ttgagatatctggttggccaataac

SEQ ID NO: 948025 - DNA, 25 bp, Mus musculus
ttgagatatgtacctgcatgcagta

SEQ ID NO: 948026 - DNA, 25 bp, Mus musculus
ttgagatatgtagctgcatgcagta

SEQ ID NO: 948027 - DNA, 25 bp, Mus musculus
ttgagatattcgagcacctgctggc

SEQ ID NO: 948028 - DNA, 25 bp, Mus musculus
ttgagatattcgtgcacctgctggc

SEQ ID NO: 948029 - DNA, 25 bp, Mus musculus
ttgagatcaccaatgaacacccaca

SEQ ID NO: 948030 - DNA, 25 bp, Mus musculus
ttgagatcaccattgaacacccaca

SEQ ID NO: 948031 - DNA, 25 bp, Mus musculus
ttgagatcagttataattcctcctt

SEQ ID NO: 948032 - DNA, 25 bp, Mus musculus
ttgagatcagttttaattcctcctt

SEQ ID NO: 948033 - DNA, 25 bp, Mus musculus
ttgagatcgtctctggtcaacttac

SEQ ID NO: 948034 - DNA, 25 bp, Mus musculus
ttgagatcgtctgtggtcaacttac

SEQ ID NO: 948035 - DNA, 25 bp, Mus musculus
ttgagatctcccctttgtaggactt

SEQ ID NO: 948036 - DNA, 25 bp, Mus musculus
ttgagatctcccgtttgtaggactt

SEQ ID NO: 948037 - DNA, 25 bp, Mus musculus
ttgagatctcctctaaacgttccct

SEQ ID NO: 948038 - DNA, 25 bp, Mus musculus
ttgagatctcctgtaaacgttccct

SEQ ID NO: 948039 - DNA, 25 bp, Mus musculus
ttgagatgatacactgtgtccctgg

SEQ ID NO: 948040 - DNA, 25 bp, Mus musculus
ttgagatgatactctgtgtccctgg

SEQ ID NO: 948041 - DNA, 25 bp, Mus musculus
ttgagatgatcaccatggccacaca

SEQ ID NO: 948042 - DNA, 25 bp, Mus musculus
ttgagatgatcagcatggccacaca

SEQ ID NO: 948043 - DNA, 25 bp, Mus musculus
ttgagatgatccacactgagaagga

SEQ ID NO: 948044 - DNA, 25 bp, Mus musculus
ttgagatgatcctcactgagaagga

SEQ ID NO: 948045 - DNA, 25 bp, Mus musculus
ttgagatgcaccctgctctcagtaa

SEQ ID NO: 948046 - DNA, 25 bp, Mus musculus
ttgagatgcaccgtgctctcagtaa

SEQ ID NO: 948047 - DNA, 25 bp, Mus musculus
ttgagatgccagctactgtggacat

SEQ ID NO: 948048 - DNA, 25 bp, Mus musculus
ttgagatgccaggtactgtggacat

SEQ ID NO: 948049 - DNA, 25 bp, Mus musculus
ttgagatgccccagcactgatcggg

SEQ ID NO: 948050 - DNA, 25 bp, Mus musculus
ttgagatgcccctgcactgatcggg

SEQ ID NO: 948051 - DNA, 25 bp, Mus musculus
ttgagatgcttacctccactgctgt

SEQ ID NO: 948052 - DNA, 25 bp, Mus musculus
ttgagatgcttagctccactgctgt

SEQ ID NO: 948053 - DNA, 25 bp, Mus musculus
ttgagatggaccctgcccttcggcg

SEQ ID NO: 948054 - DNA, 25 bp, Mus musculus
ttgagatggaccgtgcccttcggcg

SEQ ID NO: 948055 - DNA, 25 bp, Mus musculus
ttgagatggagtatactatgtgggt

SEQ ID NO: 948056 - DNA, 25 bp, Mus musculus
ttgagatggagtttactatgtgggt

SEQ ID NO: 948057 - DNA, 25 bp, Mus musculus
ttgagatggcctatgacagtatccc

SEQ ID NO: 948058 - DNA, 25 bp, Mus musculus
ttgagatggcctttgacagtatccc

SEQ ID NO: 948059 - DNA, 25 bp, Mus musculus
ttgagatgtattctttttgatggct

SEQ ID NO: 948060 - DNA, 25 bp, Mus musculus
ttgagatgtattgtttttgatggct

SEQ ID NO: 948061 - DNA, 25 bp, Mus musculus
ttgagatgtctcactgcatggcagg

SEQ ID NO: 948062 - DNA, 25 bp, Mus musculus
ttgagatgtctctctgcatggcagg

SEQ ID NO: 948063 - DNA, 25 bp, Mus musculus
ttgagattaattattcacctttgta

SEQ ID NO: 948064 - DNA, 25 bp, Mus musculus
ttgagattaatttttcacctttgta

SEQ ID NO: 948065 - DNA, 25 bp, Mus musculus
ttgagattagctccttctccgcaaa

SEQ ID NO: 948066 - DNA, 25 bp, Mus musculus
ttgagattagctgcttctccgcaaa

SEQ ID NO: 948067 - DNA, 25 bp, Mus musculus
ttgagattagttaccagcatatgca

SEQ ID NO: 948068 - DNA, 25 bp, Mus musculus
ttgagattagtttccagcatatgca

SEQ ID NO: 948069 - DNA, 25 bp, Mus musculus
ttgagattctaccagcttgcaggct

SEQ ID NO: 948070 - DNA, 25 bp, Mus musculus
ttgagattctacgagcttgcaggct

SEQ ID NO: 948071 - DNA, 25 bp, Mus musculus
ttgagattgctcactcagtgaccac

SEQ ID NO: 948072 - DNA, 25 bp, Mus musculus
ttgagattgctctctcagtgaccac

SEQ ID NO: 948073 - DNA, 25 bp, Mus musculus
ttgagattgtggcatcagtgataat

SEQ ID NO: 948074 - DNA, 25 bp, Mus musculus
ttgagattgtgggatcagtgataat

SEQ ID NO: 948075 - DNA, 25 bp, Mus musculus
ttgagatttcctctgctcaggttac

SEQ ID NO: 948076 - DNA, 25 bp, Mus musculus
ttgagatttcctgtgctcaggttac

SEQ ID NO: 948077 - DNA, 25 bp, Mus musculus
ttgagatttctaaacccgtggttat

SEQ ID NO: 948078 - DNA, 25 bp, Mus musculus
ttgagatttctatacccgtggttat

SEQ ID NO: 948079 - DNA, 25 bp, Mus musculus
ttgagatttctgagggaaacgttga

SEQ ID NO: 948080 - DNA, 25 bp, Mus musculus
ttgagatttctgtgggaaacgttga

SEQ ID NO: 948081 - DNA, 25 bp, Mus musculus
ttgagcaaagtcacctagtgacagc

SEQ ID NO: 948082 - DNA, 25 bp, Mus musculus
ttgagcaaagtctcctagtgacagc

SEQ ID NO: 948083 - DNA, 25 bp, Mus musculus
ttgagcaaatttctcctcatcttta

SEQ ID NO: 948084 - DNA, 25 bp, Mus musculus
ttgagcaaatttgtcctcatcttta

SEQ ID NO: 948085 - DNA, 25 bp, Mus musculus
ttgagcaacatcagtaccgtgcggg

SEQ ID NO: 948086 - DNA, 25 bp, Mus musculus
ttgagcaacatctgtaccgtgcggg

SEQ ID NO: 948087 - DNA, 25 bp, Mus musculus
ttgagcaacgttccaatccctgagg

SEQ ID NO: 948088 - DNA, 25 bp, Mus musculus
ttgagcaacgttgcaatccctgagg

SEQ ID NO: 948089 - DNA, 25 bp, Mus musculus
ttgagcaactctcgtcatggactgt

SEQ ID NO: 948090 - DNA, 25 bp, Mus musculus
ttgagcaactctggtcatggactgt

SEQ ID NO: 948091 - DNA, 25 bp, Mus musculus
ttgagcaagaagacgcagagccttt

SEQ ID NO: 948092 - DNA, 25 bp, Mus musculus
ttgagcaagaagtcgcagagccttt

SEQ ID NO: 948093 - DNA, 25 bp, Mus musculus
ttgagcaagcatccttccttacagg

SEQ ID NO: 948094 - DNA, 25 bp, Mus musculus
ttgagcaagcatgcttccttacagg

SEQ ID NO: 948095 - DNA, 25 bp, Mus musculus
ttgagcaagctaaaccaaagtgagg

SEQ ID NO: 948096 - DNA, 25 bp, Mus musculus
ttgagcaagctataccaaagtgagg

SEQ ID NO: 948097 - DNA, 25 bp, Mus musculus
ttgagcaagtgtagcttttctgaaa

SEQ ID NO: 948098 - DNA, 25 bp, Mus musculus
ttgagcaagtgttgcttttctgaaa

SEQ ID NO: 948099 - DNA, 25 bp, Mus musculus
ttgagcaataacaggtctgtgatgc

SEQ ID NO: 948100 - DNA, 25 bp, Mus musculus
ttgagcaataactggtctgtgatgc

SEQ ID NO: 948101 - DNA, 25 bp, Mus musculus
ttgagcaatgcacacttattcccgt

SEQ ID NO: 948102 - DNA, 25 bp, Mus musculus
ttgagcaatgcagacttattcccgt

SEQ ID NO: 948103 - DNA, 25 bp, Mus musculus
ttgagcaattcccttgaggatagta

SEQ ID NO: 948104 - DNA, 25 bp, Mus musculus
ttgagcaattccgttgaggatagta

SEQ ID NO: 948105 - DNA, 25 bp, Mus musculus
ttgagcacactgatcaaccactgac

SEQ ID NO: 948106 - DNA, 25 bp, Mus musculus
ttgagcacactgttcaaccactgac

SEQ ID NO: 948107 - DNA, 25 bp, Mus musculus
ttgagcacagctagggcagtacctt

SEQ ID NO: 948108 - DNA, 25 bp, Mus musculus
ttgagcacagcttgggcagtacctt

SEQ ID NO: 948109 - DNA, 25 bp, Mus musculus
ttgagcacaggcctttcagcagttg

SEQ ID NO: 948110 - DNA, 25 bp, Mus musculus
ttgagcacaggcgtttcagcagttg

SEQ ID NO: 948111 - DNA, 25 bp, Mus musculus
ttgagcacatcacgaggccccaggg

SEQ ID NO: 948112 - DNA, 25 bp, Mus musculus
ttgagcacatcaggaggccccaggg

SEQ ID NO: 948113 - DNA, 25 bp, Mus musculus
ttgagcaccacacaaaggctgggat

SEQ ID NO: 948114 - DNA, 25 bp, Mus musculus
ttgagcaccacagaaaggctgggat

SEQ ID NO: 948115 - DNA, 25 bp, Mus musculus
ttgagcaccctccaaattttggacg

SEQ ID NO: 948116 - DNA, 25 bp, Mus musculus
ttgagcaccctcgaaattttggacg

SEQ ID NO: 948117 - DNA, 25 bp, Mus musculus
ttgagcaccgggaacccaggctttg

SEQ ID NO: 948118 - DNA, 25 bp, Mus musculus
ttgagcaccgggtacccaggctttg

SEQ ID NO: 948119 - DNA, 25 bp, Mus musculus
ttgagcactgctaggctgcctgtaa

SEQ ID NO: 948120 - DNA, 25 bp, Mus musculus
ttgagcactgcttggctgcctgtaa

SEQ ID NO: 948121 - DNA, 25 bp, Mus musculus
ttgagcacttccagcccatgctgca

SEQ ID NO: 948122 - DNA, 25 bp, Mus musculus
ttgagcacttcctgcccatgctgca

SEQ ID NO: 948123 - DNA, 25 bp, Mus musculus
ttgagcagaagcatcgtgcctgtca

SEQ ID NO: 948124 - DNA, 25 bp, Mus musculus
ttgagcagaagcttcgtgcctgtca

SEQ ID NO: 948125 - DNA, 25 bp, Mus musculus
ttgagcagacaaacaccttatattt

SEQ ID NO: 948126 - DNA, 25 bp, Mus musculus
ttgagcagacaatcaccttatattt

SEQ ID NO: 948127 - DNA, 25 bp, Mus musculus
ttgagcagacttacttggtttttta

SEQ ID NO: 948128 - DNA, 25 bp, Mus musculus
ttgagcagactttcttggtttttta

SEQ ID NO: 948129 - DNA, 25 bp, Mus musculus
ttgagcagaggcacacagatgcatt

SEQ ID NO: 948130 - DNA, 25 bp, Mus musculus
ttgagcagaggctcacagatgcatt

SEQ ID NO: 948131 - DNA, 25 bp, Mus musculus
ttgagcagatgcatccaaggaggcg

SEQ ID NO: 948132 - DNA, 25 bp, Mus musculus
ttgagcagatgcttccaaggaggcg

SEQ ID NO: 948133 - DNA, 25 bp, Mus musculus
ttgagcagcagtatttacaataacc

SEQ ID NO: 948134 - DNA, 25 bp, Mus musculus
ttgagcagcagtttttacaataacc

SEQ ID NO: 948135 - DNA, 25 bp, Mus musculus
ttgagcagccagcagcagtctgtct

SEQ ID NO: 948136 - DNA, 25 bp, Mus musculus
ttgagcagccaggagcagtctgtct

SEQ ID NO: 948137 - DNA, 25 bp, Mus musculus
ttgagcagcccaagcaactgtattt

SEQ ID NO: 948138 - DNA, 25 bp, Mus musculus
ttgagcagcccatgcaactgtattt

SEQ ID NO: 948139 - DNA, 25 bp, Mus musculus
ttgagcagccgtccagaacctttgg

SEQ ID NO: 948140 - DNA, 25 bp, Mus musculus
ttgagcagccgtgcagaacctttgg

SEQ ID NO: 948141 - DNA, 25 bp, Mus musculus
ttgagcagctggctgcctaatgctg

SEQ ID NO: 948142 - DNA, 25 bp, Mus musculus
ttgagcagctgggtgcctaatgctg

SEQ ID NO: 948143 - DNA, 25 bp, Mus musculus
ttgagcagcttgaccgacaggaaag

SEQ ID NO: 948144 - DNA, 25 bp, Mus musculus
ttgagcagcttgtccgacaggaaag

SEQ ID NO: 948145 - DNA, 25 bp, Mus musculus
ttgagcaggcataggaagcccactg

SEQ ID NO: 948146 - DNA, 25 bp, Mus musculus
ttgagcaggcattggaagcccactg

SEQ ID NO: 948147 - DNA, 25 bp, Mus musculus
ttgagcaggtggaggatttgcccct

SEQ ID NO: 948148 - DNA, 25 bp, Mus musculus
ttgagcaggtggtggatttgcccct

SEQ ID NO: 948149 - DNA, 25 bp, Mus musculus
ttgagcagtcacattagagtccaag

SEQ ID NO: 948150 - DNA, 25 bp, Mus musculus
ttgagcagtcactttagagtccaag

SEQ ID NO: 948151 - DNA, 25 bp, Mus musculus
ttgagcagtgctactgggccagaat

SEQ ID NO: 948152 - DNA, 25 bp, Mus musculus
ttgagcagtgctctcacacttgtca

SEQ ID NO: 948153 - DNA, 25 bp, Mus musculus
ttgagcagtgctgtcacacttgtca

SEQ ID NO: 948154 - DNA, 25 bp, Mus musculus
ttgagcagtgcttctgggccagaat

SEQ ID NO: 948155 - DNA, 25 bp, Mus musculus
ttgagcagtgtcaagtcttctgcct

SEQ ID NO: 948156 - DNA, 25 bp, Mus musculus
ttgagcagtgtctagtcttctgcct

SEQ ID NO: 948157 - DNA, 25 bp, Mus musculus
ttgagcagtgtgacacatgtccctg

SEQ ID NO: 948158 - DNA, 25 bp, Mus musculus
ttgagcagtgtgtcacatgtccctg

SEQ ID NO: 948159 - DNA, 25 bp, Mus musculus
ttgagcagttgacttaggccgttct

SEQ ID NO: 948160 - DNA, 25 bp, Mus musculus
ttgagcagttgagttaggccgttct

SEQ ID NO: 948161 - DNA, 25 bp, Mus musculus
ttgagcagtttcacccgttgcagat

SEQ ID NO: 948162 - DNA, 25 bp, Mus musculus
ttgagcagtttctcccgttgcagat

SEQ ID NO: 948163 - DNA, 25 bp, Mus musculus
ttgagcatcactcagagactatcta

SEQ ID NO: 948164 - DNA, 25 bp, Mus musculus
ttgagcatcactgagagactatcta

SEQ ID NO: 948165 - DNA, 25 bp, Mus musculus
ttgagcatcagactatcacaacccc

SEQ ID NO: 948166 - DNA, 25 bp, Mus musculus
ttgagcatcagagtatcacaacccc

SEQ ID NO: 948167 - DNA, 25 bp, Mus musculus
ttgagcatcagtctagagccagggc

SEQ ID NO: 948168 - DNA, 25 bp, Mus musculus
ttgagcatcagtgtagagccagggc

SEQ ID NO: 948169 - DNA, 25 bp, Mus musculus
ttgagcatccggcagcaacacagga

SEQ ID NO: 948170 - DNA, 25 bp, Mus musculus
ttgagcatccgggagcaacacagga

SEQ ID NO: 948171 - DNA, 25 bp, Mus musculus
ttgagcatcctacagtcacagagcc

SEQ ID NO: 948172 - DNA, 25 bp, Mus musculus
ttgagcatcctagagtcacagagcc

SEQ ID NO: 948173 - DNA, 25 bp, Mus musculus
ttgagcatcctcagtacatgtgtgc

SEQ ID NO: 948174 - DNA, 25 bp, Mus musculus
ttgagcatcctctgtacatgtgtgc

SEQ ID NO: 948175 - DNA, 25 bp, Mus musculus
ttgagcatcggaattcctgcctgtg

SEQ ID NO: 948176 - DNA, 25 bp, Mus musculus
ttgagcatcggatttcctgcctgtg

SEQ ID NO: 948177 - DNA, 25 bp, Mus musculus
ttgagcatctcactccagtagggtg

SEQ ID NO: 948178 - DNA, 25 bp, Mus musculus
ttgagcatctcagtccagtagggtg

SEQ ID NO: 948179 - DNA, 25 bp, Mus musculus
ttgagcatctccatcgtatacatct

SEQ ID NO: 948180 - DNA, 25 bp, Mus musculus
ttgagcatctccttcgtatacatct

SEQ ID NO: 948181 - DNA, 25 bp, Mus musculus
ttgagcatctgaaacctggcacaca

SEQ ID NO: 948182 - DNA, 25 bp, Mus musculus
ttgagcatctgatacctggcacaca

SEQ ID NO: 948183 - DNA, 25 bp, Mus musculus
ttgagcatgaaaagtccttccccat

SEQ ID NO: 948184 - DNA, 25 bp, Mus musculus
ttgagcatgaaatgtccttccccat

SEQ ID NO: 948185 - DNA, 25 bp, Mus musculus
ttgagcatgcgcacagcctcgcaga

SEQ ID NO: 948186 - DNA, 25 bp, Mus musculus
ttgagcatgcgctcagcctcgcaga

SEQ ID NO: 948187 - DNA, 25 bp, Mus musculus
ttgagcatgctcagtacacatttcc

SEQ ID NO: 948188 - DNA, 25 bp, Mus musculus
ttgagcatgctctgtacacatttcc

SEQ ID NO: 948189 - DNA, 25 bp, Mus musculus
ttgagcatggtacgtgcttaccttt

SEQ ID NO: 948190 - DNA, 25 bp, Mus musculus
ttgagcatggtaggtgcttaccttt

SEQ ID NO: 948191 - DNA, 25 bp, Mus musculus
ttgagcattcctaaattgttgtcat

SEQ ID NO: 948192 - DNA, 25 bp, Mus musculus
ttgagcattccttaattgttgtcat

SEQ ID NO: 948193 - DNA, 25 bp, Mus musculus
ttgagcattctaatccatgttaaag

SEQ ID NO: 948194 - DNA, 25 bp, Mus musculus
ttgagcattctattccatgttaaag

SEQ ID NO: 948195 - DNA, 25 bp, Mus musculus
ttgagcattgtgacacccaggatcc

SEQ ID NO: 948196 - DNA, 25 bp, Mus musculus
ttgagcattgtgtcacccaggatcc

SEQ ID NO: 948197 - DNA, 25 bp, Mus musculus
ttgagcattgttatcttcccacgtc

SEQ ID NO: 948198 - DNA, 25 bp, Mus musculus
ttgagcattgttttcttcccacgtc

SEQ ID NO: 948199 - DNA, 25 bp, Mus musculus
ttgagcatttgtagcttcctgttgc

SEQ ID NO: 948200 - DNA, 25 bp, Mus musculus
ttgagcatttgttgcttcctgttgc

SEQ ID NO: 948201 - DNA, 25 bp, Mus musculus
ttgagccaacaccttcactgaaata

SEQ ID NO: 948202 - DNA, 25 bp, Mus musculus
ttgagccaacacgttcactgaaata

SEQ ID NO: 948203 - DNA, 25 bp, Mus musculus
ttgagccacattacagcttaggaaa

SEQ ID NO: 948204 - DNA, 25 bp, Mus musculus
ttgagccacattctatattattctg

SEQ ID NO: 948205 - DNA, 25 bp, Mus musculus
ttgagccacattgtatattattctg

SEQ ID NO: 948206 - DNA, 25 bp, Mus musculus
ttgagccacatttcagcttaggaaa

SEQ ID NO: 948207 - DNA, 25 bp, Mus musculus
ttgagccagctccattgctacttat

SEQ ID NO: 948208 - DNA, 25 bp, Mus musculus
ttgagccagctcgattgctacttat

SEQ ID NO: 948209 - DNA, 25 bp, Mus musculus
ttgagccatagaccgcagttagccc

SEQ ID NO: 948210 - DNA, 25 bp, Mus musculus
ttgagccatagagcgcagttagccc

SEQ ID NO: 948211 - DNA, 25 bp, Mus musculus
ttgagccatctccatagccacagta

SEQ ID NO: 948212 - DNA, 25 bp, Mus musculus
ttgagccatctcgatagccacagta

SEQ ID NO: 948213 - DNA, 25 bp, Mus musculus
ttgagccatgtgaaactgatgtttt

SEQ ID NO: 948214 - DNA, 25 bp, Mus musculus
ttgagccatgtgtaactgatgtttt

SEQ ID NO: 948215 - DNA, 25 bp, Mus musculus
ttgagccattccatccagtgcgttg

SEQ ID NO: 948216 - DNA, 25 bp, Mus musculus
ttgagccattccttccagtgcgttg

SEQ ID NO: 948217 - DNA, 25 bp, Mus musculus
ttgagccattggaactcaaggcccc

SEQ ID NO: 948218 - DNA, 25 bp, Mus musculus
ttgagccattggcaagcctctcgac

SEQ ID NO: 948219 - DNA, 25 bp, Mus musculus
ttgagccattgggaagcctctcgac

SEQ ID NO: 948220 - DNA, 25 bp, Mus musculus
ttgagccattggtactcaaggcccc

SEQ ID NO: 948221 - DNA, 25 bp, Mus musculus
ttgagcccaaggaggaggtaacttt

SEQ ID NO: 948222 - DNA, 25 bp, Mus musculus
ttgagcccaaggtggaggtaacttt

SEQ ID NO: 948223 - DNA, 25 bp, Mus musculus
ttgagcccaatgatatgtattctac

SEQ ID NO: 948224 - DNA, 25 bp, Mus musculus
ttgagcccaatgttatgtattctac

SEQ ID NO: 948225 - DNA, 25 bp, Mus musculus
ttgagcccacagatcaccaaggaaa

SEQ ID NO: 948226 - DNA, 25 bp, Mus musculus
ttgagcccacagttcaccaaggaaa

SEQ ID NO: 948227 - DNA, 25 bp, Mus musculus
ttgagcccagttaaagtctctcctc

SEQ ID NO: 948228 - DNA, 25 bp, Mus musculus
ttgagcccagttagccctatatagt

SEQ ID NO: 948229 - DNA, 25 bp, Mus musculus
ttgagcccagtttaagtctctcctc

SEQ ID NO: 948230 - DNA, 25 bp, Mus musculus
ttgagcccagtttgccctatatagt

SEQ ID NO: 948231 - DNA, 25 bp, Mus musculus
ttgagcccatttcgcccacgtggtt

SEQ ID NO: 948232 - DNA, 25 bp, Mus musculus
ttgagcccatttggcccacgtggtt

SEQ ID NO: 948233 - DNA, 25 bp, Mus musculus
ttgagccccacgaggagcttgcttg

SEQ ID NO: 948234 - DNA, 25 bp, Mus musculus
ttgagccccacgtggagcttgcttg

SEQ ID NO: 948235 - DNA, 25 bp, Mus musculus
ttgagccccagaccctaaagactgt

SEQ ID NO: 948236 - DNA, 25 bp, Mus musculus
ttgagccccagagcctaaagactgt

SEQ ID NO: 948237 - DNA, 25 bp, Mus musculus
ttgagccccaggcttttgttttcat

SEQ ID NO: 948238 - DNA, 25 bp, Mus musculus
ttgagccccagggttttgttttcat

SEQ ID NO: 948239 - DNA, 25 bp, Mus musculus
ttgagcccccaaacaacctgataaa

SEQ ID NO: 948240 - DNA, 25 bp, Mus musculus
ttgagcccccaatcaacctgataaa

SEQ ID NO: 948241 - DNA, 25 bp, Mus musculus
ttgagccccgaactattgaagattt

SEQ ID NO: 948242 - DNA, 25 bp, Mus musculus
ttgagccccgaagtattgaagattt

SEQ ID NO: 948243 - DNA, 25 bp, Mus musculus
ttgagccccgtcactaaggtggaaa

SEQ ID NO: 948244 - DNA, 25 bp, Mus musculus
ttgagccccgtctctaaggtggaaa

SEQ ID NO: 948245 - DNA, 25 bp, Mus musculus
ttgagcccgggtccttgagctcacg

SEQ ID NO: 948246 - DNA, 25 bp, Mus musculus
ttgagcccgggtgcttgagctcacg

SEQ ID NO: 948247 - DNA, 25 bp, Mus musculus
ttgagccctaataacatccattgtg

SEQ ID NO: 948248 - DNA, 25 bp, Mus musculus
ttgagccctaattacatccattgtg

SEQ ID NO: 948249 - DNA, 25 bp, Mus musculus
ttgagccctatgaggaaagcattgt

SEQ ID NO: 948250 - DNA, 25 bp, Mus musculus
ttgagccctatgtggaaagcattgt

SEQ ID NO: 948251 - DNA, 25 bp, Mus musculus
ttgagccctccgaagatgagattca

SEQ ID NO: 948252 - DNA, 25 bp, Mus musculus
ttgagccctccgtagatgagattca

SEQ ID NO: 948253 - DNA, 25 bp, Mus musculus
ttgagccctgacagccagcgataga

SEQ ID NO: 948254 - DNA, 25 bp, Mus musculus
ttgagccctgactgccagcgataga

SEQ ID NO: 948255 - DNA, 25 bp, Mus musculus
ttgagccctgggaatgcctgttcca

SEQ ID NO: 948256 - DNA, 25 bp, Mus musculus
ttgagccctgggtatgcctgttcca

SEQ ID NO: 948257 - DNA, 25 bp, Mus musculus
ttgagcccttcacactaagtcagct

SEQ ID NO: 948258 - DNA, 25 bp, Mus musculus
ttgagcccttcagactaagtcagct

SEQ ID NO: 948259 - DNA, 25 bp, Mus musculus
ttgagcccttttagacttgcacatc

SEQ ID NO: 948260 - DNA, 25 bp, Mus musculus
ttgagccctttttgacttgcacatc

SEQ ID NO: 948261 - DNA, 25 bp, Mus musculus
ttgagccgccaacttattatttaac

SEQ ID NO: 948262 - DNA, 25 bp, Mus musculus
ttgagccgccaagttattatttaac

SEQ ID NO: 948263 - DNA, 25 bp, Mus musculus
ttgagccgccatagccgtcattcgt

SEQ ID NO: 948264 - DNA, 25 bp, Mus musculus
ttgagccgccattgccgtcattcgt

SEQ ID NO: 948265 - DNA, 25 bp, Mus musculus
ttgagccggatcattcaagtacctc

SEQ ID NO: 948266 - DNA, 25 bp, Mus musculus
ttgagccggatctttcaagtacctc

SEQ ID NO: 948267 - DNA, 25 bp, Mus musculus
ttgagccgggagatctttggataac

SEQ ID NO: 948268 - DNA, 25 bp, Mus musculus
ttgagccgggagttctttggataac

SEQ ID NO: 948269 - DNA, 25 bp, Mus musculus
ttgagccgggctacttagaaaatgg

SEQ ID NO: 948270 - DNA, 25 bp, Mus musculus
ttgagccgggcttcttagaaaatgg

SEQ ID NO: 948271 - DNA, 25 bp, Mus musculus
ttgagcctaggccaaccagacgcag

SEQ ID NO: 948272 - DNA, 25 bp, Mus musculus
ttgagcctaggcgaaccagacgcag

SEQ ID NO: 948273 - DNA, 25 bp, Mus musculus
ttgagcctatcccttgcgatgaggc

SEQ ID NO: 948274 - DNA, 25 bp, Mus musculus
ttgagcctatccgttgcgatgaggc

SEQ ID NO: 948275 - DNA, 25 bp, Mus musculus
ttgagcctcaatctctgcagatgga

SEQ ID NO: 948276 - DNA, 25 bp, Mus musculus
ttgagcctcaatgtctgcagatgga

SEQ ID NO: 948277 - DNA, 25 bp, Mus musculus
ttgagcctcactcccttagcttgaa

SEQ ID NO: 948278 - DNA, 25 bp, Mus musculus
ttgagcctcactgccttagcttgaa

SEQ ID NO: 948279 - DNA, 25 bp, Mus musculus
ttgagcctcagaattttgtcatttt

SEQ ID NO: 948280 - DNA, 25 bp, Mus musculus
ttgagcctcagatttttgtcatttt

SEQ ID NO: 948281 - DNA, 25 bp, Mus musculus
ttgagcctccgcagcaacctagaag

SEQ ID NO: 948282 - DNA, 25 bp, Mus musculus
ttgagcctccgctgcaacctagaag

SEQ ID NO: 948283 - DNA, 25 bp, Mus musculus
ttgagcctctcactcttaggtgtgt

SEQ ID NO: 948284 - DNA, 25 bp, Mus musculus
ttgagcctctcagtcttaggtgtgt

SEQ ID NO: 948285 - DNA, 25 bp, Mus musculus
ttgagcctctccatgctgacctgga

SEQ ID NO: 948286 - DNA, 25 bp, Mus musculus
ttgagcctctccttgctgacctgga

SEQ ID NO: 948287 - DNA, 25 bp, Mus musculus
ttgagcctcttcatagcggtgttag

SEQ ID NO: 948288 - DNA, 25 bp, Mus musculus
ttgagcctcttcttagcggtgttag

SEQ ID NO: 948289 - DNA, 25 bp, Mus musculus
ttgagcctgcagacccatcaaaatg

SEQ ID NO: 948290 - DNA, 25 bp, Mus musculus
ttgagcctgcagtcccatcaaaatg

SEQ ID NO: 948291 - DNA, 25 bp, Mus musculus
ttgagcctgcatacgtcattttttg

SEQ ID NO: 948292 - DNA, 25 bp, Mus musculus
ttgagcctgcattcgtcattttttg

SEQ ID NO: 948293 - DNA, 25 bp, Mus musculus
ttgagcctgtgtatatccctctgcc

SEQ ID NO: 948294 - DNA, 25 bp, Mus musculus
ttgagcctgtgtttatccctctgcc

SEQ ID NO: 948295 - DNA, 25 bp, Mus musculus
ttgagcctgttgagttggctcatgc

SEQ ID NO: 948296 - DNA, 25 bp, Mus musculus
ttgagcctgttgtgttggctcatgc

SEQ ID NO: 948297 - DNA, 25 bp, Mus musculus
ttgagccttcaaaaaattctggata

SEQ ID NO: 948298 - DNA, 25 bp, Mus musculus
ttgagccttcaataaattctggata

SEQ ID NO: 948299 - DNA, 25 bp, Mus musculus
ttgagccttctcagtaagacatatg

SEQ ID NO: 948300 - DNA, 25 bp, Mus musculus
ttgagccttctctgtaagacatatg

SEQ ID NO: 948301 - DNA, 25 bp, Mus musculus
ttgagcctttttatcaggccttgta

SEQ ID NO: 948302 - DNA, 25 bp, Mus musculus
ttgagcctttttttcaggccttgta

SEQ ID NO: 948303 - DNA, 25 bp, Mus musculus
ttgagcgactgcatttgcctccaga

SEQ ID NO: 948304 - DNA, 25 bp, Mus musculus
ttgagcgactgcttttgcctccaga

SEQ ID NO: 948305 - DNA, 25 bp, Mus musculus
ttgagcgagcaaagcttcgagccaa

SEQ ID NO: 948306 - DNA, 25 bp, Mus musculus
ttgagcgagcaatgcttcgagccaa

SEQ ID NO: 948307 - DNA, 25 bp, Mus musculus
ttgagcgccctaaacatgtgactgt

SEQ ID NO: 948308 - DNA, 25 bp, Mus musculus
ttgagcgccctatacatgtgactgt

SEQ ID NO: 948309 - DNA, 25 bp, Mus musculus
ttgagcgcctggacgtatatggact

SEQ ID NO: 948310 - DNA, 25 bp, Mus musculus
ttgagcgcctggtcgtatatggact

SEQ ID NO: 948311 - DNA, 25 bp, Mus musculus
ttgagcgcttatcaccaaaattggt

SEQ ID NO: 948312 - DNA, 25 bp, Mus musculus
ttgagcgcttatgaccaaaattggt

SEQ ID NO: 948313 - DNA, 25 bp, Mus musculus
ttgagcgctttcacagtaacccatg

SEQ ID NO: 948314 - DNA, 25 bp, Mus musculus
ttgagcgctttctcagtaacccatg

SEQ ID NO: 948315 - DNA, 25 bp, Mus musculus
ttgagcggacgaatgtccagctgga

SEQ ID NO: 948316 - DNA, 25 bp, Mus musculus
ttgagcggacgattgtccagctgga

SEQ ID NO: 948317 - DNA, 25 bp, Mus musculus
ttgagcggagggagcctttcatcac

SEQ ID NO: 948318 - DNA, 25 bp, Mus musculus
ttgagcggagggtgcctttcatcac

SEQ ID NO: 948319 - DNA, 25 bp, Mus musculus
ttgagcggcatcaggtgaccacgat

SEQ ID NO: 948320 - DNA, 25 bp, Mus musculus
ttgagcggcatctggtgaccacgat

SEQ ID NO: 948321 - DNA, 25 bp, Mus musculus
ttgagcggcgcaaacaccagaatga

SEQ ID NO: 948322 - DNA, 25 bp, Mus musculus
ttgagcggcgcatacaccagaatga

SEQ ID NO: 948323 - DNA, 25 bp, Mus musculus
ttgagcggcgcccatgggtttaata

SEQ ID NO: 948324 - DNA, 25 bp, Mus musculus
ttgagcggcgccgatgggtttaata

SEQ ID NO: 948325 - DNA, 25 bp, Mus musculus
ttgagcggtgacagtttctttttgt

SEQ ID NO: 948326 - DNA, 25 bp, Mus musculus
ttgagcggtgactgtttctttttgt

SEQ ID NO: 948327 - DNA, 25 bp, Mus musculus
ttgagcggttttcagaccttgtaac

SEQ ID NO: 948328 - DNA, 25 bp, Mus musculus
ttgagcggttttgagaccttgtaac

SEQ ID NO: 948329 - DNA, 25 bp, Mus musculus
ttgagcgtgctcagtcctgtttaaa

SEQ ID NO: 948330 - DNA, 25 bp, Mus musculus
ttgagcgtgctctgtcctgtttaaa

SEQ ID NO: 948331 - DNA, 25 bp, Mus musculus
ttgagcgtgctgatggacctttcca

SEQ ID NO: 948332 - DNA, 25 bp, Mus musculus
ttgagcgtgctgttggacctttcca

SEQ ID NO: 948333 - DNA, 25 bp, Mus musculus
ttgagctaaccaatgccaactccaa

SEQ ID NO: 948334 - DNA, 25 bp, Mus musculus
ttgagctaaccattgccaactccaa

SEQ ID NO: 948335 - DNA, 25 bp, Mus musculus
ttgagctaatggagatgtggtatgc

SEQ ID NO: 948336 - DNA, 25 bp, Mus musculus
ttgagctaatggtgatgtggtatgc

SEQ ID NO: 948337 - DNA, 25 bp, Mus musculus
ttgagctactccctaactgtgtatc

SEQ ID NO: 948338 - DNA, 25 bp, Mus musculus
ttgagctactccgtaactgtgtatc

SEQ ID NO: 948339 - DNA, 25 bp, Mus musculus
ttgagctaggcccaaccacatgtac

SEQ ID NO: 948340 - DNA, 25 bp, Mus musculus
ttgagctaggccgaaccacatgtac

SEQ ID NO: 948341 - DNA, 25 bp, Mus musculus
ttgagctcaaggactgccaaccaga

SEQ ID NO: 948342 - DNA, 25 bp, Mus musculus
ttgagctcaaggtctgccaaccaga

SEQ ID NO: 948343 - DNA, 25 bp, Mus musculus
ttgagctcacagctgacttctgccg

SEQ ID NO: 948344 - DNA, 25 bp, Mus musculus
ttgagctcacaggtgacttctgccg

SEQ ID NO: 948345 - DNA, 25 bp, Mus musculus
ttgagctcacatagccagtgacatg

SEQ ID NO: 948346 - DNA, 25 bp, Mus musculus
ttgagctcacattgccagtgacatg

SEQ ID NO: 948347 - DNA, 25 bp, Mus musculus
ttgagctcactgctacgtcagtaag

SEQ ID NO: 948348 - DNA, 25 bp, Mus musculus
ttgagctcactggtacgtcagtaag

SEQ ID NO: 948349 - DNA, 25 bp, Mus musculus
ttgagctcagacacatctggccact

SEQ ID NO: 948350 - DNA, 25 bp, Mus musculus
ttgagctcagacagttaggcttggt

SEQ ID NO: 948351 - DNA, 25 bp, Mus musculus
ttgagctcagactcatctggccact

SEQ ID NO: 948352 - DNA, 25 bp, Mus musculus
ttgagctcagactgttaggcttggt

SEQ ID NO: 948353 - DNA, 25 bp, Mus musculus
ttgagctcatgacattttctttcca

SEQ ID NO: 948354 - DNA, 25 bp, Mus musculus
ttgagctcatgagattttctttcca

SEQ ID NO: 948355 - DNA, 25 bp, Mus musculus
ttgagctccagaatgaagcttctga

SEQ ID NO: 948356 - DNA, 25 bp, Mus musculus
ttgagctccagacagttaggaccta

SEQ ID NO: 948357 - DNA, 25 bp, Mus musculus
ttgagctccagagagttaggaccta

SEQ ID NO: 948358 - DNA, 25 bp, Mus musculus
ttgagctccagattgaagcttctga

SEQ ID NO: 948359 - DNA, 25 bp, Mus musculus
ttgagctccagtatacctgcctctg

SEQ ID NO: 948360 - DNA, 25 bp, Mus musculus
ttgagctccagtttacctgcctctg

SEQ ID NO: 948361 - DNA, 25 bp, Mus musculus
ttgagctccatacgtgctcaccgtg

SEQ ID NO: 948362 - DNA, 25 bp, Mus musculus
ttgagctccataggtgctcaccgtg

SEQ ID NO: 948363 - DNA, 25 bp, Mus musculus
ttgagctcccgtagctcttgcctca

SEQ ID NO: 948364 - DNA, 25 bp, Mus musculus
ttgagctcccgttgctcttgcctca

SEQ ID NO: 948365 - DNA, 25 bp, Mus musculus
ttgagctccttgcacccggatcagt

SEQ ID NO: 948366 - DNA, 25 bp, Mus musculus
ttgagctccttggacccggatcagt

SEQ ID NO: 948367 - DNA, 25 bp, Mus musculus
ttgagctcgtgaatgtcctgcctgt

SEQ ID NO: 948368 - DNA, 25 bp, Mus musculus
ttgagctcgtgattgtcctgcctgt

SEQ ID NO: 948369 - DNA, 25 bp, Mus musculus
ttgagctctatcaccaaccaagtgt

SEQ ID NO: 948370 - DNA, 25 bp, Mus musculus
ttgagctctatctccaaccaagtgt

SEQ ID NO: 948371 - DNA, 25 bp, Mus musculus
ttgagctctgctcagataacatgaa

SEQ ID NO: 948372 - DNA, 25 bp, Mus musculus
ttgagctctgctgagataacatgaa

SEQ ID NO: 948373 - DNA, 25 bp, Mus musculus
ttgagctgatatattccctttcctt

SEQ ID NO: 948374 - DNA, 25 bp, Mus musculus
ttgagctgatattttccctttcctt

SEQ ID NO: 948375 - DNA, 25 bp, Mus musculus
ttgagctggcagcttgttgcacatg

SEQ ID NO: 948376 - DNA, 25 bp, Mus musculus
ttgagctggcaggttgttgcacatg

SEQ ID NO: 948377 - DNA, 25 bp, Mus musculus
ttgagctgggtgagcagaccatcct

SEQ ID NO: 948378 - DNA, 25 bp, Mus musculus
ttgagctgggtgtgcagaccatcct

SEQ ID NO: 948379 - DNA, 25 bp, Mus musculus
ttgagctgtaagataactgggtatt

SEQ ID NO: 948380 - DNA, 25 bp, Mus musculus
ttgagctgtaagttaactgggtatt

SEQ ID NO: 948381 - DNA, 25 bp, Mus musculus
ttgagctgtatgacaatgcaccggg

SEQ ID NO: 948382 - DNA, 25 bp, Mus musculus
ttgagctgtatgtcaatgcaccggg

SEQ ID NO: 948383 - DNA, 25 bp, Mus musculus
ttgagctgttcacacggtgcgcagt

SEQ ID NO: 948384 - DNA, 25 bp, Mus musculus
ttgagctgttcacatttccacaagc

SEQ ID NO: 948385 - DNA, 25 bp, Mus musculus
ttgagctgttcagacggtgcgcagt

SEQ ID NO: 948386 - DNA, 25 bp, Mus musculus
ttgagctgttcagatttccacaagc

SEQ ID NO: 948387 - DNA, 25 bp, Mus musculus
ttgagctgttcccttctgtaacccg

SEQ ID NO: 948388 - DNA, 25 bp, Mus musculus
ttgagctgttccgttctgtaacccg

SEQ ID NO: 948389 - DNA, 25 bp, Mus musculus
ttgagctgttctattgcgatcaacc

SEQ ID NO: 948390 - DNA, 25 bp, Mus musculus
ttgagctgttcttttgcgatcaacc

SEQ ID NO: 948391 - DNA, 25 bp, Mus musculus
ttgagctgttgcagtacccctgaag

SEQ ID NO: 948392 - DNA, 25 bp, Mus musculus
ttgagctgttgctgtacccctgaag

SEQ ID NO: 948393 - DNA, 25 bp, Mus musculus
ttgagcttatgccagtctgtcattc

SEQ ID NO: 948394 - DNA, 25 bp, Mus musculus
ttgagcttatgcgagtctgtcattc

SEQ ID NO: 948395 - DNA, 25 bp, Mus musculus
ttgagcttgaaacctgggtgctgtt

SEQ ID NO: 948396 - DNA, 25 bp, Mus musculus
ttgagcttgaaagctgggtgctgtt

SEQ ID NO: 948397 - DNA, 25 bp, Mus musculus
ttgagcttgccccccacccagcaca

SEQ ID NO: 948398 - DNA, 25 bp, Mus musculus
ttgagcttgcccgccacccagcaca

SEQ ID NO: 948399 - DNA, 25 bp, Mus musculus
ttgagcttgtctaagcccagtgaag

SEQ ID NO: 948400 - DNA, 25 bp, Mus musculus
ttgagcttgtcttagcccagtgaag

SEQ ID NO: 948401 - DNA, 25 bp, Mus musculus
ttgagctttcctctgtgaaaaacac

SEQ ID NO: 948402 - DNA, 25 bp, Mus musculus
ttgagctttcctgtgtgaaaaacac

SEQ ID NO: 948403 - DNA, 25 bp, Mus musculus
ttgagctttctaaggtattctactt

SEQ ID NO: 948404 - DNA, 25 bp, Mus musculus
ttgagctttctaccctaaaggtaat

SEQ ID NO: 948405 - DNA, 25 bp, Mus musculus
ttgagctttctagcctaaaggtaat

SEQ ID NO: 948406 - DNA, 25 bp, Mus musculus
ttgagctttctatggtattctactt

SEQ ID NO: 948407 - DNA, 25 bp, Mus musculus
ttgagctttgtaattcgtgaaaacc

SEQ ID NO: 948408 - DNA, 25 bp, Mus musculus
ttgagctttgtatttcgtgaaaacc

SEQ ID NO: 948409 - DNA, 25 bp, Mus musculus
ttgagctttgtcaccgaaaagacct

SEQ ID NO: 948410 - DNA, 25 bp, Mus musculus
ttgagctttgtctccgaaaagacct

SEQ ID NO: 948411 - DNA, 25 bp, Mus musculus
ttgagcttttccaatgctgaacctg

SEQ ID NO: 948412 - DNA, 25 bp, Mus musculus
ttgagcttttcccaccgtgttactg

SEQ ID NO: 948413 - DNA, 25 bp, Mus musculus
ttgagcttttccgaccgtgttactg

SEQ ID NO: 948414 - DNA, 25 bp, Mus musculus
ttgagcttttcctatgctgaacctg

SEQ ID NO: 948415 - DNA, 25 bp, Mus musculus
ttgaggaaaactatagtattctaag

SEQ ID NO: 948416 - DNA, 25 bp, Mus musculus
ttgaggaaaactttagtattctaag

SEQ ID NO: 948417 - DNA, 25 bp, Mus musculus
ttgaggaaccatctgcttgacatct

SEQ ID NO: 948418 - DNA, 25 bp, Mus musculus
ttgaggaaccatgtgcttgacatct

SEQ ID NO: 948419 - DNA, 25 bp, Mus musculus
ttgaggaaccccaatgttgttattt

SEQ ID NO: 948420 - DNA, 25 bp, Mus musculus
ttgaggaacccctatgttgttattt

SEQ ID NO: 948421 - DNA, 25 bp, Mus musculus
ttgaggaacctaacgtctctgctct

SEQ ID NO: 948422 - DNA, 25 bp, Mus musculus
ttgaggaacctatcgtctctgctct

SEQ ID NO: 948423 - DNA, 25 bp, Mus musculus
ttgaggaagagcattcgtcggacag

SEQ ID NO: 948424 - DNA, 25 bp, Mus musculus
ttgaggaagagctttcgtcggacag

SEQ ID NO: 948425 - DNA, 25 bp, Mus musculus
ttgaggaaggttatcatttctttag

SEQ ID NO: 948426 - DNA, 25 bp, Mus musculus
ttgaggaaggttttcatttctttag

SEQ ID NO: 948427 - DNA, 25 bp, Mus musculus
ttgaggaagtgtccccaggaactac

SEQ ID NO: 948428 - DNA, 25 bp, Mus musculus
ttgaggaagtgtgcccaggaactac

SEQ ID NO: 948429 - DNA, 25 bp, Mus musculus
ttgaggaatcatccctgcgccaata

SEQ ID NO: 948430 - DNA, 25 bp, Mus musculus
ttgaggaatcatgcctgcgccaata

SEQ ID NO: 948431 - DNA, 25 bp, Mus musculus
ttgaggacatgaatgcacccttccg

SEQ ID NO: 948432 - DNA, 25 bp, Mus musculus
ttgaggacatgattgcacccttccg

SEQ ID NO: 948433 - DNA, 25 bp, Mus musculus
ttgaggacatgtatagactatctta

SEQ ID NO: 948434 - DNA, 25 bp, Mus musculus
ttgaggacatgtttagactatctta

SEQ ID NO: 948435 - DNA, 25 bp, Mus musculus
ttgaggacatttatctgaggttgga

SEQ ID NO: 948436 - DNA, 25 bp, Mus musculus
ttgaggacatttttctgaggttgga

SEQ ID NO: 948437 - DNA, 25 bp, Mus musculus
ttgaggaccaatccatagattacag

SEQ ID NO: 948438 - DNA, 25 bp, Mus musculus
ttgaggaccaatgcatagattacag

SEQ ID NO: 948439 - DNA, 25 bp, Mus musculus
ttgaggacccacagagtaatgtttg

SEQ ID NO: 948440 - DNA, 25 bp, Mus musculus
ttgaggacccactgagtaatgtttg

SEQ ID NO: 948441 - DNA, 25 bp, Mus musculus
ttgaggacgagaatgagagctgtta

SEQ ID NO: 948442 - DNA, 25 bp, Mus musculus
ttgaggacgagattgagagctgtta

SEQ ID NO: 948443 - DNA, 25 bp, Mus musculus
ttgaggacgcatcgaccgtggtctc

SEQ ID NO: 948444 - DNA, 25 bp, Mus musculus
ttgaggacgcatggaccgtggtctc

SEQ ID NO: 948445 - DNA, 25 bp, Mus musculus
ttgaggacgccaacgactcatgcta

SEQ ID NO: 948446 - DNA, 25 bp, Mus musculus
ttgaggacgccaactgtgccatgca

SEQ ID NO: 948447 - DNA, 25 bp, Mus musculus
ttgaggacgccatcgactcatgcta

SEQ ID NO: 948448 - DNA, 25 bp, Mus musculus
ttgaggacgccatctgtgccatgca

SEQ ID NO: 948449 - DNA, 25 bp, Mus musculus
ttgaggacgtcccaattgcacacat

SEQ ID NO: 948450 - DNA, 25 bp, Mus musculus
ttgaggacgtccgaattgcacacat

SEQ ID NO: 948451 - DNA, 25 bp, Mus musculus
ttgaggagacagacgtcctggccca

SEQ ID NO: 948452 - DNA, 25 bp, Mus musculus
ttgaggagacagtcgtcctggccca

SEQ ID NO: 948453 - DNA, 25 bp, Mus musculus
ttgaggagaccaagaacactgcttt

SEQ ID NO: 948454 - DNA, 25 bp, Mus musculus
ttgaggagaccatgaacactgcttt

SEQ ID NO: 948455 - DNA, 25 bp, Mus musculus
ttgaggagctgaacacccaggtcgc

SEQ ID NO: 948456 - DNA, 25 bp, Mus musculus
ttgaggagctgatcacccaggtcgc

SEQ ID NO: 948457 - DNA, 25 bp, Mus musculus
ttgaggagggtcacataaacccagc

SEQ ID NO: 948458 - DNA, 25 bp, Mus musculus
ttgaggagggtctcataaacccagc

SEQ ID NO: 948459 - DNA, 25 bp, Mus musculus
ttgaggagtcagaagaagacgccct

SEQ ID NO: 948460 - DNA, 25 bp, Mus musculus
ttgaggagtcagtagaagacgccct

SEQ ID NO: 948461 - DNA, 25 bp, Mus musculus
ttgaggagttctcacctcagtctct

SEQ ID NO: 948462 - DNA, 25 bp, Mus musculus
ttgaggagttctgacctcagtctct

SEQ ID NO: 948463 - DNA, 25 bp, Mus musculus
ttgaggatcctcatgtgccttttca

SEQ ID NO: 948464 - DNA, 25 bp, Mus musculus
ttgaggatcctcttgtgccttttca

SEQ ID NO: 948465 - DNA, 25 bp, Mus musculus
ttgaggatgagaattcctgcctgct

SEQ ID NO: 948466 - DNA, 25 bp, Mus musculus
ttgaggatgagatttcctgcctgct

SEQ ID NO: 948467 - DNA, 25 bp, Mus musculus
ttgaggatgcctcccagcacacatg

SEQ ID NO: 948468 - DNA, 25 bp, Mus musculus
ttgaggatgcctgccagcacacatg

SEQ ID NO: 948469 - DNA, 25 bp, Mus musculus
ttgaggatgcttatggttggttttt

SEQ ID NO: 948470 - DNA, 25 bp, Mus musculus
ttgaggatgcttttggttggttttt

SEQ ID NO: 948471 - DNA, 25 bp, Mus musculus
ttgaggatgtcgatgctgtgctgtt

SEQ ID NO: 948472 - DNA, 25 bp, Mus musculus
ttgaggatgtcgttgctgtgctgtt

SEQ ID NO: 948473 - DNA, 25 bp, Mus musculus
ttgaggattgtaccagtttctttgt

SEQ ID NO: 948474 - DNA, 25 bp, Mus musculus
ttgaggattgtagcagtttctttgt

SEQ ID NO: 948475 - DNA, 25 bp, Mus musculus
ttgaggatttctactggcagagccc

SEQ ID NO: 948476 - DNA, 25 bp, Mus musculus
ttgaggatttcttctggcagagccc

SEQ ID NO: 948477 - DNA, 25 bp, Mus musculus
ttgaggattttccaaccttcggcca

SEQ ID NO: 948478 - DNA, 25 bp, Mus musculus
ttgaggattttcgaaccttcggcca

SEQ ID NO: 948479 - DNA, 25 bp, Mus musculus
ttgaggcaacccatgagcgactgaa

SEQ ID NO: 948480 - DNA, 25 bp, Mus musculus
ttgaggcaacccttgagcgactgaa

SEQ ID NO: 948481 - DNA, 25 bp, Mus musculus
ttgaggcaacctccaagaccgtgat

SEQ ID NO: 948482 - DNA, 25 bp, Mus musculus
ttgaggcaacctgcaagaccgtgat

SEQ ID NO: 948483 - DNA, 25 bp, Mus musculus
ttgaggcaagtgatccctttgggca

SEQ ID NO: 948484 - DNA, 25 bp, Mus musculus
ttgaggcaagtgttccctttgggca

SEQ ID NO: 948485 - DNA, 25 bp, Mus musculus
ttgaggcacaccagggcgagacctt

SEQ ID NO: 948486 - DNA, 25 bp, Mus musculus
ttgaggcacacctgggcgagacctt

SEQ ID NO: 948487 - DNA, 25 bp, Mus musculus
ttgaggcaccctctctgaaagatac

SEQ ID NO: 948488 - DNA, 25 bp, Mus musculus
ttgaggcaccctgtctgaaagatac

SEQ ID NO: 948489 - DNA, 25 bp, Mus musculus
ttgaggcacctcatagagaccccag

SEQ ID NO: 948490 - DNA, 25 bp, Mus musculus
ttgaggcacctcttagagaccccag

SEQ ID NO: 948491 - DNA, 25 bp, Mus musculus
ttgaggcagactcacttttgtagcc

SEQ ID NO: 948492 - DNA, 25 bp, Mus musculus
ttgaggcagactgacttttgtagcc

SEQ ID NO: 948493 - DNA, 25 bp, Mus musculus
ttgaggcagcccagatgcccacctg

SEQ ID NO: 948494 - DNA, 25 bp, Mus musculus
ttgaggcagccctgatgcccacctg

SEQ ID NO: 948495 - DNA, 25 bp, Mus musculus
ttgaggcagcttctttccttaccca

SEQ ID NO: 948496 - DNA, 25 bp, Mus musculus
ttgaggcagcttgtttccttaccca

SEQ ID NO: 948497 - DNA, 25 bp, Mus musculus
ttgaggcagggaccatcacctctat

SEQ ID NO: 948498 - DNA, 25 bp, Mus musculus
ttgaggcagggagcatcacctctat

SEQ ID NO: 948499 - DNA, 25 bp, Mus musculus
ttgaggcataaaccacttccagctg

SEQ ID NO: 948500 - DNA, 25 bp, Mus musculus
ttgaggcataaagcacttccagctg

SEQ ID NO: 948501 - DNA, 25 bp, Mus musculus
ttgaggcatactaaggctgcatgta

SEQ ID NO: 948502 - DNA, 25 bp, Mus musculus
ttgaggcatacttaggctgcatgta

SEQ ID NO: 948503 - DNA, 25 bp, Mus musculus
ttgaggccaagacaatcaccactgt

SEQ ID NO: 948504 - DNA, 25 bp, Mus musculus
ttgaggccaagagaatcaccactgt

SEQ ID NO: 948505 - DNA, 25 bp, Mus musculus
ttgaggccacagctttgaaaggact

SEQ ID NO: 948506 - DNA, 25 bp, Mus musculus
ttgaggccacaggtttgaaaggact

SEQ ID NO: 948507 - DNA, 25 bp, Mus musculus
ttgaggccagagctcccaccaagca

SEQ ID NO: 948508 - DNA, 25 bp, Mus musculus
ttgaggccagaggtcccaccaagca

SEQ ID NO: 948509 - DNA, 25 bp, Mus musculus
ttgaggccagctagccttagcttac

SEQ ID NO: 948510 - DNA, 25 bp, Mus musculus
ttgaggccagctcggctgcatgcac

SEQ ID NO: 948511 - DNA, 25 bp, Mus musculus
ttgaggccagctgggctgcatgcac

SEQ ID NO: 948512 - DNA, 25 bp, Mus musculus
ttgaggccagcttgccttagcttac

SEQ ID NO: 948513 - DNA, 25 bp, Mus musculus
ttgaggccagttaaggttacatgtg

SEQ ID NO: 948514 - DNA, 25 bp, Mus musculus
ttgaggccagtttaggttacatgtg

SEQ ID NO: 948515 - DNA, 25 bp, Mus musculus
ttgaggccatcaatgaccactctat

SEQ ID NO: 948516 - DNA, 25 bp, Mus musculus
ttgaggccatcattgaccactctat

SEQ ID NO: 948517 - DNA, 25 bp, Mus musculus
ttgaggcccagcagacacagtggtg

SEQ ID NO: 948518 - DNA, 25 bp, Mus musculus
ttgaggcccagctgacacagtggtg

SEQ ID NO: 948519 - DNA, 25 bp, Mus musculus
ttgaggccccgtactccagtgagga

SEQ ID NO: 948520 - DNA, 25 bp, Mus musculus
ttgaggccccgttctccagtgagga

SEQ ID NO: 948521 - DNA, 25 bp, Mus musculus
ttgaggcctaagctctcagcttcct

SEQ ID NO: 948522 - DNA, 25 bp, Mus musculus
ttgaggcctaaggtctcagcttcct

SEQ ID NO: 948523 - DNA, 25 bp, Mus musculus
ttgaggcctgcacaagccaaaggtg

SEQ ID NO: 948524 - DNA, 25 bp, Mus musculus
ttgaggcctgcagaagccaaaggtg

SEQ ID NO: 948525 - DNA, 25 bp, Mus musculus
ttgaggcctgctaggaatctcctgt

SEQ ID NO: 948526 - DNA, 25 bp, Mus musculus
ttgaggcctgcttggaatctcctgt

SEQ ID NO: 948527 - DNA, 25 bp, Mus musculus
ttgaggcctggtcccatgtagccca

SEQ ID NO: 948528 - DNA, 25 bp, Mus musculus
ttgaggcctggtgccatgtagccca

SEQ ID NO: 948529 - DNA, 25 bp, Mus musculus
ttgaggccttatcgctctgtcccaa

SEQ ID NO: 948530 - DNA, 25 bp, Mus musculus
ttgaggccttatggctctgtcccaa

SEQ ID NO: 948531 - DNA, 25 bp, Mus musculus
ttgaggccttcccacaggaacgaag

SEQ ID NO: 948532 - DNA, 25 bp, Mus musculus
ttgaggccttccgacaggaacgaag

SEQ ID NO: 948533 - DNA, 25 bp, Mus musculus
ttgaggcgtgcaatcaagcaggtac

SEQ ID NO: 948534 - DNA, 25 bp, Mus musculus
ttgaggcgtgcattcaagcaggtac

SEQ ID NO: 948535 - DNA, 25 bp, Mus musculus
ttgaggctaaagacccctatccgag

SEQ ID NO: 948536 - DNA, 25 bp, Mus musculus
ttgaggctaaagtcccctatccgag

SEQ ID NO: 948537 - DNA, 25 bp, Mus musculus
ttgaggctaactcctggtgctttga

SEQ ID NO: 948538 - DNA, 25 bp, Mus musculus
ttgaggctaactgctggtgctttga

SEQ ID NO: 948539 - DNA, 25 bp, Mus musculus
ttgaggctagctaggctccacagcg

SEQ ID NO: 948540 - DNA, 25 bp, Mus musculus
ttgaggctagcttggctccacagcg

SEQ ID NO: 948541 - DNA, 25 bp, Mus musculus
ttgaggctatatacatttctctctg

SEQ ID NO: 948542 - DNA, 25 bp, Mus musculus
ttgaggctatattcatttctctctg

SEQ ID NO: 948543 - DNA, 25 bp, Mus musculus
ttgaggctcagcacatctacaggca

SEQ ID NO: 948544 - DNA, 25 bp, Mus musculus
ttgaggctcagctcatctacaggca

SEQ ID NO: 948545 - DNA, 25 bp, Mus musculus
ttgaggctccttagatctcctgagg

SEQ ID NO: 948546 - DNA, 25 bp, Mus musculus
ttgaggctcctttgatctcctgagg

SEQ ID NO: 948547 - DNA, 25 bp, Mus musculus
ttgaggctctccagaaggtgaacaa

SEQ ID NO: 948548 - DNA, 25 bp, Mus musculus
ttgaggctctcctgaaggtgaacaa

SEQ ID NO: 948549 - DNA, 25 bp, Mus musculus
ttgaggctgaggattcactatgaag

SEQ ID NO: 948550 - DNA, 25 bp, Mus musculus
ttgaggctgaggtttcactatgaag

SEQ ID NO: 948551 - DNA, 25 bp, Mus musculus
ttgaggctgcaaagcttcccatgct

SEQ ID NO: 948552 - DNA, 25 bp, Mus musculus
ttgaggctgcaatgcttcccatgct

SEQ ID NO: 948553 - DNA, 25 bp, Mus musculus
ttgaggctgcagagtacccacttag

SEQ ID NO: 948554 - DNA, 25 bp, Mus musculus
ttgaggctgcagtgtacccacttag

SEQ ID NO: 948555 - DNA, 25 bp, Mus musculus
ttgaggctggtcatgctccatagaa

SEQ ID NO: 948556 - DNA, 25 bp, Mus musculus
ttgaggctggtcttgctccatagaa

SEQ ID NO: 948557 - DNA, 25 bp, Mus musculus
ttgaggcttatacaaatgacccatt

SEQ ID NO: 948558 - DNA, 25 bp, Mus musculus
ttgaggcttatagaaatgacccatt

SEQ ID NO: 948559 - DNA, 25 bp, Mus musculus
ttgaggcttcctcagacagccacct

SEQ ID NO: 948560 - DNA, 25 bp, Mus musculus
ttgaggcttcctgagacagccacct

SEQ ID NO: 948561 - DNA, 25 bp, Mus musculus
ttgaggctttaacttgggcacttgc

SEQ ID NO: 948562 - DNA, 25 bp, Mus musculus
ttgaggctttaagttgggcacttgc

SEQ ID NO: 948563 - DNA, 25 bp, Mus musculus
ttgagggaacacctctactctctcc

SEQ ID NO: 948564 - DNA, 25 bp, Mus musculus
ttgagggaacacgtctactctctcc

SEQ ID NO: 948565 - DNA, 25 bp, Mus musculus
ttgagggaacccaggctgctgccat

SEQ ID NO: 948566 - DNA, 25 bp, Mus musculus
ttgagggaaccctggctgctgccat

SEQ ID NO: 948567 - DNA, 25 bp, Mus musculus
ttgagggacacgctgacacactaca

SEQ ID NO: 948568 - DNA, 25 bp, Mus musculus
ttgagggacacggtgacacactaca

SEQ ID NO: 948569 - DNA, 25 bp, Mus musculus
ttgagggagttcatgccgccagggc

SEQ ID NO: 948570 - DNA, 25 bp, Mus musculus
ttgagggagttcttgccgccagggc

SEQ ID NO: 948571 - DNA, 25 bp, Mus musculus
ttgagggatcacacaggccagggtt

SEQ ID NO: 948572 - DNA, 25 bp, Mus musculus
ttgagggatcactcaggccagggtt

SEQ ID NO: 948573 - DNA, 25 bp, Mus musculus
ttgagggatttgctgttcttaccgt

SEQ ID NO: 948574 - DNA, 25 bp, Mus musculus
ttgagggatttggtgttcttaccgt

SEQ ID NO: 948575 - DNA, 25 bp, Mus musculus
ttgagggcagcaccttagagtctgt

SEQ ID NO: 948576 - DNA, 25 bp, Mus musculus
ttgagggcagcagcttagagtctgt

SEQ ID NO: 948577 - DNA, 25 bp, Mus musculus
ttgagggcagtactgtccatgtgca

SEQ ID NO: 948578 - DNA, 25 bp, Mus musculus
ttgagggcagtagtgtccatgtgca

SEQ ID NO: 948579 - DNA, 25 bp, Mus musculus
ttgagggcatccagagcctgatctg

SEQ ID NO: 948580 - DNA, 25 bp, Mus musculus
ttgagggcatcctgagcctgatctg

SEQ ID NO: 948581 - DNA, 25 bp, Mus musculus
ttgagggcattcaggaaccttctac

SEQ ID NO: 948582 - DNA, 25 bp, Mus musculus
ttgagggcattctggaaccttctac

SEQ ID NO: 948583 - DNA, 25 bp, Mus musculus
ttgagggcatttacccaaacctcaa

SEQ ID NO: 948584 - DNA, 25 bp, Mus musculus
ttgagggcattttcccaaacctcaa

SEQ ID NO: 948585 - DNA, 25 bp, Mus musculus
ttgagggccctaaggatgccagcct

SEQ ID NO: 948586 - DNA, 25 bp, Mus musculus
ttgagggccctatggatgccagcct

SEQ ID NO: 948587 - DNA, 25 bp, Mus musculus
ttgagggctacaactcactggtgat

SEQ ID NO: 948588 - DNA, 25 bp, Mus musculus
ttgagggctacatctcactggtgat

SEQ ID NO: 948589 - DNA, 25 bp, Mus musculus
ttgagggctcaccttctcctgctgt

SEQ ID NO: 948590 - DNA, 25 bp, Mus musculus
ttgagggctcacgttctcctgctgt

SEQ ID NO: 948591 - DNA, 25 bp, Mus musculus
ttgagggctcctaatttgttgttgt

SEQ ID NO: 948592 - DNA, 25 bp, Mus musculus
ttgagggctccttatttgttgttgt

SEQ ID NO: 948593 - DNA, 25 bp, Mus musculus
ttgagggctctgatcgtgcaagaat

SEQ ID NO: 948594 - DNA, 25 bp, Mus musculus
ttgagggctctgttcgtgcaagaat

SEQ ID NO: 948595 - DNA, 25 bp, Mus musculus
ttgagggctgcacttcagttcccag

SEQ ID NO: 948596 - DNA, 25 bp, Mus musculus
ttgagggctgcagttcagttcccag

SEQ ID NO: 948597 - DNA, 25 bp, Mus musculus
ttgagggcttccagtgtaacattcc

SEQ ID NO: 948598 - DNA, 25 bp, Mus musculus
ttgagggcttcctgtgtaacattcc

SEQ ID NO: 948599 - DNA, 25 bp, Mus musculus
ttgagggtattgaccatcttggcaa

SEQ ID NO: 948600 - DNA, 25 bp, Mus musculus
ttgagggtattgtccatcttggcaa

SEQ ID NO: 948601 - DNA, 25 bp, Mus musculus
ttgagggtcattcatctgcccagct

SEQ ID NO: 948602 - DNA, 25 bp, Mus musculus
ttgagggtcattgatctgcccagct

SEQ ID NO: 948603 - DNA, 25 bp, Mus musculus
ttgagggtcggcacaaggacatcgt

SEQ ID NO: 948604 - DNA, 25 bp, Mus musculus
ttgagggtcggctcaaggacatcgt

SEQ ID NO: 948605 - DNA, 25 bp, Mus musculus
ttgagggtctccaagttctacttct

SEQ ID NO: 948606 - DNA, 25 bp, Mus musculus
ttgagggtctcctagttctacttct

SEQ ID NO: 948607 - DNA, 25 bp, Mus musculus
ttgagggttattcttgcctacatag

SEQ ID NO: 948608 - DNA, 25 bp, Mus musculus
ttgagggttattgttgcctacatag

SEQ ID NO: 948609 - DNA, 25 bp, Mus musculus
ttgagggttccaacatagcccacag

SEQ ID NO: 948610 - DNA, 25 bp, Mus musculus
ttgagggttccatcatagcccacag

SEQ ID NO: 948611 - DNA, 25 bp, Mus musculus
ttgagggttgtccatctcccaaaga

SEQ ID NO: 948612 - DNA, 25 bp, Mus musculus
ttgagggttgtcgatctcccaaaga

SEQ ID NO: 948613 - DNA, 25 bp, Mus musculus
ttgagggtttgtaccctttcattct

SEQ ID NO: 948614 - DNA, 25 bp, Mus musculus
ttgagggtttgtcgacttcacttat

SEQ ID NO: 948615 - DNA, 25 bp, Mus musculus
ttgagggtttgtggacttcacttat

SEQ ID NO: 948616 - DNA, 25 bp, Mus musculus
ttgagggtttgttccctttcattct

SEQ ID NO: 948617 - DNA, 25 bp, Mus musculus
ttgaggtaaattctcatgtggtact

SEQ ID NO: 948618 - DNA, 25 bp, Mus musculus
ttgaggtaaattgtcatgtggtact

SEQ ID NO: 948619 - DNA, 25 bp, Mus musculus
ttgaggtaacatctaattaggccac

SEQ ID NO: 948620 - DNA, 25 bp, Mus musculus
ttgaggtaacatgtaattaggccac

SEQ ID NO: 948621 - DNA, 25 bp, Mus musculus
ttgaggtacagtagggtcgtttcca

SEQ ID NO: 948622 - DNA, 25 bp, Mus musculus
ttgaggtacagttgggtcgtttcca

SEQ ID NO: 948623 - DNA, 25 bp, Mus musculus
ttgaggtcacatctacattgccttt

SEQ ID NO: 948624 - DNA, 25 bp, Mus musculus
ttgaggtcacatgtacattgccttt

SEQ ID NO: 948625 - DNA, 25 bp, Mus musculus
ttgaggtcacctagtatctgggcat

SEQ ID NO: 948626 - DNA, 25 bp, Mus musculus
ttgaggtcacctcatctacatatac

SEQ ID NO: 948627 - DNA, 25 bp, Mus musculus
ttgaggtcacctgatctacatatac

SEQ ID NO: 948628 - DNA, 25 bp, Mus musculus
ttgaggtcaccttgtatctgggcat

SEQ ID NO: 948629 - DNA, 25 bp, Mus musculus
ttgaggtcatacaatttcagtggaa

SEQ ID NO: 948630 - DNA, 25 bp, Mus musculus
ttgaggtcatactatttcagtggaa

SEQ ID NO: 948631 - DNA, 25 bp, Mus musculus
ttgaggtcattacacagaggatcct

SEQ ID NO: 948632 - DNA, 25 bp, Mus musculus
ttgaggtcattagacagaggatcct

SEQ ID NO: 948633 - DNA, 25 bp, Mus musculus
ttgaggtcccggaccttgcggctgc

SEQ ID NO: 948634 - DNA, 25 bp, Mus musculus
ttgaggtcccggtccttgcggctgc

SEQ ID NO: 948635 - DNA, 25 bp, Mus musculus
ttgaggtccgctaggatccgagcca

SEQ ID NO: 948636 - DNA, 25 bp, Mus musculus
ttgaggtccgcttggatccgagcca

SEQ ID NO: 948637 - DNA, 25 bp, Mus musculus
ttgaggtgaacactgtctcccacgc

SEQ ID NO: 948638 - DNA, 25 bp, Mus musculus
ttgaggtgaacagtgtctcccacgc

SEQ ID NO: 948639 - DNA, 25 bp, Mus musculus
ttgaggtgaaccctttggtgggagg

SEQ ID NO: 948640 - DNA, 25 bp, Mus musculus
ttgaggtgaaccgtttggtgggagg

SEQ ID NO: 948641 - DNA, 25 bp, Mus musculus
ttgaggtgacatcccagtacacttg

SEQ ID NO: 948642 - DNA, 25 bp, Mus musculus
ttgaggtgacatgccagtacacttg

SEQ ID NO: 948643 - DNA, 25 bp, Mus musculus
ttgaggtgccaccttacaaaaggat

SEQ ID NO: 948644 - DNA, 25 bp, Mus musculus
ttgaggtgccacgttacaaaaggat

SEQ ID NO: 948645 - DNA, 25 bp, Mus musculus
ttgaggtgccatacttcccataaga

SEQ ID NO: 948646 - DNA, 25 bp, Mus musculus
ttgaggtgccattcttcccataaga

SEQ ID NO: 948647 - DNA, 25 bp, Mus musculus
ttgaggtgcctcatcagcatggcaa

SEQ ID NO: 948648 - DNA, 25 bp, Mus musculus
ttgaggtgcctcttcagcatggcaa

SEQ ID NO: 948649 - DNA, 25 bp, Mus musculus
ttgaggtggatcagcttgctctctc

SEQ ID NO: 948650 - DNA, 25 bp, Mus musculus
ttgaggtggatctgcttgctctctc

SEQ ID NO: 948651 - DNA, 25 bp, Mus musculus
ttgaggtggttcacattcttgcttc

SEQ ID NO: 948652 - DNA, 25 bp, Mus musculus
ttgaggtggttctcattcttgcttc

SEQ ID NO: 948653 - DNA, 25 bp, Mus musculus
ttgaggtgtttcatccaattttcct

SEQ ID NO: 948654 - DNA, 25 bp, Mus musculus
ttgaggtgtttcttccaattttcct

SEQ ID NO: 948655 - DNA, 25 bp, Mus musculus
ttgaggttcctcacggctgagcgca

SEQ ID NO: 948656 - DNA, 25 bp, Mus musculus
ttgaggttcctctcggctgagcgca

SEQ ID NO: 948657 - DNA, 25 bp, Mus musculus
ttgaggttctttccgctttttggtg

SEQ ID NO: 948658 - DNA, 25 bp, Mus musculus
ttgaggttctttgcgctttttggtg

SEQ ID NO: 948659 - DNA, 25 bp, Mus musculus
ttgaggttgagtcccagagcccatc

SEQ ID NO: 948660 - DNA, 25 bp, Mus musculus
ttgaggttgagtgccagagcccatc

SEQ ID NO: 948661 - DNA, 25 bp, Mus musculus
ttgaggttgcagctctgagaagcct

SEQ ID NO: 948662 - DNA, 25 bp, Mus musculus
ttgaggttgcaggtctgagaagcct

SEQ ID NO: 948663 - DNA, 25 bp, Mus musculus
ttgaggtttcttctctgccccagta

SEQ ID NO: 948664 - DNA, 25 bp, Mus musculus
ttgaggtttcttgtctgccccagta

SEQ ID NO: 948665 - DNA, 25 bp, Mus musculus
ttgaggtttggaactacgaggtcgc

SEQ ID NO: 948666 - DNA, 25 bp, Mus musculus
ttgaggtttggatctacgaggtcgc

SEQ ID NO: 948667 - DNA, 25 bp, Mus musculus
ttgaggtttgggaacggccactctc

SEQ ID NO: 948668 - DNA, 25 bp, Mus musculus
ttgaggtttgggtacggccactctc

SEQ ID NO: 948669 - DNA, 25 bp, Mus musculus
ttgaggtttggtcacagcccttcta

SEQ ID NO: 948670 - DNA, 25 bp, Mus musculus
ttgaggtttggtgacagcccttcta

SEQ ID NO: 948671 - DNA, 25 bp, Mus musculus
ttgaggttttcaaatgctgcatttc

SEQ ID NO: 948672 - DNA, 25 bp, Mus musculus
ttgaggttttcatatgctgcatttc

SEQ ID NO: 948673 - DNA, 25 bp, Mus musculus
ttgagtaagcgtctgctcccggctg

SEQ ID NO: 948674 - DNA, 25 bp, Mus musculus
ttgagtaagcgtgtgctcccggctg

SEQ ID NO: 948675 - DNA, 25 bp, Mus musculus
ttgagtaattttcttcagtatttgg

SEQ ID NO: 948676 - DNA, 25 bp, Mus musculus
ttgagtaattttgttcagtatttgg

SEQ ID NO: 948677 - DNA, 25 bp, Mus musculus
ttgagtacattaaccatttgcatat

SEQ ID NO: 948678 - DNA, 25 bp, Mus musculus
ttgagtacattatccatttgcatat

SEQ ID NO: 948679 - DNA, 25 bp, Mus musculus
ttgagtaccaacaactcactcttca

SEQ ID NO: 948680 - DNA, 25 bp, Mus musculus
ttgagtaccaactactcactcttca

SEQ ID NO: 948681 - DNA, 25 bp, Mus musculus
ttgagtaccattcagaccctgtctt

SEQ ID NO: 948682 - DNA, 25 bp, Mus musculus
ttgagtaccattgagaccctgtctt

SEQ ID NO: 948683 - DNA, 25 bp, Mus musculus
ttgagtacctgccacagcttgtgag

SEQ ID NO: 948684 - DNA, 25 bp, Mus musculus
ttgagtacctgcgacagcttgtgag

SEQ ID NO: 948685 - DNA, 25 bp, Mus musculus
ttgagtactcttacaggaacacctg

SEQ ID NO: 948686 - DNA, 25 bp, Mus musculus
ttgagtactctttcaggaacacctg

SEQ ID NO: 948687 - DNA, 25 bp, Mus musculus
ttgagtagaactctctggatgtgtt

SEQ ID NO: 948688 - DNA, 25 bp, Mus musculus
ttgagtagaactgtctggatgtgtt

SEQ ID NO: 948689 - DNA, 25 bp, Mus musculus
ttgagtagagctcgcatagaggact

SEQ ID NO: 948690 - DNA, 25 bp, Mus musculus
ttgagtagagctggcatagaggact

SEQ ID NO: 948691 - DNA, 25 bp, Mus musculus
ttgagtagccagaaccctcacacaa

SEQ ID NO: 948692 - DNA, 25 bp, Mus musculus
ttgagtagccagtaccctcacacaa

SEQ ID NO: 948693 - DNA, 25 bp, Mus musculus
ttgagtaggaaccaggtcacctctt

SEQ ID NO: 948694 - DNA, 25 bp, Mus musculus
ttgagtaggaacgaggtcacctctt

SEQ ID NO: 948695 - DNA, 25 bp, Mus musculus
ttgagtaggcaactggtctaccact

SEQ ID NO: 948696 - DNA, 25 bp, Mus musculus
ttgagtaggcaagtggtctaccact

SEQ ID NO: 948697 - DNA, 25 bp, Mus musculus
ttgagtatcttacagcttgcctttt

SEQ ID NO: 948698 - DNA, 25 bp, Mus musculus
ttgagtatcttagagcttgcctttt

SEQ ID NO: 948699 - DNA, 25 bp, Mus musculus
ttgagtatgctcattcctgtgccag

SEQ ID NO: 948700 - DNA, 25 bp, Mus musculus
ttgagtatgctctttcctgtgccag

SEQ ID NO: 948701 - DNA, 25 bp, Mus musculus
ttgagtattctaacccctgtgttct

SEQ ID NO: 948702 - DNA, 25 bp, Mus musculus
ttgagtattctatcccctgtgttct

SEQ ID NO: 948703 - DNA, 25 bp, Mus musculus
ttgagtcaatccagcatcctgttcc

SEQ ID NO: 948704 - DNA, 25 bp, Mus musculus
ttgagtcaatcctgcatcctgttcc

SEQ ID NO: 948705 - DNA, 25 bp, Mus musculus
ttgagtcaatgcagggctctgggca

SEQ ID NO: 948706 - DNA, 25 bp, Mus musculus
ttgagtcaatgctgggctctgggca

SEQ ID NO: 948707 - DNA, 25 bp, Mus musculus
ttgagtcacaggagctccaatggga

SEQ ID NO: 948708 - DNA, 25 bp, Mus musculus
ttgagtcacaggtgctccaatggga

SEQ ID NO: 948709 - DNA, 25 bp, Mus musculus
ttgagtcaccccactgtttattctg

SEQ ID NO: 948710 - DNA, 25 bp, Mus musculus
ttgagtcacccctctgtttattctg

SEQ ID NO: 948711 - DNA, 25 bp, Mus musculus
ttgagtcagatgctttcatttacac

SEQ ID NO: 948712 - DNA, 25 bp, Mus musculus
ttgagtcagatggtttcatttacac

SEQ ID NO: 948713 - DNA, 25 bp, Mus musculus
ttgagtcagcatctttgcttcatct

SEQ ID NO: 948714 - DNA, 25 bp, Mus musculus
ttgagtcagcatgtttgcttcatct

SEQ ID NO: 948715 - DNA, 25 bp, Mus musculus
ttgagtcagcccaagaagcctagag

SEQ ID NO: 948716 - DNA, 25 bp, Mus musculus
ttgagtcagccctagaagcctagag

SEQ ID NO: 948717 - DNA, 25 bp, Mus musculus
ttgagtccagccagggtccttggag

SEQ ID NO: 948718 - DNA, 25 bp, Mus musculus
ttgagtccagcctgggtccttggag

SEQ ID NO: 948719 - DNA, 25 bp, Mus musculus
ttgagtcccacaaaatccacattgt

SEQ ID NO: 948720 - DNA, 25 bp, Mus musculus
ttgagtcccacataatccacattgt

SEQ ID NO: 948721 - DNA, 25 bp, Mus musculus
ttgagtcccacgcaggacatcttgg

SEQ ID NO: 948722 - DNA, 25 bp, Mus musculus
ttgagtcccacggaggacatcttgg

SEQ ID NO: 948723 - DNA, 25 bp, Mus musculus
ttgagtccctggcacgctgtgactg

SEQ ID NO: 948724 - DNA, 25 bp, Mus musculus
ttgagtccctgggacgctgtgactg

SEQ ID NO: 948725 - DNA, 25 bp, Mus musculus
ttgagtcctctgaaaggctcctgct

SEQ ID NO: 948726 - DNA, 25 bp, Mus musculus
ttgagtcctctgtaaggctcctgct

SEQ ID NO: 948727 - DNA, 25 bp, Mus musculus
ttgagtcctgctacaagccagtctg

SEQ ID NO: 948728 - DNA, 25 bp, Mus musculus
ttgagtcctgcttcaagccagtctg

SEQ ID NO: 948729 - DNA, 25 bp, Mus musculus
ttgagtcctgtcatgactccctcca

SEQ ID NO: 948730 - DNA, 25 bp, Mus musculus
ttgagtcctgtcttgactccctcca

SEQ ID NO: 948731 - DNA, 25 bp, Mus musculus
ttgagtcctgtgacctccttgcaag

SEQ ID NO: 948732 - DNA, 25 bp, Mus musculus
ttgagtcctgtgctcctcgtgtgag

SEQ ID NO: 948733 - DNA, 25 bp, Mus musculus
ttgagtcctgtggtcctcgtgtgag

SEQ ID NO: 948734 - DNA, 25 bp, Mus musculus
ttgagtcctgtgtcctccttgcaag

SEQ ID NO: 948735 - DNA, 25 bp, Mus musculus
ttgagtccttggctgtccctgtaac

SEQ ID NO: 948736 - DNA, 25 bp, Mus musculus
ttgagtccttggcttgactgtactg

SEQ ID NO: 948737 - DNA, 25 bp, Mus musculus
ttgagtccttgggtgtccctgtaac

SEQ ID NO: 948738 - DNA, 25 bp, Mus musculus
ttgagtccttgggttgactgtactg

SEQ ID NO: 948739 - DNA, 25 bp, Mus musculus
ttgagtctcagtcccagatctgtag

SEQ ID NO: 948740 - DNA, 25 bp, Mus musculus
ttgagtctcagtgccagatctgtag

SEQ ID NO: 948741 - DNA, 25 bp, Mus musculus
ttgagtctcctgcacgcatggaaaa

SEQ ID NO: 948742 - DNA, 25 bp, Mus musculus
ttgagtctcctggacgcatggaaaa

SEQ ID NO: 948743 - DNA, 25 bp, Mus musculus
ttgagtctctgcagcgtgagatcca

SEQ ID NO: 948744 - DNA, 25 bp, Mus musculus
ttgagtctctgctgcgtgagatcca

SEQ ID NO: 948745 - DNA, 25 bp, Mus musculus
ttgagtctgaaacccgaccctagca

SEQ ID NO: 948746 - DNA, 25 bp, Mus musculus
ttgagtctgaaagccgaccctagca

SEQ ID NO: 948747 - DNA, 25 bp, Mus musculus
ttgagtctgaggcactgaacctgaa

SEQ ID NO: 948748 - DNA, 25 bp, Mus musculus
ttgagtctgagggactgaacctgaa

SEQ ID NO: 948749 - DNA, 25 bp, Mus musculus
ttgagtctgctgcagcttgaaccag

SEQ ID NO: 948750 - DNA, 25 bp, Mus musculus
ttgagtctgctggagcttgaaccag

SEQ ID NO: 948751 - DNA, 25 bp, Mus musculus
ttgagtctggtgagtttccccactg

SEQ ID NO: 948752 - DNA, 25 bp, Mus musculus
ttgagtctggtgtgtttccccactg

SEQ ID NO: 948753 - DNA, 25 bp, Mus musculus
ttgagtctgtcaatgccgattttag

SEQ ID NO: 948754 - DNA, 25 bp, Mus musculus
ttgagtctgtcattgccgattttag

SEQ ID NO: 948755 - DNA, 25 bp, Mus musculus
ttgagtcttattactgggaacatgg

SEQ ID NO: 948756 - DNA, 25 bp, Mus musculus
ttgagtcttatttctgggaacatgg

SEQ ID NO: 948757 - DNA, 25 bp, Mus musculus
ttgagtcttcgcagcagtgtggccc

SEQ ID NO: 948758 - DNA, 25 bp, Mus musculus
ttgagtcttcgctgcagtgtggccc

SEQ ID NO: 948759 - DNA, 25 bp, Mus musculus
ttgagtcttgctacgtagcccaagt

SEQ ID NO: 948760 - DNA, 25 bp, Mus musculus
ttgagtcttgcttcgtagcccaagt

SEQ ID NO: 948761 - DNA, 25 bp, Mus musculus
ttgagtctttatattccaccactgt

SEQ ID NO: 948762 - DNA, 25 bp, Mus musculus
ttgagtctttattttccaccactgt

SEQ ID NO: 948763 - DNA, 25 bp, Mus musculus
ttgagtctttccctgcaagaggcgt

SEQ ID NO: 948764 - DNA, 25 bp, Mus musculus
ttgagtctttccgtgcaagaggcgt

SEQ ID NO: 948765 - DNA, 25 bp, Mus musculus
ttgagtgaccagcaagcaccgccca

SEQ ID NO: 948766 - DNA, 25 bp, Mus musculus
ttgagtgaccaggaagcaccgccca

SEQ ID NO: 948767 - DNA, 25 bp, Mus musculus
ttgagtgaccatcttgggttccctt

SEQ ID NO: 948768 - DNA, 25 bp, Mus musculus
ttgagtgaccatgttgggttccctt

SEQ ID NO: 948769 - DNA, 25 bp, Mus musculus
ttgagtgacccacctcaacttctct

SEQ ID NO: 948770 - DNA, 25 bp, Mus musculus
ttgagtgacccagctcaacttctct

SEQ ID NO: 948771 - DNA, 25 bp, Mus musculus
ttgagtgactcaccgagtgctcaca

SEQ ID NO: 948772 - DNA, 25 bp, Mus musculus
ttgagtgactcagcgagtgctcaca

SEQ ID NO: 948773 - DNA, 25 bp, Mus musculus
ttgagtgagcgcatttccagggcag

SEQ ID NO: 948774 - DNA, 25 bp, Mus musculus
ttgagtgagcgcttttccagggcag

SEQ ID NO: 948775 - DNA, 25 bp, Mus musculus
ttgagtgatcgcaaacccaactatg

SEQ ID NO: 948776 - DNA, 25 bp, Mus musculus
ttgagtgatcgctaacccaactatg

SEQ ID NO: 948777 - DNA, 25 bp, Mus musculus
ttgagtgattgacacctgctgcttt

SEQ ID NO: 948778 - DNA, 25 bp, Mus musculus
ttgagtgattgagacctgctgcttt

SEQ ID NO: 948779 - DNA, 25 bp, Mus musculus
ttgagtgcaaagaacccggctggtt

SEQ ID NO: 948780 - DNA, 25 bp, Mus musculus
ttgagtgcaaagtacccggctggtt

SEQ ID NO: 948781 - DNA, 25 bp, Mus musculus
ttgagtgcactcaggaactttaccc

SEQ ID NO: 948782 - DNA, 25 bp, Mus musculus
ttgagtgcactctggaactttaccc

SEQ ID NO: 948783 - DNA, 25 bp, Mus musculus
ttgagtgccggaagctcctatagag

SEQ ID NO: 948784 - DNA, 25 bp, Mus musculus
ttgagtgccggatgctcctatagag

SEQ ID NO: 948785 - DNA, 25 bp, Mus musculus
ttgagtgccttgcatggccagctag

SEQ ID NO: 948786 - DNA, 25 bp, Mus musculus
ttgagtgccttggatggccagctag

SEQ ID NO: 948787 - DNA, 25 bp, Mus musculus
ttgagtgcctttcttctgatactat

SEQ ID NO: 948788 - DNA, 25 bp, Mus musculus
ttgagtgcctttgttctgatactat

SEQ ID NO: 948789 - DNA, 25 bp, Mus musculus
ttgagtgctacactcttgcaccttt

SEQ ID NO: 948790 - DNA, 25 bp, Mus musculus
ttgagtgctacagtcttgcaccttt

SEQ ID NO: 948791 - DNA, 25 bp, Mus musculus
ttgagtgctatcactgggatccaaa

SEQ ID NO: 948792 - DNA, 25 bp, Mus musculus
ttgagtgctatctctgggatccaaa

SEQ ID NO: 948793 - DNA, 25 bp, Mus musculus
ttgagtgctctgacccgttgtgtag

SEQ ID NO: 948794 - DNA, 25 bp, Mus musculus
ttgagtgctctgtcccgttgtgtag

SEQ ID NO: 948795 - DNA, 25 bp, Mus musculus
ttgagtgcttatagttttcttgtat

SEQ ID NO: 948796 - DNA, 25 bp, Mus musculus
ttgagtgcttattgttttcttgtat

SEQ ID NO: 948797 - DNA, 25 bp, Mus musculus
ttgagtggaaacacagaccaccttg

SEQ ID NO: 948798 - DNA, 25 bp, Mus musculus
ttgagtggaaactcagaccaccttg

SEQ ID NO: 948799 - DNA, 25 bp, Mus musculus
ttgagtggcaggaatctccagtcca

SEQ ID NO: 948800 - DNA, 25 bp, Mus musculus
ttgagtggcaggtatctccagtcca

SEQ ID NO: 948801 - DNA, 25 bp, Mus musculus
ttgagtggccccatagttaccgaat

SEQ ID NO: 948802 - DNA, 25 bp, Mus musculus
ttgagtggccccttagttaccgaat

SEQ ID NO: 948803 - DNA, 25 bp, Mus musculus
ttgagtgggccgctaactccgctga

SEQ ID NO: 948804 - DNA, 25 bp, Mus musculus
ttgagtgggccggtaactccgctga

SEQ ID NO: 948805 - DNA, 25 bp, Mus musculus
ttgagtggttctagggtcccacagc

SEQ ID NO: 948806 - DNA, 25 bp, Mus musculus
ttgagtggttcttgggtcccacagc

SEQ ID NO: 948807 - DNA, 25 bp, Mus musculus
ttgagtgtaatgaccttgttaatat

SEQ ID NO: 948808 - DNA, 25 bp, Mus musculus
ttgagtgtaatgtccttgttaatat

SEQ ID NO: 948809 - DNA, 25 bp, Mus musculus
ttgagtgtcatccttgcgccggaag

SEQ ID NO: 948810 - DNA, 25 bp, Mus musculus
ttgagtgtcatcgttgcgccggaag

SEQ ID NO: 948811 - DNA, 25 bp, Mus musculus
ttgagtgtccagctcctcgacccag

SEQ ID NO: 948812 - DNA, 25 bp, Mus musculus
ttgagtgtccaggtcctcgacccag

SEQ ID NO: 948813 - DNA, 25 bp, Mus musculus
ttgagtgtcccactgtttccaattc

SEQ ID NO: 948814 - DNA, 25 bp, Mus musculus
ttgagtgtcccagtgtttccaattc

SEQ ID NO: 948815 - DNA, 25 bp, Mus musculus
ttgagtgtctccatgcttaaagtga

SEQ ID NO: 948816 - DNA, 25 bp, Mus musculus
ttgagtgtctccttgcttaaagtga

SEQ ID NO: 948817 - DNA, 25 bp, Mus musculus
ttgagtgtgaaaactgtccctgatc

SEQ ID NO: 948818 - DNA, 25 bp, Mus musculus
ttgagtgtgaaatctgtccctgatc

SEQ ID NO: 948819 - DNA, 25 bp, Mus musculus
ttgagtgtgattaccgttttccgca

SEQ ID NO: 948820 - DNA, 25 bp, Mus musculus
ttgagtgtgatttccgttttccgca

SEQ ID NO: 948821 - DNA, 25 bp, Mus musculus
ttgagtgtgcagacccaaaccttgc

SEQ ID NO: 948822 - DNA, 25 bp, Mus musculus
ttgagtgtgcagtcccaaaccttgc

SEQ ID NO: 948823 - DNA, 25 bp, Mus musculus
ttgagtgtgctaattgtgtccgttg

SEQ ID NO: 948824 - DNA, 25 bp, Mus musculus
ttgagtgtgctatttgtgtccgttg

SEQ ID NO: 948825 - DNA, 25 bp, Mus musculus
ttgagtgtgcttacaaggagaccct

SEQ ID NO: 948826 - DNA, 25 bp, Mus musculus
ttgagtgtgctttcaaggagaccct

SEQ ID NO: 948827 - DNA, 25 bp, Mus musculus
ttgagttaaactagctttgtctctc

SEQ ID NO: 948828 - DNA, 25 bp, Mus musculus
ttgagttaaacttgctttgtctctc

SEQ ID NO: 948829 - DNA, 25 bp, Mus musculus
ttgagttaaagaacccagagtgtag

SEQ ID NO: 948830 - DNA, 25 bp, Mus musculus
ttgagttaaagatcccagagtgtag

SEQ ID NO: 948831 - DNA, 25 bp, Mus musculus
ttgagttacagcaccacggtctgaa

SEQ ID NO: 948832 - DNA, 25 bp, Mus musculus
ttgagttacagctccacggtctgaa

SEQ ID NO: 948833 - DNA, 25 bp, Mus musculus
ttgagttaccacatgtcaggacttg

SEQ ID NO: 948834 - DNA, 25 bp, Mus musculus
ttgagttaccacttgtcaggacttg

SEQ ID NO: 948835 - DNA, 25 bp, Mus musculus
ttgagttaccatctacactgcctgc

SEQ ID NO: 948836 - DNA, 25 bp, Mus musculus
ttgagttaccatgtacactgcctgc

SEQ ID NO: 948837 - DNA, 25 bp, Mus musculus
ttgagttaccctctgctgtgtgcag

SEQ ID NO: 948838 - DNA, 25 bp, Mus musculus
ttgagttaccctgtgctgtgtgcag

SEQ ID NO: 948839 - DNA, 25 bp, Mus musculus
ttgagttatagcacacctgtcctac

SEQ ID NO: 948840 - DNA, 25 bp, Mus musculus
ttgagttatagctcacctgtcctac

SEQ ID NO: 948841 - DNA, 25 bp, Mus musculus
ttgagttatcttagttccctctggc

SEQ ID NO: 948842 - DNA, 25 bp, Mus musculus
ttgagttatctttgttccctctggc

SEQ ID NO: 948843 - DNA, 25 bp, Mus musculus
ttgagttcagcaaccaagactcgct

SEQ ID NO: 948844 - DNA, 25 bp, Mus musculus
ttgagttcagcatccaagactcgct

SEQ ID NO: 948845 - DNA, 25 bp, Mus musculus
ttgagttcaggaattctttgggttg

SEQ ID NO: 948846 - DNA, 25 bp, Mus musculus
ttgagttcaggatttctttgggttg

SEQ ID NO: 948847 - DNA, 25 bp, Mus musculus
ttgagttcagggcctgcctagttta

SEQ ID NO: 948848 - DNA, 25 bp, Mus musculus
ttgagttcaggggctgcctagttta

SEQ ID NO: 948849 - DNA, 25 bp, Mus musculus
ttgagttccaaactggcctggccta

SEQ ID NO: 948850 - DNA, 25 bp, Mus musculus
ttgagttccaaagtggcctggccta

SEQ ID NO: 948851 - DNA, 25 bp, Mus musculus
ttgagttccaggatcgagtttgtga

SEQ ID NO: 948852 - DNA, 25 bp, Mus musculus
ttgagttccaggttcgagtttgtga

SEQ ID NO: 948853 - DNA, 25 bp, Mus musculus
ttgagttccatactcgcagactgga

SEQ ID NO: 948854 - DNA, 25 bp, Mus musculus
ttgagttccatagtcgcagactgga

SEQ ID NO: 948855 - DNA, 25 bp, Mus musculus
ttgagttcccaaaaccattatctgt

SEQ ID NO: 948856 - DNA, 25 bp, Mus musculus
ttgagttcccaataccattatctgt

SEQ ID NO: 948857 - DNA, 25 bp, Mus musculus
ttgagttcctagctgcccacaggta

SEQ ID NO: 948858 - DNA, 25 bp, Mus musculus
ttgagttcctaggtgcccacaggta

SEQ ID NO: 948859 - DNA, 25 bp, Mus musculus
ttgagttcctgaactgctgccaggc

SEQ ID NO: 948860 - DNA, 25 bp, Mus musculus
ttgagttcctgatctgctgccaggc

SEQ ID NO: 948861 - DNA, 25 bp, Mus musculus
ttgagttccttaccctggaaaatga

SEQ ID NO: 948862 - DNA, 25 bp, Mus musculus
ttgagttccttacgatactacggtg

SEQ ID NO: 948863 - DNA, 25 bp, Mus musculus
ttgagttccttagcctggaaaatga

SEQ ID NO: 948864 - DNA, 25 bp, Mus musculus
ttgagttccttaggatactacggtg

SEQ ID NO: 948865 - DNA, 25 bp, Mus musculus
ttgagttccttgatctcccagggtg

SEQ ID NO: 948866 - DNA, 25 bp, Mus musculus
ttgagttccttgttctcccagggtg

SEQ ID NO: 948867 - DNA, 25 bp, Mus musculus
ttgagttcgagtatgaggcctaagt

SEQ ID NO: 948868 - DNA, 25 bp, Mus musculus
ttgagttcgagtttgaggcctaagt

SEQ ID NO: 948869 - DNA, 25 bp, Mus musculus
ttgagttctaagacagactctgcca

SEQ ID NO: 948870 - DNA, 25 bp, Mus musculus
ttgagttctaagtcagactctgcca

SEQ ID NO: 948871 - DNA, 25 bp, Mus musculus
ttgagttctcaccataccaatcatg

SEQ ID NO: 948872 - DNA, 25 bp, Mus musculus
ttgagttctcacgataccaatcatg

SEQ ID NO: 948873 - DNA, 25 bp, Mus musculus
ttgagttctcatcgccttgttggga

SEQ ID NO: 948874 - DNA, 25 bp, Mus musculus
ttgagttctcatggccttgttggga

SEQ ID NO: 948875 - DNA, 25 bp, Mus musculus
ttgagttctcctatattttctccat

SEQ ID NO: 948876 - DNA, 25 bp, Mus musculus
ttgagttctcctcatcacttgaaaa

SEQ ID NO: 948877 - DNA, 25 bp, Mus musculus
ttgagttctcctgatcacttgaaaa

SEQ ID NO: 948878 - DNA, 25 bp, Mus musculus
ttgagttctcctttattttctccat

SEQ ID NO: 948879 - DNA, 25 bp, Mus musculus
ttgagttcttcacgtatttagggac

SEQ ID NO: 948880 - DNA, 25 bp, Mus musculus
ttgagttcttcaggtatttagggac

SEQ ID NO: 948881 - DNA, 25 bp, Mus musculus
ttgagttctttaaccctctgtcaga

SEQ ID NO: 948882 - DNA, 25 bp, Mus musculus
ttgagttctttatccctctgtcaga

SEQ ID NO: 948883 - DNA, 25 bp, Mus musculus
ttgagttctttgagtgtgggcattt

SEQ ID NO: 948884 - DNA, 25 bp, Mus musculus
ttgagttctttgtgtgtgggcattt

SEQ ID NO: 948885 - DNA, 25 bp, Mus musculus
ttgagttgaattctagccctgtcct

SEQ ID NO: 948886 - DNA, 25 bp, Mus musculus
ttgagttgaattgtagccctgtcct

SEQ ID NO: 948887 - DNA, 25 bp, Mus musculus
ttgagttgagatatccttgatgggt

SEQ ID NO: 948888 - DNA, 25 bp, Mus musculus
ttgagttgagatttccttgatgggt

SEQ ID NO: 948889 - DNA, 25 bp, Mus musculus
ttgagttggtataaggtggaagcac

SEQ ID NO: 948890 - DNA, 25 bp, Mus musculus
ttgagttggtattaggtggaagcac

SEQ ID NO: 948891 - DNA, 25 bp, Mus musculus
ttgagttgtactattcctcgctttg

SEQ ID NO: 948892 - DNA, 25 bp, Mus musculus
ttgagttgtacttttcctcgctttg

SEQ ID NO: 948893 - DNA, 25 bp, Mus musculus
ttgagttgtgctagcatacatgcat

SEQ ID NO: 948894 - DNA, 25 bp, Mus musculus
ttgagttgtgcttgcatacatgcat

SEQ ID NO: 948895 - DNA, 25 bp, Mus musculus
ttgagtttaaatagtgcccagaata

SEQ ID NO: 948896 - DNA, 25 bp, Mus musculus
ttgagtttaaattgtgcccagaata

SEQ ID NO: 948897 - DNA, 25 bp, Mus musculus
ttgagtttaacgcaacgggacagcg

SEQ ID NO: 948898 - DNA, 25 bp, Mus musculus
ttgagtttaacggaacgggacagcg

SEQ ID NO: 948899 - DNA, 25 bp, Mus musculus
ttgagtttaagtatgaggcctaggg

SEQ ID NO: 948900 - DNA, 25 bp, Mus musculus
ttgagtttaagtttgaggcctaggg

SEQ ID NO: 948901 - DNA, 25 bp, Mus musculus
ttgagtttacgtaatgacatggttt

SEQ ID NO: 948902 - DNA, 25 bp, Mus musculus
ttgagtttacgttatgacatggttt

SEQ ID NO: 948903 - DNA, 25 bp, Mus musculus
ttgagtttactccaggaagagatac

SEQ ID NO: 948904 - DNA, 25 bp, Mus musculus
ttgagtttactcgaggaagagatac

SEQ ID NO: 948905 - DNA, 25 bp, Mus musculus
ttgagtttattaagtagctttagct

SEQ ID NO: 948906 - DNA, 25 bp, Mus musculus
ttgagtttattatgtagctttagct

SEQ ID NO: 948907 - DNA, 25 bp, Mus musculus
ttgagtttcattcgcttactgataa

SEQ ID NO: 948908 - DNA, 25 bp, Mus musculus
ttgagtttcattggcttactgataa

SEQ ID NO: 948909 - DNA, 25 bp, Mus musculus
ttgagtttcctcaacattgctagta

SEQ ID NO: 948910 - DNA, 25 bp, Mus musculus
ttgagtttcctctacattgctagta

SEQ ID NO: 948911 - DNA, 25 bp, Mus musculus
ttgagtttcctgatcgaagtgccgc

SEQ ID NO: 948912 - DNA, 25 bp, Mus musculus
ttgagtttcctgttcgaagtgccgc

SEQ ID NO: 948913 - DNA, 25 bp, Mus musculus
ttgagtttctttctccttaggcctt

SEQ ID NO: 948914 - DNA, 25 bp, Mus musculus
ttgagtttctttgtccttaggcctt

SEQ ID NO: 948915 - DNA, 25 bp, Mus musculus
ttgagtttgagcaccttgaccttaa

SEQ ID NO: 948916 - DNA, 25 bp, Mus musculus
ttgagtttgagctccttgaccttaa

SEQ ID NO: 948917 - DNA, 25 bp, Mus musculus
ttgagtttgcacactccttggccac

SEQ ID NO: 948918 - DNA, 25 bp, Mus musculus
ttgagtttgcactctccttggccac

SEQ ID NO: 948919 - DNA, 25 bp, Mus musculus
ttgagtttgcagaatcctatggttt

SEQ ID NO: 948920 - DNA, 25 bp, Mus musculus
ttgagtttgcagtatcctatggttt

SEQ ID NO: 948921 - DNA, 25 bp, Mus musculus
ttgagtttggatcacagccccaaca

SEQ ID NO: 948922 - DNA, 25 bp, Mus musculus
ttgagtttggatgacagccccaaca

SEQ ID NO: 948923 - DNA, 25 bp, Mus musculus
ttgagtttgtagactctggtctaaa

SEQ ID NO: 948924 - DNA, 25 bp, Mus musculus
ttgagtttgtagtctctggtctaaa

SEQ ID NO: 948925 - DNA, 25 bp, Mus musculus
ttgagtttgtctcctagcactcagg

SEQ ID NO: 948926 - DNA, 25 bp, Mus musculus
ttgagtttgtctgctagcactcagg

SEQ ID NO: 948927 - DNA, 25 bp, Mus musculus
ttgagtttgtgcactgggctcctat

SEQ ID NO: 948928 - DNA, 25 bp, Mus musculus
ttgagtttgtgctctgggctcctat

SEQ ID NO: 948929 - DNA, 25 bp, Mus musculus
ttgagtttgtggctagcctggacca

SEQ ID NO: 948930 - DNA, 25 bp, Mus musculus
ttgagtttgtgggtagcctggacca

SEQ ID NO: 948931 - DNA, 25 bp, Mus musculus
ttgagttttaacaattccccgtgct

SEQ ID NO: 948932 - DNA, 25 bp, Mus musculus
ttgagttttaactattccccgtgct

SEQ ID NO: 948933 - DNA, 25 bp, Mus musculus
ttgagttttatcatccagcacctaa

SEQ ID NO: 948934 - DNA, 25 bp, Mus musculus
ttgagttttatcttccagcacctaa

SEQ ID NO: 948935 - DNA, 25 bp, Mus musculus
ttgagttttccactcgagccaaaat

SEQ ID NO: 948936 - DNA, 25 bp, Mus musculus
ttgagttttccagtcgagccaaaat

SEQ ID NO: 948937 - DNA, 25 bp, Mus musculus
ttgagttttcttctagcatgacccc

SEQ ID NO: 948938 - DNA, 25 bp, Mus musculus
ttgagttttcttgtagcatgacccc

SEQ ID NO: 948939 - DNA, 25 bp, Mus musculus
ttgagttttggacacctccctggga

SEQ ID NO: 948940 - DNA, 25 bp, Mus musculus
ttgagttttggagacctccctggga

SEQ ID NO: 948941 - DNA, 25 bp, Mus musculus
ttgagttttttaaggctcaccctga

SEQ ID NO: 948942 - DNA, 25 bp, Mus musculus
ttgagttttttaccctcatgggcca

SEQ ID NO: 948943 - DNA, 25 bp, Mus musculus
ttgagttttttagcctcatgggcca

SEQ ID NO: 948944 - DNA, 25 bp, Mus musculus
ttgagttttttatggctcaccctga

SEQ ID NO: 948945 - DNA, 25 bp, Mus musculus
ttgataaaacacctgctatgtaagc

SEQ ID NO: 948946 - DNA, 25 bp, Mus musculus
ttgataaaacacgtgctatgtaagc

SEQ ID NO: 948947 - DNA, 25 bp, Mus musculus
ttgataaaagcacatgtgttccaac

SEQ ID NO: 948948 - DNA, 25 bp, Mus musculus
ttgataaaagcagatgtgttccaac

SEQ ID NO: 948949 - DNA, 25 bp, Mus musculus
ttgataacactgagggtgcctaccg

SEQ ID NO: 948950 - DNA, 25 bp, Mus musculus
ttgataacactgtgggtgcctaccg

SEQ ID NO: 948951 - DNA, 25 bp, Mus musculus
ttgataacatctacacctccgacat

SEQ ID NO: 948952 - DNA, 25 bp, Mus musculus
ttgataacatcttcacctccgacat

SEQ ID NO: 948953 - DNA, 25 bp, Mus musculus
ttgataacccaaacccttcagaaag

SEQ ID NO: 948954 - DNA, 25 bp, Mus musculus
ttgataacccaatcccttcagaaag

SEQ ID NO: 948955 - DNA, 25 bp, Mus musculus
ttgataacccgacaaatggccccaa

SEQ ID NO: 948956 - DNA, 25 bp, Mus musculus
ttgataacccgagaaatggccccaa

SEQ ID NO: 948957 - DNA, 25 bp, Mus musculus
ttgataacctccattcccagtgttt

SEQ ID NO: 948958 - DNA, 25 bp, Mus musculus
ttgataacctcctttcccagtgttt

SEQ ID NO: 948959 - DNA, 25 bp, Mus musculus
ttgataactcaacaggcagaacatg

SEQ ID NO: 948960 - DNA, 25 bp, Mus musculus
ttgataactcaagaggcagaacatg

SEQ ID NO: 948961 - DNA, 25 bp, Mus musculus
ttgataagacctaccctggtcggtc

SEQ ID NO: 948962 - DNA, 25 bp, Mus musculus
ttgataagaccttccctggtcggtc

SEQ ID NO: 948963 - DNA, 25 bp, Mus musculus
ttgataagagcaccgcgcaagccgg

SEQ ID NO: 948964 - DNA, 25 bp, Mus musculus
ttgataagagcagcgcgcaagccgg

SEQ ID NO: 948965 - DNA, 25 bp, Mus musculus
ttgataagcaagagttaggcttcag

SEQ ID NO: 948966 - DNA, 25 bp, Mus musculus
ttgataagcaagtgttaggcttcag

SEQ ID NO: 948967 - DNA, 25 bp, Mus musculus
ttgataagcataatttctccaaagg

SEQ ID NO: 948968 - DNA, 25 bp, Mus musculus
ttgataagcatattttctccaaagg

SEQ ID NO: 948969 - DNA, 25 bp, Mus musculus
ttgataagctataccttaactgtgt

SEQ ID NO: 948970 - DNA, 25 bp, Mus musculus
ttgataagctattccttaactgtgt

SEQ ID NO: 948971 - DNA, 25 bp, Mus musculus
ttgataaggtttcgcagcttcccct

SEQ ID NO: 948972 - DNA, 25 bp, Mus musculus
ttgataaggtttggcagcttcccct

SEQ ID NO: 948973 - DNA, 25 bp, Mus musculus
ttgataatcataatcctgaggccag

SEQ ID NO: 948974 - DNA, 25 bp, Mus musculus
ttgataatcatattcctgaggccag

SEQ ID NO: 948975 - DNA, 25 bp, Mus musculus
ttgataatgagcaggctgctgatta

SEQ ID NO: 948976 - DNA, 25 bp, Mus musculus
ttgataatgagctggctgctgatta

SEQ ID NO: 948977 - DNA, 25 bp, Mus musculus
ttgataatgggcaggcttggcttga

SEQ ID NO: 948978 - DNA, 25 bp, Mus musculus
ttgataatgggctggcttggcttga

SEQ ID NO: 948979 - DNA, 25 bp, Mus musculus
ttgataattcctcatttgctggctg

SEQ ID NO: 948980 - DNA, 25 bp, Mus musculus
ttgataattcctgatttgctggctg

SEQ ID NO: 948981 - DNA, 25 bp, Mus musculus
ttgatacaacctacagacctcacat

SEQ ID NO: 948982 - DNA, 25 bp, Mus musculus
ttgatacaaccttcagacctcacat

SEQ ID NO: 948983 - DNA, 25 bp, Mus musculus
ttgatacaatggcaagccttctgaa

SEQ ID NO: 948984 - DNA, 25 bp, Mus musculus
ttgatacaatgggaagccttctgaa

SEQ ID NO: 948985 - DNA, 25 bp, Mus musculus
ttgatacacccaataccatacacac

SEQ ID NO: 948986 - DNA, 25 bp, Mus musculus
ttgatacacccattaccatacacac

SEQ ID NO: 948987 - DNA, 25 bp, Mus musculus
ttgatacaggtcagagtaaagccga

SEQ ID NO: 948988 - DNA, 25 bp, Mus musculus
ttgatacaggtctgagtaaagccga

SEQ ID NO: 948989 - DNA, 25 bp, Mus musculus
ttgatacagtccactacacttttgc

SEQ ID NO: 948990 - DNA, 25 bp, Mus musculus
ttgatacagtccctcatgatgcctt

SEQ ID NO: 948991 - DNA, 25 bp, Mus musculus
ttgatacagtccgtcatgatgcctt

SEQ ID NO: 948992 - DNA, 25 bp, Mus musculus
ttgatacagtcctctacacttttgc

SEQ ID NO: 948993 - DNA, 25 bp, Mus musculus
ttgatacatacacattccagcccag

SEQ ID NO: 948994 - DNA, 25 bp, Mus musculus
ttgatacatacagattccagcccag

SEQ ID NO: 948995 - DNA, 25 bp, Mus musculus
ttgatacatcacaaactcagttggg

SEQ ID NO: 948996 - DNA, 25 bp, Mus musculus
ttgatacatcactaactcagttggg

SEQ ID NO: 948997 - DNA, 25 bp, Mus musculus
ttgatacatgcccttcactgttggt

SEQ ID NO: 948998 - DNA, 25 bp, Mus musculus
ttgatacatgccgttcactgttggt

SEQ ID NO: 948999 - DNA, 25 bp, Mus musculus
ttgataccaacaccacagggcgcct

SEQ ID NO: 949000 - DNA, 25 bp, Mus musculus
ttgataccaacagcacagggcgcct

SEQ ID NO: 949001 - DNA, 25 bp, Mus musculus
ttgataccaagaccctaagacattt

SEQ ID NO: 949002 - DNA, 25 bp, Mus musculus
ttgataccaagagcctaagacattt

SEQ ID NO: 949003 - DNA, 25 bp, Mus musculus
ttgataccaggtacacttttttgtg

SEQ ID NO: 949004 - DNA, 25 bp, Mus musculus
ttgataccaggtctttatatatata

SEQ ID NO: 949005 - DNA, 25 bp, Mus musculus
ttgataccaggtgtttatatatata

SEQ ID NO: 949006 - DNA, 25 bp, Mus musculus
ttgataccaggttcacttttttgtg

SEQ ID NO: 949007 - DNA, 25 bp, Mus musculus
ttgataccctccatcagaatcaagc

SEQ ID NO: 949008 - DNA, 25 bp, Mus musculus
ttgataccctccttcagaatcaagc

SEQ ID NO: 949009 - DNA, 25 bp, Mus musculus
ttgataccgggaatctcaacctgtc

SEQ ID NO: 949010 - DNA, 25 bp, Mus musculus
ttgataccgggattctcaacctgtc

SEQ ID NO: 949011 - DNA, 25 bp, Mus musculus
ttgatacctgaccacggtttggctc

SEQ ID NO: 949012 - DNA, 25 bp, Mus musculus
ttgatacctgacgacggtttggctc

SEQ ID NO: 949013 - DNA, 25 bp, Mus musculus
ttgatacgtatgcagccgggcacac

SEQ ID NO: 949014 - DNA, 25 bp, Mus musculus
ttgatacgtatggagccgggcacac

SEQ ID NO: 949015 - DNA, 25 bp, Mus musculus
ttgatactcaaccacgacaatccgg

SEQ ID NO: 949016 - DNA, 25 bp, Mus musculus
ttgatactcaacgacgacaatccgg

SEQ ID NO: 949017 - DNA, 25 bp, Mus musculus
ttgatactgcatatggacgatcctg

SEQ ID NO: 949018 - DNA, 25 bp, Mus musculus
ttgatactgcatttggacgatcctg

SEQ ID NO: 949019 - DNA, 25 bp, Mus musculus
ttgatacttcccattgtcttactct

SEQ ID NO: 949020 - DNA, 25 bp, Mus musculus
ttgatacttccctttgtcttactct

SEQ ID NO: 949021 - DNA, 25 bp, Mus musculus
ttgatagaaggcagtctttctccca

SEQ ID NO: 949022 - DNA, 25 bp, Mus musculus
ttgatagaaggctgtctttctccca

SEQ ID NO: 949023 - DNA, 25 bp, Mus musculus
ttgatagacgtgaacgaagcttttg

SEQ ID NO: 949024 - DNA, 25 bp, Mus musculus
ttgatagacgtgtacgaagcttttg

SEQ ID NO: 949025 - DNA, 25 bp, Mus musculus
ttgatagcacaacagcctgtgaatg

SEQ ID NO: 949026 - DNA, 25 bp, Mus musculus
ttgatagcacaagagcctgtgaatg

SEQ ID NO: 949027 - DNA, 25 bp, Mus musculus
ttgatagcattccaggctgcttcca

SEQ ID NO: 949028 - DNA, 25 bp, Mus musculus
ttgatagcattcgaggctgcttcca

SEQ ID NO: 949029 - DNA, 25 bp, Mus musculus
ttgatagccatgactcaccctgctt

SEQ ID NO: 949030 - DNA, 25 bp, Mus musculus
ttgatagccatgtctcaccctgctt

SEQ ID NO: 949031 - DNA, 25 bp, Mus musculus
ttgatagctcttaactcccttgaga

SEQ ID NO: 949032 - DNA, 25 bp, Mus musculus
ttgatagctctttactcccttgaga

SEQ ID NO: 949033 - DNA, 25 bp, Mus musculus
ttgatagctgctagggcaccgatta

SEQ ID NO: 949034 - DNA, 25 bp, Mus musculus
ttgatagctgcttgggcaccgatta

SEQ ID NO: 949035 - DNA, 25 bp, Mus musculus
ttgataggactgattgccctcagca

SEQ ID NO: 949036 - DNA, 25 bp, Mus musculus
ttgataggactgtttgccctcagca

SEQ ID NO: 949037 - DNA, 25 bp, Mus musculus
ttgataggccttacggtcccaagat

SEQ ID NO: 949038 - DNA, 25 bp, Mus musculus
ttgataggcctttcggtcccaagat

SEQ ID NO: 949039 - DNA, 25 bp, Mus musculus
ttgataggctgacattttcccctga

SEQ ID NO: 949040 - DNA, 25 bp, Mus musculus
ttgataggctgagattttcccctga

SEQ ID NO: 949041 - DNA, 25 bp, Mus musculus
ttgataggctgtcaccagtggttgt

SEQ ID NO: 949042 - DNA, 25 bp, Mus musculus
ttgataggctgtgaccagtggttgt

SEQ ID NO: 949043 - DNA, 25 bp, Mus musculus
ttgataggtcacaatctccatcctt

SEQ ID NO: 949044 - DNA, 25 bp, Mus musculus
ttgataggtcactatctccatcctt

SEQ ID NO: 949045 - DNA, 25 bp, Mus musculus
ttgatagtaacaaccttcccacccg

SEQ ID NO: 949046 - DNA, 25 bp, Mus musculus
ttgatagtaacatccttcccacccg

SEQ ID NO: 949047 - DNA, 25 bp, Mus musculus
ttgatagtcttgaaaaatgtcccat

SEQ ID NO: 949048 - DNA, 25 bp, Mus musculus
ttgatagtcttgtaaaatgtcccat

SEQ ID NO: 949049 - DNA, 25 bp, Mus musculus
ttgatagttattcatgtgcatctgt

SEQ ID NO: 949050 - DNA, 25 bp, Mus musculus
ttgatagttattgatgtgcatctgt

SEQ ID NO: 949051 - DNA, 25 bp, Mus musculus
ttgatataaatcacctgtctgccca

SEQ ID NO: 949052 - DNA, 25 bp, Mus musculus
ttgatataaatctcctgtctgccca

SEQ ID NO: 949053 - DNA, 25 bp, Mus musculus
ttgatatacactccggcggaccgac

SEQ ID NO: 949054 - DNA, 25 bp, Mus musculus
ttgatatacactgcggcggaccgac

SEQ ID NO: 949055 - DNA, 25 bp, Mus musculus
ttgatatacgcgaccactgaagtga

SEQ ID NO: 949056 - DNA, 25 bp, Mus musculus
ttgatatacgcgtccactgaagtga

SEQ ID NO: 949057 - DNA, 25 bp, Mus musculus
ttgatatatcatagcctttgaaagc

SEQ ID NO: 949058 - DNA, 25 bp, Mus musculus
ttgatatatcattgcctttgaaagc

SEQ ID NO: 949059 - DNA, 25 bp, Mus musculus
ttgatatattgcaccatgcatgttt

SEQ ID NO: 949060 - DNA, 25 bp, Mus musculus
ttgatatattgctccatgcatgttt

SEQ ID NO: 949061 - DNA, 25 bp, Mus musculus
ttgatatcaaccagtctgtctcttt

SEQ ID NO: 949062 - DNA, 25 bp, Mus musculus
ttgatatcaacctgtctgtctcttt

SEQ ID NO: 949063 - DNA, 25 bp, Mus musculus
ttgatatccgaactaattcatttag

SEQ ID NO: 949064 - DNA, 25 bp, Mus musculus
ttgatatccgaagtaattcatttag

SEQ ID NO: 949065 - DNA, 25 bp, Mus musculus
ttgatatctaaacatcccaccccgt

SEQ ID NO: 949066 - DNA, 25 bp, Mus musculus
ttgatatctaaagatcccaccccgt

SEQ ID NO: 949067 - DNA, 25 bp, Mus musculus
ttgatatctcggatacaatagaggc

SEQ ID NO: 949068 - DNA, 25 bp, Mus musculus
ttgatatctcggttacaatagaggc

SEQ ID NO: 949069 - DNA, 25 bp, Mus musculus
ttgatatctcttcctggctgcccag

SEQ ID NO: 949070 - DNA, 25 bp, Mus musculus
ttgatatctcttgctggctgcccag

SEQ ID NO: 949071 - DNA, 25 bp, Mus musculus
ttgatatctggtaccacgtgaccct

SEQ ID NO: 949072 - DNA, 25 bp, Mus musculus
ttgatatctggttccacgtgaccct

SEQ ID NO: 949073 - DNA, 25 bp, Mus musculus
ttgatatgaaacactctctgacggg

SEQ ID NO: 949074 - DNA, 25 bp, Mus musculus
ttgatatgaaactctctctgacggg

SEQ ID NO: 949075 - DNA, 25 bp, Mus musculus
ttgatatgcgcaagacagctgatga

SEQ ID NO: 949076 - DNA, 25 bp, Mus musculus
ttgatatgcgcatgacagctgatga

SEQ ID NO: 949077 - DNA, 25 bp, Mus musculus
ttgatatggactctcttctcggagc

SEQ ID NO: 949078 - DNA, 25 bp, Mus musculus
ttgatatggactgtcttctcggagc

SEQ ID NO: 949079 - DNA, 25 bp, Mus musculus
ttgatatgtcttcaggcgcacttgc

SEQ ID NO: 949080 - DNA, 25 bp, Mus musculus
ttgatatgtcttgaggcgcacttgc

SEQ ID NO: 949081 - DNA, 25 bp, Mus musculus
ttgatatgtgctacttatgattctt

SEQ ID NO: 949082 - DNA, 25 bp, Mus musculus
ttgatatgtgcttcttatgattctt

SEQ ID NO: 949083 - DNA, 25 bp, Mus musculus
ttgatattgctcatcctccattgga

SEQ ID NO: 949084 - DNA, 25 bp, Mus musculus
ttgatattgctcttcctccattgga

SEQ ID NO: 949085 - DNA, 25 bp, Mus musculus
ttgatattggctatcggttttgcaa

SEQ ID NO: 949086 - DNA, 25 bp, Mus musculus
ttgatattggctttcggttttgcaa

SEQ ID NO: 949087 - DNA, 25 bp, Mus musculus
ttgatatttgctatgtttacatgag

SEQ ID NO: 949088 - DNA, 25 bp, Mus musculus
ttgatatttgctttgtttacatgag

SEQ ID NO: 949089 - DNA, 25 bp, Mus musculus
ttgatattttgtcctctccctgaaa

SEQ ID NO: 949090 - DNA, 25 bp, Mus musculus
ttgatattttgtgctctccctgaaa

SEQ ID NO: 949091 - DNA, 25 bp, Mus musculus
ttgatatttttgaggaccccaggcc

SEQ ID NO: 949092 - DNA, 25 bp, Mus musculus
ttgatatttttgtggaccccaggcc

SEQ ID NO: 949093 - DNA, 25 bp, Mus musculus
ttgatcaaaaggatgttcccatagt

SEQ ID NO: 949094 - DNA, 25 bp, Mus musculus
ttgatcaaaaggttgttcccatagt

SEQ ID NO: 949095 - DNA, 25 bp, Mus musculus
ttgatcaaggccactttcctatcag

SEQ ID NO: 949096 - DNA, 25 bp, Mus musculus
ttgatcaaggcctctttcctatcag

SEQ ID NO: 949097 - DNA, 25 bp, Mus musculus
ttgatcacatgaacgtctcctgagc

SEQ ID NO: 949098 - DNA, 25 bp, Mus musculus
ttgatcacatgatcgtctcctgagc

SEQ ID NO: 949099 - DNA, 25 bp, Mus musculus
ttgatcacctggcaccgcataaagt

SEQ ID NO: 949100 - DNA, 25 bp, Mus musculus
ttgatcacctgggaccgcataaagt

SEQ ID NO: 949101 - DNA, 25 bp, Mus musculus
ttgatcactattcatggacctctcc

SEQ ID NO: 949102 - DNA, 25 bp, Mus musculus
ttgatcactattgatggacctctcc

SEQ ID NO: 949103 - DNA, 25 bp, Mus musculus
ttgatcactcagcatttgttcccgc

SEQ ID NO: 949104 - DNA, 25 bp, Mus musculus
ttgatcactcaggatttgttcccgc

SEQ ID NO: 949105 - DNA, 25 bp, Mus musculus
ttgatcactcatcgttttgggacac

SEQ ID NO: 949106 - DNA, 25 bp, Mus musculus
ttgatcactcatggttttgggacac

SEQ ID NO: 949107 - DNA, 25 bp, Mus musculus
ttgatcaggcgtaggattcgtccaa

SEQ ID NO: 949108 - DNA, 25 bp, Mus musculus
ttgatcaggcgttggattcgtccaa

SEQ ID NO: 949109 - DNA, 25 bp, Mus musculus
ttgatcagggttcaacctccagaac

SEQ ID NO: 949110 - DNA, 25 bp, Mus musculus
ttgatcagggttgaacctccagaac

SEQ ID NO: 949111 - DNA, 25 bp, Mus musculus
ttgatcagtcaacaaccaattaggg

SEQ ID NO: 949112 - DNA, 25 bp, Mus musculus
ttgatcagtcaagaaccaattaggg

SEQ ID NO: 949113 - DNA, 25 bp, Mus musculus
ttgatcagtctgctcttcctggtta

SEQ ID NO: 949114 - DNA, 25 bp, Mus musculus
ttgatcagtctggtcttcctggtta

SEQ ID NO: 949115 - DNA, 25 bp, Mus musculus
ttgatcagttcaaaggcacagccgc

SEQ ID NO: 949116 - DNA, 25 bp, Mus musculus
ttgatcagttcataggcacagccgc

SEQ ID NO: 949117 - DNA, 25 bp, Mus musculus
ttgatcatcagtcgtcgtcgtcttc

SEQ ID NO: 949118 - DNA, 25 bp, Mus musculus
ttgatcatcagtggtcgtcgtcttc

SEQ ID NO: 949119 - DNA, 25 bp, Mus musculus
ttgatcatccctatctacgttgtga

SEQ ID NO: 949120 - DNA, 25 bp, Mus musculus
ttgatcatccctttctacgttgtga

SEQ ID NO: 949121 - DNA, 25 bp, Mus musculus
ttgatcatctggactgagagcttca

SEQ ID NO: 949122 - DNA, 25 bp, Mus musculus
ttgatcatctggtctgagagcttca

SEQ ID NO: 949123 - DNA, 25 bp, Mus musculus
ttgatcatcttccttgtcacgcctg

SEQ ID NO: 949124 - DNA, 25 bp, Mus musculus
ttgatcatcttcgttgtcacgcctg

SEQ ID NO: 949125 - DNA, 25 bp, Mus musculus
ttgatcatgggacttgtaatcagga

SEQ ID NO: 949126 - DNA, 25 bp, Mus musculus
ttgatcatgggagttgtaatcagga

SEQ ID NO: 949127 - DNA, 25 bp, Mus musculus
ttgatcatgtctccagagagggttc

SEQ ID NO: 949128 - DNA, 25 bp, Mus musculus
ttgatcatgtctgcagagagggttc

SEQ ID NO: 949129 - DNA, 25 bp, Mus musculus
ttgatcatttccactgcacatttct

SEQ ID NO: 949130 - DNA, 25 bp, Mus musculus
ttgatcatttcctctgcacatttct

SEQ ID NO: 949131 - DNA, 25 bp, Mus musculus
ttgatccacctgatggccaaagctg

SEQ ID NO: 949132 - DNA, 25 bp, Mus musculus
ttgatccacctgttggccaaagctg

SEQ ID NO: 949133 - DNA, 25 bp, Mus musculus
ttgatccagggcaaagtccaaaaga

SEQ ID NO: 949134 - DNA, 25 bp, Mus musculus
ttgatccagggctaagtccaaaaga

SEQ ID NO: 949135 - DNA, 25 bp, Mus musculus
ttgatccagtgcactatctgttcac

SEQ ID NO: 949136 - DNA, 25 bp, Mus musculus
ttgatccagtgctctatctgttcac

SEQ ID NO: 949137 - DNA, 25 bp, Mus musculus
ttgatccatatcattttgctgtaat

SEQ ID NO: 949138 - DNA, 25 bp, Mus musculus
ttgatccatatctttttgctgtaat

SEQ ID NO: 949139 - DNA, 25 bp, Mus musculus
ttgatcccacatcccatttcttaag

SEQ ID NO: 949140 - DNA, 25 bp, Mus musculus
ttgatcccacatgccatttcttaag

SEQ ID NO: 949141 - DNA, 25 bp, Mus musculus
ttgatcccacttcgactctctctta

SEQ ID NO: 949142 - DNA, 25 bp, Mus musculus
ttgatcccacttggactctctctta

SEQ ID NO: 949143 - DNA, 25 bp, Mus musculus
ttgatcccagaaaaatgactctgag

SEQ ID NO: 949144 - DNA, 25 bp, Mus musculus
ttgatcccagaataatgactctgag

SEQ ID NO: 949145 - DNA, 25 bp, Mus musculus
ttgatcccagcaatgcatcaactgg

SEQ ID NO: 949146 - DNA, 25 bp, Mus musculus
ttgatcccagcattgcatcaactgg

SEQ ID NO: 949147 - DNA, 25 bp, Mus musculus
ttgatcccatcccaacacctcctgt

SEQ ID NO: 949148 - DNA, 25 bp, Mus musculus
ttgatcccatccgaacacctcctgt

SEQ ID NO: 949149 - DNA, 25 bp, Mus musculus
ttgatcccatctcagagcccttact

SEQ ID NO: 949150 - DNA, 25 bp, Mus musculus
ttgatcccatctgagagcccttact

SEQ ID NO: 949151 - DNA, 25 bp, Mus musculus
ttgatccccggcctgtggagaccct

SEQ ID NO: 949152 - DNA, 25 bp, Mus musculus
ttgatccccggcgtgtggagaccct

SEQ ID NO: 949153 - DNA, 25 bp, Mus musculus
ttgatcccctaactcatgtggttga

SEQ ID NO: 949154 - DNA, 25 bp, Mus musculus
ttgatcccctaagtcatgtggttga

SEQ ID NO: 949155 - DNA, 25 bp, Mus musculus
ttgatcccgtgtatgttatgacccc

SEQ ID NO: 949156 - DNA, 25 bp, Mus musculus
ttgatcccgtgtttgttatgacccc

SEQ ID NO: 949157 - DNA, 25 bp, Mus musculus
ttgatccgataacgccagttgatgc

SEQ ID NO: 949158 - DNA, 25 bp, Mus musculus
ttgatccgataaggccagttgatgc

SEQ ID NO: 949159 - DNA, 25 bp, Mus musculus
ttgatccgcgctaccctaaccagaa

SEQ ID NO: 949160 - DNA, 25 bp, Mus musculus
ttgatccgcgcttccctaaccagaa

SEQ ID NO: 949161 - DNA, 25 bp, Mus musculus
ttgatcctacctccgaggtcaaagg

SEQ ID NO: 949162 - DNA, 25 bp, Mus musculus
ttgatcctacctgcgaggtcaaagg

SEQ ID NO: 949163 - DNA, 25 bp, Mus musculus
ttgatcctactaccttaagctttga

SEQ ID NO: 949164 - DNA, 25 bp, Mus musculus
ttgatcctactagcttaagctttga

SEQ ID NO: 949165 - DNA, 25 bp, Mus musculus
ttgatcctcagacacgtgctcgaga

SEQ ID NO: 949166 - DNA, 25 bp, Mus musculus
ttgatcctcagagacgtgctcgaga

SEQ ID NO: 949167 - DNA, 25 bp, Mus musculus
ttgatcctcaggctttcacaacttc

SEQ ID NO: 949168 - DNA, 25 bp, Mus musculus
ttgatcctcagggtttcacaacttc

SEQ ID NO: 949169 - DNA, 25 bp, Mus musculus
ttgatcctccttcttacttagcctc

SEQ ID NO: 949170 - DNA, 25 bp, Mus musculus
ttgatcctccttgttacttagcctc

SEQ ID NO: 949171 - DNA, 25 bp, Mus musculus
ttgatcctcttgacaacacatccag

SEQ ID NO: 949172 - DNA, 25 bp, Mus musculus
ttgatcctcttgtcaacacatccag

SEQ ID NO: 949173 - DNA, 25 bp, Mus musculus
ttgatcctgacactcttagttttgg

SEQ ID NO: 949174 - DNA, 25 bp, Mus musculus
ttgatcctgacagtcttagttttgg

SEQ ID NO: 949175 - DNA, 25 bp, Mus musculus
ttgatcctgtcaacaaggtcttgaa

SEQ ID NO: 949176 - DNA, 25 bp, Mus musculus
ttgatcctgtcatcaaggtcttgaa

SEQ ID NO: 949177 - DNA, 25 bp, Mus musculus
ttgatccttgccctatgaaataaaa

SEQ ID NO: 949178 - DNA, 25 bp, Mus musculus
ttgatccttgccgtatgaaataaaa

SEQ ID NO: 949179 - DNA, 25 bp, Mus musculus
ttgatcgactctatttacctgttgc

SEQ ID NO: 949180 - DNA, 25 bp, Mus musculus
ttgatcgactctttttacctgttgc

SEQ ID NO: 949181 - DNA, 25 bp, Mus musculus
ttgatcgaggtcaagaacagtggct

SEQ ID NO: 949182 - DNA, 25 bp, Mus musculus
ttgatcgaggtctagaacagtggct

SEQ ID NO: 949183 - DNA, 25 bp, Mus musculus
ttgatcgcatttatctctgggtttt

SEQ ID NO: 949184 - DNA, 25 bp, Mus musculus
ttgatcgcatttttctctgggtttt

SEQ ID NO: 949185 - DNA, 25 bp, Mus musculus
ttgatcgctggtacagtccagtcaa

SEQ ID NO: 949186 - DNA, 25 bp, Mus musculus
ttgatcgctggttcagtccagtcaa

SEQ ID NO: 949187 - DNA, 25 bp, Mus musculus
ttgatcgctgtccttctctgattga

SEQ ID NO: 949188 - DNA, 25 bp, Mus musculus
ttgatcgctgtcgttctctgattga

SEQ ID NO: 949189 - DNA, 25 bp, Mus musculus
ttgatcgggagccagcttcacactg

SEQ ID NO: 949190 - DNA, 25 bp, Mus musculus
ttgatcgggagcgagcttcacactg

SEQ ID NO: 949191 - DNA, 25 bp, Mus musculus
ttgatcggtcccatgcaggaaaaga

SEQ ID NO: 949192 - DNA, 25 bp, Mus musculus
ttgatcggtcccttgcaggaaaaga

SEQ ID NO: 949193 - DNA, 25 bp, Mus musculus
ttgatcggttacataacttgcgagc

SEQ ID NO: 949194 - DNA, 25 bp, Mus musculus
ttgatcggttacttaacttgcgagc

SEQ ID NO: 949195 - DNA, 25 bp, Mus musculus
ttgatcgtgtctacccaaacctgtg

SEQ ID NO: 949196 - DNA, 25 bp, Mus musculus
ttgatcgtgtcttcccaaacctgtg

SEQ ID NO: 949197 - DNA, 25 bp, Mus musculus
ttgatctaccgcactgagctcagag

SEQ ID NO: 949198 - DNA, 25 bp, Mus musculus
ttgatctaccgctctgagctcagag

SEQ ID NO: 949199 - DNA, 25 bp, Mus musculus
ttgatctacgtacccttctttgaga

SEQ ID NO: 949200 - DNA, 25 bp, Mus musculus
ttgatctacgtagccttctttgaga

SEQ ID NO: 949201 - DNA, 25 bp, Mus musculus
ttgatctcattcacacagccggtaa

SEQ ID NO: 949202 - DNA, 25 bp, Mus musculus
ttgatctcattctcacagccggtaa

SEQ ID NO: 949203 - DNA, 25 bp, Mus musculus
ttgatctccagaccaatctggccct

SEQ ID NO: 949204 - DNA, 25 bp, Mus musculus
ttgatctccagagcaatctggccct

SEQ ID NO: 949205 - DNA, 25 bp, Mus musculus
ttgatctcctacattggcttctctt

SEQ ID NO: 949206 - DNA, 25 bp, Mus musculus
ttgatctcctactttggcttctctt

SEQ ID NO: 949207 - DNA, 25 bp, Mus musculus
ttgatctctgctactttgtggttct

SEQ ID NO: 949208 - DNA, 25 bp, Mus musculus
ttgatctctgcttctttgtggttct

SEQ ID NO: 949209 - DNA, 25 bp, Mus musculus
ttgatctcttgaacctacatagtga

SEQ ID NO: 949210 - DNA, 25 bp, Mus musculus
ttgatctcttgatcctacatagtga

SEQ ID NO: 949211 - DNA, 25 bp, Mus musculus
ttgatctgatcgagagtccctctag

SEQ ID NO: 949212 - DNA, 25 bp, Mus musculus
ttgatctgatcgtgagtccctctag

SEQ ID NO: 949213 - DNA, 25 bp, Mus musculus
ttgatctgatgtacactactgttca

SEQ ID NO: 949214 - DNA, 25 bp, Mus musculus
ttgatctgatgttcactactgttca

SEQ ID NO: 949215 - DNA, 25 bp, Mus musculus
ttgatctggcctatagcctcaaagc

SEQ ID NO: 949216 - DNA, 25 bp, Mus musculus
ttgatctggcctttagcctcaaagc

SEQ ID NO: 949217 - DNA, 25 bp, Mus musculus
ttgatctgtaacagagcgaccctgg

SEQ ID NO: 949218 - DNA, 25 bp, Mus musculus
ttgatctgtaaccaagtctctcttg

SEQ ID NO: 949219 - DNA, 25 bp, Mus musculus
ttgatctgtaacgaagtctctcttg

SEQ ID NO: 949220 - DNA, 25 bp, Mus musculus
ttgatctgtaactgagcgaccctgg

SEQ ID NO: 949221 - DNA, 25 bp, Mus musculus
ttgatctgtgtgacctgagaacaag

SEQ ID NO: 949222 - DNA, 25 bp, Mus musculus
ttgatctgtgtgtcctgagaacaag

SEQ ID NO: 949223 - DNA, 25 bp, Mus musculus
ttgatcttatctaggatccttttga

SEQ ID NO: 949224 - DNA, 25 bp, Mus musculus
ttgatcttatcttggatccttttga

SEQ ID NO: 949225 - DNA, 25 bp, Mus musculus
ttgatcttatgacccttgaaaacct

SEQ ID NO: 949226 - DNA, 25 bp, Mus musculus
ttgatcttatgagccttgaaaacct

SEQ ID NO: 949227 - DNA, 25 bp, Mus musculus
ttgatcttcaggctatggaccgtgc

SEQ ID NO: 949228 - DNA, 25 bp, Mus musculus
ttgatcttcagggtatggaccgtgc

SEQ ID NO: 949229 - DNA, 25 bp, Mus musculus
ttgatcttcccacagcagatgtcgg

SEQ ID NO: 949230 - DNA, 25 bp, Mus musculus
ttgatcttcccagagcagatgtcgg

SEQ ID NO: 949231 - DNA, 25 bp, Mus musculus
ttgatcttcctaagggttccccaaa

SEQ ID NO: 949232 - DNA, 25 bp, Mus musculus
ttgatcttcctatgggttccccaaa

SEQ ID NO: 949233 - DNA, 25 bp, Mus musculus
ttgatcttgaaaaggactccctttg

SEQ ID NO: 949234 - DNA, 25 bp, Mus musculus
ttgatcttgaaatggactccctttg

SEQ ID NO: 949235 - DNA, 25 bp, Mus musculus
ttgatcttgcttaccttttactgaa

SEQ ID NO: 949236 - DNA, 25 bp, Mus musculus
ttgatcttgctttccttttactgaa

SEQ ID NO: 949237 - DNA, 25 bp, Mus musculus
ttgatcttgggaaacagcagtcgtg

SEQ ID NO: 949238 - DNA, 25 bp, Mus musculus
ttgatcttgggatacagcagtcgtg

SEQ ID NO: 949239 - DNA, 25 bp, Mus musculus
ttgatcttgtggcattcctgacagt

SEQ ID NO: 949240 - DNA, 25 bp, Mus musculus
ttgatcttgtgggattcctgacagt

SEQ ID NO: 949241 - DNA, 25 bp, Mus musculus
ttgatctttatcagtctctgtttct

SEQ ID NO: 949242 - DNA, 25 bp, Mus musculus
ttgatctttatctgtctctgtttct

SEQ ID NO: 949243 - DNA, 25 bp, Mus musculus
ttgatctttcgcagcaggtggtaaa

SEQ ID NO: 949244 - DNA, 25 bp, Mus musculus
ttgatctttcgctgcaggtggtaaa

SEQ ID NO: 949245 - DNA, 25 bp, Mus musculus
ttgatctttctaacggtgacactcc

SEQ ID NO: 949246 - DNA, 25 bp, Mus musculus
ttgatctttctatcggtgacactcc

SEQ ID NO: 949247 - DNA, 25 bp, Mus musculus
ttgatctttgtcacagctctagttc

SEQ ID NO: 949248 - DNA, 25 bp, Mus musculus
ttgatctttgtctcagctctagttc

SEQ ID NO: 949249 - DNA, 25 bp, Mus musculus
ttgatcttttggcttttacttctgt

SEQ ID NO: 949250 - DNA, 25 bp, Mus musculus
ttgatcttttgggttttacttctgt

SEQ ID NO: 949251 - DNA, 25 bp, Mus musculus
ttgatctttttcaccatctcttttc

SEQ ID NO: 949252 - DNA, 25 bp, Mus musculus
ttgatctttttcacttcaatctgtg

SEQ ID NO: 949253 - DNA, 25 bp, Mus musculus
ttgatctttttctccatctcttttc

SEQ ID NO: 949254 - DNA, 25 bp, Mus musculus
ttgatctttttctcttcaatctgtg

SEQ ID NO: 949255 - DNA, 25 bp, Mus musculus
ttgatgaaaaatctgagctcttgta

SEQ ID NO: 949256 - DNA, 25 bp, Mus musculus
ttgatgaaaaatgtgagctcttgta

SEQ ID NO: 949257 - DNA, 25 bp, Mus musculus
ttgatgaaacacacctctcacattt

SEQ ID NO: 949258 - DNA, 25 bp, Mus musculus
ttgatgaaacactcctctcacattt

SEQ ID NO: 949259 - DNA, 25 bp, Mus musculus
ttgatgaacaacctgggccctgcga

SEQ ID NO: 949260 - DNA, 25 bp, Mus musculus
ttgatgaacaacgtgggccctgcga

SEQ ID NO: 949261 - DNA, 25 bp, Mus musculus
ttgatgaacttcatggcccagaaca

SEQ ID NO: 949262 - DNA, 25 bp, Mus musculus
ttgatgaacttcttggcccagaaca

SEQ ID NO: 949263 - DNA, 25 bp, Mus musculus
ttgatgaacttgagaccgacctttt

SEQ ID NO: 949264 - DNA, 25 bp, Mus musculus
ttgatgaacttgcatccgtccacat

SEQ ID NO: 949265 - DNA, 25 bp, Mus musculus
ttgatgaacttggatccgtccacat

SEQ ID NO: 949266 - DNA, 25 bp, Mus musculus
ttgatgaacttgtgaccgacctttt

SEQ ID NO: 949267 - DNA, 25 bp, Mus musculus
ttgatgaagaggaccggtgcctcgt

SEQ ID NO: 949268 - DNA, 25 bp, Mus musculus
ttgatgaagaggtccggtgcctcgt

SEQ ID NO: 949269 - DNA, 25 bp, Mus musculus
ttgatgaagctcagcctgtgctcat

SEQ ID NO: 949270 - DNA, 25 bp, Mus musculus
ttgatgaagctctgcctgtgctcat

SEQ ID NO: 949271 - DNA, 25 bp, Mus musculus
ttgatgacaagcaccagcaaggatt

SEQ ID NO: 949272 - DNA, 25 bp, Mus musculus
ttgatgacaagctccagcaaggatt

SEQ ID NO: 949273 - DNA, 25 bp, Mus musculus
ttgatgacaagtacagccgacggga

SEQ ID NO: 949274 - DNA, 25 bp, Mus musculus
ttgatgacaagttcagccgacggga

SEQ ID NO: 949275 - DNA, 25 bp, Mus musculus
ttgatgacacaacctagactcacct

SEQ ID NO: 949276 - DNA, 25 bp, Mus musculus
ttgatgacacaagctagactcacct

SEQ ID NO: 949277 - DNA, 25 bp, Mus musculus
ttgatgacagccagtgatacacaga

SEQ ID NO: 949278 - DNA, 25 bp, Mus musculus
ttgatgacagcctgtgatacacaga

SEQ ID NO: 949279 - DNA, 25 bp, Mus musculus
ttgatgacagtgaccggggattccc

SEQ ID NO: 949280 - DNA, 25 bp, Mus musculus
ttgatgacagtgtccggggattccc

SEQ ID NO: 949281 - DNA, 25 bp, Mus musculus
ttgatgacccaaatcaaatccctgg

SEQ ID NO: 949282 - DNA, 25 bp, Mus musculus
ttgatgacccaattcaaatccctgg

SEQ ID NO: 949283 - DNA, 25 bp, Mus musculus
ttgatgaccctaacaccttcggcaa

SEQ ID NO: 949284 - DNA, 25 bp, Mus musculus
ttgatgaccctactccacgaaaaat

SEQ ID NO: 949285 - DNA, 25 bp, Mus musculus
ttgatgaccctagtccacgaaaaat

SEQ ID NO: 949286 - DNA, 25 bp, Mus musculus
ttgatgaccctatcaccttcggcaa

SEQ ID NO: 949287 - DNA, 25 bp, Mus musculus
ttgatgacctagactctgagagcac

SEQ ID NO: 949288 - DNA, 25 bp, Mus musculus
ttgatgacctagtctctgagagcac

SEQ ID NO: 949289 - DNA, 25 bp, Mus musculus
ttgatgacctgaccggagaacctct

SEQ ID NO: 949290 - DNA, 25 bp, Mus musculus
ttgatgacctgaccgtgaacctaac

SEQ ID NO: 949291 - DNA, 25 bp, Mus musculus
ttgatgacctgagcggagaacctct

SEQ ID NO: 949292 - DNA, 25 bp, Mus musculus
ttgatgacctgagcgtgaacctaac

SEQ ID NO: 949293 - DNA, 25 bp, Mus musculus
ttgatgacctggaagacgagctcta

SEQ ID NO: 949294 - DNA, 25 bp, Mus musculus
ttgatgacctggtagacgagctcta

SEQ ID NO: 949295 - DNA, 25 bp, Mus musculus
ttgatgactcttcctactgccaagg

SEQ ID NO: 949296 - DNA, 25 bp, Mus musculus
ttgatgactcttgctactgccaagg

SEQ ID NO: 949297 - DNA, 25 bp, Mus musculus
ttgatgactgcactctggcggttta

SEQ ID NO: 949298 - DNA, 25 bp, Mus musculus
ttgatgactgcagtctggcggttta

SEQ ID NO: 949299 - DNA, 25 bp, Mus musculus
ttgatgacttcaaccagggctgcat

SEQ ID NO: 949300 - DNA, 25 bp, Mus musculus
ttgatgacttcatccagggctgcat

SEQ ID NO: 949301 - DNA, 25 bp, Mus musculus
ttgatgactttcagggctctctgca

SEQ ID NO: 949302 - DNA, 25 bp, Mus musculus
ttgatgactttctgggctctctgca

SEQ ID NO: 949303 - DNA, 25 bp, Mus musculus
ttgatgagacctctaatccgccttc

SEQ ID NO: 949304 - DNA, 25 bp, Mus musculus
ttgatgagacctgtaatccgccttc

SEQ ID NO: 949305 - DNA, 25 bp, Mus musculus
ttgatgaggatgaccggccagagct

SEQ ID NO: 949306 - DNA, 25 bp, Mus musculus
ttgatgaggatgtccggccagagct

SEQ ID NO: 949307 - DNA, 25 bp, Mus musculus
ttgatgaggcatccaaacacccaca

SEQ ID NO: 949308 - DNA, 25 bp, Mus musculus
ttgatgaggcatgcaaacacccaca

SEQ ID NO: 949309 - DNA, 25 bp, Mus musculus
ttgatgaggctgagacttcgtgtgc

SEQ ID NO: 949310 - DNA, 25 bp, Mus musculus
ttgatgaggctgtgacttcgtgtgc

SEQ ID NO: 949311 - DNA, 25 bp, Mus musculus
ttgatgaggtcgattgtcaggcccc

SEQ ID NO: 949312 - DNA, 25 bp, Mus musculus
ttgatgaggtcgtttgtcaggcccc

SEQ ID NO: 949313 - DNA, 25 bp, Mus musculus
ttgatgagtcagacaccagccttta

SEQ ID NO: 949314 - DNA, 25 bp, Mus musculus
ttgatgagtcagtcaccagccttta

SEQ ID NO: 949315 - DNA, 25 bp, Mus musculus
ttgatgagtccacgccttacagcca

SEQ ID NO: 949316 - DNA, 25 bp, Mus musculus
ttgatgagtccaggccttacagcca

SEQ ID NO: 949317 - DNA, 25 bp, Mus musculus
ttgatgatacaaccctataacccag

SEQ ID NO: 949318 - DNA, 25 bp, Mus musculus
ttgatgatacaagcctataacccag

SEQ ID NO: 949319 - DNA, 25 bp, Mus musculus
ttgatgatcctaccactccactagt

SEQ ID NO: 949320 - DNA, 25 bp, Mus musculus
ttgatgatcctagcactccactagt

SEQ ID NO: 949321 - DNA, 25 bp, Mus musculus
ttgatgatgcatagcgtcaagggca

SEQ ID NO: 949322 - DNA, 25 bp, Mus musculus
ttgatgatgcattgcgtcaagggca

SEQ ID NO: 949323 - DNA, 25 bp, Mus musculus
ttgatgatggttctcttcacaaggt

SEQ ID NO: 949324 - DNA, 25 bp, Mus musculus
ttgatgatggttgtcttcacaaggt

SEQ ID NO: 949325 - DNA, 25 bp, Mus musculus
ttgatgattggtcctctggaactga

SEQ ID NO: 949326 - DNA, 25 bp, Mus musculus
ttgatgattggtcgccgacaaccct

SEQ ID NO: 949327 - DNA, 25 bp, Mus musculus
ttgatgattggtgctctggaactga

SEQ ID NO: 949328 - DNA, 25 bp, Mus musculus
ttgatgattggtggccgacaaccct

SEQ ID NO: 949329 - DNA, 25 bp, Mus musculus
ttgatgatttgtacctgagaagtgg

SEQ ID NO: 949330 - DNA, 25 bp, Mus musculus
ttgatgatttgttcctgagaagtgg

SEQ ID NO: 949331 - DNA, 25 bp, Mus musculus
ttgatgcaactactgtctaaattgt

SEQ ID NO: 949332 - DNA, 25 bp, Mus musculus
ttgatgcaactagtgtctaaattgt

SEQ ID NO: 949333 - DNA, 25 bp, Mus musculus
ttgatgcaaggcattgttgggcttt

SEQ ID NO: 949334 - DNA, 25 bp, Mus musculus
ttgatgcaaggctttgttgggcttt

SEQ ID NO: 949335 - DNA, 25 bp, Mus musculus
ttgatgcacatcaagcctggctcta

SEQ ID NO: 949336 - DNA, 25 bp, Mus musculus
ttgatgcacatctagcctggctcta

SEQ ID NO: 949337 - DNA, 25 bp, Mus musculus
ttgatgcagaaaacaccacgtggat

SEQ ID NO: 949338 - DNA, 25 bp, Mus musculus
ttgatgcagaaatcaccacgtggat

SEQ ID NO: 949339 - DNA, 25 bp, Mus musculus
ttgatgcagtgcactactcaggtag

SEQ ID NO: 949340 - DNA, 25 bp, Mus musculus
ttgatgcagtgctctactcaggtag

SEQ ID NO: 949341 - DNA, 25 bp, Mus musculus
ttgatgccaaagacccggatcagct

SEQ ID NO: 949342 - DNA, 25 bp, Mus musculus
ttgatgccaaagtcccggatcagct

SEQ ID NO: 949343 - DNA, 25 bp, Mus musculus
ttgatgccacaactgtccaccgagc

SEQ ID NO: 949344 - DNA, 25 bp, Mus musculus
ttgatgccacaagtgtccaccgagc

SEQ ID NO: 949345 - DNA, 25 bp, Mus musculus
ttgatgccagtcagggccatataat

SEQ ID NO: 949346 - DNA, 25 bp, Mus musculus
ttgatgccagtcatttcccaagtaa

SEQ ID NO: 949347 - DNA, 25 bp, Mus musculus
ttgatgccagtctgggccatataat

SEQ ID NO: 949348 - DNA, 25 bp, Mus musculus
ttgatgccagtcttttcccaagtaa

SEQ ID NO: 949349 - DNA, 25 bp, Mus musculus
ttgatgccagtgagcggaaatgctt

SEQ ID NO: 949350 - DNA, 25 bp, Mus musculus
ttgatgccagtgtgcggaaatgctt

SEQ ID NO: 949351 - DNA, 25 bp, Mus musculus
ttgatgccatctccaagacttacag

SEQ ID NO: 949352 - DNA, 25 bp, Mus musculus
ttgatgccatctgcaagacttacag

SEQ ID NO: 949353 - DNA, 25 bp, Mus musculus
ttgatgcccctaagaagtcaaggtc

SEQ ID NO: 949354 - DNA, 25 bp, Mus musculus
ttgatgcccctatgaagtcaaggtc

SEQ ID NO: 949355 - DNA, 25 bp, Mus musculus
ttgatgcccctgctgagtctgtcaa

SEQ ID NO: 949356 - DNA, 25 bp, Mus musculus
ttgatgcccctggtgagtctgtcaa

SEQ ID NO: 949357 - DNA, 25 bp, Mus musculus
ttgatgcctatcacctacacagtag

SEQ ID NO: 949358 - DNA, 25 bp, Mus musculus
ttgatgcctatctcctacacagtag

SEQ ID NO: 949359 - DNA, 25 bp, Mus musculus
ttgatgcctccaaggcggtagagga

SEQ ID NO: 949360 - DNA, 25 bp, Mus musculus
ttgatgcctccatggcggtagagga

SEQ ID NO: 949361 - DNA, 25 bp, Mus musculus
ttgatgcctcctaacagaagcgaat

SEQ ID NO: 949362 - DNA, 25 bp, Mus musculus
ttgatgcctccttacagaagcgaat

SEQ ID NO: 949363 - DNA, 25 bp, Mus musculus
ttgatgcctgcacctttggagtcac

SEQ ID NO: 949364 - DNA, 25 bp, Mus musculus
ttgatgcctgcagctttggagtcac

SEQ ID NO: 949365 - DNA, 25 bp, Mus musculus
ttgatgccttacacactagcttttc

SEQ ID NO: 949366 - DNA, 25 bp, Mus musculus
ttgatgccttactcactagcttttc

SEQ ID NO: 949367 - DNA, 25 bp, Mus musculus
ttgatgccttcacgctaaaaccttc

SEQ ID NO: 949368 - DNA, 25 bp, Mus musculus
ttgatgccttcaggctaaaaccttc

SEQ ID NO: 949369 - DNA, 25 bp, Mus musculus
ttgatgcgaggaaccttgctacttc

SEQ ID NO: 949370 - DNA, 25 bp, Mus musculus
ttgatgcgaggatccttgctacttc

SEQ ID NO: 949371 - DNA, 25 bp, Mus musculus
ttgatgcggctgatgttcttctcca

SEQ ID NO: 949372 - DNA, 25 bp, Mus musculus
ttgatgcggctgttgttcttctcca

SEQ ID NO: 949373 - DNA, 25 bp, Mus musculus
ttgatgctcctgacaatctgtggaa

SEQ ID NO: 949374 - DNA, 25 bp, Mus musculus
ttgatgctcctgtcaatctgtggaa

SEQ ID NO: 949375 - DNA, 25 bp, Mus musculus
ttgatgctgaaacactccgatgctc

SEQ ID NO: 949376 - DNA, 25 bp, Mus musculus
ttgatgctgaaagactccgatgctc

SEQ ID NO: 949377 - DNA, 25 bp, Mus musculus
ttgatgctgaggagcaccagaggac

SEQ ID NO: 949378 - DNA, 25 bp, Mus musculus
ttgatgctgaggtgcaccagaggac

SEQ ID NO: 949379 - DNA, 25 bp, Mus musculus
ttgatgctgcagaagatccacaata

SEQ ID NO: 949380 - DNA, 25 bp, Mus musculus
ttgatgctgcagtagatccacaata

SEQ ID NO: 949381 - DNA, 25 bp, Mus musculus
ttgatgctgctcaaattctgcctac

SEQ ID NO: 949382 - DNA, 25 bp, Mus musculus
ttgatgctgctcatgccacagaaaa

SEQ ID NO: 949383 - DNA, 25 bp, Mus musculus
ttgatgctgctctaattctgcctac

SEQ ID NO: 949384 - DNA, 25 bp, Mus musculus
ttgatgctgctcttgccacagaaaa

SEQ ID NO: 949385 - DNA, 25 bp, Mus musculus
ttgatgctgtaaaactctatggctt

SEQ ID NO: 949386 - DNA, 25 bp, Mus musculus
ttgatgctgtaatactctatggctt

SEQ ID NO: 949387 - DNA, 25 bp, Mus musculus
ttgatgctgtctaaggctcacccgc

SEQ ID NO: 949388 - DNA, 25 bp, Mus musculus
ttgatgctgtcttaggctcacccgc

SEQ ID NO: 949389 - DNA, 25 bp, Mus musculus
ttgatgctgttgactccctggcaaa

SEQ ID NO: 949390 - DNA, 25 bp, Mus musculus
ttgatgctgttgtctccctggcaaa

SEQ ID NO: 949391 - DNA, 25 bp, Mus musculus
ttgatgcttacgagactactttgac

SEQ ID NO: 949392 - DNA, 25 bp, Mus musculus
ttgatgcttacgtgactactttgac

SEQ ID NO: 949393 - DNA, 25 bp, Mus musculus
ttgatgctttttagctgtctggcca

SEQ ID NO: 949394 - DNA, 25 bp, Mus musculus
ttgatgcttttttgctgtctggcca

SEQ ID NO: 949395 - DNA, 25 bp, Mus musculus
ttgatggaaccactcagggctatcc

SEQ ID NO: 949396 - DNA, 25 bp, Mus musculus
ttgatggaaccagtcagggctatcc

SEQ ID NO: 949397 - DNA, 25 bp, Mus musculus
ttgatggacagacagccccagtgcc

SEQ ID NO: 949398 - DNA, 25 bp, Mus musculus
ttgatggacagagagccccagtgcc

SEQ ID NO: 949399 - DNA, 25 bp, Mus musculus
ttgatggacagcacactccaccttg

SEQ ID NO: 949400 - DNA, 25 bp, Mus musculus
ttgatggacagctcactccaccttg

SEQ ID NO: 949401 - DNA, 25 bp, Mus musculus
ttgatggagcagatatgtgcccgct

SEQ ID NO: 949402 - DNA, 25 bp, Mus musculus
ttgatggagcagttatgtgcccgct

SEQ ID NO: 949403 - DNA, 25 bp, Mus musculus
ttgatggatcataccttcatgggac

SEQ ID NO: 949404 - DNA, 25 bp, Mus musculus
ttgatggatcattccttcatgggac

SEQ ID NO: 949405 - DNA, 25 bp, Mus musculus
ttgatggatccacctcagtcaggac

SEQ ID NO: 949406 - DNA, 25 bp, Mus musculus
ttgatggatccagctcagtcaggac

SEQ ID NO: 949407 - DNA, 25 bp, Mus musculus
ttgatggatcccaccaaagcttacc

SEQ ID NO: 949408 - DNA, 25 bp, Mus musculus
ttgatggatccctccaaagcttacc

SEQ ID NO: 949409 - DNA, 25 bp, Mus musculus
ttgatggattgcctcctagcaggac

SEQ ID NO: 949410 - DNA, 25 bp, Mus musculus
ttgatggattgcgtcctagcaggac

SEQ ID NO: 949411 - DNA, 25 bp, Mus musculus
ttgatggcacatctctaaccaacca

SEQ ID NO: 949412 - DNA, 25 bp, Mus musculus
ttgatggcacatgtctaaccaacca

SEQ ID NO: 949413 - DNA, 25 bp, Mus musculus
ttgatggccatgaaaatccgacatt

SEQ ID NO: 949414 - DNA, 25 bp, Mus musculus
ttgatggccatgtaaatccgacatt

SEQ ID NO: 949415 - DNA, 25 bp, Mus musculus
ttgatggcctcccaaagctggtctt

SEQ ID NO: 949416 - DNA, 25 bp, Mus musculus
ttgatggcctccgaaagctggtctt

SEQ ID NO: 949417 - DNA, 25 bp, Mus musculus
ttgatggctctgagtgggttgagcc

SEQ ID NO: 949418 - DNA, 25 bp, Mus musculus
ttgatggctctgtgtgggttgagcc

SEQ ID NO: 949419 - DNA, 25 bp, Mus musculus
ttgatggcttctaccggctgttcca

SEQ ID NO: 949420 - DNA, 25 bp, Mus musculus
ttgatggcttcttccggctgttcca

SEQ ID NO: 949421 - DNA, 25 bp, Mus musculus
ttgatgggcactactacccatgggt

SEQ ID NO: 949422 - DNA, 25 bp, Mus musculus
ttgatgggcacttctacccatgggt

SEQ ID NO: 949423 - DNA, 25 bp, Mus musculus
ttgatgggcagcagccgccattatc

SEQ ID NO: 949424 - DNA, 25 bp, Mus musculus
ttgatgggcagcctttaagttacta

SEQ ID NO: 949425 - DNA, 25 bp, Mus musculus
ttgatgggcagcgtttaagttacta

SEQ ID NO: 949426 - DNA, 25 bp, Mus musculus
ttgatgggcagctgccgccattatc

SEQ ID NO: 949427 - DNA, 25 bp, Mus musculus
ttgatgggcgctattctttcttcag

SEQ ID NO: 949428 - DNA, 25 bp, Mus musculus
ttgatgggcgcttttctttcttcag

SEQ ID NO: 949429 - DNA, 25 bp, Mus musculus
ttgatgggcgtccaagcagaccaca

SEQ ID NO: 949430 - DNA, 25 bp, Mus musculus
ttgatgggcgtcgaagcagaccaca

SEQ ID NO: 949431 - DNA, 25 bp, Mus musculus
ttgatgggctctcctcatgaagctc

SEQ ID NO: 949432 - DNA, 25 bp, Mus musculus
ttgatgggctctgctcatgaagctc

SEQ ID NO: 949433 - DNA, 25 bp, Mus musculus
ttgatgggtaacaggatggtgcttt

SEQ ID NO: 949434 - DNA, 25 bp, Mus musculus
ttgatgggtaactggatggtgcttt

SEQ ID NO: 949435 - DNA, 25 bp, Mus musculus
ttgatgggtacaaccttgctctcac

SEQ ID NO: 949436 - DNA, 25 bp, Mus musculus
ttgatgggtacatccttgctctcac

SEQ ID NO: 949437 - DNA, 25 bp, Mus musculus
ttgatgggtgccagcatgagccttc

SEQ ID NO: 949438 - DNA, 25 bp, Mus musculus
ttgatgggtgcctgcatgagccttc

SEQ ID NO: 949439 - DNA, 25 bp, Mus musculus
ttgatgggtggtatctgttttgaca

SEQ ID NO: 949440 - DNA, 25 bp, Mus musculus
ttgatgggtggtttctgttttgaca

SEQ ID NO: 949441 - DNA, 25 bp, Mus musculus
ttgatggtagctatcttttctctag

SEQ ID NO: 949442 - DNA, 25 bp, Mus musculus
ttgatggtagctttcttttctctag

SEQ ID NO: 949443 - DNA, 25 bp, Mus musculus
ttgatggtctctacccaactgattc

SEQ ID NO: 949444 - DNA, 25 bp, Mus musculus
ttgatggtctcttcccaactgattc

SEQ ID NO: 949445 - DNA, 25 bp, Mus musculus
ttgatggtgacactgtgccctcttc

SEQ ID NO: 949446 - DNA, 25 bp, Mus musculus
ttgatggtgacagtgtgccctcttc

SEQ ID NO: 949447 - DNA, 25 bp, Mus musculus
ttgatggtgctcactcttcatcttc

SEQ ID NO: 949448 - DNA, 25 bp, Mus musculus
ttgatggtgctctctcttcatcttc

SEQ ID NO: 949449 - DNA, 25 bp, Mus musculus
ttgatggttcagatgggccgccaca

SEQ ID NO: 949450 - DNA, 25 bp, Mus musculus
ttgatggttcagttgggccgccaca

SEQ ID NO: 949451 - DNA, 25 bp, Mus musculus
ttgatggttcttctgacaaagtcct

SEQ ID NO: 949452 - DNA, 25 bp, Mus musculus
ttgatggttcttgtgacaaagtcct

SEQ ID NO: 949453 - DNA, 25 bp, Mus musculus
ttgatggtttctcaattgctgctct

SEQ ID NO: 949454 - DNA, 25 bp, Mus musculus
ttgatggtttctgaattgctgctct

SEQ ID NO: 949455 - DNA, 25 bp, Mus musculus
ttgatgtacactaccattttatgta

SEQ ID NO: 949456 - DNA, 25 bp, Mus musculus
ttgatgtacacttccattttatgta

SEQ ID NO: 949457 - DNA, 25 bp, Mus musculus
ttgatgtcaaccagtccaaggatcc

SEQ ID NO: 949458 - DNA, 25 bp, Mus musculus
ttgatgtcaacctgtccaaggatcc

SEQ ID NO: 949459 - DNA, 25 bp, Mus musculus
ttgatgtcacatcgttctttctcat

SEQ ID NO: 949460 - DNA, 25 bp, Mus musculus
ttgatgtcacatggttctttctcat

SEQ ID NO: 949461 - DNA, 25 bp, Mus musculus
ttgatgtcatcaactcagaacaggg

SEQ ID NO: 949462 - DNA, 25 bp, Mus musculus
ttgatgtcatcatctcagaacaggg

SEQ ID NO: 949463 - DNA, 25 bp, Mus musculus
ttgatgtcctcaagctgccaggtga

SEQ ID NO: 949464 - DNA, 25 bp, Mus musculus
ttgatgtcctcatgctgccaggtga

SEQ ID NO: 949465 - DNA, 25 bp, Mus musculus
ttgatgtcctgtagactcggctcaa

SEQ ID NO: 949466 - DNA, 25 bp, Mus musculus
ttgatgtcctgttgactcggctcaa

SEQ ID NO: 949467 - DNA, 25 bp, Mus musculus
ttgatgtctcagcagacacgctctg

SEQ ID NO: 949468 - DNA, 25 bp, Mus musculus
ttgatgtctcaggagacacgctctg

SEQ ID NO: 949469 - DNA, 25 bp, Mus musculus
ttgatgtctctgagctggactccta

SEQ ID NO: 949470 - DNA, 25 bp, Mus musculus
ttgatgtctctgtgctggactccta

SEQ ID NO: 949471 - DNA, 25 bp, Mus musculus
ttgatgtctgtaagtcaccttccca

SEQ ID NO: 949472 - DNA, 25 bp, Mus musculus
ttgatgtctgtatgtcaccttccca

SEQ ID NO: 949473 - DNA, 25 bp, Mus musculus
ttgatgtcttctactgaacccagag

SEQ ID NO: 949474 - DNA, 25 bp, Mus musculus
ttgatgtcttcttctgaacccagag

SEQ ID NO: 949475 - DNA, 25 bp, Mus musculus
ttgatgtgacccctgctgctgccac

SEQ ID NO: 949476 - DNA, 25 bp, Mus musculus
ttgatgtgacccgtgctgctgccac

SEQ ID NO: 949477 - DNA, 25 bp, Mus musculus
ttgatgtgagaacgcccaacttgca

SEQ ID NO: 949478 - DNA, 25 bp, Mus musculus
ttgatgtgagaaggcccaacttgca

SEQ ID NO: 949479 - DNA, 25 bp, Mus musculus
ttgatgtgatctcttgccgggagct

SEQ ID NO: 949480 - DNA, 25 bp, Mus musculus
ttgatgtgatctgttgccgggagct

SEQ ID NO: 949481 - DNA, 25 bp, Mus musculus
ttgatgtgccacctgttggccatgg

SEQ ID NO: 949482 - DNA, 25 bp, Mus musculus
ttgatgtgccacgtgttggccatgg

SEQ ID NO: 949483 - DNA, 25 bp, Mus musculus
ttgatgtggacaaaggccctctttt

SEQ ID NO: 949484 - DNA, 25 bp, Mus musculus
ttgatgtggacataggccctctttt

SEQ ID NO: 949485 - DNA, 25 bp, Mus musculus
ttgatgtggagcaagagtccctcag

SEQ ID NO: 949486 - DNA, 25 bp, Mus musculus
ttgatgtggagctagagtccctcag

SEQ ID NO: 949487 - DNA, 25 bp, Mus musculus
ttgatgtgggaaaccccattaccat

SEQ ID NO: 949488 - DNA, 25 bp, Mus musculus
ttgatgtgggaatccccattaccat

SEQ ID NO: 949489 - DNA, 25 bp, Mus musculus
ttgatgtggtagcttctttctcagg

SEQ ID NO: 949490 - DNA, 25 bp, Mus musculus
ttgatgtggtaggttctttctcagg

SEQ ID NO: 949491 - DNA, 25 bp, Mus musculus
ttgatgtgtgatcccggctttctga

SEQ ID NO: 949492 - DNA, 25 bp, Mus musculus
ttgatgtgtgatgccggctttctga

SEQ ID NO: 949493 - DNA, 25 bp, Mus musculus
ttgatgttccatacagtctgcagct

SEQ ID NO: 949494 - DNA, 25 bp, Mus musculus
ttgatgttccatagctgccacctta

SEQ ID NO: 949495 - DNA, 25 bp, Mus musculus
ttgatgttccattcagtctgcagct

SEQ ID NO: 949496 - DNA, 25 bp, Mus musculus
ttgatgttccattgctgccacctta

SEQ ID NO: 949497 - DNA, 25 bp, Mus musculus
ttgatgttcctgagagatccctaac

SEQ ID NO: 949498 - DNA, 25 bp, Mus musculus
ttgatgttcctgtgagatccctaac

SEQ ID NO: 949499 - DNA, 25 bp, Mus musculus
ttgatgttgaacagagagtcttcct

SEQ ID NO: 949500 - DNA, 25 bp, Mus musculus
ttgatgttgaactgagagtcttcct

SEQ ID NO: 949501 - DNA, 25 bp, Mus musculus
ttgatgttgagactcctgattccat

SEQ ID NO: 949502 - DNA, 25 bp, Mus musculus
ttgatgttgagagtcctgattccat

SEQ ID NO: 949503 - DNA, 25 bp, Mus musculus
ttgatgttgatcatagggccttgaa

SEQ ID NO: 949504 - DNA, 25 bp, Mus musculus
ttgatgttgatcttagggccttgaa

SEQ ID NO: 949505 - DNA, 25 bp, Mus musculus
ttgatgtttcatacataagccataa

SEQ ID NO: 949506 - DNA, 25 bp, Mus musculus
ttgatgtttcattcataagccataa

SEQ ID NO: 949507 - DNA, 25 bp, Mus musculus
ttgatgtttgcactaggagctcctg

SEQ ID NO: 949508 - DNA, 25 bp, Mus musculus
ttgatgtttgcagtaggagctcctg

SEQ ID NO: 949509 - DNA, 25 bp, Mus musculus
ttgatgttttatagcctcaggccgc

SEQ ID NO: 949510 - DNA, 25 bp, Mus musculus
ttgatgttttattgcctcaggccgc

SEQ ID NO: 949511 - DNA, 25 bp, Mus musculus
ttgattaaaagcaaccaaaggaatt

SEQ ID NO: 949512 - DNA, 25 bp, Mus musculus
ttgattaaaagctaccaaaggaatt

SEQ ID NO: 949513 - DNA, 25 bp, Mus musculus
ttgattaaccacctctagccaggac

SEQ ID NO: 949514 - DNA, 25 bp, Mus musculus
ttgattaaccacgtctagccaggac

SEQ ID NO: 949515 - DNA, 25 bp, Mus musculus
ttgattaaccgacagagttccccaa

SEQ ID NO: 949516 - DNA, 25 bp, Mus musculus
ttgattaaccgagagagttccccaa

SEQ ID NO: 949517 - DNA, 25 bp, Mus musculus
ttgattaagcttctggactgttttg

SEQ ID NO: 949518 - DNA, 25 bp, Mus musculus
ttgattaagcttgtggactgttttg

SEQ ID NO: 949519 - DNA, 25 bp, Mus musculus
ttgattaatttaaatgggctcccat

SEQ ID NO: 949520 - DNA, 25 bp, Mus musculus
ttgattaatttatatgggctcccat

SEQ ID NO: 949521 - DNA, 25 bp, Mus musculus
ttgattacatccagtggcgctaccg

SEQ ID NO: 949522 - DNA, 25 bp, Mus musculus
ttgattacatcctgtggcgctaccg

SEQ ID NO: 949523 - DNA, 25 bp, Mus musculus
ttgattaccatcatgcttagcctca

SEQ ID NO: 949524 - DNA, 25 bp, Mus musculus
ttgattaccatcttgcttagcctca

SEQ ID NO: 949525 - DNA, 25 bp, Mus musculus
ttgattacgcctacgatgactcagc

SEQ ID NO: 949526 - DNA, 25 bp, Mus musculus
ttgattacgccttcgatgactcagc

SEQ ID NO: 949527 - DNA, 25 bp, Mus musculus
ttgattactatcatctaggcaggaa

SEQ ID NO: 949528 - DNA, 25 bp, Mus musculus
ttgattactatcttctaggcaggaa

SEQ ID NO: 949529 - DNA, 25 bp, Mus musculus
ttgattagtgaaaggaacggatcct

SEQ ID NO: 949530 - DNA, 25 bp, Mus musculus
ttgattagtgaatggaacggatcct

SEQ ID NO: 949531 - DNA, 25 bp, Mus musculus
ttgattagttgtctattgtcctgaa

SEQ ID NO: 949532 - DNA, 25 bp, Mus musculus
ttgattagttgtgtattgtcctgaa

SEQ ID NO: 949533 - DNA, 25 bp, Mus musculus
ttgattatacagaagagggagctat

SEQ ID NO: 949534 - DNA, 25 bp, Mus musculus
ttgattatacagtagagggagctat

SEQ ID NO: 949535 - DNA, 25 bp, Mus musculus
ttgattatcggcattttggtccctg

SEQ ID NO: 949536 - DNA, 25 bp, Mus musculus
ttgattatcggctttttggtccctg

SEQ ID NO: 949537 - DNA, 25 bp, Mus musculus
ttgattatgaatcaccctccttggc

SEQ ID NO: 949538 - DNA, 25 bp, Mus musculus
ttgattatgaatgaccctccttggc

SEQ ID NO: 949539 - DNA, 25 bp, Mus musculus
ttgattatgccaacctaaccggaat

SEQ ID NO: 949540 - DNA, 25 bp, Mus musculus
ttgattatgccatcctaaccggaat

SEQ ID NO: 949541 - DNA, 25 bp, Mus musculus
ttgattattcaaaggcccagggaca

SEQ ID NO: 949542 - DNA, 25 bp, Mus musculus
ttgattattcaatggcccagggaca

SEQ ID NO: 949543 - DNA, 25 bp, Mus musculus
ttgattattcataaaaccttgcttt

SEQ ID NO: 949544 - DNA, 25 bp, Mus musculus
ttgattattcattaaaccttgcttt

SEQ ID NO: 949545 - DNA, 25 bp, Mus musculus
ttgattattccaccaaaagctaatt

SEQ ID NO: 949546 - DNA, 25 bp, Mus musculus
ttgattattccactaagaccccttt

SEQ ID NO: 949547 - DNA, 25 bp, Mus musculus
ttgattattccagcaaaagctaatt

SEQ ID NO: 949548 - DNA, 25 bp, Mus musculus
ttgattattccagtaagaccccttt

SEQ ID NO: 949549 - DNA, 25 bp, Mus musculus
ttgattcaaaaactctgggtcccca

SEQ ID NO: 949550 - DNA, 25 bp, Mus musculus
ttgattcaaaaagtctgggtcccca

SEQ ID NO: 949551 - DNA, 25 bp, Mus musculus
ttgattcaactgcttctctgtgtgg

SEQ ID NO: 949552 - DNA, 25 bp, Mus musculus
ttgattcaactggttctctgtgtgg

SEQ ID NO: 949553 - DNA, 25 bp, Mus musculus
ttgattcaatgcacccacgtggtag

SEQ ID NO: 949554 - DNA, 25 bp, Mus musculus
ttgattcaatgctcccacgtggtag

SEQ ID NO: 949555 - DNA, 25 bp, Mus musculus
ttgattcacctacatggcaaacccc

SEQ ID NO: 949556 - DNA, 25 bp, Mus musculus
ttgattcacctagatggcaaacccc

SEQ ID NO: 949557 - DNA, 25 bp, Mus musculus
ttgattcacttgagtgaggctgtca

SEQ ID NO: 949558 - DNA, 25 bp, Mus musculus
ttgattcacttgtgtgaggctgtca

SEQ ID NO: 949559 - DNA, 25 bp, Mus musculus
ttgattcagcttccaacttcttgtg

SEQ ID NO: 949560 - DNA, 25 bp, Mus musculus
ttgattcagcttgcaacttcttgtg

SEQ ID NO: 949561 - DNA, 25 bp, Mus musculus
ttgattcatctgaaaaagggtctag

SEQ ID NO: 949562 - DNA, 25 bp, Mus musculus
ttgattcatctgtaaaagggtctag

SEQ ID NO: 949563 - DNA, 25 bp, Mus musculus
ttgattccactgatttcccaggtag

SEQ ID NO: 949564 - DNA, 25 bp, Mus musculus
ttgattccactgttttcccaggtag

SEQ ID NO: 949565 - DNA, 25 bp, Mus musculus
ttgattccagaaagggaccgagtcc

SEQ ID NO: 949566 - DNA, 25 bp, Mus musculus
ttgattccagaatgggaccgagtcc

SEQ ID NO: 949567 - DNA, 25 bp, Mus musculus
ttgattccagcacttagtggatgtt

SEQ ID NO: 949568 - DNA, 25 bp, Mus musculus
ttgattccagcagttagtggatgtt

SEQ ID NO: 949569 - DNA, 25 bp, Mus musculus
ttgattccaggaccactttgtgcag

SEQ ID NO: 949570 - DNA, 25 bp, Mus musculus
ttgattccaggagcactttgtgcag

SEQ ID NO: 949571 - DNA, 25 bp, Mus musculus
ttgattccattgctgtcaccatgaa

SEQ ID NO: 949572 - DNA, 25 bp, Mus musculus
ttgattccattggtgtcaccatgaa

SEQ ID NO: 949573 - DNA, 25 bp, Mus musculus
ttgattcccagtccctacatgaagc

SEQ ID NO: 949574 - DNA, 25 bp, Mus musculus
ttgattcccagtgcctacatgaagc

SEQ ID NO: 949575 - DNA, 25 bp, Mus musculus
ttgattccccaacgaagctttccca

SEQ ID NO: 949576 - DNA, 25 bp, Mus musculus
ttgattccccaaggaagctttccca

SEQ ID NO: 949577 - DNA, 25 bp, Mus musculus
ttgattccccagctgtctttcacag

SEQ ID NO: 949578 - DNA, 25 bp, Mus musculus
ttgattccccaggtgtctttcacag

SEQ ID NO: 949579 - DNA, 25 bp, Mus musculus
ttgattcctaaaagagaagctcgag

SEQ ID NO: 949580 - DNA, 25 bp, Mus musculus
ttgattcctaaatgagaagctcgag

SEQ ID NO: 949581 - DNA, 25 bp, Mus musculus
ttgattcctagcaactgcctggtat

SEQ ID NO: 949582 - DNA, 25 bp, Mus musculus
ttgattcctagctactgcctggtat

SEQ ID NO: 949583 - DNA, 25 bp, Mus musculus
ttgattcctcaaccaaacccactgg

SEQ ID NO: 949584 - DNA, 25 bp, Mus musculus
ttgattcctcaagcaaacccactgg

SEQ ID NO: 949585 - DNA, 25 bp, Mus musculus
ttgattcgactgattgaggagctga

SEQ ID NO: 949586 - DNA, 25 bp, Mus musculus
ttgattcgactgtttgaggagctga

SEQ ID NO: 949587 - DNA, 25 bp, Mus musculus
ttgattcgctgacccaagagcatga

SEQ ID NO: 949588 - DNA, 25 bp, Mus musculus
ttgattcgctgagccaagagcatga

SEQ ID NO: 949589 - DNA, 25 bp, Mus musculus
ttgattcgctggacctatgcaagat

SEQ ID NO: 949590 - DNA, 25 bp, Mus musculus
ttgattcgctggtcctatgcaagat

SEQ ID NO: 949591 - DNA, 25 bp, Mus musculus
ttgattcgttggatggcatccgcat

SEQ ID NO: 949592 - DNA, 25 bp, Mus musculus
ttgattcgttggttggcatccgcat

SEQ ID NO: 949593 - DNA, 25 bp, Mus musculus
ttgattctaaaactggcccctgata

SEQ ID NO: 949594 - DNA, 25 bp, Mus musculus
ttgattctaaaagtggcccctgata

SEQ ID NO: 949595 - DNA, 25 bp, Mus musculus
ttgattctaaaccaagacagtctgg

SEQ ID NO: 949596 - DNA, 25 bp, Mus musculus
ttgattctaaacgaagacagtctgg

SEQ ID NO: 949597 - DNA, 25 bp, Mus musculus
ttgattctcatcaggcatatctaat

SEQ ID NO: 949598 - DNA, 25 bp, Mus musculus
ttgattctcatctggcatatctaat

SEQ ID NO: 949599 - DNA, 25 bp, Mus musculus
ttgattctccatcacgtttctagca

SEQ ID NO: 949600 - DNA, 25 bp, Mus musculus
ttgattctccatgacgtttctagca

SEQ ID NO: 949601 - DNA, 25 bp, Mus musculus
ttgattctctgcatccaggcttgac

SEQ ID NO: 949602 - DNA, 25 bp, Mus musculus
ttgattctctgcttccaggcttgac

SEQ ID NO: 949603 - DNA, 25 bp, Mus musculus
ttgattctgaacatgagcttatgac

SEQ ID NO: 949604 - DNA, 25 bp, Mus musculus
ttgattctgaacttgagcttatgac

SEQ ID NO: 949605 - DNA, 25 bp, Mus musculus
ttgattctgaagaaacccctgaacc

SEQ ID NO: 949606 - DNA, 25 bp, Mus musculus
ttgattctgaagtaacccctgaacc

SEQ ID NO: 949607 - DNA, 25 bp, Mus musculus
ttgattcttactcagatggccacat

SEQ ID NO: 949608 - DNA, 25 bp, Mus musculus
ttgattcttactgagatggccacat

SEQ ID NO: 949609 - DNA, 25 bp, Mus musculus
ttgattcttggtccccaactctcct

SEQ ID NO: 949610 - DNA, 25 bp, Mus musculus
ttgattcttggtgcccaactctcct

SEQ ID NO: 949611 - DNA, 25 bp, Mus musculus
ttgattcttgttacttcctgtgttt

SEQ ID NO: 949612 - DNA, 25 bp, Mus musculus
ttgattcttgtttcttcctgtgttt

SEQ ID NO: 949613 - DNA, 25 bp, Mus musculus
ttgattctttaaccatccaactcca

SEQ ID NO: 949614 - DNA, 25 bp, Mus musculus
ttgattctttaagcatccaactcca

SEQ ID NO: 949615 - DNA, 25 bp, Mus musculus
ttgattgaacatcatatccttcttc

SEQ ID NO: 949616 - DNA, 25 bp, Mus musculus
ttgattgaacatgatatccttcttc

SEQ ID NO: 949617 - DNA, 25 bp, Mus musculus
ttgattgacaaactacgggccttaa

SEQ ID NO: 949618 - DNA, 25 bp, Mus musculus
ttgattgacaaagtacgggccttaa

SEQ ID NO: 949619 - DNA, 25 bp, Mus musculus
ttgattgactggcaacggatccttt

SEQ ID NO: 949620 - DNA, 25 bp, Mus musculus
ttgattgactgggaacggatccttt

SEQ ID NO: 949621 - DNA, 25 bp, Mus musculus
ttgattgagttgactgtttttaaaa

SEQ ID NO: 949622 - DNA, 25 bp, Mus musculus
ttgattgagttgtctgtttttaaaa

SEQ ID NO: 949623 - DNA, 25 bp, Mus musculus
ttgattgatggtcattggctactga

SEQ ID NO: 949624 - DNA, 25 bp, Mus musculus
ttgattgatggtgattggctactga

SEQ ID NO: 949625 - DNA, 25 bp, Mus musculus
ttgattgcacgtagccttaggcctg

SEQ ID NO: 949626 - DNA, 25 bp, Mus musculus
ttgattgcacgttgccttaggcctg

SEQ ID NO: 949627 - DNA, 25 bp, Mus musculus
ttgattgcatgaatacaggcctaat

SEQ ID NO: 949628 - DNA, 25 bp, Mus musculus
ttgattgcatgattacaggcctaat

SEQ ID NO: 949629 - DNA, 25 bp, Mus musculus
ttgattgccacacccttcaccaatg

SEQ ID NO: 949630 - DNA, 25 bp, Mus musculus
ttgattgccacagccttcaccaatg

SEQ ID NO: 949631 - DNA, 25 bp, Mus musculus
ttgattgccattccaccagtaatct

SEQ ID NO: 949632 - DNA, 25 bp, Mus musculus
ttgattgccattgcaccagtaatct

SEQ ID NO: 949633 - DNA, 25 bp, Mus musculus
ttgattgccttaattaaactcacaa

SEQ ID NO: 949634 - DNA, 25 bp, Mus musculus
ttgattgccttatttaaactcacaa

SEQ ID NO: 949635 - DNA, 25 bp, Mus musculus
ttgattgctgttaactaagattttc

SEQ ID NO: 949636 - DNA, 25 bp, Mus musculus
ttgattgctgttaccaaccactatg

SEQ ID NO: 949637 - DNA, 25 bp, Mus musculus
ttgattgctgtttactaagattttc

SEQ ID NO: 949638 - DNA, 25 bp, Mus musculus
ttgattgctgtttccaaccactatg

SEQ ID NO: 949639 - DNA, 25 bp, Mus musculus
ttgattgcttaactgagggcatatt

SEQ ID NO: 949640 - DNA, 25 bp, Mus musculus
ttgattgcttaagtgagggcatatt

SEQ ID NO: 949641 - DNA, 25 bp, Mus musculus
ttgattgcttccatctagggtcagt

SEQ ID NO: 949642 - DNA, 25 bp, Mus musculus
ttgattgcttccttctagggtcagt

SEQ ID NO: 949643 - DNA, 25 bp, Mus musculus
ttgattgctttaactctcgaatgag

SEQ ID NO: 949644 - DNA, 25 bp, Mus musculus
ttgattgctttatctctcgaatgag

SEQ ID NO: 949645 - DNA, 25 bp, Mus musculus
ttgattggcagcaccattgtgttca

SEQ ID NO: 949646 - DNA, 25 bp, Mus musculus
ttgattggcagctccattgtgttca

SEQ ID NO: 949647 - DNA, 25 bp, Mus musculus
ttgattggtagcattcatgccctcc

SEQ ID NO: 949648 - DNA, 25 bp, Mus musculus
ttgattggtagctttcatgccctcc

SEQ ID NO: 949649 - DNA, 25 bp, Mus musculus
ttgattggtcaaacacactgtcagt

SEQ ID NO: 949650 - DNA, 25 bp, Mus musculus
ttgattggtcaatcacactgtcagt

SEQ ID NO: 949651 - DNA, 25 bp, Mus musculus
ttgattggtgacctgacaagtgcct

SEQ ID NO: 949652 - DNA, 25 bp, Mus musculus
ttgattggtgacgtgacaagtgcct

SEQ ID NO: 949653 - DNA, 25 bp, Mus musculus
ttgattgtacaaccagggctacctt

SEQ ID NO: 949654 - DNA, 25 bp, Mus musculus
ttgattgtacaagcagggctacctt

SEQ ID NO: 949655 - DNA, 25 bp, Mus musculus
ttgattgtactgcaagggcgagaca

SEQ ID NO: 949656 - DNA, 25 bp, Mus musculus
ttgattgtactggaagggcgagaca

SEQ ID NO: 949657 - DNA, 25 bp, Mus musculus
ttgattgtccctctgactgctgctt

SEQ ID NO: 949658 - DNA, 25 bp, Mus musculus
ttgattgtccctgtgactgctgctt

SEQ ID NO: 949659 - DNA, 25 bp, Mus musculus
ttgattgtgacaagacttttccttg

SEQ ID NO: 949660 - DNA, 25 bp, Mus musculus
ttgattgtgacatgacttttccttg

SEQ ID NO: 949661 - DNA, 25 bp, Mus musculus
ttgattgtgcccatcctagctgaat

SEQ ID NO: 949662 - DNA, 25 bp, Mus musculus
ttgattgtgcccttcctagctgaat

SEQ ID NO: 949663 - DNA, 25 bp, Mus musculus
ttgattgtgggcatttcaggcaaga

SEQ ID NO: 949664 - DNA, 25 bp, Mus musculus
ttgattgtgggcttttcaggcaaga

SEQ ID NO: 949665 - DNA, 25 bp, Mus musculus
ttgattgtgtttccccagtgctcaa

SEQ ID NO: 949666 - DNA, 25 bp, Mus musculus
ttgattgtgtttgcccagtgctcaa

SEQ ID NO: 949667 - DNA, 25 bp, Mus musculus
ttgattgttcgaccagcgtgtggat

SEQ ID NO: 949668 - DNA, 25 bp, Mus musculus
ttgattgttcgagcagcgtgtggat

SEQ ID NO: 949669 - DNA, 25 bp, Mus musculus
ttgattgttgcaattttcctgtttc

SEQ ID NO: 949670 - DNA, 25 bp, Mus musculus
ttgattgttgcatttttcctgtttc

SEQ ID NO: 949671 - DNA, 25 bp, Mus musculus
ttgattgtttcacgactgcatagga

SEQ ID NO: 949672 - DNA, 25 bp, Mus musculus
ttgattgtttcaggactgcatagga

SEQ ID NO: 949673 - DNA, 25 bp, Mus musculus
ttgatttaaactattgcctcctgaa

SEQ ID NO: 949674 - DNA, 25 bp, Mus musculus
ttgatttaaacttttgcctcctgaa

SEQ ID NO: 949675 - DNA, 25 bp, Mus musculus
ttgatttaagccatgtcctgacctg

SEQ ID NO: 949676 - DNA, 25 bp, Mus musculus
ttgatttaagccttgtcctgacctg

SEQ ID NO: 949677 - DNA, 25 bp, Mus musculus
ttgatttacatcacaggttccccgg

SEQ ID NO: 949678 - DNA, 25 bp, Mus musculus
ttgatttacatctcaggttccccgg

SEQ ID NO: 949679 - DNA, 25 bp, Mus musculus
ttgatttacattcacttctccagtg

SEQ ID NO: 949680 - DNA, 25 bp, Mus musculus
ttgatttacattgacttctccagtg

SEQ ID NO: 949681 - DNA, 25 bp, Mus musculus
ttgatttcacttccagttgcaggtt

SEQ ID NO: 949682 - DNA, 25 bp, Mus musculus
ttgatttcacttgcagttgcaggtt

SEQ ID NO: 949683 - DNA, 25 bp, Mus musculus
ttgatttccaagacagtgccaatta

SEQ ID NO: 949684 - DNA, 25 bp, Mus musculus
ttgatttccaagtcagtgccaatta

SEQ ID NO: 949685 - DNA, 25 bp, Mus musculus
ttgatttcccaacctgttcaggtta

SEQ ID NO: 949686 - DNA, 25 bp, Mus musculus
ttgatttcccaagctgttcaggtta

SEQ ID NO: 949687 - DNA, 25 bp, Mus musculus
ttgatttcccacattctatctgatt

SEQ ID NO: 949688 - DNA, 25 bp, Mus musculus
ttgatttcccactttctatctgatt

SEQ ID NO: 949689 - DNA, 25 bp, Mus musculus
ttgatttcctggactctggtctgca

SEQ ID NO: 949690 - DNA, 25 bp, Mus musculus
ttgatttcctggtctctggtctgca

SEQ ID NO: 949691 - DNA, 25 bp, Mus musculus
ttgatttcctttacccttaagccat

SEQ ID NO: 949692 - DNA, 25 bp, Mus musculus
ttgatttcctttctactgtttggac

SEQ ID NO: 949693 - DNA, 25 bp, Mus musculus
ttgatttcctttgtactgtttggac

SEQ ID NO: 949694 - DNA, 25 bp, Mus musculus
ttgatttccttttcccttaagccat

SEQ ID NO: 949695 - DNA, 25 bp, Mus musculus
ttgatttcgggtaagtacaagcaaa

SEQ ID NO: 949696 - DNA, 25 bp, Mus musculus
ttgatttcgggttagtacaagcaaa

SEQ ID NO: 949697 - DNA, 25 bp, Mus musculus
ttgatttctgaaaatctctacttct

SEQ ID NO: 949698 - DNA, 25 bp, Mus musculus
ttgatttctgaatatctctacttct

SEQ ID NO: 949699 - DNA, 25 bp, Mus musculus
ttgatttcttttctttcgtctccca

SEQ ID NO: 949700 - DNA, 25 bp, Mus musculus
ttgatttcttttgtttcgtctccca

SEQ ID NO: 949701 - DNA, 25 bp, Mus musculus
ttgatttgagttaacttccctaaag

SEQ ID NO: 949702 - DNA, 25 bp, Mus musculus
ttgatttgagtttacttccctaaag

SEQ ID NO: 949703 - DNA, 25 bp, Mus musculus
ttgatttgctctaggacgctgtctt

SEQ ID NO: 949704 - DNA, 25 bp, Mus musculus
ttgatttgctcttggacgctgtctt

SEQ ID NO: 949705 - DNA, 25 bp, Mus musculus
ttgatttggcatatcgacccagcta

SEQ ID NO: 949706 - DNA, 25 bp, Mus musculus
ttgatttggcatttcgacccagcta

SEQ ID NO: 949707 - DNA, 25 bp, Mus musculus
ttgatttggccaactgtaacttaaa

SEQ ID NO: 949708 - DNA, 25 bp, Mus musculus
ttgatttggccatctgtaacttaaa

SEQ ID NO: 949709 - DNA, 25 bp, Mus musculus
ttgatttggttaattggtcaacaaa

SEQ ID NO: 949710 - DNA, 25 bp, Mus musculus
ttgatttggttatttggtcaacaaa

SEQ ID NO: 949711 - DNA, 25 bp, Mus musculus
ttgattttatcaagtattctgcccc

SEQ ID NO: 949712 - DNA, 25 bp, Mus musculus
ttgattttatcatgtattctgcccc

SEQ ID NO: 949713 - DNA, 25 bp, Mus musculus
ttgattttatttccagagacctgcc

SEQ ID NO: 949714 - DNA, 25 bp, Mus musculus
ttgattttatttgcagagacctgcc

SEQ ID NO: 949715 - DNA, 25 bp, Mus musculus
ttgattttcctcacgtttcttccaa

SEQ ID NO: 949716 - DNA, 25 bp, Mus musculus
ttgattttcctcagcgaggcacaga

SEQ ID NO: 949717 - DNA, 25 bp, Mus musculus
ttgattttcctctcgtttcttccaa

SEQ ID NO: 949718 - DNA, 25 bp, Mus musculus
ttgattttcctctgcgaggcacaga

SEQ ID NO: 949719 - DNA, 25 bp, Mus musculus
ttgattttccttcctcctcaatttt

SEQ ID NO: 949720 - DNA, 25 bp, Mus musculus
ttgattttccttgctcctcaatttt

SEQ ID NO: 949721 - DNA, 25 bp, Mus musculus
ttgattttcggcaagggcgtctact

SEQ ID NO: 949722 - DNA, 25 bp, Mus musculus
ttgattttcggctagggcgtctact

SEQ ID NO: 949723 - DNA, 25 bp, Mus musculus
ttgattttctgtaagccattcctcc

SEQ ID NO: 949724 - DNA, 25 bp, Mus musculus
ttgattttctgttagccattcctcc

SEQ ID NO: 949725 - DNA, 25 bp, Mus musculus
ttgattttgatcattgctcgctgga

SEQ ID NO: 949726 - DNA, 25 bp, Mus musculus
ttgattttgatctttgctcgctgga

SEQ ID NO: 949727 - DNA, 25 bp, Mus musculus
ttgattttggttagcccctgagttc

SEQ ID NO: 949728 - DNA, 25 bp, Mus musculus
ttgattttggtttgcccctgagttc

SEQ ID NO: 949729 - DNA, 25 bp, Mus musculus
ttgatttttgcgagaccagggtttc

SEQ ID NO: 949730 - DNA, 25 bp, Mus musculus
ttgatttttgcgtgaccagggtttc

SEQ ID NO: 949731 - DNA, 25 bp, Mus musculus
ttgatttttgtgctctcgttctctt

SEQ ID NO: 949732 - DNA, 25 bp, Mus musculus
ttgatttttgtggtctcgttctctt

SEQ ID NO: 949733 - DNA, 25 bp, Mus musculus
ttgattttttccctaaatgtgttat

SEQ ID NO: 949734 - DNA, 25 bp, Mus musculus
ttgattttttccgtaaatgtgttat

SEQ ID NO: 949735 - DNA, 25 bp, Mus musculus
ttgcaaaaaaccacagcagttagtt

SEQ ID NO: 949736 - DNA, 25 bp, Mus musculus
ttgcaaaaaacctcagcagttagtt

SEQ ID NO: 949737 - DNA, 25 bp, Mus musculus
ttgcaaaaatggcttccctgcatgt

SEQ ID NO: 949738 - DNA, 25 bp, Mus musculus
ttgcaaaaatgggttccctgcatgt

SEQ ID NO: 949739 - DNA, 25 bp, Mus musculus
ttgcaaaacataccctagagccaca

SEQ ID NO: 949740 - DNA, 25 bp, Mus musculus
ttgcaaaacatagcctagagccaca

SEQ ID NO: 949741 - DNA, 25 bp, Mus musculus
ttgcaaaatgccagttcctggatcc

SEQ ID NO: 949742 - DNA, 25 bp, Mus musculus
ttgcaaaatgcctgttcctggatcc

SEQ ID NO: 949743 - DNA, 25 bp, Mus musculus
ttgcaaaccactacagcttctttgg

SEQ ID NO: 949744 - DNA, 25 bp, Mus musculus
ttgcaaaccacttcagcttctttgg

SEQ ID NO: 949745 - DNA, 25 bp, Mus musculus
ttgcaaacccctctattgtaacatt

SEQ ID NO: 949746 - DNA, 25 bp, Mus musculus
ttgcaaacccctgtattgtaacatt

SEQ ID NO: 949747 - DNA, 25 bp, Mus musculus
ttgcaaaccggactcactgtcccat

SEQ ID NO: 949748 - DNA, 25 bp, Mus musculus
ttgcaaaccggagtcactgtcccat

SEQ ID NO: 949749 - DNA, 25 bp, Mus musculus
ttgcaaacgtgacggctcacctgat

SEQ ID NO: 949750 - DNA, 25 bp, Mus musculus
ttgcaaacgtgagggctcacctgat

SEQ ID NO: 949751 - DNA, 25 bp, Mus musculus
ttgcaaactctaagccagactaggc

SEQ ID NO: 949752 - DNA, 25 bp, Mus musculus
ttgcaaactctatgccagactaggc

SEQ ID NO: 949753 - DNA, 25 bp, Mus musculus
ttgcaaactgctctctccctaactg

SEQ ID NO: 949754 - DNA, 25 bp, Mus musculus
ttgcaaactgctgtctccctaactg

SEQ ID NO: 949755 - DNA, 25 bp, Mus musculus
ttgcaaagaaacctcgcctctcata

SEQ ID NO: 949756 - DNA, 25 bp, Mus musculus
ttgcaaagaaacgtcgcctctcata

SEQ ID NO: 949757 - DNA, 25 bp, Mus musculus
ttgcaaagagcacggttcccaagac

SEQ ID NO: 949758 - DNA, 25 bp, Mus musculus
ttgcaaagagcagggttcccaagac

SEQ ID NO: 949759 - DNA, 25 bp, Mus musculus
ttgcaaagatttctcaagccggccc

SEQ ID NO: 949760 - DNA, 25 bp, Mus musculus
ttgcaaagatttgtcaagccggccc

SEQ ID NO: 949761 - DNA, 25 bp, Mus musculus
ttgcaaagcagcattagcgctggtt

SEQ ID NO: 949762 - DNA, 25 bp, Mus musculus
ttgcaaagcagctttagcgctggtt

SEQ ID NO: 949763 - DNA, 25 bp, Mus musculus
ttgcaaagccatctttgcacggtgg

SEQ ID NO: 949764 - DNA, 25 bp, Mus musculus
ttgcaaagccatgtttgcacggtgg

SEQ ID NO: 949765 - DNA, 25 bp, Mus musculus
ttgcaaaggatgaacttgcattcca

SEQ ID NO: 949766 - DNA, 25 bp, Mus musculus
ttgcaaaggatgtacttgcattcca

SEQ ID NO: 949767 - DNA, 25 bp, Mus musculus
ttgcaaagtagtagtgtcagggact

SEQ ID NO: 949768 - DNA, 25 bp, Mus musculus
ttgcaaagtagttgtgtcagggact

SEQ ID NO: 949769 - DNA, 25 bp, Mus musculus
ttgcaaatacaacctgtctctccca

SEQ ID NO: 949770 - DNA, 25 bp, Mus musculus
ttgcaaatacaagctgtctctccca

SEQ ID NO: 949771 - DNA, 25 bp, Mus musculus
ttgcaaatagctccccagagtgtca

SEQ ID NO: 949772 - DNA, 25 bp, Mus musculus
ttgcaaatagctgcccagagtgtca

SEQ ID NO: 949773 - DNA, 25 bp, Mus musculus
ttgcaaatcatgaatagtctatagt

SEQ ID NO: 949774 - DNA, 25 bp, Mus musculus
ttgcaaatcatgtatagtctatagt

SEQ ID NO: 949775 - DNA, 25 bp, Mus musculus
ttgcaaatccaacactgagttgctg

SEQ ID NO: 949776 - DNA, 25 bp, Mus musculus
ttgcaaatccaagactgagttgctg

SEQ ID NO: 949777 - DNA, 25 bp, Mus musculus
ttgcaaatgactattttccccaaca

SEQ ID NO: 949778 - DNA, 25 bp, Mus musculus
ttgcaaatgacttttttccccaaca

SEQ ID NO: 949779 - DNA, 25 bp, Mus musculus
ttgcaaatgtgcatccatgggtgaa

SEQ ID NO: 949780 - DNA, 25 bp, Mus musculus
ttgcaaatgtgcttccatgggtgaa

SEQ ID NO: 949781 - DNA, 25 bp, Mus musculus
ttgcaaatttagagccagtgggctc

SEQ ID NO: 949782 - DNA, 25 bp, Mus musculus
ttgcaaatttagtgccagtgggctc

SEQ ID NO: 949783 - DNA, 25 bp, Mus musculus
ttgcaacaagacatctgctgtccgc

SEQ ID NO: 949784 - DNA, 25 bp, Mus musculus
ttgcaacaagaccttgaccacgggc

SEQ ID NO: 949785 - DNA, 25 bp, Mus musculus
ttgcaacaagacgttgaccacgggc

SEQ ID NO: 949786 - DNA, 25 bp, Mus musculus
ttgcaacaagacttctgctgtccgc

SEQ ID NO: 949787 - DNA, 25 bp, Mus musculus
ttgcaacacgcacagaacactcatg

SEQ ID NO: 949788 - DNA, 25 bp, Mus musculus
ttgcaacacgcagagaacactcatg

SEQ ID NO: 949789 - DNA, 25 bp, Mus musculus
ttgcaaccagttcctatggcttgga

SEQ ID NO: 949790 - DNA, 25 bp, Mus musculus
ttgcaaccagttgctatggcttgga

SEQ ID NO: 949791 - DNA, 25 bp, Mus musculus
ttgcaacccaccagcagctctggta

SEQ ID NO: 949792 - DNA, 25 bp, Mus musculus
ttgcaacccacctgcagctctggta

SEQ ID NO: 949793 - DNA, 25 bp, Mus musculus
ttgcaaccccatacacatgtacgtg

SEQ ID NO: 949794 - DNA, 25 bp, Mus musculus
ttgcaaccccattcacatgtacgtg

SEQ ID NO: 949795 - DNA, 25 bp, Mus musculus
ttgcaacccgagcacatcagcgaac

SEQ ID NO: 949796 - DNA, 25 bp, Mus musculus
ttgcaacccgaggacatcagcgaac

SEQ ID NO: 949797 - DNA, 25 bp, Mus musculus
ttgcaacccttcaccttcaaagata

SEQ ID NO: 949798 - DNA, 25 bp, Mus musculus
ttgcaacccttctccttcaaagata

SEQ ID NO: 949799 - DNA, 25 bp, Mus musculus
ttgcaacctggcattttactgtatt

SEQ ID NO: 949800 - DNA, 25 bp, Mus musculus
ttgcaacctggctttttactgtatt

SEQ ID NO: 949801 - DNA, 25 bp, Mus musculus
ttgcaacctgtgactcaggaccact

SEQ ID NO: 949802 - DNA, 25 bp, Mus musculus
ttgcaacctgtgtctcaggaccact

SEQ ID NO: 949803 - DNA, 25 bp, Mus musculus
ttgcaacgaccacgttgagaactgc

SEQ ID NO: 949804 - DNA, 25 bp, Mus musculus
ttgcaacgaccaggttgagaactgc

SEQ ID NO: 949805 - DNA, 25 bp, Mus musculus
ttgcaacgcccaagacccagaaaat

SEQ ID NO: 949806 - DNA, 25 bp, Mus musculus
ttgcaacgcccatgacccagaaaat

SEQ ID NO: 949807 - DNA, 25 bp, Mus musculus
ttgcaacgcgtcagtagcatctcag

SEQ ID NO: 949808 - DNA, 25 bp, Mus musculus
ttgcaacgcgtctgtagcatctcag

SEQ ID NO: 949809 - DNA, 25 bp, Mus musculus
ttgcaactaattcaccaggagcctt

SEQ ID NO: 949810 - DNA, 25 bp, Mus musculus
ttgcaactaattgaccaggagcctt

SEQ ID NO: 949811 - DNA, 25 bp, Mus musculus
ttgcaactcaaacccagtcctggtt

SEQ ID NO: 949812 - DNA, 25 bp, Mus musculus
ttgcaactcaaagccagtcctggtt

SEQ ID NO: 949813 - DNA, 25 bp, Mus musculus
ttgcaactgcacaacctctttacaa

SEQ ID NO: 949814 - DNA, 25 bp, Mus musculus
ttgcaactgcactacctctttacaa

SEQ ID NO: 949815 - DNA, 25 bp, Mus musculus
ttgcaactgcccagagaaatgtctg

SEQ ID NO: 949816 - DNA, 25 bp, Mus musculus
ttgcaactgccctgagaaatgtctg

SEQ ID NO: 949817 - DNA, 25 bp, Mus musculus
ttgcaacttaagcactctgcagttt

SEQ ID NO: 949818 - DNA, 25 bp, Mus musculus
ttgcaacttaaggactctgcagttt

SEQ ID NO: 949819 - DNA, 25 bp, Mus musculus
ttgcaacttagtactgtcctgtcag

SEQ ID NO: 949820 - DNA, 25 bp, Mus musculus
ttgcaacttagttctgtcctgtcag

SEQ ID NO: 949821 - DNA, 25 bp, Mus musculus
ttgcaagaaacacatccgggtccac

SEQ ID NO: 949822 - DNA, 25 bp, Mus musculus
ttgcaagaaacagatccgggtccac

SEQ ID NO: 949823 - DNA, 25 bp, Mus musculus
ttgcaagaacccagtgaaagtccca

SEQ ID NO: 949824 - DNA, 25 bp, Mus musculus
ttgcaagaaccctgtgaaagtccca

SEQ ID NO: 949825 - DNA, 25 bp, Mus musculus
ttgcaagaagccacactttctgggc

SEQ ID NO: 949826 - DNA, 25 bp, Mus musculus
ttgcaagaagcctcactttctgggc

SEQ ID NO: 949827 - DNA, 25 bp, Mus musculus
ttgcaagacatacttttgttaacag

SEQ ID NO: 949828 - DNA, 25 bp, Mus musculus
ttgcaagacatagttttgttaacag

SEQ ID NO: 949829 - DNA, 25 bp, Mus musculus
ttgcaagacgtacagaggaacacca

SEQ ID NO: 949830 - DNA, 25 bp, Mus musculus
ttgcaagacgtagagaggaacacca

SEQ ID NO: 949831 - DNA, 25 bp, Mus musculus
ttgcaagaggctccaggtctcagat

SEQ ID NO: 949832 - DNA, 25 bp, Mus musculus
ttgcaagaggctgcaggtctcagat

SEQ ID NO: 949833 - DNA, 25 bp, Mus musculus
ttgcaagatgctaccagctggatgg

SEQ ID NO: 949834 - DNA, 25 bp, Mus musculus
ttgcaagatgctctagtcaccatag

SEQ ID NO: 949835 - DNA, 25 bp, Mus musculus
ttgcaagatgctgtagtcaccatag

SEQ ID NO: 949836 - DNA, 25 bp, Mus musculus
ttgcaagatgcttccagctggatgg

SEQ ID NO: 949837 - DNA, 25 bp, Mus musculus
ttgcaagatggcaaggcccacggcc

SEQ ID NO: 949838 - DNA, 25 bp, Mus musculus
ttgcaagatggctaggcccacggcc

SEQ ID NO: 949839 - DNA, 25 bp, Mus musculus
ttgcaagcagctccatcataatcct

SEQ ID NO: 949840 - DNA, 25 bp, Mus musculus
ttgcaagcagctgcatcataatcct

SEQ ID NO: 949841 - DNA, 25 bp, Mus musculus
ttgcaagcattgacagcaggcctcg

SEQ ID NO: 949842 - DNA, 25 bp, Mus musculus
ttgcaagcattgtcagcaggcctcg

SEQ ID NO: 949843 - DNA, 25 bp, Mus musculus
ttgcaagccaatcaagagaccctgt

SEQ ID NO: 949844 - DNA, 25 bp, Mus musculus
ttgcaagccaatgaagagaccctgt

SEQ ID NO: 949845 - DNA, 25 bp, Mus musculus
ttgcaagctaagagactggtccagc

SEQ ID NO: 949846 - DNA, 25 bp, Mus musculus
ttgcaagctaagtgactggtccagc

SEQ ID NO: 949847 - DNA, 25 bp, Mus musculus
ttgcaagctcttcttttcctcactg

SEQ ID NO: 949848 - DNA, 25 bp, Mus musculus
ttgcaagctcttgttttcctcactg

SEQ ID NO: 949849 - DNA, 25 bp, Mus musculus
ttgcaagctgcgcttccccttcaaa

SEQ ID NO: 949850 - DNA, 25 bp, Mus musculus
ttgcaagctgcggttccccttcaaa

SEQ ID NO: 949851 - DNA, 25 bp, Mus musculus
ttgcaagctgctctatgtctgtcca

SEQ ID NO: 949852 - DNA, 25 bp, Mus musculus
ttgcaagctgctgtatgtctgtcca

SEQ ID NO: 949853 - DNA, 25 bp, Mus musculus
ttgcaagctggtacagggcccaact

SEQ ID NO: 949854 - DNA, 25 bp, Mus musculus
ttgcaagctggttcagggcccaact

SEQ ID NO: 949855 - DNA, 25 bp, Mus musculus
ttgcaaggcagtctcttgtgtcttc

SEQ ID NO: 949856 - DNA, 25 bp, Mus musculus
ttgcaaggcagtgtcttgtgtcttc

SEQ ID NO: 949857 - DNA, 25 bp, Mus musculus
ttgcaaggccctatgtctaagtact

SEQ ID NO: 949858 - DNA, 25 bp, Mus musculus
ttgcaaggccctttgtctaagtact

SEQ ID NO: 949859 - DNA, 25 bp, Mus musculus
ttgcaagggctaattctgacatcat

SEQ ID NO: 949860 - DNA, 25 bp, Mus musculus
ttgcaagggctatttctgacatcat

SEQ ID NO: 949861 - DNA, 25 bp, Mus musculus
ttgcaaggtttgctagtctcaccct

SEQ ID NO: 949862 - DNA, 25 bp, Mus musculus
ttgcaaggtttggtagtctcaccct

SEQ ID NO: 949863 - DNA, 25 bp, Mus musculus
ttgcaagtcacactcatctccaagt

SEQ ID NO: 949864 - DNA, 25 bp, Mus musculus
ttgcaagtcacagtcatctccaagt

SEQ ID NO: 949865 - DNA, 25 bp, Mus musculus
ttgcaagtcatccatgtcattcctt

SEQ ID NO: 949866 - DNA, 25 bp, Mus musculus
ttgcaagtcatcgatgtcattcctt

SEQ ID NO: 949867 - DNA, 25 bp, Mus musculus
ttgcaagtcctgaatttaaatgtcg

SEQ ID NO: 949868 - DNA, 25 bp, Mus musculus
ttgcaagtcctgtatttaaatgtcg

SEQ ID NO: 949869 - DNA, 25 bp, Mus musculus
ttgcaagtccttattccctgctgag

SEQ ID NO: 949870 - DNA, 25 bp, Mus musculus
ttgcaagtcctttttccctgctgag

SEQ ID NO: 949871 - DNA, 25 bp, Mus musculus
ttgcaagtcttgcttctttgggata

SEQ ID NO: 949872 - DNA, 25 bp, Mus musculus
ttgcaagtcttggttctttgggata

SEQ ID NO: 949873 - DNA, 25 bp, Mus musculus
ttgcaagtgtccagtgtctctgcac

SEQ ID NO: 949874 - DNA, 25 bp, Mus musculus
ttgcaagtgtcctgtgtctctgcac

SEQ ID NO: 949875 - DNA, 25 bp, Mus musculus
ttgcaagttggtcactcaactgttt

SEQ ID NO: 949876 - DNA, 25 bp, Mus musculus
ttgcaagttggtgactcaactgttt

SEQ ID NO: 949877 - DNA, 25 bp, Mus musculus
ttgcaagtttgtcgttgagattccc

SEQ ID NO: 949878 - DNA, 25 bp, Mus musculus
ttgcaagtttgtggttgagattccc

SEQ ID NO: 949879 - DNA, 25 bp, Mus musculus
ttgcaataacgaattggaaacatga

SEQ ID NO: 949880 - DNA, 25 bp, Mus musculus
ttgcaataacgatttggaaacatga

SEQ ID NO: 949881 - DNA, 25 bp, Mus musculus
ttgcaatagaagacctcacgaccca

SEQ ID NO: 949882 - DNA, 25 bp, Mus musculus
ttgcaatagaagtcctcacgaccca

SEQ ID NO: 949883 - DNA, 25 bp, Mus musculus
ttgcaatagcaaaatccccagttag

SEQ ID NO: 949884 - DNA, 25 bp, Mus musculus
ttgcaatagcaatatccccagttag

SEQ ID NO: 949885 - DNA, 25 bp, Mus musculus
ttgcaatattgccatgttaaaccca

SEQ ID NO: 949886 - DNA, 25 bp, Mus musculus
ttgcaatattgcgatgttaaaccca

SEQ ID NO: 949887 - DNA, 25 bp, Mus musculus
ttgcaatcaagtcgccatagagtca

SEQ ID NO: 949888 - DNA, 25 bp, Mus musculus
ttgcaatcaagtggccatagagtca

SEQ ID NO: 949889 - DNA, 25 bp, Mus musculus
ttgcaatcagatcgctcaactctgt

SEQ ID NO: 949890 - DNA, 25 bp, Mus musculus
ttgcaatcagatggctcaactctgt

SEQ ID NO: 949891 - DNA, 25 bp, Mus musculus
ttgcaatcattcatttcttccaggc

SEQ ID NO: 949892 - DNA, 25 bp, Mus musculus
ttgcaatcattcttttcttccaggc

SEQ ID NO: 949893 - DNA, 25 bp, Mus musculus
ttgcaatccccaaaggctacttcag

SEQ ID NO: 949894 - DNA, 25 bp, Mus musculus
ttgcaatccccataggctacttcag

SEQ ID NO: 949895 - DNA, 25 bp, Mus musculus
ttgcaatgcagtccttagagccacc

SEQ ID NO: 949896 - DNA, 25 bp, Mus musculus
ttgcaatgcagtgcttagagccacc

SEQ ID NO: 949897 - DNA, 25 bp, Mus musculus
ttgcaatgccttctctgcatttcct

SEQ ID NO: 949898 - DNA, 25 bp, Mus musculus
ttgcaatgccttgtctgcatttcct

SEQ ID NO: 949899 - DNA, 25 bp, Mus musculus
ttgcaatgtttcatactttccgtcg

SEQ ID NO: 949900 - DNA, 25 bp, Mus musculus
ttgcaatgtttcttactttccgtcg

SEQ ID NO: 949901 - DNA, 25 bp, Mus musculus
ttgcaattatatactctaaggagta

SEQ ID NO: 949902 - DNA, 25 bp, Mus musculus
ttgcaattatattctctaaggagta

SEQ ID NO: 949903 - DNA, 25 bp, Mus musculus
ttgcaattgcttaagtagggcacac

SEQ ID NO: 949904 - DNA, 25 bp, Mus musculus
ttgcaattgctttagtagggcacac

SEQ ID NO: 949905 - DNA, 25 bp, Mus musculus
ttgcaattgtctcgaagtagttttc

SEQ ID NO: 949906 - DNA, 25 bp, Mus musculus
ttgcaattgtctggaagtagttttc

SEQ ID NO: 949907 - DNA, 25 bp, Mus musculus
ttgcacaacactagagttcagttct

SEQ ID NO: 949908 - DNA, 25 bp, Mus musculus
ttgcacaacacttgagttcagttct

SEQ ID NO: 949909 - DNA, 25 bp, Mus musculus
ttgcacaagattagctccagactga

SEQ ID NO: 949910 - DNA, 25 bp, Mus musculus
ttgcacaagatttgctccagactga

SEQ ID NO: 949911 - DNA, 25 bp, Mus musculus
ttgcacaagtggcactagccccagg

SEQ ID NO: 949912 - DNA, 25 bp, Mus musculus
ttgcacaagtgggactagccccagg

SEQ ID NO: 949913 - DNA, 25 bp, Mus musculus
ttgcacacacacactggagctgtat

SEQ ID NO: 949914 - DNA, 25 bp, Mus musculus
ttgcacacacactctggagctgtat

SEQ ID NO: 949915 - DNA, 25 bp, Mus musculus
ttgcacacccaaaagcagaaaactt

SEQ ID NO: 949916 - DNA, 25 bp, Mus musculus
ttgcacacccaatagcagaaaactt

SEQ ID NO: 949917 - DNA, 25 bp, Mus musculus
ttgcacaccggtattgagagcccct

SEQ ID NO: 949918 - DNA, 25 bp, Mus musculus
ttgcacaccggttttgagagcccct

SEQ ID NO: 949919 - DNA, 25 bp, Mus musculus
ttgcacacgcacacggcgagggtcg

SEQ ID NO: 949920 - DNA, 25 bp, Mus musculus
ttgcacacgcactcggcgagggtcg

SEQ ID NO: 949921 - DNA, 25 bp, Mus musculus
ttgcacacgcctagcttgtagcttg

SEQ ID NO: 949922 - DNA, 25 bp, Mus musculus
ttgcacacgccttgcttgtagcttg

SEQ ID NO: 949923 - DNA, 25 bp, Mus musculus
ttgcacacgggcaggaggacctttt

SEQ ID NO: 949924 - DNA, 25 bp, Mus musculus
ttgcacacgggctggaggacctttt

SEQ ID NO: 949925 - DNA, 25 bp, Mus musculus
ttgcacacggtgcacattcccaggg

SEQ ID NO: 949926 - DNA, 25 bp, Mus musculus
ttgcacacggtggacattcccaggg

SEQ ID NO: 949927 - DNA, 25 bp, Mus musculus
ttgcacactcagcagtttccctaca

SEQ ID NO: 949928 - DNA, 25 bp, Mus musculus
ttgcacactcaggagtttccctaca

SEQ ID NO: 949929 - DNA, 25 bp, Mus musculus
ttgcacagcaaacgccacttcatgg

SEQ ID NO: 949930 - DNA, 25 bp, Mus musculus
ttgcacagcaaaggccacttcatgg

SEQ ID NO: 949931 - DNA, 25 bp, Mus musculus
ttgcacagcacgattcctttcagaa

SEQ ID NO: 949932 - DNA, 25 bp, Mus musculus
ttgcacagcacgtttcctttcagaa

SEQ ID NO: 949933 - DNA, 25 bp, Mus musculus
ttgcacagctaccttcagacaagca

SEQ ID NO: 949934 - DNA, 25 bp, Mus musculus
ttgcacagctacgttcagacaagca

SEQ ID NO: 949935 - DNA, 25 bp, Mus musculus
ttgcacaggcagctagcccaggcag

SEQ ID NO: 949936 - DNA, 25 bp, Mus musculus
ttgcacaggcaggtagcccaggcag

SEQ ID NO: 949937 - DNA, 25 bp, Mus musculus
ttgcacaggcgaagtctagagactt

SEQ ID NO: 949938 - DNA, 25 bp, Mus musculus
ttgcacaggcgatgtctagagactt

SEQ ID NO: 949939 - DNA, 25 bp, Mus musculus
ttgcacagggtcattaccttgcacc

SEQ ID NO: 949940 - DNA, 25 bp, Mus musculus
ttgcacagggtctttaccttgcacc

SEQ ID NO: 949941 - DNA, 25 bp, Mus musculus
ttgcacagtcctcaagcatgaactc

SEQ ID NO: 949942 - DNA, 25 bp, Mus musculus
ttgcacagtcctgaagcatgaactc

SEQ ID NO: 949943 - DNA, 25 bp, Mus musculus
ttgcacataccacgcaattgctcca

SEQ ID NO: 949944 - DNA, 25 bp, Mus musculus
ttgcacataccaggcaattgctcca

SEQ ID NO: 949945 - DNA, 25 bp, Mus musculus
ttgcacatatgtcctcatggatccc

SEQ ID NO: 949946 - DNA, 25 bp, Mus musculus
ttgcacatatgtgctcatggatccc

SEQ ID NO: 949947 - DNA, 25 bp, Mus musculus
ttgcacatctggacattgagaaaga

SEQ ID NO: 949948 - DNA, 25 bp, Mus musculus
ttgcacatctggtcattgagaaaga

SEQ ID NO: 949949 - DNA, 25 bp, Mus musculus
ttgcacatctgtatcagagtatttt

SEQ ID NO: 949950 - DNA, 25 bp, Mus musculus
ttgcacatctgtcttgctcatgaga

SEQ ID NO: 949951 - DNA, 25 bp, Mus musculus
ttgcacatctgtgttgctcatgaga

SEQ ID NO: 949952 - DNA, 25 bp, Mus musculus
ttgcacatctgtttcagagtatttt

SEQ ID NO: 949953 - DNA, 25 bp, Mus musculus
ttgcacatgacaacttgacaaacct

SEQ ID NO: 949954 - DNA, 25 bp, Mus musculus
ttgcacatgacatcttgacaaacct

SEQ ID NO: 949955 - DNA, 25 bp, Mus musculus
ttgcacatgcagcaacattatataa

SEQ ID NO: 949956 - DNA, 25 bp, Mus musculus
ttgcacatgcaggaacattatataa

SEQ ID NO: 949957 - DNA, 25 bp, Mus musculus
ttgcacatgctcaggcctgacttaa

SEQ ID NO: 949958 - DNA, 25 bp, Mus musculus
ttgcacatgctctggcctgacttaa

SEQ ID NO: 949959 - DNA, 25 bp, Mus musculus
ttgcacatgttaccctgggctacac

SEQ ID NO: 949960 - DNA, 25 bp, Mus musculus
ttgcacatgttagcctgggctacac

SEQ ID NO: 949961 - DNA, 25 bp, Mus musculus
ttgcacattcaaccggcttttttaa

SEQ ID NO: 949962 - DNA, 25 bp, Mus musculus
ttgcacattcaagcggcttttttaa

SEQ ID NO: 949963 - DNA, 25 bp, Mus musculus
ttgcacattcatccaatacctcaga

SEQ ID NO: 949964 - DNA, 25 bp, Mus musculus
ttgcacattcatgcaatacctcaga

SEQ ID NO: 949965 - DNA, 25 bp, Mus musculus
ttgcacattcctagggtgcccgtat

SEQ ID NO: 949966 - DNA, 25 bp, Mus musculus
ttgcacattccttgggtgcccgtat

SEQ ID NO: 949967 - DNA, 25 bp, Mus musculus
ttgcacatttcaactttgtcctgac

SEQ ID NO: 949968 - DNA, 25 bp, Mus musculus
ttgcacatttcatctttgtcctgac

SEQ ID NO: 949969 - DNA, 25 bp, Mus musculus
ttgcaccaagatcactgagtaggct

SEQ ID NO: 949970 - DNA, 25 bp, Mus musculus
ttgcaccaagatgactgagtaggct

SEQ ID NO: 949971 - DNA, 25 bp, Mus musculus
ttgcaccacaagaccggagttcctt

SEQ ID NO: 949972 - DNA, 25 bp, Mus musculus
ttgcaccacaagtccggagttcctt

SEQ ID NO: 949973 - DNA, 25 bp, Mus musculus
ttgcaccaggttctagggtttctca

SEQ ID NO: 949974 - DNA, 25 bp, Mus musculus
ttgcaccaggttgtagggtttctca

SEQ ID NO: 949975 - DNA, 25 bp, Mus musculus
ttgcaccagtcgcttgctttctaga

SEQ ID NO: 949976 - DNA, 25 bp, Mus musculus
ttgcaccagtcggttgctttctaga

SEQ ID NO: 949977 - DNA, 25 bp, Mus musculus
ttgcaccatgcaagttttaggccag

SEQ ID NO: 949978 - DNA, 25 bp, Mus musculus
ttgcaccatgcatgttttaggccag

SEQ ID NO: 949979 - DNA, 25 bp, Mus musculus
ttgcaccattacaaaggtccctttc

SEQ ID NO: 949980 - DNA, 25 bp, Mus musculus
ttgcaccattactaaggtccctttc

SEQ ID NO: 949981 - DNA, 25 bp, Mus musculus
ttgcacccactaattatgtctgaat

SEQ ID NO: 949982 - DNA, 25 bp, Mus musculus
ttgcacccactatttatgtctgaat

SEQ ID NO: 949983 - DNA, 25 bp, Mus musculus
ttgcacccagaaattttccaatgag

SEQ ID NO: 949984 - DNA, 25 bp, Mus musculus
ttgcacccagaatttttccaatgag

SEQ ID NO: 949985 - DNA, 25 bp, Mus musculus
ttgcacccaggaactattttaagaa

SEQ ID NO: 949986 - DNA, 25 bp, Mus musculus
ttgcacccaggatctattttaagaa

SEQ ID NO: 949987 - DNA, 25 bp, Mus musculus
ttgcacccatcactgacgtggagtc

SEQ ID NO: 949988 - DNA, 25 bp, Mus musculus
ttgcacccatcagtgacgtggagtc

SEQ ID NO: 949989 - DNA, 25 bp, Mus musculus
ttgcaccccaacatggtagttttct

SEQ ID NO: 949990 - DNA, 25 bp, Mus musculus
ttgcaccccaacttggtagttttct

SEQ ID NO: 949991 - DNA, 25 bp, Mus musculus
ttgcaccccagtactgcgtattaat

SEQ ID NO: 949992 - DNA, 25 bp, Mus musculus
ttgcaccccagttctgcgtattaat

SEQ ID NO: 949993 - DNA, 25 bp, Mus musculus
ttgcacccctagaggctagactcat

SEQ ID NO: 949994 - DNA, 25 bp, Mus musculus
ttgcacccctagtggctagactcat

SEQ ID NO: 949995 - DNA, 25 bp, Mus musculus
ttgcacccctgaacagaaccaacgt

SEQ ID NO: 949996 - DNA, 25 bp, Mus musculus
ttgcacccctgatcagaaccaacgt

SEQ ID NO: 949997 - DNA, 25 bp, Mus musculus
ttgcacccctggactgatggtcatg

SEQ ID NO: 949998 - DNA, 25 bp, Mus musculus
ttgcacccctggtctgatggtcatg

SEQ ID NO: 949999 - DNA, 25 bp, Mus musculus
ttgcaccctacaagtttctcagttg

SEQ ID NO: 950000 - DNA, 25 bp, Mus musculus
ttgcaccctacatgtttctcagttg

SEQ ID NO: 950001 - DNA, 25 bp, Mus musculus
ttgcaccctgtaaccttctgaggat

SEQ ID NO: 950002 - DNA, 25 bp, Mus musculus
ttgcaccctgtatccttctgaggat

SEQ ID NO: 950003 - DNA, 25 bp, Mus musculus
ttgcacccttttacaagtacagaat

SEQ ID NO: 950004 - DNA, 25 bp, Mus musculus
ttgcacccttttactgttaaagcag

SEQ ID NO: 950005 - DNA, 25 bp, Mus musculus
ttgcaccctttttcaagtacagaat

SEQ ID NO: 950006 - DNA, 25 bp, Mus musculus
ttgcaccctttttctgttaaagcag

SEQ ID NO: 950007 - DNA, 25 bp, Mus musculus
ttgcaccggcacattgatgacactc

SEQ ID NO: 950008 - DNA, 25 bp, Mus musculus
ttgcaccggcactttgatgacactc

SEQ ID NO: 950009 - DNA, 25 bp, Mus musculus
ttgcacctaattcgtccctgctggt

SEQ ID NO: 950010 - DNA, 25 bp, Mus musculus
ttgcacctaattggtccctgctggt

SEQ ID NO: 950011 - DNA, 25 bp, Mus musculus
ttgcacctactgctgaggccaagga

SEQ ID NO: 950012 - DNA, 25 bp, Mus musculus
ttgcacctactggtgaggccaagga

SEQ ID NO: 950013 - DNA, 25 bp, Mus musculus
ttgcacctacttcccagttctgctt

SEQ ID NO: 950014 - DNA, 25 bp, Mus musculus
ttgcacctacttgccagttctgctt

SEQ ID NO: 950015 - DNA, 25 bp, Mus musculus
ttgcacctccatagagcaactcatc

SEQ ID NO: 950016 - DNA, 25 bp, Mus musculus
ttgcacctccattgagcaactcatc

SEQ ID NO: 950017 - DNA, 25 bp, Mus musculus
ttgcacctgcaaatggaatgtagaa

SEQ ID NO: 950018 - DNA, 25 bp, Mus musculus
ttgcacctgcaattggaatgtagaa

SEQ ID NO: 950019 - DNA, 25 bp, Mus musculus
ttgcacctgctgaggatggatccag

SEQ ID NO: 950020 - DNA, 25 bp, Mus musculus
ttgcacctgctgtggatggatccag

SEQ ID NO: 950021 - DNA, 25 bp, Mus musculus
ttgcacctgtccaagttagccaaag

SEQ ID NO: 950022 - DNA, 25 bp, Mus musculus
ttgcacctgtcctagttagccaaag

SEQ ID NO: 950023 - DNA, 25 bp, Mus musculus
ttgcacctgtgaaacctcggcagag

SEQ ID NO: 950024 - DNA, 25 bp, Mus musculus
ttgcacctgtgatacctcggcagag

SEQ ID NO: 950025 - DNA, 25 bp, Mus musculus
ttgcacctgtggctaccagatatgc

SEQ ID NO: 950026 - DNA, 25 bp, Mus musculus
ttgcacctgtggctggaagttttaa

SEQ ID NO: 950027 - DNA, 25 bp, Mus musculus
ttgcacctgtgggtaccagatatgc

SEQ ID NO: 950028 - DNA, 25 bp, Mus musculus
ttgcacctgtgggtggaagttttaa

SEQ ID NO: 950029 - DNA, 25 bp, Mus musculus
ttgcacctgtttcctgggcctctgg

SEQ ID NO: 950030 - DNA, 25 bp, Mus musculus
ttgcacctgtttgctgggcctctgg

SEQ ID NO: 950031 - DNA, 25 bp, Mus musculus
ttgcaccttaagaagttcatccata

SEQ ID NO: 950032 - DNA, 25 bp, Mus musculus
ttgcaccttaagtagttcatccata

SEQ ID NO: 950033 - DNA, 25 bp, Mus musculus
ttgcaccttacacacaacggaggga

SEQ ID NO: 950034 - DNA, 25 bp, Mus musculus
ttgcaccttacagacaacggaggga

SEQ ID NO: 950035 - DNA, 25 bp, Mus musculus
ttgcacctttccaaagtaagctggt

SEQ ID NO: 950036 - DNA, 25 bp, Mus musculus
ttgcacctttcctaagtaagctggt

SEQ ID NO: 950037 - DNA, 25 bp, Mus musculus
ttgcacctttcgaagcttctttaat

SEQ ID NO: 950038 - DNA, 25 bp, Mus musculus
ttgcacctttcgtagcttctttaat

SEQ ID NO: 950039 - DNA, 25 bp, Mus musculus
ttgcaccttttgcacaccccatttt

SEQ ID NO: 950040 - DNA, 25 bp, Mus musculus
ttgcaccttttggacaccccatttt

SEQ ID NO: 950041 - DNA, 25 bp, Mus musculus
ttgcacgagccccagaagaacgcca

SEQ ID NO: 950042 - DNA, 25 bp, Mus musculus
ttgcacgagcccgagaagaacgcca

SEQ ID NO: 950043 - DNA, 25 bp, Mus musculus
ttgcacgatatgagtttgtaatgga

SEQ ID NO: 950044 - DNA, 25 bp, Mus musculus
ttgcacgatatgtgtttgtaatgga

SEQ ID NO: 950045 - DNA, 25 bp, Mus musculus
ttgcacgcacccaatgaggacaaaa

SEQ ID NO: 950046 - DNA, 25 bp, Mus musculus
ttgcacgcaccctatgaggacaaaa

SEQ ID NO: 950047 - DNA, 25 bp, Mus musculus
ttgcacgccaagctgaatgtgagtg

SEQ ID NO: 950048 - DNA, 25 bp, Mus musculus
ttgcacgccaaggtgaatgtgagtg

SEQ ID NO: 950049 - DNA, 25 bp, Mus musculus
ttgcacgccctcaggaaggttcgag

SEQ ID NO: 950050 - DNA, 25 bp, Mus musculus
ttgcacgccctcatcatggtgggat

SEQ ID NO: 950051 - DNA, 25 bp, Mus musculus
ttgcacgccctctggaaggttcgag

SEQ ID NO: 950052 - DNA, 25 bp, Mus musculus
ttgcacgccctcttcatggtgggat

SEQ ID NO: 950053 - DNA, 25 bp, Mus musculus
ttgcacgcttctctttatgttcatt

SEQ ID NO: 950054 - DNA, 25 bp, Mus musculus
ttgcacgcttctgtttatgttcatt

SEQ ID NO: 950055 - DNA, 25 bp, Mus musculus
ttgcacggatgcctttattgtctgg

SEQ ID NO: 950056 - DNA, 25 bp, Mus musculus
ttgcacggatgcgtttattgtctgg

SEQ ID NO: 950057 - DNA, 25 bp, Mus musculus
ttgcacggccccagagaaatctcgg

SEQ ID NO: 950058 - DNA, 25 bp, Mus musculus
ttgcacggcccctgagaaatctcgg

SEQ ID NO: 950059 - DNA, 25 bp, Mus musculus
ttgcacgggatgaagtactccgccc

SEQ ID NO: 950060 - DNA, 25 bp, Mus musculus
ttgcacgggatgtagtactccgccc

SEQ ID NO: 950061 - DNA, 25 bp, Mus musculus
ttgcacgtacaccatgccaagtcag

SEQ ID NO: 950062 - DNA, 25 bp, Mus musculus
ttgcacgtacacgatgccaagtcag

SEQ ID NO: 950063 - DNA, 25 bp, Mus musculus
ttgcacgtccttaagtgagccttca

SEQ ID NO: 950064 - DNA, 25 bp, Mus musculus
ttgcacgtcctttagtgagccttca

SEQ ID NO: 950065 - DNA, 25 bp, Mus musculus
ttgcacgtggaaaaatctttgctgt

SEQ ID NO: 950066 - DNA, 25 bp, Mus musculus
ttgcacgtggaataatctttgctgt

SEQ ID NO: 950067 - DNA, 25 bp, Mus musculus
ttgcactaacgaagctctcctggaa

SEQ ID NO: 950068 - DNA, 25 bp, Mus musculus
ttgcactaacgatgctctcctggaa

SEQ ID NO: 950069 - DNA, 25 bp, Mus musculus
ttgcactaactgctggtctttaaag

SEQ ID NO: 950070 - DNA, 25 bp, Mus musculus
ttgcactaactggtggtctttaaag

SEQ ID NO: 950071 - DNA, 25 bp, Mus musculus
ttgcactaccttcgagccttgtgaa

SEQ ID NO: 950072 - DNA, 25 bp, Mus musculus
ttgcactaccttggagccttgtgaa

SEQ ID NO: 950073 - DNA, 25 bp, Mus musculus
ttgcactatctcaatgtttaacata

SEQ ID NO: 950074 - DNA, 25 bp, Mus musculus
ttgcactatctctatgtttaacata

SEQ ID NO: 950075 - DNA, 25 bp, Mus musculus
ttgcactatggcatgttcccagatt

SEQ ID NO: 950076 - DNA, 25 bp, Mus musculus
ttgcactatggcttgttcccagatt

SEQ ID NO: 950077 - DNA, 25 bp, Mus musculus
ttgcactcaacaagacaccagtctc

SEQ ID NO: 950078 - DNA, 25 bp, Mus musculus
ttgcactcaacatgacaccagtctc

SEQ ID NO: 950079 - DNA, 25 bp, Mus musculus
ttgcactcaattatcagtttctccc

SEQ ID NO: 950080 - DNA, 25 bp, Mus musculus
ttgcactcaattttcagtttctccc

SEQ ID NO: 950081 - DNA, 25 bp, Mus musculus
ttgcactcacatccccatgttctta

SEQ ID NO: 950082 - DNA, 25 bp, Mus musculus
ttgcactcacatgcccatgttctta

SEQ ID NO: 950083 - DNA, 25 bp, Mus musculus
ttgcactcatcaccggcgcctatga

SEQ ID NO: 950084 - DNA, 25 bp, Mus musculus
ttgcactcatcagcggcgcctatga

SEQ ID NO: 950085 - DNA, 25 bp, Mus musculus
ttgcactccagaagcttattcggat

SEQ ID NO: 950086 - DNA, 25 bp, Mus musculus
ttgcactccagatgcttattcggat

SEQ ID NO: 950087 - DNA, 25 bp, Mus musculus
ttgcactcgcgtatctgtagtcata

SEQ ID NO: 950088 - DNA, 25 bp, Mus musculus
ttgcactcgcgtttctgtagtcata

SEQ ID NO: 950089 - DNA, 25 bp, Mus musculus
ttgcactctccacaagctctggtat

SEQ ID NO: 950090 - DNA, 25 bp, Mus musculus
ttgcactctccagaagctctggtat

SEQ ID NO: 950091 - DNA, 25 bp, Mus musculus
ttgcactgactgcttgagcaggcca

SEQ ID NO: 950092 - DNA, 25 bp, Mus musculus
ttgcactgactggttgagcaggcca

SEQ ID NO: 950093 - DNA, 25 bp, Mus musculus
ttgcactgagggagctttgccgtat

SEQ ID NO: 950094 - DNA, 25 bp, Mus musculus
ttgcactgagggtgctttgccgtat

SEQ ID NO: 950095 - DNA, 25 bp, Mus musculus
ttgcactgagtgcttggagtaagaa

SEQ ID NO: 950096 - DNA, 25 bp, Mus musculus
ttgcactgagtggttggagtaagaa

SEQ ID NO: 950097 - DNA, 25 bp, Mus musculus
ttgcactgcagcacttgtttaagaa

SEQ ID NO: 950098 - DNA, 25 bp, Mus musculus
ttgcactgcagctcttgtttaagaa

SEQ ID NO: 950099 - DNA, 25 bp, Mus musculus
ttgcactgctaaaccaccatgaatc

SEQ ID NO: 950100 - DNA, 25 bp, Mus musculus
ttgcactgctaatccaccatgaatc

SEQ ID NO: 950101 - DNA, 25 bp, Mus musculus
ttgcactgctagactcaccagtcac

SEQ ID NO: 950102 - DNA, 25 bp, Mus musculus
ttgcactgctagtctcaccagtcac

SEQ ID NO: 950103 - DNA, 25 bp, Mus musculus
ttgcactggagcctcagttgacaag

SEQ ID NO: 950104 - DNA, 25 bp, Mus musculus
ttgcactggagcgtcagttgacaag

SEQ ID NO: 950105 - DNA, 25 bp, Mus musculus
ttgcactggctactcatacccattc

SEQ ID NO: 950106 - DNA, 25 bp, Mus musculus
ttgcactggctagtcatacccattc

SEQ ID NO: 950107 - DNA, 25 bp, Mus musculus
ttgcactggtctaggatgtatccct

SEQ ID NO: 950108 - DNA, 25 bp, Mus musculus
ttgcactggtcttggatgtatccct

SEQ ID NO: 950109 - DNA, 25 bp, Mus musculus
ttgcactgtacacttcatctcagcc

SEQ ID NO: 950110 - DNA, 25 bp, Mus musculus
ttgcactgtacagttcatctcagcc

SEQ ID NO: 950111 - DNA, 25 bp, Mus musculus
ttgcactgtaggactcaagccgaga

SEQ ID NO: 950112 - DNA, 25 bp, Mus musculus
ttgcactgtaggtctcaagccgaga

SEQ ID NO: 950113 - DNA, 25 bp, Mus musculus
ttgcactgtattcatcatagttatt

SEQ ID NO: 950114 - DNA, 25 bp, Mus musculus
ttgcactgtattgatcatagttatt

SEQ ID NO: 950115 - DNA, 25 bp, Mus musculus
ttgcactgtgcaagcacccttacct

SEQ ID NO: 950116 - DNA, 25 bp, Mus musculus
ttgcactgtgcatgcacccttacct

SEQ ID NO: 950117 - DNA, 25 bp, Mus musculus
ttgcactgtgtgctaaactggaaca

SEQ ID NO: 950118 - DNA, 25 bp, Mus musculus
ttgcactgtgtggtaaactggaaca

SEQ ID NO: 950119 - DNA, 25 bp, Mus musculus
ttgcacttaacacacacatcgacca

SEQ ID NO: 950120 - DNA, 25 bp, Mus musculus
ttgcacttaacagacacatcgacca

SEQ ID NO: 950121 - DNA, 25 bp, Mus musculus
ttgcacttacaaccaaaatgtctta

SEQ ID NO: 950122 - DNA, 25 bp, Mus musculus
ttgcacttacaagcaaaatgtctta

SEQ ID NO: 950123 - DNA, 25 bp, Mus musculus
ttgcacttacccaggatgttaatta

SEQ ID NO: 950124 - DNA, 25 bp, Mus musculus
ttgcacttacccattgtttctccga

SEQ ID NO: 950125 - DNA, 25 bp, Mus musculus
ttgcacttaccctggatgttaatta

SEQ ID NO: 950126 - DNA, 25 bp, Mus musculus
ttgcacttaccctttgtttctccga

SEQ ID NO: 950127 - DNA, 25 bp, Mus musculus
ttgcacttagtgaccttgagtgact

SEQ ID NO: 950128 - DNA, 25 bp, Mus musculus
ttgcacttagtgtccttgagtgact

SEQ ID NO: 950129 - DNA, 25 bp, Mus musculus
ttgcacttcagacaagctgtggaga

SEQ ID NO: 950130 - DNA, 25 bp, Mus musculus
ttgcacttcagagaagctgtggaga

SEQ ID NO: 950131 - DNA, 25 bp, Mus musculus
ttgcacttcagcagggaatccgagg

SEQ ID NO: 950132 - DNA, 25 bp, Mus musculus
ttgcacttcagctgggaatccgagg

SEQ ID NO: 950133 - DNA, 25 bp, Mus musculus
ttgcacttcccacaggtgcgtatgg

SEQ ID NO: 950134 - DNA, 25 bp, Mus musculus
ttgcacttcccagaggtgcgtatgg

SEQ ID NO: 950135 - DNA, 25 bp, Mus musculus
ttgcacttccgtcgagacctctgat

SEQ ID NO: 950136 - DNA, 25 bp, Mus musculus
ttgcacttccgtggagacctctgat

SEQ ID NO: 950137 - DNA, 25 bp, Mus musculus
ttgcacttctgtaaatatctctgta

SEQ ID NO: 950138 - DNA, 25 bp, Mus musculus
ttgcacttctgttaatatctctgta

SEQ ID NO: 950139 - DNA, 25 bp, Mus musculus
ttgcacttgaagctagggcagttgt

SEQ ID NO: 950140 - DNA, 25 bp, Mus musculus
ttgcacttgaaggtagggcagttgt

SEQ ID NO: 950141 - DNA, 25 bp, Mus musculus
ttgcacttgacaaatatgggcctca

SEQ ID NO: 950142 - DNA, 25 bp, Mus musculus
ttgcacttgacatatatgggcctca

SEQ ID NO: 950143 - DNA, 25 bp, Mus musculus
ttgcacttgcccagctcagagttgg

SEQ ID NO: 950144 - DNA, 25 bp, Mus musculus
ttgcacttgccctgctcagagttgg

SEQ ID NO: 950145 - DNA, 25 bp, Mus musculus
ttgcacttggccagagactgtttaa

SEQ ID NO: 950146 - DNA, 25 bp, Mus musculus
ttgcacttggcctgagactgtttaa

SEQ ID NO: 950147 - DNA, 25 bp, Mus musculus
ttgcacttgtctacagccatgggag

SEQ ID NO: 950148 - DNA, 25 bp, Mus musculus
ttgcacttgtcttcagccatgggag

SEQ ID NO: 950149 - DNA, 25 bp, Mus musculus
ttgcacttgtggcacagccgttggc

SEQ ID NO: 950150 - DNA, 25 bp, Mus musculus
ttgcacttgtgggacagccgttggc

SEQ ID NO: 950151 - DNA, 25 bp, Mus musculus
ttgcactttaatcgcccgacaaatt

SEQ ID NO: 950152 - DNA, 25 bp, Mus musculus
ttgcactttaatctctagccacctc

SEQ ID NO: 950153 - DNA, 25 bp, Mus musculus
ttgcactttaatggcccgacaaatt

SEQ ID NO: 950154 - DNA, 25 bp, Mus musculus
ttgcactttaatgtctagccacctc

SEQ ID NO: 950155 - DNA, 25 bp, Mus musculus
ttgcactttataaccctttagagaa

SEQ ID NO: 950156 - DNA, 25 bp, Mus musculus
ttgcactttatatccctttagagaa

SEQ ID NO: 950157 - DNA, 25 bp, Mus musculus
ttgcactttattcctgcccacgtgg

SEQ ID NO: 950158 - DNA, 25 bp, Mus musculus
ttgcactttattgctgcccacgtgg

SEQ ID NO: 950159 - DNA, 25 bp, Mus musculus
ttgcactttgttcaggtgggtctta

SEQ ID NO: 950160 - DNA, 25 bp, Mus musculus
ttgcactttgttgaggtgggtctta

SEQ ID NO: 950161 - DNA, 25 bp, Mus musculus
ttgcagaaaaccatttagcccacct

SEQ ID NO: 950162 - DNA, 25 bp, Mus musculus
ttgcagaaaaccttttagcccacct

SEQ ID NO: 950163 - DNA, 25 bp, Mus musculus
ttgcagaaggtgatcccgaaacgcc

SEQ ID NO: 950164 - DNA, 25 bp, Mus musculus
ttgcagaaggtgttcccgaaacgcc

SEQ ID NO: 950165 - DNA, 25 bp, Mus musculus
ttgcagaaggttcggagacccaatc

SEQ ID NO: 950166 - DNA, 25 bp, Mus musculus
ttgcagaaggttgggagacccaatc

SEQ ID NO: 950167 - DNA, 25 bp, Mus musculus
ttgcagaatctgagcttgacggaag

SEQ ID NO: 950168 - DNA, 25 bp, Mus musculus
ttgcagaatctgtgcttgacggaag

SEQ ID NO: 950169 - DNA, 25 bp, Mus musculus
ttgcagacagatactctatgcccgt

SEQ ID NO: 950170 - DNA, 25 bp, Mus musculus
ttgcagacagattctctatgcccgt

SEQ ID NO: 950171 - DNA, 25 bp, Mus musculus
ttgcagacagcgaaacttctcccag

SEQ ID NO: 950172 - DNA, 25 bp, Mus musculus
ttgcagacagcgtaacttctcccag

SEQ ID NO: 950173 - DNA, 25 bp, Mus musculus
ttgcagaccgcaaacagttttagtt

SEQ ID NO: 950174 - DNA, 25 bp, Mus musculus
ttgcagaccgcatacagttttagtt

SEQ ID NO: 950175 - DNA, 25 bp, Mus musculus
ttgcagacgtatatccctggaaaag

SEQ ID NO: 950176 - DNA, 25 bp, Mus musculus
ttgcagacgtatttccctggaaaag

SEQ ID NO: 950177 - DNA, 25 bp, Mus musculus
ttgcagacgtggagcctaagacggc

SEQ ID NO: 950178 - DNA, 25 bp, Mus musculus
ttgcagacgtggtgcctaagacggc

SEQ ID NO: 950179 - DNA, 25 bp, Mus musculus
ttgcagacgttgacaccctgttact

SEQ ID NO: 950180 - DNA, 25 bp, Mus musculus
ttgcagacgttgtcaccctgttact

SEQ ID NO: 950181 - DNA, 25 bp, Mus musculus
ttgcagactccgcaaaccactgttt

SEQ ID NO: 950182 - DNA, 25 bp, Mus musculus
ttgcagactccggaaaccactgttt

SEQ ID NO: 950183 - DNA, 25 bp, Mus musculus
ttgcagactggccatcgggccaagc

SEQ ID NO: 950184 - DNA, 25 bp, Mus musculus
ttgcagactggcgatcgggccaagc

SEQ ID NO: 950185 - DNA, 25 bp, Mus musculus
ttgcagactgggattgtctcctcac

SEQ ID NO: 950186 - DNA, 25 bp, Mus musculus
ttgcagactgggtttgtctcctcac

SEQ ID NO: 950187 - DNA, 25 bp, Mus musculus
ttgcagactgtgacacttgacctct

SEQ ID NO: 950188 - DNA, 25 bp, Mus musculus
ttgcagactgtgtcacttgacctct

SEQ ID NO: 950189 - DNA, 25 bp, Mus musculus
ttgcagagagaacccgactccctgt

SEQ ID NO: 950190 - DNA, 25 bp, Mus musculus
ttgcagagagaagccgactccctgt

SEQ ID NO: 950191 - DNA, 25 bp, Mus musculus
ttgcagagatgtaaccaggcagccg

SEQ ID NO: 950192 - DNA, 25 bp, Mus musculus
ttgcagagatgttaccaggcagccg

SEQ ID NO: 950193 - DNA, 25 bp, Mus musculus
ttgcagaggcggagttttaccgaca

SEQ ID NO: 950194 - DNA, 25 bp, Mus musculus
ttgcagaggcggatgaacccactac

SEQ ID NO: 950195 - DNA, 25 bp, Mus musculus
ttgcagaggcggtgttttaccgaca

SEQ ID NO: 950196 - DNA, 25 bp, Mus musculus
ttgcagaggcggttgaacccactac

SEQ ID NO: 950197 - DNA, 25 bp, Mus musculus
ttgcagatactccttattcctgtct

SEQ ID NO: 950198 - DNA, 25 bp, Mus musculus
ttgcagatactcgttattcctgtct

SEQ ID NO: 950199 - DNA, 25 bp, Mus musculus
ttgcagatcacacttgtttccgtaa

SEQ ID NO: 950200 - DNA, 25 bp, Mus musculus
ttgcagatcacagttgtttccgtaa

SEQ ID NO: 950201 - DNA, 25 bp, Mus musculus
ttgcagatcctacacatgctcagga

SEQ ID NO: 950202 - DNA, 25 bp, Mus musculus
ttgcagatcctagacatgctcagga

SEQ ID NO: 950203 - DNA, 25 bp, Mus musculus
ttgcagatcttcagcataagcctct

SEQ ID NO: 950204 - DNA, 25 bp, Mus musculus
ttgcagatcttctgcataagcctct

SEQ ID NO: 950205 - DNA, 25 bp, Mus musculus
ttgcagattcttacaaatccacatt

SEQ ID NO: 950206 - DNA, 25 bp, Mus musculus
ttgcagattctttcaaatccacatt

SEQ ID NO: 950207 - DNA, 25 bp, Mus musculus
ttgcagcaagacctggctttggact

SEQ ID NO: 950208 - DNA, 25 bp, Mus musculus
ttgcagcaagacgtggctttggact

SEQ ID NO: 950209 - DNA, 25 bp, Mus musculus
ttgcagcacacaaaatcccagggat

SEQ ID NO: 950210 - DNA, 25 bp, Mus musculus
ttgcagcacacataatcccagggat

SEQ ID NO: 950211 - DNA, 25 bp, Mus musculus
ttgcagcacactcgttggaatcttt

SEQ ID NO: 950212 - DNA, 25 bp, Mus musculus
ttgcagcacactggttggaatcttt

SEQ ID NO: 950213 - DNA, 25 bp, Mus musculus
ttgcagcaccaaatggctatggcag

SEQ ID NO: 950214 - DNA, 25 bp, Mus musculus
ttgcagcaccaattggctatggcag

SEQ ID NO: 950215 - DNA, 25 bp, Mus musculus
ttgcagcaccgaagagaaggcctag

SEQ ID NO: 950216 - DNA, 25 bp, Mus musculus
ttgcagcaccgatgagaaggcctag

SEQ ID NO: 950217 - DNA, 25 bp, Mus musculus
ttgcagcactacagttaaagttcac

SEQ ID NO: 950218 - DNA, 25 bp, Mus musculus
ttgcagcactactgttaaagttcac

SEQ ID NO: 950219 - DNA, 25 bp, Mus musculus
ttgcagcagacaattctaaacagta

SEQ ID NO: 950220 - DNA, 25 bp, Mus musculus
ttgcagcagacatttctaaacagta

SEQ ID NO: 950221 - DNA, 25 bp, Mus musculus
ttgcagcagatgcagtggccccagt

SEQ ID NO: 950222 - DNA, 25 bp, Mus musculus
ttgcagcagatggagtggccccagt

SEQ ID NO: 950223 - DNA, 25 bp, Mus musculus
ttgcagcagctgcaactctgggtca

SEQ ID NO: 950224 - DNA, 25 bp, Mus musculus
ttgcagcagctggaactctgggtca

SEQ ID NO: 950225 - DNA, 25 bp, Mus musculus
ttgcagcatccgacacaatgagctt

SEQ ID NO: 950226 - DNA, 25 bp, Mus musculus
ttgcagcatccgtcacaatgagctt

SEQ ID NO: 950227 - DNA, 25 bp, Mus musculus
ttgcagcatctgcagtcacataatc

SEQ ID NO: 950228 - DNA, 25 bp, Mus musculus
ttgcagcatctggagtcacataatc

SEQ ID NO: 950229 - DNA, 25 bp, Mus musculus
ttgcagccacacagacacagggcag

SEQ ID NO: 950230 - DNA, 25 bp, Mus musculus
ttgcagccacactgacacagggcag

SEQ ID NO: 950231 - DNA, 25 bp, Mus musculus
ttgcagccacctcggtttcattcac

SEQ ID NO: 950232 - DNA, 25 bp, Mus musculus
ttgcagccacctgggtttcattcac

SEQ ID NO: 950233 - DNA, 25 bp, Mus musculus
ttgcagccagctcccttaggaatga

SEQ ID NO: 950234 - DNA, 25 bp, Mus musculus
ttgcagccagctgccttaggaatga

SEQ ID NO: 950235 - DNA, 25 bp, Mus musculus
ttgcagccaggcaatgtgcttcttt

SEQ ID NO: 950236 - DNA, 25 bp, Mus musculus
ttgcagccaggctatgtgcttcttt

SEQ ID NO: 950237 - DNA, 25 bp, Mus musculus
ttgcagccattgcacacttggtcta

SEQ ID NO: 950238 - DNA, 25 bp, Mus musculus
ttgcagccattggacacttggtcta

SEQ ID NO: 950239 - DNA, 25 bp, Mus musculus
ttgcagcccataatctgtctgaaat

SEQ ID NO: 950240 - DNA, 25 bp, Mus musculus
ttgcagcccatattctgtctgaaat

SEQ ID NO: 950241 - DNA, 25 bp, Mus musculus
ttgcagcccattcttctgtatttca

SEQ ID NO: 950242 - DNA, 25 bp, Mus musculus
ttgcagcccattgttctgtatttca

SEQ ID NO: 950243 - DNA, 25 bp, Mus musculus
ttgcagcccctgaactaaggcagcc

SEQ ID NO: 950244 - DNA, 25 bp, Mus musculus
ttgcagcccctgtactaaggcagcc

SEQ ID NO: 950245 - DNA, 25 bp, Mus musculus
ttgcagccctacacactttattttt

SEQ ID NO: 950246 - DNA, 25 bp, Mus musculus
ttgcagccctactcactttattttt

SEQ ID NO: 950247 - DNA, 25 bp, Mus musculus
ttgcagccggtgacaagattctgta

SEQ ID NO: 950248 - DNA, 25 bp, Mus musculus
ttgcagccggtgtcaagattctgta

SEQ ID NO: 950249 - DNA, 25 bp, Mus musculus
ttgcagcctagaaattcagtcctct

SEQ ID NO: 950250 - DNA, 25 bp, Mus musculus
ttgcagcctagatattcagtcctct

SEQ ID NO: 950251 - DNA, 25 bp, Mus musculus
ttgcagcctctcaattcaatgtgcc

SEQ ID NO: 950252 - DNA, 25 bp, Mus musculus
ttgcagcctctctattcaatgtgcc

SEQ ID NO: 950253 - DNA, 25 bp, Mus musculus
ttgcagcctctgcatacactcgaat

SEQ ID NO: 950254 - DNA, 25 bp, Mus musculus
ttgcagcctctggatacactcgaat

SEQ ID NO: 950255 - DNA, 25 bp, Mus musculus
ttgcagcctgcaaagcccttactgg

SEQ ID NO: 950256 - DNA, 25 bp, Mus musculus
ttgcagcctgcatagcccttactgg

SEQ ID NO: 950257 - DNA, 25 bp, Mus musculus
ttgcagccttccaaaagccagcact

SEQ ID NO: 950258 - DNA, 25 bp, Mus musculus
ttgcagccttcctaaagccagcact

SEQ ID NO: 950259 - DNA, 25 bp, Mus musculus
ttgcagccttctagtgacagatcct

SEQ ID NO: 950260 - DNA, 25 bp, Mus musculus
ttgcagccttcttgtgacagatcct

SEQ ID NO: 950261 - DNA, 25 bp, Mus musculus
ttgcagcgcactaattcctttgatg

SEQ ID NO: 950262 - DNA, 25 bp, Mus musculus
ttgcagcgcacttattcctttgatg

SEQ ID NO: 950263 - DNA, 25 bp, Mus musculus
ttgcagcggctaacctggtggccag

SEQ ID NO: 950264 - DNA, 25 bp, Mus musculus
ttgcagcggctatcctggtggccag

SEQ ID NO: 950265 - DNA, 25 bp, Mus musculus
ttgcagctacacaatcttggcattg

SEQ ID NO: 950266 - DNA, 25 bp, Mus musculus
ttgcagctacactatcttggcattg

SEQ ID NO: 950267 - DNA, 25 bp, Mus musculus
ttgcagctacgccaggcacaaatat

SEQ ID NO: 950268 - DNA, 25 bp, Mus musculus
ttgcagctacgcgaggcacaaatat

SEQ ID NO: 950269 - DNA, 25 bp, Mus musculus
ttgcagctacttcggcttaggaaat

SEQ ID NO: 950270 - DNA, 25 bp, Mus musculus
ttgcagctacttgggcttaggaaat

SEQ ID NO: 950271 - DNA, 25 bp, Mus musculus
ttgcagctcaagattgtctgggttt

SEQ ID NO: 950272 - DNA, 25 bp, Mus musculus
ttgcagctcaagtttgtctgggttt

SEQ ID NO: 950273 - DNA, 25 bp, Mus musculus
ttgcagctcactcataggcctgtgc

SEQ ID NO: 950274 - DNA, 25 bp, Mus musculus
ttgcagctcactgataggcctgtgc

SEQ ID NO: 950275 - DNA, 25 bp, Mus musculus
ttgcagctcatgaagaatccctagg

SEQ ID NO: 950276 - DNA, 25 bp, Mus musculus
ttgcagctcatgtagaatccctagg

SEQ ID NO: 950277 - DNA, 25 bp, Mus musculus
ttgcagctccacatctaagtacgat

SEQ ID NO: 950278 - DNA, 25 bp, Mus musculus
ttgcagctccacttctaagtacgat

SEQ ID NO: 950279 - DNA, 25 bp, Mus musculus
ttgcagctccccaggattatcaggc

SEQ ID NO: 950280 - DNA, 25 bp, Mus musculus
ttgcagctcccctggattatcaggc

SEQ ID NO: 950281 - DNA, 25 bp, Mus musculus
ttgcagctccctctcagttaaaact

SEQ ID NO: 950282 - DNA, 25 bp, Mus musculus
ttgcagctccctgtcagttaaaact

SEQ ID NO: 950283 - DNA, 25 bp, Mus musculus
ttgcagctgaggacaaccttggtct

SEQ ID NO: 950284 - DNA, 25 bp, Mus musculus
ttgcagctgaggtcaaccttggtct

SEQ ID NO: 950285 - DNA, 25 bp, Mus musculus
ttgcagctgcaacggaagatcaagc

SEQ ID NO: 950286 - DNA, 25 bp, Mus musculus
ttgcagctgcaagggaagatcaagc

SEQ ID NO: 950287 - DNA, 25 bp, Mus musculus
ttgcagctggacaccactcacaggg

SEQ ID NO: 950288 - DNA, 25 bp, Mus musculus
ttgcagctggactccactcacaggg

SEQ ID NO: 950289 - DNA, 25 bp, Mus musculus
ttgcagctggcccaagattacatct

SEQ ID NO: 950290 - DNA, 25 bp, Mus musculus
ttgcagctggccgaagattacatct

SEQ ID NO: 950291 - DNA, 25 bp, Mus musculus
ttgcagcttaatccttcatttcccc

SEQ ID NO: 950292 - DNA, 25 bp, Mus musculus
ttgcagcttaatgcttcatttcccc

SEQ ID NO: 950293 - DNA, 25 bp, Mus musculus
ttgcagcttcctctctgtaggctag

SEQ ID NO: 950294 - DNA, 25 bp, Mus musculus
ttgcagcttcctgtctgtaggctag

SEQ ID NO: 950295 - DNA, 25 bp, Mus musculus
ttgcagcttctcaggaggctgggta

SEQ ID NO: 950296 - DNA, 25 bp, Mus musculus
ttgcagcttctcctcactgtagtaa

SEQ ID NO: 950297 - DNA, 25 bp, Mus musculus
ttgcagcttctcgtcactgtagtaa

SEQ ID NO: 950298 - DNA, 25 bp, Mus musculus
ttgcagcttctctggaggctgggta

SEQ ID NO: 950299 - DNA, 25 bp, Mus musculus
ttgcagcttgagcttttcgcataag

SEQ ID NO: 950300 - DNA, 25 bp, Mus musculus
ttgcagcttgaggttttcgcataag

SEQ ID NO: 950301 - DNA, 25 bp, Mus musculus
ttgcagcttgctaggttagcccagc

SEQ ID NO: 950302 - DNA, 25 bp, Mus musculus
ttgcagcttgcttggttagcccagc

SEQ ID NO: 950303 - DNA, 25 bp, Mus musculus
ttgcagctttaaaggaatattgggt

SEQ ID NO: 950304 - DNA, 25 bp, Mus musculus
ttgcagctttaatggaatattgggt

SEQ ID NO: 950305 - DNA, 25 bp, Mus musculus
ttgcaggaaaagacccagtgtgctt

SEQ ID NO: 950306 - DNA, 25 bp, Mus musculus
ttgcaggaaaagtcccagtgtgctt

SEQ ID NO: 950307 - DNA, 25 bp, Mus musculus
ttgcaggaatgtagccccatcgggc

SEQ ID NO: 950308 - DNA, 25 bp, Mus musculus
ttgcaggaatgttgccccatcgggc

SEQ ID NO: 950309 - DNA, 25 bp, Mus musculus
ttgcaggactacacattcatgtggg

SEQ ID NO: 950310 - DNA, 25 bp, Mus musculus
ttgcaggactactcattcatgtggg

SEQ ID NO: 950311 - DNA, 25 bp, Mus musculus
ttgcaggatctgaggccagctacag

SEQ ID NO: 950312 - DNA, 25 bp, Mus musculus
ttgcaggatctgctggataaactcc

SEQ ID NO: 950313 - DNA, 25 bp, Mus musculus
ttgcaggatctggtggataaactcc

SEQ ID NO: 950314 - DNA, 25 bp, Mus musculus
ttgcaggatctgtggccagctacag

SEQ ID NO: 950315 - DNA, 25 bp, Mus musculus
ttgcaggcaattaccacacttatgg

SEQ ID NO: 950316 - DNA, 25 bp, Mus musculus
ttgcaggcaatttccacacttatgg

SEQ ID NO: 950317 - DNA, 25 bp, Mus musculus
ttgcaggcagcgatggtgacaccag

SEQ ID NO: 950318 - DNA, 25 bp, Mus musculus
ttgcaggcagcgttggtgacaccag

SEQ ID NO: 950319 - DNA, 25 bp, Mus musculus
ttgcaggcagtgaagaacctaacct

SEQ ID NO: 950320 - DNA, 25 bp, Mus musculus
ttgcaggcagtgtagaacctaacct

SEQ ID NO: 950321 - DNA, 25 bp, Mus musculus
ttgcaggcagttctttgtattaaat

SEQ ID NO: 950322 - DNA, 25 bp, Mus musculus
ttgcaggcagttgtttgtattaaat

SEQ ID NO: 950323 - DNA, 25 bp, Mus musculus
ttgcaggcccctcgctatcagtttg

SEQ ID NO: 950324 - DNA, 25 bp, Mus musculus
ttgcaggcccctggctatcagtttg

SEQ ID NO: 950325 - DNA, 25 bp, Mus musculus
ttgcaggcctctaagctggcaaaga

SEQ ID NO: 950326 - DNA, 25 bp, Mus musculus
ttgcaggcctcttagctggcaaaga

SEQ ID NO: 950327 - DNA, 25 bp, Mus musculus
ttgcaggcgctactgatggtaattc

SEQ ID NO: 950328 - DNA, 25 bp, Mus musculus
ttgcaggcgctagtgatggtaattc

SEQ ID NO: 950329 - DNA, 25 bp, Mus musculus
ttgcaggcggtacttgaggtttaat

SEQ ID NO: 950330 - DNA, 25 bp, Mus musculus
ttgcaggcggtagttgaggtttaat

SEQ ID NO: 950331 - DNA, 25 bp, Mus musculus
ttgcaggctcaaaagctcaactgtg

SEQ ID NO: 950332 - DNA, 25 bp, Mus musculus
ttgcaggctcaatagctcaactgtg

SEQ ID NO: 950333 - DNA, 25 bp, Mus musculus
ttgcaggctgagacagccagtcacc

SEQ ID NO: 950334 - DNA, 25 bp, Mus musculus
ttgcaggctgagtcagccagtcacc

SEQ ID NO: 950335 - DNA, 25 bp, Mus musculus
ttgcaggctgctaggccagattggc

SEQ ID NO: 950336 - DNA, 25 bp, Mus musculus
ttgcaggctgcttggccagattggc

SEQ ID NO: 950337 - DNA, 25 bp, Mus musculus
ttgcaggctggtccagatatctcta

SEQ ID NO: 950338 - DNA, 25 bp, Mus musculus
ttgcaggctggtgcagatatctcta

SEQ ID NO: 950339 - DNA, 25 bp, Mus musculus
ttgcagggacttcccaaccatggac

SEQ ID NO: 950340 - DNA, 25 bp, Mus musculus
ttgcagggacttgccaaccatggac

SEQ ID NO: 950341 - DNA, 25 bp, Mus musculus
ttgcagggagatccgctatagcgca

SEQ ID NO: 950342 - DNA, 25 bp, Mus musculus
ttgcagggagatgcgctatagcgca

SEQ ID NO: 950343 - DNA, 25 bp, Mus musculus
ttgcagggcaagctcttatttcact

SEQ ID NO: 950344 - DNA, 25 bp, Mus musculus
ttgcagggcaaggtcttatttcact

SEQ ID NO: 950345 - DNA, 25 bp, Mus musculus
ttgcagggccagctcaagtttaagt

SEQ ID NO: 950346 - DNA, 25 bp, Mus musculus
ttgcagggccaggtcaagtttaagt

SEQ ID NO: 950347 - DNA, 25 bp, Mus musculus
ttgcagggcctaattgtgaacttaa

SEQ ID NO: 950348 - DNA, 25 bp, Mus musculus
ttgcagggcctatttgtgaacttaa

SEQ ID NO: 950349 - DNA, 25 bp, Mus musculus
ttgcaggggccacgtttggtcaaac

SEQ ID NO: 950350 - DNA, 25 bp, Mus musculus
ttgcaggggccaggtttggtcaaac

SEQ ID NO: 950351 - DNA, 25 bp, Mus musculus
ttgcaggtagctagtgttcatgtaa

SEQ ID NO: 950352 - DNA, 25 bp, Mus musculus
ttgcaggtagcttgtgttcatgtaa

SEQ ID NO: 950353 - DNA, 25 bp, Mus musculus
ttgcaggtatgaactggtcgggcct

SEQ ID NO: 950354 - DNA, 25 bp, Mus musculus
ttgcaggtatgatctggtcgggcct

SEQ ID NO: 950355 - DNA, 25 bp, Mus musculus
ttgcaggtcagcagtgttgccattt

SEQ ID NO: 950356 - DNA, 25 bp, Mus musculus
ttgcaggtcagctgtgttgccattt

SEQ ID NO: 950357 - DNA, 25 bp, Mus musculus
ttgcaggtccagaagagcggagcag

SEQ ID NO: 950358 - DNA, 25 bp, Mus musculus
ttgcaggtccagaagtcaggctcaa

SEQ ID NO: 950359 - DNA, 25 bp, Mus musculus
ttgcaggtccagtagagcggagcag

SEQ ID NO: 950360 - DNA, 25 bp, Mus musculus
ttgcaggtccagtagtcaggctcaa

SEQ ID NO: 950361 - DNA, 25 bp, Mus musculus
ttgcaggtggaaagccatccatacc

SEQ ID NO: 950362 - DNA, 25 bp, Mus musculus
ttgcaggtggaatgccatccatacc

SEQ ID NO: 950363 - DNA, 25 bp, Mus musculus
ttgcaggtgtccataagtttgcccg

SEQ ID NO: 950364 - DNA, 25 bp, Mus musculus
ttgcaggtgtccttaagtttgcccg

SEQ ID NO: 950365 - DNA, 25 bp, Mus musculus
ttgcagtactgactttcccatctgg

SEQ ID NO: 950366 - DNA, 25 bp, Mus musculus
ttgcagtactgagtttcccatctgg

SEQ ID NO: 950367 - DNA, 25 bp, Mus musculus
ttgcagtagcggaaggcttcttgct

SEQ ID NO: 950368 - DNA, 25 bp, Mus musculus
ttgcagtagcggtaggcttcttgct

SEQ ID NO: 950369 - DNA, 25 bp, Mus musculus
ttgcagtaggaactgttctcctccc

SEQ ID NO: 950370 - DNA, 25 bp, Mus musculus
ttgcagtaggaagtgttctcctccc

SEQ ID NO: 950371 - DNA, 25 bp, Mus musculus
ttgcagtagtgcacccctgtgtgcc

SEQ ID NO: 950372 - DNA, 25 bp, Mus musculus
ttgcagtagtgctcccctgtgtgcc

SEQ ID NO: 950373 - DNA, 25 bp, Mus musculus
ttgcagtataacagcggcgaggagc

SEQ ID NO: 950374 - DNA, 25 bp, Mus musculus
ttgcagtataactgcggcgaggagc

SEQ ID NO: 950375 - DNA, 25 bp, Mus musculus
ttgcagtatttgaaagcatttcagc

SEQ ID NO: 950376 - DNA, 25 bp, Mus musculus
ttgcagtatttgtaagcatttcagc

SEQ ID NO: 950377 - DNA, 25 bp, Mus musculus
ttgcagtcaactcctcctagaggaa

SEQ ID NO: 950378 - DNA, 25 bp, Mus musculus
ttgcagtcaactgctcctagaggaa

SEQ ID NO: 950379 - DNA, 25 bp, Mus musculus
ttgcagtcacttatatccataccca

SEQ ID NO: 950380 - DNA, 25 bp, Mus musculus
ttgcagtcacttttatccataccca

SEQ ID NO: 950381 - DNA, 25 bp, Mus musculus
ttgcagtcagtgagtttcaactaac

SEQ ID NO: 950382 - DNA, 25 bp, Mus musculus
ttgcagtcagtgctaccctgtttaa

SEQ ID NO: 950383 - DNA, 25 bp, Mus musculus
ttgcagtcagtggtaccctgtttaa

SEQ ID NO: 950384 - DNA, 25 bp, Mus musculus
ttgcagtcagtgtgtttcaactaac

SEQ ID NO: 950385 - DNA, 25 bp, Mus musculus
ttgcagtcattacacatgctattga

SEQ ID NO: 950386 - DNA, 25 bp, Mus musculus
ttgcagtcattagacatgctattga

SEQ ID NO: 950387 - DNA, 25 bp, Mus musculus
ttgcagtcatttctgtgagctaaca

SEQ ID NO: 950388 - DNA, 25 bp, Mus musculus
ttgcagtcatttgtgtgagctaaca

SEQ ID NO: 950389 - DNA, 25 bp, Mus musculus
ttgcagtcgagccttgtttactccg

SEQ ID NO: 950390 - DNA, 25 bp, Mus musculus
ttgcagtcgagcgttgtttactccg

SEQ ID NO: 950391 - DNA, 25 bp, Mus musculus
ttgcagtctcctacgagccagggaa

SEQ ID NO: 950392 - DNA, 25 bp, Mus musculus
ttgcagtctccttcgagccagggaa

SEQ ID NO: 950393 - DNA, 25 bp, Mus musculus
ttgcagtctgctccacagggagtgc

SEQ ID NO: 950394 - DNA, 25 bp, Mus musculus
ttgcagtctgctgcacagggagtgc

SEQ ID NO: 950395 - DNA, 25 bp, Mus musculus
ttgcagtctgggaggctattgtgta

SEQ ID NO: 950396 - DNA, 25 bp, Mus musculus
ttgcagtctgggtggctattgtgta

SEQ ID NO: 950397 - DNA, 25 bp, Mus musculus
ttgcagtctttccaagttgttagct

SEQ ID NO: 950398 - DNA, 25 bp, Mus musculus
ttgcagtctttcgaagttgttagct

SEQ ID NO: 950399 - DNA, 25 bp, Mus musculus
ttgcagtgagtacacacctgggtca

SEQ ID NO: 950400 - DNA, 25 bp, Mus musculus
ttgcagtgagtagacacctgggtca

SEQ ID NO: 950401 - DNA, 25 bp, Mus musculus
ttgcagtgcagaagatgtccttgtg

SEQ ID NO: 950402 - DNA, 25 bp, Mus musculus
ttgcagtgcagatgatgtccttgtg

SEQ ID NO: 950403 - DNA, 25 bp, Mus musculus
ttgcagtgttaactggccagttcat

SEQ ID NO: 950404 - DNA, 25 bp, Mus musculus
ttgcagtgttaagtggccagttcat

SEQ ID NO: 950405 - DNA, 25 bp, Mus musculus
ttgcagttaacgatcgtgtttggac

SEQ ID NO: 950406 - DNA, 25 bp, Mus musculus
ttgcagttaacgttcgtgtttggac

SEQ ID NO: 950407 - DNA, 25 bp, Mus musculus
ttgcagttcatcactgccacaggaa

SEQ ID NO: 950408 - DNA, 25 bp, Mus musculus
ttgcagttcatctctgccacaggaa

SEQ ID NO: 950409 - DNA, 25 bp, Mus musculus
ttgcagttccacataccagctatga

SEQ ID NO: 950410 - DNA, 25 bp, Mus musculus
ttgcagttccacttaccagctatga

SEQ ID NO: 950411 - DNA, 25 bp, Mus musculus
ttgcagttccagcacctgagaggta

SEQ ID NO: 950412 - DNA, 25 bp, Mus musculus
ttgcagttccaggacctgagaggta

SEQ ID NO: 950413 - DNA, 25 bp, Mus musculus
ttgcagttccttctgtcttaaaaaa

SEQ ID NO: 950414 - DNA, 25 bp, Mus musculus
ttgcagttccttgtgtcttaaaaaa

SEQ ID NO: 950415 - DNA, 25 bp, Mus musculus
ttgcagttctcacgaggccgggaca

SEQ ID NO: 950416 - DNA, 25 bp, Mus musculus
ttgcagttctcaggaggccgggaca

SEQ ID NO: 950417 - DNA, 25 bp, Mus musculus
ttgcagttctttccagacctctgcc

SEQ ID NO: 950418 - DNA, 25 bp, Mus musculus
ttgcagttctttgcagacctctgcc

SEQ ID NO: 950419 - DNA, 25 bp, Mus musculus
ttgcagttgacaatagtcccctcaa

SEQ ID NO: 950420 - DNA, 25 bp, Mus musculus
ttgcagttgacattagtcccctcaa

SEQ ID NO: 950421 - DNA, 25 bp, Mus musculus
ttgcagttgcgtagtggttaaggac

SEQ ID NO: 950422 - DNA, 25 bp, Mus musculus
ttgcagttgcgttgtggttaaggac

SEQ ID NO: 950423 - DNA, 25 bp, Mus musculus
ttgcagttgtaaagtaaaggaccct

SEQ ID NO: 950424 - DNA, 25 bp, Mus musculus
ttgcagttgtaatgtaaaggaccct

SEQ ID NO: 950425 - DNA, 25 bp, Mus musculus
ttgcagttgtcaaccagtccgactt

SEQ ID NO: 950426 - DNA, 25 bp, Mus musculus
ttgcagttgtcatccagtccgactt

SEQ ID NO: 950427 - DNA, 25 bp, Mus musculus
ttgcagtttctaatcgtttcgatat

SEQ ID NO: 950428 - DNA, 25 bp, Mus musculus
ttgcagtttctattcgtttcgatat

SEQ ID NO: 950429 - DNA, 25 bp, Mus musculus
ttgcagtttctgattacgagcttaa

SEQ ID NO: 950430 - DNA, 25 bp, Mus musculus
ttgcagtttctgtttacgagcttaa

SEQ ID NO: 950431 - DNA, 25 bp, Mus musculus
ttgcagtttcttctccagcccttgc

SEQ ID NO: 950432 - DNA, 25 bp, Mus musculus
ttgcagtttcttgtccagcccttgc

SEQ ID NO: 950433 - DNA, 25 bp, Mus musculus
ttgcagttttcccatgatgccacat

SEQ ID NO: 950434 - DNA, 25 bp, Mus musculus
ttgcagttttccgatgatgccacat

SEQ ID NO: 950435 - DNA, 25 bp, Mus musculus
ttgcagttttctattcaatacgacg

SEQ ID NO: 950436 - DNA, 25 bp, Mus musculus
ttgcagttttcttttcaatacgacg

SEQ ID NO: 950437 - DNA, 25 bp, Mus musculus
ttgcataaagccaaccacaccatga

SEQ ID NO: 950438 - DNA, 25 bp, Mus musculus
ttgcataaagcctaccacaccatga

SEQ ID NO: 950439 - DNA, 25 bp, Mus musculus
ttgcataagacccaggtttgcttcc

SEQ ID NO: 950440 - DNA, 25 bp, Mus musculus
ttgcataagaccgaggtttgcttcc

SEQ ID NO: 950441 - DNA, 25 bp, Mus musculus
ttgcataatcatcgaacgcacttta

SEQ ID NO: 950442 - DNA, 25 bp, Mus musculus
ttgcataatcatggaacgcacttta

SEQ ID NO: 950443 - DNA, 25 bp, Mus musculus
ttgcataattgcaggttacgtttat

SEQ ID NO: 950444 - DNA, 25 bp, Mus musculus
ttgcataattgctggttacgtttat

SEQ ID NO: 950445 - DNA, 25 bp, Mus musculus
ttgcatacacacacaggaaggccat

SEQ ID NO: 950446 - DNA, 25 bp, Mus musculus
ttgcatacacactcaggaaggccat

SEQ ID NO: 950447 - DNA, 25 bp, Mus musculus
ttgcatacacgaagtaaccagctgt

SEQ ID NO: 950448 - DNA, 25 bp, Mus musculus
ttgcatacacgatgtaaccagctgt

SEQ ID NO: 950449 - DNA, 25 bp, Mus musculus
ttgcatacagcaaccgaggacagct

SEQ ID NO: 950450 - DNA, 25 bp, Mus musculus
ttgcatacagcatccgaggacagct

SEQ ID NO: 950451 - DNA, 25 bp, Mus musculus
ttgcataccggtaatggcatcctct

SEQ ID NO: 950452 - DNA, 25 bp, Mus musculus
ttgcataccggttatggcatcctct

SEQ ID NO: 950453 - DNA, 25 bp, Mus musculus
ttgcatactgcaagtgcatacctag

SEQ ID NO: 950454 - DNA, 25 bp, Mus musculus
ttgcatactgcatgtgcatacctag

SEQ ID NO: 950455 - DNA, 25 bp, Mus musculus
ttgcatagacgtcatccagttcctc

SEQ ID NO: 950456 - DNA, 25 bp, Mus musculus
ttgcatagacgtgatccagttcctc

SEQ ID NO: 950457 - DNA, 25 bp, Mus musculus
ttgcatagcaagctcagctctgctt

SEQ ID NO: 950458 - DNA, 25 bp, Mus musculus
ttgcatagcaaggtcagctctgctt

SEQ ID NO: 950459 - DNA, 25 bp, Mus musculus
ttgcatagcaatacattctttcccc

SEQ ID NO: 950460 - DNA, 25 bp, Mus musculus
ttgcatagcaattcattctttcccc

SEQ ID NO: 950461 - DNA, 25 bp, Mus musculus
ttgcatagcaccactgacactttag

SEQ ID NO: 950462 - DNA, 25 bp, Mus musculus
ttgcatagcacctctgacactttag

SEQ ID NO: 950463 - DNA, 25 bp, Mus musculus
ttgcatagcttacgatcacactgaa

SEQ ID NO: 950464 - DNA, 25 bp, Mus musculus
ttgcatagcttaggatcacactgaa

SEQ ID NO: 950465 - DNA, 25 bp, Mus musculus
ttgcatataaccaaggccagcctta

SEQ ID NO: 950466 - DNA, 25 bp, Mus musculus
ttgcatataacctaggccagcctta

SEQ ID NO: 950467 - DNA, 25 bp, Mus musculus
ttgcatatactaatgtgctgccata

SEQ ID NO: 950468 - DNA, 25 bp, Mus musculus
ttgcatatactattgtgctgccata

SEQ ID NO: 950469 - DNA, 25 bp, Mus musculus
ttgcatatatagaccattgtttcac

SEQ ID NO: 950470 - DNA, 25 bp, Mus musculus
ttgcatatatagtccattgtttcac

SEQ ID NO: 950471 - DNA, 25 bp, Mus musculus
ttgcatatcaccactccgaactgta

SEQ ID NO: 950472 - DNA, 25 bp, Mus musculus
ttgcatatcacctctccgaactgta

SEQ ID NO: 950473 - DNA, 25 bp, Mus musculus
ttgcatatcgcaatcatttttccat

SEQ ID NO: 950474 - DNA, 25 bp, Mus musculus
ttgcatatcgcattcatttttccat

SEQ ID NO: 950475 - DNA, 25 bp, Mus musculus
ttgcatatctgtcccctcaggaagt

SEQ ID NO: 950476 - DNA, 25 bp, Mus musculus
ttgcatatctgtgccctcaggaagt

SEQ ID NO: 950477 - DNA, 25 bp, Mus musculus
ttgcatatcttcaaccaactcttac

SEQ ID NO: 950478 - DNA, 25 bp, Mus musculus
ttgcatatcttctaccaactcttac

SEQ ID NO: 950479 - DNA, 25 bp, Mus musculus
ttgcatatgcacattaaactttaac

SEQ ID NO: 950480 - DNA, 25 bp, Mus musculus
ttgcatatgcactttaaactttaac

SEQ ID NO: 950481 - DNA, 25 bp, Mus musculus
ttgcatatgcccaagaacagtcttt

SEQ ID NO: 950482 - DNA, 25 bp, Mus musculus
ttgcatatgccctagaacagtcttt

SEQ ID NO: 950483 - DNA, 25 bp, Mus musculus
ttgcatattaaccttctgtcaaatg

SEQ ID NO: 950484 - DNA, 25 bp, Mus musculus
ttgcatattaacgttctgtcaaatg

SEQ ID NO: 950485 - DNA, 25 bp, Mus musculus
ttgcatattcttacaccgttttgac

SEQ ID NO: 950486 - DNA, 25 bp, Mus musculus
ttgcatattctttcaccgttttgac

SEQ ID NO: 950487 - DNA, 25 bp, Mus musculus
ttgcatattgctcccatcttcaaag

SEQ ID NO: 950488 - DNA, 25 bp, Mus musculus
ttgcatattgctgccatcttcaaag

SEQ ID NO: 950489 - DNA, 25 bp, Mus musculus
ttgcatcaagatccacagagacctt

SEQ ID NO: 950490 - DNA, 25 bp, Mus musculus
ttgcatcaagatgcacagagacctt

SEQ ID NO: 950491 - DNA, 25 bp, Mus musculus
ttgcatcaagtgaagcccttgtgaa

SEQ ID NO: 950492 - DNA, 25 bp, Mus musculus
ttgcatcaagtgtagcccttgtgaa

SEQ ID NO: 950493 - DNA, 25 bp, Mus musculus
ttgcatcacattcaaccacatgggt

SEQ ID NO: 950494 - DNA, 25 bp, Mus musculus
ttgcatcacattgaaccacatgggt

SEQ ID NO: 950495 - DNA, 25 bp, Mus musculus
ttgcatcaccacctagtaacagttg

SEQ ID NO: 950496 - DNA, 25 bp, Mus musculus
ttgcatcaccacgtagtaacagttg

SEQ ID NO: 950497 - DNA, 25 bp, Mus musculus
ttgcatcatccacgcaatggtcctg

SEQ ID NO: 950498 - DNA, 25 bp, Mus musculus
ttgcatcatccaggcaatggtcctg

SEQ ID NO: 950499 - DNA, 25 bp, Mus musculus
ttgcatcatctcctctgttaacgtt

SEQ ID NO: 950500 - DNA, 25 bp, Mus musculus
ttgcatcatctcgtctgttaacgtt

SEQ ID NO: 950501 - DNA, 25 bp, Mus musculus
ttgcatcatgcaagtggtaccagct

SEQ ID NO: 950502 - DNA, 25 bp, Mus musculus
ttgcatcatgcatgtggtaccagct

SEQ ID NO: 950503 - DNA, 25 bp, Mus musculus
ttgcatcattctctaaaaccattat

SEQ ID NO: 950504 - DNA, 25 bp, Mus musculus
ttgcatcattctgtaaaaccattat

SEQ ID NO: 950505 - DNA, 25 bp, Mus musculus
ttgcatccaacgagagaccgacaga

SEQ ID NO: 950506 - DNA, 25 bp, Mus musculus
ttgcatccaacgcaggcagcattgc

SEQ ID NO: 950507 - DNA, 25 bp, Mus musculus
ttgcatccaacggaggcagcattgc

SEQ ID NO: 950508 - DNA, 25 bp, Mus musculus
ttgcatccaacgtgagaccgacaga

SEQ ID NO: 950509 - DNA, 25 bp, Mus musculus
ttgcatccagaacacccttcatcag

SEQ ID NO: 950510 - DNA, 25 bp, Mus musculus
ttgcatccagaagacccttcatcag

SEQ ID NO: 950511 - DNA, 25 bp, Mus musculus
ttgcatccagccaaaagcgccaaga

SEQ ID NO: 950512 - DNA, 25 bp, Mus musculus
ttgcatccagcctaaagcgccaaga

SEQ ID NO: 950513 - DNA, 25 bp, Mus musculus
ttgcatccagtacctgactgcactg

SEQ ID NO: 950514 - DNA, 25 bp, Mus musculus
ttgcatccagtagctgactgcactg

SEQ ID NO: 950515 - DNA, 25 bp, Mus musculus
ttgcatccataacagaaggaccggt

SEQ ID NO: 950516 - DNA, 25 bp, Mus musculus
ttgcatccataagagaaggaccggt

SEQ ID NO: 950517 - DNA, 25 bp, Mus musculus
ttgcatccatggatacagttttttg

SEQ ID NO: 950518 - DNA, 25 bp, Mus musculus
ttgcatccatggttacagttttttg

SEQ ID NO: 950519 - DNA, 25 bp, Mus musculus
ttgcatcccatcaggaaatagcagg

SEQ ID NO: 950520 - DNA, 25 bp, Mus musculus
ttgcatcccatctggaaatagcagg

SEQ ID NO: 950521 - DNA, 25 bp, Mus musculus
ttgcatcccattcccctcaataaag

SEQ ID NO: 950522 - DNA, 25 bp, Mus musculus
ttgcatcccattgccctcaataaag

SEQ ID NO: 950523 - DNA, 25 bp, Mus musculus
ttgcatccccggaccaagacagtgg

SEQ ID NO: 950524 - DNA, 25 bp, Mus musculus
ttgcatccccggtccaagacagtgg

SEQ ID NO: 950525 - DNA, 25 bp, Mus musculus
ttgcatcccggactgtacttcaaac

SEQ ID NO: 950526 - DNA, 25 bp, Mus musculus
ttgcatcccggagtgtacttcaaac

SEQ ID NO: 950527 - DNA, 25 bp, Mus musculus
ttgcatcccttcagactgcaaggga

SEQ ID NO: 950528 - DNA, 25 bp, Mus musculus
ttgcatcccttctgactgcaaggga

SEQ ID NO: 950529 - DNA, 25 bp, Mus musculus
ttgcatccggtacccctaacaaaga

SEQ ID NO: 950530 - DNA, 25 bp, Mus musculus
ttgcatccggtagccctaacaaaga

SEQ ID NO: 950531 - DNA, 25 bp, Mus musculus
ttgcatcgatatactggctcaagaa

SEQ ID NO: 950532 - DNA, 25 bp, Mus musculus
ttgcatcgatattctggctcaagaa

SEQ ID NO: 950533 - DNA, 25 bp, Mus musculus
ttgcatctaattcgctaaggttcta

SEQ ID NO: 950534 - DNA, 25 bp, Mus musculus
ttgcatctaattggctaaggttcta

SEQ ID NO: 950535 - DNA, 25 bp, Mus musculus
ttgcatctactcagtgacccagcta

SEQ ID NO: 950536 - DNA, 25 bp, Mus musculus
ttgcatctactctgtgacccagcta

SEQ ID NO: 950537 - DNA, 25 bp, Mus musculus
ttgcatctagtgaaagctggtagac

SEQ ID NO: 950538 - DNA, 25 bp, Mus musculus
ttgcatctagtgaccgccatctgtg

SEQ ID NO: 950539 - DNA, 25 bp, Mus musculus
ttgcatctagtgcaggctgatcctc

SEQ ID NO: 950540 - DNA, 25 bp, Mus musculus
ttgcatctagtggaggctgatcctc

SEQ ID NO: 950541 - DNA, 25 bp, Mus musculus
ttgcatctagtgtaagctggtagac

SEQ ID NO: 950542 - DNA, 25 bp, Mus musculus
ttgcatctagtgtccgccatctgtg

SEQ ID NO: 950543 - DNA, 25 bp, Mus musculus
ttgcatctcataaagtctacactag

SEQ ID NO: 950544 - DNA, 25 bp, Mus musculus
ttgcatctcatatagtctacactag

SEQ ID NO: 950545 - DNA, 25 bp, Mus musculus
ttgcatctcatgaccaagtcagaat

SEQ ID NO: 950546 - DNA, 25 bp, Mus musculus
ttgcatctcatgtccaagtcagaat

SEQ ID NO: 950547 - DNA, 25 bp, Mus musculus
ttgcatctccacaccagtattgtaa

SEQ ID NO: 950548 - DNA, 25 bp, Mus musculus
ttgcatctccactccagtattgtaa

SEQ ID NO: 950549 - DNA, 25 bp, Mus musculus
ttgcatctcctgatatacccagaat

SEQ ID NO: 950550 - DNA, 25 bp, Mus musculus
ttgcatctcctgttatacccagaat

SEQ ID NO: 950551 - DNA, 25 bp, Mus musculus
ttgcatctctgacctcattttccct

SEQ ID NO: 950552 - DNA, 25 bp, Mus musculus
ttgcatctctgagctcattttccct

SEQ ID NO: 950553 - DNA, 25 bp, Mus musculus
ttgcatctctgtatttcataggcca

SEQ ID NO: 950554 - DNA, 25 bp, Mus musculus
ttgcatctctgtttttcataggcca

SEQ ID NO: 950555 - DNA, 25 bp, Mus musculus
ttgcatctcttcattcttgaaacct

SEQ ID NO: 950556 - DNA, 25 bp, Mus musculus
ttgcatctcttctttcttgaaacct

SEQ ID NO: 950557 - DNA, 25 bp, Mus musculus
ttgcatctcttgataccctgtatgg

SEQ ID NO: 950558 - DNA, 25 bp, Mus musculus
ttgcatctcttgttaccctgtatgg

SEQ ID NO: 950559 - DNA, 25 bp, Mus musculus
ttgcatctggatcgagccatggcct

SEQ ID NO: 950560 - DNA, 25 bp, Mus musculus
ttgcatctggatggagccatggcct

SEQ ID NO: 950561 - DNA, 25 bp, Mus musculus
ttgcatctggtgctttctgggccaa

SEQ ID NO: 950562 - DNA, 25 bp, Mus musculus
ttgcatctggtggtttctgggccaa

SEQ ID NO: 950563 - DNA, 25 bp, Mus musculus
ttgcatctgtaaaacactgaacatt

SEQ ID NO: 950564 - DNA, 25 bp, Mus musculus
ttgcatctgtaatacactgaacatt

SEQ ID NO: 950565 - DNA, 25 bp, Mus musculus
ttgcatctgtaccattgacctgttt

SEQ ID NO: 950566 - DNA, 25 bp, Mus musculus
ttgcatctgtacgattgacctgttt

SEQ ID NO: 950567 - DNA, 25 bp, Mus musculus
ttgcatcttatcaggcatcaactcg

SEQ ID NO: 950568 - DNA, 25 bp, Mus musculus
ttgcatcttatctggcatcaactcg

SEQ ID NO: 950569 - DNA, 25 bp, Mus musculus
ttgcatcttcttatatgccctttcc

SEQ ID NO: 950570 - DNA, 25 bp, Mus musculus
ttgcatcttcttttatgccctttcc

SEQ ID NO: 950571 - DNA, 25 bp, Mus musculus
ttgcatcttggacgctgggcatcca

SEQ ID NO: 950572 - DNA, 25 bp, Mus musculus
ttgcatcttggaggctgggcatcca

SEQ ID NO: 950573 - DNA, 25 bp, Mus musculus
ttgcatctttagagatttgcctcta

SEQ ID NO: 950574 - DNA, 25 bp, Mus musculus
ttgcatctttagtgatttgcctcta

SEQ ID NO: 950575 - DNA, 25 bp, Mus musculus
ttgcatcttttccactcgggcacaa

SEQ ID NO: 950576 - DNA, 25 bp, Mus musculus
ttgcatcttttcgactcgggcacaa

SEQ ID NO: 950577 - DNA, 25 bp, Mus musculus
ttgcatgaaacaatcctcaggctat

SEQ ID NO: 950578 - DNA, 25 bp, Mus musculus
ttgcatgaaacattcctcaggctat

SEQ ID NO: 950579 - DNA, 25 bp, Mus musculus
ttgcatgaatgcacacgcctttggg

SEQ ID NO: 950580 - DNA, 25 bp, Mus musculus
ttgcatgaatgctcacgcctttggg

SEQ ID NO: 950581 - DNA, 25 bp, Mus musculus
ttgcatgagctcaatagcccctgat

SEQ ID NO: 950582 - DNA, 25 bp, Mus musculus
ttgcatgagctctatagcccctgat

SEQ ID NO: 950583 - DNA, 25 bp, Mus musculus
ttgcatgagtccctgtgtcgaaaga

SEQ ID NO: 950584 - DNA, 25 bp, Mus musculus
ttgcatgagtccgtgtgtcgaaaga

SEQ ID NO: 950585 - DNA, 25 bp, Mus musculus
ttgcatgcaaatcaccaccagtaag

SEQ ID NO: 950586 - DNA, 25 bp, Mus musculus
ttgcatgcaaatgaccaccagtaag

SEQ ID NO: 950587 - DNA, 25 bp, Mus musculus
ttgcatgcaccaatataaacaggag

SEQ ID NO: 950588 - DNA, 25 bp, Mus musculus
ttgcatgcaccattataaacaggag

SEQ ID NO: 950589 - DNA, 25 bp, Mus musculus
ttgcatgccatccaggagcagatca

SEQ ID NO: 950590 - DNA, 25 bp, Mus musculus
ttgcatgccatcgaggagcagatca

SEQ ID NO: 950591 - DNA, 25 bp, Mus musculus
ttgcatgccggcctggaagacaaaa

SEQ ID NO: 950592 - DNA, 25 bp, Mus musculus
ttgcatgccggcgtggaagacaaaa

SEQ ID NO: 950593 - DNA, 25 bp, Mus musculus
ttgcatgccttaataatcccatggg

SEQ ID NO: 950594 - DNA, 25 bp, Mus musculus
ttgcatgccttattaatcccatggg

SEQ ID NO: 950595 - DNA, 25 bp, Mus musculus
ttgcatgcgctcaactggccaggaa

SEQ ID NO: 950596 - DNA, 25 bp, Mus musculus
ttgcatgcgctctactggccaggaa

SEQ ID NO: 950597 - DNA, 25 bp, Mus musculus
ttgcatgctctcaggaatcctgtca

SEQ ID NO: 950598 - DNA, 25 bp, Mus musculus
ttgcatgctctctggaatcctgtca

SEQ ID NO: 950599 - DNA, 25 bp, Mus musculus
ttgcatgctgaaaaccaacttgaga

SEQ ID NO: 950600 - DNA, 25 bp, Mus musculus
ttgcatgctgaataccaacttgaga

SEQ ID NO: 950601 - DNA, 25 bp, Mus musculus
ttgcatgctgcacacatctaggaca

SEQ ID NO: 950602 - DNA, 25 bp, Mus musculus
ttgcatgctgcagacatctaggaca

SEQ ID NO: 950603 - DNA, 25 bp, Mus musculus
ttgcatgctgttatcagtgagccct

SEQ ID NO: 950604 - DNA, 25 bp, Mus musculus
ttgcatgctgttttcagtgagccct

SEQ ID NO: 950605 - DNA, 25 bp, Mus musculus
ttgcatggaagtacagggcggccac

SEQ ID NO: 950606 - DNA, 25 bp, Mus musculus
ttgcatggaagttcagggcggccac

SEQ ID NO: 950607 - DNA, 25 bp, Mus musculus
ttgcatggacacagattagctgaat

SEQ ID NO: 950608 - DNA, 25 bp, Mus musculus
ttgcatggacactgattagctgaat

SEQ ID NO: 950609 - DNA, 25 bp, Mus musculus
ttgcatggaccacaccgtgtctggg

SEQ ID NO: 950610 - DNA, 25 bp, Mus musculus
ttgcatggaccagaccgtgtctggg

SEQ ID NO: 950611 - DNA, 25 bp, Mus musculus
ttgcatggcagaccatccctcagag

SEQ ID NO: 950612 - DNA, 25 bp, Mus musculus
ttgcatggcagagcatccctcagag

SEQ ID NO: 950613 - DNA, 25 bp, Mus musculus
ttgcatggctgcacatttctcatcc

SEQ ID NO: 950614 - DNA, 25 bp, Mus musculus
ttgcatggctgctcatttctcatcc

SEQ ID NO: 950615 - DNA, 25 bp, Mus musculus
ttgcatgggatcactgccagtcaat

SEQ ID NO: 950616 - DNA, 25 bp, Mus musculus
ttgcatgggatctctgccagtcaat

SEQ ID NO: 950617 - DNA, 25 bp, Mus musculus
ttgcatgggcagaagttggactaaa

SEQ ID NO: 950618 - DNA, 25 bp, Mus musculus
ttgcatgggcagtagttggactaaa

SEQ ID NO: 950619 - DNA, 25 bp, Mus musculus
ttgcatgggttgatgcaggagcctt

SEQ ID NO: 950620 - DNA, 25 bp, Mus musculus
ttgcatgggttgttgcaggagcctt

SEQ ID NO: 950621 - DNA, 25 bp, Mus musculus
ttgcatggtgagaagccacagactt

SEQ ID NO: 950622 - DNA, 25 bp, Mus musculus
ttgcatggtgagtagccacagactt

SEQ ID NO: 950623 - DNA, 25 bp, Mus musculus
ttgcatggtttcatctaagatagct

SEQ ID NO: 950624 - DNA, 25 bp, Mus musculus
ttgcatggtttcttctaagatagct

SEQ ID NO: 950625 - DNA, 25 bp, Mus musculus
ttgcatggtttgaggtgtgactcct

SEQ ID NO: 950626 - DNA, 25 bp, Mus musculus
ttgcatggtttgtggtgtgactcct

SEQ ID NO: 950627 - DNA, 25 bp, Mus musculus
ttgcatgtaaataccatatgctgtt

SEQ ID NO: 950628 - DNA, 25 bp, Mus musculus
ttgcatgtaaattccatatgctgtt

SEQ ID NO: 950629 - DNA, 25 bp, Mus musculus
ttgcatgtactcctcaggctgccaa

SEQ ID NO: 950630 - DNA, 25 bp, Mus musculus
ttgcatgtactcgtcaggctgccaa

SEQ ID NO: 950631 - DNA, 25 bp, Mus musculus
ttgcatgtcacgcaacagacactgt

SEQ ID NO: 950632 - DNA, 25 bp, Mus musculus
ttgcatgtcacggaacagacactgt

SEQ ID NO: 950633 - DNA, 25 bp, Mus musculus
ttgcatgtccatcctgggaatggct

SEQ ID NO: 950634 - DNA, 25 bp, Mus musculus
ttgcatgtccatgctgggaatggct

SEQ ID NO: 950635 - DNA, 25 bp, Mus musculus
ttgcatgtccctctaacgttcgtag

SEQ ID NO: 950636 - DNA, 25 bp, Mus musculus
ttgcatgtccctgtaacgttcgtag

SEQ ID NO: 950637 - DNA, 25 bp, Mus musculus
ttgcatgtctctacacggaggtatt

SEQ ID NO: 950638 - DNA, 25 bp, Mus musculus
ttgcatgtctcttcacggaggtatt

SEQ ID NO: 950639 - DNA, 25 bp, Mus musculus
ttgcatgtctgacatgccgtgctga

SEQ ID NO: 950640 - DNA, 25 bp, Mus musculus
ttgcatgtctgagatgccgtgctga

SEQ ID NO: 950641 - DNA, 25 bp, Mus musculus
ttgcatgtgcaaacagacattgtgc

SEQ ID NO: 950642 - DNA, 25 bp, Mus musculus
ttgcatgtgcaatcagacattgtgc

SEQ ID NO: 950643 - DNA, 25 bp, Mus musculus
ttgcatgttttcatcgctgtggtgg

SEQ ID NO: 950644 - DNA, 25 bp, Mus musculus
ttgcatgttttcttcgctgtggtgg

SEQ ID NO: 950645 - DNA, 25 bp, Mus musculus
ttgcattagagcatacatacgggtt

SEQ ID NO: 950646 - DNA, 25 bp, Mus musculus
ttgcattagagcttacatacgggtt

SEQ ID NO: 950647 - DNA, 25 bp, Mus musculus
ttgcattagcccatgtgttgcctat

SEQ ID NO: 950648 - DNA, 25 bp, Mus musculus
ttgcattagcccttgtgttgcctat

SEQ ID NO: 950649 - DNA, 25 bp, Mus musculus
ttgcattagtccattatctctcgct

SEQ ID NO: 950650 - DNA, 25 bp, Mus musculus
ttgcattagtcctttatctctcgct

SEQ ID NO: 950651 - DNA, 25 bp, Mus musculus
ttgcattatcctatgtttacttctg

SEQ ID NO: 950652 - DNA, 25 bp, Mus musculus
ttgcattatcctttgtttacttctg

SEQ ID NO: 950653 - DNA, 25 bp, Mus musculus
ttgcattattgtcgacttggctgtc

SEQ ID NO: 950654 - DNA, 25 bp, Mus musculus
ttgcattattgtggacttggctgtc

SEQ ID NO: 950655 - DNA, 25 bp, Mus musculus
ttgcattcaattaactccctgtgga

SEQ ID NO: 950656 - DNA, 25 bp, Mus musculus
ttgcattcaatttactccctgtgga

SEQ ID NO: 950657 - DNA, 25 bp, Mus musculus
ttgcattcacatatctgcctgtctc

SEQ ID NO: 950658 - DNA, 25 bp, Mus musculus
ttgcattcacatttctgcctgtctc

SEQ ID NO: 950659 - DNA, 25 bp, Mus musculus
ttgcattcaccgagagcctaacatg

SEQ ID NO: 950660 - DNA, 25 bp, Mus musculus
ttgcattcaccgtgagcctaacatg

SEQ ID NO: 950661 - DNA, 25 bp, Mus musculus
ttgcattcagagactgatgcccctc

SEQ ID NO: 950662 - DNA, 25 bp, Mus musculus
ttgcattcagagtctgatgcccctc

SEQ ID NO: 950663 - DNA, 25 bp, Mus musculus
ttgcattcagcacggttcacaggct

SEQ ID NO: 950664 - DNA, 25 bp, Mus musculus
ttgcattcagcagggttcacaggct

SEQ ID NO: 950665 - DNA, 25 bp, Mus musculus
ttgcattcaggaatgtcttgcctcc

SEQ ID NO: 950666 - DNA, 25 bp, Mus musculus
ttgcattcaggattgtcttgcctcc

SEQ ID NO: 950667 - DNA, 25 bp, Mus musculus
ttgcattcatgcagactatgttcca

SEQ ID NO: 950668 - DNA, 25 bp, Mus musculus
ttgcattcatgctgactatgttcca

SEQ ID NO: 950669 - DNA, 25 bp, Mus musculus
ttgcattccggccagttaataaagt

SEQ ID NO: 950670 - DNA, 25 bp, Mus musculus
ttgcattccggcgagttaataaagt

SEQ ID NO: 950671 - DNA, 25 bp, Mus musculus
ttgcattcctaaccatatccttgat

SEQ ID NO: 950672 - DNA, 25 bp, Mus musculus
ttgcattcctaagcatatccttgat

SEQ ID NO: 950673 - DNA, 25 bp, Mus musculus
ttgcattgacttccccagtggtaga

SEQ ID NO: 950674 - DNA, 25 bp, Mus musculus
ttgcattgacttgcccagtggtaga

SEQ ID NO: 950675 - DNA, 25 bp, Mus musculus
ttgcattgagacaagctccatggct

SEQ ID NO: 950676 - DNA, 25 bp, Mus musculus
ttgcattgagactagctccatggct

SEQ ID NO: 950677 - DNA, 25 bp, Mus musculus
ttgcattgcaatagctctttccttc

SEQ ID NO: 950678 - DNA, 25 bp, Mus musculus
ttgcattgcaattgctctttccttc

SEQ ID NO: 950679 - DNA, 25 bp, Mus musculus
ttgcattgcattctggtcattttat

SEQ ID NO: 950680 - DNA, 25 bp, Mus musculus
ttgcattgcattgtggtcattttat

SEQ ID NO: 950681 - DNA, 25 bp, Mus musculus
ttgcattgccacaagctgtaggaag

SEQ ID NO: 950682 - DNA, 25 bp, Mus musculus
ttgcattgccactagctgtaggaag

SEQ ID NO: 950683 - DNA, 25 bp, Mus musculus
ttgcattgctttatagccccacatt

SEQ ID NO: 950684 - DNA, 25 bp, Mus musculus
ttgcattgctttttagccccacatt

SEQ ID NO: 950685 - DNA, 25 bp, Mus musculus
ttgcattgggacagggcacaactcc

SEQ ID NO: 950686 - DNA, 25 bp, Mus musculus
ttgcattgggactgggcacaactcc

SEQ ID NO: 950687 - DNA, 25 bp, Mus musculus
ttgcattgggataccaaggcgtgac

SEQ ID NO: 950688 - DNA, 25 bp, Mus musculus
ttgcattgggattccaaggcgtgac

SEQ ID NO: 950689 - DNA, 25 bp, Mus musculus
ttgcattggtccctcgacccaatct

SEQ ID NO: 950690 - DNA, 25 bp, Mus musculus
ttgcattggtccgtcgacccaatct

SEQ ID NO: 950691 - DNA, 25 bp, Mus musculus
ttgcattgtatgaggattggattgt

SEQ ID NO: 950692 - DNA, 25 bp, Mus musculus
ttgcattgtatgtggattggattgt

SEQ ID NO: 950693 - DNA, 25 bp, Mus musculus
ttgcattgtcgacccattttcgtgt

SEQ ID NO: 950694 - DNA, 25 bp, Mus musculus
ttgcattgtcgagccattttcgtgt

SEQ ID NO: 950695 - DNA, 25 bp, Mus musculus
ttgcattgtgttccatagtgagatg

SEQ ID NO: 950696 - DNA, 25 bp, Mus musculus
ttgcattgtgttgcatagtgagatg

SEQ ID NO: 950697 - DNA, 25 bp, Mus musculus
ttgcattgttgcagggatacctcga

SEQ ID NO: 950698 - DNA, 25 bp, Mus musculus
ttgcattgttgctgggatacctcga

SEQ ID NO: 950699 - DNA, 25 bp, Mus musculus
ttgcatttacgaatcagtccgggtt

SEQ ID NO: 950700 - DNA, 25 bp, Mus musculus
ttgcatttacgattcagtccgggtt

SEQ ID NO: 950701 - DNA, 25 bp, Mus musculus
ttgcatttcaaaagtttaacccttt

SEQ ID NO: 950702 - DNA, 25 bp, Mus musculus
ttgcatttcaaatgtttaacccttt

SEQ ID NO: 950703 - DNA, 25 bp, Mus musculus
ttgcatttcagacctgtctactcag

SEQ ID NO: 950704 - DNA, 25 bp, Mus musculus
ttgcatttcagagctgtctactcag

SEQ ID NO: 950705 - DNA, 25 bp, Mus musculus
ttgcatttcagtcaaactagtaaga

SEQ ID NO: 950706 - DNA, 25 bp, Mus musculus
ttgcatttcagtgaaactagtaaga

SEQ ID NO: 950707 - DNA, 25 bp, Mus musculus
ttgcatttcatcaaagtctttcatc

SEQ ID NO: 950708 - DNA, 25 bp, Mus musculus
ttgcatttcatctaagtctttcatc

SEQ ID NO: 950709 - DNA, 25 bp, Mus musculus
ttgcatttcatgcatctcccctgat

SEQ ID NO: 950710 - DNA, 25 bp, Mus musculus
ttgcatttcatggatctcccctgat

SEQ ID NO: 950711 - DNA, 25 bp, Mus musculus
ttgcatttccagcttctagggcctt

SEQ ID NO: 950712 - DNA, 25 bp, Mus musculus
ttgcatttccaggttctagggcctt

SEQ ID NO: 950713 - DNA, 25 bp, Mus musculus
ttgcatttcctgattgcacctcagc

SEQ ID NO: 950714 - DNA, 25 bp, Mus musculus
ttgcatttcctgtttgcacctcagc

SEQ ID NO: 950715 - DNA, 25 bp, Mus musculus
ttgcatttgcaaactcacgtttgtc

SEQ ID NO: 950716 - DNA, 25 bp, Mus musculus
ttgcatttgcaatctcacgtttgtc

SEQ ID NO: 950717 - DNA, 25 bp, Mus musculus
ttgcatttggctactgtgttgacag

SEQ ID NO: 950718 - DNA, 25 bp, Mus musculus
ttgcatttggcttctgtgttgacag

SEQ ID NO: 950719 - DNA, 25 bp, Mus musculus
ttgcattttcccagggttgaagatg

SEQ ID NO: 950720 - DNA, 25 bp, Mus musculus
ttgcattttccctgggttgaagatg

SEQ ID NO: 950721 - DNA, 25 bp, Mus musculus
ttgcattttcggcttgtttcttctt

SEQ ID NO: 950722 - DNA, 25 bp, Mus musculus
ttgcattttcgggttgtttcttctt

SEQ ID NO: 950723 - DNA, 25 bp, Mus musculus
ttgcattttcttaggctcagtggga

SEQ ID NO: 950724 - DNA, 25 bp, Mus musculus
ttgcattttctttggctcagtggga

SEQ ID NO: 950725 - DNA, 25 bp, Mus musculus
ttgcattttgccaaggtctcacgac

SEQ ID NO: 950726 - DNA, 25 bp, Mus musculus
ttgcattttgcctaggtctcacgac

SEQ ID NO: 950727 - DNA, 25 bp, Mus musculus
ttgcatttttataacctttcctgaa

SEQ ID NO: 950728 - DNA, 25 bp, Mus musculus
ttgcatttttattacctttcctgaa

SEQ ID NO: 950729 - DNA, 25 bp, Mus musculus
ttgcattttttcacagtaggacagg

SEQ ID NO: 950730 - DNA, 25 bp, Mus musculus
ttgcattttttctcagtaggacagg

SEQ ID NO: 950731 - DNA, 25 bp, Mus musculus
ttgccaaaaggaattctaaaccagt

SEQ ID NO: 950732 - DNA, 25 bp, Mus musculus
ttgccaaaaggatttctaaaccagt

SEQ ID NO: 950733 - DNA, 25 bp, Mus musculus
ttgccaaaatggagcatggcgaggc

SEQ ID NO: 950734 - DNA, 25 bp, Mus musculus
ttgccaaaatggtgcatggcgaggc

SEQ ID NO: 950735 - DNA, 25 bp, Mus musculus
ttgccaaacattaactgcccacgtg

SEQ ID NO: 950736 - DNA, 25 bp, Mus musculus
ttgccaaacatttactgcccacgtg

SEQ ID NO: 950737 - DNA, 25 bp, Mus musculus
ttgccaaactcactcctttttagaa

SEQ ID NO: 950738 - DNA, 25 bp, Mus musculus
ttgccaaactcagtcctttttagaa

SEQ ID NO: 950739 - DNA, 25 bp, Mus musculus
ttgccaaagatcacaacaaccactg

SEQ ID NO: 950740 - DNA, 25 bp, Mus musculus
ttgccaaagatctcaacaaccactg

SEQ ID NO: 950741 - DNA, 25 bp, Mus musculus
ttgccaaagcccactgtgtcttctc

SEQ ID NO: 950742 - DNA, 25 bp, Mus musculus
ttgccaaagccctctgtgtcttctc

SEQ ID NO: 950743 - DNA, 25 bp, Mus musculus
ttgccaaataagcgcctgctcctcg

SEQ ID NO: 950744 - DNA, 25 bp, Mus musculus
ttgccaaataagggcctgctcctcg

SEQ ID NO: 950745 - DNA, 25 bp, Mus musculus
ttgccaaatcccactgagcatttct

SEQ ID NO: 950746 - DNA, 25 bp, Mus musculus
ttgccaaatccctctgagcatttct

SEQ ID NO: 950747 - DNA, 25 bp, Mus musculus
ttgccaaatgtcagaacaggtacac

SEQ ID NO: 950748 - DNA, 25 bp, Mus musculus
ttgccaaatgtctgaacaggtacac

SEQ ID NO: 950749 - DNA, 25 bp, Mus musculus
ttgccaacaactctccagctttgag

SEQ ID NO: 950750 - DNA, 25 bp, Mus musculus
ttgccaacaactgtccagctttgag

SEQ ID NO: 950751 - DNA, 25 bp, Mus musculus
ttgccaacacacactaatttgatct

SEQ ID NO: 950752 - DNA, 25 bp, Mus musculus
ttgccaacacactctaatttgatct

SEQ ID NO: 950753 - DNA, 25 bp, Mus musculus
ttgccaacaggaaagtaagcatccg

SEQ ID NO: 950754 - DNA, 25 bp, Mus musculus
ttgccaacaggatagtaagcatccg

SEQ ID NO: 950755 - DNA, 25 bp, Mus musculus
ttgccaacaggtaactaaatggagt

SEQ ID NO: 950756 - DNA, 25 bp, Mus musculus
ttgccaacaggttactaaatggagt

SEQ ID NO: 950757 - DNA, 25 bp, Mus musculus
ttgccaaccaagaggactgtcttcc

SEQ ID NO: 950758 - DNA, 25 bp, Mus musculus
ttgccaaccaagtggactgtcttcc

SEQ ID NO: 950759 - DNA, 25 bp, Mus musculus
ttgccaaccaccagaagacacatta

SEQ ID NO: 950760 - DNA, 25 bp, Mus musculus
ttgccaaccacctgaagacacatta

SEQ ID NO: 950761 - DNA, 25 bp, Mus musculus
ttgccaaccactagactacgaggac

SEQ ID NO: 950762 - DNA, 25 bp, Mus musculus
ttgccaaccacttgactacgaggac

SEQ ID NO: 950763 - DNA, 25 bp, Mus musculus
ttgccaaccatcattcgaccctcta

SEQ ID NO: 950764 - DNA, 25 bp, Mus musculus
ttgccaaccatctttcgaccctcta

SEQ ID NO: 950765 - DNA, 25 bp, Mus musculus
ttgccaacccaaagctgagtgacct

SEQ ID NO: 950766 - DNA, 25 bp, Mus musculus
ttgccaacccaatgctgagtgacct

SEQ ID NO: 950767 - DNA, 25 bp, Mus musculus
ttgccaacctccagatgaccaagga

SEQ ID NO: 950768 - DNA, 25 bp, Mus musculus
ttgccaacctcctgatgaccaagga

SEQ ID NO: 950769 - DNA, 25 bp, Mus musculus
ttgccaaccttaagtcatgctgtgt

SEQ ID NO: 950770 - DNA, 25 bp, Mus musculus
ttgccaaccttatgtcatgctgtgt

SEQ ID NO: 950771 - DNA, 25 bp, Mus musculus
ttgccaacgccgcacatggaacaga

SEQ ID NO: 950772 - DNA, 25 bp, Mus musculus
ttgccaacgccggacatggaacaga

SEQ ID NO: 950773 - DNA, 25 bp, Mus musculus
ttgccaactaacaatacgatacagg

SEQ ID NO: 950774 - DNA, 25 bp, Mus musculus
ttgccaactaactatacgatacagg

SEQ ID NO: 950775 - DNA, 25 bp, Mus musculus
ttgccaactcagatgttagcccctg

SEQ ID NO: 950776 - DNA, 25 bp, Mus musculus
ttgccaactcagttgttagcccctg

SEQ ID NO: 950777 - DNA, 25 bp, Mus musculus
ttgccaactccaaatgctctgacta

SEQ ID NO: 950778 - DNA, 25 bp, Mus musculus
ttgccaactccatatgctctgacta

SEQ ID NO: 950779 - DNA, 25 bp, Mus musculus
ttgccaagaaacagaggaagccctt

SEQ ID NO: 950780 - DNA, 25 bp, Mus musculus
ttgccaagaaactgaggaagccctt

SEQ ID NO: 950781 - DNA, 25 bp, Mus musculus
ttgccaagaaagctgcaccttgaga

SEQ ID NO: 950782 - DNA, 25 bp, Mus musculus
ttgccaagaaaggtgcaccttgaga

SEQ ID NO: 950783 - DNA, 25 bp, Mus musculus
ttgccaagacaaaggatgatccctt

SEQ ID NO: 950784 - DNA, 25 bp, Mus musculus
ttgccaagacaatggatgatccctt

SEQ ID NO: 950785 - DNA, 25 bp, Mus musculus
ttgccaagacccacctgtgttcctt

SEQ ID NO: 950786 - DNA, 25 bp, Mus musculus
ttgccaagaccctcctgtgttcctt

SEQ ID NO: 950787 - DNA, 25 bp, Mus musculus
ttgccaagattaaatgctccagtat

SEQ ID NO: 950788 - DNA, 25 bp, Mus musculus
ttgccaagattatatgctccagtat

SEQ ID NO: 950789 - DNA, 25 bp, Mus musculus
ttgccaagcacaatgttaccttctg

SEQ ID NO: 950790 - DNA, 25 bp, Mus musculus
ttgccaagcacattgttaccttctg

SEQ ID NO: 950791 - DNA, 25 bp, Mus musculus
ttgccaagccaaagggaaaccaaaa

SEQ ID NO: 950792 - DNA, 25 bp, Mus musculus
ttgccaagccaatgggaaaccaaaa

SEQ ID NO: 950793 - DNA, 25 bp, Mus musculus
ttgccaagcctgcactggctagggt

SEQ ID NO: 950794 - DNA, 25 bp, Mus musculus
ttgccaagcctggactggctagggt

SEQ ID NO: 950795 - DNA, 25 bp, Mus musculus
ttgccaagctaactgttggagcagt

SEQ ID NO: 950796 - DNA, 25 bp, Mus musculus
ttgccaagctaagtgttggagcagt

SEQ ID NO: 950797 - DNA, 25 bp, Mus musculus
ttgccaaggtgccagagattccccg

SEQ ID NO: 950798 - DNA, 25 bp, Mus musculus
ttgccaaggtgcgagagattccccg

SEQ ID NO: 950799 - DNA, 25 bp, Mus musculus
ttgccaagtcctaagttgatagctt

SEQ ID NO: 950800 - DNA, 25 bp, Mus musculus
ttgccaagtccttagttgatagctt

SEQ ID NO: 950801 - DNA, 25 bp, Mus musculus
ttgccaagtggaagatcaaaaacaa

SEQ ID NO: 950802 - DNA, 25 bp, Mus musculus
ttgccaagtggatgatcaaaaacaa

SEQ ID NO: 950803 - DNA, 25 bp, Mus musculus
ttgccaagtgtcagcatggcttcct

SEQ ID NO: 950804 - DNA, 25 bp, Mus musculus
ttgccaagtgtctgcatggcttcct

SEQ ID NO: 950805 - DNA, 25 bp, Mus musculus
ttgccaagttgtcccgccgagaaag

SEQ ID NO: 950806 - DNA, 25 bp, Mus musculus
ttgccaagttgtgccgccgagaaag

SEQ ID NO: 950807 - DNA, 25 bp, Mus musculus
ttgccaataattccccacttatctg

SEQ ID NO: 950808 - DNA, 25 bp, Mus musculus
ttgccaataattgcccacttatctg

SEQ ID NO: 950809 - DNA, 25 bp, Mus musculus
ttgccaataggacgccatatcgcga

SEQ ID NO: 950810 - DNA, 25 bp, Mus musculus
ttgccaataggaggccatatcgcga

SEQ ID NO: 950811 - DNA, 25 bp, Mus musculus
ttgccaatatgccttctggaaccac

SEQ ID NO: 950812 - DNA, 25 bp, Mus musculus
ttgccaatatgcgttctggaaccac

SEQ ID NO: 950813 - DNA, 25 bp, Mus musculus
ttgccaatattcacctcctgtaaat

SEQ ID NO: 950814 - DNA, 25 bp, Mus musculus
ttgccaatattctcctcctgtaaat

SEQ ID NO: 950815 - DNA, 25 bp, Mus musculus
ttgccaatattgacagtcaacctca

SEQ ID NO: 950816 - DNA, 25 bp, Mus musculus
ttgccaatattgtcagtcaacctca

SEQ ID NO: 950817 - DNA, 25 bp, Mus musculus
ttgccaatcagactgcggctgagct

SEQ ID NO: 950818 - DNA, 25 bp, Mus musculus
ttgccaatcagagtgcggctgagct

SEQ ID NO: 950819 - DNA, 25 bp, Mus musculus
ttgccaatcatgagccaggttttat

SEQ ID NO: 950820 - DNA, 25 bp, Mus musculus
ttgccaatcatgtgccaggttttat

SEQ ID NO: 950821 - DNA, 25 bp, Mus musculus
ttgccaatccgcacctctgtcagag

SEQ ID NO: 950822 - DNA, 25 bp, Mus musculus
ttgccaatccgctcctctgtcagag

SEQ ID NO: 950823 - DNA, 25 bp, Mus musculus
ttgccaatccggaatctgcatcgac

SEQ ID NO: 950824 - DNA, 25 bp, Mus musculus
ttgccaatccggtatctgcatcgac

SEQ ID NO: 950825 - DNA, 25 bp, Mus musculus
ttgccaatctataactgagttccag

SEQ ID NO: 950826 - DNA, 25 bp, Mus musculus
ttgccaatctattactgagttccag

SEQ ID NO: 950827 - DNA, 25 bp, Mus musculus
ttgccaatgatgaattcaggttgtt

SEQ ID NO: 950828 - DNA, 25 bp, Mus musculus
ttgccaatgatgtattcaggttgtt

SEQ ID NO: 950829 - DNA, 25 bp, Mus musculus
ttgccaatgggcacctgggtgacca

SEQ ID NO: 950830 - DNA, 25 bp, Mus musculus
ttgccaatgggctcctgggtgacca

SEQ ID NO: 950831 - DNA, 25 bp, Mus musculus
ttgccaatggtcactgggctgctgc

SEQ ID NO: 950832 - DNA, 25 bp, Mus musculus
ttgccaatggtctctgggctgctgc

SEQ ID NO: 950833 - DNA, 25 bp, Mus musculus
ttgccaatgtacagtccttttattc

SEQ ID NO: 950834 - DNA, 25 bp, Mus musculus
ttgccaatgtactgtccttttattc

SEQ ID NO: 950835 - DNA, 25 bp, Mus musculus
ttgccaatgtccagctggccaaccg

SEQ ID NO: 950836 - DNA, 25 bp, Mus musculus
ttgccaatgtcctgctggccaaccg

SEQ ID NO: 950837 - DNA, 25 bp, Mus musculus
ttgccaattttgcttccctaggaat

SEQ ID NO: 950838 - DNA, 25 bp, Mus musculus
ttgccaattttggttccctaggaat

SEQ ID NO: 950839 - DNA, 25 bp, Mus musculus
ttgccacaaagtacattgctctcag

SEQ ID NO: 950840 - DNA, 25 bp, Mus musculus
ttgccacaaagttcattgctctcag

SEQ ID NO: 950841 - DNA, 25 bp, Mus musculus
ttgccacaacatactggctttgtat

SEQ ID NO: 950842 - DNA, 25 bp, Mus musculus
ttgccacaacattctggctttgtat

SEQ ID NO: 950843 - DNA, 25 bp, Mus musculus
ttgccacaaccaaatccgaaatgtc

SEQ ID NO: 950844 - DNA, 25 bp, Mus musculus
ttgccacaaccatatccgaaatgtc

SEQ ID NO: 950845 - DNA, 25 bp, Mus musculus
ttgccacacatccaaagagtcctag

SEQ ID NO: 950846 - DNA, 25 bp, Mus musculus
ttgccacacatcgaaagagtcctag

SEQ ID NO: 950847 - DNA, 25 bp, Mus musculus
ttgccacactctacgagggctacaa

SEQ ID NO: 950848 - DNA, 25 bp, Mus musculus
ttgccacactcttcgagggctacaa

SEQ ID NO: 950849 - DNA, 25 bp, Mus musculus
ttgccacactgtaggttgggcccag

SEQ ID NO: 950850 - DNA, 25 bp, Mus musculus
ttgccacactgttggttgggcccag

SEQ ID NO: 950851 - DNA, 25 bp, Mus musculus
ttgccacagaaacatgagagatgcc

SEQ ID NO: 950852 - DNA, 25 bp, Mus musculus
ttgccacagaaagatgagagatgcc

SEQ ID NO: 950853 - DNA, 25 bp, Mus musculus
ttgccacagccgcttttgttatcgc

SEQ ID NO: 950854 - DNA, 25 bp, Mus musculus
ttgccacagccggttttgttatcgc

SEQ ID NO: 950855 - DNA, 25 bp, Mus musculus
ttgccacagggactgtaccttaact

SEQ ID NO: 950856 - DNA, 25 bp, Mus musculus
ttgccacagggagtgtaccttaact

SEQ ID NO: 950857 - DNA, 25 bp, Mus musculus
ttgccacatataatgtctccactat

SEQ ID NO: 950858 - DNA, 25 bp, Mus musculus
ttgccacatatattgtctccactat

SEQ ID NO: 950859 - DNA, 25 bp, Mus musculus
ttgccacatcgcattgcattgtcaa

SEQ ID NO: 950860 - DNA, 25 bp, Mus musculus
ttgccacatcgctttgcattgtcaa

SEQ ID NO: 950861 - DNA, 25 bp, Mus musculus
ttgccacatctcagggaatgaacct

SEQ ID NO: 950862 - DNA, 25 bp, Mus musculus
ttgccacatctctgggaatgaacct

SEQ ID NO: 950863 - DNA, 25 bp, Mus musculus
ttgccacatctgatatcccatagct

SEQ ID NO: 950864 - DNA, 25 bp, Mus musculus
ttgccacatctgttatcccatagct

SEQ ID NO: 950865 - DNA, 25 bp, Mus musculus
ttgccacatcttaggctatctttgt

SEQ ID NO: 950866 - DNA, 25 bp, Mus musculus
ttgccacatctttggctatctttgt

SEQ ID NO: 950867 - DNA, 25 bp, Mus musculus
ttgccacatgggacccaaatggctg

SEQ ID NO: 950868 - DNA, 25 bp, Mus musculus
ttgccacatgggtcccaaatggctg

SEQ ID NO: 950869 - DNA, 25 bp, Mus musculus
ttgccacatgtactgctcttcgaga

SEQ ID NO: 950870 - DNA, 25 bp, Mus musculus
ttgccacatgtagtgctcttcgaga

SEQ ID NO: 950871 - DNA, 25 bp, Mus musculus
ttgccaccaagtccagatgacctga

SEQ ID NO: 950872 - DNA, 25 bp, Mus musculus
ttgccaccaagtgcagatgacctga

SEQ ID NO: 950873 - DNA, 25 bp, Mus musculus
ttgccaccaataccttttcctaaca

SEQ ID NO: 950874 - DNA, 25 bp, Mus musculus
ttgccaccaatagcttttcctaaca

SEQ ID NO: 950875 - DNA, 25 bp, Mus musculus
ttgccaccagctctatttcatttca

SEQ ID NO: 950876 - DNA, 25 bp, Mus musculus
ttgccaccagctgtatttcatttca

SEQ ID NO: 950877 - DNA, 25 bp, Mus musculus
ttgccaccaggtctgacgaatacat

SEQ ID NO: 950878 - DNA, 25 bp, Mus musculus
ttgccaccaggtgtgacgaatacat

SEQ ID NO: 950879 - DNA, 25 bp, Mus musculus
ttgccaccattaccaatcatactag

SEQ ID NO: 950880 - DNA, 25 bp, Mus musculus
ttgccaccattagcaatcatactag

SEQ ID NO: 950881 - DNA, 25 bp, Mus musculus
ttgccaccattgcagaatcaagcat

SEQ ID NO: 950882 - DNA, 25 bp, Mus musculus
ttgccaccattggagaatcaagcat

SEQ ID NO: 950883 - DNA, 25 bp, Mus musculus
ttgccacccacacgacactgaagtg

SEQ ID NO: 950884 - DNA, 25 bp, Mus musculus
ttgccacccacaggacactgaagtg

SEQ ID NO: 950885 - DNA, 25 bp, Mus musculus
ttgccacccagtatatggattcagg

SEQ ID NO: 950886 - DNA, 25 bp, Mus musculus
ttgccacccagtttatggattcagg

SEQ ID NO: 950887 - DNA, 25 bp, Mus musculus
ttgccaccccaaatttctaacgata

SEQ ID NO: 950888 - DNA, 25 bp, Mus musculus
ttgccaccccaattttctaacgata

SEQ ID NO: 950889 - DNA, 25 bp, Mus musculus
ttgccaccccgaacacactgatgtg

SEQ ID NO: 950890 - DNA, 25 bp, Mus musculus
ttgccaccccgatcacactgatgtg

SEQ ID NO: 950891 - DNA, 25 bp, Mus musculus
ttgccaccccggagtgctacagaga

SEQ ID NO: 950892 - DNA, 25 bp, Mus musculus
ttgccaccccggtgtgctacagaga

SEQ ID NO: 950893 - DNA, 25 bp, Mus musculus
ttgccacccgggacaatcaggacaa

SEQ ID NO: 950894 - DNA, 25 bp, Mus musculus
ttgccacccgggtcaatcaggacaa

SEQ ID NO: 950895 - DNA, 25 bp, Mus musculus
ttgccaccgcgtagtgagtcaggat

SEQ ID NO: 950896 - DNA, 25 bp, Mus musculus
ttgccaccgcgttgtgagtcaggat

SEQ ID NO: 950897 - DNA, 25 bp, Mus musculus
ttgccaccgtccatatttacagtat

SEQ ID NO: 950898 - DNA, 25 bp, Mus musculus
ttgccaccgtccttatttacagtat

SEQ ID NO: 950899 - DNA, 25 bp, Mus musculus
ttgccacctacacctagaatgaagt

SEQ ID NO: 950900 - DNA, 25 bp, Mus musculus
ttgccacctacagctagaatgaagt

SEQ ID NO: 950901 - DNA, 25 bp, Mus musculus
ttgccacctcaaacttgttcagtat

SEQ ID NO: 950902 - DNA, 25 bp, Mus musculus
ttgccacctcaatcttgttcagtat

SEQ ID NO: 950903 - DNA, 25 bp, Mus musculus
ttgccaccttgcattttaacgcctt

SEQ ID NO: 950904 - DNA, 25 bp, Mus musculus
ttgccaccttgctttttaacgcctt

SEQ ID NO: 950905 - DNA, 25 bp, Mus musculus
ttgccacgatatcaagatccacttt

SEQ ID NO: 950906 - DNA, 25 bp, Mus musculus
ttgccacgatatgaagatccacttt

SEQ ID NO: 950907 - DNA, 25 bp, Mus musculus
ttgccacgatcaaggacctccggga

SEQ ID NO: 950908 - DNA, 25 bp, Mus musculus
ttgccacgatcatggacctccggga

SEQ ID NO: 950909 - DNA, 25 bp, Mus musculus
ttgccacgccaaaccaattcaataa

SEQ ID NO: 950910 - DNA, 25 bp, Mus musculus
ttgccacgccaatccaattcaataa

SEQ ID NO: 950911 - DNA, 25 bp, Mus musculus
ttgccacggccgcaggtaaataaac

SEQ ID NO: 950912 - DNA, 25 bp, Mus musculus
ttgccacggccggaggtaaataaac

SEQ ID NO: 950913 - DNA, 25 bp, Mus musculus
ttgccacgttttcctatattcatac

SEQ ID NO: 950914 - DNA, 25 bp, Mus musculus
ttgccacgttttgctatattcatac

SEQ ID NO: 950915 - DNA, 25 bp, Mus musculus
ttgccactatgaaatctttctttgt

SEQ ID NO: 950916 - DNA, 25 bp, Mus musculus
ttgccactatgaccaaacgcacagt

SEQ ID NO: 950917 - DNA, 25 bp, Mus musculus
ttgccactatgagcaaacgcacagt

SEQ ID NO: 950918 - DNA, 25 bp, Mus musculus
ttgccactatgatatctttctttgt

SEQ ID NO: 950919 - DNA, 25 bp, Mus musculus
ttgccactcaatccctgggattcca

SEQ ID NO: 950920 - DNA, 25 bp, Mus musculus
ttgccactcaatgcctgggattcca

SEQ ID NO: 950921 - DNA, 25 bp, Mus musculus
ttgccactcattcttacccagatct

SEQ ID NO: 950922 - DNA, 25 bp, Mus musculus
ttgccactcattgttacccagatct

SEQ ID NO: 950923 - DNA, 25 bp, Mus musculus
ttgccactccaaaccaaggttgctg

SEQ ID NO: 950924 - DNA, 25 bp, Mus musculus
ttgccactccaatccaaggttgctg

SEQ ID NO: 950925 - DNA, 25 bp, Mus musculus
ttgccactcctaagttcccgaaagc

SEQ ID NO: 950926 - DNA, 25 bp, Mus musculus
ttgccactcctatgttcccgaaagc

SEQ ID NO: 950927 - DNA, 25 bp, Mus musculus
ttgccactcctgagagtcttactga

SEQ ID NO: 950928 - DNA, 25 bp, Mus musculus
ttgccactcctgtgagtcttactga

SEQ ID NO: 950929 - DNA, 25 bp, Mus musculus
ttgccactcgtgaaggagttactaa

SEQ ID NO: 950930 - DNA, 25 bp, Mus musculus
ttgccactcgtgtaggagttactaa

SEQ ID NO: 950931 - DNA, 25 bp, Mus musculus
ttgccactctgcaatgagccaagca

SEQ ID NO: 950932 - DNA, 25 bp, Mus musculus
ttgccactctgctatgagccaagca

SEQ ID NO: 950933 - DNA, 25 bp, Mus musculus
ttgccactgaacctctgtattctca

SEQ ID NO: 950934 - DNA, 25 bp, Mus musculus
ttgccactgaacgtctgtattctca

SEQ ID NO: 950935 - DNA, 25 bp, Mus musculus
ttgccactgcacacactttgtaggt

SEQ ID NO: 950936 - DNA, 25 bp, Mus musculus
ttgccactgcactcactttgtaggt

SEQ ID NO: 950937 - DNA, 25 bp, Mus musculus
ttgccactggctcagactattctga

SEQ ID NO: 950938 - DNA, 25 bp, Mus musculus
ttgccactggctgagactattctga

SEQ ID NO: 950939 - DNA, 25 bp, Mus musculus
ttgccactggtgattatgctttagg

SEQ ID NO: 950940 - DNA, 25 bp, Mus musculus
ttgccactggtgctattaacaacag

SEQ ID NO: 950941 - DNA, 25 bp, Mus musculus
ttgccactggtggtattaacaacag

SEQ ID NO: 950942 - DNA, 25 bp, Mus musculus
ttgccactggtgtttatgctttagg

SEQ ID NO: 950943 - DNA, 25 bp, Mus musculus
ttgccacttatacacccaatcgtat

SEQ ID NO: 950944 - DNA, 25 bp, Mus musculus
ttgccacttatagacccaatcgtat

SEQ ID NO: 950945 - DNA, 25 bp, Mus musculus
ttgccacttccacaactgctttttg

SEQ ID NO: 950946 - DNA, 25 bp, Mus musculus
ttgccacttccagaactgctttttg

SEQ ID NO: 950947 - DNA, 25 bp, Mus musculus
ttgccactttatctgctttcagtct

SEQ ID NO: 950948 - DNA, 25 bp, Mus musculus
ttgccactttatgtgctttcagtct

SEQ ID NO: 950949 - DNA, 25 bp, Mus musculus
ttgccagaactacaatcgggcttca

SEQ ID NO: 950950 - DNA, 25 bp, Mus musculus
ttgccagaactagaatcgggcttca

SEQ ID NO: 950951 - DNA, 25 bp, Mus musculus
ttgccagaactgaaaatctgaggag

SEQ ID NO: 950952 - DNA, 25 bp, Mus musculus
ttgccagaactgatagggaacctca

SEQ ID NO: 950953 - DNA, 25 bp, Mus musculus
ttgccagaactgtaaatctgaggag

SEQ ID NO: 950954 - DNA, 25 bp, Mus musculus
ttgccagaactgttagggaacctca

SEQ ID NO: 950955 - DNA, 25 bp, Mus musculus
ttgccagaagagctccagacagctc

SEQ ID NO: 950956 - DNA, 25 bp, Mus musculus
ttgccagaagaggtccagacagctc

SEQ ID NO: 950957 - DNA, 25 bp, Mus musculus
ttgccagaatatcccacggcgagtt

SEQ ID NO: 950958 - DNA, 25 bp, Mus musculus
ttgccagaatatgccacggcgagtt

SEQ ID NO: 950959 - DNA, 25 bp, Mus musculus
ttgccagaattaaccagaccagaat

SEQ ID NO: 950960 - DNA, 25 bp, Mus musculus
ttgccagaattatccagaccagaat

SEQ ID NO: 950961 - DNA, 25 bp, Mus musculus
ttgccagacatcacgcccaaatagg

SEQ ID NO: 950962 - DNA, 25 bp, Mus musculus
ttgccagacatctcgcccaaatagg

SEQ ID NO: 950963 - DNA, 25 bp, Mus musculus
ttgccagactacatgagccatctca

SEQ ID NO: 950964 - DNA, 25 bp, Mus musculus
ttgccagactacttgagccatctca

SEQ ID NO: 950965 - DNA, 25 bp, Mus musculus
ttgccagacttaaacctcgaatgtg

SEQ ID NO: 950966 - DNA, 25 bp, Mus musculus
ttgccagacttatacctcgaatgtg

SEQ ID NO: 950967 - DNA, 25 bp, Mus musculus
ttgccagagaacctgtcttgtgtgc

SEQ ID NO: 950968 - DNA, 25 bp, Mus musculus
ttgccagagaacgtgtcttgtgtgc

SEQ ID NO: 950969 - DNA, 25 bp, Mus musculus
ttgccagagagcatggctggttctc

SEQ ID NO: 950970 - DNA, 25 bp, Mus musculus
ttgccagagagcttggctggttctc

SEQ ID NO: 950971 - DNA, 25 bp, Mus musculus
ttgccagagattccctagcatgcat

SEQ ID NO: 950972 - DNA, 25 bp, Mus musculus
ttgccagagattgcctagcatgcat

SEQ ID NO: 950973 - DNA, 25 bp, Mus musculus
ttgccagaggccattgccattgtgt

SEQ ID NO: 950974 - DNA, 25 bp, Mus musculus
ttgccagaggcctttgccattgtgt

SEQ ID NO: 950975 - DNA, 25 bp, Mus musculus
ttgccagaggctacacaagaagatt

SEQ ID NO: 950976 - DNA, 25 bp, Mus musculus
ttgccagaggcttcacaagaagatt

SEQ ID NO: 950977 - DNA, 25 bp, Mus musculus
ttgccagataccactattgacattg

SEQ ID NO: 950978 - DNA, 25 bp, Mus musculus
ttgccagatacctctattgacattg

SEQ ID NO: 950979 - DNA, 25 bp, Mus musculus
ttgccagcaaagacgcgggcctcag

SEQ ID NO: 950980 - DNA, 25 bp, Mus musculus
ttgccagcaaagtcgcgggcctcag

SEQ ID NO: 950981 - DNA, 25 bp, Mus musculus
ttgccagcaactacctgaacttcct

SEQ ID NO: 950982 - DNA, 25 bp, Mus musculus
ttgccagcaacttcctgaacttcct

SEQ ID NO: 950983 - DNA, 25 bp, Mus musculus
ttgccagcaatacaacttgccacat

SEQ ID NO: 950984 - DNA, 25 bp, Mus musculus
ttgccagcaatagaacttgccacat

SEQ ID NO: 950985 - DNA, 25 bp, Mus musculus
ttgccagcagtcacgggatgtatat

SEQ ID NO: 950986 - DNA, 25 bp, Mus musculus
ttgccagcagtctcgggatgtatat

SEQ ID NO: 950987 - DNA, 25 bp, Mus musculus
ttgccagcatctaaccaaaattccc

SEQ ID NO: 950988 - DNA, 25 bp, Mus musculus
ttgccagcatcttaccaaaattccc

SEQ ID NO: 950989 - DNA, 25 bp, Mus musculus
ttgccagcattaataagactcatcc

SEQ ID NO: 950990 - DNA, 25 bp, Mus musculus
ttgccagcattattaagactcatcc

SEQ ID NO: 950991 - DNA, 25 bp, Mus musculus
ttgccagcccctacaagcaataggg

SEQ ID NO: 950992 - DNA, 25 bp, Mus musculus
ttgccagccccttcaagcaataggg

SEQ ID NO: 950993 - DNA, 25 bp, Mus musculus
ttgccagccctgaatgcctgtcata

SEQ ID NO: 950994 - DNA, 25 bp, Mus musculus
ttgccagccctgtatgcctgtcata

SEQ ID NO: 950995 - DNA, 25 bp, Mus musculus
ttgccagcctctcccagacatcaag

SEQ ID NO: 950996 - DNA, 25 bp, Mus musculus
ttgccagcctctctactgttaagac

SEQ ID NO: 950997 - DNA, 25 bp, Mus musculus
ttgccagcctctgccagacatcaag

SEQ ID NO: 950998 - DNA, 25 bp, Mus musculus
ttgccagcctctgtactgttaagac

SEQ ID NO: 950999 - DNA, 25 bp, Mus musculus
ttgccagcctgtatacctctatgga

SEQ ID NO: 951000 - DNA, 25 bp, Mus musculus
ttgccagcctgtattaaagccctaa

SEQ ID NO: 951001 - DNA, 25 bp, Mus musculus
ttgccagcctgtttacctctatgga

SEQ ID NO: 951002 - DNA, 25 bp, Mus musculus
ttgccagcctgttttaaagccctaa

SEQ ID NO: 951003 - DNA, 25 bp, Mus musculus
ttgccagcgcaacgagaaccctaat

SEQ ID NO: 951004 - DNA, 25 bp, Mus musculus
ttgccagcgcaaggagaaccctaat

SEQ ID NO: 951005 - DNA, 25 bp, Mus musculus
ttgccagcgtgtctgtggtatgctc

SEQ ID NO: 951006 - DNA, 25 bp, Mus musculus
ttgccagcgtgtgtgtggtatgctc

SEQ ID NO: 951007 - DNA, 25 bp, Mus musculus
ttgccagctaaaaccatgacagtgt

SEQ ID NO: 951008 - DNA, 25 bp, Mus musculus
ttgccagctaaatccatgacagtgt

SEQ ID NO: 951009 - DNA, 25 bp, Mus musculus
ttgccagctggtacccgctagggag

SEQ ID NO: 951010 - DNA, 25 bp, Mus musculus
ttgccagctggttcccgctagggag

SEQ ID NO: 951011 - DNA, 25 bp, Mus musculus
ttgccagctgtgagtctatgttgta

SEQ ID NO: 951012 - DNA, 25 bp, Mus musculus
ttgccagctgtgtgtctatgttgta

SEQ ID NO: 951013 - DNA, 25 bp, Mus musculus
ttgccagctttgaaccctgtggtat

SEQ ID NO: 951014 - DNA, 25 bp, Mus musculus
ttgccagctttgtaccctgtggtat

SEQ ID NO: 951015 - DNA, 25 bp, Mus musculus
ttgccaggaacacaagtgtttcttc

SEQ ID NO: 951016 - DNA, 25 bp, Mus musculus
ttgccaggaacagaagtgtttcttc

SEQ ID NO: 951017 - DNA, 25 bp, Mus musculus
ttgccaggaaccagacttcatgctt

SEQ ID NO: 951018 - DNA, 25 bp, Mus musculus
ttgccaggaacctgacttcatgctt

SEQ ID NO: 951019 - DNA, 25 bp, Mus musculus
ttgccaggactaattttgttgtttc

SEQ ID NO: 951020 - DNA, 25 bp, Mus musculus
ttgccaggactatttttgttgtttc

SEQ ID NO: 951021 - DNA, 25 bp, Mus musculus
ttgccaggccaccatgttctttgat

SEQ ID NO: 951022 - DNA, 25 bp, Mus musculus
ttgccaggccacgatgttctttgat

SEQ ID NO: 951023 - DNA, 25 bp, Mus musculus
ttgccaggcgagcttcagagtccca

SEQ ID NO: 951024 - DNA, 25 bp, Mus musculus
ttgccaggcgaggttcagagtccca

SEQ ID NO: 951025 - DNA, 25 bp, Mus musculus
ttgccagggaacactcattgggcca

SEQ ID NO: 951026 - DNA, 25 bp, Mus musculus
ttgccagggaactctcattgggcca

SEQ ID NO: 951027 - DNA, 25 bp, Mus musculus
ttgccaggtcaacaaggactgcttg

SEQ ID NO: 951028 - DNA, 25 bp, Mus musculus
ttgccaggtcaagaaggactgcttg

SEQ ID NO: 951029 - DNA, 25 bp, Mus musculus
ttgccaggtcttaagcagtgtctga

SEQ ID NO: 951030 - DNA, 25 bp, Mus musculus
ttgccaggtctttagcagtgtctga

SEQ ID NO: 951031 - DNA, 25 bp, Mus musculus
ttgccaggtttgaaacggctttaat

SEQ ID NO: 951032 - DNA, 25 bp, Mus musculus
ttgccaggtttgtaacggctttaat

SEQ ID NO: 951033 - DNA, 25 bp, Mus musculus
ttgccagtatcacacatttctcaga

SEQ ID NO: 951034 - DNA, 25 bp, Mus musculus
ttgccagtatcagacatttctcaga

SEQ ID NO: 951035 - DNA, 25 bp, Mus musculus
ttgccagtcactaaggtccctgata

SEQ ID NO: 951036 - DNA, 25 bp, Mus musculus
ttgccagtcacttaggtccctgata

SEQ ID NO: 951037 - DNA, 25 bp, Mus musculus
ttgccagtcagtccatcccagcata

SEQ ID NO: 951038 - DNA, 25 bp, Mus musculus
ttgccagtcagtgcatcccagcata

SEQ ID NO: 951039 - DNA, 25 bp, Mus musculus
ttgccagtcggcaactgtgaaacca

SEQ ID NO: 951040 - DNA, 25 bp, Mus musculus
ttgccagtcggctactgtgaaacca

SEQ ID NO: 951041 - DNA, 25 bp, Mus musculus
ttgccagtcggtcgagcccaggttt

SEQ ID NO: 951042 - DNA, 25 bp, Mus musculus
ttgccagtcggtggagcccaggttt

SEQ ID NO: 951043 - DNA, 25 bp, Mus musculus
ttgccagtgcacaaatctcttggag

SEQ ID NO: 951044 - DNA, 25 bp, Mus musculus
ttgccagtgcactaatctcttggag

SEQ ID NO: 951045 - DNA, 25 bp, Mus musculus
ttgccagtgttaaaccattctccgc

SEQ ID NO: 951046 - DNA, 25 bp, Mus musculus
ttgccagtgttataccattctccgc

SEQ ID NO: 951047 - DNA, 25 bp, Mus musculus
ttgccagttaccaagtgatactgaa

SEQ ID NO: 951048 - DNA, 25 bp, Mus musculus
ttgccagttacctagtgatactgaa

SEQ ID NO: 951049 - DNA, 25 bp, Mus musculus
ttgccagtttacaagtgagccccat

SEQ ID NO: 951050 - DNA, 25 bp, Mus musculus
ttgccagtttactagtgagccccat

SEQ ID NO: 951051 - DNA, 25 bp, Mus musculus
ttgccagttttgacattcatacttt

SEQ ID NO: 951052 - DNA, 25 bp, Mus musculus
ttgccagttttgtcattcatacttt

SEQ ID NO: 951053 - DNA, 25 bp, Mus musculus
ttgccataacaaattccgttttaat

SEQ ID NO: 951054 - DNA, 25 bp, Mus musculus
ttgccataacaatttccgttttaat

SEQ ID NO: 951055 - DNA, 25 bp, Mus musculus
ttgccataatacagcattaccctca

SEQ ID NO: 951056 - DNA, 25 bp, Mus musculus
ttgccataatactgcattaccctca

SEQ ID NO: 951057 - DNA, 25 bp, Mus musculus
ttgccataatggacttgcccttgaa

SEQ ID NO: 951058 - DNA, 25 bp, Mus musculus
ttgccataatggtcttgcccttgaa

SEQ ID NO: 951059 - DNA, 25 bp, Mus musculus
ttgccatacctgcttgcctgttgcc

SEQ ID NO: 951060 - DNA, 25 bp, Mus musculus
ttgccatacctggttgcctgttgcc

SEQ ID NO: 951061 - DNA, 25 bp, Mus musculus
ttgccatacttgaggtggtttcacc

SEQ ID NO: 951062 - DNA, 25 bp, Mus musculus
ttgccatacttgtggtggtttcacc

SEQ ID NO: 951063 - DNA, 25 bp, Mus musculus
ttgccatagacacgcttattcaccc

SEQ ID NO: 951064 - DNA, 25 bp, Mus musculus
ttgccatagacaggcttattcaccc

SEQ ID NO: 951065 - DNA, 25 bp, Mus musculus
ttgccatagagcctgtgaacgtctt

SEQ ID NO: 951066 - DNA, 25 bp, Mus musculus
ttgccatagagcgtgtgaacgtctt

SEQ ID NO: 951067 - DNA, 25 bp, Mus musculus
ttgccatagctcctgggtgccagaa

SEQ ID NO: 951068 - DNA, 25 bp, Mus musculus
ttgccatagctcgtgggtgccagaa

SEQ ID NO: 951069 - DNA, 25 bp, Mus musculus
ttgccataggtgctacatgacagtt

SEQ ID NO: 951070 - DNA, 25 bp, Mus musculus
ttgccataggtggtacatgacagtt

SEQ ID NO: 951071 - DNA, 25 bp, Mus musculus
ttgccatagtaaccatgtgactgac

SEQ ID NO: 951072 - DNA, 25 bp, Mus musculus
ttgccatagtaagcatgtgactgac

SEQ ID NO: 951073 - DNA, 25 bp, Mus musculus
ttgccatagtatctgatcctgtata

SEQ ID NO: 951074 - DNA, 25 bp, Mus musculus
ttgccatagtatgtgatcctgtata

SEQ ID NO: 951075 - DNA, 25 bp, Mus musculus
ttgccatattttatcaggtttgtta

SEQ ID NO: 951076 - DNA, 25 bp, Mus musculus
ttgccatattttttcaggtttgtta

SEQ ID NO: 951077 - DNA, 25 bp, Mus musculus
ttgccatcaaggcacactccagtgt

SEQ ID NO: 951078 - DNA, 25 bp, Mus musculus
ttgccatcaagggacactccagtgt

SEQ ID NO: 951079 - DNA, 25 bp, Mus musculus
ttgccatcaccaacctaaagatcag

SEQ ID NO: 951080 - DNA, 25 bp, Mus musculus
ttgccatcaccatcctaaagatcag

SEQ ID NO: 951081 - DNA, 25 bp, Mus musculus
ttgccatcatacatatcctctgcct

SEQ ID NO: 951082 - DNA, 25 bp, Mus musculus
ttgccatcatacttatcctctgcct

SEQ ID NO: 951083 - DNA, 25 bp, Mus musculus
ttgccatcatttcttagttgttagt

SEQ ID NO: 951084 - DNA, 25 bp, Mus musculus
ttgccatcatttgttagttgttagt

SEQ ID NO: 951085 - DNA, 25 bp, Mus musculus
ttgccatccctcacagtgagcagag

SEQ ID NO: 951086 - DNA, 25 bp, Mus musculus
ttgccatccctctcagtgagcagag

SEQ ID NO: 951087 - DNA, 25 bp, Mus musculus
ttgccatcctctacataatactagt

SEQ ID NO: 951088 - DNA, 25 bp, Mus musculus
ttgccatcctcttcataatactagt

SEQ ID NO: 951089 - DNA, 25 bp, Mus musculus
ttgccatcctgacgattcacttgat

SEQ ID NO: 951090 - DNA, 25 bp, Mus musculus
ttgccatcctgaggattcacttgat

SEQ ID NO: 951091 - DNA, 25 bp, Mus musculus
ttgccatcctggagtacactgttgt

SEQ ID NO: 951092 - DNA, 25 bp, Mus musculus
ttgccatcctggtgtacactgttgt

SEQ ID NO: 951093 - DNA, 25 bp, Mus musculus
ttgccatccttcctacagaaactgt

SEQ ID NO: 951094 - DNA, 25 bp, Mus musculus
ttgccatccttcgtacagaaactgt

SEQ ID NO: 951095 - DNA, 25 bp, Mus musculus
ttgccatcggtaactgtctctgctg

SEQ ID NO: 951096 - DNA, 25 bp, Mus musculus
ttgccatcggtatctgtctctgctg

SEQ ID NO: 951097 - DNA, 25 bp, Mus musculus
ttgccatctagactgcccctgagaa

SEQ ID NO: 951098 - DNA, 25 bp, Mus musculus
ttgccatctagagtgcccctgagaa

SEQ ID NO: 951099 - DNA, 25 bp, Mus musculus
ttgccatctgagatgtatcatgaca

SEQ ID NO: 951100 - DNA, 25 bp, Mus musculus
ttgccatctgagttgtatcatgaca

SEQ ID NO: 951101 - DNA, 25 bp, Mus musculus
ttgccatctgcacacttgagacatg

SEQ ID NO: 951102 - DNA, 25 bp, Mus musculus
ttgccatctgcagacttgagacatg

SEQ ID NO: 951103 - DNA, 25 bp, Mus musculus
ttgccatctgggaaatgggcagaga

SEQ ID NO: 951104 - DNA, 25 bp, Mus musculus
ttgccatctgggtaatgggcagaga

SEQ ID NO: 951105 - DNA, 25 bp, Mus musculus
ttgccatctgtaccagtgactttgt

SEQ ID NO: 951106 - DNA, 25 bp, Mus musculus
ttgccatctgtagcagtgactttgt

SEQ ID NO: 951107 - DNA, 25 bp, Mus musculus
ttgccatgacctcgaaaggcctgat

SEQ ID NO: 951108 - DNA, 25 bp, Mus musculus
ttgccatgacctggaaaggcctgat

SEQ ID NO: 951109 - DNA, 25 bp, Mus musculus
ttgccatgatgacttctaattgcca

SEQ ID NO: 951110 - DNA, 25 bp, Mus musculus
ttgccatgatgagttctaattgcca

SEQ ID NO: 951111 - DNA, 25 bp, Mus musculus
ttgccatgcacacgcatgaacactt

SEQ ID NO: 951112 - DNA, 25 bp, Mus musculus
ttgccatgcacaggcatgaacactt

SEQ ID NO: 951113 - DNA, 25 bp, Mus musculus
ttgccatgcagacgcctgtccggga

SEQ ID NO: 951114 - DNA, 25 bp, Mus musculus
ttgccatgcagaggcctgtccggga

SEQ ID NO: 951115 - DNA, 25 bp, Mus musculus
ttgccatgccctctgtcagttctat

SEQ ID NO: 951116 - DNA, 25 bp, Mus musculus
ttgccatgccctgtgtcagttctat

SEQ ID NO: 951117 - DNA, 25 bp, Mus musculus
ttgccatgcgttatgatgactgata

SEQ ID NO: 951118 - DNA, 25 bp, Mus musculus
ttgccatgcgttttgatgactgata

SEQ ID NO: 951119 - DNA, 25 bp, Mus musculus
ttgccatgctgcactttgagcagga

SEQ ID NO: 951120 - DNA, 25 bp, Mus musculus
ttgccatgctgctctttgagcagga

SEQ ID NO: 951121 - DNA, 25 bp, Mus musculus
ttgccatgctgtaccctgatgatag

SEQ ID NO: 951122 - DNA, 25 bp, Mus musculus
ttgccatgctgttccctgatgatag

SEQ ID NO: 951123 - DNA, 25 bp, Mus musculus
ttgccatggcaaacaactgcagtac

SEQ ID NO: 951124 - DNA, 25 bp, Mus musculus
ttgccatggcaatcaactgcagtac

SEQ ID NO: 951125 - DNA, 25 bp, Mus musculus
ttgccatggcaccttttacaacatc

SEQ ID NO: 951126 - DNA, 25 bp, Mus musculus
ttgccatggcacgttttacaacatc

SEQ ID NO: 951127 - DNA, 25 bp, Mus musculus
ttgccatggcccacttagttagtgt

SEQ ID NO: 951128 - DNA, 25 bp, Mus musculus
ttgccatggccctcttagttagtgt

SEQ ID NO: 951129 - DNA, 25 bp, Mus musculus
ttgccatggtgactaaaaacttttc

SEQ ID NO: 951130 - DNA, 25 bp, Mus musculus
ttgccatggtgagtaaaaacttttc

SEQ ID NO: 951131 - DNA, 25 bp, Mus musculus
ttgccatggtgcagccacagagagg

SEQ ID NO: 951132 - DNA, 25 bp, Mus musculus
ttgccatggtgctgccacagagagg

SEQ ID NO: 951133 - DNA, 25 bp, Mus musculus
ttgccatggttacccctgtggagtc

SEQ ID NO: 951134 - DNA, 25 bp, Mus musculus
ttgccatggttagccctgtggagtc

SEQ ID NO: 951135 - DNA, 25 bp, Mus musculus
ttgccatgtgggatagtaattgctt

SEQ ID NO: 951136 - DNA, 25 bp, Mus musculus
ttgccatgtgggttagtaattgctt

SEQ ID NO: 951137 - DNA, 25 bp, Mus musculus
ttgccattccccaagatgctggaga

SEQ ID NO: 951138 - DNA, 25 bp, Mus musculus
ttgccattcccctagatgctggaga

SEQ ID NO: 951139 - DNA, 25 bp, Mus musculus
ttgccattcggtagctcgtccatag

SEQ ID NO: 951140 - DNA, 25 bp, Mus musculus
ttgccattcggttgctcgtccatag

SEQ ID NO: 951141 - DNA, 25 bp, Mus musculus
ttgccattcgtcctgttacacatta

SEQ ID NO: 951142 - DNA, 25 bp, Mus musculus
ttgccattcgtcgtgttacacatta

SEQ ID NO: 951143 - DNA, 25 bp, Mus musculus
ttgccattctctagtgcttcagtag

SEQ ID NO: 951144 - DNA, 25 bp, Mus musculus
ttgccattctcttgtgcttcagtag

SEQ ID NO: 951145 - DNA, 25 bp, Mus musculus
ttgccattctgtagctgtgactcca

SEQ ID NO: 951146 - DNA, 25 bp, Mus musculus
ttgccattctgttgctgtgactcca

SEQ ID NO: 951147 - DNA, 25 bp, Mus musculus
ttgccattgaaaatgctcggaaccg

SEQ ID NO: 951148 - DNA, 25 bp, Mus musculus
ttgccattgaaattgctcggaaccg

SEQ ID NO: 951149 - DNA, 25 bp, Mus musculus
ttgccattgctcagtccagctttga

SEQ ID NO: 951150 - DNA, 25 bp, Mus musculus
ttgccattgctcattgctgtcagtt

SEQ ID NO: 951151 - DNA, 25 bp, Mus musculus
ttgccattgctctgtccagctttga

SEQ ID NO: 951152 - DNA, 25 bp, Mus musculus
ttgccattgctctttgctgtcagtt

SEQ ID NO: 951153 - DNA, 25 bp, Mus musculus
ttgccattggcactgttgtataggg

SEQ ID NO: 951154 - DNA, 25 bp, Mus musculus
ttgccattggcagtgttgtataggg

SEQ ID NO: 951155 - DNA, 25 bp, Mus musculus
ttgccatttattctaaatagggttt

SEQ ID NO: 951156 - DNA, 25 bp, Mus musculus
ttgccatttattgtaaatagggttt

SEQ ID NO: 951157 - DNA, 25 bp, Mus musculus
ttgccatttctaactgcctacagaa

SEQ ID NO: 951158 - DNA, 25 bp, Mus musculus
ttgccatttctatctgcctacagaa

SEQ ID NO: 951159 - DNA, 25 bp, Mus musculus
ttgccatttctccacaagaagtggt

SEQ ID NO: 951160 - DNA, 25 bp, Mus musculus
ttgccatttctcgacaagaagtggt

SEQ ID NO: 951161 - DNA, 25 bp, Mus musculus
ttgccatttctgcactgtactgact

SEQ ID NO: 951162 - DNA, 25 bp, Mus musculus
ttgccatttctggactgtactgact

SEQ ID NO: 951163 - DNA, 25 bp, Mus musculus
ttgccatttcttaggtctgtctgaa

SEQ ID NO: 951164 - DNA, 25 bp, Mus musculus
ttgccatttctttggtctgtctgaa

SEQ ID NO: 951165 - DNA, 25 bp, Mus musculus
ttgccatttgctcgagttgcccata

SEQ ID NO: 951166 - DNA, 25 bp, Mus musculus
ttgccatttgctggagttgcccata

SEQ ID NO: 951167 - DNA, 25 bp, Mus musculus
ttgccattttctacctaccataaaa

SEQ ID NO: 951168 - DNA, 25 bp, Mus musculus
ttgccattttcttcctaccataaaa

SEQ ID NO: 951169 - DNA, 25 bp, Mus musculus
ttgccatttttgctggtggctacct

SEQ ID NO: 951170 - DNA, 25 bp, Mus musculus
ttgccatttttggtggtggctacct

SEQ ID NO: 951171 - DNA, 25 bp, Mus musculus
ttgcccaaacccagaaaagttccag

SEQ ID NO: 951172 - DNA, 25 bp, Mus musculus
ttgcccaaacccctagccaggaagg

SEQ ID NO: 951173 - DNA, 25 bp, Mus musculus
ttgcccaaacccgtagccaggaagg

SEQ ID NO: 951174 - DNA, 25 bp, Mus musculus
ttgcccaaaccctgaaaagttccag

SEQ ID NO: 951175 - DNA, 25 bp, Mus musculus
ttgcccaaagacaatcacacttcta

SEQ ID NO: 951176 - DNA, 25 bp, Mus musculus
ttgcccaaagactatcacacttcta

SEQ ID NO: 951177 - DNA, 25 bp, Mus musculus
ttgcccaaaggtcagtcagacctct

SEQ ID NO: 951178 - DNA, 25 bp, Mus musculus
ttgcccaaaggtgagtcagacctct

SEQ ID NO: 951179 - DNA, 25 bp, Mus musculus
ttgcccaacgggactgtgtgaactt

SEQ ID NO: 951180 - DNA, 25 bp, Mus musculus
ttgcccaacgggtctgtgtgaactt

SEQ ID NO: 951181 - DNA, 25 bp, Mus musculus
ttgcccaacgtacttctaatttatg

SEQ ID NO: 951182 - DNA, 25 bp, Mus musculus
ttgcccaacgtagttctaatttatg

SEQ ID NO: 951183 - DNA, 25 bp, Mus musculus
ttgcccaactatatattgactccaa

SEQ ID NO: 951184 - DNA, 25 bp, Mus musculus
ttgcccaactatttattgactccaa

SEQ ID NO: 951185 - DNA, 25 bp, Mus musculus
ttgcccaagacactggcctcagtga

SEQ ID NO: 951186 - DNA, 25 bp, Mus musculus
ttgcccaagacagtggcctcagtga

SEQ ID NO: 951187 - DNA, 25 bp, Mus musculus
ttgcccaagggcaggaaaccatgcc

SEQ ID NO: 951188 - DNA, 25 bp, Mus musculus
ttgcccaagggcccaatttgagccc

SEQ ID NO: 951189 - DNA, 25 bp, Mus musculus
ttgcccaagggcgcaatttgagccc

SEQ ID NO: 951190 - DNA, 25 bp, Mus musculus
ttgcccaagggctggaaaccatgcc

SEQ ID NO: 951191 - DNA, 25 bp, Mus musculus
ttgcccaagtgaattactctgctgt

SEQ ID NO: 951192 - DNA, 25 bp, Mus musculus
ttgcccaagtgatttactctgctgt

SEQ ID NO: 951193 - DNA, 25 bp, Mus musculus
ttgcccaatccacataattatggat

SEQ ID NO: 951194 - DNA, 25 bp, Mus musculus
ttgcccaatccagataattatggat

SEQ ID NO: 951195 - DNA, 25 bp, Mus musculus
ttgcccaatgatccacttgtgccga

SEQ ID NO: 951196 - DNA, 25 bp, Mus musculus
ttgcccaatgatgcacttgtgccga

SEQ ID NO: 951197 - DNA, 25 bp, Mus musculus
ttgcccaatgggaccaactggttgt

SEQ ID NO: 951198 - DNA, 25 bp, Mus musculus
ttgcccaatgggtccaactggttgt

SEQ ID NO: 951199 - DNA, 25 bp, Mus musculus
ttgcccacacaacaccgtctattag

SEQ ID NO: 951200 - DNA, 25 bp, Mus musculus
ttgcccacacaagaccgtctattag

SEQ ID NO: 951201 - DNA, 25 bp, Mus musculus
ttgcccacacgtcgttactttcaaa

SEQ ID NO: 951202 - DNA, 25 bp, Mus musculus
ttgcccacacgtggttactttcaaa

SEQ ID NO: 951203 - DNA, 25 bp, Mus musculus
ttgcccacagagctttcaaacacat

SEQ ID NO: 951204 - DNA, 25 bp, Mus musculus
ttgcccacagaggtttcaaacacat

SEQ ID NO: 951205 - DNA, 25 bp, Mus musculus
ttgcccacagccatttttcaaggtg

SEQ ID NO: 951206 - DNA, 25 bp, Mus musculus
ttgcccacagccttttttcaaggtg

SEQ ID NO: 951207 - DNA, 25 bp, Mus musculus
ttgcccacatttccttccggaagca

SEQ ID NO: 951208 - DNA, 25 bp, Mus musculus
ttgcccacatttgcttccggaagca

SEQ ID NO: 951209 - DNA, 25 bp, Mus musculus
ttgcccaccaaccaagtgttacagg

SEQ ID NO: 951210 - DNA, 25 bp, Mus musculus
ttgcccaccaacgaagtgttacagg

SEQ ID NO: 951211 - DNA, 25 bp, Mus musculus
ttgcccaccacaaatgcttcaagct

SEQ ID NO: 951212 - DNA, 25 bp, Mus musculus
ttgcccaccacatatgcttcaagct

SEQ ID NO: 951213 - DNA, 25 bp, Mus musculus
ttgcccacgctgaggctccaaataa

SEQ ID NO: 951214 - DNA, 25 bp, Mus musculus
ttgcccacgctgtggctccaaataa

SEQ ID NO: 951215 - DNA, 25 bp, Mus musculus
ttgcccactcatcatgtgtctttca

SEQ ID NO: 951216 - DNA, 25 bp, Mus musculus
ttgcccactcatgatgtgtctttca

SEQ ID NO: 951217 - DNA, 25 bp, Mus musculus
ttgcccactcctaaattctgagcag

SEQ ID NO: 951218 - DNA, 25 bp, Mus musculus
ttgcccactccttaattctgagcag

SEQ ID NO: 951219 - DNA, 25 bp, Mus musculus
ttgcccactgatctgctgggtcaga

SEQ ID NO: 951220 - DNA, 25 bp, Mus musculus
ttgcccactgatgtgctgggtcaga

SEQ ID NO: 951221 - DNA, 25 bp, Mus musculus
ttgcccactgggacaggagtttctg

SEQ ID NO: 951222 - DNA, 25 bp, Mus musculus
ttgcccactgggtcaggagtttctg

SEQ ID NO: 951223 - DNA, 25 bp, Mus musculus
ttgcccacttgtagctaggtgcagt

SEQ ID NO: 951224 - DNA, 25 bp, Mus musculus
ttgcccacttgttgctaggtgcagt

SEQ ID NO: 951225 - DNA, 25 bp, Mus musculus
ttgcccagaactcgagccagactaa

SEQ ID NO: 951226 - DNA, 25 bp, Mus musculus
ttgcccagaactggagccagactaa

SEQ ID NO: 951227 - DNA, 25 bp, Mus musculus
ttgcccagagcccatccagaaaaaa

SEQ ID NO: 951228 - DNA, 25 bp, Mus musculus
ttgcccagagccgatccagaaaaaa

SEQ ID NO: 951229 - DNA, 25 bp, Mus musculus
ttgcccagaggcatatctataagat

SEQ ID NO: 951230 - DNA, 25 bp, Mus musculus
ttgcccagaggcttatctataagat

SEQ ID NO: 951231 - DNA, 25 bp, Mus musculus
ttgcccagatatagccagtggtcta

SEQ ID NO: 951232 - DNA, 25 bp, Mus musculus
ttgcccagatattgccagtggtcta

SEQ ID NO: 951233 - DNA, 25 bp, Mus musculus
ttgcccagcattccatctttaacgg

SEQ ID NO: 951234 - DNA, 25 bp, Mus musculus
ttgcccagcattgcatctttaacgg

SEQ ID NO: 951235 - DNA, 25 bp, Mus musculus
ttgcccagccacctcagggagcagg

SEQ ID NO: 951236 - DNA, 25 bp, Mus musculus
ttgcccagccacgtcagggagcagg

SEQ ID NO: 951237 - DNA, 25 bp, Mus musculus
ttgcccagccttcttggaaatctta

SEQ ID NO: 951238 - DNA, 25 bp, Mus musculus
ttgcccagccttgttggaaatctta

SEQ ID NO: 951239 - DNA, 25 bp, Mus musculus
ttgcccagctttaacataggtattg

SEQ ID NO: 951240 - DNA, 25 bp, Mus musculus
ttgcccagcttttacataggtattg

SEQ ID NO: 951241 - DNA, 25 bp, Mus musculus
ttgcccaggaggctctgactgttct

SEQ ID NO: 951242 - DNA, 25 bp, Mus musculus
ttgcccaggagggtctgactgttct

SEQ ID NO: 951243 - DNA, 25 bp, Mus musculus
ttgcccaggtgacacatggacttgt

SEQ ID NO: 951244 - DNA, 25 bp, Mus musculus
ttgcccaggtgagacatggacttgt

SEQ ID NO: 951245 - DNA, 25 bp, Mus musculus
ttgcccagtaatccacaggctgttg

SEQ ID NO: 951246 - DNA, 25 bp, Mus musculus
ttgcccagtaatgcacaggctgttg

SEQ ID NO: 951247 - DNA, 25 bp, Mus musculus
ttgcccagtcatataaaactttctg

SEQ ID NO: 951248 - DNA, 25 bp, Mus musculus
ttgcccagtcatttaaaactttctg

SEQ ID NO: 951249 - DNA, 25 bp, Mus musculus
ttgcccagtgctcacctagtgtgtg

SEQ ID NO: 951250 - DNA, 25 bp, Mus musculus
ttgcccagtgctgacctagtgtgtg

SEQ ID NO: 951251 - DNA, 25 bp, Mus musculus
ttgcccagtttcacccgggaaagat

SEQ ID NO: 951252 - DNA, 25 bp, Mus musculus
ttgcccagtttctcccgggaaagat

SEQ ID NO: 951253 - DNA, 25 bp, Mus musculus
ttgcccataactctgtatatccaac

SEQ ID NO: 951254 - DNA, 25 bp, Mus musculus
ttgcccataactgtgtatatccaac

SEQ ID NO: 951255 - DNA, 25 bp, Mus musculus
ttgcccatacaacaagaacctgtct

SEQ ID NO: 951256 - DNA, 25 bp, Mus musculus
ttgcccatacaagaagaacctgtct

SEQ ID NO: 951257 - DNA, 25 bp, Mus musculus
ttgcccatagttccaaagttcattg

SEQ ID NO: 951258 - DNA, 25 bp, Mus musculus
ttgcccatagttgcaaagttcattg

SEQ ID NO: 951259 - DNA, 25 bp, Mus musculus
ttgcccatatttatctgtaactcag

SEQ ID NO: 951260 - DNA, 25 bp, Mus musculus
ttgcccatatttttctgtaactcag

SEQ ID NO: 951261 - DNA, 25 bp, Mus musculus
ttgcccatcaatccaaacacaggag

SEQ ID NO: 951262 - DNA, 25 bp, Mus musculus
ttgcccatcaatgcaaacacaggag

SEQ ID NO: 951263 - DNA, 25 bp, Mus musculus
ttgcccatccacctggagcaaaagt

SEQ ID NO: 951264 - DNA, 25 bp, Mus musculus
ttgcccatccacgtggagcaaaagt

SEQ ID NO: 951265 - DNA, 25 bp, Mus musculus
ttgcccatctctatgttttaccaaa

SEQ ID NO: 951266 - DNA, 25 bp, Mus musculus
ttgcccatctctttgttttaccaaa

SEQ ID NO: 951267 - DNA, 25 bp, Mus musculus
ttgcccatgagaatgaagccctgaa

SEQ ID NO: 951268 - DNA, 25 bp, Mus musculus
ttgcccatgagattgaagccctgaa

SEQ ID NO: 951269 - DNA, 25 bp, Mus musculus
ttgcccatgcgactgtgtgcttagc

SEQ ID NO: 951270 - DNA, 25 bp, Mus musculus
ttgcccatgcgagtgtgtgcttagc

SEQ ID NO: 951271 - DNA, 25 bp, Mus musculus
ttgcccattctgcatcacagcggag

SEQ ID NO: 951272 - DNA, 25 bp, Mus musculus
ttgcccattctggatcacagcggag

SEQ ID NO: 951273 - DNA, 25 bp, Mus musculus
ttgcccattgcaaccttgtgtagat

SEQ ID NO: 951274 - DNA, 25 bp, Mus musculus
ttgcccattgcatccttgtgtagat

SEQ ID NO: 951275 - DNA, 25 bp, Mus musculus
ttgccccaaaagaggtaccacatct

SEQ ID NO: 951276 - DNA, 25 bp, Mus musculus
ttgccccaaaagtggtaccacatct

SEQ ID NO: 951277 - DNA, 25 bp, Mus musculus
ttgccccaaaccacatattcgtcgt

SEQ ID NO: 951278 - DNA, 25 bp, Mus musculus
ttgccccaaacctcatattcgtcgt

SEQ ID NO: 951279 - DNA, 25 bp, Mus musculus
ttgccccaaattcactatctttatt

SEQ ID NO: 951280 - DNA, 25 bp, Mus musculus
ttgccccaaattgactatctttatt

SEQ ID NO: 951281 - DNA, 25 bp, Mus musculus
ttgccccaagagaagtatgtgacca

SEQ ID NO: 951282 - DNA, 25 bp, Mus musculus
ttgccccaagagtagtatgtgacca

SEQ ID NO: 951283 - DNA, 25 bp, Mus musculus
ttgccccaagatagaaactttccat

SEQ ID NO: 951284 - DNA, 25 bp, Mus musculus
ttgccccaagattgaaactttccat

SEQ ID NO: 951285 - DNA, 25 bp, Mus musculus
ttgccccaatggaacgctgtttgaa

SEQ ID NO: 951286 - DNA, 25 bp, Mus musculus
ttgccccaatggtacgctgtttgaa

SEQ ID NO: 951287 - DNA, 25 bp, Mus musculus
ttgccccaccttcaaattactttgt

SEQ ID NO: 951288 - DNA, 25 bp, Mus musculus
ttgccccaccttgaaattactttgt

SEQ ID NO: 951289 - DNA, 25 bp, Mus musculus
ttgccccagaagatcatcttccagt

SEQ ID NO: 951290 - DNA, 25 bp, Mus musculus
ttgccccagaagttcatcttccagt

SEQ ID NO: 951291 - DNA, 25 bp, Mus musculus
ttgccccagagacccaagtgatgtt

SEQ ID NO: 951292 - DNA, 25 bp, Mus musculus
ttgccccagagagccaagtgatgtt

SEQ ID NO: 951293 - DNA, 25 bp, Mus musculus
ttgccccaggaaaactttctgctgt

SEQ ID NO: 951294 - DNA, 25 bp, Mus musculus
ttgccccaggaatactttctgctgt

SEQ ID NO: 951295 - DNA, 25 bp, Mus musculus
ttgccccagtaactcactttagaac

SEQ ID NO: 951296 - DNA, 25 bp, Mus musculus
ttgccccagtaagtcactttagaac

SEQ ID NO: 951297 - DNA, 25 bp, Mus musculus
ttgccccagtccaaatcttcttttt

SEQ ID NO: 951298 - DNA, 25 bp, Mus musculus
ttgccccagtcctaatcttcttttt

SEQ ID NO: 951299 - DNA, 25 bp, Mus musculus
ttgccccatatgaacatgcattatt

SEQ ID NO: 951300 - DNA, 25 bp, Mus musculus
ttgccccatatgtacatgcattatt

SEQ ID NO: 951301 - DNA, 25 bp, Mus musculus
ttgccccatcatcctcagtgctgtt

SEQ ID NO: 951302 - DNA, 25 bp, Mus musculus
ttgccccatcatgctcagtgctgtt

SEQ ID NO: 951303 - DNA, 25 bp, Mus musculus
ttgccccatgacagtgatcctgtgg

SEQ ID NO: 951304 - DNA, 25 bp, Mus musculus
ttgccccatgactgtgatcctgtgg

SEQ ID NO: 951305 - DNA, 25 bp, Mus musculus
ttgccccattcacaagcagggatga

SEQ ID NO: 951306 - DNA, 25 bp, Mus musculus
ttgccccattcagaagcagggatga

SEQ ID NO: 951307 - DNA, 25 bp, Mus musculus
ttgccccattgcatgtccaagaaaa

SEQ ID NO: 951308 - DNA, 25 bp, Mus musculus
ttgccccattgcttgtccaagaaaa

SEQ ID NO: 951309 - DNA, 25 bp, Mus musculus
ttgccccattttaattgctttcctg

SEQ ID NO: 951310 - DNA, 25 bp, Mus musculus
ttgccccatttttattgctttcctg

SEQ ID NO: 951311 - DNA, 25 bp, Mus musculus
ttgcccccagggagctacatgcata

SEQ ID NO: 951312 - DNA, 25 bp, Mus musculus
ttgcccccagggtgctacatgcata

SEQ ID NO: 951313 - DNA, 25 bp, Mus musculus
ttgccccgaaaaactggatgacctc

SEQ ID NO: 951314 - DNA, 25 bp, Mus musculus
ttgccccgaaaatctggatgacctc

SEQ ID NO: 951315 - DNA, 25 bp, Mus musculus
ttgccccggaagacactgagttcat

SEQ ID NO: 951316 - DNA, 25 bp, Mus musculus
ttgccccggaagtcactgagttcat

SEQ ID NO: 951317 - DNA, 25 bp, Mus musculus
ttgccccgtcacagctggagcagga

SEQ ID NO: 951318 - DNA, 25 bp, Mus musculus
ttgccccgtcactgctggagcagga

SEQ ID NO: 951319 - DNA, 25 bp, Mus musculus
ttgccccgtgaaaagatttggagac

SEQ ID NO: 951320 - DNA, 25 bp, Mus musculus
ttgccccgtgaatagatttggagac

SEQ ID NO: 951321 - DNA, 25 bp, Mus musculus
ttgccccgttgaattgctagacagc

SEQ ID NO: 951322 - DNA, 25 bp, Mus musculus
ttgccccgttgatttgctagacagc

SEQ ID NO: 951323 - DNA, 25 bp, Mus musculus
ttgcccctcaagaatattcgcccag

SEQ ID NO: 951324 - DNA, 25 bp, Mus musculus
ttgcccctcaagtatattcgcccag

SEQ ID NO: 951325 - DNA, 25 bp, Mus musculus
ttgcccctcaatattgcacactata

SEQ ID NO: 951326 - DNA, 25 bp, Mus musculus
ttgcccctcaattttgcacactata

SEQ ID NO: 951327 - DNA, 25 bp, Mus musculus
ttgcccctcaccaggaaaaccattg

SEQ ID NO: 951328 - DNA, 25 bp, Mus musculus
ttgcccctcacctggaaaaccattg

SEQ ID NO: 951329 - DNA, 25 bp, Mus musculus
ttgcccctcatcagtaatactagct

SEQ ID NO: 951330 - DNA, 25 bp, Mus musculus
ttgcccctcatctgtaatactagct

SEQ ID NO: 951331 - DNA, 25 bp, Mus musculus
ttgcccctccgaagataactataca

SEQ ID NO: 951332 - DNA, 25 bp, Mus musculus
ttgcccctccgatgataactataca

SEQ ID NO: 951333 - DNA, 25 bp, Mus musculus
ttgcccctggttcctaggaatacag

SEQ ID NO: 951334 - DNA, 25 bp, Mus musculus
ttgcccctggttgctaggaatacag

SEQ ID NO: 951335 - DNA, 25 bp, Mus musculus
ttgccccttgaactgtgttacatca

SEQ ID NO: 951336 - DNA, 25 bp, Mus musculus
ttgccccttgaagtgtgttacatca

SEQ ID NO: 951337 - DNA, 25 bp, Mus musculus
ttgccccttgagagaatgtctgttt

SEQ ID NO: 951338 - DNA, 25 bp, Mus musculus
ttgccccttgagtgaatgtctgttt

SEQ ID NO: 951339 - DNA, 25 bp, Mus musculus
ttgccccttgggatgttgagtctaa

SEQ ID NO: 951340 - DNA, 25 bp, Mus musculus
ttgccccttgggttgttgagtctaa

SEQ ID NO: 951341 - DNA, 25 bp, Mus musculus
ttgccccttgtaagaagtgtagctg

SEQ ID NO: 951342 - DNA, 25 bp, Mus musculus
ttgccccttgtatgaagtgtagctg

SEQ ID NO: 951343 - DNA, 25 bp, Mus musculus
ttgcccctttatctagcttccttat

SEQ ID NO: 951344 - DNA, 25 bp, Mus musculus
ttgcccctttatgtagcttccttat

SEQ ID NO: 951345 - DNA, 25 bp, Mus musculus
ttgcccgacctcaatggtctctaca

SEQ ID NO: 951346 - DNA, 25 bp, Mus musculus
ttgcccgacctctatggtctctaca

SEQ ID NO: 951347 - DNA, 25 bp, Mus musculus
ttgcccgacgttctgtcagcgataa

SEQ ID NO: 951348 - DNA, 25 bp, Mus musculus
ttgcccgacgttgtgtcagcgataa

SEQ ID NO: 951349 - DNA, 25 bp, Mus musculus
ttgcccgagactaggttccaggtga

SEQ ID NO: 951350 - DNA, 25 bp, Mus musculus
ttgcccgagacttggttccaggtga

SEQ ID NO: 951351 - DNA, 25 bp, Mus musculus
ttgcccgaggcgacatcagaaatta

SEQ ID NO: 951352 - DNA, 25 bp, Mus musculus
ttgcccgaggcgtcatcagaaatta

SEQ ID NO: 951353 - DNA, 25 bp, Mus musculus
ttgcccgagtgcaaaggaccttgac

SEQ ID NO: 951354 - DNA, 25 bp, Mus musculus
ttgcccgagtgctaaggaccttgac

SEQ ID NO: 951355 - DNA, 25 bp, Mus musculus
ttgcccgcctcaaggagatgggatt

SEQ ID NO: 951356 - DNA, 25 bp, Mus musculus
ttgcccgcctcatggagatgggatt

SEQ ID NO: 951357 - DNA, 25 bp, Mus musculus
ttgcccgcgcatccatgtgttcaca

SEQ ID NO: 951358 - DNA, 25 bp, Mus musculus
ttgcccgcgcatgcatgtgttcaca

SEQ ID NO: 951359 - DNA, 25 bp, Mus musculus
ttgcccgctcagcacccttcagtca

SEQ ID NO: 951360 - DNA, 25 bp, Mus musculus
ttgcccgctcaggacccttcagtca

SEQ ID NO: 951361 - DNA, 25 bp, Mus musculus
ttgcccgctcataaactggtttctc

SEQ ID NO: 951362 - DNA, 25 bp, Mus musculus
ttgcccgctcattaactggtttctc

SEQ ID NO: 951363 - DNA, 25 bp, Mus musculus
ttgcccggcgcgacggtgacaaggt

SEQ ID NO: 951364 - DNA, 25 bp, Mus musculus
ttgcccggcgcgtcggtgacaaggt

SEQ ID NO: 951365 - DNA, 25 bp, Mus musculus
ttgcccggcttcacatggtgccttc

SEQ ID NO: 951366 - DNA, 25 bp, Mus musculus
ttgcccggcttctcatggtgccttc

SEQ ID NO: 951367 - DNA, 25 bp, Mus musculus
ttgcccgggcaacgatgaggactca

SEQ ID NO: 951368 - DNA, 25 bp, Mus musculus
ttgcccgggcaaggatgaggactca

SEQ ID NO: 951369 - DNA, 25 bp, Mus musculus
ttgcccgggctcatgtgcttattga

SEQ ID NO: 951370 - DNA, 25 bp, Mus musculus
ttgcccgggctcttgtgcttattga

SEQ ID NO: 951371 - DNA, 25 bp, Mus musculus
ttgcccggtactacacattctgact

SEQ ID NO: 951372 - DNA, 25 bp, Mus musculus
ttgcccggtacttcacattctgact

SEQ ID NO: 951373 - DNA, 25 bp, Mus musculus
ttgcccggtgtaaacacagttcctt

SEQ ID NO: 951374 - DNA, 25 bp, Mus musculus
ttgcccggtgtatacacagttcctt

SEQ ID NO: 951375 - DNA, 25 bp, Mus musculus
ttgcccgtagatctttttcctcatt

SEQ ID NO: 951376 - DNA, 25 bp, Mus musculus
ttgcccgtagatgtttttcctcatt

SEQ ID NO: 951377 - DNA, 25 bp, Mus musculus
ttgcccgtcagaccgagaagccgtg

SEQ ID NO: 951378 - DNA, 25 bp, Mus musculus
ttgcccgtcagagcgagaagccgtg

SEQ ID NO: 951379 - DNA, 25 bp, Mus musculus
ttgcccgtccgtctatgggtgcaaa

SEQ ID NO: 951380 - DNA, 25 bp, Mus musculus
ttgcccgtccgtgtatgggtgcaaa

SEQ ID NO: 951381 - DNA, 25 bp, Mus musculus
ttgcccgttggcagttgagctacag

SEQ ID NO: 951382 - DNA, 25 bp, Mus musculus
ttgcccgttggctgttgagctacag

SEQ ID NO: 951383 - DNA, 25 bp, Mus musculus
ttgccctaaaatacctgggcaggca

SEQ ID NO: 951384 - DNA, 25 bp, Mus musculus
ttgccctaaaattcctgggcaggca

SEQ ID NO: 951385 - DNA, 25 bp, Mus musculus
ttgccctaaatgaacacctttctcc

SEQ ID NO: 951386 - DNA, 25 bp, Mus musculus
ttgccctaaatgtacacctttctcc

SEQ ID NO: 951387 - DNA, 25 bp, Mus musculus
ttgccctaacccatgaggttcctga

SEQ ID NO: 951388 - DNA, 25 bp, Mus musculus
ttgccctaacccttgaggttcctga

SEQ ID NO: 951389 - DNA, 25 bp, Mus musculus
ttgccctaaccgcaaacatttttag

SEQ ID NO: 951390 - DNA, 25 bp, Mus musculus
ttgccctaaccggaaacatttttag

SEQ ID NO: 951391 - DNA, 25 bp, Mus musculus
ttgccctaagcaagaaagtgccttt

SEQ ID NO: 951392 - DNA, 25 bp, Mus musculus
ttgccctaagcatgaaagtgccttt

SEQ ID NO: 951393 - DNA, 25 bp, Mus musculus
ttgccctaatttctactgaagtcct

SEQ ID NO: 951394 - DNA, 25 bp, Mus musculus
ttgccctaatttgtactgaagtcct

SEQ ID NO: 951395 - DNA, 25 bp, Mus musculus
ttgccctacaggagtggctaggcat

SEQ ID NO: 951396 - DNA, 25 bp, Mus musculus
ttgccctacaggtgtggctaggcat

SEQ ID NO: 951397 - DNA, 25 bp, Mus musculus
ttgccctacgcgcactgagtgagtt

SEQ ID NO: 951398 - DNA, 25 bp, Mus musculus
ttgccctacgcggactgagtgagtt

SEQ ID NO: 951399 - DNA, 25 bp, Mus musculus
ttgccctagcggagcatacaaggtg

SEQ ID NO: 951400 - DNA, 25 bp, Mus musculus
ttgccctagcggtgcatacaaggtg

SEQ ID NO: 951401 - DNA, 25 bp, Mus musculus
ttgccctaggctcctttagtttaga

SEQ ID NO: 951402 - DNA, 25 bp, Mus musculus
ttgccctaggctgctttagtttaga

SEQ ID NO: 951403 - DNA, 25 bp, Mus musculus
ttgccctatcacagggttgggccta

SEQ ID NO: 951404 - DNA, 25 bp, Mus musculus
ttgccctatcactgggttgggccta

SEQ ID NO: 951405 - DNA, 25 bp, Mus musculus
ttgccctatgacatctagtctgacc

SEQ ID NO: 951406 - DNA, 25 bp, Mus musculus
ttgccctatgacttctagtctgacc

SEQ ID NO: 951407 - DNA, 25 bp, Mus musculus
ttgccctatgctagctactttggag

SEQ ID NO: 951408 - DNA, 25 bp, Mus musculus
ttgccctatgcttgctactttggag

SEQ ID NO: 951409 - DNA, 25 bp, Mus musculus
ttgccctcaaagatcaccaattcgg

SEQ ID NO: 951410 - DNA, 25 bp, Mus musculus
ttgccctcaaagttcaccaattcgg

SEQ ID NO: 951411 - DNA, 25 bp, Mus musculus
ttgccctcactgcagctgctatggg

SEQ ID NO: 951412 - DNA, 25 bp, Mus musculus
ttgccctcactggagctgctatggg

SEQ ID NO: 951413 - DNA, 25 bp, Mus musculus
ttgccctcagcaaagatgcttccct

SEQ ID NO: 951414 - DNA, 25 bp, Mus musculus
ttgccctcagcatagatgcttccct

SEQ ID NO: 951415 - DNA, 25 bp, Mus musculus
ttgccctcagtgaattcaaaatctg

SEQ ID NO: 951416 - DNA, 25 bp, Mus musculus
ttgccctcagtgtattcaaaatctg

SEQ ID NO: 951417 - DNA, 25 bp, Mus musculus
ttgccctcatgaacagcggctggaa

SEQ ID NO: 951418 - DNA, 25 bp, Mus musculus
ttgccctcatgatcagcggctggaa

SEQ ID NO: 951419 - DNA, 25 bp, Mus musculus
ttgccctcccggaaggaattctggt

SEQ ID NO: 951420 - DNA, 25 bp, Mus musculus
ttgccctcccggtaggaattctggt

SEQ ID NO: 951421 - DNA, 25 bp, Mus musculus
ttgccctcctgcatttaagttgtac

SEQ ID NO: 951422 - DNA, 25 bp, Mus musculus
ttgccctcctgcttttaagttgtac

SEQ ID NO: 951423 - DNA, 25 bp, Mus musculus
ttgccctcgactagtggccattcca

SEQ ID NO: 951424 - DNA, 25 bp, Mus musculus
ttgccctcgacttgtggccattcca

SEQ ID NO: 951425 - DNA, 25 bp, Mus musculus
ttgccctcgctgatgccgaacgcgt

SEQ ID NO: 951426 - DNA, 25 bp, Mus musculus
ttgccctcgctgttgccgaacgcgt

SEQ ID NO: 951427 - DNA, 25 bp, Mus musculus
ttgccctctcctaaagggtgtcctg

SEQ ID NO: 951428 - DNA, 25 bp, Mus musculus
ttgccctctccttaagggtgtcctg

SEQ ID NO: 951429 - DNA, 25 bp, Mus musculus
ttgccctctcgtattccatttaaaa

SEQ ID NO: 951430 - DNA, 25 bp, Mus musculus
ttgccctctcgttttccatttaaaa

SEQ ID NO: 951431 - DNA, 25 bp, Mus musculus
ttgccctctgaacatacatctatgc

SEQ ID NO: 951432 - DNA, 25 bp, Mus musculus
ttgccctctgaagatacatctatgc

SEQ ID NO: 951433 - DNA, 25 bp, Mus musculus
ttgccctctggtactagtctcagaa

SEQ ID NO: 951434 - DNA, 25 bp, Mus musculus
ttgccctctggttctagtctcagaa

SEQ ID NO: 951435 - DNA, 25 bp, Mus musculus
ttgccctcttccatgtagagcaagg

SEQ ID NO: 951436 - DNA, 25 bp, Mus musculus
ttgccctcttccttgtagagcaagg

SEQ ID NO: 951437 - DNA, 25 bp, Mus musculus
ttgccctgagatagcgctgaggtca

SEQ ID NO: 951438 - DNA, 25 bp, Mus musculus
ttgccctgagattgcgctgaggtca

SEQ ID NO: 951439 - DNA, 25 bp, Mus musculus
ttgccctgagtcagctcaagaagaa

SEQ ID NO: 951440 - DNA, 25 bp, Mus musculus
ttgccctgagtctgctcaagaagaa

SEQ ID NO: 951441 - DNA, 25 bp, Mus musculus
ttgccctgatgtctactctgtgaca

SEQ ID NO: 951442 - DNA, 25 bp, Mus musculus
ttgccctgatgtgtactctgtgaca

SEQ ID NO: 951443 - DNA, 25 bp, Mus musculus
ttgccctgcatgctgtgcaatgaga

SEQ ID NO: 951444 - DNA, 25 bp, Mus musculus
ttgccctgcatggtgtgcaatgaga

SEQ ID NO: 951445 - DNA, 25 bp, Mus musculus
ttgccctgccagaatcttaaagagt

SEQ ID NO: 951446 - DNA, 25 bp, Mus musculus
ttgccctgccagtatcttaaagagt

SEQ ID NO: 951447 - DNA, 25 bp, Mus musculus
ttgccctgcgtgcagacaatggtca

SEQ ID NO: 951448 - DNA, 25 bp, Mus musculus
ttgccctgcgtggagacaatggtca

SEQ ID NO: 951449 - DNA, 25 bp, Mus musculus
ttgccctgctgcaggatacagccga

SEQ ID NO: 951450 - DNA, 25 bp, Mus musculus
ttgccctgctgctggatacagccga

SEQ ID NO: 951451 - DNA, 25 bp, Mus musculus
ttgccctggaacagtgtttagaaga

SEQ ID NO: 951452 - DNA, 25 bp, Mus musculus
ttgccctggaactgtgtttagaaga

SEQ ID NO: 951453 - DNA, 25 bp, Mus musculus
ttgccctggagacaccctttggaaa

SEQ ID NO: 951454 - DNA, 25 bp, Mus musculus
ttgccctggagacctggtttcccag

SEQ ID NO: 951455 - DNA, 25 bp, Mus musculus
ttgccctggagagaccctttggaaa

SEQ ID NO: 951456 - DNA, 25 bp, Mus musculus
ttgccctggagagctggtttcccag

SEQ ID NO: 951457 - DNA, 25 bp, Mus musculus
ttgccctggagcagcgtaatccgag

SEQ ID NO: 951458 - DNA, 25 bp, Mus musculus
ttgccctggagctgcgtaatccgag

SEQ ID NO: 951459 - DNA, 25 bp, Mus musculus
ttgccctggaggaagcaggctatac

SEQ ID NO: 951460 - DNA, 25 bp, Mus musculus
ttgccctggaggtagcaggctatac

SEQ ID NO: 951461 - DNA, 25 bp, Mus musculus
ttgccctggccacttactaatgctg

SEQ ID NO: 951462 - DNA, 25 bp, Mus musculus
ttgccctggccagttactaatgctg

SEQ ID NO: 951463 - DNA, 25 bp, Mus musculus
ttgccctggctccagagctatgctg

SEQ ID NO: 951464 - DNA, 25 bp, Mus musculus
ttgccctggctcgagagctatgctg

SEQ ID NO: 951465 - DNA, 25 bp, Mus musculus
ttgccctgggacagacctactgctc

SEQ ID NO: 951466 - DNA, 25 bp, Mus musculus
ttgccctgggacagtttgcagtgtt

SEQ ID NO: 951467 - DNA, 25 bp, Mus musculus
ttgccctgggactgacctactgctc

SEQ ID NO: 951468 - DNA, 25 bp, Mus musculus
ttgccctgggactgtttgcagtgtt

SEQ ID NO: 951469 - DNA, 25 bp, Mus musculus
ttgccctgggtcagtctatagcagt

SEQ ID NO: 951470 - DNA, 25 bp, Mus musculus
ttgccctgggtctgtctatagcagt

SEQ ID NO: 951471 - DNA, 25 bp, Mus musculus
ttgccctgtgacatatagccagaaa

SEQ ID NO: 951472 - DNA, 25 bp, Mus musculus
ttgccctgtgacttatagccagaaa

SEQ ID NO: 951473 - DNA, 25 bp, Mus musculus
ttgccctgtgatcaagcgcttggta

SEQ ID NO: 951474 - DNA, 25 bp, Mus musculus
ttgccctgtgatctccatacgaatg

SEQ ID NO: 951475 - DNA, 25 bp, Mus musculus
ttgccctgtgatgaagcgcttggta

SEQ ID NO: 951476 - DNA, 25 bp, Mus musculus
ttgccctgtgatgtccatacgaatg

SEQ ID NO: 951477 - DNA, 25 bp, Mus musculus
ttgccctgtgttaggtgaaggcgtt

SEQ ID NO: 951478 - DNA, 25 bp, Mus musculus
ttgccctgtgtttggtgaaggcgtt

SEQ ID NO: 951479 - DNA, 25 bp, Mus musculus
ttgccctgttgtcgagtctgtcttc

SEQ ID NO: 951480 - DNA, 25 bp, Mus musculus
ttgccctgttgtggagtctgtcttc

SEQ ID NO: 951481 - DNA, 25 bp, Mus musculus
ttgccctgtttcaacctcatgagtt

SEQ ID NO: 951482 - DNA, 25 bp, Mus musculus
ttgccctgtttcaggttgtttcccg

SEQ ID NO: 951483 - DNA, 25 bp, Mus musculus
ttgccctgtttctacctcatgagtt

SEQ ID NO: 951484 - DNA, 25 bp, Mus musculus
ttgccctgtttctggttgtttcccg

SEQ ID NO: 951485 - DNA, 25 bp, Mus musculus
ttgccctgtttgctgtttggaatct

SEQ ID NO: 951486 - DNA, 25 bp, Mus musculus
ttgccctgtttggtgtttggaatct

SEQ ID NO: 951487 - DNA, 25 bp, Mus musculus
ttgcccttaagtccagagtcagctc

SEQ ID NO: 951488 - DNA, 25 bp, Mus musculus
ttgcccttaagtgcagagtcagctc

SEQ ID NO: 951489 - DNA, 25 bp, Mus musculus
ttgcccttaatgacagtgcccttaa

SEQ ID NO: 951490 - DNA, 25 bp, Mus musculus
ttgcccttaatgtcagtgcccttaa

SEQ ID NO: 951491 - DNA, 25 bp, Mus musculus
ttgcccttagacattatttccagct

SEQ ID NO: 951492 - DNA, 25 bp, Mus musculus
ttgcccttagactttatttccagct

SEQ ID NO: 951493 - DNA, 25 bp, Mus musculus
ttgcccttagctattcccagaaaag

SEQ ID NO: 951494 - DNA, 25 bp, Mus musculus
ttgcccttagcttttcccagaaaag

SEQ ID NO: 951495 - DNA, 25 bp, Mus musculus
ttgcccttagggatctacttactgg

SEQ ID NO: 951496 - DNA, 25 bp, Mus musculus
ttgcccttagggttctacttactgg

SEQ ID NO: 951497 - DNA, 25 bp, Mus musculus
ttgcccttcacaaattccacagaac

SEQ ID NO: 951498 - DNA, 25 bp, Mus musculus
ttgcccttcacatattccacagaac

SEQ ID NO: 951499 - DNA, 25 bp, Mus musculus
ttgcccttcaggaagagctaggctt

SEQ ID NO: 951500 - DNA, 25 bp, Mus musculus
ttgcccttcaggtagagctaggctt

SEQ ID NO: 951501 - DNA, 25 bp, Mus musculus
ttgcccttcccaactatgtatttag

SEQ ID NO: 951502 - DNA, 25 bp, Mus musculus
ttgcccttcccatctatgtatttag

SEQ ID NO: 951503 - DNA, 25 bp, Mus musculus
ttgcccttctctctgatgtcaagta

SEQ ID NO: 951504 - DNA, 25 bp, Mus musculus
ttgcccttctctgtgatgtcaagta

SEQ ID NO: 951505 - DNA, 25 bp, Mus musculus
ttgcccttctgaccgttttctaaag

SEQ ID NO: 951506 - DNA, 25 bp, Mus musculus
ttgcccttctgagcgttttctaaag

SEQ ID NO: 951507 - DNA, 25 bp, Mus musculus
ttgcccttctgtagagtctttgcca

SEQ ID NO: 951508 - DNA, 25 bp, Mus musculus
ttgcccttctgttgagtctttgcca

SEQ ID NO: 951509 - DNA, 25 bp, Mus musculus
ttgcccttgcacatggagcatagat

SEQ ID NO: 951510 - DNA, 25 bp, Mus musculus
ttgcccttgcacttggagcatagat

SEQ ID NO: 951511 - DNA, 25 bp, Mus musculus
ttgcccttgcttcacttttctggag

SEQ ID NO: 951512 - DNA, 25 bp, Mus musculus
ttgcccttgcttgacttttctggag

SEQ ID NO: 951513 - DNA, 25 bp, Mus musculus
ttgcccttggctcgacactggtaaa

SEQ ID NO: 951514 - DNA, 25 bp, Mus musculus
ttgcccttggctggacactggtaaa

SEQ ID NO: 951515 - DNA, 25 bp, Mus musculus
ttgcccttgggacctagactttctg

SEQ ID NO: 951516 - DNA, 25 bp, Mus musculus
ttgcccttgggagctagactttctg

SEQ ID NO: 951517 - DNA, 25 bp, Mus musculus
ttgcccttgtacaggtcttgtgtag

SEQ ID NO: 951518 - DNA, 25 bp, Mus musculus
ttgcccttgtacctttcatggtaga

SEQ ID NO: 951519 - DNA, 25 bp, Mus musculus
ttgcccttgtacgtttcatggtaga

SEQ ID NO: 951520 - DNA, 25 bp, Mus musculus
ttgcccttgtactggtcttgtgtag

SEQ ID NO: 951521 - DNA, 25 bp, Mus musculus
ttgcccttgtgtcctaaactgttga

SEQ ID NO: 951522 - DNA, 25 bp, Mus musculus
ttgcccttgtgtgctaaactgttga

SEQ ID NO: 951523 - DNA, 25 bp, Mus musculus
ttgccctttgatccattttgagtta

SEQ ID NO: 951524 - DNA, 25 bp, Mus musculus
ttgccctttgatgcattttgagtta

SEQ ID NO: 951525 - DNA, 25 bp, Mus musculus
ttgccctttgtacttaagtctttga

SEQ ID NO: 951526 - DNA, 25 bp, Mus musculus
ttgccctttgtagttaagtctttga

SEQ ID NO: 951527 - DNA, 25 bp, Mus musculus
ttgcccttttatcaagacagatcag

SEQ ID NO: 951528 - DNA, 25 bp, Mus musculus
ttgcccttttatgaagacagatcag

SEQ ID NO: 951529 - DNA, 25 bp, Mus musculus
ttgccgaaaaccacatgcttgccat

SEQ ID NO: 951530 - DNA, 25 bp, Mus musculus
ttgccgaaaacctcatgcttgccat

SEQ ID NO: 951531 - DNA, 25 bp, Mus musculus
ttgccgaaacaacccatcgcttgct

SEQ ID NO: 951532 - DNA, 25 bp, Mus musculus
ttgccgaaacaagccatcgcttgct

SEQ ID NO: 951533 - DNA, 25 bp, Mus musculus
ttgccgaagcggacaaacccaacta

SEQ ID NO: 951534 - DNA, 25 bp, Mus musculus
ttgccgaagcggtcaaacccaacta

SEQ ID NO: 951535 - DNA, 25 bp, Mus musculus
ttgccgaagctcactcatcaaggcg

SEQ ID NO: 951536 - DNA, 25 bp, Mus musculus
ttgccgaagctctctcatcaaggcg

SEQ ID NO: 951537 - DNA, 25 bp, Mus musculus
ttgccgaataacatgtgatgggttt

SEQ ID NO: 951538 - DNA, 25 bp, Mus musculus
ttgccgaataacttgtgatgggttt

SEQ ID NO: 951539 - DNA, 25 bp, Mus musculus
ttgccgaatggtacctttgctgcta

SEQ ID NO: 951540 - DNA, 25 bp, Mus musculus
ttgccgaatggttcctttgctgcta

SEQ ID NO: 951541 - DNA, 25 bp, Mus musculus
ttgccgaccatcatagccgacaatg

SEQ ID NO: 951542 - DNA, 25 bp, Mus musculus
ttgccgaccatcttagccgacaatg

SEQ ID NO: 951543 - DNA, 25 bp, Mus musculus
ttgccgacgcggacgatgcgcgacc

SEQ ID NO: 951544 - DNA, 25 bp, Mus musculus
ttgccgacgcggtcgatgcgcgacc

SEQ ID NO: 951545 - DNA, 25 bp, Mus musculus
ttgccgactcagcagggctaccagt

SEQ ID NO: 951546 - DNA, 25 bp, Mus musculus
ttgccgactcaggagggctaccagt

SEQ ID NO: 951547 - DNA, 25 bp, Mus musculus
ttgccgactggtatggaaggcgctc

SEQ ID NO: 951548 - DNA, 25 bp, Mus musculus
ttgccgactggtttggaaggcgctc

SEQ ID NO: 951549 - DNA, 25 bp, Mus musculus
ttgccgaggatcatctgaaacaaat

SEQ ID NO: 951550 - DNA, 25 bp, Mus musculus
ttgccgaggatcttctgaaacaaat

SEQ ID NO: 951551 - DNA, 25 bp, Mus musculus
ttgccgagttggatgctacagctaa

SEQ ID NO: 951552 - DNA, 25 bp, Mus musculus
ttgccgagttggttgctacagctaa

SEQ ID NO: 951553 - DNA, 25 bp, Mus musculus
ttgccgataaaacagaggcccgtcc

SEQ ID NO: 951554 - DNA, 25 bp, Mus musculus
ttgccgataaaagagaggcccgtcc

SEQ ID NO: 951555 - DNA, 25 bp, Mus musculus
ttgccgataacgatgatgtcgatgc

SEQ ID NO: 951556 - DNA, 25 bp, Mus musculus
ttgccgataacgttgatgtcgatgc

SEQ ID NO: 951557 - DNA, 25 bp, Mus musculus
ttgccgatagggagtacacgcttga

SEQ ID NO: 951558 - DNA, 25 bp, Mus musculus
ttgccgatagggtgtacacgcttga

SEQ ID NO: 951559 - DNA, 25 bp, Mus musculus
ttgccgatctggacaggaccttagc

SEQ ID NO: 951560 - DNA, 25 bp, Mus musculus
ttgccgatctggtcaggaccttagc

SEQ ID NO: 951561 - DNA, 25 bp, Mus musculus
ttgccgatgctgccctccggctgga

SEQ ID NO: 951562 - DNA, 25 bp, Mus musculus
ttgccgatgctggcctccggctgga

SEQ ID NO: 951563 - DNA, 25 bp, Mus musculus
ttgccgcaagccctgatgatctagg

SEQ ID NO: 951564 - DNA, 25 bp, Mus musculus
ttgccgcaagccgtgatgatctagg

SEQ ID NO: 951565 - DNA, 25 bp, Mus musculus
ttgccgcacaacacgcacttgtagg

SEQ ID NO: 951566 - DNA, 25 bp, Mus musculus
ttgccgcacaactcgcacttgtagg

SEQ ID NO: 951567 - DNA, 25 bp, Mus musculus
ttgccgcagcgtattttgagaacct

SEQ ID NO: 951568 - DNA, 25 bp, Mus musculus
ttgccgcagcgttttttgagaacct

SEQ ID NO: 951569 - DNA, 25 bp, Mus musculus
ttgccgcattttagccatcatagag

SEQ ID NO: 951570 - DNA, 25 bp, Mus musculus
ttgccgcatttttgccatcatagag

SEQ ID NO: 951571 - DNA, 25 bp, Mus musculus
ttgccgccatttcccaagattcgaa

SEQ ID NO: 951572 - DNA, 25 bp, Mus musculus
ttgccgccatttgccaagattcgaa

SEQ ID NO: 951573 - DNA, 25 bp, Mus musculus
ttgccgcgagagaagctttcaagcc

SEQ ID NO: 951574 - DNA, 25 bp, Mus musculus
ttgccgcgagagtagctttcaagcc

SEQ ID NO: 951575 - DNA, 25 bp, Mus musculus
ttgccgctaagccttaccaggagac

SEQ ID NO: 951576 - DNA, 25 bp, Mus musculus
ttgccgctaagcgttaccaggagac

SEQ ID NO: 951577 - DNA, 25 bp, Mus musculus
ttgccgctctccaagatgaggctca

SEQ ID NO: 951578 - DNA, 25 bp, Mus musculus
ttgccgctctcctagatgaggctca

SEQ ID NO: 951579 - DNA, 25 bp, Mus musculus
ttgccgcttcctaactatgattttg

SEQ ID NO: 951580 - DNA, 25 bp, Mus musculus
ttgccgcttccttactatgattttg

SEQ ID NO: 951581 - DNA, 25 bp, Mus musculus
ttgccgcttgccatggaagtcacgg

SEQ ID NO: 951582 - DNA, 25 bp, Mus musculus
ttgccgcttgccttggaagtcacgg

SEQ ID NO: 951583 - DNA, 25 bp, Mus musculus
ttgccggccattatagtcagcgaaa

SEQ ID NO: 951584 - DNA, 25 bp, Mus musculus
ttgccggccattttagtcagcgaaa

SEQ ID NO: 951585 - DNA, 25 bp, Mus musculus
ttgccggcctgtcgatacatcaaaa

SEQ ID NO: 951586 - DNA, 25 bp, Mus musculus
ttgccggcctgtggatacatcaaaa

SEQ ID NO: 951587 - DNA, 25 bp, Mus musculus
ttgccggcgcttccgtgcttccaag

SEQ ID NO: 951588 - DNA, 25 bp, Mus musculus
ttgccggcgcttgcgtgcttccaag

SEQ ID NO: 951589 - DNA, 25 bp, Mus musculus
ttgccgggccaaactagttttacat

SEQ ID NO: 951590 - DNA, 25 bp, Mus musculus
ttgccgggccaatctagttttacat

SEQ ID NO: 951591 - DNA, 25 bp, Mus musculus
ttgccgggccagctatgacagtcta

SEQ ID NO: 951592 - DNA, 25 bp, Mus musculus
ttgccgggccaggtatgacagtcta

SEQ ID NO: 951593 - DNA, 25 bp, Mus musculus
ttgccggtctagcacttcagtggga

SEQ ID NO: 951594 - DNA, 25 bp, Mus musculus
ttgccggtctaggacttcagtggga

SEQ ID NO: 951595 - DNA, 25 bp, Mus musculus
ttgccgtacacaattctcctgacaa

SEQ ID NO: 951596 - DNA, 25 bp, Mus musculus
ttgccgtacacatttctcctgacaa

SEQ ID NO: 951597 - DNA, 25 bp, Mus musculus
ttgccgtcaatacattggcccaggc

SEQ ID NO: 951598 - DNA, 25 bp, Mus musculus
ttgccgtcaatagattggcccaggc

SEQ ID NO: 951599 - DNA, 25 bp, Mus musculus
ttgccgtcagccaggtctactgtat

SEQ ID NO: 951600 - DNA, 25 bp, Mus musculus
ttgccgtcagcctggtctactgtat

SEQ ID NO: 951601 - DNA, 25 bp, Mus musculus
ttgccgtcgtcaccttctactttca

SEQ ID NO: 951602 - DNA, 25 bp, Mus musculus
ttgccgtcgtcagcttctactttca

SEQ ID NO: 951603 - DNA, 25 bp, Mus musculus
ttgccgtgtttcagtcctttagtgt

SEQ ID NO: 951604 - DNA, 25 bp, Mus musculus
ttgccgtgtttctgtcctttagtgt

SEQ ID NO: 951605 - DNA, 25 bp, Mus musculus
ttgccgtttatgctttactcactta

SEQ ID NO: 951606 - DNA, 25 bp, Mus musculus
ttgccgtttatggtttactcactta

SEQ ID NO: 951607 - DNA, 25 bp, Mus musculus
ttgcctaacctgacagagtgcctaa

SEQ ID NO: 951608 - DNA, 25 bp, Mus musculus
ttgcctaacctgtcagagtgcctaa

SEQ ID NO: 951609 - DNA, 25 bp, Mus musculus
ttgcctaacgtgcaggaagctctga

SEQ ID NO: 951610 - DNA, 25 bp, Mus musculus
ttgcctaacgtggaggaagctctga

SEQ ID NO: 951611 - DNA, 25 bp, Mus musculus
ttgcctaactacaatccctagattc

SEQ ID NO: 951612 - DNA, 25 bp, Mus musculus
ttgcctaactactatccctagattc

SEQ ID NO: 951613 - DNA, 25 bp, Mus musculus
ttgcctaatacaccataccttcctg

SEQ ID NO: 951614 - DNA, 25 bp, Mus musculus
ttgcctaatacagcataccttcctg

SEQ ID NO: 951615 - DNA, 25 bp, Mus musculus
ttgcctacaagtacacacccaagta

SEQ ID NO: 951616 - DNA, 25 bp, Mus musculus
ttgcctacaagttcacacccaagta

SEQ ID NO: 951617 - DNA, 25 bp, Mus musculus
ttgcctacaatcatcttacacacat

SEQ ID NO: 951618 - DNA, 25 bp, Mus musculus
ttgcctacaatcttcttacacacat

SEQ ID NO: 951619 - DNA, 25 bp, Mus musculus
ttgcctacacgcaagcaatctggcg

SEQ ID NO: 951620 - DNA, 25 bp, Mus musculus
ttgcctacacgctagcaatctggcg

SEQ ID NO: 951621 - DNA, 25 bp, Mus musculus
ttgcctacatatcgctgtcctacag

SEQ ID NO: 951622 - DNA, 25 bp, Mus musculus
ttgcctacatatggctgtcctacag

SEQ ID NO: 951623 - DNA, 25 bp, Mus musculus
ttgcctacatcaacaggatcctgtg

SEQ ID NO: 951624 - DNA, 25 bp, Mus musculus
ttgcctacatcatcaggatcctgtg

SEQ ID NO: 951625 - DNA, 25 bp, Mus musculus
ttgcctacatctacaaatggtaatg

SEQ ID NO: 951626 - DNA, 25 bp, Mus musculus
ttgcctacatcttcaaatggtaatg

SEQ ID NO: 951627 - DNA, 25 bp, Mus musculus
ttgcctacatgaaccttagcttctg

SEQ ID NO: 951628 - DNA, 25 bp, Mus musculus
ttgcctacatgatccttagcttctg

SEQ ID NO: 951629 - DNA, 25 bp, Mus musculus
ttgcctacattcactctacacggta

SEQ ID NO: 951630 - DNA, 25 bp, Mus musculus
ttgcctacattctctctacacggta

SEQ ID NO: 951631 - DNA, 25 bp, Mus musculus
ttgcctaccaaactaatttctgcat

SEQ ID NO: 951632 - DNA, 25 bp, Mus musculus
ttgcctaccaaagtaatttctgcat

SEQ ID NO: 951633 - DNA, 25 bp, Mus musculus
ttgcctaccccgatattgagacatg

SEQ ID NO: 951634 - DNA, 25 bp, Mus musculus
ttgcctaccccgttattgagacatg

SEQ ID NO: 951635 - DNA, 25 bp, Mus musculus
ttgcctaccgccagtggaaatgcta

SEQ ID NO: 951636 - DNA, 25 bp, Mus musculus
ttgcctaccgcctgtggaaatgcta

SEQ ID NO: 951637 - DNA, 25 bp, Mus musculus
ttgcctacctagctgggatgtctcg

SEQ ID NO: 951638 - DNA, 25 bp, Mus musculus
ttgcctacctaggtgggatgtctcg

SEQ ID NO: 951639 - DNA, 25 bp, Mus musculus
ttgcctaccttgacatgctcagagg

SEQ ID NO: 951640 - DNA, 25 bp, Mus musculus
ttgcctaccttgtcatgctcagagg

SEQ ID NO: 951641 - DNA, 25 bp, Mus musculus
ttgcctactttaacaactgtcagag

SEQ ID NO: 951642 - DNA, 25 bp, Mus musculus
ttgcctactttatcaactgtcagag

SEQ ID NO: 951643 - DNA, 25 bp, Mus musculus
ttgcctagattaccccagtccttgt

SEQ ID NO: 951644 - DNA, 25 bp, Mus musculus
ttgcctagattagcccagtccttgt

SEQ ID NO: 951645 - DNA, 25 bp, Mus musculus
ttgcctagcaagcgcaaggccctgg

SEQ ID NO: 951646 - DNA, 25 bp, Mus musculus
ttgcctagcaagggcaaggccctgg

SEQ ID NO: 951647 - DNA, 25 bp, Mus musculus
ttgcctagcatgagtgaggaaccga

SEQ ID NO: 951648 - DNA, 25 bp, Mus musculus
ttgcctagcatgtgtgaggaaccga

SEQ ID NO: 951649 - DNA, 25 bp, Mus musculus
ttgcctagccgcactcccaggtagt

SEQ ID NO: 951650 - DNA, 25 bp, Mus musculus
ttgcctagccgctctcccaggtagt

SEQ ID NO: 951651 - DNA, 25 bp, Mus musculus
ttgcctagggaaaagtgccgctcac

SEQ ID NO: 951652 - DNA, 25 bp, Mus musculus
ttgcctagggaatagtgccgctcac

SEQ ID NO: 951653 - DNA, 25 bp, Mus musculus
ttgcctagtaaacacaaggtcctgg

SEQ ID NO: 951654 - DNA, 25 bp, Mus musculus
ttgcctagtaaagacaaggtcctgg

SEQ ID NO: 951655 - DNA, 25 bp, Mus musculus
ttgcctagtactaatctcagagggt

SEQ ID NO: 951656 - DNA, 25 bp, Mus musculus
ttgcctagtacttatctcagagggt

SEQ ID NO: 951657 - DNA, 25 bp, Mus musculus
ttgcctagtatgaaactcactctta

SEQ ID NO: 951658 - DNA, 25 bp, Mus musculus
ttgcctagtatgtaactcactctta

SEQ ID NO: 951659 - DNA, 25 bp, Mus musculus
ttgcctagtgtgaacacagtgctgt

SEQ ID NO: 951660 - DNA, 25 bp, Mus musculus
ttgcctagtgtgtacacagtgctgt

SEQ ID NO: 951661 - DNA, 25 bp, Mus musculus
ttgcctatagtgctttatgtggcta

SEQ ID NO: 951662 - DNA, 25 bp, Mus musculus
ttgcctatagtggtttatgtggcta

SEQ ID NO: 951663 - DNA, 25 bp, Mus musculus
ttgcctatatgtctgagcacatgtg

SEQ ID NO: 951664 - DNA, 25 bp, Mus musculus
ttgcctatatgtgtgagcacatgtg

SEQ ID NO: 951665 - DNA, 25 bp, Mus musculus
ttgcctatcaggaacagggctctgg

SEQ ID NO: 951666 - DNA, 25 bp, Mus musculus
ttgcctatcaggtacagggctctgg

SEQ ID NO: 951667 - DNA, 25 bp, Mus musculus
ttgcctatcattactgctgtttgga

SEQ ID NO: 951668 - DNA, 25 bp, Mus musculus
ttgcctatcattctggatgatttaa

SEQ ID NO: 951669 - DNA, 25 bp, Mus musculus
ttgcctatcattgtggatgatttaa

SEQ ID NO: 951670 - DNA, 25 bp, Mus musculus
ttgcctatcatttctgctgtttgga

SEQ ID NO: 951671 - DNA, 25 bp, Mus musculus
ttgcctatcccaagaagccgaacga

SEQ ID NO: 951672 - DNA, 25 bp, Mus musculus
ttgcctatcccatgaagccgaacga

SEQ ID NO: 951673 - DNA, 25 bp, Mus musculus
ttgcctatccttcctatatcataac

SEQ ID NO: 951674 - DNA, 25 bp, Mus musculus
ttgcctatccttgctatatcataac

SEQ ID NO: 951675 - DNA, 25 bp, Mus musculus
ttgcctatctgtacaccatcatcaa

SEQ ID NO: 951676 - DNA, 25 bp, Mus musculus
ttgcctatctgttcaccatcatcaa

SEQ ID NO: 951677 - DNA, 25 bp, Mus musculus
ttgcctatcttgctctctaaaagtt

SEQ ID NO: 951678 - DNA, 25 bp, Mus musculus
ttgcctatcttggtctctaaaagtt

SEQ ID NO: 951679 - DNA, 25 bp, Mus musculus
ttgcctatggatagctaatggagct

SEQ ID NO: 951680 - DNA, 25 bp, Mus musculus
ttgcctatggattgctaatggagct

SEQ ID NO: 951681 - DNA, 25 bp, Mus musculus
ttgcctatgggtagtacaagctgaa

SEQ ID NO: 951682 - DNA, 25 bp, Mus musculus
ttgcctatgggttgtacaagctgaa

SEQ ID NO: 951683 - DNA, 25 bp, Mus musculus
ttgcctatggtcaatgaggccactg

SEQ ID NO: 951684 - DNA, 25 bp, Mus musculus
ttgcctatggtctatgaggccactg

SEQ ID NO: 951685 - DNA, 25 bp, Mus musculus
ttgcctcaaacaactgagccaaaga

SEQ ID NO: 951686 - DNA, 25 bp, Mus musculus
ttgcctcaaacatctgagccaaaga

SEQ ID NO: 951687 - DNA, 25 bp, Mus musculus
ttgcctcaaatccattccaagttgt

SEQ ID NO: 951688 - DNA, 25 bp, Mus musculus
ttgcctcaaatcgattccaagttgt

SEQ ID NO: 951689 - DNA, 25 bp, Mus musculus
ttgcctcaacctccagagtagttgg

SEQ ID NO: 951690 - DNA, 25 bp, Mus musculus
ttgcctcaacctgcagagtagttgg

SEQ ID NO: 951691 - DNA, 25 bp, Mus musculus
ttgcctcaacgtacctgggtcagtc

SEQ ID NO: 951692 - DNA, 25 bp, Mus musculus
ttgcctcaacgttcctgggtcagtc

SEQ ID NO: 951693 - DNA, 25 bp, Mus musculus
ttgcctcaagccaaccaaatatacc

SEQ ID NO: 951694 - DNA, 25 bp, Mus musculus
ttgcctcaagcctaccaaatatacc

SEQ ID NO: 951695 - DNA, 25 bp, Mus musculus
ttgcctcaatctaagtactcctgtt

SEQ ID NO: 951696 - DNA, 25 bp, Mus musculus
ttgcctcaatcttagtactcctgtt

SEQ ID NO: 951697 - DNA, 25 bp, Mus musculus
ttgcctcacctgagctatgatgctg

SEQ ID NO: 951698 - DNA, 25 bp, Mus musculus
ttgcctcacctgtgctatgatgctg

SEQ ID NO: 951699 - DNA, 25 bp, Mus musculus
ttgcctcactctaaagatgcctcag

SEQ ID NO: 951700 - DNA, 25 bp, Mus musculus
ttgcctcactcttaagatgcctcag

SEQ ID NO: 951701 - DNA, 25 bp, Mus musculus
ttgcctcagcctagcctggaagaaa

SEQ ID NO: 951702 - DNA, 25 bp, Mus musculus
ttgcctcagccttgcctggaagaaa

SEQ ID NO: 951703 - DNA, 25 bp, Mus musculus
ttgcctcagcggatatgtttataca

SEQ ID NO: 951704 - DNA, 25 bp, Mus musculus
ttgcctcagcggttatgtttataca

SEQ ID NO: 951705 - DNA, 25 bp, Mus musculus
ttgcctcagtgaagttagtccctaa

SEQ ID NO: 951706 - DNA, 25 bp, Mus musculus
ttgcctcagtgatgttagtccctaa

SEQ ID NO: 951707 - DNA, 25 bp, Mus musculus
ttgcctcatgctctaaacacagtac

SEQ ID NO: 951708 - DNA, 25 bp, Mus musculus
ttgcctcatgctgtaaacacagtac

SEQ ID NO: 951709 - DNA, 25 bp, Mus musculus
ttgcctcattatattgtcaattgtt

SEQ ID NO: 951710 - DNA, 25 bp, Mus musculus
ttgcctcattattttgtcaattgtt

SEQ ID NO: 951711 - DNA, 25 bp, Mus musculus
ttgcctccaagcatagtgacctcag

SEQ ID NO: 951712 - DNA, 25 bp, Mus musculus
ttgcctccaagcttagtgacctcag

SEQ ID NO: 951713 - DNA, 25 bp, Mus musculus
ttgcctccaccaaacatatctcagg

SEQ ID NO: 951714 - DNA, 25 bp, Mus musculus
ttgcctccaccatacatatctcagg

SEQ ID NO: 951715 - DNA, 25 bp, Mus musculus
ttgcctccatggaggtctgtaagca

SEQ ID NO: 951716 - DNA, 25 bp, Mus musculus
ttgcctccatggtggtctgtaagca

SEQ ID NO: 951717 - DNA, 25 bp, Mus musculus
ttgcctccattcagtgttcactata

SEQ ID NO: 951718 - DNA, 25 bp, Mus musculus
ttgcctccattctgtgttcactata

SEQ ID NO: 951719 - DNA, 25 bp, Mus musculus
ttgcctcccacacaatctggagaaa

SEQ ID NO: 951720 - DNA, 25 bp, Mus musculus
ttgcctcccacagaatctggagaaa

SEQ ID NO: 951721 - DNA, 25 bp, Mus musculus
ttgcctcccctgagttacttaactt

SEQ ID NO: 951722 - DNA, 25 bp, Mus musculus
ttgcctcccctgtgttacttaactt

SEQ ID NO: 951723 - DNA, 25 bp, Mus musculus
ttgcctcccgagatctaggatataa

SEQ ID NO: 951724 - DNA, 25 bp, Mus musculus
ttgcctcccgagttctaggatataa

SEQ ID NO: 951725 - DNA, 25 bp, Mus musculus
ttgcctccctaactctgggatcata

SEQ ID NO: 951726 - DNA, 25 bp, Mus musculus
ttgcctccctaagtctgggatcata

SEQ ID NO: 951727 - DNA, 25 bp, Mus musculus
ttgcctccctgaagaactgtcttgg

SEQ ID NO: 951728 - DNA, 25 bp, Mus musculus
ttgcctccctgatgaactgtcttgg

SEQ ID NO: 951729 - DNA, 25 bp, Mus musculus
ttgcctcccttcagaaatacttggc

SEQ ID NO: 951730 - DNA, 25 bp, Mus musculus
ttgcctcccttcataaagctagcag

SEQ ID NO: 951731 - DNA, 25 bp, Mus musculus
ttgcctcccttctgaaatacttggc

SEQ ID NO: 951732 - DNA, 25 bp, Mus musculus
ttgcctcccttcttaaagctagcag

SEQ ID NO: 951733 - DNA, 25 bp, Mus musculus
ttgcctcctcacaaatagctgtagc

SEQ ID NO: 951734 - DNA, 25 bp, Mus musculus
ttgcctcctcactaatagctgtagc

SEQ ID NO: 951735 - DNA, 25 bp, Mus musculus
ttgcctcctcagacttttagaccag

SEQ ID NO: 951736 - DNA, 25 bp, Mus musculus
ttgcctcctcagtcttttagaccag

SEQ ID NO: 951737 - DNA, 25 bp, Mus musculus
ttgcctcctcctaactgagtatgag

SEQ ID NO: 951738 - DNA, 25 bp, Mus musculus
ttgcctcctccttactgagtatgag

SEQ ID NO: 951739 - DNA, 25 bp, Mus musculus
ttgcctcctctcatgaatcttccag

SEQ ID NO: 951740 - DNA, 25 bp, Mus musculus
ttgcctcctctcttgaatcttccag

SEQ ID NO: 951741 - DNA, 25 bp, Mus musculus
ttgcctcctgggagtgacttgggac

SEQ ID NO: 951742 - DNA, 25 bp, Mus musculus
ttgcctcctgggtgtgacttgggac

SEQ ID NO: 951743 - DNA, 25 bp, Mus musculus
ttgcctccttgaataaagtagccgt

SEQ ID NO: 951744 - DNA, 25 bp, Mus musculus
ttgcctccttgattaaagtagccgt

SEQ ID NO: 951745 - DNA, 25 bp, Mus musculus
ttgcctccttggagaggttggtgct

SEQ ID NO: 951746 - DNA, 25 bp, Mus musculus
ttgcctccttggtgaggttggtgct

SEQ ID NO: 951747 - DNA, 25 bp, Mus musculus
ttgcctcgctggactggtatttgtg

SEQ ID NO: 951748 - DNA, 25 bp, Mus musculus
ttgcctcgctggtctggtatttgtg

SEQ ID NO: 951749 - DNA, 25 bp, Mus musculus
ttgcctcgtaccagtcagaggtcag

SEQ ID NO: 951750 - DNA, 25 bp, Mus musculus
ttgcctcgtacctgtcagaggtcag

SEQ ID NO: 951751 - DNA, 25 bp, Mus musculus
ttgcctcgtgttatgagattatgta

SEQ ID NO: 951752 - DNA, 25 bp, Mus musculus
ttgcctcgtgttttgagattatgta

SEQ ID NO: 951753 - DNA, 25 bp, Mus musculus
ttgcctctaactacctaaccgaaag

SEQ ID NO: 951754 - DNA, 25 bp, Mus musculus
ttgcctctaacttcctaaccgaaag

SEQ ID NO: 951755 - DNA, 25 bp, Mus musculus
ttgcctctactgcagcctacgcttt

SEQ ID NO: 951756 - DNA, 25 bp, Mus musculus
ttgcctctactggagcctacgcttt

SEQ ID NO: 951757 - DNA, 25 bp, Mus musculus
ttgcctctattcactgctttcagaa

SEQ ID NO: 951758 - DNA, 25 bp, Mus musculus
ttgcctctattctctgctttcagaa

SEQ ID NO: 951759 - DNA, 25 bp, Mus musculus
ttgcctctctcccagaaataatctt

SEQ ID NO: 951760 - DNA, 25 bp, Mus musculus
ttgcctctctccgagaaataatctt

SEQ ID NO: 951761 - DNA, 25 bp, Mus musculus
ttgcctctcttcatgcatagtgtgg

SEQ ID NO: 951762 - DNA, 25 bp, Mus musculus
ttgcctctcttcttgcatagtgtgg

SEQ ID NO: 951763 - DNA, 25 bp, Mus musculus
ttgcctctgagaacatcagcctgga

SEQ ID NO: 951764 - DNA, 25 bp, Mus musculus
ttgcctctgagatcatcagcctgga

SEQ ID NO: 951765 - DNA, 25 bp, Mus musculus
ttgcctctgcaaagtatgactctac

SEQ ID NO: 951766 - DNA, 25 bp, Mus musculus
ttgcctctgcaacatactgtctagt

SEQ ID NO: 951767 - DNA, 25 bp, Mus musculus
ttgcctctgcaagatactgtctagt

SEQ ID NO: 951768 - DNA, 25 bp, Mus musculus
ttgcctctgcaatgtatgactctac

SEQ ID NO: 951769 - DNA, 25 bp, Mus musculus
ttgcctctgcagatttctttaagac

SEQ ID NO: 951770 - DNA, 25 bp, Mus musculus
ttgcctctgcagttttctttaagac

SEQ ID NO: 951771 - DNA, 25 bp, Mus musculus
ttgcctctgggtaagctggctcaaa

SEQ ID NO: 951772 - DNA, 25 bp, Mus musculus
ttgcctctgggttagctggctcaaa

SEQ ID NO: 951773 - DNA, 25 bp, Mus musculus
ttgcctctggttatccatactttag

SEQ ID NO: 951774 - DNA, 25 bp, Mus musculus
ttgcctctggttttccatactttag

SEQ ID NO: 951775 - DNA, 25 bp, Mus musculus
ttgcctctgtacagtgtggtgtgga

SEQ ID NO: 951776 - DNA, 25 bp, Mus musculus
ttgcctctgtactgtgtggtgtgga

SEQ ID NO: 951777 - DNA, 25 bp, Mus musculus
ttgcctctgtgaccaccgtgctgac

SEQ ID NO: 951778 - DNA, 25 bp, Mus musculus
ttgcctctgtgagcaccgtgctgac

SEQ ID NO: 951779 - DNA, 25 bp, Mus musculus
ttgcctctgtggcagcatagaaatt

SEQ ID NO: 951780 - DNA, 25 bp, Mus musculus
ttgcctctgtgggagcatagaaatt

SEQ ID NO: 951781 - DNA, 25 bp, Mus musculus
ttgcctctgttcatagcctaacttg

SEQ ID NO: 951782 - DNA, 25 bp, Mus musculus
ttgcctctgttcttagcctaacttg

SEQ ID NO: 951783 - DNA, 25 bp, Mus musculus
ttgcctctgttgactgagggctctc

SEQ ID NO: 951784 - DNA, 25 bp, Mus musculus
ttgcctctgttgtctgagggctctc

SEQ ID NO: 951785 - DNA, 25 bp, Mus musculus
ttgcctcttaacattggctacttgt

SEQ ID NO: 951786 - DNA, 25 bp, Mus musculus
ttgcctcttaactttggctacttgt

SEQ ID NO: 951787 - DNA, 25 bp, Mus musculus
ttgcctcttaataacctcagtctgt

SEQ ID NO: 951788 - DNA, 25 bp, Mus musculus
ttgcctcttaattacctcagtctgt

SEQ ID NO: 951789 - DNA, 25 bp, Mus musculus
ttgcctcttgcaacacaaacaacat

SEQ ID NO: 951790 - DNA, 25 bp, Mus musculus
ttgcctcttgcatcacaaacaacat

SEQ ID NO: 951791 - DNA, 25 bp, Mus musculus
ttgcctcttgccactcaagggaagt

SEQ ID NO: 951792 - DNA, 25 bp, Mus musculus
ttgcctcttgcctctcaagggaagt

SEQ ID NO: 951793 - DNA, 25 bp, Mus musculus
ttgcctcttggtacacaaagcctga

SEQ ID NO: 951794 - DNA, 25 bp, Mus musculus
ttgcctcttggttcacaaagcctga

SEQ ID NO: 951795 - DNA, 25 bp, Mus musculus
ttgcctctttgaagatttgctctga

SEQ ID NO: 951796 - DNA, 25 bp, Mus musculus
ttgcctctttgatgatttgctctga

SEQ ID NO: 951797 - DNA, 25 bp, Mus musculus
ttgcctcttttgactccacaaaagg

SEQ ID NO: 951798 - DNA, 25 bp, Mus musculus
ttgcctcttttgtctccacaaaagg

SEQ ID NO: 951799 - DNA, 25 bp, Mus musculus
ttgcctgaaacgaagttgaaatacg

SEQ ID NO: 951800 - DNA, 25 bp, Mus musculus
ttgcctgaaacgtagttgaaatacg

SEQ ID NO: 951801 - DNA, 25 bp, Mus musculus
ttgcctgaagccaacttcttttgtt

SEQ ID NO: 951802 - DNA, 25 bp, Mus musculus
ttgcctgaagcctacttcttttgtt

SEQ ID NO: 951803 - DNA, 25 bp, Mus musculus
ttgcctgaattcaggaagcgcctgt

SEQ ID NO: 951804 - DNA, 25 bp, Mus musculus
ttgcctgaattctggaagcgcctgt

SEQ ID NO: 951805 - DNA, 25 bp, Mus musculus
ttgcctgacatcatctcatttgggt

SEQ ID NO: 951806 - DNA, 25 bp, Mus musculus
ttgcctgacatcttctcatttgggt

SEQ ID NO: 951807 - DNA, 25 bp, Mus musculus
ttgcctgacatgaccatgggaacat

SEQ ID NO: 951808 - DNA, 25 bp, Mus musculus
ttgcctgacatgtccatgggaacat

SEQ ID NO: 951809 - DNA, 25 bp, Mus musculus
ttgcctgacccgcatgaaaaccatg

SEQ ID NO: 951810 - DNA, 25 bp, Mus musculus
ttgcctgacccggatgaaaaccatg

SEQ ID NO: 951811 - DNA, 25 bp, Mus musculus
ttgcctgacgccctgtgagctgaac

SEQ ID NO: 951812 - DNA, 25 bp, Mus musculus
ttgcctgacgccgtgtgagctgaac

SEQ ID NO: 951813 - DNA, 25 bp, Mus musculus
ttgcctgagaccagttggaagcact

SEQ ID NO: 951814 - DNA, 25 bp, Mus musculus
ttgcctgagacctgttggaagcact

SEQ ID NO: 951815 - DNA, 25 bp, Mus musculus
ttgcctgagccaattttgggctccc

SEQ ID NO: 951816 - DNA, 25 bp, Mus musculus
ttgcctgagccatttttgggctccc

SEQ ID NO: 951817 - DNA, 25 bp, Mus musculus
ttgcctgagccgcatgcaggatgat

SEQ ID NO: 951818 - DNA, 25 bp, Mus musculus
ttgcctgagccggatgcaggatgat

SEQ ID NO: 951819 - DNA, 25 bp, Mus musculus
ttgcctgaggagattgccaacgagg

SEQ ID NO: 951820 - DNA, 25 bp, Mus musculus
ttgcctgaggagtttgccaacgagg

SEQ ID NO: 951821 - DNA, 25 bp, Mus musculus
ttgcctgaggcaattccccgagttt

SEQ ID NO: 951822 - DNA, 25 bp, Mus musculus
ttgcctgaggcacacatataacttt

SEQ ID NO: 951823 - DNA, 25 bp, Mus musculus
ttgcctgaggcagacatataacttt

SEQ ID NO: 951824 - DNA, 25 bp, Mus musculus
ttgcctgaggcatttccccgagttt

SEQ ID NO: 951825 - DNA, 25 bp, Mus musculus
ttgcctgaggctccactgtcatcga

SEQ ID NO: 951826 - DNA, 25 bp, Mus musculus
ttgcctgaggctctggtctcttaga

SEQ ID NO: 951827 - DNA, 25 bp, Mus musculus
ttgcctgaggctgcactgtcatcga

SEQ ID NO: 951828 - DNA, 25 bp, Mus musculus
ttgcctgaggctgtggtctcttaga

SEQ ID NO: 951829 - DNA, 25 bp, Mus musculus
ttgcctgagtacacaatgcaccccg

SEQ ID NO: 951830 - DNA, 25 bp, Mus musculus
ttgcctgagtactcaatgcaccccg

SEQ ID NO: 951831 - DNA, 25 bp, Mus musculus
ttgcctgatgtcacgtgggtagcga

SEQ ID NO: 951832 - DNA, 25 bp, Mus musculus
ttgcctgatgtctcgtgggtagcga

SEQ ID NO: 951833 - DNA, 25 bp, Mus musculus
ttgcctgatgtgaggttgtactctt

SEQ ID NO: 951834 - DNA, 25 bp, Mus musculus
ttgcctgatgtgtggttgtactctt

SEQ ID NO: 951835 - DNA, 25 bp, Mus musculus
ttgcctgcaaatcaattacctgccc

SEQ ID NO: 951836 - DNA, 25 bp, Mus musculus
ttgcctgcaaatgaattacctgccc

SEQ ID NO: 951837 - DNA, 25 bp, Mus musculus
ttgcctgcaataaccagaggaacca

SEQ ID NO: 951838 - DNA, 25 bp, Mus musculus
ttgcctgcaatatccagaggaacca

SEQ ID NO: 951839 - DNA, 25 bp, Mus musculus
ttgcctgcacaaaacctgctcaaga

SEQ ID NO: 951840 - DNA, 25 bp, Mus musculus
ttgcctgcacaatacctgctcaaga

SEQ ID NO: 951841 - DNA, 25 bp, Mus musculus
ttgcctgcagacatggcaacaccat

SEQ ID NO: 951842 - DNA, 25 bp, Mus musculus
ttgcctgcagacttggcaacaccat

SEQ ID NO: 951843 - DNA, 25 bp, Mus musculus
ttgcctgcagcaacgtgtgtgtaga

SEQ ID NO: 951844 - DNA, 25 bp, Mus musculus
ttgcctgcagcatcgtgtgtgtaga

SEQ ID NO: 951845 - DNA, 25 bp, Mus musculus
ttgcctgcagctacacagtatgtgt

SEQ ID NO: 951846 - DNA, 25 bp, Mus musculus
ttgcctgcagcttcacagtatgtgt

SEQ ID NO: 951847 - DNA, 25 bp, Mus musculus
ttgcctgcataaacatgctttttct

SEQ ID NO: 951848 - DNA, 25 bp, Mus musculus
ttgcctgcataactatctgcttctg

SEQ ID NO: 951849 - DNA, 25 bp, Mus musculus
ttgcctgcataagtatctgcttctg

SEQ ID NO: 951850 - DNA, 25 bp, Mus musculus
ttgcctgcataatcatgctttttct

SEQ ID NO: 951851 - DNA, 25 bp, Mus musculus
ttgcctgccaaacgagtggctcact

SEQ ID NO: 951852 - DNA, 25 bp, Mus musculus
ttgcctgccaaaggagtggctcact

SEQ ID NO: 951853 - DNA, 25 bp, Mus musculus
ttgcctgcccacatcttgggaaagt

SEQ ID NO: 951854 - DNA, 25 bp, Mus musculus
ttgcctgcccacctgaggcactgga

SEQ ID NO: 951855 - DNA, 25 bp, Mus musculus
ttgcctgcccacgtgaggcactgga

SEQ ID NO: 951856 - DNA, 25 bp, Mus musculus
ttgcctgcccacttcttgggaaagt

SEQ ID NO: 951857 - DNA, 25 bp, Mus musculus
ttgcctgccgaacatgaagagtctt

SEQ ID NO: 951858 - DNA, 25 bp, Mus musculus
ttgcctgccgaagatgaagagtctt

SEQ ID NO: 951859 - DNA, 25 bp, Mus musculus
ttgcctgccggtattccaagtgaga

SEQ ID NO: 951860 - DNA, 25 bp, Mus musculus
ttgcctgccggttttccaagtgaga

SEQ ID NO: 951861 - DNA, 25 bp, Mus musculus
ttgcctgcgattcttttccatacat

SEQ ID NO: 951862 - DNA, 25 bp, Mus musculus
ttgcctgcgattgttttccatacat

SEQ ID NO: 951863 - DNA, 25 bp, Mus musculus
ttgcctgcggtgagccacagtgaag

SEQ ID NO: 951864 - DNA, 25 bp, Mus musculus
ttgcctgcggtgtgccacagtgaag

SEQ ID NO: 951865 - DNA, 25 bp, Mus musculus
ttgcctgctataaccatgcctagag

SEQ ID NO: 951866 - DNA, 25 bp, Mus musculus
ttgcctgctatatccatgcctagag

SEQ ID NO: 951867 - DNA, 25 bp, Mus musculus
ttgcctgctatgcacaattgctggt

SEQ ID NO: 951868 - DNA, 25 bp, Mus musculus
ttgcctgctatggacaattgctggt

SEQ ID NO: 951869 - DNA, 25 bp, Mus musculus
ttgcctgctctaaaagtttcggtct

SEQ ID NO: 951870 - DNA, 25 bp, Mus musculus
ttgcctgctctataagtttcggtct

SEQ ID NO: 951871 - DNA, 25 bp, Mus musculus
ttgcctggaggaacaatcggaaagt

SEQ ID NO: 951872 - DNA, 25 bp, Mus musculus
ttgcctggaggatcaatcggaaagt

SEQ ID NO: 951873 - DNA, 25 bp, Mus musculus
ttgcctggaggtcggttgcacattt

SEQ ID NO: 951874 - DNA, 25 bp, Mus musculus
ttgcctggaggtgggttgcacattt

SEQ ID NO: 951875 - DNA, 25 bp, Mus musculus
ttgcctggcaggagggtggaattaa

SEQ ID NO: 951876 - DNA, 25 bp, Mus musculus
ttgcctggcaggtgggtggaattaa

SEQ ID NO: 951877 - DNA, 25 bp, Mus musculus
ttgcctggcatcacaggtgtcacct

SEQ ID NO: 951878 - DNA, 25 bp, Mus musculus
ttgcctggcatcacctttaagacaa

SEQ ID NO: 951879 - DNA, 25 bp, Mus musculus
ttgcctggcatctcaggtgtcacct

SEQ ID NO: 951880 - DNA, 25 bp, Mus musculus
ttgcctggcatctcctttaagacaa

SEQ ID NO: 951881 - DNA, 25 bp, Mus musculus
ttgcctggcatgaagagggtgcttt

SEQ ID NO: 951882 - DNA, 25 bp, Mus musculus
ttgcctggcatgctacatgttcagt

SEQ ID NO: 951883 - DNA, 25 bp, Mus musculus
ttgcctggcatggtacatgttcagt

SEQ ID NO: 951884 - DNA, 25 bp, Mus musculus
ttgcctggcatgtagagggtgcttt

SEQ ID NO: 951885 - DNA, 25 bp, Mus musculus
ttgcctggccatcctgagttcaatt

SEQ ID NO: 951886 - DNA, 25 bp, Mus musculus
ttgcctggccatgctgagttcaatt

SEQ ID NO: 951887 - DNA, 25 bp, Mus musculus
ttgcctggctctagccagtgatgaa

SEQ ID NO: 951888 - DNA, 25 bp, Mus musculus
ttgcctggctcttgccagtgatgaa

SEQ ID NO: 951889 - DNA, 25 bp, Mus musculus
ttgcctggcttgcagtaccatagga

SEQ ID NO: 951890 - DNA, 25 bp, Mus musculus
ttgcctggcttggagtaccatagga

SEQ ID NO: 951891 - DNA, 25 bp, Mus musculus
ttgcctgggactatagggccactca

SEQ ID NO: 951892 - DNA, 25 bp, Mus musculus
ttgcctgggactttagggccactca

SEQ ID NO: 951893 - DNA, 25 bp, Mus musculus
ttgcctgggcccaaagacaaggtga

SEQ ID NO: 951894 - DNA, 25 bp, Mus musculus
ttgcctgggccctaagacaaggtga

SEQ ID NO: 951895 - DNA, 25 bp, Mus musculus
ttgcctgggcctattaggactcggt

SEQ ID NO: 951896 - DNA, 25 bp, Mus musculus
ttgcctgggccttttaggactcggt

SEQ ID NO: 951897 - DNA, 25 bp, Mus musculus
ttgcctgggcgaccttaccagcgtg

SEQ ID NO: 951898 - DNA, 25 bp, Mus musculus
ttgcctgggcgagcttaccagcgtg

SEQ ID NO: 951899 - DNA, 25 bp, Mus musculus
ttgcctggtataaccagggcacctc

SEQ ID NO: 951900 - DNA, 25 bp, Mus musculus
ttgcctggtatatccagggcacctc

SEQ ID NO: 951901 - DNA, 25 bp, Mus musculus
ttgcctggtcttagtctgtgtacca

SEQ ID NO: 951902 - DNA, 25 bp, Mus musculus
ttgcctggtctttgtctgtgtacca

SEQ ID NO: 951903 - DNA, 25 bp, Mus musculus
ttgcctggtgcaagggtaagtgaca

SEQ ID NO: 951904 - DNA, 25 bp, Mus musculus
ttgcctggtgcatgggtaagtgaca

SEQ ID NO: 951905 - DNA, 25 bp, Mus musculus
ttgcctggtgtgcaatgactttgct

SEQ ID NO: 951906 - DNA, 25 bp, Mus musculus
ttgcctggtgtggaatgactttgct

SEQ ID NO: 951907 - DNA, 25 bp, Mus musculus
ttgcctggttttaggaatggaccca

SEQ ID NO: 951908 - DNA, 25 bp, Mus musculus
ttgcctggtttttggaatggaccca

SEQ ID NO: 951909 - DNA, 25 bp, Mus musculus
ttgcctgtacagatctttagatggg

SEQ ID NO: 951910 - DNA, 25 bp, Mus musculus
ttgcctgtacagttctttagatggg

SEQ ID NO: 951911 - DNA, 25 bp, Mus musculus
ttgcctgtagacacagggttcctgt

SEQ ID NO: 951912 - DNA, 25 bp, Mus musculus
ttgcctgtagactcagggttcctgt

SEQ ID NO: 951913 - DNA, 25 bp, Mus musculus
ttgcctgtcactagccacagagatt

SEQ ID NO: 951914 - DNA, 25 bp, Mus musculus
ttgcctgtcacttgccacagagatt

SEQ ID NO: 951915 - DNA, 25 bp, Mus musculus
ttgcctgtcaggctcttcacaaaga

SEQ ID NO: 951916 - DNA, 25 bp, Mus musculus
ttgcctgtcagggtcttcacaaaga

SEQ ID NO: 951917 - DNA, 25 bp, Mus musculus
ttgcctgtcagtctatattgctgtt

SEQ ID NO: 951918 - DNA, 25 bp, Mus musculus
ttgcctgtcagtctttttcaacttc

SEQ ID NO: 951919 - DNA, 25 bp, Mus musculus
ttgcctgtcagtgtatattgctgtt

SEQ ID NO: 951920 - DNA, 25 bp, Mus musculus
ttgcctgtcagtgtttttcaacttc

SEQ ID NO: 951921 - DNA, 25 bp, Mus musculus
ttgcctgtctcgcttgtgcagaaaa

SEQ ID NO: 951922 - DNA, 25 bp, Mus musculus
ttgcctgtctcggttgtgcagaaaa

SEQ ID NO: 951923 - DNA, 25 bp, Mus musculus
ttgcctgtctctaggctcttaacaa

SEQ ID NO: 951924 - DNA, 25 bp, Mus musculus
ttgcctgtctcttggctcttaacaa

SEQ ID NO: 951925 - DNA, 25 bp, Mus musculus
ttgcctgtctttataggtctctgct

SEQ ID NO: 951926 - DNA, 25 bp, Mus musculus
ttgcctgtctttttaggtctctgct

SEQ ID NO: 951927 - DNA, 25 bp, Mus musculus
ttgcctgtgcacagcatctttatct

SEQ ID NO: 951928 - DNA, 25 bp, Mus musculus
ttgcctgtgcactgcatctttatct

SEQ ID NO: 951929 - DNA, 25 bp, Mus musculus
ttgcctgtgcgcaaaagctgtccag

SEQ ID NO: 951930 - DNA, 25 bp, Mus musculus
ttgcctgtgcgctaaagctgtccag

SEQ ID NO: 951931 - DNA, 25 bp, Mus musculus
ttgcctgtgctaactcatcctgtaa

SEQ ID NO: 951932 - DNA, 25 bp, Mus musculus
ttgcctgtgctatctcatcctgtaa

SEQ ID NO: 951933 - DNA, 25 bp, Mus musculus
ttgcctgtgctgcaaccattgagtc

SEQ ID NO: 951934 - DNA, 25 bp, Mus musculus
ttgcctgtgctggaaccattgagtc

SEQ ID NO: 951935 - DNA, 25 bp, Mus musculus
ttgcctgtggtcatggtcccgcgga

SEQ ID NO: 951936 - DNA, 25 bp, Mus musculus
ttgcctgtggtcttggtcccgcgga

SEQ ID NO: 951937 - DNA, 25 bp, Mus musculus
ttgcctgtggttcaaccatccagcc

SEQ ID NO: 951938 - DNA, 25 bp, Mus musculus
ttgcctgtggttgaaccatccagcc

SEQ ID NO: 951939 - DNA, 25 bp, Mus musculus
ttgcctgttctgagtccatgaagcc

SEQ ID NO: 951940 - DNA, 25 bp, Mus musculus
ttgcctgttctgtgtccatgaagcc

SEQ ID NO: 951941 - DNA, 25 bp, Mus musculus
ttgcctgttgacatccacttgtacc

SEQ ID NO: 951942 - DNA, 25 bp, Mus musculus
ttgcctgttgacttccacttgtacc

SEQ ID NO: 951943 - DNA, 25 bp, Mus musculus
ttgcctgttggcattgaaatccata

SEQ ID NO: 951944 - DNA, 25 bp, Mus musculus
ttgcctgttggctttgaaatccata

SEQ ID NO: 951945 - DNA, 25 bp, Mus musculus
ttgcctgtttctctcaagagtctgg

SEQ ID NO: 951946 - DNA, 25 bp, Mus musculus
ttgcctgtttctgtcaagagtctgg

SEQ ID NO: 951947 - DNA, 25 bp, Mus musculus
ttgcctgttttgcttacggcctcac

SEQ ID NO: 951948 - DNA, 25 bp, Mus musculus
ttgcctgttttggttacggcctcac

SEQ ID NO: 951949 - DNA, 25 bp, Mus musculus
ttgccttaacttattcttgccagaa

SEQ ID NO: 951950 - DNA, 25 bp, Mus musculus
ttgccttaactttttcttgccagaa

SEQ ID NO: 951951 - DNA, 25 bp, Mus musculus
ttgccttaatcccttgacactatgt

SEQ ID NO: 951952 - DNA, 25 bp, Mus musculus
ttgccttaatccgttgacactatgt

SEQ ID NO: 951953 - DNA, 25 bp, Mus musculus
ttgccttaccacctttgaaaaagca

SEQ ID NO: 951954 - DNA, 25 bp, Mus musculus
ttgccttaccacgtttgaaaaagca

SEQ ID NO: 951955 - DNA, 25 bp, Mus musculus
ttgccttacctcacattctgacagg

SEQ ID NO: 951956 - DNA, 25 bp, Mus musculus
ttgccttacctctcattctgacagg

SEQ ID NO: 951957 - DNA, 25 bp, Mus musculus
ttgccttacttcctggtcctaaaag

SEQ ID NO: 951958 - DNA, 25 bp, Mus musculus
ttgccttacttcgtggtcctaaaag

SEQ ID NO: 951959 - DNA, 25 bp, Mus musculus
ttgccttagcttataattgtgtatc

SEQ ID NO: 951960 - DNA, 25 bp, Mus musculus
ttgccttagcttttaattgtgtatc

SEQ ID NO: 951961 - DNA, 25 bp, Mus musculus
ttgccttaggagagggtctctttta

SEQ ID NO: 951962 - DNA, 25 bp, Mus musculus
ttgccttaggagtgggtctctttta

SEQ ID NO: 951963 - DNA, 25 bp, Mus musculus
ttgccttatcttaaatgctcttcag

SEQ ID NO: 951964 - DNA, 25 bp, Mus musculus
ttgccttatctttaatgctcttcag

SEQ ID NO: 951965 - DNA, 25 bp, Mus musculus
ttgccttatgagctgggacccttta

SEQ ID NO: 951966 - DNA, 25 bp, Mus musculus
ttgccttatgaggtgggacccttta

SEQ ID NO: 951967 - DNA, 25 bp, Mus musculus
ttgccttcaacaagcacactgacag

SEQ ID NO: 951968 - DNA, 25 bp, Mus musculus
ttgccttcaacatgcacactgacag

SEQ ID NO: 951969 - DNA, 25 bp, Mus musculus
ttgccttcacatcaacgactgggct

SEQ ID NO: 951970 - DNA, 25 bp, Mus musculus
ttgccttcacatgaacgactgggct

SEQ ID NO: 951971 - DNA, 25 bp, Mus musculus
ttgccttcactgcttctgttttaaa

SEQ ID NO: 951972 - DNA, 25 bp, Mus musculus
ttgccttcactggttctgttttaaa

SEQ ID NO: 951973 - DNA, 25 bp, Mus musculus
ttgccttcagagaccagtgaggtta

SEQ ID NO: 951974 - DNA, 25 bp, Mus musculus
ttgccttcagagtccagtgaggtta

SEQ ID NO: 951975 - DNA, 25 bp, Mus musculus
ttgccttcagtacatctgctgtgca

SEQ ID NO: 951976 - DNA, 25 bp, Mus musculus
ttgccttcagtagatctgctgtgca

SEQ ID NO: 951977 - DNA, 25 bp, Mus musculus
ttgccttcatggctagcctggacac

SEQ ID NO: 951978 - DNA, 25 bp, Mus musculus
ttgccttcatgggtagcctggacac

SEQ ID NO: 951979 - DNA, 25 bp, Mus musculus
ttgccttcattaccagtagctgcat

SEQ ID NO: 951980 - DNA, 25 bp, Mus musculus
ttgccttcattagcagtagctgcat

SEQ ID NO: 951981 - DNA, 25 bp, Mus musculus
ttgccttccagaccttgttgatttt

SEQ ID NO: 951982 - DNA, 25 bp, Mus musculus
ttgccttccagagcttgttgatttt

SEQ ID NO: 951983 - DNA, 25 bp, Mus musculus
ttgccttccagcagtaagtggatct

SEQ ID NO: 951984 - DNA, 25 bp, Mus musculus
ttgccttccagctgtaagtggatct

SEQ ID NO: 951985 - DNA, 25 bp, Mus musculus
ttgccttcccaacaccgaaaagata

SEQ ID NO: 951986 - DNA, 25 bp, Mus musculus
ttgccttcccaagaccgaaaagata

SEQ ID NO: 951987 - DNA, 25 bp, Mus musculus
ttgccttccctgaaaatagccttag

SEQ ID NO: 951988 - DNA, 25 bp, Mus musculus
ttgccttccctgtaaatagccttag

SEQ ID NO: 951989 - DNA, 25 bp, Mus musculus
ttgccttcctgacaatattatcatc

SEQ ID NO: 951990 - DNA, 25 bp, Mus musculus
ttgccttcctgagaatattatcatc

SEQ ID NO: 951991 - DNA, 25 bp, Mus musculus
ttgccttcctggaatgacataagtg

SEQ ID NO: 951992 - DNA, 25 bp, Mus musculus
ttgccttcctggtatgacataagtg

SEQ ID NO: 951993 - DNA, 25 bp, Mus musculus
ttgccttcctgtcaccaagttcaaa

SEQ ID NO: 951994 - DNA, 25 bp, Mus musculus
ttgccttcctgtgaccaagttcaaa

SEQ ID NO: 951995 - DNA, 25 bp, Mus musculus
ttgccttcgaaactgaaccgggagc

SEQ ID NO: 951996 - DNA, 25 bp, Mus musculus
ttgccttcgaaagtgaaccgggagc

SEQ ID NO: 951997 - DNA, 25 bp, Mus musculus
ttgccttcgagaccatcgcagtcag

SEQ ID NO: 951998 - DNA, 25 bp, Mus musculus
ttgccttcgagagcatcgcagtcag

SEQ ID NO: 951999 - DNA, 25 bp, Mus musculus
ttgccttcgggcagcctgacaacca

SEQ ID NO: 952000 - DNA, 25 bp, Mus musculus
ttgccttcgggctgcctgacaacca

SEQ ID NO: 952001 - DNA, 25 bp, Mus musculus
ttgccttgaactagtagacatctgc

SEQ ID NO: 952002 - DNA, 25 bp, Mus musculus
ttgccttgaacttgtagacatctgc

SEQ ID NO: 952003 - DNA, 25 bp, Mus musculus
ttgccttgactgacaggatccgcaa

SEQ ID NO: 952004 - DNA, 25 bp, Mus musculus
ttgccttgactgtcaggatccgcaa

SEQ ID NO: 952005 - DNA, 25 bp, Mus musculus
ttgccttgagtcatgtttccctgga

SEQ ID NO: 952006 - DNA, 25 bp, Mus musculus
ttgccttgagtcttgtttccctgga

SEQ ID NO: 952007 - DNA, 25 bp, Mus musculus
ttgccttgatacctaaaacattgac

SEQ ID NO: 952008 - DNA, 25 bp, Mus musculus
ttgccttgatacgtaaaacattgac

SEQ ID NO: 952009 - DNA, 25 bp, Mus musculus
ttgccttgatttaatgccattgcct

SEQ ID NO: 952010 - DNA, 25 bp, Mus musculus
ttgccttgattttatgccattgcct

SEQ ID NO: 952011 - DNA, 25 bp, Mus musculus
ttgccttgcctcaattaggacttga

SEQ ID NO: 952012 - DNA, 25 bp, Mus musculus
ttgccttgcctctattaggacttga

SEQ ID NO: 952013 - DNA, 25 bp, Mus musculus
ttgccttgcgtgagctgttatggaa

SEQ ID NO: 952014 - DNA, 25 bp, Mus musculus
ttgccttgcgtgtgctgttatggaa

SEQ ID NO: 952015 - DNA, 25 bp, Mus musculus
ttgccttgcttgctatttgccatca

SEQ ID NO: 952016 - DNA, 25 bp, Mus musculus
ttgccttgcttggtatttgccatca

SEQ ID NO: 952017 - DNA, 25 bp, Mus musculus
ttgccttggaaacttcccgctgtat

SEQ ID NO: 952018 - DNA, 25 bp, Mus musculus
ttgccttggaaagttcccgctgtat

SEQ ID NO: 952019 - DNA, 25 bp, Mus musculus
ttgccttggcacatgtactactcca

SEQ ID NO: 952020 - DNA, 25 bp, Mus musculus
ttgccttggcacttgtactactcca

SEQ ID NO: 952021 - DNA, 25 bp, Mus musculus
ttgccttggcttattccatctatta

SEQ ID NO: 952022 - DNA, 25 bp, Mus musculus
ttgccttggctttttccatctatta

SEQ ID NO: 952023 - DNA, 25 bp, Mus musculus
ttgccttgggacaatgaaaatcact

SEQ ID NO: 952024 - DNA, 25 bp, Mus musculus
ttgccttgggactatgaaaatcact

SEQ ID NO: 952025 - DNA, 25 bp, Mus musculus
ttgccttggtgcatgctgctccaga

SEQ ID NO: 952026 - DNA, 25 bp, Mus musculus
ttgccttggtgcttgctgctccaga

SEQ ID NO: 952027 - DNA, 25 bp, Mus musculus
ttgccttgtaaactagctccaagga

SEQ ID NO: 952028 - DNA, 25 bp, Mus musculus
ttgccttgtaaagtagctccaagga

SEQ ID NO: 952029 - DNA, 25 bp, Mus musculus
ttgccttgtccaaaagtccagtcac

SEQ ID NO: 952030 - DNA, 25 bp, Mus musculus
ttgccttgtccataagtccagtcac

SEQ ID NO: 952031 - DNA, 25 bp, Mus musculus
ttgccttgtctaaagtccctgtggt

SEQ ID NO: 952032 - DNA, 25 bp, Mus musculus
ttgccttgtctatagtccctgtggt

SEQ ID NO: 952033 - DNA, 25 bp, Mus musculus
ttgccttgtctcagattcccaggta

SEQ ID NO: 952034 - DNA, 25 bp, Mus musculus
ttgccttgtctctgattcccaggta

SEQ ID NO: 952035 - DNA, 25 bp, Mus musculus
ttgcctttacttccttttctcttta

SEQ ID NO: 952036 - DNA, 25 bp, Mus musculus
ttgcctttacttgcttttctcttta

SEQ ID NO: 952037 - DNA, 25 bp, Mus musculus
ttgcctttagtcactgggacccaga

SEQ ID NO: 952038 - DNA, 25 bp, Mus musculus
ttgcctttagtctctgggacccaga

SEQ ID NO: 952039 - DNA, 25 bp, Mus musculus
ttgcctttatatagcttagtcttga

SEQ ID NO: 952040 - DNA, 25 bp, Mus musculus
ttgcctttatattgcttagtcttga

SEQ ID NO: 952041 - DNA, 25 bp, Mus musculus
ttgcctttcaaaaatcatactacag

SEQ ID NO: 952042 - DNA, 25 bp, Mus musculus
ttgcctttcaaatatcatactacag

SEQ ID NO: 952043 - DNA, 25 bp, Mus musculus
ttgcctttcagacacattctgtaga

SEQ ID NO: 952044 - DNA, 25 bp, Mus musculus
ttgcctttcagagacattctgtaga

SEQ ID NO: 952045 - DNA, 25 bp, Mus musculus
ttgcctttcatgacttgttcagttt

SEQ ID NO: 952046 - DNA, 25 bp, Mus musculus
ttgcctttcatgtcttgttcagttt

SEQ ID NO: 952047 - DNA, 25 bp, Mus musculus
ttgcctttcattcgtagctcatttc

SEQ ID NO: 952048 - DNA, 25 bp, Mus musculus
ttgcctttcattggtagctcatttc

SEQ ID NO: 952049 - DNA, 25 bp, Mus musculus
ttgcctttccagagtctcactaact

SEQ ID NO: 952050 - DNA, 25 bp, Mus musculus
ttgcctttccagtgtctcactaact

SEQ ID NO: 952051 - DNA, 25 bp, Mus musculus
ttgcctttcccactagaactttatc

SEQ ID NO: 952052 - DNA, 25 bp, Mus musculus
ttgcctttcccagtagaactttatc

SEQ ID NO: 952053 - DNA, 25 bp, Mus musculus
ttgcctttcctgaactctgccaggg

SEQ ID NO: 952054 - DNA, 25 bp, Mus musculus
ttgcctttcctgtactctgccaggg

SEQ ID NO: 952055 - DNA, 25 bp, Mus musculus
ttgcctttcggaacctttgtatgat

SEQ ID NO: 952056 - DNA, 25 bp, Mus musculus
ttgcctttcggatcctttgtatgat

SEQ ID NO: 952057 - DNA, 25 bp, Mus musculus
ttgcctttctttaatccgtcattct

SEQ ID NO: 952058 - DNA, 25 bp, Mus musculus
ttgcctttcttttatccgtcattct

SEQ ID NO: 952059 - DNA, 25 bp, Mus musculus
ttgcctttgaagctaggtccgtgca

SEQ ID NO: 952060 - DNA, 25 bp, Mus musculus
ttgcctttgaaggtaggtccgtgca

SEQ ID NO: 952061 - DNA, 25 bp, Mus musculus
ttgcctttgaccaccatttcttaag

SEQ ID NO: 952062 - DNA, 25 bp, Mus musculus
ttgcctttgacctccatttcttaag

SEQ ID NO: 952063 - DNA, 25 bp, Mus musculus
ttgcctttgaggctcatgatcctga

SEQ ID NO: 952064 - DNA, 25 bp, Mus musculus
ttgcctttgagggtcatgatcctga

SEQ ID NO: 952065 - DNA, 25 bp, Mus musculus
ttgcctttgcatattctatcccttt

SEQ ID NO: 952066 - DNA, 25 bp, Mus musculus
ttgcctttgcattttctatcccttt

SEQ ID NO: 952067 - DNA, 25 bp, Mus musculus
ttgcctttgccaacttagggtttga

SEQ ID NO: 952068 - DNA, 25 bp, Mus musculus
ttgcctttgccatcttagggtttga

SEQ ID NO: 952069 - DNA, 25 bp, Mus musculus
ttgcctttgcttccaaagttctgtg

SEQ ID NO: 952070 - DNA, 25 bp, Mus musculus
ttgcctttgcttgcaaagttctgtg

SEQ ID NO: 952071 - DNA, 25 bp, Mus musculus
ttgccttttaaaccttgtagttatg

SEQ ID NO: 952072 - DNA, 25 bp, Mus musculus
ttgccttttaaagcttgtagttatg

SEQ ID NO: 952073 - DNA, 25 bp, Mus musculus
ttgccttttaagatcctacagacca

SEQ ID NO: 952074 - DNA, 25 bp, Mus musculus
ttgccttttaagttcctacagacca

SEQ ID NO: 952075 - DNA, 25 bp, Mus musculus
ttgccttttacgcactttgttccag

SEQ ID NO: 952076 - DNA, 25 bp, Mus musculus
ttgccttttacggactttgttccag

SEQ ID NO: 952077 - DNA, 25 bp, Mus musculus
ttgccttttagtctctataacaata

SEQ ID NO: 952078 - DNA, 25 bp, Mus musculus
ttgccttttagtgtctataacaata

SEQ ID NO: 952079 - DNA, 25 bp, Mus musculus
ttgccttttatcatttcacttgaaa

SEQ ID NO: 952080 - DNA, 25 bp, Mus musculus
ttgccttttatcttttcacttgaaa

SEQ ID NO: 952081 - DNA, 25 bp, Mus musculus
ttgccttttcacacaagccacatgc

SEQ ID NO: 952082 - DNA, 25 bp, Mus musculus
ttgccttttcactcaagccacatgc

SEQ ID NO: 952083 - DNA, 25 bp, Mus musculus
ttgccttttgaccttctggaaacag

SEQ ID NO: 952084 - DNA, 25 bp, Mus musculus
ttgccttttgacgttctggaaacag

SEQ ID NO: 952085 - DNA, 25 bp, Mus musculus
ttgccttttgggaatgaagcctact

SEQ ID NO: 952086 - DNA, 25 bp, Mus musculus
ttgccttttgggtatgaagcctact

SEQ ID NO: 952087 - DNA, 25 bp, Mus musculus
ttgccttttgtgcagtttcctttct

SEQ ID NO: 952088 - DNA, 25 bp, Mus musculus
ttgccttttgtggagtttcctttct

SEQ ID NO: 952089 - DNA, 25 bp, Mus musculus
ttgcctttttcaagcctttcaggaa

SEQ ID NO: 952090 - DNA, 25 bp, Mus musculus
ttgcctttttcatgcctttcaggaa

SEQ ID NO: 952091 - DNA, 25 bp, Mus musculus
ttgcgaactatcagtagaactgaca

SEQ ID NO: 952092 - DNA, 25 bp, Mus musculus
ttgcgaactatctgtagaactgaca

SEQ ID NO: 952093 - DNA, 25 bp, Mus musculus
ttgcgaactgttaggcttacggaat

SEQ ID NO: 952094 - DNA, 25 bp, Mus musculus
ttgcgaactgtttggcttacggaat

SEQ ID NO: 952095 - DNA, 25 bp, Mus musculus
ttgcgaagttctcctttacccagac

SEQ ID NO: 952096 - DNA, 25 bp, Mus musculus
ttgcgaagttctgctttacccagac

SEQ ID NO: 952097 - DNA, 25 bp, Mus musculus
ttgcgacaaggactctcagtgcgga

SEQ ID NO: 952098 - DNA, 25 bp, Mus musculus
ttgcgacaaggagtctcagtgcgga

SEQ ID NO: 952099 - DNA, 25 bp, Mus musculus
ttgcgacaccgacattttgatttga

SEQ ID NO: 952100 - DNA, 25 bp, Mus musculus
ttgcgacaccgagattttgatttga

SEQ ID NO: 952101 - DNA, 25 bp, Mus musculus
ttgcgacacttaattctttgcccca

SEQ ID NO: 952102 - DNA, 25 bp, Mus musculus
ttgcgacacttatttctttgcccca

SEQ ID NO: 952103 - DNA, 25 bp, Mus musculus
ttgcgaccaaacagcccaaaggcga

SEQ ID NO: 952104 - DNA, 25 bp, Mus musculus
ttgcgaccaaactgcccaaaggcga

SEQ ID NO: 952105 - DNA, 25 bp, Mus musculus
ttgcgacccactattttaaagacat

SEQ ID NO: 952106 - DNA, 25 bp, Mus musculus
ttgcgacccacttttttaaagacat

SEQ ID NO: 952107 - DNA, 25 bp, Mus musculus
ttgcgacgtctgaggacctgtacca

SEQ ID NO: 952108 - DNA, 25 bp, Mus musculus
ttgcgacgtctgtggacctgtacca

SEQ ID NO: 952109 - DNA, 25 bp, Mus musculus
ttgcgactagacattaaactttgct

SEQ ID NO: 952110 - DNA, 25 bp, Mus musculus
ttgcgactagactttaaactttgct

SEQ ID NO: 952111 - DNA, 25 bp, Mus musculus
ttgcgaggaaataatgtacctgcca

SEQ ID NO: 952112 - DNA, 25 bp, Mus musculus
ttgcgaggaaattatgtacctgcca

SEQ ID NO: 952113 - DNA, 25 bp, Mus musculus
ttgcgaggctgcacccagcgtgttg

SEQ ID NO: 952114 - DNA, 25 bp, Mus musculus
ttgcgaggctgctcccagcgtgttg

SEQ ID NO: 952115 - DNA, 25 bp, Mus musculus
ttgcgagggtgtactgaagctttct

SEQ ID NO: 952116 - DNA, 25 bp, Mus musculus
ttgcgagggtgttctgaagctttct

SEQ ID NO: 952117 - DNA, 25 bp, Mus musculus
ttgcgagtactcaacaccaacatcg

SEQ ID NO: 952118 - DNA, 25 bp, Mus musculus
ttgcgagtactctacaccaacatcg

SEQ ID NO: 952119 - DNA, 25 bp, Mus musculus
ttgcgagtcatcatccaagaaatgc

SEQ ID NO: 952120 - DNA, 25 bp, Mus musculus
ttgcgagtcatcttccaagaaatgc

SEQ ID NO: 952121 - DNA, 25 bp, Mus musculus
ttgcgataccgtccagtaccaaact

SEQ ID NO: 952122 - DNA, 25 bp, Mus musculus
ttgcgataccgtgcagtaccaaact

SEQ ID NO: 952123 - DNA, 25 bp, Mus musculus
ttgcgatatgcccagactcatggca

SEQ ID NO: 952124 - DNA, 25 bp, Mus musculus
ttgcgatatgccgagactcatggca

SEQ ID NO: 952125 - DNA, 25 bp, Mus musculus
ttgcgatccgatatagtcagtacta

SEQ ID NO: 952126 - DNA, 25 bp, Mus musculus
ttgcgatccgatttagtcagtacta

SEQ ID NO: 952127 - DNA, 25 bp, Mus musculus
ttgcgatggatcacttcggcctgta

SEQ ID NO: 952128 - DNA, 25 bp, Mus musculus
ttgcgatggatctcttcggcctgta

SEQ ID NO: 952129 - DNA, 25 bp, Mus musculus
ttgcgatgtgccaatgtctccatca

SEQ ID NO: 952130 - DNA, 25 bp, Mus musculus
ttgcgatgtgcctatgtctccatca

SEQ ID NO: 952131 - DNA, 25 bp, Mus musculus
ttgcgattctctattatactcccac

SEQ ID NO: 952132 - DNA, 25 bp, Mus musculus
ttgcgattctcttttatactcccac

SEQ ID NO: 952133 - DNA, 25 bp, Mus musculus
ttgcgatttttcattcacgggactt

SEQ ID NO: 952134 - DNA, 25 bp, Mus musculus
ttgcgatttttctttcacgggactt

SEQ ID NO: 952135 - DNA, 25 bp, Mus musculus
ttgcgcaccactcacacaacagaat

SEQ ID NO: 952136 - DNA, 25 bp, Mus musculus
ttgcgcaccactgacacaacagaat

SEQ ID NO: 952137 - DNA, 25 bp, Mus musculus
ttgcgcacccctcaggaagttagag

SEQ ID NO: 952138 - DNA, 25 bp, Mus musculus
ttgcgcacccctgaggaagttagag

SEQ ID NO: 952139 - DNA, 25 bp, Mus musculus
ttgcgcaccgatatccgggtgaagc

SEQ ID NO: 952140 - DNA, 25 bp, Mus musculus
ttgcgcaccgatttccgggtgaagc

SEQ ID NO: 952141 - DNA, 25 bp, Mus musculus
ttgcgcacttgtactcacgggaaac

SEQ ID NO: 952142 - DNA, 25 bp, Mus musculus
ttgcgcacttgttctcacgggaaac

SEQ ID NO: 952143 - DNA, 25 bp, Mus musculus
ttgcgcagcacccatctgagagctg

SEQ ID NO: 952144 - DNA, 25 bp, Mus musculus
ttgcgcagcaccgatctgagagctg

SEQ ID NO: 952145 - DNA, 25 bp, Mus musculus
ttgcgcatcttcagtggctcttcag

SEQ ID NO: 952146 - DNA, 25 bp, Mus musculus
ttgcgcatcttctgtggctcttcag

SEQ ID NO: 952147 - DNA, 25 bp, Mus musculus
ttgcgccaatttacacaagtgtttg

SEQ ID NO: 952148 - DNA, 25 bp, Mus musculus
ttgcgccaattttcacaagtgtttg

SEQ ID NO: 952149 - DNA, 25 bp, Mus musculus
ttgcgccacccgaatattactgttt

SEQ ID NO: 952150 - DNA, 25 bp, Mus musculus
ttgcgccacccgtatattactgttt

SEQ ID NO: 952151 - DNA, 25 bp, Mus musculus
ttgcgcctagggagttttccagata

SEQ ID NO: 952152 - DNA, 25 bp, Mus musculus
ttgcgcctagggtgttttccagata

SEQ ID NO: 952153 - DNA, 25 bp, Mus musculus
ttgcgcctctgtctatgtagtctag

SEQ ID NO: 952154 - DNA, 25 bp, Mus musculus
ttgcgcctctgtgtatgtagtctag

SEQ ID NO: 952155 - DNA, 25 bp, Mus musculus
ttgcgccttgacactccttggttga

SEQ ID NO: 952156 - DNA, 25 bp, Mus musculus
ttgcgccttgactctccttggttga

SEQ ID NO: 952157 - DNA, 25 bp, Mus musculus
ttgcgccttgctacgggagactgag

SEQ ID NO: 952158 - DNA, 25 bp, Mus musculus
ttgcgccttgcttcgggagactgag

SEQ ID NO: 952159 - DNA, 25 bp, Mus musculus
ttgcgcctttccaatgtctatgact

SEQ ID NO: 952160 - DNA, 25 bp, Mus musculus
ttgcgcctttcctatgtctatgact

SEQ ID NO: 952161 - DNA, 25 bp, Mus musculus
ttgcgcgctcagattggtcaggacc

SEQ ID NO: 952162 - DNA, 25 bp, Mus musculus
ttgcgcgctcagtttggtcaggacc

SEQ ID NO: 952163 - DNA, 25 bp, Mus musculus
ttgcgctaacagagcatgcaggaca

SEQ ID NO: 952164 - DNA, 25 bp, Mus musculus
ttgcgctaacagtgcatgcaggaca

SEQ ID NO: 952165 - DNA, 25 bp, Mus musculus
ttgcgctacacaattttcagttatt

SEQ ID NO: 952166 - DNA, 25 bp, Mus musculus
ttgcgctacacatttttcagttatt

SEQ ID NO: 952167 - DNA, 25 bp, Mus musculus
ttgcgctaccagcaagtggccggcc

SEQ ID NO: 952168 - DNA, 25 bp, Mus musculus
ttgcgctaccaggaagtggccggcc

SEQ ID NO: 952169 - DNA, 25 bp, Mus musculus
ttgcgctacccgcatagaagtccaa

SEQ ID NO: 952170 - DNA, 25 bp, Mus musculus
ttgcgctacccggatagaagtccaa

SEQ ID NO: 952171 - DNA, 25 bp, Mus musculus
ttgcgctcacttctggacatctaaa

SEQ ID NO: 952172 - DNA, 25 bp, Mus musculus
ttgcgctcacttgtggacatctaaa

SEQ ID NO: 952173 - DNA, 25 bp, Mus musculus
ttgcgctccatgctctagatctgga

SEQ ID NO: 952174 - DNA, 25 bp, Mus musculus
ttgcgctccatggtctagatctgga

SEQ ID NO: 952175 - DNA, 25 bp, Mus musculus
ttgcgctctcgcatcttgctcctga

SEQ ID NO: 952176 - DNA, 25 bp, Mus musculus
ttgcgctctcgcttcttgctcctga

SEQ ID NO: 952177 - DNA, 25 bp, Mus musculus
ttgcgctcttctcacagggctggga

SEQ ID NO: 952178 - DNA, 25 bp, Mus musculus
ttgcgctcttctgacagggctggga

SEQ ID NO: 952179 - DNA, 25 bp, Mus musculus
ttgcgctgccctaatagtactgaga

SEQ ID NO: 952180 - DNA, 25 bp, Mus musculus
ttgcgctgcccttatagtactgaga

SEQ ID NO: 952181 - DNA, 25 bp, Mus musculus
ttgcgcttcaagatctacttcagtt

SEQ ID NO: 952182 - DNA, 25 bp, Mus musculus
ttgcgcttcaagttctacttcagtt

SEQ ID NO: 952183 - DNA, 25 bp, Mus musculus
ttgcgcttcagtacttactgcacat

SEQ ID NO: 952184 - DNA, 25 bp, Mus musculus
ttgcgcttcagttcttactgcacat

SEQ ID NO: 952185 - DNA, 25 bp, Mus musculus
ttgcgcttctatctccagggcagcc

SEQ ID NO: 952186 - DNA, 25 bp, Mus musculus
ttgcgcttctatgtccagggcagcc

SEQ ID NO: 952187 - DNA, 25 bp, Mus musculus
ttgcgcttctccatctattaggaac

SEQ ID NO: 952188 - DNA, 25 bp, Mus musculus
ttgcgcttctccttctattaggaac

SEQ ID NO: 952189 - DNA, 25 bp, Mus musculus
ttgcgcttctgactgttaaacacca

SEQ ID NO: 952190 - DNA, 25 bp, Mus musculus
ttgcgcttctgagtgttaaacacca

SEQ ID NO: 952191 - DNA, 25 bp, Mus musculus
ttgcgcttgctcatgtggtcttttc

SEQ ID NO: 952192 - DNA, 25 bp, Mus musculus
ttgcgcttgctcttgtggtcttttc

SEQ ID NO: 952193 - DNA, 25 bp, Mus musculus
ttgcggaaccccagtctgtaagaga

SEQ ID NO: 952194 - DNA, 25 bp, Mus musculus
ttgcggaacccctgtctgtaagaga

SEQ ID NO: 952195 - DNA, 25 bp, Mus musculus
ttgcggaacttcagtaccacaatct

SEQ ID NO: 952196 - DNA, 25 bp, Mus musculus
ttgcggaacttctgtaccacaatct

SEQ ID NO: 952197 - DNA, 25 bp, Mus musculus
ttgcggaccagcaggtatcagactt

SEQ ID NO: 952198 - DNA, 25 bp, Mus musculus
ttgcggaccagctggtatcagactt

SEQ ID NO: 952199 - DNA, 25 bp, Mus musculus
ttgcggactccccaagataatgctc

SEQ ID NO: 952200 - DNA, 25 bp, Mus musculus
ttgcggactcccgaagataatgctc

SEQ ID NO: 952201 - DNA, 25 bp, Mus musculus
ttgcggacttgtccatggtcacttg

SEQ ID NO: 952202 - DNA, 25 bp, Mus musculus
ttgcggacttgtgcatggtcacttg

SEQ ID NO: 952203 - DNA, 25 bp, Mus musculus
ttgcggagcaggcactgaagcacct

SEQ ID NO: 952204 - DNA, 25 bp, Mus musculus
ttgcggagcagggactgaagcacct

SEQ ID NO: 952205 - DNA, 25 bp, Mus musculus
ttgcggagccacaggcatcagatgg

SEQ ID NO: 952206 - DNA, 25 bp, Mus musculus
ttgcggagccactggcatcagatgg

SEQ ID NO: 952207 - DNA, 25 bp, Mus musculus
ttgcggatagacatgtaagggtgtt

SEQ ID NO: 952208 - DNA, 25 bp, Mus musculus
ttgcggatagacttgtaagggtgtt

SEQ ID NO: 952209 - DNA, 25 bp, Mus musculus
ttgcggatagtcaggtcccagtgcc

SEQ ID NO: 952210 - DNA, 25 bp, Mus musculus
ttgcggatagtctggtcccagtgcc

SEQ ID NO: 952211 - DNA, 25 bp, Mus musculus
ttgcggcaaataaagctgaagaagc

SEQ ID NO: 952212 - DNA, 25 bp, Mus musculus
ttgcggcaaatatagctgaagaagc

SEQ ID NO: 952213 - DNA, 25 bp, Mus musculus
ttgcggcaatcaagcctgggttcac

SEQ ID NO: 952214 - DNA, 25 bp, Mus musculus
ttgcggcaatcatgcctgggttcac

SEQ ID NO: 952215 - DNA, 25 bp, Mus musculus
ttgcggccagacaacaagctgcttg

SEQ ID NO: 952216 - DNA, 25 bp, Mus musculus
ttgcggccagactacaagctgcttg

SEQ ID NO: 952217 - DNA, 25 bp, Mus musculus
ttgcggcccataacaagaaggagtt

SEQ ID NO: 952218 - DNA, 25 bp, Mus musculus
ttgcggcccatatcaagaaggagtt

SEQ ID NO: 952219 - DNA, 25 bp, Mus musculus
ttgcggcgccatagtaacatccatg

SEQ ID NO: 952220 - DNA, 25 bp, Mus musculus
ttgcggcgccattgtaacatccatg

SEQ ID NO: 952221 - DNA, 25 bp, Mus musculus
ttgcggcggacacttccggattaga

SEQ ID NO: 952222 - DNA, 25 bp, Mus musculus
ttgcggcggacagttccggattaga

SEQ ID NO: 952223 - DNA, 25 bp, Mus musculus
ttgcggctcaggatactcagcctag

SEQ ID NO: 952224 - DNA, 25 bp, Mus musculus
ttgcggctcaggttactcagcctag

SEQ ID NO: 952225 - DNA, 25 bp, Mus musculus
ttgcggctccagaggactcagaaaa

SEQ ID NO: 952226 - DNA, 25 bp, Mus musculus
ttgcggctccagtggactcagaaaa

SEQ ID NO: 952227 - DNA, 25 bp, Mus musculus
ttgcggctcctgcagactgacaagg

SEQ ID NO: 952228 - DNA, 25 bp, Mus musculus
ttgcggctcctggagactgacaagg

SEQ ID NO: 952229 - DNA, 25 bp, Mus musculus
ttgcggctcttaacctttgacattt

SEQ ID NO: 952230 - DNA, 25 bp, Mus musculus
ttgcggctcttatcctttgacattt

SEQ ID NO: 952231 - DNA, 25 bp, Mus musculus
ttgcggctcttcacgcactccatgc

SEQ ID NO: 952232 - DNA, 25 bp, Mus musculus
ttgcggctcttctcgcactccatgc

SEQ ID NO: 952233 - DNA, 25 bp, Mus musculus
ttgcgggaccctacaatcgttgggt

SEQ ID NO: 952234 - DNA, 25 bp, Mus musculus
ttgcgggaccctacgagaaccacct

SEQ ID NO: 952235 - DNA, 25 bp, Mus musculus
ttgcgggacccttcaatcgttgggt

SEQ ID NO: 952236 - DNA, 25 bp, Mus musculus
ttgcgggacccttcgagaaccacct

SEQ ID NO: 952237 - DNA, 25 bp, Mus musculus
ttgcgggcagaactaatgggaataa

SEQ ID NO: 952238 - DNA, 25 bp, Mus musculus
ttgcgggcagaagtaatgggaataa

SEQ ID NO: 952239 - DNA, 25 bp, Mus musculus
ttgcgggccgcgctgagaatcaata

SEQ ID NO: 952240 - DNA, 25 bp, Mus musculus
ttgcgggccgcggtgagaatcaata

SEQ ID NO: 952241 - DNA, 25 bp, Mus musculus
ttgcgggctccgcagtgaagctaca

SEQ ID NO: 952242 - DNA, 25 bp, Mus musculus
ttgcgggctccggagtgaagctaca

SEQ ID NO: 952243 - DNA, 25 bp, Mus musculus
ttgcgggggtgaatcctcagctgca

SEQ ID NO: 952244 - DNA, 25 bp, Mus musculus
ttgcgggggtgattcctcagctgca

SEQ ID NO: 952245 - DNA, 25 bp, Mus musculus
ttgcgggtagagactcccctggact

SEQ ID NO: 952246 - DNA, 25 bp, Mus musculus
ttgcgggtagagtctcccctggact

SEQ ID NO: 952247 - DNA, 25 bp, Mus musculus
ttgcggtaccgactagatttccagg

SEQ ID NO: 952248 - DNA, 25 bp, Mus musculus
ttgcggtaccgagtagatttccagg

SEQ ID NO: 952249 - DNA, 25 bp, Mus musculus
ttgcggtactacacatctgcttctg

SEQ ID NO: 952250 - DNA, 25 bp, Mus musculus
ttgcggtactactcatctgcttctg

SEQ ID NO: 952251 - DNA, 25 bp, Mus musculus
ttgcggtcgtacatgacggtgacct

SEQ ID NO: 952252 - DNA, 25 bp, Mus musculus
ttgcggtcgtacttgacggtgacct

SEQ ID NO: 952253 - DNA, 25 bp, Mus musculus
ttgcggtcttatacagactcctagc

SEQ ID NO: 952254 - DNA, 25 bp, Mus musculus
ttgcggtcttattcagactcctagc

SEQ ID NO: 952255 - DNA, 25 bp, Mus musculus
ttgcggtgtgtgaccttagtagccc

SEQ ID NO: 952256 - DNA, 25 bp, Mus musculus
ttgcggtgtgtgtccttagtagccc

SEQ ID NO: 952257 - DNA, 25 bp, Mus musculus
ttgcggtttgccaacatcttagaag

SEQ ID NO: 952258 - DNA, 25 bp, Mus musculus
ttgcggtttgcctacatcttagaag

SEQ ID NO: 952259 - DNA, 25 bp, Mus musculus
ttgcgtaaccacacaactagattat

SEQ ID NO: 952260 - DNA, 25 bp, Mus musculus
ttgcgtaaccactcaactagattat

SEQ ID NO: 952261 - DNA, 25 bp, Mus musculus
ttgcgtacccagaagcttttatact

SEQ ID NO: 952262 - DNA, 25 bp, Mus musculus
ttgcgtacccagtagcttttatact

SEQ ID NO: 952263 - DNA, 25 bp, Mus musculus
ttgcgtacccggcatatggtccgtg

SEQ ID NO: 952264 - DNA, 25 bp, Mus musculus
ttgcgtacccgggatatggtccgtg

SEQ ID NO: 952265 - DNA, 25 bp, Mus musculus
ttgcgtacgcctattctatcaagtg

SEQ ID NO: 952266 - DNA, 25 bp, Mus musculus
ttgcgtacgccttttctatcaagtg

SEQ ID NO: 952267 - DNA, 25 bp, Mus musculus
ttgcgtacggtgatgagtctcccaa

SEQ ID NO: 952268 - DNA, 25 bp, Mus musculus
ttgcgtacggtgttgagtctcccaa

SEQ ID NO: 952269 - DNA, 25 bp, Mus musculus
ttgcgtactccccagggctagagag

SEQ ID NO: 952270 - DNA, 25 bp, Mus musculus
ttgcgtactcccgagggctagagag

SEQ ID NO: 952271 - DNA, 25 bp, Mus musculus
ttgcgtagggccaaagcactctttg

SEQ ID NO: 952272 - DNA, 25 bp, Mus musculus
ttgcgtagggcctaagcactctttg

SEQ ID NO: 952273 - DNA, 25 bp, Mus musculus
ttgcgtatgcagacaggacactcct

SEQ ID NO: 952274 - DNA, 25 bp, Mus musculus
ttgcgtatgcagtcaggacactcct

SEQ ID NO: 952275 - DNA, 25 bp, Mus musculus
ttgcgtatggtgacttggtttgttt

SEQ ID NO: 952276 - DNA, 25 bp, Mus musculus
ttgcgtatggtgtcttggtttgttt

SEQ ID NO: 952277 - DNA, 25 bp, Mus musculus
ttgcgtccagccatgggatgtggca

SEQ ID NO: 952278 - DNA, 25 bp, Mus musculus
ttgcgtccagccttgggatgtggca

SEQ ID NO: 952279 - DNA, 25 bp, Mus musculus
ttgcgtccataaactgggctccaga

SEQ ID NO: 952280 - DNA, 25 bp, Mus musculus
ttgcgtccataatctgggctccaga

SEQ ID NO: 952281 - DNA, 25 bp, Mus musculus
ttgcgtcctcatagcgtgagcaagt

SEQ ID NO: 952282 - DNA, 25 bp, Mus musculus
ttgcgtcctcattgcgtgagcaagt

SEQ ID NO: 952283 - DNA, 25 bp, Mus musculus
ttgcgtcctgtcatgtggcctggtc

SEQ ID NO: 952284 - DNA, 25 bp, Mus musculus
ttgcgtcctgtcttgtggcctggtc

SEQ ID NO: 952285 - DNA, 25 bp, Mus musculus
ttgcgtctaaatctgtttctccaca

SEQ ID NO: 952286 - DNA, 25 bp, Mus musculus
ttgcgtctaaatgtgtttctccaca

SEQ ID NO: 952287 - DNA, 25 bp, Mus musculus
ttgcgtctggatctgcgctgtagca

SEQ ID NO: 952288 - DNA, 25 bp, Mus musculus
ttgcgtctggatgtgcgctgtagca

SEQ ID NO: 952289 - DNA, 25 bp, Mus musculus
ttgcgtgagactaggaccctgtcca

SEQ ID NO: 952290 - DNA, 25 bp, Mus musculus
ttgcgtgagacttggaccctgtcca

SEQ ID NO: 952291 - DNA, 25 bp, Mus musculus
ttgcgtgagctaaccctgagtccag

SEQ ID NO: 952292 - DNA, 25 bp, Mus musculus
ttgcgtgagctatccctgagtccag

SEQ ID NO: 952293 - DNA, 25 bp, Mus musculus
ttgcgtgaggaaacccaacagtgaa

SEQ ID NO: 952294 - DNA, 25 bp, Mus musculus
ttgcgtgaggaatcccaacagtgaa

SEQ ID NO: 952295 - DNA, 25 bp, Mus musculus
ttgcgtgagtcacatgttcagctgt

SEQ ID NO: 952296 - DNA, 25 bp, Mus musculus
ttgcgtgagtcagatgttcagctgt

SEQ ID NO: 952297 - DNA, 25 bp, Mus musculus
ttgcgtgctgcaatggtattgctct

SEQ ID NO: 952298 - DNA, 25 bp, Mus musculus
ttgcgtgctgcattggtattgctct

SEQ ID NO: 952299 - DNA, 25 bp, Mus musculus
ttgcgtgctggtctgagctaagcca

SEQ ID NO: 952300 - DNA, 25 bp, Mus musculus
ttgcgtgctggtgtgagctaagcca

SEQ ID NO: 952301 - DNA, 25 bp, Mus musculus
ttgcgtggccgacggcttccgggag

SEQ ID NO: 952302 - DNA, 25 bp, Mus musculus
ttgcgtggccgagggcttccgggag

SEQ ID NO: 952303 - DNA, 25 bp, Mus musculus
ttgcgtgtacttagaagaatggaat

SEQ ID NO: 952304 - DNA, 25 bp, Mus musculus
ttgcgtgtactttgaagaatggaat

SEQ ID NO: 952305 - DNA, 25 bp, Mus musculus
ttgcgtgtgtttcagtacaggacct

SEQ ID NO: 952306 - DNA, 25 bp, Mus musculus
ttgcgtgtgtttgagtacaggacct

SEQ ID NO: 952307 - DNA, 25 bp, Mus musculus
ttgcgttcaaagactgccctcagac

SEQ ID NO: 952308 - DNA, 25 bp, Mus musculus
ttgcgttcaaagtctgccctcagac

SEQ ID NO: 952309 - DNA, 25 bp, Mus musculus
ttgcgttcagagactcgctttcctg

SEQ ID NO: 952310 - DNA, 25 bp, Mus musculus
ttgcgttcagagtctcgctttcctg

SEQ ID NO: 952311 - DNA, 25 bp, Mus musculus
ttgcgttccttaactactggctggc

SEQ ID NO: 952312 - DNA, 25 bp, Mus musculus
ttgcgttccttatctactggctggc

SEQ ID NO: 952313 - DNA, 25 bp, Mus musculus
ttgcgttcgttcaccgcgcgggttc

SEQ ID NO: 952314 - DNA, 25 bp, Mus musculus
ttgcgttcgttctccgcgcgggttc

SEQ ID NO: 952315 - DNA, 25 bp, Mus musculus
ttgcgttgcaataatttagctcctg

SEQ ID NO: 952316 - DNA, 25 bp, Mus musculus
ttgcgttgcaattatttagctcctg

SEQ ID NO: 952317 - DNA, 25 bp, Mus musculus
ttgcgtttgcctcagcggatatgtt

SEQ ID NO: 952318 - DNA, 25 bp, Mus musculus
ttgcgtttgcctgagcggatatgtt

SEQ ID NO: 952319 - DNA, 25 bp, Mus musculus
ttgcgttttctgacttcacattgtc

SEQ ID NO: 952320 - DNA, 25 bp, Mus musculus
ttgcgttttctgtcttcacattgtc

SEQ ID NO: 952321 - DNA, 25 bp, Mus musculus
ttgcgtttttgtcggctcttgggaa

SEQ ID NO: 952322 - DNA, 25 bp, Mus musculus
ttgcgtttttgtgggctcttgggaa

SEQ ID NO: 952323 - DNA, 25 bp, Mus musculus
ttgctaaaattccttggcgggaatt

SEQ ID NO: 952324 - DNA, 25 bp, Mus musculus
ttgctaaaattcgttggcgggaatt

SEQ ID NO: 952325 - DNA, 25 bp, Mus musculus
ttgctaaacctgaggaaggccctgg

SEQ ID NO: 952326 - DNA, 25 bp, Mus musculus
ttgctaaacctgtggaaggccctgg

SEQ ID NO: 952327 - DNA, 25 bp, Mus musculus
ttgctaaccatcatcacaacctaga

SEQ ID NO: 952328 - DNA, 25 bp, Mus musculus
ttgctaaccatcttcacaacctaga

SEQ ID NO: 952329 - DNA, 25 bp, Mus musculus
ttgctaacccagactcgaatcatca

SEQ ID NO: 952330 - DNA, 25 bp, Mus musculus
ttgctaacccagtctcgaatcatca

SEQ ID NO: 952331 - DNA, 25 bp, Mus musculus
ttgctaactgctatctatgcccaag

SEQ ID NO: 952332 - DNA, 25 bp, Mus musculus
ttgctaactgctttctatgcccaag

SEQ ID NO: 952333 - DNA, 25 bp, Mus musculus
ttgctaactgttcctctccacttgg

SEQ ID NO: 952334 - DNA, 25 bp, Mus musculus
ttgctaactgttgctctccacttgg

SEQ ID NO: 952335 - DNA, 25 bp, Mus musculus
ttgctaagcactcgcatcatctaga

SEQ ID NO: 952336 - DNA, 25 bp, Mus musculus
ttgctaagcactggcatcatctaga

SEQ ID NO: 952337 - DNA, 25 bp, Mus musculus
ttgctaagcctcaggatcacattaa

SEQ ID NO: 952338 - DNA, 25 bp, Mus musculus
ttgctaagcctctggatcacattaa

SEQ ID NO: 952339 - DNA, 25 bp, Mus musculus
ttgctaaggacaaagttttaaccag

SEQ ID NO: 952340 - DNA, 25 bp, Mus musculus
ttgctaaggacatagttttaaccag

SEQ ID NO: 952341 - DNA, 25 bp, Mus musculus
ttgctaaggtgcagattgagactct

SEQ ID NO: 952342 - DNA, 25 bp, Mus musculus
ttgctaaggtgctgattgagactct

SEQ ID NO: 952343 - DNA, 25 bp, Mus musculus
ttgctaagtcccaaagagccactga

SEQ ID NO: 952344 - DNA, 25 bp, Mus musculus
ttgctaagtccctaagagccactga

SEQ ID NO: 952345 - DNA, 25 bp, Mus musculus
ttgctaatggccaactgagcgcgga

SEQ ID NO: 952346 - DNA, 25 bp, Mus musculus
ttgctaatggcctactgagcgcgga

SEQ ID NO: 952347 - DNA, 25 bp, Mus musculus
ttgctaattgatccctctgttgcct

SEQ ID NO: 952348 - DNA, 25 bp, Mus musculus
ttgctaattgatgcctctgttgcct

SEQ ID NO: 952349 - DNA, 25 bp, Mus musculus
ttgctacaaagaactcgacatcgtg

SEQ ID NO: 952350 - DNA, 25 bp, Mus musculus
ttgctacaaagatctcgacatcgtg

SEQ ID NO: 952351 - DNA, 25 bp, Mus musculus
ttgctacacaacaaggaatgcccat

SEQ ID NO: 952352 - DNA, 25 bp, Mus musculus
ttgctacacaactaggaatgcccat

SEQ ID NO: 952353 - DNA, 25 bp, Mus musculus
ttgctacacgtcaggcctcacagag

SEQ ID NO: 952354 - DNA, 25 bp, Mus musculus
ttgctacacgtctggcctcacagag

SEQ ID NO: 952355 - DNA, 25 bp, Mus musculus
ttgctacagaacatactccccttag

SEQ ID NO: 952356 - DNA, 25 bp, Mus musculus
ttgctacagaacttactccccttag

SEQ ID NO: 952357 - DNA, 25 bp, Mus musculus
ttgctacagatacaggaaggcctac

SEQ ID NO: 952358 - DNA, 25 bp, Mus musculus
ttgctacagatagaggaaggcctac

SEQ ID NO: 952359 - DNA, 25 bp, Mus musculus
ttgctacaggcgactggactgcttc

SEQ ID NO: 952360 - DNA, 25 bp, Mus musculus
ttgctacaggcgtctggactgcttc

SEQ ID NO: 952361 - DNA, 25 bp, Mus musculus
ttgctacaggttcgcccgttagata

SEQ ID NO: 952362 - DNA, 25 bp, Mus musculus
ttgctacaggttggcccgttagata

SEQ ID NO: 952363 - DNA, 25 bp, Mus musculus
ttgctacagttcattgtccttgggt

SEQ ID NO: 952364 - DNA, 25 bp, Mus musculus
ttgctacagttctttgtccttgggt

SEQ ID NO: 952365 - DNA, 25 bp, Mus musculus
ttgctacatccccttgcattaaatg

SEQ ID NO: 952366 - DNA, 25 bp, Mus musculus
ttgctacatcccgttgcattaaatg

SEQ ID NO: 952367 - DNA, 25 bp, Mus musculus
ttgctaccaggacaaccactacatg

SEQ ID NO: 952368 - DNA, 25 bp, Mus musculus
ttgctaccaggagaaccactacatg

SEQ ID NO: 952369 - DNA, 25 bp, Mus musculus
ttgctaccatttagatcccatactc

SEQ ID NO: 952370 - DNA, 25 bp, Mus musculus
ttgctaccattttgatcccatactc

SEQ ID NO: 952371 - DNA, 25 bp, Mus musculus
ttgctacccagcacagtcagtaata

SEQ ID NO: 952372 - DNA, 25 bp, Mus musculus
ttgctacccagctcagtcagtaata

SEQ ID NO: 952373 - DNA, 25 bp, Mus musculus
ttgctaccccatcggtcactcagtg

SEQ ID NO: 952374 - DNA, 25 bp, Mus musculus
ttgctaccccatgggtcactcagtg

SEQ ID NO: 952375 - DNA, 25 bp, Mus musculus
ttgctaccctttaggcacgtgtttt

SEQ ID NO: 952376 - DNA, 25 bp, Mus musculus
ttgctacccttttggcacgtgtttt

SEQ ID NO: 952377 - DNA, 25 bp, Mus musculus
ttgctacctaacaacgcagactcag

SEQ ID NO: 952378 - DNA, 25 bp, Mus musculus
ttgctacctaactacgcagactcag

SEQ ID NO: 952379 - DNA, 25 bp, Mus musculus
ttgctaccttttcacccttgaatat

SEQ ID NO: 952380 - DNA, 25 bp, Mus musculus
ttgctaccttttgacccttgaatat

SEQ ID NO: 952381 - DNA, 25 bp, Mus musculus
ttgctacgctttcctcaagctgctt

SEQ ID NO: 952382 - DNA, 25 bp, Mus musculus
ttgctacgctttgctcaagctgctt

SEQ ID NO: 952383 - DNA, 25 bp, Mus musculus
ttgctacggacacgccgctttgaag

SEQ ID NO: 952384 - DNA, 25 bp, Mus musculus
ttgctacggacaggccgctttgaag

SEQ ID NO: 952385 - DNA, 25 bp, Mus musculus
ttgctactcagaatcatccctgcac

SEQ ID NO: 952386 - DNA, 25 bp, Mus musculus
ttgctactcagattcatccctgcac

SEQ ID NO: 952387 - DNA, 25 bp, Mus musculus
ttgctactctcaaggaatccaggcc

SEQ ID NO: 952388 - DNA, 25 bp, Mus musculus
ttgctactctcatggaatccaggcc

SEQ ID NO: 952389 - DNA, 25 bp, Mus musculus
ttgctactctctctgatgcgctaat

SEQ ID NO: 952390 - DNA, 25 bp, Mus musculus
ttgctactctctgtgatgcgctaat

SEQ ID NO: 952391 - DNA, 25 bp, Mus musculus
ttgctactgtagctgatcttattct

SEQ ID NO: 952392 - DNA, 25 bp, Mus musculus
ttgctactgtaggtgatcttattct

SEQ ID NO: 952393 - DNA, 25 bp, Mus musculus
ttgctagagaatagctcaggctcct

SEQ ID NO: 952394 - DNA, 25 bp, Mus musculus
ttgctagagaattgctcaggctcct

SEQ ID NO: 952395 - DNA, 25 bp, Mus musculus
ttgctagagaccacctacactcaga

SEQ ID NO: 952396 - DNA, 25 bp, Mus musculus
ttgctagagacctcctacactcaga

SEQ ID NO: 952397 - DNA, 25 bp, Mus musculus
ttgctagagcatcctgggtagaatc

SEQ ID NO: 952398 - DNA, 25 bp, Mus musculus
ttgctagagcatccttgtaagcagg

SEQ ID NO: 952399 - DNA, 25 bp, Mus musculus
ttgctagagcatgctgggtagaatc

SEQ ID NO: 952400 - DNA, 25 bp, Mus musculus
ttgctagagcatgcttgtaagcagg

SEQ ID NO: 952401 - DNA, 25 bp, Mus musculus
ttgctagaggaacgcccaccctctg

SEQ ID NO: 952402 - DNA, 25 bp, Mus musculus
ttgctagaggaaggcccaccctctg

SEQ ID NO: 952403 - DNA, 25 bp, Mus musculus
ttgctagcaagcaggctggctgatt

SEQ ID NO: 952404 - DNA, 25 bp, Mus musculus
ttgctagcaagcattggcattcctt

SEQ ID NO: 952405 - DNA, 25 bp, Mus musculus
ttgctagcaagctggctggctgatt

SEQ ID NO: 952406 - DNA, 25 bp, Mus musculus
ttgctagcaagctttggcattcctt

SEQ ID NO: 952407 - DNA, 25 bp, Mus musculus
ttgctagcactacgctggcagtgag

SEQ ID NO: 952408 - DNA, 25 bp, Mus musculus
ttgctagcactaggctggcagtgag

SEQ ID NO: 952409 - DNA, 25 bp, Mus musculus
ttgctagcagagatctcttacctcc

SEQ ID NO: 952410 - DNA, 25 bp, Mus musculus
ttgctagcagagttctcttacctcc

SEQ ID NO: 952411 - DNA, 25 bp, Mus musculus
ttgctagcagctatgaccaccgtag

SEQ ID NO: 952412 - DNA, 25 bp, Mus musculus
ttgctagcagctatgtctttctttc

SEQ ID NO: 952413 - DNA, 25 bp, Mus musculus
ttgctagcagctttgaccaccgtag

SEQ ID NO: 952414 - DNA, 25 bp, Mus musculus
ttgctagcagctttgtctttctttc

SEQ ID NO: 952415 - DNA, 25 bp, Mus musculus
ttgctagccaacacttgtcagggca

SEQ ID NO: 952416 - DNA, 25 bp, Mus musculus
ttgctagccaactcttgtcagggca

SEQ ID NO: 952417 - DNA, 25 bp, Mus musculus
ttgctagccacaagcgtgtattggt

SEQ ID NO: 952418 - DNA, 25 bp, Mus musculus
ttgctagccacacaccagggttgat

SEQ ID NO: 952419 - DNA, 25 bp, Mus musculus
ttgctagccacagaccagggttgat

SEQ ID NO: 952420 - DNA, 25 bp, Mus musculus
ttgctagccacatgcgtgtattggt

SEQ ID NO: 952421 - DNA, 25 bp, Mus musculus
ttgctagctcatcctgtcgtttgat

SEQ ID NO: 952422 - DNA, 25 bp, Mus musculus
ttgctagctcatgctgtcgtttgat

SEQ ID NO: 952423 - DNA, 25 bp, Mus musculus
ttgctaggagacaccgccagtctat

SEQ ID NO: 952424 - DNA, 25 bp, Mus musculus
ttgctaggagacaccttgcagccac

SEQ ID NO: 952425 - DNA, 25 bp, Mus musculus
ttgctaggagactccgccagtctat

SEQ ID NO: 952426 - DNA, 25 bp, Mus musculus
ttgctaggagactccttgcagccac

SEQ ID NO: 952427 - DNA, 25 bp, Mus musculus
ttgctaggcttgaataagggtaaat

SEQ ID NO: 952428 - DNA, 25 bp, Mus musculus
ttgctaggcttgtataagggtaaat

SEQ ID NO: 952429 - DNA, 25 bp, Mus musculus
ttgctagggatcaacaccctccctg

SEQ ID NO: 952430 - DNA, 25 bp, Mus musculus
ttgctagggatctacaccctccctg

SEQ ID NO: 952431 - DNA, 25 bp, Mus musculus
ttgctagggccaagctgagagctca

SEQ ID NO: 952432 - DNA, 25 bp, Mus musculus
ttgctagggccatgctgagagctca

SEQ ID NO: 952433 - DNA, 25 bp, Mus musculus
ttgctagtatgtctgcgctcacccg

SEQ ID NO: 952434 - DNA, 25 bp, Mus musculus
ttgctagtatgtgtgcgctcacccg

SEQ ID NO: 952435 - DNA, 25 bp, Mus musculus
ttgctagtcagcaggccctttaaga

SEQ ID NO: 952436 - DNA, 25 bp, Mus musculus
ttgctagtcagctggccctttaaga

SEQ ID NO: 952437 - DNA, 25 bp, Mus musculus
ttgctagtccctatgctgagcactt

SEQ ID NO: 952438 - DNA, 25 bp, Mus musculus
ttgctagtccctttgctgagcactt

SEQ ID NO: 952439 - DNA, 25 bp, Mus musculus
ttgctagtgttgagacatctgcctt

SEQ ID NO: 952440 - DNA, 25 bp, Mus musculus
ttgctagtgttgtgacatctgcctt

SEQ ID NO: 952441 - DNA, 25 bp, Mus musculus
ttgctagttttcaggttcgcaccag

SEQ ID NO: 952442 - DNA, 25 bp, Mus musculus
ttgctagttttctggttcgcaccag

SEQ ID NO: 952443 - DNA, 25 bp, Mus musculus
ttgctatacctgaaagctgacccag

SEQ ID NO: 952444 - DNA, 25 bp, Mus musculus
ttgctatacctgtaagctgacccag

SEQ ID NO: 952445 - DNA, 25 bp, Mus musculus
ttgctatcaacccttcccgtgggtt

SEQ ID NO: 952446 - DNA, 25 bp, Mus musculus
ttgctatcaaccgttcccgtgggtt

SEQ ID NO: 952447 - DNA, 25 bp, Mus musculus
ttgctatcatggcattcattggctt

SEQ ID NO: 952448 - DNA, 25 bp, Mus musculus
ttgctatcatgggattcattggctt

SEQ ID NO: 952449 - DNA, 25 bp, Mus musculus
ttgctatccatgcagcctttgggcc

SEQ ID NO: 952450 - DNA, 25 bp, Mus musculus
ttgctatccatggagcctttgggcc

SEQ ID NO: 952451 - DNA, 25 bp, Mus musculus
ttgctatcccagaaagcccctaaac

SEQ ID NO: 952452 - DNA, 25 bp, Mus musculus
ttgctatcccagtaagcccctaaac

SEQ ID NO: 952453 - DNA, 25 bp, Mus musculus
ttgctatcctagagctttctgactc

SEQ ID NO: 952454 - DNA, 25 bp, Mus musculus
ttgctatcctagtgctttctgactc

SEQ ID NO: 952455 - DNA, 25 bp, Mus musculus
ttgctatcgtttagactttccaccc

SEQ ID NO: 952456 - DNA, 25 bp, Mus musculus
ttgctatcgttttgactttccaccc

SEQ ID NO: 952457 - DNA, 25 bp, Mus musculus
ttgctatctgacatcatctcatctg

SEQ ID NO: 952458 - DNA, 25 bp, Mus musculus
ttgctatctgacttcatctcatctg

SEQ ID NO: 952459 - DNA, 25 bp, Mus musculus
ttgctatcttctaccttgttaatta

SEQ ID NO: 952460 - DNA, 25 bp, Mus musculus
ttgctatcttcttccttgttaatta

SEQ ID NO: 952461 - DNA, 25 bp, Mus musculus
ttgctatgataaactctgtggttta

SEQ ID NO: 952462 - DNA, 25 bp, Mus musculus
ttgctatgataatctctgtggttta

SEQ ID NO: 952463 - DNA, 25 bp, Mus musculus
ttgctatgcagccaatgatgtcctt

SEQ ID NO: 952464 - DNA, 25 bp, Mus musculus
ttgctatgcagcgaatgatgtcctt

SEQ ID NO: 952465 - DNA, 25 bp, Mus musculus
ttgctatgcagtagagcagcagtat

SEQ ID NO: 952466 - DNA, 25 bp, Mus musculus
ttgctatgcagttgagcagcagtat

SEQ ID NO: 952467 - DNA, 25 bp, Mus musculus
ttgctatgcgctctactgtgtagcc

SEQ ID NO: 952468 - DNA, 25 bp, Mus musculus
ttgctatgcgctgtactgtgtagcc

SEQ ID NO: 952469 - DNA, 25 bp, Mus musculus
ttgctatgctggaatctctgacttc

SEQ ID NO: 952470 - DNA, 25 bp, Mus musculus
ttgctatgctggtatctctgacttc

SEQ ID NO: 952471 - DNA, 25 bp, Mus musculus
ttgctatggaatactctttggaccc

SEQ ID NO: 952472 - DNA, 25 bp, Mus musculus
ttgctatggaattctctttggaccc

SEQ ID NO: 952473 - DNA, 25 bp, Mus musculus
ttgctatggatgcattctcttcttc

SEQ ID NO: 952474 - DNA, 25 bp, Mus musculus
ttgctatggatggattctcttcttc

SEQ ID NO: 952475 - DNA, 25 bp, Mus musculus
ttgctatgggacagagctaactgct

SEQ ID NO: 952476 - DNA, 25 bp, Mus musculus
ttgctatgggactgagctaactgct

SEQ ID NO: 952477 - DNA, 25 bp, Mus musculus
ttgctatgggtgctaatgaactctt

SEQ ID NO: 952478 - DNA, 25 bp, Mus musculus
ttgctatgggtggtaatgaactctt

SEQ ID NO: 952479 - DNA, 25 bp, Mus musculus
ttgctatgtactactagtctgtccc

SEQ ID NO: 952480 - DNA, 25 bp, Mus musculus
ttgctatgtacttctagtctgtccc

SEQ ID NO: 952481 - DNA, 25 bp, Mus musculus
ttgctatgtattccaggcaggagcc

SEQ ID NO: 952482 - DNA, 25 bp, Mus musculus
ttgctatgtattgcaggcaggagcc

SEQ ID NO: 952483 - DNA, 25 bp, Mus musculus
ttgctattacacaacaatgaccagg

SEQ ID NO: 952484 - DNA, 25 bp, Mus musculus
ttgctattacactacaatgaccagg

SEQ ID NO: 952485 - DNA, 25 bp, Mus musculus
ttgctattactcatcagtcctttat

SEQ ID NO: 952486 - DNA, 25 bp, Mus musculus
ttgctattactcttcagtcctttat

SEQ ID NO: 952487 - DNA, 25 bp, Mus musculus
ttgctattccacctttcaggacaca

SEQ ID NO: 952488 - DNA, 25 bp, Mus musculus
ttgctattccacgtttcaggacaca

SEQ ID NO: 952489 - DNA, 25 bp, Mus musculus
ttgctattccatcagtcttgctctg

SEQ ID NO: 952490 - DNA, 25 bp, Mus musculus
ttgctattccatgagtcttgctctg

SEQ ID NO: 952491 - DNA, 25 bp, Mus musculus
ttgctattccttaaacatcgtttgt

SEQ ID NO: 952492 - DNA, 25 bp, Mus musculus
ttgctattcctttaacatcgtttgt

SEQ ID NO: 952493 - DNA, 25 bp, Mus musculus
ttgctattctaacgctgaaagctgc

SEQ ID NO: 952494 - DNA, 25 bp, Mus musculus
ttgctattctaaggctgaaagctgc

SEQ ID NO: 952495 - DNA, 25 bp, Mus musculus
ttgctattcttcaggactcagctct

SEQ ID NO: 952496 - DNA, 25 bp, Mus musculus
ttgctattcttctggactcagctct

SEQ ID NO: 952497 - DNA, 25 bp, Mus musculus
ttgctattgaaacaaggcttggact

SEQ ID NO: 952498 - DNA, 25 bp, Mus musculus
ttgctattgaaagaaggcttggact

SEQ ID NO: 952499 - DNA, 25 bp, Mus musculus
ttgctatttattcttggccatggcc

SEQ ID NO: 952500 - DNA, 25 bp, Mus musculus
ttgctatttattgttggccatggcc

SEQ ID NO: 952501 - DNA, 25 bp, Mus musculus
ttgctcaactggcatctttctatga

SEQ ID NO: 952502 - DNA, 25 bp, Mus musculus
ttgctcaactgggatctttctatga

SEQ ID NO: 952503 - DNA, 25 bp, Mus musculus
ttgctcaagatgagttatcgactgc

SEQ ID NO: 952504 - DNA, 25 bp, Mus musculus
ttgctcaagatgtgttatcgactgc

SEQ ID NO: 952505 - DNA, 25 bp, Mus musculus
ttgctcacaagcaaatttccccagc

SEQ ID NO: 952506 - DNA, 25 bp, Mus musculus
ttgctcacaagccttaacatttaac

SEQ ID NO: 952507 - DNA, 25 bp, Mus musculus
ttgctcacaagcgttaacatttaac

SEQ ID NO: 952508 - DNA, 25 bp, Mus musculus
ttgctcacaagctaatttccccagc

SEQ ID NO: 952509 - DNA, 25 bp, Mus musculus
ttgctcacaagtcccaactaccaga

SEQ ID NO: 952510 - DNA, 25 bp, Mus musculus
ttgctcacaagtgccaactaccaga

SEQ ID NO: 952511 - DNA, 25 bp, Mus musculus
ttgctcacacccacgtaggatggtt

SEQ ID NO: 952512 - DNA, 25 bp, Mus musculus
ttgctcacaccctcgtaggatggtt

SEQ ID NO: 952513 - DNA, 25 bp, Mus musculus
ttgctcaccatactacggatgactt

SEQ ID NO: 952514 - DNA, 25 bp, Mus musculus
ttgctcaccatagtacggatgactt

SEQ ID NO: 952515 - DNA, 25 bp, Mus musculus
ttgctcacccaaccatctgctagaa

SEQ ID NO: 952516 - DNA, 25 bp, Mus musculus
ttgctcacccaagcatctgctagaa

SEQ ID NO: 952517 - DNA, 25 bp, Mus musculus
ttgctcaccccacagaagttaaaaa

SEQ ID NO: 952518 - DNA, 25 bp, Mus musculus
ttgctcaccccagagaagttaaaaa

SEQ ID NO: 952519 - DNA, 25 bp, Mus musculus
ttgctcaccgtgcagatgttacctc

SEQ ID NO: 952520 - DNA, 25 bp, Mus musculus
ttgctcaccgtggagatgttacctc

SEQ ID NO: 952521 - DNA, 25 bp, Mus musculus
ttgctcacctatatatctggtcatt

SEQ ID NO: 952522 - DNA, 25 bp, Mus musculus
ttgctcacctatttatctggtcatt

SEQ ID NO: 952523 - DNA, 25 bp, Mus musculus
ttgctcacgcgtagggctgggaaca

SEQ ID NO: 952524 - DNA, 25 bp, Mus musculus
ttgctcacgcgttgggctgggaaca

SEQ ID NO: 952525 - DNA, 25 bp, Mus musculus
ttgctcacgtgaaccagaactcagg

SEQ ID NO: 952526 - DNA, 25 bp, Mus musculus
ttgctcacgtgatccagaactcagg

SEQ ID NO: 952527 - DNA, 25 bp, Mus musculus
ttgctcacgttgaatatgcctttca

SEQ ID NO: 952528 - DNA, 25 bp, Mus musculus
ttgctcacgttgtatatgcctttca

SEQ ID NO: 952529 - DNA, 25 bp, Mus musculus
ttgctcactaccaggactgaagcca

SEQ ID NO: 952530 - DNA, 25 bp, Mus musculus
ttgctcactacctggactgaagcca

SEQ ID NO: 952531 - DNA, 25 bp, Mus musculus
ttgctcactcagattgtgacctagg

SEQ ID NO: 952532 - DNA, 25 bp, Mus musculus
ttgctcactcagtttgtgacctagg

SEQ ID NO: 952533 - DNA, 25 bp, Mus musculus
ttgctcactcatctgcttttctttt

SEQ ID NO: 952534 - DNA, 25 bp, Mus musculus
ttgctcactcatgtgcttttctttt

SEQ ID NO: 952535 - DNA, 25 bp, Mus musculus
ttgctcactggacttggcccacatc

SEQ ID NO: 952536 - DNA, 25 bp, Mus musculus
ttgctcactggagttggcccacatc

SEQ ID NO: 952537 - DNA, 25 bp, Mus musculus
ttgctcacttccagtctcagacaca

SEQ ID NO: 952538 - DNA, 25 bp, Mus musculus
ttgctcacttcctgtctcagacaca

SEQ ID NO: 952539 - DNA, 25 bp, Mus musculus
ttgctcacttgccagactgcaaagg

SEQ ID NO: 952540 - DNA, 25 bp, Mus musculus
ttgctcacttgcgagactgcaaagg

SEQ ID NO: 952541 - DNA, 25 bp, Mus musculus
ttgctcagaatgcattacagtggcc

SEQ ID NO: 952542 - DNA, 25 bp, Mus musculus
ttgctcagaatggattacagtggcc

SEQ ID NO: 952543 - DNA, 25 bp, Mus musculus
ttgctcagagcaaggttggacctct

SEQ ID NO: 952544 - DNA, 25 bp, Mus musculus
ttgctcagagcatggttggacctct

SEQ ID NO: 952545 - DNA, 25 bp, Mus musculus
ttgctcagcaaaagcgtacctacct

SEQ ID NO: 952546 - DNA, 25 bp, Mus musculus
ttgctcagcaaatgcgtacctacct

SEQ ID NO: 952547 - DNA, 25 bp, Mus musculus
ttgctcagcagtacctttgctggca

SEQ ID NO: 952548 - DNA, 25 bp, Mus musculus
ttgctcagcagttcctttgctggca

SEQ ID NO: 952549 - DNA, 25 bp, Mus musculus
ttgctcagccaaccttgtcagcagc

SEQ ID NO: 952550 - DNA, 25 bp, Mus musculus
ttgctcagccaagcttgtcagcagc

SEQ ID NO: 952551 - DNA, 25 bp, Mus musculus
ttgctcagccctatagtacagtata

SEQ ID NO: 952552 - DNA, 25 bp, Mus musculus
ttgctcagccctttagtacagtata

SEQ ID NO: 952553 - DNA, 25 bp, Mus musculus
ttgctcagcgctaagcccggaagac

SEQ ID NO: 952554 - DNA, 25 bp, Mus musculus
ttgctcagcgcttagcccggaagac

SEQ ID NO: 952555 - DNA, 25 bp, Mus musculus
ttgctcagcttgactctttatccaa

SEQ ID NO: 952556 - DNA, 25 bp, Mus musculus
ttgctcagcttgtctctttatccaa

SEQ ID NO: 952557 - DNA, 25 bp, Mus musculus
ttgctcagggtgctattgtcacgat

SEQ ID NO: 952558 - DNA, 25 bp, Mus musculus
ttgctcagggtggtattgtcacgat

SEQ ID NO: 952559 - DNA, 25 bp, Mus musculus
ttgctcaggttaaccagggcgttaa

SEQ ID NO: 952560 - DNA, 25 bp, Mus musculus
ttgctcaggttatccagggcgttaa

SEQ ID NO: 952561 - DNA, 25 bp, Mus musculus
ttgctcagtagcagtcatggacctg

SEQ ID NO: 952562 - DNA, 25 bp, Mus musculus
ttgctcagtagctgtcatggacctg

SEQ ID NO: 952563 - DNA, 25 bp, Mus musculus
ttgctcagtaggactgaacaagaga

SEQ ID NO: 952564 - DNA, 25 bp, Mus musculus
ttgctcagtaggtctgaacaagaga

SEQ ID NO: 952565 - DNA, 25 bp, Mus musculus
ttgctcagtgttagggtttcctcac

SEQ ID NO: 952566 - DNA, 25 bp, Mus musculus
ttgctcagtgtttgggtttcctcac

SEQ ID NO: 952567 - DNA, 25 bp, Mus musculus
ttgctcataaagacggtgctgacag

SEQ ID NO: 952568 - DNA, 25 bp, Mus musculus
ttgctcataaagtcggtgctgacag

SEQ ID NO: 952569 - DNA, 25 bp, Mus musculus
ttgctcatattcatcaactccagct

SEQ ID NO: 952570 - DNA, 25 bp, Mus musculus
ttgctcatattcttcaactccagct

SEQ ID NO: 952571 - DNA, 25 bp, Mus musculus
ttgctcatcagcactatgccaaggg

SEQ ID NO: 952572 - DNA, 25 bp, Mus musculus
ttgctcatcagctctatgccaaggg

SEQ ID NO: 952573 - DNA, 25 bp, Mus musculus
ttgctcatcattatccttctcggtt

SEQ ID NO: 952574 - DNA, 25 bp, Mus musculus
ttgctcatcattttccttctcggtt

SEQ ID NO: 952575 - DNA, 25 bp, Mus musculus
ttgctcatcccaatggtcatagcta

SEQ ID NO: 952576 - DNA, 25 bp, Mus musculus
ttgctcatcccacatccaggttata

SEQ ID NO: 952577 - DNA, 25 bp, Mus musculus
ttgctcatcccagatccaggttata

SEQ ID NO: 952578 - DNA, 25 bp, Mus musculus
ttgctcatcccattggtcatagcta

SEQ ID NO: 952579 - DNA, 25 bp, Mus musculus
ttgctcatcggcataacaccataat

SEQ ID NO: 952580 - DNA, 25 bp, Mus musculus
ttgctcatcggcttaacaccataat

SEQ ID NO: 952581 - DNA, 25 bp, Mus musculus
ttgctcatctctactatccaaagta

SEQ ID NO: 952582 - DNA, 25 bp, Mus musculus
ttgctcatctctcctttgttttgat

SEQ ID NO: 952583 - DNA, 25 bp, Mus musculus
ttgctcatctctgctttgttttgat

SEQ ID NO: 952584 - DNA, 25 bp, Mus musculus
ttgctcatctcttctatccaaagta

SEQ ID NO: 952585 - DNA, 25 bp, Mus musculus
ttgctcatctttaaccctgttttca

SEQ ID NO: 952586 - DNA, 25 bp, Mus musculus
ttgctcatcttttaccctgttttca

SEQ ID NO: 952587 - DNA, 25 bp, Mus musculus
ttgctcatgaaaccataagcttctt

SEQ ID NO: 952588 - DNA, 25 bp, Mus musculus
ttgctcatgaaagcataagcttctt

SEQ ID NO: 952589 - DNA, 25 bp, Mus musculus
ttgctcatggcactacagtaccaga

SEQ ID NO: 952590 - DNA, 25 bp, Mus musculus
ttgctcatggcagtacagtaccaga

SEQ ID NO: 952591 - DNA, 25 bp, Mus musculus
ttgctcatgtctattgcgaagtgtg

SEQ ID NO: 952592 - DNA, 25 bp, Mus musculus
ttgctcatgtcttttgcgaagtgtg

SEQ ID NO: 952593 - DNA, 25 bp, Mus musculus
ttgctcattaaaccatccctttttt

SEQ ID NO: 952594 - DNA, 25 bp, Mus musculus
ttgctcattaaagcatccctttttt

SEQ ID NO: 952595 - DNA, 25 bp, Mus musculus
ttgctcattcatcacaaatctccag

SEQ ID NO: 952596 - DNA, 25 bp, Mus musculus
ttgctcattcatgacaaatctccag

SEQ ID NO: 952597 - DNA, 25 bp, Mus musculus
ttgctcattccaataactgcttaat

SEQ ID NO: 952598 - DNA, 25 bp, Mus musculus
ttgctcattccattaactgcttaat

SEQ ID NO: 952599 - DNA, 25 bp, Mus musculus
ttgctcattgctactgttgggaaca

SEQ ID NO: 952600 - DNA, 25 bp, Mus musculus
ttgctcattgcttctgttgggaaca

SEQ ID NO: 952601 - DNA, 25 bp, Mus musculus
ttgctcattttgagcctctggccct

SEQ ID NO: 952602 - DNA, 25 bp, Mus musculus
ttgctcattttgtgcctctggccct

SEQ ID NO: 952603 - DNA, 25 bp, Mus musculus
ttgctccaaacgctttgcccagtgg

SEQ ID NO: 952604 - DNA, 25 bp, Mus musculus
ttgctccaaacggtttgcccagtgg

SEQ ID NO: 952605 - DNA, 25 bp, Mus musculus
ttgctccaacataaacaggaaggtt

SEQ ID NO: 952606 - DNA, 25 bp, Mus musculus
ttgctccaacattaacaggaaggtt

SEQ ID NO: 952607 - DNA, 25 bp, Mus musculus
ttgctccaacccataggctgtttta

SEQ ID NO: 952608 - DNA, 25 bp, Mus musculus
ttgctccaacccttaggctgtttta

SEQ ID NO: 952609 - DNA, 25 bp, Mus musculus
ttgctccaagcaacagctcgtgaga

SEQ ID NO: 952610 - DNA, 25 bp, Mus musculus
ttgctccaagcaagtaatccttcaa

SEQ ID NO: 952611 - DNA, 25 bp, Mus musculus
ttgctccaagcatcagctcgtgaga

SEQ ID NO: 952612 - DNA, 25 bp, Mus musculus
ttgctccaagcatgtaatccttcaa

SEQ ID NO: 952613 - DNA, 25 bp, Mus musculus
ttgctccaataacctttgccatcaa

SEQ ID NO: 952614 - DNA, 25 bp, Mus musculus
ttgctccaataagctttgccatcaa

SEQ ID NO: 952615 - DNA, 25 bp, Mus musculus
ttgctccacagtaggccacacaata

SEQ ID NO: 952616 - DNA, 25 bp, Mus musculus
ttgctccacagttggccacacaata

SEQ ID NO: 952617 - DNA, 25 bp, Mus musculus
ttgctccacatcaacctacagttga

SEQ ID NO: 952618 - DNA, 25 bp, Mus musculus
ttgctccacatctacctacagttga

SEQ ID NO: 952619 - DNA, 25 bp, Mus musculus
ttgctccacccaattgcttcttgaa

SEQ ID NO: 952620 - DNA, 25 bp, Mus musculus
ttgctccacccatttgcttcttgaa

SEQ ID NO: 952621 - DNA, 25 bp, Mus musculus
ttgctccacgcccatagttacagga

SEQ ID NO: 952622 - DNA, 25 bp, Mus musculus
ttgctccacgccgatagttacagga

SEQ ID NO: 952623 - DNA, 25 bp, Mus musculus
ttgctccacgtgcattccaagtgct

SEQ ID NO: 952624 - DNA, 25 bp, Mus musculus
ttgctccacgtggattccaagtgct

SEQ ID NO: 952625 - DNA, 25 bp, Mus musculus
ttgctccactagagggcagactgct

SEQ ID NO: 952626 - DNA, 25 bp, Mus musculus
ttgctccactagtgggcagactgct

SEQ ID NO: 952627 - DNA, 25 bp, Mus musculus
ttgctccagccaagtacttactatg

SEQ ID NO: 952628 - DNA, 25 bp, Mus musculus
ttgctccagccacgccaggtataaa

SEQ ID NO: 952629 - DNA, 25 bp, Mus musculus
ttgctccagccaggccaggtataaa

SEQ ID NO: 952630 - DNA, 25 bp, Mus musculus
ttgctccagccatgtacttactatg

SEQ ID NO: 952631 - DNA, 25 bp, Mus musculus
ttgctccataccaagcagaactgaa

SEQ ID NO: 952632 - DNA, 25 bp, Mus musculus
ttgctccatacctagcagaactgaa

SEQ ID NO: 952633 - DNA, 25 bp, Mus musculus
ttgctccatcttctctttccaagaa

SEQ ID NO: 952634 - DNA, 25 bp, Mus musculus
ttgctccatcttgtctttccaagaa

SEQ ID NO: 952635 - DNA, 25 bp, Mus musculus
ttgctccatgcacaaaacctaaaac

SEQ ID NO: 952636 - DNA, 25 bp, Mus musculus
ttgctccatgcagaaaacctaaaac

SEQ ID NO: 952637 - DNA, 25 bp, Mus musculus
ttgctccatgctctcaggatctgga

SEQ ID NO: 952638 - DNA, 25 bp, Mus musculus
ttgctccatgctgtcaggatctgga

SEQ ID NO: 952639 - DNA, 25 bp, Mus musculus
ttgctcccaaatctgctgatggtgg

SEQ ID NO: 952640 - DNA, 25 bp, Mus musculus
ttgctcccaaatgtgctgatggtgg

SEQ ID NO: 952641 - DNA, 25 bp, Mus musculus
ttgctcccaatccacttctgtgtca

SEQ ID NO: 952642 - DNA, 25 bp, Mus musculus
ttgctcccaatcgacttctgtgtca

SEQ ID NO: 952643 - DNA, 25 bp, Mus musculus
ttgctcccactgaccggaatccaga

SEQ ID NO: 952644 - DNA, 25 bp, Mus musculus
ttgctcccactgtccggaatccaga

SEQ ID NO: 952645 - DNA, 25 bp, Mus musculus
ttgctcccaggaagcagaggaccat

SEQ ID NO: 952646 - DNA, 25 bp, Mus musculus
ttgctcccaggatgcagaggaccat

SEQ ID NO: 952647 - DNA, 25 bp, Mus musculus
ttgctcccatgccaatatctggaca

SEQ ID NO: 952648 - DNA, 25 bp, Mus musculus
ttgctcccatgcgaatatctggaca

SEQ ID NO: 952649 - DNA, 25 bp, Mus musculus
ttgctccccatgctactgtagtata

SEQ ID NO: 952650 - DNA, 25 bp, Mus musculus
ttgctccccatggtactgtagtata

SEQ ID NO: 952651 - DNA, 25 bp, Mus musculus
ttgctccccttgactaatgttgaga

SEQ ID NO: 952652 - DNA, 25 bp, Mus musculus
ttgctccccttgtctaatgttgaga

SEQ ID NO: 952653 - DNA, 25 bp, Mus musculus
ttgctccctcctagggaggtactaa

SEQ ID NO: 952654 - DNA, 25 bp, Mus musculus
ttgctccctccttgggaggtactaa

SEQ ID NO: 952655 - DNA, 25 bp, Mus musculus
ttgctccctgggataaatggtctgg

SEQ ID NO: 952656 - DNA, 25 bp, Mus musculus
ttgctccctgggttaaatggtctgg

SEQ ID NO: 952657 - DNA, 25 bp, Mus musculus
ttgctccgacctcataaacaatcca

SEQ ID NO: 952658 - DNA, 25 bp, Mus musculus
ttgctccgacctgataaacaatcca

SEQ ID NO: 952659 - DNA, 25 bp, Mus musculus
ttgctccgatgaaggccaagaccat

SEQ ID NO: 952660 - DNA, 25 bp, Mus musculus
ttgctccgatgatggccaagaccat

SEQ ID NO: 952661 - DNA, 25 bp, Mus musculus
ttgctccggacactgggcatgctaa

SEQ ID NO: 952662 - DNA, 25 bp, Mus musculus
ttgctccggacagtgggcatgctaa

SEQ ID NO: 952663 - DNA, 25 bp, Mus musculus
ttgctccggttccacatttgactga

SEQ ID NO: 952664 - DNA, 25 bp, Mus musculus
ttgctccggttcgacatttgactga

SEQ ID NO: 952665 - DNA, 25 bp, Mus musculus
ttgctccgtagcagtccattgtgtg

SEQ ID NO: 952666 - DNA, 25 bp, Mus musculus
ttgctccgtagctgtccattgtgtg

SEQ ID NO: 952667 - DNA, 25 bp, Mus musculus
ttgctccgtgcaatttgacagtgta

SEQ ID NO: 952668 - DNA, 25 bp, Mus musculus
ttgctccgtgcattttgacagtgta

SEQ ID NO: 952669 - DNA, 25 bp, Mus musculus
ttgctcctacaactgaaatgccttt

SEQ ID NO: 952670 - DNA, 25 bp, Mus musculus
ttgctcctacaagtgaaatgccttt

SEQ ID NO: 952671 - DNA, 25 bp, Mus musculus
ttgctcctacgtctgctggtttcgg

SEQ ID NO: 952672 - DNA, 25 bp, Mus musculus
ttgctcctacgtgtgctggtttcgg

SEQ ID NO: 952673 - DNA, 25 bp, Mus musculus
ttgctcctcaaactaaaacgatctt

SEQ ID NO: 952674 - DNA, 25 bp, Mus musculus
ttgctcctcaaagtaaaacgatctt

SEQ ID NO: 952675 - DNA, 25 bp, Mus musculus
ttgctcctcacgatcagatttcctg

SEQ ID NO: 952676 - DNA, 25 bp, Mus musculus
ttgctcctcacgttcagatttcctg

SEQ ID NO: 952677 - DNA, 25 bp, Mus musculus
ttgctcctcattatctcagtaaagt

SEQ ID NO: 952678 - DNA, 25 bp, Mus musculus
ttgctcctcattttctcagtaaagt

SEQ ID NO: 952679 - DNA, 25 bp, Mus musculus
ttgctcctcctgataagccttcagt

SEQ ID NO: 952680 - DNA, 25 bp, Mus musculus
ttgctcctcctgttaagccttcagt

SEQ ID NO: 952681 - DNA, 25 bp, Mus musculus
ttgctcctggacaccgtgaagaact

SEQ ID NO: 952682 - DNA, 25 bp, Mus musculus
ttgctcctggactccgtgaagaact

SEQ ID NO: 952683 - DNA, 25 bp, Mus musculus
ttgctcctgtccatttgctcttcct

SEQ ID NO: 952684 - DNA, 25 bp, Mus musculus
ttgctcctgtccttttgctcttcct

SEQ ID NO: 952685 - DNA, 25 bp, Mus musculus
ttgctcctgtgtcgtgagctctacc

SEQ ID NO: 952686 - DNA, 25 bp, Mus musculus
ttgctcctgtgtggtgagctctacc

SEQ ID NO: 952687 - DNA, 25 bp, Mus musculus
ttgctccttctcaaattgcagctgg

SEQ ID NO: 952688 - DNA, 25 bp, Mus musculus
ttgctccttctctaattgcagctgg

SEQ ID NO: 952689 - DNA, 25 bp, Mus musculus
ttgctccttctgaccaagttgatga

SEQ ID NO: 952690 - DNA, 25 bp, Mus musculus
ttgctccttctgtccaagttgatga

SEQ ID NO: 952691 - DNA, 25 bp, Mus musculus
ttgctccttggtcaggtacttgaat

SEQ ID NO: 952692 - DNA, 25 bp, Mus musculus
ttgctccttggtgaggtacttgaat

SEQ ID NO: 952693 - DNA, 25 bp, Mus musculus
ttgctcctttccagctaagctaatg

SEQ ID NO: 952694 - DNA, 25 bp, Mus musculus
ttgctcctttcctgctaagctaatg

SEQ ID NO: 952695 - DNA, 25 bp, Mus musculus
ttgctcctttggatttggctttgta

SEQ ID NO: 952696 - DNA, 25 bp, Mus musculus
ttgctcctttggttttggctttgta

SEQ ID NO: 952697 - DNA, 25 bp, Mus musculus
ttgctcgaatatatgggtaccccgt

SEQ ID NO: 952698 - DNA, 25 bp, Mus musculus
ttgctcgaatatttgggtaccccgt

SEQ ID NO: 952699 - DNA, 25 bp, Mus musculus
ttgctcgacctgcaatcctggataa

SEQ ID NO: 952700 - DNA, 25 bp, Mus musculus
ttgctcgacctggaatcctggataa

SEQ ID NO: 952701 - DNA, 25 bp, Mus musculus
ttgctcgagggcaccgtgcgttacc

SEQ ID NO: 952702 - DNA, 25 bp, Mus musculus
ttgctcgagggctccgtgcgttacc

SEQ ID NO: 952703 - DNA, 25 bp, Mus musculus
ttgctcgcacacagttcttgacaag

SEQ ID NO: 952704 - DNA, 25 bp, Mus musculus
ttgctcgcacactgttcttgacaag

SEQ ID NO: 952705 - DNA, 25 bp, Mus musculus
ttgctcgccatgaccgagataagga

SEQ ID NO: 952706 - DNA, 25 bp, Mus musculus
ttgctcgccatgtccgagataagga

SEQ ID NO: 952707 - DNA, 25 bp, Mus musculus
ttgctcgcccatattaaaccctaag

SEQ ID NO: 952708 - DNA, 25 bp, Mus musculus
ttgctcgcccattttaaaccctaag

SEQ ID NO: 952709 - DNA, 25 bp, Mus musculus
ttgctcgctaagaaacctggaagat

SEQ ID NO: 952710 - DNA, 25 bp, Mus musculus
ttgctcgctaagtaacctggaagat

SEQ ID NO: 952711 - DNA, 25 bp, Mus musculus
ttgctcgctattacataggcctgat

SEQ ID NO: 952712 - DNA, 25 bp, Mus musculus
ttgctcgctatttcataggcctgat

SEQ ID NO: 952713 - DNA, 25 bp, Mus musculus
ttgctcggaatgacagacacaaaca

SEQ ID NO: 952714 - DNA, 25 bp, Mus musculus
ttgctcggaatgtcagacacaaaca

SEQ ID NO: 952715 - DNA, 25 bp, Mus musculus
ttgctcggctagactggtatgggaa

SEQ ID NO: 952716 - DNA, 25 bp, Mus musculus
ttgctcggctagtctggtatgggaa

SEQ ID NO: 952717 - DNA, 25 bp, Mus musculus
ttgctcgtagtaaatgtgcgcaggc

SEQ ID NO: 952718 - DNA, 25 bp, Mus musculus
ttgctcgtagtatatgtgcgcaggc

SEQ ID NO: 952719 - DNA, 25 bp, Mus musculus
ttgctcgtagtcctgctgatggctg

SEQ ID NO: 952720 - DNA, 25 bp, Mus musculus
ttgctcgtagtcgtgctgatggctg

SEQ ID NO: 952721 - DNA, 25 bp, Mus musculus
ttgctcgtcattctgaggcgccaga

SEQ ID NO: 952722 - DNA, 25 bp, Mus musculus
ttgctcgtcattgtgaggcgccaga

SEQ ID NO: 952723 - DNA, 25 bp, Mus musculus
ttgctcgtcttcctgatcaagtgta

SEQ ID NO: 952724 - DNA, 25 bp, Mus musculus
ttgctcgtcttcgtgatcaagtgta

SEQ ID NO: 952725 - DNA, 25 bp, Mus musculus
ttgctcgttccgagacaagcattta

SEQ ID NO: 952726 - DNA, 25 bp, Mus musculus
ttgctcgttccgtgacaagcattta

SEQ ID NO: 952727 - DNA, 25 bp, Mus musculus
ttgctcgttgatagcgtgggtccac

SEQ ID NO: 952728 - DNA, 25 bp, Mus musculus
ttgctcgttgattgcgtgggtccac

SEQ ID NO: 952729 - DNA, 25 bp, Mus musculus
ttgctctacagcctccagtttttca

SEQ ID NO: 952730 - DNA, 25 bp, Mus musculus
ttgctctacagcgtccagtttttca

SEQ ID NO: 952731 - DNA, 25 bp, Mus musculus
ttgctctacagtcttgcttgccaga

SEQ ID NO: 952732 - DNA, 25 bp, Mus musculus
ttgctctacagtgttgcttgccaga

SEQ ID NO: 952733 - DNA, 25 bp, Mus musculus
ttgctctacctaccatttatgttta

SEQ ID NO: 952734 - DNA, 25 bp, Mus musculus
ttgctctacctagcatttatgttta

SEQ ID NO: 952735 - DNA, 25 bp, Mus musculus
ttgctctactctcggtgcagtccag

SEQ ID NO: 952736 - DNA, 25 bp, Mus musculus
ttgctctactctgggtgcagtccag

SEQ ID NO: 952737 - DNA, 25 bp, Mus musculus
ttgctctagaatcaactccctacat

SEQ ID NO: 952738 - DNA, 25 bp, Mus musculus
ttgctctagaatgaactccctacat

SEQ ID NO: 952739 - DNA, 25 bp, Mus musculus
ttgctctagcctatttggtttctgc

SEQ ID NO: 952740 - DNA, 25 bp, Mus musculus
ttgctctagcctttttggtttctgc

SEQ ID NO: 952741 - DNA, 25 bp, Mus musculus
ttgctctagtccaagccagcttggg

SEQ ID NO: 952742 - DNA, 25 bp, Mus musculus
ttgctctagtcctagccagcttggg

SEQ ID NO: 952743 - DNA, 25 bp, Mus musculus
ttgctctatcctaggtttgtacatt

SEQ ID NO: 952744 - DNA, 25 bp, Mus musculus
ttgctctatcctcacatctggagtt

SEQ ID NO: 952745 - DNA, 25 bp, Mus musculus
ttgctctatcctgacatctggagtt

SEQ ID NO: 952746 - DNA, 25 bp, Mus musculus
ttgctctatccttggtttgtacatt

SEQ ID NO: 952747 - DNA, 25 bp, Mus musculus
ttgctctatctacctaaggaccctt

SEQ ID NO: 952748 - DNA, 25 bp, Mus musculus
ttgctctatctagctaaggaccctt

SEQ ID NO: 952749 - DNA, 25 bp, Mus musculus
ttgctctcacacagacatggtttct

SEQ ID NO: 952750 - DNA, 25 bp, Mus musculus
ttgctctcacactgacatggtttct

SEQ ID NO: 952751 - DNA, 25 bp, Mus musculus
ttgctctcacagacgtatgtgctgc

SEQ ID NO: 952752 - DNA, 25 bp, Mus musculus
ttgctctcacagtcgtatgtgctgc

SEQ ID NO: 952753 - DNA, 25 bp, Mus musculus
ttgctctcacggaaaccaattgcct

SEQ ID NO: 952754 - DNA, 25 bp, Mus musculus
ttgctctcacggtaaccaattgcct

SEQ ID NO: 952755 - DNA, 25 bp, Mus musculus
ttgctctcagcacatacttcacata

SEQ ID NO: 952756 - DNA, 25 bp, Mus musculus
ttgctctcagcagatacttcacata

SEQ ID NO: 952757 - DNA, 25 bp, Mus musculus
ttgctctcaggaccgtgagtatgta

SEQ ID NO: 952758 - DNA, 25 bp, Mus musculus
ttgctctcaggagcgtgagtatgta

SEQ ID NO: 952759 - DNA, 25 bp, Mus musculus
ttgctctcatagctgctcaggacga

SEQ ID NO: 952760 - DNA, 25 bp, Mus musculus
ttgctctcataggtgctcaggacga

SEQ ID NO: 952761 - DNA, 25 bp, Mus musculus
ttgctctcattacctgagccatcat

SEQ ID NO: 952762 - DNA, 25 bp, Mus musculus
ttgctctcattagctgagccatcat

SEQ ID NO: 952763 - DNA, 25 bp, Mus musculus
ttgctctcattgattccctttaata

SEQ ID NO: 952764 - DNA, 25 bp, Mus musculus
ttgctctcattgtttccctttaata

SEQ ID NO: 952765 - DNA, 25 bp, Mus musculus
ttgctctcgggtaggatataacagt

SEQ ID NO: 952766 - DNA, 25 bp, Mus musculus
ttgctctcgggttggatataacagt

SEQ ID NO: 952767 - DNA, 25 bp, Mus musculus
ttgctctcgtttaggatgcatagac

SEQ ID NO: 952768 - DNA, 25 bp, Mus musculus
ttgctctcgttttggatgcatagac

SEQ ID NO: 952769 - DNA, 25 bp, Mus musculus
ttgctctctactcatttgctgtgat

SEQ ID NO: 952770 - DNA, 25 bp, Mus musculus
ttgctctctactgatttgctgtgat

SEQ ID NO: 952771 - DNA, 25 bp, Mus musculus
ttgctctctcctatctgagtgtgga

SEQ ID NO: 952772 - DNA, 25 bp, Mus musculus
ttgctctctcctttctgagtgtgga

SEQ ID NO: 952773 - DNA, 25 bp, Mus musculus
ttgctctctctgagtatacaccatg

SEQ ID NO: 952774 - DNA, 25 bp, Mus musculus
ttgctctctctgtgtatacaccatg

SEQ ID NO: 952775 - DNA, 25 bp, Mus musculus
ttgctctctcttagggaggcagaac

SEQ ID NO: 952776 - DNA, 25 bp, Mus musculus
ttgctctctctttgggaggcagaac

SEQ ID NO: 952777 - DNA, 25 bp, Mus musculus
ttgctctctgagatgtagcctgtct

SEQ ID NO: 952778 - DNA, 25 bp, Mus musculus
ttgctctctgagttgtagcctgtct

SEQ ID NO: 952779 - DNA, 25 bp, Mus musculus
ttgctctctgctactgtgtacaaat

SEQ ID NO: 952780 - DNA, 25 bp, Mus musculus
ttgctctctgcttctgtgtacaaat

SEQ ID NO: 952781 - DNA, 25 bp, Mus musculus
ttgctctctggaacatctccgaatt

SEQ ID NO: 952782 - DNA, 25 bp, Mus musculus
ttgctctctggatcatctccgaatt

SEQ ID NO: 952783 - DNA, 25 bp, Mus musculus
ttgctctcttgtctcatgtctatag

SEQ ID NO: 952784 - DNA, 25 bp, Mus musculus
ttgctctcttgtgtcatgtctatag

SEQ ID NO: 952785 - DNA, 25 bp, Mus musculus
ttgctctgaaaaacgcccaaagatc

SEQ ID NO: 952786 - DNA, 25 bp, Mus musculus
ttgctctgaaaatcgcccaaagatc

SEQ ID NO: 952787 - DNA, 25 bp, Mus musculus
ttgctctgaccccaaccgaattcgt

SEQ ID NO: 952788 - DNA, 25 bp, Mus musculus
ttgctctgacccgaaccgaattcgt

SEQ ID NO: 952789 - DNA, 25 bp, Mus musculus
ttgctctgacctagtatggtcacct

SEQ ID NO: 952790 - DNA, 25 bp, Mus musculus
ttgctctgaccttgtatggtcacct

SEQ ID NO: 952791 - DNA, 25 bp, Mus musculus
ttgctctgagcaatccagctttcag

SEQ ID NO: 952792 - DNA, 25 bp, Mus musculus
ttgctctgagcattccagctttcag

SEQ ID NO: 952793 - DNA, 25 bp, Mus musculus
ttgctctgatccatcattaggctat

SEQ ID NO: 952794 - DNA, 25 bp, Mus musculus
ttgctctgatccttcattaggctat

SEQ ID NO: 952795 - DNA, 25 bp, Mus musculus
ttgctctgattcataccatggaccc

SEQ ID NO: 952796 - DNA, 25 bp, Mus musculus
ttgctctgattcttaccatggaccc

SEQ ID NO: 952797 - DNA, 25 bp, Mus musculus
ttgctctgccacagctgtgagtaag

SEQ ID NO: 952798 - DNA, 25 bp, Mus musculus
ttgctctgccacctgctgataaatg

SEQ ID NO: 952799 - DNA, 25 bp, Mus musculus
ttgctctgccacgtgctgataaatg

SEQ ID NO: 952800 - DNA, 25 bp, Mus musculus
ttgctctgccactgctgtgagtaag

SEQ ID NO: 952801 - DNA, 25 bp, Mus musculus
ttgctctgctctatttaaattgtta

SEQ ID NO: 952802 - DNA, 25 bp, Mus musculus
ttgctctgctctttttaaattgtta

SEQ ID NO: 952803 - DNA, 25 bp, Mus musculus
ttgctctggagactgcatcttttct

SEQ ID NO: 952804 - DNA, 25 bp, Mus musculus
ttgctctggagagtgcatcttttct

SEQ ID NO: 952805 - DNA, 25 bp, Mus musculus
ttgctctggaggctcttactgttac

SEQ ID NO: 952806 - DNA, 25 bp, Mus musculus
ttgctctggagggtcttactgttac

SEQ ID NO: 952807 - DNA, 25 bp, Mus musculus
ttgctctggatccaagtttccacat

SEQ ID NO: 952808 - DNA, 25 bp, Mus musculus
ttgctctggatcgaagtttccacat

SEQ ID NO: 952809 - DNA, 25 bp, Mus musculus
ttgctctggctgataaggtgctaaa

SEQ ID NO: 952810 - DNA, 25 bp, Mus musculus
ttgctctggctgttaaggtgctaaa

SEQ ID NO: 952811 - DNA, 25 bp, Mus musculus
ttgctctggtatcccttagaaggca

SEQ ID NO: 952812 - DNA, 25 bp, Mus musculus
ttgctctggtatgccttagaaggca

SEQ ID NO: 952813 - DNA, 25 bp, Mus musculus
ttgctctggtgtacttagatcccat

SEQ ID NO: 952814 - DNA, 25 bp, Mus musculus
ttgctctggtgttcttagatcccat

SEQ ID NO: 952815 - DNA, 25 bp, Mus musculus
ttgctctggtttcaagggtttacct

SEQ ID NO: 952816 - DNA, 25 bp, Mus musculus
ttgctctggtttgaagggtttacct

SEQ ID NO: 952817 - DNA, 25 bp, Mus musculus
ttgctctgtaggcaccttagtggct

SEQ ID NO: 952818 - DNA, 25 bp, Mus musculus
ttgctctgtagggaccttagtggct

SEQ ID NO: 952819 - DNA, 25 bp, Mus musculus
ttgctctgtgctaatctaacaaacc

SEQ ID NO: 952820 - DNA, 25 bp, Mus musculus
ttgctctgtgctcagattgtcccta

SEQ ID NO: 952821 - DNA, 25 bp, Mus musculus
ttgctctgtgctgagattgtcccta

SEQ ID NO: 952822 - DNA, 25 bp, Mus musculus
ttgctctgtgcttatctaacaaacc

SEQ ID NO: 952823 - DNA, 25 bp, Mus musculus
ttgctctgttctcttacctagagtc

SEQ ID NO: 952824 - DNA, 25 bp, Mus musculus
ttgctctgttctgttacctagagtc

SEQ ID NO: 952825 - DNA, 25 bp, Mus musculus
ttgctcttacttctggatcaggaga

SEQ ID NO: 952826 - DNA, 25 bp, Mus musculus
ttgctcttacttgtggatcaggaga

SEQ ID NO: 952827 - DNA, 25 bp, Mus musculus
ttgctcttcagcatatatggtgtct

SEQ ID NO: 952828 - DNA, 25 bp, Mus musculus
ttgctcttcagcttatatggtgtct

SEQ ID NO: 952829 - DNA, 25 bp, Mus musculus
ttgctcttcagtcagagggccttac

SEQ ID NO: 952830 - DNA, 25 bp, Mus musculus
ttgctcttcagtgagagggccttac

SEQ ID NO: 952831 - DNA, 25 bp, Mus musculus
ttgctcttccataccagtctgagaa

SEQ ID NO: 952832 - DNA, 25 bp, Mus musculus
ttgctcttccattccagtctgagaa

SEQ ID NO: 952833 - DNA, 25 bp, Mus musculus
ttgctcttcctcacaccagatggta

SEQ ID NO: 952834 - DNA, 25 bp, Mus musculus
ttgctcttcctccactggtatgaca

SEQ ID NO: 952835 - DNA, 25 bp, Mus musculus
ttgctcttcctcgactggtatgaca

SEQ ID NO: 952836 - DNA, 25 bp, Mus musculus
ttgctcttcctctcaccagatggta

SEQ ID NO: 952837 - DNA, 25 bp, Mus musculus
ttgctcttctccatatacctggtga

SEQ ID NO: 952838 - DNA, 25 bp, Mus musculus
ttgctcttctccttatacctggtga

SEQ ID NO: 952839 - DNA, 25 bp, Mus musculus
ttgctcttgagcagatctatcccat

SEQ ID NO: 952840 - DNA, 25 bp, Mus musculus
ttgctcttgagctgatctatcccat

SEQ ID NO: 952841 - DNA, 25 bp, Mus musculus
ttgctcttgaggaagaagtccttat

SEQ ID NO: 952842 - DNA, 25 bp, Mus musculus
ttgctcttgaggtagaagtccttat

SEQ ID NO: 952843 - DNA, 25 bp, Mus musculus
ttgctcttgatacagactgagaggc

SEQ ID NO: 952844 - DNA, 25 bp, Mus musculus
ttgctcttgatagagactgagaggc

SEQ ID NO: 952845 - DNA, 25 bp, Mus musculus
ttgctcttgcaacgaggccccaggt

SEQ ID NO: 952846 - DNA, 25 bp, Mus musculus
ttgctcttgcaaggaggccccaggt

SEQ ID NO: 952847 - DNA, 25 bp, Mus musculus
ttgctcttggagcactgactgggct

SEQ ID NO: 952848 - DNA, 25 bp, Mus musculus
ttgctcttggaggactgactgggct

SEQ ID NO: 952849 - DNA, 25 bp, Mus musculus
ttgctcttggccaggcttcttaata

SEQ ID NO: 952850 - DNA, 25 bp, Mus musculus
ttgctcttggcctggcttcttaata

SEQ ID NO: 952851 - DNA, 25 bp, Mus musculus
ttgctcttgggcctgcttttacttc

SEQ ID NO: 952852 - DNA, 25 bp, Mus musculus
ttgctcttgggcgtgcttttacttc

SEQ ID NO: 952853 - DNA, 25 bp, Mus musculus
ttgctcttggtgctcgacacttcaa

SEQ ID NO: 952854 - DNA, 25 bp, Mus musculus
ttgctcttggtggtcgacacttcaa

SEQ ID NO: 952855 - DNA, 25 bp, Mus musculus
ttgctcttgtatactttctcatggg

SEQ ID NO: 952856 - DNA, 25 bp, Mus musculus
ttgctcttgtattctttctcatggg

SEQ ID NO: 952857 - DNA, 25 bp, Mus musculus
ttgctcttgtggacttcatattgtc

SEQ ID NO: 952858 - DNA, 25 bp, Mus musculus
ttgctcttgtggtcttcatattgtc

SEQ ID NO: 952859 - DNA, 25 bp, Mus musculus
ttgctcttgtgtcttcctataggaa

SEQ ID NO: 952860 - DNA, 25 bp, Mus musculus
ttgctcttgtgtgttcctataggaa

SEQ ID NO: 952861 - DNA, 25 bp, Mus musculus
ttgctctttagaaagttccccatac

SEQ ID NO: 952862 - DNA, 25 bp, Mus musculus
ttgctctttagatagttccccatac

SEQ ID NO: 952863 - DNA, 25 bp, Mus musculus
ttgctctttatcatctagcccatat

SEQ ID NO: 952864 - DNA, 25 bp, Mus musculus
ttgctctttatcttctagcccatat

SEQ ID NO: 952865 - DNA, 25 bp, Mus musculus
ttgctctttgcacaactgtttcagg

SEQ ID NO: 952866 - DNA, 25 bp, Mus musculus
ttgctctttgcagaactgtttcagg

SEQ ID NO: 952867 - DNA, 25 bp, Mus musculus
ttgctctttttacgtattaccttat

SEQ ID NO: 952868 - DNA, 25 bp, Mus musculus
ttgctctttttaggtattaccttat

SEQ ID NO: 952869 - DNA, 25 bp, Mus musculus
ttgctgaaaagtatcgccaactgaa

SEQ ID NO: 952870 - DNA, 25 bp, Mus musculus
ttgctgaaaagtttcgccaactgaa

SEQ ID NO: 952871 - DNA, 25 bp, Mus musculus
ttgctgaaagccacccgtagaaact

SEQ ID NO: 952872 - DNA, 25 bp, Mus musculus
ttgctgaaagcctcccgtagaaact

SEQ ID NO: 952873 - DNA, 25 bp, Mus musculus
ttgctgaacacaaagctgctgctca

SEQ ID NO: 952874 - DNA, 25 bp, Mus musculus
ttgctgaacacatagctgctgctca

SEQ ID NO: 952875 - DNA, 25 bp, Mus musculus
ttgctgaacataaagttaggaactg

SEQ ID NO: 952876 - DNA, 25 bp, Mus musculus
ttgctgaacatacatacacctccga

SEQ ID NO: 952877 - DNA, 25 bp, Mus musculus
ttgctgaacatagatacacctccga

SEQ ID NO: 952878 - DNA, 25 bp, Mus musculus
ttgctgaacatatagttaggaactg

SEQ ID NO: 952879 - DNA, 25 bp, Mus musculus
ttgctgaagaaacatgctacgtttt

SEQ ID NO: 952880 - DNA, 25 bp, Mus musculus
ttgctgaagaaagatgctacgtttt

SEQ ID NO: 952881 - DNA, 25 bp, Mus musculus
ttgctgaagtagacaagtgcttggc

SEQ ID NO: 952882 - DNA, 25 bp, Mus musculus
ttgctgaagtagtcaagtgcttggc

SEQ ID NO: 952883 - DNA, 25 bp, Mus musculus
ttgctgaatgtcacatccgcctggg

SEQ ID NO: 952884 - DNA, 25 bp, Mus musculus
ttgctgaatgtctcatccgcctggg

SEQ ID NO: 952885 - DNA, 25 bp, Mus musculus
ttgctgacaactagagaaccctagt

SEQ ID NO: 952886 - DNA, 25 bp, Mus musculus
ttgctgacaacttgagaaccctagt

SEQ ID NO: 952887 - DNA, 25 bp, Mus musculus
ttgctgacagacaaaaccgggcttt

SEQ ID NO: 952888 - DNA, 25 bp, Mus musculus
ttgctgacagactaaaccgggcttt

SEQ ID NO: 952889 - DNA, 25 bp, Mus musculus
ttgctgacaggaatagccaccgaca

SEQ ID NO: 952890 - DNA, 25 bp, Mus musculus
ttgctgacaggattagccaccgaca

SEQ ID NO: 952891 - DNA, 25 bp, Mus musculus
ttgctgacattgatcctcgctggaa

SEQ ID NO: 952892 - DNA, 25 bp, Mus musculus
ttgctgacattgttcctcgctggaa

SEQ ID NO: 952893 - DNA, 25 bp, Mus musculus
ttgctgacctcccttgcagaagaaa

SEQ ID NO: 952894 - DNA, 25 bp, Mus musculus
ttgctgacctccgttgcagaagaaa

SEQ ID NO: 952895 - DNA, 25 bp, Mus musculus
ttgctgacctgtccagggtcttccc

SEQ ID NO: 952896 - DNA, 25 bp, Mus musculus
ttgctgacctgtgcagggtcttccc

SEQ ID NO: 952897 - DNA, 25 bp, Mus musculus
ttgctgactctcagaggcggtcaaa

SEQ ID NO: 952898 - DNA, 25 bp, Mus musculus
ttgctgactctctgaggcggtcaaa

SEQ ID NO: 952899 - DNA, 25 bp, Mus musculus
ttgctgactcttatgtggctttctc

SEQ ID NO: 952900 - DNA, 25 bp, Mus musculus
ttgctgactcttttgtggctttctc

SEQ ID NO: 952901 - DNA, 25 bp, Mus musculus
ttgctgactgtacacatggaacttt

SEQ ID NO: 952902 - DNA, 25 bp, Mus musculus
ttgctgactgtagacatggaacttt

SEQ ID NO: 952903 - DNA, 25 bp, Mus musculus
ttgctgacttcaaaacagtgtctca

SEQ ID NO: 952904 - DNA, 25 bp, Mus musculus
ttgctgacttcataacagtgtctca

SEQ ID NO: 952905 - DNA, 25 bp, Mus musculus
ttgctgacttgtaaggtcactcgcc

SEQ ID NO: 952906 - DNA, 25 bp, Mus musculus
ttgctgacttgttaggtcactcgcc

SEQ ID NO: 952907 - DNA, 25 bp, Mus musculus
ttgctgactttgagcacatcatccc

SEQ ID NO: 952908 - DNA, 25 bp, Mus musculus
ttgctgactttgctttctgtcccag

SEQ ID NO: 952909 - DNA, 25 bp, Mus musculus
ttgctgactttggtttctgtcccag

SEQ ID NO: 952910 - DNA, 25 bp, Mus musculus
ttgctgactttgtgcacatcatccc

SEQ ID NO: 952911 - DNA, 25 bp, Mus musculus
ttgctgagactcacccggaagatgt

SEQ ID NO: 952912 - DNA, 25 bp, Mus musculus
ttgctgagactctcccggaagatgt

SEQ ID NO: 952913 - DNA, 25 bp, Mus musculus
ttgctgagccatcatacctgcctat

SEQ ID NO: 952914 - DNA, 25 bp, Mus musculus
ttgctgagccatgatacctgcctat

SEQ ID NO: 952915 - DNA, 25 bp, Mus musculus
ttgctgagcccacattttcataggc

SEQ ID NO: 952916 - DNA, 25 bp, Mus musculus
ttgctgagcccagattttcataggc

SEQ ID NO: 952917 - DNA, 25 bp, Mus musculus
ttgctgagccgtagccctctcctgt

SEQ ID NO: 952918 - DNA, 25 bp, Mus musculus
ttgctgagccgttgccctctcctgt

SEQ ID NO: 952919 - DNA, 25 bp, Mus musculus
ttgctgagcctactggtccttatct

SEQ ID NO: 952920 - DNA, 25 bp, Mus musculus
ttgctgagcctagtggtccttatct

SEQ ID NO: 952921 - DNA, 25 bp, Mus musculus
ttgctgagctcactgactcttcagt

SEQ ID NO: 952922 - DNA, 25 bp, Mus musculus
ttgctgagctcagtgactcttcagt

SEQ ID NO: 952923 - DNA, 25 bp, Mus musculus
ttgctgagctgacaaggcccaggca

SEQ ID NO: 952924 - DNA, 25 bp, Mus musculus
ttgctgagctgagaaggcccaggca

SEQ ID NO: 952925 - DNA, 25 bp, Mus musculus
ttgctgagctggaccacatctgata

SEQ ID NO: 952926 - DNA, 25 bp, Mus musculus
ttgctgagctggtccacatctgata

SEQ ID NO: 952927 - DNA, 25 bp, Mus musculus
ttgctgaggcaaaggctgaagtaac

SEQ ID NO: 952928 - DNA, 25 bp, Mus musculus
ttgctgaggcaatggctgaagtaac

SEQ ID NO: 952929 - DNA, 25 bp, Mus musculus
ttgctgaggcttacacacgctgcta

SEQ ID NO: 952930 - DNA, 25 bp, Mus musculus
ttgctgaggctttcacacgctgcta

SEQ ID NO: 952931 - DNA, 25 bp, Mus musculus
ttgctgaggttcctccaagcaacca

SEQ ID NO: 952932 - DNA, 25 bp, Mus musculus
ttgctgaggttcgtccaagcaacca

SEQ ID NO: 952933 - DNA, 25 bp, Mus musculus
ttgctgagtctgcatgtgatccctc

SEQ ID NO: 952934 - DNA, 25 bp, Mus musculus
ttgctgagtctggatgtgatccctc

SEQ ID NO: 952935 - DNA, 25 bp, Mus musculus
ttgctgataccaagacgtactccca

SEQ ID NO: 952936 - DNA, 25 bp, Mus musculus
ttgctgataccatgacgtactccca

SEQ ID NO: 952937 - DNA, 25 bp, Mus musculus
ttgctgatatctcttggcctaggtg

SEQ ID NO: 952938 - DNA, 25 bp, Mus musculus
ttgctgatatctgttggcctaggtg

SEQ ID NO: 952939 - DNA, 25 bp, Mus musculus
ttgctgatctttaagctcacaccca

SEQ ID NO: 952940 - DNA, 25 bp, Mus musculus
ttgctgatcttttagctcacaccca

SEQ ID NO: 952941 - DNA, 25 bp, Mus musculus
ttgctgatgacgataacccctggac

SEQ ID NO: 952942 - DNA, 25 bp, Mus musculus
ttgctgatgacgttaacccctggac

SEQ ID NO: 952943 - DNA, 25 bp, Mus musculus
ttgctgatgcgaacttccctacctc

SEQ ID NO: 952944 - DNA, 25 bp, Mus musculus
ttgctgatgcgatcttccctacctc

SEQ ID NO: 952945 - DNA, 25 bp, Mus musculus
ttgctgatggatacccagtgcggct

SEQ ID NO: 952946 - DNA, 25 bp, Mus musculus
ttgctgatggattcccagtgcggct

SEQ ID NO: 952947 - DNA, 25 bp, Mus musculus
ttgctgatggcaaacacaccaaccc

SEQ ID NO: 952948 - DNA, 25 bp, Mus musculus
ttgctgatggcatacacaccaaccc

SEQ ID NO: 952949 - DNA, 25 bp, Mus musculus
ttgctgattggcaggtagttcaaaa

SEQ ID NO: 952950 - DNA, 25 bp, Mus musculus
ttgctgattggctggtagttcaaaa

SEQ ID NO: 952951 - DNA, 25 bp, Mus musculus
ttgctgatttctctgtggtttggtg

SEQ ID NO: 952952 - DNA, 25 bp, Mus musculus
ttgctgatttctgtgtggtttggtg

SEQ ID NO: 952953 - DNA, 25 bp, Mus musculus
ttgctgcaaaggctgtcccaacctg

SEQ ID NO: 952954 - DNA, 25 bp, Mus musculus
ttgctgcaaagggtgtcccaacctg

SEQ ID NO: 952955 - DNA, 25 bp, Mus musculus
ttgctgcaacagaacttaccttgag

SEQ ID NO: 952956 - DNA, 25 bp, Mus musculus
ttgctgcaacagtacttaccttgag

SEQ ID NO: 952957 - DNA, 25 bp, Mus musculus
ttgctgcaagctcaaggaccgcctg

SEQ ID NO: 952958 - DNA, 25 bp, Mus musculus
ttgctgcaagctgaaggaccgcctg

SEQ ID NO: 952959 - DNA, 25 bp, Mus musculus
ttgctgcacaaaatactttgagtgt

SEQ ID NO: 952960 - DNA, 25 bp, Mus musculus
ttgctgcacaaattactttgagtgt

SEQ ID NO: 952961 - DNA, 25 bp, Mus musculus
ttgctgcacctgcaacaatcctcat

SEQ ID NO: 952962 - DNA, 25 bp, Mus musculus
ttgctgcacctggaacaatcctcat

SEQ ID NO: 952963 - DNA, 25 bp, Mus musculus
ttgctgcacgatacatagaatgtaa

SEQ ID NO: 952964 - DNA, 25 bp, Mus musculus
ttgctgcacgattcatagaatgtaa

SEQ ID NO: 952965 - DNA, 25 bp, Mus musculus
ttgctgcacgccaaaacaactgggt

SEQ ID NO: 952966 - DNA, 25 bp, Mus musculus
ttgctgcacgcctaaacaactgggt

SEQ ID NO: 952967 - DNA, 25 bp, Mus musculus
ttgctgcagattccagaacactgtt

SEQ ID NO: 952968 - DNA, 25 bp, Mus musculus
ttgctgcagattgcagaacactgtt

SEQ ID NO: 952969 - DNA, 25 bp, Mus musculus
ttgctgcagcagcacagcatccctg

SEQ ID NO: 952970 - DNA, 25 bp, Mus musculus
ttgctgcagcaggacagcatccctg

SEQ ID NO: 952971 - DNA, 25 bp, Mus musculus
ttgctgcagctccttagtcattggt

SEQ ID NO: 952972 - DNA, 25 bp, Mus musculus
ttgctgcagctcgttagtcattggt

SEQ ID NO: 952973 - DNA, 25 bp, Mus musculus
ttgctgcagggcagtatgacaccca

SEQ ID NO: 952974 - DNA, 25 bp, Mus musculus
ttgctgcagggccttgcactgtagc

SEQ ID NO: 952975 - DNA, 25 bp, Mus musculus
ttgctgcagggcgttgcactgtagc

SEQ ID NO: 952976 - DNA, 25 bp, Mus musculus
ttgctgcagggctgtatgacaccca

SEQ ID NO: 952977 - DNA, 25 bp, Mus musculus
ttgctgcatcccctccggtgtacaa

SEQ ID NO: 952978 - DNA, 25 bp, Mus musculus
ttgctgcatcccgtccggtgtacaa

SEQ ID NO: 952979 - DNA, 25 bp, Mus musculus
ttgctgcattccaagtcatacatac

SEQ ID NO: 952980 - DNA, 25 bp, Mus musculus
ttgctgcattcctagtcatacatac

SEQ ID NO: 952981 - DNA, 25 bp, Mus musculus
ttgctgccaattaatttccatgctt

SEQ ID NO: 952982 - DNA, 25 bp, Mus musculus
ttgctgccaatttatttccatgctt

SEQ ID NO: 952983 - DNA, 25 bp, Mus musculus
ttgctgccagaacctagcctcgctg

SEQ ID NO: 952984 - DNA, 25 bp, Mus musculus
ttgctgccagaagctagcctcgctg

SEQ ID NO: 952985 - DNA, 25 bp, Mus musculus
ttgctgccagcacggatctcttgag

SEQ ID NO: 952986 - DNA, 25 bp, Mus musculus
ttgctgccagcagggatctcttgag

SEQ ID NO: 952987 - DNA, 25 bp, Mus musculus
ttgctgccagctagactgacgacag

SEQ ID NO: 952988 - DNA, 25 bp, Mus musculus
ttgctgccagcttgactgacgacag

SEQ ID NO: 952989 - DNA, 25 bp, Mus musculus
ttgctgccaggccttgttttacatc

SEQ ID NO: 952990 - DNA, 25 bp, Mus musculus
ttgctgccaggcgttgttttacatc

SEQ ID NO: 952991 - DNA, 25 bp, Mus musculus
ttgctgcccattctttcttatcatc

SEQ ID NO: 952992 - DNA, 25 bp, Mus musculus
ttgctgcccattgtttcttatcatc

SEQ ID NO: 952993 - DNA, 25 bp, Mus musculus
ttgctgccctaccttgaggaatctt

SEQ ID NO: 952994 - DNA, 25 bp, Mus musculus
ttgctgccctacgttgaggaatctt

SEQ ID NO: 952995 - DNA, 25 bp, Mus musculus
ttgctgcccttgagtatttctacat

SEQ ID NO: 952996 - DNA, 25 bp, Mus musculus
ttgctgcccttgtgtatttctacat

SEQ ID NO: 952997 - DNA, 25 bp, Mus musculus
ttgctgccctttcatgactttacaa

SEQ ID NO: 952998 - DNA, 25 bp, Mus musculus
ttgctgccctttgatgactttacaa

SEQ ID NO: 952999 - DNA, 25 bp, Mus musculus
ttgctgccgcctctgttgcttttac

SEQ ID NO: 953000 - DNA, 25 bp, Mus musculus
ttgctgccgcctgtgttgcttttac

SEQ ID NO: 953001 - DNA, 25 bp, Mus musculus
ttgctgcctcccaagttagccattg

SEQ ID NO: 953002 - DNA, 25 bp, Mus musculus
ttgctgcctccctagttagccattg

SEQ ID NO: 953003 - DNA, 25 bp, Mus musculus
ttgctgcctgcgattgttcatataa

SEQ ID NO: 953004 - DNA, 25 bp, Mus musculus
ttgctgcctgcgtttgttcatataa

SEQ ID NO: 953005 - DNA, 25 bp, Mus musculus
ttgctgcctgctaggcttactggct

SEQ ID NO: 953006 - DNA, 25 bp, Mus musculus
ttgctgcctgcttggcttactggct

SEQ ID NO: 953007 - DNA, 25 bp, Mus musculus
ttgctgcctggcaggaaactgcagt

SEQ ID NO: 953008 - DNA, 25 bp, Mus musculus
ttgctgcctggcctgtgtaaagaca

SEQ ID NO: 953009 - DNA, 25 bp, Mus musculus
ttgctgcctggcgtgtgtaaagaca

SEQ ID NO: 953010 - DNA, 25 bp, Mus musculus
ttgctgcctggctggaaactgcagt

SEQ ID NO: 953011 - DNA, 25 bp, Mus musculus
ttgctgcctgtgaccgcagacaaag

SEQ ID NO: 953012 - DNA, 25 bp, Mus musculus
ttgctgcctgtgagtccggtcccgc

SEQ ID NO: 953013 - DNA, 25 bp, Mus musculus
ttgctgcctgtgtccgcagacaaag

SEQ ID NO: 953014 - DNA, 25 bp, Mus musculus
ttgctgcctgtgtgtccggtcccgc

SEQ ID NO: 953015 - DNA, 25 bp, Mus musculus
ttgctgccttctcccattttaaaat

SEQ ID NO: 953016 - DNA, 25 bp, Mus musculus
ttgctgccttctgccattttaaaat

SEQ ID NO: 953017 - DNA, 25 bp, Mus musculus
ttgctgccttgcaggctagcccaag

SEQ ID NO: 953018 - DNA, 25 bp, Mus musculus
ttgctgccttgctggctagcccaag

SEQ ID NO: 953019 - DNA, 25 bp, Mus musculus
ttgctgcgcacactgtactgtgtct

SEQ ID NO: 953020 - DNA, 25 bp, Mus musculus
ttgctgcgcacagtgtactgtgtct

SEQ ID NO: 953021 - DNA, 25 bp, Mus musculus
ttgctgcgcataaggcttccaaaac

SEQ ID NO: 953022 - DNA, 25 bp, Mus musculus
ttgctgcgcatatggcttccaaaac

SEQ ID NO: 953023 - DNA, 25 bp, Mus musculus
ttgctgcgcgacagggcctggctaa

SEQ ID NO: 953024 - DNA, 25 bp, Mus musculus
ttgctgcgcgactgggcctggctaa

SEQ ID NO: 953025 - DNA, 25 bp, Mus musculus
ttgctgcgctgcaatgatctatcta

SEQ ID NO: 953026 - DNA, 25 bp, Mus musculus
ttgctgcgctgctatgatctatcta

SEQ ID NO: 953027 - DNA, 25 bp, Mus musculus
ttgctgcgtttcacagcataaactt

SEQ ID NO: 953028 - DNA, 25 bp, Mus musculus
ttgctgcgtttctcagcataaactt

SEQ ID NO: 953029 - DNA, 25 bp, Mus musculus
ttgctgctaagaatttgccatcccg

SEQ ID NO: 953030 - DNA, 25 bp, Mus musculus
ttgctgctaagattttgccatcccg

SEQ ID NO: 953031 - DNA, 25 bp, Mus musculus
ttgctgctaagcatcatgtaaaatc

SEQ ID NO: 953032 - DNA, 25 bp, Mus musculus
ttgctgctaagcttcatgtaaaatc

SEQ ID NO: 953033 - DNA, 25 bp, Mus musculus
ttgctgctactaccactcgcagtgg

SEQ ID NO: 953034 - DNA, 25 bp, Mus musculus
ttgctgctactagcactcgcagtgg

SEQ ID NO: 953035 - DNA, 25 bp, Mus musculus
ttgctgctacttcatttgttctgat

SEQ ID NO: 953036 - DNA, 25 bp, Mus musculus
ttgctgctacttgatttgttctgat

SEQ ID NO: 953037 - DNA, 25 bp, Mus musculus
ttgctgctagacctgcgcctacgtt

SEQ ID NO: 953038 - DNA, 25 bp, Mus musculus
ttgctgctagacgtgcgcctacgtt

SEQ ID NO: 953039 - DNA, 25 bp, Mus musculus
ttgctgctatctaggacaccatggc

SEQ ID NO: 953040 - DNA, 25 bp, Mus musculus
ttgctgctatcttggacaccatggc

SEQ ID NO: 953041 - DNA, 25 bp, Mus musculus
ttgctgctcaagaatggtacccttt

SEQ ID NO: 953042 - DNA, 25 bp, Mus musculus
ttgctgctcaagtatggtacccttt

SEQ ID NO: 953043 - DNA, 25 bp, Mus musculus
ttgctgctcgttactgagtggaggt

SEQ ID NO: 953044 - DNA, 25 bp, Mus musculus
ttgctgctcgttattctcaggttga

SEQ ID NO: 953045 - DNA, 25 bp, Mus musculus
ttgctgctcgtttctgagtggaggt

SEQ ID NO: 953046 - DNA, 25 bp, Mus musculus
ttgctgctcgtttttctcaggttga

SEQ ID NO: 953047 - DNA, 25 bp, Mus musculus
ttgctgctgaataccatgccaactc

SEQ ID NO: 953048 - DNA, 25 bp, Mus musculus
ttgctgctgaattccatgccaactc

SEQ ID NO: 953049 - DNA, 25 bp, Mus musculus
ttgctgctgatacacttgagaacct

SEQ ID NO: 953050 - DNA, 25 bp, Mus musculus
ttgctgctgatacatcagcctcctg

SEQ ID NO: 953051 - DNA, 25 bp, Mus musculus
ttgctgctgatagacttgagaacct

SEQ ID NO: 953052 - DNA, 25 bp, Mus musculus
ttgctgctgatagatcagcctcctg

SEQ ID NO: 953053 - DNA, 25 bp, Mus musculus
ttgctgctgcctatcattacccatt

SEQ ID NO: 953054 - DNA, 25 bp, Mus musculus
ttgctgctgcctttcattacccatt

SEQ ID NO: 953055 - DNA, 25 bp, Mus musculus
ttgctgctggagatgactttgctct

SEQ ID NO: 953056 - DNA, 25 bp, Mus musculus
ttgctgctggagttgactttgctct

SEQ ID NO: 953057 - DNA, 25 bp, Mus musculus
ttgctgctgggcctttcgagaatgc

SEQ ID NO: 953058 - DNA, 25 bp, Mus musculus
ttgctgctgggcgtttcgagaatgc

SEQ ID NO: 953059 - DNA, 25 bp, Mus musculus
ttgctgctgtatccgttccactgaa

SEQ ID NO: 953060 - DNA, 25 bp, Mus musculus
ttgctgctgtatgcgttccactgaa

SEQ ID NO: 953061 - DNA, 25 bp, Mus musculus
ttgctgctgttactcatttctggat

SEQ ID NO: 953062 - DNA, 25 bp, Mus musculus
ttgctgctgttagtcatttctggat

SEQ ID NO: 953063 - DNA, 25 bp, Mus musculus
ttgctgctgtttaagttgacaactt

SEQ ID NO: 953064 - DNA, 25 bp, Mus musculus
ttgctgctgtttctgtgcataaata

SEQ ID NO: 953065 - DNA, 25 bp, Mus musculus
ttgctgctgtttgtgtgcataaata

SEQ ID NO: 953066 - DNA, 25 bp, Mus musculus
ttgctgctgttttagttgacaactt

SEQ ID NO: 953067 - DNA, 25 bp, Mus musculus
ttgctgcttcatcacacaaggtgct

SEQ ID NO: 953068 - DNA, 25 bp, Mus musculus
ttgctgcttcatgacacaaggtgct

SEQ ID NO: 953069 - DNA, 25 bp, Mus musculus
ttgctgcttccacaggagataagat

SEQ ID NO: 953070 - DNA, 25 bp, Mus musculus
ttgctgcttccagaggagataagat

SEQ ID NO: 953071 - DNA, 25 bp, Mus musculus
ttgctgcttcctaatgccttctaag

SEQ ID NO: 953072 - DNA, 25 bp, Mus musculus
ttgctgcttccttatgccttctaag

SEQ ID NO: 953073 - DNA, 25 bp, Mus musculus
ttgctgcttgcacagagagctaaaa

SEQ ID NO: 953074 - DNA, 25 bp, Mus musculus
ttgctgcttgcacgcgatgaggctt

SEQ ID NO: 953075 - DNA, 25 bp, Mus musculus
ttgctgcttgcagagagagctaaaa

SEQ ID NO: 953076 - DNA, 25 bp, Mus musculus
ttgctgcttgcaggcgatgaggctt

SEQ ID NO: 953077 - DNA, 25 bp, Mus musculus
ttgctgcttggcacgttctaagatg

SEQ ID NO: 953078 - DNA, 25 bp, Mus musculus
ttgctgcttggctcgttctaagatg

SEQ ID NO: 953079 - DNA, 25 bp, Mus musculus
ttgctgctttgtacaagatctgaca

SEQ ID NO: 953080 - DNA, 25 bp, Mus musculus
ttgctgctttgttcaagatctgaca

SEQ ID NO: 953081 - DNA, 25 bp, Mus musculus
ttgctggaaatgcttctctgtgagt

SEQ ID NO: 953082 - DNA, 25 bp, Mus musculus
ttgctggaaatggttctctgtgagt

SEQ ID NO: 953083 - DNA, 25 bp, Mus musculus
ttgctggaagccctccccaaagcgg

SEQ ID NO: 953084 - DNA, 25 bp, Mus musculus
ttgctggaagccgtccccaaagcgg

SEQ ID NO: 953085 - DNA, 25 bp, Mus musculus
ttgctggactggagccgagccaaga

SEQ ID NO: 953086 - DNA, 25 bp, Mus musculus
ttgctggactggaggtttcctcctg

SEQ ID NO: 953087 - DNA, 25 bp, Mus musculus
ttgctggactggtgccgagccaaga

SEQ ID NO: 953088 - DNA, 25 bp, Mus musculus
ttgctggactggtggtttcctcctg

SEQ ID NO: 953089 - DNA, 25 bp, Mus musculus
ttgctggacttgaggctgtggtaca

SEQ ID NO: 953090 - DNA, 25 bp, Mus musculus
ttgctggacttgtggctgtggtaca

SEQ ID NO: 953091 - DNA, 25 bp, Mus musculus
ttgctggactttcagggtactacct

SEQ ID NO: 953092 - DNA, 25 bp, Mus musculus
ttgctggactttgagggtactacct

SEQ ID NO: 953093 - DNA, 25 bp, Mus musculus
ttgctggagatgattgcttatacct

SEQ ID NO: 953094 - DNA, 25 bp, Mus musculus
ttgctggagatgtttgcttatacct

SEQ ID NO: 953095 - DNA, 25 bp, Mus musculus
ttgctggagctcattgctgatctat

SEQ ID NO: 953096 - DNA, 25 bp, Mus musculus
ttgctggagctctttgctgatctat

SEQ ID NO: 953097 - DNA, 25 bp, Mus musculus
ttgctggagtccctgagttaagtca

SEQ ID NO: 953098 - DNA, 25 bp, Mus musculus
ttgctggagtccgtgagttaagtca

SEQ ID NO: 953099 - DNA, 25 bp, Mus musculus
ttgctggatatcaatactaggaacc

SEQ ID NO: 953100 - DNA, 25 bp, Mus musculus
ttgctggatatctatactaggaacc

SEQ ID NO: 953101 - DNA, 25 bp, Mus musculus
ttgctggattgcagagttgctgaat

SEQ ID NO: 953102 - DNA, 25 bp, Mus musculus
ttgctggattgctgagttgctgaat

SEQ ID NO: 953103 - DNA, 25 bp, Mus musculus
ttgctggatttgcgtccaaaagact

SEQ ID NO: 953104 - DNA, 25 bp, Mus musculus
ttgctggatttgggtccaaaagact

SEQ ID NO: 953105 - DNA, 25 bp, Mus musculus
ttgctggcagctattgtattaaaaa

SEQ ID NO: 953106 - DNA, 25 bp, Mus musculus
ttgctggcagcttttgtattaaaaa

SEQ ID NO: 953107 - DNA, 25 bp, Mus musculus
ttgctggcagtcaaactggataaat

SEQ ID NO: 953108 - DNA, 25 bp, Mus musculus
ttgctggcagtctaactggataaat

SEQ ID NO: 953109 - DNA, 25 bp, Mus musculus
ttgctggcatgaacctggactcgaa

SEQ ID NO: 953110 - DNA, 25 bp, Mus musculus
ttgctggcatgatcctggactcgaa

SEQ ID NO: 953111 - DNA, 25 bp, Mus musculus
ttgctggcatggagactgtggctat

SEQ ID NO: 953112 - DNA, 25 bp, Mus musculus
ttgctggcatggtgactgtggctat

SEQ ID NO: 953113 - DNA, 25 bp, Mus musculus
ttgctggccacaaatgactcatcgt

SEQ ID NO: 953114 - DNA, 25 bp, Mus musculus
ttgctggccacatatgactcatcgt

SEQ ID NO: 953115 - DNA, 25 bp, Mus musculus
ttgctggcccctctttctgtattct

SEQ ID NO: 953116 - DNA, 25 bp, Mus musculus
ttgctggcccctgtttctgtattct

SEQ ID NO: 953117 - DNA, 25 bp, Mus musculus
ttgctggccctgaggtggttgccaa

SEQ ID NO: 953118 - DNA, 25 bp, Mus musculus
ttgctggccctgtggtggttgccaa

SEQ ID NO: 953119 - DNA, 25 bp, Mus musculus
ttgctggccgtcagtctatcctaat

SEQ ID NO: 953120 - DNA, 25 bp, Mus musculus
ttgctggccgtctgtctatcctaat

SEQ ID NO: 953121 - DNA, 25 bp, Mus musculus
ttgctggcctatagccactatgttt

SEQ ID NO: 953122 - DNA, 25 bp, Mus musculus
ttgctggcctattgccactatgttt

SEQ ID NO: 953123 - DNA, 25 bp, Mus musculus
ttgctggctatgcacagtgtttgtc

SEQ ID NO: 953124 - DNA, 25 bp, Mus musculus
ttgctggctatggacagtgtttgtc

SEQ ID NO: 953125 - DNA, 25 bp, Mus musculus
ttgctggctcacctttcaagatgtt

SEQ ID NO: 953126 - DNA, 25 bp, Mus musculus
ttgctggctcacgtttcaagatgtt

SEQ ID NO: 953127 - DNA, 25 bp, Mus musculus
ttgctggctgtcattacgagtgagt

SEQ ID NO: 953128 - DNA, 25 bp, Mus musculus
ttgctggctgtctttacgagtgagt

SEQ ID NO: 953129 - DNA, 25 bp, Mus musculus
ttgctggctttcatcatcacgtgga

SEQ ID NO: 953130 - DNA, 25 bp, Mus musculus
ttgctggctttcttcatcacgtgga

SEQ ID NO: 953131 - DNA, 25 bp, Mus musculus
ttgctgggacttattaataaatgcc

SEQ ID NO: 953132 - DNA, 25 bp, Mus musculus
ttgctgggactttttaataaatgcc

SEQ ID NO: 953133 - DNA, 25 bp, Mus musculus
ttgctgggatgaaaccgtaccggac

SEQ ID NO: 953134 - DNA, 25 bp, Mus musculus
ttgctgggatgataccgtaccggac

SEQ ID NO: 953135 - DNA, 25 bp, Mus musculus
ttgctgggattcagacaacagcctg

SEQ ID NO: 953136 - DNA, 25 bp, Mus musculus
ttgctgggattctgacaacagcctg

SEQ ID NO: 953137 - DNA, 25 bp, Mus musculus
ttgctgggccacagatctcgagtaa

SEQ ID NO: 953138 - DNA, 25 bp, Mus musculus
ttgctgggccactgatctcgagtaa

SEQ ID NO: 953139 - DNA, 25 bp, Mus musculus
ttgctgggcgttagaactctgtcaa

SEQ ID NO: 953140 - DNA, 25 bp, Mus musculus
ttgctgggcgtttgaactctgtcaa

SEQ ID NO: 953141 - DNA, 25 bp, Mus musculus
ttgctgggcttgacttcagggttcc

SEQ ID NO: 953142 - DNA, 25 bp, Mus musculus
ttgctgggcttgtcttcagggttcc

SEQ ID NO: 953143 - DNA, 25 bp, Mus musculus
ttgctgggtcccatttcatcatgac

SEQ ID NO: 953144 - DNA, 25 bp, Mus musculus
ttgctgggtcccttttcatcatgac

SEQ ID NO: 953145 - DNA, 25 bp, Mus musculus
ttgctgggtttcactccttgaagaa

SEQ ID NO: 953146 - DNA, 25 bp, Mus musculus
ttgctgggtttctctccttgaagaa

SEQ ID NO: 953147 - DNA, 25 bp, Mus musculus
ttgctggtagtacccatgctcctgt

SEQ ID NO: 953148 - DNA, 25 bp, Mus musculus
ttgctggtagtagccatgctcctgt

SEQ ID NO: 953149 - DNA, 25 bp, Mus musculus
ttgctggtcaagacacctatctgga

SEQ ID NO: 953150 - DNA, 25 bp, Mus musculus
ttgctggtcaagtcacctatctgga

SEQ ID NO: 953151 - DNA, 25 bp, Mus musculus
ttgctggtcatgagtactctggaga

SEQ ID NO: 953152 - DNA, 25 bp, Mus musculus
ttgctggtcatgtgtactctggaga

SEQ ID NO: 953153 - DNA, 25 bp, Mus musculus
ttgctggtccagcttgcttcctgag

SEQ ID NO: 953154 - DNA, 25 bp, Mus musculus
ttgctggtccaggttgcttcctgag

SEQ ID NO: 953155 - DNA, 25 bp, Mus musculus
ttgctggtcctgagaacgaactgtg

SEQ ID NO: 953156 - DNA, 25 bp, Mus musculus
ttgctggtcctgtgaacgaactgtg

SEQ ID NO: 953157 - DNA, 25 bp, Mus musculus
ttgctggtgaccactcagtctgaga

SEQ ID NO: 953158 - DNA, 25 bp, Mus musculus
ttgctggtgacctctcagtctgaga

SEQ ID NO: 953159 - DNA, 25 bp, Mus musculus
ttgctggtgcagaggttggtatttt

SEQ ID NO: 953160 - DNA, 25 bp, Mus musculus
ttgctggtgcagtggttggtatttt

SEQ ID NO: 953161 - DNA, 25 bp, Mus musculus
ttgctggttggtagctattggtcac

SEQ ID NO: 953162 - DNA, 25 bp, Mus musculus
ttgctggttggttgctattggtcac

SEQ ID NO: 953163 - DNA, 25 bp, Mus musculus
ttgctggttgttacctcctatgaca

SEQ ID NO: 953164 - DNA, 25 bp, Mus musculus
ttgctggttgtttcctcctatgaca

SEQ ID NO: 953165 - DNA, 25 bp, Mus musculus
ttgctggttttactcatcctgtgaa

SEQ ID NO: 953166 - DNA, 25 bp, Mus musculus
ttgctggttttagtcatcctgtgaa

SEQ ID NO: 953167 - DNA, 25 bp, Mus musculus
ttgctgtaaacaaggccaaccttaa

SEQ ID NO: 953168 - DNA, 25 bp, Mus musculus
ttgctgtaaacatggccaaccttaa

SEQ ID NO: 953169 - DNA, 25 bp, Mus musculus
ttgctgtaaattcctcaggctctgt

SEQ ID NO: 953170 - DNA, 25 bp, Mus musculus
ttgctgtaaattgctcaggctctgt

SEQ ID NO: 953171 - DNA, 25 bp, Mus musculus
ttgctgtaagcaactgtttcgtata

SEQ ID NO: 953172 - DNA, 25 bp, Mus musculus
ttgctgtaagcatctgtttcgtata

SEQ ID NO: 953173 - DNA, 25 bp, Mus musculus
ttgctgtacacgctgctttgtataa

SEQ ID NO: 953174 - DNA, 25 bp, Mus musculus
ttgctgtacacggtgctttgtataa

SEQ ID NO: 953175 - DNA, 25 bp, Mus musculus
ttgctgtacccgaacccagcagtga

SEQ ID NO: 953176 - DNA, 25 bp, Mus musculus
ttgctgtacccgtacccagcagtga

SEQ ID NO: 953177 - DNA, 25 bp, Mus musculus
ttgctgtacctcagccagcttcaga

SEQ ID NO: 953178 - DNA, 25 bp, Mus musculus
ttgctgtacctctgccagcttcaga

SEQ ID NO: 953179 - DNA, 25 bp, Mus musculus
ttgctgtactgtaacttggctccaa

SEQ ID NO: 953180 - DNA, 25 bp, Mus musculus
ttgctgtactgttacttggctccaa

SEQ ID NO: 953181 - DNA, 25 bp, Mus musculus
ttgctgtagctgcaacatggcccct

SEQ ID NO: 953182 - DNA, 25 bp, Mus musculus
ttgctgtagctggaacatggcccct

SEQ ID NO: 953183 - DNA, 25 bp, Mus musculus
ttgctgtaggagacctgaccttcca

SEQ ID NO: 953184 - DNA, 25 bp, Mus musculus
ttgctgtaggagtcctgaccttcca

SEQ ID NO: 953185 - DNA, 25 bp, Mus musculus
ttgctgtatctccttcaaacctaca

SEQ ID NO: 953186 - DNA, 25 bp, Mus musculus
ttgctgtatctcgttcaaacctaca

SEQ ID NO: 953187 - DNA, 25 bp, Mus musculus
ttgctgtatgctcacccctagaata

SEQ ID NO: 953188 - DNA, 25 bp, Mus musculus
ttgctgtatgctgacccctagaata

SEQ ID NO: 953189 - DNA, 25 bp, Mus musculus
ttgctgtattaacatctgccatagt

SEQ ID NO: 953190 - DNA, 25 bp, Mus musculus
ttgctgtattaagatctgccatagt

SEQ ID NO: 953191 - DNA, 25 bp, Mus musculus
ttgctgtcaaaccacctgctgcagg

SEQ ID NO: 953192 - DNA, 25 bp, Mus musculus
ttgctgtcaaacgacctgctgcagg

SEQ ID NO: 953193 - DNA, 25 bp, Mus musculus
ttgctgtcaaccacatgtttgtctc

SEQ ID NO: 953194 - DNA, 25 bp, Mus musculus
ttgctgtcaacctcatgtttgtctc

SEQ ID NO: 953195 - DNA, 25 bp, Mus musculus
ttgctgtccaaaaagtataaacctg

SEQ ID NO: 953196 - DNA, 25 bp, Mus musculus
ttgctgtccaaatagtataaacctg

SEQ ID NO: 953197 - DNA, 25 bp, Mus musculus
ttgctgtccatcctgtctgggtaga

SEQ ID NO: 953198 - DNA, 25 bp, Mus musculus
ttgctgtccatcgtgtctgggtaga

SEQ ID NO: 953199 - DNA, 25 bp, Mus musculus
ttgctgtcccagaactctttatata

SEQ ID NO: 953200 - DNA, 25 bp, Mus musculus
ttgctgtcccagtactctttatata

SEQ ID NO: 953201 - DNA, 25 bp, Mus musculus
ttgctgtccccgagtcacagtcagt

SEQ ID NO: 953202 - DNA, 25 bp, Mus musculus
ttgctgtccccgtgtcacagtcagt

SEQ ID NO: 953203 - DNA, 25 bp, Mus musculus
ttgctgtccctaatcagggtactta

SEQ ID NO: 953204 - DNA, 25 bp, Mus musculus
ttgctgtccctattcagggtactta

SEQ ID NO: 953205 - DNA, 25 bp, Mus musculus
ttgctgtccctgcaagaaacgtcag

SEQ ID NO: 953206 - DNA, 25 bp, Mus musculus
ttgctgtccctggaagaaacgtcag

SEQ ID NO: 953207 - DNA, 25 bp, Mus musculus
ttgctgtcccttacaacatgttgtt

SEQ ID NO: 953208 - DNA, 25 bp, Mus musculus
ttgctgtcccttcggtcaccaggtc

SEQ ID NO: 953209 - DNA, 25 bp, Mus musculus
ttgctgtcccttgggtcaccaggtc

SEQ ID NO: 953210 - DNA, 25 bp, Mus musculus
ttgctgtccctttcaacatgttgtt

SEQ ID NO: 953211 - DNA, 25 bp, Mus musculus
ttgctgtccgctactgtgttcacga

SEQ ID NO: 953212 - DNA, 25 bp, Mus musculus
ttgctgtccgcttctgtgttcacga

SEQ ID NO: 953213 - DNA, 25 bp, Mus musculus
ttgctgtcctatcgtctgcaggtac

SEQ ID NO: 953214 - DNA, 25 bp, Mus musculus
ttgctgtcctatggtctgcaggtac

SEQ ID NO: 953215 - DNA, 25 bp, Mus musculus
ttgctgtcctcccttgcctaggatg

SEQ ID NO: 953216 - DNA, 25 bp, Mus musculus
ttgctgtcctccgttgcctaggatg

SEQ ID NO: 953217 - DNA, 25 bp, Mus musculus
ttgctgtccttacgcggcatcaggg

SEQ ID NO: 953218 - DNA, 25 bp, Mus musculus
ttgctgtccttaggcggcatcaggg

SEQ ID NO: 953219 - DNA, 25 bp, Mus musculus
ttgctgtctcataaaccatcgctga

SEQ ID NO: 953220 - DNA, 25 bp, Mus musculus
ttgctgtctcattaaccatcgctga

SEQ ID NO: 953221 - DNA, 25 bp, Mus musculus
ttgctgtctccaagaacctctgaag

SEQ ID NO: 953222 - DNA, 25 bp, Mus musculus
ttgctgtctccatgaacctctgaag

SEQ ID NO: 953223 - DNA, 25 bp, Mus musculus
ttgctgtctggccattgtgtccaag

SEQ ID NO: 953224 - DNA, 25 bp, Mus musculus
ttgctgtctggcgattgtgtccaag

SEQ ID NO: 953225 - DNA, 25 bp, Mus musculus
ttgctgtcttacaagcctccttagg

SEQ ID NO: 953226 - DNA, 25 bp, Mus musculus
ttgctgtcttactagcctccttagg

SEQ ID NO: 953227 - DNA, 25 bp, Mus musculus
ttgctgtgaaaccagctgctgcaag

SEQ ID NO: 953228 - DNA, 25 bp, Mus musculus
ttgctgtgaaacgagctgctgcaag

SEQ ID NO: 953229 - DNA, 25 bp, Mus musculus
ttgctgtgagttcttccagaccttt

SEQ ID NO: 953230 - DNA, 25 bp, Mus musculus
ttgctgtgagttgttccagaccttt

SEQ ID NO: 953231 - DNA, 25 bp, Mus musculus
ttgctgtgatagctctgccagtcat

SEQ ID NO: 953232 - DNA, 25 bp, Mus musculus
ttgctgtgataggtctgccagtcat

SEQ ID NO: 953233 - DNA, 25 bp, Mus musculus
ttgctgtgcaacctcagacaagacc

SEQ ID NO: 953234 - DNA, 25 bp, Mus musculus
ttgctgtgcaacgtcagacaagacc

SEQ ID NO: 953235 - DNA, 25 bp, Mus musculus
ttgctgtgcagcctcagctgtgttg

SEQ ID NO: 953236 - DNA, 25 bp, Mus musculus
ttgctgtgcagcgtcagctgtgttg

SEQ ID NO: 953237 - DNA, 25 bp, Mus musculus
ttgctgtgccggagactgaaaacca

SEQ ID NO: 953238 - DNA, 25 bp, Mus musculus
ttgctgtgccggtgactgaaaacca

SEQ ID NO: 953239 - DNA, 25 bp, Mus musculus
ttgctgtgcctgatggcagggaaaa

SEQ ID NO: 953240 - DNA, 25 bp, Mus musculus
ttgctgtgcctgttggcagggaaaa

SEQ ID NO: 953241 - DNA, 25 bp, Mus musculus
ttgctgtgccttcagtgaaaggaag

SEQ ID NO: 953242 - DNA, 25 bp, Mus musculus
ttgctgtgccttgagtgaaaggaag

SEQ ID NO: 953243 - DNA, 25 bp, Mus musculus
ttgctgtgctatacagagctcatca

SEQ ID NO: 953244 - DNA, 25 bp, Mus musculus
ttgctgtgctattcagagctcatca

SEQ ID NO: 953245 - DNA, 25 bp, Mus musculus
ttgctgtggaaaaatctctggagtc

SEQ ID NO: 953246 - DNA, 25 bp, Mus musculus
ttgctgtggaaatatctctggagtc

SEQ ID NO: 953247 - DNA, 25 bp, Mus musculus
ttgctgtggactcgaccagcaatgg

SEQ ID NO: 953248 - DNA, 25 bp, Mus musculus
ttgctgtggactggaccagcaatgg

SEQ ID NO: 953249 - DNA, 25 bp, Mus musculus
ttgctgtgtaacaaagactgacctt

SEQ ID NO: 953250 - DNA, 25 bp, Mus musculus
ttgctgtgtaactaagactgacctt

SEQ ID NO: 953251 - DNA, 25 bp, Mus musculus
ttgctgtgtccaatttcagtatgat

SEQ ID NO: 953252 - DNA, 25 bp, Mus musculus
ttgctgtgtccattttcagtatgat

SEQ ID NO: 953253 - DNA, 25 bp, Mus musculus
ttgctgtgtctcaggattggtccaa

SEQ ID NO: 953254 - DNA, 25 bp, Mus musculus
ttgctgtgtctctggattggtccaa

SEQ ID NO: 953255 - DNA, 25 bp, Mus musculus
ttgctgtgtgtccacccctccattt

SEQ ID NO: 953256 - DNA, 25 bp, Mus musculus
ttgctgtgtgtcgacccctccattt

SEQ ID NO: 953257 - DNA, 25 bp, Mus musculus
ttgctgtgttccaggccgagtacct

SEQ ID NO: 953258 - DNA, 25 bp, Mus musculus
ttgctgtgttcctggccgagtacct

SEQ ID NO: 953259 - DNA, 25 bp, Mus musculus
ttgctgtgttgacagacagaaggtc

SEQ ID NO: 953260 - DNA, 25 bp, Mus musculus
ttgctgtgttgagagacagaaggtc

SEQ ID NO: 953261 - DNA, 25 bp, Mus musculus
ttgctgtgtttgctgtaataaatta

SEQ ID NO: 953262 - DNA, 25 bp, Mus musculus
ttgctgtgtttggtgtaataaatta

SEQ ID NO: 953263 - DNA, 25 bp, Mus musculus
ttgctgttaatacgcctttgggtac

SEQ ID NO: 953264 - DNA, 25 bp, Mus musculus
ttgctgttaataggcctttgggtac

SEQ ID NO: 953265 - DNA, 25 bp, Mus musculus
ttgctgttatttatgcatggctaat

SEQ ID NO: 953266 - DNA, 25 bp, Mus musculus
ttgctgttatttttgcatggctaat

SEQ ID NO: 953267 - DNA, 25 bp, Mus musculus
ttgctgttcagtcatccctacagag

SEQ ID NO: 953268 - DNA, 25 bp, Mus musculus
ttgctgttcagtgatccctacagag

SEQ ID NO: 953269 - DNA, 25 bp, Mus musculus
ttgctgttccagcttagggcttcct

SEQ ID NO: 953270 - DNA, 25 bp, Mus musculus
ttgctgttccaggttagggcttcct

SEQ ID NO: 953271 - DNA, 25 bp, Mus musculus
ttgctgttcccaatgaaatcctttc

SEQ ID NO: 953272 - DNA, 25 bp, Mus musculus
ttgctgttcccattgaaatcctttc

SEQ ID NO: 953273 - DNA, 25 bp, Mus musculus
ttgctgttccgcagaacttccacct

SEQ ID NO: 953274 - DNA, 25 bp, Mus musculus
ttgctgttccgctgaacttccacct

SEQ ID NO: 953275 - DNA, 25 bp, Mus musculus
ttgctgttcctccagggcatcagca

SEQ ID NO: 953276 - DNA, 25 bp, Mus musculus
ttgctgttcctcgagggcatcagca

SEQ ID NO: 953277 - DNA, 25 bp, Mus musculus
ttgctgttctagaccttctcaggaa

SEQ ID NO: 953278 - DNA, 25 bp, Mus musculus
ttgctgttctagtccttctcaggaa

SEQ ID NO: 953279 - DNA, 25 bp, Mus musculus
ttgctgttcttgaggttgttttatt

SEQ ID NO: 953280 - DNA, 25 bp, Mus musculus
ttgctgttcttgtggttgttttatt

SEQ ID NO: 953281 - DNA, 25 bp, Mus musculus
ttgctgttgatgactcacacttcag

SEQ ID NO: 953282 - DNA, 25 bp, Mus musculus
ttgctgttgatgtctcacacttcag

SEQ ID NO: 953283 - DNA, 25 bp, Mus musculus
ttgctgttgcagactgtctttttgt

SEQ ID NO: 953284 - DNA, 25 bp, Mus musculus
ttgctgttgcagtctgtctttttgt

SEQ ID NO: 953285 - DNA, 25 bp, Mus musculus
ttgctgttgcatcctgtttgagtct

SEQ ID NO: 953286 - DNA, 25 bp, Mus musculus
ttgctgttgcatgctgtttgagtct

SEQ ID NO: 953287 - DNA, 25 bp, Mus musculus
ttgctgttgccaatctcgctgttgt

SEQ ID NO: 953288 - DNA, 25 bp, Mus musculus
ttgctgttgccaatgtaattcaagt

SEQ ID NO: 953289 - DNA, 25 bp, Mus musculus
ttgctgttgccattctcgctgttgt

SEQ ID NO: 953290 - DNA, 25 bp, Mus musculus
ttgctgttgccattgtaattcaagt

SEQ ID NO: 953291 - DNA, 25 bp, Mus musculus
ttgctgttgctaaaggtggttccga

SEQ ID NO: 953292 - DNA, 25 bp, Mus musculus
ttgctgttgctataggtggttccga

SEQ ID NO: 953293 - DNA, 25 bp, Mus musculus
ttgctgttggctagtgtactaataa

SEQ ID NO: 953294 - DNA, 25 bp, Mus musculus
ttgctgttggcttgtgtactaataa

SEQ ID NO: 953295 - DNA, 25 bp, Mus musculus
ttgctgttggtcacttgtaccagta

SEQ ID NO: 953296 - DNA, 25 bp, Mus musculus
ttgctgttggtctcttgtaccagta

SEQ ID NO: 953297 - DNA, 25 bp, Mus musculus
ttgctgttggttcgttatttcctgc

SEQ ID NO: 953298 - DNA, 25 bp, Mus musculus
ttgctgttggttggttatttcctgc

SEQ ID NO: 953299 - DNA, 25 bp, Mus musculus
ttgctgtttacactctcactaaatt

SEQ ID NO: 953300 - DNA, 25 bp, Mus musculus
ttgctgtttacagtctcactaaatt

SEQ ID NO: 953301 - DNA, 25 bp, Mus musculus
ttgctgtttgacctggaaaccaatc

SEQ ID NO: 953302 - DNA, 25 bp, Mus musculus
ttgctgtttgacgtggaaaccaatc

SEQ ID NO: 953303 - DNA, 25 bp, Mus musculus
ttgctgtttgccctctgtaggtggc

SEQ ID NO: 953304 - DNA, 25 bp, Mus musculus
ttgctgtttgccgtctgtaggtggc

SEQ ID NO: 953305 - DNA, 25 bp, Mus musculus
ttgctgtttgcgagcttggatatag

SEQ ID NO: 953306 - DNA, 25 bp, Mus musculus
ttgctgtttgcgtgcttggatatag

SEQ ID NO: 953307 - DNA, 25 bp, Mus musculus
ttgctgtttggcagttgttgatcat

SEQ ID NO: 953308 - DNA, 25 bp, Mus musculus
ttgctgtttggctgttgttgatcat

SEQ ID NO: 953309 - DNA, 25 bp, Mus musculus
ttgctgttttcacacactgctgttt

SEQ ID NO: 953310 - DNA, 25 bp, Mus musculus
ttgctgttttcagacactgctgttt

SEQ ID NO: 953311 - DNA, 25 bp, Mus musculus
ttgctgttttgacacttgcttaaag

SEQ ID NO: 953312 - DNA, 25 bp, Mus musculus
ttgctgttttgagacttgcttaaag

SEQ ID NO: 953313 - DNA, 25 bp, Mus musculus
ttgctgttttgcagttctttgccag

SEQ ID NO: 953314 - DNA, 25 bp, Mus musculus
ttgctgttttgctgttctttgccag

SEQ ID NO: 953315 - DNA, 25 bp, Mus musculus
ttgctgtttttaaccttctgtgagg

SEQ ID NO: 953316 - DNA, 25 bp, Mus musculus
ttgctgtttttatccttctgtgagg

SEQ ID NO: 953317 - DNA, 25 bp, Mus musculus
ttgcttaaagcaacctgcagcccac

SEQ ID NO: 953318 - DNA, 25 bp, Mus musculus
ttgcttaaagcatcctgcagcccac

SEQ ID NO: 953319 - DNA, 25 bp, Mus musculus
ttgcttaaatttctatgatacgtga

SEQ ID NO: 953320 - DNA, 25 bp, Mus musculus
ttgcttaaatttgtatgatacgtga

SEQ ID NO: 953321 - DNA, 25 bp, Mus musculus
ttgcttaactttcagctcagactgc

SEQ ID NO: 953322 - DNA, 25 bp, Mus musculus
ttgcttaactttgagctcagactgc

SEQ ID NO: 953323 - DNA, 25 bp, Mus musculus
ttgcttaagcttccactgcagtctc

SEQ ID NO: 953324 - DNA, 25 bp, Mus musculus
ttgcttaagcttgcactgcagtctc

SEQ ID NO: 953325 - DNA, 25 bp, Mus musculus
ttgcttaatatcaaacaacctttat

SEQ ID NO: 953326 - DNA, 25 bp, Mus musculus
ttgcttaatatctaacaacctttat

SEQ ID NO: 953327 - DNA, 25 bp, Mus musculus
ttgcttaatcaaaactgggaaccag

SEQ ID NO: 953328 - DNA, 25 bp, Mus musculus
ttgcttaatcaatactgggaaccag

SEQ ID NO: 953329 - DNA, 25 bp, Mus musculus
ttgcttacactgcttcctttctggc

SEQ ID NO: 953330 - DNA, 25 bp, Mus musculus
ttgcttacactggttcctttctggc

SEQ ID NO: 953331 - DNA, 25 bp, Mus musculus
ttgcttacaggaacccatgaggccc

SEQ ID NO: 953332 - DNA, 25 bp, Mus musculus
ttgcttacaggatcccatgaggccc

SEQ ID NO: 953333 - DNA, 25 bp, Mus musculus
ttgcttacaggcaggcgacaggcat

SEQ ID NO: 953334 - DNA, 25 bp, Mus musculus
ttgcttacaggctggcgacaggcat

SEQ ID NO: 953335 - DNA, 25 bp, Mus musculus
ttgcttacagtgctgttgccccgac

SEQ ID NO: 953336 - DNA, 25 bp, Mus musculus
ttgcttacagtggtgttgccccgac

SEQ ID NO: 953337 - DNA, 25 bp, Mus musculus
ttgcttaccaaacgaggcccaattc

SEQ ID NO: 953338 - DNA, 25 bp, Mus musculus
ttgcttaccaaaggaggcccaattc

SEQ ID NO: 953339 - DNA, 25 bp, Mus musculus
ttgcttaccaagaactgcccctgtc

SEQ ID NO: 953340 - DNA, 25 bp, Mus musculus
ttgcttaccaagtactgcccctgtc

SEQ ID NO: 953341 - DNA, 25 bp, Mus musculus
ttgcttaccacaatgttaactgtag

SEQ ID NO: 953342 - DNA, 25 bp, Mus musculus
ttgcttaccacattgttaactgtag

SEQ ID NO: 953343 - DNA, 25 bp, Mus musculus
ttgcttaccccaatttgaccttaga

SEQ ID NO: 953344 - DNA, 25 bp, Mus musculus
ttgcttaccccattttgaccttaga

SEQ ID NO: 953345 - DNA, 25 bp, Mus musculus
ttgcttaccctcacattgcagactg

SEQ ID NO: 953346 - DNA, 25 bp, Mus musculus
ttgcttaccctctcattgcagactg

SEQ ID NO: 953347 - DNA, 25 bp, Mus musculus
ttgcttacctttaactgaacctcag

SEQ ID NO: 953348 - DNA, 25 bp, Mus musculus
ttgcttacctttcccttgatttcaa

SEQ ID NO: 953349 - DNA, 25 bp, Mus musculus
ttgcttacctttgccttgatttcaa

SEQ ID NO: 953350 - DNA, 25 bp, Mus musculus
ttgcttaccttttactgaacctcag

SEQ ID NO: 953351 - DNA, 25 bp, Mus musculus
ttgcttacgagaaacagaccccggg

SEQ ID NO: 953352 - DNA, 25 bp, Mus musculus
ttgcttacgagatacagaccccggg

SEQ ID NO: 953353 - DNA, 25 bp, Mus musculus
ttgcttactattaccctgagggtat

SEQ ID NO: 953354 - DNA, 25 bp, Mus musculus
ttgcttactatttccctgagggtat

SEQ ID NO: 953355 - DNA, 25 bp, Mus musculus
ttgcttactccaccgggtctctgaa

SEQ ID NO: 953356 - DNA, 25 bp, Mus musculus
ttgcttactccagcgggtctctgaa

SEQ ID NO: 953357 - DNA, 25 bp, Mus musculus
ttgcttactgcaatggaaaatccca

SEQ ID NO: 953358 - DNA, 25 bp, Mus musculus
ttgcttactgcattggaaaatccca

SEQ ID NO: 953359 - DNA, 25 bp, Mus musculus
ttgcttacttctacccagtggaatg

SEQ ID NO: 953360 - DNA, 25 bp, Mus musculus
ttgcttacttcttcccagtggaatg

SEQ ID NO: 953361 - DNA, 25 bp, Mus musculus
ttgcttagaactctgacgaatggtt

SEQ ID NO: 953362 - DNA, 25 bp, Mus musculus
ttgcttagaactgtgacgaatggtt

SEQ ID NO: 953363 - DNA, 25 bp, Mus musculus
ttgcttagcattactcactgtgtgt

SEQ ID NO: 953364 - DNA, 25 bp, Mus musculus
ttgcttagcatttctcactgtgtgt

SEQ ID NO: 953365 - DNA, 25 bp, Mus musculus
ttgcttagcttcactctatgggaca

SEQ ID NO: 953366 - DNA, 25 bp, Mus musculus
ttgcttagcttctctctatgggaca

SEQ ID NO: 953367 - DNA, 25 bp, Mus musculus
ttgcttagggccatgtcaagaccgc

SEQ ID NO: 953368 - DNA, 25 bp, Mus musculus
ttgcttagggccttgtcaagaccgc

SEQ ID NO: 953369 - DNA, 25 bp, Mus musculus
ttgcttaggtgcattttcctttgtg

SEQ ID NO: 953370 - DNA, 25 bp, Mus musculus
ttgcttaggtgctttttcctttgtg

SEQ ID NO: 953371 - DNA, 25 bp, Mus musculus
ttgcttataacgatacttgaagtaa

SEQ ID NO: 953372 - DNA, 25 bp, Mus musculus
ttgcttataacgttacttgaagtaa

SEQ ID NO: 953373 - DNA, 25 bp, Mus musculus
ttgcttataactacagccttgaata

SEQ ID NO: 953374 - DNA, 25 bp, Mus musculus
ttgcttataacttcagccttgaata

SEQ ID NO: 953375 - DNA, 25 bp, Mus musculus
ttgcttataattacccaacaaaata

SEQ ID NO: 953376 - DNA, 25 bp, Mus musculus
ttgcttataatttcccaacaaaata

SEQ ID NO: 953377 - DNA, 25 bp, Mus musculus
ttgcttatacttaggctggcactat

SEQ ID NO: 953378 - DNA, 25 bp, Mus musculus
ttgcttatactttggctggcactat

SEQ ID NO: 953379 - DNA, 25 bp, Mus musculus
ttgcttatatcaaacgcctcttggt

SEQ ID NO: 953380 - DNA, 25 bp, Mus musculus
ttgcttatatcatacgcctcttggt

SEQ ID NO: 953381 - DNA, 25 bp, Mus musculus
ttgcttatcctgacgccagatttta

SEQ ID NO: 953382 - DNA, 25 bp, Mus musculus
ttgcttatcctgtcgccagatttta

SEQ ID NO: 953383 - DNA, 25 bp, Mus musculus
ttgcttatctgtctgctagcagaga

SEQ ID NO: 953384 - DNA, 25 bp, Mus musculus
ttgcttatctgtgtgctagcagaga

SEQ ID NO: 953385 - DNA, 25 bp, Mus musculus
ttgcttatgcctacagtcacatgta

SEQ ID NO: 953386 - DNA, 25 bp, Mus musculus
ttgcttatgccttcagtcacatgta

SEQ ID NO: 953387 - DNA, 25 bp, Mus musculus
ttgcttatgtctaaattgttggaaa

SEQ ID NO: 953388 - DNA, 25 bp, Mus musculus
ttgcttatgtcttaattgttggaaa

SEQ ID NO: 953389 - DNA, 25 bp, Mus musculus
ttgcttattatccttcttgtacaca

SEQ ID NO: 953390 - DNA, 25 bp, Mus musculus
ttgcttattatcgttcttgtacaca

SEQ ID NO: 953391 - DNA, 25 bp, Mus musculus
ttgcttattattcgccttggcctag

SEQ ID NO: 953392 - DNA, 25 bp, Mus musculus
ttgcttattattggccttggcctag

SEQ ID NO: 953393 - DNA, 25 bp, Mus musculus
ttgcttatttaacgttccctcctct

SEQ ID NO: 953394 - DNA, 25 bp, Mus musculus
ttgcttatttaaggttccctcctct

SEQ ID NO: 953395 - DNA, 25 bp, Mus musculus
ttgcttatttgaatgagggtgtaac

SEQ ID NO: 953396 - DNA, 25 bp, Mus musculus
ttgcttatttgattgagggtgtaac

SEQ ID NO: 953397 - DNA, 25 bp, Mus musculus
ttgcttattttaaagccatccatca

SEQ ID NO: 953398 - DNA, 25 bp, Mus musculus
ttgcttattttatagccatccatca

SEQ ID NO: 953399 - DNA, 25 bp, Mus musculus
ttgcttcaaattctccctttatctt

SEQ ID NO: 953400 - DNA, 25 bp, Mus musculus
ttgcttcaaattgtccctttatctt

SEQ ID NO: 953401 - DNA, 25 bp, Mus musculus
ttgcttcaagacatcaaggcccaaa

SEQ ID NO: 953402 - DNA, 25 bp, Mus musculus
ttgcttcaagacttcaaggcccaaa

SEQ ID NO: 953403 - DNA, 25 bp, Mus musculus
ttgcttcaaggaccggactcggagc

SEQ ID NO: 953404 - DNA, 25 bp, Mus musculus
ttgcttcaaggagcggactcggagc

SEQ ID NO: 953405 - DNA, 25 bp, Mus musculus
ttgcttcaccatcttgttgcctttg

SEQ ID NO: 953406 - DNA, 25 bp, Mus musculus
ttgcttcaccatgttgttgcctttg

SEQ ID NO: 953407 - DNA, 25 bp, Mus musculus
ttgcttcactaaaagttcctggagg

SEQ ID NO: 953408 - DNA, 25 bp, Mus musculus
ttgcttcactaatagttcctggagg

SEQ ID NO: 953409 - DNA, 25 bp, Mus musculus
ttgcttcactgtataagtgccctga

SEQ ID NO: 953410 - DNA, 25 bp, Mus musculus
ttgcttcactgtcgtgaacggccaa

SEQ ID NO: 953411 - DNA, 25 bp, Mus musculus
ttgcttcactgtggtgaacggccaa

SEQ ID NO: 953412 - DNA, 25 bp, Mus musculus
ttgcttcactgtttaagtgccctga

SEQ ID NO: 953413 - DNA, 25 bp, Mus musculus
ttgcttcagatcaatgtttccacga

SEQ ID NO: 953414 - DNA, 25 bp, Mus musculus
ttgcttcagatctatgtttccacga

SEQ ID NO: 953415 - DNA, 25 bp, Mus musculus
ttgcttcagtggctgaactcggtct

SEQ ID NO: 953416 - DNA, 25 bp, Mus musculus
ttgcttcagtgggtgaactcggtct

SEQ ID NO: 953417 - DNA, 25 bp, Mus musculus
ttgcttcagtgtacagaaacctcct

SEQ ID NO: 953418 - DNA, 25 bp, Mus musculus
ttgcttcagtgttcagaaacctcct

SEQ ID NO: 953419 - DNA, 25 bp, Mus musculus
ttgcttcagtttcgacagattgtta

SEQ ID NO: 953420 - DNA, 25 bp, Mus musculus
ttgcttcagtttggacagattgtta

SEQ ID NO: 953421 - DNA, 25 bp, Mus musculus
ttgcttcattagcaaaactgatcgg

SEQ ID NO: 953422 - DNA, 25 bp, Mus musculus
ttgcttcattaggaaaactgatcgg

SEQ ID NO: 953423 - DNA, 25 bp, Mus musculus
ttgcttccaacaccaagctgggaca

SEQ ID NO: 953424 - DNA, 25 bp, Mus musculus
ttgcttccaacagcaagctgggaca

SEQ ID NO: 953425 - DNA, 25 bp, Mus musculus
ttgcttccaagcactccaatggtga

SEQ ID NO: 953426 - DNA, 25 bp, Mus musculus
ttgcttccaagctctccaatggtga

SEQ ID NO: 953427 - DNA, 25 bp, Mus musculus
ttgcttccaatgaggcttcgtatcc

SEQ ID NO: 953428 - DNA, 25 bp, Mus musculus
ttgcttccaatgtggcttcgtatcc

SEQ ID NO: 953429 - DNA, 25 bp, Mus musculus
ttgcttccacctaacttttgacaga

SEQ ID NO: 953430 - DNA, 25 bp, Mus musculus
ttgcttccaccttacttttgacaga

SEQ ID NO: 953431 - DNA, 25 bp, Mus musculus
ttgcttccagccatgttcaacatag

SEQ ID NO: 953432 - DNA, 25 bp, Mus musculus
ttgcttccagccttgttcaacatag

SEQ ID NO: 953433 - DNA, 25 bp, Mus musculus
ttgcttccaggcagggagaacctct

SEQ ID NO: 953434 - DNA, 25 bp, Mus musculus
ttgcttccaggctgggagaacctct

SEQ ID NO: 953435 - DNA, 25 bp, Mus musculus
ttgcttccagtgatctcctttagtg

SEQ ID NO: 953436 - DNA, 25 bp, Mus musculus
ttgcttccagtgttctcctttagtg

SEQ ID NO: 953437 - DNA, 25 bp, Mus musculus
ttgcttccataaagcagcatgacat

SEQ ID NO: 953438 - DNA, 25 bp, Mus musculus
ttgcttccataatgcagcatgacat

SEQ ID NO: 953439 - DNA, 25 bp, Mus musculus
ttgcttccatcaagtttggcttcat

SEQ ID NO: 953440 - DNA, 25 bp, Mus musculus
ttgcttccatcatgtttggcttcat

SEQ ID NO: 953441 - DNA, 25 bp, Mus musculus
ttgcttccccacagtgatagactgt

SEQ ID NO: 953442 - DNA, 25 bp, Mus musculus
ttgcttccccactgtgatagactgt

SEQ ID NO: 953443 - DNA, 25 bp, Mus musculus
ttgcttccccgcactgtgttactga

SEQ ID NO: 953444 - DNA, 25 bp, Mus musculus
ttgcttccccgctctgtgttactga

SEQ ID NO: 953445 - DNA, 25 bp, Mus musculus
ttgcttcccggacgccattgtattg

SEQ ID NO: 953446 - DNA, 25 bp, Mus musculus
ttgcttcccggaggccattgtattg

SEQ ID NO: 953447 - DNA, 25 bp, Mus musculus
ttgcttccctgaagtgatgctttca

SEQ ID NO: 953448 - DNA, 25 bp, Mus musculus
ttgcttccctgatgtgatgctttca

SEQ ID NO: 953449 - DNA, 25 bp, Mus musculus
ttgcttccctgtaggctcatggaga

SEQ ID NO: 953450 - DNA, 25 bp, Mus musculus
ttgcttccctgttggctcatggaga

SEQ ID NO: 953451 - DNA, 25 bp, Mus musculus
ttgcttcctagcctttggtgtattt

SEQ ID NO: 953452 - DNA, 25 bp, Mus musculus
ttgcttcctagcgtttggtgtattt

SEQ ID NO: 953453 - DNA, 25 bp, Mus musculus
ttgcttcctatgaccactcagaaag

SEQ ID NO: 953454 - DNA, 25 bp, Mus musculus
ttgcttcctatgtccactcagaaag

SEQ ID NO: 953455 - DNA, 25 bp, Mus musculus
ttgcttcctgaaatcgtgcttaaac

SEQ ID NO: 953456 - DNA, 25 bp, Mus musculus
ttgcttcctgaattcgtgcttaaac

SEQ ID NO: 953457 - DNA, 25 bp, Mus musculus
ttgcttcctgctatacctgggatgc

SEQ ID NO: 953458 - DNA, 25 bp, Mus musculus
ttgcttcctgctttacctgggatgc

SEQ ID NO: 953459 - DNA, 25 bp, Mus musculus
ttgcttcctggcagttgtgtaaaaa

SEQ ID NO: 953460 - DNA, 25 bp, Mus musculus
ttgcttcctggctgttgtgtaaaaa

SEQ ID NO: 953461 - DNA, 25 bp, Mus musculus
ttgcttcctggtctcatttgtgtag

SEQ ID NO: 953462 - DNA, 25 bp, Mus musculus
ttgcttcctggtgtcatttgtgtag

SEQ ID NO: 953463 - DNA, 25 bp, Mus musculus
ttgcttccttccaaaagtcaggcat

SEQ ID NO: 953464 - DNA, 25 bp, Mus musculus
ttgcttccttcctaaagtcaggcat

SEQ ID NO: 953465 - DNA, 25 bp, Mus musculus
ttgcttcctttgcttagtatctcag

SEQ ID NO: 953466 - DNA, 25 bp, Mus musculus
ttgcttcctttggttagtatctcag

SEQ ID NO: 953467 - DNA, 25 bp, Mus musculus
ttgcttcgagccagccaatcagatg

SEQ ID NO: 953468 - DNA, 25 bp, Mus musculus
ttgcttcgagcctgccaatcagatg

SEQ ID NO: 953469 - DNA, 25 bp, Mus musculus
ttgcttcgctgcctagactggagag

SEQ ID NO: 953470 - DNA, 25 bp, Mus musculus
ttgcttcgctgcgtagactggagag

SEQ ID NO: 953471 - DNA, 25 bp, Mus musculus
ttgcttcgctggacttttctctaga

SEQ ID NO: 953472 - DNA, 25 bp, Mus musculus
ttgcttcgctggtcttttctctaga

SEQ ID NO: 953473 - DNA, 25 bp, Mus musculus
ttgcttctaattccatgttgccttc

SEQ ID NO: 953474 - DNA, 25 bp, Mus musculus
ttgcttctaattgcatgttgccttc

SEQ ID NO: 953475 - DNA, 25 bp, Mus musculus
ttgcttctacccatttgatcacgct

SEQ ID NO: 953476 - DNA, 25 bp, Mus musculus
ttgcttctacccttttgatcacgct

SEQ ID NO: 953477 - DNA, 25 bp, Mus musculus
ttgcttctatgtagcagatgtaaac

SEQ ID NO: 953478 - DNA, 25 bp, Mus musculus
ttgcttctatgttgcagatgtaaac

SEQ ID NO: 953479 - DNA, 25 bp, Mus musculus
ttgcttctcagaccttcagctagga

SEQ ID NO: 953480 - DNA, 25 bp, Mus musculus
ttgcttctcagagcttcagctagga

SEQ ID NO: 953481 - DNA, 25 bp, Mus musculus
ttgcttctcagccagtttgtgttag

SEQ ID NO: 953482 - DNA, 25 bp, Mus musculus
ttgcttctcagcctatagtcatagg

SEQ ID NO: 953483 - DNA, 25 bp, Mus musculus
ttgcttctcagcgagtttgtgttag

SEQ ID NO: 953484 - DNA, 25 bp, Mus musculus
ttgcttctcagcgtatagtcatagg

SEQ ID NO: 953485 - DNA, 25 bp, Mus musculus
ttgcttctcatgctggccgtaagat

SEQ ID NO: 953486 - DNA, 25 bp, Mus musculus
ttgcttctcatggtggccgtaagat

SEQ ID NO: 953487 - DNA, 25 bp, Mus musculus
ttgcttctcgccaagagcttccagt

SEQ ID NO: 953488 - DNA, 25 bp, Mus musculus
ttgcttctcgcctagagcttccagt

SEQ ID NO: 953489 - DNA, 25 bp, Mus musculus
ttgcttctctacatccagctttata

SEQ ID NO: 953490 - DNA, 25 bp, Mus musculus
ttgcttctctacttccagctttata

SEQ ID NO: 953491 - DNA, 25 bp, Mus musculus
ttgcttctctgaacgctgatatttg

SEQ ID NO: 953492 - DNA, 25 bp, Mus musculus
ttgcttctctgatcgctgatatttg

SEQ ID NO: 953493 - DNA, 25 bp, Mus musculus
ttgcttctctggctctagtgactga

SEQ ID NO: 953494 - DNA, 25 bp, Mus musculus
ttgcttctctgggtctagtgactga

SEQ ID NO: 953495 - DNA, 25 bp, Mus musculus
ttgcttctctgtctcttcatcatcc

SEQ ID NO: 953496 - DNA, 25 bp, Mus musculus
ttgcttctctgtgtcttcatcatcc

SEQ ID NO: 953497 - DNA, 25 bp, Mus musculus
ttgcttctctttatcctattctttg

SEQ ID NO: 953498 - DNA, 25 bp, Mus musculus
ttgcttctctttttcctattctttg

SEQ ID NO: 953499 - DNA, 25 bp, Mus musculus
ttgcttctgagaacttgctacttgc

SEQ ID NO: 953500 - DNA, 25 bp, Mus musculus
ttgcttctgagatcttgctacttgc

SEQ ID NO: 953501 - DNA, 25 bp, Mus musculus
ttgcttctgagtagtcaccacagga

SEQ ID NO: 953502 - DNA, 25 bp, Mus musculus
ttgcttctgagttgtcaccacagga

SEQ ID NO: 953503 - DNA, 25 bp, Mus musculus
ttgcttctggagatgagccaccagt

SEQ ID NO: 953504 - DNA, 25 bp, Mus musculus
ttgcttctggagttgagccaccagt

SEQ ID NO: 953505 - DNA, 25 bp, Mus musculus
ttgcttctgtcaatgaccaaaatac

SEQ ID NO: 953506 - DNA, 25 bp, Mus musculus
ttgcttctgtcattgaccaaaatac

SEQ ID NO: 953507 - DNA, 25 bp, Mus musculus
ttgcttctgtggacgtaaaaattgc

SEQ ID NO: 953508 - DNA, 25 bp, Mus musculus
ttgcttctgtggtcgtaaaaattgc

SEQ ID NO: 953509 - DNA, 25 bp, Mus musculus
ttgcttctgtttacctctggctttt

SEQ ID NO: 953510 - DNA, 25 bp, Mus musculus
ttgcttctgtttccttggtccatgg

SEQ ID NO: 953511 - DNA, 25 bp, Mus musculus
ttgcttctgtttgcttggtccatgg

SEQ ID NO: 953512 - DNA, 25 bp, Mus musculus
ttgcttctgttttcctctggctttt

SEQ ID NO: 953513 - DNA, 25 bp, Mus musculus
ttgcttcttcaaatgtcacctttgt

SEQ ID NO: 953514 - DNA, 25 bp, Mus musculus
ttgcttcttcaattgtcacctttgt

SEQ ID NO: 953515 - DNA, 25 bp, Mus musculus
ttgcttcttgctcgttggcaggcgc

SEQ ID NO: 953516 - DNA, 25 bp, Mus musculus
ttgcttcttgctggttggcaggcgc

SEQ ID NO: 953517 - DNA, 25 bp, Mus musculus
ttgcttctttgcaaccttggagctt

SEQ ID NO: 953518 - DNA, 25 bp, Mus musculus
ttgcttctttgctaccttggagctt

SEQ ID NO: 953519 - DNA, 25 bp, Mus musculus
ttgcttcttttcattcgtataaaat

SEQ ID NO: 953520 - DNA, 25 bp, Mus musculus
ttgcttcttttctttcgtataaaat

SEQ ID NO: 953521 - DNA, 25 bp, Mus musculus
ttgcttgaaagaaagctactgcctc

SEQ ID NO: 953522 - DNA, 25 bp, Mus musculus
ttgcttgaaagatagctactgcctc

SEQ ID NO: 953523 - DNA, 25 bp, Mus musculus
ttgcttgaagtaccacagaccctgt

SEQ ID NO: 953524 - DNA, 25 bp, Mus musculus
ttgcttgaagtagcacagaccctgt

SEQ ID NO: 953525 - DNA, 25 bp, Mus musculus
ttgcttgaccatcaggatctctatc

SEQ ID NO: 953526 - DNA, 25 bp, Mus musculus
ttgcttgaccatgaggatctctatc

SEQ ID NO: 953527 - DNA, 25 bp, Mus musculus
ttgcttgagggcagggcctaagcac

SEQ ID NO: 953528 - DNA, 25 bp, Mus musculus
ttgcttgagggctgggcctaagcac

SEQ ID NO: 953529 - DNA, 25 bp, Mus musculus
ttgcttgaggtgattatgctatcat

SEQ ID NO: 953530 - DNA, 25 bp, Mus musculus
ttgcttgaggtgtttatgctatcat

SEQ ID NO: 953531 - DNA, 25 bp, Mus musculus
ttgcttgagtcccaacaaccatcaa

SEQ ID NO: 953532 - DNA, 25 bp, Mus musculus
ttgcttgagtccgaacaaccatcaa

SEQ ID NO: 953533 - DNA, 25 bp, Mus musculus
ttgcttgattccaactcgtgtgcta

SEQ ID NO: 953534 - DNA, 25 bp, Mus musculus
ttgcttgattcctactcgtgtgcta

SEQ ID NO: 953535 - DNA, 25 bp, Mus musculus
ttgcttgcacgcatgcttgattatt

SEQ ID NO: 953536 - DNA, 25 bp, Mus musculus
ttgcttgcacgcttgcttgattatt

SEQ ID NO: 953537 - DNA, 25 bp, Mus musculus
ttgcttgcagcaaaggacgaccttg

SEQ ID NO: 953538 - DNA, 25 bp, Mus musculus
ttgcttgcagcataggacgaccttg

SEQ ID NO: 953539 - DNA, 25 bp, Mus musculus
ttgcttgcagttatttcccttaccg

SEQ ID NO: 953540 - DNA, 25 bp, Mus musculus
ttgcttgcagttttttcccttaccg

SEQ ID NO: 953541 - DNA, 25 bp, Mus musculus
ttgcttgccaagaagaacctgtgtc

SEQ ID NO: 953542 - DNA, 25 bp, Mus musculus
ttgcttgccaagtagaacctgtgtc

SEQ ID NO: 953543 - DNA, 25 bp, Mus musculus
ttgcttgccagactcttaggttgtt

SEQ ID NO: 953544 - DNA, 25 bp, Mus musculus
ttgcttgccagagtcttaggttgtt

SEQ ID NO: 953545 - DNA, 25 bp, Mus musculus
ttgcttgccatgaacagtcacctca

SEQ ID NO: 953546 - DNA, 25 bp, Mus musculus
ttgcttgccatgacgagcacagtat

SEQ ID NO: 953547 - DNA, 25 bp, Mus musculus
ttgcttgccatgtacagtcacctca

SEQ ID NO: 953548 - DNA, 25 bp, Mus musculus
ttgcttgccatgtcgagcacagtat

SEQ ID NO: 953549 - DNA, 25 bp, Mus musculus
ttgcttgctgctctgttttagacca

SEQ ID NO: 953550 - DNA, 25 bp, Mus musculus
ttgcttgctgctgtgttttagacca

SEQ ID NO: 953551 - DNA, 25 bp, Mus musculus
ttgcttgctgtacctgtatgtccgt

SEQ ID NO: 953552 - DNA, 25 bp, Mus musculus
ttgcttgctgtagctgtatgtccgt

SEQ ID NO: 953553 - DNA, 25 bp, Mus musculus
ttgcttgcttcaccccttagattga

SEQ ID NO: 953554 - DNA, 25 bp, Mus musculus
ttgcttgcttcagcccttagattga

SEQ ID NO: 953555 - DNA, 25 bp, Mus musculus
ttgcttgctttgaagaatgtttctt

SEQ ID NO: 953556 - DNA, 25 bp, Mus musculus
ttgcttgctttgtagaatgtttctt

SEQ ID NO: 953557 - DNA, 25 bp, Mus musculus
ttgcttgcttttctagacttctcag

SEQ ID NO: 953558 - DNA, 25 bp, Mus musculus
ttgcttgcttttctcagggttgatt

SEQ ID NO: 953559 - DNA, 25 bp, Mus musculus
ttgcttgcttttgtagacttctcag

SEQ ID NO: 953560 - DNA, 25 bp, Mus musculus
ttgcttgcttttgtcagggttgatt

SEQ ID NO: 953561 - DNA, 25 bp, Mus musculus
ttgcttggagtgcagccctatcatc

SEQ ID NO: 953562 - DNA, 25 bp, Mus musculus
ttgcttggagtggagccctatcatc

SEQ ID NO: 953563 - DNA, 25 bp, Mus musculus
ttgcttggcaccagtcttcgaaaga

SEQ ID NO: 953564 - DNA, 25 bp, Mus musculus
ttgcttggcacctgtcttcgaaaga

SEQ ID NO: 953565 - DNA, 25 bp, Mus musculus
ttgcttggctctcgtgatctcagag

SEQ ID NO: 953566 - DNA, 25 bp, Mus musculus
ttgcttggctctggtgatctcagag

SEQ ID NO: 953567 - DNA, 25 bp, Mus musculus
ttgcttgggcttaacactccctatg

SEQ ID NO: 953568 - DNA, 25 bp, Mus musculus
ttgcttgggctttacactccctatg

SEQ ID NO: 953569 - DNA, 25 bp, Mus musculus
ttgcttggggacacccatatccatg

SEQ ID NO: 953570 - DNA, 25 bp, Mus musculus
ttgcttggggactcccatatccatg

SEQ ID NO: 953571 - DNA, 25 bp, Mus musculus
ttgcttggtcttctgcgggtaccca

SEQ ID NO: 953572 - DNA, 25 bp, Mus musculus
ttgcttggtcttgtgcgggtaccca

SEQ ID NO: 953573 - DNA, 25 bp, Mus musculus
ttgcttgtaatgatatcctgtggta

SEQ ID NO: 953574 - DNA, 25 bp, Mus musculus
ttgcttgtaatgttatcctgtggta

SEQ ID NO: 953575 - DNA, 25 bp, Mus musculus
ttgcttgtacagagcatttcccttg

SEQ ID NO: 953576 - DNA, 25 bp, Mus musculus
ttgcttgtacagtgcatttcccttg

SEQ ID NO: 953577 - DNA, 25 bp, Mus musculus
ttgcttgtacctctggctgactaaa

SEQ ID NO: 953578 - DNA, 25 bp, Mus musculus
ttgcttgtacctgtggctgactaaa

SEQ ID NO: 953579 - DNA, 25 bp, Mus musculus
ttgcttgtatgcagggcacccgttt

SEQ ID NO: 953580 - DNA, 25 bp, Mus musculus
ttgcttgtatgctgggcacccgttt

SEQ ID NO: 953581 - DNA, 25 bp, Mus musculus
ttgcttgtatgtcgtttcaggtctg

SEQ ID NO: 953582 - DNA, 25 bp, Mus musculus
ttgcttgtatgtggtttcaggtctg

SEQ ID NO: 953583 - DNA, 25 bp, Mus musculus
ttgcttgtcacacagcgctacagga

SEQ ID NO: 953584 - DNA, 25 bp, Mus musculus
ttgcttgtcacagagcgctacagga

SEQ ID NO: 953585 - DNA, 25 bp, Mus musculus
ttgcttgtcagactcatgtctctcc

SEQ ID NO: 953586 - DNA, 25 bp, Mus musculus
ttgcttgtcagagtcatgtctctcc

SEQ ID NO: 953587 - DNA, 25 bp, Mus musculus
ttgcttgtccaacatctcagggcat

SEQ ID NO: 953588 - DNA, 25 bp, Mus musculus
ttgcttgtccaagatctcagggcat

SEQ ID NO: 953589 - DNA, 25 bp, Mus musculus
ttgcttgtccatccctaagctctat

SEQ ID NO: 953590 - DNA, 25 bp, Mus musculus
ttgcttgtccatgcctaagctctat

SEQ ID NO: 953591 - DNA, 25 bp, Mus musculus
ttgcttgtctatatagctttccttt

SEQ ID NO: 953592 - DNA, 25 bp, Mus musculus
ttgcttgtctatttagctttccttt

SEQ ID NO: 953593 - DNA, 25 bp, Mus musculus
ttgcttgtggtgactttgtacggat

SEQ ID NO: 953594 - DNA, 25 bp, Mus musculus
ttgcttgtggtgtctttgtacggat

SEQ ID NO: 953595 - DNA, 25 bp, Mus musculus
ttgcttgtgtatcacttggaagaag

SEQ ID NO: 953596 - DNA, 25 bp, Mus musculus
ttgcttgtgtatgacttggaagaag

SEQ ID NO: 953597 - DNA, 25 bp, Mus musculus
ttgcttgttcacatccaggatcttc

SEQ ID NO: 953598 - DNA, 25 bp, Mus musculus
ttgcttgttcacttccaggatcttc

SEQ ID NO: 953599 - DNA, 25 bp, Mus musculus
ttgcttgttcatacagtttttgttg

SEQ ID NO: 953600 - DNA, 25 bp, Mus musculus
ttgcttgttcattcagtttttgttg

SEQ ID NO: 953601 - DNA, 25 bp, Mus musculus
ttgcttgttgctatgcttcgacagt

SEQ ID NO: 953602 - DNA, 25 bp, Mus musculus
ttgcttgttgctttgcttcgacagt

SEQ ID NO: 953603 - DNA, 25 bp, Mus musculus
ttgcttgtttgaaacccctcacagg

SEQ ID NO: 953604 - DNA, 25 bp, Mus musculus
ttgcttgtttgatacccctcacagg

SEQ ID NO: 953605 - DNA, 25 bp, Mus musculus
ttgcttgtttgtaactcctatcgag

SEQ ID NO: 953606 - DNA, 25 bp, Mus musculus
ttgcttgtttgttactcctatcgag

SEQ ID NO: 953607 - DNA, 25 bp, Mus musculus
ttgcttgttttgattcccataggta

SEQ ID NO: 953608 - DNA, 25 bp, Mus musculus
ttgcttgttttgtttcccataggta

SEQ ID NO: 953609 - DNA, 25 bp, Mus musculus
ttgctttaaagcacccatccttttc

SEQ ID NO: 953610 - DNA, 25 bp, Mus musculus
ttgctttaaagctcccatccttttc

SEQ ID NO: 953611 - DNA, 25 bp, Mus musculus
ttgctttaactacttaatcactggt

SEQ ID NO: 953612 - DNA, 25 bp, Mus musculus
ttgctttaactagttaatcactggt

SEQ ID NO: 953613 - DNA, 25 bp, Mus musculus
ttgctttagacacgaccctccctgg

SEQ ID NO: 953614 - DNA, 25 bp, Mus musculus
ttgctttagacaggaccctccctgg

SEQ ID NO: 953615 - DNA, 25 bp, Mus musculus
ttgctttagaggatgcttgctgtac

SEQ ID NO: 953616 - DNA, 25 bp, Mus musculus
ttgctttagaggcacaggctgtaaa

SEQ ID NO: 953617 - DNA, 25 bp, Mus musculus
ttgctttagagggacaggctgtaaa

SEQ ID NO: 953618 - DNA, 25 bp, Mus musculus
ttgctttagaggttgcttgctgtac

SEQ ID NO: 953619 - DNA, 25 bp, Mus musculus
ttgctttaggcaagggacctttctt

SEQ ID NO: 953620 - DNA, 25 bp, Mus musculus
ttgctttaggcatgggacctttctt

SEQ ID NO: 953621 - DNA, 25 bp, Mus musculus
ttgctttagttacctcccatgcaat

SEQ ID NO: 953622 - DNA, 25 bp, Mus musculus
ttgctttagttagctcccatgcaat

SEQ ID NO: 953623 - DNA, 25 bp, Mus musculus
ttgctttcaaccctttggaactttg

SEQ ID NO: 953624 - DNA, 25 bp, Mus musculus
ttgctttcaaccgtttggaactttg

SEQ ID NO: 953625 - DNA, 25 bp, Mus musculus
ttgctttcaaggctagaagattatt

SEQ ID NO: 953626 - DNA, 25 bp, Mus musculus
ttgctttcaagggtagaagattatt

SEQ ID NO: 953627 - DNA, 25 bp, Mus musculus
ttgctttcaatgattgcactgatct

SEQ ID NO: 953628 - DNA, 25 bp, Mus musculus
ttgctttcaatgtttgcactgatct

SEQ ID NO: 953629 - DNA, 25 bp, Mus musculus
ttgctttcagaactgcaaaggcatt

SEQ ID NO: 953630 - DNA, 25 bp, Mus musculus
ttgctttcagaagtgcaaaggcatt

SEQ ID NO: 953631 - DNA, 25 bp, Mus musculus
ttgctttcagctctactaccgctta

SEQ ID NO: 953632 - DNA, 25 bp, Mus musculus
ttgctttcagctgtactaccgctta

SEQ ID NO: 953633 - DNA, 25 bp, Mus musculus
ttgctttcagtaaccacccccgtag

SEQ ID NO: 953634 - DNA, 25 bp, Mus musculus
ttgctttcagtatccacccccgtag

SEQ ID NO: 953635 - DNA, 25 bp, Mus musculus
ttgctttcagtcacaagcctgcgta

SEQ ID NO: 953636 - DNA, 25 bp, Mus musculus
ttgctttcagtctcaagcctgcgta

SEQ ID NO: 953637 - DNA, 25 bp, Mus musculus
ttgctttcattaaacccggttcaca

SEQ ID NO: 953638 - DNA, 25 bp, Mus musculus
ttgctttcattatacccggttcaca

SEQ ID NO: 953639 - DNA, 25 bp, Mus musculus
ttgctttccaaaagcgttgtgtttt

SEQ ID NO: 953640 - DNA, 25 bp, Mus musculus
ttgctttccaaatgcgttgtgtttt

SEQ ID NO: 953641 - DNA, 25 bp, Mus musculus
ttgctttccaatccctcctgtgttg

SEQ ID NO: 953642 - DNA, 25 bp, Mus musculus
ttgctttccaatgcctcctgtgttg

SEQ ID NO: 953643 - DNA, 25 bp, Mus musculus
ttgctttccccacgatagcgcgggc

SEQ ID NO: 953644 - DNA, 25 bp, Mus musculus
ttgctttccccaggatagcgcgggc

SEQ ID NO: 953645 - DNA, 25 bp, Mus musculus
ttgctttccggtcagtgtcacttca

SEQ ID NO: 953646 - DNA, 25 bp, Mus musculus
ttgctttccggtgagtgtcacttca

SEQ ID NO: 953647 - DNA, 25 bp, Mus musculus
ttgctttcctggcagtgagccttgg

SEQ ID NO: 953648 - DNA, 25 bp, Mus musculus
ttgctttcctgggagtgagccttgg

SEQ ID NO: 953649 - DNA, 25 bp, Mus musculus
ttgctttcctgtcttcaagccacct

SEQ ID NO: 953650 - DNA, 25 bp, Mus musculus
ttgctttcctgtgttcaagccacct

SEQ ID NO: 953651 - DNA, 25 bp, Mus musculus
ttgctttcctttcgctgcatcaaga

SEQ ID NO: 953652 - DNA, 25 bp, Mus musculus
ttgctttcctttggctgcatcaaga

SEQ ID NO: 953653 - DNA, 25 bp, Mus musculus
ttgctttcggtgcagtgcatgccat

SEQ ID NO: 953654 - DNA, 25 bp, Mus musculus
ttgctttcggtggagtgcatgccat

SEQ ID NO: 953655 - DNA, 25 bp, Mus musculus
ttgctttcgtagcttctagtgtgaa

SEQ ID NO: 953656 - DNA, 25 bp, Mus musculus
ttgctttcgtaggttctagtgtgaa

SEQ ID NO: 953657 - DNA, 25 bp, Mus musculus
ttgctttctaccagcctagggatag

SEQ ID NO: 953658 - DNA, 25 bp, Mus musculus
ttgctttctacctgcctagggatag

SEQ ID NO: 953659 - DNA, 25 bp, Mus musculus
ttgctttctcttaatacattccctg

SEQ ID NO: 953660 - DNA, 25 bp, Mus musculus
ttgctttctctttatacattccctg

SEQ ID NO: 953661 - DNA, 25 bp, Mus musculus
ttgctttctgcaactgagactctct

SEQ ID NO: 953662 - DNA, 25 bp, Mus musculus
ttgctttctgcatctgagactctct

SEQ ID NO: 953663 - DNA, 25 bp, Mus musculus
ttgctttcttcaaaatctctggccc

SEQ ID NO: 953664 - DNA, 25 bp, Mus musculus
ttgctttcttcataatctctggccc

SEQ ID NO: 953665 - DNA, 25 bp, Mus musculus
ttgctttcttctaactgcgctccac

SEQ ID NO: 953666 - DNA, 25 bp, Mus musculus
ttgctttcttcttactgcgctccac

SEQ ID NO: 953667 - DNA, 25 bp, Mus musculus
ttgctttcttttagctcagcctcag

SEQ ID NO: 953668 - DNA, 25 bp, Mus musculus
ttgctttctttttgctcagcctcag

SEQ ID NO: 953669 - DNA, 25 bp, Mus musculus
ttgctttgaaatcctcagtccccat

SEQ ID NO: 953670 - DNA, 25 bp, Mus musculus
ttgctttgaaatgctcagtccccat

SEQ ID NO: 953671 - DNA, 25 bp, Mus musculus
ttgctttgaactctataatcctcga

SEQ ID NO: 953672 - DNA, 25 bp, Mus musculus
ttgctttgaactgtataatcctcga

SEQ ID NO: 953673 - DNA, 25 bp, Mus musculus
ttgctttgcattaatggaaccttga

SEQ ID NO: 953674 - DNA, 25 bp, Mus musculus
ttgctttgcattaattatgaacaag

SEQ ID NO: 953675 - DNA, 25 bp, Mus musculus
ttgctttgcatttatggaaccttga

SEQ ID NO: 953676 - DNA, 25 bp, Mus musculus
ttgctttgcatttattatgaacaag

SEQ ID NO: 953677 - DNA, 25 bp, Mus musculus
ttgctttgccagacaggtcgacatg

SEQ ID NO: 953678 - DNA, 25 bp, Mus musculus
ttgctttgccagcagcatcgatcag

SEQ ID NO: 953679 - DNA, 25 bp, Mus musculus
ttgctttgccaggagcatcgatcag

SEQ ID NO: 953680 - DNA, 25 bp, Mus musculus
ttgctttgccagtcaggtcgacatg

SEQ ID NO: 953681 - DNA, 25 bp, Mus musculus
ttgctttgcctcagtgctttactta

SEQ ID NO: 953682 - DNA, 25 bp, Mus musculus
ttgctttgcctctgtgctttactta

SEQ ID NO: 953683 - DNA, 25 bp, Mus musculus
ttgctttgcctgagtaaagagccca

SEQ ID NO: 953684 - DNA, 25 bp, Mus musculus
ttgctttgcctgtgtaaagagccca

SEQ ID NO: 953685 - DNA, 25 bp, Mus musculus
ttgctttggaggatgtgggtacact

SEQ ID NO: 953686 - DNA, 25 bp, Mus musculus
ttgctttggaggttgtgggtacact

SEQ ID NO: 953687 - DNA, 25 bp, Mus musculus
ttgctttggcaacagctgcagtatc

SEQ ID NO: 953688 - DNA, 25 bp, Mus musculus
ttgctttggcaagagctgcagtatc

SEQ ID NO: 953689 - DNA, 25 bp, Mus musculus
ttgctttggttgagacaagttccct

SEQ ID NO: 953690 - DNA, 25 bp, Mus musculus
ttgctttggttgtgacaagttccct

SEQ ID NO: 953691 - DNA, 25 bp, Mus musculus
ttgctttgtacaattggcaaacata

SEQ ID NO: 953692 - DNA, 25 bp, Mus musculus
ttgctttgtacatttggcaaacata

SEQ ID NO: 953693 - DNA, 25 bp, Mus musculus
ttgctttgtaccattgcctgttcaa

SEQ ID NO: 953694 - DNA, 25 bp, Mus musculus
ttgctttgtacctttgcctgttcaa

SEQ ID NO: 953695 - DNA, 25 bp, Mus musculus
ttgctttgtagccatgagtgacgtt

SEQ ID NO: 953696 - DNA, 25 bp, Mus musculus
ttgctttgtagcgatgagtgacgtt

SEQ ID NO: 953697 - DNA, 25 bp, Mus musculus
ttgctttgtaggaggctagttcagt

SEQ ID NO: 953698 - DNA, 25 bp, Mus musculus
ttgctttgtaggtggctagttcagt

SEQ ID NO: 953699 - DNA, 25 bp, Mus musculus
ttgctttgtatacatgcatttaaat

SEQ ID NO: 953700 - DNA, 25 bp, Mus musculus
ttgctttgtatagatgcatttaaat

SEQ ID NO: 953701 - DNA, 25 bp, Mus musculus
ttgctttgtatgaatccgatttctt

SEQ ID NO: 953702 - DNA, 25 bp, Mus musculus
ttgctttgtatgtatccgatttctt

SEQ ID NO: 953703 - DNA, 25 bp, Mus musculus
ttgctttgtattatccctgcagctg

SEQ ID NO: 953704 - DNA, 25 bp, Mus musculus
ttgctttgtattttccctgcagctg

SEQ ID NO: 953705 - DNA, 25 bp, Mus musculus
ttgctttgtcatacttatccttgtt

SEQ ID NO: 953706 - DNA, 25 bp, Mus musculus
ttgctttgtcattcttatccttgtt

SEQ ID NO: 953707 - DNA, 25 bp, Mus musculus
ttgctttgtgacactgtcctgcagc

SEQ ID NO: 953708 - DNA, 25 bp, Mus musculus
ttgctttgtgactctgtcctgcagc

SEQ ID NO: 953709 - DNA, 25 bp, Mus musculus
ttgctttgtgtgcatttggcgtgcc

SEQ ID NO: 953710 - DNA, 25 bp, Mus musculus
ttgctttgtgtggatttggcgtgcc

SEQ ID NO: 953711 - DNA, 25 bp, Mus musculus
ttgctttgttcaagtcgtgccccaa

SEQ ID NO: 953712 - DNA, 25 bp, Mus musculus
ttgctttgttcatgtcgtgccccaa

SEQ ID NO: 953713 - DNA, 25 bp, Mus musculus
ttgctttgttcccagagagtttgtg

SEQ ID NO: 953714 - DNA, 25 bp, Mus musculus
ttgctttgttccgagagagtttgtg

SEQ ID NO: 953715 - DNA, 25 bp, Mus musculus
ttgctttgttctatacccaaccgag

SEQ ID NO: 953716 - DNA, 25 bp, Mus musculus
ttgctttgttctttacccaaccgag

SEQ ID NO: 953717 - DNA, 25 bp, Mus musculus
ttgctttgtttgaagcctaccgctt

SEQ ID NO: 953718 - DNA, 25 bp, Mus musculus
ttgctttgtttgtagcctaccgctt

SEQ ID NO: 953719 - DNA, 25 bp, Mus musculus
ttgcttttaatgaagagcccaaccc

SEQ ID NO: 953720 - DNA, 25 bp, Mus musculus
ttgcttttaatgtagagcccaaccc

SEQ ID NO: 953721 - DNA, 25 bp, Mus musculus
ttgcttttaccaaaatatctgtagt

SEQ ID NO: 953722 - DNA, 25 bp, Mus musculus
ttgcttttaccataatatctgtagt

SEQ ID NO: 953723 - DNA, 25 bp, Mus musculus
ttgcttttagaactcctgttcccag

SEQ ID NO: 953724 - DNA, 25 bp, Mus musculus
ttgcttttagaagtcctgttcccag

SEQ ID NO: 953725 - DNA, 25 bp, Mus musculus
ttgcttttatataatacatttcagg

SEQ ID NO: 953726 - DNA, 25 bp, Mus musculus
ttgcttttatattatacatttcagg

SEQ ID NO: 953727 - DNA, 25 bp, Mus musculus
ttgcttttcaaccaatcctgactct

SEQ ID NO: 953728 - DNA, 25 bp, Mus musculus
ttgcttttcaacgaatcctgactct

SEQ ID NO: 953729 - DNA, 25 bp, Mus musculus
ttgcttttcacaagtatggctctgt

SEQ ID NO: 953730 - DNA, 25 bp, Mus musculus
ttgcttttcacatgtatggctctgt

SEQ ID NO: 953731 - DNA, 25 bp, Mus musculus
ttgcttttcattctcatgagggtta

SEQ ID NO: 953732 - DNA, 25 bp, Mus musculus
ttgcttttcattgtcatgagggtta

SEQ ID NO: 953733 - DNA, 25 bp, Mus musculus
ttgcttttcctgagttcggtattcc

SEQ ID NO: 953734 - DNA, 25 bp, Mus musculus
ttgcttttcctgtgttcggtattcc

SEQ ID NO: 953735 - DNA, 25 bp, Mus musculus
ttgcttttccttcgccagtttcaga

SEQ ID NO: 953736 - DNA, 25 bp, Mus musculus
ttgcttttccttggccagtttcaga

SEQ ID NO: 953737 - DNA, 25 bp, Mus musculus
ttgcttttctagcaaggaatctgct

SEQ ID NO: 953738 - DNA, 25 bp, Mus musculus
ttgcttttctaggaaggaatctgct

SEQ ID NO: 953739 - DNA, 25 bp, Mus musculus
ttgcttttctatcagctgagggcct

SEQ ID NO: 953740 - DNA, 25 bp, Mus musculus
ttgcttttctatgagctgagggcct

SEQ ID NO: 953741 - DNA, 25 bp, Mus musculus
ttgcttttctctagtcgttgagaac

SEQ ID NO: 953742 - DNA, 25 bp, Mus musculus
ttgcttttctcttgtcgttgagaac

SEQ ID NO: 953743 - DNA, 25 bp, Mus musculus
ttgcttttcttcatagaccagaggg

SEQ ID NO: 953744 - DNA, 25 bp, Mus musculus
ttgcttttcttcttagaccagaggg

SEQ ID NO: 953745 - DNA, 25 bp, Mus musculus
ttgcttttgaacagcgagacactgg

SEQ ID NO: 953746 - DNA, 25 bp, Mus musculus
ttgcttttgaacctccatcagattc

SEQ ID NO: 953747 - DNA, 25 bp, Mus musculus
ttgcttttgaacgtccatcagattc

SEQ ID NO: 953748 - DNA, 25 bp, Mus musculus
ttgcttttgaactgcgagacactgg

SEQ ID NO: 953749 - DNA, 25 bp, Mus musculus
ttgcttttgaatcacatgcaccttg

SEQ ID NO: 953750 - DNA, 25 bp, Mus musculus
ttgcttttgaatgacatgcaccttg

SEQ ID NO: 953751 - DNA, 25 bp, Mus musculus
ttgcttttgactcttgaaatctcca

SEQ ID NO: 953752 - DNA, 25 bp, Mus musculus
ttgcttttgactgttgaaatctcca

SEQ ID NO: 953753 - DNA, 25 bp, Mus musculus
ttgcttttggatccctcaacgatga

SEQ ID NO: 953754 - DNA, 25 bp, Mus musculus
ttgcttttggatgcctcaacgatga

SEQ ID NO: 953755 - DNA, 25 bp, Mus musculus
ttgcttttggccacggctcacagac

SEQ ID NO: 953756 - DNA, 25 bp, Mus musculus
ttgcttttggcctcggctcacagac

SEQ ID NO: 953757 - DNA, 25 bp, Mus musculus
ttgcttttgtatagtcgtatcttag

SEQ ID NO: 953758 - DNA, 25 bp, Mus musculus
ttgcttttgtattgtcgtatcttag

SEQ ID NO: 953759 - DNA, 25 bp, Mus musculus
ttgcttttgtcaacagctgcctgaa

SEQ ID NO: 953760 - DNA, 25 bp, Mus musculus
ttgcttttgtcatcagctgcctgaa

SEQ ID NO: 953761 - DNA, 25 bp, Mus musculus
ttgctttttagcaccacgtcacagg

SEQ ID NO: 953762 - DNA, 25 bp, Mus musculus
ttgctttttagctccacgtcacagg

SEQ ID NO: 953763 - DNA, 25 bp, Mus musculus
ttgctttttctcatactcctttata

SEQ ID NO: 953764 - DNA, 25 bp, Mus musculus
ttgctttttctcttactcctttata

SEQ ID NO: 953765 - DNA, 25 bp, Mus musculus
ttgctttttgcactgtttgttcccc

SEQ ID NO: 953766 - DNA, 25 bp, Mus musculus
ttgctttttgcagtgtttgttcccc

SEQ ID NO: 953767 - DNA, 25 bp, Mus musculus
ttgctttttgccatgggtgacacat

SEQ ID NO: 953768 - DNA, 25 bp, Mus musculus
ttgctttttgccttgggtgacacat

SEQ ID NO: 953769 - DNA, 25 bp, Mus musculus
ttgctttttgtccttgccctttcac

SEQ ID NO: 953770 - DNA, 25 bp, Mus musculus
ttgctttttgtcgttgccctttcac

SEQ ID NO: 953771 - DNA, 25 bp, Mus musculus
ttgctttttttaacccggcccagag

SEQ ID NO: 953772 - DNA, 25 bp, Mus musculus
ttgctttttttatcccggcccagag

SEQ ID NO: 953773 - DNA, 25 bp, Mus musculus
ttgcttttttttagaccctgaggct

SEQ ID NO: 953774 - DNA, 25 bp, Mus musculus
ttgcttttttttcttcccagccact

SEQ ID NO: 953775 - DNA, 25 bp, Mus musculus
ttgcttttttttgttcccagccact

SEQ ID NO: 953776 - DNA, 25 bp, Mus musculus
ttgctttttttttgaccctgaggct

SEQ ID NO: 953777 - DNA, 25 bp, Mus musculus
ttggaaaacatcatagagacgtgga

SEQ ID NO: 953778 - DNA, 25 bp, Mus musculus
ttggaaaacatcttagagacgtgga

SEQ ID NO: 953779 - DNA, 25 bp, Mus musculus
ttggaaaacctgctcacagcgttca

SEQ ID NO: 953780 - DNA, 25 bp, Mus musculus
ttggaaaacctggtcacagcgttca

SEQ ID NO: 953781 - DNA, 25 bp, Mus musculus
ttggaaaactatcatttgccacttt

SEQ ID NO: 953782 - DNA, 25 bp, Mus musculus
ttggaaaactatgatttgccacttt

SEQ ID NO: 953783 - DNA, 25 bp, Mus musculus
ttggaaaagaacatgggctcccaag

SEQ ID NO: 953784 - DNA, 25 bp, Mus musculus
ttggaaaagaaccacgtcactgcct

SEQ ID NO: 953785 - DNA, 25 bp, Mus musculus
ttggaaaagaacgacgtcactgcct

SEQ ID NO: 953786 - DNA, 25 bp, Mus musculus
ttggaaaagaacttgggctcccaag

SEQ ID NO: 953787 - DNA, 25 bp, Mus musculus
ttggaaaagcagatccgcatcccgc

SEQ ID NO: 953788 - DNA, 25 bp, Mus musculus
ttggaaaagcagttccgcatcccgc

SEQ ID NO: 953789 - DNA, 25 bp, Mus musculus
ttggaaaagcctcttcagaagtcta

SEQ ID NO: 953790 - DNA, 25 bp, Mus musculus
ttggaaaagcctgttcagaagtcta

SEQ ID NO: 953791 - DNA, 25 bp, Mus musculus
ttggaaaatgcccaccactaaattt

SEQ ID NO: 953792 - DNA, 25 bp, Mus musculus
ttggaaaatgccgaccactaaattt

SEQ ID NO: 953793 - DNA, 25 bp, Mus musculus
ttggaaaatgcgattgctcctcttc

SEQ ID NO: 953794 - DNA, 25 bp, Mus musculus
ttggaaaatgcgtttgctcctcttc

SEQ ID NO: 953795 - DNA, 25 bp, Mus musculus
ttggaaacaaacatcaggcccctga

SEQ ID NO: 953796 - DNA, 25 bp, Mus musculus
ttggaaacaaacttcaggcccctga

SEQ ID NO: 953797 - DNA, 25 bp, Mus musculus
ttggaaacaatcacccatggaagga

SEQ ID NO: 953798 - DNA, 25 bp, Mus musculus
ttggaaacaatctcccatggaagga

SEQ ID NO: 953799 - DNA, 25 bp, Mus musculus
ttggaaacactaattcgtagctcaa

SEQ ID NO: 953800 - DNA, 25 bp, Mus musculus
ttggaaacactatttcgtagctcaa

SEQ ID NO: 953801 - DNA, 25 bp, Mus musculus
ttggaaaccattctgccgggtttgc

SEQ ID NO: 953802 - DNA, 25 bp, Mus musculus
ttggaaaccattgtgccgggtttgc

SEQ ID NO: 953803 - DNA, 25 bp, Mus musculus
ttggaaacccagaagcaaacggaca

SEQ ID NO: 953804 - DNA, 25 bp, Mus musculus
ttggaaacccagtagcaaacggaca

SEQ ID NO: 953805 - DNA, 25 bp, Mus musculus
ttggaaacccatagtcatcttattt

SEQ ID NO: 953806 - DNA, 25 bp, Mus musculus
ttggaaacccattgtcatcttattt

SEQ ID NO: 953807 - DNA, 25 bp, Mus musculus
ttggaaacctcactgaaccctggtt

SEQ ID NO: 953808 - DNA, 25 bp, Mus musculus
ttggaaacctcagtgaaccctggtt

SEQ ID NO: 953809 - DNA, 25 bp, Mus musculus
ttggaaactatcatctcatgcacag

SEQ ID NO: 953810 - DNA, 25 bp, Mus musculus
ttggaaactatcttctcatgcacag

SEQ ID NO: 953811 - DNA, 25 bp, Mus musculus
ttggaaactgacacgtctctggagg

SEQ ID NO: 953812 - DNA, 25 bp, Mus musculus
ttggaaactgactcgtctctggagg

SEQ ID NO: 953813 - DNA, 25 bp, Mus musculus
ttggaaagacaccttctaggtctgt

SEQ ID NO: 953814 - DNA, 25 bp, Mus musculus
ttggaaagacacgttctaggtctgt

SEQ ID NO: 953815 - DNA, 25 bp, Mus musculus
ttggaaagatctcaactaccctgcc

SEQ ID NO: 953816 - DNA, 25 bp, Mus musculus
ttggaaagatctgaactaccctgcc

SEQ ID NO: 953817 - DNA, 25 bp, Mus musculus
ttggaaagcgaccaacggccatgta

SEQ ID NO: 953818 - DNA, 25 bp, Mus musculus
ttggaaagcgacgaacggccatgta

SEQ ID NO: 953819 - DNA, 25 bp, Mus musculus
ttggaaagctgcagtatccttcttc

SEQ ID NO: 953820 - DNA, 25 bp, Mus musculus
ttggaaagctgctgtatccttcttc

SEQ ID NO: 953821 - DNA, 25 bp, Mus musculus
ttggaaatacttctcgtcctgtttt

SEQ ID NO: 953822 - DNA, 25 bp, Mus musculus
ttggaaatacttgtcgtcctgtttt

SEQ ID NO: 953823 - DNA, 25 bp, Mus musculus
ttggaaatcaatactctcttcccca

SEQ ID NO: 953824 - DNA, 25 bp, Mus musculus
ttggaaatcaattctctcttcccca

SEQ ID NO: 953825 - DNA, 25 bp, Mus musculus
ttggaaatcactcgcaccgcaatag

SEQ ID NO: 953826 - DNA, 25 bp, Mus musculus
ttggaaatcactggcaccgcaatag

SEQ ID NO: 953827 - DNA, 25 bp, Mus musculus
ttggaaatccacagggtagctcctt

SEQ ID NO: 953828 - DNA, 25 bp, Mus musculus
ttggaaatccactgggtagctcctt

SEQ ID NO: 953829 - DNA, 25 bp, Mus musculus
ttggaaatctttcagttttgctctt

SEQ ID NO: 953830 - DNA, 25 bp, Mus musculus
ttggaaatctttgagttttgctctt

SEQ ID NO: 953831 - DNA, 25 bp, Mus musculus
ttggaaatgactcctcaccacacct

SEQ ID NO: 953832 - DNA, 25 bp, Mus musculus
ttggaaatgactgctcaccacacct

SEQ ID NO: 953833 - DNA, 25 bp, Mus musculus
ttggaaatgagcacactgtggcaga

SEQ ID NO: 953834 - DNA, 25 bp, Mus musculus
ttggaaatgagctcactgtggcaga

SEQ ID NO: 953835 - DNA, 25 bp, Mus musculus
ttggaaattgatcactctggcagtc

SEQ ID NO: 953836 - DNA, 25 bp, Mus musculus
ttggaaattgatgactctggcagtc

SEQ ID NO: 953837 - DNA, 25 bp, Mus musculus
ttggaaattttgacctcctgaggaa

SEQ ID NO: 953838 - DNA, 25 bp, Mus musculus
ttggaaattttgtcctcctgaggaa

SEQ ID NO: 953839 - DNA, 25 bp, Mus musculus
ttggaacaattcaagccgtgccatg

SEQ ID NO: 953840 - DNA, 25 bp, Mus musculus
ttggaacaattctagccgtgccatg

SEQ ID NO: 953841 - DNA, 25 bp, Mus musculus
ttggaacacacaagctcttgtgagc

SEQ ID NO: 953842 - DNA, 25 bp, Mus musculus
ttggaacacacatgctcttgtgagc

SEQ ID NO: 953843 - DNA, 25 bp, Mus musculus
ttggaacagcttacaaggcccagca

SEQ ID NO: 953844 - DNA, 25 bp, Mus musculus
ttggaacagcttcagagcctatctg

SEQ ID NO: 953845 - DNA, 25 bp, Mus musculus
ttggaacagcttgagagcctatctg

SEQ ID NO: 953846 - DNA, 25 bp, Mus musculus
ttggaacagctttcaaggcccagca

SEQ ID NO: 953847 - DNA, 25 bp, Mus musculus
ttggaacaggcccaagatgcctcct

SEQ ID NO: 953848 - DNA, 25 bp, Mus musculus
ttggaacaggccgaagatgcctcct

SEQ ID NO: 953849 - DNA, 25 bp, Mus musculus
ttggaacatgatccccagtatgcag

SEQ ID NO: 953850 - DNA, 25 bp, Mus musculus
ttggaacatgatgcccagtatgcag

SEQ ID NO: 953851 - DNA, 25 bp, Mus musculus
ttggaaccaatgctgctgagtttca

SEQ ID NO: 953852 - DNA, 25 bp, Mus musculus
ttggaaccaatggtgctgagtttca

SEQ ID NO: 953853 - DNA, 25 bp, Mus musculus
ttggaaccacaaaaagcctcatctg

SEQ ID NO: 953854 - DNA, 25 bp, Mus musculus
ttggaaccacaataagcctcatctg

SEQ ID NO: 953855 - DNA, 25 bp, Mus musculus
ttggaaccagatcctggccacacta

SEQ ID NO: 953856 - DNA, 25 bp, Mus musculus
ttggaaccagatgctggccacacta

SEQ ID NO: 953857 - DNA, 25 bp, Mus musculus
ttggaaccaggaccacagtaatgaa

SEQ ID NO: 953858 - DNA, 25 bp, Mus musculus
ttggaaccaggagcacagtaatgaa

SEQ ID NO: 953859 - DNA, 25 bp, Mus musculus
ttggaaccagggaatctgctgcttt

SEQ ID NO: 953860 - DNA, 25 bp, Mus musculus
ttggaaccagggtatctgctgcttt

SEQ ID NO: 953861 - DNA, 25 bp, Mus musculus
ttggaacccagcctcatttcaacaa

SEQ ID NO: 953862 - DNA, 25 bp, Mus musculus
ttggaacccagcgtcatttcaacaa

SEQ ID NO: 953863 - DNA, 25 bp, Mus musculus
ttggaacccatcactgatcatgtcc

SEQ ID NO: 953864 - DNA, 25 bp, Mus musculus
ttggaacccatctctgatcatgtcc

SEQ ID NO: 953865 - DNA, 25 bp, Mus musculus
ttggaacccctgaggaatcctagca

SEQ ID NO: 953866 - DNA, 25 bp, Mus musculus
ttggaacccctgtggaatcctagca

SEQ ID NO: 953867 - DNA, 25 bp, Mus musculus
ttggaaccgcttctagagcagcctc

SEQ ID NO: 953868 - DNA, 25 bp, Mus musculus
ttggaaccgcttgtagagcagcctc

SEQ ID NO: 953869 - DNA, 25 bp, Mus musculus
ttggaacctcataggttaacacatg

SEQ ID NO: 953870 - DNA, 25 bp, Mus musculus
ttggaacctcattggttaacacatg

SEQ ID NO: 953871 - DNA, 25 bp, Mus musculus
ttggaacctgcacccctctgggatg

SEQ ID NO: 953872 - DNA, 25 bp, Mus musculus
ttggaacctgcagccctctgggatg

SEQ ID NO: 953873 - DNA, 25 bp, Mus musculus
ttggaaccttgtctctcagtagcta

SEQ ID NO: 953874 - DNA, 25 bp, Mus musculus
ttggaaccttgtgtctcagtagcta

SEQ ID NO: 953875 - DNA, 25 bp, Mus musculus
ttggaacgccaaatttcctctttga

SEQ ID NO: 953876 - DNA, 25 bp, Mus musculus
ttggaacgccaattttcctctttga

SEQ ID NO: 953877 - DNA, 25 bp, Mus musculus
ttggaactagttacctaacactggt

SEQ ID NO: 953878 - DNA, 25 bp, Mus musculus
ttggaactagtttcctaacactggt

SEQ ID NO: 953879 - DNA, 25 bp, Mus musculus
ttggaactcactcaactcactgtgt

SEQ ID NO: 953880 - DNA, 25 bp, Mus musculus
ttggaactcactgaactcactgtgt

SEQ ID NO: 953881 - DNA, 25 bp, Mus musculus
ttggaactcagaactaggtctctgg

SEQ ID NO: 953882 - DNA, 25 bp, Mus musculus
ttggaactcagatctaggtctctgg

SEQ ID NO: 953883 - DNA, 25 bp, Mus musculus
ttggaactccaacacacacttgaag

SEQ ID NO: 953884 - DNA, 25 bp, Mus musculus
ttggaactccaagacacacttgaag

SEQ ID NO: 953885 - DNA, 25 bp, Mus musculus
ttggaactctgacctagcacctatg

SEQ ID NO: 953886 - DNA, 25 bp, Mus musculus
ttggaactctgagctagcacctatg

SEQ ID NO: 953887 - DNA, 25 bp, Mus musculus
ttggaactctggctccttacatacc

SEQ ID NO: 953888 - DNA, 25 bp, Mus musculus
ttggaactctgggtccttacatacc

SEQ ID NO: 953889 - DNA, 25 bp, Mus musculus
ttggaactcttaagtcctgctttgt

SEQ ID NO: 953890 - DNA, 25 bp, Mus musculus
ttggaactcttatgtcctgctttgt

SEQ ID NO: 953891 - DNA, 25 bp, Mus musculus
ttggaactctttccctaagtctggg

SEQ ID NO: 953892 - DNA, 25 bp, Mus musculus
ttggaactctttgcctaagtctggg

SEQ ID NO: 953893 - DNA, 25 bp, Mus musculus
ttggaactggagaacgtgcccattc

SEQ ID NO: 953894 - DNA, 25 bp, Mus musculus
ttggaactggagtacgtgcccattc

SEQ ID NO: 953895 - DNA, 25 bp, Mus musculus
ttggaactggctatccatcatcatc

SEQ ID NO: 953896 - DNA, 25 bp, Mus musculus
ttggaactggctttccatcatcatc

SEQ ID NO: 953897 - DNA, 25 bp, Mus musculus
ttggaactgtctacggatgaccact

SEQ ID NO: 953898 - DNA, 25 bp, Mus musculus
ttggaactgtcttcggatgaccact

SEQ ID NO: 953899 - DNA, 25 bp, Mus musculus
ttggaactgtgcctaacaactttga

SEQ ID NO: 953900 - DNA, 25 bp, Mus musculus
ttggaactgtgcgtaacaactttga

SEQ ID NO: 953901 - DNA, 25 bp, Mus musculus
ttggaacttagtctgtccccatacc

SEQ ID NO: 953902 - DNA, 25 bp, Mus musculus
ttggaacttagtgtgtccccatacc

SEQ ID NO: 953903 - DNA, 25 bp, Mus musculus
ttggaacttgtcaccctcatttgca

SEQ ID NO: 953904 - DNA, 25 bp, Mus musculus
ttggaacttgtctccctcatttgca

SEQ ID NO: 953905 - DNA, 25 bp, Mus musculus
ttggaagaaatccttatctccctcc

SEQ ID NO: 953906 - DNA, 25 bp, Mus musculus
ttggaagaaatcgttatctccctcc

SEQ ID NO: 953907 - DNA, 25 bp, Mus musculus
ttggaagaatttcgttccgctccct

SEQ ID NO: 953908 - DNA, 25 bp, Mus musculus
ttggaagaatttggttccgctccct

SEQ ID NO: 953909 - DNA, 25 bp, Mus musculus
ttggaagacatgatcgatgccctcg

SEQ ID NO: 953910 - DNA, 25 bp, Mus musculus
ttggaagacatgttcgatgccctcg

SEQ ID NO: 953911 - DNA, 25 bp, Mus musculus
ttggaagacccacattgactgaaga

SEQ ID NO: 953912 - DNA, 25 bp, Mus musculus
ttggaagacccagattgactgaaga

SEQ ID NO: 953913 - DNA, 25 bp, Mus musculus
ttggaagacctcaccactaaaggct

SEQ ID NO: 953914 - DNA, 25 bp, Mus musculus
ttggaagacctctccactaaaggct

SEQ ID NO: 953915 - DNA, 25 bp, Mus musculus
ttggaagacgatagcagggtgacat

SEQ ID NO: 953916 - DNA, 25 bp, Mus musculus
ttggaagacgattgcagggtgacat

SEQ ID NO: 953917 - DNA, 25 bp, Mus musculus
ttggaagacggccatacgccctgtg

SEQ ID NO: 953918 - DNA, 25 bp, Mus musculus
ttggaagacggcgatacgccctgtg

SEQ ID NO: 953919 - DNA, 25 bp, Mus musculus
ttggaagacttgctaccaccaccag

SEQ ID NO: 953920 - DNA, 25 bp, Mus musculus
ttggaagacttggtaccaccaccag

SEQ ID NO: 953921 - DNA, 25 bp, Mus musculus
ttggaagagcagatccccaggtgcg

SEQ ID NO: 953922 - DNA, 25 bp, Mus musculus
ttggaagagcagttccccaggtgcg

SEQ ID NO: 953923 - DNA, 25 bp, Mus musculus
ttggaagaggcaccattcccagctg

SEQ ID NO: 953924 - DNA, 25 bp, Mus musculus
ttggaagaggcagcattcccagctg

SEQ ID NO: 953925 - DNA, 25 bp, Mus musculus
ttggaagagtcgcttctctccatcc

SEQ ID NO: 953926 - DNA, 25 bp, Mus musculus
ttggaagagtcggttctctccatcc

SEQ ID NO: 953927 - DNA, 25 bp, Mus musculus
ttggaagatactcctgaagcctgtc

SEQ ID NO: 953928 - DNA, 25 bp, Mus musculus
ttggaagatactgctgaagcctgtc

SEQ ID NO: 953929 - DNA, 25 bp, Mus musculus
ttggaagatcaacactgagccatct

SEQ ID NO: 953930 - DNA, 25 bp, Mus musculus
ttggaagatcaagactgagccatct

SEQ ID NO: 953931 - DNA, 25 bp, Mus musculus
ttggaagcaagccactcatcttcgc

SEQ ID NO: 953932 - DNA, 25 bp, Mus musculus
ttggaagcaagcgactcatcttcgc

SEQ ID NO: 953933 - DNA, 25 bp, Mus musculus
ttggaagcagacatgcattgactgt

SEQ ID NO: 953934 - DNA, 25 bp, Mus musculus
ttggaagcagacttgcattgactgt

SEQ ID NO: 953935 - DNA, 25 bp, Mus musculus
ttggaagcagtactcccctttcggt

SEQ ID NO: 953936 - DNA, 25 bp, Mus musculus
ttggaagcagtagtcccctttcggt

SEQ ID NO: 953937 - DNA, 25 bp, Mus musculus
ttggaagcagttcctcttctctcta

SEQ ID NO: 953938 - DNA, 25 bp, Mus musculus
ttggaagcagttgctcttctctcta

SEQ ID NO: 953939 - DNA, 25 bp, Mus musculus
ttggaagcccaacgtttactcaaag

SEQ ID NO: 953940 - DNA, 25 bp, Mus musculus
ttggaagcccaaggtttactcaaag

SEQ ID NO: 953941 - DNA, 25 bp, Mus musculus
ttggaagccctgcatgacctaacct

SEQ ID NO: 953942 - DNA, 25 bp, Mus musculus
ttggaagccctgctagacattctct

SEQ ID NO: 953943 - DNA, 25 bp, Mus musculus
ttggaagccctggatgacctaacct

SEQ ID NO: 953944 - DNA, 25 bp, Mus musculus
ttggaagccctggtagacattctct

SEQ ID NO: 953945 - DNA, 25 bp, Mus musculus
ttggaagccgagatggaccgcagac

SEQ ID NO: 953946 - DNA, 25 bp, Mus musculus
ttggaagccgagttggaccgcagac

SEQ ID NO: 953947 - DNA, 25 bp, Mus musculus
ttggaagccggacagtgttcgtcat

SEQ ID NO: 953948 - DNA, 25 bp, Mus musculus
ttggaagccggagagtgttcgtcat

SEQ ID NO: 953949 - DNA, 25 bp, Mus musculus
ttggaagcgcagaactgtttttcct

SEQ ID NO: 953950 - DNA, 25 bp, Mus musculus
ttggaagcgcagtactgtttttcct

SEQ ID NO: 953951 - DNA, 25 bp, Mus musculus
ttggaagctataacactgcatgaag

SEQ ID NO: 953952 - DNA, 25 bp, Mus musculus
ttggaagctatatcactgcatgaag

SEQ ID NO: 953953 - DNA, 25 bp, Mus musculus
ttggaagggacacaacctgagcagt

SEQ ID NO: 953954 - DNA, 25 bp, Mus musculus
ttggaagggacagaacctgagcagt

SEQ ID NO: 953955 - DNA, 25 bp, Mus musculus
ttggaaggtgccagtcgcagattct

SEQ ID NO: 953956 - DNA, 25 bp, Mus musculus
ttggaaggtgcctgtcgcagattct

SEQ ID NO: 953957 - DNA, 25 bp, Mus musculus
ttggaaggtgttagtcctttctctc

SEQ ID NO: 953958 - DNA, 25 bp, Mus musculus
ttggaaggtgtttgtcctttctctc

SEQ ID NO: 953959 - DNA, 25 bp, Mus musculus
ttggaagtaacccttactcacgctc

SEQ ID NO: 953960 - DNA, 25 bp, Mus musculus
ttggaagtaaccgttactcacgctc

SEQ ID NO: 953961 - DNA, 25 bp, Mus musculus
ttggaagtacatattccctcttttg

SEQ ID NO: 953962 - DNA, 25 bp, Mus musculus
ttggaagtacattttccctcttttg

SEQ ID NO: 953963 - DNA, 25 bp, Mus musculus
ttggaagtagctacccagttccact

SEQ ID NO: 953964 - DNA, 25 bp, Mus musculus
ttggaagtagcttcccagttccact

SEQ ID NO: 953965 - DNA, 25 bp, Mus musculus
ttggaagtaggtcccggatctgcca

SEQ ID NO: 953966 - DNA, 25 bp, Mus musculus
ttggaagtaggtgccggatctgcca

SEQ ID NO: 953967 - DNA, 25 bp, Mus musculus
ttggaagtatgtagctagccctcct

SEQ ID NO: 953968 - DNA, 25 bp, Mus musculus
ttggaagtatgttgctagccctcct

SEQ ID NO: 953969 - DNA, 25 bp, Mus musculus
ttggaagtctgccttggctgaaccc

SEQ ID NO: 953970 - DNA, 25 bp, Mus musculus
ttggaagtctgcgttggctgaaccc

SEQ ID NO: 953971 - DNA, 25 bp, Mus musculus
ttggaagtgccaagtgtggactagc

SEQ ID NO: 953972 - DNA, 25 bp, Mus musculus
ttggaagtgccatgtgtggactagc

SEQ ID NO: 953973 - DNA, 25 bp, Mus musculus
ttggaagtgcctatatctgcctctt

SEQ ID NO: 953974 - DNA, 25 bp, Mus musculus
ttggaagtgcctttatctgcctctt

SEQ ID NO: 953975 - DNA, 25 bp, Mus musculus
ttggaagtgcgcaccccgttgcagc

SEQ ID NO: 953976 - DNA, 25 bp, Mus musculus
ttggaagtgcgctccccgttgcagc

SEQ ID NO: 953977 - DNA, 25 bp, Mus musculus
ttggaagtgctgatcctgtgcatga

SEQ ID NO: 953978 - DNA, 25 bp, Mus musculus
ttggaagtgctgttcctgtgcatga

SEQ ID NO: 953979 - DNA, 25 bp, Mus musculus
ttggaagtgtctatgctctgcaacc

SEQ ID NO: 953980 - DNA, 25 bp, Mus musculus
ttggaagtgtctttgctctgcaacc

SEQ ID NO: 953981 - DNA, 25 bp, Mus musculus
ttggaagttcatcgaaggacccctc

SEQ ID NO: 953982 - DNA, 25 bp, Mus musculus
ttggaagttcatggaaggacccctc

SEQ ID NO: 953983 - DNA, 25 bp, Mus musculus
ttggaagttcttacagcagatcttt

SEQ ID NO: 953984 - DNA, 25 bp, Mus musculus
ttggaagttctttcagcagatcttt

SEQ ID NO: 953985 - DNA, 25 bp, Mus musculus
ttggaataagctacccttaccccag

SEQ ID NO: 953986 - DNA, 25 bp, Mus musculus
ttggaataagcttcccttaccccag

SEQ ID NO: 953987 - DNA, 25 bp, Mus musculus
ttggaataccttcggatctcctcac

SEQ ID NO: 953988 - DNA, 25 bp, Mus musculus
ttggaataccttgggatctcctcac

SEQ ID NO: 953989 - DNA, 25 bp, Mus musculus
ttggaatactacctcatgcagataa

SEQ ID NO: 953990 - DNA, 25 bp, Mus musculus
ttggaatactacgtcatgcagataa

SEQ ID NO: 953991 - DNA, 25 bp, Mus musculus
ttggaatatttcacttcagcctccc

SEQ ID NO: 953992 - DNA, 25 bp, Mus musculus
ttggaatatttctcttcagcctccc

SEQ ID NO: 953993 - DNA, 25 bp, Mus musculus
ttggaatcaaaaacgtccgtaggcc

SEQ ID NO: 953994 - DNA, 25 bp, Mus musculus
ttggaatcaaaatcgtccgtaggcc

SEQ ID NO: 953995 - DNA, 25 bp, Mus musculus
ttggaatcacacacttcagactgaa

SEQ ID NO: 953996 - DNA, 25 bp, Mus musculus
ttggaatcacactcttcagactgaa

SEQ ID NO: 953997 - DNA, 25 bp, Mus musculus
ttggaatcacgactaccatgctgaa

SEQ ID NO: 953998 - DNA, 25 bp, Mus musculus
ttggaatcacgagtaccatgctgaa

SEQ ID NO: 953999 - DNA, 25 bp, Mus musculus
ttggaatcatttatcgcagcgctgt

SEQ ID NO: 954000 - DNA, 25 bp, Mus musculus
ttggaatcatttttcgcagcgctgt

SEQ ID NO: 954001 - DNA, 25 bp, Mus musculus
ttggaatccccaccctgcaagcaga

SEQ ID NO: 954002 - DNA, 25 bp, Mus musculus
ttggaatccccagcctgcaagcaga

SEQ ID NO: 954003 - DNA, 25 bp, Mus musculus
ttggaatccgtgatctttgtgtctc

SEQ ID NO: 954004 - DNA, 25 bp, Mus musculus
ttggaatccgtgttctttgtgtctc

SEQ ID NO: 954005 - DNA, 25 bp, Mus musculus
ttggaatcctaaacaccttctccat

SEQ ID NO: 954006 - DNA, 25 bp, Mus musculus
ttggaatcctaatcaccttctccat

SEQ ID NO: 954007 - DNA, 25 bp, Mus musculus
ttggaatcctcacccatttgtatag

SEQ ID NO: 954008 - DNA, 25 bp, Mus musculus
ttggaatcctcagccatttgtatag

SEQ ID NO: 954009 - DNA, 25 bp, Mus musculus
ttggaatccttaactctggccacag

SEQ ID NO: 954010 - DNA, 25 bp, Mus musculus
ttggaatccttatctctggccacag

SEQ ID NO: 954011 - DNA, 25 bp, Mus musculus
ttggaatcgggcactgctccatttc

SEQ ID NO: 954012 - DNA, 25 bp, Mus musculus
ttggaatcgggctctgctccatttc

SEQ ID NO: 954013 - DNA, 25 bp, Mus musculus
ttggaatctccccatcaattatcat

SEQ ID NO: 954014 - DNA, 25 bp, Mus musculus
ttggaatctcccgatcaattatcat

SEQ ID NO: 954015 - DNA, 25 bp, Mus musculus
ttggaatctggtatcctcctatggc

SEQ ID NO: 954016 - DNA, 25 bp, Mus musculus
ttggaatctggtttcctcctatggc

SEQ ID NO: 954017 - DNA, 25 bp, Mus musculus
ttggaatctgtgctccgtcaggaac

SEQ ID NO: 954018 - DNA, 25 bp, Mus musculus
ttggaatctgtggtccgtcaggaac

SEQ ID NO: 954019 - DNA, 25 bp, Mus musculus
ttggaatgaactcactggctccccg

SEQ ID NO: 954020 - DNA, 25 bp, Mus musculus
ttggaatgaactgactggctccccg

SEQ ID NO: 954021 - DNA, 25 bp, Mus musculus
ttggaatgacaccatcactcccgtt

SEQ ID NO: 954022 - DNA, 25 bp, Mus musculus
ttggaatgacacgatcactcccgtt

SEQ ID NO: 954023 - DNA, 25 bp, Mus musculus
ttggaatgcaaacccttcgctgcct

SEQ ID NO: 954024 - DNA, 25 bp, Mus musculus
ttggaatgcaaagccttcgctgcct

SEQ ID NO: 954025 - DNA, 25 bp, Mus musculus
ttggaatgctggctgtttatatttc

SEQ ID NO: 954026 - DNA, 25 bp, Mus musculus
ttggaatgctgggtgtttatatttc

SEQ ID NO: 954027 - DNA, 25 bp, Mus musculus
ttggaattcggaacttcccgctgca

SEQ ID NO: 954028 - DNA, 25 bp, Mus musculus
ttggaattcggatcttcccgctgca

SEQ ID NO: 954029 - DNA, 25 bp, Mus musculus
ttggaattgaatatctgtcccatgc

SEQ ID NO: 954030 - DNA, 25 bp, Mus musculus
ttggaattgaatttctgtcccatgc

SEQ ID NO: 954031 - DNA, 25 bp, Mus musculus
ttggaattgccactggacctagctg

SEQ ID NO: 954032 - DNA, 25 bp, Mus musculus
ttggaattgccagtggacctagctg

SEQ ID NO: 954033 - DNA, 25 bp, Mus musculus
ttggaatttggacactatacctatt

SEQ ID NO: 954034 - DNA, 25 bp, Mus musculus
ttggaatttggagactatacctatt

SEQ ID NO: 954035 - DNA, 25 bp, Mus musculus
ttggaatttgtaagcttaaaagtca

SEQ ID NO: 954036 - DNA, 25 bp, Mus musculus
ttggaatttgtatgcttaaaagtca

SEQ ID NO: 954037 - DNA, 25 bp, Mus musculus
ttggacaaaaggaagcgaaacgctg

SEQ ID NO: 954038 - DNA, 25 bp, Mus musculus
ttggacaaaaggtagcgaaacgctg

SEQ ID NO: 954039 - DNA, 25 bp, Mus musculus
ttggacaaacacacagacatcgctt

SEQ ID NO: 954040 - DNA, 25 bp, Mus musculus
ttggacaaacactcagacatcgctt

SEQ ID NO: 954041 - DNA, 25 bp, Mus musculus
ttggacaaagtcagacccctggttc

SEQ ID NO: 954042 - DNA, 25 bp, Mus musculus
ttggacaaagtctgacccctggttc

SEQ ID NO: 954043 - DNA, 25 bp, Mus musculus
ttggacaaccagaagctaagacttg

SEQ ID NO: 954044 - DNA, 25 bp, Mus musculus
ttggacaaccagtagctaagacttg

SEQ ID NO: 954045 - DNA, 25 bp, Mus musculus
ttggacaagacaacctgccacttag

SEQ ID NO: 954046 - DNA, 25 bp, Mus musculus
ttggacaagacatcctgccacttag

SEQ ID NO: 954047 - DNA, 25 bp, Mus musculus
ttggacaaggtcaccacctagaggt

SEQ ID NO: 954048 - DNA, 25 bp, Mus musculus
ttggacaaggtctccacctagaggt

SEQ ID NO: 954049 - DNA, 25 bp, Mus musculus
ttggacaagtcacttaaccttccgc

SEQ ID NO: 954050 - DNA, 25 bp, Mus musculus
ttggacaagtcagttaaccttccgc

SEQ ID NO: 954051 - DNA, 25 bp, Mus musculus
ttggacaatctgcactgaagactct

SEQ ID NO: 954052 - DNA, 25 bp, Mus musculus
ttggacaatctggactgaagactct

SEQ ID NO: 954053 - DNA, 25 bp, Mus musculus
ttggacaattgcacagccagcagca

SEQ ID NO: 954054 - DNA, 25 bp, Mus musculus
ttggacaattgctcagccagcagca

SEQ ID NO: 954055 - DNA, 25 bp, Mus musculus
ttggacacagaaacccaggagacct

SEQ ID NO: 954056 - DNA, 25 bp, Mus musculus
ttggacacagaatcccaggagacct

SEQ ID NO: 954057 - DNA, 25 bp, Mus musculus
ttggacacagagctacccctggagc

SEQ ID NO: 954058 - DNA, 25 bp, Mus musculus
ttggacacagaggtacccctggagc

SEQ ID NO: 954059 - DNA, 25 bp, Mus musculus
ttggacaccacaatcactacttttc

SEQ ID NO: 954060 - DNA, 25 bp, Mus musculus
ttggacaccacattcactacttttc

SEQ ID NO: 954061 - DNA, 25 bp, Mus musculus
ttggacaccccacgtgactgatgag

SEQ ID NO: 954062 - DNA, 25 bp, Mus musculus
ttggacaccccaggtgactgatgag

SEQ ID NO: 954063 - DNA, 25 bp, Mus musculus
ttggacactcaccataccatttgct

SEQ ID NO: 954064 - DNA, 25 bp, Mus musculus
ttggacactcacgataccatttgct

SEQ ID NO: 954065 - DNA, 25 bp, Mus musculus
ttggacactgcactgcacgcagaaa

SEQ ID NO: 954066 - DNA, 25 bp, Mus musculus
ttggacactgcagtgcacgcagaaa

SEQ ID NO: 954067 - DNA, 25 bp, Mus musculus
ttggacactgtcctaggagtctgat

SEQ ID NO: 954068 - DNA, 25 bp, Mus musculus
ttggacactgtcgtaggagtctgat

SEQ ID NO: 954069 - DNA, 25 bp, Mus musculus
ttggacacttgaatcttttctgcct

SEQ ID NO: 954070 - DNA, 25 bp, Mus musculus
ttggacacttgattcttttctgcct

SEQ ID NO: 954071 - DNA, 25 bp, Mus musculus
ttggacagacggactgctcagctgt

SEQ ID NO: 954072 - DNA, 25 bp, Mus musculus
ttggacagacggtctgctcagctgt

SEQ ID NO: 954073 - DNA, 25 bp, Mus musculus
ttggacagatagatggctagacaat

SEQ ID NO: 954074 - DNA, 25 bp, Mus musculus
ttggacagatagttggctagacaat

SEQ ID NO: 954075 - DNA, 25 bp, Mus musculus
ttggacagcttacccctaaagggtt

SEQ ID NO: 954076 - DNA, 25 bp, Mus musculus
ttggacagcttagccctaaagggtt

SEQ ID NO: 954077 - DNA, 25 bp, Mus musculus
ttggacaggatcctccatcacacct

SEQ ID NO: 954078 - DNA, 25 bp, Mus musculus
ttggacaggatcgtccatcacacct

SEQ ID NO: 954079 - DNA, 25 bp, Mus musculus
ttggacaggcccaggtgactgcttc

SEQ ID NO: 954080 - DNA, 25 bp, Mus musculus
ttggacaggccctggtgactgcttc

SEQ ID NO: 954081 - DNA, 25 bp, Mus musculus
ttggacagtctcatctcaatgtgcc

SEQ ID NO: 954082 - DNA, 25 bp, Mus musculus
ttggacagtctcttctcaatgtgcc

SEQ ID NO: 954083 - DNA, 25 bp, Mus musculus
ttggacagtggtctcattgatacta

SEQ ID NO: 954084 - DNA, 25 bp, Mus musculus
ttggacagtggtgtcattgatacta

SEQ ID NO: 954085 - DNA, 25 bp, Mus musculus
ttggacagtttcctggccgtcgaca

SEQ ID NO: 954086 - DNA, 25 bp, Mus musculus
ttggacagtttcgtggccgtcgaca

SEQ ID NO: 954087 - DNA, 25 bp, Mus musculus
ttggacatactcctcaggctaaccc

SEQ ID NO: 954088 - DNA, 25 bp, Mus musculus
ttggacatactcgtcaggctaaccc

SEQ ID NO: 954089 - DNA, 25 bp, Mus musculus
ttggacatatttccttgccctctat

SEQ ID NO: 954090 - DNA, 25 bp, Mus musculus
ttggacatatttgcttgccctctat

SEQ ID NO: 954091 - DNA, 25 bp, Mus musculus
ttggacatcaagagcctggcaggcg

SEQ ID NO: 954092 - DNA, 25 bp, Mus musculus
ttggacatcaagtgcctggcaggcg

SEQ ID NO: 954093 - DNA, 25 bp, Mus musculus
ttggacatccctacctaagagaatg

SEQ ID NO: 954094 - DNA, 25 bp, Mus musculus
ttggacatcccttcctaagagaatg

SEQ ID NO: 954095 - DNA, 25 bp, Mus musculus
ttggacatctacacatgcctgcaaa

SEQ ID NO: 954096 - DNA, 25 bp, Mus musculus
ttggacatctactcatgcctgcaaa

SEQ ID NO: 954097 - DNA, 25 bp, Mus musculus
ttggacatgcttattctgttctgcc

SEQ ID NO: 954098 - DNA, 25 bp, Mus musculus
ttggacatgctttttctgttctgcc

SEQ ID NO: 954099 - DNA, 25 bp, Mus musculus
ttggacatggttagcaccttctgtt

SEQ ID NO: 954100 - DNA, 25 bp, Mus musculus
ttggacatggtttgcaccttctgtt

SEQ ID NO: 954101 - DNA, 25 bp, Mus musculus
ttggacatgtagactagctttcttc

SEQ ID NO: 954102 - DNA, 25 bp, Mus musculus
ttggacatgtagtctagctttcttc

SEQ ID NO: 954103 - DNA, 25 bp, Mus musculus
ttggacattacacctagttcctttt

SEQ ID NO: 954104 - DNA, 25 bp, Mus musculus
ttggacattacagctagttcctttt

SEQ ID NO: 954105 - DNA, 25 bp, Mus musculus
ttggacattcccacagctacagact

SEQ ID NO: 954106 - DNA, 25 bp, Mus musculus
ttggacattccctcagctacagact

SEQ ID NO: 954107 - DNA, 25 bp, Mus musculus
ttggacatttctaagttgcccaggt

SEQ ID NO: 954108 - DNA, 25 bp, Mus musculus
ttggacatttcttagttgcccaggt

SEQ ID NO: 954109 - DNA, 25 bp, Mus musculus
ttggacatttgacaccccaggaaat

SEQ ID NO: 954110 - DNA, 25 bp, Mus musculus
ttggacatttgagaccccaggaaat

SEQ ID NO: 954111 - DNA, 25 bp, Mus musculus
ttggaccaactgacgttggttctgt

SEQ ID NO: 954112 - DNA, 25 bp, Mus musculus
ttggaccaactgtcgttggttctgt

SEQ ID NO: 954113 - DNA, 25 bp, Mus musculus
ttggaccaacttagccaggagtggg

SEQ ID NO: 954114 - DNA, 25 bp, Mus musculus
ttggaccaactttgccaggagtggg

SEQ ID NO: 954115 - DNA, 25 bp, Mus musculus
ttggaccaagtaagcatatgccgac

SEQ ID NO: 954116 - DNA, 25 bp, Mus musculus
ttggaccaagtatgcatatgccgac

SEQ ID NO: 954117 - DNA, 25 bp, Mus musculus
ttggaccacctcaaaggcctggtaa

SEQ ID NO: 954118 - DNA, 25 bp, Mus musculus
ttggaccacctctaaggcctggtaa

SEQ ID NO: 954119 - DNA, 25 bp, Mus musculus
ttggaccactatattgtgtgtttgc

SEQ ID NO: 954120 - DNA, 25 bp, Mus musculus
ttggaccactattttgtgtgtttgc

SEQ ID NO: 954121 - DNA, 25 bp, Mus musculus
ttggaccactgcagctttcacagtt

SEQ ID NO: 954122 - DNA, 25 bp, Mus musculus
ttggaccactgctgctttcacagtt

SEQ ID NO: 954123 - DNA, 25 bp, Mus musculus
ttggaccacttcagtcagatcaaca

SEQ ID NO: 954124 - DNA, 25 bp, Mus musculus
ttggaccacttctgtcagatcaaca

SEQ ID NO: 954125 - DNA, 25 bp, Mus musculus
ttggaccagtgacgtttcctagaat

SEQ ID NO: 954126 - DNA, 25 bp, Mus musculus
ttggaccagtgaggtttcctagaat

SEQ ID NO: 954127 - DNA, 25 bp, Mus musculus
ttggaccatctcagggccagatagt

SEQ ID NO: 954128 - DNA, 25 bp, Mus musculus
ttggaccatctctgggccagatagt

SEQ ID NO: 954129 - DNA, 25 bp, Mus musculus
ttggaccatgcaatgtcaccatgct

SEQ ID NO: 954130 - DNA, 25 bp, Mus musculus
ttggaccatgcattgtcaccatgct

SEQ ID NO: 954131 - DNA, 25 bp, Mus musculus
ttggacccaaagctcagcaccagaa

SEQ ID NO: 954132 - DNA, 25 bp, Mus musculus
ttggacccaaaggtcagcaccagaa

SEQ ID NO: 954133 - DNA, 25 bp, Mus musculus
ttggacccaagactgatatcaggct

SEQ ID NO: 954134 - DNA, 25 bp, Mus musculus
ttggacccaagagtgatatcaggct

SEQ ID NO: 954135 - DNA, 25 bp, Mus musculus
ttggacccagatccccaaggaggcg

SEQ ID NO: 954136 - DNA, 25 bp, Mus musculus
ttggacccagatgcccaaggaggcg

SEQ ID NO: 954137 - DNA, 25 bp, Mus musculus
ttggacccagcgctactttgatagc

SEQ ID NO: 954138 - DNA, 25 bp, Mus musculus
ttggacccagcggtactttgatagc

SEQ ID NO: 954139 - DNA, 25 bp, Mus musculus
ttggacccattcattaacctgccca

SEQ ID NO: 954140 - DNA, 25 bp, Mus musculus
ttggacccattctttaacctgccca

SEQ ID NO: 954141 - DNA, 25 bp, Mus musculus
ttggaccctgatcaggatacacctc

SEQ ID NO: 954142 - DNA, 25 bp, Mus musculus
ttggaccctgatgaggatacacctc

SEQ ID NO: 954143 - DNA, 25 bp, Mus musculus
ttggaccctgctccgtcagagcctt

SEQ ID NO: 954144 - DNA, 25 bp, Mus musculus
ttggaccctgctgcgtcagagcctt

SEQ ID NO: 954145 - DNA, 25 bp, Mus musculus
ttggacccttttactcaggttggag

SEQ ID NO: 954146 - DNA, 25 bp, Mus musculus
ttggaccctttttctcaggttggag

SEQ ID NO: 954147 - DNA, 25 bp, Mus musculus
ttggaccgacagacatctagcacga

SEQ ID NO: 954148 - DNA, 25 bp, Mus musculus
ttggaccgacagtcatctagcacga

SEQ ID NO: 954149 - DNA, 25 bp, Mus musculus
ttggacctacagattgtggaaccct

SEQ ID NO: 954150 - DNA, 25 bp, Mus musculus
ttggacctacagtttgtggaaccct

SEQ ID NO: 954151 - DNA, 25 bp, Mus musculus
ttggacctcaccagtaacggccacg

SEQ ID NO: 954152 - DNA, 25 bp, Mus musculus
ttggacctcacctgtaacggccacg

SEQ ID NO: 954153 - DNA, 25 bp, Mus musculus
ttggacctccgtatagagtgctcaa

SEQ ID NO: 954154 - DNA, 25 bp, Mus musculus
ttggacctccgtttagagtgctcaa

SEQ ID NO: 954155 - DNA, 25 bp, Mus musculus
ttggacctctaccttttctgctttt

SEQ ID NO: 954156 - DNA, 25 bp, Mus musculus
ttggacctctacgttttctgctttt

SEQ ID NO: 954157 - DNA, 25 bp, Mus musculus
ttggacctggccagaagactgattg

SEQ ID NO: 954158 - DNA, 25 bp, Mus musculus
ttggacctggcctgaagactgattg

SEQ ID NO: 954159 - DNA, 25 bp, Mus musculus
ttggaccttaggacagagccggaca

SEQ ID NO: 954160 - DNA, 25 bp, Mus musculus
ttggaccttaggtcagagccggaca

SEQ ID NO: 954161 - DNA, 25 bp, Mus musculus
ttggaccttcagcattgcctgatgg

SEQ ID NO: 954162 - DNA, 25 bp, Mus musculus
ttggaccttcaggattgcctgatgg

SEQ ID NO: 954163 - DNA, 25 bp, Mus musculus
ttggaccttcgacctagctttgtct

SEQ ID NO: 954164 - DNA, 25 bp, Mus musculus
ttggaccttcgagctagctttgtct

SEQ ID NO: 954165 - DNA, 25 bp, Mus musculus
ttggacctttttcagacaagcgagg

SEQ ID NO: 954166 - DNA, 25 bp, Mus musculus
ttggacctttttgagacaagcgagg

SEQ ID NO: 954167 - DNA, 25 bp, Mus musculus
ttggacgacttactccggctgcggt

SEQ ID NO: 954168 - DNA, 25 bp, Mus musculus
ttggacgacttagtccggctgcggt

SEQ ID NO: 954169 - DNA, 25 bp, Mus musculus
ttggacgcacagctggatgcttaca

SEQ ID NO: 954170 - DNA, 25 bp, Mus musculus
ttggacgcacaggtggatgcttaca

SEQ ID NO: 954171 - DNA, 25 bp, Mus musculus
ttggacgcaccacgtgccagcatgt

SEQ ID NO: 954172 - DNA, 25 bp, Mus musculus
ttggacgcaccaggtgccagcatgt

SEQ ID NO: 954173 - DNA, 25 bp, Mus musculus
ttggacgcagagactggcttcaaat

SEQ ID NO: 954174 - DNA, 25 bp, Mus musculus
ttggacgcagagtctggcttcaaat

SEQ ID NO: 954175 - DNA, 25 bp, Mus musculus
ttggacgccgtccagcgggaatacc

SEQ ID NO: 954176 - DNA, 25 bp, Mus musculus
ttggacgccgtcgagcgggaatacc

SEQ ID NO: 954177 - DNA, 25 bp, Mus musculus
ttggacggcgtacagaataagattc

SEQ ID NO: 954178 - DNA, 25 bp, Mus musculus
ttggacggcgtagagaataagattc

SEQ ID NO: 954179 - DNA, 25 bp, Mus musculus
ttggacggctggaaccagtgcctct

SEQ ID NO: 954180 - DNA, 25 bp, Mus musculus
ttggacggctggtaccagtgcctct

SEQ ID NO: 954181 - DNA, 25 bp, Mus musculus
ttggacgtcaccctagcacatgatg

SEQ ID NO: 954182 - DNA, 25 bp, Mus musculus
ttggacgtcaccgtagcacatgatg

SEQ ID NO: 954183 - DNA, 25 bp, Mus musculus
ttggacgtggtacagcaggcggtga

SEQ ID NO: 954184 - DNA, 25 bp, Mus musculus
ttggacgtggtagagcaggcggtga

SEQ ID NO: 954185 - DNA, 25 bp, Mus musculus
ttggacgtgtgtacagtgtgctgca

SEQ ID NO: 954186 - DNA, 25 bp, Mus musculus
ttggacgtgtgttcagtgtgctgca

SEQ ID NO: 954187 - DNA, 25 bp, Mus musculus
ttggactaaatgatgggcagggccc

SEQ ID NO: 954188 - DNA, 25 bp, Mus musculus
ttggactaaatgttgggcagggccc

SEQ ID NO: 954189 - DNA, 25 bp, Mus musculus
ttggactaagcgaccttgaatggat

SEQ ID NO: 954190 - DNA, 25 bp, Mus musculus
ttggactaagcgtccttgaatggat

SEQ ID NO: 954191 - DNA, 25 bp, Mus musculus
ttggactacatacacctaaactggc

SEQ ID NO: 954192 - DNA, 25 bp, Mus musculus
ttggactacatagacctaaactggc

SEQ ID NO: 954193 - DNA, 25 bp, Mus musculus
ttggactaggttcactccaccagat

SEQ ID NO: 954194 - DNA, 25 bp, Mus musculus
ttggactaggttgactccaccagat

SEQ ID NO: 954195 - DNA, 25 bp, Mus musculus
ttggactatgttacaagctgctcaa

SEQ ID NO: 954196 - DNA, 25 bp, Mus musculus
ttggactatgtttcaagctgctcaa

SEQ ID NO: 954197 - DNA, 25 bp, Mus musculus
ttggactatttaacgattgcctgac

SEQ ID NO: 954198 - DNA, 25 bp, Mus musculus
ttggactatttatcgattgcctgac

SEQ ID NO: 954199 - DNA, 25 bp, Mus musculus
ttggactatttgcagtcaaggctta

SEQ ID NO: 954200 - DNA, 25 bp, Mus musculus
ttggactatttggagtcaaggctta

SEQ ID NO: 954201 - DNA, 25 bp, Mus musculus
ttggactcacagcactacacaaact

SEQ ID NO: 954202 - DNA, 25 bp, Mus musculus
ttggactcacaggactacacaaact

SEQ ID NO: 954203 - DNA, 25 bp, Mus musculus
ttggactcagatagcattgcttcct

SEQ ID NO: 954204 - DNA, 25 bp, Mus musculus
ttggactcagattgcattgcttcct

SEQ ID NO: 954205 - DNA, 25 bp, Mus musculus
ttggactccagaatgacaccctgtc

SEQ ID NO: 954206 - DNA, 25 bp, Mus musculus
ttggactccagattgacaccctgtc

SEQ ID NO: 954207 - DNA, 25 bp, Mus musculus
ttggactccagccacaggaagcatc

SEQ ID NO: 954208 - DNA, 25 bp, Mus musculus
ttggactccagcgacaggaagcatc

SEQ ID NO: 954209 - DNA, 25 bp, Mus musculus
ttggactccttactagtggtctcct

SEQ ID NO: 954210 - DNA, 25 bp, Mus musculus
ttggactccttagtagtggtctcct

SEQ ID NO: 954211 - DNA, 25 bp, Mus musculus
ttggactctcaactgacttacaaca

SEQ ID NO: 954212 - DNA, 25 bp, Mus musculus
ttggactctcaagtgacttacaaca

SEQ ID NO: 954213 - DNA, 25 bp, Mus musculus
ttggactctccaatttacgactact

SEQ ID NO: 954214 - DNA, 25 bp, Mus musculus
ttggactctccacatcaaccaatat

SEQ ID NO: 954215 - DNA, 25 bp, Mus musculus
ttggactctccagatcaaccaatat

SEQ ID NO: 954216 - DNA, 25 bp, Mus musculus
ttggactctccattttacgactact

SEQ ID NO: 954217 - DNA, 25 bp, Mus musculus
ttggactctgaacacacatcctggg

SEQ ID NO: 954218 - DNA, 25 bp, Mus musculus
ttggactctgaagacacatcctggg

SEQ ID NO: 954219 - DNA, 25 bp, Mus musculus
ttggactctgacactatgcagccca

SEQ ID NO: 954220 - DNA, 25 bp, Mus musculus
ttggactctgactctatgcagccca

SEQ ID NO: 954221 - DNA, 25 bp, Mus musculus
ttggactgacttcctgggcctgagc

SEQ ID NO: 954222 - DNA, 25 bp, Mus musculus
ttggactgacttgctgggcctgagc

SEQ ID NO: 954223 - DNA, 25 bp, Mus musculus
ttggactgatataagctgcctcccc

SEQ ID NO: 954224 - DNA, 25 bp, Mus musculus
ttggactgatattagctgcctcccc

SEQ ID NO: 954225 - DNA, 25 bp, Mus musculus
ttggactgcagcacacggactggta

SEQ ID NO: 954226 - DNA, 25 bp, Mus musculus
ttggactgcagctcacggactggta

SEQ ID NO: 954227 - DNA, 25 bp, Mus musculus
ttggactgccagaccaccactaaga

SEQ ID NO: 954228 - DNA, 25 bp, Mus musculus
ttggactgccagtccaccactaaga

SEQ ID NO: 954229 - DNA, 25 bp, Mus musculus
ttggactgccttaatactacggacc

SEQ ID NO: 954230 - DNA, 25 bp, Mus musculus
ttggactgcctttatactacggacc

SEQ ID NO: 954231 - DNA, 25 bp, Mus musculus
ttggactggctcagtcctctgtggg

SEQ ID NO: 954232 - DNA, 25 bp, Mus musculus
ttggactggctctgtcctctgtggg

SEQ ID NO: 954233 - DNA, 25 bp, Mus musculus
ttggactgggaaccgctattttcct

SEQ ID NO: 954234 - DNA, 25 bp, Mus musculus
ttggactgggaagcgctattttcct

SEQ ID NO: 954235 - DNA, 25 bp, Mus musculus
ttggactgtagtaatctgcctggcc

SEQ ID NO: 954236 - DNA, 25 bp, Mus musculus
ttggactgtagttatctgcctggcc

SEQ ID NO: 954237 - DNA, 25 bp, Mus musculus
ttggacttacatatttctgtgtatt

SEQ ID NO: 954238 - DNA, 25 bp, Mus musculus
ttggacttacatttttctgtgtatt

SEQ ID NO: 954239 - DNA, 25 bp, Mus musculus
ttggacttatccctagcccttttgt

SEQ ID NO: 954240 - DNA, 25 bp, Mus musculus
ttggacttatccgtagcccttttgt

SEQ ID NO: 954241 - DNA, 25 bp, Mus musculus
ttggacttcataccctttattcact

SEQ ID NO: 954242 - DNA, 25 bp, Mus musculus
ttggacttcatagcctttattcact

SEQ ID NO: 954243 - DNA, 25 bp, Mus musculus
ttggacttcccaatgactcctgaga

SEQ ID NO: 954244 - DNA, 25 bp, Mus musculus
ttggacttcccattgactcctgaga

SEQ ID NO: 954245 - DNA, 25 bp, Mus musculus
ttggacttctgcacagcattgcatt

SEQ ID NO: 954246 - DNA, 25 bp, Mus musculus
ttggacttctgctcagcattgcatt

SEQ ID NO: 954247 - DNA, 25 bp, Mus musculus
ttggacttctggaatccactgggta

SEQ ID NO: 954248 - DNA, 25 bp, Mus musculus
ttggacttctggtatccactgggta

SEQ ID NO: 954249 - DNA, 25 bp, Mus musculus
ttggacttgaagagtttgcagcaaa

SEQ ID NO: 954250 - DNA, 25 bp, Mus musculus
ttggacttgaagtgtttgcagcaaa

SEQ ID NO: 954251 - DNA, 25 bp, Mus musculus
ttggacttgcatatttagctgtttg

SEQ ID NO: 954252 - DNA, 25 bp, Mus musculus
ttggacttgcatttttagctgtttg

SEQ ID NO: 954253 - DNA, 25 bp, Mus musculus
ttggacttgggcattgcacttggag

SEQ ID NO: 954254 - DNA, 25 bp, Mus musculus
ttggacttgggctttgcacttggag

SEQ ID NO: 954255 - DNA, 25 bp, Mus musculus
ttggactttaccaggcagctacttt

SEQ ID NO: 954256 - DNA, 25 bp, Mus musculus
ttggactttacctggcagctacttt

SEQ ID NO: 954257 - DNA, 25 bp, Mus musculus
ttggactttatcattaggtgtaaca

SEQ ID NO: 954258 - DNA, 25 bp, Mus musculus
ttggactttatctttaggtgtaaca

SEQ ID NO: 954259 - DNA, 25 bp, Mus musculus
ttggactttcctatctcttcagcat

SEQ ID NO: 954260 - DNA, 25 bp, Mus musculus
ttggactttcctcatttcacgggac

SEQ ID NO: 954261 - DNA, 25 bp, Mus musculus
ttggactttcctgatttcacgggac

SEQ ID NO: 954262 - DNA, 25 bp, Mus musculus
ttggactttcctttctcttcagcat

SEQ ID NO: 954263 - DNA, 25 bp, Mus musculus
ttggactttttgatactgcagggca

SEQ ID NO: 954264 - DNA, 25 bp, Mus musculus
ttggactttttgttactgcagggca

SEQ ID NO: 954265 - DNA, 25 bp, Mus musculus
ttggagaacactcgcacccaagcgt

SEQ ID NO: 954266 - DNA, 25 bp, Mus musculus
ttggagaacactggcacccaagcgt

SEQ ID NO: 954267 - DNA, 25 bp, Mus musculus
ttggagaactgccaacccaacgctt

SEQ ID NO: 954268 - DNA, 25 bp, Mus musculus
ttggagaactgcgaacccaacgctt

SEQ ID NO: 954269 - DNA, 25 bp, Mus musculus
ttggagacacaaatgcactgcactg

SEQ ID NO: 954270 - DNA, 25 bp, Mus musculus
ttggagacacaattgcactgcactg

SEQ ID NO: 954271 - DNA, 25 bp, Mus musculus
ttggagacactcatggaaggttttt

SEQ ID NO: 954272 - DNA, 25 bp, Mus musculus
ttggagacactcttggaaggttttt

SEQ ID NO: 954273 - DNA, 25 bp, Mus musculus
ttggagacatctatgtccaccaagc

SEQ ID NO: 954274 - DNA, 25 bp, Mus musculus
ttggagacatctttgtccaccaagc

SEQ ID NO: 954275 - DNA, 25 bp, Mus musculus
ttggagaccataccataagaaagta

SEQ ID NO: 954276 - DNA, 25 bp, Mus musculus
ttggagaccatagcataagaaagta

SEQ ID NO: 954277 - DNA, 25 bp, Mus musculus
ttggagacccagctcgttcatctga

SEQ ID NO: 954278 - DNA, 25 bp, Mus musculus
ttggagacccaggtcgttcatctga

SEQ ID NO: 954279 - DNA, 25 bp, Mus musculus
ttggagaccgtaacaacaatgcccc

SEQ ID NO: 954280 - DNA, 25 bp, Mus musculus
ttggagaccgtatcaacaatgcccc

SEQ ID NO: 954281 - DNA, 25 bp, Mus musculus
ttggagacctggatgctttttctct

SEQ ID NO: 954282 - DNA, 25 bp, Mus musculus
ttggagacctggcactgggatttct

SEQ ID NO: 954283 - DNA, 25 bp, Mus musculus
ttggagacctgggactgggatttct

SEQ ID NO: 954284 - DNA, 25 bp, Mus musculus
ttggagacctggttgctttttctct

SEQ ID NO: 954285 - DNA, 25 bp, Mus musculus
ttggagacctgtaccccaggtgcca

SEQ ID NO: 954286 - DNA, 25 bp, Mus musculus
ttggagacctgttccccaggtgcca

SEQ ID NO: 954287 - DNA, 25 bp, Mus musculus
ttggagacgcccactgtctgtccag

SEQ ID NO: 954288 - DNA, 25 bp, Mus musculus
ttggagacgccctctgtctgtccag

SEQ ID NO: 954289 - DNA, 25 bp, Mus musculus
ttggagacgcgcatcctaggagagc

SEQ ID NO: 954290 - DNA, 25 bp, Mus musculus
ttggagacgcgcttcctaggagagc

SEQ ID NO: 954291 - DNA, 25 bp, Mus musculus
ttggagacggccagttctgtgaacc

SEQ ID NO: 954292 - DNA, 25 bp, Mus musculus
ttggagacggcctgttctgtgaacc

SEQ ID NO: 954293 - DNA, 25 bp, Mus musculus
ttggagacggtcaatttttacattt

SEQ ID NO: 954294 - DNA, 25 bp, Mus musculus
ttggagacggtcatctgtagcccag

SEQ ID NO: 954295 - DNA, 25 bp, Mus musculus
ttggagacggtctatttttacattt

SEQ ID NO: 954296 - DNA, 25 bp, Mus musculus
ttggagacggtcttctgtagcccag

SEQ ID NO: 954297 - DNA, 25 bp, Mus musculus
ttggagactccgatggatcatgtga

SEQ ID NO: 954298 - DNA, 25 bp, Mus musculus
ttggagactccgttggatcatgtga

SEQ ID NO: 954299 - DNA, 25 bp, Mus musculus
ttggagactgcgctgaccgagaata

SEQ ID NO: 954300 - DNA, 25 bp, Mus musculus
ttggagactgcggtgaccgagaata

SEQ ID NO: 954301 - DNA, 25 bp, Mus musculus
ttggagagacagacagcgtgcctgc

SEQ ID NO: 954302 - DNA, 25 bp, Mus musculus
ttggagagacagtcagcgtgcctgc

SEQ ID NO: 954303 - DNA, 25 bp, Mus musculus
ttggagagatctacattttgttgtg

SEQ ID NO: 954304 - DNA, 25 bp, Mus musculus
ttggagagatcttcattttgttgtg

SEQ ID NO: 954305 - DNA, 25 bp, Mus musculus
ttggagagtatcacaggccttgcga

SEQ ID NO: 954306 - DNA, 25 bp, Mus musculus
ttggagagtatctcaggccttgcga

SEQ ID NO: 954307 - DNA, 25 bp, Mus musculus
ttggagagtccccagtagccaaggt

SEQ ID NO: 954308 - DNA, 25 bp, Mus musculus
ttggagagtcccgagtagccaaggt

SEQ ID NO: 954309 - DNA, 25 bp, Mus musculus
ttggagagtgcacgcccctgagcaa

SEQ ID NO: 954310 - DNA, 25 bp, Mus musculus
ttggagagtgcaggcccctgagcaa

SEQ ID NO: 954311 - DNA, 25 bp, Mus musculus
ttggagagtgttctctttcactcag

SEQ ID NO: 954312 - DNA, 25 bp, Mus musculus
ttggagagtgttgtctttcactcag

SEQ ID NO: 954313 - DNA, 25 bp, Mus musculus
ttggagagtttcagggccagcagca

SEQ ID NO: 954314 - DNA, 25 bp, Mus musculus
ttggagagtttctgggccagcagca

SEQ ID NO: 954315 - DNA, 25 bp, Mus musculus
ttggagatccttcgtccaggatccc

SEQ ID NO: 954316 - DNA, 25 bp, Mus musculus
ttggagatccttggtccaggatccc

SEQ ID NO: 954317 - DNA, 25 bp, Mus musculus
ttggagatctcaccagcagtctctg

SEQ ID NO: 954318 - DNA, 25 bp, Mus musculus
ttggagatctcagcagcagtctctg

SEQ ID NO: 954319 - DNA, 25 bp, Mus musculus
ttggagatgacaacccaggcatgga

SEQ ID NO: 954320 - DNA, 25 bp, Mus musculus
ttggagatgacatcccaggcatgga

SEQ ID NO: 954321 - DNA, 25 bp, Mus musculus
ttggagatgatcacctgctcttttc

SEQ ID NO: 954322 - DNA, 25 bp, Mus musculus
ttggagatgatctcctgctcttttc

SEQ ID NO: 954323 - DNA, 25 bp, Mus musculus
ttggagatgtaaatgtctgggcatt

SEQ ID NO: 954324 - DNA, 25 bp, Mus musculus
ttggagatgtaattgtctgggcatt

SEQ ID NO: 954325 - DNA, 25 bp, Mus musculus
ttggagatgtgcagttcttgagaca

SEQ ID NO: 954326 - DNA, 25 bp, Mus musculus
ttggagatgtgctgttcttgagaca

SEQ ID NO: 954327 - DNA, 25 bp, Mus musculus
ttggagatgttaattattagatgat

SEQ ID NO: 954328 - DNA, 25 bp, Mus musculus
ttggagatgttatttattagatgat

SEQ ID NO: 954329 - DNA, 25 bp, Mus musculus
ttggagattgccaaacactcccaaa

SEQ ID NO: 954330 - DNA, 25 bp, Mus musculus
ttggagattgcctaacactcccaaa

SEQ ID NO: 954331 - DNA, 25 bp, Mus musculus
ttggagcaaaccatcctggtttcct

SEQ ID NO: 954332 - DNA, 25 bp, Mus musculus
ttggagcaaaccttcctggtttcct

SEQ ID NO: 954333 - DNA, 25 bp, Mus musculus
ttggagcaaagtagaccaccacctt

SEQ ID NO: 954334 - DNA, 25 bp, Mus musculus
ttggagcaaagttgaccaccacctt

SEQ ID NO: 954335 - DNA, 25 bp, Mus musculus
ttggagcaagccagaacccacacga

SEQ ID NO: 954336 - DNA, 25 bp, Mus musculus
ttggagcaagcctgaacccacacga

SEQ ID NO: 954337 - DNA, 25 bp, Mus musculus
ttggagcaccagatcgctctgaaag

SEQ ID NO: 954338 - DNA, 25 bp, Mus musculus
ttggagcaccagttcgctctgaaag

SEQ ID NO: 954339 - DNA, 25 bp, Mus musculus
ttggagcactccacgagctgttgaa

SEQ ID NO: 954340 - DNA, 25 bp, Mus musculus
ttggagcactcctcgagctgttgaa

SEQ ID NO: 954341 - DNA, 25 bp, Mus musculus
ttggagcatcacaaatggcccagcc

SEQ ID NO: 954342 - DNA, 25 bp, Mus musculus
ttggagcatcactaatggcccagcc

SEQ ID NO: 954343 - DNA, 25 bp, Mus musculus
ttggagccaccaagggagacaaacc

SEQ ID NO: 954344 - DNA, 25 bp, Mus musculus
ttggagccaccatgggagacaaacc

SEQ ID NO: 954345 - DNA, 25 bp, Mus musculus
ttggagccagacaggttacggacat

SEQ ID NO: 954346 - DNA, 25 bp, Mus musculus
ttggagccagactggttacggacat

SEQ ID NO: 954347 - DNA, 25 bp, Mus musculus
ttggagccagatctgttccctggaa

SEQ ID NO: 954348 - DNA, 25 bp, Mus musculus
ttggagccagatgtgttccctggaa

SEQ ID NO: 954349 - DNA, 25 bp, Mus musculus
ttggagccagcacacagatctcagt

SEQ ID NO: 954350 - DNA, 25 bp, Mus musculus
ttggagccagcagacagatctcagt

SEQ ID NO: 954351 - DNA, 25 bp, Mus musculus
ttggagccatccatgtaatagcagc

SEQ ID NO: 954352 - DNA, 25 bp, Mus musculus
ttggagccatccttgtaatagcagc

SEQ ID NO: 954353 - DNA, 25 bp, Mus musculus
ttggagcccatgaaccctgatgcct

SEQ ID NO: 954354 - DNA, 25 bp, Mus musculus
ttggagcccatgtaccctgatgcct

SEQ ID NO: 954355 - DNA, 25 bp, Mus musculus
ttggagccccggcatggcaatacca

SEQ ID NO: 954356 - DNA, 25 bp, Mus musculus
ttggagccccgggatggcaatacca

SEQ ID NO: 954357 - DNA, 25 bp, Mus musculus
ttggagccctctcgtcctacaggac

SEQ ID NO: 954358 - DNA, 25 bp, Mus musculus
ttggagccctctggtcctacaggac

SEQ ID NO: 954359 - DNA, 25 bp, Mus musculus
ttggagccgcacaggtgctcaagtg

SEQ ID NO: 954360 - DNA, 25 bp, Mus musculus
ttggagccgcactggtgctcaagtg

SEQ ID NO: 954361 - DNA, 25 bp, Mus musculus
ttggagccgcctcgccaggaaaaat

SEQ ID NO: 954362 - DNA, 25 bp, Mus musculus
ttggagccgcctggccaggaaaaat

SEQ ID NO: 954363 - DNA, 25 bp, Mus musculus
ttggagcctagcacactggctttaa

SEQ ID NO: 954364 - DNA, 25 bp, Mus musculus
ttggagcctagctcactggctttaa

SEQ ID NO: 954365 - DNA, 25 bp, Mus musculus
ttggagcctgcaatgtctgtatttt

SEQ ID NO: 954366 - DNA, 25 bp, Mus musculus
ttggagcctgcattgtctgtatttt

SEQ ID NO: 954367 - DNA, 25 bp, Mus musculus
ttggagcctggaaacattatttgac

SEQ ID NO: 954368 - DNA, 25 bp, Mus musculus
ttggagcctggatacattatttgac

SEQ ID NO: 954369 - DNA, 25 bp, Mus musculus
ttggagcctgtgcttcagggtataa

SEQ ID NO: 954370 - DNA, 25 bp, Mus musculus
ttggagcctgtggttcagggtataa

SEQ ID NO: 954371 - DNA, 25 bp, Mus musculus
ttggagccttccacgctgagcgaag

SEQ ID NO: 954372 - DNA, 25 bp, Mus musculus
ttggagccttcctcgctgagcgaag

SEQ ID NO: 954373 - DNA, 25 bp, Mus musculus
ttggagcgaggaaccattttctctt

SEQ ID NO: 954374 - DNA, 25 bp, Mus musculus
ttggagcgaggatccattttctctt

SEQ ID NO: 954375 - DNA, 25 bp, Mus musculus
ttggagcgatacagagtgacttgga

SEQ ID NO: 954376 - DNA, 25 bp, Mus musculus
ttggagcgatactgagtgacttgga

SEQ ID NO: 954377 - DNA, 25 bp, Mus musculus
ttggagcgatgtatggccttaccac

SEQ ID NO: 954378 - DNA, 25 bp, Mus musculus
ttggagcgatgtttggccttaccac

SEQ ID NO: 954379 - DNA, 25 bp, Mus musculus
ttggagctacaactgtgtcctctcc

SEQ ID NO: 954380 - DNA, 25 bp, Mus musculus
ttggagctacaagtgtgtcctctcc

SEQ ID NO: 954381 - DNA, 25 bp, Mus musculus
ttggagctacagagagggcacgccc

SEQ ID NO: 954382 - DNA, 25 bp, Mus musculus
ttggagctacagtgagggcacgccc

SEQ ID NO: 954383 - DNA, 25 bp, Mus musculus
ttggagctagagattgcaccctgca

SEQ ID NO: 954384 - DNA, 25 bp, Mus musculus
ttggagctagagtttgcaccctgca

SEQ ID NO: 954385 - DNA, 25 bp, Mus musculus
ttggagctgacacaatggcccagag

SEQ ID NO: 954386 - DNA, 25 bp, Mus musculus
ttggagctgacagaatggcccagag

SEQ ID NO: 954387 - DNA, 25 bp, Mus musculus
ttggagctgcaaaagtcactggagc

SEQ ID NO: 954388 - DNA, 25 bp, Mus musculus
ttggagctgcaatagtcactggagc

SEQ ID NO: 954389 - DNA, 25 bp, Mus musculus
ttggagctgcctctggtgaccaaca

SEQ ID NO: 954390 - DNA, 25 bp, Mus musculus
ttggagctgcctgtggtgaccaaca

SEQ ID NO: 954391 - DNA, 25 bp, Mus musculus
ttggagctggacacctgaggacacc

SEQ ID NO: 954392 - DNA, 25 bp, Mus musculus
ttggagctggactcctgaggacacc

SEQ ID NO: 954393 - DNA, 25 bp, Mus musculus
ttggagctgggaatcggttcctgta

SEQ ID NO: 954394 - DNA, 25 bp, Mus musculus
ttggagctgggattcggttcctgta

SEQ ID NO: 954395 - DNA, 25 bp, Mus musculus
ttggagctgggtcccatcaagaatg

SEQ ID NO: 954396 - DNA, 25 bp, Mus musculus
ttggagctgggtgccatcaagaatg

SEQ ID NO: 954397 - DNA, 25 bp, Mus musculus
ttggagctggtgacgcagatcctga

SEQ ID NO: 954398 - DNA, 25 bp, Mus musculus
ttggagctggtgtcgcagatcctga

SEQ ID NO: 954399 - DNA, 25 bp, Mus musculus
ttggagctgtcaaggccctgtggac

SEQ ID NO: 954400 - DNA, 25 bp, Mus musculus
ttggagctgtcatggccctgtggac

SEQ ID NO: 954401 - DNA, 25 bp, Mus musculus
ttggagctgtgacttctccctgtac

SEQ ID NO: 954402 - DNA, 25 bp, Mus musculus
ttggagctgtgagttctccctgtac

SEQ ID NO: 954403 - DNA, 25 bp, Mus musculus
ttggagcttaaaccccttgtatatt

SEQ ID NO: 954404 - DNA, 25 bp, Mus musculus
ttggagcttaaagcccttgtatatt

SEQ ID NO: 954405 - DNA, 25 bp, Mus musculus
ttggagcttctcaggttggaaccca

SEQ ID NO: 954406 - DNA, 25 bp, Mus musculus
ttggagcttctctggttggaaccca

SEQ ID NO: 954407 - DNA, 25 bp, Mus musculus
ttggagcttttgaactcaagtttcc

SEQ ID NO: 954408 - DNA, 25 bp, Mus musculus
ttggagcttttgtactcaagtttcc

SEQ ID NO: 954409 - DNA, 25 bp, Mus musculus
ttggaggaaaggaccaaacaggctt

SEQ ID NO: 954410 - DNA, 25 bp, Mus musculus
ttggaggaaaggtccaaacaggctt

SEQ ID NO: 954411 - DNA, 25 bp, Mus musculus
ttggaggaacgcctactcacattct

SEQ ID NO: 954412 - DNA, 25 bp, Mus musculus
ttggaggaacgcgtactcacattct

SEQ ID NO: 954413 - DNA, 25 bp, Mus musculus
ttggaggaagctacgcaggttcctt

SEQ ID NO: 954414 - DNA, 25 bp, Mus musculus
ttggaggaagcttcgcaggttcctt

SEQ ID NO: 954415 - DNA, 25 bp, Mus musculus
ttggaggacacgcatttcgttcagt

SEQ ID NO: 954416 - DNA, 25 bp, Mus musculus
ttggaggacacggatttcgttcagt

SEQ ID NO: 954417 - DNA, 25 bp, Mus musculus
ttggaggacagacgttcccatccca

SEQ ID NO: 954418 - DNA, 25 bp, Mus musculus
ttggaggacagaggttcccatccca

SEQ ID NO: 954419 - DNA, 25 bp, Mus musculus
ttggaggaccccagagtcttcccac

SEQ ID NO: 954420 - DNA, 25 bp, Mus musculus
ttggaggacccctgagtcttcccac

SEQ ID NO: 954421 - DNA, 25 bp, Mus musculus
ttggaggacgaacagcagctacagt

SEQ ID NO: 954422 - DNA, 25 bp, Mus musculus
ttggaggacgaagagcagctacagt

SEQ ID NO: 954423 - DNA, 25 bp, Mus musculus
ttggaggactctaccttgctttgaa

SEQ ID NO: 954424 - DNA, 25 bp, Mus musculus
ttggaggactctcctcagggactca

SEQ ID NO: 954425 - DNA, 25 bp, Mus musculus
ttggaggactctgctcagggactca

SEQ ID NO: 954426 - DNA, 25 bp, Mus musculus
ttggaggactcttccttgctttgaa

SEQ ID NO: 954427 - DNA, 25 bp, Mus musculus
ttggaggagtgtctgcttctgaaat

SEQ ID NO: 954428 - DNA, 25 bp, Mus musculus
ttggaggagtgtgtgcttctgaaat

SEQ ID NO: 954429 - DNA, 25 bp, Mus musculus
ttggaggatgtcctatccatcgcct

SEQ ID NO: 954430 - DNA, 25 bp, Mus musculus
ttggaggatgtcgtatccatcgcct

SEQ ID NO: 954431 - DNA, 25 bp, Mus musculus
ttggaggcaccaacggagcatcaat

SEQ ID NO: 954432 - DNA, 25 bp, Mus musculus
ttggaggcaccatcggagcatcaat

SEQ ID NO: 954433 - DNA, 25 bp, Mus musculus
ttggaggcagacagtcttgccaggc

SEQ ID NO: 954434 - DNA, 25 bp, Mus musculus
ttggaggcagactgtcttgccaggc

SEQ ID NO: 954435 - DNA, 25 bp, Mus musculus
ttggaggcagcactaggacacatac

SEQ ID NO: 954436 - DNA, 25 bp, Mus musculus
ttggaggcagcagtaggacacatac

SEQ ID NO: 954437 - DNA, 25 bp, Mus musculus
ttggaggcagccagtcttgcactta

SEQ ID NO: 954438 - DNA, 25 bp, Mus musculus
ttggaggcagcctgtcttgcactta

SEQ ID NO: 954439 - DNA, 25 bp, Mus musculus
ttggaggcatctaggctgcacacag

SEQ ID NO: 954440 - DNA, 25 bp, Mus musculus
ttggaggcatcttggctgcacacag

SEQ ID NO: 954441 - DNA, 25 bp, Mus musculus
ttggaggcatgcctatcctgtcata

SEQ ID NO: 954442 - DNA, 25 bp, Mus musculus
ttggaggcatgcgtatcctgtcata

SEQ ID NO: 954443 - DNA, 25 bp, Mus musculus
ttggaggcatttactcagtttgctg

SEQ ID NO: 954444 - DNA, 25 bp, Mus musculus
ttggaggcattttctcagtttgctg

SEQ ID NO: 954445 - DNA, 25 bp, Mus musculus
ttggaggcccctacccacagctggg

SEQ ID NO: 954446 - DNA, 25 bp, Mus musculus
ttggaggccccttcccacagctggg

SEQ ID NO: 954447 - DNA, 25 bp, Mus musculus
ttggaggccgctacctggtgtatga

SEQ ID NO: 954448 - DNA, 25 bp, Mus musculus
ttggaggccgcttcctggtgtatga

SEQ ID NO: 954449 - DNA, 25 bp, Mus musculus
ttggaggccttaaatctcatacctg

SEQ ID NO: 954450 - DNA, 25 bp, Mus musculus
ttggaggccttatatctcatacctg

SEQ ID NO: 954451 - DNA, 25 bp, Mus musculus
ttggaggcgaccacaagctcttgtt

SEQ ID NO: 954452 - DNA, 25 bp, Mus musculus
ttggaggcgacctcaagctcttgtt

SEQ ID NO: 954453 - DNA, 25 bp, Mus musculus
ttggaggcgcatcctgcacattcat

SEQ ID NO: 954454 - DNA, 25 bp, Mus musculus
ttggaggcgcatgctgcacattcat

SEQ ID NO: 954455 - DNA, 25 bp, Mus musculus
ttggaggcggtaacttccgctgcgc

SEQ ID NO: 954456 - DNA, 25 bp, Mus musculus
ttggaggcggtatcttccgctgcgc

SEQ ID NO: 954457 - DNA, 25 bp, Mus musculus
ttggaggctccaaagcacatgtctg

SEQ ID NO: 954458 - DNA, 25 bp, Mus musculus
ttggaggctccatagcacatgtctg

SEQ ID NO: 954459 - DNA, 25 bp, Mus musculus
ttggaggctgcgcacagcgacccca

SEQ ID NO: 954460 - DNA, 25 bp, Mus musculus
ttggaggctgcggacagcgacccca

SEQ ID NO: 954461 - DNA, 25 bp, Mus musculus
ttggaggctttacctcttggcttac

SEQ ID NO: 954462 - DNA, 25 bp, Mus musculus
ttggaggctttagctcttggcttac

SEQ ID NO: 954463 - DNA, 25 bp, Mus musculus
ttggagggagtaagaacaaggctca

SEQ ID NO: 954464 - DNA, 25 bp, Mus musculus
ttggagggagtatgaacaaggctca

SEQ ID NO: 954465 - DNA, 25 bp, Mus musculus
ttggagggcaccattgcctgctagg

SEQ ID NO: 954466 - DNA, 25 bp, Mus musculus
ttggagggcacctttgcctgctagg

SEQ ID NO: 954467 - DNA, 25 bp, Mus musculus
ttggagggcaggaggcataaagagt

SEQ ID NO: 954468 - DNA, 25 bp, Mus musculus
ttggagggcaggtggcataaagagt

SEQ ID NO: 954469 - DNA, 25 bp, Mus musculus
ttggagggccagagcttatttaagc

SEQ ID NO: 954470 - DNA, 25 bp, Mus musculus
ttggagggccagtgcttatttaagc

SEQ ID NO: 954471 - DNA, 25 bp, Mus musculus
ttggagggcttcagtgttggcactc

SEQ ID NO: 954472 - DNA, 25 bp, Mus musculus
ttggagggcttctgtgttggcactc

SEQ ID NO: 954473 - DNA, 25 bp, Mus musculus
ttggagggtagcagctctctgcaca

SEQ ID NO: 954474 - DNA, 25 bp, Mus musculus
ttggagggtagctgctctctgcaca

SEQ ID NO: 954475 - DNA, 25 bp, Mus musculus
ttggagggtgctcgaactgttacta

SEQ ID NO: 954476 - DNA, 25 bp, Mus musculus
ttggagggtgctggaactgttacta

SEQ ID NO: 954477 - DNA, 25 bp, Mus musculus
ttggaggtatacatgcaaagctgct

SEQ ID NO: 954478 - DNA, 25 bp, Mus musculus
ttggaggtatacttgcaaagctgct

SEQ ID NO: 954479 - DNA, 25 bp, Mus musculus
ttggaggtatttagtgactcacttc

SEQ ID NO: 954480 - DNA, 25 bp, Mus musculus
ttggaggtattttgtgactcacttc

SEQ ID NO: 954481 - DNA, 25 bp, Mus musculus
ttggaggtcaccaaagagttacgcc

SEQ ID NO: 954482 - DNA, 25 bp, Mus musculus
ttggaggtcacctaagagttacgcc

SEQ ID NO: 954483 - DNA, 25 bp, Mus musculus
ttggaggtcaggagcccctgcagat

SEQ ID NO: 954484 - DNA, 25 bp, Mus musculus
ttggaggtcaggtgcccctgcagat

SEQ ID NO: 954485 - DNA, 25 bp, Mus musculus
ttggaggtgacacggttgagtgctt

SEQ ID NO: 954486 - DNA, 25 bp, Mus musculus
ttggaggtgacagggttgagtgctt

SEQ ID NO: 954487 - DNA, 25 bp, Mus musculus
ttggaggtgcacagtgcctttctaa

SEQ ID NO: 954488 - DNA, 25 bp, Mus musculus
ttggaggtgcactgtgcctttctaa

SEQ ID NO: 954489 - DNA, 25 bp, Mus musculus
ttggaggtggtgcaagctacaatga

SEQ ID NO: 954490 - DNA, 25 bp, Mus musculus
ttggaggtggtggaagctacaatga

SEQ ID NO: 954491 - DNA, 25 bp, Mus musculus
ttggaggtttccagaagcgtagcca

SEQ ID NO: 954492 - DNA, 25 bp, Mus musculus
ttggaggtttcctgaagcgtagcca

SEQ ID NO: 954493 - DNA, 25 bp, Mus musculus
ttggaggtttgcagagacccgcttc

SEQ ID NO: 954494 - DNA, 25 bp, Mus musculus
ttggaggtttgctgagacccgcttc

SEQ ID NO: 954495 - DNA, 25 bp, Mus musculus
ttggagtaccggaggataccccaca

SEQ ID NO: 954496 - DNA, 25 bp, Mus musculus
ttggagtaccggtggataccccaca

SEQ ID NO: 954497 - DNA, 25 bp, Mus musculus
ttggagtacgctcctgtttgggttc

SEQ ID NO: 954498 - DNA, 25 bp, Mus musculus
ttggagtacgctgctgtttgggttc

SEQ ID NO: 954499 - DNA, 25 bp, Mus musculus
ttggagtagatcaatccccttctgc

SEQ ID NO: 954500 - DNA, 25 bp, Mus musculus
ttggagtagatctatccccttctgc

SEQ ID NO: 954501 - DNA, 25 bp, Mus musculus
ttggagtagcttctctttagttctc

SEQ ID NO: 954502 - DNA, 25 bp, Mus musculus
ttggagtagcttgtctttagttctc

SEQ ID NO: 954503 - DNA, 25 bp, Mus musculus
ttggagtcacccatgtcaatcggac

SEQ ID NO: 954504 - DNA, 25 bp, Mus musculus
ttggagtcacccttgtcaatcggac

SEQ ID NO: 954505 - DNA, 25 bp, Mus musculus
ttggagtcacctcgacaagtcctat

SEQ ID NO: 954506 - DNA, 25 bp, Mus musculus
ttggagtcacctggacaagtcctat

SEQ ID NO: 954507 - DNA, 25 bp, Mus musculus
ttggagtcagacagcctaaacccca

SEQ ID NO: 954508 - DNA, 25 bp, Mus musculus
ttggagtcagactgcctaaacccca

SEQ ID NO: 954509 - DNA, 25 bp, Mus musculus
ttggagtcagccacttatgagccac

SEQ ID NO: 954510 - DNA, 25 bp, Mus musculus
ttggagtcagcctcttatgagccac

SEQ ID NO: 954511 - DNA, 25 bp, Mus musculus
ttggagtcagctcaggattcctggt

SEQ ID NO: 954512 - DNA, 25 bp, Mus musculus
ttggagtcagctgaggattcctggt

SEQ ID NO: 954513 - DNA, 25 bp, Mus musculus
ttggagtcatggcacctctcagcag

SEQ ID NO: 954514 - DNA, 25 bp, Mus musculus
ttggagtcatgggacctctcagcag

SEQ ID NO: 954515 - DNA, 25 bp, Mus musculus
ttggagtccaaaaggctgccagaga

SEQ ID NO: 954516 - DNA, 25 bp, Mus musculus
ttggagtccaaatggctgccagaga

SEQ ID NO: 954517 - DNA, 25 bp, Mus musculus
ttggagtccaagaccgggagctgtt

SEQ ID NO: 954518 - DNA, 25 bp, Mus musculus
ttggagtccaagtccgggagctgtt

SEQ ID NO: 954519 - DNA, 25 bp, Mus musculus
ttggagtcccagctagctagtccct

SEQ ID NO: 954520 - DNA, 25 bp, Mus musculus
ttggagtcccaggtagctagtccct

SEQ ID NO: 954521 - DNA, 25 bp, Mus musculus
ttggagtcctgaagccacaacagca

SEQ ID NO: 954522 - DNA, 25 bp, Mus musculus
ttggagtcctgatgccacaacagca

SEQ ID NO: 954523 - DNA, 25 bp, Mus musculus
ttggagtcctgcacatcatcccaga

SEQ ID NO: 954524 - DNA, 25 bp, Mus musculus
ttggagtcctgctcatcatcccaga

SEQ ID NO: 954525 - DNA, 25 bp, Mus musculus
ttggagtcgctaatgctggattagt

SEQ ID NO: 954526 - DNA, 25 bp, Mus musculus
ttggagtcgctattgctggattagt

SEQ ID NO: 954527 - DNA, 25 bp, Mus musculus
ttggagtcggttcccaaagttccag

SEQ ID NO: 954528 - DNA, 25 bp, Mus musculus
ttggagtcggttgccaaagttccag

SEQ ID NO: 954529 - DNA, 25 bp, Mus musculus
ttggagtctcaacagtaccagagtc

SEQ ID NO: 954530 - DNA, 25 bp, Mus musculus
ttggagtctcaagagtaccagagtc

SEQ ID NO: 954531 - DNA, 25 bp, Mus musculus
ttggagtctcgacgctgaaatcaca

SEQ ID NO: 954532 - DNA, 25 bp, Mus musculus
ttggagtctcgaggctgaaatcaca

SEQ ID NO: 954533 - DNA, 25 bp, Mus musculus
ttggagtctgagacctggctgtctg

SEQ ID NO: 954534 - DNA, 25 bp, Mus musculus
ttggagtctgagtcctggctgtctg

SEQ ID NO: 954535 - DNA, 25 bp, Mus musculus
ttggagtgacacagcacgagctgct

SEQ ID NO: 954536 - DNA, 25 bp, Mus musculus
ttggagtgacactgcacgagctgct

SEQ ID NO: 954537 - DNA, 25 bp, Mus musculus
ttggagtgctttagttcttgttgat

SEQ ID NO: 954538 - DNA, 25 bp, Mus musculus
ttggagtgcttttgttcttgttgat

SEQ ID NO: 954539 - DNA, 25 bp, Mus musculus
ttggagtggcttacggtgtcctagc

SEQ ID NO: 954540 - DNA, 25 bp, Mus musculus
ttggagtggctttcggtgtcctagc

SEQ ID NO: 954541 - DNA, 25 bp, Mus musculus
ttggagtgggtgaactgctcctgcc

SEQ ID NO: 954542 - DNA, 25 bp, Mus musculus
ttggagtgggtgtactgctcctgcc

SEQ ID NO: 954543 - DNA, 25 bp, Mus musculus
ttggagtggtctacctatttatcat

SEQ ID NO: 954544 - DNA, 25 bp, Mus musculus
ttggagtggtcttcctatttatcat

SEQ ID NO: 954545 - DNA, 25 bp, Mus musculus
ttggagtgtgatcctagtgagacta

SEQ ID NO: 954546 - DNA, 25 bp, Mus musculus
ttggagtgtgatgctagtgagacta

SEQ ID NO: 954547 - DNA, 25 bp, Mus musculus
ttggagtgtgccagaacagctctgc

SEQ ID NO: 954548 - DNA, 25 bp, Mus musculus
ttggagtgtgcctgaacagctctgc

SEQ ID NO: 954549 - DNA, 25 bp, Mus musculus
ttggagttaccactggctttgagta

SEQ ID NO: 954550 - DNA, 25 bp, Mus musculus
ttggagttaccagtggctttgagta

SEQ ID NO: 954551 - DNA, 25 bp, Mus musculus
ttggagttagacactgtatgggccc

SEQ ID NO: 954552 - DNA, 25 bp, Mus musculus
ttggagttagactctgtatgggccc

SEQ ID NO: 954553 - DNA, 25 bp, Mus musculus
ttggagttctgcacccataggcctg

SEQ ID NO: 954554 - DNA, 25 bp, Mus musculus
ttggagttctgctcccataggcctg

SEQ ID NO: 954555 - DNA, 25 bp, Mus musculus
ttggagttctttatcctctttccta

SEQ ID NO: 954556 - DNA, 25 bp, Mus musculus
ttggagttctttttcctctttccta

SEQ ID NO: 954557 - DNA, 25 bp, Mus musculus
ttggagttgcttcctttcagctaat

SEQ ID NO: 954558 - DNA, 25 bp, Mus musculus
ttggagttgcttgctttcagctaat

SEQ ID NO: 954559 - DNA, 25 bp, Mus musculus
ttggagttgtggatatccgcctgaa

SEQ ID NO: 954560 - DNA, 25 bp, Mus musculus
ttggagttgtggttatccgcctgaa

SEQ ID NO: 954561 - DNA, 25 bp, Mus musculus
ttggagttgtttcctaaagtcaaag

SEQ ID NO: 954562 - DNA, 25 bp, Mus musculus
ttggagttgtttgctaaagtcaaag

SEQ ID NO: 954563 - DNA, 25 bp, Mus musculus
ttggagtttcaaagttttccacgca

SEQ ID NO: 954564 - DNA, 25 bp, Mus musculus
ttggagtttcaatgttttccacgca

SEQ ID NO: 954565 - DNA, 25 bp, Mus musculus
ttggagtttcagctgtttccgagct

SEQ ID NO: 954566 - DNA, 25 bp, Mus musculus
ttggagtttcaggtgtttccgagct

SEQ ID NO: 954567 - DNA, 25 bp, Mus musculus
ttggagtttcttcccagagagtctg

SEQ ID NO: 954568 - DNA, 25 bp, Mus musculus
ttggagtttcttgccagagagtctg

SEQ ID NO: 954569 - DNA, 25 bp, Mus musculus
ttggagtttgcacggcacttttcac

SEQ ID NO: 954570 - DNA, 25 bp, Mus musculus
ttggagtttgcagggcacttttcac

SEQ ID NO: 954571 - DNA, 25 bp, Mus musculus
ttggagtttggtcaacttcatggtt

SEQ ID NO: 954572 - DNA, 25 bp, Mus musculus
ttggagtttggtgaacttcatggtt

SEQ ID NO: 954573 - DNA, 25 bp, Mus musculus
ttggagttttcccaacatgctctgg

SEQ ID NO: 954574 - DNA, 25 bp, Mus musculus
ttggagttttccgaacatgctctgg

SEQ ID NO: 954575 - DNA, 25 bp, Mus musculus
ttggagttttcgctcaggcaaacaa

SEQ ID NO: 954576 - DNA, 25 bp, Mus musculus
ttggagttttcggtcaggcaaacaa

SEQ ID NO: 954577 - DNA, 25 bp, Mus musculus
ttggataacataattttcccaacga

SEQ ID NO: 954578 - DNA, 25 bp, Mus musculus
ttggataacatatttttcccaacga

SEQ ID NO: 954579 - DNA, 25 bp, Mus musculus
ttggataacttcctgtttctctcga

SEQ ID NO: 954580 - DNA, 25 bp, Mus musculus
ttggataacttcgtgtttctctcga

SEQ ID NO: 954581 - DNA, 25 bp, Mus musculus
ttggataatgtaagtctctctctct

SEQ ID NO: 954582 - DNA, 25 bp, Mus musculus
ttggataatgtatgtctctctctct

SEQ ID NO: 954583 - DNA, 25 bp, Mus musculus
ttggatacaagtactttaccactta

SEQ ID NO: 954584 - DNA, 25 bp, Mus musculus
ttggatacaagttctttaccactta

SEQ ID NO: 954585 - DNA, 25 bp, Mus musculus
ttggatacctccaaagatgtctctt

SEQ ID NO: 954586 - DNA, 25 bp, Mus musculus
ttggatacctcctaagatgtctctt

SEQ ID NO: 954587 - DNA, 25 bp, Mus musculus
ttggatacgggaccttgattggctt

SEQ ID NO: 954588 - DNA, 25 bp, Mus musculus
ttggatacgggagcttgattggctt

SEQ ID NO: 954589 - DNA, 25 bp, Mus musculus
ttggatactgctccccaaggacatt

SEQ ID NO: 954590 - DNA, 25 bp, Mus musculus
ttggatactgctgcccaaggacatt

SEQ ID NO: 954591 - DNA, 25 bp, Mus musculus
ttggatacttctcgcgtcaactgtc

SEQ ID NO: 954592 - DNA, 25 bp, Mus musculus
ttggatacttctggcgtcaactgtc

SEQ ID NO: 954593 - DNA, 25 bp, Mus musculus
ttggatatacacagaccaccataga

SEQ ID NO: 954594 - DNA, 25 bp, Mus musculus
ttggatatacactgaccaccataga

SEQ ID NO: 954595 - DNA, 25 bp, Mus musculus
ttggatatccccaagcctgcgggac

SEQ ID NO: 954596 - DNA, 25 bp, Mus musculus
ttggatatcccctagcctgcgggac

SEQ ID NO: 954597 - DNA, 25 bp, Mus musculus
ttggatatccctacctgctgtatag

SEQ ID NO: 954598 - DNA, 25 bp, Mus musculus
ttggatatcccttcctgctgtatag

SEQ ID NO: 954599 - DNA, 25 bp, Mus musculus
ttggatatgctgatttccttggcct

SEQ ID NO: 954600 - DNA, 25 bp, Mus musculus
ttggatatgctgttttccttggcct

SEQ ID NO: 954601 - DNA, 25 bp, Mus musculus
ttggatatgcttatcagggacgctt

SEQ ID NO: 954602 - DNA, 25 bp, Mus musculus
ttggatatgcttttcagggacgctt

SEQ ID NO: 954603 - DNA, 25 bp, Mus musculus
ttggatatgtagattgtggtggctt

SEQ ID NO: 954604 - DNA, 25 bp, Mus musculus
ttggatatgtagtttgtggtggctt

SEQ ID NO: 954605 - DNA, 25 bp, Mus musculus
ttggatatgtgtcccgaaagccctg

SEQ ID NO: 954606 - DNA, 25 bp, Mus musculus
ttggatatgtgtgccgaaagccctg

SEQ ID NO: 954607 - DNA, 25 bp, Mus musculus
ttggatattccaagcttttttccta

SEQ ID NO: 954608 - DNA, 25 bp, Mus musculus
ttggatattccatgcttttttccta

SEQ ID NO: 954609 - DNA, 25 bp, Mus musculus
ttggatattttactggacataacca

SEQ ID NO: 954610 - DNA, 25 bp, Mus musculus
ttggatattttagtggacataacca

SEQ ID NO: 954611 - DNA, 25 bp, Mus musculus
ttggatcacactcaaagctgccctg

SEQ ID NO: 954612 - DNA, 25 bp, Mus musculus
ttggatcacactgaaagctgccctg

SEQ ID NO: 954613 - DNA, 25 bp, Mus musculus
ttggatcagcacagggccaccattt

SEQ ID NO: 954614 - DNA, 25 bp, Mus musculus
ttggatcagcactgggccaccattt

SEQ ID NO: 954615 - DNA, 25 bp, Mus musculus
ttggatcatcttatacactgccatc

SEQ ID NO: 954616 - DNA, 25 bp, Mus musculus
ttggatcatcttttacactgccatc

SEQ ID NO: 954617 - DNA, 25 bp, Mus musculus
ttggatcatttgataccccttttat

SEQ ID NO: 954618 - DNA, 25 bp, Mus musculus
ttggatcatttgttaccccttttat

SEQ ID NO: 954619 - DNA, 25 bp, Mus musculus
ttggatccagttacatattgcacat

SEQ ID NO: 954620 - DNA, 25 bp, Mus musculus
ttggatccagtttcatattgcacat

SEQ ID NO: 954621 - DNA, 25 bp, Mus musculus
ttggatccatacatcccttctttgc

SEQ ID NO: 954622 - DNA, 25 bp, Mus musculus
ttggatccatacttcccttctttgc

SEQ ID NO: 954623 - DNA, 25 bp, Mus musculus
ttggatccattgctcataggctcac

SEQ ID NO: 954624 - DNA, 25 bp, Mus musculus
ttggatccattggtcataggctcac

SEQ ID NO: 954625 - DNA, 25 bp, Mus musculus
ttggatccctagaaactggttaaat

SEQ ID NO: 954626 - DNA, 25 bp, Mus musculus
ttggatccctagaggacacatccag

SEQ ID NO: 954627 - DNA, 25 bp, Mus musculus
ttggatccctagtaactggttaaat

SEQ ID NO: 954628 - DNA, 25 bp, Mus musculus
ttggatccctagtggacacatccag

SEQ ID NO: 954629 - DNA, 25 bp, Mus musculus
ttggatccgggtcacacaggtgaca

SEQ ID NO: 954630 - DNA, 25 bp, Mus musculus
ttggatccgggtgacacaggtgaca

SEQ ID NO: 954631 - DNA, 25 bp, Mus musculus
ttggatcctcgtcccttcctagaat

SEQ ID NO: 954632 - DNA, 25 bp, Mus musculus
ttggatcctcgtgccttcctagaat

SEQ ID NO: 954633 - DNA, 25 bp, Mus musculus
ttggatcctgtgaccctctgggaag

SEQ ID NO: 954634 - DNA, 25 bp, Mus musculus
ttggatcctgtgtccctctgggaag

SEQ ID NO: 954635 - DNA, 25 bp, Mus musculus
ttggatcgctttctgcctcctagag

SEQ ID NO: 954636 - DNA, 25 bp, Mus musculus
ttggatcgctttgtgcctcctagag

SEQ ID NO: 954637 - DNA, 25 bp, Mus musculus
ttggatcggaggagaccctcctgtt

SEQ ID NO: 954638 - DNA, 25 bp, Mus musculus
ttggatcggaggtgaccctcctgtt

SEQ ID NO: 954639 - DNA, 25 bp, Mus musculus
ttggatctacagcatcagcccctca

SEQ ID NO: 954640 - DNA, 25 bp, Mus musculus
ttggatctacaggatcagcccctca

SEQ ID NO: 954641 - DNA, 25 bp, Mus musculus
ttggatctacatcttcaggagacaa

SEQ ID NO: 954642 - DNA, 25 bp, Mus musculus
ttggatctacatgttcaggagacaa

SEQ ID NO: 954643 - DNA, 25 bp, Mus musculus
ttggatctaggacatcctccccgta

SEQ ID NO: 954644 - DNA, 25 bp, Mus musculus
ttggatctaggagatcctccccgta

SEQ ID NO: 954645 - DNA, 25 bp, Mus musculus
ttggatctcagtcccaagacttgat

SEQ ID NO: 954646 - DNA, 25 bp, Mus musculus
ttggatctcagtgccaagacttgat

SEQ ID NO: 954647 - DNA, 25 bp, Mus musculus
ttggatctcccacggttcacccggt

SEQ ID NO: 954648 - DNA, 25 bp, Mus musculus
ttggatctcccagggttcacccggt

SEQ ID NO: 954649 - DNA, 25 bp, Mus musculus
ttggatctcctgaacttcggtcgtc

SEQ ID NO: 954650 - DNA, 25 bp, Mus musculus
ttggatctcctgtacttcggtcgtc

SEQ ID NO: 954651 - DNA, 25 bp, Mus musculus
ttggatctctttcaatatggtaata

SEQ ID NO: 954652 - DNA, 25 bp, Mus musculus
ttggatctctttgaatatggtaata

SEQ ID NO: 954653 - DNA, 25 bp, Mus musculus
ttggatctgagaagccagctgccct

SEQ ID NO: 954654 - DNA, 25 bp, Mus musculus
ttggatctgagatgccagctgccct

SEQ ID NO: 954655 - DNA, 25 bp, Mus musculus
ttggatctgtccactaagccctcac

SEQ ID NO: 954656 - DNA, 25 bp, Mus musculus
ttggatctgtcctctaagccctcac

SEQ ID NO: 954657 - DNA, 25 bp, Mus musculus
ttggatctgtgcagcggattcccat

SEQ ID NO: 954658 - DNA, 25 bp, Mus musculus
ttggatctgtgctgcggattcccat

SEQ ID NO: 954659 - DNA, 25 bp, Mus musculus
ttggatctgttcatagctgttgttt

SEQ ID NO: 954660 - DNA, 25 bp, Mus musculus
ttggatctgttcttagctgttgttt

SEQ ID NO: 954661 - DNA, 25 bp, Mus musculus
ttggatcttcttaaaagctgcgaac

SEQ ID NO: 954662 - DNA, 25 bp, Mus musculus
ttggatcttctttaaagctgcgaac

SEQ ID NO: 954663 - DNA, 25 bp, Mus musculus
ttggatcttgaaatgggcacagcct

SEQ ID NO: 954664 - DNA, 25 bp, Mus musculus
ttggatcttgaattgggcacagcct

SEQ ID NO: 954665 - DNA, 25 bp, Mus musculus
ttggatcttggactacccaggtgct

SEQ ID NO: 954666 - DNA, 25 bp, Mus musculus
ttggatcttggagtacccaggtgct

SEQ ID NO: 954667 - DNA, 25 bp, Mus musculus
ttggatctttttacgttgaacatat

SEQ ID NO: 954668 - DNA, 25 bp, Mus musculus
ttggatctttttcggaatacttttg

SEQ ID NO: 954669 - DNA, 25 bp, Mus musculus
ttggatctttttgggaatacttttg

SEQ ID NO: 954670 - DNA, 25 bp, Mus musculus
ttggatcttttttcgttgaacatat

SEQ ID NO: 954671 - DNA, 25 bp, Mus musculus
ttggatgaagatcaacctcggttcc

SEQ ID NO: 954672 - DNA, 25 bp, Mus musculus
ttggatgaagatgaacctcggttcc

SEQ ID NO: 954673 - DNA, 25 bp, Mus musculus
ttggatgacaaaactctgggtttca

SEQ ID NO: 954674 - DNA, 25 bp, Mus musculus
ttggatgacaaatctctgggtttca

SEQ ID NO: 954675 - DNA, 25 bp, Mus musculus
ttggatgacacaagtctggtccttt

SEQ ID NO: 954676 - DNA, 25 bp, Mus musculus
ttggatgacacatgtctggtccttt

SEQ ID NO: 954677 - DNA, 25 bp, Mus musculus
ttggatgaccatcgactgatcccca

SEQ ID NO: 954678 - DNA, 25 bp, Mus musculus
ttggatgaccatggactgatcccca

SEQ ID NO: 954679 - DNA, 25 bp, Mus musculus
ttggatgagagtcgctccctttgac

SEQ ID NO: 954680 - DNA, 25 bp, Mus musculus
ttggatgagagtggctccctttgac

SEQ ID NO: 954681 - DNA, 25 bp, Mus musculus
ttggatgatattacccaggccctgg

SEQ ID NO: 954682 - DNA, 25 bp, Mus musculus
ttggatgatatttcccaggccctgg

SEQ ID NO: 954683 - DNA, 25 bp, Mus musculus
ttggatgatgccaatgtgtttctat

SEQ ID NO: 954684 - DNA, 25 bp, Mus musculus
ttggatgatgcctatgtgtttctat

SEQ ID NO: 954685 - DNA, 25 bp, Mus musculus
ttggatgcaattctttataattaac

SEQ ID NO: 954686 - DNA, 25 bp, Mus musculus
ttggatgcaattgtttataattaac

SEQ ID NO: 954687 - DNA, 25 bp, Mus musculus
ttggatgcagccacagccgtacatt

SEQ ID NO: 954688 - DNA, 25 bp, Mus musculus
ttggatgcagccatacttcagactt

SEQ ID NO: 954689 - DNA, 25 bp, Mus musculus
ttggatgcagcctcagccgtacatt

SEQ ID NO: 954690 - DNA, 25 bp, Mus musculus
ttggatgcagccttacttcagactt

SEQ ID NO: 954691 - DNA, 25 bp, Mus musculus
ttggatgccaatcaccctgaaaata

SEQ ID NO: 954692 - DNA, 25 bp, Mus musculus
ttggatgccaatgaccctgaaaata

SEQ ID NO: 954693 - DNA, 25 bp, Mus musculus
ttggatgccttcagcactctggaaa

SEQ ID NO: 954694 - DNA, 25 bp, Mus musculus
ttggatgccttctgcactctggaaa

SEQ ID NO: 954695 - DNA, 25 bp, Mus musculus
ttggatggatgacccttacctgccc

SEQ ID NO: 954696 - DNA, 25 bp, Mus musculus
ttggatggatgagccttacctgccc

SEQ ID NO: 954697 - DNA, 25 bp, Mus musculus
ttggatggcaggaatccgtttcctt

SEQ ID NO: 954698 - DNA, 25 bp, Mus musculus
ttggatggcaggtatccgtttcctt

SEQ ID NO: 954699 - DNA, 25 bp, Mus musculus
ttggatggcattaaactggagttca

SEQ ID NO: 954700 - DNA, 25 bp, Mus musculus
ttggatggcatttaactggagttca

SEQ ID NO: 954701 - DNA, 25 bp, Mus musculus
ttggatggctccctccatgcactga

SEQ ID NO: 954702 - DNA, 25 bp, Mus musculus
ttggatggctccgtccatgcactga

SEQ ID NO: 954703 - DNA, 25 bp, Mus musculus
ttggatggctgacctcgagttcttc

SEQ ID NO: 954704 - DNA, 25 bp, Mus musculus
ttggatggctgagctcgagttcttc

SEQ ID NO: 954705 - DNA, 25 bp, Mus musculus
ttggatgggaaacacctccacctga

SEQ ID NO: 954706 - DNA, 25 bp, Mus musculus
ttggatgggaaagacctccacctga

SEQ ID NO: 954707 - DNA, 25 bp, Mus musculus
ttggatgggccacaattgttatact

SEQ ID NO: 954708 - DNA, 25 bp, Mus musculus
ttggatgggccagaattgttatact

SEQ ID NO: 954709 - DNA, 25 bp, Mus musculus
ttggatggttgacaagctgcagact

SEQ ID NO: 954710 - DNA, 25 bp, Mus musculus
ttggatggttgacctctgtactgcc

SEQ ID NO: 954711 - DNA, 25 bp, Mus musculus
ttggatggttgagaagctgcagact

SEQ ID NO: 954712 - DNA, 25 bp, Mus musculus
ttggatggttgagctctgtactgcc

SEQ ID NO: 954713 - DNA, 25 bp, Mus musculus
ttggatgtagatcttcgccgtacgc

SEQ ID NO: 954714 - DNA, 25 bp, Mus musculus
ttggatgtagatgttcgccgtacgc

SEQ ID NO: 954715 - DNA, 25 bp, Mus musculus
ttggatgtagttctgtttgtaagga

SEQ ID NO: 954716 - DNA, 25 bp, Mus musculus
ttggatgtagttgtgtttgtaagga

SEQ ID NO: 954717 - DNA, 25 bp, Mus musculus
ttggatgtatctaatcctcccttct

SEQ ID NO: 954718 - DNA, 25 bp, Mus musculus
ttggatgtatcttatcctcccttct

SEQ ID NO: 954719 - DNA, 25 bp, Mus musculus
ttggatgtcacacccattgatttct

SEQ ID NO: 954720 - DNA, 25 bp, Mus musculus
ttggatgtcacagccattgatttct

SEQ ID NO: 954721 - DNA, 25 bp, Mus musculus
ttggatgtccaaaagcaccctacta

SEQ ID NO: 954722 - DNA, 25 bp, Mus musculus
ttggatgtccaatagcaccctacta

SEQ ID NO: 954723 - DNA, 25 bp, Mus musculus
ttggatgtctcacctcttagttctt

SEQ ID NO: 954724 - DNA, 25 bp, Mus musculus
ttggatgtctcacttgctataagca

SEQ ID NO: 954725 - DNA, 25 bp, Mus musculus
ttggatgtctcagctcttagttctt

SEQ ID NO: 954726 - DNA, 25 bp, Mus musculus
ttggatgtctcagttgctataagca

SEQ ID NO: 954727 - DNA, 25 bp, Mus musculus
ttggatgtctccagctctatccgct

SEQ ID NO: 954728 - DNA, 25 bp, Mus musculus
ttggatgtctcctgctctatccgct

SEQ ID NO: 954729 - DNA, 25 bp, Mus musculus
ttggatgtgatgcacaaattcagag

SEQ ID NO: 954730 - DNA, 25 bp, Mus musculus
ttggatgtgatggacaaattcagag

SEQ ID NO: 954731 - DNA, 25 bp, Mus musculus
ttggatgtgcccatccgatatacaa

SEQ ID NO: 954732 - DNA, 25 bp, Mus musculus
ttggatgtgcccttccgatatacaa

SEQ ID NO: 954733 - DNA, 25 bp, Mus musculus
ttggatgtggagaggcctcaccttc

SEQ ID NO: 954734 - DNA, 25 bp, Mus musculus
ttggatgtggagtggcctcaccttc

SEQ ID NO: 954735 - DNA, 25 bp, Mus musculus
ttggatgttcttccctctgaaggta

SEQ ID NO: 954736 - DNA, 25 bp, Mus musculus
ttggatgttcttgcctctgaaggta

SEQ ID NO: 954737 - DNA, 25 bp, Mus musculus
ttggattatagtcagctcctccgga

SEQ ID NO: 954738 - DNA, 25 bp, Mus musculus
ttggattatagtgagctcctccgga

SEQ ID NO: 954739 - DNA, 25 bp, Mus musculus
ttggattatccaagcaaagagtaat

SEQ ID NO: 954740 - DNA, 25 bp, Mus musculus
ttggattatccatgcaaagagtaat

SEQ ID NO: 954741 - DNA, 25 bp, Mus musculus
ttggattcaaacaatgcgctggcac

SEQ ID NO: 954742 - DNA, 25 bp, Mus musculus
ttggattcaaactatgcgctggcac

SEQ ID NO: 954743 - DNA, 25 bp, Mus musculus
ttggattcaaagactgtgcctgctc

SEQ ID NO: 954744 - DNA, 25 bp, Mus musculus
ttggattcaaagtctgtgcctgctc

SEQ ID NO: 954745 - DNA, 25 bp, Mus musculus
ttggattcaagaagcttcctccctg

SEQ ID NO: 954746 - DNA, 25 bp, Mus musculus
ttggattcaagatgcttcctccctg

SEQ ID NO: 954747 - DNA, 25 bp, Mus musculus
ttggattcaagtagggtttcccgag

SEQ ID NO: 954748 - DNA, 25 bp, Mus musculus
ttggattcaagttgggtttcccgag

SEQ ID NO: 954749 - DNA, 25 bp, Mus musculus
ttggattcacatcagatgctctctc

SEQ ID NO: 954750 - DNA, 25 bp, Mus musculus
ttggattcacatgagatgctctctc

SEQ ID NO: 954751 - DNA, 25 bp, Mus musculus
ttggattcagaacccacttcggtgg

SEQ ID NO: 954752 - DNA, 25 bp, Mus musculus
ttggattcagaagccacttcggtgg

SEQ ID NO: 954753 - DNA, 25 bp, Mus musculus
ttggattcagtactgcagcagctcc

SEQ ID NO: 954754 - DNA, 25 bp, Mus musculus
ttggattcagtagtgcagcagctcc

SEQ ID NO: 954755 - DNA, 25 bp, Mus musculus
ttggattcatggctcagtacttaag

SEQ ID NO: 954756 - DNA, 25 bp, Mus musculus
ttggattcatgggtcagtacttaag

SEQ ID NO: 954757 - DNA, 25 bp, Mus musculus
ttggattcccagcactcgcataaaa

SEQ ID NO: 954758 - DNA, 25 bp, Mus musculus
ttggattcccagctgccaaagctgt

SEQ ID NO: 954759 - DNA, 25 bp, Mus musculus
ttggattcccaggactcgcataaaa

SEQ ID NO: 954760 - DNA, 25 bp, Mus musculus
ttggattcccaggtgccaaagctgt

SEQ ID NO: 954761 - DNA, 25 bp, Mus musculus
ttggattccctacccggcagcaggt

SEQ ID NO: 954762 - DNA, 25 bp, Mus musculus
ttggattccctagccggcagcaggt

SEQ ID NO: 954763 - DNA, 25 bp, Mus musculus
ttggattcctttacatctctaagaa

SEQ ID NO: 954764 - DNA, 25 bp, Mus musculus
ttggattccttttcatctctaagaa

SEQ ID NO: 954765 - DNA, 25 bp, Mus musculus
ttggattctgccacttaacagccat

SEQ ID NO: 954766 - DNA, 25 bp, Mus musculus
ttggattctgcctcttaacagccat

SEQ ID NO: 954767 - DNA, 25 bp, Mus musculus
ttggattctgggatcacatgcccat

SEQ ID NO: 954768 - DNA, 25 bp, Mus musculus
ttggattctgggttcacatgcccat

SEQ ID NO: 954769 - DNA, 25 bp, Mus musculus
ttggattgcaccattgttacctgca

SEQ ID NO: 954770 - DNA, 25 bp, Mus musculus
ttggattgcacctttgttacctgca

SEQ ID NO: 954771 - DNA, 25 bp, Mus musculus
ttggattgctctactgagtcagaca

SEQ ID NO: 954772 - DNA, 25 bp, Mus musculus
ttggattgctcttctgagtcagaca

SEQ ID NO: 954773 - DNA, 25 bp, Mus musculus
ttggattgtaatccctgctgggaat

SEQ ID NO: 954774 - DNA, 25 bp, Mus musculus
ttggattgtaatgcctgctgggaat

SEQ ID NO: 954775 - DNA, 25 bp, Mus musculus
ttggattgtctgaaccttgtgcttc

SEQ ID NO: 954776 - DNA, 25 bp, Mus musculus
ttggattgtctgtaccttgtgcttc

SEQ ID NO: 954777 - DNA, 25 bp, Mus musculus
ttggattgttgtattcgtctctgaa

SEQ ID NO: 954778 - DNA, 25 bp, Mus musculus
ttggattgttgttttcgtctctgaa

SEQ ID NO: 954779 - DNA, 25 bp, Mus musculus
ttggatttatggcagtccttgctct

SEQ ID NO: 954780 - DNA, 25 bp, Mus musculus
ttggatttatgggagtccttgctct

SEQ ID NO: 954781 - DNA, 25 bp, Mus musculus
ttggatttcaaacactaattaggct

SEQ ID NO: 954782 - DNA, 25 bp, Mus musculus
ttggatttcaaagactaattaggct

SEQ ID NO: 954783 - DNA, 25 bp, Mus musculus
ttggatttcccacagagccgagtaa

SEQ ID NO: 954784 - DNA, 25 bp, Mus musculus
ttggatttcccagagagccgagtaa

SEQ ID NO: 954785 - DNA, 25 bp, Mus musculus
ttggatttccccacatttgaataag

SEQ ID NO: 954786 - DNA, 25 bp, Mus musculus
ttggatttcccctcatttgaataag

SEQ ID NO: 954787 - DNA, 25 bp, Mus musculus
ttggatttcgatctctagccagagt

SEQ ID NO: 954788 - DNA, 25 bp, Mus musculus
ttggatttcgatgtctagccagagt

SEQ ID NO: 954789 - DNA, 25 bp, Mus musculus
ttggatttcgccctctatcatgtag

SEQ ID NO: 954790 - DNA, 25 bp, Mus musculus
ttggatttcgccgtctatcatgtag

SEQ ID NO: 954791 - DNA, 25 bp, Mus musculus
ttggatttgaacagctaaaatgaat

SEQ ID NO: 954792 - DNA, 25 bp, Mus musculus
ttggatttgaactgctaaaatgaat

SEQ ID NO: 954793 - DNA, 25 bp, Mus musculus
ttggatttgccaagtactacttcac

SEQ ID NO: 954794 - DNA, 25 bp, Mus musculus
ttggatttgccatgtactacttcac

SEQ ID NO: 954795 - DNA, 25 bp, Mus musculus
ttggatttggtaactgttccttaaa

SEQ ID NO: 954796 - DNA, 25 bp, Mus musculus
ttggatttggtatctgttccttaaa

SEQ ID NO: 954797 - DNA, 25 bp, Mus musculus
ttggatttgtttaattcttgttact

SEQ ID NO: 954798 - DNA, 25 bp, Mus musculus
ttggatttgttttattcttgttact

SEQ ID NO: 954799 - DNA, 25 bp, Mus musculus
ttggattttatcactagacttgggt

SEQ ID NO: 954800 - DNA, 25 bp, Mus musculus
ttggattttatctctagacttgggt

SEQ ID NO: 954801 - DNA, 25 bp, Mus musculus
ttggattttgtacactaatgcctgc

SEQ ID NO: 954802 - DNA, 25 bp, Mus musculus
ttggattttgtagactaatgcctgc

SEQ ID NO: 954803 - DNA, 25 bp, Mus musculus
ttggattttgtcacaccgactcctc

SEQ ID NO: 954804 - DNA, 25 bp, Mus musculus
ttggattttgtctcaccgactcctc

SEQ ID NO: 954805 - DNA, 25 bp, Mus musculus
ttggcaaaactcaagtcccaccatg

SEQ ID NO: 954806 - DNA, 25 bp, Mus musculus
ttggcaaaactctagtcccaccatg

SEQ ID NO: 954807 - DNA, 25 bp, Mus musculus
ttggcaaaagccagtcagttactca

SEQ ID NO: 954808 - DNA, 25 bp, Mus musculus
ttggcaaaagcctgtcagttactca

SEQ ID NO: 954809 - DNA, 25 bp, Mus musculus
ttggcaaactaccatccttttctaa

SEQ ID NO: 954810 - DNA, 25 bp, Mus musculus
ttggcaaactacgatccttttctaa

SEQ ID NO: 954811 - DNA, 25 bp, Mus musculus
ttggcaaactctccaacctgaagac

SEQ ID NO: 954812 - DNA, 25 bp, Mus musculus
ttggcaaactctgcaacctgaagac

SEQ ID NO: 954813 - DNA, 25 bp, Mus musculus
ttggcaaactgaacactcttaaaca

SEQ ID NO: 954814 - DNA, 25 bp, Mus musculus
ttggcaaactgatcactcttaaaca

SEQ ID NO: 954815 - DNA, 25 bp, Mus musculus
ttggcaaacttgcaaaattccaaat

SEQ ID NO: 954816 - DNA, 25 bp, Mus musculus
ttggcaaacttggaaaattccaaat

SEQ ID NO: 954817 - DNA, 25 bp, Mus musculus
ttggcaaagattaagtggccctctg

SEQ ID NO: 954818 - DNA, 25 bp, Mus musculus
ttggcaaagatttagtggccctctg

SEQ ID NO: 954819 - DNA, 25 bp, Mus musculus
ttggcaaagcaactttctggacagc

SEQ ID NO: 954820 - DNA, 25 bp, Mus musculus
ttggcaaagcaagtttctggacagc

SEQ ID NO: 954821 - DNA, 25 bp, Mus musculus
ttggcaaatcacacttgatcctgtt

SEQ ID NO: 954822 - DNA, 25 bp, Mus musculus
ttggcaaatcactcttgatcctgtt

SEQ ID NO: 954823 - DNA, 25 bp, Mus musculus
ttggcaaatgatacaagctggcccc

SEQ ID NO: 954824 - DNA, 25 bp, Mus musculus
ttggcaaatgattcaagctggcccc

SEQ ID NO: 954825 - DNA, 25 bp, Mus musculus
ttggcaacatgtaggaaagagcttt

SEQ ID NO: 954826 - DNA, 25 bp, Mus musculus
ttggcaacatgttggaaagagcttt

SEQ ID NO: 954827 - DNA, 25 bp, Mus musculus
ttggcaacatttatcaaattgaaga

SEQ ID NO: 954828 - DNA, 25 bp, Mus musculus
ttggcaacatttttcaaattgaaga

SEQ ID NO: 954829 - DNA, 25 bp, Mus musculus
ttggcaaccaggattgcaagcgtgc

SEQ ID NO: 954830 - DNA, 25 bp, Mus musculus
ttggcaaccaggtttgcaagcgtgc

SEQ ID NO: 954831 - DNA, 25 bp, Mus musculus
ttggcaaccatcagaggtgggaact

SEQ ID NO: 954832 - DNA, 25 bp, Mus musculus
ttggcaaccatctgaggtgggaact

SEQ ID NO: 954833 - DNA, 25 bp, Mus musculus
ttggcaacccctcatattctgggtc

SEQ ID NO: 954834 - DNA, 25 bp, Mus musculus
ttggcaacccctgatattctgggtc

SEQ ID NO: 954835 - DNA, 25 bp, Mus musculus
ttggcaacggccctcgccatggtta

SEQ ID NO: 954836 - DNA, 25 bp, Mus musculus
ttggcaacggccgtcgccatggtta

SEQ ID NO: 954837 - DNA, 25 bp, Mus musculus
ttggcaactgctcttgcataagcta

SEQ ID NO: 954838 - DNA, 25 bp, Mus musculus
ttggcaactgctgttgcataagcta

SEQ ID NO: 954839 - DNA, 25 bp, Mus musculus
ttggcaactgtgagtaacttcctcc

SEQ ID NO: 954840 - DNA, 25 bp, Mus musculus
ttggcaactgtgtgtaacttcctcc

SEQ ID NO: 954841 - DNA, 25 bp, Mus musculus
ttggcaagaccacgaccgggcatgt

SEQ ID NO: 954842 - DNA, 25 bp, Mus musculus
ttggcaagaccaggaccgggcatgt

SEQ ID NO: 954843 - DNA, 25 bp, Mus musculus
ttggcaagatgtaccactcctatgt

SEQ ID NO: 954844 - DNA, 25 bp, Mus musculus
ttggcaagatgtatgcagctcctgc

SEQ ID NO: 954845 - DNA, 25 bp, Mus musculus
ttggcaagatgttccactcctatgt

SEQ ID NO: 954846 - DNA, 25 bp, Mus musculus
ttggcaagatgtttgcagctcctgc

SEQ ID NO: 954847 - DNA, 25 bp, Mus musculus
ttggcaagcaccactctttcatgaa

SEQ ID NO: 954848 - DNA, 25 bp, Mus musculus
ttggcaagcacctctctttcatgaa

SEQ ID NO: 954849 - DNA, 25 bp, Mus musculus
ttggcaagccaaagtatcgctacat

SEQ ID NO: 954850 - DNA, 25 bp, Mus musculus
ttggcaagccaatgtatcgctacat

SEQ ID NO: 954851 - DNA, 25 bp, Mus musculus
ttggcaagccacaattatgggacct

SEQ ID NO: 954852 - DNA, 25 bp, Mus musculus
ttggcaagccactattatgggacct

SEQ ID NO: 954853 - DNA, 25 bp, Mus musculus
ttggcaagcctcaggataactgcta

SEQ ID NO: 954854 - DNA, 25 bp, Mus musculus
ttggcaagcctctggataactgcta

SEQ ID NO: 954855 - DNA, 25 bp, Mus musculus
ttggcaagctctcggcagggtcctc

SEQ ID NO: 954856 - DNA, 25 bp, Mus musculus
ttggcaagctctgggcagggtcctc

SEQ ID NO: 954857 - DNA, 25 bp, Mus musculus
ttggcaaggacaagcccacctatga

SEQ ID NO: 954858 - DNA, 25 bp, Mus musculus
ttggcaaggacatgcccacctatga

SEQ ID NO: 954859 - DNA, 25 bp, Mus musculus
ttggcaaggcccaggagcaactgga

SEQ ID NO: 954860 - DNA, 25 bp, Mus musculus
ttggcaaggcccatgtaaactggtt

SEQ ID NO: 954861 - DNA, 25 bp, Mus musculus
ttggcaaggccctggagcaactgga

SEQ ID NO: 954862 - DNA, 25 bp, Mus musculus
ttggcaaggcccttgtaaactggtt

SEQ ID NO: 954863 - DNA, 25 bp, Mus musculus
ttggcaataaaaccctgactgttgt

SEQ ID NO: 954864 - DNA, 25 bp, Mus musculus
ttggcaataaaagcctgactgttgt

SEQ ID NO: 954865 - DNA, 25 bp, Mus musculus
ttggcaataacgatttttcagcata

SEQ ID NO: 954866 - DNA, 25 bp, Mus musculus
ttggcaataacgttttttcagcata

SEQ ID NO: 954867 - DNA, 25 bp, Mus musculus
ttggcaatgatgagcaccacccgac

SEQ ID NO: 954868 - DNA, 25 bp, Mus musculus
ttggcaatgatgtgcaccacccgac

SEQ ID NO: 954869 - DNA, 25 bp, Mus musculus
ttggcaatgccactgtaagcccaca

SEQ ID NO: 954870 - DNA, 25 bp, Mus musculus
ttggcaatgccagtgtaagcccaca

SEQ ID NO: 954871 - DNA, 25 bp, Mus musculus
ttggcaattacaacaatcagtcttc

SEQ ID NO: 954872 - DNA, 25 bp, Mus musculus
ttggcaattacatcaatcagtcttc

SEQ ID NO: 954873 - DNA, 25 bp, Mus musculus
ttggcaattcaaaatcctagcactt

SEQ ID NO: 954874 - DNA, 25 bp, Mus musculus
ttggcaattcaatatcctagcactt

SEQ ID NO: 954875 - DNA, 25 bp, Mus musculus
ttggcaattcgaatcacccttaaca

SEQ ID NO: 954876 - DNA, 25 bp, Mus musculus
ttggcaattcgattcacccttaaca

SEQ ID NO: 954877 - DNA, 25 bp, Mus musculus
ttggcaatttgactttatcctagta

SEQ ID NO: 954878 - DNA, 25 bp, Mus musculus
ttggcaatttgagtttatcctagta

SEQ ID NO: 954879 - DNA, 25 bp, Mus musculus
ttggcaatttttacggagcaccagg

SEQ ID NO: 954880 - DNA, 25 bp, Mus musculus
ttggcaattttttcggagcaccagg

SEQ ID NO: 954881 - DNA, 25 bp, Mus musculus
ttggcacaaacaacccatttccttc

SEQ ID NO: 954882 - DNA, 25 bp, Mus musculus
ttggcacaaacacccaaacactgcg

SEQ ID NO: 954883 - DNA, 25 bp, Mus musculus
ttggcacaaacagccaaacactgcg

SEQ ID NO: 954884 - DNA, 25 bp, Mus musculus
ttggcacaaacatcccatttccttc

SEQ ID NO: 954885 - DNA, 25 bp, Mus musculus
ttggcacaaattagccttgggctgt

SEQ ID NO: 954886 - DNA, 25 bp, Mus musculus
ttggcacaaatttgccttgggctgt

SEQ ID NO: 954887 - DNA, 25 bp, Mus musculus
ttggcacacaagagtaatacacctt

SEQ ID NO: 954888 - DNA, 25 bp, Mus musculus
ttggcacacaagtgtaatacacctt

SEQ ID NO: 954889 - DNA, 25 bp, Mus musculus
ttggcacactacacaatttcatgtt

SEQ ID NO: 954890 - DNA, 25 bp, Mus musculus
ttggcacactactcaatttcatgtt

SEQ ID NO: 954891 - DNA, 25 bp, Mus musculus
ttggcacactgtatgctccatatgc

SEQ ID NO: 954892 - DNA, 25 bp, Mus musculus
ttggcacactgtttgctccatatgc

SEQ ID NO: 954893 - DNA, 25 bp, Mus musculus
ttggcacagggccaaggtctctatc

SEQ ID NO: 954894 - DNA, 25 bp, Mus musculus
ttggcacagggcgaaggtctctatc

SEQ ID NO: 954895 - DNA, 25 bp, Mus musculus
ttggcacataggagaggctgtcatt

SEQ ID NO: 954896 - DNA, 25 bp, Mus musculus
ttggcacataggtgaggctgtcatt

SEQ ID NO: 954897 - DNA, 25 bp, Mus musculus
ttggcacatatccacttgccctctt

SEQ ID NO: 954898 - DNA, 25 bp, Mus musculus
ttggcacatatcgacttgccctctt

SEQ ID NO: 954899 - DNA, 25 bp, Mus musculus
ttggcacattttatactgagcagca

SEQ ID NO: 954900 - DNA, 25 bp, Mus musculus
ttggcacattttttactgagcagca

SEQ ID NO: 954901 - DNA, 25 bp, Mus musculus
ttggcaccaaagcacactttagccc

SEQ ID NO: 954902 - DNA, 25 bp, Mus musculus
ttggcaccaaaggacactttagccc

SEQ ID NO: 954903 - DNA, 25 bp, Mus musculus
ttggcaccagctcgcagcctgaatc

SEQ ID NO: 954904 - DNA, 25 bp, Mus musculus
ttggcaccagctggcagcctgaatc

SEQ ID NO: 954905 - DNA, 25 bp, Mus musculus
ttggcaccatagctgcctggaagcc

SEQ ID NO: 954906 - DNA, 25 bp, Mus musculus
ttggcaccataggtgcctggaagcc

SEQ ID NO: 954907 - DNA, 25 bp, Mus musculus
ttggcaccatggacacagctcagcg

SEQ ID NO: 954908 - DNA, 25 bp, Mus musculus
ttggcaccatggtcacagctcagcg

SEQ ID NO: 954909 - DNA, 25 bp, Mus musculus
ttggcaccattacattccactcgtg

SEQ ID NO: 954910 - DNA, 25 bp, Mus musculus
ttggcaccattagattccactcgtg

SEQ ID NO: 954911 - DNA, 25 bp, Mus musculus
ttggcaccccacagtctcagcttgg

SEQ ID NO: 954912 - DNA, 25 bp, Mus musculus
ttggcaccccactgtctcagcttgg

SEQ ID NO: 954913 - DNA, 25 bp, Mus musculus
ttggcacccgtacaagttttggaat

SEQ ID NO: 954914 - DNA, 25 bp, Mus musculus
ttggcacccgtagaagttttggaat

SEQ ID NO: 954915 - DNA, 25 bp, Mus musculus
ttggcaccctgtacggcaacgtgtt

SEQ ID NO: 954916 - DNA, 25 bp, Mus musculus
ttggcaccctgttcggcaacgtgtt

SEQ ID NO: 954917 - DNA, 25 bp, Mus musculus
ttggcaccgactcttagcaagcttt

SEQ ID NO: 954918 - DNA, 25 bp, Mus musculus
ttggcaccgactgttagcaagcttt

SEQ ID NO: 954919 - DNA, 25 bp, Mus musculus
ttggcaccgtaccttaacctgcagt

SEQ ID NO: 954920 - DNA, 25 bp, Mus musculus
ttggcaccgtacgttaacctgcagt

SEQ ID NO: 954921 - DNA, 25 bp, Mus musculus
ttggcaccgtcgagggcagtgacct

SEQ ID NO: 954922 - DNA, 25 bp, Mus musculus
ttggcaccgtcgtgggcagtgacct

SEQ ID NO: 954923 - DNA, 25 bp, Mus musculus
ttggcacctagtcttcattctggga

SEQ ID NO: 954924 - DNA, 25 bp, Mus musculus
ttggcacctagtgttcattctggga

SEQ ID NO: 954925 - DNA, 25 bp, Mus musculus
ttggcacctcaccatgctgtagaaa

SEQ ID NO: 954926 - DNA, 25 bp, Mus musculus
ttggcacctcacgatgctgtagaaa

SEQ ID NO: 954927 - DNA, 25 bp, Mus musculus
ttggcacctcatctcagtggatcat

SEQ ID NO: 954928 - DNA, 25 bp, Mus musculus
ttggcacctcatgtcagtggatcat

SEQ ID NO: 954929 - DNA, 25 bp, Mus musculus
ttggcacctcgacttgtggctgagc

SEQ ID NO: 954930 - DNA, 25 bp, Mus musculus
ttggcacctcgagttgtggctgagc

SEQ ID NO: 954931 - DNA, 25 bp, Mus musculus
ttggcacctgctatgttctatcatc

SEQ ID NO: 954932 - DNA, 25 bp, Mus musculus
ttggcacctgctttgttctatcatc

SEQ ID NO: 954933 - DNA, 25 bp, Mus musculus
ttggcaccttatctcatactctcaa

SEQ ID NO: 954934 - DNA, 25 bp, Mus musculus
ttggcaccttatgtcatactctcaa

SEQ ID NO: 954935 - DNA, 25 bp, Mus musculus
ttggcacgaatcataaggcccctgt

SEQ ID NO: 954936 - DNA, 25 bp, Mus musculus
ttggcacgaatcttaaggcccctgt

SEQ ID NO: 954937 - DNA, 25 bp, Mus musculus
ttggcacgtccacagttctttgtca

SEQ ID NO: 954938 - DNA, 25 bp, Mus musculus
ttggcacgtccagagttctttgtca

SEQ ID NO: 954939 - DNA, 25 bp, Mus musculus
ttggcactcagccttcagttttaga

SEQ ID NO: 954940 - DNA, 25 bp, Mus musculus
ttggcactcagcgttcagttttaga

SEQ ID NO: 954941 - DNA, 25 bp, Mus musculus
ttggcactcatcacatgcaagacat

SEQ ID NO: 954942 - DNA, 25 bp, Mus musculus
ttggcactcatctcatgcaagacat

SEQ ID NO: 954943 - DNA, 25 bp, Mus musculus
ttggcactcatgactttgactttca

SEQ ID NO: 954944 - DNA, 25 bp, Mus musculus
ttggcactcatgtctttgactttca

SEQ ID NO: 954945 - DNA, 25 bp, Mus musculus
ttggcactccaaaggctctgggctt

SEQ ID NO: 954946 - DNA, 25 bp, Mus musculus
ttggcactccaatggctctgggctt

SEQ ID NO: 954947 - DNA, 25 bp, Mus musculus
ttggcactgacaccgtcctggcgct

SEQ ID NO: 954948 - DNA, 25 bp, Mus musculus
ttggcactgacagcgtcctggcgct

SEQ ID NO: 954949 - DNA, 25 bp, Mus musculus
ttggcactgcagacacctgcgttca

SEQ ID NO: 954950 - DNA, 25 bp, Mus musculus
ttggcactgcagtcacctgcgttca

SEQ ID NO: 954951 - DNA, 25 bp, Mus musculus
ttggcactgcttctctgacagtaga

SEQ ID NO: 954952 - DNA, 25 bp, Mus musculus
ttggcactgcttgtctgacagtaga

SEQ ID NO: 954953 - DNA, 25 bp, Mus musculus
ttggcactggatattatcctggagt

SEQ ID NO: 954954 - DNA, 25 bp, Mus musculus
ttggcactggattttatcctggagt

SEQ ID NO: 954955 - DNA, 25 bp, Mus musculus
ttggcactgtgtactacataacttt

SEQ ID NO: 954956 - DNA, 25 bp, Mus musculus
ttggcactgtgttctacataacttt

SEQ ID NO: 954957 - DNA, 25 bp, Mus musculus
ttggcacttatacgtaacgtgattg

SEQ ID NO: 954958 - DNA, 25 bp, Mus musculus
ttggcacttataggtaacgtgattg

SEQ ID NO: 954959 - DNA, 25 bp, Mus musculus
ttggcactttacacgttactgtcac

SEQ ID NO: 954960 - DNA, 25 bp, Mus musculus
ttggcactttactcgttactgtcac

SEQ ID NO: 954961 - DNA, 25 bp, Mus musculus
ttggcactttttagactagggtaag

SEQ ID NO: 954962 - DNA, 25 bp, Mus musculus
ttggcacttttttgactagggtaag

SEQ ID NO: 954963 - DNA, 25 bp, Mus musculus
ttggcagaaagacttcatcaggctt

SEQ ID NO: 954964 - DNA, 25 bp, Mus musculus
ttggcagaaagagttcatcaggctt

SEQ ID NO: 954965 - DNA, 25 bp, Mus musculus
ttggcagacacaacccaagtctatt

SEQ ID NO: 954966 - DNA, 25 bp, Mus musculus
ttggcagacacaatggctgctctca

SEQ ID NO: 954967 - DNA, 25 bp, Mus musculus
ttggcagacacatcccaagtctatt

SEQ ID NO: 954968 - DNA, 25 bp, Mus musculus
ttggcagacacattggctgctctca

SEQ ID NO: 954969 - DNA, 25 bp, Mus musculus
ttggcagacgccagcctgtcatggt

SEQ ID NO: 954970 - DNA, 25 bp, Mus musculus
ttggcagacgcctgcctgtcatggt

SEQ ID NO: 954971 - DNA, 25 bp, Mus musculus
ttggcagactctatcttcattgtag

SEQ ID NO: 954972 - DNA, 25 bp, Mus musculus
ttggcagactctttcttcattgtag

SEQ ID NO: 954973 - DNA, 25 bp, Mus musculus
ttggcagagcacaggacagtttgga

SEQ ID NO: 954974 - DNA, 25 bp, Mus musculus
ttggcagagcactggacagtttgga

SEQ ID NO: 954975 - DNA, 25 bp, Mus musculus
ttggcagagcggagctgtttgaccc

SEQ ID NO: 954976 - DNA, 25 bp, Mus musculus
ttggcagagcggtgctgtttgaccc

SEQ ID NO: 954977 - DNA, 25 bp, Mus musculus
ttggcagagttaagaagccctgggt

SEQ ID NO: 954978 - DNA, 25 bp, Mus musculus
ttggcagagttatgaagccctgggt

SEQ ID NO: 954979 - DNA, 25 bp, Mus musculus
ttggcagattgcagcaggaagagct

SEQ ID NO: 954980 - DNA, 25 bp, Mus musculus
ttggcagattgctgcaggaagagct

SEQ ID NO: 954981 - DNA, 25 bp, Mus musculus
ttggcagattgtcccaggcgatcct

SEQ ID NO: 954982 - DNA, 25 bp, Mus musculus
ttggcagattgtgccaggcgatcct

SEQ ID NO: 954983 - DNA, 25 bp, Mus musculus
ttggcagcacacacgaagcgtggtt

SEQ ID NO: 954984 - DNA, 25 bp, Mus musculus
ttggcagcacactcgaagcgtggtt

SEQ ID NO: 954985 - DNA, 25 bp, Mus musculus
ttggcagcacatcctccatctgtaa

SEQ ID NO: 954986 - DNA, 25 bp, Mus musculus
ttggcagcacatgctccatctgtaa

SEQ ID NO: 954987 - DNA, 25 bp, Mus musculus
ttggcagcacccacatcctcttgtt

SEQ ID NO: 954988 - DNA, 25 bp, Mus musculus
ttggcagcaccctcatcctcttgtt

SEQ ID NO: 954989 - DNA, 25 bp, Mus musculus
ttggcagcagaactctcaggccttt

SEQ ID NO: 954990 - DNA, 25 bp, Mus musculus
ttggcagcagaagtctcaggccttt

SEQ ID NO: 954991 - DNA, 25 bp, Mus musculus
ttggcagcaggactgagcagcacca

SEQ ID NO: 954992 - DNA, 25 bp, Mus musculus
ttggcagcaggagtgagcagcacca

SEQ ID NO: 954993 - DNA, 25 bp, Mus musculus
ttggcagcatcgattccttgagtta

SEQ ID NO: 954994 - DNA, 25 bp, Mus musculus
ttggcagcatcgtttccttgagtta

SEQ ID NO: 954995 - DNA, 25 bp, Mus musculus
ttggcagccacaaccgagaggacta

SEQ ID NO: 954996 - DNA, 25 bp, Mus musculus
ttggcagccacatccgagaggacta

SEQ ID NO: 954997 - DNA, 25 bp, Mus musculus
ttggcagcccctcatgcataaagat

SEQ ID NO: 954998 - DNA, 25 bp, Mus musculus
ttggcagcccctgatgcataaagat

SEQ ID NO: 954999 - DNA, 25 bp, Mus musculus
ttggcagcctggagggtcagacact

SEQ ID NO: 955000 - DNA, 25 bp, Mus musculus
ttggcagcctggtgggtcagacact

SEQ ID NO: 955001 - DNA, 25 bp, Mus musculus
ttggcagccttcaaagggaactctt

SEQ ID NO: 955002 - DNA, 25 bp, Mus musculus
ttggcagccttctaagggaactctt

SEQ ID NO: 955003 - DNA, 25 bp, Mus musculus
ttggcagccttgagtagctcccggt

SEQ ID NO: 955004 - DNA, 25 bp, Mus musculus
ttggcagccttgtgtagctcccggt

SEQ ID NO: 955005 - DNA, 25 bp, Mus musculus
ttggcagcgctgcatattggcacaa

SEQ ID NO: 955006 - DNA, 25 bp, Mus musculus
ttggcagcgctggatattggcacaa

SEQ ID NO: 955007 - DNA, 25 bp, Mus musculus
ttggcagctcttcactggtacaatt

SEQ ID NO: 955008 - DNA, 25 bp, Mus musculus
ttggcagctcttgactggtacaatt

SEQ ID NO: 955009 - DNA, 25 bp, Mus musculus
ttggcagctgcaatacccaggctct

SEQ ID NO: 955010 - DNA, 25 bp, Mus musculus
ttggcagctgcattacccaggctct

SEQ ID NO: 955011 - DNA, 25 bp, Mus musculus
ttggcagctgccaacttaaggaagc

SEQ ID NO: 955012 - DNA, 25 bp, Mus musculus
ttggcagctgccacttttggattct

SEQ ID NO: 955013 - DNA, 25 bp, Mus musculus
ttggcagctgcctacttaaggaagc

SEQ ID NO: 955014 - DNA, 25 bp, Mus musculus
ttggcagctgcctcttttggattct

SEQ ID NO: 955015 - DNA, 25 bp, Mus musculus
ttggcagcttctaaatggacctcct

SEQ ID NO: 955016 - DNA, 25 bp, Mus musculus
ttggcagcttcttaatggacctcct

SEQ ID NO: 955017 - DNA, 25 bp, Mus musculus
ttggcaggaaatcacttccctgctt

SEQ ID NO: 955018 - DNA, 25 bp, Mus musculus
ttggcaggaaatgacttccctgctt

SEQ ID NO: 955019 - DNA, 25 bp, Mus musculus
ttggcaggaatgcacttcctccaga

SEQ ID NO: 955020 - DNA, 25 bp, Mus musculus
ttggcaggaatggacttcctccaga

SEQ ID NO: 955021 - DNA, 25 bp, Mus musculus
ttggcaggagccacatttgcagtga

SEQ ID NO: 955022 - DNA, 25 bp, Mus musculus
ttggcaggagcctcatttgcagtga

SEQ ID NO: 955023 - DNA, 25 bp, Mus musculus
ttggcaggatctacttctttctgac

SEQ ID NO: 955024 - DNA, 25 bp, Mus musculus
ttggcaggatcttcttctttctgac

SEQ ID NO: 955025 - DNA, 25 bp, Mus musculus
ttggcaggcatgcaacaaaatggct

SEQ ID NO: 955026 - DNA, 25 bp, Mus musculus
ttggcaggcatggaacaaaatggct

SEQ ID NO: 955027 - DNA, 25 bp, Mus musculus
ttggcaggccaaaggaacacctctt

SEQ ID NO: 955028 - DNA, 25 bp, Mus musculus
ttggcaggccaatggaacacctctt

SEQ ID NO: 955029 - DNA, 25 bp, Mus musculus
ttggcaggcgatccttccataccat

SEQ ID NO: 955030 - DNA, 25 bp, Mus musculus
ttggcaggcgatgcttccataccat

SEQ ID NO: 955031 - DNA, 25 bp, Mus musculus
ttggcaggcgctaaagtttctttgc

SEQ ID NO: 955032 - DNA, 25 bp, Mus musculus
ttggcaggcgcttaagtttctttgc

SEQ ID NO: 955033 - DNA, 25 bp, Mus musculus
ttggcaggctccagataaccatgct

SEQ ID NO: 955034 - DNA, 25 bp, Mus musculus
ttggcaggctcctgataaccatgct

SEQ ID NO: 955035 - DNA, 25 bp, Mus musculus
ttggcagggacaccagcccttcttg

SEQ ID NO: 955036 - DNA, 25 bp, Mus musculus
ttggcagggacagcagcccttcttg

SEQ ID NO: 955037 - DNA, 25 bp, Mus musculus
ttggcagggctgcttatgctttaag

SEQ ID NO: 955038 - DNA, 25 bp, Mus musculus
ttggcagggctggttatgctttaag

SEQ ID NO: 955039 - DNA, 25 bp, Mus musculus
ttggcagggtatcgttcccagacat

SEQ ID NO: 955040 - DNA, 25 bp, Mus musculus
ttggcagggtatggttcccagacat

SEQ ID NO: 955041 - DNA, 25 bp, Mus musculus
ttggcagggtgcaggccctcttctg

SEQ ID NO: 955042 - DNA, 25 bp, Mus musculus
ttggcagggtgctggccctcttctg

SEQ ID NO: 955043 - DNA, 25 bp, Mus musculus
ttggcaggttctaggaggtgcttcc

SEQ ID NO: 955044 - DNA, 25 bp, Mus musculus
ttggcaggttcttggaggtgcttcc

SEQ ID NO: 955045 - DNA, 25 bp, Mus musculus
ttggcagtacctacatggcggccac

SEQ ID NO: 955046 - DNA, 25 bp, Mus musculus
ttggcagtaccttcatggcggccac

SEQ ID NO: 955047 - DNA, 25 bp, Mus musculus
ttggcagtactgacagtgccttctc

SEQ ID NO: 955048 - DNA, 25 bp, Mus musculus
ttggcagtactgtcagtgccttctc

SEQ ID NO: 955049 - DNA, 25 bp, Mus musculus
ttggcagtagccctcattagatgtg

SEQ ID NO: 955050 - DNA, 25 bp, Mus musculus
ttggcagtagccgtcattagatgtg

SEQ ID NO: 955051 - DNA, 25 bp, Mus musculus
ttggcagtcctacggtcacatcagt

SEQ ID NO: 955052 - DNA, 25 bp, Mus musculus
ttggcagtcctagggtcacatcagt

SEQ ID NO: 955053 - DNA, 25 bp, Mus musculus
ttggcagtcgaaaacctgcactggt

SEQ ID NO: 955054 - DNA, 25 bp, Mus musculus
ttggcagtcgaatacctgcactggt

SEQ ID NO: 955055 - DNA, 25 bp, Mus musculus
ttggcagtgaccactgtcccatcac

SEQ ID NO: 955056 - DNA, 25 bp, Mus musculus
ttggcagtgacctctgtcccatcac

SEQ ID NO: 955057 - DNA, 25 bp, Mus musculus
ttggcagtgacgaggtcgcccagtt

SEQ ID NO: 955058 - DNA, 25 bp, Mus musculus
ttggcagtgacgtggtcgcccagtt

SEQ ID NO: 955059 - DNA, 25 bp, Mus musculus
ttggcagtgaggcagcatccccaat

SEQ ID NO: 955060 - DNA, 25 bp, Mus musculus
ttggcagtgagggagcatccccaat

SEQ ID NO: 955061 - DNA, 25 bp, Mus musculus
ttggcagtgccaactcttcgtgatc

SEQ ID NO: 955062 - DNA, 25 bp, Mus musculus
ttggcagtgccaatggcctctttgg

SEQ ID NO: 955063 - DNA, 25 bp, Mus musculus
ttggcagtgccacctacaaaactcg

SEQ ID NO: 955064 - DNA, 25 bp, Mus musculus
ttggcagtgccagctacaaaactcg

SEQ ID NO: 955065 - DNA, 25 bp, Mus musculus
ttggcagtgccatctcttcgtgatc

SEQ ID NO: 955066 - DNA, 25 bp, Mus musculus
ttggcagtgccattggcctctttgg

SEQ ID NO: 955067 - DNA, 25 bp, Mus musculus
ttggcagtggagcttcctgtgctct

SEQ ID NO: 955068 - DNA, 25 bp, Mus musculus
ttggcagtggaggttcctgtgctct

SEQ ID NO: 955069 - DNA, 25 bp, Mus musculus
ttggcagtgggtatcctgtcaacaa

SEQ ID NO: 955070 - DNA, 25 bp, Mus musculus
ttggcagtgggtttcctgtcaacaa

SEQ ID NO: 955071 - DNA, 25 bp, Mus musculus
ttggcataccggctaatggcacccc

SEQ ID NO: 955072 - DNA, 25 bp, Mus musculus
ttggcataccgggtaatggcacccc

SEQ ID NO: 955073 - DNA, 25 bp, Mus musculus
ttggcatacttgctgtcatgtgctt

SEQ ID NO: 955074 - DNA, 25 bp, Mus musculus
ttggcatacttggtgtcatgtgctt

SEQ ID NO: 955075 - DNA, 25 bp, Mus musculus
ttggcatatgcccatcatcccaaca

SEQ ID NO: 955076 - DNA, 25 bp, Mus musculus
ttggcatatgccgatcatcccaaca

SEQ ID NO: 955077 - DNA, 25 bp, Mus musculus
ttggcatattttaaatccctaactg

SEQ ID NO: 955078 - DNA, 25 bp, Mus musculus
ttggcatatttttaatccctaactg

SEQ ID NO: 955079 - DNA, 25 bp, Mus musculus
ttggcatcagcaaccattccggaag

SEQ ID NO: 955080 - DNA, 25 bp, Mus musculus
ttggcatcagcatccattccggaag

SEQ ID NO: 955081 - DNA, 25 bp, Mus musculus
ttggcatcatagctttggcctgttc

SEQ ID NO: 955082 - DNA, 25 bp, Mus musculus
ttggcatcataggtttggcctgttc

SEQ ID NO: 955083 - DNA, 25 bp, Mus musculus
ttggcatcatccacagtcacttctt

SEQ ID NO: 955084 - DNA, 25 bp, Mus musculus
ttggcatcatcctcagtcacttctt

SEQ ID NO: 955085 - DNA, 25 bp, Mus musculus
ttggcatccaacatgtccgaggctg

SEQ ID NO: 955086 - DNA, 25 bp, Mus musculus
ttggcatccaacttgtccgaggctg

SEQ ID NO: 955087 - DNA, 25 bp, Mus musculus
ttggcatccagcatctgctaaacaa

SEQ ID NO: 955088 - DNA, 25 bp, Mus musculus
ttggcatccagcttctgctaaacaa

SEQ ID NO: 955089 - DNA, 25 bp, Mus musculus
ttggcatccatgctgttgacagtac

SEQ ID NO: 955090 - DNA, 25 bp, Mus musculus
ttggcatccatggtgttgacagtac

SEQ ID NO: 955091 - DNA, 25 bp, Mus musculus
ttggcatccattccctttttataat

SEQ ID NO: 955092 - DNA, 25 bp, Mus musculus
ttggcatccattgcctttttataat

SEQ ID NO: 955093 - DNA, 25 bp, Mus musculus
ttggcatcccaacctgagaatgatt

SEQ ID NO: 955094 - DNA, 25 bp, Mus musculus
ttggcatcccaagctgagaatgatt

SEQ ID NO: 955095 - DNA, 25 bp, Mus musculus
ttggcatcccagctggctaatggca

SEQ ID NO: 955096 - DNA, 25 bp, Mus musculus
ttggcatcccaggtggctaatggca

SEQ ID NO: 955097 - DNA, 25 bp, Mus musculus
ttggcatccccgctgaaggcaaagg

SEQ ID NO: 955098 - DNA, 25 bp, Mus musculus
ttggcatccccggtgaaggcaaagg

SEQ ID NO: 955099 - DNA, 25 bp, Mus musculus
ttggcatccgagcaaaaagggcgaa

SEQ ID NO: 955100 - DNA, 25 bp, Mus musculus
ttggcatccgaggaaaaagggcgaa

SEQ ID NO: 955101 - DNA, 25 bp, Mus musculus
ttggcatccgtcatgtggagagctt

SEQ ID NO: 955102 - DNA, 25 bp, Mus musculus
ttggcatccgtcttgtggagagctt

SEQ ID NO: 955103 - DNA, 25 bp, Mus musculus
ttggcatcctcaccagagtgaagtc

SEQ ID NO: 955104 - DNA, 25 bp, Mus musculus
ttggcatcctcagcagagtgaagtc

SEQ ID NO: 955105 - DNA, 25 bp, Mus musculus
ttggcatcctctcggacatatcctc

SEQ ID NO: 955106 - DNA, 25 bp, Mus musculus
ttggcatcctctgggacatatcctc

SEQ ID NO: 955107 - DNA, 25 bp, Mus musculus
ttggcatcgtcgacttgtctgtttt

SEQ ID NO: 955108 - DNA, 25 bp, Mus musculus
ttggcatcgtcgtcttgtctgtttt

SEQ ID NO: 955109 - DNA, 25 bp, Mus musculus
ttggcatcgtggacagtgatcctga

SEQ ID NO: 955110 - DNA, 25 bp, Mus musculus
ttggcatcgtggtcagtgatcctga

SEQ ID NO: 955111 - DNA, 25 bp, Mus musculus
ttggcatctaatatgctctcctggg

SEQ ID NO: 955112 - DNA, 25 bp, Mus musculus
ttggcatctaatttgctctcctggg

SEQ ID NO: 955113 - DNA, 25 bp, Mus musculus
ttggcatctactattcacatgggaa

SEQ ID NO: 955114 - DNA, 25 bp, Mus musculus
ttggcatctacttttcacatgggaa

SEQ ID NO: 955115 - DNA, 25 bp, Mus musculus
ttggcatctataaggctgacattcc

SEQ ID NO: 955116 - DNA, 25 bp, Mus musculus
ttggcatctatatggctgacattcc

SEQ ID NO: 955117 - DNA, 25 bp, Mus musculus
ttggcatctctgaggagcctctgcg

SEQ ID NO: 955118 - DNA, 25 bp, Mus musculus
ttggcatctctgtggagcctctgcg

SEQ ID NO: 955119 - DNA, 25 bp, Mus musculus
ttggcatctggcacttgggacaaga

SEQ ID NO: 955120 - DNA, 25 bp, Mus musculus
ttggcatctggctcttgggacaaga

SEQ ID NO: 955121 - DNA, 25 bp, Mus musculus
ttggcatctgtaatgatagttcaaa

SEQ ID NO: 955122 - DNA, 25 bp, Mus musculus
ttggcatctgtattgatagttcaaa

SEQ ID NO: 955123 - DNA, 25 bp, Mus musculus
ttggcatcttgcacacttgtttata

SEQ ID NO: 955124 - DNA, 25 bp, Mus musculus
ttggcatcttgctcacttgtttata

SEQ ID NO: 955125 - DNA, 25 bp, Mus musculus
ttggcatcttgtatctttaatatga

SEQ ID NO: 955126 - DNA, 25 bp, Mus musculus
ttggcatcttgtttctttaatatga

SEQ ID NO: 955127 - DNA, 25 bp, Mus musculus
ttggcatgaacaaacctgcaggttt

SEQ ID NO: 955128 - DNA, 25 bp, Mus musculus
ttggcatgaacatacctgcaggttt

SEQ ID NO: 955129 - DNA, 25 bp, Mus musculus
ttggcatgaccaaggctgacctcat

SEQ ID NO: 955130 - DNA, 25 bp, Mus musculus
ttggcatgaccatggctgacctcat

SEQ ID NO: 955131 - DNA, 25 bp, Mus musculus
ttggcatgcacccagctcaagatgc

SEQ ID NO: 955132 - DNA, 25 bp, Mus musculus
ttggcatgcaccgagctcaagatgc

SEQ ID NO: 955133 - DNA, 25 bp, Mus musculus
ttggcatgcccaagtgtcccataag

SEQ ID NO: 955134 - DNA, 25 bp, Mus musculus
ttggcatgcccatgtgtcccataag

SEQ ID NO: 955135 - DNA, 25 bp, Mus musculus
ttggcatgcgtcagtgcttacctga

SEQ ID NO: 955136 - DNA, 25 bp, Mus musculus
ttggcatgcgtctgtgcttacctga

SEQ ID NO: 955137 - DNA, 25 bp, Mus musculus
ttggcatggacacctaggtcgacgc

SEQ ID NO: 955138 - DNA, 25 bp, Mus musculus
ttggcatggacagctaggtcgacgc

SEQ ID NO: 955139 - DNA, 25 bp, Mus musculus
ttggcatggacgacctgcggatttt

SEQ ID NO: 955140 - DNA, 25 bp, Mus musculus
ttggcatggacgtcctgcggatttt

SEQ ID NO: 955141 - DNA, 25 bp, Mus musculus
ttggcatggtacaccctgagcatgg

SEQ ID NO: 955142 - DNA, 25 bp, Mus musculus
ttggcatggtactccctgagcatgg

SEQ ID NO: 955143 - DNA, 25 bp, Mus musculus
ttggcatggtggacatccgaggaaa

SEQ ID NO: 955144 - DNA, 25 bp, Mus musculus
ttggcatggtggtcatccgaggaaa

SEQ ID NO: 955145 - DNA, 25 bp, Mus musculus
ttggcatggtgtcctatatttagac

SEQ ID NO: 955146 - DNA, 25 bp, Mus musculus
ttggcatggtgtgctatatttagac

SEQ ID NO: 955147 - DNA, 25 bp, Mus musculus
ttggcatgtccaacagttacgcaga

SEQ ID NO: 955148 - DNA, 25 bp, Mus musculus
ttggcatgtccacgtccagagcagt

SEQ ID NO: 955149 - DNA, 25 bp, Mus musculus
ttggcatgtccaggtccagagcagt

SEQ ID NO: 955150 - DNA, 25 bp, Mus musculus
ttggcatgtccatcagttacgcaga

SEQ ID NO: 955151 - DNA, 25 bp, Mus musculus
ttggcatgtccccagcacacagttc

SEQ ID NO: 955152 - DNA, 25 bp, Mus musculus
ttggcatgtcccgagcacacagttc

SEQ ID NO: 955153 - DNA, 25 bp, Mus musculus
ttggcattaactagcagctcccatg

SEQ ID NO: 955154 - DNA, 25 bp, Mus musculus
ttggcattaacttgcagctcccatg

SEQ ID NO: 955155 - DNA, 25 bp, Mus musculus
ttggcattacagcaataccctaaag

SEQ ID NO: 955156 - DNA, 25 bp, Mus musculus
ttggcattacaggaataccctaaag

SEQ ID NO: 955157 - DNA, 25 bp, Mus musculus
ttggcattcaggcaggaaattcatt

SEQ ID NO: 955158 - DNA, 25 bp, Mus musculus
ttggcattcagggaggaaattcatt

SEQ ID NO: 955159 - DNA, 25 bp, Mus musculus
ttggcattccgacagtttacagaag

SEQ ID NO: 955160 - DNA, 25 bp, Mus musculus
ttggcattccgagagtttacagaag

SEQ ID NO: 955161 - DNA, 25 bp, Mus musculus
ttggcattctcaacagtgtctgggt

SEQ ID NO: 955162 - DNA, 25 bp, Mus musculus
ttggcattctcatcagtgtctgggt

SEQ ID NO: 955163 - DNA, 25 bp, Mus musculus
ttggcattgcccatgaaagacgagc

SEQ ID NO: 955164 - DNA, 25 bp, Mus musculus
ttggcattgcccttgaaagacgagc

SEQ ID NO: 955165 - DNA, 25 bp, Mus musculus
ttggcatttaacactttgtgttact

SEQ ID NO: 955166 - DNA, 25 bp, Mus musculus
ttggcatttaactctttgtgttact

SEQ ID NO: 955167 - DNA, 25 bp, Mus musculus
ttggcatttcatactgaattgatga

SEQ ID NO: 955168 - DNA, 25 bp, Mus musculus
ttggcatttcattctgaattgatga

SEQ ID NO: 955169 - DNA, 25 bp, Mus musculus
ttggcatttccaaggcaggctggca

SEQ ID NO: 955170 - DNA, 25 bp, Mus musculus
ttggcatttccatggcaggctggca

SEQ ID NO: 955171 - DNA, 25 bp, Mus musculus
ttggcatttggaactcggagcacat

SEQ ID NO: 955172 - DNA, 25 bp, Mus musculus
ttggcatttggatctcggagcacat

SEQ ID NO: 955173 - DNA, 25 bp, Mus musculus
ttggcatttggcagactccactcaa

SEQ ID NO: 955174 - DNA, 25 bp, Mus musculus
ttggcatttggctgactccactcaa

SEQ ID NO: 955175 - DNA, 25 bp, Mus musculus
ttggcatttgtgaggcaggactact

SEQ ID NO: 955176 - DNA, 25 bp, Mus musculus
ttggcatttgtgtggcaggactact

SEQ ID NO: 955177 - DNA, 25 bp, Mus musculus
ttggcattttctaaatccctgctac

SEQ ID NO: 955178 - DNA, 25 bp, Mus musculus
ttggcattttcttaatccctgctac

SEQ ID NO: 955179 - DNA, 25 bp, Mus musculus
ttggccaaaattccctagaactctg

SEQ ID NO: 955180 - DNA, 25 bp, Mus musculus
ttggccaaaattgcctagaactctg

SEQ ID NO: 955181 - DNA, 25 bp, Mus musculus
ttggccaactaaactctactcgaat

SEQ ID NO: 955182 - DNA, 25 bp, Mus musculus
ttggccaactaatctctactcgaat

SEQ ID NO: 955183 - DNA, 25 bp, Mus musculus
ttggccaactggatagtcaagtcta

SEQ ID NO: 955184 - DNA, 25 bp, Mus musculus
ttggccaactggttagtcaagtcta

SEQ ID NO: 955185 - DNA, 25 bp, Mus musculus
ttggccaagaacaattaactcctgt

SEQ ID NO: 955186 - DNA, 25 bp, Mus musculus
ttggccaagaactattaactcctgt

SEQ ID NO: 955187 - DNA, 25 bp, Mus musculus
ttggccaagctacaactgggatcgg

SEQ ID NO: 955188 - DNA, 25 bp, Mus musculus
ttggccaagctagaactgggatcgg

SEQ ID NO: 955189 - DNA, 25 bp, Mus musculus
ttggccaagttcataacccttctgt

SEQ ID NO: 955190 - DNA, 25 bp, Mus musculus
ttggccaagttcttaacccttctgt

SEQ ID NO: 955191 - DNA, 25 bp, Mus musculus
ttggccaatactcagttattgagag

SEQ ID NO: 955192 - DNA, 25 bp, Mus musculus
ttggccaatactgagttattgagag

SEQ ID NO: 955193 - DNA, 25 bp, Mus musculus
ttggccaatagtcacatgatattct

SEQ ID NO: 955194 - DNA, 25 bp, Mus musculus
ttggccaatagtgacatgatattct

SEQ ID NO: 955195 - DNA, 25 bp, Mus musculus
ttggccaatattactgtaatacctg

SEQ ID NO: 955196 - DNA, 25 bp, Mus musculus
ttggccaatatttctgtaatacctg

SEQ ID NO: 955197 - DNA, 25 bp, Mus musculus
ttggccacaagtccttactgattag

SEQ ID NO: 955198 - DNA, 25 bp, Mus musculus
ttggccacaagtgcttactgattag

SEQ ID NO: 955199 - DNA, 25 bp, Mus musculus
ttggccacaccgaagctgcagctga

SEQ ID NO: 955200 - DNA, 25 bp, Mus musculus
ttggccacaccgtagctgcagctga

SEQ ID NO: 955201 - DNA, 25 bp, Mus musculus
ttggccacacttagcacgcgactgc

SEQ ID NO: 955202 - DNA, 25 bp, Mus musculus
ttggccacactttgcacgcgactgc

SEQ ID NO: 955203 - DNA, 25 bp, Mus musculus
ttggccacagcactcctgagttgtg

SEQ ID NO: 955204 - DNA, 25 bp, Mus musculus
ttggccacagcagtcctgagttgtg

SEQ ID NO: 955205 - DNA, 25 bp, Mus musculus
ttggccacagtgacaaaagtctgat

SEQ ID NO: 955206 - DNA, 25 bp, Mus musculus
ttggccacagtgtcaaaagtctgat

SEQ ID NO: 955207 - DNA, 25 bp, Mus musculus
ttggccacatttaggcactacgcca

SEQ ID NO: 955208 - DNA, 25 bp, Mus musculus
ttggccacattttggcactacgcca

SEQ ID NO: 955209 - DNA, 25 bp, Mus musculus
ttggccaccaccagctaggtagaaa

SEQ ID NO: 955210 - DNA, 25 bp, Mus musculus
ttggccaccacctgctaggtagaaa

SEQ ID NO: 955211 - DNA, 25 bp, Mus musculus
ttggccaccagcaactactgtaaac

SEQ ID NO: 955212 - DNA, 25 bp, Mus musculus
ttggccaccagctactactgtaaac

SEQ ID NO: 955213 - DNA, 25 bp, Mus musculus
ttggccaccataaattgagctactt

SEQ ID NO: 955214 - DNA, 25 bp, Mus musculus
ttggccaccatatattgagctactt

SEQ ID NO: 955215 - DNA, 25 bp, Mus musculus
ttggccaccatcaagcagtgtactg

SEQ ID NO: 955216 - DNA, 25 bp, Mus musculus
ttggccaccatctagcagtgtactg

SEQ ID NO: 955217 - DNA, 25 bp, Mus musculus
ttggccaccccaaggcaaaatggat

SEQ ID NO: 955218 - DNA, 25 bp, Mus musculus
ttggccaccccatggcaaaatggat

SEQ ID NO: 955219 - DNA, 25 bp, Mus musculus
ttggccacctagagagaagtcttat

SEQ ID NO: 955220 - DNA, 25 bp, Mus musculus
ttggccacctagtgagaagtcttat

SEQ ID NO: 955221 - DNA, 25 bp, Mus musculus
ttggccacctatccctacgaaggca

SEQ ID NO: 955222 - DNA, 25 bp, Mus musculus
ttggccacctatgcctacgaaggca

SEQ ID NO: 955223 - DNA, 25 bp, Mus musculus
ttggccacctgtcgaactgtttaag

SEQ ID NO: 955224 - DNA, 25 bp, Mus musculus
ttggccacctgtggaactgtttaag

SEQ ID NO: 955225 - DNA, 25 bp, Mus musculus
ttggccaccttaaccgaaaagctca

SEQ ID NO: 955226 - DNA, 25 bp, Mus musculus
ttggccaccttatccgaaaagctca

SEQ ID NO: 955227 - DNA, 25 bp, Mus musculus
ttggccaccttcctcagagattaga

SEQ ID NO: 955228 - DNA, 25 bp, Mus musculus
ttggccaccttcgtcagagattaga

SEQ ID NO: 955229 - DNA, 25 bp, Mus musculus
ttggccacgcctaagaggatgctct

SEQ ID NO: 955230 - DNA, 25 bp, Mus musculus
ttggccacgccttagaggatgctct

SEQ ID NO: 955231 - DNA, 25 bp, Mus musculus
ttggccactctgctgataggctaga

SEQ ID NO: 955232 - DNA, 25 bp, Mus musculus
ttggccactctggtgataggctaga

SEQ ID NO: 955233 - DNA, 25 bp, Mus musculus
ttggccactggcacaaaaacaaagc

SEQ ID NO: 955234 - DNA, 25 bp, Mus musculus
ttggccactggctcaaaaacaaagc

SEQ ID NO: 955235 - DNA, 25 bp, Mus musculus
ttggccactttcatggtcacagccg

SEQ ID NO: 955236 - DNA, 25 bp, Mus musculus
ttggccactttcttggtcacagccg

SEQ ID NO: 955237 - DNA, 25 bp, Mus musculus
ttggccactttgacccaacagtcca

SEQ ID NO: 955238 - DNA, 25 bp, Mus musculus
ttggccactttgtcccaacagtcca

SEQ ID NO: 955239 - DNA, 25 bp, Mus musculus
ttggccagagggatcttcgtttcat

SEQ ID NO: 955240 - DNA, 25 bp, Mus musculus
ttggccagagggttcttcgtttcat

SEQ ID NO: 955241 - DNA, 25 bp, Mus musculus
ttggccagatcccttcaggtcccag

SEQ ID NO: 955242 - DNA, 25 bp, Mus musculus
ttggccagatccgttcaggtcccag

SEQ ID NO: 955243 - DNA, 25 bp, Mus musculus
ttggccagccacacattcggaaaac

SEQ ID NO: 955244 - DNA, 25 bp, Mus musculus
ttggccagccactcattcggaaaac

SEQ ID NO: 955245 - DNA, 25 bp, Mus musculus
ttggccaggcagagcatggcttcac

SEQ ID NO: 955246 - DNA, 25 bp, Mus musculus
ttggccaggcagtgcatggcttcac

SEQ ID NO: 955247 - DNA, 25 bp, Mus musculus
ttggccagtcacagttctcattttc

SEQ ID NO: 955248 - DNA, 25 bp, Mus musculus
ttggccagtcactgttctcattttc

SEQ ID NO: 955249 - DNA, 25 bp, Mus musculus
ttggccagtgctacaggaacttgat

SEQ ID NO: 955250 - DNA, 25 bp, Mus musculus
ttggccagtgcttcaggaacttgat

SEQ ID NO: 955251 - DNA, 25 bp, Mus musculus
ttggccagtggtccagatctaaatc

SEQ ID NO: 955252 - DNA, 25 bp, Mus musculus
ttggccagtggtgcagatctaaatc

SEQ ID NO: 955253 - DNA, 25 bp, Mus musculus
ttggccagtttcaggtgctaaagaa

SEQ ID NO: 955254 - DNA, 25 bp, Mus musculus
ttggccagtttctggtgctaaagaa

SEQ ID NO: 955255 - DNA, 25 bp, Mus musculus
ttggccataatccaaggtcaccctg

SEQ ID NO: 955256 - DNA, 25 bp, Mus musculus
ttggccataatcgaaggtcaccctg

SEQ ID NO: 955257 - DNA, 25 bp, Mus musculus
ttggccatacatatcttcaaaatag

SEQ ID NO: 955258 - DNA, 25 bp, Mus musculus
ttggccatacatttcttcaaaatag

SEQ ID NO: 955259 - DNA, 25 bp, Mus musculus
ttggccatatgacaccccatttcta

SEQ ID NO: 955260 - DNA, 25 bp, Mus musculus
ttggccatatgagaccccatttcta

SEQ ID NO: 955261 - DNA, 25 bp, Mus musculus
ttggccatcacaacctgactgaagt

SEQ ID NO: 955262 - DNA, 25 bp, Mus musculus
ttggccatcacatcctgactgaagt

SEQ ID NO: 955263 - DNA, 25 bp, Mus musculus
ttggccatccctaatatgtgcatct

SEQ ID NO: 955264 - DNA, 25 bp, Mus musculus
ttggccatcccttatatgtgcatct

SEQ ID NO: 955265 - DNA, 25 bp, Mus musculus
ttggccatcgtcagctggcataacg

SEQ ID NO: 955266 - DNA, 25 bp, Mus musculus
ttggccatcgtctgctggcataacg

SEQ ID NO: 955267 - DNA, 25 bp, Mus musculus
ttggccatgctgcttaaacagtgaa

SEQ ID NO: 955268 - DNA, 25 bp, Mus musculus
ttggccatgctggttaaacagtgaa

SEQ ID NO: 955269 - DNA, 25 bp, Mus musculus
ttggccatggatcaagctctacttc

SEQ ID NO: 955270 - DNA, 25 bp, Mus musculus
ttggccatggatgaagctctacttc

SEQ ID NO: 955271 - DNA, 25 bp, Mus musculus
ttggccatgtaacaaggtgcactgt

SEQ ID NO: 955272 - DNA, 25 bp, Mus musculus
ttggccatgtaagaaggtgcactgt

SEQ ID NO: 955273 - DNA, 25 bp, Mus musculus
ttggccatgtgccttgtcctctggt

SEQ ID NO: 955274 - DNA, 25 bp, Mus musculus
ttggccatgtgcgttgtcctctggt

SEQ ID NO: 955275 - DNA, 25 bp, Mus musculus
ttggccatgtgtcaccgtgtctgga

SEQ ID NO: 955276 - DNA, 25 bp, Mus musculus
ttggccatgtgtgaccgtgtctgga

SEQ ID NO: 955277 - DNA, 25 bp, Mus musculus
ttggccatgttccacaagatgtaag

SEQ ID NO: 955278 - DNA, 25 bp, Mus musculus
ttggccatgttcgacaagatgtaag

SEQ ID NO: 955279 - DNA, 25 bp, Mus musculus
ttggccattctcacgaagcacttta

SEQ ID NO: 955280 - DNA, 25 bp, Mus musculus
ttggccattctctcgaagcacttta

SEQ ID NO: 955281 - DNA, 25 bp, Mus musculus
ttggccattctgctaatagaccctg

SEQ ID NO: 955282 - DNA, 25 bp, Mus musculus
ttggccattctggtaatagaccctg

SEQ ID NO: 955283 - DNA, 25 bp, Mus musculus
ttggccattgaaccctgtgcccatg

SEQ ID NO: 955284 - DNA, 25 bp, Mus musculus
ttggccattgaagcctgtgcccatg

SEQ ID NO: 955285 - DNA, 25 bp, Mus musculus
ttggccatttggagctacaaccttg

SEQ ID NO: 955286 - DNA, 25 bp, Mus musculus
ttggccatttggtgctacaaccttg

SEQ ID NO: 955287 - DNA, 25 bp, Mus musculus
ttggcccaagggattctggcaagca

SEQ ID NO: 955288 - DNA, 25 bp, Mus musculus
ttggcccaagggtttctggcaagca

SEQ ID NO: 955289 - DNA, 25 bp, Mus musculus
ttggcccaatgacgctctactcatt

SEQ ID NO: 955290 - DNA, 25 bp, Mus musculus
ttggcccaatgaggctctactcatt

SEQ ID NO: 955291 - DNA, 25 bp, Mus musculus
ttggcccacaggacccacctagtgg

SEQ ID NO: 955292 - DNA, 25 bp, Mus musculus
ttggcccacaggcagtggtagtatt

SEQ ID NO: 955293 - DNA, 25 bp, Mus musculus
ttggcccacagggagtggtagtatt

SEQ ID NO: 955294 - DNA, 25 bp, Mus musculus
ttggcccacaggtcccacctagtgg

SEQ ID NO: 955295 - DNA, 25 bp, Mus musculus
ttggcccacctgaaataactcctga

SEQ ID NO: 955296 - DNA, 25 bp, Mus musculus
ttggcccacctgtaataactcctga

SEQ ID NO: 955297 - DNA, 25 bp, Mus musculus
ttggcccactcaaatgtgctccgaa

SEQ ID NO: 955298 - DNA, 25 bp, Mus musculus
ttggcccactcatatgtgctccgaa

SEQ ID NO: 955299 - DNA, 25 bp, Mus musculus
ttggcccagaaaaatcaggtcactt

SEQ ID NO: 955300 - DNA, 25 bp, Mus musculus
ttggcccagaaatatcaggtcactt

SEQ ID NO: 955301 - DNA, 25 bp, Mus musculus
ttggcccagaggattcagcagtatt

SEQ ID NO: 955302 - DNA, 25 bp, Mus musculus
ttggcccagaggtttcagcagtatt

SEQ ID NO: 955303 - DNA, 25 bp, Mus musculus
ttggcccagagtatcagcaagatct

SEQ ID NO: 955304 - DNA, 25 bp, Mus musculus
ttggcccagagtttcagcaagatct

SEQ ID NO: 955305 - DNA, 25 bp, Mus musculus
ttggcccaggacacctatgtgttta

SEQ ID NO: 955306 - DNA, 25 bp, Mus musculus
ttggcccaggactcctatgtgttta

SEQ ID NO: 955307 - DNA, 25 bp, Mus musculus
ttggcccaggagcacaaatgttttc

SEQ ID NO: 955308 - DNA, 25 bp, Mus musculus
ttggcccaggaggacaaatgttttc

SEQ ID NO: 955309 - DNA, 25 bp, Mus musculus
ttggcccaggcacttcaccaatgtt

SEQ ID NO: 955310 - DNA, 25 bp, Mus musculus
ttggcccaggcagttcaccaatgtt

SEQ ID NO: 955311 - DNA, 25 bp, Mus musculus
ttggcccaggcccatgtaacaaata

SEQ ID NO: 955312 - DNA, 25 bp, Mus musculus
ttggcccaggccgatgtaacaaata

SEQ ID NO: 955313 - DNA, 25 bp, Mus musculus
ttggcccatcttcgacagttcttgg

SEQ ID NO: 955314 - DNA, 25 bp, Mus musculus
ttggcccatcttggacagttcttgg

SEQ ID NO: 955315 - DNA, 25 bp, Mus musculus
ttggcccatgacaagtggcagtagt

SEQ ID NO: 955316 - DNA, 25 bp, Mus musculus
ttggcccatgactagtggcagtagt

SEQ ID NO: 955317 - DNA, 25 bp, Mus musculus
ttggcccattcaagtcctcttgatg

SEQ ID NO: 955318 - DNA, 25 bp, Mus musculus
ttggcccattcatgtcctcttgatg

SEQ ID NO: 955319 - DNA, 25 bp, Mus musculus
ttggccccaacgctggagaagtcac

SEQ ID NO: 955320 - DNA, 25 bp, Mus musculus
ttggccccaacggtggagaagtcac

SEQ ID NO: 955321 - DNA, 25 bp, Mus musculus
ttggccccaagtagccaggacctgg

SEQ ID NO: 955322 - DNA, 25 bp, Mus musculus
ttggccccaagttgccaggacctgg

SEQ ID NO: 955323 - DNA, 25 bp, Mus musculus
ttggccccacaaatatatctacgta

SEQ ID NO: 955324 - DNA, 25 bp, Mus musculus
ttggccccacaattatatctacgta

SEQ ID NO: 955325 - DNA, 25 bp, Mus musculus
ttggccccagtactccatagcatag

SEQ ID NO: 955326 - DNA, 25 bp, Mus musculus
ttggccccagtagtccatagcatag

SEQ ID NO: 955327 - DNA, 25 bp, Mus musculus
ttggccccagtgaccaagcagaaaa

SEQ ID NO: 955328 - DNA, 25 bp, Mus musculus
ttggccccagtgtccaagcagaaaa

SEQ ID NO: 955329 - DNA, 25 bp, Mus musculus
ttggccccattcattccttgtctaa

SEQ ID NO: 955330 - DNA, 25 bp, Mus musculus
ttggccccattctttccttgtctaa

SEQ ID NO: 955331 - DNA, 25 bp, Mus musculus
ttggccccatttcgacccgtggaat

SEQ ID NO: 955332 - DNA, 25 bp, Mus musculus
ttggccccatttggacccgtggaat

SEQ ID NO: 955333 - DNA, 25 bp, Mus musculus
ttggccccgaaaatcggtcctctgg

SEQ ID NO: 955334 - DNA, 25 bp, Mus musculus
ttggccccgaaattcggtcctctgg

SEQ ID NO: 955335 - DNA, 25 bp, Mus musculus
ttggccccgcaaatgtatcactgat

SEQ ID NO: 955336 - DNA, 25 bp, Mus musculus
ttggccccgcaattgtatcactgat

SEQ ID NO: 955337 - DNA, 25 bp, Mus musculus
ttggcccctcctcatgaccataatg

SEQ ID NO: 955338 - DNA, 25 bp, Mus musculus
ttggcccctcctgatgaccataatg

SEQ ID NO: 955339 - DNA, 25 bp, Mus musculus
ttggcccctctgaaaataacgtgat

SEQ ID NO: 955340 - DNA, 25 bp, Mus musculus
ttggcccctctgaataatttttcat

SEQ ID NO: 955341 - DNA, 25 bp, Mus musculus
ttggcccctctgtaaataacgtgat

SEQ ID NO: 955342 - DNA, 25 bp, Mus musculus
ttggcccctctgtataatttttcat

SEQ ID NO: 955343 - DNA, 25 bp, Mus musculus
ttggcccctgccattgtctgtgttg

SEQ ID NO: 955344 - DNA, 25 bp, Mus musculus
ttggcccctgcctttgtctgtgttg

SEQ ID NO: 955345 - DNA, 25 bp, Mus musculus
ttggcccgaggaccttgggccaggc

SEQ ID NO: 955346 - DNA, 25 bp, Mus musculus
ttggcccgaggagcttgggccaggc

SEQ ID NO: 955347 - DNA, 25 bp, Mus musculus
ttggcccgggcaccttgtaccacgt

SEQ ID NO: 955348 - DNA, 25 bp, Mus musculus
ttggcccgggcagcttgtaccacgt

SEQ ID NO: 955349 - DNA, 25 bp, Mus musculus
ttggcccgtgagaaccacaactgtc

SEQ ID NO: 955350 - DNA, 25 bp, Mus musculus
ttggcccgtgagtaccacaactgtc

SEQ ID NO: 955351 - DNA, 25 bp, Mus musculus
ttggcccgttgactacttgctgcta

SEQ ID NO: 955352 - DNA, 25 bp, Mus musculus
ttggcccgttgagtacttgctgcta

SEQ ID NO: 955353 - DNA, 25 bp, Mus musculus
ttggccctaagaacaacagctctca

SEQ ID NO: 955354 - DNA, 25 bp, Mus musculus
ttggccctaagatcaacagctctca

SEQ ID NO: 955355 - DNA, 25 bp, Mus musculus
ttggccctcataaggctggttttat

SEQ ID NO: 955356 - DNA, 25 bp, Mus musculus
ttggccctcatatggctggttttat

SEQ ID NO: 955357 - DNA, 25 bp, Mus musculus
ttggccctctataccatgtagtaat

SEQ ID NO: 955358 - DNA, 25 bp, Mus musculus
ttggccctctattccatgtagtaat

SEQ ID NO: 955359 - DNA, 25 bp, Mus musculus
ttggccctgagaatcagcgcagaca

SEQ ID NO: 955360 - DNA, 25 bp, Mus musculus
ttggccctgagattcagcgcagaca

SEQ ID NO: 955361 - DNA, 25 bp, Mus musculus
ttggccctgcagagactctacagat

SEQ ID NO: 955362 - DNA, 25 bp, Mus musculus
ttggccctgcagtgactctacagat

SEQ ID NO: 955363 - DNA, 25 bp, Mus musculus
ttggccctggacattggtttcccag

SEQ ID NO: 955364 - DNA, 25 bp, Mus musculus
ttggccctggactttggtttcccag

SEQ ID NO: 955365 - DNA, 25 bp, Mus musculus
ttggccctggctcaatgaagtgcag

SEQ ID NO: 955366 - DNA, 25 bp, Mus musculus
ttggccctggctgaatgaagtgcag

SEQ ID NO: 955367 - DNA, 25 bp, Mus musculus
ttggccctgggcctgtcatatggac

SEQ ID NO: 955368 - DNA, 25 bp, Mus musculus
ttggccctgggcgtgtcatatggac

SEQ ID NO: 955369 - DNA, 25 bp, Mus musculus
ttggccctgtcacctccacggagta

SEQ ID NO: 955370 - DNA, 25 bp, Mus musculus
ttggccctgtcagctccacggagta

SEQ ID NO: 955371 - DNA, 25 bp, Mus musculus
ttggcccttcaaatactggtgttac

SEQ ID NO: 955372 - DNA, 25 bp, Mus musculus
ttggcccttcaattactggtgttac

SEQ ID NO: 955373 - DNA, 25 bp, Mus musculus
ttggcccttcagagggacactgata

SEQ ID NO: 955374 - DNA, 25 bp, Mus musculus
ttggcccttcagtgggacactgata

SEQ ID NO: 955375 - DNA, 25 bp, Mus musculus
ttggcccttctactgggacagaatc

SEQ ID NO: 955376 - DNA, 25 bp, Mus musculus
ttggcccttctagtgggacagaatc

SEQ ID NO: 955377 - DNA, 25 bp, Mus musculus
ttggcccttctcatcacaactcggg

SEQ ID NO: 955378 - DNA, 25 bp, Mus musculus
ttggcccttctcttcacaactcggg

SEQ ID NO: 955379 - DNA, 25 bp, Mus musculus
ttggcccttttacatcagagaatgt

SEQ ID NO: 955380 - DNA, 25 bp, Mus musculus
ttggcccttttagatcagagaatgt

SEQ ID NO: 955381 - DNA, 25 bp, Mus musculus
ttggccgacagcctacagctggaaa

SEQ ID NO: 955382 - DNA, 25 bp, Mus musculus
ttggccgacagcgtacagctggaaa

SEQ ID NO: 955383 - DNA, 25 bp, Mus musculus
ttggccgacgaaacctcattgagtt

SEQ ID NO: 955384 - DNA, 25 bp, Mus musculus
ttggccgacgaatcctcattgagtt

SEQ ID NO: 955385 - DNA, 25 bp, Mus musculus
ttggccgcaatgatggatactgttg

SEQ ID NO: 955386 - DNA, 25 bp, Mus musculus
ttggccgcaatgttggatactgttg

SEQ ID NO: 955387 - DNA, 25 bp, Mus musculus
ttggccgccatcactaaaatagttt

SEQ ID NO: 955388 - DNA, 25 bp, Mus musculus
ttggccgccatctctaaaatagttt

SEQ ID NO: 955389 - DNA, 25 bp, Mus musculus
ttggccgccgctcagactgaagaag

SEQ ID NO: 955390 - DNA, 25 bp, Mus musculus
ttggccgccgctgagactgaagaag

SEQ ID NO: 955391 - DNA, 25 bp, Mus musculus
ttggccgccgtgcagaagagactcc

SEQ ID NO: 955392 - DNA, 25 bp, Mus musculus
ttggccgccgtggagaagagactcc

SEQ ID NO: 955393 - DNA, 25 bp, Mus musculus
ttggccggaaacaatctgcttggag

SEQ ID NO: 955394 - DNA, 25 bp, Mus musculus
ttggccggaaactatctgcttggag

SEQ ID NO: 955395 - DNA, 25 bp, Mus musculus
ttggccggaaagcatccctgaccag

SEQ ID NO: 955396 - DNA, 25 bp, Mus musculus
ttggccggaaaggatccctgaccag

SEQ ID NO: 955397 - DNA, 25 bp, Mus musculus
ttggccggactcctctacggaggcc

SEQ ID NO: 955398 - DNA, 25 bp, Mus musculus
ttggccggactcgtctacggaggcc

SEQ ID NO: 955399 - DNA, 25 bp, Mus musculus
ttggccggccaaacactaggaggga

SEQ ID NO: 955400 - DNA, 25 bp, Mus musculus
ttggccggccaatcactaggaggga

SEQ ID NO: 955401 - DNA, 25 bp, Mus musculus
ttggccgggtctcagaggctaccta

SEQ ID NO: 955402 - DNA, 25 bp, Mus musculus
ttggccgggtctgagaggctaccta

SEQ ID NO: 955403 - DNA, 25 bp, Mus musculus
ttggccggttgacttcagagagctt

SEQ ID NO: 955404 - DNA, 25 bp, Mus musculus
ttggccggttgagttcagagagctt

SEQ ID NO: 955405 - DNA, 25 bp, Mus musculus
ttggccgtccagcattctgtagaca

SEQ ID NO: 955406 - DNA, 25 bp, Mus musculus
ttggccgtccaggattctgtagaca

SEQ ID NO: 955407 - DNA, 25 bp, Mus musculus
ttggccgtgagccatgatcttttca

SEQ ID NO: 955408 - DNA, 25 bp, Mus musculus
ttggccgtgagcgatgatcttttca

SEQ ID NO: 955409 - DNA, 25 bp, Mus musculus
ttggccgtgccaaggagtagaacaa

SEQ ID NO: 955410 - DNA, 25 bp, Mus musculus
ttggccgtgccatggagtagaacaa

SEQ ID NO: 955411 - DNA, 25 bp, Mus musculus
ttggccgtggccaggcacctgtgca

SEQ ID NO: 955412 - DNA, 25 bp, Mus musculus
ttggccgtggcctggcacctgtgca

SEQ ID NO: 955413 - DNA, 25 bp, Mus musculus
ttggcctacatgcactcttttttgt

SEQ ID NO: 955414 - DNA, 25 bp, Mus musculus
ttggcctacatggactcttttttgt

SEQ ID NO: 955415 - DNA, 25 bp, Mus musculus
ttggcctaccgtagtacctacaatc

SEQ ID NO: 955416 - DNA, 25 bp, Mus musculus
ttggcctaccgttgtacctacaatc

SEQ ID NO: 955417 - DNA, 25 bp, Mus musculus
ttggcctacgatctgtcttcaagac

SEQ ID NO: 955418 - DNA, 25 bp, Mus musculus
ttggcctacgatgtgtcttcaagac

SEQ ID NO: 955419 - DNA, 25 bp, Mus musculus
ttggcctagacgagggagccccacg

SEQ ID NO: 955420 - DNA, 25 bp, Mus musculus
ttggcctagacgtgggagccccacg

SEQ ID NO: 955421 - DNA, 25 bp, Mus musculus
ttggcctatatgaaacgaagtctat

SEQ ID NO: 955422 - DNA, 25 bp, Mus musculus
ttggcctatatgtaacgaagtctat

SEQ ID NO: 955423 - DNA, 25 bp, Mus musculus
ttggcctatgctactctgtaataga

SEQ ID NO: 955424 - DNA, 25 bp, Mus musculus
ttggcctatgcttctctgtaataga

SEQ ID NO: 955425 - DNA, 25 bp, Mus musculus
ttggcctatggcacactttcagagt

SEQ ID NO: 955426 - DNA, 25 bp, Mus musculus
ttggcctatggctcactttcagagt

SEQ ID NO: 955427 - DNA, 25 bp, Mus musculus
ttggcctcaagacttggctccacat

SEQ ID NO: 955428 - DNA, 25 bp, Mus musculus
ttggcctcaagagttggctccacat

SEQ ID NO: 955429 - DNA, 25 bp, Mus musculus
ttggcctcacatcaaagcctagaat

SEQ ID NO: 955430 - DNA, 25 bp, Mus musculus
ttggcctcacatgaaagcctagaat

SEQ ID NO: 955431 - DNA, 25 bp, Mus musculus
ttggcctcagacatgtcagtgtgaa

SEQ ID NO: 955432 - DNA, 25 bp, Mus musculus
ttggcctcagacttgtcagtgtgaa

SEQ ID NO: 955433 - DNA, 25 bp, Mus musculus
ttggcctcatagcaccttgatctcc

SEQ ID NO: 955434 - DNA, 25 bp, Mus musculus
ttggcctcataggaccttgatctcc

SEQ ID NO: 955435 - DNA, 25 bp, Mus musculus
ttggcctcatccatagatctgccta

SEQ ID NO: 955436 - DNA, 25 bp, Mus musculus
ttggcctcatccttagatctgccta

SEQ ID NO: 955437 - DNA, 25 bp, Mus musculus
ttggcctccaaaaacagatgcatat

SEQ ID NO: 955438 - DNA, 25 bp, Mus musculus
ttggcctccaaatacagatgcatat

SEQ ID NO: 955439 - DNA, 25 bp, Mus musculus
ttggcctccaggctagatatagctg

SEQ ID NO: 955440 - DNA, 25 bp, Mus musculus
ttggcctccagggtagatatagctg

SEQ ID NO: 955441 - DNA, 25 bp, Mus musculus
ttggcctccatcagcacaggtagaa

SEQ ID NO: 955442 - DNA, 25 bp, Mus musculus
ttggcctccatctgcacaggtagaa

SEQ ID NO: 955443 - DNA, 25 bp, Mus musculus
ttggcctccattcgcaaaggtggct

SEQ ID NO: 955444 - DNA, 25 bp, Mus musculus
ttggcctccattggcaaaggtggct

SEQ ID NO: 955445 - DNA, 25 bp, Mus musculus
ttggcctcccagagttagcatttca

SEQ ID NO: 955446 - DNA, 25 bp, Mus musculus
ttggcctcccagtgttagcatttca

SEQ ID NO: 955447 - DNA, 25 bp, Mus musculus
ttggcctccccaccgtggaaactga

SEQ ID NO: 955448 - DNA, 25 bp, Mus musculus
ttggcctccccagcgtggaaactga

SEQ ID NO: 955449 - DNA, 25 bp, Mus musculus
ttggcctcccttcatgatggatgga

SEQ ID NO: 955450 - DNA, 25 bp, Mus musculus
ttggcctcccttgatgatggatgga

SEQ ID NO: 955451 - DNA, 25 bp, Mus musculus
ttggcctccgaaactgtgctcaact

SEQ ID NO: 955452 - DNA, 25 bp, Mus musculus
ttggcctccgaatctgtgctcaact

SEQ ID NO: 955453 - DNA, 25 bp, Mus musculus
ttggcctcctcaaagagcctttttg

SEQ ID NO: 955454 - DNA, 25 bp, Mus musculus
ttggcctcctcatagagcctttttg

SEQ ID NO: 955455 - DNA, 25 bp, Mus musculus
ttggcctccttaacacttacctgta

SEQ ID NO: 955456 - DNA, 25 bp, Mus musculus
ttggcctccttatcacttacctgta

SEQ ID NO: 955457 - DNA, 25 bp, Mus musculus
ttggcctcgctccaataaaggattc

SEQ ID NO: 955458 - DNA, 25 bp, Mus musculus
ttggcctcgctcgaataaaggattc

SEQ ID NO: 955459 - DNA, 25 bp, Mus musculus
ttggcctctccaagtgtaagaaaac

SEQ ID NO: 955460 - DNA, 25 bp, Mus musculus
ttggcctctccatgtgtaagaaaac

SEQ ID NO: 955461 - DNA, 25 bp, Mus musculus
ttggcctctcccatagatgtgagga

SEQ ID NO: 955462 - DNA, 25 bp, Mus musculus
ttggcctctcccttagatgtgagga

SEQ ID NO: 955463 - DNA, 25 bp, Mus musculus
ttggcctctcgtcacgacactgaaa

SEQ ID NO: 955464 - DNA, 25 bp, Mus musculus
ttggcctctcgtgacgacactgaaa

SEQ ID NO: 955465 - DNA, 25 bp, Mus musculus
ttggcctctgccaaggtcttgctca

SEQ ID NO: 955466 - DNA, 25 bp, Mus musculus
ttggcctctgcctaggtcttgctca

SEQ ID NO: 955467 - DNA, 25 bp, Mus musculus
ttggcctctgctactgtctgtttgg

SEQ ID NO: 955468 - DNA, 25 bp, Mus musculus
ttggcctctgcttctgtctgtttgg

SEQ ID NO: 955469 - DNA, 25 bp, Mus musculus
ttggcctctgtaatcctgtcagtta

SEQ ID NO: 955470 - DNA, 25 bp, Mus musculus
ttggcctctgtattcctgtcagtta

SEQ ID NO: 955471 - DNA, 25 bp, Mus musculus
ttggcctcttcactccttaaggaga

SEQ ID NO: 955472 - DNA, 25 bp, Mus musculus
ttggcctcttcagtccttaaggaga

SEQ ID NO: 955473 - DNA, 25 bp, Mus musculus
ttggcctcttttcactgagaaactg

SEQ ID NO: 955474 - DNA, 25 bp, Mus musculus
ttggcctcttttgactgagaaactg

SEQ ID NO: 955475 - DNA, 25 bp, Mus musculus
ttggcctgaatcaatgtttgtcccc

SEQ ID NO: 955476 - DNA, 25 bp, Mus musculus
ttggcctgaatctatgtttgtcccc

SEQ ID NO: 955477 - DNA, 25 bp, Mus musculus
ttggcctgagatagatggacctaag

SEQ ID NO: 955478 - DNA, 25 bp, Mus musculus
ttggcctgagattgatggacctaag

SEQ ID NO: 955479 - DNA, 25 bp, Mus musculus
ttggcctgagccatgtttccttgtg

SEQ ID NO: 955480 - DNA, 25 bp, Mus musculus
ttggcctgagccttgtttccttgtg

SEQ ID NO: 955481 - DNA, 25 bp, Mus musculus
ttggcctgcacacagcatcaacaca

SEQ ID NO: 955482 - DNA, 25 bp, Mus musculus
ttggcctgcacagagcatcaacaca

SEQ ID NO: 955483 - DNA, 25 bp, Mus musculus
ttggcctgccctaagtggtataatc

SEQ ID NO: 955484 - DNA, 25 bp, Mus musculus
ttggcctgcccttagtggtataatc

SEQ ID NO: 955485 - DNA, 25 bp, Mus musculus
ttggcctggaacatgacatcttgtc

SEQ ID NO: 955486 - DNA, 25 bp, Mus musculus
ttggcctggaacttgacatcttgtc

SEQ ID NO: 955487 - DNA, 25 bp, Mus musculus
ttggcctggagcatgtaacagttct

SEQ ID NO: 955488 - DNA, 25 bp, Mus musculus
ttggcctggagcttgtaacagttct

SEQ ID NO: 955489 - DNA, 25 bp, Mus musculus
ttggcctggattaatacccctcgaa

SEQ ID NO: 955490 - DNA, 25 bp, Mus musculus
ttggcctggatttatacccctcgaa

SEQ ID NO: 955491 - DNA, 25 bp, Mus musculus
ttggcctggcaactttcagcctggt

SEQ ID NO: 955492 - DNA, 25 bp, Mus musculus
ttggcctggcaagtttcagcctggt

SEQ ID NO: 955493 - DNA, 25 bp, Mus musculus
ttggcctgggtacaaaagagccctt

SEQ ID NO: 955494 - DNA, 25 bp, Mus musculus
ttggcctgggtagaaaagagccctt

SEQ ID NO: 955495 - DNA, 25 bp, Mus musculus
ttggcctggtgtccacttaaaagat

SEQ ID NO: 955496 - DNA, 25 bp, Mus musculus
ttggcctggtgtgcacttaaaagat

SEQ ID NO: 955497 - DNA, 25 bp, Mus musculus
ttggcctgtagaccttccacgatag

SEQ ID NO: 955498 - DNA, 25 bp, Mus musculus
ttggcctgtagagcttccacgatag

SEQ ID NO: 955499 - DNA, 25 bp, Mus musculus
ttggcctgttgcatgaacgctgctt

SEQ ID NO: 955500 - DNA, 25 bp, Mus musculus
ttggcctgttgcttgaacgctgctt

SEQ ID NO: 955501 - DNA, 25 bp, Mus musculus
ttggcctgtttgaagctatttcctg

SEQ ID NO: 955502 - DNA, 25 bp, Mus musculus
ttggcctgtttgaggtgcctgccgt

SEQ ID NO: 955503 - DNA, 25 bp, Mus musculus
ttggcctgtttgtagctatttcctg

SEQ ID NO: 955504 - DNA, 25 bp, Mus musculus
ttggcctgtttgtggtgcctgccgt

SEQ ID NO: 955505 - DNA, 25 bp, Mus musculus
ttggccttaaacatgtggcctctgg

SEQ ID NO: 955506 - DNA, 25 bp, Mus musculus
ttggccttaaacttgtggcctctgg

SEQ ID NO: 955507 - DNA, 25 bp, Mus musculus
ttggccttaggtatactctcaagtg

SEQ ID NO: 955508 - DNA, 25 bp, Mus musculus
ttggccttaggtttactctcaagtg

SEQ ID NO: 955509 - DNA, 25 bp, Mus musculus
ttggccttcaccagcaaactcaaga

SEQ ID NO: 955510 - DNA, 25 bp, Mus musculus
ttggccttcacctgcaaactcaaga

SEQ ID NO: 955511 - DNA, 25 bp, Mus musculus
ttggccttccatcccactgtggatg

SEQ ID NO: 955512 - DNA, 25 bp, Mus musculus
ttggccttccatgccactgtggatg

SEQ ID NO: 955513 - DNA, 25 bp, Mus musculus
ttggccttcgccataacatgctgta

SEQ ID NO: 955514 - DNA, 25 bp, Mus musculus
ttggccttcgccttaacatgctgta

SEQ ID NO: 955515 - DNA, 25 bp, Mus musculus
ttggccttcgttctattctgtctat

SEQ ID NO: 955516 - DNA, 25 bp, Mus musculus
ttggccttcgttgtattctgtctat

SEQ ID NO: 955517 - DNA, 25 bp, Mus musculus
ttggccttctctatgttggaggtta

SEQ ID NO: 955518 - DNA, 25 bp, Mus musculus
ttggccttctctttgttggaggtta

SEQ ID NO: 955519 - DNA, 25 bp, Mus musculus
ttggccttctgaacatcacacgtat

SEQ ID NO: 955520 - DNA, 25 bp, Mus musculus
ttggccttctgaactcaacgttaat

SEQ ID NO: 955521 - DNA, 25 bp, Mus musculus
ttggccttctgatcatcacacgtat

SEQ ID NO: 955522 - DNA, 25 bp, Mus musculus
ttggccttctgatctcaacgttaat

SEQ ID NO: 955523 - DNA, 25 bp, Mus musculus
ttggccttcttacctgtgcatacct

SEQ ID NO: 955524 - DNA, 25 bp, Mus musculus
ttggccttcttactaagtcactgtc

SEQ ID NO: 955525 - DNA, 25 bp, Mus musculus
ttggccttcttagctgtgcatacct

SEQ ID NO: 955526 - DNA, 25 bp, Mus musculus
ttggccttcttagtaagtcactgtc

SEQ ID NO: 955527 - DNA, 25 bp, Mus musculus
ttggccttgaacatatcaccctgga

SEQ ID NO: 955528 - DNA, 25 bp, Mus musculus
ttggccttgaacttatcaccctgga

SEQ ID NO: 955529 - DNA, 25 bp, Mus musculus
ttggccttgaccacagtggagatcc

SEQ ID NO: 955530 - DNA, 25 bp, Mus musculus
ttggccttgacctcagtggagatcc

SEQ ID NO: 955531 - DNA, 25 bp, Mus musculus
ttggccttgagcaatcaggaaacaa

SEQ ID NO: 955532 - DNA, 25 bp, Mus musculus
ttggccttgagctatcaggaaacaa

SEQ ID NO: 955533 - DNA, 25 bp, Mus musculus
ttggccttgcctattgccattatta

SEQ ID NO: 955534 - DNA, 25 bp, Mus musculus
ttggccttgccttttgccattatta

SEQ ID NO: 955535 - DNA, 25 bp, Mus musculus
ttggccttgcgactgcttcaaagta

SEQ ID NO: 955536 - DNA, 25 bp, Mus musculus
ttggccttgcgagtgcttcaaagta

SEQ ID NO: 955537 - DNA, 25 bp, Mus musculus
ttggccttgctgacccagtttatat

SEQ ID NO: 955538 - DNA, 25 bp, Mus musculus
ttggccttgctgtcccagtttatat

SEQ ID NO: 955539 - DNA, 25 bp, Mus musculus
ttggccttggccattggttataggt

SEQ ID NO: 955540 - DNA, 25 bp, Mus musculus
ttggccttggcctttggttataggt

SEQ ID NO: 955541 - DNA, 25 bp, Mus musculus
ttggccttggtgatggaattgcttt

SEQ ID NO: 955542 - DNA, 25 bp, Mus musculus
ttggccttggtgttggaattgcttt

SEQ ID NO: 955543 - DNA, 25 bp, Mus musculus
ttggccttggttacagcgactggaa

SEQ ID NO: 955544 - DNA, 25 bp, Mus musculus
ttggccttggttagcttctgtgaaa

SEQ ID NO: 955545 - DNA, 25 bp, Mus musculus
ttggccttggtttcagcgactggaa

SEQ ID NO: 955546 - DNA, 25 bp, Mus musculus
ttggccttggtttgcttctgtgaaa

SEQ ID NO: 955547 - DNA, 25 bp, Mus musculus
ttggcctttaaaaatttgcactttg

SEQ ID NO: 955548 - DNA, 25 bp, Mus musculus
ttggcctttaaatatttgcactttg

SEQ ID NO: 955549 - DNA, 25 bp, Mus musculus
ttggcctttcagagacttcggattt

SEQ ID NO: 955550 - DNA, 25 bp, Mus musculus
ttggcctttcagtgacttcggattt

SEQ ID NO: 955551 - DNA, 25 bp, Mus musculus
ttggcctttcccaggacatattcgg

SEQ ID NO: 955552 - DNA, 25 bp, Mus musculus
ttggcctttccctggacatattcgg

SEQ ID NO: 955553 - DNA, 25 bp, Mus musculus
ttggcctttctacggagcggtagac

SEQ ID NO: 955554 - DNA, 25 bp, Mus musculus
ttggcctttctagggagcggtagac

SEQ ID NO: 955555 - DNA, 25 bp, Mus musculus
ttggcctttgagcacagagaaaaaa

SEQ ID NO: 955556 - DNA, 25 bp, Mus musculus
ttggcctttgaggacagagaaaaaa

SEQ ID NO: 955557 - DNA, 25 bp, Mus musculus
ttggcctttgcgcttacctgttacg

SEQ ID NO: 955558 - DNA, 25 bp, Mus musculus
ttggcctttgcggttacctgttacg

SEQ ID NO: 955559 - DNA, 25 bp, Mus musculus
ttggcctttgctagtgtttggtttc

SEQ ID NO: 955560 - DNA, 25 bp, Mus musculus
ttggcctttgcttgtgtttggtttc

SEQ ID NO: 955561 - DNA, 25 bp, Mus musculus
ttggccttttgcacaccggttttga

SEQ ID NO: 955562 - DNA, 25 bp, Mus musculus
ttggccttttgctcaccggttttga

SEQ ID NO: 955563 - DNA, 25 bp, Mus musculus
ttggcgaaactgcaatggccgattc

SEQ ID NO: 955564 - DNA, 25 bp, Mus musculus
ttggcgaaactggaatggccgattc

SEQ ID NO: 955565 - DNA, 25 bp, Mus musculus
ttggcgaagaagagtcctcaacctg

SEQ ID NO: 955566 - DNA, 25 bp, Mus musculus
ttggcgaagaagtgtcctcaacctg

SEQ ID NO: 955567 - DNA, 25 bp, Mus musculus
ttggcgaatagaccctgcctccgaa

SEQ ID NO: 955568 - DNA, 25 bp, Mus musculus
ttggcgaatagagcctgcctccgaa

SEQ ID NO: 955569 - DNA, 25 bp, Mus musculus
ttggcgacatggactatgtttatcc

SEQ ID NO: 955570 - DNA, 25 bp, Mus musculus
ttggcgacatggtctatgtttatcc

SEQ ID NO: 955571 - DNA, 25 bp, Mus musculus
ttggcgacccctcagacacaaagaa

SEQ ID NO: 955572 - DNA, 25 bp, Mus musculus
ttggcgacccctgagacacaaagaa

SEQ ID NO: 955573 - DNA, 25 bp, Mus musculus
ttggcgactttgactgtcagcggcc

SEQ ID NO: 955574 - DNA, 25 bp, Mus musculus
ttggcgactttgtctgtcagcggcc

SEQ ID NO: 955575 - DNA, 25 bp, Mus musculus
ttggcgaggccaaactgcaccagtg

SEQ ID NO: 955576 - DNA, 25 bp, Mus musculus
ttggcgaggccatactgcaccagtg

SEQ ID NO: 955577 - DNA, 25 bp, Mus musculus
ttggcgagtttcatgtagctactat

SEQ ID NO: 955578 - DNA, 25 bp, Mus musculus
ttggcgagtttcttgtagctactat

SEQ ID NO: 955579 - DNA, 25 bp, Mus musculus
ttggcgatactgattattggacgtt

SEQ ID NO: 955580 - DNA, 25 bp, Mus musculus
ttggcgatactgtttattggacgtt

SEQ ID NO: 955581 - DNA, 25 bp, Mus musculus
ttggcgattcacagaccctaggaac

SEQ ID NO: 955582 - DNA, 25 bp, Mus musculus
ttggcgattcactgaccctaggaac

SEQ ID NO: 955583 - DNA, 25 bp, Mus musculus
ttggcgcagcacatacctgtagttc

SEQ ID NO: 955584 - DNA, 25 bp, Mus musculus
ttggcgcagcacttacctgtagttc

SEQ ID NO: 955585 - DNA, 25 bp, Mus musculus
ttggcgcagtctcagccgcagccag

SEQ ID NO: 955586 - DNA, 25 bp, Mus musculus
ttggcgcagtctgagccgcagccag

SEQ ID NO: 955587 - DNA, 25 bp, Mus musculus
ttggcgccattgctctagagctgtg

SEQ ID NO: 955588 - DNA, 25 bp, Mus musculus
ttggcgccattggtctagagctgtg

SEQ ID NO: 955589 - DNA, 25 bp, Mus musculus
ttggcgccccagattaacagtcttt

SEQ ID NO: 955590 - DNA, 25 bp, Mus musculus
ttggcgccccagtttaacagtcttt

SEQ ID NO: 955591 - DNA, 25 bp, Mus musculus
ttggcgccgcatatgctcaattttc

SEQ ID NO: 955592 - DNA, 25 bp, Mus musculus
ttggcgccgcatttgctcaattttc

SEQ ID NO: 955593 - DNA, 25 bp, Mus musculus
ttggcgcttattcctcttgctctaa

SEQ ID NO: 955594 - DNA, 25 bp, Mus musculus
ttggcgcttattgctcttgctctaa

SEQ ID NO: 955595 - DNA, 25 bp, Mus musculus
ttggcggaaatcactacacccgtgt

SEQ ID NO: 955596 - DNA, 25 bp, Mus musculus
ttggcggaaatctctacacccgtgt

SEQ ID NO: 955597 - DNA, 25 bp, Mus musculus
ttggcggaagccactgccgtatgtg

SEQ ID NO: 955598 - DNA, 25 bp, Mus musculus
ttggcggaagcctctgccgtatgtg

SEQ ID NO: 955599 - DNA, 25 bp, Mus musculus
ttggcggagcgcacactctttgacg

SEQ ID NO: 955600 - DNA, 25 bp, Mus musculus
ttggcggagcgctcactctttgacg

SEQ ID NO: 955601 - DNA, 25 bp, Mus musculus
ttggcggccattctgatttggcatc

SEQ ID NO: 955602 - DNA, 25 bp, Mus musculus
ttggcggccattgtgatttggcatc

SEQ ID NO: 955603 - DNA, 25 bp, Mus musculus
ttggcggccgtgctcctcgatctga

SEQ ID NO: 955604 - DNA, 25 bp, Mus musculus
ttggcggccgtggtcctcgatctga

SEQ ID NO: 955605 - DNA, 25 bp, Mus musculus
ttggcggcctttcttactatctgtc

SEQ ID NO: 955606 - DNA, 25 bp, Mus musculus
ttggcggcctttgttactatctgtc

SEQ ID NO: 955607 - DNA, 25 bp, Mus musculus
ttggcggctactcccaggcctacgg

SEQ ID NO: 955608 - DNA, 25 bp, Mus musculus
ttggcggctactgccaggcctacgg

SEQ ID NO: 955609 - DNA, 25 bp, Mus musculus
ttggcggctgcaatacattctgacc

SEQ ID NO: 955610 - DNA, 25 bp, Mus musculus
ttggcggctgcattacattctgacc

SEQ ID NO: 955611 - DNA, 25 bp, Mus musculus
ttggcgggaattacacctttccatt

SEQ ID NO: 955612 - DNA, 25 bp, Mus musculus
ttggcgggaatttcacctttccatt

SEQ ID NO: 955613 - DNA, 25 bp, Mus musculus
ttggcgggtacccgtcaagcatctc

SEQ ID NO: 955614 - DNA, 25 bp, Mus musculus
ttggcgggtaccggtcaagcatctc

SEQ ID NO: 955615 - DNA, 25 bp, Mus musculus
ttggcggtgtgtcacatgcacagca

SEQ ID NO: 955616 - DNA, 25 bp, Mus musculus
ttggcggtgtgtgacatgcacagca

SEQ ID NO: 955617 - DNA, 25 bp, Mus musculus
ttggcggtgttcagtcatgagctgc

SEQ ID NO: 955618 - DNA, 25 bp, Mus musculus
ttggcggtgttctgtcatgagctgc

SEQ ID NO: 955619 - DNA, 25 bp, Mus musculus
ttggcgtaaagaccgtttcctggat

SEQ ID NO: 955620 - DNA, 25 bp, Mus musculus
ttggcgtaaagagcgtttcctggat

SEQ ID NO: 955621 - DNA, 25 bp, Mus musculus
ttggcgtaacttaccttcggtgcag

SEQ ID NO: 955622 - DNA, 25 bp, Mus musculus
ttggcgtaactttccttcggtgcag

SEQ ID NO: 955623 - DNA, 25 bp, Mus musculus
ttggcgtaatttcccactctagtaa

SEQ ID NO: 955624 - DNA, 25 bp, Mus musculus
ttggcgtaatttgccactctagtaa

SEQ ID NO: 955625 - DNA, 25 bp, Mus musculus
ttggcgtctctgaaaaaacaagatg

SEQ ID NO: 955626 - DNA, 25 bp, Mus musculus
ttggcgtctctgtaaaaacaagatg

SEQ ID NO: 955627 - DNA, 25 bp, Mus musculus
ttggcgtctttgctaagggtcacat

SEQ ID NO: 955628 - DNA, 25 bp, Mus musculus
ttggcgtctttggtaagggtcacat

SEQ ID NO: 955629 - DNA, 25 bp, Mus musculus
ttggcgtgactcatgactatctatt

SEQ ID NO: 955630 - DNA, 25 bp, Mus musculus
ttggcgtgactcttgactatctatt

SEQ ID NO: 955631 - DNA, 25 bp, Mus musculus
ttggcgtgcagcaccgtgatagagt

SEQ ID NO: 955632 - DNA, 25 bp, Mus musculus
ttggcgtgcagctccgtgatagagt

SEQ ID NO: 955633 - DNA, 25 bp, Mus musculus
ttggcgtgcataaggatcactgtgt

SEQ ID NO: 955634 - DNA, 25 bp, Mus musculus
ttggcgtgcatatggatcactgtgt

SEQ ID NO: 955635 - DNA, 25 bp, Mus musculus
ttggcgtgccaacgatgcagcagca

SEQ ID NO: 955636 - DNA, 25 bp, Mus musculus
ttggcgtgccaaggatgcagcagca

SEQ ID NO: 955637 - DNA, 25 bp, Mus musculus
ttggcgtgcccaatttgaaggaaat

SEQ ID NO: 955638 - DNA, 25 bp, Mus musculus
ttggcgtgcccattttgaaggaaat

SEQ ID NO: 955639 - DNA, 25 bp, Mus musculus
ttggcgtgtgccatgttatgatcat

SEQ ID NO: 955640 - DNA, 25 bp, Mus musculus
ttggcgtgtgccttgttatgatcat

SEQ ID NO: 955641 - DNA, 25 bp, Mus musculus
ttggcgttagaaatccccgcctaca

SEQ ID NO: 955642 - DNA, 25 bp, Mus musculus
ttggcgttagaattccccgcctaca

SEQ ID NO: 955643 - DNA, 25 bp, Mus musculus
ttggcgttcagacaccctacggtta

SEQ ID NO: 955644 - DNA, 25 bp, Mus musculus
ttggcgttcagagaccctacggtta

SEQ ID NO: 955645 - DNA, 25 bp, Mus musculus
ttggcgttcctactgggttcgagaa

SEQ ID NO: 955646 - DNA, 25 bp, Mus musculus
ttggcgttcctagtgggttcgagaa

SEQ ID NO: 955647 - DNA, 25 bp, Mus musculus
ttggcgtttggaacagactgcacac

SEQ ID NO: 955648 - DNA, 25 bp, Mus musculus
ttggcgtttggatcagactgcacac

SEQ ID NO: 955649 - DNA, 25 bp, Mus musculus
ttggcgtttggtcacattctgttgc

SEQ ID NO: 955650 - DNA, 25 bp, Mus musculus
ttggcgtttggtgacattctgttgc

SEQ ID NO: 955651 - DNA, 25 bp, Mus musculus
ttggcgtttgttctatcactcagga

SEQ ID NO: 955652 - DNA, 25 bp, Mus musculus
ttggcgtttgttgtatcactcagga

SEQ ID NO: 955653 - DNA, 25 bp, Mus musculus
ttggctaaattgaactcttttctat

SEQ ID NO: 955654 - DNA, 25 bp, Mus musculus
ttggctaaattgtactcttttctat

SEQ ID NO: 955655 - DNA, 25 bp, Mus musculus
ttggctaacgctacctggtagttgg

SEQ ID NO: 955656 - DNA, 25 bp, Mus musculus
ttggctaacgcttcctggtagttgg

SEQ ID NO: 955657 - DNA, 25 bp, Mus musculus
ttggctaactaaaccataatttatt

SEQ ID NO: 955658 - DNA, 25 bp, Mus musculus
ttggctaactaatccataatttatt

SEQ ID NO: 955659 - DNA, 25 bp, Mus musculus
ttggctaactcgctctgtgctctca

SEQ ID NO: 955660 - DNA, 25 bp, Mus musculus
ttggctaactcggtctgtgctctca

SEQ ID NO: 955661 - DNA, 25 bp, Mus musculus
ttggctaaggccctcctcaagactc

SEQ ID NO: 955662 - DNA, 25 bp, Mus musculus
ttggctaaggccgtcctcaagactc

SEQ ID NO: 955663 - DNA, 25 bp, Mus musculus
ttggctaagtggattacccttcgtg

SEQ ID NO: 955664 - DNA, 25 bp, Mus musculus
ttggctaagtggtttacccttcgtg

SEQ ID NO: 955665 - DNA, 25 bp, Mus musculus
ttggctaatgtcacccagcaatctt

SEQ ID NO: 955666 - DNA, 25 bp, Mus musculus
ttggctaatgtctcccagcaatctt

SEQ ID NO: 955667 - DNA, 25 bp, Mus musculus
ttggctacaaacatccctcttagaa

SEQ ID NO: 955668 - DNA, 25 bp, Mus musculus
ttggctacaaacttccctcttagaa

SEQ ID NO: 955669 - DNA, 25 bp, Mus musculus
ttggctacaagcaaaccttggcaca

SEQ ID NO: 955670 - DNA, 25 bp, Mus musculus
ttggctacaagctaaccttggcaca

SEQ ID NO: 955671 - DNA, 25 bp, Mus musculus
ttggctacaatgagcagatatgtat

SEQ ID NO: 955672 - DNA, 25 bp, Mus musculus
ttggctacaatgtgcagatatgtat

SEQ ID NO: 955673 - DNA, 25 bp, Mus musculus
ttggctacatcgcaccctgggcaga

SEQ ID NO: 955674 - DNA, 25 bp, Mus musculus
ttggctacatcggaccctgggcaga

SEQ ID NO: 955675 - DNA, 25 bp, Mus musculus
ttggctacatgcattctaagatttc

SEQ ID NO: 955676 - DNA, 25 bp, Mus musculus
ttggctacatgctttctaagatttc

SEQ ID NO: 955677 - DNA, 25 bp, Mus musculus
ttggctacattgattaatttaagtg

SEQ ID NO: 955678 - DNA, 25 bp, Mus musculus
ttggctacattgcaaaattgaggct

SEQ ID NO: 955679 - DNA, 25 bp, Mus musculus
ttggctacattggaaaattgaggct

SEQ ID NO: 955680 - DNA, 25 bp, Mus musculus
ttggctacattgtttaatttaagtg

SEQ ID NO: 955681 - DNA, 25 bp, Mus musculus
ttggctaccacccaaaagggacact

SEQ ID NO: 955682 - DNA, 25 bp, Mus musculus
ttggctaccaccgaaaagggacact

SEQ ID NO: 955683 - DNA, 25 bp, Mus musculus
ttggctaccccaatgaggaggctgc

SEQ ID NO: 955684 - DNA, 25 bp, Mus musculus
ttggctaccccattgaggaggctgc

SEQ ID NO: 955685 - DNA, 25 bp, Mus musculus
ttggctacctctagctgaacaccct

SEQ ID NO: 955686 - DNA, 25 bp, Mus musculus
ttggctacctcttgctgaacaccct

SEQ ID NO: 955687 - DNA, 25 bp, Mus musculus
ttggctacctttcctgagcaccaaa

SEQ ID NO: 955688 - DNA, 25 bp, Mus musculus
ttggctacctttgctgagcaccaaa

SEQ ID NO: 955689 - DNA, 25 bp, Mus musculus
ttggctacgcagcttttacaggtgt

SEQ ID NO: 955690 - DNA, 25 bp, Mus musculus
ttggctacgcaggttttacaggtgt

SEQ ID NO: 955691 - DNA, 25 bp, Mus musculus
ttggctactaccacagcccacagag

SEQ ID NO: 955692 - DNA, 25 bp, Mus musculus
ttggctactacctcagcccacagag

SEQ ID NO: 955693 - DNA, 25 bp, Mus musculus
ttggctactagaaatctaccttgga

SEQ ID NO: 955694 - DNA, 25 bp, Mus musculus
ttggctactagatatctaccttgga

SEQ ID NO: 955695 - DNA, 25 bp, Mus musculus
ttggctactccgagtcaatggcaaa

SEQ ID NO: 955696 - DNA, 25 bp, Mus musculus
ttggctactccgtgtcaatggcaaa

SEQ ID NO: 955697 - DNA, 25 bp, Mus musculus
ttggctacttctatttaagataact

SEQ ID NO: 955698 - DNA, 25 bp, Mus musculus
ttggctacttctttttaagataact

SEQ ID NO: 955699 - DNA, 25 bp, Mus musculus
ttggctagacctccagtgactgatg

SEQ ID NO: 955700 - DNA, 25 bp, Mus musculus
ttggctagacctgcagtgactgatg

SEQ ID NO: 955701 - DNA, 25 bp, Mus musculus
ttggctagcctaaatgtcctttaaa

SEQ ID NO: 955702 - DNA, 25 bp, Mus musculus
ttggctagcctatatgtcctttaaa

SEQ ID NO: 955703 - DNA, 25 bp, Mus musculus
ttggctaggagcataagctgccagt

SEQ ID NO: 955704 - DNA, 25 bp, Mus musculus
ttggctaggagcttaagctgccagt

SEQ ID NO: 955705 - DNA, 25 bp, Mus musculus
ttggctaggcaacttcagttaaaat

SEQ ID NO: 955706 - DNA, 25 bp, Mus musculus
ttggctaggcaagttcagttaaaat

SEQ ID NO: 955707 - DNA, 25 bp, Mus musculus
ttggctaggtttcctgctcagacaa

SEQ ID NO: 955708 - DNA, 25 bp, Mus musculus
ttggctaggtttgctgctcagacaa

SEQ ID NO: 955709 - DNA, 25 bp, Mus musculus
ttggctagtgctccttctgtaacat

SEQ ID NO: 955710 - DNA, 25 bp, Mus musculus
ttggctagtgctgcttctgtaacat

SEQ ID NO: 955711 - DNA, 25 bp, Mus musculus
ttggctagttagaggcctctccttg

SEQ ID NO: 955712 - DNA, 25 bp, Mus musculus
ttggctagttagtggcctctccttg

SEQ ID NO: 955713 - DNA, 25 bp, Mus musculus
ttggctatcactcgctaccttttta

SEQ ID NO: 955714 - DNA, 25 bp, Mus musculus
ttggctatcactggctaccttttta

SEQ ID NO: 955715 - DNA, 25 bp, Mus musculus
ttggctatggctactttactgacag

SEQ ID NO: 955716 - DNA, 25 bp, Mus musculus
ttggctatggcttctttactgacag

SEQ ID NO: 955717 - DNA, 25 bp, Mus musculus
ttggctatgggcacctcgaagcggt

SEQ ID NO: 955718 - DNA, 25 bp, Mus musculus
ttggctatgggcctgaagcttcaag

SEQ ID NO: 955719 - DNA, 25 bp, Mus musculus
ttggctatgggcgtgaagcttcaag

SEQ ID NO: 955720 - DNA, 25 bp, Mus musculus
ttggctatgggctcctcgaagcggt

SEQ ID NO: 955721 - DNA, 25 bp, Mus musculus
ttggctattccaaagaggtgtgtct

SEQ ID NO: 955722 - DNA, 25 bp, Mus musculus
ttggctattccatagaggtgtgtct

SEQ ID NO: 955723 - DNA, 25 bp, Mus musculus
ttggctattctgcttgtcggtgcca

SEQ ID NO: 955724 - DNA, 25 bp, Mus musculus
ttggctattctggttgtcggtgcca

SEQ ID NO: 955725 - DNA, 25 bp, Mus musculus
ttggctatttatcgcatgctgccca

SEQ ID NO: 955726 - DNA, 25 bp, Mus musculus
ttggctatttatggcatgctgccca

SEQ ID NO: 955727 - DNA, 25 bp, Mus musculus
ttggctcaagccctattcttaaaag

SEQ ID NO: 955728 - DNA, 25 bp, Mus musculus
ttggctcaagccgtattcttaaaag

SEQ ID NO: 955729 - DNA, 25 bp, Mus musculus
ttggctcaagcgagatgctgacagc

SEQ ID NO: 955730 - DNA, 25 bp, Mus musculus
ttggctcaagcgtgatgctgacagc

SEQ ID NO: 955731 - DNA, 25 bp, Mus musculus
ttggctcacaatctcttcatgggtt

SEQ ID NO: 955732 - DNA, 25 bp, Mus musculus
ttggctcacaatgtcttcatgggtt

SEQ ID NO: 955733 - DNA, 25 bp, Mus musculus
ttggctcacagtatcaaagctttca

SEQ ID NO: 955734 - DNA, 25 bp, Mus musculus
ttggctcacagtttcaaagctttca

SEQ ID NO: 955735 - DNA, 25 bp, Mus musculus
ttggctcactttagggcagtcatat

SEQ ID NO: 955736 - DNA, 25 bp, Mus musculus
ttggctcacttttgggcagtcatat

SEQ ID NO: 955737 - DNA, 25 bp, Mus musculus
ttggctcagaacatcctcaaaggaa

SEQ ID NO: 955738 - DNA, 25 bp, Mus musculus
ttggctcagaacttcctcaaaggaa

SEQ ID NO: 955739 - DNA, 25 bp, Mus musculus
ttggctcagagcctctatggctatg

SEQ ID NO: 955740 - DNA, 25 bp, Mus musculus
ttggctcagagcgtctatggctatg

SEQ ID NO: 955741 - DNA, 25 bp, Mus musculus
ttggctcagccacctcttagggtgc

SEQ ID NO: 955742 - DNA, 25 bp, Mus musculus
ttggctcagccagctcttagggtgc

SEQ ID NO: 955743 - DNA, 25 bp, Mus musculus
ttggctcagccgagtgacctcggat

SEQ ID NO: 955744 - DNA, 25 bp, Mus musculus
ttggctcagccgtgtgacctcggat

SEQ ID NO: 955745 - DNA, 25 bp, Mus musculus
ttggctcaggttcagtcagttgctc

SEQ ID NO: 955746 - DNA, 25 bp, Mus musculus
ttggctcaggttgagtcagttgctc

SEQ ID NO: 955747 - DNA, 25 bp, Mus musculus
ttggctcagtccctgaaggtaagtc

SEQ ID NO: 955748 - DNA, 25 bp, Mus musculus
ttggctcagtccgtgaaggtaagtc

SEQ ID NO: 955749 - DNA, 25 bp, Mus musculus
ttggctcatgcaaataaccacctgc

SEQ ID NO: 955750 - DNA, 25 bp, Mus musculus
ttggctcatgcatataaccacctgc

SEQ ID NO: 955751 - DNA, 25 bp, Mus musculus
ttggctcattcaaagtgtgtcctta

SEQ ID NO: 955752 - DNA, 25 bp, Mus musculus
ttggctcattcatagtgtgtcctta

SEQ ID NO: 955753 - DNA, 25 bp, Mus musculus
ttggctcattttatcacgtctatct

SEQ ID NO: 955754 - DNA, 25 bp, Mus musculus
ttggctcattttttcacgtctatct

SEQ ID NO: 955755 - DNA, 25 bp, Mus musculus
ttggctccaatgagatccttaagca

SEQ ID NO: 955756 - DNA, 25 bp, Mus musculus
ttggctccaatgtgatccttaagca

SEQ ID NO: 955757 - DNA, 25 bp, Mus musculus
ttggctccagagagcgaggctgtaa

SEQ ID NO: 955758 - DNA, 25 bp, Mus musculus
ttggctccagagatgtcagagttag

SEQ ID NO: 955759 - DNA, 25 bp, Mus musculus
ttggctccagagtgcgaggctgtaa

SEQ ID NO: 955760 - DNA, 25 bp, Mus musculus
ttggctccagagttgtcagagttag

SEQ ID NO: 955761 - DNA, 25 bp, Mus musculus
ttggctccaggccttactcagtgat

SEQ ID NO: 955762 - DNA, 25 bp, Mus musculus
ttggctccaggcgttactcagtgat

SEQ ID NO: 955763 - DNA, 25 bp, Mus musculus
ttggctcccacaaagggaagctctt

SEQ ID NO: 955764 - DNA, 25 bp, Mus musculus
ttggctcccacatagggaagctctt

SEQ ID NO: 955765 - DNA, 25 bp, Mus musculus
ttggctcccactccttatagaatat

SEQ ID NO: 955766 - DNA, 25 bp, Mus musculus
ttggctcccactgcttatagaatat

SEQ ID NO: 955767 - DNA, 25 bp, Mus musculus
ttggctcccctaatcactaggtgat

SEQ ID NO: 955768 - DNA, 25 bp, Mus musculus
ttggctcccctattcactaggtgat

SEQ ID NO: 955769 - DNA, 25 bp, Mus musculus
ttggctcccgtgaatgttgaacccc

SEQ ID NO: 955770 - DNA, 25 bp, Mus musculus
ttggctcccgtgtatgttgaacccc

SEQ ID NO: 955771 - DNA, 25 bp, Mus musculus
ttggctccctgtatgttatctagga

SEQ ID NO: 955772 - DNA, 25 bp, Mus musculus
ttggctccctgtttgttatctagga

SEQ ID NO: 955773 - DNA, 25 bp, Mus musculus
ttggctccgcccagggcagctgaag

SEQ ID NO: 955774 - DNA, 25 bp, Mus musculus
ttggctccgccctgggcagctgaag

SEQ ID NO: 955775 - DNA, 25 bp, Mus musculus
ttggctcctcccagagttggagtaa

SEQ ID NO: 955776 - DNA, 25 bp, Mus musculus
ttggctcctccctgagttggagtaa

SEQ ID NO: 955777 - DNA, 25 bp, Mus musculus
ttggctcctggtacaagcagggagt

SEQ ID NO: 955778 - DNA, 25 bp, Mus musculus
ttggctcctggttcaagcagggagt

SEQ ID NO: 955779 - DNA, 25 bp, Mus musculus
ttggctcctgtaagacttcccagaa

SEQ ID NO: 955780 - DNA, 25 bp, Mus musculus
ttggctcctgtatgacttcccagaa

SEQ ID NO: 955781 - DNA, 25 bp, Mus musculus
ttggctccttggataatatcaccca

SEQ ID NO: 955782 - DNA, 25 bp, Mus musculus
ttggctccttggttaatatcaccca

SEQ ID NO: 955783 - DNA, 25 bp, Mus musculus
ttggctcgagagacacttcagcagc

SEQ ID NO: 955784 - DNA, 25 bp, Mus musculus
ttggctcgagagtcacttcagcagc

SEQ ID NO: 955785 - DNA, 25 bp, Mus musculus
ttggctcgcccaaggctggtgacaa

SEQ ID NO: 955786 - DNA, 25 bp, Mus musculus
ttggctcgcccatggctggtgacaa

SEQ ID NO: 955787 - DNA, 25 bp, Mus musculus
ttggctcgggatagtctttgttgca

SEQ ID NO: 955788 - DNA, 25 bp, Mus musculus
ttggctcgggattgtctttgttgca

SEQ ID NO: 955789 - DNA, 25 bp, Mus musculus
ttggctcgggccaagccctggaaaa

SEQ ID NO: 955790 - DNA, 25 bp, Mus musculus
ttggctcgggcctagccctggaaaa

SEQ ID NO: 955791 - DNA, 25 bp, Mus musculus
ttggctcgtcttagggcactcggtg

SEQ ID NO: 955792 - DNA, 25 bp, Mus musculus
ttggctcgtctttgggcactcggtg

SEQ ID NO: 955793 - DNA, 25 bp, Mus musculus
ttggctctaaggctcagccttggct

SEQ ID NO: 955794 - DNA, 25 bp, Mus musculus
ttggctctaagggtcagccttggct

SEQ ID NO: 955795 - DNA, 25 bp, Mus musculus
ttggctctatccatgaccagacagg

SEQ ID NO: 955796 - DNA, 25 bp, Mus musculus
ttggctctatccttgaccagacagg

SEQ ID NO: 955797 - DNA, 25 bp, Mus musculus
ttggctctcactattcaagtttaaa

SEQ ID NO: 955798 - DNA, 25 bp, Mus musculus
ttggctctcacttttcaagtttaaa

SEQ ID NO: 955799 - DNA, 25 bp, Mus musculus
ttggctctccgccttacgttaactc

SEQ ID NO: 955800 - DNA, 25 bp, Mus musculus
ttggctctccgcgttacgttaactc

SEQ ID NO: 955801 - DNA, 25 bp, Mus musculus
ttggctctcctcaaatctaattcca

SEQ ID NO: 955802 - DNA, 25 bp, Mus musculus
ttggctctcctctaatctaattcca

SEQ ID NO: 955803 - DNA, 25 bp, Mus musculus
ttggctctcgcaattctggagtgtg

SEQ ID NO: 955804 - DNA, 25 bp, Mus musculus
ttggctctcgcatttctggagtgtg

SEQ ID NO: 955805 - DNA, 25 bp, Mus musculus
ttggctctctacacagtcacaggac

SEQ ID NO: 955806 - DNA, 25 bp, Mus musculus
ttggctctctactcagtcacaggac

SEQ ID NO: 955807 - DNA, 25 bp, Mus musculus
ttggctctctcacatgctctgttac

SEQ ID NO: 955808 - DNA, 25 bp, Mus musculus
ttggctctctcagatgctctgttac

SEQ ID NO: 955809 - DNA, 25 bp, Mus musculus
ttggctctctttctaaccttcctta

SEQ ID NO: 955810 - DNA, 25 bp, Mus musculus
ttggctctctttgtaaccttcctta

SEQ ID NO: 955811 - DNA, 25 bp, Mus musculus
ttggctctgagcacatactgaacaa

SEQ ID NO: 955812 - DNA, 25 bp, Mus musculus
ttggctctgagctcatactgaacaa

SEQ ID NO: 955813 - DNA, 25 bp, Mus musculus
ttggctctgagtaaccctcaaagta

SEQ ID NO: 955814 - DNA, 25 bp, Mus musculus
ttggctctgagttaccctcaaagta

SEQ ID NO: 955815 - DNA, 25 bp, Mus musculus
ttggctctgccaaaggaggagctct

SEQ ID NO: 955816 - DNA, 25 bp, Mus musculus
ttggctctgccaaattgtcaaatga

SEQ ID NO: 955817 - DNA, 25 bp, Mus musculus
ttggctctgccataggaggagctct

SEQ ID NO: 955818 - DNA, 25 bp, Mus musculus
ttggctctgccatattgtcaaatga

SEQ ID NO: 955819 - DNA, 25 bp, Mus musculus
ttggctctgcgtcagtaccctgatg

SEQ ID NO: 955820 - DNA, 25 bp, Mus musculus
ttggctctgcgtgagtaccctgatg

SEQ ID NO: 955821 - DNA, 25 bp, Mus musculus
ttggctctggccatgtagcccatag

SEQ ID NO: 955822 - DNA, 25 bp, Mus musculus
ttggctctggccttgtagcccatag

SEQ ID NO: 955823 - DNA, 25 bp, Mus musculus
ttggctctggctcatcaattaatgc

SEQ ID NO: 955824 - DNA, 25 bp, Mus musculus
ttggctctggctgatcaattaatgc

SEQ ID NO: 955825 - DNA, 25 bp, Mus musculus
ttggctctgggtccaaactgttatt

SEQ ID NO: 955826 - DNA, 25 bp, Mus musculus
ttggctctgggtgcaaactgttatt

SEQ ID NO: 955827 - DNA, 25 bp, Mus musculus
ttggctctggtgactaccggattgg

SEQ ID NO: 955828 - DNA, 25 bp, Mus musculus
ttggctctggtgtctaccggattgg

SEQ ID NO: 955829 - DNA, 25 bp, Mus musculus
ttggctctgtacagccgcgggacag

SEQ ID NO: 955830 - DNA, 25 bp, Mus musculus
ttggctctgtactgccgcgggacag

SEQ ID NO: 955831 - DNA, 25 bp, Mus musculus
ttggctctgtttcacaagattgagt

SEQ ID NO: 955832 - DNA, 25 bp, Mus musculus
ttggctctgtttgacaagattgagt

SEQ ID NO: 955833 - DNA, 25 bp, Mus musculus
ttggctcttagacaaaacataacct

SEQ ID NO: 955834 - DNA, 25 bp, Mus musculus
ttggctcttagagaaaacataacct

SEQ ID NO: 955835 - DNA, 25 bp, Mus musculus
ttggctcttccaacctaagaaactg

SEQ ID NO: 955836 - DNA, 25 bp, Mus musculus
ttggctcttccatcctaagaaactg

SEQ ID NO: 955837 - DNA, 25 bp, Mus musculus
ttggctcttcctatgacagggcagg

SEQ ID NO: 955838 - DNA, 25 bp, Mus musculus
ttggctcttcctttgacagggcagg

SEQ ID NO: 955839 - DNA, 25 bp, Mus musculus
ttggctcttgagaggctgcattgca

SEQ ID NO: 955840 - DNA, 25 bp, Mus musculus
ttggctcttgagtggctgcattgca

SEQ ID NO: 955841 - DNA, 25 bp, Mus musculus
ttggctcttgctattcctgtgaaga

SEQ ID NO: 955842 - DNA, 25 bp, Mus musculus
ttggctcttgcttttcctgtgaaga

SEQ ID NO: 955843 - DNA, 25 bp, Mus musculus
ttggctgaaaaacacttacttgtgt

SEQ ID NO: 955844 - DNA, 25 bp, Mus musculus
ttggctgaaaaagacttacttgtgt

SEQ ID NO: 955845 - DNA, 25 bp, Mus musculus
ttggctgaaaggaccccggaacttg

SEQ ID NO: 955846 - DNA, 25 bp, Mus musculus
ttggctgaaaggtccccggaacttg

SEQ ID NO: 955847 - DNA, 25 bp, Mus musculus
ttggctgaacatcaatctgacctgc

SEQ ID NO: 955848 - DNA, 25 bp, Mus musculus
ttggctgaacatgaatctgacctgc

SEQ ID NO: 955849 - DNA, 25 bp, Mus musculus
ttggctgaagcaccgctggtgatca

SEQ ID NO: 955850 - DNA, 25 bp, Mus musculus
ttggctgaagcagcgctggtgatca

SEQ ID NO: 955851 - DNA, 25 bp, Mus musculus
ttggctgaatcacaccatggttcca

SEQ ID NO: 955852 - DNA, 25 bp, Mus musculus
ttggctgaatcagaccatggttcca

SEQ ID NO: 955853 - DNA, 25 bp, Mus musculus
ttggctgacaagaaccactaaaccc

SEQ ID NO: 955854 - DNA, 25 bp, Mus musculus
ttggctgacaagtaccactaaaccc

SEQ ID NO: 955855 - DNA, 25 bp, Mus musculus
ttggctgaccatcttgctttaggcg

SEQ ID NO: 955856 - DNA, 25 bp, Mus musculus
ttggctgaccatgttgctttaggcg

SEQ ID NO: 955857 - DNA, 25 bp, Mus musculus
ttggctgacccaactagaaacttat

SEQ ID NO: 955858 - DNA, 25 bp, Mus musculus
ttggctgacccatctagaaacttat

SEQ ID NO: 955859 - DNA, 25 bp, Mus musculus
ttggctgacctcctcacagaggtaa

SEQ ID NO: 955860 - DNA, 25 bp, Mus musculus
ttggctgacctcgtcacagaggtaa

SEQ ID NO: 955861 - DNA, 25 bp, Mus musculus
ttggctgactgcaccctggtcctgg

SEQ ID NO: 955862 - DNA, 25 bp, Mus musculus
ttggctgactgctccctggtcctgg

SEQ ID NO: 955863 - DNA, 25 bp, Mus musculus
ttggctgacttgattcaaccaggca

SEQ ID NO: 955864 - DNA, 25 bp, Mus musculus
ttggctgacttgtttcaaccaggca

SEQ ID NO: 955865 - DNA, 25 bp, Mus musculus
ttggctgaggccatatattggaagt

SEQ ID NO: 955866 - DNA, 25 bp, Mus musculus
ttggctgaggccttatattggaagt

SEQ ID NO: 955867 - DNA, 25 bp, Mus musculus
ttggctgagggtccatagccctgct

SEQ ID NO: 955868 - DNA, 25 bp, Mus musculus
ttggctgagggtgcatagccctgct

SEQ ID NO: 955869 - DNA, 25 bp, Mus musculus
ttggctgagtggacccagcgtctct

SEQ ID NO: 955870 - DNA, 25 bp, Mus musculus
ttggctgagtggtcccagcgtctct

SEQ ID NO: 955871 - DNA, 25 bp, Mus musculus
ttggctgatagcaaagtcctcctta

SEQ ID NO: 955872 - DNA, 25 bp, Mus musculus
ttggctgatagctaagtcctcctta

SEQ ID NO: 955873 - DNA, 25 bp, Mus musculus
ttggctgatctactagccttcccag

SEQ ID NO: 955874 - DNA, 25 bp, Mus musculus
ttggctgatctagtagccttcccag

SEQ ID NO: 955875 - DNA, 25 bp, Mus musculus
ttggctgcaataaacacactgtctc

SEQ ID NO: 955876 - DNA, 25 bp, Mus musculus
ttggctgcaatatacacactgtctc

SEQ ID NO: 955877 - DNA, 25 bp, Mus musculus
ttggctgcactgcaccagtattgag

SEQ ID NO: 955878 - DNA, 25 bp, Mus musculus
ttggctgcactggaccagtattgag

SEQ ID NO: 955879 - DNA, 25 bp, Mus musculus
ttggctgcagaaactgggttccctc

SEQ ID NO: 955880 - DNA, 25 bp, Mus musculus
ttggctgcagaatctgggttccctc

SEQ ID NO: 955881 - DNA, 25 bp, Mus musculus
ttggctgcattcctcttcccattct

SEQ ID NO: 955882 - DNA, 25 bp, Mus musculus
ttggctgcattcgtcttcccattct

SEQ ID NO: 955883 - DNA, 25 bp, Mus musculus
ttggctgccactaggaccgctactg

SEQ ID NO: 955884 - DNA, 25 bp, Mus musculus
ttggctgccacttggaccgctactg

SEQ ID NO: 955885 - DNA, 25 bp, Mus musculus
ttggctgccagcattgctcattgat

SEQ ID NO: 955886 - DNA, 25 bp, Mus musculus
ttggctgccagccatgactacagag

SEQ ID NO: 955887 - DNA, 25 bp, Mus musculus
ttggctgccagcgatgactacagag

SEQ ID NO: 955888 - DNA, 25 bp, Mus musculus
ttggctgccagctttgctcattgat

SEQ ID NO: 955889 - DNA, 25 bp, Mus musculus
ttggctgcctccattttgaaggcta

SEQ ID NO: 955890 - DNA, 25 bp, Mus musculus
ttggctgcctcctttttgaaggcta

SEQ ID NO: 955891 - DNA, 25 bp, Mus musculus
ttggctgcctggaagaaccttatct

SEQ ID NO: 955892 - DNA, 25 bp, Mus musculus
ttggctgcctggtagaaccttatct

SEQ ID NO: 955893 - DNA, 25 bp, Mus musculus
ttggctgctaggagtcagtgctcag

SEQ ID NO: 955894 - DNA, 25 bp, Mus musculus
ttggctgctaggtgtcagtgctcag

SEQ ID NO: 955895 - DNA, 25 bp, Mus musculus
ttggctggacttagggccctacatc

SEQ ID NO: 955896 - DNA, 25 bp, Mus musculus
ttggctggactttgggccctacatc

SEQ ID NO: 955897 - DNA, 25 bp, Mus musculus
ttggctggatccacctatctttatg

SEQ ID NO: 955898 - DNA, 25 bp, Mus musculus
ttggctggatccactaggcatggag

SEQ ID NO: 955899 - DNA, 25 bp, Mus musculus
ttggctggatcctcctatctttatg

SEQ ID NO: 955900 - DNA, 25 bp, Mus musculus
ttggctggatcctctaggcatggag

SEQ ID NO: 955901 - DNA, 25 bp, Mus musculus
ttggctggccacagttgatatgtca

SEQ ID NO: 955902 - DNA, 25 bp, Mus musculus
ttggctggccactgttgatatgtca

SEQ ID NO: 955903 - DNA, 25 bp, Mus musculus
ttggctgggacaaggaaatatttct

SEQ ID NO: 955904 - DNA, 25 bp, Mus musculus
ttggctgggacatggaaatatttct

SEQ ID NO: 955905 - DNA, 25 bp, Mus musculus
ttggctggtcaacttgaacactgtt

SEQ ID NO: 955906 - DNA, 25 bp, Mus musculus
ttggctggtcaagttgaacactgtt

SEQ ID NO: 955907 - DNA, 25 bp, Mus musculus
ttggctggtcccagcgtctctgaat

SEQ ID NO: 955908 - DNA, 25 bp, Mus musculus
ttggctggtccctgcgtctctgaat

SEQ ID NO: 955909 - DNA, 25 bp, Mus musculus
ttggctggtctgagcttccgtgagc

SEQ ID NO: 955910 - DNA, 25 bp, Mus musculus
ttggctggtctgtgcttccgtgagc

SEQ ID NO: 955911 - DNA, 25 bp, Mus musculus
ttggctggtggaacccttggagatc

SEQ ID NO: 955912 - DNA, 25 bp, Mus musculus
ttggctggtggatcccttggagatc

SEQ ID NO: 955913 - DNA, 25 bp, Mus musculus
ttggctggtgttcagtaactctgtg

SEQ ID NO: 955914 - DNA, 25 bp, Mus musculus
ttggctggtgttgagtaactctgtg

SEQ ID NO: 955915 - DNA, 25 bp, Mus musculus
ttggctggttccataccttgggtct

SEQ ID NO: 955916 - DNA, 25 bp, Mus musculus
ttggctggttccttaccttgggtct

SEQ ID NO: 955917 - DNA, 25 bp, Mus musculus
ttggctgtaggcataatgtagtgaa

SEQ ID NO: 955918 - DNA, 25 bp, Mus musculus
ttggctgtaggcttaatgtagtgaa

SEQ ID NO: 955919 - DNA, 25 bp, Mus musculus
ttggctgtcaatacattaatgtatg

SEQ ID NO: 955920 - DNA, 25 bp, Mus musculus
ttggctgtcaattcattaatgtatg

SEQ ID NO: 955921 - DNA, 25 bp, Mus musculus
ttggctgtcacacctggatcacttg

SEQ ID NO: 955922 - DNA, 25 bp, Mus musculus
ttggctgtcacagctggatcacttg

SEQ ID NO: 955923 - DNA, 25 bp, Mus musculus
ttggctgtcagaactgtaatcataa

SEQ ID NO: 955924 - DNA, 25 bp, Mus musculus
ttggctgtcagatctgtaatcataa

SEQ ID NO: 955925 - DNA, 25 bp, Mus musculus
ttggctgtcaggaaggtgtctaaac

SEQ ID NO: 955926 - DNA, 25 bp, Mus musculus
ttggctgtcaggctgggctttccac

SEQ ID NO: 955927 - DNA, 25 bp, Mus musculus
ttggctgtcagggtgggctttccac

SEQ ID NO: 955928 - DNA, 25 bp, Mus musculus
ttggctgtcaggtaggtgtctaaac

SEQ ID NO: 955929 - DNA, 25 bp, Mus musculus
ttggctgtcagtaccggtgcatcag

SEQ ID NO: 955930 - DNA, 25 bp, Mus musculus
ttggctgtcagttccggtgcatcag

SEQ ID NO: 955931 - DNA, 25 bp, Mus musculus
ttggctgtcctgaggctgttggcct

SEQ ID NO: 955932 - DNA, 25 bp, Mus musculus
ttggctgtcctgtggctgttggcct

SEQ ID NO: 955933 - DNA, 25 bp, Mus musculus
ttggctgtctgcctccgagtgccag

SEQ ID NO: 955934 - DNA, 25 bp, Mus musculus
ttggctgtctgcgtccgagtgccag

SEQ ID NO: 955935 - DNA, 25 bp, Mus musculus
ttggctgtcttcatgcttgaataac

SEQ ID NO: 955936 - DNA, 25 bp, Mus musculus
ttggctgtcttcttgcttgaataac

SEQ ID NO: 955937 - DNA, 25 bp, Mus musculus
ttggctgtgacaacgatgctcctta

SEQ ID NO: 955938 - DNA, 25 bp, Mus musculus
ttggctgtgacatcgatgctcctta

SEQ ID NO: 955939 - DNA, 25 bp, Mus musculus
ttggctgtgcacagaatgtggtaaa

SEQ ID NO: 955940 - DNA, 25 bp, Mus musculus
ttggctgtgcactgaatgtggtaaa

SEQ ID NO: 955941 - DNA, 25 bp, Mus musculus
ttggctgtgcagcaactggaaacag

SEQ ID NO: 955942 - DNA, 25 bp, Mus musculus
ttggctgtgcagcacctttggtaat

SEQ ID NO: 955943 - DNA, 25 bp, Mus musculus
ttggctgtgcaggaactggaaacag

SEQ ID NO: 955944 - DNA, 25 bp, Mus musculus
ttggctgtgcaggacctttggtaat

SEQ ID NO: 955945 - DNA, 25 bp, Mus musculus
ttggctgtgccacaaataaccccag

SEQ ID NO: 955946 - DNA, 25 bp, Mus musculus
ttggctgtgccagaaataaccccag

SEQ ID NO: 955947 - DNA, 25 bp, Mus musculus
ttggctgtggacaatctgtgtttga

SEQ ID NO: 955948 - DNA, 25 bp, Mus musculus
ttggctgtggactatctgtgtttga

SEQ ID NO: 955949 - DNA, 25 bp, Mus musculus
ttggctgtgtgaagccaagccactt

SEQ ID NO: 955950 - DNA, 25 bp, Mus musculus
ttggctgtgtgatgccaagccactt

SEQ ID NO: 955951 - DNA, 25 bp, Mus musculus
ttggctgttgcgatttccagcagta

SEQ ID NO: 955952 - DNA, 25 bp, Mus musculus
ttggctgttgcgttttccagcagta

SEQ ID NO: 955953 - DNA, 25 bp, Mus musculus
ttggctgttggacctctggatcctg

SEQ ID NO: 955954 - DNA, 25 bp, Mus musculus
ttggctgttggagctctggatcctg

SEQ ID NO: 955955 - DNA, 25 bp, Mus musculus
ttggctgttgtgctccatctaacaa

SEQ ID NO: 955956 - DNA, 25 bp, Mus musculus
ttggctgttgtggtccatctaacaa

SEQ ID NO: 955957 - DNA, 25 bp, Mus musculus
ttggctgtttaaactcttcccacaa

SEQ ID NO: 955958 - DNA, 25 bp, Mus musculus
ttggctgtttaatctcttcccacaa

SEQ ID NO: 955959 - DNA, 25 bp, Mus musculus
ttggctgtttaccatcattttccct

SEQ ID NO: 955960 - DNA, 25 bp, Mus musculus
ttggctgtttacgatcattttccct

SEQ ID NO: 955961 - DNA, 25 bp, Mus musculus
ttggcttaactcctagcacctacat

SEQ ID NO: 955962 - DNA, 25 bp, Mus musculus
ttggcttaactcgtagcacctacat

SEQ ID NO: 955963 - DNA, 25 bp, Mus musculus
ttggcttaactgaaactgctagtac

SEQ ID NO: 955964 - DNA, 25 bp, Mus musculus
ttggcttaactgtaactgctagtac

SEQ ID NO: 955965 - DNA, 25 bp, Mus musculus
ttggcttaatacctacttatcagtg

SEQ ID NO: 955966 - DNA, 25 bp, Mus musculus
ttggcttaatacgtacttatcagtg

SEQ ID NO: 955967 - DNA, 25 bp, Mus musculus
ttggcttacaagcaccgtggcattt

SEQ ID NO: 955968 - DNA, 25 bp, Mus musculus
ttggcttacaaggaccgtggcattt

SEQ ID NO: 955969 - DNA, 25 bp, Mus musculus
ttggcttacattatccctacaatgg

SEQ ID NO: 955970 - DNA, 25 bp, Mus musculus
ttggcttacattttccctacaatgg

SEQ ID NO: 955971 - DNA, 25 bp, Mus musculus
ttggcttacctcagcattttcttac

SEQ ID NO: 955972 - DNA, 25 bp, Mus musculus
ttggcttacctctgcattttcttac

SEQ ID NO: 955973 - DNA, 25 bp, Mus musculus
ttggcttactagagtctgcccaccc

SEQ ID NO: 955974 - DNA, 25 bp, Mus musculus
ttggcttactagtgtctgcccaccc

SEQ ID NO: 955975 - DNA, 25 bp, Mus musculus
ttggcttactggctctgacctcggc

SEQ ID NO: 955976 - DNA, 25 bp, Mus musculus
ttggcttactgggtctgacctcggc

SEQ ID NO: 955977 - DNA, 25 bp, Mus musculus
ttggcttagaccataatcctctgct

SEQ ID NO: 955978 - DNA, 25 bp, Mus musculus
ttggcttagaccttaatcctctgct

SEQ ID NO: 955979 - DNA, 25 bp, Mus musculus
ttggcttagatcctccagttcctgt

SEQ ID NO: 955980 - DNA, 25 bp, Mus musculus
ttggcttagatcgtccagttcctgt

SEQ ID NO: 955981 - DNA, 25 bp, Mus musculus
ttggcttagcaactaaagaccagtt

SEQ ID NO: 955982 - DNA, 25 bp, Mus musculus
ttggcttagcaagtaaagaccagtt

SEQ ID NO: 955983 - DNA, 25 bp, Mus musculus
ttggcttatgcacttttcccttact

SEQ ID NO: 955984 - DNA, 25 bp, Mus musculus
ttggcttatgcagttttcccttact

SEQ ID NO: 955985 - DNA, 25 bp, Mus musculus
ttggcttattgtcccattttcatac

SEQ ID NO: 955986 - DNA, 25 bp, Mus musculus
ttggcttattgtgccattttcatac

SEQ ID NO: 955987 - DNA, 25 bp, Mus musculus
ttggcttcaagcaaaccttaatgga

SEQ ID NO: 955988 - DNA, 25 bp, Mus musculus
ttggcttcaagctaaccttaatgga

SEQ ID NO: 955989 - DNA, 25 bp, Mus musculus
ttggcttcaagtcaactcccggatg

SEQ ID NO: 955990 - DNA, 25 bp, Mus musculus
ttggcttcaagtgaactcccggatg

SEQ ID NO: 955991 - DNA, 25 bp, Mus musculus
ttggcttcagaacaagacgctcctt

SEQ ID NO: 955992 - DNA, 25 bp, Mus musculus
ttggcttcagaagaagacgctcctt

SEQ ID NO: 955993 - DNA, 25 bp, Mus musculus
ttggcttcagttagctcttcagata

SEQ ID NO: 955994 - DNA, 25 bp, Mus musculus
ttggcttcagtttgctcttcagata

SEQ ID NO: 955995 - DNA, 25 bp, Mus musculus
ttggcttcataccacactttttgtg

SEQ ID NO: 955996 - DNA, 25 bp, Mus musculus
ttggcttcatacgacactttttgtg

SEQ ID NO: 955997 - DNA, 25 bp, Mus musculus
ttggcttccaagacagtgttgctgc

SEQ ID NO: 955998 - DNA, 25 bp, Mus musculus
ttggcttccaagtcagtgttgctgc

SEQ ID NO: 955999 - DNA, 25 bp, Mus musculus
ttggcttccgaaccactgaaggttt

SEQ ID NO: 956000 - DNA, 25 bp, Mus musculus
ttggcttccgaagcactgaaggttt

SEQ ID NO: 956001 - DNA, 25 bp, Mus musculus
ttggcttccgtgaaacttcaagtta

SEQ ID NO: 956002 - DNA, 25 bp, Mus musculus
ttggcttccgtgctgtggccttcct

SEQ ID NO: 956003 - DNA, 25 bp, Mus musculus
ttggcttccgtggtgtggccttcct

SEQ ID NO: 956004 - DNA, 25 bp, Mus musculus
ttggcttccgtgtaacttcaagtta

SEQ ID NO: 956005 - DNA, 25 bp, Mus musculus
ttggcttcgagcagtggcatggtaa

SEQ ID NO: 956006 - DNA, 25 bp, Mus musculus
ttggcttcgagctgtggcatggtaa

SEQ ID NO: 956007 - DNA, 25 bp, Mus musculus
ttggcttctcggcttctcactctta

SEQ ID NO: 956008 - DNA, 25 bp, Mus musculus
ttggcttctcgggttctcactctta

SEQ ID NO: 956009 - DNA, 25 bp, Mus musculus
ttggcttctgcaaccgagtcctcat

SEQ ID NO: 956010 - DNA, 25 bp, Mus musculus
ttggcttctgcactacttcatttga

SEQ ID NO: 956011 - DNA, 25 bp, Mus musculus
ttggcttctgcagtacttcatttga

SEQ ID NO: 956012 - DNA, 25 bp, Mus musculus
ttggcttctgcatccgagtcctcat

SEQ ID NO: 956013 - DNA, 25 bp, Mus musculus
ttggcttctggaaccatcagtggat

SEQ ID NO: 956014 - DNA, 25 bp, Mus musculus
ttggcttctggatccatcagtggat

SEQ ID NO: 956015 - DNA, 25 bp, Mus musculus
ttggcttctggtcacatcgtttatg

SEQ ID NO: 956016 - DNA, 25 bp, Mus musculus
ttggcttctggtgacatcgtttatg

SEQ ID NO: 956017 - DNA, 25 bp, Mus musculus
ttggcttcttcccaggtatgcctgt

SEQ ID NO: 956018 - DNA, 25 bp, Mus musculus
ttggcttcttccgaggtatgcctgt

SEQ ID NO: 956019 - DNA, 25 bp, Mus musculus
ttggcttgatagctgccctaagggt

SEQ ID NO: 956020 - DNA, 25 bp, Mus musculus
ttggcttgataggtgccctaagggt

SEQ ID NO: 956021 - DNA, 25 bp, Mus musculus
ttggcttgctcacagctgcctgtaa

SEQ ID NO: 956022 - DNA, 25 bp, Mus musculus
ttggcttgctcagagctgcctgtaa

SEQ ID NO: 956023 - DNA, 25 bp, Mus musculus
ttggcttggagcctgaaggccccat

SEQ ID NO: 956024 - DNA, 25 bp, Mus musculus
ttggcttggagcgtgaaggccccat

SEQ ID NO: 956025 - DNA, 25 bp, Mus musculus
ttggcttggcttactagtacacaca

SEQ ID NO: 956026 - DNA, 25 bp, Mus musculus
ttggcttggctttctagtacacaca

SEQ ID NO: 956027 - DNA, 25 bp, Mus musculus
ttggcttgggacagttaaatacttc

SEQ ID NO: 956028 - DNA, 25 bp, Mus musculus
ttggcttgggactgttaaatacttc

SEQ ID NO: 956029 - DNA, 25 bp, Mus musculus
ttggcttgggatccagagatgtcca

SEQ ID NO: 956030 - DNA, 25 bp, Mus musculus
ttggcttgggatgcagagatgtcca

SEQ ID NO: 956031 - DNA, 25 bp, Mus musculus
ttggcttgggtacctgtttcacagt

SEQ ID NO: 956032 - DNA, 25 bp, Mus musculus
ttggcttgggtagctgtttcacagt

SEQ ID NO: 956033 - DNA, 25 bp, Mus musculus
ttggcttgggttagcttggtcttgt

SEQ ID NO: 956034 - DNA, 25 bp, Mus musculus
ttggcttgggtttgcttggtcttgt

SEQ ID NO: 956035 - DNA, 25 bp, Mus musculus
ttggcttggtttacacgtggctggc

SEQ ID NO: 956036 - DNA, 25 bp, Mus musculus
ttggcttggttttcacgtggctggc

SEQ ID NO: 956037 - DNA, 25 bp, Mus musculus
ttggcttgtagcctgactatagcaa

SEQ ID NO: 956038 - DNA, 25 bp, Mus musculus
ttggcttgtagcgtgactatagcaa

SEQ ID NO: 956039 - DNA, 25 bp, Mus musculus
ttggcttgtggcactccgttcggtg

SEQ ID NO: 956040 - DNA, 25 bp, Mus musculus
ttggcttgtggctctccgttcggtg

SEQ ID NO: 956041 - DNA, 25 bp, Mus musculus
ttggcttgtggtcttgtgatgcact

SEQ ID NO: 956042 - DNA, 25 bp, Mus musculus
ttggcttgtggtgttgtgatgcact

SEQ ID NO: 956043 - DNA, 25 bp, Mus musculus
ttggcttgttgaagggcactcttca

SEQ ID NO: 956044 - DNA, 25 bp, Mus musculus
ttggcttgttgatgggcactcttca

SEQ ID NO: 956045 - DNA, 25 bp, Mus musculus
ttggctttaaaaacaccctctcaca

SEQ ID NO: 956046 - DNA, 25 bp, Mus musculus
ttggctttaaaatcaccctctcaca

SEQ ID NO: 956047 - DNA, 25 bp, Mus musculus
ttggctttaacacagtctgacccag

SEQ ID NO: 956048 - DNA, 25 bp, Mus musculus
ttggctttaacagagtctgacccag

SEQ ID NO: 956049 - DNA, 25 bp, Mus musculus
ttggctttatacaccacttttctca

SEQ ID NO: 956050 - DNA, 25 bp, Mus musculus
ttggctttatactccacttttctca

SEQ ID NO: 956051 - DNA, 25 bp, Mus musculus
ttggctttatatacgttctgtgggt

SEQ ID NO: 956052 - DNA, 25 bp, Mus musculus
ttggctttatattcgttctgtgggt

SEQ ID NO: 956053 - DNA, 25 bp, Mus musculus
ttggctttattcacattgtcttttg

SEQ ID NO: 956054 - DNA, 25 bp, Mus musculus
ttggctttattctcattgtcttttg

SEQ ID NO: 956055 - DNA, 25 bp, Mus musculus
ttggctttcagacacacctaccagc

SEQ ID NO: 956056 - DNA, 25 bp, Mus musculus
ttggctttcagagacacctaccagc

SEQ ID NO: 956057 - DNA, 25 bp, Mus musculus
ttggctttccaaccctgacatttgg

SEQ ID NO: 956058 - DNA, 25 bp, Mus musculus
ttggctttccaacggtggctttcac

SEQ ID NO: 956059 - DNA, 25 bp, Mus musculus
ttggctttccaagcctgacatttgg

SEQ ID NO: 956060 - DNA, 25 bp, Mus musculus
ttggctttccaagggtggctttcac

SEQ ID NO: 956061 - DNA, 25 bp, Mus musculus
ttggctttcccacatcacgaaaatg

SEQ ID NO: 956062 - DNA, 25 bp, Mus musculus
ttggctttcccagatcacgaaaatg

SEQ ID NO: 956063 - DNA, 25 bp, Mus musculus
ttggctttccctacatgcagtgtat

SEQ ID NO: 956064 - DNA, 25 bp, Mus musculus
ttggctttcccttcatgcagtgtat

SEQ ID NO: 956065 - DNA, 25 bp, Mus musculus
ttggctttgatcaacaatgaagctc

SEQ ID NO: 956066 - DNA, 25 bp, Mus musculus
ttggctttgatctacaatgaagctc

SEQ ID NO: 956067 - DNA, 25 bp, Mus musculus
ttggctttgcctaaatcctcttact

SEQ ID NO: 956068 - DNA, 25 bp, Mus musculus
ttggctttgcctctatgctacctta

SEQ ID NO: 956069 - DNA, 25 bp, Mus musculus
ttggctttgcctgtatgctacctta

SEQ ID NO: 956070 - DNA, 25 bp, Mus musculus
ttggctttgccttaatcctcttact

SEQ ID NO: 956071 - DNA, 25 bp, Mus musculus
ttggctttgggtctgcttcttgcca

SEQ ID NO: 956072 - DNA, 25 bp, Mus musculus
ttggctttgggtgtgcttcttgcca

SEQ ID NO: 956073 - DNA, 25 bp, Mus musculus
ttggctttgtgcctcatatcctatt

SEQ ID NO: 956074 - DNA, 25 bp, Mus musculus
ttggctttgtgcgtcatatcctatt

SEQ ID NO: 956075 - DNA, 25 bp, Mus musculus
ttggctttgttaacttccgagaaat

SEQ ID NO: 956076 - DNA, 25 bp, Mus musculus
ttggctttgttatcttccgagaaat

SEQ ID NO: 956077 - DNA, 25 bp, Mus musculus
ttggcttttatcatgctaatatttg

SEQ ID NO: 956078 - DNA, 25 bp, Mus musculus
ttggcttttatcttgctaatatttg

SEQ ID NO: 956079 - DNA, 25 bp, Mus musculus
ttggcttttccaagttggaccatcc

SEQ ID NO: 956080 - DNA, 25 bp, Mus musculus
ttggcttttccatgttggaccatcc

SEQ ID NO: 956081 - DNA, 25 bp, Mus musculus
ttggcttttcctataggccctatgt

SEQ ID NO: 956082 - DNA, 25 bp, Mus musculus
ttggcttttcctttaggccctatgt

SEQ ID NO: 956083 - DNA, 25 bp, Mus musculus
ttggcttttcttaacattccttcct

SEQ ID NO: 956084 - DNA, 25 bp, Mus musculus
ttggcttttctttacattccttcct

SEQ ID NO: 956085 - DNA, 25 bp, Mus musculus
ttggcttttgatatgaccctaacct

SEQ ID NO: 956086 - DNA, 25 bp, Mus musculus
ttggcttttgatttgaccctaacct

SEQ ID NO: 956087 - DNA, 25 bp, Mus musculus
ttggctttttctccagatacctcac

SEQ ID NO: 956088 - DNA, 25 bp, Mus musculus
ttggctttttctgcagatacctcac

SEQ ID NO: 956089 - DNA, 25 bp, Mus musculus
ttggctttttgaatacagacttgca

SEQ ID NO: 956090 - DNA, 25 bp, Mus musculus
ttggctttttgattacagacttgca

SEQ ID NO: 956091 - DNA, 25 bp, Mus musculus
ttggctttttggcatacggtctcac

SEQ ID NO: 956092 - DNA, 25 bp, Mus musculus
ttggctttttgggatacggtctcac

SEQ ID NO: 956093 - DNA, 25 bp, Mus musculus
ttgggaaaaacaccctctccgtact

SEQ ID NO: 956094 - DNA, 25 bp, Mus musculus
ttgggaaaaacacgcctctctttga

SEQ ID NO: 956095 - DNA, 25 bp, Mus musculus
ttgggaaaaacagcctctccgtact

SEQ ID NO: 956096 - DNA, 25 bp, Mus musculus
ttgggaaaaacaggcctctctttga

SEQ ID NO: 956097 - DNA, 25 bp, Mus musculus
ttgggaaacactaagctccagcctc

SEQ ID NO: 956098 - DNA, 25 bp, Mus musculus
ttgggaaacacttagctccagcctc

SEQ ID NO: 956099 - DNA, 25 bp, Mus musculus
ttgggaaacatgcacccatcctgcc

SEQ ID NO: 956100 - DNA, 25 bp, Mus musculus
ttgggaaacatggacccatcctgcc

SEQ ID NO: 956101 - DNA, 25 bp, Mus musculus
ttgggaaaccccatacatgtataag

SEQ ID NO: 956102 - DNA, 25 bp, Mus musculus
ttgggaaaccccttacatgtataag

SEQ ID NO: 956103 - DNA, 25 bp, Mus musculus
ttgggaaaccctcccatccacattt

SEQ ID NO: 956104 - DNA, 25 bp, Mus musculus
ttgggaaaccctgccatccacattt

SEQ ID NO: 956105 - DNA, 25 bp, Mus musculus
ttgggaaagaccatcttttgtttat

SEQ ID NO: 956106 - DNA, 25 bp, Mus musculus
ttgggaaagaccttcttttgtttat

SEQ ID NO: 956107 - DNA, 25 bp, Mus musculus
ttgggaaagactctttaccaatact

SEQ ID NO: 956108 - DNA, 25 bp, Mus musculus
ttgggaaagactgtttaccaatact

SEQ ID NO: 956109 - DNA, 25 bp, Mus musculus
ttgggaaagtccaacttcctctgta

SEQ ID NO: 956110 - DNA, 25 bp, Mus musculus
ttgggaaagtcctacttcctctgta

SEQ ID NO: 956111 - DNA, 25 bp, Mus musculus
ttgggaaatgctatggtgtgtaaca

SEQ ID NO: 956112 - DNA, 25 bp, Mus musculus
ttgggaaatgctttggtgtgtaaca

SEQ ID NO: 956113 - DNA, 25 bp, Mus musculus
ttgggaaatgtaccatctcctggcc

SEQ ID NO: 956114 - DNA, 25 bp, Mus musculus
ttgggaaatgtagcatctcctggcc

SEQ ID NO: 956115 - DNA, 25 bp, Mus musculus
ttgggaaattggcacgctgctccct

SEQ ID NO: 956116 - DNA, 25 bp, Mus musculus
ttgggaaattgggacgctgctccct

SEQ ID NO: 956117 - DNA, 25 bp, Mus musculus
ttgggaacactgattggctctgcca

SEQ ID NO: 956118 - DNA, 25 bp, Mus musculus
ttgggaacactgtttggctctgcca

SEQ ID NO: 956119 - DNA, 25 bp, Mus musculus
ttgggaacccctcacattttcaaag

SEQ ID NO: 956120 - DNA, 25 bp, Mus musculus
ttgggaacccctgacattttcaaag

SEQ ID NO: 956121 - DNA, 25 bp, Mus musculus
ttgggaaccctgcagcttttagaga

SEQ ID NO: 956122 - DNA, 25 bp, Mus musculus
ttgggaaccctggagcttttagaga

SEQ ID NO: 956123 - DNA, 25 bp, Mus musculus
ttgggaacctgcagtgggccctcca

SEQ ID NO: 956124 - DNA, 25 bp, Mus musculus
ttgggaacctgctgtgggccctcca

SEQ ID NO: 956125 - DNA, 25 bp, Mus musculus
ttgggaacgggcagggccaccttct

SEQ ID NO: 956126 - DNA, 25 bp, Mus musculus
ttgggaacgggctgggccaccttct

SEQ ID NO: 956127 - DNA, 25 bp, Mus musculus
ttgggaactaacagccttcactttc

SEQ ID NO: 956128 - DNA, 25 bp, Mus musculus
ttgggaactaactgccttcactttc

SEQ ID NO: 956129 - DNA, 25 bp, Mus musculus
ttgggaactcctagcttcattctcc

SEQ ID NO: 956130 - DNA, 25 bp, Mus musculus
ttgggaactccttgcttcattctcc

SEQ ID NO: 956131 - DNA, 25 bp, Mus musculus
ttgggaactgcccagcaagttctgg

SEQ ID NO: 956132 - DNA, 25 bp, Mus musculus
ttgggaactgccgagcaagttctgg

SEQ ID NO: 956133 - DNA, 25 bp, Mus musculus
ttgggaactggactcaccctagcag

SEQ ID NO: 956134 - DNA, 25 bp, Mus musculus
ttgggaactggagtcaccctagcag

SEQ ID NO: 956135 - DNA, 25 bp, Mus musculus
ttgggaacttaaaatcacttgcatt

SEQ ID NO: 956136 - DNA, 25 bp, Mus musculus
ttgggaacttaatatcacttgcatt

SEQ ID NO: 956137 - DNA, 25 bp, Mus musculus
ttgggaagagccagatattttgaca

SEQ ID NO: 956138 - DNA, 25 bp, Mus musculus
ttgggaagagcctgatattttgaca

SEQ ID NO: 956139 - DNA, 25 bp, Mus musculus
ttgggaagcaccagcatgtatcacc

SEQ ID NO: 956140 - DNA, 25 bp, Mus musculus
ttgggaagcacctgcatgtatcacc

SEQ ID NO: 956141 - DNA, 25 bp, Mus musculus
ttgggaagccaactcctaggcttgt

SEQ ID NO: 956142 - DNA, 25 bp, Mus musculus
ttgggaagccaagtcctaggcttgt

SEQ ID NO: 956143 - DNA, 25 bp, Mus musculus
ttgggaagcccaagcgcagcagatc

SEQ ID NO: 956144 - DNA, 25 bp, Mus musculus
ttgggaagcccatgcgcagcagatc

SEQ ID NO: 956145 - DNA, 25 bp, Mus musculus
ttgggaagcctcagacccgccagga

SEQ ID NO: 956146 - DNA, 25 bp, Mus musculus
ttgggaagcctctgacccgccagga

SEQ ID NO: 956147 - DNA, 25 bp, Mus musculus
ttgggaagctttcgccagggctaac

SEQ ID NO: 956148 - DNA, 25 bp, Mus musculus
ttgggaagctttggccagggctaac

SEQ ID NO: 956149 - DNA, 25 bp, Mus musculus
ttgggaaggcttcttgttgtgtacc

SEQ ID NO: 956150 - DNA, 25 bp, Mus musculus
ttgggaaggcttgttgttgtgtacc

SEQ ID NO: 956151 - DNA, 25 bp, Mus musculus
ttgggaaggtccatgcccaacactg

SEQ ID NO: 956152 - DNA, 25 bp, Mus musculus
ttgggaaggtccttgcccaacactg

SEQ ID NO: 956153 - DNA, 25 bp, Mus musculus
ttgggaaggtgcaccgtagccattc

SEQ ID NO: 956154 - DNA, 25 bp, Mus musculus
ttgggaaggtgctccgtagccattc

SEQ ID NO: 956155 - DNA, 25 bp, Mus musculus
ttgggaagtcagatcacgctccaag

SEQ ID NO: 956156 - DNA, 25 bp, Mus musculus
ttgggaagtcagttcacgctccaag

SEQ ID NO: 956157 - DNA, 25 bp, Mus musculus
ttgggaagtctcactattcttctct

SEQ ID NO: 956158 - DNA, 25 bp, Mus musculus
ttgggaagtctctctattcttctct

SEQ ID NO: 956159 - DNA, 25 bp, Mus musculus
ttgggaataccgacaacctcacaag

SEQ ID NO: 956160 - DNA, 25 bp, Mus musculus
ttgggaataccgtcaacctcacaag

SEQ ID NO: 956161 - DNA, 25 bp, Mus musculus
ttgggaatatagagcaaagagagag

SEQ ID NO: 956162 - DNA, 25 bp, Mus musculus
ttgggaatatagtgcaaagagagag

SEQ ID NO: 956163 - DNA, 25 bp, Mus musculus
ttgggaatcccaagaatttcccctg

SEQ ID NO: 956164 - DNA, 25 bp, Mus musculus
ttgggaatcccatgaatttcccctg

SEQ ID NO: 956165 - DNA, 25 bp, Mus musculus
ttgggaatccctactcttcataata

SEQ ID NO: 956166 - DNA, 25 bp, Mus musculus
ttgggaatcccttctcttcataata

SEQ ID NO: 956167 - DNA, 25 bp, Mus musculus
ttgggaatgccaagaatttcccctg

SEQ ID NO: 956168 - DNA, 25 bp, Mus musculus
ttgggaatgccatgaatttcccctg

SEQ ID NO: 956169 - DNA, 25 bp, Mus musculus
ttgggaattaacatcctcccacacc

SEQ ID NO: 956170 - DNA, 25 bp, Mus musculus
ttgggaattaacttcctcccacacc

SEQ ID NO: 956171 - DNA, 25 bp, Mus musculus
ttgggaattcctccgtggcgacttt

SEQ ID NO: 956172 - DNA, 25 bp, Mus musculus
ttgggaattcctgcgtggcgacttt

SEQ ID NO: 956173 - DNA, 25 bp, Mus musculus
ttgggaattgatatcctaagtgaat

SEQ ID NO: 956174 - DNA, 25 bp, Mus musculus
ttgggaattgatttcctaagtgaat

SEQ ID NO: 956175 - DNA, 25 bp, Mus musculus
ttgggaattgtcaatctgctgttgc

SEQ ID NO: 956176 - DNA, 25 bp, Mus musculus
ttgggaattgtctatctgctgttgc

SEQ ID NO: 956177 - DNA, 25 bp, Mus musculus
ttgggaatttgaacttgaagttgct

SEQ ID NO: 956178 - DNA, 25 bp, Mus musculus
ttgggaatttgatcttgaagttgct

SEQ ID NO: 956179 - DNA, 25 bp, Mus musculus
ttgggacaaactatacaaagctgga

SEQ ID NO: 956180 - DNA, 25 bp, Mus musculus
ttgggacaaactttacaaagctgga

SEQ ID NO: 956181 - DNA, 25 bp, Mus musculus
ttgggacaacatccacaagcacttg

SEQ ID NO: 956182 - DNA, 25 bp, Mus musculus
ttgggacaacatgcacaagcacttg

SEQ ID NO: 956183 - DNA, 25 bp, Mus musculus
ttgggacaacctagggctacatagt

SEQ ID NO: 956184 - DNA, 25 bp, Mus musculus
ttgggacaaccttgggctacatagt

SEQ ID NO: 956185 - DNA, 25 bp, Mus musculus
ttgggacaagccacgaaagtaagtt

SEQ ID NO: 956186 - DNA, 25 bp, Mus musculus
ttgggacaagcctcgaaagtaagtt

SEQ ID NO: 956187 - DNA, 25 bp, Mus musculus
ttgggacaatccacttcaatctgtt

SEQ ID NO: 956188 - DNA, 25 bp, Mus musculus
ttgggacaatcctcttcaatctgtt

SEQ ID NO: 956189 - DNA, 25 bp, Mus musculus
ttgggacacagcaggttccgagcgc

SEQ ID NO: 956190 - DNA, 25 bp, Mus musculus
ttgggacacagctggttccgagcgc

SEQ ID NO: 956191 - DNA, 25 bp, Mus musculus
ttgggacaccatacatcatcatctt

SEQ ID NO: 956192 - DNA, 25 bp, Mus musculus
ttgggacaccattcatcatcatctt

SEQ ID NO: 956193 - DNA, 25 bp, Mus musculus
ttgggacacccaagaaggccttctg

SEQ ID NO: 956194 - DNA, 25 bp, Mus musculus
ttgggacacccatgaaggccttctg

SEQ ID NO: 956195 - DNA, 25 bp, Mus musculus
ttgggacaccctcacgctgagacag

SEQ ID NO: 956196 - DNA, 25 bp, Mus musculus
ttgggacaccctcgcatggttgttt

SEQ ID NO: 956197 - DNA, 25 bp, Mus musculus
ttgggacaccctgacgctgagacag

SEQ ID NO: 956198 - DNA, 25 bp, Mus musculus
ttgggacaccctggcatggttgttt

SEQ ID NO: 956199 - DNA, 25 bp, Mus musculus
ttgggacatgttcaacatcgttcgc

SEQ ID NO: 956200 - DNA, 25 bp, Mus musculus
ttgggacatgttgaacatcgttcgc

SEQ ID NO: 956201 - DNA, 25 bp, Mus musculus
ttgggacattggatacatgggttat

SEQ ID NO: 956202 - DNA, 25 bp, Mus musculus
ttgggacattggttacatgggttat

SEQ ID NO: 956203 - DNA, 25 bp, Mus musculus
ttgggaccaaagaatacagacatca

SEQ ID NO: 956204 - DNA, 25 bp, Mus musculus
ttgggaccaaagtatacagacatca

SEQ ID NO: 956205 - DNA, 25 bp, Mus musculus
ttgggaccagcccatctggacctaa

SEQ ID NO: 956206 - DNA, 25 bp, Mus musculus
ttgggaccagccgatctggacctaa

SEQ ID NO: 956207 - DNA, 25 bp, Mus musculus
ttgggaccagtcagcagagaagcac

SEQ ID NO: 956208 - DNA, 25 bp, Mus musculus
ttgggaccagtctgcagagaagcac

SEQ ID NO: 956209 - DNA, 25 bp, Mus musculus
ttgggaccctcacatcaggcttcaa

SEQ ID NO: 956210 - DNA, 25 bp, Mus musculus
ttgggaccctcagatcaggcttcaa

SEQ ID NO: 956211 - DNA, 25 bp, Mus musculus
ttgggaccgcctcaaggtgcccgct

SEQ ID NO: 956212 - DNA, 25 bp, Mus musculus
ttgggaccgcctgaaggtgcccgct

SEQ ID NO: 956213 - DNA, 25 bp, Mus musculus
ttgggacctaagactgctgggcgtt

SEQ ID NO: 956214 - DNA, 25 bp, Mus musculus
ttgggacctaagtctgctgggcgtt

SEQ ID NO: 956215 - DNA, 25 bp, Mus musculus
ttgggacctatgactctcagggcag

SEQ ID NO: 956216 - DNA, 25 bp, Mus musculus
ttgggacctatgtctctcagggcag

SEQ ID NO: 956217 - DNA, 25 bp, Mus musculus
ttgggacctcctcaagagcatctta

SEQ ID NO: 956218 - DNA, 25 bp, Mus musculus
ttgggacctcctgaagagcatctta

SEQ ID NO: 956219 - DNA, 25 bp, Mus musculus
ttgggacctggtagccttttctatc

SEQ ID NO: 956220 - DNA, 25 bp, Mus musculus
ttgggacctggttgccttttctatc

SEQ ID NO: 956221 - DNA, 25 bp, Mus musculus
ttgggacctgtgaacctactcaagt

SEQ ID NO: 956222 - DNA, 25 bp, Mus musculus
ttgggacctgtgtacctactcaagt

SEQ ID NO: 956223 - DNA, 25 bp, Mus musculus
ttgggacgagtaaggtggctcagta

SEQ ID NO: 956224 - DNA, 25 bp, Mus musculus
ttgggacgagtatggtggctcagta

SEQ ID NO: 956225 - DNA, 25 bp, Mus musculus
ttgggacgtacaatgcatcagaaac

SEQ ID NO: 956226 - DNA, 25 bp, Mus musculus
ttgggacgtacattgcatcagaaac

SEQ ID NO: 956227 - DNA, 25 bp, Mus musculus
ttgggacgtcccctgaggactccaa

SEQ ID NO: 956228 - DNA, 25 bp, Mus musculus
ttgggacgtcccgtgaggactccaa

SEQ ID NO: 956229 - DNA, 25 bp, Mus musculus
ttgggactaggcatctgcctgacta

SEQ ID NO: 956230 - DNA, 25 bp, Mus musculus
ttgggactaggcttctgcctgacta

SEQ ID NO: 956231 - DNA, 25 bp, Mus musculus
ttgggactattaactacctctataa

SEQ ID NO: 956232 - DNA, 25 bp, Mus musculus
ttgggactattatctacctctataa

SEQ ID NO: 956233 - DNA, 25 bp, Mus musculus
ttgggactcaaccatgtacgtctct

SEQ ID NO: 956234 - DNA, 25 bp, Mus musculus
ttgggactcaacgatgtacgtctct

SEQ ID NO: 956235 - DNA, 25 bp, Mus musculus
ttgggactccttatctcttattggt

SEQ ID NO: 956236 - DNA, 25 bp, Mus musculus
ttgggactccttttctcttattggt

SEQ ID NO: 956237 - DNA, 25 bp, Mus musculus
ttgggactctgtcaagccctgctta

SEQ ID NO: 956238 - DNA, 25 bp, Mus musculus
ttgggactctgtgaagccctgctta

SEQ ID NO: 956239 - DNA, 25 bp, Mus musculus
ttgggactcttaagtgtatgccact

SEQ ID NO: 956240 - DNA, 25 bp, Mus musculus
ttgggactcttatgtgtatgccact

SEQ ID NO: 956241 - DNA, 25 bp, Mus musculus
ttgggactgaggacaagctcttctc

SEQ ID NO: 956242 - DNA, 25 bp, Mus musculus
ttgggactgaggtcaagctcttctc

SEQ ID NO: 956243 - DNA, 25 bp, Mus musculus
ttgggactgcacactgagacccttg

SEQ ID NO: 956244 - DNA, 25 bp, Mus musculus
ttgggactgcactctgagacccttg

SEQ ID NO: 956245 - DNA, 25 bp, Mus musculus
ttgggactgctgatagtatgcttca

SEQ ID NO: 956246 - DNA, 25 bp, Mus musculus
ttgggactgctgttagtatgcttca

SEQ ID NO: 956247 - DNA, 25 bp, Mus musculus
ttgggactggcacctgaattgttcc

SEQ ID NO: 956248 - DNA, 25 bp, Mus musculus
ttgggactggcagctgaattgttcc

SEQ ID NO: 956249 - DNA, 25 bp, Mus musculus
ttgggactgggccactcaaacattt

SEQ ID NO: 956250 - DNA, 25 bp, Mus musculus
ttgggactgggcgactcaaacattt

SEQ ID NO: 956251 - DNA, 25 bp, Mus musculus
ttgggactgggtccagaaaaaccag

SEQ ID NO: 956252 - DNA, 25 bp, Mus musculus
ttgggactgggtgcagaaaaaccag

SEQ ID NO: 956253 - DNA, 25 bp, Mus musculus
ttgggactggtcctgtaactgtgtc

SEQ ID NO: 956254 - DNA, 25 bp, Mus musculus
ttgggactggtcgtgtaactgtgtc

SEQ ID NO: 956255 - DNA, 25 bp, Mus musculus
ttgggactgtacactcctatctatc

SEQ ID NO: 956256 - DNA, 25 bp, Mus musculus
ttgggactgtactctcctatctatc

SEQ ID NO: 956257 - DNA, 25 bp, Mus musculus
ttgggactgtcaccgctctgctttg

SEQ ID NO: 956258 - DNA, 25 bp, Mus musculus
ttgggactgtcagcgctctgctttg

SEQ ID NO: 956259 - DNA, 25 bp, Mus musculus
ttgggactgtccatggtgtaaagct

SEQ ID NO: 956260 - DNA, 25 bp, Mus musculus
ttgggactgtccttggtgtaaagct

SEQ ID NO: 956261 - DNA, 25 bp, Mus musculus
ttgggacttattattctgattgtaa

SEQ ID NO: 956262 - DNA, 25 bp, Mus musculus
ttgggacttatttttctgattgtaa

SEQ ID NO: 956263 - DNA, 25 bp, Mus musculus
ttgggacttctcacaaatacctggg

SEQ ID NO: 956264 - DNA, 25 bp, Mus musculus
ttgggacttctctcaaatacctggg

SEQ ID NO: 956265 - DNA, 25 bp, Mus musculus
ttgggactttttctagacttacatt

SEQ ID NO: 956266 - DNA, 25 bp, Mus musculus
ttgggactttttgtagacttacatt

SEQ ID NO: 956267 - DNA, 25 bp, Mus musculus
ttgggagaagaaaaaacctgagatt

SEQ ID NO: 956268 - DNA, 25 bp, Mus musculus
ttgggagaagaataaacctgagatt

SEQ ID NO: 956269 - DNA, 25 bp, Mus musculus
ttgggagaagccagtgcgtgttctt

SEQ ID NO: 956270 - DNA, 25 bp, Mus musculus
ttgggagaagcctgtgcgtgttctt

SEQ ID NO: 956271 - DNA, 25 bp, Mus musculus
ttgggagaatgccacagcctgctgc

SEQ ID NO: 956272 - DNA, 25 bp, Mus musculus
ttgggagaatgcgacagcctgctgc

SEQ ID NO: 956273 - DNA, 25 bp, Mus musculus
ttgggagaccacctgctgataaaaa

SEQ ID NO: 956274 - DNA, 25 bp, Mus musculus
ttgggagaccacgtgctgataaaaa

SEQ ID NO: 956275 - DNA, 25 bp, Mus musculus
ttgggagactcaaatctggagactt

SEQ ID NO: 956276 - DNA, 25 bp, Mus musculus
ttgggagactcatatctggagactt

SEQ ID NO: 956277 - DNA, 25 bp, Mus musculus
ttgggagacttcctgactggaacaa

SEQ ID NO: 956278 - DNA, 25 bp, Mus musculus
ttgggagacttcgtgactggaacaa

SEQ ID NO: 956279 - DNA, 25 bp, Mus musculus
ttgggagacttgagctaggaagaca

SEQ ID NO: 956280 - DNA, 25 bp, Mus musculus
ttgggagacttgtgctaggaagaca

SEQ ID NO: 956281 - DNA, 25 bp, Mus musculus
ttgggagagcaacctccggacctca

SEQ ID NO: 956282 - DNA, 25 bp, Mus musculus
ttgggagagcaagctccggacctca

SEQ ID NO: 956283 - DNA, 25 bp, Mus musculus
ttgggagatacacccagcttccagg

SEQ ID NO: 956284 - DNA, 25 bp, Mus musculus
ttgggagatacagccagcttccagg

SEQ ID NO: 956285 - DNA, 25 bp, Mus musculus
ttgggagattaccaccaccttggag

SEQ ID NO: 956286 - DNA, 25 bp, Mus musculus
ttgggagattacgaccaccttggag

SEQ ID NO: 956287 - DNA, 25 bp, Mus musculus
ttgggagcaaacacaggctctctgg

SEQ ID NO: 956288 - DNA, 25 bp, Mus musculus
ttgggagcaaactcaggctctctgg

SEQ ID NO: 956289 - DNA, 25 bp, Mus musculus
ttgggagcacatatgcagcactttt

SEQ ID NO: 956290 - DNA, 25 bp, Mus musculus
ttgggagcacatttgcagcactttt

SEQ ID NO: 956291 - DNA, 25 bp, Mus musculus
ttgggagccattaaggcaacgctat

SEQ ID NO: 956292 - DNA, 25 bp, Mus musculus
ttgggagccatttaggcaacgctat

SEQ ID NO: 956293 - DNA, 25 bp, Mus musculus
ttgggagcccagattccagtgggtt

SEQ ID NO: 956294 - DNA, 25 bp, Mus musculus
ttgggagcccagtttccagtgggtt

SEQ ID NO: 956295 - DNA, 25 bp, Mus musculus
ttgggagccccgctcaaaactggga

SEQ ID NO: 956296 - DNA, 25 bp, Mus musculus
ttgggagccccggtcaaaactggga

SEQ ID NO: 956297 - DNA, 25 bp, Mus musculus
ttgggagccctgcttttcctcaact

SEQ ID NO: 956298 - DNA, 25 bp, Mus musculus
ttgggagccctggttttcctcaact

SEQ ID NO: 956299 - DNA, 25 bp, Mus musculus
ttgggagcctaaagccacaggcctt

SEQ ID NO: 956300 - DNA, 25 bp, Mus musculus
ttgggagcctaatgccacaggcctt

SEQ ID NO: 956301 - DNA, 25 bp, Mus musculus
ttgggagcctcgaagaccgccaaaa

SEQ ID NO: 956302 - DNA, 25 bp, Mus musculus
ttgggagcctcgtagaccgccaaaa

SEQ ID NO: 956303 - DNA, 25 bp, Mus musculus
ttgggagcgctccaggaactttcct

SEQ ID NO: 956304 - DNA, 25 bp, Mus musculus
ttgggagcgctcgaggaactttcct

SEQ ID NO: 956305 - DNA, 25 bp, Mus musculus
ttgggagctaaaactgaagccactg

SEQ ID NO: 956306 - DNA, 25 bp, Mus musculus
ttgggagctaaatctgaagccactg

SEQ ID NO: 956307 - DNA, 25 bp, Mus musculus
ttgggagctagcctggctttaccat

SEQ ID NO: 956308 - DNA, 25 bp, Mus musculus
ttgggagctagcgtggctttaccat

SEQ ID NO: 956309 - DNA, 25 bp, Mus musculus
ttgggaggcccacgttagaatctta

SEQ ID NO: 956310 - DNA, 25 bp, Mus musculus
ttgggaggcccaggttagaatctta

SEQ ID NO: 956311 - DNA, 25 bp, Mus musculus
ttgggaggccgaattgacgccacac

SEQ ID NO: 956312 - DNA, 25 bp, Mus musculus
ttgggaggccgatttgacgccacac

SEQ ID NO: 956313 - DNA, 25 bp, Mus musculus
ttgggaggcctgagcacagccaaca

SEQ ID NO: 956314 - DNA, 25 bp, Mus musculus
ttgggaggcctgtgcacagccaaca

SEQ ID NO: 956315 - DNA, 25 bp, Mus musculus
ttgggaggctaccagcttttgccaa

SEQ ID NO: 956316 - DNA, 25 bp, Mus musculus
ttgggaggctacgagcttttgccaa

SEQ ID NO: 956317 - DNA, 25 bp, Mus musculus
ttgggaggctgacgcaagactactt

SEQ ID NO: 956318 - DNA, 25 bp, Mus musculus
ttgggaggctgaggcaagactactt

SEQ ID NO: 956319 - DNA, 25 bp, Mus musculus
ttgggaggtcccaggagacactcaa

SEQ ID NO: 956320 - DNA, 25 bp, Mus musculus
ttgggaggtccctggagacactcaa

SEQ ID NO: 956321 - DNA, 25 bp, Mus musculus
ttgggagtagataccaccaggccta

SEQ ID NO: 956322 - DNA, 25 bp, Mus musculus
ttgggagtagattccaccaggccta

SEQ ID NO: 956323 - DNA, 25 bp, Mus musculus
ttgggagtcaaactgtggcagaata

SEQ ID NO: 956324 - DNA, 25 bp, Mus musculus
ttgggagtcaaagtgtggcagaata

SEQ ID NO: 956325 - DNA, 25 bp, Mus musculus
ttgggagtccagcatgtcttggcat

SEQ ID NO: 956326 - DNA, 25 bp, Mus musculus
ttgggagtccaggatgtcttggcat

SEQ ID NO: 956327 - DNA, 25 bp, Mus musculus
ttgggagtcctcacttagaccagca

SEQ ID NO: 956328 - DNA, 25 bp, Mus musculus
ttgggagtcctctcttagaccagca

SEQ ID NO: 956329 - DNA, 25 bp, Mus musculus
ttgggagtctgcactcagcacaaag

SEQ ID NO: 956330 - DNA, 25 bp, Mus musculus
ttgggagtctgctctcagcacaaag

SEQ ID NO: 956331 - DNA, 25 bp, Mus musculus
ttgggagtgatcagcgccatcatcc

SEQ ID NO: 956332 - DNA, 25 bp, Mus musculus
ttgggagtgatctgcgccatcatcc

SEQ ID NO: 956333 - DNA, 25 bp, Mus musculus
ttgggagttcacattgccaccttca

SEQ ID NO: 956334 - DNA, 25 bp, Mus musculus
ttgggagttcactttgccaccttca

SEQ ID NO: 956335 - DNA, 25 bp, Mus musculus
ttgggagttcttagagtgcctgtct

SEQ ID NO: 956336 - DNA, 25 bp, Mus musculus
ttgggagttctttgagtgcctgtct

SEQ ID NO: 956337 - DNA, 25 bp, Mus musculus
ttgggataaattagcccctcctggt

SEQ ID NO: 956338 - DNA, 25 bp, Mus musculus
ttgggataaatttgcccctcctggt

SEQ ID NO: 956339 - DNA, 25 bp, Mus musculus
ttgggatcaggacccactgtagcct

SEQ ID NO: 956340 - DNA, 25 bp, Mus musculus
ttgggatcaggagccactgtagcct

SEQ ID NO: 956341 - DNA, 25 bp, Mus musculus
ttgggatcaggtacacttctgttca

SEQ ID NO: 956342 - DNA, 25 bp, Mus musculus
ttgggatcaggttcacttctgttca

SEQ ID NO: 956343 - DNA, 25 bp, Mus musculus
ttgggatcatttaccttcttcttct

SEQ ID NO: 956344 - DNA, 25 bp, Mus musculus
ttgggatcattttccttcttcttct

SEQ ID NO: 956345 - DNA, 25 bp, Mus musculus
ttgggatccagactccccgtattct

SEQ ID NO: 956346 - DNA, 25 bp, Mus musculus
ttgggatccagagtccccgtattct

SEQ ID NO: 956347 - DNA, 25 bp, Mus musculus
ttgggatccataactcactttcagc

SEQ ID NO: 956348 - DNA, 25 bp, Mus musculus
ttgggatccatatctcactttcagc

SEQ ID NO: 956349 - DNA, 25 bp, Mus musculus
ttgggatccccacttccagatagtt

SEQ ID NO: 956350 - DNA, 25 bp, Mus musculus
ttgggatccccagttccagatagtt

SEQ ID NO: 956351 - DNA, 25 bp, Mus musculus
ttgggatccgaacacagaacagtgt

SEQ ID NO: 956352 - DNA, 25 bp, Mus musculus
ttgggatccgaagacagaacagtgt

SEQ ID NO: 956353 - DNA, 25 bp, Mus musculus
ttgggatccggcattgccctgaaag

SEQ ID NO: 956354 - DNA, 25 bp, Mus musculus
ttgggatccggctttgccctgaaag

SEQ ID NO: 956355 - DNA, 25 bp, Mus musculus
ttgggatcctgcctagtggtacgct

SEQ ID NO: 956356 - DNA, 25 bp, Mus musculus
ttgggatcctgcgtagtggtacgct

SEQ ID NO: 956357 - DNA, 25 bp, Mus musculus
ttgggatccttcacttgttggccta

SEQ ID NO: 956358 - DNA, 25 bp, Mus musculus
ttgggatccttctcttgttggccta

SEQ ID NO: 956359 - DNA, 25 bp, Mus musculus
ttgggatctaccctagacatctgga

SEQ ID NO: 956360 - DNA, 25 bp, Mus musculus
ttgggatctaccgtagacatctgga

SEQ ID NO: 956361 - DNA, 25 bp, Mus musculus
ttgggatctcaacactgtctgcctt

SEQ ID NO: 956362 - DNA, 25 bp, Mus musculus
ttgggatctcaagactgtctgcctt

SEQ ID NO: 956363 - DNA, 25 bp, Mus musculus
ttgggatgatgacaatgtagaagat

SEQ ID NO: 956364 - DNA, 25 bp, Mus musculus
ttgggatgatgagaatgtagaagat

SEQ ID NO: 956365 - DNA, 25 bp, Mus musculus
ttgggatgctgtatgctgttaagac

SEQ ID NO: 956366 - DNA, 25 bp, Mus musculus
ttgggatgctgtttgctgttaagac

SEQ ID NO: 956367 - DNA, 25 bp, Mus musculus
ttgggatgcttgctgtatgtccttc

SEQ ID NO: 956368 - DNA, 25 bp, Mus musculus
ttgggatgcttggtgtatgtccttc

SEQ ID NO: 956369 - DNA, 25 bp, Mus musculus
ttgggatgtcccagtagattagttc

SEQ ID NO: 956370 - DNA, 25 bp, Mus musculus
ttgggatgtccctgtagattagttc

SEQ ID NO: 956371 - DNA, 25 bp, Mus musculus
ttgggattcactcgagactccttgt

SEQ ID NO: 956372 - DNA, 25 bp, Mus musculus
ttgggattcactggagactccttgt

SEQ ID NO: 956373 - DNA, 25 bp, Mus musculus
ttgggattcagaaaactgcttgtca

SEQ ID NO: 956374 - DNA, 25 bp, Mus musculus
ttgggattcagataactgcttgtca

SEQ ID NO: 956375 - DNA, 25 bp, Mus musculus
ttgggattctgtccgatccctgtta

SEQ ID NO: 956376 - DNA, 25 bp, Mus musculus
ttgggattctgtgcgatccctgtta

SEQ ID NO: 956377 - DNA, 25 bp, Mus musculus
ttgggattggtcaacttacctggct

SEQ ID NO: 956378 - DNA, 25 bp, Mus musculus
ttgggattggtctacttacctggct

SEQ ID NO: 956379 - DNA, 25 bp, Mus musculus
ttgggattgtcaccctaaaggagct

SEQ ID NO: 956380 - DNA, 25 bp, Mus musculus
ttgggattgtcagcctaaaggagct

SEQ ID NO: 956381 - DNA, 25 bp, Mus musculus
ttgggattgtgtacctaatggaaat

SEQ ID NO: 956382 - DNA, 25 bp, Mus musculus
ttgggattgtgttcctaatggaaat

SEQ ID NO: 956383 - DNA, 25 bp, Mus musculus
ttgggatttctacatgttcattggt

SEQ ID NO: 956384 - DNA, 25 bp, Mus musculus
ttgggatttctagatgttcattggt

SEQ ID NO: 956385 - DNA, 25 bp, Mus musculus
ttgggatttttcaacactgctaatg

SEQ ID NO: 956386 - DNA, 25 bp, Mus musculus
ttgggatttttctacactgctaatg

SEQ ID NO: 956387 - DNA, 25 bp, Mus musculus
ttgggcaaaaagctccccgcagatg

SEQ ID NO: 956388 - DNA, 25 bp, Mus musculus
ttgggcaaaaaggtccccgcagatg

SEQ ID NO: 956389 - DNA, 25 bp, Mus musculus
ttgggcaactatctggccgtgctgt

SEQ ID NO: 956390 - DNA, 25 bp, Mus musculus
ttgggcaactatgtggccgtgctgt

SEQ ID NO: 956391 - DNA, 25 bp, Mus musculus
ttgggcaagcccatggttttaatcc

SEQ ID NO: 956392 - DNA, 25 bp, Mus musculus
ttgggcaagcccttggttttaatcc

SEQ ID NO: 956393 - DNA, 25 bp, Mus musculus
ttgggcaatacgaggactctcagtg

SEQ ID NO: 956394 - DNA, 25 bp, Mus musculus
ttgggcaatacgtggactctcagtg

SEQ ID NO: 956395 - DNA, 25 bp, Mus musculus
ttgggcaatgcgatgtgacacactc

SEQ ID NO: 956396 - DNA, 25 bp, Mus musculus
ttgggcaatgcgttgtgacacactc

SEQ ID NO: 956397 - DNA, 25 bp, Mus musculus
ttgggcacaaaacctgccatgtgat

SEQ ID NO: 956398 - DNA, 25 bp, Mus musculus
ttgggcacaaaagctgccatgtgat

SEQ ID NO: 956399 - DNA, 25 bp, Mus musculus
ttgggcacacgtctacgctggagca

SEQ ID NO: 956400 - DNA, 25 bp, Mus musculus
ttgggcacacgtgtacgctggagca

SEQ ID NO: 956401 - DNA, 25 bp, Mus musculus
ttgggcacagaaacgggtccccaga

SEQ ID NO: 956402 - DNA, 25 bp, Mus musculus
ttgggcacagaatcgggtccccaga

SEQ ID NO: 956403 - DNA, 25 bp, Mus musculus
ttgggcacatccaacctccgtgaag

SEQ ID NO: 956404 - DNA, 25 bp, Mus musculus
ttgggcacatccaactttcctgaga

SEQ ID NO: 956405 - DNA, 25 bp, Mus musculus
ttgggcacatcctacctccgtgaag

SEQ ID NO: 956406 - DNA, 25 bp, Mus musculus
ttgggcacatcctactttcctgaga

SEQ ID NO: 956407 - DNA, 25 bp, Mus musculus
ttgggcacattccacattctgggtg

SEQ ID NO: 956408 - DNA, 25 bp, Mus musculus
ttgggcacattcgacattctgggtg

SEQ ID NO: 956409 - DNA, 25 bp, Mus musculus
ttgggcacccacagatcagatgcat

SEQ ID NO: 956410 - DNA, 25 bp, Mus musculus
ttgggcacccactgatcagatgcat

SEQ ID NO: 956411 - DNA, 25 bp, Mus musculus
ttgggcaccgataactgtcaaggtt

SEQ ID NO: 956412 - DNA, 25 bp, Mus musculus
ttgggcaccgattactgtcaaggtt

SEQ ID NO: 956413 - DNA, 25 bp, Mus musculus
ttgggcaccgctcgatgacctgaga

SEQ ID NO: 956414 - DNA, 25 bp, Mus musculus
ttgggcaccgctggatgacctgaga

SEQ ID NO: 956415 - DNA, 25 bp, Mus musculus
ttgggcacctctcaaaactgggctg

SEQ ID NO: 956416 - DNA, 25 bp, Mus musculus
ttgggcacctctgaaaactgggctg

SEQ ID NO: 956417 - DNA, 25 bp, Mus musculus
ttgggcacgcaaaataccatatctt

SEQ ID NO: 956418 - DNA, 25 bp, Mus musculus
ttgggcacgcaatataccatatctt

SEQ ID NO: 956419 - DNA, 25 bp, Mus musculus
ttgggcacgtcaagtcatttctctg

SEQ ID NO: 956420 - DNA, 25 bp, Mus musculus
ttgggcacgtcatgtcatttctctg

SEQ ID NO: 956421 - DNA, 25 bp, Mus musculus
ttgggcactaatcttaactgatttc

SEQ ID NO: 956422 - DNA, 25 bp, Mus musculus
ttgggcactaatgttaactgatttc

SEQ ID NO: 956423 - DNA, 25 bp, Mus musculus
ttgggcactcagagtcaccgcattc

SEQ ID NO: 956424 - DNA, 25 bp, Mus musculus
ttgggcactcagtgtcaccgcattc

SEQ ID NO: 956425 - DNA, 25 bp, Mus musculus
ttgggcactctacacacatgtaaca

SEQ ID NO: 956426 - DNA, 25 bp, Mus musculus
ttgggcactctagacacatgtaaca

SEQ ID NO: 956427 - DNA, 25 bp, Mus musculus
ttgggcactgcaatttgacaaatga

SEQ ID NO: 956428 - DNA, 25 bp, Mus musculus
ttgggcactgcacacgcctctgaat

SEQ ID NO: 956429 - DNA, 25 bp, Mus musculus
ttgggcactgcagacgcctctgaat

SEQ ID NO: 956430 - DNA, 25 bp, Mus musculus
ttgggcactgcattttgacaaatga

SEQ ID NO: 956431 - DNA, 25 bp, Mus musculus
ttgggcacttatccccagctttaca

SEQ ID NO: 956432 - DNA, 25 bp, Mus musculus
ttgggcacttatgcccagctttaca

SEQ ID NO: 956433 - DNA, 25 bp, Mus musculus
ttgggcagaatcacccctgggatgt

SEQ ID NO: 956434 - DNA, 25 bp, Mus musculus
ttgggcagaatctcccctgggatgt

SEQ ID NO: 956435 - DNA, 25 bp, Mus musculus
ttgggcagacacacccgtaagcgat

SEQ ID NO: 956436 - DNA, 25 bp, Mus musculus
ttgggcagacactcccgtaagcgat

SEQ ID NO: 956437 - DNA, 25 bp, Mus musculus
ttgggcagaccaatcttctatcagt

SEQ ID NO: 956438 - DNA, 25 bp, Mus musculus
ttgggcagaccattcttctatcagt

SEQ ID NO: 956439 - DNA, 25 bp, Mus musculus
ttgggcagagctccaacttgcagca

SEQ ID NO: 956440 - DNA, 25 bp, Mus musculus
ttgggcagagctgcaacttgcagca

SEQ ID NO: 956441 - DNA, 25 bp, Mus musculus
ttgggcagcgagaacgaggctccat

SEQ ID NO: 956442 - DNA, 25 bp, Mus musculus
ttgggcagcgagtacgaggctccat

SEQ ID NO: 956443 - DNA, 25 bp, Mus musculus
ttgggcagcttgaaatttcaacagt

SEQ ID NO: 956444 - DNA, 25 bp, Mus musculus
ttgggcagcttgtaatttcaacagt

SEQ ID NO: 956445 - DNA, 25 bp, Mus musculus
ttgggcaggcacagactgcagcatc

SEQ ID NO: 956446 - DNA, 25 bp, Mus musculus
ttgggcaggcactgactgcagcatc

SEQ ID NO: 956447 - DNA, 25 bp, Mus musculus
ttgggcagtctacagcaggagcttc

SEQ ID NO: 956448 - DNA, 25 bp, Mus musculus
ttgggcagtctagagcaggagcttc

SEQ ID NO: 956449 - DNA, 25 bp, Mus musculus
ttgggcagtgtcaggtccacaaaga

SEQ ID NO: 956450 - DNA, 25 bp, Mus musculus
ttgggcagtgtctggtccacaaaga

SEQ ID NO: 956451 - DNA, 25 bp, Mus musculus
ttgggcagttcccttcctagcccgt

SEQ ID NO: 956452 - DNA, 25 bp, Mus musculus
ttgggcagttccgttcctagcccgt

SEQ ID NO: 956453 - DNA, 25 bp, Mus musculus
ttgggcataagcaaagccccttatt

SEQ ID NO: 956454 - DNA, 25 bp, Mus musculus
ttgggcataagctaagccccttatt

SEQ ID NO: 956455 - DNA, 25 bp, Mus musculus
ttgggcataatcatctgacagcgtt

SEQ ID NO: 956456 - DNA, 25 bp, Mus musculus
ttgggcataatcttctgacagcgtt

SEQ ID NO: 956457 - DNA, 25 bp, Mus musculus
ttgggcataccaacacagggaactc

SEQ ID NO: 956458 - DNA, 25 bp, Mus musculus
ttgggcataccatcacagggaactc

SEQ ID NO: 956459 - DNA, 25 bp, Mus musculus
ttgggcatagtcattctggtcctgg

SEQ ID NO: 956460 - DNA, 25 bp, Mus musculus
ttgggcatagtctttctggtcctgg

SEQ ID NO: 956461 - DNA, 25 bp, Mus musculus
ttgggcatatgaccctttattttat

SEQ ID NO: 956462 - DNA, 25 bp, Mus musculus
ttgggcatatgagcctttattttat

SEQ ID NO: 956463 - DNA, 25 bp, Mus musculus
ttgggcatccctcgttcaattaacc

SEQ ID NO: 956464 - DNA, 25 bp, Mus musculus
ttgggcatccctggttcaattaacc

SEQ ID NO: 956465 - DNA, 25 bp, Mus musculus
ttgggcatccttaaagacacggtag

SEQ ID NO: 956466 - DNA, 25 bp, Mus musculus
ttgggcatccttatcatccttagca

SEQ ID NO: 956467 - DNA, 25 bp, Mus musculus
ttgggcatcctttaagacacggtag

SEQ ID NO: 956468 - DNA, 25 bp, Mus musculus
ttgggcatccttttcatccttagca

SEQ ID NO: 956469 - DNA, 25 bp, Mus musculus
ttgggcatcgtccttgtatttcttc

SEQ ID NO: 956470 - DNA, 25 bp, Mus musculus
ttgggcatcgtcgttgtatttcttc

SEQ ID NO: 956471 - DNA, 25 bp, Mus musculus
ttgggcatctcaattccatcttgca

SEQ ID NO: 956472 - DNA, 25 bp, Mus musculus
ttgggcatctcatttccatcttgca

SEQ ID NO: 956473 - DNA, 25 bp, Mus musculus
ttgggcatctttacatgtcttggac

SEQ ID NO: 956474 - DNA, 25 bp, Mus musculus
ttgggcatcttttcatgtcttggac

SEQ ID NO: 956475 - DNA, 25 bp, Mus musculus
ttgggcatgctaccagtgcagctcc

SEQ ID NO: 956476 - DNA, 25 bp, Mus musculus
ttgggcatgctagcagtgcagctcc

SEQ ID NO: 956477 - DNA, 25 bp, Mus musculus
ttgggcatgctgcaattacagcttc

SEQ ID NO: 956478 - DNA, 25 bp, Mus musculus
ttgggcatgctggaattacagcttc

SEQ ID NO: 956479 - DNA, 25 bp, Mus musculus
ttgggcatggaacccaggcaccctc

SEQ ID NO: 956480 - DNA, 25 bp, Mus musculus
ttgggcatggaagccaggcaccctc

SEQ ID NO: 956481 - DNA, 25 bp, Mus musculus
ttgggcatggagacaaccggtaaga

SEQ ID NO: 956482 - DNA, 25 bp, Mus musculus
ttgggcatggagtcaaccggtaaga

SEQ ID NO: 956483 - DNA, 25 bp, Mus musculus
ttgggcatgtttactgaccctcata

SEQ ID NO: 956484 - DNA, 25 bp, Mus musculus
ttgggcatgttttctgaccctcata

SEQ ID NO: 956485 - DNA, 25 bp, Mus musculus
ttgggcattcatcttctttgactga

SEQ ID NO: 956486 - DNA, 25 bp, Mus musculus
ttgggcattcatgttctttgactga

SEQ ID NO: 956487 - DNA, 25 bp, Mus musculus
ttgggcattcttccaataccttagc

SEQ ID NO: 956488 - DNA, 25 bp, Mus musculus
ttgggcattcttctatctcctgtgt

SEQ ID NO: 956489 - DNA, 25 bp, Mus musculus
ttgggcattcttgcaataccttagc

SEQ ID NO: 956490 - DNA, 25 bp, Mus musculus
ttgggcattcttgtatctcctgtgt

SEQ ID NO: 956491 - DNA, 25 bp, Mus musculus
ttgggccaaagcatctgctgtggaa

SEQ ID NO: 956492 - DNA, 25 bp, Mus musculus
ttgggccaaagcttctgctgtggaa

SEQ ID NO: 956493 - DNA, 25 bp, Mus musculus
ttgggccaaatcagcctgaagatca

SEQ ID NO: 956494 - DNA, 25 bp, Mus musculus
ttgggccaaatctgcctgaagatca

SEQ ID NO: 956495 - DNA, 25 bp, Mus musculus
ttgggccaatcaacacattcgcatg

SEQ ID NO: 956496 - DNA, 25 bp, Mus musculus
ttgggccaatcatcacattcgcatg

SEQ ID NO: 956497 - DNA, 25 bp, Mus musculus
ttgggccacagcagacttcctagaa

SEQ ID NO: 956498 - DNA, 25 bp, Mus musculus
ttgggccacagctgacttcctagaa

SEQ ID NO: 956499 - DNA, 25 bp, Mus musculus
ttgggccacgctagcctgtctcaac

SEQ ID NO: 956500 - DNA, 25 bp, Mus musculus
ttgggccacgcttgcctgtctcaac

SEQ ID NO: 956501 - DNA, 25 bp, Mus musculus
ttgggccacttgacacagagtcctg

SEQ ID NO: 956502 - DNA, 25 bp, Mus musculus
ttgggccacttgtcacagagtcctg

SEQ ID NO: 956503 - DNA, 25 bp, Mus musculus
ttgggccagagaacacgaagcacct

SEQ ID NO: 956504 - DNA, 25 bp, Mus musculus
ttgggccagagatcacgaagcacct

SEQ ID NO: 956505 - DNA, 25 bp, Mus musculus
ttgggccagctaaacatgcttcatc

SEQ ID NO: 956506 - DNA, 25 bp, Mus musculus
ttgggccagctatacatgcttcatc

SEQ ID NO: 956507 - DNA, 25 bp, Mus musculus
ttgggccagggcactgtatgacttt

SEQ ID NO: 956508 - DNA, 25 bp, Mus musculus
ttgggccagggccacagccgatatc

SEQ ID NO: 956509 - DNA, 25 bp, Mus musculus
ttgggccagggcgacagccgatatc

SEQ ID NO: 956510 - DNA, 25 bp, Mus musculus
ttgggccagggctctgtatgacttt

SEQ ID NO: 956511 - DNA, 25 bp, Mus musculus
ttgggccagggtctcatggtccata

SEQ ID NO: 956512 - DNA, 25 bp, Mus musculus
ttgggccagggtgtcatggtccata

SEQ ID NO: 956513 - DNA, 25 bp, Mus musculus
ttgggccaggtcagcagcaacatta

SEQ ID NO: 956514 - DNA, 25 bp, Mus musculus
ttgggccaggtctgcagcaacatta

SEQ ID NO: 956515 - DNA, 25 bp, Mus musculus
ttgggccagtaccacagcgcaggtc

SEQ ID NO: 956516 - DNA, 25 bp, Mus musculus
ttgggccagtacgacagcgcaggtc

SEQ ID NO: 956517 - DNA, 25 bp, Mus musculus
ttgggccatgctcacgataggttag

SEQ ID NO: 956518 - DNA, 25 bp, Mus musculus
ttgggccatgctgacgataggttag

SEQ ID NO: 956519 - DNA, 25 bp, Mus musculus
ttgggccatggcactagtgaagatg

SEQ ID NO: 956520 - DNA, 25 bp, Mus musculus
ttgggccatggctctagtgaagatg

SEQ ID NO: 956521 - DNA, 25 bp, Mus musculus
ttgggccatgtacgccagctttgag

SEQ ID NO: 956522 - DNA, 25 bp, Mus musculus
ttgggccatgtaggccagctttgag

SEQ ID NO: 956523 - DNA, 25 bp, Mus musculus
ttgggcccaacgcttccatcaatgt

SEQ ID NO: 956524 - DNA, 25 bp, Mus musculus
ttgggcccaacggttccatcaatgt

SEQ ID NO: 956525 - DNA, 25 bp, Mus musculus
ttgggcccaatcatgtgaccttttg

SEQ ID NO: 956526 - DNA, 25 bp, Mus musculus
ttgggcccaatcttgtgaccttttg

SEQ ID NO: 956527 - DNA, 25 bp, Mus musculus
ttgggcccacacagaaatctcattg

SEQ ID NO: 956528 - DNA, 25 bp, Mus musculus
ttgggcccacactgaaatctcattg

SEQ ID NO: 956529 - DNA, 25 bp, Mus musculus
ttgggcccactgacttagcaggttg

SEQ ID NO: 956530 - DNA, 25 bp, Mus musculus
ttgggcccactgtcttagcaggttg

SEQ ID NO: 956531 - DNA, 25 bp, Mus musculus
ttgggcccagaaactttcaaaactg

SEQ ID NO: 956532 - DNA, 25 bp, Mus musculus
ttgggcccagaatctttcaaaactg

SEQ ID NO: 956533 - DNA, 25 bp, Mus musculus
ttgggcccaggtcctgctcagccag

SEQ ID NO: 956534 - DNA, 25 bp, Mus musculus
ttgggcccaggtgctgctcagccag

SEQ ID NO: 956535 - DNA, 25 bp, Mus musculus
ttgggcccatcactgctggaattga

SEQ ID NO: 956536 - DNA, 25 bp, Mus musculus
ttgggcccatcagtgctggaattga

SEQ ID NO: 956537 - DNA, 25 bp, Mus musculus
ttgggcccatctcggattgaaacag

SEQ ID NO: 956538 - DNA, 25 bp, Mus musculus
ttgggcccatctgggattgaaacag

SEQ ID NO: 956539 - DNA, 25 bp, Mus musculus
ttgggcccatttatcttcttaactt

SEQ ID NO: 956540 - DNA, 25 bp, Mus musculus
ttgggcccatttttcttcttaactt

SEQ ID NO: 956541 - DNA, 25 bp, Mus musculus
ttgggccccgggagcccagagacag

SEQ ID NO: 956542 - DNA, 25 bp, Mus musculus
ttgggccccgggtgcccagagacag

SEQ ID NO: 956543 - DNA, 25 bp, Mus musculus
ttgggccctaccaaaaagatggcag

SEQ ID NO: 956544 - DNA, 25 bp, Mus musculus
ttgggccctacctaaaagatggcag

SEQ ID NO: 956545 - DNA, 25 bp, Mus musculus
ttgggccctctgctggaaacataga

SEQ ID NO: 956546 - DNA, 25 bp, Mus musculus
ttgggccctctggtggaaacataga

SEQ ID NO: 956547 - DNA, 25 bp, Mus musculus
ttgggccctgagaatcctgaagagc

SEQ ID NO: 956548 - DNA, 25 bp, Mus musculus
ttgggccctgagtatcctgaagagc

SEQ ID NO: 956549 - DNA, 25 bp, Mus musculus
ttgggccctgccaacacgaggaaag

SEQ ID NO: 956550 - DNA, 25 bp, Mus musculus
ttgggccctgcctacacgaggaaag

SEQ ID NO: 956551 - DNA, 25 bp, Mus musculus
ttgggccctgggatcaggctgaata

SEQ ID NO: 956552 - DNA, 25 bp, Mus musculus
ttgggccctgggttcaggctgaata

SEQ ID NO: 956553 - DNA, 25 bp, Mus musculus
ttgggccctttcagctttgacgatg

SEQ ID NO: 956554 - DNA, 25 bp, Mus musculus
ttgggccctttctgctttgacgatg

SEQ ID NO: 956555 - DNA, 25 bp, Mus musculus
ttgggccgatgtctttgtcatctct

SEQ ID NO: 956556 - DNA, 25 bp, Mus musculus
ttgggccgatgtgtttgtcatctct

SEQ ID NO: 956557 - DNA, 25 bp, Mus musculus
ttgggccgcataccagccaatggcg

SEQ ID NO: 956558 - DNA, 25 bp, Mus musculus
ttgggccgcatagcagccaatggcg

SEQ ID NO: 956559 - DNA, 25 bp, Mus musculus
ttgggccggctcattggtcacgtga

SEQ ID NO: 956560 - DNA, 25 bp, Mus musculus
ttgggccggctctttggtcacgtga

SEQ ID NO: 956561 - DNA, 25 bp, Mus musculus
ttgggcctagagatccctgctgccc

SEQ ID NO: 956562 - DNA, 25 bp, Mus musculus
ttgggcctagagttccctgctgccc

SEQ ID NO: 956563 - DNA, 25 bp, Mus musculus
ttgggcctccaaacttaaagaaatc

SEQ ID NO: 956564 - DNA, 25 bp, Mus musculus
ttgggcctccaatcttaaagaaatc

SEQ ID NO: 956565 - DNA, 25 bp, Mus musculus
ttgggcctccttagctgttgccttg

SEQ ID NO: 956566 - DNA, 25 bp, Mus musculus
ttgggcctcctttgctgttgccttg

SEQ ID NO: 956567 - DNA, 25 bp, Mus musculus
ttgggcctcgttcgagtcatgctct

SEQ ID NO: 956568 - DNA, 25 bp, Mus musculus
ttgggcctcgttggagtcatgctct

SEQ ID NO: 956569 - DNA, 25 bp, Mus musculus
ttgggcctctgaaacgagcaggtct

SEQ ID NO: 956570 - DNA, 25 bp, Mus musculus
ttgggcctctgatacgagcaggtct

SEQ ID NO: 956571 - DNA, 25 bp, Mus musculus
ttgggcctgagaacacctgtctgga

SEQ ID NO: 956572 - DNA, 25 bp, Mus musculus
ttgggcctgagatcacctgtctgga

SEQ ID NO: 956573 - DNA, 25 bp, Mus musculus
ttgggcctgattcagtggaataata

SEQ ID NO: 956574 - DNA, 25 bp, Mus musculus
ttgggcctgattgagtggaataata

SEQ ID NO: 956575 - DNA, 25 bp, Mus musculus
ttgggcctggctctttgactcaaag

SEQ ID NO: 956576 - DNA, 25 bp, Mus musculus
ttgggcctggctgtttgactcaaag

SEQ ID NO: 956577 - DNA, 25 bp, Mus musculus
ttgggccttcaacttgtatgacctc

SEQ ID NO: 956578 - DNA, 25 bp, Mus musculus
ttgggccttcaagttgtatgacctc

SEQ ID NO: 956579 - DNA, 25 bp, Mus musculus
ttgggccttctcagagactgagtga

SEQ ID NO: 956580 - DNA, 25 bp, Mus musculus
ttgggccttctctgagactgagtga

SEQ ID NO: 956581 - DNA, 25 bp, Mus musculus
ttgggccttgagatggtaatgagaa

SEQ ID NO: 956582 - DNA, 25 bp, Mus musculus
ttgggccttgagttggtaatgagaa

SEQ ID NO: 956583 - DNA, 25 bp, Mus musculus
ttgggccttggtccaagtggtattt

SEQ ID NO: 956584 - DNA, 25 bp, Mus musculus
ttgggccttggtgcaagtggtattt

SEQ ID NO: 956585 - DNA, 25 bp, Mus musculus
ttgggcctttggcagataatctaga

SEQ ID NO: 956586 - DNA, 25 bp, Mus musculus
ttgggcctttgggagataatctaga

SEQ ID NO: 956587 - DNA, 25 bp, Mus musculus
ttgggcgattatcatgacgatgacg

SEQ ID NO: 956588 - DNA, 25 bp, Mus musculus
ttgggcgattatgatgacgatgacg

SEQ ID NO: 956589 - DNA, 25 bp, Mus musculus
ttgggcgcgacgacactaattggat

SEQ ID NO: 956590 - DNA, 25 bp, Mus musculus
ttgggcgcgacgtcactaattggat

SEQ ID NO: 956591 - DNA, 25 bp, Mus musculus
ttgggcgcttgaatggctctcctag

SEQ ID NO: 956592 - DNA, 25 bp, Mus musculus
ttgggcgcttgattggctctcctag

SEQ ID NO: 956593 - DNA, 25 bp, Mus musculus
ttgggcgcttttaattccatacctt

SEQ ID NO: 956594 - DNA, 25 bp, Mus musculus
ttgggcgctttttattccatacctt

SEQ ID NO: 956595 - DNA, 25 bp, Mus musculus
ttgggcggctacaattgctcctgca

SEQ ID NO: 956596 - DNA, 25 bp, Mus musculus
ttgggcggctactattgctcctgca

SEQ ID NO: 956597 - DNA, 25 bp, Mus musculus
ttgggcgggcgccatcttccattgc

SEQ ID NO: 956598 - DNA, 25 bp, Mus musculus
ttgggcgggcgcgatcttccattgc

SEQ ID NO: 956599 - DNA, 25 bp, Mus musculus
ttgggcgtaataacccgagggcgct

SEQ ID NO: 956600 - DNA, 25 bp, Mus musculus
ttgggcgtaatatcccgagggcgct

SEQ ID NO: 956601 - DNA, 25 bp, Mus musculus
ttgggcgtggcaacagtgatctgct

SEQ ID NO: 956602 - DNA, 25 bp, Mus musculus
ttgggcgtggcatcagtgatctgct

SEQ ID NO: 956603 - DNA, 25 bp, Mus musculus
ttgggcgtttccaggtgcaacaaaa

SEQ ID NO: 956604 - DNA, 25 bp, Mus musculus
ttgggcgtttcctggtgcaacaaaa

SEQ ID NO: 956605 - DNA, 25 bp, Mus musculus
ttgggctaatggcagagggctttgt

SEQ ID NO: 956606 - DNA, 25 bp, Mus musculus
ttgggctaatgggagagggctttgt

SEQ ID NO: 956607 - DNA, 25 bp, Mus musculus
ttgggctaccaaaaaacttcttctg

SEQ ID NO: 956608 - DNA, 25 bp, Mus musculus
ttgggctaccaataaacttcttctg

SEQ ID NO: 956609 - DNA, 25 bp, Mus musculus
ttgggctacctccttaatgttgcac

SEQ ID NO: 956610 - DNA, 25 bp, Mus musculus
ttgggctacctcgttaatgttgcac

SEQ ID NO: 956611 - DNA, 25 bp, Mus musculus
ttgggctactctaacaagtgctgta

SEQ ID NO: 956612 - DNA, 25 bp, Mus musculus
ttgggctactcttacaagtgctgta

SEQ ID NO: 956613 - DNA, 25 bp, Mus musculus
ttgggctacttgattaattgctcag

SEQ ID NO: 956614 - DNA, 25 bp, Mus musculus
ttgggctacttgtttaattgctcag

SEQ ID NO: 956615 - DNA, 25 bp, Mus musculus
ttgggctaggtcatttcactgctgt

SEQ ID NO: 956616 - DNA, 25 bp, Mus musculus
ttgggctaggtcttttcactgctgt

SEQ ID NO: 956617 - DNA, 25 bp, Mus musculus
ttgggctataccaacataattggac

SEQ ID NO: 956618 - DNA, 25 bp, Mus musculus
ttgggctatacctacataattggac

SEQ ID NO: 956619 - DNA, 25 bp, Mus musculus
ttgggctcaagcagtaggccagcct

SEQ ID NO: 956620 - DNA, 25 bp, Mus musculus
ttgggctcaagctgtaggccagcct

SEQ ID NO: 956621 - DNA, 25 bp, Mus musculus
ttgggctcacccacaaagaaaacca

SEQ ID NO: 956622 - DNA, 25 bp, Mus musculus
ttgggctcaccctcaaagaaaacca

SEQ ID NO: 956623 - DNA, 25 bp, Mus musculus
ttgggctcagagattacactgtgtc

SEQ ID NO: 956624 - DNA, 25 bp, Mus musculus
ttgggctcagagtttacactgtgtc

SEQ ID NO: 956625 - DNA, 25 bp, Mus musculus
ttgggctcagcaccacttggaacag

SEQ ID NO: 956626 - DNA, 25 bp, Mus musculus
ttgggctcagcagcacttggaacag

SEQ ID NO: 956627 - DNA, 25 bp, Mus musculus
ttgggctcccagacctcatatgtat

SEQ ID NO: 956628 - DNA, 25 bp, Mus musculus
ttgggctcccagtcctcatatgtat

SEQ ID NO: 956629 - DNA, 25 bp, Mus musculus
ttgggctccctgattgggctcggca

SEQ ID NO: 956630 - DNA, 25 bp, Mus musculus
ttgggctccctgtttgggctcggca

SEQ ID NO: 956631 - DNA, 25 bp, Mus musculus
ttgggctcctcgatccgctggtccg

SEQ ID NO: 956632 - DNA, 25 bp, Mus musculus
ttgggctcctcgttccgctggtccg

SEQ ID NO: 956633 - DNA, 25 bp, Mus musculus
ttgggctcctctcggccaatagtgt

SEQ ID NO: 956634 - DNA, 25 bp, Mus musculus
ttgggctcctctgggccaatagtgt

SEQ ID NO: 956635 - DNA, 25 bp, Mus musculus
ttgggctcctgaattcatttgctcc

SEQ ID NO: 956636 - DNA, 25 bp, Mus musculus
ttgggctcctgatttcatttgctcc

SEQ ID NO: 956637 - DNA, 25 bp, Mus musculus
ttgggctccttaaggtccaaggcat

SEQ ID NO: 956638 - DNA, 25 bp, Mus musculus
ttgggctccttatggtccaaggcat

SEQ ID NO: 956639 - DNA, 25 bp, Mus musculus
ttgggctcctttactatctgagaga

SEQ ID NO: 956640 - DNA, 25 bp, Mus musculus
ttgggctccttttctatctgagaga

SEQ ID NO: 956641 - DNA, 25 bp, Mus musculus
ttgggctcgcaaccagactttctgc

SEQ ID NO: 956642 - DNA, 25 bp, Mus musculus
ttgggctcgcaagcagactttctgc

SEQ ID NO: 956643 - DNA, 25 bp, Mus musculus
ttgggctcgggtcaaatgctgactc

SEQ ID NO: 956644 - DNA, 25 bp, Mus musculus
ttgggctcgggtgaaatgctgactc

SEQ ID NO: 956645 - DNA, 25 bp, Mus musculus
ttgggctctcaactgatttgagtgg

SEQ ID NO: 956646 - DNA, 25 bp, Mus musculus
ttgggctctcaagtgatttgagtgg

SEQ ID NO: 956647 - DNA, 25 bp, Mus musculus
ttgggctctgtactgagatcttgtc

SEQ ID NO: 956648 - DNA, 25 bp, Mus musculus
ttgggctctgtagtgagatcttgtc

SEQ ID NO: 956649 - DNA, 25 bp, Mus musculus
ttgggctcttctacctattttgtat

SEQ ID NO: 956650 - DNA, 25 bp, Mus musculus
ttgggctcttcttcctattttgtat

SEQ ID NO: 956651 - DNA, 25 bp, Mus musculus
ttgggctgaattctgtgcttttctt

SEQ ID NO: 956652 - DNA, 25 bp, Mus musculus
ttgggctgaattgtgtgcttttctt

SEQ ID NO: 956653 - DNA, 25 bp, Mus musculus
ttgggctgatcgaatcggacacagg

SEQ ID NO: 956654 - DNA, 25 bp, Mus musculus
ttgggctgatcgtatcggacacagg

SEQ ID NO: 956655 - DNA, 25 bp, Mus musculus
ttgggctgcaccagacatttctgat

SEQ ID NO: 956656 - DNA, 25 bp, Mus musculus
ttgggctgcacctgacatttctgat

SEQ ID NO: 956657 - DNA, 25 bp, Mus musculus
ttgggctgcagaaccttcaacaggc

SEQ ID NO: 956658 - DNA, 25 bp, Mus musculus
ttgggctgcagactccctcagtaga

SEQ ID NO: 956659 - DNA, 25 bp, Mus musculus
ttgggctgcagagtccctcagtaga

SEQ ID NO: 956660 - DNA, 25 bp, Mus musculus
ttgggctgcagatccttcaacaggc

SEQ ID NO: 956661 - DNA, 25 bp, Mus musculus
ttgggctgcattagcaaggactggc

SEQ ID NO: 956662 - DNA, 25 bp, Mus musculus
ttgggctgcatttgcaaggactggc

SEQ ID NO: 956663 - DNA, 25 bp, Mus musculus
ttgggctgccagacacttgaagtgg

SEQ ID NO: 956664 - DNA, 25 bp, Mus musculus
ttgggctgccagtcacttgaagtgg

SEQ ID NO: 956665 - DNA, 25 bp, Mus musculus
ttgggctgctcccagagcaatggta

SEQ ID NO: 956666 - DNA, 25 bp, Mus musculus
ttgggctgctccgagagcaatggta

SEQ ID NO: 956667 - DNA, 25 bp, Mus musculus
ttgggctgctggctatgccttccga

SEQ ID NO: 956668 - DNA, 25 bp, Mus musculus
ttgggctgctgggtatgccttccga

SEQ ID NO: 956669 - DNA, 25 bp, Mus musculus
ttgggctgctgtatagatggcaact

SEQ ID NO: 956670 - DNA, 25 bp, Mus musculus
ttgggctgctgtttagatggcaact

SEQ ID NO: 956671 - DNA, 25 bp, Mus musculus
ttgggctggcctagaaccagtgtct

SEQ ID NO: 956672 - DNA, 25 bp, Mus musculus
ttgggctggcctaggactagtaacc

SEQ ID NO: 956673 - DNA, 25 bp, Mus musculus
ttgggctggccttgaaccagtgtct

SEQ ID NO: 956674 - DNA, 25 bp, Mus musculus
ttgggctggccttggactagtaacc

SEQ ID NO: 956675 - DNA, 25 bp, Mus musculus
ttgggctggctcagttatccatggt

SEQ ID NO: 956676 - DNA, 25 bp, Mus musculus
ttgggctggctctgttatccatggt

SEQ ID NO: 956677 - DNA, 25 bp, Mus musculus
ttgggctgggacagcattcttgtga

SEQ ID NO: 956678 - DNA, 25 bp, Mus musculus
ttgggctgggactgcattcttgtga

SEQ ID NO: 956679 - DNA, 25 bp, Mus musculus
ttgggctgttcaaaaggccgccttc

SEQ ID NO: 956680 - DNA, 25 bp, Mus musculus
ttgggctgttcataaggccgccttc

SEQ ID NO: 956681 - DNA, 25 bp, Mus musculus
ttgggcttaaaaatcctgtaagatc

SEQ ID NO: 956682 - DNA, 25 bp, Mus musculus
ttgggcttaaaattcctgtaagatc

SEQ ID NO: 956683 - DNA, 25 bp, Mus musculus
ttgggcttaacgatgccgcacaaag

SEQ ID NO: 956684 - DNA, 25 bp, Mus musculus
ttgggcttaacgttgccgcacaaag

SEQ ID NO: 956685 - DNA, 25 bp, Mus musculus
ttgggcttaggcataggcgctcact

SEQ ID NO: 956686 - DNA, 25 bp, Mus musculus
ttgggcttaggcttaggcgctcact

SEQ ID NO: 956687 - DNA, 25 bp, Mus musculus
ttgggcttcaacatcatgggtggca

SEQ ID NO: 956688 - DNA, 25 bp, Mus musculus
ttgggcttcaacttcatgggtggca

SEQ ID NO: 956689 - DNA, 25 bp, Mus musculus
ttgggcttccacagaggtggccact

SEQ ID NO: 956690 - DNA, 25 bp, Mus musculus
ttgggcttccacaggttccttttat

SEQ ID NO: 956691 - DNA, 25 bp, Mus musculus
ttgggcttccactgaggtggccact

SEQ ID NO: 956692 - DNA, 25 bp, Mus musculus
ttgggcttccactggttccttttat

SEQ ID NO: 956693 - DNA, 25 bp, Mus musculus
ttgggcttcccaatctggcaagtac

SEQ ID NO: 956694 - DNA, 25 bp, Mus musculus
ttgggcttcccattctggcaagtac

SEQ ID NO: 956695 - DNA, 25 bp, Mus musculus
ttgggcttccctctgatgctcatgt

SEQ ID NO: 956696 - DNA, 25 bp, Mus musculus
ttgggcttccctgtgatgctcatgt

SEQ ID NO: 956697 - DNA, 25 bp, Mus musculus
ttgggcttcctcagaagcaacggca

SEQ ID NO: 956698 - DNA, 25 bp, Mus musculus
ttgggcttcctcatgtactctgact

SEQ ID NO: 956699 - DNA, 25 bp, Mus musculus
ttgggcttcctctgaagcaacggca

SEQ ID NO: 956700 - DNA, 25 bp, Mus musculus
ttgggcttcctcttgtactctgact

SEQ ID NO: 956701 - DNA, 25 bp, Mus musculus
ttgggcttcttcaggtgttagatgg

SEQ ID NO: 956702 - DNA, 25 bp, Mus musculus
ttgggcttcttctggtgttagatgg

SEQ ID NO: 956703 - DNA, 25 bp, Mus musculus
ttgggcttcttgaggatgctcctgc

SEQ ID NO: 956704 - DNA, 25 bp, Mus musculus
ttgggcttcttgtggatgctcctgc

SEQ ID NO: 956705 - DNA, 25 bp, Mus musculus
ttgggctttagcatcatctcttctc

SEQ ID NO: 956706 - DNA, 25 bp, Mus musculus
ttgggctttagcttcatctcttctc

SEQ ID NO: 956707 - DNA, 25 bp, Mus musculus
ttgggctttgccaggctgaatgtgt

SEQ ID NO: 956708 - DNA, 25 bp, Mus musculus
ttgggctttgcctggctgaatgtgt

SEQ ID NO: 956709 - DNA, 25 bp, Mus musculus
ttgggctttggacacaacggacaga

SEQ ID NO: 956710 - DNA, 25 bp, Mus musculus
ttgggctttggagacaacggacaga

SEQ ID NO: 956711 - DNA, 25 bp, Mus musculus
ttgggcttttatatctggccaacct

SEQ ID NO: 956712 - DNA, 25 bp, Mus musculus
ttgggcttttatccagcctttgctg

SEQ ID NO: 956713 - DNA, 25 bp, Mus musculus
ttgggcttttatgcagcctttgctg

SEQ ID NO: 956714 - DNA, 25 bp, Mus musculus
ttgggcttttatttctggccaacct

SEQ ID NO: 956715 - DNA, 25 bp, Mus musculus
ttgggcttttcaatgcttcctgtca

SEQ ID NO: 956716 - DNA, 25 bp, Mus musculus
ttgggcttttcattgcttcctgtca

SEQ ID NO: 956717 - DNA, 25 bp, Mus musculus
ttgggcttttggcatgtcatcacct

SEQ ID NO: 956718 - DNA, 25 bp, Mus musculus
ttgggcttttgggatgtcatcacct

SEQ ID NO: 956719 - DNA, 25 bp, Mus musculus
ttgggcttttgtaatctccagtcac

SEQ ID NO: 956720 - DNA, 25 bp, Mus musculus
ttgggcttttgttatctccagtcac

SEQ ID NO: 956721 - DNA, 25 bp, Mus musculus
ttgggctttttgcaacctctgtcgt

SEQ ID NO: 956722 - DNA, 25 bp, Mus musculus
ttgggctttttggaacctctgtcgt

SEQ ID NO: 956723 - DNA, 25 bp, Mus musculus
ttggggaacacactgtttcttcata

SEQ ID NO: 956724 - DNA, 25 bp, Mus musculus
ttggggaacacagtgtttcttcata

SEQ ID NO: 956725 - DNA, 25 bp, Mus musculus
ttggggacgggcactgtctcttttc

SEQ ID NO: 956726 - DNA, 25 bp, Mus musculus
ttggggacgggctctgtctcttttc

SEQ ID NO: 956727 - DNA, 25 bp, Mus musculus
ttggggatttagctcagtggtagag

SEQ ID NO: 956728 - DNA, 25 bp, Mus musculus
ttggggatttaggtcagtggtagag

SEQ ID NO: 956729 - DNA, 25 bp, Mus musculus
ttggggcccactatcctataggttg

SEQ ID NO: 956730 - DNA, 25 bp, Mus musculus
ttggggcccactttcctataggttg

SEQ ID NO: 956731 - DNA, 25 bp, Mus musculus
ttggggcctagaagctgttttatac

SEQ ID NO: 956732 - DNA, 25 bp, Mus musculus
ttggggcctagatgctgttttatac

SEQ ID NO: 956733 - DNA, 25 bp, Mus musculus
ttgggggggagcactgatcctcctc

SEQ ID NO: 956734 - DNA, 25 bp, Mus musculus
ttgggggggagctctgatcctcctc

SEQ ID NO: 956735 - DNA, 25 bp, Mus musculus
ttgggtaaagccatattttgcataa

SEQ ID NO: 956736 - DNA, 25 bp, Mus musculus
ttgggtaaagccttattttgcataa

SEQ ID NO: 956737 - DNA, 25 bp, Mus musculus
ttgggtaaccataccccaggagcaa

SEQ ID NO: 956738 - DNA, 25 bp, Mus musculus
ttgggtaaccattccccaggagcaa

SEQ ID NO: 956739 - DNA, 25 bp, Mus musculus
ttgggtaatcccatgacaccagcac

SEQ ID NO: 956740 - DNA, 25 bp, Mus musculus
ttgggtaatcccttgacaccagcac

SEQ ID NO: 956741 - DNA, 25 bp, Mus musculus
ttgggtaatgacaacctgcacctgc

SEQ ID NO: 956742 - DNA, 25 bp, Mus musculus
ttgggtaatgactacctgcacctgc

SEQ ID NO: 956743 - DNA, 25 bp, Mus musculus
ttgggtaatgatcgtgcacactttt

SEQ ID NO: 956744 - DNA, 25 bp, Mus musculus
ttgggtaatgatggtgcacactttt

SEQ ID NO: 956745 - DNA, 25 bp, Mus musculus
ttgggtacaccacggtcagtatgac

SEQ ID NO: 956746 - DNA, 25 bp, Mus musculus
ttgggtacaccagggtcagtatgac

SEQ ID NO: 956747 - DNA, 25 bp, Mus musculus
ttgggtacatgccttgctgtgttta

SEQ ID NO: 956748 - DNA, 25 bp, Mus musculus
ttgggtacatgcgttgctgtgttta

SEQ ID NO: 956749 - DNA, 25 bp, Mus musculus
ttgggtacccttagcttgaagttat

SEQ ID NO: 956750 - DNA, 25 bp, Mus musculus
ttgggtaccctttgcttgaagttat

SEQ ID NO: 956751 - DNA, 25 bp, Mus musculus
ttgggtaccgctaccagtgagatag

SEQ ID NO: 956752 - DNA, 25 bp, Mus musculus
ttgggtaccgcttccagtgagatag

SEQ ID NO: 956753 - DNA, 25 bp, Mus musculus
ttgggtaccgtcagcacatagtgca

SEQ ID NO: 956754 - DNA, 25 bp, Mus musculus
ttgggtaccgtctgcacatagtgca

SEQ ID NO: 956755 - DNA, 25 bp, Mus musculus
ttgggtaccttaccacatgtggcat

SEQ ID NO: 956756 - DNA, 25 bp, Mus musculus
ttgggtaccttagcacatgtggcat

SEQ ID NO: 956757 - DNA, 25 bp, Mus musculus
ttgggtacgtgaacacagtatatgg

SEQ ID NO: 956758 - DNA, 25 bp, Mus musculus
ttgggtacgtgatcacagtatatgg

SEQ ID NO: 956759 - DNA, 25 bp, Mus musculus
ttgggtactggacccggccccagag

SEQ ID NO: 956760 - DNA, 25 bp, Mus musculus
ttgggtactggagccggccccagag

SEQ ID NO: 956761 - DNA, 25 bp, Mus musculus
ttgggtacttgaattctgccctcaa

SEQ ID NO: 956762 - DNA, 25 bp, Mus musculus
ttgggtacttgatttctgccctcaa

SEQ ID NO: 956763 - DNA, 25 bp, Mus musculus
ttgggtagcactcttccttgtggac

SEQ ID NO: 956764 - DNA, 25 bp, Mus musculus
ttgggtagcactgttccttgtggac

SEQ ID NO: 956765 - DNA, 25 bp, Mus musculus
ttgggtagccacagatacgttgtcc

SEQ ID NO: 956766 - DNA, 25 bp, Mus musculus
ttgggtagccactgatacgttgtcc

SEQ ID NO: 956767 - DNA, 25 bp, Mus musculus
ttgggtagggaacccttctgagact

SEQ ID NO: 956768 - DNA, 25 bp, Mus musculus
ttgggtagggaagccttctgagact

SEQ ID NO: 956769 - DNA, 25 bp, Mus musculus
ttgggtaggtatagcctcttctttt

SEQ ID NO: 956770 - DNA, 25 bp, Mus musculus
ttgggtaggtattgcctcttctttt

SEQ ID NO: 956771 - DNA, 25 bp, Mus musculus
ttgggtagtagccttgttatttgac

SEQ ID NO: 956772 - DNA, 25 bp, Mus musculus
ttgggtagtagcgttgttatttgac

SEQ ID NO: 956773 - DNA, 25 bp, Mus musculus
ttgggtagttggacagcactgctcg

SEQ ID NO: 956774 - DNA, 25 bp, Mus musculus
ttgggtagttggtcagcactgctcg

SEQ ID NO: 956775 - DNA, 25 bp, Mus musculus
ttgggtatattcatttgtgctaaaa

SEQ ID NO: 956776 - DNA, 25 bp, Mus musculus
ttgggtatattcttttgtgctaaaa

SEQ ID NO: 956777 - DNA, 25 bp, Mus musculus
ttgggtatattgctgccacagggct

SEQ ID NO: 956778 - DNA, 25 bp, Mus musculus
ttgggtatattggtgccacagggct

SEQ ID NO: 956779 - DNA, 25 bp, Mus musculus
ttgggtatctacacacgtttgcata

SEQ ID NO: 956780 - DNA, 25 bp, Mus musculus
ttgggtatctactcacgtttgcata

SEQ ID NO: 956781 - DNA, 25 bp, Mus musculus
ttgggtattatcacctttccttgtc

SEQ ID NO: 956782 - DNA, 25 bp, Mus musculus
ttgggtattatctcctttccttgtc

SEQ ID NO: 956783 - DNA, 25 bp, Mus musculus
ttgggtattttcatcgtgcaaagtt

SEQ ID NO: 956784 - DNA, 25 bp, Mus musculus
ttgggtattttcttcgtgcaaagtt

SEQ ID NO: 956785 - DNA, 25 bp, Mus musculus
ttgggtcaagaccttaccacatgac

SEQ ID NO: 956786 - DNA, 25 bp, Mus musculus
ttgggtcaagacgttaccacatgac

SEQ ID NO: 956787 - DNA, 25 bp, Mus musculus
ttgggtcaagtaacctaaaaatagc

SEQ ID NO: 956788 - DNA, 25 bp, Mus musculus
ttgggtcaagtatcctaaaaatagc

SEQ ID NO: 956789 - DNA, 25 bp, Mus musculus
ttgggtcaccagaagccttgcaagt

SEQ ID NO: 956790 - DNA, 25 bp, Mus musculus
ttgggtcaccagtagccttgcaagt

SEQ ID NO: 956791 - DNA, 25 bp, Mus musculus
ttgggtcaccttctggatctatgct

SEQ ID NO: 956792 - DNA, 25 bp, Mus musculus
ttgggtcaccttgtggatctatgct

SEQ ID NO: 956793 - DNA, 25 bp, Mus musculus
ttgggtcactcacggatgcctccaa

SEQ ID NO: 956794 - DNA, 25 bp, Mus musculus
ttgggtcactcagggatgcctccaa

SEQ ID NO: 956795 - DNA, 25 bp, Mus musculus
ttgggtcactgacgccactatacgg

SEQ ID NO: 956796 - DNA, 25 bp, Mus musculus
ttgggtcactgaggccactatacgg

SEQ ID NO: 956797 - DNA, 25 bp, Mus musculus
ttgggtcagattccaatgaaccatt

SEQ ID NO: 956798 - DNA, 25 bp, Mus musculus
ttgggtcagattgcaatgaaccatt

SEQ ID NO: 956799 - DNA, 25 bp, Mus musculus
ttgggtcagccaaaggtccaggcta

SEQ ID NO: 956800 - DNA, 25 bp, Mus musculus
ttgggtcagccataggtccaggcta

SEQ ID NO: 956801 - DNA, 25 bp, Mus musculus
ttgggtcagttaaagggtttttcag

SEQ ID NO: 956802 - DNA, 25 bp, Mus musculus
ttgggtcagttatagggtttttcag

SEQ ID NO: 956803 - DNA, 25 bp, Mus musculus
ttgggtcattcaaaaagtcaacctt

SEQ ID NO: 956804 - DNA, 25 bp, Mus musculus
ttgggtcattcaccacggtcaaagt

SEQ ID NO: 956805 - DNA, 25 bp, Mus musculus
ttgggtcattcagcacggtcaaagt

SEQ ID NO: 956806 - DNA, 25 bp, Mus musculus
ttgggtcattcataaagtcaacctt

SEQ ID NO: 956807 - DNA, 25 bp, Mus musculus
ttgggtcattgtcataagagttctt

SEQ ID NO: 956808 - DNA, 25 bp, Mus musculus
ttgggtcattgtgataagagttctt

SEQ ID NO: 956809 - DNA, 25 bp, Mus musculus
ttgggtccaacaagccagaggcatt

SEQ ID NO: 956810 - DNA, 25 bp, Mus musculus
ttgggtccaacatgccagaggcatt

SEQ ID NO: 956811 - DNA, 25 bp, Mus musculus
ttgggtccacaaatcttcagagatg

SEQ ID NO: 956812 - DNA, 25 bp, Mus musculus
ttgggtccacaattcttcagagatg

SEQ ID NO: 956813 - DNA, 25 bp, Mus musculus
ttgggtccacataatagcatgaaga

SEQ ID NO: 956814 - DNA, 25 bp, Mus musculus
ttgggtccacattatagcatgaaga

SEQ ID NO: 956815 - DNA, 25 bp, Mus musculus
ttgggtccagttatcagcaaccagt

SEQ ID NO: 956816 - DNA, 25 bp, Mus musculus
ttgggtccagttttcagcaaccagt

SEQ ID NO: 956817 - DNA, 25 bp, Mus musculus
ttgggtccatctaatttcactgtta

SEQ ID NO: 956818 - DNA, 25 bp, Mus musculus
ttgggtccatcttatttcactgtta

SEQ ID NO: 956819 - DNA, 25 bp, Mus musculus
ttgggtccctatcataacagagcct

SEQ ID NO: 956820 - DNA, 25 bp, Mus musculus
ttgggtccctatgataacagagcct

SEQ ID NO: 956821 - DNA, 25 bp, Mus musculus
ttgggtccctccagtaaagcctgaa

SEQ ID NO: 956822 - DNA, 25 bp, Mus musculus
ttgggtccctcctgtaaagcctgaa

SEQ ID NO: 956823 - DNA, 25 bp, Mus musculus
ttgggtccctctccttttgattact

SEQ ID NO: 956824 - DNA, 25 bp, Mus musculus
ttgggtccctctcggtgttgtaaga

SEQ ID NO: 956825 - DNA, 25 bp, Mus musculus
ttgggtccctctgcttttgattact

SEQ ID NO: 956826 - DNA, 25 bp, Mus musculus
ttgggtccctctgggtgttgtaaga

SEQ ID NO: 956827 - DNA, 25 bp, Mus musculus
ttgggtccggtcacagacgtaacat

SEQ ID NO: 956828 - DNA, 25 bp, Mus musculus
ttgggtccggtctcagacgtaacat

SEQ ID NO: 956829 - DNA, 25 bp, Mus musculus
ttgggtcctggaaaaaactcagctt

SEQ ID NO: 956830 - DNA, 25 bp, Mus musculus
ttgggtcctggataaaactcagctt

SEQ ID NO: 956831 - DNA, 25 bp, Mus musculus
ttgggtccttataaagcttacgctg

SEQ ID NO: 956832 - DNA, 25 bp, Mus musculus
ttgggtccttattaagcttacgctg

SEQ ID NO: 956833 - DNA, 25 bp, Mus musculus
ttgggtccttcaaaccacaacagat

SEQ ID NO: 956834 - DNA, 25 bp, Mus musculus
ttgggtccttcaattgttctcgctg

SEQ ID NO: 956835 - DNA, 25 bp, Mus musculus
ttgggtccttcataccacaacagat

SEQ ID NO: 956836 - DNA, 25 bp, Mus musculus
ttgggtccttcatttgttctcgctg

SEQ ID NO: 956837 - DNA, 25 bp, Mus musculus
ttgggtcgacagcacgacctctgta

SEQ ID NO: 956838 - DNA, 25 bp, Mus musculus
ttgggtcgacaggacgacctctgta

SEQ ID NO: 956839 - DNA, 25 bp, Mus musculus
ttgggtcgagccctacttcagattc

SEQ ID NO: 956840 - DNA, 25 bp, Mus musculus
ttgggtcgagccgtacttcagattc

SEQ ID NO: 956841 - DNA, 25 bp, Mus musculus
ttgggtcgcagacaaggtatagtcc

SEQ ID NO: 956842 - DNA, 25 bp, Mus musculus
ttgggtcgcagagaaggtatagtcc

SEQ ID NO: 956843 - DNA, 25 bp, Mus musculus
ttgggtctagacagcctgatcggat

SEQ ID NO: 956844 - DNA, 25 bp, Mus musculus
ttgggtctagactgcctgatcggat

SEQ ID NO: 956845 - DNA, 25 bp, Mus musculus
ttgggtctcacacgcactgcaaatg

SEQ ID NO: 956846 - DNA, 25 bp, Mus musculus
ttgggtctcacaggcactgcaaatg

SEQ ID NO: 956847 - DNA, 25 bp, Mus musculus
ttgggtctccacaccccagatgtta

SEQ ID NO: 956848 - DNA, 25 bp, Mus musculus
ttgggtctccactccccagatgtta

SEQ ID NO: 956849 - DNA, 25 bp, Mus musculus
ttgggtctccgaagaggaaatctct

SEQ ID NO: 956850 - DNA, 25 bp, Mus musculus
ttgggtctccgatgaggaaatctct

SEQ ID NO: 956851 - DNA, 25 bp, Mus musculus
ttgggtctctacactggtcagctgg

SEQ ID NO: 956852 - DNA, 25 bp, Mus musculus
ttgggtctctactctggtcagctgg

SEQ ID NO: 956853 - DNA, 25 bp, Mus musculus
ttgggtctctcacacactgttgaag

SEQ ID NO: 956854 - DNA, 25 bp, Mus musculus
ttgggtctctcagacactgttgaag

SEQ ID NO: 956855 - DNA, 25 bp, Mus musculus
ttgggtctctccatccagaggcaac

SEQ ID NO: 956856 - DNA, 25 bp, Mus musculus
ttgggtctctccttccagaggcaac

SEQ ID NO: 956857 - DNA, 25 bp, Mus musculus
ttgggtctctctagggtcatgctcg

SEQ ID NO: 956858 - DNA, 25 bp, Mus musculus
ttgggtctctcttgggtcatgctcg

SEQ ID NO: 956859 - DNA, 25 bp, Mus musculus
ttgggtctctgtcacacctatgaaa

SEQ ID NO: 956860 - DNA, 25 bp, Mus musculus
ttgggtctctgtgacacctatgaaa

SEQ ID NO: 956861 - DNA, 25 bp, Mus musculus
ttgggtctgactcggacctggctca

SEQ ID NO: 956862 - DNA, 25 bp, Mus musculus
ttgggtctgactgggacctggctca

SEQ ID NO: 956863 - DNA, 25 bp, Mus musculus
ttgggtctggagattctagtgtttt

SEQ ID NO: 956864 - DNA, 25 bp, Mus musculus
ttgggtctggagtttctagtgtttt

SEQ ID NO: 956865 - DNA, 25 bp, Mus musculus
ttgggtctggtccttagaactcaca

SEQ ID NO: 956866 - DNA, 25 bp, Mus musculus
ttgggtctggtcgttagaactcaca

SEQ ID NO: 956867 - DNA, 25 bp, Mus musculus
ttgggtctgtcgctggtaaagacac

SEQ ID NO: 956868 - DNA, 25 bp, Mus musculus
ttgggtctgtcggtggtaaagacac

SEQ ID NO: 956869 - DNA, 25 bp, Mus musculus
ttgggtcttaacatattggaactgt

SEQ ID NO: 956870 - DNA, 25 bp, Mus musculus
ttgggtcttaacttattggaactgt

SEQ ID NO: 956871 - DNA, 25 bp, Mus musculus
ttgggtcttacccttgcctagaata

SEQ ID NO: 956872 - DNA, 25 bp, Mus musculus
ttgggtcttaccgttgcctagaata

SEQ ID NO: 956873 - DNA, 25 bp, Mus musculus
ttgggtcttccgaggccaagagctt

SEQ ID NO: 956874 - DNA, 25 bp, Mus musculus
ttgggtcttccgtggccaagagctt

SEQ ID NO: 956875 - DNA, 25 bp, Mus musculus
ttgggtcttgctagatggtatacat

SEQ ID NO: 956876 - DNA, 25 bp, Mus musculus
ttgggtcttgcttgatggtatacat

SEQ ID NO: 956877 - DNA, 25 bp, Mus musculus
ttgggtgaactgagccgactggact

SEQ ID NO: 956878 - DNA, 25 bp, Mus musculus
ttgggtgaactgtgccgactggact

SEQ ID NO: 956879 - DNA, 25 bp, Mus musculus
ttgggtgaccctatactgggcagaa

SEQ ID NO: 956880 - DNA, 25 bp, Mus musculus
ttgggtgaccctttactgggcagaa

SEQ ID NO: 956881 - DNA, 25 bp, Mus musculus
ttgggtgacctactttttaagctgt

SEQ ID NO: 956882 - DNA, 25 bp, Mus musculus
ttgggtgacctagtttttaagctgt

SEQ ID NO: 956883 - DNA, 25 bp, Mus musculus
ttgggtgacgctctgaggtcacttt

SEQ ID NO: 956884 - DNA, 25 bp, Mus musculus
ttgggtgacgctgtgaggtcacttt

SEQ ID NO: 956885 - DNA, 25 bp, Mus musculus
ttgggtgagtcccagtctcatcttg

SEQ ID NO: 956886 - DNA, 25 bp, Mus musculus
ttgggtgagtccgagtctcatcttg

SEQ ID NO: 956887 - DNA, 25 bp, Mus musculus
ttgggtgattatccacgtgcgctgc

SEQ ID NO: 956888 - DNA, 25 bp, Mus musculus
ttgggtgattatgcacgtgcgctgc

SEQ ID NO: 956889 - DNA, 25 bp, Mus musculus
ttgggtgcaggtacgaaggctactt

SEQ ID NO: 956890 - DNA, 25 bp, Mus musculus
ttgggtgcaggttcgaaggctactt

SEQ ID NO: 956891 - DNA, 25 bp, Mus musculus
ttgggtgccaccaactgagccaggc

SEQ ID NO: 956892 - DNA, 25 bp, Mus musculus
ttgggtgccacctactgagccaggc

SEQ ID NO: 956893 - DNA, 25 bp, Mus musculus
ttgggtgccacgaatgaactttcct

SEQ ID NO: 956894 - DNA, 25 bp, Mus musculus
ttgggtgccacgtatgaactttcct

SEQ ID NO: 956895 - DNA, 25 bp, Mus musculus
ttgggtgccagcagtccaggtacag

SEQ ID NO: 956896 - DNA, 25 bp, Mus musculus
ttgggtgccagctgtccaggtacag

SEQ ID NO: 956897 - DNA, 25 bp, Mus musculus
ttgggtgcccataggtcccctgtgg

SEQ ID NO: 956898 - DNA, 25 bp, Mus musculus
ttgggtgcccattggtcccctgtgg

SEQ ID NO: 956899 - DNA, 25 bp, Mus musculus
ttgggtgcctcgacgggcccgggtg

SEQ ID NO: 956900 - DNA, 25 bp, Mus musculus
ttgggtgcctcgtcgggcccgggtg

SEQ ID NO: 956901 - DNA, 25 bp, Mus musculus
ttgggtgctgcccatcattgaatcc

SEQ ID NO: 956902 - DNA, 25 bp, Mus musculus
ttgggtgctgccgatcattgaatcc

SEQ ID NO: 956903 - DNA, 25 bp, Mus musculus
ttgggtggaccaaattccctcctgg

SEQ ID NO: 956904 - DNA, 25 bp, Mus musculus
ttgggtggaccatattccctcctgg

SEQ ID NO: 956905 - DNA, 25 bp, Mus musculus
ttgggtggactgactacatagttat

SEQ ID NO: 956906 - DNA, 25 bp, Mus musculus
ttgggtggactgtctacatagttat

SEQ ID NO: 956907 - DNA, 25 bp, Mus musculus
ttgggtggagacaggcctcttgcct

SEQ ID NO: 956908 - DNA, 25 bp, Mus musculus
ttgggtggagactggcctcttgcct

SEQ ID NO: 956909 - DNA, 25 bp, Mus musculus
ttgggtggatcacagtctgcactct

SEQ ID NO: 956910 - DNA, 25 bp, Mus musculus
ttgggtggatcagagtctgcactct

SEQ ID NO: 956911 - DNA, 25 bp, Mus musculus
ttgggtggcacaccgaattccagtt

SEQ ID NO: 956912 - DNA, 25 bp, Mus musculus
ttgggtggcacagcgaattccagtt

SEQ ID NO: 956913 - DNA, 25 bp, Mus musculus
ttgggtgggcatctgcgttctcaaa

SEQ ID NO: 956914 - DNA, 25 bp, Mus musculus
ttgggtgggcatgtgcgttctcaaa

SEQ ID NO: 956915 - DNA, 25 bp, Mus musculus
ttgggtgggtgcaggaagtggcaga

SEQ ID NO: 956916 - DNA, 25 bp, Mus musculus
ttgggtgggtgcagtcagtaccttc

SEQ ID NO: 956917 - DNA, 25 bp, Mus musculus
ttgggtgggtgctggaagtggcaga

SEQ ID NO: 956918 - DNA, 25 bp, Mus musculus
ttgggtgggtgctgtcagtaccttc

SEQ ID NO: 956919 - DNA, 25 bp, Mus musculus
ttgggtggtgagaatctagcctgct

SEQ ID NO: 956920 - DNA, 25 bp, Mus musculus
ttgggtggtgagtatctagcctgct

SEQ ID NO: 956921 - DNA, 25 bp, Mus musculus
ttgggtggtgttcctgtttgcccct

SEQ ID NO: 956922 - DNA, 25 bp, Mus musculus
ttgggtggtgttctagtgttcattt

SEQ ID NO: 956923 - DNA, 25 bp, Mus musculus
ttgggtggtgttgctgtttgcccct

SEQ ID NO: 956924 - DNA, 25 bp, Mus musculus
ttgggtggtgttgtagtgttcattt

SEQ ID NO: 956925 - DNA, 25 bp, Mus musculus
ttgggtggttgcctatcagacatcc

SEQ ID NO: 956926 - DNA, 25 bp, Mus musculus
ttgggtggttgcgtatcagacatcc

SEQ ID NO: 956927 - DNA, 25 bp, Mus musculus
ttgggtgtatttagctaagtgaaac

SEQ ID NO: 956928 - DNA, 25 bp, Mus musculus
ttgggtgtattttgctaagtgaaac

SEQ ID NO: 956929 - DNA, 25 bp, Mus musculus
ttgggtgtcacacgtccaggataca

SEQ ID NO: 956930 - DNA, 25 bp, Mus musculus
ttgggtgtcacaggtccaggataca

SEQ ID NO: 956931 - DNA, 25 bp, Mus musculus
ttgggtgtccagatgtgtgtcctga

SEQ ID NO: 956932 - DNA, 25 bp, Mus musculus
ttgggtgtccagttgtgtgtcctga

SEQ ID NO: 956933 - DNA, 25 bp, Mus musculus
ttgggtgtcccactagaatgagact

SEQ ID NO: 956934 - DNA, 25 bp, Mus musculus
ttgggtgtcccagtagaatgagact

SEQ ID NO: 956935 - DNA, 25 bp, Mus musculus
ttgggtgtcctaatactgccttggt

SEQ ID NO: 956936 - DNA, 25 bp, Mus musculus
ttgggtgtcctattactgccttggt

SEQ ID NO: 956937 - DNA, 25 bp, Mus musculus
ttgggtgtcctgcaggttactatac

SEQ ID NO: 956938 - DNA, 25 bp, Mus musculus
ttgggtgtcctggaggttactatac

SEQ ID NO: 956939 - DNA, 25 bp, Mus musculus
ttgggtgtggttattccagcagtca

SEQ ID NO: 956940 - DNA, 25 bp, Mus musculus
ttgggtgtggtttttccagcagtca

SEQ ID NO: 956941 - DNA, 25 bp, Mus musculus
ttgggtgttgtcacaagggtttcct

SEQ ID NO: 956942 - DNA, 25 bp, Mus musculus
ttgggtgttgtctcaagggtttcct

SEQ ID NO: 956943 - DNA, 25 bp, Mus musculus
ttgggtgtttacaaagggatccctg

SEQ ID NO: 956944 - DNA, 25 bp, Mus musculus
ttgggtgtttactaagggatccctg

SEQ ID NO: 956945 - DNA, 25 bp, Mus musculus
ttgggtgtttttcgacatactcgtc

SEQ ID NO: 956946 - DNA, 25 bp, Mus musculus
ttgggtgtttttggacatactcgtc

SEQ ID NO: 956947 - DNA, 25 bp, Mus musculus
ttgggttaaaacacattctctaggt

SEQ ID NO: 956948 - DNA, 25 bp, Mus musculus
ttgggttaaaactcattctctaggt

SEQ ID NO: 956949 - DNA, 25 bp, Mus musculus
ttgggttaagcaaacaatcctgacc

SEQ ID NO: 956950 - DNA, 25 bp, Mus musculus
ttgggttaagcatacaatcctgacc

SEQ ID NO: 956951 - DNA, 25 bp, Mus musculus
ttgggttacagtcatccctaggcac

SEQ ID NO: 956952 - DNA, 25 bp, Mus musculus
ttgggttacagtgatccctaggcac

SEQ ID NO: 956953 - DNA, 25 bp, Mus musculus
ttgggttacatcactaagtcaggaa

SEQ ID NO: 956954 - DNA, 25 bp, Mus musculus
ttgggttacatctctaagtcaggaa

SEQ ID NO: 956955 - DNA, 25 bp, Mus musculus
ttgggttagacaagtgtgagctcag

SEQ ID NO: 956956 - DNA, 25 bp, Mus musculus
ttgggttagacatgtgtgagctcag

SEQ ID NO: 956957 - DNA, 25 bp, Mus musculus
ttgggttagactcggctacaaacta

SEQ ID NO: 956958 - DNA, 25 bp, Mus musculus
ttgggttagactgggctacaaacta

SEQ ID NO: 956959 - DNA, 25 bp, Mus musculus
ttgggttagccaacctgatctttaa

SEQ ID NO: 956960 - DNA, 25 bp, Mus musculus
ttgggttagccatcctgatctttaa

SEQ ID NO: 956961 - DNA, 25 bp, Mus musculus
ttgggttagctcacccatgtactgc

SEQ ID NO: 956962 - DNA, 25 bp, Mus musculus
ttgggttagctctcccatgtactgc

SEQ ID NO: 956963 - DNA, 25 bp, Mus musculus
ttgggttatgatattggcaacgacc

SEQ ID NO: 956964 - DNA, 25 bp, Mus musculus
ttgggttatgattttggcaacgacc

SEQ ID NO: 956965 - DNA, 25 bp, Mus musculus
ttgggttatggtacaatgagccaga

SEQ ID NO: 956966 - DNA, 25 bp, Mus musculus
ttgggttatggttcaatgagccaga

SEQ ID NO: 956967 - DNA, 25 bp, Mus musculus
ttgggttcacatatttgggaaatca

SEQ ID NO: 956968 - DNA, 25 bp, Mus musculus
ttgggttcacatttttgggaaatca

SEQ ID NO: 956969 - DNA, 25 bp, Mus musculus
ttgggttccaaaaacatgaatgtac

SEQ ID NO: 956970 - DNA, 25 bp, Mus musculus
ttgggttccaaatacatgaatgtac

SEQ ID NO: 956971 - DNA, 25 bp, Mus musculus
ttgggttcccaccattcatcatgag

SEQ ID NO: 956972 - DNA, 25 bp, Mus musculus
ttgggttcccacgattcatcatgag

SEQ ID NO: 956973 - DNA, 25 bp, Mus musculus
ttgggttccctccttagactgtgtg

SEQ ID NO: 956974 - DNA, 25 bp, Mus musculus
ttgggttccctcgttagactgtgtg

SEQ ID NO: 956975 - DNA, 25 bp, Mus musculus
ttgggttccggccacatggctaaac

SEQ ID NO: 956976 - DNA, 25 bp, Mus musculus
ttgggttccggcgacatggctaaac

SEQ ID NO: 956977 - DNA, 25 bp, Mus musculus
ttgggttcctgaatgcaccataatt

SEQ ID NO: 956978 - DNA, 25 bp, Mus musculus
ttgggttcctgattgcaccataatt

SEQ ID NO: 956979 - DNA, 25 bp, Mus musculus
ttgggttcctttagtcaggccaata

SEQ ID NO: 956980 - DNA, 25 bp, Mus musculus
ttgggttccttttgtcaggccaata

SEQ ID NO: 956981 - DNA, 25 bp, Mus musculus
ttgggttcgtgaaagatcaagatga

SEQ ID NO: 956982 - DNA, 25 bp, Mus musculus
ttgggttcgtgatagatcaagatga

SEQ ID NO: 956983 - DNA, 25 bp, Mus musculus
ttgggttctaagcaggactcttcct

SEQ ID NO: 956984 - DNA, 25 bp, Mus musculus
ttgggttctaaggaggactcttcct

SEQ ID NO: 956985 - DNA, 25 bp, Mus musculus
ttgggttctatactgtgacctcatt

SEQ ID NO: 956986 - DNA, 25 bp, Mus musculus
ttgggttctatagtgtgacctcatt

SEQ ID NO: 956987 - DNA, 25 bp, Mus musculus
ttgggttctctaaagctggcatcat

SEQ ID NO: 956988 - DNA, 25 bp, Mus musculus
ttgggttctctaagacagcagtctg

SEQ ID NO: 956989 - DNA, 25 bp, Mus musculus
ttgggttctctatagctggcatcat

SEQ ID NO: 956990 - DNA, 25 bp, Mus musculus
ttgggttctctatgacagcagtctg

SEQ ID NO: 956991 - DNA, 25 bp, Mus musculus
ttgggttctggactcaaccgatcct

SEQ ID NO: 956992 - DNA, 25 bp, Mus musculus
ttgggttctggagtcaaccgatcct

SEQ ID NO: 956993 - DNA, 25 bp, Mus musculus
ttgggttcttgcctcaacgcaaaac

SEQ ID NO: 956994 - DNA, 25 bp, Mus musculus
ttgggttcttgcgtcaacgcaaaac

SEQ ID NO: 956995 - DNA, 25 bp, Mus musculus
ttgggttgaaccaagtatgtactgc

SEQ ID NO: 956996 - DNA, 25 bp, Mus musculus
ttgggttgaacctagtatgtactgc

SEQ ID NO: 956997 - DNA, 25 bp, Mus musculus
ttgggttgactgaatttttattaag

SEQ ID NO: 956998 - DNA, 25 bp, Mus musculus
ttgggttgactgtatttttattaag

SEQ ID NO: 956999 - DNA, 25 bp, Mus musculus
ttgggttgatccagccttatgcaaa

SEQ ID NO: 957000 - DNA, 25 bp, Mus musculus
ttgggttgatcctgccttatgcaaa

SEQ ID NO: 957001 - DNA, 25 bp, Mus musculus
ttgggttgatgaatggtggccgaca

SEQ ID NO: 957002 - DNA, 25 bp, Mus musculus
ttgggttgatgattggtggccgaca

SEQ ID NO: 957003 - DNA, 25 bp, Mus musculus
ttgggttgcatgaagcagcgagctt

SEQ ID NO: 957004 - DNA, 25 bp, Mus musculus
ttgggttgcatgtagcagcgagctt

SEQ ID NO: 957005 - DNA, 25 bp, Mus musculus
ttgggttggtccatcagttcatgtg

SEQ ID NO: 957006 - DNA, 25 bp, Mus musculus
ttgggttggtccttcagttcatgtg

SEQ ID NO: 957007 - DNA, 25 bp, Mus musculus
ttgggttggtttacacttgcactca

SEQ ID NO: 957008 - DNA, 25 bp, Mus musculus
ttgggttggttttcacttgcactca

SEQ ID NO: 957009 - DNA, 25 bp, Mus musculus
ttgggttgtaaacacaccgggtcat

SEQ ID NO: 957010 - DNA, 25 bp, Mus musculus
ttgggttgtaaagacaccgggtcat

SEQ ID NO: 957011 - DNA, 25 bp, Mus musculus
ttgggttgtaggactttcctggccg

SEQ ID NO: 957012 - DNA, 25 bp, Mus musculus
ttgggttgtaggtctttcctggccg

SEQ ID NO: 957013 - DNA, 25 bp, Mus musculus
ttgggttgttgtatgtttgaggcag

SEQ ID NO: 957014 - DNA, 25 bp, Mus musculus
ttgggttgttgtttgtttgaggcag

SEQ ID NO: 957015 - DNA, 25 bp, Mus musculus
ttgggtttaatcctcggtgctggat

SEQ ID NO: 957016 - DNA, 25 bp, Mus musculus
ttgggtttaatcgtcggtgctggat

SEQ ID NO: 957017 - DNA, 25 bp, Mus musculus
ttgggtttatttatgtggctaattg

SEQ ID NO: 957018 - DNA, 25 bp, Mus musculus
ttgggtttatttttgtggctaattg

SEQ ID NO: 957019 - DNA, 25 bp, Mus musculus
ttgggtttcaagacatgcctttgta

SEQ ID NO: 957020 - DNA, 25 bp, Mus musculus
ttgggtttcaagtcatgcctttgta

SEQ ID NO: 957021 - DNA, 25 bp, Mus musculus
ttgggtttcatactaactgtgttac

SEQ ID NO: 957022 - DNA, 25 bp, Mus musculus
ttgggtttcatagtaactgtgttac

SEQ ID NO: 957023 - DNA, 25 bp, Mus musculus
ttgggtttccaacaaccacctggtg

SEQ ID NO: 957024 - DNA, 25 bp, Mus musculus
ttgggtttccaagaaccacctggtg

SEQ ID NO: 957025 - DNA, 25 bp, Mus musculus
ttgggtttcccgagagccagacaaa

SEQ ID NO: 957026 - DNA, 25 bp, Mus musculus
ttgggtttcccgtgagccagacaaa

SEQ ID NO: 957027 - DNA, 25 bp, Mus musculus
ttgggtttccttagctggttgaata

SEQ ID NO: 957028 - DNA, 25 bp, Mus musculus
ttgggtttcctttgctggttgaata

SEQ ID NO: 957029 - DNA, 25 bp, Mus musculus
ttgggtttcgtgagactgcagtgcc

SEQ ID NO: 957030 - DNA, 25 bp, Mus musculus
ttgggtttcgtgtgactgcagtgcc

SEQ ID NO: 957031 - DNA, 25 bp, Mus musculus
ttgggtttctgtcgttcactcggtg

SEQ ID NO: 957032 - DNA, 25 bp, Mus musculus
ttgggtttctgtggttcactcggtg

SEQ ID NO: 957033 - DNA, 25 bp, Mus musculus
ttgggtttgaacaatctttgtgaaa

SEQ ID NO: 957034 - DNA, 25 bp, Mus musculus
ttgggtttgaaccttgggcttcatc

SEQ ID NO: 957035 - DNA, 25 bp, Mus musculus
ttgggtttgaacgttgggcttcatc

SEQ ID NO: 957036 - DNA, 25 bp, Mus musculus
ttgggtttgaactatctttgtgaaa

SEQ ID NO: 957037 - DNA, 25 bp, Mus musculus
ttgggtttggagcacgacgacacac

SEQ ID NO: 957038 - DNA, 25 bp, Mus musculus
ttgggtttggaggacgacgacacac

SEQ ID NO: 957039 - DNA, 25 bp, Mus musculus
ttgggtttggcactgctgtagcctt

SEQ ID NO: 957040 - DNA, 25 bp, Mus musculus
ttgggtttggcagtgctgtagcctt

SEQ ID NO: 957041 - DNA, 25 bp, Mus musculus
ttgggtttgtatcgccctccagtcc

SEQ ID NO: 957042 - DNA, 25 bp, Mus musculus
ttgggtttgtatggccctccagtcc

SEQ ID NO: 957043 - DNA, 25 bp, Mus musculus
ttgggtttgttaagccattggctga

SEQ ID NO: 957044 - DNA, 25 bp, Mus musculus
ttgggtttgttaccagcaacactgc

SEQ ID NO: 957045 - DNA, 25 bp, Mus musculus
ttgggtttgttagcagcaacactgc

SEQ ID NO: 957046 - DNA, 25 bp, Mus musculus
ttgggtttgttatgccattggctga

SEQ ID NO: 957047 - DNA, 25 bp, Mus musculus
ttgggttttcacaaattgattcatc

SEQ ID NO: 957048 - DNA, 25 bp, Mus musculus
ttgggttttcactaattgattcatc

SEQ ID NO: 957049 - DNA, 25 bp, Mus musculus
ttgggttttgacacagtctcctgat

SEQ ID NO: 957050 - DNA, 25 bp, Mus musculus
ttgggttttgactcagtctcctgat

SEQ ID NO: 957051 - DNA, 25 bp, Mus musculus
ttgggttttgggagtccagttgata

SEQ ID NO: 957052 - DNA, 25 bp, Mus musculus
ttgggttttgggtgtccagttgata

SEQ ID NO: 957053 - DNA, 25 bp, Mus musculus
ttgggtttttatctccagtgcgttc

SEQ ID NO: 957054 - DNA, 25 bp, Mus musculus
ttgggtttttatgtccagtgcgttc

SEQ ID NO: 957055 - DNA, 25 bp, Mus musculus
ttggtaaacagccttttctcctgtc

SEQ ID NO: 957056 - DNA, 25 bp, Mus musculus
ttggtaaacagcgttttctcctgtc

SEQ ID NO: 957057 - DNA, 25 bp, Mus musculus
ttggtaaacaggatccatgtaagaa

SEQ ID NO: 957058 - DNA, 25 bp, Mus musculus
ttggtaaacaggttccatgtaagaa

SEQ ID NO: 957059 - DNA, 25 bp, Mus musculus
ttggtaaaccctaagccctgtatga

SEQ ID NO: 957060 - DNA, 25 bp, Mus musculus
ttggtaaacccttagccctgtatga

SEQ ID NO: 957061 - DNA, 25 bp, Mus musculus
ttggtaaacgtcagcagctttggct

SEQ ID NO: 957062 - DNA, 25 bp, Mus musculus
ttggtaaacgtctgcagctttggct

SEQ ID NO: 957063 - DNA, 25 bp, Mus musculus
ttggtaaagatgacttccctggtgg

SEQ ID NO: 957064 - DNA, 25 bp, Mus musculus
ttggtaaagatgtcttccctggtgg

SEQ ID NO: 957065 - DNA, 25 bp, Mus musculus
ttggtaaagtcaccatgagtaattt

SEQ ID NO: 957066 - DNA, 25 bp, Mus musculus
ttggtaaagtcagcatgagtaattt

SEQ ID NO: 957067 - DNA, 25 bp, Mus musculus
ttggtaaatgccacctagggttggt

SEQ ID NO: 957068 - DNA, 25 bp, Mus musculus
ttggtaaatgcctcctagggttggt

SEQ ID NO: 957069 - DNA, 25 bp, Mus musculus
ttggtaacagttacacattcccacc

SEQ ID NO: 957070 - DNA, 25 bp, Mus musculus
ttggtaacagtttcacattcccacc

SEQ ID NO: 957071 - DNA, 25 bp, Mus musculus
ttggtaaccactcatctccagtgac

SEQ ID NO: 957072 - DNA, 25 bp, Mus musculus
ttggtaaccactgatctccagtgac

SEQ ID NO: 957073 - DNA, 25 bp, Mus musculus
ttggtaacgcctccaggcccagtat

SEQ ID NO: 957074 - DNA, 25 bp, Mus musculus
ttggtaacgcctgcaggcccagtat

SEQ ID NO: 957075 - DNA, 25 bp, Mus musculus
ttggtaactgctaagttccagatcc

SEQ ID NO: 957076 - DNA, 25 bp, Mus musculus
ttggtaactgcttagttccagatcc

SEQ ID NO: 957077 - DNA, 25 bp, Mus musculus
ttggtaactgtgctccacctggcta

SEQ ID NO: 957078 - DNA, 25 bp, Mus musculus
ttggtaactgtggtccacctggcta

SEQ ID NO: 957079 - DNA, 25 bp, Mus musculus
ttggtaagacacctaacttcaggct

SEQ ID NO: 957080 - DNA, 25 bp, Mus musculus
ttggtaagacacgtaacttcaggct

SEQ ID NO: 957081 - DNA, 25 bp, Mus musculus
ttggtaagagttcgtctgcaaaaga

SEQ ID NO: 957082 - DNA, 25 bp, Mus musculus
ttggtaagagttggtctgcaaaaga

SEQ ID NO: 957083 - DNA, 25 bp, Mus musculus
ttggtaagctatagagggccagaca

SEQ ID NO: 957084 - DNA, 25 bp, Mus musculus
ttggtaagctattgagggccagaca

SEQ ID NO: 957085 - DNA, 25 bp, Mus musculus
ttggtaatccaccaccaagcctggg

SEQ ID NO: 957086 - DNA, 25 bp, Mus musculus
ttggtaatccacgaccaagcctggg

SEQ ID NO: 957087 - DNA, 25 bp, Mus musculus
ttggtaatgagccccggattacgcg

SEQ ID NO: 957088 - DNA, 25 bp, Mus musculus
ttggtaatgagcgccggattacgcg

SEQ ID NO: 957089 - DNA, 25 bp, Mus musculus
ttggtaatgtgacccactacgttta

SEQ ID NO: 957090 - DNA, 25 bp, Mus musculus
ttggtaatgtgagccactacgttta

SEQ ID NO: 957091 - DNA, 25 bp, Mus musculus
ttggtaatgtgccttcttggttctt

SEQ ID NO: 957092 - DNA, 25 bp, Mus musculus
ttggtaatgtgcgttcttggttctt

SEQ ID NO: 957093 - DNA, 25 bp, Mus musculus
ttggtaattaggacccagcaatgat

SEQ ID NO: 957094 - DNA, 25 bp, Mus musculus
ttggtaattaggtcccagcaatgat

SEQ ID NO: 957095 - DNA, 25 bp, Mus musculus
ttggtaattgtcaacatttcctggg

SEQ ID NO: 957096 - DNA, 25 bp, Mus musculus
ttggtaattgtctacatttcctggg

SEQ ID NO: 957097 - DNA, 25 bp, Mus musculus
ttggtaatttccagctgcttgtgct

SEQ ID NO: 957098 - DNA, 25 bp, Mus musculus
ttggtaatttcctgctgcttgtgct

SEQ ID NO: 957099 - DNA, 25 bp, Mus musculus
ttggtacacacacagcatggacacc

SEQ ID NO: 957100 - DNA, 25 bp, Mus musculus
ttggtacacacagagcatggacacc

SEQ ID NO: 957101 - DNA, 25 bp, Mus musculus
ttggtacactgtcatccattgttcc

SEQ ID NO: 957102 - DNA, 25 bp, Mus musculus
ttggtacactgtgatccattgttcc

SEQ ID NO: 957103 - DNA, 25 bp, Mus musculus
ttggtacagagacctagttccagta

SEQ ID NO: 957104 - DNA, 25 bp, Mus musculus
ttggtacagagagctagttccagta

SEQ ID NO: 957105 - DNA, 25 bp, Mus musculus
ttggtacagagtctcagtacctata

SEQ ID NO: 957106 - DNA, 25 bp, Mus musculus
ttggtacagagtgtcagtacctata

SEQ ID NO: 957107 - DNA, 25 bp, Mus musculus
ttggtacagggcactctggcctctg

SEQ ID NO: 957108 - DNA, 25 bp, Mus musculus
ttggtacagggctctctggcctctg

SEQ ID NO: 957109 - DNA, 25 bp, Mus musculus
ttggtaccaagaactgtgcatatgt

SEQ ID NO: 957110 - DNA, 25 bp, Mus musculus
ttggtaccaagatctgtgcatatgt

SEQ ID NO: 957111 - DNA, 25 bp, Mus musculus
ttggtacccgtgaggtgaccaccat

SEQ ID NO: 957112 - DNA, 25 bp, Mus musculus
ttggtacccgtgtggtgaccaccat

SEQ ID NO: 957113 - DNA, 25 bp, Mus musculus
ttggtaccctgtacttacaatttat

SEQ ID NO: 957114 - DNA, 25 bp, Mus musculus
ttggtaccctgttcttacaatttat

SEQ ID NO: 957115 - DNA, 25 bp, Mus musculus
ttggtaccgcaacacagaactggtg

SEQ ID NO: 957116 - DNA, 25 bp, Mus musculus
ttggtaccgcaagacagaactggtg

SEQ ID NO: 957117 - DNA, 25 bp, Mus musculus
ttggtaccgctcagcgatcagtgct

SEQ ID NO: 957118 - DNA, 25 bp, Mus musculus
ttggtaccgctctgcgatcagtgct

SEQ ID NO: 957119 - DNA, 25 bp, Mus musculus
ttggtacctcacctccatgatacct

SEQ ID NO: 957120 - DNA, 25 bp, Mus musculus
ttggtacctcacgtccatgatacct

SEQ ID NO: 957121 - DNA, 25 bp, Mus musculus
ttggtacctttcagccctctggctg

SEQ ID NO: 957122 - DNA, 25 bp, Mus musculus
ttggtacctttctgccctctggctg

SEQ ID NO: 957123 - DNA, 25 bp, Mus musculus
ttggtactccagaccaggcaacaaa

SEQ ID NO: 957124 - DNA, 25 bp, Mus musculus
ttggtactccagtccaggcaacaaa

SEQ ID NO: 957125 - DNA, 25 bp, Mus musculus
ttggtacttagtcggctctcaacaa

SEQ ID NO: 957126 - DNA, 25 bp, Mus musculus
ttggtacttagtgggctctcaacaa

SEQ ID NO: 957127 - DNA, 25 bp, Mus musculus
ttggtacttcacacttgctggtgac

SEQ ID NO: 957128 - DNA, 25 bp, Mus musculus
ttggtacttcactcttgctggtgac

SEQ ID NO: 957129 - DNA, 25 bp, Mus musculus
ttggtacttcatatctcccaagcaa

SEQ ID NO: 957130 - DNA, 25 bp, Mus musculus
ttggtacttcatttctcccaagcaa

SEQ ID NO: 957131 - DNA, 25 bp, Mus musculus
ttggtacttccaactacttcagcat

SEQ ID NO: 957132 - DNA, 25 bp, Mus musculus
ttggtacttccatctacttcagcat

SEQ ID NO: 957133 - DNA, 25 bp, Mus musculus
ttggtacttgggattttcctctttg

SEQ ID NO: 957134 - DNA, 25 bp, Mus musculus
ttggtacttgggtttttcctctttg

SEQ ID NO: 957135 - DNA, 25 bp, Mus musculus
ttggtagaaccgagcaggaaggctt

SEQ ID NO: 957136 - DNA, 25 bp, Mus musculus
ttggtagaaccgtgcaggaaggctt

SEQ ID NO: 957137 - DNA, 25 bp, Mus musculus
ttggtagaagttactccagctgacc

SEQ ID NO: 957138 - DNA, 25 bp, Mus musculus
ttggtagaagtttctccagctgacc

SEQ ID NO: 957139 - DNA, 25 bp, Mus musculus
ttggtagactgcacctgtgatccca

SEQ ID NO: 957140 - DNA, 25 bp, Mus musculus
ttggtagactgctcctgtgatccca

SEQ ID NO: 957141 - DNA, 25 bp, Mus musculus
ttggtagatccaatgtctgttctat

SEQ ID NO: 957142 - DNA, 25 bp, Mus musculus
ttggtagatccattgtctgttctat

SEQ ID NO: 957143 - DNA, 25 bp, Mus musculus
ttggtagccacaattctgactctga

SEQ ID NO: 957144 - DNA, 25 bp, Mus musculus
ttggtagccacatttctgactctga

SEQ ID NO: 957145 - DNA, 25 bp, Mus musculus
ttggtagccaccatccactcaatag

SEQ ID NO: 957146 - DNA, 25 bp, Mus musculus
ttggtagccaccatggtcagagacc

SEQ ID NO: 957147 - DNA, 25 bp, Mus musculus
ttggtagccaccttccactcaatag

SEQ ID NO: 957148 - DNA, 25 bp, Mus musculus
ttggtagccaccttggtcagagacc

SEQ ID NO: 957149 - DNA, 25 bp, Mus musculus
ttggtagcccacactttcagatata

SEQ ID NO: 957150 - DNA, 25 bp, Mus musculus
ttggtagcccactctttcagatata

SEQ ID NO: 957151 - DNA, 25 bp, Mus musculus
ttggtagcctagcaggttgttctta

SEQ ID NO: 957152 - DNA, 25 bp, Mus musculus
ttggtagcctaggaggttgttctta

SEQ ID NO: 957153 - DNA, 25 bp, Mus musculus
ttggtagcgagtatggttcgcatcc

SEQ ID NO: 957154 - DNA, 25 bp, Mus musculus
ttggtagcgagtttggttcgcatcc

SEQ ID NO: 957155 - DNA, 25 bp, Mus musculus
ttggtagctaatcaaggccccttta

SEQ ID NO: 957156 - DNA, 25 bp, Mus musculus
ttggtagctaatgaaggccccttta

SEQ ID NO: 957157 - DNA, 25 bp, Mus musculus
ttggtagctaccatgcatctctgca

SEQ ID NO: 957158 - DNA, 25 bp, Mus musculus
ttggtagctaccttgcatctctgca

SEQ ID NO: 957159 - DNA, 25 bp, Mus musculus
ttggtagcttccacgcgggcaggtc

SEQ ID NO: 957160 - DNA, 25 bp, Mus musculus
ttggtagcttcctcgcgggcaggtc

SEQ ID NO: 957161 - DNA, 25 bp, Mus musculus
ttggtaggacctaagcctgattgct

SEQ ID NO: 957162 - DNA, 25 bp, Mus musculus
ttggtaggacctccaagcttgatgt

SEQ ID NO: 957163 - DNA, 25 bp, Mus musculus
ttggtaggacctgcaagcttgatgt

SEQ ID NO: 957164 - DNA, 25 bp, Mus musculus
ttggtaggaccttagcctgattgct

SEQ ID NO: 957165 - DNA, 25 bp, Mus musculus
ttggtaggactactgcttggagctt

SEQ ID NO: 957166 - DNA, 25 bp, Mus musculus
ttggtaggactagtgcttggagctt

SEQ ID NO: 957167 - DNA, 25 bp, Mus musculus
ttggtaggacttagctagtccctat

SEQ ID NO: 957168 - DNA, 25 bp, Mus musculus
ttggtaggactttgctagtccctat

SEQ ID NO: 957169 - DNA, 25 bp, Mus musculus
ttggtaggatccctcagtgtagcat

SEQ ID NO: 957170 - DNA, 25 bp, Mus musculus
ttggtaggatccgtcagtgtagcat

SEQ ID NO: 957171 - DNA, 25 bp, Mus musculus
ttggtaggctcccactttaatcacc

SEQ ID NO: 957172 - DNA, 25 bp, Mus musculus
ttggtaggctccgactttaatcacc

SEQ ID NO: 957173 - DNA, 25 bp, Mus musculus
ttggtagggatccttctctggaact

SEQ ID NO: 957174 - DNA, 25 bp, Mus musculus
ttggtagggatcgttctctggaact

SEQ ID NO: 957175 - DNA, 25 bp, Mus musculus
ttggtagtaatcacccttacctgtt

SEQ ID NO: 957176 - DNA, 25 bp, Mus musculus
ttggtagtaatctcccttacctgtt

SEQ ID NO: 957177 - DNA, 25 bp, Mus musculus
ttggtagtagccagtgcagctcctt

SEQ ID NO: 957178 - DNA, 25 bp, Mus musculus
ttggtagtagcctgtgcagctcctt

SEQ ID NO: 957179 - DNA, 25 bp, Mus musculus
ttggtagtccagagcatttgctgct

SEQ ID NO: 957180 - DNA, 25 bp, Mus musculus
ttggtagtccagtgcatttgctgct

SEQ ID NO: 957181 - DNA, 25 bp, Mus musculus
ttggtagtccccacagcagtgtgtg

SEQ ID NO: 957182 - DNA, 25 bp, Mus musculus
ttggtagtcccctcagcagtgtgtg

SEQ ID NO: 957183 - DNA, 25 bp, Mus musculus
ttggtagtctgaatgctgctatgga

SEQ ID NO: 957184 - DNA, 25 bp, Mus musculus
ttggtagtctgattgctgctatgga

SEQ ID NO: 957185 - DNA, 25 bp, Mus musculus
ttggtagtgcctcccttcgaaacag

SEQ ID NO: 957186 - DNA, 25 bp, Mus musculus
ttggtagtgcctgccttcgaaacag

SEQ ID NO: 957187 - DNA, 25 bp, Mus musculus
ttggtagtgtttctccgggtgcctc

SEQ ID NO: 957188 - DNA, 25 bp, Mus musculus
ttggtagtgtttgtccgggtgcctc

SEQ ID NO: 957189 - DNA, 25 bp, Mus musculus
ttggtagttgtcatctctttggtca

SEQ ID NO: 957190 - DNA, 25 bp, Mus musculus
ttggtagttgtcttctctttggtca

SEQ ID NO: 957191 - DNA, 25 bp, Mus musculus
ttggtataatcacatcaagtcgtat

SEQ ID NO: 957192 - DNA, 25 bp, Mus musculus
ttggtataatcagatcaagtcgtat

SEQ ID NO: 957193 - DNA, 25 bp, Mus musculus
ttggtatcaactcctgtgccattct

SEQ ID NO: 957194 - DNA, 25 bp, Mus musculus
ttggtatcaactgctgtgccattct

SEQ ID NO: 957195 - DNA, 25 bp, Mus musculus
ttggtatcatttcgcctataaacat

SEQ ID NO: 957196 - DNA, 25 bp, Mus musculus
ttggtatcatttggcctataaacat

SEQ ID NO: 957197 - DNA, 25 bp, Mus musculus
ttggtatccgttcatctgagataat

SEQ ID NO: 957198 - DNA, 25 bp, Mus musculus
ttggtatccgttgatctgagataat

SEQ ID NO: 957199 - DNA, 25 bp, Mus musculus
ttggtatctcggaactctttctcca

SEQ ID NO: 957200 - DNA, 25 bp, Mus musculus
ttggtatctcggtactctttctcca

SEQ ID NO: 957201 - DNA, 25 bp, Mus musculus
ttggtatctgcacaggcattgacat

SEQ ID NO: 957202 - DNA, 25 bp, Mus musculus
ttggtatctgcacgcatcatgccac

SEQ ID NO: 957203 - DNA, 25 bp, Mus musculus
ttggtatctgcagaggcattgacat

SEQ ID NO: 957204 - DNA, 25 bp, Mus musculus
ttggtatctgcaggcatcatgccac

SEQ ID NO: 957205 - DNA, 25 bp, Mus musculus
ttggtatctgcgatgttattcctca

SEQ ID NO: 957206 - DNA, 25 bp, Mus musculus
ttggtatctgcgttgttattcctca

SEQ ID NO: 957207 - DNA, 25 bp, Mus musculus
ttggtatctgctacccactggaaat

SEQ ID NO: 957208 - DNA, 25 bp, Mus musculus
ttggtatctgcttcccactggaaat

SEQ ID NO: 957209 - DNA, 25 bp, Mus musculus
ttggtatcttccagtcaatctatat

SEQ ID NO: 957210 - DNA, 25 bp, Mus musculus
ttggtatcttcctgtcaatctatat

SEQ ID NO: 957211 - DNA, 25 bp, Mus musculus
ttggtatgaacgaccgtctgctcgg

SEQ ID NO: 957212 - DNA, 25 bp, Mus musculus
ttggtatgaacgtccgtctgctcgg

SEQ ID NO: 957213 - DNA, 25 bp, Mus musculus
ttggtatgcagcagcctgtgtgtct

SEQ ID NO: 957214 - DNA, 25 bp, Mus musculus
ttggtatgcagctgcctgtgtgtct

SEQ ID NO: 957215 - DNA, 25 bp, Mus musculus
ttggtatgcttgctgcctcgtccag

SEQ ID NO: 957216 - DNA, 25 bp, Mus musculus
ttggtatgcttggtgcctcgtccag

SEQ ID NO: 957217 - DNA, 25 bp, Mus musculus
ttggtatggaccacatcagtatcag

SEQ ID NO: 957218 - DNA, 25 bp, Mus musculus
ttggtatggacctcatcagtatcag

SEQ ID NO: 957219 - DNA, 25 bp, Mus musculus
ttggtatgtgtcaaactggctgttt

SEQ ID NO: 957220 - DNA, 25 bp, Mus musculus
ttggtatgtgtctaactggctgttt

SEQ ID NO: 957221 - DNA, 25 bp, Mus musculus
ttggtattatgtcccccagaccaaa

SEQ ID NO: 957222 - DNA, 25 bp, Mus musculus
ttggtattatgtgccccagaccaaa

SEQ ID NO: 957223 - DNA, 25 bp, Mus musculus
ttggtattcacaatcccatatgaga

SEQ ID NO: 957224 - DNA, 25 bp, Mus musculus
ttggtattcacattcccatatgaga

SEQ ID NO: 957225 - DNA, 25 bp, Mus musculus
ttggtattgtgactgcctgacgtgc

SEQ ID NO: 957226 - DNA, 25 bp, Mus musculus
ttggtattgtgagtgcctgacgtgc

SEQ ID NO: 957227 - DNA, 25 bp, Mus musculus
ttggtatttccaacacctgccttct

SEQ ID NO: 957228 - DNA, 25 bp, Mus musculus
ttggtatttccatcacctgccttct

SEQ ID NO: 957229 - DNA, 25 bp, Mus musculus
ttggtatttcttcttgagtcctcta

SEQ ID NO: 957230 - DNA, 25 bp, Mus musculus
ttggtatttcttgttgagtcctcta

SEQ ID NO: 957231 - DNA, 25 bp, Mus musculus
ttggtcaaatatactgcaggttaat

SEQ ID NO: 957232 - DNA, 25 bp, Mus musculus
ttggtcaaatattctgcaggttaat

SEQ ID NO: 957233 - DNA, 25 bp, Mus musculus
ttggtcaacagaatccacgtcaggt

SEQ ID NO: 957234 - DNA, 25 bp, Mus musculus
ttggtcaacagattccacgtcaggt

SEQ ID NO: 957235 - DNA, 25 bp, Mus musculus
ttggtcaacccaattaggctatgct

SEQ ID NO: 957236 - DNA, 25 bp, Mus musculus
ttggtcaacccatttaggctatgct

SEQ ID NO: 957237 - DNA, 25 bp, Mus musculus
ttggtcaaggccagaaagcacccag

SEQ ID NO: 957238 - DNA, 25 bp, Mus musculus
ttggtcaaggcctgaaagcacccag

SEQ ID NO: 957239 - DNA, 25 bp, Mus musculus
ttggtcacaattatctttgctgtct

SEQ ID NO: 957240 - DNA, 25 bp, Mus musculus
ttggtcacaattttctttgctgtct

SEQ ID NO: 957241 - DNA, 25 bp, Mus musculus
ttggtcacaggcatggagcccatgc

SEQ ID NO: 957242 - DNA, 25 bp, Mus musculus
ttggtcacaggcttggagcccatgc

SEQ ID NO: 957243 - DNA, 25 bp, Mus musculus
ttggtcaccaccaagcaatgggaat

SEQ ID NO: 957244 - DNA, 25 bp, Mus musculus
ttggtcaccacctagcaatgggaat

SEQ ID NO: 957245 - DNA, 25 bp, Mus musculus
ttggtcacctgacctgcactgtacg

SEQ ID NO: 957246 - DNA, 25 bp, Mus musculus
ttggtcacctgagctgcactgtacg

SEQ ID NO: 957247 - DNA, 25 bp, Mus musculus
ttggtcacctggacctgagaagggc

SEQ ID NO: 957248 - DNA, 25 bp, Mus musculus
ttggtcacctggtcctgagaagggc

SEQ ID NO: 957249 - DNA, 25 bp, Mus musculus
ttggtcaccttacctggttctgtta

SEQ ID NO: 957250 - DNA, 25 bp, Mus musculus
ttggtcaccttagctggttctgtta

SEQ ID NO: 957251 - DNA, 25 bp, Mus musculus
ttggtcaccttcctgtcactacttt

SEQ ID NO: 957252 - DNA, 25 bp, Mus musculus
ttggtcaccttcgtgtcactacttt

SEQ ID NO: 957253 - DNA, 25 bp, Mus musculus
ttggtcacgctgactggcagtagct

SEQ ID NO: 957254 - DNA, 25 bp, Mus musculus
ttggtcacgctgtctggcagtagct

SEQ ID NO: 957255 - DNA, 25 bp, Mus musculus
ttggtcactgtcatgttcctaatct

SEQ ID NO: 957256 - DNA, 25 bp, Mus musculus
ttggtcactgtcttgttcctaatct

SEQ ID NO: 957257 - DNA, 25 bp, Mus musculus
ttggtcaggatcactctgcggcagg

SEQ ID NO: 957258 - DNA, 25 bp, Mus musculus
ttggtcaggatctctctgcggcagg

SEQ ID NO: 957259 - DNA, 25 bp, Mus musculus
ttggtcagggtaatcggtcatccga

SEQ ID NO: 957260 - DNA, 25 bp, Mus musculus
ttggtcagggtattcggtcatccga

SEQ ID NO: 957261 - DNA, 25 bp, Mus musculus
ttggtcaggtatacgtcatccgaca

SEQ ID NO: 957262 - DNA, 25 bp, Mus musculus
ttggtcaggtattcgtcatccgaca

SEQ ID NO: 957263 - DNA, 25 bp, Mus musculus
ttggtcagttgacaatttgcaggag

SEQ ID NO: 957264 - DNA, 25 bp, Mus musculus
ttggtcagttgagaatttgcaggag

SEQ ID NO: 957265 - DNA, 25 bp, Mus musculus
ttggtcataaagagaaacccgtatt

SEQ ID NO: 957266 - DNA, 25 bp, Mus musculus
ttggtcataaagtgaaacccgtatt

SEQ ID NO: 957267 - DNA, 25 bp, Mus musculus
ttggtcatggccattatcaagctat

SEQ ID NO: 957268 - DNA, 25 bp, Mus musculus
ttggtcatggcctttatcaagctat

SEQ ID NO: 957269 - DNA, 25 bp, Mus musculus
ttggtcatgtccaccagttagtgag

SEQ ID NO: 957270 - DNA, 25 bp, Mus musculus
ttggtcatgtcctccagttagtgag

SEQ ID NO: 957271 - DNA, 25 bp, Mus musculus
ttggtcattacaatcacttcacata

SEQ ID NO: 957272 - DNA, 25 bp, Mus musculus
ttggtcattacattcacttcacata

SEQ ID NO: 957273 - DNA, 25 bp, Mus musculus
ttggtcattcctaagttcctatctc

SEQ ID NO: 957274 - DNA, 25 bp, Mus musculus
ttggtcattccttagttcctatctc

SEQ ID NO: 957275 - DNA, 25 bp, Mus musculus
ttggtcattggtatctgattcctca

SEQ ID NO: 957276 - DNA, 25 bp, Mus musculus
ttggtcattggtttctgattcctca

SEQ ID NO: 957277 - DNA, 25 bp, Mus musculus
ttggtccaacctaagtgtggcgtgt

SEQ ID NO: 957278 - DNA, 25 bp, Mus musculus
ttggtccaaccttagtgtggcgtgt

SEQ ID NO: 957279 - DNA, 25 bp, Mus musculus
ttggtccaatgtactgagaggcatg

SEQ ID NO: 957280 - DNA, 25 bp, Mus musculus
ttggtccaatgttctgagaggcatg

SEQ ID NO: 957281 - DNA, 25 bp, Mus musculus
ttggtccacaccacattgagttgta

SEQ ID NO: 957282 - DNA, 25 bp, Mus musculus
ttggtccacacctcattgagttgta

SEQ ID NO: 957283 - DNA, 25 bp, Mus musculus
ttggtccacagtcttgttaaagaca

SEQ ID NO: 957284 - DNA, 25 bp, Mus musculus
ttggtccacagtgttgttaaagaca

SEQ ID NO: 957285 - DNA, 25 bp, Mus musculus
ttggtccaccaaccctgaattaaag

SEQ ID NO: 957286 - DNA, 25 bp, Mus musculus
ttggtccaccaagcctgaattaaag

SEQ ID NO: 957287 - DNA, 25 bp, Mus musculus
ttggtccaccagataaagagcctcc

SEQ ID NO: 957288 - DNA, 25 bp, Mus musculus
ttggtccaccagttaaagagcctcc

SEQ ID NO: 957289 - DNA, 25 bp, Mus musculus
ttggtccacccacacttggacaggg

SEQ ID NO: 957290 - DNA, 25 bp, Mus musculus
ttggtccacccagacttggacaggg

SEQ ID NO: 957291 - DNA, 25 bp, Mus musculus
ttggtccagagtaaatgagcgccct

SEQ ID NO: 957292 - DNA, 25 bp, Mus musculus
ttggtccagagttaatgagcgccct

SEQ ID NO: 957293 - DNA, 25 bp, Mus musculus
ttggtccaggaaaaccagcctacct

SEQ ID NO: 957294 - DNA, 25 bp, Mus musculus
ttggtccaggaataccagcctacct

SEQ ID NO: 957295 - DNA, 25 bp, Mus musculus
ttggtccagtttcccttgtgggaat

SEQ ID NO: 957296 - DNA, 25 bp, Mus musculus
ttggtccagtttgccttgtgggaat

SEQ ID NO: 957297 - DNA, 25 bp, Mus musculus
ttggtccatactccctgctgtgatg

SEQ ID NO: 957298 - DNA, 25 bp, Mus musculus
ttggtccatactgcctgctgtgatg

SEQ ID NO: 957299 - DNA, 25 bp, Mus musculus
ttggtccatattccttctactcttt

SEQ ID NO: 957300 - DNA, 25 bp, Mus musculus
ttggtccatattgcttctactcttt

SEQ ID NO: 957301 - DNA, 25 bp, Mus musculus
ttggtccatccactagacttcgtga

SEQ ID NO: 957302 - DNA, 25 bp, Mus musculus
ttggtccatccagtagacttcgtga

SEQ ID NO: 957303 - DNA, 25 bp, Mus musculus
ttggtccatcctcgactcatggaga

SEQ ID NO: 957304 - DNA, 25 bp, Mus musculus
ttggtccatcctggactcatggaga

SEQ ID NO: 957305 - DNA, 25 bp, Mus musculus
ttggtccatcttcggcttccagaga

SEQ ID NO: 957306 - DNA, 25 bp, Mus musculus
ttggtccatcttgggcttccagaga

SEQ ID NO: 957307 - DNA, 25 bp, Mus musculus
ttggtccatggaaaatttctgtcac

SEQ ID NO: 957308 - DNA, 25 bp, Mus musculus
ttggtccatggataatttctgtcac

SEQ ID NO: 957309 - DNA, 25 bp, Mus musculus
ttggtcccaccacatgtattacatg

SEQ ID NO: 957310 - DNA, 25 bp, Mus musculus
ttggtcccaccagatgtattacatg

SEQ ID NO: 957311 - DNA, 25 bp, Mus musculus
ttggtcccactgagtcctgattgca

SEQ ID NO: 957312 - DNA, 25 bp, Mus musculus
ttggtcccactgtgtcctgattgca

SEQ ID NO: 957313 - DNA, 25 bp, Mus musculus
ttggtcccagcacatgtatcctaat

SEQ ID NO: 957314 - DNA, 25 bp, Mus musculus
ttggtcccagcagatgtatcctaat

SEQ ID NO: 957315 - DNA, 25 bp, Mus musculus
ttggtcccattgctgagagttcctc

SEQ ID NO: 957316 - DNA, 25 bp, Mus musculus
ttggtcccattggtgagagttcctc

SEQ ID NO: 957317 - DNA, 25 bp, Mus musculus
ttggtccccactaagtagaactatt

SEQ ID NO: 957318 - DNA, 25 bp, Mus musculus
ttggtccccacttagtagaactatt

SEQ ID NO: 957319 - DNA, 25 bp, Mus musculus
ttggtccccagaagaaactgttctg

SEQ ID NO: 957320 - DNA, 25 bp, Mus musculus
ttggtccccagaatagtaggccttg

SEQ ID NO: 957321 - DNA, 25 bp, Mus musculus
ttggtccccagatgaaactgttctg

SEQ ID NO: 957322 - DNA, 25 bp, Mus musculus
ttggtccccagattagtaggccttg

SEQ ID NO: 957323 - DNA, 25 bp, Mus musculus
ttggtccccagtaagtgcatcttgg

SEQ ID NO: 957324 - DNA, 25 bp, Mus musculus
ttggtccccagttagtgcatcttgg

SEQ ID NO: 957325 - DNA, 25 bp, Mus musculus
ttggtccccattaagttgagtcctg

SEQ ID NO: 957326 - DNA, 25 bp, Mus musculus
ttggtccccatttagttgagtcctg

SEQ ID NO: 957327 - DNA, 25 bp, Mus musculus
ttggtccccgttcgtggctcagaga

SEQ ID NO: 957328 - DNA, 25 bp, Mus musculus
ttggtccccgttggtggctcagaga

SEQ ID NO: 957329 - DNA, 25 bp, Mus musculus
ttggtccctggacttgatctacaga

SEQ ID NO: 957330 - DNA, 25 bp, Mus musculus
ttggtccctggagttgatctacaga

SEQ ID NO: 957331 - DNA, 25 bp, Mus musculus
ttggtccgccgcagtagagctacag

SEQ ID NO: 957332 - DNA, 25 bp, Mus musculus
ttggtccgccgctgtagagctacag

SEQ ID NO: 957333 - DNA, 25 bp, Mus musculus
ttggtcctcaagatattcagcaccc

SEQ ID NO: 957334 - DNA, 25 bp, Mus musculus
ttggtcctcaagttattcagcaccc

SEQ ID NO: 957335 - DNA, 25 bp, Mus musculus
ttggtcctcaggagcggatgttcaa

SEQ ID NO: 957336 - DNA, 25 bp, Mus musculus
ttggtcctcaggtgcggatgttcaa

SEQ ID NO: 957337 - DNA, 25 bp, Mus musculus
ttggtcctcatgagggacttctaac

SEQ ID NO: 957338 - DNA, 25 bp, Mus musculus
ttggtcctcatgtgggacttctaac

SEQ ID NO: 957339 - DNA, 25 bp, Mus musculus
ttggtcctccatccctagaaaagaa

SEQ ID NO: 957340 - DNA, 25 bp, Mus musculus
ttggtcctccatgcctagaaaagaa

SEQ ID NO: 957341 - DNA, 25 bp, Mus musculus
ttggtcctggatatgttgcctagtt

SEQ ID NO: 957342 - DNA, 25 bp, Mus musculus
ttggtcctggatttgttgcctagtt

SEQ ID NO: 957343 - DNA, 25 bp, Mus musculus
ttggtcctggtgcacctggataaga

SEQ ID NO: 957344 - DNA, 25 bp, Mus musculus
ttggtcctggtggacctggataaga

SEQ ID NO: 957345 - DNA, 25 bp, Mus musculus
ttggtcctgtctactcgacagaagt

SEQ ID NO: 957346 - DNA, 25 bp, Mus musculus
ttggtcctgtcttctcgacagaagt

SEQ ID NO: 957347 - DNA, 25 bp, Mus musculus
ttggtccttaaaacatggtattagc

SEQ ID NO: 957348 - DNA, 25 bp, Mus musculus
ttggtccttaaatcatggtattagc

SEQ ID NO: 957349 - DNA, 25 bp, Mus musculus
ttggtccttagaagaaatgtttaca

SEQ ID NO: 957350 - DNA, 25 bp, Mus musculus
ttggtccttagatgaaatgtttaca

SEQ ID NO: 957351 - DNA, 25 bp, Mus musculus
ttggtcctttctccagtactaggga

SEQ ID NO: 957352 - DNA, 25 bp, Mus musculus
ttggtcctttctgcagtactaggga

SEQ ID NO: 957353 - DNA, 25 bp, Mus musculus
ttggtcctttgcctgccattttctc

SEQ ID NO: 957354 - DNA, 25 bp, Mus musculus
ttggtcctttgcgtgccattttctc

SEQ ID NO: 957355 - DNA, 25 bp, Mus musculus
ttggtcgatgagctccgtggattac

SEQ ID NO: 957356 - DNA, 25 bp, Mus musculus
ttggtcgatgaggtccgtggattac

SEQ ID NO: 957357 - DNA, 25 bp, Mus musculus
ttggtcgccactagtctcaaaggat

SEQ ID NO: 957358 - DNA, 25 bp, Mus musculus
ttggtcgccacttgtctcaaaggat

SEQ ID NO: 957359 - DNA, 25 bp, Mus musculus
ttggtcgccttgacaccaggctgaa

SEQ ID NO: 957360 - DNA, 25 bp, Mus musculus
ttggtcgccttgtcaccaggctgaa

SEQ ID NO: 957361 - DNA, 25 bp, Mus musculus
ttggtcgtgctacccctgagaaggt

SEQ ID NO: 957362 - DNA, 25 bp, Mus musculus
ttggtcgtgctagccctgagaaggt

SEQ ID NO: 957363 - DNA, 25 bp, Mus musculus
ttggtcgtgtttattcgacgcgttc

SEQ ID NO: 957364 - DNA, 25 bp, Mus musculus
ttggtcgtgttttttcgacgcgttc

SEQ ID NO: 957365 - DNA, 25 bp, Mus musculus
ttggtctaaatcacccagtggccca

SEQ ID NO: 957366 - DNA, 25 bp, Mus musculus
ttggtctaaatctcccagtggccca

SEQ ID NO: 957367 - DNA, 25 bp, Mus musculus
ttggtctaagaccatacagcagatt

SEQ ID NO: 957368 - DNA, 25 bp, Mus musculus
ttggtctaagacgatacagcagatt

SEQ ID NO: 957369 - DNA, 25 bp, Mus musculus
ttggtctagaagctacagcccctga

SEQ ID NO: 957370 - DNA, 25 bp, Mus musculus
ttggtctagaaggtacagcccctga

SEQ ID NO: 957371 - DNA, 25 bp, Mus musculus
ttggtctagcaactcctatctccag

SEQ ID NO: 957372 - DNA, 25 bp, Mus musculus
ttggtctagcaagtcctatctccag

SEQ ID NO: 957373 - DNA, 25 bp, Mus musculus
ttggtctagggaaatgagtcaatag

SEQ ID NO: 957374 - DNA, 25 bp, Mus musculus
ttggtctagggatatgagtcaatag

SEQ ID NO: 957375 - DNA, 25 bp, Mus musculus
ttggtctataatctcctcgacataa

SEQ ID NO: 957376 - DNA, 25 bp, Mus musculus
ttggtctataatgtcctcgacataa

SEQ ID NO: 957377 - DNA, 25 bp, Mus musculus
ttggtctcagagaattgccctaggt

SEQ ID NO: 957378 - DNA, 25 bp, Mus musculus
ttggtctcagagcatgtcaaaagca

SEQ ID NO: 957379 - DNA, 25 bp, Mus musculus
ttggtctcagaggatgtcaaaagca

SEQ ID NO: 957380 - DNA, 25 bp, Mus musculus
ttggtctcagagtattgccctaggt

SEQ ID NO: 957381 - DNA, 25 bp, Mus musculus
ttggtctcagcaacacaagggcatt

SEQ ID NO: 957382 - DNA, 25 bp, Mus musculus
ttggtctcagcaacctgtgagctga

SEQ ID NO: 957383 - DNA, 25 bp, Mus musculus
ttggtctcagcatcacaagggcatt

SEQ ID NO: 957384 - DNA, 25 bp, Mus musculus
ttggtctcagcatcctgtgagctga

SEQ ID NO: 957385 - DNA, 25 bp, Mus musculus
ttggtctcagttagcacagtgggta

SEQ ID NO: 957386 - DNA, 25 bp, Mus musculus
ttggtctcagtttgcacagtgggta

SEQ ID NO: 957387 - DNA, 25 bp, Mus musculus
ttggtctccagaacctagtttcttg

SEQ ID NO: 957388 - DNA, 25 bp, Mus musculus
ttggtctccagatcctagtttcttg

SEQ ID NO: 957389 - DNA, 25 bp, Mus musculus
ttggtctccgcgaagcggcgcacca

SEQ ID NO: 957390 - DNA, 25 bp, Mus musculus
ttggtctccgcgtagcggcgcacca

SEQ ID NO: 957391 - DNA, 25 bp, Mus musculus
ttggtctcctcaatctcattttaaa

SEQ ID NO: 957392 - DNA, 25 bp, Mus musculus
ttggtctcctcattctcattttaaa

SEQ ID NO: 957393 - DNA, 25 bp, Mus musculus
ttggtctcctttctgcctttcttga

SEQ ID NO: 957394 - DNA, 25 bp, Mus musculus
ttggtctcctttgtgcctttcttga

SEQ ID NO: 957395 - DNA, 25 bp, Mus musculus
ttggtctcgctgcaagccactacta

SEQ ID NO: 957396 - DNA, 25 bp, Mus musculus
ttggtctcgctggaagccactacta

SEQ ID NO: 957397 - DNA, 25 bp, Mus musculus
ttggtctcggtgatcatttgtcctc

SEQ ID NO: 957398 - DNA, 25 bp, Mus musculus
ttggtctcggtgctcttagtagaac

SEQ ID NO: 957399 - DNA, 25 bp, Mus musculus
ttggtctcggtggtcttagtagaac

SEQ ID NO: 957400 - DNA, 25 bp, Mus musculus
ttggtctcggtgttcatttgtcctc

SEQ ID NO: 957401 - DNA, 25 bp, Mus musculus
ttggtctctactctttccagctggc

SEQ ID NO: 957402 - DNA, 25 bp, Mus musculus
ttggtctctactgtttccagctggc

SEQ ID NO: 957403 - DNA, 25 bp, Mus musculus
ttggtctctcaaaagaatgcccctc

SEQ ID NO: 957404 - DNA, 25 bp, Mus musculus
ttggtctctcaatagaatgcccctc

SEQ ID NO: 957405 - DNA, 25 bp, Mus musculus
ttggtctctcttctttactgtataa

SEQ ID NO: 957406 - DNA, 25 bp, Mus musculus
ttggtctctcttgtttactgtataa

SEQ ID NO: 957407 - DNA, 25 bp, Mus musculus
ttggtctctggtagaagccccggat

SEQ ID NO: 957408 - DNA, 25 bp, Mus musculus
ttggtctctggttgaagccccggat

SEQ ID NO: 957409 - DNA, 25 bp, Mus musculus
ttggtctctgttacccagttgggtc

SEQ ID NO: 957410 - DNA, 25 bp, Mus musculus
ttggtctctgttctttgggttaatc

SEQ ID NO: 957411 - DNA, 25 bp, Mus musculus
ttggtctctgttgtttgggttaatc

SEQ ID NO: 957412 - DNA, 25 bp, Mus musculus
ttggtctctgtttcccagttgggtc

SEQ ID NO: 957413 - DNA, 25 bp, Mus musculus
ttggtctcttacaaaatgtggcctt

SEQ ID NO: 957414 - DNA, 25 bp, Mus musculus
ttggtctcttactaaatgtggcctt

SEQ ID NO: 957415 - DNA, 25 bp, Mus musculus
ttggtctcttggctcctgcacggtc

SEQ ID NO: 957416 - DNA, 25 bp, Mus musculus
ttggtctcttgggtcctgcacggtc

SEQ ID NO: 957417 - DNA, 25 bp, Mus musculus
ttggtctgactcaccataagttttg

SEQ ID NO: 957418 - DNA, 25 bp, Mus musculus
ttggtctgactctccataagttttg

SEQ ID NO: 957419 - DNA, 25 bp, Mus musculus
ttggtctggttaccagagctcctga

SEQ ID NO: 957420 - DNA, 25 bp, Mus musculus
ttggtctggttagcagagctcctga

SEQ ID NO: 957421 - DNA, 25 bp, Mus musculus
ttggtctgtacgattgtatatgcaa

SEQ ID NO: 957422 - DNA, 25 bp, Mus musculus
ttggtctgtacgtttgtatatgcaa

SEQ ID NO: 957423 - DNA, 25 bp, Mus musculus
ttggtctgtagcctcgcctttatgc

SEQ ID NO: 957424 - DNA, 25 bp, Mus musculus
ttggtctgtagcgtcgcctttatgc

SEQ ID NO: 957425 - DNA, 25 bp, Mus musculus
ttggtctgtgcaagcttcaggttcc

SEQ ID NO: 957426 - DNA, 25 bp, Mus musculus
ttggtctgtgcatgcttcaggttcc

SEQ ID NO: 957427 - DNA, 25 bp, Mus musculus
ttggtctgtgccctgtagcccacag

SEQ ID NO: 957428 - DNA, 25 bp, Mus musculus
ttggtctgtgccgtgtagcccacag

SEQ ID NO: 957429 - DNA, 25 bp, Mus musculus
ttggtctgtgggactttaggcactg

SEQ ID NO: 957430 - DNA, 25 bp, Mus musculus
ttggtctgtgggtctttaggcactg

SEQ ID NO: 957431 - DNA, 25 bp, Mus musculus
ttggtctgttgaagacccctttaca

SEQ ID NO: 957432 - DNA, 25 bp, Mus musculus
ttggtctgttgatgacccctttaca

SEQ ID NO: 957433 - DNA, 25 bp, Mus musculus
ttggtctgttttcaagcctctggtt

SEQ ID NO: 957434 - DNA, 25 bp, Mus musculus
ttggtctgttttgaagcctctggtt

SEQ ID NO: 957435 - DNA, 25 bp, Mus musculus
ttggtcttaaagagtacacattgcc

SEQ ID NO: 957436 - DNA, 25 bp, Mus musculus
ttggtcttaaagtgtacacattgcc

SEQ ID NO: 957437 - DNA, 25 bp, Mus musculus
ttggtcttactgcagggatcatctc

SEQ ID NO: 957438 - DNA, 25 bp, Mus musculus
ttggtcttactggagggatcatctc

SEQ ID NO: 957439 - DNA, 25 bp, Mus musculus
ttggtcttagaccagtgtaagcttt

SEQ ID NO: 957440 - DNA, 25 bp, Mus musculus
ttggtcttagacgagtgtaagcttt

SEQ ID NO: 957441 - DNA, 25 bp, Mus musculus
ttggtcttcaagatgtgctcacatt

SEQ ID NO: 957442 - DNA, 25 bp, Mus musculus
ttggtcttcaagttgtgctcacatt

SEQ ID NO: 957443 - DNA, 25 bp, Mus musculus
ttggtcttcaccaagtaaaatctta

SEQ ID NO: 957444 - DNA, 25 bp, Mus musculus
ttggtcttcacctagtaaaatctta

SEQ ID NO: 957445 - DNA, 25 bp, Mus musculus
ttggtcttcagaagacagcatctga

SEQ ID NO: 957446 - DNA, 25 bp, Mus musculus
ttggtcttcagaccaaattgtccta

SEQ ID NO: 957447 - DNA, 25 bp, Mus musculus
ttggtcttcagagcaaattgtccta

SEQ ID NO: 957448 - DNA, 25 bp, Mus musculus
ttggtcttcagatgacagcatctga

SEQ ID NO: 957449 - DNA, 25 bp, Mus musculus
ttggtcttcctgagagtctgtctag

SEQ ID NO: 957450 - DNA, 25 bp, Mus musculus
ttggtcttcctgtgagtctgtctag

SEQ ID NO: 957451 - DNA, 25 bp, Mus musculus
ttggtcttccttacgttaaactatg

SEQ ID NO: 957452 - DNA, 25 bp, Mus musculus
ttggtcttccttctttctgcatcat

SEQ ID NO: 957453 - DNA, 25 bp, Mus musculus
ttggtcttccttgtttctgcatcat

SEQ ID NO: 957454 - DNA, 25 bp, Mus musculus
ttggtcttcctttcgttaaactatg

SEQ ID NO: 957455 - DNA, 25 bp, Mus musculus
ttggtcttgctgaggcaccgcggat

SEQ ID NO: 957456 - DNA, 25 bp, Mus musculus
ttggtcttgctgtggcaccgcggat

SEQ ID NO: 957457 - DNA, 25 bp, Mus musculus
ttggtctttaagacagggtcctcct

SEQ ID NO: 957458 - DNA, 25 bp, Mus musculus
ttggtctttaagtcagggtcctcct

SEQ ID NO: 957459 - DNA, 25 bp, Mus musculus
ttggtctttcaacttagggctctat

SEQ ID NO: 957460 - DNA, 25 bp, Mus musculus
ttggtctttcaagttagggctctat

SEQ ID NO: 957461 - DNA, 25 bp, Mus musculus
ttggtctttcctctagaacaccttc

SEQ ID NO: 957462 - DNA, 25 bp, Mus musculus
ttggtctttcctgtagaacaccttc

SEQ ID NO: 957463 - DNA, 25 bp, Mus musculus
ttggtctttgccactgagggacttc

SEQ ID NO: 957464 - DNA, 25 bp, Mus musculus
ttggtctttgcctctgagggacttc

SEQ ID NO: 957465 - DNA, 25 bp, Mus musculus
ttggtctttgggacagccctgtgag

SEQ ID NO: 957466 - DNA, 25 bp, Mus musculus
ttggtctttgggacttagcctgcta

SEQ ID NO: 957467 - DNA, 25 bp, Mus musculus
ttggtctttgggtcagccctgtgag

SEQ ID NO: 957468 - DNA, 25 bp, Mus musculus
ttggtctttgggtcttagcctgcta

SEQ ID NO: 957469 - DNA, 25 bp, Mus musculus
ttggtctttttgctgagtctggatg

SEQ ID NO: 957470 - DNA, 25 bp, Mus musculus
ttggtctttttggtgagtctggatg

SEQ ID NO: 957471 - DNA, 25 bp, Mus musculus
ttggtgaaaagcagtttttgctgga

SEQ ID NO: 957472 - DNA, 25 bp, Mus musculus
ttggtgaaaagctgtttttgctgga

SEQ ID NO: 957473 - DNA, 25 bp, Mus musculus
ttggtgaacacacgctgctggtgac

SEQ ID NO: 957474 - DNA, 25 bp, Mus musculus
ttggtgaacacaggctgctggtgac

SEQ ID NO: 957475 - DNA, 25 bp, Mus musculus
ttggtgaagatgaatcctgatcctg

SEQ ID NO: 957476 - DNA, 25 bp, Mus musculus
ttggtgaagatgtatcctgatcctg

SEQ ID NO: 957477 - DNA, 25 bp, Mus musculus
ttggtgaagctccagtgaatctcaa

SEQ ID NO: 957478 - DNA, 25 bp, Mus musculus
ttggtgaagctcgagtgaatctcaa

SEQ ID NO: 957479 - DNA, 25 bp, Mus musculus
ttggtgaaggaaacagctgctctgc

SEQ ID NO: 957480 - DNA, 25 bp, Mus musculus
ttggtgaaggaatcagctgctctgc

SEQ ID NO: 957481 - DNA, 25 bp, Mus musculus
ttggtgaatcctccagtcaagcctg

SEQ ID NO: 957482 - DNA, 25 bp, Mus musculus
ttggtgaatcctgcagtcaagcctg

SEQ ID NO: 957483 - DNA, 25 bp, Mus musculus
ttggtgacaccaactatgcctggcc

SEQ ID NO: 957484 - DNA, 25 bp, Mus musculus
ttggtgacaccatctatgcctggcc

SEQ ID NO: 957485 - DNA, 25 bp, Mus musculus
ttggtgacatcaatccaaacctggg

SEQ ID NO: 957486 - DNA, 25 bp, Mus musculus
ttggtgacatcattccaaacctggg

SEQ ID NO: 957487 - DNA, 25 bp, Mus musculus
ttggtgacatccacggtcccagctg

SEQ ID NO: 957488 - DNA, 25 bp, Mus musculus
ttggtgacatcctcggtcccagctg

SEQ ID NO: 957489 - DNA, 25 bp, Mus musculus
ttggtgaccagcaatcaagagttca

SEQ ID NO: 957490 - DNA, 25 bp, Mus musculus
ttggtgaccagctatcaagagttca

SEQ ID NO: 957491 - DNA, 25 bp, Mus musculus
ttggtgaccagtctctgagctgtgc

SEQ ID NO: 957492 - DNA, 25 bp, Mus musculus
ttggtgaccagtgtctgagctgtgc

SEQ ID NO: 957493 - DNA, 25 bp, Mus musculus
ttggtgacctgaacatgatccctag

SEQ ID NO: 957494 - DNA, 25 bp, Mus musculus
ttggtgacctgacaagtgcctggca

SEQ ID NO: 957495 - DNA, 25 bp, Mus musculus
ttggtgacctgactttagcctccta

SEQ ID NO: 957496 - DNA, 25 bp, Mus musculus
ttggtgacctgagaagtgcctggca

SEQ ID NO: 957497 - DNA, 25 bp, Mus musculus
ttggtgacctgagtttagcctccta

SEQ ID NO: 957498 - DNA, 25 bp, Mus musculus
ttggtgacctgatcatgatccctag

SEQ ID NO: 957499 - DNA, 25 bp, Mus musculus
ttggtgacggctatcaacgactgga

SEQ ID NO: 957500 - DNA, 25 bp, Mus musculus
ttggtgacggctttcaacgactgga

SEQ ID NO: 957501 - DNA, 25 bp, Mus musculus
ttggtgacgtccagagcaagaggct

SEQ ID NO: 957502 - DNA, 25 bp, Mus musculus
ttggtgacgtcctgagcaagaggct

SEQ ID NO: 957503 - DNA, 25 bp, Mus musculus
ttggtgactattccactttcatttg

SEQ ID NO: 957504 - DNA, 25 bp, Mus musculus
ttggtgactattgcactttcatttg

SEQ ID NO: 957505 - DNA, 25 bp, Mus musculus
ttggtgactccaagtttcagcctgt

SEQ ID NO: 957506 - DNA, 25 bp, Mus musculus
ttggtgactccatgtttcagcctgt

SEQ ID NO: 957507 - DNA, 25 bp, Mus musculus
ttggtgactgtacgattggccatcc

SEQ ID NO: 957508 - DNA, 25 bp, Mus musculus
ttggtgactgtaggattggccatcc

SEQ ID NO: 957509 - DNA, 25 bp, Mus musculus
ttggtgagacttatgctaattcagc

SEQ ID NO: 957510 - DNA, 25 bp, Mus musculus
ttggtgagacttttgctaattcagc

SEQ ID NO: 957511 - DNA, 25 bp, Mus musculus
ttggtgagcacgcaagacgccctgc

SEQ ID NO: 957512 - DNA, 25 bp, Mus musculus
ttggtgagcacggaagacgccctgc

SEQ ID NO: 957513 - DNA, 25 bp, Mus musculus
ttggtgagccacagtcagctgagcg

SEQ ID NO: 957514 - DNA, 25 bp, Mus musculus
ttggtgagccactgtcagctgagcg

SEQ ID NO: 957515 - DNA, 25 bp, Mus musculus
ttggtgagcttccaatcaagtttga

SEQ ID NO: 957516 - DNA, 25 bp, Mus musculus
ttggtgagcttcgaatcaagtttga

SEQ ID NO: 957517 - DNA, 25 bp, Mus musculus
ttggtgaggcctagacttaaagctt

SEQ ID NO: 957518 - DNA, 25 bp, Mus musculus
ttggtgaggccttgacttaaagctt

SEQ ID NO: 957519 - DNA, 25 bp, Mus musculus
ttggtgagttcacccaattccatcc

SEQ ID NO: 957520 - DNA, 25 bp, Mus musculus
ttggtgagttcagccaattccatcc

SEQ ID NO: 957521 - DNA, 25 bp, Mus musculus
ttggtgatcccaattggtccaggcc

SEQ ID NO: 957522 - DNA, 25 bp, Mus musculus
ttggtgatcccatttggtccaggcc

SEQ ID NO: 957523 - DNA, 25 bp, Mus musculus
ttggtgatccttatattgtgtcttg

SEQ ID NO: 957524 - DNA, 25 bp, Mus musculus
ttggtgatccttttattgtgtcttg

SEQ ID NO: 957525 - DNA, 25 bp, Mus musculus
ttggtgatgaccatgcagccatgct

SEQ ID NO: 957526 - DNA, 25 bp, Mus musculus
ttggtgatgaccttgcagccatgct

SEQ ID NO: 957527 - DNA, 25 bp, Mus musculus
ttggtgatgggtctgcctcaattgc

SEQ ID NO: 957528 - DNA, 25 bp, Mus musculus
ttggtgatgggtgtgcctcaattgc

SEQ ID NO: 957529 - DNA, 25 bp, Mus musculus
ttggtgatgtggaaatggttaatta

SEQ ID NO: 957530 - DNA, 25 bp, Mus musculus
ttggtgatgtggtaatggttaatta

SEQ ID NO: 957531 - DNA, 25 bp, Mus musculus
ttggtgatgtttccatctaccctcc

SEQ ID NO: 957532 - DNA, 25 bp, Mus musculus
ttggtgatgtttgcatctaccctcc

SEQ ID NO: 957533 - DNA, 25 bp, Mus musculus
ttggtgattccactggactgtatct

SEQ ID NO: 957534 - DNA, 25 bp, Mus musculus
ttggtgattccagtggactgtatct

SEQ ID NO: 957535 - DNA, 25 bp, Mus musculus
ttggtgattggtctcaaactcaggg

SEQ ID NO: 957536 - DNA, 25 bp, Mus musculus
ttggtgattggtgtcaaactcaggg

SEQ ID NO: 957537 - DNA, 25 bp, Mus musculus
ttggtgcaaaagacgtcctgtgtct

SEQ ID NO: 957538 - DNA, 25 bp, Mus musculus
ttggtgcaaaagtcgtcctgtgtct

SEQ ID NO: 957539 - DNA, 25 bp, Mus musculus
ttggtgcaaagcagcatcgggcctt

SEQ ID NO: 957540 - DNA, 25 bp, Mus musculus
ttggtgcaaagctgcatcgggcctt

SEQ ID NO: 957541 - DNA, 25 bp, Mus musculus
ttggtgcaaattcaccccagctatc

SEQ ID NO: 957542 - DNA, 25 bp, Mus musculus
ttggtgcaaattctcatgtgtgttt

SEQ ID NO: 957543 - DNA, 25 bp, Mus musculus
ttggtgcaaattgaccccagctatc

SEQ ID NO: 957544 - DNA, 25 bp, Mus musculus
ttggtgcaaattgtcatgtgtgttt

SEQ ID NO: 957545 - DNA, 25 bp, Mus musculus
ttggtgcaagccctccagactgagc

SEQ ID NO: 957546 - DNA, 25 bp, Mus musculus
ttggtgcaagccgtccagactgagc

SEQ ID NO: 957547 - DNA, 25 bp, Mus musculus
ttggtgcactggcagtgccaaccac

SEQ ID NO: 957548 - DNA, 25 bp, Mus musculus
ttggtgcactgggagtgccaaccac

SEQ ID NO: 957549 - DNA, 25 bp, Mus musculus
ttggtgcagccaaagaagccgggat

SEQ ID NO: 957550 - DNA, 25 bp, Mus musculus
ttggtgcagccatagaagccgggat

SEQ ID NO: 957551 - DNA, 25 bp, Mus musculus
ttggtgcaggtcaaggcgctaagaa

SEQ ID NO: 957552 - DNA, 25 bp, Mus musculus
ttggtgcaggtctaggcgctaagaa

SEQ ID NO: 957553 - DNA, 25 bp, Mus musculus
ttggtgcagtgcactacaggtctct

SEQ ID NO: 957554 - DNA, 25 bp, Mus musculus
ttggtgcagtgctctacaggtctct

SEQ ID NO: 957555 - DNA, 25 bp, Mus musculus
ttggtgcatgcaaagggtaaaaaca

SEQ ID NO: 957556 - DNA, 25 bp, Mus musculus
ttggtgcatgcatagggtaaaaaca

SEQ ID NO: 957557 - DNA, 25 bp, Mus musculus
ttggtgccaagtctagtaactgttc

SEQ ID NO: 957558 - DNA, 25 bp, Mus musculus
ttggtgccaagtgtagtaactgttc

SEQ ID NO: 957559 - DNA, 25 bp, Mus musculus
ttggtgccaccacagattctacaga

SEQ ID NO: 957560 - DNA, 25 bp, Mus musculus
ttggtgccaccagagattctacaga

SEQ ID NO: 957561 - DNA, 25 bp, Mus musculus
ttggtgccatgtcttctcaccccgg

SEQ ID NO: 957562 - DNA, 25 bp, Mus musculus
ttggtgccatgtgttctcaccccgg

SEQ ID NO: 957563 - DNA, 25 bp, Mus musculus
ttggtgcccactagcatgctaaggc

SEQ ID NO: 957564 - DNA, 25 bp, Mus musculus
ttggtgcccacttgcatgctaaggc

SEQ ID NO: 957565 - DNA, 25 bp, Mus musculus
ttggtgcccttgatggaccaacttc

SEQ ID NO: 957566 - DNA, 25 bp, Mus musculus
ttggtgcccttgttggaccaacttc

SEQ ID NO: 957567 - DNA, 25 bp, Mus musculus
ttggtgcctagccagcctagtgtaa

SEQ ID NO: 957568 - DNA, 25 bp, Mus musculus
ttggtgcctagcgagcctagtgtaa

SEQ ID NO: 957569 - DNA, 25 bp, Mus musculus
ttggtgcctgggatgctgagtagta

SEQ ID NO: 957570 - DNA, 25 bp, Mus musculus
ttggtgcctgggttgctgagtagta

SEQ ID NO: 957571 - DNA, 25 bp, Mus musculus
ttggtgccttctctgtaacttatga

SEQ ID NO: 957572 - DNA, 25 bp, Mus musculus
ttggtgccttctgtgtaacttatga

SEQ ID NO: 957573 - DNA, 25 bp, Mus musculus
ttggtgcggcacagcagatgtttat

SEQ ID NO: 957574 - DNA, 25 bp, Mus musculus
ttggtgcggcactgcagatgtttat

SEQ ID NO: 957575 - DNA, 25 bp, Mus musculus
ttggtgcgggctaagaatcccgtca

SEQ ID NO: 957576 - DNA, 25 bp, Mus musculus
ttggtgcgggcttagaatcccgtca

SEQ ID NO: 957577 - DNA, 25 bp, Mus musculus
ttggtgctacacacagtctgcaaca

SEQ ID NO: 957578 - DNA, 25 bp, Mus musculus
ttggtgctacactcagtctgcaaca

SEQ ID NO: 957579 - DNA, 25 bp, Mus musculus
ttggtgctcacacgcacctcactgg

SEQ ID NO: 957580 - DNA, 25 bp, Mus musculus
ttggtgctcacaggcacctcactgg

SEQ ID NO: 957581 - DNA, 25 bp, Mus musculus
ttggtgctcctgcaactggtattac

SEQ ID NO: 957582 - DNA, 25 bp, Mus musculus
ttggtgctcctggaactggtattac

SEQ ID NO: 957583 - DNA, 25 bp, Mus musculus
ttggtgctcgcacgtttggcaataa

SEQ ID NO: 957584 - DNA, 25 bp, Mus musculus
ttggtgctcgcaggtttggcaataa

SEQ ID NO: 957585 - DNA, 25 bp, Mus musculus
ttggtgctgcaacatctcaatttca

SEQ ID NO: 957586 - DNA, 25 bp, Mus musculus
ttggtgctgcaagatctcaatttca

SEQ ID NO: 957587 - DNA, 25 bp, Mus musculus
ttggtgctgccgaatccagttctca

SEQ ID NO: 957588 - DNA, 25 bp, Mus musculus
ttggtgctgccgtatccagttctca

SEQ ID NO: 957589 - DNA, 25 bp, Mus musculus
ttggtgctgctgagatttgtaatgt

SEQ ID NO: 957590 - DNA, 25 bp, Mus musculus
ttggtgctgctgtgatttgtaatgt

SEQ ID NO: 957591 - DNA, 25 bp, Mus musculus
ttggtgctggttcgaaacagagcct

SEQ ID NO: 957592 - DNA, 25 bp, Mus musculus
ttggtgctggttggaaacagagcct

SEQ ID NO: 957593 - DNA, 25 bp, Mus musculus
ttggtgctgtgaaccgggtcattat

SEQ ID NO: 957594 - DNA, 25 bp, Mus musculus
ttggtgctgtgatccgggtcattat

SEQ ID NO: 957595 - DNA, 25 bp, Mus musculus
ttggtgctgtggctccatgtgcaaa

SEQ ID NO: 957596 - DNA, 25 bp, Mus musculus
ttggtgctgtgggtccatgtgcaaa

SEQ ID NO: 957597 - DNA, 25 bp, Mus musculus
ttggtgcttaagagccacggctgct

SEQ ID NO: 957598 - DNA, 25 bp, Mus musculus
ttggtgcttaagtgccacggctgct

SEQ ID NO: 957599 - DNA, 25 bp, Mus musculus
ttggtgcttactctgctggattcta

SEQ ID NO: 957600 - DNA, 25 bp, Mus musculus
ttggtgcttactgtgctggattcta

SEQ ID NO: 957601 - DNA, 25 bp, Mus musculus
ttggtgcttggcagccttctgggca

SEQ ID NO: 957602 - DNA, 25 bp, Mus musculus
ttggtgcttggctgccttctgggca

SEQ ID NO: 957603 - DNA, 25 bp, Mus musculus
ttggtggaaagtccgtgcctttgcc

SEQ ID NO: 957604 - DNA, 25 bp, Mus musculus
ttggtggaaagtgcgtgcctttgcc

SEQ ID NO: 957605 - DNA, 25 bp, Mus musculus
ttggtggaagggacccattttcatt

SEQ ID NO: 957606 - DNA, 25 bp, Mus musculus
ttggtggaagggtcccattttcatt

SEQ ID NO: 957607 - DNA, 25 bp, Mus musculus
ttggtggacactaagattctttcta

SEQ ID NO: 957608 - DNA, 25 bp, Mus musculus
ttggtggacacttagattctttcta

SEQ ID NO: 957609 - DNA, 25 bp, Mus musculus
ttggtggaccaactgggtgatccca

SEQ ID NO: 957610 - DNA, 25 bp, Mus musculus
ttggtggaccaagtgggtgatccca

SEQ ID NO: 957611 - DNA, 25 bp, Mus musculus
ttggtggacctgaagagtggcctca

SEQ ID NO: 957612 - DNA, 25 bp, Mus musculus
ttggtggacctgtagagtggcctca

SEQ ID NO: 957613 - DNA, 25 bp, Mus musculus
ttggtggaccttacatagcatgctg

SEQ ID NO: 957614 - DNA, 25 bp, Mus musculus
ttggtggacctttcatagcatgctg

SEQ ID NO: 957615 - DNA, 25 bp, Mus musculus
ttggtggactccatttctcagggac

SEQ ID NO: 957616 - DNA, 25 bp, Mus musculus
ttggtggactccttttctcagggac

SEQ ID NO: 957617 - DNA, 25 bp, Mus musculus
ttggtggactctacaatgcttttca

SEQ ID NO: 957618 - DNA, 25 bp, Mus musculus
ttggtggactcttcaatgcttttca

SEQ ID NO: 957619 - DNA, 25 bp, Mus musculus
ttggtggagataactaccgcccttt

SEQ ID NO: 957620 - DNA, 25 bp, Mus musculus
ttggtggagatatctaccgcccttt

SEQ ID NO: 957621 - DNA, 25 bp, Mus musculus
ttggtggagatgactaccgttcctt

SEQ ID NO: 957622 - DNA, 25 bp, Mus musculus
ttggtggagatgtctaccgttcctt

SEQ ID NO: 957623 - DNA, 25 bp, Mus musculus
ttggtggaggtcatcagtgtttgct

SEQ ID NO: 957624 - DNA, 25 bp, Mus musculus
ttggtggaggtcttcagtgtttgct

SEQ ID NO: 957625 - DNA, 25 bp, Mus musculus
ttggtggagtaccaggcttctgttt

SEQ ID NO: 957626 - DNA, 25 bp, Mus musculus
ttggtggagtacgaggcttctgttt

SEQ ID NO: 957627 - DNA, 25 bp, Mus musculus
ttggtggcaaacacgctgcctgctt

SEQ ID NO: 957628 - DNA, 25 bp, Mus musculus
ttggtggcaaactcgctgcctgctt

SEQ ID NO: 957629 - DNA, 25 bp, Mus musculus
ttggtggcaaatatgtttacttgtt

SEQ ID NO: 957630 - DNA, 25 bp, Mus musculus
ttggtggcaaatttgtttacttgtt

SEQ ID NO: 957631 - DNA, 25 bp, Mus musculus
ttggtggcacttcagacttttgttc

SEQ ID NO: 957632 - DNA, 25 bp, Mus musculus
ttggtggcacttgagacttttgttc

SEQ ID NO: 957633 - DNA, 25 bp, Mus musculus
ttggtggcagcaccaacttttcagc

SEQ ID NO: 957634 - DNA, 25 bp, Mus musculus
ttggtggcagcagcaacttttcagc

SEQ ID NO: 957635 - DNA, 25 bp, Mus musculus
ttggtggcagctcagagcgatgcct

SEQ ID NO: 957636 - DNA, 25 bp, Mus musculus
ttggtggcagctgagagcgatgcct

SEQ ID NO: 957637 - DNA, 25 bp, Mus musculus
ttggtggcagtcacgtggctgactc

SEQ ID NO: 957638 - DNA, 25 bp, Mus musculus
ttggtggcagtcagttagaacatgt

SEQ ID NO: 957639 - DNA, 25 bp, Mus musculus
ttggtggcagtctcgtggctgactc

SEQ ID NO: 957640 - DNA, 25 bp, Mus musculus
ttggtggcagtctgttagaacatgt

SEQ ID NO: 957641 - DNA, 25 bp, Mus musculus
ttggtggccccacggatacctaagt

SEQ ID NO: 957642 - DNA, 25 bp, Mus musculus
ttggtggccccagggatacctaagt

SEQ ID NO: 957643 - DNA, 25 bp, Mus musculus
ttggtggcctgtcttactacctgtc

SEQ ID NO: 957644 - DNA, 25 bp, Mus musculus
ttggtggcctgtgttactacctgtc

SEQ ID NO: 957645 - DNA, 25 bp, Mus musculus
ttggtggctacaccaaacactaagg

SEQ ID NO: 957646 - DNA, 25 bp, Mus musculus
ttggtggctacagcaaacactaagg

SEQ ID NO: 957647 - DNA, 25 bp, Mus musculus
ttggtggctcctccttggtgacttc

SEQ ID NO: 957648 - DNA, 25 bp, Mus musculus
ttggtggctcctgcttggtgacttc

SEQ ID NO: 957649 - DNA, 25 bp, Mus musculus
ttggtggctggcctcttttatagag

SEQ ID NO: 957650 - DNA, 25 bp, Mus musculus
ttggtggctggcgtcttttatagag

SEQ ID NO: 957651 - DNA, 25 bp, Mus musculus
ttggtggctgtgcattacaaaaggt

SEQ ID NO: 957652 - DNA, 25 bp, Mus musculus
ttggtggctgtggattacaaaaggt

SEQ ID NO: 957653 - DNA, 25 bp, Mus musculus
ttggtggctgttctctcgctgcgct

SEQ ID NO: 957654 - DNA, 25 bp, Mus musculus
ttggtggctgttgtctcgctgcgct

SEQ ID NO: 957655 - DNA, 25 bp, Mus musculus
ttggtggcttgcacacaggtgcgct

SEQ ID NO: 957656 - DNA, 25 bp, Mus musculus
ttggtggcttgctcacaggtgcgct

SEQ ID NO: 957657 - DNA, 25 bp, Mus musculus
ttggtgggaatgcagaccttgccct

SEQ ID NO: 957658 - DNA, 25 bp, Mus musculus
ttggtgggaatggagaccttgccct

SEQ ID NO: 957659 - DNA, 25 bp, Mus musculus
ttggtgggactcagcttgcgtcagc

SEQ ID NO: 957660 - DNA, 25 bp, Mus musculus
ttggtgggactctgcttgcgtcagc

SEQ ID NO: 957661 - DNA, 25 bp, Mus musculus
ttggtgggcgacaacccttctgcca

SEQ ID NO: 957662 - DNA, 25 bp, Mus musculus
ttggtgggcgactacccttctgcca

SEQ ID NO: 957663 - DNA, 25 bp, Mus musculus
ttggtgggtcacactcagacattta

SEQ ID NO: 957664 - DNA, 25 bp, Mus musculus
ttggtgggtcactctcagacattta

SEQ ID NO: 957665 - DNA, 25 bp, Mus musculus
ttggtgggtccaacacgttccaggc

SEQ ID NO: 957666 - DNA, 25 bp, Mus musculus
ttggtgggtccatcacgttccaggc

SEQ ID NO: 957667 - DNA, 25 bp, Mus musculus
ttggtgggtggtctgatttcaaaca

SEQ ID NO: 957668 - DNA, 25 bp, Mus musculus
ttggtgggtggtgtgatttcaaaca

SEQ ID NO: 957669 - DNA, 25 bp, Mus musculus
ttggtgggttagcactaggtcctcc

SEQ ID NO: 957670 - DNA, 25 bp, Mus musculus
ttggtgggttagctcaacagttaaa

SEQ ID NO: 957671 - DNA, 25 bp, Mus musculus
ttggtgggttaggactaggtcctcc

SEQ ID NO: 957672 - DNA, 25 bp, Mus musculus
ttggtgggttaggtcaacagttaaa

SEQ ID NO: 957673 - DNA, 25 bp, Mus musculus
ttggtggtaactcctcctatcccat

SEQ ID NO: 957674 - DNA, 25 bp, Mus musculus
ttggtggtaactgctcctatcccat

SEQ ID NO: 957675 - DNA, 25 bp, Mus musculus
ttggtggtgtgaactgaacccagat

SEQ ID NO: 957676 - DNA, 25 bp, Mus musculus
ttggtggtgtgatctgaacccagat

SEQ ID NO: 957677 - DNA, 25 bp, Mus musculus
ttggtggttgtgctaacaatctgct

SEQ ID NO: 957678 - DNA, 25 bp, Mus musculus
ttggtggttgtggtaacaatctgct

SEQ ID NO: 957679 - DNA, 25 bp, Mus musculus
ttggtgtacataagagtgggcattc

SEQ ID NO: 957680 - DNA, 25 bp, Mus musculus
ttggtgtacatatgagtgggcattc

SEQ ID NO: 957681 - DNA, 25 bp, Mus musculus
ttggtgtacctcacaagacttctcg

SEQ ID NO: 957682 - DNA, 25 bp, Mus musculus
ttggtgtacctctcaagacttctcg

SEQ ID NO: 957683 - DNA, 25 bp, Mus musculus
ttggtgtactttccatatcaatctc

SEQ ID NO: 957684 - DNA, 25 bp, Mus musculus
ttggtgtactttgcatatcaatctc

SEQ ID NO: 957685 - DNA, 25 bp, Mus musculus
ttggtgtatgctctcctttgtaatg

SEQ ID NO: 957686 - DNA, 25 bp, Mus musculus
ttggtgtatgctgtcctttgtaatg

SEQ ID NO: 957687 - DNA, 25 bp, Mus musculus
ttggtgtcaccgacatcttgctcta

SEQ ID NO: 957688 - DNA, 25 bp, Mus musculus
ttggtgtcaccgtcatcttgctcta

SEQ ID NO: 957689 - DNA, 25 bp, Mus musculus
ttggtgtcagtgaaccagacctgct

SEQ ID NO: 957690 - DNA, 25 bp, Mus musculus
ttggtgtcagtgtaccagacctgct

SEQ ID NO: 957691 - DNA, 25 bp, Mus musculus
ttggtgtcatgtagggagtctgctc

SEQ ID NO: 957692 - DNA, 25 bp, Mus musculus
ttggtgtcatgttgggagtctgctc

SEQ ID NO: 957693 - DNA, 25 bp, Mus musculus
ttggtgtccgttagtattgaataat

SEQ ID NO: 957694 - DNA, 25 bp, Mus musculus
ttggtgtccgtttgtattgaataat

SEQ ID NO: 957695 - DNA, 25 bp, Mus musculus
ttggtgtcctggagtactgcttcac

SEQ ID NO: 957696 - DNA, 25 bp, Mus musculus
ttggtgtcctggtgtactgcttcac

SEQ ID NO: 957697 - DNA, 25 bp, Mus musculus
ttggtgtcctgtcccaactacactt

SEQ ID NO: 957698 - DNA, 25 bp, Mus musculus
ttggtgtcctgtgccaactacactt

SEQ ID NO: 957699 - DNA, 25 bp, Mus musculus
ttggtgtcgccacggaacagctact

SEQ ID NO: 957700 - DNA, 25 bp, Mus musculus
ttggtgtcgccagggaacagctact

SEQ ID NO: 957701 - DNA, 25 bp, Mus musculus
ttggtgtcggttattattctgcctt

SEQ ID NO: 957702 - DNA, 25 bp, Mus musculus
ttggtgtcggtttttattctgcctt

SEQ ID NO: 957703 - DNA, 25 bp, Mus musculus
ttggtgtctagtcccagcatttctg

SEQ ID NO: 957704 - DNA, 25 bp, Mus musculus
ttggtgtctagtgccagcatttctg

SEQ ID NO: 957705 - DNA, 25 bp, Mus musculus
ttggtgtctcatcctgatttggtgg

SEQ ID NO: 957706 - DNA, 25 bp, Mus musculus
ttggtgtctcatgctgatttggtgg

SEQ ID NO: 957707 - DNA, 25 bp, Mus musculus
ttggtgtctcccctgaaggaagagc

SEQ ID NO: 957708 - DNA, 25 bp, Mus musculus
ttggtgtctcccgtgaaggaagagc

SEQ ID NO: 957709 - DNA, 25 bp, Mus musculus
ttggtgtctgcaagtggccattaga

SEQ ID NO: 957710 - DNA, 25 bp, Mus musculus
ttggtgtctgcatgtggccattaga

SEQ ID NO: 957711 - DNA, 25 bp, Mus musculus
ttggtgtctgctaaccttaagatgc

SEQ ID NO: 957712 - DNA, 25 bp, Mus musculus
ttggtgtctgcttaccttaagatgc

SEQ ID NO: 957713 - DNA, 25 bp, Mus musculus
ttggtgtgacccaatttctggacat

SEQ ID NO: 957714 - DNA, 25 bp, Mus musculus
ttggtgtgaccctatttctggacat

SEQ ID NO: 957715 - DNA, 25 bp, Mus musculus
ttggtgtgcaaaccgggcagaccca

SEQ ID NO: 957716 - DNA, 25 bp, Mus musculus
ttggtgtgcaaagcgggcagaccca

SEQ ID NO: 957717 - DNA, 25 bp, Mus musculus
ttggtgtgccaacgttttaaagttg

SEQ ID NO: 957718 - DNA, 25 bp, Mus musculus
ttggtgtgccaaggttttaaagttg

SEQ ID NO: 957719 - DNA, 25 bp, Mus musculus
ttggtgtgcctgactaagaaagcat

SEQ ID NO: 957720 - DNA, 25 bp, Mus musculus
ttggtgtgcctgtctaagaaagcat

SEQ ID NO: 957721 - DNA, 25 bp, Mus musculus
ttggtgtgccttactatttgtgtaa

SEQ ID NO: 957722 - DNA, 25 bp, Mus musculus
ttggtgtgcctttctatttgtgtaa

SEQ ID NO: 957723 - DNA, 25 bp, Mus musculus
ttggtgtgctctaatacacttccct

SEQ ID NO: 957724 - DNA, 25 bp, Mus musculus
ttggtgtgctcttatacacttccct

SEQ ID NO: 957725 - DNA, 25 bp, Mus musculus
ttggtgtgctgacccatagccttaa

SEQ ID NO: 957726 - DNA, 25 bp, Mus musculus
ttggtgtgctgagccatagccttaa

SEQ ID NO: 957727 - DNA, 25 bp, Mus musculus
ttggtgtggattctgtggaaggcga

SEQ ID NO: 957728 - DNA, 25 bp, Mus musculus
ttggtgtggattgtgtggaaggcga

SEQ ID NO: 957729 - DNA, 25 bp, Mus musculus
ttggtgtggctaaattttgtctcta

SEQ ID NO: 957730 - DNA, 25 bp, Mus musculus
ttggtgtggctatattttgtctcta

SEQ ID NO: 957731 - DNA, 25 bp, Mus musculus
ttggtgtgtaccagatgcattcgta

SEQ ID NO: 957732 - DNA, 25 bp, Mus musculus
ttggtgtgtacctgatgcattcgta

SEQ ID NO: 957733 - DNA, 25 bp, Mus musculus
ttggtgtgtccgaatagcatcttct

SEQ ID NO: 957734 - DNA, 25 bp, Mus musculus
ttggtgtgtccgtatagcatcttct

SEQ ID NO: 957735 - DNA, 25 bp, Mus musculus
ttggtgtgtgaccaccagtcagtca

SEQ ID NO: 957736 - DNA, 25 bp, Mus musculus
ttggtgtgtgacgaccagtcagtca

SEQ ID NO: 957737 - DNA, 25 bp, Mus musculus
ttggtgtgttgcctgatgcaaataa

SEQ ID NO: 957738 - DNA, 25 bp, Mus musculus
ttggtgtgttgcgtgatgcaaataa

SEQ ID NO: 957739 - DNA, 25 bp, Mus musculus
ttggtgttaaatccctttctccctg

SEQ ID NO: 957740 - DNA, 25 bp, Mus musculus
ttggtgttaaatgcctttctccctg

SEQ ID NO: 957741 - DNA, 25 bp, Mus musculus
ttggtgttcagcaagggatgcagac

SEQ ID NO: 957742 - DNA, 25 bp, Mus musculus
ttggtgttcagctagggatgcagac

SEQ ID NO: 957743 - DNA, 25 bp, Mus musculus
ttggtgttcaggattctaggtgtgt

SEQ ID NO: 957744 - DNA, 25 bp, Mus musculus
ttggtgttcaggtttctaggtgtgt

SEQ ID NO: 957745 - DNA, 25 bp, Mus musculus
ttggtgttcataaaataaggtcttt

SEQ ID NO: 957746 - DNA, 25 bp, Mus musculus
ttggtgttcatataataaggtcttt

SEQ ID NO: 957747 - DNA, 25 bp, Mus musculus
ttggtgttcccgcagccatattgta

SEQ ID NO: 957748 - DNA, 25 bp, Mus musculus
ttggtgttcccggagccatattgta

SEQ ID NO: 957749 - DNA, 25 bp, Mus musculus
ttggtgttcggtccttgagcttgcc

SEQ ID NO: 957750 - DNA, 25 bp, Mus musculus
ttggtgttcggtgcttgagcttgcc

SEQ ID NO: 957751 - DNA, 25 bp, Mus musculus
ttggtgttctctctgcagctctgat

SEQ ID NO: 957752 - DNA, 25 bp, Mus musculus
ttggtgttctctgtgcagctctgat

SEQ ID NO: 957753 - DNA, 25 bp, Mus musculus
ttggtgttctgaacctggttccctc

SEQ ID NO: 957754 - DNA, 25 bp, Mus musculus
ttggtgttctgacactcccttagag

SEQ ID NO: 957755 - DNA, 25 bp, Mus musculus
ttggtgttctgagactcccttagag

SEQ ID NO: 957756 - DNA, 25 bp, Mus musculus
ttggtgttctgatcctggttccctc

SEQ ID NO: 957757 - DNA, 25 bp, Mus musculus
ttggtgttgcttaatcttagtttac

SEQ ID NO: 957758 - DNA, 25 bp, Mus musculus
ttggtgttgctttatcttagtttac

SEQ ID NO: 957759 - DNA, 25 bp, Mus musculus
ttggtgttggtaaacctttgccgac

SEQ ID NO: 957760 - DNA, 25 bp, Mus musculus
ttggtgttggtatacctttgccgac

SEQ ID NO: 957761 - DNA, 25 bp, Mus musculus
ttggtgtttcctcctgagtgtcaaa

SEQ ID NO: 957762 - DNA, 25 bp, Mus musculus
ttggtgtttcctgctgagtgtcaaa

SEQ ID NO: 957763 - DNA, 25 bp, Mus musculus
ttggtgtttctccatgtcatacgct

SEQ ID NO: 957764 - DNA, 25 bp, Mus musculus
ttggtgtttctcgatgtcatacgct

SEQ ID NO: 957765 - DNA, 25 bp, Mus musculus
ttggtgtttgccattttgctttgta

SEQ ID NO: 957766 - DNA, 25 bp, Mus musculus
ttggtgtttgcctttttgctttgta

SEQ ID NO: 957767 - DNA, 25 bp, Mus musculus
ttggtgtttgtactcttgacctctt

SEQ ID NO: 957768 - DNA, 25 bp, Mus musculus
ttggtgtttgtagtcttgacctctt

SEQ ID NO: 957769 - DNA, 25 bp, Mus musculus
ttggtgtttgtgaggcacttggtat

SEQ ID NO: 957770 - DNA, 25 bp, Mus musculus
ttggtgtttgtgtggcacttggtat

SEQ ID NO: 957771 - DNA, 25 bp, Mus musculus
ttggtgttttataccatcctaccca

SEQ ID NO: 957772 - DNA, 25 bp, Mus musculus
ttggtgttttattccatcctaccca

SEQ ID NO: 957773 - DNA, 25 bp, Mus musculus
ttggttaacttgacttggcaaaaga

SEQ ID NO: 957774 - DNA, 25 bp, Mus musculus
ttggttaacttgtcttggcaaaaga

SEQ ID NO: 957775 - DNA, 25 bp, Mus musculus
ttggttacccagatcattctttgta

SEQ ID NO: 957776 - DNA, 25 bp, Mus musculus
ttggttacccagttcattctttgta

SEQ ID NO: 957777 - DNA, 25 bp, Mus musculus
ttggttactgatacatttttcccta

SEQ ID NO: 957778 - DNA, 25 bp, Mus musculus
ttggttactgattcatttttcccta

SEQ ID NO: 957779 - DNA, 25 bp, Mus musculus
ttggttagatttcaggtccgacttc

SEQ ID NO: 957780 - DNA, 25 bp, Mus musculus
ttggttagatttgaggtccgacttc

SEQ ID NO: 957781 - DNA, 25 bp, Mus musculus
ttggttagcttcctcactcactgtt

SEQ ID NO: 957782 - DNA, 25 bp, Mus musculus
ttggttagcttcgtcactcactgtt

SEQ ID NO: 957783 - DNA, 25 bp, Mus musculus
ttggttagggccatcgcgaacccca

SEQ ID NO: 957784 - DNA, 25 bp, Mus musculus
ttggttagggccttcgcgaacccca

SEQ ID NO: 957785 - DNA, 25 bp, Mus musculus
ttggttatcccacccatactggtat

SEQ ID NO: 957786 - DNA, 25 bp, Mus musculus
ttggttatcccagccatactggtat

SEQ ID NO: 957787 - DNA, 25 bp, Mus musculus
ttggttatccttcccaacaactgtc

SEQ ID NO: 957788 - DNA, 25 bp, Mus musculus
ttggttatccttgccaacaactgtc

SEQ ID NO: 957789 - DNA, 25 bp, Mus musculus
ttggttatctcaccccgcggagtgg

SEQ ID NO: 957790 - DNA, 25 bp, Mus musculus
ttggttatctcagcccgcggagtgg

SEQ ID NO: 957791 - DNA, 25 bp, Mus musculus
ttggttatgactataattccttggt

SEQ ID NO: 957792 - DNA, 25 bp, Mus musculus
ttggttatgactttaattccttggt

SEQ ID NO: 957793 - DNA, 25 bp, Mus musculus
ttggttatggtacggcactgaacag

SEQ ID NO: 957794 - DNA, 25 bp, Mus musculus
ttggttatggtagggcactgaacag

SEQ ID NO: 957795 - DNA, 25 bp, Mus musculus
ttggttcaaggtacaaacatcaaag

SEQ ID NO: 957796 - DNA, 25 bp, Mus musculus
ttggttcaaggttcaaacatcaaag

SEQ ID NO: 957797 - DNA, 25 bp, Mus musculus
ttggttcacaagaacagcacccggc

SEQ ID NO: 957798 - DNA, 25 bp, Mus musculus
ttggttcacaagtacagcacccggc

SEQ ID NO: 957799 - DNA, 25 bp, Mus musculus
ttggttcaccaactctcaaaatgtt

SEQ ID NO: 957800 - DNA, 25 bp, Mus musculus
ttggttcaccaagtctcaaaatgtt

SEQ ID NO: 957801 - DNA, 25 bp, Mus musculus
ttggttcaccggataagcagtgaca

SEQ ID NO: 957802 - DNA, 25 bp, Mus musculus
ttggttcaccggttaagcagtgaca

SEQ ID NO: 957803 - DNA, 25 bp, Mus musculus
ttggttcagacacctattcacagaa

SEQ ID NO: 957804 - DNA, 25 bp, Mus musculus
ttggttcagacagctattcacagaa

SEQ ID NO: 957805 - DNA, 25 bp, Mus musculus
ttggttcagccccagacatctaatt

SEQ ID NO: 957806 - DNA, 25 bp, Mus musculus
ttggttcagcccgagacatctaatt

SEQ ID NO: 957807 - DNA, 25 bp, Mus musculus
ttggttcaggttcatctgcccataa

SEQ ID NO: 957808 - DNA, 25 bp, Mus musculus
ttggttcaggttgatctgcccataa

SEQ ID NO: 957809 - DNA, 25 bp, Mus musculus
ttggttcagtgaagcccttgtgcaa

SEQ ID NO: 957810 - DNA, 25 bp, Mus musculus
ttggttcagtgatgcccttgtgcaa

SEQ ID NO: 957811 - DNA, 25 bp, Mus musculus
ttggttcatcatactccagaccatg

SEQ ID NO: 957812 - DNA, 25 bp, Mus musculus
ttggttcatcatctcttcttcttca

SEQ ID NO: 957813 - DNA, 25 bp, Mus musculus
ttggttcatcatgtcttcttcttca

SEQ ID NO: 957814 - DNA, 25 bp, Mus musculus
ttggttcatcattctccagaccatg

SEQ ID NO: 957815 - DNA, 25 bp, Mus musculus
ttggttcatcttaaatttccctgta

SEQ ID NO: 957816 - DNA, 25 bp, Mus musculus
ttggttcatcttactcctggtaaaa

SEQ ID NO: 957817 - DNA, 25 bp, Mus musculus
ttggttcatctttaatttccctgta

SEQ ID NO: 957818 - DNA, 25 bp, Mus musculus
ttggttcatctttctcctggtaaaa

SEQ ID NO: 957819 - DNA, 25 bp, Mus musculus
ttggttccacatctcagtgtctgct

SEQ ID NO: 957820 - DNA, 25 bp, Mus musculus
ttggttccacatgtcagtgtctgct

SEQ ID NO: 957821 - DNA, 25 bp, Mus musculus
ttggttccagaactcatctagatag

SEQ ID NO: 957822 - DNA, 25 bp, Mus musculus
ttggttccagaagtcatctagatag

SEQ ID NO: 957823 - DNA, 25 bp, Mus musculus
ttggttccagtcacatgtcccagag

SEQ ID NO: 957824 - DNA, 25 bp, Mus musculus
ttggttccagtctcatgtcccagag

SEQ ID NO: 957825 - DNA, 25 bp, Mus musculus
ttggttccagtgacagaagcaagca

SEQ ID NO: 957826 - DNA, 25 bp, Mus musculus
ttggttccagtgtcagaagcaagca

SEQ ID NO: 957827 - DNA, 25 bp, Mus musculus
ttggttccatttcaccggctctcaa

SEQ ID NO: 957828 - DNA, 25 bp, Mus musculus
ttggttccatttgaccggctctcaa

SEQ ID NO: 957829 - DNA, 25 bp, Mus musculus
ttggttcccagacctataaagaagg

SEQ ID NO: 957830 - DNA, 25 bp, Mus musculus
ttggttcccagaccttgaagcccag

SEQ ID NO: 957831 - DNA, 25 bp, Mus musculus
ttggttcccagagctataaagaagg

SEQ ID NO: 957832 - DNA, 25 bp, Mus musculus
ttggttcccagagcttgaagcccag

SEQ ID NO: 957833 - DNA, 25 bp, Mus musculus
ttggttcccggcagtcacttcaaat

SEQ ID NO: 957834 - DNA, 25 bp, Mus musculus
ttggttcccggctgtcacttcaaat

SEQ ID NO: 957835 - DNA, 25 bp, Mus musculus
ttggttccctccacttaaagagcat

SEQ ID NO: 957836 - DNA, 25 bp, Mus musculus
ttggttccctcctcttaaagagcat

SEQ ID NO: 957837 - DNA, 25 bp, Mus musculus
ttggttccctctcaagccagtcttg

SEQ ID NO: 957838 - DNA, 25 bp, Mus musculus
ttggttccctctcgctgaggaggaa

SEQ ID NO: 957839 - DNA, 25 bp, Mus musculus
ttggttccctctgaagccagtcttg

SEQ ID NO: 957840 - DNA, 25 bp, Mus musculus
ttggttccctctggctgaggaggaa

SEQ ID NO: 957841 - DNA, 25 bp, Mus musculus
ttggttccctgtcaactttctagct

SEQ ID NO: 957842 - DNA, 25 bp, Mus musculus
ttggttccctgtgaactttctagct

SEQ ID NO: 957843 - DNA, 25 bp, Mus musculus
ttggttccgggcactgccgaaagag

SEQ ID NO: 957844 - DNA, 25 bp, Mus musculus
ttggttccgggctctgccgaaagag

SEQ ID NO: 957845 - DNA, 25 bp, Mus musculus
ttggttcctagtacctgcattaggc

SEQ ID NO: 957846 - DNA, 25 bp, Mus musculus
ttggttcctagttcctgcattaggc

SEQ ID NO: 957847 - DNA, 25 bp, Mus musculus
ttggttcctcaaatattccgttgta

SEQ ID NO: 957848 - DNA, 25 bp, Mus musculus
ttggttcctcaattattccgttgta

SEQ ID NO: 957849 - DNA, 25 bp, Mus musculus
ttggttcctccaaatctttgatgtt

SEQ ID NO: 957850 - DNA, 25 bp, Mus musculus
ttggttcctccatatctttgatgtt

SEQ ID NO: 957851 - DNA, 25 bp, Mus musculus
ttggttcctgcaactcggtgatcaa

SEQ ID NO: 957852 - DNA, 25 bp, Mus musculus
ttggttcctgcatctcggtgatcaa

SEQ ID NO: 957853 - DNA, 25 bp, Mus musculus
ttggttcctgccagttatagttctc

SEQ ID NO: 957854 - DNA, 25 bp, Mus musculus
ttggttcctgcctgttatagttctc

SEQ ID NO: 957855 - DNA, 25 bp, Mus musculus
ttggttcctggtcacaagtgcgaat

SEQ ID NO: 957856 - DNA, 25 bp, Mus musculus
ttggttcctggtctacttacagaca

SEQ ID NO: 957857 - DNA, 25 bp, Mus musculus
ttggttcctggtgacaagtgcgaat

SEQ ID NO: 957858 - DNA, 25 bp, Mus musculus
ttggttcctggtgtacttacagaca

SEQ ID NO: 957859 - DNA, 25 bp, Mus musculus
ttggttccttccctaaagattgcat

SEQ ID NO: 957860 - DNA, 25 bp, Mus musculus
ttggttccttccgtaaagattgcat

SEQ ID NO: 957861 - DNA, 25 bp, Mus musculus
ttggttccttttcgtcaaagattag

SEQ ID NO: 957862 - DNA, 25 bp, Mus musculus
ttggttccttttggtcaaagattag

SEQ ID NO: 957863 - DNA, 25 bp, Mus musculus
ttggttctaacgacaactttgttgt

SEQ ID NO: 957864 - DNA, 25 bp, Mus musculus
ttggttctaacgtcaactttgttgt

SEQ ID NO: 957865 - DNA, 25 bp, Mus musculus
ttggttctcaatcccggaggcttcc

SEQ ID NO: 957866 - DNA, 25 bp, Mus musculus
ttggttctcaatgccggaggcttcc

SEQ ID NO: 957867 - DNA, 25 bp, Mus musculus
ttggttctcagtccacaggcaccta

SEQ ID NO: 957868 - DNA, 25 bp, Mus musculus
ttggttctcagtgcacaggcaccta

SEQ ID NO: 957869 - DNA, 25 bp, Mus musculus
ttggttctccctaaaacgtcatgtc

SEQ ID NO: 957870 - DNA, 25 bp, Mus musculus
ttggttctcccttaaacgtcatgtc

SEQ ID NO: 957871 - DNA, 25 bp, Mus musculus
ttggttctcctccacagttgtggga

SEQ ID NO: 957872 - DNA, 25 bp, Mus musculus
ttggttctcctcgacagttgtggga

SEQ ID NO: 957873 - DNA, 25 bp, Mus musculus
ttggttctcctgctaagctggacta

SEQ ID NO: 957874 - DNA, 25 bp, Mus musculus
ttggttctcctggtaagctggacta

SEQ ID NO: 957875 - DNA, 25 bp, Mus musculus
ttggttctgaacacacaacaggcac

SEQ ID NO: 957876 - DNA, 25 bp, Mus musculus
ttggttctgaactcacaacaggcac

SEQ ID NO: 957877 - DNA, 25 bp, Mus musculus
ttggttctgagcatatacccacctg

SEQ ID NO: 957878 - DNA, 25 bp, Mus musculus
ttggttctgagcttatacccacctg

SEQ ID NO: 957879 - DNA, 25 bp, Mus musculus
ttggttctgaggctgaagtctctct

SEQ ID NO: 957880 - DNA, 25 bp, Mus musculus
ttggttctgagggtgaagtctctct

SEQ ID NO: 957881 - DNA, 25 bp, Mus musculus
ttggttctgatactgtttttgaggt

SEQ ID NO: 957882 - DNA, 25 bp, Mus musculus
ttggttctgatagtgtttttgaggt

SEQ ID NO: 957883 - DNA, 25 bp, Mus musculus
ttggttctggagcactgagtctgtc

SEQ ID NO: 957884 - DNA, 25 bp, Mus musculus
ttggttctggaggactgagtctgtc

SEQ ID NO: 957885 - DNA, 25 bp, Mus musculus
ttggttctggctccacatctaggga

SEQ ID NO: 957886 - DNA, 25 bp, Mus musculus
ttggttctggctgcacatctaggga

SEQ ID NO: 957887 - DNA, 25 bp, Mus musculus
ttggttcttgaacgatctctgaatc

SEQ ID NO: 957888 - DNA, 25 bp, Mus musculus
ttggttcttgaaggatctctgaatc

SEQ ID NO: 957889 - DNA, 25 bp, Mus musculus
ttggttcttgacattggatccaaag

SEQ ID NO: 957890 - DNA, 25 bp, Mus musculus
ttggttcttgactttggatccaaag

SEQ ID NO: 957891 - DNA, 25 bp, Mus musculus
ttggttctttacagtgggcatacac

SEQ ID NO: 957892 - DNA, 25 bp, Mus musculus
ttggttctttactgtgggcatacac

SEQ ID NO: 957893 - DNA, 25 bp, Mus musculus
ttggttgaaatgacagccgctcctg

SEQ ID NO: 957894 - DNA, 25 bp, Mus musculus
ttggttgaaatgtcagccgctcctg

SEQ ID NO: 957895 - DNA, 25 bp, Mus musculus
ttggttgaagtgacccatcatctcc

SEQ ID NO: 957896 - DNA, 25 bp, Mus musculus
ttggttgaagtgtcccatcatctcc

SEQ ID NO: 957897 - DNA, 25 bp, Mus musculus
ttggttgaccacatgctcctcagta

SEQ ID NO: 957898 - DNA, 25 bp, Mus musculus
ttggttgaccacttgctcctcagta

SEQ ID NO: 957899 - DNA, 25 bp, Mus musculus
ttggttgagcatcgcatccggcgac

SEQ ID NO: 957900 - DNA, 25 bp, Mus musculus
ttggttgagcatggcatccggcgac

SEQ ID NO: 957901 - DNA, 25 bp, Mus musculus
ttggttgataggatagaccctggga

SEQ ID NO: 957902 - DNA, 25 bp, Mus musculus
ttggttgataggttagaccctggga

SEQ ID NO: 957903 - DNA, 25 bp, Mus musculus
ttggttgatgccatcccagaatgca

SEQ ID NO: 957904 - DNA, 25 bp, Mus musculus
ttggttgatgccttcccagaatgca

SEQ ID NO: 957905 - DNA, 25 bp, Mus musculus
ttggttgcagcccacatagtgcctg

SEQ ID NO: 957906 - DNA, 25 bp, Mus musculus
ttggttgcagccgacatagtgcctg

SEQ ID NO: 957907 - DNA, 25 bp, Mus musculus
ttggttgcagttcccaggtctggat

SEQ ID NO: 957908 - DNA, 25 bp, Mus musculus
ttggttgcagttccgtagtggttaa

SEQ ID NO: 957909 - DNA, 25 bp, Mus musculus
ttggttgcagttgccaggtctggat

SEQ ID NO: 957910 - DNA, 25 bp, Mus musculus
ttggttgcagttgcgtagtggttaa

SEQ ID NO: 957911 - DNA, 25 bp, Mus musculus
ttggttgccaaaaagaatgcctttt

SEQ ID NO: 957912 - DNA, 25 bp, Mus musculus
ttggttgccaaatagaatgcctttt

SEQ ID NO: 957913 - DNA, 25 bp, Mus musculus
ttggttgccaccagcaatccctgta

SEQ ID NO: 957914 - DNA, 25 bp, Mus musculus
ttggttgccacctgcaatccctgta

SEQ ID NO: 957915 - DNA, 25 bp, Mus musculus
ttggttgcccctaaggaatggctta

SEQ ID NO: 957916 - DNA, 25 bp, Mus musculus
ttggttgccccttaggaatggctta

SEQ ID NO: 957917 - DNA, 25 bp, Mus musculus
ttggttgcctttcgaggaagctcct

SEQ ID NO: 957918 - DNA, 25 bp, Mus musculus
ttggttgcctttggaggaagctcct

SEQ ID NO: 957919 - DNA, 25 bp, Mus musculus
ttggttgctcaaattcaggttgaaa

SEQ ID NO: 957920 - DNA, 25 bp, Mus musculus
ttggttgctcaatttcaggttgaaa

SEQ ID NO: 957921 - DNA, 25 bp, Mus musculus
ttggttgctggtatgtgttttgttg

SEQ ID NO: 957922 - DNA, 25 bp, Mus musculus
ttggttgctggtcctacatggtgac

SEQ ID NO: 957923 - DNA, 25 bp, Mus musculus
ttggttgctggtgctacatggtgac

SEQ ID NO: 957924 - DNA, 25 bp, Mus musculus
ttggttgctggtttgtgttttgttg

SEQ ID NO: 957925 - DNA, 25 bp, Mus musculus
ttggttgctgttacgaggctaggac

SEQ ID NO: 957926 - DNA, 25 bp, Mus musculus
ttggttgctgtttcgaggctaggac

SEQ ID NO: 957927 - DNA, 25 bp, Mus musculus
ttggttggccaacaaagactgtata

SEQ ID NO: 957928 - DNA, 25 bp, Mus musculus
ttggttggccaagaaagactgtata

SEQ ID NO: 957929 - DNA, 25 bp, Mus musculus
ttggttggctttaagttagtgtttg

SEQ ID NO: 957930 - DNA, 25 bp, Mus musculus
ttggttggcttttagttagtgtttg

SEQ ID NO: 957931 - DNA, 25 bp, Mus musculus
ttggttgggcttagatctgtttttt

SEQ ID NO: 957932 - DNA, 25 bp, Mus musculus
ttggttgggctttgatctgtttttt

SEQ ID NO: 957933 - DNA, 25 bp, Mus musculus
ttggttggtaccaatcatctgggaa

SEQ ID NO: 957934 - DNA, 25 bp, Mus musculus
ttggttggtacctatcatctgggaa

SEQ ID NO: 957935 - DNA, 25 bp, Mus musculus
ttggttggtgtgaagcttaacaaga

SEQ ID NO: 957936 - DNA, 25 bp, Mus musculus
ttggttggtgtgtagcttaacaaga

SEQ ID NO: 957937 - DNA, 25 bp, Mus musculus
ttggttgtacaacggaagcctggtc

SEQ ID NO: 957938 - DNA, 25 bp, Mus musculus
ttggttgtacaagggaagcctggtc

SEQ ID NO: 957939 - DNA, 25 bp, Mus musculus
ttggttgtagagaccacagtgttcc

SEQ ID NO: 957940 - DNA, 25 bp, Mus musculus
ttggttgtagagtccacagtgttcc

SEQ ID NO: 957941 - DNA, 25 bp, Mus musculus
ttggttgtagttcctcacacctgta

SEQ ID NO: 957942 - DNA, 25 bp, Mus musculus
ttggttgtagttgctcacacctgta

SEQ ID NO: 957943 - DNA, 25 bp, Mus musculus
ttggttgtatgtatgcgtcttggca

SEQ ID NO: 957944 - DNA, 25 bp, Mus musculus
ttggttgtatgtttgcgtcttggca

SEQ ID NO: 957945 - DNA, 25 bp, Mus musculus
ttggttgtcaccaacataccctaca

SEQ ID NO: 957946 - DNA, 25 bp, Mus musculus
ttggttgtcacctacataccctaca

SEQ ID NO: 957947 - DNA, 25 bp, Mus musculus
ttggttgtcattcatttcgagttaa

SEQ ID NO: 957948 - DNA, 25 bp, Mus musculus
ttggttgtcattctctagtctatat

SEQ ID NO: 957949 - DNA, 25 bp, Mus musculus
ttggttgtcattgatttcgagttaa

SEQ ID NO: 957950 - DNA, 25 bp, Mus musculus
ttggttgtcattgtctagtctatat

SEQ ID NO: 957951 - DNA, 25 bp, Mus musculus
ttggttgtcccactggaagaagaac

SEQ ID NO: 957952 - DNA, 25 bp, Mus musculus
ttggttgtcccagtggaagaagaac

SEQ ID NO: 957953 - DNA, 25 bp, Mus musculus
ttggttgtccttaagccagtggata

SEQ ID NO: 957954 - DNA, 25 bp, Mus musculus
ttggttgtcctttagccagtggata

SEQ ID NO: 957955 - DNA, 25 bp, Mus musculus
ttggttgtgagcctatgcaccttac

SEQ ID NO: 957956 - DNA, 25 bp, Mus musculus
ttggttgtgagcgtatgcaccttac

SEQ ID NO: 957957 - DNA, 25 bp, Mus musculus
ttggttgtggataattttgtcttca

SEQ ID NO: 957958 - DNA, 25 bp, Mus musculus
ttggttgtggattattttgtcttca

SEQ ID NO: 957959 - DNA, 25 bp, Mus musculus
ttggttgtggctcagcaccgtgatc

SEQ ID NO: 957960 - DNA, 25 bp, Mus musculus
ttggttgtggctgagcaccgtgatc

SEQ ID NO: 957961 - DNA, 25 bp, Mus musculus
ttggttgtggtgatcatcgcagtga

SEQ ID NO: 957962 - DNA, 25 bp, Mus musculus
ttggttgtggtgttcatcgcagtga

SEQ ID NO: 957963 - DNA, 25 bp, Mus musculus
ttggttgttacactagcgttcagaa

SEQ ID NO: 957964 - DNA, 25 bp, Mus musculus
ttggttgttacagtagcgttcagaa

SEQ ID NO: 957965 - DNA, 25 bp, Mus musculus
ttggttgttcctcagtgccacataa

SEQ ID NO: 957966 - DNA, 25 bp, Mus musculus
ttggttgttcctgagtgccacataa

SEQ ID NO: 957967 - DNA, 25 bp, Mus musculus
ttggttgtttccatccagtattaca

SEQ ID NO: 957968 - DNA, 25 bp, Mus musculus
ttggttgtttccttccagtattaca

SEQ ID NO: 957969 - DNA, 25 bp, Mus musculus
ttggttgtttgtccaatattatata

SEQ ID NO: 957970 - DNA, 25 bp, Mus musculus
ttggttgtttgtgcaatattatata

SEQ ID NO: 957971 - DNA, 25 bp, Mus musculus
ttggttgttttcaccagggctctca

SEQ ID NO: 957972 - DNA, 25 bp, Mus musculus
ttggttgttttctccagggctctca

SEQ ID NO: 957973 - DNA, 25 bp, Mus musculus
ttggtttaagtcatgcccacatata

SEQ ID NO: 957974 - DNA, 25 bp, Mus musculus
ttggtttaagtcttgcccacatata

SEQ ID NO: 957975 - DNA, 25 bp, Mus musculus
ttggtttaccataagggtgccctgt

SEQ ID NO: 957976 - DNA, 25 bp, Mus musculus
ttggtttaccattagggtgccctgt

SEQ ID NO: 957977 - DNA, 25 bp, Mus musculus
ttggtttagagaattatcagggact

SEQ ID NO: 957978 - DNA, 25 bp, Mus musculus
ttggtttagagatttatcagggact

SEQ ID NO: 957979 - DNA, 25 bp, Mus musculus
ttggtttagctgcaaccttcccact

SEQ ID NO: 957980 - DNA, 25 bp, Mus musculus
ttggtttagctggaaccttcccact

SEQ ID NO: 957981 - DNA, 25 bp, Mus musculus
ttggtttagtcccagcctttaagca

SEQ ID NO: 957982 - DNA, 25 bp, Mus musculus
ttggtttagtccgagcctttaagca

SEQ ID NO: 957983 - DNA, 25 bp, Mus musculus
ttggtttatcataagtaccccattg

SEQ ID NO: 957984 - DNA, 25 bp, Mus musculus
ttggtttatcattagtaccccattg

SEQ ID NO: 957985 - DNA, 25 bp, Mus musculus
ttggtttcagaaaggctgtgcccca

SEQ ID NO: 957986 - DNA, 25 bp, Mus musculus
ttggtttcagaatggctgtgcccca

SEQ ID NO: 957987 - DNA, 25 bp, Mus musculus
ttggtttcatcgctggtgtcgaccc

SEQ ID NO: 957988 - DNA, 25 bp, Mus musculus
ttggtttcatcggtggtgtcgaccc

SEQ ID NO: 957989 - DNA, 25 bp, Mus musculus
ttggtttcatctagcctcagcaagc

SEQ ID NO: 957990 - DNA, 25 bp, Mus musculus
ttggtttcatcttgcctcagcaagc

SEQ ID NO: 957991 - DNA, 25 bp, Mus musculus
ttggtttccaagactagccttctgg

SEQ ID NO: 957992 - DNA, 25 bp, Mus musculus
ttggtttccaagtctagccttctgg

SEQ ID NO: 957993 - DNA, 25 bp, Mus musculus
ttggtttccaatagtcccagttggt

SEQ ID NO: 957994 - DNA, 25 bp, Mus musculus
ttggtttccaattgtcccagttggt

SEQ ID NO: 957995 - DNA, 25 bp, Mus musculus
ttggtttccacacccggttgcatat

SEQ ID NO: 957996 - DNA, 25 bp, Mus musculus
ttggtttccacagccggttgcatat

SEQ ID NO: 957997 - DNA, 25 bp, Mus musculus
ttggtttccagtctcaaatgtattt

SEQ ID NO: 957998 - DNA, 25 bp, Mus musculus
ttggtttccagtgtcaaatgtattt

SEQ ID NO: 957999 - DNA, 25 bp, Mus musculus
ttggtttcccaaatgactcagtttt

SEQ ID NO: 958000 - DNA, 25 bp, Mus musculus
ttggtttcccaattgactcagtttt

SEQ ID NO: 958001 - DNA, 25 bp, Mus musculus
ttggtttcccttaatcaatcctaag

SEQ ID NO: 958002 - DNA, 25 bp, Mus musculus
ttggtttccctttatcaatcctaag

SEQ ID NO: 958003 - DNA, 25 bp, Mus musculus
ttggtttccgctatctcctcctggg

SEQ ID NO: 958004 - DNA, 25 bp, Mus musculus
ttggtttccgctttctcctcctggg

SEQ ID NO: 958005 - DNA, 25 bp, Mus musculus
ttggtttccggcagagacttttaag

SEQ ID NO: 958006 - DNA, 25 bp, Mus musculus
ttggtttccggctgagacttttaag

SEQ ID NO: 958007 - DNA, 25 bp, Mus musculus
ttggtttcctagagcagactgttac

SEQ ID NO: 958008 - DNA, 25 bp, Mus musculus
ttggtttcctagtgcagactgttac

SEQ ID NO: 958009 - DNA, 25 bp, Mus musculus
ttggtttcctcaccatgaagccaat

SEQ ID NO: 958010 - DNA, 25 bp, Mus musculus
ttggtttcctcagcatgaagccaat

SEQ ID NO: 958011 - DNA, 25 bp, Mus musculus
ttggtttcctgtcaggttcactcca

SEQ ID NO: 958012 - DNA, 25 bp, Mus musculus
ttggtttcctgtgaggttcactcca

SEQ ID NO: 958013 - DNA, 25 bp, Mus musculus
ttggtttcgaccacagatccagagc

SEQ ID NO: 958014 - DNA, 25 bp, Mus musculus
ttggtttcgacctcagatccagagc

SEQ ID NO: 958015 - DNA, 25 bp, Mus musculus
ttggtttctcctagggagggcacca

SEQ ID NO: 958016 - DNA, 25 bp, Mus musculus
ttggtttctccttgggagggcacca

SEQ ID NO: 958017 - DNA, 25 bp, Mus musculus
ttggtttctcgacatcccaggaaga

SEQ ID NO: 958018 - DNA, 25 bp, Mus musculus
ttggtttctcgagatcccaggaaga

SEQ ID NO: 958019 - DNA, 25 bp, Mus musculus
ttggtttctgaaattcattctccac

SEQ ID NO: 958020 - DNA, 25 bp, Mus musculus
ttggtttctgaacacgttcaacgtt

SEQ ID NO: 958021 - DNA, 25 bp, Mus musculus
ttggtttctgaagacgttcaacgtt

SEQ ID NO: 958022 - DNA, 25 bp, Mus musculus
ttggtttctgaatttcattctccac

SEQ ID NO: 958023 - DNA, 25 bp, Mus musculus
ttggtttctgataccattgccttga

SEQ ID NO: 958024 - DNA, 25 bp, Mus musculus
ttggtttctgattccattgccttga

SEQ ID NO: 958025 - DNA, 25 bp, Mus musculus
ttggtttctgtaatccctgaatgca

SEQ ID NO: 958026 - DNA, 25 bp, Mus musculus
ttggtttctgtattccctgaatgca

SEQ ID NO: 958027 - DNA, 25 bp, Mus musculus
ttggtttctttcctgcatcaagata

SEQ ID NO: 958028 - DNA, 25 bp, Mus musculus
ttggtttctttcgtgcatcaagata

SEQ ID NO: 958029 - DNA, 25 bp, Mus musculus
ttggtttgaaccacctctcttccca

SEQ ID NO: 958030 - DNA, 25 bp, Mus musculus
ttggtttgaacctcctctcttccca

SEQ ID NO: 958031 - DNA, 25 bp, Mus musculus
ttggtttgaactaggctgactgggt

SEQ ID NO: 958032 - DNA, 25 bp, Mus musculus
ttggtttgaacttggctgactgggt

SEQ ID NO: 958033 - DNA, 25 bp, Mus musculus
ttggtttgaccgaatgcagtgccga

SEQ ID NO: 958034 - DNA, 25 bp, Mus musculus
ttggtttgaccgtatgcagtgccga

SEQ ID NO: 958035 - DNA, 25 bp, Mus musculus
ttggtttgagttatgattagtttag

SEQ ID NO: 958036 - DNA, 25 bp, Mus musculus
ttggtttgagttttgattagtttag

SEQ ID NO: 958037 - DNA, 25 bp, Mus musculus
ttggtttgcaccaggatgcccttgc

SEQ ID NO: 958038 - DNA, 25 bp, Mus musculus
ttggtttgcacctggatgcccttgc

SEQ ID NO: 958039 - DNA, 25 bp, Mus musculus
ttggtttgctctctctgcccacata

SEQ ID NO: 958040 - DNA, 25 bp, Mus musculus
ttggtttgctctgtctgcccacata

SEQ ID NO: 958041 - DNA, 25 bp, Mus musculus
ttggtttggcacacagcatgttcaa

SEQ ID NO: 958042 - DNA, 25 bp, Mus musculus
ttggtttggcactcagcatgttcaa

SEQ ID NO: 958043 - DNA, 25 bp, Mus musculus
ttggtttggtctatcagtttcttgt

SEQ ID NO: 958044 - DNA, 25 bp, Mus musculus
ttggtttggtctttcagtttcttgt

SEQ ID NO: 958045 - DNA, 25 bp, Mus musculus
ttggtttgtgtgaggtatggcttca

SEQ ID NO: 958046 - DNA, 25 bp, Mus musculus
ttggtttgtgtgtggtatggcttca

SEQ ID NO: 958047 - DNA, 25 bp, Mus musculus
ttggttttactgaagcttgctcgac

SEQ ID NO: 958048 - DNA, 25 bp, Mus musculus
ttggttttactgtagcttgctcgac

SEQ ID NO: 958049 - DNA, 25 bp, Mus musculus
ttggttttataaattcttggtctgt

SEQ ID NO: 958050 - DNA, 25 bp, Mus musculus
ttggttttataacctgggttttgca

SEQ ID NO: 958051 - DNA, 25 bp, Mus musculus
ttggttttataagctgggttttgca

SEQ ID NO: 958052 - DNA, 25 bp, Mus musculus
ttggttttataatttcttggtctgt

SEQ ID NO: 958053 - DNA, 25 bp, Mus musculus
ttggttttatttcctgctcaggtcc

SEQ ID NO: 958054 - DNA, 25 bp, Mus musculus
ttggttttatttgctgctcaggtcc

SEQ ID NO: 958055 - DNA, 25 bp, Mus musculus
ttggttttcaaccttatctacaagg

SEQ ID NO: 958056 - DNA, 25 bp, Mus musculus
ttggttttcaacgttatctacaagg

SEQ ID NO: 958057 - DNA, 25 bp, Mus musculus
ttggttttcacccactctaaatgga

SEQ ID NO: 958058 - DNA, 25 bp, Mus musculus
ttggttttcaccgactctaaatgga

SEQ ID NO: 958059 - DNA, 25 bp, Mus musculus
ttggttttcatgcttgtagctgcct

SEQ ID NO: 958060 - DNA, 25 bp, Mus musculus
ttggttttcatggttgtagctgcct

SEQ ID NO: 958061 - DNA, 25 bp, Mus musculus
ttggttttccagacaccagggtggg

SEQ ID NO: 958062 - DNA, 25 bp, Mus musculus
ttggttttccagtcaccagggtggg

SEQ ID NO: 958063 - DNA, 25 bp, Mus musculus
ttggttttccccagacaggctacag

SEQ ID NO: 958064 - DNA, 25 bp, Mus musculus
ttggttttcccctgacaggctacag

SEQ ID NO: 958065 - DNA, 25 bp, Mus musculus
ttggttttctctacactcatccatt

SEQ ID NO: 958066 - DNA, 25 bp, Mus musculus
ttggttttctcttcactcatccatt

SEQ ID NO: 958067 - DNA, 25 bp, Mus musculus
ttggttttctggactcacctagagc

SEQ ID NO: 958068 - DNA, 25 bp, Mus musculus
ttggttttctggtctcacctagagc

SEQ ID NO: 958069 - DNA, 25 bp, Mus musculus
ttggttttctgtagctgaggctttc

SEQ ID NO: 958070 - DNA, 25 bp, Mus musculus
ttggttttctgtctgagtatttacg

SEQ ID NO: 958071 - DNA, 25 bp, Mus musculus
ttggttttctgtgtgagtatttacg

SEQ ID NO: 958072 - DNA, 25 bp, Mus musculus
ttggttttctgttgctgaggctttc

SEQ ID NO: 958073 - DNA, 25 bp, Mus musculus
ttggttttctttccaactctccaca

SEQ ID NO: 958074 - DNA, 25 bp, Mus musculus
ttggttttctttgcaactctccaca

SEQ ID NO: 958075 - DNA, 25 bp, Mus musculus
ttggttttgactatttaggacacat

SEQ ID NO: 958076 - DNA, 25 bp, Mus musculus
ttggttttgactttttaggacacat

SEQ ID NO: 958077 - DNA, 25 bp, Mus musculus
ttggttttgggactctttagaattg

SEQ ID NO: 958078 - DNA, 25 bp, Mus musculus
ttggttttgggagtctttagaattg

SEQ ID NO: 958079 - DNA, 25 bp, Mus musculus
ttggttttgtatctgctccctcatt

SEQ ID NO: 958080 - DNA, 25 bp, Mus musculus
ttggttttgtatgtgctccctcatt

SEQ ID NO: 958081 - DNA, 25 bp, Mus musculus
ttggttttgtgtaacaggagtttct

SEQ ID NO: 958082 - DNA, 25 bp, Mus musculus
ttggttttgtgttacaggagtttct

SEQ ID NO: 958083 - DNA, 25 bp, Mus musculus
ttggtttttattctctgctcttgga

SEQ ID NO: 958084 - DNA, 25 bp, Mus musculus
ttggtttttattgtctgctcttgga

SEQ ID NO: 958085 - DNA, 25 bp, Mus musculus
ttggtttttcccaagtgtgtcccat

SEQ ID NO: 958086 - DNA, 25 bp, Mus musculus
ttggtttttccctagtgtgtcccat

SEQ ID NO: 958087 - DNA, 25 bp, Mus musculus
ttggtttttcctcgaggatgcgtct

SEQ ID NO: 958088 - DNA, 25 bp, Mus musculus
ttggtttttcctggaggatgcgtct

SEQ ID NO: 958089 - DNA, 25 bp, Mus musculus
ttggtttttctcagtttgcgttaat

SEQ ID NO: 958090 - DNA, 25 bp, Mus musculus
ttggtttttctctgtttgcgttaat

SEQ ID NO: 958091 - DNA, 25 bp, Mus musculus
ttggtttttgtgagagcctactctg

SEQ ID NO: 958092 - DNA, 25 bp, Mus musculus
ttggtttttgtgtgagcctactctg

SEQ ID NO: 958093 - DNA, 25 bp, Mus musculus
ttgtaaaaagccaagccgggcgtgg

SEQ ID NO: 958094 - DNA, 25 bp, Mus musculus
ttgtaaaaagcctagccgggcgtgg

SEQ ID NO: 958095 - DNA, 25 bp, Mus musculus
ttgtaaaaccacctacaccgtctca

SEQ ID NO: 958096 - DNA, 25 bp, Mus musculus
ttgtaaaaccacgtacaccgtctca

SEQ ID NO: 958097 - DNA, 25 bp, Mus musculus
ttgtaaaagaataaggctgagcgca

SEQ ID NO: 958098 - DNA, 25 bp, Mus musculus
ttgtaaaagaattaggctgagcgca

SEQ ID NO: 958099 - DNA, 25 bp, Mus musculus
ttgtaaaattccaatcctgctccag

SEQ ID NO: 958100 - DNA, 25 bp, Mus musculus
ttgtaaaattcctatcctgctccag

SEQ ID NO: 958101 - DNA, 25 bp, Mus musculus
ttgtaaacactaagtggtgctggtg

SEQ ID NO: 958102 - DNA, 25 bp, Mus musculus
ttgtaaacactatgtggtgctggtg

SEQ ID NO: 958103 - DNA, 25 bp, Mus musculus
ttgtaaacattgcaatcggaataaa

SEQ ID NO: 958104 - DNA, 25 bp, Mus musculus
ttgtaaacattggaatcggaataaa

SEQ ID NO: 958105 - DNA, 25 bp, Mus musculus
ttgtaaaccacccttgcgaagttct

SEQ ID NO: 958106 - DNA, 25 bp, Mus musculus
ttgtaaaccaccgttgcgaagttct

SEQ ID NO: 958107 - DNA, 25 bp, Mus musculus
ttgtaaacctgtcttctggcgtaag

SEQ ID NO: 958108 - DNA, 25 bp, Mus musculus
ttgtaaacctgtgttctggcgtaag

SEQ ID NO: 958109 - DNA, 25 bp, Mus musculus
ttgtaaacgcccagagacagcagtg

SEQ ID NO: 958110 - DNA, 25 bp, Mus musculus
ttgtaaacgccctgagacagcagtg

SEQ ID NO: 958111 - DNA, 25 bp, Mus musculus
ttgtaaactgatacggccatcaata

SEQ ID NO: 958112 - DNA, 25 bp, Mus musculus
ttgtaaactgattcggccatcaata

SEQ ID NO: 958113 - DNA, 25 bp, Mus musculus
ttgtaaacttgtaggcttggtagcc

SEQ ID NO: 958114 - DNA, 25 bp, Mus musculus
ttgtaaacttgttggcttggtagcc

SEQ ID NO: 958115 - DNA, 25 bp, Mus musculus
ttgtaaagagctagtccctggcgga

SEQ ID NO: 958116 - DNA, 25 bp, Mus musculus
ttgtaaagagcttgtccctggcgga

SEQ ID NO: 958117 - DNA, 25 bp, Mus musculus
ttgtaaagatctcactggctccacc

SEQ ID NO: 958118 - DNA, 25 bp, Mus musculus
ttgtaaagatctgactggctccacc

SEQ ID NO: 958119 - DNA, 25 bp, Mus musculus
ttgtaaagccggcagagatcccaga

SEQ ID NO: 958120 - DNA, 25 bp, Mus musculus
ttgtaaagccgggagagatcccaga

SEQ ID NO: 958121 - DNA, 25 bp, Mus musculus
ttgtaaagctgccactgttacctca

SEQ ID NO: 958122 - DNA, 25 bp, Mus musculus
ttgtaaagctgcgactgttacctca

SEQ ID NO: 958123 - DNA, 25 bp, Mus musculus
ttgtaaagcttacccacattattaa

SEQ ID NO: 958124 - DNA, 25 bp, Mus musculus
ttgtaaagcttagccacattattaa

SEQ ID NO: 958125 - DNA, 25 bp, Mus musculus
ttgtaaagggttaccacttgggctg

SEQ ID NO: 958126 - DNA, 25 bp, Mus musculus
ttgtaaagggtttccacttgggctg

SEQ ID NO: 958127 - DNA, 25 bp, Mus musculus
ttgtaaagttggcacaccaggacca

SEQ ID NO: 958128 - DNA, 25 bp, Mus musculus
ttgtaaagttgggacaccaggacca

SEQ ID NO: 958129 - DNA, 25 bp, Mus musculus
ttgtaaatactgcactcaggaactt

SEQ ID NO: 958130 - DNA, 25 bp, Mus musculus
ttgtaaatactggactcaggaactt

SEQ ID NO: 958131 - DNA, 25 bp, Mus musculus
ttgtaaatagaaccagcccagccca

SEQ ID NO: 958132 - DNA, 25 bp, Mus musculus
ttgtaaatagaagcagcccagccca

SEQ ID NO: 958133 - DNA, 25 bp, Mus musculus
ttgtaaatatctctctggctggcat

SEQ ID NO: 958134 - DNA, 25 bp, Mus musculus
ttgtaaatatctgtctggctggcat

SEQ ID NO: 958135 - DNA, 25 bp, Mus musculus
ttgtaaatatgcacactgtgcaaat

SEQ ID NO: 958136 - DNA, 25 bp, Mus musculus
ttgtaaatatgctcactgtgcaaat

SEQ ID NO: 958137 - DNA, 25 bp, Mus musculus
ttgtaaatccttagacgcttgagaa

SEQ ID NO: 958138 - DNA, 25 bp, Mus musculus
ttgtaaatcctttgacgcttgagaa

SEQ ID NO: 958139 - DNA, 25 bp, Mus musculus
ttgtaaatgaaaccatgcggccttc

SEQ ID NO: 958140 - DNA, 25 bp, Mus musculus
ttgtaaatgaaagcatgcggccttc

SEQ ID NO: 958141 - DNA, 25 bp, Mus musculus
ttgtaaatgatgctcactgcctgcc

SEQ ID NO: 958142 - DNA, 25 bp, Mus musculus
ttgtaaatgatggtcactgcctgcc

SEQ ID NO: 958143 - DNA, 25 bp, Mus musculus
ttgtaaatggatccaggtacctggt

SEQ ID NO: 958144 - DNA, 25 bp, Mus musculus
ttgtaaatggatgcaggtacctggt

SEQ ID NO: 958145 - DNA, 25 bp, Mus musculus
ttgtaaattctcatcagctgttgta

SEQ ID NO: 958146 - DNA, 25 bp, Mus musculus
ttgtaaattctcttcagctgttgta

SEQ ID NO: 958147 - DNA, 25 bp, Mus musculus
ttgtaaattgtccttttgataccat

SEQ ID NO: 958148 - DNA, 25 bp, Mus musculus
ttgtaaattgtcgttttgataccat

SEQ ID NO: 958149 - DNA, 25 bp, Mus musculus
ttgtaaatttctaagggacctgcca

SEQ ID NO: 958150 - DNA, 25 bp, Mus musculus
ttgtaaatttcttagggacctgcca

SEQ ID NO: 958151 - DNA, 25 bp, Mus musculus
ttgtaacaaacccaccccagagata

SEQ ID NO: 958152 - DNA, 25 bp, Mus musculus
ttgtaacaaaccgaccccagagata

SEQ ID NO: 958153 - DNA, 25 bp, Mus musculus
ttgtaacaaagacctaacccctaat

SEQ ID NO: 958154 - DNA, 25 bp, Mus musculus
ttgtaacaaagagctaacccctaat

SEQ ID NO: 958155 - DNA, 25 bp, Mus musculus
ttgtaacaacaacgcagcatcttct

SEQ ID NO: 958156 - DNA, 25 bp, Mus musculus
ttgtaacaacaaggcagcatcttct

SEQ ID NO: 958157 - DNA, 25 bp, Mus musculus
ttgtaacaacatagccaggcctggt

SEQ ID NO: 958158 - DNA, 25 bp, Mus musculus
ttgtaacaacattgccaggcctggt

SEQ ID NO: 958159 - DNA, 25 bp, Mus musculus
ttgtaacaatctatgggcctgcctt

SEQ ID NO: 958160 - DNA, 25 bp, Mus musculus
ttgtaacaatctttgggcctgcctt

SEQ ID NO: 958161 - DNA, 25 bp, Mus musculus
ttgtaacactggacgggagtgcaat

SEQ ID NO: 958162 - DNA, 25 bp, Mus musculus
ttgtaacactggtcgggagtgcaat

SEQ ID NO: 958163 - DNA, 25 bp, Mus musculus
ttgtaacagagcagtgcccacacac

SEQ ID NO: 958164 - DNA, 25 bp, Mus musculus
ttgtaacagagctgtgcccacacac

SEQ ID NO: 958165 - DNA, 25 bp, Mus musculus
ttgtaacagcctcctacaaatagga

SEQ ID NO: 958166 - DNA, 25 bp, Mus musculus
ttgtaacagcctgctacaaatagga

SEQ ID NO: 958167 - DNA, 25 bp, Mus musculus
ttgtaacagtcgatcgctatcttcc

SEQ ID NO: 958168 - DNA, 25 bp, Mus musculus
ttgtaacagtcgttcgctatcttcc

SEQ ID NO: 958169 - DNA, 25 bp, Mus musculus
ttgtaacagtgacaaccgtcagaga

SEQ ID NO: 958170 - DNA, 25 bp, Mus musculus
ttgtaacagtgagaaccgtcagaga

SEQ ID NO: 958171 - DNA, 25 bp, Mus musculus
ttgtaacatggtcggtctgactcct

SEQ ID NO: 958172 - DNA, 25 bp, Mus musculus
ttgtaacatggtgggtctgactcct

SEQ ID NO: 958173 - DNA, 25 bp, Mus musculus
ttgtaaccaaagactcggagacaga

SEQ ID NO: 958174 - DNA, 25 bp, Mus musculus
ttgtaaccaaagtctcggagacaga

SEQ ID NO: 958175 - DNA, 25 bp, Mus musculus
ttgtaaccagccatgctacttttta

SEQ ID NO: 958176 - DNA, 25 bp, Mus musculus
ttgtaaccagccttgctacttttta

SEQ ID NO: 958177 - DNA, 25 bp, Mus musculus
ttgtaaccatctcacaggcaggaca

SEQ ID NO: 958178 - DNA, 25 bp, Mus musculus
ttgtaaccatctgacaggcaggaca

SEQ ID NO: 958179 - DNA, 25 bp, Mus musculus
ttgtaaccatttagtagttcccagc

SEQ ID NO: 958180 - DNA, 25 bp, Mus musculus
ttgtaaccattttgtagttcccagc

SEQ ID NO: 958181 - DNA, 25 bp, Mus musculus
ttgtaacccagactgagaaagctgt

SEQ ID NO: 958182 - DNA, 25 bp, Mus musculus
ttgtaacccagagtgagaaagctgt

SEQ ID NO: 958183 - DNA, 25 bp, Mus musculus
ttgtaaccctatatgccaggctcat

SEQ ID NO: 958184 - DNA, 25 bp, Mus musculus
ttgtaaccctatttgccaggctcat

SEQ ID NO: 958185 - DNA, 25 bp, Mus musculus
ttgtaacctactataaactctgatt

SEQ ID NO: 958186 - DNA, 25 bp, Mus musculus
ttgtaacctactttaaactctgatt

SEQ ID NO: 958187 - DNA, 25 bp, Mus musculus
ttgtaaccttgcagcgctatggaga

SEQ ID NO: 958188 - DNA, 25 bp, Mus musculus
ttgtaaccttgctgcgctatggaga

SEQ ID NO: 958189 - DNA, 25 bp, Mus musculus
ttgtaacgactgagctgctgcaata

SEQ ID NO: 958190 - DNA, 25 bp, Mus musculus
ttgtaacgactgtgctgctgcaata

SEQ ID NO: 958191 - DNA, 25 bp, Mus musculus
ttgtaacggtttcgtgcttctgctc

SEQ ID NO: 958192 - DNA, 25 bp, Mus musculus
ttgtaacggtttggtgcttctgctc

SEQ ID NO: 958193 - DNA, 25 bp, Mus musculus
ttgtaactaagtacctttacctgct

SEQ ID NO: 958194 - DNA, 25 bp, Mus musculus
ttgtaactaagttcctttacctgct

SEQ ID NO: 958195 - DNA, 25 bp, Mus musculus
ttgtaactagttctaggtgatccag

SEQ ID NO: 958196 - DNA, 25 bp, Mus musculus
ttgtaactagttgtaggtgatccag

SEQ ID NO: 958197 - DNA, 25 bp, Mus musculus
ttgtaactcgtgatctttatatgcc

SEQ ID NO: 958198 - DNA, 25 bp, Mus musculus
ttgtaactcgtgttctttatatgcc

SEQ ID NO: 958199 - DNA, 25 bp, Mus musculus
ttgtaactctgtcctccagtcacct

SEQ ID NO: 958200 - DNA, 25 bp, Mus musculus
ttgtaactctgtgctccagtcacct

SEQ ID NO: 958201 - DNA, 25 bp, Mus musculus
ttgtaactgtttaattgccttggca

SEQ ID NO: 958202 - DNA, 25 bp, Mus musculus
ttgtaactgttttattgccttggca

SEQ ID NO: 958203 - DNA, 25 bp, Mus musculus
ttgtaacttcaaagggctgctcttc

SEQ ID NO: 958204 - DNA, 25 bp, Mus musculus
ttgtaacttcaatgggctgctcttc

SEQ ID NO: 958205 - DNA, 25 bp, Mus musculus
ttgtaacttcttctaaccctgggtg

SEQ ID NO: 958206 - DNA, 25 bp, Mus musculus
ttgtaacttcttgtaaccctgggtg

SEQ ID NO: 958207 - DNA, 25 bp, Mus musculus
ttgtaactttccactactctacctg

SEQ ID NO: 958208 - DNA, 25 bp, Mus musculus
ttgtaactttcctctactctacctg

SEQ ID NO: 958209 - DNA, 25 bp, Mus musculus
ttgtaagaaccacagggccaggaca

SEQ ID NO: 958210 - DNA, 25 bp, Mus musculus
ttgtaagaaccagagggccaggaca

SEQ ID NO: 958211 - DNA, 25 bp, Mus musculus
ttgtaagaagcacgtagtacacact

SEQ ID NO: 958212 - DNA, 25 bp, Mus musculus
ttgtaagaagcaggtagtacacact

SEQ ID NO: 958213 - DNA, 25 bp, Mus musculus
ttgtaagactctcttctgggtgtgg

SEQ ID NO: 958214 - DNA, 25 bp, Mus musculus
ttgtaagactctgttctgggtgtgg

SEQ ID NO: 958215 - DNA, 25 bp, Mus musculus
ttgtaagagcttcaacccaagtcct

SEQ ID NO: 958216 - DNA, 25 bp, Mus musculus
ttgtaagagcttgaacccaagtcct

SEQ ID NO: 958217 - DNA, 25 bp, Mus musculus
ttgtaagatacaatcaagatccaaa

SEQ ID NO: 958218 - DNA, 25 bp, Mus musculus
ttgtaagatacattcaagatccaaa

SEQ ID NO: 958219 - DNA, 25 bp, Mus musculus
ttgtaagattgcatgttcaaaccaa

SEQ ID NO: 958220 - DNA, 25 bp, Mus musculus
ttgtaagattgcttgttcaaaccaa

SEQ ID NO: 958221 - DNA, 25 bp, Mus musculus
ttgtaagcacagaatttgctctatt

SEQ ID NO: 958222 - DNA, 25 bp, Mus musculus
ttgtaagcacagtatttgctctatt

SEQ ID NO: 958223 - DNA, 25 bp, Mus musculus
ttgtaagcacttagtgtgcccaccg

SEQ ID NO: 958224 - DNA, 25 bp, Mus musculus
ttgtaagcactttgtgtgcccaccg

SEQ ID NO: 958225 - DNA, 25 bp, Mus musculus
ttgtaagcagcgatctagtttcatt

SEQ ID NO: 958226 - DNA, 25 bp, Mus musculus
ttgtaagcagcgttctagtttcatt

SEQ ID NO: 958227 - DNA, 25 bp, Mus musculus
ttgtaagccactatgatggtgctgg

SEQ ID NO: 958228 - DNA, 25 bp, Mus musculus
ttgtaagccactttgatggtgctgg

SEQ ID NO: 958229 - DNA, 25 bp, Mus musculus
ttgtaagccagtcggcctggtcttt

SEQ ID NO: 958230 - DNA, 25 bp, Mus musculus
ttgtaagccagtgggcctggtcttt

SEQ ID NO: 958231 - DNA, 25 bp, Mus musculus
ttgtaagccctgaacatgtttatat

SEQ ID NO: 958232 - DNA, 25 bp, Mus musculus
ttgtaagccctgtacatgtttatat

SEQ ID NO: 958233 - DNA, 25 bp, Mus musculus
ttgtaagctcccagccatgctcagc

SEQ ID NO: 958234 - DNA, 25 bp, Mus musculus
ttgtaagctccctgccatgctcagc

SEQ ID NO: 958235 - DNA, 25 bp, Mus musculus
ttgtaaggtgatactatactcaata

SEQ ID NO: 958236 - DNA, 25 bp, Mus musculus
ttgtaaggtgattctatactcaata

SEQ ID NO: 958237 - DNA, 25 bp, Mus musculus
ttgtaagtaaaccacttcatccccg

SEQ ID NO: 958238 - DNA, 25 bp, Mus musculus
ttgtaagtaaacgacttcatccccg

SEQ ID NO: 958239 - DNA, 25 bp, Mus musculus
ttgtaagtactcctgtttctaatct

SEQ ID NO: 958240 - DNA, 25 bp, Mus musculus
ttgtaagtactcgtgtttctaatct

SEQ ID NO: 958241 - DNA, 25 bp, Mus musculus
ttgtaagtccccacctgtcttttgt

SEQ ID NO: 958242 - DNA, 25 bp, Mus musculus
ttgtaagtcccctcctgtcttttgt

SEQ ID NO: 958243 - DNA, 25 bp, Mus musculus
ttgtaagtctgactcactcactcac

SEQ ID NO: 958244 - DNA, 25 bp, Mus musculus
ttgtaagtctgagtcactcactcac

SEQ ID NO: 958245 - DNA, 25 bp, Mus musculus
ttgtaagtgcatctttatagccatg

SEQ ID NO: 958246 - DNA, 25 bp, Mus musculus
ttgtaagtgcatgtttatagccatg

SEQ ID NO: 958247 - DNA, 25 bp, Mus musculus
ttgtaagtggagactcatcctctct

SEQ ID NO: 958248 - DNA, 25 bp, Mus musculus
ttgtaagtggagtctcatcctctct

SEQ ID NO: 958249 - DNA, 25 bp, Mus musculus
ttgtaataactaacagtgcaagtga

SEQ ID NO: 958250 - DNA, 25 bp, Mus musculus
ttgtaataactaagccagatcctgt

SEQ ID NO: 958251 - DNA, 25 bp, Mus musculus
ttgtaataactatcagtgcaagtga

SEQ ID NO: 958252 - DNA, 25 bp, Mus musculus
ttgtaataactatgccagatcctgt

SEQ ID NO: 958253 - DNA, 25 bp, Mus musculus
ttgtaataacttcttccaaatgtta

SEQ ID NO: 958254 - DNA, 25 bp, Mus musculus
ttgtaataacttgttccaaatgtta

SEQ ID NO: 958255 - DNA, 25 bp, Mus musculus
ttgtaatatatcagtttccctttcc

SEQ ID NO: 958256 - DNA, 25 bp, Mus musculus
ttgtaatatatctgtttccctttcc

SEQ ID NO: 958257 - DNA, 25 bp, Mus musculus
ttgtaatattccacgacccttcatt

SEQ ID NO: 958258 - DNA, 25 bp, Mus musculus
ttgtaatattcctcgacccttcatt

SEQ ID NO: 958259 - DNA, 25 bp, Mus musculus
ttgtaatatttaaccaccaagttgg

SEQ ID NO: 958260 - DNA, 25 bp, Mus musculus
ttgtaatatttatccaccaagttgg

SEQ ID NO: 958261 - DNA, 25 bp, Mus musculus
ttgtaatccaccagatgtgattttt

SEQ ID NO: 958262 - DNA, 25 bp, Mus musculus
ttgtaatccacctgatgtgattttt

SEQ ID NO: 958263 - DNA, 25 bp, Mus musculus
ttgtaatcccacattcagctcaaca

SEQ ID NO: 958264 - DNA, 25 bp, Mus musculus
ttgtaatcccactttcagctcaaca

SEQ ID NO: 958265 - DNA, 25 bp, Mus musculus
ttgtaatctactactcaactcttag

SEQ ID NO: 958266 - DNA, 25 bp, Mus musculus
ttgtaatctacttctcaactcttag

SEQ ID NO: 958267 - DNA, 25 bp, Mus musculus
ttgtaatctcttctcaacctcacat

SEQ ID NO: 958268 - DNA, 25 bp, Mus musculus
ttgtaatctcttgtcaacctcacat

SEQ ID NO: 958269 - DNA, 25 bp, Mus musculus
ttgtaatcttagatcttgggaggtt

SEQ ID NO: 958270 - DNA, 25 bp, Mus musculus
ttgtaatcttagttcttgggaggtt

SEQ ID NO: 958271 - DNA, 25 bp, Mus musculus
ttgtaatcttctcgcctggagaccc

SEQ ID NO: 958272 - DNA, 25 bp, Mus musculus
ttgtaatcttctggcctggagaccc

SEQ ID NO: 958273 - DNA, 25 bp, Mus musculus
ttgtaatgaagcattgtgcacacag

SEQ ID NO: 958274 - DNA, 25 bp, Mus musculus
ttgtaatgaagctttgtgcacacag

SEQ ID NO: 958275 - DNA, 25 bp, Mus musculus
ttgtaatgacaaagctgccttctgg

SEQ ID NO: 958276 - DNA, 25 bp, Mus musculus
ttgtaatgacaatgctgccttctgg

SEQ ID NO: 958277 - DNA, 25 bp, Mus musculus
ttgtaatgacccaatctcccaaatc

SEQ ID NO: 958278 - DNA, 25 bp, Mus musculus
ttgtaatgaccctatctcccaaatc

SEQ ID NO: 958279 - DNA, 25 bp, Mus musculus
ttgtaatgacttaataatcctgcag

SEQ ID NO: 958280 - DNA, 25 bp, Mus musculus
ttgtaatgactttataatcctgcag

SEQ ID NO: 958281 - DNA, 25 bp, Mus musculus
ttgtaatgctaaatctggtacctga

SEQ ID NO: 958282 - DNA, 25 bp, Mus musculus
ttgtaatgctaattctggtacctga

SEQ ID NO: 958283 - DNA, 25 bp, Mus musculus
ttgtaatggatgactctacctcctc

SEQ ID NO: 958284 - DNA, 25 bp, Mus musculus
ttgtaatggatgtctctacctcctc

SEQ ID NO: 958285 - DNA, 25 bp, Mus musculus
ttgtaatggcttctgcttccaagat

SEQ ID NO: 958286 - DNA, 25 bp, Mus musculus
ttgtaatggcttgtgcttccaagat

SEQ ID NO: 958287 - DNA, 25 bp, Mus musculus
ttgtaatgggagagcctgtctcaca

SEQ ID NO: 958288 - DNA, 25 bp, Mus musculus
ttgtaatgggagtgcctgtctcaca

SEQ ID NO: 958289 - DNA, 25 bp, Mus musculus
ttgtaattcccaagagccatagtga

SEQ ID NO: 958290 - DNA, 25 bp, Mus musculus
ttgtaattcccatgagccatagtga

SEQ ID NO: 958291 - DNA, 25 bp, Mus musculus
ttgtaattcttaactagtaacttga

SEQ ID NO: 958292 - DNA, 25 bp, Mus musculus
ttgtaattcttatctagtaacttga

SEQ ID NO: 958293 - DNA, 25 bp, Mus musculus
ttgtaattcttcactccctgggact

SEQ ID NO: 958294 - DNA, 25 bp, Mus musculus
ttgtaattcttctctccctgggact

SEQ ID NO: 958295 - DNA, 25 bp, Mus musculus
ttgtaattgtttccttgcttctcca

SEQ ID NO: 958296 - DNA, 25 bp, Mus musculus
ttgtaattgtttgcttgcttctcca

SEQ ID NO: 958297 - DNA, 25 bp, Mus musculus
ttgtaatttacaaagcctccaaaag

SEQ ID NO: 958298 - DNA, 25 bp, Mus musculus
ttgtaatttacatagcctccaaaag

SEQ ID NO: 958299 - DNA, 25 bp, Mus musculus
ttgtaatttgtccttctgtgcgcaa

SEQ ID NO: 958300 - DNA, 25 bp, Mus musculus
ttgtaatttgtcgttctgtgcgcaa

SEQ ID NO: 958301 - DNA, 25 bp, Mus musculus
ttgtacaaaatcaggtccgtctcct

SEQ ID NO: 958302 - DNA, 25 bp, Mus musculus
ttgtacaaaatctggtccgtctcct

SEQ ID NO: 958303 - DNA, 25 bp, Mus musculus
ttgtacaaactgagtttccctcctc

SEQ ID NO: 958304 - DNA, 25 bp, Mus musculus
ttgtacaaactgtgtttccctcctc

SEQ ID NO: 958305 - DNA, 25 bp, Mus musculus
ttgtacaaagaacgccagaactggc

SEQ ID NO: 958306 - DNA, 25 bp, Mus musculus
ttgtacaaagaaggccagaactggc

SEQ ID NO: 958307 - DNA, 25 bp, Mus musculus
ttgtacaaattaaccacggcaagat

SEQ ID NO: 958308 - DNA, 25 bp, Mus musculus
ttgtacaaattatccacggcaagat

SEQ ID NO: 958309 - DNA, 25 bp, Mus musculus
ttgtacaacttcatgctgggtccag

SEQ ID NO: 958310 - DNA, 25 bp, Mus musculus
ttgtacaacttcttgctgggtccag

SEQ ID NO: 958311 - DNA, 25 bp, Mus musculus
ttgtacaagaccaaattcagccttc

SEQ ID NO: 958312 - DNA, 25 bp, Mus musculus
ttgtacaagacctaattcagccttc

SEQ ID NO: 958313 - DNA, 25 bp, Mus musculus
ttgtacaagcagatggtcacccacc

SEQ ID NO: 958314 - DNA, 25 bp, Mus musculus
ttgtacaagcagttggtcacccacc

SEQ ID NO: 958315 - DNA, 25 bp, Mus musculus
ttgtacaagcccactgctggttttt

SEQ ID NO: 958316 - DNA, 25 bp, Mus musculus
ttgtacaagccctctgctggttttt

SEQ ID NO: 958317 - DNA, 25 bp, Mus musculus
ttgtacaagcttccgtctaggatct

SEQ ID NO: 958318 - DNA, 25 bp, Mus musculus
ttgtacaagcttgcgtctaggatct

SEQ ID NO: 958319 - DNA, 25 bp, Mus musculus
ttgtacaagtgtctgcattttaagc

SEQ ID NO: 958320 - DNA, 25 bp, Mus musculus
ttgtacaagtgtgtgcattttaagc

SEQ ID NO: 958321 - DNA, 25 bp, Mus musculus
ttgtacacatccaacctatgctgat

SEQ ID NO: 958322 - DNA, 25 bp, Mus musculus
ttgtacacatcctacctatgctgat

SEQ ID NO: 958323 - DNA, 25 bp, Mus musculus
ttgtacaccgcccactattaggcta

SEQ ID NO: 958324 - DNA, 25 bp, Mus musculus
ttgtacaccgccgactattaggcta

SEQ ID NO: 958325 - DNA, 25 bp, Mus musculus
ttgtacactccccatgctgttcgtg

SEQ ID NO: 958326 - DNA, 25 bp, Mus musculus
ttgtacactcccgatgctgttcgtg

SEQ ID NO: 958327 - DNA, 25 bp, Mus musculus
ttgtacagacagctttcctttttgt

SEQ ID NO: 958328 - DNA, 25 bp, Mus musculus
ttgtacagacaggtttcctttttgt

SEQ ID NO: 958329 - DNA, 25 bp, Mus musculus
ttgtacagatgtcggcacagacctc

SEQ ID NO: 958330 - DNA, 25 bp, Mus musculus
ttgtacagatgtgggcacagacctc

SEQ ID NO: 958331 - DNA, 25 bp, Mus musculus
ttgtacagcgtccttcttccaaatg

SEQ ID NO: 958332 - DNA, 25 bp, Mus musculus
ttgtacagcgtcgttcttccaaatg

SEQ ID NO: 958333 - DNA, 25 bp, Mus musculus
ttgtacaggattctggcttctccat

SEQ ID NO: 958334 - DNA, 25 bp, Mus musculus
ttgtacaggattgtggcttctccat

SEQ ID NO: 958335 - DNA, 25 bp, Mus musculus
ttgtacaggtatcacaaggctgcag

SEQ ID NO: 958336 - DNA, 25 bp, Mus musculus
ttgtacaggtatgacaaggctgcag

SEQ ID NO: 958337 - DNA, 25 bp, Mus musculus
ttgtacagtccacccttcgatacat

SEQ ID NO: 958338 - DNA, 25 bp, Mus musculus
ttgtacagtccagccttcgatacat

SEQ ID NO: 958339 - DNA, 25 bp, Mus musculus
ttgtacatacaacaagtgatggctt

SEQ ID NO: 958340 - DNA, 25 bp, Mus musculus
ttgtacatacaagaagtgatggctt

SEQ ID NO: 958341 - DNA, 25 bp, Mus musculus
ttgtacatacttctcattactcagt

SEQ ID NO: 958342 - DNA, 25 bp, Mus musculus
ttgtacatacttgtcattactcagt

SEQ ID NO: 958343 - DNA, 25 bp, Mus musculus
ttgtacatccagaggttccttggca

SEQ ID NO: 958344 - DNA, 25 bp, Mus musculus
ttgtacatccagtggttccttggca

SEQ ID NO: 958345 - DNA, 25 bp, Mus musculus
ttgtacatgaaaccccagatagact

SEQ ID NO: 958346 - DNA, 25 bp, Mus musculus
ttgtacatgaaagcccagatagact

SEQ ID NO: 958347 - DNA, 25 bp, Mus musculus
ttgtacatgactagctctcccagtg

SEQ ID NO: 958348 - DNA, 25 bp, Mus musculus
ttgtacatgacttgctctcccagtg

SEQ ID NO: 958349 - DNA, 25 bp, Mus musculus
ttgtacatgctacggccagaactgc

SEQ ID NO: 958350 - DNA, 25 bp, Mus musculus
ttgtacatgctagggccagaactgc

SEQ ID NO: 958351 - DNA, 25 bp, Mus musculus
ttgtacatgtggacttcatgctttg

SEQ ID NO: 958352 - DNA, 25 bp, Mus musculus
ttgtacatgtggtcttcatgctttg

SEQ ID NO: 958353 - DNA, 25 bp, Mus musculus
ttgtacatttcaacactcagtgcat

SEQ ID NO: 958354 - DNA, 25 bp, Mus musculus
ttgtacatttcatcactcagtgcat

SEQ ID NO: 958355 - DNA, 25 bp, Mus musculus
ttgtaccaaagccaaccacacctgt

SEQ ID NO: 958356 - DNA, 25 bp, Mus musculus
ttgtaccaaagcgaaccacacctgt

SEQ ID NO: 958357 - DNA, 25 bp, Mus musculus
ttgtaccaagccagttacagcctga

SEQ ID NO: 958358 - DNA, 25 bp, Mus musculus
ttgtaccaagcctgttacagcctga

SEQ ID NO: 958359 - DNA, 25 bp, Mus musculus
ttgtaccacagtctgcatatctttg

SEQ ID NO: 958360 - DNA, 25 bp, Mus musculus
ttgtaccacagtgtgcatatctttg

SEQ ID NO: 958361 - DNA, 25 bp, Mus musculus
ttgtaccacatacgcaggcaagact

SEQ ID NO: 958362 - DNA, 25 bp, Mus musculus
ttgtaccacataggcaggcaagact

SEQ ID NO: 958363 - DNA, 25 bp, Mus musculus
ttgtaccacgtgatgctaggactcc

SEQ ID NO: 958364 - DNA, 25 bp, Mus musculus
ttgtaccacgtgttgctaggactcc

SEQ ID NO: 958365 - DNA, 25 bp, Mus musculus
ttgtaccactgacttctacacagga

SEQ ID NO: 958366 - DNA, 25 bp, Mus musculus
ttgtaccactgagttctacacagga

SEQ ID NO: 958367 - DNA, 25 bp, Mus musculus
ttgtaccagaagatccagcaattcc

SEQ ID NO: 958368 - DNA, 25 bp, Mus musculus
ttgtaccagaagttccagcaattcc

SEQ ID NO: 958369 - DNA, 25 bp, Mus musculus
ttgtaccagcgtccgcccagaaaca

SEQ ID NO: 958370 - DNA, 25 bp, Mus musculus
ttgtaccagcgtgcgcccagaaaca

SEQ ID NO: 958371 - DNA, 25 bp, Mus musculus
ttgtaccatccacaggacggctgaa

SEQ ID NO: 958372 - DNA, 25 bp, Mus musculus
ttgtaccatccagaggacggctgaa

SEQ ID NO: 958373 - DNA, 25 bp, Mus musculus
ttgtaccatgaacaagagcacagaa

SEQ ID NO: 958374 - DNA, 25 bp, Mus musculus
ttgtaccatgaagaagagcacagaa

SEQ ID NO: 958375 - DNA, 25 bp, Mus musculus
ttgtaccatttcagtccccaaataa

SEQ ID NO: 958376 - DNA, 25 bp, Mus musculus
ttgtaccatttctgtccccaaataa

SEQ ID NO: 958377 - DNA, 25 bp, Mus musculus
ttgtacccaggcactatggtttcaa

SEQ ID NO: 958378 - DNA, 25 bp, Mus musculus
ttgtacccaggctctatggtttcaa

SEQ ID NO: 958379 - DNA, 25 bp, Mus musculus
ttgtacccatctaccttttgtgaat

SEQ ID NO: 958380 - DNA, 25 bp, Mus musculus
ttgtacccatcttccttttgtgaat

SEQ ID NO: 958381 - DNA, 25 bp, Mus musculus
ttgtaccctcttcgttttcatccaa

SEQ ID NO: 958382 - DNA, 25 bp, Mus musculus
ttgtaccctcttggttttcatccaa

SEQ ID NO: 958383 - DNA, 25 bp, Mus musculus
ttgtaccctgtgaccaataaactca

SEQ ID NO: 958384 - DNA, 25 bp, Mus musculus
ttgtaccctgtgtccaataaactca

SEQ ID NO: 958385 - DNA, 25 bp, Mus musculus
ttgtacccttctccctgattaatag

SEQ ID NO: 958386 - DNA, 25 bp, Mus musculus
ttgtacccttctgcctgattaatag

SEQ ID NO: 958387 - DNA, 25 bp, Mus musculus
ttgtaccggctccagttccatgaaa

SEQ ID NO: 958388 - DNA, 25 bp, Mus musculus
ttgtaccggctcgagttccatgaaa

SEQ ID NO: 958389 - DNA, 25 bp, Mus musculus
ttgtaccgtgtgaactgttgctgtt

SEQ ID NO: 958390 - DNA, 25 bp, Mus musculus
ttgtaccgtgtgtactgttgctgtt

SEQ ID NO: 958391 - DNA, 25 bp, Mus musculus
ttgtacctaaaccatttgctatcgt

SEQ ID NO: 958392 - DNA, 25 bp, Mus musculus
ttgtacctaaacgatttgctatcgt

SEQ ID NO: 958393 - DNA, 25 bp, Mus musculus
ttgtacctacagagaaaattcttta

SEQ ID NO: 958394 - DNA, 25 bp, Mus musculus
ttgtacctacagtgaaaattcttta

SEQ ID NO: 958395 - DNA, 25 bp, Mus musculus
ttgtacctacctccagagcacaggc

SEQ ID NO: 958396 - DNA, 25 bp, Mus musculus
ttgtacctacctgcagagcacaggc

SEQ ID NO: 958397 - DNA, 25 bp, Mus musculus
ttgtacctagtaccaccactatcag

SEQ ID NO: 958398 - DNA, 25 bp, Mus musculus
ttgtacctagtagcaccactatcag

SEQ ID NO: 958399 - DNA, 25 bp, Mus musculus
ttgtacctatttacgccctcagctt

SEQ ID NO: 958400 - DNA, 25 bp, Mus musculus
ttgtacctattttcgccctcagctt

SEQ ID NO: 958401 - DNA, 25 bp, Mus musculus
ttgtacctgaacagcaccactgaac

SEQ ID NO: 958402 - DNA, 25 bp, Mus musculus
ttgtacctgaactgcaccactgaac

SEQ ID NO: 958403 - DNA, 25 bp, Mus musculus
ttgtacctgcagataaagctacttg

SEQ ID NO: 958404 - DNA, 25 bp, Mus musculus
ttgtacctgcagttaaagctacttg

SEQ ID NO: 958405 - DNA, 25 bp, Mus musculus
ttgtacctgctgagcactactgcaa

SEQ ID NO: 958406 - DNA, 25 bp, Mus musculus
ttgtacctgctgtgcactactgcaa

SEQ ID NO: 958407 - DNA, 25 bp, Mus musculus
ttgtacctgggacgtcaggccgagc

SEQ ID NO: 958408 - DNA, 25 bp, Mus musculus
ttgtacctgggaggtcaggccgagc

SEQ ID NO: 958409 - DNA, 25 bp, Mus musculus
ttgtacctgtttctggcttagcttt

SEQ ID NO: 958410 - DNA, 25 bp, Mus musculus
ttgtacctgtttgtggcttagcttt

SEQ ID NO: 958411 - DNA, 25 bp, Mus musculus
ttgtacgattacagtctccacgtcg

SEQ ID NO: 958412 - DNA, 25 bp, Mus musculus
ttgtacgattactgtctccacgtcg

SEQ ID NO: 958413 - DNA, 25 bp, Mus musculus
ttgtacgcacttaaactcttctctc

SEQ ID NO: 958414 - DNA, 25 bp, Mus musculus
ttgtacgcactttaactcttctctc

SEQ ID NO: 958415 - DNA, 25 bp, Mus musculus
ttgtacggctaaccttagaagcagt

SEQ ID NO: 958416 - DNA, 25 bp, Mus musculus
ttgtacggctaagcttagaagcagt

SEQ ID NO: 958417 - DNA, 25 bp, Mus musculus
ttgtacgttgggatgagctgccgcc

SEQ ID NO: 958418 - DNA, 25 bp, Mus musculus
ttgtacgttgggttgagctgccgcc

SEQ ID NO: 958419 - DNA, 25 bp, Mus musculus
ttgtactaaaagctccctctgctgt

SEQ ID NO: 958420 - DNA, 25 bp, Mus musculus
ttgtactaaaaggtccctctgctgt

SEQ ID NO: 958421 - DNA, 25 bp, Mus musculus
ttgtactacagtaagcgtaagattt

SEQ ID NO: 958422 - DNA, 25 bp, Mus musculus
ttgtactacagttagcgtaagattt

SEQ ID NO: 958423 - DNA, 25 bp, Mus musculus
ttgtactaccgtcccttgacctaaa

SEQ ID NO: 958424 - DNA, 25 bp, Mus musculus
ttgtactaccgtgccttgacctaaa

SEQ ID NO: 958425 - DNA, 25 bp, Mus musculus
ttgtactagagacggttcctgtttt

SEQ ID NO: 958426 - DNA, 25 bp, Mus musculus
ttgtactagagagggttcctgtttt

SEQ ID NO: 958427 - DNA, 25 bp, Mus musculus
ttgtactagggaatgttataagaac

SEQ ID NO: 958428 - DNA, 25 bp, Mus musculus
ttgtactagggattgttataagaac

SEQ ID NO: 958429 - DNA, 25 bp, Mus musculus
ttgtactatcacatactgctctgcc

SEQ ID NO: 958430 - DNA, 25 bp, Mus musculus
ttgtactatcacttactgctctgcc

SEQ ID NO: 958431 - DNA, 25 bp, Mus musculus
ttgtactatgtcagttccaccattg

SEQ ID NO: 958432 - DNA, 25 bp, Mus musculus
ttgtactatgtctgttccaccattg

SEQ ID NO: 958433 - DNA, 25 bp, Mus musculus
ttgtactatttccttaactgatttc

SEQ ID NO: 958434 - DNA, 25 bp, Mus musculus
ttgtactatttcgttaactgatttc

SEQ ID NO: 958435 - DNA, 25 bp, Mus musculus
ttgtactcagaaagggtttcccaga

SEQ ID NO: 958436 - DNA, 25 bp, Mus musculus
ttgtactcagaatgggtttcccaga

SEQ ID NO: 958437 - DNA, 25 bp, Mus musculus
ttgtactcagtgactatgggccgga

SEQ ID NO: 958438 - DNA, 25 bp, Mus musculus
ttgtactcagtgtctatgggccgga

SEQ ID NO: 958439 - DNA, 25 bp, Mus musculus
ttgtactcccaaaaacctgaagatt

SEQ ID NO: 958440 - DNA, 25 bp, Mus musculus
ttgtactcccaataacctgaagatt

SEQ ID NO: 958441 - DNA, 25 bp, Mus musculus
ttgtactcctgtcccctaagtagag

SEQ ID NO: 958442 - DNA, 25 bp, Mus musculus
ttgtactcctgtgccctaagtagag

SEQ ID NO: 958443 - DNA, 25 bp, Mus musculus
ttgtactcgtcgctcagcttgtcca

SEQ ID NO: 958444 - DNA, 25 bp, Mus musculus
ttgtactcgtcggtcagcttgtcca

SEQ ID NO: 958445 - DNA, 25 bp, Mus musculus
ttgtactctgacacggttttccctc

SEQ ID NO: 958446 - DNA, 25 bp, Mus musculus
ttgtactctgactcggttttccctc

SEQ ID NO: 958447 - DNA, 25 bp, Mus musculus
ttgtactgagagctggttgtcaccc

SEQ ID NO: 958448 - DNA, 25 bp, Mus musculus
ttgtactgagaggtggttgtcaccc

SEQ ID NO: 958449 - DNA, 25 bp, Mus musculus
ttgtactgcagacgcgatgaatact

SEQ ID NO: 958450 - DNA, 25 bp, Mus musculus
ttgtactgcagaggcgatgaatact

SEQ ID NO: 958451 - DNA, 25 bp, Mus musculus
ttgtactgccacattgaatctttgt

SEQ ID NO: 958452 - DNA, 25 bp, Mus musculus
ttgtactgccactttgaatctttgt

SEQ ID NO: 958453 - DNA, 25 bp, Mus musculus
ttgtactgccatacctaatgtattt

SEQ ID NO: 958454 - DNA, 25 bp, Mus musculus
ttgtactgccattcctaatgtattt

SEQ ID NO: 958455 - DNA, 25 bp, Mus musculus
ttgtactgcttacctttactttctc

SEQ ID NO: 958456 - DNA, 25 bp, Mus musculus
ttgtactgcttagctttactttctc

SEQ ID NO: 958457 - DNA, 25 bp, Mus musculus
ttgtactgggcacgcgtcagaccac

SEQ ID NO: 958458 - DNA, 25 bp, Mus musculus
ttgtactgggcaggcgtcagaccac

SEQ ID NO: 958459 - DNA, 25 bp, Mus musculus
ttgtactgggtaactatctttttgt

SEQ ID NO: 958460 - DNA, 25 bp, Mus musculus
ttgtactgggtatctatctttttgt

SEQ ID NO: 958461 - DNA, 25 bp, Mus musculus
ttgtactgtaacaacctcatggttt

SEQ ID NO: 958462 - DNA, 25 bp, Mus musculus
ttgtactgtaactacctcatggttt

SEQ ID NO: 958463 - DNA, 25 bp, Mus musculus
ttgtactgtataatggaggctgacc

SEQ ID NO: 958464 - DNA, 25 bp, Mus musculus
ttgtactgtatattggaggctgacc

SEQ ID NO: 958465 - DNA, 25 bp, Mus musculus
ttgtactgtgttacactcccaaatc

SEQ ID NO: 958466 - DNA, 25 bp, Mus musculus
ttgtactgtgtttcactcccaaatc

SEQ ID NO: 958467 - DNA, 25 bp, Mus musculus
ttgtactgttcacctcccaaagaaa

SEQ ID NO: 958468 - DNA, 25 bp, Mus musculus
ttgtactgttcagctcccaaagaaa

SEQ ID NO: 958469 - DNA, 25 bp, Mus musculus
ttgtactgttctaagctgctacatg

SEQ ID NO: 958470 - DNA, 25 bp, Mus musculus
ttgtactgttctcccttgaaaggct

SEQ ID NO: 958471 - DNA, 25 bp, Mus musculus
ttgtactgttctgccttgaaaggct

SEQ ID NO: 958472 - DNA, 25 bp, Mus musculus
ttgtactgttcttagctgctacatg

SEQ ID NO: 958473 - DNA, 25 bp, Mus musculus
ttgtacttacataggactttcaaag

SEQ ID NO: 958474 - DNA, 25 bp, Mus musculus
ttgtacttacattggactttcaaag

SEQ ID NO: 958475 - DNA, 25 bp, Mus musculus
ttgtacttcaaaaccccaggctatt

SEQ ID NO: 958476 - DNA, 25 bp, Mus musculus
ttgtacttcaaatccccaggctatt

SEQ ID NO: 958477 - DNA, 25 bp, Mus musculus
ttgtacttccatccgggctccgaga

SEQ ID NO: 958478 - DNA, 25 bp, Mus musculus
ttgtacttccatgcgggctccgaga

SEQ ID NO: 958479 - DNA, 25 bp, Mus musculus
ttgtacttcgagcactagggtctgt

SEQ ID NO: 958480 - DNA, 25 bp, Mus musculus
ttgtacttcgaggactagggtctgt

SEQ ID NO: 958481 - DNA, 25 bp, Mus musculus
ttgtacttgatcaggtctctcggac

SEQ ID NO: 958482 - DNA, 25 bp, Mus musculus
ttgtacttgatctggtctctcggac

SEQ ID NO: 958483 - DNA, 25 bp, Mus musculus
ttgtacttgattccccagctgtctt

SEQ ID NO: 958484 - DNA, 25 bp, Mus musculus
ttgtacttgattgcccagctgtctt

SEQ ID NO: 958485 - DNA, 25 bp, Mus musculus
ttgtacttgtgtcgctgtgtaactg

SEQ ID NO: 958486 - DNA, 25 bp, Mus musculus
ttgtacttgtgtggctgtgtaactg

SEQ ID NO: 958487 - DNA, 25 bp, Mus musculus
ttgtactttcaactcctcactctga

SEQ ID NO: 958488 - DNA, 25 bp, Mus musculus
ttgtactttcaagtcctcactctga

SEQ ID NO: 958489 - DNA, 25 bp, Mus musculus
ttgtactttggacacatgcggattc

SEQ ID NO: 958490 - DNA, 25 bp, Mus musculus
ttgtactttggagacatgcggattc

SEQ ID NO: 958491 - DNA, 25 bp, Mus musculus
ttgtacttttgcagactctcatgtg

SEQ ID NO: 958492 - DNA, 25 bp, Mus musculus
ttgtacttttgctgactctcatgtg

SEQ ID NO: 958493 - DNA, 25 bp, Mus musculus
ttgtagaaaacacctggcacgattt

SEQ ID NO: 958494 - DNA, 25 bp, Mus musculus
ttgtagaaaacagctggcacgattt

SEQ ID NO: 958495 - DNA, 25 bp, Mus musculus
ttgtagacagtcctggcaaagccca

SEQ ID NO: 958496 - DNA, 25 bp, Mus musculus
ttgtagacagtcgtggcaaagccca

SEQ ID NO: 958497 - DNA, 25 bp, Mus musculus
ttgtagacattgctcattctgataa

SEQ ID NO: 958498 - DNA, 25 bp, Mus musculus
ttgtagacattggtcattctgataa

SEQ ID NO: 958499 - DNA, 25 bp, Mus musculus
ttgtagaccacccagaagaggcatt

SEQ ID NO: 958500 - DNA, 25 bp, Mus musculus
ttgtagaccaccgagaagaggcatt

SEQ ID NO: 958501 - DNA, 25 bp, Mus musculus
ttgtagacgtgtactctccagtgtg

SEQ ID NO: 958502 - DNA, 25 bp, Mus musculus
ttgtagacgtgttctctccagtgtg

SEQ ID NO: 958503 - DNA, 25 bp, Mus musculus
ttgtagagagtaatcaagcaacact

SEQ ID NO: 958504 - DNA, 25 bp, Mus musculus
ttgtagagagtattcaagcaacact

SEQ ID NO: 958505 - DNA, 25 bp, Mus musculus
ttgtagagatctatgcgctctctct

SEQ ID NO: 958506 - DNA, 25 bp, Mus musculus
ttgtagagatctttgcgctctctct

SEQ ID NO: 958507 - DNA, 25 bp, Mus musculus
ttgtagagatgcaaggccaccccat

SEQ ID NO: 958508 - DNA, 25 bp, Mus musculus
ttgtagagatgctaggccaccccat

SEQ ID NO: 958509 - DNA, 25 bp, Mus musculus
ttgtagagcaagaggctgcaaagga

SEQ ID NO: 958510 - DNA, 25 bp, Mus musculus
ttgtagagcaagtggctgcaaagga

SEQ ID NO: 958511 - DNA, 25 bp, Mus musculus
ttgtagagtgcaatgatcacggcat

SEQ ID NO: 958512 - DNA, 25 bp, Mus musculus
ttgtagagtgcattgatcacggcat

SEQ ID NO: 958513 - DNA, 25 bp, Mus musculus
ttgtagataagcatagccgcccctt

SEQ ID NO: 958514 - DNA, 25 bp, Mus musculus
ttgtagataagcttagccgcccctt

SEQ ID NO: 958515 - DNA, 25 bp, Mus musculus
ttgtagatcgctccctgcaattaaa

SEQ ID NO: 958516 - DNA, 25 bp, Mus musculus
ttgtagatcgctgcctgcaattaaa

SEQ ID NO: 958517 - DNA, 25 bp, Mus musculus
ttgtagatctgaatccactctgccc

SEQ ID NO: 958518 - DNA, 25 bp, Mus musculus
ttgtagatctgaccagtccccttag

SEQ ID NO: 958519 - DNA, 25 bp, Mus musculus
ttgtagatctgagcagtccccttag

SEQ ID NO: 958520 - DNA, 25 bp, Mus musculus
ttgtagatctgattccactctgccc

SEQ ID NO: 958521 - DNA, 25 bp, Mus musculus
ttgtagatgaagcttccccggacat

SEQ ID NO: 958522 - DNA, 25 bp, Mus musculus
ttgtagatgaaggttccccggacat

SEQ ID NO: 958523 - DNA, 25 bp, Mus musculus
ttgtagatgcccagccctttttata

SEQ ID NO: 958524 - DNA, 25 bp, Mus musculus
ttgtagatgccctgccctttttata

SEQ ID NO: 958525 - DNA, 25 bp, Mus musculus
ttgtagcacactcacctgaaggcat

SEQ ID NO: 958526 - DNA, 25 bp, Mus musculus
ttgtagcacactgacctgaaggcat

SEQ ID NO: 958527 - DNA, 25 bp, Mus musculus
ttgtagcacttcaaggttcagataa

SEQ ID NO: 958528 - DNA, 25 bp, Mus musculus
ttgtagcacttctaggttcagataa

SEQ ID NO: 958529 - DNA, 25 bp, Mus musculus
ttgtagcagctaccaactggtggga

SEQ ID NO: 958530 - DNA, 25 bp, Mus musculus
ttgtagcagctagcaactggtggga

SEQ ID NO: 958531 - DNA, 25 bp, Mus musculus
ttgtagcatctgatcatgccagccg

SEQ ID NO: 958532 - DNA, 25 bp, Mus musculus
ttgtagcatctgttcatgccagccg

SEQ ID NO: 958533 - DNA, 25 bp, Mus musculus
ttgtagcatgctcttccgagagaat

SEQ ID NO: 958534 - DNA, 25 bp, Mus musculus
ttgtagcatgctgttccgagagaat

SEQ ID NO: 958535 - DNA, 25 bp, Mus musculus
ttgtagcatgtcagtcctttggagt

SEQ ID NO: 958536 - DNA, 25 bp, Mus musculus
ttgtagcatgtctgtcctttggagt

SEQ ID NO: 958537 - DNA, 25 bp, Mus musculus
ttgtagcattgaatgcttcctgtgc

SEQ ID NO: 958538 - DNA, 25 bp, Mus musculus
ttgtagcattgattgcttcctgtgc

SEQ ID NO: 958539 - DNA, 25 bp, Mus musculus
ttgtagccactaaacacacgcgact

SEQ ID NO: 958540 - DNA, 25 bp, Mus musculus
ttgtagccactatacacacgcgact

SEQ ID NO: 958541 - DNA, 25 bp, Mus musculus
ttgtagccagaaacggatgatcctt

SEQ ID NO: 958542 - DNA, 25 bp, Mus musculus
ttgtagccagaatcggatgatcctt

SEQ ID NO: 958543 - DNA, 25 bp, Mus musculus
ttgtagccagtgaaacccgttttct

SEQ ID NO: 958544 - DNA, 25 bp, Mus musculus
ttgtagccagtgtaacccgttttct

SEQ ID NO: 958545 - DNA, 25 bp, Mus musculus
ttgtagccccatacctagtacagtg

SEQ ID NO: 958546 - DNA, 25 bp, Mus musculus
ttgtagccccattcctagtacagtg

SEQ ID NO: 958547 - DNA, 25 bp, Mus musculus
ttgtagccctgactcggaaagcccg

SEQ ID NO: 958548 - DNA, 25 bp, Mus musculus
ttgtagccctgagtcggaaagcccg

SEQ ID NO: 958549 - DNA, 25 bp, Mus musculus
ttgtagccctgtccctctaaaggaa

SEQ ID NO: 958550 - DNA, 25 bp, Mus musculus
ttgtagccctgtgcctctaaaggaa

SEQ ID NO: 958551 - DNA, 25 bp, Mus musculus
ttgtagccgctgctcattgaggcac

SEQ ID NO: 958552 - DNA, 25 bp, Mus musculus
ttgtagccgctggtcattgaggcac

SEQ ID NO: 958553 - DNA, 25 bp, Mus musculus
ttgtagcctcctcgatggagctgac

SEQ ID NO: 958554 - DNA, 25 bp, Mus musculus
ttgtagcctcctggatggagctgac

SEQ ID NO: 958555 - DNA, 25 bp, Mus musculus
ttgtagcctggcaggtgctcaaagg

SEQ ID NO: 958556 - DNA, 25 bp, Mus musculus
ttgtagcctggctggtgctcaaagg

SEQ ID NO: 958557 - DNA, 25 bp, Mus musculus
ttgtagccttggatggaatgtcagt

SEQ ID NO: 958558 - DNA, 25 bp, Mus musculus
ttgtagccttggttggaatgtcagt

SEQ ID NO: 958559 - DNA, 25 bp, Mus musculus
ttgtagccttttcccttttagagaa

SEQ ID NO: 958560 - DNA, 25 bp, Mus musculus
ttgtagccttttgccttttagagaa

SEQ ID NO: 958561 - DNA, 25 bp, Mus musculus
ttgtagcgcagacatgcttctctga

SEQ ID NO: 958562 - DNA, 25 bp, Mus musculus
ttgtagcgcagagatgcttctctga

SEQ ID NO: 958563 - DNA, 25 bp, Mus musculus
ttgtagcggtcactgtttgtttgat

SEQ ID NO: 958564 - DNA, 25 bp, Mus musculus
ttgtagcggtcagtgtttgtttgat

SEQ ID NO: 958565 - DNA, 25 bp, Mus musculus
ttgtagctaacacctgttgcctcag

SEQ ID NO: 958566 - DNA, 25 bp, Mus musculus
ttgtagctaacagctgttgcctcag

SEQ ID NO: 958567 - DNA, 25 bp, Mus musculus
ttgtagctaccactctatctatacc

SEQ ID NO: 958568 - DNA, 25 bp, Mus musculus
ttgtagctaccagtctatctatacc

SEQ ID NO: 958569 - DNA, 25 bp, Mus musculus
ttgtagctccttcttgccaagtcaa

SEQ ID NO: 958570 - DNA, 25 bp, Mus musculus
ttgtagctccttgttgccaagtcaa

SEQ ID NO: 958571 - DNA, 25 bp, Mus musculus
ttgtagctgatgaatccgttgccat

SEQ ID NO: 958572 - DNA, 25 bp, Mus musculus
ttgtagctgatgtatccgttgccat

SEQ ID NO: 958573 - DNA, 25 bp, Mus musculus
ttgtagcttaggattgcaagggcat

SEQ ID NO: 958574 - DNA, 25 bp, Mus musculus
ttgtagcttaggtttgcaagggcat

SEQ ID NO: 958575 - DNA, 25 bp, Mus musculus
ttgtagcttcttactccaaaggaca

SEQ ID NO: 958576 - DNA, 25 bp, Mus musculus
ttgtagcttcttaggattgactttg

SEQ ID NO: 958577 - DNA, 25 bp, Mus musculus
ttgtagcttctttctccaaaggaca

SEQ ID NO: 958578 - DNA, 25 bp, Mus musculus
ttgtagcttctttggattgactttg

SEQ ID NO: 958579 - DNA, 25 bp, Mus musculus
ttgtagcttgtgctatggccctgga

SEQ ID NO: 958580 - DNA, 25 bp, Mus musculus
ttgtagcttgtggtatggccctgga

SEQ ID NO: 958581 - DNA, 25 bp, Mus musculus
ttgtagctttctccagcactcttgg

SEQ ID NO: 958582 - DNA, 25 bp, Mus musculus
ttgtagctttctgcagcactcttgg

SEQ ID NO: 958583 - DNA, 25 bp, Mus musculus
ttgtaggaagtcatgcctgttttac

SEQ ID NO: 958584 - DNA, 25 bp, Mus musculus
ttgtaggaagtcttgcctgttttac

SEQ ID NO: 958585 - DNA, 25 bp, Mus musculus
ttgtaggacacactgtttcgatgcc

SEQ ID NO: 958586 - DNA, 25 bp, Mus musculus
ttgtaggacacagtgtttcgatgcc

SEQ ID NO: 958587 - DNA, 25 bp, Mus musculus
ttgtaggactccatgctgccagttt

SEQ ID NO: 958588 - DNA, 25 bp, Mus musculus
ttgtaggactccttgctgccagttt

SEQ ID NO: 958589 - DNA, 25 bp, Mus musculus
ttgtaggcaacaacttccccagata

SEQ ID NO: 958590 - DNA, 25 bp, Mus musculus
ttgtaggcaacatcttccccagata

SEQ ID NO: 958591 - DNA, 25 bp, Mus musculus
ttgtaggcaccgctggacatctgta

SEQ ID NO: 958592 - DNA, 25 bp, Mus musculus
ttgtaggcaccggtggacatctgta

SEQ ID NO: 958593 - DNA, 25 bp, Mus musculus
ttgtaggccaccacggcataggtaa

SEQ ID NO: 958594 - DNA, 25 bp, Mus musculus
ttgtaggccacctcggcataggtaa

SEQ ID NO: 958595 - DNA, 25 bp, Mus musculus
ttgtaggccagtaacctagtgtcct

SEQ ID NO: 958596 - DNA, 25 bp, Mus musculus
ttgtaggccagttacctagtgtcct

SEQ ID NO: 958597 - DNA, 25 bp, Mus musculus
ttgtaggcccttaaaaagtatgcca

SEQ ID NO: 958598 - DNA, 25 bp, Mus musculus
ttgtaggccctttaaaagtatgcca

SEQ ID NO: 958599 - DNA, 25 bp, Mus musculus
ttgtaggctcctaggcgggtattaa

SEQ ID NO: 958600 - DNA, 25 bp, Mus musculus
ttgtaggctccttggcgggtattaa

SEQ ID NO: 958601 - DNA, 25 bp, Mus musculus
ttgtaggctgcccaaagcttgccag

SEQ ID NO: 958602 - DNA, 25 bp, Mus musculus
ttgtaggctgcccagtaccggtgct

SEQ ID NO: 958603 - DNA, 25 bp, Mus musculus
ttgtaggctgccgaaagcttgccag

SEQ ID NO: 958604 - DNA, 25 bp, Mus musculus
ttgtaggctgccgagtaccggtgct

SEQ ID NO: 958605 - DNA, 25 bp, Mus musculus
ttgtaggctgttcgagctccagcac

SEQ ID NO: 958606 - DNA, 25 bp, Mus musculus
ttgtaggctgttggagctccagcac

SEQ ID NO: 958607 - DNA, 25 bp, Mus musculus
ttgtagggagctatgtcagcccaaa

SEQ ID NO: 958608 - DNA, 25 bp, Mus musculus
ttgtagggagctttgtcagcccaaa

SEQ ID NO: 958609 - DNA, 25 bp, Mus musculus
ttgtagggcatacacacagagtgag

SEQ ID NO: 958610 - DNA, 25 bp, Mus musculus
ttgtagggcatagacacagagtgag

SEQ ID NO: 958611 - DNA, 25 bp, Mus musculus
ttgtagggccctcaaatagattttt

SEQ ID NO: 958612 - DNA, 25 bp, Mus musculus
ttgtagggccctgaaatagattttt

SEQ ID NO: 958613 - DNA, 25 bp, Mus musculus
ttgtagggcggcatcaagtcgtctt

SEQ ID NO: 958614 - DNA, 25 bp, Mus musculus
ttgtagggcggcttcaagtcgtctt

SEQ ID NO: 958615 - DNA, 25 bp, Mus musculus
ttgtaggtaacacacacagagaact

SEQ ID NO: 958616 - DNA, 25 bp, Mus musculus
ttgtaggtaacagacacagagaact

SEQ ID NO: 958617 - DNA, 25 bp, Mus musculus
ttgtaggtacccatcctaagaagct

SEQ ID NO: 958618 - DNA, 25 bp, Mus musculus
ttgtaggtacccttcctaagaagct

SEQ ID NO: 958619 - DNA, 25 bp, Mus musculus
ttgtaggtcaggatcttccccatca

SEQ ID NO: 958620 - DNA, 25 bp, Mus musculus
ttgtaggtcaggttcttccccatca

SEQ ID NO: 958621 - DNA, 25 bp, Mus musculus
ttgtaggtccctcagcccgagcctg

SEQ ID NO: 958622 - DNA, 25 bp, Mus musculus
ttgtaggtccctgagcccgagcctg

SEQ ID NO: 958623 - DNA, 25 bp, Mus musculus
ttgtaggtcctaaaagcagatcttt

SEQ ID NO: 958624 - DNA, 25 bp, Mus musculus
ttgtaggtcctataagcagatcttt

SEQ ID NO: 958625 - DNA, 25 bp, Mus musculus
ttgtaggtcttaatggtcatccagg

SEQ ID NO: 958626 - DNA, 25 bp, Mus musculus
ttgtaggtcttattggtcatccagg

SEQ ID NO: 958627 - DNA, 25 bp, Mus musculus
ttgtaggtgacccagcttcatcaag

SEQ ID NO: 958628 - DNA, 25 bp, Mus musculus
ttgtaggtgaccgagcttcatcaag

SEQ ID NO: 958629 - DNA, 25 bp, Mus musculus
ttgtaggtgcatatccataggattt

SEQ ID NO: 958630 - DNA, 25 bp, Mus musculus
ttgtaggtgcatttccataggattt

SEQ ID NO: 958631 - DNA, 25 bp, Mus musculus
ttgtaggtgtccagcgctctggtcg

SEQ ID NO: 958632 - DNA, 25 bp, Mus musculus
ttgtaggtgtcctgcgctctggtcg

SEQ ID NO: 958633 - DNA, 25 bp, Mus musculus
ttgtaggtttcccagataaaaagca

SEQ ID NO: 958634 - DNA, 25 bp, Mus musculus
ttgtaggtttccgagataaaaagca

SEQ ID NO: 958635 - DNA, 25 bp, Mus musculus
ttgtaggttttcaccttcttcatga

SEQ ID NO: 958636 - DNA, 25 bp, Mus musculus
ttgtaggttttctccttcttcatga

SEQ ID NO: 958637 - DNA, 25 bp, Mus musculus
ttgtagtaaactccctgtctccgac

SEQ ID NO: 958638 - DNA, 25 bp, Mus musculus
ttgtagtaaactgcctgtctccgac

SEQ ID NO: 958639 - DNA, 25 bp, Mus musculus
ttgtagtataagaagctctgcagca

SEQ ID NO: 958640 - DNA, 25 bp, Mus musculus
ttgtagtataagtagctctgcagca

SEQ ID NO: 958641 - DNA, 25 bp, Mus musculus
ttgtagtcacagactgaagatgctt

SEQ ID NO: 958642 - DNA, 25 bp, Mus musculus
ttgtagtcacagtctgaagatgctt

SEQ ID NO: 958643 - DNA, 25 bp, Mus musculus
ttgtagtcatgcctaactctgccat

SEQ ID NO: 958644 - DNA, 25 bp, Mus musculus
ttgtagtcatgcgtaactctgccat

SEQ ID NO: 958645 - DNA, 25 bp, Mus musculus
ttgtagtcccagagctcatcacaag

SEQ ID NO: 958646 - DNA, 25 bp, Mus musculus
ttgtagtcccagtgctcatcacaag

SEQ ID NO: 958647 - DNA, 25 bp, Mus musculus
ttgtagtcctcccagtggcttctgc

SEQ ID NO: 958648 - DNA, 25 bp, Mus musculus
ttgtagtcctccgagtggcttctgc

SEQ ID NO: 958649 - DNA, 25 bp, Mus musculus
ttgtagtccttaaaagagacccagt

SEQ ID NO: 958650 - DNA, 25 bp, Mus musculus
ttgtagtccttataagagacccagt

SEQ ID NO: 958651 - DNA, 25 bp, Mus musculus
ttgtagtggataagaccttgctgga

SEQ ID NO: 958652 - DNA, 25 bp, Mus musculus
ttgtagtggatatgaccttgctgga

SEQ ID NO: 958653 - DNA, 25 bp, Mus musculus
ttgtagtggctacgctggctgtcat

SEQ ID NO: 958654 - DNA, 25 bp, Mus musculus
ttgtagtggctaggctggctgtcat

SEQ ID NO: 958655 - DNA, 25 bp, Mus musculus
ttgtagttagttcgttgttttgtca

SEQ ID NO: 958656 - DNA, 25 bp, Mus musculus
ttgtagttagttggttgttttgtca

SEQ ID NO: 958657 - DNA, 25 bp, Mus musculus
ttgtagttctttagcgtttctgtaa

SEQ ID NO: 958658 - DNA, 25 bp, Mus musculus
ttgtagttcttttgcgtttctgtaa

SEQ ID NO: 958659 - DNA, 25 bp, Mus musculus
ttgtagtttcagcaaccagtctggt

SEQ ID NO: 958660 - DNA, 25 bp, Mus musculus
ttgtagtttcaggaaccagtctggt

SEQ ID NO: 958661 - DNA, 25 bp, Mus musculus
ttgtataaagcaaagtccttggatt

SEQ ID NO: 958662 - DNA, 25 bp, Mus musculus
ttgtataaagcatagtccttggatt

SEQ ID NO: 958663 - DNA, 25 bp, Mus musculus
ttgtataacatcacttgtttctgta

SEQ ID NO: 958664 - DNA, 25 bp, Mus musculus
ttgtataacatctcttgtttctgta

SEQ ID NO: 958665 - DNA, 25 bp, Mus musculus
ttgtataaccggcttctctctgctc

SEQ ID NO: 958666 - DNA, 25 bp, Mus musculus
ttgtataaccgggttctctctgctc

SEQ ID NO: 958667 - DNA, 25 bp, Mus musculus
ttgtataataatcagctgacagctg

SEQ ID NO: 958668 - DNA, 25 bp, Mus musculus
ttgtataataatgagctgacagctg

SEQ ID NO: 958669 - DNA, 25 bp, Mus musculus
ttgtataatagcaagtgtctccatt

SEQ ID NO: 958670 - DNA, 25 bp, Mus musculus
ttgtataatagctagtgtctccatt

SEQ ID NO: 958671 - DNA, 25 bp, Mus musculus
ttgtataatgtcaccttaaaggctg

SEQ ID NO: 958672 - DNA, 25 bp, Mus musculus
ttgtataatgtctccttaaaggctg

SEQ ID NO: 958673 - DNA, 25 bp, Mus musculus
ttgtatacaatcacacatgccctct

SEQ ID NO: 958674 - DNA, 25 bp, Mus musculus
ttgtatacaatctcacatgccctct

SEQ ID NO: 958675 - DNA, 25 bp, Mus musculus
ttgtataccatcatttcatccttca

SEQ ID NO: 958676 - DNA, 25 bp, Mus musculus
ttgtataccatcttttcatccttca

SEQ ID NO: 958677 - DNA, 25 bp, Mus musculus
ttgtatactgcaagacaggtcacac

SEQ ID NO: 958678 - DNA, 25 bp, Mus musculus
ttgtatactgcatgacaggtcacac

SEQ ID NO: 958679 - DNA, 25 bp, Mus musculus
ttgtatagatgcatcctgtcaggtg

SEQ ID NO: 958680 - DNA, 25 bp, Mus musculus
ttgtatagatgcttcctgtcaggtg

SEQ ID NO: 958681 - DNA, 25 bp, Mus musculus
ttgtatagccccatatctgtggaat

SEQ ID NO: 958682 - DNA, 25 bp, Mus musculus
ttgtatagccccttatctgtggaat

SEQ ID NO: 958683 - DNA, 25 bp, Mus musculus
ttgtatagtcgacttcctccagcat

SEQ ID NO: 958684 - DNA, 25 bp, Mus musculus
ttgtatagtcgagttcctccagcat

SEQ ID NO: 958685 - DNA, 25 bp, Mus musculus
ttgtatatctgtatcctcatgtccc

SEQ ID NO: 958686 - DNA, 25 bp, Mus musculus
ttgtatatctgtttcctcatgtccc

SEQ ID NO: 958687 - DNA, 25 bp, Mus musculus
ttgtatattattcatctcacgtaat

SEQ ID NO: 958688 - DNA, 25 bp, Mus musculus
ttgtatattattgatctcacgtaat

SEQ ID NO: 958689 - DNA, 25 bp, Mus musculus
ttgtatattggaaggttccctgggt

SEQ ID NO: 958690 - DNA, 25 bp, Mus musculus
ttgtatattggatggttccctgggt

SEQ ID NO: 958691 - DNA, 25 bp, Mus musculus
ttgtatcaaccaccaaaccgggcag

SEQ ID NO: 958692 - DNA, 25 bp, Mus musculus
ttgtatcaaccagcaaaccgggcag

SEQ ID NO: 958693 - DNA, 25 bp, Mus musculus
ttgtatcacatgcactatattcagt

SEQ ID NO: 958694 - DNA, 25 bp, Mus musculus
ttgtatcacatggactatattcagt

SEQ ID NO: 958695 - DNA, 25 bp, Mus musculus
ttgtatcagcaacgtggactctcag

SEQ ID NO: 958696 - DNA, 25 bp, Mus musculus
ttgtatcagcaaggtggactctcag

SEQ ID NO: 958697 - DNA, 25 bp, Mus musculus
ttgtatcagctaatcttataaggta

SEQ ID NO: 958698 - DNA, 25 bp, Mus musculus
ttgtatcagctattcttataaggta

SEQ ID NO: 958699 - DNA, 25 bp, Mus musculus
ttgtatcattgtccctatagcctct

SEQ ID NO: 958700 - DNA, 25 bp, Mus musculus
ttgtatcattgtgcctatagcctct

SEQ ID NO: 958701 - DNA, 25 bp, Mus musculus
ttgtatccaaggagctgaatcttgg

SEQ ID NO: 958702 - DNA, 25 bp, Mus musculus
ttgtatccaaggtgctgaatcttgg

SEQ ID NO: 958703 - DNA, 25 bp, Mus musculus
ttgtatccatcaaggcaaggctgcc

SEQ ID NO: 958704 - DNA, 25 bp, Mus musculus
ttgtatccatcatggcaaggctgcc

SEQ ID NO: 958705 - DNA, 25 bp, Mus musculus
ttgtatcccaagacttccacctgga

SEQ ID NO: 958706 - DNA, 25 bp, Mus musculus
ttgtatcccaagtcttccacctgga

SEQ ID NO: 958707 - DNA, 25 bp, Mus musculus
ttgtatccccacagcagtactgagg

SEQ ID NO: 958708 - DNA, 25 bp, Mus musculus
ttgtatccccactgcagtactgagg

SEQ ID NO: 958709 - DNA, 25 bp, Mus musculus
ttgtatccccatccatactactcat

SEQ ID NO: 958710 - DNA, 25 bp, Mus musculus
ttgtatccccatctttgttatagct

SEQ ID NO: 958711 - DNA, 25 bp, Mus musculus
ttgtatccccatgcatactactcat

SEQ ID NO: 958712 - DNA, 25 bp, Mus musculus
ttgtatccccatgtttgttatagct

SEQ ID NO: 958713 - DNA, 25 bp, Mus musculus
ttgtatcccggaatgcctgtgacac

SEQ ID NO: 958714 - DNA, 25 bp, Mus musculus
ttgtatcccggattgcctgtgacac

SEQ ID NO: 958715 - DNA, 25 bp, Mus musculus
ttgtatcccttcagaacgaccctgt

SEQ ID NO: 958716 - DNA, 25 bp, Mus musculus
ttgtatcccttctgaacgaccctgt

SEQ ID NO: 958717 - DNA, 25 bp, Mus musculus
ttgtatccgagaaatgtcagccatt

SEQ ID NO: 958718 - DNA, 25 bp, Mus musculus
ttgtatccgagatatgtcagccatt

SEQ ID NO: 958719 - DNA, 25 bp, Mus musculus
ttgtatcctcaaactttccctagag

SEQ ID NO: 958720 - DNA, 25 bp, Mus musculus
ttgtatcctcaatctttccctagag

SEQ ID NO: 958721 - DNA, 25 bp, Mus musculus
ttgtatcctcccagtgttttgagat

SEQ ID NO: 958722 - DNA, 25 bp, Mus musculus
ttgtatcctccctgtgttttgagat

SEQ ID NO: 958723 - DNA, 25 bp, Mus musculus
ttgtatcctctccagcctgggtgct

SEQ ID NO: 958724 - DNA, 25 bp, Mus musculus
ttgtatcctctcgagcctgggtgct

SEQ ID NO: 958725 - DNA, 25 bp, Mus musculus
ttgtatcctctgcactataccagca

SEQ ID NO: 958726 - DNA, 25 bp, Mus musculus
ttgtatcctctggactataccagca

SEQ ID NO: 958727 - DNA, 25 bp, Mus musculus
ttgtatcgaccaactttctctgcca

SEQ ID NO: 958728 - DNA, 25 bp, Mus musculus
ttgtatcgaccatctttctctgcca

SEQ ID NO: 958729 - DNA, 25 bp, Mus musculus
ttgtatctaaagatgccccataaaa

SEQ ID NO: 958730 - DNA, 25 bp, Mus musculus
ttgtatctaaagttgccccataaaa

SEQ ID NO: 958731 - DNA, 25 bp, Mus musculus
ttgtatctacccagaaaaggcttag

SEQ ID NO: 958732 - DNA, 25 bp, Mus musculus
ttgtatctaccctgaaaaggcttag

SEQ ID NO: 958733 - DNA, 25 bp, Mus musculus
ttgtatctacttcacttctgcttat

SEQ ID NO: 958734 - DNA, 25 bp, Mus musculus
ttgtatctacttgacttctgcttat

SEQ ID NO: 958735 - DNA, 25 bp, Mus musculus
ttgtatctagataactgggcctaat

SEQ ID NO: 958736 - DNA, 25 bp, Mus musculus
ttgtatctagattactgggcctaat

SEQ ID NO: 958737 - DNA, 25 bp, Mus musculus
ttgtatctcacaaatctggtctaga

SEQ ID NO: 958738 - DNA, 25 bp, Mus musculus
ttgtatctcacatatctggtctaga

SEQ ID NO: 958739 - DNA, 25 bp, Mus musculus
ttgtatctctacagtgtagtccatt

SEQ ID NO: 958740 - DNA, 25 bp, Mus musculus
ttgtatctctactgtgtagtccatt

SEQ ID NO: 958741 - DNA, 25 bp, Mus musculus
ttgtatctcttcaaaacaataggaa

SEQ ID NO: 958742 - DNA, 25 bp, Mus musculus
ttgtatctcttctaaacaataggaa

SEQ ID NO: 958743 - DNA, 25 bp, Mus musculus
ttgtatctgcatcgacgggcgagct

SEQ ID NO: 958744 - DNA, 25 bp, Mus musculus
ttgtatctgcatggacgggcgagct

SEQ ID NO: 958745 - DNA, 25 bp, Mus musculus
ttgtatctgctgagtctctctttca

SEQ ID NO: 958746 - DNA, 25 bp, Mus musculus
ttgtatctgctgtgtctctctttca

SEQ ID NO: 958747 - DNA, 25 bp, Mus musculus
ttgtatctgtttcctgttttcattt

SEQ ID NO: 958748 - DNA, 25 bp, Mus musculus
ttgtatctgtttgctgttttcattt

SEQ ID NO: 958749 - DNA, 25 bp, Mus musculus
ttgtatgacaacctatcttttcccc

SEQ ID NO: 958750 - DNA, 25 bp, Mus musculus
ttgtatgacaacgtatcttttcccc

SEQ ID NO: 958751 - DNA, 25 bp, Mus musculus
ttgtatgactttagctagctataac

SEQ ID NO: 958752 - DNA, 25 bp, Mus musculus
ttgtatgacttttgctagctataac

SEQ ID NO: 958753 - DNA, 25 bp, Mus musculus
ttgtatgagggtctttctccaccca

SEQ ID NO: 958754 - DNA, 25 bp, Mus musculus
ttgtatgagggtgtttctccaccca

SEQ ID NO: 958755 - DNA, 25 bp, Mus musculus
ttgtatgatactcgctccgggacca

SEQ ID NO: 958756 - DNA, 25 bp, Mus musculus
ttgtatgatactggctccgggacca

SEQ ID NO: 958757 - DNA, 25 bp, Mus musculus
ttgtatgcactgatctctgggcagc

SEQ ID NO: 958758 - DNA, 25 bp, Mus musculus
ttgtatgcactgttctctgggcagc

SEQ ID NO: 958759 - DNA, 25 bp, Mus musculus
ttgtatgcatgtatagggccactgt

SEQ ID NO: 958760 - DNA, 25 bp, Mus musculus
ttgtatgcatgtttagggccactgt

SEQ ID NO: 958761 - DNA, 25 bp, Mus musculus
ttgtatgccggtaatgtgccattcc

SEQ ID NO: 958762 - DNA, 25 bp, Mus musculus
ttgtatgccggttatgtgccattcc

SEQ ID NO: 958763 - DNA, 25 bp, Mus musculus
ttgtatgccgtgctcagtcctgcac

SEQ ID NO: 958764 - DNA, 25 bp, Mus musculus
ttgtatgccgtggtcagtcctgcac

SEQ ID NO: 958765 - DNA, 25 bp, Mus musculus
ttgtatgcctccaacgtctatctgt

SEQ ID NO: 958766 - DNA, 25 bp, Mus musculus
ttgtatgcctcctacgtctatctgt

SEQ ID NO: 958767 - DNA, 25 bp, Mus musculus
ttgtatgctgctaactcctagagtc

SEQ ID NO: 958768 - DNA, 25 bp, Mus musculus
ttgtatgctgcttactcctagagtc

SEQ ID NO: 958769 - DNA, 25 bp, Mus musculus
ttgtatgctgtgataatttatgctg

SEQ ID NO: 958770 - DNA, 25 bp, Mus musculus
ttgtatgctgtgttaatttatgctg

SEQ ID NO: 958771 - DNA, 25 bp, Mus musculus
ttgtatgcttacacattgaaggtat

SEQ ID NO: 958772 - DNA, 25 bp, Mus musculus
ttgtatgcttactcattgaaggtat

SEQ ID NO: 958773 - DNA, 25 bp, Mus musculus
ttgtatggcaagacactgtctcagc

SEQ ID NO: 958774 - DNA, 25 bp, Mus musculus
ttgtatggcaagtcactgtctcagc

SEQ ID NO: 958775 - DNA, 25 bp, Mus musculus
ttgtatgggctgagtgttttacctg

SEQ ID NO: 958776 - DNA, 25 bp, Mus musculus
ttgtatgggctgtgtgttttacctg

SEQ ID NO: 958777 - DNA, 25 bp, Mus musculus
ttgtatgggtggctgcatgtgggca

SEQ ID NO: 958778 - DNA, 25 bp, Mus musculus
ttgtatgggtgggtgcatgtgggca

SEQ ID NO: 958779 - DNA, 25 bp, Mus musculus
ttgtatggtataccttcgatgtaaa

SEQ ID NO: 958780 - DNA, 25 bp, Mus musculus
ttgtatggtatagcttcgatgtaaa

SEQ ID NO: 958781 - DNA, 25 bp, Mus musculus
ttgtatgtacatctctccagctaag

SEQ ID NO: 958782 - DNA, 25 bp, Mus musculus
ttgtatgtacatgtctccagctaag

SEQ ID NO: 958783 - DNA, 25 bp, Mus musculus
ttgtatgtagccattaactccgtcc

SEQ ID NO: 958784 - DNA, 25 bp, Mus musculus
ttgtatgtagcctttaactccgtcc

SEQ ID NO: 958785 - DNA, 25 bp, Mus musculus
ttgtatgtatttctagaccacagag

SEQ ID NO: 958786 - DNA, 25 bp, Mus musculus
ttgtatgtatttgtagaccacagag

SEQ ID NO: 958787 - DNA, 25 bp, Mus musculus
ttgtatgtctgcatcttgcgtttaa

SEQ ID NO: 958788 - DNA, 25 bp, Mus musculus
ttgtatgtctgccattccagtgcta

SEQ ID NO: 958789 - DNA, 25 bp, Mus musculus
ttgtatgtctgcgattccagtgcta

SEQ ID NO: 958790 - DNA, 25 bp, Mus musculus
ttgtatgtctgcttcttgcgtttaa

SEQ ID NO: 958791 - DNA, 25 bp, Mus musculus
ttgtatgttagtcctgtgctcactc

SEQ ID NO: 958792 - DNA, 25 bp, Mus musculus
ttgtatgttagtgctgtgctcactc

SEQ ID NO: 958793 - DNA, 25 bp, Mus musculus
ttgtatgttcgcagagcccgagcac

SEQ ID NO: 958794 - DNA, 25 bp, Mus musculus
ttgtatgttcgctgagcccgagcac

SEQ ID NO: 958795 - DNA, 25 bp, Mus musculus
ttgtatgttggtccttgtttcgcct

SEQ ID NO: 958796 - DNA, 25 bp, Mus musculus
ttgtatgttggtgcttgtttcgcct

SEQ ID NO: 958797 - DNA, 25 bp, Mus musculus
ttgtatgtttatcttatccctctga

SEQ ID NO: 958798 - DNA, 25 bp, Mus musculus
ttgtatgtttatgttatccctctga

SEQ ID NO: 958799 - DNA, 25 bp, Mus musculus
ttgtatgtttgtatccaggccaggc

SEQ ID NO: 958800 - DNA, 25 bp, Mus musculus
ttgtatgtttgtttccaggccaggc

SEQ ID NO: 958801 - DNA, 25 bp, Mus musculus
ttgtattaagttctctccgtgtccc

SEQ ID NO: 958802 - DNA, 25 bp, Mus musculus
ttgtattaagttgtctccgtgtccc

SEQ ID NO: 958803 - DNA, 25 bp, Mus musculus
ttgtattacagcacagctacaggct

SEQ ID NO: 958804 - DNA, 25 bp, Mus musculus
ttgtattacagctcagctacaggct

SEQ ID NO: 958805 - DNA, 25 bp, Mus musculus
ttgtattacctgaggttgccatccc

SEQ ID NO: 958806 - DNA, 25 bp, Mus musculus
ttgtattacctgtggttgccatccc

SEQ ID NO: 958807 - DNA, 25 bp, Mus musculus
ttgtattcagccctgggtccaggaa

SEQ ID NO: 958808 - DNA, 25 bp, Mus musculus
ttgtattcagccgtgggtccaggaa

SEQ ID NO: 958809 - DNA, 25 bp, Mus musculus
ttgtattcaggccaagacccactgg

SEQ ID NO: 958810 - DNA, 25 bp, Mus musculus
ttgtattcaggcgaagacccactgg

SEQ ID NO: 958811 - DNA, 25 bp, Mus musculus
ttgtattcatcaacacttaccgcca

SEQ ID NO: 958812 - DNA, 25 bp, Mus musculus
ttgtattcatcatcacttaccgcca

SEQ ID NO: 958813 - DNA, 25 bp, Mus musculus
ttgtattcatgaaccggacactgcg

SEQ ID NO: 958814 - DNA, 25 bp, Mus musculus
ttgtattcatgatccggacactgcg

SEQ ID NO: 958815 - DNA, 25 bp, Mus musculus
ttgtattcccaaccatgactcccat

SEQ ID NO: 958816 - DNA, 25 bp, Mus musculus
ttgtattcccaagcatgactcccat

SEQ ID NO: 958817 - DNA, 25 bp, Mus musculus
ttgtattcctcaagctttcttcttt

SEQ ID NO: 958818 - DNA, 25 bp, Mus musculus
ttgtattcctcatgctttcttcttt

SEQ ID NO: 958819 - DNA, 25 bp, Mus musculus
ttgtattcgtgaatgtaacctcctc

SEQ ID NO: 958820 - DNA, 25 bp, Mus musculus
ttgtattcgtgattgtaacctcctc

SEQ ID NO: 958821 - DNA, 25 bp, Mus musculus
ttgtattctctcacttaaacctctc

SEQ ID NO: 958822 - DNA, 25 bp, Mus musculus
ttgtattctctcatagattcagaag

SEQ ID NO: 958823 - DNA, 25 bp, Mus musculus
ttgtattctctctcttaaacctctc

SEQ ID NO: 958824 - DNA, 25 bp, Mus musculus
ttgtattctctcttagattcagaag

SEQ ID NO: 958825 - DNA, 25 bp, Mus musculus
ttgtattctgcacagtctccaggcc

SEQ ID NO: 958826 - DNA, 25 bp, Mus musculus
ttgtattctgcagagtctccaggcc

SEQ ID NO: 958827 - DNA, 25 bp, Mus musculus
ttgtattctgctatcccatcaggca

SEQ ID NO: 958828 - DNA, 25 bp, Mus musculus
ttgtattctgctttcccatcaggca

SEQ ID NO: 958829 - DNA, 25 bp, Mus musculus
ttgtattcttatcccttttcaatat

SEQ ID NO: 958830 - DNA, 25 bp, Mus musculus
ttgtattcttatgccttttcaatat

SEQ ID NO: 958831 - DNA, 25 bp, Mus musculus
ttgtattgccaacgctccctttgac

SEQ ID NO: 958832 - DNA, 25 bp, Mus musculus
ttgtattgccaaggctccctttgac

SEQ ID NO: 958833 - DNA, 25 bp, Mus musculus
ttgtattgtactcccattcctaatg

SEQ ID NO: 958834 - DNA, 25 bp, Mus musculus
ttgtattgtactgccattcctaatg

SEQ ID NO: 958835 - DNA, 25 bp, Mus musculus
ttgtattgtatgactctctgtgcac

SEQ ID NO: 958836 - DNA, 25 bp, Mus musculus
ttgtattgtatgtctctctgtgcac

SEQ ID NO: 958837 - DNA, 25 bp, Mus musculus
ttgtatttactcacatattgtgcta

SEQ ID NO: 958838 - DNA, 25 bp, Mus musculus
ttgtatttactccaatagtcacaca

SEQ ID NO: 958839 - DNA, 25 bp, Mus musculus
ttgtatttactcgaatagtcacaca

SEQ ID NO: 958840 - DNA, 25 bp, Mus musculus
ttgtatttactctcatattgtgcta

SEQ ID NO: 958841 - DNA, 25 bp, Mus musculus
ttgtatttagaccatacccgtgacc

SEQ ID NO: 958842 - DNA, 25 bp, Mus musculus
ttgtatttagacgatacccgtgacc

SEQ ID NO: 958843 - DNA, 25 bp, Mus musculus
ttgtatttagtcataacctctcaag

SEQ ID NO: 958844 - DNA, 25 bp, Mus musculus
ttgtatttagtcttaacctctcaag

SEQ ID NO: 958845 - DNA, 25 bp, Mus musculus
ttgtatttatgccacaaaagggcct

SEQ ID NO: 958846 - DNA, 25 bp, Mus musculus
ttgtatttatgcgacaaaagggcct

SEQ ID NO: 958847 - DNA, 25 bp, Mus musculus
ttgtatttcagcaaagtccacccac

SEQ ID NO: 958848 - DNA, 25 bp, Mus musculus
ttgtatttcagctaagtccacccac

SEQ ID NO: 958849 - DNA, 25 bp, Mus musculus
ttgtatttcattacaacagcattgt

SEQ ID NO: 958850 - DNA, 25 bp, Mus musculus
ttgtatttcatttcaacagcattgt

SEQ ID NO: 958851 - DNA, 25 bp, Mus musculus
ttgtatttccaaattcttgttcatg

SEQ ID NO: 958852 - DNA, 25 bp, Mus musculus
ttgtatttccaatttcttgttcatg

SEQ ID NO: 958853 - DNA, 25 bp, Mus musculus
ttgtatttccctcgccataagtgtt

SEQ ID NO: 958854 - DNA, 25 bp, Mus musculus
ttgtatttccctggccataagtgtt

SEQ ID NO: 958855 - DNA, 25 bp, Mus musculus
ttgtatttcttgagtgtgcacacca

SEQ ID NO: 958856 - DNA, 25 bp, Mus musculus
ttgtatttcttgtgtgtgcacacca

SEQ ID NO: 958857 - DNA, 25 bp, Mus musculus
ttgtatttgatgattctgggcagca

SEQ ID NO: 958858 - DNA, 25 bp, Mus musculus
ttgtatttgatgtttctgggcagca

SEQ ID NO: 958859 - DNA, 25 bp, Mus musculus
ttgtatttgtacattggactgctgt

SEQ ID NO: 958860 - DNA, 25 bp, Mus musculus
ttgtatttgtactttggactgctgt

SEQ ID NO: 958861 - DNA, 25 bp, Mus musculus
ttgtatttgtggctctgtctgtcct

SEQ ID NO: 958862 - DNA, 25 bp, Mus musculus
ttgtatttgtgggtctgtctgtcct

SEQ ID NO: 958863 - DNA, 25 bp, Mus musculus
ttgtattttaatacacctaagccat

SEQ ID NO: 958864 - DNA, 25 bp, Mus musculus
ttgtattttaattcacctaagccat

SEQ ID NO: 958865 - DNA, 25 bp, Mus musculus
ttgtattttcacatgttcctcaggt

SEQ ID NO: 958866 - DNA, 25 bp, Mus musculus
ttgtattttcacttgttcctcaggt

SEQ ID NO: 958867 - DNA, 25 bp, Mus musculus
ttgtattttcatctagcctcctcct

SEQ ID NO: 958868 - DNA, 25 bp, Mus musculus
ttgtattttcatgtagcctcctcct

SEQ ID NO: 958869 - DNA, 25 bp, Mus musculus
ttgtattttctgaccacataaaggc

SEQ ID NO: 958870 - DNA, 25 bp, Mus musculus
ttgtattttctgtccacataaaggc

SEQ ID NO: 958871 - DNA, 25 bp, Mus musculus
ttgtattttcttctctggcatctat

SEQ ID NO: 958872 - DNA, 25 bp, Mus musculus
ttgtattttcttgtctggcatctat

SEQ ID NO: 958873 - DNA, 25 bp, Mus musculus
ttgtattttgcccattgtgcccatt

SEQ ID NO: 958874 - DNA, 25 bp, Mus musculus
ttgtattttgccgattgtgcccatt

SEQ ID NO: 958875 - DNA, 25 bp, Mus musculus
ttgtatttttcaccctttcacttat

SEQ ID NO: 958876 - DNA, 25 bp, Mus musculus
ttgtatttttcagcctttcacttat

SEQ ID NO: 958877 - DNA, 25 bp, Mus musculus
ttgtattttttcctgctggcatgaa

SEQ ID NO: 958878 - DNA, 25 bp, Mus musculus
ttgtattttttcgtgctggcatgaa

SEQ ID NO: 958879 - DNA, 25 bp, Mus musculus
ttgtcaaaacaccagtgctttgccc

SEQ ID NO: 958880 - DNA, 25 bp, Mus musculus
ttgtcaaaacacgagtgctttgccc

SEQ ID NO: 958881 - DNA, 25 bp, Mus musculus
ttgtcaaaagatccgtgtgaacacg

SEQ ID NO: 958882 - DNA, 25 bp, Mus musculus
ttgtcaaaagatgcgtgtgaacacg

SEQ ID NO: 958883 - DNA, 25 bp, Mus musculus
ttgtcaaaatcacagcccttacctg

SEQ ID NO: 958884 - DNA, 25 bp, Mus musculus
ttgtcaaaatcagagcccttacctg

SEQ ID NO: 958885 - DNA, 25 bp, Mus musculus
ttgtcaaacaagatggcctccattt

SEQ ID NO: 958886 - DNA, 25 bp, Mus musculus
ttgtcaaacaagttggcctccattt

SEQ ID NO: 958887 - DNA, 25 bp, Mus musculus
ttgtcaaacagcatctttgtggtcc

SEQ ID NO: 958888 - DNA, 25 bp, Mus musculus
ttgtcaaacagcttctttgtggtcc

SEQ ID NO: 958889 - DNA, 25 bp, Mus musculus
ttgtcaaacctaataactgtcttta

SEQ ID NO: 958890 - DNA, 25 bp, Mus musculus
ttgtcaaacctattaactgtcttta

SEQ ID NO: 958891 - DNA, 25 bp, Mus musculus
ttgtcaaagagtctgcatggaggca

SEQ ID NO: 958892 - DNA, 25 bp, Mus musculus
ttgtcaaagagtgtgcatggaggca

SEQ ID NO: 958893 - DNA, 25 bp, Mus musculus
ttgtcaaaggataatgaccttccca

SEQ ID NO: 958894 - DNA, 25 bp, Mus musculus
ttgtcaaaggatccaggtccgctct

SEQ ID NO: 958895 - DNA, 25 bp, Mus musculus
ttgtcaaaggatcttcagaagcact

SEQ ID NO: 958896 - DNA, 25 bp, Mus musculus
ttgtcaaaggatgcaggtccgctct

SEQ ID NO: 958897 - DNA, 25 bp, Mus musculus
ttgtcaaaggatgttcagaagcact

SEQ ID NO: 958898 - DNA, 25 bp, Mus musculus
ttgtcaaaggattatgaccttccca

SEQ ID NO: 958899 - DNA, 25 bp, Mus musculus
ttgtcaaatacgactcatacttcat

SEQ ID NO: 958900 - DNA, 25 bp, Mus musculus
ttgtcaaatacgtctcatacttcat

SEQ ID NO: 958901 - DNA, 25 bp, Mus musculus
ttgtcaaatccaataaaggtcaatg

SEQ ID NO: 958902 - DNA, 25 bp, Mus musculus
ttgtcaaatccattaaaggtcaatg

SEQ ID NO: 958903 - DNA, 25 bp, Mus musculus
ttgtcaaattgacgcctccatgtgg

SEQ ID NO: 958904 - DNA, 25 bp, Mus musculus
ttgtcaaattgaggcctccatgtgg

SEQ ID NO: 958905 - DNA, 25 bp, Mus musculus
ttgtcaacaaagatgctatttaccc

SEQ ID NO: 958906 - DNA, 25 bp, Mus musculus
ttgtcaacaaagttgctatttaccc

SEQ ID NO: 958907 - DNA, 25 bp, Mus musculus
ttgtcaacaacgactgtgcagggct

SEQ ID NO: 958908 - DNA, 25 bp, Mus musculus
ttgtcaacaacgtctgtgcagggct

SEQ ID NO: 958909 - DNA, 25 bp, Mus musculus
ttgtcaacaatgacattccacccac

SEQ ID NO: 958910 - DNA, 25 bp, Mus musculus
ttgtcaacaatgtcattccacccac

SEQ ID NO: 958911 - DNA, 25 bp, Mus musculus
ttgtcaacacatcgtgggcgtcgtt

SEQ ID NO: 958912 - DNA, 25 bp, Mus musculus
ttgtcaacacatggtgggcgtcgtt

SEQ ID NO: 958913 - DNA, 25 bp, Mus musculus
ttgtcaacagcacctaactttggag

SEQ ID NO: 958914 - DNA, 25 bp, Mus musculus
ttgtcaacagcagctaactttggag

SEQ ID NO: 958915 - DNA, 25 bp, Mus musculus
ttgtcaacatttagcagtattttta

SEQ ID NO: 958916 - DNA, 25 bp, Mus musculus
ttgtcaacattttgcagtattttta

SEQ ID NO: 958917 - DNA, 25 bp, Mus musculus
ttgtcaaccccgaaaccaaggcgat

SEQ ID NO: 958918 - DNA, 25 bp, Mus musculus
ttgtcaaccccgtaaccaaggcgat

SEQ ID NO: 958919 - DNA, 25 bp, Mus musculus
ttgtcaacctttctgggtcgcctaa

SEQ ID NO: 958920 - DNA, 25 bp, Mus musculus
ttgtcaacctttgtgggtcgcctaa

SEQ ID NO: 958921 - DNA, 25 bp, Mus musculus
ttgtcaacgagcagcggtttctcca

SEQ ID NO: 958922 - DNA, 25 bp, Mus musculus
ttgtcaacgagctgcggtttctcca

SEQ ID NO: 958923 - DNA, 25 bp, Mus musculus
ttgtcaacgggccgccactgccgga

SEQ ID NO: 958924 - DNA, 25 bp, Mus musculus
ttgtcaacgggcggccactgccgga

SEQ ID NO: 958925 - DNA, 25 bp, Mus musculus
ttgtcaactactatgggaaccctca

SEQ ID NO: 958926 - DNA, 25 bp, Mus musculus
ttgtcaactactttgggaaccctca

SEQ ID NO: 958927 - DNA, 25 bp, Mus musculus
ttgtcaactataagggctgctgcga

SEQ ID NO: 958928 - DNA, 25 bp, Mus musculus
ttgtcaactatatgggctgctgcga

SEQ ID NO: 958929 - DNA, 25 bp, Mus musculus
ttgtcaactcctcagaatttggtct

SEQ ID NO: 958930 - DNA, 25 bp, Mus musculus
ttgtcaactcctgagaatttggtct

SEQ ID NO: 958931 - DNA, 25 bp, Mus musculus
ttgtcaactgcaccaatgtacccag

SEQ ID NO: 958932 - DNA, 25 bp, Mus musculus
ttgtcaactgcagcaatgtacccag

SEQ ID NO: 958933 - DNA, 25 bp, Mus musculus
ttgtcaactgctcctgcaccccacc

SEQ ID NO: 958934 - DNA, 25 bp, Mus musculus
ttgtcaactgctgctgcaccccacc

SEQ ID NO: 958935 - DNA, 25 bp, Mus musculus
ttgtcaagaatgacagctgtcagtc

SEQ ID NO: 958936 - DNA, 25 bp, Mus musculus
ttgtcaagaatgtcagctgtcagtc

SEQ ID NO: 958937 - DNA, 25 bp, Mus musculus
ttgtcaagacccaagagctcgcaga

SEQ ID NO: 958938 - DNA, 25 bp, Mus musculus
ttgtcaagaccctagagctcgcaga

SEQ ID NO: 958939 - DNA, 25 bp, Mus musculus
ttgtcaagacctcgacgtgggcgca

SEQ ID NO: 958940 - DNA, 25 bp, Mus musculus
ttgtcaagacctggacgtgggcgca

SEQ ID NO: 958941 - DNA, 25 bp, Mus musculus
ttgtcaagcatcagggaatctcgtt

SEQ ID NO: 958942 - DNA, 25 bp, Mus musculus
ttgtcaagcatctgggaatctcgtt

SEQ ID NO: 958943 - DNA, 25 bp, Mus musculus
ttgtcaaggcgcaatgggtctgcag

SEQ ID NO: 958944 - DNA, 25 bp, Mus musculus
ttgtcaaggcgctatgggtctgcag

SEQ ID NO: 958945 - DNA, 25 bp, Mus musculus
ttgtcaagggaacagagtcaagaca

SEQ ID NO: 958946 - DNA, 25 bp, Mus musculus
ttgtcaagggaagagagtcaagaca

SEQ ID NO: 958947 - DNA, 25 bp, Mus musculus
ttgtcaaggtttacccacacacaca

SEQ ID NO: 958948 - DNA, 25 bp, Mus musculus
ttgtcaaggttttcccacacacaca

SEQ ID NO: 958949 - DNA, 25 bp, Mus musculus
ttgtcaagttcaccaaggcagcccc

SEQ ID NO: 958950 - DNA, 25 bp, Mus musculus
ttgtcaagttcagcaaggcagcccc

SEQ ID NO: 958951 - DNA, 25 bp, Mus musculus
ttgtcaatccggcttggccccattt

SEQ ID NO: 958952 - DNA, 25 bp, Mus musculus
ttgtcaatccgggttggccccattt

SEQ ID NO: 958953 - DNA, 25 bp, Mus musculus
ttgtcaatggagacattccgattag

SEQ ID NO: 958954 - DNA, 25 bp, Mus musculus
ttgtcaatggagtcattccgattag

SEQ ID NO: 958955 - DNA, 25 bp, Mus musculus
ttgtcaatgtgaccctagcatgtac

SEQ ID NO: 958956 - DNA, 25 bp, Mus musculus
ttgtcaatgtgagcctagcatgtac

SEQ ID NO: 958957 - DNA, 25 bp, Mus musculus
ttgtcaattgtgcactcgctgagtt

SEQ ID NO: 958958 - DNA, 25 bp, Mus musculus
ttgtcaattgtggactcgctgagtt

SEQ ID NO: 958959 - DNA, 25 bp, Mus musculus
ttgtcacaaaggcagctcacaccat

SEQ ID NO: 958960 - DNA, 25 bp, Mus musculus
ttgtcacaaagggagctcacaccat

SEQ ID NO: 958961 - DNA, 25 bp, Mus musculus
ttgtcacaacctaccggagggcaga

SEQ ID NO: 958962 - DNA, 25 bp, Mus musculus
ttgtcacaaccttccggagggcaga

SEQ ID NO: 958963 - DNA, 25 bp, Mus musculus
ttgtcacaagtgaggtttgctttcc

SEQ ID NO: 958964 - DNA, 25 bp, Mus musculus
ttgtcacaagtgtggtttgctttcc

SEQ ID NO: 958965 - DNA, 25 bp, Mus musculus
ttgtcacaatctagtcacagtctct

SEQ ID NO: 958966 - DNA, 25 bp, Mus musculus
ttgtcacaatcttgtcacagtctct

SEQ ID NO: 958967 - DNA, 25 bp, Mus musculus
ttgtcacaatttccaatcataaatg

SEQ ID NO: 958968 - DNA, 25 bp, Mus musculus
ttgtcacaatttgcaatcataaatg

SEQ ID NO: 958969 - DNA, 25 bp, Mus musculus
ttgtcacacctgaccccagtgagtg

SEQ ID NO: 958970 - DNA, 25 bp, Mus musculus
ttgtcacacctgtccccagtgagtg

SEQ ID NO: 958971 - DNA, 25 bp, Mus musculus
ttgtcacacttaacatcattcctgt

SEQ ID NO: 958972 - DNA, 25 bp, Mus musculus
ttgtcacacttatcatcattcctgt

SEQ ID NO: 958973 - DNA, 25 bp, Mus musculus
ttgtcacagcacagcaccatggaca

SEQ ID NO: 958974 - DNA, 25 bp, Mus musculus
ttgtcacagcactgcaccatggaca

SEQ ID NO: 958975 - DNA, 25 bp, Mus musculus
ttgtcacagcccagctcttttgtga

SEQ ID NO: 958976 - DNA, 25 bp, Mus musculus
ttgtcacagccctgctcttttgtga

SEQ ID NO: 958977 - DNA, 25 bp, Mus musculus
ttgtcacagctaccttgtcaccaac

SEQ ID NO: 958978 - DNA, 25 bp, Mus musculus
ttgtcacagctagcttgtcaccaac

SEQ ID NO: 958979 - DNA, 25 bp, Mus musculus
ttgtcacaggccattccctatttca

SEQ ID NO: 958980 - DNA, 25 bp, Mus musculus
ttgtcacaggcctttccctatttca

SEQ ID NO: 958981 - DNA, 25 bp, Mus musculus
ttgtcacaggtgactccccttcata

SEQ ID NO: 958982 - DNA, 25 bp, Mus musculus
ttgtcacaggtgtctccccttcata

SEQ ID NO: 958983 - DNA, 25 bp, Mus musculus
ttgtcacatagtaagaaagcagatc

SEQ ID NO: 958984 - DNA, 25 bp, Mus musculus
ttgtcacatagttagaaagcagatc

SEQ ID NO: 958985 - DNA, 25 bp, Mus musculus
ttgtcacatgccacagctgaggtca

SEQ ID NO: 958986 - DNA, 25 bp, Mus musculus
ttgtcacatgccagcgttgcttaaa

SEQ ID NO: 958987 - DNA, 25 bp, Mus musculus
ttgtcacatgcctcagctgaggtca

SEQ ID NO: 958988 - DNA, 25 bp, Mus musculus
ttgtcacatgcctgcgttgcttaaa

SEQ ID NO: 958989 - DNA, 25 bp, Mus musculus
ttgtcacattgtcggtcactgtcac

SEQ ID NO: 958990 - DNA, 25 bp, Mus musculus
ttgtcacattgtgggtcactgtcac

SEQ ID NO: 958991 - DNA, 25 bp, Mus musculus
ttgtcaccaacactgacgtctccat

SEQ ID NO: 958992 - DNA, 25 bp, Mus musculus
ttgtcaccaacagtgacgtctccat

SEQ ID NO: 958993 - DNA, 25 bp, Mus musculus
ttgtcaccaaccacgagattgtttc

SEQ ID NO: 958994 - DNA, 25 bp, Mus musculus
ttgtcaccaacctcgagattgtttc

SEQ ID NO: 958995 - DNA, 25 bp, Mus musculus
ttgtcaccagtcagcgttatgttaa

SEQ ID NO: 958996 - DNA, 25 bp, Mus musculus
ttgtcaccagtctgcgttatgttaa

SEQ ID NO: 958997 - DNA, 25 bp, Mus musculus
ttgtcaccatgcctgcaaggagaga

SEQ ID NO: 958998 - DNA, 25 bp, Mus musculus
ttgtcaccatgcgtgcaaggagaga

SEQ ID NO: 958999 - DNA, 25 bp, Mus musculus
ttgtcacccaaactttctctttttg

SEQ ID NO: 959000 - DNA, 25 bp, Mus musculus
ttgtcacccaaagtttctctttttg

SEQ ID NO: 959001 - DNA, 25 bp, Mus musculus
ttgtcacccacacctgcaaagaaag

SEQ ID NO: 959002 - DNA, 25 bp, Mus musculus
ttgtcacccacagctgcaaagaaag

SEQ ID NO: 959003 - DNA, 25 bp, Mus musculus
ttgtcacccaccattgtcagattta

SEQ ID NO: 959004 - DNA, 25 bp, Mus musculus
ttgtcacccacctttgtcagattta

SEQ ID NO: 959005 - DNA, 25 bp, Mus musculus
ttgtcacccctccataaagaaagta

SEQ ID NO: 959006 - DNA, 25 bp, Mus musculus
ttgtcacccctcgataaagaaagta

SEQ ID NO: 959007 - DNA, 25 bp, Mus musculus
ttgtcacccgagagagactgctcct

SEQ ID NO: 959008 - DNA, 25 bp, Mus musculus
ttgtcacccgagtgagactgctcct

SEQ ID NO: 959009 - DNA, 25 bp, Mus musculus
ttgtcacctgagaactttgccagtg

SEQ ID NO: 959010 - DNA, 25 bp, Mus musculus
ttgtcacctgagtactttgccagtg

SEQ ID NO: 959011 - DNA, 25 bp, Mus musculus
ttgtcacctggaactgtatacccac

SEQ ID NO: 959012 - DNA, 25 bp, Mus musculus
ttgtcacctggactccacataggat

SEQ ID NO: 959013 - DNA, 25 bp, Mus musculus
ttgtcacctggagtccacataggat

SEQ ID NO: 959014 - DNA, 25 bp, Mus musculus
ttgtcacctggatctgtatacccac

SEQ ID NO: 959015 - DNA, 25 bp, Mus musculus
ttgtcacctgtcatggaggactgtg

SEQ ID NO: 959016 - DNA, 25 bp, Mus musculus
ttgtcacctgtcttggaggactgtg

SEQ ID NO: 959017 - DNA, 25 bp, Mus musculus
ttgtcaccttagactgatcaatgtt

SEQ ID NO: 959018 - DNA, 25 bp, Mus musculus
ttgtcaccttagtctgatcaatgtt

SEQ ID NO: 959019 - DNA, 25 bp, Mus musculus
ttgtcacgacttctcggacccagaa

SEQ ID NO: 959020 - DNA, 25 bp, Mus musculus
ttgtcacgacttgtcggacccagaa

SEQ ID NO: 959021 - DNA, 25 bp, Mus musculus
ttgtcacgccagagcacacttgagg

SEQ ID NO: 959022 - DNA, 25 bp, Mus musculus
ttgtcacgccagtgcacacttgagg

SEQ ID NO: 959023 - DNA, 25 bp, Mus musculus
ttgtcacgctatctgatgtgcctgc

SEQ ID NO: 959024 - DNA, 25 bp, Mus musculus
ttgtcacgctatgtgatgtgcctgc

SEQ ID NO: 959025 - DNA, 25 bp, Mus musculus
ttgtcacgctgtccattgtggtgac

SEQ ID NO: 959026 - DNA, 25 bp, Mus musculus
ttgtcacgctgtgcattgtggtgac

SEQ ID NO: 959027 - DNA, 25 bp, Mus musculus
ttgtcacggcttcattggagcccta

SEQ ID NO: 959028 - DNA, 25 bp, Mus musculus
ttgtcacggcttgattggagcccta

SEQ ID NO: 959029 - DNA, 25 bp, Mus musculus
ttgtcacgttgcactcttggagtaa

SEQ ID NO: 959030 - DNA, 25 bp, Mus musculus
ttgtcacgttgctctcttggagtaa

SEQ ID NO: 959031 - DNA, 25 bp, Mus musculus
ttgtcactaaggcaaacctcctgag

SEQ ID NO: 959032 - DNA, 25 bp, Mus musculus
ttgtcactaagggaaacctcctgag

SEQ ID NO: 959033 - DNA, 25 bp, Mus musculus
ttgtcactaatcctcttctggcaga

SEQ ID NO: 959034 - DNA, 25 bp, Mus musculus
ttgtcactaatcgtcttctggcaga

SEQ ID NO: 959035 - DNA, 25 bp, Mus musculus
ttgtcactagaaaacgctcttggga

SEQ ID NO: 959036 - DNA, 25 bp, Mus musculus
ttgtcactagaatacgctcttggga

SEQ ID NO: 959037 - DNA, 25 bp, Mus musculus
ttgtcactagctcggcatgtgccaa

SEQ ID NO: 959038 - DNA, 25 bp, Mus musculus
ttgtcactagctgggcatgtgccaa

SEQ ID NO: 959039 - DNA, 25 bp, Mus musculus
ttgtcactagtcatgtctgttggcc

SEQ ID NO: 959040 - DNA, 25 bp, Mus musculus
ttgtcactagtcttgtctgttggcc

SEQ ID NO: 959041 - DNA, 25 bp, Mus musculus
ttgtcactcaagatttcatctgctt

SEQ ID NO: 959042 - DNA, 25 bp, Mus musculus
ttgtcactcaagttttcatctgctt

SEQ ID NO: 959043 - DNA, 25 bp, Mus musculus
ttgtcactctgtattgtactcataa

SEQ ID NO: 959044 - DNA, 25 bp, Mus musculus
ttgtcactctgttttgtactcataa

SEQ ID NO: 959045 - DNA, 25 bp, Mus musculus
ttgtcactcttcaccatttgtatat

SEQ ID NO: 959046 - DNA, 25 bp, Mus musculus
ttgtcactcttctccatttgtatat

SEQ ID NO: 959047 - DNA, 25 bp, Mus musculus
ttgtcactgaagcaactgtgcttac

SEQ ID NO: 959048 - DNA, 25 bp, Mus musculus
ttgtcactgaaggaactgtgcttac

SEQ ID NO: 959049 - DNA, 25 bp, Mus musculus
ttgtcactgacaattgctaaaccgt

SEQ ID NO: 959050 - DNA, 25 bp, Mus musculus
ttgtcactgacatttgctaaaccgt

SEQ ID NO: 959051 - DNA, 25 bp, Mus musculus
ttgtcactgcctaggaagcaaccta

SEQ ID NO: 959052 - DNA, 25 bp, Mus musculus
ttgtcactgccttggaagcaaccta

SEQ ID NO: 959053 - DNA, 25 bp, Mus musculus
ttgtcactggacacggtctcactgt

SEQ ID NO: 959054 - DNA, 25 bp, Mus musculus
ttgtcactggactcggtctcactgt

SEQ ID NO: 959055 - DNA, 25 bp, Mus musculus
ttgtcactgtccatggtgtataaca

SEQ ID NO: 959056 - DNA, 25 bp, Mus musculus
ttgtcactgtccttggtgtataaca

SEQ ID NO: 959057 - DNA, 25 bp, Mus musculus
ttgtcactgtgcagatgcttgtctc

SEQ ID NO: 959058 - DNA, 25 bp, Mus musculus
ttgtcactgtgctgatgcttgtctc

SEQ ID NO: 959059 - DNA, 25 bp, Mus musculus
ttgtcacttcctacttaacgcagtg

SEQ ID NO: 959060 - DNA, 25 bp, Mus musculus
ttgtcacttccttcttaacgcagtg

SEQ ID NO: 959061 - DNA, 25 bp, Mus musculus
ttgtcacttgaaatggcagatcgaa

SEQ ID NO: 959062 - DNA, 25 bp, Mus musculus
ttgtcacttgaattggcagatcgaa

SEQ ID NO: 959063 - DNA, 25 bp, Mus musculus
ttgtcacttgacaccgaaggacttc

SEQ ID NO: 959064 - DNA, 25 bp, Mus musculus
ttgtcacttgactccgaaggacttc

SEQ ID NO: 959065 - DNA, 25 bp, Mus musculus
ttgtcacttggtctacagccaggat

SEQ ID NO: 959066 - DNA, 25 bp, Mus musculus
ttgtcacttggtgtacagccaggat

SEQ ID NO: 959067 - DNA, 25 bp, Mus musculus
ttgtcacttttaacgatggctcttt

SEQ ID NO: 959068 - DNA, 25 bp, Mus musculus
ttgtcacttttatcgatggctcttt

SEQ ID NO: 959069 - DNA, 25 bp, Mus musculus
ttgtcacttttgagtaccagcttcc

SEQ ID NO: 959070 - DNA, 25 bp, Mus musculus
ttgtcacttttgtgtaccagcttcc

SEQ ID NO: 959071 - DNA, 25 bp, Mus musculus
ttgtcagaaattcccttctaaggac

SEQ ID NO: 959072 - DNA, 25 bp, Mus musculus
ttgtcagaaattgccttctaaggac

SEQ ID NO: 959073 - DNA, 25 bp, Mus musculus
ttgtcagacactctgaggccagctc

SEQ ID NO: 959074 - DNA, 25 bp, Mus musculus
ttgtcagacactgtgaggccagctc

SEQ ID NO: 959075 - DNA, 25 bp, Mus musculus
ttgtcagacagcaagatgattccgt

SEQ ID NO: 959076 - DNA, 25 bp, Mus musculus
ttgtcagacagcaggaccgggatct

SEQ ID NO: 959077 - DNA, 25 bp, Mus musculus
ttgtcagacagctagatgattccgt

SEQ ID NO: 959078 - DNA, 25 bp, Mus musculus
ttgtcagacagctggaccgggatct

SEQ ID NO: 959079 - DNA, 25 bp, Mus musculus
ttgtcagacccaacaggaccaagga

SEQ ID NO: 959080 - DNA, 25 bp, Mus musculus
ttgtcagacccatcaggaccaagga

SEQ ID NO: 959081 - DNA, 25 bp, Mus musculus
ttgtcagaccccacacagatgttaa

SEQ ID NO: 959082 - DNA, 25 bp, Mus musculus
ttgtcagacccctcacagatgttaa

SEQ ID NO: 959083 - DNA, 25 bp, Mus musculus
ttgtcagacctgagatcccataggt

SEQ ID NO: 959084 - DNA, 25 bp, Mus musculus
ttgtcagacctgtgatcccataggt

SEQ ID NO: 959085 - DNA, 25 bp, Mus musculus
ttgtcagaccttctccaggaagctc

SEQ ID NO: 959086 - DNA, 25 bp, Mus musculus
ttgtcagaccttgtccaggaagctc

SEQ ID NO: 959087 - DNA, 25 bp, Mus musculus
ttgtcagactctagcattgttaacc

SEQ ID NO: 959088 - DNA, 25 bp, Mus musculus
ttgtcagactcttgcattgttaacc

SEQ ID NO: 959089 - DNA, 25 bp, Mus musculus
ttgtcagactgcacaaccttacttg

SEQ ID NO: 959090 - DNA, 25 bp, Mus musculus
ttgtcagactgctcaaccttacttg

SEQ ID NO: 959091 - DNA, 25 bp, Mus musculus
ttgtcagagcgtatcgtgttgctgt

SEQ ID NO: 959092 - DNA, 25 bp, Mus musculus
ttgtcagagcgtttcgtgttgctgt

SEQ ID NO: 959093 - DNA, 25 bp, Mus musculus
ttgtcagagcttattactgccccag

SEQ ID NO: 959094 - DNA, 25 bp, Mus musculus
ttgtcagagctttttactgccccag

SEQ ID NO: 959095 - DNA, 25 bp, Mus musculus
ttgtcagaggacaaaacccactcaa

SEQ ID NO: 959096 - DNA, 25 bp, Mus musculus
ttgtcagaggactaaacccactcaa

SEQ ID NO: 959097 - DNA, 25 bp, Mus musculus
ttgtcagagggaatcccactgcctt

SEQ ID NO: 959098 - DNA, 25 bp, Mus musculus
ttgtcagagggattcccactgcctt

SEQ ID NO: 959099 - DNA, 25 bp, Mus musculus
ttgtcagatactccttcctcggagt

SEQ ID NO: 959100 - DNA, 25 bp, Mus musculus
ttgtcagatactgcttcctcggagt

SEQ ID NO: 959101 - DNA, 25 bp, Mus musculus
ttgtcagatcccacacaacatggtc

SEQ ID NO: 959102 - DNA, 25 bp, Mus musculus
ttgtcagatccctcacaacatggtc

SEQ ID NO: 959103 - DNA, 25 bp, Mus musculus
ttgtcagatcttctctcagtgcact

SEQ ID NO: 959104 - DNA, 25 bp, Mus musculus
ttgtcagatcttgtctcagtgcact

SEQ ID NO: 959105 - DNA, 25 bp, Mus musculus
ttgtcagatttcacccggcgggcat

SEQ ID NO: 959106 - DNA, 25 bp, Mus musculus
ttgtcagatttcctgagcctctgta

SEQ ID NO: 959107 - DNA, 25 bp, Mus musculus
ttgtcagatttcgtgagcctctgta

SEQ ID NO: 959108 - DNA, 25 bp, Mus musculus
ttgtcagatttctcccggcgggcat

SEQ ID NO: 959109 - DNA, 25 bp, Mus musculus
ttgtcagcaagaacagccggcagtc

SEQ ID NO: 959110 - DNA, 25 bp, Mus musculus
ttgtcagcaagatcagccggcagtc

SEQ ID NO: 959111 - DNA, 25 bp, Mus musculus
ttgtcagcaagtctccagttaacct

SEQ ID NO: 959112 - DNA, 25 bp, Mus musculus
ttgtcagcaagtgtccagttaacct

SEQ ID NO: 959113 - DNA, 25 bp, Mus musculus
ttgtcagcacggacctgatgggtat

SEQ ID NO: 959114 - DNA, 25 bp, Mus musculus
ttgtcagcacggtcctgatgggtat

SEQ ID NO: 959115 - DNA, 25 bp, Mus musculus
ttgtcagcaggaacaccaggcagtt

SEQ ID NO: 959116 - DNA, 25 bp, Mus musculus
ttgtcagcaggactgactccatcac

SEQ ID NO: 959117 - DNA, 25 bp, Mus musculus
ttgtcagcaggagtgactccatcac

SEQ ID NO: 959118 - DNA, 25 bp, Mus musculus
ttgtcagcaggatcaccaggcagtt

SEQ ID NO: 959119 - DNA, 25 bp, Mus musculus
ttgtcagcatagcacttgttaaggc

SEQ ID NO: 959120 - DNA, 25 bp, Mus musculus
ttgtcagcataggacttgttaaggc

SEQ ID NO: 959121 - DNA, 25 bp, Mus musculus
ttgtcagcatggactactcggagga

SEQ ID NO: 959122 - DNA, 25 bp, Mus musculus
ttgtcagcatggtctactcggagga

SEQ ID NO: 959123 - DNA, 25 bp, Mus musculus
ttgtcagccaatctggtcactgtga

SEQ ID NO: 959124 - DNA, 25 bp, Mus musculus
ttgtcagccaatgtggtcactgtga

SEQ ID NO: 959125 - DNA, 25 bp, Mus musculus
ttgtcagccatgacgaaccctagaa

SEQ ID NO: 959126 - DNA, 25 bp, Mus musculus
ttgtcagccatgtcgaaccctagaa

SEQ ID NO: 959127 - DNA, 25 bp, Mus musculus
ttgtcagcctcaaacccttgtttac

SEQ ID NO: 959128 - DNA, 25 bp, Mus musculus
ttgtcagcctcatacccttgtttac

SEQ ID NO: 959129 - DNA, 25 bp, Mus musculus
ttgtcagcgcggatggatttgttgc

SEQ ID NO: 959130 - DNA, 25 bp, Mus musculus
ttgtcagcgcggttggatttgttgc

SEQ ID NO: 959131 - DNA, 25 bp, Mus musculus
ttgtcagcgttcagttgtcaacttg

SEQ ID NO: 959132 - DNA, 25 bp, Mus musculus
ttgtcagcgttctgttgtcaacttg

SEQ ID NO: 959133 - DNA, 25 bp, Mus musculus
ttgtcagctttgatgtctgtaggct

SEQ ID NO: 959134 - DNA, 25 bp, Mus musculus
ttgtcagctttgttgtctgtaggct

SEQ ID NO: 959135 - DNA, 25 bp, Mus musculus
ttgtcaggattcacggaccttggta

SEQ ID NO: 959136 - DNA, 25 bp, Mus musculus
ttgtcaggattctcggaccttggta

SEQ ID NO: 959137 - DNA, 25 bp, Mus musculus
ttgtcaggcataccatcatgtgttt

SEQ ID NO: 959138 - DNA, 25 bp, Mus musculus
ttgtcaggcatagcatcatgtgttt

SEQ ID NO: 959139 - DNA, 25 bp, Mus musculus
ttgtcaggccaaaaacagcaaatgg

SEQ ID NO: 959140 - DNA, 25 bp, Mus musculus
ttgtcaggccaataacagcaaatgg

SEQ ID NO: 959141 - DNA, 25 bp, Mus musculus
ttgtcaggcgccagggcagctagtt

SEQ ID NO: 959142 - DNA, 25 bp, Mus musculus
ttgtcaggcgcctgggcagctagtt

SEQ ID NO: 959143 - DNA, 25 bp, Mus musculus
ttgtcaggcttcataaacgaggttg

SEQ ID NO: 959144 - DNA, 25 bp, Mus musculus
ttgtcaggcttcttaaacgaggttg

SEQ ID NO: 959145 - DNA, 25 bp, Mus musculus
ttgtcagggttgatggtgacctcat

SEQ ID NO: 959146 - DNA, 25 bp, Mus musculus
ttgtcagggttgttggtgacctcat

SEQ ID NO: 959147 - DNA, 25 bp, Mus musculus
ttgtcaggtgtcaggagcagatcta

SEQ ID NO: 959148 - DNA, 25 bp, Mus musculus
ttgtcaggtgtctggagcagatcta

SEQ ID NO: 959149 - DNA, 25 bp, Mus musculus
ttgtcaggttcgctggcaagagcct

SEQ ID NO: 959150 - DNA, 25 bp, Mus musculus
ttgtcaggttcggtggcaagagcct

SEQ ID NO: 959151 - DNA, 25 bp, Mus musculus
ttgtcagtaaagctcattggctctc

SEQ ID NO: 959152 - DNA, 25 bp, Mus musculus
ttgtcagtaaaggtcattggctctc

SEQ ID NO: 959153 - DNA, 25 bp, Mus musculus
ttgtcagtatttatctatctcaccg

SEQ ID NO: 959154 - DNA, 25 bp, Mus musculus
ttgtcagtatttttctatctcaccg

SEQ ID NO: 959155 - DNA, 25 bp, Mus musculus
ttgtcagtcacgaggatgtcaacac

SEQ ID NO: 959156 - DNA, 25 bp, Mus musculus
ttgtcagtcacgtggatgtcaacac

SEQ ID NO: 959157 - DNA, 25 bp, Mus musculus
ttgtcagtcatccttctgaacccag

SEQ ID NO: 959158 - DNA, 25 bp, Mus musculus
ttgtcagtcatcgttctgaacccag

SEQ ID NO: 959159 - DNA, 25 bp, Mus musculus
ttgtcagtccctcttggtatctttt

SEQ ID NO: 959160 - DNA, 25 bp, Mus musculus
ttgtcagtccctgttggtatctttt

SEQ ID NO: 959161 - DNA, 25 bp, Mus musculus
ttgtcagtctcacggaaatcccacg

SEQ ID NO: 959162 - DNA, 25 bp, Mus musculus
ttgtcagtctcagggaaatcccacg

SEQ ID NO: 959163 - DNA, 25 bp, Mus musculus
ttgtcagtcttgacccacagatgtc

SEQ ID NO: 959164 - DNA, 25 bp, Mus musculus
ttgtcagtcttgtcccacagatgtc

SEQ ID NO: 959165 - DNA, 25 bp, Mus musculus
ttgtcagtgatgaggcaaccctata

SEQ ID NO: 959166 - DNA, 25 bp, Mus musculus
ttgtcagtgatgtggcaaccctata

SEQ ID NO: 959167 - DNA, 25 bp, Mus musculus
ttgtcagtgggaccgatctgccatc

SEQ ID NO: 959168 - DNA, 25 bp, Mus musculus
ttgtcagtgggagcgatctgccatc

SEQ ID NO: 959169 - DNA, 25 bp, Mus musculus
ttgtcagttacgatccagtcaatgg

SEQ ID NO: 959170 - DNA, 25 bp, Mus musculus
ttgtcagttacgttccagtcaatgg

SEQ ID NO: 959171 - DNA, 25 bp, Mus musculus
ttgtcagttctcaaacagcatgtaa

SEQ ID NO: 959172 - DNA, 25 bp, Mus musculus
ttgtcagttctctaacagcatgtaa

SEQ ID NO: 959173 - DNA, 25 bp, Mus musculus
ttgtcagttttgattggccattaca

SEQ ID NO: 959174 - DNA, 25 bp, Mus musculus
ttgtcagttttgtttggccattaca

SEQ ID NO: 959175 - DNA, 25 bp, Mus musculus
ttgtcataaagcctcccacctgtga

SEQ ID NO: 959176 - DNA, 25 bp, Mus musculus
ttgtcataaagcgtcccacctgtga

SEQ ID NO: 959177 - DNA, 25 bp, Mus musculus
ttgtcatacacactagttcccacca

SEQ ID NO: 959178 - DNA, 25 bp, Mus musculus
ttgtcatacacagtagttcccacca

SEQ ID NO: 959179 - DNA, 25 bp, Mus musculus
ttgtcatactccaactctcccagct

SEQ ID NO: 959180 - DNA, 25 bp, Mus musculus
ttgtcatactcctactctcccagct

SEQ ID NO: 959181 - DNA, 25 bp, Mus musculus
ttgtcatagataaaggcagagccca

SEQ ID NO: 959182 - DNA, 25 bp, Mus musculus
ttgtcatagatataggcagagccca

SEQ ID NO: 959183 - DNA, 25 bp, Mus musculus
ttgtcatagtgactcctgtcacatt

SEQ ID NO: 959184 - DNA, 25 bp, Mus musculus
ttgtcatagtgagtcctgtcacatt

SEQ ID NO: 959185 - DNA, 25 bp, Mus musculus
ttgtcatatttcagccgttaaccgt

SEQ ID NO: 959186 - DNA, 25 bp, Mus musculus
ttgtcatatttctgccgttaaccgt

SEQ ID NO: 959187 - DNA, 25 bp, Mus musculus
ttgtcatcagtgactgtgtcctctg

SEQ ID NO: 959188 - DNA, 25 bp, Mus musculus
ttgtcatcagtgtctgtgtcctctg

SEQ ID NO: 959189 - DNA, 25 bp, Mus musculus
ttgtcatcatttaggcctttacttg

SEQ ID NO: 959190 - DNA, 25 bp, Mus musculus
ttgtcatcattttggcctttacttg

SEQ ID NO: 959191 - DNA, 25 bp, Mus musculus
ttgtcatccaatagattcctaccct

SEQ ID NO: 959192 - DNA, 25 bp, Mus musculus
ttgtcatccaattgattcctaccct

SEQ ID NO: 959193 - DNA, 25 bp, Mus musculus
ttgtcatccacaagccatctaagta

SEQ ID NO: 959194 - DNA, 25 bp, Mus musculus
ttgtcatccacatgccatctaagta

SEQ ID NO: 959195 - DNA, 25 bp, Mus musculus
ttgtcatcggatatagctaccctgt

SEQ ID NO: 959196 - DNA, 25 bp, Mus musculus
ttgtcatcggatttagctaccctgt

SEQ ID NO: 959197 - DNA, 25 bp, Mus musculus
ttgtcatctcctagcagaatgccag

SEQ ID NO: 959198 - DNA, 25 bp, Mus musculus
ttgtcatctccttgcagaatgccag

SEQ ID NO: 959199 - DNA, 25 bp, Mus musculus
ttgtcatctgggaggctagccttga

SEQ ID NO: 959200 - DNA, 25 bp, Mus musculus
ttgtcatctgggtggctagccttga

SEQ ID NO: 959201 - DNA, 25 bp, Mus musculus
ttgtcatcttatatcagcctacctc

SEQ ID NO: 959202 - DNA, 25 bp, Mus musculus
ttgtcatcttatttcagcctacctc

SEQ ID NO: 959203 - DNA, 25 bp, Mus musculus
ttgtcatcttcaacactctcatagc

SEQ ID NO: 959204 - DNA, 25 bp, Mus musculus
ttgtcatcttcatcactctcatagc

SEQ ID NO: 959205 - DNA, 25 bp, Mus musculus
ttgtcatcttccactgtgcagcacc

SEQ ID NO: 959206 - DNA, 25 bp, Mus musculus
ttgtcatcttcctctgtgcagcacc

SEQ ID NO: 959207 - DNA, 25 bp, Mus musculus
ttgtcatctttactgttgcgcatgt

SEQ ID NO: 959208 - DNA, 25 bp, Mus musculus
ttgtcatctttagtgttgcgcatgt

SEQ ID NO: 959209 - DNA, 25 bp, Mus musculus
ttgtcatctttgacttcccaatatc

SEQ ID NO: 959210 - DNA, 25 bp, Mus musculus
ttgtcatctttgtcttcccaatatc

SEQ ID NO: 959211 - DNA, 25 bp, Mus musculus
ttgtcatgaactatatccgtaacct

SEQ ID NO: 959212 - DNA, 25 bp, Mus musculus
ttgtcatgaactttatccgtaacct

SEQ ID NO: 959213 - DNA, 25 bp, Mus musculus
ttgtcatgccgtagcttacccagaa

SEQ ID NO: 959214 - DNA, 25 bp, Mus musculus
ttgtcatgccgttgcttacccagaa

SEQ ID NO: 959215 - DNA, 25 bp, Mus musculus
ttgtcatgctcacaggtcctactgc

SEQ ID NO: 959216 - DNA, 25 bp, Mus musculus
ttgtcatgctcagaggtcctactgc

SEQ ID NO: 959217 - DNA, 25 bp, Mus musculus
ttgtcatggaaacgtgctcgggctt

SEQ ID NO: 959218 - DNA, 25 bp, Mus musculus
ttgtcatggaaaggtgctcgggctt

SEQ ID NO: 959219 - DNA, 25 bp, Mus musculus
ttgtcatggagaagccctgtctgtg

SEQ ID NO: 959220 - DNA, 25 bp, Mus musculus
ttgtcatggagatgccctgtctgtg

SEQ ID NO: 959221 - DNA, 25 bp, Mus musculus
ttgtcatggcaaccagcttctgaaa

SEQ ID NO: 959222 - DNA, 25 bp, Mus musculus
ttgtcatggcaagcagcttctgaaa

SEQ ID NO: 959223 - DNA, 25 bp, Mus musculus
ttgtcatggcagctcctgtttatag

SEQ ID NO: 959224 - DNA, 25 bp, Mus musculus
ttgtcatggcaggtcctgtttatag

SEQ ID NO: 959225 - DNA, 25 bp, Mus musculus
ttgtcatggctacagcatctctctg

SEQ ID NO: 959226 - DNA, 25 bp, Mus musculus
ttgtcatggctagagcatctctctg

SEQ ID NO: 959227 - DNA, 25 bp, Mus musculus
ttgtcatggtgaaactataactatc

SEQ ID NO: 959228 - DNA, 25 bp, Mus musculus
ttgtcatggtgatactataactatc

SEQ ID NO: 959229 - DNA, 25 bp, Mus musculus
ttgtcatggtggagacaggctttga

SEQ ID NO: 959230 - DNA, 25 bp, Mus musculus
ttgtcatggtggtgacaggctttga

SEQ ID NO: 959231 - DNA, 25 bp, Mus musculus
ttgtcatgtatgagtagatcctggg

SEQ ID NO: 959232 - DNA, 25 bp, Mus musculus
ttgtcatgtatgtgtagatcctggg

SEQ ID NO: 959233 - DNA, 25 bp, Mus musculus
ttgtcatgtcagacgccaaggccaa

SEQ ID NO: 959234 - DNA, 25 bp, Mus musculus
ttgtcatgtcagtcgccaaggccaa

SEQ ID NO: 959235 - DNA, 25 bp, Mus musculus
ttgtcatgtctacctgagtctggca

SEQ ID NO: 959236 - DNA, 25 bp, Mus musculus
ttgtcatgtctagctgagtctggca

SEQ ID NO: 959237 - DNA, 25 bp, Mus musculus
ttgtcatgtcttctgaagcagtgct

SEQ ID NO: 959238 - DNA, 25 bp, Mus musculus
ttgtcatgtcttgtgaagcagtgct

SEQ ID NO: 959239 - DNA, 25 bp, Mus musculus
ttgtcatgttcacccgcatacacca

SEQ ID NO: 959240 - DNA, 25 bp, Mus musculus
ttgtcatgttcagccgcatacacca

SEQ ID NO: 959241 - DNA, 25 bp, Mus musculus
ttgtcatgttccctgctaatggcag

SEQ ID NO: 959242 - DNA, 25 bp, Mus musculus
ttgtcatgttccgtgctaatggcag

SEQ ID NO: 959243 - DNA, 25 bp, Mus musculus
ttgtcattcagccactgctagccaa

SEQ ID NO: 959244 - DNA, 25 bp, Mus musculus
ttgtcattcagcgactgctagccaa

SEQ ID NO: 959245 - DNA, 25 bp, Mus musculus
ttgtcattcaggatgacttcaatgt

SEQ ID NO: 959246 - DNA, 25 bp, Mus musculus
ttgtcattcaggttgacttcaatgt

SEQ ID NO: 959247 - DNA, 25 bp, Mus musculus
ttgtcattcagtctactaaccttga

SEQ ID NO: 959248 - DNA, 25 bp, Mus musculus
ttgtcattcagtgtactaaccttga

SEQ ID NO: 959249 - DNA, 25 bp, Mus musculus
ttgtcattctctcccattatggtcg

SEQ ID NO: 959250 - DNA, 25 bp, Mus musculus
ttgtcattctctgccattatggtcg

SEQ ID NO: 959251 - DNA, 25 bp, Mus musculus
ttgtcattcttcaacctgacgcaaa

SEQ ID NO: 959252 - DNA, 25 bp, Mus musculus
ttgtcattcttctacctgacgcaaa

SEQ ID NO: 959253 - DNA, 25 bp, Mus musculus
ttgtcattggccaaggtcagtcctg

SEQ ID NO: 959254 - DNA, 25 bp, Mus musculus
ttgtcattggcctaggtcagtcctg

SEQ ID NO: 959255 - DNA, 25 bp, Mus musculus
ttgtcatttctcacgactccgggag

SEQ ID NO: 959256 - DNA, 25 bp, Mus musculus
ttgtcatttctctcgactccgggag

SEQ ID NO: 959257 - DNA, 25 bp, Mus musculus
ttgtcatttggtcagaagttacgtg

SEQ ID NO: 959258 - DNA, 25 bp, Mus musculus
ttgtcatttggtgagaagttacgtg

SEQ ID NO: 959259 - DNA, 25 bp, Mus musculus
ttgtcattttcgctcaaaccccagg

SEQ ID NO: 959260 - DNA, 25 bp, Mus musculus
ttgtcattttcggtcaaaccccagg

SEQ ID NO: 959261 - DNA, 25 bp, Mus musculus
ttgtcatttttcactccaccaaaag

SEQ ID NO: 959262 - DNA, 25 bp, Mus musculus
ttgtcatttttctctccaccaaaag

SEQ ID NO: 959263 - DNA, 25 bp, Mus musculus
ttgtccaaaagaccagctgctgcga

SEQ ID NO: 959264 - DNA, 25 bp, Mus musculus
ttgtccaaaagagcagctgctgcga

SEQ ID NO: 959265 - DNA, 25 bp, Mus musculus
ttgtccaaagcacctttgttcacta

SEQ ID NO: 959266 - DNA, 25 bp, Mus musculus
ttgtccaaagcagctttgttcacta

SEQ ID NO: 959267 - DNA, 25 bp, Mus musculus
ttgtccaaatgcatcaccctgaagc

SEQ ID NO: 959268 - DNA, 25 bp, Mus musculus
ttgtccaaatgcttcaccctgaagc

SEQ ID NO: 959269 - DNA, 25 bp, Mus musculus
ttgtccaaatgtacatcaacacgtc

SEQ ID NO: 959270 - DNA, 25 bp, Mus musculus
ttgtccaaatgttcatcaacacgtc

SEQ ID NO: 959271 - DNA, 25 bp, Mus musculus
ttgtccaacaagaggagcctgtccc

SEQ ID NO: 959272 - DNA, 25 bp, Mus musculus
ttgtccaacaagtggagcctgtccc

SEQ ID NO: 959273 - DNA, 25 bp, Mus musculus
ttgtccaacatgattgtgcgctcct

SEQ ID NO: 959274 - DNA, 25 bp, Mus musculus
ttgtccaacatgtttgtgcgctcct

SEQ ID NO: 959275 - DNA, 25 bp, Mus musculus
ttgtccaacctgcttgacagaccag

SEQ ID NO: 959276 - DNA, 25 bp, Mus musculus
ttgtccaacctggttgacagaccag

SEQ ID NO: 959277 - DNA, 25 bp, Mus musculus
ttgtccaacttgactgtcctgatgc

SEQ ID NO: 959278 - DNA, 25 bp, Mus musculus
ttgtccaacttgtctgtcctgatgc

SEQ ID NO: 959279 - DNA, 25 bp, Mus musculus
ttgtccaagcttcaagtgatttgga

SEQ ID NO: 959280 - DNA, 25 bp, Mus musculus
ttgtccaagcttgaagtgatttgga

SEQ ID NO: 959281 - DNA, 25 bp, Mus musculus
ttgtccacaacaccacctggtgata

SEQ ID NO: 959282 - DNA, 25 bp, Mus musculus
ttgtccacaacagcacctggtgata

SEQ ID NO: 959283 - DNA, 25 bp, Mus musculus
ttgtccacaagaaaactctttctgg

SEQ ID NO: 959284 - DNA, 25 bp, Mus musculus
ttgtccacaagataactctttctgg

SEQ ID NO: 959285 - DNA, 25 bp, Mus musculus
ttgtccacactacgttgccctctgt

SEQ ID NO: 959286 - DNA, 25 bp, Mus musculus
ttgtccacactaggttgccctctgt

SEQ ID NO: 959287 - DNA, 25 bp, Mus musculus
ttgtccacagacaagatcttggaat

SEQ ID NO: 959288 - DNA, 25 bp, Mus musculus
ttgtccacagactagatcttggaat

SEQ ID NO: 959289 - DNA, 25 bp, Mus musculus
ttgtccacagtcaaggaggtgccct

SEQ ID NO: 959290 - DNA, 25 bp, Mus musculus
ttgtccacagtctaggaggtgccct

SEQ ID NO: 959291 - DNA, 25 bp, Mus musculus
ttgtccacatggaactgcaggaggc

SEQ ID NO: 959292 - DNA, 25 bp, Mus musculus
ttgtccacatggtactgcaggaggc

SEQ ID NO: 959293 - DNA, 25 bp, Mus musculus
ttgtccacccctaggcttaaaggat

SEQ ID NO: 959294 - DNA, 25 bp, Mus musculus
ttgtccaccccttggcttaaaggat

SEQ ID NO: 959295 - DNA, 25 bp, Mus musculus
ttgtccaccctgctaagatatatac

SEQ ID NO: 959296 - DNA, 25 bp, Mus musculus
ttgtccaccctggtaagatatatac

SEQ ID NO: 959297 - DNA, 25 bp, Mus musculus
ttgtccaccgtcatcttggccttgg

SEQ ID NO: 959298 - DNA, 25 bp, Mus musculus
ttgtccaccgtcatgcagcacagaa

SEQ ID NO: 959299 - DNA, 25 bp, Mus musculus
ttgtccaccgtcttcttggccttgg

SEQ ID NO: 959300 - DNA, 25 bp, Mus musculus
ttgtccaccgtcttgcagcacagaa

SEQ ID NO: 959301 - DNA, 25 bp, Mus musculus
ttgtccacctcaacggttacagaag

SEQ ID NO: 959302 - DNA, 25 bp, Mus musculus
ttgtccacctcatcggttacagaag

SEQ ID NO: 959303 - DNA, 25 bp, Mus musculus
ttgtccaccttgagggaggtcatgc

SEQ ID NO: 959304 - DNA, 25 bp, Mus musculus
ttgtccaccttgtgggaggtcatgc

SEQ ID NO: 959305 - DNA, 25 bp, Mus musculus
ttgtccacgggaagtcaggttgacc

SEQ ID NO: 959306 - DNA, 25 bp, Mus musculus
ttgtccacgggatgtcaggttgacc

SEQ ID NO: 959307 - DNA, 25 bp, Mus musculus
ttgtccactcctatgtgaattgtta

SEQ ID NO: 959308 - DNA, 25 bp, Mus musculus
ttgtccactcctttgtgaattgtta

SEQ ID NO: 959309 - DNA, 25 bp, Mus musculus
ttgtccactctactcttacctttgt

SEQ ID NO: 959310 - DNA, 25 bp, Mus musculus
ttgtccactctagtcttacctttgt

SEQ ID NO: 959311 - DNA, 25 bp, Mus musculus
ttgtccactgaacttgtcttaccaa

SEQ ID NO: 959312 - DNA, 25 bp, Mus musculus
ttgtccactgaagttgtcttaccaa

SEQ ID NO: 959313 - DNA, 25 bp, Mus musculus
ttgtccacttctctgaggcggagga

SEQ ID NO: 959314 - DNA, 25 bp, Mus musculus
ttgtccacttctgtgaggcggagga

SEQ ID NO: 959315 - DNA, 25 bp, Mus musculus
ttgtccacttggacgatgtctatac

SEQ ID NO: 959316 - DNA, 25 bp, Mus musculus
ttgtccacttggtcgatgtctatac

SEQ ID NO: 959317 - DNA, 25 bp, Mus musculus
ttgtccagacacctcttgggtttca

SEQ ID NO: 959318 - DNA, 25 bp, Mus musculus
ttgtccagacacgtcttgggtttca

SEQ ID NO: 959319 - DNA, 25 bp, Mus musculus
ttgtccagacccagtgaagatttag

SEQ ID NO: 959320 - DNA, 25 bp, Mus musculus
ttgtccagaccctgtgaagatttag

SEQ ID NO: 959321 - DNA, 25 bp, Mus musculus
ttgtccagacctctgagccgagtac

SEQ ID NO: 959322 - DNA, 25 bp, Mus musculus
ttgtccagacctgtgagccgagtac

SEQ ID NO: 959323 - DNA, 25 bp, Mus musculus
ttgtccagactgagcctccgtgggc

SEQ ID NO: 959324 - DNA, 25 bp, Mus musculus
ttgtccagactgctttggtggctag

SEQ ID NO: 959325 - DNA, 25 bp, Mus musculus
ttgtccagactggtttggtggctag

SEQ ID NO: 959326 - DNA, 25 bp, Mus musculus
ttgtccagactgtgcctccgtgggc

SEQ ID NO: 959327 - DNA, 25 bp, Mus musculus
ttgtccagagaaatccaggcatgat

SEQ ID NO: 959328 - DNA, 25 bp, Mus musculus
ttgtccagagaattccaggcatgat

SEQ ID NO: 959329 - DNA, 25 bp, Mus musculus
ttgtccagccttatgagtctgggca

SEQ ID NO: 959330 - DNA, 25 bp, Mus musculus
ttgtccagccttttgagtctgggca

SEQ ID NO: 959331 - DNA, 25 bp, Mus musculus
ttgtccagtacacagcagtcagtca

SEQ ID NO: 959332 - DNA, 25 bp, Mus musculus
ttgtccagtacagagcagtcagtca

SEQ ID NO: 959333 - DNA, 25 bp, Mus musculus
ttgtccagtctgacatcttttagca

SEQ ID NO: 959334 - DNA, 25 bp, Mus musculus
ttgtccagtctgtcatcttttagca

SEQ ID NO: 959335 - DNA, 25 bp, Mus musculus
ttgtccagtcttcgccaggagagaa

SEQ ID NO: 959336 - DNA, 25 bp, Mus musculus
ttgtccagtcttggccaggagagaa

SEQ ID NO: 959337 - DNA, 25 bp, Mus musculus
ttgtccagtgctatactttctgcct

SEQ ID NO: 959338 - DNA, 25 bp, Mus musculus
ttgtccagtgctttactttctgcct

SEQ ID NO: 959339 - DNA, 25 bp, Mus musculus
ttgtccagtggaacacccaaggcca

SEQ ID NO: 959340 - DNA, 25 bp, Mus musculus
ttgtccagtggatcacccaaggcca

SEQ ID NO: 959341 - DNA, 25 bp, Mus musculus
ttgtccagtgtacgcccagcatttg

SEQ ID NO: 959342 - DNA, 25 bp, Mus musculus
ttgtccagtgtaggcccagcatttg

SEQ ID NO: 959343 - DNA, 25 bp, Mus musculus
ttgtccagtgtgatctgaagcgtgt

SEQ ID NO: 959344 - DNA, 25 bp, Mus musculus
ttgtccagtgtgttctgaagcgtgt

SEQ ID NO: 959345 - DNA, 25 bp, Mus musculus
ttgtccagttggctgggcctagcat

SEQ ID NO: 959346 - DNA, 25 bp, Mus musculus
ttgtccagttgggtgggcctagcat

SEQ ID NO: 959347 - DNA, 25 bp, Mus musculus
ttgtccatacaaatttgtctcctcc

SEQ ID NO: 959348 - DNA, 25 bp, Mus musculus
ttgtccatacaattttgtctcctcc

SEQ ID NO: 959349 - DNA, 25 bp, Mus musculus
ttgtccatattaatatgtcccatag

SEQ ID NO: 959350 - DNA, 25 bp, Mus musculus
ttgtccatattattatgtcccatag

SEQ ID NO: 959351 - DNA, 25 bp, Mus musculus
ttgtccatccgtcctttaggtaggg

SEQ ID NO: 959352 - DNA, 25 bp, Mus musculus
ttgtccatccgtgctttaggtaggg

SEQ ID NO: 959353 - DNA, 25 bp, Mus musculus
ttgtccatctcaaccacactggaag

SEQ ID NO: 959354 - DNA, 25 bp, Mus musculus
ttgtccatctcatccacactggaag

SEQ ID NO: 959355 - DNA, 25 bp, Mus musculus
ttgtccatggccacagcgtcaacgg

SEQ ID NO: 959356 - DNA, 25 bp, Mus musculus
ttgtccatggcctcagcgtcaacgg

SEQ ID NO: 959357 - DNA, 25 bp, Mus musculus
ttgtccatgtgcactgctcattaaa

SEQ ID NO: 959358 - DNA, 25 bp, Mus musculus
ttgtccatgtgctctgctcattaaa

SEQ ID NO: 959359 - DNA, 25 bp, Mus musculus
ttgtccatgttgctggagatgaccc

SEQ ID NO: 959360 - DNA, 25 bp, Mus musculus
ttgtccatgttggtggagatgaccc

SEQ ID NO: 959361 - DNA, 25 bp, Mus musculus
ttgtccattcaacaacactccaatg

SEQ ID NO: 959362 - DNA, 25 bp, Mus musculus
ttgtccattcaagaacactccaatg

SEQ ID NO: 959363 - DNA, 25 bp, Mus musculus
ttgtccattggtatgattgatcagt

SEQ ID NO: 959364 - DNA, 25 bp, Mus musculus
ttgtccattggtttgattgatcagt

SEQ ID NO: 959365 - DNA, 25 bp, Mus musculus
ttgtccattgtcattctgctcaccc

SEQ ID NO: 959366 - DNA, 25 bp, Mus musculus
ttgtccattgtctttctgctcaccc

SEQ ID NO: 959367 - DNA, 25 bp, Mus musculus
ttgtccatttctctgacttctgaac

SEQ ID NO: 959368 - DNA, 25 bp, Mus musculus
ttgtccatttctgtgacttctgaac

SEQ ID NO: 959369 - DNA, 25 bp, Mus musculus
ttgtccatttgtaaactcccggatt

SEQ ID NO: 959370 - DNA, 25 bp, Mus musculus
ttgtccatttgtccatcagacccat

SEQ ID NO: 959371 - DNA, 25 bp, Mus musculus
ttgtccatttgtgcatcagacccat

SEQ ID NO: 959372 - DNA, 25 bp, Mus musculus
ttgtccatttgttaactcccggatt

SEQ ID NO: 959373 - DNA, 25 bp, Mus musculus
ttgtcccaagccatcaccagaaagt

SEQ ID NO: 959374 - DNA, 25 bp, Mus musculus
ttgtcccaagccttcaccagaaagt

SEQ ID NO: 959375 - DNA, 25 bp, Mus musculus
ttgtcccaatatactaacctttatg

SEQ ID NO: 959376 - DNA, 25 bp, Mus musculus
ttgtcccaatattctaacctttatg

SEQ ID NO: 959377 - DNA, 25 bp, Mus musculus
ttgtcccaatgaacttgccacacaa

SEQ ID NO: 959378 - DNA, 25 bp, Mus musculus
ttgtcccaatgatcttgccacacaa

SEQ ID NO: 959379 - DNA, 25 bp, Mus musculus
ttgtcccaggtgatcttcccagact

SEQ ID NO: 959380 - DNA, 25 bp, Mus musculus
ttgtcccaggtgttcttcccagact

SEQ ID NO: 959381 - DNA, 25 bp, Mus musculus
ttgtcccaggttcttcaccgaagcg

SEQ ID NO: 959382 - DNA, 25 bp, Mus musculus
ttgtcccaggttgttcaccgaagcg

SEQ ID NO: 959383 - DNA, 25 bp, Mus musculus
ttgtcccatactccatcctatatga

SEQ ID NO: 959384 - DNA, 25 bp, Mus musculus
ttgtcccatactgcatcctatatga

SEQ ID NO: 959385 - DNA, 25 bp, Mus musculus
ttgtcccataggctaaccagttatg

SEQ ID NO: 959386 - DNA, 25 bp, Mus musculus
ttgtcccatagggtaaccagttatg

SEQ ID NO: 959387 - DNA, 25 bp, Mus musculus
ttgtcccatccacagtctcgatgtg

SEQ ID NO: 959388 - DNA, 25 bp, Mus musculus
ttgtcccatccagagtctcgatgtg

SEQ ID NO: 959389 - DNA, 25 bp, Mus musculus
ttgtcccatggaaggctgatcgatt

SEQ ID NO: 959390 - DNA, 25 bp, Mus musculus
ttgtcccatggatggctgatcgatt

SEQ ID NO: 959391 - DNA, 25 bp, Mus musculus
ttgtcccatgggacctgaggaaggc

SEQ ID NO: 959392 - DNA, 25 bp, Mus musculus
ttgtcccatgggtcctgaggaaggc

SEQ ID NO: 959393 - DNA, 25 bp, Mus musculus
ttgtcccattggaaccatgaacaaa

SEQ ID NO: 959394 - DNA, 25 bp, Mus musculus
ttgtcccattggacagttccacata

SEQ ID NO: 959395 - DNA, 25 bp, Mus musculus
ttgtcccattggtaccatgaacaaa

SEQ ID NO: 959396 - DNA, 25 bp, Mus musculus
ttgtcccattggtcagttccacata

SEQ ID NO: 959397 - DNA, 25 bp, Mus musculus
ttgtccccaaacatctgcttgttat

SEQ ID NO: 959398 - DNA, 25 bp, Mus musculus
ttgtccccaaacttctgcttgttat

SEQ ID NO: 959399 - DNA, 25 bp, Mus musculus
ttgtccccaaagatctcacagcaag

SEQ ID NO: 959400 - DNA, 25 bp, Mus musculus
ttgtccccaaagttctcacagcaag

SEQ ID NO: 959401 - DNA, 25 bp, Mus musculus
ttgtccccactgatagatcccaata

SEQ ID NO: 959402 - DNA, 25 bp, Mus musculus
ttgtccccactgttagatcccaata

SEQ ID NO: 959403 - DNA, 25 bp, Mus musculus
ttgtccccagacactggtttcgcat

SEQ ID NO: 959404 - DNA, 25 bp, Mus musculus
ttgtccccagactctggtttcgcat

SEQ ID NO: 959405 - DNA, 25 bp, Mus musculus
ttgtcccccgttactgtggaatgtt

SEQ ID NO: 959406 - DNA, 25 bp, Mus musculus
ttgtcccccgtttctgtggaatgtt

SEQ ID NO: 959407 - DNA, 25 bp, Mus musculus
ttgtccccgagtcttttgatgataa

SEQ ID NO: 959408 - DNA, 25 bp, Mus musculus
ttgtccccgagtgttttgatgataa

SEQ ID NO: 959409 - DNA, 25 bp, Mus musculus
ttgtccccggtgagattttgttggt

SEQ ID NO: 959410 - DNA, 25 bp, Mus musculus
ttgtccccggtgtgattttgttggt

SEQ ID NO: 959411 - DNA, 25 bp, Mus musculus
ttgtcccctaacagttttagtctag

SEQ ID NO: 959412 - DNA, 25 bp, Mus musculus
ttgtcccctaactgttttagtctag

SEQ ID NO: 959413 - DNA, 25 bp, Mus musculus
ttgtcccctagacactttcatgtca

SEQ ID NO: 959414 - DNA, 25 bp, Mus musculus
ttgtcccctagagactttcatgtca

SEQ ID NO: 959415 - DNA, 25 bp, Mus musculus
ttgtcccctctgacagtttgtttac

SEQ ID NO: 959416 - DNA, 25 bp, Mus musculus
ttgtcccctctgtcagtttgtttac

SEQ ID NO: 959417 - DNA, 25 bp, Mus musculus
ttgtcccctgaaaaatgcccatctt

SEQ ID NO: 959418 - DNA, 25 bp, Mus musculus
ttgtcccctgaataatgcccatctt

SEQ ID NO: 959419 - DNA, 25 bp, Mus musculus
ttgtcccctgggaaagcatggcagc

SEQ ID NO: 959420 - DNA, 25 bp, Mus musculus
ttgtcccctgggtaagcatggcagc

SEQ ID NO: 959421 - DNA, 25 bp, Mus musculus
ttgtccccttagagccggtcggcca

SEQ ID NO: 959422 - DNA, 25 bp, Mus musculus
ttgtccccttagtgccggtcggcca

SEQ ID NO: 959423 - DNA, 25 bp, Mus musculus
ttgtccccttccaatagacaccaaa

SEQ ID NO: 959424 - DNA, 25 bp, Mus musculus
ttgtccccttcctatagacaccaaa

SEQ ID NO: 959425 - DNA, 25 bp, Mus musculus
ttgtccccttgccacatttaatatt

SEQ ID NO: 959426 - DNA, 25 bp, Mus musculus
ttgtccccttgcgacatttaatatt

SEQ ID NO: 959427 - DNA, 25 bp, Mus musculus
ttgtcccctttgcactcagagcaca

SEQ ID NO: 959428 - DNA, 25 bp, Mus musculus
ttgtcccctttggactcagagcaca

SEQ ID NO: 959429 - DNA, 25 bp, Mus musculus
ttgtccccttttcctcagtgtcaca

SEQ ID NO: 959430 - DNA, 25 bp, Mus musculus
ttgtccccttttgctcagtgtcaca

SEQ ID NO: 959431 - DNA, 25 bp, Mus musculus
ttgtcccgacccatgctgttcacaa

SEQ ID NO: 959432 - DNA, 25 bp, Mus musculus
ttgtcccgacccttgctgttcacaa

SEQ ID NO: 959433 - DNA, 25 bp, Mus musculus
ttgtcccgctgtactatatttcaag

SEQ ID NO: 959434 - DNA, 25 bp, Mus musculus
ttgtcccgctgttctatatttcaag

SEQ ID NO: 959435 - DNA, 25 bp, Mus musculus
ttgtcccgggctattgctgagttgg

SEQ ID NO: 959436 - DNA, 25 bp, Mus musculus
ttgtcccgggcttttgctgagttgg

SEQ ID NO: 959437 - DNA, 25 bp, Mus musculus
ttgtcccggtggctaaacgcagacg

SEQ ID NO: 959438 - DNA, 25 bp, Mus musculus
ttgtcccggtgggtaaacgcagacg

SEQ ID NO: 959439 - DNA, 25 bp, Mus musculus
ttgtcccgtccaccaggaattagta

SEQ ID NO: 959440 - DNA, 25 bp, Mus musculus
ttgtcccgtccagcaggaattagta

SEQ ID NO: 959441 - DNA, 25 bp, Mus musculus
ttgtcccgtcctagaactggagtac

SEQ ID NO: 959442 - DNA, 25 bp, Mus musculus
ttgtcccgtccttgaactggagtac

SEQ ID NO: 959443 - DNA, 25 bp, Mus musculus
ttgtccctacagcaaagcttcacac

SEQ ID NO: 959444 - DNA, 25 bp, Mus musculus
ttgtccctacaggaaagcttcacac

SEQ ID NO: 959445 - DNA, 25 bp, Mus musculus
ttgtccctatcccagtggcaaccat

SEQ ID NO: 959446 - DNA, 25 bp, Mus musculus
ttgtccctatccgagtggcaaccat

SEQ ID NO: 959447 - DNA, 25 bp, Mus musculus
ttgtccctcaggcagagtgacctac

SEQ ID NO: 959448 - DNA, 25 bp, Mus musculus
ttgtccctcagggagagtgacctac

SEQ ID NO: 959449 - DNA, 25 bp, Mus musculus
ttgtccctcggtattcacattttat

SEQ ID NO: 959450 - DNA, 25 bp, Mus musculus
ttgtccctcggttttcacattttat

SEQ ID NO: 959451 - DNA, 25 bp, Mus musculus
ttgtccctctagaatagaagtttcc

SEQ ID NO: 959452 - DNA, 25 bp, Mus musculus
ttgtccctctagtatagaagtttcc

SEQ ID NO: 959453 - DNA, 25 bp, Mus musculus
ttgtccctctatccagtatccttag

SEQ ID NO: 959454 - DNA, 25 bp, Mus musculus
ttgtccctctatgcagtatccttag

SEQ ID NO: 959455 - DNA, 25 bp, Mus musculus
ttgtccctgaacagctgggctccag

SEQ ID NO: 959456 - DNA, 25 bp, Mus musculus
ttgtccctgaactgctgggctccag

SEQ ID NO: 959457 - DNA, 25 bp, Mus musculus
ttgtccctgaggagagtgtgctgta

SEQ ID NO: 959458 - DNA, 25 bp, Mus musculus
ttgtccctgaggtgagtgtgctgta

SEQ ID NO: 959459 - DNA, 25 bp, Mus musculus
ttgtccctgcatattttgaacaaag

SEQ ID NO: 959460 - DNA, 25 bp, Mus musculus
ttgtccctgcattttttgaacaaag

SEQ ID NO: 959461 - DNA, 25 bp, Mus musculus
ttgtccctgcgtctttgcataactt

SEQ ID NO: 959462 - DNA, 25 bp, Mus musculus
ttgtccctgcgtgtttgcataactt

SEQ ID NO: 959463 - DNA, 25 bp, Mus musculus
ttgtccctggacacatccttgggaa

SEQ ID NO: 959464 - DNA, 25 bp, Mus musculus
ttgtccctggactcatccttgggaa

SEQ ID NO: 959465 - DNA, 25 bp, Mus musculus
ttgtccctgggaaatgaccaactct

SEQ ID NO: 959466 - DNA, 25 bp, Mus musculus
ttgtccctgggatatgaccaactct

SEQ ID NO: 959467 - DNA, 25 bp, Mus musculus
ttgtccctgtcgctctggaatgaga

SEQ ID NO: 959468 - DNA, 25 bp, Mus musculus
ttgtccctgtcggtctggaatgaga

SEQ ID NO: 959469 - DNA, 25 bp, Mus musculus
ttgtccctgtgactgctgcttccat

SEQ ID NO: 959470 - DNA, 25 bp, Mus musculus
ttgtccctgtgagtgctgcttccat

SEQ ID NO: 959471 - DNA, 25 bp, Mus musculus
ttgtccctgttactcggaaggctga

SEQ ID NO: 959472 - DNA, 25 bp, Mus musculus
ttgtccctgttagtcggaaggctga

SEQ ID NO: 959473 - DNA, 25 bp, Mus musculus
ttgtcccttagcatttatttctgtt

SEQ ID NO: 959474 - DNA, 25 bp, Mus musculus
ttgtcccttagcttttatttctgtt

SEQ ID NO: 959475 - DNA, 25 bp, Mus musculus
ttgtcccttaggagtgggccatgat

SEQ ID NO: 959476 - DNA, 25 bp, Mus musculus
ttgtcccttaggtgtgggccatgat

SEQ ID NO: 959477 - DNA, 25 bp, Mus musculus
ttgtcccttctgcaccatttaaagg

SEQ ID NO: 959478 - DNA, 25 bp, Mus musculus
ttgtcccttctggaccatttaaagg

SEQ ID NO: 959479 - DNA, 25 bp, Mus musculus
ttgtcccttgacaaatgtaccttcc

SEQ ID NO: 959480 - DNA, 25 bp, Mus musculus
ttgtcccttgactaatgtaccttcc

SEQ ID NO: 959481 - DNA, 25 bp, Mus musculus
ttgtcccttgcaccctatgattatt

SEQ ID NO: 959482 - DNA, 25 bp, Mus musculus
ttgtcccttgcagcctatgattatt

SEQ ID NO: 959483 - DNA, 25 bp, Mus musculus
ttgtcccttgcgaggcatggagagt

SEQ ID NO: 959484 - DNA, 25 bp, Mus musculus
ttgtcccttgcgtggcatggagagt

SEQ ID NO: 959485 - DNA, 25 bp, Mus musculus
ttgtcccttggaaactgatctgtag

SEQ ID NO: 959486 - DNA, 25 bp, Mus musculus
ttgtcccttggatactgatctgtag

SEQ ID NO: 959487 - DNA, 25 bp, Mus musculus
ttgtccctttagacattagcaatgg

SEQ ID NO: 959488 - DNA, 25 bp, Mus musculus
ttgtccctttagtcattagcaatgg

SEQ ID NO: 959489 - DNA, 25 bp, Mus musculus
ttgtccctttctcacaaagcacaac

SEQ ID NO: 959490 - DNA, 25 bp, Mus musculus
ttgtccctttctgacaaagcacaac

SEQ ID NO: 959491 - DNA, 25 bp, Mus musculus
ttgtccgaagagcttgtgagcgtca

SEQ ID NO: 959492 - DNA, 25 bp, Mus musculus
ttgtccgaagaggttgtgagcgtca

SEQ ID NO: 959493 - DNA, 25 bp, Mus musculus
ttgtccgagcccaacagtgaaagca

SEQ ID NO: 959494 - DNA, 25 bp, Mus musculus
ttgtccgagccctacagtgaaagca

SEQ ID NO: 959495 - DNA, 25 bp, Mus musculus
ttgtccgatcatagtccattgcagt

SEQ ID NO: 959496 - DNA, 25 bp, Mus musculus
ttgtccgatcattgtccattgcagt

SEQ ID NO: 959497 - DNA, 25 bp, Mus musculus
ttgtccgcatccacatgaccaaact

SEQ ID NO: 959498 - DNA, 25 bp, Mus musculus
ttgtccgcatcctcatgaccaaact

SEQ ID NO: 959499 - DNA, 25 bp, Mus musculus
ttgtccgctgaaaccaccatgctgc

SEQ ID NO: 959500 - DNA, 25 bp, Mus musculus
ttgtccgctgaatccaccatgctgc

SEQ ID NO: 959501 - DNA, 25 bp, Mus musculus
ttgtccgctgctccagagcagtcag

SEQ ID NO: 959502 - DNA, 25 bp, Mus musculus
ttgtccgctgctgcagagcagtcag

SEQ ID NO: 959503 - DNA, 25 bp, Mus musculus
ttgtccggatgaagtctcgctgagg

SEQ ID NO: 959504 - DNA, 25 bp, Mus musculus
ttgtccggatgatgtctcgctgagg

SEQ ID NO: 959505 - DNA, 25 bp, Mus musculus
ttgtccgggtccactggtaacttgg

SEQ ID NO: 959506 - DNA, 25 bp, Mus musculus
ttgtccgggtcctctggtaacttgg

SEQ ID NO: 959507 - DNA, 25 bp, Mus musculus
ttgtccggtgttctaggctgaccag

SEQ ID NO: 959508 - DNA, 25 bp, Mus musculus
ttgtccggtgttgtaggctgaccag

SEQ ID NO: 959509 - DNA, 25 bp, Mus musculus
ttgtccgtcactcatacactggtag

SEQ ID NO: 959510 - DNA, 25 bp, Mus musculus
ttgtccgtcactgatacactggtag

SEQ ID NO: 959511 - DNA, 25 bp, Mus musculus
ttgtccgtcagaagatgtggttgct

SEQ ID NO: 959512 - DNA, 25 bp, Mus musculus
ttgtccgtcagatgatgtggttgct

SEQ ID NO: 959513 - DNA, 25 bp, Mus musculus
ttgtccgtggacacgtgagcctgct

SEQ ID NO: 959514 - DNA, 25 bp, Mus musculus
ttgtccgtggactcgtgagcctgct

SEQ ID NO: 959515 - DNA, 25 bp, Mus musculus
ttgtccgttcagaccaatggcggtt

SEQ ID NO: 959516 - DNA, 25 bp, Mus musculus
ttgtccgttcagtccaatggcggtt

SEQ ID NO: 959517 - DNA, 25 bp, Mus musculus
ttgtccgttctgctgcaggattcaa

SEQ ID NO: 959518 - DNA, 25 bp, Mus musculus
ttgtccgttctggtgcaggattcaa

SEQ ID NO: 959519 - DNA, 25 bp, Mus musculus
ttgtcctaaccaacatggcgttcca

SEQ ID NO: 959520 - DNA, 25 bp, Mus musculus
ttgtcctaaccatcatggcgttcca

SEQ ID NO: 959521 - DNA, 25 bp, Mus musculus
ttgtcctacaaacttgtctttccca

SEQ ID NO: 959522 - DNA, 25 bp, Mus musculus
ttgtcctacaaagttgtctttccca

SEQ ID NO: 959523 - DNA, 25 bp, Mus musculus
ttgtcctacatcctgccaaacagtc

SEQ ID NO: 959524 - DNA, 25 bp, Mus musculus
ttgtcctacatcgtgccaaacagtc

SEQ ID NO: 959525 - DNA, 25 bp, Mus musculus
ttgtcctacttcctgatcatacgaa

SEQ ID NO: 959526 - DNA, 25 bp, Mus musculus
ttgtcctacttcgtgatcatacgaa

SEQ ID NO: 959527 - DNA, 25 bp, Mus musculus
ttgtcctagctgattggtcctcaaa

SEQ ID NO: 959528 - DNA, 25 bp, Mus musculus
ttgtcctagctgtttggtcctcaaa

SEQ ID NO: 959529 - DNA, 25 bp, Mus musculus
ttgtcctaggatctagcaggcgctg

SEQ ID NO: 959530 - DNA, 25 bp, Mus musculus
ttgtcctaggatgtagcaggcgctg

SEQ ID NO: 959531 - DNA, 25 bp, Mus musculus
ttgtcctagtaaccaacagcagcag

SEQ ID NO: 959532 - DNA, 25 bp, Mus musculus
ttgtcctagtaagcaacagcagcag

SEQ ID NO: 959533 - DNA, 25 bp, Mus musculus
ttgtcctagttacctgcagctgtca

SEQ ID NO: 959534 - DNA, 25 bp, Mus musculus
ttgtcctagttagctgcagctgtca

SEQ ID NO: 959535 - DNA, 25 bp, Mus musculus
ttgtcctataaccacatccgcttca

SEQ ID NO: 959536 - DNA, 25 bp, Mus musculus
ttgtcctataacgacatccgcttca

SEQ ID NO: 959537 - DNA, 25 bp, Mus musculus
ttgtcctatattcagtttggtttct

SEQ ID NO: 959538 - DNA, 25 bp, Mus musculus
ttgtcctatattgagtttggtttct

SEQ ID NO: 959539 - DNA, 25 bp, Mus musculus
ttgtcctatcatatgctcctttttc

SEQ ID NO: 959540 - DNA, 25 bp, Mus musculus
ttgtcctatcatttgctcctttttc

SEQ ID NO: 959541 - DNA, 25 bp, Mus musculus
ttgtcctatgtaagtctgagatcct

SEQ ID NO: 959542 - DNA, 25 bp, Mus musculus
ttgtcctatgtatgtctgagatcct

SEQ ID NO: 959543 - DNA, 25 bp, Mus musculus
ttgtcctcactccaaagccatagga

SEQ ID NO: 959544 - DNA, 25 bp, Mus musculus
ttgtcctcactcgaaagccatagga

SEQ ID NO: 959545 - DNA, 25 bp, Mus musculus
ttgtcctcagacatccttctgaata

SEQ ID NO: 959546 - DNA, 25 bp, Mus musculus
ttgtcctcagacttccttctgaata

SEQ ID NO: 959547 - DNA, 25 bp, Mus musculus
ttgtcctcagataggcttttaaacc

SEQ ID NO: 959548 - DNA, 25 bp, Mus musculus
ttgtcctcagattggcttttaaacc

SEQ ID NO: 959549 - DNA, 25 bp, Mus musculus
ttgtcctcagcaaactcttgttcct

SEQ ID NO: 959550 - DNA, 25 bp, Mus musculus
ttgtcctcagcatactcttgttcct

SEQ ID NO: 959551 - DNA, 25 bp, Mus musculus
ttgtcctcccacattcacatatgaa

SEQ ID NO: 959552 - DNA, 25 bp, Mus musculus
ttgtcctcccactttcacatatgaa

SEQ ID NO: 959553 - DNA, 25 bp, Mus musculus
ttgtcctcccggaaggccttgggcg

SEQ ID NO: 959554 - DNA, 25 bp, Mus musculus
ttgtcctcccggtaggccttgggcg

SEQ ID NO: 959555 - DNA, 25 bp, Mus musculus
ttgtcctcctagatgaaactcctgt

SEQ ID NO: 959556 - DNA, 25 bp, Mus musculus
ttgtcctcctagttgaaactcctgt

SEQ ID NO: 959557 - DNA, 25 bp, Mus musculus
ttgtcctcctttaatattttcccat

SEQ ID NO: 959558 - DNA, 25 bp, Mus musculus
ttgtcctccttttatattttcccat

SEQ ID NO: 959559 - DNA, 25 bp, Mus musculus
ttgtcctctactcatgctgtcttgg

SEQ ID NO: 959560 - DNA, 25 bp, Mus musculus
ttgtcctctactgatgctgtcttgg

SEQ ID NO: 959561 - DNA, 25 bp, Mus musculus
ttgtcctctatcaccatgtgtgcat

SEQ ID NO: 959562 - DNA, 25 bp, Mus musculus
ttgtcctctatctccatgtgtgcat

SEQ ID NO: 959563 - DNA, 25 bp, Mus musculus
ttgtcctctattccagatggctgcc

SEQ ID NO: 959564 - DNA, 25 bp, Mus musculus
ttgtcctctattgcagatggctgcc

SEQ ID NO: 959565 - DNA, 25 bp, Mus musculus
ttgtcctctgttctgggattcactg

SEQ ID NO: 959566 - DNA, 25 bp, Mus musculus
ttgtcctctgttgtgggattcactg

SEQ ID NO: 959567 - DNA, 25 bp, Mus musculus
ttgtcctcttttaagtccaacggat

SEQ ID NO: 959568 - DNA, 25 bp, Mus musculus
ttgtcctctttttagtccaacggat

SEQ ID NO: 959569 - DNA, 25 bp, Mus musculus
ttgtcctgacaaagcaccatggcca

SEQ ID NO: 959570 - DNA, 25 bp, Mus musculus
ttgtcctgacaatgcaccatggcca

SEQ ID NO: 959571 - DNA, 25 bp, Mus musculus
ttgtcctgacatcagtgcttgtaac

SEQ ID NO: 959572 - DNA, 25 bp, Mus musculus
ttgtcctgacatgagtgcttgtaac

SEQ ID NO: 959573 - DNA, 25 bp, Mus musculus
ttgtcctgcagactgatagccagct

SEQ ID NO: 959574 - DNA, 25 bp, Mus musculus
ttgtcctgcagagtgatagccagct

SEQ ID NO: 959575 - DNA, 25 bp, Mus musculus
ttgtcctgccaaccttgtgcttttt

SEQ ID NO: 959576 - DNA, 25 bp, Mus musculus
ttgtcctgccaagcttgtgcttttt

SEQ ID NO: 959577 - DNA, 25 bp, Mus musculus
ttgtcctgccccatgagatgctgaa

SEQ ID NO: 959578 - DNA, 25 bp, Mus musculus
ttgtcctgccccttgagatgctgaa

SEQ ID NO: 959579 - DNA, 25 bp, Mus musculus
ttgtcctgctgccttggctttaccc

SEQ ID NO: 959580 - DNA, 25 bp, Mus musculus
ttgtcctgctgcgttggctttaccc

SEQ ID NO: 959581 - DNA, 25 bp, Mus musculus
ttgtcctggagtacaaacgcgtaag

SEQ ID NO: 959582 - DNA, 25 bp, Mus musculus
ttgtcctggagttcaaacgcgtaag

SEQ ID NO: 959583 - DNA, 25 bp, Mus musculus
ttgtcctgggaaacacaggccctct

SEQ ID NO: 959584 - DNA, 25 bp, Mus musculus
ttgtcctgggaacacacacatctga

SEQ ID NO: 959585 - DNA, 25 bp, Mus musculus
ttgtcctgggaagacacacatctga

SEQ ID NO: 959586 - DNA, 25 bp, Mus musculus
ttgtcctgggaatcacaggccctct

SEQ ID NO: 959587 - DNA, 25 bp, Mus musculus
ttgtcctgggccagcacaggtggct

SEQ ID NO: 959588 - DNA, 25 bp, Mus musculus
ttgtcctgggcctgcacaggtggct

SEQ ID NO: 959589 - DNA, 25 bp, Mus musculus
ttgtcctgtagactcccatgatagt

SEQ ID NO: 959590 - DNA, 25 bp, Mus musculus
ttgtcctgtagagtcccatgatagt

SEQ ID NO: 959591 - DNA, 25 bp, Mus musculus
ttgtcctgtcccaaaggacttcata

SEQ ID NO: 959592 - DNA, 25 bp, Mus musculus
ttgtcctgtccctaaggacttcata

SEQ ID NO: 959593 - DNA, 25 bp, Mus musculus
ttgtcctgtctgcagacgactgtta

SEQ ID NO: 959594 - DNA, 25 bp, Mus musculus
ttgtcctgtctggagacgactgtta

SEQ ID NO: 959595 - DNA, 25 bp, Mus musculus
ttgtcctgtcttcatttacctgact

SEQ ID NO: 959596 - DNA, 25 bp, Mus musculus
ttgtcctgtcttcccatatagccca

SEQ ID NO: 959597 - DNA, 25 bp, Mus musculus
ttgtcctgtcttgatttacctgact

SEQ ID NO: 959598 - DNA, 25 bp, Mus musculus
ttgtcctgtcttgccatatagccca

SEQ ID NO: 959599 - DNA, 25 bp, Mus musculus
ttgtcctgtgtacaagacttgtcag

SEQ ID NO: 959600 - DNA, 25 bp, Mus musculus
ttgtcctgtgtagaagacttgtcag

SEQ ID NO: 959601 - DNA, 25 bp, Mus musculus
ttgtcctgtgtcactatatcccagg

SEQ ID NO: 959602 - DNA, 25 bp, Mus musculus
ttgtcctgtgtctctatatcccagg

SEQ ID NO: 959603 - DNA, 25 bp, Mus musculus
ttgtcctgttcaagtgtctatgccc

SEQ ID NO: 959604 - DNA, 25 bp, Mus musculus
ttgtcctgttcatgtgtctatgccc

SEQ ID NO: 959605 - DNA, 25 bp, Mus musculus
ttgtcctgttgtaggagagttcccc

SEQ ID NO: 959606 - DNA, 25 bp, Mus musculus
ttgtcctgttgttggagagttcccc

SEQ ID NO: 959607 - DNA, 25 bp, Mus musculus
ttgtcctgtttgaagacccgtagta

SEQ ID NO: 959608 - DNA, 25 bp, Mus musculus
ttgtcctgtttgtagacccgtagta

SEQ ID NO: 959609 - DNA, 25 bp, Mus musculus
ttgtcctgttttatcctttgcatcc

SEQ ID NO: 959610 - DNA, 25 bp, Mus musculus
ttgtcctgttttttcctttgcatcc

SEQ ID NO: 959611 - DNA, 25 bp, Mus musculus
ttgtccttaagaaacactggctgaa

SEQ ID NO: 959612 - DNA, 25 bp, Mus musculus
ttgtccttaagatacactggctgaa

SEQ ID NO: 959613 - DNA, 25 bp, Mus musculus
ttgtccttaaggactcatgctagca

SEQ ID NO: 959614 - DNA, 25 bp, Mus musculus
ttgtccttaaggtctcatgctagca

SEQ ID NO: 959615 - DNA, 25 bp, Mus musculus
ttgtccttagaacccagcatcaaca

SEQ ID NO: 959616 - DNA, 25 bp, Mus musculus
ttgtccttagaagccagcatcaaca

SEQ ID NO: 959617 - DNA, 25 bp, Mus musculus
ttgtccttagacatgctgagatcct

SEQ ID NO: 959618 - DNA, 25 bp, Mus musculus
ttgtccttagacttgctgagatcct

SEQ ID NO: 959619 - DNA, 25 bp, Mus musculus
ttgtccttaggcaggagagcttcct

SEQ ID NO: 959620 - DNA, 25 bp, Mus musculus
ttgtccttaggctggagagcttcct

SEQ ID NO: 959621 - DNA, 25 bp, Mus musculus
ttgtccttccacctttatatgtctt

SEQ ID NO: 959622 - DNA, 25 bp, Mus musculus
ttgtccttccacgtttatatgtctt

SEQ ID NO: 959623 - DNA, 25 bp, Mus musculus
ttgtccttcctcagttggaatcaac

SEQ ID NO: 959624 - DNA, 25 bp, Mus musculus
ttgtccttcctctgttggaatcaac

SEQ ID NO: 959625 - DNA, 25 bp, Mus musculus
ttgtccttccttctttcagaactaa

SEQ ID NO: 959626 - DNA, 25 bp, Mus musculus
ttgtccttccttgtttcagaactaa

SEQ ID NO: 959627 - DNA, 25 bp, Mus musculus
ttgtccttctaccttatttatctgt

SEQ ID NO: 959628 - DNA, 25 bp, Mus musculus
ttgtccttctacgttatttatctgt

SEQ ID NO: 959629 - DNA, 25 bp, Mus musculus
ttgtccttctgaacgtctaacttgc

SEQ ID NO: 959630 - DNA, 25 bp, Mus musculus
ttgtccttctgatcgtctaacttgc

SEQ ID NO: 959631 - DNA, 25 bp, Mus musculus
ttgtccttgaccctcgggctgaatc

SEQ ID NO: 959632 - DNA, 25 bp, Mus musculus
ttgtccttgaccgtcgggctgaatc

SEQ ID NO: 959633 - DNA, 25 bp, Mus musculus
ttgtccttgatgagtggtctgcata

SEQ ID NO: 959634 - DNA, 25 bp, Mus musculus
ttgtccttgatgtgtggtctgcata

SEQ ID NO: 959635 - DNA, 25 bp, Mus musculus
ttgtccttgcaacttgatattcggc

SEQ ID NO: 959636 - DNA, 25 bp, Mus musculus
ttgtccttgcaagttgatattcggc

SEQ ID NO: 959637 - DNA, 25 bp, Mus musculus
ttgtccttggacatctcatcgtttt

SEQ ID NO: 959638 - DNA, 25 bp, Mus musculus
ttgtccttggacttctcatcgtttt

SEQ ID NO: 959639 - DNA, 25 bp, Mus musculus
ttgtccttggagctgcaatagtcac

SEQ ID NO: 959640 - DNA, 25 bp, Mus musculus
ttgtccttggaggtgcaatagtcac

SEQ ID NO: 959641 - DNA, 25 bp, Mus musculus
ttgtccttgggaacatttctttctg

SEQ ID NO: 959642 - DNA, 25 bp, Mus musculus
ttgtccttgggatcatttctttctg

SEQ ID NO: 959643 - DNA, 25 bp, Mus musculus
ttgtcctttataacagttgccgtgc

SEQ ID NO: 959644 - DNA, 25 bp, Mus musculus
ttgtcctttatatcagttgccgtgc

SEQ ID NO: 959645 - DNA, 25 bp, Mus musculus
ttgtcctttccactctgacatggat

SEQ ID NO: 959646 - DNA, 25 bp, Mus musculus
ttgtcctttccacttcggcgcggaa

SEQ ID NO: 959647 - DNA, 25 bp, Mus musculus
ttgtcctttccagtctgacatggat

SEQ ID NO: 959648 - DNA, 25 bp, Mus musculus
ttgtcctttccagttcggcgcggaa

SEQ ID NO: 959649 - DNA, 25 bp, Mus musculus
ttgtcctttcctctatccattggct

SEQ ID NO: 959650 - DNA, 25 bp, Mus musculus
ttgtcctttcctgtatccattggct

SEQ ID NO: 959651 - DNA, 25 bp, Mus musculus
ttgtcctttctcaagagcagcaaag

SEQ ID NO: 959652 - DNA, 25 bp, Mus musculus
ttgtcctttctctagagcagcaaag

SEQ ID NO: 959653 - DNA, 25 bp, Mus musculus
ttgtcctttcttcattgcctccaat

SEQ ID NO: 959654 - DNA, 25 bp, Mus musculus
ttgtcctttcttgattgcctccaat

SEQ ID NO: 959655 - DNA, 25 bp, Mus musculus
ttgtccttttttagtaatcctcctg

SEQ ID NO: 959656 - DNA, 25 bp, Mus musculus
ttgtcctttttttgtaatcctcctg

SEQ ID NO: 959657 - DNA, 25 bp, Mus musculus
ttgtcgaaaaccacactcggatctt

SEQ ID NO: 959658 - DNA, 25 bp, Mus musculus
ttgtcgaaaacctcactcggatctt

SEQ ID NO: 959659 - DNA, 25 bp, Mus musculus
ttgtcgaagcatcaaggcctccagt

SEQ ID NO: 959660 - DNA, 25 bp, Mus musculus
ttgtcgaagcatgaaggcctccagt

SEQ ID NO: 959661 - DNA, 25 bp, Mus musculus
ttgtcgaatatcagcctgttcatcc

SEQ ID NO: 959662 - DNA, 25 bp, Mus musculus
ttgtcgaatatctgcctgttcatcc

SEQ ID NO: 959663 - DNA, 25 bp, Mus musculus
ttgtcgacttttaagcttctgtgca

SEQ ID NO: 959664 - DNA, 25 bp, Mus musculus
ttgtcgactttttagcttctgtgca

SEQ ID NO: 959665 - DNA, 25 bp, Mus musculus
ttgtcgaggctcagcgaactcatgc

SEQ ID NO: 959666 - DNA, 25 bp, Mus musculus
ttgtcgaggctctgcgaactcatgc

SEQ ID NO: 959667 - DNA, 25 bp, Mus musculus
ttgtcgcagaggattttattactac

SEQ ID NO: 959668 - DNA, 25 bp, Mus musculus
ttgtcgcagaggtttttattactac

SEQ ID NO: 959669 - DNA, 25 bp, Mus musculus
ttgtcgcagtgcaggaccacagatg

SEQ ID NO: 959670 - DNA, 25 bp, Mus musculus
ttgtcgcagtgctggaccacagatg

SEQ ID NO: 959671 - DNA, 25 bp, Mus musculus
ttgtcgcccaaactgttctagagaa

SEQ ID NO: 959672 - DNA, 25 bp, Mus musculus
ttgtcgcccaaagtgttctagagaa

SEQ ID NO: 959673 - DNA, 25 bp, Mus musculus
ttgtcgccccttctctggaacaata

SEQ ID NO: 959674 - DNA, 25 bp, Mus musculus
ttgtcgccccttgtctggaacaata

SEQ ID NO: 959675 - DNA, 25 bp, Mus musculus
ttgtcgccgctgacatatgacgggt

SEQ ID NO: 959676 - DNA, 25 bp, Mus musculus
ttgtcgccgctgtcatatgacgggt

SEQ ID NO: 959677 - DNA, 25 bp, Mus musculus
ttgtcgcctggcaatgttggcacac

SEQ ID NO: 959678 - DNA, 25 bp, Mus musculus
ttgtcgcctggctatgttggcacac

SEQ ID NO: 959679 - DNA, 25 bp, Mus musculus
ttgtcgccttgcatttagattcaga

SEQ ID NO: 959680 - DNA, 25 bp, Mus musculus
ttgtcgccttgcttttagattcaga

SEQ ID NO: 959681 - DNA, 25 bp, Mus musculus
ttgtcgcggtccactcgcgcaggaa

SEQ ID NO: 959682 - DNA, 25 bp, Mus musculus
ttgtcgcggtcctctcgcgcaggaa

SEQ ID NO: 959683 - DNA, 25 bp, Mus musculus
ttgtcgctcgtcactttgaacggta

SEQ ID NO: 959684 - DNA, 25 bp, Mus musculus
ttgtcgctcgtctctttgaacggta

SEQ ID NO: 959685 - DNA, 25 bp, Mus musculus
ttgtcgctggagacaattacttcat

SEQ ID NO: 959686 - DNA, 25 bp, Mus musculus
ttgtcgctggagtcaattacttcat

SEQ ID NO: 959687 - DNA, 25 bp, Mus musculus
ttgtcgctgtctagcactctggtgt

SEQ ID NO: 959688 - DNA, 25 bp, Mus musculus
ttgtcgctgtcttgcactctggtgt

SEQ ID NO: 959689 - DNA, 25 bp, Mus musculus
ttgtcgcttcctaaaccttcctcat

SEQ ID NO: 959690 - DNA, 25 bp, Mus musculus
ttgtcgcttccttaaccttcctcat

SEQ ID NO: 959691 - DNA, 25 bp, Mus musculus
ttgtcgcttcttcctgtttgtggta

SEQ ID NO: 959692 - DNA, 25 bp, Mus musculus
ttgtcgcttcttgctgtttgtggta

SEQ ID NO: 959693 - DNA, 25 bp, Mus musculus
ttgtcggaaaccagtaccctcaaag

SEQ ID NO: 959694 - DNA, 25 bp, Mus musculus
ttgtcggaaacctgtaccctcaaag

SEQ ID NO: 959695 - DNA, 25 bp, Mus musculus
ttgtcggagtccagctattgattac

SEQ ID NO: 959696 - DNA, 25 bp, Mus musculus
ttgtcggagtcctgctattgattac

SEQ ID NO: 959697 - DNA, 25 bp, Mus musculus
ttgtcggcagctactccacctgaag

SEQ ID NO: 959698 - DNA, 25 bp, Mus musculus
ttgtcggcagcttctccacctgaag

SEQ ID NO: 959699 - DNA, 25 bp, Mus musculus
ttgtcggcccggatggtctggtcta

SEQ ID NO: 959700 - DNA, 25 bp, Mus musculus
ttgtcggcccggttggtctggtcta

SEQ ID NO: 959701 - DNA, 25 bp, Mus musculus
ttgtcggctttcataaaagtcctgt

SEQ ID NO: 959702 - DNA, 25 bp, Mus musculus
ttgtcggctttcttaaaagtcctgt

SEQ ID NO: 959703 - DNA, 25 bp, Mus musculus
ttgtcgggcctgaaccccagcgcgg

SEQ ID NO: 959704 - DNA, 25 bp, Mus musculus
ttgtcgggcctgtaccccagcgcgg

SEQ ID NO: 959705 - DNA, 25 bp, Mus musculus
ttgtcgtagcctaacctgtgaaaag

SEQ ID NO: 959706 - DNA, 25 bp, Mus musculus
ttgtcgtagccttacctgtgaaaag

SEQ ID NO: 959707 - DNA, 25 bp, Mus musculus
ttgtcgtatcctaaccaggtacaca

SEQ ID NO: 959708 - DNA, 25 bp, Mus musculus
ttgtcgtatccttaccaggtacaca

SEQ ID NO: 959709 - DNA, 25 bp, Mus musculus
ttgtcgtatgtcaagtaaactttgt

SEQ ID NO: 959710 - DNA, 25 bp, Mus musculus
ttgtcgtatgtctagtaaactttgt

SEQ ID NO: 959711 - DNA, 25 bp, Mus musculus
ttgtcgtcacttaatttccagggat

SEQ ID NO: 959712 - DNA, 25 bp, Mus musculus
ttgtcgtcactttatttccagggat

SEQ ID NO: 959713 - DNA, 25 bp, Mus musculus
ttgtcgtccaggctgtcgaagataa

SEQ ID NO: 959714 - DNA, 25 bp, Mus musculus
ttgtcgtccagggtgtcgaagataa

SEQ ID NO: 959715 - DNA, 25 bp, Mus musculus
ttgtcgtcctaaactgcaaacccag

SEQ ID NO: 959716 - DNA, 25 bp, Mus musculus
ttgtcgtcctaatctgcaaacccag

SEQ ID NO: 959717 - DNA, 25 bp, Mus musculus
ttgtcgtcctgtatttcgctcttat

SEQ ID NO: 959718 - DNA, 25 bp, Mus musculus
ttgtcgtcctgtcatgtgctttgag

SEQ ID NO: 959719 - DNA, 25 bp, Mus musculus
ttgtcgtcctgtgatgtgctttgag

SEQ ID NO: 959720 - DNA, 25 bp, Mus musculus
ttgtcgtcctgtttttcgctcttat

SEQ ID NO: 959721 - DNA, 25 bp, Mus musculus
ttgtcgtctaacactctagtgttga

SEQ ID NO: 959722 - DNA, 25 bp, Mus musculus
ttgtcgtctaactctctagtgttga

SEQ ID NO: 959723 - DNA, 25 bp, Mus musculus
ttgtcgtcttggacgtgtttattcg

SEQ ID NO: 959724 - DNA, 25 bp, Mus musculus
ttgtcgtcttggtcgtgtttattcg

SEQ ID NO: 959725 - DNA, 25 bp, Mus musculus
ttgtcgtgctatccccagcttggcg

SEQ ID NO: 959726 - DNA, 25 bp, Mus musculus
ttgtcgtgctatgcccagcttggcg

SEQ ID NO: 959727 - DNA, 25 bp, Mus musculus
ttgtcgtggcaacaaataggcctga

SEQ ID NO: 959728 - DNA, 25 bp, Mus musculus
ttgtcgtggcaagaaataggcctga

SEQ ID NO: 959729 - DNA, 25 bp, Mus musculus
ttgtcgttctttatgtttgtcttgt

SEQ ID NO: 959730 - DNA, 25 bp, Mus musculus
ttgtcgttctttttgtttgtcttgt

SEQ ID NO: 959731 - DNA, 25 bp, Mus musculus
ttgtctaaacttcagctcagtccca

SEQ ID NO: 959732 - DNA, 25 bp, Mus musculus
ttgtctaaacttgagctcagtccca

SEQ ID NO: 959733 - DNA, 25 bp, Mus musculus
ttgtctaaataaaaaggctctttct

SEQ ID NO: 959734 - DNA, 25 bp, Mus musculus
ttgtctaaataataaggctctttct

SEQ ID NO: 959735 - DNA, 25 bp, Mus musculus
ttgtctaacaccatccaagtaagag

SEQ ID NO: 959736 - DNA, 25 bp, Mus musculus
ttgtctaacaccttccaagtaagag

SEQ ID NO: 959737 - DNA, 25 bp, Mus musculus
ttgtctaagctgaatgtgcaatttg

SEQ ID NO: 959738 - DNA, 25 bp, Mus musculus
ttgtctaagctgtatgtgcaatttg

SEQ ID NO: 959739 - DNA, 25 bp, Mus musculus
ttgtctacacctactcctgtaataa

SEQ ID NO: 959740 - DNA, 25 bp, Mus musculus
ttgtctacacctcagtctcagctgt

SEQ ID NO: 959741 - DNA, 25 bp, Mus musculus
ttgtctacacctgagtctcagctgt

SEQ ID NO: 959742 - DNA, 25 bp, Mus musculus
ttgtctacaccttctcctgtaataa

SEQ ID NO: 959743 - DNA, 25 bp, Mus musculus
ttgtctacagccagaggtcattagt

SEQ ID NO: 959744 - DNA, 25 bp, Mus musculus
ttgtctacagcctgaggtcattagt

SEQ ID NO: 959745 - DNA, 25 bp, Mus musculus
ttgtctacaggcagctcccaggata

SEQ ID NO: 959746 - DNA, 25 bp, Mus musculus
ttgtctacaggctgctcccaggata

SEQ ID NO: 959747 - DNA, 25 bp, Mus musculus
ttgtctaccctcaaattctccatta

SEQ ID NO: 959748 - DNA, 25 bp, Mus musculus
ttgtctaccctctaattctccatta

SEQ ID NO: 959749 - DNA, 25 bp, Mus musculus
ttgtctacccttatgcaagactgaa

SEQ ID NO: 959750 - DNA, 25 bp, Mus musculus
ttgtctacccttcgacccagcggta

SEQ ID NO: 959751 - DNA, 25 bp, Mus musculus
ttgtctacccttggacccagcggta

SEQ ID NO: 959752 - DNA, 25 bp, Mus musculus
ttgtctacccttttgcaagactgaa

SEQ ID NO: 959753 - DNA, 25 bp, Mus musculus
ttgtctacctacaattaaccttcct

SEQ ID NO: 959754 - DNA, 25 bp, Mus musculus
ttgtctacctactattaaccttcct

SEQ ID NO: 959755 - DNA, 25 bp, Mus musculus
ttgtctacgcacatggcgcctggtc

SEQ ID NO: 959756 - DNA, 25 bp, Mus musculus
ttgtctacgcacttggcgcctggtc

SEQ ID NO: 959757 - DNA, 25 bp, Mus musculus
ttgtctacgcgcagcctcggtgtga

SEQ ID NO: 959758 - DNA, 25 bp, Mus musculus
ttgtctacgcgctgcctcggtgtga

SEQ ID NO: 959759 - DNA, 25 bp, Mus musculus
ttgtctactcaaatcaccaagtgga

SEQ ID NO: 959760 - DNA, 25 bp, Mus musculus
ttgtctactcaattcaccaagtgga

SEQ ID NO: 959761 - DNA, 25 bp, Mus musculus
ttgtctactgccctctaatgttaag

SEQ ID NO: 959762 - DNA, 25 bp, Mus musculus
ttgtctactgccgtctaatgttaag

SEQ ID NO: 959763 - DNA, 25 bp, Mus musculus
ttgtctagaaggcagcattgctctc

SEQ ID NO: 959764 - DNA, 25 bp, Mus musculus
ttgtctagaagggagcattgctctc

SEQ ID NO: 959765 - DNA, 25 bp, Mus musculus
ttgtctagaatgacactctcagtgt

SEQ ID NO: 959766 - DNA, 25 bp, Mus musculus
ttgtctagaatgtcactctcagtgt

SEQ ID NO: 959767 - DNA, 25 bp, Mus musculus
ttgtctaggatgagaccttcctcag

SEQ ID NO: 959768 - DNA, 25 bp, Mus musculus
ttgtctaggatgtgaccttcctcag

SEQ ID NO: 959769 - DNA, 25 bp, Mus musculus
ttgtctagtctgagaatggccggct

SEQ ID NO: 959770 - DNA, 25 bp, Mus musculus
ttgtctagtctgtgaatggccggct

SEQ ID NO: 959771 - DNA, 25 bp, Mus musculus
ttgtctatacccagatgttctgtca

SEQ ID NO: 959772 - DNA, 25 bp, Mus musculus
ttgtctataccctgatgttctgtca

SEQ ID NO: 959773 - DNA, 25 bp, Mus musculus
ttgtctatagccactaattcattgt

SEQ ID NO: 959774 - DNA, 25 bp, Mus musculus
ttgtctatagcctctaattcattgt

SEQ ID NO: 959775 - DNA, 25 bp, Mus musculus
ttgtctatcattcaaggcccgcttc

SEQ ID NO: 959776 - DNA, 25 bp, Mus musculus
ttgtctatcattgaaggcccgcttc

SEQ ID NO: 959777 - DNA, 25 bp, Mus musculus
ttgtctatccagctctagatatcat

SEQ ID NO: 959778 - DNA, 25 bp, Mus musculus
ttgtctatccaggtctagatatcat

SEQ ID NO: 959779 - DNA, 25 bp, Mus musculus
ttgtctatgaccatcggatgcacag

SEQ ID NO: 959780 - DNA, 25 bp, Mus musculus
ttgtctatgaccttcggatgcacag

SEQ ID NO: 959781 - DNA, 25 bp, Mus musculus
ttgtctatgcccagcttcactggat

SEQ ID NO: 959782 - DNA, 25 bp, Mus musculus
ttgtctatgccctgcttcactggat

SEQ ID NO: 959783 - DNA, 25 bp, Mus musculus
ttgtctatgcggagatcagggtgat

SEQ ID NO: 959784 - DNA, 25 bp, Mus musculus
ttgtctatgcggtgatcagggtgat

SEQ ID NO: 959785 - DNA, 25 bp, Mus musculus
ttgtctatgggacacggacccgttt

SEQ ID NO: 959786 - DNA, 25 bp, Mus musculus
ttgtctatgggagacggacccgttt

SEQ ID NO: 959787 - DNA, 25 bp, Mus musculus
ttgtctatggttcctacgtggtcag

SEQ ID NO: 959788 - DNA, 25 bp, Mus musculus
ttgtctatggttgctacgtggtcag

SEQ ID NO: 959789 - DNA, 25 bp, Mus musculus
ttgtctattcaacttgctcactgtc

SEQ ID NO: 959790 - DNA, 25 bp, Mus musculus
ttgtctattcaagttgctcactgtc

SEQ ID NO: 959791 - DNA, 25 bp, Mus musculus
ttgtctatttctctgtccttgatcc

SEQ ID NO: 959792 - DNA, 25 bp, Mus musculus
ttgtctatttctgtgtccttgatcc

SEQ ID NO: 959793 - DNA, 25 bp, Mus musculus
ttgtctcaaaaaccatgccctgtgc

SEQ ID NO: 959794 - DNA, 25 bp, Mus musculus
ttgtctcaaaaagcatgccctgtgc

SEQ ID NO: 959795 - DNA, 25 bp, Mus musculus
ttgtctcaaaataccagccttctga

SEQ ID NO: 959796 - DNA, 25 bp, Mus musculus
ttgtctcaaaattccagccttctga

SEQ ID NO: 959797 - DNA, 25 bp, Mus musculus
ttgtctcaaacaacctggcaatgga

SEQ ID NO: 959798 - DNA, 25 bp, Mus musculus
ttgtctcaaacatcctggcaatgga

SEQ ID NO: 959799 - DNA, 25 bp, Mus musculus
ttgtctcaaattataccattatgtt

SEQ ID NO: 959800 - DNA, 25 bp, Mus musculus
ttgtctcaaattcaactattcaagc

SEQ ID NO: 959801 - DNA, 25 bp, Mus musculus
ttgtctcaaattgaactattcaagc

SEQ ID NO: 959802 - DNA, 25 bp, Mus musculus
ttgtctcaaattttaccattatgtt

SEQ ID NO: 959803 - DNA, 25 bp, Mus musculus
ttgtctcaacttatcagctcatgtc

SEQ ID NO: 959804 - DNA, 25 bp, Mus musculus
ttgtctcaacttttcagctcatgtc

SEQ ID NO: 959805 - DNA, 25 bp, Mus musculus
ttgtctcaaggcctagaatgtcgta

SEQ ID NO: 959806 - DNA, 25 bp, Mus musculus
ttgtctcaaggcgtagaatgtcgta

SEQ ID NO: 959807 - DNA, 25 bp, Mus musculus
ttgtctcaatcgaagcacctaaagg

SEQ ID NO: 959808 - DNA, 25 bp, Mus musculus
ttgtctcaatcgtagcacctaaagg

SEQ ID NO: 959809 - DNA, 25 bp, Mus musculus
ttgtctcacagaaccatcactgtaa

SEQ ID NO: 959810 - DNA, 25 bp, Mus musculus
ttgtctcacagatccatcactgtaa

SEQ ID NO: 959811 - DNA, 25 bp, Mus musculus
ttgtctcaccatatctgctgtctgc

SEQ ID NO: 959812 - DNA, 25 bp, Mus musculus
ttgtctcaccatttctgctgtctgc

SEQ ID NO: 959813 - DNA, 25 bp, Mus musculus
ttgtctcactgaaagctgtctgcag

SEQ ID NO: 959814 - DNA, 25 bp, Mus musculus
ttgtctcactgatagctgtctgcag

SEQ ID NO: 959815 - DNA, 25 bp, Mus musculus
ttgtctcagactagcaacttgttgc

SEQ ID NO: 959816 - DNA, 25 bp, Mus musculus
ttgtctcagacttgcaacttgttgc

SEQ ID NO: 959817 - DNA, 25 bp, Mus musculus
ttgtctcagaggatgtcagggtgac

SEQ ID NO: 959818 - DNA, 25 bp, Mus musculus
ttgtctcagaggttgtcagggtgac

SEQ ID NO: 959819 - DNA, 25 bp, Mus musculus
ttgtctcagccacaggcttgaagcc

SEQ ID NO: 959820 - DNA, 25 bp, Mus musculus
ttgtctcagccagaggcttgaagcc

SEQ ID NO: 959821 - DNA, 25 bp, Mus musculus
ttgtctcagccccagaaacatggct

SEQ ID NO: 959822 - DNA, 25 bp, Mus musculus
ttgtctcagcccgagaaacatggct

SEQ ID NO: 959823 - DNA, 25 bp, Mus musculus
ttgtctcagcggagctcatgcttgc

SEQ ID NO: 959824 - DNA, 25 bp, Mus musculus
ttgtctcagcggtgctcatgcttgc

SEQ ID NO: 959825 - DNA, 25 bp, Mus musculus
ttgtctcaggccacaggttatcaga

SEQ ID NO: 959826 - DNA, 25 bp, Mus musculus
ttgtctcaggccctttgtgtaagca

SEQ ID NO: 959827 - DNA, 25 bp, Mus musculus
ttgtctcaggccgtttgtgtaagca

SEQ ID NO: 959828 - DNA, 25 bp, Mus musculus
ttgtctcaggcctcaggttatcaga

SEQ ID NO: 959829 - DNA, 25 bp, Mus musculus
ttgtctcaggtgacaaaggttgtcc

SEQ ID NO: 959830 - DNA, 25 bp, Mus musculus
ttgtctcaggtgtcaaaggttgtcc

SEQ ID NO: 959831 - DNA, 25 bp, Mus musculus
ttgtctcaggttagcccaacgctgg

SEQ ID NO: 959832 - DNA, 25 bp, Mus musculus
ttgtctcaggtttgcccaacgctgg

SEQ ID NO: 959833 - DNA, 25 bp, Mus musculus
ttgtctcagttgatacctgtggcat

SEQ ID NO: 959834 - DNA, 25 bp, Mus musculus
ttgtctcagttgttacctgtggcat

SEQ ID NO: 959835 - DNA, 25 bp, Mus musculus
ttgtctcatattacaatccagtgga

SEQ ID NO: 959836 - DNA, 25 bp, Mus musculus
ttgtctcatatttcaatccagtgga

SEQ ID NO: 959837 - DNA, 25 bp, Mus musculus
ttgtctcatcagaggctcctggatg

SEQ ID NO: 959838 - DNA, 25 bp, Mus musculus
ttgtctcatcagtggctcctggatg

SEQ ID NO: 959839 - DNA, 25 bp, Mus musculus
ttgtctccaagcaccctatcgaggg

SEQ ID NO: 959840 - DNA, 25 bp, Mus musculus
ttgtctccaagctccctatcgaggg

SEQ ID NO: 959841 - DNA, 25 bp, Mus musculus
ttgtctccacagaagctcttgtaga

SEQ ID NO: 959842 - DNA, 25 bp, Mus musculus
ttgtctccacagtagctcttgtaga

SEQ ID NO: 959843 - DNA, 25 bp, Mus musculus
ttgtctccactacgtcatcttcata

SEQ ID NO: 959844 - DNA, 25 bp, Mus musculus
ttgtctccactaggtcatcttcata

SEQ ID NO: 959845 - DNA, 25 bp, Mus musculus
ttgtctccattgaaggaccaggtct

SEQ ID NO: 959846 - DNA, 25 bp, Mus musculus
ttgtctccattgtaggaccaggtct

SEQ ID NO: 959847 - DNA, 25 bp, Mus musculus
ttgtctcccagaaggcttcacttag

SEQ ID NO: 959848 - DNA, 25 bp, Mus musculus
ttgtctcccagatggcttcacttag

SEQ ID NO: 959849 - DNA, 25 bp, Mus musculus
ttgtctcccaggctgtgatcacaga

SEQ ID NO: 959850 - DNA, 25 bp, Mus musculus
ttgtctcccagggtgtgatcacaga

SEQ ID NO: 959851 - DNA, 25 bp, Mus musculus
ttgtctcccctgagcactagctgaa

SEQ ID NO: 959852 - DNA, 25 bp, Mus musculus
ttgtctcccctgtgcactagctgaa

SEQ ID NO: 959853 - DNA, 25 bp, Mus musculus
ttgtctcccgcacccagtgtggtac

SEQ ID NO: 959854 - DNA, 25 bp, Mus musculus
ttgtctcccgcagccagtgtggtac

SEQ ID NO: 959855 - DNA, 25 bp, Mus musculus
ttgtctccgtaacctcaggctagaa

SEQ ID NO: 959856 - DNA, 25 bp, Mus musculus
ttgtctccgtaagctcaggctagaa

SEQ ID NO: 959857 - DNA, 25 bp, Mus musculus
ttgtctcctcaaaaggcctttcttt

SEQ ID NO: 959858 - DNA, 25 bp, Mus musculus
ttgtctcctcaacacgactggtaaa

SEQ ID NO: 959859 - DNA, 25 bp, Mus musculus
ttgtctcctcaagacgactggtaaa

SEQ ID NO: 959860 - DNA, 25 bp, Mus musculus
ttgtctcctcaataggcctttcttt

SEQ ID NO: 959861 - DNA, 25 bp, Mus musculus
ttgtctcctccaaaaagcactaatg

SEQ ID NO: 959862 - DNA, 25 bp, Mus musculus
ttgtctcctccaacaaacagtttgt

SEQ ID NO: 959863 - DNA, 25 bp, Mus musculus
ttgtctcctccataaagcactaatg

SEQ ID NO: 959864 - DNA, 25 bp, Mus musculus
ttgtctcctccatcaaacagtttgt

SEQ ID NO: 959865 - DNA, 25 bp, Mus musculus
ttgtctcctgcgacttcaacagcaa

SEQ ID NO: 959866 - DNA, 25 bp, Mus musculus
ttgtctcctgcgtcttcaacagcaa

SEQ ID NO: 959867 - DNA, 25 bp, Mus musculus
ttgtctcctggtacactgcaaggcc

SEQ ID NO: 959868 - DNA, 25 bp, Mus musculus
ttgtctcctggttcactgcaaggcc

SEQ ID NO: 959869 - DNA, 25 bp, Mus musculus
ttgtctcctgtaattcttatcatgg

SEQ ID NO: 959870 - DNA, 25 bp, Mus musculus
ttgtctcctgtatttcttatcatgg

SEQ ID NO: 959871 - DNA, 25 bp, Mus musculus
ttgtctccttgcactgtggccgggt

SEQ ID NO: 959872 - DNA, 25 bp, Mus musculus
ttgtctccttgctctgtggccgggt

SEQ ID NO: 959873 - DNA, 25 bp, Mus musculus
ttgtctcgccgtatgaagcagggat

SEQ ID NO: 959874 - DNA, 25 bp, Mus musculus
ttgtctcgccgtttgaagcagggat

SEQ ID NO: 959875 - DNA, 25 bp, Mus musculus
ttgtctcgcctcacttttcagtggg

SEQ ID NO: 959876 - DNA, 25 bp, Mus musculus
ttgtctcgcctctcttttcagtggg

SEQ ID NO: 959877 - DNA, 25 bp, Mus musculus
ttgtctcggccacattccagtggga

SEQ ID NO: 959878 - DNA, 25 bp, Mus musculus
ttgtctcggccagattccagtggga

SEQ ID NO: 959879 - DNA, 25 bp, Mus musculus
ttgtctcgggcaactaaattgaagt

SEQ ID NO: 959880 - DNA, 25 bp, Mus musculus
ttgtctcgggcatctaaattgaagt

SEQ ID NO: 959881 - DNA, 25 bp, Mus musculus
ttgtctctaatcaacttccgcaaag

SEQ ID NO: 959882 - DNA, 25 bp, Mus musculus
ttgtctctaatctacttccgcaaag

SEQ ID NO: 959883 - DNA, 25 bp, Mus musculus
ttgtctctaattctcttctgccctt

SEQ ID NO: 959884 - DNA, 25 bp, Mus musculus
ttgtctctaattgtcttctgccctt

SEQ ID NO: 959885 - DNA, 25 bp, Mus musculus
ttgtctctatttaagcatccttagt

SEQ ID NO: 959886 - DNA, 25 bp, Mus musculus
ttgtctctattttagcatccttagt

SEQ ID NO: 959887 - DNA, 25 bp, Mus musculus
ttgtctctcagcatttcgtcaaagc

SEQ ID NO: 959888 - DNA, 25 bp, Mus musculus
ttgtctctcagcttttcgtcaaagc

SEQ ID NO: 959889 - DNA, 25 bp, Mus musculus
ttgtctctcagtactattgggcttt

SEQ ID NO: 959890 - DNA, 25 bp, Mus musculus
ttgtctctcagttctattgggcttt

SEQ ID NO: 959891 - DNA, 25 bp, Mus musculus
ttgtctctccgaagccgaagaacta

SEQ ID NO: 959892 - DNA, 25 bp, Mus musculus
ttgtctctccgatgccgaagaacta

SEQ ID NO: 959893 - DNA, 25 bp, Mus musculus
ttgtctctcctgaggacgcctgtta

SEQ ID NO: 959894 - DNA, 25 bp, Mus musculus
ttgtctctcctgtggacgcctgtta

SEQ ID NO: 959895 - DNA, 25 bp, Mus musculus
ttgtctctctctcccatcttaaggt

SEQ ID NO: 959896 - DNA, 25 bp, Mus musculus
ttgtctctctctgccatcttaaggt

SEQ ID NO: 959897 - DNA, 25 bp, Mus musculus
ttgtctctcttaacgttttatcttt

SEQ ID NO: 959898 - DNA, 25 bp, Mus musculus
ttgtctctcttatcgttttatcttt

SEQ ID NO: 959899 - DNA, 25 bp, Mus musculus
ttgtctctcttcctctggttcctga

SEQ ID NO: 959900 - DNA, 25 bp, Mus musculus
ttgtctctcttcgtctggttcctga

SEQ ID NO: 959901 - DNA, 25 bp, Mus musculus
ttgtctctgaaaactaagccctcaa

SEQ ID NO: 959902 - DNA, 25 bp, Mus musculus
ttgtctctgaaatctaagccctcaa

SEQ ID NO: 959903 - DNA, 25 bp, Mus musculus
ttgtctctgagaaccagcctgagat

SEQ ID NO: 959904 - DNA, 25 bp, Mus musculus
ttgtctctgagatccagcctgagat

SEQ ID NO: 959905 - DNA, 25 bp, Mus musculus
ttgtctctgagtcgctgtgtctttg

SEQ ID NO: 959906 - DNA, 25 bp, Mus musculus
ttgtctctgagtggctgtgtctttg

SEQ ID NO: 959907 - DNA, 25 bp, Mus musculus
ttgtctctgcagaccgctcgggaat

SEQ ID NO: 959908 - DNA, 25 bp, Mus musculus
ttgtctctgcagtccgctcgggaat

SEQ ID NO: 959909 - DNA, 25 bp, Mus musculus
ttgtctctgcccagcagtgttgaca

SEQ ID NO: 959910 - DNA, 25 bp, Mus musculus
ttgtctctgccctgcagtgttgaca

SEQ ID NO: 959911 - DNA, 25 bp, Mus musculus
ttgtctctgcctcctgcatagctgt

SEQ ID NO: 959912 - DNA, 25 bp, Mus musculus
ttgtctctgcctcggagccattgaa

SEQ ID NO: 959913 - DNA, 25 bp, Mus musculus
ttgtctctgcctgctgcatagctgt

SEQ ID NO: 959914 - DNA, 25 bp, Mus musculus
ttgtctctgcctgggagccattgaa

SEQ ID NO: 959915 - DNA, 25 bp, Mus musculus
ttgtctctgcttaagaatgctgctg

SEQ ID NO: 959916 - DNA, 25 bp, Mus musculus
ttgtctctgcttactcagagtgcat

SEQ ID NO: 959917 - DNA, 25 bp, Mus musculus
ttgtctctgctttagaatgctgctg

SEQ ID NO: 959918 - DNA, 25 bp, Mus musculus
ttgtctctgctttctcagagtgcat

SEQ ID NO: 959919 - DNA, 25 bp, Mus musculus
ttgtctctggcaaacatggttttca

SEQ ID NO: 959920 - DNA, 25 bp, Mus musculus
ttgtctctggcatacatggttttca

SEQ ID NO: 959921 - DNA, 25 bp, Mus musculus
ttgtctctggccctttggtaaaggg

SEQ ID NO: 959922 - DNA, 25 bp, Mus musculus
ttgtctctggccgtttggtaaaggg

SEQ ID NO: 959923 - DNA, 25 bp, Mus musculus
ttgtctctggctcattcacttttct

SEQ ID NO: 959924 - DNA, 25 bp, Mus musculus
ttgtctctggctgattcacttttct

SEQ ID NO: 959925 - DNA, 25 bp, Mus musculus
ttgtctctgtccagatggcaacggt

SEQ ID NO: 959926 - DNA, 25 bp, Mus musculus
ttgtctctgtcctgatggcaacggt

SEQ ID NO: 959927 - DNA, 25 bp, Mus musculus
ttgtctctgtctaaatgaggattca

SEQ ID NO: 959928 - DNA, 25 bp, Mus musculus
ttgtctctgtcttaatgaggattca

SEQ ID NO: 959929 - DNA, 25 bp, Mus musculus
ttgtctctgttcatttctttctacc

SEQ ID NO: 959930 - DNA, 25 bp, Mus musculus
ttgtctctgttcttttctttctacc

SEQ ID NO: 959931 - DNA, 25 bp, Mus musculus
ttgtctcttaagatgtagcctctga

SEQ ID NO: 959932 - DNA, 25 bp, Mus musculus
ttgtctcttaagttgtagcctctga

SEQ ID NO: 959933 - DNA, 25 bp, Mus musculus
ttgtctcttgagaaaaacttgctgt

SEQ ID NO: 959934 - DNA, 25 bp, Mus musculus
ttgtctcttgagtaaaacttgctgt

SEQ ID NO: 959935 - DNA, 25 bp, Mus musculus
ttgtctcttggtaccagatttatgg

SEQ ID NO: 959936 - DNA, 25 bp, Mus musculus
ttgtctcttggttccagatttatgg

SEQ ID NO: 959937 - DNA, 25 bp, Mus musculus
ttgtctctttatacttgtgcagtga

SEQ ID NO: 959938 - DNA, 25 bp, Mus musculus
ttgtctctttattcttgtgcagtga

SEQ ID NO: 959939 - DNA, 25 bp, Mus musculus
ttgtctctttctattcatgataaac

SEQ ID NO: 959940 - DNA, 25 bp, Mus musculus
ttgtctctttcttttcatgataaac

SEQ ID NO: 959941 - DNA, 25 bp, Mus musculus
ttgtctctttgaagctgcatgtggg

SEQ ID NO: 959942 - DNA, 25 bp, Mus musculus
ttgtctctttgaatgctatatacat

SEQ ID NO: 959943 - DNA, 25 bp, Mus musculus
ttgtctctttgatgctgcatgtggg

SEQ ID NO: 959944 - DNA, 25 bp, Mus musculus
ttgtctctttgattgctatatacat

SEQ ID NO: 959945 - DNA, 25 bp, Mus musculus
ttgtctcttttacgcttcctcttta

SEQ ID NO: 959946 - DNA, 25 bp, Mus musculus
ttgtctcttttaggcttcctcttta

SEQ ID NO: 959947 - DNA, 25 bp, Mus musculus
ttgtctctttttctcatcttgacac

SEQ ID NO: 959948 - DNA, 25 bp, Mus musculus
ttgtctctttttgtcatcttgacac

SEQ ID NO: 959949 - DNA, 25 bp, Mus musculus
ttgtctgacaacattaaaggcaaaa

SEQ ID NO: 959950 - DNA, 25 bp, Mus musculus
ttgtctgacaactttaaaggcaaaa

SEQ ID NO: 959951 - DNA, 25 bp, Mus musculus
ttgtctgacaggcttggattgcatg

SEQ ID NO: 959952 - DNA, 25 bp, Mus musculus
ttgtctgacagggttggattgcatg

SEQ ID NO: 959953 - DNA, 25 bp, Mus musculus
ttgtctgaccgacctgtatctgaac

SEQ ID NO: 959954 - DNA, 25 bp, Mus musculus
ttgtctgaccgagctgtatctgaac

SEQ ID NO: 959955 - DNA, 25 bp, Mus musculus
ttgtctgagctcaggtgtgcaccaa

SEQ ID NO: 959956 - DNA, 25 bp, Mus musculus
ttgtctgagctctggtgtgcaccaa

SEQ ID NO: 959957 - DNA, 25 bp, Mus musculus
ttgtctgatacgagagctccaggcc

SEQ ID NO: 959958 - DNA, 25 bp, Mus musculus
ttgtctgatacgtgagctccaggcc

SEQ ID NO: 959959 - DNA, 25 bp, Mus musculus
ttgtctgcaagactttctccacgtg

SEQ ID NO: 959960 - DNA, 25 bp, Mus musculus
ttgtctgcaagagtttctccacgtg

SEQ ID NO: 959961 - DNA, 25 bp, Mus musculus
ttgtctgcacaactcatggattgag

SEQ ID NO: 959962 - DNA, 25 bp, Mus musculus
ttgtctgcacaagtcatggattgag

SEQ ID NO: 959963 - DNA, 25 bp, Mus musculus
ttgtctgcaccaactgcaaggacat

SEQ ID NO: 959964 - DNA, 25 bp, Mus musculus
ttgtctgcaccatctgcaaggacat

SEQ ID NO: 959965 - DNA, 25 bp, Mus musculus
ttgtctgcactcctcagtgaagcat

SEQ ID NO: 959966 - DNA, 25 bp, Mus musculus
ttgtctgcactcgtcagtgaagcat

SEQ ID NO: 959967 - DNA, 25 bp, Mus musculus
ttgtctgcactgagaccatgaccaa

SEQ ID NO: 959968 - DNA, 25 bp, Mus musculus
ttgtctgcactgtgaccatgaccaa

SEQ ID NO: 959969 - DNA, 25 bp, Mus musculus
ttgtctgcagaaaatatcccgaatt

SEQ ID NO: 959970 - DNA, 25 bp, Mus musculus
ttgtctgcagaatatatcccgaatt

SEQ ID NO: 959971 - DNA, 25 bp, Mus musculus
ttgtctgcagacaacttgataaaat

SEQ ID NO: 959972 - DNA, 25 bp, Mus musculus
ttgtctgcagactacttgataaaat

SEQ ID NO: 959973 - DNA, 25 bp, Mus musculus
ttgtctgcctgtcatgagctgtatc

SEQ ID NO: 959974 - DNA, 25 bp, Mus musculus
ttgtctgcctgtgatgagctgtatc

SEQ ID NO: 959975 - DNA, 25 bp, Mus musculus
ttgtctgctcagactattcacacac

SEQ ID NO: 959976 - DNA, 25 bp, Mus musculus
ttgtctgctcagtctattcacacac

SEQ ID NO: 959977 - DNA, 25 bp, Mus musculus
ttgtctgctcatagctgggctttat

SEQ ID NO: 959978 - DNA, 25 bp, Mus musculus
ttgtctgctcattgctgggctttat

SEQ ID NO: 959979 - DNA, 25 bp, Mus musculus
ttgtctgctgctcgtcattaagatt

SEQ ID NO: 959980 - DNA, 25 bp, Mus musculus
ttgtctgctgctggtcattaagatt

SEQ ID NO: 959981 - DNA, 25 bp, Mus musculus
ttgtctgctgtcagggaaccgccgt

SEQ ID NO: 959982 - DNA, 25 bp, Mus musculus
ttgtctgctgtctgggaaccgccgt

SEQ ID NO: 959983 - DNA, 25 bp, Mus musculus
ttgtctgcttccagatacggctgga

SEQ ID NO: 959984 - DNA, 25 bp, Mus musculus
ttgtctgcttcctgatacggctgga

SEQ ID NO: 959985 - DNA, 25 bp, Mus musculus
ttgtctgcttgcattgaatacaatg

SEQ ID NO: 959986 - DNA, 25 bp, Mus musculus
ttgtctgcttgctttgaatacaatg

SEQ ID NO: 959987 - DNA, 25 bp, Mus musculus
ttgtctggagtcacggtagctgtca

SEQ ID NO: 959988 - DNA, 25 bp, Mus musculus
ttgtctggagtctcggtagctgtca

SEQ ID NO: 959989 - DNA, 25 bp, Mus musculus
ttgtctggccttccagggcaccaga

SEQ ID NO: 959990 - DNA, 25 bp, Mus musculus
ttgtctggccttgcagggcaccaga

SEQ ID NO: 959991 - DNA, 25 bp, Mus musculus
ttgtctggctgtcggcttgatatcc

SEQ ID NO: 959992 - DNA, 25 bp, Mus musculus
ttgtctggctgtgggcttgatatcc

SEQ ID NO: 959993 - DNA, 25 bp, Mus musculus
ttgtctgggtttatactcatagtat

SEQ ID NO: 959994 - DNA, 25 bp, Mus musculus
ttgtctgggtttttactcatagtat

SEQ ID NO: 959995 - DNA, 25 bp, Mus musculus
ttgtctggtccaaatccatggcatt

SEQ ID NO: 959996 - DNA, 25 bp, Mus musculus
ttgtctggtccatatccatggcatt

SEQ ID NO: 959997 - DNA, 25 bp, Mus musculus
ttgtctggtctcaagcctgaatact

SEQ ID NO: 959998 - DNA, 25 bp, Mus musculus
ttgtctggtctctagcctgaatact

SEQ ID NO: 959999 - DNA, 25 bp, Mus musculus
ttgtctgtaagtagaaatgccaact

SEQ ID NO: 960000 - DNA, 25 bp, Mus musculus
ttgtctgtaagttgaaatgccaact

SEQ ID NO: 960001 - DNA, 25 bp, Mus musculus
ttgtctgtacataggaatccccagg

SEQ ID NO: 960002 - DNA, 25 bp, Mus musculus
ttgtctgtacattggaatccccagg

SEQ ID NO: 960003 - DNA, 25 bp, Mus musculus
ttgtctgtagccatgggagtgtgcc

SEQ ID NO: 960004 - DNA, 25 bp, Mus musculus
ttgtctgtagccttgggagtgtgcc

SEQ ID NO: 960005 - DNA, 25 bp, Mus musculus
ttgtctgtcagcctctctttaatct

SEQ ID NO: 960006 - DNA, 25 bp, Mus musculus
ttgtctgtcagcgtctctttaatct

SEQ ID NO: 960007 - DNA, 25 bp, Mus musculus
ttgtctgtccagcaaggtgtggttt

SEQ ID NO: 960008 - DNA, 25 bp, Mus musculus
ttgtctgtccaggaaggtgtggttt

SEQ ID NO: 960009 - DNA, 25 bp, Mus musculus
ttgtctgtcccgagcagcttggttt

SEQ ID NO: 960010 - DNA, 25 bp, Mus musculus
ttgtctgtcccgtgcagcttggttt

SEQ ID NO: 960011 - DNA, 25 bp, Mus musculus
ttgtctgtcctacaagtggcccttt

SEQ ID NO: 960012 - DNA, 25 bp, Mus musculus
ttgtctgtcctagaagtggcccttt

SEQ ID NO: 960013 - DNA, 25 bp, Mus musculus
ttgtctgtcgtcctgtttctctgac

SEQ ID NO: 960014 - DNA, 25 bp, Mus musculus
ttgtctgtcgtcgtgtttctctgac

SEQ ID NO: 960015 - DNA, 25 bp, Mus musculus
ttgtctgtctagcatgagttctcac

SEQ ID NO: 960016 - DNA, 25 bp, Mus musculus
ttgtctgtctaggatgagttctcac

SEQ ID NO: 960017 - DNA, 25 bp, Mus musculus
ttgtctgtcttgatggaactggcca

SEQ ID NO: 960018 - DNA, 25 bp, Mus musculus
ttgtctgtcttgttggaactggcca

SEQ ID NO: 960019 - DNA, 25 bp, Mus musculus
ttgtctgtgaagacgaccatggtgt

SEQ ID NO: 960020 - DNA, 25 bp, Mus musculus
ttgtctgtgaagtcgaccatggtgt

SEQ ID NO: 960021 - DNA, 25 bp, Mus musculus
ttgtctgtgccacaattggagacac

SEQ ID NO: 960022 - DNA, 25 bp, Mus musculus
ttgtctgtgccagaattggagacac

SEQ ID NO: 960023 - DNA, 25 bp, Mus musculus
ttgtctgtgcccagttctgtgcata

SEQ ID NO: 960024 - DNA, 25 bp, Mus musculus
ttgtctgtgccctgttctgtgcata

SEQ ID NO: 960025 - DNA, 25 bp, Mus musculus
ttgtctgtgtccctcatccagaggg

SEQ ID NO: 960026 - DNA, 25 bp, Mus musculus
ttgtctgtgtccgtcatccagaggg

SEQ ID NO: 960027 - DNA, 25 bp, Mus musculus
ttgtctgtgttcacttgctgtgaaa

SEQ ID NO: 960028 - DNA, 25 bp, Mus musculus
ttgtctgtgttcatgtcaccggatt

SEQ ID NO: 960029 - DNA, 25 bp, Mus musculus
ttgtctgtgttctcttgctgtgaaa

SEQ ID NO: 960030 - DNA, 25 bp, Mus musculus
ttgtctgtgttcttgtcaccggatt

SEQ ID NO: 960031 - DNA, 25 bp, Mus musculus
ttgtctgttactcaagtgtgggtcc

SEQ ID NO: 960032 - DNA, 25 bp, Mus musculus
ttgtctgttactgaagtgtgggtcc

SEQ ID NO: 960033 - DNA, 25 bp, Mus musculus
ttgtctgttatcactgtcactatgc

SEQ ID NO: 960034 - DNA, 25 bp, Mus musculus
ttgtctgttatctctgtcactatgc

SEQ ID NO: 960035 - DNA, 25 bp, Mus musculus
ttgtctgttgagagtggcgtctcct

SEQ ID NO: 960036 - DNA, 25 bp, Mus musculus
ttgtctgttgagatcttggctagcc

SEQ ID NO: 960037 - DNA, 25 bp, Mus musculus
ttgtctgttgagtgtggcgtctcct

SEQ ID NO: 960038 - DNA, 25 bp, Mus musculus
ttgtctgttgagttcttggctagcc

SEQ ID NO: 960039 - DNA, 25 bp, Mus musculus
ttgtctgttgctcctcactgcaacc

SEQ ID NO: 960040 - DNA, 25 bp, Mus musculus
ttgtctgttgctgctcactgcaacc

SEQ ID NO: 960041 - DNA, 25 bp, Mus musculus
ttgtctgttgttctcagtctttggg

SEQ ID NO: 960042 - DNA, 25 bp, Mus musculus
ttgtctgttgttgtcagtctttggg

SEQ ID NO: 960043 - DNA, 25 bp, Mus musculus
ttgtctgtttgaagctatgctacgt

SEQ ID NO: 960044 - DNA, 25 bp, Mus musculus
ttgtctgtttgatgctatgctacgt

SEQ ID NO: 960045 - DNA, 25 bp, Mus musculus
ttgtctgtttgcatctgggttgaca

SEQ ID NO: 960046 - DNA, 25 bp, Mus musculus
ttgtctgtttgcttctgggttgaca

SEQ ID NO: 960047 - DNA, 25 bp, Mus musculus
ttgtcttaagtgcttcagtcttttg

SEQ ID NO: 960048 - DNA, 25 bp, Mus musculus
ttgtcttaagtggttcagtcttttg

SEQ ID NO: 960049 - DNA, 25 bp, Mus musculus
ttgtcttactctaaccatagctagg

SEQ ID NO: 960050 - DNA, 25 bp, Mus musculus
ttgtcttactcttaccatagctagg

SEQ ID NO: 960051 - DNA, 25 bp, Mus musculus
ttgtcttagcaccattttctctcac

SEQ ID NO: 960052 - DNA, 25 bp, Mus musculus
ttgtcttagcacgattttctctcac

SEQ ID NO: 960053 - DNA, 25 bp, Mus musculus
ttgtcttagccaatttcctgttagt

SEQ ID NO: 960054 - DNA, 25 bp, Mus musculus
ttgtcttagccattttcctgttagt

SEQ ID NO: 960055 - DNA, 25 bp, Mus musculus
ttgtcttatatacctcctgaccaca

SEQ ID NO: 960056 - DNA, 25 bp, Mus musculus
ttgtcttatatagctcctgaccaca

SEQ ID NO: 960057 - DNA, 25 bp, Mus musculus
ttgtcttatatgagcagcagaaata

SEQ ID NO: 960058 - DNA, 25 bp, Mus musculus
ttgtcttatatgtgcagcagaaata

SEQ ID NO: 960059 - DNA, 25 bp, Mus musculus
ttgtcttatgctatgaaaccctctt

SEQ ID NO: 960060 - DNA, 25 bp, Mus musculus
ttgtcttatgctttgaaaccctctt

SEQ ID NO: 960061 - DNA, 25 bp, Mus musculus
ttgtcttcaagaacgcaggagccat

SEQ ID NO: 960062 - DNA, 25 bp, Mus musculus
ttgtcttcaagatcgcaggagccat

SEQ ID NO: 960063 - DNA, 25 bp, Mus musculus
ttgtcttcaataagttggtccgata

SEQ ID NO: 960064 - DNA, 25 bp, Mus musculus
ttgtcttcaatatgttggtccgata

SEQ ID NO: 960065 - DNA, 25 bp, Mus musculus
ttgtcttcagagatttggaggaccc

SEQ ID NO: 960066 - DNA, 25 bp, Mus musculus
ttgtcttcagagttttggaggaccc

SEQ ID NO: 960067 - DNA, 25 bp, Mus musculus
ttgtcttcagctcttgcgagtctat

SEQ ID NO: 960068 - DNA, 25 bp, Mus musculus
ttgtcttcagctgttgcgagtctat

SEQ ID NO: 960069 - DNA, 25 bp, Mus musculus
ttgtcttcatatacatgtgcaggaa

SEQ ID NO: 960070 - DNA, 25 bp, Mus musculus
ttgtcttcatattcatgtgcaggaa

SEQ ID NO: 960071 - DNA, 25 bp, Mus musculus
ttgtcttcatctcccgagtaatggg

SEQ ID NO: 960072 - DNA, 25 bp, Mus musculus
ttgtcttcatctgccgagtaatggg

SEQ ID NO: 960073 - DNA, 25 bp, Mus musculus
ttgtcttccaatcaaggctgaagtt

SEQ ID NO: 960074 - DNA, 25 bp, Mus musculus
ttgtcttccaatgaaggctgaagtt

SEQ ID NO: 960075 - DNA, 25 bp, Mus musculus
ttgtcttcccataaacctttgccag

SEQ ID NO: 960076 - DNA, 25 bp, Mus musculus
ttgtcttcccattaacctttgccag

SEQ ID NO: 960077 - DNA, 25 bp, Mus musculus
ttgtcttcccctactgaataacatc

SEQ ID NO: 960078 - DNA, 25 bp, Mus musculus
ttgtcttccccttctgaataacatc

SEQ ID NO: 960079 - DNA, 25 bp, Mus musculus
ttgtcttcccttcagtgtaatccat

SEQ ID NO: 960080 - DNA, 25 bp, Mus musculus
ttgtcttcccttgagtgtaatccat

SEQ ID NO: 960081 - DNA, 25 bp, Mus musculus
ttgtcttcctggctgccatggcatc

SEQ ID NO: 960082 - DNA, 25 bp, Mus musculus
ttgtcttcctgggtgccatggcatc

SEQ ID NO: 960083 - DNA, 25 bp, Mus musculus
ttgtcttcggtcacctttttgtgaa

SEQ ID NO: 960084 - DNA, 25 bp, Mus musculus
ttgtcttcggtctcctttttgtgaa

SEQ ID NO: 960085 - DNA, 25 bp, Mus musculus
ttgtcttctcagataccggcaaggt

SEQ ID NO: 960086 - DNA, 25 bp, Mus musculus
ttgtcttctcagttaccggcaaggt

SEQ ID NO: 960087 - DNA, 25 bp, Mus musculus
ttgtcttctgagatccacatgtaca

SEQ ID NO: 960088 - DNA, 25 bp, Mus musculus
ttgtcttctgagttccacatgtaca

SEQ ID NO: 960089 - DNA, 25 bp, Mus musculus
ttgtcttctgcgcaagagtgtgaat

SEQ ID NO: 960090 - DNA, 25 bp, Mus musculus
ttgtcttctgcggaagagtgtgaat

SEQ ID NO: 960091 - DNA, 25 bp, Mus musculus
ttgtcttctgtcctcatggctagat

SEQ ID NO: 960092 - DNA, 25 bp, Mus musculus
ttgtcttctgtcgtcatggctagat

SEQ ID NO: 960093 - DNA, 25 bp, Mus musculus
ttgtcttcttgaaagtgtaccgtag

SEQ ID NO: 960094 - DNA, 25 bp, Mus musculus
ttgtcttcttgatagtgtaccgtag

SEQ ID NO: 960095 - DNA, 25 bp, Mus musculus
ttgtcttgaattaggaccccagagc

SEQ ID NO: 960096 - DNA, 25 bp, Mus musculus
ttgtcttgaatttggaccccagagc

SEQ ID NO: 960097 - DNA, 25 bp, Mus musculus
ttgtcttgacaaatcggccttcatc

SEQ ID NO: 960098 - DNA, 25 bp, Mus musculus
ttgtcttgacaactgaaagctgtgt

SEQ ID NO: 960099 - DNA, 25 bp, Mus musculus
ttgtcttgacaagtgaaagctgtgt

SEQ ID NO: 960100 - DNA, 25 bp, Mus musculus
ttgtcttgacaattcggccttcatc

SEQ ID NO: 960101 - DNA, 25 bp, Mus musculus
ttgtcttgacataatcatccagcct

SEQ ID NO: 960102 - DNA, 25 bp, Mus musculus
ttgtcttgacattatcatccagcct

SEQ ID NO: 960103 - DNA, 25 bp, Mus musculus
ttgtcttgacctactgaagcgttgg

SEQ ID NO: 960104 - DNA, 25 bp, Mus musculus
ttgtcttgaccttctgaagcgttgg

SEQ ID NO: 960105 - DNA, 25 bp, Mus musculus
ttgtcttgagtgcagaccgaagtgt

SEQ ID NO: 960106 - DNA, 25 bp, Mus musculus
ttgtcttgagtggagaccgaagtgt

SEQ ID NO: 960107 - DNA, 25 bp, Mus musculus
ttgtcttgcaagcctatatggaaca

SEQ ID NO: 960108 - DNA, 25 bp, Mus musculus
ttgtcttgcaaggctatatggaaca

SEQ ID NO: 960109 - DNA, 25 bp, Mus musculus
ttgtcttgcatccttattttcttct

SEQ ID NO: 960110 - DNA, 25 bp, Mus musculus
ttgtcttgcatcgttattttcttct

SEQ ID NO: 960111 - DNA, 25 bp, Mus musculus
ttgtcttggacaccaactggactgg

SEQ ID NO: 960112 - DNA, 25 bp, Mus musculus
ttgtcttggacagcaactggactgg

SEQ ID NO: 960113 - DNA, 25 bp, Mus musculus
ttgtcttggactatcacagtactct

SEQ ID NO: 960114 - DNA, 25 bp, Mus musculus
ttgtcttggactcttccttcctaga

SEQ ID NO: 960115 - DNA, 25 bp, Mus musculus
ttgtcttggactgttccttcctaga

SEQ ID NO: 960116 - DNA, 25 bp, Mus musculus
ttgtcttggactttcacagtactct

SEQ ID NO: 960117 - DNA, 25 bp, Mus musculus
ttgtcttggcacatcttgtctttgt

SEQ ID NO: 960118 - DNA, 25 bp, Mus musculus
ttgtcttggcacttcttgtctttgt

SEQ ID NO: 960119 - DNA, 25 bp, Mus musculus
ttgtcttgtgtaaaatggcatcctc

SEQ ID NO: 960120 - DNA, 25 bp, Mus musculus
ttgtcttgtgtataatggcatcctc

SEQ ID NO: 960121 - DNA, 25 bp, Mus musculus
ttgtctttaaccaccaagtaggtct

SEQ ID NO: 960122 - DNA, 25 bp, Mus musculus
ttgtctttaacctccaagtaggtct

SEQ ID NO: 960123 - DNA, 25 bp, Mus musculus
ttgtctttagctctctgactgagga

SEQ ID NO: 960124 - DNA, 25 bp, Mus musculus
ttgtctttagctgtctgactgagga

SEQ ID NO: 960125 - DNA, 25 bp, Mus musculus
ttgtctttataacttccttctgcct

SEQ ID NO: 960126 - DNA, 25 bp, Mus musculus
ttgtctttataagttccttctgcct

SEQ ID NO: 960127 - DNA, 25 bp, Mus musculus
ttgtctttatatccgagggaactac

SEQ ID NO: 960128 - DNA, 25 bp, Mus musculus
ttgtctttatatgcgagggaactac

SEQ ID NO: 960129 - DNA, 25 bp, Mus musculus
ttgtctttatgtcacctgttggcct

SEQ ID NO: 960130 - DNA, 25 bp, Mus musculus
ttgtctttatgtgacctgttggcct

SEQ ID NO: 960131 - DNA, 25 bp, Mus musculus
ttgtctttcaatagtatttactcta

SEQ ID NO: 960132 - DNA, 25 bp, Mus musculus
ttgtctttcaattgtatttactcta

SEQ ID NO: 960133 - DNA, 25 bp, Mus musculus
ttgtctttcataatgagaggctcag

SEQ ID NO: 960134 - DNA, 25 bp, Mus musculus
ttgtctttcatattgagaggctcag

SEQ ID NO: 960135 - DNA, 25 bp, Mus musculus
ttgtctttcccacaatgccaagcaa

SEQ ID NO: 960136 - DNA, 25 bp, Mus musculus
ttgtctttcccagaatgccaagcaa

SEQ ID NO: 960137 - DNA, 25 bp, Mus musculus
ttgtctttccctagaggcaccaggt

SEQ ID NO: 960138 - DNA, 25 bp, Mus musculus
ttgtctttccctccatagcaatata

SEQ ID NO: 960139 - DNA, 25 bp, Mus musculus
ttgtctttccctgcatagcaatata

SEQ ID NO: 960140 - DNA, 25 bp, Mus musculus
ttgtctttcccttgaggcaccaggt

SEQ ID NO: 960141 - DNA, 25 bp, Mus musculus
ttgtctttccttactgtgtctgcaa

SEQ ID NO: 960142 - DNA, 25 bp, Mus musculus
ttgtctttcctttctgtgtctgcaa

SEQ ID NO: 960143 - DNA, 25 bp, Mus musculus
ttgtctttctggatccatagccaaa

SEQ ID NO: 960144 - DNA, 25 bp, Mus musculus
ttgtctttctggttccatagccaaa

SEQ ID NO: 960145 - DNA, 25 bp, Mus musculus
ttgtctttctttactgtacttagga

SEQ ID NO: 960146 - DNA, 25 bp, Mus musculus
ttgtctttcttttctgtacttagga

SEQ ID NO: 960147 - DNA, 25 bp, Mus musculus
ttgtctttgcaccagtcccacaaat

SEQ ID NO: 960148 - DNA, 25 bp, Mus musculus
ttgtctttgcacgagtcccacaaat

SEQ ID NO: 960149 - DNA, 25 bp, Mus musculus
ttgtctttgctgcttgactccgttc

SEQ ID NO: 960150 - DNA, 25 bp, Mus musculus
ttgtctttgctggttgactccgttc

SEQ ID NO: 960151 - DNA, 25 bp, Mus musculus
ttgtctttggagatcacaaagcctt

SEQ ID NO: 960152 - DNA, 25 bp, Mus musculus
ttgtctttggagttcacaaagcctt

SEQ ID NO: 960153 - DNA, 25 bp, Mus musculus
ttgtctttgttcacttgtccagctt

SEQ ID NO: 960154 - DNA, 25 bp, Mus musculus
ttgtctttgttcatcttggccttgc

SEQ ID NO: 960155 - DNA, 25 bp, Mus musculus
ttgtctttgttctcttgtccagctt

SEQ ID NO: 960156 - DNA, 25 bp, Mus musculus
ttgtctttgttcttcttggccttgc

SEQ ID NO: 960157 - DNA, 25 bp, Mus musculus
ttgtcttttcctccctattggagta

SEQ ID NO: 960158 - DNA, 25 bp, Mus musculus
ttgtcttttcctgcctattggagta

SEQ ID NO: 960159 - DNA, 25 bp, Mus musculus
ttgtcttttgagctcgcatcctgat

SEQ ID NO: 960160 - DNA, 25 bp, Mus musculus
ttgtcttttgaggtcgcatcctgat

SEQ ID NO: 960161 - DNA, 25 bp, Mus musculus
ttgtgaaacattccaggtgaagcat

SEQ ID NO: 960162 - DNA, 25 bp, Mus musculus
ttgtgaaacattgcaggtgaagcat

SEQ ID NO: 960163 - DNA, 25 bp, Mus musculus
ttgtgaaactcccagacgtgccgtg

SEQ ID NO: 960164 - DNA, 25 bp, Mus musculus
ttgtgaaactccgagacgtgccgtg

SEQ ID NO: 960165 - DNA, 25 bp, Mus musculus
ttgtgaaactctcacaggcccgcag

SEQ ID NO: 960166 - DNA, 25 bp, Mus musculus
ttgtgaaactctgacaggcccgcag

SEQ ID NO: 960167 - DNA, 25 bp, Mus musculus
ttgtgaaagccaactcataccctga

SEQ ID NO: 960168 - DNA, 25 bp, Mus musculus
ttgtgaaagccatctcataccctga

SEQ ID NO: 960169 - DNA, 25 bp, Mus musculus
ttgtgaaaggtgctgtcatgtcccc

SEQ ID NO: 960170 - DNA, 25 bp, Mus musculus
ttgtgaaaggtggtgtcatgtcccc

SEQ ID NO: 960171 - DNA, 25 bp, Mus musculus
ttgtgaaagtcccagcgtcaatgcc

SEQ ID NO: 960172 - DNA, 25 bp, Mus musculus
ttgtgaaagtccgagcgtcaatgcc

SEQ ID NO: 960173 - DNA, 25 bp, Mus musculus
ttgtgaaagttacccttttagccag

SEQ ID NO: 960174 - DNA, 25 bp, Mus musculus
ttgtgaaagttagccttttagccag

SEQ ID NO: 960175 - DNA, 25 bp, Mus musculus
ttgtgaaagttgaggatttgccgct

SEQ ID NO: 960176 - DNA, 25 bp, Mus musculus
ttgtgaaagttgtggatttgccgct

SEQ ID NO: 960177 - DNA, 25 bp, Mus musculus
ttgtgaaatggacctaagttctctt

SEQ ID NO: 960178 - DNA, 25 bp, Mus musculus
ttgtgaaatggagctaagttctctt

SEQ ID NO: 960179 - DNA, 25 bp, Mus musculus
ttgtgaaatggccaggatcctcccc

SEQ ID NO: 960180 - DNA, 25 bp, Mus musculus
ttgtgaaatggcgaggatcctcccc

SEQ ID NO: 960181 - DNA, 25 bp, Mus musculus
ttgtgaaattcccaacagcctggct

SEQ ID NO: 960182 - DNA, 25 bp, Mus musculus
ttgtgaaattccgaacagcctggct

SEQ ID NO: 960183 - DNA, 25 bp, Mus musculus
ttgtgaacaactatcaagccaccgg

SEQ ID NO: 960184 - DNA, 25 bp, Mus musculus
ttgtgaacaactttcaagccaccgg

SEQ ID NO: 960185 - DNA, 25 bp, Mus musculus
ttgtgaacaagcatggtggccacca

SEQ ID NO: 960186 - DNA, 25 bp, Mus musculus
ttgtgaacaagcttggtggccacca

SEQ ID NO: 960187 - DNA, 25 bp, Mus musculus
ttgtgaacaaggcaccagtggctgt

SEQ ID NO: 960188 - DNA, 25 bp, Mus musculus
ttgtgaacaagggaccagtggctgt

SEQ ID NO: 960189 - DNA, 25 bp, Mus musculus
ttgtgaacagaactggtttggactc

SEQ ID NO: 960190 - DNA, 25 bp, Mus musculus
ttgtgaacagaagtggtttggactc

SEQ ID NO: 960191 - DNA, 25 bp, Mus musculus
ttgtgaacagctcgtggcatctctc

SEQ ID NO: 960192 - DNA, 25 bp, Mus musculus
ttgtgaacagctggtggcatctctc

SEQ ID NO: 960193 - DNA, 25 bp, Mus musculus
ttgtgaacccacaagcagccgagaa

SEQ ID NO: 960194 - DNA, 25 bp, Mus musculus
ttgtgaacccactagcagccgagaa

SEQ ID NO: 960195 - DNA, 25 bp, Mus musculus
ttgtgaaccccactgtgttcttgta

SEQ ID NO: 960196 - DNA, 25 bp, Mus musculus
ttgtgaaccccagtgtgttcttgta

SEQ ID NO: 960197 - DNA, 25 bp, Mus musculus
ttgtgaacccctagtgtgctgcctt

SEQ ID NO: 960198 - DNA, 25 bp, Mus musculus
ttgtgaaccccttgtgtgctgcctt

SEQ ID NO: 960199 - DNA, 25 bp, Mus musculus
ttgtgaacctatatgggctgcgctc

SEQ ID NO: 960200 - DNA, 25 bp, Mus musculus
ttgtgaacctatttgggctgcgctc

SEQ ID NO: 960201 - DNA, 25 bp, Mus musculus
ttgtgaacctccagagcttcatgat

SEQ ID NO: 960202 - DNA, 25 bp, Mus musculus
ttgtgaacctcctgagcttcatgat

SEQ ID NO: 960203 - DNA, 25 bp, Mus musculus
ttgtgaacgtcaattcctgttcttg

SEQ ID NO: 960204 - DNA, 25 bp, Mus musculus
ttgtgaacgtcatttcctgttcttg

SEQ ID NO: 960205 - DNA, 25 bp, Mus musculus
ttgtgaactattctcgtttccacct

SEQ ID NO: 960206 - DNA, 25 bp, Mus musculus
ttgtgaactattgtcgtttccacct

SEQ ID NO: 960207 - DNA, 25 bp, Mus musculus
ttgtgaactcacaacacccgatgct

SEQ ID NO: 960208 - DNA, 25 bp, Mus musculus
ttgtgaactcactacacccgatgct

SEQ ID NO: 960209 - DNA, 25 bp, Mus musculus
ttgtgaactcataccacatcccaag

SEQ ID NO: 960210 - DNA, 25 bp, Mus musculus
ttgtgaactcattccacatcccaag

SEQ ID NO: 960211 - DNA, 25 bp, Mus musculus
ttgtgaactcttcattatcagcttc

SEQ ID NO: 960212 - DNA, 25 bp, Mus musculus
ttgtgaactcttgattatcagcttc

SEQ ID NO: 960213 - DNA, 25 bp, Mus musculus
ttgtgaactggacccggtgactgtc

SEQ ID NO: 960214 - DNA, 25 bp, Mus musculus
ttgtgaactggagccggtgactgtc

SEQ ID NO: 960215 - DNA, 25 bp, Mus musculus
ttgtgaacttctacatccagtgcct

SEQ ID NO: 960216 - DNA, 25 bp, Mus musculus
ttgtgaacttcttcatccagtgcct

SEQ ID NO: 960217 - DNA, 25 bp, Mus musculus
ttgtgaagaagaacccacgccattc

SEQ ID NO: 960218 - DNA, 25 bp, Mus musculus
ttgtgaagaagatcccacgccattc

SEQ ID NO: 960219 - DNA, 25 bp, Mus musculus
ttgtgaagactacgttcgcccatat

SEQ ID NO: 960220 - DNA, 25 bp, Mus musculus
ttgtgaagactaggttcgcccatat

SEQ ID NO: 960221 - DNA, 25 bp, Mus musculus
ttgtgaagatctcacaggaccgcag

SEQ ID NO: 960222 - DNA, 25 bp, Mus musculus
ttgtgaagatctcactggactacac

SEQ ID NO: 960223 - DNA, 25 bp, Mus musculus
ttgtgaagatctgacaggaccgcag

SEQ ID NO: 960224 - DNA, 25 bp, Mus musculus
ttgtgaagatctgactggactacac

SEQ ID NO: 960225 - DNA, 25 bp, Mus musculus
ttgtgaagcataagcaagacacttg

SEQ ID NO: 960226 - DNA, 25 bp, Mus musculus
ttgtgaagcatatgcaagacacttg

SEQ ID NO: 960227 - DNA, 25 bp, Mus musculus
ttgtgaagcatgaggcctttataac

SEQ ID NO: 960228 - DNA, 25 bp, Mus musculus
ttgtgaagcatgatcccgtgtgagg

SEQ ID NO: 960229 - DNA, 25 bp, Mus musculus
ttgtgaagcatgtggcctttataac

SEQ ID NO: 960230 - DNA, 25 bp, Mus musculus
ttgtgaagcatgttcccgtgtgagg

SEQ ID NO: 960231 - DNA, 25 bp, Mus musculus
ttgtgaagcccaacgtgggtctcgc

SEQ ID NO: 960232 - DNA, 25 bp, Mus musculus
ttgtgaagcccatcgtgggtctcgc

SEQ ID NO: 960233 - DNA, 25 bp, Mus musculus
ttgtgaagcctgaggatggttccct

SEQ ID NO: 960234 - DNA, 25 bp, Mus musculus
ttgtgaagcctgcacccattgacca

SEQ ID NO: 960235 - DNA, 25 bp, Mus musculus
ttgtgaagcctggacccattgacca

SEQ ID NO: 960236 - DNA, 25 bp, Mus musculus
ttgtgaagcctgtggatggttccct

SEQ ID NO: 960237 - DNA, 25 bp, Mus musculus
ttgtgaaggcagagccaagctcaca

SEQ ID NO: 960238 - DNA, 25 bp, Mus musculus
ttgtgaaggcagtgccaagctcaca

SEQ ID NO: 960239 - DNA, 25 bp, Mus musculus
ttgtgaagtaaaacccctgttaaat

SEQ ID NO: 960240 - DNA, 25 bp, Mus musculus
ttgtgaagtaaatcccctgttaaat

SEQ ID NO: 960241 - DNA, 25 bp, Mus musculus
ttgtgaagtcaccacgttttcagtt

SEQ ID NO: 960242 - DNA, 25 bp, Mus musculus
ttgtgaagtcacgacgttttcagtt

SEQ ID NO: 960243 - DNA, 25 bp, Mus musculus
ttgtgaagttctcaaacctcaaata

SEQ ID NO: 960244 - DNA, 25 bp, Mus musculus
ttgtgaagttctgaaacctcaaata

SEQ ID NO: 960245 - DNA, 25 bp, Mus musculus
ttgtgaatagctcattggcatcatt

SEQ ID NO: 960246 - DNA, 25 bp, Mus musculus
ttgtgaatagctgattggcatcatt

SEQ ID NO: 960247 - DNA, 25 bp, Mus musculus
ttgtgaatggctaactttggttttt

SEQ ID NO: 960248 - DNA, 25 bp, Mus musculus
ttgtgaatggcttactttggttttt

SEQ ID NO: 960249 - DNA, 25 bp, Mus musculus
ttgtgaattataatgccaacctgca

SEQ ID NO: 960250 - DNA, 25 bp, Mus musculus
ttgtgaattatattgccaacctgca

SEQ ID NO: 960251 - DNA, 25 bp, Mus musculus
ttgtgaattggaccccaggcccacc

SEQ ID NO: 960252 - DNA, 25 bp, Mus musculus
ttgtgaattggagcccaggcccacc

SEQ ID NO: 960253 - DNA, 25 bp, Mus musculus
ttgtgaattgtgcagcttccaaact

SEQ ID NO: 960254 - DNA, 25 bp, Mus musculus
ttgtgaattgtggagcttccaaact

SEQ ID NO: 960255 - DNA, 25 bp, Mus musculus
ttgtgacaaacaccagaggtgataa

SEQ ID NO: 960256 - DNA, 25 bp, Mus musculus
ttgtgacaaacagcagaggtgataa

SEQ ID NO: 960257 - DNA, 25 bp, Mus musculus
ttgtgacaatccctagctggcgaga

SEQ ID NO: 960258 - DNA, 25 bp, Mus musculus
ttgtgacaatccgtagctggcgaga

SEQ ID NO: 960259 - DNA, 25 bp, Mus musculus
ttgtgacacacaactccttgcagga

SEQ ID NO: 960260 - DNA, 25 bp, Mus musculus
ttgtgacacacatctccttgcagga

SEQ ID NO: 960261 - DNA, 25 bp, Mus musculus
ttgtgacacagtcggtcttccatct

SEQ ID NO: 960262 - DNA, 25 bp, Mus musculus
ttgtgacacagtgggtcttccatct

SEQ ID NO: 960263 - DNA, 25 bp, Mus musculus
ttgtgacaccggatttttatagatt

SEQ ID NO: 960264 - DNA, 25 bp, Mus musculus
ttgtgacaccggttttttatagatt

SEQ ID NO: 960265 - DNA, 25 bp, Mus musculus
ttgtgacatcctatttctgcagcat

SEQ ID NO: 960266 - DNA, 25 bp, Mus musculus
ttgtgacatcctttttctgcagcat

SEQ ID NO: 960267 - DNA, 25 bp, Mus musculus
ttgtgacattccaagttgacttttt

SEQ ID NO: 960268 - DNA, 25 bp, Mus musculus
ttgtgacattcctagttgacttttt

SEQ ID NO: 960269 - DNA, 25 bp, Mus musculus
ttgtgacatttgctaccctgggcat

SEQ ID NO: 960270 - DNA, 25 bp, Mus musculus
ttgtgacatttggtaccctgggcat

SEQ ID NO: 960271 - DNA, 25 bp, Mus musculus
ttgtgaccagccagatgacttagat

SEQ ID NO: 960272 - DNA, 25 bp, Mus musculus
ttgtgaccagcctgatgacttagat

SEQ ID NO: 960273 - DNA, 25 bp, Mus musculus
ttgtgaccatagagcaccgtgcagg

SEQ ID NO: 960274 - DNA, 25 bp, Mus musculus
ttgtgaccatagatctctctggaac

SEQ ID NO: 960275 - DNA, 25 bp, Mus musculus
ttgtgaccatagtgcaccgtgcagg

SEQ ID NO: 960276 - DNA, 25 bp, Mus musculus
ttgtgaccatagttctctctggaac

SEQ ID NO: 960277 - DNA, 25 bp, Mus musculus
ttgtgaccattcacagacactcttt

SEQ ID NO: 960278 - DNA, 25 bp, Mus musculus
ttgtgaccattctcagacactcttt

SEQ ID NO: 960279 - DNA, 25 bp, Mus musculus
ttgtgacccataccgccatatctta

SEQ ID NO: 960280 - DNA, 25 bp, Mus musculus
ttgtgacccatacgccaccacgatt

SEQ ID NO: 960281 - DNA, 25 bp, Mus musculus
ttgtgacccatagcgccatatctta

SEQ ID NO: 960282 - DNA, 25 bp, Mus musculus
ttgtgacccataggccaccacgatt

SEQ ID NO: 960283 - DNA, 25 bp, Mus musculus
ttgtgaccctttagttcccctaatg

SEQ ID NO: 960284 - DNA, 25 bp, Mus musculus
ttgtgacccttttgttcccctaatg

SEQ ID NO: 960285 - DNA, 25 bp, Mus musculus
ttgtgaccggtcctaacgtccgata

SEQ ID NO: 960286 - DNA, 25 bp, Mus musculus
ttgtgaccggtcgtaacgtccgata

SEQ ID NO: 960287 - DNA, 25 bp, Mus musculus
ttgtgacctaaaatctcaaccccag

SEQ ID NO: 960288 - DNA, 25 bp, Mus musculus
ttgtgacctaaattctcaaccccag

SEQ ID NO: 960289 - DNA, 25 bp, Mus musculus
ttgtgacctcatatcctggttggaa

SEQ ID NO: 960290 - DNA, 25 bp, Mus musculus
ttgtgacctcatttcctggttggaa

SEQ ID NO: 960291 - DNA, 25 bp, Mus musculus
ttgtgacctctactttcctgtgtga

SEQ ID NO: 960292 - DNA, 25 bp, Mus musculus
ttgtgacctctagtttcctgtgtga

SEQ ID NO: 960293 - DNA, 25 bp, Mus musculus
ttgtgacgccctacaaactgtaatt

SEQ ID NO: 960294 - DNA, 25 bp, Mus musculus
ttgtgacgcccttcaaactgtaatt

SEQ ID NO: 960295 - DNA, 25 bp, Mus musculus
ttgtgacgctgactgatcaacccta

SEQ ID NO: 960296 - DNA, 25 bp, Mus musculus
ttgtgacgctgagtgatcaacccta

SEQ ID NO: 960297 - DNA, 25 bp, Mus musculus
ttgtgactactacagcaatcaccat

SEQ ID NO: 960298 - DNA, 25 bp, Mus musculus
ttgtgactactagagcaatcaccat

SEQ ID NO: 960299 - DNA, 25 bp, Mus musculus
ttgtgactcatacttgccgtccttc

SEQ ID NO: 960300 - DNA, 25 bp, Mus musculus
ttgtgactcatagttgccgtccttc

SEQ ID NO: 960301 - DNA, 25 bp, Mus musculus
ttgtgactcctacaatactgcccaa

SEQ ID NO: 960302 - DNA, 25 bp, Mus musculus
ttgtgactcctagaatactgcccaa

SEQ ID NO: 960303 - DNA, 25 bp, Mus musculus
ttgtgactcctgatgtggaacacgg

SEQ ID NO: 960304 - DNA, 25 bp, Mus musculus
ttgtgactcctgttgtggaacacgg

SEQ ID NO: 960305 - DNA, 25 bp, Mus musculus
ttgtgactcttaattctttcggtgc

SEQ ID NO: 960306 - DNA, 25 bp, Mus musculus
ttgtgactcttatttctttcggtgc

SEQ ID NO: 960307 - DNA, 25 bp, Mus musculus
ttgtgactgctcatcaaccatggca

SEQ ID NO: 960308 - DNA, 25 bp, Mus musculus
ttgtgactgctcttcaaccatggca

SEQ ID NO: 960309 - DNA, 25 bp, Mus musculus
ttgtgactggaaacgtgttcaaact

SEQ ID NO: 960310 - DNA, 25 bp, Mus musculus
ttgtgactggaatcgtgttcaaact

SEQ ID NO: 960311 - DNA, 25 bp, Mus musculus
ttgtgactgggcctcttgtcatcaa

SEQ ID NO: 960312 - DNA, 25 bp, Mus musculus
ttgtgactgggcgtcttgtcatcaa

SEQ ID NO: 960313 - DNA, 25 bp, Mus musculus
ttgtgacttaagaaaccttctgtgg

SEQ ID NO: 960314 - DNA, 25 bp, Mus musculus
ttgtgacttaagaatggcagccctt

SEQ ID NO: 960315 - DNA, 25 bp, Mus musculus
ttgtgacttaagtaaccttctgtgg

SEQ ID NO: 960316 - DNA, 25 bp, Mus musculus
ttgtgacttaagtatggcagccctt

SEQ ID NO: 960317 - DNA, 25 bp, Mus musculus
ttgtgacttcacaattggcacctcc

SEQ ID NO: 960318 - DNA, 25 bp, Mus musculus
ttgtgacttcactattggcacctcc

SEQ ID NO: 960319 - DNA, 25 bp, Mus musculus
ttgtgacttggtatactctgttgta

SEQ ID NO: 960320 - DNA, 25 bp, Mus musculus
ttgtgacttggtttactctgttgta

SEQ ID NO: 960321 - DNA, 25 bp, Mus musculus
ttgtgactttaacctcttgcttctg

SEQ ID NO: 960322 - DNA, 25 bp, Mus musculus
ttgtgactttaagctcttgcttctg

SEQ ID NO: 960323 - DNA, 25 bp, Mus musculus
ttgtgactttctccagtggtctcta

SEQ ID NO: 960324 - DNA, 25 bp, Mus musculus
ttgtgactttctgcagtggtctcta

SEQ ID NO: 960325 - DNA, 25 bp, Mus musculus
ttgtgactttttaaagccttcaatt

SEQ ID NO: 960326 - DNA, 25 bp, Mus musculus
ttgtgacttttttaagccttcaatt

SEQ ID NO: 960327 - DNA, 25 bp, Mus musculus
ttgtgagaaatcacccatttgattt

SEQ ID NO: 960328 - DNA, 25 bp, Mus musculus
ttgtgagaaatctcccatttgattt

SEQ ID NO: 960329 - DNA, 25 bp, Mus musculus
ttgtgagaactaagtaaatgtaatc

SEQ ID NO: 960330 - DNA, 25 bp, Mus musculus
ttgtgagaactatgtaaatgtaatc

SEQ ID NO: 960331 - DNA, 25 bp, Mus musculus
ttgtgagaaggtcagcctcctgcat

SEQ ID NO: 960332 - DNA, 25 bp, Mus musculus
ttgtgagaaggtgagcctcctgcat

SEQ ID NO: 960333 - DNA, 25 bp, Mus musculus
ttgtgagacacacgcaatttgcttc

SEQ ID NO: 960334 - DNA, 25 bp, Mus musculus
ttgtgagacacaggcaatttgcttc

SEQ ID NO: 960335 - DNA, 25 bp, Mus musculus
ttgtgagaccttctacatgcccatg

SEQ ID NO: 960336 - DNA, 25 bp, Mus musculus
ttgtgagaccttgtacatgcccatg

SEQ ID NO: 960337 - DNA, 25 bp, Mus musculus
ttgtgagagccgaatttcaccccat

SEQ ID NO: 960338 - DNA, 25 bp, Mus musculus
ttgtgagagccgtatttcaccccat

SEQ ID NO: 960339 - DNA, 25 bp, Mus musculus
ttgtgagatggaagcagacagatgt

SEQ ID NO: 960340 - DNA, 25 bp, Mus musculus
ttgtgagatggatgcagacagatgt

SEQ ID NO: 960341 - DNA, 25 bp, Mus musculus
ttgtgagcaagaaggatgccccaga

SEQ ID NO: 960342 - DNA, 25 bp, Mus musculus
ttgtgagcaagatggatgccccaga

SEQ ID NO: 960343 - DNA, 25 bp, Mus musculus
ttgtgagcacacatacctttgccca

SEQ ID NO: 960344 - DNA, 25 bp, Mus musculus
ttgtgagcacacttacctttgccca

SEQ ID NO: 960345 - DNA, 25 bp, Mus musculus
ttgtgagcacccagaaacagcttgt

SEQ ID NO: 960346 - DNA, 25 bp, Mus musculus
ttgtgagcaccctgaaacagcttgt

SEQ ID NO: 960347 - DNA, 25 bp, Mus musculus
ttgtgagcactacactttttccaat

SEQ ID NO: 960348 - DNA, 25 bp, Mus musculus
ttgtgagcactagactttttccaat

SEQ ID NO: 960349 - DNA, 25 bp, Mus musculus
ttgtgagcagaacactttgccttcc

SEQ ID NO: 960350 - DNA, 25 bp, Mus musculus
ttgtgagcagaagactttgccttcc

SEQ ID NO: 960351 - DNA, 25 bp, Mus musculus
ttgtgagcatgcaggcagagcccaa

SEQ ID NO: 960352 - DNA, 25 bp, Mus musculus
ttgtgagcatgctggcagagcccaa

SEQ ID NO: 960353 - DNA, 25 bp, Mus musculus
ttgtgagccaccagccttggtggag

SEQ ID NO: 960354 - DNA, 25 bp, Mus musculus
ttgtgagccaccatcttccgcagaa

SEQ ID NO: 960355 - DNA, 25 bp, Mus musculus
ttgtgagccacctgccttggtggag

SEQ ID NO: 960356 - DNA, 25 bp, Mus musculus
ttgtgagccaccttcttccgcagaa

SEQ ID NO: 960357 - DNA, 25 bp, Mus musculus
ttgtgagccagtactacagggtcct

SEQ ID NO: 960358 - DNA, 25 bp, Mus musculus
ttgtgagccagttctacagggtcct

SEQ ID NO: 960359 - DNA, 25 bp, Mus musculus
ttgtgagccatacagtcatccttgg

SEQ ID NO: 960360 - DNA, 25 bp, Mus musculus
ttgtgagccatagagtcatccttgg

SEQ ID NO: 960361 - DNA, 25 bp, Mus musculus
ttgtgagccctacgtctcagcgaca

SEQ ID NO: 960362 - DNA, 25 bp, Mus musculus
ttgtgagccctaggtctcagcgaca

SEQ ID NO: 960363 - DNA, 25 bp, Mus musculus
ttgtgagcccttccaaaattgtgtg

SEQ ID NO: 960364 - DNA, 25 bp, Mus musculus
ttgtgagcccttgcaaaattgtgtg

SEQ ID NO: 960365 - DNA, 25 bp, Mus musculus
ttgtgagccgctctctggatagatt

SEQ ID NO: 960366 - DNA, 25 bp, Mus musculus
ttgtgagccgctgtctggatagatt

SEQ ID NO: 960367 - DNA, 25 bp, Mus musculus
ttgtgagccttgctgtattggcgca

SEQ ID NO: 960368 - DNA, 25 bp, Mus musculus
ttgtgagccttggtgtattggcgca

SEQ ID NO: 960369 - DNA, 25 bp, Mus musculus
ttgtgagctgctaagcccgggagac

SEQ ID NO: 960370 - DNA, 25 bp, Mus musculus
ttgtgagctgcttagcccgggagac

SEQ ID NO: 960371 - DNA, 25 bp, Mus musculus
ttgtgagctttcagcagcccttgct

SEQ ID NO: 960372 - DNA, 25 bp, Mus musculus
ttgtgagctttctgcagcccttgct

SEQ ID NO: 960373 - DNA, 25 bp, Mus musculus
ttgtgaggcaggattacaacactac

SEQ ID NO: 960374 - DNA, 25 bp, Mus musculus
ttgtgaggcaggtttacaacactac

SEQ ID NO: 960375 - DNA, 25 bp, Mus musculus
ttgtgagggaatcagctcgtcaccc

SEQ ID NO: 960376 - DNA, 25 bp, Mus musculus
ttgtgagggaatgagctcgtcaccc

SEQ ID NO: 960377 - DNA, 25 bp, Mus musculus
ttgtgagggctgactcagcaaacaa

SEQ ID NO: 960378 - DNA, 25 bp, Mus musculus
ttgtgagggctgtctcagcaaacaa

SEQ ID NO: 960379 - DNA, 25 bp, Mus musculus
ttgtgagggcttcagaactgttaac

SEQ ID NO: 960380 - DNA, 25 bp, Mus musculus
ttgtgagggcttgagaactgttaac

SEQ ID NO: 960381 - DNA, 25 bp, Mus musculus
ttgtgagggtctcaaactcccagac

SEQ ID NO: 960382 - DNA, 25 bp, Mus musculus
ttgtgagggtctgaaactcccagac

SEQ ID NO: 960383 - DNA, 25 bp, Mus musculus
ttgtgaggtggcacgtccagagaac

SEQ ID NO: 960384 - DNA, 25 bp, Mus musculus
ttgtgaggtggctcgtccagagaac

SEQ ID NO: 960385 - DNA, 25 bp, Mus musculus
ttgtgagtaccactgctctgggacc

SEQ ID NO: 960386 - DNA, 25 bp, Mus musculus
ttgtgagtaccagtgctctgggacc

SEQ ID NO: 960387 - DNA, 25 bp, Mus musculus
ttgtgagtactcatgcctgctgttc

SEQ ID NO: 960388 - DNA, 25 bp, Mus musculus
ttgtgagtactccagttgctttaaa

SEQ ID NO: 960389 - DNA, 25 bp, Mus musculus
ttgtgagtactcgagttgctttaaa

SEQ ID NO: 960390 - DNA, 25 bp, Mus musculus
ttgtgagtactcttgcctgctgttc

SEQ ID NO: 960391 - DNA, 25 bp, Mus musculus
ttgtgagtcaaccttgtgccaaaga

SEQ ID NO: 960392 - DNA, 25 bp, Mus musculus
ttgtgagtcaacgttgtgccaaaga

SEQ ID NO: 960393 - DNA, 25 bp, Mus musculus
ttgtgagtctttcccacatttgact

SEQ ID NO: 960394 - DNA, 25 bp, Mus musculus
ttgtgagtctttgccacatttgact

SEQ ID NO: 960395 - DNA, 25 bp, Mus musculus
ttgtgagtgaatattactgcattct

SEQ ID NO: 960396 - DNA, 25 bp, Mus musculus
ttgtgagtgaattttactgcattct

SEQ ID NO: 960397 - DNA, 25 bp, Mus musculus
ttgtgagtgcagattctctatcata

SEQ ID NO: 960398 - DNA, 25 bp, Mus musculus
ttgtgagtgcagtttctctatcata

SEQ ID NO: 960399 - DNA, 25 bp, Mus musculus
ttgtgagtggagatagggctacttt

SEQ ID NO: 960400 - DNA, 25 bp, Mus musculus
ttgtgagtggagttagggctacttt

SEQ ID NO: 960401 - DNA, 25 bp, Mus musculus
ttgtgagtggcgactgctaatgctg

SEQ ID NO: 960402 - DNA, 25 bp, Mus musculus
ttgtgagtggcgtctgctaatgctg

SEQ ID NO: 960403 - DNA, 25 bp, Mus musculus
ttgtgagtgtggcacaccttgatac

SEQ ID NO: 960404 - DNA, 25 bp, Mus musculus
ttgtgagtgtgggacaccttgatac

SEQ ID NO: 960405 - DNA, 25 bp, Mus musculus
ttgtgagttataacagcgcctggat

SEQ ID NO: 960406 - DNA, 25 bp, Mus musculus
ttgtgagttatatcagcgcctggat

SEQ ID NO: 960407 - DNA, 25 bp, Mus musculus
ttgtgagttccaactagcttgtggt

SEQ ID NO: 960408 - DNA, 25 bp, Mus musculus
ttgtgagttccatctagcttgtggt

SEQ ID NO: 960409 - DNA, 25 bp, Mus musculus
ttgtgagttctcaattgacccttgt

SEQ ID NO: 960410 - DNA, 25 bp, Mus musculus
ttgtgagttctctattgacccttgt

SEQ ID NO: 960411 - DNA, 25 bp, Mus musculus
ttgtgagttttccatcatgttggcc

SEQ ID NO: 960412 - DNA, 25 bp, Mus musculus
ttgtgagttttcgatcatgttggcc

SEQ ID NO: 960413 - DNA, 25 bp, Mus musculus
ttgtgataaccacgctacttgcctt

SEQ ID NO: 960414 - DNA, 25 bp, Mus musculus
ttgtgataaccaggctacttgcctt

SEQ ID NO: 960415 - DNA, 25 bp, Mus musculus
ttgtgataatatatgctttccgctt

SEQ ID NO: 960416 - DNA, 25 bp, Mus musculus
ttgtgataatatttgctttccgctt

SEQ ID NO: 960417 - DNA, 25 bp, Mus musculus
ttgtgatacagtcgccctggctggc

SEQ ID NO: 960418 - DNA, 25 bp, Mus musculus
ttgtgatacagtggccctggctggc

SEQ ID NO: 960419 - DNA, 25 bp, Mus musculus
ttgtgatacatgaccacatctcctc

SEQ ID NO: 960420 - DNA, 25 bp, Mus musculus
ttgtgatacatgtccacatctcctc

SEQ ID NO: 960421 - DNA, 25 bp, Mus musculus
ttgtgatatatccttcccttcactt

SEQ ID NO: 960422 - DNA, 25 bp, Mus musculus
ttgtgatatatcgttcccttcactt

SEQ ID NO: 960423 - DNA, 25 bp, Mus musculus
ttgtgatatgggaccttggcttcat

SEQ ID NO: 960424 - DNA, 25 bp, Mus musculus
ttgtgatatgggtccttggcttcat

SEQ ID NO: 960425 - DNA, 25 bp, Mus musculus
ttgtgatcaaccacgtcatcagcgt

SEQ ID NO: 960426 - DNA, 25 bp, Mus musculus
ttgtgatcaacctcgtcatcagcgt

SEQ ID NO: 960427 - DNA, 25 bp, Mus musculus
ttgtgatcagctcgcttgcggacat

SEQ ID NO: 960428 - DNA, 25 bp, Mus musculus
ttgtgatcagctggcttgcggacat

SEQ ID NO: 960429 - DNA, 25 bp, Mus musculus
ttgtgatcaggacacagcaccccat

SEQ ID NO: 960430 - DNA, 25 bp, Mus musculus
ttgtgatcaggacatgtttcatgga

SEQ ID NO: 960431 - DNA, 25 bp, Mus musculus
ttgtgatcaggagacagcaccccat

SEQ ID NO: 960432 - DNA, 25 bp, Mus musculus
ttgtgatcaggagatgtttcatgga

SEQ ID NO: 960433 - DNA, 25 bp, Mus musculus
ttgtgatccacactccctatgtgta

SEQ ID NO: 960434 - DNA, 25 bp, Mus musculus
ttgtgatccacagtccctatgtgta

SEQ ID NO: 960435 - DNA, 25 bp, Mus musculus
ttgtgatccaccctcggaagactcg

SEQ ID NO: 960436 - DNA, 25 bp, Mus musculus
ttgtgatccaccgtcggaagactcg

SEQ ID NO: 960437 - DNA, 25 bp, Mus musculus
ttgtgatccgtacctgtcaattccc

SEQ ID NO: 960438 - DNA, 25 bp, Mus musculus
ttgtgatccgtagctgtcaattccc

SEQ ID NO: 960439 - DNA, 25 bp, Mus musculus
ttgtgatcctcaacctcaccagtgg

SEQ ID NO: 960440 - DNA, 25 bp, Mus musculus
ttgtgatcctcatcctcaccagtgg

SEQ ID NO: 960441 - DNA, 25 bp, Mus musculus
ttgtgatccttcaagatgctcctga

SEQ ID NO: 960442 - DNA, 25 bp, Mus musculus
ttgtgatccttctagatgctcctga

SEQ ID NO: 960443 - DNA, 25 bp, Mus musculus
ttgtgatctcagctttgaccaagag

SEQ ID NO: 960444 - DNA, 25 bp, Mus musculus
ttgtgatctcaggtttgaccaagag

SEQ ID NO: 960445 - DNA, 25 bp, Mus musculus
ttgtgatctgagagggatccctgcc

SEQ ID NO: 960446 - DNA, 25 bp, Mus musculus
ttgtgatctgagtgggatccctgcc

SEQ ID NO: 960447 - DNA, 25 bp, Mus musculus
ttgtgatctttgacacggtgctggt

SEQ ID NO: 960448 - DNA, 25 bp, Mus musculus
ttgtgatctttgtcacggtgctggt

SEQ ID NO: 960449 - DNA, 25 bp, Mus musculus
ttgtgatgacatcatccttagggtt

SEQ ID NO: 960450 - DNA, 25 bp, Mus musculus
ttgtgatgacatgatccttagggtt

SEQ ID NO: 960451 - DNA, 25 bp, Mus musculus
ttgtgatggccaaatgcatcccctg

SEQ ID NO: 960452 - DNA, 25 bp, Mus musculus
ttgtgatggccatatgcatcccctg

SEQ ID NO: 960453 - DNA, 25 bp, Mus musculus
ttgtgatggccgacactatcgtgaa

SEQ ID NO: 960454 - DNA, 25 bp, Mus musculus
ttgtgatggccgtcactatcgtgaa

SEQ ID NO: 960455 - DNA, 25 bp, Mus musculus
ttgtgatgtctgctggtttctgggt

SEQ ID NO: 960456 - DNA, 25 bp, Mus musculus
ttgtgatgtctggtggtttctgggt

SEQ ID NO: 960457 - DNA, 25 bp, Mus musculus
ttgtgattaaggctccccttctata

SEQ ID NO: 960458 - DNA, 25 bp, Mus musculus
ttgtgattaagggtccccttctata

SEQ ID NO: 960459 - DNA, 25 bp, Mus musculus
ttgtgattcactcaacccatcttta

SEQ ID NO: 960460 - DNA, 25 bp, Mus musculus
ttgtgattcactgaacccatcttta

SEQ ID NO: 960461 - DNA, 25 bp, Mus musculus
ttgtgattgattagtctccagtgca

SEQ ID NO: 960462 - DNA, 25 bp, Mus musculus
ttgtgattgatttgtctccagtgca

SEQ ID NO: 960463 - DNA, 25 bp, Mus musculus
ttgtgattggttcgcttccttaccc

SEQ ID NO: 960464 - DNA, 25 bp, Mus musculus
ttgtgattggttggcttccttaccc

SEQ ID NO: 960465 - DNA, 25 bp, Mus musculus
ttgtgattgtcccacagtggagagt

SEQ ID NO: 960466 - DNA, 25 bp, Mus musculus
ttgtgattgtccgacagtggagagt

SEQ ID NO: 960467 - DNA, 25 bp, Mus musculus
ttgtgattgtgtacccatgttctca

SEQ ID NO: 960468 - DNA, 25 bp, Mus musculus
ttgtgattgtgttcccatgttctca

SEQ ID NO: 960469 - DNA, 25 bp, Mus musculus
ttgtgatttcttatttgagaactag

SEQ ID NO: 960470 - DNA, 25 bp, Mus musculus
ttgtgatttcttttttgagaactag

SEQ ID NO: 960471 - DNA, 25 bp, Mus musculus
ttgtgattttcaaagctgtgtcggt

SEQ ID NO: 960472 - DNA, 25 bp, Mus musculus
ttgtgattttcatagctgtgtcggt

SEQ ID NO: 960473 - DNA, 25 bp, Mus musculus
ttgtgatttttcatcccaatcctct

SEQ ID NO: 960474 - DNA, 25 bp, Mus musculus
ttgtgatttttcttcccaatcctct

SEQ ID NO: 960475 - DNA, 25 bp, Mus musculus
ttgtgcaaacacagtgagttcttcc

SEQ ID NO: 960476 - DNA, 25 bp, Mus musculus
ttgtgcaaacactgtgagttcttcc

SEQ ID NO: 960477 - DNA, 25 bp, Mus musculus
ttgtgcaaatgcatcgacttccagt

SEQ ID NO: 960478 - DNA, 25 bp, Mus musculus
ttgtgcaaatgcttcgacttccagt

SEQ ID NO: 960479 - DNA, 25 bp, Mus musculus
ttgtgcaagtacacccttcatggaa

SEQ ID NO: 960480 - DNA, 25 bp, Mus musculus
ttgtgcaagtactcccttcatggaa

SEQ ID NO: 960481 - DNA, 25 bp, Mus musculus
ttgtgcaatattacgtttctgtagt

SEQ ID NO: 960482 - DNA, 25 bp, Mus musculus
ttgtgcaatatttcgtttctgtagt

SEQ ID NO: 960483 - DNA, 25 bp, Mus musculus
ttgtgcaatcacaaaaccctggctt

SEQ ID NO: 960484 - DNA, 25 bp, Mus musculus
ttgtgcaatcactaaaccctggctt

SEQ ID NO: 960485 - DNA, 25 bp, Mus musculus
ttgtgcacacctaccgtctgcctag

SEQ ID NO: 960486 - DNA, 25 bp, Mus musculus
ttgtgcacaccttccgtctgcctag

SEQ ID NO: 960487 - DNA, 25 bp, Mus musculus
ttgtgcacaggaaccatgatatttt

SEQ ID NO: 960488 - DNA, 25 bp, Mus musculus
ttgtgcacaggatccatgatatttt

SEQ ID NO: 960489 - DNA, 25 bp, Mus musculus
ttgtgcacagtactccagtttctga

SEQ ID NO: 960490 - DNA, 25 bp, Mus musculus
ttgtgcacagtagtccagtttctga

SEQ ID NO: 960491 - DNA, 25 bp, Mus musculus
ttgtgcaccatgacgactgcttgga

SEQ ID NO: 960492 - DNA, 25 bp, Mus musculus
ttgtgcaccatgtcgactgcttgga

SEQ ID NO: 960493 - DNA, 25 bp, Mus musculus
ttgtgcacccacacggaaagatgtc

SEQ ID NO: 960494 - DNA, 25 bp, Mus musculus
ttgtgcacccactcggaaagatgtc

SEQ ID NO: 960495 - DNA, 25 bp, Mus musculus
ttgtgcacgagaccggccagctgta

SEQ ID NO: 960496 - DNA, 25 bp, Mus musculus
ttgtgcacgagagcggccagctgta

SEQ ID NO: 960497 - DNA, 25 bp, Mus musculus
ttgtgcacgattaaaaaaccgcttg

SEQ ID NO: 960498 - DNA, 25 bp, Mus musculus
ttgtgcacgatttaaaaaccgcttg

SEQ ID NO: 960499 - DNA, 25 bp, Mus musculus
ttgtgcacggacctcccagagatag

SEQ ID NO: 960500 - DNA, 25 bp, Mus musculus
ttgtgcacggacgtcccagagatag

SEQ ID NO: 960501 - DNA, 25 bp, Mus musculus
ttgtgcactatgatgattactctat

SEQ ID NO: 960502 - DNA, 25 bp, Mus musculus
ttgtgcactatgttgattactctat

SEQ ID NO: 960503 - DNA, 25 bp, Mus musculus
ttgtgcactcgacgcaaggcaagac

SEQ ID NO: 960504 - DNA, 25 bp, Mus musculus
ttgtgcactcgaggcaaggcaagac

SEQ ID NO: 960505 - DNA, 25 bp, Mus musculus
ttgtgcactgatatgaccattgtga

SEQ ID NO: 960506 - DNA, 25 bp, Mus musculus
ttgtgcactgatttgaccattgtga

SEQ ID NO: 960507 - DNA, 25 bp, Mus musculus
ttgtgcactggcctttgaagcatga

SEQ ID NO: 960508 - DNA, 25 bp, Mus musculus
ttgtgcactggcgtttgaagcatga

SEQ ID NO: 960509 - DNA, 25 bp, Mus musculus
ttgtgcacttctcgtatcccagcac

SEQ ID NO: 960510 - DNA, 25 bp, Mus musculus
ttgtgcacttctggtatcccagcac

SEQ ID NO: 960511 - DNA, 25 bp, Mus musculus
ttgtgcactttgatgccatgaccca

SEQ ID NO: 960512 - DNA, 25 bp, Mus musculus
ttgtgcactttgttgccatgaccca

SEQ ID NO: 960513 - DNA, 25 bp, Mus musculus
ttgtgcagaaagaacagccctgtca

SEQ ID NO: 960514 - DNA, 25 bp, Mus musculus
ttgtgcagaaagtacagccctgtca

SEQ ID NO: 960515 - DNA, 25 bp, Mus musculus
ttgtgcagaagtaccagcgagctca

SEQ ID NO: 960516 - DNA, 25 bp, Mus musculus
ttgtgcagaagttccagcgagctca

SEQ ID NO: 960517 - DNA, 25 bp, Mus musculus
ttgtgcagctaccttctctcattac

SEQ ID NO: 960518 - DNA, 25 bp, Mus musculus
ttgtgcagctacgttctctcattac

SEQ ID NO: 960519 - DNA, 25 bp, Mus musculus
ttgtgcaggccgatctctctttcta

SEQ ID NO: 960520 - DNA, 25 bp, Mus musculus
ttgtgcaggccgttctctctttcta

SEQ ID NO: 960521 - DNA, 25 bp, Mus musculus
ttgtgcagtctccaccatataagca

SEQ ID NO: 960522 - DNA, 25 bp, Mus musculus
ttgtgcagtctcgaccatataagca

SEQ ID NO: 960523 - DNA, 25 bp, Mus musculus
ttgtgcagtggcacctatacactct

SEQ ID NO: 960524 - DNA, 25 bp, Mus musculus
ttgtgcagtggctcctatacactct

SEQ ID NO: 960525 - DNA, 25 bp, Mus musculus
ttgtgcagttccagcactctcactt

SEQ ID NO: 960526 - DNA, 25 bp, Mus musculus
ttgtgcagttcctgcactctcactt

SEQ ID NO: 960527 - DNA, 25 bp, Mus musculus
ttgtgcatataaacctacagttaac

SEQ ID NO: 960528 - DNA, 25 bp, Mus musculus
ttgtgcatataatcctacagttaac

SEQ ID NO: 960529 - DNA, 25 bp, Mus musculus
ttgtgcatattcagccctcaatgag

SEQ ID NO: 960530 - DNA, 25 bp, Mus musculus
ttgtgcatattctgccctcaatgag

SEQ ID NO: 960531 - DNA, 25 bp, Mus musculus
ttgtgcatccaacctctaactcttt

SEQ ID NO: 960532 - DNA, 25 bp, Mus musculus
ttgtgcatccaagctctaactcttt

SEQ ID NO: 960533 - DNA, 25 bp, Mus musculus
ttgtgcatctgcattcaactaccct

SEQ ID NO: 960534 - DNA, 25 bp, Mus musculus
ttgtgcatctgctttcaactaccct

SEQ ID NO: 960535 - DNA, 25 bp, Mus musculus
ttgtgcatgatgaccttggtttttt

SEQ ID NO: 960536 - DNA, 25 bp, Mus musculus
ttgtgcatgatgtccttggtttttt

SEQ ID NO: 960537 - DNA, 25 bp, Mus musculus
ttgtgcatgctgacctcagcgagta

SEQ ID NO: 960538 - DNA, 25 bp, Mus musculus
ttgtgcatgctgtcctcagcgagta

SEQ ID NO: 960539 - DNA, 25 bp, Mus musculus
ttgtgcatgcttctggactttggag

SEQ ID NO: 960540 - DNA, 25 bp, Mus musculus
ttgtgcatgcttgtggactttggag

SEQ ID NO: 960541 - DNA, 25 bp, Mus musculus
ttgtgcatgttacattgtagttgta

SEQ ID NO: 960542 - DNA, 25 bp, Mus musculus
ttgtgcatgttagattgtagttgta

SEQ ID NO: 960543 - DNA, 25 bp, Mus musculus
ttgtgcatgtttaccccttttctga

SEQ ID NO: 960544 - DNA, 25 bp, Mus musculus
ttgtgcatgttttccccttttctga

SEQ ID NO: 960545 - DNA, 25 bp, Mus musculus
ttgtgcattaaaatcttcaaataca

SEQ ID NO: 960546 - DNA, 25 bp, Mus musculus
ttgtgcattaaattcttcaaataca

SEQ ID NO: 960547 - DNA, 25 bp, Mus musculus
ttgtgcattctaaaaaccgtccctg

SEQ ID NO: 960548 - DNA, 25 bp, Mus musculus
ttgtgcattctataaaccgtccctg

SEQ ID NO: 960549 - DNA, 25 bp, Mus musculus
ttgtgcattctgactccaagtacca

SEQ ID NO: 960550 - DNA, 25 bp, Mus musculus
ttgtgcattctgtctccaagtacca

SEQ ID NO: 960551 - DNA, 25 bp, Mus musculus
ttgtgcattcttctacctcgacata

SEQ ID NO: 960552 - DNA, 25 bp, Mus musculus
ttgtgcattcttgtacctcgacata

SEQ ID NO: 960553 - DNA, 25 bp, Mus musculus
ttgtgcattgataacccaggaccca

SEQ ID NO: 960554 - DNA, 25 bp, Mus musculus
ttgtgcattgattacccaggaccca

SEQ ID NO: 960555 - DNA, 25 bp, Mus musculus
ttgtgcatttcaaccggaagtcttt

SEQ ID NO: 960556 - DNA, 25 bp, Mus musculus
ttgtgcatttcatccggaagtcttt

SEQ ID NO: 960557 - DNA, 25 bp, Mus musculus
ttgtgccaaattagggtcagagcgc

SEQ ID NO: 960558 - DNA, 25 bp, Mus musculus
ttgtgccaaatttgggtcagagcgc

SEQ ID NO: 960559 - DNA, 25 bp, Mus musculus
ttgtgccaacgacgactgggccctg

SEQ ID NO: 960560 - DNA, 25 bp, Mus musculus
ttgtgccaacgaggactgggccctg

SEQ ID NO: 960561 - DNA, 25 bp, Mus musculus
ttgtgccaataactcatctgaacca

SEQ ID NO: 960562 - DNA, 25 bp, Mus musculus
ttgtgccaataagtcatctgaacca

SEQ ID NO: 960563 - DNA, 25 bp, Mus musculus
ttgtgccacaggatgtcccaccaga

SEQ ID NO: 960564 - DNA, 25 bp, Mus musculus
ttgtgccacaggttgtcccaccaga

SEQ ID NO: 960565 - DNA, 25 bp, Mus musculus
ttgtgccacctgagaagcaagtttt

SEQ ID NO: 960566 - DNA, 25 bp, Mus musculus
ttgtgccacctgtgaagcaagtttt

SEQ ID NO: 960567 - DNA, 25 bp, Mus musculus
ttgtgccacgatccctaactgaata

SEQ ID NO: 960568 - DNA, 25 bp, Mus musculus
ttgtgccacgatgcctaactgaata

SEQ ID NO: 960569 - DNA, 25 bp, Mus musculus
ttgtgccacgtaattctccaacaga

SEQ ID NO: 960570 - DNA, 25 bp, Mus musculus
ttgtgccacgtatttctccaacaga

SEQ ID NO: 960571 - DNA, 25 bp, Mus musculus
ttgtgccactttaacctttcactac

SEQ ID NO: 960572 - DNA, 25 bp, Mus musculus
ttgtgccacttttacctttcactac

SEQ ID NO: 960573 - DNA, 25 bp, Mus musculus
ttgtgccagagcaacagaatagcat

SEQ ID NO: 960574 - DNA, 25 bp, Mus musculus
ttgtgccagagctacagaatagcat

SEQ ID NO: 960575 - DNA, 25 bp, Mus musculus
ttgtgccagggcaccctaagaatgt

SEQ ID NO: 960576 - DNA, 25 bp, Mus musculus
ttgtgccagggctccctaagaatgt

SEQ ID NO: 960577 - DNA, 25 bp, Mus musculus
ttgtgccaggtcattcccattaaac

SEQ ID NO: 960578 - DNA, 25 bp, Mus musculus
ttgtgccaggtctttcccattaaac

SEQ ID NO: 960579 - DNA, 25 bp, Mus musculus
ttgtgccattggacgaaaacgttca

SEQ ID NO: 960580 - DNA, 25 bp, Mus musculus
ttgtgccattggtcgaaaacgttca

SEQ ID NO: 960581 - DNA, 25 bp, Mus musculus
ttgtgcccagagaagcaagctcaac

SEQ ID NO: 960582 - DNA, 25 bp, Mus musculus
ttgtgcccagagtagcaagctcaac

SEQ ID NO: 960583 - DNA, 25 bp, Mus musculus
ttgtgcccagcgagatgatgtgatg

SEQ ID NO: 960584 - DNA, 25 bp, Mus musculus
ttgtgcccagcgtgatgatgtgatg

SEQ ID NO: 960585 - DNA, 25 bp, Mus musculus
ttgtgcccagtgactgcgccggcaa

SEQ ID NO: 960586 - DNA, 25 bp, Mus musculus
ttgtgcccagtgatgtctttccttg

SEQ ID NO: 960587 - DNA, 25 bp, Mus musculus
ttgtgcccagtgtctgcgccggcaa

SEQ ID NO: 960588 - DNA, 25 bp, Mus musculus
ttgtgcccagtgttgtctttccttg

SEQ ID NO: 960589 - DNA, 25 bp, Mus musculus
ttgtgccccagacttatctctgttt

SEQ ID NO: 960590 - DNA, 25 bp, Mus musculus
ttgtgccccagagttatctctgttt

SEQ ID NO: 960591 - DNA, 25 bp, Mus musculus
ttgtgccccatgagatatgtgactt

SEQ ID NO: 960592 - DNA, 25 bp, Mus musculus
ttgtgccccatgtgatatgtgactt

SEQ ID NO: 960593 - DNA, 25 bp, Mus musculus
ttgtgccccattataatttctaatg

SEQ ID NO: 960594 - DNA, 25 bp, Mus musculus
ttgtgccccattttaatttctaatg

SEQ ID NO: 960595 - DNA, 25 bp, Mus musculus
ttgtgccccggaagttatcttgcat

SEQ ID NO: 960596 - DNA, 25 bp, Mus musculus
ttgtgccccggatgttatcttgcat

SEQ ID NO: 960597 - DNA, 25 bp, Mus musculus
ttgtgcccctctccagttttacaga

SEQ ID NO: 960598 - DNA, 25 bp, Mus musculus
ttgtgcccctctgcagttttacaga

SEQ ID NO: 960599 - DNA, 25 bp, Mus musculus
ttgtgcccctgaactaccattaggg

SEQ ID NO: 960600 - DNA, 25 bp, Mus musculus
ttgtgcccctgatctaccattaggg

SEQ ID NO: 960601 - DNA, 25 bp, Mus musculus
ttgtgcccgcttatccctagttctt

SEQ ID NO: 960602 - DNA, 25 bp, Mus musculus
ttgtgcccgcttttccctagttctt

SEQ ID NO: 960603 - DNA, 25 bp, Mus musculus
ttgtgcccggttacgtgatctttgc

SEQ ID NO: 960604 - DNA, 25 bp, Mus musculus
ttgtgcccggtttcgtgatctttgc

SEQ ID NO: 960605 - DNA, 25 bp, Mus musculus
ttgtgccctaagattatgtttaaag

SEQ ID NO: 960606 - DNA, 25 bp, Mus musculus
ttgtgccctaagtttatgtttaaag

SEQ ID NO: 960607 - DNA, 25 bp, Mus musculus
ttgtgccctcacattgctttgaaat

SEQ ID NO: 960608 - DNA, 25 bp, Mus musculus
ttgtgccctcactttgctttgaaat

SEQ ID NO: 960609 - DNA, 25 bp, Mus musculus
ttgtgccctgatagtaacccaaaat

SEQ ID NO: 960610 - DNA, 25 bp, Mus musculus
ttgtgccctgattgtaacccaaaat

SEQ ID NO: 960611 - DNA, 25 bp, Mus musculus
ttgtgccctgccagtcccgtggcgt

SEQ ID NO: 960612 - DNA, 25 bp, Mus musculus
ttgtgccctgcctgtcccgtggcgt

SEQ ID NO: 960613 - DNA, 25 bp, Mus musculus
ttgtgccctgggaaatcttttgaag

SEQ ID NO: 960614 - DNA, 25 bp, Mus musculus
ttgtgccctgggacacgcttagcat

SEQ ID NO: 960615 - DNA, 25 bp, Mus musculus
ttgtgccctgggtaatcttttgaag

SEQ ID NO: 960616 - DNA, 25 bp, Mus musculus
ttgtgccctgggtcacgcttagcat

SEQ ID NO: 960617 - DNA, 25 bp, Mus musculus
ttgtgcccttggaaacaagctcctt

SEQ ID NO: 960618 - DNA, 25 bp, Mus musculus
ttgtgcccttggtaacaagctcctt

SEQ ID NO: 960619 - DNA, 25 bp, Mus musculus
ttgtgccgaatcatgaataccagtc

SEQ ID NO: 960620 - DNA, 25 bp, Mus musculus
ttgtgccgaatcttgaataccagtc

SEQ ID NO: 960621 - DNA, 25 bp, Mus musculus
ttgtgccgggcaacctgctgttagt

SEQ ID NO: 960622 - DNA, 25 bp, Mus musculus
ttgtgccgggcatcctgctgttagt

SEQ ID NO: 960623 - DNA, 25 bp, Mus musculus
ttgtgccggttcatttctgttgtca

SEQ ID NO: 960624 - DNA, 25 bp, Mus musculus
ttgtgccggttcttttctgttgtca

SEQ ID NO: 960625 - DNA, 25 bp, Mus musculus
ttgtgccgtgtcatgaaccagagat

SEQ ID NO: 960626 - DNA, 25 bp, Mus musculus
ttgtgccgtgtcttgaaccagagat

SEQ ID NO: 960627 - DNA, 25 bp, Mus musculus
ttgtgccgtgttcatgcctttcgta

SEQ ID NO: 960628 - DNA, 25 bp, Mus musculus
ttgtgccgtgttgatgcctttcgta

SEQ ID NO: 960629 - DNA, 25 bp, Mus musculus
ttgtgcctactcataccagttcagc

SEQ ID NO: 960630 - DNA, 25 bp, Mus musculus
ttgtgcctactcttaccagttcagc

SEQ ID NO: 960631 - DNA, 25 bp, Mus musculus
ttgtgcctagtacactgtaaatgct

SEQ ID NO: 960632 - DNA, 25 bp, Mus musculus
ttgtgcctagtagactgtaaatgct

SEQ ID NO: 960633 - DNA, 25 bp, Mus musculus
ttgtgcctcaagagccaaggagcag

SEQ ID NO: 960634 - DNA, 25 bp, Mus musculus
ttgtgcctcaagtgccaaggagcag

SEQ ID NO: 960635 - DNA, 25 bp, Mus musculus
ttgtgcctccaacccggaagaacag

SEQ ID NO: 960636 - DNA, 25 bp, Mus musculus
ttgtgcctccaagccggaagaacag

SEQ ID NO: 960637 - DNA, 25 bp, Mus musculus
ttgtgcctccatagccccagaatgc

SEQ ID NO: 960638 - DNA, 25 bp, Mus musculus
ttgtgcctccattgccccagaatgc

SEQ ID NO: 960639 - DNA, 25 bp, Mus musculus
ttgtgcctccggattccatttgctc

SEQ ID NO: 960640 - DNA, 25 bp, Mus musculus
ttgtgcctccggtttccatttgctc

SEQ ID NO: 960641 - DNA, 25 bp, Mus musculus
ttgtgcctgcacagagggtcttgat

SEQ ID NO: 960642 - DNA, 25 bp, Mus musculus
ttgtgcctgcactgagggtcttgat

SEQ ID NO: 960643 - DNA, 25 bp, Mus musculus
ttgtgcctggaaagtgtgtgtcact

SEQ ID NO: 960644 - DNA, 25 bp, Mus musculus
ttgtgcctggaatgtgtgtgtcact

SEQ ID NO: 960645 - DNA, 25 bp, Mus musculus
ttgtgcctggtgaatgatgccacta

SEQ ID NO: 960646 - DNA, 25 bp, Mus musculus
ttgtgcctggtgtatgatgccacta

SEQ ID NO: 960647 - DNA, 25 bp, Mus musculus
ttgtgccttcctaacagacagagaa

SEQ ID NO: 960648 - DNA, 25 bp, Mus musculus
ttgtgccttccttacagacagagaa

SEQ ID NO: 960649 - DNA, 25 bp, Mus musculus
ttgtgcctttagaaaacactgtgct

SEQ ID NO: 960650 - DNA, 25 bp, Mus musculus
ttgtgcctttagtaaacactgtgct

SEQ ID NO: 960651 - DNA, 25 bp, Mus musculus
ttgtgcctttttacattggtcaggt

SEQ ID NO: 960652 - DNA, 25 bp, Mus musculus
ttgtgccttttttcattggtcaggt

SEQ ID NO: 960653 - DNA, 25 bp, Mus musculus
ttgtgcgatgggatccatgtgaccc

SEQ ID NO: 960654 - DNA, 25 bp, Mus musculus
ttgtgcgatgggttccatgtgaccc

SEQ ID NO: 960655 - DNA, 25 bp, Mus musculus
ttgtgcgccaccactgatgggatgc

SEQ ID NO: 960656 - DNA, 25 bp, Mus musculus
ttgtgcgccacctctgatgggatgc

SEQ ID NO: 960657 - DNA, 25 bp, Mus musculus
ttgtgcgcttgtcactgtcccatca

SEQ ID NO: 960658 - DNA, 25 bp, Mus musculus
ttgtgcgcttgtgactgtcccatca

SEQ ID NO: 960659 - DNA, 25 bp, Mus musculus
ttgtgcggaacccacgggtcctcat

SEQ ID NO: 960660 - DNA, 25 bp, Mus musculus
ttgtgcggaaccgacgggtcctcat

SEQ ID NO: 960661 - DNA, 25 bp, Mus musculus
ttgtgcgggcccaggaattcaaggt

SEQ ID NO: 960662 - DNA, 25 bp, Mus musculus
ttgtgcgggccctggaattcaaggt

SEQ ID NO: 960663 - DNA, 25 bp, Mus musculus
ttgtgcgtttggctggtactcctcc

SEQ ID NO: 960664 - DNA, 25 bp, Mus musculus
ttgtgcgtttgggtggtactcctcc

SEQ ID NO: 960665 - DNA, 25 bp, Mus musculus
ttgtgctaaataaccctgaactttg

SEQ ID NO: 960666 - DNA, 25 bp, Mus musculus
ttgtgctaaatactgcttcccttat

SEQ ID NO: 960667 - DNA, 25 bp, Mus musculus
ttgtgctaaatagtgcttcccttat

SEQ ID NO: 960668 - DNA, 25 bp, Mus musculus
ttgtgctaaatatccctgaactttg

SEQ ID NO: 960669 - DNA, 25 bp, Mus musculus
ttgtgctaacacatttgctcttggt

SEQ ID NO: 960670 - DNA, 25 bp, Mus musculus
ttgtgctaacacttttgctcttggt

SEQ ID NO: 960671 - DNA, 25 bp, Mus musculus
ttgtgctaaggacccatcatcaccc

SEQ ID NO: 960672 - DNA, 25 bp, Mus musculus
ttgtgctaaggacccggtagtcacc

SEQ ID NO: 960673 - DNA, 25 bp, Mus musculus
ttgtgctaaggagccatcatcaccc

SEQ ID NO: 960674 - DNA, 25 bp, Mus musculus
ttgtgctaaggagccggtagtcacc

SEQ ID NO: 960675 - DNA, 25 bp, Mus musculus
ttgtgctacaaacggctgagctgca

SEQ ID NO: 960676 - DNA, 25 bp, Mus musculus
ttgtgctacaaagggctgagctgca

SEQ ID NO: 960677 - DNA, 25 bp, Mus musculus
ttgtgctacagcaaccaataatgga

SEQ ID NO: 960678 - DNA, 25 bp, Mus musculus
ttgtgctacagctaccaataatgga

SEQ ID NO: 960679 - DNA, 25 bp, Mus musculus
ttgtgctagaggaatctgctgccgg

SEQ ID NO: 960680 - DNA, 25 bp, Mus musculus
ttgtgctagaggtatctgctgccgg

SEQ ID NO: 960681 - DNA, 25 bp, Mus musculus
ttgtgctagatcactgggcttgcga

SEQ ID NO: 960682 - DNA, 25 bp, Mus musculus
ttgtgctagatctctgggcttgcga

SEQ ID NO: 960683 - DNA, 25 bp, Mus musculus
ttgtgctcaagacccactgttatag

SEQ ID NO: 960684 - DNA, 25 bp, Mus musculus
ttgtgctcaagagccactgttatag

SEQ ID NO: 960685 - DNA, 25 bp, Mus musculus
ttgtgctcaatcacagcaccggcta

SEQ ID NO: 960686 - DNA, 25 bp, Mus musculus
ttgtgctcaatctcagcaccggcta

SEQ ID NO: 960687 - DNA, 25 bp, Mus musculus
ttgtgctcacacaagcatggacagg

SEQ ID NO: 960688 - DNA, 25 bp, Mus musculus
ttgtgctcacactagcatggacagg

SEQ ID NO: 960689 - DNA, 25 bp, Mus musculus
ttgtgctcataacgtcattggtggc

SEQ ID NO: 960690 - DNA, 25 bp, Mus musculus
ttgtgctcataaggtcattggtggc

SEQ ID NO: 960691 - DNA, 25 bp, Mus musculus
ttgtgctcatccaaaactctaactg

SEQ ID NO: 960692 - DNA, 25 bp, Mus musculus
ttgtgctcatcctaaactctaactg

SEQ ID NO: 960693 - DNA, 25 bp, Mus musculus
ttgtgctcccataagaaccaaacta

SEQ ID NO: 960694 - DNA, 25 bp, Mus musculus
ttgtgctcccattagaaccaaacta

SEQ ID NO: 960695 - DNA, 25 bp, Mus musculus
ttgtgctcggagctatgccgtccaa

SEQ ID NO: 960696 - DNA, 25 bp, Mus musculus
ttgtgctcggaggtatgccgtccaa

SEQ ID NO: 960697 - DNA, 25 bp, Mus musculus
ttgtgctcgttcaatgcgtagaaat

SEQ ID NO: 960698 - DNA, 25 bp, Mus musculus
ttgtgctcgttctatgcgtagaaat

SEQ ID NO: 960699 - DNA, 25 bp, Mus musculus
ttgtgctctactatatcttcatcct

SEQ ID NO: 960700 - DNA, 25 bp, Mus musculus
ttgtgctctactttatcttcatcct

SEQ ID NO: 960701 - DNA, 25 bp, Mus musculus
ttgtgctctcataccctgcagtcag

SEQ ID NO: 960702 - DNA, 25 bp, Mus musculus
ttgtgctctcattccctgcagtcag

SEQ ID NO: 960703 - DNA, 25 bp, Mus musculus
ttgtgctctgaaaaaggctaggcct

SEQ ID NO: 960704 - DNA, 25 bp, Mus musculus
ttgtgctctgaataaggctaggcct

SEQ ID NO: 960705 - DNA, 25 bp, Mus musculus
ttgtgctctgcacgaacgtggactc

SEQ ID NO: 960706 - DNA, 25 bp, Mus musculus
ttgtgctctgcaggaacgtggactc

SEQ ID NO: 960707 - DNA, 25 bp, Mus musculus
ttgtgctctggacttcgtttttatt

SEQ ID NO: 960708 - DNA, 25 bp, Mus musculus
ttgtgctctggagttcgtttttatt

SEQ ID NO: 960709 - DNA, 25 bp, Mus musculus
ttgtgctctggcagcaaacaggagc

SEQ ID NO: 960710 - DNA, 25 bp, Mus musculus
ttgtgctctggctgcaaacaggagc

SEQ ID NO: 960711 - DNA, 25 bp, Mus musculus
ttgtgctctgtgaatttgggctgga

SEQ ID NO: 960712 - DNA, 25 bp, Mus musculus
ttgtgctctgtgtatttgggctgga

SEQ ID NO: 960713 - DNA, 25 bp, Mus musculus
ttgtgctcttctcttatggagtgga

SEQ ID NO: 960714 - DNA, 25 bp, Mus musculus
ttgtgctcttctgttatggagtgga

SEQ ID NO: 960715 - DNA, 25 bp, Mus musculus
ttgtgctgaagtcgtgctcactgca

SEQ ID NO: 960716 - DNA, 25 bp, Mus musculus
ttgtgctgaagtggtgctcactgca

SEQ ID NO: 960717 - DNA, 25 bp, Mus musculus
ttgtgctgacaaagactggccgctc

SEQ ID NO: 960718 - DNA, 25 bp, Mus musculus
ttgtgctgacaatgactggccgctc

SEQ ID NO: 960719 - DNA, 25 bp, Mus musculus
ttgtgctgacacagtctcctgcttc

SEQ ID NO: 960720 - DNA, 25 bp, Mus musculus
ttgtgctgacactgtctcctgcttc

SEQ ID NO: 960721 - DNA, 25 bp, Mus musculus
ttgtgctgacagcacccggaggaca

SEQ ID NO: 960722 - DNA, 25 bp, Mus musculus
ttgtgctgacaggacccggaggaca

SEQ ID NO: 960723 - DNA, 25 bp, Mus musculus
ttgtgctgacctcaatctgtgcgag

SEQ ID NO: 960724 - DNA, 25 bp, Mus musculus
ttgtgctgacctgaatctgtgcgag

SEQ ID NO: 960725 - DNA, 25 bp, Mus musculus
ttgtgctgagcaagacagatcgctt

SEQ ID NO: 960726 - DNA, 25 bp, Mus musculus
ttgtgctgagcaagtggtttccaga

SEQ ID NO: 960727 - DNA, 25 bp, Mus musculus
ttgtgctgagcatgacagatcgctt

SEQ ID NO: 960728 - DNA, 25 bp, Mus musculus
ttgtgctgagcatgtggtttccaga

SEQ ID NO: 960729 - DNA, 25 bp, Mus musculus
ttgtgctgaggtaatggcctcccac

SEQ ID NO: 960730 - DNA, 25 bp, Mus musculus
ttgtgctgaggttatggcctcccac

SEQ ID NO: 960731 - DNA, 25 bp, Mus musculus
ttgtgctgcagcaggccgagaaaaa

SEQ ID NO: 960732 - DNA, 25 bp, Mus musculus
ttgtgctgcagctggccgagaaaaa

SEQ ID NO: 960733 - DNA, 25 bp, Mus musculus
ttgtgctgccccatacagagaggcc

SEQ ID NO: 960734 - DNA, 25 bp, Mus musculus
ttgtgctgccccatgaagagaaaga

SEQ ID NO: 960735 - DNA, 25 bp, Mus musculus
ttgtgctgccccttacagagaggcc

SEQ ID NO: 960736 - DNA, 25 bp, Mus musculus
ttgtgctgccccttgaagagaaaga

SEQ ID NO: 960737 - DNA, 25 bp, Mus musculus
ttgtgctgcccgaagccacacagat

SEQ ID NO: 960738 - DNA, 25 bp, Mus musculus
ttgtgctgcccgtagccacacagat

SEQ ID NO: 960739 - DNA, 25 bp, Mus musculus
ttgtgctgcggaaaaggcttggttt

SEQ ID NO: 960740 - DNA, 25 bp, Mus musculus
ttgtgctgcggataaggcttggttt

SEQ ID NO: 960741 - DNA, 25 bp, Mus musculus
ttgtgctgctctccagtgaaagcca

SEQ ID NO: 960742 - DNA, 25 bp, Mus musculus
ttgtgctgctctgcagtgaaagcca

SEQ ID NO: 960743 - DNA, 25 bp, Mus musculus
ttgtgctgcttgctatctttcttgc

SEQ ID NO: 960744 - DNA, 25 bp, Mus musculus
ttgtgctgcttggtatctttcttgc

SEQ ID NO: 960745 - DNA, 25 bp, Mus musculus
ttgtgctggaaacaacccgggccca

SEQ ID NO: 960746 - DNA, 25 bp, Mus musculus
ttgtgctggaaagaacccgggccca

SEQ ID NO: 960747 - DNA, 25 bp, Mus musculus
ttgtgctgggcactgttgtcaaagc

SEQ ID NO: 960748 - DNA, 25 bp, Mus musculus
ttgtgctgggcagtgttgtcaaagc

SEQ ID NO: 960749 - DNA, 25 bp, Mus musculus
ttgtgctggtttaactgtcaacttg

SEQ ID NO: 960750 - DNA, 25 bp, Mus musculus
ttgtgctggttttactgtcaacttg

SEQ ID NO: 960751 - DNA, 25 bp, Mus musculus
ttgtgctgtacgaaggctgcggcta

SEQ ID NO: 960752 - DNA, 25 bp, Mus musculus
ttgtgctgtacgtaggctgcggcta

SEQ ID NO: 960753 - DNA, 25 bp, Mus musculus
ttgtgctgtgccaccacttggaaga

SEQ ID NO: 960754 - DNA, 25 bp, Mus musculus
ttgtgctgtgcctccacttggaaga

SEQ ID NO: 960755 - DNA, 25 bp, Mus musculus
ttgtgctgtgtacatcactgcttta

SEQ ID NO: 960756 - DNA, 25 bp, Mus musculus
ttgtgctgtgtagatcactgcttta

SEQ ID NO: 960757 - DNA, 25 bp, Mus musculus
ttgtgctgttacacatccttaccag

SEQ ID NO: 960758 - DNA, 25 bp, Mus musculus
ttgtgctgttactcatccttaccag

SEQ ID NO: 960759 - DNA, 25 bp, Mus musculus
ttgtgctgttctcttgtgatcaacc

SEQ ID NO: 960760 - DNA, 25 bp, Mus musculus
ttgtgctgttctgttgtgatcaacc

SEQ ID NO: 960761 - DNA, 25 bp, Mus musculus
ttgtgcttaaaaaccccacgtgggt

SEQ ID NO: 960762 - DNA, 25 bp, Mus musculus
ttgtgcttaaaatccccacgtgggt

SEQ ID NO: 960763 - DNA, 25 bp, Mus musculus
ttgtgcttaaaccaagaatctgagt

SEQ ID NO: 960764 - DNA, 25 bp, Mus musculus
ttgtgcttaaacgaagaatctgagt

SEQ ID NO: 960765 - DNA, 25 bp, Mus musculus
ttgtgcttaattaggtggctatatc

SEQ ID NO: 960766 - DNA, 25 bp, Mus musculus
ttgtgcttaatttggtggctatatc

SEQ ID NO: 960767 - DNA, 25 bp, Mus musculus
ttgtgcttacttctcaaccagtttg

SEQ ID NO: 960768 - DNA, 25 bp, Mus musculus
ttgtgcttacttgtcaaccagtttg

SEQ ID NO: 960769 - DNA, 25 bp, Mus musculus
ttgtgcttccccattttattgtgta

SEQ ID NO: 960770 - DNA, 25 bp, Mus musculus
ttgtgcttcccctttttattgtgta

SEQ ID NO: 960771 - DNA, 25 bp, Mus musculus
ttgtgcttgatgatatcctaccctt

SEQ ID NO: 960772 - DNA, 25 bp, Mus musculus
ttgtgcttgatgctgagacgcgtct

SEQ ID NO: 960773 - DNA, 25 bp, Mus musculus
ttgtgcttgatggtgagacgcgtct

SEQ ID NO: 960774 - DNA, 25 bp, Mus musculus
ttgtgcttgatgttatcctaccctt

SEQ ID NO: 960775 - DNA, 25 bp, Mus musculus
ttgtgcttgcgcatgatgttgctcg

SEQ ID NO: 960776 - DNA, 25 bp, Mus musculus
ttgtgcttgcgcttgatgttgctcg

SEQ ID NO: 960777 - DNA, 25 bp, Mus musculus
ttgtgcttgtttcgagatcagttca

SEQ ID NO: 960778 - DNA, 25 bp, Mus musculus
ttgtgcttgtttggagatcagttca

SEQ ID NO: 960779 - DNA, 25 bp, Mus musculus
ttgtgctttcctagtggaagccgtc

SEQ ID NO: 960780 - DNA, 25 bp, Mus musculus
ttgtgctttccttgtggaagccgtc

SEQ ID NO: 960781 - DNA, 25 bp, Mus musculus
ttgtgctttctcattatgggttgta

SEQ ID NO: 960782 - DNA, 25 bp, Mus musculus
ttgtgctttctctttatgggttgta

SEQ ID NO: 960783 - DNA, 25 bp, Mus musculus
ttgtgctttgtaacagtcagtgctg

SEQ ID NO: 960784 - DNA, 25 bp, Mus musculus
ttgtgctttgtaatctggactcttg

SEQ ID NO: 960785 - DNA, 25 bp, Mus musculus
ttgtgctttgtatcagtcagtgctg

SEQ ID NO: 960786 - DNA, 25 bp, Mus musculus
ttgtgctttgtattctggactcttg

SEQ ID NO: 960787 - DNA, 25 bp, Mus musculus
ttgtgctttttactgtatgtgttct

SEQ ID NO: 960788 - DNA, 25 bp, Mus musculus
ttgtgctttttagtgtatgtgttct

SEQ ID NO: 960789 - DNA, 25 bp, Mus musculus
ttgtgctttttcatgtgtgaacagt

SEQ ID NO: 960790 - DNA, 25 bp, Mus musculus
ttgtgctttttcatgttcggtacat

SEQ ID NO: 960791 - DNA, 25 bp, Mus musculus
ttgtgctttttcttgtgtgaacagt

SEQ ID NO: 960792 - DNA, 25 bp, Mus musculus
ttgtgctttttcttgttcggtacat

SEQ ID NO: 960793 - DNA, 25 bp, Mus musculus
ttgtggaaaacccaggctctgtttc

SEQ ID NO: 960794 - DNA, 25 bp, Mus musculus
ttgtggaaaaccgaggctctgtttc

SEQ ID NO: 960795 - DNA, 25 bp, Mus musculus
ttgtggaaactactcggctgagaac

SEQ ID NO: 960796 - DNA, 25 bp, Mus musculus
ttgtggaaactagtcggctgagaac

SEQ ID NO: 960797 - DNA, 25 bp, Mus musculus
ttgtggaacaacacctggcagacct

SEQ ID NO: 960798 - DNA, 25 bp, Mus musculus
ttgtggaacaactcctggcagacct

SEQ ID NO: 960799 - DNA, 25 bp, Mus musculus
ttgtggaactgtattcccaaggcca

SEQ ID NO: 960800 - DNA, 25 bp, Mus musculus
ttgtggaactgttttcccaaggcca

SEQ ID NO: 960801 - DNA, 25 bp, Mus musculus
ttgtggaagcgcaccaagctgaaat

SEQ ID NO: 960802 - DNA, 25 bp, Mus musculus
ttgtggaagcgctccaagctgaaat

SEQ ID NO: 960803 - DNA, 25 bp, Mus musculus
ttgtggaaggaccatctttgtgtgt

SEQ ID NO: 960804 - DNA, 25 bp, Mus musculus
ttgtggaaggacgatctttgtgtgt

SEQ ID NO: 960805 - DNA, 25 bp, Mus musculus
ttgtggacaagaaactccatgccaa

SEQ ID NO: 960806 - DNA, 25 bp, Mus musculus
ttgtggacaagatactccatgccaa

SEQ ID NO: 960807 - DNA, 25 bp, Mus musculus
ttgtggacacacagcttggcttcaa

SEQ ID NO: 960808 - DNA, 25 bp, Mus musculus
ttgtggacacactgcttggcttcaa

SEQ ID NO: 960809 - DNA, 25 bp, Mus musculus
ttgtggacactgcacagcagctcac

SEQ ID NO: 960810 - DNA, 25 bp, Mus musculus
ttgtggacactggacagcagctcac

SEQ ID NO: 960811 - DNA, 25 bp, Mus musculus
ttgtggacagcccataccagtttcc

SEQ ID NO: 960812 - DNA, 25 bp, Mus musculus
ttgtggacagccgataccagtttcc

SEQ ID NO: 960813 - DNA, 25 bp, Mus musculus
ttgtggacccctcggcaaggatgtt

SEQ ID NO: 960814 - DNA, 25 bp, Mus musculus
ttgtggacccctgggcaaggatgtt

SEQ ID NO: 960815 - DNA, 25 bp, Mus musculus
ttgtggacggacacagtggcaaccg

SEQ ID NO: 960816 - DNA, 25 bp, Mus musculus
ttgtggacggactcagtggcaaccg

SEQ ID NO: 960817 - DNA, 25 bp, Mus musculus
ttgtggactgcacaaggcgcccact

SEQ ID NO: 960818 - DNA, 25 bp, Mus musculus
ttgtggactgcagaaggcgcccact

SEQ ID NO: 960819 - DNA, 25 bp, Mus musculus
ttgtggagaaccaagagggcctcta

SEQ ID NO: 960820 - DNA, 25 bp, Mus musculus
ttgtggagaacctagagggcctcta

SEQ ID NO: 960821 - DNA, 25 bp, Mus musculus
ttgtggagagcaagcacagacttcg

SEQ ID NO: 960822 - DNA, 25 bp, Mus musculus
ttgtggagagcatgcacagacttcg

SEQ ID NO: 960823 - DNA, 25 bp, Mus musculus
ttgtggagcccacccggcagtttgt

SEQ ID NO: 960824 - DNA, 25 bp, Mus musculus
ttgtggagcccagccggcagtttgt

SEQ ID NO: 960825 - DNA, 25 bp, Mus musculus
ttgtggaggtcaagccccaaaacca

SEQ ID NO: 960826 - DNA, 25 bp, Mus musculus
ttgtggaggtcatgccccaaaacca

SEQ ID NO: 960827 - DNA, 25 bp, Mus musculus
ttgtggataattatgtcttcatttc

SEQ ID NO: 960828 - DNA, 25 bp, Mus musculus
ttgtggataattttgtcttcatttc

SEQ ID NO: 960829 - DNA, 25 bp, Mus musculus
ttgtggatacaccaaggcagcagga

SEQ ID NO: 960830 - DNA, 25 bp, Mus musculus
ttgtggatacacgaaggcagcagga

SEQ ID NO: 960831 - DNA, 25 bp, Mus musculus
ttgtggatacccatgatcttcgctt

SEQ ID NO: 960832 - DNA, 25 bp, Mus musculus
ttgtggatacccttgatcttcgctt

SEQ ID NO: 960833 - DNA, 25 bp, Mus musculus
ttgtggatagtcagtattgttctca

SEQ ID NO: 960834 - DNA, 25 bp, Mus musculus
ttgtggatagtctgtattgttctca

SEQ ID NO: 960835 - DNA, 25 bp, Mus musculus
ttgtggatccaaaagctgccgacct

SEQ ID NO: 960836 - DNA, 25 bp, Mus musculus
ttgtggatccaatagctgccgacct

SEQ ID NO: 960837 - DNA, 25 bp, Mus musculus
ttgtggatccagcactttggttcag

SEQ ID NO: 960838 - DNA, 25 bp, Mus musculus
ttgtggatccaggactttggttcag

SEQ ID NO: 960839 - DNA, 25 bp, Mus musculus
ttgtggatctccattcaaatgctgc

SEQ ID NO: 960840 - DNA, 25 bp, Mus musculus
ttgtggatctcctttcaaatgctgc

SEQ ID NO: 960841 - DNA, 25 bp, Mus musculus
ttgtggatgagacacctctggtgac

SEQ ID NO: 960842 - DNA, 25 bp, Mus musculus
ttgtggatgagagacctctggtgac

SEQ ID NO: 960843 - DNA, 25 bp, Mus musculus
ttgtggatgcctaggaggacagcct

SEQ ID NO: 960844 - DNA, 25 bp, Mus musculus
ttgtggatgccttggaggacagcct

SEQ ID NO: 960845 - DNA, 25 bp, Mus musculus
ttgtggatgctcagagaccggctgc

SEQ ID NO: 960846 - DNA, 25 bp, Mus musculus
ttgtggatgctctgagaccggctgc

SEQ ID NO: 960847 - DNA, 25 bp, Mus musculus
ttgtggatggaaaccaccggctgac

SEQ ID NO: 960848 - DNA, 25 bp, Mus musculus
ttgtggatggaatccaccggctgac

SEQ ID NO: 960849 - DNA, 25 bp, Mus musculus
ttgtggatggagactcacggtgcat

SEQ ID NO: 960850 - DNA, 25 bp, Mus musculus
ttgtggatggagtctcacggtgcat

SEQ ID NO: 960851 - DNA, 25 bp, Mus musculus
ttgtggatggttctggctgacacat

SEQ ID NO: 960852 - DNA, 25 bp, Mus musculus
ttgtggatggttgtggctgacacat

SEQ ID NO: 960853 - DNA, 25 bp, Mus musculus
ttgtggatgtaacccttgctagtct

SEQ ID NO: 960854 - DNA, 25 bp, Mus musculus
ttgtggatgtaagccttgctagtct

SEQ ID NO: 960855 - DNA, 25 bp, Mus musculus
ttgtggatgtcaccccatatatgaa

SEQ ID NO: 960856 - DNA, 25 bp, Mus musculus
ttgtggatgtcagcccatatatgaa

SEQ ID NO: 960857 - DNA, 25 bp, Mus musculus
ttgtggatgtgcctcagcttcttgg

SEQ ID NO: 960858 - DNA, 25 bp, Mus musculus
ttgtggatgtgcgtcagcttcttgg

SEQ ID NO: 960859 - DNA, 25 bp, Mus musculus
ttgtggatgttaagtagggacccat

SEQ ID NO: 960860 - DNA, 25 bp, Mus musculus
ttgtggatgttatgtagggacccat

SEQ ID NO: 960861 - DNA, 25 bp, Mus musculus
ttgtggattagcagggcatgccttc

SEQ ID NO: 960862 - DNA, 25 bp, Mus musculus
ttgtggattagctgggcatgccttc

SEQ ID NO: 960863 - DNA, 25 bp, Mus musculus
ttgtggattcacacggcagtcactt

SEQ ID NO: 960864 - DNA, 25 bp, Mus musculus
ttgtggattcactcggcagtcactt

SEQ ID NO: 960865 - DNA, 25 bp, Mus musculus
ttgtggattgagcaaccaacacctt

SEQ ID NO: 960866 - DNA, 25 bp, Mus musculus
ttgtggattgaggaaccaacacctt

SEQ ID NO: 960867 - DNA, 25 bp, Mus musculus
ttgtggcaaaatcttctcttcctac

SEQ ID NO: 960868 - DNA, 25 bp, Mus musculus
ttgtggcaaaatgttctcttcctac

SEQ ID NO: 960869 - DNA, 25 bp, Mus musculus
ttgtggcaaactccttgaagtcttg

SEQ ID NO: 960870 - DNA, 25 bp, Mus musculus
ttgtggcaaactgcttgaagtcttg

SEQ ID NO: 960871 - DNA, 25 bp, Mus musculus
ttgtggcaagagaccagagctttgt

SEQ ID NO: 960872 - DNA, 25 bp, Mus musculus
ttgtggcaagagtccagagctttgt

SEQ ID NO: 960873 - DNA, 25 bp, Mus musculus
ttgtggcacaccctttgggaaacag

SEQ ID NO: 960874 - DNA, 25 bp, Mus musculus
ttgtggcacaccgtttgggaaacag

SEQ ID NO: 960875 - DNA, 25 bp, Mus musculus
ttgtggcaccacaacctgcatcaaa

SEQ ID NO: 960876 - DNA, 25 bp, Mus musculus
ttgtggcaccactacctgcatcaaa

SEQ ID NO: 960877 - DNA, 25 bp, Mus musculus
ttgtggcaccagagtcgtctagctt

SEQ ID NO: 960878 - DNA, 25 bp, Mus musculus
ttgtggcaccagtgtcgtctagctt

SEQ ID NO: 960879 - DNA, 25 bp, Mus musculus
ttgtggcacgtgagtgatcacagcc

SEQ ID NO: 960880 - DNA, 25 bp, Mus musculus
ttgtggcacgtgtgtgatcacagcc

SEQ ID NO: 960881 - DNA, 25 bp, Mus musculus
ttgtggcactaaatgactgcttcct

SEQ ID NO: 960882 - DNA, 25 bp, Mus musculus
ttgtggcactaattgactgcttcct

SEQ ID NO: 960883 - DNA, 25 bp, Mus musculus
ttgtggcactttaatcctggattcc

SEQ ID NO: 960884 - DNA, 25 bp, Mus musculus
ttgtggcacttttatcctggattcc

SEQ ID NO: 960885 - DNA, 25 bp, Mus musculus
ttgtggcagacaaaatcccctggat

SEQ ID NO: 960886 - DNA, 25 bp, Mus musculus
ttgtggcagacataatcccctggat

SEQ ID NO: 960887 - DNA, 25 bp, Mus musculus
ttgtggcattgaaccatccccacca

SEQ ID NO: 960888 - DNA, 25 bp, Mus musculus
ttgtggcattgatccatccccacca

SEQ ID NO: 960889 - DNA, 25 bp, Mus musculus
ttgtggccacaaccagctatcagtc

SEQ ID NO: 960890 - DNA, 25 bp, Mus musculus
ttgtggccacaagcagctatcagtc

SEQ ID NO: 960891 - DNA, 25 bp, Mus musculus
ttgtggccacgtctgaccatagttt

SEQ ID NO: 960892 - DNA, 25 bp, Mus musculus
ttgtggccacgtgtgaccatagttt

SEQ ID NO: 960893 - DNA, 25 bp, Mus musculus
ttgtggccatggatggaggatattc

SEQ ID NO: 960894 - DNA, 25 bp, Mus musculus
ttgtggccatggttggaggatattc

SEQ ID NO: 960895 - DNA, 25 bp, Mus musculus
ttgtggccatttctcactctgtttc

SEQ ID NO: 960896 - DNA, 25 bp, Mus musculus
ttgtggccatttgtcactctgtttc

SEQ ID NO: 960897 - DNA, 25 bp, Mus musculus
ttgtggccccgtagtctgatttttt

SEQ ID NO: 960898 - DNA, 25 bp, Mus musculus
ttgtggccccgttgtctgatttttt

SEQ ID NO: 960899 - DNA, 25 bp, Mus musculus
ttgtggccccttaagcccataaaga

SEQ ID NO: 960900 - DNA, 25 bp, Mus musculus
ttgtggcccctttagcccataaaga

SEQ ID NO: 960901 - DNA, 25 bp, Mus musculus
ttgtggccctctaggcatccaggaa

SEQ ID NO: 960902 - DNA, 25 bp, Mus musculus
ttgtggccctcttggcatccaggaa

SEQ ID NO: 960903 - DNA, 25 bp, Mus musculus
ttgtggcccttcaccatgggaacga

SEQ ID NO: 960904 - DNA, 25 bp, Mus musculus
ttgtggcccttctccatgggaacga

SEQ ID NO: 960905 - DNA, 25 bp, Mus musculus
ttgtggccgcacattttggacgcat

SEQ ID NO: 960906 - DNA, 25 bp, Mus musculus
ttgtggccgcactttttggacgcat

SEQ ID NO: 960907 - DNA, 25 bp, Mus musculus
ttgtggccggacatttgctgtggac

SEQ ID NO: 960908 - DNA, 25 bp, Mus musculus
ttgtggccggacttttgctgtggac

SEQ ID NO: 960909 - DNA, 25 bp, Mus musculus
ttgtggccgttcactctgctgtcat

SEQ ID NO: 960910 - DNA, 25 bp, Mus musculus
ttgtggccgttctctctgctgtcat

SEQ ID NO: 960911 - DNA, 25 bp, Mus musculus
ttgtggcctggtatgtaaataaaat

SEQ ID NO: 960912 - DNA, 25 bp, Mus musculus
ttgtggcctggtttgtaaataaaat

SEQ ID NO: 960913 - DNA, 25 bp, Mus musculus
ttgtggcgactcagaactgtagcga

SEQ ID NO: 960914 - DNA, 25 bp, Mus musculus
ttgtggcgactctgaactgtagcga

SEQ ID NO: 960915 - DNA, 25 bp, Mus musculus
ttgtggcgtttcattagaaacccag

SEQ ID NO: 960916 - DNA, 25 bp, Mus musculus
ttgtggcgtttctttagaaacccag

SEQ ID NO: 960917 - DNA, 25 bp, Mus musculus
ttgtggctacccctagaccagtaat

SEQ ID NO: 960918 - DNA, 25 bp, Mus musculus
ttgtggctacccgtagaccagtaat

SEQ ID NO: 960919 - DNA, 25 bp, Mus musculus
ttgtggctatgcatgtggtttttaa

SEQ ID NO: 960920 - DNA, 25 bp, Mus musculus
ttgtggctatgcttgtggtttttaa

SEQ ID NO: 960921 - DNA, 25 bp, Mus musculus
ttgtggctattgaggcttatacaga

SEQ ID NO: 960922 - DNA, 25 bp, Mus musculus
ttgtggctattgtggcttatacaga

SEQ ID NO: 960923 - DNA, 25 bp, Mus musculus
ttgtggctcaatagtctaatattac

SEQ ID NO: 960924 - DNA, 25 bp, Mus musculus
ttgtggctcaattgtctaatattac

SEQ ID NO: 960925 - DNA, 25 bp, Mus musculus
ttgtggctcaccctttataatggag

SEQ ID NO: 960926 - DNA, 25 bp, Mus musculus
ttgtggctcaccgtttataatggag

SEQ ID NO: 960927 - DNA, 25 bp, Mus musculus
ttgtggctcatgacttagcatccca

SEQ ID NO: 960928 - DNA, 25 bp, Mus musculus
ttgtggctcatgtcttagcatccca

SEQ ID NO: 960929 - DNA, 25 bp, Mus musculus
ttgtggctcattacctctggcctac

SEQ ID NO: 960930 - DNA, 25 bp, Mus musculus
ttgtggctcatttcctctggcctac

SEQ ID NO: 960931 - DNA, 25 bp, Mus musculus
ttgtggctcccgaaaagctggctga

SEQ ID NO: 960932 - DNA, 25 bp, Mus musculus
ttgtggctcccgtaaagctggctga

SEQ ID NO: 960933 - DNA, 25 bp, Mus musculus
ttgtggctcctgataaatcttccag

SEQ ID NO: 960934 - DNA, 25 bp, Mus musculus
ttgtggctcctgttaaatcttccag

SEQ ID NO: 960935 - DNA, 25 bp, Mus musculus
ttgtggctccttagtaccactttca

SEQ ID NO: 960936 - DNA, 25 bp, Mus musculus
ttgtggctccttcaggcactgcagg

SEQ ID NO: 960937 - DNA, 25 bp, Mus musculus
ttgtggctccttgaggcactgcagg

SEQ ID NO: 960938 - DNA, 25 bp, Mus musculus
ttgtggctcctttgtaccactttca

SEQ ID NO: 960939 - DNA, 25 bp, Mus musculus
ttgtggctctccatgatcctcttca

SEQ ID NO: 960940 - DNA, 25 bp, Mus musculus
ttgtggctctccttgatcctcttca

SEQ ID NO: 960941 - DNA, 25 bp, Mus musculus
ttgtggctctgcacagttctggaga

SEQ ID NO: 960942 - DNA, 25 bp, Mus musculus
ttgtggctctgctcagttctggaga

SEQ ID NO: 960943 - DNA, 25 bp, Mus musculus
ttgtggctctttactggatttgaga

SEQ ID NO: 960944 - DNA, 25 bp, Mus musculus
ttgtggctcttttctggatttgaga

SEQ ID NO: 960945 - DNA, 25 bp, Mus musculus
ttgtggctgccaaaggatctttcca

SEQ ID NO: 960946 - DNA, 25 bp, Mus musculus
ttgtggctgccataggatctttcca

SEQ ID NO: 960947 - DNA, 25 bp, Mus musculus
ttgtggctgcgacagtgttgtctat

SEQ ID NO: 960948 - DNA, 25 bp, Mus musculus
ttgtggctgcgagagtgttgtctat

SEQ ID NO: 960949 - DNA, 25 bp, Mus musculus
ttgtggctgttccataattccatgt

SEQ ID NO: 960950 - DNA, 25 bp, Mus musculus
ttgtggctgttcgataattccatgt

SEQ ID NO: 960951 - DNA, 25 bp, Mus musculus
ttgtggcttaacaggagactactca

SEQ ID NO: 960952 - DNA, 25 bp, Mus musculus
ttgtggcttaactggagactactca

SEQ ID NO: 960953 - DNA, 25 bp, Mus musculus
ttgtggcttataaactctggaaatc

SEQ ID NO: 960954 - DNA, 25 bp, Mus musculus
ttgtggcttatatactctggaaatc

SEQ ID NO: 960955 - DNA, 25 bp, Mus musculus
ttgtggctttaaagaccatgaagat

SEQ ID NO: 960956 - DNA, 25 bp, Mus musculus
ttgtggctttaatgaccatgaagat

SEQ ID NO: 960957 - DNA, 25 bp, Mus musculus
ttgtgggaatccatgaaagccctct

SEQ ID NO: 960958 - DNA, 25 bp, Mus musculus
ttgtgggaatccctgatcccttttt

SEQ ID NO: 960959 - DNA, 25 bp, Mus musculus
ttgtgggaatccgtgatcccttttt

SEQ ID NO: 960960 - DNA, 25 bp, Mus musculus
ttgtgggaatccttgaaagccctct

SEQ ID NO: 960961 - DNA, 25 bp, Mus musculus
ttgtgggacccacacccatgtttga

SEQ ID NO: 960962 - DNA, 25 bp, Mus musculus
ttgtgggacccagacccatgtttga

SEQ ID NO: 960963 - DNA, 25 bp, Mus musculus
ttgtgggaccctatgaacttactat

SEQ ID NO: 960964 - DNA, 25 bp, Mus musculus
ttgtgggaccctttgaacttactat

SEQ ID NO: 960965 - DNA, 25 bp, Mus musculus
ttgtgggacctcatatacccctgta

SEQ ID NO: 960966 - DNA, 25 bp, Mus musculus
ttgtgggacctcttatacccctgta

SEQ ID NO: 960967 - DNA, 25 bp, Mus musculus
ttgtgggaggctacggcagtttact

SEQ ID NO: 960968 - DNA, 25 bp, Mus musculus
ttgtgggaggcttcggcagtttact

SEQ ID NO: 960969 - DNA, 25 bp, Mus musculus
ttgtgggatacacgccatcggcaat

SEQ ID NO: 960970 - DNA, 25 bp, Mus musculus
ttgtgggatacaggccatcggcaat

SEQ ID NO: 960971 - DNA, 25 bp, Mus musculus
ttgtgggatggcacccacaaggact

SEQ ID NO: 960972 - DNA, 25 bp, Mus musculus
ttgtgggatggctcccacaaggact

SEQ ID NO: 960973 - DNA, 25 bp, Mus musculus
ttgtgggcaagcagcatccttttgt

SEQ ID NO: 960974 - DNA, 25 bp, Mus musculus
ttgtgggcaagctgcatccttttgt

SEQ ID NO: 960975 - DNA, 25 bp, Mus musculus
ttgtgggcaaggctccaggatctaa

SEQ ID NO: 960976 - DNA, 25 bp, Mus musculus
ttgtgggcaagggtccaggatctaa

SEQ ID NO: 960977 - DNA, 25 bp, Mus musculus
ttgtgggcacaaacatctttcatat

SEQ ID NO: 960978 - DNA, 25 bp, Mus musculus
ttgtgggcacaatcatctttcatat

SEQ ID NO: 960979 - DNA, 25 bp, Mus musculus
ttgtgggcaccaagtttatgaagaa

SEQ ID NO: 960980 - DNA, 25 bp, Mus musculus
ttgtgggcaccatgtttatgaagaa

SEQ ID NO: 960981 - DNA, 25 bp, Mus musculus
ttgtgggcagccctctttccagttt

SEQ ID NO: 960982 - DNA, 25 bp, Mus musculus
ttgtgggcagccgtctttccagttt

SEQ ID NO: 960983 - DNA, 25 bp, Mus musculus
ttgtgggccacaaaaccaagatgaa

SEQ ID NO: 960984 - DNA, 25 bp, Mus musculus
ttgtgggccacaacaggagaccttc

SEQ ID NO: 960985 - DNA, 25 bp, Mus musculus
ttgtgggccacataaccaagatgaa

SEQ ID NO: 960986 - DNA, 25 bp, Mus musculus
ttgtgggccacatcaggagaccttc

SEQ ID NO: 960987 - DNA, 25 bp, Mus musculus
ttgtgggcccagatttgctggttat

SEQ ID NO: 960988 - DNA, 25 bp, Mus musculus
ttgtgggcccagttttgctggttat

SEQ ID NO: 960989 - DNA, 25 bp, Mus musculus
ttgtgggccgatacttccaagggaa

SEQ ID NO: 960990 - DNA, 25 bp, Mus musculus
ttgtgggccgattcttccaagggaa

SEQ ID NO: 960991 - DNA, 25 bp, Mus musculus
ttgtgggctcgaatcctaagagtaa

SEQ ID NO: 960992 - DNA, 25 bp, Mus musculus
ttgtgggctcgattcctaagagtaa

SEQ ID NO: 960993 - DNA, 25 bp, Mus musculus
ttgtgggctggcacttgtggacaca

SEQ ID NO: 960994 - DNA, 25 bp, Mus musculus
ttgtgggctggctcttgtggacaca

SEQ ID NO: 960995 - DNA, 25 bp, Mus musculus
ttgtgggcttgtagcagtatctgct

SEQ ID NO: 960996 - DNA, 25 bp, Mus musculus
ttgtgggcttgttgcagtatctgct

SEQ ID NO: 960997 - DNA, 25 bp, Mus musculus
ttgtgggctttaacatccagacaac

SEQ ID NO: 960998 - DNA, 25 bp, Mus musculus
ttgtgggctttatcatccagacaac

SEQ ID NO: 960999 - DNA, 25 bp, Mus musculus
ttgtggggcattactaggggctctt

SEQ ID NO: 961000 - DNA, 25 bp, Mus musculus
ttgtggggcatttctaggggctctt

SEQ ID NO: 961001 - DNA, 25 bp, Mus musculus
ttgtgggtaaacctgctgggcccct

SEQ ID NO: 961002 - DNA, 25 bp, Mus musculus
ttgtgggtaaacgtgctgggcccct

SEQ ID NO: 961003 - DNA, 25 bp, Mus musculus
ttgtgggtcacacactcaaatccct

SEQ ID NO: 961004 - DNA, 25 bp, Mus musculus
ttgtgggtcacagactcaaatccct

SEQ ID NO: 961005 - DNA, 25 bp, Mus musculus
ttgtgggtcactcttccgatcttag

SEQ ID NO: 961006 - DNA, 25 bp, Mus musculus
ttgtgggtcactgttccgatcttag

SEQ ID NO: 961007 - DNA, 25 bp, Mus musculus
ttgtgggtcctaacttgatgacgta

SEQ ID NO: 961008 - DNA, 25 bp, Mus musculus
ttgtgggtcctatcttgatgacgta

SEQ ID NO: 961009 - DNA, 25 bp, Mus musculus
ttgtgggtgtatatggatttctctc

SEQ ID NO: 961010 - DNA, 25 bp, Mus musculus
ttgtgggtgtatttggatttctctc

SEQ ID NO: 961011 - DNA, 25 bp, Mus musculus
ttgtgggttataagctagtcttcca

SEQ ID NO: 961012 - DNA, 25 bp, Mus musculus
ttgtgggttatatgctagtcttcca

SEQ ID NO: 961013 - DNA, 25 bp, Mus musculus
ttgtgggttcctcacttgtagttaa

SEQ ID NO: 961014 - DNA, 25 bp, Mus musculus
ttgtgggttcctgacttgtagttaa

SEQ ID NO: 961015 - DNA, 25 bp, Mus musculus
ttgtgggttgctatccctttgggtg

SEQ ID NO: 961016 - DNA, 25 bp, Mus musculus
ttgtgggttgctttccctttgggtg

SEQ ID NO: 961017 - DNA, 25 bp, Mus musculus
ttgtgggttggtactgataagcacc

SEQ ID NO: 961018 - DNA, 25 bp, Mus musculus
ttgtgggttggttctgataagcacc

SEQ ID NO: 961019 - DNA, 25 bp, Mus musculus
ttgtgggtttcaagactgcgcttcc

SEQ ID NO: 961020 - DNA, 25 bp, Mus musculus
ttgtgggtttcatgactgcgcttcc

SEQ ID NO: 961021 - DNA, 25 bp, Mus musculus
ttgtggtaaaccatgagactcgatt

SEQ ID NO: 961022 - DNA, 25 bp, Mus musculus
ttgtggtaaaccttgagactcgatt

SEQ ID NO: 961023 - DNA, 25 bp, Mus musculus
ttgtggtaccatactcacggtgtgg

SEQ ID NO: 961024 - DNA, 25 bp, Mus musculus
ttgtggtaccattctcacggtgtgg

SEQ ID NO: 961025 - DNA, 25 bp, Mus musculus
ttgtggtagcaaccatgcagccggc

SEQ ID NO: 961026 - DNA, 25 bp, Mus musculus
ttgtggtagcaagcatgcagccggc

SEQ ID NO: 961027 - DNA, 25 bp, Mus musculus
ttgtggtaggccatattcgcctgat

SEQ ID NO: 961028 - DNA, 25 bp, Mus musculus
ttgtggtaggccttattcgcctgat

SEQ ID NO: 961029 - DNA, 25 bp, Mus musculus
ttgtggtataaactgctcctggaat

SEQ ID NO: 961030 - DNA, 25 bp, Mus musculus
ttgtggtataaagtgctcctggaat

SEQ ID NO: 961031 - DNA, 25 bp, Mus musculus
ttgtggtatccaagctcttagaacc

SEQ ID NO: 961032 - DNA, 25 bp, Mus musculus
ttgtggtatccatgctcttagaacc

SEQ ID NO: 961033 - DNA, 25 bp, Mus musculus
ttgtggtatcgtaatcttggtgctg

SEQ ID NO: 961034 - DNA, 25 bp, Mus musculus
ttgtggtatcgttatcttggtgctg

SEQ ID NO: 961035 - DNA, 25 bp, Mus musculus
ttgtggtattagacccataaagaaa

SEQ ID NO: 961036 - DNA, 25 bp, Mus musculus
ttgtggtattagtcccataaagaaa

SEQ ID NO: 961037 - DNA, 25 bp, Mus musculus
ttgtggtcaagtacgcactgggcca

SEQ ID NO: 961038 - DNA, 25 bp, Mus musculus
ttgtggtcaagttcgcactgggcca

SEQ ID NO: 961039 - DNA, 25 bp, Mus musculus
ttgtggtcacaaatcctgcaaagcc

SEQ ID NO: 961040 - DNA, 25 bp, Mus musculus
ttgtggtcacaattcctgcaaagcc

SEQ ID NO: 961041 - DNA, 25 bp, Mus musculus
ttgtggtcacagcagtgcccttgga

SEQ ID NO: 961042 - DNA, 25 bp, Mus musculus
ttgtggtcacaggagtgcccttgga

SEQ ID NO: 961043 - DNA, 25 bp, Mus musculus
ttgtggtcactgcatccagcttcac

SEQ ID NO: 961044 - DNA, 25 bp, Mus musculus
ttgtggtcactggatccagcttcac

SEQ ID NO: 961045 - DNA, 25 bp, Mus musculus
ttgtggtcttacagaaggctctcct

SEQ ID NO: 961046 - DNA, 25 bp, Mus musculus
ttgtggtcttactgaaggctctcct

SEQ ID NO: 961047 - DNA, 25 bp, Mus musculus
ttgtggtgaatccagttaccaggac

SEQ ID NO: 961048 - DNA, 25 bp, Mus musculus
ttgtggtgaatcgagttaccaggac

SEQ ID NO: 961049 - DNA, 25 bp, Mus musculus
ttgtggtgagatccctgggttttga

SEQ ID NO: 961050 - DNA, 25 bp, Mus musculus
ttgtggtgagatgcctgggttttga

SEQ ID NO: 961051 - DNA, 25 bp, Mus musculus
ttgtggtgctaactttgtgtccgtc

SEQ ID NO: 961052 - DNA, 25 bp, Mus musculus
ttgtggtgctaagtttgtgtccgtc

SEQ ID NO: 961053 - DNA, 25 bp, Mus musculus
ttgtggtgctagagcaaggtcactg

SEQ ID NO: 961054 - DNA, 25 bp, Mus musculus
ttgtggtgctagtgcaaggtcactg

SEQ ID NO: 961055 - DNA, 25 bp, Mus musculus
ttgtggtgcttgaggcaaagctttc

SEQ ID NO: 961056 - DNA, 25 bp, Mus musculus
ttgtggtgcttgtggcaaagctttc

SEQ ID NO: 961057 - DNA, 25 bp, Mus musculus
ttgtggtggcaactggtccgattcc

SEQ ID NO: 961058 - DNA, 25 bp, Mus musculus
ttgtggtggcaagtggtccgattcc

SEQ ID NO: 961059 - DNA, 25 bp, Mus musculus
ttgtggtgggttagcccactatgtc

SEQ ID NO: 961060 - DNA, 25 bp, Mus musculus
ttgtggtgggtttgcccactatgtc

SEQ ID NO: 961061 - DNA, 25 bp, Mus musculus
ttgtggtgttctatatcacctcttc

SEQ ID NO: 961062 - DNA, 25 bp, Mus musculus
ttgtggtgttctttatcacctcttc

SEQ ID NO: 961063 - DNA, 25 bp, Mus musculus
ttgtggttacatagggtaccctcac

SEQ ID NO: 961064 - DNA, 25 bp, Mus musculus
ttgtggttacattgggtaccctcac

SEQ ID NO: 961065 - DNA, 25 bp, Mus musculus
ttgtggttaccccagatgtccaggc

SEQ ID NO: 961066 - DNA, 25 bp, Mus musculus
ttgtggttacccgagatgtccaggc

SEQ ID NO: 961067 - DNA, 25 bp, Mus musculus
ttgtggttaccgactgcccagagag

SEQ ID NO: 961068 - DNA, 25 bp, Mus musculus
ttgtggttaccgtctgcccagagag

SEQ ID NO: 961069 - DNA, 25 bp, Mus musculus
ttgtggttacgcaaggaatccctct

SEQ ID NO: 961070 - DNA, 25 bp, Mus musculus
ttgtggttacgctaggaatccctct

SEQ ID NO: 961071 - DNA, 25 bp, Mus musculus
ttgtggttgatccacattctttccc

SEQ ID NO: 961072 - DNA, 25 bp, Mus musculus
ttgtggttgatcgacattctttccc

SEQ ID NO: 961073 - DNA, 25 bp, Mus musculus
ttgtggttgccaacatggtgctgga

SEQ ID NO: 961074 - DNA, 25 bp, Mus musculus
ttgtggttgccatcatggtgctgga

SEQ ID NO: 961075 - DNA, 25 bp, Mus musculus
ttgtggtttattctgtttccaacag

SEQ ID NO: 961076 - DNA, 25 bp, Mus musculus
ttgtggtttattgtgtttccaacag

SEQ ID NO: 961077 - DNA, 25 bp, Mus musculus
ttgtggtttcagaatggtgtgccat

SEQ ID NO: 961078 - DNA, 25 bp, Mus musculus
ttgtggtttcagtatggtgtgccat

SEQ ID NO: 961079 - DNA, 25 bp, Mus musculus
ttgtggtttcttagctttctccaaa

SEQ ID NO: 961080 - DNA, 25 bp, Mus musculus
ttgtggtttctttgctttctccaaa

SEQ ID NO: 961081 - DNA, 25 bp, Mus musculus
ttgtggtttttgaaccattcaataa

SEQ ID NO: 961082 - DNA, 25 bp, Mus musculus
ttgtggtttttgtaccattcaataa

SEQ ID NO: 961083 - DNA, 25 bp, Mus musculus
ttgtgtaacactatctttaagacag

SEQ ID NO: 961084 - DNA, 25 bp, Mus musculus
ttgtgtaacactttctttaagacag

SEQ ID NO: 961085 - DNA, 25 bp, Mus musculus
ttgtgtaacagactttgctgtcctg

SEQ ID NO: 961086 - DNA, 25 bp, Mus musculus
ttgtgtaacagagtttgctgtcctg

SEQ ID NO: 961087 - DNA, 25 bp, Mus musculus
ttgtgtaactcacgttctggagcct

SEQ ID NO: 961088 - DNA, 25 bp, Mus musculus
ttgtgtaactcaggttctggagcct

SEQ ID NO: 961089 - DNA, 25 bp, Mus musculus
ttgtgtaatttcaggctcttgtcta

SEQ ID NO: 961090 - DNA, 25 bp, Mus musculus
ttgtgtaatttctggctcttgtcta

SEQ ID NO: 961091 - DNA, 25 bp, Mus musculus
ttgtgtacacagctagcctttctac

SEQ ID NO: 961092 - DNA, 25 bp, Mus musculus
ttgtgtacacaggtagcctttctac

SEQ ID NO: 961093 - DNA, 25 bp, Mus musculus
ttgtgtacagttccctttgtagcaa

SEQ ID NO: 961094 - DNA, 25 bp, Mus musculus
ttgtgtacagttgcctttgtagcaa

SEQ ID NO: 961095 - DNA, 25 bp, Mus musculus
ttgtgtacatacactgtgttagact

SEQ ID NO: 961096 - DNA, 25 bp, Mus musculus
ttgtgtacatactctgtgttagact

SEQ ID NO: 961097 - DNA, 25 bp, Mus musculus
ttgtgtacatgtacttcctccaaag

SEQ ID NO: 961098 - DNA, 25 bp, Mus musculus
ttgtgtacatgttcttcctccaaag

SEQ ID NO: 961099 - DNA, 25 bp, Mus musculus
ttgtgtaccatacttcctctttgtt

SEQ ID NO: 961100 - DNA, 25 bp, Mus musculus
ttgtgtaccatagttcctctttgtt

SEQ ID NO: 961101 - DNA, 25 bp, Mus musculus
ttgtgtacccacagggctcttctga

SEQ ID NO: 961102 - DNA, 25 bp, Mus musculus
ttgtgtacccactgggctcttctga

SEQ ID NO: 961103 - DNA, 25 bp, Mus musculus
ttgtgtaccggcatagaccttgtta

SEQ ID NO: 961104 - DNA, 25 bp, Mus musculus
ttgtgtaccggcttagaccttgtta

SEQ ID NO: 961105 - DNA, 25 bp, Mus musculus
ttgtgtacctagagacctgggtcta

SEQ ID NO: 961106 - DNA, 25 bp, Mus musculus
ttgtgtacctagtgacctgggtcta

SEQ ID NO: 961107 - DNA, 25 bp, Mus musculus
ttgtgtacctatcaacctggatgat

SEQ ID NO: 961108 - DNA, 25 bp, Mus musculus
ttgtgtacctatgaacctggatgat

SEQ ID NO: 961109 - DNA, 25 bp, Mus musculus
ttgtgtacctggcagtccatgcagt

SEQ ID NO: 961110 - DNA, 25 bp, Mus musculus
ttgtgtacctgggagtccatgcagt

SEQ ID NO: 961111 - DNA, 25 bp, Mus musculus
ttgtgtactgtgattactcgccctc

SEQ ID NO: 961112 - DNA, 25 bp, Mus musculus
ttgtgtactgtgtttactcgccctc

SEQ ID NO: 961113 - DNA, 25 bp, Mus musculus
ttgtgtactttaatttccacccatg

SEQ ID NO: 961114 - DNA, 25 bp, Mus musculus
ttgtgtactttattttccacccatg

SEQ ID NO: 961115 - DNA, 25 bp, Mus musculus
ttgtgtagagcacaaccagcccaaa

SEQ ID NO: 961116 - DNA, 25 bp, Mus musculus
ttgtgtagagcagaaccagcccaaa

SEQ ID NO: 961117 - DNA, 25 bp, Mus musculus
ttgtgtagattaacagtgccagctc

SEQ ID NO: 961118 - DNA, 25 bp, Mus musculus
ttgtgtagattatcagtgccagctc

SEQ ID NO: 961119 - DNA, 25 bp, Mus musculus
ttgtgtagctttacttctgtgtccc

SEQ ID NO: 961120 - DNA, 25 bp, Mus musculus
ttgtgtagcttttcttctgtgtccc

SEQ ID NO: 961121 - DNA, 25 bp, Mus musculus
ttgtgtaggaagcaggtcacacctt

SEQ ID NO: 961122 - DNA, 25 bp, Mus musculus
ttgtgtaggaaggaggtcacacctt

SEQ ID NO: 961123 - DNA, 25 bp, Mus musculus
ttgtgtagtaaaccgcacccttcgc

SEQ ID NO: 961124 - DNA, 25 bp, Mus musculus
ttgtgtagtaaagcgcacccttcgc

SEQ ID NO: 961125 - DNA, 25 bp, Mus musculus
ttgtgtagtgagcaccttgttccca

SEQ ID NO: 961126 - DNA, 25 bp, Mus musculus
ttgtgtagtgaggaccttgttccca

SEQ ID NO: 961127 - DNA, 25 bp, Mus musculus
ttgtgtagtgtaacattgaattcat

SEQ ID NO: 961128 - DNA, 25 bp, Mus musculus
ttgtgtagtgtatcattgaattcat

SEQ ID NO: 961129 - DNA, 25 bp, Mus musculus
ttgtgtagtgttcccttctacccaa

SEQ ID NO: 961130 - DNA, 25 bp, Mus musculus
ttgtgtagtgttgccttctacccaa

SEQ ID NO: 961131 - DNA, 25 bp, Mus musculus
ttgtgtatactgaacatgcatcctt

SEQ ID NO: 961132 - DNA, 25 bp, Mus musculus
ttgtgtatactgtacatgcatcctt

SEQ ID NO: 961133 - DNA, 25 bp, Mus musculus
ttgtgtatatagcaccatgggctgt

SEQ ID NO: 961134 - DNA, 25 bp, Mus musculus
ttgtgtatataggaccatgggctgt

SEQ ID NO: 961135 - DNA, 25 bp, Mus musculus
ttgtgtatattgacagttcagggca

SEQ ID NO: 961136 - DNA, 25 bp, Mus musculus
ttgtgtatattgtcagttcagggca

SEQ ID NO: 961137 - DNA, 25 bp, Mus musculus
ttgtgtatcattactcaggcgtcat

SEQ ID NO: 961138 - DNA, 25 bp, Mus musculus
ttgtgtatcatttctcaggcgtcat

SEQ ID NO: 961139 - DNA, 25 bp, Mus musculus
ttgtgtatccagaagctccatcaac

SEQ ID NO: 961140 - DNA, 25 bp, Mus musculus
ttgtgtatccagtagctccatcaac

SEQ ID NO: 961141 - DNA, 25 bp, Mus musculus
ttgtgtatcctcacatacctgtcac

SEQ ID NO: 961142 - DNA, 25 bp, Mus musculus
ttgtgtatcctctcatacctgtcac

SEQ ID NO: 961143 - DNA, 25 bp, Mus musculus
ttgtgtatccttaccgcatccttat

SEQ ID NO: 961144 - DNA, 25 bp, Mus musculus
ttgtgtatcctttccgcatccttat

SEQ ID NO: 961145 - DNA, 25 bp, Mus musculus
ttgtgtatctccattattgtaatgt

SEQ ID NO: 961146 - DNA, 25 bp, Mus musculus
ttgtgtatctcctttattgtaatgt

SEQ ID NO: 961147 - DNA, 25 bp, Mus musculus
ttgtgtatgactaccagcggctcct

SEQ ID NO: 961148 - DNA, 25 bp, Mus musculus
ttgtgtatgactaggaagaagggcc

SEQ ID NO: 961149 - DNA, 25 bp, Mus musculus
ttgtgtatgacttccagcggctcct

SEQ ID NO: 961150 - DNA, 25 bp, Mus musculus
ttgtgtatgacttggaagaagggcc

SEQ ID NO: 961151 - DNA, 25 bp, Mus musculus
ttgtgtatgcacaagctttccagct

SEQ ID NO: 961152 - DNA, 25 bp, Mus musculus
ttgtgtatgcactagctttccagct

SEQ ID NO: 961153 - DNA, 25 bp, Mus musculus
ttgtgtatgcccaggtcttcttata

SEQ ID NO: 961154 - DNA, 25 bp, Mus musculus
ttgtgtatgccctggtcttcttata

SEQ ID NO: 961155 - DNA, 25 bp, Mus musculus
ttgtgtatgcggatggcttgtctac

SEQ ID NO: 961156 - DNA, 25 bp, Mus musculus
ttgtgtatgcggttggcttgtctac

SEQ ID NO: 961157 - DNA, 25 bp, Mus musculus
ttgtgtatgctcatgcaccgtagaa

SEQ ID NO: 961158 - DNA, 25 bp, Mus musculus
ttgtgtatgctcttgcaccgtagaa

SEQ ID NO: 961159 - DNA, 25 bp, Mus musculus
ttgtgtatggccaacctgcagtcct

SEQ ID NO: 961160 - DNA, 25 bp, Mus musculus
ttgtgtatggcctacctgcagtcct

SEQ ID NO: 961161 - DNA, 25 bp, Mus musculus
ttgtgtatggctccctggtccagac

SEQ ID NO: 961162 - DNA, 25 bp, Mus musculus
ttgtgtatggctgcctggtccagac

SEQ ID NO: 961163 - DNA, 25 bp, Mus musculus
ttgtgtatgtaaagaggcttcctct

SEQ ID NO: 961164 - DNA, 25 bp, Mus musculus
ttgtgtatgtaatgaggcttcctct

SEQ ID NO: 961165 - DNA, 25 bp, Mus musculus
ttgtgtatgtacctcacgcatgcct

SEQ ID NO: 961166 - DNA, 25 bp, Mus musculus
ttgtgtatgtacgtcacgcatgcct

SEQ ID NO: 961167 - DNA, 25 bp, Mus musculus
ttgtgtattatgagtgtctgtgtat

SEQ ID NO: 961168 - DNA, 25 bp, Mus musculus
ttgtgtattatgtgtgtctgtgtat

SEQ ID NO: 961169 - DNA, 25 bp, Mus musculus
ttgtgtattgcaatgacagtcctga

SEQ ID NO: 961170 - DNA, 25 bp, Mus musculus
ttgtgtattgcattgacagtcctga

SEQ ID NO: 961171 - DNA, 25 bp, Mus musculus
ttgtgtattgctccaaatcatgtgc

SEQ ID NO: 961172 - DNA, 25 bp, Mus musculus
ttgtgtattgctgcaaatcatgtgc

SEQ ID NO: 961173 - DNA, 25 bp, Mus musculus
ttgtgtcacaaaaaacctactagag

SEQ ID NO: 961174 - DNA, 25 bp, Mus musculus
ttgtgtcacaaataacctactagag

SEQ ID NO: 961175 - DNA, 25 bp, Mus musculus
ttgtgtcacaggcttgctaggtagc

SEQ ID NO: 961176 - DNA, 25 bp, Mus musculus
ttgtgtcacagggttgctaggtagc

SEQ ID NO: 961177 - DNA, 25 bp, Mus musculus
ttgtgtcacagtaccaaaagtcaga

SEQ ID NO: 961178 - DNA, 25 bp, Mus musculus
ttgtgtcacagttccaaaagtcaga

SEQ ID NO: 961179 - DNA, 25 bp, Mus musculus
ttgtgtcacgaacaaagcccctcaa

SEQ ID NO: 961180 - DNA, 25 bp, Mus musculus
ttgtgtcacgaagaaagcccctcaa

SEQ ID NO: 961181 - DNA, 25 bp, Mus musculus
ttgtgtcacggaatgagccggccaa

SEQ ID NO: 961182 - DNA, 25 bp, Mus musculus
ttgtgtcacggattgagccggccaa

SEQ ID NO: 961183 - DNA, 25 bp, Mus musculus
ttgtgtcagctgatagtggtgaaac

SEQ ID NO: 961184 - DNA, 25 bp, Mus musculus
ttgtgtcagctgttagtggtgaaac

SEQ ID NO: 961185 - DNA, 25 bp, Mus musculus
ttgtgtcatagcaaccaggctgttt

SEQ ID NO: 961186 - DNA, 25 bp, Mus musculus
ttgtgtcatagctaccaggctgttt

SEQ ID NO: 961187 - DNA, 25 bp, Mus musculus
ttgtgtccaataaggtgtctcgctt

SEQ ID NO: 961188 - DNA, 25 bp, Mus musculus
ttgtgtccaatatggtgtctcgctt

SEQ ID NO: 961189 - DNA, 25 bp, Mus musculus
ttgtgtccaccaatggcatgaagtg

SEQ ID NO: 961190 - DNA, 25 bp, Mus musculus
ttgtgtccaccattggcatgaagtg

SEQ ID NO: 961191 - DNA, 25 bp, Mus musculus
ttgtgtccactcagtgccatctgag

SEQ ID NO: 961192 - DNA, 25 bp, Mus musculus
ttgtgtccactctgtgccatctgag

SEQ ID NO: 961193 - DNA, 25 bp, Mus musculus
ttgtgtccagccaataatttctcat

SEQ ID NO: 961194 - DNA, 25 bp, Mus musculus
ttgtgtccagcctataatttctcat

SEQ ID NO: 961195 - DNA, 25 bp, Mus musculus
ttgtgtcccaagacaatcccacaag

SEQ ID NO: 961196 - DNA, 25 bp, Mus musculus
ttgtgtcccaagatccgctgaagca

SEQ ID NO: 961197 - DNA, 25 bp, Mus musculus
ttgtgtcccaagtcaatcccacaag

SEQ ID NO: 961198 - DNA, 25 bp, Mus musculus
ttgtgtcccaagttccgctgaagca

SEQ ID NO: 961199 - DNA, 25 bp, Mus musculus
ttgtgtcccaccctaattttatatg

SEQ ID NO: 961200 - DNA, 25 bp, Mus musculus
ttgtgtcccaccgtaattttatatg

SEQ ID NO: 961201 - DNA, 25 bp, Mus musculus
ttgtgtcccagcaaacccagctttg

SEQ ID NO: 961202 - DNA, 25 bp, Mus musculus
ttgtgtcccagctaacccagctttg

SEQ ID NO: 961203 - DNA, 25 bp, Mus musculus
ttgtgtcccatcacgagaggctcat

SEQ ID NO: 961204 - DNA, 25 bp, Mus musculus
ttgtgtcccatctcgagaggctcat

SEQ ID NO: 961205 - DNA, 25 bp, Mus musculus
ttgtgtcccctccatcttctttaat

SEQ ID NO: 961206 - DNA, 25 bp, Mus musculus
ttgtgtcccctcgatcttctttaat

SEQ ID NO: 961207 - DNA, 25 bp, Mus musculus
ttgtgtccctttatgagcagaagac

SEQ ID NO: 961208 - DNA, 25 bp, Mus musculus
ttgtgtccctttttgagcagaagac

SEQ ID NO: 961209 - DNA, 25 bp, Mus musculus
ttgtgtccgtacattcttgtgtcca

SEQ ID NO: 961210 - DNA, 25 bp, Mus musculus
ttgtgtccgtactttcttgtgtcca

SEQ ID NO: 961211 - DNA, 25 bp, Mus musculus
ttgtgtccgtttactactgcttctt

SEQ ID NO: 961212 - DNA, 25 bp, Mus musculus
ttgtgtccgtttcctgcctaggaag

SEQ ID NO: 961213 - DNA, 25 bp, Mus musculus
ttgtgtccgtttgctgcctaggaag

SEQ ID NO: 961214 - DNA, 25 bp, Mus musculus
ttgtgtccgttttctactgcttctt

SEQ ID NO: 961215 - DNA, 25 bp, Mus musculus
ttgtgtcctcagacaactgtgtcgg

SEQ ID NO: 961216 - DNA, 25 bp, Mus musculus
ttgtgtcctcagtcaactgtgtcgg

SEQ ID NO: 961217 - DNA, 25 bp, Mus musculus
ttgtgtcctccactggtgctgttca

SEQ ID NO: 961218 - DNA, 25 bp, Mus musculus
ttgtgtcctccagtggtgctgttca

SEQ ID NO: 961219 - DNA, 25 bp, Mus musculus
ttgtgtcctcgacccacgcgtggat

SEQ ID NO: 961220 - DNA, 25 bp, Mus musculus
ttgtgtcctcgagccacgcgtggat

SEQ ID NO: 961221 - DNA, 25 bp, Mus musculus
ttgtgtcctctcaatgagaccctga

SEQ ID NO: 961222 - DNA, 25 bp, Mus musculus
ttgtgtcctctctatgagaccctga

SEQ ID NO: 961223 - DNA, 25 bp, Mus musculus
ttgtgtcctgtaagagttggtgata

SEQ ID NO: 961224 - DNA, 25 bp, Mus musculus
ttgtgtcctgtatgagttggtgata

SEQ ID NO: 961225 - DNA, 25 bp, Mus musculus
ttgtgtccttaacggcagagtgtca

SEQ ID NO: 961226 - DNA, 25 bp, Mus musculus
ttgtgtccttaagggcagagtgtca

SEQ ID NO: 961227 - DNA, 25 bp, Mus musculus
ttgtgtcctttgctttagtgtcagt

SEQ ID NO: 961228 - DNA, 25 bp, Mus musculus
ttgtgtcctttggtttagtgtcagt

SEQ ID NO: 961229 - DNA, 25 bp, Mus musculus
ttgtgtctaacccacatttggctgt

SEQ ID NO: 961230 - DNA, 25 bp, Mus musculus
ttgtgtctaaccgacatttggctgt

SEQ ID NO: 961231 - DNA, 25 bp, Mus musculus
ttgtgtctaagcatctcagagtcaa

SEQ ID NO: 961232 - DNA, 25 bp, Mus musculus
ttgtgtctaagcttctcagagtcaa

SEQ ID NO: 961233 - DNA, 25 bp, Mus musculus
ttgtgtctaaggagtatcttgaact

SEQ ID NO: 961234 - DNA, 25 bp, Mus musculus
ttgtgtctaaggtgtatcttgaact

SEQ ID NO: 961235 - DNA, 25 bp, Mus musculus
ttgtgtctacaaaaacttctctaaa

SEQ ID NO: 961236 - DNA, 25 bp, Mus musculus
ttgtgtctacaataacttctctaaa

SEQ ID NO: 961237 - DNA, 25 bp, Mus musculus
ttgtgtctacagcagctcccaggac

SEQ ID NO: 961238 - DNA, 25 bp, Mus musculus
ttgtgtctacaggagctcccaggac

SEQ ID NO: 961239 - DNA, 25 bp, Mus musculus
ttgtgtctacatcacgcataacgct

SEQ ID NO: 961240 - DNA, 25 bp, Mus musculus
ttgtgtctacatgacgcataacgct

SEQ ID NO: 961241 - DNA, 25 bp, Mus musculus
ttgtgtctcagcctagatcacctga

SEQ ID NO: 961242 - DNA, 25 bp, Mus musculus
ttgtgtctcagcgtagatcacctga

SEQ ID NO: 961243 - DNA, 25 bp, Mus musculus
ttgtgtctccagacgcactcaaagt

SEQ ID NO: 961244 - DNA, 25 bp, Mus musculus
ttgtgtctccagtcgcactcaaagt

SEQ ID NO: 961245 - DNA, 25 bp, Mus musculus
ttgtgtctcctgactgtgcaatcta

SEQ ID NO: 961246 - DNA, 25 bp, Mus musculus
ttgtgtctcctgatcccaaatttgt

SEQ ID NO: 961247 - DNA, 25 bp, Mus musculus
ttgtgtctcctgtctgtgcaatcta

SEQ ID NO: 961248 - DNA, 25 bp, Mus musculus
ttgtgtctcctgttcccaaatttgt

SEQ ID NO: 961249 - DNA, 25 bp, Mus musculus
ttgtgtctctaccacctgtgtataa

SEQ ID NO: 961250 - DNA, 25 bp, Mus musculus
ttgtgtctctacgacctgtgtataa

SEQ ID NO: 961251 - DNA, 25 bp, Mus musculus
ttgtgtctcttcattcaactacatc

SEQ ID NO: 961252 - DNA, 25 bp, Mus musculus
ttgtgtctcttctttcaactacatc

SEQ ID NO: 961253 - DNA, 25 bp, Mus musculus
ttgtgtctgctcagatttggcccca

SEQ ID NO: 961254 - DNA, 25 bp, Mus musculus
ttgtgtctgctctgatttggcccca

SEQ ID NO: 961255 - DNA, 25 bp, Mus musculus
ttgtgtctggccctattgcatttac

SEQ ID NO: 961256 - DNA, 25 bp, Mus musculus
ttgtgtctggccgtattgcatttac

SEQ ID NO: 961257 - DNA, 25 bp, Mus musculus
ttgtgtcttaggctggtgaaagtca

SEQ ID NO: 961258 - DNA, 25 bp, Mus musculus
ttgtgtcttagggtggtgaaagtca

SEQ ID NO: 961259 - DNA, 25 bp, Mus musculus
ttgtgtcttccaacagtctgagaga

SEQ ID NO: 961260 - DNA, 25 bp, Mus musculus
ttgtgtcttccatcagtctgagaga

SEQ ID NO: 961261 - DNA, 25 bp, Mus musculus
ttgtgtcttgttcaaagctgcccat

SEQ ID NO: 961262 - DNA, 25 bp, Mus musculus
ttgtgtcttgttgaaagctgcccat

SEQ ID NO: 961263 - DNA, 25 bp, Mus musculus
ttgtgtctttgcatgcatacagtgg

SEQ ID NO: 961264 - DNA, 25 bp, Mus musculus
ttgtgtctttgcttgcatacagtgg

SEQ ID NO: 961265 - DNA, 25 bp, Mus musculus
ttgtgtgaccaactgttccccaaac

SEQ ID NO: 961266 - DNA, 25 bp, Mus musculus
ttgtgtgaccaagtgttccccaaac

SEQ ID NO: 961267 - DNA, 25 bp, Mus musculus
ttgtgtgaccacatgctttctgtac

SEQ ID NO: 961268 - DNA, 25 bp, Mus musculus
ttgtgtgaccacttgctttctgtac

SEQ ID NO: 961269 - DNA, 25 bp, Mus musculus
ttgtgtgaccttcgacattgagaac

SEQ ID NO: 961270 - DNA, 25 bp, Mus musculus
ttgtgtgaccttggacattgagaac

SEQ ID NO: 961271 - DNA, 25 bp, Mus musculus
ttgtgtgactccaggttggcctcct

SEQ ID NO: 961272 - DNA, 25 bp, Mus musculus
ttgtgtgactcctggttggcctcct

SEQ ID NO: 961273 - DNA, 25 bp, Mus musculus
ttgtgtgactctcaactgtgggagc

SEQ ID NO: 961274 - DNA, 25 bp, Mus musculus
ttgtgtgactctgaactgtgggagc

SEQ ID NO: 961275 - DNA, 25 bp, Mus musculus
ttgtgtgagaccctctgtgctttag

SEQ ID NO: 961276 - DNA, 25 bp, Mus musculus
ttgtgtgagaccgtctgtgctttag

SEQ ID NO: 961277 - DNA, 25 bp, Mus musculus
ttgtgtgagccgctgcctctcagca

SEQ ID NO: 961278 - DNA, 25 bp, Mus musculus
ttgtgtgagccggtgcctctcagca

SEQ ID NO: 961279 - DNA, 25 bp, Mus musculus
ttgtgtgagctcaaagacccttcgt

SEQ ID NO: 961280 - DNA, 25 bp, Mus musculus
ttgtgtgagctctaagacccttcgt

SEQ ID NO: 961281 - DNA, 25 bp, Mus musculus
ttgtgtgataatcgcgtgtcttccc

SEQ ID NO: 961282 - DNA, 25 bp, Mus musculus
ttgtgtgataatggcgtgtcttccc

SEQ ID NO: 961283 - DNA, 25 bp, Mus musculus
ttgtgtgatcatcgtgaagccccat

SEQ ID NO: 961284 - DNA, 25 bp, Mus musculus
ttgtgtgatcatggtgaagccccat

SEQ ID NO: 961285 - DNA, 25 bp, Mus musculus
ttgtgtgatgctatagacattcatt

SEQ ID NO: 961286 - DNA, 25 bp, Mus musculus
ttgtgtgatgctttagacattcatt

SEQ ID NO: 961287 - DNA, 25 bp, Mus musculus
ttgtgtgattcgagactagtcttct

SEQ ID NO: 961288 - DNA, 25 bp, Mus musculus
ttgtgtgattcgtgactagtcttct

SEQ ID NO: 961289 - DNA, 25 bp, Mus musculus
ttgtgtgcactaattctttctcatt

SEQ ID NO: 961290 - DNA, 25 bp, Mus musculus
ttgtgtgcactatttctttctcatt

SEQ ID NO: 961291 - DNA, 25 bp, Mus musculus
ttgtgtgcagaaagtgtcttccttc

SEQ ID NO: 961292 - DNA, 25 bp, Mus musculus
ttgtgtgcagaatgtgtcttccttc

SEQ ID NO: 961293 - DNA, 25 bp, Mus musculus
ttgtgtgcatctcaagtaaccttgt

SEQ ID NO: 961294 - DNA, 25 bp, Mus musculus
ttgtgtgcatctgaagtaaccttgt

SEQ ID NO: 961295 - DNA, 25 bp, Mus musculus
ttgtgtgccaccaagggctacaaat

SEQ ID NO: 961296 - DNA, 25 bp, Mus musculus
ttgtgtgccacctagggctacaaat

SEQ ID NO: 961297 - DNA, 25 bp, Mus musculus
ttgtgtgccctactgcctcatgatc

SEQ ID NO: 961298 - DNA, 25 bp, Mus musculus
ttgtgtgccctagtgcctcatgatc

SEQ ID NO: 961299 - DNA, 25 bp, Mus musculus
ttgtgtgccctgaagatttctctgt

SEQ ID NO: 961300 - DNA, 25 bp, Mus musculus
ttgtgtgccctgagaatatttctat

SEQ ID NO: 961301 - DNA, 25 bp, Mus musculus
ttgtgtgccctgcaccttgatagac

SEQ ID NO: 961302 - DNA, 25 bp, Mus musculus
ttgtgtgccctggaccttgatagac

SEQ ID NO: 961303 - DNA, 25 bp, Mus musculus
ttgtgtgccctgtagatttctctgt

SEQ ID NO: 961304 - DNA, 25 bp, Mus musculus
ttgtgtgccctgtgaatatttctat

SEQ ID NO: 961305 - DNA, 25 bp, Mus musculus
ttgtgtgcccttagctggattgtat

SEQ ID NO: 961306 - DNA, 25 bp, Mus musculus
ttgtgtgccctttgctggattgtat

SEQ ID NO: 961307 - DNA, 25 bp, Mus musculus
ttgtgtgccgatattcttccattac

SEQ ID NO: 961308 - DNA, 25 bp, Mus musculus
ttgtgtgccgattttcttccattac

SEQ ID NO: 961309 - DNA, 25 bp, Mus musculus
ttgtgtgccgttactgtccataaat

SEQ ID NO: 961310 - DNA, 25 bp, Mus musculus
ttgtgtgccgtttctgtccataaat

SEQ ID NO: 961311 - DNA, 25 bp, Mus musculus
ttgtgtgctacaattccatgctttc

SEQ ID NO: 961312 - DNA, 25 bp, Mus musculus
ttgtgtgctacatttccatgctttc

SEQ ID NO: 961313 - DNA, 25 bp, Mus musculus
ttgtgtgctacgagtggatcccatg

SEQ ID NO: 961314 - DNA, 25 bp, Mus musculus
ttgtgtgctacgtgtggatcccatg

SEQ ID NO: 961315 - DNA, 25 bp, Mus musculus
ttgtgtgctagacaacactccactc

SEQ ID NO: 961316 - DNA, 25 bp, Mus musculus
ttgtgtgctagagaacactccactc

SEQ ID NO: 961317 - DNA, 25 bp, Mus musculus
ttgtgtgctcacagatgacatgaag

SEQ ID NO: 961318 - DNA, 25 bp, Mus musculus
ttgtgtgctcactgatgacatgaag

SEQ ID NO: 961319 - DNA, 25 bp, Mus musculus
ttgtgtgctcatagctttagtatac

SEQ ID NO: 961320 - DNA, 25 bp, Mus musculus
ttgtgtgctcattgctttagtatac

SEQ ID NO: 961321 - DNA, 25 bp, Mus musculus
ttgtgtgctctactttccatctcaa

SEQ ID NO: 961322 - DNA, 25 bp, Mus musculus
ttgtgtgctctagtttccatctcaa

SEQ ID NO: 961323 - DNA, 25 bp, Mus musculus
ttgtgtgctgttcccgttcaatacc

SEQ ID NO: 961324 - DNA, 25 bp, Mus musculus
ttgtgtgctgttgccgttcaatacc

SEQ ID NO: 961325 - DNA, 25 bp, Mus musculus
ttgtgtgcttctacacctacaactt

SEQ ID NO: 961326 - DNA, 25 bp, Mus musculus
ttgtgtgcttcttcacctacaactt

SEQ ID NO: 961327 - DNA, 25 bp, Mus musculus
ttgtgtggaacgagcatcctggtgt

SEQ ID NO: 961328 - DNA, 25 bp, Mus musculus
ttgtgtggaacgtgcatcctggtgt

SEQ ID NO: 961329 - DNA, 25 bp, Mus musculus
ttgtgtggaatacagaaatcccgga

SEQ ID NO: 961330 - DNA, 25 bp, Mus musculus
ttgtgtggaatagagaaatcccgga

SEQ ID NO: 961331 - DNA, 25 bp, Mus musculus
ttgtgtggagacaatagggttccct

SEQ ID NO: 961332 - DNA, 25 bp, Mus musculus
ttgtgtggagactatagggttccct

SEQ ID NO: 961333 - DNA, 25 bp, Mus musculus
ttgtgtggcacaatcattcctggac

SEQ ID NO: 961334 - DNA, 25 bp, Mus musculus
ttgtgtggcacattcattcctggac

SEQ ID NO: 961335 - DNA, 25 bp, Mus musculus
ttgtgtggcacgagagctggtccat

SEQ ID NO: 961336 - DNA, 25 bp, Mus musculus
ttgtgtggcacgtgagctggtccat

SEQ ID NO: 961337 - DNA, 25 bp, Mus musculus
ttgtgtggcattattagtctgacta

SEQ ID NO: 961338 - DNA, 25 bp, Mus musculus
ttgtgtggcatttttagtctgacta

SEQ ID NO: 961339 - DNA, 25 bp, Mus musculus
ttgtgtggcctaagctgatcttgaa

SEQ ID NO: 961340 - DNA, 25 bp, Mus musculus
ttgtgtggcctatgctgatcttgaa

SEQ ID NO: 961341 - DNA, 25 bp, Mus musculus
ttgtgtggcgctagtgacattggaa

SEQ ID NO: 961342 - DNA, 25 bp, Mus musculus
ttgtgtggcgcttgtgacattggaa

SEQ ID NO: 961343 - DNA, 25 bp, Mus musculus
ttgtgtggctgtctccaagtccttc

SEQ ID NO: 961344 - DNA, 25 bp, Mus musculus
ttgtgtggctgtgtccaagtccttc

SEQ ID NO: 961345 - DNA, 25 bp, Mus musculus
ttgtgtggcttgagttttgttccca

SEQ ID NO: 961346 - DNA, 25 bp, Mus musculus
ttgtgtggcttgctaatcttggccc

SEQ ID NO: 961347 - DNA, 25 bp, Mus musculus
ttgtgtggcttggtaatcttggccc

SEQ ID NO: 961348 - DNA, 25 bp, Mus musculus
ttgtgtggcttgtgttttgttccca

SEQ ID NO: 961349 - DNA, 25 bp, Mus musculus
ttgtgtggtcacagctgtctcttca

SEQ ID NO: 961350 - DNA, 25 bp, Mus musculus
ttgtgtggtcactgctgtctcttca

SEQ ID NO: 961351 - DNA, 25 bp, Mus musculus
ttgtgtggtgagcattataggccct

SEQ ID NO: 961352 - DNA, 25 bp, Mus musculus
ttgtgtggtgaggattataggccct

SEQ ID NO: 961353 - DNA, 25 bp, Mus musculus
ttgtgtggtgatcttctcaaaaaca

SEQ ID NO: 961354 - DNA, 25 bp, Mus musculus
ttgtgtggtgatgttctcaaaaaca

SEQ ID NO: 961355 - DNA, 25 bp, Mus musculus
ttgtgtggtggtcagtcttgtttcc

SEQ ID NO: 961356 - DNA, 25 bp, Mus musculus
ttgtgtggtggtgagtcttgtttcc

SEQ ID NO: 961357 - DNA, 25 bp, Mus musculus
ttgtgtggtgttaggagcccctcct

SEQ ID NO: 961358 - DNA, 25 bp, Mus musculus
ttgtgtggtgtttggagcccctcct

SEQ ID NO: 961359 - DNA, 25 bp, Mus musculus
ttgtgtggttgcctgcttacttcac

SEQ ID NO: 961360 - DNA, 25 bp, Mus musculus
ttgtgtggttgcgtgcttacttcac

SEQ ID NO: 961361 - DNA, 25 bp, Mus musculus
ttgtgtggtttgcttactgcacagc

SEQ ID NO: 961362 - DNA, 25 bp, Mus musculus
ttgtgtggtttggttactgcacagc

SEQ ID NO: 961363 - DNA, 25 bp, Mus musculus
ttgtgtgtaaatcctggctcagcca

SEQ ID NO: 961364 - DNA, 25 bp, Mus musculus
ttgtgtgtaaatgctggctcagcca

SEQ ID NO: 961365 - DNA, 25 bp, Mus musculus
ttgtgtgtaacacgctgagaaggaa

SEQ ID NO: 961366 - DNA, 25 bp, Mus musculus
ttgtgtgtaacaggctgagaaggaa

SEQ ID NO: 961367 - DNA, 25 bp, Mus musculus
ttgtgtgtactgagccacagtgctc

SEQ ID NO: 961368 - DNA, 25 bp, Mus musculus
ttgtgtgtactgtgccacagtgctc

SEQ ID NO: 961369 - DNA, 25 bp, Mus musculus
ttgtgtgtagacatgaggtcgcttg

SEQ ID NO: 961370 - DNA, 25 bp, Mus musculus
ttgtgtgtagacttgaggtcgcttg

SEQ ID NO: 961371 - DNA, 25 bp, Mus musculus
ttgtgtgtatgaatactttgccttc

SEQ ID NO: 961372 - DNA, 25 bp, Mus musculus
ttgtgtgtatgattactttgccttc

SEQ ID NO: 961373 - DNA, 25 bp, Mus musculus
ttgtgtgtcaggcaacatcagattt

SEQ ID NO: 961374 - DNA, 25 bp, Mus musculus
ttgtgtgtcagggaacatcagattt

SEQ ID NO: 961375 - DNA, 25 bp, Mus musculus
ttgtgtgtccatcacccctcgaagg

SEQ ID NO: 961376 - DNA, 25 bp, Mus musculus
ttgtgtgtccatgacccctcgaagg

SEQ ID NO: 961377 - DNA, 25 bp, Mus musculus
ttgtgtgtccccaagaagtagttgt

SEQ ID NO: 961378 - DNA, 25 bp, Mus musculus
ttgtgtgtcccctagaagtagttgt

SEQ ID NO: 961379 - DNA, 25 bp, Mus musculus
ttgtgtgtcgagacctggtctacag

SEQ ID NO: 961380 - DNA, 25 bp, Mus musculus
ttgtgtgtcgagtcctggtctacag

SEQ ID NO: 961381 - DNA, 25 bp, Mus musculus
ttgtgtgtctcacagaatcagccag

SEQ ID NO: 961382 - DNA, 25 bp, Mus musculus
ttgtgtgtctcagagaatcagccag

SEQ ID NO: 961383 - DNA, 25 bp, Mus musculus
ttgtgtgtctcgaaaccagtaggta

SEQ ID NO: 961384 - DNA, 25 bp, Mus musculus
ttgtgtgtctcgtaaccagtaggta

SEQ ID NO: 961385 - DNA, 25 bp, Mus musculus
ttgtgtgtcttgctgatactctgtc

SEQ ID NO: 961386 - DNA, 25 bp, Mus musculus
ttgtgtgtcttggtgatactctgtc

SEQ ID NO: 961387 - DNA, 25 bp, Mus musculus
ttgtgtgtgaaacttcgaccccatg

SEQ ID NO: 961388 - DNA, 25 bp, Mus musculus
ttgtgtgtgaaagttcgaccccatg

SEQ ID NO: 961389 - DNA, 25 bp, Mus musculus
ttgtgtgtgaccagtcctcgtgtgc

SEQ ID NO: 961390 - DNA, 25 bp, Mus musculus
ttgtgtgtgacctgtcctcgtgtgc

SEQ ID NO: 961391 - DNA, 25 bp, Mus musculus
ttgtgtgtgagcaattgcggcagtt

SEQ ID NO: 961392 - DNA, 25 bp, Mus musculus
ttgtgtgtgagcagatgccgccgcc

SEQ ID NO: 961393 - DNA, 25 bp, Mus musculus
ttgtgtgtgagctattgcggcagtt

SEQ ID NO: 961394 - DNA, 25 bp, Mus musculus
ttgtgtgtgagctgatgccgccgcc

SEQ ID NO: 961395 - DNA, 25 bp, Mus musculus
ttgtgtgtgatgctgccttcagaat

SEQ ID NO: 961396 - DNA, 25 bp, Mus musculus
ttgtgtgtgatggtgccttcagaat

SEQ ID NO: 961397 - DNA, 25 bp, Mus musculus
ttgtgtgtgcatcctgggcacgaaa

SEQ ID NO: 961398 - DNA, 25 bp, Mus musculus
ttgtgtgtgcatgctgggcacgaaa

SEQ ID NO: 961399 - DNA, 25 bp, Mus musculus
ttgtgtgtgccaacaagggctctga

SEQ ID NO: 961400 - DNA, 25 bp, Mus musculus
ttgtgtgtgccatcaagggctctga

SEQ ID NO: 961401 - DNA, 25 bp, Mus musculus
ttgtgtgtgggcagccatccttcct

SEQ ID NO: 961402 - DNA, 25 bp, Mus musculus
ttgtgtgtgggctgccatccttcct

SEQ ID NO: 961403 - DNA, 25 bp, Mus musculus
ttgtgtgtgtcaagagccctggcta

SEQ ID NO: 961404 - DNA, 25 bp, Mus musculus
ttgtgtgtgtcatgagccctggcta

SEQ ID NO: 961405 - DNA, 25 bp, Mus musculus
ttgtgtgtgtggattacccgccttc

SEQ ID NO: 961406 - DNA, 25 bp, Mus musculus
ttgtgtgtgtggtttacccgccttc

SEQ ID NO: 961407 - DNA, 25 bp, Mus musculus
ttgtgtgtgtgtacgctcgcacgcc

SEQ ID NO: 961408 - DNA, 25 bp, Mus musculus
ttgtgtgtgtgtcataatttcagtg

SEQ ID NO: 961409 - DNA, 25 bp, Mus musculus
ttgtgtgtgtgtgataatttcagtg

SEQ ID NO: 961410 - DNA, 25 bp, Mus musculus
ttgtgtgtgtgttcgctcgcacgcc

SEQ ID NO: 961411 - DNA, 25 bp, Mus musculus
ttgtgtgtgttgctatcagcttcct

SEQ ID NO: 961412 - DNA, 25 bp, Mus musculus
ttgtgtgtgttggtatcagcttcct

SEQ ID NO: 961413 - DNA, 25 bp, Mus musculus
ttgtgtgttccaagataccctccac

SEQ ID NO: 961414 - DNA, 25 bp, Mus musculus
ttgtgtgttccatgataccctccac

SEQ ID NO: 961415 - DNA, 25 bp, Mus musculus
ttgtgtgttgtaccacaccaactca

SEQ ID NO: 961416 - DNA, 25 bp, Mus musculus
ttgtgtgttgtagcacaccaactca

SEQ ID NO: 961417 - DNA, 25 bp, Mus musculus
ttgtgtgttgtcagtgagcaccctc

SEQ ID NO: 961418 - DNA, 25 bp, Mus musculus
ttgtgtgttgtctgtgagcaccctc

SEQ ID NO: 961419 - DNA, 25 bp, Mus musculus
ttgtgttacacacaccttggaaggt

SEQ ID NO: 961420 - DNA, 25 bp, Mus musculus
ttgtgttacacagaccttggaaggt

SEQ ID NO: 961421 - DNA, 25 bp, Mus musculus
ttgtgttactggatgccaaggctcc

SEQ ID NO: 961422 - DNA, 25 bp, Mus musculus
ttgtgttactggttgccaaggctcc

SEQ ID NO: 961423 - DNA, 25 bp, Mus musculus
ttgtgttacttcactccattttccc

SEQ ID NO: 961424 - DNA, 25 bp, Mus musculus
ttgtgttacttctctccattttccc

SEQ ID NO: 961425 - DNA, 25 bp, Mus musculus
ttgtgttagctgcaacccacagatt

SEQ ID NO: 961426 - DNA, 25 bp, Mus musculus
ttgtgttagctggaacccacagatt

SEQ ID NO: 961427 - DNA, 25 bp, Mus musculus
ttgtgttatttcacagctatggata

SEQ ID NO: 961428 - DNA, 25 bp, Mus musculus
ttgtgttatttctcagctatggata

SEQ ID NO: 961429 - DNA, 25 bp, Mus musculus
ttgtgttcagctctagcttaatgaa

SEQ ID NO: 961430 - DNA, 25 bp, Mus musculus
ttgtgttcagctgtagcttaatgaa

SEQ ID NO: 961431 - DNA, 25 bp, Mus musculus
ttgtgttcatacagagagcaagtct

SEQ ID NO: 961432 - DNA, 25 bp, Mus musculus
ttgtgttcatactgagagcaagtct

SEQ ID NO: 961433 - DNA, 25 bp, Mus musculus
ttgtgttcatggagcccttaggccc

SEQ ID NO: 961434 - DNA, 25 bp, Mus musculus
ttgtgttcatggagtgtgctcccaa

SEQ ID NO: 961435 - DNA, 25 bp, Mus musculus
ttgtgttcatggtgcccttaggccc

SEQ ID NO: 961436 - DNA, 25 bp, Mus musculus
ttgtgttcatggtgtgtgctcccaa

SEQ ID NO: 961437 - DNA, 25 bp, Mus musculus
ttgtgttccacaccagagtgatcat

SEQ ID NO: 961438 - DNA, 25 bp, Mus musculus
ttgtgttccacagcagagtgatcat

SEQ ID NO: 961439 - DNA, 25 bp, Mus musculus
ttgtgttccactcacccaattagct

SEQ ID NO: 961440 - DNA, 25 bp, Mus musculus
ttgtgttccactgacccaattagct

SEQ ID NO: 961441 - DNA, 25 bp, Mus musculus
ttgtgttcccaacgtcctaagaaat

SEQ ID NO: 961442 - DNA, 25 bp, Mus musculus
ttgtgttcccaaggtcctaagaaat

SEQ ID NO: 961443 - DNA, 25 bp, Mus musculus
ttgtgttcctctcagcaatgcaaga

SEQ ID NO: 961444 - DNA, 25 bp, Mus musculus
ttgtgttcctctgagcaatgcaaga

SEQ ID NO: 961445 - DNA, 25 bp, Mus musculus
ttgtgttccttgaatgctgacgtgt

SEQ ID NO: 961446 - DNA, 25 bp, Mus musculus
ttgtgttccttgtatgctgacgtgt

SEQ ID NO: 961447 - DNA, 25 bp, Mus musculus
ttgtgttcctttaaaatgaggcaac

SEQ ID NO: 961448 - DNA, 25 bp, Mus musculus
ttgtgttccttttaaatgaggcaac

SEQ ID NO: 961449 - DNA, 25 bp, Mus musculus
ttgtgttcgataccattggactgat

SEQ ID NO: 961450 - DNA, 25 bp, Mus musculus
ttgtgttcgatagcattggactgat

SEQ ID NO: 961451 - DNA, 25 bp, Mus musculus
ttgtgttctatacttgtgtttctga

SEQ ID NO: 961452 - DNA, 25 bp, Mus musculus
ttgtgttctatagttgtgtttctga

SEQ ID NO: 961453 - DNA, 25 bp, Mus musculus
ttgtgttctatgctctatactttta

SEQ ID NO: 961454 - DNA, 25 bp, Mus musculus
ttgtgttctatggtctatactttta

SEQ ID NO: 961455 - DNA, 25 bp, Mus musculus
ttgtgttctcacatgcataaagcta

SEQ ID NO: 961456 - DNA, 25 bp, Mus musculus
ttgtgttctcacttgcataaagcta

SEQ ID NO: 961457 - DNA, 25 bp, Mus musculus
ttgtgttctcagcacttctggagta

SEQ ID NO: 961458 - DNA, 25 bp, Mus musculus
ttgtgttctcaggacttctggagta

SEQ ID NO: 961459 - DNA, 25 bp, Mus musculus
ttgtgttctgaacaacccctaccat

SEQ ID NO: 961460 - DNA, 25 bp, Mus musculus
ttgtgttctgaagaacccctaccat

SEQ ID NO: 961461 - DNA, 25 bp, Mus musculus
ttgtgttctgctctcttcattttac

SEQ ID NO: 961462 - DNA, 25 bp, Mus musculus
ttgtgttctgctgtcttcattttac

SEQ ID NO: 961463 - DNA, 25 bp, Mus musculus
ttgtgttctgttctcagggtgcccc

SEQ ID NO: 961464 - DNA, 25 bp, Mus musculus
ttgtgttctgttgtcagggtgcccc

SEQ ID NO: 961465 - DNA, 25 bp, Mus musculus
ttgtgttctttgaccttaagttctc

SEQ ID NO: 961466 - DNA, 25 bp, Mus musculus
ttgtgttctttgtccttaagttctc

SEQ ID NO: 961467 - DNA, 25 bp, Mus musculus
ttgtgttgatttctacctgtagcct

SEQ ID NO: 961468 - DNA, 25 bp, Mus musculus
ttgtgttgatttgtacctgtagcct

SEQ ID NO: 961469 - DNA, 25 bp, Mus musculus
ttgtgttgccatctcttatgttgta

SEQ ID NO: 961470 - DNA, 25 bp, Mus musculus
ttgtgttgccatgtcttatgttgta

SEQ ID NO: 961471 - DNA, 25 bp, Mus musculus
ttgtgttgtaacatgcaggctcgag

SEQ ID NO: 961472 - DNA, 25 bp, Mus musculus
ttgtgttgtaacttgcaggctcgag

SEQ ID NO: 961473 - DNA, 25 bp, Mus musculus
ttgtgttgtgccaacctaagttcat

SEQ ID NO: 961474 - DNA, 25 bp, Mus musculus
ttgtgttgtgcctacctaagttcat

SEQ ID NO: 961475 - DNA, 25 bp, Mus musculus
ttgtgttgtgctccgtgctgaatgc

SEQ ID NO: 961476 - DNA, 25 bp, Mus musculus
ttgtgttgtgctgcgtgctgaatgc

SEQ ID NO: 961477 - DNA, 25 bp, Mus musculus
ttgtgttgtgttcccagccaaggct

SEQ ID NO: 961478 - DNA, 25 bp, Mus musculus
ttgtgttgtgttgccagccaaggct

SEQ ID NO: 961479 - DNA, 25 bp, Mus musculus
ttgtgtttaaagctgggagcccact

SEQ ID NO: 961480 - DNA, 25 bp, Mus musculus
ttgtgtttaaaggtgggagcccact

SEQ ID NO: 961481 - DNA, 25 bp, Mus musculus
ttgtgtttatttaccctgtctctaa

SEQ ID NO: 961482 - DNA, 25 bp, Mus musculus
ttgtgtttattttccctgtctctaa

SEQ ID NO: 961483 - DNA, 25 bp, Mus musculus
ttgtgtttccctccctgtaagaagg

SEQ ID NO: 961484 - DNA, 25 bp, Mus musculus
ttgtgtttccctgcctgtaagaagg

SEQ ID NO: 961485 - DNA, 25 bp, Mus musculus
ttgtgtttccttctgtttgctaatt

SEQ ID NO: 961486 - DNA, 25 bp, Mus musculus
ttgtgtttccttgtgtttgctaatt

SEQ ID NO: 961487 - DNA, 25 bp, Mus musculus
ttgtgtttctagaatggtgcctgtg

SEQ ID NO: 961488 - DNA, 25 bp, Mus musculus
ttgtgtttctagtatggtgcctgtg

SEQ ID NO: 961489 - DNA, 25 bp, Mus musculus
ttgtgtttctccaaagccttatggg

SEQ ID NO: 961490 - DNA, 25 bp, Mus musculus
ttgtgtttctcctaagccttatggg

SEQ ID NO: 961491 - DNA, 25 bp, Mus musculus
ttgtgtttctctaaaagggtcttct

SEQ ID NO: 961492 - DNA, 25 bp, Mus musculus
ttgtgtttctcttaaagggtcttct

SEQ ID NO: 961493 - DNA, 25 bp, Mus musculus
ttgtgtttctgtagtgggaactcag

SEQ ID NO: 961494 - DNA, 25 bp, Mus musculus
ttgtgtttctgttgtgggaactcag

SEQ ID NO: 961495 - DNA, 25 bp, Mus musculus
ttgtgtttgcatagttaatccggaa

SEQ ID NO: 961496 - DNA, 25 bp, Mus musculus
ttgtgtttgcatatcagcaagtgac

SEQ ID NO: 961497 - DNA, 25 bp, Mus musculus
ttgtgtttgcattgttaatccggaa

SEQ ID NO: 961498 - DNA, 25 bp, Mus musculus
ttgtgtttgcatttcagcaagtgac

SEQ ID NO: 961499 - DNA, 25 bp, Mus musculus
ttgtgtttgggccagcttaggacct

SEQ ID NO: 961500 - DNA, 25 bp, Mus musculus
ttgtgtttgggcgagcttaggacct

SEQ ID NO: 961501 - DNA, 25 bp, Mus musculus
ttgtgtttgtctaaccaaccttcct

SEQ ID NO: 961502 - DNA, 25 bp, Mus musculus
ttgtgtttgtcttaccaaccttcct

SEQ ID NO: 961503 - DNA, 25 bp, Mus musculus
ttgtgtttgtgtaattgctttttgc

SEQ ID NO: 961504 - DNA, 25 bp, Mus musculus
ttgtgtttgtgttattgctttttgc

SEQ ID NO: 961505 - DNA, 25 bp, Mus musculus
ttgtgttttacaatctagcgatgct

SEQ ID NO: 961506 - DNA, 25 bp, Mus musculus
ttgtgttttacattctagcgatgct

SEQ ID NO: 961507 - DNA, 25 bp, Mus musculus
ttgtgttttattagccggaagaggt

SEQ ID NO: 961508 - DNA, 25 bp, Mus musculus
ttgtgttttattcctggagcgcaat

SEQ ID NO: 961509 - DNA, 25 bp, Mus musculus
ttgtgttttattgctggagcgcaat

SEQ ID NO: 961510 - DNA, 25 bp, Mus musculus
ttgtgttttatttgccggaagaggt

SEQ ID NO: 961511 - DNA, 25 bp, Mus musculus
ttgtgttttgataatggcctagatt

SEQ ID NO: 961512 - DNA, 25 bp, Mus musculus
ttgtgttttgattatggcctagatt

SEQ ID NO: 961513 - DNA, 25 bp, Mus musculus
ttgtgttttgtcagtagccttgtca

SEQ ID NO: 961514 - DNA, 25 bp, Mus musculus
ttgtgttttgtctgtagccttgtca

SEQ ID NO: 961515 - DNA, 25 bp, Mus musculus
ttgtgttttttactcggcctataat

SEQ ID NO: 961516 - DNA, 25 bp, Mus musculus
ttgtgttttttagtcggcctataat

SEQ ID NO: 961517 - DNA, 25 bp, Mus musculus
ttgttaaaatcccagacacctcact

SEQ ID NO: 961518 - DNA, 25 bp, Mus musculus
ttgttaaaatccgagacacctcact

SEQ ID NO: 961519 - DNA, 25 bp, Mus musculus
ttgttaaaatgcacgttgtagccag

SEQ ID NO: 961520 - DNA, 25 bp, Mus musculus
ttgttaaaatgctcgttgtagccag

SEQ ID NO: 961521 - DNA, 25 bp, Mus musculus
ttgttaaacccgaactgacctctag

SEQ ID NO: 961522 - DNA, 25 bp, Mus musculus
ttgttaaacccgtactgacctctag

SEQ ID NO: 961523 - DNA, 25 bp, Mus musculus
ttgttaaagccactagctctgcacc

SEQ ID NO: 961524 - DNA, 25 bp, Mus musculus
ttgttaaagccagtagctctgcacc

SEQ ID NO: 961525 - DNA, 25 bp, Mus musculus
ttgttaaaggagctgccagtgctgc

SEQ ID NO: 961526 - DNA, 25 bp, Mus musculus
ttgttaaaggaggtgccagtgctgc

SEQ ID NO: 961527 - DNA, 25 bp, Mus musculus
ttgttaaatctgctgaaaggcctgt

SEQ ID NO: 961528 - DNA, 25 bp, Mus musculus
ttgttaaatctggtgaaaggcctgt

SEQ ID NO: 961529 - DNA, 25 bp, Mus musculus
ttgttaaatttcatgccgtgcatgc

SEQ ID NO: 961530 - DNA, 25 bp, Mus musculus
ttgttaaatttcttgccgtgcatgc

SEQ ID NO: 961531 - DNA, 25 bp, Mus musculus
ttgttaacacagcacttgggcatct

SEQ ID NO: 961532 - DNA, 25 bp, Mus musculus
ttgttaacacaggacttgggcatct

SEQ ID NO: 961533 - DNA, 25 bp, Mus musculus
ttgttaacagttctcacatgtcaag

SEQ ID NO: 961534 - DNA, 25 bp, Mus musculus
ttgttaacagttgtcacatgtcaag

SEQ ID NO: 961535 - DNA, 25 bp, Mus musculus
ttgttaacatcacttccgggctatt

SEQ ID NO: 961536 - DNA, 25 bp, Mus musculus
ttgttaacatcagttccgggctatt

SEQ ID NO: 961537 - DNA, 25 bp, Mus musculus
ttgttaacattgaccttctaaggca

SEQ ID NO: 961538 - DNA, 25 bp, Mus musculus
ttgttaacattgtccttctaaggca

SEQ ID NO: 961539 - DNA, 25 bp, Mus musculus
ttgttaactacaagcaccgtgtgca

SEQ ID NO: 961540 - DNA, 25 bp, Mus musculus
ttgttaactacatgcaccgtgtgca

SEQ ID NO: 961541 - DNA, 25 bp, Mus musculus
ttgttaacttgcctgttgccgcaat

SEQ ID NO: 961542 - DNA, 25 bp, Mus musculus
ttgttaacttgcgtgttgccgcaat

SEQ ID NO: 961543 - DNA, 25 bp, Mus musculus
ttgttaacttttaatgatcatcaaa

SEQ ID NO: 961544 - DNA, 25 bp, Mus musculus
ttgttaactttttatgatcatcaaa

SEQ ID NO: 961545 - DNA, 25 bp, Mus musculus
ttgttaagccttatggtcatgacag

SEQ ID NO: 961546 - DNA, 25 bp, Mus musculus
ttgttaagccttttggtcatgacag

SEQ ID NO: 961547 - DNA, 25 bp, Mus musculus
ttgttaagctctatactgtggtcta

SEQ ID NO: 961548 - DNA, 25 bp, Mus musculus
ttgttaagctctttactgtggtcta

SEQ ID NO: 961549 - DNA, 25 bp, Mus musculus
ttgttaaggaagacagcccactgtg

SEQ ID NO: 961550 - DNA, 25 bp, Mus musculus
ttgttaaggaagtcagcccactgtg

SEQ ID NO: 961551 - DNA, 25 bp, Mus musculus
ttgttaagtgctccttaataagctt

SEQ ID NO: 961552 - DNA, 25 bp, Mus musculus
ttgttaagtgctgcttaataagctt

SEQ ID NO: 961553 - DNA, 25 bp, Mus musculus
ttgttaatagtacgcatttttgcac

SEQ ID NO: 961554 - DNA, 25 bp, Mus musculus
ttgttaatagtaggcatttttgcac

SEQ ID NO: 961555 - DNA, 25 bp, Mus musculus
ttgttaatcattctcagctgcagtg

SEQ ID NO: 961556 - DNA, 25 bp, Mus musculus
ttgttaatcattgtcagctgcagtg

SEQ ID NO: 961557 - DNA, 25 bp, Mus musculus
ttgttaatccttatcagaattcctg

SEQ ID NO: 961558 - DNA, 25 bp, Mus musculus
ttgttaatccttttcagaattcctg

SEQ ID NO: 961559 - DNA, 25 bp, Mus musculus
ttgttaattccccagcaacttaggt

SEQ ID NO: 961560 - DNA, 25 bp, Mus musculus
ttgttaattcccgagcaacttaggt

SEQ ID NO: 961561 - DNA, 25 bp, Mus musculus
ttgttacacatcaagcaatcaataa

SEQ ID NO: 961562 - DNA, 25 bp, Mus musculus
ttgttacacatctagcaatcaataa

SEQ ID NO: 961563 - DNA, 25 bp, Mus musculus
ttgttacagaaacccactgccgttt

SEQ ID NO: 961564 - DNA, 25 bp, Mus musculus
ttgttacagaaagccactgccgttt

SEQ ID NO: 961565 - DNA, 25 bp, Mus musculus
ttgttacagagaccgtcactcgcca

SEQ ID NO: 961566 - DNA, 25 bp, Mus musculus
ttgttacagagagcgtcactcgcca

SEQ ID NO: 961567 - DNA, 25 bp, Mus musculus
ttgttacagatcaattcaaatgttt

SEQ ID NO: 961568 - DNA, 25 bp, Mus musculus
ttgttacagatctattcaaatgttt

SEQ ID NO: 961569 - DNA, 25 bp, Mus musculus
ttgttaccaggtatctacactcact

SEQ ID NO: 961570 - DNA, 25 bp, Mus musculus
ttgttaccaggtttctacactcact

SEQ ID NO: 961571 - DNA, 25 bp, Mus musculus
ttgttacccaggcttctcctttgca

SEQ ID NO: 961572 - DNA, 25 bp, Mus musculus
ttgttacccagggttctcctttgca

SEQ ID NO: 961573 - DNA, 25 bp, Mus musculus
ttgttacccattcctttttcctcag

SEQ ID NO: 961574 - DNA, 25 bp, Mus musculus
ttgttacccattgctttttcctcag

SEQ ID NO: 961575 - DNA, 25 bp, Mus musculus
ttgttaccctgacgtatactccctg

SEQ ID NO: 961576 - DNA, 25 bp, Mus musculus
ttgttaccctgaggtatactccctg

SEQ ID NO: 961577 - DNA, 25 bp, Mus musculus
ttgttaccgattcgcctctgagact

SEQ ID NO: 961578 - DNA, 25 bp, Mus musculus
ttgttaccgattggcctctgagact

SEQ ID NO: 961579 - DNA, 25 bp, Mus musculus
ttgttacctaggaacgcactgtgcc

SEQ ID NO: 961580 - DNA, 25 bp, Mus musculus
ttgttacctaggtacgcactgtgcc

SEQ ID NO: 961581 - DNA, 25 bp, Mus musculus
ttgttacctttgacttcccgagttg

SEQ ID NO: 961582 - DNA, 25 bp, Mus musculus
ttgttacctttgtcttcccgagttg

SEQ ID NO: 961583 - DNA, 25 bp, Mus musculus
ttgttacggttgattctggcttaat

SEQ ID NO: 961584 - DNA, 25 bp, Mus musculus
ttgttacggttgtttctggcttaat

SEQ ID NO: 961585 - DNA, 25 bp, Mus musculus
ttgttacgtctaagggaactgaagt

SEQ ID NO: 961586 - DNA, 25 bp, Mus musculus
ttgttacgtctatgggaactgaagt

SEQ ID NO: 961587 - DNA, 25 bp, Mus musculus
ttgttacgtgataaccgcgagttaa

SEQ ID NO: 961588 - DNA, 25 bp, Mus musculus
ttgttacgtgattaccgcgagttaa

SEQ ID NO: 961589 - DNA, 25 bp, Mus musculus
ttgttactaagcagttccaccctta

SEQ ID NO: 961590 - DNA, 25 bp, Mus musculus
ttgttactaagctgttccaccctta

SEQ ID NO: 961591 - DNA, 25 bp, Mus musculus
ttgttactatctaattcctcctatg

SEQ ID NO: 961592 - DNA, 25 bp, Mus musculus
ttgttactatcttattcctcctatg

SEQ ID NO: 961593 - DNA, 25 bp, Mus musculus
ttgttactcaagacacatcagctgt

SEQ ID NO: 961594 - DNA, 25 bp, Mus musculus
ttgttactcaagtcacatcagctgt

SEQ ID NO: 961595 - DNA, 25 bp, Mus musculus
ttgttactcactctgttcggccgtt

SEQ ID NO: 961596 - DNA, 25 bp, Mus musculus
ttgttactcactgtgttcggccgtt

SEQ ID NO: 961597 - DNA, 25 bp, Mus musculus
ttgttactccctctgacaagaattt

SEQ ID NO: 961598 - DNA, 25 bp, Mus musculus
ttgttactccctgtgacaagaattt

SEQ ID NO: 961599 - DNA, 25 bp, Mus musculus
ttgttactcctcctgtcctgcaaca

SEQ ID NO: 961600 - DNA, 25 bp, Mus musculus
ttgttactcctcgtgtcctgcaaca

SEQ ID NO: 961601 - DNA, 25 bp, Mus musculus
ttgttactgctgaatgctccccacc

SEQ ID NO: 961602 - DNA, 25 bp, Mus musculus
ttgttactgctgtatgctccccacc

SEQ ID NO: 961603 - DNA, 25 bp, Mus musculus
ttgttacttcacatctcttttaatc

SEQ ID NO: 961604 - DNA, 25 bp, Mus musculus
ttgttacttcacttctcttttaatc

SEQ ID NO: 961605 - DNA, 25 bp, Mus musculus
ttgttacttggaagagagcacctga

SEQ ID NO: 961606 - DNA, 25 bp, Mus musculus
ttgttacttggatgagagcacctga

SEQ ID NO: 961607 - DNA, 25 bp, Mus musculus
ttgttactttccacttctcaataaa

SEQ ID NO: 961608 - DNA, 25 bp, Mus musculus
ttgttactttcctcttctcaataaa

SEQ ID NO: 961609 - DNA, 25 bp, Mus musculus
ttgttagaagctctcttgcctttac

SEQ ID NO: 961610 - DNA, 25 bp, Mus musculus
ttgttagaagctgtcttgcctttac

SEQ ID NO: 961611 - DNA, 25 bp, Mus musculus
ttgttagacaagagcctcctggtgc

SEQ ID NO: 961612 - DNA, 25 bp, Mus musculus
ttgttagacaagtgcctcctggtgc

SEQ ID NO: 961613 - DNA, 25 bp, Mus musculus
ttgttagagtgcaaacgtcgcctgc

SEQ ID NO: 961614 - DNA, 25 bp, Mus musculus
ttgttagagtgctaacgtcgcctgc

SEQ ID NO: 961615 - DNA, 25 bp, Mus musculus
ttgttagagttcagagcacagcatc

SEQ ID NO: 961616 - DNA, 25 bp, Mus musculus
ttgttagagttctgagcacagcatc

SEQ ID NO: 961617 - DNA, 25 bp, Mus musculus
ttgttagatcctagagtctctgaac

SEQ ID NO: 961618 - DNA, 25 bp, Mus musculus
ttgttagatccttgagtctctgaac

SEQ ID NO: 961619 - DNA, 25 bp, Mus musculus
ttgttagatctacttcattctccac

SEQ ID NO: 961620 - DNA, 25 bp, Mus musculus
ttgttagatctagttcattctccac

SEQ ID NO: 961621 - DNA, 25 bp, Mus musculus
ttgttagattcacaggcccatttag

SEQ ID NO: 961622 - DNA, 25 bp, Mus musculus
ttgttagattcagaggcccatttag

SEQ ID NO: 961623 - DNA, 25 bp, Mus musculus
ttgttagcaacgctgccttcatctt

SEQ ID NO: 961624 - DNA, 25 bp, Mus musculus
ttgttagcaacggtgccttcatctt

SEQ ID NO: 961625 - DNA, 25 bp, Mus musculus
ttgttagcatccaagaagcaccctc

SEQ ID NO: 961626 - DNA, 25 bp, Mus musculus
ttgttagcatcctagaagcaccctc

SEQ ID NO: 961627 - DNA, 25 bp, Mus musculus
ttgttagccaaactgttctgtttat

SEQ ID NO: 961628 - DNA, 25 bp, Mus musculus
ttgttagccaaagtgttctgtttat

SEQ ID NO: 961629 - DNA, 25 bp, Mus musculus
ttgttagctcttaggcaattctcct

SEQ ID NO: 961630 - DNA, 25 bp, Mus musculus
ttgttagctctttggcaattctcct

SEQ ID NO: 961631 - DNA, 25 bp, Mus musculus
ttgttagctgtcctaagtaccccag

SEQ ID NO: 961632 - DNA, 25 bp, Mus musculus
ttgttagctgtcgtaagtaccccag

SEQ ID NO: 961633 - DNA, 25 bp, Mus musculus
ttgttagcttccagggttcccatga

SEQ ID NO: 961634 - DNA, 25 bp, Mus musculus
ttgttagcttcctgggttcccatga

SEQ ID NO: 961635 - DNA, 25 bp, Mus musculus
ttgttaggccaaccattcatgcccc

SEQ ID NO: 961636 - DNA, 25 bp, Mus musculus
ttgttaggccaagcattcatgcccc

SEQ ID NO: 961637 - DNA, 25 bp, Mus musculus
ttgttaggttggcttttctatatga

SEQ ID NO: 961638 - DNA, 25 bp, Mus musculus
ttgttaggttgggttttctatatga

SEQ ID NO: 961639 - DNA, 25 bp, Mus musculus
ttgttataaaaacccacctatccag

SEQ ID NO: 961640 - DNA, 25 bp, Mus musculus
ttgttataaaaagccacctatccag

SEQ ID NO: 961641 - DNA, 25 bp, Mus musculus
ttgttatagaagatgtccagtgtac

SEQ ID NO: 961642 - DNA, 25 bp, Mus musculus
ttgttatagaagttgtccagtgtac

SEQ ID NO: 961643 - DNA, 25 bp, Mus musculus
ttgttatatattactcccgacccta

SEQ ID NO: 961644 - DNA, 25 bp, Mus musculus
ttgttatatatttctcccgacccta

SEQ ID NO: 961645 - DNA, 25 bp, Mus musculus
ttgttatatttaactcattttcgtg

SEQ ID NO: 961646 - DNA, 25 bp, Mus musculus
ttgttatatttatctcattttcgtg

SEQ ID NO: 961647 - DNA, 25 bp, Mus musculus
ttgttatcatctagagctgagggtt

SEQ ID NO: 961648 - DNA, 25 bp, Mus musculus
ttgttatcatcttgagctgagggtt

SEQ ID NO: 961649 - DNA, 25 bp, Mus musculus
ttgttatccaccattacgcagacac

SEQ ID NO: 961650 - DNA, 25 bp, Mus musculus
ttgttatccacctttacgcagacac

SEQ ID NO: 961651 - DNA, 25 bp, Mus musculus
ttgttatcgcctatgtcctttgcag

SEQ ID NO: 961652 - DNA, 25 bp, Mus musculus
ttgttatcgcctttgtcctttgcag

SEQ ID NO: 961653 - DNA, 25 bp, Mus musculus
ttgttatcgctgctgccaccttggt

SEQ ID NO: 961654 - DNA, 25 bp, Mus musculus
ttgttatcgctggtgccaccttggt

SEQ ID NO: 961655 - DNA, 25 bp, Mus musculus
ttgttatctccccaatgaaagctga

SEQ ID NO: 961656 - DNA, 25 bp, Mus musculus
ttgttatctcccgaatgaaagctga

SEQ ID NO: 961657 - DNA, 25 bp, Mus musculus
ttgttatgaaacctccacaggtcgt

SEQ ID NO: 961658 - DNA, 25 bp, Mus musculus
ttgttatgaaacgtccacaggtcgt

SEQ ID NO: 961659 - DNA, 25 bp, Mus musculus
ttgttatgaagtatgctgttctggc

SEQ ID NO: 961660 - DNA, 25 bp, Mus musculus
ttgttatgaagtttgctgttctggc

SEQ ID NO: 961661 - DNA, 25 bp, Mus musculus
ttgttatgacatctctttcttcctg

SEQ ID NO: 961662 - DNA, 25 bp, Mus musculus
ttgttatgacatgtctttcttcctg

SEQ ID NO: 961663 - DNA, 25 bp, Mus musculus
ttgttatgcgccacaaaagagccaa

SEQ ID NO: 961664 - DNA, 25 bp, Mus musculus
ttgttatgcgcctcaaaagagccaa

SEQ ID NO: 961665 - DNA, 25 bp, Mus musculus
ttgttatgggcgacacagagagatc

SEQ ID NO: 961666 - DNA, 25 bp, Mus musculus
ttgttatgggcgtcacagagagatc

SEQ ID NO: 961667 - DNA, 25 bp, Mus musculus
ttgttatggtctatccaaagaaact

SEQ ID NO: 961668 - DNA, 25 bp, Mus musculus
ttgttatggtctttccaaagaaact

SEQ ID NO: 961669 - DNA, 25 bp, Mus musculus
ttgttatgttgtccaattccccgga

SEQ ID NO: 961670 - DNA, 25 bp, Mus musculus
ttgttatgttgtgcaattccccgga

SEQ ID NO: 961671 - DNA, 25 bp, Mus musculus
ttgttatgttttagtgcctggctga

SEQ ID NO: 961672 - DNA, 25 bp, Mus musculus
ttgttatgtttttgtgcctggctga

SEQ ID NO: 961673 - DNA, 25 bp, Mus musculus
ttgttattaacgattttgcatgatg

SEQ ID NO: 961674 - DNA, 25 bp, Mus musculus
ttgttattaacgtttttgcatgatg

SEQ ID NO: 961675 - DNA, 25 bp, Mus musculus
ttgttattaatcctagaactagctt

SEQ ID NO: 961676 - DNA, 25 bp, Mus musculus
ttgttattaatcgtagaactagctt

SEQ ID NO: 961677 - DNA, 25 bp, Mus musculus
ttgttattactcatttgcggcacca

SEQ ID NO: 961678 - DNA, 25 bp, Mus musculus
ttgttattactcttttgcggcacca

SEQ ID NO: 961679 - DNA, 25 bp, Mus musculus
ttgttattctctagaatggctccag

SEQ ID NO: 961680 - DNA, 25 bp, Mus musculus
ttgttattctcttgaatggctccag

SEQ ID NO: 961681 - DNA, 25 bp, Mus musculus
ttgttatttattagcagtgtcaagt

SEQ ID NO: 961682 - DNA, 25 bp, Mus musculus
ttgttatttatttgcagtgtcaagt

SEQ ID NO: 961683 - DNA, 25 bp, Mus musculus
ttgttatttctacttaagggaccag

SEQ ID NO: 961684 - DNA, 25 bp, Mus musculus
ttgttatttctagttaagggaccag

SEQ ID NO: 961685 - DNA, 25 bp, Mus musculus
ttgttcaaataaataggcattctgt

SEQ ID NO: 961686 - DNA, 25 bp, Mus musculus
ttgttcaaataattaggcattctgt

SEQ ID NO: 961687 - DNA, 25 bp, Mus musculus
ttgttcaaatccctatgatgctgta

SEQ ID NO: 961688 - DNA, 25 bp, Mus musculus
ttgttcaaatccgtatgatgctgta

SEQ ID NO: 961689 - DNA, 25 bp, Mus musculus
ttgttcaacaggagactcactgcct

SEQ ID NO: 961690 - DNA, 25 bp, Mus musculus
ttgttcaacaggtgactcactgcct

SEQ ID NO: 961691 - DNA, 25 bp, Mus musculus
ttgttcaacatcacctagtcatcag

SEQ ID NO: 961692 - DNA, 25 bp, Mus musculus
ttgttcaacatctcctagtcatcag

SEQ ID NO: 961693 - DNA, 25 bp, Mus musculus
ttgttcaagtataggcataccgggt

SEQ ID NO: 961694 - DNA, 25 bp, Mus musculus
ttgttcaagtattggcataccgggt

SEQ ID NO: 961695 - DNA, 25 bp, Mus musculus
ttgttcacacacagacccattagga

SEQ ID NO: 961696 - DNA, 25 bp, Mus musculus
ttgttcacacactgacccattagga

SEQ ID NO: 961697 - DNA, 25 bp, Mus musculus
ttgttcacacccacagaccatcaag

SEQ ID NO: 961698 - DNA, 25 bp, Mus musculus
ttgttcacaccctcagaccatcaag

SEQ ID NO: 961699 - DNA, 25 bp, Mus musculus
ttgttcacactcagtattcacgctt

SEQ ID NO: 961700 - DNA, 25 bp, Mus musculus
ttgttcacactctgtattcacgctt

SEQ ID NO: 961701 - DNA, 25 bp, Mus musculus
ttgttcacaggaagtagtcctcccc

SEQ ID NO: 961702 - DNA, 25 bp, Mus musculus
ttgttcacaggatgtagtcctcccc

SEQ ID NO: 961703 - DNA, 25 bp, Mus musculus
ttgttcacagtgctccaggttccat

SEQ ID NO: 961704 - DNA, 25 bp, Mus musculus
ttgttcacagtggtccaggttccat

SEQ ID NO: 961705 - DNA, 25 bp, Mus musculus
ttgttcacatgcctcaacactttct

SEQ ID NO: 961706 - DNA, 25 bp, Mus musculus
ttgttcacatgcgtcaacactttct

SEQ ID NO: 961707 - DNA, 25 bp, Mus musculus
ttgttcacattcatgtttctctgtt

SEQ ID NO: 961708 - DNA, 25 bp, Mus musculus
ttgttcacattcttgtttctctgtt

SEQ ID NO: 961709 - DNA, 25 bp, Mus musculus
ttgttcaccttgcttttccgatgat

SEQ ID NO: 961710 - DNA, 25 bp, Mus musculus
ttgttcaccttggttttccgatgat

SEQ ID NO: 961711 - DNA, 25 bp, Mus musculus
ttgttcactctgacaaatccctcag

SEQ ID NO: 961712 - DNA, 25 bp, Mus musculus
ttgttcactctgtcaaatccctcag

SEQ ID NO: 961713 - DNA, 25 bp, Mus musculus
ttgttcacttcccagcctggaggat

SEQ ID NO: 961714 - DNA, 25 bp, Mus musculus
ttgttcacttccgagcctggaggat

SEQ ID NO: 961715 - DNA, 25 bp, Mus musculus
ttgttcagagccctgtctctgtgac

SEQ ID NO: 961716 - DNA, 25 bp, Mus musculus
ttgttcagagccgtgtctctgtgac

SEQ ID NO: 961717 - DNA, 25 bp, Mus musculus
ttgttcagatataccctgcagcgaa

SEQ ID NO: 961718 - DNA, 25 bp, Mus musculus
ttgttcagatattccctgcagcgaa

SEQ ID NO: 961719 - DNA, 25 bp, Mus musculus
ttgttcagccttcttgcataccaac

SEQ ID NO: 961720 - DNA, 25 bp, Mus musculus
ttgttcagccttgttgcataccaac

SEQ ID NO: 961721 - DNA, 25 bp, Mus musculus
ttgttcagggcaacatgtgggacat

SEQ ID NO: 961722 - DNA, 25 bp, Mus musculus
ttgttcagggcatcatgtgggacat

SEQ ID NO: 961723 - DNA, 25 bp, Mus musculus
ttgttcagtcgaagcttagacttgt

SEQ ID NO: 961724 - DNA, 25 bp, Mus musculus
ttgttcagtcgatgcttagacttgt

SEQ ID NO: 961725 - DNA, 25 bp, Mus musculus
ttgttcagtggtaaaggcatgtagt

SEQ ID NO: 961726 - DNA, 25 bp, Mus musculus
ttgttcagtggttaaggcatgtagt

SEQ ID NO: 961727 - DNA, 25 bp, Mus musculus
ttgttcagtgttcctctcacttcag

SEQ ID NO: 961728 - DNA, 25 bp, Mus musculus
ttgttcagtgttgctctcacttcag

SEQ ID NO: 961729 - DNA, 25 bp, Mus musculus
ttgttcatatggctcatgccctgaa

SEQ ID NO: 961730 - DNA, 25 bp, Mus musculus
ttgttcatatgggtcatgccctgaa

SEQ ID NO: 961731 - DNA, 25 bp, Mus musculus
ttgttcatattcatttgcattcctg

SEQ ID NO: 961732 - DNA, 25 bp, Mus musculus
ttgttcatattcttttgcattcctg

SEQ ID NO: 961733 - DNA, 25 bp, Mus musculus
ttgttcatcaaaatctccactgcct

SEQ ID NO: 961734 - DNA, 25 bp, Mus musculus
ttgttcatcaaattctccactgcct

SEQ ID NO: 961735 - DNA, 25 bp, Mus musculus
ttgttcatccccatcagaataagag

SEQ ID NO: 961736 - DNA, 25 bp, Mus musculus
ttgttcatccccttcagaataagag

SEQ ID NO: 961737 - DNA, 25 bp, Mus musculus
ttgttcatctctcatttctggtgca

SEQ ID NO: 961738 - DNA, 25 bp, Mus musculus
ttgttcatctctgatttctggtgca

SEQ ID NO: 961739 - DNA, 25 bp, Mus musculus
ttgttcatggaaagtcaaatcgcct

SEQ ID NO: 961740 - DNA, 25 bp, Mus musculus
ttgttcatggaatgtcaaatcgcct

SEQ ID NO: 961741 - DNA, 25 bp, Mus musculus
ttgttcatggccctctacacttaag

SEQ ID NO: 961742 - DNA, 25 bp, Mus musculus
ttgttcatggccgtctacacttaag

SEQ ID NO: 961743 - DNA, 25 bp, Mus musculus
ttgttcatggtaatcccacattccc

SEQ ID NO: 961744 - DNA, 25 bp, Mus musculus
ttgttcatggtattcccacattccc

SEQ ID NO: 961745 - DNA, 25 bp, Mus musculus
ttgttcatgtccctcattgtgacct

SEQ ID NO: 961746 - DNA, 25 bp, Mus musculus
ttgttcatgtccgtcattgtgacct

SEQ ID NO: 961747 - DNA, 25 bp, Mus musculus
ttgttcattgctaagttcctgtctg

SEQ ID NO: 961748 - DNA, 25 bp, Mus musculus
ttgttcattgcttagttcctgtctg

SEQ ID NO: 961749 - DNA, 25 bp, Mus musculus
ttgttcattgtcagatccttaccac

SEQ ID NO: 961750 - DNA, 25 bp, Mus musculus
ttgttcattgtcctgggcacatgtt

SEQ ID NO: 961751 - DNA, 25 bp, Mus musculus
ttgttcattgtcgtgggcacatgtt

SEQ ID NO: 961752 - DNA, 25 bp, Mus musculus
ttgttcattgtctgatccttaccac

SEQ ID NO: 961753 - DNA, 25 bp, Mus musculus
ttgttcattttcataccgcttggta

SEQ ID NO: 961754 - DNA, 25 bp, Mus musculus
ttgttcattttcttaccgcttggta

SEQ ID NO: 961755 - DNA, 25 bp, Mus musculus
ttgttccaaagacccatgtgttatg

SEQ ID NO: 961756 - DNA, 25 bp, Mus musculus
ttgttccaaagagccatgtgttatg

SEQ ID NO: 961757 - DNA, 25 bp, Mus musculus
ttgttccaaagcattagtgatgtaa

SEQ ID NO: 961758 - DNA, 25 bp, Mus musculus
ttgttccaaagctttagtgatgtaa

SEQ ID NO: 961759 - DNA, 25 bp, Mus musculus
ttgttccaatgcacagaggccacac

SEQ ID NO: 961760 - DNA, 25 bp, Mus musculus
ttgttccaatgctcagaggccacac

SEQ ID NO: 961761 - DNA, 25 bp, Mus musculus
ttgttccacactaggttgctgttac

SEQ ID NO: 961762 - DNA, 25 bp, Mus musculus
ttgttccacacttggttgctgttac

SEQ ID NO: 961763 - DNA, 25 bp, Mus musculus
ttgttccacaggcacccaaaacaag

SEQ ID NO: 961764 - DNA, 25 bp, Mus musculus
ttgttccacagggacccaaaacaag

SEQ ID NO: 961765 - DNA, 25 bp, Mus musculus
ttgttccacttgattgcactgtgtg

SEQ ID NO: 961766 - DNA, 25 bp, Mus musculus
ttgttccacttgtttgcactgtgtg

SEQ ID NO: 961767 - DNA, 25 bp, Mus musculus
ttgttccagaatccctcaatgctca

SEQ ID NO: 961768 - DNA, 25 bp, Mus musculus
ttgttccagaatgcctcaatgctca

SEQ ID NO: 961769 - DNA, 25 bp, Mus musculus
ttgttccaggagctcatgtccatga

SEQ ID NO: 961770 - DNA, 25 bp, Mus musculus
ttgttccaggaggtcatgtccatga

SEQ ID NO: 961771 - DNA, 25 bp, Mus musculus
ttgttccaggcaaaacagtgacttt

SEQ ID NO: 961772 - DNA, 25 bp, Mus musculus
ttgttccaggcataacagtgacttt

SEQ ID NO: 961773 - DNA, 25 bp, Mus musculus
ttgttccatcctaactctctgaaag

SEQ ID NO: 961774 - DNA, 25 bp, Mus musculus
ttgttccatccttactctctgaaag

SEQ ID NO: 961775 - DNA, 25 bp, Mus musculus
ttgttccatctcatagtacctctca

SEQ ID NO: 961776 - DNA, 25 bp, Mus musculus
ttgttccatctcttagtacctctca

SEQ ID NO: 961777 - DNA, 25 bp, Mus musculus
ttgttccatgggactgcgagtaagc

SEQ ID NO: 961778 - DNA, 25 bp, Mus musculus
ttgttccatgggtctgcgagtaagc

SEQ ID NO: 961779 - DNA, 25 bp, Mus musculus
ttgttccattagaagccattcattg

SEQ ID NO: 961780 - DNA, 25 bp, Mus musculus
ttgttccattagtagccattcattg

SEQ ID NO: 961781 - DNA, 25 bp, Mus musculus
ttgttccattgaacccaagttccca

SEQ ID NO: 961782 - DNA, 25 bp, Mus musculus
ttgttccattgatcccaagttccca

SEQ ID NO: 961783 - DNA, 25 bp, Mus musculus
ttgttcccacccagctaactgctgg

SEQ ID NO: 961784 - DNA, 25 bp, Mus musculus
ttgttcccaccctgctaactgctgg

SEQ ID NO: 961785 - DNA, 25 bp, Mus musculus
ttgttcccacgccaggtgcgaagga

SEQ ID NO: 961786 - DNA, 25 bp, Mus musculus
ttgttcccacgcgaggtgcgaagga

SEQ ID NO: 961787 - DNA, 25 bp, Mus musculus
ttgttcccagaaatccatatagtac

SEQ ID NO: 961788 - DNA, 25 bp, Mus musculus
ttgttcccagaattccatatagtac

SEQ ID NO: 961789 - DNA, 25 bp, Mus musculus
ttgttcccagccacatcagtattct

SEQ ID NO: 961790 - DNA, 25 bp, Mus musculus
ttgttcccagcctcatcagtattct

SEQ ID NO: 961791 - DNA, 25 bp, Mus musculus
ttgttcccagttacctggctaccga

SEQ ID NO: 961792 - DNA, 25 bp, Mus musculus
ttgttcccagtttcctggctaccga

SEQ ID NO: 961793 - DNA, 25 bp, Mus musculus
ttgttccccaaaatccacattacat

SEQ ID NO: 961794 - DNA, 25 bp, Mus musculus
ttgttccccaaattccacattacat

SEQ ID NO: 961795 - DNA, 25 bp, Mus musculus
ttgttccccaacataaagtgattcg

SEQ ID NO: 961796 - DNA, 25 bp, Mus musculus
ttgttccccaacttaaagtgattcg

SEQ ID NO: 961797 - DNA, 25 bp, Mus musculus
ttgttccccattctaagaagcagtg

SEQ ID NO: 961798 - DNA, 25 bp, Mus musculus
ttgttccccattgtaagaagcagtg

SEQ ID NO: 961799 - DNA, 25 bp, Mus musculus
ttgttcccctatactggagggttcg

SEQ ID NO: 961800 - DNA, 25 bp, Mus musculus
ttgttcccctattctggagggttcg

SEQ ID NO: 961801 - DNA, 25 bp, Mus musculus
ttgttccctcatagccacagatgac

SEQ ID NO: 961802 - DNA, 25 bp, Mus musculus
ttgttccctcattgccacagatgac

SEQ ID NO: 961803 - DNA, 25 bp, Mus musculus
ttgttccctctaagaaatgcacttc

SEQ ID NO: 961804 - DNA, 25 bp, Mus musculus
ttgttccctctatgaaatgcacttc

SEQ ID NO: 961805 - DNA, 25 bp, Mus musculus
ttgttccctgaaattcgtctgagat

SEQ ID NO: 961806 - DNA, 25 bp, Mus musculus
ttgttccctgaatttcgtctgagat

SEQ ID NO: 961807 - DNA, 25 bp, Mus musculus
ttgttccctgcacatgagctctatg

SEQ ID NO: 961808 - DNA, 25 bp, Mus musculus
ttgttccctgcagatgagctctatg

SEQ ID NO: 961809 - DNA, 25 bp, Mus musculus
ttgttccctgtcaatatatgccttt

SEQ ID NO: 961810 - DNA, 25 bp, Mus musculus
ttgttccctgtctatatatgccttt

SEQ ID NO: 961811 - DNA, 25 bp, Mus musculus
ttgttcccttgtccagtgtggctga

SEQ ID NO: 961812 - DNA, 25 bp, Mus musculus
ttgttcccttgtgcagtgtggctga

SEQ ID NO: 961813 - DNA, 25 bp, Mus musculus
ttgttccctttcagagcatgtggcc

SEQ ID NO: 961814 - DNA, 25 bp, Mus musculus
ttgttccctttctgagcatgtggcc

SEQ ID NO: 961815 - DNA, 25 bp, Mus musculus
ttgttccggatcaatgagtctgcag

SEQ ID NO: 961816 - DNA, 25 bp, Mus musculus
ttgttccggatctatgagtctgcag

SEQ ID NO: 961817 - DNA, 25 bp, Mus musculus
ttgttcctaggtagcaggcttttct

SEQ ID NO: 961818 - DNA, 25 bp, Mus musculus
ttgttcctaggttgcaggcttttct

SEQ ID NO: 961819 - DNA, 25 bp, Mus musculus
ttgttcctagtaactagtgggcagg

SEQ ID NO: 961820 - DNA, 25 bp, Mus musculus
ttgttcctagtatctagtgggcagg

SEQ ID NO: 961821 - DNA, 25 bp, Mus musculus
ttgttcctcactcttaattcgccca

SEQ ID NO: 961822 - DNA, 25 bp, Mus musculus
ttgttcctcactgttaattcgccca

SEQ ID NO: 961823 - DNA, 25 bp, Mus musculus
ttgttcctcctaattattctcccaa

SEQ ID NO: 961824 - DNA, 25 bp, Mus musculus
ttgttcctcctatttattctcccaa

SEQ ID NO: 961825 - DNA, 25 bp, Mus musculus
ttgttcctccttaattcacaccctt

SEQ ID NO: 961826 - DNA, 25 bp, Mus musculus
ttgttcctcctttattcacaccctt

SEQ ID NO: 961827 - DNA, 25 bp, Mus musculus
ttgttcctctaaaactggtccttat

SEQ ID NO: 961828 - DNA, 25 bp, Mus musculus
ttgttcctctaatactggtccttat

SEQ ID NO: 961829 - DNA, 25 bp, Mus musculus
ttgttcctctcaactagactttcag

SEQ ID NO: 961830 - DNA, 25 bp, Mus musculus
ttgttcctctcatctagactttcag

SEQ ID NO: 961831 - DNA, 25 bp, Mus musculus
ttgttcctgatactatctctctctt

SEQ ID NO: 961832 - DNA, 25 bp, Mus musculus
ttgttcctgatagtatctctctctt

SEQ ID NO: 961833 - DNA, 25 bp, Mus musculus
ttgttcctgcacatcaagatccctt

SEQ ID NO: 961834 - DNA, 25 bp, Mus musculus
ttgttcctgcacttcaagatccctt

SEQ ID NO: 961835 - DNA, 25 bp, Mus musculus
ttgttcctgccaagttgtgtttttt

SEQ ID NO: 961836 - DNA, 25 bp, Mus musculus
ttgttcctgccatgttgtgtttttt

SEQ ID NO: 961837 - DNA, 25 bp, Mus musculus
ttgttcctggcgaactgcagcagca

SEQ ID NO: 961838 - DNA, 25 bp, Mus musculus
ttgttcctggcgtactgcagcagca

SEQ ID NO: 961839 - DNA, 25 bp, Mus musculus
ttgttcctgtggaactaagtctcat

SEQ ID NO: 961840 - DNA, 25 bp, Mus musculus
ttgttcctgtggtactaagtctcat

SEQ ID NO: 961841 - DNA, 25 bp, Mus musculus
ttgttcctgttgagacttggccagt

SEQ ID NO: 961842 - DNA, 25 bp, Mus musculus
ttgttcctgttgtgacttggccagt

SEQ ID NO: 961843 - DNA, 25 bp, Mus musculus
ttgttccttaggcattcattctatc

SEQ ID NO: 961844 - DNA, 25 bp, Mus musculus
ttgttccttagggattcattctatc

SEQ ID NO: 961845 - DNA, 25 bp, Mus musculus
ttgttccttatgctgtttggtgtaa

SEQ ID NO: 961846 - DNA, 25 bp, Mus musculus
ttgttccttatggtgtttggtgtaa

SEQ ID NO: 961847 - DNA, 25 bp, Mus musculus
ttgttccttccacgattatccacca

SEQ ID NO: 961848 - DNA, 25 bp, Mus musculus
ttgttccttccaggattatccacca

SEQ ID NO: 961849 - DNA, 25 bp, Mus musculus
ttgttccttgctccttgtggtaaag

SEQ ID NO: 961850 - DNA, 25 bp, Mus musculus
ttgttccttgctgcttgtggtaaag

SEQ ID NO: 961851 - DNA, 25 bp, Mus musculus
ttgttccttggaacgaaacagaacc

SEQ ID NO: 961852 - DNA, 25 bp, Mus musculus
ttgttccttggatcgaaacagaacc

SEQ ID NO: 961853 - DNA, 25 bp, Mus musculus
ttgttcgagattcctcccaggtgca

SEQ ID NO: 961854 - DNA, 25 bp, Mus musculus
ttgttcgagattgctcccaggtgca

SEQ ID NO: 961855 - DNA, 25 bp, Mus musculus
ttgttcgagcttccccttgattaga

SEQ ID NO: 961856 - DNA, 25 bp, Mus musculus
ttgttcgagcttgcccttgattaga

SEQ ID NO: 961857 - DNA, 25 bp, Mus musculus
ttgttcgagttgagaaacgtgtgta

SEQ ID NO: 961858 - DNA, 25 bp, Mus musculus
ttgttcgagttgtgaaacgtgtgta

SEQ ID NO: 961859 - DNA, 25 bp, Mus musculus
ttgttcgataatctggatgccaggc

SEQ ID NO: 961860 - DNA, 25 bp, Mus musculus
ttgttcgataatgtggatgccaggc

SEQ ID NO: 961861 - DNA, 25 bp, Mus musculus
ttgttcgatgatccaccccataggc

SEQ ID NO: 961862 - DNA, 25 bp, Mus musculus
ttgttcgatgatgcaccccataggc

SEQ ID NO: 961863 - DNA, 25 bp, Mus musculus
ttgttcgatggcagccatttactga

SEQ ID NO: 961864 - DNA, 25 bp, Mus musculus
ttgttcgatggctgccatttactga

SEQ ID NO: 961865 - DNA, 25 bp, Mus musculus
ttgttcgcatggacacacactgatg

SEQ ID NO: 961866 - DNA, 25 bp, Mus musculus
ttgttcgcatggtcacacactgatg

SEQ ID NO: 961867 - DNA, 25 bp, Mus musculus
ttgttcggtggtactggcctttgcc

SEQ ID NO: 961868 - DNA, 25 bp, Mus musculus
ttgttcggtggttctggcctttgcc

SEQ ID NO: 961869 - DNA, 25 bp, Mus musculus
ttgttcgtgtccatccagactgcag

SEQ ID NO: 961870 - DNA, 25 bp, Mus musculus
ttgttcgtgtccttccagactgcag

SEQ ID NO: 961871 - DNA, 25 bp, Mus musculus
ttgttcgtgttcagcaggctccacg

SEQ ID NO: 961872 - DNA, 25 bp, Mus musculus
ttgttcgtgttctgcaggctccacg

SEQ ID NO: 961873 - DNA, 25 bp, Mus musculus
ttgttctacagcagactttggtcta

SEQ ID NO: 961874 - DNA, 25 bp, Mus musculus
ttgttctacagctgactttggtcta

SEQ ID NO: 961875 - DNA, 25 bp, Mus musculus
ttgttctacctaagccacactttaa

SEQ ID NO: 961876 - DNA, 25 bp, Mus musculus
ttgttctacctatgccacactttaa

SEQ ID NO: 961877 - DNA, 25 bp, Mus musculus
ttgttctacttccacctcttgagga

SEQ ID NO: 961878 - DNA, 25 bp, Mus musculus
ttgttctacttcgacctcttgagga

SEQ ID NO: 961879 - DNA, 25 bp, Mus musculus
ttgttctagattactgcctgagctt

SEQ ID NO: 961880 - DNA, 25 bp, Mus musculus
ttgttctagatttctgcctgagctt

SEQ ID NO: 961881 - DNA, 25 bp, Mus musculus
ttgttctatcatcttttctctcctt

SEQ ID NO: 961882 - DNA, 25 bp, Mus musculus
ttgttctatcatgttttctctcctt

SEQ ID NO: 961883 - DNA, 25 bp, Mus musculus
ttgttctatgagaaagtttttacca

SEQ ID NO: 961884 - DNA, 25 bp, Mus musculus
ttgttctatgagtaagtttttacca

SEQ ID NO: 961885 - DNA, 25 bp, Mus musculus
ttgttctatgataacctttgcggtc

SEQ ID NO: 961886 - DNA, 25 bp, Mus musculus
ttgttctatgatagctgacccctga

SEQ ID NO: 961887 - DNA, 25 bp, Mus musculus
ttgttctatgattacctttgcggtc

SEQ ID NO: 961888 - DNA, 25 bp, Mus musculus
ttgttctatgattgctgacccctga

SEQ ID NO: 961889 - DNA, 25 bp, Mus musculus
ttgttctcaaagattatgccatttt

SEQ ID NO: 961890 - DNA, 25 bp, Mus musculus
ttgttctcaaagtttatgccatttt

SEQ ID NO: 961891 - DNA, 25 bp, Mus musculus
ttgttctcaagaattggacgttctt

SEQ ID NO: 961892 - DNA, 25 bp, Mus musculus
ttgttctcaagatttggacgttctt

SEQ ID NO: 961893 - DNA, 25 bp, Mus musculus
ttgttctcactgagcgaatgccctg

SEQ ID NO: 961894 - DNA, 25 bp, Mus musculus
ttgttctcactgtgcgaatgccctg

SEQ ID NO: 961895 - DNA, 25 bp, Mus musculus
ttgttctcagaactggacgtttttt

SEQ ID NO: 961896 - DNA, 25 bp, Mus musculus
ttgttctcagaagtggacgtttttt

SEQ ID NO: 961897 - DNA, 25 bp, Mus musculus
ttgttctcagagctcccttagccac

SEQ ID NO: 961898 - DNA, 25 bp, Mus musculus
ttgttctcagaggtcccttagccac

SEQ ID NO: 961899 - DNA, 25 bp, Mus musculus
ttgttctcatgtatgcctcacccaa

SEQ ID NO: 961900 - DNA, 25 bp, Mus musculus
ttgttctcatgtttgcctcacccaa

SEQ ID NO: 961901 - DNA, 25 bp, Mus musculus
ttgttctccacacgtcaccggaaag

SEQ ID NO: 961902 - DNA, 25 bp, Mus musculus
ttgttctccacaggtcaccggaaag

SEQ ID NO: 961903 - DNA, 25 bp, Mus musculus
ttgttctccaccctagcttaattct

SEQ ID NO: 961904 - DNA, 25 bp, Mus musculus
ttgttctccaccgtagcttaattct

SEQ ID NO: 961905 - DNA, 25 bp, Mus musculus
ttgttctccatgaaggtactcactg

SEQ ID NO: 961906 - DNA, 25 bp, Mus musculus
ttgttctccatgtaggtactcactg

SEQ ID NO: 961907 - DNA, 25 bp, Mus musculus
ttgttctccctgacttctgacttga

SEQ ID NO: 961908 - DNA, 25 bp, Mus musculus
ttgttctccctgcttccttaatact

SEQ ID NO: 961909 - DNA, 25 bp, Mus musculus
ttgttctccctggttccttaatact

SEQ ID NO: 961910 - DNA, 25 bp, Mus musculus
ttgttctccctgtcttctgacttga

SEQ ID NO: 961911 - DNA, 25 bp, Mus musculus
ttgttctccggacatcaggcggaag

SEQ ID NO: 961912 - DNA, 25 bp, Mus musculus
ttgttctccggagatcaggcggaag

SEQ ID NO: 961913 - DNA, 25 bp, Mus musculus
ttgttctcctcaagggccctggaga

SEQ ID NO: 961914 - DNA, 25 bp, Mus musculus
ttgttctcctcatgggccctggaga

SEQ ID NO: 961915 - DNA, 25 bp, Mus musculus
ttgttctcctctaggacacctgtgg

SEQ ID NO: 961916 - DNA, 25 bp, Mus musculus
ttgttctcctctagggttcagtcac

SEQ ID NO: 961917 - DNA, 25 bp, Mus musculus
ttgttctcctcttggacacctgtgg

SEQ ID NO: 961918 - DNA, 25 bp, Mus musculus
ttgttctcctcttgggttcagtcac

SEQ ID NO: 961919 - DNA, 25 bp, Mus musculus
ttgttctcctgacagccattgtcac

SEQ ID NO: 961920 - DNA, 25 bp, Mus musculus
ttgttctcctgagagccattgtcac

SEQ ID NO: 961921 - DNA, 25 bp, Mus musculus
ttgttctcctgtaccagctgatgat

SEQ ID NO: 961922 - DNA, 25 bp, Mus musculus
ttgttctcctgttccagctgatgat

SEQ ID NO: 961923 - DNA, 25 bp, Mus musculus
ttgttctccttaattttgtttctgg

SEQ ID NO: 961924 - DNA, 25 bp, Mus musculus
ttgttctccttatttttgtttctgg

SEQ ID NO: 961925 - DNA, 25 bp, Mus musculus
ttgttctcctttcgacagctgccaa

SEQ ID NO: 961926 - DNA, 25 bp, Mus musculus
ttgttctcctttggacagctgccaa

SEQ ID NO: 961927 - DNA, 25 bp, Mus musculus
ttgttctcgctgagattgtaggtct

SEQ ID NO: 961928 - DNA, 25 bp, Mus musculus
ttgttctcgctgtgattgtaggtct

SEQ ID NO: 961929 - DNA, 25 bp, Mus musculus
ttgttctcggagatggctgatgcac

SEQ ID NO: 961930 - DNA, 25 bp, Mus musculus
ttgttctcggagttggctgatgcac

SEQ ID NO: 961931 - DNA, 25 bp, Mus musculus
ttgttctctcctaccataatgtgtt

SEQ ID NO: 961932 - DNA, 25 bp, Mus musculus
ttgttctctccttccataatgtgtt

SEQ ID NO: 961933 - DNA, 25 bp, Mus musculus
ttgttctctctacttcatcttgtct

SEQ ID NO: 961934 - DNA, 25 bp, Mus musculus
ttgttctctctagttcatcttgtct

SEQ ID NO: 961935 - DNA, 25 bp, Mus musculus
ttgttctctctgctgctaaaagatc

SEQ ID NO: 961936 - DNA, 25 bp, Mus musculus
ttgttctctctggtgctaaaagatc

SEQ ID NO: 961937 - DNA, 25 bp, Mus musculus
ttgttctctgatctgcacatgcaca

SEQ ID NO: 961938 - DNA, 25 bp, Mus musculus
ttgttctctgatgtgcacatgcaca

SEQ ID NO: 961939 - DNA, 25 bp, Mus musculus
ttgttctctgtgattggcctactgt

SEQ ID NO: 961940 - DNA, 25 bp, Mus musculus
ttgttctctgtgtttggcctactgt

SEQ ID NO: 961941 - DNA, 25 bp, Mus musculus
ttgttctcttcgcttctaatttttg

SEQ ID NO: 961942 - DNA, 25 bp, Mus musculus
ttgttctcttcggttctaatttttg

SEQ ID NO: 961943 - DNA, 25 bp, Mus musculus
ttgttctctttcattagctatccta

SEQ ID NO: 961944 - DNA, 25 bp, Mus musculus
ttgttctctttctttagctatccta

SEQ ID NO: 961945 - DNA, 25 bp, Mus musculus
ttgttctgaatgatggtagtccctt

SEQ ID NO: 961946 - DNA, 25 bp, Mus musculus
ttgttctgaatgttggtagtccctt

SEQ ID NO: 961947 - DNA, 25 bp, Mus musculus
ttgttctgacagaccccaatgtcat

SEQ ID NO: 961948 - DNA, 25 bp, Mus musculus
ttgttctgacagtccccaatgtcat

SEQ ID NO: 961949 - DNA, 25 bp, Mus musculus
ttgttctgatctaaagtgcctcttt

SEQ ID NO: 961950 - DNA, 25 bp, Mus musculus
ttgttctgatcttaagtgcctcttt

SEQ ID NO: 961951 - DNA, 25 bp, Mus musculus
ttgttctgctccaacctttatactg

SEQ ID NO: 961952 - DNA, 25 bp, Mus musculus
ttgttctgctcctacctttatactg

SEQ ID NO: 961953 - DNA, 25 bp, Mus musculus
ttgttctgctgtcaacaggccagct

SEQ ID NO: 961954 - DNA, 25 bp, Mus musculus
ttgttctgctgtgaacaggccagct

SEQ ID NO: 961955 - DNA, 25 bp, Mus musculus
ttgttctgcttgacagcccgggatc

SEQ ID NO: 961956 - DNA, 25 bp, Mus musculus
ttgttctgcttgtcagcccgggatc

SEQ ID NO: 961957 - DNA, 25 bp, Mus musculus
ttgttctggcttatccctgtaagag

SEQ ID NO: 961958 - DNA, 25 bp, Mus musculus
ttgttctggcttttccctgtaagag

SEQ ID NO: 961959 - DNA, 25 bp, Mus musculus
ttgttctggtagaggacaggaccca

SEQ ID NO: 961960 - DNA, 25 bp, Mus musculus
ttgttctggtagtggacaggaccca

SEQ ID NO: 961961 - DNA, 25 bp, Mus musculus
ttgttctgtattcgaaagctgcccc

SEQ ID NO: 961962 - DNA, 25 bp, Mus musculus
ttgttctgtattggaaagctgcccc

SEQ ID NO: 961963 - DNA, 25 bp, Mus musculus
ttgttctgtcacacggttgcacatt

SEQ ID NO: 961964 - DNA, 25 bp, Mus musculus
ttgttctgtcactcggttgcacatt

SEQ ID NO: 961965 - DNA, 25 bp, Mus musculus
ttgttctgtggtccttgttactaca

SEQ ID NO: 961966 - DNA, 25 bp, Mus musculus
ttgttctgtggtgcttgttactaca

SEQ ID NO: 961967 - DNA, 25 bp, Mus musculus
ttgttctgttagcagctgtgtcttt

SEQ ID NO: 961968 - DNA, 25 bp, Mus musculus
ttgttctgttaggagctgtgtcttt

SEQ ID NO: 961969 - DNA, 25 bp, Mus musculus
ttgttctgttgtctgcgcctgaaaa

SEQ ID NO: 961970 - DNA, 25 bp, Mus musculus
ttgttctgttgtgtgcgcctgaaaa

SEQ ID NO: 961971 - DNA, 25 bp, Mus musculus
ttgttctgttttctgatgagcagga

SEQ ID NO: 961972 - DNA, 25 bp, Mus musculus
ttgttctgttttgtgatgagcagga

SEQ ID NO: 961973 - DNA, 25 bp, Mus musculus
ttgttcttacccaaaattggtgagt

SEQ ID NO: 961974 - DNA, 25 bp, Mus musculus
ttgttcttaccctaaattggtgagt

SEQ ID NO: 961975 - DNA, 25 bp, Mus musculus
ttgttcttcactcacttggcaggtg

SEQ ID NO: 961976 - DNA, 25 bp, Mus musculus
ttgttcttcactgacttggcaggtg

SEQ ID NO: 961977 - DNA, 25 bp, Mus musculus
ttgttcttccagaggcttggcatgg

SEQ ID NO: 961978 - DNA, 25 bp, Mus musculus
ttgttcttccagtggcttggcatgg

SEQ ID NO: 961979 - DNA, 25 bp, Mus musculus
ttgttcttcctaacactcctgtagt

SEQ ID NO: 961980 - DNA, 25 bp, Mus musculus
ttgttcttcctatcactcctgtagt

SEQ ID NO: 961981 - DNA, 25 bp, Mus musculus
ttgttcttgcccatgtccattctca

SEQ ID NO: 961982 - DNA, 25 bp, Mus musculus
ttgttcttgcccttgtccattctca

SEQ ID NO: 961983 - DNA, 25 bp, Mus musculus
ttgttcttgtgtccattgtgcgtgt

SEQ ID NO: 961984 - DNA, 25 bp, Mus musculus
ttgttcttgtgtgcattgtgcgtgt

SEQ ID NO: 961985 - DNA, 25 bp, Mus musculus
ttgttctttagaaaccatctgttgg

SEQ ID NO: 961986 - DNA, 25 bp, Mus musculus
ttgttctttagataccatctgttgg

SEQ ID NO: 961987 - DNA, 25 bp, Mus musculus
ttgttctttaggaccttgctcaggc

SEQ ID NO: 961988 - DNA, 25 bp, Mus musculus
ttgttctttaggtccttgctcaggc

SEQ ID NO: 961989 - DNA, 25 bp, Mus musculus
ttgttctttctcaacgtgtcaatgg

SEQ ID NO: 961990 - DNA, 25 bp, Mus musculus
ttgttctttctctacgtgtcaatgg

SEQ ID NO: 961991 - DNA, 25 bp, Mus musculus
ttgttctttgtgacccatacagcag

SEQ ID NO: 961992 - DNA, 25 bp, Mus musculus
ttgttctttgtgatactgcagtgaa

SEQ ID NO: 961993 - DNA, 25 bp, Mus musculus
ttgttctttgtgtcccatacagcag

SEQ ID NO: 961994 - DNA, 25 bp, Mus musculus
ttgttctttgtgttactgcagtgaa

SEQ ID NO: 961995 - DNA, 25 bp, Mus musculus
ttgttcttttccaacagtcattttc

SEQ ID NO: 961996 - DNA, 25 bp, Mus musculus
ttgttcttttcctacagtcattttc

SEQ ID NO: 961997 - DNA, 25 bp, Mus musculus
ttgttcttttggatcctcactaaca

SEQ ID NO: 961998 - DNA, 25 bp, Mus musculus
ttgttcttttggttcctcactaaca

SEQ ID NO: 961999 - DNA, 25 bp, Mus musculus
ttgttgaaccagagtttttgggtga

SEQ ID NO: 962000 - DNA, 25 bp, Mus musculus
ttgttgaaccagtgtttttgggtga

SEQ ID NO: 962001 - DNA, 25 bp, Mus musculus
ttgttgaagcttacacaccactgtc

SEQ ID NO: 962002 - DNA, 25 bp, Mus musculus
ttgttgaagctttcacaccactgtc

SEQ ID NO: 962003 - DNA, 25 bp, Mus musculus
ttgttgacccatagcatggatatgg

SEQ ID NO: 962004 - DNA, 25 bp, Mus musculus
ttgttgacccattgcatggatatgg

SEQ ID NO: 962005 - DNA, 25 bp, Mus musculus
ttgttgaccccgagttctactcctc

SEQ ID NO: 962006 - DNA, 25 bp, Mus musculus
ttgttgaccccgtgttctactcctc

SEQ ID NO: 962007 - DNA, 25 bp, Mus musculus
ttgttgacctccagagctcagggaa

SEQ ID NO: 962008 - DNA, 25 bp, Mus musculus
ttgttgacctcctgagctcagggaa

SEQ ID NO: 962009 - DNA, 25 bp, Mus musculus
ttgttgacctttatcgtgcaccgaa

SEQ ID NO: 962010 - DNA, 25 bp, Mus musculus
ttgttgacctttttcgtgcaccgaa

SEQ ID NO: 962011 - DNA, 25 bp, Mus musculus
ttgttgactgagattttcatcctta

SEQ ID NO: 962012 - DNA, 25 bp, Mus musculus
ttgttgactgagtttttcatcctta

SEQ ID NO: 962013 - DNA, 25 bp, Mus musculus
ttgttgacttttatggacaccaaat

SEQ ID NO: 962014 - DNA, 25 bp, Mus musculus
ttgttgacttttttggacaccaaat

SEQ ID NO: 962015 - DNA, 25 bp, Mus musculus
ttgttgagaagtacctcccctatat

SEQ ID NO: 962016 - DNA, 25 bp, Mus musculus
ttgttgagaagttcctcccctatat

SEQ ID NO: 962017 - DNA, 25 bp, Mus musculus
ttgttgagactcattggtactgata

SEQ ID NO: 962018 - DNA, 25 bp, Mus musculus
ttgttgagactctttggtactgata

SEQ ID NO: 962019 - DNA, 25 bp, Mus musculus
ttgttgagacttccactttggaaga

SEQ ID NO: 962020 - DNA, 25 bp, Mus musculus
ttgttgagacttgcactttggaaga

SEQ ID NO: 962021 - DNA, 25 bp, Mus musculus
ttgttgagaggtccgggcgactgcc

SEQ ID NO: 962022 - DNA, 25 bp, Mus musculus
ttgttgagaggtgcgggcgactgcc

SEQ ID NO: 962023 - DNA, 25 bp, Mus musculus
ttgttgagtcacatgccctcttcgg

SEQ ID NO: 962024 - DNA, 25 bp, Mus musculus
ttgttgagtcacttgccctcttcgg

SEQ ID NO: 962025 - DNA, 25 bp, Mus musculus
ttgttgagtctcactgggtattaga

SEQ ID NO: 962026 - DNA, 25 bp, Mus musculus
ttgttgagtctctctgggtattaga

SEQ ID NO: 962027 - DNA, 25 bp, Mus musculus
ttgttgagttaaccgcctgaagcgc

SEQ ID NO: 962028 - DNA, 25 bp, Mus musculus
ttgttgagttaagcgcctgaagcgc

SEQ ID NO: 962029 - DNA, 25 bp, Mus musculus
ttgttgataaacatccagggccacc

SEQ ID NO: 962030 - DNA, 25 bp, Mus musculus
ttgttgataaacttccagggccacc

SEQ ID NO: 962031 - DNA, 25 bp, Mus musculus
ttgttgatatggaccctggcaagcc

SEQ ID NO: 962032 - DNA, 25 bp, Mus musculus
ttgttgatatggtccctggcaagcc

SEQ ID NO: 962033 - DNA, 25 bp, Mus musculus
ttgttgatgcatagaagccgcccca

SEQ ID NO: 962034 - DNA, 25 bp, Mus musculus
ttgttgatgcattgaagccgcccca

SEQ ID NO: 962035 - DNA, 25 bp, Mus musculus
ttgttgatggttctgtgcatctcct

SEQ ID NO: 962036 - DNA, 25 bp, Mus musculus
ttgttgatggttgtgtgcatctcct

SEQ ID NO: 962037 - DNA, 25 bp, Mus musculus
ttgttgattcttccaagaaggagcc

SEQ ID NO: 962038 - DNA, 25 bp, Mus musculus
ttgttgattcttgcaagaaggagcc

SEQ ID NO: 962039 - DNA, 25 bp, Mus musculus
ttgttgcaacctctgcaccctagaa

SEQ ID NO: 962040 - DNA, 25 bp, Mus musculus
ttgttgcaacctgtgcaccctagaa

SEQ ID NO: 962041 - DNA, 25 bp, Mus musculus
ttgttgcaactgctacattctggtc

SEQ ID NO: 962042 - DNA, 25 bp, Mus musculus
ttgttgcaactggtacattctggtc

SEQ ID NO: 962043 - DNA, 25 bp, Mus musculus
ttgttgcaatcgacttcgccgtcaa

SEQ ID NO: 962044 - DNA, 25 bp, Mus musculus
ttgttgcaatcgtcttcgccgtcaa

SEQ ID NO: 962045 - DNA, 25 bp, Mus musculus
ttgttgcacagaaatccgtgcaggc

SEQ ID NO: 962046 - DNA, 25 bp, Mus musculus
ttgttgcacagatatccgtgcaggc

SEQ ID NO: 962047 - DNA, 25 bp, Mus musculus
ttgttgcactgcactttggcattgc

SEQ ID NO: 962048 - DNA, 25 bp, Mus musculus
ttgttgcactgctctttggcattgc

SEQ ID NO: 962049 - DNA, 25 bp, Mus musculus
ttgttgcagggcatcaacctgaagc

SEQ ID NO: 962050 - DNA, 25 bp, Mus musculus
ttgttgcagggcttcaacctgaagc

SEQ ID NO: 962051 - DNA, 25 bp, Mus musculus
ttgttgcatgccaacagttcagcta

SEQ ID NO: 962052 - DNA, 25 bp, Mus musculus
ttgttgcatgccctttcacggtttc

SEQ ID NO: 962053 - DNA, 25 bp, Mus musculus
ttgttgcatgccgtttcacggtttc

SEQ ID NO: 962054 - DNA, 25 bp, Mus musculus
ttgttgcatgcctacagttcagcta

SEQ ID NO: 962055 - DNA, 25 bp, Mus musculus
ttgttgccaaaaattcatgctaggt

SEQ ID NO: 962056 - DNA, 25 bp, Mus musculus
ttgttgccaaaatttcatgctaggt

SEQ ID NO: 962057 - DNA, 25 bp, Mus musculus
ttgttgccagcaagtctgacagctt

SEQ ID NO: 962058 - DNA, 25 bp, Mus musculus
ttgttgccagcaatcctagcaccaa

SEQ ID NO: 962059 - DNA, 25 bp, Mus musculus
ttgttgccagcacaggcccaggtgt

SEQ ID NO: 962060 - DNA, 25 bp, Mus musculus
ttgttgccagcagaggcccaggtgt

SEQ ID NO: 962061 - DNA, 25 bp, Mus musculus
ttgttgccagcatgtctgacagctt

SEQ ID NO: 962062 - DNA, 25 bp, Mus musculus
ttgttgccagcattcctagcaccaa

SEQ ID NO: 962063 - DNA, 25 bp, Mus musculus
ttgttgccaggaaactttagctgat

SEQ ID NO: 962064 - DNA, 25 bp, Mus musculus
ttgttgccaggatactttagctgat

SEQ ID NO: 962065 - DNA, 25 bp, Mus musculus
ttgttgcccacaatagacctaaaga

SEQ ID NO: 962066 - DNA, 25 bp, Mus musculus
ttgttgcccacattagacctaaaga

SEQ ID NO: 962067 - DNA, 25 bp, Mus musculus
ttgttgccgggacaatcactatatt

SEQ ID NO: 962068 - DNA, 25 bp, Mus musculus
ttgttgccgggagaatcactatatt

SEQ ID NO: 962069 - DNA, 25 bp, Mus musculus
ttgttgcctaccactgtgaaaccta

SEQ ID NO: 962070 - DNA, 25 bp, Mus musculus
ttgttgcctacctctgtgaaaccta

SEQ ID NO: 962071 - DNA, 25 bp, Mus musculus
ttgttgcctcacagttctctaactt

SEQ ID NO: 962072 - DNA, 25 bp, Mus musculus
ttgttgcctcactgttctctaactt

SEQ ID NO: 962073 - DNA, 25 bp, Mus musculus
ttgttgcctccgagagcactgcata

SEQ ID NO: 962074 - DNA, 25 bp, Mus musculus
ttgttgcctccgtgagcactgcata

SEQ ID NO: 962075 - DNA, 25 bp, Mus musculus
ttgttgcctcttactacagagaatg

SEQ ID NO: 962076 - DNA, 25 bp, Mus musculus
ttgttgcctctttctacagagaatg

SEQ ID NO: 962077 - DNA, 25 bp, Mus musculus
ttgttgcctggtacgtgactgtgcc

SEQ ID NO: 962078 - DNA, 25 bp, Mus musculus
ttgttgcctggttcgtgactgtgcc

SEQ ID NO: 962079 - DNA, 25 bp, Mus musculus
ttgttgcgacaacgcccagacccta

SEQ ID NO: 962080 - DNA, 25 bp, Mus musculus
ttgttgcgacaaggcccagacccta

SEQ ID NO: 962081 - DNA, 25 bp, Mus musculus
ttgttgctatcacaagtgccgtgga

SEQ ID NO: 962082 - DNA, 25 bp, Mus musculus
ttgttgctatcagaagtgccgtgga

SEQ ID NO: 962083 - DNA, 25 bp, Mus musculus
ttgttgctccgtataaaccaggtgt

SEQ ID NO: 962084 - DNA, 25 bp, Mus musculus
ttgttgctccgtttaaaccaggtgt

SEQ ID NO: 962085 - DNA, 25 bp, Mus musculus
ttgttgctgactatgtgttgacccc

SEQ ID NO: 962086 - DNA, 25 bp, Mus musculus
ttgttgctgactttgtgttgacccc

SEQ ID NO: 962087 - DNA, 25 bp, Mus musculus
ttgttgctgatgctccaagttccct

SEQ ID NO: 962088 - DNA, 25 bp, Mus musculus
ttgttgctgatggtccaagttccct

SEQ ID NO: 962089 - DNA, 25 bp, Mus musculus
ttgttgctggagcagacggcacact

SEQ ID NO: 962090 - DNA, 25 bp, Mus musculus
ttgttgctggaggagacggcacact

SEQ ID NO: 962091 - DNA, 25 bp, Mus musculus
ttgttgctggcaagctctgtggaga

SEQ ID NO: 962092 - DNA, 25 bp, Mus musculus
ttgttgctggcatgctctgtggaga

SEQ ID NO: 962093 - DNA, 25 bp, Mus musculus
ttgttgctggtgaaacttttgttct

SEQ ID NO: 962094 - DNA, 25 bp, Mus musculus
ttgttgctggtgtaacttttgttct

SEQ ID NO: 962095 - DNA, 25 bp, Mus musculus
ttgttgctgtatatgggtccaggaa

SEQ ID NO: 962096 - DNA, 25 bp, Mus musculus
ttgttgctgtatttgggtccaggaa

SEQ ID NO: 962097 - DNA, 25 bp, Mus musculus
ttgttgcttgctcaggttgatgacc

SEQ ID NO: 962098 - DNA, 25 bp, Mus musculus
ttgttgcttgctgaggttgatgacc

SEQ ID NO: 962099 - DNA, 25 bp, Mus musculus
ttgttgcttttcacttacctttgag

SEQ ID NO: 962100 - DNA, 25 bp, Mus musculus
ttgttgcttttctcttacctttgag

SEQ ID NO: 962101 - DNA, 25 bp, Mus musculus
ttgttggaactaatccattctgcca

SEQ ID NO: 962102 - DNA, 25 bp, Mus musculus
ttgttggaactattccattctgcca

SEQ ID NO: 962103 - DNA, 25 bp, Mus musculus
ttgttggaagacatgcccctccaaa

SEQ ID NO: 962104 - DNA, 25 bp, Mus musculus
ttgttggaagacttgcccctccaaa

SEQ ID NO: 962105 - DNA, 25 bp, Mus musculus
ttgttggacagtctggctcagcaga

SEQ ID NO: 962106 - DNA, 25 bp, Mus musculus
ttgttggacagtgtggctcagcaga

SEQ ID NO: 962107 - DNA, 25 bp, Mus musculus
ttgttggacccaatttccctagcaa

SEQ ID NO: 962108 - DNA, 25 bp, Mus musculus
ttgttggacccattttccctagcaa

SEQ ID NO: 962109 - DNA, 25 bp, Mus musculus
ttgttggacctcaatccaccaagtt

SEQ ID NO: 962110 - DNA, 25 bp, Mus musculus
ttgttggacctctatccaccaagtt

SEQ ID NO: 962111 - DNA, 25 bp, Mus musculus
ttgttggagatcatgccccgtgtaa

SEQ ID NO: 962112 - DNA, 25 bp, Mus musculus
ttgttggagatcttgccccgtgtaa

SEQ ID NO: 962113 - DNA, 25 bp, Mus musculus
ttgttggagctaatgccagctgcgt

SEQ ID NO: 962114 - DNA, 25 bp, Mus musculus
ttgttggagctattgccagctgcgt

SEQ ID NO: 962115 - DNA, 25 bp, Mus musculus
ttgttggagcttaaaccccttgtat

SEQ ID NO: 962116 - DNA, 25 bp, Mus musculus
ttgttggagctttaaccccttgtat

SEQ ID NO: 962117 - DNA, 25 bp, Mus musculus
ttgttggagggactgtctgtcttcc

SEQ ID NO: 962118 - DNA, 25 bp, Mus musculus
ttgttggagggagtgtctgtcttcc

SEQ ID NO: 962119 - DNA, 25 bp, Mus musculus
ttgttggcaaatacctgtcccatgt

SEQ ID NO: 962120 - DNA, 25 bp, Mus musculus
ttgttggcaaattcctgtcccatgt

SEQ ID NO: 962121 - DNA, 25 bp, Mus musculus
ttgttggcagacatggccttcatgt

SEQ ID NO: 962122 - DNA, 25 bp, Mus musculus
ttgttggcagacttggccttcatgt

SEQ ID NO: 962123 - DNA, 25 bp, Mus musculus
ttgttggccagcaggtgacgctagc

SEQ ID NO: 962124 - DNA, 25 bp, Mus musculus
ttgttggccagctggtgacgctagc

SEQ ID NO: 962125 - DNA, 25 bp, Mus musculus
ttgttggccattctctcgaagcact

SEQ ID NO: 962126 - DNA, 25 bp, Mus musculus
ttgttggccattgtctcgaagcact

SEQ ID NO: 962127 - DNA, 25 bp, Mus musculus
ttgttggccctacaatcttcagtcc

SEQ ID NO: 962128 - DNA, 25 bp, Mus musculus
ttgttggccctagaatcttcagtcc

SEQ ID NO: 962129 - DNA, 25 bp, Mus musculus
ttgttggcctctatctccagctaac

SEQ ID NO: 962130 - DNA, 25 bp, Mus musculus
ttgttggcctctttctccagctaac

SEQ ID NO: 962131 - DNA, 25 bp, Mus musculus
ttgttggctggtatcattcccaccc

SEQ ID NO: 962132 - DNA, 25 bp, Mus musculus
ttgttggctggtttcattcccaccc

SEQ ID NO: 962133 - DNA, 25 bp, Mus musculus
ttgttggctgttactggtaccctat

SEQ ID NO: 962134 - DNA, 25 bp, Mus musculus
ttgttggctgtttctggtaccctat

SEQ ID NO: 962135 - DNA, 25 bp, Mus musculus
ttgttggctttaattactgctgcca

SEQ ID NO: 962136 - DNA, 25 bp, Mus musculus
ttgttggctttatttactgctgcca

SEQ ID NO: 962137 - DNA, 25 bp, Mus musculus
ttgttggctttcagaacactgagac

SEQ ID NO: 962138 - DNA, 25 bp, Mus musculus
ttgttggctttctgaacactgagac

SEQ ID NO: 962139 - DNA, 25 bp, Mus musculus
ttgttgggaccgagatggactttca

SEQ ID NO: 962140 - DNA, 25 bp, Mus musculus
ttgttgggaccgtgatggactttca

SEQ ID NO: 962141 - DNA, 25 bp, Mus musculus
ttgttgggagcccacacttagcaga

SEQ ID NO: 962142 - DNA, 25 bp, Mus musculus
ttgttgggagccgacacttagcaga

SEQ ID NO: 962143 - DNA, 25 bp, Mus musculus
ttgttgggcccaaagtagtcctgaa

SEQ ID NO: 962144 - DNA, 25 bp, Mus musculus
ttgttgggcccatagtagtcctgaa

SEQ ID NO: 962145 - DNA, 25 bp, Mus musculus
ttgttgggctacagcacgggcctga

SEQ ID NO: 962146 - DNA, 25 bp, Mus musculus
ttgttgggctactgcacgggcctga

SEQ ID NO: 962147 - DNA, 25 bp, Mus musculus
ttgttgggctagctggcatcccagc

SEQ ID NO: 962148 - DNA, 25 bp, Mus musculus
ttgttgggctaggtggcatcccagc

SEQ ID NO: 962149 - DNA, 25 bp, Mus musculus
ttgttggtagatcaatgcctatccc

SEQ ID NO: 962150 - DNA, 25 bp, Mus musculus
ttgttggtagatgaatgcctatccc

SEQ ID NO: 962151 - DNA, 25 bp, Mus musculus
ttgttggtatttatccttcagttag

SEQ ID NO: 962152 - DNA, 25 bp, Mus musculus
ttgttggtatttttccttcagttag

SEQ ID NO: 962153 - DNA, 25 bp, Mus musculus
ttgttggtccggaattgctggacat

SEQ ID NO: 962154 - DNA, 25 bp, Mus musculus
ttgttggtccggtattgctggacat

SEQ ID NO: 962155 - DNA, 25 bp, Mus musculus
ttgttggtctgacaattgatacacc

SEQ ID NO: 962156 - DNA, 25 bp, Mus musculus
ttgttggtctgagaattgatacacc

SEQ ID NO: 962157 - DNA, 25 bp, Mus musculus
ttgttggtgcctcctgcattgaaga

SEQ ID NO: 962158 - DNA, 25 bp, Mus musculus
ttgttggtgcctgctgcattgaaga

SEQ ID NO: 962159 - DNA, 25 bp, Mus musculus
ttgttggtgcttacacaagcgagtt

SEQ ID NO: 962160 - DNA, 25 bp, Mus musculus
ttgttggtgctttcacaagcgagtt

SEQ ID NO: 962161 - DNA, 25 bp, Mus musculus
ttgttggtggctctgctgcttactc

SEQ ID NO: 962162 - DNA, 25 bp, Mus musculus
ttgttggtggctgtgctgcttactc

SEQ ID NO: 962163 - DNA, 25 bp, Mus musculus
ttgttgtaacatccggtccccttca

SEQ ID NO: 962164 - DNA, 25 bp, Mus musculus
ttgttgtaacatgcggtccccttca

SEQ ID NO: 962165 - DNA, 25 bp, Mus musculus
ttgttgtaatggatttgctgtaaac

SEQ ID NO: 962166 - DNA, 25 bp, Mus musculus
ttgttgtaatggttttgctgtaaac

SEQ ID NO: 962167 - DNA, 25 bp, Mus musculus
ttgttgtacaagaaccaggtccaag

SEQ ID NO: 962168 - DNA, 25 bp, Mus musculus
ttgttgtacaagtaccaggtccaag

SEQ ID NO: 962169 - DNA, 25 bp, Mus musculus
ttgttgtacccaaagcggcaaggat

SEQ ID NO: 962170 - DNA, 25 bp, Mus musculus
ttgttgtacccatagcggcaaggat

SEQ ID NO: 962171 - DNA, 25 bp, Mus musculus
ttgttgtatcaacagtgaacactca

SEQ ID NO: 962172 - DNA, 25 bp, Mus musculus
ttgttgtatcaagagtgaacactca

SEQ ID NO: 962173 - DNA, 25 bp, Mus musculus
ttgttgtattgcattgcagcccacc

SEQ ID NO: 962174 - DNA, 25 bp, Mus musculus
ttgttgtattgctttgcagcccacc

SEQ ID NO: 962175 - DNA, 25 bp, Mus musculus
ttgttgtattgtagacgctgtcccc

SEQ ID NO: 962176 - DNA, 25 bp, Mus musculus
ttgttgtattgttgacgctgtcccc

SEQ ID NO: 962177 - DNA, 25 bp, Mus musculus
ttgttgtcaagcatgtaggacggtt

SEQ ID NO: 962178 - DNA, 25 bp, Mus musculus
ttgttgtcaagcttgtaggacggtt

SEQ ID NO: 962179 - DNA, 25 bp, Mus musculus
ttgttgtcatacagtctgtgccgat

SEQ ID NO: 962180 - DNA, 25 bp, Mus musculus
ttgttgtcatactgtctgtgccgat

SEQ ID NO: 962181 - DNA, 25 bp, Mus musculus
ttgttgtccactaatttgtgctccc

SEQ ID NO: 962182 - DNA, 25 bp, Mus musculus
ttgttgtccacttatttgtgctccc

SEQ ID NO: 962183 - DNA, 25 bp, Mus musculus
ttgttgtccagtctgccatgtagga

SEQ ID NO: 962184 - DNA, 25 bp, Mus musculus
ttgttgtccagtgtgccatgtagga

SEQ ID NO: 962185 - DNA, 25 bp, Mus musculus
ttgttgtccgaaacctcaaggctca

SEQ ID NO: 962186 - DNA, 25 bp, Mus musculus
ttgttgtccgaatcctcaaggctca

SEQ ID NO: 962187 - DNA, 25 bp, Mus musculus
ttgttgtccttgcttgaatctccaa

SEQ ID NO: 962188 - DNA, 25 bp, Mus musculus
ttgttgtccttggttgaatctccaa

SEQ ID NO: 962189 - DNA, 25 bp, Mus musculus
ttgttgtcggacacagtctacagga

SEQ ID NO: 962190 - DNA, 25 bp, Mus musculus
ttgttgtcggactcagtctacagga

SEQ ID NO: 962191 - DNA, 25 bp, Mus musculus
ttgttgtctgtcacatcaggacatg

SEQ ID NO: 962192 - DNA, 25 bp, Mus musculus
ttgttgtctgtctcatcaggacatg

SEQ ID NO: 962193 - DNA, 25 bp, Mus musculus
ttgttgtgaaccacacaggaaggtt

SEQ ID NO: 962194 - DNA, 25 bp, Mus musculus
ttgttgtgaacctcacaggaaggtt

SEQ ID NO: 962195 - DNA, 25 bp, Mus musculus
ttgttgtgagcccaatttctctgtg

SEQ ID NO: 962196 - DNA, 25 bp, Mus musculus
ttgttgtgagccgaatttctctgtg

SEQ ID NO: 962197 - DNA, 25 bp, Mus musculus
ttgttgtgtacccatggacccatag

SEQ ID NO: 962198 - DNA, 25 bp, Mus musculus
ttgttgtgtaccgatggacccatag

SEQ ID NO: 962199 - DNA, 25 bp, Mus musculus
ttgttgtgtgatatgaaagtctaac

SEQ ID NO: 962200 - DNA, 25 bp, Mus musculus
ttgttgtgtgatttgaaagtctaac

SEQ ID NO: 962201 - DNA, 25 bp, Mus musculus
ttgttgtgtgtgatacctgtataat

SEQ ID NO: 962202 - DNA, 25 bp, Mus musculus
ttgttgtgtgtgttacctgtataat

SEQ ID NO: 962203 - DNA, 25 bp, Mus musculus
ttgttgttactgatagtgaggctaa

SEQ ID NO: 962204 - DNA, 25 bp, Mus musculus
ttgttgttactgttagtgaggctaa

SEQ ID NO: 962205 - DNA, 25 bp, Mus musculus
ttgttgttattcatgttacaaggaa

SEQ ID NO: 962206 - DNA, 25 bp, Mus musculus
ttgttgttattcttgttacaaggaa

SEQ ID NO: 962207 - DNA, 25 bp, Mus musculus
ttgttgttcattacacttctgggtg

SEQ ID NO: 962208 - DNA, 25 bp, Mus musculus
ttgttgttcatttcacttctgggtg

SEQ ID NO: 962209 - DNA, 25 bp, Mus musculus
ttgttgttgcaaccagtgtctaagc

SEQ ID NO: 962210 - DNA, 25 bp, Mus musculus
ttgttgttgcaagcagtgtctaagc

SEQ ID NO: 962211 - DNA, 25 bp, Mus musculus
ttgttgttgcatactttgaggcaga

SEQ ID NO: 962212 - DNA, 25 bp, Mus musculus
ttgttgttgcattctttgaggcaga

SEQ ID NO: 962213 - DNA, 25 bp, Mus musculus
ttgttgttgcccaaagctcttctct

SEQ ID NO: 962214 - DNA, 25 bp, Mus musculus
ttgttgttgccctaagctcttctct

SEQ ID NO: 962215 - DNA, 25 bp, Mus musculus
ttgttgttggagcttaaaccccttg

SEQ ID NO: 962216 - DNA, 25 bp, Mus musculus
ttgttgttggaggttaaaccccttg

SEQ ID NO: 962217 - DNA, 25 bp, Mus musculus
ttgttgttgggccttcggatgcaat

SEQ ID NO: 962218 - DNA, 25 bp, Mus musculus
ttgttgttgggcgttcggatgcaat

SEQ ID NO: 962219 - DNA, 25 bp, Mus musculus
ttgttgttgtctctggttattcctt

SEQ ID NO: 962220 - DNA, 25 bp, Mus musculus
ttgttgttgtctgtggttattcctt

SEQ ID NO: 962221 - DNA, 25 bp, Mus musculus
ttgttgtttagcacgatggtggttt

SEQ ID NO: 962222 - DNA, 25 bp, Mus musculus
ttgttgtttagctcgatggtggttt

SEQ ID NO: 962223 - DNA, 25 bp, Mus musculus
ttgttgttttatcgcactcactata

SEQ ID NO: 962224 - DNA, 25 bp, Mus musculus
ttgttgttttatggcactcactata

SEQ ID NO: 962225 - DNA, 25 bp, Mus musculus
ttgttgttttggaagccctatccca

SEQ ID NO: 962226 - DNA, 25 bp, Mus musculus
ttgttgttttggtagccctatccca

SEQ ID NO: 962227 - DNA, 25 bp, Mus musculus
ttgtttaaacctaccactgttagag

SEQ ID NO: 962228 - DNA, 25 bp, Mus musculus
ttgtttaaaccttccactgttagag

SEQ ID NO: 962229 - DNA, 25 bp, Mus musculus
ttgtttaacactacctgccaaaata

SEQ ID NO: 962230 - DNA, 25 bp, Mus musculus
ttgtttaacacttcctgccaaaata

SEQ ID NO: 962231 - DNA, 25 bp, Mus musculus
ttgtttaaccacaccgtataacttg

SEQ ID NO: 962232 - DNA, 25 bp, Mus musculus
ttgtttaaccactccgtataacttg

SEQ ID NO: 962233 - DNA, 25 bp, Mus musculus
ttgtttaacccacagaagttttatg

SEQ ID NO: 962234 - DNA, 25 bp, Mus musculus
ttgtttaacccagagaagttttatg

SEQ ID NO: 962235 - DNA, 25 bp, Mus musculus
ttgtttaaccgccagaggagttgag

SEQ ID NO: 962236 - DNA, 25 bp, Mus musculus
ttgtttaaccgcgagaggagttgag

SEQ ID NO: 962237 - DNA, 25 bp, Mus musculus
ttgtttaacggcagtgtcatcccct

SEQ ID NO: 962238 - DNA, 25 bp, Mus musculus
ttgtttaacggctgtgtcatcccct

SEQ ID NO: 962239 - DNA, 25 bp, Mus musculus
ttgtttaactgtcaccatggtgtgt

SEQ ID NO: 962240 - DNA, 25 bp, Mus musculus
ttgtttaactgtgaccatggtgtgt

SEQ ID NO: 962241 - DNA, 25 bp, Mus musculus
ttgtttaacttcattgggtcagtgc

SEQ ID NO: 962242 - DNA, 25 bp, Mus musculus
ttgtttaacttctttgggtcagtgc

SEQ ID NO: 962243 - DNA, 25 bp, Mus musculus
ttgtttaagatcacctttatctttt

SEQ ID NO: 962244 - DNA, 25 bp, Mus musculus
ttgtttaagatctcctttatctttt

SEQ ID NO: 962245 - DNA, 25 bp, Mus musculus
ttgtttaatcagatctaagcccaaa

SEQ ID NO: 962246 - DNA, 25 bp, Mus musculus
ttgtttaatcagttctaagcccaaa

SEQ ID NO: 962247 - DNA, 25 bp, Mus musculus
ttgtttaattcaaaccgaggccctc

SEQ ID NO: 962248 - DNA, 25 bp, Mus musculus
ttgtttaattcataccgaggccctc

SEQ ID NO: 962249 - DNA, 25 bp, Mus musculus
ttgtttaattgcacttcctccatag

SEQ ID NO: 962250 - DNA, 25 bp, Mus musculus
ttgtttaattgctcttcctccatag

SEQ ID NO: 962251 - DNA, 25 bp, Mus musculus
ttgtttacactacccaatggagtag

SEQ ID NO: 962252 - DNA, 25 bp, Mus musculus
ttgtttacactagccaatggagtag

SEQ ID NO: 962253 - DNA, 25 bp, Mus musculus
ttgtttacacttctatgaccaggcc

SEQ ID NO: 962254 - DNA, 25 bp, Mus musculus
ttgtttacacttgtatgaccaggcc

SEQ ID NO: 962255 - DNA, 25 bp, Mus musculus
ttgtttacagttctggaagctgcag

SEQ ID NO: 962256 - DNA, 25 bp, Mus musculus
ttgtttacagttgtggaagctgcag

SEQ ID NO: 962257 - DNA, 25 bp, Mus musculus
ttgtttacatctcgagactgctcct

SEQ ID NO: 962258 - DNA, 25 bp, Mus musculus
ttgtttacatctggagactgctcct

SEQ ID NO: 962259 - DNA, 25 bp, Mus musculus
ttgtttagaattatccagccccatt

SEQ ID NO: 962260 - DNA, 25 bp, Mus musculus
ttgtttagaattttccagccccatt

SEQ ID NO: 962261 - DNA, 25 bp, Mus musculus
ttgtttagctccactggtaacgtca

SEQ ID NO: 962262 - DNA, 25 bp, Mus musculus
ttgtttagctcctctggtaacgtca

SEQ ID NO: 962263 - DNA, 25 bp, Mus musculus
ttgtttagctttactgcacctctgg

SEQ ID NO: 962264 - DNA, 25 bp, Mus musculus
ttgtttagcttttctgcacctctgg

SEQ ID NO: 962265 - DNA, 25 bp, Mus musculus
ttgtttagtcttctctcagatttta

SEQ ID NO: 962266 - DNA, 25 bp, Mus musculus
ttgtttagtcttgtctcagatttta

SEQ ID NO: 962267 - DNA, 25 bp, Mus musculus
ttgtttataactcatctcttgctac

SEQ ID NO: 962268 - DNA, 25 bp, Mus musculus
ttgtttataactgatctcttgctac

SEQ ID NO: 962269 - DNA, 25 bp, Mus musculus
ttgtttataatgacataccctgtaa

SEQ ID NO: 962270 - DNA, 25 bp, Mus musculus
ttgtttataatgtcataccctgtaa

SEQ ID NO: 962271 - DNA, 25 bp, Mus musculus
ttgtttatacccaaggccttatgtt

SEQ ID NO: 962272 - DNA, 25 bp, Mus musculus
ttgtttataccctaggccttatgtt

SEQ ID NO: 962273 - DNA, 25 bp, Mus musculus
ttgtttatagcccacagttcctcct

SEQ ID NO: 962274 - DNA, 25 bp, Mus musculus
ttgtttatagccgacagttcctcct

SEQ ID NO: 962275 - DNA, 25 bp, Mus musculus
ttgtttattttgagtaccaacataa

SEQ ID NO: 962276 - DNA, 25 bp, Mus musculus
ttgtttattttgtgtaccaacataa

SEQ ID NO: 962277 - DNA, 25 bp, Mus musculus
ttgtttcaacatatgcgctttgcat

SEQ ID NO: 962278 - DNA, 25 bp, Mus musculus
ttgtttcaacatttgcgctttgcat

SEQ ID NO: 962279 - DNA, 25 bp, Mus musculus
ttgtttcaccttagtatgtgatgta

SEQ ID NO: 962280 - DNA, 25 bp, Mus musculus
ttgtttcacctttgtatgtgatgta

SEQ ID NO: 962281 - DNA, 25 bp, Mus musculus
ttgtttcacttaaatccttccctgt

SEQ ID NO: 962282 - DNA, 25 bp, Mus musculus
ttgtttcacttatatccttccctgt

SEQ ID NO: 962283 - DNA, 25 bp, Mus musculus
ttgtttcagcggacttgtatctctc

SEQ ID NO: 962284 - DNA, 25 bp, Mus musculus
ttgtttcagcggtcttgtatctctc

SEQ ID NO: 962285 - DNA, 25 bp, Mus musculus
ttgtttcaggccacatgactcagtc

SEQ ID NO: 962286 - DNA, 25 bp, Mus musculus
ttgtttcaggcctcatgactcagtc

SEQ ID NO: 962287 - DNA, 25 bp, Mus musculus
ttgtttcagtttcgcatcttcatcc

SEQ ID NO: 962288 - DNA, 25 bp, Mus musculus
ttgtttcagtttggcatcttcatcc

SEQ ID NO: 962289 - DNA, 25 bp, Mus musculus
ttgtttcattctattggtcatgtat

SEQ ID NO: 962290 - DNA, 25 bp, Mus musculus
ttgtttcattcttttggtcatgtat

SEQ ID NO: 962291 - DNA, 25 bp, Mus musculus
ttgtttccaaaaacaatcgtctgac

SEQ ID NO: 962292 - DNA, 25 bp, Mus musculus
ttgtttccaaaatcaatcgtctgac

SEQ ID NO: 962293 - DNA, 25 bp, Mus musculus
ttgtttccaaatagtgcttgttgag

SEQ ID NO: 962294 - DNA, 25 bp, Mus musculus
ttgtttccaaattgtgcttgttgag

SEQ ID NO: 962295 - DNA, 25 bp, Mus musculus
ttgtttccaacaagccccagtcgtt

SEQ ID NO: 962296 - DNA, 25 bp, Mus musculus
ttgtttccaacatgccccagtcgtt

SEQ ID NO: 962297 - DNA, 25 bp, Mus musculus
ttgtttccacaaacagttcctgctg

SEQ ID NO: 962298 - DNA, 25 bp, Mus musculus
ttgtttccacaatcagttcctgctg

SEQ ID NO: 962299 - DNA, 25 bp, Mus musculus
ttgtttccacagctatctcttccat

SEQ ID NO: 962300 - DNA, 25 bp, Mus musculus
ttgtttccacaggtatctcttccat

SEQ ID NO: 962301 - DNA, 25 bp, Mus musculus
ttgtttccagagctctcctgtttat

SEQ ID NO: 962302 - DNA, 25 bp, Mus musculus
ttgtttccagaggtctcctgtttat

SEQ ID NO: 962303 - DNA, 25 bp, Mus musculus
ttgtttccaggcaaccagagttcca

SEQ ID NO: 962304 - DNA, 25 bp, Mus musculus
ttgtttccaggctaccagagttcca

SEQ ID NO: 962305 - DNA, 25 bp, Mus musculus
ttgtttccagtgaatcccattgcgg

SEQ ID NO: 962306 - DNA, 25 bp, Mus musculus
ttgtttccagtgtatcccattgcgg

SEQ ID NO: 962307 - DNA, 25 bp, Mus musculus
ttgtttcccaacacccaagtcaggt

SEQ ID NO: 962308 - DNA, 25 bp, Mus musculus
ttgtttcccaactcccaagtcaggt

SEQ ID NO: 962309 - DNA, 25 bp, Mus musculus
ttgtttccccaaagggtgatttgca

SEQ ID NO: 962310 - DNA, 25 bp, Mus musculus
ttgtttccccaaattcatcagtctc

SEQ ID NO: 962311 - DNA, 25 bp, Mus musculus
ttgtttccccaatgggtgatttgca

SEQ ID NO: 962312 - DNA, 25 bp, Mus musculus
ttgtttccccaatttcatcagtctc

SEQ ID NO: 962313 - DNA, 25 bp, Mus musculus
ttgtttccccaccagtgtcagtgtc

SEQ ID NO: 962314 - DNA, 25 bp, Mus musculus
ttgtttccccacgagtgtcagtgtc

SEQ ID NO: 962315 - DNA, 25 bp, Mus musculus
ttgtttccccatctttgttatagct

SEQ ID NO: 962316 - DNA, 25 bp, Mus musculus
ttgtttccccatgtttgttatagct

SEQ ID NO: 962317 - DNA, 25 bp, Mus musculus
ttgtttccccttatctaatgaaatg

SEQ ID NO: 962318 - DNA, 25 bp, Mus musculus
ttgtttccccttttctaatgaaatg

SEQ ID NO: 962319 - DNA, 25 bp, Mus musculus
ttgtttcccgagatactgtaaagaa

SEQ ID NO: 962320 - DNA, 25 bp, Mus musculus
ttgtttcccgagttactgtaaagaa

SEQ ID NO: 962321 - DNA, 25 bp, Mus musculus
ttgtttccctcaaagattctctgta

SEQ ID NO: 962322 - DNA, 25 bp, Mus musculus
ttgtttccctcatagattctctgta

SEQ ID NO: 962323 - DNA, 25 bp, Mus musculus
ttgtttccctccaagttcattatta

SEQ ID NO: 962324 - DNA, 25 bp, Mus musculus
ttgtttccctcctagttcattatta

SEQ ID NO: 962325 - DNA, 25 bp, Mus musculus
ttgtttcccttccattgcagtttgc

SEQ ID NO: 962326 - DNA, 25 bp, Mus musculus
ttgtttcccttcgattgcagtttgc

SEQ ID NO: 962327 - DNA, 25 bp, Mus musculus
ttgtttccgaggaattgcttccctt

SEQ ID NO: 962328 - DNA, 25 bp, Mus musculus
ttgtttccgaggtattgcttccctt

SEQ ID NO: 962329 - DNA, 25 bp, Mus musculus
ttgtttccggtcactgtgtgaccca

SEQ ID NO: 962330 - DNA, 25 bp, Mus musculus
ttgtttccggtctctgtgtgaccca

SEQ ID NO: 962331 - DNA, 25 bp, Mus musculus
ttgtttccgtctctggtaagcagct

SEQ ID NO: 962332 - DNA, 25 bp, Mus musculus
ttgtttccgtctgtggtaagcagct

SEQ ID NO: 962333 - DNA, 25 bp, Mus musculus
ttgtttcctaacagttctgttccct

SEQ ID NO: 962334 - DNA, 25 bp, Mus musculus
ttgtttcctaactgttctgttccct

SEQ ID NO: 962335 - DNA, 25 bp, Mus musculus
ttgtttcctctcaatcagagtatgt

SEQ ID NO: 962336 - DNA, 25 bp, Mus musculus
ttgtttcctctctatcagagtatgt

SEQ ID NO: 962337 - DNA, 25 bp, Mus musculus
ttgtttcctgacattgcccaagaac

SEQ ID NO: 962338 - DNA, 25 bp, Mus musculus
ttgtttcctgactttgcccaagaac

SEQ ID NO: 962339 - DNA, 25 bp, Mus musculus
ttgtttcctgatatgcagttgcttc

SEQ ID NO: 962340 - DNA, 25 bp, Mus musculus
ttgtttcctgatttgcagttgcttc

SEQ ID NO: 962341 - DNA, 25 bp, Mus musculus
ttgtttcctgcacctctctgttggg

SEQ ID NO: 962342 - DNA, 25 bp, Mus musculus
ttgtttcctgcagctctctgttggg

SEQ ID NO: 962343 - DNA, 25 bp, Mus musculus
ttgtttcctgggacctcaacagaaa

SEQ ID NO: 962344 - DNA, 25 bp, Mus musculus
ttgtttcctgggtcctcaacagaaa

SEQ ID NO: 962345 - DNA, 25 bp, Mus musculus
ttgtttccttacaaatcctcgcatg

SEQ ID NO: 962346 - DNA, 25 bp, Mus musculus
ttgtttccttactaatcctcgcatg

SEQ ID NO: 962347 - DNA, 25 bp, Mus musculus
ttgtttccttatcctgcatccttta

SEQ ID NO: 962348 - DNA, 25 bp, Mus musculus
ttgtttccttatgctgcatccttta

SEQ ID NO: 962349 - DNA, 25 bp, Mus musculus
ttgtttccttgacttgctccaccag

SEQ ID NO: 962350 - DNA, 25 bp, Mus musculus
ttgtttccttgagttgctccaccag

SEQ ID NO: 962351 - DNA, 25 bp, Mus musculus
ttgtttccttggagagcctgccatg

SEQ ID NO: 962352 - DNA, 25 bp, Mus musculus
ttgtttccttggtgagcctgccatg

SEQ ID NO: 962353 - DNA, 25 bp, Mus musculus
ttgtttcgcggtaacaagcgttgta

SEQ ID NO: 962354 - DNA, 25 bp, Mus musculus
ttgtttcgcggttacaagcgttgta

SEQ ID NO: 962355 - DNA, 25 bp, Mus musculus
ttgtttcgggacacctttatcatga

SEQ ID NO: 962356 - DNA, 25 bp, Mus musculus
ttgtttcgggactcctttatcatga

SEQ ID NO: 962357 - DNA, 25 bp, Mus musculus
ttgtttcgggccattctagctagta

SEQ ID NO: 962358 - DNA, 25 bp, Mus musculus
ttgtttcgggcctttctagctagta

SEQ ID NO: 962359 - DNA, 25 bp, Mus musculus
ttgtttcgtgataagttttccccat

SEQ ID NO: 962360 - DNA, 25 bp, Mus musculus
ttgtttcgtgattagttttccccat

SEQ ID NO: 962361 - DNA, 25 bp, Mus musculus
ttgtttctacataccttcaaggaga

SEQ ID NO: 962362 - DNA, 25 bp, Mus musculus
ttgtttctacattccttcaaggaga

SEQ ID NO: 962363 - DNA, 25 bp, Mus musculus
ttgtttctagaaatccagggtcttc

SEQ ID NO: 962364 - DNA, 25 bp, Mus musculus
ttgtttctagaattccagggtcttc

SEQ ID NO: 962365 - DNA, 25 bp, Mus musculus
ttgtttctagctattcactttatat

SEQ ID NO: 962366 - DNA, 25 bp, Mus musculus
ttgtttctagcttttcactttatat

SEQ ID NO: 962367 - DNA, 25 bp, Mus musculus
ttgtttctatgtaccttattcctga

SEQ ID NO: 962368 - DNA, 25 bp, Mus musculus
ttgtttctatgttccttattcctga

SEQ ID NO: 962369 - DNA, 25 bp, Mus musculus
ttgtttctcagtcttagtgtttccc

SEQ ID NO: 962370 - DNA, 25 bp, Mus musculus
ttgtttctcagtgttagtgtttccc

SEQ ID NO: 962371 - DNA, 25 bp, Mus musculus
ttgtttctccatatataaaccacag

SEQ ID NO: 962372 - DNA, 25 bp, Mus musculus
ttgtttctccatttataaaccacag

SEQ ID NO: 962373 - DNA, 25 bp, Mus musculus
ttgtttctctaaaatcggtccttat

SEQ ID NO: 962374 - DNA, 25 bp, Mus musculus
ttgtttctctaaatccaccatgtgg

SEQ ID NO: 962375 - DNA, 25 bp, Mus musculus
ttgtttctctaatatcggtccttat

SEQ ID NO: 962376 - DNA, 25 bp, Mus musculus
ttgtttctctaattccaccatgtgg

SEQ ID NO: 962377 - DNA, 25 bp, Mus musculus
ttgtttctctgcagtatgaaaagat

SEQ ID NO: 962378 - DNA, 25 bp, Mus musculus
ttgtttctctgctgtatgaaaagat

SEQ ID NO: 962379 - DNA, 25 bp, Mus musculus
ttgtttctgagaagtgtccaaatta

SEQ ID NO: 962380 - DNA, 25 bp, Mus musculus
ttgtttctgagatgtgtccaaatta

SEQ ID NO: 962381 - DNA, 25 bp, Mus musculus
ttgtttctggcgctttctttccctg

SEQ ID NO: 962382 - DNA, 25 bp, Mus musculus
ttgtttctggcggtttctttccctg

SEQ ID NO: 962383 - DNA, 25 bp, Mus musculus
ttgtttctggtcaagaagacccaca

SEQ ID NO: 962384 - DNA, 25 bp, Mus musculus
ttgtttctggtctagaagacccaca

SEQ ID NO: 962385 - DNA, 25 bp, Mus musculus
ttgtttctggttaagcctcaagggc

SEQ ID NO: 962386 - DNA, 25 bp, Mus musculus
ttgtttctggtttagcctcaagggc

SEQ ID NO: 962387 - DNA, 25 bp, Mus musculus
ttgtttctgtgaatgatgagcaaga

SEQ ID NO: 962388 - DNA, 25 bp, Mus musculus
ttgtttctgtgattgatgagcaaga

SEQ ID NO: 962389 - DNA, 25 bp, Mus musculus
ttgtttcttagcatctgtagctgct

SEQ ID NO: 962390 - DNA, 25 bp, Mus musculus
ttgtttcttagcttctgtagctgct

SEQ ID NO: 962391 - DNA, 25 bp, Mus musculus
ttgtttcttattacttccatccttc

SEQ ID NO: 962392 - DNA, 25 bp, Mus musculus
ttgtttcttatttcttccatccttc

SEQ ID NO: 962393 - DNA, 25 bp, Mus musculus
ttgtttcttctgatctaccaggctc

SEQ ID NO: 962394 - DNA, 25 bp, Mus musculus
ttgtttcttctgttctaccaggctc

SEQ ID NO: 962395 - DNA, 25 bp, Mus musculus
ttgtttcttgaaatctgcccttgaa

SEQ ID NO: 962396 - DNA, 25 bp, Mus musculus
ttgtttcttgaattctgcccttgaa

SEQ ID NO: 962397 - DNA, 25 bp, Mus musculus
ttgtttcttttaagttgctctctcg

SEQ ID NO: 962398 - DNA, 25 bp, Mus musculus
ttgtttcttttatgttgctctctcg

SEQ ID NO: 962399 - DNA, 25 bp, Mus musculus
ttgtttctttttcatggcccaaaat

SEQ ID NO: 962400 - DNA, 25 bp, Mus musculus
ttgtttctttttgatggcccaaaat

SEQ ID NO: 962401 - DNA, 25 bp, Mus musculus
ttgtttgaatcacccgacttcagca

SEQ ID NO: 962402 - DNA, 25 bp, Mus musculus
ttgtttgaatcagccgacttcagca

SEQ ID NO: 962403 - DNA, 25 bp, Mus musculus
ttgtttgacactcccctgttgatgc

SEQ ID NO: 962404 - DNA, 25 bp, Mus musculus
ttgtttgacactgccctgttgatgc

SEQ ID NO: 962405 - DNA, 25 bp, Mus musculus
ttgtttgacctgctggtacctatga

SEQ ID NO: 962406 - DNA, 25 bp, Mus musculus
ttgtttgacctggtggtacctatga

SEQ ID NO: 962407 - DNA, 25 bp, Mus musculus
ttgtttgagctcaccgttgtcaaca

SEQ ID NO: 962408 - DNA, 25 bp, Mus musculus
ttgtttgagctctccgttgtcaaca

SEQ ID NO: 962409 - DNA, 25 bp, Mus musculus
ttgtttgaggccaaccctaagctac

SEQ ID NO: 962410 - DNA, 25 bp, Mus musculus
ttgtttgaggcctaccctaagctac

SEQ ID NO: 962411 - DNA, 25 bp, Mus musculus
ttgtttgcaaacagggctccgaggc

SEQ ID NO: 962412 - DNA, 25 bp, Mus musculus
ttgtttgcaaactgggctccgaggc

SEQ ID NO: 962413 - DNA, 25 bp, Mus musculus
ttgtttgcaagacgagtatgtattc

SEQ ID NO: 962414 - DNA, 25 bp, Mus musculus
ttgtttgcaagaggagtatgtattc

SEQ ID NO: 962415 - DNA, 25 bp, Mus musculus
ttgtttgcagtgatgcttctggtga

SEQ ID NO: 962416 - DNA, 25 bp, Mus musculus
ttgtttgcagtgttgcttctggtga

SEQ ID NO: 962417 - DNA, 25 bp, Mus musculus
ttgtttgccaaaagagcagcacgcg

SEQ ID NO: 962418 - DNA, 25 bp, Mus musculus
ttgtttgccaaatgagcagcacgcg

SEQ ID NO: 962419 - DNA, 25 bp, Mus musculus
ttgtttgccacaccgatggagttgt

SEQ ID NO: 962420 - DNA, 25 bp, Mus musculus
ttgtttgccacagcgatggagttgt

SEQ ID NO: 962421 - DNA, 25 bp, Mus musculus
ttgtttgcctttagaccttctggaa

SEQ ID NO: 962422 - DNA, 25 bp, Mus musculus
ttgtttgccttttgaccttctggaa

SEQ ID NO: 962423 - DNA, 25 bp, Mus musculus
ttgtttgctatcagagtgtcccttc

SEQ ID NO: 962424 - DNA, 25 bp, Mus musculus
ttgtttgctatctgagtgtcccttc

SEQ ID NO: 962425 - DNA, 25 bp, Mus musculus
ttgtttgcttggctactacattaga

SEQ ID NO: 962426 - DNA, 25 bp, Mus musculus
ttgtttgcttgggtactacattaga

SEQ ID NO: 962427 - DNA, 25 bp, Mus musculus
ttgtttgctttcaaggttggctccc

SEQ ID NO: 962428 - DNA, 25 bp, Mus musculus
ttgtttgctttctaggttggctccc

SEQ ID NO: 962429 - DNA, 25 bp, Mus musculus
ttgtttggaggtacggctccctgcc

SEQ ID NO: 962430 - DNA, 25 bp, Mus musculus
ttgtttggaggttcggctccctgcc

SEQ ID NO: 962431 - DNA, 25 bp, Mus musculus
ttgtttggcactacattgtacagac

SEQ ID NO: 962432 - DNA, 25 bp, Mus musculus
ttgtttggcacttcattgtacagac

SEQ ID NO: 962433 - DNA, 25 bp, Mus musculus
ttgtttggccaaagcagcacagtat

SEQ ID NO: 962434 - DNA, 25 bp, Mus musculus
ttgtttggccaacggtttgcagtct

SEQ ID NO: 962435 - DNA, 25 bp, Mus musculus
ttgtttggccaagggtttgcagtct

SEQ ID NO: 962436 - DNA, 25 bp, Mus musculus
ttgtttggccaatgcagcacagtat

SEQ ID NO: 962437 - DNA, 25 bp, Mus musculus
ttgtttggccccatttcttacagtc

SEQ ID NO: 962438 - DNA, 25 bp, Mus musculus
ttgtttggccccttttcttacagtc

SEQ ID NO: 962439 - DNA, 25 bp, Mus musculus
ttgtttggctacagatgctgcctga

SEQ ID NO: 962440 - DNA, 25 bp, Mus musculus
ttgtttggctactgatgctgcctga

SEQ ID NO: 962441 - DNA, 25 bp, Mus musculus
ttgtttggtacactctcctttgcaa

SEQ ID NO: 962442 - DNA, 25 bp, Mus musculus
ttgtttggtacagtctcctttgcaa

SEQ ID NO: 962443 - DNA, 25 bp, Mus musculus
ttgtttgtaaatccttagacgcttg

SEQ ID NO: 962444 - DNA, 25 bp, Mus musculus
ttgtttgtaaatgcttagacgcttg

SEQ ID NO: 962445 - DNA, 25 bp, Mus musculus
ttgtttgtaaccattggccggttga

SEQ ID NO: 962446 - DNA, 25 bp, Mus musculus
ttgtttgtaacctttggccggttga

SEQ ID NO: 962447 - DNA, 25 bp, Mus musculus
ttgtttgtacagattccacatgtct

SEQ ID NO: 962448 - DNA, 25 bp, Mus musculus
ttgtttgtacagtttccacatgtct

SEQ ID NO: 962449 - DNA, 25 bp, Mus musculus
ttgtttgtatttcgctgctcacagc

SEQ ID NO: 962450 - DNA, 25 bp, Mus musculus
ttgtttgtatttggctgctcacagc

SEQ ID NO: 962451 - DNA, 25 bp, Mus musculus
ttgtttgtccaaatgtacctataaa

SEQ ID NO: 962452 - DNA, 25 bp, Mus musculus
ttgtttgtccaattgtacctataaa

SEQ ID NO: 962453 - DNA, 25 bp, Mus musculus
ttgtttgtctgactctagtcactgc

SEQ ID NO: 962454 - DNA, 25 bp, Mus musculus
ttgtttgtctgagtctagtcactgc

SEQ ID NO: 962455 - DNA, 25 bp, Mus musculus
ttgtttgtctttcccgcattgatgg

SEQ ID NO: 962456 - DNA, 25 bp, Mus musculus
ttgtttgtctttgccgcattgatgg

SEQ ID NO: 962457 - DNA, 25 bp, Mus musculus
ttgtttgtgaacactcggaataaca

SEQ ID NO: 962458 - DNA, 25 bp, Mus musculus
ttgtttgtgaactctcggaataaca

SEQ ID NO: 962459 - DNA, 25 bp, Mus musculus
ttgtttgtgcttacagtttgtgtac

SEQ ID NO: 962460 - DNA, 25 bp, Mus musculus
ttgtttgtgctttcagtttgtgtac

SEQ ID NO: 962461 - DNA, 25 bp, Mus musculus
ttgtttgtggttaggaaactttcag

SEQ ID NO: 962462 - DNA, 25 bp, Mus musculus
ttgtttgtggtttggaaactttcag

SEQ ID NO: 962463 - DNA, 25 bp, Mus musculus
ttgtttgtgtgactctcaactgtgg

SEQ ID NO: 962464 - DNA, 25 bp, Mus musculus
ttgtttgtgtgagtctcaactgtgg

SEQ ID NO: 962465 - DNA, 25 bp, Mus musculus
ttgtttgttaagagcaccttccccg

SEQ ID NO: 962466 - DNA, 25 bp, Mus musculus
ttgtttgttaagtgcaccttccccg

SEQ ID NO: 962467 - DNA, 25 bp, Mus musculus
ttgtttgttccaatcccatagttct

SEQ ID NO: 962468 - DNA, 25 bp, Mus musculus
ttgtttgttccattcccatagttct

SEQ ID NO: 962469 - DNA, 25 bp, Mus musculus
ttgtttgtttcacctgtcaatatat

SEQ ID NO: 962470 - DNA, 25 bp, Mus musculus
ttgtttgtttcagctgtcaatatat

SEQ ID NO: 962471 - DNA, 25 bp, Mus musculus
ttgtttgtttctactgaccagcttt

SEQ ID NO: 962472 - DNA, 25 bp, Mus musculus
ttgtttgtttcttctgaccagcttt

SEQ ID NO: 962473 - DNA, 25 bp, Mus musculus
ttgtttgttttccttctactttgtg

SEQ ID NO: 962474 - DNA, 25 bp, Mus musculus
ttgtttgttttcgttctactttgtg

SEQ ID NO: 962475 - DNA, 25 bp, Mus musculus
ttgttttaagataaactggcaggag

SEQ ID NO: 962476 - DNA, 25 bp, Mus musculus
ttgttttaagattaactggcaggag

SEQ ID NO: 962477 - DNA, 25 bp, Mus musculus
ttgttttaaggacgctgttggtact

SEQ ID NO: 962478 - DNA, 25 bp, Mus musculus
ttgttttaaggaggctgttggtact

SEQ ID NO: 962479 - DNA, 25 bp, Mus musculus
ttgttttaatcacaacctgggccgc

SEQ ID NO: 962480 - DNA, 25 bp, Mus musculus
ttgttttaatcagaacctgggccgc

SEQ ID NO: 962481 - DNA, 25 bp, Mus musculus
ttgttttacaatatgctgggtgact

SEQ ID NO: 962482 - DNA, 25 bp, Mus musculus
ttgttttacaatttgctgggtgact

SEQ ID NO: 962483 - DNA, 25 bp, Mus musculus
ttgttttacaggagagtggctcttt

SEQ ID NO: 962484 - DNA, 25 bp, Mus musculus
ttgttttacaggtgagtggctcttt

SEQ ID NO: 962485 - DNA, 25 bp, Mus musculus
ttgttttaccctatatgttcaccat

SEQ ID NO: 962486 - DNA, 25 bp, Mus musculus
ttgttttaccctttatgttcaccat

SEQ ID NO: 962487 - DNA, 25 bp, Mus musculus
ttgttttactacataatcttaactg

SEQ ID NO: 962488 - DNA, 25 bp, Mus musculus
ttgttttactacttaatcttaactg

SEQ ID NO: 962489 - DNA, 25 bp, Mus musculus
ttgttttagtcaccattgttctttg

SEQ ID NO: 962490 - DNA, 25 bp, Mus musculus
ttgttttagtcagcattgttctttg

SEQ ID NO: 962491 - DNA, 25 bp, Mus musculus
ttgttttagttcattgagctctcat

SEQ ID NO: 962492 - DNA, 25 bp, Mus musculus
ttgttttagttctttgagctctcat

SEQ ID NO: 962493 - DNA, 25 bp, Mus musculus
ttgttttatactcaccctgccagcg

SEQ ID NO: 962494 - DNA, 25 bp, Mus musculus
ttgttttatactgaccctgccagcg

SEQ ID NO: 962495 - DNA, 25 bp, Mus musculus
ttgttttattctaacctcctcccag

SEQ ID NO: 962496 - DNA, 25 bp, Mus musculus
ttgttttattcttacctcctcccag

SEQ ID NO: 962497 - DNA, 25 bp, Mus musculus
ttgttttcaaggaccagtggttttg

SEQ ID NO: 962498 - DNA, 25 bp, Mus musculus
ttgttttcaaggtccagtggttttg

SEQ ID NO: 962499 - DNA, 25 bp, Mus musculus
ttgttttcacctatctgactctttg

SEQ ID NO: 962500 - DNA, 25 bp, Mus musculus
ttgttttcacctttctgactctttg

SEQ ID NO: 962501 - DNA, 25 bp, Mus musculus
ttgttttcagggatcctagtttgtg

SEQ ID NO: 962502 - DNA, 25 bp, Mus musculus
ttgttttcagggttcctagtttgtg

SEQ ID NO: 962503 - DNA, 25 bp, Mus musculus
ttgttttcattgatgtagttagtca

SEQ ID NO: 962504 - DNA, 25 bp, Mus musculus
ttgttttcattgttgtagttagtca

SEQ ID NO: 962505 - DNA, 25 bp, Mus musculus
ttgttttccaaaacctgcttaaaag

SEQ ID NO: 962506 - DNA, 25 bp, Mus musculus
ttgttttccaaatcctgcttaaaag

SEQ ID NO: 962507 - DNA, 25 bp, Mus musculus
ttgttttccaatactagaggccctc

SEQ ID NO: 962508 - DNA, 25 bp, Mus musculus
ttgttttccaattctagaggccctc

SEQ ID NO: 962509 - DNA, 25 bp, Mus musculus
ttgttttccatgcatgcagaagtcc

SEQ ID NO: 962510 - DNA, 25 bp, Mus musculus
ttgttttccatggatgcagaagtcc

SEQ ID NO: 962511 - DNA, 25 bp, Mus musculus
ttgttttccccaagaaaggaggcag

SEQ ID NO: 962512 - DNA, 25 bp, Mus musculus
ttgttttccccatgaaaggaggcag

SEQ ID NO: 962513 - DNA, 25 bp, Mus musculus
ttgttttcccttatgtgcattttaa

SEQ ID NO: 962514 - DNA, 25 bp, Mus musculus
ttgttttcccttttgtgcattttaa

SEQ ID NO: 962515 - DNA, 25 bp, Mus musculus
ttgttttcctaaagacctgtgtccg

SEQ ID NO: 962516 - DNA, 25 bp, Mus musculus
ttgttttcctaatgacctgtgtccg

SEQ ID NO: 962517 - DNA, 25 bp, Mus musculus
ttgttttcctctagtgaccttcatt

SEQ ID NO: 962518 - DNA, 25 bp, Mus musculus
ttgttttcctctcaaccccgagatg

SEQ ID NO: 962519 - DNA, 25 bp, Mus musculus
ttgttttcctctgaaccccgagatg

SEQ ID NO: 962520 - DNA, 25 bp, Mus musculus
ttgttttcctcttgtgaccttcatt

SEQ ID NO: 962521 - DNA, 25 bp, Mus musculus
ttgttttcctggctatgtattcagt

SEQ ID NO: 962522 - DNA, 25 bp, Mus musculus
ttgttttcctggcttcaacctttgt

SEQ ID NO: 962523 - DNA, 25 bp, Mus musculus
ttgttttcctgggtatgtattcagt

SEQ ID NO: 962524 - DNA, 25 bp, Mus musculus
ttgttttcctgggttcaacctttgt

SEQ ID NO: 962525 - DNA, 25 bp, Mus musculus
ttgttttcctgtcacaacctcagta

SEQ ID NO: 962526 - DNA, 25 bp, Mus musculus
ttgttttcctgtgacaacctcagta

SEQ ID NO: 962527 - DNA, 25 bp, Mus musculus
ttgttttccttcaatccatgcttag

SEQ ID NO: 962528 - DNA, 25 bp, Mus musculus
ttgttttccttctatccatgcttag

SEQ ID NO: 962529 - DNA, 25 bp, Mus musculus
ttgttttctaacaaccttcaagtag

SEQ ID NO: 962530 - DNA, 25 bp, Mus musculus
ttgttttctaactaccttcaagtag

SEQ ID NO: 962531 - DNA, 25 bp, Mus musculus
ttgttttctaagacaccttcacgat

SEQ ID NO: 962532 - DNA, 25 bp, Mus musculus
ttgttttctaagtcaccttcacgat

SEQ ID NO: 962533 - DNA, 25 bp, Mus musculus
ttgttttctaccacctaaaactcag

SEQ ID NO: 962534 - DNA, 25 bp, Mus musculus
ttgttttctaccatatcttcccttg

SEQ ID NO: 962535 - DNA, 25 bp, Mus musculus
ttgttttctacctcctaaaactcag

SEQ ID NO: 962536 - DNA, 25 bp, Mus musculus
ttgttttctaccttatcttcccttg

SEQ ID NO: 962537 - DNA, 25 bp, Mus musculus
ttgttttctcagattggcagtatag

SEQ ID NO: 962538 - DNA, 25 bp, Mus musculus
ttgttttctcagtttggcagtatag

SEQ ID NO: 962539 - DNA, 25 bp, Mus musculus
ttgttttctcccaaatctctgtgca

SEQ ID NO: 962540 - DNA, 25 bp, Mus musculus
ttgttttctccctaatctctgtgca

SEQ ID NO: 962541 - DNA, 25 bp, Mus musculus
ttgttttctcttcagttaagctctc

SEQ ID NO: 962542 - DNA, 25 bp, Mus musculus
ttgttttctcttgagttaagctctc

SEQ ID NO: 962543 - DNA, 25 bp, Mus musculus
ttgttttctggaaagcctggcttcc

SEQ ID NO: 962544 - DNA, 25 bp, Mus musculus
ttgttttctggatagcctggcttcc

SEQ ID NO: 962545 - DNA, 25 bp, Mus musculus
ttgttttcttgtcgtccaatccctt

SEQ ID NO: 962546 - DNA, 25 bp, Mus musculus
ttgttttcttgtggtccaatccctt

SEQ ID NO: 962547 - DNA, 25 bp, Mus musculus
ttgttttctttgatggcttctctca

SEQ ID NO: 962548 - DNA, 25 bp, Mus musculus
ttgttttctttgttggcttctctca

SEQ ID NO: 962549 - DNA, 25 bp, Mus musculus
ttgttttgacatctcccatggcaga

SEQ ID NO: 962550 - DNA, 25 bp, Mus musculus
ttgttttgacatgtcccatggcaga

SEQ ID NO: 962551 - DNA, 25 bp, Mus musculus
ttgttttgagagactctgcctctgc

SEQ ID NO: 962552 - DNA, 25 bp, Mus musculus
ttgttttgagagtctctgcctctgc

SEQ ID NO: 962553 - DNA, 25 bp, Mus musculus
ttgttttgccgaattgcacattaaa

SEQ ID NO: 962554 - DNA, 25 bp, Mus musculus
ttgttttgccgatttgcacattaaa

SEQ ID NO: 962555 - DNA, 25 bp, Mus musculus
ttgttttgctccatgccaagtgatt

SEQ ID NO: 962556 - DNA, 25 bp, Mus musculus
ttgttttgctccttgccaagtgatt

SEQ ID NO: 962557 - DNA, 25 bp, Mus musculus
ttgttttgctcgatgcatgcattgt

SEQ ID NO: 962558 - DNA, 25 bp, Mus musculus
ttgttttgctcgttgcatgcattgt

SEQ ID NO: 962559 - DNA, 25 bp, Mus musculus
ttgttttgcttgaaccagggcctca

SEQ ID NO: 962560 - DNA, 25 bp, Mus musculus
ttgttttgcttgtaccagggcctca

SEQ ID NO: 962561 - DNA, 25 bp, Mus musculus
ttgttttggagtctttcctccctct

SEQ ID NO: 962562 - DNA, 25 bp, Mus musculus
ttgttttggagtgtttcctccctct

SEQ ID NO: 962563 - DNA, 25 bp, Mus musculus
ttgttttggtgtacctcgttctgat

SEQ ID NO: 962564 - DNA, 25 bp, Mus musculus
ttgttttggtgttcctcgttctgat

SEQ ID NO: 962565 - DNA, 25 bp, Mus musculus
ttgttttggttccataacccttctg

SEQ ID NO: 962566 - DNA, 25 bp, Mus musculus
ttgttttggttcgataacccttctg

SEQ ID NO: 962567 - DNA, 25 bp, Mus musculus
ttgttttgtctaactccccattttc

SEQ ID NO: 962568 - DNA, 25 bp, Mus musculus
ttgttttgtctatctccccattttc

SEQ ID NO: 962569 - DNA, 25 bp, Mus musculus
ttgttttgtggacttcaccgttact

SEQ ID NO: 962570 - DNA, 25 bp, Mus musculus
ttgttttgtggagttcaccgttact

SEQ ID NO: 962571 - DNA, 25 bp, Mus musculus
ttgttttgttatcctcatgcattta

SEQ ID NO: 962572 - DNA, 25 bp, Mus musculus
ttgttttgttatgctcatgcattta

SEQ ID NO: 962573 - DNA, 25 bp, Mus musculus
ttgttttgttgccttagccaagaaa

SEQ ID NO: 962574 - DNA, 25 bp, Mus musculus
ttgttttgttgcgttagccaagaaa

SEQ ID NO: 962575 - DNA, 25 bp, Mus musculus
ttgttttgttgtagtgtgctgctta

SEQ ID NO: 962576 - DNA, 25 bp, Mus musculus
ttgttttgttgtctaccccagactc

SEQ ID NO: 962577 - DNA, 25 bp, Mus musculus
ttgttttgttgtgtaccccagactc

SEQ ID NO: 962578 - DNA, 25 bp, Mus musculus
ttgttttgttgttgtgtgctgctta

SEQ ID NO: 962579 - DNA, 25 bp, Mus musculus
ttgttttgtttgaagctcagattat

SEQ ID NO: 962580 - DNA, 25 bp, Mus musculus
ttgttttgtttgtagctcagattat

SEQ ID NO: 962581 - DNA, 25 bp, Mus musculus
ttgtttttaacacgcagagtagtga

SEQ ID NO: 962582 - DNA, 25 bp, Mus musculus
ttgtttttaacaggcagagtagtga

SEQ ID NO: 962583 - DNA, 25 bp, Mus musculus
ttgtttttaactcgaacagttctct

SEQ ID NO: 962584 - DNA, 25 bp, Mus musculus
ttgtttttaactggaacagttctct

SEQ ID NO: 962585 - DNA, 25 bp, Mus musculus
ttgtttttaaggaaggcgctgtgcc

SEQ ID NO: 962586 - DNA, 25 bp, Mus musculus
ttgtttttaaggtaggcgctgtgcc

SEQ ID NO: 962587 - DNA, 25 bp, Mus musculus
ttgtttttaatgctgaaccctcggc

SEQ ID NO: 962588 - DNA, 25 bp, Mus musculus
ttgtttttaatggtgaaccctcggc

SEQ ID NO: 962589 - DNA, 25 bp, Mus musculus
ttgtttttacccacacactgtatgt

SEQ ID NO: 962590 - DNA, 25 bp, Mus musculus
ttgtttttaccctcacactgtatgt

SEQ ID NO: 962591 - DNA, 25 bp, Mus musculus
ttgtttttagcacacttggcttcag

SEQ ID NO: 962592 - DNA, 25 bp, Mus musculus
ttgtttttagcaccattcacccgtg

SEQ ID NO: 962593 - DNA, 25 bp, Mus musculus
ttgtttttagcagacttggcttcag

SEQ ID NO: 962594 - DNA, 25 bp, Mus musculus
ttgtttttagcagcattcacccgtg

SEQ ID NO: 962595 - DNA, 25 bp, Mus musculus
ttgtttttatgactgatggtacccc

SEQ ID NO: 962596 - DNA, 25 bp, Mus musculus
ttgtttttatgagtgatggtacccc

SEQ ID NO: 962597 - DNA, 25 bp, Mus musculus
ttgtttttcaaacgcccactgttca

SEQ ID NO: 962598 - DNA, 25 bp, Mus musculus
ttgtttttcaaaggcccactgttca

SEQ ID NO: 962599 - DNA, 25 bp, Mus musculus
ttgtttttcagcatcctctgcagtt

SEQ ID NO: 962600 - DNA, 25 bp, Mus musculus
ttgtttttcagcttcctctgcagtt

SEQ ID NO: 962601 - DNA, 25 bp, Mus musculus
ttgtttttcatcacagcggtggtgt

SEQ ID NO: 962602 - DNA, 25 bp, Mus musculus
ttgtttttcatctcagcggtggtgt

SEQ ID NO: 962603 - DNA, 25 bp, Mus musculus
ttgtttttccagaccctttcagaat

SEQ ID NO: 962604 - DNA, 25 bp, Mus musculus
ttgtttttccagtccctttcagaat

SEQ ID NO: 962605 - DNA, 25 bp, Mus musculus
ttgtttttcccaagagctcactctg

SEQ ID NO: 962606 - DNA, 25 bp, Mus musculus
ttgtttttcccatgagctcactctg

SEQ ID NO: 962607 - DNA, 25 bp, Mus musculus
ttgtttttccgtattagcagcaaga

SEQ ID NO: 962608 - DNA, 25 bp, Mus musculus
ttgtttttccgtctggtcatggtct

SEQ ID NO: 962609 - DNA, 25 bp, Mus musculus
ttgtttttccgtgtggtcatggtct

SEQ ID NO: 962610 - DNA, 25 bp, Mus musculus
ttgtttttccgttttagcagcaaga

SEQ ID NO: 962611 - DNA, 25 bp, Mus musculus
ttgtttttcctaccccagattccca

SEQ ID NO: 962612 - DNA, 25 bp, Mus musculus
ttgtttttcctagcccagattccca

SEQ ID NO: 962613 - DNA, 25 bp, Mus musculus
ttgtttttcctgacattccctaatt

SEQ ID NO: 962614 - DNA, 25 bp, Mus musculus
ttgtttttcctgtcattccctaatt

SEQ ID NO: 962615 - DNA, 25 bp, Mus musculus
ttgtttttctacctcccgcacttat

SEQ ID NO: 962616 - DNA, 25 bp, Mus musculus
ttgtttttctacgtcccgcacttat

SEQ ID NO: 962617 - DNA, 25 bp, Mus musculus
ttgtttttctccaatctagtgtaag

SEQ ID NO: 962618 - DNA, 25 bp, Mus musculus
ttgtttttctcctatctagtgtaag

SEQ ID NO: 962619 - DNA, 25 bp, Mus musculus
ttgtttttcttgaagtcatagactt

SEQ ID NO: 962620 - DNA, 25 bp, Mus musculus
ttgtttttcttgtagtcatagactt

SEQ ID NO: 962621 - DNA, 25 bp, Mus musculus
ttgtttttgaagagtctcgccccaa

SEQ ID NO: 962622 - DNA, 25 bp, Mus musculus
ttgtttttgaagatgtacatattga

SEQ ID NO: 962623 - DNA, 25 bp, Mus musculus
ttgtttttgaagtgtctcgccccaa

SEQ ID NO: 962624 - DNA, 25 bp, Mus musculus
ttgtttttgaagttgtacatattga

SEQ ID NO: 962625 - DNA, 25 bp, Mus musculus
ttgtttttgactagcctgattatga

SEQ ID NO: 962626 - DNA, 25 bp, Mus musculus
ttgtttttgacttgcctgattatga

SEQ ID NO: 962627 - DNA, 25 bp, Mus musculus
ttgtttttgatacctcatgcaccct

SEQ ID NO: 962628 - DNA, 25 bp, Mus musculus
ttgtttttgatagctcatgcaccct

SEQ ID NO: 962629 - DNA, 25 bp, Mus musculus
ttgtttttgcgactgtacacatagc

SEQ ID NO: 962630 - DNA, 25 bp, Mus musculus
ttgtttttgcgagtgtacacatagc

SEQ ID NO: 962631 - DNA, 25 bp, Mus musculus
ttgtttttgctacggtgactctctc

SEQ ID NO: 962632 - DNA, 25 bp, Mus musculus
ttgtttttgctagggtgactctctc

SEQ ID NO: 962633 - DNA, 25 bp, Mus musculus
ttgtttttggtacagagtctcagta

SEQ ID NO: 962634 - DNA, 25 bp, Mus musculus
ttgtttttggtagagagtctcagta

SEQ ID NO: 962635 - DNA, 25 bp, Mus musculus
ttgtttttgtcaagtgtttccacta

SEQ ID NO: 962636 - DNA, 25 bp, Mus musculus
ttgtttttgtcatgtgtttccacta

SEQ ID NO: 962637 - DNA, 25 bp, Mus musculus
ttgtttttgtctcaactgtagctaa

SEQ ID NO: 962638 - DNA, 25 bp, Mus musculus
ttgtttttgtctgaactgtagctaa

SEQ ID NO: 962639 - DNA, 25 bp, Mus musculus
ttgtttttgtggctatctgcctcat

SEQ ID NO: 962640 - DNA, 25 bp, Mus musculus
ttgtttttgtgggtatctgcctcat

SEQ ID NO: 962641 - DNA, 25 bp, Mus musculus
ttgtttttgtgtctccacgtggaat

SEQ ID NO: 962642 - DNA, 25 bp, Mus musculus
ttgtttttgtgtgtccacgtggaat

SEQ ID NO: 962643 - DNA, 25 bp, Mus musculus
ttgtttttgttcatgagggctggcc

SEQ ID NO: 962644 - DNA, 25 bp, Mus musculus
ttgtttttgttcttgagggctggcc

SEQ ID NO: 962645 - DNA, 25 bp, Mus musculus
ttgtttttgtttctcacccctcgat

SEQ ID NO: 962646 - DNA, 25 bp, Mus musculus
ttgtttttgtttgtcacccctcgat

SEQ ID NO: 962647 - DNA, 25 bp, Mus musculus
ttgttttttagcacccaggtacaat

SEQ ID NO: 962648 - DNA, 25 bp, Mus musculus
ttgttttttagctcccaggtacaat

SEQ ID NO: 962649 - DNA, 25 bp, Mus musculus
ttgttttttagtcacaggcttctcc

SEQ ID NO: 962650 - DNA, 25 bp, Mus musculus
ttgttttttagtgacaggcttctcc

SEQ ID NO: 962651 - DNA, 25 bp, Mus musculus
ttgttttttctcagccacaaaggct

SEQ ID NO: 962652 - DNA, 25 bp, Mus musculus
ttgttttttctctgccacaaaggct

SEQ ID NO: 962653 - DNA, 25 bp, Mus musculus
ttgttttttgcgactgacgggataa

SEQ ID NO: 962654 - DNA, 25 bp, Mus musculus
ttgttttttgcgtctgacgggataa

SEQ ID NO: 962655 - DNA, 25 bp, Mus musculus
ttgttttttgttacgaggctgggtg

SEQ ID NO: 962656 - DNA, 25 bp, Mus musculus
ttgttttttgtttcgaggctgggtg

SEQ ID NO: 962657 - DNA, 25 bp, Mus musculus
tttaaaaaacccatgcatctcctgc

SEQ ID NO: 962658 - DNA, 25 bp, Mus musculus
tttaaaaaacccttgcatctcctgc

SEQ ID NO: 962659 - DNA, 25 bp, Mus musculus
tttaaaaaccacacgacaccagcac

SEQ ID NO: 962660 - DNA, 25 bp, Mus musculus
tttaaaaaccactcgacaccagcac

SEQ ID NO: 962661 - DNA, 25 bp, Mus musculus
tttaaaaagtccatgtccctcccat

SEQ ID NO: 962662 - DNA, 25 bp, Mus musculus
tttaaaaagtccttgtccctcccat

SEQ ID NO: 962663 - DNA, 25 bp, Mus musculus
tttaaaaataggactgagcactggt

SEQ ID NO: 962664 - DNA, 25 bp, Mus musculus
tttaaaaataggtctgagcactggt

SEQ ID NO: 962665 - DNA, 25 bp, Mus musculus
tttaaaacaaccctcaacacatcca

SEQ ID NO: 962666 - DNA, 25 bp, Mus musculus
tttaaaacaaccgtcaacacatcca

SEQ ID NO: 962667 - DNA, 25 bp, Mus musculus
tttaaaacacccctagtcaatgcca

SEQ ID NO: 962668 - DNA, 25 bp, Mus musculus
tttaaaacacccgtagtcaatgcca

SEQ ID NO: 962669 - DNA, 25 bp, Mus musculus
tttaaaaccataattagctcacttt

SEQ ID NO: 962670 - DNA, 25 bp, Mus musculus
tttaaaaccatatttagctcacttt

SEQ ID NO: 962671 - DNA, 25 bp, Mus musculus
tttaaaaccgtgatgatcccactga

SEQ ID NO: 962672 - DNA, 25 bp, Mus musculus
tttaaaaccgtgttgatcccactga

SEQ ID NO: 962673 - DNA, 25 bp, Mus musculus
tttaaaacctaccagcttactctgg

SEQ ID NO: 962674 - DNA, 25 bp, Mus musculus
tttaaaacctacgagcttactctgg

SEQ ID NO: 962675 - DNA, 25 bp, Mus musculus
tttaaaactttgaggctagagctag

SEQ ID NO: 962676 - DNA, 25 bp, Mus musculus
tttaaaactttgtggctagagctag

SEQ ID NO: 962677 - DNA, 25 bp, Mus musculus
tttaaaacttttagcaaagcagcat

SEQ ID NO: 962678 - DNA, 25 bp, Mus musculus
tttaaaactttttgcaaagcagcat

SEQ ID NO: 962679 - DNA, 25 bp, Mus musculus
tttaaaagagtcactcccttgccat

SEQ ID NO: 962680 - DNA, 25 bp, Mus musculus
tttaaaagagtctctcccttgccat

SEQ ID NO: 962681 - DNA, 25 bp, Mus musculus
tttaaaagcagacccacccatgata

SEQ ID NO: 962682 - DNA, 25 bp, Mus musculus
tttaaaagcagagccacccatgata

SEQ ID NO: 962683 - DNA, 25 bp, Mus musculus
tttaaaagtcatcaaaggtgttgcc

SEQ ID NO: 962684 - DNA, 25 bp, Mus musculus
tttaaaagtcatgaaaggtgttgcc

SEQ ID NO: 962685 - DNA, 25 bp, Mus musculus
tttaaaagtctaactgggagtgcca

SEQ ID NO: 962686 - DNA, 25 bp, Mus musculus
tttaaaagtctatctgggagtgcca

SEQ ID NO: 962687 - DNA, 25 bp, Mus musculus
tttaaaatgaccaaaccatccctag

SEQ ID NO: 962688 - DNA, 25 bp, Mus musculus
tttaaaatgacctaaccatccctag

SEQ ID NO: 962689 - DNA, 25 bp, Mus musculus
tttaaaatgactcttcccagcaact

SEQ ID NO: 962690 - DNA, 25 bp, Mus musculus
tttaaaatgactgttcccagcaact

SEQ ID NO: 962691 - DNA, 25 bp, Mus musculus
tttaaaatgctcctacacctgtccg

SEQ ID NO: 962692 - DNA, 25 bp, Mus musculus
tttaaaatgctcgtacacctgtccg

SEQ ID NO: 962693 - DNA, 25 bp, Mus musculus
tttaaaattatcacacttgcacatg

SEQ ID NO: 962694 - DNA, 25 bp, Mus musculus
tttaaaattatctcacttgcacatg

SEQ ID NO: 962695 - DNA, 25 bp, Mus musculus
tttaaaattcagactatctgcttaa

SEQ ID NO: 962696 - DNA, 25 bp, Mus musculus
tttaaaattcagtctatctgcttaa

SEQ ID NO: 962697 - DNA, 25 bp, Mus musculus
tttaaaattgtgctctgcctccacc

SEQ ID NO: 962698 - DNA, 25 bp, Mus musculus
tttaaaattgtggtctgcctccacc

SEQ ID NO: 962699 - DNA, 25 bp, Mus musculus
tttaaacaaacacagcccagaccca

SEQ ID NO: 962700 - DNA, 25 bp, Mus musculus
tttaaacaaacagagcccagaccca

SEQ ID NO: 962701 - DNA, 25 bp, Mus musculus
tttaaacaattaacaccatgtggtg

SEQ ID NO: 962702 - DNA, 25 bp, Mus musculus
tttaaacaattatcaccatgtggtg

SEQ ID NO: 962703 - DNA, 25 bp, Mus musculus
tttaaacagacgacagattcaccct

SEQ ID NO: 962704 - DNA, 25 bp, Mus musculus
tttaaacagacgtcagattcaccct

SEQ ID NO: 962705 - DNA, 25 bp, Mus musculus
tttaaacagtacacacagagtccac

SEQ ID NO: 962706 - DNA, 25 bp, Mus musculus
tttaaacagtactcacagagtccac

SEQ ID NO: 962707 - DNA, 25 bp, Mus musculus
tttaaacattacctggcactgtgta

SEQ ID NO: 962708 - DNA, 25 bp, Mus musculus
tttaaacattacgtggcactgtgta

SEQ ID NO: 962709 - DNA, 25 bp, Mus musculus
tttaaacattcaattgcccacaggg

SEQ ID NO: 962710 - DNA, 25 bp, Mus musculus
tttaaacattcatttgcccacaggg

SEQ ID NO: 962711 - DNA, 25 bp, Mus musculus
tttaaaccacatactgcttgctttg

SEQ ID NO: 962712 - DNA, 25 bp, Mus musculus
tttaaaccacattctgcttgctttg

SEQ ID NO: 962713 - DNA, 25 bp, Mus musculus
tttaaaccatcgatgccagtcagat

SEQ ID NO: 962714 - DNA, 25 bp, Mus musculus
tttaaaccatcgttgccagtcagat

SEQ ID NO: 962715 - DNA, 25 bp, Mus musculus
tttaaacccagcatgcatgaggcag

SEQ ID NO: 962716 - DNA, 25 bp, Mus musculus
tttaaacccagcttgcatgaggcag

SEQ ID NO: 962717 - DNA, 25 bp, Mus musculus
tttaaaccctccagtgtgatcattg

SEQ ID NO: 962718 - DNA, 25 bp, Mus musculus
tttaaaccctcctgtgtgatcattg

SEQ ID NO: 962719 - DNA, 25 bp, Mus musculus
tttaaaccctgcctatttccatgct

SEQ ID NO: 962720 - DNA, 25 bp, Mus musculus
tttaaaccctgcgtatttccatgct

SEQ ID NO: 962721 - DNA, 25 bp, Mus musculus
tttaaacccttgctctctgaggcca

SEQ ID NO: 962722 - DNA, 25 bp, Mus musculus
tttaaacccttggtctctgaggcca

SEQ ID NO: 962723 - DNA, 25 bp, Mus musculus
tttaaacgctcacttagcctccagg

SEQ ID NO: 962724 - DNA, 25 bp, Mus musculus
tttaaacgctcagttagcctccagg

SEQ ID NO: 962725 - DNA, 25 bp, Mus musculus
tttaaacggctcactagcgccatat

SEQ ID NO: 962726 - DNA, 25 bp, Mus musculus
tttaaacggctctctagcgccatat

SEQ ID NO: 962727 - DNA, 25 bp, Mus musculus
tttaaactcacaaaggtcctcccat

SEQ ID NO: 962728 - DNA, 25 bp, Mus musculus
tttaaactcacataggtcctcccat

SEQ ID NO: 962729 - DNA, 25 bp, Mus musculus
tttaaactccacagtcacccagtga

SEQ ID NO: 962730 - DNA, 25 bp, Mus musculus
tttaaactccactgtcacccagtga

SEQ ID NO: 962731 - DNA, 25 bp, Mus musculus
tttaaactcgcccttggagcatgcc

SEQ ID NO: 962732 - DNA, 25 bp, Mus musculus
tttaaactcgccgttggagcatgcc

SEQ ID NO: 962733 - DNA, 25 bp, Mus musculus
tttaaactctctcctaaggacctgc

SEQ ID NO: 962734 - DNA, 25 bp, Mus musculus
tttaaactctctgctaaggacctgc

SEQ ID NO: 962735 - DNA, 25 bp, Mus musculus
tttaaactctgcaccatacacttgt

SEQ ID NO: 962736 - DNA, 25 bp, Mus musculus
tttaaactctgctccatacacttgt

SEQ ID NO: 962737 - DNA, 25 bp, Mus musculus
tttaaactggaccaaggctctcaga

SEQ ID NO: 962738 - DNA, 25 bp, Mus musculus
tttaaactggacgaaggctctcaga

SEQ ID NO: 962739 - DNA, 25 bp, Mus musculus
tttaaactgtacactggcttggaat

SEQ ID NO: 962740 - DNA, 25 bp, Mus musculus
tttaaactgtactctggcttggaat

SEQ ID NO: 962741 - DNA, 25 bp, Mus musculus
tttaaacttaagactcacatgcagt

SEQ ID NO: 962742 - DNA, 25 bp, Mus musculus
tttaaacttaagtctcacatgcagt

SEQ ID NO: 962743 - DNA, 25 bp, Mus musculus
tttaaacttcccaatctcaaacaag

SEQ ID NO: 962744 - DNA, 25 bp, Mus musculus
tttaaacttccctatctcaaacaag

SEQ ID NO: 962745 - DNA, 25 bp, Mus musculus
tttaaacttggcatgtgttctgtaa

SEQ ID NO: 962746 - DNA, 25 bp, Mus musculus
tttaaacttggcttgtgttctgtaa

SEQ ID NO: 962747 - DNA, 25 bp, Mus musculus
tttaaactttgcaaaccacatctag

SEQ ID NO: 962748 - DNA, 25 bp, Mus musculus
tttaaactttgctaaccacatctag

SEQ ID NO: 962749 - DNA, 25 bp, Mus musculus
tttaaacttttgattctctgtgaat

SEQ ID NO: 962750 - DNA, 25 bp, Mus musculus
tttaaacttttgtttctctgtgaat

SEQ ID NO: 962751 - DNA, 25 bp, Mus musculus
tttaaagacatccacgtccggcttc

SEQ ID NO: 962752 - DNA, 25 bp, Mus musculus
tttaaagacatcgacgtccggcttc

SEQ ID NO: 962753 - DNA, 25 bp, Mus musculus
tttaaagacccacctctctacactt

SEQ ID NO: 962754 - DNA, 25 bp, Mus musculus
tttaaagacccagctctctacactt

SEQ ID NO: 962755 - DNA, 25 bp, Mus musculus
tttaaagacgtaattattcacacac

SEQ ID NO: 962756 - DNA, 25 bp, Mus musculus
tttaaagacgtatttattcacacac

SEQ ID NO: 962757 - DNA, 25 bp, Mus musculus
tttaaagagactactggtcctttca

SEQ ID NO: 962758 - DNA, 25 bp, Mus musculus
tttaaagagacttctggtcctttca

SEQ ID NO: 962759 - DNA, 25 bp, Mus musculus
tttaaagagatcacctgcaatccta

SEQ ID NO: 962760 - DNA, 25 bp, Mus musculus
tttaaagagatctcctgcaatccta

SEQ ID NO: 962761 - DNA, 25 bp, Mus musculus
tttaaagagcccacatcctcaaatc

SEQ ID NO: 962762 - DNA, 25 bp, Mus musculus
tttaaagagccctcatcctcaaatc

SEQ ID NO: 962763 - DNA, 25 bp, Mus musculus
tttaaagagtctctctgtccaccaa

SEQ ID NO: 962764 - DNA, 25 bp, Mus musculus
tttaaagagtctgtctgtccaccaa

SEQ ID NO: 962765 - DNA, 25 bp, Mus musculus
tttaaagagttcatccaccatagta

SEQ ID NO: 962766 - DNA, 25 bp, Mus musculus
tttaaagagttcttccaccatagta

SEQ ID NO: 962767 - DNA, 25 bp, Mus musculus
tttaaagcaagtaagaacctctctg

SEQ ID NO: 962768 - DNA, 25 bp, Mus musculus
tttaaagcaagttagaacctctctg

SEQ ID NO: 962769 - DNA, 25 bp, Mus musculus
tttaaagcaggtagtctcctcagtt

SEQ ID NO: 962770 - DNA, 25 bp, Mus musculus
tttaaagcaggttgtctcctcagtt

SEQ ID NO: 962771 - DNA, 25 bp, Mus musculus
tttaaagcatctacgtcttccaggt

SEQ ID NO: 962772 - DNA, 25 bp, Mus musculus
tttaaagcatcttcgtcttccaggt

SEQ ID NO: 962773 - DNA, 25 bp, Mus musculus
tttaaagcatgcctccaagactgtc

SEQ ID NO: 962774 - DNA, 25 bp, Mus musculus
tttaaagcatgcgtccaagactgtc

SEQ ID NO: 962775 - DNA, 25 bp, Mus musculus
tttaaagccctgcttttactctctg

SEQ ID NO: 962776 - DNA, 25 bp, Mus musculus
tttaaagccctggttttactctctg

SEQ ID NO: 962777 - DNA, 25 bp, Mus musculus
tttaaagcctaaacggtgcctcatc

SEQ ID NO: 962778 - DNA, 25 bp, Mus musculus
tttaaagcctaatcggtgcctcatc

SEQ ID NO: 962779 - DNA, 25 bp, Mus musculus
tttaaagcctgactaattctgccct

SEQ ID NO: 962780 - DNA, 25 bp, Mus musculus
tttaaagcctgagtaattctgccct

SEQ ID NO: 962781 - DNA, 25 bp, Mus musculus
tttaaagcggctagctgctgtccaa

SEQ ID NO: 962782 - DNA, 25 bp, Mus musculus
tttaaagcggcttgctgctgtccaa

SEQ ID NO: 962783 - DNA, 25 bp, Mus musculus
tttaaagctaacattcgccgggcat

SEQ ID NO: 962784 - DNA, 25 bp, Mus musculus
tttaaagctaactttcgccgggcat

SEQ ID NO: 962785 - DNA, 25 bp, Mus musculus
tttaaagctactattcgccaccaca

SEQ ID NO: 962786 - DNA, 25 bp, Mus musculus
tttaaagctacttttcgccaccaca

SEQ ID NO: 962787 - DNA, 25 bp, Mus musculus
tttaaagctgagcacgcccgggaag

SEQ ID NO: 962788 - DNA, 25 bp, Mus musculus
tttaaagctgaggacgcccgggaag

SEQ ID NO: 962789 - DNA, 25 bp, Mus musculus
tttaaagcttggagcagtcactgca

SEQ ID NO: 962790 - DNA, 25 bp, Mus musculus
tttaaagcttggagctccggctctg

SEQ ID NO: 962791 - DNA, 25 bp, Mus musculus
tttaaagcttggtgcagtcactgca

SEQ ID NO: 962792 - DNA, 25 bp, Mus musculus
tttaaagcttggtgctccggctctg

SEQ ID NO: 962793 - DNA, 25 bp, Mus musculus
tttaaaggacagatagggcttcaag

SEQ ID NO: 962794 - DNA, 25 bp, Mus musculus
tttaaaggacagttagggcttcaag

SEQ ID NO: 962795 - DNA, 25 bp, Mus musculus
tttaaaggccacaatatgaccaatt

SEQ ID NO: 962796 - DNA, 25 bp, Mus musculus
tttaaaggccactatatgaccaatt

SEQ ID NO: 962797 - DNA, 25 bp, Mus musculus
tttaaaggccagctttcctggtcat

SEQ ID NO: 962798 - DNA, 25 bp, Mus musculus
tttaaaggccaggtttcctggtcat

SEQ ID NO: 962799 - DNA, 25 bp, Mus musculus
tttaaaggcgtgctcttgttcccgt

SEQ ID NO: 962800 - DNA, 25 bp, Mus musculus
tttaaaggcgtggtcttgttcccgt

SEQ ID NO: 962801 - DNA, 25 bp, Mus musculus
tttaaaggctgtctcgccctgtttt

SEQ ID NO: 962802 - DNA, 25 bp, Mus musculus
tttaaaggctgtgtcgccctgtttt

SEQ ID NO: 962803 - DNA, 25 bp, Mus musculus
tttaaagggcctcatccagcttggc

SEQ ID NO: 962804 - DNA, 25 bp, Mus musculus
tttaaagggcctgatccagcttggc

SEQ ID NO: 962805 - DNA, 25 bp, Mus musculus
tttaaagggtccatcacccactctg

SEQ ID NO: 962806 - DNA, 25 bp, Mus musculus
tttaaagggtccttcacccactctg

SEQ ID NO: 962807 - DNA, 25 bp, Mus musculus
tttaaaggtgccatgtgctggcctt

SEQ ID NO: 962808 - DNA, 25 bp, Mus musculus
tttaaaggtgccttgtgctggcctt

SEQ ID NO: 962809 - DNA, 25 bp, Mus musculus
tttaaaggtgttcgccggagctaca

SEQ ID NO: 962810 - DNA, 25 bp, Mus musculus
tttaaaggtgttggccggagctaca

SEQ ID NO: 962811 - DNA, 25 bp, Mus musculus
tttaaagtaacgcacgcagcgtgcc

SEQ ID NO: 962812 - DNA, 25 bp, Mus musculus
tttaaagtaacggacgcagcgtgcc

SEQ ID NO: 962813 - DNA, 25 bp, Mus musculus
tttaaagtacatactacttccaaat

SEQ ID NO: 962814 - DNA, 25 bp, Mus musculus
tttaaagtacattctacttccaaat

SEQ ID NO: 962815 - DNA, 25 bp, Mus musculus
tttaaagtcagtatagcctattatt

SEQ ID NO: 962816 - DNA, 25 bp, Mus musculus
tttaaagtcagtttagcctattatt

SEQ ID NO: 962817 - DNA, 25 bp, Mus musculus
tttaaagtcccgcatgcgagccctg

SEQ ID NO: 962818 - DNA, 25 bp, Mus musculus
tttaaagtcccggatgcgagccctg

SEQ ID NO: 962819 - DNA, 25 bp, Mus musculus
tttaaagtctttctgctcccagcgt

SEQ ID NO: 962820 - DNA, 25 bp, Mus musculus
tttaaagtctttgtgctcccagcgt

SEQ ID NO: 962821 - DNA, 25 bp, Mus musculus
tttaaagtgcccagtcttgctatat

SEQ ID NO: 962822 - DNA, 25 bp, Mus musculus
tttaaagtgccctgtcttgctatat

SEQ ID NO: 962823 - DNA, 25 bp, Mus musculus
tttaaagtgcttaccctgccaggac

SEQ ID NO: 962824 - DNA, 25 bp, Mus musculus
tttaaagtgcttcctcaagttccca

SEQ ID NO: 962825 - DNA, 25 bp, Mus musculus
tttaaagtgcttgctcaagttccca

SEQ ID NO: 962826 - DNA, 25 bp, Mus musculus
tttaaagtgctttccctgccaggac

SEQ ID NO: 962827 - DNA, 25 bp, Mus musculus
tttaaagttaggaggctctgggcag

SEQ ID NO: 962828 - DNA, 25 bp, Mus musculus
tttaaagttaggtggctctgggcag

SEQ ID NO: 962829 - DNA, 25 bp, Mus musculus
tttaaagttgtgaccactggataag

SEQ ID NO: 962830 - DNA, 25 bp, Mus musculus
tttaaagttgtgtccactggataag

SEQ ID NO: 962831 - DNA, 25 bp, Mus musculus
tttaaataatcccttcccatgagcc

SEQ ID NO: 962832 - DNA, 25 bp, Mus musculus
tttaaataatccgttcccatgagcc

SEQ ID NO: 962833 - DNA, 25 bp, Mus musculus
tttaaatacctaccacttagagcaa

SEQ ID NO: 962834 - DNA, 25 bp, Mus musculus
tttaaatacctagcacttagagcaa

SEQ ID NO: 962835 - DNA, 25 bp, Mus musculus
tttaaatagtgtccattcctcctct

SEQ ID NO: 962836 - DNA, 25 bp, Mus musculus
tttaaatagtgtgcattcctcctct

SEQ ID NO: 962837 - DNA, 25 bp, Mus musculus
tttaaatatcctatgtccatgtttt

SEQ ID NO: 962838 - DNA, 25 bp, Mus musculus
tttaaatatcctttgtccatgtttt

SEQ ID NO: 962839 - DNA, 25 bp, Mus musculus
tttaaatcaacaccctagcacgcta

SEQ ID NO: 962840 - DNA, 25 bp, Mus musculus
tttaaatcaacagcctagcacgcta

SEQ ID NO: 962841 - DNA, 25 bp, Mus musculus
tttaaatcaatcatcattatcttgc

SEQ ID NO: 962842 - DNA, 25 bp, Mus musculus
tttaaatcaatcttcattatcttgc

SEQ ID NO: 962843 - DNA, 25 bp, Mus musculus
tttaaatcactgagtttgctatttt

SEQ ID NO: 962844 - DNA, 25 bp, Mus musculus
tttaaatcactgtgtttgctatttt

SEQ ID NO: 962845 - DNA, 25 bp, Mus musculus
tttaaatccagtctgcgagccttcc

SEQ ID NO: 962846 - DNA, 25 bp, Mus musculus
tttaaatccagtgtgcgagccttcc

SEQ ID NO: 962847 - DNA, 25 bp, Mus musculus
tttaaatccatactctgtctgtctg

SEQ ID NO: 962848 - DNA, 25 bp, Mus musculus
tttaaatccatagtctgtctgtctg

SEQ ID NO: 962849 - DNA, 25 bp, Mus musculus
tttaaatcccaccacctggcagtat

SEQ ID NO: 962850 - DNA, 25 bp, Mus musculus
tttaaatcccacgacctggcagtat

SEQ ID NO: 962851 - DNA, 25 bp, Mus musculus
tttaaatccctcattaccagacact

SEQ ID NO: 962852 - DNA, 25 bp, Mus musculus
tttaaatccctctttaccagacact

SEQ ID NO: 962853 - DNA, 25 bp, Mus musculus
tttaaatcggatatgaatctcttgt

SEQ ID NO: 962854 - DNA, 25 bp, Mus musculus
tttaaatcggatttgaatctcttgt

SEQ ID NO: 962855 - DNA, 25 bp, Mus musculus
tttaaatcgtccaagcgcagtgcgc

SEQ ID NO: 962856 - DNA, 25 bp, Mus musculus
tttaaatcgtcctagcgcagtgcgc

SEQ ID NO: 962857 - DNA, 25 bp, Mus musculus
tttaaatctagccttactgcaccgg

SEQ ID NO: 962858 - DNA, 25 bp, Mus musculus
tttaaatctagcgttactgcaccgg

SEQ ID NO: 962859 - DNA, 25 bp, Mus musculus
tttaaatctcgtagttccctccgag

SEQ ID NO: 962860 - DNA, 25 bp, Mus musculus
tttaaatctcgttgttccctccgag

SEQ ID NO: 962861 - DNA, 25 bp, Mus musculus
tttaaatctctaatccttccttgtt

SEQ ID NO: 962862 - DNA, 25 bp, Mus musculus
tttaaatctctattccttccttgtt

SEQ ID NO: 962863 - DNA, 25 bp, Mus musculus
tttaaatctgtcactcagccttcag

SEQ ID NO: 962864 - DNA, 25 bp, Mus musculus
tttaaatctgtctctcagccttcag

SEQ ID NO: 962865 - DNA, 25 bp, Mus musculus
tttaaatgccctaacctctcccaag

SEQ ID NO: 962866 - DNA, 25 bp, Mus musculus
tttaaatgcccttacctctcccaag

SEQ ID NO: 962867 - DNA, 25 bp, Mus musculus
tttaaatggcagacaattcctcaca

SEQ ID NO: 962868 - DNA, 25 bp, Mus musculus
tttaaatggcagtcaattcctcaca

SEQ ID NO: 962869 - DNA, 25 bp, Mus musculus
tttaaatgtgtacgtaagcaggcta

SEQ ID NO: 962870 - DNA, 25 bp, Mus musculus
tttaaatgtgtaggtaagcaggcta

SEQ ID NO: 962871 - DNA, 25 bp, Mus musculus
tttaaatgttctctgtttgtatctg

SEQ ID NO: 962872 - DNA, 25 bp, Mus musculus
tttaaatgttctgtgtttgtatctg

SEQ ID NO: 962873 - DNA, 25 bp, Mus musculus
tttaaattactgctgttacacctcc

SEQ ID NO: 962874 - DNA, 25 bp, Mus musculus
tttaaattactggtgttacacctcc

SEQ ID NO: 962875 - DNA, 25 bp, Mus musculus
tttaaattattgactgcagttcatt

SEQ ID NO: 962876 - DNA, 25 bp, Mus musculus
tttaaattattgtctgcagttcatt

SEQ ID NO: 962877 - DNA, 25 bp, Mus musculus
tttaaattccctctgatgtgtgttt

SEQ ID NO: 962878 - DNA, 25 bp, Mus musculus
tttaaattccctgtgatgtgtgttt

SEQ ID NO: 962879 - DNA, 25 bp, Mus musculus
tttaaattctatccccatcaagtgt

SEQ ID NO: 962880 - DNA, 25 bp, Mus musculus
tttaaattctatgcccatcaagtgt

SEQ ID NO: 962881 - DNA, 25 bp, Mus musculus
tttaaattctcaatctatgtctcag

SEQ ID NO: 962882 - DNA, 25 bp, Mus musculus
tttaaattctcattctatgtctcag

SEQ ID NO: 962883 - DNA, 25 bp, Mus musculus
tttaaattgtcactaggctcttctt

SEQ ID NO: 962884 - DNA, 25 bp, Mus musculus
tttaaattgtcagtaggctcttctt

SEQ ID NO: 962885 - DNA, 25 bp, Mus musculus
tttaaattgtttcaggatcgccctc

SEQ ID NO: 962886 - DNA, 25 bp, Mus musculus
tttaaattgtttgaggatcgccctc

SEQ ID NO: 962887 - DNA, 25 bp, Mus musculus
tttaacaaaactattttctggtgct

SEQ ID NO: 962888 - DNA, 25 bp, Mus musculus
tttaacaaaacttttttctggtgct

SEQ ID NO: 962889 - DNA, 25 bp, Mus musculus
tttaacaatccgacttttctccttg

SEQ ID NO: 962890 - DNA, 25 bp, Mus musculus
tttaacaatccgtcttttctccttg

SEQ ID NO: 962891 - DNA, 25 bp, Mus musculus
tttaacaattggctcctgcccatgt

SEQ ID NO: 962892 - DNA, 25 bp, Mus musculus
tttaacaattgggtcctgcccatgt

SEQ ID NO: 962893 - DNA, 25 bp, Mus musculus
tttaacacacttaccattccttctg

SEQ ID NO: 962894 - DNA, 25 bp, Mus musculus
tttaacacactttccattccttctg

SEQ ID NO: 962895 - DNA, 25 bp, Mus musculus
tttaacaccaccaagtcaagagctt

SEQ ID NO: 962896 - DNA, 25 bp, Mus musculus
tttaacaccacctagtcaagagctt

SEQ ID NO: 962897 - DNA, 25 bp, Mus musculus
tttaacacctccataaagcctctat

SEQ ID NO: 962898 - DNA, 25 bp, Mus musculus
tttaacacctccttaaagcctctat

SEQ ID NO: 962899 - DNA, 25 bp, Mus musculus
tttaacacgtctatccatgctggga

SEQ ID NO: 962900 - DNA, 25 bp, Mus musculus
tttaacacgtctttccatgctggga

SEQ ID NO: 962901 - DNA, 25 bp, Mus musculus
tttaacactccgattccggcaggat

SEQ ID NO: 962902 - DNA, 25 bp, Mus musculus
tttaacactccgtttccggcaggat

SEQ ID NO: 962903 - DNA, 25 bp, Mus musculus
tttaacagaagcaccgtcctcatca

SEQ ID NO: 962904 - DNA, 25 bp, Mus musculus
tttaacagaagctccgtcctcatca

SEQ ID NO: 962905 - DNA, 25 bp, Mus musculus
tttaacagaccacgagtgactcttc

SEQ ID NO: 962906 - DNA, 25 bp, Mus musculus
tttaacagaccaggagtgactcttc

SEQ ID NO: 962907 - DNA, 25 bp, Mus musculus
tttaacagcctcattttccttcttg

SEQ ID NO: 962908 - DNA, 25 bp, Mus musculus
tttaacagcctctttttccttcttg

SEQ ID NO: 962909 - DNA, 25 bp, Mus musculus
tttaacagctttaagtacggagagt

SEQ ID NO: 962910 - DNA, 25 bp, Mus musculus
tttaacagcttttagtacggagagt

SEQ ID NO: 962911 - DNA, 25 bp, Mus musculus
tttaacagtgtcaatctccagagat

SEQ ID NO: 962912 - DNA, 25 bp, Mus musculus
tttaacagtgtctatctccagagat

SEQ ID NO: 962913 - DNA, 25 bp, Mus musculus
tttaacagttgcatcttattttcct

SEQ ID NO: 962914 - DNA, 25 bp, Mus musculus
tttaacagttgcttcttattttcct

SEQ ID NO: 962915 - DNA, 25 bp, Mus musculus
tttaacatataaaccacagtacatt

SEQ ID NO: 962916 - DNA, 25 bp, Mus musculus
tttaacatataatccacagtacatt

SEQ ID NO: 962917 - DNA, 25 bp, Mus musculus
tttaacatgaagactgtgtatctca

SEQ ID NO: 962918 - DNA, 25 bp, Mus musculus
tttaacatgaagactgtgtttctca

SEQ ID NO: 962919 - DNA, 25 bp, Mus musculus
tttaacatgaagtctgtgtatctca

SEQ ID NO: 962920 - DNA, 25 bp, Mus musculus
tttaacatgaagtctgtgtttctca

SEQ ID NO: 962921 - DNA, 25 bp, Mus musculus
tttaacatgcttcttggaggtcacc

SEQ ID NO: 962922 - DNA, 25 bp, Mus musculus
tttaacatgcttgttggaggtcacc

SEQ ID NO: 962923 - DNA, 25 bp, Mus musculus
tttaacattacaaccctcaactctt

SEQ ID NO: 962924 - DNA, 25 bp, Mus musculus
tttaacattacatccctcaactctt

SEQ ID NO: 962925 - DNA, 25 bp, Mus musculus
tttaacattcccattctgtacttgg

SEQ ID NO: 962926 - DNA, 25 bp, Mus musculus
tttaacattccctttctgtacttgg

SEQ ID NO: 962927 - DNA, 25 bp, Mus musculus
tttaacatttgaacgcaactctggc

SEQ ID NO: 962928 - DNA, 25 bp, Mus musculus
tttaacatttgatcgcaactctggc

SEQ ID NO: 962929 - DNA, 25 bp, Mus musculus
tttaaccaaatacctcctcagtaat

SEQ ID NO: 962930 - DNA, 25 bp, Mus musculus
tttaaccaaatagctcctcagtaat

SEQ ID NO: 962931 - DNA, 25 bp, Mus musculus
tttaaccaagagacgggagccctca

SEQ ID NO: 962932 - DNA, 25 bp, Mus musculus
tttaaccaagagtcgggagccctca

SEQ ID NO: 962933 - DNA, 25 bp, Mus musculus
tttaaccaagccaattcttaacttg

SEQ ID NO: 962934 - DNA, 25 bp, Mus musculus
tttaaccaagcctattcttaacttg

SEQ ID NO: 962935 - DNA, 25 bp, Mus musculus
tttaaccacaccaacgtctgctaag

SEQ ID NO: 962936 - DNA, 25 bp, Mus musculus
tttaaccacacctacgtctgctaag

SEQ ID NO: 962937 - DNA, 25 bp, Mus musculus
tttaaccacagcacttagaagacag

SEQ ID NO: 962938 - DNA, 25 bp, Mus musculus
tttaaccacagctcttagaagacag

SEQ ID NO: 962939 - DNA, 25 bp, Mus musculus
tttaaccacagtcggttccctgaca

SEQ ID NO: 962940 - DNA, 25 bp, Mus musculus
tttaaccacagtgggttccctgaca

SEQ ID NO: 962941 - DNA, 25 bp, Mus musculus
tttaaccaccagacttacagaggga

SEQ ID NO: 962942 - DNA, 25 bp, Mus musculus
tttaaccaccagtcttacagaggga

SEQ ID NO: 962943 - DNA, 25 bp, Mus musculus
tttaaccacttgagtgtggagcctc

SEQ ID NO: 962944 - DNA, 25 bp, Mus musculus
tttaaccacttgtgtgtggagcctc

SEQ ID NO: 962945 - DNA, 25 bp, Mus musculus
tttaaccagcagaacgcagagcagc

SEQ ID NO: 962946 - DNA, 25 bp, Mus musculus
tttaaccagcagtacgcagagcagc

SEQ ID NO: 962947 - DNA, 25 bp, Mus musculus
tttaaccagggcaacactatatatt

SEQ ID NO: 962948 - DNA, 25 bp, Mus musculus
tttaaccagggctacactatatatt

SEQ ID NO: 962949 - DNA, 25 bp, Mus musculus
tttaaccatcatatatagacatcaa

SEQ ID NO: 962950 - DNA, 25 bp, Mus musculus
tttaaccatcatcccctgtttgcaa

SEQ ID NO: 962951 - DNA, 25 bp, Mus musculus
tttaaccatcatgccctgtttgcaa

SEQ ID NO: 962952 - DNA, 25 bp, Mus musculus
tttaaccatcatttatagacatcaa

SEQ ID NO: 962953 - DNA, 25 bp, Mus musculus
tttaacccacacatgctgtactttg

SEQ ID NO: 962954 - DNA, 25 bp, Mus musculus
tttaacccacacttgctgtactttg

SEQ ID NO: 962955 - DNA, 25 bp, Mus musculus
tttaacccacataagcgaatctctg

SEQ ID NO: 962956 - DNA, 25 bp, Mus musculus
tttaacccacattagcgaatctctg

SEQ ID NO: 962957 - DNA, 25 bp, Mus musculus
tttaaccccagcagatggccggcag

SEQ ID NO: 962958 - DNA, 25 bp, Mus musculus
tttaaccccagctgatggccggcag

SEQ ID NO: 962959 - DNA, 25 bp, Mus musculus
tttaaccccatgaaagagtctagat

SEQ ID NO: 962960 - DNA, 25 bp, Mus musculus
tttaaccccatgtaagagtctagat

SEQ ID NO: 962961 - DNA, 25 bp, Mus musculus
tttaaccccgctaagcaaagctcgc

SEQ ID NO: 962962 - DNA, 25 bp, Mus musculus
tttaaccccgcttagcaaagctcgc

SEQ ID NO: 962963 - DNA, 25 bp, Mus musculus
tttaaccccgtaagaaacagcactg

SEQ ID NO: 962964 - DNA, 25 bp, Mus musculus
tttaaccccgtatgaaacagcactg

SEQ ID NO: 962965 - DNA, 25 bp, Mus musculus
tttaacccctgacggcgcttgttca

SEQ ID NO: 962966 - DNA, 25 bp, Mus musculus
tttaacccctgagggcgcttgttca

SEQ ID NO: 962967 - DNA, 25 bp, Mus musculus
tttaacccggcgatctcaggatgac

SEQ ID NO: 962968 - DNA, 25 bp, Mus musculus
tttaacccggcgttctcaggatgac

SEQ ID NO: 962969 - DNA, 25 bp, Mus musculus
tttaaccctaacactaaccatgctc

SEQ ID NO: 962970 - DNA, 25 bp, Mus musculus
tttaaccctaactctaaccatgctc

SEQ ID NO: 962971 - DNA, 25 bp, Mus musculus
tttaaccctaatctggctggaccag

SEQ ID NO: 962972 - DNA, 25 bp, Mus musculus
tttaaccctaatgtggctggaccag

SEQ ID NO: 962973 - DNA, 25 bp, Mus musculus
tttaaccctcaaaacaatttcactt

SEQ ID NO: 962974 - DNA, 25 bp, Mus musculus
tttaaccctcaaattgcccaagcat

SEQ ID NO: 962975 - DNA, 25 bp, Mus musculus
tttaaccctcaatacaatttcactt

SEQ ID NO: 962976 - DNA, 25 bp, Mus musculus
tttaaccctcaatttgcccaagcat

SEQ ID NO: 962977 - DNA, 25 bp, Mus musculus
tttaaccctcgcatcgatgaatcca

SEQ ID NO: 962978 - DNA, 25 bp, Mus musculus
tttaaccctcgcttcgatgaatcca

SEQ ID NO: 962979 - DNA, 25 bp, Mus musculus
tttaacccttgaacgggctgaaagg

SEQ ID NO: 962980 - DNA, 25 bp, Mus musculus
tttaacccttgacaggatgttccca

SEQ ID NO: 962981 - DNA, 25 bp, Mus musculus
tttaacccttgagaggatgttccca

SEQ ID NO: 962982 - DNA, 25 bp, Mus musculus
tttaacccttgatcgggctgaaagg

SEQ ID NO: 962983 - DNA, 25 bp, Mus musculus
tttaaccgaggccaccaatgaattg

SEQ ID NO: 962984 - DNA, 25 bp, Mus musculus
tttaaccgaggcgaccaatgaattg

SEQ ID NO: 962985 - DNA, 25 bp, Mus musculus
tttaaccgtgctaactgtcaagtgc

SEQ ID NO: 962986 - DNA, 25 bp, Mus musculus
tttaaccgtgcttactgtcaagtgc

SEQ ID NO: 962987 - DNA, 25 bp, Mus musculus
tttaacctaaccctgaggctgagga

SEQ ID NO: 962988 - DNA, 25 bp, Mus musculus
tttaacctaaccgtgaggctgagga

SEQ ID NO: 962989 - DNA, 25 bp, Mus musculus
tttaacctcagtctgaacacctacc

SEQ ID NO: 962990 - DNA, 25 bp, Mus musculus
tttaacctcagtgtgaacacctacc

SEQ ID NO: 962991 - DNA, 25 bp, Mus musculus
tttaacctccaaagcagtaactgca

SEQ ID NO: 962992 - DNA, 25 bp, Mus musculus
tttaacctccaatgcagtaactgca

SEQ ID NO: 962993 - DNA, 25 bp, Mus musculus
tttaacctcggacctgtgacctttg

SEQ ID NO: 962994 - DNA, 25 bp, Mus musculus
tttaacctcggagctgtgacctttg

SEQ ID NO: 962995 - DNA, 25 bp, Mus musculus
tttaacctctgaccctcaggagaaa

SEQ ID NO: 962996 - DNA, 25 bp, Mus musculus
tttaacctctgagcctcaggagaaa

SEQ ID NO: 962997 - DNA, 25 bp, Mus musculus
tttaacctcttaactcgaacattag

SEQ ID NO: 962998 - DNA, 25 bp, Mus musculus
tttaacctcttatctcgaacattag

SEQ ID NO: 962999 - DNA, 25 bp, Mus musculus
tttaaccttaccatctcatggccca

SEQ ID NO: 963000 - DNA, 25 bp, Mus musculus
tttaaccttaccttctcatggccca

SEQ ID NO: 963001 - DNA, 25 bp, Mus musculus
tttaaccttaggctacagaccacta

SEQ ID NO: 963002 - DNA, 25 bp, Mus musculus
tttaaccttagggtacagaccacta

SEQ ID NO: 963003 - DNA, 25 bp, Mus musculus
tttaaccttgacattgtatagctca

SEQ ID NO: 963004 - DNA, 25 bp, Mus musculus
tttaaccttgactttgtatagctca

SEQ ID NO: 963005 - DNA, 25 bp, Mus musculus
tttaacctttgtacacaccagggat

SEQ ID NO: 963006 - DNA, 25 bp, Mus musculus
tttaacctttgttcacaccagggat

SEQ ID NO: 963007 - DNA, 25 bp, Mus musculus
tttaacgcctttcctatctgtacca

SEQ ID NO: 963008 - DNA, 25 bp, Mus musculus
tttaacgcctttgctatctgtacca

SEQ ID NO: 963009 - DNA, 25 bp, Mus musculus
tttaacggaaggatcattcacctac

SEQ ID NO: 963010 - DNA, 25 bp, Mus musculus
tttaacggaaggttcattcacctac

SEQ ID NO: 963011 - DNA, 25 bp, Mus musculus
tttaacggagttcaccagcacacct

SEQ ID NO: 963012 - DNA, 25 bp, Mus musculus
tttaacggagttgaccagcacacct

SEQ ID NO: 963013 - DNA, 25 bp, Mus musculus
tttaacggcagtctcatcccctttg

SEQ ID NO: 963014 - DNA, 25 bp, Mus musculus
tttaacggcagtgtcatcccctttg

SEQ ID NO: 963015 - DNA, 25 bp, Mus musculus
tttaacgtctctcgaagcactgttg

SEQ ID NO: 963016 - DNA, 25 bp, Mus musculus
tttaacgtctctggaagcactgttg

SEQ ID NO: 963017 - DNA, 25 bp, Mus musculus
tttaacgtgatgcattcactcccac

SEQ ID NO: 963018 - DNA, 25 bp, Mus musculus
tttaacgtgatggattcactcccac

SEQ ID NO: 963019 - DNA, 25 bp, Mus musculus
tttaacgtttggctgccaagaagtg

SEQ ID NO: 963020 - DNA, 25 bp, Mus musculus
tttaacgtttgggtgccaagaagtg

SEQ ID NO: 963021 - DNA, 25 bp, Mus musculus
tttaactcaagcaggctaacagttt

SEQ ID NO: 963022 - DNA, 25 bp, Mus musculus
tttaactcaagctggctaacagttt

SEQ ID NO: 963023 - DNA, 25 bp, Mus musculus
tttaactccaaaatttgcatgggaa

SEQ ID NO: 963024 - DNA, 25 bp, Mus musculus
tttaactccaaattttgcatgggaa

SEQ ID NO: 963025 - DNA, 25 bp, Mus musculus
tttaactccatacggctggtttgct

SEQ ID NO: 963026 - DNA, 25 bp, Mus musculus
tttaactccatagggctggtttgct

SEQ ID NO: 963027 - DNA, 25 bp, Mus musculus
tttaactccatcacaagctccaaat

SEQ ID NO: 963028 - DNA, 25 bp, Mus musculus
tttaactccatctcaagctccaaat

SEQ ID NO: 963029 - DNA, 25 bp, Mus musculus
tttaactccgcactccatatagctg

SEQ ID NO: 963030 - DNA, 25 bp, Mus musculus
tttaactccgcagtccatatagctg

SEQ ID NO: 963031 - DNA, 25 bp, Mus musculus
tttaactccggcattggtctcaaag

SEQ ID NO: 963032 - DNA, 25 bp, Mus musculus
tttaactccggctttggtctcaaag

SEQ ID NO: 963033 - DNA, 25 bp, Mus musculus
tttaactcgcaacatttctatcctc

SEQ ID NO: 963034 - DNA, 25 bp, Mus musculus
tttaactcgcaagatttctatcctc

SEQ ID NO: 963035 - DNA, 25 bp, Mus musculus
tttaactcggaactattgtctgacc

SEQ ID NO: 963036 - DNA, 25 bp, Mus musculus
tttaactcggaagtattgtctgacc

SEQ ID NO: 963037 - DNA, 25 bp, Mus musculus
tttaactcgttccaatatgccttat

SEQ ID NO: 963038 - DNA, 25 bp, Mus musculus
tttaactcgttcgaatatgccttat

SEQ ID NO: 963039 - DNA, 25 bp, Mus musculus
tttaactctaagagactgtctgcct

SEQ ID NO: 963040 - DNA, 25 bp, Mus musculus
tttaactctaagtgactgtctgcct

SEQ ID NO: 963041 - DNA, 25 bp, Mus musculus
tttaactctaggacccaaggtatct

SEQ ID NO: 963042 - DNA, 25 bp, Mus musculus
tttaactctaggtcccaaggtatct

SEQ ID NO: 963043 - DNA, 25 bp, Mus musculus
tttaactctatacgtgctgacgggt

SEQ ID NO: 963044 - DNA, 25 bp, Mus musculus
tttaactctataggtgctgacgggt

SEQ ID NO: 963045 - DNA, 25 bp, Mus musculus
tttaactctcttagttctgaacatc

SEQ ID NO: 963046 - DNA, 25 bp, Mus musculus
tttaactctctttgttctgaacatc

SEQ ID NO: 963047 - DNA, 25 bp, Mus musculus
tttaactcttccactatcatcttta

SEQ ID NO: 963048 - DNA, 25 bp, Mus musculus
tttaactcttcctctatcatcttta

SEQ ID NO: 963049 - DNA, 25 bp, Mus musculus
tttaactcttgcatctgtcacttcc

SEQ ID NO: 963050 - DNA, 25 bp, Mus musculus
tttaactcttgcttctgtcacttcc

SEQ ID NO: 963051 - DNA, 25 bp, Mus musculus
tttaactcttggctgcagattgact

SEQ ID NO: 963052 - DNA, 25 bp, Mus musculus
tttaactcttgggtgcagattgact

SEQ ID NO: 963053 - DNA, 25 bp, Mus musculus
tttaactgacaacccatctgcgtgg

SEQ ID NO: 963054 - DNA, 25 bp, Mus musculus
tttaactgacaagccatctgcgtgg

SEQ ID NO: 963055 - DNA, 25 bp, Mus musculus
tttaactgagtaaagtaacacggtt

SEQ ID NO: 963056 - DNA, 25 bp, Mus musculus
tttaactgagtatagtaacacggtt

SEQ ID NO: 963057 - DNA, 25 bp, Mus musculus
tttaactgcagtcaagggtccccgt

SEQ ID NO: 963058 - DNA, 25 bp, Mus musculus
tttaactgcagtgaagggtccccgt

SEQ ID NO: 963059 - DNA, 25 bp, Mus musculus
tttaactggaacagttctctaactc

SEQ ID NO: 963060 - DNA, 25 bp, Mus musculus
tttaactggaactgttctctaactc

SEQ ID NO: 963061 - DNA, 25 bp, Mus musculus
tttaactggaagcttgccgactctt

SEQ ID NO: 963062 - DNA, 25 bp, Mus musculus
tttaactggaaggttgccgactctt

SEQ ID NO: 963063 - DNA, 25 bp, Mus musculus
tttaactggtggcagaaaactctgt

SEQ ID NO: 963064 - DNA, 25 bp, Mus musculus
tttaactggtgggagaaaactctgt

SEQ ID NO: 963065 - DNA, 25 bp, Mus musculus
tttaactgtgtacccattgactggc

SEQ ID NO: 963066 - DNA, 25 bp, Mus musculus
tttaactgtgtagccattgactggc

SEQ ID NO: 963067 - DNA, 25 bp, Mus musculus
tttaactgttatcacgaagtctgcg

SEQ ID NO: 963068 - DNA, 25 bp, Mus musculus
tttaactgttatgacgaagtctgcg

SEQ ID NO: 963069 - DNA, 25 bp, Mus musculus
tttaacttacaaaccactgccattg

SEQ ID NO: 963070 - DNA, 25 bp, Mus musculus
tttaacttacaatccactgccattg

SEQ ID NO: 963071 - DNA, 25 bp, Mus musculus
tttaacttagctcactcccagtttc

SEQ ID NO: 963072 - DNA, 25 bp, Mus musculus
tttaacttagctgactcccagtttc

SEQ ID NO: 963073 - DNA, 25 bp, Mus musculus
tttaacttcaaaacccatggctgcc

SEQ ID NO: 963074 - DNA, 25 bp, Mus musculus
tttaacttcaaatcccatggctgcc

SEQ ID NO: 963075 - DNA, 25 bp, Mus musculus
tttaacttcacaaataaatggtatc

SEQ ID NO: 963076 - DNA, 25 bp, Mus musculus
tttaacttcacatataaatggtatc

SEQ ID NO: 963077 - DNA, 25 bp, Mus musculus
tttaacttcattctggctaccaatt

SEQ ID NO: 963078 - DNA, 25 bp, Mus musculus
tttaacttcattgtggctaccaatt

SEQ ID NO: 963079 - DNA, 25 bp, Mus musculus
tttaacttcctgcattaaccctggg

SEQ ID NO: 963080 - DNA, 25 bp, Mus musculus
tttaacttcctggattaaccctggg

SEQ ID NO: 963081 - DNA, 25 bp, Mus musculus
tttaacttcgaacccggctcaggct

SEQ ID NO: 963082 - DNA, 25 bp, Mus musculus
tttaacttcgaagccggctcaggct

SEQ ID NO: 963083 - DNA, 25 bp, Mus musculus
tttaacttctttcggtcagtgcagt

SEQ ID NO: 963084 - DNA, 25 bp, Mus musculus
tttaacttctttgggtcagtgcagt

SEQ ID NO: 963085 - DNA, 25 bp, Mus musculus
tttaacttgactctagctgcctata

SEQ ID NO: 963086 - DNA, 25 bp, Mus musculus
tttaacttgactgtagctgcctata

SEQ ID NO: 963087 - DNA, 25 bp, Mus musculus
tttaacttgatcatggtcagctctg

SEQ ID NO: 963088 - DNA, 25 bp, Mus musculus
tttaacttgatcttggtcagctctg

SEQ ID NO: 963089 - DNA, 25 bp, Mus musculus
tttaacttggcccagctggcagagc

SEQ ID NO: 963090 - DNA, 25 bp, Mus musculus
tttaacttggccgagctggcagagc

SEQ ID NO: 963091 - DNA, 25 bp, Mus musculus
tttaacttgtggactatgtaaacac

SEQ ID NO: 963092 - DNA, 25 bp, Mus musculus
tttaacttgtggtctatgtaaacac

SEQ ID NO: 963093 - DNA, 25 bp, Mus musculus
tttaactttctgagggacttccaag

SEQ ID NO: 963094 - DNA, 25 bp, Mus musculus
tttaactttctgtgggacttccaag

SEQ ID NO: 963095 - DNA, 25 bp, Mus musculus
tttaactttgaaacgccgatggcct

SEQ ID NO: 963096 - DNA, 25 bp, Mus musculus
tttaactttgaatcgccgatggcct

SEQ ID NO: 963097 - DNA, 25 bp, Mus musculus
tttaacttttatctccttggcgtca

SEQ ID NO: 963098 - DNA, 25 bp, Mus musculus
tttaacttttatgtccttggcgtca

SEQ ID NO: 963099 - DNA, 25 bp, Mus musculus
tttaacttttcaaccctatcagtag

SEQ ID NO: 963100 - DNA, 25 bp, Mus musculus
tttaacttttcatccctatcagtag

SEQ ID NO: 963101 - DNA, 25 bp, Mus musculus
tttaagaaacaccaggcaaccctgc

SEQ ID NO: 963102 - DNA, 25 bp, Mus musculus
tttaagaaacacgaggcaaccctgc

SEQ ID NO: 963103 - DNA, 25 bp, Mus musculus
tttaagaaaccaatgctttatgctg

SEQ ID NO: 963104 - DNA, 25 bp, Mus musculus
tttaagaaaccattgctttatgctg

SEQ ID NO: 963105 - DNA, 25 bp, Mus musculus
tttaagaacaaacccaagactcaag

SEQ ID NO: 963106 - DNA, 25 bp, Mus musculus
tttaagaacaaagccaagactcaag

SEQ ID NO: 963107 - DNA, 25 bp, Mus musculus
tttaagaaccccagtgtagcttcca

SEQ ID NO: 963108 - DNA, 25 bp, Mus musculus
tttaagaacccctgtgtagcttcca

SEQ ID NO: 963109 - DNA, 25 bp, Mus musculus
tttaagaagactacggccctgatcc

SEQ ID NO: 963110 - DNA, 25 bp, Mus musculus
tttaagaagacttcggccctgatcc

SEQ ID NO: 963111 - DNA, 25 bp, Mus musculus
tttaagaataagcaagtctcgcttc

SEQ ID NO: 963112 - DNA, 25 bp, Mus musculus
tttaagaataaggaagtctcgcttc

SEQ ID NO: 963113 - DNA, 25 bp, Mus musculus
tttaagaatgtaaacaccgctgttc

SEQ ID NO: 963114 - DNA, 25 bp, Mus musculus
tttaagaatgtatacaccgctgttc

SEQ ID NO: 963115 - DNA, 25 bp, Mus musculus
tttaagacacacattgctgggtatt

SEQ ID NO: 963116 - DNA, 25 bp, Mus musculus
tttaagacacactttgctgggtatt

SEQ ID NO: 963117 - DNA, 25 bp, Mus musculus
tttaagacagtcacagccaggccca

SEQ ID NO: 963118 - DNA, 25 bp, Mus musculus
tttaagacagtctcagccaggccca

SEQ ID NO: 963119 - DNA, 25 bp, Mus musculus
tttaagacatttcaattatgacatg

SEQ ID NO: 963120 - DNA, 25 bp, Mus musculus
tttaagacatttgaattatgacatg

SEQ ID NO: 963121 - DNA, 25 bp, Mus musculus
tttaagactctcctcctacttcttt

SEQ ID NO: 963122 - DNA, 25 bp, Mus musculus
tttaagactctcgtcctacttcttt

SEQ ID NO: 963123 - DNA, 25 bp, Mus musculus
tttaagactgagacacctctgaccc

SEQ ID NO: 963124 - DNA, 25 bp, Mus musculus
tttaagactgagtcacctctgaccc

SEQ ID NO: 963125 - DNA, 25 bp, Mus musculus
tttaagactgctattcctccagcac

SEQ ID NO: 963126 - DNA, 25 bp, Mus musculus
tttaagactgcttttcctccagcac

SEQ ID NO: 963127 - DNA, 25 bp, Mus musculus
tttaagacttttcttatcagccatt

SEQ ID NO: 963128 - DNA, 25 bp, Mus musculus
tttaagacttttgttatcagccatt

SEQ ID NO: 963129 - DNA, 25 bp, Mus musculus
tttaagagctgaactcttccacctg

SEQ ID NO: 963130 - DNA, 25 bp, Mus musculus
tttaagagctgatctcttccacctg

SEQ ID NO: 963131 - DNA, 25 bp, Mus musculus
tttaagaggcttaataacacagtat

SEQ ID NO: 963132 - DNA, 25 bp, Mus musculus
tttaagaggctttataacacagtat

SEQ ID NO: 963133 - DNA, 25 bp, Mus musculus
tttaagagtgacctggagtcgccat

SEQ ID NO: 963134 - DNA, 25 bp, Mus musculus
tttaagagtgacgtggagtcgccat

SEQ ID NO: 963135 - DNA, 25 bp, Mus musculus
tttaagataccacgtgcccatctct

SEQ ID NO: 963136 - DNA, 25 bp, Mus musculus
tttaagataccaggtgcccatctct

SEQ ID NO: 963137 - DNA, 25 bp, Mus musculus
tttaagatagccatccagctcttgg

SEQ ID NO: 963138 - DNA, 25 bp, Mus musculus
tttaagatagccttccagctcttgg

SEQ ID NO: 963139 - DNA, 25 bp, Mus musculus
tttaagatgcttatcctatccttcc

SEQ ID NO: 963140 - DNA, 25 bp, Mus musculus
tttaagatgcttttcctatccttcc

SEQ ID NO: 963141 - DNA, 25 bp, Mus musculus
tttaagattgtcaggtggcacaccc

SEQ ID NO: 963142 - DNA, 25 bp, Mus musculus
tttaagattgtctggtggcacaccc

SEQ ID NO: 963143 - DNA, 25 bp, Mus musculus
tttaagatttggaggcagctgtaat

SEQ ID NO: 963144 - DNA, 25 bp, Mus musculus
tttaagatttggtggcagctgtaat

SEQ ID NO: 963145 - DNA, 25 bp, Mus musculus
tttaagcacgtgatggtgatgttaa

SEQ ID NO: 963146 - DNA, 25 bp, Mus musculus
tttaagcacgtgttggtgatgttaa

SEQ ID NO: 963147 - DNA, 25 bp, Mus musculus
tttaagcagctacaaaatcgggtct

SEQ ID NO: 963148 - DNA, 25 bp, Mus musculus
tttaagcagctagaaaatcgggtct

SEQ ID NO: 963149 - DNA, 25 bp, Mus musculus
tttaagcaggcgattatttctgcag

SEQ ID NO: 963150 - DNA, 25 bp, Mus musculus
tttaagcaggcgtttatttctgcag

SEQ ID NO: 963151 - DNA, 25 bp, Mus musculus
tttaagcatacaagaatgtccctct

SEQ ID NO: 963152 - DNA, 25 bp, Mus musculus
tttaagcatacatgaatgtccctct

SEQ ID NO: 963153 - DNA, 25 bp, Mus musculus
tttaagcatccaacctttccttgaa

SEQ ID NO: 963154 - DNA, 25 bp, Mus musculus
tttaagcatccatcctttccttgaa

SEQ ID NO: 963155 - DNA, 25 bp, Mus musculus
tttaagcatcttagttccctctatc

SEQ ID NO: 963156 - DNA, 25 bp, Mus musculus
tttaagcatctttgttccctctatc

SEQ ID NO: 963157 - DNA, 25 bp, Mus musculus
tttaagcatgttcagtggctcccct

SEQ ID NO: 963158 - DNA, 25 bp, Mus musculus
tttaagcatgttgagtggctcccct

SEQ ID NO: 963159 - DNA, 25 bp, Mus musculus
tttaagcattcaagatcctacaagt

SEQ ID NO: 963160 - DNA, 25 bp, Mus musculus
tttaagcattcatgatcctacaagt

SEQ ID NO: 963161 - DNA, 25 bp, Mus musculus
tttaagcatttcaagacccactccc

SEQ ID NO: 963162 - DNA, 25 bp, Mus musculus
tttaagcatttctagacccactccc

SEQ ID NO: 963163 - DNA, 25 bp, Mus musculus
tttaagccatcaccatctacctcaa

SEQ ID NO: 963164 - DNA, 25 bp, Mus musculus
tttaagccatcagcatctacctcaa

SEQ ID NO: 963165 - DNA, 25 bp, Mus musculus
tttaagcccagcctttagagagtgg

SEQ ID NO: 963166 - DNA, 25 bp, Mus musculus
tttaagcccagcgtttagagagtgg

SEQ ID NO: 963167 - DNA, 25 bp, Mus musculus
tttaagccctccaattacaagtatg

SEQ ID NO: 963168 - DNA, 25 bp, Mus musculus
tttaagccctcctattacaagtatg

SEQ ID NO: 963169 - DNA, 25 bp, Mus musculus
tttaagccctttctgaacatgccta

SEQ ID NO: 963170 - DNA, 25 bp, Mus musculus
tttaagccctttgtgaacatgccta

SEQ ID NO: 963171 - DNA, 25 bp, Mus musculus
tttaagcctagcaccctgctttctc

SEQ ID NO: 963172 - DNA, 25 bp, Mus musculus
tttaagcctagctccctgctttctc

SEQ ID NO: 963173 - DNA, 25 bp, Mus musculus
tttaagcctcgccagtgtgggcagc

SEQ ID NO: 963174 - DNA, 25 bp, Mus musculus
tttaagcctcgcgagtgtgggcagc

SEQ ID NO: 963175 - DNA, 25 bp, Mus musculus
tttaagcctctcctgcaagctcaag

SEQ ID NO: 963176 - DNA, 25 bp, Mus musculus
tttaagcctctcgtgcaagctcaag

SEQ ID NO: 963177 - DNA, 25 bp, Mus musculus
tttaagcggataacgggcacttcca

SEQ ID NO: 963178 - DNA, 25 bp, Mus musculus
tttaagcggatatcgggcacttcca

SEQ ID NO: 963179 - DNA, 25 bp, Mus musculus
tttaagcggcgcaggagtgaagact

SEQ ID NO: 963180 - DNA, 25 bp, Mus musculus
tttaagcggcgctggagtgaagact

SEQ ID NO: 963181 - DNA, 25 bp, Mus musculus
tttaagctaaaccagttagacactg

SEQ ID NO: 963182 - DNA, 25 bp, Mus musculus
tttaagctaaacgagttagacactg

SEQ ID NO: 963183 - DNA, 25 bp, Mus musculus
tttaagctacccaggatttactgag

SEQ ID NO: 963184 - DNA, 25 bp, Mus musculus
tttaagctaccctggatttactgag

SEQ ID NO: 963185 - DNA, 25 bp, Mus musculus
tttaagctcagcaattttgaacact

SEQ ID NO: 963186 - DNA, 25 bp, Mus musculus
tttaagctcagctattttgaacact

SEQ ID NO: 963187 - DNA, 25 bp, Mus musculus
tttaagctccaactgtgctgcaggg

SEQ ID NO: 963188 - DNA, 25 bp, Mus musculus
tttaagctccaagtgtgctgcaggg
